United States Patent 7,888,497 (BIOINFORMATICALLY DETECTABLE GROUP OF NOVEL REGULATORY OLIGONUCLEOTIDES AND USES THEREOF) - sequence listing, part 99

SEQ ID NO: 4186108 - DNA, 23 bp, Homo sapiens
ctccttcccttctctccttccct

SEQ ID NO: 4186109 - DNA, 16 bp, Homo sapiens
ctccttcttccctgtt

SEQ ID NO: 4186110 - DNA, 13 bp, Homo sapiens
ctccttcttgctt

SEQ ID NO: 4186111 - DNA, 14 bp, Homo sapiens
ctccttgctctgca

SEQ ID NO: 4186112 - DNA, 16 bp, Homo sapiens
ctcctttacctaccac

SEQ ID NO: 4186113 - DNA, 14 bp, Homo sapiens
ctcctttgcctctg

SEQ ID NO: 4186114 - DNA, 17 bp, Homo sapiens
ctcctttttctaccttt

SEQ ID NO: 4186115 - DNA, 16 bp, Homo sapiens
ctcgccacggggaggg

SEQ ID NO: 4186116 - DNA, 12 bp, Homo sapiens
ctcgccccaccc

SEQ ID NO: 4186117 - DNA, 18 bp, Homo sapiens
ctcgctgtcctttctaga

SEQ ID NO: 4186118 - DNA, 21 bp, Homo sapiens
ctcggcacctccccggcctct

SEQ ID NO: 4186119 - DNA, 21 bp, Homo sapiens
ctcgggaggctgagacaggag

SEQ ID NO: 4186120 - DNA, 12 bp, Homo sapiens
ctcgtaccagcc

SEQ ID NO: 4186121 - DNA, 14 bp, Homo sapiens
ctcgtaccagccag

SEQ ID NO: 4186122 - DNA, 15 bp, Homo sapiens
ctcgtaccagccagg

SEQ ID NO: 4186123 - DNA, 16 bp, Homo sapiens
ctcgtaccagccagga

SEQ ID NO: 4186124 - DNA, 17 bp, Homo sapiens
ctcgtggacacctgccc

SEQ ID NO: 4186125 - DNA, 19 bp, Homo sapiens
ctcgtggacacctgccctg

SEQ ID NO: 4186126 - DNA, 22 bp, Homo sapiens
ctcgtttgctctagtcttgctt

SEQ ID NO: 4186127 - DNA, 22 bp, Homo sapiens
ctctaacccccagtgccacaga

SEQ ID NO: 4186128 - DNA, 16 bp, Homo sapiens
ctctaactcctgccat

SEQ ID NO: 4186129 - DNA, 19 bp, Homo sapiens
ctctaagccactcttccaa

SEQ ID NO: 4186130 - DNA, 12 bp, Homo sapiens
ctctaagctgtg

SEQ ID NO: 4186131 - DNA, 15 bp, Homo sapiens
ctctaagctgtgtgc

SEQ ID NO: 4186132 - DNA, 17 bp, Homo sapiens
ctctaagctgtgtgcag

SEQ ID NO: 4186133 - DNA, 20 bp, Homo sapiens
ctctaagttatgtacgtata

SEQ ID NO: 4186134 - DNA, 18 bp, Homo sapiens
ctctaagttcaagaagac

SEQ ID NO: 4186135 - DNA, 18 bp, Homo sapiens
ctctacccggcccagaga

SEQ ID NO: 4186136 - DNA, 17 bp, Homo sapiens
ctctacctggatggatg

SEQ ID NO: 4186137 - DNA, 14 bp, Homo sapiens
ctctagtcttgctt

SEQ ID NO: 4186138 - DNA, 19 bp, Homo sapiens
ctctatggggcatcctctt

SEQ ID NO: 4186139 - DNA, 14 bp, Homo sapiens
ctctatttcacaat

SEQ ID NO: 4186140 - DNA, 10 bp, Homo sapiens
ctctcaatat

SEQ ID NO: 4186141 - DNA, 16 bp, Homo sapiens
ctctcaatatgcttac

SEQ ID NO: 4186142 - DNA, 18 bp, Homo sapiens
ctctcaatattcaataaa

SEQ ID NO: 4186143 - DNA, 19 bp, Homo sapiens
ctctcaatattcaataaag

SEQ ID NO: 4186144 - DNA, 21 bp, Homo sapiens
ctctcaatattcaataaagct

SEQ ID NO: 4186145 - DNA, 18 bp, Homo sapiens
ctctcaggggccagtgag

SEQ ID NO: 4186146 - DNA, 15 bp, Homo sapiens
ctctcccctccctct

SEQ ID NO: 4186147 - DNA, 15 bp, Homo sapiens
ctctcccctgccctg

SEQ ID NO: 4186148 - DNA, 21 bp, Homo sapiens
ctctcctaccccacctcatgc

SEQ ID NO: 4186149 - DNA, 16 bp, Homo sapiens
ctctcctcctctgtgc

SEQ ID NO: 4186150 - DNA, 20 bp, Homo sapiens
ctctcctcctctgtgctcct

SEQ ID NO: 4186151 - DNA, 13 bp, Homo sapiens
ctctccttccctc

SEQ ID NO: 4186152 - DNA, 16 bp, Homo sapiens
ctctcggaaggctggc

SEQ ID NO: 4186153 - DNA, 22 bp, Homo sapiens
ctctcggaaggctggctgggca

SEQ ID NO: 4186154 - DNA, 16 bp, Homo sapiens
ctctcgtaactggttt

SEQ ID NO: 4186155 - DNA, 19 bp, Homo sapiens
ctctctactcctacctcag

SEQ ID NO: 4186156 - DNA, 22 bp, Homo sapiens
ctctctctacccggcccagaga

SEQ ID NO: 4186157 - DNA, 13 bp, Homo sapiens
ctctctgctccag

SEQ ID NO: 4186158 - DNA, 14 bp, Homo sapiens
ctctctgctccaga

SEQ ID NO: 4186159 - DNA, 15 bp, Homo sapiens
ctctctgctccagag

SEQ ID NO: 4186160 - DNA, 16 bp, Homo sapiens
ctctctgctccagaga

SEQ ID NO: 4186161 - DNA, 12 bp, Homo sapiens
ctctctgctgag

SEQ ID NO: 4186162 - DNA, 19 bp, Homo sapiens
ctctctgtacaaaaacaaa

SEQ ID NO: 4186163 - DNA, 16 bp, Homo sapiens
ctctgactcaaactcc

SEQ ID NO: 4186164 - DNA, 19 bp, Homo sapiens
ctctgaggctctttctggg

SEQ ID NO: 4186165 - DNA, 17 bp, Homo sapiens
ctctgagtgttttatga

SEQ ID NO: 4186166 - DNA, 17 bp, Homo sapiens
ctctgatacccagagca

SEQ ID NO: 4186167 - DNA, 17 bp, Homo sapiens
ctctgatccttcttcct

SEQ ID NO: 4186168 - DNA, 14 bp, Homo sapiens
ctctgcaggcacct

SEQ ID NO: 4186169 - DNA, 15 bp, Homo sapiens
ctctgccccagaggc

SEQ ID NO: 4186170 - DNA, 20 bp, Homo sapiens
ctctgccccagaggcctctc

SEQ ID NO: 4186171 - DNA, 22 bp, Homo sapiens
ctctgccccagaggcctctctc

SEQ ID NO: 4186172 - DNA, 12 bp, Homo sapiens
ctctgccccagc

SEQ ID NO: 4186173 - DNA, 16 bp, Homo sapiens
ctctgccccagctctg

SEQ ID NO: 4186174 - DNA, 23 bp, Homo sapiens
ctctgcctggaggatccctccat

SEQ ID NO: 4186175 - DNA, 19 bp, Homo sapiens
ctctgcggtggtgccagag

SEQ ID NO: 4186176 - DNA, 23 bp, Homo sapiens
ctctgctatatgccttaagccaa

SEQ ID NO: 4186177 - DNA, 13 bp, Homo sapiens
ctctgctccagag

SEQ ID NO: 4186178 - DNA, 15 bp, Homo sapiens
ctctgctgccatggc

SEQ ID NO: 4186179 - DNA, 13 bp, Homo sapiens
ctctgctgctccc

SEQ ID NO: 4186180 - DNA, 17 bp, Homo sapiens
ctctgctttctcctgta

SEQ ID NO: 4186181 - DNA, 20 bp, Homo sapiens
ctctgctttctcctgtagca

SEQ ID NO: 4186182 - DNA, 19 bp, Homo sapiens
ctctggaaaatgtgaccca

SEQ ID NO: 4186183 - DNA, 15 bp, Homo sapiens
ctctggcttagaaat

SEQ ID NO: 4186184 - DNA, 16 bp, Homo sapiens
ctctggcttagaaatt

SEQ ID NO: 4186185 - DNA, 17 bp, Homo sapiens
ctctgggccaagactcc

SEQ ID NO: 4186186 - DNA, 15 bp, Homo sapiens
ctctgtcaatgaaaa

SEQ ID NO: 4186187 - DNA, 13 bp, Homo sapiens
ctctgtccactct

SEQ ID NO: 4186188 - DNA, 23 bp, Homo sapiens
ctctgtgacctgccccgcccagc

SEQ ID NO: 4186189 - DNA, 10 bp, Homo sapiens
ctctgtgctc

SEQ ID NO: 4186190 - DNA, 15 bp, Homo sapiens
ctctgtgtccgtctg

SEQ ID NO: 4186191 - DNA, 16 bp, Homo sapiens
ctctgtttctccttct

SEQ ID NO: 4186192 - DNA, 20 bp, Homo sapiens
ctcttaaagctgcctgtagt

SEQ ID NO: 4186193 - DNA, 20 bp, Homo sapiens
ctcttaaattatatatttat

SEQ ID NO: 4186194 - DNA, 15 bp, Homo sapiens
ctcttcaaatgcctg

SEQ ID NO: 4186195 - DNA, 13 bp, Homo sapiens
ctcttcactcagc

SEQ ID NO: 4186196 - DNA, 17 bp, Homo sapiens
ctcttcactcagccaca

SEQ ID NO: 4186197 - DNA, 18 bp, Homo sapiens
ctcttcactcagccacac

SEQ ID NO: 4186198 - DNA, 20 bp, Homo sapiens
ctcttcactcagccacaccc

SEQ ID NO: 4186199 - DNA, 21 bp, Homo sapiens
ctcttcagcagcatctactct

SEQ ID NO: 4186200 - DNA, 18 bp, Homo sapiens
ctcttcagggtgagtgaa

SEQ ID NO: 4186201 - DNA, 13 bp, Homo sapiens
ctcttcatacttt

SEQ ID NO: 4186202 - DNA, 19 bp, Homo sapiens
ctcttcatactttttttca

SEQ ID NO: 4186203 - DNA, 14 bp, Homo sapiens
ctcttccctctgat

SEQ ID NO: 4186204 - DNA, 16 bp, Homo sapiens
ctcttccctctgattt

SEQ ID NO: 4186205 - DNA, 13 bp, Homo sapiens
ctcttccttcccc

SEQ ID NO: 4186206 - DNA, 16 bp, Homo sapiens
ctcttgaattattttg

SEQ ID NO: 4186207 - DNA, 13 bp, Homo sapiens
ctcttggcctctg

SEQ ID NO: 4186208 - DNA, 21 bp, Homo sapiens
ctctttatgcttgcaaaaact

SEQ ID NO: 4186209 - DNA, 19 bp, Homo sapiens
ctctttgccttgatgttgt

SEQ ID NO: 4186210 - DNA, 17 bp, Homo sapiens
ctctttggggtcagcca

SEQ ID NO: 4186211 - DNA, 19 bp, Homo sapiens
ctctttggggtcagccagg

SEQ ID NO: 4186212 - DNA, 20 bp, Homo sapiens
ctctttggggtcagccaggg

SEQ ID NO: 4186213 - DNA, 14 bp, Homo sapiens
ctcttttccactcc

SEQ ID NO: 4186214 - DNA, 19 bp, Homo sapiens
ctcttttccactccaagat

SEQ ID NO: 4186215 - DNA, 20 bp, Homo sapiens
ctgaaaaaaaaaaagaagaa

SEQ ID NO: 4186216 - DNA, 15 bp, Homo sapiens
ctgaaaaaaagttta

SEQ ID NO: 4186217 - DNA, 15 bp, Homo sapiens
ctgaaaatagcagga

SEQ ID NO: 4186218 - DNA, 15 bp, Homo sapiens
ctgaaaatctaatat

SEQ ID NO: 4186219 - DNA, 17 bp, Homo sapiens
ctgaaaattatttaaac

SEQ ID NO: 4186220 - DNA, 19 bp, Homo sapiens
ctgaaattggtgggaagca

SEQ ID NO: 4186221 - DNA, 21 bp, Homo sapiens
ctgaacatttgctttgttttc

SEQ ID NO: 4186222 - DNA, 13 bp, Homo sapiens
ctgaactgttaca

SEQ ID NO: 4186223 - DNA, 18 bp, Homo sapiens
ctgaacttattacctaat

SEQ ID NO: 4186224 - DNA, 16 bp, Homo sapiens
ctgaagaggcaagaga

SEQ ID NO: 4186225 - DNA, 22 bp, Homo sapiens
ctgaaggaataggcaaaatgtt

SEQ ID NO: 4186226 - DNA, 16 bp, Homo sapiens
ctgaaggagattttcc

SEQ ID NO: 4186227 - DNA, 21 bp, Homo sapiens
ctgaagtcaaaccttaagata

SEQ ID NO: 4186228 - DNA, 17 bp, Homo sapiens
ctgaataggaaaatgta

SEQ ID NO: 4186229 - DNA, 21 bp, Homo sapiens
ctgaataggaaaatgtacata

SEQ ID NO: 4186230 - DNA, 18 bp, Homo sapiens
ctgaatgacctgcagtca

SEQ ID NO: 4186231 - DNA, 21 bp, Homo sapiens
ctgaatgacctgcagtcaggg

SEQ ID NO: 4186232 - DNA, 15 bp, Homo sapiens
ctgaatggtccaggg

SEQ ID NO: 4186233 - DNA, 16 bp, Homo sapiens
ctgaatggtccagggt

SEQ ID NO: 4186234 - DNA, 18 bp, Homo sapiens
ctgaatggtccagggttg

SEQ ID NO: 4186235 - DNA, 16 bp, Homo sapiens
ctgaatgtttattcct

SEQ ID NO: 4186236 - DNA, 18 bp, Homo sapiens
ctgaatgtttattccttg

SEQ ID NO: 4186237 - DNA, 19 bp, Homo sapiens
ctgaatgtttattccttga

SEQ ID NO: 4186238 - DNA, 14 bp, Homo sapiens
ctgaattaagttat

SEQ ID NO: 4186239 - DNA, 21 bp, Homo sapiens
ctgaatttttaaacaagtatt

SEQ ID NO: 4186240 - DNA, 22 bp, Homo sapiens
ctgaatttttaaacaagtattt

SEQ ID NO: 4186241 - DNA, 17 bp, Homo sapiens
ctgacaagataaaggaa

SEQ ID NO: 4186242 - DNA, 13 bp, Homo sapiens
ctgacatggcttt

SEQ ID NO: 4186243 - DNA, 13 bp, Homo sapiens
ctgacccagtgag

SEQ ID NO: 4186244 - DNA, 14 bp, Homo sapiens
ctgacccagtgaga

SEQ ID NO: 4186245 - DNA, 20 bp, Homo sapiens
ctgaccccaaagagcctgga

SEQ ID NO: 4186246 - DNA, 18 bp, Homo sapiens
ctgaccctccaccgcaga

SEQ ID NO: 4186247 - DNA, 19 bp, Homo sapiens
ctgacctgtttttgtgttt

SEQ ID NO: 4186248 - DNA, 21 bp, Homo sapiens
ctgacgacactgaagaatcaa

SEQ ID NO: 4186249 - DNA, 21 bp, Homo sapiens
ctgacggaagccaacttggct

SEQ ID NO: 4186250 - DNA, 19 bp, Homo sapiens
ctgactcctctaagccact

SEQ ID NO: 4186251 - DNA, 13 bp, Homo sapiens
ctgactctctgtg

SEQ ID NO: 4186252 - DNA, 22 bp, Homo sapiens
ctgactggtgctataggctgga

SEQ ID NO: 4186253 - DNA, 23 bp, Homo sapiens
ctgacttctttgtggtttcaaat

SEQ ID NO: 4186254 - DNA, 20 bp, Homo sapiens
ctgagacctgacaagcactg

SEQ ID NO: 4186255 - DNA, 21 bp, Homo sapiens
ctgagactttcagtgcactgt

SEQ ID NO: 4186256 - DNA, 18 bp, Homo sapiens
ctgagagacttttaatca

SEQ ID NO: 4186257 - DNA, 18 bp, Homo sapiens
ctgagatcacaccactgc

SEQ ID NO: 4186258 - DNA, 19 bp, Homo sapiens
ctgagatctccctccaggg

SEQ ID NO: 4186259 - DNA, 17 bp, Homo sapiens
ctgagcaacctcttcag

SEQ ID NO: 4186260 - DNA, 20 bp, Homo sapiens
ctgagcaacctcttcagctg

SEQ ID NO: 4186261 - DNA, 23 bp, Homo sapiens
ctgagcaacctcttcagctggga

SEQ ID NO: 4186262 - DNA, 14 bp, Homo sapiens
ctgagcaagagctg

SEQ ID NO: 4186263 - DNA, 16 bp, Homo sapiens
ctgagcaagagctggc

SEQ ID NO: 4186264 - DNA, 16 bp, Homo sapiens
ctgagcacctgcttca

SEQ ID NO: 4186265 - DNA, 17 bp, Homo sapiens
ctgagcacctgcttcat

SEQ ID NO: 4186266 - DNA, 14 bp, Homo sapiens
ctgagcagcccagc

SEQ ID NO: 4186267 - DNA, 18 bp, Homo sapiens
ctgagcagcccagcacaa

SEQ ID NO: 4186268 - DNA, 15 bp, Homo sapiens
ctgagccctggcagg

SEQ ID NO: 4186269 - DNA, 16 bp, Homo sapiens
ctgagcggaggctcgg

SEQ ID NO: 4186270 - DNA, 12 bp, Homo sapiens
ctgagctgggct

SEQ ID NO: 4186271 - DNA, 14 bp, Homo sapiens
ctgagcttggccct

SEQ ID NO: 4186272 - DNA, 17 bp, Homo sapiens
ctgagcttggccctatt

SEQ ID NO: 4186273 - DNA, 14 bp, Homo sapiens
ctgaggcaggagaa

SEQ ID NO: 4186274 - DNA, 17 bp, Homo sapiens
ctgaggctcctgtgcta

SEQ ID NO: 4186275 - DNA, 20 bp, Homo sapiens
ctgaggctcctgtgctactt

SEQ ID NO: 4186276 - DNA, 22 bp, Homo sapiens
ctgaggggaggatcactggagc

SEQ ID NO: 4186277 - DNA, 15 bp, Homo sapiens
ctgaggggcagggag

SEQ ID NO: 4186278 - DNA, 18 bp, Homo sapiens
ctgaggggcagggagagc

SEQ ID NO: 4186279 - DNA, 16 bp, Homo sapiens
ctgaggggggccgtgc

SEQ ID NO: 4186280 - DNA, 21 bp, Homo sapiens
ctgaggggggccgtgcccagg

SEQ ID NO: 4186281 - DNA, 14 bp, Homo sapiens
ctgagtgcactcct

SEQ ID NO: 4186282 - DNA, 16 bp, Homo sapiens
ctgagtgcactcctgg

SEQ ID NO: 4186283 - DNA, 18 bp, Homo sapiens
ctgagtgtgggcttctga

SEQ ID NO: 4186284 - DNA, 11 bp, Homo sapiens
ctgagttttcc

SEQ ID NO: 4186285 - DNA, 14 bp, Homo sapiens
ctgatagagtgatt

SEQ ID NO: 4186286 - DNA, 15 bp, Homo sapiens
ctgatcaaggcctta

SEQ ID NO: 4186287 - DNA, 22 bp, Homo sapiens
ctgatcattacatggctgtggt

SEQ ID NO: 4186288 - DNA, 19 bp, Homo sapiens
ctgatcattctgttttttc

SEQ ID NO: 4186289 - DNA, 19 bp, Homo sapiens
ctgatccggctgctcctcc

SEQ ID NO: 4186290 - DNA, 14 bp, Homo sapiens
ctgatgaaaatgaa

SEQ ID NO: 4186291 - DNA, 15 bp, Homo sapiens
ctgatgacagagcga

SEQ ID NO: 4186292 - DNA, 17 bp, Homo sapiens
ctgatgacagagcgaga

SEQ ID NO: 4186293 - DNA, 13 bp, Homo sapiens
ctgatgagcaaga

SEQ ID NO: 4186294 - DNA, 14 bp, Homo sapiens
ctgatgagcaagaa

SEQ ID NO: 4186295 - DNA, 20 bp, Homo sapiens
ctgatgggtcccaaaagctt

SEQ ID NO: 4186296 - DNA, 16 bp, Homo sapiens
ctgattacctgccaat

SEQ ID NO: 4186297 - DNA, 23 bp, Homo sapiens
ctgattcagcctggccatcccca

SEQ ID NO: 4186298 - DNA, 14 bp, Homo sapiens
ctgcaagcagggct

SEQ ID NO: 4186299 - DNA, 18 bp, Homo sapiens
ctgcaagcagggctctgc

SEQ ID NO: 4186300 - DNA, 17 bp, Homo sapiens
ctgcaatctccagggct

SEQ ID NO: 4186301 - DNA, 16 bp, Homo sapiens
ctgcacacagctaggc

SEQ ID NO: 4186302 - DNA, 16 bp, Homo sapiens
ctgcacctgccagcct

SEQ ID NO: 4186303 - DNA, 18 bp, Homo sapiens
ctgcacctgccagcctgg

SEQ ID NO: 4186304 - DNA, 14 bp, Homo sapiens
ctgcacctgcttct

SEQ ID NO: 4186305 - DNA, 15 bp, Homo sapiens
ctgcacctgcttctc

SEQ ID NO: 4186306 - DNA, 18 bp, Homo sapiens
ctgcacctgcttctcagc

SEQ ID NO: 4186307 - DNA, 13 bp, Homo sapiens
ctgcactccagaa

SEQ ID NO: 4186308 - DNA, 14 bp, Homo sapiens
ctgcactccagaat

SEQ ID NO: 4186309 - DNA, 15 bp, Homo sapiens
ctgcactccagcctg

SEQ ID NO: 4186310 - DNA, 16 bp, Homo sapiens
ctgcactccagcctgg

SEQ ID NO: 4186311 - DNA, 19 bp, Homo sapiens
ctgcactccagcctgggcg

SEQ ID NO: 4186312 - DNA, 18 bp, Homo sapiens
ctgcactccagcctgggg

SEQ ID NO: 4186313 - DNA, 14 bp, Homo sapiens
ctgcactgccctcc

SEQ ID NO: 4186314 - DNA, 22 bp, Homo sapiens
ctgcagaaagcccttcaacttc

SEQ ID NO: 4186315 - DNA, 13 bp, Homo sapiens
ctgcagaggacag

SEQ ID NO: 4186316 - DNA, 19 bp, Homo sapiens
ctgcagaggacagagctgg

SEQ ID NO: 4186317 - DNA, 23 bp, Homo sapiens
ctgcagaggacagagctggctgt

SEQ ID NO: 4186318 - DNA, 22 bp, Homo sapiens
ctgcagaggggaaagacttcca

SEQ ID NO: 4186319 - DNA, 19 bp, Homo sapiens
ctgcagaggggctttctgg

SEQ ID NO: 4186320 - DNA, 20 bp, Homo sapiens
ctgcagaggggctttctgga

SEQ ID NO: 4186321 - DNA, 14 bp, Homo sapiens
ctgcagagtggtga

SEQ ID NO: 4186322 - DNA, 16 bp, Homo sapiens
ctgcagatcttccgtg

SEQ ID NO: 4186323 - DNA, 18 bp, Homo sapiens
ctgcagatcttccgtggt

SEQ ID NO: 4186324 - DNA, 12 bp, Homo sapiens
ctgcagcaactc

SEQ ID NO: 4186325 - DNA, 14 bp, Homo sapiens
ctgcagcaactccc

SEQ ID NO: 4186326 - DNA, 12 bp, Homo sapiens
ctgcagcacttt

SEQ ID NO: 4186327 - DNA, 20 bp, Homo sapiens
ctgcagcctggtagaattgg

SEQ ID NO: 4186328 - DNA, 20 bp, Homo sapiens
ctgcaggcaccttagtggct

SEQ ID NO: 4186329 - DNA, 15 bp, Homo sapiens
ctgcaggccaagagc

SEQ ID NO: 4186330 - DNA, 19 bp, Homo sapiens
ctgcaggccaagagcagag

SEQ ID NO: 4186331 - DNA, 21 bp, Homo sapiens
ctgcaggccaagagcagaggc

SEQ ID NO: 4186332 - DNA, 23 bp, Homo sapiens
ctgcaggccaagagcagaggcag

SEQ ID NO: 4186333 - DNA, 14 bp, Homo sapiens
ctgcagggctgctg

SEQ ID NO: 4186334 - DNA, 15 bp, Homo sapiens
ctgcagggctgctgt

SEQ ID NO: 4186335 - DNA, 16 bp, Homo sapiens
ctgcagtaacactggc

SEQ ID NO: 4186336 - DNA, 17 bp, Homo sapiens
ctgcagtaacactggcc

SEQ ID NO: 4186337 - DNA, 23 bp, Homo sapiens
ctgcagtaacactggccttccct

SEQ ID NO: 4186338 - DNA, 15 bp, Homo sapiens
ctgcagtgaggggag

SEQ ID NO: 4186339 - DNA, 16 bp, Homo sapiens
ctgcagtgaggggaga

SEQ ID NO: 4186340 - DNA, 13 bp, Homo sapiens
ctgcattgcctga

SEQ ID NO: 4186341 - DNA, 19 bp, Homo sapiens
ctgccaagtctcagaagag

SEQ ID NO: 4186342 - DNA, 17 bp, Homo sapiens
ctgccaccatcctgctg

SEQ ID NO: 4186343 - DNA, 19 bp, Homo sapiens
ctgccaccatcctgctgct

SEQ ID NO: 4186344 - DNA, 14 bp, Homo sapiens
ctgccagcctgagc

SEQ ID NO: 4186345 - DNA, 20 bp, Homo sapiens
ctgccagcctgagcggaggc

SEQ ID NO: 4186346 - DNA, 12 bp, Homo sapiens
ctgccagcctgg

SEQ ID NO: 4186347 - DNA, 13 bp, Homo sapiens
ctgccagcctggc

SEQ ID NO: 4186348 - DNA, 16 bp, Homo sapiens
ctgccagcctggcttc

SEQ ID NO: 4186349 - DNA, 14 bp, Homo sapiens
ctgccatggcgtgt

SEQ ID NO: 4186350 - DNA, 19 bp, Homo sapiens
ctgccattgggaccctcca

SEQ ID NO: 4186351 - DNA, 21 bp, Homo sapiens
ctgccattgggaccctccagt

SEQ ID NO: 4186352 - DNA, 21 bp, Homo sapiens
ctgccatttgcaccctccgcc

SEQ ID NO: 4186353 - DNA, 14 bp, Homo sapiens
ctgcccaggcactg

SEQ ID NO: 4186354 - DNA, 12 bp, Homo sapiens
ctgccccaccct

SEQ ID NO: 4186355 - DNA, 16 bp, Homo sapiens
ctgccccagctctggc

SEQ ID NO: 4186356 - DNA, 19 bp, Homo sapiens
ctgccccagctctggcttc

SEQ ID NO: 4186357 - DNA, 11 bp, Homo sapiens
ctgccccccgc

SEQ ID NO: 4186358 - DNA, 12 bp, Homo sapiens
ctgccccctggt

SEQ ID NO: 4186359 - DNA, 17 bp, Homo sapiens
ctgccccgggtgcctca

SEQ ID NO: 4186360 - DNA, 13 bp, Homo sapiens
ctgcccctgcacc

SEQ ID NO: 4186361 - DNA, 14 bp, Homo sapiens
ctgcccgcagagcc

SEQ ID NO: 4186362 - DNA, 12 bp, Homo sapiens
ctgccctcaggg

SEQ ID NO: 4186363 - DNA, 13 bp, Homo sapiens
ctgccctcaggga

SEQ ID NO: 4186364 - DNA, 16 bp, Homo sapiens
ctgccctccgcccttc

SEQ ID NO: 4186365 - DNA, 14 bp, Homo sapiens
ctgccctgccacct

SEQ ID NO: 4186366 - DNA, 13 bp, Homo sapiens
ctgccctgccact

SEQ ID NO: 4186367 - DNA, 21 bp, Homo sapiens
ctgccctgctgccgcctccca

SEQ ID NO: 4186368 - DNA, 14 bp, Homo sapiens
ctgccgcctcccag

SEQ ID NO: 4186369 - DNA, 15 bp, Homo sapiens
ctgccgcctcccagc

SEQ ID NO: 4186370 - DNA, 19 bp, Homo sapiens
ctgcctatatatgtaaata

SEQ ID NO: 4186371 - DNA, 15 bp, Homo sapiens
ctgcctatccatcct

SEQ ID NO: 4186372 - DNA, 17 bp, Homo sapiens
ctgcctatccatcctgc

SEQ ID NO: 4186373 - DNA, 15 bp, Homo sapiens
ctgcctatcctctgt

SEQ ID NO: 4186374 - DNA, 16 bp, Homo sapiens
ctgcctatcctctgta

SEQ ID NO: 4186375 - DNA, 21 bp, Homo sapiens
ctgcctatcctctgtatatag

SEQ ID NO: 4186376 - DNA, 16 bp, Homo sapiens
ctgcctcagcctctca

SEQ ID NO: 4186377 - DNA, 17 bp, Homo sapiens
ctgcctctctgctccag

SEQ ID NO: 4186378 - DNA, 18 bp, Homo sapiens
ctgcctctctgctccaga

SEQ ID NO: 4186379 - DNA, 19 bp, Homo sapiens
ctgcctctctgctccagag

SEQ ID NO: 4186380 - DNA, 13 bp, Homo sapiens
ctgcctgtagtta

SEQ ID NO: 4186381 - DNA, 18 bp, Homo sapiens
ctgcctgtagttaggaaa

SEQ ID NO: 4186382 - DNA, 21 bp, Homo sapiens
ctgcctgtagttaggaaataa

SEQ ID NO: 4186383 - DNA, 18 bp, Homo sapiens
ctgcctgtgcatgacctg

SEQ ID NO: 4186384 - DNA, 16 bp, Homo sapiens
ctgcctgtggagacag

SEQ ID NO: 4186385 - DNA, 20 bp, Homo sapiens
ctgcctgtggagacagccct

SEQ ID NO: 4186386 - DNA, 20 bp, Homo sapiens
ctgccttgaagccactgaag

SEQ ID NO: 4186387 - DNA, 16 bp, Homo sapiens
ctgccttttgctgctg

SEQ ID NO: 4186388 - DNA, 17 bp, Homo sapiens
ctgcgaaggggccctgg

SEQ ID NO: 4186389 - DNA, 19 bp, Homo sapiens
ctgcgatcttcagagcagg

SEQ ID NO: 4186390 - DNA, 17 bp, Homo sapiens
ctgcgattttgcctgtg

SEQ ID NO: 4186391 - DNA, 13 bp, Homo sapiens
ctgcggcatccct

SEQ ID NO: 4186392 - DNA, 16 bp, Homo sapiens
ctgcggcatccctgtg

SEQ ID NO: 4186393 - DNA, 17 bp, Homo sapiens
ctgcgggatggtcctgg

SEQ ID NO: 4186394 - DNA, 20 bp, Homo sapiens
ctgcggtggtgccagaggtt

SEQ ID NO: 4186395 - DNA, 20 bp, Homo sapiens
ctgcgtcagaccagtactgg

SEQ ID NO: 4186396 - DNA, 15 bp, Homo sapiens
ctgctactgaggcag

SEQ ID NO: 4186397 - DNA, 15 bp, Homo sapiens
ctgctagagaagggg

SEQ ID NO: 4186398 - DNA, 19 bp, Homo sapiens
ctgctaggcgagtgccagg

SEQ ID NO: 4186399 - DNA, 23 bp, Homo sapiens
ctgctatattttcatgacttttc

SEQ ID NO: 4186400 - DNA, 18 bp, Homo sapiens
ctgctcccatctgcacta

SEQ ID NO: 4186401 - DNA, 23 bp, Homo sapiens
ctgctcctaaacccccgctccag

SEQ ID NO: 4186402 - DNA, 15 bp, Homo sapiens
ctgctcctccagccc

SEQ ID NO: 4186403 - DNA, 22 bp, Homo sapiens
ctgctgaagaggcaagagacag

SEQ ID NO: 4186404 - DNA, 20 bp, Homo sapiens
ctgctgagatacatacagaa

SEQ ID NO: 4186405 - DNA, 12 bp, Homo sapiens
ctgctgcactgc

SEQ ID NO: 4186406 - DNA, 16 bp, Homo sapiens
ctgctgcactgccctc

SEQ ID NO: 4186407 - DNA, 14 bp, Homo sapiens
ctgctgccagagaa

SEQ ID NO: 4186408 - DNA, 12 bp, Homo sapiens
ctgctgccaggc

SEQ ID NO: 4186409 - DNA, 19 bp, Homo sapiens
ctgctgccgcctcccagcc

SEQ ID NO: 4186410 - DNA, 22 bp, Homo sapiens
ctgctgcggccagcctgactag

SEQ ID NO: 4186411 - DNA, 20 bp, Homo sapiens
ctgctgcgtcagaccagtac

SEQ ID NO: 4186412 - DNA, 11 bp, Homo sapiens
ctgctgctccc

SEQ ID NO: 4186413 - DNA, 13 bp, Homo sapiens
ctgctgctgtgtt

SEQ ID NO: 4186414 - DNA, 16 bp, Homo sapiens
ctgctggctgacctgg

SEQ ID NO: 4186415 - DNA, 20 bp, Homo sapiens
ctgctggctgacctgggccc

SEQ ID NO: 4186416 - DNA, 12 bp, Homo sapiens
ctgctgtcagcc

SEQ ID NO: 4186417 - DNA, 14 bp, Homo sapiens
ctgctgtcagccaa

SEQ ID NO: 4186418 - DNA, 14 bp, Homo sapiens
ctgctgtggcccag

SEQ ID NO: 4186419 - DNA, 15 bp, Homo sapiens
ctgctgtggcccagt

SEQ ID NO: 4186420 - DNA, 18 bp, Homo sapiens
ctgcttctcctcccagcg

SEQ ID NO: 4186421 - DNA, 19 bp, Homo sapiens
ctgcttcttcatcttgaca

SEQ ID NO: 4186422 - DNA, 21 bp, Homo sapiens
ctgcttgatgggattctggac

SEQ ID NO: 4186423 - DNA, 17 bp, Homo sapiens
ctgcttggagctgagca

SEQ ID NO: 4186424 - DNA, 23 bp, Homo sapiens
ctgcttgggttcctttttcaact

SEQ ID NO: 4186425 - DNA, 17 bp, Homo sapiens
ctggaaaactcaggatt

SEQ ID NO: 4186426 - DNA, 14 bp, Homo sapiens
ctggaaaggctcag

SEQ ID NO: 4186427 - DNA, 17 bp, Homo sapiens
ctggaaaggctcagtct

SEQ ID NO: 4186428 - DNA, 10 bp, Homo sapiens
ctggaaataa

SEQ ID NO: 4186429 - DNA, 21 bp, Homo sapiens
ctggaacactagacaagccag

SEQ ID NO: 4186430 - DNA, 14 bp, Homo sapiens
ctggaagaaagcaa

SEQ ID NO: 4186431 - DNA, 12 bp, Homo sapiens
ctggaagaagag

SEQ ID NO: 4186432 - DNA, 13 bp, Homo sapiens
ctggaagaagagg

SEQ ID NO: 4186433 - DNA, 17 bp, Homo sapiens
ctggaagaagaggagga

SEQ ID NO: 4186434 - DNA, 23 bp, Homo sapiens
ctggaagtttctggtgccatttc

SEQ ID NO: 4186435 - DNA, 21 bp, Homo sapiens
ctggaatggaattcagtaaca

SEQ ID NO: 4186436 - DNA, 17 bp, Homo sapiens
ctggacaagaagctgct

SEQ ID NO: 4186437 - DNA, 17 bp, Homo sapiens
ctggaccgcttcccaga

SEQ ID NO: 4186438 - DNA, 20 bp, Homo sapiens
ctggaccgcttcccagaggc

SEQ ID NO: 4186439 - DNA, 18 bp, Homo sapiens
ctggacgccgagggcagc

SEQ ID NO: 4186440 - DNA, 20 bp, Homo sapiens
ctggacggcattcctgctta

SEQ ID NO: 4186441 - DNA, 19 bp, Homo sapiens
ctggagaagctcacccaat

SEQ ID NO: 4186442 - DNA, 17 bp, Homo sapiens
ctggagagaagtttctg

SEQ ID NO: 4186443 - DNA, 13 bp, Homo sapiens
ctggagatgatga

SEQ ID NO: 4186444 - DNA, 15 bp, Homo sapiens
ctggagatgatgatg

SEQ ID NO: 4186445 - DNA, 15 bp, Homo sapiens
ctggagcatcccagg

SEQ ID NO: 4186446 - DNA, 17 bp, Homo sapiens
ctggagcatcccaggcg

SEQ ID NO: 4186447 - DNA, 14 bp, Homo sapiens
ctggagcccgcttc

SEQ ID NO: 4186448 - DNA, 21 bp, Homo sapiens
ctggagcggagcttgcctgcc

SEQ ID NO: 4186449 - DNA, 15 bp, Homo sapiens
ctggagggatgccac

SEQ ID NO: 4186450 - DNA, 22 bp, Homo sapiens
ctggaggtcacattcaggaaga

SEQ ID NO: 4186451 - DNA, 14 bp, Homo sapiens
ctggagtcccctgg

SEQ ID NO: 4186452 - DNA, 14 bp, Homo sapiens
ctggagtcttgtac

SEQ ID NO: 4186453 - DNA, 18 bp, Homo sapiens
ctggatcttttggtggag

SEQ ID NO: 4186454 - DNA, 13 bp, Homo sapiens
ctggatgcagtgg

SEQ ID NO: 4186455 - DNA, 15 bp, Homo sapiens
ctggatgcagtggct

SEQ ID NO: 4186456 - DNA, 22 bp, Homo sapiens
ctggatgcagtggctcatgcct

SEQ ID NO: 4186457 - DNA, 16 bp, Homo sapiens
ctggattcaagtgatt

SEQ ID NO: 4186458 - DNA, 18 bp, Homo sapiens
ctggcaaaggtggctctc

SEQ ID NO: 4186459 - DNA, 22 bp, Homo sapiens
ctggcaaaggtggctctccagt

SEQ ID NO: 4186460 - DNA, 15 bp, Homo sapiens
ctggcagagcacagc

SEQ ID NO: 4186461 - DNA, 17 bp, Homo sapiens
ctggcagagcacagccc

SEQ ID NO: 4186462 - DNA, 18 bp, Homo sapiens
ctggcagagcacagccca

SEQ ID NO: 4186463 - DNA, 20 bp, Homo sapiens
ctggcagtttatatttaact

SEQ ID NO: 4186464 - DNA, 17 bp, Homo sapiens
ctggcatgtcagagcca

SEQ ID NO: 4186465 - DNA, 20 bp, Homo sapiens
ctggcccagccaactgcccc

SEQ ID NO: 4186466 - DNA, 21 bp, Homo sapiens
ctggcccagccaactgccccg

SEQ ID NO: 4186467 - DNA, 22 bp, Homo sapiens
ctggcccagccaactgccccgg

SEQ ID NO: 4186468 - DNA, 15 bp, Homo sapiens
ctggcccagccagcc

SEQ ID NO: 4186469 - DNA, 16 bp, Homo sapiens
ctggcccagccagcca

SEQ ID NO: 4186470 - DNA, 12 bp, Homo sapiens
ctggccccaccc

SEQ ID NO: 4186471 - DNA, 13 bp, Homo sapiens
ctggcccccctcc

SEQ ID NO: 4186472 - DNA, 16 bp, Homo sapiens
ctggcccccctccagg

SEQ ID NO: 4186473 - DNA, 17 bp, Homo sapiens
ctggcccccctccaggc

SEQ ID NO: 4186474 - DNA, 21 bp, Homo sapiens
ctggcccgtcatgttcctcaa

SEQ ID NO: 4186475 - DNA, 17 bp, Homo sapiens
ctggccctggggccatg

SEQ ID NO: 4186476 - DNA, 22 bp, Homo sapiens
ctggcccttaaacaactgcaga

SEQ ID NO: 4186477 - DNA, 23 bp, Homo sapiens
ctggcccttaaacaactgcagaa

SEQ ID NO: 4186478 - DNA, 18 bp, Homo sapiens
ctggccctttctggacca

SEQ ID NO: 4186479 - DNA, 21 bp, Homo sapiens
ctggcctcaaagcaagcattc

SEQ ID NO: 4186480 - DNA, 22 bp, Homo sapiens
ctggcctcccaataaagctgga

SEQ ID NO: 4186481 - DNA, 23 bp, Homo sapiens
ctggcctcccaataaagctggac

SEQ ID NO: 4186482 - DNA, 21 bp, Homo sapiens
ctggcctttcaggtccaggcc

SEQ ID NO: 4186483 - DNA, 22 bp, Homo sapiens
ctggcctttcaggtccaggcca

SEQ ID NO: 4186484 - DNA, 16 bp, Homo sapiens
ctggcggcgcagaggg

SEQ ID NO: 4186485 - DNA, 15 bp, Homo sapiens
ctggctcccagggtc

SEQ ID NO: 4186486 - DNA, 20 bp, Homo sapiens
ctggctcctttgcctctgct

SEQ ID NO: 4186487 - DNA, 19 bp, Homo sapiens
ctggctgaccccaaagagc

SEQ ID NO: 4186488 - DNA, 22 bp, Homo sapiens
ctggctgaccccaaagagcctg

SEQ ID NO: 4186489 - DNA, 13 bp, Homo sapiens
ctggctgagctga

SEQ ID NO: 4186490 - DNA, 14 bp, Homo sapiens
ctggctgtgtggcc

SEQ ID NO: 4186491 - DNA, 15 bp, Homo sapiens
ctggctgtgtggcca

SEQ ID NO: 4186492 - DNA, 22 bp, Homo sapiens
ctggcttattcccaactgctct

SEQ ID NO: 4186493 - DNA, 12 bp, Homo sapiens
ctggcttctggc

SEQ ID NO: 4186494 - DNA, 13 bp, Homo sapiens
ctggcttctggcc

SEQ ID NO: 4186495 - DNA, 17 bp, Homo sapiens
ctggcttctggccagga

SEQ ID NO: 4186496 - DNA, 22 bp, Homo sapiens
ctggctttctccgactgctagg

SEQ ID NO: 4186497 - DNA, 17 bp, Homo sapiens
ctggctttggtccccag

SEQ ID NO: 4186498 - DNA, 19 bp, Homo sapiens
ctggctttggtccccagca

SEQ ID NO: 4186499 - DNA, 18 bp, Homo sapiens
ctggctttgtctctagcc

SEQ ID NO: 4186500 - DNA, 15 bp, Homo sapiens
ctggcttttcgcttg

SEQ ID NO: 4186501 - DNA, 13 bp, Homo sapiens
ctgggaaggagga

SEQ ID NO: 4186502 - DNA, 18 bp, Homo sapiens
ctgggagaaatctggctt

SEQ ID NO: 4186503 - DNA, 12 bp, Homo sapiens
ctgggagaacct

SEQ ID NO: 4186504 - DNA, 16 bp, Homo sapiens
ctgggagaacctcagg

SEQ ID NO: 4186505 - DNA, 21 bp, Homo sapiens
ctgggagagcctggcaaggca

SEQ ID NO: 4186506 - DNA, 21 bp, Homo sapiens
ctgggaggaagcaggttgagg

SEQ ID NO: 4186507 - DNA, 22 bp, Homo sapiens
ctgggaggcggagagtacagtg

SEQ ID NO: 4186508 - DNA, 12 bp, Homo sapiens
ctgggagtcctg

SEQ ID NO: 4186509 - DNA, 18 bp, Homo sapiens
ctgggccaagttcctcta

SEQ ID NO: 4186510 - DNA, 20 bp, Homo sapiens
ctgggccaagttcctctagt

SEQ ID NO: 4186511 - DNA, 14 bp, Homo sapiens
ctgggcccacagag

SEQ ID NO: 4186512 - DNA, 17 bp, Homo sapiens
ctgggcccacagagcct

SEQ ID NO: 4186513 - DNA, 18 bp, Homo sapiens
ctgggcccacagagcctg

SEQ ID NO: 4186514 - DNA, 21 bp, Homo sapiens
ctgggcccacagagcctggct

SEQ ID NO: 4186515 - DNA, 24 bp, Homo sapiens
ctgggccccaaacgggctgccctg

SEQ ID NO: 4186516 - DNA, 15 bp, Homo sapiens
ctgggcctgagccta

SEQ ID NO: 4186517 - DNA, 13 bp, Homo sapiens
ctgggctctgccc

SEQ ID NO: 4186518 - DNA, 18 bp, Homo sapiens
ctgggctctgccccagct

SEQ ID NO: 4186519 - DNA, 11 bp, Homo sapiens
ctgggctctgg

SEQ ID NO: 4186520 - DNA, 12 bp, Homo sapiens
ctgggctctggt

SEQ ID NO: 4186521 - DNA, 20 bp, Homo sapiens
ctggggactgctacctctga

SEQ ID NO: 4186522 - DNA, 19 bp, Homo sapiens
ctggggctctgtgcaggga

SEQ ID NO: 4186523 - DNA, 18 bp, Homo sapiens
ctggggctgccagcctga

SEQ ID NO: 4186524 - DNA, 19 bp, Homo sapiens
ctggggctgccagcctgag

SEQ ID NO: 4186525 - DNA, 20 bp, Homo sapiens
ctggggctgggcctgagcct

SEQ ID NO: 4186526 - DNA, 16 bp, Homo sapiens
ctgggggaagggtggt

SEQ ID NO: 4186527 - DNA, 12 bp, Homo sapiens
ctgggggctgct

SEQ ID NO: 4186528 - DNA, 16 bp, Homo sapiens
ctgggggctgctgcac

SEQ ID NO: 4186529 - DNA, 21 bp, Homo sapiens
ctgggggtcttttagctccat

SEQ ID NO: 4186530 - DNA, 16 bp, Homo sapiens
ctggggtacaggtttg

SEQ ID NO: 4186531 - DNA, 15 bp, Homo sapiens
ctgggtaagaagaaa

SEQ ID NO: 4186532 - DNA, 17 bp, Homo sapiens
ctgggtcacctagctgg

SEQ ID NO: 4186533 - DNA, 14 bp, Homo sapiens
ctgggtccctcgga

SEQ ID NO: 4186534 - DNA, 20 bp, Homo sapiens
ctgggtccctcggagctgcc

SEQ ID NO: 4186535 - DNA, 21 bp, Homo sapiens
ctgggtccctcggagctgcca

SEQ ID NO: 4186536 - DNA, 22 bp, Homo sapiens
ctgggtgtggccccgcagtgcc

SEQ ID NO: 4186537 - DNA, 15 bp, Homo sapiens
ctgggttgcagacag

SEQ ID NO: 4186538 - DNA, 18 bp, Homo sapiens
ctgggttgcagacaggaa

SEQ ID NO: 4186539 - DNA, 23 bp, Homo sapiens
ctgggttttgtctctgcatctca

SEQ ID NO: 4186540 - DNA, 19 bp, Homo sapiens
ctggtaaactatttgtctt

SEQ ID NO: 4186541 - DNA, 22 bp, Homo sapiens
ctggtaatttgtatctgaagga

SEQ ID NO: 4186542 - DNA, 20 bp, Homo sapiens
ctggtagcacatgtctgtcc

SEQ ID NO: 4186543 - DNA, 21 bp, Homo sapiens
ctggtagcacatgtctgtcct

SEQ ID NO: 4186544 - DNA, 18 bp, Homo sapiens
ctggtatgaacttgagga

SEQ ID NO: 4186545 - DNA, 18 bp, Homo sapiens
ctggtcaagtagatcatg

SEQ ID NO: 4186546 - DNA, 14 bp, Homo sapiens
ctggtcctgcactg

SEQ ID NO: 4186547 - DNA, 15 bp, Homo sapiens
ctggtcctgcactgt

SEQ ID NO: 4186548 - DNA, 16 bp, Homo sapiens
ctggtccttccaggcc

SEQ ID NO: 4186549 - DNA, 15 bp, Homo sapiens
ctggtctttcctctg

SEQ ID NO: 4186550 - DNA, 14 bp, Homo sapiens
ctggtgaggcccag

SEQ ID NO: 4186551 - DNA, 19 bp, Homo sapiens
ctggtgaggcccagcctgt

SEQ ID NO: 4186552 - DNA, 16 bp, Homo sapiens
ctggtgcactggcccc

SEQ ID NO: 4186553 - DNA, 15 bp, Homo sapiens
ctggtgctactccat

SEQ ID NO: 4186554 - DNA, 17 bp, Homo sapiens
ctggtgctactccatgc

SEQ ID NO: 4186555 - DNA, 20 bp, Homo sapiens
ctggtgctataggctggaga

SEQ ID NO: 4186556 - DNA, 21 bp, Homo sapiens
ctggtgctataggctggagaa

SEQ ID NO: 4186557 - DNA, 16 bp, Homo sapiens
ctggtgctgtggccag

SEQ ID NO: 4186558 - DNA, 18 bp, Homo sapiens
ctggtgctgtggccaggg

SEQ ID NO: 4186559 - DNA, 19 bp, Homo sapiens
ctggtgctgtggccagggt

SEQ ID NO: 4186560 - DNA, 17 bp, Homo sapiens
ctggtggacagtcctgg

SEQ ID NO: 4186561 - DNA, 20 bp, Homo sapiens
ctggtgtagctcctctgctg

SEQ ID NO: 4186562 - DNA, 16 bp, Homo sapiens
ctggtttgcagctgtt

SEQ ID NO: 4186563 - DNA, 21 bp, Homo sapiens
ctgtaaaaagagagaaaactt

SEQ ID NO: 4186564 - DNA, 19 bp, Homo sapiens
ctgtaaactcaaaacttaa

SEQ ID NO: 4186565 - DNA, 13 bp, Homo sapiens
ctgtaagaaacct

SEQ ID NO: 4186566 - DNA, 14 bp, Homo sapiens
ctgtacaaaaacaa

SEQ ID NO: 4186567 - DNA, 20 bp, Homo sapiens
ctgtacccaatttaattcca

SEQ ID NO: 4186568 - DNA, 15 bp, Homo sapiens
ctgtagctttcctgg

SEQ ID NO: 4186569 - DNA, 22 bp, Homo sapiens
ctgtaggtttgtagtagccacc

SEQ ID NO: 4186570 - DNA, 14 bp, Homo sapiens
ctgtagtcccagcc

SEQ ID NO: 4186571 - DNA, 15 bp, Homo sapiens
ctgtagtcccagcca

SEQ ID NO: 4186572 - DNA, 20 bp, Homo sapiens
ctgtagtgtcactcaaggcg

SEQ ID NO: 4186573 - DNA, 13 bp, Homo sapiens
ctgtagttaggaa

SEQ ID NO: 4186574 - DNA, 12 bp, Homo sapiens
ctgtatgtcaga

SEQ ID NO: 4186575 - DNA, 15 bp, Homo sapiens
ctgtattcagacaga

SEQ ID NO: 4186576 - DNA, 13 bp, Homo sapiens
ctgtcacactaaa

SEQ ID NO: 4186577 - DNA, 16 bp, Homo sapiens
ctgtcacactaaactt

SEQ ID NO: 4186578 - DNA, 17 bp, Homo sapiens
ctgtcactggcagagca

SEQ ID NO: 4186579 - DNA, 18 bp, Homo sapiens
ctgtcactggcagagcac

SEQ ID NO: 4186580 - DNA, 21 bp, Homo sapiens
ctgtcactggcagagcacagc

SEQ ID NO: 4186581 - DNA, 18 bp, Homo sapiens
ctgtcatggtcctttctg

SEQ ID NO: 4186582 - DNA, 22 bp, Homo sapiens
ctgtcattcaggaccccaaccc

SEQ ID NO: 4186583 - DNA, 18 bp, Homo sapiens
ctgtccaatcagagaata

SEQ ID NO: 4186584 - DNA, 15 bp, Homo sapiens
ctgtccaccagaccc

SEQ ID NO: 4186585 - DNA, 16 bp, Homo sapiens
ctgtccaccagaccca

SEQ ID NO: 4186586 - DNA, 19 bp, Homo sapiens
ctgtccactcttgttcaag

SEQ ID NO: 4186587 - DNA, 19 bp, Homo sapiens
ctgtccagcgcggctcccg

SEQ ID NO: 4186588 - DNA, 19 bp, Homo sapiens
ctgtcccggttcaccttgc

SEQ ID NO: 4186589 - DNA, 18 bp, Homo sapiens
ctgtccgcctctgcccgc

SEQ ID NO: 4186590 - DNA, 19 bp, Homo sapiens
ctgtccgcctctgcccgca

SEQ ID NO: 4186591 - DNA, 20 bp, Homo sapiens
ctgtccgcctctgcccgcag

SEQ ID NO: 4186592 - DNA, 21 bp, Homo sapiens
ctgtccgcctctgcccgcaga

SEQ ID NO: 4186593 - DNA, 14 bp, Homo sapiens
ctgtcctggtacag

SEQ ID NO: 4186594 - DNA, 19 bp, Homo sapiens
ctgtcctggtacagcaggg

SEQ ID NO: 4186595 - DNA, 13 bp, Homo sapiens
ctgtcctttctag

SEQ ID NO: 4186596 - DNA, 23 bp, Homo sapiens
ctgtcctttctagagcactgcca

SEQ ID NO: 4186597 - DNA, 16 bp, Homo sapiens
ctgtctggttttaaca

SEQ ID NO: 4186598 - DNA, 14 bp, Homo sapiens
ctgtctgtctgtct

SEQ ID NO: 4186599 - DNA, 14 bp, Homo sapiens
ctgtcttctggact

SEQ ID NO: 4186600 - DNA, 15 bp, Homo sapiens
ctgtcttctggactg

SEQ ID NO: 4186601 - DNA, 20 bp, Homo sapiens
ctgtgaaataccacaagcct

SEQ ID NO: 4186602 - DNA, 14 bp, Homo sapiens
ctgtgaagcaaaaa

SEQ ID NO: 4186603 - DNA, 18 bp, Homo sapiens
ctgtgacccatctgtagt

SEQ ID NO: 4186604 - DNA, 15 bp, Homo sapiens
ctgtgcagggaggag

SEQ ID NO: 4186605 - DNA, 14 bp, Homo sapiens
ctgtgccctgcctt

SEQ ID NO: 4186606 - DNA, 10 bp, Homo sapiens
ctgtgcctta

SEQ ID NO: 4186607 - DNA, 24 bp, Homo sapiens
ctgtgctaaagaagccctgctggg

SEQ ID NO: 4186608 - DNA, 19 bp, Homo sapiens
ctgtgctatggtgctctgt

SEQ ID NO: 4186609 - DNA, 16 bp, Homo sapiens
ctgtgctcctgtccct

SEQ ID NO: 4186610 - DNA, 22 bp, Homo sapiens
ctgtggagacagccctgcctat

SEQ ID NO: 4186611 - DNA, 23 bp, Homo sapiens
ctgtggattttttccttcaaagt

SEQ ID NO: 4186612 - DNA, 20 bp, Homo sapiens
ctgtggcccttctgtccacc

SEQ ID NO: 4186613 - DNA, 14 bp, Homo sapiens
ctgtggcctgggca

SEQ ID NO: 4186614 - DNA, 15 bp, Homo sapiens
ctgtggccttctcag

SEQ ID NO: 4186615 - DNA, 18 bp, Homo sapiens
ctgtggccttctcagcct

SEQ ID NO: 4186616 - DNA, 16 bp, Homo sapiens
ctgtgggagctcagct

SEQ ID NO: 4186617 - DNA, 13 bp, Homo sapiens
ctgtggggcctga

SEQ ID NO: 4186618 - DNA, 17 bp, Homo sapiens
ctgtggggtctggctgt

SEQ ID NO: 4186619 - DNA, 15 bp, Homo sapiens
ctgtgtactgcagtt

SEQ ID NO: 4186620 - DNA, 14 bp, Homo sapiens
ctgtgtctggcccc

SEQ ID NO: 4186621 - DNA, 15 bp, Homo sapiens
ctgtgtctggcccct

SEQ ID NO: 4186622 - DNA, 17 bp, Homo sapiens
ctgtgtgcagtgaaggt

SEQ ID NO: 4186623 - DNA, 13 bp, Homo sapiens
ctgtgtgtacatg

SEQ ID NO: 4186624 - DNA, 16 bp, Homo sapiens
ctgtgttaactcagga

SEQ ID NO: 4186625 - DNA, 22 bp, Homo sapiens
ctgtgttatttggaccactcca

SEQ ID NO: 4186626 - DNA, 18 bp, Homo sapiens
ctgtgttgcgtgtcgtgg

SEQ ID NO: 4186627 - DNA, 20 bp, Homo sapiens
ctgtgttgcgtgtcgtgggt

SEQ ID NO: 4186628 - DNA, 18 bp, Homo sapiens
ctgttaagcaattccttt

SEQ ID NO: 4186629 - DNA, 23 bp, Homo sapiens
ctgttatcaaacaccaacataaa

SEQ ID NO: 4186630 - DNA, 17 bp, Homo sapiens
ctgttcccaatatgtag

SEQ ID NO: 4186631 - DNA, 22 bp, Homo sapiens
ctgttcttggtaactgattacc

SEQ ID NO: 4186632 - DNA, 14 bp, Homo sapiens
ctgttgaaaattat

SEQ ID NO: 4186633 - DNA, 13 bp, Homo sapiens
ctgttgccacaac

SEQ ID NO: 4186634 - DNA, 15 bp, Homo sapiens
ctgttggggcagggg

SEQ ID NO: 4186635 - DNA, 14 bp, Homo sapiens
ctgttgtacaagct

SEQ ID NO: 4186636 - DNA, 17 bp, Homo sapiens
ctgttgttcccatctgc

SEQ ID NO: 4186637 - DNA, 20 bp, Homo sapiens
ctgttgttttgttttaaata

SEQ ID NO: 4186638 - DNA, 17 bp, Homo sapiens
ctgtttactgcaaggtt

SEQ ID NO: 4186639 - DNA, 20 bp, Homo sapiens
ctgtttagtagcagtgattg

SEQ ID NO: 4186640 - DNA, 13 bp, Homo sapiens
ctgttttcaaagc

SEQ ID NO: 4186641 - DNA, 10 bp, Homo sapiens
ctgttttcca

SEQ ID NO: 4186642 - DNA, 14 bp, Homo sapiens
ctgttttgtttctt

SEQ ID NO: 4186643 - DNA, 15 bp, Homo sapiens
ctgttttgtttcttg

SEQ ID NO: 4186644 - DNA, 18 bp, Homo sapiens
ctgttttttctgtacaca

SEQ ID NO: 4186645 - DNA, 16 bp, Homo sapiens
cttaaacaactgcaga

SEQ ID NO: 4186646 - DNA, 22 bp, Homo sapiens
cttaaagaaagtcgaattaata

SEQ ID NO: 4186647 - DNA, 18 bp, Homo sapiens
cttaaatgttaatgagaa

SEQ ID NO: 4186648 - DNA, 15 bp, Homo sapiens
cttaacatatttact

SEQ ID NO: 4186649 - DNA, 18 bp, Homo sapiens
cttaacatggaagatatt

SEQ ID NO: 4186650 - DNA, 21 bp, Homo sapiens
cttaagcagagcagaactttt

SEQ ID NO: 4186651 - DNA, 20 bp, Homo sapiens
cttaagccttttgctcacaa

SEQ ID NO: 4186652 - DNA, 21 bp, Homo sapiens
cttaaggtgtagccacaccag

SEQ ID NO: 4186653 - DNA, 11 bp, Homo sapiens
cttaataatac

SEQ ID NO: 4186654 - DNA, 22 bp, Homo sapiens
cttaatggctgataattttaaa

SEQ ID NO: 4186655 - DNA, 15 bp, Homo sapiens
cttaattttaatcca

SEQ ID NO: 4186656 - DNA, 15 bp, Homo sapiens
cttaccaactttctg

SEQ ID NO: 4186657 - DNA, 17 bp, Homo sapiens
cttaccaactttctgta

SEQ ID NO: 4186658 - DNA, 19 bp, Homo sapiens
cttaccaggcaccaaaaga

SEQ ID NO: 4186659 - DNA, 17 bp, Homo sapiens
cttactaatgtgcccca

SEQ ID NO: 4186660 - DNA, 13 bp, Homo sapiens
cttactcacctct

SEQ ID NO: 4186661 - DNA, 17 bp, Homo sapiens
cttactctttcactcag

SEQ ID NO: 4186662 - DNA, 17 bp, Homo sapiens
cttagaataaaattgta

SEQ ID NO: 4186663 - DNA, 18 bp, Homo sapiens
cttagaattgaggagttg

SEQ ID NO: 4186664 - DNA, 20 bp, Homo sapiens
cttagagaatgttctcctaa

SEQ ID NO: 4186665 - DNA, 17 bp, Homo sapiens
cttagcctcctgacctg

SEQ ID NO: 4186666 - DNA, 21 bp, Homo sapiens
cttagcctcctgacctgaggc

SEQ ID NO: 4186667 - DNA, 15 bp, Homo sapiens
cttaggaacagctct

SEQ ID NO: 4186668 - DNA, 13 bp, Homo sapiens
cttaggaagaaat

SEQ ID NO: 4186669 - DNA, 18 bp, Homo sapiens
cttaggctgctgggagat

SEQ ID NO: 4186670 - DNA, 16 bp, Homo sapiens
cttagtacggctgctg

SEQ ID NO: 4186671 - DNA, 17 bp, Homo sapiens
cttagtacggctgctgc

SEQ ID NO: 4186672 - DNA, 18 bp, Homo sapiens
cttagtacggctgctgca

SEQ ID NO: 4186673 - DNA, 22 bp, Homo sapiens
cttagtggcttttttcctcctg

SEQ ID NO: 4186674 - DNA, 13 bp, Homo sapiens
cttataacttctg

SEQ ID NO: 4186675 - DNA, 12 bp, Homo sapiens
cttatcatcagc

SEQ ID NO: 4186676 - DNA, 12 bp, Homo sapiens
cttatccaggac

SEQ ID NO: 4186677 - DNA, 13 bp, Homo sapiens
cttatccaggact

SEQ ID NO: 4186678 - DNA, 14 bp, Homo sapiens
cttattatcccagc

SEQ ID NO: 4186679 - DNA, 21 bp, Homo sapiens
cttattcatgctttctccttt

SEQ ID NO: 4186680 - DNA, 23 bp, Homo sapiens
cttattcatgctttctccttttt

SEQ ID NO: 4186681 - DNA, 15 bp, Homo sapiens
cttattctcctccct

SEQ ID NO: 4186682 - DNA, 16 bp, Homo sapiens
cttattgtttgtaaac

SEQ ID NO: 4186683 - DNA, 17 bp, Homo sapiens
cttattgtttgtaaaca

SEQ ID NO: 4186684 - DNA, 18 bp, Homo sapiens
cttattttttaaaataat

SEQ ID NO: 4186685 - DNA, 20 bp, Homo sapiens
cttcaacaattctaaaatga

SEQ ID NO: 4186686 - DNA, 12 bp, Homo sapiens
cttcaagtgcca

SEQ ID NO: 4186687 - DNA, 17 bp, Homo sapiens
cttcaagttagctcagg

SEQ ID NO: 4186688 - DNA, 16 bp, Homo sapiens
cttcaattcctgggcc

SEQ ID NO: 4186689 - DNA, 15 bp, Homo sapiens
cttcactcagccaca

SEQ ID NO: 4186690 - DNA, 24 bp, Homo sapiens
cttcactccggtgtgcctgcagcc

SEQ ID NO: 4186691 - DNA, 16 bp, Homo sapiens
cttcagaaggcctcac

SEQ ID NO: 4186692 - DNA, 20 bp, Homo sapiens
cttcagaaggcctcactcaa

SEQ ID NO: 4186693 - DNA, 17 bp, Homo sapiens
cttcagacgagatcctg

SEQ ID NO: 4186694 - DNA, 19 bp, Homo sapiens
cttcagacttttatcaaaa

SEQ ID NO: 4186695 - DNA, 18 bp, Homo sapiens
cttcagatttgtgttata

SEQ ID NO: 4186696 - DNA, 22 bp, Homo sapiens
cttcagcctgaggctgagactg

SEQ ID NO: 4186697 - DNA, 19 bp, Homo sapiens
cttcagtgacaagtagggc

SEQ ID NO: 4186698 - DNA, 17 bp, Homo sapiens
cttcagtggagaattat

SEQ ID NO: 4186699 - DNA, 17 bp, Homo sapiens
cttcagttgttttcccg

SEQ ID NO: 4186700 - DNA, 12 bp, Homo sapiens
cttcatcttgac

SEQ ID NO: 4186701 - DNA, 14 bp, Homo sapiens
cttcatggtgacat

SEQ ID NO: 4186702 - DNA, 20 bp, Homo sapiens
cttccaggtatctccaggat

SEQ ID NO: 4186703 - DNA, 16 bp, Homo sapiens
cttccaggtggcagga

SEQ ID NO: 4186704 - DNA, 16 bp, Homo sapiens
cttccatgatacttta

SEQ ID NO: 4186705 - DNA, 18 bp, Homo sapiens
cttccatgatactttaat

SEQ ID NO: 4186706 - DNA, 11 bp, Homo sapiens
cttccatgcct

SEQ ID NO: 4186707 - DNA, 14 bp, Homo sapiens
cttccatgcctgta

SEQ ID NO: 4186708 - DNA, 21 bp, Homo sapiens
cttccatgcctgtagctttcc

SEQ ID NO: 4186709 - DNA, 10 bp, Homo sapiens
cttcccagag

SEQ ID NO: 4186710 - DNA, 17 bp, Homo sapiens
cttccccagactcagct

SEQ ID NO: 4186711 - DNA, 18 bp, Homo sapiens
cttccccagactcagctc

SEQ ID NO: 4186712 - DNA, 16 bp, Homo sapiens
cttccccaggagctct

SEQ ID NO: 4186713 - DNA, 21 bp, Homo sapiens
cttcccccatcccctttcctc

SEQ ID NO: 4186714 - DNA, 23 bp, Homo sapiens
cttcccccatcccctttcctccc

SEQ ID NO: 4186715 - DNA, 23 bp, Homo sapiens
cttccccctccaacccacagcct

SEQ ID NO: 4186716 - DNA, 13 bp, Homo sapiens
cttccctctttcc

SEQ ID NO: 4186717 - DNA, 23 bp, Homo sapiens
cttccctctttccccacctcttc

SEQ ID NO: 4186718 - DNA, 14 bp, Homo sapiens
cttcccttctctcc

SEQ ID NO: 4186719 - DNA, 17 bp, Homo sapiens
cttcccttctctccttc

SEQ ID NO: 4186720 - DNA, 14 bp, Homo sapiens
cttccgctccttta

SEQ ID NO: 4186721 - DNA, 21 bp, Homo sapiens
cttccgtggtcagagtgccac

SEQ ID NO: 4186722 - DNA, 22 bp, Homo sapiens
cttccgtggtcagagtgccact

SEQ ID NO: 4186723 - DNA, 23 bp, Homo sapiens
cttcctacacccttggacttgag

SEQ ID NO: 4186724 - DNA, 14 bp, Homo sapiens
cttcctccctggag

SEQ ID NO: 4186725 - DNA, 16 bp, Homo sapiens
cttcctcgtgcagagc

SEQ ID NO: 4186726 - DNA, 13 bp, Homo sapiens
cttcctctgggca

SEQ ID NO: 4186727 - DNA, 18 bp, Homo sapiens
cttcctggtgaggcccag

SEQ ID NO: 4186728 - DNA, 19 bp, Homo sapiens
cttccttaattcactccca

SEQ ID NO: 4186729 - DNA, 15 bp, Homo sapiens
cttccttctttctct

SEQ ID NO: 4186730 - DNA, 18 bp, Homo sapiens
cttccttctttctcttcc

SEQ ID NO: 4186731 - DNA, 19 bp, Homo sapiens
cttccttctttctcttccc

SEQ ID NO: 4186732 - DNA, 14 bp, Homo sapiens
cttccttgtgattg

SEQ ID NO: 4186733 - DNA, 11 bp, Homo sapiens
cttcctttcct

SEQ ID NO: 4186734 - DNA, 12 bp, Homo sapiens
cttctacccaga

SEQ ID NO: 4186735 - DNA, 17 bp, Homo sapiens
cttctagccacagttct

SEQ ID NO: 4186736 - DNA, 21 bp, Homo sapiens
cttctcaaaagattgttttat

SEQ ID NO: 4186737 - DNA, 21 bp, Homo sapiens
cttctcagcctacagcagtgt

SEQ ID NO: 4186738 - DNA, 21 bp, Homo sapiens
cttctcattccaacagtgagt

SEQ ID NO: 4186739 - DNA, 10 bp, Homo sapiens
cttctccatc

SEQ ID NO: 4186740 - DNA, 16 bp, Homo sapiens
cttctcgtttgctcta

SEQ ID NO: 4186741 - DNA, 15 bp, Homo sapiens
cttctctacagactt

SEQ ID NO: 4186742 - DNA, 21 bp, Homo sapiens
cttctctccttccctctttcc

SEQ ID NO: 4186743 - DNA, 13 bp, Homo sapiens
cttctcttgaatt

SEQ ID NO: 4186744 - DNA, 18 bp, Homo sapiens
cttctgattcccctccac

SEQ ID NO: 4186745 - DNA, 15 bp, Homo sapiens
cttctgcagcaactc

SEQ ID NO: 4186746 - DNA, 17 bp, Homo sapiens
cttctgcagcaactccc

SEQ ID NO: 4186747 - DNA, 21 bp, Homo sapiens
cttctgcagcaactcccacga

SEQ ID NO: 4186748 - DNA, 22 bp, Homo sapiens
cttctgcagcaactcccacgac

SEQ ID NO: 4186749 - DNA, 11 bp, Homo sapiens
cttctggagcc

SEQ ID NO: 4186750 - DNA, 13 bp, Homo sapiens
cttctggagccct

SEQ ID NO: 4186751 - DNA, 14 bp, Homo sapiens
cttctggagccctt

SEQ ID NO: 4186752 - DNA, 15 bp, Homo sapiens
cttctggccaggaag

SEQ ID NO: 4186753 - DNA, 22 bp, Homo sapiens
cttctggccaggaagctttggt

SEQ ID NO: 4186754 - DNA, 22 bp, Homo sapiens
cttctggctccaaggtgctctg

SEQ ID NO: 4186755 - DNA, 22 bp, Homo sapiens
cttctggctcctccttcccctg

SEQ ID NO: 4186756 - DNA, 19 bp, Homo sapiens
cttctggtgctactccatg

SEQ ID NO: 4186757 - DNA, 14 bp, Homo sapiens
cttcttaacgaaat

SEQ ID NO: 4186758 - DNA, 12 bp, Homo sapiens
cttcttccctgt

SEQ ID NO: 4186759 - DNA, 13 bp, Homo sapiens
cttcttgcccaga

SEQ ID NO: 4186760 - DNA, 17 bp, Homo sapiens
cttctttctcttccctc

SEQ ID NO: 4186761 - DNA, 19 bp, Homo sapiens
cttctttctcttccctcct

SEQ ID NO: 4186762 - DNA, 16 bp, Homo sapiens
cttctttgaagttatt

SEQ ID NO: 4186763 - DNA, 14 bp, Homo sapiens
cttcttttcacctc

SEQ ID NO: 4186764 - DNA, 14 bp, Homo sapiens
cttgaaacagcctg

SEQ ID NO: 4186765 - DNA, 16 bp, Homo sapiens
cttgaaacagcctggg

SEQ ID NO: 4186766 - DNA, 18 bp, Homo sapiens
cttgaacatgttttgtat

SEQ ID NO: 4186767 - DNA, 20 bp, Homo sapiens
cttgaagaatctctcctctc

SEQ ID NO: 4186768 - DNA, 18 bp, Homo sapiens
cttgaagccactgaagct

SEQ ID NO: 4186769 - DNA, 21 bp, Homo sapiens
cttgaagccactgaagctggg

SEQ ID NO: 4186770 - DNA, 16 bp, Homo sapiens
cttgaagggtaaagaa

SEQ ID NO: 4186771 - DNA, 14 bp, Homo sapiens
cttgaattattttg

SEQ ID NO: 4186772 - DNA, 16 bp, Homo sapiens
cttgacccatctcccc

SEQ ID NO: 4186773 - DNA, 14 bp, Homo sapiens
cttgaccctgagct

SEQ ID NO: 4186774 - DNA, 12 bp, Homo sapiens
cttgagcttggc

SEQ ID NO: 4186775 - DNA, 13 bp, Homo sapiens
cttgaggacacat

SEQ ID NO: 4186776 - DNA, 15 bp, Homo sapiens
cttgaggacacatgt

SEQ ID NO: 4186777 - DNA, 22 bp, Homo sapiens
cttgatactaaaagttcttctc

SEQ ID NO: 4186778 - DNA, 21 bp, Homo sapiens
cttgcactaaagtatgtaaag

SEQ ID NO: 4186779 - DNA, 23 bp, Homo sapiens
cttgcaggaaggactatgaaaag

SEQ ID NO: 4186780 - DNA, 11 bp, Homo sapiens
cttgcctgcct

SEQ ID NO: 4186781 - DNA, 12 bp, Homo sapiens
cttgcctgcctg

SEQ ID NO: 4186782 - DNA, 17 bp, Homo sapiens
cttgccttttaaaagaa

SEQ ID NO: 4186783 - DNA, 20 bp, Homo sapiens
cttgcggaatcactctgtcc

SEQ ID NO: 4186784 - DNA, 18 bp, Homo sapiens
cttgctgacatggctttg

SEQ ID NO: 4186785 - DNA, 15 bp, Homo sapiens
cttgctgtcctaggc

SEQ ID NO: 4186786 - DNA, 16 bp, Homo sapiens
cttgctgtcctaggcc

SEQ ID NO: 4186787 - DNA, 12 bp, Homo sapiens
cttgcttctgca

SEQ ID NO: 4186788 - DNA, 21 bp, Homo sapiens
cttgcttctgcagcaactccc

SEQ ID NO: 4186789 - DNA, 22 bp, Homo sapiens
cttgcttctgcagcaactccca

SEQ ID NO: 4186790 - DNA, 22 bp, Homo sapiens
cttggaaagcatcacctcaggc

SEQ ID NO: 4186791 - DNA, 17 bp, Homo sapiens
cttggaagtgtgtggaa

SEQ ID NO: 4186792 - DNA, 16 bp, Homo sapiens
cttggactcctcccac

SEQ ID NO: 4186793 - DNA, 18 bp, Homo sapiens
cttggactcctcccacaa

SEQ ID NO: 4186794 - DNA, 15 bp, Homo sapiens
cttggagagcagctg

SEQ ID NO: 4186795 - DNA, 16 bp, Homo sapiens
cttggagcctgaacat

SEQ ID NO: 4186796 - DNA, 18 bp, Homo sapiens
cttggagcctgaacatga

SEQ ID NO: 4186797 - DNA, 14 bp, Homo sapiens
cttggagctgagca

SEQ ID NO: 4186798 - DNA, 16 bp, Homo sapiens
cttggcagagaggacc

SEQ ID NO: 4186799 - DNA, 15 bp, Homo sapiens
cttggcagctgaact

SEQ ID NO: 4186800 - DNA, 18 bp, Homo sapiens
cttggcagtattccatgg

SEQ ID NO: 4186801 - DNA, 22 bp, Homo sapiens
cttggcatcacagggcagagcc

SEQ ID NO: 4186802 - DNA, 17 bp, Homo sapiens
cttggcttttgcttggc

SEQ ID NO: 4186803 - DNA, 18 bp, Homo sapiens
cttggcttttgcttggca

SEQ ID NO: 4186804 - DNA, 21 bp, Homo sapiens
cttggcttttgcttggcagag

SEQ ID NO: 4186805 - DNA, 15 bp, Homo sapiens
cttgggcccaggagg

SEQ ID NO: 4186806 - DNA, 16 bp, Homo sapiens
cttgggcccaggaggt

SEQ ID NO: 4186807 - DNA, 15 bp, Homo sapiens
cttggggctcgcccc

SEQ ID NO: 4186808 - DNA, 19 bp, Homo sapiens
cttggggctcgccccaccc

SEQ ID NO: 4186809 - DNA, 20 bp, Homo sapiens
cttggggttttcagtatgaa

SEQ ID NO: 4186810 - DNA, 15 bp, Homo sapiens
cttggtcagagccac

SEQ ID NO: 4186811 - DNA, 20 bp, Homo sapiens
cttggtctgatttcaggata

SEQ ID NO: 4186812 - DNA, 18 bp, Homo sapiens
cttggtggccaagcctgg

SEQ ID NO: 4186813 - DNA, 19 bp, Homo sapiens
cttggtggccaagcctggc

SEQ ID NO: 4186814 - DNA, 20 bp, Homo sapiens
cttggtggccaagcctggcc

SEQ ID NO: 4186815 - DNA, 21 bp, Homo sapiens
cttggtggccaagcctggccc

SEQ ID NO: 4186816 - DNA, 19 bp, Homo sapiens
cttggtgtgaccctctgaa

SEQ ID NO: 4186817 - DNA, 21 bp, Homo sapiens
cttggttttgctacataatta

SEQ ID NO: 4186818 - DNA, 14 bp, Homo sapiens
cttgtatctttcta

SEQ ID NO: 4186819 - DNA, 14 bp, Homo sapiens
cttgtattttctta

SEQ ID NO: 4186820 - DNA, 23 bp, Homo sapiens
cttgtccttttgtaccatggtgt

SEQ ID NO: 4186821 - DNA, 18 bp, Homo sapiens
cttgtgtcaagacatttc

SEQ ID NO: 4186822 - DNA, 21 bp, Homo sapiens
cttgtgtcaagacatttctct

SEQ ID NO: 4186823 - DNA, 18 bp, Homo sapiens
cttgtgtcagagacagac

SEQ ID NO: 4186824 - DNA, 19 bp, Homo sapiens
cttgtgtgttttgagagta

SEQ ID NO: 4186825 - DNA, 21 bp, Homo sapiens
cttgttgtttttaagtcctgt

SEQ ID NO: 4186826 - DNA, 19 bp, Homo sapiens
ctttaaaatgtaaagccat

SEQ ID NO: 4186827 - DNA, 21 bp, Homo sapiens
ctttaaaatgtaaagccatgc

SEQ ID NO: 4186828 - DNA, 22 bp, Homo sapiens
ctttaaccactcctcaggaaca

SEQ ID NO: 4186829 - DNA, 19 bp, Homo sapiens
ctttaaccctctcttccct

SEQ ID NO: 4186830 - DNA, 15 bp, Homo sapiens
ctttaacttaaatag

SEQ ID NO: 4186831 - DNA, 23 bp, Homo sapiens
ctttaatttttataaatatgtga

SEQ ID NO: 4186832 - DNA, 21 bp, Homo sapiens
ctttacatttgataaactaaa

SEQ ID NO: 4186833 - DNA, 14 bp, Homo sapiens
ctttaggcagcctg

SEQ ID NO: 4186834 - DNA, 19 bp, Homo sapiens
ctttaggcagcctgccgcc

SEQ ID NO: 4186835 - DNA, 20 bp, Homo sapiens
ctttaggcagcctgccgccg

SEQ ID NO: 4186836 - DNA, 13 bp, Homo sapiens
ctttataaacttt

SEQ ID NO: 4186837 - DNA, 14 bp, Homo sapiens
ctttatacagaact

SEQ ID NO: 4186838 - DNA, 20 bp, Homo sapiens
ctttataggcagtagactca

SEQ ID NO: 4186839 - DNA, 20 bp, Homo sapiens
ctttatcaccaggatgtcac

SEQ ID NO: 4186840 - DNA, 19 bp, Homo sapiens
ctttatctttatctttata

SEQ ID NO: 4186841 - DNA, 17 bp, Homo sapiens
ctttcagcactcagaaa

SEQ ID NO: 4186842 - DNA, 13 bp, Homo sapiens
ctttcagctgtga

SEQ ID NO: 4186843 - DNA, 20 bp, Homo sapiens
ctttcccatgatccagaact

SEQ ID NO: 4186844 - DNA, 19 bp, Homo sapiens
ctttcccccaccccagagt

SEQ ID NO: 4186845 - DNA, 18 bp, Homo sapiens
ctttccccgggggaggaa

SEQ ID NO: 4186846 - DNA, 15 bp, Homo sapiens
ctttcctacaaaatg

SEQ ID NO: 4186847 - DNA, 18 bp, Homo sapiens
ctttcctatcatggagtg

SEQ ID NO: 4186848 - DNA, 20 bp, Homo sapiens
ctttcctccccaccttcccc

SEQ ID NO: 4186849 - DNA, 16 bp, Homo sapiens
ctttccttttcttcct

SEQ ID NO: 4186850 - DNA, 18 bp, Homo sapiens
ctttccttttcttccttc

SEQ ID NO: 4186851 - DNA, 20 bp, Homo sapiens
ctttccttttcttccttctt

SEQ ID NO: 4186852 - DNA, 13 bp, Homo sapiens
ctttctcactgct

SEQ ID NO: 4186853 - DNA, 14 bp, Homo sapiens
ctttctctccttct

SEQ ID NO: 4186854 - DNA, 21 bp, Homo sapiens
ctttctctccttcttccctgt

SEQ ID NO: 4186855 - DNA, 19 bp, Homo sapiens
ctttctctggctccagaat

SEQ ID NO: 4186856 - DNA, 21 bp, Homo sapiens
ctttctcttccctccttccct

SEQ ID NO: 4186857 - DNA, 15 bp, Homo sapiens
ctttctgatcaaggc

SEQ ID NO: 4186858 - DNA, 17 bp, Homo sapiens
ctttctggaccagatcc

SEQ ID NO: 4186859 - DNA, 15 bp, Homo sapiens
ctttctgtgtgcacc

SEQ ID NO: 4186860 - DNA, 16 bp, Homo sapiens
ctttctgttgccacaa

SEQ ID NO: 4186861 - DNA, 11 bp, Homo sapiens
ctttgaagtta

SEQ ID NO: 4186862 - DNA, 15 bp, Homo sapiens
ctttgaagttattta

SEQ ID NO: 4186863 - DNA, 16 bp, Homo sapiens
ctttgaatgctttttg

SEQ ID NO: 4186864 - DNA, 13 bp, Homo sapiens
ctttgagtaccaa

SEQ ID NO: 4186865 - DNA, 13 bp, Homo sapiens
ctttgagttatag

SEQ ID NO: 4186866 - DNA, 21 bp, Homo sapiens
ctttgcatggaatttgtaagt

SEQ ID NO: 4186867 - DNA, 16 bp, Homo sapiens
ctttgccccagttaca

SEQ ID NO: 4186868 - DNA, 13 bp, Homo sapiens
ctttgcctctgct

SEQ ID NO: 4186869 - DNA, 15 bp, Homo sapiens
ctttgcctctgctac

SEQ ID NO: 4186870 - DNA, 11 bp, Homo sapiens
ctttgcctggt

SEQ ID NO: 4186871 - DNA, 21 bp, Homo sapiens
ctttgccttgatgttgtgttg

SEQ ID NO: 4186872 - DNA, 17 bp, Homo sapiens
ctttggaaacaggacca

SEQ ID NO: 4186873 - DNA, 11 bp, Homo sapiens
ctttggaagga

SEQ ID NO: 4186874 - DNA, 15 bp, Homo sapiens
ctttggaaggagtga

SEQ ID NO: 4186875 - DNA, 18 bp, Homo sapiens
ctttggcaatttcctggc

SEQ ID NO: 4186876 - DNA, 18 bp, Homo sapiens
ctttggggttgcccagcc

SEQ ID NO: 4186877 - DNA, 19 bp, Homo sapiens
ctttggtgagaacctgggt

SEQ ID NO: 4186878 - DNA, 15 bp, Homo sapiens
ctttgtataatccca

SEQ ID NO: 4186879 - DNA, 22 bp, Homo sapiens
ctttgtttcctccttgtcactg

SEQ ID NO: 4186880 - DNA, 14 bp, Homo sapiens
ctttgttttctaaa

SEQ ID NO: 4186881 - DNA, 15 bp, Homo sapiens
ctttgttttgcactg

SEQ ID NO: 4186882 - DNA, 11 bp, Homo sapiens
cttttaaaatg

SEQ ID NO: 4186883 - DNA, 22 bp, Homo sapiens
cttttaacagagtctgaaccta

SEQ ID NO: 4186884 - DNA, 21 bp, Homo sapiens
cttttaagcaaagttgggtgt

SEQ ID NO: 4186885 - DNA, 14 bp, Homo sapiens
cttttaatcagaca

SEQ ID NO: 4186886 - DNA, 19 bp, Homo sapiens
cttttaccatgaattcttg

SEQ ID NO: 4186887 - DNA, 17 bp, Homo sapiens
cttttatagctattact

SEQ ID NO: 4186888 - DNA, 20 bp, Homo sapiens
cttttatcttctagccacag

SEQ ID NO: 4186889 - DNA, 13 bp, Homo sapiens
cttttattgtata

SEQ ID NO: 4186890 - DNA, 19 bp, Homo sapiens
cttttattgtataaactat

SEQ ID NO: 4186891 - DNA, 21 bp, Homo sapiens
cttttattgtataaactatca

SEQ ID NO: 4186892 - DNA, 13 bp, Homo sapiens
cttttcacctctt

SEQ ID NO: 4186893 - DNA, 16 bp, Homo sapiens
cttttcagttagacaa

SEQ ID NO: 4186894 - DNA, 21 bp, Homo sapiens
cttttcatctccagtgtgaat

SEQ ID NO: 4186895 - DNA, 18 bp, Homo sapiens
cttttcgcttgcttctgc

SEQ ID NO: 4186896 - DNA, 20 bp, Homo sapiens
cttttcgcttgcttctgcag

SEQ ID NO: 4186897 - DNA, 24 bp, Homo sapiens
cttttcgcttgcttctgcagcaac

SEQ ID NO: 4186898 - DNA, 12 bp, Homo sapiens
cttttctgcaga

SEQ ID NO: 4186899 - DNA, 15 bp, Homo sapiens
cttttctgcagaggg

SEQ ID NO: 4186900 - DNA, 14 bp, Homo sapiens
cttttcttccttct

SEQ ID NO: 4186901 - DNA, 14 bp, Homo sapiens
cttttctttttctc

SEQ ID NO: 4186902 - DNA, 14 bp, Homo sapiens
cttttgctgctgct

SEQ ID NO: 4186903 - DNA, 11 bp, Homo sapiens
cttttgggagg

SEQ ID NO: 4186904 - DNA, 23 bp, Homo sapiens
cttttgggtgtggtgtcaccagc

SEQ ID NO: 4186905 - DNA, 15 bp, Homo sapiens
cttttggtggagtca

SEQ ID NO: 4186906 - DNA, 23 bp, Homo sapiens
cttttgtgtacagtgtgtaaagt

SEQ ID NO: 4186907 - DNA, 23 bp, Homo sapiens
ctttttcaacttggaaaaagaaa

SEQ ID NO: 4186908 - DNA, 13 bp, Homo sapiens
cttttttcctcct

SEQ ID NO: 4186909 - DNA, 14 bp, Homo sapiens
ctttttttctctcc

SEQ ID NO: 4186910 - DNA, 16 bp, Homo sapiens
cttttttttaataagg

SEQ ID NO: 4186911 - DNA, 17 bp, Homo sapiens
cttttttttaataagga

SEQ ID NO: 4186912 - DNA, 22 bp, Homo sapiens
gaaaaaagttcaatgttcagtt

SEQ ID NO: 4186913 - DNA, 23 bp, Homo sapiens
gaaaaacaaactcgttttttaca

SEQ ID NO: 4186914 - DNA, 23 bp, Homo sapiens
gaaaaacacggcagctgtagctc

SEQ ID NO: 4186915 - DNA, 12 bp, Homo sapiens
gaaaaatgctgc

SEQ ID NO: 4186916 - DNA, 13 bp, Homo sapiens
gaaaacaaaactg

SEQ ID NO: 4186917 - DNA, 22 bp, Homo sapiens
gaaaacgttgacccctttcccc

SEQ ID NO: 4186918 - DNA, 23 bp, Homo sapiens
gaaaacgttgacccctttccccc

SEQ ID NO: 4186919 - DNA, 20 bp, Homo sapiens
gaaaactcttggcctctgct

SEQ ID NO: 4186920 - DNA, 18 bp, Homo sapiens
gaaaactgaaaatctaat

SEQ ID NO: 4186921 - DNA, 20 bp, Homo sapiens
gaaaactgaaaatctaatat

SEQ ID NO: 4186922 - DNA, 12 bp, Homo sapiens
gaaaagaggagt

SEQ ID NO: 4186923 - DNA, 21 bp, Homo sapiens
gaaaagaggtggattcctggg

SEQ ID NO: 4186924 - DNA, 15 bp, Homo sapiens
gaaaagctgcctctg

SEQ ID NO: 4186925 - DNA, 23 bp, Homo sapiens
gaaaaggtttatgaaaaagaaga

SEQ ID NO: 4186926 - DNA, 15 bp, Homo sapiens
gaaaagtgttattat

SEQ ID NO: 4186927 - DNA, 21 bp, Homo sapiens
gaaaatctaatattaaaaata

SEQ ID NO: 4186928 - DNA, 12 bp, Homo sapiens
gaaaattagtaa

SEQ ID NO: 4186929 - DNA, 22 bp, Homo sapiens
gaaaattattccttgctttcat

SEQ ID NO: 4186930 - DNA, 13 bp, Homo sapiens
gaaacaaagggga

SEQ ID NO: 4186931 - DNA, 15 bp, Homo sapiens
gaaacacaaatgggg

SEQ ID NO: 4186932 - DNA, 15 bp, Homo sapiens
gaaaccaaagccagg

SEQ ID NO: 4186933 - DNA, 21 bp, Homo sapiens
gaaaccacacttcttgaaaca

SEQ ID NO: 4186934 - DNA, 14 bp, Homo sapiens
gaaacccaaggaac

SEQ ID NO: 4186935 - DNA, 18 bp, Homo sapiens
gaaacctgaaaaaaagtt

SEQ ID NO: 4186936 - DNA, 19 bp, Homo sapiens
gaaacgaatgtttcaaatc

SEQ ID NO: 4186937 - DNA, 19 bp, Homo sapiens
gaaactttgatctctgctt

SEQ ID NO: 4186938 - DNA, 17 bp, Homo sapiens
gaaacttttttatttaa

SEQ ID NO: 4186939 - DNA, 18 bp, Homo sapiens
gaaagaaaatgtctgttt

SEQ ID NO: 4186940 - DNA, 17 bp, Homo sapiens
gaaagacaggctgagct

SEQ ID NO: 4186941 - DNA, 21 bp, Homo sapiens
gaaagacatcacatccctctc

SEQ ID NO: 4186942 - DNA, 10 bp, Homo sapiens
gaaagagacc

SEQ ID NO: 4186943 - DNA, 13 bp, Homo sapiens
gaaagagagtacc

SEQ ID NO: 4186944 - DNA, 23 bp, Homo sapiens
gaaagatttgtgaactggaagaa

SEQ ID NO: 4186945 - DNA, 18 bp, Homo sapiens
gaaagcatcacctcaggc

SEQ ID NO: 4186946 - DNA, 19 bp, Homo sapiens
gaaagcatcacctcaggcc

SEQ ID NO: 4186947 - DNA, 15 bp, Homo sapiens
gaaagcctctgctgc

SEQ ID NO: 4186948 - DNA, 15 bp, Homo sapiens
gaaagcctctggaaa

SEQ ID NO: 4186949 - DNA, 14 bp, Homo sapiens
gaaagccttctttt

SEQ ID NO: 4186950 - DNA, 21 bp, Homo sapiens
gaaagctgagaccctcgccac

SEQ ID NO: 4186951 - DNA, 19 bp, Homo sapiens
gaaaggctcagtctcagga

SEQ ID NO: 4186952 - DNA, 22 bp, Homo sapiens
gaaaggctcagtctcaggagca

SEQ ID NO: 4186953 - DNA, 17 bp, Homo sapiens
gaaagggaagcctgact

SEQ ID NO: 4186954 - DNA, 19 bp, Homo sapiens
gaaagggagggcccctcat

SEQ ID NO: 4186955 - DNA, 13 bp, Homo sapiens
gaaaggtttcaag

SEQ ID NO: 4186956 - DNA, 14 bp, Homo sapiens
gaaaggtttcaaga

SEQ ID NO: 4186957 - DNA, 21 bp, Homo sapiens
gaaaggtttcaagacttgata

SEQ ID NO: 4186958 - DNA, 22 bp, Homo sapiens
gaaagtgcagaatcaacttgaa

SEQ ID NO: 4186959 - DNA, 14 bp, Homo sapiens
gaaagttcagccag

SEQ ID NO: 4186960 - DNA, 19 bp, Homo sapiens
gaaataaacctggagatga

SEQ ID NO: 4186961 - DNA, 20 bp, Homo sapiens
gaaataaacctggagatgat

SEQ ID NO: 4186962 - DNA, 22 bp, Homo sapiens
gaaataaacctggagatgatga

SEQ ID NO: 4186963 - DNA, 23 bp, Homo sapiens
gaaataaacctggagatgatgat

SEQ ID NO: 4186964 - DNA, 18 bp, Homo sapiens
gaaatagacagtatattt

SEQ ID NO: 4186965 - DNA, 16 bp, Homo sapiens
gaaatatagttctgat

SEQ ID NO: 4186966 - DNA, 24 bp, Homo sapiens
gaaatatcctttggaacaattatt

SEQ ID NO: 4186967 - DNA, 15 bp, Homo sapiens
gaaatcaacttgctt

SEQ ID NO: 4186968 - DNA, 23 bp, Homo sapiens
gaaatctggcttctggccaggaa

SEQ ID NO: 4186969 - DNA, 17 bp, Homo sapiens
gaaatggtatgagctga

SEQ ID NO: 4186970 - DNA, 23 bp, Homo sapiens
gaaatgtgtgttgtaacaaatat

SEQ ID NO: 4186971 - DNA, 13 bp, Homo sapiens
gaaatttaaacta

SEQ ID NO: 4186972 - DNA, 21 bp, Homo sapiens
gaaatttattagttaatatat

SEQ ID NO: 4186973 - DNA, 14 bp, Homo sapiens
gaaatttgatttct

SEQ ID NO: 4186974 - DNA, 13 bp, Homo sapiens
gaaattttgttaa

SEQ ID NO: 4186975 - DNA, 15 bp, Homo sapiens
gaacaacaacaacaa

SEQ ID NO: 4186976 - DNA, 20 bp, Homo sapiens
gaacaacaacaacaataaca

SEQ ID NO: 4186977 - DNA, 16 bp, Homo sapiens
gaacaagcattctcct

SEQ ID NO: 4186978 - DNA, 18 bp, Homo sapiens
gaacactagacaagccag

SEQ ID NO: 4186979 - DNA, 23 bp, Homo sapiens
gaacagaacatagacagaagaaa

SEQ ID NO: 4186980 - DNA, 23 bp, Homo sapiens
gaacagctcttcactcagccaca

SEQ ID NO: 4186981 - DNA, 21 bp, Homo sapiens
gaacatctcactttgccccag

SEQ ID NO: 4186982 - DNA, 19 bp, Homo sapiens
gaaccacaagagatcagca

SEQ ID NO: 4186983 - DNA, 23 bp, Homo sapiens
gaaccacagatgtgtctgggaga

SEQ ID NO: 4186984 - DNA, 12 bp, Homo sapiens
gaaccactgtgg

SEQ ID NO: 4186985 - DNA, 14 bp, Homo sapiens
gaaccactgtggcc

SEQ ID NO: 4186986 - DNA, 11 bp, Homo sapiens
gaaccaggagg

SEQ ID NO: 4186987 - DNA, 20 bp, Homo sapiens
gaaccattcccaagccatgg

SEQ ID NO: 4186988 - DNA, 16 bp, Homo sapiens
gaacccagagtcagga

SEQ ID NO: 4186989 - DNA, 14 bp, Homo sapiens
gaacccagctctca

SEQ ID NO: 4186990 - DNA, 18 bp, Homo sapiens
gaacccagctctcagggc

SEQ ID NO: 4186991 - DNA, 19 bp, Homo sapiens
gaacccctgtgtccctttt

SEQ ID NO: 4186992 - DNA, 19 bp, Homo sapiens
gaacctaattcaattcaaa

SEQ ID NO: 4186993 - DNA, 11 bp, Homo sapiens
gaacctcaggc

SEQ ID NO: 4186994 - DNA, 15 bp, Homo sapiens
gaacctgatgagcaa

SEQ ID NO: 4186995 - DNA, 20 bp, Homo sapiens
gaacgcaacttaggatggct

SEQ ID NO: 4186996 - DNA, 15 bp, Homo sapiens
gaacgttgccacacc

SEQ ID NO: 4186997 - DNA, 23 bp, Homo sapiens
gaactaggtttaaaacagcctgg

SEQ ID NO: 4186998 - DNA, 19 bp, Homo sapiens
gaactggctcctttgcctc

SEQ ID NO: 4186999 - DNA, 22 bp, Homo sapiens
gaactggctcctttgcctctgc

SEQ ID NO: 4187000 - DNA, 20 bp, Homo sapiens
gaactggttcaagagacact

SEQ ID NO: 4187001 - DNA, 13 bp, Homo sapiens
gaacttctaatat

SEQ ID NO: 4187002 - DNA, 14 bp, Homo sapiens
gaacttgaggacac

SEQ ID NO: 4187003 - DNA, 15 bp, Homo sapiens
gaacttgaggacaca

SEQ ID NO: 4187004 - DNA, 21 bp, Homo sapiens
gaactttctcttcatactttt

SEQ ID NO: 4187005 - DNA, 13 bp, Homo sapiens
gaagaaaaagaag

SEQ ID NO: 4187006 - DNA, 13 bp, Homo sapiens
gaagaaaagcact

SEQ ID NO: 4187007 - DNA, 19 bp, Homo sapiens
gaagaaagaacggaagaag

SEQ ID NO: 4187008 - DNA, 23 bp, Homo sapiens
gaagaagaggaggaagactctgg

SEQ ID NO: 4187009 - DNA, 19 bp, Homo sapiens
gaagaagtttcatcatttt

SEQ ID NO: 4187010 - DNA, 18 bp, Homo sapiens
gaagaatgggctgcagaa

SEQ ID NO: 4187011 - DNA, 17 bp, Homo sapiens
gaagacagaagtttgca

SEQ ID NO: 4187012 - DNA, 14 bp, Homo sapiens
gaagaccacatcca

SEQ ID NO: 4187013 - DNA, 20 bp, Homo sapiens
gaagaccacatccacacacg

SEQ ID NO: 4187014 - DNA, 21 bp, Homo sapiens
gaagaccacatccacacacgc

SEQ ID NO: 4187015 - DNA, 15 bp, Homo sapiens
gaagactctggagcc

SEQ ID NO: 4187016 - DNA, 16 bp, Homo sapiens
gaagactctggagcca

SEQ ID NO: 4187017 - DNA, 23 bp, Homo sapiens
gaagactctggagccaaggcaga

SEQ ID NO: 4187018 - DNA, 12 bp, Homo sapiens
gaagagaaattt

SEQ ID NO: 4187019 - DNA, 14 bp, Homo sapiens
gaagagaaggagca

SEQ ID NO: 4187020 - DNA, 18 bp, Homo sapiens
gaagagacaggagggcaa

SEQ ID NO: 4187021 - DNA, 15 bp, Homo sapiens
gaagagaccacagca

SEQ ID NO: 4187022 - DNA, 15 bp, Homo sapiens
gaagaggagggacct

SEQ ID NO: 4187023 - DNA, 16 bp, Homo sapiens
gaagataattttatgt

SEQ ID NO: 4187024 - DNA, 13 bp, Homo sapiens
gaagatgaaagag

SEQ ID NO: 4187025 - DNA, 17 bp, Homo sapiens
gaagatgaaagaggagg

SEQ ID NO: 4187026 - DNA, 11 bp, Homo sapiens
gaagattaaaa

SEQ ID NO: 4187027 - DNA, 21 bp, Homo sapiens
gaagattaaaaccacagaaca

SEQ ID NO: 4187028 - DNA, 20 bp, Homo sapiens
gaagcaacctcagtaattta

SEQ ID NO: 4187029 - DNA, 22 bp, Homo sapiens
gaagcaactccgtgtgcctggg

SEQ ID NO: 4187030 - DNA, 14 bp, Homo sapiens
gaagcaagcagggg

SEQ ID NO: 4187031 - DNA, 15 bp, Homo sapiens
gaagcaagcaggggt

SEQ ID NO: 4187032 - DNA, 22 bp, Homo sapiens
gaagcacactgcagggctgctg

SEQ ID NO: 4187033 - DNA, 23 bp, Homo sapiens
gaagcacactgcagggctgctgt

SEQ ID NO: 4187034 - DNA, 23 bp, Homo sapiens
gaagcaggttgaggggctcctgg

SEQ ID NO: 4187035 - DNA, 15 bp, Homo sapiens
gaagccactgaagct

SEQ ID NO: 4187036 - DNA, 12 bp, Homo sapiens
gaagcctgaggc

SEQ ID NO: 4187037 - DNA, 20 bp, Homo sapiens
gaagcctgttttgttggaag

SEQ ID NO: 4187038 - DNA, 15 bp, Homo sapiens
gaagcgggtggtggc

SEQ ID NO: 4187039 - DNA, 15 bp, Homo sapiens
gaagctttgaaggcc

SEQ ID NO: 4187040 - DNA, 14 bp, Homo sapiens
gaagctttggccct

SEQ ID NO: 4187041 - DNA, 14 bp, Homo sapiens
gaagctttggtgag

SEQ ID NO: 4187042 - DNA, 20 bp, Homo sapiens
gaagctttggtgagaacctg

SEQ ID NO: 4187043 - DNA, 15 bp, Homo sapiens
gaaggaactctggct

SEQ ID NO: 4187044 - DNA, 23 bp, Homo sapiens
gaaggaactctggcttccaggta

SEQ ID NO: 4187045 - DNA, 18 bp, Homo sapiens
gaaggaaggcagggagga

SEQ ID NO: 4187046 - DNA, 20 bp, Homo sapiens
gaaggaaggcagggaggagg

SEQ ID NO: 4187047 - DNA, 22 bp, Homo sapiens
gaaggaaggctccatctccagt

SEQ ID NO: 4187048 - DNA, 15 bp, Homo sapiens
gaaggaggtgaggga

SEQ ID NO: 4187049 - DNA, 15 bp, Homo sapiens
gaaggatagcctcag

SEQ ID NO: 4187050 - DNA, 19 bp, Homo sapiens
gaaggatagcctcagccac

SEQ ID NO: 4187051 - DNA, 16 bp, Homo sapiens
gaaggctggctgggca

SEQ ID NO: 4187052 - DNA, 19 bp, Homo sapiens
gaaggcttgttgtgctttt

SEQ ID NO: 4187053 - DNA, 17 bp, Homo sapiens
gaagggaccttgaaggg

SEQ ID NO: 4187054 - DNA, 19 bp, Homo sapiens
gaagggcatccttctgcct

SEQ ID NO: 4187055 - DNA, 19 bp, Homo sapiens
gaaggggacgcgggctgtg

SEQ ID NO: 4187056 - DNA, 20 bp, Homo sapiens
gaaggggacgcgggctgtgc

SEQ ID NO: 4187057 - DNA, 18 bp, Homo sapiens
gaagggggtccacccagc

SEQ ID NO: 4187058 - DNA, 22 bp, Homo sapiens
gaagggtggtctgagcaccccc

SEQ ID NO: 4187059 - DNA, 18 bp, Homo sapiens
gaagggttggtgggctgg

SEQ ID NO: 4187060 - DNA, 21 bp, Homo sapiens
gaagggttggtgggctggccc

SEQ ID NO: 4187061 - DNA, 22 bp, Homo sapiens
gaagggttggtgggctggccca

SEQ ID NO: 4187062 - DNA, 23 bp, Homo sapiens
gaagggttggtgggctggcccag

SEQ ID NO: 4187063 - DNA, 19 bp, Homo sapiens
gaaggtatacctgggaaga

SEQ ID NO: 4187064 - DNA, 21 bp, Homo sapiens
gaaggtcactcttcctgcaag

SEQ ID NO: 4187065 - DNA, 20 bp, Homo sapiens
gaaggtttggtgtgtggaga

SEQ ID NO: 4187066 - DNA, 18 bp, Homo sapiens
gaagtaggaaggaaaaaa

SEQ ID NO: 4187067 - DNA, 19 bp, Homo sapiens
gaagtagtttgtataactt

SEQ ID NO: 4187068 - DNA, 13 bp, Homo sapiens
gaagtatgtgtgg

SEQ ID NO: 4187069 - DNA, 11 bp, Homo sapiens
gaagtatttta

SEQ ID NO: 4187070 - DNA, 19 bp, Homo sapiens
gaagtcaaaccttaagata

SEQ ID NO: 4187071 - DNA, 17 bp, Homo sapiens
gaagtccctaggaggga

SEQ ID NO: 4187072 - DNA, 21 bp, Homo sapiens
gaagtgaccaaattgggagat

SEQ ID NO: 4187073 - DNA, 19 bp, Homo sapiens
gaagttagctttaacttaa

SEQ ID NO: 4187074 - DNA, 13 bp, Homo sapiens
gaagttttcagga

SEQ ID NO: 4187075 - DNA, 13 bp, Homo sapiens
gaataaagcaggg

SEQ ID NO: 4187076 - DNA, 12 bp, Homo sapiens
gaataaatgttc

SEQ ID NO: 4187077 - DNA, 13 bp, Homo sapiens
gaataaatgttca

SEQ ID NO: 4187078 - DNA, 17 bp, Homo sapiens
gaataagaaagtttcac

SEQ ID NO: 4187079 - DNA, 19 bp, Homo sapiens
gaataaggtacaagaagca

SEQ ID NO: 4187080 - DNA, 13 bp, Homo sapiens
gaataagtattct

SEQ ID NO: 4187081 - DNA, 17 bp, Homo sapiens
gaataagtattcttcat

SEQ ID NO: 4187082 - DNA, 21 bp, Homo sapiens
gaataatgccttgtatggtgt

SEQ ID NO: 4187083 - DNA, 19 bp, Homo sapiens
gaatagcgaatcatctcaa

SEQ ID NO: 4187084 - DNA, 17 bp, Homo sapiens
gaatatgactgttttta

SEQ ID NO: 4187085 - DNA, 19 bp, Homo sapiens
gaatatttcaaatgaacac

SEQ ID NO: 4187086 - DNA, 23 bp, Homo sapiens
gaatcaagagggcagcccccact

SEQ ID NO: 4187087 - DNA, 22 bp, Homo sapiens
gaatcaaggaatcctgagtctg

SEQ ID NO: 4187088 - DNA, 23 bp, Homo sapiens
gaatcactgtattttcattttaa

SEQ ID NO: 4187089 - DNA, 12 bp, Homo sapiens
gaatccctgcag

SEQ ID NO: 4187090 - DNA, 16 bp, Homo sapiens
gaatcctgctgccaga

SEQ ID NO: 4187091 - DNA, 17 bp, Homo sapiens
gaatcctgctgccagag

SEQ ID NO: 4187092 - DNA, 18 bp, Homo sapiens
gaatcctgctgccagaga

SEQ ID NO: 4187093 - DNA, 23 bp, Homo sapiens
gaatctcagttgattttctggat

SEQ ID NO: 4187094 - DNA, 22 bp, Homo sapiens
gaatcttaaggtgtagccacac

SEQ ID NO: 4187095 - DNA, 15 bp, Homo sapiens
gaatgaaaactcatt

SEQ ID NO: 4187096 - DNA, 15 bp, Homo sapiens
gaatgacctgcagtc

SEQ ID NO: 4187097 - DNA, 16 bp, Homo sapiens
gaatgatttttgctat

SEQ ID NO: 4187098 - DNA, 20 bp, Homo sapiens
gaatgccttccgggccgggc

SEQ ID NO: 4187099 - DNA, 17 bp, Homo sapiens
gaatggggatccagtta

SEQ ID NO: 4187100 - DNA, 15 bp, Homo sapiens
gaatggtcagttgta

SEQ ID NO: 4187101 - DNA, 13 bp, Homo sapiens
gaatggtccaggg

SEQ ID NO: 4187102 - DNA, 19 bp, Homo sapiens
gaatgtgataaggaaatca

SEQ ID NO: 4187103 - DNA, 15 bp, Homo sapiens
gaattaatgacagaa

SEQ ID NO: 4187104 - DNA, 21 bp, Homo sapiens
gaattatttttgagcaggagc

SEQ ID NO: 4187105 - DNA, 22 bp, Homo sapiens
gaattatttttgagcaggagca

SEQ ID NO: 4187106 - DNA, 19 bp, Homo sapiens
gaattgagtgtttaaagtt

SEQ ID NO: 4187107 - DNA, 16 bp, Homo sapiens
gaattgggaagctggg

SEQ ID NO: 4187108 - DNA, 14 bp, Homo sapiens
gaattgtatcattt

SEQ ID NO: 4187109 - DNA, 17 bp, Homo sapiens
gaattgtccatgtgctt

SEQ ID NO: 4187110 - DNA, 17 bp, Homo sapiens
gaatttattattgttct

SEQ ID NO: 4187111 - DNA, 11 bp, Homo sapiens
gaatttctgat

SEQ ID NO: 4187112 - DNA, 22 bp, Homo sapiens
gaatttgtaagtttatgtctaa

SEQ ID NO: 4187113 - DNA, 18 bp, Homo sapiens
gaatttttaaacaagtat

SEQ ID NO: 4187114 - DNA, 12 bp, Homo sapiens
gacaactggcag

SEQ ID NO: 4187115 - DNA, 15 bp, Homo sapiens
gacaactggcaggca

SEQ ID NO: 4187116 - DNA, 18 bp, Homo sapiens
gacaactggcaggcaggc

SEQ ID NO: 4187117 - DNA, 12 bp, Homo sapiens
gacaagaagctg

SEQ ID NO: 4187118 - DNA, 14 bp, Homo sapiens
gacaagtaatcact

SEQ ID NO: 4187119 - DNA, 23 bp, Homo sapiens
gacaagtaatcactaacccgttt

SEQ ID NO: 4187120 - DNA, 15 bp, Homo sapiens
gacacaaacacacac

SEQ ID NO: 4187121 - DNA, 22 bp, Homo sapiens
gacacaaggtgatttcagactg

SEQ ID NO: 4187122 - DNA, 22 bp, Homo sapiens
gacacacgtatttatatttgga

SEQ ID NO: 4187123 - DNA, 20 bp, Homo sapiens
gacacagacccacacatgtt

SEQ ID NO: 4187124 - DNA, 15 bp, Homo sapiens
gacacaggctcagca

SEQ ID NO: 4187125 - DNA, 18 bp, Homo sapiens
gacacaggctcagcatgc

SEQ ID NO: 4187126 - DNA, 21 bp, Homo sapiens
gacaccccccgccccccacct

SEQ ID NO: 4187127 - DNA, 19 bp, Homo sapiens
gacaccccttatccaggac

SEQ ID NO: 4187128 - DNA, 21 bp, Homo sapiens
gacaccccttatccaggactc

SEQ ID NO: 4187129 - DNA, 14 bp, Homo sapiens
gacacctgccctgc

SEQ ID NO: 4187130 - DNA, 18 bp, Homo sapiens
gacactagttcagaggaa

SEQ ID NO: 4187131 - DNA, 22 bp, Homo sapiens
gacactagttcagaggaagcac

SEQ ID NO: 4187132 - DNA, 12 bp, Homo sapiens
gacactgggaga

SEQ ID NO: 4187133 - DNA, 15 bp, Homo sapiens
gacagaagtttgcac

SEQ ID NO: 4187134 - DNA, 19 bp, Homo sapiens
gacagaccccttggctttt

SEQ ID NO: 4187135 - DNA, 16 bp, Homo sapiens
gacagatgaggctttc

SEQ ID NO: 4187136 - DNA, 12 bp, Homo sapiens
gacagcaggtgg

SEQ ID NO: 4187137 - DNA, 10 bp, Homo sapiens
gacagcccag

SEQ ID NO: 4187138 - DNA, 12 bp, Homo sapiens
gacagccctgcc

SEQ ID NO: 4187139 - DNA, 15 bp, Homo sapiens
gacagccctgcctat

SEQ ID NO: 4187140 - DNA, 17 bp, Homo sapiens
gacagccctgcctatcc

SEQ ID NO: 4187141 - DNA, 21 bp, Homo sapiens
gacagccctgcctatcctctg

SEQ ID NO: 4187142 - DNA, 23 bp, Homo sapiens
gacaggacagtgcttcagcctga

SEQ ID NO: 4187143 - DNA, 21 bp, Homo sapiens
gacaggaggggcccacaatgg

SEQ ID NO: 4187144 - DNA, 18 bp, Homo sapiens
gacaggatgtgtttgctt

SEQ ID NO: 4187145 - DNA, 18 bp, Homo sapiens
gacaggtaagtggcagga

SEQ ID NO: 4187146 - DNA, 13 bp, Homo sapiens
gacagtcctggga

SEQ ID NO: 4187147 - DNA, 23 bp, Homo sapiens
gacagtcctgggagaacctcagg

SEQ ID NO: 4187148 - DNA, 17 bp, Homo sapiens
gacagtgctgccctgcg

SEQ ID NO: 4187149 - DNA, 18 bp, Homo sapiens
gacatggaagattagagg

SEQ ID NO: 4187150 - DNA, 20 bp, Homo sapiens
gacatggaagattagaggtt

SEQ ID NO: 4187151 - DNA, 13 bp, Homo sapiens
gacatggaaggtt

SEQ ID NO: 4187152 - DNA, 18 bp, Homo sapiens
gacatgtttttgttttct

SEQ ID NO: 4187153 - DNA, 22 bp, Homo sapiens
gacatttctctaactcctgcca

SEQ ID NO: 4187154 - DNA, 14 bp, Homo sapiens
gaccactggccctg

SEQ ID NO: 4187155 - DNA, 14 bp, Homo sapiens
gaccaggactatag

SEQ ID NO: 4187156 - DNA, 22 bp, Homo sapiens
gaccaggggtgatttcagagag

SEQ ID NO: 4187157 - DNA, 16 bp, Homo sapiens
gaccataacagccaac

SEQ ID NO: 4187158 - DNA, 19 bp, Homo sapiens
gaccataacagccaacagg

SEQ ID NO: 4187159 - DNA, 17 bp, Homo sapiens
gaccatcgtccagccct

SEQ ID NO: 4187160 - DNA, 18 bp, Homo sapiens
gaccatcgtccagccctc

SEQ ID NO: 4187161 - DNA, 19 bp, Homo sapiens
gaccatcgtccagccctcc

SEQ ID NO: 4187162 - DNA, 20 bp, Homo sapiens
gaccatcgtccagccctcct

SEQ ID NO: 4187163 - DNA, 18 bp, Homo sapiens
gacccacctggagcccgc

SEQ ID NO: 4187164 - DNA, 15 bp, Homo sapiens
gacccagctcctctg

SEQ ID NO: 4187165 - DNA, 22 bp, Homo sapiens
gacccagtgagattacagagga

SEQ ID NO: 4187166 - DNA, 20 bp, Homo sapiens
gacccatttaatttctattg

SEQ ID NO: 4187167 - DNA, 18 bp, Homo sapiens
gaccccaaagagcctgga

SEQ ID NO: 4187168 - DNA, 20 bp, Homo sapiens
gaccccaaagagcctggaga

SEQ ID NO: 4187169 - DNA, 23 bp, Homo sapiens
gaccccaaagagcctggagaagc

SEQ ID NO: 4187170 - DNA, 14 bp, Homo sapiens
gaccccatctcatt

SEQ ID NO: 4187171 - DNA, 17 bp, Homo sapiens
gaccccttcctttcctc

SEQ ID NO: 4187172 - DNA, 18 bp, Homo sapiens
gaccccttcctttcctct

SEQ ID NO: 4187173 - DNA, 12 bp, Homo sapiens
gaccccttggct

SEQ ID NO: 4187174 - DNA, 12 bp, Homo sapiens
gacccctttccc

SEQ ID NO: 4187175 - DNA, 18 bp, Homo sapiens
gaccctaagaccggcggc

SEQ ID NO: 4187176 - DNA, 22 bp, Homo sapiens
gaccctccaccgcagaaggaag

SEQ ID NO: 4187177 - DNA, 21 bp, Homo sapiens
gaccctcctccactccacctc

SEQ ID NO: 4187178 - DNA, 20 bp, Homo sapiens
gaccctgcgaaggggccctg

SEQ ID NO: 4187179 - DNA, 20 bp, Homo sapiens
gaccgcgtagagagccgggc

SEQ ID NO: 4187180 - DNA, 17 bp, Homo sapiens
gaccgcttcccagaggc

SEQ ID NO: 4187181 - DNA, 15 bp, Homo sapiens
gacctactgaaccca

SEQ ID NO: 4187182 - DNA, 22 bp, Homo sapiens
gacctataaaacaaagtctggg

SEQ ID NO: 4187183 - DNA, 20 bp, Homo sapiens
gacctgaatgacctgcagtc

SEQ ID NO: 4187184 - DNA, 18 bp, Homo sapiens
gacctgaggctcctgtgc

SEQ ID NO: 4187185 - DNA, 16 bp, Homo sapiens
gacctgcagtcagggc

SEQ ID NO: 4187186 - DNA, 17 bp, Homo sapiens
gacctgggcccacagag

SEQ ID NO: 4187187 - DNA, 18 bp, Homo sapiens
gacctgggcccacagagc

SEQ ID NO: 4187188 - DNA, 21 bp, Homo sapiens
gacctgggcccacagagcctg

SEQ ID NO: 4187189 - DNA, 22 bp, Homo sapiens
gacctgggcccacagagcctgg

SEQ ID NO: 4187190 - DNA, 23 bp, Homo sapiens
gacctgggcccacagagcctggc

SEQ ID NO: 4187191 - DNA, 17 bp, Homo sapiens
gacctttcagctgtgaa

SEQ ID NO: 4187192 - DNA, 15 bp, Homo sapiens
gacgaacggaagggt

SEQ ID NO: 4187193 - DNA, 23 bp, Homo sapiens
gacgatgccgtgtgtctcgtctc

SEQ ID NO: 4187194 - DNA, 14 bp, Homo sapiens
gacgccgagggcag

SEQ ID NO: 4187195 - DNA, 17 bp, Homo sapiens
gacggctggacctgcac

SEQ ID NO: 4187196 - DNA, 14 bp, Homo sapiens
gacgtcaagtctcc

SEQ ID NO: 4187197 - DNA, 17 bp, Homo sapiens
gacgttggttctgcact

SEQ ID NO: 4187198 - DNA, 20 bp, Homo sapiens
gactaatggcatgagaaata

SEQ ID NO: 4187199 - DNA, 16 bp, Homo sapiens
gactattttttaataa

SEQ ID NO: 4187200 - DNA, 18 bp, Homo sapiens
gactattttttaataaaa

SEQ ID NO: 4187201 - DNA, 15 bp, Homo sapiens
gactcaggagcctcc

SEQ ID NO: 4187202 - DNA, 15 bp, Homo sapiens
gactcatcttttgaa

SEQ ID NO: 4187203 - DNA, 13 bp, Homo sapiens
gactctaagctgt

SEQ ID NO: 4187204 - DNA, 19 bp, Homo sapiens
gactctaagctgtgtgcag

SEQ ID NO: 4187205 - DNA, 21 bp, Homo sapiens
gactctatactaccctgggct

SEQ ID NO: 4187206 - DNA, 12 bp, Homo sapiens
gactctctgtga

SEQ ID NO: 4187207 - DNA, 22 bp, Homo sapiens
gactctgaggctctttctgggc

SEQ ID NO: 4187208 - DNA, 21 bp, Homo sapiens
gactctgccttttttcacagc

SEQ ID NO: 4187209 - DNA, 14 bp, Homo sapiens
gactctggagccaa

SEQ ID NO: 4187210 - DNA, 20 bp, Homo sapiens
gactctgggtccctcggagc

SEQ ID NO: 4187211 - DNA, 22 bp, Homo sapiens
gactctgtcaatttccctgact

SEQ ID NO: 4187212 - DNA, 12 bp, Homo sapiens
gactcttcctgc

SEQ ID NO: 4187213 - DNA, 14 bp, Homo sapiens
gactgagcacctgc

SEQ ID NO: 4187214 - DNA, 22 bp, Homo sapiens
gactgagtcctcgtagccatct

SEQ ID NO: 4187215 - DNA, 24 bp, Homo sapiens
gactgcacacagctaggcatgcct

SEQ ID NO: 4187216 - DNA, 20 bp, Homo sapiens
gactgcgatcttcagagcag

SEQ ID NO: 4187217 - DNA, 21 bp, Homo sapiens
gactgcgggatggtcctgggg

SEQ ID NO: 4187218 - DNA, 14 bp, Homo sapiens
gactgctacctctg

SEQ ID NO: 4187219 - DNA, 21 bp, Homo sapiens
gactgctacctctgagaagac

SEQ ID NO: 4187220 - DNA, 12 bp, Homo sapiens
gactgctgggac

SEQ ID NO: 4187221 - DNA, 14 bp, Homo sapiens
gactgctgggactg

SEQ ID NO: 4187222 - DNA, 16 bp, Homo sapiens
gactggctggctgcag

SEQ ID NO: 4187223 - DNA, 22 bp, Homo sapiens
gactgggggcacctgaccagaa

SEQ ID NO: 4187224 - DNA, 22 bp, Homo sapiens
gactggtgctataggctggaga

SEQ ID NO: 4187225 - DNA, 21 bp, Homo sapiens
gactgttcttggtaactgatt

SEQ ID NO: 4187226 - DNA, 19 bp, Homo sapiens
gactgtttttatatgcaca

SEQ ID NO: 4187227 - DNA, 15 bp, Homo sapiens
gacttactgtttctt

SEQ ID NO: 4187228 - DNA, 22 bp, Homo sapiens
gacttactgtttcttaccttaa

SEQ ID NO: 4187229 - DNA, 22 bp, Homo sapiens
gacttcctggtgaggcccagcc

SEQ ID NO: 4187230 - DNA, 23 bp, Homo sapiens
gacttcctggtgaggcccagcct

SEQ ID NO: 4187231 - DNA, 14 bp, Homo sapiens
gacttgaataaagt

SEQ ID NO: 4187232 - DNA, 17 bp, Homo sapiens
gacttggcaacagaagc

SEQ ID NO: 4187233 - DNA, 17 bp, Homo sapiens
gagaaaaactttcattt

SEQ ID NO: 4187234 - DNA, 13 bp, Homo sapiens
gagaaatgtttaa

SEQ ID NO: 4187235 - DNA, 14 bp, Homo sapiens
gagaaattctgtgg

SEQ ID NO: 4187236 - DNA, 13 bp, Homo sapiens
gagaaatttttat

SEQ ID NO: 4187237 - DNA, 19 bp, Homo sapiens
gagaaatttttatttttga

SEQ ID NO: 4187238 - DNA, 14 bp, Homo sapiens
gagaacctcaggct

SEQ ID NO: 4187239 - DNA, 21 bp, Homo sapiens
gagaacctgggttgcagacag

SEQ ID NO: 4187240 - DNA, 21 bp, Homo sapiens
gagaagaaagaacggaagaag

SEQ ID NO: 4187241 - DNA, 17 bp, Homo sapiens
gagaagagaacctcaaa

SEQ ID NO: 4187242 - DNA, 21 bp, Homo sapiens
gagaagaggctggtgctgtgg

SEQ ID NO: 4187243 - DNA, 13 bp, Homo sapiens
gagaaggaacagg

SEQ ID NO: 4187244 - DNA, 19 bp, Homo sapiens
gagaagggggattggaggg

SEQ ID NO: 4187245 - DNA, 21 bp, Homo sapiens
gagaagggggattggagggaa

SEQ ID NO: 4187246 - DNA, 19 bp, Homo sapiens
gagaaggtattagcaaagc

SEQ ID NO: 4187247 - DNA, 17 bp, Homo sapiens
gagaaggttggaggtgg

SEQ ID NO: 4187248 - DNA, 21 bp, Homo sapiens
gagaagtttctggccctggct

SEQ ID NO: 4187249 - DNA, 16 bp, Homo sapiens
gagaagttttgttttt

SEQ ID NO: 4187250 - DNA, 21 bp, Homo sapiens
gagaattgtatcatttgaaca

SEQ ID NO: 4187251 - DNA, 9 bp, Homo sapiens
gagacagag

SEQ ID NO: 4187252 - DNA, 17 bp, Homo sapiens
gagacagccctgcctat

SEQ ID NO: 4187253 - DNA, 12 bp, Homo sapiens
gagacaggaagg

SEQ ID NO: 4187254 - DNA, 15 bp, Homo sapiens
gagacaggagggcaa

SEQ ID NO: 4187255 - DNA, 23 bp, Homo sapiens
gagaccacagcaattggctcctc

SEQ ID NO: 4187256 - DNA, 12 bp, Homo sapiens
gagaccacctct

SEQ ID NO: 4187257 - DNA, 11 bp, Homo sapiens
gagaccagcac

SEQ ID NO: 4187258 - DNA, 14 bp, Homo sapiens
gagaccagcctggc

SEQ ID NO: 4187259 - DNA, 14 bp, Homo sapiens
gagaccccttcctt

SEQ ID NO: 4187260 - DNA, 20 bp, Homo sapiens
gagaccccttcctttcctct

SEQ ID NO: 4187261 - DNA, 22 bp, Homo sapiens
gagacggagaccccggtggcag

SEQ ID NO: 4187262 - DNA, 14 bp, Homo sapiens
gagacggctggacc

SEQ ID NO: 4187263 - DNA, 16 bp, Homo sapiens
gagacggctggacctg

SEQ ID NO: 4187264 - DNA, 12 bp, Homo sapiens
gagactctggcc

SEQ ID NO: 4187265 - DNA, 13 bp, Homo sapiens
gagactctggcct

SEQ ID NO: 4187266 - DNA, 16 bp, Homo sapiens
gagactggtcctgtgt

SEQ ID NO: 4187267 - DNA, 23 bp, Homo sapiens
gagactggtcctgtgtgcagtga

SEQ ID NO: 4187268 - DNA, 22 bp, Homo sapiens
gagacttttaatcagacaaagt

SEQ ID NO: 4187269 - DNA, 15 bp, Homo sapiens
gagagaaccaggagg

SEQ ID NO: 4187270 - DNA, 16 bp, Homo sapiens
gagagacgtgtacata

SEQ ID NO: 4187271 - DNA, 20 bp, Homo sapiens
gagagacgtgtacatagtgt

SEQ ID NO: 4187272 - DNA, 19 bp, Homo sapiens
gagagagttgctggctatt

SEQ ID NO: 4187273 - DNA, 18 bp, Homo sapiens
gagagcaaacataggaat

SEQ ID NO: 4187274 - DNA, 10 bp, Homo sapiens
gagagcagct

SEQ ID NO: 4187275 - DNA, 11 bp, Homo sapiens
gagagcagctg

SEQ ID NO: 4187276 - DNA, 12 bp, Homo sapiens
gagagcctggca

SEQ ID NO: 4187277 - DNA, 16 bp, Homo sapiens
gagagcctggcaaggc

SEQ ID NO: 4187278 - DNA, 18 bp, Homo sapiens
gagagcgcctcttcctct

SEQ ID NO: 4187279 - DNA, 21 bp, Homo sapiens
gagagcgggtgggtgggtgtg

SEQ ID NO: 4187280 - DNA, 17 bp, Homo sapiens
gagaggaaaagctgcct

SEQ ID NO: 4187281 - DNA, 20 bp, Homo sapiens
gagaggaaaagctgcctctg

SEQ ID NO: 4187282 - DNA, 16 bp, Homo sapiens
gagaggatgcagaggg

SEQ ID NO: 4187283 - DNA, 16 bp, Homo sapiens
gagaggcacctgctgg

SEQ ID NO: 4187284 - DNA, 14 bp, Homo sapiens
gagagggcagaggg

SEQ ID NO: 4187285 - DNA, 22 bp, Homo sapiens
gagaggtttgtcaacacaaaga

SEQ ID NO: 4187286 - DNA, 19 bp, Homo sapiens
gagagtacagtgagccaag

SEQ ID NO: 4187287 - DNA, 21 bp, Homo sapiens
gagagtcctttgggattctag

SEQ ID NO: 4187288 - DNA, 16 bp, Homo sapiens
gagatacatacagaat

SEQ ID NO: 4187289 - DNA, 16 bp, Homo sapiens
gagatagcagaggaaa

SEQ ID NO: 4187290 - DNA, 16 bp, Homo sapiens
gagatatgcagaagga

SEQ ID NO: 4187291 - DNA, 13 bp, Homo sapiens
gagatccagcaca

SEQ ID NO: 4187292 - DNA, 17 bp, Homo sapiens
gagatctccctccaggg

SEQ ID NO: 4187293 - DNA, 15 bp, Homo sapiens
gagatgatgatgatg

SEQ ID NO: 4187294 - DNA, 14 bp, Homo sapiens
gagatgcagaggta

SEQ ID NO: 4187295 - DNA, 17 bp, Homo sapiens
gagatgcatgcgcaggc

SEQ ID NO: 4187296 - DNA, 19 bp, Homo sapiens
gagatgctggcttgggcag

SEQ ID NO: 4187297 - DNA, 14 bp, Homo sapiens
gagatgtaattgtt

SEQ ID NO: 4187298 - DNA, 15 bp, Homo sapiens
gagattaattttaac

SEQ ID NO: 4187299 - DNA, 22 bp, Homo sapiens
gagatttaacactaaaattcca

SEQ ID NO: 4187300 - DNA, 21 bp, Homo sapiens
gagcaaacaccagtgaggctc

SEQ ID NO: 4187301 - DNA, 16 bp, Homo sapiens
gagcaaacataggaat

SEQ ID NO: 4187302 - DNA, 19 bp, Homo sapiens
gagcaaagtctaaagttta

SEQ ID NO: 4187303 - DNA, 20 bp, Homo sapiens
gagcaacagagtgagaccct

SEQ ID NO: 4187304 - DNA, 14 bp, Homo sapiens
gagcaacctcttca

SEQ ID NO: 4187305 - DNA, 12 bp, Homo sapiens
gagcaagagctg

SEQ ID NO: 4187306 - DNA, 20 bp, Homo sapiens
gagcaaggacaacctgcccc

SEQ ID NO: 4187307 - DNA, 20 bp, Homo sapiens
gagcacagaggggctagggg

SEQ ID NO: 4187308 - DNA, 13 bp, Homo sapiens
gagcactgctcca

SEQ ID NO: 4187309 - DNA, 20 bp, Homo sapiens
gagcagagctgatggagaag

SEQ ID NO: 4187310 - DNA, 15 bp, Homo sapiens
gagcagctggctctc

SEQ ID NO: 4187311 - DNA, 16 bp, Homo sapiens
gagcagctggctctcc

SEQ ID NO: 4187312 - DNA, 15 bp, Homo sapiens
gagcaggagcagaaa

SEQ ID NO: 4187313 - DNA, 15 bp, Homo sapiens
gagcaggccacgctc

SEQ ID NO: 4187314 - DNA, 18 bp, Homo sapiens
gagcaggctcagactctg

SEQ ID NO: 4187315 - DNA, 13 bp, Homo sapiens
gagcatcacagaa

SEQ ID NO: 4187316 - DNA, 17 bp, Homo sapiens
gagcattacgtgagcca

SEQ ID NO: 4187317 - DNA, 21 bp, Homo sapiens
gagccaagatcgcgccactgc

SEQ ID NO: 4187318 - DNA, 15 bp, Homo sapiens
gagccaatagactga

SEQ ID NO: 4187319 - DNA, 20 bp, Homo sapiens
gagccaccagggcactgtct

SEQ ID NO: 4187320 - DNA, 19 bp, Homo sapiens
gagccaccgcgcccagccc

SEQ ID NO: 4187321 - DNA, 15 bp, Homo sapiens
gagccactacctttg

SEQ ID NO: 4187322 - DNA, 15 bp, Homo sapiens
gagccaggctctgcc

SEQ ID NO: 4187323 - DNA, 12 bp, Homo sapiens
gagccatgtttc

SEQ ID NO: 4187324 - DNA, 21 bp, Homo sapiens
gagccattttggggggccccc

SEQ ID NO: 4187325 - DNA, 23 bp, Homo sapiens
gagccattttggggggcccccct

SEQ ID NO: 4187326 - DNA, 17 bp, Homo sapiens
gagccccccgtgtggct

SEQ ID NO: 4187327 - DNA, 13 bp, Homo sapiens
gagccctggcagg

SEQ ID NO: 4187328 - DNA, 23 bp, Homo sapiens
gagccctggcaggatgaccctgc

SEQ ID NO: 4187329 - DNA, 20 bp, Homo sapiens
gagccgagatcacgccactg

SEQ ID NO: 4187330 - DNA, 21 bp, Homo sapiens
gagcctagaacatccctgggc

SEQ ID NO: 4187331 - DNA, 22 bp, Homo sapiens
gagcctagaacatccctgggca

SEQ ID NO: 4187332 - DNA, 23 bp, Homo sapiens
gagcctagaacatccctgggcaa

SEQ ID NO: 4187333 - DNA, 14 bp, Homo sapiens
gagcctccacttag

SEQ ID NO: 4187334 - DNA, 16 bp, Homo sapiens
gagcctcctagggctt

SEQ ID NO: 4187335 - DNA, 13 bp, Homo sapiens
gagcctgcctcct

SEQ ID NO: 4187336 - DNA, 12 bp, Homo sapiens
gagcctggagaa

SEQ ID NO: 4187337 - DNA, 13 bp, Homo sapiens
gagcctggagaag

SEQ ID NO: 4187338 - DNA, 14 bp, Homo sapiens
gagcctggagaagc

SEQ ID NO: 4187339 - DNA, 12 bp, Homo sapiens
gagcctggcaag

SEQ ID NO: 4187340 - DNA, 11 bp, Homo sapiens
gagcctggctt

SEQ ID NO: 4187341 - DNA, 13 bp, Homo sapiens
gagccttcaagtg

SEQ ID NO: 4187342 - DNA, 17 bp, Homo sapiens
gagcctttggatgacca

SEQ ID NO: 4187343 - DNA, 18 bp, Homo sapiens
gagcgcacctgccccctg

SEQ ID NO: 4187344 - DNA, 20 bp, Homo sapiens
gagcgcacctgccccctggt

SEQ ID NO: 4187345 - DNA, 13 bp, Homo sapiens
gagcgcctcttcc

SEQ ID NO: 4187346 - DNA, 17 bp, Homo sapiens
gagcgcctcttcctctg

SEQ ID NO: 4187347 - DNA, 15 bp, Homo sapiens
gagcggagcttgcct

SEQ ID NO: 4187348 - DNA, 19 bp, Homo sapiens
gagcggagcttgcctgcct

SEQ ID NO: 4187349 - DNA, 15 bp, Homo sapiens
gagctactctcttgc

SEQ ID NO: 4187350 - DNA, 20 bp, Homo sapiens
gagctactctcttgccagca

SEQ ID NO: 4187351 - DNA, 14 bp, Homo sapiens
gagctgaccagccg

SEQ ID NO: 4187352 - DNA, 14 bp, Homo sapiens
gagctgctctgcta

SEQ ID NO: 4187353 - DNA, 23 bp, Homo sapiens
gagctgctggctgacctgggccc

SEQ ID NO: 4187354 - DNA, 17 bp, Homo sapiens
gagctggaaataaacct

SEQ ID NO: 4187355 - DNA, 20 bp, Homo sapiens
gagctggcaaaggtggctct

SEQ ID NO: 4187356 - DNA, 20 bp, Homo sapiens
gagctggcattggtctgctg

SEQ ID NO: 4187357 - DNA, 16 bp, Homo sapiens
gagctggctgtcttcc

SEQ ID NO: 4187358 - DNA, 19 bp, Homo sapiens
gagctggggctgccagcct

SEQ ID NO: 4187359 - DNA, 19 bp, Homo sapiens
gagctgttggggcaggggt

SEQ ID NO: 4187360 - DNA, 16 bp, Homo sapiens
gagcttgcctgcctgc

SEQ ID NO: 4187361 - DNA, 16 bp, Homo sapiens
gagcttggtggctgag

SEQ ID NO: 4187362 - DNA, 14 bp, Homo sapiens
gaggaaagacacag

SEQ ID NO: 4187363 - DNA, 15 bp, Homo sapiens
gaggaaagacacaga

SEQ ID NO: 4187364 - DNA, 13 bp, Homo sapiens
gaggaagactctg

SEQ ID NO: 4187365 - DNA, 18 bp, Homo sapiens
gaggaatatgactgtttt

SEQ ID NO: 4187366 - DNA, 19 bp, Homo sapiens
gaggaatatgactgttttt

SEQ ID NO: 4187367 - DNA, 23 bp, Homo sapiens
gaggactgatgaatgacaacatt

SEQ ID NO: 4187368 - DNA, 20 bp, Homo sapiens
gaggaggcagagaagaaaga

SEQ ID NO: 4187369 - DNA, 15 bp, Homo sapiens
gaggaggtggcagcc

SEQ ID NO: 4187370 - DNA, 20 bp, Homo sapiens
gaggaggtggcagccctgta

SEQ ID NO: 4187371 - DNA, 22 bp, Homo sapiens
gaggaggtggcagccctgtagg

SEQ ID NO: 4187372 - DNA, 17 bp, Homo sapiens
gaggatcactggagccc

SEQ ID NO: 4187373 - DNA, 22 bp, Homo sapiens
gaggatcacttgggcccaggag

SEQ ID NO: 4187374 - DNA, 23 bp, Homo sapiens
gaggatcacttgggcccaggagg

SEQ ID NO: 4187375 - DNA, 14 bp, Homo sapiens
gaggatgcagaggg

SEQ ID NO: 4187376 - DNA, 18 bp, Homo sapiens
gaggatttaactgtgaac

SEQ ID NO: 4187377 - DNA, 22 bp, Homo sapiens
gaggattttccagttctgacac

SEQ ID NO: 4187378 - DNA, 13 bp, Homo sapiens
gaggattttgagt

SEQ ID NO: 4187379 - DNA, 17 bp, Homo sapiens
gaggcaagagacagaat

SEQ ID NO: 4187380 - DNA, 18 bp, Homo sapiens
gaggcagagaagaaagaa

SEQ ID NO: 4187381 - DNA, 23 bp, Homo sapiens
gaggcagcgtgaaagcagatgag

SEQ ID NO: 4187382 - DNA, 13 bp, Homo sapiens
gaggcagtaggaa

SEQ ID NO: 4187383 - DNA, 21 bp, Homo sapiens
gaggcagtgctgatccggctg

SEQ ID NO: 4187384 - DNA, 14 bp, Homo sapiens
gaggcatagaggga

SEQ ID NO: 4187385 - DNA, 20 bp, Homo sapiens
gaggcatagagggagaggaa

SEQ ID NO: 4187386 - DNA, 23 bp, Homo sapiens
gaggcatagagggagaggaagca

SEQ ID NO: 4187387 - DNA, 18 bp, Homo sapiens
gaggccaggaatctgcca

SEQ ID NO: 4187388 - DNA, 14 bp, Homo sapiens
gaggcccagcctgt

SEQ ID NO: 4187389 - DNA, 19 bp, Homo sapiens
gaggcctcgtaccagccag

SEQ ID NO: 4187390 - DNA, 20 bp, Homo sapiens
gaggcctcgtaccagccagg

SEQ ID NO: 4187391 - DNA, 14 bp, Homo sapiens
gaggcgaataaatg

SEQ ID NO: 4187392 - DNA, 14 bp, Homo sapiens
gaggcgcgtctgcc

SEQ ID NO: 4187393 - DNA, 16 bp, Homo sapiens
gaggcggctccaggtc

SEQ ID NO: 4187394 - DNA, 18 bp, Homo sapiens
gaggcggctccaggtccg

SEQ ID NO: 4187395 - DNA, 14 bp, Homo sapiens
gaggctctattgag

SEQ ID NO: 4187396 - DNA, 18 bp, Homo sapiens
gaggctcttccatcccca

SEQ ID NO: 4187397 - DNA, 16 bp, Homo sapiens
gaggctgcagcgagct

SEQ ID NO: 4187398 - DNA, 17 bp, Homo sapiens
gaggcttcttgcccaga

SEQ ID NO: 4187399 - DNA, 14 bp, Homo sapiens
gaggctttccatgg

SEQ ID NO: 4187400 - DNA, 15 bp, Homo sapiens
gagggagaggaagca

SEQ ID NO: 4187401 - DNA, 16 bp, Homo sapiens
gagggagaggaagcac

SEQ ID NO: 4187402 - DNA, 19 bp, Homo sapiens
gagggagccatcccttccc

SEQ ID NO: 4187403 - DNA, 15 bp, Homo sapiens
gagggagctgctggc

SEQ ID NO: 4187404 - DNA, 15 bp, Homo sapiens
gagggatgagagtgg

SEQ ID NO: 4187405 - DNA, 17 bp, Homo sapiens
gagggatgctgcctgag

SEQ ID NO: 4187406 - DNA, 21 bp, Homo sapiens
gagggatgtaactattgaatt

SEQ ID NO: 4187407 - DNA, 22 bp, Homo sapiens
gagggattttagcctcttccct

SEQ ID NO: 4187408 - DNA, 22 bp, Homo sapiens
gagggcaagggccatgctgaag

SEQ ID NO: 4187409 - DNA, 21 bp, Homo sapiens
gagggcaggtgccctctgctc

SEQ ID NO: 4187410 - DNA, 18 bp, Homo sapiens
gagggccaagacttggca

SEQ ID NO: 4187411 - DNA, 16 bp, Homo sapiens
gagggcccaggcaggc

SEQ ID NO: 4187412 - DNA, 15 bp, Homo sapiens
gaggggacccagctc

SEQ ID NO: 4187413 - DNA, 18 bp, Homo sapiens
gaggggatggcagacagt

SEQ ID NO: 4187414 - DNA, 14 bp, Homo sapiens
gaggggcagggaga

SEQ ID NO: 4187415 - DNA, 13 bp, Homo sapiens
gaggggctcctgg

SEQ ID NO: 4187416 - DNA, 14 bp, Homo sapiens
gaggggtaggcaga

SEQ ID NO: 4187417 - DNA, 20 bp, Homo sapiens
gaggggtgacagtggaggaa

SEQ ID NO: 4187418 - DNA, 22 bp, Homo sapiens
gagggtaacagaagaggaggga

SEQ ID NO: 4187419 - DNA, 19 bp, Homo sapiens
gagggtgggagagcccagc

SEQ ID NO: 4187420 - DNA, 22 bp, Homo sapiens
gaggtaaaagtgtgagcagtga

SEQ ID NO: 4187421 - DNA, 21 bp, Homo sapiens
gaggtagcgagctgctctgct

SEQ ID NO: 4187422 - DNA, 15 bp, Homo sapiens
gaggtggcagccctg

SEQ ID NO: 4187423 - DNA, 16 bp, Homo sapiens
gaggtggcagccctgt

SEQ ID NO: 4187424 - DNA, 19 bp, Homo sapiens
gaggttgcagggagccgag

SEQ ID NO: 4187425 - DNA, 15 bp, Homo sapiens
gaggttgcagtgagc

SEQ ID NO: 4187426 - DNA, 16 bp, Homo sapiens
gaggtttgtcaacaca

SEQ ID NO: 4187427 - DNA, 19 bp, Homo sapiens
gaggtttgtcaacacaaag

SEQ ID NO: 4187428 - DNA, 19 bp, Homo sapiens
gagtacagacgtctcaaga

SEQ ID NO: 4187429 - DNA, 18 bp, Homo sapiens
gagtagatggtgaaattt

SEQ ID NO: 4187430 - DNA, 22 bp, Homo sapiens
gagtagcaagttctagagaaga

SEQ ID NO: 4187431 - DNA, 23 bp, Homo sapiens
gagtatctcggacctttcagctg

SEQ ID NO: 4187432 - DNA, 12 bp, Homo sapiens
gagtcagccctt

SEQ ID NO: 4187433 - DNA, 13 bp, Homo sapiens
gagtcaggaagag

SEQ ID NO: 4187434 - DNA, 18 bp, Homo sapiens
gagtctacctcttcagta

SEQ ID NO: 4187435 - DNA, 22 bp, Homo sapiens
gagtggatctccaaggaccagg

SEQ ID NO: 4187436 - DNA, 20 bp, Homo sapiens
gagtgtgcgtgtgtgcatgt

SEQ ID NO: 4187437 - DNA, 18 bp, Homo sapiens
gagttacagcgagaggca

SEQ ID NO: 4187438 - DNA, 19 bp, Homo sapiens
gagttacagcgagaggcag

SEQ ID NO: 4187439 - DNA, 16 bp, Homo sapiens
gagttataaaaataca

SEQ ID NO: 4187440 - DNA, 15 bp, Homo sapiens
gagttccatgaagac

SEQ ID NO: 4187441 - DNA, 17 bp, Homo sapiens
gagttcgagaccagcct

SEQ ID NO: 4187442 - DNA, 15 bp, Homo sapiens
gagtttcgaggtaga

SEQ ID NO: 4187443 - DNA, 23 bp, Homo sapiens
gagttttcacctggtatccatta

SEQ ID NO: 4187444 - DNA, 18 bp, Homo sapiens
gagttttccatggcagga

SEQ ID NO: 4187445 - DNA, 17 bp, Homo sapiens
gataaagattttttaat

SEQ ID NO: 4187446 - DNA, 15 bp, Homo sapiens
gataacaagatcttt

SEQ ID NO: 4187447 - DNA, 17 bp, Homo sapiens
gataacccttattccat

SEQ ID NO: 4187448 - DNA, 23 bp, Homo sapiens
gataacctatatgatttatagtt

SEQ ID NO: 4187449 - DNA, 21 bp, Homo sapiens
gataactatttacatataata

SEQ ID NO: 4187450 - DNA, 13 bp, Homo sapiens
gataaggaaatca

SEQ ID NO: 4187451 - DNA, 19 bp, Homo sapiens
gataaggcagttgaacctg

SEQ ID NO: 4187452 - DNA, 17 bp, Homo sapiens
gataaggtaaaatgcca

SEQ ID NO: 4187453 - DNA, 18 bp, Homo sapiens
gataatcttcggccaatt

SEQ ID NO: 4187454 - DNA, 16 bp, Homo sapiens
gataatgataacttgt

SEQ ID NO: 4187455 - DNA, 16 bp, Homo sapiens
gataatgtcaaaatca

SEQ ID NO: 4187456 - DNA, 12 bp, Homo sapiens
gataattttaaa

SEQ ID NO: 4187457 - DNA, 15 bp, Homo sapiens
gatacgctggtctgg

SEQ ID NO: 4187458 - DNA, 20 bp, Homo sapiens
gatactaaaagttcttctcc

SEQ ID NO: 4187459 - DNA, 20 bp, Homo sapiens
gatacttaagtgctgcaatt

SEQ ID NO: 4187460 - DNA, 17 bp, Homo sapiens
gatactttaatttttat

SEQ ID NO: 4187461 - DNA, 22 bp, Homo sapiens
gatactttaatttttataaata

SEQ ID NO: 4187462 - DNA, 13 bp, Homo sapiens
gatagaaatgcca

SEQ ID NO: 4187463 - DNA, 19 bp, Homo sapiens
gatagaaatgccaagcact

SEQ ID NO: 4187464 - DNA, 19 bp, Homo sapiens
gatagacagtgctgccctg

SEQ ID NO: 4187465 - DNA, 12 bp, Homo sapiens
gatagagtgatt

SEQ ID NO: 4187466 - DNA, 17 bp, Homo sapiens
gatagcatttttgattt

SEQ ID NO: 4187467 - DNA, 23 bp, Homo sapiens
gatagcatttttgatttatgcat

SEQ ID NO: 4187468 - DNA, 15 bp, Homo sapiens
gatagcctcagccac

SEQ ID NO: 4187469 - DNA, 15 bp, Homo sapiens
gatagtatcttttaa

SEQ ID NO: 4187470 - DNA, 13 bp, Homo sapiens
gatatatatcata

SEQ ID NO: 4187471 - DNA, 22 bp, Homo sapiens
gatatatatttactaaaagaat

SEQ ID NO: 4187472 - DNA, 19 bp, Homo sapiens
gatatcaccatgatttaat

SEQ ID NO: 4187473 - DNA, 22 bp, Homo sapiens
gatatcaccatgatttaatcca

SEQ ID NO: 4187474 - DNA, 19 bp, Homo sapiens
gatatgtaaaacatttatt

SEQ ID NO: 4187475 - DNA, 13 bp, Homo sapiens
gatcaagtccaga

SEQ ID NO: 4187476 - DNA, 19 bp, Homo sapiens
gatcacagcgtttcaggaa

SEQ ID NO: 4187477 - DNA, 14 bp, Homo sapiens
gatcacctgaggtt

SEQ ID NO: 4187478 - DNA, 23 bp, Homo sapiens
gatcacgccactgcactccagcc

SEQ ID NO: 4187479 - DNA, 14 bp, Homo sapiens
gatcactggagccc

SEQ ID NO: 4187480 - DNA, 17 bp, Homo sapiens
gatcactggagcccagg

SEQ ID NO: 4187481 - DNA, 16 bp, Homo sapiens
gatcacttgggcccag

SEQ ID NO: 4187482 - DNA, 17 bp, Homo sapiens
gatcagcagtggcagga

SEQ ID NO: 4187483 - DNA, 11 bp, Homo sapiens
gatcagcctcc

SEQ ID NO: 4187484 - DNA, 21 bp, Homo sapiens
gatcagcctccgccattccaa

SEQ ID NO: 4187485 - DNA, 16 bp, Homo sapiens
gatcaggaagagaagg

SEQ ID NO: 4187486 - DNA, 17 bp, Homo sapiens
gatcaggaagagaagga

SEQ ID NO: 4187487 - DNA, 19 bp, Homo sapiens
gatcattacatggctgtgg

SEQ ID NO: 4187488 - DNA, 22 bp, Homo sapiens
gatcattacatggctgtggttc

SEQ ID NO: 4187489 - DNA, 19 bp, Homo sapiens
gatcattttagacactggg

SEQ ID NO: 4187490 - DNA, 17 bp, Homo sapiens
gatccaggattggcctg

SEQ ID NO: 4187491 - DNA, 20 bp, Homo sapiens
gatccatttggacaaaatgg

SEQ ID NO: 4187492 - DNA, 13 bp, Homo sapiens
gatccggctgctc

SEQ ID NO: 4187493 - DNA, 21 bp, Homo sapiens
gatccggctgctcctccagcc

SEQ ID NO: 4187494 - DNA, 17 bp, Homo sapiens
gatcctcaaacacacaa

SEQ ID NO: 4187495 - DNA, 23 bp, Homo sapiens
gatcgcgccactacactccagcc

SEQ ID NO: 4187496 - DNA, 16 bp, Homo sapiens
gatctccaaggaccag

SEQ ID NO: 4187497 - DNA, 12 bp, Homo sapiens
gatctctgctta

SEQ ID NO: 4187498 - DNA, 22 bp, Homo sapiens
gatctgaaattggtgggaagca

SEQ ID NO: 4187499 - DNA, 21 bp, Homo sapiens
gatctgggaggtctccactga

SEQ ID NO: 4187500 - DNA, 14 bp, Homo sapiens
gatcttcagagcag

SEQ ID NO: 4187501 - DNA, 17 bp, Homo sapiens
gatcttccgtggtcaga

SEQ ID NO: 4187502 - DNA, 15 bp, Homo sapiens
gatctttcaggaaag

SEQ ID NO: 4187503 - DNA, 15 bp, Homo sapiens
gatctttgactgaaa

SEQ ID NO: 4187504 - DNA, 16 bp, Homo sapiens
gatctttgactgaaaa

SEQ ID NO: 4187505 - DNA, 23 bp, Homo sapiens
gatgaaattttctagactttctg

SEQ ID NO: 4187506 - DNA, 18 bp, Homo sapiens
gatgaccagaacaaggtt

SEQ ID NO: 4187507 - DNA, 20 bp, Homo sapiens
gatgactcactccattccta

SEQ ID NO: 4187508 - DNA, 12 bp, Homo sapiens
gatgactgagtc

SEQ ID NO: 4187509 - DNA, 17 bp, Homo sapiens
gatgactgagtcctcgt

SEQ ID NO: 4187510 - DNA, 18 bp, Homo sapiens
gatgagagtggcttaaaa

SEQ ID NO: 4187511 - DNA, 18 bp, Homo sapiens
gatgagttaactgtgaaa

SEQ ID NO: 4187512 - DNA, 11 bp, Homo sapiens
gatgcagaggg

SEQ ID NO: 4187513 - DNA, 12 bp, Homo sapiens
gatgcagagggg

SEQ ID NO: 4187514 - DNA, 23 bp, Homo sapiens
gatgcagaggtaaaagtgtgagc

SEQ ID NO: 4187515 - DNA, 13 bp, Homo sapiens
gatgcatgcgcag

SEQ ID NO: 4187516 - DNA, 22 bp, Homo sapiens
gatgcccagagggcccaggcag

SEQ ID NO: 4187517 - DNA, 17 bp, Homo sapiens
gatgcggggcagagcca

SEQ ID NO: 4187518 - DNA, 14 bp, Homo sapiens
gatgctgcctgagt

SEQ ID NO: 4187519 - DNA, 15 bp, Homo sapiens
gatggaaagaaagca

SEQ ID NO: 4187520 - DNA, 14 bp, Homo sapiens
gatggagaaggaag

SEQ ID NO: 4187521 - DNA, 16 bp, Homo sapiens
gatggagaaggaaggc

SEQ ID NO: 4187522 - DNA, 17 bp, Homo sapiens
gatggaggccgagccaa

SEQ ID NO: 4187523 - DNA, 21 bp, Homo sapiens
gatggcaccatccaccctgca

SEQ ID NO: 4187524 - DNA, 19 bp, Homo sapiens
gatggcccagcaggcaggc

SEQ ID NO: 4187525 - DNA, 13 bp, Homo sapiens
gatgggattctgg

SEQ ID NO: 4187526 - DNA, 21 bp, Homo sapiens
gatgggtctggctgagctgaa

SEQ ID NO: 4187527 - DNA, 22 bp, Homo sapiens
gatggtatctgggtaagaagaa

SEQ ID NO: 4187528 - DNA, 16 bp, Homo sapiens
gatgtaactattgaat

SEQ ID NO: 4187529 - DNA, 23 bp, Homo sapiens
gatgtaaggtaatttctgtgtat

SEQ ID NO: 4187530 - DNA, 21 bp, Homo sapiens
gatgtcaaagtgtaacagata

SEQ ID NO: 4187531 - DNA, 12 bp, Homo sapiens
gatgtcagcctt

SEQ ID NO: 4187532 - DNA, 14 bp, Homo sapiens
gatgtgtctgggag

SEQ ID NO: 4187533 - DNA, 15 bp, Homo sapiens
gatgtgtctgggaga

SEQ ID NO: 4187534 - DNA, 22 bp, Homo sapiens
gatgtgtctgggagagcctggc

SEQ ID NO: 4187535 - DNA, 14 bp, Homo sapiens
gatgtgtttgcttt

SEQ ID NO: 4187536 - DNA, 19 bp, Homo sapiens
gatgttgttactgattctc

SEQ ID NO: 4187537 - DNA, 10 bp, Homo sapiens
gatgtttgtt

SEQ ID NO: 4187538 - DNA, 14 bp, Homo sapiens
gattaaaggaagga

SEQ ID NO: 4187539 - DNA, 15 bp, Homo sapiens
gattaaaggaaggaa

SEQ ID NO: 4187540 - DNA, 13 bp, Homo sapiens
gattaacaaataa

SEQ ID NO: 4187541 - DNA, 14 bp, Homo sapiens
gattaacaaataaa

SEQ ID NO: 4187542 - DNA, 17 bp, Homo sapiens
gattaatacaatattaa

SEQ ID NO: 4187543 - DNA, 20 bp, Homo sapiens
gattacagacatgagccacc

SEQ ID NO: 4187544 - DNA, 23 bp, Homo sapiens
gattactactttgcctcttcagc

SEQ ID NO: 4187545 - DNA, 23 bp, Homo sapiens
gattatttgttatttgtacagtt

SEQ ID NO: 4187546 - DNA, 17 bp, Homo sapiens
gattcagagacttagaa

SEQ ID NO: 4187547 - DNA, 22 bp, Homo sapiens
gattcccaccaaggtcttcagc

SEQ ID NO: 4187548 - DNA, 13 bp, Homo sapiens
gattcccctccac

SEQ ID NO: 4187549 - DNA, 16 bp, Homo sapiens
gattcctgggcaagaa

SEQ ID NO: 4187550 - DNA, 16 bp, Homo sapiens
gattctcctgtcagag

SEQ ID NO: 4187551 - DNA, 22 bp, Homo sapiens
gattctgggaggaagcaggttg

SEQ ID NO: 4187552 - DNA, 13 bp, Homo sapiens
gattgaggcctgc

SEQ ID NO: 4187553 - DNA, 22 bp, Homo sapiens
gattgaggcctgccctcaggga

SEQ ID NO: 4187554 - DNA, 19 bp, Homo sapiens
gattgtataatgtgatttt

SEQ ID NO: 4187555 - DNA, 13 bp, Homo sapiens
gatttaacaaata

SEQ ID NO: 4187556 - DNA, 16 bp, Homo sapiens
gatttaacaaatacat

SEQ ID NO: 4187557 - DNA, 17 bp, Homo sapiens
gatttaacaaatacatt

SEQ ID NO: 4187558 - DNA, 20 bp, Homo sapiens
gatttatagtttgtacatgc

SEQ ID NO: 4187559 - DNA, 12 bp, Homo sapiens
gatttatttaaa

SEQ ID NO: 4187560 - DNA, 14 bp, Homo sapiens
gatttcaacatatc

SEQ ID NO: 4187561 - DNA, 17 bp, Homo sapiens
gatttcaacatatcatt

SEQ ID NO: 4187562 - DNA, 22 bp, Homo sapiens
gatttctccaggtttgctgtgt

SEQ ID NO: 4187563 - DNA, 18 bp, Homo sapiens
gatttgaagctgtaccca

SEQ ID NO: 4187564 - DNA, 13 bp, Homo sapiens
gatttggaagaga

SEQ ID NO: 4187565 - DNA, 14 bp, Homo sapiens
gatttgtgaactgg

SEQ ID NO: 4187566 - DNA, 17 bp, Homo sapiens
gattttagcctcttccc

SEQ ID NO: 4187567 - DNA, 20 bp, Homo sapiens
gattttctgctactttgctg

SEQ ID NO: 4187568 - DNA, 14 bp, Homo sapiens
gattttgagtatct

SEQ ID NO: 4187569 - DNA, 13 bp, Homo sapiens
gattttgcctgtg

SEQ ID NO: 4187570 - DNA, 12 bp, Homo sapiens
gatttttccttt

SEQ ID NO: 4187571 - DNA, 23 bp, Homo sapiens
gattttttttttttggtaattat

SEQ ID NO: 4187572 - DNA, 14 bp, Homo sapiens
gcaaaactgtgctt

SEQ ID NO: 4187573 - DNA, 16 bp, Homo sapiens
gcaaaagaagtaaaag

SEQ ID NO: 4187574 - DNA, 20 bp, Homo sapiens
gcaaaagcaagggaccttca

SEQ ID NO: 4187575 - DNA, 17 bp, Homo sapiens
gcaaaccatttcaaatg

SEQ ID NO: 4187576 - DNA, 16 bp, Homo sapiens
gcaaagaactgcccca

SEQ ID NO: 4187577 - DNA, 21 bp, Homo sapiens
gcaaagcaccagcttctccag

SEQ ID NO: 4187578 - DNA, 12 bp, Homo sapiens
gcaaagcctcct

SEQ ID NO: 4187579 - DNA, 16 bp, Homo sapiens
gcaaaggaaaccaaag

SEQ ID NO: 4187580 - DNA, 17 bp, Homo sapiens
gcaaaggaaaccaaagg

SEQ ID NO: 4187581 - DNA, 12 bp, Homo sapiens
gcaaattagtaa

SEQ ID NO: 4187582 - DNA, 13 bp, Homo sapiens
gcaaattagtaat

SEQ ID NO: 4187583 - DNA, 16 bp, Homo sapiens
gcaacaaatatttata

SEQ ID NO: 4187584 - DNA, 23 bp, Homo sapiens
gcaacaaatccatggacctatga

SEQ ID NO: 4187585 - DNA, 14 bp, Homo sapiens
gcaacagagtgaga

SEQ ID NO: 4187586 - DNA, 19 bp, Homo sapiens
gcaacctcagtaatttaga

SEQ ID NO: 4187587 - DNA, 18 bp, Homo sapiens
gcaacctcttcagctggg

SEQ ID NO: 4187588 - DNA, 18 bp, Homo sapiens
gcaagaacctaaagtagc

SEQ ID NO: 4187589 - DNA, 21 bp, Homo sapiens
gcaagaaggcaaaaatagttt

SEQ ID NO: 4187590 - DNA, 24 bp, Homo sapiens
gcaagaattataacagcaaggaaa

SEQ ID NO: 4187591 - DNA, 17 bp, Homo sapiens
gcaagacacaggctcag

SEQ ID NO: 4187592 - DNA, 15 bp, Homo sapiens
gcaagagaaaataaa

SEQ ID NO: 4187593 - DNA, 22 bp, Homo sapiens
gcaaggactacgttaagggaag

SEQ ID NO: 4187594 - DNA, 18 bp, Homo sapiens
gcaaggcatacctgtcct

SEQ ID NO: 4187595 - DNA, 13 bp, Homo sapiens
gcaagggaccttc

SEQ ID NO: 4187596 - DNA, 13 bp, Homo sapiens
gcaagggggcggg

SEQ ID NO: 4187597 - DNA, 18 bp, Homo sapiens
gcaagtggatggcccagc

SEQ ID NO: 4187598 - DNA, 20 bp, Homo sapiens
gcaagtggatggcccagcag

SEQ ID NO: 4187599 - DNA, 17 bp, Homo sapiens
gcaagttctagagaaga

SEQ ID NO: 4187600 - DNA, 20 bp, Homo sapiens
gcaagttctagagaagaggc

SEQ ID NO: 4187601 - DNA, 20 bp, Homo sapiens
gcaataagttccatgttaaa

SEQ ID NO: 4187602 - DNA, 18 bp, Homo sapiens
gcaatataaaaatgtgaa

SEQ ID NO: 4187603 - DNA, 13 bp, Homo sapiens
gcaatccatgtta

SEQ ID NO: 4187604 - DNA, 14 bp, Homo sapiens
gcaatgaaaccaaa

SEQ ID NO: 4187605 - DNA, 16 bp, Homo sapiens
gcaatgaaaccaaagc

SEQ ID NO: 4187606 - DNA, 19 bp, Homo sapiens
gcacaactcagtctgtggg

SEQ ID NO: 4187607 - DNA, 19 bp, Homo sapiens
gcacactgcagggctgctg

SEQ ID NO: 4187608 - DNA, 16 bp, Homo sapiens
gcacagatttcaacag

SEQ ID NO: 4187609 - DNA, 18 bp, Homo sapiens
gcacagcgcgggcggagg

SEQ ID NO: 4187610 - DNA, 16 bp, Homo sapiens
gcacaggctaattttt

SEQ ID NO: 4187611 - DNA, 14 bp, Homo sapiens
gcacagtgaatgtg

SEQ ID NO: 4187612 - DNA, 21 bp, Homo sapiens
gcacatgtctgtcctcagagc

SEQ ID NO: 4187613 - DNA, 18 bp, Homo sapiens
gcaccagcttctccaggc

SEQ ID NO: 4187614 - DNA, 16 bp, Homo sapiens
gcaccatcacacatgc

SEQ ID NO: 4187615 - DNA, 17 bp, Homo sapiens
gcaccccctcattcccc

SEQ ID NO: 4187616 - DNA, 21 bp, Homo sapiens
gcacctaaaccaccagtgccc

SEQ ID NO: 4187617 - DNA, 14 bp, Homo sapiens
gcacctgccagcct

SEQ ID NO: 4187618 - DNA, 22 bp, Homo sapiens
gcacctgccagcctggcttctg

SEQ ID NO: 4187619 - DNA, 15 bp, Homo sapiens
gcacctgccccctgg

SEQ ID NO: 4187620 - DNA, 16 bp, Homo sapiens
gcacctgccccctggt

SEQ ID NO: 4187621 - DNA, 23 bp, Homo sapiens
gcacctgctggaaaccacacttc

SEQ ID NO: 4187622 - DNA, 13 bp, Homo sapiens
gcaccttagtggc

SEQ ID NO: 4187623 - DNA, 16 bp, Homo sapiens
gcaccttagtggcttt

SEQ ID NO: 4187624 - DNA, 19 bp, Homo sapiens
gcactaaagtatgtaaagt

SEQ ID NO: 4187625 - DNA, 19 bp, Homo sapiens
gcactcacccatgtgccaa

SEQ ID NO: 4187626 - DNA, 16 bp, Homo sapiens
gcactccagcctgggc

SEQ ID NO: 4187627 - DNA, 19 bp, Homo sapiens
gcactcctcggtactccca

SEQ ID NO: 4187628 - DNA, 17 bp, Homo sapiens
gcactgatcaatccttc

SEQ ID NO: 4187629 - DNA, 15 bp, Homo sapiens
gcactgccctccgcc

SEQ ID NO: 4187630 - DNA, 22 bp, Homo sapiens
gcactgctaggcgagtgccagg

SEQ ID NO: 4187631 - DNA, 14 bp, Homo sapiens
gcactggccccacc

SEQ ID NO: 4187632 - DNA, 16 bp, Homo sapiens
gcactgtatgctggac

SEQ ID NO: 4187633 - DNA, 15 bp, Homo sapiens
gcactgtctgcgtga

SEQ ID NO: 4187634 - DNA, 23 bp, Homo sapiens
gcacttctttttctcgctgtcct

SEQ ID NO: 4187635 - DNA, 16 bp, Homo sapiens
gcactttaaccctctc

SEQ ID NO: 4187636 - DNA, 20 bp, Homo sapiens
gcactttaaccctctcttcc

SEQ ID NO: 4187637 - DNA, 21 bp, Homo sapiens
gcactttgggaggctgaggcg

SEQ ID NO: 4187638 - DNA, 22 bp, Homo sapiens
gcagaaaatcttttactagtgt

SEQ ID NO: 4187639 - DNA, 14 bp, Homo sapiens
gcagaaagattaaa

SEQ ID NO: 4187640 - DNA, 17 bp, Homo sapiens
gcagaactttttttgtg

SEQ ID NO: 4187641 - DNA, 22 bp, Homo sapiens
gcagaaggaagggcatccttct

SEQ ID NO: 4187642 - DNA, 17 bp, Homo sapiens
gcagacagtcaaggaga

SEQ ID NO: 4187643 - DNA, 17 bp, Homo sapiens
gcagaccgtgatttgga

SEQ ID NO: 4187644 - DNA, 17 bp, Homo sapiens
gcagaccttttttagga

SEQ ID NO: 4187645 - DNA, 22 bp, Homo sapiens
gcagacttgagtctgaggcccc

SEQ ID NO: 4187646 - DNA, 16 bp, Homo sapiens
gcagagagaagcctgt

SEQ ID NO: 4187647 - DNA, 22 bp, Homo sapiens
gcagagagcaggacaggagaca

SEQ ID NO: 4187648 - DNA, 14 bp, Homo sapiens
gcagagcaggggca

SEQ ID NO: 4187649 - DNA, 13 bp, Homo sapiens
gcagagctggggc

SEQ ID NO: 4187650 - DNA, 20 bp, Homo sapiens
gcagagctggggctgccagc

SEQ ID NO: 4187651 - DNA, 22 bp, Homo sapiens
gcagagctggggctgccagcct

SEQ ID NO: 4187652 - DNA, 12 bp, Homo sapiens
gcagaggaaaaa

SEQ ID NO: 4187653 - DNA, 19 bp, Homo sapiens
gcagaggacagtctggaga

SEQ ID NO: 4187654 - DNA, 22 bp, Homo sapiens
gcagaggacagtctggagaagg

SEQ ID NO: 4187655 - DNA, 12 bp, Homo sapiens
gcagaggcagcg

SEQ ID NO: 4187656 - DNA, 20 bp, Homo sapiens
gcagaggggctttctggaga

SEQ ID NO: 4187657 - DNA, 13 bp, Homo sapiens
gcagaggtaaaag

SEQ ID NO: 4187658 - DNA, 23 bp, Homo sapiens
gcagatcttccgtggtcagagtg

SEQ ID NO: 4187659 - DNA, 22 bp, Homo sapiens
gcagatgctgtcactggcagag

SEQ ID NO: 4187660 - DNA, 18 bp, Homo sapiens
gcagcactttaaccctct

SEQ ID NO: 4187661 - DNA, 18 bp, Homo sapiens
gcagcagttccatgaaga

SEQ ID NO: 4187662 - DNA, 20 bp, Homo sapiens
gcagccagcagttgtaaaat

SEQ ID NO: 4187663 - DNA, 23 bp, Homo sapiens
gcagccccgacccctgtccagcg

SEQ ID NO: 4187664 - DNA, 23 bp, Homo sapiens
gcagcctccctctgacctgcagg

SEQ ID NO: 4187665 - DNA, 22 bp, Homo sapiens
gcagcctggtagaattgggaag

SEQ ID NO: 4187666 - DNA, 22 bp, Homo sapiens
gcagcgagctatgatcgcgcca

SEQ ID NO: 4187667 - DNA, 24 bp, Homo sapiens
gcagcgagttgtggaaagcctctg

SEQ ID NO: 4187668 - DNA, 18 bp, Homo sapiens
gcagcgcagccgccgggc

SEQ ID NO: 4187669 - DNA, 16 bp, Homo sapiens
gcagctcaagagatcc

SEQ ID NO: 4187670 - DNA, 18 bp, Homo sapiens
gcagctggctctccacct

SEQ ID NO: 4187671 - DNA, 18 bp, Homo sapiens
gcagctgtagctcccgag

SEQ ID NO: 4187672 - DNA, 16 bp, Homo sapiens
gcaggaactcccagca

SEQ ID NO: 4187673 - DNA, 17 bp, Homo sapiens
gcaggaaggatggcaag

SEQ ID NO: 4187674 - DNA, 13 bp, Homo sapiens
gcaggaccaggac

SEQ ID NO: 4187675 - DNA, 14 bp, Homo sapiens
gcaggaccaggact

SEQ ID NO: 4187676 - DNA, 15 bp, Homo sapiens
gcaggaccctgtcag

SEQ ID NO: 4187677 - DNA, 18 bp, Homo sapiens
gcaggacccttaggaatc

SEQ ID NO: 4187678 - DNA, 15 bp, Homo sapiens
gcaggagcagaaaga

SEQ ID NO: 4187679 - DNA, 15 bp, Homo sapiens
gcaggcactgtggcc

SEQ ID NO: 4187680 - DNA, 17 bp, Homo sapiens
gcaggcaggctcccagg

SEQ ID NO: 4187681 - DNA, 12 bp, Homo sapiens
gcaggcatgccg

SEQ ID NO: 4187682 - DNA, 23 bp, Homo sapiens
gcaggctcccagggacacctggg

SEQ ID NO: 4187683 - DNA, 18 bp, Homo sapiens
gcagggaattaatgacag

SEQ ID NO: 4187684 - DNA, 15 bp, Homo sapiens
gcagggacacccccc

SEQ ID NO: 4187685 - DNA, 22 bp, Homo sapiens
gcagggacaccccccgcccccc

SEQ ID NO: 4187686 - DNA, 17 bp, Homo sapiens
gcagggacggggactgg

SEQ ID NO: 4187687 - DNA, 19 bp, Homo sapiens
gcagggagagcgcctcttc

SEQ ID NO: 4187688 - DNA, 14 bp, Homo sapiens
gcagggatttgagg

SEQ ID NO: 4187689 - DNA, 15 bp, Homo sapiens
gcagggatttgagga

SEQ ID NO: 4187690 - DNA, 12 bp, Homo sapiens
gcagggctgctg

SEQ ID NO: 4187691 - DNA, 13 bp, Homo sapiens
gcagggctgctgt

SEQ ID NO: 4187692 - DNA, 15 bp, Homo sapiens
gcagggctgctgtgg

SEQ ID NO: 4187693 - DNA, 22 bp, Homo sapiens
gcaggtagttggtgaacagaga

SEQ ID NO: 4187694 - DNA, 21 bp, Homo sapiens
gcaggtattttaactgtgtga

SEQ ID NO: 4187695 - DNA, 20 bp, Homo sapiens
gcaggtgcctggcttgctgt

SEQ ID NO: 4187696 - DNA, 16 bp, Homo sapiens
gcaggtggtcctgaga

SEQ ID NO: 4187697 - DNA, 16 bp, Homo sapiens
gcaggttgaggggctc

SEQ ID NO: 4187698 - DNA, 20 bp, Homo sapiens
gcaggttgaggggctcctgg

SEQ ID NO: 4187699 - DNA, 13 bp, Homo sapiens
gcagtaagcaggc

SEQ ID NO: 4187700 - DNA, 18 bp, Homo sapiens
gcagtaagtcttttttga

SEQ ID NO: 4187701 - DNA, 18 bp, Homo sapiens
gcagtagactcatctttt

SEQ ID NO: 4187702 - DNA, 21 bp, Homo sapiens
gcagtgaacacactcagcagc

SEQ ID NO: 4187703 - DNA, 18 bp, Homo sapiens
gcagtgacgtgcacctgt

SEQ ID NO: 4187704 - DNA, 14 bp, Homo sapiens
gcagtgagctgaga

SEQ ID NO: 4187705 - DNA, 15 bp, Homo sapiens
gcagtgagctgagat

SEQ ID NO: 4187706 - DNA, 16 bp, Homo sapiens
gcagtgagcttctatt

SEQ ID NO: 4187707 - DNA, 23 bp, Homo sapiens
gcagtgcaagagactctggcctc

SEQ ID NO: 4187708 - DNA, 21 bp, Homo sapiens
gcagtgctgatccggctgctc

SEQ ID NO: 4187709 - DNA, 22 bp, Homo sapiens
gcagtggaaaaatcagaagcac

SEQ ID NO: 4187710 - DNA, 16 bp, Homo sapiens
gcagtggctcacgcct

SEQ ID NO: 4187711 - DNA, 22 bp, Homo sapiens
gcagtgtggtctcttacatggc

SEQ ID NO: 4187712 - DNA, 21 bp, Homo sapiens
gcagtgttcctatttggggct

SEQ ID NO: 4187713 - DNA, 15 bp, Homo sapiens
gcagttgggagtgag

SEQ ID NO: 4187714 - DNA, 16 bp, Homo sapiens
gcataagattaaagga

SEQ ID NO: 4187715 - DNA, 23 bp, Homo sapiens
gcataagattaaaggaaggaaaa

SEQ ID NO: 4187716 - DNA, 19 bp, Homo sapiens
gcatacctgtcctagcagg

SEQ ID NO: 4187717 - DNA, 22 bp, Homo sapiens
gcatagaggtaccagcaatatg

SEQ ID NO: 4187718 - DNA, 23 bp, Homo sapiens
gcatagctgttttagctgaggga

SEQ ID NO: 4187719 - DNA, 23 bp, Homo sapiens
gcatatttatagcaatccatgtt

SEQ ID NO: 4187720 - DNA, 17 bp, Homo sapiens
gcatcacctcaggccag

SEQ ID NO: 4187721 - DNA, 14 bp, Homo sapiens
gcatccacgcacac

SEQ ID NO: 4187722 - DNA, 19 bp, Homo sapiens
gcatcccccagcactgatg

SEQ ID NO: 4187723 - DNA, 20 bp, Homo sapiens
gcatccttttctgcagaggg

SEQ ID NO: 4187724 - DNA, 13 bp, Homo sapiens
gcatctcattgta

SEQ ID NO: 4187725 - DNA, 14 bp, Homo sapiens
gcatgacactctag

SEQ ID NO: 4187726 - DNA, 14 bp, Homo sapiens
gcatgagaaataca

SEQ ID NO: 4187727 - DNA, 23 bp, Homo sapiens
gcatgcctgggaatcctgctgcc

SEQ ID NO: 4187728 - DNA, 14 bp, Homo sapiens
gcatgcgcaggctc

SEQ ID NO: 4187729 - DNA, 24 bp, Homo sapiens
gcatgctggcctcccaataaagct

SEQ ID NO: 4187730 - DNA, 15 bp, Homo sapiens
gcatgctggggcaag

SEQ ID NO: 4187731 - DNA, 17 bp, Homo sapiens
gcatggaatttgtaagt

SEQ ID NO: 4187732 - DNA, 18 bp, Homo sapiens
gcatgtttgtctgtgtgc

SEQ ID NO: 4187733 - DNA, 17 bp, Homo sapiens
gcattacgtgagccagg

SEQ ID NO: 4187734 - DNA, 18 bp, Homo sapiens
gcattcagggttatacac

SEQ ID NO: 4187735 - DNA, 23 bp, Homo sapiens
gcattcagggttatacacagaaa

SEQ ID NO: 4187736 - DNA, 16 bp, Homo sapiens
gcattctgagctgggc

SEQ ID NO: 4187737 - DNA, 15 bp, Homo sapiens
gcattgaatgacaag

SEQ ID NO: 4187738 - DNA, 21 bp, Homo sapiens
gcattgaatgacaagcatcag

SEQ ID NO: 4187739 - DNA, 22 bp, Homo sapiens
gcatttcactttcccggtgttc

SEQ ID NO: 4187740 - DNA, 22 bp, Homo sapiens
gcattttcacattttgcctttc

SEQ ID NO: 4187741 - DNA, 23 bp, Homo sapiens
gccaaaacaatgtttaaaccttt

SEQ ID NO: 4187742 - DNA, 23 bp, Homo sapiens
gccaaactgttggaagttcactg

SEQ ID NO: 4187743 - DNA, 16 bp, Homo sapiens
gccaaagcaaaagaag

SEQ ID NO: 4187744 - DNA, 21 bp, Homo sapiens
gccaaagcaaaagaagtaaaa

SEQ ID NO: 4187745 - DNA, 22 bp, Homo sapiens
gccaaataaaacctcagggaca

SEQ ID NO: 4187746 - DNA, 18 bp, Homo sapiens
gccaaattatttgtgtaa

SEQ ID NO: 4187747 - DNA, 22 bp, Homo sapiens
gccaacaggtggcaggaccagg

SEQ ID NO: 4187748 - DNA, 14 bp, Homo sapiens
gccaacatggtgaa

SEQ ID NO: 4187749 - DNA, 23 bp, Homo sapiens
gccaacgacaaagccaaactctg

SEQ ID NO: 4187750 - DNA, 11 bp, Homo sapiens
gccaagcctgg

SEQ ID NO: 4187751 - DNA, 23 bp, Homo sapiens
gccaagcgggggcgtggctggcc

SEQ ID NO: 4187752 - DNA, 19 bp, Homo sapiens
gccaagggctaggctcttg

SEQ ID NO: 4187753 - DNA, 18 bp, Homo sapiens
gccaaggtgggctgagcc

SEQ ID NO: 4187754 - DNA, 17 bp, Homo sapiens
gccaagtctcagaagag

SEQ ID NO: 4187755 - DNA, 20 bp, Homo sapiens
gccacaaaactctgtcaggc

SEQ ID NO: 4187756 - DNA, 14 bp, Homo sapiens
gccacaaagggaca

SEQ ID NO: 4187757 - DNA, 14 bp, Homo sapiens
gccacaagaaattt

SEQ ID NO: 4187758 - DNA, 16 bp, Homo sapiens
gccacaagaaatttga

SEQ ID NO: 4187759 - DNA, 17 bp, Homo sapiens
gccacaccaatcagaga

SEQ ID NO: 4187760 - DNA, 20 bp, Homo sapiens
gccacaccaatcagagagcc

SEQ ID NO: 4187761 - DNA, 13 bp, Homo sapiens
gccacaccaggat

SEQ ID NO: 4187762 - DNA, 19 bp, Homo sapiens
gccacaccatctcctttca

SEQ ID NO: 4187763 - DNA, 12 bp, Homo sapiens
gccacagagaag

SEQ ID NO: 4187764 - DNA, 13 bp, Homo sapiens
gccacagagaaga

SEQ ID NO: 4187765 - DNA, 17 bp, Homo sapiens
gccacagttctaagacc

SEQ ID NO: 4187766 - DNA, 12 bp, Homo sapiens
gccaccaggatg

SEQ ID NO: 4187767 - DNA, 19 bp, Homo sapiens
gccaccagggcactgtctg

SEQ ID NO: 4187768 - DNA, 13 bp, Homo sapiens
gccacctgtctgt

SEQ ID NO: 4187769 - DNA, 17 bp, Homo sapiens
gccacggggagggggac

SEQ ID NO: 4187770 - DNA, 20 bp, Homo sapiens
gccactacactccagcctga

SEQ ID NO: 4187771 - DNA, 22 bp, Homo sapiens
gccactacctttgtccaggcct

SEQ ID NO: 4187772 - DNA, 22 bp, Homo sapiens
gccactctcccctccctcttcc

SEQ ID NO: 4187773 - DNA, 14 bp, Homo sapiens
gccactgaagctgg

SEQ ID NO: 4187774 - DNA, 15 bp, Homo sapiens
gccactgcactccgg

SEQ ID NO: 4187775 - DNA, 21 bp, Homo sapiens
gccactgcgggagctctgtat

SEQ ID NO: 4187776 - DNA, 22 bp, Homo sapiens
gccagaatcttcgtcctgcccc

SEQ ID NO: 4187777 - DNA, 16 bp, Homo sapiens
gccagcagttgtaaaa

SEQ ID NO: 4187778 - DNA, 17 bp, Homo sapiens
gccagccggtgcctggc

SEQ ID NO: 4187779 - DNA, 12 bp, Homo sapiens
gccagcctgagc

SEQ ID NO: 4187780 - DNA, 17 bp, Homo sapiens
gccagcctggcttctgg

SEQ ID NO: 4187781 - DNA, 21 bp, Homo sapiens
gccagcctggcttctggagcc

SEQ ID NO: 4187782 - DNA, 22 bp, Homo sapiens
gccagcctggcttctggagccc

SEQ ID NO: 4187783 - DNA, 10 bp, Homo sapiens
gccagctctc

SEQ ID NO: 4187784 - DNA, 18 bp, Homo sapiens
gccaggaactggctcctt

SEQ ID NO: 4187785 - DNA, 17 bp, Homo sapiens
gccaggatcccaagcgt

SEQ ID NO: 4187786 - DNA, 14 bp, Homo sapiens
gccaggcaggggtg

SEQ ID NO: 4187787 - DNA, 16 bp, Homo sapiens
gccaggccaccaggat

SEQ ID NO: 4187788 - DNA, 13 bp, Homo sapiens
gccaggctctgcc

SEQ ID NO: 4187789 - DNA, 16 bp, Homo sapiens
gccaggctctgcctgg

SEQ ID NO: 4187790 - DNA, 13 bp, Homo sapiens
gccagggccaggg

SEQ ID NO: 4187791 - DNA, 19 bp, Homo sapiens
gccagggccctgcagaggg

SEQ ID NO: 4187792 - DNA, 17 bp, Homo sapiens
gccagggtgagagctgc

SEQ ID NO: 4187793 - DNA, 16 bp, Homo sapiens
gccaggtaatgaggga

SEQ ID NO: 4187794 - DNA, 12 bp, Homo sapiens
gccagtatttct

SEQ ID NO: 4187795 - DNA, 13 bp, Homo sapiens
gccagtcttgtgt

SEQ ID NO: 4187796 - DNA, 13 bp, Homo sapiens
gccagtgggcctg

SEQ ID NO: 4187797 - DNA, 16 bp, Homo sapiens
gccatattcacacctc

SEQ ID NO: 4187798 - DNA, 13 bp, Homo sapiens
gccatcagggtgg

SEQ ID NO: 4187799 - DNA, 24 bp, Homo sapiens
gccatcagggtgggccactctccc

SEQ ID NO: 4187800 - DNA, 19 bp, Homo sapiens
gccatgatgcctctgtctt

SEQ ID NO: 4187801 - DNA, 22 bp, Homo sapiens
gccatgatggtgctgacctctg

SEQ ID NO: 4187802 - DNA, 14 bp, Homo sapiens
gccatgccaccctg

SEQ ID NO: 4187803 - DNA, 14 bp, Homo sapiens
gccatggcatgctc

SEQ ID NO: 4187804 - DNA, 16 bp, Homo sapiens
gccatggcgtgtccct

SEQ ID NO: 4187805 - DNA, 18 bp, Homo sapiens
gccattaccatggagaca

SEQ ID NO: 4187806 - DNA, 20 bp, Homo sapiens
gccattcttctggtgctact

SEQ ID NO: 4187807 - DNA, 22 bp, Homo sapiens
gccattgggaccctccagtgct

SEQ ID NO: 4187808 - DNA, 18 bp, Homo sapiens
gccattgtactccagcct

SEQ ID NO: 4187809 - DNA, 19 bp, Homo sapiens
gccattgtactccagcctg

SEQ ID NO: 4187810 - DNA, 20 bp, Homo sapiens
gccattgtactccagcctgg

SEQ ID NO: 4187811 - DNA, 20 bp, Homo sapiens
gccatttgcaccctccgcct

SEQ ID NO: 4187812 - DNA, 14 bp, Homo sapiens
gcccaacctcctga

SEQ ID NO: 4187813 - DNA, 22 bp, Homo sapiens
gcccacaagccttactcacctc

SEQ ID NO: 4187814 - DNA, 18 bp, Homo sapiens
gcccacagagatgcatgc

SEQ ID NO: 4187815 - DNA, 18 bp, Homo sapiens
gcccacagagcctggctt

SEQ ID NO: 4187816 - DNA, 16 bp, Homo sapiens
gcccacattggaccca

SEQ ID NO: 4187817 - DNA, 21 bp, Homo sapiens
gcccacgcccgactagcaggc

SEQ ID NO: 4187818 - DNA, 16 bp, Homo sapiens
gcccagagggcccagg

SEQ ID NO: 4187819 - DNA, 20 bp, Homo sapiens
gcccagagggcccaggcagg

SEQ ID NO: 4187820 - DNA, 14 bp, Homo sapiens
gcccagcacaaccc

SEQ ID NO: 4187821 - DNA, 21 bp, Homo sapiens
gcccagcaggcaggcactgtg

SEQ ID NO: 4187822 - DNA, 13 bp, Homo sapiens
gcccagccagcca

SEQ ID NO: 4187823 - DNA, 11 bp, Homo sapiens
gcccagcctgt

SEQ ID NO: 4187824 - DNA, 23 bp, Homo sapiens
gcccagctgcacctgccagcctg

SEQ ID NO: 4187825 - DNA, 15 bp, Homo sapiens
gcccaggcactgcaa

SEQ ID NO: 4187826 - DNA, 22 bp, Homo sapiens
gcccagtcgtccgctcagccaa

SEQ ID NO: 4187827 - DNA, 15 bp, Homo sapiens
gcccagtctggaaga

SEQ ID NO: 4187828 - DNA, 18 bp, Homo sapiens
gcccatctctccagagag

SEQ ID NO: 4187829 - DNA, 19 bp, Homo sapiens
gcccatctctccagagagc

SEQ ID NO: 4187830 - DNA, 15 bp, Homo sapiens
gcccattctgcatgc

SEQ ID NO: 4187831 - DNA, 18 bp, Homo sapiens
gcccattctgcatgccct

SEQ ID NO: 4187832 - DNA, 23 bp, Homo sapiens
gccccacccagggctccctcctg

SEQ ID NO: 4187833 - DNA, 17 bp, Homo sapiens
gccccacccccatgcag

SEQ ID NO: 4187834 - DNA, 21 bp, Homo sapiens
gccccaccctcaaaccctgtg

SEQ ID NO: 4187835 - DNA, 20 bp, Homo sapiens
gccccaccctcgtggacacc

SEQ ID NO: 4187836 - DNA, 23 bp, Homo sapiens
gccccaccctcgtggacacctgc

SEQ ID NO: 4187837 - DNA, 12 bp, Homo sapiens
gccccagaggcc

SEQ ID NO: 4187838 - DNA, 15 bp, Homo sapiens
gccccagaggcctct

SEQ ID NO: 4187839 - DNA, 13 bp, Homo sapiens
gccccagctctgg

SEQ ID NO: 4187840 - DNA, 13 bp, Homo sapiens
gccccatctcctc

SEQ ID NO: 4187841 - DNA, 16 bp, Homo sapiens
gccccatctcctccca

SEQ ID NO: 4187842 - DNA, 21 bp, Homo sapiens
gcccccactttcctacaaaat

SEQ ID NO: 4187843 - DNA, 14 bp, Homo sapiens
gccccccatgccct

SEQ ID NO: 4187844 - DNA, 14 bp, Homo sapiens
gcccccctccaggc

SEQ ID NO: 4187845 - DNA, 16 bp, Homo sapiens
gcccccgacagcccag

SEQ ID NO: 4187846 - DNA, 16 bp, Homo sapiens
gccccgacccctgtcc

SEQ ID NO: 4187847 - DNA, 18 bp, Homo sapiens
gccccgggtgcctcagag

SEQ ID NO: 4187848 - DNA, 19 bp, Homo sapiens
gccccgggtgcctcagagc

SEQ ID NO: 4187849 - DNA, 19 bp, Homo sapiens
gcccctgcacctgcttctc

SEQ ID NO: 4187850 - DNA, 10 bp, Homo sapiens
gccccttcca

SEQ ID NO: 4187851 - DNA, 19 bp, Homo sapiens
gccccttgacaactggcag

SEQ ID NO: 4187852 - DNA, 14 bp, Homo sapiens
gcccgactagcagg

SEQ ID NO: 4187853 - DNA, 15 bp, Homo sapiens
gcccgactagcaggc

SEQ ID NO: 4187854 - DNA, 12 bp, Homo sapiens
gcccgcagagcc

SEQ ID NO: 4187855 - DNA, 13 bp, Homo sapiens
gcccgcagagccc

SEQ ID NO: 4187856 - DNA, 14 bp, Homo sapiens
gcccgcctctgtcc

SEQ ID NO: 4187857 - DNA, 13 bp, Homo sapiens
gcccgcttcaagc

SEQ ID NO: 4187858 - DNA, 17 bp, Homo sapiens
gcccgcttcaagctctc

SEQ ID NO: 4187859 - DNA, 16 bp, Homo sapiens
gcccggattctgggag

SEQ ID NO: 4187860 - DNA, 18 bp, Homo sapiens
gcccggtttggggctgcg

SEQ ID NO: 4187861 - DNA, 22 bp, Homo sapiens
gcccgtggtgaggttgtgctgc

SEQ ID NO: 4187862 - DNA, 23 bp, Homo sapiens
gccctaggattcctcccccagag

SEQ ID NO: 4187863 - DNA, 22 bp, Homo sapiens
gccctcataaaccaatgtggca

SEQ ID NO: 4187864 - DNA, 23 bp, Homo sapiens
gccctccacagccgcagcctccc

SEQ ID NO: 4187865 - DNA, 24 bp, Homo sapiens
gccctcccagcaagtttcaccttg

SEQ ID NO: 4187866 - DNA, 13 bp, Homo sapiens
gccctccctgctg

SEQ ID NO: 4187867 - DNA, 16 bp, Homo sapiens
gccctccctgctgcca

SEQ ID NO: 4187868 - DNA, 18 bp, Homo sapiens
gccctccctgctgccagg

SEQ ID NO: 4187869 - DNA, 18 bp, Homo sapiens
gccctccgcccttccctg

SEQ ID NO: 4187870 - DNA, 21 bp, Homo sapiens
gccctgagtggatctccaagg

SEQ ID NO: 4187871 - DNA, 13 bp, Homo sapiens
gccctgcagaggg

SEQ ID NO: 4187872 - DNA, 13 bp, Homo sapiens
gccctgccacctg

SEQ ID NO: 4187873 - DNA, 14 bp, Homo sapiens
gccctgccacctgt

SEQ ID NO: 4187874 - DNA, 15 bp, Homo sapiens
gccctgccacctgtc

SEQ ID NO: 4187875 - DNA, 18 bp, Homo sapiens
gccctgcctatcctctgt

SEQ ID NO: 4187876 - DNA, 19 bp, Homo sapiens
gccctgccttcagctttgg

SEQ ID NO: 4187877 - DNA, 23 bp, Homo sapiens
gccctgctgccgcctcccagcct

SEQ ID NO: 4187878 - DNA, 14 bp, Homo sapiens
gccctggagggagg

SEQ ID NO: 4187879 - DNA, 20 bp, Homo sapiens
gccctgggtcacctagctgg

SEQ ID NO: 4187880 - DNA, 20 bp, Homo sapiens
gccctgtgccccttgacaac

SEQ ID NO: 4187881 - DNA, 22 bp, Homo sapiens
gccctgtgccccttgacaactg

SEQ ID NO: 4187882 - DNA, 22 bp, Homo sapiens
gcccttcagacgagatcctgtt

SEQ ID NO: 4187883 - DNA, 14 bp, Homo sapiens
gcccttcccaacct

SEQ ID NO: 4187884 - DNA, 15 bp, Homo sapiens
gccctttgcaggccc

SEQ ID NO: 4187885 - DNA, 23 bp, Homo sapiens
gccctttgcaggcccagcagact

SEQ ID NO: 4187886 - DNA, 22 bp, Homo sapiens
gccgagatcacgccactgcact

SEQ ID NO: 4187887 - DNA, 12 bp, Homo sapiens
gccgagggcagc

SEQ ID NO: 4187888 - DNA, 17 bp, Homo sapiens
gccgcagggacggggac

SEQ ID NO: 4187889 - DNA, 12 bp, Homo sapiens
gccgcctcccag

SEQ ID NO: 4187890 - DNA, 13 bp, Homo sapiens
gccgcctcccagc

SEQ ID NO: 4187891 - DNA, 19 bp, Homo sapiens
gccgcctcccagcctgggg

SEQ ID NO: 4187892 - DNA, 15 bp, Homo sapiens
gccgggagaggactc

SEQ ID NO: 4187893 - DNA, 15 bp, Homo sapiens
gccgggaggcagtgc

SEQ ID NO: 4187894 - DNA, 16 bp, Homo sapiens
gccgggaggcagtgct

SEQ ID NO: 4187895 - DNA, 15 bp, Homo sapiens
gccgggcaggcctgc

SEQ ID NO: 4187896 - DNA, 19 bp, Homo sapiens
gccgggcgtggtggcgggc

SEQ ID NO: 4187897 - DNA, 13 bp, Homo sapiens
gccgtacatctct

SEQ ID NO: 4187898 - DNA, 21 bp, Homo sapiens
gccgtctaggattgggcctcc

SEQ ID NO: 4187899 - DNA, 14 bp, Homo sapiens
gccgtgcccagggg

SEQ ID NO: 4187900 - DNA, 15 bp, Homo sapiens
gccgtgggccgggag

SEQ ID NO: 4187901 - DNA, 17 bp, Homo sapiens
gccgtgggccgggaggc

SEQ ID NO: 4187902 - DNA, 22 bp, Homo sapiens
gccgtgtgtctcgtctcctgac

SEQ ID NO: 4187903 - DNA, 18 bp, Homo sapiens
gcctaatatttaggcaag

SEQ ID NO: 4187904 - DNA, 15 bp, Homo sapiens
gcctaattcctggca

SEQ ID NO: 4187905 - DNA, 13 bp, Homo sapiens
gcctagactgtgt

SEQ ID NO: 4187906 - DNA, 20 bp, Homo sapiens
gcctagactgttactttggc

SEQ ID NO: 4187907 - DNA, 16 bp, Homo sapiens
gcctcactcaagcctg

SEQ ID NO: 4187908 - DNA, 18 bp, Homo sapiens
gcctcactcaagcctgag

SEQ ID NO: 4187909 - DNA, 15 bp, Homo sapiens
gcctcagagcaggct

SEQ ID NO: 4187910 - DNA, 17 bp, Homo sapiens
gcctccaaatgccaact

SEQ ID NO: 4187911 - DNA, 22 bp, Homo sapiens
gcctccaaatgccaacttgtcc

SEQ ID NO: 4187912 - DNA, 15 bp, Homo sapiens
gcctcccaataaagc

SEQ ID NO: 4187913 - DNA, 20 bp, Homo sapiens
gcctcccaataaagctggac

SEQ ID NO: 4187914 - DNA, 21 bp, Homo sapiens
gcctcccataattgctttgcc

SEQ ID NO: 4187915 - DNA, 14 bp, Homo sapiens
gcctccctctgacc

SEQ ID NO: 4187916 - DNA, 17 bp, Homo sapiens
gcctcgtaccagccagg

SEQ ID NO: 4187917 - DNA, 12 bp, Homo sapiens
gcctctccctta

SEQ ID NO: 4187918 - DNA, 13 bp, Homo sapiens
gcctctctgctcc

SEQ ID NO: 4187919 - DNA, 14 bp, Homo sapiens
gcctctctgctcca

SEQ ID NO: 4187920 - DNA, 15 bp, Homo sapiens
gcctctctgctccag

SEQ ID NO: 4187921 - DNA, 16 bp, Homo sapiens
gcctctctgctccaga

SEQ ID NO: 4187922 - DNA, 17 bp, Homo sapiens
gcctctgactcaaactc

SEQ ID NO: 4187923 - DNA, 16 bp, Homo sapiens
gcctctgcccgcagag

SEQ ID NO: 4187924 - DNA, 17 bp, Homo sapiens
gcctctgcccgcagagc

SEQ ID NO: 4187925 - DNA, 11 bp, Homo sapiens
gcctctgctgc

SEQ ID NO: 4187926 - DNA, 23 bp, Homo sapiens
gcctcttaaagctgcctgtagtt

SEQ ID NO: 4187927 - DNA, 16 bp, Homo sapiens
gcctcttcagcagcat

SEQ ID NO: 4187928 - DNA, 15 bp, Homo sapiens
gcctcttccctctga

SEQ ID NO: 4187929 - DNA, 14 bp, Homo sapiens
gcctcttcctctgg

SEQ ID NO: 4187930 - DNA, 16 bp, Homo sapiens
gcctcttcctctgggc

SEQ ID NO: 4187931 - DNA, 17 bp, Homo sapiens
gcctcttcctctgggca

SEQ ID NO: 4187932 - DNA, 21 bp, Homo sapiens
gcctcttcctctgggcagcgc

SEQ ID NO: 4187933 - DNA, 23 bp, Homo sapiens
gcctcttcctctgggcagcgcta

SEQ ID NO: 4187934 - DNA, 15 bp, Homo sapiens
gcctcttcttcttca

SEQ ID NO: 4187935 - DNA, 16 bp, Homo sapiens
gcctcttcttcttcag

SEQ ID NO: 4187936 - DNA, 20 bp, Homo sapiens
gcctcttcttcttcagaaga

SEQ ID NO: 4187937 - DNA, 21 bp, Homo sapiens
gcctcttcttcttcagaagac

SEQ ID NO: 4187938 - DNA, 20 bp, Homo sapiens
gcctgactagggagccatgt

SEQ ID NO: 4187939 - DNA, 18 bp, Homo sapiens
gcctgactgcacacagct

SEQ ID NO: 4187940 - DNA, 22 bp, Homo sapiens
gcctgagcaacagagtgagacc

SEQ ID NO: 4187941 - DNA, 18 bp, Homo sapiens
gcctgagcggaggctcgg

SEQ ID NO: 4187942 - DNA, 15 bp, Homo sapiens
gcctgaggctgagac

SEQ ID NO: 4187943 - DNA, 12 bp, Homo sapiens
gcctgatgacag

SEQ ID NO: 4187944 - DNA, 17 bp, Homo sapiens
gcctgatgacagagcga

SEQ ID NO: 4187945 - DNA, 11 bp, Homo sapiens
gcctgcagaga

SEQ ID NO: 4187946 - DNA, 16 bp, Homo sapiens
gcctgcagagagaagc

SEQ ID NO: 4187947 - DNA, 17 bp, Homo sapiens
gcctgcagagagaagcc

SEQ ID NO: 4187948 - DNA, 18 bp, Homo sapiens
gcctgcagagagaagcct

SEQ ID NO: 4187949 - DNA, 13 bp, Homo sapiens
gcctgcagcgagc

SEQ ID NO: 4187950 - DNA, 18 bp, Homo sapiens
gcctgccctggagggagg

SEQ ID NO: 4187951 - DNA, 20 bp, Homo sapiens
gcctgccgccgtctctgtcc

SEQ ID NO: 4187952 - DNA, 21 bp, Homo sapiens
gcctgccgccgtctctgtccc

SEQ ID NO: 4187953 - DNA, 17 bp, Homo sapiens
gcctgcctccttcagtg

SEQ ID NO: 4187954 - DNA, 19 bp, Homo sapiens
gcctgcctgtggagacagc

SEQ ID NO: 4187955 - DNA, 20 bp, Homo sapiens
gcctgcctgtggagacagcc

SEQ ID NO: 4187956 - DNA, 17 bp, Homo sapiens
gcctgctgcgtcagacc

SEQ ID NO: 4187957 - DNA, 18 bp, Homo sapiens
gcctggaccgcttcccag

SEQ ID NO: 4187958 - DNA, 23 bp, Homo sapiens
gcctggaccgcttcccagaggcc

SEQ ID NO: 4187959 - DNA, 15 bp, Homo sapiens
gcctggagaagctga

SEQ ID NO: 4187960 - DNA, 17 bp, Homo sapiens
gcctggagggatgccac

SEQ ID NO: 4187961 - DNA, 12 bp, Homo sapiens
gcctggcaaggc

SEQ ID NO: 4187962 - DNA, 12 bp, Homo sapiens
gcctggccaggc

SEQ ID NO: 4187963 - DNA, 15 bp, Homo sapiens
gcctggccatcccca

SEQ ID NO: 4187964 - DNA, 16 bp, Homo sapiens
gcctggcttctggagc

SEQ ID NO: 4187965 - DNA, 16 bp, Homo sapiens
gcctggcttgctgtgg

SEQ ID NO: 4187966 - DNA, 17 bp, Homo sapiens
gcctggcttgctgtggc

SEQ ID NO: 4187967 - DNA, 19 bp, Homo sapiens
gcctgggaatcctgctgcc

SEQ ID NO: 4187968 - DNA, 20 bp, Homo sapiens
gcctgggaatcctgctgcca

SEQ ID NO: 4187969 - DNA, 19 bp, Homo sapiens
gcctggggttcccgaggga

SEQ ID NO: 4187970 - DNA, 23 bp, Homo sapiens
gcctggggttcccgagggagctg

SEQ ID NO: 4187971 - DNA, 20 bp, Homo sapiens
gcctgggtggcagagtgaga

SEQ ID NO: 4187972 - DNA, 23 bp, Homo sapiens
gcctgggtggcagagtgagactc

SEQ ID NO: 4187973 - DNA, 22 bp, Homo sapiens
gcctgtaatcccagctacccag

SEQ ID NO: 4187974 - DNA, 14 bp, Homo sapiens
gcctgtagttagga

SEQ ID NO: 4187975 - DNA, 16 bp, Homo sapiens
gcctgtagttaggaaa

SEQ ID NO: 4187976 - DNA, 18 bp, Homo sapiens
gcctgtagttaggaaata

SEQ ID NO: 4187977 - DNA, 22 bp, Homo sapiens
gcctgtagttaggaaataaaac

SEQ ID NO: 4187978 - DNA, 23 bp, Homo sapiens
gcctgtagttaggaaataaaacc

SEQ ID NO: 4187979 - DNA, 18 bp, Homo sapiens
gcctgtatagacagcact

SEQ ID NO: 4187980 - DNA, 12 bp, Homo sapiens
gcctgtcctgcc

SEQ ID NO: 4187981 - DNA, 14 bp, Homo sapiens
gcctgtcctgcctc

SEQ ID NO: 4187982 - DNA, 21 bp, Homo sapiens
gcctgtcctggtacagcaggg

SEQ ID NO: 4187983 - DNA, 21 bp, Homo sapiens
gcctgtggagacagccctgcc

SEQ ID NO: 4187984 - DNA, 22 bp, Homo sapiens
gcctgtggagacagccctgcct

SEQ ID NO: 4187985 - DNA, 15 bp, Homo sapiens
gcctgtgtctggccc

SEQ ID NO: 4187986 - DNA, 19 bp, Homo sapiens
gcctgttgctgaagtcatt

SEQ ID NO: 4187987 - DNA, 16 bp, Homo sapiens
gccttaggctgctggg

SEQ ID NO: 4187988 - DNA, 18 bp, Homo sapiens
gccttagtacggctgctg

SEQ ID NO: 4187989 - DNA, 19 bp, Homo sapiens
gccttagtacggctgctgc

SEQ ID NO: 4187990 - DNA, 20 bp, Homo sapiens
gccttagtacggctgctgca

SEQ ID NO: 4187991 - DNA, 20 bp, Homo sapiens
gccttcactccggtgtgcct

SEQ ID NO: 4187992 - DNA, 19 bp, Homo sapiens
gccttccctccccacagtc

SEQ ID NO: 4187993 - DNA, 15 bp, Homo sapiens
gccttcctcgtgcag

SEQ ID NO: 4187994 - DNA, 22 bp, Homo sapiens
gccttcctcgtgcagagctggg

SEQ ID NO: 4187995 - DNA, 22 bp, Homo sapiens
gccttcctgtctttctggccct

SEQ ID NO: 4187996 - DNA, 23 bp, Homo sapiens
gccttcttttgggggtcaacagt

SEQ ID NO: 4187997 - DNA, 14 bp, Homo sapiens
gccttgaagccact

SEQ ID NO: 4187998 - DNA, 17 bp, Homo sapiens
gcctttctctggctcca

SEQ ID NO: 4187999 - DNA, 19 bp, Homo sapiens
gcctttgggaggcagcatc

SEQ ID NO: 4188000 - DNA, 16 bp, Homo sapiens
gccttttgctgctgct

SEQ ID NO: 4188001 - DNA, 19 bp, Homo sapiens
gcgaaaacgttgacccctt

SEQ ID NO: 4188002 - DNA, 22 bp, Homo sapiens
gcgaaacaacttgtgttctatt

SEQ ID NO: 4188003 - DNA, 15 bp, Homo sapiens
gcgaaggggccctgg

SEQ ID NO: 4188004 - DNA, 15 bp, Homo sapiens
gcgaagtggctctca

SEQ ID NO: 4188005 - DNA, 16 bp, Homo sapiens
gcgagagtctgtctca

SEQ ID NO: 4188006 - DNA, 22 bp, Homo sapiens
gcgagggctactcagcagtaag

SEQ ID NO: 4188007 - DNA, 17 bp, Homo sapiens
gcgatcaagtccagagc

SEQ ID NO: 4188008 - DNA, 15 bp, Homo sapiens
gcgatggtctcagaa

SEQ ID NO: 4188009 - DNA, 17 bp, Homo sapiens
gcgcacctgccccctgg

SEQ ID NO: 4188010 - DNA, 22 bp, Homo sapiens
gcgcagtgcttctctacagact

SEQ ID NO: 4188011 - DNA, 20 bp, Homo sapiens
gcgcatttgatttctccagg

SEQ ID NO: 4188012 - DNA, 12 bp, Homo sapiens
gcgcctcttcct

SEQ ID NO: 4188013 - DNA, 16 bp, Homo sapiens
gcgcctgtagtcccag

SEQ ID NO: 4188014 - DNA, 14 bp, Homo sapiens
gcgcgggcggaggc

SEQ ID NO: 4188015 - DNA, 15 bp, Homo sapiens
gcgctttctggaaaa

SEQ ID NO: 4188016 - DNA, 22 bp, Homo sapiens
gcggagagtacagtgagccaag

SEQ ID NO: 4188017 - DNA, 17 bp, Homo sapiens
gcggagcttgcctgcct

SEQ ID NO: 4188018 - DNA, 17 bp, Homo sapiens
gcggaggcggctccagg

SEQ ID NO: 4188019 - DNA, 15 bp, Homo sapiens
gcggaggttgcaggg

SEQ ID NO: 4188020 - DNA, 13 bp, Homo sapiens
gcggatctcactc

SEQ ID NO: 4188021 - DNA, 20 bp, Homo sapiens
gcggcacgccaacagccccc

SEQ ID NO: 4188022 - DNA, 13 bp, Homo sapiens
gcggcgcagaggg

SEQ ID NO: 4188023 - DNA, 17 bp, Homo sapiens
gcggctgctgtgtgcct

SEQ ID NO: 4188024 - DNA, 20 bp, Homo sapiens
gcgggcacctatagtcccag

SEQ ID NO: 4188025 - DNA, 15 bp, Homo sapiens
gcgggcggaggcggc

SEQ ID NO: 4188026 - DNA, 14 bp, Homo sapiens
gcggggcagagcca

SEQ ID NO: 4188027 - DNA, 17 bp, Homo sapiens
gcggtgcttgatagaaa

SEQ ID NO: 4188028 - DNA, 14 bp, Homo sapiens
gcggtggaaggccc

SEQ ID NO: 4188029 - DNA, 18 bp, Homo sapiens
gcggtggaaggcccgagg

SEQ ID NO: 4188030 - DNA, 15 bp, Homo sapiens
gcggtggtgccagag

SEQ ID NO: 4188031 - DNA, 12 bp, Homo sapiens
gcggttcaggaa

SEQ ID NO: 4188032 - DNA, 14 bp, Homo sapiens
gcgtagagagccgg

SEQ ID NO: 4188033 - DNA, 20 bp, Homo sapiens
gcgtccctgagggcccttcc

SEQ ID NO: 4188034 - DNA, 23 bp, Homo sapiens
gcgtgcacagcgcgggcggaggc

SEQ ID NO: 4188035 - DNA, 19 bp, Homo sapiens
gcgtgtcgtgggtgtgtgt

SEQ ID NO: 4188036 - DNA, 11 bp, Homo sapiens
gcgtgtgtatc

SEQ ID NO: 4188037 - DNA, 12 bp, Homo sapiens
gctaaaagaaac

SEQ ID NO: 4188038 - DNA, 20 bp, Homo sapiens
gctaaacgactccgagaaca

SEQ ID NO: 4188039 - DNA, 19 bp, Homo sapiens
gctaaattgaatacacaaa

SEQ ID NO: 4188040 - DNA, 13 bp, Homo sapiens
gctaagagaagta

SEQ ID NO: 4188041 - DNA, 19 bp, Homo sapiens
gctactcagaagcctgagg

SEQ ID NO: 4188042 - DNA, 21 bp, Homo sapiens
gctactcagcagtaagcaggc

SEQ ID NO: 4188043 - DNA, 14 bp, Homo sapiens
gctactctcttgcc

SEQ ID NO: 4188044 - DNA, 17 bp, Homo sapiens
gctactgatttttgtga

SEQ ID NO: 4188045 - DNA, 16 bp, Homo sapiens
gctactttgctgctat

SEQ ID NO: 4188046 - DNA, 23 bp, Homo sapiens
gctactttgctgctatggttttc

SEQ ID NO: 4188047 - DNA, 17 bp, Homo sapiens
gctaggaaagggaagcc

SEQ ID NO: 4188048 - DNA, 20 bp, Homo sapiens
gctaggaaagggaagcctga

SEQ ID NO: 4188049 - DNA, 14 bp, Homo sapiens
gctaggcatgcctg

SEQ ID NO: 4188050 - DNA, 18 bp, Homo sapiens
gctaggggctggtccttc

SEQ ID NO: 4188051 - DNA, 12 bp, Homo sapiens
gctatatgcatt

SEQ ID NO: 4188052 - DNA, 19 bp, Homo sapiens
gctatatgccttaagccaa

SEQ ID NO: 4188053 - DNA, 14 bp, Homo sapiens
gctatattttcatg

SEQ ID NO: 4188054 - DNA, 23 bp, Homo sapiens
gctatattttcatgacttttcca

SEQ ID NO: 4188055 - DNA, 17 bp, Homo sapiens
gctatgatcgcgccact

SEQ ID NO: 4188056 - DNA, 15 bp, Homo sapiens
gctattactgtctgg

SEQ ID NO: 4188057 - DNA, 13 bp, Homo sapiens
gctcaaaaagttt

SEQ ID NO: 4188058 - DNA, 16 bp, Homo sapiens
gctcacgactcttcct

SEQ ID NO: 4188059 - DNA, 22 bp, Homo sapiens
gctcacgcctatgatcccagca

SEQ ID NO: 4188060 - DNA, 16 bp, Homo sapiens
gctcagccctgactgg

SEQ ID NO: 4188061 - DNA, 16 bp, Homo sapiens
gctcagggtttcggaa

SEQ ID NO: 4188062 - DNA, 18 bp, Homo sapiens
gctcatattttgtatata

SEQ ID NO: 4188063 - DNA, 15 bp, Homo sapiens
gctcattttttctta

SEQ ID NO: 4188064 - DNA, 9 bp, Homo sapiens
gctccaagg

SEQ ID NO: 4188065 - DNA, 19 bp, Homo sapiens
gctccaaggtgctctgtgt

SEQ ID NO: 4188066 - DNA, 14 bp, Homo sapiens
gctccaggtccgga

SEQ ID NO: 4188067 - DNA, 16 bp, Homo sapiens
gctccaggtccggagg

SEQ ID NO: 4188068 - DNA, 18 bp, Homo sapiens
gctcccactgcccctgca

SEQ ID NO: 4188069 - DNA, 23 bp, Homo sapiens
gctcccagggtcctgggggctgc

SEQ ID NO: 4188070 - DNA, 15 bp, Homo sapiens
gctcccctctcctcc

SEQ ID NO: 4188071 - DNA, 19 bp, Homo sapiens
gctcccctctcctccgcca

SEQ ID NO: 4188072 - DNA, 14 bp, Homo sapiens
gctcccgagctact

SEQ ID NO: 4188073 - DNA, 17 bp, Homo sapiens
gctcccgagctactctc

SEQ ID NO: 4188074 - DNA, 19 bp, Homo sapiens
gctcccgagctactctctt

SEQ ID NO: 4188075 - DNA, 15 bp, Homo sapiens
gctccctcctggagc

SEQ ID NO: 4188076 - DNA, 19 bp, Homo sapiens
gctccctcctggagcatcc

SEQ ID NO: 4188077 - DNA, 16 bp, Homo sapiens
gctccctggcccagcc

SEQ ID NO: 4188078 - DNA, 19 bp, Homo sapiens
gctccctggcccagccagc

SEQ ID NO: 4188079 - DNA, 22 bp, Homo sapiens
gctccggaggggacccagctcc

SEQ ID NO: 4188080 - DNA, 23 bp, Homo sapiens
gctcctaaacccccgctccagat

SEQ ID NO: 4188081 - DNA, 15 bp, Homo sapiens
gctcctaagcttcaa

SEQ ID NO: 4188082 - DNA, 15 bp, Homo sapiens
gctcctccttcccct

SEQ ID NO: 4188083 - DNA, 15 bp, Homo sapiens
gctcctctgctgctc

SEQ ID NO: 4188084 - DNA, 17 bp, Homo sapiens
gctcctctgctgctccc

SEQ ID NO: 4188085 - DNA, 18 bp, Homo sapiens
gctcctggaaaggctcag

SEQ ID NO: 4188086 - DNA, 23 bp, Homo sapiens
gctcctggaaaggctcagtctca

SEQ ID NO: 4188087 - DNA, 21 bp, Homo sapiens
gctcctggagggggcaagcct

SEQ ID NO: 4188088 - DNA, 18 bp, Homo sapiens
gctccttgggtcctgcaa

SEQ ID NO: 4188089 - DNA, 15 bp, Homo sapiens
gctcggccgtgggcc

SEQ ID NO: 4188090 - DNA, 22 bp, Homo sapiens
gctcgtaaatattccctgacga

SEQ ID NO: 4188091 - DNA, 12 bp, Homo sapiens
gctctaatacat

SEQ ID NO: 4188092 - DNA, 19 bp, Homo sapiens
gctctcaggggccagtgag

SEQ ID NO: 4188093 - DNA, 21 bp, Homo sapiens
gctctcaggggccagtgaggg

SEQ ID NO: 4188094 - DNA, 16 bp, Homo sapiens
gctctgcaggcacctt

SEQ ID NO: 4188095 - DNA, 16 bp, Homo sapiens
gctctgcccactgtga

SEQ ID NO: 4188096 - DNA, 12 bp, Homo sapiens
gctctgccccag

SEQ ID NO: 4188097 - DNA, 21 bp, Homo sapiens
gctctgccccagaggcctctc

SEQ ID NO: 4188098 - DNA, 22 bp, Homo sapiens
gctctggaaaatgtgacccaga

SEQ ID NO: 4188099 - DNA, 22 bp, Homo sapiens
gctctgtgtccgtctgtgtatg

SEQ ID NO: 4188100 - DNA, 21 bp, Homo sapiens
gctctgttatgcaagcacaaa

SEQ ID NO: 4188101 - DNA, 19 bp, Homo sapiens
gctcttcactcagccacac

SEQ ID NO: 4188102 - DNA, 13 bp, Homo sapiens
gctcttgcctgta

SEQ ID NO: 4188103 - DNA, 13 bp, Homo sapiens
gctctttcagggg

SEQ ID NO: 4188104 - DNA, 13 bp, Homo sapiens
gctctttctgggc

SEQ ID NO: 4188105 - DNA, 14 bp, Homo sapiens
gctctttctgggcc

SEQ ID NO: 4188106 - DNA, 18 bp, Homo sapiens
gctctttggggtcagcca

SEQ ID NO: 4188107 - DNA, 20 bp, Homo sapiens
gctctttggggtcagccagg

SEQ ID NO: 4188108 - DNA, 20 bp, Homo sapiens
gctcttttccactccaagat

SEQ ID NO: 4188109 - DNA, 13 bp, Homo sapiens
gctgaaagccatt

SEQ ID NO: 4188110 - DNA, 15 bp, Homo sapiens
gctgacatggctttg

SEQ ID NO: 4188111 - DNA, 21 bp, Homo sapiens
gctgaccagccgtgagcatgt

SEQ ID NO: 4188112 - DNA, 16 bp, Homo sapiens
gctgacctctggtggc

SEQ ID NO: 4188113 - DNA, 14 bp, Homo sapiens
gctgacctgggccc

SEQ ID NO: 4188114 - DNA, 16 bp, Homo sapiens
gctgagaaggaacagg

SEQ ID NO: 4188115 - DNA, 18 bp, Homo sapiens
gctgagcaaatcaccaca

SEQ ID NO: 4188116 - DNA, 17 bp, Homo sapiens
gctgagcaacctcttca

SEQ ID NO: 4188117 - DNA, 13 bp, Homo sapiens
gctgagccctggc

SEQ ID NO: 4188118 - DNA, 16 bp, Homo sapiens
gctgagccctggcagg

SEQ ID NO: 4188119 - DNA, 13 bp, Homo sapiens
gctgaggggcagg

SEQ ID NO: 4188120 - DNA, 19 bp, Homo sapiens
gctgataattttaaattct

SEQ ID NO: 4188121 - DNA, 16 bp, Homo sapiens
gctgatcaatgaaatg

SEQ ID NO: 4188122 - DNA, 20 bp, Homo sapiens
gctgatccggctgctcctcc

SEQ ID NO: 4188123 - DNA, 17 bp, Homo sapiens
gctgatggagaaggaag

SEQ ID NO: 4188124 - DNA, 18 bp, Homo sapiens
gctgcacctgccagcctg

SEQ ID NO: 4188125 - DNA, 19 bp, Homo sapiens
gctgcacctgccagcctgg

SEQ ID NO: 4188126 - DNA, 17 bp, Homo sapiens
gctgcatatgagtcttt

SEQ ID NO: 4188127 - DNA, 18 bp, Homo sapiens
gctgcatgcctggtcttt

SEQ ID NO: 4188128 - DNA, 20 bp, Homo sapiens
gctgcatgcctggtctttcc

SEQ ID NO: 4188129 - DNA, 14 bp, Homo sapiens
gctgccagccgggc

SEQ ID NO: 4188130 - DNA, 15 bp, Homo sapiens
gctgccagcctgagc

SEQ ID NO: 4188131 - DNA, 18 bp, Homo sapiens
gctgccaggctcccactg

SEQ ID NO: 4188132 - DNA, 15 bp, Homo sapiens
gctgccgcctcccag

SEQ ID NO: 4188133 - DNA, 18 bp, Homo sapiens
gctgccgcctcccagcct

SEQ ID NO: 4188134 - DNA, 16 bp, Homo sapiens
gctgcctctggtcaag

SEQ ID NO: 4188135 - DNA, 13 bp, Homo sapiens
gctgcctgtagtt

SEQ ID NO: 4188136 - DNA, 15 bp, Homo sapiens
gctgcctgtagttag

SEQ ID NO: 4188137 - DNA, 16 bp, Homo sapiens
gctgcctgtagttagg

SEQ ID NO: 4188138 - DNA, 19 bp, Homo sapiens
gctgccttttgctgctgct

SEQ ID NO: 4188139 - DNA, 21 bp, Homo sapiens
gctgcgaaaacgttgacccct

SEQ ID NO: 4188140 - DNA, 17 bp, Homo sapiens
gctgcggcatccctgtg

SEQ ID NO: 4188141 - DNA, 14 bp, Homo sapiens
gctgctagagaagg

SEQ ID NO: 4188142 - DNA, 13 bp, Homo sapiens
gctgctcctccag

SEQ ID NO: 4188143 - DNA, 12 bp, Homo sapiens
gctgctctggaa

SEQ ID NO: 4188144 - DNA, 14 bp, Homo sapiens
gctgctctggaaaa

SEQ ID NO: 4188145 - DNA, 11 bp, Homo sapiens
gctggaaataa

SEQ ID NO: 4188146 - DNA, 16 bp, Homo sapiens
gctggacaagaagctg

SEQ ID NO: 4188147 - DNA, 17 bp, Homo sapiens
gctggacaagaagctgc

SEQ ID NO: 4188148 - DNA, 17 bp, Homo sapiens
gctggatttgatgagtt

SEQ ID NO: 4188149 - DNA, 20 bp, Homo sapiens
gctggcctcccaataaagct

SEQ ID NO: 4188150 - DNA, 23 bp, Homo sapiens
gctggcctcccaataaagctgga

SEQ ID NO: 4188151 - DNA, 23 bp, Homo sapiens
gctggctatttaaaaagctcttt

SEQ ID NO: 4188152 - DNA, 13 bp, Homo sapiens
gctggctgcagtg

SEQ ID NO: 4188153 - DNA, 15 bp, Homo sapiens
gctggctgggcatgg

SEQ ID NO: 4188154 - DNA, 10 bp, Homo sapiens
gctggctgtc

SEQ ID NO: 4188155 - DNA, 14 bp, Homo sapiens
gctgggactacagg

SEQ ID NO: 4188156 - DNA, 14 bp, Homo sapiens
gctgggactggcca

SEQ ID NO: 4188157 - DNA, 15 bp, Homo sapiens
gctgggcctgagcct

SEQ ID NO: 4188158 - DNA, 15 bp, Homo sapiens
gctggggctgccagc

SEQ ID NO: 4188159 - DNA, 16 bp, Homo sapiens
gctggggctgccagcc

SEQ ID NO: 4188160 - DNA, 18 bp, Homo sapiens
gctggggctgccagcctg

SEQ ID NO: 4188161 - DNA, 15 bp, Homo sapiens
gctggggtacaggtt

SEQ ID NO: 4188162 - DNA, 17 bp, Homo sapiens
gctgggtcccgggtgcc

SEQ ID NO: 4188163 - DNA, 14 bp, Homo sapiens
gctggtaaactatt

SEQ ID NO: 4188164 - DNA, 19 bp, Homo sapiens
gctggtgctgtggccaggg

SEQ ID NO: 4188165 - DNA, 17 bp, Homo sapiens
gctgtcactggcagagc

SEQ ID NO: 4188166 - DNA, 18 bp, Homo sapiens
gctgtcactggcagagca

SEQ ID NO: 4188167 - DNA, 19 bp, Homo sapiens
gctgtcactggcagagcac

SEQ ID NO: 4188168 - DNA, 20 bp, Homo sapiens
gctgtcactggcagagcaca

SEQ ID NO: 4188169 - DNA, 21 bp, Homo sapiens
gctgtcactggcagagcacag

SEQ ID NO: 4188170 - DNA, 21 bp, Homo sapiens
gctgtcatggtcctttctgga

SEQ ID NO: 4188171 - DNA, 14 bp, Homo sapiens
gctgtcctaggcca

SEQ ID NO: 4188172 - DNA, 14 bp, Homo sapiens
gctgtggccagggt

SEQ ID NO: 4188173 - DNA, 21 bp, Homo sapiens
gctgtggccagggtgagagct

SEQ ID NO: 4188174 - DNA, 22 bp, Homo sapiens
gctgtggccagggtgagagctg

SEQ ID NO: 4188175 - DNA, 14 bp, Homo sapiens
gctgtggcccagtc

SEQ ID NO: 4188176 - DNA, 14 bp, Homo sapiens
gctgtggcctgggc

SEQ ID NO: 4188177 - DNA, 15 bp, Homo sapiens
gctgtggcctgggca

SEQ ID NO: 4188178 - DNA, 14 bp, Homo sapiens
gctgtggggtctgg

SEQ ID NO: 4188179 - DNA, 16 bp, Homo sapiens
gctgtggggtctggct

SEQ ID NO: 4188180 - DNA, 12 bp, Homo sapiens
gctgttggggca

SEQ ID NO: 4188181 - DNA, 18 bp, Homo sapiens
gctgttttagctgaggga

SEQ ID NO: 4188182 - DNA, 12 bp, Homo sapiens
gcttaaaacttt

SEQ ID NO: 4188183 - DNA, 17 bp, Homo sapiens
gcttaatcagatagata

SEQ ID NO: 4188184 - DNA, 18 bp, Homo sapiens
gcttagagaatgttctcc

SEQ ID NO: 4188185 - DNA, 15 bp, Homo sapiens
gcttagagaggaaaa

SEQ ID NO: 4188186 - DNA, 18 bp, Homo sapiens
gcttaggtgccaggctgt

SEQ ID NO: 4188187 - DNA, 19 bp, Homo sapiens
gcttcaccttggagcctga

SEQ ID NO: 4188188 - DNA, 14 bp, Homo sapiens
gcttcagcctgagg

SEQ ID NO: 4188189 - DNA, 21 bp, Homo sapiens
gcttcaggtccaggctgtgtt

SEQ ID NO: 4188190 - DNA, 17 bp, Homo sapiens
gcttccaggtggcagga

SEQ ID NO: 4188191 - DNA, 13 bp, Homo sapiens
gcttcccagaggc

SEQ ID NO: 4188192 - DNA, 18 bp, Homo sapiens
gcttctagatctggaacc

SEQ ID NO: 4188193 - DNA, 12 bp, Homo sapiens
gcttctccaggc

SEQ ID NO: 4188194 - DNA, 15 bp, Homo sapiens
gcttctcctcccagc

SEQ ID NO: 4188195 - DNA, 14 bp, Homo sapiens
gcttctctacagac

SEQ ID NO: 4188196 - DNA, 17 bp, Homo sapiens
gcttctgcagcaactcc

SEQ ID NO: 4188197 - DNA, 19 bp, Homo sapiens
gcttctgcagcaactccca

SEQ ID NO: 4188198 - DNA, 13 bp, Homo sapiens
gcttctggagccc

SEQ ID NO: 4188199 - DNA, 17 bp, Homo sapiens
gcttctggccaggaagc

SEQ ID NO: 4188200 - DNA, 19 bp, Homo sapiens
gcttcttcatcttgacatg

SEQ ID NO: 4188201 - DNA, 13 bp, Homo sapiens
gcttgagggacaa

SEQ ID NO: 4188202 - DNA, 15 bp, Homo sapiens
gcttgcctgcctgcc

SEQ ID NO: 4188203 - DNA, 12 bp, Homo sapiens
gcttgcttctgc

SEQ ID NO: 4188204 - DNA, 14 bp, Homo sapiens
gcttgcttctgcag

SEQ ID NO: 4188205 - DNA, 15 bp, Homo sapiens
gcttgcttctgcagc

SEQ ID NO: 4188206 - DNA, 21 bp, Homo sapiens
gcttggaaagcatcacctcag

SEQ ID NO: 4188207 - DNA, 15 bp, Homo sapiens
gcttggagctgagca

SEQ ID NO: 4188208 - DNA, 13 bp, Homo sapiens
gcttggcagctga

SEQ ID NO: 4188209 - DNA, 18 bp, Homo sapiens
gcttggtggccaagcctg

SEQ ID NO: 4188210 - DNA, 16 bp, Homo sapiens
gcttgttgtgctttta

SEQ ID NO: 4188211 - DNA, 17 bp, Homo sapiens
gctttaatcaattctag

SEQ ID NO: 4188212 - DNA, 12 bp, Homo sapiens
gctttacatgca

SEQ ID NO: 4188213 - DNA, 15 bp, Homo sapiens
gctttccatgggacc

SEQ ID NO: 4188214 - DNA, 16 bp, Homo sapiens
gctttcctggtccctc

SEQ ID NO: 4188215 - DNA, 12 bp, Homo sapiens
gctttctccttt

SEQ ID NO: 4188216 - DNA, 15 bp, Homo sapiens
gctttgaaacagaaa

SEQ ID NO: 4188217 - DNA, 12 bp, Homo sapiens
gctttgccaaaa

SEQ ID NO: 4188218 - DNA, 21 bp, Homo sapiens
gctttgccaaaataccagagc

SEQ ID NO: 4188219 - DNA, 23 bp, Homo sapiens
gctttgccaaaataccagagcct

SEQ ID NO: 4188220 - DNA, 19 bp, Homo sapiens
gctttgccatgggcctgct

SEQ ID NO: 4188221 - DNA, 21 bp, Homo sapiens
gctttgccatgggcctgctgc

SEQ ID NO: 4188222 - DNA, 14 bp, Homo sapiens
gctttggtccccag

SEQ ID NO: 4188223 - DNA, 17 bp, Homo sapiens
gctttggtgagaacctg

SEQ ID NO: 4188224 - DNA, 18 bp, Homo sapiens
gctttgtctctagccggg

SEQ ID NO: 4188225 - DNA, 15 bp, Homo sapiens
gcttttattgtataa

SEQ ID NO: 4188226 - DNA, 22 bp, Homo sapiens
gcttttcagttcccgctctgca

SEQ ID NO: 4188227 - DNA, 23 bp, Homo sapiens
gcttttgcggttcaggaaaattg

SEQ ID NO: 4188228 - DNA, 21 bp, Homo sapiens
gcttttggtggtccccacagc

SEQ ID NO: 4188229 - DNA, 13 bp, Homo sapiens
ggaaaaagaaaga

SEQ ID NO: 4188230 - DNA, 22 bp, Homo sapiens
ggaaaagaatccctgcagcctg

SEQ ID NO: 4188231 - DNA, 23 bp, Homo sapiens
ggaaaagaatccctgcagcctgg

SEQ ID NO: 4188232 - DNA, 12 bp, Homo sapiens
ggaaaagacaga

SEQ ID NO: 4188233 - DNA, 13 bp, Homo sapiens
ggaaaagacagag

SEQ ID NO: 4188234 - DNA, 15 bp, Homo sapiens
ggaaaagtgttatta

SEQ ID NO: 4188235 - DNA, 23 bp, Homo sapiens
ggaaaagttctttactggtgatt

SEQ ID NO: 4188236 - DNA, 15 bp, Homo sapiens
ggaaaattagaagca

SEQ ID NO: 4188237 - DNA, 16 bp, Homo sapiens
ggaaacccaaggaaca

SEQ ID NO: 4188238 - DNA, 20 bp, Homo sapiens
ggaaaggccagaggcagagt

SEQ ID NO: 4188239 - DNA, 20 bp, Homo sapiens
ggaaaggctcagtctcagga

SEQ ID NO: 4188240 - DNA, 23 bp, Homo sapiens
ggaaaggctcagtctcaggagca

SEQ ID NO: 4188241 - DNA, 15 bp, Homo sapiens
ggaaagggaagcctg

SEQ ID NO: 4188242 - DNA, 16 bp, Homo sapiens
ggaaagggaagcctga

SEQ ID NO: 4188243 - DNA, 16 bp, Homo sapiens
ggaaataaaacctttc

SEQ ID NO: 4188244 - DNA, 13 bp, Homo sapiens
ggaaataaatgat

SEQ ID NO: 4188245 - DNA, 23 bp, Homo sapiens
ggaaatgtgtgttgtaacaaata

SEQ ID NO: 4188246 - DNA, 11 bp, Homo sapiens
ggaacattttc

SEQ ID NO: 4188247 - DNA, 13 bp, Homo sapiens
ggaaccagggaga

SEQ ID NO: 4188248 - DNA, 17 bp, Homo sapiens
ggaaccagggagaccga

SEQ ID NO: 4188249 - DNA, 11 bp, Homo sapiens
ggaactcccag

SEQ ID NO: 4188250 - DNA, 22 bp, Homo sapiens
ggaactcccagcaacacaagct

SEQ ID NO: 4188251 - DNA, 15 bp, Homo sapiens
ggaactggttcaaga

SEQ ID NO: 4188252 - DNA, 20 bp, Homo sapiens
ggaagaagagatcaggaaga

SEQ ID NO: 4188253 - DNA, 16 bp, Homo sapiens
ggaagagaagggaagc

SEQ ID NO: 4188254 - DNA, 12 bp, Homo sapiens
ggaagagaggca

SEQ ID NO: 4188255 - DNA, 14 bp, Homo sapiens
ggaagagaggcacc

SEQ ID NO: 4188256 - DNA, 15 bp, Homo sapiens
ggaagagaggcacct

SEQ ID NO: 4188257 - DNA, 18 bp, Homo sapiens
ggaagccaacttggcttt

SEQ ID NO: 4188258 - DNA, 20 bp, Homo sapiens
ggaagcggaggttgcaggga

SEQ ID NO: 4188259 - DNA, 13 bp, Homo sapiens
ggaaggagtgaga

SEQ ID NO: 4188260 - DNA, 14 bp, Homo sapiens
ggaaggctggctgg

SEQ ID NO: 4188261 - DNA, 21 bp, Homo sapiens
ggaaggcttgttgtgctttta

SEQ ID NO: 4188262 - DNA, 18 bp, Homo sapiens
ggaagggttggtgggctg

SEQ ID NO: 4188263 - DNA, 19 bp, Homo sapiens
ggaaggtcccttgtttcca

SEQ ID NO: 4188264 - DNA, 18 bp, Homo sapiens
ggaaggttagaggtttgt

SEQ ID NO: 4188265 - DNA, 19 bp, Homo sapiens
ggaataaggtacaagaagc

SEQ ID NO: 4188266 - DNA, 15 bp, Homo sapiens
ggaatataattgttt

SEQ ID NO: 4188267 - DNA, 16 bp, Homo sapiens
ggaatatgactgtttt

SEQ ID NO: 4188268 - DNA, 19 bp, Homo sapiens
ggaatcagctggtggctag

SEQ ID NO: 4188269 - DNA, 21 bp, Homo sapiens
ggaatcagctggtggctaggt

SEQ ID NO: 4188270 - DNA, 17 bp, Homo sapiens
ggaatccgcctgcagag

SEQ ID NO: 4188271 - DNA, 19 bp, Homo sapiens
ggaatggaaggctttgcca

SEQ ID NO: 4188272 - DNA, 21 bp, Homo sapiens
ggaatggaaggctttgccatg

SEQ ID NO: 4188273 - DNA, 21 bp, Homo sapiens
ggaatgtttgggcagaaggga

SEQ ID NO: 4188274 - DNA, 12 bp, Homo sapiens
ggacaacatttt

SEQ ID NO: 4188275 - DNA, 15 bp, Homo sapiens
ggacacacagtgaca

SEQ ID NO: 4188276 - DNA, 12 bp, Homo sapiens
ggacacatgtcc

SEQ ID NO: 4188277 - DNA, 13 bp, Homo sapiens
ggacacatgtcca

SEQ ID NO: 4188278 - DNA, 21 bp, Homo sapiens
ggacaccccccgccccccacc

SEQ ID NO: 4188279 - DNA, 20 bp, Homo sapiens
ggacaccccttatccaggac

SEQ ID NO: 4188280 - DNA, 13 bp, Homo sapiens
ggacacctgccct

SEQ ID NO: 4188281 - DNA, 19 bp, Homo sapiens
ggacagatagacagtgctg

SEQ ID NO: 4188282 - DNA, 17 bp, Homo sapiens
ggacaggatgtgtttgc

SEQ ID NO: 4188283 - DNA, 17 bp, Homo sapiens
ggacaggtaagtggcag

SEQ ID NO: 4188284 - DNA, 17 bp, Homo sapiens
ggacagtattctcagtg

SEQ ID NO: 4188285 - DNA, 16 bp, Homo sapiens
ggacagtgcttcagcc

SEQ ID NO: 4188286 - DNA, 21 bp, Homo sapiens
ggacagtgcttcagcctgagg

SEQ ID NO: 4188287 - DNA, 23 bp, Homo sapiens
ggacagtgcttcagcctgaggct

SEQ ID NO: 4188288 - DNA, 21 bp, Homo sapiens
ggacatgatttagggaagcag

SEQ ID NO: 4188289 - DNA, 14 bp, Homo sapiens
ggacccagctcctc

SEQ ID NO: 4188290 - DNA, 17 bp, Homo sapiens
ggacccagctcctctga

SEQ ID NO: 4188291 - DNA, 21 bp, Homo sapiens
ggacccagctcctctgagcca

SEQ ID NO: 4188292 - DNA, 18 bp, Homo sapiens
ggaccgcttcccagaggc

SEQ ID NO: 4188293 - DNA, 22 bp, Homo sapiens
ggacctatgacaggctgaaagc

SEQ ID NO: 4188294 - DNA, 17 bp, Homo sapiens
ggacctgaatgacctgc

SEQ ID NO: 4188295 - DNA, 21 bp, Homo sapiens
ggacctgcacgccaccgctgc

SEQ ID NO: 4188296 - DNA, 15 bp, Homo sapiens
ggacctttcagctgt

SEQ ID NO: 4188297 - DNA, 14 bp, Homo sapiens
ggactccccaggcc

SEQ ID NO: 4188298 - DNA, 15 bp, Homo sapiens
ggactcctcccacaa

SEQ ID NO: 4188299 - DNA, 18 bp, Homo sapiens
ggactcgtaaagctgcta

SEQ ID NO: 4188300 - DNA, 13 bp, Homo sapiens
ggactctgaggct

SEQ ID NO: 4188301 - DNA, 21 bp, Homo sapiens
ggactctgaggctctttctgg

SEQ ID NO: 4188302 - DNA, 22 bp, Homo sapiens
ggactgcaagcagggctctgcc

SEQ ID NO: 4188303 - DNA, 14 bp, Homo sapiens
ggactggaaccagg

SEQ ID NO: 4188304 - DNA, 15 bp, Homo sapiens
ggactggaaccaggg

SEQ ID NO: 4188305 - DNA, 18 bp, Homo sapiens
ggactgggttttgtctct

SEQ ID NO: 4188306 - DNA, 19 bp, Homo sapiens
ggactgtgataatcagaag

SEQ ID NO: 4188307 - DNA, 18 bp, Homo sapiens
ggacttgaggattttgag

SEQ ID NO: 4188308 - DNA, 20 bp, Homo sapiens
ggagaactaggtttaaaaca

SEQ ID NO: 4188309 - DNA, 13 bp, Homo sapiens
ggagaagagaacc

SEQ ID NO: 4188310 - DNA, 13 bp, Homo sapiens
ggagaagctgatg

SEQ ID NO: 4188311 - DNA, 12 bp, Homo sapiens
ggagaaggaagg

SEQ ID NO: 4188312 - DNA, 16 bp, Homo sapiens
ggagacagccctgcct

SEQ ID NO: 4188313 - DNA, 18 bp, Homo sapiens
ggagacagccctgcctat

SEQ ID NO: 4188314 - DNA, 20 bp, Homo sapiens
ggagaccccggtggcagtgg

SEQ ID NO: 4188315 - DNA, 20 bp, Homo sapiens
ggagagatcatagctcactg

SEQ ID NO: 4188316 - DNA, 17 bp, Homo sapiens
ggagagcaagaaggaaa

SEQ ID NO: 4188317 - DNA, 13 bp, Homo sapiens
ggagagcagctgg

SEQ ID NO: 4188318 - DNA, 15 bp, Homo sapiens
ggagagccagctctc

SEQ ID NO: 4188319 - DNA, 17 bp, Homo sapiens
ggagagccagctctctc

SEQ ID NO: 4188320 - DNA, 19 bp, Homo sapiens
ggagagcgcctcttcctct

SEQ ID NO: 4188321 - DNA, 20 bp, Homo sapiens
ggagagcgcctcttcctctg

SEQ ID NO: 4188322 - DNA, 23 bp, Homo sapiens
ggagagcgcctcttcctctgggc

SEQ ID NO: 4188323 - DNA, 22 bp, Homo sapiens
ggagaggaagcacactgcaggg

SEQ ID NO: 4188324 - DNA, 14 bp, Homo sapiens
ggagaggactctgc

SEQ ID NO: 4188325 - DNA, 16 bp, Homo sapiens
ggagaggactctgcct

SEQ ID NO: 4188326 - DNA, 22 bp, Homo sapiens
ggagaggtttgtcaacacaaag

SEQ ID NO: 4188327 - DNA, 17 bp, Homo sapiens
ggagagtacagtgagcc

SEQ ID NO: 4188328 - DNA, 15 bp, Homo sapiens
ggagcatcccaggcg

SEQ ID NO: 4188329 - DNA, 15 bp, Homo sapiens
ggagccaaggcagag

SEQ ID NO: 4188330 - DNA, 21 bp, Homo sapiens
ggagcccgcttcaagctctct

SEQ ID NO: 4188331 - DNA, 23 bp, Homo sapiens
ggagcgcacctgccccctggtgg

SEQ ID NO: 4188332 - DNA, 20 bp, Homo sapiens
ggagcggagcttgcctgcct

SEQ ID NO: 4188333 - DNA, 16 bp, Homo sapiens
ggagctctctgctgag

SEQ ID NO: 4188334 - DNA, 13 bp, Homo sapiens
ggagctggaaata

SEQ ID NO: 4188335 - DNA, 14 bp, Homo sapiens
ggagcttgagggac

SEQ ID NO: 4188336 - DNA, 21 bp, Homo sapiens
ggagcttgagggacaatgcca

SEQ ID NO: 4188337 - DNA, 23 bp, Homo sapiens
ggagcttgagggacaatgccact

SEQ ID NO: 4188338 - DNA, 13 bp, Homo sapiens
ggagcttgcctgc

SEQ ID NO: 4188339 - DNA, 14 bp, Homo sapiens
ggagcttgcctgcc

SEQ ID NO: 4188340 - DNA, 15 bp, Homo sapiens
ggagcttgcctgcct

SEQ ID NO: 4188341 - DNA, 20 bp, Homo sapiens
ggaggaagactctggagcca

SEQ ID NO: 4188342 - DNA, 17 bp, Homo sapiens
ggaggaggcagagaaga

SEQ ID NO: 4188343 - DNA, 17 bp, Homo sapiens
ggaggatcactggagcc

SEQ ID NO: 4188344 - DNA, 19 bp, Homo sapiens
ggaggatcactggagccca

SEQ ID NO: 4188345 - DNA, 15 bp, Homo sapiens
ggaggcagagaagaa

SEQ ID NO: 4188346 - DNA, 20 bp, Homo sapiens
ggaggcctcgtaccagccag

SEQ ID NO: 4188347 - DNA, 17 bp, Homo sapiens
ggaggcgaataaatgtt

SEQ ID NO: 4188348 - DNA, 12 bp, Homo sapiens
ggaggcggagag

SEQ ID NO: 4188349 - DNA, 14 bp, Homo sapiens
ggaggcggctccag

SEQ ID NO: 4188350 - DNA, 15 bp, Homo sapiens
ggaggcggctccagg

SEQ ID NO: 4188351 - DNA, 17 bp, Homo sapiens
ggaggcggctccaggtc

SEQ ID NO: 4188352 - DNA, 20 bp, Homo sapiens
ggaggctcggccgtgggccg

SEQ ID NO: 4188353 - DNA, 15 bp, Homo sapiens
ggaggctgagacagg

SEQ ID NO: 4188354 - DNA, 19 bp, Homo sapiens
ggaggctgagacaggagaa

SEQ ID NO: 4188355 - DNA, 15 bp, Homo sapiens
ggaggctgaggcagg

SEQ ID NO: 4188356 - DNA, 17 bp, Homo sapiens
ggaggctgaggcaggag

SEQ ID NO: 4188357 - DNA, 20 bp, Homo sapiens
ggaggggacccagctcctct

SEQ ID NO: 4188358 - DNA, 19 bp, Homo sapiens
ggaggggatggcagacagt

SEQ ID NO: 4188359 - DNA, 23 bp, Homo sapiens
ggaggggttgcgggggagctgga

SEQ ID NO: 4188360 - DNA, 20 bp, Homo sapiens
ggaggtcaagcctgcagcga

SEQ ID NO: 4188361 - DNA, 15 bp, Homo sapiens
ggaggtccaggcagg

SEQ ID NO: 4188362 - DNA, 22 bp, Homo sapiens
ggaggtcgaccccaaagcccct

SEQ ID NO: 4188363 - DNA, 18 bp, Homo sapiens
ggaggtctccactgagga

SEQ ID NO: 4188364 - DNA, 17 bp, Homo sapiens
ggaggtgagaccacctc

SEQ ID NO: 4188365 - DNA, 19 bp, Homo sapiens
ggaggtggaggttgcagtg

SEQ ID NO: 4188366 - DNA, 17 bp, Homo sapiens
ggaggtggcagccctgt

SEQ ID NO: 4188367 - DNA, 14 bp, Homo sapiens
ggaggttgcagtga

SEQ ID NO: 4188368 - DNA, 21 bp, Homo sapiens
ggaggttgcagtgagctgaga

SEQ ID NO: 4188369 - DNA, 15 bp, Homo sapiens
ggagttccatgaaga

SEQ ID NO: 4188370 - DNA, 20 bp, Homo sapiens
ggagttcgagaccagcctgg

SEQ ID NO: 4188371 - DNA, 19 bp, Homo sapiens
ggagttgacgcatcctgca

SEQ ID NO: 4188372 - DNA, 14 bp, Homo sapiens
ggataacctatatg

SEQ ID NO: 4188373 - DNA, 13 bp, Homo sapiens
ggatagcattttt

SEQ ID NO: 4188374 - DNA, 17 bp, Homo sapiens
ggatatggtgcaaaaat

SEQ ID NO: 4188375 - DNA, 14 bp, Homo sapiens
ggatcactggagcc

SEQ ID NO: 4188376 - DNA, 18 bp, Homo sapiens
ggatcactggagcccagg

SEQ ID NO: 4188377 - DNA, 19 bp, Homo sapiens
ggatcactggagcccagga

SEQ ID NO: 4188378 - DNA, 12 bp, Homo sapiens
ggatcagcctcc

SEQ ID NO: 4188379 - DNA, 19 bp, Homo sapiens
ggatccagagacttgggga

SEQ ID NO: 4188380 - DNA, 20 bp, Homo sapiens
ggatccagagacttggggac

SEQ ID NO: 4188381 - DNA, 14 bp, Homo sapiens
ggatctccaaggac

SEQ ID NO: 4188382 - DNA, 17 bp, Homo sapiens
ggatcttgcattcccag

SEQ ID NO: 4188383 - DNA, 14 bp, Homo sapiens
ggatgagagtggct

SEQ ID NO: 4188384 - DNA, 20 bp, Homo sapiens
ggatggcccagcaggcaggc

SEQ ID NO: 4188385 - DNA, 22 bp, Homo sapiens
ggatggcccttcccactggagg

SEQ ID NO: 4188386 - DNA, 14 bp, Homo sapiens
ggatgggccctgca

SEQ ID NO: 4188387 - DNA, 22 bp, Homo sapiens
ggatggtcctggggctctgtgc

SEQ ID NO: 4188388 - DNA, 15 bp, Homo sapiens
ggattaatttattta

SEQ ID NO: 4188389 - DNA, 18 bp, Homo sapiens
ggattccagcatttgcca

SEQ ID NO: 4188390 - DNA, 23 bp, Homo sapiens
ggattcccaccaaggtcttcagc

SEQ ID NO: 4188391 - DNA, 12 bp, Homo sapiens
ggattggcctgt

SEQ ID NO: 4188392 - DNA, 16 bp, Homo sapiens
ggattggcctgtgtct

SEQ ID NO: 4188393 - DNA, 14 bp, Homo sapiens
ggatttatttaaaa

SEQ ID NO: 4188394 - DNA, 23 bp, Homo sapiens
ggatttgatgagttaactgtgaa

SEQ ID NO: 4188395 - DNA, 13 bp, Homo sapiens
ggatttgttcaca

SEQ ID NO: 4188396 - DNA, 18 bp, Homo sapiens
ggcaaagaactgccccat

SEQ ID NO: 4188397 - DNA, 23 bp, Homo sapiens
ggcaaagaactgccccatctcct

SEQ ID NO: 4188398 - DNA, 12 bp, Homo sapiens
ggcaaagctgga

SEQ ID NO: 4188399 - DNA, 17 bp, Homo sapiens
ggcaacgacggtttcaa

SEQ ID NO: 4188400 - DNA, 17 bp, Homo sapiens
ggcaaggcattcctcat

SEQ ID NO: 4188401 - DNA, 21 bp, Homo sapiens
ggcaagggccatgctgaaggg

SEQ ID NO: 4188402 - DNA, 22 bp, Homo sapiens
ggcaagtccctgactctctgtg

SEQ ID NO: 4188403 - DNA, 19 bp, Homo sapiens
ggcaagtggatggcccagc

SEQ ID NO: 4188404 - DNA, 14 bp, Homo sapiens
ggcaccccctggag

SEQ ID NO: 4188405 - DNA, 18 bp, Homo sapiens
ggcaccccctggagagaa

SEQ ID NO: 4188406 - DNA, 18 bp, Homo sapiens
ggcacctatagtcccagc

SEQ ID NO: 4188407 - DNA, 18 bp, Homo sapiens
ggcacctgaccagaatgc

SEQ ID NO: 4188408 - DNA, 18 bp, Homo sapiens
ggcacgccaacagccccc

SEQ ID NO: 4188409 - DNA, 16 bp, Homo sapiens
ggcactgtggcccttc

SEQ ID NO: 4188410 - DNA, 23 bp, Homo sapiens
ggcagaaaacggagagtgcttgg

SEQ ID NO: 4188411 - DNA, 15 bp, Homo sapiens
ggcagaagggagaag

SEQ ID NO: 4188412 - DNA, 16 bp, Homo sapiens
ggcagaaggggaagat

SEQ ID NO: 4188413 - DNA, 19 bp, Homo sapiens
ggcagactctttatgcttg

SEQ ID NO: 4188414 - DNA, 20 bp, Homo sapiens
ggcagactctttatgcttgc

SEQ ID NO: 4188415 - DNA, 20 bp, Homo sapiens
ggcagagcacagcccacggg

SEQ ID NO: 4188416 - DNA, 20 bp, Homo sapiens
ggcagagccaccagggcact

SEQ ID NO: 4188417 - DNA, 13 bp, Homo sapiens
ggcagccctgtag

SEQ ID NO: 4188418 - DNA, 15 bp, Homo sapiens
ggcagccctgtaggg

SEQ ID NO: 4188419 - DNA, 14 bp, Homo sapiens
ggcagcctgccgcc

SEQ ID NO: 4188420 - DNA, 15 bp, Homo sapiens
ggcaggaccaggact

SEQ ID NO: 4188421 - DNA, 16 bp, Homo sapiens
ggcaggaccctgtcag

SEQ ID NO: 4188422 - DNA, 17 bp, Homo sapiens
ggcaggaccctgtcagg

SEQ ID NO: 4188423 - DNA, 24 bp, Homo sapiens
ggcaggtgccctctgctccccagt

SEQ ID NO: 4188424 - DNA, 24 bp, Homo sapiens
ggcagtgaacacactcagcagccc

SEQ ID NO: 4188425 - DNA, 23 bp, Homo sapiens
ggcagtgctgatccggctgctcc

SEQ ID NO: 4188426 - DNA, 22 bp, Homo sapiens
ggcagtggaaaaatcagaagca

SEQ ID NO: 4188427 - DNA, 14 bp, Homo sapiens
ggcagttgggagtg

SEQ ID NO: 4188428 - DNA, 21 bp, Homo sapiens
ggcatagagggagaggaagca

SEQ ID NO: 4188429 - DNA, 14 bp, Homo sapiens
ggcatcacagggca

SEQ ID NO: 4188430 - DNA, 22 bp, Homo sapiens
ggcatcacagggcagagccggg

SEQ ID NO: 4188431 - DNA, 16 bp, Homo sapiens
ggcatccttctgcctt

SEQ ID NO: 4188432 - DNA, 13 bp, Homo sapiens
ggcatgctggcct

SEQ ID NO: 4188433 - DNA, 16 bp, Homo sapiens
ggcatgctggggcaag

SEQ ID NO: 4188434 - DNA, 14 bp, Homo sapiens
ggcatgtcagagcc

SEQ ID NO: 4188435 - DNA, 19 bp, Homo sapiens
ggcatgtcagagccaggct

SEQ ID NO: 4188436 - DNA, 23 bp, Homo sapiens
ggcatgttagcccttcctccaat

SEQ ID NO: 4188437 - DNA, 23 bp, Homo sapiens
ggcatgtttgtctgtgtgctgta

SEQ ID NO: 4188438 - DNA, 21 bp, Homo sapiens
ggccaaattatttgtgtaata

SEQ ID NO: 4188439 - DNA, 22 bp, Homo sapiens
ggccaatgcacctaaagaaaaa

SEQ ID NO: 4188440 - DNA, 20 bp, Homo sapiens
ggccactctcccctccctct

SEQ ID NO: 4188441 - DNA, 21 bp, Homo sapiens
ggccactctcccctccctctt

SEQ ID NO: 4188442 - DNA, 14 bp, Homo sapiens
ggccagagccaagg

SEQ ID NO: 4188443 - DNA, 21 bp, Homo sapiens
ggccagctgtcgcatctcagc

SEQ ID NO: 4188444 - DNA, 16 bp, Homo sapiens
ggccagggccctgcag

SEQ ID NO: 4188445 - DNA, 17 bp, Homo sapiens
ggccagggccctgcaga

SEQ ID NO: 4188446 - DNA, 17 bp, Homo sapiens
ggccaggggtctccctg

SEQ ID NO: 4188447 - DNA, 17 bp, Homo sapiens
ggccaggtttctgccca

SEQ ID NO: 4188448 - DNA, 13 bp, Homo sapiens
ggccagtgagggc

SEQ ID NO: 4188449 - DNA, 15 bp, Homo sapiens
ggccagtgagggctg

SEQ ID NO: 4188450 - DNA, 16 bp, Homo sapiens
ggccagtgagggctgg

SEQ ID NO: 4188451 - DNA, 14 bp, Homo sapiens
ggccagtgggcctg

SEQ ID NO: 4188452 - DNA, 15 bp, Homo sapiens
ggccagtgggcctgg

SEQ ID NO: 4188453 - DNA, 16 bp, Homo sapiens
ggccatgctgaaggga

SEQ ID NO: 4188454 - DNA, 17 bp, Homo sapiens
ggccatgctgaagggac

SEQ ID NO: 4188455 - DNA, 20 bp, Homo sapiens
ggccatgctttccttttctt

SEQ ID NO: 4188456 - DNA, 13 bp, Homo sapiens
ggcccacagagcc

SEQ ID NO: 4188457 - DNA, 12 bp, Homo sapiens
ggcccagcctgt

SEQ ID NO: 4188458 - DNA, 16 bp, Homo sapiens
ggcccagcctgtcctg

SEQ ID NO: 4188459 - DNA, 17 bp, Homo sapiens
ggcccagcctgtcctgg

SEQ ID NO: 4188460 - DNA, 18 bp, Homo sapiens
ggcccaggaggtcaagcc

SEQ ID NO: 4188461 - DNA, 18 bp, Homo sapiens
ggcccccctccaggcatg

SEQ ID NO: 4188462 - DNA, 19 bp, Homo sapiens
ggcccccctccaggcatgc

SEQ ID NO: 4188463 - DNA, 23 bp, Homo sapiens
ggcccctagaaaccacctgggtt

SEQ ID NO: 4188464 - DNA, 14 bp, Homo sapiens
ggcccgaaagctga

SEQ ID NO: 4188465 - DNA, 20 bp, Homo sapiens
ggcccttcccaacctcccct

SEQ ID NO: 4188466 - DNA, 15 bp, Homo sapiens
ggccgggaggcagtg

SEQ ID NO: 4188467 - DNA, 15 bp, Homo sapiens
ggccggtgtgggctg

SEQ ID NO: 4188468 - DNA, 13 bp, Homo sapiens
ggccgtgcccagg

SEQ ID NO: 4188469 - DNA, 22 bp, Homo sapiens
ggccgtggccatcagggtgggc

SEQ ID NO: 4188470 - DNA, 17 bp, Homo sapiens
ggcctcagcacccctgt

SEQ ID NO: 4188471 - DNA, 22 bp, Homo sapiens
ggcctccgtcatgaatgccttc

SEQ ID NO: 4188472 - DNA, 14 bp, Homo sapiens
ggcctctaattgaa

SEQ ID NO: 4188473 - DNA, 18 bp, Homo sapiens
ggcctctctcttcccagc

SEQ ID NO: 4188474 - DNA, 18 bp, Homo sapiens
ggcctgatgacagagcga

SEQ ID NO: 4188475 - DNA, 17 bp, Homo sapiens
ggcctgccctcagggat

SEQ ID NO: 4188476 - DNA, 18 bp, Homo sapiens
ggcctgccttgaagccac

SEQ ID NO: 4188477 - DNA, 21 bp, Homo sapiens
ggcctggaccgcttcccagag

SEQ ID NO: 4188478 - DNA, 23 bp, Homo sapiens
ggcctggaccgcttcccagaggc

SEQ ID NO: 4188479 - DNA, 14 bp, Homo sapiens
ggcctggccaggca

SEQ ID NO: 4188480 - DNA, 13 bp, Homo sapiens
ggccttctcagcc

SEQ ID NO: 4188481 - DNA, 22 bp, Homo sapiens
ggccttctcagcctacagcagt

SEQ ID NO: 4188482 - DNA, 17 bp, Homo sapiens
ggcgacagagcaagact

SEQ ID NO: 4188483 - DNA, 23 bp, Homo sapiens
ggcgacagagcgagagtctgtct

SEQ ID NO: 4188484 - DNA, 15 bp, Homo sapiens
ggcgatcaagtccag

SEQ ID NO: 4188485 - DNA, 14 bp, Homo sapiens
ggcgcgtctgcccc

SEQ ID NO: 4188486 - DNA, 17 bp, Homo sapiens
ggcgcgtctgccccacc

SEQ ID NO: 4188487 - DNA, 19 bp, Homo sapiens
ggcggagagtacagtgagc

SEQ ID NO: 4188488 - DNA, 20 bp, Homo sapiens
ggcggagagtacagtgagcc

SEQ ID NO: 4188489 - DNA, 13 bp, Homo sapiens
ggcggaggcggct

SEQ ID NO: 4188490 - DNA, 19 bp, Homo sapiens
ggcggaggttgcagtgagc

SEQ ID NO: 4188491 - DNA, 20 bp, Homo sapiens
ggcgggggcccgaaagctga

SEQ ID NO: 4188492 - DNA, 13 bp, Homo sapiens
ggctactcagcag

SEQ ID NO: 4188493 - DNA, 20 bp, Homo sapiens
ggctagagtgcggtggcgcg

SEQ ID NO: 4188494 - DNA, 12 bp, Homo sapiens
ggctaggctctt

SEQ ID NO: 4188495 - DNA, 20 bp, Homo sapiens
ggctatgggaatcagctggt

SEQ ID NO: 4188496 - DNA, 23 bp, Homo sapiens
ggctatgggaatcagctggtggc

SEQ ID NO: 4188497 - DNA, 21 bp, Homo sapiens
ggctcacgcctatgatcccag

SEQ ID NO: 4188498 - DNA, 17 bp, Homo sapiens
ggctcagtctcaggagc

SEQ ID NO: 4188499 - DNA, 15 bp, Homo sapiens
ggctccaaggtgctc

SEQ ID NO: 4188500 - DNA, 13 bp, Homo sapiens
ggctccaggtccg

SEQ ID NO: 4188501 - DNA, 20 bp, Homo sapiens
ggctccaggtccggaggggt

SEQ ID NO: 4188502 - DNA, 19 bp, Homo sapiens
ggctcccactgcccctgca

SEQ ID NO: 4188503 - DNA, 17 bp, Homo sapiens
ggctcccagggacacct

SEQ ID NO: 4188504 - DNA, 23 bp, Homo sapiens
ggctcccgccaccctcaataaat

SEQ ID NO: 4188505 - DNA, 15 bp, Homo sapiens
ggctccctcctggag

SEQ ID NO: 4188506 - DNA, 20 bp, Homo sapiens
ggctcctgtgctactttgcc

SEQ ID NO: 4188507 - DNA, 20 bp, Homo sapiens
ggctcctttgcctctgctac

SEQ ID NO: 4188508 - DNA, 14 bp, Homo sapiens
ggctcgccccaccc

SEQ ID NO: 4188509 - DNA, 20 bp, Homo sapiens
ggctcgccccacccagggct

SEQ ID NO: 4188510 - DNA, 21 bp, Homo sapiens
ggctctattgagccaagacca

SEQ ID NO: 4188511 - DNA, 16 bp, Homo sapiens
ggctctgccccagagg

SEQ ID NO: 4188512 - DNA, 18 bp, Homo sapiens
ggctctgccccagaggcc

SEQ ID NO: 4188513 - DNA, 14 bp, Homo sapiens
ggctctgccccagc

SEQ ID NO: 4188514 - DNA, 21 bp, Homo sapiens
ggctctgccccagctctggct

SEQ ID NO: 4188515 - DNA, 14 bp, Homo sapiens
ggctctgcctggag

SEQ ID NO: 4188516 - DNA, 20 bp, Homo sapiens
ggctgaccccaaagagcctg

SEQ ID NO: 4188517 - DNA, 22 bp, Homo sapiens
ggctgaccccaaagagcctgga

SEQ ID NO: 4188518 - DNA, 14 bp, Homo sapiens
ggctgacctgggcc

SEQ ID NO: 4188519 - DNA, 13 bp, Homo sapiens
ggctgagaaggaa

SEQ ID NO: 4188520 - DNA, 14 bp, Homo sapiens
ggctgagaaggaac

SEQ ID NO: 4188521 - DNA, 19 bp, Homo sapiens
ggctgagaaggaacaggga

SEQ ID NO: 4188522 - DNA, 21 bp, Homo sapiens
ggctgagactgcgggatggtc

SEQ ID NO: 4188523 - DNA, 16 bp, Homo sapiens
ggctgagccctggcag

SEQ ID NO: 4188524 - DNA, 15 bp, Homo sapiens
ggctgagcttggccc

SEQ ID NO: 4188525 - DNA, 22 bp, Homo sapiens
ggctgcagtgacgtgcacctgt

SEQ ID NO: 4188526 - DNA, 23 bp, Homo sapiens
ggctgcatctgggattcccacca

SEQ ID NO: 4188527 - DNA, 12 bp, Homo sapiens
ggctgccagcct

SEQ ID NO: 4188528 - DNA, 15 bp, Homo sapiens
ggctgcccaatctga

SEQ ID NO: 4188529 - DNA, 24 bp, Homo sapiens
ggctgctcattccttctggaggac

SEQ ID NO: 4188530 - DNA, 13 bp, Homo sapiens
ggctgctcctcca

SEQ ID NO: 4188531 - DNA, 16 bp, Homo sapiens
ggctgctgtggcccag

SEQ ID NO: 4188532 - DNA, 15 bp, Homo sapiens
ggctgctgtgtgcct

SEQ ID NO: 4188533 - DNA, 19 bp, Homo sapiens
ggctggagtgcagtggcat

SEQ ID NO: 4188534 - DNA, 15 bp, Homo sapiens
ggctgggcctgagcc

SEQ ID NO: 4188535 - DNA, 23 bp, Homo sapiens
ggctgtcttggtggatgggccct

SEQ ID NO: 4188536 - DNA, 18 bp, Homo sapiens
ggcttatcatcagccctc

SEQ ID NO: 4188537 - DNA, 23 bp, Homo sapiens
ggcttattcccaactgctctgcc

SEQ ID NO: 4188538 - DNA, 13 bp, Homo sapiens
ggcttcaggtcca

SEQ ID NO: 4188539 - DNA, 16 bp, Homo sapiens
ggcttcaggtccaggc

SEQ ID NO: 4188540 - DNA, 14 bp, Homo sapiens
ggcttcttgcccag

SEQ ID NO: 4188541 - DNA, 15 bp, Homo sapiens
ggcttgccctgggtc

SEQ ID NO: 4188542 - DNA, 17 bp, Homo sapiens
ggcttggtggccaagcc

SEQ ID NO: 4188543 - DNA, 21 bp, Homo sapiens
ggcttttcgcttgcttctgca

SEQ ID NO: 4188544 - DNA, 19 bp, Homo sapiens
gggaaaagggcaatcagca

SEQ ID NO: 4188545 - DNA, 13 bp, Homo sapiens
gggaaattctata

SEQ ID NO: 4188546 - DNA, 17 bp, Homo sapiens
gggaacactcatccctg

SEQ ID NO: 4188547 - DNA, 23 bp, Homo sapiens
gggaagcggaggttgcagggagc

SEQ ID NO: 4188548 - DNA, 14 bp, Homo sapiens
gggaagctggggga

SEQ ID NO: 4188549 - DNA, 12 bp, Homo sapiens
gggaatccgcct

SEQ ID NO: 4188550 - DNA, 18 bp, Homo sapiens
gggaatccgcctgcagag

SEQ ID NO: 4188551 - DNA, 13 bp, Homo sapiens
gggaatcctgctg

SEQ ID NO: 4188552 - DNA, 15 bp, Homo sapiens
gggaatcctgctgcc

SEQ ID NO: 4188553 - DNA, 23 bp, Homo sapiens
gggaatgtttgggcagaagggag

SEQ ID NO: 4188554 - DNA, 16 bp, Homo sapiens
gggacaccccccgccc

SEQ ID NO: 4188555 - DNA, 14 bp, Homo sapiens
gggacccagctcct

SEQ ID NO: 4188556 - DNA, 17 bp, Homo sapiens
gggacctactgaaccca

SEQ ID NO: 4188557 - DNA, 21 bp, Homo sapiens
gggacctactgaacccagagt

SEQ ID NO: 4188558 - DNA, 21 bp, Homo sapiens
gggactgctacctctgagaag

SEQ ID NO: 4188559 - DNA, 19 bp, Homo sapiens
gggactggaaccagggaga

SEQ ID NO: 4188560 - DNA, 15 bp, Homo sapiens
gggagaacctcaggc

SEQ ID NO: 4188561 - DNA, 14 bp, Homo sapiens
gggagagccagctc

SEQ ID NO: 4188562 - DNA, 13 bp, Homo sapiens
gggagagcgcctc

SEQ ID NO: 4188563 - DNA, 12 bp, Homo sapiens
gggagaggaagc

SEQ ID NO: 4188564 - DNA, 14 bp, Homo sapiens
gggagaggactctg

SEQ ID NO: 4188565 - DNA, 15 bp, Homo sapiens
gggagcaactctcca

SEQ ID NO: 4188566 - DNA, 13 bp, Homo sapiens
gggagctcagctc

SEQ ID NO: 4188567 - DNA, 23 bp, Homo sapiens
gggagctcagctcgctgcccagg

SEQ ID NO: 4188568 - DNA, 13 bp, Homo sapiens
gggagctctgtat

SEQ ID NO: 4188569 - DNA, 15 bp, Homo sapiens
gggagctggaaataa

SEQ ID NO: 4188570 - DNA, 23 bp, Homo sapiens
gggaggaagcaggttgaggggct

SEQ ID NO: 4188571 - DNA, 23 bp, Homo sapiens
gggaggatcactggagcccagga

SEQ ID NO: 4188572 - DNA, 23 bp, Homo sapiens
gggaggcctcgtaccagccagga

SEQ ID NO: 4188573 - DNA, 15 bp, Homo sapiens
gggaggctgagacag

SEQ ID NO: 4188574 - DNA, 16 bp, Homo sapiens
gggaggtccaggcagg

SEQ ID NO: 4188575 - DNA, 18 bp, Homo sapiens
gggaggtgagaccacctc

SEQ ID NO: 4188576 - DNA, 13 bp, Homo sapiens
gggatcacaaggt

SEQ ID NO: 4188577 - DNA, 22 bp, Homo sapiens
gggcaagtggatggcccagcag

SEQ ID NO: 4188578 - DNA, 19 bp, Homo sapiens
gggcacctatagtcccagc

SEQ ID NO: 4188579 - DNA, 18 bp, Homo sapiens
gggcagggagagcgcctc

SEQ ID NO: 4188580 - DNA, 15 bp, Homo sapiens
gggcagtggggagca

SEQ ID NO: 4188581 - DNA, 21 bp, Homo sapiens
gggcagtggtaagctctggct

SEQ ID NO: 4188582 - DNA, 17 bp, Homo sapiens
gggcataggctgcccaa

SEQ ID NO: 4188583 - DNA, 17 bp, Homo sapiens
gggccaagacttggcaa

SEQ ID NO: 4188584 - DNA, 24 bp, Homo sapiens
gggcccacaatggagtgggagatc

SEQ ID NO: 4188585 - DNA, 12 bp, Homo sapiens
gggcccaggagg

SEQ ID NO: 4188586 - DNA, 13 bp, Homo sapiens
gggcccaggcagg

SEQ ID NO: 4188587 - DNA, 15 bp, Homo sapiens
gggcccgaaagctga

SEQ ID NO: 4188588 - DNA, 18 bp, Homo sapiens
gggcctcccataattgct

SEQ ID NO: 4188589 - DNA, 23 bp, Homo sapiens
gggcctcccataattgctttgcc

SEQ ID NO: 4188590 - DNA, 11 bp, Homo sapiens
gggcctgctgc

SEQ ID NO: 4188591 - DNA, 23 bp, Homo sapiens
gggcgcacatgttatccacaagc

SEQ ID NO: 4188592 - DNA, 13 bp, Homo sapiens
gggcggaggcggc

SEQ ID NO: 4188593 - DNA, 15 bp, Homo sapiens
gggcgtggctggcct

SEQ ID NO: 4188594 - DNA, 15 bp, Homo sapiens
gggcgtggtggcacg

SEQ ID NO: 4188595 - DNA, 14 bp, Homo sapiens
gggcgtgttgtttt

SEQ ID NO: 4188596 - DNA, 20 bp, Homo sapiens
gggctactgcagctttacat

SEQ ID NO: 4188597 - DNA, 22 bp, Homo sapiens
gggctcagcataagtaaacaac

SEQ ID NO: 4188598 - DNA, 23 bp, Homo sapiens
gggctccggaggggacccagctc

SEQ ID NO: 4188599 - DNA, 23 bp, Homo sapiens
gggctctgccccagaggcctctc

SEQ ID NO: 4188600 - DNA, 21 bp, Homo sapiens
gggctctgccccagctctggc

SEQ ID NO: 4188601 - DNA, 13 bp, Homo sapiens
gggctgagccctg

SEQ ID NO: 4188602 - DNA, 14 bp, Homo sapiens
gggctgcagaagat

SEQ ID NO: 4188603 - DNA, 14 bp, Homo sapiens
gggctgctgcactg

SEQ ID NO: 4188604 - DNA, 13 bp, Homo sapiens
gggctggcccagc

SEQ ID NO: 4188605 - DNA, 22 bp, Homo sapiens
gggctgggcccacagagatgca

SEQ ID NO: 4188606 - DNA, 17 bp, Homo sapiens
gggcttcaggtccaggc

SEQ ID NO: 4188607 - DNA, 18 bp, Homo sapiens
gggcttccatgcctgtag

SEQ ID NO: 4188608 - DNA, 17 bp, Homo sapiens
gggcttgccctgggtca

SEQ ID NO: 4188609 - DNA, 24 bp, Homo sapiens
gggcttgttgtttttaagtcctgt

SEQ ID NO: 4188610 - DNA, 14 bp, Homo sapiens
gggctttctggaga

SEQ ID NO: 4188611 - DNA, 15 bp, Homo sapiens
gggctttctggagag

SEQ ID NO: 4188612 - DNA, 14 bp, Homo sapiens
ggggagctggaaat

SEQ ID NO: 4188613 - DNA, 11 bp, Homo sapiens
ggggaggggga

SEQ ID NO: 4188614 - DNA, 12 bp, Homo sapiens
ggggagggggac

SEQ ID NO: 4188615 - DNA, 14 bp, Homo sapiens
ggggagtagtggag

SEQ ID NO: 4188616 - DNA, 17 bp, Homo sapiens
ggggatcacagcgtttc

SEQ ID NO: 4188617 - DNA, 18 bp, Homo sapiens
ggggattggagggaagac

SEQ ID NO: 4188618 - DNA, 20 bp, Homo sapiens
ggggattggagggaagacag

SEQ ID NO: 4188619 - DNA, 17 bp, Homo sapiens
ggggcactgcaggggcc

SEQ ID NO: 4188620 - DNA, 13 bp, Homo sapiens
ggggcagggagag

SEQ ID NO: 4188621 - DNA, 18 bp, Homo sapiens
ggggccagtgagggctgg

SEQ ID NO: 4188622 - DNA, 19 bp, Homo sapiens
ggggcccattctgcatgcc

SEQ ID NO: 4188623 - DNA, 21 bp, Homo sapiens
ggggccctggtccttccaggc

SEQ ID NO: 4188624 - DNA, 19 bp, Homo sapiens
ggggcgatcaagtccagag

SEQ ID NO: 4188625 - DNA, 12 bp, Homo sapiens
ggggctcctgga

SEQ ID NO: 4188626 - DNA, 15 bp, Homo sapiens
ggggctcgccccacc

SEQ ID NO: 4188627 - DNA, 17 bp, Homo sapiens
ggggctcgccccaccca

SEQ ID NO: 4188628 - DNA, 24 bp, Homo sapiens
gggggtttttactccagtggtgaa

SEQ ID NO: 4188629 - DNA, 17 bp, Homo sapiens
ggggtaggcagagcctt

SEQ ID NO: 4188630 - DNA, 16 bp, Homo sapiens
ggggtcatataaaata

SEQ ID NO: 4188631 - DNA, 21 bp, Homo sapiens
ggggtccaggtcaccagcctg

SEQ ID NO: 4188632 - DNA, 22 bp, Homo sapiens
ggggtccttcaagttagctcag

SEQ ID NO: 4188633 - DNA, 17 bp, Homo sapiens
ggggtcttttggctctg

SEQ ID NO: 4188634 - DNA, 17 bp, Homo sapiens
ggggtgatttcagagag

SEQ ID NO: 4188635 - DNA, 22 bp, Homo sapiens
ggggttaacttggtcagagcca

SEQ ID NO: 4188636 - DNA, 17 bp, Homo sapiens
ggggttgtgaggcctgg

SEQ ID NO: 4188637 - DNA, 21 bp, Homo sapiens
gggtaataaacttagaataaa

SEQ ID NO: 4188638 - DNA, 15 bp, Homo sapiens
gggtagactgaggga

SEQ ID NO: 4188639 - DNA, 12 bp, Homo sapiens
gggtcagccagg

SEQ ID NO: 4188640 - DNA, 13 bp, Homo sapiens
gggtcagccaggg

SEQ ID NO: 4188641 - DNA, 19 bp, Homo sapiens
gggtcagccagggccaggg

SEQ ID NO: 4188642 - DNA, 19 bp, Homo sapiens
gggtcagtgcagcagagga

SEQ ID NO: 4188643 - DNA, 18 bp, Homo sapiens
gggtgaataaagcaggga

SEQ ID NO: 4188644 - DNA, 14 bp, Homo sapiens
gggtgatagaacaa

SEQ ID NO: 4188645 - DNA, 22 bp, Homo sapiens
gggtgcctcagagcaggctcag

SEQ ID NO: 4188646 - DNA, 16 bp, Homo sapiens
gggtgggagagccagc

SEQ ID NO: 4188647 - DNA, 15 bp, Homo sapiens
gggtgggccactctc

SEQ ID NO: 4188648 - DNA, 17 bp, Homo sapiens
gggttaacttggtcaga

SEQ ID NO: 4188649 - DNA, 16 bp, Homo sapiens
gggttcagcctctccc

SEQ ID NO: 4188650 - DNA, 17 bp, Homo sapiens
gggttcccgagggagct

SEQ ID NO: 4188651 - DNA, 17 bp, Homo sapiens
gggttctgagtcagagg

SEQ ID NO: 4188652 - DNA, 19 bp, Homo sapiens
gggttctttggaaggagtg

SEQ ID NO: 4188653 - DNA, 12 bp, Homo sapiens
gggttgcccagc

SEQ ID NO: 4188654 - DNA, 15 bp, Homo sapiens
gggttgcgggggagc

SEQ ID NO: 4188655 - DNA, 22 bp, Homo sapiens
gggttgcgggggagctggaaat

SEQ ID NO: 4188656 - DNA, 20 bp, Homo sapiens
gggtttcaccatgttggcca

SEQ ID NO: 4188657 - DNA, 16 bp, Homo sapiens
gggttttccaccctgg

SEQ ID NO: 4188658 - DNA, 13 bp, Homo sapiens
ggtaaaatgccat

SEQ ID NO: 4188659 - DNA, 13 bp, Homo sapiens
ggtaagaagaaag

SEQ ID NO: 4188660 - DNA, 15 bp, Homo sapiens
ggtaagaagaaagca

SEQ ID NO: 4188661 - DNA, 17 bp, Homo sapiens
ggtaagaagaaagcaaa

SEQ ID NO: 4188662 - DNA, 15 bp, Homo sapiens
ggtaataaacttaga

SEQ ID NO: 4188663 - DNA, 16 bp, Homo sapiens
ggtaattatatctgtt

SEQ ID NO: 4188664 - DNA, 16 bp, Homo sapiens
ggtagaattgggaagc

SEQ ID NO: 4188665 - DNA, 18 bp, Homo sapiens
ggtagaattgggaagctg

SEQ ID NO: 4188666 - DNA, 15 bp, Homo sapiens
ggtagactgagggat

SEQ ID NO: 4188667 - DNA, 14 bp, Homo sapiens
ggtagagatgtgtg

SEQ ID NO: 4188668 - DNA, 14 bp, Homo sapiens
ggtagtactgggaa

SEQ ID NO: 4188669 - DNA, 13 bp, Homo sapiens
ggtatacatttta

SEQ ID NO: 4188670 - DNA, 22 bp, Homo sapiens
ggtatgaacttgaggacacatg

SEQ ID NO: 4188671 - DNA, 14 bp, Homo sapiens
ggtatgagctgagg

SEQ ID NO: 4188672 - DNA, 13 bp, Homo sapiens
ggtatgggaagcc

SEQ ID NO: 4188673 - DNA, 15 bp, Homo sapiens
ggtattaaagatgtg

SEQ ID NO: 4188674 - DNA, 19 bp, Homo sapiens
ggtattccttttgtgtaca

SEQ ID NO: 4188675 - DNA, 14 bp, Homo sapiens
ggtatttcctgcta

SEQ ID NO: 4188676 - DNA, 18 bp, Homo sapiens
ggtcaccagcctgactgc

SEQ ID NO: 4188677 - DNA, 19 bp, Homo sapiens
ggtcaccagcctgactgca

SEQ ID NO: 4188678 - DNA, 13 bp, Homo sapiens
ggtcagagccact

SEQ ID NO: 4188679 - DNA, 24 bp, Homo sapiens
ggtcagatgcaccacccatggaga

SEQ ID NO: 4188680 - DNA, 13 bp, Homo sapiens
ggtcagccagggc

SEQ ID NO: 4188681 - DNA, 18 bp, Homo sapiens
ggtcagccagggccaggg

SEQ ID NO: 4188682 - DNA, 21 bp, Homo sapiens
ggtcagcccattggctcccat

SEQ ID NO: 4188683 - DNA, 14 bp, Homo sapiens
ggtccaggcaggag

SEQ ID NO: 4188684 - DNA, 16 bp, Homo sapiens
ggtccaggcaggagga

SEQ ID NO: 4188685 - DNA, 19 bp, Homo sapiens
ggtccaggccagtgggcct

SEQ ID NO: 4188686 - DNA, 13 bp, Homo sapiens
ggtccaggctgtg

SEQ ID NO: 4188687 - DNA, 13 bp, Homo sapiens
ggtccagggttga

SEQ ID NO: 4188688 - DNA, 18 bp, Homo sapiens
ggtccaggtcaccagcct

SEQ ID NO: 4188689 - DNA, 19 bp, Homo sapiens
ggtccagtttctagagggc

SEQ ID NO: 4188690 - DNA, 17 bp, Homo sapiens
ggtccctcggagctgcc

SEQ ID NO: 4188691 - DNA, 14 bp, Homo sapiens
ggtccctggatcag

SEQ ID NO: 4188692 - DNA, 15 bp, Homo sapiens
ggtcctggggctctg

SEQ ID NO: 4188693 - DNA, 22 bp, Homo sapiens
ggtcctgggggctgctgcactg

SEQ ID NO: 4188694 - DNA, 21 bp, Homo sapiens
ggtccttcaagttagctcagg

SEQ ID NO: 4188695 - DNA, 16 bp, Homo sapiens
ggtccttccaggcccc

SEQ ID NO: 4188696 - DNA, 23 bp, Homo sapiens
ggtcggtttggtttgttgtaaat

SEQ ID NO: 4188697 - DNA, 15 bp, Homo sapiens
ggtctaaagagaaca

SEQ ID NO: 4188698 - DNA, 17 bp, Homo sapiens
ggtctcttacatggcca

SEQ ID NO: 4188699 - DNA, 16 bp, Homo sapiens
ggtctgagcaccccct

SEQ ID NO: 4188700 - DNA, 12 bp, Homo sapiens
ggtctgccacca

SEQ ID NO: 4188701 - DNA, 16 bp, Homo sapiens
ggtcttcttgtgtcct

SEQ ID NO: 4188702 - DNA, 18 bp, Homo sapiens
ggtgaaaccctgtctcta

SEQ ID NO: 4188703 - DNA, 15 bp, Homo sapiens
ggtgacagtggagga

SEQ ID NO: 4188704 - DNA, 23 bp, Homo sapiens
ggtgacggtcctttaggcagcct

SEQ ID NO: 4188705 - DNA, 21 bp, Homo sapiens
ggtgagaacctgggttgcaga

SEQ ID NO: 4188706 - DNA, 12 bp, Homo sapiens
ggtgagagctgc

SEQ ID NO: 4188707 - DNA, 12 bp, Homo sapiens
ggtgagctcagc

SEQ ID NO: 4188708 - DNA, 13 bp, Homo sapiens
ggtgaggcccagc

SEQ ID NO: 4188709 - DNA, 14 bp, Homo sapiens
ggtgaggcccagcc

SEQ ID NO: 4188710 - DNA, 23 bp, Homo sapiens
ggtgatttcagactgcagagggg

SEQ ID NO: 4188711 - DNA, 15 bp, Homo sapiens
ggtgatttcagagag

SEQ ID NO: 4188712 - DNA, 16 bp, Homo sapiens
ggtgccatttctgaac

SEQ ID NO: 4188713 - DNA, 20 bp, Homo sapiens
ggtgcctcagagcaggctca

SEQ ID NO: 4188714 - DNA, 22 bp, Homo sapiens
ggtgcctggcttgctgtggcta

SEQ ID NO: 4188715 - DNA, 17 bp, Homo sapiens
ggtgctataggctggag

SEQ ID NO: 4188716 - DNA, 12 bp, Homo sapiens
ggtgctggagga

SEQ ID NO: 4188717 - DNA, 19 bp, Homo sapiens
ggtgctgtggccagggtga

SEQ ID NO: 4188718 - DNA, 19 bp, Homo sapiens
ggtggaaggcccgaggggc

SEQ ID NO: 4188719 - DNA, 16 bp, Homo sapiens
ggtggacacagaagtc

SEQ ID NO: 4188720 - DNA, 17 bp, Homo sapiens
ggtggaggttgcagtga

SEQ ID NO: 4188721 - DNA, 16 bp, Homo sapiens
ggtggatgggccctgc

SEQ ID NO: 4188722 - DNA, 22 bp, Homo sapiens
ggtggattcctgggcaagaacc

SEQ ID NO: 4188723 - DNA, 20 bp, Homo sapiens
ggtggcaagggggcggggcg

SEQ ID NO: 4188724 - DNA, 14 bp, Homo sapiens
ggtggcaggaccag

SEQ ID NO: 4188725 - DNA, 15 bp, Homo sapiens
ggtggcaggaccagg

SEQ ID NO: 4188726 - DNA, 17 bp, Homo sapiens
ggtggcaggaccaggac

SEQ ID NO: 4188727 - DNA, 19 bp, Homo sapiens
ggtggcgggcacctatagt

SEQ ID NO: 4188728 - DNA, 13 bp, Homo sapiens
ggtggctgagctt

SEQ ID NO: 4188729 - DNA, 22 bp, Homo sapiens
ggtgggaaatggtatgagctga

SEQ ID NO: 4188730 - DNA, 15 bp, Homo sapiens
ggtgggagagcccag

SEQ ID NO: 4188731 - DNA, 18 bp, Homo sapiens
ggtgggctgagccctggc

SEQ ID NO: 4188732 - DNA, 17 bp, Homo sapiens
ggtgggctggcccagcc

SEQ ID NO: 4188733 - DNA, 19 bp, Homo sapiens
ggtgggttctttggaagga

SEQ ID NO: 4188734 - DNA, 13 bp, Homo sapiens
ggtggtgccagag

SEQ ID NO: 4188735 - DNA, 21 bp, Homo sapiens
ggtggtttttggttacatgga

SEQ ID NO: 4188736 - DNA, 18 bp, Homo sapiens
ggtgtagctcctctgctg

SEQ ID NO: 4188737 - DNA, 23 bp, Homo sapiens
ggtgtagctcctctgctgctccc

SEQ ID NO: 4188738 - DNA, 13 bp, Homo sapiens
ggtgtcaccctgc

SEQ ID NO: 4188739 - DNA, 14 bp, Homo sapiens
ggtgtgcctgcagc

SEQ ID NO: 4188740 - DNA, 15 bp, Homo sapiens
ggtgtgcctgcagcc

SEQ ID NO: 4188741 - DNA, 15 bp, Homo sapiens
ggtgtgcctgccctg

SEQ ID NO: 4188742 - DNA, 17 bp, Homo sapiens
ggtgtggataaggctta

SEQ ID NO: 4188743 - DNA, 17 bp, Homo sapiens
ggttaagatctgaaagt

SEQ ID NO: 4188744 - DNA, 14 bp, Homo sapiens
ggttcaacttatta

SEQ ID NO: 4188745 - DNA, 19 bp, Homo sapiens
ggttcaagagacactgctt

SEQ ID NO: 4188746 - DNA, 23 bp, Homo sapiens
ggttcccattttcgctttcctct

SEQ ID NO: 4188747 - DNA, 13 bp, Homo sapiens
ggttccctctgag

SEQ ID NO: 4188748 - DNA, 16 bp, Homo sapiens
ggttccctctgagaat

SEQ ID NO: 4188749 - DNA, 16 bp, Homo sapiens
ggttcttgggagggaa

SEQ ID NO: 4188750 - DNA, 13 bp, Homo sapiens
ggttgcagggagc

SEQ ID NO: 4188751 - DNA, 11 bp, Homo sapiens
ggttgcagtga

SEQ ID NO: 4188752 - DNA, 11 bp, Homo sapiens
ggttgcccagc

SEQ ID NO: 4188753 - DNA, 19 bp, Homo sapiens
ggttgcttcaccttggagc

SEQ ID NO: 4188754 - DNA, 14 bp, Homo sapiens
ggttggggcaaagc

SEQ ID NO: 4188755 - DNA, 19 bp, Homo sapiens
ggttggggcaaagcctcct

SEQ ID NO: 4188756 - DNA, 14 bp, Homo sapiens
ggttggtgggctgg

SEQ ID NO: 4188757 - DNA, 14 bp, Homo sapiens
ggttgtgaggcctg

SEQ ID NO: 4188758 - DNA, 17 bp, Homo sapiens
ggtttaaaacagcctgg

SEQ ID NO: 4188759 - DNA, 13 bp, Homo sapiens
ggtttgtcaacac

SEQ ID NO: 4188760 - DNA, 13 bp, Homo sapiens
gtaaaaacaaaaa

SEQ ID NO: 4188761 - DNA, 21 bp, Homo sapiens
gtaaaactacacatccctaat

SEQ ID NO: 4188762 - DNA, 13 bp, Homo sapiens
gtaaaagctaatt

SEQ ID NO: 4188763 - DNA, 21 bp, Homo sapiens
gtaaagtatgtaaacaggaga

SEQ ID NO: 4188764 - DNA, 18 bp, Homo sapiens
gtaaataaattgtttgac

SEQ ID NO: 4188765 - DNA, 13 bp, Homo sapiens
gtaaatattttaa

SEQ ID NO: 4188766 - DNA, 15 bp, Homo sapiens
gtaaatcctttttct

SEQ ID NO: 4188767 - DNA, 16 bp, Homo sapiens
gtaaatcctttttctt

SEQ ID NO: 4188768 - DNA, 21 bp, Homo sapiens
gtaaatctaactacaaggaca

SEQ ID NO: 4188769 - DNA, 22 bp, Homo sapiens
gtaaatctaactacaaggacaa

SEQ ID NO: 4188770 - DNA, 12 bp, Homo sapiens
gtaaatggtatc

SEQ ID NO: 4188771 - DNA, 17 bp, Homo sapiens
gtaaatgtccaaaatgt

SEQ ID NO: 4188772 - DNA, 22 bp, Homo sapiens
gtaaattattaatttatgcaga

SEQ ID NO: 4188773 - DNA, 18 bp, Homo sapiens
gtaaattttgtatgaaaa

SEQ ID NO: 4188774 - DNA, 15 bp, Homo sapiens
gtaacagaagaggag

SEQ ID NO: 4188775 - DNA, 20 bp, Homo sapiens
gtaacagatatcagtgtctc

SEQ ID NO: 4188776 - DNA, 20 bp, Homo sapiens
gtaacatttggagtgtgtat

SEQ ID NO: 4188777 - DNA, 15 bp, Homo sapiens
gtaagaagaaagcaa

SEQ ID NO: 4188778 - DNA, 19 bp, Homo sapiens
gtaagcattctgagctggg

SEQ ID NO: 4188779 - DNA, 21 bp, Homo sapiens
gtaagcattctgagctgggct

SEQ ID NO: 4188780 - DNA, 16 bp, Homo sapiens
gtaagtaccacatcta

SEQ ID NO: 4188781 - DNA, 22 bp, Homo sapiens
gtaagtggcaggaccctgtcag

SEQ ID NO: 4188782 - DNA, 23 bp, Homo sapiens
gtaagttgaatggcctgccttga

SEQ ID NO: 4188783 - DNA, 19 bp, Homo sapiens
gtaagtttatgtctaaaga

SEQ ID NO: 4188784 - DNA, 19 bp, Homo sapiens
gtaatagaaaactgaaaat

SEQ ID NO: 4188785 - DNA, 17 bp, Homo sapiens
gtaatagattatagttg

SEQ ID NO: 4188786 - DNA, 15 bp, Homo sapiens
gtaatatattgctgc

SEQ ID NO: 4188787 - DNA, 14 bp, Homo sapiens
gtaatgagggactg

SEQ ID NO: 4188788 - DNA, 15 bp, Homo sapiens
gtaattatatctgtt

SEQ ID NO: 4188789 - DNA, 21 bp, Homo sapiens
gtaatttctgtgtattttgag

SEQ ID NO: 4188790 - DNA, 13 bp, Homo sapiens
gtaatttgtatct

SEQ ID NO: 4188791 - DNA, 14 bp, Homo sapiens
gtaatttgtatctg

SEQ ID NO: 4188792 - DNA, 20 bp, Homo sapiens
gtaatttttttgaaaaaagt

SEQ ID NO: 4188793 - DNA, 23 bp, Homo sapiens
gtacaaattatacataataaagt

SEQ ID NO: 4188794 - DNA, 15 bp, Homo sapiens
gtacaagctcaggag

SEQ ID NO: 4188795 - DNA, 17 bp, Homo sapiens
gtacaatcctttgagtt

SEQ ID NO: 4188796 - DNA, 19 bp, Homo sapiens
gtacatacgtgttctatag

SEQ ID NO: 4188797 - DNA, 19 bp, Homo sapiens
gtaccaaatccacaagcca

SEQ ID NO: 4188798 - DNA, 18 bp, Homo sapiens
gtacctatgtgacagaca

SEQ ID NO: 4188799 - DNA, 12 bp, Homo sapiens
gtacggctgctg

SEQ ID NO: 4188800 - DNA, 15 bp, Homo sapiens
gtacggctgctgcac

SEQ ID NO: 4188801 - DNA, 12 bp, Homo sapiens
gtacgtaatgta

SEQ ID NO: 4188802 - DNA, 23 bp, Homo sapiens
gtactcaggaggctgaggggagg

SEQ ID NO: 4188803 - DNA, 14 bp, Homo sapiens
gtactccagcaggt

SEQ ID NO: 4188804 - DNA, 14 bp, Homo sapiens
gtagaataataata

SEQ ID NO: 4188805 - DNA, 18 bp, Homo sapiens
gtagaattgggaagctgg

SEQ ID NO: 4188806 - DNA, 18 bp, Homo sapiens
gtagacacgctcttctat

SEQ ID NO: 4188807 - DNA, 13 bp, Homo sapiens
gtagagatgtgtg

SEQ ID NO: 4188808 - DNA, 17 bp, Homo sapiens
gtagatagaaagcaata

SEQ ID NO: 4188809 - DNA, 19 bp, Homo sapiens
gtagatcatggcagcatga

SEQ ID NO: 4188810 - DNA, 16 bp, Homo sapiens
gtagcacaaagaggga

SEQ ID NO: 4188811 - DNA, 12 bp, Homo sapiens
gtagcatgagag

SEQ ID NO: 4188812 - DNA, 14 bp, Homo sapiens
gtagccaaaggttc

SEQ ID NO: 4188813 - DNA, 14 bp, Homo sapiens
gtagccctttctgt

SEQ ID NO: 4188814 - DNA, 13 bp, Homo sapiens
gtagcgagctgct

SEQ ID NO: 4188815 - DNA, 17 bp, Homo sapiens
gtagctttcccaaataa

SEQ ID NO: 4188816 - DNA, 16 bp, Homo sapiens
gtaggaaatcaggcag

SEQ ID NO: 4188817 - DNA, 23 bp, Homo sapiens
gtaggaacccagctctcagggct

SEQ ID NO: 4188818 - DNA, 16 bp, Homo sapiens
gtaggattaatttatt

SEQ ID NO: 4188819 - DNA, 15 bp, Homo sapiens
gtaggtattaaagat

SEQ ID NO: 4188820 - DNA, 19 bp, Homo sapiens
gtaggtattaaagatgtgt

SEQ ID NO: 4188821 - DNA, 14 bp, Homo sapiens
gtaggtttgtagta

SEQ ID NO: 4188822 - DNA, 22 bp, Homo sapiens
gtagttaggaaataaaaccttt

SEQ ID NO: 4188823 - DNA, 14 bp, Homo sapiens
gtataaaagacaaa

SEQ ID NO: 4188824 - DNA, 18 bp, Homo sapiens
gtatagcatgcatctgtt

SEQ ID NO: 4188825 - DNA, 20 bp, Homo sapiens
gtatatactatacaacaatg

SEQ ID NO: 4188826 - DNA, 19 bp, Homo sapiens
gtatatcagaaaagggaag

SEQ ID NO: 4188827 - DNA, 14 bp, Homo sapiens
gtatatgtcattta

SEQ ID NO: 4188828 - DNA, 16 bp, Homo sapiens
gtatccgactctaagc

SEQ ID NO: 4188829 - DNA, 24 bp, Homo sapiens
gtatccgactctaagctgtgtgca

SEQ ID NO: 4188830 - DNA, 13 bp, Homo sapiens
gtatctctggcct

SEQ ID NO: 4188831 - DNA, 14 bp, Homo sapiens
gtatctgaaggaga

SEQ ID NO: 4188832 - DNA, 19 bp, Homo sapiens
gtatctgggtaagaagaaa

SEQ ID NO: 4188833 - DNA, 17 bp, Homo sapiens
gtatcttactctgtcca

SEQ ID NO: 4188834 - DNA, 16 bp, Homo sapiens
gtatgaacttgaggac

SEQ ID NO: 4188835 - DNA, 19 bp, Homo sapiens
gtatgaacttgaggacaca

SEQ ID NO: 4188836 - DNA, 22 bp, Homo sapiens
gtatgaacttgaggacacatgt

SEQ ID NO: 4188837 - DNA, 14 bp, Homo sapiens
gtatgggaagccat

SEQ ID NO: 4188838 - DNA, 11 bp, Homo sapiens
gtatgtgtgtg

SEQ ID NO: 4188839 - DNA, 13 bp, Homo sapiens
gtatgtgtgtggt

SEQ ID NO: 4188840 - DNA, 14 bp, Homo sapiens
gtattaaagatgtg

SEQ ID NO: 4188841 - DNA, 16 bp, Homo sapiens
gtattaaagatgtgtt

SEQ ID NO: 4188842 - DNA, 19 bp, Homo sapiens
gtattaggggtaatatatt

SEQ ID NO: 4188843 - DNA, 20 bp, Homo sapiens
gtattccttttgtgtacagt

SEQ ID NO: 4188844 - DNA, 23 bp, Homo sapiens
gtattgcgaaacaacttgtgttc

SEQ ID NO: 4188845 - DNA, 22 bp, Homo sapiens
gtattggggtcttttggctctg

SEQ ID NO: 4188846 - DNA, 18 bp, Homo sapiens
gtatttatatttggaaag

SEQ ID NO: 4188847 - DNA, 20 bp, Homo sapiens
gtatttatatttggaaagag

SEQ ID NO: 4188848 - DNA, 23 bp, Homo sapiens
gtatttgttaatttagaaaactt

SEQ ID NO: 4188849 - DNA, 16 bp, Homo sapiens
gtattttaaatgtttt

SEQ ID NO: 4188850 - DNA, 14 bp, Homo sapiens
gtattttggagaaa

SEQ ID NO: 4188851 - DNA, 18 bp, Homo sapiens
gtatttttgtatgtggca

SEQ ID NO: 4188852 - DNA, 15 bp, Homo sapiens
gtcaaaagctggatt

SEQ ID NO: 4188853 - DNA, 17 bp, Homo sapiens
gtcaacacaaagacatg

SEQ ID NO: 4188854 - DNA, 22 bp, Homo sapiens
gtcaacacaaagacatggaaga

SEQ ID NO: 4188855 - DNA, 14 bp, Homo sapiens
gtcaacactcttct

SEQ ID NO: 4188856 - DNA, 22 bp, Homo sapiens
gtcaacagttttcctatgcttt

SEQ ID NO: 4188857 - DNA, 21 bp, Homo sapiens
gtcaagatcaacattccaggg

SEQ ID NO: 4188858 - DNA, 22 bp, Homo sapiens
gtcaagcctgcagcgagctgag

SEQ ID NO: 4188859 - DNA, 24 bp, Homo sapiens
gtcaatccaatctgtaatttcact

SEQ ID NO: 4188860 - DNA, 18 bp, Homo sapiens
gtcacacctgacaaatgg

SEQ ID NO: 4188861 - DNA, 14 bp, Homo sapiens
gtcacattcaggaa

SEQ ID NO: 4188862 - DNA, 16 bp, Homo sapiens
gtcacattcaggaaga

SEQ ID NO: 4188863 - DNA, 20 bp, Homo sapiens
gtcacccaggctggagtaca

SEQ ID NO: 4188864 - DNA, 13 bp, Homo sapiens
gtcaccctgcaga

SEQ ID NO: 4188865 - DNA, 16 bp, Homo sapiens
gtcaccctgcagagct

SEQ ID NO: 4188866 - DNA, 19 bp, Homo sapiens
gtcactcttcctgcaagga

SEQ ID NO: 4188867 - DNA, 20 bp, Homo sapiens
gtcactcttcctgcaaggac

SEQ ID NO: 4188868 - DNA, 16 bp, Homo sapiens
gtcactggcagagcac

SEQ ID NO: 4188869 - DNA, 13 bp, Homo sapiens
gtcactgggttct

SEQ ID NO: 4188870 - DNA, 18 bp, Homo sapiens
gtcagaccagtactggga

SEQ ID NO: 4188871 - DNA, 17 bp, Homo sapiens
gtcagaccctaggaagc

SEQ ID NO: 4188872 - DNA, 21 bp, Homo sapiens
gtcagaccctaggaagctgga

SEQ ID NO: 4188873 - DNA, 14 bp, Homo sapiens
gtcagactgctggg

SEQ ID NO: 4188874 - DNA, 15 bp, Homo sapiens
gtcagactgctggga

SEQ ID NO: 4188875 - DNA, 18 bp, Homo sapiens
gtcagactggctggctgc

SEQ ID NO: 4188876 - DNA, 22 bp, Homo sapiens
gtcagactggctggctgcagtg

SEQ ID NO: 4188877 - DNA, 12 bp, Homo sapiens
gtcagagacaga

SEQ ID NO: 4188878 - DNA, 23 bp, Homo sapiens
gtcagcttccccaggagctctct

SEQ ID NO: 4188879 - DNA, 19 bp, Homo sapiens
gtcagctttgcttttcctg

SEQ ID NO: 4188880 - DNA, 14 bp, Homo sapiens
gtcatatcagcttt

SEQ ID NO: 4188881 - DNA, 21 bp, Homo sapiens
gtcatatcagctttatccctt

SEQ ID NO: 4188882 - DNA, 18 bp, Homo sapiens
gtcatatgtaggtgtctg

SEQ ID NO: 4188883 - DNA, 17 bp, Homo sapiens
gtcatcacttttcagtg

SEQ ID NO: 4188884 - DNA, 14 bp, Homo sapiens
gtcatcccctacac

SEQ ID NO: 4188885 - DNA, 17 bp, Homo sapiens
gtcatctcatgatacag

SEQ ID NO: 4188886 - DNA, 22 bp, Homo sapiens
gtcatgatttctgtgaagcaaa

SEQ ID NO: 4188887 - DNA, 21 bp, Homo sapiens
gtcatggtcctttctggaagt

SEQ ID NO: 4188888 - DNA, 15 bp, Homo sapiens
gtcattactaaccat

SEQ ID NO: 4188889 - DNA, 17 bp, Homo sapiens
gtcatttaccctggtgg

SEQ ID NO: 4188890 - DNA, 20 bp, Homo sapiens
gtcatttaccctggtggagg

SEQ ID NO: 4188891 - DNA, 20 bp, Homo sapiens
gtccagatgccttcctgtct

SEQ ID NO: 4188892 - DNA, 24 bp, Homo sapiens
gtccagtgggaggtgagaccacct

SEQ ID NO: 4188893 - DNA, 17 bp, Homo sapiens
gtcccacactggtgact

SEQ ID NO: 4188894 - DNA, 14 bp, Homo sapiens
gtccccagttgccg

SEQ ID NO: 4188895 - DNA, 17 bp, Homo sapiens
gtcccggttcaccttgc

SEQ ID NO: 4188896 - DNA, 20 bp, Homo sapiens
gtccctgagggcccttccca

SEQ ID NO: 4188897 - DNA, 20 bp, Homo sapiens
gtcccttggaaagttcagcc

SEQ ID NO: 4188898 - DNA, 23 bp, Homo sapiens
gtcccttggaaagttcagccaga

SEQ ID NO: 4188899 - DNA, 20 bp, Homo sapiens
gtcccttgtttccagctaga

SEQ ID NO: 4188900 - DNA, 17 bp, Homo sapiens
gtccgccaaacactcca

SEQ ID NO: 4188901 - DNA, 21 bp, Homo sapiens
gtccgcctctgcccgcagagc

SEQ ID NO: 4188902 - DNA, 22 bp, Homo sapiens
gtccgcctctgcccgcagagcc

SEQ ID NO: 4188903 - DNA, 13 bp, Homo sapiens
gtccgctcagcca

SEQ ID NO: 4188904 - DNA, 18 bp, Homo sapiens
gtcctagcaggatctgcc

SEQ ID NO: 4188905 - DNA, 22 bp, Homo sapiens
gtcctaggccacaccatctcct

SEQ ID NO: 4188906 - DNA, 21 bp, Homo sapiens
gtcctgcccccgacagcccag

SEQ ID NO: 4188907 - DNA, 23 bp, Homo sapiens
gtcctgcccccgacagcccagcc

SEQ ID NO: 4188908 - DNA, 18 bp, Homo sapiens
gtcctgcctctctgctcc

SEQ ID NO: 4188909 - DNA, 19 bp, Homo sapiens
gtcctgcctctctgctcca

SEQ ID NO: 4188910 - DNA, 20 bp, Homo sapiens
gtcctggcttctagatctgg

SEQ ID NO: 4188911 - DNA, 20 bp, Homo sapiens
gtcctgggagaacctcaggc

SEQ ID NO: 4188912 - DNA, 21 bp, Homo sapiens
gtcctgggagaacctcaggct

SEQ ID NO: 4188913 - DNA, 17 bp, Homo sapiens
gtcctggggctctgtgc

SEQ ID NO: 4188914 - DNA, 20 bp, Homo sapiens
gtcctgggggctgctgcact

SEQ ID NO: 4188915 - DNA, 16 bp, Homo sapiens
gtcctggtacagcagg

SEQ ID NO: 4188916 - DNA, 18 bp, Homo sapiens
gtcctggtacagcagggt

SEQ ID NO: 4188917 - DNA, 19 bp, Homo sapiens
gtcctgtcagcttccccag

SEQ ID NO: 4188918 - DNA, 17 bp, Homo sapiens
gtcctgtcctggctccc

SEQ ID NO: 4188919 - DNA, 15 bp, Homo sapiens
gtcctgtgaatttct

SEQ ID NO: 4188920 - DNA, 19 bp, Homo sapiens
gtccttattatcccagctt

SEQ ID NO: 4188921 - DNA, 18 bp, Homo sapiens
gtccttctcgtttgctct

SEQ ID NO: 4188922 - DNA, 22 bp, Homo sapiens
gtccttggtgtgaccctctgaa

SEQ ID NO: 4188923 - DNA, 16 bp, Homo sapiens
gtcctttaggcagcct

SEQ ID NO: 4188924 - DNA, 17 bp, Homo sapiens
gtcctttaggcagcctg

SEQ ID NO: 4188925 - DNA, 17 bp, Homo sapiens
gtccttttaaagttgga

SEQ ID NO: 4188926 - DNA, 22 bp, Homo sapiens
gtccttttgtaccatggtgtga

SEQ ID NO: 4188927 - DNA, 23 bp, Homo sapiens
gtcgcgcgcagcgcgtgcacagc

SEQ ID NO: 4188928 - DNA, 16 bp, Homo sapiens
gtctaaagagaacaag

SEQ ID NO: 4188929 - DNA, 18 bp, Homo sapiens
gtctaaagagaacaagag

SEQ ID NO: 4188930 - DNA, 17 bp, Homo sapiens
gtctaggattgggcctc

SEQ ID NO: 4188931 - DNA, 18 bp, Homo sapiens
gtctatagagaaaaactt

SEQ ID NO: 4188932 - DNA, 15 bp, Homo sapiens
gtctcaagactgaaa

SEQ ID NO: 4188933 - DNA, 11 bp, Homo sapiens
gtctcagaaga

SEQ ID NO: 4188934 - DNA, 13 bp, Homo sapiens
gtctcagaagagg

SEQ ID NO: 4188935 - DNA, 14 bp, Homo sapiens
gtctcagaagaggt

SEQ ID NO: 4188936 - DNA, 12 bp, Homo sapiens
gtctcaggagca

SEQ ID NO: 4188937 - DNA, 16 bp, Homo sapiens
gtctcaggagcatggg

SEQ ID NO: 4188938 - DNA, 16 bp, Homo sapiens
gtctcagtccagatgc

SEQ ID NO: 4188939 - DNA, 19 bp, Homo sapiens
gtctccactgaggatgtga

SEQ ID NO: 4188940 - DNA, 16 bp, Homo sapiens
gtctccttacctgtgg

SEQ ID NO: 4188941 - DNA, 21 bp, Homo sapiens
gtctcctttctcagccacaaa

SEQ ID NO: 4188942 - DNA, 14 bp, Homo sapiens
gtctctagccactt

SEQ ID NO: 4188943 - DNA, 14 bp, Homo sapiens
gtctctagccgggc

SEQ ID NO: 4188944 - DNA, 19 bp, Homo sapiens
gtctgaggccccaggccct

SEQ ID NO: 4188945 - DNA, 14 bp, Homo sapiens
gtctgatgtttgtt

SEQ ID NO: 4188946 - DNA, 20 bp, Homo sapiens
gtctgattggctcacccaag

SEQ ID NO: 4188947 - DNA, 22 bp, Homo sapiens
gtctgatttcaggatactctgt

SEQ ID NO: 4188948 - DNA, 17 bp, Homo sapiens
gtctgcacccaggggtg

SEQ ID NO: 4188949 - DNA, 18 bp, Homo sapiens
gtctgccttaggctgctg

SEQ ID NO: 4188950 - DNA, 19 bp, Homo sapiens
gtctgccttaggctgctgg

SEQ ID NO: 4188951 - DNA, 20 bp, Homo sapiens
gtctgccttaggctgctggg

SEQ ID NO: 4188952 - DNA, 17 bp, Homo sapiens
gtctgctatattttcat

SEQ ID NO: 4188953 - DNA, 16 bp, Homo sapiens
gtctgctatcattatt

SEQ ID NO: 4188954 - DNA, 13 bp, Homo sapiens
gtctggaagaaga

SEQ ID NO: 4188955 - DNA, 16 bp, Homo sapiens
gtctggaagaagagga

SEQ ID NO: 4188956 - DNA, 19 bp, Homo sapiens
gtctggaagaagaggagga

SEQ ID NO: 4188957 - DNA, 15 bp, Homo sapiens
gtctggcccctccgc

SEQ ID NO: 4188958 - DNA, 15 bp, Homo sapiens
gtctggctgagctga

SEQ ID NO: 4188959 - DNA, 14 bp, Homo sapiens
gtctgggagagcct

SEQ ID NO: 4188960 - DNA, 17 bp, Homo sapiens
gtctgggagagcctggc

SEQ ID NO: 4188961 - DNA, 20 bp, Homo sapiens
gtctgggagagcctggcaag

SEQ ID NO: 4188962 - DNA, 11 bp, Homo sapiens
gtctggtgtag

SEQ ID NO: 4188963 - DNA, 13 bp, Homo sapiens
gtctgtcctcaga

SEQ ID NO: 4188964 - DNA, 16 bp, Homo sapiens
gtctgtggattttttc

SEQ ID NO: 4188965 - DNA, 22 bp, Homo sapiens
gtctgtgttgcgtgtcgtgggt

SEQ ID NO: 4188966 - DNA, 12 bp, Homo sapiens
gtctgtttactg

SEQ ID NO: 4188967 - DNA, 13 bp, Homo sapiens
gtctgtttactgc

SEQ ID NO: 4188968 - DNA, 23 bp, Homo sapiens
gtcttaagccttttgctcacaaa

SEQ ID NO: 4188969 - DNA, 17 bp, Homo sapiens
gtcttcactgccatgcc

SEQ ID NO: 4188970 - DNA, 16 bp, Homo sapiens
gtcttcttgtgtcctg

SEQ ID NO: 4188971 - DNA, 19 bp, Homo sapiens
gtcttcttgtgtcctgatg

SEQ ID NO: 4188972 - DNA, 16 bp, Homo sapiens
gtctttgggcagggaa

SEQ ID NO: 4188973 - DNA, 18 bp, Homo sapiens
gtgaaacaattattgtac

SEQ ID NO: 4188974 - DNA, 17 bp, Homo sapiens
gtgaaaccctgtctcta

SEQ ID NO: 4188975 - DNA, 23 bp, Homo sapiens
gtgaaataccacaagcctgagaa

SEQ ID NO: 4188976 - DNA, 18 bp, Homo sapiens
gtgaacagagagaaccag

SEQ ID NO: 4188977 - DNA, 20 bp, Homo sapiens
gtgaacagagagaaccagga

SEQ ID NO: 4188978 - DNA, 15 bp, Homo sapiens
gtgaactggaagaaa

SEQ ID NO: 4188979 - DNA, 14 bp, Homo sapiens
gtgaagaatacttc

SEQ ID NO: 4188980 - DNA, 22 bp, Homo sapiens
gtgaattgcctgcagagagaag

SEQ ID NO: 4188981 - DNA, 20 bp, Homo sapiens
gtgaatttaatgcttaaaaa

SEQ ID NO: 4188982 - DNA, 13 bp, Homo sapiens
gtgaatttctgat

SEQ ID NO: 4188983 - DNA, 19 bp, Homo sapiens
gtgaatttcttcactgttg

SEQ ID NO: 4188984 - DNA, 19 bp, Homo sapiens
gtgacaaaaggctcggaat

SEQ ID NO: 4188985 - DNA, 14 bp, Homo sapiens
gtgacacaaacaca

SEQ ID NO: 4188986 - DNA, 13 bp, Homo sapiens
gtgaccctctgaa

SEQ ID NO: 4188987 - DNA, 20 bp, Homo sapiens
gtgacggtcctttaggcagc

SEQ ID NO: 4188988 - DNA, 13 bp, Homo sapiens
gtgagaccacctc

SEQ ID NO: 4188989 - DNA, 20 bp, Homo sapiens
gtgagaccacctctcaatat

SEQ ID NO: 4188990 - DNA, 16 bp, Homo sapiens
gtgagaccctgtctct

SEQ ID NO: 4188991 - DNA, 15 bp, Homo sapiens
gtgagatgtaattgt

SEQ ID NO: 4188992 - DNA, 19 bp, Homo sapiens
gtgagctgagatcacgcca

SEQ ID NO: 4188993 - DNA, 14 bp, Homo sapiens
gtgaggcctggcca

SEQ ID NO: 4188994 - DNA, 16 bp, Homo sapiens
gtgaggttgtgctgcc

SEQ ID NO: 4188995 - DNA, 17 bp, Homo sapiens
gtgagtgaatggcaaag

SEQ ID NO: 4188996 - DNA, 17 bp, Homo sapiens
gtgagttacagcgagag

SEQ ID NO: 4188997 - DNA, 19 bp, Homo sapiens
gtgagtttaggcagcttct

SEQ ID NO: 4188998 - DNA, 21 bp, Homo sapiens
gtgataaatctagaaaattga

SEQ ID NO: 4188999 - DNA, 18 bp, Homo sapiens
gtgatttagaactgtatg

SEQ ID NO: 4189000 - DNA, 19 bp, Homo sapiens
gtgatttcagactgcagag

SEQ ID NO: 4189001 - DNA, 12 bp, Homo sapiens
gtgatttctgag

SEQ ID NO: 4189002 - DNA, 23 bp, Homo sapiens
gtgcaaaaataaaaggaaaacca

SEQ ID NO: 4189003 - DNA, 20 bp, Homo sapiens
gtgcaacaagagcaaaatga

SEQ ID NO: 4189004 - DNA, 20 bp, Homo sapiens
gtgcaagagactctggcctc

SEQ ID NO: 4189005 - DNA, 22 bp, Homo sapiens
gtgcaagagactctggcctcca

SEQ ID NO: 4189006 - DNA, 21 bp, Homo sapiens
gtgcacctgtactcaggaggc

SEQ ID NO: 4189007 - DNA, 16 bp, Homo sapiens
gtgcactggccccacc

SEQ ID NO: 4189008 - DNA, 13 bp, Homo sapiens
gtgcagagctggg

SEQ ID NO: 4189009 - DNA, 17 bp, Homo sapiens
gtgcagagctggggctg

SEQ ID NO: 4189010 - DNA, 20 bp, Homo sapiens
gtgcatccacgcacacatgg

SEQ ID NO: 4189011 - DNA, 14 bp, Homo sapiens
gtgcatgtatgtgt

SEQ ID NO: 4189012 - DNA, 22 bp, Homo sapiens
gtgcatgtatgtgtgtgtgtat

SEQ ID NO: 4189013 - DNA, 15 bp, Homo sapiens
gtgccacagagaaga

SEQ ID NO: 4189014 - DNA, 11 bp, Homo sapiens
gtgccagaggt

SEQ ID NO: 4189015 - DNA, 13 bp, Homo sapiens
gtgccagcgctgg

SEQ ID NO: 4189016 - DNA, 17 bp, Homo sapiens
gtgccaggactccccag

SEQ ID NO: 4189017 - DNA, 13 bp, Homo sapiens
gtgccccatgtcc

SEQ ID NO: 4189018 - DNA, 20 bp, Homo sapiens
gtgccctccacagccgcagc

SEQ ID NO: 4189019 - DNA, 21 bp, Homo sapiens
gtgccctttggggttgcccag

SEQ ID NO: 4189020 - DNA, 17 bp, Homo sapiens
gtgccgggagaggactc

SEQ ID NO: 4189021 - DNA, 16 bp, Homo sapiens
gtgcctagactgttac

SEQ ID NO: 4189022 - DNA, 18 bp, Homo sapiens
gtgcctagactgttactt

SEQ ID NO: 4189023 - DNA, 21 bp, Homo sapiens
gtgcctttctctggctccaga

SEQ ID NO: 4189024 - DNA, 14 bp, Homo sapiens
gtgccttttatagc

SEQ ID NO: 4189025 - DNA, 15 bp, Homo sapiens
gtgcggtggctcacg

SEQ ID NO: 4189026 - DNA, 20 bp, Homo sapiens
gtgctactccatgcaggggt

SEQ ID NO: 4189027 - DNA, 16 bp, Homo sapiens
gtgctatggtgctctg

SEQ ID NO: 4189028 - DNA, 16 bp, Homo sapiens
gtgctcctgtccctcc

SEQ ID NO: 4189029 - DNA, 14 bp, Homo sapiens
gtgctgacctctgg

SEQ ID NO: 4189030 - DNA, 14 bp, Homo sapiens
gtgctgatccggct

SEQ ID NO: 4189031 - DNA, 15 bp, Homo sapiens
gtgctgatccggctg

SEQ ID NO: 4189032 - DNA, 17 bp, Homo sapiens
gtgctgtggccagggtg

SEQ ID NO: 4189033 - DNA, 23 bp, Homo sapiens
gtgctgtggccagggtgagagct

SEQ ID NO: 4189034 - DNA, 13 bp, Homo sapiens
gtgcttcagcctg

SEQ ID NO: 4189035 - DNA, 20 bp, Homo sapiens
gtgcttccctaggctgagct

SEQ ID NO: 4189036 - DNA, 18 bp, Homo sapiens
gtgcttgatagaaatgcc

SEQ ID NO: 4189037 - DNA, 20 bp, Homo sapiens
gtgctttcaggtctggggct

SEQ ID NO: 4189038 - DNA, 19 bp, Homo sapiens
gtggaaaaatcagaagcac

SEQ ID NO: 4189039 - DNA, 20 bp, Homo sapiens
gtggaaaagaatccctgcag

SEQ ID NO: 4189040 - DNA, 13 bp, Homo sapiens
gtggacacctgcc

SEQ ID NO: 4189041 - DNA, 13 bp, Homo sapiens
gtggacagtcctg

SEQ ID NO: 4189042 - DNA, 16 bp, Homo sapiens
gtggacagtcctggga

SEQ ID NO: 4189043 - DNA, 14 bp, Homo sapiens
gtggagacagccct

SEQ ID NO: 4189044 - DNA, 15 bp, Homo sapiens
gtggatcacctgagg

SEQ ID NO: 4189045 - DNA, 23 bp, Homo sapiens
gtggatctccaaggaccaggtta

SEQ ID NO: 4189046 - DNA, 17 bp, Homo sapiens
gtggatctgtccaagga

SEQ ID NO: 4189047 - DNA, 16 bp, Homo sapiens
gtggatgggccctgca

SEQ ID NO: 4189048 - DNA, 19 bp, Homo sapiens
gtggattcctgggcaagaa

SEQ ID NO: 4189049 - DNA, 13 bp, Homo sapiens
gtggcaagggggc

SEQ ID NO: 4189050 - DNA, 15 bp, Homo sapiens
gtggcaagggggcgg

SEQ ID NO: 4189051 - DNA, 21 bp, Homo sapiens
gtggcagataatcagcctctt

SEQ ID NO: 4189052 - DNA, 20 bp, Homo sapiens
gtggcatggcagaatgaaaa

SEQ ID NO: 4189053 - DNA, 13 bp, Homo sapiens
gtggccaagcctg

SEQ ID NO: 4189054 - DNA, 18 bp, Homo sapiens
gtggccatcagggtgggc

SEQ ID NO: 4189055 - DNA, 23 bp, Homo sapiens
gtggcccagtcgtccgctcagcc

SEQ ID NO: 4189056 - DNA, 12 bp, Homo sapiens
gtggcctgggca

SEQ ID NO: 4189057 - DNA, 14 bp, Homo sapiens
gtggctctggacag

SEQ ID NO: 4189058 - DNA, 16 bp, Homo sapiens
gtggctgagcttggcc

SEQ ID NO: 4189059 - DNA, 21 bp, Homo sapiens
gtggctggcctttcaggtcca

SEQ ID NO: 4189060 - DNA, 15 bp, Homo sapiens
gtggcttacaaattc

SEQ ID NO: 4189061 - DNA, 20 bp, Homo sapiens
gtggcttttttcctcctgtg

SEQ ID NO: 4189062 - DNA, 17 bp, Homo sapiens
gtgggaactcactttcc

SEQ ID NO: 4189063 - DNA, 14 bp, Homo sapiens
gtgggaagcaagca

SEQ ID NO: 4189064 - DNA, 21 bp, Homo sapiens
gtgggacaaaccagagcagag

SEQ ID NO: 4189065 - DNA, 18 bp, Homo sapiens
gtgggagctcagctcgct

SEQ ID NO: 4189066 - DNA, 17 bp, Homo sapiens
gtgggaggtgagaccac

SEQ ID NO: 4189067 - DNA, 15 bp, Homo sapiens
gtgggcggggagaag

SEQ ID NO: 4189068 - DNA, 15 bp, Homo sapiens
gtgggctccctggcc

SEQ ID NO: 4189069 - DNA, 14 bp, Homo sapiens
gtgggctgagccct

SEQ ID NO: 4189070 - DNA, 18 bp, Homo sapiens
gtgggctgagccctggca

SEQ ID NO: 4189071 - DNA, 15 bp, Homo sapiens
gtgggctgcatctgg

SEQ ID NO: 4189072 - DNA, 13 bp, Homo sapiens
gtggggccttggt

SEQ ID NO: 4189073 - DNA, 17 bp, Homo sapiens
gtggggggtggacacag

SEQ ID NO: 4189074 - DNA, 19 bp, Homo sapiens
gtgggtatttcctgctaca

SEQ ID NO: 4189075 - DNA, 16 bp, Homo sapiens
gtgggtggtggatctg

SEQ ID NO: 4189076 - DNA, 15 bp, Homo sapiens
gtggtgaagaaaact

SEQ ID NO: 4189077 - DNA, 22 bp, Homo sapiens
gtggtgaggtcctgtcctggct

SEQ ID NO: 4189078 - DNA, 21 bp, Homo sapiens
gtggtgaggttgtgctgcctg

SEQ ID NO: 4189079 - DNA, 20 bp, Homo sapiens
gtggtggatctgtccaagga

SEQ ID NO: 4189080 - DNA, 14 bp, Homo sapiens
gtggtgtgtgtgct

SEQ ID NO: 4189081 - DNA, 21 bp, Homo sapiens
gtggtgtttgtaggctgtggg

SEQ ID NO: 4189082 - DNA, 12 bp, Homo sapiens
gtgtacagtgtg

SEQ ID NO: 4189083 - DNA, 16 bp, Homo sapiens
gtgtagcaactacagt

SEQ ID NO: 4189084 - DNA, 14 bp, Homo sapiens
gtgtagccaaggtc

SEQ ID NO: 4189085 - DNA, 17 bp, Homo sapiens
gtgtagccacaccagga

SEQ ID NO: 4189086 - DNA, 16 bp, Homo sapiens
gtgtagccttgcccgg

SEQ ID NO: 4189087 - DNA, 16 bp, Homo sapiens
gtgtcaagacatttct

SEQ ID NO: 4189088 - DNA, 15 bp, Homo sapiens
gtgtcaccctgcaga

SEQ ID NO: 4189089 - DNA, 15 bp, Homo sapiens
gtgtcactcaaggcg

SEQ ID NO: 4189090 - DNA, 21 bp, Homo sapiens
gtgtcactcaaggcggtgctt

SEQ ID NO: 4189091 - DNA, 15 bp, Homo sapiens
gtgtcctctccctgc

SEQ ID NO: 4189092 - DNA, 22 bp, Homo sapiens
gtgtctccccgtgtcctctccc

SEQ ID NO: 4189093 - DNA, 15 bp, Homo sapiens
gtgtctgatgtttgt

SEQ ID NO: 4189094 - DNA, 14 bp, Homo sapiens
gtgtctgcacccag

SEQ ID NO: 4189095 - DNA, 17 bp, Homo sapiens
gtgtctgggagagcctg

SEQ ID NO: 4189096 - DNA, 19 bp, Homo sapiens
gtgtctgggagagcctggc

SEQ ID NO: 4189097 - DNA, 21 bp, Homo sapiens
gtgtctgggagagcctggcaa

SEQ ID NO: 4189098 - DNA, 22 bp, Homo sapiens
gtgtctgggagagcctggcaag

SEQ ID NO: 4189099 - DNA, 18 bp, Homo sapiens
gtgtgaaagtcagatgcc

SEQ ID NO: 4189100 - DNA, 23 bp, Homo sapiens
gtgtgactctcttggattattta

SEQ ID NO: 4189101 - DNA, 17 bp, Homo sapiens
gtgtgatcccaagtgcc

SEQ ID NO: 4189102 - DNA, 17 bp, Homo sapiens
gtgtgatgaactttctc

SEQ ID NO: 4189103 - DNA, 15 bp, Homo sapiens
gtgtgcctgcagccc

SEQ ID NO: 4189104 - DNA, 14 bp, Homo sapiens
gtgtgggctgtgtc

SEQ ID NO: 4189105 - DNA, 22 bp, Homo sapiens
gtgtggtgtcaccagcctgttt

SEQ ID NO: 4189106 - DNA, 19 bp, Homo sapiens
gtgtgtctgtgcgtctgtg

SEQ ID NO: 4189107 - DNA, 21 bp, Homo sapiens
gtgtgttttgagagtatatta

SEQ ID NO: 4189108 - DNA, 12 bp, Homo sapiens
gtgttaattttt

SEQ ID NO: 4189109 - DNA, 20 bp, Homo sapiens
gtgttataatgggtaatata

SEQ ID NO: 4189110 - DNA, 15 bp, Homo sapiens
gtgttattatttggc

SEQ ID NO: 4189111 - DNA, 17 bp, Homo sapiens
gtgttccagctgcctgg

SEQ ID NO: 4189112 - DNA, 21 bp, Homo sapiens
gtgttcctataaaatcaaaga

SEQ ID NO: 4189113 - DNA, 14 bp, Homo sapiens
gtgtttaacattca

SEQ ID NO: 4189114 - DNA, 13 bp, Homo sapiens
gtgtttgctttct

SEQ ID NO: 4189115 - DNA, 18 bp, Homo sapiens
gtgttttctgaataacat

SEQ ID NO: 4189116 - DNA, 19 bp, Homo sapiens
gtgttttctgaataacatt

SEQ ID NO: 4189117 - DNA, 18 bp, Homo sapiens
gttaaattccatatgctc

SEQ ID NO: 4189118 - DNA, 15 bp, Homo sapiens
gttaacattaacatc

SEQ ID NO: 4189119 - DNA, 17 bp, Homo sapiens
gttaactttaagactga

SEQ ID NO: 4189120 - DNA, 19 bp, Homo sapiens
gttaagatctgaaagtttt

SEQ ID NO: 4189121 - DNA, 13 bp, Homo sapiens
gttaagggaagga

SEQ ID NO: 4189122 - DNA, 12 bp, Homo sapiens
gttaatttttga

SEQ ID NO: 4189123 - DNA, 17 bp, Homo sapiens
gttacaacttgtatttc

SEQ ID NO: 4189124 - DNA, 21 bp, Homo sapiens
gttacagcgagaggcagagaa

SEQ ID NO: 4189125 - DNA, 14 bp, Homo sapiens
gttactgattctcc

SEQ ID NO: 4189126 - DNA, 18 bp, Homo sapiens
gttagagaggtagcgagc

SEQ ID NO: 4189127 - DNA, 21 bp, Homo sapiens
gttagagaggtagcgagctgc

SEQ ID NO: 4189128 - DNA, 20 bp, Homo sapiens
gttagctcaggaggcttgga

SEQ ID NO: 4189129 - DNA, 14 bp, Homo sapiens
gttaggaaataaaa

SEQ ID NO: 4189130 - DNA, 22 bp, Homo sapiens
gttaggaaataaaacctttcaa

SEQ ID NO: 4189131 - DNA, 14 bp, Homo sapiens
gttagtttttactt

SEQ ID NO: 4189132 - DNA, 17 bp, Homo sapiens
gttatatattttttgta

SEQ ID NO: 4189133 - DNA, 19 bp, Homo sapiens
gttatattttctattacac

SEQ ID NO: 4189134 - DNA, 14 bp, Homo sapiens
gttatctttttgtg

SEQ ID NO: 4189135 - DNA, 15 bp, Homo sapiens
gttatttacttgaaa

SEQ ID NO: 4189136 - DNA, 20 bp, Homo sapiens
gttatttgtacagttcagtt

SEQ ID NO: 4189137 - DNA, 14 bp, Homo sapiens
gttattttcagtat

SEQ ID NO: 4189138 - DNA, 15 bp, Homo sapiens
gttattttcagtatt

SEQ ID NO: 4189139 - DNA, 16 bp, Homo sapiens
gttcaagaaataagtt

SEQ ID NO: 4189140 - DNA, 13 bp, Homo sapiens
gttcaagaagact

SEQ ID NO: 4189141 - DNA, 18 bp, Homo sapiens
gttcaaggaccacatgtg

SEQ ID NO: 4189142 - DNA, 19 bp, Homo sapiens
gttcatatttatactttgc

SEQ ID NO: 4189143 - DNA, 23 bp, Homo sapiens
gttccaaataaggatttgttcac

SEQ ID NO: 4189144 - DNA, 16 bp, Homo sapiens
gttccagctgcctggg

SEQ ID NO: 4189145 - DNA, 18 bp, Homo sapiens
gttccagctgcctgggag

SEQ ID NO: 4189146 - DNA, 23 bp, Homo sapiens
gttccatgaagaccacatccaca

SEQ ID NO: 4189147 - DNA, 13 bp, Homo sapiens
gttccatgttaaa

SEQ ID NO: 4189148 - DNA, 18 bp, Homo sapiens
gttcccaatatgtagcct

SEQ ID NO: 4189149 - DNA, 14 bp, Homo sapiens
gttcccgagggagc

SEQ ID NO: 4189150 - DNA, 19 bp, Homo sapiens
gttcccgagggagctgctg

SEQ ID NO: 4189151 - DNA, 22 bp, Homo sapiens
gttcccgagggagctgctggct

SEQ ID NO: 4189152 - DNA, 14 bp, Homo sapiens
gttcctgcactcca

SEQ ID NO: 4189153 - DNA, 21 bp, Homo sapiens
gttcctttttcaacttggaaa

SEQ ID NO: 4189154 - DNA, 16 bp, Homo sapiens
gttcgagaccagcctg

SEQ ID NO: 4189155 - DNA, 19 bp, Homo sapiens
gttcgagaccagcctggcc

SEQ ID NO: 4189156 - DNA, 14 bp, Homo sapiens
gttctaatattttt

SEQ ID NO: 4189157 - DNA, 18 bp, Homo sapiens
gttctatagagcctggcg

SEQ ID NO: 4189158 - DNA, 14 bp, Homo sapiens
gttctgcgttacaa

SEQ ID NO: 4189159 - DNA, 12 bp, Homo sapiens
gttctgtatttt

SEQ ID NO: 4189160 - DNA, 18 bp, Homo sapiens
gttctgtgacccatctgt

SEQ ID NO: 4189161 - DNA, 13 bp, Homo sapiens
gttcttgatgaca

SEQ ID NO: 4189162 - DNA, 16 bp, Homo sapiens
gttcttggtaactgat

SEQ ID NO: 4189163 - DNA, 23 bp, Homo sapiens
gttctttactggtgatttctgag

SEQ ID NO: 4189164 - DNA, 19 bp, Homo sapiens
gttctttataaaaagtgaa

SEQ ID NO: 4189165 - DNA, 21 bp, Homo sapiens
gttcttttttgttacagctat

SEQ ID NO: 4189166 - DNA, 19 bp, Homo sapiens
gttgaacatctcactttgc

SEQ ID NO: 4189167 - DNA, 15 bp, Homo sapiens
gttgaatgacaacag

SEQ ID NO: 4189168 - DNA, 19 bp, Homo sapiens
gttgaatgacaacagaagc

SEQ ID NO: 4189169 - DNA, 16 bp, Homo sapiens
gttgaatggcctgcct

SEQ ID NO: 4189170 - DNA, 19 bp, Homo sapiens
gttgacccctttcccccac

SEQ ID NO: 4189171 - DNA, 23 bp, Homo sapiens
gttgacccctttcccccacccca

SEQ ID NO: 4189172 - DNA, 18 bp, Homo sapiens
gttgaggggctcctggaa

SEQ ID NO: 4189173 - DNA, 16 bp, Homo sapiens
gttgatcataattaaa

SEQ ID NO: 4189174 - DNA, 19 bp, Homo sapiens
gttgattctgaatctgaaa

SEQ ID NO: 4189175 - DNA, 21 bp, Homo sapiens
gttgccacaccaatcagagag

SEQ ID NO: 4189176 - DNA, 12 bp, Homo sapiens
gttgcccagcct

SEQ ID NO: 4189177 - DNA, 14 bp, Homo sapiens
gttgcccagcctgg

SEQ ID NO: 4189178 - DNA, 18 bp, Homo sapiens
gttgcgggggagctggaa

SEQ ID NO: 4189179 - DNA, 14 bp, Homo sapiens
gttgcttctggctc

SEQ ID NO: 4189180 - DNA, 17 bp, Homo sapiens
gttgcttctggctcctc

SEQ ID NO: 4189181 - DNA, 14 bp, Homo sapiens
gttggacttcagtc

SEQ ID NO: 4189182 - DNA, 17 bp, Homo sapiens
gttggggcaaagcctcc

SEQ ID NO: 4189183 - DNA, 15 bp, Homo sapiens
gttgggttcatctga

SEQ ID NO: 4189184 - DNA, 20 bp, Homo sapiens
gttggtgaacagagagaacc

SEQ ID NO: 4189185 - DNA, 18 bp, Homo sapiens
gttggtgggctggcccag

SEQ ID NO: 4189186 - DNA, 19 bp, Homo sapiens
gttggtttccaaaaaggaa

SEQ ID NO: 4189187 - DNA, 16 bp, Homo sapiens
gttgtaaataaaagta

SEQ ID NO: 4189188 - DNA, 14 bp, Homo sapiens
gttgtacaagctca

SEQ ID NO: 4189189 - DNA, 22 bp, Homo sapiens
gttgtgaggcctggccaggcac

SEQ ID NO: 4189190 - DNA, 22 bp, Homo sapiens
gttgtgcttgctggtactaaga

SEQ ID NO: 4189191 - DNA, 15 bp, Homo sapiens
gttgttactgattct

SEQ ID NO: 4189192 - DNA, 16 bp, Homo sapiens
gttgttactgattctc

SEQ ID NO: 4189193 - DNA, 13 bp, Homo sapiens
gttgttgttgttt

SEQ ID NO: 4189194 - DNA, 18 bp, Homo sapiens
gtttaaattattttatca

SEQ ID NO: 4189195 - DNA, 16 bp, Homo sapiens
gtttaacattcacagc

SEQ ID NO: 4189196 - DNA, 19 bp, Homo sapiens
gtttaacattcacagccca

SEQ ID NO: 4189197 - DNA, 14 bp, Homo sapiens
gtttaatactcaga

SEQ ID NO: 4189198 - DNA, 11 bp, Homo sapiens
gtttacagaat

SEQ ID NO: 4189199 - DNA, 15 bp, Homo sapiens
gtttacagtaaataa

SEQ ID NO: 4189200 - DNA, 19 bp, Homo sapiens
gtttacatgaacacagctg

SEQ ID NO: 4189201 - DNA, 13 bp, Homo sapiens
gtttacatgcaga

SEQ ID NO: 4189202 - DNA, 16 bp, Homo sapiens
gtttactaaagagaca

SEQ ID NO: 4189203 - DNA, 14 bp, Homo sapiens
gtttacttcatgag

SEQ ID NO: 4189204 - DNA, 17 bp, Homo sapiens
gtttacttttcagggca

SEQ ID NO: 4189205 - DNA, 15 bp, Homo sapiens
gtttagaagcgctca

SEQ ID NO: 4189206 - DNA, 19 bp, Homo sapiens
gtttagcccttccctgcct

SEQ ID NO: 4189207 - DNA, 21 bp, Homo sapiens
gtttatagagggccaagactt

SEQ ID NO: 4189208 - DNA, 17 bp, Homo sapiens
gtttcaaaaataaaaga

SEQ ID NO: 4189209 - DNA, 19 bp, Homo sapiens
gtttcacaaggtctttaaa

SEQ ID NO: 4189210 - DNA, 23 bp, Homo sapiens
gtttcacagcctataaccagaca

SEQ ID NO: 4189211 - DNA, 13 bp, Homo sapiens
gtttcagaagcag

SEQ ID NO: 4189212 - DNA, 19 bp, Homo sapiens
gtttcagaagcaggcaggg

SEQ ID NO: 4189213 - DNA, 16 bp, Homo sapiens
gtttcagatatatatc

SEQ ID NO: 4189214 - DNA, 17 bp, Homo sapiens
gtttcagatatatatca

SEQ ID NO: 4189215 - DNA, 23 bp, Homo sapiens
gtttccaagttcctgcactccag

SEQ ID NO: 4189216 - DNA, 15 bp, Homo sapiens
gtttctagagggcac

SEQ ID NO: 4189217 - DNA, 22 bp, Homo sapiens
gtttctccccctgggctctgcc

SEQ ID NO: 4189218 - DNA, 19 bp, Homo sapiens
gtttgcactgtatgctgga

SEQ ID NO: 4189219 - DNA, 22 bp, Homo sapiens
gtttgcactgtatgctggacgg

SEQ ID NO: 4189220 - DNA, 19 bp, Homo sapiens
gtttgctctagtcttgctt

SEQ ID NO: 4189221 - DNA, 22 bp, Homo sapiens
gtttggaaaagctaagtagaaa

SEQ ID NO: 4189222 - DNA, 20 bp, Homo sapiens
gtttggatatgtaaaacatt

SEQ ID NO: 4189223 - DNA, 21 bp, Homo sapiens
gtttggatatgtaaaacattt

SEQ ID NO: 4189224 - DNA, 19 bp, Homo sapiens
gtttggcaatagtttgcat

SEQ ID NO: 4189225 - DNA, 16 bp, Homo sapiens
gtttgtaggctgtggg

SEQ ID NO: 4189226 - DNA, 14 bp, Homo sapiens
gtttgtattttaaa

SEQ ID NO: 4189227 - DNA, 21 bp, Homo sapiens
gtttgtcaacaaaaagacatg

SEQ ID NO: 4189228 - DNA, 22 bp, Homo sapiens
gtttgtttaaacacttatcttc

SEQ ID NO: 4189229 - DNA, 19 bp, Homo sapiens
gtttgtttctccccctggg

SEQ ID NO: 4189230 - DNA, 20 bp, Homo sapiens
gtttgtttctccccctgggc

SEQ ID NO: 4189231 - DNA, 22 bp, Homo sapiens
gttttaaatacgcactacatgt

SEQ ID NO: 4189232 - DNA, 14 bp, Homo sapiens
gttttatcatgaca

SEQ ID NO: 4189233 - DNA, 18 bp, Homo sapiens
gttttccaaagataatgt

SEQ ID NO: 4189234 - DNA, 20 bp, Homo sapiens
gttttctcttccttgtgatt

SEQ ID NO: 4189235 - DNA, 13 bp, Homo sapiens
gtttttaatgtat

SEQ ID NO: 4189236 - DNA, 17 bp, Homo sapiens
gtttttactttctgttg

SEQ ID NO: 4189237 - DNA, 17 bp, Homo sapiens
gtttttattttcctctg

SEQ ID NO: 4189238 - DNA, 14 bp, Homo sapiens
gtttttgctataga

SEQ ID NO: 4189239 - DNA, 14 bp, Homo sapiens
gttttttgtaccaa

SEQ ID NO: 4189240 - DNA, 17 bp, Homo sapiens
taaaaaactaaaaacta

SEQ ID NO: 4189241 - DNA, 21 bp, Homo sapiens
taaaaaactatctttttgctt

SEQ ID NO: 4189242 - DNA, 16 bp, Homo sapiens
taaaaaagatttgtag

SEQ ID NO: 4189243 - DNA, 23 bp, Homo sapiens
taaaaagactattaagagcaata

SEQ ID NO: 4189244 - DNA, 21 bp, Homo sapiens
taaaaagctctttcatctttt

SEQ ID NO: 4189245 - DNA, 23 bp, Homo sapiens
taaaaatatggaacttctaatat

SEQ ID NO: 4189246 - DNA, 21 bp, Homo sapiens
taaaaatatgtgaatctggat

SEQ ID NO: 4189247 - DNA, 16 bp, Homo sapiens
taaaaatattttctga

SEQ ID NO: 4189248 - DNA, 17 bp, Homo sapiens
taaaaatctttgattca

SEQ ID NO: 4189249 - DNA, 14 bp, Homo sapiens
taaaaatgaaatta

SEQ ID NO: 4189250 - DNA, 15 bp, Homo sapiens
taaaaccacagaaca

SEQ ID NO: 4189251 - DNA, 23 bp, Homo sapiens
taaaacctcagggacaacatttt

SEQ ID NO: 4189252 - DNA, 10 bp, Homo sapiens
taaaaccttt

SEQ ID NO: 4189253 - DNA, 11 bp, Homo sapiens
taaaacctttc

SEQ ID NO: 4189254 - DNA, 20 bp, Homo sapiens
taaaacctttcaaatttcac

SEQ ID NO: 4189255 - DNA, 21 bp, Homo sapiens
taaaactttgaagttagcttt

SEQ ID NO: 4189256 - DNA, 14 bp, Homo sapiens
taaaagataaacag

SEQ ID NO: 4189257 - DNA, 23 bp, Homo sapiens
taaaagataacaagatctttcag

SEQ ID NO: 4189258 - DNA, 14 bp, Homo sapiens
taaaagatgctttt

SEQ ID NO: 4189259 - DNA, 15 bp, Homo sapiens
taaaagatgctttta

SEQ ID NO: 4189260 - DNA, 17 bp, Homo sapiens
taaaagcaaaaaagaaa

SEQ ID NO: 4189261 - DNA, 18 bp, Homo sapiens
taaaagcaaaaaagaaaa

SEQ ID NO: 4189262 - DNA, 14 bp, Homo sapiens
taaaagtgtgagca

SEQ ID NO: 4189263 - DNA, 18 bp, Homo sapiens
taaaagtgtgagcagtga

SEQ ID NO: 4189264 - DNA, 21 bp, Homo sapiens
taaaatagcaaaagaagaagt

SEQ ID NO: 4189265 - DNA, 15 bp, Homo sapiens
taaaatcaataaaag

SEQ ID NO: 4189266 - DNA, 13 bp, Homo sapiens
taaaatcactata

SEQ ID NO: 4189267 - DNA, 16 bp, Homo sapiens
taaaatgaaatgtttt

SEQ ID NO: 4189268 - DNA, 14 bp, Homo sapiens
taaaatgattgtaa

SEQ ID NO: 4189269 - DNA, 15 bp, Homo sapiens
taaaatgattgtaaa

SEQ ID NO: 4189270 - DNA, 17 bp, Homo sapiens
taaaatgattgtaaaat

SEQ ID NO: 4189271 - DNA, 22 bp, Homo sapiens
taaaatgattgtaaaatagctt

SEQ ID NO: 4189272 - DNA, 14 bp, Homo sapiens
taaaattgtaaaat

SEQ ID NO: 4189273 - DNA, 14 bp, Homo sapiens
taaaattgtataga

SEQ ID NO: 4189274 - DNA, 19 bp, Homo sapiens
taaaattgttagtaaacat

SEQ ID NO: 4189275 - DNA, 13 bp, Homo sapiens
taaaatttcaaca

SEQ ID NO: 4189276 - DNA, 18 bp, Homo sapiens
taaacaaaatagaagctg

SEQ ID NO: 4189277 - DNA, 18 bp, Homo sapiens
taaacaaatgaattgtat

SEQ ID NO: 4189278 - DNA, 13 bp, Homo sapiens
taaacaagtattt

SEQ ID NO: 4189279 - DNA, 23 bp, Homo sapiens
taaacaagtatttgttaatttag

SEQ ID NO: 4189280 - DNA, 18 bp, Homo sapiens
taaacactgcctatatat

SEQ ID NO: 4189281 - DNA, 16 bp, Homo sapiens
taaacacttgcaacct

SEQ ID NO: 4189282 - DNA, 18 bp, Homo sapiens
taaacaggagacaggaag

SEQ ID NO: 4189283 - DNA, 18 bp, Homo sapiens
taaacatcatagtttctt

SEQ ID NO: 4189284 - DNA, 16 bp, Homo sapiens
taaacctggagatgat

SEQ ID NO: 4189285 - DNA, 19 bp, Homo sapiens
taaacgactccgagaacaa

SEQ ID NO: 4189286 - DNA, 15 bp, Homo sapiens
taaactcaaaactta

SEQ ID NO: 4189287 - DNA, 20 bp, Homo sapiens
taaactcaaaacttaacata

SEQ ID NO: 4189288 - DNA, 14 bp, Homo sapiens
taaactctaaacat

SEQ ID NO: 4189289 - DNA, 15 bp, Homo sapiens
taaactctaaacatt

SEQ ID NO: 4189290 - DNA, 14 bp, Homo sapiens
taaagaaaaacaaa

SEQ ID NO: 4189291 - DNA, 11 bp, Homo sapiens
taaagaaagtc

SEQ ID NO: 4189292 - DNA, 17 bp, Homo sapiens
taaagaaagtcgaatta

SEQ ID NO: 4189293 - DNA, 17 bp, Homo sapiens
taaagaagggaagcttt

SEQ ID NO: 4189294 - DNA, 11 bp, Homo sapiens
taaagatgtgt

SEQ ID NO: 4189295 - DNA, 21 bp, Homo sapiens
taaagattttttaataattta

SEQ ID NO: 4189296 - DNA, 22 bp, Homo sapiens
taaagattttttaataatttag

SEQ ID NO: 4189297 - DNA, 22 bp, Homo sapiens
taaagcaaggcatacctgtcct

SEQ ID NO: 4189298 - DNA, 10 bp, Homo sapiens
taaagcaggg

SEQ ID NO: 4189299 - DNA, 21 bp, Homo sapiens
taaagctgcctgtagttagga

SEQ ID NO: 4189300 - DNA, 20 bp, Homo sapiens
taaagctggacaagaagctg

SEQ ID NO: 4189301 - DNA, 21 bp, Homo sapiens
taaagctggacaagaagctgc

SEQ ID NO: 4189302 - DNA, 15 bp, Homo sapiens
taaagctggtttaat

SEQ ID NO: 4189303 - DNA, 10 bp, Homo sapiens
taaaggaaat

SEQ ID NO: 4189304 - DNA, 18 bp, Homo sapiens
taaaggaagtcaccaaaa

SEQ ID NO: 4189305 - DNA, 17 bp, Homo sapiens
taaaggagaaggcatga

SEQ ID NO: 4189306 - DNA, 16 bp, Homo sapiens
taaaggagttaagagt

SEQ ID NO: 4189307 - DNA, 21 bp, Homo sapiens
taaaggattgatcactttgtt

SEQ ID NO: 4189308 - DNA, 22 bp, Homo sapiens
taaaggattgatcactttgtta

SEQ ID NO: 4189309 - DNA, 13 bp, Homo sapiens
taaagtatgtaaa

SEQ ID NO: 4189310 - DNA, 15 bp, Homo sapiens
taaagtatgtaaaca

SEQ ID NO: 4189311 - DNA, 16 bp, Homo sapiens
taaagtatgtaaacag

SEQ ID NO: 4189312 - DNA, 19 bp, Homo sapiens
taaagtgactaatggcatg

SEQ ID NO: 4189313 - DNA, 16 bp, Homo sapiens
taaagtgtaaatcctt

SEQ ID NO: 4189314 - DNA, 16 bp, Homo sapiens
taaagttgataaagat

SEQ ID NO: 4189315 - DNA, 14 bp, Homo sapiens
taaagtttacagta

SEQ ID NO: 4189316 - DNA, 19 bp, Homo sapiens
taaagtttacagtctttct

SEQ ID NO: 4189317 - DNA, 15 bp, Homo sapiens
taaataaattgtttg

SEQ ID NO: 4189318 - DNA, 11 bp, Homo sapiens
taaataagaaa

SEQ ID NO: 4189319 - DNA, 16 bp, Homo sapiens
taaatagaaattttgt

SEQ ID NO: 4189320 - DNA, 14 bp, Homo sapiens
taaatagagttcca

SEQ ID NO: 4189321 - DNA, 22 bp, Homo sapiens
taaataggtaggcctctaattg

SEQ ID NO: 4189322 - DNA, 13 bp, Homo sapiens
taaatagtatttc

SEQ ID NO: 4189323 - DNA, 21 bp, Homo sapiens
taaatatatctatattattgt

SEQ ID NO: 4189324 - DNA, 20 bp, Homo sapiens
taaatattgacttctcttga

SEQ ID NO: 4189325 - DNA, 14 bp, Homo sapiens
taaatattttaaag

SEQ ID NO: 4189326 - DNA, 15 bp, Homo sapiens
taaatattttaaaga

SEQ ID NO: 4189327 - DNA, 18 bp, Homo sapiens
taaatattttaaagaatt

SEQ ID NO: 4189328 - DNA, 16 bp, Homo sapiens
taaatcagaaatagga

SEQ ID NO: 4189329 - DNA, 17 bp, Homo sapiens
taaatcctttttcttta

SEQ ID NO: 4189330 - DNA, 15 bp, Homo sapiens
taaatctctaatatg

SEQ ID NO: 4189331 - DNA, 15 bp, Homo sapiens
taaatgcctcttaaa

SEQ ID NO: 4189332 - DNA, 21 bp, Homo sapiens
taaatgcctcttaaattatat

SEQ ID NO: 4189333 - DNA, 11 bp, Homo sapiens
taaatgttcaa

SEQ ID NO: 4189334 - DNA, 20 bp, Homo sapiens
taaattaaaaaggaaagaaa

SEQ ID NO: 4189335 - DNA, 18 bp, Homo sapiens
taaattcagatatatttt

SEQ ID NO: 4189336 - DNA, 13 bp, Homo sapiens
taaattccactgg

SEQ ID NO: 4189337 - DNA, 21 bp, Homo sapiens
taaattccatatgctccagga

SEQ ID NO: 4189338 - DNA, 15 bp, Homo sapiens
taaattgaatacaca

SEQ ID NO: 4189339 - DNA, 20 bp, Homo sapiens
taaatttaataaaaacttca

SEQ ID NO: 4189340 - DNA, 14 bp, Homo sapiens
taaatttgtaccta

SEQ ID NO: 4189341 - DNA, 19 bp, Homo sapiens
taaattttgacttgaaaaa

SEQ ID NO: 4189342 - DNA, 13 bp, Homo sapiens
taacaaatacatt

SEQ ID NO: 4189343 - DNA, 16 bp, Homo sapiens
taacaagatctttcag

SEQ ID NO: 4189344 - DNA, 14 bp, Homo sapiens
taacaaggttcttc

SEQ ID NO: 4189345 - DNA, 16 bp, Homo sapiens
taacaataatatttca

SEQ ID NO: 4189346 - DNA, 19 bp, Homo sapiens
taacaataatatttcaagt

SEQ ID NO: 4189347 - DNA, 23 bp, Homo sapiens
taacaataatatttcaagtgcct

SEQ ID NO: 4189348 - DNA, 21 bp, Homo sapiens
taacaatctaacaataatatt

SEQ ID NO: 4189349 - DNA, 20 bp, Homo sapiens
taacaattaggcagactctt

SEQ ID NO: 4189350 - DNA, 15 bp, Homo sapiens
taacaatttccttta

SEQ ID NO: 4189351 - DNA, 21 bp, Homo sapiens
taacaatttcctttatattta

SEQ ID NO: 4189352 - DNA, 17 bp, Homo sapiens
taacacaagtcctgtga

SEQ ID NO: 4189353 - DNA, 18 bp, Homo sapiens
taacacaagtcctgtgaa

SEQ ID NO: 4189354 - DNA, 14 bp, Homo sapiens
taacatatttacta

SEQ ID NO: 4189355 - DNA, 16 bp, Homo sapiens
taacatggaatttaat

SEQ ID NO: 4189356 - DNA, 21 bp, Homo sapiens
taacatggaatttaatttatg

SEQ ID NO: 4189357 - DNA, 23 bp, Homo sapiens
taacatggaatttaatttatgtg

SEQ ID NO: 4189358 - DNA, 17 bp, Homo sapiens
taacattaacatctatt

SEQ ID NO: 4189359 - DNA, 14 bp, Homo sapiens
taacattcacagcc

SEQ ID NO: 4189360 - DNA, 18 bp, Homo sapiens
taacatttgcaaaatgga

SEQ ID NO: 4189361 - DNA, 22 bp, Homo sapiens
taaccaagaaatactaatgtaa

SEQ ID NO: 4189362 - DNA, 19 bp, Homo sapiens
taaccactcctcaggaaca

SEQ ID NO: 4189363 - DNA, 22 bp, Homo sapiens
taaccagacacatactcatttt

SEQ ID NO: 4189364 - DNA, 15 bp, Homo sapiens
taaccctctcttccc

SEQ ID NO: 4189365 - DNA, 16 bp, Homo sapiens
taaccctctcttccct

SEQ ID NO: 4189366 - DNA, 19 bp, Homo sapiens
taaccctctcttccctatt

SEQ ID NO: 4189367 - DNA, 19 bp, Homo sapiens
taaccgcttctggggccac

SEQ ID NO: 4189368 - DNA, 22 bp, Homo sapiens
taacctaaatgatgttatagaa

SEQ ID NO: 4189369 - DNA, 22 bp, Homo sapiens
taacctatatgatttatagttt

SEQ ID NO: 4189370 - DNA, 13 bp, Homo sapiens
taactatgtgatg

SEQ ID NO: 4189371 - DNA, 19 bp, Homo sapiens
taactccagtgatgttctt

SEQ ID NO: 4189372 - DNA, 19 bp, Homo sapiens
taactcctgccattcttct

SEQ ID NO: 4189373 - DNA, 14 bp, Homo sapiens
taactctctttatg

SEQ ID NO: 4189374 - DNA, 19 bp, Homo sapiens
taactgggtaatgaaacaa

SEQ ID NO: 4189375 - DNA, 21 bp, Homo sapiens
taactggtagctataacttga

SEQ ID NO: 4189376 - DNA, 13 bp, Homo sapiens
taactggtataga

SEQ ID NO: 4189377 - DNA, 14 bp, Homo sapiens
taactgtgaaatac

SEQ ID NO: 4189378 - DNA, 18 bp, Homo sapiens
taacttcttaaaagttgt

SEQ ID NO: 4189379 - DNA, 16 bp, Homo sapiens
taacttctttgaagtt

SEQ ID NO: 4189380 - DNA, 17 bp, Homo sapiens
taacttggtcagagcca

SEQ ID NO: 4189381 - DNA, 21 bp, Homo sapiens
taacttggtcagagccactct

SEQ ID NO: 4189382 - DNA, 23 bp, Homo sapiens
taactttgtggtaacttctttga

SEQ ID NO: 4189383 - DNA, 19 bp, Homo sapiens
taagaaacttttttattta

SEQ ID NO: 4189384 - DNA, 21 bp, Homo sapiens
taagaaacttttttatttaaa

SEQ ID NO: 4189385 - DNA, 19 bp, Homo sapiens
taagaaagtgcagaatcaa

SEQ ID NO: 4189386 - DNA, 16 bp, Homo sapiens
taagaatcattgtgct

SEQ ID NO: 4189387 - DNA, 17 bp, Homo sapiens
taagaatggttgcctta

SEQ ID NO: 4189388 - DNA, 19 bp, Homo sapiens
taagaccataacagccaac

SEQ ID NO: 4189389 - DNA, 18 bp, Homo sapiens
taagagaagtagaaatca

SEQ ID NO: 4189390 - DNA, 16 bp, Homo sapiens
taagataaatagagtt

SEQ ID NO: 4189391 - DNA, 17 bp, Homo sapiens
taagattaaaggaagga

SEQ ID NO: 4189392 - DNA, 18 bp, Homo sapiens
taagattaaaggaaggaa

SEQ ID NO: 4189393 - DNA, 14 bp, Homo sapiens
taagcaggaaggat

SEQ ID NO: 4189394 - DNA, 21 bp, Homo sapiens
taagcatcttgtcaagaaata

SEQ ID NO: 4189395 - DNA, 19 bp, Homo sapiens
taaggaaatcaacttgctt

SEQ ID NO: 4189396 - DNA, 11 bp, Homo sapiens
taaggagaaga

SEQ ID NO: 4189397 - DNA, 21 bp, Homo sapiens
taaggcttaggtgccaggctg

SEQ ID NO: 4189398 - DNA, 21 bp, Homo sapiens
taagggaaggaactctggctt

SEQ ID NO: 4189399 - DNA, 19 bp, Homo sapiens
taaggtaatttctgtgtat

SEQ ID NO: 4189400 - DNA, 23 bp, Homo sapiens
taaggtaatttctgtgtattttg

SEQ ID NO: 4189401 - DNA, 20 bp, Homo sapiens
taaggtcttcttgtgtcctg

SEQ ID NO: 4189402 - DNA, 19 bp, Homo sapiens
taaggtgtagccacaccag

SEQ ID NO: 4189403 - DNA, 18 bp, Homo sapiens
taagtgatttttttgtcc

SEQ ID NO: 4189404 - DNA, 17 bp, Homo sapiens
taagttgaatggcctgc

SEQ ID NO: 4189405 - DNA, 12 bp, Homo sapiens
taagtttgatca

SEQ ID NO: 4189406 - DNA, 20 bp, Homo sapiens
taataaaagtactgaagacc

SEQ ID NO: 4189407 - DNA, 23 bp, Homo sapiens
taataaattttaacattttccaa

SEQ ID NO: 4189408 - DNA, 13 bp, Homo sapiens
taataagagtaaa

SEQ ID NO: 4189409 - DNA, 15 bp, Homo sapiens
taataataatgaatg

SEQ ID NO: 4189410 - DNA, 22 bp, Homo sapiens
taatacaacatgtagctgagtt

SEQ ID NO: 4189411 - DNA, 14 bp, Homo sapiens
taatactgctgaga

SEQ ID NO: 4189412 - DNA, 16 bp, Homo sapiens
taatagaaaactgaaa

SEQ ID NO: 4189413 - DNA, 19 bp, Homo sapiens
taatagaaaactgaaaatc

SEQ ID NO: 4189414 - DNA, 22 bp, Homo sapiens
taatagatgtttgatagatttt

SEQ ID NO: 4189415 - DNA, 21 bp, Homo sapiens
taatagcttttattgtataaa

SEQ ID NO: 4189416 - DNA, 17 bp, Homo sapiens
taatatatcccagaaat

SEQ ID NO: 4189417 - DNA, 12 bp, Homo sapiens
taatatatggaa

SEQ ID NO: 4189418 - DNA, 15 bp, Homo sapiens
taatatatggaagat

SEQ ID NO: 4189419 - DNA, 23 bp, Homo sapiens
taatatatggaagataattttat

SEQ ID NO: 4189420 - DNA, 16 bp, Homo sapiens
taatatattaggcact

SEQ ID NO: 4189421 - DNA, 12 bp, Homo sapiens
taatatattgct

SEQ ID NO: 4189422 - DNA, 20 bp, Homo sapiens
taatatccatacagtcaaga

SEQ ID NO: 4189423 - DNA, 17 bp, Homo sapiens
taatatcctaaacatca

SEQ ID NO: 4189424 - DNA, 13 bp, Homo sapiens
taatatgctctca

SEQ ID NO: 4189425 - DNA, 15 bp, Homo sapiens
taatatggcaaaaat

SEQ ID NO: 4189426 - DNA, 18 bp, Homo sapiens
taatattaaaaatatgga

SEQ ID NO: 4189427 - DNA, 14 bp, Homo sapiens
taatatttcaagtg

SEQ ID NO: 4189428 - DNA, 23 bp, Homo sapiens
taatatttttagctctgttcttt

SEQ ID NO: 4189429 - DNA, 13 bp, Homo sapiens
taatcaattctag

SEQ ID NO: 4189430 - DNA, 14 bp, Homo sapiens
taatcagcctctta

SEQ ID NO: 4189431 - DNA, 14 bp, Homo sapiens
taatccacagtatg

SEQ ID NO: 4189432 - DNA, 13 bp, Homo sapiens
taatctccacagt

SEQ ID NO: 4189433 - DNA, 19 bp, Homo sapiens
taatggaaaacatttacat

SEQ ID NO: 4189434 - DNA, 17 bp, Homo sapiens
taatggcatgagaaata

SEQ ID NO: 4189435 - DNA, 22 bp, Homo sapiens
taatggctgataattttaaatt

SEQ ID NO: 4189436 - DNA, 14 bp, Homo sapiens
taatgtaagaaaat

SEQ ID NO: 4189437 - DNA, 12 bp, Homo sapiens
taattaaatata

SEQ ID NO: 4189438 - DNA, 16 bp, Homo sapiens
taattaaatatatcac

SEQ ID NO: 4189439 - DNA, 13 bp, Homo sapiens
taattaacatatc

SEQ ID NO: 4189440 - DNA, 14 bp, Homo sapiens
taattaatgtgtgt

SEQ ID NO: 4189441 - DNA, 23 bp, Homo sapiens
taattaatgtgtgtctgaagact

SEQ ID NO: 4189442 - DNA, 15 bp, Homo sapiens
taattagaaacgtga

SEQ ID NO: 4189443 - DNA, 21 bp, Homo sapiens
taattagaaacgtgataaata

SEQ ID NO: 4189444 - DNA, 15 bp, Homo sapiens
taattcacctcttct

SEQ ID NO: 4189445 - DNA, 17 bp, Homo sapiens
taattcacctcttcttt

SEQ ID NO: 4189446 - DNA, 14 bp, Homo sapiens
taattgctttgcca

SEQ ID NO: 4189447 - DNA, 23 bp, Homo sapiens
taattgtactaaagccaaacata

SEQ ID NO: 4189448 - DNA, 15 bp, Homo sapiens
taatttaaaaaataa

SEQ ID NO: 4189449 - DNA, 17 bp, Homo sapiens
taatttagaaaacttta

SEQ ID NO: 4189450 - DNA, 15 bp, Homo sapiens
taatttagaaatcat

SEQ ID NO: 4189451 - DNA, 21 bp, Homo sapiens
taatttatactggtaacttat

SEQ ID NO: 4189452 - DNA, 13 bp, Homo sapiens
taatttatgtgaa

SEQ ID NO: 4189453 - DNA, 19 bp, Homo sapiens
taatttatttagtttttaa

SEQ ID NO: 4189454 - DNA, 18 bp, Homo sapiens
taattttaaaagttggga

SEQ ID NO: 4189455 - DNA, 21 bp, Homo sapiens
taatttttgatactaagcatt

SEQ ID NO: 4189456 - DNA, 23 bp, Homo sapiens
taatttttgatactaagcattga

SEQ ID NO: 4189457 - DNA, 23 bp, Homo sapiens
taatttttttgtaaaggaaataa

SEQ ID NO: 4189458 - DNA, 15 bp, Homo sapiens
tacaaaaacaaaaca

SEQ ID NO: 4189459 - DNA, 18 bp, Homo sapiens
tacaaaaacaaaacaaaa

SEQ ID NO: 4189460 - DNA, 22 bp, Homo sapiens
tacaaaaatagtagaacaagca

SEQ ID NO: 4189461 - DNA, 22 bp, Homo sapiens
tacaaaaattagccgggggtgg

SEQ ID NO: 4189462 - DNA, 10 bp, Homo sapiens
tacaaaatgg

SEQ ID NO: 4189463 - DNA, 11 bp, Homo sapiens
tacaaaatgga

SEQ ID NO: 4189464 - DNA, 15 bp, Homo sapiens
tacaacaagaacaac

SEQ ID NO: 4189465 - DNA, 16 bp, Homo sapiens
tacaataataaatcct

SEQ ID NO: 4189466 - DNA, 20 bp, Homo sapiens
tacacaacatttatttcaaa

SEQ ID NO: 4189467 - DNA, 19 bp, Homo sapiens
tacactaacatatttagaa

SEQ ID NO: 4189468 - DNA, 15 bp, Homo sapiens
tacactccagcctga

SEQ ID NO: 4189469 - DNA, 22 bp, Homo sapiens
tacacttaagcagagcagaact

SEQ ID NO: 4189470 - DNA, 15 bp, Homo sapiens
tacagacatgagcca

SEQ ID NO: 4189471 - DNA, 15 bp, Homo sapiens
tacagacgtctcaag

SEQ ID NO: 4189472 - DNA, 22 bp, Homo sapiens
tacagacgtctcaagactgaaa

SEQ ID NO: 4189473 - DNA, 15 bp, Homo sapiens
tacagacttctccag

SEQ ID NO: 4189474 - DNA, 18 bp, Homo sapiens
tacagagaaattctgtgg

SEQ ID NO: 4189475 - DNA, 11 bp, Homo sapiens
tacagcagggt

SEQ ID NO: 4189476 - DNA, 18 bp, Homo sapiens
tacaggcgggaggggcag

SEQ ID NO: 4189477 - DNA, 14 bp, Homo sapiens
tacaggtggttttt

SEQ ID NO: 4189478 - DNA, 14 bp, Homo sapiens
tacagtcaatttta

SEQ ID NO: 4189479 - DNA, 16 bp, Homo sapiens
tacagtgaatttctga

SEQ ID NO: 4189480 - DNA, 23 bp, Homo sapiens
tacagtgaatttctgatttcact

SEQ ID NO: 4189481 - DNA, 14 bp, Homo sapiens
tacagtgagccaag

SEQ ID NO: 4189482 - DNA, 16 bp, Homo sapiens
tacagttaactttcta

SEQ ID NO: 4189483 - DNA, 20 bp, Homo sapiens
tacagttatgcatcctgtat

SEQ ID NO: 4189484 - DNA, 22 bp, Homo sapiens
tacagttcagttcctctttgca

SEQ ID NO: 4189485 - DNA, 12 bp, Homo sapiens
tacataatggaa

SEQ ID NO: 4189486 - DNA, 18 bp, Homo sapiens
tacatacgtgttctatag

SEQ ID NO: 4189487 - DNA, 17 bp, Homo sapiens
tacatatggaaatatag

SEQ ID NO: 4189488 - DNA, 23 bp, Homo sapiens
tacatcaaatcccacttacttta

SEQ ID NO: 4189489 - DNA, 14 bp, Homo sapiens
tacatccagaaaga

SEQ ID NO: 4189490 - DNA, 11 bp, Homo sapiens
tacatgaacac

SEQ ID NO: 4189491 - DNA, 16 bp, Homo sapiens
tacatgcaatttatta

SEQ ID NO: 4189492 - DNA, 19 bp, Homo sapiens
tacatgcaatttattaaaa

SEQ ID NO: 4189493 - DNA, 20 bp, Homo sapiens
tacatgcaatttattaaaat

SEQ ID NO: 4189494 - DNA, 22 bp, Homo sapiens
tacatgcaatttattaaaatga

SEQ ID NO: 4189495 - DNA, 14 bp, Homo sapiens
tacattaagtgggg

SEQ ID NO: 4189496 - DNA, 18 bp, Homo sapiens
tacattaagtggggtaga

SEQ ID NO: 4189497 - DNA, 17 bp, Homo sapiens
tacattcataaggaaat

SEQ ID NO: 4189498 - DNA, 23 bp, Homo sapiens
tacattctcatctactcattgtc

SEQ ID NO: 4189499 - DNA, 16 bp, Homo sapiens
tacattttacatatgg

SEQ ID NO: 4189500 - DNA, 14 bp, Homo sapiens
taccaactttctgt

SEQ ID NO: 4189501 - DNA, 15 bp, Homo sapiens
taccaactttctgta

SEQ ID NO: 4189502 - DNA, 22 bp, Homo sapiens
taccaaggataattaaatatat

SEQ ID NO: 4189503 - DNA, 13 bp, Homo sapiens
taccaccttccct

SEQ ID NO: 4189504 - DNA, 20 bp, Homo sapiens
taccaccttccctctttcta

SEQ ID NO: 4189505 - DNA, 14 bp, Homo sapiens
taccactcaggcca

SEQ ID NO: 4189506 - DNA, 18 bp, Homo sapiens
taccagagccttcaagtg

SEQ ID NO: 4189507 - DNA, 21 bp, Homo sapiens
taccagagccttcaagtgcca

SEQ ID NO: 4189508 - DNA, 22 bp, Homo sapiens
taccagatagttatattaaatt

SEQ ID NO: 4189509 - DNA, 18 bp, Homo sapiens
taccaggcaccaaaagaa

SEQ ID NO: 4189510 - DNA, 20 bp, Homo sapiens
taccatcactgagttttcca

SEQ ID NO: 4189511 - DNA, 16 bp, Homo sapiens
taccatgaattcttga

SEQ ID NO: 4189512 - DNA, 17 bp, Homo sapiens
taccatgaattcttgag

SEQ ID NO: 4189513 - DNA, 12 bp, Homo sapiens
taccatttgtgt

SEQ ID NO: 4189514 - DNA, 13 bp, Homo sapiens
tacccaaatatgt

SEQ ID NO: 4189515 - DNA, 13 bp, Homo sapiens
tacccagagcatt

SEQ ID NO: 4189516 - DNA, 21 bp, Homo sapiens
tacccaggaggctgaggcagg

SEQ ID NO: 4189517 - DNA, 19 bp, Homo sapiens
taccccaagtccacctgcc

SEQ ID NO: 4189518 - DNA, 18 bp, Homo sapiens
taccccacctcatgcctg

SEQ ID NO: 4189519 - DNA, 20 bp, Homo sapiens
taccccacctcatgcctggc

SEQ ID NO: 4189520 - DNA, 12 bp, Homo sapiens
taccctgggctc

SEQ ID NO: 4189521 - DNA, 12 bp, Homo sapiens
taccctggtgga

SEQ ID NO: 4189522 - DNA, 20 bp, Homo sapiens
taccgctcccctctcctccg

SEQ ID NO: 4189523 - DNA, 23 bp, Homo sapiens
tacctaggatgcatgacaattgt

SEQ ID NO: 4189524 - DNA, 16 bp, Homo sapiens
tacctatgtgacagac

SEQ ID NO: 4189525 - DNA, 14 bp, Homo sapiens
tacctcgaggctct

SEQ ID NO: 4189526 - DNA, 17 bp, Homo sapiens
tacctgtcctagcagga

SEQ ID NO: 4189527 - DNA, 13 bp, Homo sapiens
tacctgttgagca

SEQ ID NO: 4189528 - DNA, 18 bp, Homo sapiens
taccttccacttccatgt

SEQ ID NO: 4189529 - DNA, 23 bp, Homo sapiens
tacgcactacatgtggtttatag

SEQ ID NO: 4189530 - DNA, 13 bp, Homo sapiens
tacgctggtctgg

SEQ ID NO: 4189531 - DNA, 13 bp, Homo sapiens
tacggctgctgca

SEQ ID NO: 4189532 - DNA, 14 bp, Homo sapiens
tacgtgagccaggt

SEQ ID NO: 4189533 - DNA, 14 bp, Homo sapiens
tacgtgtgtgaagt

SEQ ID NO: 4189534 - DNA, 14 bp, Homo sapiens
tactaaagagacat

SEQ ID NO: 4189535 - DNA, 14 bp, Homo sapiens
tactaaagccaaac

SEQ ID NO: 4189536 - DNA, 20 bp, Homo sapiens
tactaagcattgaatggcta

SEQ ID NO: 4189537 - DNA, 18 bp, Homo sapiens
tactaccctgggctctgg

SEQ ID NO: 4189538 - DNA, 14 bp, Homo sapiens
tactatacaacaat

SEQ ID NO: 4189539 - DNA, 14 bp, Homo sapiens
tactatctgtgaag

SEQ ID NO: 4189540 - DNA, 19 bp, Homo sapiens
tactcagcagtaagcaggc

SEQ ID NO: 4189541 - DNA, 12 bp, Homo sapiens
tactcattgtct

SEQ ID NO: 4189542 - DNA, 21 bp, Homo sapiens
tactccagcctgggcgacaga

SEQ ID NO: 4189543 - DNA, 19 bp, Homo sapiens
tactccagtggtgaagaaa

SEQ ID NO: 4189544 - DNA, 14 bp, Homo sapiens
tactcctacctcag

SEQ ID NO: 4189545 - DNA, 17 bp, Homo sapiens
tactcctacctcagcct

SEQ ID NO: 4189546 - DNA, 15 bp, Homo sapiens
tactctgtcagatgg

SEQ ID NO: 4189547 - DNA, 15 bp, Homo sapiens
tactgaacccagagt

SEQ ID NO: 4189548 - DNA, 18 bp, Homo sapiens
tactgaacccagagtcag

SEQ ID NO: 4189549 - DNA, 22 bp, Homo sapiens
tactgaacccagagtcaggaag

SEQ ID NO: 4189550 - DNA, 14 bp, Homo sapiens
tactgatccctttc

SEQ ID NO: 4189551 - DNA, 20 bp, Homo sapiens
tactgattaacaaataaatt

SEQ ID NO: 4189552 - DNA, 13 bp, Homo sapiens
tactgattctcct

SEQ ID NO: 4189553 - DNA, 23 bp, Homo sapiens
tactgattctcctgtcagagatc

SEQ ID NO: 4189554 - DNA, 21 bp, Homo sapiens
tactgcaaggttcaacttatt

SEQ ID NO: 4189555 - DNA, 13 bp, Homo sapiens
tactgcaataaat

SEQ ID NO: 4189556 - DNA, 15 bp, Homo sapiens
tactgcagctttaca

SEQ ID NO: 4189557 - DNA, 22 bp, Homo sapiens
tactgcagctttacatgcaatt

SEQ ID NO: 4189558 - DNA, 20 bp, Homo sapiens
tactgctgagatacatacag

SEQ ID NO: 4189559 - DNA, 19 bp, Homo sapiens
tactggtgatttctgagat

SEQ ID NO: 4189560 - DNA, 14 bp, Homo sapiens
tactgtacttaata

SEQ ID NO: 4189561 - DNA, 19 bp, Homo sapiens
tactgtctggttttaacaa

SEQ ID NO: 4189562 - DNA, 20 bp, Homo sapiens
tactgtctggttttaacaat

SEQ ID NO: 4189563 - DNA, 22 bp, Homo sapiens
tacttacaaactgcggtataca

SEQ ID NO: 4189564 - DNA, 11 bp, Homo sapiens
tacttcatgag

SEQ ID NO: 4189565 - DNA, 23 bp, Homo sapiens
tacttcccattttggaagttttc

SEQ ID NO: 4189566 - DNA, 16 bp, Homo sapiens
tacttgctcaggtact

SEQ ID NO: 4189567 - DNA, 20 bp, Homo sapiens
tactttaatttttataaata

SEQ ID NO: 4189568 - DNA, 21 bp, Homo sapiens
tactttaatttttataaatat

SEQ ID NO: 4189569 - DNA, 18 bp, Homo sapiens
tactttgcaatccaaata

SEQ ID NO: 4189570 - DNA, 19 bp, Homo sapiens
tactttgccttttgcaaac

SEQ ID NO: 4189571 - DNA, 16 bp, Homo sapiens
tactttggcaatttcc

SEQ ID NO: 4189572 - DNA, 17 bp, Homo sapiens
tactttggcaatttcct

SEQ ID NO: 4189573 - DNA, 20 bp, Homo sapiens
tacttttgttctgtattttc

SEQ ID NO: 4189574 - DNA, 14 bp, Homo sapiens
tactttttttcaca

SEQ ID NO: 4189575 - DNA, 13 bp, Homo sapiens
tagaaaactgaaa

SEQ ID NO: 4189576 - DNA, 15 bp, Homo sapiens
tagaaaactgaaaat

SEQ ID NO: 4189577 - DNA, 12 bp, Homo sapiens
tagaaacaaagg

SEQ ID NO: 4189578 - DNA, 22 bp, Homo sapiens
tagaaacgtgataaatatatgg

SEQ ID NO: 4189579 - DNA, 13 bp, Homo sapiens
tagaaagaaaatg

SEQ ID NO: 4189580 - DNA, 14 bp, Homo sapiens
tagaaagaaaatgt

SEQ ID NO: 4189581 - DNA, 16 bp, Homo sapiens
tagaaatatcctttgg

SEQ ID NO: 4189582 - DNA, 13 bp, Homo sapiens
tagaaatcatttt

SEQ ID NO: 4189583 - DNA, 17 bp, Homo sapiens
tagaaatcattttgcaa

SEQ ID NO: 4189584 - DNA, 20 bp, Homo sapiens
tagaaattttttcatgcaca

SEQ ID NO: 4189585 - DNA, 19 bp, Homo sapiens
tagaactgtatgtcagaca

SEQ ID NO: 4189586 - DNA, 12 bp, Homo sapiens
tagaacttcaaa

SEQ ID NO: 4189587 - DNA, 22 bp, Homo sapiens
tagaacttcaaaatgttcgtat

SEQ ID NO: 4189588 - DNA, 15 bp, Homo sapiens
tagaactttgtgcca

SEQ ID NO: 4189589 - DNA, 20 bp, Homo sapiens
tagaagacaattgacaacag

SEQ ID NO: 4189590 - DNA, 10 bp, Homo sapiens
tagaagccag

SEQ ID NO: 4189591 - DNA, 19 bp, Homo sapiens
tagaagcgctcatctggct

SEQ ID NO: 4189592 - DNA, 14 bp, Homo sapiens
tagaataaaattgt

SEQ ID NO: 4189593 - DNA, 15 bp, Homo sapiens
tagaataaaattgta

SEQ ID NO: 4189594 - DNA, 18 bp, Homo sapiens
tagaatagccatgtacta

SEQ ID NO: 4189595 - DNA, 18 bp, Homo sapiens
tagaatgatttttgctat

SEQ ID NO: 4189596 - DNA, 20 bp, Homo sapiens
tagaatgtgttttctgaata

SEQ ID NO: 4189597 - DNA, 22 bp, Homo sapiens
tagaattatttttgagcaggag

SEQ ID NO: 4189598 - DNA, 17 bp, Homo sapiens
tagaattgagtgtttaa

SEQ ID NO: 4189599 - DNA, 19 bp, Homo sapiens
tagaattgagtgtttaaag

SEQ ID NO: 4189600 - DNA, 23 bp, Homo sapiens
tagaatttgtattttgcttaaaa

SEQ ID NO: 4189601 - DNA, 14 bp, Homo sapiens
tagacaagccagaa

SEQ ID NO: 4189602 - DNA, 15 bp, Homo sapiens
tagacaagccagaac

SEQ ID NO: 4189603 - DNA, 19 bp, Homo sapiens
tagacaagccagaacttga

SEQ ID NO: 4189604 - DNA, 15 bp, Homo sapiens
tagacaaggaccagg

SEQ ID NO: 4189605 - DNA, 14 bp, Homo sapiens
tagacactgggaga

SEQ ID NO: 4189606 - DNA, 15 bp, Homo sapiens
tagacactgggagaa

SEQ ID NO: 4189607 - DNA, 17 bp, Homo sapiens
tagacactgggagaaga

SEQ ID NO: 4189608 - DNA, 20 bp, Homo sapiens
tagacactgggagaagagaa

SEQ ID NO: 4189609 - DNA, 21 bp, Homo sapiens
tagacactgggagaagagaac

SEQ ID NO: 4189610 - DNA, 22 bp, Homo sapiens
tagacactgggagaagagaacc

SEQ ID NO: 4189611 - DNA, 14 bp, Homo sapiens
tagacagtgctgcc

SEQ ID NO: 4189612 - DNA, 16 bp, Homo sapiens
tagacagtgctgccct

SEQ ID NO: 4189613 - DNA, 14 bp, Homo sapiens
tagactgaagagac

SEQ ID NO: 4189614 - DNA, 14 bp, Homo sapiens
tagactgtgtatgt

SEQ ID NO: 4189615 - DNA, 19 bp, Homo sapiens
tagactgttactttggcaa

SEQ ID NO: 4189616 - DNA, 19 bp, Homo sapiens
tagactttctcagtgggac

SEQ ID NO: 4189617 - DNA, 18 bp, Homo sapiens
tagagactggaacactag

SEQ ID NO: 4189618 - DNA, 13 bp, Homo sapiens
tagagaggaaaag

SEQ ID NO: 4189619 - DNA, 14 bp, Homo sapiens
tagagaggaaaagc

SEQ ID NO: 4189620 - DNA, 18 bp, Homo sapiens
tagagaggtagcgagctg

SEQ ID NO: 4189621 - DNA, 17 bp, Homo sapiens
tagagatgactgagtcc

SEQ ID NO: 4189622 - DNA, 20 bp, Homo sapiens
tagagcacctagtccagtga

SEQ ID NO: 4189623 - DNA, 17 bp, Homo sapiens
tagagcactgccaccag

SEQ ID NO: 4189624 - DNA, 20 bp, Homo sapiens
tagagggagaggaagcacac

SEQ ID NO: 4189625 - DNA, 23 bp, Homo sapiens
tagaggtaccagcaatatgtaaa

SEQ ID NO: 4189626 - DNA, 13 bp, Homo sapiens
tagaggtttgtca

SEQ ID NO: 4189627 - DNA, 14 bp, Homo sapiens
tagagtcagccttc

SEQ ID NO: 4189628 - DNA, 12 bp, Homo sapiens
tagatcatggca

SEQ ID NO: 4189629 - DNA, 18 bp, Homo sapiens
tagatcatggcagcatga

SEQ ID NO: 4189630 - DNA, 16 bp, Homo sapiens
tagatctggcatgtta

SEQ ID NO: 4189631 - DNA, 20 bp, Homo sapiens
tagatgggtctggctgagct

SEQ ID NO: 4189632 - DNA, 14 bp, Homo sapiens
tagatggtgaaatt

SEQ ID NO: 4189633 - DNA, 17 bp, Homo sapiens
tagatgttactgtgtga

SEQ ID NO: 4189634 - DNA, 21 bp, Homo sapiens
tagattgagaagttttgtaca

SEQ ID NO: 4189635 - DNA, 14 bp, Homo sapiens
tagcaaaagaagaa

SEQ ID NO: 4189636 - DNA, 17 bp, Homo sapiens
tagcaaagcaaaaggct

SEQ ID NO: 4189637 - DNA, 16 bp, Homo sapiens
tagcaaggtccaggca

SEQ ID NO: 4189638 - DNA, 18 bp, Homo sapiens
tagcaagttctagagaag

SEQ ID NO: 4189639 - DNA, 23 bp, Homo sapiens
tagcacaggttagggtgtgtgcc

SEQ ID NO: 4189640 - DNA, 22 bp, Homo sapiens
tagcacatgtctgtcctcagag

SEQ ID NO: 4189641 - DNA, 19 bp, Homo sapiens
tagcagaaaatataaatgg

SEQ ID NO: 4189642 - DNA, 16 bp, Homo sapiens
tagcagaagtgaccaa

SEQ ID NO: 4189643 - DNA, 19 bp, Homo sapiens
tagcagaggaaaaagaaaa

SEQ ID NO: 4189644 - DNA, 20 bp, Homo sapiens
tagcagaggaaaaagaaaaa

SEQ ID NO: 4189645 - DNA, 21 bp, Homo sapiens
tagcattcagggttatacaca

SEQ ID NO: 4189646 - DNA, 14 bp, Homo sapiens
tagcatttttgatt

SEQ ID NO: 4189647 - DNA, 16 bp, Homo sapiens
tagccaaaaatagcta

SEQ ID NO: 4189648 - DNA, 21 bp, Homo sapiens
tagccaaaaatagctaaatac

SEQ ID NO: 4189649 - DNA, 20 bp, Homo sapiens
tagccaaggtgggctgagcc

SEQ ID NO: 4189650 - DNA, 23 bp, Homo sapiens
tagccaaggtgggctgagccctg

SEQ ID NO: 4189651 - DNA, 14 bp, Homo sapiens
tagccacaccagga

SEQ ID NO: 4189652 - DNA, 19 bp, Homo sapiens
tagccacatccctttgaaa

SEQ ID NO: 4189653 - DNA, 18 bp, Homo sapiens
tagccaggatggtctgga

SEQ ID NO: 4189654 - DNA, 18 bp, Homo sapiens
tagcccatctctccagag

SEQ ID NO: 4189655 - DNA, 22 bp, Homo sapiens
tagcccatctctccagagagca

SEQ ID NO: 4189656 - DNA, 13 bp, Homo sapiens
tagccctccctgg

SEQ ID NO: 4189657 - DNA, 14 bp, Homo sapiens
tagccctttctgtg

SEQ ID NO: 4189658 - DNA, 22 bp, Homo sapiens
tagcctaagtgtggagaaggat

SEQ ID NO: 4189659 - DNA, 20 bp, Homo sapiens
tagcctaatacaacatgtag

SEQ ID NO: 4189660 - DNA, 12 bp, Homo sapiens
tagcctcagcca

SEQ ID NO: 4189661 - DNA, 13 bp, Homo sapiens
tagcctcagccac

SEQ ID NO: 4189662 - DNA, 17 bp, Homo sapiens
tagcctcctgacctgag

SEQ ID NO: 4189663 - DNA, 21 bp, Homo sapiens
tagccttgccttttaaaagaa

SEQ ID NO: 4189664 - DNA, 22 bp, Homo sapiens
tagccttgccttttaaaagaaa

SEQ ID NO: 4189665 - DNA, 17 bp, Homo sapiens
tagctaaacattgtgat

SEQ ID NO: 4189666 - DNA, 14 bp, Homo sapiens
tagctatcagaaga

SEQ ID NO: 4189667 - DNA, 11 bp, Homo sapiens
tagctgaggga

SEQ ID NO: 4189668 - DNA, 11 bp, Homo sapiens
tagctggagaa

SEQ ID NO: 4189669 - DNA, 13 bp, Homo sapiens
tagctggagaact

SEQ ID NO: 4189670 - DNA, 14 bp, Homo sapiens
tagctgggactaca

SEQ ID NO: 4189671 - DNA, 21 bp, Homo sapiens
tagcttacagtcaattttaca

SEQ ID NO: 4189672 - DNA, 15 bp, Homo sapiens
tagcttgttccctgt

SEQ ID NO: 4189673 - DNA, 13 bp, Homo sapiens
tagctttcctggt

SEQ ID NO: 4189674 - DNA, 14 bp, Homo sapiens
tagctttcctggtc

SEQ ID NO: 4189675 - DNA, 14 bp, Homo sapiens
tagcttttattgta

SEQ ID NO: 4189676 - DNA, 13 bp, Homo sapiens
taggaaaatgtac

SEQ ID NO: 4189677 - DNA, 24 bp, Homo sapiens
taggaaacccaaggaacaagagaa

SEQ ID NO: 4189678 - DNA, 20 bp, Homo sapiens
taggaaataaaacctttcaa

SEQ ID NO: 4189679 - DNA, 22 bp, Homo sapiens
taggaacagctcttcactcagc

SEQ ID NO: 4189680 - DNA, 17 bp, Homo sapiens
taggaagaaaaatgttt

SEQ ID NO: 4189681 - DNA, 13 bp, Homo sapiens
taggaagaaatca

SEQ ID NO: 4189682 - DNA, 19 bp, Homo sapiens
taggaagaaatcacttaaa

SEQ ID NO: 4189683 - DNA, 21 bp, Homo sapiens
taggaagattaaaaccacaga

SEQ ID NO: 4189684 - DNA, 14 bp, Homo sapiens
taggaaggaaaaaa

SEQ ID NO: 4189685 - DNA, 17 bp, Homo sapiens
taggaaggaaaaaataa

SEQ ID NO: 4189686 - DNA, 20 bp, Homo sapiens
taggaggaaaagacagagcc

SEQ ID NO: 4189687 - DNA, 16 bp, Homo sapiens
taggagggaaggagct

SEQ ID NO: 4189688 - DNA, 13 bp, Homo sapiens
taggatagcattt

SEQ ID NO: 4189689 - DNA, 17 bp, Homo sapiens
taggatggttctgtgac

SEQ ID NO: 4189690 - DNA, 13 bp, Homo sapiens
taggatgtttttc

SEQ ID NO: 4189691 - DNA, 13 bp, Homo sapiens
taggattaattta

SEQ ID NO: 4189692 - DNA, 15 bp, Homo sapiens
taggattaatttatt

SEQ ID NO: 4189693 - DNA, 16 bp, Homo sapiens
taggatttatttaaaa

SEQ ID NO: 4189694 - DNA, 17 bp, Homo sapiens
taggatttatttaaaat

SEQ ID NO: 4189695 - DNA, 22 bp, Homo sapiens
taggattttttttaatgtttaa

SEQ ID NO: 4189696 - DNA, 12 bp, Homo sapiens
taggcaacatag

SEQ ID NO: 4189697 - DNA, 12 bp, Homo sapiens
taggcaagagaa

SEQ ID NO: 4189698 - DNA, 18 bp, Homo sapiens
taggcagacgtggggagg

SEQ ID NO: 4189699 - DNA, 22 bp, Homo sapiens
taggcagactctttatgcttgc

SEQ ID NO: 4189700 - DNA, 13 bp, Homo sapiens
taggcagagcctt

SEQ ID NO: 4189701 - DNA, 16 bp, Homo sapiens
taggcagagcctttgg

SEQ ID NO: 4189702 - DNA, 16 bp, Homo sapiens
taggcagcttctctgt

SEQ ID NO: 4189703 - DNA, 17 bp, Homo sapiens
taggcagggatttgagg

SEQ ID NO: 4189704 - DNA, 14 bp, Homo sapiens
taggcgagtgccag

SEQ ID NO: 4189705 - DNA, 22 bp, Homo sapiens
taggctgcccaatctgagcaaa

SEQ ID NO: 4189706 - DNA, 15 bp, Homo sapiens
taggctgctgggaga

SEQ ID NO: 4189707 - DNA, 16 bp, Homo sapiens
taggctgctgggagat

SEQ ID NO: 4189708 - DNA, 12 bp, Homo sapiens
taggctggagaa

SEQ ID NO: 4189709 - DNA, 17 bp, Homo sapiens
taggctggagaagctca

SEQ ID NO: 4189710 - DNA, 21 bp, Homo sapiens
taggctgtggggtctggctgt

SEQ ID NO: 4189711 - DNA, 17 bp, Homo sapiens
taggggaagtatgtgtg

SEQ ID NO: 4189712 - DNA, 17 bp, Homo sapiens
taggtattaaagatgtg

SEQ ID NO: 4189713 - DNA, 18 bp, Homo sapiens
taggtattaaagatgtgt

SEQ ID NO: 4189714 - DNA, 23 bp, Homo sapiens
taggtcatgatttctgtgaagca

SEQ ID NO: 4189715 - DNA, 23 bp, Homo sapiens
taggtgaaaacagcccaggtcct

SEQ ID NO: 4189716 - DNA, 12 bp, Homo sapiens
taggtttgtcaa

SEQ ID NO: 4189717 - DNA, 14 bp, Homo sapiens
taggtttgtcaaca

SEQ ID NO: 4189718 - DNA, 15 bp, Homo sapiens
taggtttgtcaacac

SEQ ID NO: 4189719 - DNA, 21 bp, Homo sapiens
tagtaaatcacgctttttgaa

SEQ ID NO: 4189720 - DNA, 19 bp, Homo sapiens
tagtaaatggtatcatttg

SEQ ID NO: 4189721 - DNA, 24 bp, Homo sapiens
tagtaatttattgtctgtctacat

SEQ ID NO: 4189722 - DNA, 14 bp, Homo sapiens
tagtagaaagaaaa

SEQ ID NO: 4189723 - DNA, 19 bp, Homo sapiens
tagtagcggatctcactca

SEQ ID NO: 4189724 - DNA, 13 bp, Homo sapiens
tagtatctctggc

SEQ ID NO: 4189725 - DNA, 14 bp, Homo sapiens
tagtatctctggcc

SEQ ID NO: 4189726 - DNA, 18 bp, Homo sapiens
tagtcaatcaagtctgtt

SEQ ID NO: 4189727 - DNA, 21 bp, Homo sapiens
tagtcaatcaagtctgtttac

SEQ ID NO: 4189728 - DNA, 22 bp, Homo sapiens
tagtcatagaaatacctcattc

SEQ ID NO: 4189729 - DNA, 21 bp, Homo sapiens
tagtcccagctactcagaagc

SEQ ID NO: 4189730 - DNA, 17 bp, Homo sapiens
tagtcttgctttgctgt

SEQ ID NO: 4189731 - DNA, 14 bp, Homo sapiens
tagtgacttcctgg

SEQ ID NO: 4189732 - DNA, 13 bp, Homo sapiens
tagtgcacacttg

SEQ ID NO: 4189733 - DNA, 23 bp, Homo sapiens
tagtgccctccacagccgcagcc

SEQ ID NO: 4189734 - DNA, 19 bp, Homo sapiens
tagttaaatagctatattt

SEQ ID NO: 4189735 - DNA, 18 bp, Homo sapiens
tagttaggaaataaaacc

SEQ ID NO: 4189736 - DNA, 21 bp, Homo sapiens
tagttattgttttatgttcta

SEQ ID NO: 4189737 - DNA, 21 bp, Homo sapiens
tagttcaccccttatcctgag

SEQ ID NO: 4189738 - DNA, 17 bp, Homo sapiens
tagttcagaggaagcac

SEQ ID NO: 4189739 - DNA, 13 bp, Homo sapiens
tagtttggcacat

SEQ ID NO: 4189740 - DNA, 18 bp, Homo sapiens
tagtttggcacatgcagg

SEQ ID NO: 4189741 - DNA, 17 bp, Homo sapiens
tagtttgtacatgcatt

SEQ ID NO: 4189742 - DNA, 14 bp, Homo sapiens
tagtttgtataact

SEQ ID NO: 4189743 - DNA, 17 bp, Homo sapiens
tagtttgtataacttct

SEQ ID NO: 4189744 - DNA, 22 bp, Homo sapiens
tagtttttaacaatctaacaat

SEQ ID NO: 4189745 - DNA, 13 bp, Homo sapiens
tataaaaagtgaa

SEQ ID NO: 4189746 - DNA, 17 bp, Homo sapiens
tataaaaagtgaaataa

SEQ ID NO: 4189747 - DNA, 14 bp, Homo sapiens
tataaaaatgtgaa

SEQ ID NO: 4189748 - DNA, 16 bp, Homo sapiens
tataaaactgctttgt

SEQ ID NO: 4189749 - DNA, 16 bp, Homo sapiens
tataaaagacaaaact

SEQ ID NO: 4189750 - DNA, 19 bp, Homo sapiens
tataaaaggtgagctcagc

SEQ ID NO: 4189751 - DNA, 12 bp, Homo sapiens
tataaaataggc

SEQ ID NO: 4189752 - DNA, 18 bp, Homo sapiens
tataaaatatatttatga

SEQ ID NO: 4189753 - DNA, 15 bp, Homo sapiens
tataaactttagagt

SEQ ID NO: 4189754 - DNA, 14 bp, Homo sapiens
tataaatatgtgaa

SEQ ID NO: 4189755 - DNA, 14 bp, Homo sapiens
tataacttctgaag

SEQ ID NO: 4189756 - DNA, 15 bp, Homo sapiens
tataacttcttaaaa

SEQ ID NO: 4189757 - DNA, 16 bp, Homo sapiens
tataacttcttaaaag

SEQ ID NO: 4189758 - DNA, 19 bp, Homo sapiens
tataagaggactgtagttt

SEQ ID NO: 4189759 - DNA, 22 bp, Homo sapiens
tataagcaagaaggcaaaaata

SEQ ID NO: 4189760 - DNA, 18 bp, Homo sapiens
tataagctatttatgtaa

SEQ ID NO: 4189761 - DNA, 14 bp, Homo sapiens
tataagctgaaatt

SEQ ID NO: 4189762 - DNA, 21 bp, Homo sapiens
tataatactaaaatgtaactt

SEQ ID NO: 4189763 - DNA, 15 bp, Homo sapiens
tataatttaacagtg

SEQ ID NO: 4189764 - DNA, 20 bp, Homo sapiens
tatacaggtggtttttggtt

SEQ ID NO: 4189765 - DNA, 14 bp, Homo sapiens
tatacataataaag

SEQ ID NO: 4189766 - DNA, 18 bp, Homo sapiens
tatacatgtttagtatta

SEQ ID NO: 4189767 - DNA, 22 bp, Homo sapiens
tatactaaaaaatgtctataga

SEQ ID NO: 4189768 - DNA, 17 bp, Homo sapiens
tatactctctgaaatat

SEQ ID NO: 4189769 - DNA, 16 bp, Homo sapiens
tatactgtacttaata

SEQ ID NO: 4189770 - DNA, 13 bp, Homo sapiens
tatagaaagcact

SEQ ID NO: 4189771 - DNA, 13 bp, Homo sapiens
tatagcaatccat

SEQ ID NO: 4189772 - DNA, 18 bp, Homo sapiens
tatagccaaaaatagcta

SEQ ID NO: 4189773 - DNA, 22 bp, Homo sapiens
tatagctattactgtctggttt

SEQ ID NO: 4189774 - DNA, 13 bp, Homo sapiens
tatagctcatcac

SEQ ID NO: 4189775 - DNA, 17 bp, Homo sapiens
tatagctctcatcacta

SEQ ID NO: 4189776 - DNA, 19 bp, Homo sapiens
tataggcagtagactcatc

SEQ ID NO: 4189777 - DNA, 10 bp, Homo sapiens
tataggtcat

SEQ ID NO: 4189778 - DNA, 13 bp, Homo sapiens
tataggtttaatt

SEQ ID NO: 4189779 - DNA, 14 bp, Homo sapiens
tataggtttaattt

SEQ ID NO: 4189780 - DNA, 20 bp, Homo sapiens
tatagtcccagctactcaga

SEQ ID NO: 4189781 - DNA, 13 bp, Homo sapiens
tatagtttcagat

SEQ ID NO: 4189782 - DNA, 15 bp, Homo sapiens
tatagtttgtacatg

SEQ ID NO: 4189783 - DNA, 16 bp, Homo sapiens
tatatagatgtgcaag

SEQ ID NO: 4189784 - DNA, 19 bp, Homo sapiens
tatatatctgcttcagtgg

SEQ ID NO: 4189785 - DNA, 22 bp, Homo sapiens
tatatattgattatatattgtt

SEQ ID NO: 4189786 - DNA, 22 bp, Homo sapiens
tatatatttgattgtaaaaaca

SEQ ID NO: 4189787 - DNA, 13 bp, Homo sapiens
tatatcagaaaag

SEQ ID NO: 4189788 - DNA, 21 bp, Homo sapiens
tatatgcacatgtaacccaaa

SEQ ID NO: 4189789 - DNA, 17 bp, Homo sapiens
tatatggaacattttct

SEQ ID NO: 4189790 - DNA, 16 bp, Homo sapiens
tatatggtctgtgtgt

SEQ ID NO: 4189791 - DNA, 13 bp, Homo sapiens
tatattacctcaa

SEQ ID NO: 4189792 - DNA, 14 bp, Homo sapiens
tatattgaaaagat

SEQ ID NO: 4189793 - DNA, 16 bp, Homo sapiens
tatattgcaaaaacat

SEQ ID NO: 4189794 - DNA, 19 bp, Homo sapiens
tatatttaactctctttat

SEQ ID NO: 4189795 - DNA, 22 bp, Homo sapiens
tatatttatcaaacttgtgctg

SEQ ID NO: 4189796 - DNA, 17 bp, Homo sapiens
tatatttgaatatcatt

SEQ ID NO: 4189797 - DNA, 17 bp, Homo sapiens
tatatttggaaagagac

SEQ ID NO: 4189798 - DNA, 20 bp, Homo sapiens
tatatttttatatttagtta

SEQ ID NO: 4189799 - DNA, 14 bp, Homo sapiens
tatatttttgtaaa

SEQ ID NO: 4189800 - DNA, 15 bp, Homo sapiens
tatcaaaagacagca

SEQ ID NO: 4189801 - DNA, 14 bp, Homo sapiens
tatcaaacttgtgc

SEQ ID NO: 4189802 - DNA, 15 bp, Homo sapiens
tatcagtcatgagga

SEQ ID NO: 4189803 - DNA, 15 bp, Homo sapiens
tatcagttaacatta

SEQ ID NO: 4189804 - DNA, 23 bp, Homo sapiens
tatcatcagtgtagaacctaatt

SEQ ID NO: 4189805 - DNA, 15 bp, Homo sapiens
tatcatggagtgacg

SEQ ID NO: 4189806 - DNA, 21 bp, Homo sapiens
tatccacagaaacattttcat

SEQ ID NO: 4189807 - DNA, 11 bp, Homo sapiens
tatccagtcta

SEQ ID NO: 4189808 - DNA, 19 bp, Homo sapiens
tatcccagcttgctgaggg

SEQ ID NO: 4189809 - DNA, 12 bp, Homo sapiens
tatcccagtgtg

SEQ ID NO: 4189810 - DNA, 15 bp, Homo sapiens
tatccgactctaagc

SEQ ID NO: 4189811 - DNA, 20 bp, Homo sapiens
tatccgactctaagctgtgt

SEQ ID NO: 4189812 - DNA, 19 bp, Homo sapiens
tatcctacaacaagagttt

SEQ ID NO: 4189813 - DNA, 20 bp, Homo sapiens
tatccttggagagcagctgg

SEQ ID NO: 4189814 - DNA, 13 bp, Homo sapiens
tatctaactcttc

SEQ ID NO: 4189815 - DNA, 14 bp, Homo sapiens
tatctctggcctcc

SEQ ID NO: 4189816 - DNA, 19 bp, Homo sapiens
tatctgaatttttaaacaa

SEQ ID NO: 4189817 - DNA, 20 bp, Homo sapiens
tatctgaatttttaaacaag

SEQ ID NO: 4189818 - DNA, 20 bp, Homo sapiens
tatctgcttcagtggagaat

SEQ ID NO: 4189819 - DNA, 22 bp, Homo sapiens
tatctgggtaagaagaaagcaa

SEQ ID NO: 4189820 - DNA, 16 bp, Homo sapiens
tatctgttttgtttct

SEQ ID NO: 4189821 - DNA, 18 bp, Homo sapiens
tatcttactatttcacaa

SEQ ID NO: 4189822 - DNA, 13 bp, Homo sapiens
tatcttctggatt

SEQ ID NO: 4189823 - DNA, 14 bp, Homo sapiens
tatcttctggatta

SEQ ID NO: 4189824 - DNA, 21 bp, Homo sapiens
tatctttataggcagtagact

SEQ ID NO: 4189825 - DNA, 20 bp, Homo sapiens
tatctttgaagccagtattt

SEQ ID NO: 4189826 - DNA, 15 bp, Homo sapiens
tatgaaaaagaagaa

SEQ ID NO: 4189827 - DNA, 20 bp, Homo sapiens
tatgaacttgaggacacatg

SEQ ID NO: 4189828 - DNA, 19 bp, Homo sapiens
tatgacaatcctgaagaaa

SEQ ID NO: 4189829 - DNA, 20 bp, Homo sapiens
tatgataactatttacatat

SEQ ID NO: 4189830 - DNA, 16 bp, Homo sapiens
tatgataatgataact

SEQ ID NO: 4189831 - DNA, 15 bp, Homo sapiens
tatgatcccagcact

SEQ ID NO: 4189832 - DNA, 14 bp, Homo sapiens
tatgatttatagtt

SEQ ID NO: 4189833 - DNA, 17 bp, Homo sapiens
tatgatttttacaataa

SEQ ID NO: 4189834 - DNA, 14 bp, Homo sapiens
tatgcagaatgttt

SEQ ID NO: 4189835 - DNA, 22 bp, Homo sapiens
tatgcataatcagcgccctgga

SEQ ID NO: 4189836 - DNA, 14 bp, Homo sapiens
tatgcatttttaat

SEQ ID NO: 4189837 - DNA, 15 bp, Homo sapiens
tatgcatttttaata

SEQ ID NO: 4189838 - DNA, 15 bp, Homo sapiens
tatgctgtcatggtc

SEQ ID NO: 4189839 - DNA, 16 bp, Homo sapiens
tatgcttgcaaaaact

SEQ ID NO: 4189840 - DNA, 17 bp, Homo sapiens
tatggaacttctaatat

SEQ ID NO: 4189841 - DNA, 14 bp, Homo sapiens
tatggattctaaaa

SEQ ID NO: 4189842 - DNA, 16 bp, Homo sapiens
tatggattctaaaatg

SEQ ID NO: 4189843 - DNA, 19 bp, Homo sapiens
tatgggaatcagctggtgg

SEQ ID NO: 4189844 - DNA, 17 bp, Homo sapiens
tatggtaccagatgcag

SEQ ID NO: 4189845 - DNA, 13 bp, Homo sapiens
tatggtgcaaaaa

SEQ ID NO: 4189846 - DNA, 16 bp, Homo sapiens
tatggtgtgttcctaa

SEQ ID NO: 4189847 - DNA, 16 bp, Homo sapiens
tatgtaaaatcaataa

SEQ ID NO: 4189848 - DNA, 10 bp, Homo sapiens
tatgtaccaa

SEQ ID NO: 4189849 - DNA, 17 bp, Homo sapiens
tatgtatatagatgtgc

SEQ ID NO: 4189850 - DNA, 17 bp, Homo sapiens
tatgtcatttattttgt

SEQ ID NO: 4189851 - DNA, 12 bp, Homo sapiens
tatgtctaaaga

SEQ ID NO: 4189852 - DNA, 20 bp, Homo sapiens
tatgtggcatggcagaatga

SEQ ID NO: 4189853 - DNA, 13 bp, Homo sapiens
tatgtttttaatg

SEQ ID NO: 4189854 - DNA, 20 bp, Homo sapiens
tattaaaaatatggaacttc

SEQ ID NO: 4189855 - DNA, 22 bp, Homo sapiens
tattaaaatgattgtaaaatag

SEQ ID NO: 4189856 - DNA, 18 bp, Homo sapiens
tattaaggggatcagaag

SEQ ID NO: 4189857 - DNA, 19 bp, Homo sapiens
tattaccaaaaaagtattt

SEQ ID NO: 4189858 - DNA, 20 bp, Homo sapiens
tattaccaaaaaagtatttt

SEQ ID NO: 4189859 - DNA, 21 bp, Homo sapiens
tattaccaaaaaagtattttt

SEQ ID NO: 4189860 - DNA, 18 bp, Homo sapiens
tattactgtctggtttta

SEQ ID NO: 4189861 - DNA, 18 bp, Homo sapiens
tattaggggtaatatatt

SEQ ID NO: 4189862 - DNA, 15 bp, Homo sapiens
tattatgagatgctg

SEQ ID NO: 4189863 - DNA, 13 bp, Homo sapiens
tattatgtgttca

SEQ ID NO: 4189864 - DNA, 17 bp, Homo sapiens
tattattttttccacat

SEQ ID NO: 4189865 - DNA, 16 bp, Homo sapiens
tattcaagttattgta

SEQ ID NO: 4189866 - DNA, 20 bp, Homo sapiens
tattcaagttattgtacagc

SEQ ID NO: 4189867 - DNA, 13 bp, Homo sapiens
tattcaataaagc

SEQ ID NO: 4189868 - DNA, 21 bp, Homo sapiens
tattcagtgctgtggcctggg

SEQ ID NO: 4189869 - DNA, 20 bp, Homo sapiens
tattcatgctttctcctttt

SEQ ID NO: 4189870 - DNA, 17 bp, Homo sapiens
tattcctatctgtggat

SEQ ID NO: 4189871 - DNA, 21 bp, Homo sapiens
tattccttttgtgtacagtgt

SEQ ID NO: 4189872 - DNA, 14 bp, Homo sapiens
tattctcaccagga

SEQ ID NO: 4189873 - DNA, 16 bp, Homo sapiens
tattcttatgcagggt

SEQ ID NO: 4189874 - DNA, 21 bp, Homo sapiens
tattctttttgtgtgtgccaa

SEQ ID NO: 4189875 - DNA, 16 bp, Homo sapiens
tattgaagaaaagcac

SEQ ID NO: 4189876 - DNA, 18 bp, Homo sapiens
tattgaagaaaagcactt

SEQ ID NO: 4189877 - DNA, 16 bp, Homo sapiens
tattgacttctcttga

SEQ ID NO: 4189878 - DNA, 22 bp, Homo sapiens
tattgctgctggtaatttgtat

SEQ ID NO: 4189879 - DNA, 17 bp, Homo sapiens
tattgggagggatgaga

SEQ ID NO: 4189880 - DNA, 18 bp, Homo sapiens
tattgggagggatgagag

SEQ ID NO: 4189881 - DNA, 20 bp, Homo sapiens
tattgtacagctgtttaaga

SEQ ID NO: 4189882 - DNA, 19 bp, Homo sapiens
tattgtctgtctacatttc

SEQ ID NO: 4189883 - DNA, 15 bp, Homo sapiens
tattgtttgtaaaca

SEQ ID NO: 4189884 - DNA, 17 bp, Homo sapiens
tattgttttatgttcta

SEQ ID NO: 4189885 - DNA, 20 bp, Homo sapiens
tatttaaaaaactaaaaact

SEQ ID NO: 4189886 - DNA, 17 bp, Homo sapiens
tatttaaaaagctcttt

SEQ ID NO: 4189887 - DNA, 21 bp, Homo sapiens
tatttaaaaccattatttaat

SEQ ID NO: 4189888 - DNA, 23 bp, Homo sapiens
tatttaaaaccattatttaataa

SEQ ID NO: 4189889 - DNA, 23 bp, Homo sapiens
tatttaaaagtataaaactgctt

SEQ ID NO: 4189890 - DNA, 15 bp, Homo sapiens
tatttaaaatagcaa

SEQ ID NO: 4189891 - DNA, 21 bp, Homo sapiens
tatttaaaatagcaaaagaag

SEQ ID NO: 4189892 - DNA, 19 bp, Homo sapiens
tatttaaaccgctaaaaga

SEQ ID NO: 4189893 - DNA, 21 bp, Homo sapiens
tatttaacttgagggtaataa

SEQ ID NO: 4189894 - DNA, 12 bp, Homo sapiens
tatttaataaga

SEQ ID NO: 4189895 - DNA, 13 bp, Homo sapiens
tatttaataagag

SEQ ID NO: 4189896 - DNA, 13 bp, Homo sapiens
tatttacatataa

SEQ ID NO: 4189897 - DNA, 15 bp, Homo sapiens
tatttactaaaagaa

SEQ ID NO: 4189898 - DNA, 17 bp, Homo sapiens
tatttagttatagtttc

SEQ ID NO: 4189899 - DNA, 17 bp, Homo sapiens
tatttatatatttgaat

SEQ ID NO: 4189900 - DNA, 14 bp, Homo sapiens
tatttatatgttaa

SEQ ID NO: 4189901 - DNA, 14 bp, Homo sapiens
tatttatgataact

SEQ ID NO: 4189902 - DNA, 19 bp, Homo sapiens
tatttatgtaaaatcaata

SEQ ID NO: 4189903 - DNA, 13 bp, Homo sapiens
tatttatttgtgt

SEQ ID NO: 4189904 - DNA, 15 bp, Homo sapiens
tatttcaaatgaaca

SEQ ID NO: 4189905 - DNA, 20 bp, Homo sapiens
tatttcaaatgaacacgtgc

SEQ ID NO: 4189906 - DNA, 15 bp, Homo sapiens
tatttcaagtgccta

SEQ ID NO: 4189907 - DNA, 16 bp, Homo sapiens
tatttcacaattatat

SEQ ID NO: 4189908 - DNA, 16 bp, Homo sapiens
tatttcacatgtttat

SEQ ID NO: 4189909 - DNA, 20 bp, Homo sapiens
tatttcacatgtttatattt

SEQ ID NO: 4189910 - DNA, 19 bp, Homo sapiens
tatttccaaacctggttca

SEQ ID NO: 4189911 - DNA, 22 bp, Homo sapiens
tatttctagtagaaagaaaatg

SEQ ID NO: 4189912 - DNA, 19 bp, Homo sapiens
tatttcttttttttaataa

SEQ ID NO: 4189913 - DNA, 16 bp, Homo sapiens
tatttggaaagagacc

SEQ ID NO: 4189914 - DNA, 14 bp, Homo sapiens
tatttgtaatagat

SEQ ID NO: 4189915 - DNA, 15 bp, Homo sapiens
tatttgtaatagatg

SEQ ID NO: 4189916 - DNA, 20 bp, Homo sapiens
tatttgtaatagatgtttga

SEQ ID NO: 4189917 - DNA, 15 bp, Homo sapiens
tatttgtctttcagg

SEQ ID NO: 4189918 - DNA, 14 bp, Homo sapiens
tatttgttattttc

SEQ ID NO: 4189919 - DNA, 17 bp, Homo sapiens
tatttgttattttcagt

SEQ ID NO: 4189920 - DNA, 18 bp, Homo sapiens
tatttgttattttcagta

SEQ ID NO: 4189921 - DNA, 19 bp, Homo sapiens
tattttaaacaaaatagaa

SEQ ID NO: 4189922 - DNA, 21 bp, Homo sapiens
tattttaggcagggatttgag

SEQ ID NO: 4189923 - DNA, 15 bp, Homo sapiens
tattttattgtctaa

SEQ ID NO: 4189924 - DNA, 18 bp, Homo sapiens
tattttcattttaattta

SEQ ID NO: 4189925 - DNA, 13 bp, Homo sapiens
tattttctgaatt

SEQ ID NO: 4189926 - DNA, 13 bp, Homo sapiens
tattttcttggat

SEQ ID NO: 4189927 - DNA, 21 bp, Homo sapiens
tattttgtaatttttttgaaa

SEQ ID NO: 4189928 - DNA, 15 bp, Homo sapiens
tatttttcacagttt

SEQ ID NO: 4189929 - DNA, 15 bp, Homo sapiens
tatttttccacattt

SEQ ID NO: 4189930 - DNA, 17 bp, Homo sapiens
tatttttgagcaggagc

SEQ ID NO: 4189931 - DNA, 20 bp, Homo sapiens
tatttttttaagctgtaaaa

SEQ ID NO: 4189932 - DNA, 21 bp, Homo sapiens
tcaaaacacatctttcctgtc

SEQ ID NO: 4189933 - DNA, 21 bp, Homo sapiens
tcaaacaccaacataaaaatg

SEQ ID NO: 4189934 - DNA, 17 bp, Homo sapiens
tcaaactaggaggaaaa

SEQ ID NO: 4189935 - DNA, 17 bp, Homo sapiens
tcaaacttgtgctgaga

SEQ ID NO: 4189936 - DNA, 16 bp, Homo sapiens
tcaaagaaatgctgat

SEQ ID NO: 4189937 - DNA, 19 bp, Homo sapiens
tcaaagaaatgctgatgga

SEQ ID NO: 4189938 - DNA, 22 bp, Homo sapiens
tcaaagaaggatggcacctaaa

SEQ ID NO: 4189939 - DNA, 19 bp, Homo sapiens
tcaaagcaagcattcagaa

SEQ ID NO: 4189940 - DNA, 21 bp, Homo sapiens
tcaaagcacctgaaccactgt

SEQ ID NO: 4189941 - DNA, 18 bp, Homo sapiens
tcaaagggcccacagtga

SEQ ID NO: 4189942 - DNA, 22 bp, Homo sapiens
tcaaagtgtaacagatatcagt

SEQ ID NO: 4189943 - DNA, 15 bp, Homo sapiens
tcaaatgctgttagt

SEQ ID NO: 4189944 - DNA, 13 bp, Homo sapiens
tcaaatgtcagtt

SEQ ID NO: 4189945 - DNA, 14 bp, Homo sapiens
tcaacaaaaagaca

SEQ ID NO: 4189946 - DNA, 16 bp, Homo sapiens
tcaacaaaaagacatg

SEQ ID NO: 4189947 - DNA, 16 bp, Homo sapiens
tcaacaacaaaccaaa

SEQ ID NO: 4189948 - DNA, 13 bp, Homo sapiens
tcaacaacaattt

SEQ ID NO: 4189949 - DNA, 23 bp, Homo sapiens
tcaacaacaattttaaataagat

SEQ ID NO: 4189950 - DNA, 12 bp, Homo sapiens
tcaacaataaag

SEQ ID NO: 4189951 - DNA, 14 bp, Homo sapiens
tcaacaataaagac

SEQ ID NO: 4189952 - DNA, 22 bp, Homo sapiens
tcaacacaaagacacaggaaga

SEQ ID NO: 4189953 - DNA, 15 bp, Homo sapiens
tcaacacaaagacat

SEQ ID NO: 4189954 - DNA, 16 bp, Homo sapiens
tcaacacaaagacatg

SEQ ID NO: 4189955 - DNA, 21 bp, Homo sapiens
tcaacacaaagacatggaaga

SEQ ID NO: 4189956 - DNA, 14 bp, Homo sapiens
tcaacactcttctt

SEQ ID NO: 4189957 - DNA, 15 bp, Homo sapiens
tcaacagtgaagaca

SEQ ID NO: 4189958 - DNA, 15 bp, Homo sapiens
tcaacagttttccta

SEQ ID NO: 4189959 - DNA, 20 bp, Homo sapiens
tcaacagttttcctatgctt

SEQ ID NO: 4189960 - DNA, 24 bp, Homo sapiens
tcaaccagaaaacttagaaataag

SEQ ID NO: 4189961 - DNA, 14 bp, Homo sapiens
tcaacttcagaagg

SEQ ID NO: 4189962 - DNA, 14 bp, Homo sapiens
tcaacttgcttatc

SEQ ID NO: 4189963 - DNA, 17 bp, Homo sapiens
tcaacttggaaaaagaa

SEQ ID NO: 4189964 - DNA, 21 bp, Homo sapiens
tcaacttggaaaaagaaagaa

SEQ ID NO: 4189965 - DNA, 14 bp, Homo sapiens
tcaagaaataagtt

SEQ ID NO: 4189966 - DNA, 13 bp, Homo sapiens
tcaagacatttct

SEQ ID NO: 4189967 - DNA, 23 bp, Homo sapiens
tcaagactgtggtattggggtct

SEQ ID NO: 4189968 - DNA, 22 bp, Homo sapiens
tcaagagtgcagttgattctga

SEQ ID NO: 4189969 - DNA, 18 bp, Homo sapiens
tcaagatacatagtaaat

SEQ ID NO: 4189970 - DNA, 18 bp, Homo sapiens
tcaagatgtcagactggc

SEQ ID NO: 4189971 - DNA, 15 bp, Homo sapiens
tcaagcctgcagcga

SEQ ID NO: 4189972 - DNA, 16 bp, Homo sapiens
tcaaggaatcctgagt

SEQ ID NO: 4189973 - DNA, 16 bp, Homo sapiens
tcaaggaccacatgtg

SEQ ID NO: 4189974 - DNA, 19 bp, Homo sapiens
tcaagtagatcatggcagc

SEQ ID NO: 4189975 - DNA, 23 bp, Homo sapiens
tcaagtatctaactcttctggaa

SEQ ID NO: 4189976 - DNA, 11 bp, Homo sapiens
tcaagtccaga

SEQ ID NO: 4189977 - DNA, 12 bp, Homo sapiens
tcaagtccagag

SEQ ID NO: 4189978 - DNA, 13 bp, Homo sapiens
tcaagtccagagc

SEQ ID NO: 4189979 - DNA, 14 bp, Homo sapiens
tcaagtccagagcc

SEQ ID NO: 4189980 - DNA, 13 bp, Homo sapiens
tcaagtgccaaac

SEQ ID NO: 4189981 - DNA, 21 bp, Homo sapiens
tcaagtgcctagactgttact

SEQ ID NO: 4189982 - DNA, 15 bp, Homo sapiens
tcaagtgtcatatgt

SEQ ID NO: 4189983 - DNA, 12 bp, Homo sapiens
tcaataaaaatc

SEQ ID NO: 4189984 - DNA, 22 bp, Homo sapiens
tcaataccccaagtccacctgc

SEQ ID NO: 4189985 - DNA, 16 bp, Homo sapiens
tcaatacccctgttaa

SEQ ID NO: 4189986 - DNA, 15 bp, Homo sapiens
tcaatacttcatgat

SEQ ID NO: 4189987 - DNA, 15 bp, Homo sapiens
tcaatattcaataaa

SEQ ID NO: 4189988 - DNA, 21 bp, Homo sapiens
tcaatcagtctcagaatgtca

SEQ ID NO: 4189989 - DNA, 22 bp, Homo sapiens
tcaatcagtctcagaatgtcat

SEQ ID NO: 4189990 - DNA, 19 bp, Homo sapiens
tcaatcatctgtgtgaaaa

SEQ ID NO: 4189991 - DNA, 15 bp, Homo sapiens
tcaatgtcaagtacc

SEQ ID NO: 4189992 - DNA, 18 bp, Homo sapiens
tcaatgtggtgatgaaat

SEQ ID NO: 4189993 - DNA, 15 bp, Homo sapiens
tcaattcaaagctgt

SEQ ID NO: 4189994 - DNA, 18 bp, Homo sapiens
tcaattcttaaatttctt

SEQ ID NO: 4189995 - DNA, 18 bp, Homo sapiens
tcaatttccctgactcct

SEQ ID NO: 4189996 - DNA, 16 bp, Homo sapiens
tcacaaggtcaggagt

SEQ ID NO: 4189997 - DNA, 23 bp, Homo sapiens
tcacacagtgggtggtggatctg

SEQ ID NO: 4189998 - DNA, 22 bp, Homo sapiens
tcacacatgcatcatcagccta

SEQ ID NO: 4189999 - DNA, 12 bp, Homo sapiens
tcacaccactgc

SEQ ID NO: 4190000 - DNA, 15 bp, Homo sapiens
tcacacctgacaaat

SEQ ID NO: 4190001 - DNA, 17 bp, Homo sapiens
tcacacctgacaaatgg

SEQ ID NO: 4190002 - DNA, 20 bp, Homo sapiens
tcacacctgacaaatggaag

SEQ ID NO: 4190003 - DNA, 13 bp, Homo sapiens
tcacactcagaaa

SEQ ID NO: 4190004 - DNA, 20 bp, Homo sapiens
tcacagacgctcctgaagtt

SEQ ID NO: 4190005 - DNA, 22 bp, Homo sapiens
tcacagacgctcctgaagttag

SEQ ID NO: 4190006 - DNA, 16 bp, Homo sapiens
tcacagcccagaacca

SEQ ID NO: 4190007 - DNA, 23 bp, Homo sapiens
tcacagcccgggtgtgcctgccc

SEQ ID NO: 4190008 - DNA, 15 bp, Homo sapiens
tcacagggcagagcc

SEQ ID NO: 4190009 - DNA, 13 bp, Homo sapiens
tcacagtctcaca

SEQ ID NO: 4190010 - DNA, 22 bp, Homo sapiens
tcacagtgtttgcaatggtgtt

SEQ ID NO: 4190011 - DNA, 17 bp, Homo sapiens
tcacataaaacctcatt

SEQ ID NO: 4190012 - DNA, 14 bp, Homo sapiens
tcacattagaagac

SEQ ID NO: 4190013 - DNA, 15 bp, Homo sapiens
tcacattagaagaca

SEQ ID NO: 4190014 - DNA, 22 bp, Homo sapiens
tcacattagaagacaattgaca

SEQ ID NO: 4190015 - DNA, 22 bp, Homo sapiens
tcaccacaaactgtaatacaat

SEQ ID NO: 4190016 - DNA, 17 bp, Homo sapiens
tcaccagcctgactgca

SEQ ID NO: 4190017 - DNA, 14 bp, Homo sapiens
tcacccagaaaaaa

SEQ ID NO: 4190018 - DNA, 16 bp, Homo sapiens
tcaccccttatcctga

SEQ ID NO: 4190019 - DNA, 18 bp, Homo sapiens
tcaccgagacggctggac

SEQ ID NO: 4190020 - DNA, 19 bp, Homo sapiens
tcaccgagacggctggacc

SEQ ID NO: 4190021 - DNA, 19 bp, Homo sapiens
tcacctctttaaccactcc

SEQ ID NO: 4190022 - DNA, 13 bp, Homo sapiens
tcacgactcttcc

SEQ ID NO: 4190023 - DNA, 19 bp, Homo sapiens
tcacgcctgtaatcccagc

SEQ ID NO: 4190024 - DNA, 20 bp, Homo sapiens
tcacgcctgtaatcccagca

SEQ ID NO: 4190025 - DNA, 15 bp, Homo sapiens
tcacgctctggacat

SEQ ID NO: 4190026 - DNA, 23 bp, Homo sapiens
tcactacctttatagctcatcac

SEQ ID NO: 4190027 - DNA, 14 bp, Homo sapiens
tcactcaagcctga

SEQ ID NO: 4190028 - DNA, 20 bp, Homo sapiens
tcactcaaggcggtgcttga

SEQ ID NO: 4190029 - DNA, 13 bp, Homo sapiens
tcactcagccaca

SEQ ID NO: 4190030 - DNA, 19 bp, Homo sapiens
tcactcttcctgcaaggac

SEQ ID NO: 4190031 - DNA, 14 bp, Homo sapiens
tcactgaagattgg

SEQ ID NO: 4190032 - DNA, 17 bp, Homo sapiens
tcactgagttttccatg

SEQ ID NO: 4190033 - DNA, 14 bp, Homo sapiens
tcactgccatgcct

SEQ ID NO: 4190034 - DNA, 17 bp, Homo sapiens
tcactgccatgcctcaa

SEQ ID NO: 4190035 - DNA, 11 bp, Homo sapiens
tcactgctgtc

SEQ ID NO: 4190036 - DNA, 14 bp, Homo sapiens
tcactgctgtcagc

SEQ ID NO: 4190037 - DNA, 18 bp, Homo sapiens
tcactgctgtcagccaag

SEQ ID NO: 4190038 - DNA, 12 bp, Homo sapiens
tcactggagccc

SEQ ID NO: 4190039 - DNA, 15 bp, Homo sapiens
tcactggcagagcac

SEQ ID NO: 4190040 - DNA, 17 bp, Homo sapiens
tcactggcagagcacag

SEQ ID NO: 4190041 - DNA, 20 bp, Homo sapiens
tcactggcagagcacagccc

SEQ ID NO: 4190042 - DNA, 22 bp, Homo sapiens
tcactggcagagcacagcccac

SEQ ID NO: 4190043 - DNA, 16 bp, Homo sapiens
tcactggtccatttct

SEQ ID NO: 4190044 - DNA, 19 bp, Homo sapiens
tcactgttgaaaattattt

SEQ ID NO: 4190045 - DNA, 20 bp, Homo sapiens
tcactgttgaaaattatttt

SEQ ID NO: 4190046 - DNA, 16 bp, Homo sapiens
tcactgttgtacacag

SEQ ID NO: 4190047 - DNA, 19 bp, Homo sapiens
tcactgttgtacacagtct

SEQ ID NO: 4190048 - DNA, 18 bp, Homo sapiens
tcacttcatacttctaaa

SEQ ID NO: 4190049 - DNA, 22 bp, Homo sapiens
tcacttgaagccaaactgttgg

SEQ ID NO: 4190050 - DNA, 13 bp, Homo sapiens
tcacttttcagtg

SEQ ID NO: 4190051 - DNA, 14 bp, Homo sapiens
tcacttttcagtga

SEQ ID NO: 4190052 - DNA, 12 bp, Homo sapiens
tcagaaactgtt

SEQ ID NO: 4190053 - DNA, 14 bp, Homo sapiens
tcagaaataggaag

SEQ ID NO: 4190054 - DNA, 17 bp, Homo sapiens
tcagaagaaaaagaagc

SEQ ID NO: 4190055 - DNA, 16 bp, Homo sapiens
tcagaagcaggcaggg

SEQ ID NO: 4190056 - DNA, 13 bp, Homo sapiens
tcagaagcctgag

SEQ ID NO: 4190057 - DNA, 14 bp, Homo sapiens
tcagaatgtcattt

SEQ ID NO: 4190058 - DNA, 21 bp, Homo sapiens
tcagacatccatgtttgtaaa

SEQ ID NO: 4190059 - DNA, 13 bp, Homo sapiens
tcagactgcagag

SEQ ID NO: 4190060 - DNA, 21 bp, Homo sapiens
tcagactgctgggactggcca

SEQ ID NO: 4190061 - DNA, 21 bp, Homo sapiens
tcagactggctggctgcagtg

SEQ ID NO: 4190062 - DNA, 12 bp, Homo sapiens
tcagagagccta

SEQ ID NO: 4190063 - DNA, 14 bp, Homo sapiens
tcagagcaggggtc

SEQ ID NO: 4190064 - DNA, 14 bp, Homo sapiens
tcagagccaggctc

SEQ ID NO: 4190065 - DNA, 17 bp, Homo sapiens
tcagagccaggctctgc

SEQ ID NO: 4190066 - DNA, 19 bp, Homo sapiens
tcagagccaggctctgcct

SEQ ID NO: 4190067 - DNA, 21 bp, Homo sapiens
tcagagccaggctctgcctgg

SEQ ID NO: 4190068 - DNA, 15 bp, Homo sapiens
tcagaggaagcacat

SEQ ID NO: 4190069 - DNA, 12 bp, Homo sapiens
tcagagtgccac

SEQ ID NO: 4190070 - DNA, 23 bp, Homo sapiens
tcagataaggtaaaatgccatga

SEQ ID NO: 4190071 - DNA, 23 bp, Homo sapiens
tcagatatatttttcacagtttt

SEQ ID NO: 4190072 - DNA, 17 bp, Homo sapiens
tcagcacccctgtctct

SEQ ID NO: 4190073 - DNA, 19 bp, Homo sapiens
tcagccacaaaactctgtc

SEQ ID NO: 4190074 - DNA, 20 bp, Homo sapiens
tcagccagaatcttcgtcct

SEQ ID NO: 4190075 - DNA, 23 bp, Homo sapiens
tcagccagaatcttcgtcctgcc

SEQ ID NO: 4190076 - DNA, 13 bp, Homo sapiens
tcagcccttggct

SEQ ID NO: 4190077 - DNA, 21 bp, Homo sapiens
tcagcctcccgagtagctgag

SEQ ID NO: 4190078 - DNA, 20 bp, Homo sapiens
tcagcctcccgagtagctgg

SEQ ID NO: 4190079 - DNA, 12 bp, Homo sapiens
tcagcctcttaa

SEQ ID NO: 4190080 - DNA, 20 bp, Homo sapiens
tcagcctcttgagtagctgg

SEQ ID NO: 4190081 - DNA, 18 bp, Homo sapiens
tcagcctgaggctgagac

SEQ ID NO: 4190082 - DNA, 18 bp, Homo sapiens
tcagcgtgcttagcctcc

SEQ ID NO: 4190083 - DNA, 16 bp, Homo sapiens
tcagctaaatgcaggg

SEQ ID NO: 4190084 - DNA, 19 bp, Homo sapiens
tcagctactgatttttgtg

SEQ ID NO: 4190085 - DNA, 14 bp, Homo sapiens
tcagctcactggtc

SEQ ID NO: 4190086 - DNA, 19 bp, Homo sapiens
tcagctccagaataccttc

SEQ ID NO: 4190087 - DNA, 18 bp, Homo sapiens
tcagctcgctgcccaggg

SEQ ID NO: 4190088 - DNA, 19 bp, Homo sapiens
tcagctcgctgcccaggga

SEQ ID NO: 4190089 - DNA, 17 bp, Homo sapiens
tcagcttcagactttta

SEQ ID NO: 4190090 - DNA, 23 bp, Homo sapiens
tcagcttccccaggagctctctg

SEQ ID NO: 4190091 - DNA, 12 bp, Homo sapiens
tcaggaaaattg

SEQ ID NO: 4190092 - DNA, 15 bp, Homo sapiens
tcaggaaagacaggc

SEQ ID NO: 4190093 - DNA, 15 bp, Homo sapiens
tcaggaacagaacac

SEQ ID NO: 4190094 - DNA, 15 bp, Homo sapiens
tcaggaagagaagga

SEQ ID NO: 4190095 - DNA, 20 bp, Homo sapiens
tcaggaagatgaaagaggag

SEQ ID NO: 4190096 - DNA, 24 bp, Homo sapiens
tcaggagagagtctaagataaaag

SEQ ID NO: 4190097 - DNA, 17 bp, Homo sapiens
tcaggagattgttaatt

SEQ ID NO: 4190098 - DNA, 23 bp, Homo sapiens
tcaggaggcgaataaatgttcaa

SEQ ID NO: 4190099 - DNA, 15 bp, Homo sapiens
tcaggaggctgaggg

SEQ ID NO: 4190100 - DNA, 15 bp, Homo sapiens
tcaggatttttggta

SEQ ID NO: 4190101 - DNA, 18 bp, Homo sapiens
tcaggcagttactatttt

SEQ ID NO: 4190102 - DNA, 21 bp, Homo sapiens
tcaggcattgaatgacaagca

SEQ ID NO: 4190103 - DNA, 17 bp, Homo sapiens
tcaggccagagccaagg

SEQ ID NO: 4190104 - DNA, 14 bp, Homo sapiens
tcaggcttccttgg

SEQ ID NO: 4190105 - DNA, 22 bp, Homo sapiens
tcagggaggccctgtgcccctt

SEQ ID NO: 4190106 - DNA, 18 bp, Homo sapiens
tcagggtgggccactctc

SEQ ID NO: 4190107 - DNA, 20 bp, Homo sapiens
tcagggtgggccactctccc

SEQ ID NO: 4190108 - DNA, 22 bp, Homo sapiens
tcaggtccaggccagtgggcct

SEQ ID NO: 4190109 - DNA, 23 bp, Homo sapiens
tcaggtccaggccagtgggcctg

SEQ ID NO: 4190110 - DNA, 18 bp, Homo sapiens
tcagtaatttagaaatca

SEQ ID NO: 4190111 - DNA, 19 bp, Homo sapiens
tcagtaatttagaaatcat

SEQ ID NO: 4190112 - DNA, 16 bp, Homo sapiens
tcagtagctgagtgca

SEQ ID NO: 4190113 - DNA, 19 bp, Homo sapiens
tcagtattttggagaaatt

SEQ ID NO: 4190114 - DNA, 23 bp, Homo sapiens
tcagtattttggagaaattattt

SEQ ID NO: 4190115 - DNA, 14 bp, Homo sapiens
tcagtcatgaggaa

SEQ ID NO: 4190116 - DNA, 17 bp, Homo sapiens
tcagtcatgaggaaaga

SEQ ID NO: 4190117 - DNA, 14 bp, Homo sapiens
tcagtccagatgcc

SEQ ID NO: 4190118 - DNA, 19 bp, Homo sapiens
tcagtccagatgccttcct

SEQ ID NO: 4190119 - DNA, 20 bp, Homo sapiens
tcagtccttattatcccagc

SEQ ID NO: 4190120 - DNA, 22 bp, Homo sapiens
tcagtccttattatcccagctt

SEQ ID NO: 4190121 - DNA, 17 bp, Homo sapiens
tcagtctagtgaagatg

SEQ ID NO: 4190122 - DNA, 19 bp, Homo sapiens
tcagtctcagaatgtcatt

SEQ ID NO: 4190123 - DNA, 17 bp, Homo sapiens
tcagtgcagcagaggac

SEQ ID NO: 4190124 - DNA, 16 bp, Homo sapiens
tcagtgctgtgctgtg

SEQ ID NO: 4190125 - DNA, 19 bp, Homo sapiens
tcagtgctgtggcctgggc

SEQ ID NO: 4190126 - DNA, 12 bp, Homo sapiens
tcagtggcttct

SEQ ID NO: 4190127 - DNA, 20 bp, Homo sapiens
tcagtgggacaaaccagagc

SEQ ID NO: 4190128 - DNA, 15 bp, Homo sapiens
tcagtgggctccctg

SEQ ID NO: 4190129 - DNA, 13 bp, Homo sapiens
tcagtgtggaaaa

SEQ ID NO: 4190130 - DNA, 14 bp, Homo sapiens
tcagttcataatat

SEQ ID NO: 4190131 - DNA, 18 bp, Homo sapiens
tcagttcccgctctgcat

SEQ ID NO: 4190132 - DNA, 19 bp, Homo sapiens
tcagttcctctttgcatgg

SEQ ID NO: 4190133 - DNA, 21 bp, Homo sapiens
tcagttcctctttgcatggaa

SEQ ID NO: 4190134 - DNA, 17 bp, Homo sapiens
tcagttgattttctgga

SEQ ID NO: 4190135 - DNA, 18 bp, Homo sapiens
tcagttgattttctggat

SEQ ID NO: 4190136 - DNA, 12 bp, Homo sapiens
tcagttgttttc

SEQ ID NO: 4190137 - DNA, 15 bp, Homo sapiens
tcatacttctaaatc

SEQ ID NO: 4190138 - DNA, 16 bp, Homo sapiens
tcataggtatttcaaa

SEQ ID NO: 4190139 - DNA, 13 bp, Homo sapiens
tcatataaaaggt

SEQ ID NO: 4190140 - DNA, 19 bp, Homo sapiens
tcatataaaaggtgagctc

SEQ ID NO: 4190141 - DNA, 22 bp, Homo sapiens
tcatataaaaggtgagctcagc

SEQ ID NO: 4190142 - DNA, 18 bp, Homo sapiens
tcatataaagtatcatca

SEQ ID NO: 4190143 - DNA, 15 bp, Homo sapiens
tcatattttgtatat

SEQ ID NO: 4190144 - DNA, 22 bp, Homo sapiens
tcatcaccatcgtgtttgcaaa

SEQ ID NO: 4190145 - DNA, 20 bp, Homo sapiens
tcatcactacctttatagct

SEQ ID NO: 4190146 - DNA, 15 bp, Homo sapiens
tcatcacttttcagt

SEQ ID NO: 4190147 - DNA, 21 bp, Homo sapiens
tcatcagcatttaataaatgt

SEQ ID NO: 4190148 - DNA, 18 bp, Homo sapiens
tcatccccttgtgtcaga

SEQ ID NO: 4190149 - DNA, 20 bp, Homo sapiens
tcatctggcttttcgcttgc

SEQ ID NO: 4190150 - DNA, 19 bp, Homo sapiens
tcatctgtgtgaaaatggg

SEQ ID NO: 4190151 - DNA, 14 bp, Homo sapiens
tcatgacatgttat

SEQ ID NO: 4190152 - DNA, 19 bp, Homo sapiens
tcatgacatgttatatatt

SEQ ID NO: 4190153 - DNA, 17 bp, Homo sapiens
tcatgaggaaagacaca

SEQ ID NO: 4190154 - DNA, 21 bp, Homo sapiens
tcatgaggaggtcagcccatt

SEQ ID NO: 4190155 - DNA, 17 bp, Homo sapiens
tcatgatagtgtgattt

SEQ ID NO: 4190156 - DNA, 17 bp, Homo sapiens
tcatgccaaagcaaaag

SEQ ID NO: 4190157 - DNA, 20 bp, Homo sapiens
tcatgccaaagcaaaagaag

SEQ ID NO: 4190158 - DNA, 19 bp, Homo sapiens
tcatgcctggcccccctcc

SEQ ID NO: 4190159 - DNA, 19 bp, Homo sapiens
tcatggaagccaccagtga

SEQ ID NO: 4190160 - DNA, 17 bp, Homo sapiens
tcatgtaaattttgtat

SEQ ID NO: 4190161 - DNA, 15 bp, Homo sapiens
tcatgtgtgctgtgc

SEQ ID NO: 4190162 - DNA, 20 bp, Homo sapiens
tcatgtgtttaaattatttt

SEQ ID NO: 4190163 - DNA, 13 bp, Homo sapiens
tcatgttcctcaa

SEQ ID NO: 4190164 - DNA, 13 bp, Homo sapiens
tcatgttggtcaa

SEQ ID NO: 4190165 - DNA, 19 bp, Homo sapiens
tcattaaactttttttgtc

SEQ ID NO: 4190166 - DNA, 12 bp, Homo sapiens
tcattactataa

SEQ ID NO: 4190167 - DNA, 16 bp, Homo sapiens
tcattcaggtgttctc

SEQ ID NO: 4190168 - DNA, 12 bp, Homo sapiens
tcattcccctcg

SEQ ID NO: 4190169 - DNA, 14 bp, Homo sapiens
tcattgtagagctt

SEQ ID NO: 4190170 - DNA, 23 bp, Homo sapiens
tcattgtagagcttggtggctga

SEQ ID NO: 4190171 - DNA, 15 bp, Homo sapiens
tcattgtcgctcagc

SEQ ID NO: 4190172 - DNA, 18 bp, Homo sapiens
tcattgtgcttaataata

SEQ ID NO: 4190173 - DNA, 19 bp, Homo sapiens
tcattgtgcttaataatac

SEQ ID NO: 4190174 - DNA, 15 bp, Homo sapiens
tcatttctactgtga

SEQ ID NO: 4190175 - DNA, 13 bp, Homo sapiens
tcatttgcttttt

SEQ ID NO: 4190176 - DNA, 18 bp, Homo sapiens
tcatttggttcaggcata

SEQ ID NO: 4190177 - DNA, 23 bp, Homo sapiens
tcatttggttcaggcataaatta

SEQ ID NO: 4190178 - DNA, 13 bp, Homo sapiens
tcattttaattta

SEQ ID NO: 4190179 - DNA, 14 bp, Homo sapiens
tcattttaatttat

SEQ ID NO: 4190180 - DNA, 14 bp, Homo sapiens
tccaaacctggttc

SEQ ID NO: 4190181 - DNA, 12 bp, Homo sapiens
tccaaagataat

SEQ ID NO: 4190182 - DNA, 13 bp, Homo sapiens
tccaaagataatg

SEQ ID NO: 4190183 - DNA, 20 bp, Homo sapiens
tccaagggtatgggaagcca

SEQ ID NO: 4190184 - DNA, 21 bp, Homo sapiens
tccaagggtatgggaagccat

SEQ ID NO: 4190185 - DNA, 14 bp, Homo sapiens
tccaagtcaacact

SEQ ID NO: 4190186 - DNA, 13 bp, Homo sapiens
tccaagtctagct

SEQ ID NO: 4190187 - DNA, 19 bp, Homo sapiens
tccaagttcctgcactcca

SEQ ID NO: 4190188 - DNA, 23 bp, Homo sapiens
tccaagttcctgcactccagaat

SEQ ID NO: 4190189 - DNA, 12 bp, Homo sapiens
tccaatataaat

SEQ ID NO: 4190190 - DNA, 14 bp, Homo sapiens
tccaatctgtaatt

SEQ ID NO: 4190191 - DNA, 17 bp, Homo sapiens
tccaatctgtaatttca

SEQ ID NO: 4190192 - DNA, 18 bp, Homo sapiens
tccaatctgtaatttcac

SEQ ID NO: 4190193 - DNA, 22 bp, Homo sapiens
tccaattataagaggatatgaa

SEQ ID NO: 4190194 - DNA, 23 bp, Homo sapiens
tccacaaagccgtgcctttctct

SEQ ID NO: 4190195 - DNA, 15 bp, Homo sapiens
tccacacacgcagga

SEQ ID NO: 4190196 - DNA, 20 bp, Homo sapiens
tccacagaaacattttcatt

SEQ ID NO: 4190197 - DNA, 16 bp, Homo sapiens
tccacagccgcagcct

SEQ ID NO: 4190198 - DNA, 18 bp, Homo sapiens
tccacagccgcagcctcc

SEQ ID NO: 4190199 - DNA, 22 bp, Homo sapiens
tccacagttcgacctgcggctg

SEQ ID NO: 4190200 - DNA, 12 bp, Homo sapiens
tccaccagaccc

SEQ ID NO: 4190201 - DNA, 13 bp, Homo sapiens
tccaccagaccca

SEQ ID NO: 4190202 - DNA, 14 bp, Homo sapiens
tccaccccctccag

SEQ ID NO: 4190203 - DNA, 19 bp, Homo sapiens
tccaccccctccagctcca

SEQ ID NO: 4190204 - DNA, 12 bp, Homo sapiens
tccaccctggaa

SEQ ID NO: 4190205 - DNA, 18 bp, Homo sapiens
tccaccgcagaaggaagg

SEQ ID NO: 4190206 - DNA, 15 bp, Homo sapiens
tccacgcacacatgg

SEQ ID NO: 4190207 - DNA, 19 bp, Homo sapiens
tccactccaagatgccctc

SEQ ID NO: 4190208 - DNA, 16 bp, Homo sapiens
tccactccatatttat

SEQ ID NO: 4190209 - DNA, 19 bp, Homo sapiens
tccacttagttttgggagg

SEQ ID NO: 4190210 - DNA, 14 bp, Homo sapiens
tccagaaaacaaaa

SEQ ID NO: 4190211 - DNA, 23 bp, Homo sapiens
tccagaaagaaggacacttgtat

SEQ ID NO: 4190212 - DNA, 18 bp, Homo sapiens
tccagaagtggggctctg

SEQ ID NO: 4190213 - DNA, 19 bp, Homo sapiens
tccagaagtggggctctgg

SEQ ID NO: 4190214 - DNA, 23 bp, Homo sapiens
tccagaagtggggctctgggagg

SEQ ID NO: 4190215 - DNA, 22 bp, Homo sapiens
tccagaataaaacgcaaagggc

SEQ ID NO: 4190216 - DNA, 16 bp, Homo sapiens
tccagagagaggatgc

SEQ ID NO: 4190217 - DNA, 19 bp, Homo sapiens
tccagagagaggatgcaga

SEQ ID NO: 4190218 - DNA, 18 bp, Homo sapiens
tccagagagcaaacatag

SEQ ID NO: 4190219 - DNA, 21 bp, Homo sapiens
tccagagagcaaacataggaa

SEQ ID NO: 4190220 - DNA, 11 bp, Homo sapiens
tccagatctgc

SEQ ID NO: 4190221 - DNA, 20 bp, Homo sapiens
tccagatgccttcctgtctt

SEQ ID NO: 4190222 - DNA, 21 bp, Homo sapiens
tccagcacaactcagtctgtg

SEQ ID NO: 4190223 - DNA, 13 bp, Homo sapiens
tccagcatttgcc

SEQ ID NO: 4190224 - DNA, 11 bp, Homo sapiens
tccagcctggg

SEQ ID NO: 4190225 - DNA, 17 bp, Homo sapiens
tccagcctgggcgacag

SEQ ID NO: 4190226 - DNA, 22 bp, Homo sapiens
tccagcctgggcgacagagcaa

SEQ ID NO: 4190227 - DNA, 14 bp, Homo sapiens
tccagctgcctggg

SEQ ID NO: 4190228 - DNA, 16 bp, Homo sapiens
tccagctgcctgggag

SEQ ID NO: 4190229 - DNA, 16 bp, Homo sapiens
tccaggaataggcatt

SEQ ID NO: 4190230 - DNA, 21 bp, Homo sapiens
tccaggatctttgactgaaaa

SEQ ID NO: 4190231 - DNA, 18 bp, Homo sapiens
tccaggattggcctgtgt

SEQ ID NO: 4190232 - DNA, 19 bp, Homo sapiens
tccaggattggcctgtgtc

SEQ ID NO: 4190233 - DNA, 13 bp, Homo sapiens
tccaggcaggagg

SEQ ID NO: 4190234 - DNA, 14 bp, Homo sapiens
tccaggcaggagga

SEQ ID NO: 4190235 - DNA, 17 bp, Homo sapiens
tccaggcatgctggcct

SEQ ID NO: 4190236 - DNA, 19 bp, Homo sapiens
tccaggcatgctggcctcc

SEQ ID NO: 4190237 - DNA, 14 bp, Homo sapiens
tccagggctgcccc

SEQ ID NO: 4190238 - DNA, 18 bp, Homo sapiens
tccagggtctaaagagaa

SEQ ID NO: 4190239 - DNA, 16 bp, Homo sapiens
tccaggtcaccagcct

SEQ ID NO: 4190240 - DNA, 20 bp, Homo sapiens
tccaggtcaccagcctgact

SEQ ID NO: 4190241 - DNA, 22 bp, Homo sapiens
tccagtaggtaatgattatgtg

SEQ ID NO: 4190242 - DNA, 15 bp, Homo sapiens
tccagtgcaacaaaa

SEQ ID NO: 4190243 - DNA, 19 bp, Homo sapiens
tccagtggtgaagaaaact

SEQ ID NO: 4190244 - DNA, 16 bp, Homo sapiens
tccagttgttactgaa

SEQ ID NO: 4190245 - DNA, 15 bp, Homo sapiens
tccagtttcagaagc

SEQ ID NO: 4190246 - DNA, 17 bp, Homo sapiens
tccagtttcagaagcag

SEQ ID NO: 4190247 - DNA, 13 bp, Homo sapiens
tccagtttcccac

SEQ ID NO: 4190248 - DNA, 16 bp, Homo sapiens
tccataatcaatctat

SEQ ID NO: 4190249 - DNA, 20 bp, Homo sapiens
tccatacagtcaagatacat

SEQ ID NO: 4190250 - DNA, 21 bp, Homo sapiens
tccatacagtcaagatacata

SEQ ID NO: 4190251 - DNA, 14 bp, Homo sapiens
tccatatgctccag

SEQ ID NO: 4190252 - DNA, 20 bp, Homo sapiens
tccatgagggtttcattgtg

SEQ ID NO: 4190253 - DNA, 16 bp, Homo sapiens
tccatgatactttaat

SEQ ID NO: 4190254 - DNA, 21 bp, Homo sapiens
tccatgcctgtagctttcctg

SEQ ID NO: 4190255 - DNA, 22 bp, Homo sapiens
tccatgcctgtagctttcctgg

SEQ ID NO: 4190256 - DNA, 23 bp, Homo sapiens
tccatgcctgtagctttcctggt

SEQ ID NO: 4190257 - DNA, 18 bp, Homo sapiens
tccatggcaggaaggctt

SEQ ID NO: 4190258 - DNA, 14 bp, Homo sapiens
tccatgtccctgta

SEQ ID NO: 4190259 - DNA, 19 bp, Homo sapiens
tccatgtttgtaaaactac

SEQ ID NO: 4190260 - DNA, 20 bp, Homo sapiens
tccattcctaggtcacttga

SEQ ID NO: 4190261 - DNA, 17 bp, Homo sapiens
tccatttcaactccaga

SEQ ID NO: 4190262 - DNA, 17 bp, Homo sapiens
tccatttctcagtggct

SEQ ID NO: 4190263 - DNA, 20 bp, Homo sapiens
tccatttggacaaaatggaa

SEQ ID NO: 4190264 - DNA, 14 bp, Homo sapiens
tcccaacctcccct

SEQ ID NO: 4190265 - DNA, 16 bp, Homo sapiens
tcccaacctcccctgg

SEQ ID NO: 4190266 - DNA, 14 bp, Homo sapiens
tcccaactgctctg

SEQ ID NO: 4190267 - DNA, 13 bp, Homo sapiens
tcccaagagctac

SEQ ID NO: 4190268 - DNA, 14 bp, Homo sapiens
tcccaataaagctg

SEQ ID NO: 4190269 - DNA, 16 bp, Homo sapiens
tcccaataaagctgga

SEQ ID NO: 4190270 - DNA, 21 bp, Homo sapiens
tcccaccaccttggactcctc

SEQ ID NO: 4190271 - DNA, 16 bp, Homo sapiens
tcccacccacctcacc

SEQ ID NO: 4190272 - DNA, 21 bp, Homo sapiens
tcccacttactttaatgcgaa

SEQ ID NO: 4190273 - DNA, 12 bp, Homo sapiens
tcccagaaatta

SEQ ID NO: 4190274 - DNA, 21 bp, Homo sapiens
tcccagcgtgtgtatccgact

SEQ ID NO: 4190275 - DNA, 16 bp, Homo sapiens
tcccagctactcagaa

SEQ ID NO: 4190276 - DNA, 17 bp, Homo sapiens
tcccagggccagggccc

SEQ ID NO: 4190277 - DNA, 22 bp, Homo sapiens
tcccagggccagggccctgcag

SEQ ID NO: 4190278 - DNA, 23 bp, Homo sapiens
tcccagggccagggccctgcaga

SEQ ID NO: 4190279 - DNA, 12 bp, Homo sapiens
tcccagggtcct

SEQ ID NO: 4190280 - DNA, 23 bp, Homo sapiens
tcccagtgtgtgtttaacattca

SEQ ID NO: 4190281 - DNA, 14 bp, Homo sapiens
tcccatggccttcc

SEQ ID NO: 4190282 - DNA, 18 bp, Homo sapiens
tcccattttggaagtttt

SEQ ID NO: 4190283 - DNA, 15 bp, Homo sapiens
tccccaccttcccca

SEQ ID NO: 4190284 - DNA, 22 bp, Homo sapiens
tccccactccctggctctcaga

SEQ ID NO: 4190285 - DNA, 19 bp, Homo sapiens
tccccactgtatctaggca

SEQ ID NO: 4190286 - DNA, 17 bp, Homo sapiens
tccccagactcagctcc

SEQ ID NO: 4190287 - DNA, 14 bp, Homo sapiens
tccccaggccaggc

SEQ ID NO: 4190288 - DNA, 15 bp, Homo sapiens
tcccccagagccact

SEQ ID NO: 4190289 - DNA, 18 bp, Homo sapiens
tcccccatcccctttcct

SEQ ID NO: 4190290 - DNA, 20 bp, Homo sapiens
tcccccatcccctttcctcc

SEQ ID NO: 4190291 - DNA, 18 bp, Homo sapiens
tcccccgattcagagact

SEQ ID NO: 4190292 - DNA, 17 bp, Homo sapiens
tccccctcccagggcca

SEQ ID NO: 4190293 - DNA, 18 bp, Homo sapiens
tccccctcccagggccag

SEQ ID NO: 4190294 - DNA, 19 bp, Homo sapiens
tccccctcccagggccagg

SEQ ID NO: 4190295 - DNA, 14 bp, Homo sapiens
tccccctgggctct

SEQ ID NO: 4190296 - DNA, 15 bp, Homo sapiens
tccccctgggctctg

SEQ ID NO: 4190297 - DNA, 23 bp, Homo sapiens
tccccctgggctctgccccagct

SEQ ID NO: 4190298 - DNA, 16 bp, Homo sapiens
tccccgcctgtcctgc

SEQ ID NO: 4190299 - DNA, 12 bp, Homo sapiens
tccccggcctca

SEQ ID NO: 4190300 - DNA, 19 bp, Homo sapiens
tccccgtgtcctctccctg

SEQ ID NO: 4190301 - DNA, 22 bp, Homo sapiens
tccccgtgtcctctccctgcca

SEQ ID NO: 4190302 - DNA, 15 bp, Homo sapiens
tcccctgccctgctg

SEQ ID NO: 4190303 - DNA, 14 bp, Homo sapiens
tcccctgggcctgg

SEQ ID NO: 4190304 - DNA, 16 bp, Homo sapiens
tcccctggtcctgcac

SEQ ID NO: 4190305 - DNA, 18 bp, Homo sapiens
tcccctggtcctgcactg

SEQ ID NO: 4190306 - DNA, 14 bp, Homo sapiens
tcccgccaccctca

SEQ ID NO: 4190307 - DNA, 19 bp, Homo sapiens
tcccgccaccctcaataaa

SEQ ID NO: 4190308 - DNA, 19 bp, Homo sapiens
tcccgcctcttcttcttca

SEQ ID NO: 4190309 - DNA, 21 bp, Homo sapiens
tcccgcctcttcttcttcaga

SEQ ID NO: 4190310 - DNA, 15 bp, Homo sapiens
tcccggttcaccttg

SEQ ID NO: 4190311 - DNA, 19 bp, Homo sapiens
tccctacttttcaagagtg

SEQ ID NO: 4190312 - DNA, 23 bp, Homo sapiens
tccctagatctttctattccaaa

SEQ ID NO: 4190313 - DNA, 17 bp, Homo sapiens
tccctaggagggaagga

SEQ ID NO: 4190314 - DNA, 20 bp, Homo sapiens
tccctaggagggaaggagct

SEQ ID NO: 4190315 - DNA, 15 bp, Homo sapiens
tccctatactgcttg

SEQ ID NO: 4190316 - DNA, 15 bp, Homo sapiens
tccctcacccccatg

SEQ ID NO: 4190317 - DNA, 23 bp, Homo sapiens
tccctccccctagcaaggtccag

SEQ ID NO: 4190318 - DNA, 16 bp, Homo sapiens
tccctcctggagcatc

SEQ ID NO: 4190319 - DNA, 12 bp, Homo sapiens
tccctccttccc

SEQ ID NO: 4190320 - DNA, 23 bp, Homo sapiens
tccctctcctctcctcctctgtg

SEQ ID NO: 4190321 - DNA, 20 bp, Homo sapiens
tccctctttctacattctca

SEQ ID NO: 4190322 - DNA, 24 bp, Homo sapiens
tccctgacgacactgaagaatcaa

SEQ ID NO: 4190323 - DNA, 16 bp, Homo sapiens
tccctgactctctgtg

SEQ ID NO: 4190324 - DNA, 18 bp, Homo sapiens
tccctgagggcccttccc

SEQ ID NO: 4190325 - DNA, 18 bp, Homo sapiens
tccctggcatgtcagagc

SEQ ID NO: 4190326 - DNA, 23 bp, Homo sapiens
tccctggcatgtcagagccaggc

SEQ ID NO: 4190327 - DNA, 11 bp, Homo sapiens
tccctggccca

SEQ ID NO: 4190328 - DNA, 13 bp, Homo sapiens
tccctggcccagc

SEQ ID NO: 4190329 - DNA, 14 bp, Homo sapiens
tccctggcccagcc

SEQ ID NO: 4190330 - DNA, 17 bp, Homo sapiens
tccctggcccagccagc

SEQ ID NO: 4190331 - DNA, 20 bp, Homo sapiens
tccctgtgttaactcaggat

SEQ ID NO: 4190332 - DNA, 14 bp, Homo sapiens
tcccttaatatcct

SEQ ID NO: 4190333 - DNA, 21 bp, Homo sapiens
tcccttaatatcctaaacatc

SEQ ID NO: 4190334 - DNA, 14 bp, Homo sapiens
tcccttctctcctt

SEQ ID NO: 4190335 - DNA, 13 bp, Homo sapiens
tcccttgtgtgtg

SEQ ID NO: 4190336 - DNA, 17 bp, Homo sapiens
tccctttaaagcctttt

SEQ ID NO: 4190337 - DNA, 20 bp, Homo sapiens
tccgactctaagctgtgtgc

SEQ ID NO: 4190338 - DNA, 12 bp, Homo sapiens
tccgagaacaac

SEQ ID NO: 4190339 - DNA, 14 bp, Homo sapiens
tccgagaacaacag

SEQ ID NO: 4190340 - DNA, 15 bp, Homo sapiens
tccgcctgcagagga

SEQ ID NO: 4190341 - DNA, 19 bp, Homo sapiens
tccgcgagggctactcagc

SEQ ID NO: 4190342 - DNA, 23 bp, Homo sapiens
tccggaggggacccagctcctct

SEQ ID NO: 4190343 - DNA, 21 bp, Homo sapiens
tccggaggggttgcgggggag

SEQ ID NO: 4190344 - DNA, 16 bp, Homo sapiens
tccggctgctcctcca

SEQ ID NO: 4190345 - DNA, 20 bp, Homo sapiens
tccgggccgggcggaagggg

SEQ ID NO: 4190346 - DNA, 14 bp, Homo sapiens
tccgggtgccattc

SEQ ID NO: 4190347 - DNA, 15 bp, Homo sapiens
tccgtctgtgtatgt

SEQ ID NO: 4190348 - DNA, 21 bp, Homo sapiens
tcctaaacatcattcattttt

SEQ ID NO: 4190349 - DNA, 19 bp, Homo sapiens
tcctaaacccccgctccag

SEQ ID NO: 4190350 - DNA, 21 bp, Homo sapiens
tcctaaacccccgctccagat

SEQ ID NO: 4190351 - DNA, 17 bp, Homo sapiens
tcctacctcagcctaga

SEQ ID NO: 4190352 - DNA, 16 bp, Homo sapiens
tcctatacatttctgt

SEQ ID NO: 4190353 - DNA, 21 bp, Homo sapiens
tcctattgtgcaatgtaaata

SEQ ID NO: 4190354 - DNA, 18 bp, Homo sapiens
tcctatttggggcttgca

SEQ ID NO: 4190355 - DNA, 16 bp, Homo sapiens
tcctattttggagtgg

SEQ ID NO: 4190356 - DNA, 22 bp, Homo sapiens
tcctcaaagcacctgaaccact

SEQ ID NO: 4190357 - DNA, 18 bp, Homo sapiens
tcctcacagcctctccct

SEQ ID NO: 4190358 - DNA, 19 bp, Homo sapiens
tcctcacagcctctccctt

SEQ ID NO: 4190359 - DNA, 13 bp, Homo sapiens
tcctcaggaacag

SEQ ID NO: 4190360 - DNA, 17 bp, Homo sapiens
tcctccactccacctcc

SEQ ID NO: 4190361 - DNA, 19 bp, Homo sapiens
tcctcccagcgtgtgtatc

SEQ ID NO: 4190362 - DNA, 18 bp, Homo sapiens
tcctcccatggccttccc

SEQ ID NO: 4190363 - DNA, 14 bp, Homo sapiens
tcctccccaccttc

SEQ ID NO: 4190364 - DNA, 19 bp, Homo sapiens
tcctccccaccttccccag

SEQ ID NO: 4190365 - DNA, 15 bp, Homo sapiens
tcctcccccagagcc

SEQ ID NO: 4190366 - DNA, 19 bp, Homo sapiens
tcctccctgggcagaaagt

SEQ ID NO: 4190367 - DNA, 20 bp, Homo sapiens
tcctccctgttatctgctag

SEQ ID NO: 4190368 - DNA, 15 bp, Homo sapiens
tcctccttcccctgt

SEQ ID NO: 4190369 - DNA, 16 bp, Homo sapiens
tcctcggtactcccat

SEQ ID NO: 4190370 - DNA, 17 bp, Homo sapiens
tcctcggtactcccata

SEQ ID NO: 4190371 - DNA, 15 bp, Homo sapiens
tcctcgtgcagagct

SEQ ID NO: 4190372 - DNA, 13 bp, Homo sapiens
tcctctccctgcc

SEQ ID NO: 4190373 - DNA, 15 bp, Homo sapiens
tcctctgcaaaaaga

SEQ ID NO: 4190374 - DNA, 14 bp, Homo sapiens
tcctctgcagcact

SEQ ID NO: 4190375 - DNA, 19 bp, Homo sapiens
tcctctgggcagcgctatc

SEQ ID NO: 4190376 - DNA, 22 bp, Homo sapiens
tcctctgtttctccttctgaaa

SEQ ID NO: 4190377 - DNA, 19 bp, Homo sapiens
tcctcttataacttctgaa

SEQ ID NO: 4190378 - DNA, 21 bp, Homo sapiens
tcctctttctctccttcttcc

SEQ ID NO: 4190379 - DNA, 21 bp, Homo sapiens
tcctgaatttattattgttct

SEQ ID NO: 4190380 - DNA, 23 bp, Homo sapiens
tcctgactcggtcaaaatatttt

SEQ ID NO: 4190381 - DNA, 23 bp, Homo sapiens
tcctgagaataagaaagtttcac

SEQ ID NO: 4190382 - DNA, 23 bp, Homo sapiens
tcctgatgaaaaatatgtgcttg

SEQ ID NO: 4190383 - DNA, 20 bp, Homo sapiens
tcctgcaatctccagggctg

SEQ ID NO: 4190384 - DNA, 18 bp, Homo sapiens
tcctgccattcttctggt

SEQ ID NO: 4190385 - DNA, 12 bp, Homo sapiens
tcctgcctctct

SEQ ID NO: 4190386 - DNA, 14 bp, Homo sapiens
tcctgcctctctgc

SEQ ID NO: 4190387 - DNA, 18 bp, Homo sapiens
tcctgcctctctgctcca

SEQ ID NO: 4190388 - DNA, 19 bp, Homo sapiens
tcctgcctctctgctccag

SEQ ID NO: 4190389 - DNA, 20 bp, Homo sapiens
tcctgcctctctgctccaga

SEQ ID NO: 4190390 - DNA, 17 bp, Homo sapiens
tcctgctacacaaaagc

SEQ ID NO: 4190391 - DNA, 16 bp, Homo sapiens
tcctgctgccagagaa

SEQ ID NO: 4190392 - DNA, 19 bp, Homo sapiens
tcctgctgccagagaacca

SEQ ID NO: 4190393 - DNA, 14 bp, Homo sapiens
tcctgctgctgtgt

SEQ ID NO: 4190394 - DNA, 18 bp, Homo sapiens
tcctggagcatcccaggc

SEQ ID NO: 4190395 - DNA, 19 bp, Homo sapiens
tcctggagcatcccaggcg

SEQ ID NO: 4190396 - DNA, 19 bp, Homo sapiens
tcctggagggggcaagcct

SEQ ID NO: 4190397 - DNA, 16 bp, Homo sapiens
tcctggctcccagggt

SEQ ID NO: 4190398 - DNA, 23 bp, Homo sapiens
tcctgggagaacctcaggcttcc

SEQ ID NO: 4190399 - DNA, 23 bp, Homo sapiens
tcctgggggcccattctgcatgc

SEQ ID NO: 4190400 - DNA, 14 bp, Homo sapiens
tcctgggggctgct

SEQ ID NO: 4190401 - DNA, 19 bp, Homo sapiens
tcctgggggctgctgcact

SEQ ID NO: 4190402 - DNA, 18 bp, Homo sapiens
tcctggtacagcagggtc

SEQ ID NO: 4190403 - DNA, 23 bp, Homo sapiens
tcctggtacagcagggtcttgct

SEQ ID NO: 4190404 - DNA, 18 bp, Homo sapiens
tcctggtgaggcccagcc

SEQ ID NO: 4190405 - DNA, 21 bp, Homo sapiens
tcctggtgaggcccagcctgt

SEQ ID NO: 4190406 - DNA, 21 bp, Homo sapiens
tcctgtattcagacagatgag

SEQ ID NO: 4190407 - DNA, 19 bp, Homo sapiens
tcctgtcctggctcccagg

SEQ ID NO: 4190408 - DNA, 23 bp, Homo sapiens
tccttaaaggcaccatctaatag

SEQ ID NO: 4190409 - DNA, 18 bp, Homo sapiens
tccttaattcactcccac

SEQ ID NO: 4190410 - DNA, 23 bp, Homo sapiens
tccttaccaaggataattaaata

SEQ ID NO: 4190411 - DNA, 18 bp, Homo sapiens
tccttaccccagctgcgg

SEQ ID NO: 4190412 - DNA, 17 bp, Homo sapiens
tccttagatctggcatg

SEQ ID NO: 4190413 - DNA, 18 bp, Homo sapiens
tccttagatctggcatgt

SEQ ID NO: 4190414 - DNA, 18 bp, Homo sapiens
tccttattatcccagctt

SEQ ID NO: 4190415 - DNA, 23 bp, Homo sapiens
tccttattatcccagcttgctga

SEQ ID NO: 4190416 - DNA, 19 bp, Homo sapiens
tccttattgtttgtaaaca

SEQ ID NO: 4190417 - DNA, 18 bp, Homo sapiens
tccttcaacaattctaaa

SEQ ID NO: 4190418 - DNA, 18 bp, Homo sapiens
tccttcaagttagctcag

SEQ ID NO: 4190419 - DNA, 19 bp, Homo sapiens
tccttcaagttagctcagg

SEQ ID NO: 4190420 - DNA, 13 bp, Homo sapiens
tccttccaggccc

SEQ ID NO: 4190421 - DNA, 22 bp, Homo sapiens
tccttcccccatcccctttcct

SEQ ID NO: 4190422 - DNA, 17 bp, Homo sapiens
tccttcccctttcccca

SEQ ID NO: 4190423 - DNA, 9 bp, Homo sapiens
tccttccct

SEQ ID NO: 4190424 - DNA, 15 bp, Homo sapiens
tccttccctaaagac

SEQ ID NO: 4190425 - DNA, 16 bp, Homo sapiens
tccttccgctccttta

SEQ ID NO: 4190426 - DNA, 18 bp, Homo sapiens
tccttccgctcctttacc

SEQ ID NO: 4190427 - DNA, 21 bp, Homo sapiens
tccttcctacacccttggact

SEQ ID NO: 4190428 - DNA, 12 bp, Homo sapiens
tccttctgcctt

SEQ ID NO: 4190429 - DNA, 20 bp, Homo sapiens
tccttctttctcttccctcc

SEQ ID NO: 4190430 - DNA, 18 bp, Homo sapiens
tccttgaccactggccct

SEQ ID NO: 4190431 - DNA, 20 bp, Homo sapiens
tccttgaccactggccctgg

SEQ ID NO: 4190432 - DNA, 13 bp, Homo sapiens
tccttgagcattt

SEQ ID NO: 4190433 - DNA, 16 bp, Homo sapiens
tccttgctctgcaggc

SEQ ID NO: 4190434 - DNA, 17 bp, Homo sapiens
tccttgctgtcctaggc

SEQ ID NO: 4190435 - DNA, 20 bp, Homo sapiens
tccttggagagcagctggct

SEQ ID NO: 4190436 - DNA, 21 bp, Homo sapiens
tccttggtgtgaccctctgaa

SEQ ID NO: 4190437 - DNA, 14 bp, Homo sapiens
tccttgtcactgaa

SEQ ID NO: 4190438 - DNA, 12 bp, Homo sapiens
tccttgtgattg

SEQ ID NO: 4190439 - DNA, 13 bp, Homo sapiens
tccttgtgattga

SEQ ID NO: 4190440 - DNA, 15 bp, Homo sapiens
tcctttacctaccac

SEQ ID NO: 4190441 - DNA, 23 bp, Homo sapiens
tcctttcagggaatttcaggaac

SEQ ID NO: 4190442 - DNA, 13 bp, Homo sapiens
tcctttgacattt

SEQ ID NO: 4190443 - DNA, 14 bp, Homo sapiens
tcctttggaacaat

SEQ ID NO: 4190444 - DNA, 15 bp, Homo sapiens
tccttttcttccttc

SEQ ID NO: 4190445 - DNA, 13 bp, Homo sapiens
tccttttgcttga

SEQ ID NO: 4190446 - DNA, 18 bp, Homo sapiens
tccttttgtgtacagtgt

SEQ ID NO: 4190447 - DNA, 22 bp, Homo sapiens
tcctttttgcagtatatttctg

SEQ ID NO: 4190448 - DNA, 15 bp, Homo sapiens
tcgaattaatagctt

SEQ ID NO: 4190449 - DNA, 14 bp, Homo sapiens
tcgaccccaaagcc

SEQ ID NO: 4190450 - DNA, 22 bp, Homo sapiens
tcgacctgcggctgctgtgtgc

SEQ ID NO: 4190451 - DNA, 17 bp, Homo sapiens
tcgagaccagcctggcc

SEQ ID NO: 4190452 - DNA, 15 bp, Homo sapiens
tcgaggtgtcaccct

SEQ ID NO: 4190453 - DNA, 20 bp, Homo sapiens
tcgaggtgtcaccctgcaga

SEQ ID NO: 4190454 - DNA, 23 bp, Homo sapiens
tcgaggtgtcaccctgcagagct

SEQ ID NO: 4190455 - DNA, 23 bp, Homo sapiens
tcgcccacaagccttactcacct

SEQ ID NO: 4190456 - DNA, 12 bp, Homo sapiens
tcgcctgtggga

SEQ ID NO: 4190457 - DNA, 11 bp, Homo sapiens
tcgctgtcctt

SEQ ID NO: 4190458 - DNA, 14 bp, Homo sapiens
tcgcttgcttctgc

SEQ ID NO: 4190459 - DNA, 16 bp, Homo sapiens
tcgcttgcttctgcag

SEQ ID NO: 4190460 - DNA, 19 bp, Homo sapiens
tcggaaggctggctgggca

SEQ ID NO: 4190461 - DNA, 17 bp, Homo sapiens
tcggacctttcagctgt

SEQ ID NO: 4190462 - DNA, 19 bp, Homo sapiens
tcggcctcccaaagtgctg

SEQ ID NO: 4190463 - DNA, 19 bp, Homo sapiens
tcggcctcctaaagtgctg

SEQ ID NO: 4190464 - DNA, 19 bp, Homo sapiens
tcggctggggactgctacc

SEQ ID NO: 4190465 - DNA, 15 bp, Homo sapiens
tcgtaccagccagga

SEQ ID NO: 4190466 - DNA, 21 bp, Homo sapiens
tcgtcatgttggccaggctgg

SEQ ID NO: 4190467 - DNA, 13 bp, Homo sapiens
tcgtccagccctc

SEQ ID NO: 4190468 - DNA, 13 bp, Homo sapiens
tcgtccgctcagc

SEQ ID NO: 4190469 - DNA, 12 bp, Homo sapiens
tcgtggacacct

SEQ ID NO: 4190470 - DNA, 19 bp, Homo sapiens
tcgtggacacctgccctgc

SEQ ID NO: 4190471 - DNA, 15 bp, Homo sapiens
tcgtgggtgtgtgta

SEQ ID NO: 4190472 - DNA, 15 bp, Homo sapiens
tctaaagagaacaag

SEQ ID NO: 4190473 - DNA, 20 bp, Homo sapiens
tctaaagagaacaagaggtg

SEQ ID NO: 4190474 - DNA, 15 bp, Homo sapiens
tctaaagctttctga

SEQ ID NO: 4190475 - DNA, 13 bp, Homo sapiens
tctaaagtttaca

SEQ ID NO: 4190476 - DNA, 17 bp, Homo sapiens
tctaaagtttacagtaa

SEQ ID NO: 4190477 - DNA, 19 bp, Homo sapiens
tctaaagtttacagtaaat

SEQ ID NO: 4190478 - DNA, 15 bp, Homo sapiens
tctaaatcagaaata

SEQ ID NO: 4190479 - DNA, 22 bp, Homo sapiens
tctaacaataatatttcaagtg

SEQ ID NO: 4190480 - DNA, 15 bp, Homo sapiens
tctaactacaaggac

SEQ ID NO: 4190481 - DNA, 16 bp, Homo sapiens
tctaactacaaggaca

SEQ ID NO: 4190482 - DNA, 15 bp, Homo sapiens
tctaactcctgccat

SEQ ID NO: 4190483 - DNA, 15 bp, Homo sapiens
tctaagctgtgtgca

SEQ ID NO: 4190484 - DNA, 15 bp, Homo sapiens
tctaagttatgtacg

SEQ ID NO: 4190485 - DNA, 16 bp, Homo sapiens
tctaagttatgtacgt

SEQ ID NO: 4190486 - DNA, 21 bp, Homo sapiens
tctaatagcgggttactttca

SEQ ID NO: 4190487 - DNA, 17 bp, Homo sapiens
tctaatgtaagaaaatt

SEQ ID NO: 4190488 - DNA, 22 bp, Homo sapiens
tctaatgtaagaaaatttgaag

SEQ ID NO: 4190489 - DNA, 16 bp, Homo sapiens
tctacaagcatttgcc

SEQ ID NO: 4190490 - DNA, 23 bp, Homo sapiens
tctacaagcatttgccctgtgga

SEQ ID NO: 4190491 - DNA, 17 bp, Homo sapiens
tctacagacttctccag

SEQ ID NO: 4190492 - DNA, 16 bp, Homo sapiens
tctacagcatacagag

SEQ ID NO: 4190493 - DNA, 14 bp, Homo sapiens
tctacataatggaa

SEQ ID NO: 4190494 - DNA, 20 bp, Homo sapiens
tctacatttctgcagatctt

SEQ ID NO: 4190495 - DNA, 17 bp, Homo sapiens
tctacccggcccagaga

SEQ ID NO: 4190496 - DNA, 17 bp, Homo sapiens
tctagactttctcagtg

SEQ ID NO: 4190497 - DNA, 16 bp, Homo sapiens
tctagagaagaggctg

SEQ ID NO: 4190498 - DNA, 20 bp, Homo sapiens
tctagagattttcttggcag

SEQ ID NO: 4190499 - DNA, 16 bp, Homo sapiens
tctagcagcagatctg

SEQ ID NO: 4190500 - DNA, 22 bp, Homo sapiens
tctagcctttattattactgtt

SEQ ID NO: 4190501 - DNA, 18 bp, Homo sapiens
tctaggactgggggtctt

SEQ ID NO: 4190502 - DNA, 21 bp, Homo sapiens
tctaggcagttcaaagcagga

SEQ ID NO: 4190503 - DNA, 13 bp, Homo sapiens
tctagtagaaaga

SEQ ID NO: 4190504 - DNA, 19 bp, Homo sapiens
tctagtcacaaagactcct

SEQ ID NO: 4190505 - DNA, 15 bp, Homo sapiens
tctagtgatttcctg

SEQ ID NO: 4190506 - DNA, 22 bp, Homo sapiens
tctagttctcaatcactgctcc

SEQ ID NO: 4190507 - DNA, 22 bp, Homo sapiens
tctagtttggcacatgcaggta

SEQ ID NO: 4190508 - DNA, 16 bp, Homo sapiens
tctatactaccctggg

SEQ ID NO: 4190509 - DNA, 13 bp, Homo sapiens
tctatagagcctg

SEQ ID NO: 4190510 - DNA, 21 bp, Homo sapiens
tctataggtcatgatttctgt

SEQ ID NO: 4190511 - DNA, 19 bp, Homo sapiens
tctatagttattgttttat

SEQ ID NO: 4190512 - DNA, 11 bp, Homo sapiens
tctatatgaac

SEQ ID NO: 4190513 - DNA, 16 bp, Homo sapiens
tctatatgatcctgaa

SEQ ID NO: 4190514 - DNA, 20 bp, Homo sapiens
tctatgagttggacttcagt

SEQ ID NO: 4190515 - DNA, 19 bp, Homo sapiens
tctatgtatgttaatttat

SEQ ID NO: 4190516 - DNA, 20 bp, Homo sapiens
tctatgtatgttaatttatt

SEQ ID NO: 4190517 - DNA, 20 bp, Homo sapiens
tctattattataaaaataat

SEQ ID NO: 4190518 - DNA, 18 bp, Homo sapiens
tctcaaaataagttgaaa

SEQ ID NO: 4190519 - DNA, 24 bp, Homo sapiens
tctcaatcttcggggtgtgatgaa

SEQ ID NO: 4190520 - DNA, 17 bp, Homo sapiens
tctcactaaactttacc

SEQ ID NO: 4190521 - DNA, 22 bp, Homo sapiens
tctcagattgacctataaaaca

SEQ ID NO: 4190522 - DNA, 16 bp, Homo sapiens
tctcagcctacagcag

SEQ ID NO: 4190523 - DNA, 18 bp, Homo sapiens
tctcagcctacagcagtg

SEQ ID NO: 4190524 - DNA, 15 bp, Homo sapiens
tctcaggagcatggg

SEQ ID NO: 4190525 - DNA, 22 bp, Homo sapiens
tctcaggggccagtgagggctg

SEQ ID NO: 4190526 - DNA, 20 bp, Homo sapiens
tctcagtccagatgccttcc

SEQ ID NO: 4190527 - DNA, 17 bp, Homo sapiens
tctcatgcttcttctca

SEQ ID NO: 4190528 - DNA, 17 bp, Homo sapiens
tctcattccaacagtga

SEQ ID NO: 4190529 - DNA, 21 bp, Homo sapiens
tctccaccaactggagcactg

SEQ ID NO: 4190530 - DNA, 18 bp, Homo sapiens
tctccactgaggatgtga

SEQ ID NO: 4190531 - DNA, 17 bp, Homo sapiens
tctccagatagctgaat

SEQ ID NO: 4190532 - DNA, 19 bp, Homo sapiens
tctccaggtttgctgtgtc

SEQ ID NO: 4190533 - DNA, 13 bp, Homo sapiens
tctccccctgggc

SEQ ID NO: 4190534 - DNA, 19 bp, Homo sapiens
tctccccgtgtcctctccc

SEQ ID NO: 4190535 - DNA, 13 bp, Homo sapiens
tctcccctccctc

SEQ ID NO: 4190536 - DNA, 13 bp, Homo sapiens
tctccctccaggg

SEQ ID NO: 4190537 - DNA, 14 bp, Homo sapiens
tctccctgccaagt

SEQ ID NO: 4190538 - DNA, 23 bp, Homo sapiens
tctcctaaaacatgaaaattatc

SEQ ID NO: 4190539 - DNA, 13 bp, Homo sapiens
tctcctcccagcg

SEQ ID NO: 4190540 - DNA, 14 bp, Homo sapiens
tctcctcctctgtg

SEQ ID NO: 4190541 - DNA, 18 bp, Homo sapiens
tctcctctcctcctctgt

SEQ ID NO: 4190542 - DNA, 14 bp, Homo sapiens
tctccttacctgtg

SEQ ID NO: 4190543 - DNA, 19 bp, Homo sapiens
tctccttcccctttcccca

SEQ ID NO: 4190544 - DNA, 13 bp, Homo sapiens
tctcgatctcctg

SEQ ID NO: 4190545 - DNA, 19 bp, Homo sapiens
tctcgtggtagaagccagt

SEQ ID NO: 4190546 - DNA, 17 bp, Homo sapiens
tctctaactcctgccat

SEQ ID NO: 4190547 - DNA, 22 bp, Homo sapiens
tctctaagtttagaagcgctca

SEQ ID NO: 4190548 - DNA, 20 bp, Homo sapiens
tctctacagacttctccaga

SEQ ID NO: 4190549 - DNA, 19 bp, Homo sapiens
tctctacccggcccagaga

SEQ ID NO: 4190550 - DNA, 12 bp, Homo sapiens
tctctagccact

SEQ ID NO: 4190551 - DNA, 20 bp, Homo sapiens
tctctcaatatgcttacaaa

SEQ ID NO: 4190552 - DNA, 21 bp, Homo sapiens
tctctctaagtttagaagcgc

SEQ ID NO: 4190553 - DNA, 13 bp, Homo sapiens
tctctctctctgg

SEQ ID NO: 4190554 - DNA, 14 bp, Homo sapiens
tctctgaaacatat

SEQ ID NO: 4190555 - DNA, 18 bp, Homo sapiens
tctctgctccagagagag

SEQ ID NO: 4190556 - DNA, 16 bp, Homo sapiens
tctctgctgagcagcc

SEQ ID NO: 4190557 - DNA, 17 bp, Homo sapiens
tctctggcctcctgggg

SEQ ID NO: 4190558 - DNA, 19 bp, Homo sapiens
tctctggcctcctgggggc

SEQ ID NO: 4190559 - DNA, 14 bp, Homo sapiens
tctctggctccaga

SEQ ID NO: 4190560 - DNA, 12 bp, Homo sapiens
tctctgtacaaa

SEQ ID NO: 4190561 - DNA, 15 bp, Homo sapiens
tctcttactgcagta

SEQ ID NO: 4190562 - DNA, 14 bp, Homo sapiens
tctcttcatacttt

SEQ ID NO: 4190563 - DNA, 15 bp, Homo sapiens
tctgaacaattctct

SEQ ID NO: 4190564 - DNA, 16 bp, Homo sapiens
tctgaaccactttgcc

SEQ ID NO: 4190565 - DNA, 14 bp, Homo sapiens
tctgaactgttaca

SEQ ID NO: 4190566 - DNA, 19 bp, Homo sapiens
tctgaaggagattttcctt

SEQ ID NO: 4190567 - DNA, 18 bp, Homo sapiens
tctgaaggatcctggaac

SEQ ID NO: 4190568 - DNA, 23 bp, Homo sapiens
tctgaaggcgtcaacgtgcattt

SEQ ID NO: 4190569 - DNA, 13 bp, Homo sapiens
tctgaagtaattt

SEQ ID NO: 4190570 - DNA, 22 bp, Homo sapiens
tctgaagtaatttgtaaaaaag

SEQ ID NO: 4190571 - DNA, 21 bp, Homo sapiens
tctgacccagtgagattacag

SEQ ID NO: 4190572 - DNA, 17 bp, Homo sapiens
tctgacctgcaggccaa

SEQ ID NO: 4190573 - DNA, 19 bp, Homo sapiens
tctgacctgcaggccaaga

SEQ ID NO: 4190574 - DNA, 18 bp, Homo sapiens
tctgagaattccaaggag

SEQ ID NO: 4190575 - DNA, 23 bp, Homo sapiens
tctgagatccagcacaactcagt

SEQ ID NO: 4190576 - DNA, 17 bp, Homo sapiens
tctgagatctccctcca

SEQ ID NO: 4190577 - DNA, 16 bp, Homo sapiens
tctgagcaagagctgg

SEQ ID NO: 4190578 - DNA, 17 bp, Homo sapiens
tctgagcaagagctggc

SEQ ID NO: 4190579 - DNA, 14 bp, Homo sapiens
tctgagcaccccct

SEQ ID NO: 4190580 - DNA, 19 bp, Homo sapiens
tctgagcaccccctcattc

SEQ ID NO: 4190581 - DNA, 15 bp, Homo sapiens
tctgagcttcagtat

SEQ ID NO: 4190582 - DNA, 18 bp, Homo sapiens
tctgaggccccaggccct

SEQ ID NO: 4190583 - DNA, 18 bp, Homo sapiens
tctgattggctcacccaa

SEQ ID NO: 4190584 - DNA, 14 bp, Homo sapiens
tctgcagagtggtg

SEQ ID NO: 4190585 - DNA, 19 bp, Homo sapiens
tctgcagatcttccgtggt

SEQ ID NO: 4190586 - DNA, 14 bp, Homo sapiens
tctgcaggcacctt

SEQ ID NO: 4190587 - DNA, 16 bp, Homo sapiens
tctgcatctcattgta

SEQ ID NO: 4190588 - DNA, 14 bp, Homo sapiens
tctgccacagagag

SEQ ID NO: 4190589 - DNA, 15 bp, Homo sapiens
tctgccattgggacc

SEQ ID NO: 4190590 - DNA, 17 bp, Homo sapiens
tctgccattgggaccct

SEQ ID NO: 4190591 - DNA, 23 bp, Homo sapiens
tctgccattgggaccctccagtg

SEQ ID NO: 4190592 - DNA, 15 bp, Homo sapiens
tctgccccaccctca

SEQ ID NO: 4190593 - DNA, 14 bp, Homo sapiens
tctgccccagaggc

SEQ ID NO: 4190594 - DNA, 16 bp, Homo sapiens
tctgccccagctctgg

SEQ ID NO: 4190595 - DNA, 17 bp, Homo sapiens
tctgccccagctctggc

SEQ ID NO: 4190596 - DNA, 17 bp, Homo sapiens
tctgccttaggctgctg

SEQ ID NO: 4190597 - DNA, 16 bp, Homo sapiens
tctgctactttgctgc

SEQ ID NO: 4190598 - DNA, 17 bp, Homo sapiens
tctgctatattttcatg

SEQ ID NO: 4190599 - DNA, 20 bp, Homo sapiens
tctgctgagcagcccagcac

SEQ ID NO: 4190600 - DNA, 16 bp, Homo sapiens
tctgcttcttcatctt

SEQ ID NO: 4190601 - DNA, 18 bp, Homo sapiens
tctgcttcttcatcttga

SEQ ID NO: 4190602 - DNA, 15 bp, Homo sapiens
tctggaaaactcagg

SEQ ID NO: 4190603 - DNA, 19 bp, Homo sapiens
tctggaaaactcaggattc

SEQ ID NO: 4190604 - DNA, 14 bp, Homo sapiens
tctggaagaagagg

SEQ ID NO: 4190605 - DNA, 16 bp, Homo sapiens
tctggaagaagaggag

SEQ ID NO: 4190606 - DNA, 19 bp, Homo sapiens
tctggacaggatgtgtttg

SEQ ID NO: 4190607 - DNA, 21 bp, Homo sapiens
tctggagccaaggcagagggg

SEQ ID NO: 4190608 - DNA, 20 bp, Homo sapiens
tctggcaccactagggtcct

SEQ ID NO: 4190609 - DNA, 18 bp, Homo sapiens
tctggccctttctggacc

SEQ ID NO: 4190610 - DNA, 11 bp, Homo sapiens
tctggcctcca

SEQ ID NO: 4190611 - DNA, 13 bp, Homo sapiens
tctggctcctcct

SEQ ID NO: 4190612 - DNA, 15 bp, Homo sapiens
tctggctcctccttc

SEQ ID NO: 4190613 - DNA, 19 bp, Homo sapiens
tctggctgtgtggccaagg

SEQ ID NO: 4190614 - DNA, 15 bp, Homo sapiens
tctggcttagaaatt

SEQ ID NO: 4190615 - DNA, 15 bp, Homo sapiens
tctggcttctggcca

SEQ ID NO: 4190616 - DNA, 18 bp, Homo sapiens
tctggcttctggccagga

SEQ ID NO: 4190617 - DNA, 16 bp, Homo sapiens
tctgggagagcctggc

SEQ ID NO: 4190618 - DNA, 16 bp, Homo sapiens
tctgggccaagttcct

SEQ ID NO: 4190619 - DNA, 16 bp, Homo sapiens
tctggggctgggcctg

SEQ ID NO: 4190620 - DNA, 16 bp, Homo sapiens
tctgggtccctcggag

SEQ ID NO: 4190621 - DNA, 13 bp, Homo sapiens
tctggttttaaca

SEQ ID NO: 4190622 - DNA, 17 bp, Homo sapiens
tctgtaaccgcttctgg

SEQ ID NO: 4190623 - DNA, 14 bp, Homo sapiens
tctgtaagaaacct

SEQ ID NO: 4190624 - DNA, 22 bp, Homo sapiens
tctgtagtaatttattgtctgt

SEQ ID NO: 4190625 - DNA, 16 bp, Homo sapiens
tctgtcacccaggctg

SEQ ID NO: 4190626 - DNA, 17 bp, Homo sapiens
tctgtccaccagaccca

SEQ ID NO: 4190627 - DNA, 12 bp, Homo sapiens
tctgtccactct

SEQ ID NO: 4190628 - DNA, 15 bp, Homo sapiens
tctgtcctcagagca

SEQ ID NO: 4190629 - DNA, 14 bp, Homo sapiens
tctgtctgtcccaa

SEQ ID NO: 4190630 - DNA, 15 bp, Homo sapiens
tctgtctgtctgtcc

SEQ ID NO: 4190631 - DNA, 16 bp, Homo sapiens
tctgtgacccatctgt

SEQ ID NO: 4190632 - DNA, 18 bp, Homo sapiens
tctgtgtgatgaactttc

SEQ ID NO: 4190633 - DNA, 18 bp, Homo sapiens
tctgtgtgcaccttacca

SEQ ID NO: 4190634 - DNA, 22 bp, Homo sapiens
tctgtgtgcaccttaccaactt

SEQ ID NO: 4190635 - DNA, 16 bp, Homo sapiens
tctgtgttatttggac

SEQ ID NO: 4190636 - DNA, 23 bp, Homo sapiens
tctgttgagtgcaacaagagcaa

SEQ ID NO: 4190637 - DNA, 18 bp, Homo sapiens
tctgttgccacaaccctg

SEQ ID NO: 4190638 - DNA, 18 bp, Homo sapiens
tctgttttgtttcttgac

SEQ ID NO: 4190639 - DNA, 16 bp, Homo sapiens
tcttaaagctgcctgt

SEQ ID NO: 4190640 - DNA, 21 bp, Homo sapiens
tcttaaagctgcctgtagtta

SEQ ID NO: 4190641 - DNA, 18 bp, Homo sapiens
tcttaaataagaaacttt

SEQ ID NO: 4190642 - DNA, 19 bp, Homo sapiens
tcttaaataagaaactttt

SEQ ID NO: 4190643 - DNA, 15 bp, Homo sapiens
tcttactatttcaca

SEQ ID NO: 4190644 - DNA, 20 bp, Homo sapiens
tcttacttatcaaaagacag

SEQ ID NO: 4190645 - DNA, 21 bp, Homo sapiens
tcttataacttctgaagtaat

SEQ ID NO: 4190646 - DNA, 15 bp, Homo sapiens
tcttatcttctgcaa

SEQ ID NO: 4190647 - DNA, 17 bp, Homo sapiens
tcttatgcttataatat

SEQ ID NO: 4190648 - DNA, 21 bp, Homo sapiens
tcttattcatgctttctcctt

SEQ ID NO: 4190649 - DNA, 23 bp, Homo sapiens
tcttattcatgctttctcctttt

SEQ ID NO: 4190650 - DNA, 14 bp, Homo sapiens
tcttcaaatgcctg

SEQ ID NO: 4190651 - DNA, 23 bp, Homo sapiens
tcttcacctgggcgccaactgct

SEQ ID NO: 4190652 - DNA, 12 bp, Homo sapiens
tcttcactcagc

SEQ ID NO: 4190653 - DNA, 19 bp, Homo sapiens
tcttcactgccatgcctca

SEQ ID NO: 4190654 - DNA, 21 bp, Homo sapiens
tcttcactgccatgcctcaag

SEQ ID NO: 4190655 - DNA, 13 bp, Homo sapiens
tcttcagaagaca

SEQ ID NO: 4190656 - DNA, 18 bp, Homo sapiens
tcttcagcagcatctact

SEQ ID NO: 4190657 - DNA, 13 bp, Homo sapiens
tcttcagccatca

SEQ ID NO: 4190658 - DNA, 13 bp, Homo sapiens
tcttcagctggga

SEQ ID NO: 4190659 - DNA, 17 bp, Homo sapiens
tcttccagtgcaacaaa

SEQ ID NO: 4190660 - DNA, 18 bp, Homo sapiens
tcttcccccactcctctt

SEQ ID NO: 4190661 - DNA, 11 bp, Homo sapiens
tcttcctctgg

SEQ ID NO: 4190662 - DNA, 20 bp, Homo sapiens
tcttcctctgggcagcgcta

SEQ ID NO: 4190663 - DNA, 11 bp, Homo sapiens
tcttccttccc

SEQ ID NO: 4190664 - DNA, 13 bp, Homo sapiens
tcttccttctttc

SEQ ID NO: 4190665 - DNA, 19 bp, Homo sapiens
tcttcgctgctagagaagg

SEQ ID NO: 4190666 - DNA, 20 bp, Homo sapiens
tcttcgctgctagagaaggg

SEQ ID NO: 4190667 - DNA, 17 bp, Homo sapiens
tcttcggggtgtgatga

SEQ ID NO: 4190668 - DNA, 21 bp, Homo sapiens
tcttctggaaaccaaataggc

SEQ ID NO: 4190669 - DNA, 14 bp, Homo sapiens
tcttcttcagaaga

SEQ ID NO: 4190670 - DNA, 15 bp, Homo sapiens
tcttcttcttcagaa

SEQ ID NO: 4190671 - DNA, 16 bp, Homo sapiens
tcttgaaacagcctgg

SEQ ID NO: 4190672 - DNA, 15 bp, Homo sapiens
tcttgaattattttg

SEQ ID NO: 4190673 - DNA, 12 bp, Homo sapiens
tcttgagcagac

SEQ ID NO: 4190674 - DNA, 20 bp, Homo sapiens
tcttgctgggaacacagcca

SEQ ID NO: 4190675 - DNA, 22 bp, Homo sapiens
tcttgctgtaactcagacattc

SEQ ID NO: 4190676 - DNA, 16 bp, Homo sapiens
tcttggggctcgcccc

SEQ ID NO: 4190677 - DNA, 14 bp, Homo sapiens
tcttggtattctta

SEQ ID NO: 4190678 - DNA, 15 bp, Homo sapiens
tcttgtacacttaag

SEQ ID NO: 4190679 - DNA, 13 bp, Homo sapiens
tcttgtcagaatt

SEQ ID NO: 4190680 - DNA, 21 bp, Homo sapiens
tcttgtcagaattggcctcag

SEQ ID NO: 4190681 - DNA, 15 bp, Homo sapiens
tctttccccacctct

SEQ ID NO: 4190682 - DNA, 18 bp, Homo sapiens
tctttccccacctcttcc

SEQ ID NO: 4190683 - DNA, 17 bp, Homo sapiens
tctttctcactaaatct

SEQ ID NO: 4190684 - DNA, 22 bp, Homo sapiens
tctttctctccttcttccctgt

SEQ ID NO: 4190685 - DNA, 23 bp, Homo sapiens
tctttgaagttatttagaaatat

SEQ ID NO: 4190686 - DNA, 13 bp, Homo sapiens
tctttgattcaga

SEQ ID NO: 4190687 - DNA, 18 bp, Homo sapiens
tctttggaaggagtgaga

SEQ ID NO: 4190688 - DNA, 12 bp, Homo sapiens
tctttgttcagt

SEQ ID NO: 4190689 - DNA, 21 bp, Homo sapiens
tcttttaaaatgaaatgtttt

SEQ ID NO: 4190690 - DNA, 23 bp, Homo sapiens
tcttttcacctctttaaccactc

SEQ ID NO: 4190691 - DNA, 16 bp, Homo sapiens
tcttttcccacattca

SEQ ID NO: 4190692 - DNA, 17 bp, Homo sapiens
tctttttgtgtgtgcca

SEQ ID NO: 4190693 - DNA, 19 bp, Homo sapiens
tcttttttaaaagagatgt

SEQ ID NO: 4190694 - DNA, 23 bp, Homo sapiens
tcttttttttaataaggaaaaaa

SEQ ID NO: 4190695 - DNA, 12 bp, Homo sapiens
tgaaaaaatgat

SEQ ID NO: 4190696 - DNA, 18 bp, Homo sapiens
tgaaaaacacggcagctg

SEQ ID NO: 4190697 - DNA, 19 bp, Homo sapiens
tgaaaaacacggcagctgt

SEQ ID NO: 4190698 - DNA, 13 bp, Homo sapiens
tgaaaaagaagaa

SEQ ID NO: 4190699 - DNA, 16 bp, Homo sapiens
tgaaaaatatgtgctt

SEQ ID NO: 4190700 - DNA, 20 bp, Homo sapiens
tgaaaaatattcatgtagat

SEQ ID NO: 4190701 - DNA, 14 bp, Homo sapiens
tgaaaactttttca

SEQ ID NO: 4190702 - DNA, 17 bp, Homo sapiens
tgaaaagctagaattga

SEQ ID NO: 4190703 - DNA, 22 bp, Homo sapiens
tgaaaaggtttatgaaaaagaa

SEQ ID NO: 4190704 - DNA, 13 bp, Homo sapiens
tgaaaataattgt

SEQ ID NO: 4190705 - DNA, 20 bp, Homo sapiens
tgaaaatgaatagagagtat

SEQ ID NO: 4190706 - DNA, 17 bp, Homo sapiens
tgaaaattatttaaacc

SEQ ID NO: 4190707 - DNA, 18 bp, Homo sapiens
tgaaaattattttaaaca

SEQ ID NO: 4190708 - DNA, 13 bp, Homo sapiens
tgaaaattgtatt

SEQ ID NO: 4190709 - DNA, 23 bp, Homo sapiens
tgaaacccattaggcatgcctaa

SEQ ID NO: 4190710 - DNA, 14 bp, Homo sapiens
tgaaaccctgtctc

SEQ ID NO: 4190711 - DNA, 18 bp, Homo sapiens
tgaaactagaagtcaaaa

SEQ ID NO: 4190712 - DNA, 19 bp, Homo sapiens
tgaaactagaagtcaaaaa

SEQ ID NO: 4190713 - DNA, 13 bp, Homo sapiens
tgaaagaatatct

SEQ ID NO: 4190714 - DNA, 15 bp, Homo sapiens
tgaaagcctctggaa

SEQ ID NO: 4190715 - DNA, 12 bp, Homo sapiens
tgaaagctgaat

SEQ ID NO: 4190716 - DNA, 16 bp, Homo sapiens
tgaaagtaaaagttat

SEQ ID NO: 4190717 - DNA, 15 bp, Homo sapiens
tgaaagtcagatgcc

SEQ ID NO: 4190718 - DNA, 23 bp, Homo sapiens
tgaaataccacaagcctgagaac

SEQ ID NO: 4190719 - DNA, 15 bp, Homo sapiens
tgaaatatcctgctt

SEQ ID NO: 4190720 - DNA, 16 bp, Homo sapiens
tgaaatatgatgttaa

SEQ ID NO: 4190721 - DNA, 20 bp, Homo sapiens
tgaaatatgatgttaaaaaa

SEQ ID NO: 4190722 - DNA, 16 bp, Homo sapiens
tgaaattgaacctggt

SEQ ID NO: 4190723 - DNA, 12 bp, Homo sapiens
tgaaattggtgg

SEQ ID NO: 4190724 - DNA, 22 bp, Homo sapiens
tgaaatttattagttaatatat

SEQ ID NO: 4190725 - DNA, 17 bp, Homo sapiens
tgaaattttaaactata

SEQ ID NO: 4190726 - DNA, 18 bp, Homo sapiens
tgaaattttatttagttc

SEQ ID NO: 4190727 - DNA, 17 bp, Homo sapiens
tgaaattttctagactt

SEQ ID NO: 4190728 - DNA, 20 bp, Homo sapiens
tgaaattttctagactttct

SEQ ID NO: 4190729 - DNA, 19 bp, Homo sapiens
tgaacaccaggactttaat

SEQ ID NO: 4190730 - DNA, 11 bp, Homo sapiens
tgaacagagag

SEQ ID NO: 4190731 - DNA, 21 bp, Homo sapiens
tgaacagggtccctggatcag

SEQ ID NO: 4190732 - DNA, 20 bp, Homo sapiens
tgaacatttgctttgttttc

SEQ ID NO: 4190733 - DNA, 14 bp, Homo sapiens
tgaaccactttgcc

SEQ ID NO: 4190734 - DNA, 19 bp, Homo sapiens
tgaacccattttgagtgac

SEQ ID NO: 4190735 - DNA, 15 bp, Homo sapiens
tgaactggaagaaag

SEQ ID NO: 4190736 - DNA, 13 bp, Homo sapiens
tgaactggttcat

SEQ ID NO: 4190737 - DNA, 21 bp, Homo sapiens
tgaacttatttacacatagtt

SEQ ID NO: 4190738 - DNA, 17 bp, Homo sapiens
tgaacttgaggacacat

SEQ ID NO: 4190739 - DNA, 21 bp, Homo sapiens
tgaacttgaggacacatgtcc

SEQ ID NO: 4190740 - DNA, 22 bp, Homo sapiens
tgaacttgaggacacatgtcca

SEQ ID NO: 4190741 - DNA, 21 bp, Homo sapiens
tgaactttctcttcatacttt

SEQ ID NO: 4190742 - DNA, 20 bp, Homo sapiens
tgaagaatacttctcatttt

SEQ ID NO: 4190743 - DNA, 19 bp, Homo sapiens
tgaagacaggtcaaatgct

SEQ ID NO: 4190744 - DNA, 17 bp, Homo sapiens
tgaagagatttcaacat

SEQ ID NO: 4190745 - DNA, 18 bp, Homo sapiens
tgaagcaaagcaccagct

SEQ ID NO: 4190746 - DNA, 20 bp, Homo sapiens
tgaagcaaatcgaatgaaat

SEQ ID NO: 4190747 - DNA, 15 bp, Homo sapiens
tgaagccaaactgtt

SEQ ID NO: 4190748 - DNA, 20 bp, Homo sapiens
tgaagccactgaagctggga

SEQ ID NO: 4190749 - DNA, 19 bp, Homo sapiens
tgaagctttggccctcagt

SEQ ID NO: 4190750 - DNA, 17 bp, Homo sapiens
tgaaggaggtgagggat

SEQ ID NO: 4190751 - DNA, 22 bp, Homo sapiens
tgaaggatcctggaaccactga

SEQ ID NO: 4190752 - DNA, 22 bp, Homo sapiens
tgaaggtcactcttcctgcaag

SEQ ID NO: 4190753 - DNA, 19 bp, Homo sapiens
tgaagtaaaggattgatca

SEQ ID NO: 4190754 - DNA, 19 bp, Homo sapiens
tgaagtcaaaccttaagat

SEQ ID NO: 4190755 - DNA, 20 bp, Homo sapiens
tgaagtcaaaccttaagata

SEQ ID NO: 4190756 - DNA, 13 bp, Homo sapiens
tgaagttatctgt

SEQ ID NO: 4190757 - DNA, 19 bp, Homo sapiens
tgaagttatttagaaatat

SEQ ID NO: 4190758 - DNA, 18 bp, Homo sapiens
tgaagtttgaacttcata

SEQ ID NO: 4190759 - DNA, 14 bp, Homo sapiens
tgaataaagcaggg

SEQ ID NO: 4190760 - DNA, 15 bp, Homo sapiens
tgaataaagcaggga

SEQ ID NO: 4190761 - DNA, 17 bp, Homo sapiens
tgaataaagcagggaat

SEQ ID NO: 4190762 - DNA, 14 bp, Homo sapiens
tgaataagtattct

SEQ ID NO: 4190763 - DNA, 18 bp, Homo sapiens
tgaataggaaaatgtaca

SEQ ID NO: 4190764 - DNA, 16 bp, Homo sapiens
tgaatatatggtctgt

SEQ ID NO: 4190765 - DNA, 15 bp, Homo sapiens
tgaatgacaacagaa

SEQ ID NO: 4190766 - DNA, 13 bp, Homo sapiens
tgaatgacaacat

SEQ ID NO: 4190767 - DNA, 15 bp, Homo sapiens
tgaatgatcattgaa

SEQ ID NO: 4190768 - DNA, 17 bp, Homo sapiens
tgaatgcctcaatgtga

SEQ ID NO: 4190769 - DNA, 20 bp, Homo sapiens
tgaatgcttaaagcaaggca

SEQ ID NO: 4190770 - DNA, 20 bp, Homo sapiens
tgaatggctatgtttttaat

SEQ ID NO: 4190771 - DNA, 15 bp, Homo sapiens
tgaatggtccagggt

SEQ ID NO: 4190772 - DNA, 16 bp, Homo sapiens
tgaatgtcattcacaa

SEQ ID NO: 4190773 - DNA, 14 bp, Homo sapiens
tgaatgttatttgt

SEQ ID NO: 4190774 - DNA, 21 bp, Homo sapiens
tgaatgttgtctgtttgttct

SEQ ID NO: 4190775 - DNA, 23 bp, Homo sapiens
tgaatgtttatgttctcagaatc

SEQ ID NO: 4190776 - DNA, 21 bp, Homo sapiens
tgaatgtttccaacctggagt

SEQ ID NO: 4190777 - DNA, 19 bp, Homo sapiens
tgaattaagttattgattt

SEQ ID NO: 4190778 - DNA, 16 bp, Homo sapiens
tgaattgcctgcagag

SEQ ID NO: 4190779 - DNA, 23 bp, Homo sapiens
tgaatttcttcactgttgaaaat

SEQ ID NO: 4190780 - DNA, 19 bp, Homo sapiens
tgaatttttaaacaagtat

SEQ ID NO: 4190781 - DNA, 13 bp, Homo sapiens
tgacaactggcag

SEQ ID NO: 4190782 - DNA, 12 bp, Homo sapiens
tgacacaaacac

SEQ ID NO: 4190783 - DNA, 17 bp, Homo sapiens
tgacacaaacacacaca

SEQ ID NO: 4190784 - DNA, 12 bp, Homo sapiens
tgacacaaattg

SEQ ID NO: 4190785 - DNA, 20 bp, Homo sapiens
tgacacacgtatttatattt

SEQ ID NO: 4190786 - DNA, 23 bp, Homo sapiens
tgacacacgtatttatatttgga

SEQ ID NO: 4190787 - DNA, 16 bp, Homo sapiens
tgacagaatgctgttt

SEQ ID NO: 4190788 - DNA, 14 bp, Homo sapiens
tgacagcaggtggg

SEQ ID NO: 4190789 - DNA, 16 bp, Homo sapiens
tgacataaagttgata

SEQ ID NO: 4190790 - DNA, 13 bp, Homo sapiens
tgacatggctttg

SEQ ID NO: 4190791 - DNA, 15 bp, Homo sapiens
tgaccaagatactta

SEQ ID NO: 4190792 - DNA, 15 bp, Homo sapiens
tgaccacaaagagta

SEQ ID NO: 4190793 - DNA, 16 bp, Homo sapiens
tgaccactggccctgg

SEQ ID NO: 4190794 - DNA, 17 bp, Homo sapiens
tgacccaatgctcctgg

SEQ ID NO: 4190795 - DNA, 18 bp, Homo sapiens
tgacccaatgctcctgga

SEQ ID NO: 4190796 - DNA, 13 bp, Homo sapiens
tgacccagtgaga

SEQ ID NO: 4190797 - DNA, 14 bp, Homo sapiens
tgacccatctgtag

SEQ ID NO: 4190798 - DNA, 12 bp, Homo sapiens
tgacccctttcc

SEQ ID NO: 4190799 - DNA, 14 bp, Homo sapiens
tgacccctttcccc

SEQ ID NO: 4190800 - DNA, 19 bp, Homo sapiens
tgacccctttcccccaccc

SEQ ID NO: 4190801 - DNA, 20 bp, Homo sapiens
tgacccctttcccccacccc

SEQ ID NO: 4190802 - DNA, 22 bp, Homo sapiens
tgaccctccaccgcagaaggaa

SEQ ID NO: 4190803 - DNA, 23 bp, Homo sapiens
tgaccctccaccgcagaaggaag

SEQ ID NO: 4190804 - DNA, 16 bp, Homo sapiens
tgacctatgtctgcct

SEQ ID NO: 4190805 - DNA, 18 bp, Homo sapiens
tgacctgaggctcctgtg

SEQ ID NO: 4190806 - DNA, 17 bp, Homo sapiens
tgacctgcagtcagggc

SEQ ID NO: 4190807 - DNA, 20 bp, Homo sapiens
tgacctgccccgcccagctg

SEQ ID NO: 4190808 - DNA, 18 bp, Homo sapiens
tgacgtgcacctgtactc

SEQ ID NO: 4190809 - DNA, 13 bp, Homo sapiens
tgactagggagcc

SEQ ID NO: 4190810 - DNA, 17 bp, Homo sapiens
tgactagtcatagaaat

SEQ ID NO: 4190811 - DNA, 16 bp, Homo sapiens
tgactattttttaata

SEQ ID NO: 4190812 - DNA, 17 bp, Homo sapiens
tgactcctctaagccac

SEQ ID NO: 4190813 - DNA, 15 bp, Homo sapiens
tgactcgtgctgcat

SEQ ID NO: 4190814 - DNA, 16 bp, Homo sapiens
tgactgcgatcttcag

SEQ ID NO: 4190815 - DNA, 14 bp, Homo sapiens
tgacttactgtttc

SEQ ID NO: 4190816 - DNA, 15 bp, Homo sapiens
tgacttactgtttct

SEQ ID NO: 4190817 - DNA, 13 bp, Homo sapiens
tgacttgaataaa

SEQ ID NO: 4190818 - DNA, 13 bp, Homo sapiens
tgacttttccatg

SEQ ID NO: 4190819 - DNA, 19 bp, Homo sapiens
tgacttttccatgtatcta

SEQ ID NO: 4190820 - DNA, 22 bp, Homo sapiens
tgacttttccatgtatctacct

SEQ ID NO: 4190821 - DNA, 19 bp, Homo sapiens
tgacttttctggaagacat

SEQ ID NO: 4190822 - DNA, 20 bp, Homo sapiens
tgagaaagagagagatacat

SEQ ID NO: 4190823 - DNA, 14 bp, Homo sapiens
tgagaaagccttct

SEQ ID NO: 4190824 - DNA, 14 bp, Homo sapiens
tgagaaatttaaac

SEQ ID NO: 4190825 - DNA, 17 bp, Homo sapiens
tgagaaatttaaactat

SEQ ID NO: 4190826 - DNA, 18 bp, Homo sapiens
tgagaaatttaaactata

SEQ ID NO: 4190827 - DNA, 22 bp, Homo sapiens
tgagaacctgggttgcagacag

SEQ ID NO: 4190828 - DNA, 13 bp, Homo sapiens
tgagaaggaacag

SEQ ID NO: 4190829 - DNA, 22 bp, Homo sapiens
tgagaaggagtcagaaactgtt

SEQ ID NO: 4190830 - DNA, 17 bp, Homo sapiens
tgagaagttttgtacag

SEQ ID NO: 4190831 - DNA, 18 bp, Homo sapiens
tgagaagttttgtacaga

SEQ ID NO: 4190832 - DNA, 16 bp, Homo sapiens
tgagaattccaaggag

SEQ ID NO: 4190833 - DNA, 15 bp, Homo sapiens
tgagactcgtctcaa

SEQ ID NO: 4190834 - DNA, 16 bp, Homo sapiens
tgagagaagttgggag

SEQ ID NO: 4190835 - DNA, 18 bp, Homo sapiens
tgagagaattgtatcatt

SEQ ID NO: 4190836 - DNA, 14 bp, Homo sapiens
tgagatacatacag

SEQ ID NO: 4190837 - DNA, 20 bp, Homo sapiens
tgagatcacgccattgtact

SEQ ID NO: 4190838 - DNA, 17 bp, Homo sapiens
tgagatgctggcttggg

SEQ ID NO: 4190839 - DNA, 16 bp, Homo sapiens
tgagcaaatcaccaca

SEQ ID NO: 4190840 - DNA, 20 bp, Homo sapiens
tgagcaaggacaacctgccc

SEQ ID NO: 4190841 - DNA, 21 bp, Homo sapiens
tgagcacctgcttcatgctca

SEQ ID NO: 4190842 - DNA, 16 bp, Homo sapiens
tgagcagatgggacaa

SEQ ID NO: 4190843 - DNA, 13 bp, Homo sapiens
tgagcaggagcag

SEQ ID NO: 4190844 - DNA, 18 bp, Homo sapiens
tgagcaggagcagaaaga

SEQ ID NO: 4190845 - DNA, 12 bp, Homo sapiens
tgagcatcacag

SEQ ID NO: 4190846 - DNA, 13 bp, Homo sapiens
tgagcatcacaga

SEQ ID NO: 4190847 - DNA, 15 bp, Homo sapiens
tgagcatcacagaat

SEQ ID NO: 4190848 - DNA, 18 bp, Homo sapiens
tgagcatcacagaatgtg

SEQ ID NO: 4190849 - DNA, 21 bp, Homo sapiens
tgagcattttatatccacatc

SEQ ID NO: 4190850 - DNA, 20 bp, Homo sapiens
tgagccaggtaatgagggac

SEQ ID NO: 4190851 - DNA, 21 bp, Homo sapiens
tgagccaggtaatgagggact

SEQ ID NO: 4190852 - DNA, 22 bp, Homo sapiens
tgagcggaggctcggccgtggg

SEQ ID NO: 4190853 - DNA, 19 bp, Homo sapiens
tgagcgtcctaaggcatgt

SEQ ID NO: 4190854 - DNA, 13 bp, Homo sapiens
tgagctcagctca

SEQ ID NO: 4190855 - DNA, 22 bp, Homo sapiens
tgagctggcattggtctgctga

SEQ ID NO: 4190856 - DNA, 19 bp, Homo sapiens
tgagcttggcagctgaact

SEQ ID NO: 4190857 - DNA, 14 bp, Homo sapiens
tgaggacacatgtc

SEQ ID NO: 4190858 - DNA, 14 bp, Homo sapiens
tgaggatgacagag

SEQ ID NO: 4190859 - DNA, 13 bp, Homo sapiens
tgaggcaggagaa

SEQ ID NO: 4190860 - DNA, 12 bp, Homo sapiens
tgaggcccagcc

SEQ ID NO: 4190861 - DNA, 13 bp, Homo sapiens
tgaggcccagcct

SEQ ID NO: 4190862 - DNA, 16 bp, Homo sapiens
tgaggcccagcctgtc

SEQ ID NO: 4190863 - DNA, 19 bp, Homo sapiens
tgaggcccagcctgtcctg

SEQ ID NO: 4190864 - DNA, 20 bp, Homo sapiens
tgaggcccagcctgtcctgg

SEQ ID NO: 4190865 - DNA, 14 bp, Homo sapiens
tgaggcctggccag

SEQ ID NO: 4190866 - DNA, 16 bp, Homo sapiens
tgaggcctggccaggc

SEQ ID NO: 4190867 - DNA, 21 bp, Homo sapiens
tgaggctctgacccagtgaga

SEQ ID NO: 4190868 - DNA, 18 bp, Homo sapiens
tgaggctctttctgggcc

SEQ ID NO: 4190869 - DNA, 22 bp, Homo sapiens
tgaggggaggatcactggagcc

SEQ ID NO: 4190870 - DNA, 15 bp, Homo sapiens
tgaggtcactgggtt

SEQ ID NO: 4190871 - DNA, 18 bp, Homo sapiens
tgaggtcactgggttcta

SEQ ID NO: 4190872 - DNA, 18 bp, Homo sapiens
tgaggtgtcttaagcctt

SEQ ID NO: 4190873 - DNA, 19 bp, Homo sapiens
tgagtactagaatttgtat

SEQ ID NO: 4190874 - DNA, 21 bp, Homo sapiens
tgagtcagaggacaccatcca

SEQ ID NO: 4190875 - DNA, 23 bp, Homo sapiens
tgagtctgggcaatgaaaccaaa

SEQ ID NO: 4190876 - DNA, 14 bp, Homo sapiens
tgagtgattatttg

SEQ ID NO: 4190877 - DNA, 20 bp, Homo sapiens
tgagtgattatttgttattt

SEQ ID NO: 4190878 - DNA, 13 bp, Homo sapiens
tgagtgcaacaag

SEQ ID NO: 4190879 - DNA, 21 bp, Homo sapiens
tgagtgttttatgagaaagcc

SEQ ID NO: 4190880 - DNA, 17 bp, Homo sapiens
tgagttggacttcagtc

SEQ ID NO: 4190881 - DNA, 13 bp, Homo sapiens
tgagtttgcttat

SEQ ID NO: 4190882 - DNA, 12 bp, Homo sapiens
tgataaatatat

SEQ ID NO: 4190883 - DNA, 16 bp, Homo sapiens
tgataaatcagactct

SEQ ID NO: 4190884 - DNA, 17 bp, Homo sapiens
tgataaatctagaaaat

SEQ ID NO: 4190885 - DNA, 20 bp, Homo sapiens
tgataaatctagaaaattga

SEQ ID NO: 4190886 - DNA, 13 bp, Homo sapiens
tgataacttgttt

SEQ ID NO: 4190887 - DNA, 13 bp, Homo sapiens
tgatacccagagc

SEQ ID NO: 4190888 - DNA, 16 bp, Homo sapiens
tgatactgcaataaat

SEQ ID NO: 4190889 - DNA, 12 bp, Homo sapiens
tgatactttaat

SEQ ID NO: 4190890 - DNA, 20 bp, Homo sapiens
tgatagacaagtagttaaga

SEQ ID NO: 4190891 - DNA, 14 bp, Homo sapiens
tgatagtgtgattt

SEQ ID NO: 4190892 - DNA, 16 bp, Homo sapiens
tgatagtgtgattttt

SEQ ID NO: 4190893 - DNA, 16 bp, Homo sapiens
tgatattaaaggagtt

SEQ ID NO: 4190894 - DNA, 11 bp, Homo sapiens
tgatcaaggcc

SEQ ID NO: 4190895 - DNA, 13 bp, Homo sapiens
tgatcaaggcctt

SEQ ID NO: 4190896 - DNA, 18 bp, Homo sapiens
tgatcataattaaactgt

SEQ ID NO: 4190897 - DNA, 23 bp, Homo sapiens
tgatcattttagacactgggaga

SEQ ID NO: 4190898 - DNA, 13 bp, Homo sapiens
tgatcccagcact

SEQ ID NO: 4190899 - DNA, 22 bp, Homo sapiens
tgatccggctgctcctccagcc

SEQ ID NO: 4190900 - DNA, 18 bp, Homo sapiens
tgatcctcaaacacacaa

SEQ ID NO: 4190901 - DNA, 20 bp, Homo sapiens
tgatcctgtattcagacaga

SEQ ID NO: 4190902 - DNA, 22 bp, Homo sapiens
tgatccttcctattcctattct

SEQ ID NO: 4190903 - DNA, 13 bp, Homo sapiens
tgatcgcctgtgg

SEQ ID NO: 4190904 - DNA, 14 bp, Homo sapiens
tgatctcaaatcca

SEQ ID NO: 4190905 - DNA, 16 bp, Homo sapiens
tgatctcaaatccact

SEQ ID NO: 4190906 - DNA, 23 bp, Homo sapiens
tgatgaaaatgaatagagagtat

SEQ ID NO: 4190907 - DNA, 17 bp, Homo sapiens
tgatgagttaactgtga

SEQ ID NO: 4190908 - DNA, 18 bp, Homo sapiens
tgatgagttaactgtgaa

SEQ ID NO: 4190909 - DNA, 20 bp, Homo sapiens
tgatgagttaactgtgaaat

SEQ ID NO: 4190910 - DNA, 17 bp, Homo sapiens
tgatgatgatgatgatg

SEQ ID NO: 4190911 - DNA, 21 bp, Homo sapiens
tgatgcctctgtcttctggac

SEQ ID NO: 4190912 - DNA, 22 bp, Homo sapiens
tgatggcacttagctatcagaa

SEQ ID NO: 4190913 - DNA, 16 bp, Homo sapiens
tgatgggattctggac

SEQ ID NO: 4190914 - DNA, 14 bp, Homo sapiens
tgatgtcaaagtgt

SEQ ID NO: 4190915 - DNA, 15 bp, Homo sapiens
tgatgtcagccttgc

SEQ ID NO: 4190916 - DNA, 16 bp, Homo sapiens
tgatgtcagccttgca

SEQ ID NO: 4190917 - DNA, 17 bp, Homo sapiens
tgatgtcagccttgcat

SEQ ID NO: 4190918 - DNA, 15 bp, Homo sapiens
tgatgttaactatta

SEQ ID NO: 4190919 - DNA, 22 bp, Homo sapiens
tgattaacaaataaattggaat

SEQ ID NO: 4190920 - DNA, 15 bp, Homo sapiens
tgattacctgccaat

SEQ ID NO: 4190921 - DNA, 21 bp, Homo sapiens
tgattatgtgtcctttcttga

SEQ ID NO: 4190922 - DNA, 15 bp, Homo sapiens
tgattgtataatgtg

SEQ ID NO: 4190923 - DNA, 14 bp, Homo sapiens
tgattgtcttaata

SEQ ID NO: 4190924 - DNA, 22 bp, Homo sapiens
tgatttatagtttgtacatgca

SEQ ID NO: 4190925 - DNA, 11 bp, Homo sapiens
tgatttcagga

SEQ ID NO: 4190926 - DNA, 14 bp, Homo sapiens
tgatttctattcaa

SEQ ID NO: 4190927 - DNA, 11 bp, Homo sapiens
tgatttctgag

SEQ ID NO: 4190928 - DNA, 14 bp, Homo sapiens
tgatttctgagatt

SEQ ID NO: 4190929 - DNA, 13 bp, Homo sapiens
tgattttctggat

SEQ ID NO: 4190930 - DNA, 13 bp, Homo sapiens
tgatttttccttt

SEQ ID NO: 4190931 - DNA, 14 bp, Homo sapiens
tgatttttgtaata

SEQ ID NO: 4190932 - DNA, 21 bp, Homo sapiens
tgcaaaaatgagttttcacct

SEQ ID NO: 4190933 - DNA, 20 bp, Homo sapiens
tgcaaaagactaatttaaaa

SEQ ID NO: 4190934 - DNA, 14 bp, Homo sapiens
tgcaaaatggaaat

SEQ ID NO: 4190935 - DNA, 12 bp, Homo sapiens
tgcaaactttat

SEQ ID NO: 4190936 - DNA, 20 bp, Homo sapiens
tgcaagacacaggctcagca

SEQ ID NO: 4190937 - DNA, 21 bp, Homo sapiens
tgcaagacacaggctcagcat

SEQ ID NO: 4190938 - DNA, 19 bp, Homo sapiens
tgcaagagactctggcctc

SEQ ID NO: 4190939 - DNA, 18 bp, Homo sapiens
tgcaagatttaacactaa

SEQ ID NO: 4190940 - DNA, 23 bp, Homo sapiens
tgcaagcacaaatttcatctcct

SEQ ID NO: 4190941 - DNA, 16 bp, Homo sapiens
tgcaagcagggctctg

SEQ ID NO: 4190942 - DNA, 17 bp, Homo sapiens
tgcaatccaaataaaga

SEQ ID NO: 4190943 - DNA, 18 bp, Homo sapiens
tgcaatggctatatggca

SEQ ID NO: 4190944 - DNA, 22 bp, Homo sapiens
tgcaatgtaaatattttaaaga

SEQ ID NO: 4190945 - DNA, 23 bp, Homo sapiens
tgcaattggggaagaaaaaatgt

SEQ ID NO: 4190946 - DNA, 22 bp, Homo sapiens
tgcaattttctataggtgactt

SEQ ID NO: 4190947 - DNA, 19 bp, Homo sapiens
tgcacactagcctctccag

SEQ ID NO: 4190948 - DNA, 21 bp, Homo sapiens
tgcacactagcctctccagga

SEQ ID NO: 4190949 - DNA, 15 bp, Homo sapiens
tgcacacttgtatat

SEQ ID NO: 4190950 - DNA, 17 bp, Homo sapiens
tgcaccatcacacatgc

SEQ ID NO: 4190951 - DNA, 14 bp, Homo sapiens
tgcacctaaagaaa

SEQ ID NO: 4190952 - DNA, 19 bp, Homo sapiens
tgcacctaaagaaaaacaa

SEQ ID NO: 4190953 - DNA, 15 bp, Homo sapiens
tgcacctcagggcca

SEQ ID NO: 4190954 - DNA, 16 bp, Homo sapiens
tgcacctgccagcctg

SEQ ID NO: 4190955 - DNA, 13 bp, Homo sapiens
tgcacctgcttct

SEQ ID NO: 4190956 - DNA, 16 bp, Homo sapiens
tgcacctgtactcagg

SEQ ID NO: 4190957 - DNA, 18 bp, Homo sapiens
tgcaccttaccaactttc

SEQ ID NO: 4190958 - DNA, 19 bp, Homo sapiens
tgcaccttaccaactttct

SEQ ID NO: 4190959 - DNA, 19 bp, Homo sapiens
tgcactagcattttcttga

SEQ ID NO: 4190960 - DNA, 16 bp, Homo sapiens
tgcactatctttcagc

SEQ ID NO: 4190961 - DNA, 15 bp, Homo sapiens
tgcactccagcctgg

SEQ ID NO: 4190962 - DNA, 17 bp, Homo sapiens
tgcactccagcctgggc

SEQ ID NO: 4190963 - DNA, 10 bp, Homo sapiens
tgcactgaca

SEQ ID NO: 4190964 - DNA, 15 bp, Homo sapiens
tgcactgtatgctgg

SEQ ID NO: 4190965 - DNA, 20 bp, Homo sapiens
tgcagaagtgcatgaacagg

SEQ ID NO: 4190966 - DNA, 20 bp, Homo sapiens
tgcagacaggaatcttaagg

SEQ ID NO: 4190967 - DNA, 14 bp, Homo sapiens
tgcagagagaagcc

SEQ ID NO: 4190968 - DNA, 19 bp, Homo sapiens
tgcagagctatggtgaggt

SEQ ID NO: 4190969 - DNA, 16 bp, Homo sapiens
tgcagaggggaaagac

SEQ ID NO: 4190970 - DNA, 20 bp, Homo sapiens
tgcagaggggctttctggag

SEQ ID NO: 4190971 - DNA, 22 bp, Homo sapiens
tgcagaggggctttctggagag

SEQ ID NO: 4190972 - DNA, 18 bp, Homo sapiens
tgcagatggtgagagata

SEQ ID NO: 4190973 - DNA, 12 bp, Homo sapiens
tgcagcaactcc

SEQ ID NO: 4190974 - DNA, 16 bp, Homo sapiens
tgcagcaactcccacg

SEQ ID NO: 4190975 - DNA, 19 bp, Homo sapiens
tgcagcaactcccacgact

SEQ ID NO: 4190976 - DNA, 15 bp, Homo sapiens
tgcagcttctgtcct

SEQ ID NO: 4190977 - DNA, 19 bp, Homo sapiens
tgcaggaatctttaaaaga

SEQ ID NO: 4190978 - DNA, 20 bp, Homo sapiens
tgcaggccaagagcagaggc

SEQ ID NO: 4190979 - DNA, 17 bp, Homo sapiens
tgcaggcttgggaactg

SEQ ID NO: 4190980 - DNA, 20 bp, Homo sapiens
tgcagggctgctgtggccca

SEQ ID NO: 4190981 - DNA, 23 bp, Homo sapiens
tgcagggctgctgtggcccagtc

SEQ ID NO: 4190982 - DNA, 17 bp, Homo sapiens
tgcaggtgcctggcttg

SEQ ID NO: 4190983 - DNA, 18 bp, Homo sapiens
tgcagtaacactggcctt

SEQ ID NO: 4190984 - DNA, 17 bp, Homo sapiens
tgcagtatggtgtggtg

SEQ ID NO: 4190985 - DNA, 19 bp, Homo sapiens
tgcagtgacgtgcacctgt

SEQ ID NO: 4190986 - DNA, 17 bp, Homo sapiens
tgcagtggctcacgcct

SEQ ID NO: 4190987 - DNA, 17 bp, Homo sapiens
tgcagttgacagcaggt

SEQ ID NO: 4190988 - DNA, 12 bp, Homo sapiens
tgcagtttccaa

SEQ ID NO: 4190989 - DNA, 23 bp, Homo sapiens
tgcataatcagcgccctggagtc

SEQ ID NO: 4190990 - DNA, 21 bp, Homo sapiens
tgcatactgatccctttccca

SEQ ID NO: 4190991 - DNA, 19 bp, Homo sapiens
tgcatcaagggctttatca

SEQ ID NO: 4190992 - DNA, 19 bp, Homo sapiens
tgcatctgggattcccacc

SEQ ID NO: 4190993 - DNA, 20 bp, Homo sapiens
tgcatgaacagggtccctgg

SEQ ID NO: 4190994 - DNA, 22 bp, Homo sapiens
tgcatgccaaattgtagttctt

SEQ ID NO: 4190995 - DNA, 14 bp, Homo sapiens
tgcatgcctggtct

SEQ ID NO: 4190996 - DNA, 13 bp, Homo sapiens
tgcatgtatgtgt

SEQ ID NO: 4190997 - DNA, 20 bp, Homo sapiens
tgcattagaaatagacagta

SEQ ID NO: 4190998 - DNA, 22 bp, Homo sapiens
tgcattagaaatagacagtata

SEQ ID NO: 4190999 - DNA, 21 bp, Homo sapiens
tgcattagagcccatttcaat

SEQ ID NO: 4191000 - DNA, 16 bp, Homo sapiens
tgccaaaaaaaaatac

SEQ ID NO: 4191001 - DNA, 17 bp, Homo sapiens
tgccaaagcaaaagaag

SEQ ID NO: 4191002 - DNA, 15 bp, Homo sapiens
tgccaattgctaccg

SEQ ID NO: 4191003 - DNA, 13 bp, Homo sapiens
tgccacagagaag

SEQ ID NO: 4191004 - DNA, 13 bp, Homo sapiens
tgccacccacctt

SEQ ID NO: 4191005 - DNA, 21 bp, Homo sapiens
tgccacccagcaacacagagc

SEQ ID NO: 4191006 - DNA, 11 bp, Homo sapiens
tgccacctgtc

SEQ ID NO: 4191007 - DNA, 14 bp, Homo sapiens
tgccacctgtctgt

SEQ ID NO: 4191008 - DNA, 15 bp, Homo sapiens
tgccacctgtctgtc

SEQ ID NO: 4191009 - DNA, 16 bp, Homo sapiens
tgccacctgtctgtct

SEQ ID NO: 4191010 - DNA, 17 bp, Homo sapiens
tgccactcattcctgta

SEQ ID NO: 4191011 - DNA, 11 bp, Homo sapiens
tgccagccaca

SEQ ID NO: 4191012 - DNA, 15 bp, Homo sapiens
tgccagcctggcttc

SEQ ID NO: 4191013 - DNA, 18 bp, Homo sapiens
tgccagcctggcttctgg

SEQ ID NO: 4191014 - DNA, 22 bp, Homo sapiens
tgccagcctggcttctggagcc

SEQ ID NO: 4191015 - DNA, 13 bp, Homo sapiens
tgccagcgctggc

SEQ ID NO: 4191016 - DNA, 16 bp, Homo sapiens
tgccaggctaattttt

SEQ ID NO: 4191017 - DNA, 19 bp, Homo sapiens
tgccaggctcccactgccc

SEQ ID NO: 4191018 - DNA, 21 bp, Homo sapiens
tgccaggctgtaagcattctg

SEQ ID NO: 4191019 - DNA, 21 bp, Homo sapiens
tgccatagagtttaacacaag

SEQ ID NO: 4191020 - DNA, 21 bp, Homo sapiens
tgccatgatgcctctgtcttc

SEQ ID NO: 4191021 - DNA, 15 bp, Homo sapiens
tgccatgggcctgct

SEQ ID NO: 4191022 - DNA, 13 bp, Homo sapiens
tgccattactctg

SEQ ID NO: 4191023 - DNA, 11 bp, Homo sapiens
tgccattccca

SEQ ID NO: 4191024 - DNA, 16 bp, Homo sapiens
tgccattcttctggtg

SEQ ID NO: 4191025 - DNA, 22 bp, Homo sapiens
tgccatttctgaactgttacaa

SEQ ID NO: 4191026 - DNA, 17 bp, Homo sapiens
tgccatttgcaccctcc

SEQ ID NO: 4191027 - DNA, 19 bp, Homo sapiens
tgcccagccctaaacatca

SEQ ID NO: 4191028 - DNA, 11 bp, Homo sapiens
tgcccagcctg

SEQ ID NO: 4191029 - DNA, 13 bp, Homo sapiens
tgccccagaggcc

SEQ ID NO: 4191030 - DNA, 14 bp, Homo sapiens
tgccccagctctgg

SEQ ID NO: 4191031 - DNA, 18 bp, Homo sapiens
tgccccagctctggcttc

SEQ ID NO: 4191032 - DNA, 19 bp, Homo sapiens
tgccccagctctggcttcc

SEQ ID NO: 4191033 - DNA, 17 bp, Homo sapiens
tgccccatctcctccca

SEQ ID NO: 4191034 - DNA, 21 bp, Homo sapiens
tgccccatctcctcccatggc

SEQ ID NO: 4191035 - DNA, 18 bp, Homo sapiens
tgccccccatgccctccc

SEQ ID NO: 4191036 - DNA, 17 bp, Homo sapiens
tgcccccgacagcccag

SEQ ID NO: 4191037 - DNA, 18 bp, Homo sapiens
tgcccccgacagcccagc

SEQ ID NO: 4191038 - DNA, 21 bp, Homo sapiens
tgcccccgacagcccagccta

SEQ ID NO: 4191039 - DNA, 18 bp, Homo sapiens
tgcccctgcacctgcttc

SEQ ID NO: 4191040 - DNA, 19 bp, Homo sapiens
tgcccctgcacctgcttct

SEQ ID NO: 4191041 - DNA, 12 bp, Homo sapiens
tgccccttccac

SEQ ID NO: 4191042 - DNA, 13 bp, Homo sapiens
tgcccgcagagcc

SEQ ID NO: 4191043 - DNA, 16 bp, Homo sapiens
tgcccgcagagcccac

SEQ ID NO: 4191044 - DNA, 23 bp, Homo sapiens
tgcccgtggtgaggttgtgctgc

SEQ ID NO: 4191045 - DNA, 12 bp, Homo sapiens
tgccctcaggga

SEQ ID NO: 4191046 - DNA, 18 bp, Homo sapiens
tgccctccacagccgcag

SEQ ID NO: 4191047 - DNA, 21 bp, Homo sapiens
tgccctccacagccgcagcct

SEQ ID NO: 4191048 - DNA, 16 bp, Homo sapiens
tgccctccctgctgcc

SEQ ID NO: 4191049 - DNA, 17 bp, Homo sapiens
tgccctccctgctgcca

SEQ ID NO: 4191050 - DNA, 19 bp, Homo sapiens
tgccctccctgctgccagg

SEQ ID NO: 4191051 - DNA, 15 bp, Homo sapiens
tgccctccgcccttc

SEQ ID NO: 4191052 - DNA, 18 bp, Homo sapiens
tgccctccgcccttccct

SEQ ID NO: 4191053 - DNA, 22 bp, Homo sapiens
tgccctgagtggatctccaagg

SEQ ID NO: 4191054 - DNA, 23 bp, Homo sapiens
tgccctgagtggatctccaagga

SEQ ID NO: 4191055 - DNA, 14 bp, Homo sapiens
tgccctgccacctg

SEQ ID NO: 4191056 - DNA, 21 bp, Homo sapiens
tgccctgccacctgtctgtct

SEQ ID NO: 4191057 - DNA, 11 bp, Homo sapiens
tgccctgctgc

SEQ ID NO: 4191058 - DNA, 14 bp, Homo sapiens
tgccctgtggattc

SEQ ID NO: 4191059 - DNA, 20 bp, Homo sapiens
tgccctgtggattccagcat

SEQ ID NO: 4191060 - DNA, 19 bp, Homo sapiens
tgccctttggggttgccca

SEQ ID NO: 4191061 - DNA, 21 bp, Homo sapiens
tgccctttggggttgcccagc

SEQ ID NO: 4191062 - DNA, 13 bp, Homo sapiens
tgccgagagaggc

SEQ ID NO: 4191063 - DNA, 22 bp, Homo sapiens
tgccgagagaggcgcgtctgcc

SEQ ID NO: 4191064 - DNA, 13 bp, Homo sapiens
tgccgcctcccag

SEQ ID NO: 4191065 - DNA, 16 bp, Homo sapiens
tgccgcctcccagcct

SEQ ID NO: 4191066 - DNA, 19 bp, Homo sapiens
tgccgtcagtgctgtgctg

SEQ ID NO: 4191067 - DNA, 21 bp, Homo sapiens
tgccgtgtgtctcgtctcctg

SEQ ID NO: 4191068 - DNA, 18 bp, Homo sapiens
tgcctaattcctggcatg

SEQ ID NO: 4191069 - DNA, 23 bp, Homo sapiens
tgcctaattcctggcatgacact

SEQ ID NO: 4191070 - DNA, 15 bp, Homo sapiens
tgcctatccatcctg

SEQ ID NO: 4191071 - DNA, 15 bp, Homo sapiens
tgcctatcctctgta

SEQ ID NO: 4191072 - DNA, 17 bp, Homo sapiens
tgcctcaagaacacctt

SEQ ID NO: 4191073 - DNA, 15 bp, Homo sapiens
tgcctcagagcaggc

SEQ ID NO: 4191074 - DNA, 14 bp, Homo sapiens
tgcctccttcagtg

SEQ ID NO: 4191075 - DNA, 17 bp, Homo sapiens
tgcctccttcagtgaca

SEQ ID NO: 4191076 - DNA, 18 bp, Homo sapiens
tgcctctctgctccagag

SEQ ID NO: 4191077 - DNA, 15 bp, Homo sapiens
tgcctctgctactga

SEQ ID NO: 4191078 - DNA, 16 bp, Homo sapiens
tgcctctgtcttctgg

SEQ ID NO: 4191079 - DNA, 21 bp, Homo sapiens
tgcctgactagggagccatgt

SEQ ID NO: 4191080 - DNA, 11 bp, Homo sapiens
tgcctgcagcc

SEQ ID NO: 4191081 - DNA, 12 bp, Homo sapiens
tgcctgccctgg

SEQ ID NO: 4191082 - DNA, 13 bp, Homo sapiens
tgcctgccctgga

SEQ ID NO: 4191083 - DNA, 19 bp, Homo sapiens
tgcctggaggatccctcca

SEQ ID NO: 4191084 - DNA, 21 bp, Homo sapiens
tgcctggcccccctccaggca

SEQ ID NO: 4191085 - DNA, 17 bp, Homo sapiens
tgcctggcttgctgtgg

SEQ ID NO: 4191086 - DNA, 19 bp, Homo sapiens
tgcctgtaatcccaacact

SEQ ID NO: 4191087 - DNA, 22 bp, Homo sapiens
tgcctgtagctttcctggtccc

SEQ ID NO: 4191088 - DNA, 23 bp, Homo sapiens
tgcctgtagctttcctggtccct

SEQ ID NO: 4191089 - DNA, 19 bp, Homo sapiens
tgcctgtagttaggaaata

SEQ ID NO: 4191090 - DNA, 21 bp, Homo sapiens
tgcctgtagttaggaaataaa

SEQ ID NO: 4191091 - DNA, 15 bp, Homo sapiens
tgcctgtgcatgacc

SEQ ID NO: 4191092 - DNA, 22 bp, Homo sapiens
tgcctgtggagacagccctgcc

SEQ ID NO: 4191093 - DNA, 21 bp, Homo sapiens
tgcctgtggtgaggtcctgtc

SEQ ID NO: 4191094 - DNA, 22 bp, Homo sapiens
tgcctgtggtgaggtcctgtcc

SEQ ID NO: 4191095 - DNA, 23 bp, Homo sapiens
tgccttaataagaatggttgcct

SEQ ID NO: 4191096 - DNA, 15 bp, Homo sapiens
tgccttccagaaaac

SEQ ID NO: 4191097 - DNA, 18 bp, Homo sapiens
tgccttccagaaaacaaa

SEQ ID NO: 4191098 - DNA, 14 bp, Homo sapiens
tgccttcctcgtgc

SEQ ID NO: 4191099 - DNA, 13 bp, Homo sapiens
tgccttctccctg

SEQ ID NO: 4191100 - DNA, 14 bp, Homo sapiens
tgccttgaagccac

SEQ ID NO: 4191101 - DNA, 21 bp, Homo sapiens
tgccttgatgttgtgttgtta

SEQ ID NO: 4191102 - DNA, 17 bp, Homo sapiens
tgcctttagatgtgagc

SEQ ID NO: 4191103 - DNA, 11 bp, Homo sapiens
tgcctttctct

SEQ ID NO: 4191104 - DNA, 20 bp, Homo sapiens
tgcctttctctggctccaga

SEQ ID NO: 4191105 - DNA, 16 bp, Homo sapiens
tgccttttaaaagaaa

SEQ ID NO: 4191106 - DNA, 22 bp, Homo sapiens
tgccttttatagctattactgt

SEQ ID NO: 4191107 - DNA, 23 bp, Homo sapiens
tgccttttttcacagcccgggtg

SEQ ID NO: 4191108 - DNA, 17 bp, Homo sapiens
tgcgaaaacgttgaccc

SEQ ID NO: 4191109 - DNA, 18 bp, Homo sapiens
tgcgaaaacgttgacccc

SEQ ID NO: 4191110 - DNA, 17 bp, Homo sapiens
tgcgatcttcagagcag

SEQ ID NO: 4191111 - DNA, 19 bp, Homo sapiens
tgcgattttgcctgtgtct

SEQ ID NO: 4191112 - DNA, 17 bp, Homo sapiens
tgcgctcccgcatttct

SEQ ID NO: 4191113 - DNA, 18 bp, Homo sapiens
tgcgggatggtcctgggg

SEQ ID NO: 4191114 - DNA, 14 bp, Homo sapiens
tgcggtatacattt

SEQ ID NO: 4191115 - DNA, 22 bp, Homo sapiens
tgcgtgactattttttaataaa

SEQ ID NO: 4191116 - DNA, 23 bp, Homo sapiens
tgcgtgccgggagaggactctgc

SEQ ID NO: 4191117 - DNA, 20 bp, Homo sapiens
tgcgtgtgtgcatgtatgtg

SEQ ID NO: 4191118 - DNA, 20 bp, Homo sapiens
tgctaattgaacatgcaatt

SEQ ID NO: 4191119 - DNA, 15 bp, Homo sapiens
tgctaccgagaaggt

SEQ ID NO: 4191120 - DNA, 17 bp, Homo sapiens
tgctacctctgagaaga

SEQ ID NO: 4191121 - DNA, 18 bp, Homo sapiens
tgctacctctgagaagac

SEQ ID NO: 4191122 - DNA, 12 bp, Homo sapiens
tgctactccatg

SEQ ID NO: 4191123 - DNA, 14 bp, Homo sapiens
tgctactccatgca

SEQ ID NO: 4191124 - DNA, 18 bp, Homo sapiens
tgctactccatgcagggg

SEQ ID NO: 4191125 - DNA, 19 bp, Homo sapiens
tgctaggcgagtgccagga

SEQ ID NO: 4191126 - DNA, 21 bp, Homo sapiens
tgctaggcgagtgccaggact

SEQ ID NO: 4191127 - DNA, 19 bp, Homo sapiens
tgctataggctggagaagc

SEQ ID NO: 4191128 - DNA, 20 bp, Homo sapiens
tgctataggctggagaagct

SEQ ID NO: 4191129 - DNA, 14 bp, Homo sapiens
tgctatctcaaagt

SEQ ID NO: 4191130 - DNA, 15 bp, Homo sapiens
tgctatgacatgcaa

SEQ ID NO: 4191131 - DNA, 15 bp, Homo sapiens
tgctatggtgctctg

SEQ ID NO: 4191132 - DNA, 17 bp, Homo sapiens
tgctcagccctgactgg

SEQ ID NO: 4191133 - DNA, 13 bp, Homo sapiens
tgctcaggtactt

SEQ ID NO: 4191134 - DNA, 17 bp, Homo sapiens
tgctcaggtacttgtaa

SEQ ID NO: 4191135 - DNA, 22 bp, Homo sapiens
tgctcctaaacccccgctccag

SEQ ID NO: 4191136 - DNA, 23 bp, Homo sapiens
tgctcctaaacccccgctccaga

SEQ ID NO: 4191137 - DNA, 13 bp, Homo sapiens
tgctcctccagcc

SEQ ID NO: 4191138 - DNA, 20 bp, Homo sapiens
tgctcctccagcccttcaga

SEQ ID NO: 4191139 - DNA, 23 bp, Homo sapiens
tgctcctccagcccttcagacga

SEQ ID NO: 4191140 - DNA, 22 bp, Homo sapiens
tgctctagtcttgctttgctgt

SEQ ID NO: 4191141 - DNA, 23 bp, Homo sapiens
tgctctagtcttgctttgctgtc

SEQ ID NO: 4191142 - DNA, 15 bp, Homo sapiens
tgctctcatttcttt

SEQ ID NO: 4191143 - DNA, 13 bp, Homo sapiens
tgctctcccctgc

SEQ ID NO: 4191144 - DNA, 16 bp, Homo sapiens
tgctctcccctgccct

SEQ ID NO: 4191145 - DNA, 15 bp, Homo sapiens
tgctctgcaggcacc

SEQ ID NO: 4191146 - DNA, 22 bp, Homo sapiens
tgctgaagggaccttgaagggt

SEQ ID NO: 4191147 - DNA, 15 bp, Homo sapiens
tgctgagaatagtgt

SEQ ID NO: 4191148 - DNA, 18 bp, Homo sapiens
tgctgagcagcccagcac

SEQ ID NO: 4191149 - DNA, 22 bp, Homo sapiens
tgctgaggggcagggagagcgc

SEQ ID NO: 4191150 - DNA, 18 bp, Homo sapiens
tgctgatcaatgaaatgc

SEQ ID NO: 4191151 - DNA, 15 bp, Homo sapiens
tgctgatgtcaaagt

SEQ ID NO: 4191152 - DNA, 18 bp, Homo sapiens
tgctgattcaagaaacag

SEQ ID NO: 4191153 - DNA, 16 bp, Homo sapiens
tgctgattcagcctgg

SEQ ID NO: 4191154 - DNA, 16 bp, Homo sapiens
tgctgcactgccctcc

SEQ ID NO: 4191155 - DNA, 22 bp, Homo sapiens
tgctgctgacctgatcacctct

SEQ ID NO: 4191156 - DNA, 18 bp, Homo sapiens
tgctggaaaataatactg

SEQ ID NO: 4191157 - DNA, 17 bp, Homo sapiens
tgctggaaaccacactt

SEQ ID NO: 4191158 - DNA, 13 bp, Homo sapiens
tgctggatttgat

SEQ ID NO: 4191159 - DNA, 14 bp, Homo sapiens
tgctggctttttgt

SEQ ID NO: 4191160 - DNA, 18 bp, Homo sapiens
tgctgggaacacagccag

SEQ ID NO: 4191161 - DNA, 13 bp, Homo sapiens
tgctgggatagcc

SEQ ID NO: 4191162 - DNA, 19 bp, Homo sapiens
tgctgggcattttcccaga

SEQ ID NO: 4191163 - DNA, 16 bp, Homo sapiens
tgctgtcactggcaga

SEQ ID NO: 4191164 - DNA, 18 bp, Homo sapiens
tgctgtcactggcagagc

SEQ ID NO: 4191165 - DNA, 13 bp, Homo sapiens
tgctgtcagccaa

SEQ ID NO: 4191166 - DNA, 15 bp, Homo sapiens
tgctgtcatggtcct

SEQ ID NO: 4191167 - DNA, 23 bp, Homo sapiens
tgctgtcatggtcctttctggaa

SEQ ID NO: 4191168 - DNA, 14 bp, Homo sapiens
tgctgtggccaggg

SEQ ID NO: 4191169 - DNA, 14 bp, Homo sapiens
tgctgtggcccagt

SEQ ID NO: 4191170 - DNA, 14 bp, Homo sapiens
tgcttcaaaccctc

SEQ ID NO: 4191171 - DNA, 12 bp, Homo sapiens
tgcttcacataa

SEQ ID NO: 4191172 - DNA, 14 bp, Homo sapiens
tgcttcagcctgag

SEQ ID NO: 4191173 - DNA, 16 bp, Homo sapiens
tgcttctctacagact

SEQ ID NO: 4191174 - DNA, 13 bp, Homo sapiens
tgcttctgcagca

SEQ ID NO: 4191175 - DNA, 19 bp, Homo sapiens
tgcttctgcagcaactccc

SEQ ID NO: 4191176 - DNA, 16 bp, Homo sapiens
tgcttcttcatcttga

SEQ ID NO: 4191177 - DNA, 19 bp, Homo sapiens
tgcttgatgggattctgga

SEQ ID NO: 4191178 - DNA, 20 bp, Homo sapiens
tgcttgatgggattctggac

SEQ ID NO: 4191179 - DNA, 13 bp, Homo sapiens
tgcttggcagaga

SEQ ID NO: 4191180 - DNA, 13 bp, Homo sapiens
tgctttcaggtct

SEQ ID NO: 4191181 - DNA, 14 bp, Homo sapiens
tgctttccttttct

SEQ ID NO: 4191182 - DNA, 14 bp, Homo sapiens
tgctttgcttttta

SEQ ID NO: 4191183 - DNA, 19 bp, Homo sapiens
tgctttgtatccatgaggg

SEQ ID NO: 4191184 - DNA, 15 bp, Homo sapiens
tgctttgttttctaa

SEQ ID NO: 4191185 - DNA, 24 bp, Homo sapiens
tgcttttagtattttagtgaactt

SEQ ID NO: 4191186 - DNA, 21 bp, Homo sapiens
tggaaaaagaaagaaacactc

SEQ ID NO: 4191187 - DNA, 17 bp, Homo sapiens
tggaaaaataacaacta

SEQ ID NO: 4191188 - DNA, 23 bp, Homo sapiens
tggaaaagaatccctgcagcctg

SEQ ID NO: 4191189 - DNA, 14 bp, Homo sapiens
tggaaacaggacca

SEQ ID NO: 4191190 - DNA, 15 bp, Homo sapiens
tggaaaccacacttc

SEQ ID NO: 4191191 - DNA, 20 bp, Homo sapiens
tggaaagactgattgtttta

SEQ ID NO: 4191192 - DNA, 12 bp, Homo sapiens
tggaaagagacc

SEQ ID NO: 4191193 - DNA, 16 bp, Homo sapiens
tggaaagcatcacctc

SEQ ID NO: 4191194 - DNA, 15 bp, Homo sapiens
tggaaagcctctgct

SEQ ID NO: 4191195 - DNA, 17 bp, Homo sapiens
tggaaaggctcagtctc

SEQ ID NO: 4191196 - DNA, 22 bp, Homo sapiens
tggaaaggtttcaagacttgat

SEQ ID NO: 4191197 - DNA, 16 bp, Homo sapiens
tggaaagttcagccag

SEQ ID NO: 4191198 - DNA, 19 bp, Homo sapiens
tggaaataaacctggagat

SEQ ID NO: 4191199 - DNA, 23 bp, Homo sapiens
tggaaataaacctggagatgatg

SEQ ID NO: 4191200 - DNA, 23 bp, Homo sapiens
tggaaatattcatgcttcttcct

SEQ ID NO: 4191201 - DNA, 21 bp, Homo sapiens
tggaacaattattttattgtc

SEQ ID NO: 4191202 - DNA, 22 bp, Homo sapiens
tggaacactagacaagccagaa

SEQ ID NO: 4191203 - DNA, 15 bp, Homo sapiens
tggaacttctaatat

SEQ ID NO: 4191204 - DNA, 13 bp, Homo sapiens
tggaagagaggca

SEQ ID NO: 4191205 - DNA, 14 bp, Homo sapiens
tggaagagaggcac

SEQ ID NO: 4191206 - DNA, 19 bp, Homo sapiens
tggaagagaggcacctgct

SEQ ID NO: 4191207 - DNA, 16 bp, Homo sapiens
tggaagataattttat

SEQ ID NO: 4191208 - DNA, 17 bp, Homo sapiens
tggaagataattttatg

SEQ ID NO: 4191209 - DNA, 15 bp, Homo sapiens
tggaaggcagggaca

SEQ ID NO: 4191210 - DNA, 22 bp, Homo sapiens
tggaaggttaggtttgtcaaca

SEQ ID NO: 4191211 - DNA, 14 bp, Homo sapiens
tggaatataattgt

SEQ ID NO: 4191212 - DNA, 16 bp, Homo sapiens
tggaatcaaggaatcc

SEQ ID NO: 4191213 - DNA, 19 bp, Homo sapiens
tggaatcaaggaatcctga

SEQ ID NO: 4191214 - DNA, 20 bp, Homo sapiens
tggaatcaaggaatcctgag

SEQ ID NO: 4191215 - DNA, 20 bp, Homo sapiens
tggaatttaatttatgtgaa

SEQ ID NO: 4191216 - DNA, 16 bp, Homo sapiens
tggaatttgtaagttt

SEQ ID NO: 4191217 - DNA, 15 bp, Homo sapiens
tggaattttcagtca

SEQ ID NO: 4191218 - DNA, 13 bp, Homo sapiens
tggacaaaatgga

SEQ ID NO: 4191219 - DNA, 15 bp, Homo sapiens
tggacaaagaacctt

SEQ ID NO: 4191220 - DNA, 13 bp, Homo sapiens
tggacaaatggac

SEQ ID NO: 4191221 - DNA, 13 bp, Homo sapiens
tggacaagaagct

SEQ ID NO: 4191222 - DNA, 20 bp, Homo sapiens
tggacacagacccacacatg

SEQ ID NO: 4191223 - DNA, 16 bp, Homo sapiens
tggacacctgccctgc

SEQ ID NO: 4191224 - DNA, 16 bp, Homo sapiens
tggacagtcctgggag

SEQ ID NO: 4191225 - DNA, 16 bp, Homo sapiens
tggacgccgagggcag

SEQ ID NO: 4191226 - DNA, 13 bp, Homo sapiens
tggactcctccca

SEQ ID NO: 4191227 - DNA, 23 bp, Homo sapiens
tggactgggttttgtctctgcat

SEQ ID NO: 4191228 - DNA, 15 bp, Homo sapiens
tggagaaattattta

SEQ ID NO: 4191229 - DNA, 17 bp, Homo sapiens
tggagaaattatttaat

SEQ ID NO: 4191230 - DNA, 13 bp, Homo sapiens
tggagaactaggt

SEQ ID NO: 4191231 - DNA, 22 bp, Homo sapiens
tggagaagcctattagctggga

SEQ ID NO: 4191232 - DNA, 16 bp, Homo sapiens
tggagaagctcaccca

SEQ ID NO: 4191233 - DNA, 12 bp, Homo sapiens
tggagaaggaag

SEQ ID NO: 4191234 - DNA, 22 bp, Homo sapiens
tggagaaggatagcctcagcca

SEQ ID NO: 4191235 - DNA, 16 bp, Homo sapiens
tggagacagccctgcc

SEQ ID NO: 4191236 - DNA, 13 bp, Homo sapiens
tggagagcagctg

SEQ ID NO: 4191237 - DNA, 16 bp, Homo sapiens
tggagagcagctggct

SEQ ID NO: 4191238 - DNA, 20 bp, Homo sapiens
tggagagcagctggctctcc

SEQ ID NO: 4191239 - DNA, 17 bp, Homo sapiens
tggagagcgggtgggtg

SEQ ID NO: 4191240 - DNA, 22 bp, Homo sapiens
tggagaggagggatgctgcctg

SEQ ID NO: 4191241 - DNA, 12 bp, Homo sapiens
tggagatgatga

SEQ ID NO: 4191242 - DNA, 13 bp, Homo sapiens
tggagatgcagag

SEQ ID NO: 4191243 - DNA, 17 bp, Homo sapiens
tggagccaaggcagagg

SEQ ID NO: 4191244 - DNA, 19 bp, Homo sapiens
tggagcccgcttcaagctc

SEQ ID NO: 4191245 - DNA, 15 bp, Homo sapiens
tggagcccttgggtt

SEQ ID NO: 4191246 - DNA, 16 bp, Homo sapiens
tggagcctgaacatga

SEQ ID NO: 4191247 - DNA, 16 bp, Homo sapiens
tggagcgcacctgccc

SEQ ID NO: 4191248 - DNA, 22 bp, Homo sapiens
tggagcggagcttgcctgcctg

SEQ ID NO: 4191249 - DNA, 18 bp, Homo sapiens
tggaggcttcttgcccag

SEQ ID NO: 4191250 - DNA, 16 bp, Homo sapiens
tggagggaagacaggt

SEQ ID NO: 4191251 - DNA, 17 bp, Homo sapiens
tggaggtggggaaggct

SEQ ID NO: 4191252 - DNA, 18 bp, Homo sapiens
tggagtgtgcgtgtgtgc

SEQ ID NO: 4191253 - DNA, 19 bp, Homo sapiens
tggagtgtgcgtgtgtgca

SEQ ID NO: 4191254 - DNA, 13 bp, Homo sapiens
tggagttcagaga

SEQ ID NO: 4191255 - DNA, 18 bp, Homo sapiens
tggagttttttgtaccaa

SEQ ID NO: 4191256 - DNA, 23 bp, Homo sapiens
tggataatcttcggccaatttat

SEQ ID NO: 4191257 - DNA, 15 bp, Homo sapiens
tggatatatttaaaa

SEQ ID NO: 4191258 - DNA, 21 bp, Homo sapiens
tggatatggtgcaaaaatgag

SEQ ID NO: 4191259 - DNA, 18 bp, Homo sapiens
tggatggcccagcaggca

SEQ ID NO: 4191260 - DNA, 20 bp, Homo sapiens
tggatggcccagcaggcagg

SEQ ID NO: 4191261 - DNA, 14 bp, Homo sapiens
tggatgggccctgc

SEQ ID NO: 4191262 - DNA, 18 bp, Homo sapiens
tggattcaaatgtcagtt

SEQ ID NO: 4191263 - DNA, 19 bp, Homo sapiens
tggattccccatctcaggc

SEQ ID NO: 4191264 - DNA, 22 bp, Homo sapiens
tggattccccatctcaggccag

SEQ ID NO: 4191265 - DNA, 23 bp, Homo sapiens
tggattttttccttcaaagttta

SEQ ID NO: 4191266 - DNA, 20 bp, Homo sapiens
tggcaaagcggttgcttctg

SEQ ID NO: 4191267 - DNA, 12 bp, Homo sapiens
tggcaacagaag

SEQ ID NO: 4191268 - DNA, 15 bp, Homo sapiens
tggcaacagaagcag

SEQ ID NO: 4191269 - DNA, 16 bp, Homo sapiens
tggcaatttcctggcc

SEQ ID NO: 4191270 - DNA, 22 bp, Homo sapiens
tggcaatttcctggccctccac

SEQ ID NO: 4191271 - DNA, 17 bp, Homo sapiens
tggcagagcacagccca

SEQ ID NO: 4191272 - DNA, 14 bp, Homo sapiens
tggcagccctgtag

SEQ ID NO: 4191273 - DNA, 12 bp, Homo sapiens
tggcaggaaggc

SEQ ID NO: 4191274 - DNA, 14 bp, Homo sapiens
tggcaggaccagga

SEQ ID NO: 4191275 - DNA, 16 bp, Homo sapiens
tggcaggaccaggact

SEQ ID NO: 4191276 - DNA, 17 bp, Homo sapiens
tggcaggaccctgtcag

SEQ ID NO: 4191277 - DNA, 14 bp, Homo sapiens
tggcaggagaatca

SEQ ID NO: 4191278 - DNA, 22 bp, Homo sapiens
tggcaggatgaccctgcgaagg

SEQ ID NO: 4191279 - DNA, 21 bp, Homo sapiens
tggcatgagaaatacaaaaat

SEQ ID NO: 4191280 - DNA, 20 bp, Homo sapiens
tggcatgcttaaatattgaa

SEQ ID NO: 4191281 - DNA, 12 bp, Homo sapiens
tggcatggcaga

SEQ ID NO: 4191282 - DNA, 23 bp, Homo sapiens
tggcatggtgctttcaggtctgg

SEQ ID NO: 4191283 - DNA, 21 bp, Homo sapiens
tggcatgtcagagccaggctc

SEQ ID NO: 4191284 - DNA, 23 bp, Homo sapiens
tggcatgtcagagccaggctctg

SEQ ID NO: 4191285 - DNA, 18 bp, Homo sapiens
tggccaaattatttgtgt

SEQ ID NO: 4191286 - DNA, 22 bp, Homo sapiens
tggccaatgcacctaaagaaaa

SEQ ID NO: 4191287 - DNA, 20 bp, Homo sapiens
tggccaggcaccccctggag

SEQ ID NO: 4191288 - DNA, 17 bp, Homo sapiens
tggccagggtgagagct

SEQ ID NO: 4191289 - DNA, 18 bp, Homo sapiens
tggccagggtgagagctg

SEQ ID NO: 4191290 - DNA, 13 bp, Homo sapiens
tggcccagcaggc

SEQ ID NO: 4191291 - DNA, 14 bp, Homo sapiens
tggcccagcaggca

SEQ ID NO: 4191292 - DNA, 15 bp, Homo sapiens
tggcccagccagcca

SEQ ID NO: 4191293 - DNA, 22 bp, Homo sapiens
tggccccaggcccacagcgtgg

SEQ ID NO: 4191294 - DNA, 15 bp, Homo sapiens
tggcccccctccagg

SEQ ID NO: 4191295 - DNA, 21 bp, Homo sapiens
tggcccccctccaggcatgct

SEQ ID NO: 4191296 - DNA, 18 bp, Homo sapiens
tggccgggtgcggtggct

SEQ ID NO: 4191297 - DNA, 15 bp, Homo sapiens
tggcctcctgggggc

SEQ ID NO: 4191298 - DNA, 18 bp, Homo sapiens
tggcctgtgtctggcccc

SEQ ID NO: 4191299 - DNA, 14 bp, Homo sapiens
tggccttctcagcc

SEQ ID NO: 4191300 - DNA, 20 bp, Homo sapiens
tggcgctgagggtttttcta

SEQ ID NO: 4191301 - DNA, 18 bp, Homo sapiens
tggcgtgtccctctcgga

SEQ ID NO: 4191302 - DNA, 15 bp, Homo sapiens
tggctaattcccaga

SEQ ID NO: 4191303 - DNA, 21 bp, Homo sapiens
tggctatatggcaagaaagct

SEQ ID NO: 4191304 - DNA, 16 bp, Homo sapiens
tggctatgggaatcag

SEQ ID NO: 4191305 - DNA, 22 bp, Homo sapiens
tggctatgggaatcagctggtg

SEQ ID NO: 4191306 - DNA, 19 bp, Homo sapiens
tggctccaaggtgctctgt

SEQ ID NO: 4191307 - DNA, 21 bp, Homo sapiens
tggctccaaggtgctctgtgt

SEQ ID NO: 4191308 - DNA, 18 bp, Homo sapiens
tggctcccagggtcctgg

SEQ ID NO: 4191309 - DNA, 18 bp, Homo sapiens
tggctcctccttcccctg

SEQ ID NO: 4191310 - DNA, 16 bp, Homo sapiens
tggctctccaccttgt

SEQ ID NO: 4191311 - DNA, 19 bp, Homo sapiens
tggctctgaaggatcctgg

SEQ ID NO: 4191312 - DNA, 19 bp, Homo sapiens
tggctctggacagcagcag

SEQ ID NO: 4191313 - DNA, 15 bp, Homo sapiens
tggctcttgcctgta

SEQ ID NO: 4191314 - DNA, 22 bp, Homo sapiens
tggctgaccccaaagagcctgg

SEQ ID NO: 4191315 - DNA, 19 bp, Homo sapiens
tggctgcaggaatctttaa

SEQ ID NO: 4191316 - DNA, 14 bp, Homo sapiens
tggctggctgcagt

SEQ ID NO: 4191317 - DNA, 21 bp, Homo sapiens
tggctgtggttcctaagcctg

SEQ ID NO: 4191318 - DNA, 23 bp, Homo sapiens
tggctgtggttcctaagcctgtt

SEQ ID NO: 4191319 - DNA, 14 bp, Homo sapiens
tggcttagaaattt

SEQ ID NO: 4191320 - DNA, 19 bp, Homo sapiens
tggcttattttttaaaata

SEQ ID NO: 4191321 - DNA, 23 bp, Homo sapiens
tggcttccaggtatctccaggat

SEQ ID NO: 4191322 - DNA, 14 bp, Homo sapiens
tggcttcctcactc

SEQ ID NO: 4191323 - DNA, 11 bp, Homo sapiens
tggctttcagg

SEQ ID NO: 4191324 - DNA, 14 bp, Homo sapiens
tggctttcagggag

SEQ ID NO: 4191325 - DNA, 12 bp, Homo sapiens
tggctttcccgg

SEQ ID NO: 4191326 - DNA, 20 bp, Homo sapiens
tggctttctcccactgagtt

SEQ ID NO: 4191327 - DNA, 23 bp, Homo sapiens
tggctttctccgactgctaggga

SEQ ID NO: 4191328 - DNA, 21 bp, Homo sapiens
tggcttttcgcttgcttctgc

SEQ ID NO: 4191329 - DNA, 22 bp, Homo sapiens
tggcttttcgcttgcttctgca

SEQ ID NO: 4191330 - DNA, 20 bp, Homo sapiens
tggcttttgcggttcaggaa

SEQ ID NO: 4191331 - DNA, 19 bp, Homo sapiens
tggcttttttcctcctgtg

SEQ ID NO: 4191332 - DNA, 21 bp, Homo sapiens
tgggaagccatattcacacct

SEQ ID NO: 4191333 - DNA, 14 bp, Homo sapiens
tgggaatcctgctg

SEQ ID NO: 4191334 - DNA, 18 bp, Homo sapiens
tgggaatcctgctgccag

SEQ ID NO: 4191335 - DNA, 20 bp, Homo sapiens
tgggaattctttacaataaa

SEQ ID NO: 4191336 - DNA, 17 bp, Homo sapiens
tgggaccacaactattt

SEQ ID NO: 4191337 - DNA, 13 bp, Homo sapiens
tgggaccctccag

SEQ ID NO: 4191338 - DNA, 23 bp, Homo sapiens
tgggacctgaatgacctgcagtc

SEQ ID NO: 4191339 - DNA, 20 bp, Homo sapiens
tgggactctatactaccctg

SEQ ID NO: 4191340 - DNA, 19 bp, Homo sapiens
tgggagaaatctggcttct

SEQ ID NO: 4191341 - DNA, 15 bp, Homo sapiens
tgggagaacctcagg

SEQ ID NO: 4191342 - DNA, 13 bp, Homo sapiens
tgggagaagagaa

SEQ ID NO: 4191343 - DNA, 18 bp, Homo sapiens
tgggagagcccagccatt

SEQ ID NO: 4191344 - DNA, 14 bp, Homo sapiens
tgggagagcctggc

SEQ ID NO: 4191345 - DNA, 13 bp, Homo sapiens
tgggagctcagct

SEQ ID NO: 4191346 - DNA, 19 bp, Homo sapiens
tgggagctcagctcgctgc

SEQ ID NO: 4191347 - DNA, 24 bp, Homo sapiens
tgggaggaagcaggttgaggggct

SEQ ID NO: 4191348 - DNA, 13 bp, Homo sapiens
tgggaggcagcat

SEQ ID NO: 4191349 - DNA, 23 bp, Homo sapiens
tgggaggcctcgtaccagccagg

SEQ ID NO: 4191350 - DNA, 22 bp, Homo sapiens
tgggaggcggagagtacagtga

SEQ ID NO: 4191351 - DNA, 15 bp, Homo sapiens
tgggaggctgaggcg

SEQ ID NO: 4191352 - DNA, 19 bp, Homo sapiens
tgggaggggatggcagaca

SEQ ID NO: 4191353 - DNA, 17 bp, Homo sapiens
tgggaggtccaggcagg

SEQ ID NO: 4191354 - DNA, 18 bp, Homo sapiens
tgggaggtccaggcagga

SEQ ID NO: 4191355 - DNA, 20 bp, Homo sapiens
tgggatagggtcagatgcac

SEQ ID NO: 4191356 - DNA, 15 bp, Homo sapiens
tgggccactctcccc

SEQ ID NO: 4191357 - DNA, 19 bp, Homo sapiens
tgggccagctgtcgcatct

SEQ ID NO: 4191358 - DNA, 17 bp, Homo sapiens
tgggcccacagagatgc

SEQ ID NO: 4191359 - DNA, 19 bp, Homo sapiens
tgggcccacagagatgcat

SEQ ID NO: 4191360 - DNA, 15 bp, Homo sapiens
tgggcccacagagcc

SEQ ID NO: 4191361 - DNA, 16 bp, Homo sapiens
tgggctccctggccca

SEQ ID NO: 4191362 - DNA, 21 bp, Homo sapiens
tgggctccctggcccagccag

SEQ ID NO: 4191363 - DNA, 12 bp, Homo sapiens
tgggctctgccc

SEQ ID NO: 4191364 - DNA, 23 bp, Homo sapiens
tgggctctgccccagctctggct

SEQ ID NO: 4191365 - DNA, 14 bp, Homo sapiens
tgggctctggtctg

SEQ ID NO: 4191366 - DNA, 13 bp, Homo sapiens
tgggctggcccag

SEQ ID NO: 4191367 - DNA, 20 bp, Homo sapiens
tgggcttctgaaacttcata

SEQ ID NO: 4191368 - DNA, 12 bp, Homo sapiens
tggggaagaaaa

SEQ ID NO: 4191369 - DNA, 15 bp, Homo sapiens
tggggaagaaaaaat

SEQ ID NO: 4191370 - DNA, 17 bp, Homo sapiens
tggggaagaaaaaatgt

SEQ ID NO: 4191371 - DNA, 22 bp, Homo sapiens
tggggacaggtaagtggcagga

SEQ ID NO: 4191372 - DNA, 23 bp, Homo sapiens
tggggactgctacctctgagaag

SEQ ID NO: 4191373 - DNA, 20 bp, Homo sapiens
tggggagggtggaggggtga

SEQ ID NO: 4191374 - DNA, 17 bp, Homo sapiens
tggggataaaggagaag

SEQ ID NO: 4191375 - DNA, 11 bp, Homo sapiens
tggggcagtgg

SEQ ID NO: 4191376 - DNA, 23 bp, Homo sapiens
tggggctccggaggggacccagc

SEQ ID NO: 4191377 - DNA, 21 bp, Homo sapiens
tggggctcgccccacccaggg

SEQ ID NO: 4191378 - DNA, 13 bp, Homo sapiens
tggggctgggcct

SEQ ID NO: 4191379 - DNA, 15 bp, Homo sapiens
tggggcttgccctgg

SEQ ID NO: 4191380 - DNA, 18 bp, Homo sapiens
tggggcttgccctgggtc

SEQ ID NO: 4191381 - DNA, 13 bp, Homo sapiens
tggggtcagccag

SEQ ID NO: 4191382 - DNA, 14 bp, Homo sapiens
tggggtcagccagg

SEQ ID NO: 4191383 - DNA, 18 bp, Homo sapiens
tggggtcagccagggcca

SEQ ID NO: 4191384 - DNA, 22 bp, Homo sapiens
tggggtccaggtcaccagcctg

SEQ ID NO: 4191385 - DNA, 16 bp, Homo sapiens
tggggttcccgaggga

SEQ ID NO: 4191386 - DNA, 17 bp, Homo sapiens
tggggttgcccagcctg

SEQ ID NO: 4191387 - DNA, 19 bp, Homo sapiens
tggggttgcccagcctgga

SEQ ID NO: 4191388 - DNA, 12 bp, Homo sapiens
tgggtaagaaga

SEQ ID NO: 4191389 - DNA, 14 bp, Homo sapiens
tgggtaattttctt

SEQ ID NO: 4191390 - DNA, 15 bp, Homo sapiens
tgggtacatgtgagg

SEQ ID NO: 4191391 - DNA, 20 bp, Homo sapiens
tgggtatagttcatgtctgc

SEQ ID NO: 4191392 - DNA, 22 bp, Homo sapiens
tgggtcacacctgacaaatgga

SEQ ID NO: 4191393 - DNA, 21 bp, Homo sapiens
tgggtcccgggtgccccccat

SEQ ID NO: 4191394 - DNA, 20 bp, Homo sapiens
tgggtccctcggagctgcca

SEQ ID NO: 4191395 - DNA, 13 bp, Homo sapiens
tgggtgacggtcc

SEQ ID NO: 4191396 - DNA, 14 bp, Homo sapiens
tgggtggtggatct

SEQ ID NO: 4191397 - DNA, 18 bp, Homo sapiens
tgggtgtgtgtagccaag

SEQ ID NO: 4191398 - DNA, 13 bp, Homo sapiens
tgggttcctcttc

SEQ ID NO: 4191399 - DNA, 23 bp, Homo sapiens
tgggttctttggaaggagtgaga

SEQ ID NO: 4191400 - DNA, 22 bp, Homo sapiens
tggtaactgattacctgccaat

SEQ ID NO: 4191401 - DNA, 15 bp, Homo sapiens
tggtaagctctggct

SEQ ID NO: 4191402 - DNA, 21 bp, Homo sapiens
tggtaatttgtatctgaagga

SEQ ID NO: 4191403 - DNA, 22 bp, Homo sapiens
tggtagcacatgtctgtcctca

SEQ ID NO: 4191404 - DNA, 23 bp, Homo sapiens
tggtagcacatgtctgtcctcag

SEQ ID NO: 4191405 - DNA, 20 bp, Homo sapiens
tggtaggcttatcaaaatct

SEQ ID NO: 4191406 - DNA, 20 bp, Homo sapiens
tggtattgggcagttgggag

SEQ ID NO: 4191407 - DNA, 17 bp, Homo sapiens
tggtcaaaagctggatt

SEQ ID NO: 4191408 - DNA, 17 bp, Homo sapiens
tggtcaaaccgcactca

SEQ ID NO: 4191409 - DNA, 15 bp, Homo sapiens
tggtcagagccactc

SEQ ID NO: 4191410 - DNA, 12 bp, Homo sapiens
tggtcagagtgc

SEQ ID NO: 4191411 - DNA, 14 bp, Homo sapiens
tggtcagagtgcca

SEQ ID NO: 4191412 - DNA, 13 bp, Homo sapiens
tggtcatggacag

SEQ ID NO: 4191413 - DNA, 20 bp, Homo sapiens
tggtccagtttctagagggc

SEQ ID NO: 4191414 - DNA, 13 bp, Homo sapiens
tggtccctcaccc

SEQ ID NO: 4191415 - DNA, 23 bp, Homo sapiens
tggtcctccatttcaactccaga

SEQ ID NO: 4191416 - DNA, 13 bp, Homo sapiens
tggtcctgcactg

SEQ ID NO: 4191417 - DNA, 11 bp, Homo sapiens
tggtcctgggg

SEQ ID NO: 4191418 - DNA, 18 bp, Homo sapiens
tggtctgagcaccccctc

SEQ ID NO: 4191419 - DNA, 16 bp, Homo sapiens
tggtctgatttcagga

SEQ ID NO: 4191420 - DNA, 14 bp, Homo sapiens
tggtcttcactgcc

SEQ ID NO: 4191421 - DNA, 14 bp, Homo sapiens
tggtctttcctctg

SEQ ID NO: 4191422 - DNA, 16 bp, Homo sapiens
tggtctttgggcaggg

SEQ ID NO: 4191423 - DNA, 18 bp, Homo sapiens
tggtgaacagagagaacc

SEQ ID NO: 4191424 - DNA, 17 bp, Homo sapiens
tggtgacatgtgcctgt

SEQ ID NO: 4191425 - DNA, 21 bp, Homo sapiens
tggtgaggcccagcctgtcct

SEQ ID NO: 4191426 - DNA, 12 bp, Homo sapiens
tggtgatggagt

SEQ ID NO: 4191427 - DNA, 20 bp, Homo sapiens
tggtgccatttctgaactgt

SEQ ID NO: 4191428 - DNA, 22 bp, Homo sapiens
tggtgccatttctgaactgtta

SEQ ID NO: 4191429 - DNA, 22 bp, Homo sapiens
tggtgctcacgactcttcctgc

SEQ ID NO: 4191430 - DNA, 15 bp, Homo sapiens
tggtgctgacctctg

SEQ ID NO: 4191431 - DNA, 13 bp, Homo sapiens
tggtgctgtggcc

SEQ ID NO: 4191432 - DNA, 17 bp, Homo sapiens
tggtgctgtggccaggg

SEQ ID NO: 4191433 - DNA, 18 bp, Homo sapiens
tggtggagtcaggaaaga

SEQ ID NO: 4191434 - DNA, 13 bp, Homo sapiens
tggtggccaagcc

SEQ ID NO: 4191435 - DNA, 12 bp, Homo sapiens
tggtgggctggc

SEQ ID NO: 4191436 - DNA, 18 bp, Homo sapiens
tggtgggctggcccagcc

SEQ ID NO: 4191437 - DNA, 12 bp, Homo sapiens
tggtggggacag

SEQ ID NO: 4191438 - DNA, 18 bp, Homo sapiens
tggtgtagctcctctgct

SEQ ID NO: 4191439 - DNA, 12 bp, Homo sapiens
tggttctgtgac

SEQ ID NO: 4191440 - DNA, 18 bp, Homo sapiens
tggttgccttaaagaaag

SEQ ID NO: 4191441 - DNA, 11 bp, Homo sapiens
tggtttataga

SEQ ID NO: 4191442 - DNA, 15 bp, Homo sapiens
tggtttgcagctgtt

SEQ ID NO: 4191443 - DNA, 12 bp, Homo sapiens
tggttttaacaa

SEQ ID NO: 4191444 - DNA, 23 bp, Homo sapiens
tggttttacagtgaatttctgat

SEQ ID NO: 4191445 - DNA, 13 bp, Homo sapiens
tgtaaaaacaaaa

SEQ ID NO: 4191446 - DNA, 20 bp, Homo sapiens
tgtaaaaacaaaaagacagt

SEQ ID NO: 4191447 - DNA, 12 bp, Homo sapiens
tgtaaaatagct

SEQ ID NO: 4191448 - DNA, 20 bp, Homo sapiens
tgtaaaatagcttgtatagt

SEQ ID NO: 4191449 - DNA, 21 bp, Homo sapiens
tgtaaaatagcttgtatagtg

SEQ ID NO: 4191450 - DNA, 14 bp, Homo sapiens
tgtaaaattgtata

SEQ ID NO: 4191451 - DNA, 16 bp, Homo sapiens
tgtaaactcaaaactt

SEQ ID NO: 4191452 - DNA, 21 bp, Homo sapiens
tgtaaactcaaaacttaacat

SEQ ID NO: 4191453 - DNA, 18 bp, Homo sapiens
tgtaaaggcattctataa

SEQ ID NO: 4191454 - DNA, 17 bp, Homo sapiens
tgtaaagtgtaaatcct

SEQ ID NO: 4191455 - DNA, 18 bp, Homo sapiens
tgtaaatattttaaagaa

SEQ ID NO: 4191456 - DNA, 20 bp, Homo sapiens
tgtaaatattttaaagaatt

SEQ ID NO: 4191457 - DNA, 20 bp, Homo sapiens
tgtaagcattctgagctggg

SEQ ID NO: 4191458 - DNA, 23 bp, Homo sapiens
tgtaaggtcttcttgtgtcctga

SEQ ID NO: 4191459 - DNA, 12 bp, Homo sapiens
tgtaataaaagg

SEQ ID NO: 4191460 - DNA, 11 bp, Homo sapiens
tgtaataagac

SEQ ID NO: 4191461 - DNA, 16 bp, Homo sapiens
tgtaatagaaaactga

SEQ ID NO: 4191462 - DNA, 18 bp, Homo sapiens
tgtaatagaaaactgaaa

SEQ ID NO: 4191463 - DNA, 14 bp, Homo sapiens
tgtaatcagtttta

SEQ ID NO: 4191464 - DNA, 22 bp, Homo sapiens
tgtaatcccagctacccaggag

SEQ ID NO: 4191465 - DNA, 23 bp, Homo sapiens
tgtaatcccagctactcaggagg

SEQ ID NO: 4191466 - DNA, 20 bp, Homo sapiens
tgtaattaagtaaaccaaaa

SEQ ID NO: 4191467 - DNA, 23 bp, Homo sapiens
tgtaatttttttgtaaaggaaat

SEQ ID NO: 4191468 - DNA, 11 bp, Homo sapiens
tgtacaaatga

SEQ ID NO: 4191469 - DNA, 16 bp, Homo sapiens
tgtacacagtctgttt

SEQ ID NO: 4191470 - DNA, 15 bp, Homo sapiens
tgtaccaagaatctt

SEQ ID NO: 4191471 - DNA, 17 bp, Homo sapiens
tgtacctatgtgacaga

SEQ ID NO: 4191472 - DNA, 13 bp, Homo sapiens
tgtacctttgtgt

SEQ ID NO: 4191473 - DNA, 20 bp, Homo sapiens
tgtacctttgtgtaaagaag

SEQ ID NO: 4191474 - DNA, 14 bp, Homo sapiens
tgtactccagcctg

SEQ ID NO: 4191475 - DNA, 21 bp, Homo sapiens
tgtacttaataaattcagata

SEQ ID NO: 4191476 - DNA, 22 bp, Homo sapiens
tgtacttaataaattcagatat

SEQ ID NO: 4191477 - DNA, 15 bp, Homo sapiens
tgtagaatgattttt

SEQ ID NO: 4191478 - DNA, 19 bp, Homo sapiens
tgtagagtcaatcatgtgt

SEQ ID NO: 4191479 - DNA, 13 bp, Homo sapiens
tgtagccacacca

SEQ ID NO: 4191480 - DNA, 16 bp, Homo sapiens
tgtagccacaccagga

SEQ ID NO: 4191481 - DNA, 16 bp, Homo sapiens
tgtagccttgcccgga

SEQ ID NO: 4191482 - DNA, 17 bp, Homo sapiens
tgtagccttgcccggat

SEQ ID NO: 4191483 - DNA, 17 bp, Homo sapiens
tgtagctttcctggtcc

SEQ ID NO: 4191484 - DNA, 13 bp, Homo sapiens
tgtaggctgtggg

SEQ ID NO: 4191485 - DNA, 14 bp, Homo sapiens
tgtaggctgtgggg

SEQ ID NO: 4191486 - DNA, 15 bp, Homo sapiens
tgtaggggttaactt

SEQ ID NO: 4191487 - DNA, 13 bp, Homo sapiens
tgtagtaatttat

SEQ ID NO: 4191488 - DNA, 20 bp, Homo sapiens
tgtagtaggcatttttacca

SEQ ID NO: 4191489 - DNA, 15 bp, Homo sapiens
tgtagttaggaaata

SEQ ID NO: 4191490 - DNA, 21 bp, Homo sapiens
tgtataaatctttcttttgat

SEQ ID NO: 4191491 - DNA, 18 bp, Homo sapiens
tgtataacttcttaaaag

SEQ ID NO: 4191492 - DNA, 14 bp, Homo sapiens
tgtataatgtgatt

SEQ ID NO: 4191493 - DNA, 17 bp, Homo sapiens
tgtataatgtgattttt

SEQ ID NO: 4191494 - DNA, 17 bp, Homo sapiens
tgtataatttaacagtg

SEQ ID NO: 4191495 - DNA, 23 bp, Homo sapiens
tgtataatttaacagtgcccttt

SEQ ID NO: 4191496 - DNA, 14 bp, Homo sapiens
tgtatatgtcattt

SEQ ID NO: 4191497 - DNA, 16 bp, Homo sapiens
tgtatattgaaaagat

SEQ ID NO: 4191498 - DNA, 20 bp, Homo sapiens
tgtatcccccccctgtatag

SEQ ID NO: 4191499 - DNA, 21 bp, Homo sapiens
tgtatcccccccctgtatagt

SEQ ID NO: 4191500 - DNA, 17 bp, Homo sapiens
tgtatccgactctaagc

SEQ ID NO: 4191501 - DNA, 24 bp, Homo sapiens
tgtatccgactctaagctgtgtgc

SEQ ID NO: 4191502 - DNA, 18 bp, Homo sapiens
tgtatctgaaggagattt

SEQ ID NO: 4191503 - DNA, 17 bp, Homo sapiens
tgtatgacttctgctga

SEQ ID NO: 4191504 - DNA, 22 bp, Homo sapiens
tgtatgctaattgaacatgcaa

SEQ ID NO: 4191505 - DNA, 15 bp, Homo sapiens
tgtatttatatgtta

SEQ ID NO: 4191506 - DNA, 16 bp, Homo sapiens
tgtattttgagataat

SEQ ID NO: 4191507 - DNA, 18 bp, Homo sapiens
tgtcaacacaaagacatg

SEQ ID NO: 4191508 - DNA, 15 bp, Homo sapiens
tgtcaagacatttct

SEQ ID NO: 4191509 - DNA, 17 bp, Homo sapiens
tgtcaatacccctgtta

SEQ ID NO: 4191510 - DNA, 14 bp, Homo sapiens
tgtcaccctgcaga

SEQ ID NO: 4191511 - DNA, 17 bp, Homo sapiens
tgtcaccctgcagagct

SEQ ID NO: 4191512 - DNA, 18 bp, Homo sapiens
tgtcaccctgcagagcta

SEQ ID NO: 4191513 - DNA, 13 bp, Homo sapiens
tgtcactgaagat

SEQ ID NO: 4191514 - DNA, 18 bp, Homo sapiens
tgtcactggcagagcaca

SEQ ID NO: 4191515 - DNA, 23 bp, Homo sapiens
tgtcagagacagaccccttggct

SEQ ID NO: 4191516 - DNA, 20 bp, Homo sapiens
tgtcagagccaggctctgcc

SEQ ID NO: 4191517 - DNA, 18 bp, Homo sapiens
tgtcagcttttgcttcat

SEQ ID NO: 4191518 - DNA, 15 bp, Homo sapiens
tgtcagttcataata

SEQ ID NO: 4191519 - DNA, 19 bp, Homo sapiens
tgtcagttcataatatatg

SEQ ID NO: 4191520 - DNA, 21 bp, Homo sapiens
tgtcatatgtaggtgtctgca

SEQ ID NO: 4191521 - DNA, 16 bp, Homo sapiens
tgtcatgaattcttat

SEQ ID NO: 4191522 - DNA, 14 bp, Homo sapiens
tgtcattacaacct

SEQ ID NO: 4191523 - DNA, 23 bp, Homo sapiens
tgtcattcaggaccccaacccct

SEQ ID NO: 4191524 - DNA, 13 bp, Homo sapiens
tgtcattttggta

SEQ ID NO: 4191525 - DNA, 16 bp, Homo sapiens
tgtccaatataaattg

SEQ ID NO: 4191526 - DNA, 15 bp, Homo sapiens
tgtccaccagaccca

SEQ ID NO: 4191527 - DNA, 16 bp, Homo sapiens
tgtccaccagacccac

SEQ ID NO: 4191528 - DNA, 20 bp, Homo sapiens
tgtccatgtggttcttcaaa

SEQ ID NO: 4191529 - DNA, 16 bp, Homo sapiens
tgtccccggcctcagc

SEQ ID NO: 4191530 - DNA, 14 bp, Homo sapiens
tgtcccctcttgac

SEQ ID NO: 4191531 - DNA, 17 bp, Homo sapiens
tgtcccggttcaccttg

SEQ ID NO: 4191532 - DNA, 21 bp, Homo sapiens
tgtccctctcggaaggctggc

SEQ ID NO: 4191533 - DNA, 21 bp, Homo sapiens
tgtcccttttgcataagatta

SEQ ID NO: 4191534 - DNA, 13 bp, Homo sapiens
tgtccgcctctgc

SEQ ID NO: 4191535 - DNA, 23 bp, Homo sapiens
tgtcctagcaggatctgcccaca

SEQ ID NO: 4191536 - DNA, 14 bp, Homo sapiens
tgtcctcagagcag

SEQ ID NO: 4191537 - DNA, 18 bp, Homo sapiens
tgtcctctccctgccaag

SEQ ID NO: 4191538 - DNA, 11 bp, Homo sapiens
tgtcctgcctc

SEQ ID NO: 4191539 - DNA, 15 bp, Homo sapiens
tgtcctggtacagca

SEQ ID NO: 4191540 - DNA, 19 bp, Homo sapiens
tgtcctggtacagcagggt

SEQ ID NO: 4191541 - DNA, 18 bp, Homo sapiens
tgtcctttctagagcact

SEQ ID NO: 4191542 - DNA, 19 bp, Homo sapiens
tgtctaaagagctttagtc

SEQ ID NO: 4191543 - DNA, 22 bp, Homo sapiens
tgtctagaggtgagaccaaagg

SEQ ID NO: 4191544 - DNA, 14 bp, Homo sapiens
tgtctcacagacgc

SEQ ID NO: 4191545 - DNA, 13 bp, Homo sapiens
tgtctcagtgctg

SEQ ID NO: 4191546 - DNA, 14 bp, Homo sapiens
tgtctcgtctcctg

SEQ ID NO: 4191547 - DNA, 16 bp, Homo sapiens
tgtctctagccacttt

SEQ ID NO: 4191548 - DNA, 22 bp, Homo sapiens
tgtctctagccgggccatgctt

SEQ ID NO: 4191549 - DNA, 16 bp, Homo sapiens
tgtctgcacccagggg

SEQ ID NO: 4191550 - DNA, 18 bp, Homo sapiens
tgtctgggagagcctggc

SEQ ID NO: 4191551 - DNA, 15 bp, Homo sapiens
tgtctggttttaaca

SEQ ID NO: 4191552 - DNA, 17 bp, Homo sapiens
tgtctgtctacatttct

SEQ ID NO: 4191553 - DNA, 14 bp, Homo sapiens
tgtctgtctgtccc

SEQ ID NO: 4191554 - DNA, 15 bp, Homo sapiens
tgtctgtctgtccca

SEQ ID NO: 4191555 - DNA, 15 bp, Homo sapiens
tgtctgtgtgctgta

SEQ ID NO: 4191556 - DNA, 13 bp, Homo sapiens
tgtgaaaatgggt

SEQ ID NO: 4191557 - DNA, 13 bp, Homo sapiens
tgtgaactggaag

SEQ ID NO: 4191558 - DNA, 18 bp, Homo sapiens
tgtgaattgcctgcagag

SEQ ID NO: 4191559 - DNA, 15 bp, Homo sapiens
tgtgaccaggggtga

SEQ ID NO: 4191560 - DNA, 12 bp, Homo sapiens
tgtgactctctt

SEQ ID NO: 4191561 - DNA, 22 bp, Homo sapiens
tgtgactgatgttacatcacag

SEQ ID NO: 4191562 - DNA, 14 bp, Homo sapiens
tgtgagatgtaatt

SEQ ID NO: 4191563 - DNA, 14 bp, Homo sapiens
tgtgagcagtgagt

SEQ ID NO: 4191564 - DNA, 23 bp, Homo sapiens
tgtgatcccaagtgccagtcttg

SEQ ID NO: 4191565 - DNA, 17 bp, Homo sapiens
tgtgattggagtgtgtc

SEQ ID NO: 4191566 - DNA, 17 bp, Homo sapiens
tgtgatttagaactgta

SEQ ID NO: 4191567 - DNA, 21 bp, Homo sapiens
tgtgcaccttaccaactttct

SEQ ID NO: 4191568 - DNA, 22 bp, Homo sapiens
tgtgcaccttaccaactttctg

SEQ ID NO: 4191569 - DNA, 20 bp, Homo sapiens
tgtgcagtgaaggttgctga

SEQ ID NO: 4191570 - DNA, 17 bp, Homo sapiens
tgtgccacaccccatgc

SEQ ID NO: 4191571 - DNA, 23 bp, Homo sapiens
tgtgccccttgacaactggcagg

SEQ ID NO: 4191572 - DNA, 16 bp, Homo sapiens
tgtgcccgtggtgagg

SEQ ID NO: 4191573 - DNA, 13 bp, Homo sapiens
tgtgccctgcctt

SEQ ID NO: 4191574 - DNA, 15 bp, Homo sapiens
tgtgcctgccctgga

SEQ ID NO: 4191575 - DNA, 15 bp, Homo sapiens
tgtgccttttatagc

SEQ ID NO: 4191576 - DNA, 20 bp, Homo sapiens
tgtgcgtgtgtgcatgtatg

SEQ ID NO: 4191577 - DNA, 14 bp, Homo sapiens
tgtgctactttgcc

SEQ ID NO: 4191578 - DNA, 15 bp, Homo sapiens
tgtgctcctgtccct

SEQ ID NO: 4191579 - DNA, 22 bp, Homo sapiens
tgtgctgagaatagtgtctgat

SEQ ID NO: 4191580 - DNA, 23 bp, Homo sapiens
tgtgctgagaatagtgtctgatt

SEQ ID NO: 4191581 - DNA, 19 bp, Homo sapiens
tgtgctgtaacctgaagtc

SEQ ID NO: 4191582 - DNA, 15 bp, Homo sapiens
tgtgcttaataatac

SEQ ID NO: 4191583 - DNA, 12 bp, Homo sapiens
tgtgcttcccta

SEQ ID NO: 4191584 - DNA, 14 bp, Homo sapiens
tgtggaaagcctct

SEQ ID NO: 4191585 - DNA, 15 bp, Homo sapiens
tgtggaaagcctctg

SEQ ID NO: 4191586 - DNA, 20 bp, Homo sapiens
tgtggaaagcctctgctgcc

SEQ ID NO: 4191587 - DNA, 13 bp, Homo sapiens
tgtggaaggcagg

SEQ ID NO: 4191588 - DNA, 16 bp, Homo sapiens
tgtggactttgttcac

SEQ ID NO: 4191589 - DNA, 16 bp, Homo sapiens
tgtggattccagcatt

SEQ ID NO: 4191590 - DNA, 22 bp, Homo sapiens
tgtggattttttccttcaaagt

SEQ ID NO: 4191591 - DNA, 20 bp, Homo sapiens
tgtggcccttctgtccacca

SEQ ID NO: 4191592 - DNA, 17 bp, Homo sapiens
tgtggccttctcagcct

SEQ ID NO: 4191593 - DNA, 15 bp, Homo sapiens
tgtgggagctcagct

SEQ ID NO: 4191594 - DNA, 13 bp, Homo sapiens
tgtgggtgggaga

SEQ ID NO: 4191595 - DNA, 22 bp, Homo sapiens
tgtgggtgttaatttttgatac

SEQ ID NO: 4191596 - DNA, 17 bp, Homo sapiens
tgtggtaacttctttga

SEQ ID NO: 4191597 - DNA, 18 bp, Homo sapiens
tgtggtaacttctttgaa

SEQ ID NO: 4191598 - DNA, 23 bp, Homo sapiens
tgtggttcctaagcctgttgctg

SEQ ID NO: 4191599 - DNA, 21 bp, Homo sapiens
tgtgtaatagaaaactgaaaa

SEQ ID NO: 4191600 - DNA, 12 bp, Homo sapiens
tgtgtacatgta

SEQ ID NO: 4191601 - DNA, 10 bp, Homo sapiens
tgtgtatccg

SEQ ID NO: 4191602 - DNA, 19 bp, Homo sapiens
tgtgtatccgactctaagc

SEQ ID NO: 4191603 - DNA, 21 bp, Homo sapiens
tgtgtatccgactctaagctg

SEQ ID NO: 4191604 - DNA, 16 bp, Homo sapiens
tgtgtctgggagagcc

SEQ ID NO: 4191605 - DNA, 17 bp, Homo sapiens
tgtgtctgggagagcct

SEQ ID NO: 4191606 - DNA, 22 bp, Homo sapiens
tgtgtgcaccttaccaactttc

SEQ ID NO: 4191607 - DNA, 19 bp, Homo sapiens
tgtgtgcatgtatgtgtgt

SEQ ID NO: 4191608 - DNA, 22 bp, Homo sapiens
tgtgtggaaggcagggacagag

SEQ ID NO: 4191609 - DNA, 23 bp, Homo sapiens
tgtgtggaaggcagggacagaga

SEQ ID NO: 4191610 - DNA, 16 bp, Homo sapiens
tgtgtgtctcacccct

SEQ ID NO: 4191611 - DNA, 22 bp, Homo sapiens
tgtgtgttgatcccaagacaat

SEQ ID NO: 4191612 - DNA, 14 bp, Homo sapiens
tgtgtttgctttct

SEQ ID NO: 4191613 - DNA, 16 bp, Homo sapiens
tgtgtttggctttcag

SEQ ID NO: 4191614 - DNA, 23 bp, Homo sapiens
tgtgttttctgaataacatttgt

SEQ ID NO: 4191615 - DNA, 21 bp, Homo sapiens
tgttaaaaatattttctgaat

SEQ ID NO: 4191616 - DNA, 18 bp, Homo sapiens
tgttaacatggaatttaa

SEQ ID NO: 4191617 - DNA, 19 bp, Homo sapiens
tgttaagaaaaactacagc

SEQ ID NO: 4191618 - DNA, 21 bp, Homo sapiens
tgttaatgagaaaatggcttt

SEQ ID NO: 4191619 - DNA, 17 bp, Homo sapiens
tgttaatttagaaaact

SEQ ID NO: 4191620 - DNA, 18 bp, Homo sapiens
tgttaatttagaaaactt

SEQ ID NO: 4191621 - DNA, 17 bp, Homo sapiens
tgttaatttgttatgta

SEQ ID NO: 4191622 - DNA, 20 bp, Homo sapiens
tgttacaacttgtatttcca

SEQ ID NO: 4191623 - DNA, 13 bp, Homo sapiens
tgttactgtgtga

SEQ ID NO: 4191624 - DNA, 19 bp, Homo sapiens
tgttactttggcaatttcc

SEQ ID NO: 4191625 - DNA, 12 bp, Homo sapiens
tgttagagaggt

SEQ ID NO: 4191626 - DNA, 21 bp, Homo sapiens
tgttagagaggtagcgagctg

SEQ ID NO: 4191627 - DNA, 20 bp, Homo sapiens
tgttatgtatatagatgtgc

SEQ ID NO: 4191628 - DNA, 17 bp, Homo sapiens
tgttatttgtacagttc

SEQ ID NO: 4191629 - DNA, 14 bp, Homo sapiens
tgttattttcagta

SEQ ID NO: 4191630 - DNA, 14 bp, Homo sapiens
tgttcaagtatcta

SEQ ID NO: 4191631 - DNA, 17 bp, Homo sapiens
tgttccaaatgaatgtt

SEQ ID NO: 4191632 - DNA, 12 bp, Homo sapiens
tgttctgtattt

SEQ ID NO: 4191633 - DNA, 21 bp, Homo sapiens
tgttgaaaattattttaaaca

SEQ ID NO: 4191634 - DNA, 22 bp, Homo sapiens
tgttgaatgcttaaagcaaggc

SEQ ID NO: 4191635 - DNA, 16 bp, Homo sapiens
tgttgagtgcaacaag

SEQ ID NO: 4191636 - DNA, 16 bp, Homo sapiens
tgttgtaaataaaagt

SEQ ID NO: 4191637 - DNA, 13 bp, Homo sapiens
tgttgtacaagct

SEQ ID NO: 4191638 - DNA, 11 bp, Homo sapiens
tgttgttttgt

SEQ ID NO: 4191639 - DNA, 20 bp, Homo sapiens
tgttgttttgttttaaatac

SEQ ID NO: 4191640 - DNA, 18 bp, Homo sapiens
tgttgtttttaagtcctg

SEQ ID NO: 4191641 - DNA, 12 bp, Homo sapiens
tgtttaaagttc

SEQ ID NO: 4191642 - DNA, 13 bp, Homo sapiens
tgtttaaagttca

SEQ ID NO: 4191643 - DNA, 16 bp, Homo sapiens
tgtttaaattatttta

SEQ ID NO: 4191644 - DNA, 17 bp, Homo sapiens
tgtttaacattcacagc

SEQ ID NO: 4191645 - DNA, 15 bp, Homo sapiens
tgtttaagtggcttt

SEQ ID NO: 4191646 - DNA, 14 bp, Homo sapiens
tgtttacagaactg

SEQ ID NO: 4191647 - DNA, 22 bp, Homo sapiens
tgtttaccaaggaaagaacaaa

SEQ ID NO: 4191648 - DNA, 13 bp, Homo sapiens
tgtttattccttg

SEQ ID NO: 4191649 - DNA, 13 bp, Homo sapiens
tgtttcacaaggt

SEQ ID NO: 4191650 - DNA, 18 bp, Homo sapiens
tgtttccaacctggagta

SEQ ID NO: 4191651 - DNA, 16 bp, Homo sapiens
tgtttctccccctggg

SEQ ID NO: 4191652 - DNA, 17 bp, Homo sapiens
tgtttctccttctgaaa

SEQ ID NO: 4191653 - DNA, 11 bp, Homo sapiens
tgtttctgtaa

SEQ ID NO: 4191654 - DNA, 16 bp, Homo sapiens
tgtttctgtaagaaac

SEQ ID NO: 4191655 - DNA, 15 bp, Homo sapiens
tgtttgtaaatgcct

SEQ ID NO: 4191656 - DNA, 17 bp, Homo sapiens
tgtttgtaaatgcctct

SEQ ID NO: 4191657 - DNA, 22 bp, Homo sapiens
tgtttgtaaatgcctcttaaat

SEQ ID NO: 4191658 - DNA, 12 bp, Homo sapiens
tgttttaaatta

SEQ ID NO: 4191659 - DNA, 14 bp, Homo sapiens
tgttttatgagaaa

SEQ ID NO: 4191660 - DNA, 12 bp, Homo sapiens
tgttttctgaat

SEQ ID NO: 4191661 - DNA, 17 bp, Homo sapiens
tgttttctgaataacat

SEQ ID NO: 4191662 - DNA, 23 bp, Homo sapiens
tgttttgacttaagtagaagtaa

SEQ ID NO: 4191663 - DNA, 17 bp, Homo sapiens
tgttttgacttgaataa

SEQ ID NO: 4191664 - DNA, 13 bp, Homo sapiens
tgtttttcatgaa

SEQ ID NO: 4191665 - DNA, 19 bp, Homo sapiens
tgtttttgctattacatgt

SEQ ID NO: 4191666 - DNA, 14 bp, Homo sapiens
ttaaaaaaagaaat

SEQ ID NO: 4191667 - DNA, 13 bp, Homo sapiens
ttaaaaaactaaa

SEQ ID NO: 4191668 - DNA, 19 bp, Homo sapiens
ttaaaaaagcttaaaactt

SEQ ID NO: 4191669 - DNA, 21 bp, Homo sapiens
ttaaaaaagcttaaaactttg

SEQ ID NO: 4191670 - DNA, 16 bp, Homo sapiens
ttaaaaagtactcttt

SEQ ID NO: 4191671 - DNA, 23 bp, Homo sapiens
ttaaaaatatggaacttctaata

SEQ ID NO: 4191672 - DNA, 15 bp, Homo sapiens
ttaaaacagcctggg

SEQ ID NO: 4191673 - DNA, 20 bp, Homo sapiens
ttaaaagatgcttttaacag

SEQ ID NO: 4191674 - DNA, 21 bp, Homo sapiens
ttaaaagttgggaaaagtgtt

SEQ ID NO: 4191675 - DNA, 22 bp, Homo sapiens
ttaaaagttgggaaaagtgtta

SEQ ID NO: 4191676 - DNA, 19 bp, Homo sapiens
ttaaaatagcaaaagaaga

SEQ ID NO: 4191677 - DNA, 21 bp, Homo sapiens
ttaaaatagcaaaagaagaag

SEQ ID NO: 4191678 - DNA, 18 bp, Homo sapiens
ttaaaatgattgtaaaat

SEQ ID NO: 4191679 - DNA, 17 bp, Homo sapiens
ttaaaatgtaaagccat

SEQ ID NO: 4191680 - DNA, 21 bp, Homo sapiens
ttaaacacttatcttctggat

SEQ ID NO: 4191681 - DNA, 16 bp, Homo sapiens
ttaaaccgctaaaaga

SEQ ID NO: 4191682 - DNA, 12 bp, Homo sapiens
ttaaaggaagga

SEQ ID NO: 4191683 - DNA, 15 bp, Homo sapiens
ttaaaggaaggaaaa

SEQ ID NO: 4191684 - DNA, 16 bp, Homo sapiens
ttaaaggtagagatgt

SEQ ID NO: 4191685 - DNA, 11 bp, Homo sapiens
ttaaataagat

SEQ ID NO: 4191686 - DNA, 19 bp, Homo sapiens
ttaaatacgcactacatgt

SEQ ID NO: 4191687 - DNA, 14 bp, Homo sapiens
ttaaatatatcact

SEQ ID NO: 4191688 - DNA, 12 bp, Homo sapiens
ttaaatgttaat

SEQ ID NO: 4191689 - DNA, 16 bp, Homo sapiens
ttaaatgttaatgaga

SEQ ID NO: 4191690 - DNA, 14 bp, Homo sapiens
ttaaatttcttaac

SEQ ID NO: 4191691 - DNA, 18 bp, Homo sapiens
ttaaattttaagcttgaa

SEQ ID NO: 4191692 - DNA, 12 bp, Homo sapiens
ttaacaaataaa

SEQ ID NO: 4191693 - DNA, 17 bp, Homo sapiens
ttaacaattaggcagac

SEQ ID NO: 4191694 - DNA, 14 bp, Homo sapiens
ttaacagagtctga

SEQ ID NO: 4191695 - DNA, 17 bp, Homo sapiens
ttaacatctattataaa

SEQ ID NO: 4191696 - DNA, 22 bp, Homo sapiens
ttaacatggaatttaatttatg

SEQ ID NO: 4191697 - DNA, 17 bp, Homo sapiens
ttaacattaacatctat

SEQ ID NO: 4191698 - DNA, 19 bp, Homo sapiens
ttaacattcacagcccaga

SEQ ID NO: 4191699 - DNA, 19 bp, Homo sapiens
ttaactatgtgatgttaac

SEQ ID NO: 4191700 - DNA, 22 bp, Homo sapiens
ttaacttgagggtaataaactt

SEQ ID NO: 4191701 - DNA, 16 bp, Homo sapiens
ttaacttggtcagagc

SEQ ID NO: 4191702 - DNA, 20 bp, Homo sapiens
ttaactttgtggtaacttct

SEQ ID NO: 4191703 - DNA, 22 bp, Homo sapiens
ttaactttgtggtaacttcttt

SEQ ID NO: 4191704 - DNA, 19 bp, Homo sapiens
ttaagcaaaggaaaccaaa

SEQ ID NO: 4191705 - DNA, 19 bp, Homo sapiens
ttaagcagagcagaacttt

SEQ ID NO: 4191706 - DNA, 22 bp, Homo sapiens
ttaagcagagcagaactttttt

SEQ ID NO: 4191707 - DNA, 22 bp, Homo sapiens
ttaagccaatatttactcatca

SEQ ID NO: 4191708 - DNA, 15 bp, Homo sapiens
ttaaggcatttgttt

SEQ ID NO: 4191709 - DNA, 19 bp, Homo sapiens
ttaaggcatttgtttaatt

SEQ ID NO: 4191710 - DNA, 13 bp, Homo sapiens
ttaagtgaatgtc

SEQ ID NO: 4191711 - DNA, 19 bp, Homo sapiens
ttaagttagagaatatatt

SEQ ID NO: 4191712 - DNA, 11 bp, Homo sapiens
ttaagttattg

SEQ ID NO: 4191713 - DNA, 21 bp, Homo sapiens
ttaataaggaaaaaataatat

SEQ ID NO: 4191714 - DNA, 19 bp, Homo sapiens
ttaataatttagacttcaa

SEQ ID NO: 4191715 - DNA, 15 bp, Homo sapiens
ttaatagcaaagaat

SEQ ID NO: 4191716 - DNA, 20 bp, Homo sapiens
ttaatagcttttattgtata

SEQ ID NO: 4191717 - DNA, 22 bp, Homo sapiens
ttaatagcttttattgtataaa

SEQ ID NO: 4191718 - DNA, 19 bp, Homo sapiens
ttaatatatcccagaaatt

SEQ ID NO: 4191719 - DNA, 20 bp, Homo sapiens
ttaatatatcccagaaatta

SEQ ID NO: 4191720 - DNA, 17 bp, Homo sapiens
ttaatatcctaaacatc

SEQ ID NO: 4191721 - DNA, 16 bp, Homo sapiens
ttaatcagacaaagta

SEQ ID NO: 4191722 - DNA, 18 bp, Homo sapiens
ttaatggctgataatttt

SEQ ID NO: 4191723 - DNA, 23 bp, Homo sapiens
ttaatgttctttataaaaagtga

SEQ ID NO: 4191724 - DNA, 15 bp, Homo sapiens
ttaatgtttaaaaca

SEQ ID NO: 4191725 - DNA, 17 bp, Homo sapiens
ttaattataataaaggt

SEQ ID NO: 4191726 - DNA, 15 bp, Homo sapiens
ttaattttgaccaaa

SEQ ID NO: 4191727 - DNA, 16 bp, Homo sapiens
ttaatttttataaata

SEQ ID NO: 4191728 - DNA, 19 bp, Homo sapiens
ttaatttttataaatatgt

SEQ ID NO: 4191729 - DNA, 17 bp, Homo sapiens
ttacaaaaatagtagaa

SEQ ID NO: 4191730 - DNA, 18 bp, Homo sapiens
ttacaaagcccttttata

SEQ ID NO: 4191731 - DNA, 13 bp, Homo sapiens
ttacaacttgtat

SEQ ID NO: 4191732 - DNA, 18 bp, Homo sapiens
ttacaagaattgtccatg

SEQ ID NO: 4191733 - DNA, 16 bp, Homo sapiens
ttacactctctgtaca

SEQ ID NO: 4191734 - DNA, 16 bp, Homo sapiens
ttacagaggaagttat

SEQ ID NO: 4191735 - DNA, 20 bp, Homo sapiens
ttacagctatgcactgtaaa

SEQ ID NO: 4191736 - DNA, 16 bp, Homo sapiens
ttacagtaaataaatt

SEQ ID NO: 4191737 - DNA, 17 bp, Homo sapiens
ttacagtgaatttctga

SEQ ID NO: 4191738 - DNA, 20 bp, Homo sapiens
ttacataattcactctgagt

SEQ ID NO: 4191739 - DNA, 16 bp, Homo sapiens
ttacatataataaata

SEQ ID NO: 4191740 - DNA, 16 bp, Homo sapiens
ttacatggctgtggtt

SEQ ID NO: 4191741 - DNA, 17 bp, Homo sapiens
ttacatgtgttagtgta

SEQ ID NO: 4191742 - DNA, 22 bp, Homo sapiens
ttacatgtgttagtgtatgtga

SEQ ID NO: 4191743 - DNA, 13 bp, Homo sapiens
ttaccaactttct

SEQ ID NO: 4191744 - DNA, 18 bp, Homo sapiens
ttaccaactttctgtaaa

SEQ ID NO: 4191745 - DNA, 17 bp, Homo sapiens
ttaccatgaattcttga

SEQ ID NO: 4191746 - DNA, 22 bp, Homo sapiens
ttaccctgcgattttgcctgtg

SEQ ID NO: 4191747 - DNA, 18 bp, Homo sapiens
ttacctaccaccttccct

SEQ ID NO: 4191748 - DNA, 21 bp, Homo sapiens
ttacctaccaccttccctctt

SEQ ID NO: 4191749 - DNA, 16 bp, Homo sapiens
ttaccttgttttctct

SEQ ID NO: 4191750 - DNA, 17 bp, Homo sapiens
ttactactttgcctctt

SEQ ID NO: 4191751 - DNA, 21 bp, Homo sapiens
ttactactttgcctcttcagc

SEQ ID NO: 4191752 - DNA, 20 bp, Homo sapiens
ttactataagaactttgagc

SEQ ID NO: 4191753 - DNA, 16 bp, Homo sapiens
ttactatgccacagat

SEQ ID NO: 4191754 - DNA, 14 bp, Homo sapiens
ttactcacctctct

SEQ ID NO: 4191755 - DNA, 23 bp, Homo sapiens
ttactctgcggtggtgccagagg

SEQ ID NO: 4191756 - DNA, 12 bp, Homo sapiens
ttactgaagtta

SEQ ID NO: 4191757 - DNA, 20 bp, Homo sapiens
ttactgattaacaaataaat

SEQ ID NO: 4191758 - DNA, 21 bp, Homo sapiens
ttactgcagtaacactggcct

SEQ ID NO: 4191759 - DNA, 23 bp, Homo sapiens
ttactgtctggttttaacaattt

SEQ ID NO: 4191760 - DNA, 17 bp, Homo sapiens
ttacttccatgatactt

SEQ ID NO: 4191761 - DNA, 20 bp, Homo sapiens
ttacttttgttctgtatttt

SEQ ID NO: 4191762 - DNA, 15 bp, Homo sapiens
ttagaaatagacagt

SEQ ID NO: 4191763 - DNA, 15 bp, Homo sapiens
ttagaaatatccttt

SEQ ID NO: 4191764 - DNA, 15 bp, Homo sapiens
ttagaaggttgtatt

SEQ ID NO: 4191765 - DNA, 13 bp, Homo sapiens
ttagaagtgtttt

SEQ ID NO: 4191766 - DNA, 23 bp, Homo sapiens
ttagaatgccggttaaattccat

SEQ ID NO: 4191767 - DNA, 14 bp, Homo sapiens
ttagaggtttgtca

SEQ ID NO: 4191768 - DNA, 22 bp, Homo sapiens
ttagcaaagcaaaaggctgaga

SEQ ID NO: 4191769 - DNA, 14 bp, Homo sapiens
ttagccaaaacact

SEQ ID NO: 4191770 - DNA, 22 bp, Homo sapiens
ttagcccatctctccagagagc

SEQ ID NO: 4191771 - DNA, 11 bp, Homo sapiens
ttagcctcttc

SEQ ID NO: 4191772 - DNA, 12 bp, Homo sapiens
ttaggaagaaat

SEQ ID NO: 4191773 - DNA, 18 bp, Homo sapiens
ttaggcagggatttgagg

SEQ ID NO: 4191774 - DNA, 19 bp, Homo sapiens
ttaggcagggatttgagga

SEQ ID NO: 4191775 - DNA, 20 bp, Homo sapiens
ttaggccacattgacagtgg

SEQ ID NO: 4191776 - DNA, 13 bp, Homo sapiens
ttagtgtatgtga

SEQ ID NO: 4191777 - DNA, 13 bp, Homo sapiens
ttagttatagttt

SEQ ID NO: 4191778 - DNA, 22 bp, Homo sapiens
ttagttatagtttcagatatat

SEQ ID NO: 4191779 - DNA, 22 bp, Homo sapiens
ttagttcaccccttatcctgag

SEQ ID NO: 4191780 - DNA, 15 bp, Homo sapiens
ttagtttgttttaca

SEQ ID NO: 4191781 - DNA, 15 bp, Homo sapiens
ttataacttctgaag

SEQ ID NO: 4191782 - DNA, 13 bp, Homo sapiens
ttataatgggtaa

SEQ ID NO: 4191783 - DNA, 17 bp, Homo sapiens
ttatacacaacatttat

SEQ ID NO: 4191784 - DNA, 21 bp, Homo sapiens
ttatactttgcaatccaaata

SEQ ID NO: 4191785 - DNA, 20 bp, Homo sapiens
ttatagttgtgggtgggaga

SEQ ID NO: 4191786 - DNA, 16 bp, Homo sapiens
ttatagtttgtacatg

SEQ ID NO: 4191787 - DNA, 17 bp, Homo sapiens
ttatatattgttgacaa

SEQ ID NO: 4191788 - DNA, 14 bp, Homo sapiens
ttatatctgttttg

SEQ ID NO: 4191789 - DNA, 15 bp, Homo sapiens
ttatatgttaatttg

SEQ ID NO: 4191790 - DNA, 15 bp, Homo sapiens
ttatattctataact

SEQ ID NO: 4191791 - DNA, 13 bp, Homo sapiens
ttatatttaactc

SEQ ID NO: 4191792 - DNA, 19 bp, Homo sapiens
ttatatttagttatagttt

SEQ ID NO: 4191793 - DNA, 17 bp, Homo sapiens
ttatatttggaaagaga

SEQ ID NO: 4191794 - DNA, 21 bp, Homo sapiens
ttatcaacttcctaaatatta

SEQ ID NO: 4191795 - DNA, 15 bp, Homo sapiens
ttatcagaatatcaa

SEQ ID NO: 4191796 - DNA, 18 bp, Homo sapiens
ttatcagtcatgaggaaa

SEQ ID NO: 4191797 - DNA, 19 bp, Homo sapiens
ttatcatgacatgttatat

SEQ ID NO: 4191798 - DNA, 19 bp, Homo sapiens
ttatccacagaaacatttt

SEQ ID NO: 4191799 - DNA, 12 bp, Homo sapiens
ttatccaggact

SEQ ID NO: 4191800 - DNA, 18 bp, Homo sapiens
ttatccaggactctgtca

SEQ ID NO: 4191801 - DNA, 17 bp, Homo sapiens
ttatctgaatttttaaa

SEQ ID NO: 4191802 - DNA, 18 bp, Homo sapiens
ttatctgaatttttaaac

SEQ ID NO: 4191803 - DNA, 18 bp, Homo sapiens
ttatctgtgttatttgga

SEQ ID NO: 4191804 - DNA, 14 bp, Homo sapiens
ttatcttctggatt

SEQ ID NO: 4191805 - DNA, 20 bp, Homo sapiens
ttatctttttgtgtctcctt

SEQ ID NO: 4191806 - DNA, 19 bp, Homo sapiens
ttatgaaaaagaagaatct

SEQ ID NO: 4191807 - DNA, 15 bp, Homo sapiens
ttatgagtttgctta

SEQ ID NO: 4191808 - DNA, 14 bp, Homo sapiens
ttatgctgtcatgg

SEQ ID NO: 4191809 - DNA, 18 bp, Homo sapiens
ttatgtatatagatgtgc

SEQ ID NO: 4191810 - DNA, 13 bp, Homo sapiens
ttatgtctaaaga

SEQ ID NO: 4191811 - DNA, 16 bp, Homo sapiens
ttatgttctcagaatc

SEQ ID NO: 4191812 - DNA, 21 bp, Homo sapiens
ttattaaaatgattgtaaaat

SEQ ID NO: 4191813 - DNA, 14 bp, Homo sapiens
ttattattattact

SEQ ID NO: 4191814 - DNA, 19 bp, Homo sapiens
ttattcgtagatattggac

SEQ ID NO: 4191815 - DNA, 13 bp, Homo sapiens
ttattctcctccc

SEQ ID NO: 4191816 - DNA, 22 bp, Homo sapiens
ttattcttaagtaaggacaaag

SEQ ID NO: 4191817 - DNA, 14 bp, Homo sapiens
ttattggaccagaa

SEQ ID NO: 4191818 - DNA, 21 bp, Homo sapiens
ttatttaaaatagcaaaagaa

SEQ ID NO: 4191819 - DNA, 19 bp, Homo sapiens
ttatttccaaataaaatga

SEQ ID NO: 4191820 - DNA, 12 bp, Homo sapiens
ttatttgtaata

SEQ ID NO: 4191821 - DNA, 13 bp, Homo sapiens
ttatttgtacagt

SEQ ID NO: 4191822 - DNA, 18 bp, Homo sapiens
ttatttgttattttcagt

SEQ ID NO: 4191823 - DNA, 20 bp, Homo sapiens
ttatttttttaagctgtaaa

SEQ ID NO: 4191824 - DNA, 20 bp, Homo sapiens
ttcaaagctgtgtgtttgga

SEQ ID NO: 4191825 - DNA, 14 bp, Homo sapiens
ttcaaagtttaata

SEQ ID NO: 4191826 - DNA, 21 bp, Homo sapiens
ttcaaatgtcagttcataata

SEQ ID NO: 4191827 - DNA, 19 bp, Homo sapiens
ttcaacagtgaagacagaa

SEQ ID NO: 4191828 - DNA, 12 bp, Homo sapiens
ttcaactccaga

SEQ ID NO: 4191829 - DNA, 19 bp, Homo sapiens
ttcaacttattaacaatta

SEQ ID NO: 4191830 - DNA, 18 bp, Homo sapiens
ttcaacttggaaaaagaa

SEQ ID NO: 4191831 - DNA, 20 bp, Homo sapiens
ttcaaggtggccaaattatt

SEQ ID NO: 4191832 - DNA, 21 bp, Homo sapiens
ttcaagtattaggggtaatat

SEQ ID NO: 4191833 - DNA, 11 bp, Homo sapiens
ttcaagtgcct

SEQ ID NO: 4191834 - DNA, 12 bp, Homo sapiens
ttcaagtgccta

SEQ ID NO: 4191835 - DNA, 15 bp, Homo sapiens
ttcaagtgcctagac

SEQ ID NO: 4191836 - DNA, 18 bp, Homo sapiens
ttcaagtgcctagactgt

SEQ ID NO: 4191837 - DNA, 20 bp, Homo sapiens
ttcacacctcacgctctgga

SEQ ID NO: 4191838 - DNA, 22 bp, Homo sapiens
ttcacagcccagaaccacagat

SEQ ID NO: 4191839 - DNA, 23 bp, Homo sapiens
ttcacaggttctgcgttacaaca

SEQ ID NO: 4191840 - DNA, 23 bp, Homo sapiens
ttcacagttggctggatgaaatt

SEQ ID NO: 4191841 - DNA, 13 bp, Homo sapiens
ttcacagtttttc

SEQ ID NO: 4191842 - DNA, 16 bp, Homo sapiens
ttcaccgtgttagcca

SEQ ID NO: 4191843 - DNA, 22 bp, Homo sapiens
ttcactccggtgtgcctgcagc

SEQ ID NO: 4191844 - DNA, 14 bp, Homo sapiens
ttcactgccatgcc

SEQ ID NO: 4191845 - DNA, 21 bp, Homo sapiens
ttcactgttgaaaattatttt

SEQ ID NO: 4191846 - DNA, 14 bp, Homo sapiens
ttcagaagaaaaag

SEQ ID NO: 4191847 - DNA, 15 bp, Homo sapiens
ttcagaagcaggcag

SEQ ID NO: 4191848 - DNA, 17 bp, Homo sapiens
ttcagaagcaggcaggg

SEQ ID NO: 4191849 - DNA, 21 bp, Homo sapiens
ttcagacttttatcaaaatcc

SEQ ID NO: 4191850 - DNA, 14 bp, Homo sapiens
ttcagaggaagcac

SEQ ID NO: 4191851 - DNA, 16 bp, Homo sapiens
ttcagatatatttttc

SEQ ID NO: 4191852 - DNA, 16 bp, Homo sapiens
ttcagatgtgaaccat

SEQ ID NO: 4191853 - DNA, 21 bp, Homo sapiens
ttcagccatcaacaagagttg

SEQ ID NO: 4191854 - DNA, 18 bp, Homo sapiens
ttcaggaaaattgaatgc

SEQ ID NO: 4191855 - DNA, 14 bp, Homo sapiens
ttcaggaagatgaa

SEQ ID NO: 4191856 - DNA, 17 bp, Homo sapiens
ttcaggatactctgtca

SEQ ID NO: 4191857 - DNA, 21 bp, Homo sapiens
ttcaggatactctgtcagatg

SEQ ID NO: 4191858 - DNA, 22 bp, Homo sapiens
ttcagggaatttcaggaactag

SEQ ID NO: 4191859 - DNA, 22 bp, Homo sapiens
ttcaggggggttgtgaggcctg

SEQ ID NO: 4191860 - DNA, 15 bp, Homo sapiens
ttcaggtccaggcca

SEQ ID NO: 4191861 - DNA, 17 bp, Homo sapiens
ttcagtattttggagaa

SEQ ID NO: 4191862 - DNA, 20 bp, Homo sapiens
ttcagtattttggagaaatt

SEQ ID NO: 4191863 - DNA, 23 bp, Homo sapiens
ttcagttcctctttgcatggaat

SEQ ID NO: 4191864 - DNA, 14 bp, Homo sapiens
ttcatataaagtat

SEQ ID NO: 4191865 - DNA, 16 bp, Homo sapiens
ttcatataaagtatca

SEQ ID NO: 4191866 - DNA, 18 bp, Homo sapiens
ttcatatttatactttgc

SEQ ID NO: 4191867 - DNA, 23 bp, Homo sapiens
ttcatgacttttccatgtatcta

SEQ ID NO: 4191868 - DNA, 16 bp, Homo sapiens
ttcatgcccttctgat

SEQ ID NO: 4191869 - DNA, 14 bp, Homo sapiens
ttcatgctcagccc

SEQ ID NO: 4191870 - DNA, 17 bp, Homo sapiens
ttcatgctcagccctga

SEQ ID NO: 4191871 - DNA, 14 bp, Homo sapiens
ttcatgctttctcc

SEQ ID NO: 4191872 - DNA, 16 bp, Homo sapiens
ttcatgctttctcctt

SEQ ID NO: 4191873 - DNA, 22 bp, Homo sapiens
ttcattttaatttatatttgaa

SEQ ID NO: 4191874 - DNA, 22 bp, Homo sapiens
ttccaaataaggatttgttcac

SEQ ID NO: 4191875 - DNA, 16 bp, Homo sapiens
ttccacatataaagct

SEQ ID NO: 4191876 - DNA, 17 bp, Homo sapiens
ttccactccaagatgcc

SEQ ID NO: 4191877 - DNA, 22 bp, Homo sapiens
ttccactggacttgagcttggc

SEQ ID NO: 4191878 - DNA, 18 bp, Homo sapiens
ttccagaaaaccccagca

SEQ ID NO: 4191879 - DNA, 21 bp, Homo sapiens
ttccagaaaaccccagcatcc

SEQ ID NO: 4191880 - DNA, 18 bp, Homo sapiens
ttccagataaccagctgt

SEQ ID NO: 4191881 - DNA, 14 bp, Homo sapiens
ttccagctgcctgg

SEQ ID NO: 4191882 - DNA, 15 bp, Homo sapiens
ttccaggtggcagga

SEQ ID NO: 4191883 - DNA, 18 bp, Homo sapiens
ttccagtctctgcatgta

SEQ ID NO: 4191884 - DNA, 19 bp, Homo sapiens
ttccagttctgacacacgt

SEQ ID NO: 4191885 - DNA, 17 bp, Homo sapiens
ttccatatgctccagga

SEQ ID NO: 4191886 - DNA, 22 bp, Homo sapiens
ttccatgaagacacgcttaaaa

SEQ ID NO: 4191887 - DNA, 22 bp, Homo sapiens
ttccatttgggcacattttact

SEQ ID NO: 4191888 - DNA, 19 bp, Homo sapiens
ttcccaaaatgttgaaata

SEQ ID NO: 4191889 - DNA, 16 bp, Homo sapiens
ttcccaacctcccctg

SEQ ID NO: 4191890 - DNA, 17 bp, Homo sapiens
ttcccaactgctctgcc

SEQ ID NO: 4191891 - DNA, 23 bp, Homo sapiens
ttcccaagccatggcatgctcct

SEQ ID NO: 4191892 - DNA, 15 bp, Homo sapiens
ttcccaatatgtagc

SEQ ID NO: 4191893 - DNA, 17 bp, Homo sapiens
ttcccaatatgtagcct

SEQ ID NO: 4191894 - DNA, 20 bp, Homo sapiens
ttcccactaagctttctcct

SEQ ID NO: 4191895 - DNA, 11 bp, Homo sapiens
ttcccagaggc

SEQ ID NO: 4191896 - DNA, 14 bp, Homo sapiens
ttcccagatacttc

SEQ ID NO: 4191897 - DNA, 15 bp, Homo sapiens
ttcccatgatccaga

SEQ ID NO: 4191898 - DNA, 16 bp, Homo sapiens
ttcccatgatccagaa

SEQ ID NO: 4191899 - DNA, 13 bp, Homo sapiens
ttcccattttgga

SEQ ID NO: 4191900 - DNA, 19 bp, Homo sapiens
ttccccacctcttccttcc

SEQ ID NO: 4191901 - DNA, 21 bp, Homo sapiens
ttccccaggagctctctgctg

SEQ ID NO: 4191902 - DNA, 20 bp, Homo sapiens
ttcccccatcccctttcctc

SEQ ID NO: 4191903 - DNA, 23 bp, Homo sapiens
ttcccccatcccctttcctcccc

SEQ ID NO: 4191904 - DNA, 14 bp, Homo sapiens
ttcccctttcccca

SEQ ID NO: 4191905 - DNA, 14 bp, Homo sapiens
ttcccgagggagct

SEQ ID NO: 4191906 - DNA, 21 bp, Homo sapiens
ttccctattatttccgggtgg

SEQ ID NO: 4191907 - DNA, 14 bp, Homo sapiens
ttccctccttccct

SEQ ID NO: 4191908 - DNA, 23 bp, Homo sapiens
ttccctctgagaattccaaggag

SEQ ID NO: 4191909 - DNA, 15 bp, Homo sapiens
ttccctctttcccca

SEQ ID NO: 4191910 - DNA, 21 bp, Homo sapiens
ttccctgacactgtctgctgc

SEQ ID NO: 4191911 - DNA, 22 bp, Homo sapiens
ttccctgacactgtctgctgcc

SEQ ID NO: 4191912 - DNA, 18 bp, Homo sapiens
ttccctgactcctctaag

SEQ ID NO: 4191913 - DNA, 11 bp, Homo sapiens
ttccctgcctt

SEQ ID NO: 4191914 - DNA, 19 bp, Homo sapiens
ttccctgttttaaattata

SEQ ID NO: 4191915 - DNA, 22 bp, Homo sapiens
ttcccttctctccttccctctt

SEQ ID NO: 4191916 - DNA, 23 bp, Homo sapiens
ttcccttgaaattttaaactata

SEQ ID NO: 4191917 - DNA, 23 bp, Homo sapiens
ttcccttgtgtcaagacatttct

SEQ ID NO: 4191918 - DNA, 19 bp, Homo sapiens
ttccgtggtcagagtgcca

SEQ ID NO: 4191919 - DNA, 20 bp, Homo sapiens
ttccgtggtcagagtgccac

SEQ ID NO: 4191920 - DNA, 21 bp, Homo sapiens
ttccgtggtcagagtgccact

SEQ ID NO: 4191921 - DNA, 18 bp, Homo sapiens
ttcctaaatattatgaga

SEQ ID NO: 4191922 - DNA, 20 bp, Homo sapiens
ttcctaagcctgttgctgaa

SEQ ID NO: 4191923 - DNA, 18 bp, Homo sapiens
ttcctacacccttggact

SEQ ID NO: 4191924 - DNA, 13 bp, Homo sapiens
ttcctataaaatc

SEQ ID NO: 4191925 - DNA, 16 bp, Homo sapiens
ttcctatgctttgaaa

SEQ ID NO: 4191926 - DNA, 21 bp, Homo sapiens
ttcctattttggagtggtcag

SEQ ID NO: 4191927 - DNA, 14 bp, Homo sapiens
ttcctcatgaatta

SEQ ID NO: 4191928 - DNA, 23 bp, Homo sapiens
ttcctccccattagagtcagcct

SEQ ID NO: 4191929 - DNA, 13 bp, Homo sapiens
ttcctcctgtgta

SEQ ID NO: 4191930 - DNA, 23 bp, Homo sapiens
ttcctctagtgccctccacagcc

SEQ ID NO: 4191931 - DNA, 17 bp, Homo sapiens
ttcctctcactaaactt

SEQ ID NO: 4191932 - DNA, 20 bp, Homo sapiens
ttcctcttataacttctgaa

SEQ ID NO: 4191933 - DNA, 12 bp, Homo sapiens
ttcctctttgca

SEQ ID NO: 4191934 - DNA, 17 bp, Homo sapiens
ttcctctttgcatggaa

SEQ ID NO: 4191935 - DNA, 22 bp, Homo sapiens
ttcctgatggtacaggaaagct

SEQ ID NO: 4191936 - DNA, 15 bp, Homo sapiens
ttcctggccctccac

SEQ ID NO: 4191937 - DNA, 16 bp, Homo sapiens
ttccttaccccagctg

SEQ ID NO: 4191938 - DNA, 14 bp, Homo sapiens
ttccttagttttta

SEQ ID NO: 4191939 - DNA, 16 bp, Homo sapiens
ttccttattgtttgta

SEQ ID NO: 4191940 - DNA, 23 bp, Homo sapiens
ttccttcccccatcccctttcct

SEQ ID NO: 4191941 - DNA, 20 bp, Homo sapiens
ttccttgaccactggccctg

SEQ ID NO: 4191942 - DNA, 11 bp, Homo sapiens
ttcctttcctc

SEQ ID NO: 4191943 - DNA, 14 bp, Homo sapiens
ttcgagaccagcct

SEQ ID NO: 4191944 - DNA, 19 bp, Homo sapiens
ttcgctgctagagaagggg

SEQ ID NO: 4191945 - DNA, 18 bp, Homo sapiens
ttcgggggacaacttgta

SEQ ID NO: 4191946 - DNA, 15 bp, Homo sapiens
ttcggggtgtgatga

SEQ ID NO: 4191947 - DNA, 15 bp, Homo sapiens
ttcgtagatattgga

SEQ ID NO: 4191948 - DNA, 19 bp, Homo sapiens
ttcgtagctttcccaaata

SEQ ID NO: 4191949 - DNA, 14 bp, Homo sapiens
ttctaaaatgcctt

SEQ ID NO: 4191950 - DNA, 16 bp, Homo sapiens
ttctaaatcagaaata

SEQ ID NO: 4191951 - DNA, 20 bp, Homo sapiens
ttctacccagatggaaaaat

SEQ ID NO: 4191952 - DNA, 13 bp, Homo sapiens
ttctactgtgact

SEQ ID NO: 4191953 - DNA, 15 bp, Homo sapiens
ttctacttttaaaga

SEQ ID NO: 4191954 - DNA, 19 bp, Homo sapiens
ttctagagggcactagaac

SEQ ID NO: 4191955 - DNA, 16 bp, Homo sapiens
ttctagccaaactatt

SEQ ID NO: 4191956 - DNA, 22 bp, Homo sapiens
ttctagtgatttcctgtataat

SEQ ID NO: 4191957 - DNA, 15 bp, Homo sapiens
ttctatagccaaaaa

SEQ ID NO: 4191958 - DNA, 21 bp, Homo sapiens
ttctatagccaaaaatagcta

SEQ ID NO: 4191959 - DNA, 23 bp, Homo sapiens
ttctatagccaaaaatagctaaa

SEQ ID NO: 4191960 - DNA, 17 bp, Homo sapiens
ttctatatgatcctgaa

SEQ ID NO: 4191961 - DNA, 17 bp, Homo sapiens
ttctatgtatgttaatt

SEQ ID NO: 4191962 - DNA, 21 bp, Homo sapiens
ttctattgtgtttcacaaaat

SEQ ID NO: 4191963 - DNA, 13 bp, Homo sapiens
ttctcactgctgt

SEQ ID NO: 4191964 - DNA, 22 bp, Homo sapiens
ttctcagtgctctcctacccca

SEQ ID NO: 4191965 - DNA, 18 bp, Homo sapiens
ttctcattccaacagtga

SEQ ID NO: 4191966 - DNA, 20 bp, Homo sapiens
ttctcattccaacagtgagt

SEQ ID NO: 4191967 - DNA, 22 bp, Homo sapiens
ttctcattttttaaaaaagctt

SEQ ID NO: 4191968 - DNA, 14 bp, Homo sapiens
ttctcctgtcagag

SEQ ID NO: 4191969 - DNA, 16 bp, Homo sapiens
ttctcctgtcagagat

SEQ ID NO: 4191970 - DNA, 13 bp, Homo sapiens
ttctcctttttct

SEQ ID NO: 4191971 - DNA, 19 bp, Homo sapiens
ttctcgctgtcctttctag

SEQ ID NO: 4191972 - DNA, 13 bp, Homo sapiens
ttctcgggaaatt

SEQ ID NO: 4191973 - DNA, 16 bp, Homo sapiens
ttctctaactcctgcc

SEQ ID NO: 4191974 - DNA, 18 bp, Homo sapiens
ttctctaactcctgccat

SEQ ID NO: 4191975 - DNA, 21 bp, Homo sapiens
ttctctataggtcatgatttc

SEQ ID NO: 4191976 - DNA, 16 bp, Homo sapiens
ttctctccttccctct

SEQ ID NO: 4191977 - DNA, 20 bp, Homo sapiens
ttctctccttccctctttcc

SEQ ID NO: 4191978 - DNA, 21 bp, Homo sapiens
ttctctccttccctctttccc

SEQ ID NO: 4191979 - DNA, 16 bp, Homo sapiens
ttctctggctccagaa

SEQ ID NO: 4191980 - DNA, 19 bp, Homo sapiens
ttctcttccctccttccct

SEQ ID NO: 4191981 - DNA, 16 bp, Homo sapiens
ttctctttgccttgat

SEQ ID NO: 4191982 - DNA, 20 bp, Homo sapiens
ttctgaaatgacagaatgct

SEQ ID NO: 4191983 - DNA, 18 bp, Homo sapiens
ttctgagatccagcacaa

SEQ ID NO: 4191984 - DNA, 15 bp, Homo sapiens
ttctgatcaaggcct

SEQ ID NO: 4191985 - DNA, 20 bp, Homo sapiens
ttctgattcccctccaccaa

SEQ ID NO: 4191986 - DNA, 20 bp, Homo sapiens
ttctgcagcaactcccacga

SEQ ID NO: 4191987 - DNA, 21 bp, Homo sapiens
ttctgcagcaactcccacgac

SEQ ID NO: 4191988 - DNA, 13 bp, Homo sapiens
ttctggagccctt

SEQ ID NO: 4191989 - DNA, 14 bp, Homo sapiens
ttctggccaggaag

SEQ ID NO: 4191990 - DNA, 20 bp, Homo sapiens
ttctggcttccttctctcaa

SEQ ID NO: 4191991 - DNA, 17 bp, Homo sapiens
ttctggggctgggcctg

SEQ ID NO: 4191992 - DNA, 18 bp, Homo sapiens
ttctggtcttcactgcca

SEQ ID NO: 4191993 - DNA, 20 bp, Homo sapiens
ttctggtgctactccatgca

SEQ ID NO: 4191994 - DNA, 22 bp, Homo sapiens
ttctggtgctactccatgcagg

SEQ ID NO: 4191995 - DNA, 23 bp, Homo sapiens
ttctgtaaactcaaaacttaaca

SEQ ID NO: 4191996 - DNA, 23 bp, Homo sapiens
ttctgttgtagaataataataaa

SEQ ID NO: 4191997 - DNA, 16 bp, Homo sapiens
ttcttaaacacttgca

SEQ ID NO: 4191998 - DNA, 18 bp, Homo sapiens
ttcttaaataagaaactt

SEQ ID NO: 4191999 - DNA, 13 bp, Homo sapiens
ttcttaatataca

SEQ ID NO: 4192000 - DNA, 16 bp, Homo sapiens
ttcttacataattttt

SEQ ID NO: 4192001 - DNA, 22 bp, Homo sapiens
ttcttattcatgctttctcctt

SEQ ID NO: 4192002 - DNA, 21 bp, Homo sapiens
ttcttcaacgttggtatgata

SEQ ID NO: 4192003 - DNA, 13 bp, Homo sapiens
ttcttcatcttga

SEQ ID NO: 4192004 - DNA, 14 bp, Homo sapiens
ttcttcatcttgac

SEQ ID NO: 4192005 - DNA, 16 bp, Homo sapiens
ttcttccagtgcaaca

SEQ ID NO: 4192006 - DNA, 14 bp, Homo sapiens
ttcttctaaaattg

SEQ ID NO: 4192007 - DNA, 15 bp, Homo sapiens
ttcttgagtagatct

SEQ ID NO: 4192008 - DNA, 19 bp, Homo sapiens
ttcttgtctgattggctca

SEQ ID NO: 4192009 - DNA, 21 bp, Homo sapiens
ttctttaagaattacaggttg

SEQ ID NO: 4192010 - DNA, 18 bp, Homo sapiens
ttctttataaaaagtgaa

SEQ ID NO: 4192011 - DNA, 23 bp, Homo sapiens
ttctttataaaaagtgaaataag

SEQ ID NO: 4192012 - DNA, 14 bp, Homo sapiens
ttctttgccacctt

SEQ ID NO: 4192013 - DNA, 21 bp, Homo sapiens
ttcttttttttaataaggaaa

SEQ ID NO: 4192014 - DNA, 15 bp, Homo sapiens
ttgaaaattatttta

SEQ ID NO: 4192015 - DNA, 22 bp, Homo sapiens
ttgaaaattattttaaacaaaa

SEQ ID NO: 4192016 - DNA, 18 bp, Homo sapiens
ttgaaaattgtatttttg

SEQ ID NO: 4192017 - DNA, 15 bp, Homo sapiens
ttgaaacagaaaaat

SEQ ID NO: 4192018 - DNA, 14 bp, Homo sapiens
ttgaaacagcctgg

SEQ ID NO: 4192019 - DNA, 14 bp, Homo sapiens
ttgaacccctgtgt

SEQ ID NO: 4192020 - DNA, 14 bp, Homo sapiens
ttgaaccttggtaa

SEQ ID NO: 4192021 - DNA, 20 bp, Homo sapiens
ttgaactcttcactcttcaa

SEQ ID NO: 4192022 - DNA, 16 bp, Homo sapiens
ttgaagaaaagcactt

SEQ ID NO: 4192023 - DNA, 21 bp, Homo sapiens
ttgaagccactgaagctggga

SEQ ID NO: 4192024 - DNA, 16 bp, Homo sapiens
ttgaataagtattctt

SEQ ID NO: 4192025 - DNA, 15 bp, Homo sapiens
ttgaatgcaaaccat

SEQ ID NO: 4192026 - DNA, 17 bp, Homo sapiens
ttgaatgctttttgaat

SEQ ID NO: 4192027 - DNA, 16 bp, Homo sapiens
ttgaatggctatgttt

SEQ ID NO: 4192028 - DNA, 20 bp, Homo sapiens
ttgaatggctatgtttttaa

SEQ ID NO: 4192029 - DNA, 23 bp, Homo sapiens
ttgaattggatacaaggatcaga

SEQ ID NO: 4192030 - DNA, 20 bp, Homo sapiens
ttgacccctttcccccaccc

SEQ ID NO: 4192031 - DNA, 15 bp, Homo sapiens
ttgacgcatcctgca

SEQ ID NO: 4192032 - DNA, 20 bp, Homo sapiens
ttgactgaaaaaaaaaaaga

SEQ ID NO: 4192033 - DNA, 20 bp, Homo sapiens
ttgacttactgtttcttacc

SEQ ID NO: 4192034 - DNA, 16 bp, Homo sapiens
ttgagaagttttgtac

SEQ ID NO: 4192035 - DNA, 18 bp, Homo sapiens
ttgagaagttttgtacag

SEQ ID NO: 4192036 - DNA, 14 bp, Homo sapiens
ttgagataatgtca

SEQ ID NO: 4192037 - DNA, 18 bp, Homo sapiens
ttgagcaggagcagaaag

SEQ ID NO: 4192038 - DNA, 19 bp, Homo sapiens
ttgaggagcagcttcagtt

SEQ ID NO: 4192039 - DNA, 15 bp, Homo sapiens
ttgaggggctcctgg

SEQ ID NO: 4192040 - DNA, 16 bp, Homo sapiens
ttgaggggctcctgga

SEQ ID NO: 4192041 - DNA, 18 bp, Homo sapiens
ttgagggtaataaactta

SEQ ID NO: 4192042 - DNA, 18 bp, Homo sapiens
ttgagtagatctgcttct

SEQ ID NO: 4192043 - DNA, 14 bp, Homo sapiens
ttgagtgactcgag

SEQ ID NO: 4192044 - DNA, 12 bp, Homo sapiens
ttgagtgattat

SEQ ID NO: 4192045 - DNA, 16 bp, Homo sapiens
ttgagtgcaacaagag

SEQ ID NO: 4192046 - DNA, 20 bp, Homo sapiens
ttgagtgcaacaagagcaaa

SEQ ID NO: 4192047 - DNA, 14 bp, Homo sapiens
ttgataaagatttt

SEQ ID NO: 4192048 - DNA, 22 bp, Homo sapiens
ttgatacgtgtgtgaagtattt

SEQ ID NO: 4192049 - DNA, 15 bp, Homo sapiens
ttgatagaaatgcca

SEQ ID NO: 4192050 - DNA, 21 bp, Homo sapiens
ttgatagcaggtgtaataaga

SEQ ID NO: 4192051 - DNA, 22 bp, Homo sapiens
ttgatagcaggtgtaataagac

SEQ ID NO: 4192052 - DNA, 13 bp, Homo sapiens
ttgatctctgctt

SEQ ID NO: 4192053 - DNA, 22 bp, Homo sapiens
ttgatgccaaaaaaaaatacat

SEQ ID NO: 4192054 - DNA, 17 bp, Homo sapiens
ttgatgggattctggac

SEQ ID NO: 4192055 - DNA, 16 bp, Homo sapiens
ttgatgtcagccttgc

SEQ ID NO: 4192056 - DNA, 17 bp, Homo sapiens
ttgatgtcagccttgca

SEQ ID NO: 4192057 - DNA, 14 bp, Homo sapiens
ttgattacagtgca

SEQ ID NO: 4192058 - DNA, 17 bp, Homo sapiens
ttgcaaaaacatagttt

SEQ ID NO: 4192059 - DNA, 12 bp, Homo sapiens
ttgcaaacttta

SEQ ID NO: 4192060 - DNA, 20 bp, Homo sapiens
ttgcaatggtgttgccctga

SEQ ID NO: 4192061 - DNA, 15 bp, Homo sapiens
ttgcactatctttca

SEQ ID NO: 4192062 - DNA, 18 bp, Homo sapiens
ttgcactcagcttttttc

SEQ ID NO: 4192063 - DNA, 11 bp, Homo sapiens
ttgcagacagg

SEQ ID NO: 4192064 - DNA, 16 bp, Homo sapiens
ttgcagacaggaatct

SEQ ID NO: 4192065 - DNA, 21 bp, Homo sapiens
ttgcagctgttttcaaagccc

SEQ ID NO: 4192066 - DNA, 17 bp, Homo sapiens
ttgcaggtgcctggctt

SEQ ID NO: 4192067 - DNA, 19 bp, Homo sapiens
ttgcaggtgcctggcttgc

SEQ ID NO: 4192068 - DNA, 14 bp, Homo sapiens
ttgcagttgagagg

SEQ ID NO: 4192069 - DNA, 22 bp, Homo sapiens
ttgcataagattaaaggaagga

SEQ ID NO: 4192070 - DNA, 14 bp, Homo sapiens
ttgccaaaatacca

SEQ ID NO: 4192071 - DNA, 18 bp, Homo sapiens
ttgcccctccagagacag

SEQ ID NO: 4192072 - DNA, 14 bp, Homo sapiens
ttgccgagagaggc

SEQ ID NO: 4192073 - DNA, 23 bp, Homo sapiens
ttgcctaggcgattttgtctacc

SEQ ID NO: 4192074 - DNA, 17 bp, Homo sapiens
ttgcctcttcagcagca

SEQ ID NO: 4192075 - DNA, 15 bp, Homo sapiens
ttgcctgcagagaga

SEQ ID NO: 4192076 - DNA, 20 bp, Homo sapiens
ttgcctgcagagagaagcct

SEQ ID NO: 4192077 - DNA, 22 bp, Homo sapiens
ttgccttccagaaaacaaaact

SEQ ID NO: 4192078 - DNA, 21 bp, Homo sapiens
ttgccttcctcgtgcagagct

SEQ ID NO: 4192079 - DNA, 21 bp, Homo sapiens
ttgcgggggagctggaaataa

SEQ ID NO: 4192080 - DNA, 17 bp, Homo sapiens
ttgctctgcaggcacct

SEQ ID NO: 4192081 - DNA, 19 bp, Homo sapiens
ttgctgaggggcagggaga

SEQ ID NO: 4192082 - DNA, 20 bp, Homo sapiens
ttgctggtgtctgagcttca

SEQ ID NO: 4192083 - DNA, 11 bp, Homo sapiens
ttgctgtccta

SEQ ID NO: 4192084 - DNA, 15 bp, Homo sapiens
ttgctgtcctaggcc

SEQ ID NO: 4192085 - DNA, 14 bp, Homo sapiens
ttgcttctgcagca

SEQ ID NO: 4192086 - DNA, 16 bp, Homo sapiens
ttgcttggcagagagg

SEQ ID NO: 4192087 - DNA, 14 bp, Homo sapiens
ttggaaagagacca

SEQ ID NO: 4192088 - DNA, 20 bp, Homo sapiens
ttggaaagcatcacctcagg

SEQ ID NO: 4192089 - DNA, 17 bp, Homo sapiens
ttggaaagttcagccag

SEQ ID NO: 4192090 - DNA, 23 bp, Homo sapiens
ttggaagagaggcacctgctgga

SEQ ID NO: 4192091 - DNA, 16 bp, Homo sapiens
ttggaagttttcagga

SEQ ID NO: 4192092 - DNA, 15 bp, Homo sapiens
ttggaatataattgt

SEQ ID NO: 4192093 - DNA, 13 bp, Homo sapiens
ttggacacagtgt

SEQ ID NO: 4192094 - DNA, 22 bp, Homo sapiens
ttggactttgtttcctccttgt

SEQ ID NO: 4192095 - DNA, 15 bp, Homo sapiens
ttggagaaattattt

SEQ ID NO: 4192096 - DNA, 11 bp, Homo sapiens
ttggagctgac

SEQ ID NO: 4192097 - DNA, 16 bp, Homo sapiens
ttggaggcctttagat

SEQ ID NO: 4192098 - DNA, 15 bp, Homo sapiens
ttggcacatgcaggt

SEQ ID NO: 4192099 - DNA, 18 bp, Homo sapiens
ttggcacatgcaggtagt

SEQ ID NO: 4192100 - DNA, 22 bp, Homo sapiens
ttggccaatgcacctaaagaaa

SEQ ID NO: 4192101 - DNA, 18 bp, Homo sapiens
ttggccctcagtgggctc

SEQ ID NO: 4192102 - DNA, 15 bp, Homo sapiens
ttggcctctgctttc

SEQ ID NO: 4192103 - DNA, 19 bp, Homo sapiens
ttggcctgtgtctggcccc

SEQ ID NO: 4192104 - DNA, 19 bp, Homo sapiens
ttggctgctcattccttct

SEQ ID NO: 4192105 - DNA, 22 bp, Homo sapiens
ttggcttattttttaaaataat

SEQ ID NO: 4192106 - DNA, 17 bp, Homo sapiens
ttgggaccctccagtgc

SEQ ID NO: 4192107 - DNA, 12 bp, Homo sapiens
ttgggacttcta

SEQ ID NO: 4192108 - DNA, 15 bp, Homo sapiens
ttgggatcagcctcc

SEQ ID NO: 4192109 - DNA, 19 bp, Homo sapiens
ttgggcagaagggagaagg

SEQ ID NO: 4192110 - DNA, 20 bp, Homo sapiens
ttgggcagaagggagaagga

SEQ ID NO: 4192111 - DNA, 13 bp, Homo sapiens
ttggggaagaaaa

SEQ ID NO: 4192112 - DNA, 14 bp, Homo sapiens
ttggggaagaaaaa

SEQ ID NO: 4192113 - DNA, 23 bp, Homo sapiens
ttggggagggggaagagaaattt

SEQ ID NO: 4192114 - DNA, 22 bp, Homo sapiens
ttgggtagctccctgatttgga

SEQ ID NO: 4192115 - DNA, 22 bp, Homo sapiens
ttgggtgtggtgtcaccagcct

SEQ ID NO: 4192116 - DNA, 16 bp, Homo sapiens
ttgggttcatctgagc

SEQ ID NO: 4192117 - DNA, 19 bp, Homo sapiens
ttggtaacacaaattttca

SEQ ID NO: 4192118 - DNA, 20 bp, Homo sapiens
ttggtaactgattacctgcc

SEQ ID NO: 4192119 - DNA, 20 bp, Homo sapiens
ttggtacatggccagtgtga

SEQ ID NO: 4192120 - DNA, 15 bp, Homo sapiens
ttggtatacaggtgg

SEQ ID NO: 4192121 - DNA, 19 bp, Homo sapiens
ttggtgaacagagagaacc

SEQ ID NO: 4192122 - DNA, 13 bp, Homo sapiens
ttggtggctgagc

SEQ ID NO: 4192123 - DNA, 14 bp, Homo sapiens
ttggtgggaagcaa

SEQ ID NO: 4192124 - DNA, 20 bp, Homo sapiens
ttggtgggaagcaagcaggg

SEQ ID NO: 4192125 - DNA, 13 bp, Homo sapiens
ttggtgggctggc

SEQ ID NO: 4192126 - DNA, 17 bp, Homo sapiens
ttggtgggctggcccag

SEQ ID NO: 4192127 - DNA, 16 bp, Homo sapiens
ttggtgtgtggagatg

SEQ ID NO: 4192128 - DNA, 19 bp, Homo sapiens
ttggtttggacacagtgtt

SEQ ID NO: 4192129 - DNA, 19 bp, Homo sapiens
ttgtaaacagctaataatg

SEQ ID NO: 4192130 - DNA, 12 bp, Homo sapiens
ttgtaaaggaaa

SEQ ID NO: 4192131 - DNA, 14 bp, Homo sapiens
ttgtaaaggaaata

SEQ ID NO: 4192132 - DNA, 16 bp, Homo sapiens
ttgtaaaggcattcta

SEQ ID NO: 4192133 - DNA, 17 bp, Homo sapiens
ttgtaaaggcattctat

SEQ ID NO: 4192134 - DNA, 21 bp, Homo sapiens
ttgtaaataaaagtatttaat

SEQ ID NO: 4192135 - DNA, 13 bp, Homo sapiens
ttgtaaatgcctc

SEQ ID NO: 4192136 - DNA, 14 bp, Homo sapiens
ttgtaagtttatgt

SEQ ID NO: 4192137 - DNA, 17 bp, Homo sapiens
ttgtaatttttttgaaa

SEQ ID NO: 4192138 - DNA, 22 bp, Homo sapiens
ttgtaatttttttgaaaaaagt

SEQ ID NO: 4192139 - DNA, 13 bp, Homo sapiens
ttgtacactatct

SEQ ID NO: 4192140 - DNA, 11 bp, Homo sapiens
ttgtacagttc

SEQ ID NO: 4192141 - DNA, 15 bp, Homo sapiens
ttgtacagttcagtt

SEQ ID NO: 4192142 - DNA, 14 bp, Homo sapiens
ttgtagaataataa

SEQ ID NO: 4192143 - DNA, 16 bp, Homo sapiens
ttgtagagtcaatcat

SEQ ID NO: 4192144 - DNA, 15 bp, Homo sapiens
ttgtaggctgtgggg

SEQ ID NO: 4192145 - DNA, 20 bp, Homo sapiens
ttgtaggggtcaaagaaatg

SEQ ID NO: 4192146 - DNA, 14 bp, Homo sapiens
ttgtataacttctt

SEQ ID NO: 4192147 - DNA, 14 bp, Homo sapiens
ttgtatagtgtaaa

SEQ ID NO: 4192148 - DNA, 16 bp, Homo sapiens
ttgtatagtgtaaaat

SEQ ID NO: 4192149 - DNA, 11 bp, Homo sapiens
ttgtatatatc

SEQ ID NO: 4192150 - DNA, 13 bp, Homo sapiens
ttgtatatatctg

SEQ ID NO: 4192151 - DNA, 15 bp, Homo sapiens
ttgtatgacttctgc

SEQ ID NO: 4192152 - DNA, 18 bp, Homo sapiens
ttgtattttaaaacataa

SEQ ID NO: 4192153 - DNA, 21 bp, Homo sapiens
ttgtattttaaatgttttaca

SEQ ID NO: 4192154 - DNA, 15 bp, Homo sapiens
ttgtcaacaaaaaga

SEQ ID NO: 4192155 - DNA, 20 bp, Homo sapiens
ttgtcaacacaaagacacag

SEQ ID NO: 4192156 - DNA, 14 bp, Homo sapiens
ttgtcccctcttga

SEQ ID NO: 4192157 - DNA, 15 bp, Homo sapiens
ttgtcgggacagaga

SEQ ID NO: 4192158 - DNA, 20 bp, Homo sapiens
ttgtctagaggtgagaccaa

SEQ ID NO: 4192159 - DNA, 12 bp, Homo sapiens
ttgtctgtctac

SEQ ID NO: 4192160 - DNA, 12 bp, Homo sapiens
ttgtcttaatat

SEQ ID NO: 4192161 - DNA, 13 bp, Homo sapiens
ttgtctttcagga

SEQ ID NO: 4192162 - DNA, 19 bp, Homo sapiens
ttgtctttttagatgccca

SEQ ID NO: 4192163 - DNA, 18 bp, Homo sapiens
ttgtgaactggaagaaag

SEQ ID NO: 4192164 - DNA, 12 bp, Homo sapiens
ttgtgaccacag

SEQ ID NO: 4192165 - DNA, 17 bp, Homo sapiens
ttgtgcaatgtaaatat

SEQ ID NO: 4192166 - DNA, 23 bp, Homo sapiens
ttgtgcaatgtaaatattttaaa

SEQ ID NO: 4192167 - DNA, 19 bp, Homo sapiens
ttgtgcttggcaaatgagt

SEQ ID NO: 4192168 - DNA, 18 bp, Homo sapiens
ttgtggtaacttctttga

SEQ ID NO: 4192169 - DNA, 21 bp, Homo sapiens
ttgtgtaatagaaaactgaaa

SEQ ID NO: 4192170 - DNA, 15 bp, Homo sapiens
ttgtgtacagtgtgt

SEQ ID NO: 4192171 - DNA, 18 bp, Homo sapiens
ttgtgtcaagacatttct

SEQ ID NO: 4192172 - DNA, 16 bp, Homo sapiens
ttgtgttctgagtgaa

SEQ ID NO: 4192173 - DNA, 20 bp, Homo sapiens
ttgttaatttagaaaacttt

SEQ ID NO: 4192174 - DNA, 15 bp, Homo sapiens
ttgttactgaagtta

SEQ ID NO: 4192175 - DNA, 15 bp, Homo sapiens
ttgttagtaaacata

SEQ ID NO: 4192176 - DNA, 13 bp, Homo sapiens
ttgttatgtatat

SEQ ID NO: 4192177 - DNA, 15 bp, Homo sapiens
ttgttctgtattttc

SEQ ID NO: 4192178 - DNA, 14 bp, Homo sapiens
ttgttgaaagtaaa

SEQ ID NO: 4192179 - DNA, 20 bp, Homo sapiens
ttgttgataaattccactgg

SEQ ID NO: 4192180 - DNA, 14 bp, Homo sapiens
ttgttgtgctttta

SEQ ID NO: 4192181 - DNA, 15 bp, Homo sapiens
ttgtttcctccttgt

SEQ ID NO: 4192182 - DNA, 12 bp, Homo sapiens
ttgtttcttaaa

SEQ ID NO: 4192183 - DNA, 23 bp, Homo sapiens
ttgtttcttaaataagaaacttt

SEQ ID NO: 4192184 - DNA, 21 bp, Homo sapiens
ttgtttgtttctccccctggg

SEQ ID NO: 4192185 - DNA, 13 bp, Homo sapiens
ttgttttgtttta

SEQ ID NO: 4192186 - DNA, 12 bp, Homo sapiens
tttaaaaaaaga

SEQ ID NO: 4192187 - DNA, 20 bp, Homo sapiens
tttaaaaaataactaccaag

SEQ ID NO: 4192188 - DNA, 16 bp, Homo sapiens
tttaaaaccattattt

SEQ ID NO: 4192189 - DNA, 15 bp, Homo sapiens
tttaaaagataaaca

SEQ ID NO: 4192190 - DNA, 17 bp, Homo sapiens
tttaaaccgctaaaaga

SEQ ID NO: 4192191 - DNA, 20 bp, Homo sapiens
tttaaaccgctaaaagaaac

SEQ ID NO: 4192192 - DNA, 19 bp, Homo sapiens
tttaacacataactagaaa

SEQ ID NO: 4192193 - DNA, 14 bp, Homo sapiens
tttaacttaaatag

SEQ ID NO: 4192194 - DNA, 16 bp, Homo sapiens
tttaacttaaatttta

SEQ ID NO: 4192195 - DNA, 19 bp, Homo sapiens
tttaacttgagggtaataa

SEQ ID NO: 4192196 - DNA, 13 bp, Homo sapiens
tttaagaatcaca

SEQ ID NO: 4192197 - DNA, 16 bp, Homo sapiens
tttaagccaaaatgca

SEQ ID NO: 4192198 - DNA, 17 bp, Homo sapiens
tttaatagcaaagaatt

SEQ ID NO: 4192199 - DNA, 22 bp, Homo sapiens
tttaatccacagtatgttacat

SEQ ID NO: 4192200 - DNA, 16 bp, Homo sapiens
tttaatccagatctgg

SEQ ID NO: 4192201 - DNA, 16 bp, Homo sapiens
tttaatgtttaaaaca

SEQ ID NO: 4192202 - DNA, 15 bp, Homo sapiens
tttaattaactatgt

SEQ ID NO: 4192203 - DNA, 20 bp, Homo sapiens
tttaattaactatgtgatgt

SEQ ID NO: 4192204 - DNA, 15 bp, Homo sapiens
tttacaagtgtatat

SEQ ID NO: 4192205 - DNA, 21 bp, Homo sapiens
tttacaagtgtatatcagaaa

SEQ ID NO: 4192206 - DNA, 19 bp, Homo sapiens
tttacagtaaataaattgt

SEQ ID NO: 4192207 - DNA, 14 bp, Homo sapiens
tttacccaaatatg

SEQ ID NO: 4192208 - DNA, 15 bp, Homo sapiens
tttactaaagagaca

SEQ ID NO: 4192209 - DNA, 12 bp, Homo sapiens
tttacttgaaag

SEQ ID NO: 4192210 - DNA, 13 bp, Homo sapiens
tttagaaaacttt

SEQ ID NO: 4192211 - DNA, 15 bp, Homo sapiens
tttagacttcaagca

SEQ ID NO: 4192212 - DNA, 23 bp, Homo sapiens
tttagcagtccaaagaacaagaa

SEQ ID NO: 4192213 - DNA, 15 bp, Homo sapiens
tttagcctcttccct

SEQ ID NO: 4192214 - DNA, 19 bp, Homo sapiens
tttagcctcttccctctga

SEQ ID NO: 4192215 - DNA, 16 bp, Homo sapiens
tttaggcaagagaaaa

SEQ ID NO: 4192216 - DNA, 13 bp, Homo sapiens
tttaggcagcctg

SEQ ID NO: 4192217 - DNA, 18 bp, Homo sapiens
tttaggggaagtatgtgt

SEQ ID NO: 4192218 - DNA, 16 bp, Homo sapiens
tttagtgaacttgaaa

SEQ ID NO: 4192219 - DNA, 12 bp, Homo sapiens
tttataaaaagt

SEQ ID NO: 4192220 - DNA, 19 bp, Homo sapiens
tttataaatatgtgaaaat

SEQ ID NO: 4192221 - DNA, 21 bp, Homo sapiens
tttatactttgcaatccaaat

SEQ ID NO: 4192222 - DNA, 13 bp, Homo sapiens
tttatatgttaat

SEQ ID NO: 4192223 - DNA, 14 bp, Homo sapiens
tttatatttagtga

SEQ ID NO: 4192224 - DNA, 14 bp, Homo sapiens
tttatatttagtta

SEQ ID NO: 4192225 - DNA, 16 bp, Homo sapiens
tttatatttggaaaga

SEQ ID NO: 4192226 - DNA, 16 bp, Homo sapiens
tttatcgcagaccttt

SEQ ID NO: 4192227 - DNA, 13 bp, Homo sapiens
tttatgcttgcaa

SEQ ID NO: 4192228 - DNA, 18 bp, Homo sapiens
tttatggtattgtattgt

SEQ ID NO: 4192229 - DNA, 19 bp, Homo sapiens
tttatggtgtgttcctaac

SEQ ID NO: 4192230 - DNA, 22 bp, Homo sapiens
tttatggtgtgttcctaacata

SEQ ID NO: 4192231 - DNA, 21 bp, Homo sapiens
tttatgtaaaatcaataaaag

SEQ ID NO: 4192232 - DNA, 19 bp, Homo sapiens
tttatgtctgtggattttt

SEQ ID NO: 4192233 - DNA, 15 bp, Homo sapiens
tttatgtgaaagagt

SEQ ID NO: 4192234 - DNA, 14 bp, Homo sapiens
tttatgtgttatag

SEQ ID NO: 4192235 - DNA, 17 bp, Homo sapiens
tttatgttctcagaatc

SEQ ID NO: 4192236 - DNA, 22 bp, Homo sapiens
tttattaaaatgattgtaaaat

SEQ ID NO: 4192237 - DNA, 15 bp, Homo sapiens
tttatttagttttta

SEQ ID NO: 4192238 - DNA, 18 bp, Homo sapiens
tttattttattctatgta

SEQ ID NO: 4192239 - DNA, 17 bp, Homo sapiens
tttcaaaataaactggg

SEQ ID NO: 4192240 - DNA, 19 bp, Homo sapiens
tttcaacagtgaagacaga

SEQ ID NO: 4192241 - DNA, 16 bp, Homo sapiens
tttcaacatatcattt

SEQ ID NO: 4192242 - DNA, 24 bp, Homo sapiens
tttcaagagtgcagttgattctga

SEQ ID NO: 4192243 - DNA, 12 bp, Homo sapiens
tttcaagtgcct

SEQ ID NO: 4192244 - DNA, 21 bp, Homo sapiens
tttcaagtgcctagactgtta

SEQ ID NO: 4192245 - DNA, 17 bp, Homo sapiens
tttcacaaggtctttaa

SEQ ID NO: 4192246 - DNA, 15 bp, Homo sapiens
tttcacagtttttcc

SEQ ID NO: 4192247 - DNA, 23 bp, Homo sapiens
tttcacatgtttatatttggctc

SEQ ID NO: 4192248 - DNA, 17 bp, Homo sapiens
tttcacattagaagaca

SEQ ID NO: 4192249 - DNA, 13 bp, Homo sapiens
tttcacctcttta

SEQ ID NO: 4192250 - DNA, 16 bp, Homo sapiens
tttcaccttgggtttg

SEQ ID NO: 4192251 - DNA, 23 bp, Homo sapiens
tttcactcagggtgataaatcag

SEQ ID NO: 4192252 - DNA, 16 bp, Homo sapiens
tttcagatatatatca

SEQ ID NO: 4192253 - DNA, 13 bp, Homo sapiens
tttcaggatactc

SEQ ID NO: 4192254 - DNA, 16 bp, Homo sapiens
tttcaggatactctgt

SEQ ID NO: 4192255 - DNA, 13 bp, Homo sapiens
tttcatcattttt

SEQ ID NO: 4192256 - DNA, 22 bp, Homo sapiens
tttcatgataatgaacagaaca

SEQ ID NO: 4192257 - DNA, 13 bp, Homo sapiens
tttcatgcacact

SEQ ID NO: 4192258 - DNA, 20 bp, Homo sapiens
tttcatgtagattttagttc

SEQ ID NO: 4192259 - DNA, 15 bp, Homo sapiens
tttccactccaagat

SEQ ID NO: 4192260 - DNA, 15 bp, Homo sapiens
tttccagttctgaca

SEQ ID NO: 4192261 - DNA, 17 bp, Homo sapiens
tttccatgaagtttgaa

SEQ ID NO: 4192262 - DNA, 21 bp, Homo sapiens
tttccatggcaggaaggcttg

SEQ ID NO: 4192263 - DNA, 22 bp, Homo sapiens
tttccatgggaccacaactatt

SEQ ID NO: 4192264 - DNA, 22 bp, Homo sapiens
tttccattcatgccaaagcaaa

SEQ ID NO: 4192265 - DNA, 13 bp, Homo sapiens
tttcccaccacct

SEQ ID NO: 4192266 - DNA, 12 bp, Homo sapiens
tttcccccaccc

SEQ ID NO: 4192267 - DNA, 19 bp, Homo sapiens
tttcccccaccccagagtt

SEQ ID NO: 4192268 - DNA, 16 bp, Homo sapiens
tttcccctctaattat

SEQ ID NO: 4192269 - DNA, 20 bp, Homo sapiens
tttcccttgtgtcaagacat

SEQ ID NO: 4192270 - DNA, 13 bp, Homo sapiens
tttcctaaatgtt

SEQ ID NO: 4192271 - DNA, 13 bp, Homo sapiens
tttcctaacattt

SEQ ID NO: 4192272 - DNA, 17 bp, Homo sapiens
tttcctccttgtcactg

SEQ ID NO: 4192273 - DNA, 23 bp, Homo sapiens
tttcctcttataacttctgaagt

SEQ ID NO: 4192274 - DNA, 16 bp, Homo sapiens
tttcctggaaagactg

SEQ ID NO: 4192275 - DNA, 19 bp, Homo sapiens
tttcctggccctccactcc

SEQ ID NO: 4192276 - DNA, 18 bp, Homo sapiens
tttccttcaaagtttaat

SEQ ID NO: 4192277 - DNA, 15 bp, Homo sapiens
tttcgctttcctctg

SEQ ID NO: 4192278 - DNA, 14 bp, Homo sapiens
tttctaaagttgtt

SEQ ID NO: 4192279 - DNA, 23 bp, Homo sapiens
tttctaagtagatagaaagcaat

SEQ ID NO: 4192280 - DNA, 16 bp, Homo sapiens
tttctacttttaaaga

SEQ ID NO: 4192281 - DNA, 16 bp, Homo sapiens
tttctagagcactgcc

SEQ ID NO: 4192282 - DNA, 22 bp, Homo sapiens
tttctatagccaaaaatagcta

SEQ ID NO: 4192283 - DNA, 14 bp, Homo sapiens
tttctcactgctgt

SEQ ID NO: 4192284 - DNA, 15 bp, Homo sapiens
tttctccccctgggc

SEQ ID NO: 4192285 - DNA, 17 bp, Homo sapiens
tttctccctagaaacaa

SEQ ID NO: 4192286 - DNA, 20 bp, Homo sapiens
tttctctccttcttccctgt

SEQ ID NO: 4192287 - DNA, 17 bp, Homo sapiens
tttctctggctccagaa

SEQ ID NO: 4192288 - DNA, 16 bp, Homo sapiens
tttctcttcatacttt

SEQ ID NO: 4192289 - DNA, 11 bp, Homo sapiens
tttctcttccc

SEQ ID NO: 4192290 - DNA, 15 bp, Homo sapiens
tttctgaactgttac

SEQ ID NO: 4192291 - DNA, 20 bp, Homo sapiens
tttctgagattttagttcac

SEQ ID NO: 4192292 - DNA, 15 bp, Homo sapiens
tttctgatcaaggcc

SEQ ID NO: 4192293 - DNA, 19 bp, Homo sapiens
tttctgtgaagcaaaaaga

SEQ ID NO: 4192294 - DNA, 22 bp, Homo sapiens
tttctgtgtgcaccttaccaac

SEQ ID NO: 4192295 - DNA, 22 bp, Homo sapiens
tttcttacccatatatcttatg

SEQ ID NO: 4192296 - DNA, 21 bp, Homo sapiens
tttcttcactgttgaaaatta

SEQ ID NO: 4192297 - DNA, 14 bp, Homo sapiens
tttctttaaaacca

SEQ ID NO: 4192298 - DNA, 18 bp, Homo sapiens
tttgaaaacgtttcaaag

SEQ ID NO: 4192299 - DNA, 22 bp, Homo sapiens
tttgaacaactaggcttcagca

SEQ ID NO: 4192300 - DNA, 22 bp, Homo sapiens
tttgaactaatttcttagagaa

SEQ ID NO: 4192301 - DNA, 19 bp, Homo sapiens
tttgaaggaggtgagggat

SEQ ID NO: 4192302 - DNA, 13 bp, Homo sapiens
tttgaatatcatt

SEQ ID NO: 4192303 - DNA, 21 bp, Homo sapiens
tttgactctgtcacactaaac

SEQ ID NO: 4192304 - DNA, 15 bp, Homo sapiens
tttgactgaaaaaaa

SEQ ID NO: 4192305 - DNA, 18 bp, Homo sapiens
tttgagcaggagcagaaa

SEQ ID NO: 4192306 - DNA, 22 bp, Homo sapiens
tttgaggagcagcttcagttgt

SEQ ID NO: 4192307 - DNA, 14 bp, Homo sapiens
tttgagttatagtt

SEQ ID NO: 4192308 - DNA, 16 bp, Homo sapiens
tttgatactaagcatt

SEQ ID NO: 4192309 - DNA, 21 bp, Homo sapiens
tttgatggtaagactgtaatt

SEQ ID NO: 4192310 - DNA, 15 bp, Homo sapiens
tttgatgtcagcctt

SEQ ID NO: 4192311 - DNA, 16 bp, Homo sapiens
tttgatgtcagccttg

SEQ ID NO: 4192312 - DNA, 18 bp, Homo sapiens
tttgcaggcccagcagac

SEQ ID NO: 4192313 - DNA, 18 bp, Homo sapiens
tttgcagtatatttctga

SEQ ID NO: 4192314 - DNA, 15 bp, Homo sapiens
tttgccattcctgga

SEQ ID NO: 4192315 - DNA, 15 bp, Homo sapiens
tttgccccagttaca

SEQ ID NO: 4192316 - DNA, 13 bp, Homo sapiens
tttgccctgtgga

SEQ ID NO: 4192317 - DNA, 12 bp, Homo sapiens
tttgcctctgct

SEQ ID NO: 4192318 - DNA, 21 bp, Homo sapiens
tttgcctctgctactgaggca

SEQ ID NO: 4192319 - DNA, 12 bp, Homo sapiens
tttgccttttgc

SEQ ID NO: 4192320 - DNA, 18 bp, Homo sapiens
tttgctctagtcttgctt

SEQ ID NO: 4192321 - DNA, 15 bp, Homo sapiens
tttgcttggcagaga

SEQ ID NO: 4192322 - DNA, 13 bp, Homo sapiens
tttggacaaaatg

SEQ ID NO: 4192323 - DNA, 12 bp, Homo sapiens
tttggagtgtgt

SEQ ID NO: 4192324 - DNA, 19 bp, Homo sapiens
tttggatatgtaaaacatt

SEQ ID NO: 4192325 - DNA, 20 bp, Homo sapiens
tttggcaatttcctggccct

SEQ ID NO: 4192326 - DNA, 14 bp, Homo sapiens
tttggtgagaacct

SEQ ID NO: 4192327 - DNA, 14 bp, Homo sapiens
tttgtaaaggaaat

SEQ ID NO: 4192328 - DNA, 21 bp, Homo sapiens
tttgtaaatgcctcttaaatt

SEQ ID NO: 4192329 - DNA, 20 bp, Homo sapiens
tttgtaagttgaagcaaatc

SEQ ID NO: 4192330 - DNA, 14 bp, Homo sapiens
tttgtaccatggtg

SEQ ID NO: 4192331 - DNA, 20 bp, Homo sapiens
tttgtaggggtcaaagaaat

SEQ ID NO: 4192332 - DNA, 18 bp, Homo sapiens
tttgtataacttcttaaa

SEQ ID NO: 4192333 - DNA, 13 bp, Homo sapiens
tttgtatgtggca

SEQ ID NO: 4192334 - DNA, 18 bp, Homo sapiens
tttgtcgagtttacttca

SEQ ID NO: 4192335 - DNA, 12 bp, Homo sapiens
tttgtgaactgg

SEQ ID NO: 4192336 - DNA, 23 bp, Homo sapiens
tttgtgctatcagactgtaggat

SEQ ID NO: 4192337 - DNA, 16 bp, Homo sapiens
tttgtggggctgggtg

SEQ ID NO: 4192338 - DNA, 19 bp, Homo sapiens
tttgtgtaatagaaaactg

SEQ ID NO: 4192339 - DNA, 20 bp, Homo sapiens
tttgttaaaaatattttctg

SEQ ID NO: 4192340 - DNA, 15 bp, Homo sapiens
tttgttaacatggaa

SEQ ID NO: 4192341 - DNA, 21 bp, Homo sapiens
tttgttaatttagaaaacttt

SEQ ID NO: 4192342 - DNA, 21 bp, Homo sapiens
tttgttatgtatatagatgtg

SEQ ID NO: 4192343 - DNA, 19 bp, Homo sapiens
tttgttatttgtacagttc

SEQ ID NO: 4192344 - DNA, 14 bp, Homo sapiens
tttgttctgtattt

SEQ ID NO: 4192345 - DNA, 14 bp, Homo sapiens
tttgtttcctcctt

SEQ ID NO: 4192346 - DNA, 21 bp, Homo sapiens
ttttaaaaaagcttaaaactt

SEQ ID NO: 4192347 - DNA, 20 bp, Homo sapiens
ttttaaaagataaacagttt

SEQ ID NO: 4192348 - DNA, 16 bp, Homo sapiens
ttttaaacaaaataga

SEQ ID NO: 4192349 - DNA, 12 bp, Homo sapiens
ttttaaagaatt

SEQ ID NO: 4192350 - DNA, 20 bp, Homo sapiens
ttttaaattataagatgtca

SEQ ID NO: 4192351 - DNA, 23 bp, Homo sapiens
ttttaacacataactagaaacct

SEQ ID NO: 4192352 - DNA, 20 bp, Homo sapiens
ttttacagtgaatttctgat

SEQ ID NO: 4192353 - DNA, 16 bp, Homo sapiens
ttttacccaaatatgt

SEQ ID NO: 4192354 - DNA, 18 bp, Homo sapiens
ttttacttttgttctgta

SEQ ID NO: 4192355 - DNA, 20 bp, Homo sapiens
ttttagatgagattgtttta

SEQ ID NO: 4192356 - DNA, 20 bp, Homo sapiens
ttttagcctcttccctctga

SEQ ID NO: 4192357 - DNA, 22 bp, Homo sapiens
ttttataaatatgtgaaaatga

SEQ ID NO: 4192358 - DNA, 19 bp, Homo sapiens
ttttatcatgacatgttat

SEQ ID NO: 4192359 - DNA, 14 bp, Homo sapiens
ttttattcaagtta

SEQ ID NO: 4192360 - DNA, 22 bp, Homo sapiens
ttttcaacagtgaagacagaag

SEQ ID NO: 4192361 - DNA, 11 bp, Homo sapiens
ttttcagatgt

SEQ ID NO: 4192362 - DNA, 16 bp, Homo sapiens
ttttcagtattttgga

SEQ ID NO: 4192363 - DNA, 23 bp, Homo sapiens
ttttcagtattttggagaaatta

SEQ ID NO: 4192364 - DNA, 22 bp, Homo sapiens
ttttcattttaatttatatttg

SEQ ID NO: 4192365 - DNA, 21 bp, Homo sapiens
ttttccatggcaggaaggctt

SEQ ID NO: 4192366 - DNA, 22 bp, Homo sapiens
ttttccatggcaggaaggcttg

SEQ ID NO: 4192367 - DNA, 16 bp, Homo sapiens
ttttccttcaaagttt

SEQ ID NO: 4192368 - DNA, 23 bp, Homo sapiens
ttttcgaacattctttgcctggt

SEQ ID NO: 4192369 - DNA, 12 bp, Homo sapiens
ttttctagaaga

SEQ ID NO: 4192370 - DNA, 18 bp, Homo sapiens
ttttctagactttctgtt

SEQ ID NO: 4192371 - DNA, 14 bp, Homo sapiens
ttttctggaagaca

SEQ ID NO: 4192372 - DNA, 13 bp, Homo sapiens
ttttctgtacaca

SEQ ID NO: 4192373 - DNA, 17 bp, Homo sapiens
ttttctttgaatgcttt

SEQ ID NO: 4192374 - DNA, 19 bp, Homo sapiens
ttttgaagtagtttgtata

SEQ ID NO: 4192375 - DNA, 13 bp, Homo sapiens
ttttgaatgttat

SEQ ID NO: 4192376 - DNA, 14 bp, Homo sapiens
ttttgaatgttatt

SEQ ID NO: 4192377 - DNA, 15 bp, Homo sapiens
ttttgacttgaataa

SEQ ID NO: 4192378 - DNA, 15 bp, Homo sapiens
ttttgatttatgcat

SEQ ID NO: 4192379 - DNA, 22 bp, Homo sapiens
ttttgcataagattaaaggaag

SEQ ID NO: 4192380 - DNA, 19 bp, Homo sapiens
ttttgtaagttgaagcaaa

SEQ ID NO: 4192381 - DNA, 15 bp, Homo sapiens
ttttgtaataaaagg

SEQ ID NO: 4192382 - DNA, 18 bp, Homo sapiens
ttttgtgaaaatgtcaaa

SEQ ID NO: 4192383 - DNA, 16 bp, Homo sapiens
ttttgtgatttagaac

SEQ ID NO: 4192384 - DNA, 18 bp, Homo sapiens
ttttgtggattgacagta

SEQ ID NO: 4192385 - DNA, 13 bp, Homo sapiens
ttttgttaacatg

SEQ ID NO: 4192386 - DNA, 19 bp, Homo sapiens
ttttgttgtttcttaaata

SEQ ID NO: 4192387 - DNA, 22 bp, Homo sapiens
tttttaaaaaagcttaaaactt

SEQ ID NO: 4192388 - DNA, 23 bp, Homo sapiens
tttttaaaaaagcttaaaacttt

SEQ ID NO: 4192389 - DNA, 16 bp, Homo sapiens
tttttaaacaagtatt

SEQ ID NO: 4192390 - DNA, 12 bp, Homo sapiens
tttttaaagtct

SEQ ID NO: 4192391 - DNA, 23 bp, Homo sapiens
tttttaagctgtaaaaagagaga

SEQ ID NO: 4192392 - DNA, 14 bp, Homo sapiens
tttttaataattta

SEQ ID NO: 4192393 - DNA, 21 bp, Homo sapiens
tttttaattgaggacagcctg

SEQ ID NO: 4192394 - DNA, 16 bp, Homo sapiens
tttttacccaaatatg

SEQ ID NO: 4192395 - DNA, 13 bp, Homo sapiens
tttttatttaaaa

SEQ ID NO: 4192396 - DNA, 16 bp, Homo sapiens
tttttcatgataatga

SEQ ID NO: 4192397 - DNA, 14 bp, Homo sapiens
tttttccaactgtg

SEQ ID NO: 4192398 - DNA, 18 bp, Homo sapiens
tttttccttcaaagttta

SEQ ID NO: 4192399 - DNA, 18 bp, Homo sapiens
tttttctacttttaaaga

SEQ ID NO: 4192400 - DNA, 19 bp, Homo sapiens
tttttctagtttggcacat

SEQ ID NO: 4192401 - DNA, 17 bp, Homo sapiens
tttttctttataaactt

SEQ ID NO: 4192402 - DNA, 23 bp, Homo sapiens
tttttgaaaggcatgttcctctg

SEQ ID NO: 4192403 - DNA, 18 bp, Homo sapiens
tttttgatggtaagactg

SEQ ID NO: 4192404 - DNA, 17 bp, Homo sapiens
tttttgctatttctagt

SEQ ID NO: 4192405 - DNA, 16 bp, Homo sapiens
tttttggtgtatttga

SEQ ID NO: 4192406 - DNA, 13 bp, Homo sapiens
tttttgtcactat

SEQ ID NO: 4192407 - DNA, 17 bp, Homo sapiens
ttttttaacacataact

SEQ ID NO: 4192408 - DNA, 14 bp, Homo sapiens
ttttttggtaatta

SEQ ID NO: 4192409 - DNA, 18 bp, Homo sapiens
aaacacatctttcctgtc

SEQ ID NO: 4192410 - DNA, 11 bp, Homo sapiens
aaacactccac

SEQ ID NO: 4192411 - DNA, 20 bp, Homo sapiens
aaacagcctgggtaggaaaa

SEQ ID NO: 4192412 - DNA, 22 bp, Homo sapiens
aaacagcctgggtaggaaaatt

SEQ ID NO: 4192413 - DNA, 18 bp, Homo sapiens
aaacaggagacaggaagg

SEQ ID NO: 4192414 - DNA, 16 bp, Homo sapiens
aaacatagcttgtaac

SEQ ID NO: 4192415 - DNA, 19 bp, Homo sapiens
aaacatcattcatttttgt

SEQ ID NO: 4192416 - DNA, 15 bp, Homo sapiens
aaacattaagattga

SEQ ID NO: 4192417 - DNA, 20 bp, Homo sapiens
aaacattaatgcttagaatt

SEQ ID NO: 4192418 - DNA, 18 bp, Homo sapiens
aaacattgtgatgattat

SEQ ID NO: 4192419 - DNA, 18 bp, Homo sapiens
aaacatttattttgacat

SEQ ID NO: 4192420 - DNA, 22 bp, Homo sapiens
aaaccaaaaaggctagtttatt

SEQ ID NO: 4192421 - DNA, 23 bp, Homo sapiens
aaaccacctgggttcagcctctc

SEQ ID NO: 4192422 - DNA, 16 bp, Homo sapiens
aaaccactgaacattt

SEQ ID NO: 4192423 - DNA, 20 bp, Homo sapiens
aaaccattatttaataagag

SEQ ID NO: 4192424 - DNA, 13 bp, Homo sapiens
aaaccatttcaaa

SEQ ID NO: 4192425 - DNA, 15 bp, Homo sapiens
aaaccatttcaaatg

SEQ ID NO: 4192426 - DNA, 19 bp, Homo sapiens
aaacccattaggcatgcct

SEQ ID NO: 4192427 - DNA, 18 bp, Homo sapiens
aaacccccgctccagatc

SEQ ID NO: 4192428 - DNA, 15 bp, Homo sapiens
aaaccgctaaaagaa

SEQ ID NO: 4192429 - DNA, 21 bp, Homo sapiens
aaaccgctaaaagaaactttc

SEQ ID NO: 4192430 - DNA, 16 bp, Homo sapiens
aaacctagaacttcaa

SEQ ID NO: 4192431 - DNA, 21 bp, Homo sapiens
aaacctcagtcatattcttat

SEQ ID NO: 4192432 - DNA, 22 bp, Homo sapiens
aaacctgaaaaaaagtttacaa

SEQ ID NO: 4192433 - DNA, 12 bp, Homo sapiens
aaacctggagat

SEQ ID NO: 4192434 - DNA, 18 bp, Homo sapiens
aaacctggagatgatgat

SEQ ID NO: 4192435 - DNA, 20 bp, Homo sapiens
aaacctggcatggtgctttc

SEQ ID NO: 4192436 - DNA, 21 bp, Homo sapiens
aaacctggttcatatttatac

SEQ ID NO: 4192437 - DNA, 22 bp, Homo sapiens
aaacctggttcatatttatact

SEQ ID NO: 4192438 - DNA, 17 bp, Homo sapiens
aaacctttcaaatttca

SEQ ID NO: 4192439 - DNA, 18 bp, Homo sapiens
aaacgttgacccctttcc

SEQ ID NO: 4192440 - DNA, 14 bp, Homo sapiens
aaactaaaaactag

SEQ ID NO: 4192441 - DNA, 18 bp, Homo sapiens
aaactaaatctctaatat

SEQ ID NO: 4192442 - DNA, 14 bp, Homo sapiens
aaactaacaaccaa

SEQ ID NO: 4192443 - DNA, 21 bp, Homo sapiens
aaactacaaccaatggaatgt

SEQ ID NO: 4192444 - DNA, 18 bp, Homo sapiens
aaactaggaggaaaagac

SEQ ID NO: 4192445 - DNA, 22 bp, Homo sapiens
aaactataagcaagaaggcaaa

SEQ ID NO: 4192446 - DNA, 11 bp, Homo sapiens
aaactatcagt

SEQ ID NO: 4192447 - DNA, 16 bp, Homo sapiens
aaactatcagtttgtc

SEQ ID NO: 4192448 - DNA, 19 bp, Homo sapiens
aaactcaaaacttaacata

SEQ ID NO: 4192449 - DNA, 14 bp, Homo sapiens
aaactctgccagcc

SEQ ID NO: 4192450 - DNA, 14 bp, Homo sapiens
aaactcttggcctc

SEQ ID NO: 4192451 - DNA, 12 bp, Homo sapiens
aaactgaaaatc

SEQ ID NO: 4192452 - DNA, 19 bp, Homo sapiens
aaactgaaaatctaatatt

SEQ ID NO: 4192453 - DNA, 17 bp, Homo sapiens
aaactgtaatacaatga

SEQ ID NO: 4192454 - DNA, 14 bp, Homo sapiens
aaactgttggaagt

SEQ ID NO: 4192455 - DNA, 22 bp, Homo sapiens
aaacttagaataaaattgtaaa

SEQ ID NO: 4192456 - DNA, 10 bp, Homo sapiens
aaacttattt

SEQ ID NO: 4192457 - DNA, 20 bp, Homo sapiens
aaacttgtcaagaatgagaa

SEQ ID NO: 4192458 - DNA, 14 bp, Homo sapiens
aaagaaaaacattt

SEQ ID NO: 4192459 - DNA, 13 bp, Homo sapiens
aaagaaaaccatt

SEQ ID NO: 4192460 - DNA, 15 bp, Homo sapiens
aaagaacggaagaag

SEQ ID NO: 4192461 - DNA, 14 bp, Homo sapiens
aaagaactgcccca

SEQ ID NO: 4192462 - DNA, 15 bp, Homo sapiens
aaagaactgccccat

SEQ ID NO: 4192463 - DNA, 21 bp, Homo sapiens
aaagaagaagaagaaggagag

SEQ ID NO: 4192464 - DNA, 12 bp, Homo sapiens
aaagaagagaca

SEQ ID NO: 4192465 - DNA, 13 bp, Homo sapiens
aaagaagtaaaag

SEQ ID NO: 4192466 - DNA, 15 bp, Homo sapiens
aaagaagtaaaagca

SEQ ID NO: 4192467 - DNA, 15 bp, Homo sapiens
aaagaatccctgcag

SEQ ID NO: 4192468 - DNA, 14 bp, Homo sapiens
aaagactaatttaa

SEQ ID NO: 4192469 - DNA, 14 bp, Homo sapiens
aaagagaacaagag

SEQ ID NO: 4192470 - DNA, 16 bp, Homo sapiens
aaagagagagatacat

SEQ ID NO: 4192471 - DNA, 20 bp, Homo sapiens
aaagagttcaagaaataagt

SEQ ID NO: 4192472 - DNA, 20 bp, Homo sapiens
aaagataacaagatctttca

SEQ ID NO: 4192473 - DNA, 16 bp, Homo sapiens
aaagataatgttatac

SEQ ID NO: 4192474 - DNA, 18 bp, Homo sapiens
aaagatagtatcttttaa

SEQ ID NO: 4192475 - DNA, 12 bp, Homo sapiens
aaagatgctttt

SEQ ID NO: 4192476 - DNA, 13 bp, Homo sapiens
aaagatgctttta

SEQ ID NO: 4192477 - DNA, 13 bp, Homo sapiens
aaagattttttaa

SEQ ID NO: 4192478 - DNA, 19 bp, Homo sapiens
aaagattttttaataattt

SEQ ID NO: 4192479 - DNA, 20 bp, Homo sapiens
aaagattttttaataattta

SEQ ID NO: 4192480 - DNA, 22 bp, Homo sapiens
aaagattttttaataatttaga

SEQ ID NO: 4192481 - DNA, 14 bp, Homo sapiens
aaagcaaaaaagaa

SEQ ID NO: 4192482 - DNA, 15 bp, Homo sapiens
aaagcaaaaaagaaa

SEQ ID NO: 4192483 - DNA, 15 bp, Homo sapiens
aaagcaaaagaagta

SEQ ID NO: 4192484 - DNA, 23 bp, Homo sapiens
aaagcagttaactttaagactga

SEQ ID NO: 4192485 - DNA, 16 bp, Homo sapiens
aaagcatcacctcagg

SEQ ID NO: 4192486 - DNA, 18 bp, Homo sapiens
aaagcatcacctcaggcc

SEQ ID NO: 4192487 - DNA, 15 bp, Homo sapiens
aaagccaaacatata

SEQ ID NO: 4192488 - DNA, 13 bp, Homo sapiens
aaagccatgctgg

SEQ ID NO: 4192489 - DNA, 11 bp, Homo sapiens
aaagccttctt

SEQ ID NO: 4192490 - DNA, 18 bp, Homo sapiens
aaagccttcttttggggg

SEQ ID NO: 4192491 - DNA, 16 bp, Homo sapiens
aaagcgaaaaaatcag

SEQ ID NO: 4192492 - DNA, 14 bp, Homo sapiens
aaagcgtttgcaca

SEQ ID NO: 4192493 - DNA, 20 bp, Homo sapiens
aaagctagaattgagtgttt

SEQ ID NO: 4192494 - DNA, 17 bp, Homo sapiens
aaagctgcctgtagtta

SEQ ID NO: 4192495 - DNA, 21 bp, Homo sapiens
aaagctgcctgtagttaggaa

SEQ ID NO: 4192496 - DNA, 18 bp, Homo sapiens
aaagctggacaagaagct

SEQ ID NO: 4192497 - DNA, 16 bp, Homo sapiens
aaagctggtttaatgt

SEQ ID NO: 4192498 - DNA, 14 bp, Homo sapiens
aaagcttaaaactt

SEQ ID NO: 4192499 - DNA, 15 bp, Homo sapiens
aaagcttaaaacttt

SEQ ID NO: 4192500 - DNA, 17 bp, Homo sapiens
aaaggaagtcaccaaaa

SEQ ID NO: 4192501 - DNA, 17 bp, Homo sapiens
aaaggcaccatctaata

SEQ ID NO: 4192502 - DNA, 19 bp, Homo sapiens
aaaggctagtttattttgt

SEQ ID NO: 4192503 - DNA, 18 bp, Homo sapiens
aaagggaagttgtgcctt

SEQ ID NO: 4192504 - DNA, 23 bp, Homo sapiens
aaagggcccacagtgacttttgc

SEQ ID NO: 4192505 - DNA, 16 bp, Homo sapiens
aaaggtagagatgtgt

SEQ ID NO: 4192506 - DNA, 16 bp, Homo sapiens
aaaggtttatgaaaaa

SEQ ID NO: 4192507 - DNA, 21 bp, Homo sapiens
aaaggtttcaagacttgatac

SEQ ID NO: 4192508 - DNA, 22 bp, Homo sapiens
aaaggtttcatgtagattttag

SEQ ID NO: 4192509 - DNA, 19 bp, Homo sapiens
aaagtaagtaccactcagg

SEQ ID NO: 4192510 - DNA, 13 bp, Homo sapiens
aaagtagcaggac

SEQ ID NO: 4192511 - DNA, 20 bp, Homo sapiens
aaagtatgtaaagtatgtaa

SEQ ID NO: 4192512 - DNA, 20 bp, Homo sapiens
aaagtctgggaaattctata

SEQ ID NO: 4192513 - DNA, 15 bp, Homo sapiens
aaagtgccactcatt

SEQ ID NO: 4192514 - DNA, 22 bp, Homo sapiens
aaagtgtgagcagtgagttaca

SEQ ID NO: 4192515 - DNA, 21 bp, Homo sapiens
aaagtgttattatttggcatg

SEQ ID NO: 4192516 - DNA, 14 bp, Homo sapiens
aaagttagctgagc

SEQ ID NO: 4192517 - DNA, 18 bp, Homo sapiens
aaagttcaacatgttatt

SEQ ID NO: 4192518 - DNA, 17 bp, Homo sapiens
aaagttgataaagattt

SEQ ID NO: 4192519 - DNA, 18 bp, Homo sapiens
aaagttgataaagatttt

SEQ ID NO: 4192520 - DNA, 18 bp, Homo sapiens
aaagttgtgattccagat

SEQ ID NO: 4192521 - DNA, 12 bp, Homo sapiens
aaagtttaataa

SEQ ID NO: 4192522 - DNA, 18 bp, Homo sapiens
aaagtttacagtaaataa

SEQ ID NO: 4192523 - DNA, 11 bp, Homo sapiens
aaataaaacct

SEQ ID NO: 4192524 - DNA, 14 bp, Homo sapiens
aaataaaacctcag

SEQ ID NO: 4192525 - DNA, 12 bp, Homo sapiens
aaataaaacctt

SEQ ID NO: 4192526 - DNA, 15 bp, Homo sapiens
aaataaaacctttca

SEQ ID NO: 4192527 - DNA, 18 bp, Homo sapiens
aaataaacctggagatga

SEQ ID NO: 4192528 - DNA, 14 bp, Homo sapiens
aaataaactctaaa

SEQ ID NO: 4192529 - DNA, 17 bp, Homo sapiens
aaataaagataaccctt

SEQ ID NO: 4192530 - DNA, 15 bp, Homo sapiens
aaataaattttgaat

SEQ ID NO: 4192531 - DNA, 19 bp, Homo sapiens
aaataacaactatttttgt

SEQ ID NO: 4192532 - DNA, 16 bp, Homo sapiens
aaataagtttttgttt

SEQ ID NO: 4192533 - DNA, 13 bp, Homo sapiens
aaatacatgctaa

SEQ ID NO: 4192534 - DNA, 14 bp, Homo sapiens
aaataccacaagcc

SEQ ID NO: 4192535 - DNA, 22 bp, Homo sapiens
aaataccacaagcctgagaact

SEQ ID NO: 4192536 - DNA, 23 bp, Homo sapiens
aaatactatgaaatgaaagaact

SEQ ID NO: 4192537 - DNA, 15 bp, Homo sapiens
aaatagacagtatat

SEQ ID NO: 4192538 - DNA, 16 bp, Homo sapiens
aaatagacagtatatt

SEQ ID NO: 4192539 - DNA, 19 bp, Homo sapiens
aaatagacagtatatttat

SEQ ID NO: 4192540 - DNA, 16 bp, Homo sapiens
aaatagcaaaagaaga

SEQ ID NO: 4192541 - DNA, 17 bp, Homo sapiens
aaatagcaaaagaagaa

SEQ ID NO: 4192542 - DNA, 15 bp, Homo sapiens
aaatagcttgtatag

SEQ ID NO: 4192543 - DNA, 21 bp, Homo sapiens
aaataggcttagagaggaaaa

SEQ ID NO: 4192544 - DNA, 22 bp, Homo sapiens
aaataggtaggcctctaattga

SEQ ID NO: 4192545 - DNA, 13 bp, Homo sapiens
aaggttgtattac

SEQ ID NO: 4192546 - DNA, 13 bp, Homo sapiens
aagtaaaagcaaa

SEQ ID NO: 4192547 - DNA, 15 bp, Homo sapiens
aagtaaaagctaatt

SEQ ID NO: 4192548 - DNA, 19 bp, Homo sapiens
aagtaagaacactgagata

SEQ ID NO: 4192549 - DNA, 17 bp, Homo sapiens
aagtaaggacaaagaag

SEQ ID NO: 4192550 - DNA, 21 bp, Homo sapiens
aagtaagtaccactcaggcca

SEQ ID NO: 4192551 - DNA, 19 bp, Homo sapiens
aagtaatttgtaaaaaaga

SEQ ID NO: 4192552 - DNA, 22 bp, Homo sapiens
aagtaatttgtaaaaaagattt

SEQ ID NO: 4192553 - DNA, 23 bp, Homo sapiens
aagtaatttgtaaaaaagatttg

SEQ ID NO: 4192554 - DNA, 17 bp, Homo sapiens
aagtaccactcaggcca

SEQ ID NO: 4192555 - DNA, 15 bp, Homo sapiens
aagtagaaatcatag

SEQ ID NO: 4192556 - DNA, 13 bp, Homo sapiens
aagtagaagagga

SEQ ID NO: 4192557 - DNA, 17 bp, Homo sapiens
aagtagatagaaagcaa

SEQ ID NO: 4192558 - DNA, 23 bp, Homo sapiens
aagtaggactttcctaaatgttt

SEQ ID NO: 4192559 - DNA, 22 bp, Homo sapiens
aagtatctaactcttctggaaa

SEQ ID NO: 4192560 - DNA, 13 bp, Homo sapiens
aagtatgtaaaca

SEQ ID NO: 4192561 - DNA, 13 bp, Homo sapiens
aagtattcttcat

SEQ ID NO: 4192562 - DNA, 19 bp, Homo sapiens
aagtatttgttaatttaga

SEQ ID NO: 4192563 - DNA, 16 bp, Homo sapiens
aagtattttatttgtc

SEQ ID NO: 4192564 - DNA, 16 bp, Homo sapiens
aagtccaacctgcctg

SEQ ID NO: 4192565 - DNA, 19 bp, Homo sapiens
aagtccaacctgcctgtgc

SEQ ID NO: 4192566 - DNA, 12 bp, Homo sapiens
aagtccagagcc

SEQ ID NO: 4192567 - DNA, 17 bp, Homo sapiens
aagtccctaggagggaa

SEQ ID NO: 4192568 - DNA, 15 bp, Homo sapiens
aagtcgaattaatag

SEQ ID NO: 4192569 - DNA, 23 bp, Homo sapiens
aagtctgggaaattctatatgat

SEQ ID NO: 4192570 - DNA, 22 bp, Homo sapiens
aagtctgtgtgatgaactttct

SEQ ID NO: 4192571 - DNA, 19 bp, Homo sapiens
aagtgactaatggcatgag

SEQ ID NO: 4192572 - DNA, 18 bp, Homo sapiens
aagtgagcgattagttga

SEQ ID NO: 4192573 - DNA, 17 bp, Homo sapiens
aagtgatttttttgtcc

SEQ ID NO: 4192574 - DNA, 21 bp, Homo sapiens
aagtgccagtcttgtgtctgc

SEQ ID NO: 4192575 - DNA, 19 bp, Homo sapiens
aagtgcctagactgttact

SEQ ID NO: 4192576 - DNA, 21 bp, Homo sapiens
aagtgctgggattacagacat

SEQ ID NO: 4192577 - DNA, 15 bp, Homo sapiens
aagtggggtgcatcc

SEQ ID NO: 4192578 - DNA, 23 bp, Homo sapiens
aagtgtatatcagaaaagggaag

SEQ ID NO: 4192579 - DNA, 24 bp, Homo sapiens
aagtgtgtggaaggcagggacaga

SEQ ID NO: 4192580 - DNA, 23 bp, Homo sapiens
aagtgtgtggtcccaagttggaa

SEQ ID NO: 4192581 - DNA, 14 bp, Homo sapiens
aagttagctcagga

SEQ ID NO: 4192582 - DNA, 14 bp, Homo sapiens
aagttagctgagcg

SEQ ID NO: 4192583 - DNA, 21 bp, Homo sapiens
aagttagctgagcgtggtggc

SEQ ID NO: 4192584 - DNA, 16 bp, Homo sapiens
aagttagctttaactt

SEQ ID NO: 4192585 - DNA, 22 bp, Homo sapiens
aagttaggtcattactaaccat

SEQ ID NO: 4192586 - DNA, 12 bp, Homo sapiens
aagttattgtac

SEQ ID NO: 4192587 - DNA, 20 bp, Homo sapiens
aagttattgtacagctgttt

SEQ ID NO: 4192588 - DNA, 17 bp, Homo sapiens
aagttatttagaaatat

SEQ ID NO: 4192589 - DNA, 23 bp, Homo sapiens
aagttcaatgttcagttttcctt

SEQ ID NO: 4192590 - DNA, 13 bp, Homo sapiens
aagttcagccaga

SEQ ID NO: 4192591 - DNA, 14 bp, Homo sapiens
aagttcctctagtg

SEQ ID NO: 4192592 - DNA, 17 bp, Homo sapiens
aagttctagagaagagg

SEQ ID NO: 4192593 - DNA, 18 bp, Homo sapiens
aagttgggaaaagtgtta

SEQ ID NO: 4192594 - DNA, 15 bp, Homo sapiens
aagttgtctggcttt

SEQ ID NO: 4192595 - DNA, 18 bp, Homo sapiens
aagttgtgccttttatag

SEQ ID NO: 4192596 - DNA, 19 bp, Homo sapiens
aagttgtgccttttatagc

SEQ ID NO: 4192597 - DNA, 16 bp, Homo sapiens
aagtttaaaaatatta

SEQ ID NO: 4192598 - DNA, 19 bp, Homo sapiens
aagtttacagtaaataaat

SEQ ID NO: 4192599 - DNA, 16 bp, Homo sapiens
aagtttatgtctaaag

SEQ ID NO: 4192600 - DNA, 17 bp, Homo sapiens
aagtttatgtctaaaga

SEQ ID NO: 4192601 - DNA, 22 bp, Homo sapiens
aagtttcaggagattgttaatt

SEQ ID NO: 4192602 - DNA, 21 bp, Homo sapiens
aagtttgcactatctttcagc

SEQ ID NO: 4192603 - DNA, 14 bp, Homo sapiens
aataaaattgtaaa

SEQ ID NO: 4192604 - DNA, 19 bp, Homo sapiens
aataaacatagcttgtaac

SEQ ID NO: 4192605 - DNA, 14 bp, Homo sapiens
aataaaccattttt

SEQ ID NO: 4192606 - DNA, 14 bp, Homo sapiens
aataaacctggaga

SEQ ID NO: 4192607 - DNA, 19 bp, Homo sapiens
aataaacctggagatgatg

SEQ ID NO: 4192608 - DNA, 17 bp, Homo sapiens
aataaacttagaataaa

SEQ ID NO: 4192609 - DNA, 22 bp, Homo sapiens
aataaacttagaataaaattgt

SEQ ID NO: 4192610 - DNA, 14 bp, Homo sapiens
aataaaggtcacat

SEQ ID NO: 4192611 - DNA, 15 bp, Homo sapiens
aataaatattgactt

SEQ ID NO: 4192612 - DNA, 17 bp, Homo sapiens
aataaatgttcaaactg

SEQ ID NO: 4192613 - DNA, 13 bp, Homo sapiens
aataacatttgtg

SEQ ID NO: 4192614 - DNA, 20 bp, Homo sapiens
aataagccaagggctaggct

SEQ ID NO: 4192615 - DNA, 15 bp, Homo sapiens
aataaggtacaagaa

SEQ ID NO: 4192616 - DNA, 19 bp, Homo sapiens
aataaggtacaagaagcat

SEQ ID NO: 4192617 - DNA, 12 bp, Homo sapiens
aataataatgaa

SEQ ID NO: 4192618 - DNA, 14 bp, Homo sapiens
aataatatttcaag

SEQ ID NO: 4192619 - DNA, 20 bp, Homo sapiens
aataattttaaaagttggga

SEQ ID NO: 4192620 - DNA, 16 bp, Homo sapiens
aatacaacaagaacaa

SEQ ID NO: 4192621 - DNA, 14 bp, Homo sapiens
aatacacaaatttc

SEQ ID NO: 4192622 - DNA, 20 bp, Homo sapiens
aatacactaattcctttcta

SEQ ID NO: 4192623 - DNA, 16 bp, Homo sapiens
aatacagtggatctca

SEQ ID NO: 4192624 - DNA, 13 bp, Homo sapiens
aatacatcaaaaa

SEQ ID NO: 4192625 - DNA, 17 bp, Homo sapiens
aataccaagactaagca

SEQ ID NO: 4192626 - DNA, 20 bp, Homo sapiens
aatactaatgtaaagattgt

SEQ ID NO: 4192627 - DNA, 21 bp, Homo sapiens
aatactgctgagatacataca

SEQ ID NO: 4192628 - DNA, 19 bp, Homo sapiens
aatagaaaactgaaaatct

SEQ ID NO: 4192629 - DNA, 17 bp, Homo sapiens
aatagaaattttgttaa

SEQ ID NO: 4192630 - DNA, 15 bp, Homo sapiens
aatagacagtatatt

SEQ ID NO: 4192631 - DNA, 19 bp, Homo sapiens
aatagcttgtatagtgtaa

SEQ ID NO: 4192632 - DNA, 21 bp, Homo sapiens
aatagcttttcatcaattctt

SEQ ID NO: 4192633 - DNA, 21 bp, Homo sapiens
aataggatgataggaaataaa

SEQ ID NO: 4192634 - DNA, 18 bp, Homo sapiens
aataggcttagagaggaa

SEQ ID NO: 4192635 - DNA, 19 bp, Homo sapiens
aataggcttagagaggaaa

SEQ ID NO: 4192636 - DNA, 20 bp, Homo sapiens
aataggcttagagaggaaaa

SEQ ID NO: 4192637 - DNA, 21 bp, Homo sapiens
aataggcttagagaggaaaag

SEQ ID NO: 4192638 - DNA, 18 bp, Homo sapiens
aataggctttagaagaga

SEQ ID NO: 4192639 - DNA, 22 bp, Homo sapiens
aatagtaaaagataacaagatc

SEQ ID NO: 4192640 - DNA, 16 bp, Homo sapiens
aatagtatttcccatt

SEQ ID NO: 4192641 - DNA, 14 bp, Homo sapiens
aatagtttggatat

SEQ ID NO: 4192642 - DNA, 15 bp, Homo sapiens
aatataaaaatgtga

SEQ ID NO: 4192643 - DNA, 17 bp, Homo sapiens
aatataaaaatgtgaat

SEQ ID NO: 4192644 - DNA, 18 bp, Homo sapiens
aatataaaaatgtgaatc

SEQ ID NO: 4192645 - DNA, 16 bp, Homo sapiens
aatatatcccagaaat

SEQ ID NO: 4192646 - DNA, 22 bp, Homo sapiens
aatatatcccagaaattagaaa

SEQ ID NO: 4192647 - DNA, 21 bp, Homo sapiens
aatatattgctgctggtaatt

SEQ ID NO: 4192648 - DNA, 12 bp, Homo sapiens
aatatatttatg

SEQ ID NO: 4192649 - DNA, 16 bp, Homo sapiens
aatatcctaaacatca

SEQ ID NO: 4192650 - DNA, 16 bp, Homo sapiens
aatatcctttggaaca

SEQ ID NO: 4192651 - DNA, 22 bp, Homo sapiens
aatatcctttggaacaattatt

SEQ ID NO: 4192652 - DNA, 17 bp, Homo sapiens
aatatgactcaggagcc

SEQ ID NO: 4192653 - DNA, 16 bp, Homo sapiens
aatatgatgttaaaaa

SEQ ID NO: 4192654 - DNA, 14 bp, Homo sapiens
aatatggaacttct

SEQ ID NO: 4192655 - DNA, 20 bp, Homo sapiens
aatatggaacttctaatata

SEQ ID NO: 4192656 - DNA, 14 bp, Homo sapiens
aatattaccaaaaa

SEQ ID NO: 4192657 - DNA, 15 bp, Homo sapiens
aatatttactcatca

SEQ ID NO: 4192658 - DNA, 15 bp, Homo sapiens
aatatttaggcaaga

SEQ ID NO: 4192659 - DNA, 18 bp, Homo sapiens
aatatttcaagtgcctag

SEQ ID NO: 4192660 - DNA, 15 bp, Homo sapiens
aatattttaaagaat

SEQ ID NO: 4192661 - DNA, 16 bp, Homo sapiens
aatattttaaagaatt

SEQ ID NO: 4192662 - DNA, 23 bp, Homo sapiens
aatatttttgaaaggcatgttcc

SEQ ID NO: 4192663 - DNA, 16 bp, Homo sapiens
aatcaaagaaaacata

SEQ ID NO: 4192664 - DNA, 18 bp, Homo sapiens
aatcaacttgcttatcaa

SEQ ID NO: 4192665 - DNA, 18 bp, Homo sapiens
aatcaagaatattcaaat

SEQ ID NO: 4192666 - DNA, 12 bp, Homo sapiens
aatcaataaaaa

SEQ ID NO: 4192667 - DNA, 14 bp, Homo sapiens
aatcacgctttttg

SEQ ID NO: 4192668 - DNA, 16 bp, Homo sapiens
aatcacgctttttgaa

SEQ ID NO: 4192669 - DNA, 18 bp, Homo sapiens
aatcacgctttttgaaaa

SEQ ID NO: 4192670 - DNA, 17 bp, Homo sapiens
aatcactgtattttcat

SEQ ID NO: 4192671 - DNA, 22 bp, Homo sapiens
aatcagaagctataagagaact

SEQ ID NO: 4192672 - DNA, 11 bp, Homo sapiens
aatcagagaat

SEQ ID NO: 4192673 - DNA, 16 bp, Homo sapiens
aatcagatagatattc

SEQ ID NO: 4192674 - DNA, 22 bp, Homo sapiens
aatcagcatcgtgggcactgct

SEQ ID NO: 4192675 - DNA, 16 bp, Homo sapiens
aatcagcctcttaaag

SEQ ID NO: 4192676 - DNA, 16 bp, Homo sapiens
aatcaggtggcttttg

SEQ ID NO: 4192677 - DNA, 19 bp, Homo sapiens
aatcaggttgacagtccct

SEQ ID NO: 4192678 - DNA, 17 bp, Homo sapiens
aatcagtctcagaatgt

SEQ ID NO: 4192679 - DNA, 18 bp, Homo sapiens
accacagcaattggctcc

SEQ ID NO: 4192680 - DNA, 23 bp, Homo sapiens
accacatccacacacgcaggaac

SEQ ID NO: 4192681 - DNA, 14 bp, Homo sapiens
accaccttccctct

SEQ ID NO: 4192682 - DNA, 17 bp, Homo sapiens
accaccttggactcctc

SEQ ID NO: 4192683 - DNA, 16 bp, Homo sapiens
accactcctcaggaac

SEQ ID NO: 4192684 - DNA, 20 bp, Homo sapiens
accactgcactccagcctgg

SEQ ID NO: 4192685 - DNA, 18 bp, Homo sapiens
accagacccacctggagc

SEQ ID NO: 4192686 - DNA, 23 bp, Homo sapiens
accagacccacctggagcccgct

SEQ ID NO: 4192687 - DNA, 17 bp, Homo sapiens
accagagccttcaagtg

SEQ ID NO: 4192688 - DNA, 18 bp, Homo sapiens
accagagccttcaagtgc

SEQ ID NO: 4192689 - DNA, 20 bp, Homo sapiens
accagatagttatattaaat

SEQ ID NO: 4192690 - DNA, 22 bp, Homo sapiens
accagccgtgagcatgtttgga

SEQ ID NO: 4192691 - DNA, 18 bp, Homo sapiens
accagctttttctctcag

SEQ ID NO: 4192692 - DNA, 20 bp, Homo sapiens
accaggactatagcccaggt

SEQ ID NO: 4192693 - DNA, 23 bp, Homo sapiens
accaggagggtaacagaagagga

SEQ ID NO: 4192694 - DNA, 14 bp, Homo sapiens
accaggatggccct

SEQ ID NO: 4192695 - DNA, 20 bp, Homo sapiens
accaggcaccaaaagaagta

SEQ ID NO: 4192696 - DNA, 22 bp, Homo sapiens
accaggggtgctatgacatgca

SEQ ID NO: 4192697 - DNA, 13 bp, Homo sapiens
accagtgtagcct

SEQ ID NO: 4192698 - DNA, 21 bp, Homo sapiens
accagtgtagccttgcccgga

SEQ ID NO: 4192699 - DNA, 19 bp, Homo sapiens
accagttaagaatggaaga

SEQ ID NO: 4192700 - DNA, 20 bp, Homo sapiens
accagttaagaatggaagaa

SEQ ID NO: 4192701 - DNA, 22 bp, Homo sapiens
accataaactgtacaaatgaaa

SEQ ID NO: 4192702 - DNA, 19 bp, Homo sapiens
accatattcagtgctgtgg

SEQ ID NO: 4192703 - DNA, 14 bp, Homo sapiens
accatcacacatgc

SEQ ID NO: 4192704 - DNA, 20 bp, Homo sapiens
accatcgtgtttgcaaaggt

SEQ ID NO: 4192705 - DNA, 14 bp, Homo sapiens
accatgctggcggc

SEQ ID NO: 4192706 - DNA, 20 bp, Homo sapiens
accatgctggcggcgcagag

SEQ ID NO: 4192707 - DNA, 16 bp, Homo sapiens
accatggagacaagaa

SEQ ID NO: 4192708 - DNA, 14 bp, Homo sapiens
accattaatgaaaa

SEQ ID NO: 4192709 - DNA, 21 bp, Homo sapiens
acccaactttctcactgctgt

SEQ ID NO: 4192710 - DNA, 15 bp, Homo sapiens
acccaatgctcctgg

SEQ ID NO: 4192711 - DNA, 21 bp, Homo sapiens
acccaatttaattccataatc

SEQ ID NO: 4192712 - DNA, 12 bp, Homo sapiens
acccacacatgt

SEQ ID NO: 4192713 - DNA, 14 bp, Homo sapiens
acccacctggagcc

SEQ ID NO: 4192714 - DNA, 17 bp, Homo sapiens
acccacctggagcccgc

SEQ ID NO: 4192715 - DNA, 23 bp, Homo sapiens
acccagagcattacgtgagccag

SEQ ID NO: 4192716 - DNA, 24 bp, Homo sapiens
acccagagcattacgtgagccagg

SEQ ID NO: 4192717 - DNA, 17 bp, Homo sapiens
acccagagtcaggaaga

SEQ ID NO: 4192718 - DNA, 19 bp, Homo sapiens
acccagagtcaggaagaga

SEQ ID NO: 4192719 - DNA, 15 bp, Homo sapiens
acccagcaacacaga

SEQ ID NO: 4192720 - DNA, 12 bp, Homo sapiens
acccagctcctc

SEQ ID NO: 4192721 - DNA, 18 bp, Homo sapiens
acccagctcctctgagcc

SEQ ID NO: 4192722 - DNA, 19 bp, Homo sapiens
acccagctcctctgagcca

SEQ ID NO: 4192723 - DNA, 22 bp, Homo sapiens
acccagctctcagggctgtctt

SEQ ID NO: 4192724 - DNA, 23 bp, Homo sapiens
acccaggaggcggaggttgcagt

SEQ ID NO: 4192725 - DNA, 12 bp, Homo sapiens
acccaggaggct

SEQ ID NO: 4192726 - DNA, 19 bp, Homo sapiens
acccagggctccctcctgg

SEQ ID NO: 4192727 - DNA, 13 bp, Homo sapiens
acccatctgtagt

SEQ ID NO: 4192728 - DNA, 19 bp, Homo sapiens
acccatgaagacaggacag

SEQ ID NO: 4192729 - DNA, 14 bp, Homo sapiens
acccatggagaggt

SEQ ID NO: 4192730 - DNA, 19 bp, Homo sapiens
acccattaggcatgcctaa

SEQ ID NO: 4192731 - DNA, 22 bp, Homo sapiens
acccatttaatttctattgtgt

SEQ ID NO: 4192732 - DNA, 20 bp, Homo sapiens
acccattttgagtgactcga

SEQ ID NO: 4192733 - DNA, 15 bp, Homo sapiens
accccaaagagcctg

SEQ ID NO: 4192734 - DNA, 19 bp, Homo sapiens
accccaaagagcctggaga

SEQ ID NO: 4192735 - DNA, 16 bp, Homo sapiens
accccaaagccccttg

SEQ ID NO: 4192736 - DNA, 15 bp, Homo sapiens
acccccagtgccaca

SEQ ID NO: 4192737 - DNA, 16 bp, Homo sapiens
acccccagtgccacag

SEQ ID NO: 4192738 - DNA, 13 bp, Homo sapiens
accccccacctgc

SEQ ID NO: 4192739 - DNA, 17 bp, Homo sapiens
acccccgctccagatct

SEQ ID NO: 4192740 - DNA, 15 bp, Homo sapiens
accccctcattcccc

SEQ ID NO: 4192741 - DNA, 16 bp, Homo sapiens
accccctcattcccct

SEQ ID NO: 4192742 - DNA, 13 bp, Homo sapiens
accccctccagct

SEQ ID NO: 4192743 - DNA, 12 bp, Homo sapiens
accccctggaga

SEQ ID NO: 4192744 - DNA, 11 bp, Homo sapiens
acccctaacct

SEQ ID NO: 4192745 - DNA, 16 bp, Homo sapiens
acccctaacctggctt

SEQ ID NO: 4192746 - DNA, 18 bp, Homo sapiens
acccctaacctggcttat

SEQ ID NO: 4192747 - DNA, 22 bp, Homo sapiens
acccctgtccagcgcggctccc

SEQ ID NO: 4192748 - DNA, 15 bp, Homo sapiens
accccttatccagga

SEQ ID NO: 4192749 - DNA, 16 bp, Homo sapiens
accccttatccaggac

SEQ ID NO: 4192750 - DNA, 17 bp, Homo sapiens
accccttatccaggact

SEQ ID NO: 4192751 - DNA, 17 bp, Homo sapiens
accccttatcctgagca

SEQ ID NO: 4192752 - DNA, 15 bp, Homo sapiens
accccttcctttcct

SEQ ID NO: 4192753 - DNA, 22 bp, Homo sapiens
accccttcctttcctctgcagc

SEQ ID NO: 4192754 - DNA, 24 bp, Homo sapiens
accccttcctttcctctgcagcac

SEQ ID NO: 4192755 - DNA, 17 bp, Homo sapiens
acccctttcccccaccc

SEQ ID NO: 4192756 - DNA, 22 bp, Homo sapiens
acccctttcccccaccccagag

SEQ ID NO: 4192757 - DNA, 20 bp, Homo sapiens
accctccaccgcagaaggaa

SEQ ID NO: 4192758 - DNA, 20 bp, Homo sapiens
accctccagtgctggatttg

SEQ ID NO: 4192759 - DNA, 17 bp, Homo sapiens
accctcgtggacacctg

SEQ ID NO: 4192760 - DNA, 19 bp, Homo sapiens
accctcgtggacacctgcc

SEQ ID NO: 4192761 - DNA, 23 bp, Homo sapiens
accctcgtggacacctgccctgc

SEQ ID NO: 4192762 - DNA, 14 bp, Homo sapiens
accctctacctgga

SEQ ID NO: 4192763 - DNA, 14 bp, Homo sapiens
accctctcttccct

SEQ ID NO: 4192764 - DNA, 20 bp, Homo sapiens
accctgcccagtctggaaga

SEQ ID NO: 4192765 - DNA, 18 bp, Homo sapiens
accctgcgaaggggccct

SEQ ID NO: 4192766 - DNA, 13 bp, Homo sapiens
acccttggacttg

SEQ ID NO: 4192767 - DNA, 15 bp, Homo sapiens
acccttggacttgag

SEQ ID NO: 4192768 - DNA, 17 bp, Homo sapiens
accgaccatcgtccagc

SEQ ID NO: 4192769 - DNA, 21 bp, Homo sapiens
accgagacggctggacctgca

SEQ ID NO: 4192770 - DNA, 12 bp, Homo sapiens
accgcagaagga

SEQ ID NO: 4192771 - DNA, 23 bp, Homo sapiens
accgcagccagccggtgcctggc

SEQ ID NO: 4192772 - DNA, 16 bp, Homo sapiens
accgctaaaagaaact

SEQ ID NO: 4192773 - DNA, 22 bp, Homo sapiens
accgctgccttttgctgctgct

SEQ ID NO: 4192774 - DNA, 12 bp, Homo sapiens
accggcagaaaa

SEQ ID NO: 4192775 - DNA, 16 bp, Homo sapiens
acctaatcaggctgag

SEQ ID NO: 4192776 - DNA, 15 bp, Homo sapiens
acctacctgttgagc

SEQ ID NO: 4192777 - DNA, 24 bp, Homo sapiens
acctacctgttgagcatcacagaa

SEQ ID NO: 4192778 - DNA, 19 bp, Homo sapiens
acctactgcccaggcactg

SEQ ID NO: 4192779 - DNA, 23 bp, Homo sapiens
acctaggcccattgctgacgatt

SEQ ID NO: 4192780 - DNA, 16 bp, Homo sapiens
acctatagtcccagct

SEQ ID NO: 4192781 - DNA, 13 bp, Homo sapiens
acctatatgattt

SEQ ID NO: 4192782 - DNA, 17 bp, Homo sapiens
acctattacattttact

SEQ ID NO: 4192783 - DNA, 20 bp, Homo sapiens
acctcactattcaagtatta

SEQ ID NO: 4192784 - DNA, 15 bp, Homo sapiens
acctcagcctagacc

SEQ ID NO: 4192785 - DNA, 21 bp, Homo sapiens
acctcaggccaggtgcagtgg

SEQ ID NO: 4192786 - DNA, 18 bp, Homo sapiens
acctcaggcttccttggc

SEQ ID NO: 4192787 - DNA, 20 bp, Homo sapiens
acctcatctacaagcatttg

SEQ ID NO: 4192788 - DNA, 19 bp, Homo sapiens
acctcatggtcatggacag

SEQ ID NO: 4192789 - DNA, 23 bp, Homo sapiens
acctcatggtcatggacagatag

SEQ ID NO: 4192790 - DNA, 22 bp, Homo sapiens
acctccacccactgtccgcctc

SEQ ID NO: 4192791 - DNA, 19 bp, Homo sapiens
acctccattggcttcctca

SEQ ID NO: 4192792 - DNA, 20 bp, Homo sapiens
acctccccggcctctctctt

SEQ ID NO: 4192793 - DNA, 16 bp, Homo sapiens
acctcccctggtcctg

SEQ ID NO: 4192794 - DNA, 18 bp, Homo sapiens
acctcccctggtcctgca

SEQ ID NO: 4192795 - DNA, 17 bp, Homo sapiens
acctcctatccttggag

SEQ ID NO: 4192796 - DNA, 21 bp, Homo sapiens
acctctctaagttatgtacgt

SEQ ID NO: 4192797 - DNA, 20 bp, Homo sapiens
acctctctctaagtttagaa

SEQ ID NO: 4192798 - DNA, 14 bp, Homo sapiens
acctctgagaagac

SEQ ID NO: 4192799 - DNA, 21 bp, Homo sapiens
acctgaaaaaaagtttacaag

SEQ ID NO: 4192800 - DNA, 13 bp, Homo sapiens
acctgaaccactg

SEQ ID NO: 4192801 - DNA, 16 bp, Homo sapiens
acctgaaccactgtgg

SEQ ID NO: 4192802 - DNA, 19 bp, Homo sapiens
acctgaaccactgtggcct

SEQ ID NO: 4192803 - DNA, 13 bp, Homo sapiens
acctgacaaatgg

SEQ ID NO: 4192804 - DNA, 21 bp, Homo sapiens
acctgatggcacttagctatc

SEQ ID NO: 4192805 - DNA, 16 bp, Homo sapiens
acctgcacgccaccgc

SEQ ID NO: 4192806 - DNA, 15 bp, Homo sapiens
acctgcagtcagggc

SEQ ID NO: 4192807 - DNA, 18 bp, Homo sapiens
acctgccagcctggcttc

SEQ ID NO: 4192808 - DNA, 15 bp, Homo sapiens
acctgccatttgcac

SEQ ID NO: 4192809 - DNA, 23 bp, Homo sapiens
acctgccccgcccagctgcacct

SEQ ID NO: 4192810 - DNA, 13 bp, Homo sapiens
acctgccctgccc

SEQ ID NO: 4192811 - DNA, 20 bp, Homo sapiens
acctgccctgccctgccacc

SEQ ID NO: 4192812 - DNA, 17 bp, Homo sapiens
acctgcctatccatcct

SEQ ID NO: 4192813 - DNA, 19 bp, Homo sapiens
actttagagtagcatgaga

SEQ ID NO: 4192814 - DNA, 14 bp, Homo sapiens
actttataaaagca

SEQ ID NO: 4192815 - DNA, 13 bp, Homo sapiens
actttcctacaaa

SEQ ID NO: 4192816 - DNA, 17 bp, Homo sapiens
actttctcactgctgtc

SEQ ID NO: 4192817 - DNA, 19 bp, Homo sapiens
actttctcttcatactttt

SEQ ID NO: 4192818 - DNA, 22 bp, Homo sapiens
actttctttctcactaaatctt

SEQ ID NO: 4192819 - DNA, 17 bp, Homo sapiens
actttgaagttagcttt

SEQ ID NO: 4192820 - DNA, 15 bp, Homo sapiens
actttgatctctgct

SEQ ID NO: 4192821 - DNA, 20 bp, Homo sapiens
actttgcaatccaaataaag

SEQ ID NO: 4192822 - DNA, 20 bp, Homo sapiens
actttgcctcttcagcagca

SEQ ID NO: 4192823 - DNA, 14 bp, Homo sapiens
actttgggaggcca

SEQ ID NO: 4192824 - DNA, 19 bp, Homo sapiens
actttgggaggccaaggtg

SEQ ID NO: 4192825 - DNA, 20 bp, Homo sapiens
actttgggaggccaaggtgg

SEQ ID NO: 4192826 - DNA, 17 bp, Homo sapiens
actttgtgccagcgctg

SEQ ID NO: 4192827 - DNA, 17 bp, Homo sapiens
actttgtggtaacttct

SEQ ID NO: 4192828 - DNA, 17 bp, Homo sapiens
actttgttaaaaatatt

SEQ ID NO: 4192829 - DNA, 17 bp, Homo sapiens
acttttccatgtatcta

SEQ ID NO: 4192830 - DNA, 22 bp, Homo sapiens
acttttccttaattttaatcca

SEQ ID NO: 4192831 - DNA, 22 bp, Homo sapiens
acttttgggaggtccaggcagg

SEQ ID NO: 4192832 - DNA, 18 bp, Homo sapiens
acttttgttctgtatttt

SEQ ID NO: 4192833 - DNA, 18 bp, Homo sapiens
actttttacccaaatatg

SEQ ID NO: 4192834 - DNA, 21 bp, Homo sapiens
acttttttttttttttttaaa

SEQ ID NO: 4192835 - DNA, 16 bp, Homo sapiens
agaaaaacatttcctc

SEQ ID NO: 4192836 - DNA, 14 bp, Homo sapiens
agaaaaagaagcaa

SEQ ID NO: 4192837 - DNA, 20 bp, Homo sapiens
agaaaacggagagtgcttgg

SEQ ID NO: 4192838 - DNA, 23 bp, Homo sapiens
agaaaagggaagttgtgcctttt

SEQ ID NO: 4192839 - DNA, 23 bp, Homo sapiens
agaaaatggggcttgccctgggt

SEQ ID NO: 4192840 - DNA, 18 bp, Homo sapiens
agaaacgtgataaatata

SEQ ID NO: 4192841 - DNA, 20 bp, Homo sapiens
agaaactcacgatgaaattg

SEQ ID NO: 4192842 - DNA, 20 bp, Homo sapiens
agaaagaacggaagaagaga

SEQ ID NO: 4192843 - DNA, 12 bp, Homo sapiens
agaaagaagaga

SEQ ID NO: 4192844 - DNA, 21 bp, Homo sapiens
agaaagacatcacatccctct

SEQ ID NO: 4192845 - DNA, 12 bp, Homo sapiens
agaaagcaataa

SEQ ID NO: 4192846 - DNA, 17 bp, Homo sapiens
agaaagcacctgttttt

SEQ ID NO: 4192847 - DNA, 16 bp, Homo sapiens
agaaagcactactgca

SEQ ID NO: 4192848 - DNA, 19 bp, Homo sapiens
agaaagctggtaaactatt

SEQ ID NO: 4192849 - DNA, 16 bp, Homo sapiens
agaaagtgcagaatca

SEQ ID NO: 4192850 - DNA, 14 bp, Homo sapiens
agaaataagttttt

SEQ ID NO: 4192851 - DNA, 16 bp, Homo sapiens
agaaataagtttttgt

SEQ ID NO: 4192852 - DNA, 13 bp, Homo sapiens
agaaatacttttc

SEQ ID NO: 4192853 - DNA, 16 bp, Homo sapiens
agaaataggaagatta

SEQ ID NO: 4192854 - DNA, 14 bp, Homo sapiens
agaaatcacttaaa

SEQ ID NO: 4192855 - DNA, 17 bp, Homo sapiens
agaaatcattttgcaat

SEQ ID NO: 4192856 - DNA, 22 bp, Homo sapiens
agaaatcattttgcaatccctt

SEQ ID NO: 4192857 - DNA, 11 bp, Homo sapiens
agaaatgccaa

SEQ ID NO: 4192858 - DNA, 14 bp, Homo sapiens
agaaatgccaagca

SEQ ID NO: 4192859 - DNA, 17 bp, Homo sapiens
agaaattagaaacctta

SEQ ID NO: 4192860 - DNA, 17 bp, Homo sapiens
agaaattatttaataaa

SEQ ID NO: 4192861 - DNA, 13 bp, Homo sapiens
agaaattctgtgg

SEQ ID NO: 4192862 - DNA, 22 bp, Homo sapiens
agaaattcttttcaaaagctga

SEQ ID NO: 4192863 - DNA, 16 bp, Homo sapiens
agaaatttgatttcta

SEQ ID NO: 4192864 - DNA, 14 bp, Homo sapiens
agaaattttttcat

SEQ ID NO: 4192865 - DNA, 14 bp, Homo sapiens
agaacacgctttca

SEQ ID NO: 4192866 - DNA, 19 bp, Homo sapiens
agaacatagacagaagaaa

SEQ ID NO: 4192867 - DNA, 17 bp, Homo sapiens
agaacatccctgggcaa

SEQ ID NO: 4192868 - DNA, 20 bp, Homo sapiens
agaaccaaaagttttcctga

SEQ ID NO: 4192869 - DNA, 15 bp, Homo sapiens
agaaccacttggctg

SEQ ID NO: 4192870 - DNA, 12 bp, Homo sapiens
agaaccaggagg

SEQ ID NO: 4192871 - DNA, 12 bp, Homo sapiens
agaacctcaggc

SEQ ID NO: 4192872 - DNA, 21 bp, Homo sapiens
agaacctgggttgcagacagg

SEQ ID NO: 4192873 - DNA, 12 bp, Homo sapiens
agaacggaagaa

SEQ ID NO: 4192874 - DNA, 19 bp, Homo sapiens
agaactgaggtcactgggt

SEQ ID NO: 4192875 - DNA, 21 bp, Homo sapiens
agaactttcggagcctgcctc

SEQ ID NO: 4192876 - DNA, 15 bp, Homo sapiens
agaactttgagctac

SEQ ID NO: 4192877 - DNA, 13 bp, Homo sapiens
agaagaaagcaaa

SEQ ID NO: 4192878 - DNA, 22 bp, Homo sapiens
agaagaaagcaaaagcaaggga

SEQ ID NO: 4192879 - DNA, 15 bp, Homo sapiens
agaagacaattgaca

SEQ ID NO: 4192880 - DNA, 21 bp, Homo sapiens
agaagaccacaaaaattgact

SEQ ID NO: 4192881 - DNA, 13 bp, Homo sapiens
agaagaggaggga

SEQ ID NO: 4192882 - DNA, 22 bp, Homo sapiens
agaagaggctggtgctgtggcc

SEQ ID NO: 4192883 - DNA, 15 bp, Homo sapiens
agaagatagggaaca

SEQ ID NO: 4192884 - DNA, 14 bp, Homo sapiens
agaagcaagctgga

SEQ ID NO: 4192885 - DNA, 19 bp, Homo sapiens
agaagcaagctggatgcag

SEQ ID NO: 4192886 - DNA, 16 bp, Homo sapiens
agaagcaggcagggca

SEQ ID NO: 4192887 - DNA, 20 bp, Homo sapiens
agaagccatgtactcaagta

SEQ ID NO: 4192888 - DNA, 19 bp, Homo sapiens
agaagccctgctgggccca

SEQ ID NO: 4192889 - DNA, 16 bp, Homo sapiens
agaagctataagagaa

SEQ ID NO: 4192890 - DNA, 17 bp, Homo sapiens
agaaggaaggcagggag

SEQ ID NO: 4192891 - DNA, 19 bp, Homo sapiens
agaaggatagcctcagcca

SEQ ID NO: 4192892 - DNA, 22 bp, Homo sapiens
agaaggcctcactcaagcctga

SEQ ID NO: 4192893 - DNA, 13 bp, Homo sapiens
agaagggagaagg

SEQ ID NO: 4192894 - DNA, 14 bp, Homo sapiens
agaagggagaagga

SEQ ID NO: 4192895 - DNA, 20 bp, Homo sapiens
agaagggttttccaccctgg

SEQ ID NO: 4192896 - DNA, 21 bp, Homo sapiens
agaaggtattccttttgtgta

SEQ ID NO: 4192897 - DNA, 22 bp, Homo sapiens
agaagtaaaagcaaaaaagaaa

SEQ ID NO: 4192898 - DNA, 19 bp, Homo sapiens
agaagtaatatgctctcat

SEQ ID NO: 4192899 - DNA, 20 bp, Homo sapiens
agaagtaatatgctctcatt

SEQ ID NO: 4192900 - DNA, 14 bp, Homo sapiens
agaagtaggaagga

SEQ ID NO: 4192901 - DNA, 21 bp, Homo sapiens
agaagtaggaaggaaaaaata

SEQ ID NO: 4192902 - DNA, 18 bp, Homo sapiens
agaagtccctaggaggga

SEQ ID NO: 4192903 - DNA, 23 bp, Homo sapiens
agaagtttcatcattttttactt

SEQ ID NO: 4192904 - DNA, 16 bp, Homo sapiens
agaagtttctggccct

SEQ ID NO: 4192905 - DNA, 13 bp, Homo sapiens
agaagtttgcact

SEQ ID NO: 4192906 - DNA, 16 bp, Homo sapiens
agaagtttgcactatc

SEQ ID NO: 4192907 - DNA, 21 bp, Homo sapiens
agaagtttgcactatctttca

SEQ ID NO: 4192908 - DNA, 23 bp, Homo sapiens
agaagtttgcactatctttcagc

SEQ ID NO: 4192909 - DNA, 16 bp, Homo sapiens
agaagttttgtacaga

SEQ ID NO: 4192910 - DNA, 12 bp, Homo sapiens
agaataaaattg

SEQ ID NO: 4192911 - DNA, 14 bp, Homo sapiens
agaataaaattgta

SEQ ID NO: 4192912 - DNA, 19 bp, Homo sapiens
agaatacttctcatttttt

SEQ ID NO: 4192913 - DNA, 14 bp, Homo sapiens
agaatagtgtctga

SEQ ID NO: 4192914 - DNA, 14 bp, Homo sapiens
agaatattcaaatg

SEQ ID NO: 4192915 - DNA, 16 bp, Homo sapiens
agaatccctgcagcct

SEQ ID NO: 4192916 - DNA, 17 bp, Homo sapiens
agaatccctgcagcctg

SEQ ID NO: 4192917 - DNA, 15 bp, Homo sapiens
agaatctctcctctc

SEQ ID NO: 4192918 - DNA, 20 bp, Homo sapiens
agaatgatatccagtaagca

SEQ ID NO: 4192919 - DNA, 16 bp, Homo sapiens
agaatgatttttagat

SEQ ID NO: 4192920 - DNA, 23 bp, Homo sapiens
agaatgtcattttggtactttgg

SEQ ID NO: 4192921 - DNA, 18 bp, Homo sapiens
agaatgtgttttctgaat

SEQ ID NO: 4192922 - DNA, 20 bp, Homo sapiens
agaattactgtaactgatta

SEQ ID NO: 4192923 - DNA, 22 bp, Homo sapiens
agaattatataggttgtgcaaa

SEQ ID NO: 4192924 - DNA, 20 bp, Homo sapiens
agaattatttttgagcagga

SEQ ID NO: 4192925 - DNA, 22 bp, Homo sapiens
agaattatttttgagcaggagc

SEQ ID NO: 4192926 - DNA, 18 bp, Homo sapiens
agaattcacaccttaggt

SEQ ID NO: 4192927 - DNA, 13 bp, Homo sapiens
agaattccaagga

SEQ ID NO: 4192928 - DNA, 15 bp, Homo sapiens
agaattctagaaaat

SEQ ID NO: 4192929 - DNA, 12 bp, Homo sapiens
agaattggcctc

SEQ ID NO: 4192930 - DNA, 19 bp, Homo sapiens
agaattgtccatgtgcttc

SEQ ID NO: 4192931 - DNA, 15 bp, Homo sapiens
agaatttgtattttg

SEQ ID NO: 4192932 - DNA, 16 bp, Homo sapiens
agaatttgtattttgc

SEQ ID NO: 4192933 - DNA, 17 bp, Homo sapiens
agacaactcttccattt

SEQ ID NO: 4192934 - DNA, 20 bp, Homo sapiens
agacaactcttccatttatt

SEQ ID NO: 4192935 - DNA, 22 bp, Homo sapiens
agacacaaggtgatttcagact

SEQ ID NO: 4192936 - DNA, 16 bp, Homo sapiens
agacacgctcttctat

SEQ ID NO: 4192937 - DNA, 22 bp, Homo sapiens
agacactagttcagaggaagca

SEQ ID NO: 4192938 - DNA, 20 bp, Homo sapiens
agacactgggagaagagaac

SEQ ID NO: 4192939 - DNA, 16 bp, Homo sapiens
agacagaagaaacaag

SEQ ID NO: 4192940 - DNA, 17 bp, Homo sapiens
agacagaagaaacaagg

SEQ ID NO: 4192941 - DNA, 19 bp, Homo sapiens
agacagaccccttggcttt

SEQ ID NO: 4192942 - DNA, 14 bp, Homo sapiens
agacagccctgcct

SEQ ID NO: 4192943 - DNA, 21 bp, Homo sapiens
agacagccctgcctatcctct

SEQ ID NO: 4192944 - DNA, 14 bp, Homo sapiens
agacaggagggcaa

SEQ ID NO: 4192945 - DNA, 15 bp, Homo sapiens
agacaggctgagctt

SEQ ID NO: 4192946 - DNA, 15 bp, Homo sapiens
agacaggtctagact

SEQ ID NO: 4192947 - DNA, 18 bp, Homo sapiens
agacagtatatttatagt

SEQ ID NO: 4192948 - DNA, 17 bp, Homo sapiens
agcagatggaaagaaag

SEQ ID NO: 4192949 - DNA, 12 bp, Homo sapiens
agcagcccagca

SEQ ID NO: 4192950 - DNA, 16 bp, Homo sapiens
agcagcccagcacaac

SEQ ID NO: 4192951 - DNA, 18 bp, Homo sapiens
agcagctgaacagccaaa

SEQ ID NO: 4192952 - DNA, 15 bp, Homo sapiens
agcaggagcagaaag

SEQ ID NO: 4192953 - DNA, 18 bp, Homo sapiens
agcaggccacgctcaggc

SEQ ID NO: 4192954 - DNA, 23 bp, Homo sapiens
agcagggctctgccccagaggcc

SEQ ID NO: 4192955 - DNA, 17 bp, Homo sapiens
agcaggggccagatgat

SEQ ID NO: 4192956 - DNA, 22 bp, Homo sapiens
agcaggggtccttggtgtgacc

SEQ ID NO: 4192957 - DNA, 16 bp, Homo sapiens
agcagggtcttgctgt

SEQ ID NO: 4192958 - DNA, 18 bp, Homo sapiens
agcaggtggtcctgagac

SEQ ID NO: 4192959 - DNA, 20 bp, Homo sapiens
agcaggttgaggggctcctg

SEQ ID NO: 4192960 - DNA, 15 bp, Homo sapiens
agcagtccaaagaac

SEQ ID NO: 4192961 - DNA, 17 bp, Homo sapiens
agcagtgagcttctatt

SEQ ID NO: 4192962 - DNA, 13 bp, Homo sapiens
agcatcacagaat

SEQ ID NO: 4192963 - DNA, 17 bp, Homo sapiens
agcatccccttgaactc

SEQ ID NO: 4192964 - DNA, 21 bp, Homo sapiens
agcatccttttctgcagaggg

SEQ ID NO: 4192965 - DNA, 17 bp, Homo sapiens
agcattacgtgagccag

SEQ ID NO: 4192966 - DNA, 17 bp, Homo sapiens
agcatttgccattcctg

SEQ ID NO: 4192967 - DNA, 17 bp, Homo sapiens
agcattttgtaagttga

SEQ ID NO: 4192968 - DNA, 21 bp, Homo sapiens
agccaaacatatatatactat

SEQ ID NO: 4192969 - DNA, 14 bp, Homo sapiens
agccaaactctgcc

SEQ ID NO: 4192970 - DNA, 15 bp, Homo sapiens
agccaaactctgcca

SEQ ID NO: 4192971 - DNA, 21 bp, Homo sapiens
agccaacaggtggcaggacca

SEQ ID NO: 4192972 - DNA, 23 bp, Homo sapiens
agccaacaggtggcaggaccagg

SEQ ID NO: 4192973 - DNA, 21 bp, Homo sapiens
agccaacgacaaagccaaact

SEQ ID NO: 4192974 - DNA, 19 bp, Homo sapiens
agccaacttggctttcccg

SEQ ID NO: 4192975 - DNA, 16 bp, Homo sapiens
agccaaggggcttcag

SEQ ID NO: 4192976 - DNA, 22 bp, Homo sapiens
agccaaggtgggctgagccctg

SEQ ID NO: 4192977 - DNA, 15 bp, Homo sapiens
agccaagtagctttg

SEQ ID NO: 4192978 - DNA, 19 bp, Homo sapiens
agccaagtagctttgggca

SEQ ID NO: 4192979 - DNA, 13 bp, Homo sapiens
agccaagtcatgg

SEQ ID NO: 4192980 - DNA, 13 bp, Homo sapiens
agccacaccagga

SEQ ID NO: 4192981 - DNA, 11 bp, Homo sapiens
agccacaggag

SEQ ID NO: 4192982 - DNA, 23 bp, Homo sapiens
agccacagttctaagacccaaag

SEQ ID NO: 4192983 - DNA, 23 bp, Homo sapiens
agccacatccctttgaaacaaga

SEQ ID NO: 4192984 - DNA, 16 bp, Homo sapiens
agccactacctttgtc

SEQ ID NO: 4192985 - DNA, 14 bp, Homo sapiens
agccactctatgag

SEQ ID NO: 4192986 - DNA, 16 bp, Homo sapiens
agccactgaagctggg

SEQ ID NO: 4192987 - DNA, 20 bp, Homo sapiens
agccagccaggaactggctc

SEQ ID NO: 4192988 - DNA, 11 bp, Homo sapiens
agccagctctc

SEQ ID NO: 4192989 - DNA, 17 bp, Homo sapiens
agccaggaactggctcc

SEQ ID NO: 4192990 - DNA, 12 bp, Homo sapiens
agccaggctctg

SEQ ID NO: 4192991 - DNA, 15 bp, Homo sapiens
agccaggctctgcct

SEQ ID NO: 4192992 - DNA, 11 bp, Homo sapiens
agccagggcca

SEQ ID NO: 4192993 - DNA, 12 bp, Homo sapiens
agccagggccag

SEQ ID NO: 4192994 - DNA, 22 bp, Homo sapiens
agccataccgaccatcgtccag

SEQ ID NO: 4192995 - DNA, 15 bp, Homo sapiens
agccatggcatgctc

SEQ ID NO: 4192996 - DNA, 14 bp, Homo sapiens
agccattcctgttc

SEQ ID NO: 4192997 - DNA, 16 bp, Homo sapiens
agccattcctgttctc

SEQ ID NO: 4192998 - DNA, 23 bp, Homo sapiens
agcccacgcccgactagcaggca

SEQ ID NO: 4192999 - DNA, 13 bp, Homo sapiens
agcccagcacaac

SEQ ID NO: 4193000 - DNA, 15 bp, Homo sapiens
agcccagcagggcct

SEQ ID NO: 4193001 - DNA, 14 bp, Homo sapiens
agcccaggtcctcc

SEQ ID NO: 4193002 - DNA, 20 bp, Homo sapiens
agcccatctctccagagagc

SEQ ID NO: 4193003 - DNA, 23 bp, Homo sapiens
agccccaaagtcaattaaaggct

SEQ ID NO: 4193004 - DNA, 17 bp, Homo sapiens
agccccgacccctgtcc

SEQ ID NO: 4193005 - DNA, 13 bp, Homo sapiens
agccctaaacatc

SEQ ID NO: 4193006 - DNA, 21 bp, Homo sapiens
agccctaaacatcattcttga

SEQ ID NO: 4193007 - DNA, 21 bp, Homo sapiens
agccctccctggcatgtcaga

SEQ ID NO: 4193008 - DNA, 22 bp, Homo sapiens
agccctccctggcatgtcagag

SEQ ID NO: 4193009 - DNA, 15 bp, Homo sapiens
agcccttccctgcct

SEQ ID NO: 4193010 - DNA, 17 bp, Homo sapiens
agcccttggcttctgct

SEQ ID NO: 4193011 - DNA, 12 bp, Homo sapiens
agcccttgggtt

SEQ ID NO: 4193012 - DNA, 12 bp, Homo sapiens
agccctttctgt

SEQ ID NO: 4193013 - DNA, 13 bp, Homo sapiens
agccctttctgtg

SEQ ID NO: 4193014 - DNA, 17 bp, Homo sapiens
agccctttctgtgtgca

SEQ ID NO: 4193015 - DNA, 20 bp, Homo sapiens
agccctttgcaggcccagca

SEQ ID NO: 4193016 - DNA, 17 bp, Homo sapiens
agccgccgggcaggcct

SEQ ID NO: 4193017 - DNA, 18 bp, Homo sapiens
agccgccgggcaggcctg

SEQ ID NO: 4193018 - DNA, 19 bp, Homo sapiens
agccgccgggcaggcctgc

SEQ ID NO: 4193019 - DNA, 14 bp, Homo sapiens
agccggtgcctggc

SEQ ID NO: 4193020 - DNA, 22 bp, Homo sapiens
agccggtgcctggcgcccctgc

SEQ ID NO: 4193021 - DNA, 17 bp, Homo sapiens
agcctagaacatccctg

SEQ ID NO: 4193022 - DNA, 21 bp, Homo sapiens
agcctagaacatccctgggca

SEQ ID NO: 4193023 - DNA, 15 bp, Homo sapiens
agcctagaccctcct

SEQ ID NO: 4193024 - DNA, 18 bp, Homo sapiens
agcctagaccctcctcct

SEQ ID NO: 4193025 - DNA, 14 bp, Homo sapiens
agcctcagccacaa

SEQ ID NO: 4193026 - DNA, 14 bp, Homo sapiens
agcctccctctgac

SEQ ID NO: 4193027 - DNA, 15 bp, Homo sapiens
agcctccctctgacc

SEQ ID NO: 4193028 - DNA, 21 bp, Homo sapiens
agcctccctctgacctgcagg

SEQ ID NO: 4193029 - DNA, 17 bp, Homo sapiens
agcctccgccattccaa

SEQ ID NO: 4193030 - DNA, 13 bp, Homo sapiens
agcctctgactca

SEQ ID NO: 4193031 - DNA, 12 bp, Homo sapiens
agcctctgctgc

SEQ ID NO: 4193032 - DNA, 13 bp, Homo sapiens
agcctctgctgcc

SEQ ID NO: 4193033 - DNA, 18 bp, Homo sapiens
agcctctgctgccatggc

SEQ ID NO: 4193034 - DNA, 16 bp, Homo sapiens
agcctctgggccaaga

SEQ ID NO: 4193035 - DNA, 22 bp, Homo sapiens
agcctcttaaagctgcctgtag

SEQ ID NO: 4193036 - DNA, 23 bp, Homo sapiens
agcctcttaaagctgcctgtagt

SEQ ID NO: 4193037 - DNA, 13 bp, Homo sapiens
agcctcttccctc

SEQ ID NO: 4193038 - DNA, 14 bp, Homo sapiens
agcctcttccctct

SEQ ID NO: 4193039 - DNA, 20 bp, Homo sapiens
agcctgaacatgacatttct

SEQ ID NO: 4193040 - DNA, 11 bp, Homo sapiens
agcctgaggct

SEQ ID NO: 4193041 - DNA, 13 bp, Homo sapiens
agcctggcaaggc

SEQ ID NO: 4193042 - DNA, 14 bp, Homo sapiens
agcctggccaacat

SEQ ID NO: 4193043 - DNA, 15 bp, Homo sapiens
agcctggccatcccc

SEQ ID NO: 4193044 - DNA, 18 bp, Homo sapiens
agcctggcttctggagcc

SEQ ID NO: 4193045 - DNA, 23 bp, Homo sapiens
agcctggcttctggagcccttgg

SEQ ID NO: 4193046 - DNA, 23 bp, Homo sapiens
agcctggggtgatagaacaagac

SEQ ID NO: 4193047 - DNA, 22 bp, Homo sapiens
agcctggtagaattgggaagct

SEQ ID NO: 4193048 - DNA, 12 bp, Homo sapiens
agcctgtcctgg

SEQ ID NO: 4193049 - DNA, 14 bp, Homo sapiens
agcctgtcctggta

SEQ ID NO: 4193050 - DNA, 21 bp, Homo sapiens
agcctgtcctggtacagcagg

SEQ ID NO: 4193051 - DNA, 22 bp, Homo sapiens
agcctgtcctggtacagcaggg

SEQ ID NO: 4193052 - DNA, 15 bp, Homo sapiens
agcctgttgctgaag

SEQ ID NO: 4193053 - DNA, 16 bp, Homo sapiens
agccttactcacctct

SEQ ID NO: 4193054 - DNA, 18 bp, Homo sapiens
agccttgcatcaagggct

SEQ ID NO: 4193055 - DNA, 21 bp, Homo sapiens
agccttgcccggattctggga

SEQ ID NO: 4193056 - DNA, 20 bp, Homo sapiens
agccttgccttttaaaagaa

SEQ ID NO: 4193057 - DNA, 12 bp, Homo sapiens
agcctttattat

SEQ ID NO: 4193058 - DNA, 21 bp, Homo sapiens
agcctttttttaggccacatt

SEQ ID NO: 4193059 - DNA, 15 bp, Homo sapiens
agcgagctgctctgc

SEQ ID NO: 4193060 - DNA, 18 bp, Homo sapiens
agcgagctgctctgctat

SEQ ID NO: 4193061 - DNA, 22 bp, Homo sapiens
agcgcagccgccgggcaggcct

SEQ ID NO: 4193062 - DNA, 23 bp, Homo sapiens
agcgcagccgccgggcaggcctg

SEQ ID NO: 4193063 - DNA, 13 bp, Homo sapiens
agcgcctcttcct

SEQ ID NO: 4193064 - DNA, 15 bp, Homo sapiens
agcgcctcttcctct

SEQ ID NO: 4193065 - DNA, 19 bp, Homo sapiens
agcgcctcttcctctgggc

SEQ ID NO: 4193066 - DNA, 12 bp, Homo sapiens
agcgcgggcgga

SEQ ID NO: 4193067 - DNA, 15 bp, Homo sapiens
agcgggggcgtggct

SEQ ID NO: 4193068 - DNA, 17 bp, Homo sapiens
agcgggtggtggctctg

SEQ ID NO: 4193069 - DNA, 21 bp, Homo sapiens
agcgggtggtggctctggaca

SEQ ID NO: 4193070 - DNA, 19 bp, Homo sapiens
agcggttgcttctggctcc

SEQ ID NO: 4193071 - DNA, 12 bp, Homo sapiens
agcgtgtgtatc

SEQ ID NO: 4193072 - DNA, 14 bp, Homo sapiens
agcgtgtgtatccg

SEQ ID NO: 4193073 - DNA, 15 bp, Homo sapiens
agcgttcatgttctg

SEQ ID NO: 4193074 - DNA, 16 bp, Homo sapiens
agctaaagcccaacct

SEQ ID NO: 4193075 - DNA, 19 bp, Homo sapiens
agctaaatgcagggaaact

SEQ ID NO: 4193076 - DNA, 18 bp, Homo sapiens
agctaaattgaatacaca

SEQ ID NO: 4193077 - DNA, 21 bp, Homo sapiens
agctaaattgaatacacaaat

SEQ ID NO: 4193078 - DNA, 22 bp, Homo sapiens
agctaaattgaatacacaaatt

SEQ ID NO: 4193079 - DNA, 15 bp, Homo sapiens
agctacataatttag

SEQ ID NO: 4193080 - DNA, 18 bp, Homo sapiens
agctactcagaagcctga

SEQ ID NO: 4193081 - DNA, 13 bp, Homo sapiens
agctactctcttg

SEQ ID NO: 4193082 - DNA, 14 bp, Homo sapiens
agctagaattgagt

SEQ ID NO: 4193083 - DNA, 21 bp, Homo sapiens
agggcttggtggccaagcctg

SEQ ID NO: 4193084 - DNA, 23 bp, Homo sapiens
aggggaaaccagtgtagccttgc

SEQ ID NO: 4193085 - DNA, 20 bp, Homo sapiens
aggggaaagacttccatcta

SEQ ID NO: 4193086 - DNA, 16 bp, Homo sapiens
aggggacccagctcct

SEQ ID NO: 4193087 - DNA, 20 bp, Homo sapiens
aggggagatgctgggatagc

SEQ ID NO: 4193088 - DNA, 14 bp, Homo sapiens
aggggatggcagac

SEQ ID NO: 4193089 - DNA, 16 bp, Homo sapiens
aggggatggcagacag

SEQ ID NO: 4193090 - DNA, 16 bp, Homo sapiens
aggggcagggagagcg

SEQ ID NO: 4193091 - DNA, 21 bp, Homo sapiens
aggggccagtgagggctgggc

SEQ ID NO: 4193092 - DNA, 14 bp, Homo sapiens
aggggcccacaggg

SEQ ID NO: 4193093 - DNA, 15 bp, Homo sapiens
aggggcttcaggtcc

SEQ ID NO: 4193094 - DNA, 14 bp, Homo sapiens
aggggctttctgga

SEQ ID NO: 4193095 - DNA, 16 bp, Homo sapiens
aggggctttctggaga

SEQ ID NO: 4193096 - DNA, 17 bp, Homo sapiens
agggggaagagaaattt

SEQ ID NO: 4193097 - DNA, 17 bp, Homo sapiens
agggggattggagggaa

SEQ ID NO: 4193098 - DNA, 16 bp, Homo sapiens
agggggtccacccagc

SEQ ID NO: 4193099 - DNA, 21 bp, Homo sapiens
agggggttgggtttggggaca

SEQ ID NO: 4193100 - DNA, 19 bp, Homo sapiens
aggggtaatatattgctgc

SEQ ID NO: 4193101 - DNA, 14 bp, Homo sapiens
aggggtcaaagaaa

SEQ ID NO: 4193102 - DNA, 16 bp, Homo sapiens
aggggtccttggtgtg

SEQ ID NO: 4193103 - DNA, 22 bp, Homo sapiens
aggggtgatttcagagagggca

SEQ ID NO: 4193104 - DNA, 18 bp, Homo sapiens
aggggtgggagagccagc

SEQ ID NO: 4193105 - DNA, 20 bp, Homo sapiens
aggggtgggttcctcttccc

SEQ ID NO: 4193106 - DNA, 21 bp, Homo sapiens
aggggttaacttggtcagagc

SEQ ID NO: 4193107 - DNA, 23 bp, Homo sapiens
aggggttaacttggtcagagcca

SEQ ID NO: 4193108 - DNA, 13 bp, Homo sapiens
agggtaacagaag

SEQ ID NO: 4193109 - DNA, 14 bp, Homo sapiens
agggtcagatgcac

SEQ ID NO: 4193110 - DNA, 16 bp, Homo sapiens
agggtctaaagagaac

SEQ ID NO: 4193111 - DNA, 18 bp, Homo sapiens
agggtctaaagagaacaa

SEQ ID NO: 4193112 - DNA, 14 bp, Homo sapiens
agggtgagagctgc

SEQ ID NO: 4193113 - DNA, 20 bp, Homo sapiens
agggtgcagttttccaggaa

SEQ ID NO: 4193114 - DNA, 17 bp, Homo sapiens
agggtgggccactctcc

SEQ ID NO: 4193115 - DNA, 22 bp, Homo sapiens
agggtgggccactctcccctcc

SEQ ID NO: 4193116 - DNA, 23 bp, Homo sapiens
agggtgggccactctcccctccc

SEQ ID NO: 4193117 - DNA, 17 bp, Homo sapiens
agggtggtctgagcacc

SEQ ID NO: 4193118 - DNA, 20 bp, Homo sapiens
agggtggtctgagcaccccc

SEQ ID NO: 4193119 - DNA, 17 bp, Homo sapiens
agggtggtggggacagg

SEQ ID NO: 4193120 - DNA, 23 bp, Homo sapiens
agggttgggttcatctgagcaag

SEQ ID NO: 4193121 - DNA, 16 bp, Homo sapiens
agggttggtgggctgg

SEQ ID NO: 4193122 - DNA, 21 bp, Homo sapiens
agggttggtgggctggcccag

SEQ ID NO: 4193123 - DNA, 21 bp, Homo sapiens
agggttgttctgggagtcctg

SEQ ID NO: 4193124 - DNA, 15 bp, Homo sapiens
agggttttccaccct

SEQ ID NO: 4193125 - DNA, 13 bp, Homo sapiens
aggtaaaatgcca

SEQ ID NO: 4193126 - DNA, 16 bp, Homo sapiens
aggtaaaatgccatga

SEQ ID NO: 4193127 - DNA, 22 bp, Homo sapiens
aggtaaaatgccatgatgcctc

SEQ ID NO: 4193128 - DNA, 22 bp, Homo sapiens
aggtactatctgtgaagttaca

SEQ ID NO: 4193129 - DNA, 14 bp, Homo sapiens
aggtagagatgtgt

SEQ ID NO: 4193130 - DNA, 18 bp, Homo sapiens
aggtagagatgtgtgtgt

SEQ ID NO: 4193131 - DNA, 17 bp, Homo sapiens
aggtagcgagctgctct

SEQ ID NO: 4193132 - DNA, 17 bp, Homo sapiens
aggtatacctgggaaga

SEQ ID NO: 4193133 - DNA, 18 bp, Homo sapiens
aggtatgacctatgtctg

SEQ ID NO: 4193134 - DNA, 14 bp, Homo sapiens
aggtattaaagatg

SEQ ID NO: 4193135 - DNA, 17 bp, Homo sapiens
aggtattaaagatgtgt

SEQ ID NO: 4193136 - DNA, 18 bp, Homo sapiens
aggtcaacatctaagcct

SEQ ID NO: 4193137 - DNA, 15 bp, Homo sapiens
aggtcaagactgtgg

SEQ ID NO: 4193138 - DNA, 18 bp, Homo sapiens
aggtcaagcctgcagcga

SEQ ID NO: 4193139 - DNA, 18 bp, Homo sapiens
aggtcaccagcctgactg

SEQ ID NO: 4193140 - DNA, 19 bp, Homo sapiens
aggtcaccagcctgactgc

SEQ ID NO: 4193141 - DNA, 17 bp, Homo sapiens
aggtcatgatttctgtg

SEQ ID NO: 4193142 - DNA, 14 bp, Homo sapiens
aggtccaggcagga

SEQ ID NO: 4193143 - DNA, 14 bp, Homo sapiens
aggtcccttgtttc

SEQ ID NO: 4193144 - DNA, 15 bp, Homo sapiens
aggtccggaggggtt

SEQ ID NO: 4193145 - DNA, 12 bp, Homo sapiens
aggtcctggctt

SEQ ID NO: 4193146 - DNA, 16 bp, Homo sapiens
aggtctagactttctc

SEQ ID NO: 4193147 - DNA, 20 bp, Homo sapiens
aggtctagactttctcagtg

SEQ ID NO: 4193148 - DNA, 16 bp, Homo sapiens
aggtgaatagcacagg

SEQ ID NO: 4193149 - DNA, 20 bp, Homo sapiens
aggtgacccaatgctcctgg

SEQ ID NO: 4193150 - DNA, 21 bp, Homo sapiens
aggtgacccaatgctcctgga

SEQ ID NO: 4193151 - DNA, 13 bp, Homo sapiens
aggtgagaaattt

SEQ ID NO: 4193152 - DNA, 18 bp, Homo sapiens
aggtgagctcagctcact

SEQ ID NO: 4193153 - DNA, 16 bp, Homo sapiens
aggtgatttcagactg

SEQ ID NO: 4193154 - DNA, 21 bp, Homo sapiens
aggtgcaaaaataaaaggaaa

SEQ ID NO: 4193155 - DNA, 13 bp, Homo sapiens
aggtgccaggctg

SEQ ID NO: 4193156 - DNA, 15 bp, Homo sapiens
aggtgctagctctta

SEQ ID NO: 4193157 - DNA, 13 bp, Homo sapiens
aggtgctctgtgt

SEQ ID NO: 4193158 - DNA, 20 bp, Homo sapiens
aggtggaggttgcagtgagc

SEQ ID NO: 4193159 - DNA, 14 bp, Homo sapiens
aggtggcagccctg

SEQ ID NO: 4193160 - DNA, 15 bp, Homo sapiens
aggtggcagccctgt

SEQ ID NO: 4193161 - DNA, 19 bp, Homo sapiens
aggtggcaggaccaggact

SEQ ID NO: 4193162 - DNA, 17 bp, Homo sapiens
aggtggctctccagtta

SEQ ID NO: 4193163 - DNA, 19 bp, Homo sapiens
aggtggctctccagttagt

SEQ ID NO: 4193164 - DNA, 18 bp, Homo sapiens
aggtgggcagaggctggc

SEQ ID NO: 4193165 - DNA, 22 bp, Homo sapiens
aggtggggtatttaccacagca

SEQ ID NO: 4193166 - DNA, 19 bp, Homo sapiens
aggtggtcctgagacctga

SEQ ID NO: 4193167 - DNA, 15 bp, Homo sapiens
aggtggtgcttacat

SEQ ID NO: 4193168 - DNA, 13 bp, Homo sapiens
aggtggtgtttct

SEQ ID NO: 4193169 - DNA, 22 bp, Homo sapiens
aggtggtttttggttacatgga

SEQ ID NO: 4193170 - DNA, 19 bp, Homo sapiens
aggtgtagccacaccagga

SEQ ID NO: 4193171 - DNA, 19 bp, Homo sapiens
aggtgtcaccctgcagagc

SEQ ID NO: 4193172 - DNA, 20 bp, Homo sapiens
aggtgtcaccctgcagagct

SEQ ID NO: 4193173 - DNA, 18 bp, Homo sapiens
aggttaggtttgtcaaca

SEQ ID NO: 4193174 - DNA, 19 bp, Homo sapiens
aggttctaggtcctggctt

SEQ ID NO: 4193175 - DNA, 21 bp, Homo sapiens
aggttctaggtcctggcttct

SEQ ID NO: 4193176 - DNA, 14 bp, Homo sapiens
aggttgcagtgagc

SEQ ID NO: 4193177 - DNA, 16 bp, Homo sapiens
aggttgcagtgagctg

SEQ ID NO: 4193178 - DNA, 15 bp, Homo sapiens
aggttgtgctgcctg

SEQ ID NO: 4193179 - DNA, 16 bp, Homo sapiens
aggtttatgaaaaaga

SEQ ID NO: 4193180 - DNA, 20 bp, Homo sapiens
aggtttgctgtgtctcacag

SEQ ID NO: 4193181 - DNA, 21 bp, Homo sapiens
aggtttggggagggggaagag

SEQ ID NO: 4193182 - DNA, 18 bp, Homo sapiens
aggtttgtcaacacaaag

SEQ ID NO: 4193183 - DNA, 10 bp, Homo sapiens
aggttttcag

SEQ ID NO: 4193184 - DNA, 16 bp, Homo sapiens
agtaaaagcaaaaaag

SEQ ID NO: 4193185 - DNA, 20 bp, Homo sapiens
agtaaaagctaattaggatt

SEQ ID NO: 4193186 - DNA, 14 bp, Homo sapiens
agtaaataaattgt

SEQ ID NO: 4193187 - DNA, 18 bp, Homo sapiens
agtaaataaattgtttga

SEQ ID NO: 4193188 - DNA, 19 bp, Homo sapiens
agtaaatcacgctttttga

SEQ ID NO: 4193189 - DNA, 17 bp, Homo sapiens
agtaagtaccactcagg

SEQ ID NO: 4193190 - DNA, 23 bp, Homo sapiens
agtaagtttcaggagattgttaa

SEQ ID NO: 4193191 - DNA, 16 bp, Homo sapiens
agtaatatgctctcat

SEQ ID NO: 4193192 - DNA, 23 bp, Homo sapiens
agtaatctgcattattggaatat

SEQ ID NO: 4193193 - DNA, 14 bp, Homo sapiens
agtaatttagaaat

SEQ ID NO: 4193194 - DNA, 17 bp, Homo sapiens
agtaatttagaaatcat

SEQ ID NO: 4193195 - DNA, 19 bp, Homo sapiens
agtaatttattgtctgtct

SEQ ID NO: 4193196 - DNA, 13 bp, Homo sapiens
agtacggctgctg

SEQ ID NO: 4193197 - DNA, 14 bp, Homo sapiens
agtacggctgctgc

SEQ ID NO: 4193198 - DNA, 16 bp, Homo sapiens
agtacggctgctgcac

SEQ ID NO: 4193199 - DNA, 16 bp, Homo sapiens
agtagatagaaagcaa

SEQ ID NO: 4193200 - DNA, 15 bp, Homo sapiens
agtagatggtgaaat

SEQ ID NO: 4193201 - DNA, 16 bp, Homo sapiens
agtagccctttctgtg

SEQ ID NO: 4193202 - DNA, 17 bp, Homo sapiens
agtagccctttctgtgt

SEQ ID NO: 4193203 - DNA, 19 bp, Homo sapiens
agtagccctttctgtgtgc

SEQ ID NO: 4193204 - DNA, 18 bp, Homo sapiens
agtagctttgggcatagg

SEQ ID NO: 4193205 - DNA, 17 bp, Homo sapiens
agtaggcatttttacca

SEQ ID NO: 4193206 - DNA, 22 bp, Homo sapiens
agtaggcatttttaccatcact

SEQ ID NO: 4193207 - DNA, 13 bp, Homo sapiens
agtagttaaaagt

SEQ ID NO: 4193208 - DNA, 12 bp, Homo sapiens
agtagtttgtat

SEQ ID NO: 4193209 - DNA, 17 bp, Homo sapiens
agtagtttgtataactt

SEQ ID NO: 4193210 - DNA, 15 bp, Homo sapiens
agtatattatgtatt

SEQ ID NO: 4193211 - DNA, 13 bp, Homo sapiens
agtatatttctga

SEQ ID NO: 4193212 - DNA, 15 bp, Homo sapiens
agtatcttttaaaat

SEQ ID NO: 4193213 - DNA, 15 bp, Homo sapiens
agtatgtaaagtatg

SEQ ID NO: 4193214 - DNA, 18 bp, Homo sapiens
agtattcttgtcaaaaaa

SEQ ID NO: 4193215 - DNA, 23 bp, Homo sapiens
agtatttttttaagttagagaat

SEQ ID NO: 4193216 - DNA, 15 bp, Homo sapiens
agtcaacactcttct

SEQ ID NO: 4193217 - DNA, 14 bp, Homo sapiens
agtcaagatacata

SEQ ID NO: 4193218 - DNA, 13 bp, Homo sapiens
atcagctggtggc

SEQ ID NO: 4193219 - DNA, 20 bp, Homo sapiens
atcagggtgggccactctcc

SEQ ID NO: 4193220 - DNA, 15 bp, Homo sapiens
atcagtagctgagtg

SEQ ID NO: 4193221 - DNA, 20 bp, Homo sapiens
atcagtccttattatcccag

SEQ ID NO: 4193222 - DNA, 16 bp, Homo sapiens
atcataattaaactgt

SEQ ID NO: 4193223 - DNA, 16 bp, Homo sapiens
atcataggtatttcaa

SEQ ID NO: 4193224 - DNA, 17 bp, Homo sapiens
atcataggtatttcaaa

SEQ ID NO: 4193225 - DNA, 16 bp, Homo sapiens
atcatgacatgttata

SEQ ID NO: 4193226 - DNA, 19 bp, Homo sapiens
atcattgtgcttaataata

SEQ ID NO: 4193227 - DNA, 19 bp, Homo sapiens
atccacccatgtttattaa

SEQ ID NO: 4193228 - DNA, 15 bp, Homo sapiens
atccacgcacacatg

SEQ ID NO: 4193229 - DNA, 23 bp, Homo sapiens
atccagaactgaggtcactgggt

SEQ ID NO: 4193230 - DNA, 15 bp, Homo sapiens
atccagtttcccacc

SEQ ID NO: 4193231 - DNA, 11 bp, Homo sapiens
atccatcctgc

SEQ ID NO: 4193232 - DNA, 19 bp, Homo sapiens
atccatttggacaaaatgg

SEQ ID NO: 4193233 - DNA, 23 bp, Homo sapiens
atccatttggacaaaatggaagg

SEQ ID NO: 4193234 - DNA, 17 bp, Homo sapiens
atcccaagtagaatctc

SEQ ID NO: 4193235 - DNA, 15 bp, Homo sapiens
atcccaagtgccagt

SEQ ID NO: 4193236 - DNA, 13 bp, Homo sapiens
atcccacccacct

SEQ ID NO: 4193237 - DNA, 18 bp, Homo sapiens
atcccagctacccaggag

SEQ ID NO: 4193238 - DNA, 18 bp, Homo sapiens
atcccagcttgctgaggg

SEQ ID NO: 4193239 - DNA, 21 bp, Homo sapiens
atcccagcttgctgaggggca

SEQ ID NO: 4193240 - DNA, 16 bp, Homo sapiens
atccccaaactgtgcc

SEQ ID NO: 4193241 - DNA, 23 bp, Homo sapiens
atccccaaactgtgccctgcctt

SEQ ID NO: 4193242 - DNA, 21 bp, Homo sapiens
atccccttgtgtcagagacag

SEQ ID NO: 4193243 - DNA, 12 bp, Homo sapiens
atcccctttcct

SEQ ID NO: 4193244 - DNA, 18 bp, Homo sapiens
atccctaatgtgtgccat

SEQ ID NO: 4193245 - DNA, 23 bp, Homo sapiens
atccctctcctctcctcctctgt

SEQ ID NO: 4193246 - DNA, 16 bp, Homo sapiens
atccgactctaagctg

SEQ ID NO: 4193247 - DNA, 17 bp, Homo sapiens
atccgactctaagctgt

SEQ ID NO: 4193248 - DNA, 18 bp, Homo sapiens
atcctattctcaccagga

SEQ ID NO: 4193249 - DNA, 20 bp, Homo sapiens
atcctattctcaccaggaag

SEQ ID NO: 4193250 - DNA, 16 bp, Homo sapiens
atcctcaaacacacaa

SEQ ID NO: 4193251 - DNA, 14 bp, Homo sapiens
atcctctttttcca

SEQ ID NO: 4193252 - DNA, 16 bp, Homo sapiens
atcctgaagaaaccac

SEQ ID NO: 4193253 - DNA, 15 bp, Homo sapiens
atcctgagcagtgta

SEQ ID NO: 4193254 - DNA, 17 bp, Homo sapiens
atcctggaaccactgat

SEQ ID NO: 4193255 - DNA, 16 bp, Homo sapiens
atcctgtattcagaca

SEQ ID NO: 4193256 - DNA, 14 bp, Homo sapiens
atcctgtttcagct

SEQ ID NO: 4193257 - DNA, 14 bp, Homo sapiens
atccttggagagca

SEQ ID NO: 4193258 - DNA, 16 bp, Homo sapiens
atccttggagagcagc

SEQ ID NO: 4193259 - DNA, 15 bp, Homo sapiens
atccttttctgcaga

SEQ ID NO: 4193260 - DNA, 15 bp, Homo sapiens
atcctttttctttat

SEQ ID NO: 4193261 - DNA, 19 bp, Homo sapiens
atcgctcttttccactcca

SEQ ID NO: 4193262 - DNA, 14 bp, Homo sapiens
atcgtccagccctc

SEQ ID NO: 4193263 - DNA, 15 bp, Homo sapiens
atcgtgtttgcaaag

SEQ ID NO: 4193264 - DNA, 23 bp, Homo sapiens
atcgttcctatacatttctgttc

SEQ ID NO: 4193265 - DNA, 21 bp, Homo sapiens
atctaattgggggaggtgtga

SEQ ID NO: 4193266 - DNA, 21 bp, Homo sapiens
atctatctgcctttacctaca

SEQ ID NO: 4193267 - DNA, 14 bp, Homo sapiens
atctatcttttcca

SEQ ID NO: 4193268 - DNA, 13 bp, Homo sapiens
atctcaaatccac

SEQ ID NO: 4193269 - DNA, 17 bp, Homo sapiens
atctcaaatccactgac

SEQ ID NO: 4193270 - DNA, 18 bp, Homo sapiens
atctcaaatccactgaca

SEQ ID NO: 4193271 - DNA, 13 bp, Homo sapiens
atctcactttgcc

SEQ ID NO: 4193272 - DNA, 23 bp, Homo sapiens
atctcataggttgccaataatac

SEQ ID NO: 4193273 - DNA, 12 bp, Homo sapiens
atctccaaggac

SEQ ID NO: 4193274 - DNA, 16 bp, Homo sapiens
atctccaaggaccagg

SEQ ID NO: 4193275 - DNA, 12 bp, Homo sapiens
atctccaggatt

SEQ ID NO: 4193276 - DNA, 18 bp, Homo sapiens
atctccagggctgcccct

SEQ ID NO: 4193277 - DNA, 18 bp, Homo sapiens
atctccagtattcttgtc

SEQ ID NO: 4193278 - DNA, 22 bp, Homo sapiens
atctcctcccatggccttccct

SEQ ID NO: 4193279 - DNA, 21 bp, Homo sapiens
atctcctgacctcgtgatcca

SEQ ID NO: 4193280 - DNA, 15 bp, Homo sapiens
atctcctttcaggga

SEQ ID NO: 4193281 - DNA, 22 bp, Homo sapiens
atctctctactcctacctcagc

SEQ ID NO: 4193282 - DNA, 23 bp, Homo sapiens
atctctctactcctacctcagcc

SEQ ID NO: 4193283 - DNA, 22 bp, Homo sapiens
atctgaaattggtgggaagcaa

SEQ ID NO: 4193284 - DNA, 13 bp, Homo sapiens
atctgaaggagat

SEQ ID NO: 4193285 - DNA, 18 bp, Homo sapiens
atctgaatttttaaacaa

SEQ ID NO: 4193286 - DNA, 21 bp, Homo sapiens
atctgagatctccctccaggg

SEQ ID NO: 4193287 - DNA, 13 bp, Homo sapiens
atctgagcaaaca

SEQ ID NO: 4193288 - DNA, 19 bp, Homo sapiens
atctgcactgggtgtggcc

SEQ ID NO: 4193289 - DNA, 17 bp, Homo sapiens
atctgcagaatgggcca

SEQ ID NO: 4193290 - DNA, 17 bp, Homo sapiens
atctgccattactctgc

SEQ ID NO: 4193291 - DNA, 16 bp, Homo sapiens
atctggcttagtgcca

SEQ ID NO: 4193292 - DNA, 17 bp, Homo sapiens
atctggcttagtgccac

SEQ ID NO: 4193293 - DNA, 22 bp, Homo sapiens
atctgggattcccaccaaggtc

SEQ ID NO: 4193294 - DNA, 17 bp, Homo sapiens
atctgggtaagaagaaa

SEQ ID NO: 4193295 - DNA, 19 bp, Homo sapiens
atctgggtaagaagaaagc

SEQ ID NO: 4193296 - DNA, 16 bp, Homo sapiens
atctggttagataatg

SEQ ID NO: 4193297 - DNA, 22 bp, Homo sapiens
atctggttagataatgaatgat

SEQ ID NO: 4193298 - DNA, 18 bp, Homo sapiens
atctggtttttaaaagat

SEQ ID NO: 4193299 - DNA, 14 bp, Homo sapiens
atctgtaatttcac

SEQ ID NO: 4193300 - DNA, 13 bp, Homo sapiens
atctgtagtaatt

SEQ ID NO: 4193301 - DNA, 13 bp, Homo sapiens
atctgtgtgaaaa

SEQ ID NO: 4193302 - DNA, 15 bp, Homo sapiens
atctgttgttttgtt

SEQ ID NO: 4193303 - DNA, 18 bp, Homo sapiens
atcttcggggtgtgatga

SEQ ID NO: 4193304 - DNA, 16 bp, Homo sapiens
atcttcgtcctgcccc

SEQ ID NO: 4193305 - DNA, 18 bp, Homo sapiens
atcttctgcagacactgt

SEQ ID NO: 4193306 - DNA, 12 bp, Homo sapiens
atcttctggatt

SEQ ID NO: 4193307 - DNA, 17 bp, Homo sapiens
atcttgacatgtaatga

SEQ ID NO: 4193308 - DNA, 24 bp, Homo sapiens
atcttgcccctccagagacaggaa

SEQ ID NO: 4193309 - DNA, 17 bp, Homo sapiens
atcttggtttgccttcc

SEQ ID NO: 4193310 - DNA, 20 bp, Homo sapiens
atcttggtttgccttccaga

SEQ ID NO: 4193311 - DNA, 21 bp, Homo sapiens
atcttggtttgccttccagaa

SEQ ID NO: 4193312 - DNA, 13 bp, Homo sapiens
atcttgtcaagaa

SEQ ID NO: 4193313 - DNA, 12 bp, Homo sapiens
atctttcaggaa

SEQ ID NO: 4193314 - DNA, 21 bp, Homo sapiens
atctttctagcagcagatctg

SEQ ID NO: 4193315 - DNA, 16 bp, Homo sapiens
atctttctattccaaa

SEQ ID NO: 4193316 - DNA, 16 bp, Homo sapiens
atctttgaaagctgaa

SEQ ID NO: 4193317 - DNA, 22 bp, Homo sapiens
atcttttaaaatgaaatgtttt

SEQ ID NO: 4193318 - DNA, 18 bp, Homo sapiens
atcttttccacaaatatg

SEQ ID NO: 4193319 - DNA, 19 bp, Homo sapiens
atcttttccacaaatatga

SEQ ID NO: 4193320 - DNA, 18 bp, Homo sapiens
atcttttggtggagtcag

SEQ ID NO: 4193321 - DNA, 15 bp, Homo sapiens
atgaaaaagaagaat

SEQ ID NO: 4193322 - DNA, 13 bp, Homo sapiens
atgaaaagctaga

SEQ ID NO: 4193323 - DNA, 18 bp, Homo sapiens
atgaaaagctagaattga

SEQ ID NO: 4193324 - DNA, 13 bp, Homo sapiens
atgaaaatgaata

SEQ ID NO: 4193325 - DNA, 11 bp, Homo sapiens
atgaaaccaaa

SEQ ID NO: 4193326 - DNA, 16 bp, Homo sapiens
atgaaaccaaaattat

SEQ ID NO: 4193327 - DNA, 14 bp, Homo sapiens
atgaaaccaaagcc

SEQ ID NO: 4193328 - DNA, 15 bp, Homo sapiens
atgaaagaatatcta

SEQ ID NO: 4193329 - DNA, 16 bp, Homo sapiens
atgaaattgaacctgg

SEQ ID NO: 4193330 - DNA, 22 bp, Homo sapiens
atgaaattgtctagcagagcag

SEQ ID NO: 4193331 - DNA, 19 bp, Homo sapiens
atgaaattttctagacttt

SEQ ID NO: 4193332 - DNA, 22 bp, Homo sapiens
atgaaattttctagactttctg

SEQ ID NO: 4193333 - DNA, 16 bp, Homo sapiens
atgaacagaacataga

SEQ ID NO: 4193334 - DNA, 13 bp, Homo sapiens
atgaacttgagga

SEQ ID NO: 4193335 - DNA, 15 bp, Homo sapiens
atgaacttgaggaca

SEQ ID NO: 4193336 - DNA, 19 bp, Homo sapiens
atgaacttgaggacacatg

SEQ ID NO: 4193337 - DNA, 21 bp, Homo sapiens
atgaagactgttaaatgaaac

SEQ ID NO: 4193338 - DNA, 21 bp, Homo sapiens
atgaaggtaggtaaataggta

SEQ ID NO: 4193339 - DNA, 19 bp, Homo sapiens
atgaatatttcaaaataaa

SEQ ID NO: 4193340 - DNA, 14 bp, Homo sapiens
atgaatgacaacat

SEQ ID NO: 4193341 - DNA, 22 bp, Homo sapiens
atgaatgatcattgaaagtaaa

SEQ ID NO: 4193342 - DNA, 18 bp, Homo sapiens
atgaattccaactcactt

SEQ ID NO: 4193343 - DNA, 17 bp, Homo sapiens
atgaattcttatgctta

SEQ ID NO: 4193344 - DNA, 21 bp, Homo sapiens
atgacaatcctgaagaaacca

SEQ ID NO: 4193345 - DNA, 17 bp, Homo sapiens
atgacacatttggcagt

SEQ ID NO: 4193346 - DNA, 22 bp, Homo sapiens
atgacactctagtgacttcctg

SEQ ID NO: 4193347 - DNA, 12 bp, Homo sapiens
atgacagagcga

SEQ ID NO: 4193348 - DNA, 14 bp, Homo sapiens
atgactcaggagcc

SEQ ID NO: 4193349 - DNA, 12 bp, Homo sapiens
atgacttctgct

SEQ ID NO: 4193350 - DNA, 15 bp, Homo sapiens
atgacttctgctgaa

SEQ ID NO: 4193351 - DNA, 17 bp, Homo sapiens
atgacttttctggaaga

SEQ ID NO: 4193352 - DNA, 22 bp, Homo sapiens
atgagaaactttgatctctgct

SEQ ID NO: 4193353 - DNA, 16 bp, Homo sapiens
attcctggcatgacac

SEQ ID NO: 4193354 - DNA, 20 bp, Homo sapiens
attcctggcatgacactcta

SEQ ID NO: 4193355 - DNA, 21 bp, Homo sapiens
attcctggcatgacactctag

SEQ ID NO: 4193356 - DNA, 10 bp, Homo sapiens
attcctgggc

SEQ ID NO: 4193357 - DNA, 15 bp, Homo sapiens
attcctgggcaagaa

SEQ ID NO: 4193358 - DNA, 18 bp, Homo sapiens
attccttttgtgtacagt

SEQ ID NO: 4193359 - DNA, 16 bp, Homo sapiens
attcctttttaacttt

SEQ ID NO: 4193360 - DNA, 14 bp, Homo sapiens
attctaaaatgatt

SEQ ID NO: 4193361 - DNA, 22 bp, Homo sapiens
attctacagcatacagagcagg

SEQ ID NO: 4193362 - DNA, 13 bp, Homo sapiens
attctagaagcag

SEQ ID NO: 4193363 - DNA, 20 bp, Homo sapiens
attctagccaaactattcta

SEQ ID NO: 4193364 - DNA, 19 bp, Homo sapiens
attctaggaaacccaagga

SEQ ID NO: 4193365 - DNA, 15 bp, Homo sapiens
attctatatgatcct

SEQ ID NO: 4193366 - DNA, 18 bp, Homo sapiens
attctatatgatcctgaa

SEQ ID NO: 4193367 - DNA, 13 bp, Homo sapiens
attctatgtatgt

SEQ ID NO: 4193368 - DNA, 20 bp, Homo sapiens
attctgaccacccttctcat

SEQ ID NO: 4193369 - DNA, 14 bp, Homo sapiens
attcttatgcttat

SEQ ID NO: 4193370 - DNA, 14 bp, Homo sapiens
attcttgtcaaaaa

SEQ ID NO: 4193371 - DNA, 20 bp, Homo sapiens
attgaagagatttcaacata

SEQ ID NO: 4193372 - DNA, 21 bp, Homo sapiens
attgaagagatttcaacatat

SEQ ID NO: 4193373 - DNA, 23 bp, Homo sapiens
attgaagagatttcaacatatca

SEQ ID NO: 4193374 - DNA, 23 bp, Homo sapiens
attgaatggctatgtttttaatg

SEQ ID NO: 4193375 - DNA, 15 bp, Homo sapiens
attgacctataaaac

SEQ ID NO: 4193376 - DNA, 11 bp, Homo sapiens
attgagaagcc

SEQ ID NO: 4193377 - DNA, 12 bp, Homo sapiens
attgaggcctgc

SEQ ID NO: 4193378 - DNA, 21 bp, Homo sapiens
attgatttttgtaataaaagg

SEQ ID NO: 4193379 - DNA, 15 bp, Homo sapiens
attgcctgcagagag

SEQ ID NO: 4193380 - DNA, 17 bp, Homo sapiens
attgcctgcagagagaa

SEQ ID NO: 4193381 - DNA, 14 bp, Homo sapiens
attgccttcctcgt

SEQ ID NO: 4193382 - DNA, 17 bp, Homo sapiens
attggaatttaaaaata

SEQ ID NO: 4193383 - DNA, 15 bp, Homo sapiens
attggaattttctta

SEQ ID NO: 4193384 - DNA, 13 bp, Homo sapiens
attggagggaaga

SEQ ID NO: 4193385 - DNA, 22 bp, Homo sapiens
attggagggtgggagagcccag

SEQ ID NO: 4193386 - DNA, 18 bp, Homo sapiens
attggcctgtgtctggcc

SEQ ID NO: 4193387 - DNA, 19 bp, Homo sapiens
attggctcccatctgaacc

SEQ ID NO: 4193388 - DNA, 15 bp, Homo sapiens
attgggaccctccag

SEQ ID NO: 4193389 - DNA, 14 bp, Homo sapiens
attgggagggatga

SEQ ID NO: 4193390 - DNA, 17 bp, Homo sapiens
attggggaagaaaaaat

SEQ ID NO: 4193391 - DNA, 17 bp, Homo sapiens
attgggtagctccctga

SEQ ID NO: 4193392 - DNA, 15 bp, Homo sapiens
attggtgggaagcaa

SEQ ID NO: 4193393 - DNA, 15 bp, Homo sapiens
attgtaaaatagctt

SEQ ID NO: 4193394 - DNA, 21 bp, Homo sapiens
attgtaaaatagcttgtatag

SEQ ID NO: 4193395 - DNA, 22 bp, Homo sapiens
attgtaaaatagcttgtatagt

SEQ ID NO: 4193396 - DNA, 16 bp, Homo sapiens
attgtacagctgttta

SEQ ID NO: 4193397 - DNA, 20 bp, Homo sapiens
attgtacagctgtttaagat

SEQ ID NO: 4193398 - DNA, 14 bp, Homo sapiens
attgtactccagcc

SEQ ID NO: 4193399 - DNA, 17 bp, Homo sapiens
attgtactccagcctgg

SEQ ID NO: 4193400 - DNA, 15 bp, Homo sapiens
attgtagatggaaat

SEQ ID NO: 4193401 - DNA, 17 bp, Homo sapiens
attgtataaactatcag

SEQ ID NO: 4193402 - DNA, 15 bp, Homo sapiens
attgtataatgtgat

SEQ ID NO: 4193403 - DNA, 15 bp, Homo sapiens
attgtctaataaata

SEQ ID NO: 4193404 - DNA, 16 bp, Homo sapiens
attgtctcagtgctgg

SEQ ID NO: 4193405 - DNA, 15 bp, Homo sapiens
attgtctccttgagt

SEQ ID NO: 4193406 - DNA, 21 bp, Homo sapiens
attgtctgtctacatttctgc

SEQ ID NO: 4193407 - DNA, 20 bp, Homo sapiens
attgtgcaatgtaaatattt

SEQ ID NO: 4193408 - DNA, 15 bp, Homo sapiens
attgtgcttaataat

SEQ ID NO: 4193409 - DNA, 18 bp, Homo sapiens
attgtgggtaacgtgaga

SEQ ID NO: 4193410 - DNA, 16 bp, Homo sapiens
attgtgggtgttaatt

SEQ ID NO: 4193411 - DNA, 18 bp, Homo sapiens
attgttttatcatgacat

SEQ ID NO: 4193412 - DNA, 16 bp, Homo sapiens
attgttttatgttcta

SEQ ID NO: 4193413 - DNA, 13 bp, Homo sapiens
atttaaaaaacta

SEQ ID NO: 4193414 - DNA, 17 bp, Homo sapiens
atttaaaaaactaaaaa

SEQ ID NO: 4193415 - DNA, 22 bp, Homo sapiens
atttaaaaaactaaaaactaga

SEQ ID NO: 4193416 - DNA, 14 bp, Homo sapiens
atttaaaaatatcg

SEQ ID NO: 4193417 - DNA, 22 bp, Homo sapiens
atttaaaaccattatttaataa

SEQ ID NO: 4193418 - DNA, 15 bp, Homo sapiens
atttaaaatagcaaa

SEQ ID NO: 4193419 - DNA, 21 bp, Homo sapiens
atttaaaatagcaaaagaaga

SEQ ID NO: 4193420 - DNA, 22 bp, Homo sapiens
atttaaaatagcaaaagaagaa

SEQ ID NO: 4193421 - DNA, 23 bp, Homo sapiens
atttaaaatagcaaaagaagaag

SEQ ID NO: 4193422 - DNA, 21 bp, Homo sapiens
atttaacaaatacattcataa

SEQ ID NO: 4193423 - DNA, 15 bp, Homo sapiens
atttaataaatgtat

SEQ ID NO: 4193424 - DNA, 17 bp, Homo sapiens
atttaatagcaaagaat

SEQ ID NO: 4193425 - DNA, 16 bp, Homo sapiens
atttaatccagatctg

SEQ ID NO: 4193426 - DNA, 13 bp, Homo sapiens
atttaatttatgt

SEQ ID NO: 4193427 - DNA, 14 bp, Homo sapiens
atttaatttatgtg

SEQ ID NO: 4193428 - DNA, 14 bp, Homo sapiens
atttactaaaagaa

SEQ ID NO: 4193429 - DNA, 15 bp, Homo sapiens
atttactaaaagaat

SEQ ID NO: 4193430 - DNA, 22 bp, Homo sapiens
atttactaagccacaagaaatt

SEQ ID NO: 4193431 - DNA, 23 bp, Homo sapiens
atttactaagccacaagaaattt

SEQ ID NO: 4193432 - DNA, 19 bp, Homo sapiens
atttacttaatgggtacaa

SEQ ID NO: 4193433 - DNA, 20 bp, Homo sapiens
atttatactggtaacttatt

SEQ ID NO: 4193434 - DNA, 14 bp, Homo sapiens
atttatactttgca

SEQ ID NO: 4193435 - DNA, 12 bp, Homo sapiens
atttatagtttg

SEQ ID NO: 4193436 - DNA, 14 bp, Homo sapiens
atttatagtttgta

SEQ ID NO: 4193437 - DNA, 23 bp, Homo sapiens
atttatatcttatatataataat

SEQ ID NO: 4193438 - DNA, 12 bp, Homo sapiens
atttatatgtta

SEQ ID NO: 4193439 - DNA, 18 bp, Homo sapiens
atttatatgttaatttgt

SEQ ID NO: 4193440 - DNA, 15 bp, Homo sapiens
atttatatttggaaa

SEQ ID NO: 4193441 - DNA, 16 bp, Homo sapiens
atttatatttggaaag

SEQ ID NO: 4193442 - DNA, 17 bp, Homo sapiens
atttatatttggaaaga

SEQ ID NO: 4193443 - DNA, 18 bp, Homo sapiens
atttatatttggaaagag

SEQ ID NO: 4193444 - DNA, 17 bp, Homo sapiens
atttatcaccagcatat

SEQ ID NO: 4193445 - DNA, 19 bp, Homo sapiens
atttatgcatggaaacctg

SEQ ID NO: 4193446 - DNA, 21 bp, Homo sapiens
atttattaaaatgattgtaaa

SEQ ID NO: 4193447 - DNA, 16 bp, Homo sapiens
atttattagttaatat

SEQ ID NO: 4193448 - DNA, 12 bp, Homo sapiens
atttattttgac

SEQ ID NO: 4193449 - DNA, 19 bp, Homo sapiens
atttcaaatagaatatgga

SEQ ID NO: 4193450 - DNA, 15 bp, Homo sapiens
atttcaaatgaacac

SEQ ID NO: 4193451 - DNA, 19 bp, Homo sapiens
atttcaacatatcattttt

SEQ ID NO: 4193452 - DNA, 15 bp, Homo sapiens
atttcaactccagaa

SEQ ID NO: 4193453 - DNA, 14 bp, Homo sapiens
atttcaagtgccta

SEQ ID NO: 4193454 - DNA, 15 bp, Homo sapiens
atttcaattctcaaa

SEQ ID NO: 4193455 - DNA, 19 bp, Homo sapiens
atttcacaacagcctgaca

SEQ ID NO: 4193456 - DNA, 16 bp, Homo sapiens
atttcagactgcagag

SEQ ID NO: 4193457 - DNA, 19 bp, Homo sapiens
atttcaggatactctgtca

SEQ ID NO: 4193458 - DNA, 22 bp, Homo sapiens
atttcaggatactctgtcagat

SEQ ID NO: 4193459 - DNA, 17 bp, Homo sapiens
atttccaaataaaatga

SEQ ID NO: 4193460 - DNA, 20 bp, Homo sapiens
atttccattcccaaaataac

SEQ ID NO: 4193461 - DNA, 18 bp, Homo sapiens
atttccctgactcctcta

SEQ ID NO: 4193462 - DNA, 23 bp, Homo sapiens
atttcccttgaaattttaaacta

SEQ ID NO: 4193463 - DNA, 23 bp, Homo sapiens
atttcctgctacacaaaagccaa

SEQ ID NO: 4193464 - DNA, 16 bp, Homo sapiens
atttcctttttctagt

SEQ ID NO: 4193465 - DNA, 14 bp, Homo sapiens
atttctagtagaaa

SEQ ID NO: 4193466 - DNA, 17 bp, Homo sapiens
atttctatagccaaaaa

SEQ ID NO: 4193467 - DNA, 20 bp, Homo sapiens
atttctcatgcttcttctca

SEQ ID NO: 4193468 - DNA, 20 bp, Homo sapiens
atttctctaactcctgccat

SEQ ID NO: 4193469 - DNA, 13 bp, Homo sapiens
atttctgaactgt

SEQ ID NO: 4193470 - DNA, 21 bp, Homo sapiens
atttctgtgtattttgagata

SEQ ID NO: 4193471 - DNA, 19 bp, Homo sapiens
atttctttgttcccactgt

SEQ ID NO: 4193472 - DNA, 18 bp, Homo sapiens
atttctttttttaaattg

SEQ ID NO: 4193473 - DNA, 20 bp, Homo sapiens
atttctttttttaaattgta

SEQ ID NO: 4193474 - DNA, 17 bp, Homo sapiens
atttgaaaataattgtt

SEQ ID NO: 4193475 - DNA, 16 bp, Homo sapiens
atttgaagtaaaggat

SEQ ID NO: 4193476 - DNA, 22 bp, Homo sapiens
atttgaggagcagcttcagttg

SEQ ID NO: 4193477 - DNA, 18 bp, Homo sapiens
atttgagtgattatttgt

SEQ ID NO: 4193478 - DNA, 19 bp, Homo sapiens
atttgatgcccagataata

SEQ ID NO: 4193479 - DNA, 16 bp, Homo sapiens
atttgccattcctgga

SEQ ID NO: 4193480 - DNA, 17 bp, Homo sapiens
atttgccattcctggaa

SEQ ID NO: 4193481 - DNA, 17 bp, Homo sapiens
atttgcctaattcctgg

SEQ ID NO: 4193482 - DNA, 20 bp, Homo sapiens
atttgcctaattcctggcat

SEQ ID NO: 4193483 - DNA, 20 bp, Homo sapiens
atttggaagagaggcacctg

SEQ ID NO: 4193484 - DNA, 14 bp, Homo sapiens
atttggacaaaatg

SEQ ID NO: 4193485 - DNA, 21 bp, Homo sapiens
atttggggcttgcatgccaaa

SEQ ID NO: 4193486 - DNA, 21 bp, Homo sapiens
atttggggtttgcttgtaaaa

SEQ ID NO: 4193487 - DNA, 17 bp, Homo sapiens
atttgtaatagatgttt

SEQ ID NO: 4193488 - DNA, 16 bp, Homo sapiens
cacctgccctgccctg

SEQ ID NO: 4193489 - DNA, 17 bp, Homo sapiens
cacctgccctgccctgc

SEQ ID NO: 4193490 - DNA, 22 bp, Homo sapiens
cacctgccctgccctgccacct

SEQ ID NO: 4193491 - DNA, 14 bp, Homo sapiens
cacctgctcttcta

SEQ ID NO: 4193492 - DNA, 23 bp, Homo sapiens
cacctggaattttcagtcatctc

SEQ ID NO: 4193493 - DNA, 14 bp, Homo sapiens
cacctggagcccgc

SEQ ID NO: 4193494 - DNA, 16 bp, Homo sapiens
caccttgccgagagag

SEQ ID NO: 4193495 - DNA, 18 bp, Homo sapiens
caccttgccgagagaggc

SEQ ID NO: 4193496 - DNA, 16 bp, Homo sapiens
caccttgcttttcagt

SEQ ID NO: 4193497 - DNA, 17 bp, Homo sapiens
caccttggactcctccc

SEQ ID NO: 4193498 - DNA, 18 bp, Homo sapiens
caccttggactcctccca

SEQ ID NO: 4193499 - DNA, 22 bp, Homo sapiens
caccttggactcctcccacaat

SEQ ID NO: 4193500 - DNA, 14 bp, Homo sapiens
cacctttgccacaa

SEQ ID NO: 4193501 - DNA, 17 bp, Homo sapiens
cacctttgggatcagcc

SEQ ID NO: 4193502 - DNA, 19 bp, Homo sapiens
cacctttgttttgcactga

SEQ ID NO: 4193503 - DNA, 19 bp, Homo sapiens
cacgactcttcctgcaaag

SEQ ID NO: 4193504 - DNA, 13 bp, Homo sapiens
cacgcaggaactc

SEQ ID NO: 4193505 - DNA, 19 bp, Homo sapiens
cacgcaggaactcccagca

SEQ ID NO: 4193506 - DNA, 16 bp, Homo sapiens
cacgccaacagccccc

SEQ ID NO: 4193507 - DNA, 18 bp, Homo sapiens
cacgccaccgctgccttt

SEQ ID NO: 4193508 - DNA, 19 bp, Homo sapiens
cacgcctatgatcccagca

SEQ ID NO: 4193509 - DNA, 18 bp, Homo sapiens
cacgcctgtaatcccagc

SEQ ID NO: 4193510 - DNA, 20 bp, Homo sapiens
cacgcctgtaatcccagcac

SEQ ID NO: 4193511 - DNA, 15 bp, Homo sapiens
cacggggtattttag

SEQ ID NO: 4193512 - DNA, 19 bp, Homo sapiens
cacgtatttatatttggaa

SEQ ID NO: 4193513 - DNA, 15 bp, Homo sapiens
cactaaaattccact

SEQ ID NO: 4193514 - DNA, 21 bp, Homo sapiens
cactaaaattccactcatgcc

SEQ ID NO: 4193515 - DNA, 18 bp, Homo sapiens
cactaacccgttttattc

SEQ ID NO: 4193516 - DNA, 20 bp, Homo sapiens
cactaagagctttatatatt

SEQ ID NO: 4193517 - DNA, 18 bp, Homo sapiens
cactaagctttctccttt

SEQ ID NO: 4193518 - DNA, 16 bp, Homo sapiens
cactacactccagcct

SEQ ID NO: 4193519 - DNA, 17 bp, Homo sapiens
cactacactccagcctg

SEQ ID NO: 4193520 - DNA, 19 bp, Homo sapiens
cactacatgtggtttatag

SEQ ID NO: 4193521 - DNA, 20 bp, Homo sapiens
cactacatgtggtttataga

SEQ ID NO: 4193522 - DNA, 20 bp, Homo sapiens
cactacctttgtccaggcct

SEQ ID NO: 4193523 - DNA, 16 bp, Homo sapiens
cactagacaagccaga

SEQ ID NO: 4193524 - DNA, 16 bp, Homo sapiens
cactagcctctccagg

SEQ ID NO: 4193525 - DNA, 21 bp, Homo sapiens
cactagcctctccaggaatgc

SEQ ID NO: 4193526 - DNA, 17 bp, Homo sapiens
cactaggactctgaggc

SEQ ID NO: 4193527 - DNA, 20 bp, Homo sapiens
cactaggttctaggtcctgg

SEQ ID NO: 4193528 - DNA, 22 bp, Homo sapiens
cactagttcagaggaagcacat

SEQ ID NO: 4193529 - DNA, 13 bp, Homo sapiens
cactcaaacaatc

SEQ ID NO: 4193530 - DNA, 15 bp, Homo sapiens
cactcaacaataaag

SEQ ID NO: 4193531 - DNA, 12 bp, Homo sapiens
cactcaagcctg

SEQ ID NO: 4193532 - DNA, 11 bp, Homo sapiens
cactcaaggcg

SEQ ID NO: 4193533 - DNA, 19 bp, Homo sapiens
cactcaaggcggtgcttga

SEQ ID NO: 4193534 - DNA, 21 bp, Homo sapiens
cactcacccatgtgccaaggt

SEQ ID NO: 4193535 - DNA, 21 bp, Homo sapiens
cactcagaaaagaaaaccatt

SEQ ID NO: 4193536 - DNA, 14 bp, Homo sapiens
cactcagcagcccc

SEQ ID NO: 4193537 - DNA, 13 bp, Homo sapiens
cactcattcctgt

SEQ ID NO: 4193538 - DNA, 18 bp, Homo sapiens
cactccaccccctccagc

SEQ ID NO: 4193539 - DNA, 13 bp, Homo sapiens
cactccagcctgg

SEQ ID NO: 4193540 - DNA, 15 bp, Homo sapiens
cactccagcctgggc

SEQ ID NO: 4193541 - DNA, 21 bp, Homo sapiens
cactccagcctgggcgacaga

SEQ ID NO: 4193542 - DNA, 22 bp, Homo sapiens
cactccccgcctgtcctgcctc

SEQ ID NO: 4193543 - DNA, 20 bp, Homo sapiens
cactccggcctgatgacaga

SEQ ID NO: 4193544 - DNA, 17 bp, Homo sapiens
cactccggtgtgcctgc

SEQ ID NO: 4193545 - DNA, 13 bp, Homo sapiens
cactctatgagtt

SEQ ID NO: 4193546 - DNA, 16 bp, Homo sapiens
cactctcccctccctc

SEQ ID NO: 4193547 - DNA, 21 bp, Homo sapiens
cactctcccctccctcttcct

SEQ ID NO: 4193548 - DNA, 22 bp, Homo sapiens
cactgatgttgttactgattct

SEQ ID NO: 4193549 - DNA, 20 bp, Homo sapiens
cactgcaaaccgccacctcc

SEQ ID NO: 4193550 - DNA, 16 bp, Homo sapiens
cactgcactccagcct

SEQ ID NO: 4193551 - DNA, 18 bp, Homo sapiens
cactgcactccagcctgg

SEQ ID NO: 4193552 - DNA, 13 bp, Homo sapiens
cactgcagggctg

SEQ ID NO: 4193553 - DNA, 11 bp, Homo sapiens
cactgccatgc

SEQ ID NO: 4193554 - DNA, 21 bp, Homo sapiens
cactgccctccgcccttccct

SEQ ID NO: 4193555 - DNA, 15 bp, Homo sapiens
cactgcctatatatg

SEQ ID NO: 4193556 - DNA, 16 bp, Homo sapiens
cactgctgtcagccaa

SEQ ID NO: 4193557 - DNA, 11 bp, Homo sapiens
cactggagccc

SEQ ID NO: 4193558 - DNA, 12 bp, Homo sapiens
cactggagccca

SEQ ID NO: 4193559 - DNA, 13 bp, Homo sapiens
cactggagcccag

SEQ ID NO: 4193560 - DNA, 12 bp, Homo sapiens
cactggcagagc

SEQ ID NO: 4193561 - DNA, 16 bp, Homo sapiens
cactggcagagcacag

SEQ ID NO: 4193562 - DNA, 17 bp, Homo sapiens
cactggcagagcacagc

SEQ ID NO: 4193563 - DNA, 18 bp, Homo sapiens
cactggcagagcacagcc

SEQ ID NO: 4193564 - DNA, 20 bp, Homo sapiens
cactggcagagcacagccca

SEQ ID NO: 4193565 - DNA, 13 bp, Homo sapiens
cactggccccacc

SEQ ID NO: 4193566 - DNA, 14 bp, Homo sapiens
cactggccccaccc

SEQ ID NO: 4193567 - DNA, 16 bp, Homo sapiens
cactggccccaccctc

SEQ ID NO: 4193568 - DNA, 15 bp, Homo sapiens
cactggccctggggc

SEQ ID NO: 4193569 - DNA, 23 bp, Homo sapiens
cactggcgcatcatatgcagtga

SEQ ID NO: 4193570 - DNA, 11 bp, Homo sapiens
cactgggagaa

SEQ ID NO: 4193571 - DNA, 14 bp, Homo sapiens
cactgggagaagag

SEQ ID NO: 4193572 - DNA, 15 bp, Homo sapiens
cactgggagaagaga

SEQ ID NO: 4193573 - DNA, 18 bp, Homo sapiens
cactgggagaagagaacc

SEQ ID NO: 4193574 - DNA, 15 bp, Homo sapiens
cactgggtgtggccc

SEQ ID NO: 4193575 - DNA, 16 bp, Homo sapiens
cactgggttctagaac

SEQ ID NO: 4193576 - DNA, 22 bp, Homo sapiens
cactggtccatttctcagtggc

SEQ ID NO: 4193577 - DNA, 17 bp, Homo sapiens
cactggttgtaagtaat

SEQ ID NO: 4193578 - DNA, 16 bp, Homo sapiens
cactgtatgctggacg

SEQ ID NO: 4193579 - DNA, 12 bp, Homo sapiens
cactgtctgcgt

SEQ ID NO: 4193580 - DNA, 13 bp, Homo sapiens
cactgtctgcgtg

SEQ ID NO: 4193581 - DNA, 14 bp, Homo sapiens
cactgtctgctgcc

SEQ ID NO: 4193582 - DNA, 14 bp, Homo sapiens
cactgttgaaaatt

SEQ ID NO: 4193583 - DNA, 16 bp, Homo sapiens
cactgttgaaaattat

SEQ ID NO: 4193584 - DNA, 17 bp, Homo sapiens
cactgttgaaaattatt

SEQ ID NO: 4193585 - DNA, 18 bp, Homo sapiens
cactgttgaaaattattt

SEQ ID NO: 4193586 - DNA, 18 bp, Homo sapiens
cactgttgtacacagtct

SEQ ID NO: 4193587 - DNA, 18 bp, Homo sapiens
cacttactttaatgcgaa

SEQ ID NO: 4193588 - DNA, 13 bp, Homo sapiens
cacttaggaagaa

SEQ ID NO: 4193589 - DNA, 18 bp, Homo sapiens
cacttagttttgggaggg

SEQ ID NO: 4193590 - DNA, 15 bp, Homo sapiens
cacttcttgaaacag

SEQ ID NO: 4193591 - DNA, 20 bp, Homo sapiens
cacttcttgaaacagcctgg

SEQ ID NO: 4193592 - DNA, 14 bp, Homo sapiens
cacttgattccttg

SEQ ID NO: 4193593 - DNA, 14 bp, Homo sapiens
cacttggctgctca

SEQ ID NO: 4193594 - DNA, 18 bp, Homo sapiens
cacttgggcccaggaggt

SEQ ID NO: 4193595 - DNA, 18 bp, Homo sapiens
cactttaaccctctcttc

SEQ ID NO: 4193596 - DNA, 19 bp, Homo sapiens
cactttaaccctctcttcc

SEQ ID NO: 4193597 - DNA, 19 bp, Homo sapiens
cactttcctacaaaatgga

SEQ ID NO: 4193598 - DNA, 20 bp, Homo sapiens
cacttttgatgtttgaagtt

SEQ ID NO: 4193599 - DNA, 14 bp, Homo sapiens
cagaaaacaaaact

SEQ ID NO: 4193600 - DNA, 14 bp, Homo sapiens
cagaaaagaaaacc

SEQ ID NO: 4193601 - DNA, 22 bp, Homo sapiens
cagaaaccaagtctacttcact

SEQ ID NO: 4193602 - DNA, 20 bp, Homo sapiens
cagaaagctttatatgtaat

SEQ ID NO: 4193603 - DNA, 22 bp, Homo sapiens
cagaaagtggccatgccaccct

SEQ ID NO: 4193604 - DNA, 15 bp, Homo sapiens
cagaaataggaagat

SEQ ID NO: 4193605 - DNA, 21 bp, Homo sapiens
cagaacatagacagaagaaac

SEQ ID NO: 4193606 - DNA, 20 bp, Homo sapiens
cagaacattgccttcctcgt

SEQ ID NO: 4193607 - DNA, 17 bp, Homo sapiens
cagaactgaggtcactg

SEQ ID NO: 4193608 - DNA, 14 bp, Homo sapiens
cagaagaaacaagg

SEQ ID NO: 4193609 - DNA, 19 bp, Homo sapiens
cagaagacactgcaaaggc

SEQ ID NO: 4193610 - DNA, 19 bp, Homo sapiens
cagaagaggttgggcttcc

SEQ ID NO: 4193611 - DNA, 13 bp, Homo sapiens
cagaagcacaaag

SEQ ID NO: 4193612 - DNA, 11 bp, Homo sapiens
cagaagcaggc

SEQ ID NO: 4193613 - DNA, 16 bp, Homo sapiens
cagaagcaggcagggc

SEQ ID NO: 4193614 - DNA, 20 bp, Homo sapiens
cagaaggaaggcagggagga

SEQ ID NO: 4193615 - DNA, 21 bp, Homo sapiens
cagaaggaagggcatccttct

SEQ ID NO: 4193616 - DNA, 23 bp, Homo sapiens
cagaaggcctcactcaagcctga

SEQ ID NO: 4193617 - DNA, 15 bp, Homo sapiens
cagaaggtattcctt

SEQ ID NO: 4193618 - DNA, 15 bp, Homo sapiens
cagaagtgaccaaat

SEQ ID NO: 4193619 - DNA, 19 bp, Homo sapiens
cagaagtgcatgaacaggg

SEQ ID NO: 4193620 - DNA, 16 bp, Homo sapiens
cagaagtggggctctg

SEQ ID NO: 4193621 - DNA, 18 bp, Homo sapiens
cagaagtggggctctggg

SEQ ID NO: 4193622 - DNA, 18 bp, Homo sapiens
cagaagtttgcactatct

SEQ ID NO: 4193623 - DNA, 24 bp, Homo sapiens
cattccagtaggaaatcaggcagt

SEQ ID NO: 4193624 - DNA, 19 bp, Homo sapiens
cattccttctggaggacac

SEQ ID NO: 4193625 - DNA, 21 bp, Homo sapiens
cattctccagtttcagaagca

SEQ ID NO: 4193626 - DNA, 18 bp, Homo sapiens
cattctgttttttctgta

SEQ ID NO: 4193627 - DNA, 18 bp, Homo sapiens
cattcttctggtgctact

SEQ ID NO: 4193628 - DNA, 17 bp, Homo sapiens
cattgaaaaaaatatat

SEQ ID NO: 4193629 - DNA, 20 bp, Homo sapiens
cattgaaagtaaaaaataac

SEQ ID NO: 4193630 - DNA, 22 bp, Homo sapiens
cattgaatggctatgtttttaa

SEQ ID NO: 4193631 - DNA, 17 bp, Homo sapiens
cattgggaccctccagt

SEQ ID NO: 4193632 - DNA, 18 bp, Homo sapiens
cattgtactccagcctgg

SEQ ID NO: 4193633 - DNA, 20 bp, Homo sapiens
cattgtactccagcctgggc

SEQ ID NO: 4193634 - DNA, 18 bp, Homo sapiens
cattgtctcagtgctggt

SEQ ID NO: 4193635 - DNA, 16 bp, Homo sapiens
catttacctcgaggct

SEQ ID NO: 4193636 - DNA, 17 bp, Homo sapiens
catttccatggctctgt

SEQ ID NO: 4193637 - DNA, 17 bp, Homo sapiens
catttctgaactgttac

SEQ ID NO: 4193638 - DNA, 17 bp, Homo sapiens
catttgaaagaaagtgt

SEQ ID NO: 4193639 - DNA, 15 bp, Homo sapiens
catttgacagtgtgg

SEQ ID NO: 4193640 - DNA, 19 bp, Homo sapiens
catttgcctaattcctggc

SEQ ID NO: 4193641 - DNA, 22 bp, Homo sapiens
catttgggaaattcagcttttg

SEQ ID NO: 4193642 - DNA, 14 bp, Homo sapiens
catttgggcacatt

SEQ ID NO: 4193643 - DNA, 20 bp, Homo sapiens
cattttacttagctggagaa

SEQ ID NO: 4193644 - DNA, 20 bp, Homo sapiens
cattttagacactgggagaa

SEQ ID NO: 4193645 - DNA, 13 bp, Homo sapiens
cattttcaataat

SEQ ID NO: 4193646 - DNA, 19 bp, Homo sapiens
cattttctgtgtgtacatg

SEQ ID NO: 4193647 - DNA, 20 bp, Homo sapiens
cattttgagtgactcgaggg

SEQ ID NO: 4193648 - DNA, 22 bp, Homo sapiens
cattttggaagttttcaggact

SEQ ID NO: 4193649 - DNA, 14 bp, Homo sapiens
cattttggtacttt

SEQ ID NO: 4193650 - DNA, 17 bp, Homo sapiens
catttttaatacattgg

SEQ ID NO: 4193651 - DNA, 21 bp, Homo sapiens
ccaaaacgtgggtatttcctg

SEQ ID NO: 4193652 - DNA, 22 bp, Homo sapiens
ccaaaacgtgggtatttcctgc

SEQ ID NO: 4193653 - DNA, 23 bp, Homo sapiens
ccaaaactctacaccctctgccc

SEQ ID NO: 4193654 - DNA, 18 bp, Homo sapiens
ccaaaagttttcctgaga

SEQ ID NO: 4193655 - DNA, 17 bp, Homo sapiens
ccaaaataccagagcct

SEQ ID NO: 4193656 - DNA, 15 bp, Homo sapiens
ccaaaataggtgctg

SEQ ID NO: 4193657 - DNA, 13 bp, Homo sapiens
ccaaacctggttc

SEQ ID NO: 4193658 - DNA, 18 bp, Homo sapiens
ccaaactgtgccctgcct

SEQ ID NO: 4193659 - DNA, 16 bp, Homo sapiens
ccaaagagcctggaga

SEQ ID NO: 4193660 - DNA, 17 bp, Homo sapiens
ccaaagagcctggagaa

SEQ ID NO: 4193661 - DNA, 23 bp, Homo sapiens
ccaaagccccttgctctcccctg

SEQ ID NO: 4193662 - DNA, 21 bp, Homo sapiens
ccaaataggctttagaagaga

SEQ ID NO: 4193663 - DNA, 16 bp, Homo sapiens
ccaaatccacaagcca

SEQ ID NO: 4193664 - DNA, 17 bp, Homo sapiens
ccaaatgcatggtgcag

SEQ ID NO: 4193665 - DNA, 18 bp, Homo sapiens
ccaaattatttgtgtaat

SEQ ID NO: 4193666 - DNA, 14 bp, Homo sapiens
ccaacaggtggcag

SEQ ID NO: 4193667 - DNA, 18 bp, Homo sapiens
ccaactgtgttcattaga

SEQ ID NO: 4193668 - DNA, 13 bp, Homo sapiens
ccaactttctgta

SEQ ID NO: 4193669 - DNA, 14 bp, Homo sapiens
ccaactttctgtaa

SEQ ID NO: 4193670 - DNA, 11 bp, Homo sapiens
ccaagaatctt

SEQ ID NO: 4193671 - DNA, 19 bp, Homo sapiens
ccaagagcagaggcagcga

SEQ ID NO: 4193672 - DNA, 21 bp, Homo sapiens
ccaagcagccgcagcgcagcc

SEQ ID NO: 4193673 - DNA, 11 bp, Homo sapiens
ccaagcctggc

SEQ ID NO: 4193674 - DNA, 13 bp, Homo sapiens
ccaaggaccaggt

SEQ ID NO: 4193675 - DNA, 21 bp, Homo sapiens
ccaaggtgctgatgtcaaagt

SEQ ID NO: 4193676 - DNA, 17 bp, Homo sapiens
ccaaggtgggctgagcc

SEQ ID NO: 4193677 - DNA, 17 bp, Homo sapiens
ccaagtcaacactcttc

SEQ ID NO: 4193678 - DNA, 20 bp, Homo sapiens
ccaagtcaacactcttcttg

SEQ ID NO: 4193679 - DNA, 23 bp, Homo sapiens
ccaagtcaacactcttcttgagc

SEQ ID NO: 4193680 - DNA, 17 bp, Homo sapiens
ccaagtctagctttcct

SEQ ID NO: 4193681 - DNA, 16 bp, Homo sapiens
ccaagtctcagaagag

SEQ ID NO: 4193682 - DNA, 14 bp, Homo sapiens
ccaagtggccctca

SEQ ID NO: 4193683 - DNA, 18 bp, Homo sapiens
ccaagttcctgcactcca

SEQ ID NO: 4193684 - DNA, 20 bp, Homo sapiens
ccaagttcctgcactccaga

SEQ ID NO: 4193685 - DNA, 13 bp, Homo sapiens
ccaataaagctgg

SEQ ID NO: 4193686 - DNA, 23 bp, Homo sapiens
ccaataaagctggacaagaagct

SEQ ID NO: 4193687 - DNA, 19 bp, Homo sapiens
ccaataggtgcaaaaataa

SEQ ID NO: 4193688 - DNA, 13 bp, Homo sapiens
ccaatcagagagc

SEQ ID NO: 4193689 - DNA, 17 bp, Homo sapiens
ccaatcagagagcctag

SEQ ID NO: 4193690 - DNA, 23 bp, Homo sapiens
ccaatctgagcaaacaccagtga

SEQ ID NO: 4193691 - DNA, 14 bp, Homo sapiens
ccaatgctcctgga

SEQ ID NO: 4193692 - DNA, 20 bp, Homo sapiens
ccaatggaatgtgatgttca

SEQ ID NO: 4193693 - DNA, 22 bp, Homo sapiens
ccaatggaatgtgatgttcatg

SEQ ID NO: 4193694 - DNA, 14 bp, Homo sapiens
ccaatgtggcaaga

SEQ ID NO: 4193695 - DNA, 19 bp, Homo sapiens
ccaattcacccagaaaaaa

SEQ ID NO: 4193696 - DNA, 15 bp, Homo sapiens
ccaatttaattccat

SEQ ID NO: 4193697 - DNA, 19 bp, Homo sapiens
ccacaaagccgtgcctttc

SEQ ID NO: 4193698 - DNA, 21 bp, Homo sapiens
ccacaagagatcagcagtggc

SEQ ID NO: 4193699 - DNA, 16 bp, Homo sapiens
ccacaagcctgagaac

SEQ ID NO: 4193700 - DNA, 23 bp, Homo sapiens
ccacaagcctgagaactgaattt

SEQ ID NO: 4193701 - DNA, 20 bp, Homo sapiens
ccacaagccttactcacctc

SEQ ID NO: 4193702 - DNA, 20 bp, Homo sapiens
ccacaatctggcttagtgcc

SEQ ID NO: 4193703 - DNA, 18 bp, Homo sapiens
ccacacacgcaggaactc

SEQ ID NO: 4193704 - DNA, 19 bp, Homo sapiens
ccacaccaatcagagagcc

SEQ ID NO: 4193705 - DNA, 11 bp, Homo sapiens
ccacagagcct

SEQ ID NO: 4193706 - DNA, 19 bp, Homo sapiens
ccacagatgtgtctgggag

SEQ ID NO: 4193707 - DNA, 23 bp, Homo sapiens
ccacagatgtgtctgggagagcc

SEQ ID NO: 4193708 - DNA, 19 bp, Homo sapiens
ccacagcaattggctcctc

SEQ ID NO: 4193709 - DNA, 16 bp, Homo sapiens
ccacattggacttcct

SEQ ID NO: 4193710 - DNA, 12 bp, Homo sapiens
ccaccaccttgg

SEQ ID NO: 4193711 - DNA, 20 bp, Homo sapiens
ccaccactaggactctgagg

SEQ ID NO: 4193712 - DNA, 20 bp, Homo sapiens
ccaccagacccacctggagc

SEQ ID NO: 4193713 - DNA, 18 bp, Homo sapiens
ccacccagggctccctcc

SEQ ID NO: 4193714 - DNA, 13 bp, Homo sapiens
ccaccccagagtt

SEQ ID NO: 4193715 - DNA, 18 bp, Homo sapiens
ccaccccctccagctcca

SEQ ID NO: 4193716 - DNA, 19 bp, Homo sapiens
ccaccctcgtggacacctg

SEQ ID NO: 4193717 - DNA, 20 bp, Homo sapiens
ccaccctcgtggacacctgc

SEQ ID NO: 4193718 - DNA, 11 bp, Homo sapiens
ccaccctggaa

SEQ ID NO: 4193719 - DNA, 13 bp, Homo sapiens
ccacctctcaata

SEQ ID NO: 4193720 - DNA, 23 bp, Homo sapiens
ccacctctcaatattcaataaag

SEQ ID NO: 4193721 - DNA, 13 bp, Homo sapiens
ccacctcttcctt

SEQ ID NO: 4193722 - DNA, 14 bp, Homo sapiens
ccacctggagcccg

SEQ ID NO: 4193723 - DNA, 16 bp, Homo sapiens
ccacctggagcccgct

SEQ ID NO: 4193724 - DNA, 19 bp, Homo sapiens
ccacctggagcccgcttca

SEQ ID NO: 4193725 - DNA, 14 bp, Homo sapiens
ccacctgtctgtct

SEQ ID NO: 4193726 - DNA, 16 bp, Homo sapiens
ccacctgtctgtctgt

SEQ ID NO: 4193727 - DNA, 22 bp, Homo sapiens
ccacctgtctgtctgtctgtcc

SEQ ID NO: 4193728 - DNA, 11 bp, Homo sapiens
ccaccttcccc

SEQ ID NO: 4193729 - DNA, 15 bp, Homo sapiens
ccaccttccccagac

SEQ ID NO: 4193730 - DNA, 20 bp, Homo sapiens
ccaccttccccagactcagc

SEQ ID NO: 4193731 - DNA, 11 bp, Homo sapiens
ccaccttccct

SEQ ID NO: 4193732 - DNA, 20 bp, Homo sapiens
ccacctttgggatcagcctc

SEQ ID NO: 4193733 - DNA, 16 bp, Homo sapiens
ccacggggagggggac

SEQ ID NO: 4193734 - DNA, 17 bp, Homo sapiens
ccacggggatcacagcg

SEQ ID NO: 4193735 - DNA, 17 bp, Homo sapiens
ccactaagctttctcct

SEQ ID NO: 4193736 - DNA, 19 bp, Homo sapiens
ccactacactccagcctga

SEQ ID NO: 4193737 - DNA, 20 bp, Homo sapiens
ccactacactccagcctgag

SEQ ID NO: 4193738 - DNA, 22 bp, Homo sapiens
ccactacactccagcctgagca

SEQ ID NO: 4193739 - DNA, 18 bp, Homo sapiens
ccactaggttctaggtcc

SEQ ID NO: 4193740 - DNA, 21 bp, Homo sapiens
ccactatagtttaatactcag

SEQ ID NO: 4193741 - DNA, 15 bp, Homo sapiens
ccactcctcttattt

SEQ ID NO: 4193742 - DNA, 20 bp, Homo sapiens
ccactcgggaggctgagaca

SEQ ID NO: 4193743 - DNA, 13 bp, Homo sapiens
ccactctcccctc

SEQ ID NO: 4193744 - DNA, 22 bp, Homo sapiens
ccactctcccctccctcttcct

SEQ ID NO: 4193745 - DNA, 23 bp, Homo sapiens
ccactctcccctccctcttcctt

SEQ ID NO: 4193746 - DNA, 14 bp, Homo sapiens
ccactgaagctggg

SEQ ID NO: 4193747 - DNA, 15 bp, Homo sapiens
ccactgaagctggga

SEQ ID NO: 4193748 - DNA, 14 bp, Homo sapiens
ccactgcactccag

SEQ ID NO: 4193749 - DNA, 20 bp, Homo sapiens
ccactggacttgagcttggc

SEQ ID NO: 4193750 - DNA, 21 bp, Homo sapiens
ccactgtaggggttggggttt

SEQ ID NO: 4193751 - DNA, 14 bp, Homo sapiens
ccactgtccgcctc

SEQ ID NO: 4193752 - DNA, 18 bp, Homo sapiens
ccacttagttttgggagg

SEQ ID NO: 4193753 - DNA, 23 bp, Homo sapiens
ccacttcccccgattcagagact

SEQ ID NO: 4193754 - DNA, 15 bp, Homo sapiens
ccacttggctgctca

SEQ ID NO: 4193755 - DNA, 21 bp, Homo sapiens
ccactttggtacatggccagt

SEQ ID NO: 4193756 - DNA, 16 bp, Homo sapiens
ccagaaaacaaaactg

SEQ ID NO: 4193757 - DNA, 18 bp, Homo sapiens
cccccatgccctccctgc

SEQ ID NO: 4193758 - DNA, 20 bp, Homo sapiens
ccccccttgaatctgcaggg

SEQ ID NO: 4193759 - DNA, 13 bp, Homo sapiens
cccccgctccaga

SEQ ID NO: 4193760 - DNA, 11 bp, Homo sapiens
ccccctcattc

SEQ ID NO: 4193761 - DNA, 20 bp, Homo sapiens
ccccctccaggcatgctggc

SEQ ID NO: 4193762 - DNA, 14 bp, Homo sapiens
ccccctctaacccc

SEQ ID NO: 4193763 - DNA, 12 bp, Homo sapiens
ccccctggagag

SEQ ID NO: 4193764 - DNA, 11 bp, Homo sapiens
ccccctgggct

SEQ ID NO: 4193765 - DNA, 15 bp, Homo sapiens
ccccgctccagatct

SEQ ID NO: 4193766 - DNA, 14 bp, Homo sapiens
ccccggcctcagca

SEQ ID NO: 4193767 - DNA, 22 bp, Homo sapiens
ccccgtgtcctctccctgccaa

SEQ ID NO: 4193768 - DNA, 17 bp, Homo sapiens
cccctaacctggcttat

SEQ ID NO: 4193769 - DNA, 12 bp, Homo sapiens
cccctcccaggg

SEQ ID NO: 4193770 - DNA, 14 bp, Homo sapiens
cccctcccagggcc

SEQ ID NO: 4193771 - DNA, 20 bp, Homo sapiens
cccctccctcttccttcccc

SEQ ID NO: 4193772 - DNA, 17 bp, Homo sapiens
cccctcgtgtgactctc

SEQ ID NO: 4193773 - DNA, 23 bp, Homo sapiens
cccctcgtgtgactctcttggat

SEQ ID NO: 4193774 - DNA, 19 bp, Homo sapiens
cccctctcctccgccaccc

SEQ ID NO: 4193775 - DNA, 14 bp, Homo sapiens
cccctgcacctgct

SEQ ID NO: 4193776 - DNA, 23 bp, Homo sapiens
cccctgggctctgccccagctct

SEQ ID NO: 4193777 - DNA, 21 bp, Homo sapiens
cccctggtcctgcactgtccc

SEQ ID NO: 4193778 - DNA, 19 bp, Homo sapiens
cccctggtggacagtcctg

SEQ ID NO: 4193779 - DNA, 20 bp, Homo sapiens
cccctggtggacagtcctgg

SEQ ID NO: 4193780 - DNA, 23 bp, Homo sapiens
cccctggtggacagtcctgggag

SEQ ID NO: 4193781 - DNA, 15 bp, Homo sapiens
ccccttatccaggac

SEQ ID NO: 4193782 - DNA, 14 bp, Homo sapiens
ccccttcctttcct

SEQ ID NO: 4193783 - DNA, 21 bp, Homo sapiens
ccccttcctttcctctgcagc

SEQ ID NO: 4193784 - DNA, 20 bp, Homo sapiens
ccccttgccaaattccatgt

SEQ ID NO: 4193785 - DNA, 16 bp, Homo sapiens
cccgaaagctgagacc

SEQ ID NO: 4193786 - DNA, 13 bp, Homo sapiens
cccgacagcccag

SEQ ID NO: 4193787 - DNA, 14 bp, Homo sapiens
cccgactcctcaaa

SEQ ID NO: 4193788 - DNA, 22 bp, Homo sapiens
cccgagctactctcttgccagc

SEQ ID NO: 4193789 - DNA, 14 bp, Homo sapiens
cccgagggagctgc

SEQ ID NO: 4193790 - DNA, 18 bp, Homo sapiens
cccgattcagagacttag

SEQ ID NO: 4193791 - DNA, 12 bp, Homo sapiens
cccgctccagat

SEQ ID NO: 4193792 - DNA, 18 bp, Homo sapiens
cccggatgtgtgtctcac

SEQ ID NO: 4193793 - DNA, 14 bp, Homo sapiens
cccggattctggga

SEQ ID NO: 4193794 - DNA, 14 bp, Homo sapiens
cccgtgtcctctcc

SEQ ID NO: 4193795 - DNA, 19 bp, Homo sapiens
ccctaggagggaaggagct

SEQ ID NO: 4193796 - DNA, 23 bp, Homo sapiens
ccctatactgcttggagctgagc

SEQ ID NO: 4193797 - DNA, 22 bp, Homo sapiens
ccctcaatccccaagctggcag

SEQ ID NO: 4193798 - DNA, 15 bp, Homo sapiens
ccctcagtgggctcc

SEQ ID NO: 4193799 - DNA, 23 bp, Homo sapiens
ccctcataagtttgtttaaacac

SEQ ID NO: 4193800 - DNA, 16 bp, Homo sapiens
ccctccacagccgcag

SEQ ID NO: 4193801 - DNA, 18 bp, Homo sapiens
ccctccaccgcagaagga

SEQ ID NO: 4193802 - DNA, 19 bp, Homo sapiens
ccctccagagacaggaaag

SEQ ID NO: 4193803 - DNA, 13 bp, Homo sapiens
ccctccagctcca

SEQ ID NO: 4193804 - DNA, 14 bp, Homo sapiens
ccctccagctccag

SEQ ID NO: 4193805 - DNA, 19 bp, Homo sapiens
ccctccaggcatgctggcc

SEQ ID NO: 4193806 - DNA, 18 bp, Homo sapiens
ccctccagtgctggattt

SEQ ID NO: 4193807 - DNA, 17 bp, Homo sapiens
ccctccccacagtcctc

SEQ ID NO: 4193808 - DNA, 18 bp, Homo sapiens
ccctccccacagtcctca

SEQ ID NO: 4193809 - DNA, 21 bp, Homo sapiens
ccctccctggcatgtcagagc

SEQ ID NO: 4193810 - DNA, 14 bp, Homo sapiens
ccctccgcccttcc

SEQ ID NO: 4193811 - DNA, 21 bp, Homo sapiens
ccctccgccttcactccggtg

SEQ ID NO: 4193812 - DNA, 22 bp, Homo sapiens
ccctccgccttcactccggtgt

SEQ ID NO: 4193813 - DNA, 17 bp, Homo sapiens
ccctcctggagcatccc

SEQ ID NO: 4193814 - DNA, 11 bp, Homo sapiens
ccctccttccc

SEQ ID NO: 4193815 - DNA, 19 bp, Homo sapiens
ccctctgaatggtccaggg

SEQ ID NO: 4193816 - DNA, 18 bp, Homo sapiens
ccctctgttgccaggcta

SEQ ID NO: 4193817 - DNA, 17 bp, Homo sapiens
ccctcttccttccccca

SEQ ID NO: 4193818 - DNA, 22 bp, Homo sapiens
ccctcttgacccatctccccct

SEQ ID NO: 4193819 - DNA, 12 bp, Homo sapiens
ccctctttctac

SEQ ID NO: 4193820 - DNA, 22 bp, Homo sapiens
ccctctttctacattctcatct

SEQ ID NO: 4193821 - DNA, 13 bp, Homo sapiens
ccctgacactgtc

SEQ ID NO: 4193822 - DNA, 13 bp, Homo sapiens
ccctgactctctg

SEQ ID NO: 4193823 - DNA, 18 bp, Homo sapiens
ccctgactctctgtgacc

SEQ ID NO: 4193824 - DNA, 14 bp, Homo sapiens
ccctgagggccctt

SEQ ID NO: 4193825 - DNA, 23 bp, Homo sapiens
ccctgagggcccttcccaacctc

SEQ ID NO: 4193826 - DNA, 22 bp, Homo sapiens
ccctgagtggatctccaaggac

SEQ ID NO: 4193827 - DNA, 12 bp, Homo sapiens
ccctgcaagaca

SEQ ID NO: 4193828 - DNA, 18 bp, Homo sapiens
ccctgcaagacacaggct

SEQ ID NO: 4193829 - DNA, 12 bp, Homo sapiens
ccctgcagcctg

SEQ ID NO: 4193830 - DNA, 14 bp, Homo sapiens
ccctgccacctgtc

SEQ ID NO: 4193831 - DNA, 16 bp, Homo sapiens
ccctgccacctgtctg

SEQ ID NO: 4193832 - DNA, 17 bp, Homo sapiens
ccctgccacctgtctgt

SEQ ID NO: 4193833 - DNA, 13 bp, Homo sapiens
ccctgccctgctg

SEQ ID NO: 4193834 - DNA, 17 bp, Homo sapiens
ccctgcgaaggggccct

SEQ ID NO: 4193835 - DNA, 21 bp, Homo sapiens
ccctgctgccaggctcccact

SEQ ID NO: 4193836 - DNA, 22 bp, Homo sapiens
ccctgctgccgcctcccagcct

SEQ ID NO: 4193837 - DNA, 22 bp, Homo sapiens
ccctgctgcggccagcctgact

SEQ ID NO: 4193838 - DNA, 13 bp, Homo sapiens
ccctggagagaag

SEQ ID NO: 4193839 - DNA, 22 bp, Homo sapiens
ccctggagtcccctgggcctgg

SEQ ID NO: 4193840 - DNA, 20 bp, Homo sapiens
ccctggcaggatgaccctgc

SEQ ID NO: 4193841 - DNA, 23 bp, Homo sapiens
ccctggcatgtcagagccaggct

SEQ ID NO: 4193842 - DNA, 19 bp, Homo sapiens
ccctggctctcagaaggta

SEQ ID NO: 4193843 - DNA, 19 bp, Homo sapiens
ccctggctgaccccaaaga

SEQ ID NO: 4193844 - DNA, 23 bp, Homo sapiens
ccctggctgaccccaaagagcct

SEQ ID NO: 4193845 - DNA, 12 bp, Homo sapiens
ccctgggctctg

SEQ ID NO: 4193846 - DNA, 13 bp, Homo sapiens
ccctgggctctgc

SEQ ID NO: 4193847 - DNA, 16 bp, Homo sapiens
ccctgggctctgcccc

SEQ ID NO: 4193848 - DNA, 13 bp, Homo sapiens
ccctggtcctgca

SEQ ID NO: 4193849 - DNA, 17 bp, Homo sapiens
ccctggtccttccaggc

SEQ ID NO: 4193850 - DNA, 18 bp, Homo sapiens
ccctgtgactatggctct

SEQ ID NO: 4193851 - DNA, 16 bp, Homo sapiens
ccctgttatctgctag

SEQ ID NO: 4193852 - DNA, 12 bp, Homo sapiens
cccttatccagg

SEQ ID NO: 4193853 - DNA, 16 bp, Homo sapiens
cccttatccaggactc

SEQ ID NO: 4193854 - DNA, 13 bp, Homo sapiens
cccttatcctgag

SEQ ID NO: 4193855 - DNA, 16 bp, Homo sapiens
cccttccctgacactg

SEQ ID NO: 4193856 - DNA, 16 bp, Homo sapiens
cccttgaatctgcagg

SEQ ID NO: 4193857 - DNA, 17 bp, Homo sapiens
cccttgacaactggcag

SEQ ID NO: 4193858 - DNA, 21 bp, Homo sapiens
cccttgacaactggcaggcag

SEQ ID NO: 4193859 - DNA, 20 bp, Homo sapiens
cccttggaaagttcagccag

SEQ ID NO: 4193860 - DNA, 21 bp, Homo sapiens
cccttggaaagttcagccaga

SEQ ID NO: 4193861 - DNA, 16 bp, Homo sapiens
cccttggacttgagga

SEQ ID NO: 4193862 - DNA, 14 bp, Homo sapiens
cccttgtgtcaaga

SEQ ID NO: 4193863 - DNA, 13 bp, Homo sapiens
ccctttcccccac

SEQ ID NO: 4193864 - DNA, 18 bp, Homo sapiens
ccctttctggaccagatc

SEQ ID NO: 4193865 - DNA, 21 bp, Homo sapiens
ccctttgcttcccaacctaaa

SEQ ID NO: 4193866 - DNA, 11 bp, Homo sapiens
ccgaaagctga

SEQ ID NO: 4193867 - DNA, 14 bp, Homo sapiens
ccgacagcccagcc

SEQ ID NO: 4193868 - DNA, 19 bp, Homo sapiens
ccgacagcccagcctagcc

SEQ ID NO: 4193869 - DNA, 18 bp, Homo sapiens
ccgaccatcgtccagccc

SEQ ID NO: 4193870 - DNA, 19 bp, Homo sapiens
ccgaccatcgtccagccct

SEQ ID NO: 4193871 - DNA, 20 bp, Homo sapiens
ccgaccatcgtccagccctc

SEQ ID NO: 4193872 - DNA, 21 bp, Homo sapiens
ccgaccatcgtccagccctcc

SEQ ID NO: 4193873 - DNA, 14 bp, Homo sapiens
ccgaccccatctca

SEQ ID NO: 4193874 - DNA, 14 bp, Homo sapiens
ccgacccctgtcca

SEQ ID NO: 4193875 - DNA, 15 bp, Homo sapiens
ccgacccctgtccag

SEQ ID NO: 4193876 - DNA, 14 bp, Homo sapiens
ccgactctaagctg

SEQ ID NO: 4193877 - DNA, 20 bp, Homo sapiens
ccgactctaagctgtgtgca

SEQ ID NO: 4193878 - DNA, 17 bp, Homo sapiens
ccgagacggctggacct

SEQ ID NO: 4193879 - DNA, 20 bp, Homo sapiens
ccgagcaaagtctaaagttt

SEQ ID NO: 4193880 - DNA, 23 bp, Homo sapiens
ccgagctactctcttgccagcat

SEQ ID NO: 4193881 - DNA, 17 bp, Homo sapiens
ccgagggagctgctggc

SEQ ID NO: 4193882 - DNA, 15 bp, Homo sapiens
ccgcacttggaaagg

SEQ ID NO: 4193883 - DNA, 21 bp, Homo sapiens
ccgcagccagccggtgcctgg

SEQ ID NO: 4193884 - DNA, 22 bp, Homo sapiens
ccgcagccagccggtgcctggc

SEQ ID NO: 4193885 - DNA, 15 bp, Homo sapiens
ccgcagggacgggga

SEQ ID NO: 4193886 - DNA, 16 bp, Homo sapiens
ccgccaaacactccac

SEQ ID NO: 4193887 - DNA, 18 bp, Homo sapiens
ccgcccttccctgacact

SEQ ID NO: 4193888 - DNA, 17 bp, Homo sapiens
ccgcctctgcccgcaga

SEQ ID NO: 4193889 - DNA, 15 bp, Homo sapiens
ccgcctgcagaggac

SEQ ID NO: 4193890 - DNA, 16 bp, Homo sapiens
ccgcctgtcctgcctc

SEQ ID NO: 4193891 - DNA, 20 bp, Homo sapiens
ccgcggtaggtaagggccgc

SEQ ID NO: 4193892 - DNA, 14 bp, Homo sapiens
ctaatgtaaagatt

SEQ ID NO: 4193893 - DNA, 14 bp, Homo sapiens
ctaattcccagagt

SEQ ID NO: 4193894 - DNA, 16 bp, Homo sapiens
ctaattcccagagtgt

SEQ ID NO: 4193895 - DNA, 21 bp, Homo sapiens
ctaatttttttgtattttagc

SEQ ID NO: 4193896 - DNA, 13 bp, Homo sapiens
ctacaaaatggag

SEQ ID NO: 4193897 - DNA, 15 bp, Homo sapiens
ctacaaggacaatgc

SEQ ID NO: 4193898 - DNA, 15 bp, Homo sapiens
ctacaccctctgccc

SEQ ID NO: 4193899 - DNA, 20 bp, Homo sapiens
ctacacccttggacttgagg

SEQ ID NO: 4193900 - DNA, 16 bp, Homo sapiens
ctacagacttctccag

SEQ ID NO: 4193901 - DNA, 18 bp, Homo sapiens
ctaccaccttccctcttt

SEQ ID NO: 4193902 - DNA, 20 bp, Homo sapiens
ctaccaccttccctctttct

SEQ ID NO: 4193903 - DNA, 20 bp, Homo sapiens
ctaccatttgtgttttgaaa

SEQ ID NO: 4193904 - DNA, 23 bp, Homo sapiens
ctacccaggaggctgaggcagga

SEQ ID NO: 4193905 - DNA, 18 bp, Homo sapiens
ctacccccagctgtgctt

SEQ ID NO: 4193906 - DNA, 19 bp, Homo sapiens
ctacccccagctgtgctta

SEQ ID NO: 4193907 - DNA, 22 bp, Homo sapiens
ctacctcactattcaagtatta

SEQ ID NO: 4193908 - DNA, 17 bp, Homo sapiens
ctacctctgagaagaca

SEQ ID NO: 4193909 - DNA, 22 bp, Homo sapiens
ctacctttatagctctcatcac

SEQ ID NO: 4193910 - DNA, 20 bp, Homo sapiens
ctacctttttttctctccta

SEQ ID NO: 4193911 - DNA, 16 bp, Homo sapiens
ctactcagaagcctga

SEQ ID NO: 4193912 - DNA, 21 bp, Homo sapiens
ctactcagaagcctgaggctg

SEQ ID NO: 4193913 - DNA, 12 bp, Homo sapiens
ctactcagcagt

SEQ ID NO: 4193914 - DNA, 16 bp, Homo sapiens
ctactcattgtctcag

SEQ ID NO: 4193915 - DNA, 19 bp, Homo sapiens
ctactcattgtctcagtgc

SEQ ID NO: 4193916 - DNA, 15 bp, Homo sapiens
ctactctcttgccag

SEQ ID NO: 4193917 - DNA, 18 bp, Homo sapiens
ctactctcttgccagcat

SEQ ID NO: 4193918 - DNA, 19 bp, Homo sapiens
ctactcttcctttctaaat

SEQ ID NO: 4193919 - DNA, 21 bp, Homo sapiens
ctactgccgtcagtgctgtgc

SEQ ID NO: 4193920 - DNA, 21 bp, Homo sapiens
ctactgtaagcaagaaaaata

SEQ ID NO: 4193921 - DNA, 18 bp, Homo sapiens
ctagaacatccctgggca

SEQ ID NO: 4193922 - DNA, 13 bp, Homo sapiens
ctagaacttcaaa

SEQ ID NO: 4193923 - DNA, 22 bp, Homo sapiens
ctagaatagccatgtactataa

SEQ ID NO: 4193924 - DNA, 17 bp, Homo sapiens
ctagaatttgtattttg

SEQ ID NO: 4193925 - DNA, 19 bp, Homo sapiens
ctagaatttgtattttgct

SEQ ID NO: 4193926 - DNA, 13 bp, Homo sapiens
ctagacaagccag

SEQ ID NO: 4193927 - DNA, 16 bp, Homo sapiens
ctagactgtgtatgtc

SEQ ID NO: 4193928 - DNA, 15 bp, Homo sapiens
ctagactgttacttt

SEQ ID NO: 4193929 - DNA, 18 bp, Homo sapiens
ctagactgttactttggc

SEQ ID NO: 4193930 - DNA, 12 bp, Homo sapiens
ctagactttctg

SEQ ID NO: 4193931 - DNA, 19 bp, Homo sapiens
ctagagaagaggctggtgc

SEQ ID NO: 4193932 - DNA, 14 bp, Homo sapiens
ctagagcactgcca

SEQ ID NO: 4193933 - DNA, 15 bp, Homo sapiens
ctagagcactgccac

SEQ ID NO: 4193934 - DNA, 18 bp, Homo sapiens
ctagagcactgccaccag

SEQ ID NO: 4193935 - DNA, 19 bp, Homo sapiens
ctagaggtgagaaatttaa

SEQ ID NO: 4193936 - DNA, 12 bp, Homo sapiens
ctagcagaaaat

SEQ ID NO: 4193937 - DNA, 23 bp, Homo sapiens
ctagcagagcaggggcagggtga

SEQ ID NO: 4193938 - DNA, 15 bp, Homo sapiens
ctagcattttcttga

SEQ ID NO: 4193939 - DNA, 21 bp, Homo sapiens
ctagccgggccatgctttcct

SEQ ID NO: 4193940 - DNA, 17 bp, Homo sapiens
ctagcctaagtgtggag

SEQ ID NO: 4193941 - DNA, 15 bp, Homo sapiens
ctaggaaagggaagc

SEQ ID NO: 4193942 - DNA, 18 bp, Homo sapiens
ctaggaaagggaagcctg

SEQ ID NO: 4193943 - DNA, 12 bp, Homo sapiens
ctaggactctga

SEQ ID NO: 4193944 - DNA, 17 bp, Homo sapiens
ctaggagggaaggagct

SEQ ID NO: 4193945 - DNA, 18 bp, Homo sapiens
ctaggagggaaggagctg

SEQ ID NO: 4193946 - DNA, 15 bp, Homo sapiens
ctaggattcctcccc

SEQ ID NO: 4193947 - DNA, 23 bp, Homo sapiens
ctaggattcctcccccagagcca

SEQ ID NO: 4193948 - DNA, 14 bp, Homo sapiens
ctaggattgggcct

SEQ ID NO: 4193949 - DNA, 20 bp, Homo sapiens
ctaggcagttcaaagcagga

SEQ ID NO: 4193950 - DNA, 14 bp, Homo sapiens
ctaggcatgcctgg

SEQ ID NO: 4193951 - DNA, 18 bp, Homo sapiens
ctaggcgagtgccaggac

SEQ ID NO: 4193952 - DNA, 24 bp, Homo sapiens
ctaggcgattttgtctaccatttg

SEQ ID NO: 4193953 - DNA, 14 bp, Homo sapiens
ctagggagccatgt

SEQ ID NO: 4193954 - DNA, 16 bp, Homo sapiens
ctagggagtggtcttt

SEQ ID NO: 4193955 - DNA, 14 bp, Homo sapiens
ctaggggctggtcc

SEQ ID NO: 4193956 - DNA, 15 bp, Homo sapiens
ctagtagaaagaaaa

SEQ ID NO: 4193957 - DNA, 18 bp, Homo sapiens
ctagtcttgctttgctgt

SEQ ID NO: 4193958 - DNA, 15 bp, Homo sapiens
ctagtgaatgtgcct

SEQ ID NO: 4193959 - DNA, 18 bp, Homo sapiens
ctagtgacttcctggtga

SEQ ID NO: 4193960 - DNA, 14 bp, Homo sapiens
ctagtttattttgt

SEQ ID NO: 4193961 - DNA, 12 bp, Homo sapiens
ctataaaacaaa

SEQ ID NO: 4193962 - DNA, 16 bp, Homo sapiens
ctataaccagacacat

SEQ ID NO: 4193963 - DNA, 12 bp, Homo sapiens
ctatacaacaat

SEQ ID NO: 4193964 - DNA, 13 bp, Homo sapiens
ctatagccaaaaa

SEQ ID NO: 4193965 - DNA, 16 bp, Homo sapiens
ctataggctggagaag

SEQ ID NO: 4193966 - DNA, 17 bp, Homo sapiens
ctataggctggagaagc

SEQ ID NO: 4193967 - DNA, 22 bp, Homo sapiens
ctataggtcatgatttctgtga

SEQ ID NO: 4193968 - DNA, 14 bp, Homo sapiens
ctatatatgtaaat

SEQ ID NO: 4193969 - DNA, 20 bp, Homo sapiens
ctatatgatcctgaaaaaat

SEQ ID NO: 4193970 - DNA, 13 bp, Homo sapiens
ctatatgatttat

SEQ ID NO: 4193971 - DNA, 19 bp, Homo sapiens
ctatattccgggtgccatt

SEQ ID NO: 4193972 - DNA, 20 bp, Homo sapiens
ctatattccgggtgccattc

SEQ ID NO: 4193973 - DNA, 14 bp, Homo sapiens
ctatcacacagtgg

SEQ ID NO: 4193974 - DNA, 14 bp, Homo sapiens
ctatcatggagtga

SEQ ID NO: 4193975 - DNA, 22 bp, Homo sapiens
ctatccaatgaatgatcattga

SEQ ID NO: 4193976 - DNA, 12 bp, Homo sapiens
ctatccatcctg

SEQ ID NO: 4193977 - DNA, 16 bp, Homo sapiens
ctatcctctgtatata

SEQ ID NO: 4193978 - DNA, 21 bp, Homo sapiens
ctatccttggagagcagctgg

SEQ ID NO: 4193979 - DNA, 13 bp, Homo sapiens
ctatgaaatgaaa

SEQ ID NO: 4193980 - DNA, 18 bp, Homo sapiens
ctatgacaggctgaaagc

SEQ ID NO: 4193981 - DNA, 19 bp, Homo sapiens
ctatgctttgaaacagaaa

SEQ ID NO: 4193982 - DNA, 15 bp, Homo sapiens
ctatggtcagttgag

SEQ ID NO: 4193983 - DNA, 17 bp, Homo sapiens
ctatggtgctctgtcta

SEQ ID NO: 4193984 - DNA, 18 bp, Homo sapiens
ctatgtatgttaatttat

SEQ ID NO: 4193985 - DNA, 13 bp, Homo sapiens
ctatgtgacagac

SEQ ID NO: 4193986 - DNA, 14 bp, Homo sapiens
ctatgtttttaatg

SEQ ID NO: 4193987 - DNA, 17 bp, Homo sapiens
ctattacatgtgttagt

SEQ ID NO: 4193988 - DNA, 13 bp, Homo sapiens
ctattacatttta

SEQ ID NO: 4193989 - DNA, 21 bp, Homo sapiens
ctattagctgggatatgtagt

SEQ ID NO: 4193990 - DNA, 20 bp, Homo sapiens
ctatttaaaaagctctttca

SEQ ID NO: 4193991 - DNA, 15 bp, Homo sapiens
ctatttacatataat

SEQ ID NO: 4193992 - DNA, 14 bp, Homo sapiens
ctatttatgtaaaa

SEQ ID NO: 4193993 - DNA, 21 bp, Homo sapiens
ctatttctagtagaaagaaaa

SEQ ID NO: 4193994 - DNA, 15 bp, Homo sapiens
ctattttttaataaa

SEQ ID NO: 4193995 - DNA, 12 bp, Homo sapiens
ctcaaaaagttt

SEQ ID NO: 4193996 - DNA, 20 bp, Homo sapiens
ctcaaaacttaacatattta

SEQ ID NO: 4193997 - DNA, 12 bp, Homo sapiens
ctcaaacacaca

SEQ ID NO: 4193998 - DNA, 13 bp, Homo sapiens
ctcaaacacacaa

SEQ ID NO: 4193999 - DNA, 14 bp, Homo sapiens
ctcaaaccctgtgg

SEQ ID NO: 4194000 - DNA, 19 bp, Homo sapiens
ctcaaagcaagcattcaga

SEQ ID NO: 4194001 - DNA, 12 bp, Homo sapiens
ctcaaatccttg

SEQ ID NO: 4194002 - DNA, 17 bp, Homo sapiens
ctcaacaacaattttaa

SEQ ID NO: 4194003 - DNA, 14 bp, Homo sapiens
ctcaacaataaaga

SEQ ID NO: 4194004 - DNA, 16 bp, Homo sapiens
ctcaatattcaataaa

SEQ ID NO: 4194005 - DNA, 14 bp, Homo sapiens
ctcaatcactgctc

SEQ ID NO: 4194006 - DNA, 14 bp, Homo sapiens
ctcaatgtgaccag

SEQ ID NO: 4194007 - DNA, 18 bp, Homo sapiens
ctcaatgtgaccaggggt

SEQ ID NO: 4194008 - DNA, 22 bp, Homo sapiens
ctcaccaggggtgctatgacat

SEQ ID NO: 4194009 - DNA, 15 bp, Homo sapiens
ctcacctctctctaa

SEQ ID NO: 4194010 - DNA, 23 bp, Homo sapiens
ctcacgatgaaattgaacctggt

SEQ ID NO: 4194011 - DNA, 13 bp, Homo sapiens
ctcactcaagcct

SEQ ID NO: 4194012 - DNA, 19 bp, Homo sapiens
ctcagaaaagaaaaccatt

SEQ ID NO: 4194013 - DNA, 13 bp, Homo sapiens
ctcagaagcctga

SEQ ID NO: 4194014 - DNA, 16 bp, Homo sapiens
ctcagaagcctgaggc

SEQ ID NO: 4194015 - DNA, 19 bp, Homo sapiens
ctcagaaggtattcctttt

SEQ ID NO: 4194016 - DNA, 22 bp, Homo sapiens
ctcagataaggtaaaatgccat

SEQ ID NO: 4194017 - DNA, 23 bp, Homo sapiens
ctcagataaggtaaaatgccatg

SEQ ID NO: 4194018 - DNA, 13 bp, Homo sapiens
ctcagcagccccc

SEQ ID NO: 4194019 - DNA, 19 bp, Homo sapiens
ctcagcagccccctgcccg

SEQ ID NO: 4194020 - DNA, 17 bp, Homo sapiens
ctcagcagtaagcaggc

SEQ ID NO: 4194021 - DNA, 16 bp, Homo sapiens
ctcagcataagtaaac

SEQ ID NO: 4194022 - DNA, 15 bp, Homo sapiens
ctcagcatgcagaag

SEQ ID NO: 4194023 - DNA, 21 bp, Homo sapiens
ctcagcatgcagaagtgcatg

SEQ ID NO: 4194024 - DNA, 13 bp, Homo sapiens
ctcagcctacagc

SEQ ID NO: 4194025 - DNA, 24 bp, Homo sapiens
ctcagctcactggtccatttctca

SEQ ID NO: 4194026 - DNA, 16 bp, Homo sapiens
ctcagctcgctgccca

SEQ ID NO: 4194027 - DNA, 21 bp, Homo sapiens
ctcaggaacagaacacttcta

SEQ ID NO: 4194028 - DNA, 16 bp, Homo sapiens
cttcactgttgaaaat

SEQ ID NO: 4194029 - DNA, 19 bp, Homo sapiens
cttcactgttgaaaattat

SEQ ID NO: 4194030 - DNA, 12 bp, Homo sapiens
cttcagagcagg

SEQ ID NO: 4194031 - DNA, 14 bp, Homo sapiens
cttcagccatcaac

SEQ ID NO: 4194032 - DNA, 14 bp, Homo sapiens
cttcagcctgaggc

SEQ ID NO: 4194033 - DNA, 16 bp, Homo sapiens
cttcagcctgaggctg

SEQ ID NO: 4194034 - DNA, 20 bp, Homo sapiens
cttcagcctgaggctgagac

SEQ ID NO: 4194035 - DNA, 14 bp, Homo sapiens
cttcagctttggtg

SEQ ID NO: 4194036 - DNA, 19 bp, Homo sapiens
cttcagggagcatatgaaa

SEQ ID NO: 4194037 - DNA, 14 bp, Homo sapiens
cttcagttgttttc

SEQ ID NO: 4194038 - DNA, 16 bp, Homo sapiens
cttcatcttgacatgt

SEQ ID NO: 4194039 - DNA, 15 bp, Homo sapiens
cttcatgcccttctg

SEQ ID NO: 4194040 - DNA, 17 bp, Homo sapiens
cttccatctagtcacaa

SEQ ID NO: 4194041 - DNA, 20 bp, Homo sapiens
cttccatgttgtcttataaa

SEQ ID NO: 4194042 - DNA, 22 bp, Homo sapiens
cttcccaacctcccctggtcct

SEQ ID NO: 4194043 - DNA, 13 bp, Homo sapiens
cttccccagactc

SEQ ID NO: 4194044 - DNA, 19 bp, Homo sapiens
cttccccagactcagctcc

SEQ ID NO: 4194045 - DNA, 20 bp, Homo sapiens
cttccccagactcagctcca

SEQ ID NO: 4194046 - DNA, 20 bp, Homo sapiens
cttccccaggagctctctgc

SEQ ID NO: 4194047 - DNA, 22 bp, Homo sapiens
cttccccaggagctctctgctg

SEQ ID NO: 4194048 - DNA, 22 bp, Homo sapiens
cttcccccatcccctttcctcc

SEQ ID NO: 4194049 - DNA, 20 bp, Homo sapiens
cttcccccgattcagagact

SEQ ID NO: 4194050 - DNA, 19 bp, Homo sapiens
cttccctccccacagtcct

SEQ ID NO: 4194051 - DNA, 12 bp, Homo sapiens
cttccctccttc

SEQ ID NO: 4194052 - DNA, 15 bp, Homo sapiens
cttccctccttccct

SEQ ID NO: 4194053 - DNA, 20 bp, Homo sapiens
cttccctctgatttttcctt

SEQ ID NO: 4194054 - DNA, 21 bp, Homo sapiens
cttccctctttccccacctct

SEQ ID NO: 4194055 - DNA, 23 bp, Homo sapiens
cttccctgacactgtctgctgcc

SEQ ID NO: 4194056 - DNA, 24 bp, Homo sapiens
cttccctgacactgtctgctgccc

SEQ ID NO: 4194057 - DNA, 19 bp, Homo sapiens
cttcccttctctccttccc

SEQ ID NO: 4194058 - DNA, 17 bp, Homo sapiens
cttccgctcctttacct

SEQ ID NO: 4194059 - DNA, 23 bp, Homo sapiens
cttccgtggtcagagtgccactg

SEQ ID NO: 4194060 - DNA, 15 bp, Homo sapiens
cttcctcgtgcagag

SEQ ID NO: 4194061 - DNA, 18 bp, Homo sapiens
cttcctcgtgcagagctg

SEQ ID NO: 4194062 - DNA, 21 bp, Homo sapiens
cttccttaattcactcccaca

SEQ ID NO: 4194063 - DNA, 18 bp, Homo sapiens
cttccttccgctccttta

SEQ ID NO: 4194064 - DNA, 21 bp, Homo sapiens
cttccttccgctcctttacct

SEQ ID NO: 4194065 - DNA, 21 bp, Homo sapiens
cttccttctttctcttccctc

SEQ ID NO: 4194066 - DNA, 17 bp, Homo sapiens
cttccttgctgtcctag

SEQ ID NO: 4194067 - DNA, 13 bp, Homo sapiens
cttcctttcctct

SEQ ID NO: 4194068 - DNA, 12 bp, Homo sapiens
cttctaatatat

SEQ ID NO: 4194069 - DNA, 15 bp, Homo sapiens
cttctaatatatttt

SEQ ID NO: 4194070 - DNA, 18 bp, Homo sapiens
cttctaatatatttttat

SEQ ID NO: 4194071 - DNA, 21 bp, Homo sapiens
cttctagccacagttctaaga

SEQ ID NO: 4194072 - DNA, 20 bp, Homo sapiens
cttctcattccaacagtgag

SEQ ID NO: 4194073 - DNA, 20 bp, Homo sapiens
cttctcattttttaaaaaag

SEQ ID NO: 4194074 - DNA, 15 bp, Homo sapiens
cttctcctcccagcg

SEQ ID NO: 4194075 - DNA, 19 bp, Homo sapiens
cttctcctcccagcgtgtg

SEQ ID NO: 4194076 - DNA, 11 bp, Homo sapiens
cttctctacag

SEQ ID NO: 4194077 - DNA, 12 bp, Homo sapiens
cttctcttgaat

SEQ ID NO: 4194078 - DNA, 17 bp, Homo sapiens
cttctgaaacttcataa

SEQ ID NO: 4194079 - DNA, 15 bp, Homo sapiens
cttctgaagtaattt

SEQ ID NO: 4194080 - DNA, 15 bp, Homo sapiens
cttctgattcccctc

SEQ ID NO: 4194081 - DNA, 19 bp, Homo sapiens
cttctgcaattgcttagga

SEQ ID NO: 4194082 - DNA, 14 bp, Homo sapiens
cttctgcagcaact

SEQ ID NO: 4194083 - DNA, 20 bp, Homo sapiens
cttctgcagcaactcccacg

SEQ ID NO: 4194084 - DNA, 13 bp, Homo sapiens
cttctgccttttt

SEQ ID NO: 4194085 - DNA, 21 bp, Homo sapiens
cttctgctaaatttaataaaa

SEQ ID NO: 4194086 - DNA, 21 bp, Homo sapiens
cttctgcttcaaaccctcaag

SEQ ID NO: 4194087 - DNA, 15 bp, Homo sapiens
cttctggactggttt

SEQ ID NO: 4194088 - DNA, 19 bp, Homo sapiens
cttctggattcaagtgatt

SEQ ID NO: 4194089 - DNA, 13 bp, Homo sapiens
cttctggccagga

SEQ ID NO: 4194090 - DNA, 11 bp, Homo sapiens
cttctggctcc

SEQ ID NO: 4194091 - DNA, 12 bp, Homo sapiens
cttctggctcca

SEQ ID NO: 4194092 - DNA, 13 bp, Homo sapiens
cttctggctcctc

SEQ ID NO: 4194093 - DNA, 14 bp, Homo sapiens
cttctggcttcctt

SEQ ID NO: 4194094 - DNA, 20 bp, Homo sapiens
cttctggcttccttctctca

SEQ ID NO: 4194095 - DNA, 15 bp, Homo sapiens
cttctggtgctactc

SEQ ID NO: 4194096 - DNA, 19 bp, Homo sapiens
cttctgtccaccagaccca

SEQ ID NO: 4194097 - DNA, 15 bp, Homo sapiens
cttcttatgtttgct

SEQ ID NO: 4194098 - DNA, 23 bp, Homo sapiens
cttcttattcatgctttctcctt

SEQ ID NO: 4194099 - DNA, 15 bp, Homo sapiens
cttcttcatcttgac

SEQ ID NO: 4194100 - DNA, 20 bp, Homo sapiens
cttcttccctgttttaaatt

SEQ ID NO: 4194101 - DNA, 21 bp, Homo sapiens
cttcttccctgttttaaatta

SEQ ID NO: 4194102 - DNA, 19 bp, Homo sapiens
cttcttcgctgctagagaa

SEQ ID NO: 4194103 - DNA, 14 bp, Homo sapiens
cttcttcttcagaa

SEQ ID NO: 4194104 - DNA, 17 bp, Homo sapiens
cttcttgaaacagcctg

SEQ ID NO: 4194105 - DNA, 20 bp, Homo sapiens
cttcttgaaacagcctgggt

SEQ ID NO: 4194106 - DNA, 15 bp, Homo sapiens
cttcttgagcagacc

SEQ ID NO: 4194107 - DNA, 18 bp, Homo sapiens
cttcttgtgtcctgatga

SEQ ID NO: 4194108 - DNA, 17 bp, Homo sapiens
cttctttaattgatcta

SEQ ID NO: 4194109 - DNA, 16 bp, Homo sapiens
cttctttgtcttagct

SEQ ID NO: 4194110 - DNA, 17 bp, Homo sapiens
cttgaaacagcctgggt

SEQ ID NO: 4194111 - DNA, 19 bp, Homo sapiens
cttgaaattttaaactata

SEQ ID NO: 4194112 - DNA, 19 bp, Homo sapiens
cttgaagaatctctcctct

SEQ ID NO: 4194113 - DNA, 17 bp, Homo sapiens
cttgaagccactgaagc

SEQ ID NO: 4194114 - DNA, 19 bp, Homo sapiens
cttgaagccactgaagctg

SEQ ID NO: 4194115 - DNA, 16 bp, Homo sapiens
cttgacaactggcagg

SEQ ID NO: 4194116 - DNA, 14 bp, Homo sapiens
cttgacatgtaatg

SEQ ID NO: 4194117 - DNA, 17 bp, Homo sapiens
cttgaccactggccctg

SEQ ID NO: 4194118 - DNA, 13 bp, Homo sapiens
cttgaccctgagc

SEQ ID NO: 4194119 - DNA, 12 bp, Homo sapiens
cttgaggacaca

SEQ ID NO: 4194120 - DNA, 17 bp, Homo sapiens
cttgaggattttgagta

SEQ ID NO: 4194121 - DNA, 23 bp, Homo sapiens
cttgatactaaaagttcttctcc

SEQ ID NO: 4194122 - DNA, 18 bp, Homo sapiens
cttgatgggattctggac

SEQ ID NO: 4194123 - DNA, 12 bp, Homo sapiens
cttgcattccca

SEQ ID NO: 4194124 - DNA, 16 bp, Homo sapiens
cttgcattcccagtgg

SEQ ID NO: 4194125 - DNA, 17 bp, Homo sapiens
cttgccaaattccatgt

SEQ ID NO: 4194126 - DNA, 19 bp, Homo sapiens
cttgcccctccagagacag

SEQ ID NO: 4194127 - DNA, 10 bp, Homo sapiens
cttgccctgg

SEQ ID NO: 4194128 - DNA, 23 bp, Homo sapiens
cttgccgagagaggcgcgtctgc

SEQ ID NO: 4194129 - DNA, 13 bp, Homo sapiens
cttgcctgcctgc

SEQ ID NO: 4194130 - DNA, 19 bp, Homo sapiens
cttgctctcccctgccctg

SEQ ID NO: 4194131 - DNA, 20 bp, Homo sapiens
cttgctctcccctgccctgc

SEQ ID NO: 4194132 - DNA, 12 bp, Homo sapiens
cttgctgagggg

SEQ ID NO: 4194133 - DNA, 16 bp, Homo sapiens
cttgctgaggggcagg

SEQ ID NO: 4194134 - DNA, 18 bp, Homo sapiens
cttgctgaggggcaggga

SEQ ID NO: 4194135 - DNA, 18 bp, Homo sapiens
cttgctgtaactcagaca

SEQ ID NO: 4194136 - DNA, 19 bp, Homo sapiens
cttgctgtaactcagacat

SEQ ID NO: 4194137 - DNA, 17 bp, Homo sapiens
cttgctgtcctaggcca

SEQ ID NO: 4194138 - DNA, 15 bp, Homo sapiens
cttgcttctgcagca

SEQ ID NO: 4194139 - DNA, 16 bp, Homo sapiens
cttgcttctgcagcaa

SEQ ID NO: 4194140 - DNA, 20 bp, Homo sapiens
cttgcttctgcagcaactcc

SEQ ID NO: 4194141 - DNA, 19 bp, Homo sapiens
cttgctttcatcactacct

SEQ ID NO: 4194142 - DNA, 18 bp, Homo sapiens
cttgctttgctgtctggt

SEQ ID NO: 4194143 - DNA, 17 bp, Homo sapiens
cttggaaaaagaaagaa

SEQ ID NO: 4194144 - DNA, 21 bp, Homo sapiens
cttggaaagcatcacctcagg

SEQ ID NO: 4194145 - DNA, 22 bp, Homo sapiens
cttggaagtgtgtggaaggcag

SEQ ID NO: 4194146 - DNA, 21 bp, Homo sapiens
cttggaagtttcatatattgt

SEQ ID NO: 4194147 - DNA, 15 bp, Homo sapiens
cttggactcctccca

SEQ ID NO: 4194148 - DNA, 13 bp, Homo sapiens
cttggacttgagg

SEQ ID NO: 4194149 - DNA, 13 bp, Homo sapiens
cttggagagcagc

SEQ ID NO: 4194150 - DNA, 20 bp, Homo sapiens
cttggcaacagaagcagttg

SEQ ID NO: 4194151 - DNA, 19 bp, Homo sapiens
cttggcagtattccatggg

SEQ ID NO: 4194152 - DNA, 19 bp, Homo sapiens
cttggcatcacagggcaga

SEQ ID NO: 4194153 - DNA, 13 bp, Homo sapiens
cttggctgcagga

SEQ ID NO: 4194154 - DNA, 22 bp, Homo sapiens
cttgggaaaggtggtgtttctg

SEQ ID NO: 4194155 - DNA, 14 bp, Homo sapiens
cttgggcagcatcc

SEQ ID NO: 4194156 - DNA, 14 bp, Homo sapiens
cttgggcccaggag

SEQ ID NO: 4194157 - DNA, 20 bp, Homo sapiens
cttggggctcgccccaccca

SEQ ID NO: 4194158 - DNA, 23 bp, Homo sapiens
cttggggggtttttactccagtg

SEQ ID NO: 4194159 - DNA, 23 bp, Homo sapiens
cttgggtcctgcaatctccaggg

SEQ ID NO: 4194160 - DNA, 23 bp, Homo sapiens
cttggtaaattgtaaacagctaa

SEQ ID NO: 4194161 - DNA, 14 bp, Homo sapiens
cttggtcagagcca

SEQ ID NO: 4194162 - DNA, 22 bp, Homo sapiens
cttggtggccaagcctggccct

SEQ ID NO: 4194163 - DNA, 16 bp, Homo sapiens
ggccttctcagcctac

SEQ ID NO: 4194164 - DNA, 18 bp, Homo sapiens
ggcgaataaatgttcaaa

SEQ ID NO: 4194165 - DNA, 15 bp, Homo sapiens
ggcgacagagcaaga

SEQ ID NO: 4194166 - DNA, 13 bp, Homo sapiens
ggcgcagagggaa

SEQ ID NO: 4194167 - DNA, 21 bp, Homo sapiens
ggcggaggttgcagtgagccg

SEQ ID NO: 4194168 - DNA, 21 bp, Homo sapiens
ggcggcacgccaacagccccc

SEQ ID NO: 4194169 - DNA, 17 bp, Homo sapiens
ggcggccatgatggtgc

SEQ ID NO: 4194170 - DNA, 14 bp, Homo sapiens
ggcggcgcagaggg

SEQ ID NO: 4194171 - DNA, 16 bp, Homo sapiens
ggcggcgcagagggaa

SEQ ID NO: 4194172 - DNA, 16 bp, Homo sapiens
ggcgtggtggcgggca

SEQ ID NO: 4194173 - DNA, 15 bp, Homo sapiens
ggctactgcagcttt

SEQ ID NO: 4194174 - DNA, 18 bp, Homo sapiens
ggctactgcagctttaca

SEQ ID NO: 4194175 - DNA, 17 bp, Homo sapiens
ggctaggggctggtcct

SEQ ID NO: 4194176 - DNA, 13 bp, Homo sapiens
ggctatttaaaag

SEQ ID NO: 4194177 - DNA, 23 bp, Homo sapiens
ggctcacgcctatgatcccagca

SEQ ID NO: 4194178 - DNA, 14 bp, Homo sapiens
ggctcagactctgg

SEQ ID NO: 4194179 - DNA, 13 bp, Homo sapiens
ggctcagcatgca

SEQ ID NO: 4194180 - DNA, 15 bp, Homo sapiens
ggctcagtctcagga

SEQ ID NO: 4194181 - DNA, 19 bp, Homo sapiens
ggctccaggtccggagggg

SEQ ID NO: 4194182 - DNA, 16 bp, Homo sapiens
ggctccctcctggagc

SEQ ID NO: 4194183 - DNA, 14 bp, Homo sapiens
ggctccctggccca

SEQ ID NO: 4194184 - DNA, 20 bp, Homo sapiens
ggctcctccatctagagatt

SEQ ID NO: 4194185 - DNA, 13 bp, Homo sapiens
ggctcctggaaag

SEQ ID NO: 4194186 - DNA, 12 bp, Homo sapiens
ggctcctgtgct

SEQ ID NO: 4194187 - DNA, 13 bp, Homo sapiens
ggctcctgtgcta

SEQ ID NO: 4194188 - DNA, 19 bp, Homo sapiens
ggctcctttgcctctgcta

SEQ ID NO: 4194189 - DNA, 15 bp, Homo sapiens
ggctcgccccaccca

SEQ ID NO: 4194190 - DNA, 21 bp, Homo sapiens
ggctctgccccagaggcctct

SEQ ID NO: 4194191 - DNA, 22 bp, Homo sapiens
ggctctttggggtcagccaggg

SEQ ID NO: 4194192 - DNA, 16 bp, Homo sapiens
ggctcttttcctgctg

SEQ ID NO: 4194193 - DNA, 19 bp, Homo sapiens
ggctgaccccaaagagcct

SEQ ID NO: 4194194 - DNA, 15 bp, Homo sapiens
ggctgacctgggccc

SEQ ID NO: 4194195 - DNA, 23 bp, Homo sapiens
ggctgacctgggcccacagagcc

SEQ ID NO: 4194196 - DNA, 10 bp, Homo sapiens
ggctgagaag

SEQ ID NO: 4194197 - DNA, 12 bp, Homo sapiens
ggctgagccctg

SEQ ID NO: 4194198 - DNA, 15 bp, Homo sapiens
ggctgagccctggca

SEQ ID NO: 4194199 - DNA, 13 bp, Homo sapiens
ggctgaggcagga

SEQ ID NO: 4194200 - DNA, 14 bp, Homo sapiens
ggctgaggcaggag

SEQ ID NO: 4194201 - DNA, 12 bp, Homo sapiens
ggctgcagaaga

SEQ ID NO: 4194202 - DNA, 15 bp, Homo sapiens
ggctgccagcctgag

SEQ ID NO: 4194203 - DNA, 16 bp, Homo sapiens
ggctgccagcctgagc

SEQ ID NO: 4194204 - DNA, 21 bp, Homo sapiens
ggctgctcattccttctggag

SEQ ID NO: 4194205 - DNA, 19 bp, Homo sapiens
ggctgctcctccagccctt

SEQ ID NO: 4194206 - DNA, 19 bp, Homo sapiens
ggctgctgcactgccctcc

SEQ ID NO: 4194207 - DNA, 12 bp, Homo sapiens
ggctgctgtggc

SEQ ID NO: 4194208 - DNA, 17 bp, Homo sapiens
ggctgctgtgtgccttc

SEQ ID NO: 4194209 - DNA, 14 bp, Homo sapiens
ggctggcagtgctg

SEQ ID NO: 4194210 - DNA, 22 bp, Homo sapiens
ggctggcctttcaggtccaggc

SEQ ID NO: 4194211 - DNA, 16 bp, Homo sapiens
ggctgggcctgagcct

SEQ ID NO: 4194212 - DNA, 19 bp, Homo sapiens
ggctgggtggggggagaag

SEQ ID NO: 4194213 - DNA, 15 bp, Homo sapiens
ggctgtgtggccaag

SEQ ID NO: 4194214 - DNA, 13 bp, Homo sapiens
ggcttagtgccac

SEQ ID NO: 4194215 - DNA, 18 bp, Homo sapiens
ggcttattttttaaaata

SEQ ID NO: 4194216 - DNA, 12 bp, Homo sapiens
ggcttccaggta

SEQ ID NO: 4194217 - DNA, 12 bp, Homo sapiens
ggcttgctgtgg

SEQ ID NO: 4194218 - DNA, 23 bp, Homo sapiens
ggcttgctgtggctatgggaatc

SEQ ID NO: 4194219 - DNA, 21 bp, Homo sapiens
ggcttggtggccaagcctggc

SEQ ID NO: 4194220 - DNA, 14 bp, Homo sapiens
ggctttctggagag

SEQ ID NO: 4194221 - DNA, 20 bp, Homo sapiens
ggcttttcgcttgcttctgc

SEQ ID NO: 4194222 - DNA, 22 bp, Homo sapiens
ggcttttcgcttgcttctgcag

SEQ ID NO: 4194223 - DNA, 19 bp, Homo sapiens
ggcttttgcttggcagaga

SEQ ID NO: 4194224 - DNA, 16 bp, Homo sapiens
ggcttttggtggtccc

SEQ ID NO: 4194225 - DNA, 19 bp, Homo sapiens
gggaaattattatgactca

SEQ ID NO: 4194226 - DNA, 12 bp, Homo sapiens
gggaagaaaaaa

SEQ ID NO: 4194227 - DNA, 15 bp, Homo sapiens
gggaagagaagggaa

SEQ ID NO: 4194228 - DNA, 17 bp, Homo sapiens
gggaaggaactctggct

SEQ ID NO: 4194229 - DNA, 14 bp, Homo sapiens
gggaaggagctgtt

SEQ ID NO: 4194230 - DNA, 14 bp, Homo sapiens
gggaatcctgctgc

SEQ ID NO: 4194231 - DNA, 20 bp, Homo sapiens
gggacagggtgaataaagca

SEQ ID NO: 4194232 - DNA, 13 bp, Homo sapiens
gggacccagctcc

SEQ ID NO: 4194233 - DNA, 15 bp, Homo sapiens
gggacccagctcctc

SEQ ID NO: 4194234 - DNA, 12 bp, Homo sapiens
gggagagcctgg

SEQ ID NO: 4194235 - DNA, 14 bp, Homo sapiens
gggagagcctggca

SEQ ID NO: 4194236 - DNA, 19 bp, Homo sapiens
gggagagcgcctcttcctc

SEQ ID NO: 4194237 - DNA, 14 bp, Homo sapiens
gggagctggaaata

SEQ ID NO: 4194238 - DNA, 11 bp, Homo sapiens
gggaggaaggg

SEQ ID NO: 4194239 - DNA, 20 bp, Homo sapiens
gggaggaggtggcagccctg

SEQ ID NO: 4194240 - DNA, 20 bp, Homo sapiens
gggaggcggagagtacagtg

SEQ ID NO: 4194241 - DNA, 17 bp, Homo sapiens
gggaggctgagacagga

SEQ ID NO: 4194242 - DNA, 13 bp, Homo sapiens
gggagggggacgc

SEQ ID NO: 4194243 - DNA, 15 bp, Homo sapiens
gggaggtccaggcag

SEQ ID NO: 4194244 - DNA, 24 bp, Homo sapiens
gggaggtctccactgaggatgtga

SEQ ID NO: 4194245 - DNA, 16 bp, Homo sapiens
gggagtagtggagagc

SEQ ID NO: 4194246 - DNA, 17 bp, Homo sapiens
gggagttggctggatct

SEQ ID NO: 4194247 - DNA, 12 bp, Homo sapiens
gggatgcccagt

SEQ ID NO: 4194248 - DNA, 22 bp, Homo sapiens
gggatgtgaattgcctgcagag

SEQ ID NO: 4194249 - DNA, 15 bp, Homo sapiens
gggattcccaccaag

SEQ ID NO: 4194250 - DNA, 20 bp, Homo sapiens
gggcaaagaactgccccatc

SEQ ID NO: 4194251 - DNA, 21 bp, Homo sapiens
gggcaagaacctaaagtagca

SEQ ID NO: 4194252 - DNA, 20 bp, Homo sapiens
gggcactgtctgcgtgacta

SEQ ID NO: 4194253 - DNA, 16 bp, Homo sapiens
gggcagaagggagaag

SEQ ID NO: 4194254 - DNA, 13 bp, Homo sapiens
gggcagagccacc

SEQ ID NO: 4194255 - DNA, 18 bp, Homo sapiens
gggcagagccaccagggc

SEQ ID NO: 4194256 - DNA, 13 bp, Homo sapiens
gggcagagccggg

SEQ ID NO: 4194257 - DNA, 17 bp, Homo sapiens
gggcagagccgggaagc

SEQ ID NO: 4194258 - DNA, 22 bp, Homo sapiens
gggcagtggtaagctctggctt

SEQ ID NO: 4194259 - DNA, 13 bp, Homo sapiens
gggccagggccct

SEQ ID NO: 4194260 - DNA, 14 bp, Homo sapiens
gggccagggccctg

SEQ ID NO: 4194261 - DNA, 16 bp, Homo sapiens
gggccagggccctgca

SEQ ID NO: 4194262 - DNA, 18 bp, Homo sapiens
gggccagggccctgcaga

SEQ ID NO: 4194263 - DNA, 23 bp, Homo sapiens
gggccaggggtctccctggagtg

SEQ ID NO: 4194264 - DNA, 17 bp, Homo sapiens
gggccagtgagggctgg

SEQ ID NO: 4194265 - DNA, 18 bp, Homo sapiens
gggcccaaagcccagctc

SEQ ID NO: 4194266 - DNA, 17 bp, Homo sapiens
gggcccccctccttgct

SEQ ID NO: 4194267 - DNA, 21 bp, Homo sapiens
gggcccccctccttgctctgc

SEQ ID NO: 4194268 - DNA, 15 bp, Homo sapiens
gggccgggaggcagt

SEQ ID NO: 4194269 - DNA, 14 bp, Homo sapiens
gggccgtgcccagg

SEQ ID NO: 4194270 - DNA, 17 bp, Homo sapiens
gggcctgctgcgtcaga

SEQ ID NO: 4194271 - DNA, 18 bp, Homo sapiens
gggcgatcaagtccagag

SEQ ID NO: 4194272 - DNA, 20 bp, Homo sapiens
gggcgatcaagtccagagcc

SEQ ID NO: 4194273 - DNA, 22 bp, Homo sapiens
gggcgcctgtagtcccagccac

SEQ ID NO: 4194274 - DNA, 18 bp, Homo sapiens
gggcgtggctggcctttc

SEQ ID NO: 4194275 - DNA, 14 bp, Homo sapiens
gggctactcagcag

SEQ ID NO: 4194276 - DNA, 18 bp, Homo sapiens
gggctaggggctggtcct

SEQ ID NO: 4194277 - DNA, 20 bp, Homo sapiens
gggctccggaggggacccag

SEQ ID NO: 4194278 - DNA, 11 bp, Homo sapiens
gggctcctgga

SEQ ID NO: 4194279 - DNA, 20 bp, Homo sapiens
gggctcctggaaaggctcag

SEQ ID NO: 4194280 - DNA, 11 bp, Homo sapiens
gggctctgccc

SEQ ID NO: 4194281 - DNA, 12 bp, Homo sapiens
gggctctgcccc

SEQ ID NO: 4194282 - DNA, 20 bp, Homo sapiens
gggctctgccccagctctgg

SEQ ID NO: 4194283 - DNA, 17 bp, Homo sapiens
gggctgagccctggcag

SEQ ID NO: 4194284 - DNA, 18 bp, Homo sapiens
gggctgagccctggcagg

SEQ ID NO: 4194285 - DNA, 15 bp, Homo sapiens
gggctgccagcctga

SEQ ID NO: 4194286 - DNA, 23 bp, Homo sapiens
gggctgccagcctgagcggaggc

SEQ ID NO: 4194287 - DNA, 15 bp, Homo sapiens
gggctgctgtggccc

SEQ ID NO: 4194288 - DNA, 16 bp, Homo sapiens
gggctgctgtggccca

SEQ ID NO: 4194289 - DNA, 17 bp, Homo sapiens
gggctgctgtggcccag

SEQ ID NO: 4194290 - DNA, 19 bp, Homo sapiens
gggctggcccagccaactg

SEQ ID NO: 4194291 - DNA, 13 bp, Homo sapiens
gggctgggcccac

SEQ ID NO: 4194292 - DNA, 14 bp, Homo sapiens
gggctgggcccaca

SEQ ID NO: 4194293 - DNA, 17 bp, Homo sapiens
gggctgggcctgagcct

SEQ ID NO: 4194294 - DNA, 18 bp, Homo sapiens
ggggacataaagcctctg

SEQ ID NO: 4194295 - DNA, 15 bp, Homo sapiens
ggggacccagctcct

SEQ ID NO: 4194296 - DNA, 12 bp, Homo sapiens
ggggaggaaggg

SEQ ID NO: 4194297 - DNA, 13 bp, Homo sapiens
ggggatcacagcg

SEQ ID NO: 4194298 - DNA, 16 bp, Homo sapiens
ggggcaaagcctcctt

SEQ ID NO: 4194299 - DNA, 14 bp, Homo sapiens
ggggcaagcctgta

SEQ ID NO: 4194300 - DNA, 18 bp, Homo sapiens
gtggacacctgccctgcc

SEQ ID NO: 4194301 - DNA, 15 bp, Homo sapiens
gtggacagtcctggg

SEQ ID NO: 4194302 - DNA, 16 bp, Homo sapiens
gtggagtcaggaaaga

SEQ ID NO: 4194303 - DNA, 21 bp, Homo sapiens
gtggagtcaggaaagacaggc

SEQ ID NO: 4194304 - DNA, 19 bp, Homo sapiens
gtggagttgacatttgaca

SEQ ID NO: 4194305 - DNA, 13 bp, Homo sapiens
gtggatcacctga

SEQ ID NO: 4194306 - DNA, 17 bp, Homo sapiens
gtggatctccaaggacc

SEQ ID NO: 4194307 - DNA, 20 bp, Homo sapiens
gtggatggcccagcaggcag

SEQ ID NO: 4194308 - DNA, 15 bp, Homo sapiens
gtggatgggccctgc

SEQ ID NO: 4194309 - DNA, 16 bp, Homo sapiens
gtggcaagggggcggg

SEQ ID NO: 4194310 - DNA, 20 bp, Homo sapiens
gtggcagataatcagcctct

SEQ ID NO: 4194311 - DNA, 23 bp, Homo sapiens
gtggcagataatcagcctcttaa

SEQ ID NO: 4194312 - DNA, 12 bp, Homo sapiens
gtggcagccctg

SEQ ID NO: 4194313 - DNA, 16 bp, Homo sapiens
gtggccatcagggtgg

SEQ ID NO: 4194314 - DNA, 16 bp, Homo sapiens
gtggctatgggaatca

SEQ ID NO: 4194315 - DNA, 21 bp, Homo sapiens
gtggctatgggaatcagctgg

SEQ ID NO: 4194316 - DNA, 22 bp, Homo sapiens
gtggctcacgcctgtaatccca

SEQ ID NO: 4194317 - DNA, 18 bp, Homo sapiens
gtggctggcctttcaggt

SEQ ID NO: 4194318 - DNA, 12 bp, Homo sapiens
gtgggaacattc

SEQ ID NO: 4194319 - DNA, 14 bp, Homo sapiens
gtgggagagcccag

SEQ ID NO: 4194320 - DNA, 20 bp, Homo sapiens
gtgggagctcagctcgctgc

SEQ ID NO: 4194321 - DNA, 18 bp, Homo sapiens
gtgggcctggtagcacat

SEQ ID NO: 4194322 - DNA, 13 bp, Homo sapiens
gtgggctgagccc

SEQ ID NO: 4194323 - DNA, 15 bp, Homo sapiens
gtgggctgagccctg

SEQ ID NO: 4194324 - DNA, 13 bp, Homo sapiens
gtgggctggccca

SEQ ID NO: 4194325 - DNA, 14 bp, Homo sapiens
gtgggctggcccag

SEQ ID NO: 4194326 - DNA, 17 bp, Homo sapiens
gtgggctggcccagcca

SEQ ID NO: 4194327 - DNA, 14 bp, Homo sapiens
gtgggggcggggaa

SEQ ID NO: 4194328 - DNA, 18 bp, Homo sapiens
gtggggggtggacacaga

SEQ ID NO: 4194329 - DNA, 14 bp, Homo sapiens
gtggggtctggctg

SEQ ID NO: 4194330 - DNA, 16 bp, Homo sapiens
gtggggtctggctgtg

SEQ ID NO: 4194331 - DNA, 17 bp, Homo sapiens
gtggggtctggctgtgt

SEQ ID NO: 4194332 - DNA, 18 bp, Homo sapiens
gtggggttggggcaaagc

SEQ ID NO: 4194333 - DNA, 23 bp, Homo sapiens
gtggggttggggcaaagcctcct

SEQ ID NO: 4194334 - DNA, 21 bp, Homo sapiens
gtggtaacttctttgaagtta

SEQ ID NO: 4194335 - DNA, 16 bp, Homo sapiens
gtggtaagctctggct

SEQ ID NO: 4194336 - DNA, 15 bp, Homo sapiens
gtggtcctgagacct

SEQ ID NO: 4194337 - DNA, 20 bp, Homo sapiens
gtggtgaggttgtgctgcct

SEQ ID NO: 4194338 - DNA, 14 bp, Homo sapiens
gtggtgccagaggt

SEQ ID NO: 4194339 - DNA, 14 bp, Homo sapiens
gtggtggggacagg

SEQ ID NO: 4194340 - DNA, 17 bp, Homo sapiens
gtggtgtttgtaggctg

SEQ ID NO: 4194341 - DNA, 23 bp, Homo sapiens
gtgtatccgactctaagctgtgt

SEQ ID NO: 4194342 - DNA, 18 bp, Homo sapiens
gtgtatgtatgaaggcca

SEQ ID NO: 4194343 - DNA, 20 bp, Homo sapiens
gtgtatgtgtgtgtctgtgc

SEQ ID NO: 4194344 - DNA, 14 bp, Homo sapiens
gtgtcaccctgcag

SEQ ID NO: 4194345 - DNA, 17 bp, Homo sapiens
gtgtcaccctgcagagc

SEQ ID NO: 4194346 - DNA, 16 bp, Homo sapiens
gtgtcctctccctgcc

SEQ ID NO: 4194347 - DNA, 17 bp, Homo sapiens
gtgtcctctccctgcca

SEQ ID NO: 4194348 - DNA, 16 bp, Homo sapiens
gtgtctccccgtgtcc

SEQ ID NO: 4194349 - DNA, 16 bp, Homo sapiens
gtgtctgggagagcct

SEQ ID NO: 4194350 - DNA, 18 bp, Homo sapiens
gtgtctgggagagcctgg

SEQ ID NO: 4194351 - DNA, 13 bp, Homo sapiens
gtgtgaaaatggg

SEQ ID NO: 4194352 - DNA, 13 bp, Homo sapiens
gtgtgagcagtga

SEQ ID NO: 4194353 - DNA, 13 bp, Homo sapiens
gtgtgcagtgaag

SEQ ID NO: 4194354 - DNA, 16 bp, Homo sapiens
gtgtgcctgcagcccc

SEQ ID NO: 4194355 - DNA, 15 bp, Homo sapiens
gtgtggaaaaaaatt

SEQ ID NO: 4194356 - DNA, 21 bp, Homo sapiens
gtgtggagaaggatagcctca

SEQ ID NO: 4194357 - DNA, 16 bp, Homo sapiens
gtgtggtgtgtgtgct

SEQ ID NO: 4194358 - DNA, 21 bp, Homo sapiens
gtgtggtgtttgtaggctgtg

SEQ ID NO: 4194359 - DNA, 23 bp, Homo sapiens
gtgtgtatccgactctaagctgt

SEQ ID NO: 4194360 - DNA, 14 bp, Homo sapiens
gtgtgtctgtgcgt

SEQ ID NO: 4194361 - DNA, 20 bp, Homo sapiens
gtgtgtggaaggcagggaca

SEQ ID NO: 4194362 - DNA, 13 bp, Homo sapiens
gtgtgtgtctgtg

SEQ ID NO: 4194363 - DNA, 20 bp, Homo sapiens
gtgtgttttgagagtatatt

SEQ ID NO: 4194364 - DNA, 15 bp, Homo sapiens
gtgttaatttttgat

SEQ ID NO: 4194365 - DNA, 18 bp, Homo sapiens
gtgttgatacgtgtgtga

SEQ ID NO: 4194366 - DNA, 13 bp, Homo sapiens
gtgttggaagcca

SEQ ID NO: 4194367 - DNA, 21 bp, Homo sapiens
gtgtttaaagttcaacatgtt

SEQ ID NO: 4194368 - DNA, 19 bp, Homo sapiens
gtgtttaacattcacagcc

SEQ ID NO: 4194369 - DNA, 12 bp, Homo sapiens
gtgtttcacaaa

SEQ ID NO: 4194370 - DNA, 20 bp, Homo sapiens
gtgtttggcaggagaatcaa

SEQ ID NO: 4194371 - DNA, 17 bp, Homo sapiens
gttaaatggagtatttt

SEQ ID NO: 4194372 - DNA, 15 bp, Homo sapiens
gttaacttggtcaga

SEQ ID NO: 4194373 - DNA, 16 bp, Homo sapiens
gttaacttggtcagag

SEQ ID NO: 4194374 - DNA, 22 bp, Homo sapiens
gttaagggaaggaactctggct

SEQ ID NO: 4194375 - DNA, 14 bp, Homo sapiens
gttaatttttgata

SEQ ID NO: 4194376 - DNA, 13 bp, Homo sapiens
gttacaaaaatag

SEQ ID NO: 4194377 - DNA, 19 bp, Homo sapiens
gttacagcgagaggcagag

SEQ ID NO: 4194378 - DNA, 19 bp, Homo sapiens
gttacatggaaaagttctt

SEQ ID NO: 4194379 - DNA, 15 bp, Homo sapiens
gttactatttttata

SEQ ID NO: 4194380 - DNA, 21 bp, Homo sapiens
gttactatttttatattctat

SEQ ID NO: 4194381 - DNA, 22 bp, Homo sapiens
gttactatttttatattctata

SEQ ID NO: 4194382 - DNA, 18 bp, Homo sapiens
gttactgaagttatctgt

SEQ ID NO: 4194383 - DNA, 12 bp, Homo sapiens
gttactgtgtga

SEQ ID NO: 4194384 - DNA, 20 bp, Homo sapiens
gttagagaatatatttttga

SEQ ID NO: 4194385 - DNA, 21 bp, Homo sapiens
gttaggaaataaaacctttca

SEQ ID NO: 4194386 - DNA, 23 bp, Homo sapiens
gttaggaaataaaacctttcaaa

SEQ ID NO: 4194387 - DNA, 16 bp, Homo sapiens
gttatcagttaacatt

SEQ ID NO: 4194388 - DNA, 17 bp, Homo sapiens
gttatgatcgcctgtgg

SEQ ID NO: 4194389 - DNA, 17 bp, Homo sapiens
gttatgtatatagatgt

SEQ ID NO: 4194390 - DNA, 18 bp, Homo sapiens
gttatgtatatagatgtg

SEQ ID NO: 4194391 - DNA, 17 bp, Homo sapiens
gttatttgtaatagatg

SEQ ID NO: 4194392 - DNA, 12 bp, Homo sapiens
gttattttcagt

SEQ ID NO: 4194393 - DNA, 14 bp, Homo sapiens
gttcaacttattaa

SEQ ID NO: 4194394 - DNA, 19 bp, Homo sapiens
gttcaccccttatcctgag

SEQ ID NO: 4194395 - DNA, 23 bp, Homo sapiens
gttcaccccttatcctgagcagt

SEQ ID NO: 4194396 - DNA, 13 bp, Homo sapiens
gttcactggagtc

SEQ ID NO: 4194397 - DNA, 15 bp, Homo sapiens
gttcagaggaagcac

SEQ ID NO: 4194398 - DNA, 21 bp, Homo sapiens
gttcagccagaatcttcgtcc

SEQ ID NO: 4194399 - DNA, 15 bp, Homo sapiens
gttccaaatgaatgt

SEQ ID NO: 4194400 - DNA, 12 bp, Homo sapiens
gttccatgaaga

SEQ ID NO: 4194401 - DNA, 16 bp, Homo sapiens
gttcccaatatgtagc

SEQ ID NO: 4194402 - DNA, 23 bp, Homo sapiens
gttcccgagggagctgctggctg

SEQ ID NO: 4194403 - DNA, 21 bp, Homo sapiens
gttccctagctgaggatgaca

SEQ ID NO: 4194404 - DNA, 15 bp, Homo sapiens
gttcctgcactccag

SEQ ID NO: 4194405 - DNA, 16 bp, Homo sapiens
gttcctgcactccaga

SEQ ID NO: 4194406 - DNA, 17 bp, Homo sapiens
gttcctgcactccagaa

SEQ ID NO: 4194407 - DNA, 17 bp, Homo sapiens
gttcgagaccagcctgg

SEQ ID NO: 4194408 - DNA, 18 bp, Homo sapiens
gttcgagaccagcctggc

SEQ ID NO: 4194409 - DNA, 13 bp, Homo sapiens
gttcgtagctttc

SEQ ID NO: 4194410 - DNA, 15 bp, Homo sapiens
gttctagagaagagg

SEQ ID NO: 4194411 - DNA, 19 bp, Homo sapiens
gttctaggtcctggcttct

SEQ ID NO: 4194412 - DNA, 21 bp, Homo sapiens
gttctctattttgcctttaaa

SEQ ID NO: 4194413 - DNA, 22 bp, Homo sapiens
gttctctttgccttgatgttgt

SEQ ID NO: 4194414 - DNA, 16 bp, Homo sapiens
gttctgagtcagagga

SEQ ID NO: 4194415 - DNA, 21 bp, Homo sapiens
gttctggattcaaatgtcagt

SEQ ID NO: 4194416 - DNA, 22 bp, Homo sapiens
gttctgtgacccatctgtagta

SEQ ID NO: 4194417 - DNA, 19 bp, Homo sapiens
gttcttgagtagatctgct

SEQ ID NO: 4194418 - DNA, 20 bp, Homo sapiens
gttcttgagtagatctgctt

SEQ ID NO: 4194419 - DNA, 23 bp, Homo sapiens
gttctttaaaatgtaaagccatg

SEQ ID NO: 4194420 - DNA, 15 bp, Homo sapiens
gttgacccctttccc

SEQ ID NO: 4194421 - DNA, 17 bp, Homo sapiens
gttgacccctttccccc

SEQ ID NO: 4194422 - DNA, 21 bp, Homo sapiens
gttgacccctttcccccaccc

SEQ ID NO: 4194423 - DNA, 12 bp, Homo sapiens
gttgagacagag

SEQ ID NO: 4194424 - DNA, 16 bp, Homo sapiens
gttgaggggctcctgg

SEQ ID NO: 4194425 - DNA, 17 bp, Homo sapiens
gttgaggggctcctgga

SEQ ID NO: 4194426 - DNA, 21 bp, Homo sapiens
gttgataaattccactggact

SEQ ID NO: 4194427 - DNA, 19 bp, Homo sapiens
gttgatacgtgtgtgaagt

SEQ ID NO: 4194428 - DNA, 14 bp, Homo sapiens
gttgcagacaggaa

SEQ ID NO: 4194429 - DNA, 15 bp, Homo sapiens
gttgcagacaggaat

SEQ ID NO: 4194430 - DNA, 16 bp, Homo sapiens
gttgcagacaggaatc

SEQ ID NO: 4194431 - DNA, 16 bp, Homo sapiens
gttgcagtgagctgag

SEQ ID NO: 4194432 - DNA, 16 bp, Homo sapiens
gttgccaatgtctgat

SEQ ID NO: 4194433 - DNA, 13 bp, Homo sapiens
gttgcccagcctg

SEQ ID NO: 4194434 - DNA, 18 bp, Homo sapiens
gttgccttaaagaaagtc

SEQ ID NO: 4194435 - DNA, 17 bp, Homo sapiens
tatactaccctgggctc

SEQ ID NO: 4194436 - DNA, 19 bp, Homo sapiens
tatactattaaaaaggttt

SEQ ID NO: 4194437 - DNA, 18 bp, Homo sapiens
tatactctctgaaatata

SEQ ID NO: 4194438 - DNA, 13 bp, Homo sapiens
tatagacagcact

SEQ ID NO: 4194439 - DNA, 15 bp, Homo sapiens
tatagagatatgcag

SEQ ID NO: 4194440 - DNA, 23 bp, Homo sapiens
tatagcaatccatgttagttttt

SEQ ID NO: 4194441 - DNA, 19 bp, Homo sapiens
tatagccaaaaatagctaa

SEQ ID NO: 4194442 - DNA, 22 bp, Homo sapiens
tatagccaaaaatagctaaata

SEQ ID NO: 4194443 - DNA, 14 bp, Homo sapiens
tatagctattactg

SEQ ID NO: 4194444 - DNA, 22 bp, Homo sapiens
tataggttgtgcaaattaacag

SEQ ID NO: 4194445 - DNA, 23 bp, Homo sapiens
tatagtatgatttttacaataat

SEQ ID NO: 4194446 - DNA, 13 bp, Homo sapiens
tatagtgtaaaat

SEQ ID NO: 4194447 - DNA, 22 bp, Homo sapiens
tatagttattaagttctttaaa

SEQ ID NO: 4194448 - DNA, 18 bp, Homo sapiens
tatagtttgtacatgcat

SEQ ID NO: 4194449 - DNA, 13 bp, Homo sapiens
tatatactacatg

SEQ ID NO: 4194450 - DNA, 13 bp, Homo sapiens
tatatagatgtgc

SEQ ID NO: 4194451 - DNA, 14 bp, Homo sapiens
tatatatataaaca

SEQ ID NO: 4194452 - DNA, 16 bp, Homo sapiens
tatatattgttgacaa

SEQ ID NO: 4194453 - DNA, 21 bp, Homo sapiens
tatatcactaagagctttata

SEQ ID NO: 4194454 - DNA, 14 bp, Homo sapiens
tatatcccagaaat

SEQ ID NO: 4194455 - DNA, 17 bp, Homo sapiens
tatatctgcttcagtgg

SEQ ID NO: 4194456 - DNA, 21 bp, Homo sapiens
tatatctgttttgtttcttga

SEQ ID NO: 4194457 - DNA, 20 bp, Homo sapiens
tatatcttatatataataat

SEQ ID NO: 4194458 - DNA, 14 bp, Homo sapiens
tatatgatcctgaa

SEQ ID NO: 4194459 - DNA, 21 bp, Homo sapiens
tatatgatttatagtttgtac

SEQ ID NO: 4194460 - DNA, 21 bp, Homo sapiens
tatatggaagataattttatg

SEQ ID NO: 4194461 - DNA, 14 bp, Homo sapiens
tatatggacaaatg

SEQ ID NO: 4194462 - DNA, 16 bp, Homo sapiens
tatatggcaagaaagc

SEQ ID NO: 4194463 - DNA, 14 bp, Homo sapiens
tatatgtatgtagt

SEQ ID NO: 4194464 - DNA, 19 bp, Homo sapiens
tatattacctcaaattcct

SEQ ID NO: 4194465 - DNA, 21 bp, Homo sapiens
tatattacctcaaattcctaa

SEQ ID NO: 4194466 - DNA, 16 bp, Homo sapiens
tatatttagttatagt

SEQ ID NO: 4194467 - DNA, 11 bp, Homo sapiens
tatatttggaa

SEQ ID NO: 4194468 - DNA, 16 bp, Homo sapiens
tatatttggaaagaga

SEQ ID NO: 4194469 - DNA, 18 bp, Homo sapiens
tatatttggaaagagacc

SEQ ID NO: 4194470 - DNA, 23 bp, Homo sapiens
tatattttcatgacttttccatg

SEQ ID NO: 4194471 - DNA, 24 bp, Homo sapiens
tatattttcatgacttttccatgt

SEQ ID NO: 4194472 - DNA, 21 bp, Homo sapiens
tatatttttgatggtaagact

SEQ ID NO: 4194473 - DNA, 19 bp, Homo sapiens
tatcaaacaccaacataaa

SEQ ID NO: 4194474 - DNA, 16 bp, Homo sapiens
tatcaaacttgtgctg

SEQ ID NO: 4194475 - DNA, 14 bp, Homo sapiens
tatcaacttcctaa

SEQ ID NO: 4194476 - DNA, 20 bp, Homo sapiens
tatcagtttgtcctgtagag

SEQ ID NO: 4194477 - DNA, 13 bp, Homo sapiens
tatcatgacatgt

SEQ ID NO: 4194478 - DNA, 14 bp, Homo sapiens
tatcatgacatgtt

SEQ ID NO: 4194479 - DNA, 16 bp, Homo sapiens
tatcattaaattggaa

SEQ ID NO: 4194480 - DNA, 11 bp, Homo sapiens
tatccaggact

SEQ ID NO: 4194481 - DNA, 17 bp, Homo sapiens
tatccatacagtcaaga

SEQ ID NO: 4194482 - DNA, 14 bp, Homo sapiens
tatcccagaaatta

SEQ ID NO: 4194483 - DNA, 20 bp, Homo sapiens
tatcccagcttgctgagggg

SEQ ID NO: 4194484 - DNA, 18 bp, Homo sapiens
tatccgactctaagctgt

SEQ ID NO: 4194485 - DNA, 19 bp, Homo sapiens
tatccgactctaagctgtg

SEQ ID NO: 4194486 - DNA, 16 bp, Homo sapiens
tatccttggagagcag

SEQ ID NO: 4194487 - DNA, 19 bp, Homo sapiens
tatccttggagagcagctg

SEQ ID NO: 4194488 - DNA, 17 bp, Homo sapiens
tatctaggcaacatagt

SEQ ID NO: 4194489 - DNA, 17 bp, Homo sapiens
tatctcaaagtttaaca

SEQ ID NO: 4194490 - DNA, 21 bp, Homo sapiens
tatctcaaagtttaacacaat

SEQ ID NO: 4194491 - DNA, 21 bp, Homo sapiens
tatctgaaggagattttcctt

SEQ ID NO: 4194492 - DNA, 19 bp, Homo sapiens
tatctgcagaatgggccac

SEQ ID NO: 4194493 - DNA, 21 bp, Homo sapiens
tatctgggtaagaagaaagca

SEQ ID NO: 4194494 - DNA, 19 bp, Homo sapiens
tatctgttttgtttcttga

SEQ ID NO: 4194495 - DNA, 17 bp, Homo sapiens
tatcttactatttcaca

SEQ ID NO: 4194496 - DNA, 15 bp, Homo sapiens
tatcttactctgtcc

SEQ ID NO: 4194497 - DNA, 14 bp, Homo sapiens
tatcttatgttaaa

SEQ ID NO: 4194498 - DNA, 19 bp, Homo sapiens
tatcttctgcagacactgt

SEQ ID NO: 4194499 - DNA, 22 bp, Homo sapiens
tatctttctagcagcagatctg

SEQ ID NO: 4194500 - DNA, 19 bp, Homo sapiens
tatgaacttgaggacacat

SEQ ID NO: 4194501 - DNA, 13 bp, Homo sapiens
tatgacttctgct

SEQ ID NO: 4194502 - DNA, 12 bp, Homo sapiens
tatgagctgagg

SEQ ID NO: 4194503 - DNA, 18 bp, Homo sapiens
tatgagtgggaaataaat

SEQ ID NO: 4194504 - DNA, 16 bp, Homo sapiens
tatgagttggacttca

SEQ ID NO: 4194505 - DNA, 15 bp, Homo sapiens
tatgatcgcgccact

SEQ ID NO: 4194506 - DNA, 19 bp, Homo sapiens
tatgcgtcccaagcagccg

SEQ ID NO: 4194507 - DNA, 15 bp, Homo sapiens
tatgctaattgaaca

SEQ ID NO: 4194508 - DNA, 12 bp, Homo sapiens
tatgctctcatt

SEQ ID NO: 4194509 - DNA, 13 bp, Homo sapiens
tatgctgtcatgg

SEQ ID NO: 4194510 - DNA, 12 bp, Homo sapiens
tatggaaatata

SEQ ID NO: 4194511 - DNA, 20 bp, Homo sapiens
tatggaacttctaatatatt

SEQ ID NO: 4194512 - DNA, 16 bp, Homo sapiens
tatggctcttcacctg

SEQ ID NO: 4194513 - DNA, 13 bp, Homo sapiens
tatgggaagccat

SEQ ID NO: 4194514 - DNA, 16 bp, Homo sapiens
tatggtaccagatgca

SEQ ID NO: 4194515 - DNA, 17 bp, Homo sapiens
tatggtgcaaaaatgag

SEQ ID NO: 4194516 - DNA, 20 bp, Homo sapiens
tatgtaaagtatgtaaacag

SEQ ID NO: 4194517 - DNA, 14 bp, Homo sapiens
tatgtaaatagctt

SEQ ID NO: 4194518 - DNA, 14 bp, Homo sapiens
tatgtaccaagaat

SEQ ID NO: 4194519 - DNA, 15 bp, Homo sapiens
tatgtacgtatatat

SEQ ID NO: 4194520 - DNA, 13 bp, Homo sapiens
tatgttagagagg

SEQ ID NO: 4194521 - DNA, 19 bp, Homo sapiens
tatgtttgctttaatgtgt

SEQ ID NO: 4194522 - DNA, 12 bp, Homo sapiens
tattaaaaatat

SEQ ID NO: 4194523 - DNA, 22 bp, Homo sapiens
tattaaaaatatggaacttcta

SEQ ID NO: 4194524 - DNA, 17 bp, Homo sapiens
tattaaaatgattgtaa

SEQ ID NO: 4194525 - DNA, 19 bp, Homo sapiens
tattaaaatgattgtaaaa

SEQ ID NO: 4194526 - DNA, 15 bp, Homo sapiens
tattaataaatttta

SEQ ID NO: 4194527 - DNA, 20 bp, Homo sapiens
tattaataaattttaacatt

SEQ ID NO: 4194528 - DNA, 19 bp, Homo sapiens
tattaattttcaggatttt

SEQ ID NO: 4194529 - DNA, 16 bp, Homo sapiens
tattacatggcagtgt

SEQ ID NO: 4194530 - DNA, 20 bp, Homo sapiens
tattacattttactgattaa

SEQ ID NO: 4194531 - DNA, 21 bp, Homo sapiens
tattaccttccacttccatgt

SEQ ID NO: 4194532 - DNA, 19 bp, Homo sapiens
tattactgtttttgctatt

SEQ ID NO: 4194533 - DNA, 13 bp, Homo sapiens
tattagttaatat

SEQ ID NO: 4194534 - DNA, 14 bp, Homo sapiens
tattatgagatgct

SEQ ID NO: 4194535 - DNA, 17 bp, Homo sapiens
tattatgagatgctggc

SEQ ID NO: 4194536 - DNA, 14 bp, Homo sapiens
tattattaataaat

SEQ ID NO: 4194537 - DNA, 22 bp, Homo sapiens
tattcagtgctgtggcctgggc

SEQ ID NO: 4194538 - DNA, 23 bp, Homo sapiens
tattcatcccttttcaaaagtca

SEQ ID NO: 4194539 - DNA, 14 bp, Homo sapiens
tattcatgcttctt

SEQ ID NO: 4194540 - DNA, 19 bp, Homo sapiens
tattcatgctttctccttt

SEQ ID NO: 4194541 - DNA, 20 bp, Homo sapiens
tattcatgggtgtcagcttt

SEQ ID NO: 4194542 - DNA, 19 bp, Homo sapiens
tattcctattctttgccac

SEQ ID NO: 4194543 - DNA, 20 bp, Homo sapiens
tattccttttgtgtacagtg

SEQ ID NO: 4194544 - DNA, 22 bp, Homo sapiens
tattctaaagctttctgacaag

SEQ ID NO: 4194545 - DNA, 17 bp, Homo sapiens
tattctatgtatgttaa

SEQ ID NO: 4194546 - DNA, 15 bp, Homo sapiens
tattctcaccaggaa

SEQ ID NO: 4194547 - DNA, 20 bp, Homo sapiens
tattgaagaaaagcactttt

SEQ ID NO: 4194548 - DNA, 12 bp, Homo sapiens
tattgaatgttt

SEQ ID NO: 4194549 - DNA, 17 bp, Homo sapiens
tattgaggggactaggc

SEQ ID NO: 4194550 - DNA, 17 bp, Homo sapiens
tattgcaaaaacatagt

SEQ ID NO: 4194551 - DNA, 16 bp, Homo sapiens
tattggaatataattg

SEQ ID NO: 4194552 - DNA, 16 bp, Homo sapiens
tattgtataaactatc

SEQ ID NO: 4194553 - DNA, 21 bp, Homo sapiens
tattgtataaactatcagttt

SEQ ID NO: 4194554 - DNA, 14 bp, Homo sapiens
tattgtctgtctac

SEQ ID NO: 4194555 - DNA, 15 bp, Homo sapiens
tattgtctgtctaca

SEQ ID NO: 4194556 - DNA, 16 bp, Homo sapiens
tatttaaaaaaagaaa

SEQ ID NO: 4194557 - DNA, 22 bp, Homo sapiens
tatttaaaaaaagaaatttgat

SEQ ID NO: 4194558 - DNA, 14 bp, Homo sapiens
tatttaaaaaacta

SEQ ID NO: 4194559 - DNA, 23 bp, Homo sapiens
tatttaaaatagcaaaagaagaa

SEQ ID NO: 4194560 - DNA, 21 bp, Homo sapiens
tatttaaaccgctaaaagaaa

SEQ ID NO: 4194561 - DNA, 14 bp, Homo sapiens
tatttaacttgagg

SEQ ID NO: 4194562 - DNA, 19 bp, Homo sapiens
tatttaatagcaaagaatt

SEQ ID NO: 4194563 - DNA, 22 bp, Homo sapiens
tatttaatagcaaagaattgac

SEQ ID NO: 4194564 - DNA, 14 bp, Homo sapiens
tatttactaaaaga

SEQ ID NO: 4194565 - DNA, 17 bp, Homo sapiens
tatttacttgaaagatg

SEQ ID NO: 4194566 - DNA, 19 bp, Homo sapiens
tatttagcttgggaaaggt

SEQ ID NO: 4194567 - DNA, 15 bp, Homo sapiens
tatttagttatagtt

SEQ ID NO: 4194568 - DNA, 14 bp, Homo sapiens
tatttagtttttaa

SEQ ID NO: 4194569 - DNA, 13 bp, Homo sapiens
tatttatatattt

SEQ ID NO: 4194570 - DNA, 16 bp, Homo sapiens
tcgaggagctcagggt

SEQ ID NO: 4194571 - DNA, 16 bp, Homo sapiens
tcgagtctacctcttc

SEQ ID NO: 4194572 - DNA, 18 bp, Homo sapiens
tcgatatcaccatgattt

SEQ ID NO: 4194573 - DNA, 22 bp, Homo sapiens
tcgcccacaagccttactcacc

SEQ ID NO: 4194574 - DNA, 14 bp, Homo sapiens
tcgccccacccagg

SEQ ID NO: 4194575 - DNA, 22 bp, Homo sapiens
tcgcgcgcagcgcgtgcacagc

SEQ ID NO: 4194576 - DNA, 17 bp, Homo sapiens
tcgctgtcctttctaga

SEQ ID NO: 4194577 - DNA, 13 bp, Homo sapiens
tcggaatgttaca

SEQ ID NO: 4194578 - DNA, 14 bp, Homo sapiens
tcggagcctgcctc

SEQ ID NO: 4194579 - DNA, 18 bp, Homo sapiens
tcggctggggactgctac

SEQ ID NO: 4194580 - DNA, 13 bp, Homo sapiens
tcgggacagagag

SEQ ID NO: 4194581 - DNA, 17 bp, Homo sapiens
tcggggcatgctggggc

SEQ ID NO: 4194582 - DNA, 14 bp, Homo sapiens
tcggggtgtgatga

SEQ ID NO: 4194583 - DNA, 12 bp, Homo sapiens
tcgtagctttcc

SEQ ID NO: 4194584 - DNA, 14 bp, Homo sapiens
tcgtccagccctcc

SEQ ID NO: 4194585 - DNA, 15 bp, Homo sapiens
tcgtccagccctcct

SEQ ID NO: 4194586 - DNA, 15 bp, Homo sapiens
tcgtccgctcagcca

SEQ ID NO: 4194587 - DNA, 13 bp, Homo sapiens
tcgtgcagagctg

SEQ ID NO: 4194588 - DNA, 15 bp, Homo sapiens
tcgtgcagagctggg

SEQ ID NO: 4194589 - DNA, 14 bp, Homo sapiens
tcgtggacacctgc

SEQ ID NO: 4194590 - DNA, 20 bp, Homo sapiens
tcgtggacacctgccctgcc

SEQ ID NO: 4194591 - DNA, 22 bp, Homo sapiens
tcgtggcagataatcagcctct

SEQ ID NO: 4194592 - DNA, 17 bp, Homo sapiens
tcgtggtagaagccagt

SEQ ID NO: 4194593 - DNA, 16 bp, Homo sapiens
tcgtgtttgcaaaggt

SEQ ID NO: 4194594 - DNA, 17 bp, Homo sapiens
tctaaacattaatcaat

SEQ ID NO: 4194595 - DNA, 13 bp, Homo sapiens
tctaaagagaaca

SEQ ID NO: 4194596 - DNA, 19 bp, Homo sapiens
tctaaagctggtttaatgt

SEQ ID NO: 4194597 - DNA, 21 bp, Homo sapiens
tctaaagctggtttaatgttt

SEQ ID NO: 4194598 - DNA, 19 bp, Homo sapiens
tctaaagttgttcacatat

SEQ ID NO: 4194599 - DNA, 22 bp, Homo sapiens
tctaaagtttacagtaaataaa

SEQ ID NO: 4194600 - DNA, 14 bp, Homo sapiens
tctaacaataatat

SEQ ID NO: 4194601 - DNA, 15 bp, Homo sapiens
tctaacaataatatt

SEQ ID NO: 4194602 - DNA, 21 bp, Homo sapiens
tctaacccccagtgccacaga

SEQ ID NO: 4194603 - DNA, 19 bp, Homo sapiens
tctaactagaaatctgcca

SEQ ID NO: 4194604 - DNA, 21 bp, Homo sapiens
tctaagcatcttgtcaagaaa

SEQ ID NO: 4194605 - DNA, 14 bp, Homo sapiens
tctaagctgtgtgc

SEQ ID NO: 4194606 - DNA, 20 bp, Homo sapiens
tctaagtagatagaaagcaa

SEQ ID NO: 4194607 - DNA, 16 bp, Homo sapiens
tctaagtatttgaaac

SEQ ID NO: 4194608 - DNA, 21 bp, Homo sapiens
tctaagtttagaagcgctcat

SEQ ID NO: 4194609 - DNA, 20 bp, Homo sapiens
tctaatatggcaaaaatggc

SEQ ID NO: 4194610 - DNA, 17 bp, Homo sapiens
tctaatattaaaaatat

SEQ ID NO: 4194611 - DNA, 18 bp, Homo sapiens
tctaatattaaaaatatg

SEQ ID NO: 4194612 - DNA, 19 bp, Homo sapiens
tctacaagcatttgccctg

SEQ ID NO: 4194613 - DNA, 16 bp, Homo sapiens
tctacagacttctcca

SEQ ID NO: 4194614 - DNA, 19 bp, Homo sapiens
tctacccggcccagagacc

SEQ ID NO: 4194615 - DNA, 17 bp, Homo sapiens
tctactcctacctcagc

SEQ ID NO: 4194616 - DNA, 17 bp, Homo sapiens
tctagaaaattgagttt

SEQ ID NO: 4194617 - DNA, 20 bp, Homo sapiens
tctagaatgtgttttctgaa

SEQ ID NO: 4194618 - DNA, 13 bp, Homo sapiens
tctagagaagagg

SEQ ID NO: 4194619 - DNA, 14 bp, Homo sapiens
tctagagcactgcc

SEQ ID NO: 4194620 - DNA, 15 bp, Homo sapiens
tctagccctccctgg

SEQ ID NO: 4194621 - DNA, 19 bp, Homo sapiens
tctagccgggccatgcttt

SEQ ID NO: 4194622 - DNA, 17 bp, Homo sapiens
tctaggtcctggcttct

SEQ ID NO: 4194623 - DNA, 19 bp, Homo sapiens
tctagtgatttcctgtata

SEQ ID NO: 4194624 - DNA, 16 bp, Homo sapiens
tctatagagaaaaact

SEQ ID NO: 4194625 - DNA, 17 bp, Homo sapiens
tctatagccaaaaatag

SEQ ID NO: 4194626 - DNA, 20 bp, Homo sapiens
tctatagccaaaaatagcta

SEQ ID NO: 4194627 - DNA, 23 bp, Homo sapiens
tctataggtcatgatttctgtga

SEQ ID NO: 4194628 - DNA, 22 bp, Homo sapiens
tctatattccgggtgccattcc

SEQ ID NO: 4194629 - DNA, 15 bp, Homo sapiens
tctatcttttccaca

SEQ ID NO: 4194630 - DNA, 18 bp, Homo sapiens
tctatcttttccacaaat

SEQ ID NO: 4194631 - DNA, 12 bp, Homo sapiens
tctatgtatgtt

SEQ ID NO: 4194632 - DNA, 16 bp, Homo sapiens
tctatgtatgttaatt

SEQ ID NO: 4194633 - DNA, 16 bp, Homo sapiens
tctattcaaaaggaaa

SEQ ID NO: 4194634 - DNA, 19 bp, Homo sapiens
tctcaaatccactgacaga

SEQ ID NO: 4194635 - DNA, 20 bp, Homo sapiens
tctcaaatccactgacagat

SEQ ID NO: 4194636 - DNA, 20 bp, Homo sapiens
tctcaatattcaataaagct

SEQ ID NO: 4194637 - DNA, 13 bp, Homo sapiens
tctcactaaactt

SEQ ID NO: 4194638 - DNA, 19 bp, Homo sapiens
tctcagaaggtattccttt

SEQ ID NO: 4194639 - DNA, 18 bp, Homo sapiens
tctcagaatgtcattttg

SEQ ID NO: 4194640 - DNA, 17 bp, Homo sapiens
tctcagcctacagcagt

SEQ ID NO: 4194641 - DNA, 22 bp, Homo sapiens
tctcagggttctgagtcagagg

SEQ ID NO: 4194642 - DNA, 18 bp, Homo sapiens
tctcagtcggtgtgtaat

SEQ ID NO: 4194643 - DNA, 13 bp, Homo sapiens
tctcagtggcttc

SEQ ID NO: 4194644 - DNA, 21 bp, Homo sapiens
tctcattcaggtgttctcttc

SEQ ID NO: 4194645 - DNA, 23 bp, Homo sapiens
tctcattgtagagcttggtggct

SEQ ID NO: 4194646 - DNA, 20 bp, Homo sapiens
tctcattttttaaaaaagct

SEQ ID NO: 4194647 - DNA, 18 bp, Homo sapiens
tctccaggtttgctgtgt

SEQ ID NO: 4194648 - DNA, 12 bp, Homo sapiens
tctccccctggg

SEQ ID NO: 4194649 - DNA, 15 bp, Homo sapiens
tctcccctgccctgc

SEQ ID NO: 4194650 - DNA, 14 bp, Homo sapiens
tctccctagaaaca

SEQ ID NO: 4194651 - DNA, 15 bp, Homo sapiens
tctccctagaaacaa

SEQ ID NO: 4194652 - DNA, 15 bp, Homo sapiens
tctcctaccccacct

SEQ ID NO: 4194653 - DNA, 16 bp, Homo sapiens
tctcctaccccacctc

SEQ ID NO: 4194654 - DNA, 23 bp, Homo sapiens
tctcctaccccacctcatgcctg

SEQ ID NO: 4194655 - DNA, 15 bp, Homo sapiens
tctcctcccagcgtg

SEQ ID NO: 4194656 - DNA, 21 bp, Homo sapiens
tctcctcccagcgtgtgtatc

SEQ ID NO: 4194657 - DNA, 22 bp, Homo sapiens
tctcctcccagcgtgtgtatcc

SEQ ID NO: 4194658 - DNA, 18 bp, Homo sapiens
tctcctcccatggccttc

SEQ ID NO: 4194659 - DNA, 13 bp, Homo sapiens
tctcctcctctgt

SEQ ID NO: 4194660 - DNA, 21 bp, Homo sapiens
tctcctgtagcacaaagaggg

SEQ ID NO: 4194661 - DNA, 22 bp, Homo sapiens
tctcctgtcagagatctgggag

SEQ ID NO: 4194662 - DNA, 11 bp, Homo sapiens
tctccttccct

SEQ ID NO: 4194663 - DNA, 14 bp, Homo sapiens
tctcctttcaggga

SEQ ID NO: 4194664 - DNA, 12 bp, Homo sapiens
tctcgtctcctg

SEQ ID NO: 4194665 - DNA, 20 bp, Homo sapiens
tctcgtggtagaagccagta

SEQ ID NO: 4194666 - DNA, 19 bp, Homo sapiens
tctctactcctacctcagc

SEQ ID NO: 4194667 - DNA, 20 bp, Homo sapiens
tctctactcctacctcagcc

SEQ ID NO: 4194668 - DNA, 16 bp, Homo sapiens
tctctaggctgttttc

SEQ ID NO: 4194669 - DNA, 20 bp, Homo sapiens
tctctctactcctacctcag

SEQ ID NO: 4194670 - DNA, 20 bp, Homo sapiens
tctctgatgtgatatccact

SEQ ID NO: 4194671 - DNA, 14 bp, Homo sapiens
tctctgctccagag

SEQ ID NO: 4194672 - DNA, 13 bp, Homo sapiens
tctctgctgagca

SEQ ID NO: 4194673 - DNA, 20 bp, Homo sapiens
tctctgctgagcagcccagc

SEQ ID NO: 4194674 - DNA, 15 bp, Homo sapiens
tctctggctccagaa

SEQ ID NO: 4194675 - DNA, 18 bp, Homo sapiens
tctcttccctccttccct

SEQ ID NO: 4194676 - DNA, 20 bp, Homo sapiens
tctcttgaattattttgcag

SEQ ID NO: 4194677 - DNA, 13 bp, Homo sapiens
tctcttgccagca

SEQ ID NO: 4194678 - DNA, 18 bp, Homo sapiens
tctgaaacatatttatag

SEQ ID NO: 4194679 - DNA, 20 bp, Homo sapiens
tctgaaattggtgggaagca

SEQ ID NO: 4194680 - DNA, 23 bp, Homo sapiens
tctgaaattggtgggaagcaagc

SEQ ID NO: 4194681 - DNA, 15 bp, Homo sapiens
tctgaactgttacaa

SEQ ID NO: 4194682 - DNA, 16 bp, Homo sapiens
tctgaataacatttgt

SEQ ID NO: 4194683 - DNA, 15 bp, Homo sapiens
tctgaatttttaaac

SEQ ID NO: 4194684 - DNA, 17 bp, Homo sapiens
tctgaatttttaaacaa

SEQ ID NO: 4194685 - DNA, 19 bp, Homo sapiens
tctgaatttttaaacaagt

SEQ ID NO: 4194686 - DNA, 14 bp, Homo sapiens
tctgacccagtgag

SEQ ID NO: 4194687 - DNA, 15 bp, Homo sapiens
tctgacccagtgaga

SEQ ID NO: 4194688 - DNA, 16 bp, Homo sapiens
tctgacctgcaggcca

SEQ ID NO: 4194689 - DNA, 21 bp, Homo sapiens
tctgacctgcaggccaagagc

SEQ ID NO: 4194690 - DNA, 15 bp, Homo sapiens
tctgagcaccccctc

SEQ ID NO: 4194691 - DNA, 20 bp, Homo sapiens
tctgagcaccccctcattcc

SEQ ID NO: 4194692 - DNA, 21 bp, Homo sapiens
tctgagcaccccctcattccc

SEQ ID NO: 4194693 - DNA, 19 bp, Homo sapiens
tctgaggctctttctgggc

SEQ ID NO: 4194694 - DNA, 21 bp, Homo sapiens
tctgaggctctttctgggcca

SEQ ID NO: 4194695 - DNA, 16 bp, Homo sapiens
tctgatacccagagca

SEQ ID NO: 4194696 - DNA, 18 bp, Homo sapiens
tctgatttcactcagggt

SEQ ID NO: 4194697 - DNA, 19 bp, Homo sapiens
tctgcaaaaagatttaaca

SEQ ID NO: 4194698 - DNA, 23 bp, Homo sapiens
tctgcaaaaagatttaacaaata

SEQ ID NO: 4194699 - DNA, 13 bp, Homo sapiens
tctgcactgggtg

SEQ ID NO: 4194700 - DNA, 19 bp, Homo sapiens
tctgcagacactgtgggta

SEQ ID NO: 4194701 - DNA, 21 bp, Homo sapiens
tctgcagcactttaaccctct

SEQ ID NO: 4194702 - DNA, 16 bp, Homo sapiens
tctgcagggagcaact

SEQ ID NO: 4194703 - DNA, 19 bp, Homo sapiens
tctgccacagagagtcctt

SEQ ID NO: 4194704 - DNA, 10 bp, Homo sapiens
tctgccacca

SEQ ID NO: 4194705 - DNA, 17 bp, Homo sapiens
tggatatgtaaaacatt

SEQ ID NO: 4194706 - DNA, 21 bp, Homo sapiens
tggatatgtaaaacatttatt

SEQ ID NO: 4194707 - DNA, 14 bp, Homo sapiens
tggatctcaatctt

SEQ ID NO: 4194708 - DNA, 15 bp, Homo sapiens
tggatctccaaggac

SEQ ID NO: 4194709 - DNA, 21 bp, Homo sapiens
tggatctccaaggaccaggtt

SEQ ID NO: 4194710 - DNA, 16 bp, Homo sapiens
tggatctgtccaagga

SEQ ID NO: 4194711 - DNA, 14 bp, Homo sapiens
tggatgaaattttc

SEQ ID NO: 4194712 - DNA, 17 bp, Homo sapiens
tggatgaaattttctag

SEQ ID NO: 4194713 - DNA, 13 bp, Homo sapiens
tggatgaccagaa

SEQ ID NO: 4194714 - DNA, 19 bp, Homo sapiens
tggatggcccagcaggcag

SEQ ID NO: 4194715 - DNA, 15 bp, Homo sapiens
tggatgggccctgca

SEQ ID NO: 4194716 - DNA, 21 bp, Homo sapiens
tggatggtctttgggcaggga

SEQ ID NO: 4194717 - DNA, 16 bp, Homo sapiens
tggattccagcatttg

SEQ ID NO: 4194718 - DNA, 13 bp, Homo sapiens
tggattctaaaat

SEQ ID NO: 4194719 - DNA, 15 bp, Homo sapiens
tggattctaaaatgc

SEQ ID NO: 4194720 - DNA, 21 bp, Homo sapiens
tggatttgatgagttaactgt

SEQ ID NO: 4194721 - DNA, 13 bp, Homo sapiens
tggcaacagaagc

SEQ ID NO: 4194722 - DNA, 21 bp, Homo sapiens
tggcaacagttagctggagct

SEQ ID NO: 4194723 - DNA, 15 bp, Homo sapiens
tggcaagactactgg

SEQ ID NO: 4194724 - DNA, 15 bp, Homo sapiens
tggcaatttcctggc

SEQ ID NO: 4194725 - DNA, 19 bp, Homo sapiens
tggcaatttcctggccctc

SEQ ID NO: 4194726 - DNA, 20 bp, Homo sapiens
tggcaccatccaccctgcag

SEQ ID NO: 4194727 - DNA, 16 bp, Homo sapiens
tggcagagcacagccc

SEQ ID NO: 4194728 - DNA, 18 bp, Homo sapiens
tggcagagcacagcccac

SEQ ID NO: 4194729 - DNA, 19 bp, Homo sapiens
tggcagataatcagcctct

SEQ ID NO: 4194730 - DNA, 21 bp, Homo sapiens
tggcagataatcagcctctta

SEQ ID NO: 4194731 - DNA, 11 bp, Homo sapiens
tggcagccctg

SEQ ID NO: 4194732 - DNA, 17 bp, Homo sapiens
tggcagccctgtaggga

SEQ ID NO: 4194733 - DNA, 15 bp, Homo sapiens
tggcaggaaggcttg

SEQ ID NO: 4194734 - DNA, 23 bp, Homo sapiens
tggcaggagaatcaataaaaatc

SEQ ID NO: 4194735 - DNA, 22 bp, Homo sapiens
tggcagtggaaaaatcagaagc

SEQ ID NO: 4194736 - DNA, 15 bp, Homo sapiens
tggcatcacagggca

SEQ ID NO: 4194737 - DNA, 18 bp, Homo sapiens
tggcatcacagggcagag

SEQ ID NO: 4194738 - DNA, 18 bp, Homo sapiens
tggcatgagaaatacaaa

SEQ ID NO: 4194739 - DNA, 18 bp, Homo sapiens
tggcatgcttaaatattg

SEQ ID NO: 4194740 - DNA, 14 bp, Homo sapiens
tggcatgtcagagc

SEQ ID NO: 4194741 - DNA, 15 bp, Homo sapiens
tggcatgtcagagcc

SEQ ID NO: 4194742 - DNA, 20 bp, Homo sapiens
tggccaaattatttgtgtaa

SEQ ID NO: 4194743 - DNA, 13 bp, Homo sapiens
tggccaagcctgg

SEQ ID NO: 4194744 - DNA, 20 bp, Homo sapiens
tggccaaggtgaatagcaca

SEQ ID NO: 4194745 - DNA, 20 bp, Homo sapiens
tggccaggctggtcttgaac

SEQ ID NO: 4194746 - DNA, 16 bp, Homo sapiens
tggccagtgtgatccc

SEQ ID NO: 4194747 - DNA, 16 bp, Homo sapiens
tggccatcagggtggg

SEQ ID NO: 4194748 - DNA, 21 bp, Homo sapiens
tggccatggaataaaccattt

SEQ ID NO: 4194749 - DNA, 22 bp, Homo sapiens
tggcccagtcgtccgctcagcc

SEQ ID NO: 4194750 - DNA, 23 bp, Homo sapiens
tggcccagtcgtccgctcagcca

SEQ ID NO: 4194751 - DNA, 12 bp, Homo sapiens
tggcccccctcc

SEQ ID NO: 4194752 - DNA, 14 bp, Homo sapiens
tggcccccctccag

SEQ ID NO: 4194753 - DNA, 12 bp, Homo sapiens
tggccctcagat

SEQ ID NO: 4194754 - DNA, 12 bp, Homo sapiens
tggccctcagtg

SEQ ID NO: 4194755 - DNA, 19 bp, Homo sapiens
tggccctgtgactatggct

SEQ ID NO: 4194756 - DNA, 19 bp, Homo sapiens
tggcccttaaacaactgca

SEQ ID NO: 4194757 - DNA, 19 bp, Homo sapiens
tggcccttctgtccaccag

SEQ ID NO: 4194758 - DNA, 17 bp, Homo sapiens
tggccgggtgcggtggc

SEQ ID NO: 4194759 - DNA, 17 bp, Homo sapiens
tggcctcccaataaagc

SEQ ID NO: 4194760 - DNA, 12 bp, Homo sapiens
tggcctctgctt

SEQ ID NO: 4194761 - DNA, 13 bp, Homo sapiens
tggcctctgcttt

SEQ ID NO: 4194762 - DNA, 18 bp, Homo sapiens
tggccttccctccccaca

SEQ ID NO: 4194763 - DNA, 19 bp, Homo sapiens
tggccttctcagcctacag

SEQ ID NO: 4194764 - DNA, 24 bp, Homo sapiens
tggcctttcaggtccaggccagtg

SEQ ID NO: 4194765 - DNA, 17 bp, Homo sapiens
tggcgggcgcctgtagt

SEQ ID NO: 4194766 - DNA, 22 bp, Homo sapiens
tggctaggaaagggaagcctga

SEQ ID NO: 4194767 - DNA, 13 bp, Homo sapiens
tggctatgttttt

SEQ ID NO: 4194768 - DNA, 17 bp, Homo sapiens
tggctatgtttttaatg

SEQ ID NO: 4194769 - DNA, 18 bp, Homo sapiens
tggctatgtttttaatgt

SEQ ID NO: 4194770 - DNA, 21 bp, Homo sapiens
tggctatttaaaaagctcttt

SEQ ID NO: 4194771 - DNA, 12 bp, Homo sapiens
tggctattttat

SEQ ID NO: 4194772 - DNA, 11 bp, Homo sapiens
tggctccagaa

SEQ ID NO: 4194773 - DNA, 18 bp, Homo sapiens
tggctctcaggggccagt

SEQ ID NO: 4194774 - DNA, 21 bp, Homo sapiens
tggctgaccccaaagagcctg

SEQ ID NO: 4194775 - DNA, 15 bp, Homo sapiens
tggctgagcttggcc

SEQ ID NO: 4194776 - DNA, 19 bp, Homo sapiens
tggctgataattttaaatt

SEQ ID NO: 4194777 - DNA, 14 bp, Homo sapiens
tggctgcaggaatc

SEQ ID NO: 4194778 - DNA, 21 bp, Homo sapiens
tggcttacaaattctacagca

SEQ ID NO: 4194779 - DNA, 13 bp, Homo sapiens
tggcttagaaatc

SEQ ID NO: 4194780 - DNA, 14 bp, Homo sapiens
tggcttagtgccac

SEQ ID NO: 4194781 - DNA, 22 bp, Homo sapiens
tggcttccagaaaaccccagca

SEQ ID NO: 4194782 - DNA, 15 bp, Homo sapiens
tggcttccaggtatc

SEQ ID NO: 4194783 - DNA, 20 bp, Homo sapiens
tggcttccaggtatctccag

SEQ ID NO: 4194784 - DNA, 19 bp, Homo sapiens
tggcttctagatctggaac

SEQ ID NO: 4194785 - DNA, 23 bp, Homo sapiens
tggcttctccatcctcatttgca

SEQ ID NO: 4194786 - DNA, 14 bp, Homo sapiens
tggcttctggagcc

SEQ ID NO: 4194787 - DNA, 15 bp, Homo sapiens
tggcttctggccagg

SEQ ID NO: 4194788 - DNA, 19 bp, Homo sapiens
tggcttctggccaggaagc

SEQ ID NO: 4194789 - DNA, 14 bp, Homo sapiens
tggcttgctgtggc

SEQ ID NO: 4194790 - DNA, 22 bp, Homo sapiens
tggctttctccgactgctaggg

SEQ ID NO: 4194791 - DNA, 13 bp, Homo sapiens
tgggaagacatga

SEQ ID NO: 4194792 - DNA, 17 bp, Homo sapiens
tgggaagagaagggaag

SEQ ID NO: 4194793 - DNA, 16 bp, Homo sapiens
tgggaagcaagcaggg

SEQ ID NO: 4194794 - DNA, 12 bp, Homo sapiens
tgggaagctggg

SEQ ID NO: 4194795 - DNA, 16 bp, Homo sapiens
tgggaatcctgctgcc

SEQ ID NO: 4194796 - DNA, 23 bp, Homo sapiens
tgggacaaaccagagcagagagc

SEQ ID NO: 4194797 - DNA, 18 bp, Homo sapiens
tgggacaagttagtcttt

SEQ ID NO: 4194798 - DNA, 20 bp, Homo sapiens
tgggaccctccagtgctgga

SEQ ID NO: 4194799 - DNA, 21 bp, Homo sapiens
tgggaccctccagtgctggat

SEQ ID NO: 4194800 - DNA, 20 bp, Homo sapiens
tgggacttctacccagatgg

SEQ ID NO: 4194801 - DNA, 14 bp, Homo sapiens
tgggagaacctcag

SEQ ID NO: 4194802 - DNA, 22 bp, Homo sapiens
tgggagaacctcaggcttcctt

SEQ ID NO: 4194803 - DNA, 23 bp, Homo sapiens
tgggagaacctcaggcttccttg

SEQ ID NO: 4194804 - DNA, 12 bp, Homo sapiens
tgggagaagaga

SEQ ID NO: 4194805 - DNA, 22 bp, Homo sapiens
tgggagacgaacggaagggttg

SEQ ID NO: 4194806 - DNA, 19 bp, Homo sapiens
tgggagagaatatttcaaa

SEQ ID NO: 4194807 - DNA, 16 bp, Homo sapiens
tgggagagccagctct

SEQ ID NO: 4194808 - DNA, 17 bp, Homo sapiens
tgggagagccagctctc

SEQ ID NO: 4194809 - DNA, 14 bp, Homo sapiens
tgggagagcccagc

SEQ ID NO: 4194810 - DNA, 13 bp, Homo sapiens
tgggagagcctgg

SEQ ID NO: 4194811 - DNA, 14 bp, Homo sapiens
tgggagctcagctc

SEQ ID NO: 4194812 - DNA, 13 bp, Homo sapiens
tgggaggctgagg

SEQ ID NO: 4194813 - DNA, 14 bp, Homo sapiens
tgggagggatgaga

SEQ ID NO: 4194814 - DNA, 20 bp, Homo sapiens
tgggaggggatggcagacag

SEQ ID NO: 4194815 - DNA, 13 bp, Homo sapiens
tgggagggtggtg

SEQ ID NO: 4194816 - DNA, 20 bp, Homo sapiens
tgggaggtctccactgagga

SEQ ID NO: 4194817 - DNA, 19 bp, Homo sapiens
tgggaggtgagaccacctc

SEQ ID NO: 4194818 - DNA, 13 bp, Homo sapiens
tgggatgcggggc

SEQ ID NO: 4194819 - DNA, 21 bp, Homo sapiens
tgggattacagacatgagcca

SEQ ID NO: 4194820 - DNA, 23 bp, Homo sapiens
tgggattcccaccaaggtcttca

SEQ ID NO: 4194821 - DNA, 17 bp, Homo sapiens
tgggcaatgaaaccaaa

SEQ ID NO: 4194822 - DNA, 15 bp, Homo sapiens
tgggcactgctgagg

SEQ ID NO: 4194823 - DNA, 18 bp, Homo sapiens
tgggcagaagggagaagg

SEQ ID NO: 4194824 - DNA, 13 bp, Homo sapiens
tgggcagaggctg

SEQ ID NO: 4194825 - DNA, 16 bp, Homo sapiens
tgggcagttgggagtg

SEQ ID NO: 4194826 - DNA, 17 bp, Homo sapiens
tgggcagttgggagtga

SEQ ID NO: 4194827 - DNA, 18 bp, Homo sapiens
tgggccactctcccctcc

SEQ ID NO: 4194828 - DNA, 13 bp, Homo sapiens
tgggcccacagag

SEQ ID NO: 4194829 - DNA, 16 bp, Homo sapiens
tgggcccacagagcct

SEQ ID NO: 4194830 - DNA, 19 bp, Homo sapiens
tgggcccacagagcctggc

SEQ ID NO: 4194831 - DNA, 21 bp, Homo sapiens
tgggcccaggaggtcaagcct

SEQ ID NO: 4194832 - DNA, 14 bp, Homo sapiens
tgggccgggaggca

SEQ ID NO: 4194833 - DNA, 17 bp, Homo sapiens
tgggccgggaggcagtg

SEQ ID NO: 4194834 - DNA, 17 bp, Homo sapiens
tgggctctgccccagct

SEQ ID NO: 4194835 - DNA, 15 bp, Homo sapiens
tgggctgagccctgg

SEQ ID NO: 4194836 - DNA, 18 bp, Homo sapiens
tgggctgagccctggcag

SEQ ID NO: 4194837 - DNA, 14 bp, Homo sapiens
tgggctgcagaaga

SEQ ID NO: 4194838 - DNA, 12 bp, Homo sapiens
tgggctggccca

SEQ ID NO: 4194839 - DNA, 15 bp, Homo sapiens
tgggctgtcaacatt

SEQ ID NO: 4194840 - DNA, 15 bp, Homo sapiens
ttaggcatgcctaat

SEQ ID NO: 4194841 - DNA, 14 bp, Homo sapiens
ttagtgcctgtgtg

SEQ ID NO: 4194842 - DNA, 17 bp, Homo sapiens
ttagtttttaacaatct

SEQ ID NO: 4194843 - DNA, 17 bp, Homo sapiens
ttataaatatgtgaaaa

SEQ ID NO: 4194844 - DNA, 20 bp, Homo sapiens
ttatagtttgctttgctttt

SEQ ID NO: 4194845 - DNA, 22 bp, Homo sapiens
ttatatctgttttgtttcttga

SEQ ID NO: 4194846 - DNA, 22 bp, Homo sapiens
ttatatttagttatagtttcag

SEQ ID NO: 4194847 - DNA, 14 bp, Homo sapiens
ttatatttggaaag

SEQ ID NO: 4194848 - DNA, 17 bp, Homo sapiens
ttatattttctattaca

SEQ ID NO: 4194849 - DNA, 19 bp, Homo sapiens
ttatatttttgtaaatagt

SEQ ID NO: 4194850 - DNA, 12 bp, Homo sapiens
ttatcaaaatct

SEQ ID NO: 4194851 - DNA, 17 bp, Homo sapiens
ttatcagttaacattaa

SEQ ID NO: 4194852 - DNA, 15 bp, Homo sapiens
ttatcatttaagatt

SEQ ID NO: 4194853 - DNA, 18 bp, Homo sapiens
ttatgaaaaagaagaatc

SEQ ID NO: 4194854 - DNA, 15 bp, Homo sapiens
ttatgagaaagcctt

SEQ ID NO: 4194855 - DNA, 16 bp, Homo sapiens
ttatggaaatatagtt

SEQ ID NO: 4194856 - DNA, 22 bp, Homo sapiens
ttatggggtattttaagcattc

SEQ ID NO: 4194857 - DNA, 17 bp, Homo sapiens
ttatggtgtgttcctaa

SEQ ID NO: 4194858 - DNA, 21 bp, Homo sapiens
ttatgtagctaaacattgtga

SEQ ID NO: 4194859 - DNA, 19 bp, Homo sapiens
ttatgtctcaaaataagtt

SEQ ID NO: 4194860 - DNA, 17 bp, Homo sapiens
ttatgtctgtggatttt

SEQ ID NO: 4194861 - DNA, 20 bp, Homo sapiens
ttattaaaatgattgtaaaa

SEQ ID NO: 4194862 - DNA, 20 bp, Homo sapiens
ttattccttgctttcatcac

SEQ ID NO: 4194863 - DNA, 17 bp, Homo sapiens
ttattgatttttgtaat

SEQ ID NO: 4194864 - DNA, 19 bp, Homo sapiens
ttattgtacagctgtttaa

SEQ ID NO: 4194865 - DNA, 14 bp, Homo sapiens
ttattgtataaact

SEQ ID NO: 4194866 - DNA, 21 bp, Homo sapiens
ttattgtataaactatcagtt

SEQ ID NO: 4194867 - DNA, 22 bp, Homo sapiens
ttattgtataaactatcagttt

SEQ ID NO: 4194868 - DNA, 17 bp, Homo sapiens
ttatttaaaaaactaaa

SEQ ID NO: 4194869 - DNA, 22 bp, Homo sapiens
ttatttaaaatagcaaaagaag

SEQ ID NO: 4194870 - DNA, 23 bp, Homo sapiens
ttatttaaaccgctaaaagaaac

SEQ ID NO: 4194871 - DNA, 15 bp, Homo sapiens
ttatttgtacagttc

SEQ ID NO: 4194872 - DNA, 14 bp, Homo sapiens
ttattttcagtatt

SEQ ID NO: 4194873 - DNA, 15 bp, Homo sapiens
ttattttgacataaa

SEQ ID NO: 4194874 - DNA, 13 bp, Homo sapiens
ttattttttattg

SEQ ID NO: 4194875 - DNA, 14 bp, Homo sapiens
ttcaaaatgttcgt

SEQ ID NO: 4194876 - DNA, 16 bp, Homo sapiens
ttcaaaccctcaagag

SEQ ID NO: 4194877 - DNA, 18 bp, Homo sapiens
ttcaaactattgggaggg

SEQ ID NO: 4194878 - DNA, 23 bp, Homo sapiens
ttcaaatggcagcagttccatga

SEQ ID NO: 4194879 - DNA, 13 bp, Homo sapiens
ttcaaatttcaca

SEQ ID NO: 4194880 - DNA, 14 bp, Homo sapiens
ttcaacaattctaa

SEQ ID NO: 4194881 - DNA, 19 bp, Homo sapiens
ttcaacaattctaaaatga

SEQ ID NO: 4194882 - DNA, 18 bp, Homo sapiens
ttcaacagtgaagacaga

SEQ ID NO: 4194883 - DNA, 17 bp, Homo sapiens
ttcaacatgttatttgt

SEQ ID NO: 4194884 - DNA, 21 bp, Homo sapiens
ttcaacatgttatttgtaata

SEQ ID NO: 4194885 - DNA, 13 bp, Homo sapiens
ttcaactccagaa

SEQ ID NO: 4194886 - DNA, 14 bp, Homo sapiens
ttcaactccagaag

SEQ ID NO: 4194887 - DNA, 16 bp, Homo sapiens
ttcaagagacactgct

SEQ ID NO: 4194888 - DNA, 15 bp, Homo sapiens
ttcaagtatctaact

SEQ ID NO: 4194889 - DNA, 12 bp, Homo sapiens
ttcaagtgccaa

SEQ ID NO: 4194890 - DNA, 14 bp, Homo sapiens
ttcaagtgcctaga

SEQ ID NO: 4194891 - DNA, 17 bp, Homo sapiens
ttcaagttagctcagga

SEQ ID NO: 4194892 - DNA, 14 bp, Homo sapiens
ttcaagttattgta

SEQ ID NO: 4194893 - DNA, 17 bp, Homo sapiens
ttcaagttattgtacag

SEQ ID NO: 4194894 - DNA, 15 bp, Homo sapiens
ttcaattcaaagctg

SEQ ID NO: 4194895 - DNA, 13 bp, Homo sapiens
ttcaattcctggg

SEQ ID NO: 4194896 - DNA, 16 bp, Homo sapiens
ttcaattcctgggccc

SEQ ID NO: 4194897 - DNA, 22 bp, Homo sapiens
ttcacaacagcctgacaacatt

SEQ ID NO: 4194898 - DNA, 17 bp, Homo sapiens
ttcacacctcacgctct

SEQ ID NO: 4194899 - DNA, 23 bp, Homo sapiens
ttcacacctcacgctctggacat

SEQ ID NO: 4194900 - DNA, 11 bp, Homo sapiens
ttcacacctta

SEQ ID NO: 4194901 - DNA, 12 bp, Homo sapiens
ttcacagcccag

SEQ ID NO: 4194902 - DNA, 19 bp, Homo sapiens
ttcacagcctataaccaga

SEQ ID NO: 4194903 - DNA, 16 bp, Homo sapiens
ttcacattagaagaca

SEQ ID NO: 4194904 - DNA, 17 bp, Homo sapiens
ttcaccccttatcctga

SEQ ID NO: 4194905 - DNA, 21 bp, Homo sapiens
ttcacctgggcgccaactgct

SEQ ID NO: 4194906 - DNA, 17 bp, Homo sapiens
ttcactcagccacaccc

SEQ ID NO: 4194907 - DNA, 21 bp, Homo sapiens
ttcactccggtgtgcctgcag

SEQ ID NO: 4194908 - DNA, 23 bp, Homo sapiens
ttcactccggtgtgcctgcagcc

SEQ ID NO: 4194909 - DNA, 20 bp, Homo sapiens
ttcactcttcaaatgcctga

SEQ ID NO: 4194910 - DNA, 22 bp, Homo sapiens
ttcactgaagaaaccttcagat

SEQ ID NO: 4194911 - DNA, 16 bp, Homo sapiens
ttcagaagacactgca

SEQ ID NO: 4194912 - DNA, 20 bp, Homo sapiens
ttcagaaggcctcactcaag

SEQ ID NO: 4194913 - DNA, 14 bp, Homo sapiens
ttcagacgagatcc

SEQ ID NO: 4194914 - DNA, 18 bp, Homo sapiens
ttcagacttttatcaaaa

SEQ ID NO: 4194915 - DNA, 15 bp, Homo sapiens
ttcagatatatatca

SEQ ID NO: 4194916 - DNA, 15 bp, Homo sapiens
ttcagatgtgaacca

SEQ ID NO: 4194917 - DNA, 19 bp, Homo sapiens
ttcagcctggccatcccca

SEQ ID NO: 4194918 - DNA, 23 bp, Homo sapiens
ttcagctgtgaacatggactctt

SEQ ID NO: 4194919 - DNA, 23 bp, Homo sapiens
ttcagctttggtgaaagggaggg

SEQ ID NO: 4194920 - DNA, 17 bp, Homo sapiens
ttcagggtgagtgaatg

SEQ ID NO: 4194921 - DNA, 14 bp, Homo sapiens
ttcagggttataca

SEQ ID NO: 4194922 - DNA, 14 bp, Homo sapiens
ttcaggtccaggct

SEQ ID NO: 4194923 - DNA, 21 bp, Homo sapiens
ttcagtattttggagaaatta

SEQ ID NO: 4194924 - DNA, 18 bp, Homo sapiens
ttcagtgacaagtagggc

SEQ ID NO: 4194925 - DNA, 13 bp, Homo sapiens
ttcagtgctgtgg

SEQ ID NO: 4194926 - DNA, 21 bp, Homo sapiens
ttcagtgctgtggcctgggca

SEQ ID NO: 4194927 - DNA, 20 bp, Homo sapiens
ttcagttttccttagttttt

SEQ ID NO: 4194928 - DNA, 13 bp, Homo sapiens
ttcataaggaaat

SEQ ID NO: 4194929 - DNA, 19 bp, Homo sapiens
ttcatacttctaaatcaga

SEQ ID NO: 4194930 - DNA, 14 bp, Homo sapiens
ttcatcatttttta

SEQ ID NO: 4194931 - DNA, 23 bp, Homo sapiens
ttcatgcccttctgattcccctc

SEQ ID NO: 4194932 - DNA, 23 bp, Homo sapiens
ttcatgccgtggtaagtaccaca

SEQ ID NO: 4194933 - DNA, 16 bp, Homo sapiens
ttcatgtctgctatca

SEQ ID NO: 4194934 - DNA, 13 bp, Homo sapiens
ttcatgttctgtg

SEQ ID NO: 4194935 - DNA, 11 bp, Homo sapiens
ttcatttttgg

SEQ ID NO: 4194936 - DNA, 17 bp, Homo sapiens
ttccaaacctggttcat

SEQ ID NO: 4194937 - DNA, 21 bp, Homo sapiens
ttccaaatgaatgttgtctgt

SEQ ID NO: 4194938 - DNA, 23 bp, Homo sapiens
ttccaagggtatgggaagccata

SEQ ID NO: 4194939 - DNA, 13 bp, Homo sapiens
ttccacaaatatg

SEQ ID NO: 4194940 - DNA, 14 bp, Homo sapiens
ttccacaaatatga

SEQ ID NO: 4194941 - DNA, 14 bp, Homo sapiens
ttccactcatgccg

SEQ ID NO: 4194942 - DNA, 20 bp, Homo sapiens
ttccactgcaaatttcaaaa

SEQ ID NO: 4194943 - DNA, 23 bp, Homo sapiens
ttccagataaccagctgtaacac

SEQ ID NO: 4194944 - DNA, 15 bp, Homo sapiens
ttccagctgcctggg

SEQ ID NO: 4194945 - DNA, 17 bp, Homo sapiens
ttccagtgggttatctt

SEQ ID NO: 4194946 - DNA, 17 bp, Homo sapiens
ttccagttgttactgaa

SEQ ID NO: 4194947 - DNA, 20 bp, Homo sapiens
ttccagttgttactgaagtt

SEQ ID NO: 4194948 - DNA, 21 bp, Homo sapiens
ttccagttgttactgaagtta

SEQ ID NO: 4194949 - DNA, 22 bp, Homo sapiens
ttccagtttagcccttccctgc

SEQ ID NO: 4194950 - DNA, 14 bp, Homo sapiens
ttccatctagtcac

SEQ ID NO: 4194951 - DNA, 17 bp, Homo sapiens
ttccatggcaggaaggc

SEQ ID NO: 4194952 - DNA, 22 bp, Homo sapiens
ttccatgggaccacaactattt

SEQ ID NO: 4194953 - DNA, 16 bp, Homo sapiens
ttcccaactgctctgc

SEQ ID NO: 4194954 - DNA, 15 bp, Homo sapiens
ttcccaagccatggc

SEQ ID NO: 4194955 - DNA, 10 bp, Homo sapiens
ttcccagagg

SEQ ID NO: 4194956 - DNA, 15 bp, Homo sapiens
ttccccacctcttcc

SEQ ID NO: 4194957 - DNA, 17 bp, Homo sapiens
ttccccagactcagctc

SEQ ID NO: 4194958 - DNA, 20 bp, Homo sapiens
ttccccaggagctctctgct

SEQ ID NO: 4194959 - DNA, 11 bp, Homo sapiens
ttcccccaccc

SEQ ID NO: 4194960 - DNA, 18 bp, Homo sapiens
ttcccccaccccagagtt

SEQ ID NO: 4194961 - DNA, 21 bp, Homo sapiens
ttcccccatcccctttcctcc

SEQ ID NO: 4194962 - DNA, 22 bp, Homo sapiens
ttcccgagcaaagtctaaagtt

SEQ ID NO: 4194963 - DNA, 23 bp, Homo sapiens
ttccctaggctgagctggcattg

SEQ ID NO: 4194964 - DNA, 13 bp, Homo sapiens
ttccctccttccc

SEQ ID NO: 4194965 - DNA, 18 bp, Homo sapiens
ttccctccttcccttctc

SEQ ID NO: 4194966 - DNA, 19 bp, Homo sapiens
ttccctccttcccttctct

SEQ ID NO: 4194967 - DNA, 19 bp, Homo sapiens
ttccctctttccccacctc

SEQ ID NO: 4194968 - DNA, 23 bp, Homo sapiens
ttccctgggggcagatatttccc

SEQ ID NO: 4194969 - DNA, 22 bp, Homo sapiens
ttccgctcctttacctaccacc

SEQ ID NO: 4194970 - DNA, 16 bp, Homo sapiens
ttcctaaatattatga

SEQ ID NO: 4194971 - DNA, 13 bp, Homo sapiens
ttcctacaaaatg

SEQ ID NO: 4194972 - DNA, 14 bp, Homo sapiens
ttcctatgctttga

SEQ ID NO: 4194973 - DNA, 19 bp, Homo sapiens
ttcctccccaccttcccca

SEQ ID NO: 4194974 - DNA, 15 bp, Homo sapiens
ttttatactgtactt

SEQ ID NO: 4194975 - DNA, 23 bp, Homo sapiens
ttttatctgaatttttaaacaag

SEQ ID NO: 4194976 - DNA, 21 bp, Homo sapiens
ttttatgtgctctcatcagaa

SEQ ID NO: 4194977 - DNA, 12 bp, Homo sapiens
ttttattgtttt

SEQ ID NO: 4194978 - DNA, 12 bp, Homo sapiens
ttttatttttga

SEQ ID NO: 4194979 - DNA, 21 bp, Homo sapiens
ttttcaaggaaaaatgctgct

SEQ ID NO: 4194980 - DNA, 18 bp, Homo sapiens
ttttcacattagaagaca

SEQ ID NO: 4194981 - DNA, 12 bp, Homo sapiens
ttttcacctctt

SEQ ID NO: 4194982 - DNA, 21 bp, Homo sapiens
ttttcatagattgagaagttt

SEQ ID NO: 4194983 - DNA, 15 bp, Homo sapiens
ttttcatctgttgtt

SEQ ID NO: 4194984 - DNA, 21 bp, Homo sapiens
ttttccaacttggctgcagga

SEQ ID NO: 4194985 - DNA, 14 bp, Homo sapiens
ttttccatgtatct

SEQ ID NO: 4194986 - DNA, 16 bp, Homo sapiens
ttttccatttgggcac

SEQ ID NO: 4194987 - DNA, 20 bp, Homo sapiens
ttttcccagatacttcccat

SEQ ID NO: 4194988 - DNA, 23 bp, Homo sapiens
ttttcccgagcaaagtctaaagt

SEQ ID NO: 4194989 - DNA, 13 bp, Homo sapiens
ttttctagacttt

SEQ ID NO: 4194990 - DNA, 15 bp, Homo sapiens
ttttctccaccaact

SEQ ID NO: 4194991 - DNA, 17 bp, Homo sapiens
ttttctgaataacattt

SEQ ID NO: 4194992 - DNA, 15 bp, Homo sapiens
ttttgacataaagtt

SEQ ID NO: 4194993 - DNA, 16 bp, Homo sapiens
ttttgacttgaataaa

SEQ ID NO: 4194994 - DNA, 18 bp, Homo sapiens
ttttgatactaagcattg

SEQ ID NO: 4194995 - DNA, 18 bp, Homo sapiens
ttttgcaatcccttaata

SEQ ID NO: 4194996 - DNA, 17 bp, Homo sapiens
ttttgcaatggctatat

SEQ ID NO: 4194997 - DNA, 16 bp, Homo sapiens
ttttgctgctgctgct

SEQ ID NO: 4194998 - DNA, 19 bp, Homo sapiens
ttttgctggtgtctgagct

SEQ ID NO: 4194999 - DNA, 18 bp, Homo sapiens
ttttgcttaaaattttac

SEQ ID NO: 4195000 - DNA, 11 bp, Homo sapiens
ttttgggactt

SEQ ID NO: 4195001 - DNA, 21 bp, Homo sapiens
ttttgggaggggatggcagac

SEQ ID NO: 4195002 - DNA, 16 bp, Homo sapiens
ttttgtaataaaaggt

SEQ ID NO: 4195003 - DNA, 11 bp, Homo sapiens
ttttgtaccaa

SEQ ID NO: 4195004 - DNA, 22 bp, Homo sapiens
ttttgtaggggtcaaagaaatg

SEQ ID NO: 4195005 - DNA, 23 bp, Homo sapiens
ttttgtaggggtcaaagaaatgc

SEQ ID NO: 4195006 - DNA, 13 bp, Homo sapiens
ttttgtatatatc

SEQ ID NO: 4195007 - DNA, 18 bp, Homo sapiens
ttttgtatgacttctgct

SEQ ID NO: 4195008 - DNA, 10 bp, Homo sapiens
ttttgtctct

SEQ ID NO: 4195009 - DNA, 19 bp, Homo sapiens
ttttgtgatttagaactgt

SEQ ID NO: 4195010 - DNA, 20 bp, Homo sapiens
ttttgtgcttggcaaatgag

SEQ ID NO: 4195011 - DNA, 14 bp, Homo sapiens
ttttgtgtctcctt

SEQ ID NO: 4195012 - DNA, 15 bp, Homo sapiens
ttttgttctgtattt

SEQ ID NO: 4195013 - DNA, 17 bp, Homo sapiens
tttttaaaaaagcttaa

SEQ ID NO: 4195014 - DNA, 14 bp, Homo sapiens
tttttaaaataatt

SEQ ID NO: 4195015 - DNA, 16 bp, Homo sapiens
tttttaactttgtggt

SEQ ID NO: 4195016 - DNA, 14 bp, Homo sapiens
tttttaagctgtaa

SEQ ID NO: 4195017 - DNA, 13 bp, Homo sapiens
tttttcatgcaca

SEQ ID NO: 4195018 - DNA, 21 bp, Homo sapiens
tttttctcgctgtcctttcta

SEQ ID NO: 4195019 - DNA, 13 bp, Homo sapiens
tttttctttataa

SEQ ID NO: 4195020 - DNA, 16 bp, Homo sapiens
tttttctttataaact

SEQ ID NO: 4195021 - DNA, 23 bp, Homo sapiens
tttttgaaaaagcgaaaaaatca

SEQ ID NO: 4195022 - DNA, 13 bp, Homo sapiens
tttttgatgtcag

SEQ ID NO: 4195023 - DNA, 14 bp, Homo sapiens
tttttggtaattat

SEQ ID NO: 4195024 - DNA, 17 bp, Homo sapiens
tttttggtgtatttgag

SEQ ID NO: 4195025 - DNA, 22 bp, Homo sapiens
agaatatggacttaaatgttaa

SEQ ID NO: 4195026 - DNA, 19 bp, Homo sapiens
agaatatttcaaatgaaca

SEQ ID NO: 4195027 - DNA, 21 bp, Homo sapiens
agaatcattgtgcttaataat

SEQ ID NO: 4195028 - DNA, 17 bp, Homo sapiens
agaatgagcagtcccta

SEQ ID NO: 4195029 - DNA, 19 bp, Homo sapiens
agaatgatttttgctattt

SEQ ID NO: 4195030 - DNA, 23 bp, Homo sapiens
agaatggttgccttaaagaaagt

SEQ ID NO: 4195031 - DNA, 16 bp, Homo sapiens
agaatgtcattttggt

SEQ ID NO: 4195032 - DNA, 20 bp, Homo sapiens
agaatgtcattttggtactt

SEQ ID NO: 4195033 - DNA, 17 bp, Homo sapiens
agaattaaaaatgaaat

SEQ ID NO: 4195034 - DNA, 14 bp, Homo sapiens
agaattactgtaac

SEQ ID NO: 4195035 - DNA, 18 bp, Homo sapiens
agaattataacagcaagg

SEQ ID NO: 4195036 - DNA, 23 bp, Homo sapiens
agaattataacagcaaggaaaca

SEQ ID NO: 4195037 - DNA, 19 bp, Homo sapiens
agaattatttttgagcagg

SEQ ID NO: 4195038 - DNA, 14 bp, Homo sapiens
agaattccaaggag

SEQ ID NO: 4195039 - DNA, 20 bp, Homo sapiens
agaattccaaggagttccat

SEQ ID NO: 4195040 - DNA, 14 bp, Homo sapiens
agaattgagtgttt

SEQ ID NO: 4195041 - DNA, 19 bp, Homo sapiens
agaattgtgtcagactgtt

SEQ ID NO: 4195042 - DNA, 21 bp, Homo sapiens
agacaaaacttcctgtttgtg

SEQ ID NO: 4195043 - DNA, 19 bp, Homo sapiens
agacaaggaccaggattgc

SEQ ID NO: 4195044 - DNA, 19 bp, Homo sapiens
agacaagtaatcactaacc

SEQ ID NO: 4195045 - DNA, 16 bp, Homo sapiens
agacaattgacaacag

SEQ ID NO: 4195046 - DNA, 19 bp, Homo sapiens
agacaattgacaacagtta

SEQ ID NO: 4195047 - DNA, 12 bp, Homo sapiens
agacacaggaag

SEQ ID NO: 4195048 - DNA, 16 bp, Homo sapiens
agacacaggctcagca

SEQ ID NO: 4195049 - DNA, 18 bp, Homo sapiens
agacactagttcagagga

SEQ ID NO: 4195050 - DNA, 13 bp, Homo sapiens
agacagagcctcc

SEQ ID NO: 4195051 - DNA, 18 bp, Homo sapiens
agacagcacttggctcct

SEQ ID NO: 4195052 - DNA, 13 bp, Homo sapiens
agacagccctgcc

SEQ ID NO: 4195053 - DNA, 15 bp, Homo sapiens
agacagccctgccta

SEQ ID NO: 4195054 - DNA, 14 bp, Homo sapiens
agacaggaaagaat

SEQ ID NO: 4195055 - DNA, 17 bp, Homo sapiens
agacagtatatttatag

SEQ ID NO: 4195056 - DNA, 14 bp, Homo sapiens
agacagtcaaggag

SEQ ID NO: 4195057 - DNA, 18 bp, Homo sapiens
agacagtcaaggagatga

SEQ ID NO: 4195058 - DNA, 13 bp, Homo sapiens
agacagtgtgtgt

SEQ ID NO: 4195059 - DNA, 17 bp, Homo sapiens
agacatccatgtttgta

SEQ ID NO: 4195060 - DNA, 17 bp, Homo sapiens
agacatgaatgcacact

SEQ ID NO: 4195061 - DNA, 14 bp, Homo sapiens
agacatggaaggtt

SEQ ID NO: 4195062 - DNA, 10 bp, Homo sapiens
agacatttct

SEQ ID NO: 4195063 - DNA, 16 bp, Homo sapiens
agaccaagtcctcaaa

SEQ ID NO: 4195064 - DNA, 17 bp, Homo sapiens
agaccaagtcctcaaag

SEQ ID NO: 4195065 - DNA, 18 bp, Homo sapiens
agaccaataggtgcaaaa

SEQ ID NO: 4195066 - DNA, 22 bp, Homo sapiens
agaccaataggtgcaaaaataa

SEQ ID NO: 4195067 - DNA, 16 bp, Homo sapiens
agaccacaaaaattga

SEQ ID NO: 4195068 - DNA, 21 bp, Homo sapiens
agaccacagcaattggctcct

SEQ ID NO: 4195069 - DNA, 17 bp, Homo sapiens
agaccacctctcaatat

SEQ ID NO: 4195070 - DNA, 13 bp, Homo sapiens
agaccagcctggc

SEQ ID NO: 4195071 - DNA, 15 bp, Homo sapiens
agaccagcctggcca

SEQ ID NO: 4195072 - DNA, 17 bp, Homo sapiens
agacctgacaagcactg

SEQ ID NO: 4195073 - DNA, 14 bp, Homo sapiens
agacggctggacct

SEQ ID NO: 4195074 - DNA, 19 bp, Homo sapiens
agacgtctcaagactgaaa

SEQ ID NO: 4195075 - DNA, 14 bp, Homo sapiens
agactaatttaaaa

SEQ ID NO: 4195076 - DNA, 14 bp, Homo sapiens
agactagttgaaca

SEQ ID NO: 4195077 - DNA, 11 bp, Homo sapiens
agactcagctc

SEQ ID NO: 4195078 - DNA, 17 bp, Homo sapiens
agactcagctccagaat

SEQ ID NO: 4195079 - DNA, 14 bp, Homo sapiens
agactcctgtccct

SEQ ID NO: 4195080 - DNA, 17 bp, Homo sapiens
agactccttcaacaatt

SEQ ID NO: 4195081 - DNA, 12 bp, Homo sapiens
agactctggagc

SEQ ID NO: 4195082 - DNA, 15 bp, Homo sapiens
agactctggagccaa

SEQ ID NO: 4195083 - DNA, 22 bp, Homo sapiens
agactctggagccaaggcagag

SEQ ID NO: 4195084 - DNA, 21 bp, Homo sapiens
agactctgggtccctcggagc

SEQ ID NO: 4195085 - DNA, 13 bp, Homo sapiens
agactgaagagac

SEQ ID NO: 4195086 - DNA, 20 bp, Homo sapiens
agactgcgggatggtcctgg

SEQ ID NO: 4195087 - DNA, 15 bp, Homo sapiens
agactgctgggactg

SEQ ID NO: 4195088 - DNA, 22 bp, Homo sapiens
agactgctgggactggccaggt

SEQ ID NO: 4195089 - DNA, 18 bp, Homo sapiens
agactggaacactagaca

SEQ ID NO: 4195090 - DNA, 20 bp, Homo sapiens
agactggctggctgcagtga

SEQ ID NO: 4195091 - DNA, 18 bp, Homo sapiens
agactgttaaatgaaacc

SEQ ID NO: 4195092 - DNA, 13 bp, Homo sapiens
agacttagaagca

SEQ ID NO: 4195093 - DNA, 19 bp, Homo sapiens
agacttggcaacagaagca

SEQ ID NO: 4195094 - DNA, 17 bp, Homo sapiens
agacttggggaccagag

SEQ ID NO: 4195095 - DNA, 13 bp, Homo sapiens
agactttagctta

SEQ ID NO: 4195096 - DNA, 19 bp, Homo sapiens
agagaaaacttatttgagt

SEQ ID NO: 4195097 - DNA, 20 bp, Homo sapiens
agagaaaacttatttgagtg

SEQ ID NO: 4195098 - DNA, 18 bp, Homo sapiens
agagaaacatttatggaa

SEQ ID NO: 4195099 - DNA, 15 bp, Homo sapiens
agagaaagaagagac

SEQ ID NO: 4195100 - DNA, 15 bp, Homo sapiens
agagaaccaggaggg

SEQ ID NO: 4195101 - DNA, 20 bp, Homo sapiens
agagaaccattcccaagcca

SEQ ID NO: 4195102 - DNA, 24 bp, Homo sapiens
agagaaccattcccaagccatggc

SEQ ID NO: 4195103 - DNA, 22 bp, Homo sapiens
agattgagaagttttgtacaga

SEQ ID NO: 4195104 - DNA, 13 bp, Homo sapiens
agattgaggcctg

SEQ ID NO: 4195105 - DNA, 19 bp, Homo sapiens
agattgaggcctgccctca

SEQ ID NO: 4195106 - DNA, 23 bp, Homo sapiens
agattgttttatcatgacatgtt

SEQ ID NO: 4195107 - DNA, 14 bp, Homo sapiens
agatttaacactaa

SEQ ID NO: 4195108 - DNA, 13 bp, Homo sapiens
agatttgtgttat

SEQ ID NO: 4195109 - DNA, 13 bp, Homo sapiens
agattttccttcc

SEQ ID NO: 4195110 - DNA, 19 bp, Homo sapiens
agattttctgctactttgc

SEQ ID NO: 4195111 - DNA, 14 bp, Homo sapiens
agattttcttggca

SEQ ID NO: 4195112 - DNA, 18 bp, Homo sapiens
agattttgtcgggacaga

SEQ ID NO: 4195113 - DNA, 14 bp, Homo sapiens
agcaaaaaagaaaa

SEQ ID NO: 4195114 - DNA, 16 bp, Homo sapiens
agcaaagagtgggctg

SEQ ID NO: 4195115 - DNA, 22 bp, Homo sapiens
agcaaagagtgggctgcatctg

SEQ ID NO: 4195116 - DNA, 14 bp, Homo sapiens
agcaaaggaaacca

SEQ ID NO: 4195117 - DNA, 22 bp, Homo sapiens
agcaaagtctaaagtttacagt

SEQ ID NO: 4195118 - DNA, 22 bp, Homo sapiens
agcaaatcaccacaaactgtaa

SEQ ID NO: 4195119 - DNA, 20 bp, Homo sapiens
agcaacacaagctggaagca

SEQ ID NO: 4195120 - DNA, 22 bp, Homo sapiens
agcaacagagtgagaccctgtc

SEQ ID NO: 4195121 - DNA, 15 bp, Homo sapiens
agcaacagataaagt

SEQ ID NO: 4195122 - DNA, 15 bp, Homo sapiens
agcaacctcagtaat

SEQ ID NO: 4195123 - DNA, 12 bp, Homo sapiens
agcaactcccac

SEQ ID NO: 4195124 - DNA, 14 bp, Homo sapiens
agcaactcccacga

SEQ ID NO: 4195125 - DNA, 20 bp, Homo sapiens
agcaactccgtgtgcctggg

SEQ ID NO: 4195126 - DNA, 19 bp, Homo sapiens
agcaagaaggcaaaaatag

SEQ ID NO: 4195127 - DNA, 22 bp, Homo sapiens
agcaagactccatttcaaaaaa

SEQ ID NO: 4195128 - DNA, 17 bp, Homo sapiens
agcaagcttaatggctg

SEQ ID NO: 4195129 - DNA, 19 bp, Homo sapiens
agcaagggaccttcatgcc

SEQ ID NO: 4195130 - DNA, 21 bp, Homo sapiens
agcaagttctagagaagaggc

SEQ ID NO: 4195131 - DNA, 16 bp, Homo sapiens
agcacactgcagggct

SEQ ID NO: 4195132 - DNA, 22 bp, Homo sapiens
agcacaggttagggtgtgtgcc

SEQ ID NO: 4195133 - DNA, 15 bp, Homo sapiens
agcacatatttcaca

SEQ ID NO: 4195134 - DNA, 17 bp, Homo sapiens
agcacatgtctgtcctc

SEQ ID NO: 4195135 - DNA, 18 bp, Homo sapiens
agcaccagcttctccagg

SEQ ID NO: 4195136 - DNA, 13 bp, Homo sapiens
agcaccccctcat

SEQ ID NO: 4195137 - DNA, 14 bp, Homo sapiens
agcaccccctcatt

SEQ ID NO: 4195138 - DNA, 16 bp, Homo sapiens
agcaccccctcattcc

SEQ ID NO: 4195139 - DNA, 21 bp, Homo sapiens
agcacctgcttcatgctcagc

SEQ ID NO: 4195140 - DNA, 13 bp, Homo sapiens
agcacctgttttt

SEQ ID NO: 4195141 - DNA, 15 bp, Homo sapiens
agcacgggacaggag

SEQ ID NO: 4195142 - DNA, 22 bp, Homo sapiens
agcactgctaggcgagtgccag

SEQ ID NO: 4195143 - DNA, 23 bp, Homo sapiens
agcactgctaggcgagtgccagg

SEQ ID NO: 4195144 - DNA, 15 bp, Homo sapiens
agcacttctttttct

SEQ ID NO: 4195145 - DNA, 18 bp, Homo sapiens
agcactttaaccctctct

SEQ ID NO: 4195146 - DNA, 19 bp, Homo sapiens
agcactttaaccctctctt

SEQ ID NO: 4195147 - DNA, 22 bp, Homo sapiens
agcactttgggaggctgaggcg

SEQ ID NO: 4195148 - DNA, 23 bp, Homo sapiens
agcagaaaatataaatggtaagc

SEQ ID NO: 4195149 - DNA, 15 bp, Homo sapiens
agcagaagtgaccaa

SEQ ID NO: 4195150 - DNA, 15 bp, Homo sapiens
agcagagcaggggca

SEQ ID NO: 4195151 - DNA, 16 bp, Homo sapiens
agcagagcttcctcag

SEQ ID NO: 4195152 - DNA, 13 bp, Homo sapiens
agcagcagtgagc

SEQ ID NO: 4195153 - DNA, 17 bp, Homo sapiens
aggaagatgaaagagga

SEQ ID NO: 4195154 - DNA, 20 bp, Homo sapiens
aggaagcacactgcagggct

SEQ ID NO: 4195155 - DNA, 23 bp, Homo sapiens
aggaagctttggtgagaacctgg

SEQ ID NO: 4195156 - DNA, 21 bp, Homo sapiens
aggaaggcttgttgtgctttt

SEQ ID NO: 4195157 - DNA, 16 bp, Homo sapiens
aggaagggggttgtgg

SEQ ID NO: 4195158 - DNA, 17 bp, Homo sapiens
aggaataggcaaaatgt

SEQ ID NO: 4195159 - DNA, 14 bp, Homo sapiens
aggacaacctgccc

SEQ ID NO: 4195160 - DNA, 15 bp, Homo sapiens
aggacaacctgcccc

SEQ ID NO: 4195161 - DNA, 18 bp, Homo sapiens
aggacaacctgcccctcc

SEQ ID NO: 4195162 - DNA, 20 bp, Homo sapiens
aggacacacagtctcagtcc

SEQ ID NO: 4195163 - DNA, 23 bp, Homo sapiens
aggacacacagtctcagtccaga

SEQ ID NO: 4195164 - DNA, 11 bp, Homo sapiens
aggacacatgt

SEQ ID NO: 4195165 - DNA, 15 bp, Homo sapiens
aggacagaacattgc

SEQ ID NO: 4195166 - DNA, 13 bp, Homo sapiens
aggacagtctgga

SEQ ID NO: 4195167 - DNA, 15 bp, Homo sapiens
aggacagtctggaga

SEQ ID NO: 4195168 - DNA, 19 bp, Homo sapiens
aggacagtctggagaaggt

SEQ ID NO: 4195169 - DNA, 20 bp, Homo sapiens
aggacagtgcttcagcctga

SEQ ID NO: 4195170 - DNA, 21 bp, Homo sapiens
aggacagtgcttcagcctgag

SEQ ID NO: 4195171 - DNA, 21 bp, Homo sapiens
aggacatgatggagcgcacct

SEQ ID NO: 4195172 - DNA, 16 bp, Homo sapiens
aggacatgtttttgtt

SEQ ID NO: 4195173 - DNA, 21 bp, Homo sapiens
aggacatgtttttgttttctt

SEQ ID NO: 4195174 - DNA, 23 bp, Homo sapiens
aggaccaggactatagcccaggt

SEQ ID NO: 4195175 - DNA, 20 bp, Homo sapiens
aggactacgttaagggaagg

SEQ ID NO: 4195176 - DNA, 20 bp, Homo sapiens
aggactatagcccaggtcct

SEQ ID NO: 4195177 - DNA, 13 bp, Homo sapiens
aggactctgaggc

SEQ ID NO: 4195178 - DNA, 14 bp, Homo sapiens
aggactctgccttt

SEQ ID NO: 4195179 - DNA, 16 bp, Homo sapiens
aggacttggtctgatt

SEQ ID NO: 4195180 - DNA, 20 bp, Homo sapiens
aggacttggtctgatttcag

SEQ ID NO: 4195181 - DNA, 23 bp, Homo sapiens
aggacttggtctgatttcaggat

SEQ ID NO: 4195182 - DNA, 21 bp, Homo sapiens
aggactttcctaaatgtttaa

SEQ ID NO: 4195183 - DNA, 20 bp, Homo sapiens
aggagagagtctaagataaa

SEQ ID NO: 4195184 - DNA, 18 bp, Homo sapiens
aggagattttccttccta

SEQ ID NO: 4195185 - DNA, 16 bp, Homo sapiens
aggagcagaaagatta

SEQ ID NO: 4195186 - DNA, 16 bp, Homo sapiens
aggagcagcttcagtt

SEQ ID NO: 4195187 - DNA, 13 bp, Homo sapiens
aggagctctctgc

SEQ ID NO: 4195188 - DNA, 13 bp, Homo sapiens
aggagcttctctg

SEQ ID NO: 4195189 - DNA, 16 bp, Homo sapiens
aggaggaaaagacaga

SEQ ID NO: 4195190 - DNA, 20 bp, Homo sapiens
aggaggaaaagacagagcct

SEQ ID NO: 4195191 - DNA, 21 bp, Homo sapiens
aggaggaagactctggagcca

SEQ ID NO: 4195192 - DNA, 14 bp, Homo sapiens
aggaggctgaggca

SEQ ID NO: 4195193 - DNA, 16 bp, Homo sapiens
aggaggctgaggcagg

SEQ ID NO: 4195194 - DNA, 18 bp, Homo sapiens
aggaggctgaggcaggag

SEQ ID NO: 4195195 - DNA, 19 bp, Homo sapiens
aggaggctgaggcaggaga

SEQ ID NO: 4195196 - DNA, 13 bp, Homo sapiens
aggaggctgaggg

SEQ ID NO: 4195197 - DNA, 21 bp, Homo sapiens
aggagggacctactgaaccca

SEQ ID NO: 4195198 - DNA, 23 bp, Homo sapiens
aggagggtgcagtatctcttgct

SEQ ID NO: 4195199 - DNA, 16 bp, Homo sapiens
aggaggtcaagcctgc

SEQ ID NO: 4195200 - DNA, 21 bp, Homo sapiens
aggaggtcaagcctgcagcga

SEQ ID NO: 4195201 - DNA, 13 bp, Homo sapiens
aggaggtgaggga

SEQ ID NO: 4195202 - DNA, 20 bp, Homo sapiens
aggaggtggcagccctgtag

SEQ ID NO: 4195203 - DNA, 23 bp, Homo sapiens
aggaggtttggggtctgccacca

SEQ ID NO: 4195204 - DNA, 16 bp, Homo sapiens
aggagttcgagaccag

SEQ ID NO: 4195205 - DNA, 21 bp, Homo sapiens
aggagttcgagaccagcctgg

SEQ ID NO: 4195206 - DNA, 14 bp, Homo sapiens
aggagttgccaggg

SEQ ID NO: 4195207 - DNA, 16 bp, Homo sapiens
aggatactctgtcaga

SEQ ID NO: 4195208 - DNA, 14 bp, Homo sapiens
aggatagcctcagc

SEQ ID NO: 4195209 - DNA, 16 bp, Homo sapiens
aggatagcctcagcca

SEQ ID NO: 4195210 - DNA, 14 bp, Homo sapiens
aggatcactggagc

SEQ ID NO: 4195211 - DNA, 20 bp, Homo sapiens
aggatcactggagcccagga

SEQ ID NO: 4195212 - DNA, 22 bp, Homo sapiens
aggatcactggagcccaggagt

SEQ ID NO: 4195213 - DNA, 22 bp, Homo sapiens
aggatcacttgggcccaggagg

SEQ ID NO: 4195214 - DNA, 22 bp, Homo sapiens
aggatcagaatggaaagaaact

SEQ ID NO: 4195215 - DNA, 20 bp, Homo sapiens
aggatcctattctcaccagg

SEQ ID NO: 4195216 - DNA, 22 bp, Homo sapiens
aggatcctattctcaccaggaa

SEQ ID NO: 4195217 - DNA, 13 bp, Homo sapiens
aggatgcagaggg

SEQ ID NO: 4195218 - DNA, 17 bp, Homo sapiens
aggatgtgtttgctttc

SEQ ID NO: 4195219 - DNA, 15 bp, Homo sapiens
aggattcctccccca

SEQ ID NO: 4195220 - DNA, 17 bp, Homo sapiens
aggattggcctgtgtct

SEQ ID NO: 4195221 - DNA, 17 bp, Homo sapiens
aggatttatttaaaata

SEQ ID NO: 4195222 - DNA, 17 bp, Homo sapiens
aggattttgtgtttttt

SEQ ID NO: 4195223 - DNA, 21 bp, Homo sapiens
aggattttttttaatgtttaa

SEQ ID NO: 4195224 - DNA, 13 bp, Homo sapiens
aggcaagagacag

SEQ ID NO: 4195225 - DNA, 15 bp, Homo sapiens
aggcaagagacagaa

SEQ ID NO: 4195226 - DNA, 17 bp, Homo sapiens
aggcaagagacagaatg

SEQ ID NO: 4195227 - DNA, 20 bp, Homo sapiens
aggcaccaaaagaagtaaaa

SEQ ID NO: 4195228 - DNA, 16 bp, Homo sapiens
aggcaccccctggaga

SEQ ID NO: 4195229 - DNA, 20 bp, Homo sapiens
aggcaccccctggagagaag

SEQ ID NO: 4195230 - DNA, 13 bp, Homo sapiens
aggcacctgctgg

SEQ ID NO: 4195231 - DNA, 16 bp, Homo sapiens
aggcacctgctggaaa

SEQ ID NO: 4195232 - DNA, 14 bp, Homo sapiens
aggcactgtggccc

SEQ ID NO: 4195233 - DNA, 21 bp, Homo sapiens
aggcagacgtggggagggtgg

SEQ ID NO: 4195234 - DNA, 13 bp, Homo sapiens
aggcagagaagaa

SEQ ID NO: 4195235 - DNA, 14 bp, Homo sapiens
aggcagagaagaaa

SEQ ID NO: 4195236 - DNA, 20 bp, Homo sapiens
aggcagaggggagcttgagg

SEQ ID NO: 4195237 - DNA, 15 bp, Homo sapiens
aggcagcttctctgt

SEQ ID NO: 4195238 - DNA, 16 bp, Homo sapiens
aggcagcttctctgta

SEQ ID NO: 4195239 - DNA, 17 bp, Homo sapiens
aggcaggcactgtggcc

SEQ ID NO: 4195240 - DNA, 14 bp, Homo sapiens
aggcagggatttga

SEQ ID NO: 4195241 - DNA, 15 bp, Homo sapiens
aggcagggatttgag

SEQ ID NO: 4195242 - DNA, 17 bp, Homo sapiens
aggcaggggagtagtgg

SEQ ID NO: 4195243 - DNA, 16 bp, Homo sapiens
aggcaggggtgggaga

SEQ ID NO: 4195244 - DNA, 23 bp, Homo sapiens
aggcaggggtgggagagccagct

SEQ ID NO: 4195245 - DNA, 22 bp, Homo sapiens
aggcagtgcaagagactctggc

SEQ ID NO: 4195246 - DNA, 18 bp, Homo sapiens
aggcagttcaaagcagga

SEQ ID NO: 4195247 - DNA, 19 bp, Homo sapiens
aggcagttcaaagcaggat

SEQ ID NO: 4195248 - DNA, 21 bp, Homo sapiens
aggcatacctgtcctagcagg

SEQ ID NO: 4195249 - DNA, 22 bp, Homo sapiens
aggcatacctgtcctagcagga

SEQ ID NO: 4195250 - DNA, 18 bp, Homo sapiens
aggcatgctggcctccca

SEQ ID NO: 4195251 - DNA, 23 bp, Homo sapiens
aggcatttgcctaattcctggca

SEQ ID NO: 4195252 - DNA, 17 bp, Homo sapiens
aggccaagagcagaggc

SEQ ID NO: 4195253 - DNA, 13 bp, Homo sapiens
aggccaccaggat

SEQ ID NO: 4195254 - DNA, 14 bp, Homo sapiens
aggccagagccaag

SEQ ID NO: 4195255 - DNA, 18 bp, Homo sapiens
aggcccagcctgtcctgg

SEQ ID NO: 4195256 - DNA, 24 bp, Homo sapiens
aggcccaggtcaacatctaagcct

SEQ ID NO: 4195257 - DNA, 17 bp, Homo sapiens
aggccctaggattcctc

SEQ ID NO: 4195258 - DNA, 13 bp, Homo sapiens
aggccctgtctgt

SEQ ID NO: 4195259 - DNA, 18 bp, Homo sapiens
aggcctcgtaccagccag

SEQ ID NO: 4195260 - DNA, 20 bp, Homo sapiens
aggcctcgtaccagccagga

SEQ ID NO: 4195261 - DNA, 22 bp, Homo sapiens
aggcctcgtaccagccaggatc

SEQ ID NO: 4195262 - DNA, 22 bp, Homo sapiens
aggcctgccctcagggatcttg

SEQ ID NO: 4195263 - DNA, 11 bp, Homo sapiens
aggcctggcca

SEQ ID NO: 4195264 - DNA, 13 bp, Homo sapiens
aggcctggccagg

SEQ ID NO: 4195265 - DNA, 19 bp, Homo sapiens
aggccttagtacggctgct

SEQ ID NO: 4195266 - DNA, 21 bp, Homo sapiens
aggccttagtacggctgctgc

SEQ ID NO: 4195267 - DNA, 21 bp, Homo sapiens
aggcctttagatattattcat

SEQ ID NO: 4195268 - DNA, 18 bp, Homo sapiens
aggcgaataaatgttcaa

SEQ ID NO: 4195269 - DNA, 19 bp, Homo sapiens
aggcgaataaatgttcaaa

SEQ ID NO: 4195270 - DNA, 14 bp, Homo sapiens
aggcgagtgccagg

SEQ ID NO: 4195271 - DNA, 19 bp, Homo sapiens
aggcgcgtctgccccaccc

SEQ ID NO: 4195272 - DNA, 15 bp, Homo sapiens
aggcggagagtacag

SEQ ID NO: 4195273 - DNA, 20 bp, Homo sapiens
aggcggagagtacagtgagc

SEQ ID NO: 4195274 - DNA, 24 bp, Homo sapiens
aggcggagagtacagtgagccaag

SEQ ID NO: 4195275 - DNA, 19 bp, Homo sapiens
aggcgtcaacgtgcatttt

SEQ ID NO: 4195276 - DNA, 22 bp, Homo sapiens
aggctaatttttttgtatttta

SEQ ID NO: 4195277 - DNA, 20 bp, Homo sapiens
aggctagagtgcagtggcat

SEQ ID NO: 4195278 - DNA, 22 bp, Homo sapiens
aggctatgtaatgtaaatacat

SEQ ID NO: 4195279 - DNA, 13 bp, Homo sapiens
aggctcagcatgc

SEQ ID NO: 4195280 - DNA, 16 bp, Homo sapiens
aggctcagtctcagga

SEQ ID NO: 4195281 - DNA, 18 bp, Homo sapiens
aggctcagtctcaggagc

SEQ ID NO: 4195282 - DNA, 13 bp, Homo sapiens
aggctcctgtgct

SEQ ID NO: 4195283 - DNA, 18 bp, Homo sapiens
aggctctattgagccaag

SEQ ID NO: 4195284 - DNA, 17 bp, Homo sapiens
aggctcttccatcccca

SEQ ID NO: 4195285 - DNA, 15 bp, Homo sapiens
aggctctttctgggc

SEQ ID NO: 4195286 - DNA, 18 bp, Homo sapiens
aggctctttctgggccaa

SEQ ID NO: 4195287 - DNA, 20 bp, Homo sapiens
aggctctttctgggccaagt

SEQ ID NO: 4195288 - DNA, 21 bp, Homo sapiens
aggctctttggggtcagccag

SEQ ID NO: 4195289 - DNA, 12 bp, Homo sapiens
aggctgaaagcc

SEQ ID NO: 4195290 - DNA, 13 bp, Homo sapiens
aggctgagaagga

SEQ ID NO: 4195291 - DNA, 16 bp, Homo sapiens
ataatatttcaagtgc

SEQ ID NO: 4195292 - DNA, 14 bp, Homo sapiens
ataatgaatgtcat

SEQ ID NO: 4195293 - DNA, 12 bp, Homo sapiens
ataatgtccaga

SEQ ID NO: 4195294 - DNA, 12 bp, Homo sapiens
ataatgtgattt

SEQ ID NO: 4195295 - DNA, 13 bp, Homo sapiens
ataatgtgatttt

SEQ ID NO: 4195296 - DNA, 15 bp, Homo sapiens
ataattaaaaaccac

SEQ ID NO: 4195297 - DNA, 23 bp, Homo sapiens
ataattaatgtgtgtctgaagac

SEQ ID NO: 4195298 - DNA, 21 bp, Homo sapiens
ataattgttttatctgaattt

SEQ ID NO: 4195299 - DNA, 14 bp, Homo sapiens
ataattttaaattc

SEQ ID NO: 4195300 - DNA, 20 bp, Homo sapiens
ataattttatgtgttatagt

SEQ ID NO: 4195301 - DNA, 13 bp, Homo sapiens
atacaacaagaac

SEQ ID NO: 4195302 - DNA, 16 bp, Homo sapiens
atacaacaagaacaac

SEQ ID NO: 4195303 - DNA, 20 bp, Homo sapiens
atacaatattaattataata

SEQ ID NO: 4195304 - DNA, 13 bp, Homo sapiens
atacacaacattt

SEQ ID NO: 4195305 - DNA, 14 bp, Homo sapiens
atacacaggatcct

SEQ ID NO: 4195306 - DNA, 19 bp, Homo sapiens
atacactaattcctttcta

SEQ ID NO: 4195307 - DNA, 20 bp, Homo sapiens
atacactcaaacaatcatga

SEQ ID NO: 4195308 - DNA, 20 bp, Homo sapiens
atacagaactgaattaagtt

SEQ ID NO: 4195309 - DNA, 20 bp, Homo sapiens
atacagccctcccccagcag

SEQ ID NO: 4195310 - DNA, 14 bp, Homo sapiens
atacataactagtt

SEQ ID NO: 4195311 - DNA, 14 bp, Homo sapiens
atacataataaagt

SEQ ID NO: 4195312 - DNA, 20 bp, Homo sapiens
ataccaatgcttttatcaaa

SEQ ID NO: 4195313 - DNA, 20 bp, Homo sapiens
ataccacaagcctgagaact

SEQ ID NO: 4195314 - DNA, 12 bp, Homo sapiens
ataccagagcct

SEQ ID NO: 4195315 - DNA, 21 bp, Homo sapiens
ataccagagccttcaagtgcc

SEQ ID NO: 4195316 - DNA, 22 bp, Homo sapiens
ataccagattttataaaatatt

SEQ ID NO: 4195317 - DNA, 17 bp, Homo sapiens
ataccccaagtccacct

SEQ ID NO: 4195318 - DNA, 21 bp, Homo sapiens
ataccgaccatcgtccagccc

SEQ ID NO: 4195319 - DNA, 15 bp, Homo sapiens
atacgtgtgtgaagt

SEQ ID NO: 4195320 - DNA, 16 bp, Homo sapiens
atacgtgttctataga

SEQ ID NO: 4195321 - DNA, 16 bp, Homo sapiens
atactaatgtaaagat

SEQ ID NO: 4195322 - DNA, 16 bp, Homo sapiens
atactatacaacaatg

SEQ ID NO: 4195323 - DNA, 15 bp, Homo sapiens
atactatatgataaa

SEQ ID NO: 4195324 - DNA, 22 bp, Homo sapiens
atactattaaaaaggtttacag

SEQ ID NO: 4195325 - DNA, 17 bp, Homo sapiens
atactctctgaaatata

SEQ ID NO: 4195326 - DNA, 14 bp, Homo sapiens
atactctgtcagat

SEQ ID NO: 4195327 - DNA, 16 bp, Homo sapiens
atactctgtcagatgg

SEQ ID NO: 4195328 - DNA, 21 bp, Homo sapiens
atactgcgggcaccagaatgc

SEQ ID NO: 4195329 - DNA, 12 bp, Homo sapiens
atactgctgaga

SEQ ID NO: 4195330 - DNA, 19 bp, Homo sapiens
atactgctgagatacatac

SEQ ID NO: 4195331 - DNA, 10 bp, Homo sapiens
atactgcttg

SEQ ID NO: 4195332 - DNA, 17 bp, Homo sapiens
atactgtacttaataaa

SEQ ID NO: 4195333 - DNA, 21 bp, Homo sapiens
atacttctaaatcagaaatag

SEQ ID NO: 4195334 - DNA, 22 bp, Homo sapiens
atactttaatttttataaatat

SEQ ID NO: 4195335 - DNA, 23 bp, Homo sapiens
atactttaatttttataaatatg

SEQ ID NO: 4195336 - DNA, 20 bp, Homo sapiens
atactttttacccaaatatg

SEQ ID NO: 4195337 - DNA, 21 bp, Homo sapiens
atactttttacccaaatatgt

SEQ ID NO: 4195338 - DNA, 22 bp, Homo sapiens
atactttttacccaaatatgtt

SEQ ID NO: 4195339 - DNA, 13 bp, Homo sapiens
atagaagctgtag

SEQ ID NO: 4195340 - DNA, 23 bp, Homo sapiens
atagaatatggacttaaatgtta

SEQ ID NO: 4195341 - DNA, 13 bp, Homo sapiens
atagacagaagaa

SEQ ID NO: 4195342 - DNA, 20 bp, Homo sapiens
atagacagtatatttatagt

SEQ ID NO: 4195343 - DNA, 14 bp, Homo sapiens
atagagaaaaactt

SEQ ID NO: 4195344 - DNA, 21 bp, Homo sapiens
atagagggagaggaagcacac

SEQ ID NO: 4195345 - DNA, 14 bp, Homo sapiens
atagagggccaaga

SEQ ID NO: 4195346 - DNA, 22 bp, Homo sapiens
atagatgggtctggctgagctg

SEQ ID NO: 4195347 - DNA, 13 bp, Homo sapiens
atagatgtgcaag

SEQ ID NO: 4195348 - DNA, 12 bp, Homo sapiens
atagatgtttga

SEQ ID NO: 4195349 - DNA, 23 bp, Homo sapiens
atagatttgtattttaaaacata

SEQ ID NO: 4195350 - DNA, 17 bp, Homo sapiens
atagcaaaagaagaagt

SEQ ID NO: 4195351 - DNA, 13 bp, Homo sapiens
atagcatgcatct

SEQ ID NO: 4195352 - DNA, 14 bp, Homo sapiens
atagccaaaaatag

SEQ ID NO: 4195353 - DNA, 15 bp, Homo sapiens
atagccaaaaatagc

SEQ ID NO: 4195354 - DNA, 22 bp, Homo sapiens
atagctattactgtctggtttt

SEQ ID NO: 4195355 - DNA, 17 bp, Homo sapiens
atagcttgtatagtgta

SEQ ID NO: 4195356 - DNA, 19 bp, Homo sapiens
ataggaagattaaaaccac

SEQ ID NO: 4195357 - DNA, 22 bp, Homo sapiens
ataggaagattaaaaccacaga

SEQ ID NO: 4195358 - DNA, 16 bp, Homo sapiens
ataggatttatttaaa

SEQ ID NO: 4195359 - DNA, 13 bp, Homo sapiens
ataggctggagaa

SEQ ID NO: 4195360 - DNA, 14 bp, Homo sapiens
ataggctggagaag

SEQ ID NO: 4195361 - DNA, 14 bp, Homo sapiens
ataggcttagagag

SEQ ID NO: 4195362 - DNA, 15 bp, Homo sapiens
ataggcttagagagg

SEQ ID NO: 4195363 - DNA, 15 bp, Homo sapiens
ataggtgcaaaaata

SEQ ID NO: 4195364 - DNA, 16 bp, Homo sapiens
ataggtgcaaaaataa

SEQ ID NO: 4195365 - DNA, 19 bp, Homo sapiens
atagtaaatcacgcttttt

SEQ ID NO: 4195366 - DNA, 14 bp, Homo sapiens
atagtcacaagagc

SEQ ID NO: 4195367 - DNA, 13 bp, Homo sapiens
atagtgtaaaata

SEQ ID NO: 4195368 - DNA, 17 bp, Homo sapiens
atagttatttacttgaa

SEQ ID NO: 4195369 - DNA, 18 bp, Homo sapiens
atagttgtgggtgggaga

SEQ ID NO: 4195370 - DNA, 19 bp, Homo sapiens
atagtttggatatgtaaaa

SEQ ID NO: 4195371 - DNA, 16 bp, Homo sapiens
atataaaatatattta

SEQ ID NO: 4195372 - DNA, 19 bp, Homo sapiens
atatacacaggatcctatt

SEQ ID NO: 4195373 - DNA, 14 bp, Homo sapiens
atatatattaaaat

SEQ ID NO: 4195374 - DNA, 23 bp, Homo sapiens
atatatatttgattgtaaaaaca

SEQ ID NO: 4195375 - DNA, 13 bp, Homo sapiens
atatatgtaaata

SEQ ID NO: 4195376 - DNA, 22 bp, Homo sapiens
atatattaaaatgtaggaagaa

SEQ ID NO: 4195377 - DNA, 17 bp, Homo sapiens
atatatttactaaaaga

SEQ ID NO: 4195378 - DNA, 22 bp, Homo sapiens
atatatttattttattctatgt

SEQ ID NO: 4195379 - DNA, 18 bp, Homo sapiens
atatatttgaatatcatt

SEQ ID NO: 4195380 - DNA, 22 bp, Homo sapiens
atatatttgattgtaaaaacaa

SEQ ID NO: 4195381 - DNA, 15 bp, Homo sapiens
atatatttttatatt

SEQ ID NO: 4195382 - DNA, 15 bp, Homo sapiens
atatatttttcacag

SEQ ID NO: 4195383 - DNA, 14 bp, Homo sapiens
atatattttttgta

SEQ ID NO: 4195384 - DNA, 14 bp, Homo sapiens
atatcaaaaagact

SEQ ID NO: 4195385 - DNA, 19 bp, Homo sapiens
atatcaaggaaaactgtga

SEQ ID NO: 4195386 - DNA, 20 bp, Homo sapiens
atatcaaggaaaactgtgac

SEQ ID NO: 4195387 - DNA, 14 bp, Homo sapiens
atatcagaaaaggg

SEQ ID NO: 4195388 - DNA, 16 bp, Homo sapiens
atatccacatctttaa

SEQ ID NO: 4195389 - DNA, 20 bp, Homo sapiens
atatccacatctttaagtat

SEQ ID NO: 4195390 - DNA, 21 bp, Homo sapiens
atatctattattataaaaata

SEQ ID NO: 4195391 - DNA, 13 bp, Homo sapiens
atatctcctgaaa

SEQ ID NO: 4195392 - DNA, 15 bp, Homo sapiens
atatctcctgaaaag

SEQ ID NO: 4195393 - DNA, 22 bp, Homo sapiens
atatctgttttgtttcttgact

SEQ ID NO: 4195394 - DNA, 16 bp, Homo sapiens
atatcttatatataat

SEQ ID NO: 4195395 - DNA, 15 bp, Homo sapiens
atatcttatgttaaa

SEQ ID NO: 4195396 - DNA, 19 bp, Homo sapiens
atatgacaatcctgaagaa

SEQ ID NO: 4195397 - DNA, 23 bp, Homo sapiens
atatgacaatcctgaagaaacca

SEQ ID NO: 4195398 - DNA, 15 bp, Homo sapiens
atatgactcaggagc

SEQ ID NO: 4195399 - DNA, 18 bp, Homo sapiens
atatgataaagagggatg

SEQ ID NO: 4195400 - DNA, 15 bp, Homo sapiens
atatgatgttaaaaa

SEQ ID NO: 4195401 - DNA, 23 bp, Homo sapiens
atatgattgtataatgtgatttt

SEQ ID NO: 4195402 - DNA, 18 bp, Homo sapiens
atatggacttaaatgtta

SEQ ID NO: 4195403 - DNA, 13 bp, Homo sapiens
atatggcaagaaa

SEQ ID NO: 4195404 - DNA, 19 bp, Homo sapiens
atatggcaagaaagctggt

SEQ ID NO: 4195405 - DNA, 18 bp, Homo sapiens
atatggtgcaaaaatgag

SEQ ID NO: 4195406 - DNA, 12 bp, Homo sapiens
atatgtaaaaca

SEQ ID NO: 4195407 - DNA, 18 bp, Homo sapiens
atatgtaaaacatttatt

SEQ ID NO: 4195408 - DNA, 21 bp, Homo sapiens
atatgtagttaaatagctata

SEQ ID NO: 4195409 - DNA, 15 bp, Homo sapiens
atatgtgaatctgga

SEQ ID NO: 4195410 - DNA, 14 bp, Homo sapiens
atattaaatgaaag

SEQ ID NO: 4195411 - DNA, 21 bp, Homo sapiens
atattaaatttatatcttata

SEQ ID NO: 4195412 - DNA, 22 bp, Homo sapiens
atattaaggggatcagaagtag

SEQ ID NO: 4195413 - DNA, 15 bp, Homo sapiens
atattacactacaca

SEQ ID NO: 4195414 - DNA, 15 bp, Homo sapiens
atattacctcaaatt

SEQ ID NO: 4195415 - DNA, 16 bp, Homo sapiens
atattatgagatgctg

SEQ ID NO: 4195416 - DNA, 16 bp, Homo sapiens
atattattaacttgta

SEQ ID NO: 4195417 - DNA, 13 bp, Homo sapiens
atattcaataaag

SEQ ID NO: 4195418 - DNA, 17 bp, Homo sapiens
atattcctattgtgcaa

SEQ ID NO: 4195419 - DNA, 17 bp, Homo sapiens
atattctctaagatata

SEQ ID NO: 4195420 - DNA, 19 bp, Homo sapiens
atattgaataagtattctt

SEQ ID NO: 4195421 - DNA, 19 bp, Homo sapiens
atattgacttctcttgaat

SEQ ID NO: 4195422 - DNA, 22 bp, Homo sapiens
atattgatcattttagacactg

SEQ ID NO: 4195423 - DNA, 15 bp, Homo sapiens
atattggtattcact

SEQ ID NO: 4195424 - DNA, 19 bp, Homo sapiens
atattgtgggtgttaattt

SEQ ID NO: 4195425 - DNA, 23 bp, Homo sapiens
atatttactaagccacaagaaat

SEQ ID NO: 4195426 - DNA, 14 bp, Homo sapiens
atatttaggcaaga

SEQ ID NO: 4195427 - DNA, 22 bp, Homo sapiens
atatttatcaaacttgtgctga

SEQ ID NO: 4195428 - DNA, 19 bp, Homo sapiens
atatttattttattctatg

SEQ ID NO: 4195429 - DNA, 17 bp, Homo sapiens
atatttcaaatgaacac

SEQ ID NO: 4195430 - DNA, 15 bp, Homo sapiens
agggataaggcagtt

SEQ ID NO: 4195431 - DNA, 16 bp, Homo sapiens
agggatgccacccagc

SEQ ID NO: 4195432 - DNA, 18 bp, Homo sapiens
agggatgctgcctgagtc

SEQ ID NO: 4195433 - DNA, 12 bp, Homo sapiens
agggatttgagg

SEQ ID NO: 4195434 - DNA, 19 bp, Homo sapiens
agggattttagcctcttcc

SEQ ID NO: 4195435 - DNA, 20 bp, Homo sapiens
agggcagaaggggaagatac

SEQ ID NO: 4195436 - DNA, 19 bp, Homo sapiens
agggccagggccctgcaga

SEQ ID NO: 4195437 - DNA, 18 bp, Homo sapiens
agggccatgctgaaggga

SEQ ID NO: 4195438 - DNA, 19 bp, Homo sapiens
agggccatgctgaagggac

SEQ ID NO: 4195439 - DNA, 12 bp, Homo sapiens
agggccctgcag

SEQ ID NO: 4195440 - DNA, 19 bp, Homo sapiens
agggctaccctcccccagg

SEQ ID NO: 4195441 - DNA, 15 bp, Homo sapiens
agggctactcagcag

SEQ ID NO: 4195442 - DNA, 21 bp, Homo sapiens
agggctactgcagctttacat

SEQ ID NO: 4195443 - DNA, 20 bp, Homo sapiens
agggctgctgtggcccagtc

SEQ ID NO: 4195444 - DNA, 15 bp, Homo sapiens
agggcttggtggcca

SEQ ID NO: 4195445 - DNA, 22 bp, Homo sapiens
agggcttggtggccaagcctgg

SEQ ID NO: 4195446 - DNA, 21 bp, Homo sapiens
aggggaaaccagtgtagcctt

SEQ ID NO: 4195447 - DNA, 19 bp, Homo sapiens
aggggacccagctcctctg

SEQ ID NO: 4195448 - DNA, 17 bp, Homo sapiens
aggggacgcgggctgtg

SEQ ID NO: 4195449 - DNA, 15 bp, Homo sapiens
aggggcagggagagc

SEQ ID NO: 4195450 - DNA, 17 bp, Homo sapiens
aggggccagtgagggct

SEQ ID NO: 4195451 - DNA, 13 bp, Homo sapiens
aggggctcctgga

SEQ ID NO: 4195452 - DNA, 16 bp, Homo sapiens
aggggcttcaggtcca

SEQ ID NO: 4195453 - DNA, 21 bp, Homo sapiens
agggggagtttttagtttgtt

SEQ ID NO: 4195454 - DNA, 18 bp, Homo sapiens
agggggttgggtttgggg

SEQ ID NO: 4195455 - DNA, 17 bp, Homo sapiens
aggggtaggcagagcct

SEQ ID NO: 4195456 - DNA, 16 bp, Homo sapiens
aggggtcaaagaaatg

SEQ ID NO: 4195457 - DNA, 17 bp, Homo sapiens
aggggtctccctggagt

SEQ ID NO: 4195458 - DNA, 19 bp, Homo sapiens
aggggtctccctggagtgc

SEQ ID NO: 4195459 - DNA, 13 bp, Homo sapiens
aggggtgatttca

SEQ ID NO: 4195460 - DNA, 17 bp, Homo sapiens
aggggtgatttcagaga

SEQ ID NO: 4195461 - DNA, 15 bp, Homo sapiens
aggggtgggagagcc

SEQ ID NO: 4195462 - DNA, 21 bp, Homo sapiens
aggggtgggttcctcttcccc

SEQ ID NO: 4195463 - DNA, 18 bp, Homo sapiens
aggggtgtgattggagtg

SEQ ID NO: 4195464 - DNA, 18 bp, Homo sapiens
aggggttaacttggtcag

SEQ ID NO: 4195465 - DNA, 16 bp, Homo sapiens
agggtaacagaagagg

SEQ ID NO: 4195466 - DNA, 22 bp, Homo sapiens
agggtaataaacttagaataaa

SEQ ID NO: 4195467 - DNA, 17 bp, Homo sapiens
agggtctaaagagaaca

SEQ ID NO: 4195468 - DNA, 15 bp, Homo sapiens
agggtgaataaagca

SEQ ID NO: 4195469 - DNA, 18 bp, Homo sapiens
agggtgaataaagcaggg

SEQ ID NO: 4195470 - DNA, 21 bp, Homo sapiens
agggtgagtgaatggcaaagc

SEQ ID NO: 4195471 - DNA, 20 bp, Homo sapiens
agggtgctaacgtatctcta

SEQ ID NO: 4195472 - DNA, 18 bp, Homo sapiens
agggtgggccactctccc

SEQ ID NO: 4195473 - DNA, 21 bp, Homo sapiens
agggttatacacagaaaaggg

SEQ ID NO: 4195474 - DNA, 18 bp, Homo sapiens
agggttggtgggctggcc

SEQ ID NO: 4195475 - DNA, 14 bp, Homo sapiens
aggtaaaatgccat

SEQ ID NO: 4195476 - DNA, 15 bp, Homo sapiens
aggtaaaatgccatg

SEQ ID NO: 4195477 - DNA, 13 bp, Homo sapiens
aggtaatgaggga

SEQ ID NO: 4195478 - DNA, 14 bp, Homo sapiens
aggtaatgagggac

SEQ ID NO: 4195479 - DNA, 22 bp, Homo sapiens
aggtaccagcaatatgtaaata

SEQ ID NO: 4195480 - DNA, 17 bp, Homo sapiens
aggtactatctgtgaag

SEQ ID NO: 4195481 - DNA, 20 bp, Homo sapiens
aggtagcgagctgctctgct

SEQ ID NO: 4195482 - DNA, 16 bp, Homo sapiens
aggtaggggcacagtg

SEQ ID NO: 4195483 - DNA, 17 bp, Homo sapiens
aggtagttggtgaacag

SEQ ID NO: 4195484 - DNA, 14 bp, Homo sapiens
aggtatctccagga

SEQ ID NO: 4195485 - DNA, 22 bp, Homo sapiens
aggtattccttttgtgtacagt

SEQ ID NO: 4195486 - DNA, 14 bp, Homo sapiens
aggtatttcaaaac

SEQ ID NO: 4195487 - DNA, 13 bp, Homo sapiens
aggtcaacatcta

SEQ ID NO: 4195488 - DNA, 16 bp, Homo sapiens
aggtcaagactgtggt

SEQ ID NO: 4195489 - DNA, 21 bp, Homo sapiens
aggtcactcttcctgcaagga

SEQ ID NO: 4195490 - DNA, 23 bp, Homo sapiens
aggtcactcttcctgcaaggact

SEQ ID NO: 4195491 - DNA, 14 bp, Homo sapiens
aggtcactgggttc

SEQ ID NO: 4195492 - DNA, 15 bp, Homo sapiens
aggtcactgggttct

SEQ ID NO: 4195493 - DNA, 14 bp, Homo sapiens
aggtcacttgaagc

SEQ ID NO: 4195494 - DNA, 19 bp, Homo sapiens
aggtcagcgtgcttagcct

SEQ ID NO: 4195495 - DNA, 14 bp, Homo sapiens
aggtcatgatttct

SEQ ID NO: 4195496 - DNA, 23 bp, Homo sapiens
aggtcatgatttctgtgaagcaa

SEQ ID NO: 4195497 - DNA, 17 bp, Homo sapiens
aggtccaggcaaagctg

SEQ ID NO: 4195498 - DNA, 13 bp, Homo sapiens
aggtccaggcagg

SEQ ID NO: 4195499 - DNA, 17 bp, Homo sapiens
aggtccaggccagtggg

SEQ ID NO: 4195500 - DNA, 15 bp, Homo sapiens
aggtcctggcttcta

SEQ ID NO: 4195501 - DNA, 13 bp, Homo sapiens
aggtcctgtcctg

SEQ ID NO: 4195502 - DNA, 23 bp, Homo sapiens
aggtcctgtcctggctcccaggg

SEQ ID NO: 4195503 - DNA, 17 bp, Homo sapiens
aggtctagactttctca

SEQ ID NO: 4195504 - DNA, 18 bp, Homo sapiens
aggtcttcttgtgtcctg

SEQ ID NO: 4195505 - DNA, 22 bp, Homo sapiens
aggtgaaaacagcccaggtcct

SEQ ID NO: 4195506 - DNA, 22 bp, Homo sapiens
aggtgagaccaaaggatccaga

SEQ ID NO: 4195507 - DNA, 23 bp, Homo sapiens
aggtgagaccaaaggatccagag

SEQ ID NO: 4195508 - DNA, 14 bp, Homo sapiens
aggtgagaccacct

SEQ ID NO: 4195509 - DNA, 12 bp, Homo sapiens
aggtgagctcag

SEQ ID NO: 4195510 - DNA, 15 bp, Homo sapiens
aggtgagctcagctc

SEQ ID NO: 4195511 - DNA, 19 bp, Homo sapiens
aggtgagctcagctcactg

SEQ ID NO: 4195512 - DNA, 13 bp, Homo sapiens
aggtgagggatgt

SEQ ID NO: 4195513 - DNA, 17 bp, Homo sapiens
aggtgcctggcttgctg

SEQ ID NO: 4195514 - DNA, 22 bp, Homo sapiens
aggtgcctggcttgctgtggct

SEQ ID NO: 4195515 - DNA, 17 bp, Homo sapiens
aggtggcaggaccagga

SEQ ID NO: 4195516 - DNA, 18 bp, Homo sapiens
aggtgggagagagtgcat

SEQ ID NO: 4195517 - DNA, 17 bp, Homo sapiens
aggtgggctgagccctg

SEQ ID NO: 4195518 - DNA, 20 bp, Homo sapiens
aggtgggctgagccctggca

SEQ ID NO: 4195519 - DNA, 23 bp, Homo sapiens
aggtggggtatttaccacagcag

SEQ ID NO: 4195520 - DNA, 17 bp, Homo sapiens
aggtgtcaccctgcaga

SEQ ID NO: 4195521 - DNA, 16 bp, Homo sapiens
aggtgtctgcacccag

SEQ ID NO: 4195522 - DNA, 14 bp, Homo sapiens
aggttagaaatact

SEQ ID NO: 4195523 - DNA, 16 bp, Homo sapiens
aggttccctctgagaa

SEQ ID NO: 4195524 - DNA, 20 bp, Homo sapiens
aggttgacagtcccttgctg

SEQ ID NO: 4195525 - DNA, 15 bp, Homo sapiens
aggttgcagtgagct

SEQ ID NO: 4195526 - DNA, 19 bp, Homo sapiens
aggttgggcttccatgcct

SEQ ID NO: 4195527 - DNA, 14 bp, Homo sapiens
aggtttacagaatt

SEQ ID NO: 4195528 - DNA, 21 bp, Homo sapiens
aggtttatgaaaaagaagaat

SEQ ID NO: 4195529 - DNA, 14 bp, Homo sapiens
aggtttgctgtgtc

SEQ ID NO: 4195530 - DNA, 15 bp, Homo sapiens
aggtttgctgtgtct

SEQ ID NO: 4195531 - DNA, 23 bp, Homo sapiens
aggtttggggagggggaagagaa

SEQ ID NO: 4195532 - DNA, 16 bp, Homo sapiens
aggtttggtgtgtgga

SEQ ID NO: 4195533 - DNA, 17 bp, Homo sapiens
aggtttgtcaacacaaa

SEQ ID NO: 4195534 - DNA, 12 bp, Homo sapiens
aggttttgttgt

SEQ ID NO: 4195535 - DNA, 13 bp, Homo sapiens
agtaaaaatatgt

SEQ ID NO: 4195536 - DNA, 12 bp, Homo sapiens
agtaaaagcaaa

SEQ ID NO: 4195537 - DNA, 12 bp, Homo sapiens
agtaaaagctaa

SEQ ID NO: 4195538 - DNA, 14 bp, Homo sapiens
agtaaaagctaatt

SEQ ID NO: 4195539 - DNA, 13 bp, Homo sapiens
agagaaggagcag

SEQ ID NO: 4195540 - DNA, 13 bp, Homo sapiens
agagaagggaagc

SEQ ID NO: 4195541 - DNA, 18 bp, Homo sapiens
agagaatatatttttgat

SEQ ID NO: 4195542 - DNA, 21 bp, Homo sapiens
agagacagaccccttggcttt

SEQ ID NO: 4195543 - DNA, 15 bp, Homo sapiens
agagacaggagggca

SEQ ID NO: 4195544 - DNA, 19 bp, Homo sapiens
agagagaaaacttatttga

SEQ ID NO: 4195545 - DNA, 17 bp, Homo sapiens
agagagaaacatttatg

SEQ ID NO: 4195546 - DNA, 14 bp, Homo sapiens
agagagaaccagga

SEQ ID NO: 4195547 - DNA, 11 bp, Homo sapiens
agagagaagcc

SEQ ID NO: 4195548 - DNA, 22 bp, Homo sapiens
agagagcctagaacatccctgg

SEQ ID NO: 4195549 - DNA, 14 bp, Homo sapiens
agagaggaaaagct

SEQ ID NO: 4195550 - DNA, 12 bp, Homo sapiens
agagaggcacct

SEQ ID NO: 4195551 - DNA, 18 bp, Homo sapiens
agagaggcacctgctgga

SEQ ID NO: 4195552 - DNA, 19 bp, Homo sapiens
agagaggggtacatttccc

SEQ ID NO: 4195553 - DNA, 16 bp, Homo sapiens
agagaggtagcgagct

SEQ ID NO: 4195554 - DNA, 19 bp, Homo sapiens
agagaggtagcgagctgct

SEQ ID NO: 4195555 - DNA, 22 bp, Homo sapiens
agagaggtagcgagctgctctg

SEQ ID NO: 4195556 - DNA, 16 bp, Homo sapiens
agagatagcagaggaa

SEQ ID NO: 4195557 - DNA, 18 bp, Homo sapiens
agagatcagcagtggcag

SEQ ID NO: 4195558 - DNA, 15 bp, Homo sapiens
agagatcaggaagag

SEQ ID NO: 4195559 - DNA, 17 bp, Homo sapiens
agagatgactgagtcct

SEQ ID NO: 4195560 - DNA, 15 bp, Homo sapiens
agagattaattttaa

SEQ ID NO: 4195561 - DNA, 13 bp, Homo sapiens
agagcaagaagga

SEQ ID NO: 4195562 - DNA, 19 bp, Homo sapiens
agagcaagactccatttca

SEQ ID NO: 4195563 - DNA, 17 bp, Homo sapiens
agagcacagcccacggg

SEQ ID NO: 4195564 - DNA, 18 bp, Homo sapiens
agagcacctagtccagtg

SEQ ID NO: 4195565 - DNA, 12 bp, Homo sapiens
agagcactgcca

SEQ ID NO: 4195566 - DNA, 14 bp, Homo sapiens
agagcagagagcag

SEQ ID NO: 4195567 - DNA, 11 bp, Homo sapiens
agagcagctgg

SEQ ID NO: 4195568 - DNA, 20 bp, Homo sapiens
agagcaggccacgctcaggc

SEQ ID NO: 4195569 - DNA, 17 bp, Homo sapiens
agagcaggctcagactc

SEQ ID NO: 4195570 - DNA, 21 bp, Homo sapiens
agagccaccagggcactgtct

SEQ ID NO: 4195571 - DNA, 23 bp, Homo sapiens
agagccaccagggcactgtctgc

SEQ ID NO: 4195572 - DNA, 16 bp, Homo sapiens
agagccaggctctgcc

SEQ ID NO: 4195573 - DNA, 18 bp, Homo sapiens
agagccaggctctgcctg

SEQ ID NO: 4195574 - DNA, 21 bp, Homo sapiens
agagccccccgtgtggcttac

SEQ ID NO: 4195575 - DNA, 15 bp, Homo sapiens
agagccgggccccgg

SEQ ID NO: 4195576 - DNA, 16 bp, Homo sapiens
agagcctagaacatcc

SEQ ID NO: 4195577 - DNA, 23 bp, Homo sapiens
agagcctccacttagttttggga

SEQ ID NO: 4195578 - DNA, 15 bp, Homo sapiens
agagcctggagaagc

SEQ ID NO: 4195579 - DNA, 15 bp, Homo sapiens
agagccttcaagtgc

SEQ ID NO: 4195580 - DNA, 17 bp, Homo sapiens
agagccttcaagtgcca

SEQ ID NO: 4195581 - DNA, 20 bp, Homo sapiens
agagccttcaagtgccaaac

SEQ ID NO: 4195582 - DNA, 20 bp, Homo sapiens
agagcgcctcttcctctggg

SEQ ID NO: 4195583 - DNA, 16 bp, Homo sapiens
agagctacataattta

SEQ ID NO: 4195584 - DNA, 18 bp, Homo sapiens
agagctacataatttagt

SEQ ID NO: 4195585 - DNA, 18 bp, Homo sapiens
agagctgatggagaagga

SEQ ID NO: 4195586 - DNA, 21 bp, Homo sapiens
agagctgatggagaaggaagg

SEQ ID NO: 4195587 - DNA, 22 bp, Homo sapiens
agagctgctctggaaaatgtga

SEQ ID NO: 4195588 - DNA, 20 bp, Homo sapiens
agagctggggctgccagcct

SEQ ID NO: 4195589 - DNA, 21 bp, Homo sapiens
agagctggggctgccagcctg

SEQ ID NO: 4195590 - DNA, 22 bp, Homo sapiens
agagctggggctgccagcctga

SEQ ID NO: 4195591 - DNA, 14 bp, Homo sapiens
agagcttggtggct

SEQ ID NO: 4195592 - DNA, 14 bp, Homo sapiens
agaggaaaagctgc

SEQ ID NO: 4195593 - DNA, 21 bp, Homo sapiens
agaggaaaagctgcctctggt

SEQ ID NO: 4195594 - DNA, 20 bp, Homo sapiens
agaggacagtctggagaagg

SEQ ID NO: 4195595 - DNA, 19 bp, Homo sapiens
agttccagtttagcccttc

SEQ ID NO: 4195596 - DNA, 22 bp, Homo sapiens
agttccatgaagaccacatcca

SEQ ID NO: 4195597 - DNA, 15 bp, Homo sapiens
agttcccgctctgca

SEQ ID NO: 4195598 - DNA, 17 bp, Homo sapiens
agttcctctaacatttg

SEQ ID NO: 4195599 - DNA, 18 bp, Homo sapiens
agttcctctagtgccctc

SEQ ID NO: 4195600 - DNA, 15 bp, Homo sapiens
agttcctctttgcat

SEQ ID NO: 4195601 - DNA, 17 bp, Homo sapiens
agttcctgcactccaga

SEQ ID NO: 4195602 - DNA, 14 bp, Homo sapiens
agttctagagaaga

SEQ ID NO: 4195603 - DNA, 20 bp, Homo sapiens
agttctagagaagaggctgg

SEQ ID NO: 4195604 - DNA, 17 bp, Homo sapiens
agttctatgaatatgga

SEQ ID NO: 4195605 - DNA, 16 bp, Homo sapiens
agttctctcgtaactg

SEQ ID NO: 4195606 - DNA, 19 bp, Homo sapiens
agttctggaaaccacgtgg

SEQ ID NO: 4195607 - DNA, 15 bp, Homo sapiens
agttcttgcccttca

SEQ ID NO: 4195608 - DNA, 14 bp, Homo sapiens
agttgaaaaataaa

SEQ ID NO: 4195609 - DNA, 14 bp, Homo sapiens
agttgaacatctca

SEQ ID NO: 4195610 - DNA, 20 bp, Homo sapiens
agttgacttactgtttctta

SEQ ID NO: 4195611 - DNA, 22 bp, Homo sapiens
agttgacttactgtttcttacc

SEQ ID NO: 4195612 - DNA, 15 bp, Homo sapiens
agttgatcataatta

SEQ ID NO: 4195613 - DNA, 19 bp, Homo sapiens
agttggagttttttgtacc

SEQ ID NO: 4195614 - DNA, 20 bp, Homo sapiens
agttggagttttttgtacca

SEQ ID NO: 4195615 - DNA, 21 bp, Homo sapiens
agttggtcttatagaaagcac

SEQ ID NO: 4195616 - DNA, 16 bp, Homo sapiens
agttggtgaacagaga

SEQ ID NO: 4195617 - DNA, 19 bp, Homo sapiens
agttggtgaacagagagaa

SEQ ID NO: 4195618 - DNA, 21 bp, Homo sapiens
agttggtgaacagagagaacc

SEQ ID NO: 4195619 - DNA, 15 bp, Homo sapiens
agttgtacctccatt

SEQ ID NO: 4195620 - DNA, 23 bp, Homo sapiens
agttgtctggctttttgcacgtg

SEQ ID NO: 4195621 - DNA, 13 bp, Homo sapiens
agttgtcttgtcc

SEQ ID NO: 4195622 - DNA, 15 bp, Homo sapiens
agttgtgccttttat

SEQ ID NO: 4195623 - DNA, 23 bp, Homo sapiens
agttgtgccttttatagctatta

SEQ ID NO: 4195624 - DNA, 19 bp, Homo sapiens
agttgtggaaagcctctgc

SEQ ID NO: 4195625 - DNA, 20 bp, Homo sapiens
agttgtggaaagcctctgct

SEQ ID NO: 4195626 - DNA, 16 bp, Homo sapiens
agttgttactgaagtt

SEQ ID NO: 4195627 - DNA, 19 bp, Homo sapiens
agttgttcacatatatgta

SEQ ID NO: 4195628 - DNA, 12 bp, Homo sapiens
agtttaacacaa

SEQ ID NO: 4195629 - DNA, 21 bp, Homo sapiens
agtttacaagtgtatatcaga

SEQ ID NO: 4195630 - DNA, 23 bp, Homo sapiens
agtttacaagtgtatatcagaaa

SEQ ID NO: 4195631 - DNA, 16 bp, Homo sapiens
agtttacagtaaataa

SEQ ID NO: 4195632 - DNA, 20 bp, Homo sapiens
agtttagaagcgctcatctg

SEQ ID NO: 4195633 - DNA, 14 bp, Homo sapiens
agtttagcccatct

SEQ ID NO: 4195634 - DNA, 18 bp, Homo sapiens
agtttagcccttccctgc

SEQ ID NO: 4195635 - DNA, 20 bp, Homo sapiens
agtttagcccttccctgcct

SEQ ID NO: 4195636 - DNA, 16 bp, Homo sapiens
agtttatatttaactc

SEQ ID NO: 4195637 - DNA, 12 bp, Homo sapiens
agtttcagaagc

SEQ ID NO: 4195638 - DNA, 14 bp, Homo sapiens
agtttcagaagcag

SEQ ID NO: 4195639 - DNA, 18 bp, Homo sapiens
agtttcagaagcaggcag

SEQ ID NO: 4195640 - DNA, 15 bp, Homo sapiens
agtttcagatatata

SEQ ID NO: 4195641 - DNA, 14 bp, Homo sapiens
agtttctagagggc

SEQ ID NO: 4195642 - DNA, 15 bp, Homo sapiens
agtttgaacttcata

SEQ ID NO: 4195643 - DNA, 22 bp, Homo sapiens
agtttggatatgtaaaacattt

SEQ ID NO: 4195644 - DNA, 17 bp, Homo sapiens
agtttggcaatagtttg

SEQ ID NO: 4195645 - DNA, 22 bp, Homo sapiens
agtttggccgggtgcggtggct

SEQ ID NO: 4195646 - DNA, 17 bp, Homo sapiens
agtttgtataacttctt

SEQ ID NO: 4195647 - DNA, 13 bp, Homo sapiens
agtttgttttaca

SEQ ID NO: 4195648 - DNA, 23 bp, Homo sapiens
agttttgggaggggatggcagac

SEQ ID NO: 4195649 - DNA, 21 bp, Homo sapiens
agttttgttttccctttaaag

SEQ ID NO: 4195650 - DNA, 16 bp, Homo sapiens
agtttttactttctgt

SEQ ID NO: 4195651 - DNA, 14 bp, Homo sapiens
agtttttagtttgt

SEQ ID NO: 4195652 - DNA, 17 bp, Homo sapiens
ataaaaaaacaatcatt

SEQ ID NO: 4195653 - DNA, 19 bp, Homo sapiens
ataaaaaaacaatcatttg

SEQ ID NO: 4195654 - DNA, 21 bp, Homo sapiens
ataaaaagactattaagagca

SEQ ID NO: 4195655 - DNA, 23 bp, Homo sapiens
ataaaaagactattaagagcaat

SEQ ID NO: 4195656 - DNA, 11 bp, Homo sapiens
ataaaaataca

SEQ ID NO: 4195657 - DNA, 11 bp, Homo sapiens
ataaaaccttt

SEQ ID NO: 4195658 - DNA, 14 bp, Homo sapiens
ataaaacctttcaa

SEQ ID NO: 4195659 - DNA, 16 bp, Homo sapiens
ataaaaggaaaaccag

SEQ ID NO: 4195660 - DNA, 14 bp, Homo sapiens
ataaaatatattta

SEQ ID NO: 4195661 - DNA, 16 bp, Homo sapiens
ataaaatatatttatg

SEQ ID NO: 4195662 - DNA, 11 bp, Homo sapiens
ataaaattgta

SEQ ID NO: 4195663 - DNA, 23 bp, Homo sapiens
ataaaattgtaaaattgtataga

SEQ ID NO: 4195664 - DNA, 22 bp, Homo sapiens
ataaacactgcctatatatgta

SEQ ID NO: 4195665 - DNA, 15 bp, Homo sapiens
ataaacctggagatg

SEQ ID NO: 4195666 - DNA, 17 bp, Homo sapiens
ataaacctggagatgat

SEQ ID NO: 4195667 - DNA, 19 bp, Homo sapiens
ataaacctggagatgatga

SEQ ID NO: 4195668 - DNA, 14 bp, Homo sapiens
ataaactatcagtt

SEQ ID NO: 4195669 - DNA, 15 bp, Homo sapiens
ataaactgtacaaat

SEQ ID NO: 4195670 - DNA, 17 bp, Homo sapiens
ataaactgtacaaatga

SEQ ID NO: 4195671 - DNA, 21 bp, Homo sapiens
ataaacttagaataaaattgt

SEQ ID NO: 4195672 - DNA, 18 bp, Homo sapiens
ataaagattttttaataa

SEQ ID NO: 4195673 - DNA, 15 bp, Homo sapiens
ataaagcaagctcaa

SEQ ID NO: 4195674 - DNA, 18 bp, Homo sapiens
ataaaggaagtcaccaaa

SEQ ID NO: 4195675 - DNA, 16 bp, Homo sapiens
ataaaggtcacataaa

SEQ ID NO: 4195676 - DNA, 20 bp, Homo sapiens
ataaaggtcacataaacttt

SEQ ID NO: 4195677 - DNA, 14 bp, Homo sapiens
ataaagtatcatca

SEQ ID NO: 4195678 - DNA, 16 bp, Homo sapiens
ataaagttgataaaga

SEQ ID NO: 4195679 - DNA, 17 bp, Homo sapiens
ataaagttgataaagat

SEQ ID NO: 4195680 - DNA, 11 bp, Homo sapiens
ataaatatgtg

SEQ ID NO: 4195681 - DNA, 21 bp, Homo sapiens
ataaatatgtgaaaatgatta

SEQ ID NO: 4195682 - DNA, 17 bp, Homo sapiens
ataaattcataactggt

SEQ ID NO: 4195683 - DNA, 15 bp, Homo sapiens
ataaattccactgga

SEQ ID NO: 4195684 - DNA, 13 bp, Homo sapiens
ataaattgtttga

SEQ ID NO: 4195685 - DNA, 14 bp, Homo sapiens
ataacaagatcttt

SEQ ID NO: 4195686 - DNA, 19 bp, Homo sapiens
ataacaagatctttcagga

SEQ ID NO: 4195687 - DNA, 22 bp, Homo sapiens
ataacaaggttcttctaaaatt

SEQ ID NO: 4195688 - DNA, 19 bp, Homo sapiens
ataaccagctgtaacacag

SEQ ID NO: 4195689 - DNA, 13 bp, Homo sapiens
ataacctatatga

SEQ ID NO: 4195690 - DNA, 13 bp, Homo sapiens
ataactagtttaa

SEQ ID NO: 4195691 - DNA, 14 bp, Homo sapiens
ataactatttacat

SEQ ID NO: 4195692 - DNA, 19 bp, Homo sapiens
ataactggtagctataact

SEQ ID NO: 4195693 - DNA, 16 bp, Homo sapiens
ataacttctgaagtaa

SEQ ID NO: 4195694 - DNA, 19 bp, Homo sapiens
ataacttgttttgacttga

SEQ ID NO: 4195695 - DNA, 21 bp, Homo sapiens
ataagaaacttttttatttaa

SEQ ID NO: 4195696 - DNA, 15 bp, Homo sapiens
ataagaaagtttcac

SEQ ID NO: 4195697 - DNA, 11 bp, Homo sapiens
ataagaagaat

SEQ ID NO: 4195698 - DNA, 15 bp, Homo sapiens
ataagaagaatgctt

SEQ ID NO: 4195699 - DNA, 13 bp, Homo sapiens
ataagagtaaaaa

SEQ ID NO: 4195700 - DNA, 14 bp, Homo sapiens
ataagattaaagga

SEQ ID NO: 4195701 - DNA, 23 bp, Homo sapiens
ataagcaagaaggcaaaaatagt

SEQ ID NO: 4195702 - DNA, 13 bp, Homo sapiens
ataagcaggaagg

SEQ ID NO: 4195703 - DNA, 22 bp, Homo sapiens
ataaggaaatcaacttgcttat

SEQ ID NO: 4195704 - DNA, 21 bp, Homo sapiens
ataaggaaatgtgtgttgtaa

SEQ ID NO: 4195705 - DNA, 13 bp, Homo sapiens
ataaggcagttga

SEQ ID NO: 4195706 - DNA, 15 bp, Homo sapiens
ataagtaaacaacat

SEQ ID NO: 4195707 - DNA, 16 bp, Homo sapiens
ataagtaaacaacata

SEQ ID NO: 4195708 - DNA, 17 bp, Homo sapiens
ataagtgggagctaaat

SEQ ID NO: 4195709 - DNA, 21 bp, Homo sapiens
ataagtgtgtggtcccaagtt

SEQ ID NO: 4195710 - DNA, 13 bp, Homo sapiens
ataataaaaagac

SEQ ID NO: 4195711 - DNA, 23 bp, Homo sapiens
ataataaaggtcacataaacttt

SEQ ID NO: 4195712 - DNA, 17 bp, Homo sapiens
ataataatgaatgtcat

SEQ ID NO: 4195713 - DNA, 22 bp, Homo sapiens
ataatacactaattcctttcta

SEQ ID NO: 4195714 - DNA, 21 bp, Homo sapiens
ataatactgctgagatacata

SEQ ID NO: 4195715 - DNA, 21 bp, Homo sapiens
caccacactccccgcctgtcc

SEQ ID NO: 4195716 - DNA, 20 bp, Homo sapiens
caccaccttggactcctccc

SEQ ID NO: 4195717 - DNA, 20 bp, Homo sapiens
caccactgcactccagcctg

SEQ ID NO: 4195718 - DNA, 23 bp, Homo sapiens
caccagacccacctggagcccgc

SEQ ID NO: 4195719 - DNA, 15 bp, Homo sapiens
caccagcctgactgc

SEQ ID NO: 4195720 - DNA, 16 bp, Homo sapiens
caccagcttctccagg

SEQ ID NO: 4195721 - DNA, 22 bp, Homo sapiens
caccaggatagagactggaaca

SEQ ID NO: 4195722 - DNA, 13 bp, Homo sapiens
caccaggatggcc

SEQ ID NO: 4195723 - DNA, 16 bp, Homo sapiens
caccagggcactgtct

SEQ ID NO: 4195724 - DNA, 21 bp, Homo sapiens
caccataaccaagaaatacta

SEQ ID NO: 4195725 - DNA, 15 bp, Homo sapiens
caccatcgtgtttgc

SEQ ID NO: 4195726 - DNA, 14 bp, Homo sapiens
cacccactgtccgc

SEQ ID NO: 4195727 - DNA, 14 bp, Homo sapiens
cacccatgaagaca

SEQ ID NO: 4195728 - DNA, 15 bp, Homo sapiens
cacccatgaagacag

SEQ ID NO: 4195729 - DNA, 21 bp, Homo sapiens
caccccacattggacttcctt

SEQ ID NO: 4195730 - DNA, 12 bp, Homo sapiens
caccccctcatt

SEQ ID NO: 4195731 - DNA, 14 bp, Homo sapiens
caccccctccagct

SEQ ID NO: 4195732 - DNA, 13 bp, Homo sapiens
cacccctgtctct

SEQ ID NO: 4195733 - DNA, 17 bp, Homo sapiens
caccccttatccaggac

SEQ ID NO: 4195734 - DNA, 18 bp, Homo sapiens
caccccttatccaggact

SEQ ID NO: 4195735 - DNA, 14 bp, Homo sapiens
cacccgactcctca

SEQ ID NO: 4195736 - DNA, 19 bp, Homo sapiens
caccctctgccccagaaca

SEQ ID NO: 4195737 - DNA, 13 bp, Homo sapiens
caccctgcagagc

SEQ ID NO: 4195738 - DNA, 14 bp, Homo sapiens
caccctgcagagct

SEQ ID NO: 4195739 - DNA, 15 bp, Homo sapiens
caccctgcccagtct

SEQ ID NO: 4195740 - DNA, 14 bp, Homo sapiens
cacccttggacttg

SEQ ID NO: 4195741 - DNA, 19 bp, Homo sapiens
caccgagacggctggacct

SEQ ID NO: 4195742 - DNA, 12 bp, Homo sapiens
cacctaaagaaa

SEQ ID NO: 4195743 - DNA, 13 bp, Homo sapiens
cacctaaagaaaa

SEQ ID NO: 4195744 - DNA, 17 bp, Homo sapiens
cacctactactcaattg

SEQ ID NO: 4195745 - DNA, 15 bp, Homo sapiens
cacctagtccagtga

SEQ ID NO: 4195746 - DNA, 13 bp, Homo sapiens
cacctctcaatat

SEQ ID NO: 4195747 - DNA, 23 bp, Homo sapiens
cacctctctaagttatgtacgta

SEQ ID NO: 4195748 - DNA, 13 bp, Homo sapiens
cacctctggcttt

SEQ ID NO: 4195749 - DNA, 18 bp, Homo sapiens
cacctctggctttgtctc

SEQ ID NO: 4195750 - DNA, 19 bp, Homo sapiens
cacctctggctttgtctct

SEQ ID NO: 4195751 - DNA, 21 bp, Homo sapiens
cacctctttaaccactcctca

SEQ ID NO: 4195752 - DNA, 20 bp, Homo sapiens
caagtatttgttaatttaga

SEQ ID NO: 4195753 - DNA, 22 bp, Homo sapiens
caagtatttgttaatttagaaa

SEQ ID NO: 4195754 - DNA, 16 bp, Homo sapiens
caagtcatgggtcaca

SEQ ID NO: 4195755 - DNA, 19 bp, Homo sapiens
caagtccaacctgcctgtg

SEQ ID NO: 4195756 - DNA, 14 bp, Homo sapiens
caagtccagagccg

SEQ ID NO: 4195757 - DNA, 14 bp, Homo sapiens
caagtctcagaaga

SEQ ID NO: 4195758 - DNA, 17 bp, Homo sapiens
caagtctccttcccctt

SEQ ID NO: 4195759 - DNA, 18 bp, Homo sapiens
caagtgccaaacagagta

SEQ ID NO: 4195760 - DNA, 12 bp, Homo sapiens
caagtgcctaga

SEQ ID NO: 4195761 - DNA, 15 bp, Homo sapiens
caagtggatggccca

SEQ ID NO: 4195762 - DNA, 17 bp, Homo sapiens
caagttagctcaggagg

SEQ ID NO: 4195763 - DNA, 16 bp, Homo sapiens
caagttcctgcactcc

SEQ ID NO: 4195764 - DNA, 18 bp, Homo sapiens
caagttctagagaagagg

SEQ ID NO: 4195765 - DNA, 23 bp, Homo sapiens
caagttctagagaagaggctggt

SEQ ID NO: 4195766 - DNA, 11 bp, Homo sapiens
caataaagctg

SEQ ID NO: 4195767 - DNA, 17 bp, Homo sapiens
caataaagctgctgaga

SEQ ID NO: 4195768 - DNA, 13 bp, Homo sapiens
caataacaacaat

SEQ ID NO: 4195769 - DNA, 22 bp, Homo sapiens
caataacaacaatggtttacat

SEQ ID NO: 4195770 - DNA, 14 bp, Homo sapiens
caataatatttcaa

SEQ ID NO: 4195771 - DNA, 14 bp, Homo sapiens
caatacaacaagaa

SEQ ID NO: 4195772 - DNA, 14 bp, Homo sapiens
caatacttcatgat

SEQ ID NO: 4195773 - DNA, 19 bp, Homo sapiens
caataggtgcaaaaataaa

SEQ ID NO: 4195774 - DNA, 14 bp, Homo sapiens
caatataaaaatgt

SEQ ID NO: 4195775 - DNA, 17 bp, Homo sapiens
caatataaaaatgtgaa

SEQ ID NO: 4195776 - DNA, 11 bp, Homo sapiens
caatatgctta

SEQ ID NO: 4195777 - DNA, 15 bp, Homo sapiens
caatatgtaaatagt

SEQ ID NO: 4195778 - DNA, 13 bp, Homo sapiens
caatatgtagcct

SEQ ID NO: 4195779 - DNA, 16 bp, Homo sapiens
caatattaattataat

SEQ ID NO: 4195780 - DNA, 15 bp, Homo sapiens
caatattcaataaag

SEQ ID NO: 4195781 - DNA, 15 bp, Homo sapiens
caatcaagtctgttt

SEQ ID NO: 4195782 - DNA, 21 bp, Homo sapiens
attatttaataaaaaaacaat

SEQ ID NO: 4195783 - DNA, 14 bp, Homo sapiens
attatttaataaga

SEQ ID NO: 4195784 - DNA, 16 bp, Homo sapiens
attatttaataagagt

SEQ ID NO: 4195785 - DNA, 17 bp, Homo sapiens
attatttgtgtaataga

SEQ ID NO: 4195786 - DNA, 15 bp, Homo sapiens
attattttaaacaaa

SEQ ID NO: 4195787 - DNA, 13 bp, Homo sapiens
attattttatcac

SEQ ID NO: 4195788 - DNA, 17 bp, Homo sapiens
attatttttgagcagga

SEQ ID NO: 4195789 - DNA, 20 bp, Homo sapiens
attatttttgagcaggagca

SEQ ID NO: 4195790 - DNA, 15 bp, Homo sapiens
attcaagaaacagaa

SEQ ID NO: 4195791 - DNA, 15 bp, Homo sapiens
attcaaggtggccaa

SEQ ID NO: 4195792 - DNA, 16 bp, Homo sapiens
attcaattcaaagctg

SEQ ID NO: 4195793 - DNA, 20 bp, Homo sapiens
attcacacctcacgctctgg

SEQ ID NO: 4195794 - DNA, 21 bp, Homo sapiens
cagcattttcacattttgcct

SEQ ID NO: 4195795 - DNA, 22 bp, Homo sapiens
cagccaacaggtggcaggacca

SEQ ID NO: 4195796 - DNA, 21 bp, Homo sapiens
cagccactcgggaggctgaga

SEQ ID NO: 4195797 - DNA, 14 bp, Homo sapiens
cagccagccaggaa

SEQ ID NO: 4195798 - DNA, 18 bp, Homo sapiens
cagccaggaactggctcc

SEQ ID NO: 4195799 - DNA, 22 bp, Homo sapiens
cagcccgggtgtgcctgccctg

SEQ ID NO: 4195800 - DNA, 14 bp, Homo sapiens
cagccctaaacatc

SEQ ID NO: 4195801 - DNA, 13 bp, Homo sapiens
cagccctgcctat

SEQ ID NO: 4195802 - DNA, 13 bp, Homo sapiens
cagcccttcagac

SEQ ID NO: 4195803 - DNA, 13 bp, Homo sapiens
cagcccttggctt

SEQ ID NO: 4195804 - DNA, 16 bp, Homo sapiens
cagccgcagcctccct

SEQ ID NO: 4195805 - DNA, 19 bp, Homo sapiens
cagccgcagcctccctctg

SEQ ID NO: 4195806 - DNA, 13 bp, Homo sapiens
cagccggtgcctg

SEQ ID NO: 4195807 - DNA, 20 bp, Homo sapiens
cagcctacagcagtgtggtc

SEQ ID NO: 4195808 - DNA, 15 bp, Homo sapiens
cagcctccctctgac

SEQ ID NO: 4195809 - DNA, 21 bp, Homo sapiens
cagcctccctctgacctgcag

SEQ ID NO: 4195810 - DNA, 22 bp, Homo sapiens
cagcctctgggccaagactcct

SEQ ID NO: 4195811 - DNA, 22 bp, Homo sapiens
cagcctgactgcacacagctag

SEQ ID NO: 4195812 - DNA, 12 bp, Homo sapiens
cagcctgaggct

SEQ ID NO: 4195813 - DNA, 20 bp, Homo sapiens
cagcctgccgccgtctctgt

SEQ ID NO: 4195814 - DNA, 21 bp, Homo sapiens
cagcctggagcggagcttgcc

SEQ ID NO: 4195815 - DNA, 22 bp, Homo sapiens
cagcctggagcggagcttgcct

SEQ ID NO: 4195816 - DNA, 20 bp, Homo sapiens
cagcctggcttctggagccc

SEQ ID NO: 4195817 - DNA, 21 bp, Homo sapiens
cagcctggcttctggagccct

SEQ ID NO: 4195818 - DNA, 18 bp, Homo sapiens
cagcctggggtgatagaa

SEQ ID NO: 4195819 - DNA, 12 bp, Homo sapiens
cagcctgtcctg

SEQ ID NO: 4195820 - DNA, 16 bp, Homo sapiens
cagcctgtcctggtac

SEQ ID NO: 4195821 - DNA, 14 bp, Homo sapiens
cagccttccccctc

SEQ ID NO: 4195822 - DNA, 20 bp, Homo sapiens
cagccttccccctcccaggg

SEQ ID NO: 4195823 - DNA, 21 bp, Homo sapiens
cagccttccccctcccagggc

SEQ ID NO: 4195824 - DNA, 17 bp, Homo sapiens
cagcgcagccgccgggc

SEQ ID NO: 4195825 - DNA, 20 bp, Homo sapiens
cagcgcgggcggaggcggct

SEQ ID NO: 4195826 - DNA, 15 bp, Homo sapiens
cagcgcgtgcacagc

SEQ ID NO: 4195827 - DNA, 19 bp, Homo sapiens
cagcgcgtgcacagcgcgg

SEQ ID NO: 4195828 - DNA, 21 bp, Homo sapiens
cagcgcgtgcacagcgcgggc

SEQ ID NO: 4195829 - DNA, 18 bp, Homo sapiens
cagcggggccccagggct

SEQ ID NO: 4195830 - DNA, 18 bp, Homo sapiens
cagctaaagcccaacctc

SEQ ID NO: 4195831 - DNA, 15 bp, Homo sapiens
cagctaaatgcaggg

SEQ ID NO: 4195832 - DNA, 14 bp, Homo sapiens
cagctactcagaag

SEQ ID NO: 4195833 - DNA, 16 bp, Homo sapiens
cagctactcagaagcc

SEQ ID NO: 4195834 - DNA, 19 bp, Homo sapiens
cagctactcagaagcctga

SEQ ID NO: 4195835 - DNA, 20 bp, Homo sapiens
cagctactcagaagcctgag

SEQ ID NO: 4195836 - DNA, 23 bp, Homo sapiens
cagctactcagaagcctgaggct

SEQ ID NO: 4195837 - DNA, 16 bp, Homo sapiens
cagctactgatttttg

SEQ ID NO: 4195838 - DNA, 20 bp, Homo sapiens
cagctaggcatgcctgggaa

SEQ ID NO: 4195839 - DNA, 16 bp, Homo sapiens
cagctccagaatacct

SEQ ID NO: 4195840 - DNA, 23 bp, Homo sapiens
cagctccagtttccaagttcctg

SEQ ID NO: 4195841 - DNA, 13 bp, Homo sapiens
cagctcctctgag

SEQ ID NO: 4195842 - DNA, 15 bp, Homo sapiens
catctgagcaagagc

SEQ ID NO: 4195843 - DNA, 18 bp, Homo sapiens
catctgagcaagagctgg

SEQ ID NO: 4195844 - DNA, 15 bp, Homo sapiens
catctgtgtgaaaat

SEQ ID NO: 4195845 - DNA, 13 bp, Homo sapiens
catcttgacatgt

SEQ ID NO: 4195846 - DNA, 14 bp, Homo sapiens
catcttttgtgaga

SEQ ID NO: 4195847 - DNA, 16 bp, Homo sapiens
catcttttgtgagatg

SEQ ID NO: 4195848 - DNA, 14 bp, Homo sapiens
catgaagacaggac

SEQ ID NO: 4195849 - DNA, 16 bp, Homo sapiens
catgaagacaggacag

SEQ ID NO: 4195850 - DNA, 21 bp, Homo sapiens
catgaaggtaggtaaataggt

SEQ ID NO: 4195851 - DNA, 16 bp, Homo sapiens
catgaatgcacactag

SEQ ID NO: 4195852 - DNA, 18 bp, Homo sapiens
catgaattcttatgctta

SEQ ID NO: 4195853 - DNA, 19 bp, Homo sapiens
catgacatgttatatattt

SEQ ID NO: 4195854 - DNA, 14 bp, Homo sapiens
catgactatggata

SEQ ID NO: 4195855 - DNA, 22 bp, Homo sapiens
catgagaaatacaaaaatactc

SEQ ID NO: 4195856 - DNA, 18 bp, Homo sapiens
catgaggaaagacacaga

SEQ ID NO: 4195857 - DNA, 16 bp, Homo sapiens
catgatactttaattt

SEQ ID NO: 4195858 - DNA, 23 bp, Homo sapiens
catgatactttaatttttataaa

SEQ ID NO: 4195859 - DNA, 16 bp, Homo sapiens
catgatagtgtgattt

SEQ ID NO: 4195860 - DNA, 17 bp, Homo sapiens
catgatagtgtgatttt

SEQ ID NO: 4195861 - DNA, 21 bp, Homo sapiens
catgattggtttctaggcagt

SEQ ID NO: 4195862 - DNA, 20 bp, Homo sapiens
catgatttaatccagatctg

SEQ ID NO: 4195863 - DNA, 19 bp, Homo sapiens
catgatttctgtgaagcaa

SEQ ID NO: 4195864 - DNA, 19 bp, Homo sapiens
catgcaattggggaagaaa

SEQ ID NO: 4195865 - DNA, 21 bp, Homo sapiens
catgcaattggggaagaaaaa

SEQ ID NO: 4195866 - DNA, 18 bp, Homo sapiens
catgcaatttattaaaat

SEQ ID NO: 4195867 - DNA, 14 bp, Homo sapiens
catgcacctcaggg

SEQ ID NO: 4195868 - DNA, 19 bp, Homo sapiens
catgcaggggtcagtgcag

SEQ ID NO: 4195869 - DNA, 23 bp, Homo sapiens
catgcaggtagttggtgaacaga

SEQ ID NO: 4195870 - DNA, 22 bp, Homo sapiens
catgcatctgtttattctatag

SEQ ID NO: 4195871 - DNA, 18 bp, Homo sapiens
catgccaaagcaaaagaa

SEQ ID NO: 4195872 - DNA, 16 bp, Homo sapiens
catgccaggctaattt

SEQ ID NO: 4195873 - DNA, 22 bp, Homo sapiens
catgcccagtcgatatctcact

SEQ ID NO: 4195874 - DNA, 22 bp, Homo sapiens
catgcctggcccccctccaggc

SEQ ID NO: 4195875 - DNA, 23 bp, Homo sapiens
catgcctggcccccctccaggca

SEQ ID NO: 4195876 - DNA, 21 bp, Homo sapiens
catgcctgtagctttcctggt

SEQ ID NO: 4195877 - DNA, 13 bp, Homo sapiens
catgcgcaggctc

SEQ ID NO: 4195878 - DNA, 17 bp, Homo sapiens
catgctaagagaagtag

SEQ ID NO: 4195879 - DNA, 16 bp, Homo sapiens
catgctggcctcccaa

SEQ ID NO: 4195880 - DNA, 22 bp, Homo sapiens
catgctggcctcccaataaagc

SEQ ID NO: 4195881 - DNA, 22 bp, Homo sapiens
catgctggcggcgcagagggaa

SEQ ID NO: 4195882 - DNA, 20 bp, Homo sapiens
catgctggggcaagtccctg

SEQ ID NO: 4195883 - DNA, 23 bp, Homo sapiens
catgctttccttttcttccttct

SEQ ID NO: 4195884 - DNA, 17 bp, Homo sapiens
catggaaacctgaaaaa

SEQ ID NO: 4195885 - DNA, 15 bp, Homo sapiens
catggaagattagag

SEQ ID NO: 4195886 - DNA, 21 bp, Homo sapiens
catggaagattagaggtttgt

SEQ ID NO: 4195887 - DNA, 21 bp, Homo sapiens
catggaaggttagaggtttgt

SEQ ID NO: 4195888 - DNA, 16 bp, Homo sapiens
catggaatttgtaagt

SEQ ID NO: 4195889 - DNA, 22 bp, Homo sapiens
catggacaccccttatccagga

SEQ ID NO: 4195890 - DNA, 19 bp, Homo sapiens
catggacgttcggggcatg

SEQ ID NO: 4195891 - DNA, 20 bp, Homo sapiens
catggactcgtaaagctgct

SEQ ID NO: 4195892 - DNA, 22 bp, Homo sapiens
catggactcgtaaagctgctag

SEQ ID NO: 4195893 - DNA, 22 bp, Homo sapiens
catggagaggtttgtcaacaca

SEQ ID NO: 4195894 - DNA, 14 bp, Homo sapiens
catggcgtgtccct

SEQ ID NO: 4195895 - DNA, 19 bp, Homo sapiens
catggcgtgtccctctcgg

SEQ ID NO: 4195896 - DNA, 17 bp, Homo sapiens
catgggaccacaactat

SEQ ID NO: 4195897 - DNA, 17 bp, Homo sapiens
catgggactgtgccttt

SEQ ID NO: 4195898 - DNA, 22 bp, Homo sapiens
catgggcctgctgcgtcagacc

SEQ ID NO: 4195899 - DNA, 13 bp, Homo sapiens
catgggtgcatgg

SEQ ID NO: 4195900 - DNA, 15 bp, Homo sapiens
catggtcatggacag

SEQ ID NO: 4195901 - DNA, 19 bp, Homo sapiens
catggtgcagttgacagca

SEQ ID NO: 4195902 - DNA, 22 bp, Homo sapiens
catggtgtgaaagtcagatgcc

SEQ ID NO: 4195903 - DNA, 20 bp, Homo sapiens
catgtaaggtcttcttgtgt

SEQ ID NO: 4195904 - DNA, 13 bp, Homo sapiens
catgtacatgcat

SEQ ID NO: 4195905 - DNA, 17 bp, Homo sapiens
catgtagattttagttc

SEQ ID NO: 4195906 - DNA, 14 bp, Homo sapiens
catgtagctgagtt

SEQ ID NO: 4195907 - DNA, 14 bp, Homo sapiens
catgtatctacctc

SEQ ID NO: 4195908 - DNA, 11 bp, Homo sapiens
catgtatgtgt

SEQ ID NO: 4195909 - DNA, 19 bp, Homo sapiens
catgtccaagtccaacctg

SEQ ID NO: 4195910 - DNA, 22 bp, Homo sapiens
catgtccaagtccaacctgcct

SEQ ID NO: 4195911 - DNA, 24 bp, Homo sapiens
catgtccaagtccaacctgcctgt

SEQ ID NO: 4195912 - DNA, 22 bp, Homo sapiens
catgtccttgtgtgttttgaga

SEQ ID NO: 4195913 - DNA, 15 bp, Homo sapiens
atatttcaagtgcct

SEQ ID NO: 4195914 - DNA, 16 bp, Homo sapiens
atatttcacatgttta

SEQ ID NO: 4195915 - DNA, 21 bp, Homo sapiens
atatttctttttagattgtct

SEQ ID NO: 4195916 - DNA, 17 bp, Homo sapiens
atatttgaatatcatta

SEQ ID NO: 4195917 - DNA, 23 bp, Homo sapiens
atatttgattgtaaaaacaaaaa

SEQ ID NO: 4195918 - DNA, 13 bp, Homo sapiens
atatttggaaaga

SEQ ID NO: 4195919 - DNA, 14 bp, Homo sapiens
atatttggaaagag

SEQ ID NO: 4195920 - DNA, 15 bp, Homo sapiens
atatttggaaagaga

SEQ ID NO: 4195921 - DNA, 15 bp, Homo sapiens
atattttaaagaatt

SEQ ID NO: 4195922 - DNA, 17 bp, Homo sapiens
atattttagaaccacaa

SEQ ID NO: 4195923 - DNA, 16 bp, Homo sapiens
atatttttgatggtaa

SEQ ID NO: 4195924 - DNA, 15 bp, Homo sapiens
atattttttaaagtc

SEQ ID NO: 4195925 - DNA, 12 bp, Homo sapiens
atcaaaagacag

SEQ ID NO: 4195926 - DNA, 14 bp, Homo sapiens
atcaagaatattca

SEQ ID NO: 4195927 - DNA, 18 bp, Homo sapiens
atcaagatgtcagactgg

SEQ ID NO: 4195928 - DNA, 13 bp, Homo sapiens
atcaagtccagag

SEQ ID NO: 4195929 - DNA, 14 bp, Homo sapiens
atcaagtccagagc

SEQ ID NO: 4195930 - DNA, 13 bp, Homo sapiens
atcaagtctgttt

SEQ ID NO: 4195931 - DNA, 15 bp, Homo sapiens
atcaagtctgtttac

SEQ ID NO: 4195932 - DNA, 18 bp, Homo sapiens
atcaattcttaaatttct

SEQ ID NO: 4195933 - DNA, 18 bp, Homo sapiens
atcacagcgtttcaggaa

SEQ ID NO: 4195934 - DNA, 19 bp, Homo sapiens
atcacagggcagagccggg

SEQ ID NO: 4195935 - DNA, 15 bp, Homo sapiens
atcaccatgatttaa

SEQ ID NO: 4195936 - DNA, 19 bp, Homo sapiens
atcaccatgatttaatcca

SEQ ID NO: 4195937 - DNA, 14 bp, Homo sapiens
atcacctcaggcca

SEQ ID NO: 4195938 - DNA, 18 bp, Homo sapiens
atcacgctttttgaaaaa

SEQ ID NO: 4195939 - DNA, 20 bp, Homo sapiens
atcactaatactaattcatt

SEQ ID NO: 4195940 - DNA, 22 bp, Homo sapiens
atcactacctttatagctctca

SEQ ID NO: 4195941 - DNA, 16 bp, Homo sapiens
atcactgagttttcca

SEQ ID NO: 4195942 - DNA, 12 bp, Homo sapiens
atcactgctccc

SEQ ID NO: 4195943 - DNA, 12 bp, Homo sapiens
atcactggagcc

SEQ ID NO: 4195944 - DNA, 19 bp, Homo sapiens
atcactttgttaaaaatat

SEQ ID NO: 4195945 - DNA, 13 bp, Homo sapiens
atcagaaaaggga

SEQ ID NO: 4195946 - DNA, 21 bp, Homo sapiens
atcagaaatgtcatcaaatat

SEQ ID NO: 4195947 - DNA, 14 bp, Homo sapiens
atcagaagtaggaa

SEQ ID NO: 4195948 - DNA, 17 bp, Homo sapiens
atcagaagtaggaagga

SEQ ID NO: 4195949 - DNA, 19 bp, Homo sapiens
atcagaagtaggaaggaaa

SEQ ID NO: 4195950 - DNA, 21 bp, Homo sapiens
atcagaagtaggaaggaaaaa

SEQ ID NO: 4195951 - DNA, 18 bp, Homo sapiens
atcagaatcgctaataga

SEQ ID NO: 4195952 - DNA, 19 bp, Homo sapiens
atcagactcttggggaagc

SEQ ID NO: 4195953 - DNA, 15 bp, Homo sapiens
atcagagaataaaca

SEQ ID NO: 4195954 - DNA, 19 bp, Homo sapiens
atcagagaataaacatcat

SEQ ID NO: 4195955 - DNA, 15 bp, Homo sapiens
atcagccctcacacc

SEQ ID NO: 4195956 - DNA, 11 bp, Homo sapiens
atcagcctctt

SEQ ID NO: 4195957 - DNA, 14 bp, Homo sapiens
atcaggaagagaag

SEQ ID NO: 4195958 - DNA, 13 bp, Homo sapiens
atcaggctgaggt

SEQ ID NO: 4195959 - DNA, 18 bp, Homo sapiens
atcataggtatttcaaaa

SEQ ID NO: 4195960 - DNA, 16 bp, Homo sapiens
atcatcagtgtagaac

SEQ ID NO: 4195961 - DNA, 23 bp, Homo sapiens
atcatctggtttttaaaagataa

SEQ ID NO: 4195962 - DNA, 18 bp, Homo sapiens
atcatctgtgtgaaaatg

SEQ ID NO: 4195963 - DNA, 19 bp, Homo sapiens
atcatctgtgtgaaaatgg

SEQ ID NO: 4195964 - DNA, 20 bp, Homo sapiens
atcatgaatatttcaaaata

SEQ ID NO: 4195965 - DNA, 13 bp, Homo sapiens
atcatgacatgtt

SEQ ID NO: 4195966 - DNA, 20 bp, Homo sapiens
atcattgtgcttaataatac

SEQ ID NO: 4195967 - DNA, 13 bp, Homo sapiens
atcatttgctttt

SEQ ID NO: 4195968 - DNA, 15 bp, Homo sapiens
atcattttagacact

SEQ ID NO: 4195969 - DNA, 22 bp, Homo sapiens
atcattttgcaatcccttaata

SEQ ID NO: 4195970 - DNA, 14 bp, Homo sapiens
atccaaataaagat

SEQ ID NO: 4195971 - DNA, 16 bp, Homo sapiens
atccacgcacacatgg

SEQ ID NO: 4195972 - DNA, 18 bp, Homo sapiens
atccacgcagcagcccct

SEQ ID NO: 4195973 - DNA, 14 bp, Homo sapiens
atccagatctggga

SEQ ID NO: 4195974 - DNA, 23 bp, Homo sapiens
atccagcacaactcagtctgtgg

SEQ ID NO: 4195975 - DNA, 13 bp, Homo sapiens
atccaggactctg

SEQ ID NO: 4195976 - DNA, 15 bp, Homo sapiens
atccaggactctgtc

SEQ ID NO: 4195977 - DNA, 17 bp, Homo sapiens
atccagtaagcacatgt

SEQ ID NO: 4195978 - DNA, 18 bp, Homo sapiens
atccagttagcaacaaat

SEQ ID NO: 4195979 - DNA, 20 bp, Homo sapiens
atccatgttagtttttactt

SEQ ID NO: 4195980 - DNA, 16 bp, Homo sapiens
atccatgtttgtaaaa

SEQ ID NO: 4195981 - DNA, 18 bp, Homo sapiens
atccatttggacaaaatg

SEQ ID NO: 4195982 - DNA, 20 bp, Homo sapiens
atccatttggacaaaatgga

SEQ ID NO: 4195983 - DNA, 16 bp, Homo sapiens
atccccaagctggcag

SEQ ID NO: 4195984 - DNA, 12 bp, Homo sapiens
atccccttgaac

SEQ ID NO: 4195985 - DNA, 16 bp, Homo sapiens
atccccttgaactctt

SEQ ID NO: 4195986 - DNA, 15 bp, Homo sapiens
atcccctttcctccc

SEQ ID NO: 4195987 - DNA, 19 bp, Homo sapiens
atcccctttcctccccacc

SEQ ID NO: 4195988 - DNA, 13 bp, Homo sapiens
atccctatttaat

SEQ ID NO: 4195989 - DNA, 17 bp, Homo sapiens
atccctccatccggctc

SEQ ID NO: 4195990 - DNA, 21 bp, Homo sapiens
atccctggtcgtctatcccag

SEQ ID NO: 4195991 - DNA, 23 bp, Homo sapiens
atccctgtgttaactcaggatgc

SEQ ID NO: 4195992 - DNA, 20 bp, Homo sapiens
atcccttaatatcctaaaca

SEQ ID NO: 4195993 - DNA, 22 bp, Homo sapiens
atccctttcccatgatccagaa

SEQ ID NO: 4195994 - DNA, 21 bp, Homo sapiens
atccgactctaagctgtgtgc

SEQ ID NO: 4195995 - DNA, 22 bp, Homo sapiens
atccgactctaagctgtgtgca

SEQ ID NO: 4195996 - DNA, 19 bp, Homo sapiens
atccggctgctcctccagc

SEQ ID NO: 4195997 - DNA, 21 bp, Homo sapiens
atccggctgctcctccagccc

SEQ ID NO: 4195998 - DNA, 20 bp, Homo sapiens
atcctagtggtaggtcagaa

SEQ ID NO: 4195999 - DNA, 17 bp, Homo sapiens
atcctattatgtgttca

SEQ ID NO: 4196000 - DNA, 18 bp, Homo sapiens
atcctcaggtagtactgg

SEQ ID NO: 4196001 - DNA, 15 bp, Homo sapiens
atcctgaaaaaatga

SEQ ID NO: 4196002 - DNA, 13 bp, Homo sapiens
atcctgaagaaac

SEQ ID NO: 4196003 - DNA, 13 bp, Homo sapiens
atcctgaggctga

SEQ ID NO: 4196004 - DNA, 17 bp, Homo sapiens
atcctgcagttgggcca

SEQ ID NO: 4196005 - DNA, 15 bp, Homo sapiens
atcctggaaccactg

SEQ ID NO: 4196006 - DNA, 20 bp, Homo sapiens
atcctgtattcagacagatg

SEQ ID NO: 4196007 - DNA, 14 bp, Homo sapiens
atccttagatctgg

SEQ ID NO: 4196008 - DNA, 22 bp, Homo sapiens
atccttcatctggattccagag

SEQ ID NO: 4196009 - DNA, 11 bp, Homo sapiens
atccttctgcc

SEQ ID NO: 4196010 - DNA, 19 bp, Homo sapiens
atccttcttatgtttgctt

SEQ ID NO: 4196011 - DNA, 19 bp, Homo sapiens
atccttgagcactcagtct

SEQ ID NO: 4196012 - DNA, 17 bp, Homo sapiens
atccttggagagcagct

SEQ ID NO: 4196013 - DNA, 19 bp, Homo sapiens
atccttggagagcagctgg

SEQ ID NO: 4196014 - DNA, 22 bp, Homo sapiens
atcctttgagttatagtttgct

SEQ ID NO: 4196015 - DNA, 13 bp, Homo sapiens
atcgaatgaaatt

SEQ ID NO: 4196016 - DNA, 14 bp, Homo sapiens
atcgaatgaaatta

SEQ ID NO: 4196017 - DNA, 16 bp, Homo sapiens
atcgctcttttccact

SEQ ID NO: 4196018 - DNA, 22 bp, Homo sapiens
atcgtatttcttttttttaata

SEQ ID NO: 4196019 - DNA, 23 bp, Homo sapiens
atcgtctcctttgacatttcctt

SEQ ID NO: 4196020 - DNA, 17 bp, Homo sapiens
atcgtgggcactgctga

SEQ ID NO: 4196021 - DNA, 20 bp, Homo sapiens
atctaacaataatatttcaa

SEQ ID NO: 4196022 - DNA, 23 bp, Homo sapiens
atctaacaataatatttcaagtg

SEQ ID NO: 4196023 - DNA, 21 bp, Homo sapiens
atctaatagcgggttactttc

SEQ ID NO: 4196024 - DNA, 22 bp, Homo sapiens
atctaatagcgggttactttca

SEQ ID NO: 4196025 - DNA, 22 bp, Homo sapiens
atctaatgtaagaaaatttgaa

SEQ ID NO: 4196026 - DNA, 21 bp, Homo sapiens
atctacctcactattcaagta

SEQ ID NO: 4196027 - DNA, 17 bp, Homo sapiens
atctagtcacaaagact

SEQ ID NO: 4196028 - DNA, 17 bp, Homo sapiens
atctattataaaaccat

SEQ ID NO: 4196029 - DNA, 15 bp, Homo sapiens
atctcaaatccactg

SEQ ID NO: 4196030 - DNA, 17 bp, Homo sapiens
atctcaggccagagcca

SEQ ID NO: 4196031 - DNA, 18 bp, Homo sapiens
atctcaggccagagccaa

SEQ ID NO: 4196032 - DNA, 14 bp, Homo sapiens
atctcagtgaagaa

SEQ ID NO: 4196033 - DNA, 19 bp, Homo sapiens
atctcagttgattttctgg

SEQ ID NO: 4196034 - DNA, 21 bp, Homo sapiens
atctcatgatacaggcgggag

SEQ ID NO: 4196035 - DNA, 15 bp, Homo sapiens
atctcatgctctctg

SEQ ID NO: 4196036 - DNA, 12 bp, Homo sapiens
atctcctgaaaa

SEQ ID NO: 4196037 - DNA, 21 bp, Homo sapiens
atctctctactcctacctcag

SEQ ID NO: 4196038 - DNA, 19 bp, Homo sapiens
atctctggcctcctggggg

SEQ ID NO: 4196039 - DNA, 14 bp, Homo sapiens
atctctgtgagaga

SEQ ID NO: 4196040 - DNA, 18 bp, Homo sapiens
atctgaaccactttgcct

SEQ ID NO: 4196041 - DNA, 20 bp, Homo sapiens
atctgaatttttaaacaagt

SEQ ID NO: 4196042 - DNA, 20 bp, Homo sapiens
atctgagatctccctccagg

SEQ ID NO: 4196043 - DNA, 17 bp, Homo sapiens
atctgagcaagagctgg

SEQ ID NO: 4196044 - DNA, 19 bp, Homo sapiens
atctgcagaatgggccact

SEQ ID NO: 4196045 - DNA, 22 bp, Homo sapiens
atctgccattgggaccctccag

SEQ ID NO: 4196046 - DNA, 15 bp, Homo sapiens
atctggattccagag

SEQ ID NO: 4196047 - DNA, 17 bp, Homo sapiens
atctggtttttaaaaga

SEQ ID NO: 4196048 - DNA, 23 bp, Homo sapiens
atctgtagtaatttattgtctgt

SEQ ID NO: 4196049 - DNA, 13 bp, Homo sapiens
atctgtccaagga

SEQ ID NO: 4196050 - DNA, 14 bp, Homo sapiens
atctgtccaaggaa

SEQ ID NO: 4196051 - DNA, 15 bp, Homo sapiens
atctgtgtgaaaatg

SEQ ID NO: 4196052 - DNA, 16 bp, Homo sapiens
atcttatgcttaaaat

SEQ ID NO: 4196053 - DNA, 17 bp, Homo sapiens
atcttatgttaaaggag

SEQ ID NO: 4196054 - DNA, 17 bp, Homo sapiens
atcttctgcaattgctt

SEQ ID NO: 4196055 - DNA, 13 bp, Homo sapiens
atcttctgcagac

SEQ ID NO: 4196056 - DNA, 11 bp, Homo sapiens
atcttctggat

SEQ ID NO: 4196057 - DNA, 20 bp, Homo sapiens
atcttctgttgtagaataat

SEQ ID NO: 4196058 - DNA, 15 bp, Homo sapiens
atcttggctcactgc

SEQ ID NO: 4196059 - DNA, 21 bp, Homo sapiens
atcttggttgatgccaaaaaa

SEQ ID NO: 4196060 - DNA, 19 bp, Homo sapiens
atctttcagcactcagaaa

SEQ ID NO: 4196061 - DNA, 11 bp, Homo sapiens
atctttcctgt

SEQ ID NO: 4196062 - DNA, 19 bp, Homo sapiens
atctttctagcagcagatc

SEQ ID NO: 4196063 - DNA, 21 bp, Homo sapiens
atctttcttttgattcttcct

SEQ ID NO: 4196064 - DNA, 13 bp, Homo sapiens
atctttgactgaa

SEQ ID NO: 4196065 - DNA, 17 bp, Homo sapiens
atctttgactgaaaaaa

SEQ ID NO: 4196066 - DNA, 20 bp, Homo sapiens
atcttttaattcacctcttc

SEQ ID NO: 4196067 - DNA, 19 bp, Homo sapiens
atgaaaaacacggcagctg

SEQ ID NO: 4196068 - DNA, 14 bp, Homo sapiens
atgaaaaagaagaa

SEQ ID NO: 4196069 - DNA, 12 bp, Homo sapiens
atgaaaactcat

SEQ ID NO: 4196070 - DNA, 18 bp, Homo sapiens
atgaaaattatctccctt

SEQ ID NO: 4196071 - DNA, 19 bp, Homo sapiens
atgaaaggagtaagaaatt

SEQ ID NO: 4196072 - DNA, 21 bp, Homo sapiens
atgaacttagtcattaatgtt

SEQ ID NO: 4196073 - DNA, 16 bp, Homo sapiens
atgaacttgaggacac

SEQ ID NO: 4196074 - DNA, 18 bp, Homo sapiens
atgaacttgaggacacat

SEQ ID NO: 4196075 - DNA, 17 bp, Homo sapiens
atgaactttctcttcat

SEQ ID NO: 4196076 - DNA, 16 bp, Homo sapiens
atgaagacaggacagt

SEQ ID NO: 4196077 - DNA, 16 bp, Homo sapiens
atgaagctttggccct

SEQ ID NO: 4196078 - DNA, 18 bp, Homo sapiens
atgaagtttgaacttcat

SEQ ID NO: 4196079 - DNA, 19 bp, Homo sapiens
atgaagtttgaacttcata

SEQ ID NO: 4196080 - DNA, 17 bp, Homo sapiens
atgaatatttcaaaata

SEQ ID NO: 4196081 - DNA, 16 bp, Homo sapiens
atgaatcttttccact

SEQ ID NO: 4196082 - DNA, 13 bp, Homo sapiens
atgaatgccttcc

SEQ ID NO: 4196083 - DNA, 14 bp, Homo sapiens
atgacaacagaagc

SEQ ID NO: 4196084 - DNA, 21 bp, Homo sapiens
atgacaacattgcattgtgac

SEQ ID NO: 4196085 - DNA, 17 bp, Homo sapiens
atgacatgttatatatt

SEQ ID NO: 4196086 - DNA, 22 bp, Homo sapiens
atgacctaattgatagcaggtg

SEQ ID NO: 4196087 - DNA, 13 bp, Homo sapiens
atgacctgcagtc

SEQ ID NO: 4196088 - DNA, 17 bp, Homo sapiens
atgacttttccatgtat

SEQ ID NO: 4196089 - DNA, 19 bp, Homo sapiens
atgagaaagccttcttttg

SEQ ID NO: 4196090 - DNA, 19 bp, Homo sapiens
atgagagtggcttaaaaac

SEQ ID NO: 4196091 - DNA, 14 bp, Homo sapiens
atgagatgctggct

SEQ ID NO: 4196092 - DNA, 18 bp, Homo sapiens
atgagattgttttatcat

SEQ ID NO: 4196093 - DNA, 14 bp, Homo sapiens
atgagcaagaatta

SEQ ID NO: 4196094 - DNA, 12 bp, Homo sapiens
atgagctgaggg

SEQ ID NO: 4196095 - DNA, 13 bp, Homo sapiens
atgagctgagggg

SEQ ID NO: 4196096 - DNA, 18 bp, Homo sapiens
atgaggctgagatccaga

SEQ ID NO: 4196097 - DNA, 13 bp, Homo sapiens
atgaggctttcca

SEQ ID NO: 4196098 - DNA, 14 bp, Homo sapiens
atgagggactggaa

SEQ ID NO: 4196099 - DNA, 20 bp, Homo sapiens
atgagggactggaaccaggg

SEQ ID NO: 4196100 - DNA, 14 bp, Homo sapiens
atgagtctgctttc

SEQ ID NO: 4196101 - DNA, 18 bp, Homo sapiens
atgagttaactgtgaaat

SEQ ID NO: 4196102 - DNA, 18 bp, Homo sapiens
atgataactatttacata

SEQ ID NO: 4196103 - DNA, 18 bp, Homo sapiens
atgatactttaattttta

SEQ ID NO: 4196104 - DNA, 22 bp, Homo sapiens
atgatcactaatactaattcat

SEQ ID NO: 4196105 - DNA, 21 bp, Homo sapiens
atgatcattgaaagtaaaaaa

SEQ ID NO: 4196106 - DNA, 18 bp, Homo sapiens
atgatggttgcaaaagac

SEQ ID NO: 4196107 - DNA, 16 bp, Homo sapiens
atgattatatgacaat

SEQ ID NO: 4196108 - DNA, 16 bp, Homo sapiens
atgattattatttaaa

SEQ ID NO: 4196109 - DNA, 18 bp, Homo sapiens
atgattgtataatgtgat

SEQ ID NO: 4196110 - DNA, 20 bp, Homo sapiens
atgattgtataatgtgattt

SEQ ID NO: 4196111 - DNA, 15 bp, Homo sapiens
atgatttaatccaga

SEQ ID NO: 4196112 - DNA, 20 bp, Homo sapiens
atgatttatagtttgtacat

SEQ ID NO: 4196113 - DNA, 18 bp, Homo sapiens
atgatttttacaataatt

SEQ ID NO: 4196114 - DNA, 17 bp, Homo sapiens
atgcaagtgagaagctg

SEQ ID NO: 4196115 - DNA, 19 bp, Homo sapiens
atgcaatataaaaatgtga

SEQ ID NO: 4196116 - DNA, 20 bp, Homo sapiens
atgcaattggggaagaaaaa

SEQ ID NO: 4196117 - DNA, 15 bp, Homo sapiens
atgcacctcagggcc

SEQ ID NO: 4196118 - DNA, 13 bp, Homo sapiens
atgcagaaggaag

SEQ ID NO: 4196119 - DNA, 19 bp, Homo sapiens
atgcagcctcttccccacc

SEQ ID NO: 4196120 - DNA, 13 bp, Homo sapiens
atgcagctcaaga

SEQ ID NO: 4196121 - DNA, 14 bp, Homo sapiens
atgcagggtattgc

SEQ ID NO: 4196122 - DNA, 19 bp, Homo sapiens
atgcatggtgcagttgaca

SEQ ID NO: 4196123 - DNA, 21 bp, Homo sapiens
atgccctccctgctgccaggc

SEQ ID NO: 4196124 - DNA, 16 bp, Homo sapiens
atgcccttctgattcc

SEQ ID NO: 4196125 - DNA, 18 bp, Homo sapiens
atgcctagactgtgtatg

SEQ ID NO: 4196126 - DNA, 19 bp, Homo sapiens
atgcctcaagaacaccttt

SEQ ID NO: 4196127 - DNA, 19 bp, Homo sapiens
atgcctgggaatcctgctg

SEQ ID NO: 4196128 - DNA, 20 bp, Homo sapiens
atgcctgtagctttcctggt

SEQ ID NO: 4196129 - DNA, 22 bp, Homo sapiens
atgccttcctgtctttctggcc

SEQ ID NO: 4196130 - DNA, 17 bp, Homo sapiens
atgcctttagatgtgag

SEQ ID NO: 4196131 - DNA, 21 bp, Homo sapiens
atgcgcaagggcaaaccattt

SEQ ID NO: 4196132 - DNA, 12 bp, Homo sapiens
atgcgcaggctc

SEQ ID NO: 4196133 - DNA, 22 bp, Homo sapiens
atgctaagagaagtagaaatca

SEQ ID NO: 4196134 - DNA, 20 bp, Homo sapiens
atgctgcttctcctcccagc

SEQ ID NO: 4196135 - DNA, 22 bp, Homo sapiens
atgctggcctcccaataaagct

SEQ ID NO: 4196136 - DNA, 16 bp, Homo sapiens
atgctgtcactggcag

SEQ ID NO: 4196137 - DNA, 20 bp, Homo sapiens
atgctgtcactggcagagca

SEQ ID NO: 4196138 - DNA, 23 bp, Homo sapiens
atgctgtcatggtcctttctgga

SEQ ID NO: 4196139 - DNA, 18 bp, Homo sapiens
atgcttagaattctgaga

SEQ ID NO: 4196140 - DNA, 19 bp, Homo sapiens
atgcttgcaaaaactacaa

SEQ ID NO: 4196141 - DNA, 14 bp, Homo sapiens
atgctttctccttt

SEQ ID NO: 4196142 - DNA, 16 bp, Homo sapiens
atgctttctccttttt

SEQ ID NO: 4196143 - DNA, 18 bp, Homo sapiens
atgctttgaaacagaaaa

SEQ ID NO: 4196144 - DNA, 16 bp, Homo sapiens
atggaaaaataacaac

SEQ ID NO: 4196145 - DNA, 16 bp, Homo sapiens
atggaaaataaattat

SEQ ID NO: 4196146 - DNA, 17 bp, Homo sapiens
atggaaaataaattata

SEQ ID NO: 4196147 - DNA, 17 bp, Homo sapiens
atggaatttaatttatg

SEQ ID NO: 4196148 - DNA, 15 bp, Homo sapiens
atggaatttgtaagt

SEQ ID NO: 4196149 - DNA, 17 bp, Homo sapiens
atggaatttgtaagttt

SEQ ID NO: 4196150 - DNA, 22 bp, Homo sapiens
atggacaccccttatccaggac

SEQ ID NO: 4196151 - DNA, 14 bp, Homo sapiens
atggacctatgaca

SEQ ID NO: 4196152 - DNA, 21 bp, Homo sapiens
atggactcatggcttagaaat

SEQ ID NO: 4196153 - DNA, 23 bp, Homo sapiens
atggactcatggcttagaaatct

SEQ ID NO: 4196154 - DNA, 17 bp, Homo sapiens
atggactcttcccccac

SEQ ID NO: 4196155 - DNA, 12 bp, Homo sapiens
atggagaaggaa

SEQ ID NO: 4196156 - DNA, 14 bp, Homo sapiens
atggagaaggaagg

SEQ ID NO: 4196157 - DNA, 16 bp, Homo sapiens
atggagaataaattat

SEQ ID NO: 4196158 - DNA, 21 bp, Homo sapiens
atggagactggtcctgtgtgc

SEQ ID NO: 4196159 - DNA, 14 bp, Homo sapiens
atggagtctgcagt

SEQ ID NO: 4196160 - DNA, 22 bp, Homo sapiens
atggagtgacggtcccacactg

SEQ ID NO: 4196161 - DNA, 23 bp, Homo sapiens
atggatgggggttacctagccct

SEQ ID NO: 4196162 - DNA, 13 bp, Homo sapiens
atggattctaaaa

SEQ ID NO: 4196163 - DNA, 15 bp, Homo sapiens
atggattctaaaatg

SEQ ID NO: 4196164 - DNA, 20 bp, Homo sapiens
atggcacttagctatcagaa

SEQ ID NO: 4196165 - DNA, 22 bp, Homo sapiens
atggcacttagctatcagaaga

SEQ ID NO: 4196166 - DNA, 16 bp, Homo sapiens
atggcagacagtcaag

SEQ ID NO: 4196167 - DNA, 22 bp, Homo sapiens
atggcagcatgaattccaactc

SEQ ID NO: 4196168 - DNA, 18 bp, Homo sapiens
atggcatgagaaatacaa

SEQ ID NO: 4196169 - DNA, 15 bp, Homo sapiens
atggcccagcaggca

SEQ ID NO: 4196170 - DNA, 18 bp, Homo sapiens
atggcccttcccactgga

SEQ ID NO: 4196171 - DNA, 14 bp, Homo sapiens
atggccttccctcc

SEQ ID NO: 4196172 - DNA, 17 bp, Homo sapiens
atggctaattcccagag

SEQ ID NO: 4196173 - DNA, 21 bp, Homo sapiens
atggctaggaaagggaagcct

SEQ ID NO: 4196174 - DNA, 23 bp, Homo sapiens
atggctaggaaagggaagcctga

SEQ ID NO: 4196175 - DNA, 19 bp, Homo sapiens
atggctatgtttttaatgt

SEQ ID NO: 4196176 - DNA, 13 bp, Homo sapiens
atggctattttat

SEQ ID NO: 4196177 - DNA, 23 bp, Homo sapiens
atggctctgttatgcaagcacaa

SEQ ID NO: 4196178 - DNA, 19 bp, Homo sapiens
atggctttgctttgtgtaa

SEQ ID NO: 4196179 - DNA, 14 bp, Homo sapiens
atgggaagacatga

SEQ ID NO: 4196180 - DNA, 23 bp, Homo sapiens
atgggagagtagatggtgaaatt

SEQ ID NO: 4196181 - DNA, 14 bp, Homo sapiens
atgggattctggac

SEQ ID NO: 4196182 - DNA, 12 bp, Homo sapiens
atgggctgcaga

SEQ ID NO: 4196183 - DNA, 21 bp, Homo sapiens
atggggcgatcaagtccagag

SEQ ID NO: 4196184 - DNA, 23 bp, Homo sapiens
atggggtggggttggggcaaagc

SEQ ID NO: 4196185 - DNA, 15 bp, Homo sapiens
atgggtactccagca

SEQ ID NO: 4196186 - DNA, 19 bp, Homo sapiens
atgggtctggctgagctga

SEQ ID NO: 4196187 - DNA, 21 bp, Homo sapiens
atggtatcatttggaaatcag

SEQ ID NO: 4196188 - DNA, 14 bp, Homo sapiens
atggtatgagctga

SEQ ID NO: 4196189 - DNA, 17 bp, Homo sapiens
atggtcagttgaggaat

SEQ ID NO: 4196190 - DNA, 20 bp, Homo sapiens
atggtcctggggctctgtgc

SEQ ID NO: 4196191 - DNA, 17 bp, Homo sapiens
atttattgtctgtctac

SEQ ID NO: 4196192 - DNA, 23 bp, Homo sapiens
atttattgtctgtctacatttct

SEQ ID NO: 4196193 - DNA, 12 bp, Homo sapiens
atttatttgtgt

SEQ ID NO: 4196194 - DNA, 17 bp, Homo sapiens
atttcaaaataaactgg

SEQ ID NO: 4196195 - DNA, 21 bp, Homo sapiens
atttcaaaatggacgtactgg

SEQ ID NO: 4196196 - DNA, 13 bp, Homo sapiens
atttcaactccag

SEQ ID NO: 4196197 - DNA, 14 bp, Homo sapiens
atttcaactccaga

SEQ ID NO: 4196198 - DNA, 17 bp, Homo sapiens
atttcaactccagaagt

SEQ ID NO: 4196199 - DNA, 11 bp, Homo sapiens
atttcaagtgc

SEQ ID NO: 4196200 - DNA, 13 bp, Homo sapiens
atttcaagtgcct

SEQ ID NO: 4196201 - DNA, 20 bp, Homo sapiens
atttcactttagaaggttgt

SEQ ID NO: 4196202 - DNA, 13 bp, Homo sapiens
atttccaaataaa

SEQ ID NO: 4196203 - DNA, 15 bp, Homo sapiens
atttccaaataaaat

SEQ ID NO: 4196204 - DNA, 22 bp, Homo sapiens
atttcctgtataatttaacagt

SEQ ID NO: 4196205 - DNA, 22 bp, Homo sapiens
atttctagtagaaagaaaatgt

SEQ ID NO: 4196206 - DNA, 15 bp, Homo sapiens
atttctgatttcact

SEQ ID NO: 4196207 - DNA, 17 bp, Homo sapiens
atttctgtgaagcaaaa

SEQ ID NO: 4196208 - DNA, 19 bp, Homo sapiens
atttctgtgaagcaaaaag

SEQ ID NO: 4196209 - DNA, 20 bp, Homo sapiens
atttctgtgtattttgagat

SEQ ID NO: 4196210 - DNA, 14 bp, Homo sapiens
atttcttaaacact

SEQ ID NO: 4196211 - DNA, 21 bp, Homo sapiens
atttcttttttttaataagga

SEQ ID NO: 4196212 - DNA, 18 bp, Homo sapiens
atttgaaaataattgttc

SEQ ID NO: 4196213 - DNA, 16 bp, Homo sapiens
atttgaagctgtaccc

SEQ ID NO: 4196214 - DNA, 17 bp, Homo sapiens
atttgaatatcattaaa

SEQ ID NO: 4196215 - DNA, 22 bp, Homo sapiens
atttgaatatcattaaattgga

SEQ ID NO: 4196216 - DNA, 19 bp, Homo sapiens
atttgaggagcagcttcag

SEQ ID NO: 4196217 - DNA, 15 bp, Homo sapiens
atttgataaactaaa

SEQ ID NO: 4196218 - DNA, 14 bp, Homo sapiens
atttgatacaaaat

SEQ ID NO: 4196219 - DNA, 17 bp, Homo sapiens
atttgatgagttaactg

SEQ ID NO: 4196220 - DNA, 21 bp, Homo sapiens
atttgatgagttaactgtgaa

SEQ ID NO: 4196221 - DNA, 19 bp, Homo sapiens
atttgattgtaaaaacaaa

SEQ ID NO: 4196222 - DNA, 21 bp, Homo sapiens
atttgattgtaaaaacaaaaa

SEQ ID NO: 4196223 - DNA, 13 bp, Homo sapiens
atttgatttctat

SEQ ID NO: 4196224 - DNA, 17 bp, Homo sapiens
atttgatttctattcaa

SEQ ID NO: 4196225 - DNA, 22 bp, Homo sapiens
atttgcaaaatggaaatgtaat

SEQ ID NO: 4196226 - DNA, 14 bp, Homo sapiens
atttgccctgtgga

SEQ ID NO: 4196227 - DNA, 17 bp, Homo sapiens
atttgccttctccctgg

SEQ ID NO: 4196228 - DNA, 16 bp, Homo sapiens
atttggaaagagacca

SEQ ID NO: 4196229 - DNA, 21 bp, Homo sapiens
atttggaagagaggcacctgc

SEQ ID NO: 4196230 - DNA, 16 bp, Homo sapiens
atttggacaaaatgga

SEQ ID NO: 4196231 - DNA, 18 bp, Homo sapiens
atttggcatgcttaaata

SEQ ID NO: 4196232 - DNA, 19 bp, Homo sapiens
atttggcatgcttaaatat

SEQ ID NO: 4196233 - DNA, 15 bp, Homo sapiens
atttgtaaaaaagat

SEQ ID NO: 4196234 - DNA, 22 bp, Homo sapiens
atttgtaagtttatgtctaaag

SEQ ID NO: 4196235 - DNA, 23 bp, Homo sapiens
atttgtaagtttatgtctaaaga

SEQ ID NO: 4196236 - DNA, 17 bp, Homo sapiens
atttgtatctgaaggag

SEQ ID NO: 4196237 - DNA, 13 bp, Homo sapiens
atttgtgtaatag

SEQ ID NO: 4196238 - DNA, 12 bp, Homo sapiens
atttgtgttttg

SEQ ID NO: 4196239 - DNA, 23 bp, Homo sapiens
atttgttaagaaaaactacagca

SEQ ID NO: 4196240 - DNA, 19 bp, Homo sapiens
atttgttaatttagaaaac

SEQ ID NO: 4196241 - DNA, 17 bp, Homo sapiens
atttgtttaatttatac

SEQ ID NO: 4196242 - DNA, 12 bp, Homo sapiens
attttaaagaat

SEQ ID NO: 4196243 - DNA, 14 bp, Homo sapiens
attttaaataagat

SEQ ID NO: 4196244 - DNA, 23 bp, Homo sapiens
attttaaataagatggagaataa

SEQ ID NO: 4196245 - DNA, 16 bp, Homo sapiens
attttaacttaaattt

SEQ ID NO: 4196246 - DNA, 18 bp, Homo sapiens
attttaagcttgaagatt

SEQ ID NO: 4196247 - DNA, 18 bp, Homo sapiens
attttactgattaacaaa

SEQ ID NO: 4196248 - DNA, 19 bp, Homo sapiens
attttacttagctggagaa

SEQ ID NO: 4196249 - DNA, 13 bp, Homo sapiens
attttagcagaga

SEQ ID NO: 4196250 - DNA, 21 bp, Homo sapiens
attttaggcagggatttgagg

SEQ ID NO: 4196251 - DNA, 14 bp, Homo sapiens
attttattctatgt

SEQ ID NO: 4196252 - DNA, 16 bp, Homo sapiens
attttatttagttctt

SEQ ID NO: 4196253 - DNA, 13 bp, Homo sapiens
attttcatgactt

SEQ ID NO: 4196254 - DNA, 18 bp, Homo sapiens
attttctagactttctgt

SEQ ID NO: 4196255 - DNA, 15 bp, Homo sapiens
attttctgctacttt

SEQ ID NO: 4196256 - DNA, 16 bp, Homo sapiens
attttcttaatataca

SEQ ID NO: 4196257 - DNA, 14 bp, Homo sapiens
attttgaatgttta

SEQ ID NO: 4196258 - DNA, 21 bp, Homo sapiens
attttgagtatctcggacctt

SEQ ID NO: 4196259 - DNA, 21 bp, Homo sapiens
attttggagaaattatttaat

SEQ ID NO: 4196260 - DNA, 16 bp, Homo sapiens
attttgggacttctac

SEQ ID NO: 4196261 - DNA, 22 bp, Homo sapiens
attttggtttattccctccagg

SEQ ID NO: 4196262 - DNA, 12 bp, Homo sapiens
attttgtaagtt

SEQ ID NO: 4196263 - DNA, 15 bp, Homo sapiens
atttttacaataatt

SEQ ID NO: 4196264 - DNA, 21 bp, Homo sapiens
atttttataaatatgtgaaaa

SEQ ID NO: 4196265 - DNA, 12 bp, Homo sapiens
atttttcctgca

SEQ ID NO: 4196266 - DNA, 18 bp, Homo sapiens
atttttcttaatcaagaa

SEQ ID NO: 4196267 - DNA, 13 bp, Homo sapiens
atttttgatttat

SEQ ID NO: 4196268 - DNA, 23 bp, Homo sapiens
atttttgatttatgcatggaaac

SEQ ID NO: 4196269 - DNA, 13 bp, Homo sapiens
atttttgtaataa

SEQ ID NO: 4196270 - DNA, 15 bp, Homo sapiens
atttttgtaataaaa

SEQ ID NO: 4196271 - DNA, 16 bp, Homo sapiens
atttttgttgttgttg

SEQ ID NO: 4196272 - DNA, 18 bp, Homo sapiens
attttttaaaaaagctta

SEQ ID NO: 4196273 - DNA, 13 bp, Homo sapiens
attttttaaaata

SEQ ID NO: 4196274 - DNA, 17 bp, Homo sapiens
attttttaaaataattt

SEQ ID NO: 4196275 - DNA, 12 bp, Homo sapiens
attttttaataa

SEQ ID NO: 4196276 - DNA, 14 bp, Homo sapiens
attttttaataatt

SEQ ID NO: 4196277 - DNA, 12 bp, Homo sapiens
attttttattgt

SEQ ID NO: 4196278 - DNA, 20 bp, Homo sapiens
attttttccttcaaagttta

SEQ ID NO: 4196279 - DNA, 21 bp, Homo sapiens
attttttccttcaaagtttaa

SEQ ID NO: 4196280 - DNA, 18 bp, Homo sapiens
atttttttaagctgtaaa

SEQ ID NO: 4196281 - DNA, 23 bp, Homo sapiens
atttttttgtaaaggaaataatt

SEQ ID NO: 4196282 - DNA, 23 bp, Homo sapiens
caaaaaaaaaaaaaaaatccact

SEQ ID NO: 4196283 - DNA, 15 bp, Homo sapiens
caaaaacaaaacaaa

SEQ ID NO: 4196284 - DNA, 22 bp, Homo sapiens
caaaaaggctagtttattttgt

SEQ ID NO: 4196285 - DNA, 19 bp, Homo sapiens
caaaaatgaaagcatgtct

SEQ ID NO: 4196286 - DNA, 15 bp, Homo sapiens
caaaacaaaacaaca

SEQ ID NO: 4196287 - DNA, 18 bp, Homo sapiens
caaaacaaaacaacaaca

SEQ ID NO: 4196288 - DNA, 11 bp, Homo sapiens
caaaacaacaa

SEQ ID NO: 4196289 - DNA, 12 bp, Homo sapiens
caaaacaacaac

SEQ ID NO: 4196290 - DNA, 15 bp, Homo sapiens
caaaacaacaacaat

SEQ ID NO: 4196291 - DNA, 18 bp, Homo sapiens
caaaacacttaggaagaa

SEQ ID NO: 4196292 - DNA, 15 bp, Homo sapiens
caaaacgatgaagtt

SEQ ID NO: 4196293 - DNA, 21 bp, Homo sapiens
caaaagaaaaaaaaaagcacc

SEQ ID NO: 4196294 - DNA, 14 bp, Homo sapiens
caaaagaagaagtt

SEQ ID NO: 4196295 - DNA, 15 bp, Homo sapiens
caaaagaagaagttt

SEQ ID NO: 4196296 - DNA, 19 bp, Homo sapiens
caaaagaagtaaaagcaaa

SEQ ID NO: 4196297 - DNA, 15 bp, Homo sapiens
caaaaggctgagaag

SEQ ID NO: 4196298 - DNA, 20 bp, Homo sapiens
caaaataaagaatagcaatt

SEQ ID NO: 4196299 - DNA, 22 bp, Homo sapiens
caaaataccagagccttcaagt

SEQ ID NO: 4196300 - DNA, 18 bp, Homo sapiens
caaaatggaaatgtaata

SEQ ID NO: 4196301 - DNA, 22 bp, Homo sapiens
caaaatggaaatgtaataataa

SEQ ID NO: 4196302 - DNA, 14 bp, Homo sapiens
caaacaagcacaga

SEQ ID NO: 4196303 - DNA, 16 bp, Homo sapiens
caaacaccaacataaa

SEQ ID NO: 4196304 - DNA, 18 bp, Homo sapiens
caaacaccaacataaaaa

SEQ ID NO: 4196305 - DNA, 14 bp, Homo sapiens
caaacagagtatgt

SEQ ID NO: 4196306 - DNA, 17 bp, Homo sapiens
caaaccatttcaaatgg

SEQ ID NO: 4196307 - DNA, 13 bp, Homo sapiens
caaacctcagagg

SEQ ID NO: 4196308 - DNA, 15 bp, Homo sapiens
caaacctcagaggga

SEQ ID NO: 4196309 - DNA, 13 bp, Homo sapiens
caaacctggttca

SEQ ID NO: 4196310 - DNA, 20 bp, Homo sapiens
caaactaggaggaaaagaca

SEQ ID NO: 4196311 - DNA, 22 bp, Homo sapiens
caaactaggaggaaaagacaga

SEQ ID NO: 4196312 - DNA, 16 bp, Homo sapiens
caaactctgccagcca

SEQ ID NO: 4196313 - DNA, 18 bp, Homo sapiens
caaactgcggtatacatt

SEQ ID NO: 4196314 - DNA, 21 bp, Homo sapiens
caaactgcggtatacatttta

SEQ ID NO: 4196315 - DNA, 14 bp, Homo sapiens
caaactgtgccctg

SEQ ID NO: 4196316 - DNA, 17 bp, Homo sapiens
caaactgtgccctgcct

SEQ ID NO: 4196317 - DNA, 15 bp, Homo sapiens
caaactgttggaagt

SEQ ID NO: 4196318 - DNA, 19 bp, Homo sapiens
caaactgttggaagttcac

SEQ ID NO: 4196319 - DNA, 18 bp, Homo sapiens
caaacttgtgctgagaat

SEQ ID NO: 4196320 - DNA, 16 bp, Homo sapiens
caaagaacaagaaatt

SEQ ID NO: 4196321 - DNA, 13 bp, Homo sapiens
caaagaaggaaat

SEQ ID NO: 4196322 - DNA, 17 bp, Homo sapiens
caaagacacaggaagaa

SEQ ID NO: 4196323 - DNA, 18 bp, Homo sapiens
caaagagcctggagaagc

SEQ ID NO: 4196324 - DNA, 18 bp, Homo sapiens
caaagagggagttggctg

SEQ ID NO: 4196325 - DNA, 20 bp, Homo sapiens
caaagagtgggctgcatctg

SEQ ID NO: 4196326 - DNA, 17 bp, Homo sapiens
caaagagttcaagaaat

SEQ ID NO: 4196327 - DNA, 19 bp, Homo sapiens
caaagataatgttatacat

SEQ ID NO: 4196328 - DNA, 18 bp, Homo sapiens
caaagcaaaagaagtaaa

SEQ ID NO: 4196329 - DNA, 21 bp, Homo sapiens
caaagcaccagcttctccagg

SEQ ID NO: 4196330 - DNA, 14 bp, Homo sapiens
caaagcctcctttt

SEQ ID NO: 4196331 - DNA, 13 bp, Homo sapiens
caaaggaaaccaa

SEQ ID NO: 4196332 - DNA, 14 bp, Homo sapiens
caaaggaaaccaaa

SEQ ID NO: 4196333 - DNA, 20 bp, Homo sapiens
caaagggacacacagtgaca

SEQ ID NO: 4196334 - DNA, 23 bp, Homo sapiens
caaagggacacacagtgacaaaa

SEQ ID NO: 4196335 - DNA, 14 bp, Homo sapiens
caaagggctgaaag

SEQ ID NO: 4196336 - DNA, 17 bp, Homo sapiens
caaagggctgaaagcca

SEQ ID NO: 4196337 - DNA, 13 bp, Homo sapiens
caaagtctaaagt

SEQ ID NO: 4196338 - DNA, 16 bp, Homo sapiens
caaagtctaaagttta

SEQ ID NO: 4196339 - DNA, 22 bp, Homo sapiens
caaagtgccactcattcctgta

SEQ ID NO: 4196340 - DNA, 20 bp, Homo sapiens
caaagtggggggtggacaca

SEQ ID NO: 4196341 - DNA, 13 bp, Homo sapiens
caaagtttaataa

SEQ ID NO: 4196342 - DNA, 20 bp, Homo sapiens
caaagtttaataaatttatt

SEQ ID NO: 4196343 - DNA, 16 bp, Homo sapiens
caaataaaacctcagg

SEQ ID NO: 4196344 - DNA, 17 bp, Homo sapiens
caaataaactctaaaca

SEQ ID NO: 4196345 - DNA, 19 bp, Homo sapiens
caaatacattcataaggaa

SEQ ID NO: 4196346 - DNA, 19 bp, Homo sapiens
caaatattgttaccatgaa

SEQ ID NO: 4196347 - DNA, 16 bp, Homo sapiens
caaatccatccagaat

SEQ ID NO: 4196348 - DNA, 21 bp, Homo sapiens
caaatccttagatctggcatg

SEQ ID NO: 4196349 - DNA, 17 bp, Homo sapiens
gtctccgcacttggaaa

SEQ ID NO: 4196350 - DNA, 16 bp, Homo sapiens
gtctctagccactttg

SEQ ID NO: 4196351 - DNA, 20 bp, Homo sapiens
gtctctagccgggccatgct

SEQ ID NO: 4196352 - DNA, 13 bp, Homo sapiens
gtctctgcatctc

SEQ ID NO: 4196353 - DNA, 22 bp, Homo sapiens
gtctgagcaccccctcattccc

SEQ ID NO: 4196354 - DNA, 13 bp, Homo sapiens
gtctgcacccagg

SEQ ID NO: 4196355 - DNA, 13 bp, Homo sapiens
gtctgccccaccc

SEQ ID NO: 4196356 - DNA, 14 bp, Homo sapiens
gtctgccccaccct

SEQ ID NO: 4196357 - DNA, 21 bp, Homo sapiens
gtctgccttaggctgctggga

SEQ ID NO: 4196358 - DNA, 15 bp, Homo sapiens
gtctgctatattttc

SEQ ID NO: 4196359 - DNA, 23 bp, Homo sapiens
gtctggaagaagaggaggaagac

SEQ ID NO: 4196360 - DNA, 16 bp, Homo sapiens
gtctgggagagcctgg

SEQ ID NO: 4196361 - DNA, 18 bp, Homo sapiens
gtctgggagagcctggca

SEQ ID NO: 4196362 - DNA, 19 bp, Homo sapiens
gtctgggagagcctggcaa

SEQ ID NO: 4196363 - DNA, 15 bp, Homo sapiens
tccaccccctccagc

SEQ ID NO: 4196364 - DNA, 16 bp, Homo sapiens
tccaccccctccagct

SEQ ID NO: 4196365 - DNA, 15 bp, Homo sapiens
tccacctccacccac

SEQ ID NO: 4196366 - DNA, 13 bp, Homo sapiens
tccacctgcctat

SEQ ID NO: 4196367 - DNA, 22 bp, Homo sapiens
tccacctgcctatccatcctgc

SEQ ID NO: 4196368 - DNA, 16 bp, Homo sapiens
tccactcatataaaag

SEQ ID NO: 4196369 - DNA, 13 bp, Homo sapiens
tccactgaggatg

SEQ ID NO: 4196370 - DNA, 20 bp, Homo sapiens
tccactgaggatgtgagcct

SEQ ID NO: 4196371 - DNA, 10 bp, Homo sapiens
tccactggac

SEQ ID NO: 4196372 - DNA, 16 bp, Homo sapiens
tccactggacttgagc

SEQ ID NO: 4196373 - DNA, 23 bp, Homo sapiens
tccacttccatgttgtcttataa

SEQ ID NO: 4196374 - DNA, 14 bp, Homo sapiens
tccagaagtggggc

SEQ ID NO: 4196375 - DNA, 22 bp, Homo sapiens
tccagagagaggatgcagaggg

SEQ ID NO: 4196376 - DNA, 17 bp, Homo sapiens
tccagagcactgctcca

SEQ ID NO: 4196377 - DNA, 15 bp, Homo sapiens
tccagatgccttcct

SEQ ID NO: 4196378 - DNA, 19 bp, Homo sapiens
tccagatgccttcctgtct

SEQ ID NO: 4196379 - DNA, 21 bp, Homo sapiens
tccagatgccttcctgtcttt

SEQ ID NO: 4196380 - DNA, 19 bp, Homo sapiens
tccagcacaactcagtctg

SEQ ID NO: 4196381 - DNA, 21 bp, Homo sapiens
tccagcaggtaggggcacagt

SEQ ID NO: 4196382 - DNA, 19 bp, Homo sapiens
tccagcccttcagacgaga

SEQ ID NO: 4196383 - DNA, 12 bp, Homo sapiens
tccagcctgggc

SEQ ID NO: 4196384 - DNA, 20 bp, Homo sapiens
tccagcctgggcgacagagc

SEQ ID NO: 4196385 - DNA, 18 bp, Homo sapiens
tccaggcaaagctggaga

SEQ ID NO: 4196386 - DNA, 11 bp, Homo sapiens
tccaggcagga

SEQ ID NO: 4196387 - DNA, 22 bp, Homo sapiens
tccaggcaggaggatcacttgg

SEQ ID NO: 4196388 - DNA, 14 bp, Homo sapiens
tccaggcatgctgg

SEQ ID NO: 4196389 - DNA, 16 bp, Homo sapiens
tccaggcatgctggcc

SEQ ID NO: 4196390 - DNA, 18 bp, Homo sapiens
tccaggcatgctggcctc

SEQ ID NO: 4196391 - DNA, 17 bp, Homo sapiens
tccaggccagtgggcct

SEQ ID NO: 4196392 - DNA, 21 bp, Homo sapiens
tccaggccagtgggcctggta

SEQ ID NO: 4196393 - DNA, 15 bp, Homo sapiens
tccaggctgtgtttg

SEQ ID NO: 4196394 - DNA, 13 bp, Homo sapiens
tccagggctgccc

SEQ ID NO: 4196395 - DNA, 21 bp, Homo sapiens
tccagggtctaaagagaacaa

SEQ ID NO: 4196396 - DNA, 18 bp, Homo sapiens
tccagggttgatcacact

SEQ ID NO: 4196397 - DNA, 15 bp, Homo sapiens
tccaggtatctccag

SEQ ID NO: 4196398 - DNA, 16 bp, Homo sapiens
tccaggtatctccagg

SEQ ID NO: 4196399 - DNA, 18 bp, Homo sapiens
tccaggtatctccaggat

SEQ ID NO: 4196400 - DNA, 17 bp, Homo sapiens
tccaggtcaccagcctg

SEQ ID NO: 4196401 - DNA, 19 bp, Homo sapiens
tccaggtcaccagcctgac

SEQ ID NO: 4196402 - DNA, 23 bp, Homo sapiens
tccaggtcaccagcctgactgca

SEQ ID NO: 4196403 - DNA, 17 bp, Homo sapiens
tccaggtttgctgtgtc

SEQ ID NO: 4196404 - DNA, 15 bp, Homo sapiens
tccagtgctggattt

SEQ ID NO: 4196405 - DNA, 16 bp, Homo sapiens
tccagtgctggatttg

SEQ ID NO: 4196406 - DNA, 19 bp, Homo sapiens
tccagtgctggatttgatg

SEQ ID NO: 4196407 - DNA, 12 bp, Homo sapiens
tccagtggtgaa

SEQ ID NO: 4196408 - DNA, 23 bp, Homo sapiens
tccagttggagttttttgtacca

SEQ ID NO: 4196409 - DNA, 20 bp, Homo sapiens
tccagttgttactgaagtta

SEQ ID NO: 4196410 - DNA, 12 bp, Homo sapiens
tccagtttccca

SEQ ID NO: 4196411 - DNA, 20 bp, Homo sapiens
tccagtttctagagggcact

SEQ ID NO: 4196412 - DNA, 21 bp, Homo sapiens
tccataaagcaagctcaacct

SEQ ID NO: 4196413 - DNA, 22 bp, Homo sapiens
tccatccccaaactgtgccctg

SEQ ID NO: 4196414 - DNA, 23 bp, Homo sapiens
tccatccccaaactgtgccctgc

SEQ ID NO: 4196415 - DNA, 23 bp, Homo sapiens
tccatctagagattttcttggca

SEQ ID NO: 4196416 - DNA, 22 bp, Homo sapiens
tccatgatactttaatttttat

SEQ ID NO: 4196417 - DNA, 20 bp, Homo sapiens
tccatgcctgtagctttcct

SEQ ID NO: 4196418 - DNA, 22 bp, Homo sapiens
tccatgtgcttccctaggctga

SEQ ID NO: 4196419 - DNA, 19 bp, Homo sapiens
tccatgttaaaatagacaa

SEQ ID NO: 4196420 - DNA, 19 bp, Homo sapiens
tccatgttagtttttactt

SEQ ID NO: 4196421 - DNA, 13 bp, Homo sapiens
tccatgtttgtaa

SEQ ID NO: 4196422 - DNA, 14 bp, Homo sapiens
tccattataaacaa

SEQ ID NO: 4196423 - DNA, 20 bp, Homo sapiens
tccattggcttcctcactcc

SEQ ID NO: 4196424 - DNA, 22 bp, Homo sapiens
tccattttcctaaccacaagat

SEQ ID NO: 4196425 - DNA, 20 bp, Homo sapiens
tcccaaaatgttgaaatatg

SEQ ID NO: 4196426 - DNA, 23 bp, Homo sapiens
tcccaacacttttgggaggtcca

SEQ ID NO: 4196427 - DNA, 17 bp, Homo sapiens
tcccaactgctctgccc

SEQ ID NO: 4196428 - DNA, 16 bp, Homo sapiens
tcccaagtagaatctc

SEQ ID NO: 4196429 - DNA, 17 bp, Homo sapiens
tcccaagtagaatctca

SEQ ID NO: 4196430 - DNA, 17 bp, Homo sapiens
tcccaagtgccagtctt

SEQ ID NO: 4196431 - DNA, 12 bp, Homo sapiens
tcccaataaagc

SEQ ID NO: 4196432 - DNA, 11 bp, Homo sapiens
tcccacccacc

SEQ ID NO: 4196433 - DNA, 22 bp, Homo sapiens
tcccacgactgttgtacaagct

SEQ ID NO: 4196434 - DNA, 20 bp, Homo sapiens
tcccactaagctttctcctt

SEQ ID NO: 4196435 - DNA, 19 bp, Homo sapiens
tcccactgcccctgcacct

SEQ ID NO: 4196436 - DNA, 15 bp, Homo sapiens
tcccagaggccagga

SEQ ID NO: 4196437 - DNA, 23 bp, Homo sapiens
tcccagcactttgggaggccaag

SEQ ID NO: 4196438 - DNA, 10 bp, Homo sapiens
tcccagcctg

SEQ ID NO: 4196439 - DNA, 14 bp, Homo sapiens
tcccagcgtgtgta

SEQ ID NO: 4196440 - DNA, 17 bp, Homo sapiens
tcccagcgtgtgtatcc

SEQ ID NO: 4196441 - DNA, 18 bp, Homo sapiens
tcccagcgtgtgtatccg

SEQ ID NO: 4196442 - DNA, 20 bp, Homo sapiens
tcccagcgtgtgtatccgac

SEQ ID NO: 4196443 - DNA, 16 bp, Homo sapiens
tcccagctacccagga

SEQ ID NO: 4196444 - DNA, 20 bp, Homo sapiens
tcccagctacccaggaggct

SEQ ID NO: 4196445 - DNA, 18 bp, Homo sapiens
tcccagcttgctgagggg

SEQ ID NO: 4196446 - DNA, 16 bp, Homo sapiens
tcccagggccagggcc

SEQ ID NO: 4196447 - DNA, 21 bp, Homo sapiens
tcccagggccagggccctgca

SEQ ID NO: 4196448 - DNA, 11 bp, Homo sapiens
tcccagtgtgt

SEQ ID NO: 4196449 - DNA, 20 bp, Homo sapiens
tcccatctgaaccactttgc

SEQ ID NO: 4196450 - DNA, 17 bp, Homo sapiens
tcccatgatccagaact

SEQ ID NO: 4196451 - DNA, 13 bp, Homo sapiens
tcccatggccttc

SEQ ID NO: 4196452 - DNA, 15 bp, Homo sapiens
tcccatggccttccc

SEQ ID NO: 4196453 - DNA, 17 bp, Homo sapiens
taggtcacttgaagcca

SEQ ID NO: 4196454 - DNA, 20 bp, Homo sapiens
taggtcatgatttctgtgaa

SEQ ID NO: 4196455 - DNA, 14 bp, Homo sapiens
taggtcctggcttc

SEQ ID NO: 4196456 - DNA, 15 bp, Homo sapiens
taggtcctggcttct

SEQ ID NO: 4196457 - DNA, 17 bp, Homo sapiens
taggtgaaagtgtaata

SEQ ID NO: 4196458 - DNA, 12 bp, Homo sapiens
taggtgcaaaaa

SEQ ID NO: 4196459 - DNA, 23 bp, Homo sapiens
taggtgcaaaaataaaaggaaaa

SEQ ID NO: 4196460 - DNA, 17 bp, Homo sapiens
tagtaatctgcattatt

SEQ ID NO: 4196461 - DNA, 13 bp, Homo sapiens
tagtaattgtaag

SEQ ID NO: 4196462 - DNA, 14 bp, Homo sapiens
tagtacggctgctg

SEQ ID NO: 4196463 - DNA, 15 bp, Homo sapiens
tagtacggctgctgc

SEQ ID NO: 4196464 - DNA, 16 bp, Homo sapiens
tagtacggctgctgca

SEQ ID NO: 4196465 - DNA, 16 bp, Homo sapiens
tagtagccctttctgt

SEQ ID NO: 4196466 - DNA, 19 bp, Homo sapiens
tagtagccctttctgtgtg

SEQ ID NO: 4196467 - DNA, 17 bp, Homo sapiens
tagtaggattaatttat

SEQ ID NO: 4196468 - DNA, 16 bp, Homo sapiens
tagtaggcatttttac

SEQ ID NO: 4196469 - DNA, 16 bp, Homo sapiens
tagtatctctggcctc

SEQ ID NO: 4196470 - DNA, 15 bp, Homo sapiens
tagtatcttttaaaa

SEQ ID NO: 4196471 - DNA, 21 bp, Homo sapiens
tagtatgatttttacaataat

SEQ ID NO: 4196472 - DNA, 15 bp, Homo sapiens
tagtcaatcaagtct

SEQ ID NO: 4196473 - DNA, 21 bp, Homo sapiens
tagtcatagaaatacctcatt

SEQ ID NO: 4196474 - DNA, 21 bp, Homo sapiens
tagtcttgctttgctgtctgg

SEQ ID NO: 4196475 - DNA, 14 bp, Homo sapiens
tagtgaacttgaaa

SEQ ID NO: 4196476 - DNA, 16 bp, Homo sapiens
tagtgatttcctgtat

SEQ ID NO: 4196477 - DNA, 16 bp, Homo sapiens
tagtgcacacttgtat

SEQ ID NO: 4196478 - DNA, 13 bp, Homo sapiens
tagtgccacccac

SEQ ID NO: 4196479 - DNA, 16 bp, Homo sapiens
tagtgccacccacctt

SEQ ID NO: 4196480 - DNA, 13 bp, Homo sapiens
tagtgtaaaataa

SEQ ID NO: 4196481 - DNA, 22 bp, Homo sapiens
tagtgtaaaataagaatgattt

SEQ ID NO: 4196482 - DNA, 21 bp, Homo sapiens
tagttaagtatttacagatgt

SEQ ID NO: 4196483 - DNA, 17 bp, Homo sapiens
tagttatattttctatt

SEQ ID NO: 4196484 - DNA, 18 bp, Homo sapiens
tagttatttacttgaaag

SEQ ID NO: 4196485 - DNA, 17 bp, Homo sapiens
tagttcatgtctgctat

SEQ ID NO: 4196486 - DNA, 17 bp, Homo sapiens
tagttggtgaacagaga

SEQ ID NO: 4196487 - DNA, 17 bp, Homo sapiens
tagttgtgggtgggaga

SEQ ID NO: 4196488 - DNA, 15 bp, Homo sapiens
tagtttaatacccca

SEQ ID NO: 4196489 - DNA, 21 bp, Homo sapiens
tagtttaatactcagaggggg

SEQ ID NO: 4196490 - DNA, 23 bp, Homo sapiens
tagtttaattaactatgtgatgt

SEQ ID NO: 4196491 - DNA, 20 bp, Homo sapiens
tagtttcatataaagtatca

SEQ ID NO: 4196492 - DNA, 14 bp, Homo sapiens
tagtttgttttaca

SEQ ID NO: 4196493 - DNA, 14 bp, Homo sapiens
tataaaaatacaac

SEQ ID NO: 4196494 - DNA, 21 bp, Homo sapiens
tataaaatcaaagaaaacata

SEQ ID NO: 4196495 - DNA, 19 bp, Homo sapiens
tataaactatcagtttgtc

SEQ ID NO: 4196496 - DNA, 21 bp, Homo sapiens
tataaactttagagtagcatg

SEQ ID NO: 4196497 - DNA, 19 bp, Homo sapiens
tataaatatgtgaaaatga

SEQ ID NO: 4196498 - DNA, 19 bp, Homo sapiens
tataacaaggttcttctaa

SEQ ID NO: 4196499 - DNA, 22 bp, Homo sapiens
tataacaaggttcttctaaaat

SEQ ID NO: 4196500 - DNA, 15 bp, Homo sapiens
tataagtagaaactt

SEQ ID NO: 4196501 - DNA, 20 bp, Homo sapiens
tataataaaggtcacataaa

SEQ ID NO: 4196502 - DNA, 16 bp, Homo sapiens
tatactatacaacaat

SEQ ID NO: 4196503 - DNA, 17 bp, Homo sapiens
tatactatacaacaatg

SEQ ID NO: 4196504 - DNA, 21 bp, Homo sapiens
tatactattaaaaaggtttac

SEQ ID NO: 4196505 - DNA, 23 bp, Homo sapiens
tatactgcttggagctgagcaaa

SEQ ID NO: 4196506 - DNA, 21 bp, Homo sapiens
tatagagatatgcagaaggaa

SEQ ID NO: 4196507 - DNA, 13 bp, Homo sapiens
tatagctctcatc

SEQ ID NO: 4196508 - DNA, 19 bp, Homo sapiens
tataggatttatttaaaat

SEQ ID NO: 4196509 - DNA, 14 bp, Homo sapiens
tataggctggagaa

SEQ ID NO: 4196510 - DNA, 13 bp, Homo sapiens
tataggtgaagga

SEQ ID NO: 4196511 - DNA, 15 bp, Homo sapiens
tataggttgtgcaaa

SEQ ID NO: 4196512 - DNA, 21 bp, Homo sapiens
tatagtgtaaaataagaatga

SEQ ID NO: 4196513 - DNA, 17 bp, Homo sapiens
tatagttaggatagcat

SEQ ID NO: 4196514 - DNA, 18 bp, Homo sapiens
tatagttaggatagcatt

SEQ ID NO: 4196515 - DNA, 19 bp, Homo sapiens
tatagttaggatagcattt

SEQ ID NO: 4196516 - DNA, 21 bp, Homo sapiens
tatagttcatgtctgctatca

SEQ ID NO: 4196517 - DNA, 14 bp, Homo sapiens
tatatagatgtgca

SEQ ID NO: 4196518 - DNA, 18 bp, Homo sapiens
tatatattgattatatat

SEQ ID NO: 4196519 - DNA, 20 bp, Homo sapiens
tatatatttgaatatcatta

SEQ ID NO: 4196520 - DNA, 18 bp, Homo sapiens
tatatcagaaaagggaag

SEQ ID NO: 4196521 - DNA, 16 bp, Homo sapiens
tatatctgcttcagtg

SEQ ID NO: 4196522 - DNA, 16 bp, Homo sapiens
tatatcttatgttaaa

SEQ ID NO: 4196523 - DNA, 14 bp, Homo sapiens
tatatctttttcca

SEQ ID NO: 4196524 - DNA, 21 bp, Homo sapiens
tatatgattgtataatgtgat

SEQ ID NO: 4196525 - DNA, 16 bp, Homo sapiens
tatatgatttatagtt

SEQ ID NO: 4196526 - DNA, 14 bp, Homo sapiens
tatatgcatttgcc

SEQ ID NO: 4196527 - DNA, 15 bp, Homo sapiens
tatatgcatttgcct

SEQ ID NO: 4196528 - DNA, 22 bp, Homo sapiens
tatatggaagataattttatgt

SEQ ID NO: 4196529 - DNA, 18 bp, Homo sapiens
tatatttactaaaagaat

SEQ ID NO: 4196530 - DNA, 18 bp, Homo sapiens
tatatttagttatagttt

SEQ ID NO: 4196531 - DNA, 14 bp, Homo sapiens
tatatttatgataa

SEQ ID NO: 4196532 - DNA, 18 bp, Homo sapiens
tatatttatgataactat

SEQ ID NO: 4196533 - DNA, 22 bp, Homo sapiens
tatatttctttttagattgtct

SEQ ID NO: 4196534 - DNA, 14 bp, Homo sapiens
tatatttgaaattt

SEQ ID NO: 4196535 - DNA, 13 bp, Homo sapiens
tatatttttatat

SEQ ID NO: 4196536 - DNA, 18 bp, Homo sapiens
tatatttttatatttagt

SEQ ID NO: 4196537 - DNA, 15 bp, Homo sapiens
tatatttttcacagt

SEQ ID NO: 4196538 - DNA, 19 bp, Homo sapiens
tatcaacttcctaaatatt

SEQ ID NO: 4196539 - DNA, 16 bp, Homo sapiens
tatcaaggaaaactgt

SEQ ID NO: 4196540 - DNA, 17 bp, Homo sapiens
tatcaatccttgttcag

SEQ ID NO: 4196541 - DNA, 15 bp, Homo sapiens
tatcaccatgattta

SEQ ID NO: 4196542 - DNA, 16 bp, Homo sapiens
tatcaccatgatttaa

SEQ ID NO: 4196543 - DNA, 15 bp, Homo sapiens
tatcatattggtatt

SEQ ID NO: 4196544 - DNA, 21 bp, Homo sapiens
tatcccccccctgtatagtta

SEQ ID NO: 4196545 - DNA, 17 bp, Homo sapiens
tatccgactctaagctg

SEQ ID NO: 4196546 - DNA, 16 bp, Homo sapiens
tatcctaaacatcatt

SEQ ID NO: 4196547 - DNA, 16 bp, Homo sapiens
tatcctataggcagac

SEQ ID NO: 4196548 - DNA, 18 bp, Homo sapiens
tatccttggagagcagct

SEQ ID NO: 4196549 - DNA, 14 bp, Homo sapiens
tatcctttggaaca

SEQ ID NO: 4196550 - DNA, 22 bp, Homo sapiens
tatcctttgtggcaccttttct

SEQ ID NO: 4196551 - DNA, 14 bp, Homo sapiens
tatctaactcttct

SEQ ID NO: 4196552 - DNA, 23 bp, Homo sapiens
tatctccaggattgaagagcatt

SEQ ID NO: 4196553 - DNA, 17 bp, Homo sapiens
tatctctaggctgtttt

SEQ ID NO: 4196554 - DNA, 12 bp, Homo sapiens
tatctctggcct

SEQ ID NO: 4196555 - DNA, 21 bp, Homo sapiens
tatctgagctcttatctatga

SEQ ID NO: 4196556 - DNA, 16 bp, Homo sapiens
tatctgcagaatgggc

SEQ ID NO: 4196557 - DNA, 12 bp, Homo sapiens
tatcttctggat

SEQ ID NO: 4196558 - DNA, 19 bp, Homo sapiens
tatcttttccacaaatatg

SEQ ID NO: 4196559 - DNA, 14 bp, Homo sapiens
tatgaaaaagaaga

SEQ ID NO: 4196560 - DNA, 18 bp, Homo sapiens
tatgaacttgaggacaca

SEQ ID NO: 4196561 - DNA, 22 bp, Homo sapiens
tatgaacttgaggacacatgtc

SEQ ID NO: 4196562 - DNA, 23 bp, Homo sapiens
tatgaacttgaggacacatgtcc

SEQ ID NO: 4196563 - DNA, 19 bp, Homo sapiens
tatgaagttgaaaaataaa

SEQ ID NO: 4196564 - DNA, 14 bp, Homo sapiens
tatgacctatgtct

SEQ ID NO: 4196565 - DNA, 14 bp, Homo sapiens
tatgactcaggagc

SEQ ID NO: 4196566 - DNA, 15 bp, Homo sapiens
tatgactcaggagcc

SEQ ID NO: 4196567 - DNA, 13 bp, Homo sapiens
tatgagctgaggg

SEQ ID NO: 4196568 - DNA, 16 bp, Homo sapiens
tatgagctgagggggg

SEQ ID NO: 4196569 - DNA, 12 bp, Homo sapiens
tatgataactat

SEQ ID NO: 4196570 - DNA, 18 bp, Homo sapiens
tatgatgttaaaaaaata

SEQ ID NO: 4196571 - DNA, 15 bp, Homo sapiens
tatgatttatagttt

SEQ ID NO: 4196572 - DNA, 13 bp, Homo sapiens
tatgcaagcacaa

SEQ ID NO: 4196573 - DNA, 14 bp, Homo sapiens
tattacctcaaatt

SEQ ID NO: 4196574 - DNA, 13 bp, Homo sapiens
tattactgtaata

SEQ ID NO: 4196575 - DNA, 23 bp, Homo sapiens
tattactgtctggttttaacaat

SEQ ID NO: 4196576 - DNA, 17 bp, Homo sapiens
tattactgtttttgcta

SEQ ID NO: 4196577 - DNA, 15 bp, Homo sapiens
tattataaaaccatg

SEQ ID NO: 4196578 - DNA, 11 bp, Homo sapiens
tattcaataaa

SEQ ID NO: 4196579 - DNA, 12 bp, Homo sapiens
tattcaataaag

SEQ ID NO: 4196580 - DNA, 14 bp, Homo sapiens
tattcaataaagct

SEQ ID NO: 4196581 - DNA, 13 bp, Homo sapiens
tattcagacagat

SEQ ID NO: 4196582 - DNA, 18 bp, Homo sapiens
tattcagtgctgtggcct

SEQ ID NO: 4196583 - DNA, 22 bp, Homo sapiens
tattcccaactgctctgcccac

SEQ ID NO: 4196584 - DNA, 23 bp, Homo sapiens
tattcccaagctctagtgggaag

SEQ ID NO: 4196585 - DNA, 14 bp, Homo sapiens
tattcctattgtgc

SEQ ID NO: 4196586 - DNA, 12 bp, Homo sapiens
tattcctgagaa

SEQ ID NO: 4196587 - DNA, 16 bp, Homo sapiens
tattctcctccctgtt

SEQ ID NO: 4196588 - DNA, 21 bp, Homo sapiens
tattctcttaatttttcttaa

SEQ ID NO: 4196589 - DNA, 17 bp, Homo sapiens
tattgaataagtattct

SEQ ID NO: 4196590 - DNA, 14 bp, Homo sapiens
tattgacttctctt

SEQ ID NO: 4196591 - DNA, 17 bp, Homo sapiens
tattgacttctcttgaa

SEQ ID NO: 4196592 - DNA, 23 bp, Homo sapiens
tattggaagataaacttgtcaaa

SEQ ID NO: 4196593 - DNA, 15 bp, Homo sapiens
tattggaccagaagt

SEQ ID NO: 4196594 - DNA, 15 bp, Homo sapiens
tattgggacacacat

SEQ ID NO: 4196595 - DNA, 20 bp, Homo sapiens
tattggggtcttttggctct

SEQ ID NO: 4196596 - DNA, 20 bp, Homo sapiens
tattgtctgtctacatttct

SEQ ID NO: 4196597 - DNA, 19 bp, Homo sapiens
tattgtgcaatgtaaatat

SEQ ID NO: 4196598 - DNA, 16 bp, Homo sapiens
tattgttttatgttct

SEQ ID NO: 4196599 - DNA, 21 bp, Homo sapiens
tatttaaaaaactaaaaacta

SEQ ID NO: 4196600 - DNA, 16 bp, Homo sapiens
tatttaactctcttta

SEQ ID NO: 4196601 - DNA, 23 bp, Homo sapiens
tatttaactctctttatgtctgt

SEQ ID NO: 4196602 - DNA, 13 bp, Homo sapiens
tatttaatagcaa

SEQ ID NO: 4196603 - DNA, 18 bp, Homo sapiens
tatttaatagcaaagaat

SEQ ID NO: 4196604 - DNA, 17 bp, Homo sapiens
tatttaattttcctgga

SEQ ID NO: 4196605 - DNA, 18 bp, Homo sapiens
tatttatagcaatccatg

SEQ ID NO: 4196606 - DNA, 15 bp, Homo sapiens
tatttatatatttga

SEQ ID NO: 4196607 - DNA, 21 bp, Homo sapiens
tatttatatgttaatttgtta

SEQ ID NO: 4196608 - DNA, 13 bp, Homo sapiens
tatttatatttgg

SEQ ID NO: 4196609 - DNA, 15 bp, Homo sapiens
tatttatatttggaa

SEQ ID NO: 4196610 - DNA, 21 bp, Homo sapiens
tatttatgataactatttaca

SEQ ID NO: 4196611 - DNA, 17 bp, Homo sapiens
tatttcaaaataaactg

SEQ ID NO: 4196612 - DNA, 11 bp, Homo sapiens
tatttcaaatg

SEQ ID NO: 4196613 - DNA, 11 bp, Homo sapiens
tatttcaagtg

SEQ ID NO: 4196614 - DNA, 12 bp, Homo sapiens
tatttcaagtgc

SEQ ID NO: 4196615 - DNA, 14 bp, Homo sapiens
tatttcaagtgcct

SEQ ID NO: 4196616 - DNA, 11 bp, Homo sapiens
tatttcctgct

SEQ ID NO: 4196617 - DNA, 19 bp, Homo sapiens
tatttgtacagttcagttc

SEQ ID NO: 4196618 - DNA, 13 bp, Homo sapiens
tatttgtgtaata

SEQ ID NO: 4196619 - DNA, 14 bp, Homo sapiens
tatttgtgtaatag

SEQ ID NO: 4196620 - DNA, 17 bp, Homo sapiens
tatttgtgtaatagaaa

SEQ ID NO: 4196621 - DNA, 12 bp, Homo sapiens
tattttaaacaa

SEQ ID NO: 4196622 - DNA, 14 bp, Homo sapiens
tattttaaacaaaa

SEQ ID NO: 4196623 - DNA, 14 bp, Homo sapiens
tattttaaagaatt

SEQ ID NO: 4196624 - DNA, 22 bp, Homo sapiens
tattttaggcagggatttgagg

SEQ ID NO: 4196625 - DNA, 15 bp, Homo sapiens
tattttatgtatata

SEQ ID NO: 4196626 - DNA, 21 bp, Homo sapiens
tattttcatgacttttccatg

SEQ ID NO: 4196627 - DNA, 17 bp, Homo sapiens
tattttgacataaagtt

SEQ ID NO: 4196628 - DNA, 16 bp, Homo sapiens
tattttggagaaatta

SEQ ID NO: 4196629 - DNA, 13 bp, Homo sapiens
tattttttaataa

SEQ ID NO: 4196630 - DNA, 15 bp, Homo sapiens
tattttttaataaaa

SEQ ID NO: 4196631 - DNA, 13 bp, Homo sapiens
tattttttattgt

SEQ ID NO: 4196632 - DNA, 17 bp, Homo sapiens
tattttttattgttttc

SEQ ID NO: 4196633 - DNA, 14 bp, Homo sapiens
tattttttgttgaa

SEQ ID NO: 4196634 - DNA, 19 bp, Homo sapiens
tatttttttaagctgtaaa

SEQ ID NO: 4196635 - DNA, 18 bp, Homo sapiens
tcaaaaaaaaaaaaaaca

SEQ ID NO: 4196636 - DNA, 19 bp, Homo sapiens
tcaaaaaaaaaaaaaacaa

SEQ ID NO: 4196637 - DNA, 22 bp, Homo sapiens
tcaaaaaaaaaaaaaacaacaa

SEQ ID NO: 4196638 - DNA, 13 bp, Homo sapiens
tcaaaaataaaag

SEQ ID NO: 4196639 - DNA, 15 bp, Homo sapiens
tcaaaccttaagata

SEQ ID NO: 4196640 - DNA, 20 bp, Homo sapiens
tcaaaccttaagataatgga

SEQ ID NO: 4196641 - DNA, 23 bp, Homo sapiens
tcaaactaggaggaaaagacaga

SEQ ID NO: 4196642 - DNA, 13 bp, Homo sapiens
tcaaagcaagcat

SEQ ID NO: 4196643 - DNA, 15 bp, Homo sapiens
tcaaagcaagcattc

SEQ ID NO: 4196644 - DNA, 19 bp, Homo sapiens
tcaaagcacctgaaccact

SEQ ID NO: 4196645 - DNA, 20 bp, Homo sapiens
tcaaagcacctgaaccactg

SEQ ID NO: 4196646 - DNA, 19 bp, Homo sapiens
tcaaagctgtgtgtttgga

SEQ ID NO: 4196647 - DNA, 14 bp, Homo sapiens
tcaaagtttaataa

SEQ ID NO: 4196648 - DNA, 15 bp, Homo sapiens
tcaaatagaatatgg

SEQ ID NO: 4196649 - DNA, 15 bp, Homo sapiens
tcaaatccactgaca

SEQ ID NO: 4196650 - DNA, 15 bp, Homo sapiens
tcaaatccatccaga

SEQ ID NO: 4196651 - DNA, 14 bp, Homo sapiens
tcaaatccttgagc

SEQ ID NO: 4196652 - DNA, 13 bp, Homo sapiens
tcaacaaaaagac

SEQ ID NO: 4196653 - DNA, 21 bp, Homo sapiens
tcaacaacaattttaaataag

SEQ ID NO: 4196654 - DNA, 22 bp, Homo sapiens
tcaacaacaattttaaataaga

SEQ ID NO: 4196655 - DNA, 17 bp, Homo sapiens
tcaacaattctaaaatg

SEQ ID NO: 4196656 - DNA, 14 bp, Homo sapiens
tcaacacaaagaca

SEQ ID NO: 4196657 - DNA, 15 bp, Homo sapiens
tcaacacaaagacac

SEQ ID NO: 4196658 - DNA, 20 bp, Homo sapiens
tcaacacaaagacacaggaa

SEQ ID NO: 4196659 - DNA, 23 bp, Homo sapiens
tcaacacaaagacacaggaagaa

SEQ ID NO: 4196660 - DNA, 21 bp, Homo sapiens
tcaacacaaagacatggaagg

SEQ ID NO: 4196661 - DNA, 17 bp, Homo sapiens
tcaacagtgaagacaga

SEQ ID NO: 4196662 - DNA, 22 bp, Homo sapiens
tcaacagtgaagacagaagttt

SEQ ID NO: 4196663 - DNA, 14 bp, Homo sapiens
tcaactccagaagt

SEQ ID NO: 4196664 - DNA, 15 bp, Homo sapiens
tcaacttgaagcaag

SEQ ID NO: 4196665 - DNA, 15 bp, Homo sapiens
tcaagaatattcaaa

SEQ ID NO: 4196666 - DNA, 12 bp, Homo sapiens
tcaagactgaaa

SEQ ID NO: 4196667 - DNA, 13 bp, Homo sapiens
tcaagacttgata

SEQ ID NO: 4196668 - DNA, 17 bp, Homo sapiens
tcaagatgtcagactgg

SEQ ID NO: 4196669 - DNA, 12 bp, Homo sapiens
tcaagcctgaga

SEQ ID NO: 4196670 - DNA, 15 bp, Homo sapiens
tcaagcgattcttct

SEQ ID NO: 4196671 - DNA, 18 bp, Homo sapiens
tcaagctatttctctgga

SEQ ID NO: 4196672 - DNA, 15 bp, Homo sapiens
tcaaggaatcctgag

SEQ ID NO: 4196673 - DNA, 17 bp, Homo sapiens
tcaaggaccacatgtgt

SEQ ID NO: 4196674 - DNA, 13 bp, Homo sapiens
tcaaggagatgag

SEQ ID NO: 4196675 - DNA, 20 bp, Homo sapiens
tcaaggtggccaaattattt

SEQ ID NO: 4196676 - DNA, 14 bp, Homo sapiens
tcaagtagatcatg

SEQ ID NO: 4196677 - DNA, 19 bp, Homo sapiens
tcaagtctgtttactgcaa

SEQ ID NO: 4196678 - DNA, 18 bp, Homo sapiens
tcaagtgccaaacagagt

SEQ ID NO: 4196679 - DNA, 15 bp, Homo sapiens
tcaagttagctcagg

SEQ ID NO: 4196680 - DNA, 13 bp, Homo sapiens
tcaagttattgta

SEQ ID NO: 4196681 - DNA, 15 bp, Homo sapiens
tcaatcactgctccc

SEQ ID NO: 4196682 - DNA, 16 bp, Homo sapiens
tcaatcatctgtgtga

SEQ ID NO: 4196683 - DNA, 15 bp, Homo sapiens
tcaatccttgttcag

SEQ ID NO: 4196684 - DNA, 16 bp, Homo sapiens
tcaatctatcaattac

SEQ ID NO: 4196685 - DNA, 20 bp, Homo sapiens
tcaatcttcggggtgtgatg

SEQ ID NO: 4196686 - DNA, 13 bp, Homo sapiens
tcaattcctgggc

SEQ ID NO: 4196687 - DNA, 13 bp, Homo sapiens
tctgccagccaca

SEQ ID NO: 4196688 - DNA, 18 bp, Homo sapiens
tctgcccacattggaccc

SEQ ID NO: 4196689 - DNA, 14 bp, Homo sapiens
tctgccccagaaca

SEQ ID NO: 4196690 - DNA, 15 bp, Homo sapiens
tctgccccagaggcc

SEQ ID NO: 4196691 - DNA, 18 bp, Homo sapiens
tctgccccagaggcctct

SEQ ID NO: 4196692 - DNA, 14 bp, Homo sapiens
tctgccccagctct

SEQ ID NO: 4196693 - DNA, 20 bp, Homo sapiens
tctgccccagctctggcttc

SEQ ID NO: 4196694 - DNA, 13 bp, Homo sapiens
tctgcccgcagag

SEQ ID NO: 4196695 - DNA, 22 bp, Homo sapiens
tctgccttaggctgctgggaga

SEQ ID NO: 4196696 - DNA, 17 bp, Homo sapiens
tctgcggtggtgccaga

SEQ ID NO: 4196697 - DNA, 20 bp, Homo sapiens
tctgcggtggtgccagaggt

SEQ ID NO: 4196698 - DNA, 15 bp, Homo sapiens
tctgcgtctgtgttg

SEQ ID NO: 4196699 - DNA, 22 bp, Homo sapiens
tctgcgtgactattttttaata

SEQ ID NO: 4196700 - DNA, 14 bp, Homo sapiens
tctgcttcagtgga

SEQ ID NO: 4196701 - DNA, 16 bp, Homo sapiens
tctggaagtttctggt

SEQ ID NO: 4196702 - DNA, 18 bp, Homo sapiens
tctggaagtttctggtgc

SEQ ID NO: 4196703 - DNA, 17 bp, Homo sapiens
tctggacagcagcagga

SEQ ID NO: 4196704 - DNA, 16 bp, Homo sapiens
tctggagccaaggcag

SEQ ID NO: 4196705 - DNA, 22 bp, Homo sapiens
tctggatatatttaaaaaaaga

SEQ ID NO: 4196706 - DNA, 22 bp, Homo sapiens
tctggatatggtgcaaaaatga

SEQ ID NO: 4196707 - DNA, 14 bp, Homo sapiens
tctggattccagag

SEQ ID NO: 4196708 - DNA, 22 bp, Homo sapiens
tctggattccagagcactgctc

SEQ ID NO: 4196709 - DNA, 20 bp, Homo sapiens
tctggattccccatctcagg

SEQ ID NO: 4196710 - DNA, 19 bp, Homo sapiens
tctggctccaaggtgctct

SEQ ID NO: 4196711 - DNA, 15 bp, Homo sapiens
tctggctgagctgaa

SEQ ID NO: 4196712 - DNA, 13 bp, Homo sapiens
tctggctgtgtgg

SEQ ID NO: 4196713 - DNA, 15 bp, Homo sapiens
tctggctgtgtggcc

SEQ ID NO: 4196714 - DNA, 15 bp, Homo sapiens
tctggcttagtgcca

SEQ ID NO: 4196715 - DNA, 22 bp, Homo sapiens
tctggcttagtgccacccacct

SEQ ID NO: 4196716 - DNA, 23 bp, Homo sapiens
tctggcttccagaaaaccccagc

SEQ ID NO: 4196717 - DNA, 22 bp, Homo sapiens
tctggcttccaggtatctccag

SEQ ID NO: 4196718 - DNA, 19 bp, Homo sapiens
tctggcttctggccaggaa

SEQ ID NO: 4196719 - DNA, 20 bp, Homo sapiens
tctggcttctggccaggaag

SEQ ID NO: 4196720 - DNA, 23 bp, Homo sapiens
tctggctttgtctctagccgggc

SEQ ID NO: 4196721 - DNA, 23 bp, Homo sapiens
tctggcttttcgcttgcttctgc

SEQ ID NO: 4196722 - DNA, 14 bp, Homo sapiens
tctgggagagcctg

SEQ ID NO: 4196723 - DNA, 17 bp, Homo sapiens
tctgggagagcctggca

SEQ ID NO: 4196724 - DNA, 18 bp, Homo sapiens
tctgggtaagaagaaagc

SEQ ID NO: 4196725 - DNA, 23 bp, Homo sapiens
tctggtatgaacttgaggacaca

SEQ ID NO: 4196726 - DNA, 17 bp, Homo sapiens
tctggtgccatttctga

SEQ ID NO: 4196727 - DNA, 21 bp, Homo sapiens
tctggtggccgatcggggcac

SEQ ID NO: 4196728 - DNA, 16 bp, Homo sapiens
tctggtgtagctcctc

SEQ ID NO: 4196729 - DNA, 18 bp, Homo sapiens
tctggtgtagctcctctg

SEQ ID NO: 4196730 - DNA, 19 bp, Homo sapiens
tctggtttttaaaagataa

SEQ ID NO: 4196731 - DNA, 23 bp, Homo sapiens
tctggtttttaaaagataaacag

SEQ ID NO: 4196732 - DNA, 15 bp, Homo sapiens
tctgtaaactcaaaa

SEQ ID NO: 4196733 - DNA, 18 bp, Homo sapiens
tctgtaaactcaaaactt

SEQ ID NO: 4196734 - DNA, 20 bp, Homo sapiens
tctgtaagaaacctactgcc

SEQ ID NO: 4196735 - DNA, 14 bp, Homo sapiens
tctgtaatttcact

SEQ ID NO: 4196736 - DNA, 24 bp, Homo sapiens
tctgtagtaatttattgtctgtct

SEQ ID NO: 4196737 - DNA, 15 bp, Homo sapiens
tctgtattttcatgt

SEQ ID NO: 4196738 - DNA, 14 bp, Homo sapiens
tctgtcacactaaa

SEQ ID NO: 4196739 - DNA, 17 bp, Homo sapiens
tctgtcacccaggctgg

SEQ ID NO: 4196740 - DNA, 18 bp, Homo sapiens
tctgtcagatgggaagac

SEQ ID NO: 4196741 - DNA, 13 bp, Homo sapiens
tctgtcctcagag

SEQ ID NO: 4196742 - DNA, 23 bp, Homo sapiens
tctgtctacttgctcaggtactt

SEQ ID NO: 4196743 - DNA, 18 bp, Homo sapiens
tctgtctgtctgtcccaa

SEQ ID NO: 4196744 - DNA, 20 bp, Homo sapiens
tctgtgacccatctgtagta

SEQ ID NO: 4196745 - DNA, 19 bp, Homo sapiens
tctgtgtgcaccttaccaa

SEQ ID NO: 4196746 - DNA, 19 bp, Homo sapiens
tctgtgtgtacatgtacat

SEQ ID NO: 4196747 - DNA, 15 bp, Homo sapiens
tctgttgccaggcta

SEQ ID NO: 4196748 - DNA, 12 bp, Homo sapiens
tctgttttccaa

SEQ ID NO: 4196749 - DNA, 14 bp, Homo sapiens
tctgttttgtttct

SEQ ID NO: 4196750 - DNA, 17 bp, Homo sapiens
tctgttttgtttcttga

SEQ ID NO: 4196751 - DNA, 20 bp, Homo sapiens
tcttaaagctgcctgtagtt

SEQ ID NO: 4196752 - DNA, 16 bp, Homo sapiens
tcttaaataagaaact

SEQ ID NO: 4196753 - DNA, 19 bp, Homo sapiens
tcttaaattatatatttat

SEQ ID NO: 4196754 - DNA, 23 bp, Homo sapiens
tcttaacacatgtccttgtgtgt

SEQ ID NO: 4196755 - DNA, 21 bp, Homo sapiens
tcttaagccttttgctcacaa

SEQ ID NO: 4196756 - DNA, 18 bp, Homo sapiens
tcttacccatatatctta

SEQ ID NO: 4196757 - DNA, 19 bp, Homo sapiens
tcttaccttaaaaagtaat

SEQ ID NO: 4196758 - DNA, 15 bp, Homo sapiens
tcttactctgtccac

SEQ ID NO: 4196759 - DNA, 13 bp, Homo sapiens
tgaatctgcaggg

SEQ ID NO: 4196760 - DNA, 19 bp, Homo sapiens
tgaatgcacactagcctct

SEQ ID NO: 4196761 - DNA, 15 bp, Homo sapiens
tgaatggcctgcctt

SEQ ID NO: 4196762 - DNA, 21 bp, Homo sapiens
tgaatggctatgtttttaatg

SEQ ID NO: 4196763 - DNA, 14 bp, Homo sapiens
tgaatggtccaggg

SEQ ID NO: 4196764 - DNA, 16 bp, Homo sapiens
tgaatgtgtgtatgta

SEQ ID NO: 4196765 - DNA, 15 bp, Homo sapiens
tgaatgttatttgtt

SEQ ID NO: 4196766 - DNA, 23 bp, Homo sapiens
tgaatgttatttgttattttcag

SEQ ID NO: 4196767 - DNA, 18 bp, Homo sapiens
tgaatgtttatgttctca

SEQ ID NO: 4196768 - DNA, 22 bp, Homo sapiens
tgaatgtttccaacctggagta

SEQ ID NO: 4196769 - DNA, 14 bp, Homo sapiens
tgaattaagttatt

SEQ ID NO: 4196770 - DNA, 12 bp, Homo sapiens
tgaatttctgat

SEQ ID NO: 4196771 - DNA, 20 bp, Homo sapiens
tgaatttcttcactgttgaa

SEQ ID NO: 4196772 - DNA, 15 bp, Homo sapiens
tgaattttgggactt

SEQ ID NO: 4196773 - DNA, 17 bp, Homo sapiens
tgaatttttaaacaagt

SEQ ID NO: 4196774 - DNA, 22 bp, Homo sapiens
tgacaacagaagcttcagaagt

SEQ ID NO: 4196775 - DNA, 16 bp, Homo sapiens
tgacaacatttctata

SEQ ID NO: 4196776 - DNA, 23 bp, Homo sapiens
tgacaacatttctatagccaaaa

SEQ ID NO: 4196777 - DNA, 15 bp, Homo sapiens
tgacaactggcaggc

SEQ ID NO: 4196778 - DNA, 17 bp, Homo sapiens
tgacaactggcaggcag

SEQ ID NO: 4196779 - DNA, 18 bp, Homo sapiens
tgacaactggcaggcagg

SEQ ID NO: 4196780 - DNA, 15 bp, Homo sapiens
tgacaagataaagga

SEQ ID NO: 4196781 - DNA, 20 bp, Homo sapiens
tgacaagataaaggaagtca

SEQ ID NO: 4196782 - DNA, 12 bp, Homo sapiens
tgacaagcatca

SEQ ID NO: 4196783 - DNA, 23 bp, Homo sapiens
tgacaagcatcagtagctgagtg

SEQ ID NO: 4196784 - DNA, 22 bp, Homo sapiens
tgacactctagtgacttcctgg

SEQ ID NO: 4196785 - DNA, 20 bp, Homo sapiens
tgacagtagtcccctccgta

SEQ ID NO: 4196786 - DNA, 24 bp, Homo sapiens
tgacagtgtgggaggcctcgtacc

SEQ ID NO: 4196787 - DNA, 14 bp, Homo sapiens
tgacataaagttga

SEQ ID NO: 4196788 - DNA, 15 bp, Homo sapiens
tgacatgtgcctgta

SEQ ID NO: 4196789 - DNA, 17 bp, Homo sapiens
tgaccaaattgggagat

SEQ ID NO: 4196790 - DNA, 14 bp, Homo sapiens
tgaccactggccct

SEQ ID NO: 4196791 - DNA, 17 bp, Homo sapiens
tgaccagccgtgagcat

SEQ ID NO: 4196792 - DNA, 22 bp, Homo sapiens
tgaccccaaagagcctggagaa

SEQ ID NO: 4196793 - DNA, 13 bp, Homo sapiens
tgacccctttccc

SEQ ID NO: 4196794 - DNA, 14 bp, Homo sapiens
tgaccctgagctga

SEQ ID NO: 4196795 - DNA, 20 bp, Homo sapiens
tgaccctgcgaaggggccct

SEQ ID NO: 4196796 - DNA, 21 bp, Homo sapiens
tgaccctgcgaaggggccctg

SEQ ID NO: 4196797 - DNA, 22 bp, Homo sapiens
tgaccctgcgaaggggccctgg

SEQ ID NO: 4196798 - DNA, 23 bp, Homo sapiens
tgaccctgcgaaggggccctggt

SEQ ID NO: 4196799 - DNA, 17 bp, Homo sapiens
tgacctcgtgatccacc

SEQ ID NO: 4196800 - DNA, 16 bp, Homo sapiens
tgacctgatcacctct

SEQ ID NO: 4196801 - DNA, 20 bp, Homo sapiens
tgacctgcagtcagggccca

SEQ ID NO: 4196802 - DNA, 23 bp, Homo sapiens
tgacctgcagtcagggcccagag

SEQ ID NO: 4196803 - DNA, 11 bp, Homo sapiens
tgacctgggcc

SEQ ID NO: 4196804 - DNA, 12 bp, Homo sapiens
tgacctgtcacc

SEQ ID NO: 4196805 - DNA, 15 bp, Homo sapiens
tgacgcatcctgcag

SEQ ID NO: 4196806 - DNA, 19 bp, Homo sapiens
tgacgtcaagtctccttcc

SEQ ID NO: 4196807 - DNA, 14 bp, Homo sapiens
tgactaatggcatg

SEQ ID NO: 4196808 - DNA, 15 bp, Homo sapiens
tgactaatggcatga

SEQ ID NO: 4196809 - DNA, 20 bp, Homo sapiens
tgactagggagccatgtttc

SEQ ID NO: 4196810 - DNA, 20 bp, Homo sapiens
tgactattttttaataaaag

SEQ ID NO: 4196811 - DNA, 23 bp, Homo sapiens
tgactcaaactcctcccttttat

SEQ ID NO: 4196812 - DNA, 13 bp, Homo sapiens
tgactcaggagcc

SEQ ID NO: 4196813 - DNA, 21 bp, Homo sapiens
tgactgaaaaaaaaaaagaag

SEQ ID NO: 4196814 - DNA, 22 bp, Homo sapiens
tgactgaaaaaaaaaaagaaga

SEQ ID NO: 4196815 - DNA, 23 bp, Homo sapiens
tgactgcacacagctaggcatgc

SEQ ID NO: 4196816 - DNA, 17 bp, Homo sapiens
tgactgcgatcttcaga

SEQ ID NO: 4196817 - DNA, 15 bp, Homo sapiens
tgacttgaaaaatat

SEQ ID NO: 4196818 - DNA, 18 bp, Homo sapiens
tgacttttccatgtatct

SEQ ID NO: 4196819 - DNA, 19 bp, Homo sapiens
tgagaaaatggctttaatc

SEQ ID NO: 4196820 - DNA, 13 bp, Homo sapiens
tgagaaatttaaa

SEQ ID NO: 4196821 - DNA, 15 bp, Homo sapiens
tgagaaatttaaact

SEQ ID NO: 4196822 - DNA, 15 bp, Homo sapiens
tgagaactgaatttt

SEQ ID NO: 4196823 - DNA, 13 bp, Homo sapiens
tgagaacttcaat

SEQ ID NO: 4196824 - DNA, 19 bp, Homo sapiens
tgagaatttaaaaataaga

SEQ ID NO: 4196825 - DNA, 15 bp, Homo sapiens
tgagaccacctctca

SEQ ID NO: 4196826 - DNA, 15 bp, Homo sapiens
tgagacttagataat

SEQ ID NO: 4196827 - DNA, 16 bp, Homo sapiens
tgagagctgctctgga

SEQ ID NO: 4196828 - DNA, 20 bp, Homo sapiens
tgagatattgggacacacat

SEQ ID NO: 4196829 - DNA, 19 bp, Homo sapiens
tgagatctccctccaggga

SEQ ID NO: 4196830 - DNA, 14 bp, Homo sapiens
tgagatgatgaaaa

SEQ ID NO: 4196831 - DNA, 12 bp, Homo sapiens
tgagatgctggc

SEQ ID NO: 4196832 - DNA, 15 bp, Homo sapiens
tgagattacagagga

SEQ ID NO: 4196833 - DNA, 17 bp, Homo sapiens
tgagattacaggtgtga

SEQ ID NO: 4196834 - DNA, 18 bp, Homo sapiens
tgagattactttgtcccg

SEQ ID NO: 4196835 - DNA, 14 bp, Homo sapiens
tgagcaaaccacat

SEQ ID NO: 4196836 - DNA, 20 bp, Homo sapiens
tgagcaacctcttcagctgg

SEQ ID NO: 4196837 - DNA, 12 bp, Homo sapiens
tgagcacctgct

SEQ ID NO: 4196838 - DNA, 11 bp, Homo sapiens
tgagcagaccg

SEQ ID NO: 4196839 - DNA, 15 bp, Homo sapiens
tgagcagcccagcac

SEQ ID NO: 4196840 - DNA, 11 bp, Homo sapiens
tgagcaggagc

SEQ ID NO: 4196841 - DNA, 24 bp, Homo sapiens
tgagctactgccgtcagtgctgtg

SEQ ID NO: 4196842 - DNA, 11 bp, Homo sapiens
tgagctcagct

SEQ ID NO: 4196843 - DNA, 12 bp, Homo sapiens
tgagctcagctc

SEQ ID NO: 4196844 - DNA, 15 bp, Homo sapiens
tgagctgaccagccg

SEQ ID NO: 4196845 - DNA, 19 bp, Homo sapiens
tgaggaatatgactgtttt

SEQ ID NO: 4196846 - DNA, 12 bp, Homo sapiens
tgaggacacatg

SEQ ID NO: 4196847 - DNA, 15 bp, Homo sapiens
tgaggacacatgtcc

SEQ ID NO: 4196848 - DNA, 21 bp, Homo sapiens
tgaggacatgtttttgttttc

SEQ ID NO: 4196849 - DNA, 17 bp, Homo sapiens
tgaggatgcaacaaata

SEQ ID NO: 4196850 - DNA, 16 bp, Homo sapiens
tgaggattttgagtat

SEQ ID NO: 4196851 - DNA, 15 bp, Homo sapiens
tgaggcaggagaatc

SEQ ID NO: 4196852 - DNA, 13 bp, Homo sapiens
tgaggcaggggag

SEQ ID NO: 4196853 - DNA, 14 bp, Homo sapiens
tgaggcccagcctg

SEQ ID NO: 4196854 - DNA, 15 bp, Homo sapiens
tgaggccccaggccc

SEQ ID NO: 4196855 - DNA, 15 bp, Homo sapiens
tgaggcctggccagg

SEQ ID NO: 4196856 - DNA, 23 bp, Homo sapiens
tgaggcgggtggatcacctgagg

SEQ ID NO: 4196857 - DNA, 15 bp, Homo sapiens
tgaggctcctgtgct

SEQ ID NO: 4196858 - DNA, 16 bp, Homo sapiens
tgaggctcctgtgcta

SEQ ID NO: 4196859 - DNA, 17 bp, Homo sapiens
tgaggctctttctgggc

SEQ ID NO: 4196860 - DNA, 13 bp, Homo sapiens
tgaggctgcagcg

SEQ ID NO: 4196861 - DNA, 18 bp, Homo sapiens
tgagggactggaaccagg

SEQ ID NO: 4196862 - DNA, 20 bp, Homo sapiens
tgagggattttagcctcttc

SEQ ID NO: 4196863 - DNA, 21 bp, Homo sapiens
tgagggtttcattgtgtgtta

SEQ ID NO: 4196864 - DNA, 22 bp, Homo sapiens
tgaggtcctgcatttctcagtc

SEQ ID NO: 4196865 - DNA, 22 bp, Homo sapiens
tgagtaccaaatccacaagcca

SEQ ID NO: 4196866 - DNA, 21 bp, Homo sapiens
tgagtactagaatttgtattt

SEQ ID NO: 4196867 - DNA, 21 bp, Homo sapiens
tgagtctttaacatcttgaac

SEQ ID NO: 4196868 - DNA, 20 bp, Homo sapiens
tgagtgacaatagaagaaat

SEQ ID NO: 4196869 - DNA, 15 bp, Homo sapiens
tgagtgcaacaagag

SEQ ID NO: 4196870 - DNA, 19 bp, Homo sapiens
tgagtgttttatgagaaag

SEQ ID NO: 4196871 - DNA, 13 bp, Homo sapiens
tgagttaactgtg

SEQ ID NO: 4196872 - DNA, 15 bp, Homo sapiens
tgagttaactgtgaa

SEQ ID NO: 4196873 - DNA, 16 bp, Homo sapiens
tgataaactaaaagca

SEQ ID NO: 4196874 - DNA, 19 bp, Homo sapiens
tgataaagattttttaata

SEQ ID NO: 4196875 - DNA, 14 bp, Homo sapiens
tgataaatatatgg

SEQ ID NO: 4196876 - DNA, 17 bp, Homo sapiens
tgataaatatatggaca

SEQ ID NO: 4196877 - DNA, 15 bp, Homo sapiens
tgataactatttaca

SEQ ID NO: 4196878 - DNA, 17 bp, Homo sapiens
tgataactatttacata

SEQ ID NO: 4196879 - DNA, 20 bp, Homo sapiens
tgataatgaacagaacatag

SEQ ID NO: 4196880 - DNA, 13 bp, Homo sapiens
tgataattttaaa

SEQ ID NO: 4196881 - DNA, 14 bp, Homo sapiens
tgataattttaaat

SEQ ID NO: 4196882 - DNA, 19 bp, Homo sapiens
tgatacaaaatgctgaggt

SEQ ID NO: 4196883 - DNA, 19 bp, Homo sapiens
tgatacattagcagctatg

SEQ ID NO: 4196884 - DNA, 16 bp, Homo sapiens
tgatacgtgtgtgaag

SEQ ID NO: 4196885 - DNA, 17 bp, Homo sapiens
tgatacgtgtgtgaagt

SEQ ID NO: 4196886 - DNA, 16 bp, Homo sapiens
tgatactaagcattga

SEQ ID NO: 4196887 - DNA, 21 bp, Homo sapiens
tgatactttaatttttataaa

SEQ ID NO: 4196888 - DNA, 13 bp, Homo sapiens
tgatagaacaaga

SEQ ID NO: 4196889 - DNA, 21 bp, Homo sapiens
tgatagaacaagaccctgtct

SEQ ID NO: 4196890 - DNA, 14 bp, Homo sapiens
tgatagattttctg

SEQ ID NO: 4196891 - DNA, 18 bp, Homo sapiens
tgataggaaataaatgat

SEQ ID NO: 4196892 - DNA, 15 bp, Homo sapiens
tgatagtgtgatttt

SEQ ID NO: 4196893 - DNA, 21 bp, Homo sapiens
tgatatccagtaagcacatgt

SEQ ID NO: 4196894 - DNA, 15 bp, Homo sapiens
tcgtggacacctgcc

SEQ ID NO: 4196895 - DNA, 16 bp, Homo sapiens
tcgtggacacctgccc

SEQ ID NO: 4196896 - DNA, 17 bp, Homo sapiens
tcgtggacacctgccct

SEQ ID NO: 4196897 - DNA, 21 bp, Homo sapiens
tcgtggcagataatcagcctc

SEQ ID NO: 4196898 - DNA, 21 bp, Homo sapiens
tcgttcctatacatttctgtt

SEQ ID NO: 4196899 - DNA, 13 bp, Homo sapiens
tctaaacattaat

SEQ ID NO: 4196900 - DNA, 14 bp, Homo sapiens
tctaaacattaatc

SEQ ID NO: 4196901 - DNA, 15 bp, Homo sapiens
tctaaagtttacagt

SEQ ID NO: 4196902 - DNA, 18 bp, Homo sapiens
tctaaagtttacagtaaa

SEQ ID NO: 4196903 - DNA, 18 bp, Homo sapiens
tctaacaataatatttca

SEQ ID NO: 4196904 - DNA, 19 bp, Homo sapiens
tctaacaataatatttcaa

SEQ ID NO: 4196905 - DNA, 20 bp, Homo sapiens
tctaacaataatatttcaag

SEQ ID NO: 4196906 - DNA, 21 bp, Homo sapiens
tctaacaataatatttcaagt

SEQ ID NO: 4196907 - DNA, 23 bp, Homo sapiens
tctaacaataatatttcaagtgc

SEQ ID NO: 4196908 - DNA, 22 bp, Homo sapiens
tctaacccccagtgccacagag

SEQ ID NO: 4196909 - DNA, 15 bp, Homo sapiens
tctaacctgatggca

SEQ ID NO: 4196910 - DNA, 12 bp, Homo sapiens
tctaagctgtgt

SEQ ID NO: 4196911 - DNA, 16 bp, Homo sapiens
tctaagctgtgtgcag

SEQ ID NO: 4196912 - DNA, 17 bp, Homo sapiens
tctaagctgtgtgcagg

SEQ ID NO: 4196913 - DNA, 16 bp, Homo sapiens
tctaagtaagaacact

SEQ ID NO: 4196914 - DNA, 20 bp, Homo sapiens
tctaataaatattgacttct

SEQ ID NO: 4196915 - DNA, 14 bp, Homo sapiens
tctacacacccata

SEQ ID NO: 4196916 - DNA, 15 bp, Homo sapiens
tctacaccctctgcc

SEQ ID NO: 4196917 - DNA, 20 bp, Homo sapiens
tctacaccctctgccccaga

SEQ ID NO: 4196918 - DNA, 18 bp, Homo sapiens
tctacagacttctccaga

SEQ ID NO: 4196919 - DNA, 16 bp, Homo sapiens
tctacatttctgcaga

SEQ ID NO: 4196920 - DNA, 22 bp, Homo sapiens
tctacccggcccagagacccct

SEQ ID NO: 4196921 - DNA, 19 bp, Homo sapiens
tctacctttttttctctcc

SEQ ID NO: 4196922 - DNA, 21 bp, Homo sapiens
tctacctttttttctctccta

SEQ ID NO: 4196923 - DNA, 19 bp, Homo sapiens
tctactcctacctcagcct

SEQ ID NO: 4196924 - DNA, 22 bp, Homo sapiens
tctactcctacctcagcctaga

SEQ ID NO: 4196925 - DNA, 14 bp, Homo sapiens
tctacttttaaaga

SEQ ID NO: 4196926 - DNA, 14 bp, Homo sapiens
tctagaagcagaag

SEQ ID NO: 4196927 - DNA, 14 bp, Homo sapiens
tctagactttctca

SEQ ID NO: 4196928 - DNA, 15 bp, Homo sapiens
tctagactttctgtt

SEQ ID NO: 4196929 - DNA, 21 bp, Homo sapiens
tctagagattttcttggcagt

SEQ ID NO: 4196930 - DNA, 15 bp, Homo sapiens
tctagagcactgcca

SEQ ID NO: 4196931 - DNA, 14 bp, Homo sapiens
tctagagggcacta

SEQ ID NO: 4196932 - DNA, 22 bp, Homo sapiens
tctagaggtgagaccaaaggat

SEQ ID NO: 4196933 - DNA, 23 bp, Homo sapiens
tctagccactttggtcccgtgca

SEQ ID NO: 4196934 - DNA, 20 bp, Homo sapiens
tctagccgggccatgctttc

SEQ ID NO: 4196935 - DNA, 23 bp, Homo sapiens
tctagcctaagtgtggagaagga

SEQ ID NO: 4196936 - DNA, 16 bp, Homo sapiens
tctaggattgggcctc

SEQ ID NO: 4196937 - DNA, 20 bp, Homo sapiens
tctaggattgggcctcccat

SEQ ID NO: 4196938 - DNA, 17 bp, Homo sapiens
tctagtagaaagaaaat

SEQ ID NO: 4196939 - DNA, 14 bp, Homo sapiens
tctagtgccctcca

SEQ ID NO: 4196940 - DNA, 12 bp, Homo sapiens
tctagtgggaag

SEQ ID NO: 4196941 - DNA, 11 bp, Homo sapiens
tctatagagaa

SEQ ID NO: 4196942 - DNA, 13 bp, Homo sapiens
tctatatgaactt

SEQ ID NO: 4196943 - DNA, 16 bp, Homo sapiens
tctatcctacaacaag

SEQ ID NO: 4196944 - DNA, 22 bp, Homo sapiens
tctatgaatatggaaaggccag

SEQ ID NO: 4196945 - DNA, 13 bp, Homo sapiens
tctatgtatgtta

SEQ ID NO: 4196946 - DNA, 23 bp, Homo sapiens
tctatgtatgttaatttatttag

SEQ ID NO: 4196947 - DNA, 17 bp, Homo sapiens
tctattataaaaccatg

SEQ ID NO: 4196948 - DNA, 13 bp, Homo sapiens
tctattgagccaa

SEQ ID NO: 4196949 - DNA, 13 bp, Homo sapiens
tctattgtttgtt

SEQ ID NO: 4196950 - DNA, 20 bp, Homo sapiens
tctcaaaaaaaaaaaaaaca

SEQ ID NO: 4196951 - DNA, 15 bp, Homo sapiens
tctcaccaggaaggg

SEQ ID NO: 4196952 - DNA, 14 bp, Homo sapiens
tctcactaaatctt

SEQ ID NO: 4196953 - DNA, 21 bp, Homo sapiens
tctcactcagccgcagacaag

SEQ ID NO: 4196954 - DNA, 13 bp, Homo sapiens
tctcactgctgtc

SEQ ID NO: 4196955 - DNA, 14 bp, Homo sapiens
tctcactgctgtca

SEQ ID NO: 4196956 - DNA, 17 bp, Homo sapiens
tctcaggccagagccaa

SEQ ID NO: 4196957 - DNA, 16 bp, Homo sapiens
tctcagtgaagaatac

SEQ ID NO: 4196958 - DNA, 14 bp, Homo sapiens
tctcagtgctctcc

SEQ ID NO: 4196959 - DNA, 23 bp, Homo sapiens
tctcagtgggacaaaccagagca

SEQ ID NO: 4196960 - DNA, 15 bp, Homo sapiens
tctcatcagaaatgt

SEQ ID NO: 4196961 - DNA, 13 bp, Homo sapiens
tctcatctactca

SEQ ID NO: 4196962 - DNA, 19 bp, Homo sapiens
tctcatctcagtgaagaat

SEQ ID NO: 4196963 - DNA, 21 bp, Homo sapiens
tctccaaacaccggcagaaaa

SEQ ID NO: 4196964 - DNA, 14 bp, Homo sapiens
tctccaaggaccag

SEQ ID NO: 4196965 - DNA, 16 bp, Homo sapiens
tctccaaggaccaggt

SEQ ID NO: 4196966 - DNA, 14 bp, Homo sapiens
tctccagatagctg

SEQ ID NO: 4196967 - DNA, 19 bp, Homo sapiens
tctccaggattgaagagca

SEQ ID NO: 4196968 - DNA, 17 bp, Homo sapiens
tctccagggctgcccct

SEQ ID NO: 4196969 - DNA, 24 bp, Homo sapiens
tctccagggctgcccctgtaggtt

SEQ ID NO: 4196970 - DNA, 19 bp, Homo sapiens
tctccagtttcagaagcag

SEQ ID NO: 4196971 - DNA, 21 bp, Homo sapiens
tctccattctgaaaatagcag

SEQ ID NO: 4196972 - DNA, 15 bp, Homo sapiens
tctcccctccctctt

SEQ ID NO: 4196973 - DNA, 16 bp, Homo sapiens
tgctacctctgagaag

SEQ ID NO: 4196974 - DNA, 20 bp, Homo sapiens
tgctacctctgagaagacac

SEQ ID NO: 4196975 - DNA, 13 bp, Homo sapiens
tgctactccatgc

SEQ ID NO: 4196976 - DNA, 13 bp, Homo sapiens
tgctactttgcct

SEQ ID NO: 4196977 - DNA, 17 bp, Homo sapiens
tgctactttgccttttg

SEQ ID NO: 4196978 - DNA, 18 bp, Homo sapiens
tgctaggcgagtgccagg

SEQ ID NO: 4196979 - DNA, 22 bp, Homo sapiens
tgctatattttcatgacttttc

SEQ ID NO: 4196980 - DNA, 14 bp, Homo sapiens
tgctatcacacagt

SEQ ID NO: 4196981 - DNA, 14 bp, Homo sapiens
tgctattacatgtg

SEQ ID NO: 4196982 - DNA, 15 bp, Homo sapiens
tgctcacgactcttc

SEQ ID NO: 4196983 - DNA, 18 bp, Homo sapiens
tgctcacgactcttcctg

SEQ ID NO: 4196984 - DNA, 13 bp, Homo sapiens
tgctcagccctga

SEQ ID NO: 4196985 - DNA, 23 bp, Homo sapiens
tgctccagagagaggatgcagag

SEQ ID NO: 4196986 - DNA, 14 bp, Homo sapiens
tgctcctccagccc

SEQ ID NO: 4196987 - DNA, 15 bp, Homo sapiens
tgctcctccagccct

SEQ ID NO: 4196988 - DNA, 15 bp, Homo sapiens
tgctctagtcttgct

SEQ ID NO: 4196989 - DNA, 14 bp, Homo sapiens
tgctctcatcagaa

SEQ ID NO: 4196990 - DNA, 14 bp, Homo sapiens
tgctctcccctgcc

SEQ ID NO: 4196991 - DNA, 15 bp, Homo sapiens
tgctctcccctgccc

SEQ ID NO: 4196992 - DNA, 19 bp, Homo sapiens
tgctctgcaggcaccttag

SEQ ID NO: 4196993 - DNA, 23 bp, Homo sapiens
tgctctggaaaatgtgacccaga

SEQ ID NO: 4196994 - DNA, 21 bp, Homo sapiens
tgctctgtgtccgtctgtgta

SEQ ID NO: 4196995 - DNA, 13 bp, Homo sapiens
tgctgaagggacc

SEQ ID NO: 4196996 - DNA, 18 bp, Homo sapiens
tgctgagatacatacaga

SEQ ID NO: 4196997 - DNA, 17 bp, Homo sapiens
tgctgaggtaataatta

SEQ ID NO: 4196998 - DNA, 19 bp, Homo sapiens
tgctgatccggctgctcct

SEQ ID NO: 4196999 - DNA, 20 bp, Homo sapiens
tgctgatccggctgctcctc

SEQ ID NO: 4197000 - DNA, 21 bp, Homo sapiens
tgctgatccggctgctcctcc

SEQ ID NO: 4197001 - DNA, 15 bp, Homo sapiens
tgctgatccttccta

SEQ ID NO: 4197002 - DNA, 14 bp, Homo sapiens
tgctgatgtcaaag

SEQ ID NO: 4197003 - DNA, 15 bp, Homo sapiens
tgctgattcaagaaa

SEQ ID NO: 4197004 - DNA, 21 bp, Homo sapiens
tgctgattcaagaaacagaag

SEQ ID NO: 4197005 - DNA, 14 bp, Homo sapiens
tgctgcactgccct

SEQ ID NO: 4197006 - DNA, 15 bp, Homo sapiens
tgctgcatgcctggt

SEQ ID NO: 4197007 - DNA, 18 bp, Homo sapiens
tgctgccaggctcccact

SEQ ID NO: 4197008 - DNA, 16 bp, Homo sapiens
tgctgccgcctcccag

SEQ ID NO: 4197009 - DNA, 14 bp, Homo sapiens
tgctgcctgagtca

SEQ ID NO: 4197010 - DNA, 15 bp, Homo sapiens
tgctgcgtcagacca

SEQ ID NO: 4197011 - DNA, 20 bp, Homo sapiens
tgctgcgtcagaccagtact

SEQ ID NO: 4197012 - DNA, 17 bp, Homo sapiens
tgctgctcccatctgca

SEQ ID NO: 4197013 - DNA, 11 bp, Homo sapiens
tgctgctccta

SEQ ID NO: 4197014 - DNA, 14 bp, Homo sapiens
tgctgctgtgtttt

SEQ ID NO: 4197015 - DNA, 16 bp, Homo sapiens
tgctggaaaccacact

SEQ ID NO: 4197016 - DNA, 18 bp, Homo sapiens
tgctggaaaccacacttc

SEQ ID NO: 4197017 - DNA, 20 bp, Homo sapiens
tgctggacggcattcctgct

SEQ ID NO: 4197018 - DNA, 23 bp, Homo sapiens
tgctggcctcccaataaagctgg

SEQ ID NO: 4197019 - DNA, 17 bp, Homo sapiens
tgctggcggcgcagagg

SEQ ID NO: 4197020 - DNA, 20 bp, Homo sapiens
tgctggcggcgcagagggaa

SEQ ID NO: 4197021 - DNA, 18 bp, Homo sapiens
tgctggggcaagtccctg

SEQ ID NO: 4197022 - DNA, 22 bp, Homo sapiens
tgctggtaatttgtatctgaag

SEQ ID NO: 4197023 - DNA, 16 bp, Homo sapiens
tgctgtcatggtcctt

SEQ ID NO: 4197024 - DNA, 17 bp, Homo sapiens
tgctgtggccagggtga

SEQ ID NO: 4197025 - DNA, 15 bp, Homo sapiens
tgctgtggcctgggc

SEQ ID NO: 4197026 - DNA, 15 bp, Homo sapiens
tgctgtgtctcacag

SEQ ID NO: 4197027 - DNA, 15 bp, Homo sapiens
tgctgtgtctgcacc

SEQ ID NO: 4197028 - DNA, 15 bp, Homo sapiens
tgctgtgtttgagct

SEQ ID NO: 4197029 - DNA, 15 bp, Homo sapiens
tgcttaaaattttac

SEQ ID NO: 4197030 - DNA, 14 bp, Homo sapiens
tgcttagcctcctg

SEQ ID NO: 4197031 - DNA, 15 bp, Homo sapiens
tgcttagcctcctga

SEQ ID NO: 4197032 - DNA, 17 bp, Homo sapiens
tgcttcaaatccatcca

SEQ ID NO: 4197033 - DNA, 12 bp, Homo sapiens
tgcttcagcctg

SEQ ID NO: 4197034 - DNA, 15 bp, Homo sapiens
tgcttcagcctgagg

SEQ ID NO: 4197035 - DNA, 22 bp, Homo sapiens
tgcttcagcctgaggctgagac

SEQ ID NO: 4197036 - DNA, 16 bp, Homo sapiens
tgcttcagtggagaat

SEQ ID NO: 4197037 - DNA, 18 bp, Homo sapiens
tgcttcagtggagaatta

SEQ ID NO: 4197038 - DNA, 16 bp, Homo sapiens
tgcttccaggtggcag

SEQ ID NO: 4197039 - DNA, 19 bp, Homo sapiens
tgcttctcctcccagcgtg

SEQ ID NO: 4197040 - DNA, 14 bp, Homo sapiens
tgcttctctacaga

SEQ ID NO: 4197041 - DNA, 14 bp, Homo sapiens
tgcttctgcagcaa

SEQ ID NO: 4197042 - DNA, 18 bp, Homo sapiens
tgcttgatagaaatgcca

SEQ ID NO: 4197043 - DNA, 22 bp, Homo sapiens
tgcttgatgggattctggacag

SEQ ID NO: 4197044 - DNA, 22 bp, Homo sapiens
tgcttgcactttgtaacatgtt

SEQ ID NO: 4197045 - DNA, 14 bp, Homo sapiens
tgcttgggttcctt

SEQ ID NO: 4197046 - DNA, 21 bp, Homo sapiens
tgctttgaaacagaaaaatat

SEQ ID NO: 4197047 - DNA, 17 bp, Homo sapiens
tgctttgccaaaatacc

SEQ ID NO: 4197048 - DNA, 20 bp, Homo sapiens
tgctttgccaaaataccaga

SEQ ID NO: 4197049 - DNA, 23 bp, Homo sapiens
tgctttgctgtctggtgtagctc

SEQ ID NO: 4197050 - DNA, 21 bp, Homo sapiens
tggaaaaaaattctgatacat

SEQ ID NO: 4197051 - DNA, 18 bp, Homo sapiens
tggaaaagaatccctgca

SEQ ID NO: 4197052 - DNA, 17 bp, Homo sapiens
tggaaacctgaaaaaaa

SEQ ID NO: 4197053 - DNA, 18 bp, Homo sapiens
tggaaagcctctgctgcc

SEQ ID NO: 4197054 - DNA, 13 bp, Homo sapiens
tggaaaggctcag

SEQ ID NO: 4197055 - DNA, 20 bp, Homo sapiens
tggaaaggctcagtctcagg

SEQ ID NO: 4197056 - DNA, 21 bp, Homo sapiens
tggaaaggctcagtctcagga

SEQ ID NO: 4197057 - DNA, 16 bp, Homo sapiens
tggaaaggtttcaaga

SEQ ID NO: 4197058 - DNA, 17 bp, Homo sapiens
tggaaataaacctggag

SEQ ID NO: 4197059 - DNA, 20 bp, Homo sapiens
tggaaataaacctggagatg

SEQ ID NO: 4197060 - DNA, 17 bp, Homo sapiens
tggaaatgtaataataa

SEQ ID NO: 4197061 - DNA, 21 bp, Homo sapiens
tggaacaaaagttcgaaagaa

SEQ ID NO: 4197062 - DNA, 11 bp, Homo sapiens
tggaaccactg

SEQ ID NO: 4197063 - DNA, 14 bp, Homo sapiens
tggaacttctaata

SEQ ID NO: 4197064 - DNA, 16 bp, Homo sapiens
tggaagagaggcacct

SEQ ID NO: 4197065 - DNA, 18 bp, Homo sapiens
tggaagagaggcacctgc

SEQ ID NO: 4197066 - DNA, 17 bp, Homo sapiens
tggaaggcagggacaga

SEQ ID NO: 4197067 - DNA, 21 bp, Homo sapiens
tggaagtagttctatgaatat

SEQ ID NO: 4197068 - DNA, 20 bp, Homo sapiens
tggaagtgtgtggaaggcag

SEQ ID NO: 4197069 - DNA, 22 bp, Homo sapiens
tggaatataattgttttatctg

SEQ ID NO: 4197070 - DNA, 21 bp, Homo sapiens
tggaatcaaggaatcctgagt

SEQ ID NO: 4197071 - DNA, 16 bp, Homo sapiens
tggaatttaatttatg

SEQ ID NO: 4197072 - DNA, 14 bp, Homo sapiens
tggaatttgtaagt

SEQ ID NO: 4197073 - DNA, 22 bp, Homo sapiens
tggaattttcagtcatctcatg

SEQ ID NO: 4197074 - DNA, 16 bp, Homo sapiens
tggacaagaagctgct

SEQ ID NO: 4197075 - DNA, 17 bp, Homo sapiens
tggacaagaagctgcta

SEQ ID NO: 4197076 - DNA, 21 bp, Homo sapiens
tggacaccccttatccaggac

SEQ ID NO: 4197077 - DNA, 22 bp, Homo sapiens
tggacaccccttatccaggact

SEQ ID NO: 4197078 - DNA, 23 bp, Homo sapiens
tggacaccccttatccaggactc

SEQ ID NO: 4197079 - DNA, 11 bp, Homo sapiens
tggacacctgc

SEQ ID NO: 4197080 - DNA, 12 bp, Homo sapiens
tggacagaagat

SEQ ID NO: 4197081 - DNA, 12 bp, Homo sapiens
tggacagtcctg

SEQ ID NO: 4197082 - DNA, 19 bp, Homo sapiens
tggaccgcttcccagaggc

SEQ ID NO: 4197083 - DNA, 14 bp, Homo sapiens
tggactcctcccac

SEQ ID NO: 4197084 - DNA, 14 bp, Homo sapiens
tggactggttttca

SEQ ID NO: 4197085 - DNA, 11 bp, Homo sapiens
tggacttcaaa

SEQ ID NO: 4197086 - DNA, 19 bp, Homo sapiens
tggagaaattatttaataa

SEQ ID NO: 4197087 - DNA, 22 bp, Homo sapiens
tggagaactaggtttaaaacag

SEQ ID NO: 4197088 - DNA, 23 bp, Homo sapiens
tggagaactaggtttaaaacagc

SEQ ID NO: 4197089 - DNA, 14 bp, Homo sapiens
tggagaaggaaggc

SEQ ID NO: 4197090 - DNA, 18 bp, Homo sapiens
tggagaaggatagcctca

SEQ ID NO: 4197091 - DNA, 21 bp, Homo sapiens
tggagaaggatagcctcagcc

SEQ ID NO: 4197092 - DNA, 21 bp, Homo sapiens
tggagaaggtattagcaaagc

SEQ ID NO: 4197093 - DNA, 21 bp, Homo sapiens
tggagacagcaattgtagaca

SEQ ID NO: 4197094 - DNA, 14 bp, Homo sapiens
tggagacagccctg

SEQ ID NO: 4197095 - DNA, 19 bp, Homo sapiens
tggagacagccctgcctat

SEQ ID NO: 4197096 - DNA, 14 bp, Homo sapiens
tggagactctgtgg

SEQ ID NO: 4197097 - DNA, 19 bp, Homo sapiens
tggagactctgtggggcct

SEQ ID NO: 4197098 - DNA, 12 bp, Homo sapiens
tggagagcagct

SEQ ID NO: 4197099 - DNA, 23 bp, Homo sapiens
tggagaggagggatgctgcctga

SEQ ID NO: 4197100 - DNA, 16 bp, Homo sapiens
tggagaggtttgtcaa

SEQ ID NO: 4197101 - DNA, 18 bp, Homo sapiens
tggagaggtttgtcaaca

SEQ ID NO: 4197102 - DNA, 19 bp, Homo sapiens
tggagaggtttgtcaacac

SEQ ID NO: 4197103 - DNA, 13 bp, Homo sapiens
tggagatgatgat

SEQ ID NO: 4197104 - DNA, 14 bp, Homo sapiens
tggagatgatgatg

SEQ ID NO: 4197105 - DNA, 15 bp, Homo sapiens
tggagatgatgatga

SEQ ID NO: 4197106 - DNA, 16 bp, Homo sapiens
tggagatgatgatgat

SEQ ID NO: 4197107 - DNA, 20 bp, Homo sapiens
tggagcccgcttcaagctct

SEQ ID NO: 4197108 - DNA, 14 bp, Homo sapiens
tggagcgcacctgc

SEQ ID NO: 4197109 - DNA, 17 bp, Homo sapiens
tggagcggagcttgcct

SEQ ID NO: 4197110 - DNA, 18 bp, Homo sapiens
tggagcggagcttgcctg

SEQ ID NO: 4197111 - DNA, 20 bp, Homo sapiens
tggaggaaaatccatggata

SEQ ID NO: 4197112 - DNA, 13 bp, Homo sapiens
tggagggatgcca

SEQ ID NO: 4197113 - DNA, 21 bp, Homo sapiens
gaccccaaagagcctggagaa

SEQ ID NO: 4197114 - DNA, 14 bp, Homo sapiens
gaccccactggact

SEQ ID NO: 4197115 - DNA, 17 bp, Homo sapiens
gaccccggtggcagtgg

SEQ ID NO: 4197116 - DNA, 16 bp, Homo sapiens
gaccccttcctttcct

SEQ ID NO: 4197117 - DNA, 23 bp, Homo sapiens
gaccccttggcttttgcttggca

SEQ ID NO: 4197118 - DNA, 15 bp, Homo sapiens
gaccctccagtgctg

SEQ ID NO: 4197119 - DNA, 23 bp, Homo sapiens
gaccctcctccactccacctcca

SEQ ID NO: 4197120 - DNA, 23 bp, Homo sapiens
gaccctctgaatggtccagggtt

SEQ ID NO: 4197121 - DNA, 20 bp, Homo sapiens
gaccctgagctgaccagccg

SEQ ID NO: 4197122 - DNA, 21 bp, Homo sapiens
gaccgtgatttggaagagagg

SEQ ID NO: 4197123 - DNA, 17 bp, Homo sapiens
gacctaattgatagcag

SEQ ID NO: 4197124 - DNA, 16 bp, Homo sapiens
gacctactgaacccag

SEQ ID NO: 4197125 - DNA, 19 bp, Homo sapiens
gacctactgaacccagagt

SEQ ID NO: 4197126 - DNA, 15 bp, Homo sapiens
gacctgatcacctct

SEQ ID NO: 4197127 - DNA, 22 bp, Homo sapiens
gacctgatcattacatggctgt

SEQ ID NO: 4197128 - DNA, 23 bp, Homo sapiens
gacctgatcattacatggctgtg

SEQ ID NO: 4197129 - DNA, 13 bp, Homo sapiens
gacctgcaggcca

SEQ ID NO: 4197130 - DNA, 19 bp, Homo sapiens
gacctgggcccacagagcc

SEQ ID NO: 4197131 - DNA, 19 bp, Homo sapiens
gaccttgaagggtaaagaa

SEQ ID NO: 4197132 - DNA, 13 bp, Homo sapiens
gaccttgtgatct

SEQ ID NO: 4197133 - DNA, 14 bp, Homo sapiens
gacgcgcacacaca

SEQ ID NO: 4197134 - DNA, 13 bp, Homo sapiens
gacggctggacct

SEQ ID NO: 4197135 - DNA, 19 bp, Homo sapiens
gacggtcctttaggcagcc

SEQ ID NO: 4197136 - DNA, 21 bp, Homo sapiens
gacggtcctttaggcagcctg

SEQ ID NO: 4197137 - DNA, 14 bp, Homo sapiens
gacggttgtaagca

SEQ ID NO: 4197138 - DNA, 16 bp, Homo sapiens
gacgtctcaagactga

SEQ ID NO: 4197139 - DNA, 18 bp, Homo sapiens
gacgtgcacctgtactca

SEQ ID NO: 4197140 - DNA, 16 bp, Homo sapiens
gactatttaacttgag

SEQ ID NO: 4197141 - DNA, 15 bp, Homo sapiens
gactcaataaaagaa

SEQ ID NO: 4197142 - DNA, 15 bp, Homo sapiens
gactccccaggccag

SEQ ID NO: 4197143 - DNA, 11 bp, Homo sapiens
gactcctccca

SEQ ID NO: 4197144 - DNA, 14 bp, Homo sapiens
gactcctcccacaa

SEQ ID NO: 4197145 - DNA, 16 bp, Homo sapiens
gactcgtaaagctgct

SEQ ID NO: 4197146 - DNA, 18 bp, Homo sapiens
gactcgtaaagctgctag

SEQ ID NO: 4197147 - DNA, 20 bp, Homo sapiens
gactctaagctgtgtgcagg

SEQ ID NO: 4197148 - DNA, 13 bp, Homo sapiens
gactctctgtgac

SEQ ID NO: 4197149 - DNA, 15 bp, Homo sapiens
gactctctgtgacct

SEQ ID NO: 4197150 - DNA, 19 bp, Homo sapiens
gactctgaggctctttctg

SEQ ID NO: 4197151 - DNA, 15 bp, Homo sapiens
gactctggagccaag

SEQ ID NO: 4197152 - DNA, 18 bp, Homo sapiens
gactctggagccaaggca

SEQ ID NO: 4197153 - DNA, 15 bp, Homo sapiens
gactctggcctccac

SEQ ID NO: 4197154 - DNA, 19 bp, Homo sapiens
gactctgggtccctcggag

SEQ ID NO: 4197155 - DNA, 13 bp, Homo sapiens
gactcttcctgca

SEQ ID NO: 4197156 - DNA, 16 bp, Homo sapiens
gactcttcctgcaaag

SEQ ID NO: 4197157 - DNA, 16 bp, Homo sapiens
gactgcagaggggaaa

SEQ ID NO: 4197158 - DNA, 22 bp, Homo sapiens
gactgcgggatggtcctggggc

SEQ ID NO: 4197159 - DNA, 19 bp, Homo sapiens
gactgctacctctgagaag

SEQ ID NO: 4197160 - DNA, 15 bp, Homo sapiens
gactgctagggagtg

SEQ ID NO: 4197161 - DNA, 19 bp, Homo sapiens
gactgctgggactggccag

SEQ ID NO: 4197162 - DNA, 17 bp, Homo sapiens
gactggctggctgcagt

SEQ ID NO: 4197163 - DNA, 14 bp, Homo sapiens
gactgggggtcttt

SEQ ID NO: 4197164 - DNA, 17 bp, Homo sapiens
gactgggttttgtctct

SEQ ID NO: 4197165 - DNA, 16 bp, Homo sapiens
gactggtaagtaactg

SEQ ID NO: 4197166 - DNA, 12 bp, Homo sapiens
gactgtgtatgt

SEQ ID NO: 4197167 - DNA, 21 bp, Homo sapiens
gacttcaagcatggctatttt

SEQ ID NO: 4197168 - DNA, 15 bp, Homo sapiens
gacttcagtcttgcc

SEQ ID NO: 4197169 - DNA, 16 bp, Homo sapiens
gacttcagtcttgcct

SEQ ID NO: 4197170 - DNA, 14 bp, Homo sapiens
gacttctacccaga

SEQ ID NO: 4197171 - DNA, 19 bp, Homo sapiens
gacttgaggattttgagta

SEQ ID NO: 4197172 - DNA, 16 bp, Homo sapiens
gactttcctaaatgtt

SEQ ID NO: 4197173 - DNA, 13 bp, Homo sapiens
gactttctgttgg

SEQ ID NO: 4197174 - DNA, 13 bp, Homo sapiens
gactttgtgatcc

SEQ ID NO: 4197175 - DNA, 17 bp, Homo sapiens
gacttttccatgtatct

SEQ ID NO: 4197176 - DNA, 16 bp, Homo sapiens
gagaaaacttatttga

SEQ ID NO: 4197177 - DNA, 18 bp, Homo sapiens
gagaaaacttatttgagt

SEQ ID NO: 4197178 - DNA, 13 bp, Homo sapiens
gagaaagaagaga

SEQ ID NO: 4197179 - DNA, 14 bp, Homo sapiens
gagaaatacaaaaa

SEQ ID NO: 4197180 - DNA, 23 bp, Homo sapiens
gagaaatctggcttctggccagg

SEQ ID NO: 4197181 - DNA, 14 bp, Homo sapiens
gagaaatggttctg

SEQ ID NO: 4197182 - DNA, 23 bp, Homo sapiens
gagaacctgggttgcagacagga

SEQ ID NO: 4197183 - DNA, 21 bp, Homo sapiens
gagaactttcggagcctgcct

SEQ ID NO: 4197184 - DNA, 21 bp, Homo sapiens
gagaagccatgtactcaagta

SEQ ID NO: 4197185 - DNA, 20 bp, Homo sapiens
gagaaggatagcctcagcca

SEQ ID NO: 4197186 - DNA, 16 bp, Homo sapiens
gagaagtttctggccc

SEQ ID NO: 4197187 - DNA, 17 bp, Homo sapiens
gagaagtttctggccct

SEQ ID NO: 4197188 - DNA, 18 bp, Homo sapiens
gagaagttttgtacagag

SEQ ID NO: 4197189 - DNA, 19 bp, Homo sapiens
gagaagttttgtacagaga

SEQ ID NO: 4197190 - DNA, 15 bp, Homo sapiens
gagaattgtatcatt

SEQ ID NO: 4197191 - DNA, 16 bp, Homo sapiens
gagacagccctgccta

SEQ ID NO: 4197192 - DNA, 17 bp, Homo sapiens
gagaccccttcctttcc

SEQ ID NO: 4197193 - DNA, 17 bp, Homo sapiens
gagaccctcgccacggg

SEQ ID NO: 4197194 - DNA, 22 bp, Homo sapiens
gagaccctcgccacggggaggg

SEQ ID NO: 4197195 - DNA, 18 bp, Homo sapiens
gagacctgacaagcactg

SEQ ID NO: 4197196 - DNA, 19 bp, Homo sapiens
gagacctgacaagcactgc

SEQ ID NO: 4197197 - DNA, 19 bp, Homo sapiens
gagacggctggacctgcac

SEQ ID NO: 4197198 - DNA, 15 bp, Homo sapiens
gagacgtgtacatag

SEQ ID NO: 4197199 - DNA, 16 bp, Homo sapiens
gagacgtgtacatagt

SEQ ID NO: 4197200 - DNA, 19 bp, Homo sapiens
gagactgcgggatggtcct

SEQ ID NO: 4197201 - DNA, 22 bp, Homo sapiens
gagactgcgggatggtcctggg

SEQ ID NO: 4197202 - DNA, 23 bp, Homo sapiens
gagactgcgggatggtcctgggg

SEQ ID NO: 4197203 - DNA, 16 bp, Homo sapiens
gagagaatatttcaaa

SEQ ID NO: 4197204 - DNA, 19 bp, Homo sapiens
gagagacgtgtacatagtg

SEQ ID NO: 4197205 - DNA, 18 bp, Homo sapiens
gaggtttgtcaacacaaa

SEQ ID NO: 4197206 - DNA, 21 bp, Homo sapiens
gagtaccaaatccacaagcca

SEQ ID NO: 4197207 - DNA, 20 bp, Homo sapiens
gagtactagaatttgtattt

SEQ ID NO: 4197208 - DNA, 19 bp, Homo sapiens
gagtagctgggactacagg

SEQ ID NO: 4197209 - DNA, 13 bp, Homo sapiens
gagtatactaaaa

SEQ ID NO: 4197210 - DNA, 20 bp, Homo sapiens
gagtatgatccaggattggc

SEQ ID NO: 4197211 - DNA, 15 bp, Homo sapiens
gagtcagccattcct

SEQ ID NO: 4197212 - DNA, 11 bp, Homo sapiens
gagtcagcctt

SEQ ID NO: 4197213 - DNA, 23 bp, Homo sapiens
gagtcgtcatcacttttcagtga

SEQ ID NO: 4197214 - DNA, 18 bp, Homo sapiens
gagtctctatttcacaat

SEQ ID NO: 4197215 - DNA, 18 bp, Homo sapiens
gagtctgctatattttca

SEQ ID NO: 4197216 - DNA, 21 bp, Homo sapiens
gagtctgctatattttcatga

SEQ ID NO: 4197217 - DNA, 24 bp, Homo sapiens
gagtgaaataattaaaaaccactg

SEQ ID NO: 4197218 - DNA, 20 bp, Homo sapiens
gagtgacggtcccacactgg

SEQ ID NO: 4197219 - DNA, 13 bp, Homo sapiens
gagtgagaccctg

SEQ ID NO: 4197220 - DNA, 13 bp, Homo sapiens
gagtgatctcaaa

SEQ ID NO: 4197221 - DNA, 12 bp, Homo sapiens
gagtgccaggac

SEQ ID NO: 4197222 - DNA, 13 bp, Homo sapiens
gagtgccaggact

SEQ ID NO: 4197223 - DNA, 14 bp, Homo sapiens
gagtgccaggactc

SEQ ID NO: 4197224 - DNA, 19 bp, Homo sapiens
gagtgccaggactccccag

SEQ ID NO: 4197225 - DNA, 22 bp, Homo sapiens
gagtgccaggactccccaggcc

SEQ ID NO: 4197226 - DNA, 17 bp, Homo sapiens
gagtggatctccaagga

SEQ ID NO: 4197227 - DNA, 20 bp, Homo sapiens
gagttacagcgagaggcaga

SEQ ID NO: 4197228 - DNA, 23 bp, Homo sapiens
gagttccaaataaggatttgttc

SEQ ID NO: 4197229 - DNA, 17 bp, Homo sapiens
gagttccatgaagacca

SEQ ID NO: 4197230 - DNA, 21 bp, Homo sapiens
gagttcgagaccagcctggcc

SEQ ID NO: 4197231 - DNA, 15 bp, Homo sapiens
gagttgacgcatcct

SEQ ID NO: 4197232 - DNA, 16 bp, Homo sapiens
gagttgccagggaaga

SEQ ID NO: 4197233 - DNA, 22 bp, Homo sapiens
gagttgtacctccattggcttc

SEQ ID NO: 4197234 - DNA, 16 bp, Homo sapiens
gagttgtggaaagcct

SEQ ID NO: 4197235 - DNA, 17 bp, Homo sapiens
gagtttaggcagcttct

SEQ ID NO: 4197236 - DNA, 22 bp, Homo sapiens
gagtttgaaggaggtgagggat

SEQ ID NO: 4197237 - DNA, 13 bp, Homo sapiens
gagtttttagttt

SEQ ID NO: 4197238 - DNA, 20 bp, Homo sapiens
gataaaggaagtcaccaaaa

SEQ ID NO: 4197239 - DNA, 15 bp, Homo sapiens
gataaccagctgtaa

SEQ ID NO: 4197240 - DNA, 17 bp, Homo sapiens
gataacctatatgattt

SEQ ID NO: 4197241 - DNA, 13 bp, Homo sapiens
gataatcagcctc

SEQ ID NO: 4197242 - DNA, 15 bp, Homo sapiens
gataatcagcctctt

SEQ ID NO: 4197243 - DNA, 15 bp, Homo sapiens
gataatcttcggcca

SEQ ID NO: 4197244 - DNA, 22 bp, Homo sapiens
gataattttatgtgttatagta

SEQ ID NO: 4197245 - DNA, 12 bp, Homo sapiens
gatacaaaatgc

SEQ ID NO: 4197246 - DNA, 14 bp, Homo sapiens
gatacatacagaat

SEQ ID NO: 4197247 - DNA, 17 bp, Homo sapiens
gatacggttgtctagag

SEQ ID NO: 4197248 - DNA, 23 bp, Homo sapiens
gatagagactggaacactagaca

SEQ ID NO: 4197249 - DNA, 23 bp, Homo sapiens
gatagatccatttggacaaaatg

SEQ ID NO: 4197250 - DNA, 22 bp, Homo sapiens
gatagattttctgctactttgc

SEQ ID NO: 4197251 - DNA, 19 bp, Homo sapiens
gatagcagaggaaaaagaa

SEQ ID NO: 4197252 - DNA, 21 bp, Homo sapiens
gatagccatttccatggctct

SEQ ID NO: 4197253 - DNA, 23 bp, Homo sapiens
gatagccatttccatggctctgt

SEQ ID NO: 4197254 - DNA, 14 bp, Homo sapiens
gatagcctcagcca

SEQ ID NO: 4197255 - DNA, 22 bp, Homo sapiens
gatagggaacactcatccctgg

SEQ ID NO: 4197256 - DNA, 22 bp, Homo sapiens
gatagtgtgatttttttcacat

SEQ ID NO: 4197257 - DNA, 17 bp, Homo sapiens
gatatatttttcacagt

SEQ ID NO: 4197258 - DNA, 20 bp, Homo sapiens
gcaagtccctgactctctgt

SEQ ID NO: 4197259 - DNA, 14 bp, Homo sapiens
gcaagtggatggcc

SEQ ID NO: 4197260 - DNA, 21 bp, Homo sapiens
gcaagtggatggcccagcagg

SEQ ID NO: 4197261 - DNA, 21 bp, Homo sapiens
gcaagttctagagaagaggct

SEQ ID NO: 4197262 - DNA, 21 bp, Homo sapiens
gcaataaagtgtagcaccctg

SEQ ID NO: 4197263 - DNA, 21 bp, Homo sapiens
gcaataacgtttaagccaaaa

SEQ ID NO: 4197264 - DNA, 14 bp, Homo sapiens
gcaatatgtaaata

SEQ ID NO: 4197265 - DNA, 22 bp, Homo sapiens
gcaatccatgttagtttttact

SEQ ID NO: 4197266 - DNA, 13 bp, Homo sapiens
gcaatctccaggg

SEQ ID NO: 4197267 - DNA, 20 bp, Homo sapiens
gcaatctccagggctgcccc

SEQ ID NO: 4197268 - DNA, 15 bp, Homo sapiens
gcaatgaaaccaaag

SEQ ID NO: 4197269 - DNA, 20 bp, Homo sapiens
gcaatgaaaccaaagccagg

SEQ ID NO: 4197270 - DNA, 17 bp, Homo sapiens
gcaatgggtactccagc

SEQ ID NO: 4197271 - DNA, 13 bp, Homo sapiens
gcaatgtaaatat

SEQ ID NO: 4197272 - DNA, 15 bp, Homo sapiens
gcaatgtaaatattt

SEQ ID NO: 4197273 - DNA, 19 bp, Homo sapiens
gcaatgtaaatattttaaa

SEQ ID NO: 4197274 - DNA, 23 bp, Homo sapiens
gcaatgtaaatattttaaagaat

SEQ ID NO: 4197275 - DNA, 20 bp, Homo sapiens
gcaattggggaagaaaaaat

SEQ ID NO: 4197276 - DNA, 17 bp, Homo sapiens
gcaatttattaaaatga

SEQ ID NO: 4197277 - DNA, 20 bp, Homo sapiens
gcaatttcctggccctccac

SEQ ID NO: 4197278 - DNA, 23 bp, Homo sapiens
gcaatttttccatgaagtttgaa

SEQ ID NO: 4197279 - DNA, 23 bp, Homo sapiens
gcacacagctaggcatgcctggg

SEQ ID NO: 4197280 - DNA, 21 bp, Homo sapiens
gcacactgcagggctgctgtg

SEQ ID NO: 4197281 - DNA, 22 bp, Homo sapiens
gcacactgcagggctgctgtgg

SEQ ID NO: 4197282 - DNA, 17 bp, Homo sapiens
gcacagcgcgggcggag

SEQ ID NO: 4197283 - DNA, 23 bp, Homo sapiens
gcacagcgcgggcggaggcggct

SEQ ID NO: 4197284 - DNA, 21 bp, Homo sapiens
gcacagcggggccccagggct

SEQ ID NO: 4197285 - DNA, 20 bp, Homo sapiens
gcacatgtctgtcctcagag

SEQ ID NO: 4197286 - DNA, 22 bp, Homo sapiens
gcacatgtctgtcctcagagca

SEQ ID NO: 4197287 - DNA, 15 bp, Homo sapiens
gcaccaaaagaagta

SEQ ID NO: 4197288 - DNA, 19 bp, Homo sapiens
gcaccaccatgccaggcta

SEQ ID NO: 4197289 - DNA, 17 bp, Homo sapiens
gcaccacccatggagag

SEQ ID NO: 4197290 - DNA, 20 bp, Homo sapiens
gcaccagcttctccaggctc

SEQ ID NO: 4197291 - DNA, 19 bp, Homo sapiens
gcaccataaccaagaaata

SEQ ID NO: 4197292 - DNA, 22 bp, Homo sapiens
gcaccataaccaagaaatacta

SEQ ID NO: 4197293 - DNA, 18 bp, Homo sapiens
gcaccatccaccctgcag

SEQ ID NO: 4197294 - DNA, 19 bp, Homo sapiens
gcacctaaaccaccagtgc

SEQ ID NO: 4197295 - DNA, 21 bp, Homo sapiens
gcacctatagtcccagctact

SEQ ID NO: 4197296 - DNA, 16 bp, Homo sapiens
gcacctgaaccactgt

SEQ ID NO: 4197297 - DNA, 17 bp, Homo sapiens
gcacctgaaccactgtg

SEQ ID NO: 4197298 - DNA, 17 bp, Homo sapiens
gcacctgaccagaatgc

SEQ ID NO: 4197299 - DNA, 13 bp, Homo sapiens
gcacctgccagcc

SEQ ID NO: 4197300 - DNA, 15 bp, Homo sapiens
gcacctgccagcctg

SEQ ID NO: 4197301 - DNA, 22 bp, Homo sapiens
gcacctgccccctggtggacag

SEQ ID NO: 4197302 - DNA, 11 bp, Homo sapiens
gcacctgctgg

SEQ ID NO: 4197303 - DNA, 20 bp, Homo sapiens
gcacctgcttcatgctcagc

SEQ ID NO: 4197304 - DNA, 18 bp, Homo sapiens
gcaccttaccaactttct

SEQ ID NO: 4197305 - DNA, 20 bp, Homo sapiens
gcaccttaccaactttctgt

SEQ ID NO: 4197306 - DNA, 20 bp, Homo sapiens
gcacgcggagtgagtttttt

SEQ ID NO: 4197307 - DNA, 23 bp, Homo sapiens
gcactaaaacccatcttccccgg

SEQ ID NO: 4197308 - DNA, 17 bp, Homo sapiens
gcactaattgacccaaa

SEQ ID NO: 4197309 - DNA, 13 bp, Homo sapiens
gcactacatgtgg

SEQ ID NO: 4197310 - DNA, 21 bp, Homo sapiens
gcactacatgtggtttataga

SEQ ID NO: 4197311 - DNA, 20 bp, Homo sapiens
gcactcacccatgtgccaag

SEQ ID NO: 4197312 - DNA, 23 bp, Homo sapiens
gcactcacccatgtgccaaggtg

SEQ ID NO: 4197313 - DNA, 22 bp, Homo sapiens
gcactcagaaaagaaaaccatt

SEQ ID NO: 4197314 - DNA, 23 bp, Homo sapiens
gcactcagtctagtgaagatgtt

SEQ ID NO: 4197315 - DNA, 11 bp, Homo sapiens
gcactccagaa

SEQ ID NO: 4197316 - DNA, 13 bp, Homo sapiens
gcactccagcctg

SEQ ID NO: 4197317 - DNA, 17 bp, Homo sapiens
gcactccggcctgatga

SEQ ID NO: 4197318 - DNA, 20 bp, Homo sapiens
gcactcctcggtactcccat

SEQ ID NO: 4197319 - DNA, 12 bp, Homo sapiens
gcactgacaaga

SEQ ID NO: 4197320 - DNA, 20 bp, Homo sapiens
gcactgccctccgcccttcc

SEQ ID NO: 4197321 - DNA, 17 bp, Homo sapiens
gcacttagctatcagaa

SEQ ID NO: 4197322 - DNA, 13 bp, Homo sapiens
gcacttggctcct

SEQ ID NO: 4197323 - DNA, 22 bp, Homo sapiens
gcactttaaccctctcttccct

SEQ ID NO: 4197324 - DNA, 15 bp, Homo sapiens
gcactttataaaagc

SEQ ID NO: 4197325 - DNA, 17 bp, Homo sapiens
gcactttataaaagcaa

SEQ ID NO: 4197326 - DNA, 16 bp, Homo sapiens
gcactttgggaggctg

SEQ ID NO: 4197327 - DNA, 13 bp, Homo sapiens
gcagaagggagaa

SEQ ID NO: 4197328 - DNA, 15 bp, Homo sapiens
gcagaagggagaagg

SEQ ID NO: 4197329 - DNA, 13 bp, Homo sapiens
gcagaatgggcca

SEQ ID NO: 4197330 - DNA, 17 bp, Homo sapiens
gcagaatgtttttaaaa

SEQ ID NO: 4197331 - DNA, 14 bp, Homo sapiens
gcagagagaagcct

SEQ ID NO: 4197332 - DNA, 15 bp, Homo sapiens
gccaggactgtgata

SEQ ID NO: 4197333 - DNA, 22 bp, Homo sapiens
gccaggcaggggtgggagagcc

SEQ ID NO: 4197334 - DNA, 15 bp, Homo sapiens
gccaggccaccagga

SEQ ID NO: 4197335 - DNA, 14 bp, Homo sapiens
gccaggctctgcct

SEQ ID NO: 4197336 - DNA, 21 bp, Homo sapiens
gccaggctgtaagcattctga

SEQ ID NO: 4197337 - DNA, 13 bp, Homo sapiens
gccagggccctgc

SEQ ID NO: 4197338 - DNA, 16 bp, Homo sapiens
gccagggccctgcaga

SEQ ID NO: 4197339 - DNA, 17 bp, Homo sapiens
gccagggccctgcagag

SEQ ID NO: 4197340 - DNA, 18 bp, Homo sapiens
gccaggggtctccctgga

SEQ ID NO: 4197341 - DNA, 21 bp, Homo sapiens
gccaggggtctccctggagtg

SEQ ID NO: 4197342 - DNA, 16 bp, Homo sapiens
gccagggtgagagctg

SEQ ID NO: 4197343 - DNA, 23 bp, Homo sapiens
gccagggtgagagctgctctgga

SEQ ID NO: 4197344 - DNA, 14 bp, Homo sapiens
gccaggtgcagtgg

SEQ ID NO: 4197345 - DNA, 17 bp, Homo sapiens
gccagtgggcctggtag

SEQ ID NO: 4197346 - DNA, 19 bp, Homo sapiens
gccagtgggcctggtagca

SEQ ID NO: 4197347 - DNA, 18 bp, Homo sapiens
gccatgatgcctctgtct

SEQ ID NO: 4197348 - DNA, 18 bp, Homo sapiens
gccatgctttccttttct

SEQ ID NO: 4197349 - DNA, 17 bp, Homo sapiens
gccatggcgtgtccctc

SEQ ID NO: 4197350 - DNA, 13 bp, Homo sapiens
gccatgggcctgc

SEQ ID NO: 4197351 - DNA, 16 bp, Homo sapiens
gccatgggcctgctgc

SEQ ID NO: 4197352 - DNA, 19 bp, Homo sapiens
gccatgtactcaagtacca

SEQ ID NO: 4197353 - DNA, 22 bp, Homo sapiens
gccattccaagtcaacactctt

SEQ ID NO: 4197354 - DNA, 15 bp, Homo sapiens
gccattcctgttctc

SEQ ID NO: 4197355 - DNA, 16 bp, Homo sapiens
gccattcctgttctct

SEQ ID NO: 4197356 - DNA, 21 bp, Homo sapiens
gccattcctgttctctttgcc

SEQ ID NO: 4197357 - DNA, 16 bp, Homo sapiens
gccattgtactccagc

SEQ ID NO: 4197358 - DNA, 23 bp, Homo sapiens
gccatttgcaccctccgccttca

SEQ ID NO: 4197359 - DNA, 17 bp, Homo sapiens
gcccaaagtctgtgtga

SEQ ID NO: 4197360 - DNA, 23 bp, Homo sapiens
gcccaacagacaccatcttttgt

SEQ ID NO: 4197361 - DNA, 13 bp, Homo sapiens
gcccaacctcctg

SEQ ID NO: 4197362 - DNA, 20 bp, Homo sapiens
gcccacaagccttactcacc

SEQ ID NO: 4197363 - DNA, 23 bp, Homo sapiens
gcccacaagccttactcacctct

SEQ ID NO: 4197364 - DNA, 11 bp, Homo sapiens
gcccacagagc

SEQ ID NO: 4197365 - DNA, 15 bp, Homo sapiens
gcccacagagcctgg

SEQ ID NO: 4197366 - DNA, 16 bp, Homo sapiens
gcccacagagcctggc

SEQ ID NO: 4197367 - DNA, 21 bp, Homo sapiens
gcccaccccttctccatcttt

SEQ ID NO: 4197368 - DNA, 18 bp, Homo sapiens
gcccacggggatcacagc

SEQ ID NO: 4197369 - DNA, 19 bp, Homo sapiens
gcccagcaggcaggcactg

SEQ ID NO: 4197370 - DNA, 15 bp, Homo sapiens
gcccagccagccagg

SEQ ID NO: 4197371 - DNA, 21 bp, Homo sapiens
gcccagccattaccatggaga

SEQ ID NO: 4197372 - DNA, 15 bp, Homo sapiens
gcccagcctagccca

SEQ ID NO: 4197373 - DNA, 12 bp, Homo sapiens
gcccagcctgga

SEQ ID NO: 4197374 - DNA, 14 bp, Homo sapiens
gcccagcctggagc

SEQ ID NO: 4197375 - DNA, 18 bp, Homo sapiens
gcccagcctggagcggag

SEQ ID NO: 4197376 - DNA, 12 bp, Homo sapiens
gcccagcctgtc

SEQ ID NO: 4197377 - DNA, 16 bp, Homo sapiens
gcccagcctgtcctgg

SEQ ID NO: 4197378 - DNA, 14 bp, Homo sapiens
gcccagctctttgt

SEQ ID NO: 4197379 - DNA, 18 bp, Homo sapiens
gcccagctgcacctgcca

SEQ ID NO: 4197380 - DNA, 24 bp, Homo sapiens
gcccagctgcacctgccagcctgg

SEQ ID NO: 4197381 - DNA, 19 bp, Homo sapiens
gcccaggggcccacaggga

SEQ ID NO: 4197382 - DNA, 18 bp, Homo sapiens
gcccagtcgtccgctcag

SEQ ID NO: 4197383 - DNA, 20 bp, Homo sapiens
gcccagtcgtccgctcagcc

SEQ ID NO: 4197384 - DNA, 21 bp, Homo sapiens
gcccagtcgtccgctcagcca

SEQ ID NO: 4197385 - DNA, 14 bp, Homo sapiens
gcccatcaaaatgt

SEQ ID NO: 4197386 - DNA, 17 bp, Homo sapiens
gcccatctctccagaga

SEQ ID NO: 4197387 - DNA, 16 bp, Homo sapiens
gcccattctgcatgcc

SEQ ID NO: 4197388 - DNA, 18 bp, Homo sapiens
gcccatttcaattctcaa

SEQ ID NO: 4197389 - DNA, 19 bp, Homo sapiens
gcccatttcaattctcaaa

SEQ ID NO: 4197390 - DNA, 20 bp, Homo sapiens
gcccatttcaattctcaaaa

SEQ ID NO: 4197391 - DNA, 21 bp, Homo sapiens
gccccaccctcgtggacacct

SEQ ID NO: 4197392 - DNA, 20 bp, Homo sapiens
gccccagaacaattctgcag

SEQ ID NO: 4197393 - DNA, 22 bp, Homo sapiens
gccccagaacaattctgcagag

SEQ ID NO: 4197394 - DNA, 14 bp, Homo sapiens
gccccagctctggc

SEQ ID NO: 4197395 - DNA, 22 bp, Homo sapiens
gccccatctcctcccatggcct

SEQ ID NO: 4197396 - DNA, 12 bp, Homo sapiens
gcccccacccag

SEQ ID NO: 4197397 - DNA, 23 bp, Homo sapiens
gcccccactttcctacaaaatgg

SEQ ID NO: 4197398 - DNA, 23 bp, Homo sapiens
gccccccacctttgggatcagcc

SEQ ID NO: 4197399 - DNA, 16 bp, Homo sapiens
gccccccatgccctcc

SEQ ID NO: 4197400 - DNA, 15 bp, Homo sapiens
gcccccctccaggca

SEQ ID NO: 4197401 - DNA, 20 bp, Homo sapiens
gcccccctccttgctctgca

SEQ ID NO: 4197402 - DNA, 18 bp, Homo sapiens
gcgcgggcggaggcggct

SEQ ID NO: 4197403 - DNA, 16 bp, Homo sapiens
gcgcgtccttccctaa

SEQ ID NO: 4197404 - DNA, 14 bp, Homo sapiens
gcgctcccgcattt

SEQ ID NO: 4197405 - DNA, 15 bp, Homo sapiens
gcggagagtacagtg

SEQ ID NO: 4197406 - DNA, 20 bp, Homo sapiens
gcgggcgcctgtagtcccag

SEQ ID NO: 4197407 - DNA, 21 bp, Homo sapiens
gcgggcggaggcggctccagg

SEQ ID NO: 4197408 - DNA, 21 bp, Homo sapiens
gcggggagaagatagggaaca

SEQ ID NO: 4197409 - DNA, 15 bp, Homo sapiens
gcggggcagagccac

SEQ ID NO: 4197410 - DNA, 16 bp, Homo sapiens
gcgggggagctggaaa

SEQ ID NO: 4197411 - DNA, 19 bp, Homo sapiens
gcgggtggatcacctgagg

SEQ ID NO: 4197412 - DNA, 17 bp, Homo sapiens
gcggtggtgccagaggt

SEQ ID NO: 4197413 - DNA, 23 bp, Homo sapiens
gcgtcctaaggcatgttgggata

SEQ ID NO: 4197414 - DNA, 11 bp, Homo sapiens
gcgtgcagatg

SEQ ID NO: 4197415 - DNA, 17 bp, Homo sapiens
gcgttacaacagtaaca

SEQ ID NO: 4197416 - DNA, 22 bp, Homo sapiens
gctaaatttttcttaatcaaga

SEQ ID NO: 4197417 - DNA, 20 bp, Homo sapiens
gctaattttttgttgtttct

SEQ ID NO: 4197418 - DNA, 19 bp, Homo sapiens
gctaatttttttgtatttt

SEQ ID NO: 4197419 - DNA, 21 bp, Homo sapiens
gctaatttttttgtattttag

SEQ ID NO: 4197420 - DNA, 15 bp, Homo sapiens
gctacctctgagaag

SEQ ID NO: 4197421 - DNA, 21 bp, Homo sapiens
gctactcagaagcctgaggct

SEQ ID NO: 4197422 - DNA, 12 bp, Homo sapiens
gctactcagcag

SEQ ID NO: 4197423 - DNA, 19 bp, Homo sapiens
gctactcagcagtaagcag

SEQ ID NO: 4197424 - DNA, 15 bp, Homo sapiens
gctagacacccattt

SEQ ID NO: 4197425 - DNA, 13 bp, Homo sapiens
gctagagaagggg

SEQ ID NO: 4197426 - DNA, 15 bp, Homo sapiens
gctaggcatgcctgg

SEQ ID NO: 4197427 - DNA, 20 bp, Homo sapiens
gctaggcgagtgccaggact

SEQ ID NO: 4197428 - DNA, 15 bp, Homo sapiens
gctagtctatggtca

SEQ ID NO: 4197429 - DNA, 19 bp, Homo sapiens
gctataggctggagaagct

SEQ ID NO: 4197430 - DNA, 13 bp, Homo sapiens
gctatggttttct

SEQ ID NO: 4197431 - DNA, 18 bp, Homo sapiens
gctatgtttttaatgtat

SEQ ID NO: 4197432 - DNA, 22 bp, Homo sapiens
gctatttgtttacatgcagatt

SEQ ID NO: 4197433 - DNA, 21 bp, Homo sapiens
gctcacacggggtattttagg

SEQ ID NO: 4197434 - DNA, 20 bp, Homo sapiens
gctcagcaatagggtgcagt

SEQ ID NO: 4197435 - DNA, 13 bp, Homo sapiens
gctcagcatgcag

SEQ ID NO: 4197436 - DNA, 19 bp, Homo sapiens
gctcagccctgactggtgc

SEQ ID NO: 4197437 - DNA, 20 bp, Homo sapiens
gctcagctactgatttttgt

SEQ ID NO: 4197438 - DNA, 20 bp, Homo sapiens
gctcaggaggcgaataaatg

SEQ ID NO: 4197439 - DNA, 22 bp, Homo sapiens
gctcaggaggcgaataaatgtt

SEQ ID NO: 4197440 - DNA, 13 bp, Homo sapiens
gctcaggaggctt

SEQ ID NO: 4197441 - DNA, 16 bp, Homo sapiens
gctcaggaggcttgga

SEQ ID NO: 4197442 - DNA, 20 bp, Homo sapiens
gctcagtctcaggagcatgg

SEQ ID NO: 4197443 - DNA, 21 bp, Homo sapiens
gctcagtctcaggagcatggg

SEQ ID NO: 4197444 - DNA, 10 bp, Homo sapiens
gctcatcact

SEQ ID NO: 4197445 - DNA, 15 bp, Homo sapiens
gctcatcactgtgcc

SEQ ID NO: 4197446 - DNA, 17 bp, Homo sapiens
gctccagatctgcactg

SEQ ID NO: 4197447 - DNA, 21 bp, Homo sapiens
gctccagatctgcactgggtg

SEQ ID NO: 4197448 - DNA, 20 bp, Homo sapiens
gctccaggtccggaggggtt

SEQ ID NO: 4197449 - DNA, 23 bp, Homo sapiens
gctccagtttccaagttcctgca

SEQ ID NO: 4197450 - DNA, 15 bp, Homo sapiens
gctcccactgcccct

SEQ ID NO: 4197451 - DNA, 19 bp, Homo sapiens
gctcccactgcccctgcac

SEQ ID NO: 4197452 - DNA, 22 bp, Homo sapiens
gctcccagggacacctgggaga

SEQ ID NO: 4197453 - DNA, 16 bp, Homo sapiens
gctcccctctcctccg

SEQ ID NO: 4197454 - DNA, 22 bp, Homo sapiens
gctcccgcatttctcatgcttc

SEQ ID NO: 4197455 - DNA, 23 bp, Homo sapiens
gctccggaggggacccagctcct

SEQ ID NO: 4197456 - DNA, 22 bp, Homo sapiens
gctcctaaacccccgctccaga

SEQ ID NO: 4197457 - DNA, 22 bp, Homo sapiens
ggaggcagtgctgatccggctg

SEQ ID NO: 4197458 - DNA, 23 bp, Homo sapiens
ggaggccctgtgccccttgacaa

SEQ ID NO: 4197459 - DNA, 21 bp, Homo sapiens
ggaggcctcgtaccagccagg

SEQ ID NO: 4197460 - DNA, 18 bp, Homo sapiens
ggaggcgaataaatgttc

SEQ ID NO: 4197461 - DNA, 16 bp, Homo sapiens
ggaggctgaggcagga

SEQ ID NO: 4197462 - DNA, 23 bp, Homo sapiens
ggagggcaagggccatgctgaag

SEQ ID NO: 4197463 - DNA, 18 bp, Homo sapiens
ggaggggatggcagacag

SEQ ID NO: 4197464 - DNA, 21 bp, Homo sapiens
ggagggggacgcgcacacaca

SEQ ID NO: 4197465 - DNA, 18 bp, Homo sapiens
ggagggtaacagaagagg

SEQ ID NO: 4197466 - DNA, 21 bp, Homo sapiens
ggagggtgcagtatctcttgc

SEQ ID NO: 4197467 - DNA, 20 bp, Homo sapiens
ggaggtcacattcaggaaga

SEQ ID NO: 4197468 - DNA, 21 bp, Homo sapiens
ggaggtctccactgaggatgt

SEQ ID NO: 4197469 - DNA, 15 bp, Homo sapiens
ggaggtggcagccct

SEQ ID NO: 4197470 - DNA, 17 bp, Homo sapiens
ggaggttgcagggagcc

SEQ ID NO: 4197471 - DNA, 13 bp, Homo sapiens
ggagtctgcagtg

SEQ ID NO: 4197472 - DNA, 20 bp, Homo sapiens
ggagtgagtttaggcagctt

SEQ ID NO: 4197473 - DNA, 14 bp, Homo sapiens
ggagttccatgaag

SEQ ID NO: 4197474 - DNA, 18 bp, Homo sapiens
ggagttcgagaccagcct

SEQ ID NO: 4197475 - DNA, 13 bp, Homo sapiens
ggagtttgaggct

SEQ ID NO: 4197476 - DNA, 16 bp, Homo sapiens
ggagttttttgtacca

SEQ ID NO: 4197477 - DNA, 15 bp, Homo sapiens
ggataattaaatata

SEQ ID NO: 4197478 - DNA, 16 bp, Homo sapiens
ggatcacagcgtttca

SEQ ID NO: 4197479 - DNA, 13 bp, Homo sapiens
ggatcactggagc

SEQ ID NO: 4197480 - DNA, 20 bp, Homo sapiens
ggatcacttgggcccaggag

SEQ ID NO: 4197481 - DNA, 18 bp, Homo sapiens
ggatcagaagtaggaagg

SEQ ID NO: 4197482 - DNA, 11 bp, Homo sapiens
ggatcagcctc

SEQ ID NO: 4197483 - DNA, 18 bp, Homo sapiens
ggatccagttagcaacaa

SEQ ID NO: 4197484 - DNA, 21 bp, Homo sapiens
ggatcctattctcaccaggaa

SEQ ID NO: 4197485 - DNA, 23 bp, Homo sapiens
ggatcctattctcaccaggaagg

SEQ ID NO: 4197486 - DNA, 18 bp, Homo sapiens
ggatcctggaaccactga

SEQ ID NO: 4197487 - DNA, 13 bp, Homo sapiens
ggatctccaagga

SEQ ID NO: 4197488 - DNA, 15 bp, Homo sapiens
ggatctgtccaagga

SEQ ID NO: 4197489 - DNA, 16 bp, Homo sapiens
ggatcttgcattccca

SEQ ID NO: 4197490 - DNA, 22 bp, Homo sapiens
ggatcttgcattcccagtggtc

SEQ ID NO: 4197491 - DNA, 16 bp, Homo sapiens
ggatgagagtggctta

SEQ ID NO: 4197492 - DNA, 20 bp, Homo sapiens
ggatgccaagtggccctcag

SEQ ID NO: 4197493 - DNA, 14 bp, Homo sapiens
ggatgcggggcaga

SEQ ID NO: 4197494 - DNA, 22 bp, Homo sapiens
ggatgtgaattgcctgcagaga

SEQ ID NO: 4197495 - DNA, 18 bp, Homo sapiens
ggatgtgtgtctcacccc

SEQ ID NO: 4197496 - DNA, 22 bp, Homo sapiens
ggattaatggtcctgtgatgct

SEQ ID NO: 4197497 - DNA, 13 bp, Homo sapiens
ggattaatttatt

SEQ ID NO: 4197498 - DNA, 14 bp, Homo sapiens
ggattggcctgtgt

SEQ ID NO: 4197499 - DNA, 21 bp, Homo sapiens
ggatttgaggagcagcttcag

SEQ ID NO: 4197500 - DNA, 12 bp, Homo sapiens
ggattttgagta

SEQ ID NO: 4197501 - DNA, 17 bp, Homo sapiens
ggattttgtgttttttc

SEQ ID NO: 4197502 - DNA, 19 bp, Homo sapiens
ggcaaaccatttcaaatgg

SEQ ID NO: 4197503 - DNA, 20 bp, Homo sapiens
ggcaaagaactgccccatct

SEQ ID NO: 4197504 - DNA, 16 bp, Homo sapiens
ggcaaaggtcaagact

SEQ ID NO: 4197505 - DNA, 20 bp, Homo sapiens
ggcaaaggtggctctccagt

SEQ ID NO: 4197506 - DNA, 15 bp, Homo sapiens
ggcaaggggtttcca

SEQ ID NO: 4197507 - DNA, 23 bp, Homo sapiens
ggcaagtccctgactctctgtga

SEQ ID NO: 4197508 - DNA, 20 bp, Homo sapiens
ggcaagtggatggcccagca

SEQ ID NO: 4197509 - DNA, 18 bp, Homo sapiens
ggcaatttcctggccctc

SEQ ID NO: 4197510 - DNA, 23 bp, Homo sapiens
ggcacaaaattctagaagcagaa

SEQ ID NO: 4197511 - DNA, 18 bp, Homo sapiens
ggcacagcggggccccag

SEQ ID NO: 4197512 - DNA, 16 bp, Homo sapiens
ggcacatgcaggtagt

SEQ ID NO: 4197513 - DNA, 22 bp, Homo sapiens
ggcacattttacttagctggag

SEQ ID NO: 4197514 - DNA, 23 bp, Homo sapiens
ggcaccactagggtcctggccct

SEQ ID NO: 4197515 - DNA, 19 bp, Homo sapiens
ggcacctatagtcccagct

SEQ ID NO: 4197516 - DNA, 12 bp, Homo sapiens
ggcacctgctgg

SEQ ID NO: 4197517 - DNA, 19 bp, Homo sapiens
ggcacgccaacagcccccc

SEQ ID NO: 4197518 - DNA, 14 bp, Homo sapiens
ggcactgctgagga

SEQ ID NO: 4197519 - DNA, 15 bp, Homo sapiens
ggcactgtggccctt

SEQ ID NO: 4197520 - DNA, 14 bp, Homo sapiens
ggcagaaagtggcc

SEQ ID NO: 4197521 - DNA, 18 bp, Homo sapiens
ggcagagaaagaagagac

SEQ ID NO: 4197522 - DNA, 13 bp, Homo sapiens
ggcagagcacagc

SEQ ID NO: 4197523 - DNA, 17 bp, Homo sapiens
ggcagagcacagcccac

SEQ ID NO: 4197524 - DNA, 16 bp, Homo sapiens
ggcagagccgggaagc

SEQ ID NO: 4197525 - DNA, 22 bp, Homo sapiens
ggcagagcctttggatgaccag

SEQ ID NO: 4197526 - DNA, 15 bp, Homo sapiens
ggcagataatcagcc

SEQ ID NO: 4197527 - DNA, 19 bp, Homo sapiens
ggcagataatcagcctctt

SEQ ID NO: 4197528 - DNA, 17 bp, Homo sapiens
ggcagcatccccttgaa

SEQ ID NO: 4197529 - DNA, 21 bp, Homo sapiens
ggcagcatgaattccaactca

SEQ ID NO: 4197530 - DNA, 22 bp, Homo sapiens
ggcagcctgccgccgtctctgt

SEQ ID NO: 4197531 - DNA, 13 bp, Homo sapiens
ggcagctgtagct

SEQ ID NO: 4197532 - DNA, 14 bp, Homo sapiens
ggcagcttctctgt

SEQ ID NO: 4197533 - DNA, 19 bp, Homo sapiens
ggcaggagaatcaataaaa

SEQ ID NO: 4197534 - DNA, 18 bp, Homo sapiens
ggcaggcactgtggccct

SEQ ID NO: 4197535 - DNA, 20 bp, Homo sapiens
ggcaggcagatcacaaggtc

SEQ ID NO: 4197536 - DNA, 18 bp, Homo sapiens
ggcaggcaggctcccagg

SEQ ID NO: 4197537 - DNA, 14 bp, Homo sapiens
ggcagggagagcgc

SEQ ID NO: 4197538 - DNA, 16 bp, Homo sapiens
ggcagggagagcgcct

SEQ ID NO: 4197539 - DNA, 15 bp, Homo sapiens
ggcagggcaaaggtc

SEQ ID NO: 4197540 - DNA, 22 bp, Homo sapiens
ggcagtaggaacccagctctca

SEQ ID NO: 4197541 - DNA, 22 bp, Homo sapiens
ggcagtgctgatccggctgctc

SEQ ID NO: 4197542 - DNA, 22 bp, Homo sapiens
ggcatagagggagaggaagcac

SEQ ID NO: 4197543 - DNA, 16 bp, Homo sapiens
ggcatcacagggcaga

SEQ ID NO: 4197544 - DNA, 23 bp, Homo sapiens
ggcatccctgtgttaactcagga

SEQ ID NO: 4197545 - DNA, 12 bp, Homo sapiens
ggcatgctgggg

SEQ ID NO: 4197546 - DNA, 13 bp, Homo sapiens
ggcattcctgctt

SEQ ID NO: 4197547 - DNA, 16 bp, Homo sapiens
ggcattggtctgctga

SEQ ID NO: 4197548 - DNA, 15 bp, Homo sapiens
ggccaagcctggccc

SEQ ID NO: 4197549 - DNA, 22 bp, Homo sapiens
ggccaagcgggggcgtggctgg

SEQ ID NO: 4197550 - DNA, 16 bp, Homo sapiens
ggccacatcaacttta

SEQ ID NO: 4197551 - DNA, 21 bp, Homo sapiens
ccagcaaagagtgggctgcat

SEQ ID NO: 4197552 - DNA, 21 bp, Homo sapiens
ccagcaacacaagctggaagc

SEQ ID NO: 4197553 - DNA, 20 bp, Homo sapiens
ccagcacaactcagtctgtg

SEQ ID NO: 4197554 - DNA, 12 bp, Homo sapiens
ccagcaccgagc

SEQ ID NO: 4197555 - DNA, 17 bp, Homo sapiens
ccagcactttgggaggc

SEQ ID NO: 4197556 - DNA, 21 bp, Homo sapiens
ccagcaggcaggcactgtggc

SEQ ID NO: 4197557 - DNA, 24 bp, Homo sapiens
ccagcaggcaggcactgtggccct

SEQ ID NO: 4197558 - DNA, 19 bp, Homo sapiens
ccagcatccttttctgcag

SEQ ID NO: 4197559 - DNA, 21 bp, Homo sapiens
ccagcatccttttctgcagag

SEQ ID NO: 4197560 - DNA, 14 bp, Homo sapiens
ccagcatttgccat

SEQ ID NO: 4197561 - DNA, 14 bp, Homo sapiens
ccagccagccagga

SEQ ID NO: 4197562 - DNA, 18 bp, Homo sapiens
ccagccaggaactggctc

SEQ ID NO: 4197563 - DNA, 18 bp, Homo sapiens
ccagccctttgcaggccc

SEQ ID NO: 4197564 - DNA, 14 bp, Homo sapiens
ccagcctgactgca

SEQ ID NO: 4197565 - DNA, 17 bp, Homo sapiens
ccagcctggcttctgga

SEQ ID NO: 4197566 - DNA, 20 bp, Homo sapiens
ccagcctggcttctggagcc

SEQ ID NO: 4197567 - DNA, 21 bp, Homo sapiens
ccagcctggcttctggagccc

SEQ ID NO: 4197568 - DNA, 14 bp, Homo sapiens
ccagcctgtcctgg

SEQ ID NO: 4197569 - DNA, 16 bp, Homo sapiens
ccagcctgtcctggta

SEQ ID NO: 4197570 - DNA, 19 bp, Homo sapiens
ccagcgtgtgtatccgact

SEQ ID NO: 4197571 - DNA, 18 bp, Homo sapiens
ccagctacccaggaggct

SEQ ID NO: 4197572 - DNA, 21 bp, Homo sapiens
ccagctactcagaagcctgag

SEQ ID NO: 4197573 - DNA, 23 bp, Homo sapiens
ccagctactcagaagcctgaggc

SEQ ID NO: 4197574 - DNA, 14 bp, Homo sapiens
ccagctccagtttc

SEQ ID NO: 4197575 - DNA, 18 bp, Homo sapiens
ccagctcctctgagccat

SEQ ID NO: 4197576 - DNA, 21 bp, Homo sapiens
ccagctcctctgagccatacc

SEQ ID NO: 4197577 - DNA, 12 bp, Homo sapiens
ccagctctcagg

SEQ ID NO: 4197578 - DNA, 14 bp, Homo sapiens
ccagctctctctac

SEQ ID NO: 4197579 - DNA, 14 bp, Homo sapiens
ccagctctggcttc

SEQ ID NO: 4197580 - DNA, 16 bp, Homo sapiens
ccagctctttgttcag

SEQ ID NO: 4197581 - DNA, 20 bp, Homo sapiens
ccagctgcacctgccagcct

SEQ ID NO: 4197582 - DNA, 22 bp, Homo sapiens
ccagctgcacctgccagcctgg

SEQ ID NO: 4197583 - DNA, 19 bp, Homo sapiens
ccagctgcggcatccctgt

SEQ ID NO: 4197584 - DNA, 22 bp, Homo sapiens
ccagctgcggcatccctgtgtt

SEQ ID NO: 4197585 - DNA, 15 bp, Homo sapiens
ccagcttctccaggc

SEQ ID NO: 4197586 - DNA, 16 bp, Homo sapiens
ccagcttctccaggct

SEQ ID NO: 4197587 - DNA, 18 bp, Homo sapiens
ccagcttctccaggctct

SEQ ID NO: 4197588 - DNA, 18 bp, Homo sapiens
ccagctttttctctcagg

SEQ ID NO: 4197589 - DNA, 22 bp, Homo sapiens
ccaggaacacccgactcctcaa

SEQ ID NO: 4197590 - DNA, 16 bp, Homo sapiens
ccaggaactggctcct

SEQ ID NO: 4197591 - DNA, 19 bp, Homo sapiens
ccaggactatagcccaggt

SEQ ID NO: 4197592 - DNA, 19 bp, Homo sapiens
ccaggactccccaggccag

SEQ ID NO: 4197593 - DNA, 20 bp, Homo sapiens
ccaggagctctctgctgagc

SEQ ID NO: 4197594 - DNA, 21 bp, Homo sapiens
ccaggagctctctgctgagca

SEQ ID NO: 4197595 - DNA, 13 bp, Homo sapiens
ccaggaggctgag

SEQ ID NO: 4197596 - DNA, 17 bp, Homo sapiens
ccaggaggctgaggcag

SEQ ID NO: 4197597 - DNA, 14 bp, Homo sapiens
ccaggagggtaaca

SEQ ID NO: 4197598 - DNA, 17 bp, Homo sapiens
ccaggagggtaacagaa

SEQ ID NO: 4197599 - DNA, 22 bp, Homo sapiens
ccaggagggtaacagaagagga

SEQ ID NO: 4197600 - DNA, 16 bp, Homo sapiens
ccaggaggtcaagcct

SEQ ID NO: 4197601 - DNA, 18 bp, Homo sapiens
ccaggaggtcgaccccaa

SEQ ID NO: 4197602 - DNA, 16 bp, Homo sapiens
ccaggagttgacgcat

SEQ ID NO: 4197603 - DNA, 19 bp, Homo sapiens
ccaggagttgacgcatcct

SEQ ID NO: 4197604 - DNA, 23 bp, Homo sapiens
ccaggagttgacgcatcctgcag

SEQ ID NO: 4197605 - DNA, 22 bp, Homo sapiens
ccaggagtttgaggctgcagcg

SEQ ID NO: 4197606 - DNA, 13 bp, Homo sapiens
ccaggatctttga

SEQ ID NO: 4197607 - DNA, 20 bp, Homo sapiens
ccaggatctttgactgaaaa

SEQ ID NO: 4197608 - DNA, 23 bp, Homo sapiens
ccaggatggcccttcccactgga

SEQ ID NO: 4197609 - DNA, 14 bp, Homo sapiens
ccaggatggtctgg

SEQ ID NO: 4197610 - DNA, 15 bp, Homo sapiens
ccaggatggtctgga

SEQ ID NO: 4197611 - DNA, 17 bp, Homo sapiens
cccagctacccaggagg

SEQ ID NO: 4197612 - DNA, 12 bp, Homo sapiens
cccagctcctct

SEQ ID NO: 4197613 - DNA, 15 bp, Homo sapiens
cccagctcctctgag

SEQ ID NO: 4197614 - DNA, 12 bp, Homo sapiens
cccagctctcag

SEQ ID NO: 4197615 - DNA, 13 bp, Homo sapiens
cccagctctcagg

SEQ ID NO: 4197616 - DNA, 16 bp, Homo sapiens
cccagctctcagggct

SEQ ID NO: 4197617 - DNA, 18 bp, Homo sapiens
cccagctgcacctgccag

SEQ ID NO: 4197618 - DNA, 21 bp, Homo sapiens
cccagctgcacctgccagcct

SEQ ID NO: 4197619 - DNA, 22 bp, Homo sapiens
cccagctgcacctgccagcctg

SEQ ID NO: 4197620 - DNA, 12 bp, Homo sapiens
cccagctgcaga

SEQ ID NO: 4197621 - DNA, 14 bp, Homo sapiens
cccagcttgctgag

SEQ ID NO: 4197622 - DNA, 23 bp, Homo sapiens
cccagcttgctgaggggcaggga

SEQ ID NO: 4197623 - DNA, 20 bp, Homo sapiens
cccaggaggctgaggcagga

SEQ ID NO: 4197624 - DNA, 17 bp, Homo sapiens
cccaggccaggccacca

SEQ ID NO: 4197625 - DNA, 22 bp, Homo sapiens
cccagggccagggccctgcaga

SEQ ID NO: 4197626 - DNA, 21 bp, Homo sapiens
cccagggctaccctcccccag

SEQ ID NO: 4197627 - DNA, 22 bp, Homo sapiens
cccagggctccctcctggagca

SEQ ID NO: 4197628 - DNA, 18 bp, Homo sapiens
cccaggggcccacaggga

SEQ ID NO: 4197629 - DNA, 15 bp, Homo sapiens
cccaggtcctctgat

SEQ ID NO: 4197630 - DNA, 14 bp, Homo sapiens
cccagtctggaaga

SEQ ID NO: 4197631 - DNA, 23 bp, Homo sapiens
cccatctcaggccagagccaagg

SEQ ID NO: 4197632 - DNA, 13 bp, Homo sapiens
cccatctccccct

SEQ ID NO: 4197633 - DNA, 15 bp, Homo sapiens
cccatctcctcccat

SEQ ID NO: 4197634 - DNA, 18 bp, Homo sapiens
cccatctctccagagagc

SEQ ID NO: 4197635 - DNA, 19 bp, Homo sapiens
cccatctgaaccactttgc

SEQ ID NO: 4197636 - DNA, 19 bp, Homo sapiens
cccatctgtagtaatttat

SEQ ID NO: 4197637 - DNA, 22 bp, Homo sapiens
cccatgaagacaggacagtgct

SEQ ID NO: 4197638 - DNA, 19 bp, Homo sapiens
cccatgcacctcagggcca

SEQ ID NO: 4197639 - DNA, 21 bp, Homo sapiens
cccatgcacctcagggccaag

SEQ ID NO: 4197640 - DNA, 20 bp, Homo sapiens
cccatggccttccctcccca

SEQ ID NO: 4197641 - DNA, 17 bp, Homo sapiens
cccatgtgacttttatc

SEQ ID NO: 4197642 - DNA, 13 bp, Homo sapiens
cccatgtgccaag

SEQ ID NO: 4197643 - DNA, 20 bp, Homo sapiens
ccccaaactgtgccctgcct

SEQ ID NO: 4197644 - DNA, 22 bp, Homo sapiens
ccccaaagagcctggagaagct

SEQ ID NO: 4197645 - DNA, 20 bp, Homo sapiens
ccccaactacccccagctgt

SEQ ID NO: 4197646 - DNA, 12 bp, Homo sapiens
ccccacagtcct

SEQ ID NO: 4197647 - DNA, 18 bp, Homo sapiens
ccccacattggacttcct

SEQ ID NO: 4197648 - DNA, 20 bp, Homo sapiens
ccccacatttacctcgaggc

SEQ ID NO: 4197649 - DNA, 22 bp, Homo sapiens
ccccaccctcgtggacacctgc

SEQ ID NO: 4197650 - DNA, 23 bp, Homo sapiens
ccccaccctcgtggacacctgcc

SEQ ID NO: 4197651 - DNA, 16 bp, Homo sapiens
ccccaccttccccaga

SEQ ID NO: 4197652 - DNA, 17 bp, Homo sapiens
ccccaccttccccagac

SEQ ID NO: 4197653 - DNA, 14 bp, Homo sapiens
ccccactccccacc

SEQ ID NO: 4197654 - DNA, 15 bp, Homo sapiens
ccccagagccactac

SEQ ID NO: 4197655 - DNA, 21 bp, Homo sapiens
ccccagagccactacctttgt

SEQ ID NO: 4197656 - DNA, 22 bp, Homo sapiens
ccccagagccactacctttgtc

SEQ ID NO: 4197657 - DNA, 20 bp, Homo sapiens
ccccagctagcgtctcggcc

SEQ ID NO: 4197658 - DNA, 17 bp, Homo sapiens
ccccagctctggcttcc

SEQ ID NO: 4197659 - DNA, 18 bp, Homo sapiens
ccccaggagctctctgct

SEQ ID NO: 4197660 - DNA, 22 bp, Homo sapiens
ccccaggagctctctgctgagc

SEQ ID NO: 4197661 - DNA, 15 bp, Homo sapiens
ccccagtgccacaga

SEQ ID NO: 4197662 - DNA, 13 bp, Homo sapiens
ccccatctcaggc

SEQ ID NO: 4197663 - DNA, 16 bp, Homo sapiens
ccccatgccctccctg

SEQ ID NO: 4197664 - DNA, 20 bp, Homo sapiens
ccccatggccccaggcccac

SEQ ID NO: 4197665 - DNA, 21 bp, Homo sapiens
ccccattaccagcatttacta

SEQ ID NO: 4197666 - DNA, 17 bp, Homo sapiens
ccccattagagtcagcc

SEQ ID NO: 4197667 - DNA, 15 bp, Homo sapiens
cccccaccactagga

SEQ ID NO: 4197668 - DNA, 16 bp, Homo sapiens
cccccagtgccacaga

SEQ ID NO: 4197669 - DNA, 19 bp, Homo sapiens
cccccatgccctccctgct

SEQ ID NO: 4197670 - DNA, 13 bp, Homo sapiens
cccccctccaggc

SEQ ID NO: 4197671 - DNA, 18 bp, Homo sapiens
cccccgacagcccagcct

SEQ ID NO: 4197672 - DNA, 14 bp, Homo sapiens
cccccgctccagat

SEQ ID NO: 4197673 - DNA, 12 bp, Homo sapiens
ccccctccagct

SEQ ID NO: 4197674 - DNA, 13 bp, Homo sapiens
ccccctccagctc

SEQ ID NO: 4197675 - DNA, 16 bp, Homo sapiens
ccccctccaggcatgc

SEQ ID NO: 4197676 - DNA, 13 bp, Homo sapiens
ccccctcccaggg

SEQ ID NO: 4197677 - DNA, 15 bp, Homo sapiens
ccccctccttgctct

SEQ ID NO: 4197678 - DNA, 23 bp, Homo sapiens
ccccctggtggacagtcctggga

SEQ ID NO: 4197679 - DNA, 15 bp, Homo sapiens
ccccgacagcccagc

SEQ ID NO: 4197680 - DNA, 16 bp, Homo sapiens
ccccgacagcccagcc

SEQ ID NO: 4197681 - DNA, 17 bp, Homo sapiens
ccccgcccagctgcacc

SEQ ID NO: 4197682 - DNA, 23 bp, Homo sapiens
ccccgcccagctgcacctgccag

SEQ ID NO: 4197683 - DNA, 17 bp, Homo sapiens
ccccgcctgtcctgcct

SEQ ID NO: 4197684 - DNA, 13 bp, Homo sapiens
ccccgctccagat

SEQ ID NO: 4197685 - DNA, 16 bp, Homo sapiens
ccccggcctctctctt

SEQ ID NO: 4197686 - DNA, 17 bp, Homo sapiens
ccccgggggaggaaggg

SEQ ID NO: 4197687 - DNA, 15 bp, Homo sapiens
cccctcatgtgtgct

SEQ ID NO: 4197688 - DNA, 11 bp, Homo sapiens
cccctccaggc

SEQ ID NO: 4197689 - DNA, 20 bp, Homo sapiens
cccctccaggcatgctggcc

SEQ ID NO: 4197690 - DNA, 14 bp, Homo sapiens
cccctgccctgctg

SEQ ID NO: 4197691 - DNA, 15 bp, Homo sapiens
cccctggagagaagt

SEQ ID NO: 4197692 - DNA, 13 bp, Homo sapiens
cccctgggctctg

SEQ ID NO: 4197693 - DNA, 15 bp, Homo sapiens
cccctgggctctgcc

SEQ ID NO: 4197694 - DNA, 21 bp, Homo sapiens
cccctgggctctgccccagct

SEQ ID NO: 4197695 - DNA, 15 bp, Homo sapiens
cccctggtcctgcac

SEQ ID NO: 4197696 - DNA, 18 bp, Homo sapiens
gggagggaatgggacagg

SEQ ID NO: 4197697 - DNA, 23 bp, Homo sapiens
gggatagccatttccatggctct

SEQ ID NO: 4197698 - DNA, 18 bp, Homo sapiens
gggatcttgcattcccag

SEQ ID NO: 4197699 - DNA, 15 bp, Homo sapiens
gggatgactgtgatt

SEQ ID NO: 4197700 - DNA, 14 bp, Homo sapiens
gggatgagagtggc

SEQ ID NO: 4197701 - DNA, 12 bp, Homo sapiens
gggatggcagac

SEQ ID NO: 4197702 - DNA, 15 bp, Homo sapiens
gggatggtcctgggg

SEQ ID NO: 4197703 - DNA, 19 bp, Homo sapiens
gggattctggtcttcactg

SEQ ID NO: 4197704 - DNA, 17 bp, Homo sapiens
gggcaaaccatttcaaa

SEQ ID NO: 4197705 - DNA, 19 bp, Homo sapiens
gggcaagtggatggcccag

SEQ ID NO: 4197706 - DNA, 21 bp, Homo sapiens
gggcacaaaattctagaagca

SEQ ID NO: 4197707 - DNA, 15 bp, Homo sapiens
gggcactgctgagga

SEQ ID NO: 4197708 - DNA, 15 bp, Homo sapiens
gggcagaaagtggcc

SEQ ID NO: 4197709 - DNA, 19 bp, Homo sapiens
gggcagaagggagaaggat

SEQ ID NO: 4197710 - DNA, 17 bp, Homo sapiens
gggcagaaggggaagat

SEQ ID NO: 4197711 - DNA, 23 bp, Homo sapiens
gggcagccccgacccctgtccag

SEQ ID NO: 4197712 - DNA, 22 bp, Homo sapiens
gggcagggagagcgcctcttcc

SEQ ID NO: 4197713 - DNA, 14 bp, Homo sapiens
gggcatgctggggc

SEQ ID NO: 4197714 - DNA, 22 bp, Homo sapiens
gggcatggacgttcggggcatg

SEQ ID NO: 4197715 - DNA, 23 bp, Homo sapiens
gggcatgtttgtctgtgtgctgt

SEQ ID NO: 4197716 - DNA, 17 bp, Homo sapiens
gggccactctcccctcc

SEQ ID NO: 4197717 - DNA, 18 bp, Homo sapiens
gggccactctcccctccc

SEQ ID NO: 4197718 - DNA, 20 bp, Homo sapiens
gggccagatgattttcctcc

SEQ ID NO: 4197719 - DNA, 18 bp, Homo sapiens
gggccagtgagggctggg

SEQ ID NO: 4197720 - DNA, 15 bp, Homo sapiens
gggccatgctgaagg

SEQ ID NO: 4197721 - DNA, 14 bp, Homo sapiens
gggcccacagagcc

SEQ ID NO: 4197722 - DNA, 17 bp, Homo sapiens
gggcccacagagcctgg

SEQ ID NO: 4197723 - DNA, 18 bp, Homo sapiens
gggcccacagagcctggc

SEQ ID NO: 4197724 - DNA, 19 bp, Homo sapiens
gggcccacagagcctggct

SEQ ID NO: 4197725 - DNA, 15 bp, Homo sapiens
gggcccccctccttg

SEQ ID NO: 4197726 - DNA, 19 bp, Homo sapiens
gggcccccctccttgctct

SEQ ID NO: 4197727 - DNA, 15 bp, Homo sapiens
gggccctgcagaggg

SEQ ID NO: 4197728 - DNA, 19 bp, Homo sapiens
gggccctggtccttccagg

SEQ ID NO: 4197729 - DNA, 19 bp, Homo sapiens
gtagtaatttattgtctgt

SEQ ID NO: 4197730 - DNA, 24 bp, Homo sapiens
gtagtaatttattgtctgtctaca

SEQ ID NO: 4197731 - DNA, 17 bp, Homo sapiens
gtagtagccctttctgt

SEQ ID NO: 4197732 - DNA, 21 bp, Homo sapiens
gtagtagccctttctgtgtgc

SEQ ID NO: 4197733 - DNA, 16 bp, Homo sapiens
gtagtaggcattttta

SEQ ID NO: 4197734 - DNA, 12 bp, Homo sapiens
gtagtcccagcc

SEQ ID NO: 4197735 - DNA, 14 bp, Homo sapiens
gtagttaggaaata

SEQ ID NO: 4197736 - DNA, 16 bp, Homo sapiens
gtagttaggaaataaa

SEQ ID NO: 4197737 - DNA, 13 bp, Homo sapiens
gtataaactatca

SEQ ID NO: 4197738 - DNA, 17 bp, Homo sapiens
gtataaactatcagttt

SEQ ID NO: 4197739 - DNA, 17 bp, Homo sapiens
gtataaatggttgtctg

SEQ ID NO: 4197740 - DNA, 20 bp, Homo sapiens
gtataacttcttaaaagttg

SEQ ID NO: 4197741 - DNA, 18 bp, Homo sapiens
gtataatcccacccacct

SEQ ID NO: 4197742 - DNA, 15 bp, Homo sapiens
gtatagagatatgca

SEQ ID NO: 4197743 - DNA, 17 bp, Homo sapiens
gtatagtagaaaggcca

SEQ ID NO: 4197744 - DNA, 14 bp, Homo sapiens
gtatagtgtaaaat

SEQ ID NO: 4197745 - DNA, 15 bp, Homo sapiens
gtatatactatacaa

SEQ ID NO: 4197746 - DNA, 20 bp, Homo sapiens
gtatataggccttccgccag

SEQ ID NO: 4197747 - DNA, 14 bp, Homo sapiens
gtatatcagaaaag

SEQ ID NO: 4197748 - DNA, 15 bp, Homo sapiens
gtatattacctcaaa

SEQ ID NO: 4197749 - DNA, 16 bp, Homo sapiens
gtatattatgtattta

SEQ ID NO: 4197750 - DNA, 15 bp, Homo sapiens
gtgtgtgtctgtgcg

SEQ ID NO: 4197751 - DNA, 18 bp, Homo sapiens
gtgttccagctgcctggg

SEQ ID NO: 4197752 - DNA, 15 bp, Homo sapiens
gtgttgatcccaaga

SEQ ID NO: 4197753 - DNA, 18 bp, Homo sapiens
gtgttgcgtgtcgtgggt

SEQ ID NO: 4197754 - DNA, 12 bp, Homo sapiens
gtgttggaagcc

SEQ ID NO: 4197755 - DNA, 15 bp, Homo sapiens
gtgtttaacattcac

SEQ ID NO: 4197756 - DNA, 20 bp, Homo sapiens
gtgtttaacattcacagccc

SEQ ID NO: 4197757 - DNA, 23 bp, Homo sapiens
gtgtttaacattcacagcccaga

SEQ ID NO: 4197758 - DNA, 21 bp, Homo sapiens
tgcagaggggctttctggaga

SEQ ID NO: 4197759 - DNA, 15 bp, Homo sapiens
tgcagcaactcccac

SEQ ID NO: 4197760 - DNA, 20 bp, Homo sapiens
tgcagcaactcccacgactg

SEQ ID NO: 4197761 - DNA, 11 bp, Homo sapiens
tgcagcacttt

SEQ ID NO: 4197762 - DNA, 15 bp, Homo sapiens
tgcagcctggtagaa

SEQ ID NO: 4197763 - DNA, 20 bp, Homo sapiens
tgcagctcaagagatcccaa

SEQ ID NO: 4197764 - DNA, 19 bp, Homo sapiens
tgcagctgcaccatcacac

SEQ ID NO: 4197765 - DNA, 23 bp, Homo sapiens
tgcagctgcaccatcacacatgc

SEQ ID NO: 4197766 - DNA, 15 bp, Homo sapiens
tgcagctttacatgc

SEQ ID NO: 4197767 - DNA, 21 bp, Homo sapiens
tgcaggccaagagcagaggca

SEQ ID NO: 4197768 - DNA, 14 bp, Homo sapiens
tgcaggcccagcag

SEQ ID NO: 4197769 - DNA, 15 bp, Homo sapiens
tgcagggctgctgtg

SEQ ID NO: 4197770 - DNA, 16 bp, Homo sapiens
tgcagggctgctgtgg

SEQ ID NO: 4197771 - DNA, 18 bp, Homo sapiens
tgcagggctgctgtggcc

SEQ ID NO: 4197772 - DNA, 21 bp, Homo sapiens
tgcagggctgctgtggcccag

SEQ ID NO: 4197773 - DNA, 14 bp, Homo sapiens
tgcaggtgcctggc

SEQ ID NO: 4197774 - DNA, 14 bp, Homo sapiens
tgcagtcagtgtca

SEQ ID NO: 4197775 - DNA, 21 bp, Homo sapiens
tgcagtcttaccaatgacttt

SEQ ID NO: 4197776 - DNA, 18 bp, Homo sapiens
tgcagtgacgtgcacctg

SEQ ID NO: 4197777 - DNA, 22 bp, Homo sapiens
tgcagtgacgtgcacctgtact

SEQ ID NO: 4197778 - DNA, 15 bp, Homo sapiens
tgcagtgagctgaga

SEQ ID NO: 4197779 - DNA, 19 bp, Homo sapiens
tgcagtgagctgagatcac

SEQ ID NO: 4197780 - DNA, 22 bp, Homo sapiens
tgcagtggcatgatctcagctc

SEQ ID NO: 4197781 - DNA, 16 bp, Homo sapiens
tgcagtggctcatgcc

SEQ ID NO: 4197782 - DNA, 16 bp, Homo sapiens
tgcagttgacagcagg

SEQ ID NO: 4197783 - DNA, 12 bp, Homo sapiens
tgcataagatta

SEQ ID NO: 4197784 - DNA, 19 bp, Homo sapiens
tgcatagaggtaccagcaa

SEQ ID NO: 4197785 - DNA, 21 bp, Homo sapiens
tgcatcccccagcactgatgt

SEQ ID NO: 4197786 - DNA, 23 bp, Homo sapiens
tgcatctgggattcccaccaagg

SEQ ID NO: 4197787 - DNA, 11 bp, Homo sapiens
tgcatgaaaat

SEQ ID NO: 4197788 - DNA, 19 bp, Homo sapiens
tgcatggaatttgtaagtt

SEQ ID NO: 4197789 - DNA, 23 bp, Homo sapiens
tgcatggtgcagttgacagcagg

SEQ ID NO: 4197790 - DNA, 15 bp, Homo sapiens
tgcatgtatgtgtgt

SEQ ID NO: 4197791 - DNA, 14 bp, Homo sapiens
tgcattcccagtgg

SEQ ID NO: 4197792 - DNA, 18 bp, Homo sapiens
tgccaattgctaccgaga

SEQ ID NO: 4197793 - DNA, 19 bp, Homo sapiens
tgccacaccaatcagagag

SEQ ID NO: 4197794 - DNA, 15 bp, Homo sapiens
tgccaccatcctgct

SEQ ID NO: 4197795 - DNA, 19 bp, Homo sapiens
tgccaccatcctgctgctg

SEQ ID NO: 4197796 - DNA, 19 bp, Homo sapiens
tgccaccttttgggtgtgg

SEQ ID NO: 4197797 - DNA, 18 bp, Homo sapiens
tgccactcattcctgtag

SEQ ID NO: 4197798 - DNA, 14 bp, Homo sapiens
tgccagcctgagcg

SEQ ID NO: 4197799 - DNA, 17 bp, Homo sapiens
tgccagcctggcttctg

SEQ ID NO: 4197800 - DNA, 20 bp, Homo sapiens
tgccagcctggcttctggag

SEQ ID NO: 4197801 - DNA, 21 bp, Homo sapiens
tgccagcctggcttctggagc

SEQ ID NO: 4197802 - DNA, 23 bp, Homo sapiens
tgccagcctggcttctggagccc

SEQ ID NO: 4197803 - DNA, 16 bp, Homo sapiens
tgccaggactccccag

SEQ ID NO: 4197804 - DNA, 23 bp, Homo sapiens
tgccaggactccccaggccaggc

SEQ ID NO: 4197805 - DNA, 20 bp, Homo sapiens
tgccaggctagagtgcagtg

SEQ ID NO: 4197806 - DNA, 21 bp, Homo sapiens
tgccaggctcccactgcccct

SEQ ID NO: 4197807 - DNA, 13 bp, Homo sapiens
tgccatagagttt

SEQ ID NO: 4197808 - DNA, 18 bp, Homo sapiens
tgccatagagtttaacac

SEQ ID NO: 4197809 - DNA, 16 bp, Homo sapiens
tgccatgatgcctctg

SEQ ID NO: 4197810 - DNA, 16 bp, Homo sapiens
tgccatgggcctgctg

SEQ ID NO: 4197811 - DNA, 17 bp, Homo sapiens
tgccatgggcctgctgc

SEQ ID NO: 4197812 - DNA, 19 bp, Homo sapiens
tgccattgggaccctccag

SEQ ID NO: 4197813 - DNA, 21 bp, Homo sapiens
tgccattgggaccctccagtg

SEQ ID NO: 4197814 - DNA, 15 bp, Homo sapiens
ctgaaccactgtggc

SEQ ID NO: 4197815 - DNA, 16 bp, Homo sapiens
ctgaaccactgtggcc

SEQ ID NO: 4197816 - DNA, 14 bp, Homo sapiens
ctgaaccactttgc

SEQ ID NO: 4197817 - DNA, 23 bp, Homo sapiens
ctgaacctatttcttaaacactt

SEQ ID NO: 4197818 - DNA, 16 bp, Homo sapiens
ctgaagacctccacat

SEQ ID NO: 4197819 - DNA, 18 bp, Homo sapiens
ctgaagaggcaagagaca

SEQ ID NO: 4197820 - DNA, 22 bp, Homo sapiens
ctgaagaggcaagagacagaat

SEQ ID NO: 4197821 - DNA, 20 bp, Homo sapiens
ctgaaggagattttccttcc

SEQ ID NO: 4197822 - DNA, 21 bp, Homo sapiens
ctgaaggatcctggaaccact

SEQ ID NO: 4197823 - DNA, 20 bp, Homo sapiens
ctgaataacatttgtgtggt

SEQ ID NO: 4197824 - DNA, 22 bp, Homo sapiens
ctgaatgacctgcagtcagggc

SEQ ID NO: 4197825 - DNA, 23 bp, Homo sapiens
ctgaatgcctcaatgtgaccagg

SEQ ID NO: 4197826 - DNA, 16 bp, Homo sapiens
ctgaattttgggactt

SEQ ID NO: 4197827 - DNA, 12 bp, Homo sapiens
ctgaatttttaa

SEQ ID NO: 4197828 - DNA, 20 bp, Homo sapiens
ctgaccagccgtgagcatgt

SEQ ID NO: 4197829 - DNA, 23 bp, Homo sapiens
ctgaccccaaagagcctggagaa

SEQ ID NO: 4197830 - DNA, 13 bp, Homo sapiens
ctgacctgaggct

SEQ ID NO: 4197831 - DNA, 19 bp, Homo sapiens
ctgacctgatcacctctgg

SEQ ID NO: 4197832 - DNA, 22 bp, Homo sapiens
ctgacctgatcacctctggctt

SEQ ID NO: 4197833 - DNA, 12 bp, Homo sapiens
ctgacctgcagg

SEQ ID NO: 4197834 - DNA, 13 bp, Homo sapiens
ctgacctgcaggc

SEQ ID NO: 4197835 - DNA, 13 bp, Homo sapiens
ctgacctgggccc

SEQ ID NO: 4197836 - DNA, 15 bp, Homo sapiens
ctgacctgggcccac

SEQ ID NO: 4197837 - DNA, 20 bp, Homo sapiens
ctgacctgggcccacagagc

SEQ ID NO: 4197838 - DNA, 22 bp, Homo sapiens
ctgacctgggcccacagagcct

SEQ ID NO: 4197839 - DNA, 17 bp, Homo sapiens
ctgactagatctctgga

SEQ ID NO: 4197840 - DNA, 21 bp, Homo sapiens
ctgactagggagccatgtttc

SEQ ID NO: 4197841 - DNA, 21 bp, Homo sapiens
ctgactcggtcaaaatatttt

SEQ ID NO: 4197842 - DNA, 14 bp, Homo sapiens
ctgactctctgtga

SEQ ID NO: 4197843 - DNA, 14 bp, Homo sapiens
ctgactgttcttgg

SEQ ID NO: 4197844 - DNA, 22 bp, Homo sapiens
ctgactgttcttggtaactgat

SEQ ID NO: 4197845 - DNA, 22 bp, Homo sapiens
ctgagaatttaaaaataagaaa

SEQ ID NO: 4197846 - DNA, 15 bp, Homo sapiens
ctgagacaggagaat

SEQ ID NO: 4197847 - DNA, 14 bp, Homo sapiens
ctgagactgcggga

SEQ ID NO: 4197848 - DNA, 16 bp, Homo sapiens
ctgagagacttttaat

SEQ ID NO: 4197849 - DNA, 17 bp, Homo sapiens
ctgagatcacaccactg

SEQ ID NO: 4197850 - DNA, 15 bp, Homo sapiens
ctgagatccagcaca

SEQ ID NO: 4197851 - DNA, 24 bp, Homo sapiens
ctgagcaacagagtgagaccctgt

SEQ ID NO: 4197852 - DNA, 14 bp, Homo sapiens
ctgagcaccccctc

SEQ ID NO: 4197853 - DNA, 16 bp, Homo sapiens
ctgagcaccccctcat

SEQ ID NO: 4197854 - DNA, 23 bp, Homo sapiens
ctgagcacctgcttcatgctcag

SEQ ID NO: 4197855 - DNA, 16 bp, Homo sapiens
ctgagcagcccagcac

SEQ ID NO: 4197856 - DNA, 23 bp, Homo sapiens
ctgagctggcattggtctgctga

SEQ ID NO: 4197857 - DNA, 18 bp, Homo sapiens
ctgaggcgggtggatcac

SEQ ID NO: 4197858 - DNA, 22 bp, Homo sapiens
ctgaggctctgacccagtgaga

SEQ ID NO: 4197859 - DNA, 20 bp, Homo sapiens
ctgaggctctttctgggcca

SEQ ID NO: 4197860 - DNA, 20 bp, Homo sapiens
ctgagggattttagcctctt

SEQ ID NO: 4197861 - DNA, 16 bp, Homo sapiens
ctgagggcccttccca

SEQ ID NO: 4197862 - DNA, 18 bp, Homo sapiens
ctgagggcccttcccaac

SEQ ID NO: 4197863 - DNA, 13 bp, Homo sapiens
ctgaggggcaggg

SEQ ID NO: 4197864 - DNA, 23 bp, Homo sapiens
ctgaggggggccgtgcccagggg

SEQ ID NO: 4197865 - DNA, 18 bp, Homo sapiens
ctgaggtcactgggttct

SEQ ID NO: 4197866 - DNA, 21 bp, Homo sapiens
ctgaggtcctgcatttctcag

SEQ ID NO: 4197867 - DNA, 20 bp, Homo sapiens
ctgagtcacccatgaagaca

SEQ ID NO: 4197868 - DNA, 15 bp, Homo sapiens
ctgagtcagaggaca

SEQ ID NO: 4197869 - DNA, 17 bp, Homo sapiens
ctgagtctgctatattt

SEQ ID NO: 4197870 - DNA, 13 bp, Homo sapiens
ctgagtgcactcc

SEQ ID NO: 4197871 - DNA, 20 bp, Homo sapiens
ctgagttctggtgagacgga

SEQ ID NO: 4197872 - DNA, 18 bp, Homo sapiens
ctgagttttccatggcag

SEQ ID NO: 4197873 - DNA, 19 bp, Homo sapiens
ctgagttttccatggcagg

SEQ ID NO: 4197874 - DNA, 15 bp, Homo sapiens
ctgataattttaaat

SEQ ID NO: 4197875 - DNA, 18 bp, Homo sapiens
ctgataattttaaattct

SEQ ID NO: 4197876 - DNA, 15 bp, Homo sapiens
ctgatacccagagca

SEQ ID NO: 4197877 - DNA, 23 bp, Homo sapiens
ctgatcacctctggctttgtctc

SEQ ID NO: 4197878 - DNA, 16 bp, Homo sapiens
ctgatgacagagcgag

SEQ ID NO: 4197879 - DNA, 19 bp, Homo sapiens
ctgatgagcaagaattata

SEQ ID NO: 4197880 - DNA, 22 bp, Homo sapiens
ctgatgagcaagaattataaca

SEQ ID NO: 4197881 - DNA, 14 bp, Homo sapiens
ctgatggagaagga

SEQ ID NO: 4197882 - DNA, 17 bp, Homo sapiens
ctgatggagaaggaagg

SEQ ID NO: 4197883 - DNA, 22 bp, Homo sapiens
ctgatggcacttagctatcaga

SEQ ID NO: 4197884 - DNA, 12 bp, Homo sapiens
ctgattaacaaa

SEQ ID NO: 4197885 - DNA, 16 bp, Homo sapiens
ctgattggctcaccca

SEQ ID NO: 4197886 - DNA, 12 bp, Homo sapiens
ctgatttcagga

SEQ ID NO: 4197887 - DNA, 15 bp, Homo sapiens
ctgatttttcctttc

SEQ ID NO: 4197888 - DNA, 16 bp, Homo sapiens
ctgatttttcctttcg

SEQ ID NO: 4197889 - DNA, 19 bp, Homo sapiens
ctgcaaaaagatttaacaa

SEQ ID NO: 4197890 - DNA, 14 bp, Homo sapiens
ctgcaaaagtggaa

SEQ ID NO: 4197891 - DNA, 20 bp, Homo sapiens
ctgcaataaattatggctct

SEQ ID NO: 4197892 - DNA, 13 bp, Homo sapiens
ctgcaatctccag

SEQ ID NO: 4197893 - DNA, 15 bp, Homo sapiens
ctgcaatctccaggg

SEQ ID NO: 4197894 - DNA, 15 bp, Homo sapiens
ctgcaattgcttagg

SEQ ID NO: 4197895 - DNA, 16 bp, Homo sapiens
ctgcaattgcttagga

SEQ ID NO: 4197896 - DNA, 20 bp, Homo sapiens
ctgcaattgcttaggatgtt

SEQ ID NO: 4197897 - DNA, 14 bp, Homo sapiens
ctgcaccatcacac

SEQ ID NO: 4197898 - DNA, 11 bp, Homo sapiens
ctgcacccagg

SEQ ID NO: 4197899 - DNA, 12 bp, Homo sapiens
ctgcacccaggg

SEQ ID NO: 4197900 - DNA, 13 bp, Homo sapiens
ctgcaccgcttgg

SEQ ID NO: 4197901 - DNA, 13 bp, Homo sapiens
ctgcacctgccag

SEQ ID NO: 4197902 - DNA, 17 bp, Homo sapiens
ctgcacctgccagcctg

SEQ ID NO: 4197903 - DNA, 19 bp, Homo sapiens
ctgcacctgccagcctggc

SEQ ID NO: 4197904 - DNA, 16 bp, Homo sapiens
ctgcacctgcttctca

SEQ ID NO: 4197905 - DNA, 20 bp, Homo sapiens
ctgcacgccaccgctgcctt

SEQ ID NO: 4197906 - DNA, 21 bp, Homo sapiens
ctgcacgccaccgctgccttt

SEQ ID NO: 4197907 - DNA, 14 bp, Homo sapiens
ctgcactccagcct

SEQ ID NO: 4197908 - DNA, 20 bp, Homo sapiens
ctgcactccggcctgatgac

SEQ ID NO: 4197909 - DNA, 21 bp, Homo sapiens
ctgcagagctatggtgaggtg

SEQ ID NO: 4197910 - DNA, 23 bp, Homo sapiens
ctgcagaggggctttctggagag

SEQ ID NO: 4197911 - DNA, 13 bp, Homo sapiens
ctgcagagtggtg

SEQ ID NO: 4197912 - DNA, 19 bp, Homo sapiens
ctgcagatcttccgtggtc

SEQ ID NO: 4197913 - DNA, 16 bp, Homo sapiens
ctgcagcaactcccac

SEQ ID NO: 4197914 - DNA, 17 bp, Homo sapiens
ctgcagcaactcccacg

SEQ ID NO: 4197915 - DNA, 18 bp, Homo sapiens
ctgcagcaactcccacga

SEQ ID NO: 4197916 - DNA, 19 bp, Homo sapiens
ctgcagcactttaaccctc

SEQ ID NO: 4197917 - DNA, 18 bp, Homo sapiens
ctgcagcctccttctcct

SEQ ID NO: 4197918 - DNA, 12 bp, Homo sapiens
ctgcagctttac

SEQ ID NO: 4197919 - DNA, 22 bp, Homo sapiens
ctgcaggccaagagcagaggca

SEQ ID NO: 4197920 - DNA, 24 bp, Homo sapiens
ctgcaggccaagagcagaggcagc

SEQ ID NO: 4197921 - DNA, 15 bp, Homo sapiens
ctgcagggagcaact

SEQ ID NO: 4197922 - DNA, 16 bp, Homo sapiens
ctgcagggctgctgtg

SEQ ID NO: 4197923 - DNA, 18 bp, Homo sapiens
ctgcagtcagggcccaga

SEQ ID NO: 4197924 - DNA, 16 bp, Homo sapiens
ctgcagttgggccagc

SEQ ID NO: 4197925 - DNA, 20 bp, Homo sapiens
ctgcatgccctccccacttc

SEQ ID NO: 4197926 - DNA, 20 bp, Homo sapiens
ctgcatgcctggtctttcct

SEQ ID NO: 4197927 - DNA, 23 bp, Homo sapiens
ctgcatgcctggtctttcctctg

SEQ ID NO: 4197928 - DNA, 23 bp, Homo sapiens
ctgcattattggaatataattgt

SEQ ID NO: 4197929 - DNA, 12 bp, Homo sapiens
ctgccacctgtc

SEQ ID NO: 4197930 - DNA, 14 bp, Homo sapiens
ctgccacctgtctg

SEQ ID NO: 4197931 - DNA, 15 bp, Homo sapiens
ctgccacctgtctgt

SEQ ID NO: 4197932 - DNA, 19 bp, Homo sapiens
ctgccactttggtacatgg

SEQ ID NO: 4197933 - DNA, 23 bp, Homo sapiens
ctgccactttggtacatggccag

SEQ ID NO: 4197934 - DNA, 12 bp, Homo sapiens
ctgccagccaca

SEQ ID NO: 4197935 - DNA, 11 bp, Homo sapiens
ctgccagcctg

SEQ ID NO: 4197936 - DNA, 12 bp, Homo sapiens
ctgccagcctga

SEQ ID NO: 4197937 - DNA, 13 bp, Homo sapiens
ctgccagcctgag

SEQ ID NO: 4197938 - DNA, 16 bp, Homo sapiens
ctgccagcctgagcgg

SEQ ID NO: 4197939 - DNA, 15 bp, Homo sapiens
ctgccagcctggctt

SEQ ID NO: 4197940 - DNA, 20 bp, Homo sapiens
ctgccagcctggcttctgga

SEQ ID NO: 4197941 - DNA, 23 bp, Homo sapiens
ctgccagcctggcttctggagcc

SEQ ID NO: 4197942 - DNA, 17 bp, Homo sapiens
ctgccaggctcccactg

SEQ ID NO: 4197943 - DNA, 21 bp, Homo sapiens
ctgccaggctcccactgcccc

SEQ ID NO: 4197944 - DNA, 21 bp, Homo sapiens
ctgccatgcctcaagaacacc

SEQ ID NO: 4197945 - DNA, 16 bp, Homo sapiens
ctgccattcttctggt

SEQ ID NO: 4197946 - DNA, 22 bp, Homo sapiens
ctgccattcttctggtgctact

SEQ ID NO: 4197947 - DNA, 14 bp, Homo sapiens
ctgccattgggacc

SEQ ID NO: 4197948 - DNA, 15 bp, Homo sapiens
ctggctgggcatgga

SEQ ID NO: 4197949 - DNA, 15 bp, Homo sapiens
ctggcttagtgccac

SEQ ID NO: 4197950 - DNA, 21 bp, Homo sapiens
ctggcttagtgccacccacct

SEQ ID NO: 4197951 - DNA, 15 bp, Homo sapiens
ctggcttattcccaa

SEQ ID NO: 4197952 - DNA, 14 bp, Homo sapiens
ctggcttccaggta

SEQ ID NO: 4197953 - DNA, 15 bp, Homo sapiens
ctggcttccaggtat

SEQ ID NO: 4197954 - DNA, 22 bp, Homo sapiens
ctggcttccaggtatctccagg

SEQ ID NO: 4197955 - DNA, 18 bp, Homo sapiens
ctggcttccttctctcaa

SEQ ID NO: 4197956 - DNA, 17 bp, Homo sapiens
ctggcttctagatctgg

SEQ ID NO: 4197957 - DNA, 16 bp, Homo sapiens
ctggcttgggcagcat

SEQ ID NO: 4197958 - DNA, 20 bp, Homo sapiens
ctggctttggtccccagcat

SEQ ID NO: 4197959 - DNA, 23 bp, Homo sapiens
cctttggggttgcccagcctgga

SEQ ID NO: 4197960 - DNA, 20 bp, Homo sapiens
cctttgttttgcactgacaa

SEQ ID NO: 4197961 - DNA, 14 bp, Homo sapiens
cctttttgcagtat

SEQ ID NO: 4197962 - DNA, 17 bp, Homo sapiens
cctttttttaggccaca

SEQ ID NO: 4197963 - DNA, 16 bp, Homo sapiens
cctttttttctctcct

SEQ ID NO: 4197964 - DNA, 22 bp, Homo sapiens
cgaaaacgttgacccctttccc

SEQ ID NO: 4197965 - DNA, 21 bp, Homo sapiens
cgaaaccagttaagaatggaa

SEQ ID NO: 4197966 - DNA, 23 bp, Homo sapiens
cgaaggcagtgcaagagactctg

SEQ ID NO: 4197967 - DNA, 19 bp, Homo sapiens
cgaataaatgttcaaactg

SEQ ID NO: 4197968 - DNA, 15 bp, Homo sapiens
cgaatgtttcaaatc

SEQ ID NO: 4197969 - DNA, 14 bp, Homo sapiens
cgaattaatagctt

SEQ ID NO: 4197970 - DNA, 11 bp, Homo sapiens
cgacagcccag

SEQ ID NO: 4197971 - DNA, 12 bp, Homo sapiens
cgacagcccagc

SEQ ID NO: 4197972 - DNA, 16 bp, Homo sapiens
cgaccatcgtccagcc

SEQ ID NO: 4197973 - DNA, 18 bp, Homo sapiens
cgaccatcgtccagccct

SEQ ID NO: 4197974 - DNA, 19 bp, Homo sapiens
cgaccatcgtccagccctc

SEQ ID NO: 4197975 - DNA, 21 bp, Homo sapiens
cgaccatcgtccagccctcct

SEQ ID NO: 4197976 - DNA, 19 bp, Homo sapiens
cgacggtttcaaaccagga

SEQ ID NO: 4197977 - DNA, 17 bp, Homo sapiens
cgactagcaggcatgcc

SEQ ID NO: 4197978 - DNA, 14 bp, Homo sapiens
cgactctaagctgt

SEQ ID NO: 4197979 - DNA, 19 bp, Homo sapiens
cgactctaagctgtgtgca

SEQ ID NO: 4197980 - DNA, 14 bp, Homo sapiens
cgactcttcctgca

SEQ ID NO: 4197981 - DNA, 13 bp, Homo sapiens
cgagaacaacagt

SEQ ID NO: 4197982 - DNA, 12 bp, Homo sapiens
cgagagaggcgc

SEQ ID NO: 4197983 - DNA, 16 bp, Homo sapiens
cgagatcacgccactg

SEQ ID NO: 4197984 - DNA, 19 bp, Homo sapiens
cgagcaaagtctaaagttt

SEQ ID NO: 4197985 - DNA, 15 bp, Homo sapiens
cgagcatcctggcca

SEQ ID NO: 4197986 - DNA, 22 bp, Homo sapiens
cgagctactctcttgccagcat

SEQ ID NO: 4197987 - DNA, 21 bp, Homo sapiens
cgagctccttgggtcctgcaa

SEQ ID NO: 4197988 - DNA, 17 bp, Homo sapiens
cgagggctactcagcag

SEQ ID NO: 4197989 - DNA, 18 bp, Homo sapiens
cgagggctactcagcagt

SEQ ID NO: 4197990 - DNA, 20 bp, Homo sapiens
cgaggtagagtttgaaggag

SEQ ID NO: 4197991 - DNA, 17 bp, Homo sapiens
cgagtctacctcttcag

SEQ ID NO: 4197992 - DNA, 17 bp, Homo sapiens
cgagtttacttcatgag

SEQ ID NO: 4197993 - DNA, 13 bp, Homo sapiens
cgattttgcctgt

SEQ ID NO: 4197994 - DNA, 13 bp, Homo sapiens
cgattttgtctac

SEQ ID NO: 4197995 - DNA, 14 bp, Homo sapiens
cgattttgtctacc

SEQ ID NO: 4197996 - DNA, 19 bp, Homo sapiens
cgcaaagggctgaaagcca

SEQ ID NO: 4197997 - DNA, 20 bp, Homo sapiens
cgcaacagctgtgtgtgccc

SEQ ID NO: 4197998 - DNA, 22 bp, Homo sapiens
cgcacacacaccggtcaccgag

SEQ ID NO: 4197999 - DNA, 18 bp, Homo sapiens
cgcactcacccatgtgcc

SEQ ID NO: 4198000 - DNA, 18 bp, Homo sapiens
cgcagatgctgtcactgg

SEQ ID NO: 4198001 - DNA, 16 bp, Homo sapiens
cgcagcctccctctga

SEQ ID NO: 4198002 - DNA, 12 bp, Homo sapiens
cgcattgtacac

SEQ ID NO: 4198003 - DNA, 15 bp, Homo sapiens
cgccaaacactccac

SEQ ID NO: 4198004 - DNA, 22 bp, Homo sapiens
cgccacccccgccgtggggctc

SEQ ID NO: 4198005 - DNA, 15 bp, Homo sapiens
cgccaccgctgcctt

SEQ ID NO: 4198006 - DNA, 22 bp, Homo sapiens
cgccactacactccagcctgag

SEQ ID NO: 4198007 - DNA, 22 bp, Homo sapiens
cgccactgcactccagcctggg

SEQ ID NO: 4198008 - DNA, 15 bp, Homo sapiens
cgcccagctgcacct

SEQ ID NO: 4198009 - DNA, 17 bp, Homo sapiens
cgcccgactagcaggca

SEQ ID NO: 4198010 - DNA, 19 bp, Homo sapiens
cgcccgactagcaggcatg

SEQ ID NO: 4198011 - DNA, 21 bp, Homo sapiens
cgcccgactagcaggcatgcc

SEQ ID NO: 4198012 - DNA, 21 bp, Homo sapiens
cgccctggagtcccctgggcc

SEQ ID NO: 4198013 - DNA, 14 bp, Homo sapiens
cgccgggcaggcct

SEQ ID NO: 4198014 - DNA, 16 bp, Homo sapiens
cgccgtggggctccgg

SEQ ID NO: 4198015 - DNA, 21 bp, Homo sapiens
cgccgtggggctccggagggg

SEQ ID NO: 4198016 - DNA, 15 bp, Homo sapiens
cgcctcccagcctgg

SEQ ID NO: 4198017 - DNA, 16 bp, Homo sapiens
cgcctctgcccgcaga

SEQ ID NO: 4198018 - DNA, 19 bp, Homo sapiens
cgcctctgcccgcagagcc

SEQ ID NO: 4198019 - DNA, 15 bp, Homo sapiens
cgcctcttcctctgg

SEQ ID NO: 4198020 - DNA, 14 bp, Homo sapiens
cgcctgcagaggac

SEQ ID NO: 4198021 - DNA, 17 bp, Homo sapiens
cgcctgtaatcccagca

SEQ ID NO: 4198022 - DNA, 15 bp, Homo sapiens
cgcctgtcctgcctc

SEQ ID NO: 4198023 - DNA, 16 bp, Homo sapiens
cgcctgtcctgcctct

SEQ ID NO: 4198024 - DNA, 22 bp, Homo sapiens
cgccttcactccggtgtgcctg

SEQ ID NO: 4198025 - DNA, 19 bp, Homo sapiens
cgcgcagcgcgtgcacagc

SEQ ID NO: 4198026 - DNA, 22 bp, Homo sapiens
cgcgccactacactccagcctg

SEQ ID NO: 4198027 - DNA, 13 bp, Homo sapiens
cgcgtagagagcc

SEQ ID NO: 4198028 - DNA, 14 bp, Homo sapiens
cgcgtctgccccac

SEQ ID NO: 4198029 - DNA, 13 bp, Homo sapiens
cgctcatctggct

SEQ ID NO: 4198030 - DNA, 17 bp, Homo sapiens
cgctcccctctcctccg

SEQ ID NO: 4198031 - DNA, 18 bp, Homo sapiens
cgctcccctctcctccgc

SEQ ID NO: 4198032 - DNA, 21 bp, Homo sapiens
cgctcccgcatttctcatgct

SEQ ID NO: 4198033 - DNA, 22 bp, Homo sapiens
cgctcccgcatttctcatgctt

SEQ ID NO: 4198034 - DNA, 16 bp, Homo sapiens
cgctcctttacctacc

SEQ ID NO: 4198035 - DNA, 16 bp, Homo sapiens
cgctgctagagaaggg

SEQ ID NO: 4198036 - DNA, 16 bp, Homo sapiens
cgctggcgagatacca

SEQ ID NO: 4198037 - DNA, 17 bp, Homo sapiens
cgctgtcctttctagag

SEQ ID NO: 4198038 - DNA, 14 bp, Homo sapiens
cgcttcccagaggc

SEQ ID NO: 4198039 - DNA, 15 bp, Homo sapiens
cgcttcccagaggcc

SEQ ID NO: 4198040 - DNA, 14 bp, Homo sapiens
cgcttgcttctgca

SEQ ID NO: 4198041 - DNA, 15 bp, Homo sapiens
cgcttgcttctgcag

SEQ ID NO: 4198042 - DNA, 21 bp, Homo sapiens
cgcttgcttctgcagcaactc

SEQ ID NO: 4198043 - DNA, 22 bp, Homo sapiens
cgcttgcttctgcagcaactcc

SEQ ID NO: 4198044 - DNA, 11 bp, Homo sapiens
cgctttttgaa

SEQ ID NO: 4198045 - DNA, 18 bp, Homo sapiens
cggaaggctggctgggca

SEQ ID NO: 4198046 - DNA, 16 bp, Homo sapiens
cggaatgttacaatgg

SEQ ID NO: 4198047 - DNA, 17 bp, Homo sapiens
cggaccgcgtagagagc

SEQ ID NO: 4198048 - DNA, 14 bp, Homo sapiens
cggacctttcagct

SEQ ID NO: 4198049 - DNA, 19 bp, Homo sapiens
cggacgttggttctgcact

SEQ ID NO: 4198050 - DNA, 17 bp, Homo sapiens
cggagagtacagtgagc

SEQ ID NO: 4198051 - DNA, 18 bp, Homo sapiens
cggagagtacagtgagcc

SEQ ID NO: 4198052 - DNA, 17 bp, Homo sapiens
cggagcctgcctccttc

SEQ ID NO: 4198053 - DNA, 15 bp, Homo sapiens
cggagcttgcctgcc

SEQ ID NO: 4198054 - DNA, 23 bp, Homo sapiens
cggaggggttgcgggggagctgg

SEQ ID NO: 4198055 - DNA, 13 bp, Homo sapiens
cggaggttgcagg

SEQ ID NO: 4198056 - DNA, 18 bp, Homo sapiens
cggagtacagacgtctca

SEQ ID NO: 4198057 - DNA, 18 bp, Homo sapiens
cggagtgagttttttagt

SEQ ID NO: 4198058 - DNA, 15 bp, Homo sapiens
cggatctcactcagc

SEQ ID NO: 4198059 - DNA, 23 bp, Homo sapiens
cggcacgccaacagcccccccct

SEQ ID NO: 4198060 - DNA, 17 bp, Homo sapiens
cggcccagagacccctt

SEQ ID NO: 4198061 - DNA, 21 bp, Homo sapiens
cggcccagagaccccttcctt

SEQ ID NO: 4198062 - DNA, 14 bp, Homo sapiens
cggcccttgccgcc

SEQ ID NO: 4198063 - DNA, 19 bp, Homo sapiens
cggccgtacatctctgtga

SEQ ID NO: 4198064 - DNA, 19 bp, Homo sapiens
cggccgtgggccgggaggc

SEQ ID NO: 4198065 - DNA, 19 bp, Homo sapiens
cggcgtccctgagggccct

SEQ ID NO: 4198066 - DNA, 18 bp, Homo sapiens
cggctccaggtccggagg

SEQ ID NO: 4198067 - DNA, 15 bp, Homo sapiens
cggctgctcctccag

SEQ ID NO: 4198068 - DNA, 20 bp, Homo sapiens
cggctgctcctccagccctt

SEQ ID NO: 4198069 - DNA, 20 bp, Homo sapiens
cgggaggctgagacaggaga

SEQ ID NO: 4198070 - DNA, 23 bp, Homo sapiens
cgggaggctgagacaggagaatc

SEQ ID NO: 4198071 - DNA, 16 bp, Homo sapiens
cgggatggtcctgggg

SEQ ID NO: 4198072 - DNA, 23 bp, Homo sapiens
cgggcgcctgtagtcccagccac

SEQ ID NO: 4198073 - DNA, 13 bp, Homo sapiens
cgggcggaggcgg

SEQ ID NO: 4198074 - DNA, 14 bp, Homo sapiens
cggggccccagggc

SEQ ID NO: 4198075 - DNA, 18 bp, Homo sapiens
cgggggcgtggctggcct

SEQ ID NO: 4198076 - DNA, 17 bp, Homo sapiens
cgggtgccccccatgcc

SEQ ID NO: 4198077 - DNA, 19 bp, Homo sapiens
cgggtgtgcctgccctgga

SEQ ID NO: 4198078 - DNA, 12 bp, Homo sapiens
cggtactcccat

SEQ ID NO: 4198079 - DNA, 19 bp, Homo sapiens
cggtcctttaggcagcctg

SEQ ID NO: 4198080 - DNA, 20 bp, Homo sapiens
cggtcctttaggcagcctgc

SEQ ID NO: 4198081 - DNA, 14 bp, Homo sapiens
cggtggtgccagag

SEQ ID NO: 4198082 - DNA, 16 bp, Homo sapiens
cggtggtgccagaggt

SEQ ID NO: 4198083 - DNA, 14 bp, Homo sapiens
cggttgcttcacct

SEQ ID NO: 4198084 - DNA, 23 bp, Homo sapiens
cggtttggtttgttgtaaataaa

SEQ ID NO: 4198085 - DNA, 19 bp, Homo sapiens
cgtaatgattatatgacaa

SEQ ID NO: 4198086 - DNA, 15 bp, Homo sapiens
cgtacatctctgtga

SEQ ID NO: 4198087 - DNA, 18 bp, Homo sapiens
cgtatttatatttggaaa

SEQ ID NO: 4198088 - DNA, 19 bp, Homo sapiens
cgtatttatatttggaaag

SEQ ID NO: 4198089 - DNA, 23 bp, Homo sapiens
ctcccacaatctgggactttcac

SEQ ID NO: 4198090 - DNA, 14 bp, Homo sapiens
ctcccactgagttt

SEQ ID NO: 4198091 - DNA, 15 bp, Homo sapiens
ctcccagcgtgtgta

SEQ ID NO: 4198092 - DNA, 22 bp, Homo sapiens
ctcccagggccagggccctgca

SEQ ID NO: 4198093 - DNA, 13 bp, Homo sapiens
ctcccagggtcct

SEQ ID NO: 4198094 - DNA, 21 bp, Homo sapiens
ctccccaccttcaattcctgg

SEQ ID NO: 4198095 - DNA, 15 bp, Homo sapiens
ctccccaccttcccc

SEQ ID NO: 4198096 - DNA, 12 bp, Homo sapiens
ctccccagccct

SEQ ID NO: 4198097 - DNA, 17 bp, Homo sapiens
ctccccaggccaggcca

SEQ ID NO: 4198098 - DNA, 21 bp, Homo sapiens
ctccccattagagtcagcctt

SEQ ID NO: 4198099 - DNA, 20 bp, Homo sapiens
ctccccgcctgtcctgcctc

SEQ ID NO: 4198100 - DNA, 22 bp, Homo sapiens
ctccccgtgtcctctccctgcc

SEQ ID NO: 4198101 - DNA, 13 bp, Homo sapiens
ctcccctggtcct

SEQ ID NO: 4198102 - DNA, 14 bp, Homo sapiens
ctcccctggtcctg

SEQ ID NO: 4198103 - DNA, 20 bp, Homo sapiens
ctccctagaaacaaagggga

SEQ ID NO: 4198104 - DNA, 18 bp, Homo sapiens
ctccctatactgcttgga

SEQ ID NO: 4198105 - DNA, 12 bp, Homo sapiens
ctccctccaggg

SEQ ID NO: 4198106 - DNA, 22 bp, Homo sapiens
ctccctccagggaatccgcctg

SEQ ID NO: 4198107 - DNA, 12 bp, Homo sapiens
ctccctcccaca

SEQ ID NO: 4198108 - DNA, 15 bp, Homo sapiens
ctccctcctggagca

SEQ ID NO: 4198109 - DNA, 16 bp, Homo sapiens
ctccctcttccttccc

SEQ ID NO: 4198110 - DNA, 19 bp, Homo sapiens
ctccctcttccttccccca

SEQ ID NO: 4198111 - DNA, 18 bp, Homo sapiens
ctccctgatttggagcca

SEQ ID NO: 4198112 - DNA, 19 bp, Homo sapiens
ctccctgatttggagccag

SEQ ID NO: 4198113 - DNA, 17 bp, Homo sapiens
ctccctgccaagtctca

SEQ ID NO: 4198114 - DNA, 21 bp, Homo sapiens
ctccctgccaagtctcagaag

SEQ ID NO: 4198115 - DNA, 14 bp, Homo sapiens
ctccctggcatgtc

SEQ ID NO: 4198116 - DNA, 20 bp, Homo sapiens
ctccctggcatgtcagagcc

SEQ ID NO: 4198117 - DNA, 18 bp, Homo sapiens
ctccctggcccagccagc

SEQ ID NO: 4198118 - DNA, 23 bp, Homo sapiens
ctccctggcccagccagccagga

SEQ ID NO: 4198119 - DNA, 13 bp, Homo sapiens
ctccgagaacaac

SEQ ID NO: 4198120 - DNA, 12 bp, Homo sapiens
ctccggagggga

SEQ ID NO: 4198121 - DNA, 14 bp, Homo sapiens
ctccggaggggacc

SEQ ID NO: 4198122 - DNA, 21 bp, Homo sapiens
ctccggaggggacccagctcc

SEQ ID NO: 4198123 - DNA, 19 bp, Homo sapiens
ctccggtgtgcctgcagcc

SEQ ID NO: 4198124 - DNA, 18 bp, Homo sapiens
ctccgtcatgaatgcctt

SEQ ID NO: 4198125 - DNA, 20 bp, Homo sapiens
ctcctaaacccccgctccag

SEQ ID NO: 4198126 - DNA, 22 bp, Homo sapiens
ctcctaaacccccgctccagat

SEQ ID NO: 4198127 - DNA, 18 bp, Homo sapiens
ctcctacctcagcctaga

SEQ ID NO: 4198128 - DNA, 15 bp, Homo sapiens
ctcctatccttggag

SEQ ID NO: 4198129 - DNA, 22 bp, Homo sapiens
ctcctattctcttaatttttct

SEQ ID NO: 4198130 - DNA, 18 bp, Homo sapiens
ctcctcaggaacagaaca

SEQ ID NO: 4198131 - DNA, 15 bp, Homo sapiens
ctcctccactccacc

SEQ ID NO: 4198132 - DNA, 22 bp, Homo sapiens
ctcctccagcccttcagacgag

SEQ ID NO: 4198133 - DNA, 20 bp, Homo sapiens
ctcctcccacaatctgggac

SEQ ID NO: 4198134 - DNA, 13 bp, Homo sapiens
ctcctcccagcgt

SEQ ID NO: 4198135 - DNA, 15 bp, Homo sapiens
ctcctcccagcgtgt

SEQ ID NO: 4198136 - DNA, 16 bp, Homo sapiens
ctcctcccagcgtgtg

SEQ ID NO: 4198137 - DNA, 14 bp, Homo sapiens
ctcctcccatggcc

SEQ ID NO: 4198138 - DNA, 13 bp, Homo sapiens
ctcctcctctgtg

SEQ ID NO: 4198139 - DNA, 14 bp, Homo sapiens
ctcctcctctgtgc

SEQ ID NO: 4198140 - DNA, 13 bp, Homo sapiens
ctcctctaagcca

SEQ ID NO: 4198141 - DNA, 13 bp, Homo sapiens
ctcctctgagcca

SEQ ID NO: 4198142 - DNA, 14 bp, Homo sapiens
ctcctctgctgctc

SEQ ID NO: 4198143 - DNA, 14 bp, Homo sapiens
ctcctgacctgagg

SEQ ID NO: 4198144 - DNA, 19 bp, Homo sapiens
ctcctgccattcttctggt

SEQ ID NO: 4198145 - DNA, 17 bp, Homo sapiens
ctcctggagcatcccag

SEQ ID NO: 4198146 - DNA, 21 bp, Homo sapiens
ctcctgggcatgtttgtctgt

SEQ ID NO: 4198147 - DNA, 15 bp, Homo sapiens
ctcctgggggcccat

SEQ ID NO: 4198148 - DNA, 13 bp, Homo sapiens
ctccttcccctgt

SEQ ID NO: 4198149 - DNA, 22 bp, Homo sapiens
ctccttccttgctgtcctaggc

SEQ ID NO: 4198150 - DNA, 17 bp, Homo sapiens
ctccttgctctgcaggc

SEQ ID NO: 4198151 - DNA, 15 bp, Homo sapiens
ctccttgggtcctgc

SEQ ID NO: 4198152 - DNA, 15 bp, Homo sapiens
ctcctttacctacca

SEQ ID NO: 4198153 - DNA, 21 bp, Homo sapiens
ctcctttaggcaggttacagt

SEQ ID NO: 4198154 - DNA, 16 bp, Homo sapiens
ctcggaaggctggctg

SEQ ID NO: 4198155 - DNA, 19 bp, Homo sapiens
ctcgggaggctgagacagg

SEQ ID NO: 4198156 - DNA, 15 bp, Homo sapiens
ctcggtcaggagggt

SEQ ID NO: 4198157 - DNA, 14 bp, Homo sapiens
ctcgtggacacctg

SEQ ID NO: 4198158 - DNA, 15 bp, Homo sapiens
ctcgtggacacctgc

SEQ ID NO: 4198159 - DNA, 22 bp, Homo sapiens
ctctaacatttgcaaaatggaa

SEQ ID NO: 4198160 - DNA, 21 bp, Homo sapiens
ctctaacccccagtgccacag

SEQ ID NO: 4198161 - DNA, 14 bp, Homo sapiens
ctctaagctgtgtg

SEQ ID NO: 4198162 - DNA, 14 bp, Homo sapiens
ctctaatcagtcct

SEQ ID NO: 4198163 - DNA, 17 bp, Homo sapiens
ctctacaccctctgccc

SEQ ID NO: 4198164 - DNA, 19 bp, Homo sapiens
ctctacccggcccagagac

SEQ ID NO: 4198165 - DNA, 22 bp, Homo sapiens
ctctagtcttgctttgctgtct

SEQ ID NO: 4198166 - DNA, 15 bp, Homo sapiens
ctctagtgacttcct

SEQ ID NO: 4198167 - DNA, 22 bp, Homo sapiens
ctctagtgacttcctggtgagg

SEQ ID NO: 4198168 - DNA, 13 bp, Homo sapiens
ctctagtgccctc

SEQ ID NO: 4198169 - DNA, 21 bp, Homo sapiens
ctctagtgccctccacagccg

SEQ ID NO: 4198170 - DNA, 23 bp, Homo sapiens
ctctatactaccctgggctctgg

SEQ ID NO: 4198171 - DNA, 18 bp, Homo sapiens
ctctataggtcatgattt

SEQ ID NO: 4198172 - DNA, 15 bp, Homo sapiens
ctctcactaaacttt

SEQ ID NO: 4198173 - DNA, 13 bp, Homo sapiens
ctctccactccat

SEQ ID NO: 4198174 - DNA, 12 bp, Homo sapiens
ctctccagagag

SEQ ID NO: 4198175 - DNA, 13 bp, Homo sapiens
ctctccagagagc

SEQ ID NO: 4198176 - DNA, 12 bp, Homo sapiens
ctctcccctccc

SEQ ID NO: 4198177 - DNA, 16 bp, Homo sapiens
ctctcccctgccctgc

SEQ ID NO: 4198178 - DNA, 13 bp, Homo sapiens
ctctccctgccaa

SEQ ID NO: 4198179 - DNA, 20 bp, Homo sapiens
ctctcctaccccacctcatg

SEQ ID NO: 4198180 - DNA, 14 bp, Homo sapiens
ctctcctcctctgt

SEQ ID NO: 4198181 - DNA, 12 bp, Homo sapiens
ctctccttccct

SEQ ID NO: 4198182 - DNA, 13 bp, Homo sapiens
ctctcttgccagc

SEQ ID NO: 4198183 - DNA, 18 bp, Homo sapiens
ctctgaatggtccagggt

SEQ ID NO: 4198184 - DNA, 16 bp, Homo sapiens
ctctgacccagtgaga

SEQ ID NO: 4198185 - DNA, 13 bp, Homo sapiens
ctctgacctgcag

SEQ ID NO: 4198186 - DNA, 16 bp, Homo sapiens
ctctgacctgcaggcc

SEQ ID NO: 4198187 - DNA, 13 bp, Homo sapiens
ctctgagaagaca

SEQ ID NO: 4198188 - DNA, 18 bp, Homo sapiens
ctctgagaattccaagga

SEQ ID NO: 4198189 - DNA, 13 bp, Homo sapiens
ctctgagatgtgt

SEQ ID NO: 4198190 - DNA, 20 bp, Homo sapiens
ctctgaggctctttctgggc

SEQ ID NO: 4198191 - DNA, 19 bp, Homo sapiens
ctctgagtgttttatgaga

SEQ ID NO: 4198192 - DNA, 22 bp, Homo sapiens
ctctgagtgttttatgagaaag

SEQ ID NO: 4198193 - DNA, 15 bp, Homo sapiens
ctctgcaggcacctt

SEQ ID NO: 4198194 - DNA, 15 bp, Homo sapiens
ctctgcatctcattg

SEQ ID NO: 4198195 - DNA, 17 bp, Homo sapiens
ctctgcatctcattgta

SEQ ID NO: 4198196 - DNA, 14 bp, Homo sapiens
ctctgccagccaca

SEQ ID NO: 4198197 - DNA, 14 bp, Homo sapiens
ctctgccccagagg

SEQ ID NO: 4198198 - DNA, 16 bp, Homo sapiens
ctctgccccagaggcc

SEQ ID NO: 4198199 - DNA, 18 bp, Homo sapiens
ctctgccccagaggcctc

SEQ ID NO: 4198200 - DNA, 13 bp, Homo sapiens
ctctgccccagct

SEQ ID NO: 4198201 - DNA, 17 bp, Homo sapiens
ctctgccccagctctgg

SEQ ID NO: 4198202 - DNA, 18 bp, Homo sapiens
ctctgccccagctctggc

SEQ ID NO: 4198203 - DNA, 19 bp, Homo sapiens
ctctgccccagctctggct

SEQ ID NO: 4198204 - DNA, 21 bp, Homo sapiens
ctctgccccagctctggcttc

SEQ ID NO: 4198205 - DNA, 15 bp, Homo sapiens
ctctgcggtggtgcc

SEQ ID NO: 4198206 - DNA, 18 bp, Homo sapiens
ctctgcggtggtgccaga

SEQ ID NO: 4198207 - DNA, 17 bp, Homo sapiens
ctatagttattgtttta

SEQ ID NO: 4198208 - DNA, 20 bp, Homo sapiens
ctatcacctattacatttta

SEQ ID NO: 4198209 - DNA, 13 bp, Homo sapiens
ctatcagaagacc

SEQ ID NO: 4198210 - DNA, 19 bp, Homo sapiens
ctatccttggagagcagct

SEQ ID NO: 4198211 - DNA, 13 bp, Homo sapiens
ctatcgactttat

SEQ ID NO: 4198212 - DNA, 16 bp, Homo sapiens
ctatgaaaagctagaa

SEQ ID NO: 4198213 - DNA, 17 bp, Homo sapiens
ctatgaagttgaaaaat

SEQ ID NO: 4198214 - DNA, 15 bp, Homo sapiens
ctatgagttggactt

SEQ ID NO: 4198215 - DNA, 11 bp, Homo sapiens
ctatgctttga

SEQ ID NO: 4198216 - DNA, 15 bp, Homo sapiens
ctatggtgaggtgtg

SEQ ID NO: 4198217 - DNA, 14 bp, Homo sapiens
ctatgtatgttaat

SEQ ID NO: 4198218 - DNA, 20 bp, Homo sapiens
ctatgtatgttaatttattt

SEQ ID NO: 4198219 - DNA, 11 bp, Homo sapiens
ctatgtgatgt

SEQ ID NO: 4198220 - DNA, 22 bp, Homo sapiens
ctatgttcatgatagtgtgatt

SEQ ID NO: 4198221 - DNA, 20 bp, Homo sapiens
ctattaagataaatagagtt

SEQ ID NO: 4198222 - DNA, 14 bp, Homo sapiens
ctattatagccaca

SEQ ID NO: 4198223 - DNA, 18 bp, Homo sapiens
ctattatagccacatccc

SEQ ID NO: 4198224 - DNA, 23 bp, Homo sapiens
ctattcaaggtggccaaattatt

SEQ ID NO: 4198225 - DNA, 16 bp, Homo sapiens
ctattctcaccaggaa

SEQ ID NO: 4198226 - DNA, 13 bp, Homo sapiens
ctattgagccaag

SEQ ID NO: 4198227 - DNA, 22 bp, Homo sapiens
ctattgtgcaatgtaaatattt

SEQ ID NO: 4198228 - DNA, 18 bp, Homo sapiens
ctatttaaaaagctcttt

SEQ ID NO: 4198229 - DNA, 17 bp, Homo sapiens
ctatttaaaagtataaa

SEQ ID NO: 4198230 - DNA, 21 bp, Homo sapiens
ctatttaaaagtataaaactg

SEQ ID NO: 4198231 - DNA, 14 bp, Homo sapiens
ctatttaacttgag

SEQ ID NO: 4198232 - DNA, 14 bp, Homo sapiens
ctatttacatataa

SEQ ID NO: 4198233 - DNA, 18 bp, Homo sapiens
ctatttacatataataaa

SEQ ID NO: 4198234 - DNA, 16 bp, Homo sapiens
ctatttctctggatct

SEQ ID NO: 4198235 - DNA, 18 bp, Homo sapiens
ctatttgtttacatgcag

SEQ ID NO: 4198236 - DNA, 13 bp, Homo sapiens
ctatttttgttgt

SEQ ID NO: 4198237 - DNA, 14 bp, Homo sapiens
ctattttttaataa

SEQ ID NO: 4198238 - DNA, 16 bp, Homo sapiens
ctattttttaataaaa

SEQ ID NO: 4198239 - DNA, 16 bp, Homo sapiens
ctcaaaacttaacata

SEQ ID NO: 4198240 - DNA, 20 bp, Homo sapiens
ctcaaacacacaaactatta

SEQ ID NO: 4198241 - DNA, 15 bp, Homo sapiens
ctcaaactaggagga

SEQ ID NO: 4198242 - DNA, 16 bp, Homo sapiens
ctcaaactaggaggaa

SEQ ID NO: 4198243 - DNA, 22 bp, Homo sapiens
ctcaaagtttaacacaatttaa

SEQ ID NO: 4198244 - DNA, 22 bp, Homo sapiens
ctcaaatccactgacagatata

SEQ ID NO: 4198245 - DNA, 17 bp, Homo sapiens
ctcaacaacaaaccaaa

SEQ ID NO: 4198246 - DNA, 23 bp, Homo sapiens
ctcaaggcggtgcttgatagaaa

SEQ ID NO: 4198247 - DNA, 21 bp, Homo sapiens
ctcaatcttcggggtgtgatg

SEQ ID NO: 4198248 - DNA, 16 bp, Homo sapiens
ctcaatggacttcaaa

SEQ ID NO: 4198249 - DNA, 18 bp, Homo sapiens
ctcaatggacttcaaatt

SEQ ID NO: 4198250 - DNA, 14 bp, Homo sapiens
ctcacagcctctcc

SEQ ID NO: 4198251 - DNA, 20 bp, Homo sapiens
ctcacagcctctcccttaat

SEQ ID NO: 4198252 - DNA, 16 bp, Homo sapiens
ctcacccatgtgccaa

SEQ ID NO: 4198253 - DNA, 16 bp, Homo sapiens
ctcacgactcttcctg

SEQ ID NO: 4198254 - DNA, 15 bp, Homo sapiens
ctcacgctctggaca

SEQ ID NO: 4198255 - DNA, 19 bp, Homo sapiens
ctcactgctgtcagccaag

SEQ ID NO: 4198256 - DNA, 19 bp, Homo sapiens
ctcactggtccatttctca

SEQ ID NO: 4198257 - DNA, 22 bp, Homo sapiens
ctcactggtccatttctcagtg

SEQ ID NO: 4198258 - DNA, 20 bp, Homo sapiens
ctcactttcccttgtgtcaa

SEQ ID NO: 4198259 - DNA, 13 bp, Homo sapiens
ctcacttttccct

SEQ ID NO: 4198260 - DNA, 18 bp, Homo sapiens
ctcacttttttacaactc

SEQ ID NO: 4198261 - DNA, 22 bp, Homo sapiens
ctcagaagaggttgggcttcca

SEQ ID NO: 4198262 - DNA, 14 bp, Homo sapiens
ctcagaagcctgag

SEQ ID NO: 4198263 - DNA, 15 bp, Homo sapiens
ctcagaagcctgagg

SEQ ID NO: 4198264 - DNA, 13 bp, Homo sapiens
ctcagaaggtatt

SEQ ID NO: 4198265 - DNA, 16 bp, Homo sapiens
ctcagaaggtattcct

SEQ ID NO: 4198266 - DNA, 22 bp, Homo sapiens
ctcagagcaggctcagactctg

SEQ ID NO: 4198267 - DNA, 23 bp, Homo sapiens
ctcagagcaggctcagactctgg

SEQ ID NO: 4198268 - DNA, 16 bp, Homo sapiens
ctcagagcaggggcca

SEQ ID NO: 4198269 - DNA, 17 bp, Homo sapiens
ctcagagcaggggccag

SEQ ID NO: 4198270 - DNA, 22 bp, Homo sapiens
ctcagagggataaggcagttga

SEQ ID NO: 4198271 - DNA, 19 bp, Homo sapiens
ctcagcaatagggtgcagt

SEQ ID NO: 4198272 - DNA, 11 bp, Homo sapiens
ctcagcagccc

SEQ ID NO: 4198273 - DNA, 19 bp, Homo sapiens
ctcagcagtaagcaggcct

SEQ ID NO: 4198274 - DNA, 20 bp, Homo sapiens
ctcagccacaaaactctgtc

SEQ ID NO: 4198275 - DNA, 15 bp, Homo sapiens
ctcagccacacccca

SEQ ID NO: 4198276 - DNA, 13 bp, Homo sapiens
ctcagccctgact

SEQ ID NO: 4198277 - DNA, 18 bp, Homo sapiens
ctcagccctgactggtgc

SEQ ID NO: 4198278 - DNA, 19 bp, Homo sapiens
ctcagccctgactggtgct

SEQ ID NO: 4198279 - DNA, 15 bp, Homo sapiens
ctcagcctacagcag

SEQ ID NO: 4198280 - DNA, 22 bp, Homo sapiens
ctcagctccagaataccttctt

SEQ ID NO: 4198281 - DNA, 12 bp, Homo sapiens
ctcagctcgctg

SEQ ID NO: 4198282 - DNA, 22 bp, Homo sapiens
ctcaggagagagtctaagataa

SEQ ID NO: 4198283 - DNA, 20 bp, Homo sapiens
ctcaggaggcgaataaatgt

SEQ ID NO: 4198284 - DNA, 14 bp, Homo sapiens
ctcaggaggctgag

SEQ ID NO: 4198285 - DNA, 15 bp, Homo sapiens
ctcaggaggctgagg

SEQ ID NO: 4198286 - DNA, 18 bp, Homo sapiens
ctcaggccagagccaagg

SEQ ID NO: 4198287 - DNA, 13 bp, Homo sapiens
ctcagggctgtct

SEQ ID NO: 4198288 - DNA, 15 bp, Homo sapiens
ctcaggtagtactgg

SEQ ID NO: 4198289 - DNA, 16 bp, Homo sapiens
ctcaggtagtactggg

SEQ ID NO: 4198290 - DNA, 17 bp, Homo sapiens
ctcaggtagtactggga

SEQ ID NO: 4198291 - DNA, 18 bp, Homo sapiens
ctcaggtagtactgggaa

SEQ ID NO: 4198292 - DNA, 13 bp, Homo sapiens
ctcagtaatttag

SEQ ID NO: 4198293 - DNA, 14 bp, Homo sapiens
ctcagtctcaggag

SEQ ID NO: 4198294 - DNA, 14 bp, Homo sapiens
ctcagtctgtggga

SEQ ID NO: 4198295 - DNA, 15 bp, Homo sapiens
ctcagtgaagaatac

SEQ ID NO: 4198296 - DNA, 18 bp, Homo sapiens
ctcagtgaagaatacttc

SEQ ID NO: 4198297 - DNA, 21 bp, Homo sapiens
ctcagtgctctcctaccccac

SEQ ID NO: 4198298 - DNA, 13 bp, Homo sapiens
ctcagtggcttct

SEQ ID NO: 4198299 - DNA, 23 bp, Homo sapiens
ctcagtgtagttaaagggcagaa

SEQ ID NO: 4198300 - DNA, 17 bp, Homo sapiens
ctcataaaccaatgtgg

SEQ ID NO: 4198301 - DNA, 13 bp, Homo sapiens
ctcataagagttt

SEQ ID NO: 4198302 - DNA, 12 bp, Homo sapiens
ctcatattttgt

SEQ ID NO: 4198303 - DNA, 14 bp, Homo sapiens
ctcatcaccatcgt

SEQ ID NO: 4198304 - DNA, 18 bp, Homo sapiens
ctcatctaaaatttttct

SEQ ID NO: 4198305 - DNA, 20 bp, Homo sapiens
ctcatgcctggcccccctcc

SEQ ID NO: 4198306 - DNA, 13 bp, Homo sapiens
ctcatgctctctg

SEQ ID NO: 4198307 - DNA, 16 bp, Homo sapiens
ctcatgctctctgaac

SEQ ID NO: 4198308 - DNA, 16 bp, Homo sapiens
ctcatgcttcttctca

SEQ ID NO: 4198309 - DNA, 21 bp, Homo sapiens
ctcatgcttcttctcatgggg

SEQ ID NO: 4198310 - DNA, 13 bp, Homo sapiens
ctcattcccctcg

SEQ ID NO: 4198311 - DNA, 12 bp, Homo sapiens
ctcattcctgta

SEQ ID NO: 4198312 - DNA, 16 bp, Homo sapiens
ctcattcgcctgtggg

SEQ ID NO: 4198313 - DNA, 21 bp, Homo sapiens
ctcatttgtcatttaccctgg

SEQ ID NO: 4198314 - DNA, 15 bp, Homo sapiens
ctccaaggaccaggt

SEQ ID NO: 4198315 - DNA, 16 bp, Homo sapiens
ctccaaggtgctctgt

SEQ ID NO: 4198316 - DNA, 22 bp, Homo sapiens
ctccaccccctccagctccagt

SEQ ID NO: 4198317 - DNA, 18 bp, Homo sapiens
ctccactcctcatcccca

SEQ ID NO: 4198318 - DNA, 20 bp, Homo sapiens
ctccagaagtggggctctgg

SEQ ID NO: 4198319 - DNA, 22 bp, Homo sapiens
ctccagaagtggggctctggga

SEQ ID NO: 4198320 - DNA, 17 bp, Homo sapiens
ctccagacccaccacac

SEQ ID NO: 4198321 - DNA, 16 bp, Homo sapiens
ctccagagacaggaaa

SEQ ID NO: 4198322 - DNA, 13 bp, Homo sapiens
ctccagatctgca

SEQ ID NO: 4198323 - DNA, 15 bp, Homo sapiens
ctccagcccttcaga

SEQ ID NO: 4198324 - DNA, 13 bp, Homo sapiens
ctccagcctgagc

SEQ ID NO: 4198325 - DNA, 14 bp, Homo sapiens
ctccagcctgagca

SEQ ID NO: 4198326 - DNA, 14 bp, Homo sapiens
ctccagctccagtt

SEQ ID NO: 4198327 - DNA, 20 bp, Homo sapiens
ctccaggaatgcctcctccc

SEQ ID NO: 4198328 - DNA, 22 bp, Homo sapiens
ctccaggatctttgactgaaaa

SEQ ID NO: 4198329 - DNA, 19 bp, Homo sapiens
ctccaggattgaagagcat

SEQ ID NO: 4198330 - DNA, 14 bp, Homo sapiens
ctccagggctgccc

SEQ ID NO: 4198331 - DNA, 16 bp, Homo sapiens
ctccagggctgcccct

SEQ ID NO: 4198332 - DNA, 20 bp, Homo sapiens
ctccaggtccggaggggttg

SEQ ID NO: 4198333 - DNA, 22 bp, Homo sapiens
ctccaggtttgctgtgtctcac

SEQ ID NO: 4198334 - DNA, 21 bp, Homo sapiens
cgtatttcttttttttaataa

SEQ ID NO: 4198335 - DNA, 22 bp, Homo sapiens
aaatgtaactttttaatcatct

SEQ ID NO: 4198336 - DNA, 19 bp, Homo sapiens
aaatgttaatgagaaaatg

SEQ ID NO: 4198337 - DNA, 17 bp, Homo sapiens
aaattaacagtcctaac

SEQ ID NO: 4198338 - DNA, 20 bp, Homo sapiens
aaattaactgggtaatgaaa

SEQ ID NO: 4198339 - DNA, 21 bp, Homo sapiens
aaattaactgggtaatgaaac

SEQ ID NO: 4198340 - DNA, 14 bp, Homo sapiens
aaattaagtgttgt

SEQ ID NO: 4198341 - DNA, 17 bp, Homo sapiens
aaattagaaaatcctat

SEQ ID NO: 4198342 - DNA, 17 bp, Homo sapiens
aaattattatgactcaa

SEQ ID NO: 4198343 - DNA, 13 bp, Homo sapiens
aaattatttgtgt

SEQ ID NO: 4198344 - DNA, 15 bp, Homo sapiens
aaattattttaaaca

SEQ ID NO: 4198345 - DNA, 22 bp, Homo sapiens
aaattcaaaccaattcacccag

SEQ ID NO: 4198346 - DNA, 20 bp, Homo sapiens
aaattcagatatatttttca

SEQ ID NO: 4198347 - DNA, 13 bp, Homo sapiens
aaattccactgga

SEQ ID NO: 4198348 - DNA, 20 bp, Homo sapiens
aaattctatatgatcctgaa

SEQ ID NO: 4198349 - DNA, 13 bp, Homo sapiens
aaattgaatgcaa

SEQ ID NO: 4198350 - DNA, 13 bp, Homo sapiens
aaattgtattttt

SEQ ID NO: 4198351 - DNA, 22 bp, Homo sapiens
aaattgtatttttgtatgtggc

SEQ ID NO: 4198352 - DNA, 21 bp, Homo sapiens
aaatttaataaaaacttcaga

SEQ ID NO: 4198353 - DNA, 23 bp, Homo sapiens
aaatttatatcttatatataata

SEQ ID NO: 4198354 - DNA, 14 bp, Homo sapiens
aaatttgatttcta

SEQ ID NO: 4198355 - DNA, 10 bp, Homo sapiens
aaattttaac

SEQ ID NO: 4198356 - DNA, 14 bp, Homo sapiens
aaattttaacattt

SEQ ID NO: 4198357 - DNA, 16 bp, Homo sapiens
aaattttatttagttc

SEQ ID NO: 4198358 - DNA, 20 bp, Homo sapiens
aaattttatttagttcttga

SEQ ID NO: 4198359 - DNA, 19 bp, Homo sapiens
aaattttctagactttctg

SEQ ID NO: 4198360 - DNA, 20 bp, Homo sapiens
aaatttttctagaagatatc

SEQ ID NO: 4198361 - DNA, 19 bp, Homo sapiens
aaattttttgatgtcagcc

SEQ ID NO: 4198362 - DNA, 16 bp, Homo sapiens
aacaaactcgtttttt

SEQ ID NO: 4198363 - DNA, 19 bp, Homo sapiens
aacaaagagttcaagaaat

SEQ ID NO: 4198364 - DNA, 12 bp, Homo sapiens
aacaaataaatt

SEQ ID NO: 4198365 - DNA, 18 bp, Homo sapiens
aacaaatatttatatatt

SEQ ID NO: 4198366 - DNA, 11 bp, Homo sapiens
aacaacaaaaa

SEQ ID NO: 4198367 - DNA, 16 bp, Homo sapiens
aacaacaacaatacaa

SEQ ID NO: 4198368 - DNA, 17 bp, Homo sapiens
aacaacaacaatacaac

SEQ ID NO: 4198369 - DNA, 10 bp, Homo sapiens
aacaacaata

SEQ ID NO: 4198370 - DNA, 19 bp, Homo sapiens
aacaacaattttaaataag

SEQ ID NO: 4198371 - DNA, 20 bp, Homo sapiens
aacaacaattttaaataaga

SEQ ID NO: 4198372 - DNA, 16 bp, Homo sapiens
aacaaggttcttctaa

SEQ ID NO: 4198373 - DNA, 22 bp, Homo sapiens
aacaaggttcttctaaaattga

SEQ ID NO: 4198374 - DNA, 14 bp, Homo sapiens
aacaataacaacaa

SEQ ID NO: 4198375 - DNA, 20 bp, Homo sapiens
aacaatacaacaagaacaac

SEQ ID NO: 4198376 - DNA, 17 bp, Homo sapiens
aacaattaaacagccaa

SEQ ID NO: 4198377 - DNA, 15 bp, Homo sapiens
aacaattattttatt

SEQ ID NO: 4198378 - DNA, 14 bp, Homo sapiens
aacaattctaaaat

SEQ ID NO: 4198379 - DNA, 19 bp, Homo sapiens
aacaattctaaaatgattg

SEQ ID NO: 4198380 - DNA, 22 bp, Homo sapiens
aacaattctaaaatgattgtag

SEQ ID NO: 4198381 - DNA, 21 bp, Homo sapiens
aacaatttcctttatatttag

SEQ ID NO: 4198382 - DNA, 16 bp, Homo sapiens
aacaattttaaataag

SEQ ID NO: 4198383 - DNA, 19 bp, Homo sapiens
aacacaaagacacaggaag

SEQ ID NO: 4198384 - DNA, 14 bp, Homo sapiens
aacacacacaaaag

SEQ ID NO: 4198385 - DNA, 18 bp, Homo sapiens
aacacacactcccaccct

SEQ ID NO: 4198386 - DNA, 15 bp, Homo sapiens
aacaccaacataaaa

SEQ ID NO: 4198387 - DNA, 14 bp, Homo sapiens
aacacggcagctgt

SEQ ID NO: 4198388 - DNA, 19 bp, Homo sapiens
aacactagacaagccagaa

SEQ ID NO: 4198389 - DNA, 20 bp, Homo sapiens
aacactcttcttgagcagac

SEQ ID NO: 4198390 - DNA, 15 bp, Homo sapiens
aacactgcctatata

SEQ ID NO: 4198391 - DNA, 13 bp, Homo sapiens
aacagcaaggaaa

SEQ ID NO: 4198392 - DNA, 23 bp, Homo sapiens
aacagccaccctgcccagtctgg

SEQ ID NO: 4198393 - DNA, 18 bp, Homo sapiens
aacagcctgacaacattt

SEQ ID NO: 4198394 - DNA, 20 bp, Homo sapiens
aacagctcttcactcagcca

SEQ ID NO: 4198395 - DNA, 16 bp, Homo sapiens
aacagtaacacatctt

SEQ ID NO: 4198396 - DNA, 22 bp, Homo sapiens
aacagtagttttgaaactagaa

SEQ ID NO: 4198397 - DNA, 17 bp, Homo sapiens
aacagtgaagacagaag

SEQ ID NO: 4198398 - DNA, 12 bp, Homo sapiens
aacagttttcct

SEQ ID NO: 4198399 - DNA, 18 bp, Homo sapiens
aacagttttcctatgctt

SEQ ID NO: 4198400 - DNA, 15 bp, Homo sapiens
aacatagacagaaga

SEQ ID NO: 4198401 - DNA, 12 bp, Homo sapiens
aacatcattcta

SEQ ID NO: 4198402 - DNA, 16 bp, Homo sapiens
aacatcattctacata

SEQ ID NO: 4198403 - DNA, 21 bp, Homo sapiens
aacatcattctacataatgga

SEQ ID NO: 4198404 - DNA, 16 bp, Homo sapiens
aacatccctgggcaag

SEQ ID NO: 4198405 - DNA, 20 bp, Homo sapiens
aacatctattataaaaccat

SEQ ID NO: 4198406 - DNA, 15 bp, Homo sapiens
aacatctcactttgc

SEQ ID NO: 4198407 - DNA, 18 bp, Homo sapiens
aacatgcaattggggaag

SEQ ID NO: 4198408 - DNA, 21 bp, Homo sapiens
aacatgcaattggggaagaaa

SEQ ID NO: 4198409 - DNA, 13 bp, Homo sapiens
aacatggaagata

SEQ ID NO: 4198410 - DNA, 14 bp, Homo sapiens
aacatggaagatat

SEQ ID NO: 4198411 - DNA, 15 bp, Homo sapiens
aacatggaatttaat

SEQ ID NO: 4198412 - DNA, 21 bp, Homo sapiens
aacattaagattgaggcctgc

SEQ ID NO: 4198413 - DNA, 14 bp, Homo sapiens
aacattcacagccc

SEQ ID NO: 4198414 - DNA, 16 bp, Homo sapiens
aacatttcctcttata

SEQ ID NO: 4198415 - DNA, 19 bp, Homo sapiens
aacatttgctttgttttct

SEQ ID NO: 4198416 - DNA, 23 bp, Homo sapiens
aaccaaataggctttagaagaga

SEQ ID NO: 4198417 - DNA, 21 bp, Homo sapiens
aaccaattcacccagaaaaaa

SEQ ID NO: 4198418 - DNA, 13 bp, Homo sapiens
aaccacagatgtg

SEQ ID NO: 4198419 - DNA, 22 bp, Homo sapiens
aaccacctgggttcagcctctc

SEQ ID NO: 4198420 - DNA, 17 bp, Homo sapiens
aaccacttggctgctca

SEQ ID NO: 4198421 - DNA, 23 bp, Homo sapiens
aaccagatctagtcaatcaagtc

SEQ ID NO: 4198422 - DNA, 22 bp, Homo sapiens
aaccagctgtaacacagctgag

SEQ ID NO: 4198423 - DNA, 21 bp, Homo sapiens
aaccaggagggtaacagaaga

SEQ ID NO: 4198424 - DNA, 19 bp, Homo sapiens
aaccagtgaagtgccacat

SEQ ID NO: 4198425 - DNA, 17 bp, Homo sapiens
aacccatcttccccgga

SEQ ID NO: 4198426 - DNA, 16 bp, Homo sapiens
aacccccagtgccaca

SEQ ID NO: 4198427 - DNA, 18 bp, Homo sapiens
aacccccagtgccacaga

SEQ ID NO: 4198428 - DNA, 22 bp, Homo sapiens
aacccccgctccagatctgcac

SEQ ID NO: 4198429 - DNA, 13 bp, Homo sapiens
aaccctctcttcc

SEQ ID NO: 4198430 - DNA, 20 bp, Homo sapiens
aaccctgttttatactgtac

SEQ ID NO: 4198431 - DNA, 14 bp, Homo sapiens
aacccttattccat

SEQ ID NO: 4198432 - DNA, 17 bp, Homo sapiens
aacctaaaatttcaagt

SEQ ID NO: 4198433 - DNA, 21 bp, Homo sapiens
aacctcaaactaggaggaaaa

SEQ ID NO: 4198434 - DNA, 11 bp, Homo sapiens
aacctcacttg

SEQ ID NO: 4198435 - DNA, 20 bp, Homo sapiens
aacctcagagggataaggca

SEQ ID NO: 4198436 - DNA, 18 bp, Homo sapiens
aacctcaggcttccttgg

SEQ ID NO: 4198437 - DNA, 14 bp, Homo sapiens
aacctcagtaattt

SEQ ID NO: 4198438 - DNA, 14 bp, Homo sapiens
aacctcccctggtc

SEQ ID NO: 4198439 - DNA, 17 bp, Homo sapiens
aacctgatgagcaagaa

SEQ ID NO: 4198440 - DNA, 17 bp, Homo sapiens
aacctggagatgatgat

SEQ ID NO: 4198441 - DNA, 17 bp, Homo sapiens
aacctgggttgcagaca

SEQ ID NO: 4198442 - DNA, 22 bp, Homo sapiens
aacctggtttttgtatatttat

SEQ ID NO: 4198443 - DNA, 14 bp, Homo sapiens
aacctttcaaattt

SEQ ID NO: 4198444 - DNA, 19 bp, Homo sapiens
aacgcactttataaaagca

SEQ ID NO: 4198445 - DNA, 15 bp, Homo sapiens
aacgggctgccctgc

SEQ ID NO: 4198446 - DNA, 17 bp, Homo sapiens
aacgggctgccctgcca

SEQ ID NO: 4198447 - DNA, 15 bp, Homo sapiens
aacggggtccttcaa

SEQ ID NO: 4198448 - DNA, 15 bp, Homo sapiens
aacgttgaccccttt

SEQ ID NO: 4198449 - DNA, 19 bp, Homo sapiens
aacgttgacccctttcccc

SEQ ID NO: 4198450 - DNA, 23 bp, Homo sapiens
aacgttgacccctttcccccacc

SEQ ID NO: 4198451 - DNA, 13 bp, Homo sapiens
aactaacaaccaa

SEQ ID NO: 4198452 - DNA, 20 bp, Homo sapiens
aactacaaccaatggaatgt

SEQ ID NO: 4198453 - DNA, 14 bp, Homo sapiens
aactacagtctaaa

SEQ ID NO: 4198454 - DNA, 19 bp, Homo sapiens
aactacgcttgctcatttt

SEQ ID NO: 4198455 - DNA, 15 bp, Homo sapiens
aactaggaggaaaag

SEQ ID NO: 4198456 - DNA, 23 bp, Homo sapiens
aactaggtttaaaacagcctggg

SEQ ID NO: 4198457 - DNA, 15 bp, Homo sapiens
aagcaagcattcaga

SEQ ID NO: 4198458 - DNA, 21 bp, Homo sapiens
aagcaagcattcagaagaaaa

SEQ ID NO: 4198459 - DNA, 15 bp, Homo sapiens
aagcaagctggatgc

SEQ ID NO: 4198460 - DNA, 16 bp, Homo sapiens
aagcacactgcagggc

SEQ ID NO: 4198461 - DNA, 22 bp, Homo sapiens
aagcacactgcagggctgctgt

SEQ ID NO: 4198462 - DNA, 23 bp, Homo sapiens
aagcacactgcagggctgctgtg

SEQ ID NO: 4198463 - DNA, 20 bp, Homo sapiens
aagcacagtctgatgacaca

SEQ ID NO: 4198464 - DNA, 16 bp, Homo sapiens
aagcacatgtttattt

SEQ ID NO: 4198465 - DNA, 20 bp, Homo sapiens
aagcaccagcttctccaggc

SEQ ID NO: 4198466 - DNA, 21 bp, Homo sapiens
aagcaccagcttctccaggct

SEQ ID NO: 4198467 - DNA, 17 bp, Homo sapiens
aagcaccataaccaaga

SEQ ID NO: 4198468 - DNA, 19 bp, Homo sapiens
aagcaccgcctccaaatgc

SEQ ID NO: 4198469 - DNA, 17 bp, Homo sapiens
aagcacctgaaccactg

SEQ ID NO: 4198470 - DNA, 11 bp, Homo sapiens
aagcacttttt

SEQ ID NO: 4198471 - DNA, 15 bp, Homo sapiens
aagcatcacctcagg

SEQ ID NO: 4198472 - DNA, 16 bp, Homo sapiens
aagcatcacctcaggc

SEQ ID NO: 4198473 - DNA, 15 bp, Homo sapiens
aagcatcagtagctg

SEQ ID NO: 4198474 - DNA, 15 bp, Homo sapiens
aagcattcagaagaa

SEQ ID NO: 4198475 - DNA, 12 bp, Homo sapiens
aagcattcttag

SEQ ID NO: 4198476 - DNA, 22 bp, Homo sapiens
aagcattcttagactagttgaa

SEQ ID NO: 4198477 - DNA, 13 bp, Homo sapiens
aagcattgaatgg

SEQ ID NO: 4198478 - DNA, 16 bp, Homo sapiens
aagcattgaatggcta

SEQ ID NO: 4198479 - DNA, 13 bp, Homo sapiens
aagcattttgtaa

SEQ ID NO: 4198480 - DNA, 14 bp, Homo sapiens
aagtctgtttactg

SEQ ID NO: 4198481 - DNA, 16 bp, Homo sapiens
aagtcttgtcagaatt

SEQ ID NO: 4198482 - DNA, 19 bp, Homo sapiens
aagtgaccaaattgggaga

SEQ ID NO: 4198483 - DNA, 18 bp, Homo sapiens
aagtgagcagatgggaca

SEQ ID NO: 4198484 - DNA, 11 bp, Homo sapiens
aagtgccaaac

SEQ ID NO: 4198485 - DNA, 14 bp, Homo sapiens
aagtgccaaacaga

SEQ ID NO: 4198486 - DNA, 18 bp, Homo sapiens
aagtgctgggattacaga

SEQ ID NO: 4198487 - DNA, 23 bp, Homo sapiens
aagtgctgggattacagacatga

SEQ ID NO: 4198488 - DNA, 22 bp, Homo sapiens
aagtgtcatatgtaggtgtctg

SEQ ID NO: 4198489 - DNA, 15 bp, Homo sapiens
aagtgtgagcagtga

SEQ ID NO: 4198490 - DNA, 18 bp, Homo sapiens
aagttaattttgaccaaa

SEQ ID NO: 4198491 - DNA, 19 bp, Homo sapiens
aagttatctgtgttatttg

SEQ ID NO: 4198492 - DNA, 11 bp, Homo sapiens
aagttattgta

SEQ ID NO: 4198493 - DNA, 19 bp, Homo sapiens
aagttatttagaaatatcc

SEQ ID NO: 4198494 - DNA, 21 bp, Homo sapiens
aagttatttagaaatatcctt

SEQ ID NO: 4198495 - DNA, 18 bp, Homo sapiens
aagttcaagaagactatg

SEQ ID NO: 4198496 - DNA, 19 bp, Homo sapiens
aagttcacttccccaactc

SEQ ID NO: 4198497 - DNA, 18 bp, Homo sapiens
aagttctagagaagaggc

SEQ ID NO: 4198498 - DNA, 21 bp, Homo sapiens
aagttgaatggcctgccttga

SEQ ID NO: 4198499 - DNA, 22 bp, Homo sapiens
aagttggtcttatagaaagcac

SEQ ID NO: 4198500 - DNA, 13 bp, Homo sapiens
aagttgtctggct

SEQ ID NO: 4198501 - DNA, 14 bp, Homo sapiens
aagttgtctggctt

SEQ ID NO: 4198502 - DNA, 18 bp, Homo sapiens
aagttgttcacatatatg

SEQ ID NO: 4198503 - DNA, 12 bp, Homo sapiens
aagtttacagta

SEQ ID NO: 4198504 - DNA, 18 bp, Homo sapiens
aagtttacagtaaataaa

SEQ ID NO: 4198505 - DNA, 20 bp, Homo sapiens
aagtttacagtaaataaatt

SEQ ID NO: 4198506 - DNA, 21 bp, Homo sapiens
aagtttacagtaaataaattg

SEQ ID NO: 4198507 - DNA, 14 bp, Homo sapiens
aagtttcaccttgg

SEQ ID NO: 4198508 - DNA, 22 bp, Homo sapiens
aagtttcaccttgggtttgtat

SEQ ID NO: 4198509 - DNA, 14 bp, Homo sapiens
aagtttgcactgta

SEQ ID NO: 4198510 - DNA, 14 bp, Homo sapiens
aagtttgtttttaa

SEQ ID NO: 4198511 - DNA, 14 bp, Homo sapiens
aagttttgtacaga

SEQ ID NO: 4198512 - DNA, 14 bp, Homo sapiens
aagttttgttttcc

SEQ ID NO: 4198513 - DNA, 13 bp, Homo sapiens
aataaaacctttc

SEQ ID NO: 4198514 - DNA, 15 bp, Homo sapiens
aataaaacctttcaa

SEQ ID NO: 4198515 - DNA, 16 bp, Homo sapiens
aataaaacctttcaaa

SEQ ID NO: 4198516 - DNA, 22 bp, Homo sapiens
aataaaacctttcaaatttcac

SEQ ID NO: 4198517 - DNA, 20 bp, Homo sapiens
aataaacatcatagtttctt

SEQ ID NO: 4198518 - DNA, 15 bp, Homo sapiens
aataaacctggagat

SEQ ID NO: 4198519 - DNA, 17 bp, Homo sapiens
aataaacctggagatga

SEQ ID NO: 4198520 - DNA, 18 bp, Homo sapiens
aataaacctggagatgat

SEQ ID NO: 4198521 - DNA, 20 bp, Homo sapiens
aataaacctggagatgatga

SEQ ID NO: 4198522 - DNA, 15 bp, Homo sapiens
aataaagagttagaa

SEQ ID NO: 4198523 - DNA, 13 bp, Homo sapiens
aataaagataacc

SEQ ID NO: 4198524 - DNA, 13 bp, Homo sapiens
aataaagctggac

SEQ ID NO: 4198525 - DNA, 22 bp, Homo sapiens
aataaagctggacaagaagctg

SEQ ID NO: 4198526 - DNA, 23 bp, Homo sapiens
aataaagctggacaagaagctgc

SEQ ID NO: 4198527 - DNA, 19 bp, Homo sapiens
aataaagggaaacgaatgt

SEQ ID NO: 4198528 - DNA, 17 bp, Homo sapiens
aataaagtactacatca

SEQ ID NO: 4198529 - DNA, 19 bp, Homo sapiens
aataaagtactacatcagt

SEQ ID NO: 4198530 - DNA, 12 bp, Homo sapiens
aataaatgttca

SEQ ID NO: 4198531 - DNA, 18 bp, Homo sapiens
aataaatgttcaaactgt

SEQ ID NO: 4198532 - DNA, 13 bp, Homo sapiens
aataaatgttgct

SEQ ID NO: 4198533 - DNA, 14 bp, Homo sapiens
aataaattcagata

SEQ ID NO: 4198534 - DNA, 23 bp, Homo sapiens
aataacaacaatggtttacatga

SEQ ID NO: 4198535 - DNA, 22 bp, Homo sapiens
aataacgtttaagccaaaacaa

SEQ ID NO: 4198536 - DNA, 15 bp, Homo sapiens
aataagaaagtttca

SEQ ID NO: 4198537 - DNA, 14 bp, Homo sapiens
aataagaatgattt

SEQ ID NO: 4198538 - DNA, 21 bp, Homo sapiens
aataagagatagcagaggaaa

SEQ ID NO: 4198539 - DNA, 15 bp, Homo sapiens
aataaggaaaaaata

SEQ ID NO: 4198540 - DNA, 17 bp, Homo sapiens
aataaggaaaaaataat

SEQ ID NO: 4198541 - DNA, 14 bp, Homo sapiens
aataagtattcttc

SEQ ID NO: 4198542 - DNA, 22 bp, Homo sapiens
aataatatccatacagtcaaga

SEQ ID NO: 4198543 - DNA, 18 bp, Homo sapiens
aataatatttcaagtgcc

SEQ ID NO: 4198544 - DNA, 18 bp, Homo sapiens
aataatgaagttattctt

SEQ ID NO: 4198545 - DNA, 18 bp, Homo sapiens
aataatgaatgtcatgca

SEQ ID NO: 4198546 - DNA, 21 bp, Homo sapiens
aataatttagacttcaagcat

SEQ ID NO: 4198547 - DNA, 22 bp, Homo sapiens
aatacaacatgtagctgagttt

SEQ ID NO: 4198548 - DNA, 23 bp, Homo sapiens
aatacatgctaagagaagtagaa

SEQ ID NO: 4198549 - DNA, 16 bp, Homo sapiens
aataccacaagcctga

SEQ ID NO: 4198550 - DNA, 20 bp, Homo sapiens
aataccagagccttcaagtg

SEQ ID NO: 4198551 - DNA, 19 bp, Homo sapiens
aatacctaggcccattgct

SEQ ID NO: 4198552 - DNA, 18 bp, Homo sapiens
aatacgcactacatgtgg

SEQ ID NO: 4198553 - DNA, 13 bp, Homo sapiens
aatactaatgtaa

SEQ ID NO: 4198554 - DNA, 13 bp, Homo sapiens
aatactgctgaga

SEQ ID NO: 4198555 - DNA, 18 bp, Homo sapiens
aatactgctgagatacat

SEQ ID NO: 4198556 - DNA, 13 bp, Homo sapiens
aatacttcatgat

SEQ ID NO: 4198557 - DNA, 16 bp, Homo sapiens
aatacttctcattttt

SEQ ID NO: 4198558 - DNA, 13 bp, Homo sapiens
aatagaaaactga

SEQ ID NO: 4198559 - DNA, 15 bp, Homo sapiens
aatagaaattttgtt

SEQ ID NO: 4198560 - DNA, 20 bp, Homo sapiens
aatagaaattttgttaacat

SEQ ID NO: 4198561 - DNA, 23 bp, Homo sapiens
aatagacaactcttccatttatt

SEQ ID NO: 4198562 - DNA, 11 bp, Homo sapiens
aatagatgttt

SEQ ID NO: 4198563 - DNA, 19 bp, Homo sapiens
aatagatgtttgatagatt

SEQ ID NO: 4198564 - DNA, 14 bp, Homo sapiens
aatagcaaagaatt

SEQ ID NO: 4198565 - DNA, 18 bp, Homo sapiens
aatagcaaagaattgact

SEQ ID NO: 4198566 - DNA, 21 bp, Homo sapiens
aatagctaaatacctcaatca

SEQ ID NO: 4198567 - DNA, 14 bp, Homo sapiens
aatagcttgtatag

SEQ ID NO: 4198568 - DNA, 13 bp, Homo sapiens
aataggaaaatgt

SEQ ID NO: 4198569 - DNA, 17 bp, Homo sapiens
aataggaaaatgtacat

SEQ ID NO: 4198570 - DNA, 23 bp, Homo sapiens
aataggaagattaaaaccacaga

SEQ ID NO: 4198571 - DNA, 14 bp, Homo sapiens
aataggtgcaaaaa

SEQ ID NO: 4198572 - DNA, 15 bp, Homo sapiens
aatataattgtttta

SEQ ID NO: 4198573 - DNA, 20 bp, Homo sapiens
aatatatgattgtataatgt

SEQ ID NO: 4198574 - DNA, 22 bp, Homo sapiens
aatatatgattgtataatgtga

SEQ ID NO: 4198575 - DNA, 16 bp, Homo sapiens
aatatatggaagataa

SEQ ID NO: 4198576 - DNA, 22 bp, Homo sapiens
aatatatggaagataattttat

SEQ ID NO: 4198577 - DNA, 15 bp, Homo sapiens
aatatcctaaacatc

SEQ ID NO: 4198578 - DNA, 17 bp, Homo sapiens
aatatcctaaacatcat

SEQ ID NO: 4198579 - DNA, 16 bp, Homo sapiens
aatatgactcaggagc

SEQ ID NO: 4198580 - DNA, 19 bp, Homo sapiens
aatatgatcacttcatact

SEQ ID NO: 4198581 - DNA, 11 bp, Homo sapiens
aatatgcttac

SEQ ID NO: 4198582 - DNA, 17 bp, Homo sapiens
aatatggaacttctaat

SEQ ID NO: 4198583 - DNA, 17 bp, Homo sapiens
aatatggacttaaatgt

SEQ ID NO: 4198584 - DNA, 15 bp, Homo sapiens
aatatgtaccaagaa

SEQ ID NO: 4198585 - DNA, 20 bp, Homo sapiens
aatatgtctgccacagagag

SEQ ID NO: 4198586 - DNA, 14 bp, Homo sapiens
aatattatgagatg

SEQ ID NO: 4198587 - DNA, 16 bp, Homo sapiens
aatattatgagatgct

SEQ ID NO: 4198588 - DNA, 18 bp, Homo sapiens
aatattatgagatgctgg

SEQ ID NO: 4198589 - DNA, 13 bp, Homo sapiens
aatattcaaatgt

SEQ ID NO: 4198590 - DNA, 15 bp, Homo sapiens
aatattgaataagta

SEQ ID NO: 4198591 - DNA, 18 bp, Homo sapiens
aatatttaggcaagagaa

SEQ ID NO: 4198592 - DNA, 14 bp, Homo sapiens
aatatttcaaatga

SEQ ID NO: 4198593 - DNA, 13 bp, Homo sapiens
aatatttcaagtg

SEQ ID NO: 4198594 - DNA, 14 bp, Homo sapiens
aatatttcaagtgc

SEQ ID NO: 4198595 - DNA, 16 bp, Homo sapiens
aatatttcaagtgcct

SEQ ID NO: 4198596 - DNA, 14 bp, Homo sapiens
aatattttgttctt

SEQ ID NO: 4198597 - DNA, 13 bp, Homo sapiens
aatcaacttgctt

SEQ ID NO: 4198598 - DNA, 20 bp, Homo sapiens
aatcaatctatcaattacag

SEQ ID NO: 4198599 - DNA, 15 bp, Homo sapiens
aatcacgctttttga

SEQ ID NO: 4198600 - DNA, 20 bp, Homo sapiens
aatcacgctttttgaaaaag

SEQ ID NO: 4198601 - DNA, 18 bp, Homo sapiens
aatcactctgtccttgga

SEQ ID NO: 4198602 - DNA, 23 bp, Homo sapiens
aatcactgtattttcattttaat

SEQ ID NO: 4198603 - DNA, 15 bp, Homo sapiens
aatcagaagcacaaa

SEQ ID NO: 4198604 - DNA, 13 bp, Homo sapiens
aatcagacaaagt

SEQ ID NO: 4198605 - DNA, 14 bp, Homo sapiens
aatcagagaataaa

SEQ ID NO: 4198606 - DNA, 14 bp, Homo sapiens
aatcagatagatat

SEQ ID NO: 4198607 - DNA, 12 bp, Homo sapiens
aatcagcctctt

SEQ ID NO: 4198608 - DNA, 15 bp, Homo sapiens
aatcagcgccctgga

SEQ ID NO: 4198609 - DNA, 19 bp, Homo sapiens
aatcaggcccaatatcagt

SEQ ID NO: 4198610 - DNA, 20 bp, Homo sapiens
aatcatagctggttcacact

SEQ ID NO: 4198611 - DNA, 16 bp, Homo sapiens
aatcattgtgcttaat

SEQ ID NO: 4198612 - DNA, 19 bp, Homo sapiens
aatcattgtgcttaataat

SEQ ID NO: 4198613 - DNA, 14 bp, Homo sapiens
aatcatttgctttt

SEQ ID NO: 4198614 - DNA, 15 bp, Homo sapiens
aattttaaataagat

SEQ ID NO: 4198615 - DNA, 14 bp, Homo sapiens
aattttatgtgtta

SEQ ID NO: 4198616 - DNA, 16 bp, Homo sapiens
aattttatgtgttata

SEQ ID NO: 4198617 - DNA, 20 bp, Homo sapiens
aattttctagactttctgtt

SEQ ID NO: 4198618 - DNA, 18 bp, Homo sapiens
aattttgaatgtttatgt

SEQ ID NO: 4198619 - DNA, 23 bp, Homo sapiens
aattttgacttgaaaaatattca

SEQ ID NO: 4198620 - DNA, 16 bp, Homo sapiens
aattttgtatgaaaaa

SEQ ID NO: 4198621 - DNA, 14 bp, Homo sapiens
aattttgttatcac

SEQ ID NO: 4198622 - DNA, 12 bp, Homo sapiens
aatttttataaa

SEQ ID NO: 4198623 - DNA, 19 bp, Homo sapiens
aattttttgatgtcagcct

SEQ ID NO: 4198624 - DNA, 21 bp, Homo sapiens
aattttttgatgtcagccttg

SEQ ID NO: 4198625 - DNA, 18 bp, Homo sapiens
aatttttttgtattttag

SEQ ID NO: 4198626 - DNA, 14 bp, Homo sapiens
acaaaaaaccacaa

SEQ ID NO: 4198627 - DNA, 14 bp, Homo sapiens
acaaaaacaaaaca

SEQ ID NO: 4198628 - DNA, 15 bp, Homo sapiens
acaaaaacaaaacaa

SEQ ID NO: 4198629 - DNA, 16 bp, Homo sapiens
acaaaaacaaaacaaa

SEQ ID NO: 4198630 - DNA, 12 bp, Homo sapiens
acaaaacaacaa

SEQ ID NO: 4198631 - DNA, 13 bp, Homo sapiens
acaaaacaacaac

SEQ ID NO: 4198632 - DNA, 16 bp, Homo sapiens
acaaaacaacaacaat

SEQ ID NO: 4198633 - DNA, 20 bp, Homo sapiens
acaaaacaacaacaatacaa

SEQ ID NO: 4198634 - DNA, 21 bp, Homo sapiens
acaaaccaccctaaaatgaca

SEQ ID NO: 4198635 - DNA, 23 bp, Homo sapiens
acaaactattacttacaaactgc

SEQ ID NO: 4198636 - DNA, 20 bp, Homo sapiens
acaaactcgttttttacaaa

SEQ ID NO: 4198637 - DNA, 19 bp, Homo sapiens
acaaactgtaatacaatga

SEQ ID NO: 4198638 - DNA, 15 bp, Homo sapiens
acaaagaaggaaata

SEQ ID NO: 4198639 - DNA, 18 bp, Homo sapiens
acaaagacacaggaagaa

SEQ ID NO: 4198640 - DNA, 14 bp, Homo sapiens
acaaagacatggaa

SEQ ID NO: 4198641 - DNA, 16 bp, Homo sapiens
acaaagacatggaaga

SEQ ID NO: 4198642 - DNA, 18 bp, Homo sapiens
acaaagagttcaagaaat

SEQ ID NO: 4198643 - DNA, 19 bp, Homo sapiens
acaaagagttcaagaaata

SEQ ID NO: 4198644 - DNA, 16 bp, Homo sapiens
acaaagattgagaagc

SEQ ID NO: 4198645 - DNA, 24 bp, Homo sapiens
acaaaggaaaactcttggcctctg

SEQ ID NO: 4198646 - DNA, 12 bp, Homo sapiens
acaaagggacac

SEQ ID NO: 4198647 - DNA, 19 bp, Homo sapiens
acaaagggacacacagtga

SEQ ID NO: 4198648 - DNA, 20 bp, Homo sapiens
acaaaggggatgcccagtgg

SEQ ID NO: 4198649 - DNA, 23 bp, Homo sapiens
acaaatgaattgtattttttgtt

SEQ ID NO: 4198650 - DNA, 15 bp, Homo sapiens
acaaatttttcctgc

SEQ ID NO: 4198651 - DNA, 9 bp, Homo sapiens
acaacaaaa

SEQ ID NO: 4198652 - DNA, 14 bp, Homo sapiens
acaacaaaccaaaa

SEQ ID NO: 4198653 - DNA, 14 bp, Homo sapiens
acaacaacaacaat

SEQ ID NO: 4198654 - DNA, 15 bp, Homo sapiens
acaacaacaacaata

SEQ ID NO: 4198655 - DNA, 22 bp, Homo sapiens
aaaatgctatctcaaagtttaa

SEQ ID NO: 4198656 - DNA, 18 bp, Homo sapiens
aaaatgtctgttttccaa

SEQ ID NO: 4198657 - DNA, 22 bp, Homo sapiens
acactgggagaagagaacctca

SEQ ID NO: 4198658 - DNA, 21 bp, Homo sapiens
acactgttcccaatatgtagc

SEQ ID NO: 4198659 - DNA, 13 bp, Homo sapiens
acacttaggaaga

SEQ ID NO: 4198660 - DNA, 15 bp, Homo sapiens
acacttaggaagaaa

SEQ ID NO: 4198661 - DNA, 17 bp, Homo sapiens
acacttaggaagaaatc

SEQ ID NO: 4198662 - DNA, 19 bp, Homo sapiens
acacttcttgaaacagcct

SEQ ID NO: 4198663 - DNA, 21 bp, Homo sapiens
acacttcttgaaacagcctgg

SEQ ID NO: 4198664 - DNA, 13 bp, Homo sapiens
acacttgcaacct

SEQ ID NO: 4198665 - DNA, 22 bp, Homo sapiens
acactttggccaagcaagaggt

SEQ ID NO: 4198666 - DNA, 14 bp, Homo sapiens
acagaaacattttc

SEQ ID NO: 4198667 - DNA, 17 bp, Homo sapiens
acagaaattagccgggc

SEQ ID NO: 4198668 - DNA, 22 bp, Homo sapiens
acagaacaattaaacagccaaa

SEQ ID NO: 4198669 - DNA, 12 bp, Homo sapiens
acagaagaggag

SEQ ID NO: 4198670 - DNA, 22 bp, Homo sapiens
acagaagaggagggacctactg

SEQ ID NO: 4198671 - DNA, 18 bp, Homo sapiens
acagaagcttcagaagtt

SEQ ID NO: 4198672 - DNA, 15 bp, Homo sapiens
acagaagtttgcact

SEQ ID NO: 4198673 - DNA, 17 bp, Homo sapiens
acagaatgctgttttaa

SEQ ID NO: 4198674 - DNA, 18 bp, Homo sapiens
acagaatgctgttttaaa

SEQ ID NO: 4198675 - DNA, 12 bp, Homo sapiens
acagacccacac

SEQ ID NO: 4198676 - DNA, 19 bp, Homo sapiens
acagacgtctcaagactga

SEQ ID NO: 4198677 - DNA, 17 bp, Homo sapiens
acagactatttaacttg

SEQ ID NO: 4198678 - DNA, 15 bp, Homo sapiens
acagacttctccaga

SEQ ID NO: 4198679 - DNA, 16 bp, Homo sapiens
acagacttctccagac

SEQ ID NO: 4198680 - DNA, 17 bp, Homo sapiens
acagagagtcctttggg

SEQ ID NO: 4198681 - DNA, 19 bp, Homo sapiens
acagagatgcatgcgcagg

SEQ ID NO: 4198682 - DNA, 21 bp, Homo sapiens
acagagcgagagtctgtctca

SEQ ID NO: 4198683 - DNA, 16 bp, Homo sapiens
acagagctggctgtct

SEQ ID NO: 4198684 - DNA, 19 bp, Homo sapiens
acagagctggctgtcttcc

SEQ ID NO: 4198685 - DNA, 15 bp, Homo sapiens
acagaggcagtagga

SEQ ID NO: 4198686 - DNA, 14 bp, Homo sapiens
acagataactgaaa

SEQ ID NO: 4198687 - DNA, 21 bp, Homo sapiens
acagattctagccaaactatt

SEQ ID NO: 4198688 - DNA, 12 bp, Homo sapiens
acagcagtgtgg

SEQ ID NO: 4198689 - DNA, 15 bp, Homo sapiens
acagcagtgtggtct

SEQ ID NO: 4198690 - DNA, 21 bp, Homo sapiens
acagcccacggggatcacagc

SEQ ID NO: 4198691 - DNA, 14 bp, Homo sapiens
acagcccagcctag

SEQ ID NO: 4198692 - DNA, 23 bp, Homo sapiens
acagcccgggtgtgcctgccctg

SEQ ID NO: 4198693 - DNA, 23 bp, Homo sapiens
acagccgcagcctccctctgacc

SEQ ID NO: 4198694 - DNA, 19 bp, Homo sapiens
acagcctgggtaggaaaat

SEQ ID NO: 4198695 - DNA, 16 bp, Homo sapiens
acagctaggcatgcct

SEQ ID NO: 4198696 - DNA, 16 bp, Homo sapiens
acagctgagagacttt

SEQ ID NO: 4198697 - DNA, 19 bp, Homo sapiens
acagctgagagacttttaa

SEQ ID NO: 4198698 - DNA, 22 bp, Homo sapiens
acagctgagagacttttaatca

SEQ ID NO: 4198699 - DNA, 18 bp, Homo sapiens
acagctgctgaagaggca

SEQ ID NO: 4198700 - DNA, 15 bp, Homo sapiens
acagctgtttaagat

SEQ ID NO: 4198701 - DNA, 17 bp, Homo sapiens
acagctgtttaagatgg

SEQ ID NO: 4198702 - DNA, 19 bp, Homo sapiens
acagctgtttaagatgggc

SEQ ID NO: 4198703 - DNA, 21 bp, Homo sapiens
acattttaaaacgttttctct

SEQ ID NO: 4198704 - DNA, 23 bp, Homo sapiens
acattttacatatggaaatatag

SEQ ID NO: 4198705 - DNA, 20 bp, Homo sapiens
acattttctgtgtgtacatg

SEQ ID NO: 4198706 - DNA, 13 bp, Homo sapiens
acattttgccttt

SEQ ID NO: 4198707 - DNA, 17 bp, Homo sapiens
accaaaaaagtattttt

SEQ ID NO: 4198708 - DNA, 21 bp, Homo sapiens
accaaaaaggctagtttattt

SEQ ID NO: 4198709 - DNA, 13 bp, Homo sapiens
accaaaagaagta

SEQ ID NO: 4198710 - DNA, 14 bp, Homo sapiens
accaaaagaagtaa

SEQ ID NO: 4198711 - DNA, 23 bp, Homo sapiens
accaaaatttctttttttaaatt

SEQ ID NO: 4198712 - DNA, 21 bp, Homo sapiens
accaaaggaatcgtttcaaat

SEQ ID NO: 4198713 - DNA, 14 bp, Homo sapiens
accaaattgggaga

SEQ ID NO: 4198714 - DNA, 14 bp, Homo sapiens
accaacataaaaat

SEQ ID NO: 4198715 - DNA, 23 bp, Homo sapiens
accaacataaaaatgatctaaac

SEQ ID NO: 4198716 - DNA, 15 bp, Homo sapiens
accaaccaaccacaa

SEQ ID NO: 4198717 - DNA, 14 bp, Homo sapiens
accaactttctgta

SEQ ID NO: 4198718 - DNA, 20 bp, Homo sapiens
accaagatacttaagtgctg

SEQ ID NO: 4198719 - DNA, 13 bp, Homo sapiens
accaagctgagca

SEQ ID NO: 4198720 - DNA, 14 bp, Homo sapiens
accaatgacttttt

SEQ ID NO: 4198721 - DNA, 19 bp, Homo sapiens
accaatgcttttatcaaac

SEQ ID NO: 4198722 - DNA, 19 bp, Homo sapiens
accaattcacccagaaaaa

SEQ ID NO: 4198723 - DNA, 16 bp, Homo sapiens
accaattggttaatct

SEQ ID NO: 4198724 - DNA, 16 bp, Homo sapiens
accaattttaaataca

SEQ ID NO: 4198725 - DNA, 18 bp, Homo sapiens
accacaaactgtaataca

SEQ ID NO: 4198726 - DNA, 17 bp, Homo sapiens
accacaagcctgagaac

SEQ ID NO: 4198727 - DNA, 16 bp, Homo sapiens
accacaccgcagaagc

SEQ ID NO: 4198728 - DNA, 16 bp, Homo sapiens
accacagcagctgaac

SEQ ID NO: 4198729 - DNA, 15 bp, Homo sapiens
accacctctcaatat

SEQ ID NO: 4198730 - DNA, 20 bp, Homo sapiens
accacctgggttcagcctct

SEQ ID NO: 4198731 - DNA, 12 bp, Homo sapiens
accaccttccct

SEQ ID NO: 4198732 - DNA, 21 bp, Homo sapiens
accactagggtcctggccctc

SEQ ID NO: 4198733 - DNA, 13 bp, Homo sapiens
accactcctcagg

SEQ ID NO: 4198734 - DNA, 22 bp, Homo sapiens
accactcctcaggaacagaaca

SEQ ID NO: 4198735 - DNA, 18 bp, Homo sapiens
accactgaacatttgctt

SEQ ID NO: 4198736 - DNA, 21 bp, Homo sapiens
accactgcactccagcctggg

SEQ ID NO: 4198737 - DNA, 16 bp, Homo sapiens
accactgtggccttct

SEQ ID NO: 4198738 - DNA, 15 bp, Homo sapiens
accagagcagagagc

SEQ ID NO: 4198739 - DNA, 19 bp, Homo sapiens
accagagccttcaagtgcc

SEQ ID NO: 4198740 - DNA, 19 bp, Homo sapiens
accaggactatagcccagg

SEQ ID NO: 4198741 - DNA, 19 bp, Homo sapiens
accaggagggtaacagaag

SEQ ID NO: 4198742 - DNA, 14 bp, Homo sapiens
accaggatagagac

SEQ ID NO: 4198743 - DNA, 21 bp, Homo sapiens
accaggcaccaaaagaagtaa

SEQ ID NO: 4198744 - DNA, 21 bp, Homo sapiens
accagggagaccgagcgcttt

SEQ ID NO: 4198745 - DNA, 19 bp, Homo sapiens
accagggcactgtctgcgt

SEQ ID NO: 4198746 - DNA, 20 bp, Homo sapiens
accagggcactgtctgcgtg

SEQ ID NO: 4198747 - DNA, 24 bp, Homo sapiens
accaggggtgatttcagagagggc

SEQ ID NO: 4198748 - DNA, 16 bp, Homo sapiens
accagttaagaatgga

SEQ ID NO: 4198749 - DNA, 22 bp, Homo sapiens
accatagcacaggctaattttt

SEQ ID NO: 4198750 - DNA, 18 bp, Homo sapiens
accatccaccctgcaggc

SEQ ID NO: 4198751 - DNA, 15 bp, Homo sapiens
accatcgtccagccc

SEQ ID NO: 4198752 - DNA, 13 bp, Homo sapiens
accatctaatagc

SEQ ID NO: 4198753 - DNA, 19 bp, Homo sapiens
accatgccaggctaatttt

SEQ ID NO: 4198754 - DNA, 14 bp, Homo sapiens
accattaagaaatg

SEQ ID NO: 4198755 - DNA, 23 bp, Homo sapiens
acgtgagccaggtaatgagggac

SEQ ID NO: 4198756 - DNA, 15 bp, Homo sapiens
acgtggggagggtgg

SEQ ID NO: 4198757 - DNA, 17 bp, Homo sapiens
acgtggggagggtggag

SEQ ID NO: 4198758 - DNA, 12 bp, Homo sapiens
acgtgtgtgaag

SEQ ID NO: 4198759 - DNA, 18 bp, Homo sapiens
acgtgttcctataaaatc

SEQ ID NO: 4198760 - DNA, 21 bp, Homo sapiens
acgttaagggaaggaactctg

SEQ ID NO: 4198761 - DNA, 18 bp, Homo sapiens
actaaaaaatgtctatag

SEQ ID NO: 4198762 - DNA, 11 bp, Homo sapiens
actaaaagaat

SEQ ID NO: 4198763 - DNA, 15 bp, Homo sapiens
actaaaattccactc

SEQ ID NO: 4198764 - DNA, 22 bp, Homo sapiens
actaaagtatgtaaagtatgta

SEQ ID NO: 4198765 - DNA, 24 bp, Homo sapiens
actaagagctttatatattgatta

SEQ ID NO: 4198766 - DNA, 21 bp, Homo sapiens
actaagcaccataaccaagaa

SEQ ID NO: 4198767 - DNA, 22 bp, Homo sapiens
actaagcaccataaccaagaaa

SEQ ID NO: 4198768 - DNA, 15 bp, Homo sapiens
actaagccacaagaa

SEQ ID NO: 4198769 - DNA, 18 bp, Homo sapiens
actaagccacaagaaatt

SEQ ID NO: 4198770 - DNA, 18 bp, Homo sapiens
actaagctttctcctttg

SEQ ID NO: 4198771 - DNA, 23 bp, Homo sapiens
actaatgaagatacggttgcttc

SEQ ID NO: 4198772 - DNA, 13 bp, Homo sapiens
actaatggcatga

SEQ ID NO: 4198773 - DNA, 16 bp, Homo sapiens
actaatggcatgagaa

SEQ ID NO: 4198774 - DNA, 22 bp, Homo sapiens
actaatggcatgagaaatacaa

SEQ ID NO: 4198775 - DNA, 16 bp, Homo sapiens
actacaaccaatggaa

SEQ ID NO: 4198776 - DNA, 20 bp, Homo sapiens
actacacatccctaatgtgt

SEQ ID NO: 4198777 - DNA, 17 bp, Homo sapiens
actacagtctaaagctg

SEQ ID NO: 4198778 - DNA, 15 bp, Homo sapiens
actacatgtggttta

SEQ ID NO: 4198779 - DNA, 13 bp, Homo sapiens
actaccctgggct

SEQ ID NO: 4198780 - DNA, 21 bp, Homo sapiens
actacctttatagctcatcac

SEQ ID NO: 4198781 - DNA, 18 bp, Homo sapiens
actacctttatagctctc

SEQ ID NO: 4198782 - DNA, 23 bp, Homo sapiens
actactttgcctcttcagcagca

SEQ ID NO: 4198783 - DNA, 17 bp, Homo sapiens
actagaatttgtatttt

SEQ ID NO: 4198784 - DNA, 18 bp, Homo sapiens
actagaatttgtattttg

SEQ ID NO: 4198785 - DNA, 21 bp, Homo sapiens
actagaggtgagaaatttaaa

SEQ ID NO: 4198786 - DNA, 20 bp, Homo sapiens
actagatctctggattctaa

SEQ ID NO: 4198787 - DNA, 15 bp, Homo sapiens
actagatggcgagca

SEQ ID NO: 4198788 - DNA, 16 bp, Homo sapiens
actaggaggaaaagac

SEQ ID NO: 4198789 - DNA, 22 bp, Homo sapiens
actagggagccatgtttcacaa

SEQ ID NO: 4198790 - DNA, 21 bp, Homo sapiens
actaggtttaaaacagcctgg

SEQ ID NO: 4198791 - DNA, 19 bp, Homo sapiens
actagtatctctggcctcc

SEQ ID NO: 4198792 - DNA, 14 bp, Homo sapiens
actagttcagagga

SEQ ID NO: 4198793 - DNA, 19 bp, Homo sapiens
actagttcagaggaagcac

SEQ ID NO: 4198794 - DNA, 19 bp, Homo sapiens
actagttgaacatctcact

SEQ ID NO: 4198795 - DNA, 14 bp, Homo sapiens
actataagaacttt

SEQ ID NO: 4198796 - DNA, 15 bp, Homo sapiens
actataatgtgatga

SEQ ID NO: 4198797 - DNA, 13 bp, Homo sapiens
actatacaacaat

SEQ ID NO: 4198798 - DNA, 14 bp, Homo sapiens
actatacaacaatg

SEQ ID NO: 4198799 - DNA, 15 bp, Homo sapiens
actatacatactata

SEQ ID NO: 4198800 - DNA, 20 bp, Homo sapiens
actatagcccaggtcctctg

SEQ ID NO: 4198801 - DNA, 21 bp, Homo sapiens
actatagtttaatactcagag

SEQ ID NO: 4198802 - DNA, 21 bp, Homo sapiens
actatcaactagcagaaaata

SEQ ID NO: 4198803 - DNA, 23 bp, Homo sapiens
actatccaatgaatgatcattga

SEQ ID NO: 4198804 - DNA, 19 bp, Homo sapiens
actatcgtcttcctacaca

SEQ ID NO: 4198805 - DNA, 20 bp, Homo sapiens
actatgaaaagctagaattg

SEQ ID NO: 4198806 - DNA, 17 bp, Homo sapiens
actatgaaatgaaagaa

SEQ ID NO: 4198807 - DNA, 19 bp, Homo sapiens
actatgacccatttaattt

SEQ ID NO: 4198808 - DNA, 14 bp, Homo sapiens
actatgccacagat

SEQ ID NO: 4198809 - DNA, 14 bp, Homo sapiens
actatgctgaagag

SEQ ID NO: 4198810 - DNA, 21 bp, Homo sapiens
actatggataaactaaacacg

SEQ ID NO: 4198811 - DNA, 13 bp, Homo sapiens
actattattaata

SEQ ID NO: 4198812 - DNA, 19 bp, Homo sapiens
actattgcaagtcatactt

SEQ ID NO: 4198813 - DNA, 21 bp, Homo sapiens
actattggaagataaacttgt

SEQ ID NO: 4198814 - DNA, 14 bp, Homo sapiens
actatttaacttga

SEQ ID NO: 4198815 - DNA, 18 bp, Homo sapiens
actatttttatattctat

SEQ ID NO: 4198816 - DNA, 19 bp, Homo sapiens
actcaacaataaagactga

SEQ ID NO: 4198817 - DNA, 17 bp, Homo sapiens
actcaagcctgagagaa

SEQ ID NO: 4198818 - DNA, 18 bp, Homo sapiens
actcacccatgtgccaag

SEQ ID NO: 4198819 - DNA, 15 bp, Homo sapiens
actcacctctctcta

SEQ ID NO: 4198820 - DNA, 17 bp, Homo sapiens
actcacctctctctaag

SEQ ID NO: 4198821 - DNA, 15 bp, Homo sapiens
actcactttcccttg

SEQ ID NO: 4198822 - DNA, 14 bp, Homo sapiens
actcagaagcctga

SEQ ID NO: 4198823 - DNA, 19 bp, Homo sapiens
actcagcagtaagcaggcc

SEQ ID NO: 4198824 - DNA, 14 bp, Homo sapiens
actcagctccagaa

SEQ ID NO: 4198825 - DNA, 18 bp, Homo sapiens
actcaggaggctgagggg

SEQ ID NO: 4198826 - DNA, 22 bp, Homo sapiens
actcaggatgccaagtggccct

SEQ ID NO: 4198827 - DNA, 13 bp, Homo sapiens
actcaggattctc

SEQ ID NO: 4198828 - DNA, 21 bp, Homo sapiens
actcagtctgtgggagctcag

SEQ ID NO: 4198829 - DNA, 13 bp, Homo sapiens
tgtcaccagcctg

SEQ ID NO: 4198830 - DNA, 14 bp, Homo sapiens
tgtcaccagcctgt

SEQ ID NO: 4198831 - DNA, 22 bp, Homo sapiens
tgtcaccagcctgtttagccaa

SEQ ID NO: 4198832 - DNA, 22 bp, Homo sapiens
tgtcaccgtgagcagctttgga

SEQ ID NO: 4198833 - DNA, 17 bp, Homo sapiens
tgtcactcaaggcggtg

SEQ ID NO: 4198834 - DNA, 22 bp, Homo sapiens
tgtcactcaaggcggtgcttga

SEQ ID NO: 4198835 - DNA, 14 bp, Homo sapiens
tgtcactgaagatt

SEQ ID NO: 4198836 - DNA, 20 bp, Homo sapiens
tgtcactggcagagcacagc

SEQ ID NO: 4198837 - DNA, 22 bp, Homo sapiens
tgtcactggcagagcacagccc

SEQ ID NO: 4198838 - DNA, 16 bp, Homo sapiens
tgtcagagccaggctc

SEQ ID NO: 4198839 - DNA, 18 bp, Homo sapiens
tgtcagagccaggctctg

SEQ ID NO: 4198840 - DNA, 14 bp, Homo sapiens
tgtcatcaaatatt

SEQ ID NO: 4198841 - DNA, 18 bp, Homo sapiens
tgtcatccccttgtgtca

SEQ ID NO: 4198842 - DNA, 19 bp, Homo sapiens
tgtcatgaattcttatgct

SEQ ID NO: 4198843 - DNA, 19 bp, Homo sapiens
tgtcatggtcctttctgga

SEQ ID NO: 4198844 - DNA, 17 bp, Homo sapiens
tgtcatttaccctggtg

SEQ ID NO: 4198845 - DNA, 12 bp, Homo sapiens
tgtcatttgctt

SEQ ID NO: 4198846 - DNA, 15 bp, Homo sapiens
tgtccaatcagagaa

SEQ ID NO: 4198847 - DNA, 16 bp, Homo sapiens
tgtccaattctcttta

SEQ ID NO: 4198848 - DNA, 19 bp, Homo sapiens
tgtccgatggtatctgggt

SEQ ID NO: 4198849 - DNA, 13 bp, Homo sapiens
tgtcctcagagca

SEQ ID NO: 4198850 - DNA, 19 bp, Homo sapiens
tgtcctcagagcaggggcc

SEQ ID NO: 4198851 - DNA, 13 bp, Homo sapiens
tgtcctgcctctc

SEQ ID NO: 4198852 - DNA, 22 bp, Homo sapiens
tgtcctgcctctctgctccaga

SEQ ID NO: 4198853 - DNA, 23 bp, Homo sapiens
tgtcctgcctctctgctccagag

SEQ ID NO: 4198854 - DNA, 14 bp, Homo sapiens
tgtcctggctccca

SEQ ID NO: 4198855 - DNA, 18 bp, Homo sapiens
tgtcctggtacagcaggg

SEQ ID NO: 4198856 - DNA, 20 bp, Homo sapiens
tgtcctgtagaggttttgtt

SEQ ID NO: 4198857 - DNA, 13 bp, Homo sapiens
tgtcctttctaga

SEQ ID NO: 4198858 - DNA, 21 bp, Homo sapiens
tgtctagaggtgagaccaaag

SEQ ID NO: 4198859 - DNA, 16 bp, Homo sapiens
tgtctcacagaggcag

SEQ ID NO: 4198860 - DNA, 20 bp, Homo sapiens
tgtctcgtctcctgacatgt

SEQ ID NO: 4198861 - DNA, 15 bp, Homo sapiens
tgtctctagccgggc

SEQ ID NO: 4198862 - DNA, 16 bp, Homo sapiens
tgtctctgcatctcat

SEQ ID NO: 4198863 - DNA, 16 bp, Homo sapiens
tgtctgatttaacact

SEQ ID NO: 4198864 - DNA, 14 bp, Homo sapiens
tgtctgcacccagg

SEQ ID NO: 4198865 - DNA, 15 bp, Homo sapiens
tgtctgcacccaggg

SEQ ID NO: 4198866 - DNA, 16 bp, Homo sapiens
tgtctggttttaacaa

SEQ ID NO: 4198867 - DNA, 13 bp, Homo sapiens
tgtctgtcctcag

SEQ ID NO: 4198868 - DNA, 16 bp, Homo sapiens
tgtctgtcctcagagc

SEQ ID NO: 4198869 - DNA, 15 bp, Homo sapiens
tgtctgtgcgtctgt

SEQ ID NO: 4198870 - DNA, 19 bp, Homo sapiens
tgtctgttttccaaagata

SEQ ID NO: 4198871 - DNA, 19 bp, Homo sapiens
tgtcttataaacaaatgaa

SEQ ID NO: 4198872 - DNA, 20 bp, Homo sapiens
tgtcttggtggatgggccct

SEQ ID NO: 4198873 - DNA, 21 bp, Homo sapiens
tgtcttggtggatgggccctg

SEQ ID NO: 4198874 - DNA, 22 bp, Homo sapiens
tgtcttggtggatgggccctgc

SEQ ID NO: 4198875 - DNA, 22 bp, Homo sapiens
tgtgaattgcctgcagagagaa

SEQ ID NO: 4198876 - DNA, 23 bp, Homo sapiens
tgtgaatttcttcactgttgaaa

SEQ ID NO: 4198877 - DNA, 21 bp, Homo sapiens
tgtgacccaaagaagtttaag

SEQ ID NO: 4198878 - DNA, 18 bp, Homo sapiens
tgtgatcccaagtgccag

SEQ ID NO: 4198879 - DNA, 16 bp, Homo sapiens
tgtgatgattaataca

SEQ ID NO: 4198880 - DNA, 17 bp, Homo sapiens
tgtgatgttaactatta

SEQ ID NO: 4198881 - DNA, 18 bp, Homo sapiens
tgtgatttagaactgtat

SEQ ID NO: 4198882 - DNA, 23 bp, Homo sapiens
tgtgatttagaactgtatgtcag

SEQ ID NO: 4198883 - DNA, 15 bp, Homo sapiens
tgtgcaaattaacag

SEQ ID NO: 4198884 - DNA, 19 bp, Homo sapiens
tgtgcagtcagtgtcaatc

SEQ ID NO: 4198885 - DNA, 21 bp, Homo sapiens
tgtgcatatatactacatgag

SEQ ID NO: 4198886 - DNA, 20 bp, Homo sapiens
tgtgccaatgtgacaacatg

SEQ ID NO: 4198887 - DNA, 20 bp, Homo sapiens
tgtgccatagagtttaacac

SEQ ID NO: 4198888 - DNA, 21 bp, Homo sapiens
tgtgccatagagtttaacaca

SEQ ID NO: 4198889 - DNA, 22 bp, Homo sapiens
tgtgccatagagtttaacacaa

SEQ ID NO: 4198890 - DNA, 15 bp, Homo sapiens
tgtgccctgccttca

SEQ ID NO: 4198891 - DNA, 14 bp, Homo sapiens
tgtgcctgccctgg

SEQ ID NO: 4198892 - DNA, 18 bp, Homo sapiens
tgtgctatggtgctctgt

SEQ ID NO: 4198893 - DNA, 12 bp, Homo sapiens
tgtgcttaataa

SEQ ID NO: 4198894 - DNA, 19 bp, Homo sapiens
tgtgcttatggtaccagat

SEQ ID NO: 4198895 - DNA, 17 bp, Homo sapiens
tgtggaaagcctctgct

SEQ ID NO: 4198896 - DNA, 19 bp, Homo sapiens
tgtggaaagcctctgctgc

SEQ ID NO: 4198897 - DNA, 16 bp, Homo sapiens
tgtggagacagccctg

SEQ ID NO: 4198898 - DNA, 18 bp, Homo sapiens
tgtggagacagccctgcc

SEQ ID NO: 4198899 - DNA, 22 bp, Homo sapiens
tgtggcccagtcgtccgctcag

SEQ ID NO: 4198900 - DNA, 11 bp, Homo sapiens
tgtgggaagag

SEQ ID NO: 4198901 - DNA, 15 bp, Homo sapiens
tgtgggtacatgtga

SEQ ID NO: 4198902 - DNA, 22 bp, Homo sapiens
tgtggtgaggtcctgtcctggc

SEQ ID NO: 4198903 - DNA, 23 bp, Homo sapiens
tgtggtgaggtcctgtcctggct

SEQ ID NO: 4198904 - DNA, 23 bp, Homo sapiens
tgtggtgggttctttggaaggag

SEQ ID NO: 4198905 - DNA, 15 bp, Homo sapiens
tgtggtgtgtgtgct

SEQ ID NO: 4198906 - DNA, 18 bp, Homo sapiens
tgtggttcctaagcctgt

SEQ ID NO: 4198907 - DNA, 21 bp, Homo sapiens
tgtgtaaagtgtaaatccttt

SEQ ID NO: 4198908 - DNA, 18 bp, Homo sapiens
tgtgtaatagaaaactga

SEQ ID NO: 4198909 - DNA, 10 bp, Homo sapiens
tgtgtacagg

SEQ ID NO: 4198910 - DNA, 19 bp, Homo sapiens
tgtgtacagtgtgtaaagt

SEQ ID NO: 4198911 - DNA, 20 bp, Homo sapiens
tgtgtacctttgtgtaaaga

SEQ ID NO: 4198912 - DNA, 13 bp, Homo sapiens
tgtgtatccgact

SEQ ID NO: 4198913 - DNA, 14 bp, Homo sapiens
tgtgtatgtatgtg

SEQ ID NO: 4198914 - DNA, 14 bp, Homo sapiens
tgtgtattgaagaa

SEQ ID NO: 4198915 - DNA, 16 bp, Homo sapiens
tgtgtctcgtctcctg

SEQ ID NO: 4198916 - DNA, 16 bp, Homo sapiens
tgtgtgatgaactttc

SEQ ID NO: 4198917 - DNA, 24 bp, Homo sapiens
tgtgtgccatagagtttaacacaa

SEQ ID NO: 4198918 - DNA, 20 bp, Homo sapiens
tgtgtggtgggttctttgga

SEQ ID NO: 4198919 - DNA, 23 bp, Homo sapiens
tgtgtgtaggtattaaagatgtg

SEQ ID NO: 4198920 - DNA, 16 bp, Homo sapiens
tgtgtgtatgtatgtg

SEQ ID NO: 4198921 - DNA, 12 bp, Homo sapiens
tgtgtgtctcac

SEQ ID NO: 4198922 - DNA, 20 bp, Homo sapiens
tgttaaaaaaataagaagaa

SEQ ID NO: 4198923 - DNA, 19 bp, Homo sapiens
tgttaacatggaatttaat

SEQ ID NO: 4198924 - DNA, 22 bp, Homo sapiens
tgttaagcaaaggaaaccaaag

SEQ ID NO: 4198925 - DNA, 15 bp, Homo sapiens
tgttaatgagaaaat

SEQ ID NO: 4198926 - DNA, 16 bp, Homo sapiens
tgttaatttgttatgt

SEQ ID NO: 4198927 - DNA, 13 bp, Homo sapiens
tgttaatttttga

SEQ ID NO: 4198928 - DNA, 15 bp, Homo sapiens
tgttaatttttgata

SEQ ID NO: 4198929 - DNA, 18 bp, Homo sapiens
tgttacagctcatgtttt

SEQ ID NO: 4198930 - DNA, 14 bp, Homo sapiens
tgttactgtgtgaa

SEQ ID NO: 4198931 - DNA, 15 bp, Homo sapiens
tgttactgtgtgaag

SEQ ID NO: 4198932 - DNA, 17 bp, Homo sapiens
tgttagagagtataact

SEQ ID NO: 4198933 - DNA, 21 bp, Homo sapiens
tgttaggctttataggtgaag

SEQ ID NO: 4198934 - DNA, 22 bp, Homo sapiens
tgttatcaaacaccaacataaa

SEQ ID NO: 4198935 - DNA, 14 bp, Homo sapiens
tgttatccacaagc

SEQ ID NO: 4198936 - DNA, 18 bp, Homo sapiens
tgttatgatcgcctgtgg

SEQ ID NO: 4198937 - DNA, 19 bp, Homo sapiens
tgttatgtatatagatgtg

SEQ ID NO: 4198938 - DNA, 19 bp, Homo sapiens
tgttcaagtatctaactct

SEQ ID NO: 4198939 - DNA, 14 bp, Homo sapiens
tgttcagcttcaga

SEQ ID NO: 4198940 - DNA, 13 bp, Homo sapiens
tgttcagttgact

SEQ ID NO: 4198941 - DNA, 15 bp, Homo sapiens
tgttcagttttcctt

SEQ ID NO: 4198942 - DNA, 16 bp, Homo sapiens
tgttcatgatagtgtg

SEQ ID NO: 4198943 - DNA, 20 bp, Homo sapiens
tgttcgtattctattcaaaa

SEQ ID NO: 4198944 - DNA, 18 bp, Homo sapiens
tgttctatagagcctggc

SEQ ID NO: 4198945 - DNA, 15 bp, Homo sapiens
tgttctgtattttca

SEQ ID NO: 4198946 - DNA, 23 bp, Homo sapiens
tgttctttataaaaagtgaaata

SEQ ID NO: 4198947 - DNA, 16 bp, Homo sapiens
tgttctttctggagtc

SEQ ID NO: 4198948 - DNA, 14 bp, Homo sapiens
tgttgaaagtaaaa

SEQ ID NO: 4198949 - DNA, 21 bp, Homo sapiens
tgttgaatgcttaaagcaagg

SEQ ID NO: 4198950 - DNA, 16 bp, Homo sapiens
tgttgagcatcacaga

SEQ ID NO: 4198951 - DNA, 20 bp, Homo sapiens
tgttgagcatcacagaatgt

SEQ ID NO: 4198952 - DNA, 15 bp, Homo sapiens
tgttgcgctcccgca

SEQ ID NO: 4198953 - DNA, 14 bp, Homo sapiens
tgttgcttggagtg

SEQ ID NO: 4198954 - DNA, 18 bp, Homo sapiens
tgttgctttaggtgagtc

SEQ ID NO: 4198955 - DNA, 13 bp, Homo sapiens
tgttgtaaataaa

SEQ ID NO: 4198956 - DNA, 18 bp, Homo sapiens
tgttgtacacagtctgtt

SEQ ID NO: 4198957 - DNA, 21 bp, Homo sapiens
tgttgttatcatttaagattt

SEQ ID NO: 4198958 - DNA, 16 bp, Homo sapiens
tgttgtttcttaaata

SEQ ID NO: 4198959 - DNA, 15 bp, Homo sapiens
tgtttaaaacatcat

SEQ ID NO: 4198960 - DNA, 14 bp, Homo sapiens
tgtttaaacctttt

SEQ ID NO: 4198961 - DNA, 15 bp, Homo sapiens
tgtttactgcaaggt

SEQ ID NO: 4198962 - DNA, 16 bp, Homo sapiens
tgtttagtagcagtga

SEQ ID NO: 4198963 - DNA, 18 bp, Homo sapiens
tgtttagtagcagtgatt

SEQ ID NO: 4198964 - DNA, 16 bp, Homo sapiens
tgtttcacaaggtctt

SEQ ID NO: 4198965 - DNA, 15 bp, Homo sapiens
tgtttctccccctgg

SEQ ID NO: 4198966 - DNA, 13 bp, Homo sapiens
tgtttgatagatt

SEQ ID NO: 4198967 - DNA, 12 bp, Homo sapiens
tgtttgctttct

SEQ ID NO: 4198968 - DNA, 22 bp, Homo sapiens
tgtttgggcagaagggagaagg

SEQ ID NO: 4198969 - DNA, 19 bp, Homo sapiens
tgtttgtctgtgtgctgta

SEQ ID NO: 4198970 - DNA, 22 bp, Homo sapiens
tgtttgtttctccccctgggct

SEQ ID NO: 4198971 - DNA, 22 bp, Homo sapiens
tgttttaaatacgcactacatg

SEQ ID NO: 4198972 - DNA, 20 bp, Homo sapiens
tgttttacaagaattgtcca

SEQ ID NO: 4198973 - DNA, 21 bp, Homo sapiens
tgttttacaagaattgtccat

SEQ ID NO: 4198974 - DNA, 12 bp, Homo sapiens
tgttttatcatg

SEQ ID NO: 4198975 - DNA, 23 bp, Homo sapiens
tgttttatcatgacatgttatat

SEQ ID NO: 4198976 - DNA, 21 bp, Homo sapiens
tgttttccctttaaagccttt

SEQ ID NO: 4198977 - DNA, 15 bp, Homo sapiens
tgttttgcactgaca

SEQ ID NO: 4198978 - DNA, 21 bp, Homo sapiens
tgttttgcactgacaagatgg

SEQ ID NO: 4198979 - DNA, 15 bp, Homo sapiens
tgttttgtttcttga

SEQ ID NO: 4198980 - DNA, 22 bp, Homo sapiens
ttaaaaatatggaacttctaat

SEQ ID NO: 4198981 - DNA, 16 bp, Homo sapiens
ttaaaacagcctgggt

SEQ ID NO: 4198982 - DNA, 16 bp, Homo sapiens
ttaaaaccacagaaca

SEQ ID NO: 4198983 - DNA, 13 bp, Homo sapiens
tatggaacttcta

SEQ ID NO: 4198984 - DNA, 19 bp, Homo sapiens
tatggaagataattttatg

SEQ ID NO: 4198985 - DNA, 23 bp, Homo sapiens
tatggacaaatggactatacata

SEQ ID NO: 4198986 - DNA, 15 bp, Homo sapiens
tatggattctaaaat

SEQ ID NO: 4198987 - DNA, 15 bp, Homo sapiens
tatggtgctctgtct

SEQ ID NO: 4198988 - DNA, 15 bp, Homo sapiens
tatgtaaaacattta

SEQ ID NO: 4198989 - DNA, 17 bp, Homo sapiens
tatgtaaagtatgtaaa

SEQ ID NO: 4198990 - DNA, 18 bp, Homo sapiens
tatgtaaagtatgtaaac

SEQ ID NO: 4198991 - DNA, 23 bp, Homo sapiens
tatgtatatactatacaacaatg

SEQ ID NO: 4198992 - DNA, 16 bp, Homo sapiens
tatgtatatagatgtg

SEQ ID NO: 4198993 - DNA, 16 bp, Homo sapiens
tatgtctaaagagctt

SEQ ID NO: 4198994 - DNA, 19 bp, Homo sapiens
tatgtgtgtggtgtgtgtg

SEQ ID NO: 4198995 - DNA, 20 bp, Homo sapiens
tatgttaatttgttatgtat

SEQ ID NO: 4198996 - DNA, 20 bp, Homo sapiens
tattaaaaaggtttacagaa

SEQ ID NO: 4198997 - DNA, 18 bp, Homo sapiens
tattaaaatgattgtaaa

SEQ ID NO: 4198998 - DNA, 20 bp, Homo sapiens
tattaaaatgattgtaaaat

SEQ ID NO: 4198999 - DNA, 18 bp, Homo sapiens
tattaacttgtattttct

SEQ ID NO: 4199000 - DNA, 19 bp, Homo sapiens
tattaaggggatcagaagt

SEQ ID NO: 4199001 - DNA, 17 bp, Homo sapiens
tattaatttatgcagaa

SEQ ID NO: 4199002 - DNA, 13 bp, Homo sapiens
tattacatgtgtt

SEQ ID NO: 4199003 - DNA, 19 bp, Homo sapiens
ttgatttttgtaataaaag

SEQ ID NO: 4199004 - DNA, 15 bp, Homo sapiens
ttgcaaaaactacaa

SEQ ID NO: 4199005 - DNA, 15 bp, Homo sapiens
ttgcaaaactgtgct

SEQ ID NO: 4199006 - DNA, 14 bp, Homo sapiens
ttgcaaacctcaga

SEQ ID NO: 4199007 - DNA, 19 bp, Homo sapiens
ttgcaaacctcagagggat

SEQ ID NO: 4199008 - DNA, 16 bp, Homo sapiens
ttgcaacatggtccag

SEQ ID NO: 4199009 - DNA, 19 bp, Homo sapiens
ttgcactaaagtatgtaaa

SEQ ID NO: 4199010 - DNA, 12 bp, Homo sapiens
ttgcagaagcag

SEQ ID NO: 4199011 - DNA, 15 bp, Homo sapiens
ttgcagtatatttct

SEQ ID NO: 4199012 - DNA, 16 bp, Homo sapiens
ttgccaaaataccaga

SEQ ID NO: 4199013 - DNA, 20 bp, Homo sapiens
ttgccaaaataccagagcct

SEQ ID NO: 4199014 - DNA, 15 bp, Homo sapiens
ttgccatgggcctgc

SEQ ID NO: 4199015 - DNA, 14 bp, Homo sapiens
ttgcccagatagag

SEQ ID NO: 4199016 - DNA, 19 bp, Homo sapiens
ttgcccggattctgggagg

SEQ ID NO: 4199017 - DNA, 20 bp, Homo sapiens
ttgccctgtggattccagca

SEQ ID NO: 4199018 - DNA, 19 bp, Homo sapiens
ttgccgccccgtgcctgta

SEQ ID NO: 4199019 - DNA, 22 bp, Homo sapiens
ttgccgtctaggattgggcctc

SEQ ID NO: 4199020 - DNA, 13 bp, Homo sapiens
ttgcctgcagaga

SEQ ID NO: 4199021 - DNA, 11 bp, Homo sapiens
ttgcctgcctg

SEQ ID NO: 4199022 - DNA, 20 bp, Homo sapiens
ttgccttcctcgtgcagagc

SEQ ID NO: 4199023 - DNA, 22 bp, Homo sapiens
ttgccttcctcgtgcagagctg

SEQ ID NO: 4199024 - DNA, 13 bp, Homo sapiens
ttgccttttgcaa

SEQ ID NO: 4199025 - DNA, 20 bp, Homo sapiens
ttgcgggggagctggaaata

SEQ ID NO: 4199026 - DNA, 12 bp, Homo sapiens
ttgctatttcta

SEQ ID NO: 4199027 - DNA, 21 bp, Homo sapiens
ttgctctcccctgccctgctg

SEQ ID NO: 4199028 - DNA, 15 bp, Homo sapiens
ttgctctgcaggcac

SEQ ID NO: 4199029 - DNA, 14 bp, Homo sapiens
ttgctctggctgag

SEQ ID NO: 4199030 - DNA, 19 bp, Homo sapiens
ttgctgacatggctttgct

SEQ ID NO: 4199031 - DNA, 22 bp, Homo sapiens
ttgctgacgattagttctaaaa

SEQ ID NO: 4199032 - DNA, 16 bp, Homo sapiens
ttgctgggaacacagc

SEQ ID NO: 4199033 - DNA, 14 bp, Homo sapiens
ttgctgtgtctcac

SEQ ID NO: 4199034 - DNA, 16 bp, Homo sapiens
ttgcttccaggtggca

SEQ ID NO: 4199035 - DNA, 24 bp, Homo sapiens
ttgcttctgcagcaactcccacga

SEQ ID NO: 4199036 - DNA, 15 bp, Homo sapiens
ttgctttgctgtctg

SEQ ID NO: 4199037 - DNA, 22 bp, Homo sapiens
ttggaaagcatcacctcaggcc

SEQ ID NO: 4199038 - DNA, 17 bp, Homo sapiens
ttggaaaggtttcaaga

SEQ ID NO: 4199039 - DNA, 18 bp, Homo sapiens
ttggaaagttcagccaga

SEQ ID NO: 4199040 - DNA, 22 bp, Homo sapiens
ttggaagagaggcacctgctgg

SEQ ID NO: 4199041 - DNA, 20 bp, Homo sapiens
ttggaagtgtgtggaaggca

SEQ ID NO: 4199042 - DNA, 22 bp, Homo sapiens
ttggacttcagtcttgcctagg

SEQ ID NO: 4199043 - DNA, 12 bp, Homo sapiens
ttggacttcctt

SEQ ID NO: 4199044 - DNA, 14 bp, Homo sapiens
ttggagaaattatt

SEQ ID NO: 4199045 - DNA, 20 bp, Homo sapiens
ttggagacagcaattgtaga

SEQ ID NO: 4199046 - DNA, 15 bp, Homo sapiens
ttggagactctgtgg

SEQ ID NO: 4199047 - DNA, 13 bp, Homo sapiens
ttggagagcagct

SEQ ID NO: 4199048 - DNA, 14 bp, Homo sapiens
ttggagagcagctg

SEQ ID NO: 4199049 - DNA, 15 bp, Homo sapiens
ttggagagcagctgg

SEQ ID NO: 4199050 - DNA, 21 bp, Homo sapiens
ttggagctgactgttcttggt

SEQ ID NO: 4199051 - DNA, 21 bp, Homo sapiens
ttggatacaaggatcagaatg

SEQ ID NO: 4199052 - DNA, 16 bp, Homo sapiens
ttggcaaattcctagt

SEQ ID NO: 4199053 - DNA, 17 bp, Homo sapiens
ttggcacatgcaggtag

SEQ ID NO: 4199054 - DNA, 12 bp, Homo sapiens
ttggcagagagg

SEQ ID NO: 4199055 - DNA, 21 bp, Homo sapiens
ttggcatcacagggcagagcc

SEQ ID NO: 4199056 - DNA, 12 bp, Homo sapiens
ttggcctctgct

SEQ ID NO: 4199057 - DNA, 12 bp, Homo sapiens
ttggctcaccca

SEQ ID NO: 4199058 - DNA, 16 bp, Homo sapiens
ttggctgctcattcct

SEQ ID NO: 4199059 - DNA, 20 bp, Homo sapiens
ttggcttttgcttggcagag

SEQ ID NO: 4199060 - DNA, 23 bp, Homo sapiens
ttgggagggatgagagtggctta

SEQ ID NO: 4199061 - DNA, 19 bp, Homo sapiens
ttgggaggtccaggcagga

SEQ ID NO: 4199062 - DNA, 20 bp, Homo sapiens
ttgggaggtccaggcaggag

SEQ ID NO: 4199063 - DNA, 17 bp, Homo sapiens
ttgggatcagcctccgc

SEQ ID NO: 4199064 - DNA, 17 bp, Homo sapiens
ttgggatgcggggcaga

SEQ ID NO: 4199065 - DNA, 20 bp, Homo sapiens
ttgggccagctgtcgcatct

SEQ ID NO: 4199066 - DNA, 16 bp, Homo sapiens
ttgggcttccatgcct

SEQ ID NO: 4199067 - DNA, 13 bp, Homo sapiens
ttggggtcagcca

SEQ ID NO: 4199068 - DNA, 22 bp, Homo sapiens
ttggtaaattgtaaacagctaa

SEQ ID NO: 4199069 - DNA, 18 bp, Homo sapiens
ttggtaggcttatcaaaa

SEQ ID NO: 4199070 - DNA, 21 bp, Homo sapiens
ttggtaggcttatcaaaatct

SEQ ID NO: 4199071 - DNA, 17 bp, Homo sapiens
ttggtcagagccactct

SEQ ID NO: 4199072 - DNA, 14 bp, Homo sapiens
ttggtccccagcat

SEQ ID NO: 4199073 - DNA, 14 bp, Homo sapiens
ttggtgagaacctg

SEQ ID NO: 4199074 - DNA, 21 bp, Homo sapiens
ttggtggccaagcctggccct

SEQ ID NO: 4199075 - DNA, 14 bp, Homo sapiens
ttggtggccacata

SEQ ID NO: 4199076 - DNA, 23 bp, Homo sapiens
ttggtttattccctccagggtct

SEQ ID NO: 4199077 - DNA, 21 bp, Homo sapiens
ttggttttgctacataattat

SEQ ID NO: 4199078 - DNA, 19 bp, Homo sapiens
ttgtaaaaaagatttgtag

SEQ ID NO: 4199079 - DNA, 19 bp, Homo sapiens
ttgtaaaaacaaaaagaca

SEQ ID NO: 4199080 - DNA, 15 bp, Homo sapiens
ttgtaaaatagcttg

SEQ ID NO: 4199081 - DNA, 16 bp, Homo sapiens
ttgtaaattattaatt

SEQ ID NO: 4199082 - DNA, 23 bp, Homo sapiens
ttgtaaattattaatttatgcag

SEQ ID NO: 4199083 - DNA, 12 bp, Homo sapiens
ttgtaagtttat

SEQ ID NO: 4199084 - DNA, 16 bp, Homo sapiens
ttgtaatttttttgaa

SEQ ID NO: 4199085 - DNA, 14 bp, Homo sapiens
ttgtacaagctcag

SEQ ID NO: 4199086 - DNA, 13 bp, Homo sapiens
ttgtacacttaag

SEQ ID NO: 4199087 - DNA, 20 bp, Homo sapiens
ttgtacctatgtgacagaca

SEQ ID NO: 4199088 - DNA, 23 bp, Homo sapiens
ttgtactaaagccaaacatatat

SEQ ID NO: 4199089 - DNA, 23 bp, Homo sapiens
ttgtaggctgtggggtctggctg

SEQ ID NO: 4199090 - DNA, 17 bp, Homo sapiens
ttgtatagagatatgca

SEQ ID NO: 4199091 - DNA, 19 bp, Homo sapiens
ttgtatatatctgcttcag

SEQ ID NO: 4199092 - DNA, 14 bp, Homo sapiens
ttgtattttaaatg

SEQ ID NO: 4199093 - DNA, 15 bp, Homo sapiens
ttgtccatgtgcttc

SEQ ID NO: 4199094 - DNA, 20 bp, Homo sapiens
ttgtccatgtgcttccctag

SEQ ID NO: 4199095 - DNA, 15 bp, Homo sapiens
ttgtctgtgtgctgt

SEQ ID NO: 4199096 - DNA, 17 bp, Homo sapiens
ttgtctgtgtgctgtaa

SEQ ID NO: 4199097 - DNA, 17 bp, Homo sapiens
ttgtcttaatattgtgg

SEQ ID NO: 4199098 - DNA, 12 bp, Homo sapiens
ttgtgaactgga

SEQ ID NO: 4199099 - DNA, 19 bp, Homo sapiens
ttgtgaactggaagaaagc

SEQ ID NO: 4199100 - DNA, 21 bp, Homo sapiens
ttgtgaactggaagaaagcaa

SEQ ID NO: 4199101 - DNA, 16 bp, Homo sapiens
ttgtgccttttatagc

SEQ ID NO: 4199102 - DNA, 18 bp, Homo sapiens
ttgtggaaagcctctgct

SEQ ID NO: 4199103 - DNA, 15 bp, Homo sapiens
ttgtggaacaaaagt

SEQ ID NO: 4199104 - DNA, 19 bp, Homo sapiens
ttgtgtaatagaaaactga

SEQ ID NO: 4199105 - DNA, 17 bp, Homo sapiens
ttgttaaaaatattttc

SEQ ID NO: 4199106 - DNA, 19 bp, Homo sapiens
ttgttaatttagaaaactt

SEQ ID NO: 4199107 - DNA, 21 bp, Homo sapiens
ttgttaatttagaaaacttta

SEQ ID NO: 4199108 - DNA, 14 bp, Homo sapiens
ttgttactgaagtt

SEQ ID NO: 4199109 - DNA, 14 bp, Homo sapiens
ttgttatcatttaa

SEQ ID NO: 4199110 - DNA, 22 bp, Homo sapiens
ttgttatgtatatagatgtgca

SEQ ID NO: 4199111 - DNA, 21 bp, Homo sapiens
ttgttgaaagtaaaagttata

SEQ ID NO: 4199112 - DNA, 18 bp, Homo sapiens
ttgttgacatgagtggaa

SEQ ID NO: 4199113 - DNA, 20 bp, Homo sapiens
ttgttgggcttgggggaaaa

SEQ ID NO: 4199114 - DNA, 16 bp, Homo sapiens
ttgtttctccccctgg

SEQ ID NO: 4199115 - DNA, 15 bp, Homo sapiens
ttgtttcttaaataa

SEQ ID NO: 4199116 - DNA, 16 bp, Homo sapiens
ttgtttgtaaatgcct

SEQ ID NO: 4199117 - DNA, 14 bp, Homo sapiens
tttaaaaaactaaa

SEQ ID NO: 4199118 - DNA, 14 bp, Homo sapiens
tttaaaaaagctta

SEQ ID NO: 4199119 - DNA, 17 bp, Homo sapiens
tttaaaaaagcttaaaa

SEQ ID NO: 4199120 - DNA, 15 bp, Homo sapiens
tttaaaacagcctgg

SEQ ID NO: 4199121 - DNA, 19 bp, Homo sapiens
tttaaaacgttttctcttc

SEQ ID NO: 4199122 - DNA, 13 bp, Homo sapiens
tttaaaagatgct

SEQ ID NO: 4199123 - DNA, 22 bp, Homo sapiens
tttaaaagtataaaactgcttt

SEQ ID NO: 4199124 - DNA, 12 bp, Homo sapiens
tttaaaatagca

SEQ ID NO: 4199125 - DNA, 17 bp, Homo sapiens
tttaaaatgtaaagcca

SEQ ID NO: 4199126 - DNA, 20 bp, Homo sapiens
tttaaacaaaatagaagctg

SEQ ID NO: 4199127 - DNA, 11 bp, Homo sapiens
tttaaaccttt

SEQ ID NO: 4199128 - DNA, 13 bp, Homo sapiens
tttaaagaattgt

SEQ ID NO: 4199129 - DNA, 19 bp, Homo sapiens
tttaaaggtagagatgtgt

SEQ ID NO: 4199130 - DNA, 22 bp, Homo sapiens
tttaaagtgactaatggcatga

SEQ ID NO: 4199131 - DNA, 19 bp, Homo sapiens
tttaaatgtgcagtacaca

SEQ ID NO: 4199132 - DNA, 19 bp, Homo sapiens
tttaacacaagtcctgtga

SEQ ID NO: 4199133 - DNA, 17 bp, Homo sapiens
tttaacattcacagccc

SEQ ID NO: 4199134 - DNA, 22 bp, Homo sapiens
tttaactttgtggtaacttctt

SEQ ID NO: 4199135 - DNA, 16 bp, Homo sapiens
tttaagcattcttaga

SEQ ID NO: 4199136 - DNA, 12 bp, Homo sapiens
tttaagccaaaa

SEQ ID NO: 4199137 - DNA, 18 bp, Homo sapiens
tttaagccaaaacaatgt

SEQ ID NO: 4199138 - DNA, 14 bp, Homo sapiens
tttaagctgtaaaa

SEQ ID NO: 4199139 - DNA, 10 bp, Homo sapiens
tttaagtcct

SEQ ID NO: 4199140 - DNA, 11 bp, Homo sapiens
tttaataagag

SEQ ID NO: 4199141 - DNA, 18 bp, Homo sapiens
tttaatagcaaagaattg

SEQ ID NO: 4199142 - DNA, 21 bp, Homo sapiens
tttaatgtttaaaacatcatt

SEQ ID NO: 4199143 - DNA, 19 bp, Homo sapiens
tttaattaactatgtgatg

SEQ ID NO: 4199144 - DNA, 23 bp, Homo sapiens
tttaatttatatttgaaatttta

SEQ ID NO: 4199145 - DNA, 19 bp, Homo sapiens
tttacaaatttttcctgca

SEQ ID NO: 4199146 - DNA, 22 bp, Homo sapiens
tttacaactccaacttctatgt

SEQ ID NO: 4199147 - DNA, 20 bp, Homo sapiens
tttacaagaattgtccatgt

SEQ ID NO: 4199148 - DNA, 13 bp, Homo sapiens
tttacagaatttt

SEQ ID NO: 4199149 - DNA, 20 bp, Homo sapiens
tttacagtaaataaattgtt

SEQ ID NO: 4199150 - DNA, 14 bp, Homo sapiens
tttacatcaataat

SEQ ID NO: 4199151 - DNA, 20 bp, Homo sapiens
tttaccatgaattcttgagt

SEQ ID NO: 4199152 - DNA, 21 bp, Homo sapiens
tttacctaccaccttccctct

SEQ ID NO: 4199153 - DNA, 20 bp, Homo sapiens
tttactaagccacaagaaat

SEQ ID NO: 4199154 - DNA, 21 bp, Homo sapiens
tttactaagccacaagaaatt

SEQ ID NO: 4199155 - DNA, 22 bp, Homo sapiens
tttactaagccacaagaaattt

SEQ ID NO: 4199156 - DNA, 18 bp, Homo sapiens
tttactggtgatttctga

SEQ ID NO: 4199157 - DNA, 13 bp, Homo sapiens
tttacttcatgag

SEQ ID NO: 4199158 - DNA, 20 bp, Homo sapiens
tttacttccatgatacttta

SEQ ID NO: 4199159 - DNA, 16 bp, Homo sapiens
tttagaaaactttaaa

SEQ ID NO: 4199160 - DNA, 16 bp, Homo sapiens
tttagaaatcattttg

SEQ ID NO: 4199161 - DNA, 18 bp, Homo sapiens
tttagaaatcattttgca

SEQ ID NO: 4199162 - DNA, 18 bp, Homo sapiens
tttagagtagcatgagag

SEQ ID NO: 4199163 - DNA, 13 bp, Homo sapiens
tttagctgaggga

SEQ ID NO: 4199164 - DNA, 17 bp, Homo sapiens
tttaggcagcctgccgc

SEQ ID NO: 4199165 - DNA, 20 bp, Homo sapiens
tttaggcagcctgccgccgt

SEQ ID NO: 4199166 - DNA, 16 bp, Homo sapiens
tttagggaagcaggga

SEQ ID NO: 4199167 - DNA, 22 bp, Homo sapiens
tttagtagcagtgattgtctta

SEQ ID NO: 4199168 - DNA, 13 bp, Homo sapiens
tttagttatagtt

SEQ ID NO: 4199169 - DNA, 22 bp, Homo sapiens
tttagttcaccccttatcctga

SEQ ID NO: 4199170 - DNA, 16 bp, Homo sapiens
tttagtttttaacaat

SEQ ID NO: 4199171 - DNA, 20 bp, Homo sapiens
tttataaaaagtgaaataag

SEQ ID NO: 4199172 - DNA, 13 bp, Homo sapiens
tttataaaagcaa

SEQ ID NO: 4199173 - DNA, 22 bp, Homo sapiens
tttataaatatgtgaaaatgat

SEQ ID NO: 4199174 - DNA, 23 bp, Homo sapiens
tttatacagaactgaattaagtt

SEQ ID NO: 4199175 - DNA, 17 bp, Homo sapiens
tttatagtttgtacatg

SEQ ID NO: 4199176 - DNA, 15 bp, Homo sapiens
tttatatccacatct

SEQ ID NO: 4199177 - DNA, 14 bp, Homo sapiens
tttatatttggaaa

SEQ ID NO: 4199178 - DNA, 21 bp, Homo sapiens
tttatatttggaaagagacca

SEQ ID NO: 4199179 - DNA, 16 bp, Homo sapiens
tttatctgaattttta

SEQ ID NO: 4199180 - DNA, 19 bp, Homo sapiens
tttatgaaaaagaagaatc

SEQ ID NO: 4199181 - DNA, 17 bp, Homo sapiens
tttatgagaaagccttc

SEQ ID NO: 4199182 - DNA, 19 bp, Homo sapiens
tttatgtaaaatcaataaa

SEQ ID NO: 4199183 - DNA, 21 bp, Homo sapiens
tttatgtgctctcatcagaaa

SEQ ID NO: 4199184 - DNA, 21 bp, Homo sapiens
tttattaaaatgattgtaaaa

SEQ ID NO: 4199185 - DNA, 20 bp, Homo sapiens
tttattaagaatcattgtgc

SEQ ID NO: 4199186 - DNA, 17 bp, Homo sapiens
tttattcaagttattgt

SEQ ID NO: 4199187 - DNA, 18 bp, Homo sapiens
tttattctatgtatgtta

SEQ ID NO: 4199188 - DNA, 22 bp, Homo sapiens
tttatttaaaaaactaaaaact

SEQ ID NO: 4199189 - DNA, 23 bp, Homo sapiens
tttcaaaacacatctttcctgtc

SEQ ID NO: 4199190 - DNA, 20 bp, Homo sapiens
tttcaaactcctgactttgt

SEQ ID NO: 4199191 - DNA, 23 bp, Homo sapiens
tttcaaatggactcatggcttag

SEQ ID NO: 4199192 - DNA, 20 bp, Homo sapiens
tttcaacagtgaagacagaa

SEQ ID NO: 4199193 - DNA, 13 bp, Homo sapiens
tttcaatatttgt

SEQ ID NO: 4199194 - DNA, 22 bp, Homo sapiens
tttcacatgtttatatttggct

SEQ ID NO: 4199195 - DNA, 15 bp, Homo sapiens
tttcacatttaagca

SEQ ID NO: 4199196 - DNA, 15 bp, Homo sapiens
tttcaccacattcgt

SEQ ID NO: 4199197 - DNA, 16 bp, Homo sapiens
tttcagcactcagaaa

SEQ ID NO: 4199198 - DNA, 21 bp, Homo sapiens
tttcaggagattgttaattcc

SEQ ID NO: 4199199 - DNA, 20 bp, Homo sapiens
tttcaggatactctgtcaga

SEQ ID NO: 4199200 - DNA, 16 bp, Homo sapiens
tttcaggtctggggct

SEQ ID NO: 4199201 - DNA, 13 bp, Homo sapiens
tttcatataaagt

SEQ ID NO: 4199202 - DNA, 19 bp, Homo sapiens
tttcatgataatgaacaga

SEQ ID NO: 4199203 - DNA, 23 bp, Homo sapiens
tttccaagttcctgcactccaga

SEQ ID NO: 4199204 - DNA, 16 bp, Homo sapiens
tttccagttgttactg

SEQ ID NO: 4199205 - DNA, 20 bp, Homo sapiens
tttccatggcaggaaggctt

SEQ ID NO: 4199206 - DNA, 13 bp, Homo sapiens
tttccatggctct

SEQ ID NO: 4199207 - DNA, 19 bp, Homo sapiens
tttccatgggaccacaact

SEQ ID NO: 4199208 - DNA, 23 bp, Homo sapiens
tttccatttgggcacattttact

SEQ ID NO: 4199209 - DNA, 22 bp, Homo sapiens
tttcccaccaccttggactcct

SEQ ID NO: 4199210 - DNA, 17 bp, Homo sapiens
tttccccacctcttcct

SEQ ID NO: 4199211 - DNA, 18 bp, Homo sapiens
tttcccccaccccagagt

SEQ ID NO: 4199212 - DNA, 20 bp, Homo sapiens
tttccccgggggaggaaggg

SEQ ID NO: 4199213 - DNA, 17 bp, Homo sapiens
tttccctttgcttccca

SEQ ID NO: 4199214 - DNA, 14 bp, Homo sapiens
tttcctaaatgttt

SEQ ID NO: 4199215 - DNA, 18 bp, Homo sapiens
tttcctaagaaagacatc

SEQ ID NO: 4199216 - DNA, 14 bp, Homo sapiens
tttcctacaaaatg

SEQ ID NO: 4199217 - DNA, 15 bp, Homo sapiens
tttcctatgctttga

SEQ ID NO: 4199218 - DNA, 14 bp, Homo sapiens
tttcctccccacct

SEQ ID NO: 4199219 - DNA, 19 bp, Homo sapiens
tttcctccccaccttcccc

SEQ ID NO: 4199220 - DNA, 22 bp, Homo sapiens
tttcctccctggtttgcagctg

SEQ ID NO: 4199221 - DNA, 14 bp, Homo sapiens
tttcctctgcagca

SEQ ID NO: 4199222 - DNA, 19 bp, Homo sapiens
tttcctttatatttagtga

SEQ ID NO: 4199223 - DNA, 12 bp, Homo sapiens
tttcgcttgctt

SEQ ID NO: 4199224 - DNA, 17 bp, Homo sapiens
tttcgcttgcttctgca

SEQ ID NO: 4199225 - DNA, 15 bp, Homo sapiens
tttctagactttctg

SEQ ID NO: 4199226 - DNA, 16 bp, Homo sapiens
tttctagactttctgt

SEQ ID NO: 4199227 - DNA, 18 bp, Homo sapiens
tttctatagccaaaaata

SEQ ID NO: 4199228 - DNA, 13 bp, Homo sapiens
tttctattccaaa

SEQ ID NO: 4199229 - DNA, 16 bp, Homo sapiens
tttctcagtggcttct

SEQ ID NO: 4199230 - DNA, 17 bp, Homo sapiens
tttctcatgcttcttct

SEQ ID NO: 4199231 - DNA, 20 bp, Homo sapiens
tttctccaggtttgctgtgt

SEQ ID NO: 4199232 - DNA, 13 bp, Homo sapiens
tttctccccctgg

SEQ ID NO: 4199233 - DNA, 18 bp, Homo sapiens
tttctcctactttacact

SEQ ID NO: 4199234 - DNA, 19 bp, Homo sapiens
tttctcgtggtagaagcca

SEQ ID NO: 4199235 - DNA, 21 bp, Homo sapiens
tttctctccttcttccctgtt

SEQ ID NO: 4199236 - DNA, 14 bp, Homo sapiens
tttctgaactgtta

SEQ ID NO: 4199237 - DNA, 20 bp, Homo sapiens
tttctgaccaatcactgagt

SEQ ID NO: 4199238 - DNA, 13 bp, Homo sapiens
tttctgagatttt

SEQ ID NO: 4199239 - DNA, 23 bp, Homo sapiens
tttctggattccccatctcaggc

SEQ ID NO: 4199240 - DNA, 17 bp, Homo sapiens
tttctggtgccatttct

SEQ ID NO: 4199241 - DNA, 15 bp, Homo sapiens
tttctgtacacagaa

SEQ ID NO: 4199242 - DNA, 14 bp, Homo sapiens
tttctgttcatctt

SEQ ID NO: 4199243 - DNA, 14 bp, Homo sapiens
tttctgttgccaca

SEQ ID NO: 4199244 - DNA, 13 bp, Homo sapiens
tttcttaaataag

SEQ ID NO: 4199245 - DNA, 20 bp, Homo sapiens
tttcttaaataagaaacttt

SEQ ID NO: 4199246 - DNA, 21 bp, Homo sapiens
tttcttaaataagaaactttt

SEQ ID NO: 4199247 - DNA, 23 bp, Homo sapiens
tttcttaccttaaaaagtaattg

SEQ ID NO: 4199248 - DNA, 16 bp, Homo sapiens
tttcttacttatcaaa

SEQ ID NO: 4199249 - DNA, 16 bp, Homo sapiens
tttcttagtgcctgtg

SEQ ID NO: 4199250 - DNA, 22 bp, Homo sapiens
tttcttccttctttctcttccc

SEQ ID NO: 4199251 - DNA, 15 bp, Homo sapiens
tttgaacccctgtgt

SEQ ID NO: 4199252 - DNA, 23 bp, Homo sapiens
tttgaagtagtttgtataacttc

SEQ ID NO: 4199253 - DNA, 17 bp, Homo sapiens
tttgaagttagctttaa

SEQ ID NO: 4199254 - DNA, 17 bp, Homo sapiens
tttgaatgtttatgttc

SEQ ID NO: 4199255 - DNA, 17 bp, Homo sapiens
tttgacatgaacagaaa

SEQ ID NO: 4199256 - DNA, 13 bp, Homo sapiens
tttgactgaaaaa

SEQ ID NO: 4199257 - DNA, 21 bp, Homo sapiens
tttgaggagcagcttcagttg

SEQ ID NO: 4199258 - DNA, 14 bp, Homo sapiens
tttgaggattcctg

SEQ ID NO: 4199259 - DNA, 15 bp, Homo sapiens
tttgaggctgcagcg

SEQ ID NO: 4199260 - DNA, 16 bp, Homo sapiens
tttgagtgattatttg

SEQ ID NO: 4199261 - DNA, 17 bp, Homo sapiens
tttgatactaagcattg

SEQ ID NO: 4199262 - DNA, 21 bp, Homo sapiens
tttgatactaagcattgaatg

SEQ ID NO: 4199263 - DNA, 13 bp, Homo sapiens
tttgatcaaatct

SEQ ID NO: 4199264 - DNA, 16 bp, Homo sapiens
tttgatgccaagaaag

SEQ ID NO: 4199265 - DNA, 20 bp, Homo sapiens
tttgattgtaaaaacaaaaa

SEQ ID NO: 4199266 - DNA, 12 bp, Homo sapiens
tttgatttatgc

SEQ ID NO: 4199267 - DNA, 13 bp, Homo sapiens
tttgatttctatt

SEQ ID NO: 4199268 - DNA, 21 bp, Homo sapiens
tcactacctttatagctctca

SEQ ID NO: 4199269 - DNA, 14 bp, Homo sapiens
tcactcagccacac

SEQ ID NO: 4199270 - DNA, 16 bp, Homo sapiens
tcactccaaaataggt

SEQ ID NO: 4199271 - DNA, 14 bp, Homo sapiens
tcactccggtgtgc

SEQ ID NO: 4199272 - DNA, 20 bp, Homo sapiens
tcactctgagtgttttatga

SEQ ID NO: 4199273 - DNA, 19 bp, Homo sapiens
tcactgaagattgggtagc

SEQ ID NO: 4199274 - DNA, 22 bp, Homo sapiens
tcactgcagcctccttctcctg

SEQ ID NO: 4199275 - DNA, 16 bp, Homo sapiens
tcactgctgtcagcca

SEQ ID NO: 4199276 - DNA, 13 bp, Homo sapiens
tcactggagccca

SEQ ID NO: 4199277 - DNA, 15 bp, Homo sapiens
tcactggagcccagg

SEQ ID NO: 4199278 - DNA, 17 bp, Homo sapiens
tcactggagcccaggag

SEQ ID NO: 4199279 - DNA, 16 bp, Homo sapiens
tcactggcagagcaca

SEQ ID NO: 4199280 - DNA, 21 bp, Homo sapiens
tcactggcagagcacagccca

SEQ ID NO: 4199281 - DNA, 18 bp, Homo sapiens
tcactgttgaaaattatt

SEQ ID NO: 4199282 - DNA, 15 bp, Homo sapiens
tcacttccccaactc

SEQ ID NO: 4199283 - DNA, 17 bp, Homo sapiens
tcacttgggcccaggag

SEQ ID NO: 4199284 - DNA, 21 bp, Homo sapiens
tcactttcccttgtgtcaaga

SEQ ID NO: 4199285 - DNA, 15 bp, Homo sapiens
tcagaaaagaaaacc

SEQ ID NO: 4199286 - DNA, 17 bp, Homo sapiens
tcagaaaagaaaaccat

SEQ ID NO: 4199287 - DNA, 16 bp, Homo sapiens
tcagaaataggaagat

SEQ ID NO: 4199288 - DNA, 18 bp, Homo sapiens
tcagaagaaaaagaagca

SEQ ID NO: 4199289 - DNA, 15 bp, Homo sapiens
tcagaagcacaaagg

SEQ ID NO: 4199290 - DNA, 22 bp, Homo sapiens
tcagaagcaggcagggcaaagg

SEQ ID NO: 4199291 - DNA, 20 bp, Homo sapiens
tcagaagcctgaggctggga

SEQ ID NO: 4199292 - DNA, 22 bp, Homo sapiens
tcagacatccatgtttgtaaaa

SEQ ID NO: 4199293 - DNA, 15 bp, Homo sapiens
tcagacattccaagg

SEQ ID NO: 4199294 - DNA, 19 bp, Homo sapiens
tcagactcttggggaagcg

SEQ ID NO: 4199295 - DNA, 13 bp, Homo sapiens
tcagactgctggg

SEQ ID NO: 4199296 - DNA, 15 bp, Homo sapiens
tcagactgctgggac

SEQ ID NO: 4199297 - DNA, 17 bp, Homo sapiens
tcagactgctgggactg

SEQ ID NO: 4199298 - DNA, 15 bp, Homo sapiens
tcagacttttatcaa

SEQ ID NO: 4199299 - DNA, 17 bp, Homo sapiens
tcagagacttagaagca

SEQ ID NO: 4199300 - DNA, 19 bp, Homo sapiens
tcagagacttagaagcatc

SEQ ID NO: 4199301 - DNA, 11 bp, Homo sapiens
tcagagagcct

SEQ ID NO: 4199302 - DNA, 12 bp, Homo sapiens
tcagagccactc

SEQ ID NO: 4199303 - DNA, 18 bp, Homo sapiens
tcagagccactctatgag

SEQ ID NO: 4199304 - DNA, 23 bp, Homo sapiens
tcagagccactctatgagttgga

SEQ ID NO: 4199305 - DNA, 20 bp, Homo sapiens
tcagataaggtaaaatgcca

SEQ ID NO: 4199306 - DNA, 18 bp, Homo sapiens
tcagatatatatcatatt

SEQ ID NO: 4199307 - DNA, 18 bp, Homo sapiens
tcagatatatttttcaca

SEQ ID NO: 4199308 - DNA, 14 bp, Homo sapiens
tcagatgcccagag

SEQ ID NO: 4199309 - DNA, 21 bp, Homo sapiens
tcagatgcccagagggcccag

SEQ ID NO: 4199310 - DNA, 22 bp, Homo sapiens
tcagattgacctataaaacaaa

SEQ ID NO: 4199311 - DNA, 18 bp, Homo sapiens
tcagcaatagggtgcagt

SEQ ID NO: 4199312 - DNA, 14 bp, Homo sapiens
tcagcagccccctg

SEQ ID NO: 4199313 - DNA, 19 bp, Homo sapiens
tcagcatttaataaatgta

SEQ ID NO: 4199314 - DNA, 20 bp, Homo sapiens
tcagcatttaataaatgtat

SEQ ID NO: 4199315 - DNA, 16 bp, Homo sapiens
tcagccagggccaggg

SEQ ID NO: 4199316 - DNA, 18 bp, Homo sapiens
tcagccatcaacaagagt

SEQ ID NO: 4199317 - DNA, 20 bp, Homo sapiens
tcagcctcctgagtagctgg

SEQ ID NO: 4199318 - DNA, 18 bp, Homo sapiens
tcagcctggccatcccca

SEQ ID NO: 4199319 - DNA, 24 bp, Homo sapiens
tcagccttccccctcccagggcca

SEQ ID NO: 4199320 - DNA, 16 bp, Homo sapiens
tcagcgtgcttagcct

SEQ ID NO: 4199321 - DNA, 18 bp, Homo sapiens
tcaggaaaattgaatgca

SEQ ID NO: 4199322 - DNA, 20 bp, Homo sapiens
tcaggaacgttgccacacca

SEQ ID NO: 4199323 - DNA, 19 bp, Homo sapiens
tcaggaggcgaataaatgt

SEQ ID NO: 4199324 - DNA, 18 bp, Homo sapiens
tcaggaggctgaggggag

SEQ ID NO: 4199325 - DNA, 18 bp, Homo sapiens
tcaggatggtttctttaa

SEQ ID NO: 4199326 - DNA, 21 bp, Homo sapiens
tcaggatgtaggggttaactt

SEQ ID NO: 4199327 - DNA, 14 bp, Homo sapiens
tcaggccagagcca

SEQ ID NO: 4199328 - DNA, 16 bp, Homo sapiens
tcaggccaggtgcagt

SEQ ID NO: 4199329 - DNA, 17 bp, Homo sapiens
tcaggccaggtgcagtg

SEQ ID NO: 4199330 - DNA, 13 bp, Homo sapiens
tcaggctgaggtg

SEQ ID NO: 4199331 - DNA, 23 bp, Homo sapiens
tcaggcttccttggcatcacagg

SEQ ID NO: 4199332 - DNA, 15 bp, Homo sapiens
tcagggatcttgcat

SEQ ID NO: 4199333 - DNA, 13 bp, Homo sapiens
tcagggtgggcca

SEQ ID NO: 4199334 - DNA, 14 bp, Homo sapiens
tcaggtacttgtaa

SEQ ID NO: 4199335 - DNA, 13 bp, Homo sapiens
tcaggttgacagt

SEQ ID NO: 4199336 - DNA, 20 bp, Homo sapiens
tcagtaatttagaaatcatt

SEQ ID NO: 4199337 - DNA, 20 bp, Homo sapiens
tcagtattttggagaaatta

SEQ ID NO: 4199338 - DNA, 22 bp, Homo sapiens
tcagtattttggagaaattatt

SEQ ID NO: 4199339 - DNA, 14 bp, Homo sapiens
tcagtcatattctt

SEQ ID NO: 4199340 - DNA, 19 bp, Homo sapiens
tcagtcatgaggaaagaca

SEQ ID NO: 4199341 - DNA, 18 bp, Homo sapiens
tcagtccccacagataac

SEQ ID NO: 4199342 - DNA, 19 bp, Homo sapiens
tcagtctagtgaagatgtt

SEQ ID NO: 4199343 - DNA, 20 bp, Homo sapiens
tcagtctgtgggagctcagc

SEQ ID NO: 4199344 - DNA, 22 bp, Homo sapiens
tcagtctttcttagtgcctgtg

SEQ ID NO: 4199345 - DNA, 14 bp, Homo sapiens
tcagtgctgtggcc

SEQ ID NO: 4199346 - DNA, 22 bp, Homo sapiens
tcagtgggctccctggcccagc

SEQ ID NO: 4199347 - DNA, 22 bp, Homo sapiens
tcagtgtagaacctaattcaat

SEQ ID NO: 4199348 - DNA, 19 bp, Homo sapiens
tcagttcataatatatgga

SEQ ID NO: 4199349 - DNA, 17 bp, Homo sapiens
tcagttcccgctctgca

SEQ ID NO: 4199350 - DNA, 23 bp, Homo sapiens
tcagttcccgctctgcattgcct

SEQ ID NO: 4199351 - DNA, 16 bp, Homo sapiens
tcagttcctctttgca

SEQ ID NO: 4199352 - DNA, 18 bp, Homo sapiens
tcagttcctctttgcatg

SEQ ID NO: 4199353 - DNA, 18 bp, Homo sapiens
tcagtttgtcctgtagag

SEQ ID NO: 4199354 - DNA, 13 bp, Homo sapiens
tcagttttcctta

SEQ ID NO: 4199355 - DNA, 14 bp, Homo sapiens
tcataaccattccc

SEQ ID NO: 4199356 - DNA, 22 bp, Homo sapiens
tcataactggtagctataactt

SEQ ID NO: 4199357 - DNA, 22 bp, Homo sapiens
tcataagtttgtttaaacactt

SEQ ID NO: 4199358 - DNA, 18 bp, Homo sapiens
tcatacttctaaatcaga

SEQ ID NO: 4199359 - DNA, 22 bp, Homo sapiens
tcatacttctaaatcagaaata

SEQ ID NO: 4199360 - DNA, 20 bp, Homo sapiens
tcatagaaatacctcattcg

SEQ ID NO: 4199361 - DNA, 20 bp, Homo sapiens
tcataggttgccaataatac

SEQ ID NO: 4199362 - DNA, 14 bp, Homo sapiens
tcatagtttcttgg

SEQ ID NO: 4199363 - DNA, 22 bp, Homo sapiens
tcatagtttcttggccactgaa

SEQ ID NO: 4199364 - DNA, 16 bp, Homo sapiens
tcccatggccttccct

SEQ ID NO: 4199365 - DNA, 19 bp, Homo sapiens
tcccattttggaagttttc

SEQ ID NO: 4199366 - DNA, 20 bp, Homo sapiens
tcccattttggaagttttca

SEQ ID NO: 4199367 - DNA, 15 bp, Homo sapiens
tccccaaactgtgcc

SEQ ID NO: 4199368 - DNA, 21 bp, Homo sapiens
tccccaaactgtgccctgcct

SEQ ID NO: 4199369 - DNA, 22 bp, Homo sapiens
tccccaaactgtgccctgcctt

SEQ ID NO: 4199370 - DNA, 14 bp, Homo sapiens
tccccaaaggcatc

SEQ ID NO: 4199371 - DNA, 15 bp, Homo sapiens
tccccaaaggcatcc

SEQ ID NO: 4199372 - DNA, 20 bp, Homo sapiens
tccccacagtcctcacagcc

SEQ ID NO: 4199373 - DNA, 23 bp, Homo sapiens
tccccacagtcctcacagcctct

SEQ ID NO: 4199374 - DNA, 11 bp, Homo sapiens
tccccacctct

SEQ ID NO: 4199375 - DNA, 18 bp, Homo sapiens
tccccacctcttccttcc

SEQ ID NO: 4199376 - DNA, 18 bp, Homo sapiens
tccccaccttcaattcct

SEQ ID NO: 4199377 - DNA, 13 bp, Homo sapiens
tccccaccttccc

SEQ ID NO: 4199378 - DNA, 15 bp, Homo sapiens
tccccactgtatcta

SEQ ID NO: 4199379 - DNA, 21 bp, Homo sapiens
tccccagactcagctccagaa

SEQ ID NO: 4199380 - DNA, 16 bp, Homo sapiens
tccccaggccaggcca

SEQ ID NO: 4199381 - DNA, 19 bp, Homo sapiens
tccccaggccaggccacca

SEQ ID NO: 4199382 - DNA, 22 bp, Homo sapiens
tccccaggccaggccaccagga

SEQ ID NO: 4199383 - DNA, 16 bp, Homo sapiens
tccccagttgccgtct

SEQ ID NO: 4199384 - DNA, 13 bp, Homo sapiens
tccccatctcagg

SEQ ID NO: 4199385 - DNA, 16 bp, Homo sapiens
tcccccaccccagagt

SEQ ID NO: 4199386 - DNA, 17 bp, Homo sapiens
tcccccaccccagagtt

SEQ ID NO: 4199387 - DNA, 17 bp, Homo sapiens
tcccccccctgtatagt

SEQ ID NO: 4199388 - DNA, 17 bp, Homo sapiens
tcccccgattcagagac

SEQ ID NO: 4199389 - DNA, 12 bp, Homo sapiens
tccccctgggct

SEQ ID NO: 4199390 - DNA, 13 bp, Homo sapiens
tccccggcctcag

SEQ ID NO: 4199391 - DNA, 21 bp, Homo sapiens
tcccctacactttggccaagc

SEQ ID NO: 4199392 - DNA, 15 bp, Homo sapiens
tcccctctcctccgc

SEQ ID NO: 4199393 - DNA, 16 bp, Homo sapiens
tcccctgccctgctgc

SEQ ID NO: 4199394 - DNA, 15 bp, Homo sapiens
tcccctggtcctgca

SEQ ID NO: 4199395 - DNA, 20 bp, Homo sapiens
tcccctggtcctgcactgtc

SEQ ID NO: 4199396 - DNA, 18 bp, Homo sapiens
tccccttgaactcttcac

SEQ ID NO: 4199397 - DNA, 12 bp, Homo sapiens
tcccctttcctc

SEQ ID NO: 4199398 - DNA, 18 bp, Homo sapiens
tcccggagctcaggccct

SEQ ID NO: 4199399 - DNA, 22 bp, Homo sapiens
tcccgggtgccccccatgccct

SEQ ID NO: 4199400 - DNA, 16 bp, Homo sapiens
tccctagatctttcta

SEQ ID NO: 4199401 - DNA, 14 bp, Homo sapiens
tccctagctgagga

SEQ ID NO: 4199402 - DNA, 17 bp, Homo sapiens
tccctatactgcttgga

SEQ ID NO: 4199403 - DNA, 22 bp, Homo sapiens
tccctcaccccctctaagttca

SEQ ID NO: 4199404 - DNA, 17 bp, Homo sapiens
tccctccttcccttctc

SEQ ID NO: 4199405 - DNA, 18 bp, Homo sapiens
tccctcggagctgccagc

SEQ ID NO: 4199406 - DNA, 12 bp, Homo sapiens
tccctctcggaa

SEQ ID NO: 4199407 - DNA, 17 bp, Homo sapiens
tccctctgacctgcagg

SEQ ID NO: 4199408 - DNA, 22 bp, Homo sapiens
tccctctgagaattccaaggag

SEQ ID NO: 4199409 - DNA, 16 bp, Homo sapiens
tccctcttccttcccc

SEQ ID NO: 4199410 - DNA, 18 bp, Homo sapiens
tccctcttccttccccca

SEQ ID NO: 4199411 - DNA, 18 bp, Homo sapiens
tccctgactctctgtgac

SEQ ID NO: 4199412 - DNA, 14 bp, Homo sapiens
tccctgatttggag

SEQ ID NO: 4199413 - DNA, 21 bp, Homo sapiens
tcaatttccctgactcctcta

SEQ ID NO: 4199414 - DNA, 13 bp, Homo sapiens
tcacaatgcctag

SEQ ID NO: 4199415 - DNA, 19 bp, Homo sapiens
tcacaccactgcactccag

SEQ ID NO: 4199416 - DNA, 17 bp, Homo sapiens
tcacacggggtatttta

SEQ ID NO: 4199417 - DNA, 11 bp, Homo sapiens
tcacactgatg

SEQ ID NO: 4199418 - DNA, 17 bp, Homo sapiens
tcacagaggcagtagga

SEQ ID NO: 4199419 - DNA, 13 bp, Homo sapiens
tcacagcctctcc

SEQ ID NO: 4199420 - DNA, 15 bp, Homo sapiens
tcacagcgtttcagg

SEQ ID NO: 4199421 - DNA, 18 bp, Homo sapiens
tcacagtgtttgcaatgg

SEQ ID NO: 4199422 - DNA, 17 bp, Homo sapiens
tcacagttgagtgaaat

SEQ ID NO: 4199423 - DNA, 13 bp, Homo sapiens
tcacattcaggaa

SEQ ID NO: 4199424 - DNA, 19 bp, Homo sapiens
tcacattttgcctttctcg

SEQ ID NO: 4199425 - DNA, 12 bp, Homo sapiens
tcaccagcctgt

SEQ ID NO: 4199426 - DNA, 17 bp, Homo sapiens
tcacccatgaagacagg

SEQ ID NO: 4199427 - DNA, 12 bp, Homo sapiens
tcacccatgtgc

SEQ ID NO: 4199428 - DNA, 14 bp, Homo sapiens
tcacccccatggcc

SEQ ID NO: 4199429 - DNA, 20 bp, Homo sapiens
tcaccgagacggctggacct

SEQ ID NO: 4199430 - DNA, 13 bp, Homo sapiens
tcacctctctcta

SEQ ID NO: 4199431 - DNA, 16 bp, Homo sapiens
tcacctctttaaccac

SEQ ID NO: 4199432 - DNA, 15 bp, Homo sapiens
tcacctgatcatata

SEQ ID NO: 4199433 - DNA, 20 bp, Homo sapiens
tcaccttggagcctgaacat

SEQ ID NO: 4199434 - DNA, 21 bp, Homo sapiens
tcaccttggagcctgaacatg

SEQ ID NO: 4199435 - DNA, 22 bp, Homo sapiens
tcacgccattgtactccagcct

SEQ ID NO: 4199436 - DNA, 21 bp, Homo sapiens
tcacgcctatgatcccagcac

SEQ ID NO: 4199437 - DNA, 21 bp, Homo sapiens
tcacgcctgtaatcccagcac

SEQ ID NO: 4199438 - DNA, 13 bp, Homo sapiens
tcactaaacttta

SEQ ID NO: 4199439 - DNA, 12 bp, Homo sapiens
tcactaaatctt

SEQ ID NO: 4199440 - DNA, 19 bp, Homo sapiens
tcactaatactaattcatt

SEQ ID NO: 4199441 - DNA, 16 bp, Homo sapiens
taagtttagaagcgct

SEQ ID NO: 4199442 - DNA, 17 bp, Homo sapiens
taagtttatgtctaaag

SEQ ID NO: 4199443 - DNA, 18 bp, Homo sapiens
taagtttatgtctaaaga

SEQ ID NO: 4199444 - DNA, 20 bp, Homo sapiens
taagtttatgtctaaagagc

SEQ ID NO: 4199445 - DNA, 13 bp, Homo sapiens
taagtttgatcaa

SEQ ID NO: 4199446 - DNA, 15 bp, Homo sapiens
taataaaaacttcag

SEQ ID NO: 4199447 - DNA, 17 bp, Homo sapiens
taataaacttagaataa

SEQ ID NO: 4199448 - DNA, 18 bp, Homo sapiens
taataaacttagaataaa

SEQ ID NO: 4199449 - DNA, 19 bp, Homo sapiens
taataaaggctatttcctg

SEQ ID NO: 4199450 - DNA, 13 bp, Homo sapiens
taataaatattga

SEQ ID NO: 4199451 - DNA, 13 bp, Homo sapiens
taataaattcaga

SEQ ID NO: 4199452 - DNA, 12 bp, Homo sapiens
taataataatga

SEQ ID NO: 4199453 - DNA, 15 bp, Homo sapiens
taatacaatattaat

SEQ ID NO: 4199454 - DNA, 20 bp, Homo sapiens
taatacactaattcctttct

SEQ ID NO: 4199455 - DNA, 17 bp, Homo sapiens
taataccaagactaagc

SEQ ID NO: 4199456 - DNA, 19 bp, Homo sapiens
taatactgctgagatacat

SEQ ID NO: 4199457 - DNA, 23 bp, Homo sapiens
taatactgctgagatacatacag

SEQ ID NO: 4199458 - DNA, 14 bp, Homo sapiens
taatagatgtttga

SEQ ID NO: 4199459 - DNA, 13 bp, Homo sapiens
taatagcaaagaa

SEQ ID NO: 4199460 - DNA, 19 bp, Homo sapiens
taatagcgggttactttca

SEQ ID NO: 4199461 - DNA, 15 bp, Homo sapiens
taatatacaatctat

SEQ ID NO: 4199462 - DNA, 14 bp, Homo sapiens
taatatattgctgc

SEQ ID NO: 4199463 - DNA, 15 bp, Homo sapiens
taatatcctaaacat

SEQ ID NO: 4199464 - DNA, 18 bp, Homo sapiens
taatatggcaaaaatggc

SEQ ID NO: 4199465 - DNA, 12 bp, Homo sapiens
taatatttaggc

SEQ ID NO: 4199466 - DNA, 15 bp, Homo sapiens
taatatttaggcaag

SEQ ID NO: 4199467 - DNA, 21 bp, Homo sapiens
taatcaagaatattcaaatgt

SEQ ID NO: 4199468 - DNA, 12 bp, Homo sapiens
taatcagcctct

SEQ ID NO: 4199469 - DNA, 13 bp, Homo sapiens
taatcagcctctt

SEQ ID NO: 4199470 - DNA, 17 bp, Homo sapiens
taatccacagtatgtta

SEQ ID NO: 4199471 - DNA, 20 bp, Homo sapiens
taatcccagctacccaggag

SEQ ID NO: 4199472 - DNA, 23 bp, Homo sapiens
taatcccagctacccaggaggct

SEQ ID NO: 4199473 - DNA, 21 bp, Homo sapiens
taatctgcaaagaatgagaag

SEQ ID NO: 4199474 - DNA, 16 bp, Homo sapiens
taatgaaacaaagagt

SEQ ID NO: 4199475 - DNA, 17 bp, Homo sapiens
taatgaaacaaagagtt

SEQ ID NO: 4199476 - DNA, 23 bp, Homo sapiens
taatgaaacaaagagttcaagaa

SEQ ID NO: 4199477 - DNA, 15 bp, Homo sapiens
taatgacagattgtt

SEQ ID NO: 4199478 - DNA, 15 bp, Homo sapiens
taatgataacttgtt

SEQ ID NO: 4199479 - DNA, 16 bp, Homo sapiens
taatggaaaacattta

SEQ ID NO: 4199480 - DNA, 14 bp, Homo sapiens
taatgtaaatacat

SEQ ID NO: 4199481 - DNA, 20 bp, Homo sapiens
taatgtaagaaaatttgaag

SEQ ID NO: 4199482 - DNA, 22 bp, Homo sapiens
taatgtaagaaaatttgaagta

SEQ ID NO: 4199483 - DNA, 17 bp, Homo sapiens
taatgtatttatatgtt

SEQ ID NO: 4199484 - DNA, 13 bp, Homo sapiens
taatgtgattttt

SEQ ID NO: 4199485 - DNA, 14 bp, Homo sapiens
taatgttctttata

SEQ ID NO: 4199486 - DNA, 15 bp, Homo sapiens
taatgtttaaaacat

SEQ ID NO: 4199487 - DNA, 17 bp, Homo sapiens
taattaactatgtgatg

SEQ ID NO: 4199488 - DNA, 12 bp, Homo sapiens
taattaagtaaa

SEQ ID NO: 4199489 - DNA, 14 bp, Homo sapiens
taattataataaag

SEQ ID NO: 4199490 - DNA, 16 bp, Homo sapiens
taattatcagtcatga

SEQ ID NO: 4199491 - DNA, 16 bp, Homo sapiens
taattcaattcaaagc

SEQ ID NO: 4199492 - DNA, 14 bp, Homo sapiens
taattcacctcttc

SEQ ID NO: 4199493 - DNA, 22 bp, Homo sapiens
taattcctctcactaaacttta

SEQ ID NO: 4199494 - DNA, 15 bp, Homo sapiens
taattcctggcatga

SEQ ID NO: 4199495 - DNA, 20 bp, Homo sapiens
taattctcagccatgtgctt

SEQ ID NO: 4199496 - DNA, 20 bp, Homo sapiens
taattcttgttgttctgtag

SEQ ID NO: 4199497 - DNA, 16 bp, Homo sapiens
taattgccaaatacct

SEQ ID NO: 4199498 - DNA, 15 bp, Homo sapiens
taatttagaaaactt

SEQ ID NO: 4199499 - DNA, 21 bp, Homo sapiens
taatttagacttcaagcatgg

SEQ ID NO: 4199500 - DNA, 18 bp, Homo sapiens
taatttatatttgaaatt

SEQ ID NO: 4199501 - DNA, 19 bp, Homo sapiens
taatttattgtctgtctac

SEQ ID NO: 4199502 - DNA, 22 bp, Homo sapiens
taatttgaaaacataatctgca

SEQ ID NO: 4199503 - DNA, 21 bp, Homo sapiens
taattttcaggatttttggta

SEQ ID NO: 4199504 - DNA, 23 bp, Homo sapiens
taattttgtgaccacagttgtac

SEQ ID NO: 4199505 - DNA, 22 bp, Homo sapiens
taatttttataaatatgtgaaa

SEQ ID NO: 4199506 - DNA, 21 bp, Homo sapiens
taatttttcttacacatttta

SEQ ID NO: 4199507 - DNA, 17 bp, Homo sapiens
taattttttattcaagt

SEQ ID NO: 4199508 - DNA, 13 bp, Homo sapiens
taatttttttgaa

SEQ ID NO: 4199509 - DNA, 14 bp, Homo sapiens
tacaaaaacaaaac

SEQ ID NO: 4199510 - DNA, 12 bp, Homo sapiens
tacaaaatggag

SEQ ID NO: 4199511 - DNA, 19 bp, Homo sapiens
tacaaatgaaatttttcaa

SEQ ID NO: 4199512 - DNA, 17 bp, Homo sapiens
tacaaatttttcctgca

SEQ ID NO: 4199513 - DNA, 19 bp, Homo sapiens
tacaacaagagtttatttc

SEQ ID NO: 4199514 - DNA, 16 bp, Homo sapiens
tacaaccaatggaatg

SEQ ID NO: 4199515 - DNA, 20 bp, Homo sapiens
tacaacctggaaaataaatc

SEQ ID NO: 4199516 - DNA, 14 bp, Homo sapiens
tacaagaagcattt

SEQ ID NO: 4199517 - DNA, 16 bp, Homo sapiens
tacaaggatcagaatg

SEQ ID NO: 4199518 - DNA, 13 bp, Homo sapiens
tacaagtgtatat

SEQ ID NO: 4199519 - DNA, 15 bp, Homo sapiens
tacaagtgtatatca

SEQ ID NO: 4199520 - DNA, 22 bp, Homo sapiens
tacaatattaattataataaag

SEQ ID NO: 4199521 - DNA, 14 bp, Homo sapiens
tacacccttggact

SEQ ID NO: 4199522 - DNA, 16 bp, Homo sapiens
tacactctctgtacaa

SEQ ID NO: 4199523 - DNA, 21 bp, Homo sapiens
tacactctctgtacaaaaaca

SEQ ID NO: 4199524 - DNA, 22 bp, Homo sapiens
tacactctctgtacaaaaacaa

SEQ ID NO: 4199525 - DNA, 23 bp, Homo sapiens
tacactttggccaagcaagaggt

SEQ ID NO: 4199526 - DNA, 19 bp, Homo sapiens
tacagagaaattctgtggt

SEQ ID NO: 4199527 - DNA, 21 bp, Homo sapiens
tacagcagggtcttgctgtaa

SEQ ID NO: 4199528 - DNA, 14 bp, Homo sapiens
tacagcgagaggca

SEQ ID NO: 4199529 - DNA, 20 bp, Homo sapiens
tacagcgagaggcagagaaa

SEQ ID NO: 4199530 - DNA, 14 bp, Homo sapiens
tacagctgtttaag

SEQ ID NO: 4199531 - DNA, 13 bp, Homo sapiens
tacagtaaataaa

SEQ ID NO: 4199532 - DNA, 16 bp, Homo sapiens
tacagtaaataaattg

SEQ ID NO: 4199533 - DNA, 17 bp, Homo sapiens
tacagtaaataaattgt

SEQ ID NO: 4199534 - DNA, 18 bp, Homo sapiens
tacagtaaataaattgtt

SEQ ID NO: 4199535 - DNA, 17 bp, Homo sapiens
tacagtgaatttctgat

SEQ ID NO: 4199536 - DNA, 12 bp, Homo sapiens
tacagtgagcca

SEQ ID NO: 4199537 - DNA, 22 bp, Homo sapiens
tacataattttttattcaagtt

SEQ ID NO: 4199538 - DNA, 19 bp, Homo sapiens
tacatacgtgttctataga

SEQ ID NO: 4199539 - DNA, 14 bp, Homo sapiens
tacatagtaaatgg

SEQ ID NO: 4199540 - DNA, 20 bp, Homo sapiens
tacatcttttcaacaagtaa

SEQ ID NO: 4199541 - DNA, 16 bp, Homo sapiens
tacatgaacacagctg

SEQ ID NO: 4199542 - DNA, 23 bp, Homo sapiens
tacatgaacacagctgctgaaga

SEQ ID NO: 4199543 - DNA, 17 bp, Homo sapiens
tacatgctaagagaagt

SEQ ID NO: 4199544 - DNA, 19 bp, Homo sapiens
tacatgctaagagaagtag

SEQ ID NO: 4199545 - DNA, 16 bp, Homo sapiens
tacatggccagtgtga

SEQ ID NO: 4199546 - DNA, 16 bp, Homo sapiens
tacattagcagctatg

SEQ ID NO: 4199547 - DNA, 15 bp, Homo sapiens
tacatttctgcagat

SEQ ID NO: 4199548 - DNA, 17 bp, Homo sapiens
tacattttactgattaa

SEQ ID NO: 4199549 - DNA, 18 bp, Homo sapiens
taccaaatccacaagcca

SEQ ID NO: 4199550 - DNA, 19 bp, Homo sapiens
taccaactttctgtaaact

SEQ ID NO: 4199551 - DNA, 19 bp, Homo sapiens
taccaatgcttttatcaaa

SEQ ID NO: 4199552 - DNA, 21 bp, Homo sapiens
taccagatagttatattaaat

SEQ ID NO: 4199553 - DNA, 12 bp, Homo sapiens
taccagatgcag

SEQ ID NO: 4199554 - DNA, 15 bp, Homo sapiens
tacccaaatatgttt

SEQ ID NO: 4199555 - DNA, 19 bp, Homo sapiens
tacccaggaggctgaggca

SEQ ID NO: 4199556 - DNA, 17 bp, Homo sapiens
taccccacctcatgcct

SEQ ID NO: 4199557 - DNA, 21 bp, Homo sapiens
taccccacctcatgcctggcc

SEQ ID NO: 4199558 - DNA, 22 bp, Homo sapiens
tacccggcccagagaccccttc

SEQ ID NO: 4199559 - DNA, 15 bp, Homo sapiens
taccctggtggaggc

SEQ ID NO: 4199560 - DNA, 14 bp, Homo sapiens
tacctatgtgacag

SEQ ID NO: 4199561 - DNA, 20 bp, Homo sapiens
tacctatgtgacagacattt

SEQ ID NO: 4199562 - DNA, 12 bp, Homo sapiens
tacctcagccta

SEQ ID NO: 4199563 - DNA, 16 bp, Homo sapiens
tacctcagcctagacc

SEQ ID NO: 4199564 - DNA, 16 bp, Homo sapiens
tacctctgagaagaca

SEQ ID NO: 4199565 - DNA, 15 bp, Homo sapiens
tacctgtcctagcag

SEQ ID NO: 4199566 - DNA, 16 bp, Homo sapiens
tacctgtcctagcagg

SEQ ID NO: 4199567 - DNA, 14 bp, Homo sapiens
tacctgttgagcat

SEQ ID NO: 4199568 - DNA, 22 bp, Homo sapiens
taccttctcaaaagattgtttt

SEQ ID NO: 4199569 - DNA, 17 bp, Homo sapiens
taccttgttttctctat

SEQ ID NO: 4199570 - DNA, 15 bp, Homo sapiens
tacggttgcttcacc

SEQ ID NO: 4199571 - DNA, 18 bp, Homo sapiens
tacgtgttcctataaaat

SEQ ID NO: 4199572 - DNA, 15 bp, Homo sapiens
tactaagaggctatt

SEQ ID NO: 4199573 - DNA, 19 bp, Homo sapiens
tactactttgcctcttcag

SEQ ID NO: 4199574 - DNA, 18 bp, Homo sapiens
tactagaatttgtatttt

SEQ ID NO: 4199575 - DNA, 19 bp, Homo sapiens
tactagaatttgtattttg

SEQ ID NO: 4199576 - DNA, 20 bp, Homo sapiens
tactatgaaatgaaagaact

SEQ ID NO: 4199577 - DNA, 22 bp, Homo sapiens
tactattggaagataaacttgt

SEQ ID NO: 4199578 - DNA, 12 bp, Homo sapiens
tactatttcaca

SEQ ID NO: 4199579 - DNA, 13 bp, Homo sapiens
tactcacctctct

SEQ ID NO: 4199580 - DNA, 18 bp, Homo sapiens
tactcacctctctctaag

SEQ ID NO: 4199581 - DNA, 16 bp, Homo sapiens
tactcagaagcctgag

SEQ ID NO: 4199582 - DNA, 19 bp, Homo sapiens
tactcagaagcctgaggct

SEQ ID NO: 4199583 - DNA, 11 bp, Homo sapiens
tactcagcagt

SEQ ID NO: 4199584 - DNA, 17 bp, Homo sapiens
tactcagcagtaagcag

SEQ ID NO: 4199585 - DNA, 14 bp, Homo sapiens
tactccagcaggta

SEQ ID NO: 4199586 - DNA, 15 bp, Homo sapiens
tactcctacctcagc

SEQ ID NO: 4199587 - DNA, 16 bp, Homo sapiens
tactctaatcagtcct

SEQ ID NO: 4199588 - DNA, 14 bp, Homo sapiens
tactctctgaaata

SEQ ID NO: 4199589 - DNA, 16 bp, Homo sapiens
tactctcttgccagca

SEQ ID NO: 4199590 - DNA, 15 bp, Homo sapiens
tactctgtccactct

SEQ ID NO: 4199591 - DNA, 15 bp, Homo sapiens
tactcttcctttcta

SEQ ID NO: 4199592 - DNA, 21 bp, Homo sapiens
tactgaacccagagtcaggaa

SEQ ID NO: 4199593 - DNA, 17 bp, Homo sapiens
tactgattctcctgtca

SEQ ID NO: 4199594 - DNA, 13 bp, Homo sapiens
tactgatttttgt

SEQ ID NO: 4199595 - DNA, 17 bp, Homo sapiens
tactgatttttgtgatt

SEQ ID NO: 4199596 - DNA, 19 bp, Homo sapiens
tactgcagctttacatgca

SEQ ID NO: 4199597 - DNA, 23 bp, Homo sapiens
tactgcagctttacatgcaattt

SEQ ID NO: 4199598 - DNA, 21 bp, Homo sapiens
tactgcagtaacactggcctt

SEQ ID NO: 4199599 - DNA, 21 bp, Homo sapiens
tactgctgagatacatacaga

SEQ ID NO: 4199600 - DNA, 24 bp, Homo sapiens
tactgcttggagctgagcaaatca

SEQ ID NO: 4199601 - DNA, 22 bp, Homo sapiens
tactgggaatggaaggctttgc

SEQ ID NO: 4199602 - DNA, 21 bp, Homo sapiens
tactgtctggttttaacaatt

SEQ ID NO: 4199603 - DNA, 13 bp, Homo sapiens
tactgtgtgaaga

SEQ ID NO: 4199604 - DNA, 14 bp, Homo sapiens
tactgtttttgcta

SEQ ID NO: 4199605 - DNA, 22 bp, Homo sapiens
tactgtttttgctattacatgt

SEQ ID NO: 4199606 - DNA, 13 bp, Homo sapiens
tacttaataaatt

SEQ ID NO: 4199607 - DNA, 14 bp, Homo sapiens
tacttaataaattc

SEQ ID NO: 4199608 - DNA, 19 bp, Homo sapiens
tacttaataaattcagata

SEQ ID NO: 4199609 - DNA, 23 bp, Homo sapiens
tacttacaaactgcggtatacat

SEQ ID NO: 4199610 - DNA, 17 bp, Homo sapiens
tacttaccaagctgagc

SEQ ID NO: 4199611 - DNA, 20 bp, Homo sapiens
tacttctcattttttaaaaa

SEQ ID NO: 4199612 - DNA, 12 bp, Homo sapiens
tacttgaaagat

SEQ ID NO: 4199613 - DNA, 20 bp, Homo sapiens
tactttacactctctgtaca

SEQ ID NO: 4199614 - DNA, 17 bp, Homo sapiens
tactttgccttttgcaa

SEQ ID NO: 4199615 - DNA, 22 bp, Homo sapiens
tactttggtggccacataagcc

SEQ ID NO: 4199616 - DNA, 16 bp, Homo sapiens
tagaaaactgaaaatc

SEQ ID NO: 4199617 - DNA, 20 bp, Homo sapiens
tagaaaactgaaaatctaat

SEQ ID NO: 4199618 - DNA, 21 bp, Homo sapiens
tagaaaactgaaaatctaata

SEQ ID NO: 4199619 - DNA, 14 bp, Homo sapiens
tagaaaccttaata

SEQ ID NO: 4199620 - DNA, 18 bp, Homo sapiens
tagaaacgtgataaatat

SEQ ID NO: 4199621 - DNA, 16 bp, Homo sapiens
tagaaagaaaatgtct

SEQ ID NO: 4199622 - DNA, 22 bp, Homo sapiens
tagaaagaaaatgtctgttttc

SEQ ID NO: 4199623 - DNA, 18 bp, Homo sapiens
tagaaatacttttcctta

SEQ ID NO: 4199624 - DNA, 22 bp, Homo sapiens
tagaaatacttttccttaattt

SEQ ID NO: 4199625 - DNA, 11 bp, Homo sapiens
tagaaatcata

SEQ ID NO: 4199626 - DNA, 22 bp, Homo sapiens
tagaaattaccagagttgttct

SEQ ID NO: 4199627 - DNA, 17 bp, Homo sapiens
tagaacatccctgggca

SEQ ID NO: 4199628 - DNA, 20 bp, Homo sapiens
tagaactgtatgtcagacat

SEQ ID NO: 4199629 - DNA, 23 bp, Homo sapiens
tagaactttgtgccagcgctggc

SEQ ID NO: 4199630 - DNA, 19 bp, Homo sapiens
tagaataaaattgtaaaat

SEQ ID NO: 4199631 - DNA, 16 bp, Homo sapiens
tagaatgccggttaaa

SEQ ID NO: 4199632 - DNA, 22 bp, Homo sapiens
tagaatgccggttaaattccat

SEQ ID NO: 4199633 - DNA, 23 bp, Homo sapiens
tagaattatttttgagcaggagc

SEQ ID NO: 4199634 - DNA, 20 bp, Homo sapiens
tagaattgagtgtttaaagt

SEQ ID NO: 4199635 - DNA, 16 bp, Homo sapiens
tagaatttgtattttg

SEQ ID NO: 4199636 - DNA, 18 bp, Homo sapiens
tagacactgggagaagag

SEQ ID NO: 4199637 - DNA, 15 bp, Homo sapiens
tagactcatcttttg

SEQ ID NO: 4199638 - DNA, 17 bp, Homo sapiens
tagactcatcttttgaa

SEQ ID NO: 4199639 - DNA, 12 bp, Homo sapiens
tagactttctgt

SEQ ID NO: 4199640 - DNA, 17 bp, Homo sapiens
tagagaggtagcgagct

SEQ ID NO: 4199641 - DNA, 11 bp, Homo sapiens
tagagatgtgt

SEQ ID NO: 4199642 - DNA, 12 bp, Homo sapiens
tagagatgtgtg

SEQ ID NO: 4199643 - DNA, 17 bp, Homo sapiens
tagagattttcttggca

SEQ ID NO: 4199644 - DNA, 11 bp, Homo sapiens
tagagcactgc

SEQ ID NO: 4199645 - DNA, 22 bp, Homo sapiens
tagagccccccgtgtggcttac

SEQ ID NO: 4199646 - DNA, 18 bp, Homo sapiens
tagagggagaggaagcac

SEQ ID NO: 4199647 - DNA, 17 bp, Homo sapiens
tagaggtgagaaattta

SEQ ID NO: 4199648 - DNA, 20 bp, Homo sapiens
tagaggtttgtcaacacaaa

SEQ ID NO: 4199649 - DNA, 19 bp, Homo sapiens
tagaggttttgttgtttta

SEQ ID NO: 4199650 - DNA, 13 bp, Homo sapiens
tagagtcagcctt

SEQ ID NO: 4199651 - DNA, 15 bp, Homo sapiens
tagatctggcatgtt

SEQ ID NO: 4199652 - DNA, 16 bp, Homo sapiens
tagatgggtctggctg

SEQ ID NO: 4199653 - DNA, 14 bp, Homo sapiens
tagattgaaaccat

SEQ ID NO: 4199654 - DNA, 13 bp, Homo sapiens
tagattttctgct

SEQ ID NO: 4199655 - DNA, 12 bp, Homo sapiens
tagcaaagaatt

SEQ ID NO: 4199656 - DNA, 14 bp, Homo sapiens
tagcaaagaattga

SEQ ID NO: 4199657 - DNA, 21 bp, Homo sapiens
tagcaactacagtctaaagct

SEQ ID NO: 4199658 - DNA, 17 bp, Homo sapiens
tagcaagttctagagaa

SEQ ID NO: 4199659 - DNA, 21 bp, Homo sapiens
tagcaagttctagagaagagg

SEQ ID NO: 4199660 - DNA, 18 bp, Homo sapiens
tagcaattagcagaagtg

SEQ ID NO: 4199661 - DNA, 19 bp, Homo sapiens
tagcacgggttaagatctg

SEQ ID NO: 4199662 - DNA, 15 bp, Homo sapiens
tagcagaggaaaaag

SEQ ID NO: 4199663 - DNA, 14 bp, Homo sapiens
tagcagctatgtaa

SEQ ID NO: 4199664 - DNA, 15 bp, Homo sapiens
tagcaggtggtcctg

SEQ ID NO: 4199665 - DNA, 22 bp, Homo sapiens
tagcattcagggttatacacag

SEQ ID NO: 4199666 - DNA, 16 bp, Homo sapiens
tagcattttcttgaac

SEQ ID NO: 4199667 - DNA, 16 bp, Homo sapiens
tagccaaaacacttag

SEQ ID NO: 4199668 - DNA, 21 bp, Homo sapiens
tagccaaggtgggctgagccc

SEQ ID NO: 4199669 - DNA, 15 bp, Homo sapiens
tagccacaccaggat

SEQ ID NO: 4199670 - DNA, 21 bp, Homo sapiens
tagccactttggtcccgtgca

SEQ ID NO: 4199671 - DNA, 22 bp, Homo sapiens
tagccatgtactataatgtgat

SEQ ID NO: 4199672 - DNA, 22 bp, Homo sapiens
tagccatttccatggctctgtt

SEQ ID NO: 4199673 - DNA, 22 bp, Homo sapiens
tagccctccctggcatgtcaga

SEQ ID NO: 4199674 - DNA, 15 bp, Homo sapiens
tagcccttccctgcc

SEQ ID NO: 4199675 - DNA, 18 bp, Homo sapiens
tagcgagctgctctgcta

SEQ ID NO: 4199676 - DNA, 16 bp, Homo sapiens
tagcggatctcactca

SEQ ID NO: 4199677 - DNA, 17 bp, Homo sapiens
tagctaggtatcttact

SEQ ID NO: 4199678 - DNA, 21 bp, Homo sapiens
tagctatatttatatatatcc

SEQ ID NO: 4199679 - DNA, 21 bp, Homo sapiens
tagctatcagaagaccacaaa

SEQ ID NO: 4199680 - DNA, 14 bp, Homo sapiens
tagctattactgtc

SEQ ID NO: 4199681 - DNA, 21 bp, Homo sapiens
tagctatttgtttacatgcag

SEQ ID NO: 4199682 - DNA, 17 bp, Homo sapiens
tagctgagcgtggtggc

SEQ ID NO: 4199683 - DNA, 18 bp, Homo sapiens
tagctgagtgcactcctg

SEQ ID NO: 4199684 - DNA, 20 bp, Homo sapiens
tagctgttttagctgaggga

SEQ ID NO: 4199685 - DNA, 13 bp, Homo sapiens
tagcttgtatagt

SEQ ID NO: 4199686 - DNA, 16 bp, Homo sapiens
tagctttaacttaaat

SEQ ID NO: 4199687 - DNA, 22 bp, Homo sapiens
tagcttttgcaacatggtccag

SEQ ID NO: 4199688 - DNA, 19 bp, Homo sapiens
taggaaagggaagcctgac

SEQ ID NO: 4199689 - DNA, 17 bp, Homo sapiens
taggaaataaaaccttt

SEQ ID NO: 4199690 - DNA, 19 bp, Homo sapiens
taggaaataaaacctttca

SEQ ID NO: 4199691 - DNA, 17 bp, Homo sapiens
taggaacccagctctca

SEQ ID NO: 4199692 - DNA, 13 bp, Homo sapiens
taggaagaaaaat

SEQ ID NO: 4199693 - DNA, 19 bp, Homo sapiens
taggaatatgactcaggag

SEQ ID NO: 4199694 - DNA, 14 bp, Homo sapiens
taggactctgaggc

SEQ ID NO: 4199695 - DNA, 16 bp, Homo sapiens
taggactctgaggctc

SEQ ID NO: 4199696 - DNA, 18 bp, Homo sapiens
taggactctgaggctctt

SEQ ID NO: 4199697 - DNA, 15 bp, Homo sapiens
taggagctcacagtc

SEQ ID NO: 4199698 - DNA, 17 bp, Homo sapiens
taggaggaaaagacaga

SEQ ID NO: 4199699 - DNA, 17 bp, Homo sapiens
taggagttcgagaccag

SEQ ID NO: 4199700 - DNA, 23 bp, Homo sapiens
taggagttcgagaccagcctggc

SEQ ID NO: 4199701 - DNA, 16 bp, Homo sapiens
taggatggttctgtga

SEQ ID NO: 4199702 - DNA, 18 bp, Homo sapiens
taggatgtttttcatgaa

SEQ ID NO: 4199703 - DNA, 22 bp, Homo sapiens
taggatttatttaaaatagcaa

SEQ ID NO: 4199704 - DNA, 13 bp, Homo sapiens
taggcagacgtgg

SEQ ID NO: 4199705 - DNA, 12 bp, Homo sapiens
taggcagcctgc

SEQ ID NO: 4199706 - DNA, 19 bp, Homo sapiens
taggcagggatttgaggag

SEQ ID NO: 4199707 - DNA, 14 bp, Homo sapiens
taggcatgcctaat

SEQ ID NO: 4199708 - DNA, 19 bp, Homo sapiens
taggcatttttaccatcac

SEQ ID NO: 4199709 - DNA, 17 bp, Homo sapiens
taggctatatgcatttg

SEQ ID NO: 4199710 - DNA, 21 bp, Homo sapiens
taggctggagaagctcaccca

SEQ ID NO: 4199711 - DNA, 17 bp, Homo sapiens
taggcttatcaaaatct

SEQ ID NO: 4199712 - DNA, 15 bp, Homo sapiens
taggctttagaagag

SEQ ID NO: 4199713 - DNA, 14 bp, Homo sapiens
tagggaagcaggga

SEQ ID NO: 4199714 - DNA, 18 bp, Homo sapiens
taggggaagtatgtgtgg

SEQ ID NO: 4199715 - DNA, 16 bp, Homo sapiens
taggggtaatatattg

SEQ ID NO: 4199716 - DNA, 23 bp, Homo sapiens
taggggtaatatattgctgctgg

SEQ ID NO: 4199717 - DNA, 14 bp, Homo sapiens
taggggtcaaagaa

SEQ ID NO: 4199718 - DNA, 17 bp, Homo sapiens
tagggtcctggccctct

SEQ ID NO: 4199719 - DNA, 14 bp, Homo sapiens
taggtcacttgaag

SEQ ID NO: 4199720 - DNA, 21 bp, Homo sapiens
ggccttagtacggctgctgca

SEQ ID NO: 4199721 - DNA, 16 bp, Homo sapiens
ggcgaataaatgttca

SEQ ID NO: 4199722 - DNA, 17 bp, Homo sapiens
ggcgaataaatgttcaa

SEQ ID NO: 4199723 - DNA, 15 bp, Homo sapiens
ggcgccaactgctga

SEQ ID NO: 4199724 - DNA, 20 bp, Homo sapiens
ggcgcctgtagtcccagcca

SEQ ID NO: 4199725 - DNA, 20 bp, Homo sapiens
ggcgcgtctgccccaccctc

SEQ ID NO: 4199726 - DNA, 15 bp, Homo sapiens
ggcggaaggggacgc

SEQ ID NO: 4199727 - DNA, 21 bp, Homo sapiens
ggcggagagtacagtgagcca

SEQ ID NO: 4199728 - DNA, 11 bp, Homo sapiens
ggcggaggcgg

SEQ ID NO: 4199729 - DNA, 14 bp, Homo sapiens
ggcggctccaggtc

SEQ ID NO: 4199730 - DNA, 15 bp, Homo sapiens
ggcggctccaggtcc

SEQ ID NO: 4199731 - DNA, 21 bp, Homo sapiens
ggcggggaagggtgcatagct

SEQ ID NO: 4199732 - DNA, 21 bp, Homo sapiens
ggcgtccctgagggcccttcc

SEQ ID NO: 4199733 - DNA, 23 bp, Homo sapiens
ggcgtccctgagggcccttccca

SEQ ID NO: 4199734 - DNA, 16 bp, Homo sapiens
ggcgtctggacgccga

SEQ ID NO: 4199735 - DNA, 16 bp, Homo sapiens
ggctaagtcaagatca

SEQ ID NO: 4199736 - DNA, 19 bp, Homo sapiens
ggctaattcccagagtgtg

SEQ ID NO: 4199737 - DNA, 23 bp, Homo sapiens
ggctaattcccagagtgtgaaac

SEQ ID NO: 4199738 - DNA, 12 bp, Homo sapiens
ggctaccctccc

SEQ ID NO: 4199739 - DNA, 23 bp, Homo sapiens
ggctactgcagctttacatgcaa

SEQ ID NO: 4199740 - DNA, 20 bp, Homo sapiens
ggctagagtgcagtggcatg

SEQ ID NO: 4199741 - DNA, 16 bp, Homo sapiens
ggctaggaaagggaag

SEQ ID NO: 4199742 - DNA, 20 bp, Homo sapiens
ggctatttaaaaagctcttt

SEQ ID NO: 4199743 - DNA, 20 bp, Homo sapiens
ggctcacgcctatgatccca

SEQ ID NO: 4199744 - DNA, 23 bp, Homo sapiens
ggctcacgcctgtaatcccagca

SEQ ID NO: 4199745 - DNA, 17 bp, Homo sapiens
ggctcatatgcgtccca

SEQ ID NO: 4199746 - DNA, 18 bp, Homo sapiens
ggctccctcctggagcat

SEQ ID NO: 4199747 - DNA, 17 bp, Homo sapiens
ggctccctggcccagcc

SEQ ID NO: 4199748 - DNA, 19 bp, Homo sapiens
ggctccctggcccagccag

SEQ ID NO: 4199749 - DNA, 23 bp, Homo sapiens
ggctccggaggggacccagctcc

SEQ ID NO: 4199750 - DNA, 21 bp, Homo sapiens
ggctctccaccttgttacaca

SEQ ID NO: 4199751 - DNA, 13 bp, Homo sapiens
ggctctccagtta

SEQ ID NO: 4199752 - DNA, 17 bp, Homo sapiens
ggctctgccccagaggc

SEQ ID NO: 4199753 - DNA, 20 bp, Homo sapiens
ggctctgccccagctctggc

SEQ ID NO: 4199754 - DNA, 15 bp, Homo sapiens
ggctctgtgcaggga

SEQ ID NO: 4199755 - DNA, 18 bp, Homo sapiens
ggctctgttatgcaagca

SEQ ID NO: 4199756 - DNA, 21 bp, Homo sapiens
ggctctgttatgcaagcacaa

SEQ ID NO: 4199757 - DNA, 11 bp, Homo sapiens
ggctgaaagcc

SEQ ID NO: 4199758 - DNA, 19 bp, Homo sapiens
ggctgacctgggcccacag

SEQ ID NO: 4199759 - DNA, 13 bp, Homo sapiens
ggctgagccctgg

SEQ ID NO: 4199760 - DNA, 18 bp, Homo sapiens
ggctgagctttctagcct

SEQ ID NO: 4199761 - DNA, 12 bp, Homo sapiens
ggctgaggcagg

SEQ ID NO: 4199762 - DNA, 15 bp, Homo sapiens
ggctgataattttaa

SEQ ID NO: 4199763 - DNA, 21 bp, Homo sapiens
ggctgcgaaaacgttgacccc

SEQ ID NO: 4199764 - DNA, 14 bp, Homo sapiens
ggctgctcctccag

SEQ ID NO: 4199765 - DNA, 17 bp, Homo sapiens
ggctgctcctccagccc

SEQ ID NO: 4199766 - DNA, 14 bp, Homo sapiens
ggctgctgggagat

SEQ ID NO: 4199767 - DNA, 18 bp, Homo sapiens
ggctgcttattggaccag

SEQ ID NO: 4199768 - DNA, 14 bp, Homo sapiens
ggctggacctgcac

SEQ ID NO: 4199769 - DNA, 20 bp, Homo sapiens
ggctggagttcagtggtgtg

SEQ ID NO: 4199770 - DNA, 15 bp, Homo sapiens
ggctggatgaaattt

SEQ ID NO: 4199771 - DNA, 14 bp, Homo sapiens
ggctggctgcagtg

SEQ ID NO: 4199772 - DNA, 13 bp, Homo sapiens
ggctggctgggca

SEQ ID NO: 4199773 - DNA, 13 bp, Homo sapiens
ggctgggcccaca

SEQ ID NO: 4199774 - DNA, 19 bp, Homo sapiens
ggctggtgctgtggccagg

SEQ ID NO: 4199775 - DNA, 21 bp, Homo sapiens
ggctgtaagcattctgagctg

SEQ ID NO: 4199776 - DNA, 15 bp, Homo sapiens
ggctgtggggtctgg

SEQ ID NO: 4199777 - DNA, 12 bp, Homo sapiens
ggctgtggttcc

SEQ ID NO: 4199778 - DNA, 17 bp, Homo sapiens
ggcttaggtgccaggct

SEQ ID NO: 4199779 - DNA, 15 bp, Homo sapiens
ggcttagtgccaccc

SEQ ID NO: 4199780 - DNA, 19 bp, Homo sapiens
ggcttagtgccacccacct

SEQ ID NO: 4199781 - DNA, 15 bp, Homo sapiens
ggcttatcatcagcc

SEQ ID NO: 4199782 - DNA, 20 bp, Homo sapiens
ggcttattttttaaaataat

SEQ ID NO: 4199783 - DNA, 20 bp, Homo sapiens
ggcttcagcatatttatagc

SEQ ID NO: 4199784 - DNA, 21 bp, Homo sapiens
ggcttccagaaaaccccagca

SEQ ID NO: 4199785 - DNA, 21 bp, Homo sapiens
ggcttccaggtatctccagga

SEQ ID NO: 4199786 - DNA, 18 bp, Homo sapiens
ggcttctggagcccttgg

SEQ ID NO: 4199787 - DNA, 18 bp, Homo sapiens
ggcttctggccaggaagc

SEQ ID NO: 4199788 - DNA, 15 bp, Homo sapiens
ggcttcttgcccaga

SEQ ID NO: 4199789 - DNA, 14 bp, Homo sapiens
ggcttgcatgccaa

SEQ ID NO: 4199790 - DNA, 12 bp, Homo sapiens
ggctttctggag

SEQ ID NO: 4199791 - DNA, 22 bp, Homo sapiens
ggctttgccatgggcctgctgc

SEQ ID NO: 4199792 - DNA, 17 bp, Homo sapiens
gggaagagaagggaagc

SEQ ID NO: 4199793 - DNA, 15 bp, Homo sapiens
gggaagcaagcaggg

SEQ ID NO: 4199794 - DNA, 12 bp, Homo sapiens
gggaagcaggga

SEQ ID NO: 4199795 - DNA, 15 bp, Homo sapiens
gggaagcagggacac

SEQ ID NO: 4199796 - DNA, 20 bp, Homo sapiens
gggaagcctcttcagggtga

SEQ ID NO: 4199797 - DNA, 18 bp, Homo sapiens
gggaagctgggggaaggg

SEQ ID NO: 4199798 - DNA, 13 bp, Homo sapiens
gggaatccgcctg

SEQ ID NO: 4199799 - DNA, 21 bp, Homo sapiens
gggaatcctgctgccagagaa

SEQ ID NO: 4199800 - DNA, 22 bp, Homo sapiens
gggaatgtttgggcagaaggga

SEQ ID NO: 4199801 - DNA, 22 bp, Homo sapiens
gggaattctttacaataaacat

SEQ ID NO: 4199802 - DNA, 13 bp, Homo sapiens
gggacaacatttt

SEQ ID NO: 4199803 - DNA, 17 bp, Homo sapiens
gggacacacatcaaaaa

SEQ ID NO: 4199804 - DNA, 15 bp, Homo sapiens
gggacagtattctca

SEQ ID NO: 4199805 - DNA, 17 bp, Homo sapiens
gggacccagctcctctg

SEQ ID NO: 4199806 - DNA, 20 bp, Homo sapiens
gggacccagctcctctgagc

SEQ ID NO: 4199807 - DNA, 23 bp, Homo sapiens
gggacccagctcctctgagccat

SEQ ID NO: 4199808 - DNA, 20 bp, Homo sapiens
gggacgcgcacacacaccgg

SEQ ID NO: 4199809 - DNA, 15 bp, Homo sapiens
gggactgtgcctttg

SEQ ID NO: 4199810 - DNA, 14 bp, Homo sapiens
gggagaacctcagg

SEQ ID NO: 4199811 - DNA, 15 bp, Homo sapiens
gggagaagaccgact

SEQ ID NO: 4199812 - DNA, 13 bp, Homo sapiens
gggagagcctggc

SEQ ID NO: 4199813 - DNA, 19 bp, Homo sapiens
gggagctgctggctgacct

SEQ ID NO: 4199814 - DNA, 21 bp, Homo sapiens
gggagctgctggctgacctgg

SEQ ID NO: 4199815 - DNA, 13 bp, Homo sapiens
gggagctggaaat

SEQ ID NO: 4199816 - DNA, 19 bp, Homo sapiens
gggagcttgagggacaatg

SEQ ID NO: 4199817 - DNA, 15 bp, Homo sapiens
gggaggaggcagaga

SEQ ID NO: 4199818 - DNA, 19 bp, Homo sapiens
gggaggatcactggagccc

SEQ ID NO: 4199819 - DNA, 18 bp, Homo sapiens
gggaggcggagagtacag

SEQ ID NO: 4199820 - DNA, 14 bp, Homo sapiens
gggaggctgaggcg

SEQ ID NO: 4199821 - DNA, 18 bp, Homo sapiens
ggtggattcctgggcaag

SEQ ID NO: 4199822 - DNA, 19 bp, Homo sapiens
ggtggcaagggggcggggc

SEQ ID NO: 4199823 - DNA, 15 bp, Homo sapiens
ggtggcagccctgta

SEQ ID NO: 4199824 - DNA, 18 bp, Homo sapiens
ggtggcaggaccaggact

SEQ ID NO: 4199825 - DNA, 14 bp, Homo sapiens
ggtggcagtggaaa

SEQ ID NO: 4199826 - DNA, 15 bp, Homo sapiens
ggtggccaagcctgg

SEQ ID NO: 4199827 - DNA, 17 bp, Homo sapiens
ggtggctcttgcctgta

SEQ ID NO: 4199828 - DNA, 19 bp, Homo sapiens
ggtgggaagcaagcagggg

SEQ ID NO: 4199829 - DNA, 16 bp, Homo sapiens
ggtgggagagcccagc

SEQ ID NO: 4199830 - DNA, 13 bp, Homo sapiens
ggtgggctgagcc

SEQ ID NO: 4199831 - DNA, 17 bp, Homo sapiens
ggtgggctgagccctgg

SEQ ID NO: 4199832 - DNA, 15 bp, Homo sapiens
ggtgggctggcccag

SEQ ID NO: 4199833 - DNA, 16 bp, Homo sapiens
ggtgggctggcccagc

SEQ ID NO: 4199834 - DNA, 20 bp, Homo sapiens
ggtgtcaccagcctgtttag

SEQ ID NO: 4199835 - DNA, 19 bp, Homo sapiens
ggtgtcaccctgcagagct

SEQ ID NO: 4199836 - DNA, 10 bp, Homo sapiens
ggtgtcagct

SEQ ID NO: 4199837 - DNA, 12 bp, Homo sapiens
ggtgtccctgcg

SEQ ID NO: 4199838 - DNA, 16 bp, Homo sapiens
ggtgtctgcacccagg

SEQ ID NO: 4199839 - DNA, 20 bp, Homo sapiens
ggtgtgaaagtcagatgccc

SEQ ID NO: 4199840 - DNA, 14 bp, Homo sapiens
ggtgtgcctgccct

SEQ ID NO: 4199841 - DNA, 16 bp, Homo sapiens
ggtgtgcctgccctgg

SEQ ID NO: 4199842 - DNA, 14 bp, Homo sapiens
ggtgttaatttttg

SEQ ID NO: 4199843 - DNA, 17 bp, Homo sapiens
ggttaatctttcctgat

SEQ ID NO: 4199844 - DNA, 22 bp, Homo sapiens
ggttagaggtttgtcaacaaaa

SEQ ID NO: 4199845 - DNA, 20 bp, Homo sapiens
ggttaggagttcgagaccag

SEQ ID NO: 4199846 - DNA, 23 bp, Homo sapiens
ggttagggtgtgtgccacacccc

SEQ ID NO: 4199847 - DNA, 13 bp, Homo sapiens
ggttcaccttgcc

SEQ ID NO: 4199848 - DNA, 16 bp, Homo sapiens
ggttcctaagcctgtt

SEQ ID NO: 4199849 - DNA, 18 bp, Homo sapiens
ggttctggggctgggcct

SEQ ID NO: 4199850 - DNA, 19 bp, Homo sapiens
ggttctgtgacccatctgt

SEQ ID NO: 4199851 - DNA, 19 bp, Homo sapiens
ggttgccaatgtctgattt

SEQ ID NO: 4199852 - DNA, 18 bp, Homo sapiens
ggttgcgggggagctgga

SEQ ID NO: 4199853 - DNA, 21 bp, Homo sapiens
ggttgcgggggagctggaaat

SEQ ID NO: 4199854 - DNA, 19 bp, Homo sapiens
ggttgcttaaaagggacag

SEQ ID NO: 4199855 - DNA, 19 bp, Homo sapiens
ggttggtgggctggcccag

SEQ ID NO: 4199856 - DNA, 21 bp, Homo sapiens
ggttgtctgtttttgtaactt

SEQ ID NO: 4199857 - DNA, 21 bp, Homo sapiens
ggttgtgaggcctggccaggc

SEQ ID NO: 4199858 - DNA, 14 bp, Homo sapiens
ggtttacatgaaca

SEQ ID NO: 4199859 - DNA, 12 bp, Homo sapiens
ggtttattccct

SEQ ID NO: 4199860 - DNA, 23 bp, Homo sapiens
ggtttcaaagaaaaaggtccatg

SEQ ID NO: 4199861 - DNA, 17 bp, Homo sapiens
ggtttgtcaacaaaaag

SEQ ID NO: 4199862 - DNA, 15 bp, Homo sapiens
ggtttgttgtaaata

SEQ ID NO: 4199863 - DNA, 16 bp, Homo sapiens
ggtttgttgtaaataa

SEQ ID NO: 4199864 - DNA, 11 bp, Homo sapiens
gtaaaacattt

SEQ ID NO: 4199865 - DNA, 20 bp, Homo sapiens
gtaaaacatttattttgaca

SEQ ID NO: 4199866 - DNA, 17 bp, Homo sapiens
gtaaaagataacaagat

SEQ ID NO: 4199867 - DNA, 18 bp, Homo sapiens
gtaaaagcaaaaaagaaa

SEQ ID NO: 4199868 - DNA, 18 bp, Homo sapiens
gtaaaatgagtgatctca

SEQ ID NO: 4199869 - DNA, 21 bp, Homo sapiens
gtaaactcaaaacttaacata

SEQ ID NO: 4199870 - DNA, 13 bp, Homo sapiens
gtaaagattgttt

SEQ ID NO: 4199871 - DNA, 12 bp, Homo sapiens
gtaaaggaaata

SEQ ID NO: 4199872 - DNA, 23 bp, Homo sapiens
gtaaatattttaaagaattgtgt

SEQ ID NO: 4199873 - DNA, 22 bp, Homo sapiens
gtaaatcctttttctttataaa

SEQ ID NO: 4199874 - DNA, 10 bp, Homo sapiens
gtaaatgcct

SEQ ID NO: 4199875 - DNA, 19 bp, Homo sapiens
gtaaatggtatcatttgga

SEQ ID NO: 4199876 - DNA, 22 bp, Homo sapiens
gtaacacagctgagagactttt

SEQ ID NO: 4199877 - DNA, 22 bp, Homo sapiens
gtaacactggccttcccttctc

SEQ ID NO: 4199878 - DNA, 22 bp, Homo sapiens
gtaacatgtttacttttcaggg

SEQ ID NO: 4199879 - DNA, 14 bp, Homo sapiens
gtaactcagacatt

SEQ ID NO: 4199880 - DNA, 19 bp, Homo sapiens
gtaactgattacctgccaa

SEQ ID NO: 4199881 - DNA, 12 bp, Homo sapiens
gtaagaagaaag

SEQ ID NO: 4199882 - DNA, 18 bp, Homo sapiens
gtaataataatgaatgtc

SEQ ID NO: 4199883 - DNA, 15 bp, Homo sapiens
gtaatagaaaactga

SEQ ID NO: 4199884 - DNA, 14 bp, Homo sapiens
gtaatcccagcact

SEQ ID NO: 4199885 - DNA, 22 bp, Homo sapiens
gtaatcccagctacccaggagg

SEQ ID NO: 4199886 - DNA, 15 bp, Homo sapiens
gtaatgagggactgg

SEQ ID NO: 4199887 - DNA, 18 bp, Homo sapiens
gtaatgattatatgacaa

SEQ ID NO: 4199888 - DNA, 20 bp, Homo sapiens
gtaatgcttagagaatgttc

SEQ ID NO: 4199889 - DNA, 15 bp, Homo sapiens
gtaatgtaaatacat

SEQ ID NO: 4199890 - DNA, 16 bp, Homo sapiens
gtaattatatctgttt

SEQ ID NO: 4199891 - DNA, 18 bp, Homo sapiens
gtaattgtactaaagcca

SEQ ID NO: 4199892 - DNA, 13 bp, Homo sapiens
gtaatttattgtc

SEQ ID NO: 4199893 - DNA, 11 bp, Homo sapiens
gtaatttcact

SEQ ID NO: 4199894 - DNA, 19 bp, Homo sapiens
gtaatttttttgaaaaaag

SEQ ID NO: 4199895 - DNA, 21 bp, Homo sapiens
gtacaagaagcattttgtaag

SEQ ID NO: 4199896 - DNA, 19 bp, Homo sapiens
gtacaatacataactagtt

SEQ ID NO: 4199897 - DNA, 16 bp, Homo sapiens
gtacagtgtgtaaagt

SEQ ID NO: 4199898 - DNA, 19 bp, Homo sapiens
gtacagttcagttcctctt

SEQ ID NO: 4199899 - DNA, 22 bp, Homo sapiens
gtacagttcagttcctctttgc

SEQ ID NO: 4199900 - DNA, 23 bp, Homo sapiens
gtacagttcagttcctctttgca

SEQ ID NO: 4199901 - DNA, 14 bp, Homo sapiens
gtacatttccctgt

SEQ ID NO: 4199902 - DNA, 21 bp, Homo sapiens
gtaccaagaatcttggtttgc

SEQ ID NO: 4199903 - DNA, 14 bp, Homo sapiens
gtaccactcaggcc

SEQ ID NO: 4199904 - DNA, 13 bp, Homo sapiens
gtaccagccagga

SEQ ID NO: 4199905 - DNA, 24 bp, Homo sapiens
gtaccagccaggatcccaagcgtc

SEQ ID NO: 4199906 - DNA, 18 bp, Homo sapiens
gtacctccattggcttcc

SEQ ID NO: 4199907 - DNA, 14 bp, Homo sapiens
gtacggctgctgca

SEQ ID NO: 4199908 - DNA, 19 bp, Homo sapiens
gtactagaatttgtatttt

SEQ ID NO: 4199909 - DNA, 23 bp, Homo sapiens
gtagaaactttctataacctaaa

SEQ ID NO: 4199910 - DNA, 11 bp, Homo sapiens
gtagaagccag

SEQ ID NO: 4199911 - DNA, 21 bp, Homo sapiens
gtagaagtaatatgctctcat

SEQ ID NO: 4199912 - DNA, 18 bp, Homo sapiens
gtagaatgatttttgcta

SEQ ID NO: 4199913 - DNA, 19 bp, Homo sapiens
gtagacagccttccagtgg

SEQ ID NO: 4199914 - DNA, 22 bp, Homo sapiens
gtagactgagggattttagcct

SEQ ID NO: 4199915 - DNA, 20 bp, Homo sapiens
gtagagtttgaaggaggtga

SEQ ID NO: 4199916 - DNA, 21 bp, Homo sapiens
gtagcaagttctagagaagag

SEQ ID NO: 4199917 - DNA, 18 bp, Homo sapiens
gtagccaaggtgggctga

SEQ ID NO: 4199918 - DNA, 19 bp, Homo sapiens
gtagccaaggtgggctgag

SEQ ID NO: 4199919 - DNA, 22 bp, Homo sapiens
gtagccttgccttttaaaagaa

SEQ ID NO: 4199920 - DNA, 23 bp, Homo sapiens
gtagccttgccttttaaaagaaa

SEQ ID NO: 4199921 - DNA, 16 bp, Homo sapiens
gtagctcctctgctgc

SEQ ID NO: 4199922 - DNA, 18 bp, Homo sapiens
gtagctcctctgctgctc

SEQ ID NO: 4199923 - DNA, 18 bp, Homo sapiens
gtagctgagtgcactcct

SEQ ID NO: 4199924 - DNA, 17 bp, Homo sapiens
gtagctgggactacagg

SEQ ID NO: 4199925 - DNA, 14 bp, Homo sapiens
gtaggcagagcctt

SEQ ID NO: 4199926 - DNA, 15 bp, Homo sapiens
gtaggcagagccttt

SEQ ID NO: 4199927 - DNA, 11 bp, Homo sapiens
gtaggctgtgg

SEQ ID NO: 4199928 - DNA, 19 bp, Homo sapiens
gtaggctgtggggtctggc

SEQ ID NO: 4199929 - DNA, 20 bp, Homo sapiens
gtaggctgtggggtctggct

SEQ ID NO: 4199930 - DNA, 20 bp, Homo sapiens
gtaggggtcaaagaaatgct

SEQ ID NO: 4199931 - DNA, 23 bp, Homo sapiens
gtaggggttaacttggtcagagc

SEQ ID NO: 4199932 - DNA, 14 bp, Homo sapiens
gtagtaatttattg

SEQ ID NO: 4199933 - DNA, 22 bp, Homo sapiens
gtctgggcaatgaaaccaaagc

SEQ ID NO: 4199934 - DNA, 19 bp, Homo sapiens
gtctggtgtagctcctctg

SEQ ID NO: 4199935 - DNA, 16 bp, Homo sapiens
gtctggttttaacaat

SEQ ID NO: 4199936 - DNA, 12 bp, Homo sapiens
gtctgtgtatgt

SEQ ID NO: 4199937 - DNA, 20 bp, Homo sapiens
gtctgtgtgatgaactttct

SEQ ID NO: 4199938 - DNA, 15 bp, Homo sapiens
gtcttcaattaaaag

SEQ ID NO: 4199939 - DNA, 17 bp, Homo sapiens
gtcttcttgtgtcctga

SEQ ID NO: 4199940 - DNA, 13 bp, Homo sapiens
gtcttgctttgct

SEQ ID NO: 4199941 - DNA, 15 bp, Homo sapiens
gtcttggtattctta

SEQ ID NO: 4199942 - DNA, 19 bp, Homo sapiens
gtcttggtggatgggccct

SEQ ID NO: 4199943 - DNA, 23 bp, Homo sapiens
gtcttggtggatgggccctgcaa

SEQ ID NO: 4199944 - DNA, 21 bp, Homo sapiens
gtctttcaggaccttttgaag

SEQ ID NO: 4199945 - DNA, 21 bp, Homo sapiens
gtcttttctccctagaaacaa

SEQ ID NO: 4199946 - DNA, 16 bp, Homo sapiens
gtctttttagatgccc

SEQ ID NO: 4199947 - DNA, 15 bp, Homo sapiens
gtgaatatatggtct

SEQ ID NO: 4199948 - DNA, 23 bp, Homo sapiens
gtgaattgcctgcagagagaagc

SEQ ID NO: 4199949 - DNA, 21 bp, Homo sapiens
gtgacaacatgtggaaagcct

SEQ ID NO: 4199950 - DNA, 14 bp, Homo sapiens
gtgaccaggggtga

SEQ ID NO: 4199951 - DNA, 15 bp, Homo sapiens
gtgacccatctgtag

SEQ ID NO: 4199952 - DNA, 21 bp, Homo sapiens
gtgaccctctgaatggtccag

SEQ ID NO: 4199953 - DNA, 23 bp, Homo sapiens
gtgacctgccccgcccagctgca

SEQ ID NO: 4199954 - DNA, 13 bp, Homo sapiens
gtgacggtcccac

SEQ ID NO: 4199955 - DNA, 15 bp, Homo sapiens
gtgacggtcccacac

SEQ ID NO: 4199956 - DNA, 19 bp, Homo sapiens
gtgactattttttaataaa

SEQ ID NO: 4199957 - DNA, 17 bp, Homo sapiens
gtgactgcgatcttcag

SEQ ID NO: 4199958 - DNA, 22 bp, Homo sapiens
gtgagaacctgggttgcagaca

SEQ ID NO: 4199959 - DNA, 12 bp, Homo sapiens
gtgagctcagct

SEQ ID NO: 4199960 - DNA, 15 bp, Homo sapiens
gtgaggcccagcctg

SEQ ID NO: 4199961 - DNA, 16 bp, Homo sapiens
gtgaggcccagcctgt

SEQ ID NO: 4199962 - DNA, 11 bp, Homo sapiens
gtgaggcctgg

SEQ ID NO: 4199963 - DNA, 12 bp, Homo sapiens
gtgagggctggg

SEQ ID NO: 4199964 - DNA, 19 bp, Homo sapiens
gtgatcctcaaacacacaa

SEQ ID NO: 4199965 - DNA, 18 bp, Homo sapiens
gtgatctcaaatccactg

SEQ ID NO: 4199966 - DNA, 23 bp, Homo sapiens
gtgatggagtgtgcgtgtgtgca

SEQ ID NO: 4199967 - DNA, 15 bp, Homo sapiens
gtgatgttcatgggt

SEQ ID NO: 4199968 - DNA, 14 bp, Homo sapiens
gtgatttttttgtc

SEQ ID NO: 4199969 - DNA, 13 bp, Homo sapiens
gtgcaaaaataaa

SEQ ID NO: 4199970 - DNA, 20 bp, Homo sapiens
gtgcaatgtaaatattttaa

SEQ ID NO: 4199971 - DNA, 18 bp, Homo sapiens
gtgcacctgtactcagga

SEQ ID NO: 4199972 - DNA, 17 bp, Homo sapiens
gtgcactggccccaccc

SEQ ID NO: 4199973 - DNA, 23 bp, Homo sapiens
gtgcagggaggaggtggcagccc

SEQ ID NO: 4199974 - DNA, 15 bp, Homo sapiens
gtgcagttgacagca

SEQ ID NO: 4199975 - DNA, 20 bp, Homo sapiens
gtgcagttgacagcaggtgg

SEQ ID NO: 4199976 - DNA, 19 bp, Homo sapiens
gtgcatcccccagcactga

SEQ ID NO: 4199977 - DNA, 18 bp, Homo sapiens
gtgccaatgtgacaacat

SEQ ID NO: 4199978 - DNA, 10 bp, Homo sapiens
gtgccacaga

SEQ ID NO: 4199979 - DNA, 12 bp, Homo sapiens
gtgccacagaga

SEQ ID NO: 4199980 - DNA, 13 bp, Homo sapiens
gtgccacagagaa

SEQ ID NO: 4199981 - DNA, 13 bp, Homo sapiens
gtgccactgcggg

SEQ ID NO: 4199982 - DNA, 23 bp, Homo sapiens
gtgccatagagtttaacacaagt

SEQ ID NO: 4199983 - DNA, 15 bp, Homo sapiens
gtgccccccatgccc

SEQ ID NO: 4199984 - DNA, 16 bp, Homo sapiens
gtgcccctcctgcccc

SEQ ID NO: 4199985 - DNA, 18 bp, Homo sapiens
gtgcctggcgcccctgcc

SEQ ID NO: 4199986 - DNA, 13 bp, Homo sapiens
gtgcctggcttgc

SEQ ID NO: 4199987 - DNA, 14 bp, Homo sapiens
gtgcctggcttgct

SEQ ID NO: 4199988 - DNA, 23 bp, Homo sapiens
gtgcctggcttgctgtggctatg

SEQ ID NO: 4199989 - DNA, 13 bp, Homo sapiens
gtgcctttctctg

SEQ ID NO: 4199990 - DNA, 23 bp, Homo sapiens
gtgcctttctctggctccagaat

SEQ ID NO: 4199991 - DNA, 18 bp, Homo sapiens
gtgctactccatgcaggg

SEQ ID NO: 4199992 - DNA, 16 bp, Homo sapiens
gtgctataggctggag

SEQ ID NO: 4199993 - DNA, 14 bp, Homo sapiens
gtgctatggtgctc

SEQ ID NO: 4199994 - DNA, 18 bp, Homo sapiens
gtgctcacgactcttcct

SEQ ID NO: 4199995 - DNA, 13 bp, Homo sapiens
gtgctcctgtccc

SEQ ID NO: 4199996 - DNA, 14 bp, Homo sapiens
gtgctcctgtccct

SEQ ID NO: 4199997 - DNA, 20 bp, Homo sapiens
gtgctcctgtccctccctcc

SEQ ID NO: 4199998 - DNA, 15 bp, Homo sapiens
gtgctgacctctggt

SEQ ID NO: 4199999 - DNA, 11 bp, Homo sapiens
gtgctgccctg

SEQ ID NO: 4200000 - DNA, 20 bp, Homo sapiens
gtgctgggattacaggtgta

SEQ ID NO: 4200001 - DNA, 19 bp, Homo sapiens
gtgctgtaacctgaagtca

SEQ ID NO: 4200002 - DNA, 18 bp, Homo sapiens
gtgctgtggccagggtga

SEQ ID NO: 4200003 - DNA, 16 bp, Homo sapiens
gtgcttatggtaccag

SEQ ID NO: 4200004 - DNA, 21 bp, Homo sapiens
gtgcttccctaggctgagctg

SEQ ID NO: 4200005 - DNA, 21 bp, Homo sapiens
gtgcttgggtggtgggtgctg

SEQ ID NO: 4200006 - DNA, 14 bp, Homo sapiens
gtgctttcaggtct

SEQ ID NO: 4200007 - DNA, 18 bp, Homo sapiens
gtggaaaaatcagaagca

SEQ ID NO: 4200008 - DNA, 18 bp, Homo sapiens
gtggaaggcagggacaga

SEQ ID NO: 4200009 - DNA, 12 bp, Homo sapiens
gtggacacctgc

SEQ ID NO: 4200010 - DNA, 17 bp, Homo sapiens
gtggagacagccctgcc

SEQ ID NO: 4200011 - DNA, 21 bp, Homo sapiens
gtggaggggtgacagtggagg

SEQ ID NO: 4200012 - DNA, 17 bp, Homo sapiens
gtggaggttgcagtgag

SEQ ID NO: 4200013 - DNA, 18 bp, Homo sapiens
gtggatctgtccaaggaa

SEQ ID NO: 4200014 - DNA, 17 bp, Homo sapiens
gtggatgctagtgctgt

SEQ ID NO: 4200015 - DNA, 22 bp, Homo sapiens
gtggatggcccagcaggcaggc

SEQ ID NO: 4200016 - DNA, 14 bp, Homo sapiens
gtggcagccctgta

SEQ ID NO: 4200017 - DNA, 17 bp, Homo sapiens
gtggcaggaccaggact

SEQ ID NO: 4200018 - DNA, 14 bp, Homo sapiens
gtggccaagcctgg

SEQ ID NO: 4200019 - DNA, 18 bp, Homo sapiens
gtggccaagcctggccct

SEQ ID NO: 4200020 - DNA, 22 bp, Homo sapiens
gtggcccagtcgtccgctcagc

SEQ ID NO: 4200021 - DNA, 14 bp, Homo sapiens
gtggcctgggcaag

SEQ ID NO: 4200022 - DNA, 23 bp, Homo sapiens
gtggctcacgcctgtaatcccag

SEQ ID NO: 4200023 - DNA, 12 bp, Homo sapiens
gtgggaagagaa

SEQ ID NO: 4200024 - DNA, 14 bp, Homo sapiens
gtgggaagagaagg

SEQ ID NO: 4200025 - DNA, 15 bp, Homo sapiens
gtgggagagcccagc

SEQ ID NO: 4200026 - DNA, 12 bp, Homo sapiens
gtgggagctcag

SEQ ID NO: 4200027 - DNA, 17 bp, Homo sapiens
gtgggccactctcccct

SEQ ID NO: 4200028 - DNA, 12 bp, Homo sapiens
gtgggcggggag

SEQ ID NO: 4200029 - DNA, 14 bp, Homo sapiens
gtgggctccctggc

SEQ ID NO: 4200030 - DNA, 16 bp, Homo sapiens
gtgggctgagccctgg

SEQ ID NO: 4200031 - DNA, 16 bp, Homo sapiens
gtgggtatttcctgct

SEQ ID NO: 4200032 - DNA, 12 bp, Homo sapiens
gtgggtggtgga

SEQ ID NO: 4200033 - DNA, 18 bp, Homo sapiens
gtggtaacttctttgaag

SEQ ID NO: 4200034 - DNA, 24 bp, Homo sapiens
gtggtcttggaagtgtgtggaagg

SEQ ID NO: 4200035 - DNA, 14 bp, Homo sapiens
gtggtgaggtcctg

SEQ ID NO: 4200036 - DNA, 18 bp, Homo sapiens
gtggtgtcaccagcctgt

SEQ ID NO: 4200037 - DNA, 20 bp, Homo sapiens
gtggtgtttgtaggctgtgg

SEQ ID NO: 4200038 - DNA, 17 bp, Homo sapiens
gtgtagccttgcccgga

SEQ ID NO: 4200039 - DNA, 14 bp, Homo sapiens
gtgtagctcctctg

SEQ ID NO: 4200040 - DNA, 22 bp, Homo sapiens
gtgtatcccccccctgtatagt

SEQ ID NO: 4200041 - DNA, 18 bp, Homo sapiens
gtgtcaccctgcagagct

SEQ ID NO: 4200042 - DNA, 19 bp, Homo sapiens
gtgtcctctccctgccaag

SEQ ID NO: 4200043 - DNA, 15 bp, Homo sapiens
gtgtcgtagccaagg

SEQ ID NO: 4200044 - DNA, 21 bp, Homo sapiens
gtgtctgcacccaggggtggg

SEQ ID NO: 4200045 - DNA, 15 bp, Homo sapiens
gtgtctgggagagcc

SEQ ID NO: 4200046 - DNA, 20 bp, Homo sapiens
gtgtctgggagagcctggca

SEQ ID NO: 4200047 - DNA, 19 bp, Homo sapiens
gtgtgatcccaagtgccag

SEQ ID NO: 4200048 - DNA, 22 bp, Homo sapiens
gtgtgatgaactttctcttcat

SEQ ID NO: 4200049 - DNA, 22 bp, Homo sapiens
gtgtgcaccttaccaactttct

SEQ ID NO: 4200050 - DNA, 17 bp, Homo sapiens
gtgtgcctgccctggag

SEQ ID NO: 4200051 - DNA, 15 bp, Homo sapiens
gtgtgcgtgtgtgca

SEQ ID NO: 4200052 - DNA, 11 bp, Homo sapiens
gtgtgctgtaa

SEQ ID NO: 4200053 - DNA, 18 bp, Homo sapiens
gtgtgctgtgctgtgtct

SEQ ID NO: 4200054 - DNA, 12 bp, Homo sapiens
gtgtggagaagg

SEQ ID NO: 4200055 - DNA, 23 bp, Homo sapiens
gtgtggtgggttctttggaagga

SEQ ID NO: 4200056 - DNA, 22 bp, Homo sapiens
gtgtggtgtttgtaggctgtgg

SEQ ID NO: 4200057 - DNA, 14 bp, Homo sapiens
gtgtgtagccaagg

SEQ ID NO: 4200058 - DNA, 18 bp, Homo sapiens
gtgtgtggtgtgtgtgct

SEQ ID NO: 4200059 - DNA, 12 bp, Homo sapiens
gagagcagctgg

SEQ ID NO: 4200060 - DNA, 13 bp, Homo sapiens
gagagcagctggc

SEQ ID NO: 4200061 - DNA, 17 bp, Homo sapiens
gagagccagctctctct

SEQ ID NO: 4200062 - DNA, 22 bp, Homo sapiens
gagagcctagaacatccctggg

SEQ ID NO: 4200063 - DNA, 11 bp, Homo sapiens
gagagcctggc

SEQ ID NO: 4200064 - DNA, 14 bp, Homo sapiens
gagagcgcctcttc

SEQ ID NO: 4200065 - DNA, 16 bp, Homo sapiens
gagaggcgcgtctgcc

SEQ ID NO: 4200066 - DNA, 19 bp, Homo sapiens
gagaggcgcgtctgcccca

SEQ ID NO: 4200067 - DNA, 20 bp, Homo sapiens
gagaggtttgtcaacacaaa

SEQ ID NO: 4200068 - DNA, 16 bp, Homo sapiens
gagagtacagtgagcc

SEQ ID NO: 4200069 - DNA, 11 bp, Homo sapiens
gagagtaccat

SEQ ID NO: 4200070 - DNA, 14 bp, Homo sapiens
gagagtaccatgct

SEQ ID NO: 4200071 - DNA, 18 bp, Homo sapiens
gagagtctaagataaaag

SEQ ID NO: 4200072 - DNA, 19 bp, Homo sapiens
gagatattgggacacacat

SEQ ID NO: 4200073 - DNA, 19 bp, Homo sapiens
gagatcagcagtggcagga

SEQ ID NO: 4200074 - DNA, 14 bp, Homo sapiens
gagatccagcacaa

SEQ ID NO: 4200075 - DNA, 16 bp, Homo sapiens
gagatgactgagtcct

SEQ ID NO: 4200076 - DNA, 14 bp, Homo sapiens
gagatgatgatgat

SEQ ID NO: 4200077 - DNA, 17 bp, Homo sapiens
gagatgatgatgatgat

SEQ ID NO: 4200078 - DNA, 16 bp, Homo sapiens
gagatgcagaggtaaa

SEQ ID NO: 4200079 - DNA, 20 bp, Homo sapiens
gagatgcatgcgcaggctca

SEQ ID NO: 4200080 - DNA, 16 bp, Homo sapiens
gagatgtaattgtttt

SEQ ID NO: 4200081 - DNA, 21 bp, Homo sapiens
gagattgcaccactgcactcc

SEQ ID NO: 4200082 - DNA, 13 bp, Homo sapiens
gagcaactctcca

SEQ ID NO: 4200083 - DNA, 16 bp, Homo sapiens
gagcaactctccactc

SEQ ID NO: 4200084 - DNA, 14 bp, Homo sapiens
gagcaagaaggaaa

SEQ ID NO: 4200085 - DNA, 13 bp, Homo sapiens
gagcaagagctgg

SEQ ID NO: 4200086 - DNA, 15 bp, Homo sapiens
gagcacagcccacgg

SEQ ID NO: 4200087 - DNA, 12 bp, Homo sapiens
gagcacctgctt

SEQ ID NO: 4200088 - DNA, 13 bp, Homo sapiens
gagcagaggcagc

SEQ ID NO: 4200089 - DNA, 13 bp, Homo sapiens
gagcagcccagca

SEQ ID NO: 4200090 - DNA, 14 bp, Homo sapiens
gagcagctggctct

SEQ ID NO: 4200091 - DNA, 15 bp, Homo sapiens
gagcagcttcagttg

SEQ ID NO: 4200092 - DNA, 11 bp, Homo sapiens
gagcaggagca

SEQ ID NO: 4200093 - DNA, 15 bp, Homo sapiens
gagcaggctcagact

SEQ ID NO: 4200094 - DNA, 16 bp, Homo sapiens
gagcaggggcagggtg

SEQ ID NO: 4200095 - DNA, 20 bp, Homo sapiens
gagcaggggtccttggtgtg

SEQ ID NO: 4200096 - DNA, 21 bp, Homo sapiens
gagcatggggataaaggagaa

SEQ ID NO: 4200097 - DNA, 22 bp, Homo sapiens
gagcatggggataaaggagaag

SEQ ID NO: 4200098 - DNA, 21 bp, Homo sapiens
gagcattacgtgagccaggta

SEQ ID NO: 4200099 - DNA, 14 bp, Homo sapiens
gagccaaggcagag

SEQ ID NO: 4200100 - DNA, 19 bp, Homo sapiens
gagccaggtaatgagggac

SEQ ID NO: 4200101 - DNA, 23 bp, Homo sapiens
gagcccacgcccgactagcaggc

SEQ ID NO: 4200102 - DNA, 20 bp, Homo sapiens
gagccccccgtgtggcttac

SEQ ID NO: 4200103 - DNA, 20 bp, Homo sapiens
gagcccgcttcaagctctct

SEQ ID NO: 4200104 - DNA, 22 bp, Homo sapiens
gagcccgcttcaagctctctgt

SEQ ID NO: 4200105 - DNA, 15 bp, Homo sapiens
gagccgggccccgga

SEQ ID NO: 4200106 - DNA, 19 bp, Homo sapiens
gagccggggcactttcaga

SEQ ID NO: 4200107 - DNA, 16 bp, Homo sapiens
taaaactgctttgtat

SEQ ID NO: 4200108 - DNA, 15 bp, Homo sapiens
taaaactttgaagtt

SEQ ID NO: 4200109 - DNA, 21 bp, Homo sapiens
taagtagatagaaagcaataa

SEQ ID NO: 4200110 - DNA, 17 bp, Homo sapiens
taagtatttacagatgt

SEQ ID NO: 4200111 - DNA, 12 bp, Homo sapiens
taagtatttcca

SEQ ID NO: 4200112 - DNA, 20 bp, Homo sapiens
ccaaagagcctggagaagct

SEQ ID NO: 4200113 - DNA, 14 bp, Homo sapiens
ccaaagataatgtt

SEQ ID NO: 4200114 - DNA, 21 bp, Homo sapiens
ccaaagatatatacacaggat

SEQ ID NO: 4200115 - DNA, 12 bp, Homo sapiens
ccaaaggaatcg

SEQ ID NO: 4200116 - DNA, 23 bp, Homo sapiens
ccaaagtgccactcattcctgta

SEQ ID NO: 4200117 - DNA, 17 bp, Homo sapiens
ccaaatccacaagccat

SEQ ID NO: 4200118 - DNA, 22 bp, Homo sapiens
ccaaatgcatggtgcagttgac

SEQ ID NO: 4200119 - DNA, 11 bp, Homo sapiens
ccaaattattt

SEQ ID NO: 4200120 - DNA, 14 bp, Homo sapiens
ccaaattatttgtg

SEQ ID NO: 4200121 - DNA, 13 bp, Homo sapiens
ccaaattgggaga

SEQ ID NO: 4200122 - DNA, 16 bp, Homo sapiens
ccaacagcccccccct

SEQ ID NO: 4200123 - DNA, 15 bp, Homo sapiens
ccaacaggtggcagg

SEQ ID NO: 4200124 - DNA, 18 bp, Homo sapiens
ccaacaggtggcaggacc

SEQ ID NO: 4200125 - DNA, 12 bp, Homo sapiens
ccaacagtgagt

SEQ ID NO: 4200126 - DNA, 14 bp, Homo sapiens
ccaaccacaaacca

SEQ ID NO: 4200127 - DNA, 14 bp, Homo sapiens
ccaacctcctgacc

SEQ ID NO: 4200128 - DNA, 13 bp, Homo sapiens
ccaactaaataaa

SEQ ID NO: 4200129 - DNA, 17 bp, Homo sapiens
ccaacttggctgcagga

SEQ ID NO: 4200130 - DNA, 14 bp, Homo sapiens
ccaacttggctttc

SEQ ID NO: 4200131 - DNA, 20 bp, Homo sapiens
ccaactttctcactgctgtc

SEQ ID NO: 4200132 - DNA, 22 bp, Homo sapiens
ccaactttctcactgctgtcag

SEQ ID NO: 4200133 - DNA, 17 bp, Homo sapiens
ccaactttctgtaaact

SEQ ID NO: 4200134 - DNA, 18 bp, Homo sapiens
ccaagcacttctttttct

SEQ ID NO: 4200135 - DNA, 18 bp, Homo sapiens
ccaagcgggggcgtggct

SEQ ID NO: 4200136 - DNA, 22 bp, Homo sapiens
ccaagcgggggcgtggctggcc

SEQ ID NO: 4200137 - DNA, 15 bp, Homo sapiens
ccaagcgtcccgtcc

SEQ ID NO: 4200138 - DNA, 23 bp, Homo sapiens
ccaagctgagcaacctcttcagc

SEQ ID NO: 4200139 - DNA, 23 bp, Homo sapiens
ccaaggagtcagatggcaatggg

SEQ ID NO: 4200140 - DNA, 13 bp, Homo sapiens
ccaaggcagaggg

SEQ ID NO: 4200141 - DNA, 17 bp, Homo sapiens
ccaaggcagaggggagc

SEQ ID NO: 4200142 - DNA, 15 bp, Homo sapiens
ccaaggtgctctgtg

SEQ ID NO: 4200143 - DNA, 17 bp, Homo sapiens
ccaaggtgctctgtgtc

SEQ ID NO: 4200144 - DNA, 22 bp, Homo sapiens
ccaagtagaatctcagttgatt

SEQ ID NO: 4200145 - DNA, 18 bp, Homo sapiens
ccaagtccaacctgcctg

SEQ ID NO: 4200146 - DNA, 19 bp, Homo sapiens
ccaagtccaacctgcctgt

SEQ ID NO: 4200147 - DNA, 16 bp, Homo sapiens
ccaagtccacctgcct

SEQ ID NO: 4200148 - DNA, 21 bp, Homo sapiens
ccaagttcctgcactccagaa

SEQ ID NO: 4200149 - DNA, 22 bp, Homo sapiens
ccaatattggagcatatcaaaa

SEQ ID NO: 4200150 - DNA, 15 bp, Homo sapiens
ccaatcagagagcct

SEQ ID NO: 4200151 - DNA, 16 bp, Homo sapiens
ccaatcagagagccta

SEQ ID NO: 4200152 - DNA, 18 bp, Homo sapiens
ccaatctgtaatttcact

SEQ ID NO: 4200153 - DNA, 18 bp, Homo sapiens
ccaatgcttttatcaaac

SEQ ID NO: 4200154 - DNA, 14 bp, Homo sapiens
ccaatttatgcaga

SEQ ID NO: 4200155 - DNA, 22 bp, Homo sapiens
ccacaaaatagagattaatttt

SEQ ID NO: 4200156 - DNA, 14 bp, Homo sapiens
ccacaaactgtaat

SEQ ID NO: 4200157 - DNA, 12 bp, Homo sapiens
ccacaaatatga

SEQ ID NO: 4200158 - DNA, 16 bp, Homo sapiens
ccacaagaaatttgat

SEQ ID NO: 4200159 - DNA, 15 bp, Homo sapiens
ccacaagcctgagaa

SEQ ID NO: 4200160 - DNA, 16 bp, Homo sapiens
ccacaagccttactca

SEQ ID NO: 4200161 - DNA, 22 bp, Homo sapiens
ccacaagccttactcacctctc

SEQ ID NO: 4200162 - DNA, 21 bp, Homo sapiens
ccacaatctggcttagtgcca

SEQ ID NO: 4200163 - DNA, 20 bp, Homo sapiens
ccacaccaatcagagagcct

SEQ ID NO: 4200164 - DNA, 14 bp, Homo sapiens
ccacaccgcagaag

SEQ ID NO: 4200165 - DNA, 13 bp, Homo sapiens
ccacactccccgc

SEQ ID NO: 4200166 - DNA, 14 bp, Homo sapiens
ccacactggtgact

SEQ ID NO: 4200167 - DNA, 21 bp, Homo sapiens
ccacacttcttgaaacagcct

SEQ ID NO: 4200168 - DNA, 22 bp, Homo sapiens
ccacacttcttgaaacagcctg

SEQ ID NO: 4200169 - DNA, 23 bp, Homo sapiens
ccacacttcttgaaacagcctgg

SEQ ID NO: 4200170 - DNA, 14 bp, Homo sapiens
ccacagagatgcat

SEQ ID NO: 4200171 - DNA, 15 bp, Homo sapiens
ccacagagcctggct

SEQ ID NO: 4200172 - DNA, 13 bp, Homo sapiens
ccacagatgtgtc

SEQ ID NO: 4200173 - DNA, 22 bp, Homo sapiens
ccacagatgtgtctgggagagc

SEQ ID NO: 4200174 - DNA, 17 bp, Homo sapiens
ccacagcaattggctcc

SEQ ID NO: 4200175 - DNA, 12 bp, Homo sapiens
ccacagccgcag

SEQ ID NO: 4200176 - DNA, 15 bp, Homo sapiens
ccacagccgcagcct

SEQ ID NO: 4200177 - DNA, 16 bp, Homo sapiens
ccacagggaaccctgc

SEQ ID NO: 4200178 - DNA, 14 bp, Homo sapiens
ccacagtcaaagaa

SEQ ID NO: 4200179 - DNA, 19 bp, Homo sapiens
actgcactccagcctgggc

SEQ ID NO: 4200180 - DNA, 21 bp, Homo sapiens
actgcactccagcctgggcga

SEQ ID NO: 4200181 - DNA, 17 bp, Homo sapiens
actgcacttagtagcta

SEQ ID NO: 4200182 - DNA, 15 bp, Homo sapiens
actgcagggctgctg

SEQ ID NO: 4200183 - DNA, 16 bp, Homo sapiens
actgcagggctgctgt

SEQ ID NO: 4200184 - DNA, 22 bp, Homo sapiens
actgcagggctgctgtggccca

SEQ ID NO: 4200185 - DNA, 15 bp, Homo sapiens
actgccccatctcct

SEQ ID NO: 4200186 - DNA, 22 bp, Homo sapiens
actgcccctgcacctgcttctc

SEQ ID NO: 4200187 - DNA, 20 bp, Homo sapiens
actgcgggatggtcctgggg

SEQ ID NO: 4200188 - DNA, 20 bp, Homo sapiens
actgctaggcgagtgccagg

SEQ ID NO: 4200189 - DNA, 18 bp, Homo sapiens
actgctgagatacataca

SEQ ID NO: 4200190 - DNA, 19 bp, Homo sapiens
actgctgagatacatacag

SEQ ID NO: 4200191 - DNA, 22 bp, Homo sapiens
actgctgagatacatacagaat

SEQ ID NO: 4200192 - DNA, 14 bp, Homo sapiens
actgctgtcagcca

SEQ ID NO: 4200193 - DNA, 18 bp, Homo sapiens
actgcttggagctgagca

SEQ ID NO: 4200194 - DNA, 22 bp, Homo sapiens
actggaacactagacaagccag

SEQ ID NO: 4200195 - DNA, 15 bp, Homo sapiens
actggaaccagggag

SEQ ID NO: 4200196 - DNA, 13 bp, Homo sapiens
actggaagaaagc

SEQ ID NO: 4200197 - DNA, 14 bp, Homo sapiens
actggaagaaagca

SEQ ID NO: 4200198 - DNA, 15 bp, Homo sapiens
actggaagaaagcaa

SEQ ID NO: 4200199 - DNA, 21 bp, Homo sapiens
actggagacttggaagagttg

SEQ ID NO: 4200200 - DNA, 13 bp, Homo sapiens
actggagcactga

SEQ ID NO: 4200201 - DNA, 12 bp, Homo sapiens
actggagcccag

SEQ ID NO: 4200202 - DNA, 14 bp, Homo sapiens
actggaggtcacat

SEQ ID NO: 4200203 - DNA, 12 bp, Homo sapiens
actggcagagca

SEQ ID NO: 4200204 - DNA, 13 bp, Homo sapiens
actggcagagcac

SEQ ID NO: 4200205 - DNA, 21 bp, Homo sapiens
actggcaggcaggctcccagg

SEQ ID NO: 4200206 - DNA, 17 bp, Homo sapiens
actggcctcaaagcaag

SEQ ID NO: 4200207 - DNA, 22 bp, Homo sapiens
actggcctcaaagcaagcattc

SEQ ID NO: 4200208 - DNA, 15 bp, Homo sapiens
actggcgcagacttc

SEQ ID NO: 4200209 - DNA, 21 bp, Homo sapiens
actggctcctttgcctctgct

SEQ ID NO: 4200210 - DNA, 23 bp, Homo sapiens
actggctcctttgcctctgctac

SEQ ID NO: 4200211 - DNA, 17 bp, Homo sapiens
actgggagaagagaacc

SEQ ID NO: 4200212 - DNA, 21 bp, Homo sapiens
actgggagaagagaacctcaa

SEQ ID NO: 4200213 - DNA, 23 bp, Homo sapiens
actggggagttataaaaatacaa

SEQ ID NO: 4200214 - DNA, 19 bp, Homo sapiens
actgggttttgtctctgca

SEQ ID NO: 4200215 - DNA, 22 bp, Homo sapiens
actgggttttgtctctgcatct

SEQ ID NO: 4200216 - DNA, 21 bp, Homo sapiens
actggtgactgcgatcttcag

SEQ ID NO: 4200217 - DNA, 13 bp, Homo sapiens
actggtgatttct

SEQ ID NO: 4200218 - DNA, 23 bp, Homo sapiens
actggtgctataggctggagaag

SEQ ID NO: 4200219 - DNA, 16 bp, Homo sapiens
actgtaactgattaca

SEQ ID NO: 4200220 - DNA, 16 bp, Homo sapiens
actgtagtttaatact

SEQ ID NO: 4200221 - DNA, 22 bp, Homo sapiens
actgtatctaggcaacatagta

SEQ ID NO: 4200222 - DNA, 19 bp, Homo sapiens
actgtcccggagctcaggc

SEQ ID NO: 4200223 - DNA, 23 bp, Homo sapiens
actgtcccggagctcaggccctg

SEQ ID NO: 4200224 - DNA, 15 bp, Homo sapiens
actgtccgcctctgc

SEQ ID NO: 4200225 - DNA, 13 bp, Homo sapiens
actgtctggtttt

SEQ ID NO: 4200226 - DNA, 17 bp, Homo sapiens
actgtctggttttaaca

SEQ ID NO: 4200227 - DNA, 19 bp, Homo sapiens
actgtctggttttaacaat

SEQ ID NO: 4200228 - DNA, 17 bp, Homo sapiens
actgtgccctgccttca

SEQ ID NO: 4200229 - DNA, 20 bp, Homo sapiens
actgtggcccttctgtccac

SEQ ID NO: 4200230 - DNA, 23 bp, Homo sapiens
actgtggcccttctgtccaccag

SEQ ID NO: 4200231 - DNA, 12 bp, Homo sapiens
actgtgtgaaga

SEQ ID NO: 4200232 - DNA, 13 bp, Homo sapiens
actgttactttgg

SEQ ID NO: 4200233 - DNA, 17 bp, Homo sapiens
actgttactttggcaat

SEQ ID NO: 4200234 - DNA, 21 bp, Homo sapiens
actgttactttggcaatttcc

SEQ ID NO: 4200235 - DNA, 15 bp, Homo sapiens
acttaaatgttaatg

SEQ ID NO: 4200236 - DNA, 14 bp, Homo sapiens
acttaaattttaag

SEQ ID NO: 4200237 - DNA, 14 bp, Homo sapiens
acttaacatattta

SEQ ID NO: 4200238 - DNA, 17 bp, Homo sapiens
acttaataaattcagat

SEQ ID NO: 4200239 - DNA, 21 bp, Homo sapiens
acttaccaggcaccaaaagaa

SEQ ID NO: 4200240 - DNA, 15 bp, Homo sapiens
acttactgtttctta

SEQ ID NO: 4200241 - DNA, 17 bp, Homo sapiens
acttactttaatgcgaa

SEQ ID NO: 4200242 - DNA, 16 bp, Homo sapiens
acttagaataaaattg

SEQ ID NO: 4200243 - DNA, 13 bp, Homo sapiens
acttagctggaga

SEQ ID NO: 4200244 - DNA, 20 bp, Homo sapiens
acttataagtgggagctaaa

SEQ ID NO: 4200245 - DNA, 14 bp, Homo sapiens
acttatcttctgga

SEQ ID NO: 4200246 - DNA, 21 bp, Homo sapiens
acttattaacaattaggcaga

SEQ ID NO: 4200247 - DNA, 14 bp, Homo sapiens
ccattcccaagcca

SEQ ID NO: 4200248 - DNA, 22 bp, Homo sapiens
ccattctgaaaatagcaggaca

SEQ ID NO: 4200249 - DNA, 12 bp, Homo sapiens
ccattggcttcc

SEQ ID NO: 4200250 - DNA, 11 bp, Homo sapiens
ccattgggacc

SEQ ID NO: 4200251 - DNA, 18 bp, Homo sapiens
ccattgtactccagcctg

SEQ ID NO: 4200252 - DNA, 12 bp, Homo sapiens
ccatttcaaatg

SEQ ID NO: 4200253 - DNA, 15 bp, Homo sapiens
ccatttcaactccag

SEQ ID NO: 4200254 - DNA, 19 bp, Homo sapiens
ccatttctgaactgttaca

SEQ ID NO: 4200255 - DNA, 20 bp, Homo sapiens
ccatttctgaactgttacaa

SEQ ID NO: 4200256 - DNA, 17 bp, Homo sapiens
cccaaagcccagctctt

SEQ ID NO: 4200257 - DNA, 22 bp, Homo sapiens
cccaaagtggggggtggacaca

SEQ ID NO: 4200258 - DNA, 18 bp, Homo sapiens
cccaacacttttgggagg

SEQ ID NO: 4200259 - DNA, 20 bp, Homo sapiens
cccaacctcccctggtcctg

SEQ ID NO: 4200260 - DNA, 13 bp, Homo sapiens
cccaactgctctg

SEQ ID NO: 4200261 - DNA, 16 bp, Homo sapiens
cccaactgctctgccc

SEQ ID NO: 4200262 - DNA, 20 bp, Homo sapiens
cccaactttctcactgctgt

SEQ ID NO: 4200263 - DNA, 23 bp, Homo sapiens
cccaagagctacgtatttaatag

SEQ ID NO: 4200264 - DNA, 15 bp, Homo sapiens
cccaagtgccagtct

SEQ ID NO: 4200265 - DNA, 17 bp, Homo sapiens
cccaatgctcctggagg

SEQ ID NO: 4200266 - DNA, 20 bp, Homo sapiens
cccacaagccttactcacct

SEQ ID NO: 4200267 - DNA, 21 bp, Homo sapiens
cccacacatgtttacagaact

SEQ ID NO: 4200268 - DNA, 20 bp, Homo sapiens
cccacagagatgcatgcgca

SEQ ID NO: 4200269 - DNA, 15 bp, Homo sapiens
cccacagagcctggc

SEQ ID NO: 4200270 - DNA, 20 bp, Homo sapiens
cccacagcctttgcttccag

SEQ ID NO: 4200271 - DNA, 14 bp, Homo sapiens
cccacattggaccc

SEQ ID NO: 4200272 - DNA, 22 bp, Homo sapiens
cccaccaccttggactcctccc

SEQ ID NO: 4200273 - DNA, 23 bp, Homo sapiens
cccaccaccttggactcctccca

SEQ ID NO: 4200274 - DNA, 14 bp, Homo sapiens
cccaccccagagtt

SEQ ID NO: 4200275 - DNA, 21 bp, Homo sapiens
cccaccctcaaaccctgtggg

SEQ ID NO: 4200276 - DNA, 20 bp, Homo sapiens
cccaccctcgtggacacctg

SEQ ID NO: 4200277 - DNA, 22 bp, Homo sapiens
cccaccctcgtggacacctgcc

SEQ ID NO: 4200278 - DNA, 22 bp, Homo sapiens
cccacctcttccttccgctcct

SEQ ID NO: 4200279 - DNA, 18 bp, Homo sapiens
cccacctggagcccgctt

SEQ ID NO: 4200280 - DNA, 19 bp, Homo sapiens
cccaccttcaattcctggg

SEQ ID NO: 4200281 - DNA, 15 bp, Homo sapiens
cccaccttccccaga

SEQ ID NO: 4200282 - DNA, 18 bp, Homo sapiens
cccaccttccccagactc

SEQ ID NO: 4200283 - DNA, 22 bp, Homo sapiens
cccactaagctttctcctttga

SEQ ID NO: 4200284 - DNA, 17 bp, Homo sapiens
cccactccccaccttca

SEQ ID NO: 4200285 - DNA, 19 bp, Homo sapiens
cccactgcccctgcacctg

SEQ ID NO: 4200286 - DNA, 13 bp, Homo sapiens
cccacttgtcatc

SEQ ID NO: 4200287 - DNA, 15 bp, Homo sapiens
cccacttgtcatcca

SEQ ID NO: 4200288 - DNA, 15 bp, Homo sapiens
cccagaaccacagat

SEQ ID NO: 4200289 - DNA, 16 bp, Homo sapiens
cccagactcagctcca

SEQ ID NO: 4200290 - DNA, 21 bp, Homo sapiens
cccagagaccccttcctttcc

SEQ ID NO: 4200291 - DNA, 22 bp, Homo sapiens
cccagaggccaggaatctgcca

SEQ ID NO: 4200292 - DNA, 18 bp, Homo sapiens
cccagagtcaggaagaga

SEQ ID NO: 4200293 - DNA, 20 bp, Homo sapiens
cccagcactttgggaggcca

SEQ ID NO: 4200294 - DNA, 22 bp, Homo sapiens
cccagcaggcaggcactgtggc

SEQ ID NO: 4200295 - DNA, 13 bp, Homo sapiens
cccagcagggcct

SEQ ID NO: 4200296 - DNA, 16 bp, Homo sapiens
cccagcctagcccact

SEQ ID NO: 4200297 - DNA, 13 bp, Homo sapiens
cccagcctgtcct

SEQ ID NO: 4200298 - DNA, 14 bp, Homo sapiens
cccagcctgtcctg

SEQ ID NO: 4200299 - DNA, 19 bp, Homo sapiens
cccagcctgtcctggtaca

SEQ ID NO: 4200300 - DNA, 20 bp, Homo sapiens
cccagcctgtcctggtacag

SEQ ID NO: 4200301 - DNA, 21 bp, Homo sapiens
cccctggtggacagtcctggg

SEQ ID NO: 4200302 - DNA, 18 bp, Homo sapiens
ccccttgacaactggcag

SEQ ID NO: 4200303 - DNA, 22 bp, Homo sapiens
ccccttgctctcccctgccctg

SEQ ID NO: 4200304 - DNA, 12 bp, Homo sapiens
cccctttccccc

SEQ ID NO: 4200305 - DNA, 13 bp, Homo sapiens
cccctttccccca

SEQ ID NO: 4200306 - DNA, 14 bp, Homo sapiens
cccgaccccatctc

SEQ ID NO: 4200307 - DNA, 12 bp, Homo sapiens
cccgactcctca

SEQ ID NO: 4200308 - DNA, 23 bp, Homo sapiens
cccgagctactctcttgccagca

SEQ ID NO: 4200309 - DNA, 15 bp, Homo sapiens
cccgagggagctgct

SEQ ID NO: 4200310 - DNA, 15 bp, Homo sapiens
cccgcatttctcatg

SEQ ID NO: 4200311 - DNA, 22 bp, Homo sapiens
cccgcttattctcctccctgtt

SEQ ID NO: 4200312 - DNA, 17 bp, Homo sapiens
cccggagctcaggccct

SEQ ID NO: 4200313 - DNA, 18 bp, Homo sapiens
cccgtcatgttcctcaaa

SEQ ID NO: 4200314 - DNA, 19 bp, Homo sapiens
cccgtgtccccggcctcag

SEQ ID NO: 4200315 - DNA, 22 bp, Homo sapiens
ccctagatctttctattccaaa

SEQ ID NO: 4200316 - DNA, 22 bp, Homo sapiens
ccctcaataaatgttgcttgga

SEQ ID NO: 4200317 - DNA, 21 bp, Homo sapiens
ccctcaccccctctaagttca

SEQ ID NO: 4200318 - DNA, 21 bp, Homo sapiens
ccctcataaaccaatgtggca

SEQ ID NO: 4200319 - DNA, 13 bp, Homo sapiens
ccctcatcctttt

SEQ ID NO: 4200320 - DNA, 12 bp, Homo sapiens
ccctcattcccc

SEQ ID NO: 4200321 - DNA, 15 bp, Homo sapiens
ccctcattcccctcg

SEQ ID NO: 4200322 - DNA, 21 bp, Homo sapiens
ccctccaccgcagaaggaagg

SEQ ID NO: 4200323 - DNA, 22 bp, Homo sapiens
ccctccaggcatgctggcctcc

SEQ ID NO: 4200324 - DNA, 22 bp, Homo sapiens
ccctcccagggccagggccctg

SEQ ID NO: 4200325 - DNA, 21 bp, Homo sapiens
ccctccccacagtcctcacag

SEQ ID NO: 4200326 - DNA, 13 bp, Homo sapiens
ccctccccagccc

SEQ ID NO: 4200327 - DNA, 19 bp, Homo sapiens
ccctcctacgcagatgctg

SEQ ID NO: 4200328 - DNA, 12 bp, Homo sapiens
ccctccttccct

SEQ ID NO: 4200329 - DNA, 17 bp, Homo sapiens
ccctccttcccttctct

SEQ ID NO: 4200330 - DNA, 23 bp, Homo sapiens
ccctccttgctctgcaggcacct

SEQ ID NO: 4200331 - DNA, 16 bp, Homo sapiens
ccctcgtggacacctg

SEQ ID NO: 4200332 - DNA, 18 bp, Homo sapiens
ccctcgtggacacctgcc

SEQ ID NO: 4200333 - DNA, 19 bp, Homo sapiens
ccctcgtggacacctgccc

SEQ ID NO: 4200334 - DNA, 23 bp, Homo sapiens
ccctcgtggacacctgccctgcc

SEQ ID NO: 4200335 - DNA, 14 bp, Homo sapiens
ccctctcttcccta

SEQ ID NO: 4200336 - DNA, 15 bp, Homo sapiens
ccctctcttccctat

SEQ ID NO: 4200337 - DNA, 16 bp, Homo sapiens
ccctcttccttccccc

SEQ ID NO: 4200338 - DNA, 17 bp, Homo sapiens
ccctgactctctgtgac

SEQ ID NO: 4200339 - DNA, 14 bp, Homo sapiens
ccctgactggtgct

SEQ ID NO: 4200340 - DNA, 13 bp, Homo sapiens
ccctgagggccct

SEQ ID NO: 4200341 - DNA, 18 bp, Homo sapiens
ccctgagggcccttccca

SEQ ID NO: 4200342 - DNA, 23 bp, Homo sapiens
ccctgagtggatctccaaggacc

SEQ ID NO: 4200343 - DNA, 16 bp, Homo sapiens
ccctgcacctgcttct

SEQ ID NO: 4200344 - DNA, 21 bp, Homo sapiens
ccctgcagagctatggtgagg

SEQ ID NO: 4200345 - DNA, 13 bp, Homo sapiens
ccctgcagcctgg

SEQ ID NO: 4200346 - DNA, 17 bp, Homo sapiens
ccctgccaagtctcaga

SEQ ID NO: 4200347 - DNA, 13 bp, Homo sapiens
ccctgccacctgt

SEQ ID NO: 4200348 - DNA, 13 bp, Homo sapiens
cctgccttgaagc

SEQ ID NO: 4200349 - DNA, 16 bp, Homo sapiens
cctgccttgaagccac

SEQ ID NO: 4200350 - DNA, 23 bp, Homo sapiens
cctgccttgaagccactgaagct

SEQ ID NO: 4200351 - DNA, 17 bp, Homo sapiens
cctgcgaaggggccctg

SEQ ID NO: 4200352 - DNA, 20 bp, Homo sapiens
cctgcgaagtggctctcagg

SEQ ID NO: 4200353 - DNA, 21 bp, Homo sapiens
cctgctgccgcctcccagcct

SEQ ID NO: 4200354 - DNA, 23 bp, Homo sapiens
cctgctgcgtcagaccagtactg

SEQ ID NO: 4200355 - DNA, 15 bp, Homo sapiens
cctgctgctgacctg

SEQ ID NO: 4200356 - DNA, 14 bp, Homo sapiens
cctgcttcatgctc

SEQ ID NO: 4200357 - DNA, 20 bp, Homo sapiens
cctggaaaggctcagtctca

SEQ ID NO: 4200358 - DNA, 13 bp, Homo sapiens
cctggaaccactg

SEQ ID NO: 4200359 - DNA, 13 bp, Homo sapiens
cctggagatgatg

SEQ ID NO: 4200360 - DNA, 13 bp, Homo sapiens
cctggagcccgct

SEQ ID NO: 4200361 - DNA, 19 bp, Homo sapiens
cctggagcggagcttgcct

SEQ ID NO: 4200362 - DNA, 18 bp, Homo sapiens
cctggaggatccctccat

SEQ ID NO: 4200363 - DNA, 21 bp, Homo sapiens
cctggagtcccctgggcctgg

SEQ ID NO: 4200364 - DNA, 14 bp, Homo sapiens
cctggcatgtcaga

SEQ ID NO: 4200365 - DNA, 16 bp, Homo sapiens
cctggcatgtcagagc

SEQ ID NO: 4200366 - DNA, 22 bp, Homo sapiens
cctggcatgtcagagccaggct

SEQ ID NO: 4200367 - DNA, 21 bp, Homo sapiens
cctggccaggcaccccctgga

SEQ ID NO: 4200368 - DNA, 14 bp, Homo sapiens
cctggcccagccag

SEQ ID NO: 4200369 - DNA, 16 bp, Homo sapiens
cctggcccccctccag

SEQ ID NO: 4200370 - DNA, 19 bp, Homo sapiens
cctggcccccctccaggca

SEQ ID NO: 4200371 - DNA, 20 bp, Homo sapiens
cctggcccccctccaggcat

SEQ ID NO: 4200372 - DNA, 23 bp, Homo sapiens
cctggcccccctccaggcatgct

SEQ ID NO: 4200373 - DNA, 14 bp, Homo sapiens
cctggccctcttct

SEQ ID NO: 4200374 - DNA, 17 bp, Homo sapiens
cctggcctcaagcaatc

SEQ ID NO: 4200375 - DNA, 19 bp, Homo sapiens
cctggcgcccctgcccccc

SEQ ID NO: 4200376 - DNA, 14 bp, Homo sapiens
cctggctcccaggg

SEQ ID NO: 4200377 - DNA, 17 bp, Homo sapiens
cctggcttctggagccc

SEQ ID NO: 4200378 - DNA, 17 bp, Homo sapiens
cctggcttgctgtggct

SEQ ID NO: 4200379 - DNA, 15 bp, Homo sapiens
cctgggaatcctgct

SEQ ID NO: 4200380 - DNA, 16 bp, Homo sapiens
cctgggaatcctgctg

SEQ ID NO: 4200381 - DNA, 21 bp, Homo sapiens
cctgggaatcctgctgccaga

SEQ ID NO: 4200382 - DNA, 18 bp, Homo sapiens
cctgggagaacctcaggc

SEQ ID NO: 4200383 - DNA, 19 bp, Homo sapiens
cctgggagaacctcaggct

SEQ ID NO: 4200384 - DNA, 23 bp, Homo sapiens
cctgggaggcggagagtacagtg

SEQ ID NO: 4200385 - DNA, 22 bp, Homo sapiens
cctgggcccacagagcctggct

SEQ ID NO: 4200386 - DNA, 20 bp, Homo sapiens
cctgggctctgccccagctc

SEQ ID NO: 4200387 - DNA, 12 bp, Homo sapiens
cctgggctctgg

SEQ ID NO: 4200388 - DNA, 18 bp, Homo sapiens
cctggggctctgtgcagg

SEQ ID NO: 4200389 - DNA, 15 bp, Homo sapiens
cctgggtaggaaaat

SEQ ID NO: 4200390 - DNA, 23 bp, Homo sapiens
cctgggtggtatagggcgtttgg

SEQ ID NO: 4200391 - DNA, 19 bp, Homo sapiens
cctgggttcagcctctccc

SEQ ID NO: 4200392 - DNA, 17 bp, Homo sapiens
cctgggttgcagacagg

SEQ ID NO: 4200393 - DNA, 14 bp, Homo sapiens
cctggtacagcagg

SEQ ID NO: 4200394 - DNA, 18 bp, Homo sapiens
cctggtagaattgggaag

SEQ ID NO: 4200395 - DNA, 18 bp, Homo sapiens
cctggtccttccaggccc

SEQ ID NO: 4200396 - DNA, 18 bp, Homo sapiens
cctggtcgtctatcccag

SEQ ID NO: 4200397 - DNA, 18 bp, Homo sapiens
cctggtgaggcccagcct

SEQ ID NO: 4200398 - DNA, 19 bp, Homo sapiens
cctggtgaggcccagcctg

SEQ ID NO: 4200399 - DNA, 20 bp, Homo sapiens
cctggtgaggcccagcctgt

SEQ ID NO: 4200400 - DNA, 17 bp, Homo sapiens
cctggtgcactggcccc

SEQ ID NO: 4200401 - DNA, 12 bp, Homo sapiens
cctggtggacag

SEQ ID NO: 4200402 - DNA, 14 bp, Homo sapiens
cctggtggacagtc

SEQ ID NO: 4200403 - DNA, 20 bp, Homo sapiens
cctggtggacagtcctggga

SEQ ID NO: 4200404 - DNA, 17 bp, Homo sapiens
cctgtaatcccagcact

SEQ ID NO: 4200405 - DNA, 13 bp, Homo sapiens
cctgtactcagga

SEQ ID NO: 4200406 - DNA, 21 bp, Homo sapiens
cctgtactcaggaggctgagg

SEQ ID NO: 4200407 - DNA, 13 bp, Homo sapiens
cctgtagcacaaa

SEQ ID NO: 4200408 - DNA, 14 bp, Homo sapiens
cctgtagcacaaag

SEQ ID NO: 4200409 - DNA, 19 bp, Homo sapiens
cctgtagctttcctggtcc

SEQ ID NO: 4200410 - DNA, 20 bp, Homo sapiens
cctgtagctttcctggtccc

SEQ ID NO: 4200411 - DNA, 19 bp, Homo sapiens
cctgtagtcccagccactc

SEQ ID NO: 4200412 - DNA, 21 bp, Homo sapiens
cctgtagttaggaaataaaac

SEQ ID NO: 4200413 - DNA, 22 bp, Homo sapiens
cctgtagttaggaaataaaacc

SEQ ID NO: 4200414 - DNA, 22 bp, Homo sapiens
cctgtatagttaggatagcatt

SEQ ID NO: 4200415 - DNA, 13 bp, Homo sapiens
cctgtcagagatc

SEQ ID NO: 4200416 - DNA, 14 bp, Homo sapiens
cctgtcccttcttg

SEQ ID NO: 4200417 - DNA, 20 bp, Homo sapiens
cctgtcctagcaggatctgc

SEQ ID NO: 4200418 - DNA, 21 bp, Homo sapiens
cctgtcctagcaggatctgcc

SEQ ID NO: 4200419 - DNA, 12 bp, Homo sapiens
cctgtcctggct

SEQ ID NO: 4200420 - DNA, 14 bp, Homo sapiens
cctgtcctggctcc

SEQ ID NO: 4200421 - DNA, 20 bp, Homo sapiens
cctgtcctggtacagcaggg

SEQ ID NO: 4200422 - DNA, 23 bp, Homo sapiens
cctgtctcaaaaaaaaaaaaaac

SEQ ID NO: 4200423 - DNA, 19 bp, Homo sapiens
cctgtgctactttgccttt

SEQ ID NO: 4200424 - DNA, 18 bp, Homo sapiens
cctgtgctgacggaagcc

SEQ ID NO: 4200425 - DNA, 17 bp, Homo sapiens
cctgtggagacagccct

SEQ ID NO: 4200426 - DNA, 20 bp, Homo sapiens
cctgtggagacagccctgcc

SEQ ID NO: 4200427 - DNA, 21 bp, Homo sapiens
cctgtggagacagccctgcct

SEQ ID NO: 4200428 - DNA, 21 bp, Homo sapiens
cctgtggtcttggaagtgtgt

SEQ ID NO: 4200429 - DNA, 12 bp, Homo sapiens
cctgtgtctggc

SEQ ID NO: 4200430 - DNA, 20 bp, Homo sapiens
cctgttgttcccatctgcgc

SEQ ID NO: 4200431 - DNA, 18 bp, Homo sapiens
cctgttttgttggaaggt

SEQ ID NO: 4200432 - DNA, 15 bp, Homo sapiens
ccttactcacctctc

SEQ ID NO: 4200433 - DNA, 18 bp, Homo sapiens
ccttaggctgctgggaga

SEQ ID NO: 4200434 - DNA, 22 bp, Homo sapiens
ccttcaacaattctaaaatgat

SEQ ID NO: 4200435 - DNA, 17 bp, Homo sapiens
ccttcaacttcagaagg

SEQ ID NO: 4200436 - DNA, 14 bp, Homo sapiens
ccttcaagtgccaa

SEQ ID NO: 4200437 - DNA, 19 bp, Homo sapiens
ccttcaagttagctcagga

SEQ ID NO: 4200438 - DNA, 14 bp, Homo sapiens
ccttccagaaaaca

SEQ ID NO: 4200439 - DNA, 20 bp, Homo sapiens
ccttccagtgggttatcttt

SEQ ID NO: 4200440 - DNA, 21 bp, Homo sapiens
ccttcccccatcccctttcct

SEQ ID NO: 4200441 - DNA, 19 bp, Homo sapiens
ccttccctctttccccacc

SEQ ID NO: 4200442 - DNA, 21 bp, Homo sapiens
ccttcccttctctccttccct

SEQ ID NO: 4200443 - DNA, 20 bp, Homo sapiens
ccttcctacacccttggact

SEQ ID NO: 4200444 - DNA, 17 bp, Homo sapiens
ccttcctcgtgcagagc

SEQ ID NO: 4200445 - DNA, 18 bp, Homo sapiens
ccttcctcgtgcagagct

SEQ ID NO: 4200446 - DNA, 14 bp, Homo sapiens
ccttcctttcctct

SEQ ID NO: 4200447 - DNA, 16 bp, Homo sapiens
ccttctctccttccct

SEQ ID NO: 4200448 - DNA, 13 bp, Homo sapiens
ccttctggctcca

SEQ ID NO: 4200449 - DNA, 14 bp, Homo sapiens
ccttctggctccaa

SEQ ID NO: 4200450 - DNA, 18 bp, Homo sapiens
ccttctgtccaccagacc

SEQ ID NO: 4200451 - DNA, 18 bp, Homo sapiens
ccttcttccctgttttaa

SEQ ID NO: 4200452 - DNA, 19 bp, Homo sapiens
ccttgaagccactgaagct

SEQ ID NO: 4200453 - DNA, 21 bp, Homo sapiens
ccttgaagggtaaagaagttt

SEQ ID NO: 4200454 - DNA, 16 bp, Homo sapiens
ccttgacaactggcag

SEQ ID NO: 4200455 - DNA, 21 bp, Homo sapiens
ccttgacaactggcaggcagg

SEQ ID NO: 4200456 - DNA, 18 bp, Homo sapiens
ccttgaccactggccctg

SEQ ID NO: 4200457 - DNA, 23 bp, Homo sapiens
ccttgagcactcagtctagtgaa

SEQ ID NO: 4200458 - DNA, 13 bp, Homo sapiens
ccttggacttgag

SEQ ID NO: 4200459 - DNA, 11 bp, Homo sapiens
ccttggcttct

SEQ ID NO: 4200460 - DNA, 14 bp, Homo sapiens
ccttggcttctgct

SEQ ID NO: 4200461 - DNA, 17 bp, Homo sapiens
ccttggcttctgcttca

SEQ ID NO: 4200462 - DNA, 22 bp, Homo sapiens
ccttggcttttgcttggcagag

SEQ ID NO: 4200463 - DNA, 14 bp, Homo sapiens
cctttaaagccttt

SEQ ID NO: 4200464 - DNA, 17 bp, Homo sapiens
cctttacctaccacctt

SEQ ID NO: 4200465 - DNA, 19 bp, Homo sapiens
cctttatatttagtgaact

SEQ ID NO: 4200466 - DNA, 15 bp, Homo sapiens
cctttcaaatttcac

SEQ ID NO: 4200467 - DNA, 16 bp, Homo sapiens
cctttcaaatttcaca

SEQ ID NO: 4200468 - DNA, 17 bp, Homo sapiens
cctttcaggtccaggcc

SEQ ID NO: 4200469 - DNA, 18 bp, Homo sapiens
cctttcaggtccaggcca

SEQ ID NO: 4200470 - DNA, 19 bp, Homo sapiens
cctttcaggtccaggccag

SEQ ID NO: 4200471 - DNA, 19 bp, Homo sapiens
cctttcccccaccccagag

SEQ ID NO: 4200472 - DNA, 20 bp, Homo sapiens
cctttcccccaccccagagt

SEQ ID NO: 4200473 - DNA, 21 bp, Homo sapiens
cctttcccccaccccagagtt

SEQ ID NO: 4200474 - DNA, 13 bp, Homo sapiens
cctttcctcccca

SEQ ID NO: 4200475 - DNA, 22 bp, Homo sapiens
cctttctcgtggtagaagccag

SEQ ID NO: 4200476 - DNA, 18 bp, Homo sapiens
cctttctctggctccaga

SEQ ID NO: 4200477 - DNA, 19 bp, Homo sapiens
cctttctctggctccagaa

SEQ ID NO: 4200478 - DNA, 19 bp, Homo sapiens
cctttctggaagtttctgg

SEQ ID NO: 4200479 - DNA, 21 bp, Homo sapiens
cctttctggaagtttctggtg

SEQ ID NO: 4200480 - DNA, 22 bp, Homo sapiens
cctttctggaagtttctggtgc

SEQ ID NO: 4200481 - DNA, 14 bp, Homo sapiens
cctttctggaccag

SEQ ID NO: 4200482 - DNA, 13 bp, Homo sapiens
cctttgcctctgc

SEQ ID NO: 4200483 - DNA, 15 bp, Homo sapiens
cctttgcctctgcta

SEQ ID NO: 4200484 - DNA, 19 bp, Homo sapiens
cctttggatgaccagaaca

SEQ ID NO: 4200485 - DNA, 14 bp, Homo sapiens
cctttgtgtaaaga

SEQ ID NO: 4200486 - DNA, 19 bp, Homo sapiens
cctttgttttgcactgaca

SEQ ID NO: 4200487 - DNA, 11 bp, Homo sapiens
ccttttatagc

SEQ ID NO: 4200488 - DNA, 14 bp, Homo sapiens
ccttttatcttcta

SEQ ID NO: 4200489 - DNA, 16 bp, Homo sapiens
ccttttatcttctagc

SEQ ID NO: 4200490 - DNA, 18 bp, Homo sapiens
ccttttcatctccagtgt

SEQ ID NO: 4200491 - DNA, 23 bp, Homo sapiens
ccttttcccaaaatgttgaaata

SEQ ID NO: 4200492 - DNA, 19 bp, Homo sapiens
ccttttcttccttctttct

SEQ ID NO: 4200493 - DNA, 23 bp, Homo sapiens
ccttttgaagtagtttgtataac

SEQ ID NO: 4200494 - DNA, 17 bp, Homo sapiens
ccttttgcataagatta

SEQ ID NO: 4200495 - DNA, 14 bp, Homo sapiens
cctttttctacctt

SEQ ID NO: 4200496 - DNA, 15 bp, Homo sapiens
ccttttttcacagcc

SEQ ID NO: 4200497 - DNA, 18 bp, Homo sapiens
cgaaaacgttgacccctt

SEQ ID NO: 4200498 - DNA, 20 bp, Homo sapiens
cgaaaacgttgacccctttc

SEQ ID NO: 4200499 - DNA, 16 bp, Homo sapiens
cgaaatttccattccc

SEQ ID NO: 4200500 - DNA, 12 bp, Homo sapiens
cgaataaatgtt

SEQ ID NO: 4200501 - DNA, 15 bp, Homo sapiens
cgaataaatgttcaa

SEQ ID NO: 4200502 - DNA, 16 bp, Homo sapiens
cgaataaatgttcaaa

SEQ ID NO: 4200503 - DNA, 12 bp, Homo sapiens
cgaatcatctca

SEQ ID NO: 4200504 - DNA, 23 bp, Homo sapiens
cgaatggggcgatcaagtccaga

SEQ ID NO: 4200505 - DNA, 15 bp, Homo sapiens
cgacagagcaagact

SEQ ID NO: 4200506 - DNA, 14 bp, Homo sapiens
cgacagcccagcct

SEQ ID NO: 4200507 - DNA, 17 bp, Homo sapiens
cgacagcccagcctagc

SEQ ID NO: 4200508 - DNA, 15 bp, Homo sapiens
cgaccatcgtccagc

SEQ ID NO: 4200509 - DNA, 13 bp, Homo sapiens
cgaccccatctca

SEQ ID NO: 4200510 - DNA, 12 bp, Homo sapiens
cgacccctgtcc

SEQ ID NO: 4200511 - DNA, 16 bp, Homo sapiens
cgactctaagctgtgt

SEQ ID NO: 4200512 - DNA, 18 bp, Homo sapiens
cgactctaagctgtgtgc

SEQ ID NO: 4200513 - DNA, 20 bp, Homo sapiens
cgactctaagctgtgtgcag

SEQ ID NO: 4200514 - DNA, 21 bp, Homo sapiens
cgactctaagctgtgtgcagg

SEQ ID NO: 4200515 - DNA, 14 bp, Homo sapiens
cgagaccagcctgg

SEQ ID NO: 4200516 - DNA, 15 bp, Homo sapiens
cgagaccagcctggc

SEQ ID NO: 4200517 - DNA, 17 bp, Homo sapiens
cgagacggctggacctg

SEQ ID NO: 4200518 - DNA, 15 bp, Homo sapiens
cgagaggcagagaaa

SEQ ID NO: 4200519 - DNA, 20 bp, Homo sapiens
cgagatcacgccactgcact

SEQ ID NO: 4200520 - DNA, 23 bp, Homo sapiens
cgagcgctttctggaaaagagga

SEQ ID NO: 4200521 - DNA, 15 bp, Homo sapiens
cgagctgctctgcta

SEQ ID NO: 4200522 - DNA, 16 bp, Homo sapiens
cgaggtgtcaccctgc

SEQ ID NO: 4200523 - DNA, 14 bp, Homo sapiens
cgagtgccaggact

SEQ ID NO: 4200524 - DNA, 15 bp, Homo sapiens
cgatcaagtccagag

SEQ ID NO: 4200525 - DNA, 17 bp, Homo sapiens
cgatcaagtccagagcc

SEQ ID NO: 4200526 - DNA, 19 bp, Homo sapiens
cgatcggggcactgcaggg

SEQ ID NO: 4200527 - DNA, 22 bp, Homo sapiens
cgcactacatgtggtttataga

SEQ ID NO: 4200528 - DNA, 12 bp, Homo sapiens
cgcagaaggaag

SEQ ID NO: 4200529 - DNA, 13 bp, Homo sapiens
cgcagaaggaagg

SEQ ID NO: 4200530 - DNA, 13 bp, Homo sapiens
cgcagatgctgtc

SEQ ID NO: 4200531 - DNA, 17 bp, Homo sapiens
cgcaggaactcccagca

SEQ ID NO: 4200532 - DNA, 19 bp, Homo sapiens
cgcagtgcttctctacaga

SEQ ID NO: 4200533 - DNA, 14 bp, Homo sapiens
cgcatttctcatgc

SEQ ID NO: 4200534 - DNA, 17 bp, Homo sapiens
cgcatttctcatgcttc

SEQ ID NO: 4200535 - DNA, 22 bp, Homo sapiens
cgcccacaagccttactcacct

SEQ ID NO: 4200536 - DNA, 18 bp, Homo sapiens
cgcccagctgcacctgcc

SEQ ID NO: 4200537 - DNA, 12 bp, Homo sapiens
cgccccccacct

SEQ ID NO: 4200538 - DNA, 13 bp, Homo sapiens
cgccgggcaggcc

SEQ ID NO: 4200539 - DNA, 16 bp, Homo sapiens
cgcctatgatcccagc

SEQ ID NO: 4200540 - DNA, 21 bp, Homo sapiens
cgcctccatttttgttgttat

SEQ ID NO: 4200541 - DNA, 14 bp, Homo sapiens
cgcctcccagcctg

SEQ ID NO: 4200542 - DNA, 13 bp, Homo sapiens
cgcctcttcctct

SEQ ID NO: 4200543 - DNA, 18 bp, Homo sapiens
cgcctgtagtcccagcca

SEQ ID NO: 4200544 - DNA, 19 bp, Homo sapiens
cgcgagggctactcagcag

SEQ ID NO: 4200545 - DNA, 20 bp, Homo sapiens
cgcgagggctactcagcagt

SEQ ID NO: 4200546 - DNA, 11 bp, Homo sapiens
cgcgcacacac

SEQ ID NO: 4200547 - DNA, 20 bp, Homo sapiens
cgcggtggctcttgcctgta

SEQ ID NO: 4200548 - DNA, 15 bp, Homo sapiens
cgctaaaagaaactt

SEQ ID NO: 4200549 - DNA, 22 bp, Homo sapiens
cgctcagcaatagggtgcagtt

SEQ ID NO: 4200550 - DNA, 13 bp, Homo sapiens
cgctcctttacct

SEQ ID NO: 4200551 - DNA, 12 bp, Homo sapiens
cgctctggacat

SEQ ID NO: 4200552 - DNA, 16 bp, Homo sapiens
cgctcttttccactcc

SEQ ID NO: 4200553 - DNA, 15 bp, Homo sapiens
cgctgctagagaagg

SEQ ID NO: 4200554 - DNA, 22 bp, Homo sapiens
cgcttgaaccggggaggtggag

SEQ ID NO: 4200555 - DNA, 16 bp, Homo sapiens
cgctttttgaaaaagc

SEQ ID NO: 4200556 - DNA, 22 bp, Homo sapiens
cggaagaagagatcaggaagag

SEQ ID NO: 4200557 - DNA, 19 bp, Homo sapiens
cggaaggggacgcgggctg

SEQ ID NO: 4200558 - DNA, 22 bp, Homo sapiens
cggaaggggacgcgggctgtgc

SEQ ID NO: 4200559 - DNA, 21 bp, Homo sapiens
cggaattctcgggaaattatt

SEQ ID NO: 4200560 - DNA, 13 bp, Homo sapiens
cggaccgcgtaga

SEQ ID NO: 4200561 - DNA, 13 bp, Homo sapiens
cggagcctgcctc

SEQ ID NO: 4200562 - DNA, 15 bp, Homo sapiens
cggagcctgcctcct

SEQ ID NO: 4200563 - DNA, 15 bp, Homo sapiens
cggaggggttgcggg

SEQ ID NO: 4200564 - DNA, 20 bp, Homo sapiens
cggaggggttgcgggggagc

SEQ ID NO: 4200565 - DNA, 14 bp, Homo sapiens
cggcagctgtagct

SEQ ID NO: 4200566 - DNA, 12 bp, Homo sapiens
cggctccaggtc

SEQ ID NO: 4200567 - DNA, 16 bp, Homo sapiens
cggctccaggtccgga

SEQ ID NO: 4200568 - DNA, 20 bp, Homo sapiens
cggctccaggtccggagggg

SEQ ID NO: 4200569 - DNA, 17 bp, Homo sapiens
cggctgctcctccagcc

SEQ ID NO: 4200570 - DNA, 18 bp, Homo sapiens
cggctgctcctccagccc

SEQ ID NO: 4200571 - DNA, 21 bp, Homo sapiens
cggctgctcctccagcccttc

SEQ ID NO: 4200572 - DNA, 15 bp, Homo sapiens
cggctggggactgct

SEQ ID NO: 4200573 - DNA, 19 bp, Homo sapiens
cggctggggactgctacct

SEQ ID NO: 4200574 - DNA, 21 bp, Homo sapiens
cgggacgagaccctacaggag

SEQ ID NO: 4200575 - DNA, 13 bp, Homo sapiens
cgggagctctgta

SEQ ID NO: 4200576 - DNA, 18 bp, Homo sapiens
cgggaggctgagacagga

SEQ ID NO: 4200577 - DNA, 19 bp, Homo sapiens
cgggcacctatagtcccag

SEQ ID NO: 4200578 - DNA, 20 bp, Homo sapiens
cgggccatgctttccttttc

SEQ ID NO: 4200579 - DNA, 15 bp, Homo sapiens
cgggcggaggcggct

SEQ ID NO: 4200580 - DNA, 14 bp, Homo sapiens
cgggctgtgcctta

SEQ ID NO: 4200581 - DNA, 15 bp, Homo sapiens
cggggcagagccacc

SEQ ID NO: 4200582 - DNA, 16 bp, Homo sapiens
cggggcatgctggggc

SEQ ID NO: 4200583 - DNA, 19 bp, Homo sapiens
cggggcatgctggggcaag

SEQ ID NO: 4200584 - DNA, 16 bp, Homo sapiens
cgggggagctggaaat

SEQ ID NO: 4200585 - DNA, 18 bp, Homo sapiens
cgggggagctggaaataa

SEQ ID NO: 4200586 - DNA, 14 bp, Homo sapiens
cgggggaggaaggg

SEQ ID NO: 4200587 - DNA, 16 bp, Homo sapiens
cggggtattttaggca

SEQ ID NO: 4200588 - DNA, 21 bp, Homo sapiens
cgggtgccccccatgccctcc

SEQ ID NO: 4200589 - DNA, 23 bp, Homo sapiens
cgggtggaaaagaatccctgcag

SEQ ID NO: 4200590 - DNA, 18 bp, Homo sapiens
cgggtggatcacctgagg

SEQ ID NO: 4200591 - DNA, 17 bp, Homo sapiens
cgggtgtgcctgccctg

SEQ ID NO: 4200592 - DNA, 20 bp, Homo sapiens
cgggtgtgcctgccctggag

SEQ ID NO: 4200593 - DNA, 23 bp, Homo sapiens
cggtcaccgagacggctggacct

SEQ ID NO: 4200594 - DNA, 14 bp, Homo sapiens
cggtcccacactgg

SEQ ID NO: 4200595 - DNA, 21 bp, Homo sapiens
cggtctaggtgggagagagtg

SEQ ID NO: 4200596 - DNA, 18 bp, Homo sapiens
cggtgcatccacgcacac

SEQ ID NO: 4200597 - DNA, 11 bp, Homo sapiens
cggtggctcac

SEQ ID NO: 4200598 - DNA, 17 bp, Homo sapiens
cggtgtgcctgcagccc

SEQ ID NO: 4200599 - DNA, 20 bp, Homo sapiens
cggttcaggaaaattgaatg

SEQ ID NO: 4200600 - DNA, 15 bp, Homo sapiens
cggttgcttcacctt

SEQ ID NO: 4200601 - DNA, 22 bp, Homo sapiens
cggtttggtttgttgtaaataa

SEQ ID NO: 4200602 - DNA, 21 bp, Homo sapiens
cgtaatgcttagagaatgttc

SEQ ID NO: 4200603 - DNA, 13 bp, Homo sapiens
cgtaccagccagg

SEQ ID NO: 4200604 - DNA, 17 bp, Homo sapiens
cgtcaacgtgcatttta

SEQ ID NO: 4200605 - DNA, 15 bp, Homo sapiens
cgtcatgttcctcaa

SEQ ID NO: 4200606 - DNA, 13 bp, Homo sapiens
cgtccagccctcc

SEQ ID NO: 4200607 - DNA, 20 bp, Homo sapiens
cgtccctgagggcccttccc

SEQ ID NO: 4200608 - DNA, 13 bp, Homo sapiens
cgtctctgtcccg

SEQ ID NO: 4200609 - DNA, 13 bp, Homo sapiens
cgtgacacaaaca

SEQ ID NO: 4200610 - DNA, 21 bp, Homo sapiens
cgtgactattttttaataaaa

SEQ ID NO: 4200611 - DNA, 13 bp, Homo sapiens
cgtgagccaggta

SEQ ID NO: 4200612 - DNA, 21 bp, Homo sapiens
cgtgagccaggtaatgaggga

SEQ ID NO: 4200613 - DNA, 20 bp, Homo sapiens
cgtgcacagcgcgggcggag

SEQ ID NO: 4200614 - DNA, 23 bp, Homo sapiens
cgtgccctttggggttgcccagc

SEQ ID NO: 4200615 - DNA, 13 bp, Homo sapiens
cgtggacacctgc

SEQ ID NO: 4200616 - DNA, 17 bp, Homo sapiens
cgtggacacctgccctg

SEQ ID NO: 4200617 - DNA, 18 bp, Homo sapiens
cgtggacacctgccctgc

SEQ ID NO: 4200618 - DNA, 19 bp, Homo sapiens
cgtggacacctgccctgcc

SEQ ID NO: 4200619 - DNA, 16 bp, Homo sapiens
cgtgggccgggaggca

SEQ ID NO: 4200620 - DNA, 23 bp, Homo sapiens
cgtgggtgtgtgtagccaaggtc

SEQ ID NO: 4200621 - DNA, 23 bp, Homo sapiens
cgtggtgaggttgtgctgcctgt

SEQ ID NO: 4200622 - DNA, 15 bp, Homo sapiens
cgtgtcgtgggtgtg

SEQ ID NO: 4200623 - DNA, 22 bp, Homo sapiens
cgtgtgtatccgactctaagct

SEQ ID NO: 4200624 - DNA, 19 bp, Homo sapiens
cgtgttctatagagcctgg

SEQ ID NO: 4200625 - DNA, 17 bp, Homo sapiens
cgttcatgttctgtgat

SEQ ID NO: 4200626 - DNA, 13 bp, Homo sapiens
cttccttccccca

SEQ ID NO: 4200627 - DNA, 20 bp, Homo sapiens
cttccttctttctcttccct

SEQ ID NO: 4200628 - DNA, 19 bp, Homo sapiens
cttccttggcatcacaggg

SEQ ID NO: 4200629 - DNA, 12 bp, Homo sapiens
cttcctttcctc

SEQ ID NO: 4200630 - DNA, 17 bp, Homo sapiens
cttcctttcctctgcag

SEQ ID NO: 4200631 - DNA, 20 bp, Homo sapiens
cttcgctgctagagaagggg

SEQ ID NO: 4200632 - DNA, 18 bp, Homo sapiens
cttctaaatcagaaatag

SEQ ID NO: 4200633 - DNA, 22 bp, Homo sapiens
cttctacccagatggaaaaata

SEQ ID NO: 4200634 - DNA, 17 bp, Homo sapiens
cttctagatctggaacc

SEQ ID NO: 4200635 - DNA, 16 bp, Homo sapiens
cttctattaaatgtat

SEQ ID NO: 4200636 - DNA, 22 bp, Homo sapiens
cttctcctcccagcgtgtgtat

SEQ ID NO: 4200637 - DNA, 13 bp, Homo sapiens
cttctgaagtaat

SEQ ID NO: 4200638 - DNA, 14 bp, Homo sapiens
cttctgaagtaatt

SEQ ID NO: 4200639 - DNA, 20 bp, Homo sapiens
cttctgaagtaatttgtaaa

SEQ ID NO: 4200640 - DNA, 16 bp, Homo sapiens
cttctgcagcaactcc

SEQ ID NO: 4200641 - DNA, 18 bp, Homo sapiens
cttctgcagcaactccca

SEQ ID NO: 4200642 - DNA, 23 bp, Homo sapiens
cttctgcagcaactcccacgact

SEQ ID NO: 4200643 - DNA, 13 bp, Homo sapiens
cttctgtccacca

SEQ ID NO: 4200644 - DNA, 16 bp, Homo sapiens
cttctgtccaccagac

SEQ ID NO: 4200645 - DNA, 14 bp, Homo sapiens
cttctttctcttcc

SEQ ID NO: 4200646 - DNA, 13 bp, Homo sapiens
cttctttgaagtt

SEQ ID NO: 4200647 - DNA, 13 bp, Homo sapiens
cttgaaaaatatt

SEQ ID NO: 4200648 - DNA, 18 bp, Homo sapiens
cttgaaatatcctgcttg

SEQ ID NO: 4200649 - DNA, 13 bp, Homo sapiens
cttgaagccactg

SEQ ID NO: 4200650 - DNA, 11 bp, Homo sapiens
cttgaataaag

SEQ ID NO: 4200651 - DNA, 14 bp, Homo sapiens
cttgacaactggca

SEQ ID NO: 4200652 - DNA, 20 bp, Homo sapiens
cttgagcactcagtctagtg

SEQ ID NO: 4200653 - DNA, 13 bp, Homo sapiens
cttgagcagaccg

SEQ ID NO: 4200654 - DNA, 20 bp, Homo sapiens
cttgagcttggcagctgaac

SEQ ID NO: 4200655 - DNA, 16 bp, Homo sapiens
cttgaggacacatgtc

SEQ ID NO: 4200656 - DNA, 17 bp, Homo sapiens
cttgaggacacatgtcc

SEQ ID NO: 4200657 - DNA, 18 bp, Homo sapiens
cttgaggacacatgtcca

SEQ ID NO: 4200658 - DNA, 16 bp, Homo sapiens
cttgaggattttgagt

SEQ ID NO: 4200659 - DNA, 19 bp, Homo sapiens
cttgagtagatctgcttct

SEQ ID NO: 4200660 - DNA, 14 bp, Homo sapiens
cttgagtttacatc

SEQ ID NO: 4200661 - DNA, 12 bp, Homo sapiens
cttgatagaaat

SEQ ID NO: 4200662 - DNA, 14 bp, Homo sapiens
cttgatagaaatgc

SEQ ID NO: 4200663 - DNA, 19 bp, Homo sapiens
cttgatgggattctggaca

SEQ ID NO: 4200664 - DNA, 21 bp, Homo sapiens
cttgccaaattccatgtccct

SEQ ID NO: 4200665 - DNA, 21 bp, Homo sapiens
cttgcccctccagagacagga

SEQ ID NO: 4200666 - DNA, 23 bp, Homo sapiens
cttgcccctccagagacaggaaa

SEQ ID NO: 4200667 - DNA, 18 bp, Homo sapiens
cttgcccggattctggga

SEQ ID NO: 4200668 - DNA, 19 bp, Homo sapiens
cttgccctgggtcacctag

SEQ ID NO: 4200669 - DNA, 13 bp, Homo sapiens
cttgccgagagag

SEQ ID NO: 4200670 - DNA, 16 bp, Homo sapiens
cttgccgagagaggcg

SEQ ID NO: 4200671 - DNA, 15 bp, Homo sapiens
cttgcctgcctgcct

SEQ ID NO: 4200672 - DNA, 18 bp, Homo sapiens
cttgccttttaaaagaaa

SEQ ID NO: 4200673 - DNA, 17 bp, Homo sapiens
cttgctgaggggcaggg

SEQ ID NO: 4200674 - DNA, 22 bp, Homo sapiens
cttgctgaggggcagggagagc

SEQ ID NO: 4200675 - DNA, 23 bp, Homo sapiens
cttgctgaggggcagggagagcg

SEQ ID NO: 4200676 - DNA, 23 bp, Homo sapiens
cttgcttctgcagcaactcccac

SEQ ID NO: 4200677 - DNA, 18 bp, Homo sapiens
cttgctttagagtagatg

SEQ ID NO: 4200678 - DNA, 14 bp, Homo sapiens
cttgctttgctgtc

SEQ ID NO: 4200679 - DNA, 16 bp, Homo sapiens
cttggaaaaagaaaga

SEQ ID NO: 4200680 - DNA, 18 bp, Homo sapiens
cttggaaaaagaaagaaa

SEQ ID NO: 4200681 - DNA, 21 bp, Homo sapiens
cttggaaaaagaaagaaacac

SEQ ID NO: 4200682 - DNA, 13 bp, Homo sapiens
cttggactcctcc

SEQ ID NO: 4200683 - DNA, 14 bp, Homo sapiens
cttggagagcagct

SEQ ID NO: 4200684 - DNA, 16 bp, Homo sapiens
cttggagagcagctgg

SEQ ID NO: 4200685 - DNA, 17 bp, Homo sapiens
cttggagataatttatg

SEQ ID NO: 4200686 - DNA, 17 bp, Homo sapiens
cttggagctgagcaaat

SEQ ID NO: 4200687 - DNA, 18 bp, Homo sapiens
cttggcatcacagggcag

SEQ ID NO: 4200688 - DNA, 13 bp, Homo sapiens
cttggcctctgct

SEQ ID NO: 4200689 - DNA, 20 bp, Homo sapiens
cttgggcccaggaggtcaag

SEQ ID NO: 4200690 - DNA, 22 bp, Homo sapiens
cttggggggtttttactccagt

SEQ ID NO: 4200691 - DNA, 18 bp, Homo sapiens
cttggtaattatatctgt

SEQ ID NO: 4200692 - DNA, 13 bp, Homo sapiens
cttggtcagagcc

SEQ ID NO: 4200693 - DNA, 17 bp, Homo sapiens
cttggtcttacatctgt

SEQ ID NO: 4200694 - DNA, 19 bp, Homo sapiens
cttggtggatgggccctgc

SEQ ID NO: 4200695 - DNA, 13 bp, Homo sapiens
cttggtggccaag

SEQ ID NO: 4200696 - DNA, 15 bp, Homo sapiens
cttggtggctgagct

SEQ ID NO: 4200697 - DNA, 21 bp, Homo sapiens
cttggtggctgagcttggccc

SEQ ID NO: 4200698 - DNA, 15 bp, Homo sapiens
cttggtttgccttcc

SEQ ID NO: 4200699 - DNA, 21 bp, Homo sapiens
cttggtttggacacagtgttc

SEQ ID NO: 4200700 - DNA, 23 bp, Homo sapiens
cttgtaaattattaatttatgca

SEQ ID NO: 4200701 - DNA, 15 bp, Homo sapiens
cttgtatagtgtaaa

SEQ ID NO: 4200702 - DNA, 15 bp, Homo sapiens
cttgtatttccaaac

SEQ ID NO: 4200703 - DNA, 23 bp, Homo sapiens
cttgtcatccataaagcaagctc

SEQ ID NO: 4200704 - DNA, 23 bp, Homo sapiens
cttgtctgattggctcacccaag

SEQ ID NO: 4200705 - DNA, 14 bp, Homo sapiens
cttgtgctgagaat

SEQ ID NO: 4200706 - DNA, 23 bp, Homo sapiens
cttgtgctgagaatagtgtctga

SEQ ID NO: 4200707 - DNA, 19 bp, Homo sapiens
cttgtgtcaagacatttct

SEQ ID NO: 4200708 - DNA, 12 bp, Homo sapiens
cttgtgtcctga

SEQ ID NO: 4200709 - DNA, 13 bp, Homo sapiens
cttgtgtctgcgt

SEQ ID NO: 4200710 - DNA, 17 bp, Homo sapiens
cttgttgtgcttttagt

SEQ ID NO: 4200711 - DNA, 18 bp, Homo sapiens
cttgttgtttttaagtcc

SEQ ID NO: 4200712 - DNA, 22 bp, Homo sapiens
cttgttgtttttaagtcctgta

SEQ ID NO: 4200713 - DNA, 23 bp, Homo sapiens
cttgttttgacttgaataaagta

SEQ ID NO: 4200714 - DNA, 13 bp, Homo sapiens
ctttaaagccttt

SEQ ID NO: 4200715 - DNA, 23 bp, Homo sapiens
ctttaaccactcctcaggaacag

SEQ ID NO: 4200716 - DNA, 15 bp, Homo sapiens
ctttaagactgagca

SEQ ID NO: 4200717 - DNA, 14 bp, Homo sapiens
ctttaaggagaaga

SEQ ID NO: 4200718 - DNA, 20 bp, Homo sapiens
ctttaatgtgtattgaagaa

SEQ ID NO: 4200719 - DNA, 19 bp, Homo sapiens
ctttacatgcaatttatta

SEQ ID NO: 4200720 - DNA, 13 bp, Homo sapiens
ctttaccactatg

SEQ ID NO: 4200721 - DNA, 19 bp, Homo sapiens
ctttacctaccaccttccc

SEQ ID NO: 4200722 - DNA, 22 bp, Homo sapiens
ctttacctaccaccttccctct

SEQ ID NO: 4200723 - DNA, 16 bp, Homo sapiens
ctttaggcagcctgcc

SEQ ID NO: 4200724 - DNA, 18 bp, Homo sapiens
ctttataaaaagtgaaat

SEQ ID NO: 4200725 - DNA, 16 bp, Homo sapiens
ctttatagctcatcac

SEQ ID NO: 4200726 - DNA, 15 bp, Homo sapiens
ctttatagctctcat

SEQ ID NO: 4200727 - DNA, 18 bp, Homo sapiens
ctttatagctctcatcac

SEQ ID NO: 4200728 - DNA, 13 bp, Homo sapiens
ctttatatttagt

SEQ ID NO: 4200729 - DNA, 13 bp, Homo sapiens
ctttatgcttgca

SEQ ID NO: 4200730 - DNA, 14 bp, Homo sapiens
ctttcaaatttcac

SEQ ID NO: 4200731 - DNA, 15 bp, Homo sapiens
ctttcaaatttcaca

SEQ ID NO: 4200732 - DNA, 21 bp, Homo sapiens
ctttcaggggggttgtgaggc

SEQ ID NO: 4200733 - DNA, 17 bp, Homo sapiens
ctttcccatgatccaga

SEQ ID NO: 4200734 - DNA, 15 bp, Homo sapiens
ctttccccacctctt

SEQ ID NO: 4200735 - DNA, 19 bp, Homo sapiens
ctttccccacctcttcctt

SEQ ID NO: 4200736 - DNA, 20 bp, Homo sapiens
ctttcccccaccccagagtt

SEQ ID NO: 4200737 - DNA, 21 bp, Homo sapiens
ctttccccgggggaggaaggg

SEQ ID NO: 4200738 - DNA, 18 bp, Homo sapiens
ctttcccggactgcaagc

SEQ ID NO: 4200739 - DNA, 16 bp, Homo sapiens
ctttcctacaaaatgg

SEQ ID NO: 4200740 - DNA, 13 bp, Homo sapiens
ctttcctccccac

SEQ ID NO: 4200741 - DNA, 21 bp, Homo sapiens
ctttcctccccaccttcccca

SEQ ID NO: 4200742 - DNA, 16 bp, Homo sapiens
ctttccttctggctcc

SEQ ID NO: 4200743 - DNA, 17 bp, Homo sapiens
ctttccttctggctcca

SEQ ID NO: 4200744 - DNA, 16 bp, Homo sapiens
ctttcggagcctgcct

SEQ ID NO: 4200745 - DNA, 17 bp, Homo sapiens
ctttcggagcctgcctc

SEQ ID NO: 4200746 - DNA, 20 bp, Homo sapiens
ctttctagcagcagatctgt

SEQ ID NO: 4200747 - DNA, 15 bp, Homo sapiens
ctttctattccaaag

SEQ ID NO: 4200748 - DNA, 15 bp, Homo sapiens
ctttctcactgctgt

SEQ ID NO: 4200749 - DNA, 17 bp, Homo sapiens
ctttctcactgctgtca

SEQ ID NO: 4200750 - DNA, 12 bp, Homo sapiens
ctttctcctttg

SEQ ID NO: 4200751 - DNA, 18 bp, Homo sapiens
ctttctggaccagatcct

SEQ ID NO: 4200752 - DNA, 14 bp, Homo sapiens
ctttctgggccaag

SEQ ID NO: 4200753 - DNA, 18 bp, Homo sapiens
ctttcttttgattcttcc

SEQ ID NO: 4200754 - DNA, 21 bp, Homo sapiens
ctttgaagttagctttaactt

SEQ ID NO: 4200755 - DNA, 13 bp, Homo sapiens
ctttgaatgcttt

SEQ ID NO: 4200756 - DNA, 23 bp, Homo sapiens
ctttgaatgctttttgaatgtta

SEQ ID NO: 4200757 - DNA, 22 bp, Homo sapiens
ctttgagctactgccgtcagtg

SEQ ID NO: 4200758 - DNA, 18 bp, Homo sapiens
ctttgcaatccaaataaa

SEQ ID NO: 4200759 - DNA, 18 bp, Homo sapiens
gaactgccccatctcctc

SEQ ID NO: 4200760 - DNA, 13 bp, Homo sapiens
gaactggaagaaa

SEQ ID NO: 4200761 - DNA, 14 bp, Homo sapiens
gaactggttcaaga

SEQ ID NO: 4200762 - DNA, 18 bp, Homo sapiens
gaactggttcaagagaca

SEQ ID NO: 4200763 - DNA, 23 bp, Homo sapiens
gaactggttcaagagacactgct

SEQ ID NO: 4200764 - DNA, 21 bp, Homo sapiens
gaactgttacaacttgtattt

SEQ ID NO: 4200765 - DNA, 19 bp, Homo sapiens
gaactgttgtttacttgtt

SEQ ID NO: 4200766 - DNA, 14 bp, Homo sapiens
gaacttcaaaatgt

SEQ ID NO: 4200767 - DNA, 14 bp, Homo sapiens
gaacttcaatcact

SEQ ID NO: 4200768 - DNA, 14 bp, Homo sapiens
gaacttctaatata

SEQ ID NO: 4200769 - DNA, 22 bp, Homo sapiens
gaacttgaaatatcctgcttga

SEQ ID NO: 4200770 - DNA, 15 bp, Homo sapiens
gaacttgaccctgag

SEQ ID NO: 4200771 - DNA, 13 bp, Homo sapiens
gaacttgaggaca

SEQ ID NO: 4200772 - DNA, 21 bp, Homo sapiens
gaacttgaggacacatgtcca

SEQ ID NO: 4200773 - DNA, 19 bp, Homo sapiens
gaactttcggagcctgcct

SEQ ID NO: 4200774 - DNA, 16 bp, Homo sapiens
gaagaaagaacggaag

SEQ ID NO: 4200775 - DNA, 20 bp, Homo sapiens
gaagaaagaacggaagaaga

SEQ ID NO: 4200776 - DNA, 14 bp, Homo sapiens
gaagaagaggagga

SEQ ID NO: 4200777 - DNA, 23 bp, Homo sapiens
gaagaccaatctcttgaatccca

SEQ ID NO: 4200778 - DNA, 23 bp, Homo sapiens
gaagactatcttactatttcaca

SEQ ID NO: 4200779 - DNA, 21 bp, Homo sapiens
gaagagaacctcaaactagga

SEQ ID NO: 4200780 - DNA, 13 bp, Homo sapiens
gaagagaggcacc

SEQ ID NO: 4200781 - DNA, 23 bp, Homo sapiens
gaagagaggcacctgctggaaac

SEQ ID NO: 4200782 - DNA, 17 bp, Homo sapiens
gaagagatcaggaagag

SEQ ID NO: 4200783 - DNA, 16 bp, Homo sapiens
gaagcaaagcaccagc

SEQ ID NO: 4200784 - DNA, 14 bp, Homo sapiens
gaagcaagctggat

SEQ ID NO: 4200785 - DNA, 17 bp, Homo sapiens
gaagccaacttggcttt

SEQ ID NO: 4200786 - DNA, 18 bp, Homo sapiens
gaagccactgaagctggg

SEQ ID NO: 4200787 - DNA, 22 bp, Homo sapiens
gaagcctgttttgttggaaggt

SEQ ID NO: 4200788 - DNA, 14 bp, Homo sapiens
gaagcgctcatctg

SEQ ID NO: 4200789 - DNA, 19 bp, Homo sapiens
gaagctggagggaggtggg

SEQ ID NO: 4200790 - DNA, 17 bp, Homo sapiens
gaagctgggggaagggt

SEQ ID NO: 4200791 - DNA, 19 bp, Homo sapiens
gaagctgggggaagggtgg

SEQ ID NO: 4200792 - DNA, 23 bp, Homo sapiens
gaagctgtagtagccctttctgt

SEQ ID NO: 4200793 - DNA, 23 bp, Homo sapiens
gaaggaaagatttgtgaactgga

SEQ ID NO: 4200794 - DNA, 14 bp, Homo sapiens
ctgtgcatgacctg

SEQ ID NO: 4200795 - DNA, 15 bp, Homo sapiens
ctgtgccctgccttc

SEQ ID NO: 4200796 - DNA, 16 bp, Homo sapiens
ctgtgccctgccttca

SEQ ID NO: 4200797 - DNA, 18 bp, Homo sapiens
ctgtgcctttgggaggca

SEQ ID NO: 4200798 - DNA, 16 bp, Homo sapiens
ctgtgcgtctgtgtgt

SEQ ID NO: 4200799 - DNA, 14 bp, Homo sapiens
ctgtgctactttgc

SEQ ID NO: 4200800 - DNA, 16 bp, Homo sapiens
ctgtgctactttgcct

SEQ ID NO: 4200801 - DNA, 17 bp, Homo sapiens
ctgtgctactttgcctt

SEQ ID NO: 4200802 - DNA, 13 bp, Homo sapiens
ctgtggagacagc

SEQ ID NO: 4200803 - DNA, 15 bp, Homo sapiens
ctgtggagacagccc

SEQ ID NO: 4200804 - DNA, 13 bp, Homo sapiens
ctgtggcctgggc

SEQ ID NO: 4200805 - DNA, 16 bp, Homo sapiens
ctgtggccttctcagc

SEQ ID NO: 4200806 - DNA, 15 bp, Homo sapiens
ctgtgggagctcagc

SEQ ID NO: 4200807 - DNA, 18 bp, Homo sapiens
ctgtgggagctcagctcg

SEQ ID NO: 4200808 - DNA, 13 bp, Homo sapiens
ctgtggtcttgga

SEQ ID NO: 4200809 - DNA, 23 bp, Homo sapiens
ctgtggtgaggtcctgtcctggc

SEQ ID NO: 4200810 - DNA, 20 bp, Homo sapiens
ctgtggttcctaagcctgtt

SEQ ID NO: 4200811 - DNA, 23 bp, Homo sapiens
ctgtgtatgtgtgtgtctgtgcg

SEQ ID NO: 4200812 - DNA, 19 bp, Homo sapiens
gacagaacattgccttcct

SEQ ID NO: 4200813 - DNA, 20 bp, Homo sapiens
gacagaacattgccttcctc

SEQ ID NO: 4200814 - DNA, 21 bp, Homo sapiens
gacagaacattgccttcctcg

SEQ ID NO: 4200815 - DNA, 22 bp, Homo sapiens
gacagaagtttgcactatcttt

SEQ ID NO: 4200816 - DNA, 18 bp, Homo sapiens
gacagatagacagtgctg

SEQ ID NO: 4200817 - DNA, 11 bp, Homo sapiens
gacagcccagc

SEQ ID NO: 4200818 - DNA, 14 bp, Homo sapiens
gacagccctgccta

SEQ ID NO: 4200819 - DNA, 22 bp, Homo sapiens
gacagccctgcctatcctctgt

SEQ ID NO: 4200820 - DNA, 13 bp, Homo sapiens
gacaggaaagaat

SEQ ID NO: 4200821 - DNA, 14 bp, Homo sapiens
gacaggacagtgct

SEQ ID NO: 4200822 - DNA, 22 bp, Homo sapiens
gacaggacagtgcttcagcctg

SEQ ID NO: 4200823 - DNA, 14 bp, Homo sapiens
gacaggatgtgttt

SEQ ID NO: 4200824 - DNA, 20 bp, Homo sapiens
gacaggatgtgtttgctttc

SEQ ID NO: 4200825 - DNA, 21 bp, Homo sapiens
gacagggtgaataaagcaggg

SEQ ID NO: 4200826 - DNA, 16 bp, Homo sapiens
gacaggtaagtggcag

SEQ ID NO: 4200827 - DNA, 14 bp, Homo sapiens
gacagtattctcag

SEQ ID NO: 4200828 - DNA, 15 bp, Homo sapiens
gacagtctggagaag

SEQ ID NO: 4200829 - DNA, 15 bp, Homo sapiens
gacagtgctgccctg

SEQ ID NO: 4200830 - DNA, 16 bp, Homo sapiens
gacagtgcttcagcct

SEQ ID NO: 4200831 - DNA, 17 bp, Homo sapiens
gacagtgcttcagcctg

SEQ ID NO: 4200832 - DNA, 20 bp, Homo sapiens
gacagtgcttcagcctgagg

SEQ ID NO: 4200833 - DNA, 14 bp, Homo sapiens
gacagtggtgggcg

SEQ ID NO: 4200834 - DNA, 22 bp, Homo sapiens
gacataaagttgataaagattt

SEQ ID NO: 4200835 - DNA, 18 bp, Homo sapiens
gacatataccttctcaaa

SEQ ID NO: 4200836 - DNA, 20 bp, Homo sapiens
gacatgaaggtaggtaaata

SEQ ID NO: 4200837 - DNA, 16 bp, Homo sapiens
gacatgagccaccgcg

SEQ ID NO: 4200838 - DNA, 21 bp, Homo sapiens
gacatgatggagcgcacctgc

SEQ ID NO: 4200839 - DNA, 21 bp, Homo sapiens
gacatgatttagggaagcagg

SEQ ID NO: 4200840 - DNA, 15 bp, Homo sapiens
gacattaaacctgga

SEQ ID NO: 4200841 - DNA, 21 bp, Homo sapiens
gacatttctctaactcctgcc

SEQ ID NO: 4200842 - DNA, 14 bp, Homo sapiens
gacattttcaataa

SEQ ID NO: 4200843 - DNA, 15 bp, Homo sapiens
gaccaaattgggaga

SEQ ID NO: 4200844 - DNA, 11 bp, Homo sapiens
gaccagcctgg

SEQ ID NO: 4200845 - DNA, 14 bp, Homo sapiens
gaccagtactggga

SEQ ID NO: 4200846 - DNA, 22 bp, Homo sapiens
gacccaactttctcactgctgt

SEQ ID NO: 4200847 - DNA, 12 bp, Homo sapiens
gacccacctgga

SEQ ID NO: 4200848 - DNA, 15 bp, Homo sapiens
gacccagatcctcac

SEQ ID NO: 4200849 - DNA, 20 bp, Homo sapiens
gacccagatcctcacaacca

SEQ ID NO: 4200850 - DNA, 16 bp, Homo sapiens
gacccagctcctctga

SEQ ID NO: 4200851 - DNA, 20 bp, Homo sapiens
gacccagctcctctgagcca

SEQ ID NO: 4200852 - DNA, 11 bp, Homo sapiens
gacccatctgt

SEQ ID NO: 4200853 - DNA, 16 bp, Homo sapiens
gaccccaaagagcctg

SEQ ID NO: 4200854 - DNA, 15 bp, Homo sapiens
ttagatctggcatgt

SEQ ID NO: 4200855 - DNA, 17 bp, Homo sapiens
ttagattgtctatctgt

SEQ ID NO: 4200856 - DNA, 19 bp, Homo sapiens
ttagcagctatgtaaatga

SEQ ID NO: 4200857 - DNA, 15 bp, Homo sapiens
ttagcccttccctgc

SEQ ID NO: 4200858 - DNA, 12 bp, Homo sapiens
ttagcctcttcc

SEQ ID NO: 4200859 - DNA, 18 bp, Homo sapiens
ttagcctcttccctctga

SEQ ID NO: 4200860 - DNA, 10 bp, Homo sapiens
ttagctgagc

SEQ ID NO: 4200861 - DNA, 16 bp, Homo sapiens
ttagctggagaactag

SEQ ID NO: 4200862 - DNA, 11 bp, Homo sapiens
ttaggaaataa

SEQ ID NO: 4200863 - DNA, 12 bp, Homo sapiens
ttaggaaataaa

SEQ ID NO: 4200864 - DNA, 17 bp, Homo sapiens
ttaggaaataaaacctt

SEQ ID NO: 4200865 - DNA, 18 bp, Homo sapiens
ttaggaaataaaaccttt

SEQ ID NO: 4200866 - DNA, 21 bp, Homo sapiens
ttaggaaataaaacctttcaa

SEQ ID NO: 4200867 - DNA, 23 bp, Homo sapiens
ttaggaacagctcttcactcagc

SEQ ID NO: 4200868 - DNA, 21 bp, Homo sapiens
ttaggagttcgagaccagcct

SEQ ID NO: 4200869 - DNA, 13 bp, Homo sapiens
ttaggcagcctgc

SEQ ID NO: 4200870 - DNA, 14 bp, Homo sapiens
ttaggcatgcctaa

SEQ ID NO: 4200871 - DNA, 14 bp, Homo sapiens
ttaggtttgtcaac

SEQ ID NO: 4200872 - DNA, 12 bp, Homo sapiens
ttagtggctttt

SEQ ID NO: 4200873 - DNA, 13 bp, Homo sapiens
ttagttaatatat

SEQ ID NO: 4200874 - DNA, 15 bp, Homo sapiens
ttagttatagtttca

SEQ ID NO: 4200875 - DNA, 18 bp, Homo sapiens
ttagttatagtttcagat

SEQ ID NO: 4200876 - DNA, 18 bp, Homo sapiens
ttagtttttaacaatcta

SEQ ID NO: 4200877 - DNA, 23 bp, Homo sapiens
ttagtttttaacaatctaacaat

SEQ ID NO: 4200878 - DNA, 20 bp, Homo sapiens
ttataaattcataactggta

SEQ ID NO: 4200879 - DNA, 14 bp, Homo sapiens
ttataacttctgaa

SEQ ID NO: 4200880 - DNA, 16 bp, Homo sapiens
ttatacacaacattta

SEQ ID NO: 4200881 - DNA, 12 bp, Homo sapiens
ttatacacagaa

SEQ ID NO: 4200882 - DNA, 19 bp, Homo sapiens
ttatagagggccaagactt

SEQ ID NO: 4200883 - DNA, 17 bp, Homo sapiens
ttatagctattactgtc

SEQ ID NO: 4200884 - DNA, 17 bp, Homo sapiens
aaatatcctttggaaca

SEQ ID NO: 4200885 - DNA, 23 bp, Homo sapiens
aaatatgagtggttattgaaaat

SEQ ID NO: 4200886 - DNA, 13 bp, Homo sapiens
aaatatgtaccaa

SEQ ID NO: 4200887 - DNA, 17 bp, Homo sapiens
aaatatgtttaaaaact

SEQ ID NO: 4200888 - DNA, 22 bp, Homo sapiens
aaatattaccaaaaaagtattt

SEQ ID NO: 4200889 - DNA, 17 bp, Homo sapiens
aaatattatgagatgct

SEQ ID NO: 4200890 - DNA, 16 bp, Homo sapiens
aaatattcatgcttct

SEQ ID NO: 4200891 - DNA, 19 bp, Homo sapiens
aaatattgaataagtattc

SEQ ID NO: 4200892 - DNA, 15 bp, Homo sapiens
aaatatttatatatt

SEQ ID NO: 4200893 - DNA, 16 bp, Homo sapiens
aaatattttaaagaat

SEQ ID NO: 4200894 - DNA, 11 bp, Homo sapiens
aaatcaaagaa

SEQ ID NO: 4200895 - DNA, 19 bp, Homo sapiens
aaatcaccacaaactgtaa

SEQ ID NO: 4200896 - DNA, 18 bp, Homo sapiens
aaatcagcacatttgaaa

SEQ ID NO: 4200897 - DNA, 13 bp, Homo sapiens
aaatcagtaattg

SEQ ID NO: 4200898 - DNA, 11 bp, Homo sapiens
aaatcagttgt

SEQ ID NO: 4200899 - DNA, 19 bp, Homo sapiens
aaatccttagatctggcat

SEQ ID NO: 4200900 - DNA, 19 bp, Homo sapiens
aaatcctttttctttataa

SEQ ID NO: 4200901 - DNA, 17 bp, Homo sapiens
aaatctaatattaaaaa

SEQ ID NO: 4200902 - DNA, 18 bp, Homo sapiens
aaatctaatattaaaaat

SEQ ID NO: 4200903 - DNA, 20 bp, Homo sapiens
aaatcttggttgatgccaaa

SEQ ID NO: 4200904 - DNA, 22 bp, Homo sapiens
aaatgaaatttttcaatatttg

SEQ ID NO: 4200905 - DNA, 14 bp, Homo sapiens
aaatgaatagagag

SEQ ID NO: 4200906 - DNA, 21 bp, Homo sapiens
aaatgagtgatctcaaatcca

SEQ ID NO: 4200907 - DNA, 13 bp, Homo sapiens
aaatgcctcttaa

SEQ ID NO: 4200908 - DNA, 16 bp, Homo sapiens
aaatgccttttcccaa

SEQ ID NO: 4200909 - DNA, 14 bp, Homo sapiens
aaatgctgcttctc

SEQ ID NO: 4200910 - DNA, 20 bp, Homo sapiens
aaatgctggggtcatataaa

SEQ ID NO: 4200911 - DNA, 14 bp, Homo sapiens
aaatggaaatgtaa

SEQ ID NO: 4200912 - DNA, 17 bp, Homo sapiens
aaatggaaatgtaataa

SEQ ID NO: 4200913 - DNA, 20 bp, Homo sapiens
aaatgggttggtgcttctaa

SEQ ID NO: 4200914 - DNA, 16 bp, Homo sapiens
aaatgtaataataatg

SEQ ID NO: 4200915 - DNA, 18 bp, Homo sapiens
aaatgtacatactatgtt

SEQ ID NO: 4200916 - DNA, 18 bp, Homo sapiens
aaatgtctatagagaaaa

SEQ ID NO: 4200917 - DNA, 19 bp, Homo sapiens
aaatgtgtgttgtaacaaa

SEQ ID NO: 4200918 - DNA, 23 bp, Homo sapiens
aaatgttgaaatatgatgttaaa

SEQ ID NO: 4200919 - DNA, 13 bp, Homo sapiens
aaatgttttacaa

SEQ ID NO: 4200920 - DNA, 18 bp, Homo sapiens
aaattaacagtcctaact

SEQ ID NO: 4200921 - DNA, 23 bp, Homo sapiens
aaattagaaaccttaatatgtgg

SEQ ID NO: 4200922 - DNA, 18 bp, Homo sapiens
aaattagatctagctaat

SEQ ID NO: 4200923 - DNA, 13 bp, Homo sapiens
aaattagtaattg

SEQ ID NO: 4200924 - DNA, 15 bp, Homo sapiens
aaattagtaattgta

SEQ ID NO: 4200925 - DNA, 18 bp, Homo sapiens
aaattattaatttatgca

SEQ ID NO: 4200926 - DNA, 21 bp, Homo sapiens
aaattatttgtgtaatagaaa

SEQ ID NO: 4200927 - DNA, 23 bp, Homo sapiens
aaattatttgtgtaatagaaaac

SEQ ID NO: 4200928 - DNA, 13 bp, Homo sapiens
aaattattttatc

SEQ ID NO: 4200929 - DNA, 14 bp, Homo sapiens
aaattgaatgcaaa

SEQ ID NO: 4200930 - DNA, 15 bp, Homo sapiens
aaattgaatgcaaac

SEQ ID NO: 4200931 - DNA, 15 bp, Homo sapiens
aaattggaattttct

SEQ ID NO: 4200932 - DNA, 16 bp, Homo sapiens
aaattggtgggaagca

SEQ ID NO: 4200933 - DNA, 14 bp, Homo sapiens
aaatttaaactata

SEQ ID NO: 4200934 - DNA, 12 bp, Homo sapiens
aaatttcaaaag

SEQ ID NO: 4200935 - DNA, 22 bp, Homo sapiens
aaatttccattcccaaaataac

SEQ ID NO: 4200936 - DNA, 14 bp, Homo sapiens
aaatttgaagtaaa

SEQ ID NO: 4200937 - DNA, 16 bp, Homo sapiens
aaatttttatttttga

SEQ ID NO: 4200938 - DNA, 13 bp, Homo sapiens
aaatttttcctgc

SEQ ID NO: 4200939 - DNA, 16 bp, Homo sapiens
aacaaaaagacatgga

SEQ ID NO: 4200940 - DNA, 14 bp, Homo sapiens
aacaaaacaacaac

SEQ ID NO: 4200941 - DNA, 13 bp, Homo sapiens
aacaacaacaata

SEQ ID NO: 4200942 - DNA, 21 bp, Homo sapiens
aacaacaattttaaataagat

SEQ ID NO: 4200943 - DNA, 19 bp, Homo sapiens
aacaagaaattgtttcttt

SEQ ID NO: 4200944 - DNA, 14 bp, Homo sapiens
aacaagaccctgtc

SEQ ID NO: 4200945 - DNA, 23 bp, Homo sapiens
aacaagtatttgttaatttagaa

SEQ ID NO: 4200946 - DNA, 15 bp, Homo sapiens
aacaataaagactga

SEQ ID NO: 4200947 - DNA, 15 bp, Homo sapiens
aacaataacaacaat

SEQ ID NO: 4200948 - DNA, 22 bp, Homo sapiens
aacaatacaacaagaacaacaa

SEQ ID NO: 4200949 - DNA, 23 bp, Homo sapiens
aacaatacaacaagaacaacaac

SEQ ID NO: 4200950 - DNA, 19 bp, Homo sapiens
aacaatctaacaataatat

SEQ ID NO: 4200951 - DNA, 20 bp, Homo sapiens
aacaatggtttacatgaaca

SEQ ID NO: 4200952 - DNA, 14 bp, Homo sapiens
aacaattattgtac

SEQ ID NO: 4200953 - DNA, 14 bp, Homo sapiens
aacaattttaaata

SEQ ID NO: 4200954 - DNA, 17 bp, Homo sapiens
aacaattttaaataaga

SEQ ID NO: 4200955 - DNA, 17 bp, Homo sapiens
aacacaaagacatggaa

SEQ ID NO: 4200956 - DNA, 19 bp, Homo sapiens
aacacaaagacatggaaga

SEQ ID NO: 4200957 - DNA, 14 bp, Homo sapiens
aacacaaatgtaaa

SEQ ID NO: 4200958 - DNA, 19 bp, Homo sapiens
aacacagctgagagacttt

SEQ ID NO: 4200959 - DNA, 16 bp, Homo sapiens
aacacagctgctgaag

SEQ ID NO: 4200960 - DNA, 21 bp, Homo sapiens
aacacagctgctgaagaggca

SEQ ID NO: 4200961 - DNA, 22 bp, Homo sapiens
aacacagctgctgaagaggcaa

SEQ ID NO: 4200962 - DNA, 20 bp, Homo sapiens
aacacaggtgttggaagcca

SEQ ID NO: 4200963 - DNA, 17 bp, Homo sapiens
aacacataactagaaac

SEQ ID NO: 4200964 - DNA, 21 bp, Homo sapiens
aacacataactagaaacctga

SEQ ID NO: 4200965 - DNA, 17 bp, Homo sapiens
aacacatctttcctgtc

SEQ ID NO: 4200966 - DNA, 13 bp, Homo sapiens
aacaccggcagaa

SEQ ID NO: 4200967 - DNA, 22 bp, Homo sapiens
aacacctttgttttgcactgac

SEQ ID NO: 4200968 - DNA, 21 bp, Homo sapiens
aacacgtccagaatttttcat

SEQ ID NO: 4200969 - DNA, 18 bp, Homo sapiens
aacactagacaagccaga

SEQ ID NO: 4200970 - DNA, 20 bp, Homo sapiens
aacactatccaatgaatgat

SEQ ID NO: 4200971 - DNA, 19 bp, Homo sapiens
aacactccaccccctccag

SEQ ID NO: 4200972 - DNA, 14 bp, Homo sapiens
aacacttaggaaga

SEQ ID NO: 4200973 - DNA, 16 bp, Homo sapiens
aacacttatcttctgg

SEQ ID NO: 4200974 - DNA, 24 bp, Homo sapiens
aacagaagaggagggacctactga

SEQ ID NO: 4200975 - DNA, 13 bp, Homo sapiens
aacagactattta

SEQ ID NO: 4200976 - DNA, 20 bp, Homo sapiens
aacagactatttaacttgag

SEQ ID NO: 4200977 - DNA, 12 bp, Homo sapiens
aacagagagaac

SEQ ID NO: 4200978 - DNA, 21 bp, Homo sapiens
aacagatggtagagagagttg

SEQ ID NO: 4200979 - DNA, 15 bp, Homo sapiens
aacagcaaggaaaca

SEQ ID NO: 4200980 - DNA, 15 bp, Homo sapiens
aacagccaacaggtg

SEQ ID NO: 4200981 - DNA, 20 bp, Homo sapiens
aacagcctgggtaggaaaat

SEQ ID NO: 4200982 - DNA, 17 bp, Homo sapiens
aacaggagacaggaagg

SEQ ID NO: 4200983 - DNA, 21 bp, Homo sapiens
aacaggtggcaggaccaggac

SEQ ID NO: 4200984 - DNA, 22 bp, Homo sapiens
aacaggtggcaggaccaggact

SEQ ID NO: 4200985 - DNA, 20 bp, Homo sapiens
aacagttttcctatgctttg

SEQ ID NO: 4200986 - DNA, 21 bp, Homo sapiens
aacagttttcctatgctttga

SEQ ID NO: 4200987 - DNA, 13 bp, Homo sapiens
aacataaaaatga

SEQ ID NO: 4200988 - DNA, 16 bp, Homo sapiens
aacataaaacaatgaa

SEQ ID NO: 4200989 - DNA, 19 bp, Homo sapiens
aacatcattactataagaa

SEQ ID NO: 4200990 - DNA, 22 bp, Homo sapiens
aacatcattctacataatggaa

SEQ ID NO: 4200991 - DNA, 21 bp, Homo sapiens
aacatctattataaaaccatg

SEQ ID NO: 4200992 - DNA, 21 bp, Homo sapiens
aacatgaaaaacacggcagct

SEQ ID NO: 4200993 - DNA, 20 bp, Homo sapiens
aacatgcaattggggaagaa

SEQ ID NO: 4200994 - DNA, 19 bp, Homo sapiens
aacatggaatttaatttat

SEQ ID NO: 4200995 - DNA, 22 bp, Homo sapiens
aacatggaatttaatttatgtg

SEQ ID NO: 4200996 - DNA, 18 bp, Homo sapiens
aacattaacatctattat

SEQ ID NO: 4200997 - DNA, 17 bp, Homo sapiens
aacattcaaagcagcag

SEQ ID NO: 4200998 - DNA, 17 bp, Homo sapiens
aacatttattttgacat

SEQ ID NO: 4200999 - DNA, 22 bp, Homo sapiens
aacatttctatagccaaaaata

SEQ ID NO: 4201000 - DNA, 14 bp, Homo sapiens
aacatttgcaaaat

SEQ ID NO: 4201001 - DNA, 17 bp, Homo sapiens
aaccaaccacaaaccac

SEQ ID NO: 4201002 - DNA, 13 bp, Homo sapiens
aaccaatgtggca

SEQ ID NO: 4201003 - DNA, 22 bp, Homo sapiens
aaccaggattttgtgttttttc

SEQ ID NO: 4201004 - DNA, 14 bp, Homo sapiens
aaccagtgtagcct

SEQ ID NO: 4201005 - DNA, 23 bp, Homo sapiens
aaccatagttatttacttgaaag

SEQ ID NO: 4201006 - DNA, 21 bp, Homo sapiens
aaccattaatgaaaacttttt

SEQ ID NO: 4201007 - DNA, 18 bp, Homo sapiens
aaccattatttaataaga

SEQ ID NO: 4201008 - DNA, 19 bp, Homo sapiens
aaccattatttaataagag

SEQ ID NO: 4201009 - DNA, 21 bp, Homo sapiens
aacccaaatgtccaatataaa

SEQ ID NO: 4201010 - DNA, 21 bp, Homo sapiens
aacccccacatttacctcgag

SEQ ID NO: 4201011 - DNA, 18 bp, Homo sapiens
aacccccgctccagatct

SEQ ID NO: 4201012 - DNA, 11 bp, Homo sapiens
aacccctgtgt

SEQ ID NO: 4201013 - DNA, 12 bp, Homo sapiens
aacccctgtgtc

SEQ ID NO: 4201014 - DNA, 15 bp, Homo sapiens
aaccctctcttccct

SEQ ID NO: 4201015 - DNA, 23 bp, Homo sapiens
aaccctctcttccctattatttc

SEQ ID NO: 4201016 - DNA, 16 bp, Homo sapiens
aaccgctaaaagaaac

SEQ ID NO: 4201017 - DNA, 15 bp, Homo sapiens
aacctagaacttcaa

SEQ ID NO: 4201018 - DNA, 18 bp, Homo sapiens
aatcatctgtgtgaaaat

SEQ ID NO: 4201019 - DNA, 13 bp, Homo sapiens
aatcattttgcaa

SEQ ID NO: 4201020 - DNA, 20 bp, Homo sapiens
aatccaatctgtaatttcac

SEQ ID NO: 4201021 - DNA, 21 bp, Homo sapiens
aatccacaaagccgtgccttt

SEQ ID NO: 4201022 - DNA, 18 bp, Homo sapiens
aatccacaagccattttt

SEQ ID NO: 4201023 - DNA, 22 bp, Homo sapiens
aatccagatctgggattatgta

SEQ ID NO: 4201024 - DNA, 17 bp, Homo sapiens
aatccatgttagttttt

SEQ ID NO: 4201025 - DNA, 17 bp, Homo sapiens
aatccccaagctggcag

SEQ ID NO: 4201026 - DNA, 21 bp, Homo sapiens
aatcccttaatatcctaaaca

SEQ ID NO: 4201027 - DNA, 17 bp, Homo sapiens
aatccgcctgcagagga

SEQ ID NO: 4201028 - DNA, 20 bp, Homo sapiens
aatccttagatctggcatgt

SEQ ID NO: 4201029 - DNA, 23 bp, Homo sapiens
aatctaacaataatatttcaagt

SEQ ID NO: 4201030 - DNA, 14 bp, Homo sapiens
aatctaactacaag

SEQ ID NO: 4201031 - DNA, 17 bp, Homo sapiens
aatctaatattaaaaat

SEQ ID NO: 4201032 - DNA, 17 bp, Homo sapiens
aatctaatgtaagaaaa

SEQ ID NO: 4201033 - DNA, 21 bp, Homo sapiens
aatctcagttgattttctgga

SEQ ID NO: 4201034 - DNA, 11 bp, Homo sapiens
aatctccaggg

SEQ ID NO: 4201035 - DNA, 22 bp, Homo sapiens
aatctccagggctgcccctgta

SEQ ID NO: 4201036 - DNA, 23 bp, Homo sapiens
aatctccagggctgcccctgtag

SEQ ID NO: 4201037 - DNA, 12 bp, Homo sapiens
aatctgagcaaa

SEQ ID NO: 4201038 - DNA, 17 bp, Homo sapiens
aatctggcttagtgcca

SEQ ID NO: 4201039 - DNA, 18 bp, Homo sapiens
aatctggcttagtgccac

SEQ ID NO: 4201040 - DNA, 23 bp, Homo sapiens
aatctggcttctggccaggaagc

SEQ ID NO: 4201041 - DNA, 15 bp, Homo sapiens
aatctgggactttca

SEQ ID NO: 4201042 - DNA, 14 bp, Homo sapiens
aatctgtaatttca

SEQ ID NO: 4201043 - DNA, 21 bp, Homo sapiens
aatctttcagcactcagaaaa

SEQ ID NO: 4201044 - DNA, 16 bp, Homo sapiens
aatgaaacaaagagtt

SEQ ID NO: 4201045 - DNA, 14 bp, Homo sapiens
aatgaaaccaaagc

SEQ ID NO: 4201046 - DNA, 17 bp, Homo sapiens
aatgaaaccaaagccag

SEQ ID NO: 4201047 - DNA, 14 bp, Homo sapiens
aatgaaattaactg

SEQ ID NO: 4201048 - DNA, 14 bp, Homo sapiens
aatgaacagaacat

SEQ ID NO: 4201049 - DNA, 22 bp, Homo sapiens
aatgaacagaacatagacagaa

SEQ ID NO: 4201050 - DNA, 13 bp, Homo sapiens
aatgacaacagaa

SEQ ID NO: 4201051 - DNA, 16 bp, Homo sapiens
aatgacaacattgcat

SEQ ID NO: 4201052 - DNA, 20 bp, Homo sapiens
aatgagaaaatggctttaat

SEQ ID NO: 4201053 - DNA, 21 bp, Homo sapiens
aatgagggactggaaccaggg

SEQ ID NO: 4201054 - DNA, 14 bp, Homo sapiens
aatgataacttgtt

SEQ ID NO: 4201055 - DNA, 15 bp, Homo sapiens
aatgatatccagtaa

SEQ ID NO: 4201056 - DNA, 21 bp, Homo sapiens
aatgatcctgtattcagacag

SEQ ID NO: 4201057 - DNA, 23 bp, Homo sapiens
aatgatcctgtattcagacagat

SEQ ID NO: 4201058 - DNA, 17 bp, Homo sapiens
aatgatgttatagaatt

SEQ ID NO: 4201059 - DNA, 14 bp, Homo sapiens
aatgattgtaaaat

SEQ ID NO: 4201060 - DNA, 16 bp, Homo sapiens
aatgatttttgctatt

SEQ ID NO: 4201061 - DNA, 13 bp, Homo sapiens
aatgcacactagc

SEQ ID NO: 4201062 - DNA, 15 bp, Homo sapiens
aatgcacctaaagaa

SEQ ID NO: 4201063 - DNA, 19 bp, Homo sapiens
aatgccaagcacttctttt

SEQ ID NO: 4201064 - DNA, 22 bp, Homo sapiens
aatgccatgatgcctctgtctt

SEQ ID NO: 4201065 - DNA, 12 bp, Homo sapiens
aatgcctcctcc

SEQ ID NO: 4201066 - DNA, 20 bp, Homo sapiens
aatgcctcttaaattatata

SEQ ID NO: 4201067 - DNA, 22 bp, Homo sapiens
aatgcctgactagggagccatg

SEQ ID NO: 4201068 - DNA, 21 bp, Homo sapiens
aatgctggggtcatataaaat

SEQ ID NO: 4201069 - DNA, 14 bp, Homo sapiens
aatgcttaatcaga

SEQ ID NO: 4201070 - DNA, 17 bp, Homo sapiens
aatgctttttgaatgtt

SEQ ID NO: 4201071 - DNA, 18 bp, Homo sapiens
aatggaaaacatttacat

SEQ ID NO: 4201072 - DNA, 13 bp, Homo sapiens
aatggactcatgg

SEQ ID NO: 4201073 - DNA, 14 bp, Homo sapiens
aatggagggagcca

SEQ ID NO: 4201074 - DNA, 14 bp, Homo sapiens
aatggagtgggaga

SEQ ID NO: 4201075 - DNA, 22 bp, Homo sapiens
aatggcaaagcggttgcttctg

SEQ ID NO: 4201076 - DNA, 23 bp, Homo sapiens
aatggcaaagcggttgcttctgg

SEQ ID NO: 4201077 - DNA, 19 bp, Homo sapiens
aatggcagcagttccatga

SEQ ID NO: 4201078 - DNA, 22 bp, Homo sapiens
aatggcagcagttccatgaaga

SEQ ID NO: 4201079 - DNA, 23 bp, Homo sapiens
aatggcatgagaaatacaaaaat

SEQ ID NO: 4201080 - DNA, 16 bp, Homo sapiens
aatggctgataatttt

SEQ ID NO: 4201081 - DNA, 20 bp, Homo sapiens
aatggggcttgccctgggtc

SEQ ID NO: 4201082 - DNA, 16 bp, Homo sapiens
aatggttaattcttca

SEQ ID NO: 4201083 - DNA, 15 bp, Homo sapiens
aatggttgccttaaa

SEQ ID NO: 4201084 - DNA, 18 bp, Homo sapiens
aatggttgccttaaagaa

SEQ ID NO: 4201085 - DNA, 15 bp, Homo sapiens
aatgtaaagccatgc

SEQ ID NO: 4201086 - DNA, 16 bp, Homo sapiens
aatgtaaatattttaa

SEQ ID NO: 4201087 - DNA, 17 bp, Homo sapiens
aatgtaaatattttaaa

SEQ ID NO: 4201088 - DNA, 22 bp, Homo sapiens
aatgtaaatattttaaagaatt

SEQ ID NO: 4201089 - DNA, 13 bp, Homo sapiens
aatgtatagtaaa

SEQ ID NO: 4201090 - DNA, 13 bp, Homo sapiens
aatgtatcccatt

SEQ ID NO: 4201091 - DNA, 20 bp, Homo sapiens
aatgtatgctaattgaacat

SEQ ID NO: 4201092 - DNA, 17 bp, Homo sapiens
aatgtatttatatgtta

SEQ ID NO: 4201093 - DNA, 14 bp, Homo sapiens
aatgtccaaaatgt

SEQ ID NO: 4201094 - DNA, 13 bp, Homo sapiens
aatgtctgttttc

SEQ ID NO: 4201095 - DNA, 14 bp, Homo sapiens
aatgtgaatctctt

SEQ ID NO: 4201096 - DNA, 13 bp, Homo sapiens
aatgtgacaacat

SEQ ID NO: 4201097 - DNA, 15 bp, Homo sapiens
aatgtgaccaggggt

SEQ ID NO: 4201098 - DNA, 21 bp, Homo sapiens
aatgtgtgttgtaacaaatat

SEQ ID NO: 4201099 - DNA, 21 bp, Homo sapiens
aatgttatttgttattttcag

SEQ ID NO: 4201100 - DNA, 22 bp, Homo sapiens
aatgttatttgttattttcagt

SEQ ID NO: 4201101 - DNA, 15 bp, Homo sapiens
aatgtttaaaccttt

SEQ ID NO: 4201102 - DNA, 18 bp, Homo sapiens
aatgtttatgttctcaga

SEQ ID NO: 4201103 - DNA, 21 bp, Homo sapiens
aatgtttatgttctcagaatc

SEQ ID NO: 4201104 - DNA, 16 bp, Homo sapiens
aatgtttattccttga

SEQ ID NO: 4201105 - DNA, 13 bp, Homo sapiens
aatgtttcaaatc

SEQ ID NO: 4201106 - DNA, 23 bp, Homo sapiens
aatgtttgggcagaagggagaag

SEQ ID NO: 4201107 - DNA, 23 bp, Homo sapiens
aatgttttacaagaattgtccat

SEQ ID NO: 4201108 - DNA, 19 bp, Homo sapiens
aattaactatgtgatgtta

SEQ ID NO: 4201109 - DNA, 21 bp, Homo sapiens
aattaactgggtaatgaaaca

SEQ ID NO: 4201110 - DNA, 18 bp, Homo sapiens
aattaagtaaaccaaaaa

SEQ ID NO: 4201111 - DNA, 20 bp, Homo sapiens
aattaatgtgtgtctgaaga

SEQ ID NO: 4201112 - DNA, 17 bp, Homo sapiens
aattaccagatagttat

SEQ ID NO: 4201113 - DNA, 19 bp, Homo sapiens
aattagcagaagtgaccaa

SEQ ID NO: 4201114 - DNA, 14 bp, Homo sapiens
aattagccgggcgt

SEQ ID NO: 4201115 - DNA, 12 bp, Homo sapiens
aattataagatg

SEQ ID NO: 4201116 - DNA, 12 bp, Homo sapiens
aattatatattt

SEQ ID NO: 4201117 - DNA, 13 bp, Homo sapiens
aattatatctgtt

SEQ ID NO: 4201118 - DNA, 14 bp, Homo sapiens
aattatatttttgt

SEQ ID NO: 4201119 - DNA, 17 bp, Homo sapiens
aattatcagtcatgagg

SEQ ID NO: 4201120 - DNA, 21 bp, Homo sapiens
aattatgaggtgaaacaatta

SEQ ID NO: 4201121 - DNA, 20 bp, Homo sapiens
aattattatgtctcaaaata

SEQ ID NO: 4201122 - DNA, 21 bp, Homo sapiens
aattatttgtgtaatagaaaa

SEQ ID NO: 4201123 - DNA, 12 bp, Homo sapiens
aattcactctga

SEQ ID NO: 4201124 - DNA, 19 bp, Homo sapiens
aattccatatgctccagga

SEQ ID NO: 4201125 - DNA, 11 bp, Homo sapiens
aattcctgggc

SEQ ID NO: 4201126 - DNA, 12 bp, Homo sapiens
aattctaaaatg

SEQ ID NO: 4201127 - DNA, 20 bp, Homo sapiens
aattctgagatccagcacaa

SEQ ID NO: 4201128 - DNA, 15 bp, Homo sapiens
aattcttaaatttct

SEQ ID NO: 4201129 - DNA, 21 bp, Homo sapiens
aattcttccagtgcaacaaaa

SEQ ID NO: 4201130 - DNA, 22 bp, Homo sapiens
aattgatagcaggtgtaataag

SEQ ID NO: 4201131 - DNA, 19 bp, Homo sapiens
aattgcctgcagagagaag

SEQ ID NO: 4201132 - DNA, 21 bp, Homo sapiens
aattgctttgccaaaatacca

SEQ ID NO: 4201133 - DNA, 23 bp, Homo sapiens
aattgctttgccaaaataccaga

SEQ ID NO: 4201134 - DNA, 18 bp, Homo sapiens
aattggggaagaaaaaat

SEQ ID NO: 4201135 - DNA, 14 bp, Homo sapiens
aattggtgggaagc

SEQ ID NO: 4201136 - DNA, 18 bp, Homo sapiens
aattgtaaaattgtatag

SEQ ID NO: 4201137 - DNA, 17 bp, Homo sapiens
aattgtactaaagccaa

SEQ ID NO: 4201138 - DNA, 13 bp, Homo sapiens
aattgtatagaga

SEQ ID NO: 4201139 - DNA, 17 bp, Homo sapiens
aattgtatttttgtatg

SEQ ID NO: 4201140 - DNA, 19 bp, Homo sapiens
aattgttttatctgaattt

SEQ ID NO: 4201141 - DNA, 13 bp, Homo sapiens
aatttaaaaaata

SEQ ID NO: 4201142 - DNA, 14 bp, Homo sapiens
aatttaaaaaataa

SEQ ID NO: 4201143 - DNA, 22 bp, Homo sapiens
aatttaaactataagcaagaag

SEQ ID NO: 4201144 - DNA, 12 bp, Homo sapiens
aatttaatttat

SEQ ID NO: 4201145 - DNA, 15 bp, Homo sapiens
aatttaatttatgtg

SEQ ID NO: 4201146 - DNA, 15 bp, Homo sapiens
aatttagaaaacttt

SEQ ID NO: 4201147 - DNA, 14 bp, Homo sapiens
aatttagaaatcat

SEQ ID NO: 4201148 - DNA, 15 bp, Homo sapiens
aatttagaaatcatt

SEQ ID NO: 4201149 - DNA, 12 bp, Homo sapiens
aatttagtttca

SEQ ID NO: 4201150 - DNA, 19 bp, Homo sapiens
aatttattagttaatatat

SEQ ID NO: 4201151 - DNA, 17 bp, Homo sapiens
aatttattgtctgtcta

SEQ ID NO: 4201152 - DNA, 13 bp, Homo sapiens
aatttattttctt

SEQ ID NO: 4201153 - DNA, 19 bp, Homo sapiens
acctgctggaaaccacact

SEQ ID NO: 4201154 - DNA, 23 bp, Homo sapiens
acctgcttcatgctcagccctga

SEQ ID NO: 4201155 - DNA, 22 bp, Homo sapiens
acctgcttctcagcgcaacagc

SEQ ID NO: 4201156 - DNA, 14 bp, Homo sapiens
acctggccagaggc

SEQ ID NO: 4201157 - DNA, 16 bp, Homo sapiens
acctgggcccacagag

SEQ ID NO: 4201158 - DNA, 22 bp, Homo sapiens
acctgggcccacagagcctggc

SEQ ID NO: 4201159 - DNA, 23 bp, Homo sapiens
acctgggcccacagagcctggct

SEQ ID NO: 4201160 - DNA, 12 bp, Homo sapiens
acctgtactcag

SEQ ID NO: 4201161 - DNA, 18 bp, Homo sapiens
acctgtcaccgtgagcag

SEQ ID NO: 4201162 - DNA, 20 bp, Homo sapiens
acctgtctgtctgtctgtcc

SEQ ID NO: 4201163 - DNA, 14 bp, Homo sapiens
acctgttgagcatc

SEQ ID NO: 4201164 - DNA, 19 bp, Homo sapiens
acctgttgagcatcacaga

SEQ ID NO: 4201165 - DNA, 16 bp, Homo sapiens
accttaccaactttct

SEQ ID NO: 4201166 - DNA, 19 bp, Homo sapiens
accttaccaactttctgta

SEQ ID NO: 4201167 - DNA, 14 bp, Homo sapiens
accttagtggcttt

SEQ ID NO: 4201168 - DNA, 18 bp, Homo sapiens
accttcaattcctgggcc

SEQ ID NO: 4201169 - DNA, 9 bp, Homo sapiens
accttcccc

SEQ ID NO: 4201170 - DNA, 9 bp, Homo sapiens
accttccct

SEQ ID NO: 4201171 - DNA, 15 bp, Homo sapiens
accttccctctttct

SEQ ID NO: 4201172 - DNA, 22 bp, Homo sapiens
accttctcaaaagattgtttta

SEQ ID NO: 4201173 - DNA, 22 bp, Homo sapiens
accttctctatggggcatcctc

SEQ ID NO: 4201174 - DNA, 17 bp, Homo sapiens
accttggactcctccca

SEQ ID NO: 4201175 - DNA, 16 bp, Homo sapiens
accttggtaaattgta

SEQ ID NO: 4201176 - DNA, 18 bp, Homo sapiens
accttggtaaattgtaaa

SEQ ID NO: 4201177 - DNA, 14 bp, Homo sapiens
accttgttttctct

SEQ ID NO: 4201178 - DNA, 17 bp, Homo sapiens
accttgttttctctata

SEQ ID NO: 4201179 - DNA, 17 bp, Homo sapiens
acctttcaaatttcaca

SEQ ID NO: 4201180 - DNA, 20 bp, Homo sapiens
acctttcttcaccaaatctt

SEQ ID NO: 4201181 - DNA, 19 bp, Homo sapiens
acctttgggatcagcctcc

SEQ ID NO: 4201182 - DNA, 17 bp, Homo sapiens
acctttgtccaggcctg

SEQ ID NO: 4201183 - DNA, 18 bp, Homo sapiens
acctttgttttgcactga

SEQ ID NO: 4201184 - DNA, 23 bp, Homo sapiens
accttttttcaacagtgaagaca

SEQ ID NO: 4201185 - DNA, 19 bp, Homo sapiens
acgagaccctacaggagag

SEQ ID NO: 4201186 - DNA, 21 bp, Homo sapiens
acgcaaagggctgaaagccat

SEQ ID NO: 4201187 - DNA, 19 bp, Homo sapiens
acgcacacatggacacaga

SEQ ID NO: 4201188 - DNA, 16 bp, Homo sapiens
acgcaggaactcccag

SEQ ID NO: 4201189 - DNA, 14 bp, Homo sapiens
acgccaacagcccc

SEQ ID NO: 4201190 - DNA, 22 bp, Homo sapiens
acgccactgcactccagcctgg

SEQ ID NO: 4201191 - DNA, 23 bp, Homo sapiens
acgccactgcactccagcctggg

SEQ ID NO: 4201192 - DNA, 23 bp, Homo sapiens
acgccattgtactccagcctggg

SEQ ID NO: 4201193 - DNA, 16 bp, Homo sapiens
acgcctgtaatcccag

SEQ ID NO: 4201194 - DNA, 21 bp, Homo sapiens
acgcctgtaatcccagcactt

SEQ ID NO: 4201195 - DNA, 15 bp, Homo sapiens
acgcgcacacacacc

SEQ ID NO: 4201196 - DNA, 12 bp, Homo sapiens
acgctctggaca

SEQ ID NO: 4201197 - DNA, 22 bp, Homo sapiens
acggaagaagagatcaggaaga

SEQ ID NO: 4201198 - DNA, 22 bp, Homo sapiens
acggagagtgcttgggtggtgg

SEQ ID NO: 4201199 - DNA, 21 bp, Homo sapiens
acggagcctggagggatgcca

SEQ ID NO: 4201200 - DNA, 15 bp, Homo sapiens
acggcagctgtagct

SEQ ID NO: 4201201 - DNA, 18 bp, Homo sapiens
acgggttaagatctgaaa

SEQ ID NO: 4201202 - DNA, 19 bp, Homo sapiens
acggtcctttaggcagcct

SEQ ID NO: 4201203 - DNA, 16 bp, Homo sapiens
acgtaatgtatttata

SEQ ID NO: 4201204 - DNA, 22 bp, Homo sapiens
acgtatttatatttggaaagag

SEQ ID NO: 4201205 - DNA, 15 bp, Homo sapiens
acgtctcaagactga

SEQ ID NO: 4201206 - DNA, 16 bp, Homo sapiens
acgtgaagccacagga

SEQ ID NO: 4201207 - DNA, 22 bp, Homo sapiens
acgtgagccaggtaatgaggga

SEQ ID NO: 4201208 - DNA, 14 bp, Homo sapiens
acgtgataaatata

SEQ ID NO: 4201209 - DNA, 20 bp, Homo sapiens
acgtgcacctgtactcagga

SEQ ID NO: 4201210 - DNA, 21 bp, Homo sapiens
acgtgcacctgtactcaggag

SEQ ID NO: 4201211 - DNA, 23 bp, Homo sapiens
acgtgcacctgtactcaggaggc

SEQ ID NO: 4201212 - DNA, 18 bp, Homo sapiens
acgtgggtatttcctgct

SEQ ID NO: 4201213 - DNA, 19 bp, Homo sapiens
acgtgggtatttcctgcta

SEQ ID NO: 4201214 - DNA, 13 bp, Homo sapiens
acgtgttctatag

SEQ ID NO: 4201215 - DNA, 20 bp, Homo sapiens
acgtgttctatagagcctgg

SEQ ID NO: 4201216 - DNA, 14 bp, Homo sapiens
acgttcggggcatg

SEQ ID NO: 4201217 - DNA, 17 bp, Homo sapiens
acgttgacccctttccc

SEQ ID NO: 4201218 - DNA, 19 bp, Homo sapiens
acgttgacccctttccccc

SEQ ID NO: 4201219 - DNA, 19 bp, Homo sapiens
acgtttaagccaaaacaat

SEQ ID NO: 4201220 - DNA, 19 bp, Homo sapiens
actaaagagacatatttat

SEQ ID NO: 4201221 - DNA, 14 bp, Homo sapiens
actaaatctctaat

SEQ ID NO: 4201222 - DNA, 14 bp, Homo sapiens
actaacttgtcttt

SEQ ID NO: 4201223 - DNA, 20 bp, Homo sapiens
actaagcaccataaccaaga

SEQ ID NO: 4201224 - DNA, 16 bp, Homo sapiens
actaagccacaagaaa

SEQ ID NO: 4201225 - DNA, 12 bp, Homo sapiens
actaatggcatg

SEQ ID NO: 4201226 - DNA, 21 bp, Homo sapiens
actaatggcatgagaaataca

SEQ ID NO: 4201227 - DNA, 22 bp, Homo sapiens
actacacactgtgtactgcagt

SEQ ID NO: 4201228 - DNA, 21 bp, Homo sapiens
actaccaagaggccctgtctg

SEQ ID NO: 4201229 - DNA, 15 bp, Homo sapiens
actacttacaggtga

SEQ ID NO: 4201230 - DNA, 15 bp, Homo sapiens
actagaaatctgcca

SEQ ID NO: 4201231 - DNA, 14 bp, Homo sapiens
actagcagaaaata

SEQ ID NO: 4201232 - DNA, 17 bp, Homo sapiens
actaggactctgaggct

SEQ ID NO: 4201233 - DNA, 14 bp, Homo sapiens
actaggaggaaaag

SEQ ID NO: 4201234 - DNA, 14 bp, Homo sapiens
actaggttctaggt

SEQ ID NO: 4201235 - DNA, 18 bp, Homo sapiens
actagtatctctggcctc

SEQ ID NO: 4201236 - DNA, 21 bp, Homo sapiens
actagttgaacatctcacttt

SEQ ID NO: 4201237 - DNA, 13 bp, Homo sapiens
actataagaactt

SEQ ID NO: 4201238 - DNA, 18 bp, Homo sapiens
actataagaactttgagc

SEQ ID NO: 4201239 - DNA, 19 bp, Homo sapiens
actataagaactttgagct

SEQ ID NO: 4201240 - DNA, 14 bp, Homo sapiens
actatagcccaggt

SEQ ID NO: 4201241 - DNA, 14 bp, Homo sapiens
actatcttcacaag

SEQ ID NO: 4201242 - DNA, 20 bp, Homo sapiens
actatcttcacaagtgtgta

SEQ ID NO: 4201243 - DNA, 19 bp, Homo sapiens
actatgaaaagctagaatt

SEQ ID NO: 4201244 - DNA, 15 bp, Homo sapiens
actatgacccattta

SEQ ID NO: 4201245 - DNA, 13 bp, Homo sapiens
actatgctgaaga

SEQ ID NO: 4201246 - DNA, 18 bp, Homo sapiens
actatggtcctgcagaaa

SEQ ID NO: 4201247 - DNA, 14 bp, Homo sapiens
actatgtgatgtta

SEQ ID NO: 4201248 - DNA, 23 bp, Homo sapiens
actatgttcatgatagtgtgatt

SEQ ID NO: 4201249 - DNA, 18 bp, Homo sapiens
actattaagagcaataaa

SEQ ID NO: 4201250 - DNA, 13 bp, Homo sapiens
actattggagggt

SEQ ID NO: 4201251 - DNA, 19 bp, Homo sapiens
actattggagggtgggaga

SEQ ID NO: 4201252 - DNA, 14 bp, Homo sapiens
actattgggaggga

SEQ ID NO: 4201253 - DNA, 17 bp, Homo sapiens
actattgggagggatga

SEQ ID NO: 4201254 - DNA, 13 bp, Homo sapiens
actattttttaat

SEQ ID NO: 4201255 - DNA, 14 bp, Homo sapiens
actattttttaata

SEQ ID NO: 4201256 - DNA, 17 bp, Homo sapiens
actattttttaataaaa

SEQ ID NO: 4201257 - DNA, 15 bp, Homo sapiens
actcaaaacttaaca

SEQ ID NO: 4201258 - DNA, 23 bp, Homo sapiens
actcaagtaccaccaagggatct

SEQ ID NO: 4201259 - DNA, 13 bp, Homo sapiens
actcaataaaaga

SEQ ID NO: 4201260 - DNA, 21 bp, Homo sapiens
actcacccatgtgccaaggtg

SEQ ID NO: 4201261 - DNA, 16 bp, Homo sapiens
actcacgatgaaattg

SEQ ID NO: 4201262 - DNA, 23 bp, Homo sapiens
actcactttcccttgtgtcaaga

SEQ ID NO: 4201263 - DNA, 20 bp, Homo sapiens
actcagaaaagaaaaccatt

SEQ ID NO: 4201264 - DNA, 16 bp, Homo sapiens
actcagaagcctgagg

SEQ ID NO: 4201265 - DNA, 18 bp, Homo sapiens
actcagaagcctgaggct

SEQ ID NO: 4201266 - DNA, 14 bp, Homo sapiens
actcaggagcctcc

SEQ ID NO: 4201267 - DNA, 16 bp, Homo sapiens
actcaggaggctgagg

SEQ ID NO: 4201268 - DNA, 17 bp, Homo sapiens
actcaggaggctgaggg

SEQ ID NO: 4201269 - DNA, 22 bp, Homo sapiens
actcagtctgtgggagctcagc

SEQ ID NO: 4201270 - DNA, 15 bp, Homo sapiens
actcataagagttta

SEQ ID NO: 4201271 - DNA, 19 bp, Homo sapiens
actcataagagtttagcac

SEQ ID NO: 4201272 - DNA, 14 bp, Homo sapiens
actcatcttttgaa

SEQ ID NO: 4201273 - DNA, 23 bp, Homo sapiens
actcatttttcatgataatgaac

SEQ ID NO: 4201274 - DNA, 22 bp, Homo sapiens
actccaccccctccagctccag

SEQ ID NO: 4201275 - DNA, 23 bp, Homo sapiens
actccaccccctccagctccagt

SEQ ID NO: 4201276 - DNA, 15 bp, Homo sapiens
actccacctccaccc

SEQ ID NO: 4201277 - DNA, 14 bp, Homo sapiens
actccagcctgagc

SEQ ID NO: 4201278 - DNA, 15 bp, Homo sapiens
actccagcctgggcg

SEQ ID NO: 4201279 - DNA, 20 bp, Homo sapiens
actccagcctgggcgacaga

SEQ ID NO: 4201280 - DNA, 19 bp, Homo sapiens
actccccaggccaggccac

SEQ ID NO: 4201281 - DNA, 14 bp, Homo sapiens
actccccgcctgtc

SEQ ID NO: 4201282 - DNA, 15 bp, Homo sapiens
actccccgcctgtcc

SEQ ID NO: 4201283 - DNA, 17 bp, Homo sapiens
actccctggctctcaga

SEQ ID NO: 4201284 - DNA, 18 bp, Homo sapiens
actccctggctctcagaa

SEQ ID NO: 4201285 - DNA, 23 bp, Homo sapiens
actccggcctgatgacagagcga

SEQ ID NO: 4201286 - DNA, 15 bp, Homo sapiens
actccggtgtgcctg

SEQ ID NO: 4201287 - DNA, 16 bp, Homo sapiens
agacagtgctgccctg

SEQ ID NO: 4201288 - DNA, 19 bp, Homo sapiens
agacagtgctgccctgcga

SEQ ID NO: 4201289 - DNA, 18 bp, Homo sapiens
agacatccatgtttgtaa

SEQ ID NO: 4201290 - DNA, 20 bp, Homo sapiens
agacatggaaggttaggttt

SEQ ID NO: 4201291 - DNA, 14 bp, Homo sapiens
agaccagcctggcc

SEQ ID NO: 4201292 - DNA, 13 bp, Homo sapiens
agaccagtactgg

SEQ ID NO: 4201293 - DNA, 15 bp, Homo sapiens
agacccacctggagc

SEQ ID NO: 4201294 - DNA, 20 bp, Homo sapiens
agacccacctggagcccgct

SEQ ID NO: 4201295 - DNA, 16 bp, Homo sapiens
agaccccggtggcagt

SEQ ID NO: 4201296 - DNA, 13 bp, Homo sapiens
agaccccttcctt

SEQ ID NO: 4201297 - DNA, 15 bp, Homo sapiens
agaccccttcctttc

SEQ ID NO: 4201298 - DNA, 13 bp, Homo sapiens
agaccctgtctct

SEQ ID NO: 4201299 - DNA, 21 bp, Homo sapiens
agaccgagcgctttctggaaa

SEQ ID NO: 4201300 - DNA, 19 bp, Homo sapiens
agaccgtgatttggaagag

SEQ ID NO: 4201301 - DNA, 19 bp, Homo sapiens
agacctgacaagcactgct

SEQ ID NO: 4201302 - DNA, 16 bp, Homo sapiens
agaccttttttaggaa

SEQ ID NO: 4201303 - DNA, 13 bp, Homo sapiens
agacgctcctgaa

SEQ ID NO: 4201304 - DNA, 15 bp, Homo sapiens
agacggctggacctg

SEQ ID NO: 4201305 - DNA, 23 bp, Homo sapiens
agactagttgaacatctcacttt

SEQ ID NO: 4201306 - DNA, 17 bp, Homo sapiens
agactatttaacttgag

SEQ ID NO: 4201307 - DNA, 18 bp, Homo sapiens
agactatttaacttgagg

SEQ ID NO: 4201308 - DNA, 13 bp, Homo sapiens
agactcatctttt

SEQ ID NO: 4201309 - DNA, 16 bp, Homo sapiens
agactcatcttttgaa

SEQ ID NO: 4201310 - DNA, 13 bp, Homo sapiens
agactccatttca

SEQ ID NO: 4201311 - DNA, 18 bp, Homo sapiens
agactccttcgtccccag

SEQ ID NO: 4201312 - DNA, 19 bp, Homo sapiens
agactctggagccaaggca

SEQ ID NO: 4201313 - DNA, 23 bp, Homo sapiens
agactctggagccaaggcagagg

SEQ ID NO: 4201314 - DNA, 14 bp, Homo sapiens
agactctttatgct

SEQ ID NO: 4201315 - DNA, 16 bp, Homo sapiens
agactgagcacctgct

SEQ ID NO: 4201316 - DNA, 22 bp, Homo sapiens
agactgagggattttagcctct

SEQ ID NO: 4201317 - DNA, 21 bp, Homo sapiens
agactgcagaggggaaagact

SEQ ID NO: 4201318 - DNA, 23 bp, Homo sapiens
agactgcgggatggtcctggggc

SEQ ID NO: 4201319 - DNA, 14 bp, Homo sapiens
agactgctgggact

SEQ ID NO: 4201320 - DNA, 19 bp, Homo sapiens
agactgctgggactggcca

SEQ ID NO: 4201321 - DNA, 17 bp, Homo sapiens
agactgtaattaagtaa

SEQ ID NO: 4201322 - DNA, 21 bp, Homo sapiens
agactgtggtattggggtctt

SEQ ID NO: 4201323 - DNA, 22 bp, Homo sapiens
agactgtggtattggggtcttt

SEQ ID NO: 4201324 - DNA, 20 bp, Homo sapiens
agacttcacaattcatggaa

SEQ ID NO: 4201325 - DNA, 17 bp, Homo sapiens
agacttggcaacagaag

SEQ ID NO: 4201326 - DNA, 18 bp, Homo sapiens
agacttggggaccagagg

SEQ ID NO: 4201327 - DNA, 12 bp, Homo sapiens
agactttctgtt

SEQ ID NO: 4201328 - DNA, 18 bp, Homo sapiens
agacttttaatcagacaa

SEQ ID NO: 4201329 - DNA, 16 bp, Homo sapiens
agagaaaaaactagag

SEQ ID NO: 4201330 - DNA, 18 bp, Homo sapiens
agagaaaacttatttgag

SEQ ID NO: 4201331 - DNA, 23 bp, Homo sapiens
agagaaccaggagggtaacagaa

SEQ ID NO: 4201332 - DNA, 13 bp, Homo sapiens
agagaacctcaaa

SEQ ID NO: 4201333 - DNA, 23 bp, Homo sapiens
agagaactttcggagcctgcctc

SEQ ID NO: 4201334 - DNA, 13 bp, Homo sapiens
agagaagaaagaa

SEQ ID NO: 4201335 - DNA, 22 bp, Homo sapiens
agagaagggggattggagggaa

SEQ ID NO: 4201336 - DNA, 17 bp, Homo sapiens
agagaatatttcaaatg

SEQ ID NO: 4201337 - DNA, 23 bp, Homo sapiens
agagaatatttcaaatgaacacg

SEQ ID NO: 4201338 - DNA, 23 bp, Homo sapiens
agagaccacagcaattggctcct

SEQ ID NO: 4201339 - DNA, 19 bp, Homo sapiens
agagaccccttcctttcct

SEQ ID NO: 4201340 - DNA, 22 bp, Homo sapiens
agagactctggcctccacagtt

SEQ ID NO: 4201341 - DNA, 16 bp, Homo sapiens
agagacttagaagcat

SEQ ID NO: 4201342 - DNA, 16 bp, Homo sapiens
agagacttggggacca

SEQ ID NO: 4201343 - DNA, 19 bp, Homo sapiens
agagacttgtgctcaagga

SEQ ID NO: 4201344 - DNA, 13 bp, Homo sapiens
agagagcaaacat

SEQ ID NO: 4201345 - DNA, 22 bp, Homo sapiens
agagagcaaacataggaatatg

SEQ ID NO: 4201346 - DNA, 17 bp, Homo sapiens
agagaggatgcagaggg

SEQ ID NO: 4201347 - DNA, 17 bp, Homo sapiens
agagaggcacctgctgg

SEQ ID NO: 4201348 - DNA, 23 bp, Homo sapiens
agagaggcgcgtctgccccaccc

SEQ ID NO: 4201349 - DNA, 15 bp, Homo sapiens
agagagggcagaggg

SEQ ID NO: 4201350 - DNA, 21 bp, Homo sapiens
agagatacatcttataaactg

SEQ ID NO: 4201351 - DNA, 15 bp, Homo sapiens
agagatcagcagtgg

SEQ ID NO: 4201352 - DNA, 16 bp, Homo sapiens
agagatcagcagtggc

SEQ ID NO: 4201353 - DNA, 19 bp, Homo sapiens
agagatcaggaagagaagg

SEQ ID NO: 4201354 - DNA, 20 bp, Homo sapiens
agagatcaggaagagaagga

SEQ ID NO: 4201355 - DNA, 18 bp, Homo sapiens
agagatgactgagtcctc

SEQ ID NO: 4201356 - DNA, 17 bp, Homo sapiens
agagatgtagcagaata

SEQ ID NO: 4201357 - DNA, 17 bp, Homo sapiens
agagatttaacactaaa

SEQ ID NO: 4201358 - DNA, 18 bp, Homo sapiens
agagattttgtcgggaca

SEQ ID NO: 4201359 - DNA, 15 bp, Homo sapiens
agagcaagaaggaaa

SEQ ID NO: 4201360 - DNA, 20 bp, Homo sapiens
agagcaagactccatttcaa

SEQ ID NO: 4201361 - DNA, 14 bp, Homo sapiens
agagcactgccacc

SEQ ID NO: 4201362 - DNA, 12 bp, Homo sapiens
agagcactgctc

SEQ ID NO: 4201363 - DNA, 16 bp, Homo sapiens
agagcactgctccagt

SEQ ID NO: 4201364 - DNA, 13 bp, Homo sapiens
agagcagagagca

SEQ ID NO: 4201365 - DNA, 14 bp, Homo sapiens
agagcagaggcagc

SEQ ID NO: 4201366 - DNA, 12 bp, Homo sapiens
agagcagctggc

SEQ ID NO: 4201367 - DNA, 18 bp, Homo sapiens
agagcagctggctctcca

SEQ ID NO: 4201368 - DNA, 19 bp, Homo sapiens
agagcattacgtgagccag

SEQ ID NO: 4201369 - DNA, 21 bp, Homo sapiens
agagcattacgtgagccaggt

SEQ ID NO: 4201370 - DNA, 14 bp, Homo sapiens
agagccagctctct

SEQ ID NO: 4201371 - DNA, 16 bp, Homo sapiens
agagccagctctctct

SEQ ID NO: 4201372 - DNA, 14 bp, Homo sapiens
agagcccagccatt

SEQ ID NO: 4201373 - DNA, 16 bp, Homo sapiens
agagccgggaagcgat

SEQ ID NO: 4201374 - DNA, 21 bp, Homo sapiens
agagcctagaacatccctggg

SEQ ID NO: 4201375 - DNA, 13 bp, Homo sapiens
agagcctccactt

SEQ ID NO: 4201376 - DNA, 10 bp, Homo sapiens
agagcctggc

SEQ ID NO: 4201377 - DNA, 11 bp, Homo sapiens
agagcctggcg

SEQ ID NO: 4201378 - DNA, 22 bp, Homo sapiens
agagcctggctttggtccccag

SEQ ID NO: 4201379 - DNA, 14 bp, Homo sapiens
agagccttcaagtg

SEQ ID NO: 4201380 - DNA, 19 bp, Homo sapiens
agagccttcaagtgccaaa

SEQ ID NO: 4201381 - DNA, 14 bp, Homo sapiens
agagctacgtattt

SEQ ID NO: 4201382 - DNA, 17 bp, Homo sapiens
agagctacgtatttaat

SEQ ID NO: 4201383 - DNA, 15 bp, Homo sapiens
agagctatggtgagg

SEQ ID NO: 4201384 - DNA, 19 bp, Homo sapiens
agagctgatggagaaggaa

SEQ ID NO: 4201385 - DNA, 14 bp, Homo sapiens
agagctgctctgga

SEQ ID NO: 4201386 - DNA, 16 bp, Homo sapiens
agagctgctctggaaa

SEQ ID NO: 4201387 - DNA, 18 bp, Homo sapiens
agagctggggctgccagc

SEQ ID NO: 4201388 - DNA, 19 bp, Homo sapiens
agagctggggctgccagcc

SEQ ID NO: 4201389 - DNA, 16 bp, Homo sapiens
agagcttggtggctga

SEQ ID NO: 4201390 - DNA, 14 bp, Homo sapiens
agaggaaaaagaaa

SEQ ID NO: 4201391 - DNA, 18 bp, Homo sapiens
agaggacagtctggagaa

SEQ ID NO: 4201392 - DNA, 17 bp, Homo sapiens
agaggagggacctactg

SEQ ID NO: 4201393 - DNA, 23 bp, Homo sapiens
agaggagggacctactgaaccca

SEQ ID NO: 4201394 - DNA, 18 bp, Homo sapiens
agaggcaagagacagaat

SEQ ID NO: 4201395 - DNA, 13 bp, Homo sapiens
agaggcagagaaa

SEQ ID NO: 4201396 - DNA, 17 bp, Homo sapiens
agaggcagagaaagaag

SEQ ID NO: 4201397 - DNA, 20 bp, Homo sapiens
agaggcagagaaagaagaga

SEQ ID NO: 4201398 - DNA, 22 bp, Homo sapiens
agaggcagagaaagaagagaca

SEQ ID NO: 4201399 - DNA, 14 bp, Homo sapiens
agaggctggtgctg

SEQ ID NO: 4201400 - DNA, 21 bp, Homo sapiens
agagggcagcccccactttcc

SEQ ID NO: 4201401 - DNA, 21 bp, Homo sapiens
agagggcccaggcaggccacc

SEQ ID NO: 4201402 - DNA, 19 bp, Homo sapiens
agaggggtacatttccctg

SEQ ID NO: 4201403 - DNA, 20 bp, Homo sapiens
agaggggtacatttccctgt

SEQ ID NO: 4201404 - DNA, 19 bp, Homo sapiens
agaggtaaaagtgtgagca

SEQ ID NO: 4201405 - DNA, 16 bp, Homo sapiens
agaggtaatttttcac

SEQ ID NO: 4201406 - DNA, 20 bp, Homo sapiens
agaggtagcgagctgctctg

SEQ ID NO: 4201407 - DNA, 22 bp, Homo sapiens
agaggtgagaccaaaggatcca

SEQ ID NO: 4201408 - DNA, 19 bp, Homo sapiens
agaggttagaaatactttt

SEQ ID NO: 4201409 - DNA, 20 bp, Homo sapiens
agaggttgggcttccatgcc

SEQ ID NO: 4201410 - DNA, 19 bp, Homo sapiens
agaggtttgtcaacaaaaa

SEQ ID NO: 4201411 - DNA, 16 bp, Homo sapiens
agaggtttgtcaacac

SEQ ID NO: 4201412 - DNA, 12 bp, Homo sapiens
agaggttttgtt

SEQ ID NO: 4201413 - DNA, 16 bp, Homo sapiens
agaggttttgttgttt

SEQ ID NO: 4201414 - DNA, 22 bp, Homo sapiens
agagtagatggtgaaatttatt

SEQ ID NO: 4201415 - DNA, 20 bp, Homo sapiens
agagtccgtaggtttatcag

SEQ ID NO: 4201416 - DNA, 12 bp, Homo sapiens
agagtcctttgg

SEQ ID NO: 4201417 - DNA, 12 bp, Homo sapiens
agagtctgtctc

SEQ ID NO: 4201418 - DNA, 22 bp, Homo sapiens
agagtgaaataattaaaaacca

SEQ ID NO: 4201419 - DNA, 14 bp, Homo sapiens
agagttcaagaaat

SEQ ID NO: 4201420 - DNA, 17 bp, Homo sapiens
agagttctggattcaaa

SEQ ID NO: 4201421 - DNA, 14 bp, Homo sapiens
agagtttaacacaa

SEQ ID NO: 4201422 - DNA, 21 bp, Homo sapiens
agctagcgtctcggcccttgc

SEQ ID NO: 4201423 - DNA, 23 bp, Homo sapiens
agctagcgtctcggcccttgccg

SEQ ID NO: 4201424 - DNA, 17 bp, Homo sapiens
agctagttcgtagcttt

SEQ ID NO: 4201425 - DNA, 20 bp, Homo sapiens
agctatcagaagaccacaaa

SEQ ID NO: 4201426 - DNA, 15 bp, Homo sapiens
agctatgtaaatgac

SEQ ID NO: 4201427 - DNA, 16 bp, Homo sapiens
agctatgtaaatgacc

SEQ ID NO: 4201428 - DNA, 15 bp, Homo sapiens
agctatttctctgga

SEQ ID NO: 4201429 - DNA, 20 bp, Homo sapiens
agctcaagcaggaagttcaa

SEQ ID NO: 4201430 - DNA, 21 bp, Homo sapiens
agctcactggtccatttctca

SEQ ID NO: 4201431 - DNA, 20 bp, Homo sapiens
agctcaggaggcgaataaat

SEQ ID NO: 4201432 - DNA, 14 bp, Homo sapiens
agctcatattttgt

SEQ ID NO: 4201433 - DNA, 16 bp, Homo sapiens
agctcatcactgtgcc

SEQ ID NO: 4201434 - DNA, 15 bp, Homo sapiens
agctcctctgagcca

SEQ ID NO: 4201435 - DNA, 19 bp, Homo sapiens
agctcttcactcagccaca

SEQ ID NO: 4201436 - DNA, 17 bp, Homo sapiens
agctgaatgagtctgct

SEQ ID NO: 4201437 - DNA, 16 bp, Homo sapiens
agctgaccagccgtga

SEQ ID NO: 4201438 - DNA, 20 bp, Homo sapiens
agctgagcaaatcaccacaa

SEQ ID NO: 4201439 - DNA, 20 bp, Homo sapiens
agctgagcaacctcttcagc

SEQ ID NO: 4201440 - DNA, 13 bp, Homo sapiens
agctgaggggggc

SEQ ID NO: 4201441 - DNA, 22 bp, Homo sapiens
agctgaggggggccgtgcccag

SEQ ID NO: 4201442 - DNA, 19 bp, Homo sapiens
agctgatggagaaggaagg

SEQ ID NO: 4201443 - DNA, 17 bp, Homo sapiens
agctgcaccatcacaca

SEQ ID NO: 4201444 - DNA, 16 bp, Homo sapiens
agctgcacctgccagc

SEQ ID NO: 4201445 - DNA, 15 bp, Homo sapiens
agctgcctgtagtta

SEQ ID NO: 4201446 - DNA, 19 bp, Homo sapiens
agctgcctgtagttaggaa

SEQ ID NO: 4201447 - DNA, 16 bp, Homo sapiens
agctgcggcatccctg

SEQ ID NO: 4201448 - DNA, 11 bp, Homo sapiens
agctgctctgc

SEQ ID NO: 4201449 - DNA, 23 bp, Homo sapiens
agctgctgaagaggcaagagaca

SEQ ID NO: 4201450 - DNA, 10 bp, Homo sapiens
agctggaaat

SEQ ID NO: 4201451 - DNA, 18 bp, Homo sapiens
agctggaaataaacctgg

SEQ ID NO: 4201452 - DNA, 22 bp, Homo sapiens
agctggaaataaacctggagat

SEQ ID NO: 4201453 - DNA, 16 bp, Homo sapiens
agctggacaagaagct

SEQ ID NO: 4201454 - DNA, 19 bp, Homo sapiens
agctggacaagaagctgct

SEQ ID NO: 4201455 - DNA, 17 bp, Homo sapiens
agctggatgcagtggct

SEQ ID NO: 4201456 - DNA, 19 bp, Homo sapiens
agctggcaaaggtggctct

SEQ ID NO: 4201457 - DNA, 18 bp, Homo sapiens
agctggcattggtctgct

SEQ ID NO: 4201458 - DNA, 11 bp, Homo sapiens
agctggctgtc

SEQ ID NO: 4201459 - DNA, 15 bp, Homo sapiens
agctggctgtcttcc

SEQ ID NO: 4201460 - DNA, 17 bp, Homo sapiens
agctgggactacaggtg

SEQ ID NO: 4201461 - DNA, 19 bp, Homo sapiens
agctggggctgccagcctg

SEQ ID NO: 4201462 - DNA, 15 bp, Homo sapiens
agctgtcattcagga

SEQ ID NO: 4201463 - DNA, 13 bp, Homo sapiens
agctgtcgcatct

SEQ ID NO: 4201464 - DNA, 14 bp, Homo sapiens
agctgttggggcag

SEQ ID NO: 4201465 - DNA, 12 bp, Homo sapiens
agctgtttaaga

SEQ ID NO: 4201466 - DNA, 14 bp, Homo sapiens
agctgttttcaaag

SEQ ID NO: 4201467 - DNA, 12 bp, Homo sapiens
agcttaaaactt

SEQ ID NO: 4201468 - DNA, 13 bp, Homo sapiens
agcttaaaacttt

SEQ ID NO: 4201469 - DNA, 23 bp, Homo sapiens
agcttcagacttttatcaaaatc

SEQ ID NO: 4201470 - DNA, 15 bp, Homo sapiens
agcttctccaggctc

SEQ ID NO: 4201471 - DNA, 20 bp, Homo sapiens
agcttcttgctgccaggccc

SEQ ID NO: 4201472 - DNA, 13 bp, Homo sapiens
agcttgcctgcct

SEQ ID NO: 4201473 - DNA, 20 bp, Homo sapiens
agcttgcctgcctgcctgtg

SEQ ID NO: 4201474 - DNA, 20 bp, Homo sapiens
agcttgggaaaggtggtgtt

SEQ ID NO: 4201475 - DNA, 21 bp, Homo sapiens
agcttgtatagtgtaaaataa

SEQ ID NO: 4201476 - DNA, 15 bp, Homo sapiens
agctttacatgcaat

SEQ ID NO: 4201477 - DNA, 19 bp, Homo sapiens
agctttacatgcaatttat

SEQ ID NO: 4201478 - DNA, 17 bp, Homo sapiens
agctttatatattgatt

SEQ ID NO: 4201479 - DNA, 18 bp, Homo sapiens
agctttcctttccttctg

SEQ ID NO: 4201480 - DNA, 22 bp, Homo sapiens
agctttcctttccttctggctc

SEQ ID NO: 4201481 - DNA, 23 bp, Homo sapiens
agctttcctttccttctggctcc

SEQ ID NO: 4201482 - DNA, 12 bp, Homo sapiens
agctttctcctt

SEQ ID NO: 4201483 - DNA, 14 bp, Homo sapiens
agctttctcctttg

SEQ ID NO: 4201484 - DNA, 16 bp, Homo sapiens
agctttggaaacagga

SEQ ID NO: 4201485 - DNA, 14 bp, Homo sapiens
agctttggccctca

SEQ ID NO: 4201486 - DNA, 20 bp, Homo sapiens
agctttggccctcagtgggc

SEQ ID NO: 4201487 - DNA, 13 bp, Homo sapiens
aggaaaaagaaaa

SEQ ID NO: 4201488 - DNA, 13 bp, Homo sapiens
aggaaaagacaga

SEQ ID NO: 4201489 - DNA, 18 bp, Homo sapiens
aggaaaccaaaggaatcg

SEQ ID NO: 4201490 - DNA, 22 bp, Homo sapiens
aggaaacccaaggaacaagaga

SEQ ID NO: 4201491 - DNA, 14 bp, Homo sapiens
aggaaagacacaga

SEQ ID NO: 4201492 - DNA, 18 bp, Homo sapiens
aggaaagacaggctgagc

SEQ ID NO: 4201493 - DNA, 18 bp, Homo sapiens
aggaaagggaagcctgac

SEQ ID NO: 4201494 - DNA, 22 bp, Homo sapiens
aggaaagggaagcctgactgct

SEQ ID NO: 4201495 - DNA, 21 bp, Homo sapiens
aggaaataaaacctttcaaat

SEQ ID NO: 4201496 - DNA, 13 bp, Homo sapiens
aggaacaagagaa

SEQ ID NO: 4201497 - DNA, 14 bp, Homo sapiens
aggaacactggaaa

SEQ ID NO: 4201498 - DNA, 23 bp, Homo sapiens
aggaacagctcttcactcagcca

SEQ ID NO: 4201499 - DNA, 17 bp, Homo sapiens
aggaacccagctctcag

SEQ ID NO: 4201500 - DNA, 21 bp, Homo sapiens
aggaacccagctctcagggct

SEQ ID NO: 4201501 - DNA, 12 bp, Homo sapiens
aggaactggctc

SEQ ID NO: 4201502 - DNA, 18 bp, Homo sapiens
aggaactggctcctttgc

SEQ ID NO: 4201503 - DNA, 19 bp, Homo sapiens
aggaactggctcctttgcc

SEQ ID NO: 4201504 - DNA, 20 bp, Homo sapiens
aggaactggctcctttgcct

SEQ ID NO: 4201505 - DNA, 20 bp, Homo sapiens
aggaagaggtaatttttcac

SEQ ID NO: 4201506 - DNA, 17 bp, Homo sapiens
aggaagcaagcttaatg

SEQ ID NO: 4201507 - DNA, 17 bp, Homo sapiens
aggaagcacactgcagg

SEQ ID NO: 4201508 - DNA, 21 bp, Homo sapiens
aggaagcacactgcagggctg

SEQ ID NO: 4201509 - DNA, 23 bp, Homo sapiens
aggaagcacactgcagggctgct

SEQ ID NO: 4201510 - DNA, 22 bp, Homo sapiens
aggaagctttggtgagaacctg

SEQ ID NO: 4201511 - DNA, 14 bp, Homo sapiens
aggaaggaaaaaat

SEQ ID NO: 4201512 - DNA, 16 bp, Homo sapiens
aggaaggaaaaaataa

SEQ ID NO: 4201513 - DNA, 16 bp, Homo sapiens
aggaaggactatgaaa

SEQ ID NO: 4201514 - DNA, 13 bp, Homo sapiens
aggaaggatggca

SEQ ID NO: 4201515 - DNA, 22 bp, Homo sapiens
aggaaggcagggaggaggcaga

SEQ ID NO: 4201516 - DNA, 22 bp, Homo sapiens
aggaaggcttgttgtgctttta

SEQ ID NO: 4201517 - DNA, 19 bp, Homo sapiens
aggaatatgactcaggagc

SEQ ID NO: 4201518 - DNA, 13 bp, Homo sapiens
aggaatgcaatat

SEQ ID NO: 4201519 - DNA, 22 bp, Homo sapiens
aggaatttctcctactttacac

SEQ ID NO: 4201520 - DNA, 22 bp, Homo sapiens
aggacacacagtctcagtccag

SEQ ID NO: 4201521 - DNA, 14 bp, Homo sapiens
aggacagtctggag

SEQ ID NO: 4201522 - DNA, 17 bp, Homo sapiens
aggacagtctggagaag

SEQ ID NO: 4201523 - DNA, 18 bp, Homo sapiens
aggacagtgcttcagcct

SEQ ID NO: 4201524 - DNA, 23 bp, Homo sapiens
aggacatgtttttgttttctttg

SEQ ID NO: 4201525 - DNA, 15 bp, Homo sapiens
aggacatttacctct

SEQ ID NO: 4201526 - DNA, 12 bp, Homo sapiens
aggaccaggact

SEQ ID NO: 4201527 - DNA, 22 bp, Homo sapiens
aggaccaggactatagcccagg

SEQ ID NO: 4201528 - DNA, 22 bp, Homo sapiens
aggaccctgtcaggattgcagg

SEQ ID NO: 4201529 - DNA, 16 bp, Homo sapiens
aggacggttgtaagca

SEQ ID NO: 4201530 - DNA, 20 bp, Homo sapiens
aggacggttgtaagcagttg

SEQ ID NO: 4201531 - DNA, 21 bp, Homo sapiens
aggacggttgtaagcagttgt

SEQ ID NO: 4201532 - DNA, 19 bp, Homo sapiens
aggactacgttaagggaag

SEQ ID NO: 4201533 - DNA, 18 bp, Homo sapiens
aggactccccaggccagg

SEQ ID NO: 4201534 - DNA, 19 bp, Homo sapiens
aggactccccaggccaggc

SEQ ID NO: 4201535 - DNA, 14 bp, Homo sapiens
aggactctgaggct

SEQ ID NO: 4201536 - DNA, 13 bp, Homo sapiens
aggactctgcctt

SEQ ID NO: 4201537 - DNA, 22 bp, Homo sapiens
aggactgtgataatcagaagct

SEQ ID NO: 4201538 - DNA, 18 bp, Homo sapiens
aggagaatcaataaaaat

SEQ ID NO: 4201539 - DNA, 19 bp, Homo sapiens
aggagaatcgcttgaaccg

SEQ ID NO: 4201540 - DNA, 16 bp, Homo sapiens
aggagctctctgctga

SEQ ID NO: 4201541 - DNA, 17 bp, Homo sapiens
aggagctctctgctgag

SEQ ID NO: 4201542 - DNA, 13 bp, Homo sapiens
aggaggaaaagac

SEQ ID NO: 4201543 - DNA, 14 bp, Homo sapiens
aggaggaagactct

SEQ ID NO: 4201544 - DNA, 14 bp, Homo sapiens
aggaggcagagaag

SEQ ID NO: 4201545 - DNA, 19 bp, Homo sapiens
aggaggcgaataaatgttc

SEQ ID NO: 4201546 - DNA, 15 bp, Homo sapiens
aggagggaaggagct

SEQ ID NO: 4201547 - DNA, 19 bp, Homo sapiens
aggagggatgctgcctgag

SEQ ID NO: 4201548 - DNA, 20 bp, Homo sapiens
aggagggcaagggccatgct

SEQ ID NO: 4201549 - DNA, 24 bp, Homo sapiens
aggaggtcaagcctgcagcgagct

SEQ ID NO: 4201550 - DNA, 17 bp, Homo sapiens
aggaggtggcagccctg

SEQ ID NO: 4201551 - DNA, 21 bp, Homo sapiens
aggaggtggcagccctgtagg

SEQ ID NO: 4201552 - DNA, 14 bp, Homo sapiens
aggagtgagatcat

SEQ ID NO: 4201553 - DNA, 22 bp, Homo sapiens
aggagttcgagaccagcctggc

SEQ ID NO: 4201554 - DNA, 16 bp, Homo sapiens
aggagttgccagggaa

SEQ ID NO: 4201555 - DNA, 19 bp, Homo sapiens
aggagttgtacctccattg

SEQ ID NO: 4201556 - DNA, 16 bp, Homo sapiens
agtcaagatacatagt

SEQ ID NO: 4201557 - DNA, 18 bp, Homo sapiens
agtcaatcaagtctgttt

SEQ ID NO: 4201558 - DNA, 17 bp, Homo sapiens
agtcacccatgaagaca

SEQ ID NO: 4201559 - DNA, 22 bp, Homo sapiens
agtcagccttccccctcccagg

SEQ ID NO: 4201560 - DNA, 23 bp, Homo sapiens
agtcagccttccccctcccaggg

SEQ ID NO: 4201561 - DNA, 17 bp, Homo sapiens
agtcaggaaagacaggc

SEQ ID NO: 4201562 - DNA, 15 bp, Homo sapiens
agtcagggcccagag

SEQ ID NO: 4201563 - DNA, 13 bp, Homo sapiens
agtcagtgtcaat

SEQ ID NO: 4201564 - DNA, 20 bp, Homo sapiens
agtcatgaggaaagacacag

SEQ ID NO: 4201565 - DNA, 15 bp, Homo sapiens
agtccaacctgcctg

SEQ ID NO: 4201566 - DNA, 22 bp, Homo sapiens
agtcccagctactcagaagcct

SEQ ID NO: 4201567 - DNA, 22 bp, Homo sapiens
agtccccacagataactgaaaa

SEQ ID NO: 4201568 - DNA, 19 bp, Homo sapiens
agtccctgactctctgtga

SEQ ID NO: 4201569 - DNA, 18 bp, Homo sapiens
agtccgccaaacactcca

SEQ ID NO: 4201570 - DNA, 17 bp, Homo sapiens
agtcctatcgactttat

SEQ ID NO: 4201571 - DNA, 13 bp, Homo sapiens
agtcctcacagcc

SEQ ID NO: 4201572 - DNA, 18 bp, Homo sapiens
agtcctcacagcctctcc

SEQ ID NO: 4201573 - DNA, 18 bp, Homo sapiens
agtcctgcagaggattta

SEQ ID NO: 4201574 - DNA, 13 bp, Homo sapiens
agtcctgtgaatt

SEQ ID NO: 4201575 - DNA, 23 bp, Homo sapiens
agtcctgtgaatttcttcactgt

SEQ ID NO: 4201576 - DNA, 18 bp, Homo sapiens
agtcgaattaatagcttt

SEQ ID NO: 4201577 - DNA, 21 bp, Homo sapiens
agtcgaattaatagcttttat

SEQ ID NO: 4201578 - DNA, 21 bp, Homo sapiens
agtctaaagctggtttaatgt

SEQ ID NO: 4201579 - DNA, 23 bp, Homo sapiens
agtctaaagtttacagtaaataa

SEQ ID NO: 4201580 - DNA, 22 bp, Homo sapiens
agtctacttcactaatgacgat

SEQ ID NO: 4201581 - DNA, 14 bp, Homo sapiens
agtctatggtcagt

SEQ ID NO: 4201582 - DNA, 13 bp, Homo sapiens
agtctcagaagag

SEQ ID NO: 4201583 - DNA, 14 bp, Homo sapiens
agtctccttcccct

SEQ ID NO: 4201584 - DNA, 17 bp, Homo sapiens
agtctctatttcacaat

SEQ ID NO: 4201585 - DNA, 13 bp, Homo sapiens
agtctgctttcac

SEQ ID NO: 4201586 - DNA, 15 bp, Homo sapiens
agtctggaagaagag

SEQ ID NO: 4201587 - DNA, 19 bp, Homo sapiens
agtctggaagaagaggagg

SEQ ID NO: 4201588 - DNA, 20 bp, Homo sapiens
agtctggaagaagaggagga

SEQ ID NO: 4201589 - DNA, 22 bp, Homo sapiens
agtctggaagaagaggaggaag

SEQ ID NO: 4201590 - DNA, 22 bp, Homo sapiens
agtctgggcaatgaaaccaaag

SEQ ID NO: 4201591 - DNA, 17 bp, Homo sapiens
agtctgtgggagctcag

SEQ ID NO: 4201592 - DNA, 12 bp, Homo sapiens
agtcttgcctag

SEQ ID NO: 4201593 - DNA, 18 bp, Homo sapiens
agtcttgctttgctgtct

SEQ ID NO: 4201594 - DNA, 16 bp, Homo sapiens
agtcttgtacacttaa

SEQ ID NO: 4201595 - DNA, 18 bp, Homo sapiens
agtcttgtacacttaagc

SEQ ID NO: 4201596 - DNA, 21 bp, Homo sapiens
agtcttgtcagaattggcctc

SEQ ID NO: 4201597 - DNA, 20 bp, Homo sapiens
agtgaactacgcttgctcat

SEQ ID NO: 4201598 - DNA, 12 bp, Homo sapiens
agtgaagaatac

SEQ ID NO: 4201599 - DNA, 20 bp, Homo sapiens
agtgaatttctgatttcact

SEQ ID NO: 4201600 - DNA, 14 bp, Homo sapiens
agtgactcgagggt

SEQ ID NO: 4201601 - DNA, 16 bp, Homo sapiens
agtgacttcctggtga

SEQ ID NO: 4201602 - DNA, 18 bp, Homo sapiens
agtgacttcctggtgagg

SEQ ID NO: 4201603 - DNA, 21 bp, Homo sapiens
agtgaggctctattgagccaa

SEQ ID NO: 4201604 - DNA, 13 bp, Homo sapiens
agtgagggctggg

SEQ ID NO: 4201605 - DNA, 17 bp, Homo sapiens
agtgaggggagatgctg

SEQ ID NO: 4201606 - DNA, 15 bp, Homo sapiens
agtgagtctgtcagc

SEQ ID NO: 4201607 - DNA, 22 bp, Homo sapiens
agtgagttacagcgagaggcag

SEQ ID NO: 4201608 - DNA, 19 bp, Homo sapiens
agtgatcctcaaacacaca

SEQ ID NO: 4201609 - DNA, 14 bp, Homo sapiens
agtgatctcaaatc

SEQ ID NO: 4201610 - DNA, 17 bp, Homo sapiens
agtgattgtcttaatat

SEQ ID NO: 4201611 - DNA, 15 bp, Homo sapiens
agtgcaacaaaatca

SEQ ID NO: 4201612 - DNA, 13 bp, Homo sapiens
agtgcacacttgt

SEQ ID NO: 4201613 - DNA, 17 bp, Homo sapiens
agtgcattttcccagat

SEQ ID NO: 4201614 - DNA, 15 bp, Homo sapiens
agtgccaaacagagt

SEQ ID NO: 4201615 - DNA, 15 bp, Homo sapiens
agtgccacagagaag

SEQ ID NO: 4201616 - DNA, 21 bp, Homo sapiens
agtgccacatgacagcagtgt

SEQ ID NO: 4201617 - DNA, 23 bp, Homo sapiens
agtgccaggactccccaggccag

SEQ ID NO: 4201618 - DNA, 16 bp, Homo sapiens
agtgcccccacccagt

SEQ ID NO: 4201619 - DNA, 15 bp, Homo sapiens
agtgctgatccggct

SEQ ID NO: 4201620 - DNA, 22 bp, Homo sapiens
agtgctgccctgcgaagtggct

SEQ ID NO: 4201621 - DNA, 17 bp, Homo sapiens
agtgctggatttgatga

SEQ ID NO: 4201622 - DNA, 11 bp, Homo sapiens
agtgctgggat

SEQ ID NO: 4201623 - DNA, 12 bp, Homo sapiens
agtgctgtgctg

SEQ ID NO: 4201624 - DNA, 18 bp, Homo sapiens
agtgctgtggcctgggca

SEQ ID NO: 4201625 - DNA, 20 bp, Homo sapiens
agtgctgtggcctgggcaag

SEQ ID NO: 4201626 - DNA, 14 bp, Homo sapiens
agtgcttcagcctg

SEQ ID NO: 4201627 - DNA, 16 bp, Homo sapiens
agtgcttcagcctgag

SEQ ID NO: 4201628 - DNA, 17 bp, Homo sapiens
agtgcttcagcctgagg

SEQ ID NO: 4201629 - DNA, 18 bp, Homo sapiens
agtgcttcagcctgaggc

SEQ ID NO: 4201630 - DNA, 17 bp, Homo sapiens
agtggaaaaatcagaag

SEQ ID NO: 4201631 - DNA, 16 bp, Homo sapiens
agtggaaattttctac

SEQ ID NO: 4201632 - DNA, 19 bp, Homo sapiens
agtggaatcactgtatttt

SEQ ID NO: 4201633 - DNA, 18 bp, Homo sapiens
agtggatctccaaggacc

SEQ ID NO: 4201634 - DNA, 14 bp, Homo sapiens
agtggatggcccag

SEQ ID NO: 4201635 - DNA, 15 bp, Homo sapiens
agtggatggcccagc

SEQ ID NO: 4201636 - DNA, 16 bp, Homo sapiens
agtggatggcccagca

SEQ ID NO: 4201637 - DNA, 22 bp, Homo sapiens
agtggatggcccagcaggcagg

SEQ ID NO: 4201638 - DNA, 17 bp, Homo sapiens
agtggcaggaccctgtc

SEQ ID NO: 4201639 - DNA, 14 bp, Homo sapiens
agtggctcacgcct

SEQ ID NO: 4201640 - DNA, 19 bp, Homo sapiens
agtggcttctccatcctca

SEQ ID NO: 4201641 - DNA, 21 bp, Homo sapiens
agtgggacaaaccagagcaga

SEQ ID NO: 4201642 - DNA, 17 bp, Homo sapiens
agtgggctccctggccc

SEQ ID NO: 4201643 - DNA, 23 bp, Homo sapiens
agtgggctccctggcccagccag

SEQ ID NO: 4201644 - DNA, 17 bp, Homo sapiens
agtgggctgcatctggg

SEQ ID NO: 4201645 - DNA, 18 bp, Homo sapiens
agtggggggtggacacag

SEQ ID NO: 4201646 - DNA, 19 bp, Homo sapiens
agtggggggtggacacaga

SEQ ID NO: 4201647 - DNA, 18 bp, Homo sapiens
agtgggtggtggatctgt

SEQ ID NO: 4201648 - DNA, 16 bp, Homo sapiens
agtggtaagctctggc

SEQ ID NO: 4201649 - DNA, 22 bp, Homo sapiens
agtggtcaaaccgcactcaccc

SEQ ID NO: 4201650 - DNA, 13 bp, Homo sapiens
agtgtaaaataag

SEQ ID NO: 4201651 - DNA, 21 bp, Homo sapiens
agtgtaaatcctttttcttta

SEQ ID NO: 4201652 - DNA, 17 bp, Homo sapiens
agtgtagccttgcccgg

SEQ ID NO: 4201653 - DNA, 20 bp, Homo sapiens
agtgtgaatatatggtctgt

SEQ ID NO: 4201654 - DNA, 16 bp, Homo sapiens
agtgtgagcagtgagt

SEQ ID NO: 4201655 - DNA, 17 bp, Homo sapiens
agtgtgatttttttcac

SEQ ID NO: 4201656 - DNA, 23 bp, Homo sapiens
agtgtgtgtgtctgttgagtgca

SEQ ID NO: 4201657 - DNA, 17 bp, Homo sapiens
agtgttgttcattatac

SEQ ID NO: 4201658 - DNA, 18 bp, Homo sapiens
agttaaagggcagaaggg

SEQ ID NO: 4201659 - DNA, 18 bp, Homo sapiens
agttaactgtgaaatacc

SEQ ID NO: 4201660 - DNA, 18 bp, Homo sapiens
agttaactttaagactga

SEQ ID NO: 4201661 - DNA, 20 bp, Homo sapiens
agttaatatatcccagaaat

SEQ ID NO: 4201662 - DNA, 21 bp, Homo sapiens
agttaatatatcccagaaatt

SEQ ID NO: 4201663 - DNA, 14 bp, Homo sapiens
agttacaaaaatag

SEQ ID NO: 4201664 - DNA, 16 bp, Homo sapiens
agttacaaaaatagta

SEQ ID NO: 4201665 - DNA, 23 bp, Homo sapiens
agttacagcgagaggcagagaaa

SEQ ID NO: 4201666 - DNA, 17 bp, Homo sapiens
agttagagaatatattt

SEQ ID NO: 4201667 - DNA, 21 bp, Homo sapiens
agttagctttaacttaaatag

SEQ ID NO: 4201668 - DNA, 22 bp, Homo sapiens
agttaggaaataaaacctttca

SEQ ID NO: 4201669 - DNA, 18 bp, Homo sapiens
agttaggatagcattttt

SEQ ID NO: 4201670 - DNA, 13 bp, Homo sapiens
agttataaaaata

SEQ ID NO: 4201671 - DNA, 16 bp, Homo sapiens
agttatagtttgcttt

SEQ ID NO: 4201672 - DNA, 14 bp, Homo sapiens
agttatattttcta

SEQ ID NO: 4201673 - DNA, 22 bp, Homo sapiens
agttatattttctattacacaa

SEQ ID NO: 4201674 - DNA, 19 bp, Homo sapiens
agttatgtacgtatatata

SEQ ID NO: 4201675 - DNA, 18 bp, Homo sapiens
agttattaagttctttaa

SEQ ID NO: 4201676 - DNA, 19 bp, Homo sapiens
agttattaagttctttaaa

SEQ ID NO: 4201677 - DNA, 13 bp, Homo sapiens
agttattgtacag

SEQ ID NO: 4201678 - DNA, 19 bp, Homo sapiens
agttattgtacagctgttt

SEQ ID NO: 4201679 - DNA, 21 bp, Homo sapiens
agttattgtacagctgtttaa

SEQ ID NO: 4201680 - DNA, 21 bp, Homo sapiens
agttattgttttatgttctag

SEQ ID NO: 4201681 - DNA, 19 bp, Homo sapiens
agttcaagaaataagtttt

SEQ ID NO: 4201682 - DNA, 18 bp, Homo sapiens
agttcagaggaagcacat

SEQ ID NO: 4201683 - DNA, 12 bp, Homo sapiens
agttcagccaga

SEQ ID NO: 4201684 - DNA, 16 bp, Homo sapiens
agttcagttcctcttt

SEQ ID NO: 4201685 - DNA, 20 bp, Homo sapiens
agttcagttcctctttgcat

SEQ ID NO: 4201686 - DNA, 17 bp, Homo sapiens
agttcatgtctgctatc

SEQ ID NO: 4201687 - DNA, 13 bp, Homo sapiens
agttccatgaaga

SEQ ID NO: 4201688 - DNA, 18 bp, Homo sapiens
agttcctgcactccagaa

SEQ ID NO: 4201689 - DNA, 16 bp, Homo sapiens
agttctagagaagagg

SEQ ID NO: 4201690 - DNA, 13 bp, Homo sapiens
atactctgtcaga

SEQ ID NO: 4201691 - DNA, 22 bp, Homo sapiens
atactgctgagatacatacaga

SEQ ID NO: 4201692 - DNA, 15 bp, Homo sapiens
atactgcttggagct

SEQ ID NO: 4201693 - DNA, 20 bp, Homo sapiens
atactgcttggagctgagca

SEQ ID NO: 4201694 - DNA, 16 bp, Homo sapiens
atactttaatttttat

SEQ ID NO: 4201695 - DNA, 18 bp, Homo sapiens
atactttgcaatccaaat

SEQ ID NO: 4201696 - DNA, 14 bp, Homo sapiens
atactttttttcac

SEQ ID NO: 4201697 - DNA, 15 bp, Homo sapiens
atactttttttcaca

SEQ ID NO: 4201698 - DNA, 18 bp, Homo sapiens
atagaaatacctcattcg

SEQ ID NO: 4201699 - DNA, 16 bp, Homo sapiens
atagaaatgccaagca

SEQ ID NO: 4201700 - DNA, 21 bp, Homo sapiens
atagaacaagaccctgtctca

SEQ ID NO: 4201701 - DNA, 14 bp, Homo sapiens
atagaatttccaat

SEQ ID NO: 4201702 - DNA, 23 bp, Homo sapiens
atagacaagtagttaagagctaa

SEQ ID NO: 4201703 - DNA, 17 bp, Homo sapiens
atagagtatactaaaaa

SEQ ID NO: 4201704 - DNA, 16 bp, Homo sapiens
atagagtttaacacaa

SEQ ID NO: 4201705 - DNA, 15 bp, Homo sapiens
atagataaattttga

SEQ ID NO: 4201706 - DNA, 13 bp, Homo sapiens
atagatgggtctg

SEQ ID NO: 4201707 - DNA, 23 bp, Homo sapiens
atagatgggtctggctgagctga

SEQ ID NO: 4201708 - DNA, 16 bp, Homo sapiens
atagcaaaagaagaag

SEQ ID NO: 4201709 - DNA, 18 bp, Homo sapiens
atagcaaaagaagaagtt

SEQ ID NO: 4201710 - DNA, 13 bp, Homo sapiens
atagcaaagaatt

SEQ ID NO: 4201711 - DNA, 14 bp, Homo sapiens
atagcacaggctaa

SEQ ID NO: 4201712 - DNA, 17 bp, Homo sapiens
atagcacaggctaattt

SEQ ID NO: 4201713 - DNA, 18 bp, Homo sapiens
atagcatttttgatttat

SEQ ID NO: 4201714 - DNA, 19 bp, Homo sapiens
atagcatttttgatttatg

SEQ ID NO: 4201715 - DNA, 22 bp, Homo sapiens
atagccacatccctttgaaaca

SEQ ID NO: 4201716 - DNA, 21 bp, Homo sapiens
atagccatttccatggctctg

SEQ ID NO: 4201717 - DNA, 22 bp, Homo sapiens
atagccatttccatggctctgt

SEQ ID NO: 4201718 - DNA, 13 bp, Homo sapiens
atagcctcagcca

SEQ ID NO: 4201719 - DNA, 13 bp, Homo sapiens
atagctaaatacc

SEQ ID NO: 4201720 - DNA, 18 bp, Homo sapiens
atagctattactgtctgg

SEQ ID NO: 4201721 - DNA, 21 bp, Homo sapiens
atagctgttttagctgaggga

SEQ ID NO: 4201722 - DNA, 14 bp, Homo sapiens
atagcttgtatagt

SEQ ID NO: 4201723 - DNA, 18 bp, Homo sapiens
atagcttttcatcaattc

SEQ ID NO: 4201724 - DNA, 14 bp, Homo sapiens
ataggaagattaaa

SEQ ID NO: 4201725 - DNA, 22 bp, Homo sapiens
ataggaatatgactcaggagcc

SEQ ID NO: 4201726 - DNA, 16 bp, Homo sapiens
ataggctggagaagct

SEQ ID NO: 4201727 - DNA, 21 bp, Homo sapiens
ataggctggagaagctcaccc

SEQ ID NO: 4201728 - DNA, 22 bp, Homo sapiens
ataggcttagagaggaaaagct

SEQ ID NO: 4201729 - DNA, 14 bp, Homo sapiens
ataggctttagaag

SEQ ID NO: 4201730 - DNA, 15 bp, Homo sapiens
atagggagaaaccaa

SEQ ID NO: 4201731 - DNA, 18 bp, Homo sapiens
atagtaaaagataacaag

SEQ ID NO: 4201732 - DNA, 22 bp, Homo sapiens
atagttattgttttatgttcta

SEQ ID NO: 4201733 - DNA, 22 bp, Homo sapiens
atagttatttacttgaaagatg

SEQ ID NO: 4201734 - DNA, 13 bp, Homo sapiens
atagtttgtacat

SEQ ID NO: 4201735 - DNA, 14 bp, Homo sapiens
atataaaaatgtga

SEQ ID NO: 4201736 - DNA, 17 bp, Homo sapiens
atataaaaatgtgaatc

SEQ ID NO: 4201737 - DNA, 22 bp, Homo sapiens
atataaaaggtgagctcagctc

SEQ ID NO: 4201738 - DNA, 13 bp, Homo sapiens
atataaaatatat

SEQ ID NO: 4201739 - DNA, 18 bp, Homo sapiens
atataaaatatatttatg

SEQ ID NO: 4201740 - DNA, 19 bp, Homo sapiens
atataagctgaaattgtgt

SEQ ID NO: 4201741 - DNA, 18 bp, Homo sapiens
atataattgttttatctg

SEQ ID NO: 4201742 - DNA, 15 bp, Homo sapiens
atataccttctcaaa

SEQ ID NO: 4201743 - DNA, 22 bp, Homo sapiens
atatactattaaaaaggtttac

SEQ ID NO: 4201744 - DNA, 23 bp, Homo sapiens
atatagcgtgggttatcagttaa

SEQ ID NO: 4201745 - DNA, 15 bp, Homo sapiens
atataggttgtgcaa

SEQ ID NO: 4201746 - DNA, 12 bp, Homo sapiens
atatataataat

SEQ ID NO: 4201747 - DNA, 16 bp, Homo sapiens
atatatactacatgag

SEQ ID NO: 4201748 - DNA, 14 bp, Homo sapiens
atatatactattaa

SEQ ID NO: 4201749 - DNA, 15 bp, Homo sapiens
atatatctgcttcag

SEQ ID NO: 4201750 - DNA, 17 bp, Homo sapiens
atatatctgcttcagtg

SEQ ID NO: 4201751 - DNA, 22 bp, Homo sapiens
atatatgattgtataatgtgat

SEQ ID NO: 4201752 - DNA, 12 bp, Homo sapiens
atatattgctgc

SEQ ID NO: 4201753 - DNA, 18 bp, Homo sapiens
atatattgttgacaactg

SEQ ID NO: 4201754 - DNA, 18 bp, Homo sapiens
atatatttattttattct

SEQ ID NO: 4201755 - DNA, 23 bp, Homo sapiens
atatatttgattgtaaaaacaaa

SEQ ID NO: 4201756 - DNA, 21 bp, Homo sapiens
atatatttttatatttagtta

SEQ ID NO: 4201757 - DNA, 14 bp, Homo sapiens
atatatttttcaca

SEQ ID NO: 4201758 - DNA, 17 bp, Homo sapiens
atatcagaaaagggaag

SEQ ID NO: 4201759 - DNA, 15 bp, Homo sapiens
atatcagctttatcc

SEQ ID NO: 4201760 - DNA, 17 bp, Homo sapiens
atatcattaaattggaa

SEQ ID NO: 4201761 - DNA, 13 bp, Homo sapiens
atatcctaaacat

SEQ ID NO: 4201762 - DNA, 15 bp, Homo sapiens
atatcctaaacatca

SEQ ID NO: 4201763 - DNA, 22 bp, Homo sapiens
atatcctaaacatcattcattt

SEQ ID NO: 4201764 - DNA, 22 bp, Homo sapiens
atatctcctgaaaaggtttatg

SEQ ID NO: 4201765 - DNA, 23 bp, Homo sapiens
atatctcctgaaaaggtttatga

SEQ ID NO: 4201766 - DNA, 20 bp, Homo sapiens
atatctgttttgtttcttga

SEQ ID NO: 4201767 - DNA, 21 bp, Homo sapiens
atatctgttttgtttcttgac

SEQ ID NO: 4201768 - DNA, 13 bp, Homo sapiens
atatgatcctgaa

SEQ ID NO: 4201769 - DNA, 14 bp, Homo sapiens
atatgatcctgaaa

SEQ ID NO: 4201770 - DNA, 17 bp, Homo sapiens
atatgatcctgaaaaaa

SEQ ID NO: 4201771 - DNA, 20 bp, Homo sapiens
atatgattgtataatgtgat

SEQ ID NO: 4201772 - DNA, 12 bp, Homo sapiens
atatgatttata

SEQ ID NO: 4201773 - DNA, 14 bp, Homo sapiens
atatgatttatagt

SEQ ID NO: 4201774 - DNA, 15 bp, Homo sapiens
atatgcatttttaat

SEQ ID NO: 4201775 - DNA, 22 bp, Homo sapiens
atatggaagataattttatgtg

SEQ ID NO: 4201776 - DNA, 15 bp, Homo sapiens
atatggacaaatgga

SEQ ID NO: 4201777 - DNA, 19 bp, Homo sapiens
atatggacttaaatgttaa

SEQ ID NO: 4201778 - DNA, 13 bp, Homo sapiens
atatgtaaaacat

SEQ ID NO: 4201779 - DNA, 16 bp, Homo sapiens
atatgtaaaacattta

SEQ ID NO: 4201780 - DNA, 13 bp, Homo sapiens
atatgtaaatagc

SEQ ID NO: 4201781 - DNA, 22 bp, Homo sapiens
atatgtaaatagcttttcatca

SEQ ID NO: 4201782 - DNA, 17 bp, Homo sapiens
atatgtaattaacatat

SEQ ID NO: 4201783 - DNA, 12 bp, Homo sapiens
atatgtctgcca

SEQ ID NO: 4201784 - DNA, 14 bp, Homo sapiens
atatgtgaaaatga

SEQ ID NO: 4201785 - DNA, 15 bp, Homo sapiens
atatgtgatgattaa

SEQ ID NO: 4201786 - DNA, 21 bp, Homo sapiens
atattaattataataaaggtc

SEQ ID NO: 4201787 - DNA, 21 bp, Homo sapiens
atattatgtatttatattttg

SEQ ID NO: 4201788 - DNA, 22 bp, Homo sapiens
atattcacacctcacgctctgg

SEQ ID NO: 4201789 - DNA, 20 bp, Homo sapiens
atattcatgtagatcaagtg

SEQ ID NO: 4201790 - DNA, 21 bp, Homo sapiens
atattccgggtgccattccca

SEQ ID NO: 4201791 - DNA, 18 bp, Homo sapiens
atattgaatgtttccaac

SEQ ID NO: 4201792 - DNA, 12 bp, Homo sapiens
atattgacttct

SEQ ID NO: 4201793 - DNA, 21 bp, Homo sapiens
atattgctgctggtaatttgt

SEQ ID NO: 4201794 - DNA, 15 bp, Homo sapiens
atatttatagtcaca

SEQ ID NO: 4201795 - DNA, 13 bp, Homo sapiens
atatttcaaatga

SEQ ID NO: 4201796 - DNA, 23 bp, Homo sapiens
atatttcaagtgcctagactgtt

SEQ ID NO: 4201797 - DNA, 16 bp, Homo sapiens
atattttaaagaattg

SEQ ID NO: 4201798 - DNA, 20 bp, Homo sapiens
atattttaaagaattgtgtc

SEQ ID NO: 4201799 - DNA, 13 bp, Homo sapiens
atattttgtatat

SEQ ID NO: 4201800 - DNA, 21 bp, Homo sapiens
atattttgtatatatctgctt

SEQ ID NO: 4201801 - DNA, 15 bp, Homo sapiens
atatttttagctctg

SEQ ID NO: 4201802 - DNA, 16 bp, Homo sapiens
atatttttatatttag

SEQ ID NO: 4201803 - DNA, 19 bp, Homo sapiens
atcaagaatattcaaatgt

SEQ ID NO: 4201804 - DNA, 15 bp, Homo sapiens
atcaaggaatcctga

SEQ ID NO: 4201805 - DNA, 22 bp, Homo sapiens
atcaaggccttattggaaagca

SEQ ID NO: 4201806 - DNA, 22 bp, Homo sapiens
atcaatccttcttatgtttgct

SEQ ID NO: 4201807 - DNA, 23 bp, Homo sapiens
atcaccacaaactgtaatacaat

SEQ ID NO: 4201808 - DNA, 12 bp, Homo sapiens
atcacctcaggc

SEQ ID NO: 4201809 - DNA, 14 bp, Homo sapiens
atcacgccactgca

SEQ ID NO: 4201810 - DNA, 21 bp, Homo sapiens
atcacgccattgtactccagc

SEQ ID NO: 4201811 - DNA, 23 bp, Homo sapiens
atcactacctttatagctctcat

SEQ ID NO: 4201812 - DNA, 17 bp, Homo sapiens
atcactgagttttccat

SEQ ID NO: 4201813 - DNA, 18 bp, Homo sapiens
atcactgagttttccatg

SEQ ID NO: 4201814 - DNA, 16 bp, Homo sapiens
atcactggagcccagg

SEQ ID NO: 4201815 - DNA, 17 bp, Homo sapiens
atcacttcatacttcta

SEQ ID NO: 4201816 - DNA, 19 bp, Homo sapiens
atcacttgggcccaggagg

SEQ ID NO: 4201817 - DNA, 14 bp, Homo sapiens
atcactttgttaaa

SEQ ID NO: 4201818 - DNA, 14 bp, Homo sapiens
atcacttttcagtg

SEQ ID NO: 4201819 - DNA, 22 bp, Homo sapiens
atcagaagaccacaaaaattga

SEQ ID NO: 4201820 - DNA, 22 bp, Homo sapiens
atcagaagtaggaaggaaaaaa

SEQ ID NO: 4201821 - DNA, 18 bp, Homo sapiens
atcagagaataaacatca

SEQ ID NO: 4201822 - DNA, 13 bp, Homo sapiens
atcagagagccta

SEQ ID NO: 4201823 - DNA, 16 bp, Homo sapiens
atcagcagtggcagga

SEQ ID NO: 4201824 - DNA, 22 bp, Homo sapiens
atggtgtgaaagtcagatgccc

SEQ ID NO: 4201825 - DNA, 17 bp, Homo sapiens
atggttgccttaaagaa

SEQ ID NO: 4201826 - DNA, 15 bp, Homo sapiens
atggttttacagtga

SEQ ID NO: 4201827 - DNA, 23 bp, Homo sapiens
atggtttttgcaagatttaacac

SEQ ID NO: 4201828 - DNA, 13 bp, Homo sapiens
atgtaaaacattt

SEQ ID NO: 4201829 - DNA, 14 bp, Homo sapiens
atgtaaaacattta

SEQ ID NO: 4201830 - DNA, 14 bp, Homo sapiens
atgtaaacaggaga

SEQ ID NO: 4201831 - DNA, 19 bp, Homo sapiens
atgtaaatacatcaaaaat

SEQ ID NO: 4201832 - DNA, 18 bp, Homo sapiens
atgtaaatagcttttcat

SEQ ID NO: 4201833 - DNA, 12 bp, Homo sapiens
atgtaaatagtg

SEQ ID NO: 4201834 - DNA, 17 bp, Homo sapiens
atgtaaatagtgcagaa

SEQ ID NO: 4201835 - DNA, 13 bp, Homo sapiens
atgtaaatatttt

SEQ ID NO: 4201836 - DNA, 15 bp, Homo sapiens
atgtaaatattttaa

SEQ ID NO: 4201837 - DNA, 21 bp, Homo sapiens
atgtaaatgacctaattgata

SEQ ID NO: 4201838 - DNA, 18 bp, Homo sapiens
atgtaactttttaatcat

SEQ ID NO: 4201839 - DNA, 20 bp, Homo sapiens
atgtaataataatgaatgtc

SEQ ID NO: 4201840 - DNA, 17 bp, Homo sapiens
atgtaatgtaaatacat

SEQ ID NO: 4201841 - DNA, 17 bp, Homo sapiens
atgtaattaacatatct

SEQ ID NO: 4201842 - DNA, 14 bp, Homo sapiens
atgtagaatgattt

SEQ ID NO: 4201843 - DNA, 19 bp, Homo sapiens
atgtagttaaatagctata

SEQ ID NO: 4201844 - DNA, 22 bp, Homo sapiens
atgtatatactatacaacaatg

SEQ ID NO: 4201845 - DNA, 14 bp, Homo sapiens
atgtatatagatgt

SEQ ID NO: 4201846 - DNA, 15 bp, Homo sapiens
atgtatctacctcac

SEQ ID NO: 4201847 - DNA, 13 bp, Homo sapiens
atgtcaaaatcat

SEQ ID NO: 4201848 - DNA, 13 bp, Homo sapiens
atgtcagccttgc

SEQ ID NO: 4201849 - DNA, 20 bp, Homo sapiens
atgtcatccccttgtgtcag

SEQ ID NO: 4201850 - DNA, 13 bp, Homo sapiens
atgtccaaaatgt

SEQ ID NO: 4201851 - DNA, 14 bp, Homo sapiens
atgtcccttctcat

SEQ ID NO: 4201852 - DNA, 20 bp, Homo sapiens
atgtctcaatagtaaaagat

SEQ ID NO: 4201853 - DNA, 16 bp, Homo sapiens
atgtctgccacagaga

SEQ ID NO: 4201854 - DNA, 19 bp, Homo sapiens
atgtctgtcctcagagcag

SEQ ID NO: 4201855 - DNA, 18 bp, Homo sapiens
atgtgaatttaatgctta

SEQ ID NO: 4201856 - DNA, 17 bp, Homo sapiens
atgtgataaggaaatca

SEQ ID NO: 4201857 - DNA, 13 bp, Homo sapiens
atgtgccaaggtg

SEQ ID NO: 4201858 - DNA, 18 bp, Homo sapiens
atgtggaatggattatag

SEQ ID NO: 4201859 - DNA, 15 bp, Homo sapiens
atgtggttcttcaaa

SEQ ID NO: 4201860 - DNA, 13 bp, Homo sapiens
atgtggtttatag

SEQ ID NO: 4201861 - DNA, 13 bp, Homo sapiens
atgtgtctgggag

SEQ ID NO: 4201862 - DNA, 16 bp, Homo sapiens
atgtgtctgggagagc

SEQ ID NO: 4201863 - DNA, 17 bp, Homo sapiens
atgtgtctgggagagcc

SEQ ID NO: 4201864 - DNA, 20 bp, Homo sapiens
atgtgtctgggagagcctgg

SEQ ID NO: 4201865 - DNA, 11 bp, Homo sapiens
atgtgtgtggt

SEQ ID NO: 4201866 - DNA, 20 bp, Homo sapiens
atgtgtgttgtaacaaatat

SEQ ID NO: 4201867 - DNA, 22 bp, Homo sapiens
atgtgttatagtaggattaatt

SEQ ID NO: 4201868 - DNA, 22 bp, Homo sapiens
atgtgtttaaattattttatca

SEQ ID NO: 4201869 - DNA, 17 bp, Homo sapiens
atgtgtttgctttctga

SEQ ID NO: 4201870 - DNA, 15 bp, Homo sapiens
atgtgttttctgaat

SEQ ID NO: 4201871 - DNA, 19 bp, Homo sapiens
atgttaaaaaaataagaag

SEQ ID NO: 4201872 - DNA, 22 bp, Homo sapiens
atgttaaaaaaataagaagaat

SEQ ID NO: 4201873 - DNA, 12 bp, Homo sapiens
atgttaatttat

SEQ ID NO: 4201874 - DNA, 13 bp, Homo sapiens
atgttaatttgtt

SEQ ID NO: 4201875 - DNA, 18 bp, Homo sapiens
atgttatacatcctattt

SEQ ID NO: 4201876 - DNA, 13 bp, Homo sapiens
atgttatatattt

SEQ ID NO: 4201877 - DNA, 16 bp, Homo sapiens
atgttcagttttcctt

SEQ ID NO: 4201878 - DNA, 21 bp, Homo sapiens
atgttggatgatgaaacattc

SEQ ID NO: 4201879 - DNA, 14 bp, Homo sapiens
atgtttaaaccttt

SEQ ID NO: 4201880 - DNA, 20 bp, Homo sapiens
atgtttattcatgggtgtca

SEQ ID NO: 4201881 - DNA, 16 bp, Homo sapiens
atgtttgaagttacaa

SEQ ID NO: 4201882 - DNA, 12 bp, Homo sapiens
atgtttttaatg

SEQ ID NO: 4201883 - DNA, 18 bp, Homo sapiens
attaaaaaggtttacaga

SEQ ID NO: 4201884 - DNA, 14 bp, Homo sapiens
attaaaaatatgga

SEQ ID NO: 4201885 - DNA, 21 bp, Homo sapiens
attaaaaccacagaacagttt

SEQ ID NO: 4201886 - DNA, 17 bp, Homo sapiens
attaaacctggatacta

SEQ ID NO: 4201887 - DNA, 18 bp, Homo sapiens
attaactgggtaatgaaa

SEQ ID NO: 4201888 - DNA, 18 bp, Homo sapiens
attaagaatcattgtgct

SEQ ID NO: 4201889 - DNA, 17 bp, Homo sapiens
attaagattgaggcctg

SEQ ID NO: 4201890 - DNA, 16 bp, Homo sapiens
attaagtgttgttcat

SEQ ID NO: 4201891 - DNA, 16 bp, Homo sapiens
attaatgaaaactttt

SEQ ID NO: 4201892 - DNA, 19 bp, Homo sapiens
attaatgaaaactttttca

SEQ ID NO: 4201893 - DNA, 16 bp, Homo sapiens
attaatgacagaatga

SEQ ID NO: 4201894 - DNA, 23 bp, Homo sapiens
attaattataataaaggtcacat

SEQ ID NO: 4201895 - DNA, 20 bp, Homo sapiens
attaattttcaggatttttg

SEQ ID NO: 4201896 - DNA, 16 bp, Homo sapiens
attacacaagtttaaa

SEQ ID NO: 4201897 - DNA, 22 bp, Homo sapiens
attacattttactgattaacaa

SEQ ID NO: 4201898 - DNA, 23 bp, Homo sapiens
attacattttactgattaacaaa

SEQ ID NO: 4201899 - DNA, 19 bp, Homo sapiens
attaccaaaaaagtatttt

SEQ ID NO: 4201900 - DNA, 17 bp, Homo sapiens
attaccagagttgttct

SEQ ID NO: 4201901 - DNA, 17 bp, Homo sapiens
attaccagatagttata

SEQ ID NO: 4201902 - DNA, 18 bp, Homo sapiens
attacctgccaattgcta

SEQ ID NO: 4201903 - DNA, 19 bp, Homo sapiens
attacctgccaattgctac

SEQ ID NO: 4201904 - DNA, 14 bp, Homo sapiens
attagaaaatccta

SEQ ID NO: 4201905 - DNA, 21 bp, Homo sapiens
attagaaacgtgataaatata

SEQ ID NO: 4201906 - DNA, 22 bp, Homo sapiens
attagaaatagacagtatattt

SEQ ID NO: 4201907 - DNA, 16 bp, Homo sapiens
attagaggtttgtcaa

SEQ ID NO: 4201908 - DNA, 20 bp, Homo sapiens
attagatgttactgtgtgaa

SEQ ID NO: 4201909 - DNA, 14 bp, Homo sapiens
attagttaatatat

SEQ ID NO: 4201910 - DNA, 13 bp, Homo sapiens
attataaaaccat

SEQ ID NO: 4201911 - DNA, 15 bp, Homo sapiens
attataataaaggtc

SEQ ID NO: 4201912 - DNA, 17 bp, Homo sapiens
attataataaaggtcac

SEQ ID NO: 4201913 - DNA, 18 bp, Homo sapiens
attatactctctgaaata

SEQ ID NO: 4201914 - DNA, 21 bp, Homo sapiens
attatactctctgaaatatag

SEQ ID NO: 4201915 - DNA, 20 bp, Homo sapiens
attatagagtatactaaaaa

SEQ ID NO: 4201916 - DNA, 16 bp, Homo sapiens
attatgagtttgctta

SEQ ID NO: 4201917 - DNA, 23 bp, Homo sapiens
attattaataaattttaacattt

SEQ ID NO: 4201918 - DNA, 16 bp, Homo sapiens
attattaatttatgca

SEQ ID NO: 4201919 - DNA, 18 bp, Homo sapiens
attattccttgctttcat

SEQ ID NO: 4201920 - DNA, 20 bp, Homo sapiens
attattggaatataattgtt

SEQ ID NO: 4201921 - DNA, 13 bp, Homo sapiens
attatttaataaa

SEQ ID NO: 4201922 - DNA, 21 bp, Homo sapiens
attatttggcatgcttaaata

SEQ ID NO: 4201923 - DNA, 15 bp, Homo sapiens
attatttgtgtaata

SEQ ID NO: 4201924 - DNA, 18 bp, Homo sapiens
attatttgtgtaatagaa

SEQ ID NO: 4201925 - DNA, 23 bp, Homo sapiens
attatttgtgtaatagaaaactg

SEQ ID NO: 4201926 - DNA, 21 bp, Homo sapiens
attattttaaacaaaatagaa

SEQ ID NO: 4201927 - DNA, 21 bp, Homo sapiens
attatttttgagcaggagcag

SEQ ID NO: 4201928 - DNA, 20 bp, Homo sapiens
attcaagtattaggggtaat

SEQ ID NO: 4201929 - DNA, 14 bp, Homo sapiens
attcaagttattgt

SEQ ID NO: 4201930 - DNA, 15 bp, Homo sapiens
attcaagttattgta

SEQ ID NO: 4201931 - DNA, 12 bp, Homo sapiens
attcacacctta

SEQ ID NO: 4201932 - DNA, 11 bp, Homo sapiens
attcacagccc

SEQ ID NO: 4201933 - DNA, 18 bp, Homo sapiens
attcacagcccagaacca

SEQ ID NO: 4201934 - DNA, 16 bp, Homo sapiens
attcacccagaaaaaa

SEQ ID NO: 4201935 - DNA, 18 bp, Homo sapiens
attcagaagaaaaagaag

SEQ ID NO: 4201936 - DNA, 14 bp, Homo sapiens
attcagacagatga

SEQ ID NO: 4201937 - DNA, 21 bp, Homo sapiens
attcagatatatttttcacag

SEQ ID NO: 4201938 - DNA, 19 bp, Homo sapiens
attcagcctggccatcccc

SEQ ID NO: 4201939 - DNA, 17 bp, Homo sapiens
attcaggtgttctcttc

SEQ ID NO: 4201940 - DNA, 14 bp, Homo sapiens
attcagtaacattt

SEQ ID NO: 4201941 - DNA, 21 bp, Homo sapiens
attcagtgctgtggcctgggc

SEQ ID NO: 4201942 - DNA, 19 bp, Homo sapiens
attcatctcatgctctctg

SEQ ID NO: 4201943 - DNA, 21 bp, Homo sapiens
attcatgccaaagcaaaagaa

SEQ ID NO: 4201944 - DNA, 18 bp, Homo sapiens
attcatgctttctccttt

SEQ ID NO: 4201945 - DNA, 13 bp, Homo sapiens
attcatgggtgtc

SEQ ID NO: 4201946 - DNA, 16 bp, Homo sapiens
attcatttttaccttg

SEQ ID NO: 4201947 - DNA, 23 bp, Homo sapiens
attccaactcgtatagcatgcat

SEQ ID NO: 4201948 - DNA, 22 bp, Homo sapiens
attccaagggtatgggaagcca

SEQ ID NO: 4201949 - DNA, 22 bp, Homo sapiens
attccagcatttgccattcctg

SEQ ID NO: 4201950 - DNA, 16 bp, Homo sapiens
attccatgggatgtta

SEQ ID NO: 4201951 - DNA, 17 bp, Homo sapiens
attccatgggatgttaa

SEQ ID NO: 4201952 - DNA, 18 bp, Homo sapiens
attcccaactgctctgcc

SEQ ID NO: 4201953 - DNA, 14 bp, Homo sapiens
attcccaccaaggt

SEQ ID NO: 4201954 - DNA, 15 bp, Homo sapiens
attcccaccaaggtc

SEQ ID NO: 4201955 - DNA, 19 bp, Homo sapiens
attcccactaagctttctc

SEQ ID NO: 4201956 - DNA, 22 bp, Homo sapiens
attcccactaagctttctcctt

SEQ ID NO: 4201957 - DNA, 12 bp, Homo sapiens
attcctatcagt

SEQ ID NO: 4201958 - DNA, 22 bp, Homo sapiens
attcctattgtgcaatgtaaat

SEQ ID NO: 4201959 - DNA, 22 bp, Homo sapiens
caacatttatttcaaactattg

SEQ ID NO: 4201960 - DNA, 22 bp, Homo sapiens
caacatttctatagccaaaaat

SEQ ID NO: 4201961 - DNA, 14 bp, Homo sapiens
caaccacaaaccac

SEQ ID NO: 4201962 - DNA, 19 bp, Homo sapiens
caacctcccctggtcctgc

SEQ ID NO: 4201963 - DNA, 21 bp, Homo sapiens
caacctcccctggtcctgcac

SEQ ID NO: 4201964 - DNA, 17 bp, Homo sapiens
caacctcttcagctggg

SEQ ID NO: 4201965 - DNA, 17 bp, Homo sapiens
caacctgcccctcccca

SEQ ID NO: 4201966 - DNA, 22 bp, Homo sapiens
caacctgcccctccccagccct

SEQ ID NO: 4201967 - DNA, 17 bp, Homo sapiens
caacctgcctgtgcatg

SEQ ID NO: 4201968 - DNA, 17 bp, Homo sapiens
caacctggaaaataaat

SEQ ID NO: 4201969 - DNA, 21 bp, Homo sapiens
caactaaataaaaaattcaaa

SEQ ID NO: 4201970 - DNA, 17 bp, Homo sapiens
caactaggcttcagcat

SEQ ID NO: 4201971 - DNA, 14 bp, Homo sapiens
caactattttcaga

SEQ ID NO: 4201972 - DNA, 23 bp, Homo sapiens
caactcacttttttacaactcca

SEQ ID NO: 4201973 - DNA, 17 bp, Homo sapiens
caactcccacgactgtt

SEQ ID NO: 4201974 - DNA, 13 bp, Homo sapiens
caactctccactc

SEQ ID NO: 4201975 - DNA, 16 bp, Homo sapiens
caactctccactccat

SEQ ID NO: 4201976 - DNA, 13 bp, Homo sapiens
caacttggctttc

SEQ ID NO: 4201977 - DNA, 23 bp, Homo sapiens
caactttatgtagcaaagggctt

SEQ ID NO: 4201978 - DNA, 20 bp, Homo sapiens
caactttctcactgctgtca

SEQ ID NO: 4201979 - DNA, 11 bp, Homo sapiens
caactttctgt

SEQ ID NO: 4201980 - DNA, 12 bp, Homo sapiens
caactttctgta

SEQ ID NO: 4201981 - DNA, 23 bp, Homo sapiens
caactttctgtaaactcaaaact

SEQ ID NO: 4201982 - DNA, 17 bp, Homo sapiens
caagaaacagaagtaga

SEQ ID NO: 4201983 - DNA, 16 bp, Homo sapiens
caagaaatttgatttc

SEQ ID NO: 4201984 - DNA, 14 bp, Homo sapiens
caagaacaacaaca

SEQ ID NO: 4201985 - DNA, 22 bp, Homo sapiens
caagaacaacaacaacaataac

SEQ ID NO: 4201986 - DNA, 17 bp, Homo sapiens
caagaagcattttgtaa

SEQ ID NO: 4201987 - DNA, 13 bp, Homo sapiens
caagaagctgcta

SEQ ID NO: 4201988 - DNA, 22 bp, Homo sapiens
caagaagctttaatatttaaat

SEQ ID NO: 4201989 - DNA, 20 bp, Homo sapiens
caagaaggaaagatttgtga

SEQ ID NO: 4201990 - DNA, 21 bp, Homo sapiens
caagaaggaaagatttgtgaa

SEQ ID NO: 4201991 - DNA, 17 bp, Homo sapiens
caagaatattcaaatgt

SEQ ID NO: 4201992 - DNA, 19 bp, Homo sapiens
caagaattctagaaaattt

SEQ ID NO: 4201993 - DNA, 20 bp, Homo sapiens
caagaattgtccatgtgctt

SEQ ID NO: 4201994 - DNA, 15 bp, Homo sapiens
caagactccatttca

SEQ ID NO: 4201995 - DNA, 11 bp, Homo sapiens
caagactgatc

SEQ ID NO: 4201996 - DNA, 13 bp, Homo sapiens
caagactgtggta

SEQ ID NO: 4201997 - DNA, 12 bp, Homo sapiens
caagagactctg

SEQ ID NO: 4201998 - DNA, 16 bp, Homo sapiens
caagagcagaggcagc

SEQ ID NO: 4201999 - DNA, 22 bp, Homo sapiens
caagagtttatttccaaataaa

SEQ ID NO: 4202000 - DNA, 22 bp, Homo sapiens
caagataaaggaagtcaccaaa

SEQ ID NO: 4202001 - DNA, 14 bp, Homo sapiens
caagatctttcagg

SEQ ID NO: 4202002 - DNA, 13 bp, Homo sapiens
caagatgccctca

SEQ ID NO: 4202003 - DNA, 15 bp, Homo sapiens
caagatggaaaataa

SEQ ID NO: 4202004 - DNA, 23 bp, Homo sapiens
caagatttaacactaaaaaggtt

SEQ ID NO: 4202005 - DNA, 22 bp, Homo sapiens
caagcaagaggtggtagaacca

SEQ ID NO: 4202006 - DNA, 14 bp, Homo sapiens
caagcacagacatt

SEQ ID NO: 4202007 - DNA, 23 bp, Homo sapiens
caagcactgctaggcgagtgcca

SEQ ID NO: 4202008 - DNA, 16 bp, Homo sapiens
caagcagccgcagcgc

SEQ ID NO: 4202009 - DNA, 15 bp, Homo sapiens
caagcagggctctgc

SEQ ID NO: 4202010 - DNA, 18 bp, Homo sapiens
caagcatggctattttat

SEQ ID NO: 4202011 - DNA, 13 bp, Homo sapiens
caagcattctcct

SEQ ID NO: 4202012 - DNA, 15 bp, Homo sapiens
caagcattctcctgt

SEQ ID NO: 4202013 - DNA, 19 bp, Homo sapiens
caagccatggcatgctcct

SEQ ID NO: 4202014 - DNA, 21 bp, Homo sapiens
caagccattttttgaggagag

SEQ ID NO: 4202015 - DNA, 13 bp, Homo sapiens
caagcctgagaac

SEQ ID NO: 4202016 - DNA, 12 bp, Homo sapiens
caagcctggccc

SEQ ID NO: 4202017 - DNA, 17 bp, Homo sapiens
caagccttactcacctc

SEQ ID NO: 4202018 - DNA, 18 bp, Homo sapiens
caagccttactcacctct

SEQ ID NO: 4202019 - DNA, 17 bp, Homo sapiens
caagcgggggcgtggct

SEQ ID NO: 4202020 - DNA, 16 bp, Homo sapiens
caagctatttctctgg

SEQ ID NO: 4202021 - DNA, 13 bp, Homo sapiens
caagctggaagca

SEQ ID NO: 4202022 - DNA, 20 bp, Homo sapiens
caagcttaatggctgataat

SEQ ID NO: 4202023 - DNA, 14 bp, Homo sapiens
caaggaaacattaa

SEQ ID NO: 4202024 - DNA, 17 bp, Homo sapiens
caaggaacaagagaaaa

SEQ ID NO: 4202025 - DNA, 19 bp, Homo sapiens
caaggacaatgccttggga

SEQ ID NO: 4202026 - DNA, 21 bp, Homo sapiens
caaggactacgttaagggaag

SEQ ID NO: 4202027 - DNA, 19 bp, Homo sapiens
caaggagttccatgaagac

SEQ ID NO: 4202028 - DNA, 23 bp, Homo sapiens
caaggagttccatgaagaccaca

SEQ ID NO: 4202029 - DNA, 18 bp, Homo sapiens
caaggcatacctgtccta

SEQ ID NO: 4202030 - DNA, 14 bp, Homo sapiens
caaggcattcctca

SEQ ID NO: 4202031 - DNA, 13 bp, Homo sapiens
caaggcggtgctt

SEQ ID NO: 4202032 - DNA, 16 bp, Homo sapiens
caaggcggtgcttgat

SEQ ID NO: 4202033 - DNA, 14 bp, Homo sapiens
caagggccatgctg

SEQ ID NO: 4202034 - DNA, 13 bp, Homo sapiens
caaggtctgcttt

SEQ ID NO: 4202035 - DNA, 18 bp, Homo sapiens
caaggtgatttcagactg

SEQ ID NO: 4202036 - DNA, 23 bp, Homo sapiens
caaggtgatttcagactgcagag

SEQ ID NO: 4202037 - DNA, 12 bp, Homo sapiens
caaggtgctctg

SEQ ID NO: 4202038 - DNA, 15 bp, Homo sapiens
caaggtgctctgtgt

SEQ ID NO: 4202039 - DNA, 18 bp, Homo sapiens
caaggtgggctgagccct

SEQ ID NO: 4202040 - DNA, 20 bp, Homo sapiens
caaggtgggctgagccctgg

SEQ ID NO: 4202041 - DNA, 22 bp, Homo sapiens
caaggtggggggatcacaaggt

SEQ ID NO: 4202042 - DNA, 15 bp, Homo sapiens
caaggttcttctaaa

SEQ ID NO: 4202043 - DNA, 20 bp, Homo sapiens
caagtacatggctagctttt

SEQ ID NO: 4202044 - DNA, 14 bp, Homo sapiens
caagtaccaccaag

SEQ ID NO: 4202045 - DNA, 22 bp, Homo sapiens
caagtagatcatggcagcatga

SEQ ID NO: 4202046 - DNA, 13 bp, Homo sapiens
caagtccaacctg

SEQ ID NO: 4202047 - DNA, 13 bp, Homo sapiens
caagtccagagcc

SEQ ID NO: 4202048 - DNA, 21 bp, Homo sapiens
caagtccctgactctctgtga

SEQ ID NO: 4202049 - DNA, 18 bp, Homo sapiens
caagtgtatatcagaaaa

SEQ ID NO: 4202050 - DNA, 16 bp, Homo sapiens
caagttagctcaggag

SEQ ID NO: 4202051 - DNA, 21 bp, Homo sapiens
caagttcctctagtgccctcc

SEQ ID NO: 4202052 - DNA, 15 bp, Homo sapiens
caagttcctgcactc

SEQ ID NO: 4202053 - DNA, 20 bp, Homo sapiens
caagttcctgcactccagaa

SEQ ID NO: 4202054 - DNA, 13 bp, Homo sapiens
caagttctagaga

SEQ ID NO: 4202055 - DNA, 21 bp, Homo sapiens
caagttctagagaagaggctg

SEQ ID NO: 4202056 - DNA, 15 bp, Homo sapiens
caagtttaaaaatat

SEQ ID NO: 4202057 - DNA, 22 bp, Homo sapiens
caataaaaatctttgattcaga

SEQ ID NO: 4202058 - DNA, 17 bp, Homo sapiens
caataaacatagcttgt

SEQ ID NO: 4202059 - DNA, 22 bp, Homo sapiens
caataaagagttagaatgaaaa

SEQ ID NO: 4202060 - DNA, 23 bp, Homo sapiens
caataaagctgctgagaatctag

SEQ ID NO: 4202061 - DNA, 12 bp, Homo sapiens
caataaagctgg

SEQ ID NO: 4202062 - DNA, 13 bp, Homo sapiens
caataaagctgga

SEQ ID NO: 4202063 - DNA, 14 bp, Homo sapiens
caataaagctggac

SEQ ID NO: 4202064 - DNA, 23 bp, Homo sapiens
caataaattatttttaagaaatc

SEQ ID NO: 4202065 - DNA, 12 bp, Homo sapiens
caataacaacaa

SEQ ID NO: 4202066 - DNA, 15 bp, Homo sapiens
caataacgtttaagc

SEQ ID NO: 4202067 - DNA, 17 bp, Homo sapiens
caataagttccatgtta

SEQ ID NO: 4202068 - DNA, 17 bp, Homo sapiens
caataatatttcaagtg

SEQ ID NO: 4202069 - DNA, 20 bp, Homo sapiens
caataatatttcaagtgcct

SEQ ID NO: 4202070 - DNA, 21 bp, Homo sapiens
caataatatttcaagtgccta

SEQ ID NO: 4202071 - DNA, 16 bp, Homo sapiens
caatagtttgcataga

SEQ ID NO: 4202072 - DNA, 13 bp, Homo sapiens
caatataaattgg

SEQ ID NO: 4202073 - DNA, 20 bp, Homo sapiens
caatatgtagccttttatcc

SEQ ID NO: 4202074 - DNA, 14 bp, Homo sapiens
caatattcaataaa

SEQ ID NO: 4202075 - DNA, 16 bp, Homo sapiens
caatattcaataaagc

SEQ ID NO: 4202076 - DNA, 17 bp, Homo sapiens
caatattcaataaagct

SEQ ID NO: 4202077 - DNA, 17 bp, Homo sapiens
caatatttactcatcag

SEQ ID NO: 4202078 - DNA, 18 bp, Homo sapiens
caatcaagtctgtttact

SEQ ID NO: 4202079 - DNA, 14 bp, Homo sapiens
caatcagagagcct

SEQ ID NO: 4202080 - DNA, 17 bp, Homo sapiens
caatcagagagcctaga

SEQ ID NO: 4202081 - DNA, 21 bp, Homo sapiens
caatccatgttagtttttact

SEQ ID NO: 4202082 - DNA, 22 bp, Homo sapiens
caatcccttaatatcctaaaca

SEQ ID NO: 4202083 - DNA, 18 bp, Homo sapiens
caatcctgaagaaaccac

SEQ ID NO: 4202084 - DNA, 20 bp, Homo sapiens
caatctggcttagtgccacc

SEQ ID NO: 4202085 - DNA, 20 bp, Homo sapiens
caatgaaggaaaacctcact

SEQ ID NO: 4202086 - DNA, 17 bp, Homo sapiens
caatggacttcaaattg

SEQ ID NO: 4202087 - DNA, 19 bp, Homo sapiens
caatggagtctgcagtgag

SEQ ID NO: 4202088 - DNA, 17 bp, Homo sapiens
caatggctaattcccag

SEQ ID NO: 4202089 - DNA, 22 bp, Homo sapiens
caatggtactctaatcagtcct

SEQ ID NO: 4202090 - DNA, 22 bp, Homo sapiens
caatggtgttgccctgagtgga

SEQ ID NO: 4202091 - DNA, 18 bp, Homo sapiens
caatggtttacatgaaca

SEQ ID NO: 4202092 - DNA, 19 bp, Homo sapiens
caatgtaaatattttaaag

SEQ ID NO: 4202093 - DNA, 16 bp, Homo sapiens
cagaagtttggcaata

SEQ ID NO: 4202094 - DNA, 18 bp, Homo sapiens
cagaatagataaattttg

SEQ ID NO: 4202095 - DNA, 15 bp, Homo sapiens
cagaatcttcgtcct

SEQ ID NO: 4202096 - DNA, 16 bp, Homo sapiens
cagaatgctgttttaa

SEQ ID NO: 4202097 - DNA, 19 bp, Homo sapiens
cagaatgggccactgtagg

SEQ ID NO: 4202098 - DNA, 21 bp, Homo sapiens
cagaatgtcattttggtactt

SEQ ID NO: 4202099 - DNA, 21 bp, Homo sapiens
cagaatgtgataaggaaatca

SEQ ID NO: 4202100 - DNA, 22 bp, Homo sapiens
cagaatgttgattacagtgcag

SEQ ID NO: 4202101 - DNA, 15 bp, Homo sapiens
cagaattaactccat

SEQ ID NO: 4202102 - DNA, 23 bp, Homo sapiens
cagaattactgtaactgattaca

SEQ ID NO: 4202103 - DNA, 16 bp, Homo sapiens
cagacagtcaaggaga

SEQ ID NO: 4202104 - DNA, 17 bp, Homo sapiens
cagacagtcaaggagat

SEQ ID NO: 4202105 - DNA, 16 bp, Homo sapiens
cagacccacacatgtt

SEQ ID NO: 4202106 - DNA, 17 bp, Homo sapiens
cagacccacctggagcc

SEQ ID NO: 4202107 - DNA, 18 bp, Homo sapiens
cagacccacctggagccc

SEQ ID NO: 4202108 - DNA, 21 bp, Homo sapiens
cagacccacctggagcccgct

SEQ ID NO: 4202109 - DNA, 13 bp, Homo sapiens
cagaccccttggc

SEQ ID NO: 4202110 - DNA, 15 bp, Homo sapiens
cagaccccttggctt

SEQ ID NO: 4202111 - DNA, 15 bp, Homo sapiens
cagaccttttttagg

SEQ ID NO: 4202112 - DNA, 14 bp, Homo sapiens
cagacgagatcctg

SEQ ID NO: 4202113 - DNA, 18 bp, Homo sapiens
cagactatttaacttgag

SEQ ID NO: 4202114 - DNA, 16 bp, Homo sapiens
cagactcagctccaga

SEQ ID NO: 4202115 - DNA, 23 bp, Homo sapiens
cagactccttcaacaattctaaa

SEQ ID NO: 4202116 - DNA, 15 bp, Homo sapiens
cagactctttatgct

SEQ ID NO: 4202117 - DNA, 23 bp, Homo sapiens
cagactgctgggactggccaggt

SEQ ID NO: 4202118 - DNA, 15 bp, Homo sapiens
cagacttctccagac

SEQ ID NO: 4202119 - DNA, 18 bp, Homo sapiens
cagagaaagaagagacag

SEQ ID NO: 4202120 - DNA, 21 bp, Homo sapiens
cagagaaagaagagacaggag

SEQ ID NO: 4202121 - DNA, 22 bp, Homo sapiens
cagagaaagaagagacaggagg

SEQ ID NO: 4202122 - DNA, 16 bp, Homo sapiens
cagagaaattctgtgg

SEQ ID NO: 4202123 - DNA, 16 bp, Homo sapiens
cagagaaccattccca

SEQ ID NO: 4202124 - DNA, 14 bp, Homo sapiens
cagagaagaaagaa

SEQ ID NO: 4202125 - DNA, 18 bp, Homo sapiens
cagagaagaaagaacgga

SEQ ID NO: 4202126 - DNA, 19 bp, Homo sapiens
cagagaagaaagaacggaa

SEQ ID NO: 4202127 - DNA, 22 bp, Homo sapiens
cagagacagaccccttggcttt

SEQ ID NO: 4202128 - DNA, 23 bp, Homo sapiens
cagagacagaccccttggctttt

SEQ ID NO: 4202129 - DNA, 16 bp, Homo sapiens
cagagaccccttcctt

SEQ ID NO: 4202130 - DNA, 21 bp, Homo sapiens
cagagaccccttcctttcctc

SEQ ID NO: 4202131 - DNA, 22 bp, Homo sapiens
cagagaccccttcctttcctct

SEQ ID NO: 4202132 - DNA, 19 bp, Homo sapiens
cagagacttggggaccaga

SEQ ID NO: 4202133 - DNA, 14 bp, Homo sapiens
cagagagaagcctg

SEQ ID NO: 4202134 - DNA, 12 bp, Homo sapiens
cagagagggcag

SEQ ID NO: 4202135 - DNA, 15 bp, Homo sapiens
cagagatctgggagg

SEQ ID NO: 4202136 - DNA, 18 bp, Homo sapiens
cagagcacagcccacggg

SEQ ID NO: 4202137 - DNA, 13 bp, Homo sapiens
cagagcactgctc

SEQ ID NO: 4202138 - DNA, 18 bp, Homo sapiens
cagagcaggccacgctca

SEQ ID NO: 4202139 - DNA, 12 bp, Homo sapiens
cagagcaggctc

SEQ ID NO: 4202140 - DNA, 15 bp, Homo sapiens
cagagcaggggccag

SEQ ID NO: 4202141 - DNA, 23 bp, Homo sapiens
cagagcaggggtccttggtgtga

SEQ ID NO: 4202142 - DNA, 19 bp, Homo sapiens
cagagcattacgtgagcca

SEQ ID NO: 4202143 - DNA, 20 bp, Homo sapiens
cagagccaaggggcttcagg

SEQ ID NO: 4202144 - DNA, 17 bp, Homo sapiens
cagagccaccagggcac

SEQ ID NO: 4202145 - DNA, 17 bp, Homo sapiens
cagagccaggctctgcc

SEQ ID NO: 4202146 - DNA, 16 bp, Homo sapiens
cagagcctccacttag

SEQ ID NO: 4202147 - DNA, 18 bp, Homo sapiens
cagagccttcaagtgcca

SEQ ID NO: 4202148 - DNA, 19 bp, Homo sapiens
cagagctgatggagaagga

SEQ ID NO: 4202149 - DNA, 12 bp, Homo sapiens
cagaggaaaaag

SEQ ID NO: 4202150 - DNA, 18 bp, Homo sapiens
cagaggaaaaagaaaaac

SEQ ID NO: 4202151 - DNA, 21 bp, Homo sapiens
cagaggaaaaagaaaaacatt

SEQ ID NO: 4202152 - DNA, 14 bp, Homo sapiens
cagaggacagagct

SEQ ID NO: 4202153 - DNA, 21 bp, Homo sapiens
cagaggacagtctggagaagg

SEQ ID NO: 4202154 - DNA, 18 bp, Homo sapiens
cagagggcccaggcaggc

SEQ ID NO: 4202155 - DNA, 22 bp, Homo sapiens
cagaggggagcttgagggacaa

SEQ ID NO: 4202156 - DNA, 18 bp, Homo sapiens
cagaggggtgctgctcct

SEQ ID NO: 4202157 - DNA, 15 bp, Homo sapiens
cagaggtgacagtgg

SEQ ID NO: 4202158 - DNA, 16 bp, Homo sapiens
cagagtcaggaagaga

SEQ ID NO: 4202159 - DNA, 17 bp, Homo sapiens
cagagtgaaataaaatg

SEQ ID NO: 4202160 - DNA, 19 bp, Homo sapiens
cagagtgagaccctgtctc

SEQ ID NO: 4202161 - DNA, 15 bp, Homo sapiens
cagagtgccactgcg

SEQ ID NO: 4202162 - DNA, 16 bp, Homo sapiens
cagagtgtagaataat

SEQ ID NO: 4202163 - DNA, 22 bp, Homo sapiens
cagagttgggatgcggggcaga

SEQ ID NO: 4202164 - DNA, 19 bp, Homo sapiens
cagataactgaaaattatt

SEQ ID NO: 4202165 - DNA, 21 bp, Homo sapiens
cagatagacagtgctgccctg

SEQ ID NO: 4202166 - DNA, 16 bp, Homo sapiens
cagatatatttttcac

SEQ ID NO: 4202167 - DNA, 18 bp, Homo sapiens
cagatcctactcttcctt

SEQ ID NO: 4202168 - DNA, 17 bp, Homo sapiens
cagatctgcactgggtg

SEQ ID NO: 4202169 - DNA, 13 bp, Homo sapiens
cagatctgggatt

SEQ ID NO: 4202170 - DNA, 22 bp, Homo sapiens
cagatcttccgtggtcagagtg

SEQ ID NO: 4202171 - DNA, 16 bp, Homo sapiens
cagatgaggctttcca

SEQ ID NO: 4202172 - DNA, 16 bp, Homo sapiens
cagatgcagctcaaga

SEQ ID NO: 4202173 - DNA, 16 bp, Homo sapiens
cagatgccacacctgc

SEQ ID NO: 4202174 - DNA, 20 bp, Homo sapiens
cagatgcccagagggcccag

SEQ ID NO: 4202175 - DNA, 22 bp, Homo sapiens
cagatgcccagagggcccaggc

SEQ ID NO: 4202176 - DNA, 22 bp, Homo sapiens
cagatgctgtcactggcagagc

SEQ ID NO: 4202177 - DNA, 14 bp, Homo sapiens
cagatggtagagag

SEQ ID NO: 4202178 - DNA, 15 bp, Homo sapiens
cagatggtagagaga

SEQ ID NO: 4202179 - DNA, 22 bp, Homo sapiens
cagatgtgtctgggagagcctg

SEQ ID NO: 4202180 - DNA, 14 bp, Homo sapiens
cagcaacacagagc

SEQ ID NO: 4202181 - DNA, 14 bp, Homo sapiens
cagcaactcccacg

SEQ ID NO: 4202182 - DNA, 17 bp, Homo sapiens
cagcaagtttcaccttg

SEQ ID NO: 4202183 - DNA, 18 bp, Homo sapiens
cagcacaacccccaggaa

SEQ ID NO: 4202184 - DNA, 16 bp, Homo sapiens
cagcacccctgtctct

SEQ ID NO: 4202185 - DNA, 21 bp, Homo sapiens
cagcactttaaccctctcttc

SEQ ID NO: 4202186 - DNA, 19 bp, Homo sapiens
cagcactttgggaggctga

SEQ ID NO: 4202187 - DNA, 23 bp, Homo sapiens
cagcactttgggaggctgaggcg

SEQ ID NO: 4202188 - DNA, 21 bp, Homo sapiens
cagcagaggacagtctggaga

SEQ ID NO: 4202189 - DNA, 16 bp, Homo sapiens
cagcagccccctgccc

SEQ ID NO: 4202190 - DNA, 23 bp, Homo sapiens
cagcagcccctctttaacctcat

SEQ ID NO: 4202191 - DNA, 21 bp, Homo sapiens
cagcaggcaggcactgtggcc

SEQ ID NO: 4202192 - DNA, 15 bp, Homo sapiens
cagcagtgagcttct

SEQ ID NO: 4202193 - DNA, 14 bp, Homo sapiens
cagcagtggcagga

SEQ ID NO: 4202194 - DNA, 20 bp, Homo sapiens
cagcagttccatgaagacac

SEQ ID NO: 4202195 - DNA, 23 bp, Homo sapiens
cagcagttgaatgacaacagaag

SEQ ID NO: 4202196 - DNA, 23 bp, Homo sapiens
cagcataagtaaacaacatattt

SEQ ID NO: 4202197 - DNA, 20 bp, Homo sapiens
cagcatccccttgaactctt

SEQ ID NO: 4202198 - DNA, 21 bp, Homo sapiens
cagcatttactatgccacaga

SEQ ID NO: 4202199 - DNA, 13 bp, Homo sapiens
cagccaactcatt

SEQ ID NO: 4202200 - DNA, 16 bp, Homo sapiens
cagccaactgccccgg

SEQ ID NO: 4202201 - DNA, 14 bp, Homo sapiens
cagccactcgggag

SEQ ID NO: 4202202 - DNA, 19 bp, Homo sapiens
cagccagccggtgcctggc

SEQ ID NO: 4202203 - DNA, 22 bp, Homo sapiens
cagccaggaactggctcctttg

SEQ ID NO: 4202204 - DNA, 16 bp, Homo sapiens
cagccattaccatgga

SEQ ID NO: 4202205 - DNA, 20 bp, Homo sapiens
cagccattaccatggagaca

SEQ ID NO: 4202206 - DNA, 13 bp, Homo sapiens
cagcccagaacca

SEQ ID NO: 4202207 - DNA, 17 bp, Homo sapiens
cagcccagaaccacaga

SEQ ID NO: 4202208 - DNA, 15 bp, Homo sapiens
cagcccaggtcctcc

SEQ ID NO: 4202209 - DNA, 19 bp, Homo sapiens
cagcccaggtcctcccggg

SEQ ID NO: 4202210 - DNA, 16 bp, Homo sapiens
cagccccgcgcctcct

SEQ ID NO: 4202211 - DNA, 16 bp, Homo sapiens
cagccctaaacatcat

SEQ ID NO: 4202212 - DNA, 20 bp, Homo sapiens
cagccctcctacgcagatgc

SEQ ID NO: 4202213 - DNA, 17 bp, Homo sapiens
cagccctttgcaggccc

SEQ ID NO: 4202214 - DNA, 22 bp, Homo sapiens
cagccctttgcaggcccagcag

SEQ ID NO: 4202215 - DNA, 16 bp, Homo sapiens
cagccgcagcgcagcc

SEQ ID NO: 4202216 - DNA, 13 bp, Homo sapiens
cagcctccctctg

SEQ ID NO: 4202217 - DNA, 14 bp, Homo sapiens
cagcctccctctga

SEQ ID NO: 4202218 - DNA, 22 bp, Homo sapiens
cagcctccctctgacctgcagg

SEQ ID NO: 4202219 - DNA, 23 bp, Homo sapiens
cagcctccctctgacctgcaggc

SEQ ID NO: 4202220 - DNA, 19 bp, Homo sapiens
cagcctcttaaagctgcct

SEQ ID NO: 4202221 - DNA, 21 bp, Homo sapiens
cagcctcttaaagctgcctgt

SEQ ID NO: 4202222 - DNA, 16 bp, Homo sapiens
cagcctcttccccacc

SEQ ID NO: 4202223 - DNA, 22 bp, Homo sapiens
cagcctgactagaccccaccct

SEQ ID NO: 4202224 - DNA, 18 bp, Homo sapiens
cagcctgaggctgagact

SEQ ID NO: 4202225 - DNA, 14 bp, Homo sapiens
cagcctggcttctg

SEQ ID NO: 4202226 - DNA, 19 bp, Homo sapiens
catataaaatatatttatg

SEQ ID NO: 4202227 - DNA, 12 bp, Homo sapiens
catataaagtat

SEQ ID NO: 4202228 - DNA, 16 bp, Homo sapiens
catatatactacatga

SEQ ID NO: 4202229 - DNA, 17 bp, Homo sapiens
catatatatactattaa

SEQ ID NO: 4202230 - DNA, 22 bp, Homo sapiens
catatgaaaaaaatgcatttta

SEQ ID NO: 4202231 - DNA, 20 bp, Homo sapiens
catatgcgtcccaagcagcc

SEQ ID NO: 4202232 - DNA, 14 bp, Homo sapiens
catatgctccagga

SEQ ID NO: 4202233 - DNA, 16 bp, Homo sapiens
catatttatactttgc

SEQ ID NO: 4202234 - DNA, 12 bp, Homo sapiens
catcacagaatg

SEQ ID NO: 4202235 - DNA, 13 bp, Homo sapiens
catcacctcaggc

SEQ ID NO: 4202236 - DNA, 23 bp, Homo sapiens
catcactgagttttccatggcag

SEQ ID NO: 4202237 - DNA, 20 bp, Homo sapiens
catcagcatttaataaatgt

SEQ ID NO: 4202238 - DNA, 13 bp, Homo sapiens
catcagggtgggc

SEQ ID NO: 4202239 - DNA, 20 bp, Homo sapiens
catcagggtgggccactctc

SEQ ID NO: 4202240 - DNA, 22 bp, Homo sapiens
catcagggtgggccactctccc

SEQ ID NO: 4202241 - DNA, 19 bp, Homo sapiens
catccaaccccccacctgc

SEQ ID NO: 4202242 - DNA, 17 bp, Homo sapiens
catccacgcacacatgg

SEQ ID NO: 4202243 - DNA, 14 bp, Homo sapiens
catcccctttcctc

SEQ ID NO: 4202244 - DNA, 19 bp, Homo sapiens
catcccctttcctccccac

SEQ ID NO: 4202245 - DNA, 15 bp, Homo sapiens
catccctgggcaagt

SEQ ID NO: 4202246 - DNA, 21 bp, Homo sapiens
catcccttccctgtccacctc

SEQ ID NO: 4202247 - DNA, 13 bp, Homo sapiens
catcctattttgt

SEQ ID NO: 4202248 - DNA, 23 bp, Homo sapiens
catccttcatctggattccagag

SEQ ID NO: 4202249 - DNA, 17 bp, Homo sapiens
catccttttctgcagag

SEQ ID NO: 4202250 - DNA, 19 bp, Homo sapiens
catccttttctgcagaggg

SEQ ID NO: 4202251 - DNA, 12 bp, Homo sapiens
catcgtccagcc

SEQ ID NO: 4202252 - DNA, 23 bp, Homo sapiens
catctaatagcgggttactttca

SEQ ID NO: 4202253 - DNA, 23 bp, Homo sapiens
catctagagattttcttggcagt

SEQ ID NO: 4202254 - DNA, 19 bp, Homo sapiens
catctattataaaaccatg

SEQ ID NO: 4202255 - DNA, 21 bp, Homo sapiens
catctcaaatccttgagcact

SEQ ID NO: 4202256 - DNA, 13 bp, Homo sapiens
catctcactttgc

SEQ ID NO: 4202257 - DNA, 18 bp, Homo sapiens
catctcaggccagagcca

SEQ ID NO: 4202258 - DNA, 21 bp, Homo sapiens
catctctctactcctacctca

SEQ ID NO: 4202259 - DNA, 23 bp, Homo sapiens
catctctctactcctacctcagc

SEQ ID NO: 4202260 - DNA, 20 bp, Homo sapiens
catctggtttttaaaagata

SEQ ID NO: 4202261 - DNA, 23 bp, Homo sapiens
catctggtttttaaaagataaac

SEQ ID NO: 4202262 - DNA, 20 bp, Homo sapiens
catctgttgttttgttttaa

SEQ ID NO: 4202263 - DNA, 13 bp, Homo sapiens
catctttaagtat

SEQ ID NO: 4202264 - DNA, 21 bp, Homo sapiens
catcttttgtgagatgtaatt

SEQ ID NO: 4202265 - DNA, 20 bp, Homo sapiens
catgaaaaacacggcagctg

SEQ ID NO: 4202266 - DNA, 22 bp, Homo sapiens
catgaaaaacacggcagctgta

SEQ ID NO: 4202267 - DNA, 19 bp, Homo sapiens
catgaaaattatctccctt

SEQ ID NO: 4202268 - DNA, 24 bp, Homo sapiens
catgaaattgtctagcagagcagg

SEQ ID NO: 4202269 - DNA, 20 bp, Homo sapiens
catgaacagggtccctggat

SEQ ID NO: 4202270 - DNA, 15 bp, Homo sapiens
catgaagacaggaca

SEQ ID NO: 4202271 - DNA, 17 bp, Homo sapiens
catgaagacaggacagt

SEQ ID NO: 4202272 - DNA, 13 bp, Homo sapiens
catgaattcttga

SEQ ID NO: 4202273 - DNA, 16 bp, Homo sapiens
catgaattcttgagtt

SEQ ID NO: 4202274 - DNA, 15 bp, Homo sapiens
catgacatgttatat

SEQ ID NO: 4202275 - DNA, 15 bp, Homo sapiens
catgacgtaaaattt

SEQ ID NO: 4202276 - DNA, 21 bp, Homo sapiens
catgacttttccatgtatcta

SEQ ID NO: 4202277 - DNA, 18 bp, Homo sapiens
catgagaaatacaaaaat

SEQ ID NO: 4202278 - DNA, 23 bp, Homo sapiens
catgagagaattgtatcatttga

SEQ ID NO: 4202279 - DNA, 16 bp, Homo sapiens
catgagaggactgatg

SEQ ID NO: 4202280 - DNA, 16 bp, Homo sapiens
catgaggaaagacaca

SEQ ID NO: 4202281 - DNA, 19 bp, Homo sapiens
catgaggaaagacacagat

SEQ ID NO: 4202282 - DNA, 21 bp, Homo sapiens
catgaggacatgatggagcgc

SEQ ID NO: 4202283 - DNA, 22 bp, Homo sapiens
catgaggacatgatggagcgca

SEQ ID NO: 4202284 - DNA, 16 bp, Homo sapiens
catgatgcctctgtct

SEQ ID NO: 4202285 - DNA, 17 bp, Homo sapiens
catgatgcctctgtctt

SEQ ID NO: 4202286 - DNA, 23 bp, Homo sapiens
catgatgcctctgtcttctggac

SEQ ID NO: 4202287 - DNA, 19 bp, Homo sapiens
catgatggagcgcacctgc

SEQ ID NO: 4202288 - DNA, 20 bp, Homo sapiens
catgatggtgctgacctctg

SEQ ID NO: 4202289 - DNA, 13 bp, Homo sapiens
catgatttaatcc

SEQ ID NO: 4202290 - DNA, 21 bp, Homo sapiens
catgatttagggaagcaggga

SEQ ID NO: 4202291 - DNA, 22 bp, Homo sapiens
catgatttagggaagcagggac

SEQ ID NO: 4202292 - DNA, 18 bp, Homo sapiens
catgccaggctaattttt

SEQ ID NO: 4202293 - DNA, 11 bp, Homo sapiens
catgccctccc

SEQ ID NO: 4202294 - DNA, 21 bp, Homo sapiens
catgccctccctgctgccagg

SEQ ID NO: 4202295 - DNA, 12 bp, Homo sapiens
catgcccttctg

SEQ ID NO: 4202296 - DNA, 16 bp, Homo sapiens
catgcctcaagaacac

SEQ ID NO: 4202297 - DNA, 14 bp, Homo sapiens
catgcgcaggctca

SEQ ID NO: 4202298 - DNA, 23 bp, Homo sapiens
catgctcagccctgactggtgct

SEQ ID NO: 4202299 - DNA, 19 bp, Homo sapiens
catgctgaagggaccttga

SEQ ID NO: 4202300 - DNA, 17 bp, Homo sapiens
catgctggaaaataata

SEQ ID NO: 4202301 - DNA, 23 bp, Homo sapiens
catgctggcctcccaataaagct

SEQ ID NO: 4202302 - DNA, 18 bp, Homo sapiens
catgctggcggcgcagag

SEQ ID NO: 4202303 - DNA, 16 bp, Homo sapiens
catgcttcttccttac

SEQ ID NO: 4202304 - DNA, 16 bp, Homo sapiens
catgctttctcctttt

SEQ ID NO: 4202305 - DNA, 18 bp, Homo sapiens
catggaaacctgaaaaaa

SEQ ID NO: 4202306 - DNA, 20 bp, Homo sapiens
catggaaggttagaggtttg

SEQ ID NO: 4202307 - DNA, 14 bp, Homo sapiens
catggaaggttagg

SEQ ID NO: 4202308 - DNA, 13 bp, Homo sapiens
catggaatttaat

SEQ ID NO: 4202309 - DNA, 17 bp, Homo sapiens
catggaatttaatttat

SEQ ID NO: 4202310 - DNA, 12 bp, Homo sapiens
catggacacaga

SEQ ID NO: 4202311 - DNA, 14 bp, Homo sapiens
catggacacccctt

SEQ ID NO: 4202312 - DNA, 21 bp, Homo sapiens
catggacaccccttatccagg

SEQ ID NO: 4202313 - DNA, 23 bp, Homo sapiens
catggacaccccttatccaggac

SEQ ID NO: 4202314 - DNA, 20 bp, Homo sapiens
catggatatccacgcagcag

SEQ ID NO: 4202315 - DNA, 18 bp, Homo sapiens
catggccacaaagggaca

SEQ ID NO: 4202316 - DNA, 22 bp, Homo sapiens
catggccacaaagggacacaca

SEQ ID NO: 4202317 - DNA, 13 bp, Homo sapiens
catggccttccct

SEQ ID NO: 4202318 - DNA, 14 bp, Homo sapiens
catggccttccctc

SEQ ID NO: 4202319 - DNA, 17 bp, Homo sapiens
catggctattttatatt

SEQ ID NO: 4202320 - DNA, 13 bp, Homo sapiens
catggctctgtta

SEQ ID NO: 4202321 - DNA, 14 bp, Homo sapiens
catgggcctgctgc

SEQ ID NO: 4202322 - DNA, 23 bp, Homo sapiens
catggggtggggttggggcaaag

SEQ ID NO: 4202323 - DNA, 18 bp, Homo sapiens
catgggtgtcagctttgc

SEQ ID NO: 4202324 - DNA, 21 bp, Homo sapiens
catggtgcagttgacagcagg

SEQ ID NO: 4202325 - DNA, 19 bp, Homo sapiens
catggtgctttcaggtctg

SEQ ID NO: 4202326 - DNA, 14 bp, Homo sapiens
catgtactataatg

SEQ ID NO: 4202327 - DNA, 15 bp, Homo sapiens
catgtagctgagttt

SEQ ID NO: 4202328 - DNA, 13 bp, Homo sapiens
catgtcagagcca

SEQ ID NO: 4202329 - DNA, 15 bp, Homo sapiens
catgtcagagccagg

SEQ ID NO: 4202330 - DNA, 17 bp, Homo sapiens
catgtcagagccaggct

SEQ ID NO: 4202331 - DNA, 18 bp, Homo sapiens
catgtctgtcctcagagc

SEQ ID NO: 4202332 - DNA, 19 bp, Homo sapiens
catgtctgtcctcagagca

SEQ ID NO: 4202333 - DNA, 12 bp, Homo sapiens
catgtgcctgta

SEQ ID NO: 4202334 - DNA, 20 bp, Homo sapiens
catgttatatattttttgta

SEQ ID NO: 4202335 - DNA, 23 bp, Homo sapiens
catgttatttgtaatagatgttt

SEQ ID NO: 4202336 - DNA, 19 bp, Homo sapiens
catgtttacttttcagggc

SEQ ID NO: 4202337 - DNA, 21 bp, Homo sapiens
catgtttacttttcagggcat

SEQ ID NO: 4202338 - DNA, 15 bp, Homo sapiens
catgtttattaagaa

SEQ ID NO: 4202339 - DNA, 13 bp, Homo sapiens
catgtttgtaaaa

SEQ ID NO: 4202340 - DNA, 18 bp, Homo sapiens
catgtttgtctgtgtgct

SEQ ID NO: 4202341 - DNA, 12 bp, Homo sapiens
catgttttgtat

SEQ ID NO: 4202342 - DNA, 17 bp, Homo sapiens
catgtttttgttttctt

SEQ ID NO: 4202343 - DNA, 23 bp, Homo sapiens
catgtttttgttttctttgaatg

SEQ ID NO: 4202344 - DNA, 13 bp, Homo sapiens
cattaaacctgga

SEQ ID NO: 4202345 - DNA, 14 bp, Homo sapiens
cattaagagtgaat

SEQ ID NO: 4202346 - DNA, 22 bp, Homo sapiens
cattaatcaatcatctgtgtga

SEQ ID NO: 4202347 - DNA, 23 bp, Homo sapiens
cattaatcaatcatctgtgtgaa

SEQ ID NO: 4202348 - DNA, 15 bp, Homo sapiens
cattaatgaaaactt

SEQ ID NO: 4202349 - DNA, 15 bp, Homo sapiens
cattacaacctggaa

SEQ ID NO: 4202350 - DNA, 14 bp, Homo sapiens
cattacatggctgt

SEQ ID NO: 4202351 - DNA, 15 bp, Homo sapiens
cattacatggctgtg

SEQ ID NO: 4202352 - DNA, 17 bp, Homo sapiens
cattagcagctatgtaa

SEQ ID NO: 4202353 - DNA, 20 bp, Homo sapiens
cattatgttagagaggtagc

SEQ ID NO: 4202354 - DNA, 22 bp, Homo sapiens
cattattcgtagatattggaca

SEQ ID NO: 4202355 - DNA, 23 bp, Homo sapiens
cattcaggaccccaacccctctc

SEQ ID NO: 4202356 - DNA, 23 bp, Homo sapiens
cattcagggttatacacagaaaa

SEQ ID NO: 4202357 - DNA, 18 bp, Homo sapiens
cattcaggtgttctcttc

SEQ ID NO: 4202358 - DNA, 14 bp, Homo sapiens
cattcataaggaaa

SEQ ID NO: 4202359 - DNA, 21 bp, Homo sapiens
cattccaactcgtatagcatg

SEQ ID NO: 4202360 - DNA, 13 bp, Homo sapiens
ccgcgtagagagc

SEQ ID NO: 4202361 - DNA, 14 bp, Homo sapiens
ccgctaaaagaaac

SEQ ID NO: 4202362 - DNA, 13 bp, Homo sapiens
ccgctccagatct

SEQ ID NO: 4202363 - DNA, 11 bp, Homo sapiens
ccgctctgcat

SEQ ID NO: 4202364 - DNA, 17 bp, Homo sapiens
ccgctgccttttgctgc

SEQ ID NO: 4202365 - DNA, 21 bp, Homo sapiens
ccgctgccttttgctgctgct

SEQ ID NO: 4202366 - DNA, 12 bp, Homo sapiens
ccgcttcaagct

SEQ ID NO: 4202367 - DNA, 15 bp, Homo sapiens
ccgcttcaagctctc

SEQ ID NO: 4202368 - DNA, 12 bp, Homo sapiens
ccgcttcccaga

SEQ ID NO: 4202369 - DNA, 16 bp, Homo sapiens
ccgcttcccagaggcc

SEQ ID NO: 4202370 - DNA, 15 bp, Homo sapiens
ccggaggggacccag

SEQ ID NO: 4202371 - DNA, 18 bp, Homo sapiens
ccggaggggacccagctc

SEQ ID NO: 4202372 - DNA, 20 bp, Homo sapiens
ccggcccagagaccccttcc

SEQ ID NO: 4202373 - DNA, 18 bp, Homo sapiens
ccggctgctcctccagcc

SEQ ID NO: 4202374 - DNA, 20 bp, Homo sapiens
ccgggagaggactctgcctt

SEQ ID NO: 4202375 - DNA, 17 bp, Homo sapiens
ccgggccatgctttcct

SEQ ID NO: 4202376 - DNA, 16 bp, Homo sapiens
ccgggcggaaggggac

SEQ ID NO: 4202377 - DNA, 16 bp, Homo sapiens
ccggggcactttcaga

SEQ ID NO: 4202378 - DNA, 16 bp, Homo sapiens
ccgggtgccattccca

SEQ ID NO: 4202379 - DNA, 20 bp, Homo sapiens
ccgggtgtgcctgccctgga

SEQ ID NO: 4202380 - DNA, 15 bp, Homo sapiens
ccggtgtgcctgcag

SEQ ID NO: 4202381 - DNA, 15 bp, Homo sapiens
ccgtacatctctgtg

SEQ ID NO: 4202382 - DNA, 15 bp, Homo sapiens
ccgtctgtgtatgtg

SEQ ID NO: 4202383 - DNA, 16 bp, Homo sapiens
ccgtgatttggaagag

SEQ ID NO: 4202384 - DNA, 19 bp, Homo sapiens
ccgtgatttggaagagagg

SEQ ID NO: 4202385 - DNA, 20 bp, Homo sapiens
ccgtgcccaggggcccacag

SEQ ID NO: 4202386 - DNA, 16 bp, Homo sapiens
ccgtggggctccggag

SEQ ID NO: 4202387 - DNA, 20 bp, Homo sapiens
cctaaacccccgctccagat

SEQ ID NO: 4202388 - DNA, 11 bp, Homo sapiens
cctaaactgta

SEQ ID NO: 4202389 - DNA, 20 bp, Homo sapiens
cctaagaccggcggccatga

SEQ ID NO: 4202390 - DNA, 20 bp, Homo sapiens
cctaaggcatgttgggatag

SEQ ID NO: 4202391 - DNA, 21 bp, Homo sapiens
cctaataagtttgatcaaatc

SEQ ID NO: 4202392 - DNA, 21 bp, Homo sapiens
cctaatatttaggcaagagaa

SEQ ID NO: 4202393 - DNA, 17 bp, Homo sapiens
cctaatcaggctgaggt

SEQ ID NO: 4202394 - DNA, 20 bp, Homo sapiens
cctaattcaattcaaagctg

SEQ ID NO: 4202395 - DNA, 21 bp, Homo sapiens
cctaattcctggcatgacact

SEQ ID NO: 4202396 - DNA, 13 bp, Homo sapiens
cctacaaaatgga

SEQ ID NO: 4202397 - DNA, 21 bp, Homo sapiens
cctaccaccttccctctttct

SEQ ID NO: 4202398 - DNA, 19 bp, Homo sapiens
cctaccccacctcatgcct

SEQ ID NO: 4202399 - DNA, 12 bp, Homo sapiens
cctacctcagcc

SEQ ID NO: 4202400 - DNA, 16 bp, Homo sapiens
cctacctcagcctaga

SEQ ID NO: 4202401 - DNA, 22 bp, Homo sapiens
cctacgcagatgctgtcactgg

SEQ ID NO: 4202402 - DNA, 13 bp, Homo sapiens
cctactgcccagg

SEQ ID NO: 4202403 - DNA, 20 bp, Homo sapiens
cctactgcccaggcactgca

SEQ ID NO: 4202404 - DNA, 14 bp, Homo sapiens
cctagaacttcaaa

SEQ ID NO: 4202405 - DNA, 16 bp, Homo sapiens
cctagaccctcctcct

SEQ ID NO: 4202406 - DNA, 18 bp, Homo sapiens
cctagactgttactttgg

SEQ ID NO: 4202407 - DNA, 22 bp, Homo sapiens
cctaggagggaaggagctgttg

SEQ ID NO: 4202408 - DNA, 23 bp, Homo sapiens
cctaggccacaccatctcctttc

SEQ ID NO: 4202409 - DNA, 23 bp, Homo sapiens
cctaggcgattttgtctaccatt

SEQ ID NO: 4202410 - DNA, 18 bp, Homo sapiens
cctataaaatcaaagaaa

SEQ ID NO: 4202411 - DNA, 22 bp, Homo sapiens
cctatactgcttggagctgagc

SEQ ID NO: 4202412 - DNA, 18 bp, Homo sapiens
cctatagtcccagctact

SEQ ID NO: 4202413 - DNA, 23 bp, Homo sapiens
cctatccatcctgcgagctcctt

SEQ ID NO: 4202414 - DNA, 16 bp, Homo sapiens
cctatccttggagagc

SEQ ID NO: 4202415 - DNA, 22 bp, Homo sapiens
cctatccttggagagcagctgg

SEQ ID NO: 4202416 - DNA, 13 bp, Homo sapiens
cctatgatcccag

SEQ ID NO: 4202417 - DNA, 14 bp, Homo sapiens
cctatgatcccagc

SEQ ID NO: 4202418 - DNA, 19 bp, Homo sapiens
cctattatttccgggtgga

SEQ ID NO: 4202419 - DNA, 13 bp, Homo sapiens
cctattctcacca

SEQ ID NO: 4202420 - DNA, 21 bp, Homo sapiens
cctattttgtaatttttttga

SEQ ID NO: 4202421 - DNA, 14 bp, Homo sapiens
cctcaaaccctgtg

SEQ ID NO: 4202422 - DNA, 16 bp, Homo sapiens
cctcaaactaggagga

SEQ ID NO: 4202423 - DNA, 18 bp, Homo sapiens
cctcaaactaggaggaaa

SEQ ID NO: 4202424 - DNA, 15 bp, Homo sapiens
cctcaaagcacctga

SEQ ID NO: 4202425 - DNA, 17 bp, Homo sapiens
cctcaatggacttcaaa

SEQ ID NO: 4202426 - DNA, 12 bp, Homo sapiens
cctcacagcctc

SEQ ID NO: 4202427 - DNA, 13 bp, Homo sapiens
cctcacagcctct

SEQ ID NO: 4202428 - DNA, 18 bp, Homo sapiens
cctcacagcctctccctt

SEQ ID NO: 4202429 - DNA, 21 bp, Homo sapiens
cctcaccaaaacgatgaagtt

SEQ ID NO: 4202430 - DNA, 16 bp, Homo sapiens
cctcacctgagagcca

SEQ ID NO: 4202431 - DNA, 16 bp, Homo sapiens
cctcacgctctggaca

SEQ ID NO: 4202432 - DNA, 17 bp, Homo sapiens
cctcactattcaagtat

SEQ ID NO: 4202433 - DNA, 15 bp, Homo sapiens
cctcactcaagcctg

SEQ ID NO: 4202434 - DNA, 17 bp, Homo sapiens
cctcactgaatgcctca

SEQ ID NO: 4202435 - DNA, 14 bp, Homo sapiens
cctcagagcaggct

SEQ ID NO: 4202436 - DNA, 20 bp, Homo sapiens
cctcagattacacttctcca

SEQ ID NO: 4202437 - DNA, 14 bp, Homo sapiens
cctcagcctagacc

SEQ ID NO: 4202438 - DNA, 19 bp, Homo sapiens
cctcaggcagttactattt

SEQ ID NO: 4202439 - DNA, 16 bp, Homo sapiens
cctcaggcttccttgg

SEQ ID NO: 4202440 - DNA, 17 bp, Homo sapiens
cctcaggcttccttggc

SEQ ID NO: 4202441 - DNA, 13 bp, Homo sapiens
cctcagtgggctc

SEQ ID NO: 4202442 - DNA, 23 bp, Homo sapiens
cctcagtgggctccctggcccag

SEQ ID NO: 4202443 - DNA, 16 bp, Homo sapiens
cctcatcaccatcgtg

SEQ ID NO: 4202444 - DNA, 14 bp, Homo sapiens
cctcatgcctggcc

SEQ ID NO: 4202445 - DNA, 15 bp, Homo sapiens
cctcatgcctggccc

SEQ ID NO: 4202446 - DNA, 22 bp, Homo sapiens
cctcatgcctggcccccctcca

SEQ ID NO: 4202447 - DNA, 17 bp, Homo sapiens
cctcatgtgtgctgtgc

SEQ ID NO: 4202448 - DNA, 15 bp, Homo sapiens
cctcattcccctcgt

SEQ ID NO: 4202449 - DNA, 20 bp, Homo sapiens
cctcatttgcaaacctcaga

SEQ ID NO: 4202450 - DNA, 21 bp, Homo sapiens
cctcatttgcaaacctcagag

SEQ ID NO: 4202451 - DNA, 21 bp, Homo sapiens
cctccacattaagtggctttt

SEQ ID NO: 4202452 - DNA, 17 bp, Homo sapiens
cctccaccaaaccccac

SEQ ID NO: 4202453 - DNA, 16 bp, Homo sapiens
cctccactccacctcc

SEQ ID NO: 4202454 - DNA, 12 bp, Homo sapiens
cctccagccctt

SEQ ID NO: 4202455 - DNA, 14 bp, Homo sapiens
cctccagctccagt

SEQ ID NO: 4202456 - DNA, 18 bp, Homo sapiens
cctccagggaatccgcct

SEQ ID NO: 4202457 - DNA, 20 bp, Homo sapiens
cctccatccggctcctgtca

SEQ ID NO: 4202458 - DNA, 16 bp, Homo sapiens
cctcccaataaagctg

SEQ ID NO: 4202459 - DNA, 14 bp, Homo sapiens
cctcccagggccag

SEQ ID NO: 4202460 - DNA, 21 bp, Homo sapiens
cctcccagggccagggccctg

SEQ ID NO: 4202461 - DNA, 12 bp, Homo sapiens
cctcccatggcc

SEQ ID NO: 4202462 - DNA, 17 bp, Homo sapiens
cctcccccagagccact

SEQ ID NO: 4202463 - DNA, 17 bp, Homo sapiens
cctcccctggtcctgca

SEQ ID NO: 4202464 - DNA, 15 bp, Homo sapiens
cctcccgggagcaca

SEQ ID NO: 4202465 - DNA, 18 bp, Homo sapiens
cctccctctgacctgcag

SEQ ID NO: 4202466 - DNA, 12 bp, Homo sapiens
cctccctcttcc

SEQ ID NO: 4202467 - DNA, 20 bp, Homo sapiens
cctccctcttccttccccca

SEQ ID NO: 4202468 - DNA, 15 bp, Homo sapiens
cctccctgctgccag

SEQ ID NO: 4202469 - DNA, 19 bp, Homo sapiens
cctccctggcatgtcagag

SEQ ID NO: 4202470 - DNA, 17 bp, Homo sapiens
cctcctagggcttatca

SEQ ID NO: 4202471 - DNA, 22 bp, Homo sapiens
cctcctagggcttatcatcagc

SEQ ID NO: 4202472 - DNA, 16 bp, Homo sapiens
cctcctatccttggag

SEQ ID NO: 4202473 - DNA, 12 bp, Homo sapiens
cctcctccactc

SEQ ID NO: 4202474 - DNA, 15 bp, Homo sapiens
cctcctccactccac

SEQ ID NO: 4202475 - DNA, 16 bp, Homo sapiens
cctcctgacctgaggc

SEQ ID NO: 4202476 - DNA, 13 bp, Homo sapiens
cctccttcccctg

SEQ ID NO: 4202477 - DNA, 20 bp, Homo sapiens
cctccttccttgctgtccta

SEQ ID NO: 4202478 - DNA, 18 bp, Homo sapiens
cctccttttgcttgaaac

SEQ ID NO: 4202479 - DNA, 17 bp, Homo sapiens
cctcgccacggggaggg

SEQ ID NO: 4202480 - DNA, 17 bp, Homo sapiens
cctcggccgtacatctc

SEQ ID NO: 4202481 - DNA, 21 bp, Homo sapiens
cctcggccgtacatctctgtg

SEQ ID NO: 4202482 - DNA, 15 bp, Homo sapiens
cctcgtaccagccag

SEQ ID NO: 4202483 - DNA, 17 bp, Homo sapiens
cctcgtaccagccagga

SEQ ID NO: 4202484 - DNA, 18 bp, Homo sapiens
cctcgtaccagccaggat

SEQ ID NO: 4202485 - DNA, 16 bp, Homo sapiens
cctcgtggacacctgc

SEQ ID NO: 4202486 - DNA, 17 bp, Homo sapiens
cctcgtggacacctgcc

SEQ ID NO: 4202487 - DNA, 22 bp, Homo sapiens
cctcgtggacacctgccctgcc

SEQ ID NO: 4202488 - DNA, 20 bp, Homo sapiens
cctctcaatattcaataaag

SEQ ID NO: 4202489 - DNA, 22 bp, Homo sapiens
cctctcaatattcaataaagct

SEQ ID NO: 4202490 - DNA, 16 bp, Homo sapiens
cctctcactaaacttt

SEQ ID NO: 4202491 - DNA, 14 bp, Homo sapiens
cctctcctccgcca

SEQ ID NO: 4202492 - DNA, 15 bp, Homo sapiens
cctctcctcctctgt

SEQ ID NO: 4202493 - DNA, 16 bp, Homo sapiens
cctctcctcctctgtg

SEQ ID NO: 4202494 - DNA, 18 bp, Homo sapiens
cctctcctcctctgtgct

SEQ ID NO: 4202495 - DNA, 12 bp, Homo sapiens
cgcatcatatgc

SEQ ID NO: 4202496 - DNA, 14 bp, Homo sapiens
cgccaacagccccc

SEQ ID NO: 4202497 - DNA, 19 bp, Homo sapiens
cgccagatgaagctttggc

SEQ ID NO: 4202498 - DNA, 17 bp, Homo sapiens
cgccattgtactccagc

SEQ ID NO: 4202499 - DNA, 20 bp, Homo sapiens
cgccattgtactccagcctg

SEQ ID NO: 4202500 - DNA, 22 bp, Homo sapiens
cgccattgtactccagcctggg

SEQ ID NO: 4202501 - DNA, 20 bp, Homo sapiens
cgcccagctgcacctgccag

SEQ ID NO: 4202502 - DNA, 23 bp, Homo sapiens
cgcccagctgcacctgccagcct

SEQ ID NO: 4202503 - DNA, 14 bp, Homo sapiens
cgccccacccaggg

SEQ ID NO: 4202504 - DNA, 13 bp, Homo sapiens
cgccgagggcagc

SEQ ID NO: 4202505 - DNA, 11 bp, Homo sapiens
cgcctcccagc

SEQ ID NO: 4202506 - DNA, 10 bp, Homo sapiens
cgcctcttcc

SEQ ID NO: 4202507 - DNA, 18 bp, Homo sapiens
cgcctcttcctctgggca

SEQ ID NO: 4202508 - DNA, 19 bp, Homo sapiens
cgcctcttcttcttcagaa

SEQ ID NO: 4202509 - DNA, 12 bp, Homo sapiens
cgcgcacacaca

SEQ ID NO: 4202510 - DNA, 22 bp, Homo sapiens
cgcgcagcgcgtgcacagcgcg

SEQ ID NO: 4202511 - DNA, 21 bp, Homo sapiens
cgcggctcccgccaccctcaa

SEQ ID NO: 4202512 - DNA, 12 bp, Homo sapiens
cgcgtagagagc

SEQ ID NO: 4202513 - DNA, 17 bp, Homo sapiens
cgcgtctgccccaccct

SEQ ID NO: 4202514 - DNA, 19 bp, Homo sapiens
cgcgtctgccccaccctca

SEQ ID NO: 4202515 - DNA, 13 bp, Homo sapiens
cgctcccgcattt

SEQ ID NO: 4202516 - DNA, 17 bp, Homo sapiens
cgctcctttacctacca

SEQ ID NO: 4202517 - DNA, 21 bp, Homo sapiens
cgctcctttacctaccacctt

SEQ ID NO: 4202518 - DNA, 22 bp, Homo sapiens
cgctcctttacctaccaccttc

SEQ ID NO: 4202519 - DNA, 17 bp, Homo sapiens
cgctcttttccactcca

SEQ ID NO: 4202520 - DNA, 20 bp, Homo sapiens
cgctgccttttgctgctgct

SEQ ID NO: 4202521 - DNA, 12 bp, Homo sapiens
cgctggtctgga

SEQ ID NO: 4202522 - DNA, 14 bp, Homo sapiens
cgcttcaagctctc

SEQ ID NO: 4202523 - DNA, 12 bp, Homo sapiens
cgcttcccagag

SEQ ID NO: 4202524 - DNA, 13 bp, Homo sapiens
cgcttgcttctgc

SEQ ID NO: 4202525 - DNA, 17 bp, Homo sapiens
cgcttgcttctgcagca

SEQ ID NO: 4202526 - DNA, 22 bp, Homo sapiens
cgctttctggaaaagaggagtt

SEQ ID NO: 4202527 - DNA, 21 bp, Homo sapiens
cggaagggttggtgggctggc

SEQ ID NO: 4202528 - DNA, 21 bp, Homo sapiens
cggaatcactctgtccttgga

SEQ ID NO: 4202529 - DNA, 12 bp, Homo sapiens
cggagcctgcct

SEQ ID NO: 4202530 - DNA, 18 bp, Homo sapiens
cggaggcggctccaggtc

SEQ ID NO: 4202531 - DNA, 15 bp, Homo sapiens
cggaggggacccagc

SEQ ID NO: 4202532 - DNA, 19 bp, Homo sapiens
cggaggggacccagctcct

SEQ ID NO: 4202533 - DNA, 16 bp, Homo sapiens
cggatctcactcagcc

SEQ ID NO: 4202534 - DNA, 10 bp, Homo sapiens
cggcagctgt

SEQ ID NO: 4202535 - DNA, 14 bp, Homo sapiens
cggcattcctgctt

SEQ ID NO: 4202536 - DNA, 12 bp, Homo sapiens
cggcccagagac

SEQ ID NO: 4202537 - DNA, 21 bp, Homo sapiens
cggccgtgggccgggaggcag

SEQ ID NO: 4202538 - DNA, 19 bp, Homo sapiens
cggcctctctcttcccagc

SEQ ID NO: 4202539 - DNA, 23 bp, Homo sapiens
cggcgtccctgagggcccttccc

SEQ ID NO: 4202540 - DNA, 14 bp, Homo sapiens
cggctccaggtccg

SEQ ID NO: 4202541 - DNA, 16 bp, Homo sapiens
cggctggggactgcta

SEQ ID NO: 4202542 - DNA, 18 bp, Homo sapiens
cggctggggactgctacc

SEQ ID NO: 4202543 - DNA, 12 bp, Homo sapiens
cgggacagagag

SEQ ID NO: 4202544 - DNA, 15 bp, Homo sapiens
cgggacagagaggag

SEQ ID NO: 4202545 - DNA, 18 bp, Homo sapiens
cgggagctctgtatggtc

SEQ ID NO: 4202546 - DNA, 16 bp, Homo sapiens
cgggaggctgagacag

SEQ ID NO: 4202547 - DNA, 17 bp, Homo sapiens
cgggaggctgagacagg

SEQ ID NO: 4202548 - DNA, 19 bp, Homo sapiens
cgggaggctgagacaggag

SEQ ID NO: 4202549 - DNA, 21 bp, Homo sapiens
cgggcacctatagtcccagct

SEQ ID NO: 4202550 - DNA, 14 bp, Homo sapiens
cgggctgccctgcc

SEQ ID NO: 4202551 - DNA, 15 bp, Homo sapiens
cggggagggggacgc

SEQ ID NO: 4202552 - DNA, 23 bp, Homo sapiens
cggggcgggggcccgaaagctga

SEQ ID NO: 4202553 - DNA, 18 bp, Homo sapiens
cgggggcccgaaagctga

SEQ ID NO: 4202554 - DNA, 19 bp, Homo sapiens
cgggtggatcacctgaggt

SEQ ID NO: 4202555 - DNA, 18 bp, Homo sapiens
cgggtgtgcctgccctgg

SEQ ID NO: 4202556 - DNA, 17 bp, Homo sapiens
cggtcctttaggcagcc

SEQ ID NO: 4202557 - DNA, 18 bp, Homo sapiens
cggtcctttaggcagcct

SEQ ID NO: 4202558 - DNA, 22 bp, Homo sapiens
cggtcctttaggcagcctgccg

SEQ ID NO: 4202559 - DNA, 20 bp, Homo sapiens
cggtggctcacgcctgtaat

SEQ ID NO: 4202560 - DNA, 20 bp, Homo sapiens
cggtggctcttgcctgtaat

SEQ ID NO: 4202561 - DNA, 15 bp, Homo sapiens
cggtgtgcctgcagc

SEQ ID NO: 4202562 - DNA, 20 bp, Homo sapiens
cggtgtgcctgcagccccgc

SEQ ID NO: 4202563 - DNA, 19 bp, Homo sapiens
cggttgcttctggctcctc

SEQ ID NO: 4202564 - DNA, 12 bp, Homo sapiens
cgtaccagccag

SEQ ID NO: 4202565 - DNA, 14 bp, Homo sapiens
cgtaccagccagga

SEQ ID NO: 4202566 - DNA, 23 bp, Homo sapiens
cgtagatattggacaaagaacct

SEQ ID NO: 4202567 - DNA, 15 bp, Homo sapiens
cgtatttaatagcaa

SEQ ID NO: 4202568 - DNA, 21 bp, Homo sapiens
cgtatttaatagcaaagaatt

SEQ ID NO: 4202569 - DNA, 16 bp, Homo sapiens
cgtatttatatttgga

SEQ ID NO: 4202570 - DNA, 21 bp, Homo sapiens
cgtatttatatttggaaagag

SEQ ID NO: 4202571 - DNA, 22 bp, Homo sapiens
cgtatttcttttttttaataag

SEQ ID NO: 4202572 - DNA, 14 bp, Homo sapiens
cgtcagtgctgtgc

SEQ ID NO: 4202573 - DNA, 19 bp, Homo sapiens
cgtcatcacttttcagtga

SEQ ID NO: 4202574 - DNA, 16 bp, Homo sapiens
cgtccccaaacctagc

SEQ ID NO: 4202575 - DNA, 17 bp, Homo sapiens
cgtccctgagggccctt

SEQ ID NO: 4202576 - DNA, 20 bp, Homo sapiens
cgtcccttggaaagttcagc

SEQ ID NO: 4202577 - DNA, 23 bp, Homo sapiens
cgtccgctcagccaaggagtcag

SEQ ID NO: 4202578 - DNA, 15 bp, Homo sapiens
cgtctgccccaccct

SEQ ID NO: 4202579 - DNA, 16 bp, Homo sapiens
cgtctgccccaccctc

SEQ ID NO: 4202580 - DNA, 20 bp, Homo sapiens
cgtgatttggaagagaggca

SEQ ID NO: 4202581 - DNA, 13 bp, Homo sapiens
cgtgcagagctgg

SEQ ID NO: 4202582 - DNA, 16 bp, Homo sapiens
cgtgcagagctggggc

SEQ ID NO: 4202583 - DNA, 19 bp, Homo sapiens
cgtgccgggagaggactct

SEQ ID NO: 4202584 - DNA, 21 bp, Homo sapiens
cgtgccgggagaggactctgc

SEQ ID NO: 4202585 - DNA, 21 bp, Homo sapiens
cgtgcctttctctggctccag

SEQ ID NO: 4202586 - DNA, 14 bp, Homo sapiens
cgtggacacctgcc

SEQ ID NO: 4202587 - DNA, 15 bp, Homo sapiens
cgtggacacctgccc

SEQ ID NO: 4202588 - DNA, 20 bp, Homo sapiens
cgtggcagataatcagcctc

SEQ ID NO: 4202589 - DNA, 21 bp, Homo sapiens
cgtggcagataatcagcctct

SEQ ID NO: 4202590 - DNA, 17 bp, Homo sapiens
cgtgggtatttcctgct

SEQ ID NO: 4202591 - DNA, 15 bp, Homo sapiens
cgtggtagaagccag

SEQ ID NO: 4202592 - DNA, 17 bp, Homo sapiens
cgtggtagaagccagta

SEQ ID NO: 4202593 - DNA, 14 bp, Homo sapiens
cgtggtcagagtgc

SEQ ID NO: 4202594 - DNA, 15 bp, Homo sapiens
cgtgtccctctcgga

SEQ ID NO: 4202595 - DNA, 19 bp, Homo sapiens
cgtgtgtatccgactctaa

SEQ ID NO: 4202596 - DNA, 20 bp, Homo sapiens
cgttaagggaaggaactctg

SEQ ID NO: 4202597 - DNA, 18 bp, Homo sapiens
cgttgacccctttccccc

SEQ ID NO: 4202598 - DNA, 16 bp, Homo sapiens
cgttggtatgataatg

SEQ ID NO: 4202599 - DNA, 23 bp, Homo sapiens
cgtttcaggaacgttgccacacc

SEQ ID NO: 4202600 - DNA, 10 bp, Homo sapiens
ctaaaagaat

SEQ ID NO: 4202601 - DNA, 17 bp, Homo sapiens
ctaaagaaaaacaaact

SEQ ID NO: 4202602 - DNA, 12 bp, Homo sapiens
ctaaagagaaca

SEQ ID NO: 4202603 - DNA, 18 bp, Homo sapiens
ctaaagctggtttaatgt

SEQ ID NO: 4202604 - DNA, 16 bp, Homo sapiens
ctaaagtatgtaaagt

SEQ ID NO: 4202605 - DNA, 20 bp, Homo sapiens
ctaaagtatgtaaagtatgt

SEQ ID NO: 4202606 - DNA, 19 bp, Homo sapiens
ctaaatacctcaatcagtc

SEQ ID NO: 4202607 - DNA, 15 bp, Homo sapiens
ctaaatctctaatat

SEQ ID NO: 4202608 - DNA, 15 bp, Homo sapiens
ctaacaataatattt

SEQ ID NO: 4202609 - DNA, 18 bp, Homo sapiens
ctaacaataatatttcaa

SEQ ID NO: 4202610 - DNA, 22 bp, Homo sapiens
ctaacaataatatttcaagtgc

SEQ ID NO: 4202611 - DNA, 16 bp, Homo sapiens
ctaacccccagtgcca

SEQ ID NO: 4202612 - DNA, 21 bp, Homo sapiens
ctaacccccagtgccacagag

SEQ ID NO: 4202613 - DNA, 23 bp, Homo sapiens
ctaacccccagtgccacagagaa

SEQ ID NO: 4202614 - DNA, 22 bp, Homo sapiens
ctaactaaggtcccataataaa

SEQ ID NO: 4202615 - DNA, 21 bp, Homo sapiens
ctaactacaaggacaatgcct

SEQ ID NO: 4202616 - DNA, 23 bp, Homo sapiens
ctaactcctgccattcttctggt

SEQ ID NO: 4202617 - DNA, 13 bp, Homo sapiens
ctaagagaagtag

SEQ ID NO: 4202618 - DNA, 19 bp, Homo sapiens
ctaagagaagtagaaatca

SEQ ID NO: 4202619 - DNA, 23 bp, Homo sapiens
ctaagataaaagcttaggctgat

SEQ ID NO: 4202620 - DNA, 14 bp, Homo sapiens
ctaagcctcctttt

SEQ ID NO: 4202621 - DNA, 13 bp, Homo sapiens
ctaagctgtgtgc

SEQ ID NO: 4202622 - DNA, 16 bp, Homo sapiens
ctaagctttctccttt

SEQ ID NO: 4202623 - DNA, 17 bp, Homo sapiens
ctaagctttctcctttg

SEQ ID NO: 4202624 - DNA, 20 bp, Homo sapiens
ctaagtaagaacactgagat

SEQ ID NO: 4202625 - DNA, 16 bp, Homo sapiens
ctaagtgtggagaagg

SEQ ID NO: 4202626 - DNA, 15 bp, Homo sapiens
ctaagttatgtacgt

SEQ ID NO: 4202627 - DNA, 13 bp, Homo sapiens
ctaatattaaaaa

SEQ ID NO: 4202628 - DNA, 18 bp, Homo sapiens
ctaatatttaggcaagag

SEQ ID NO: 4202629 - DNA, 20 bp, Homo sapiens
ctaatcaggctgaggtgtct

SEQ ID NO: 4202630 - DNA, 23 bp, Homo sapiens
ctgatggtgctcacgactcttcc

SEQ ID NO: 4202631 - DNA, 14 bp, Homo sapiens
ctgatgtcaaagtg

SEQ ID NO: 4202632 - DNA, 12 bp, Homo sapiens
ctgatgtttgtt

SEQ ID NO: 4202633 - DNA, 21 bp, Homo sapiens
ctgattatcctataggcagac

SEQ ID NO: 4202634 - DNA, 22 bp, Homo sapiens
ctgattatcctataggcagacg

SEQ ID NO: 4202635 - DNA, 17 bp, Homo sapiens
ctgattcaagaaacaga

SEQ ID NO: 4202636 - DNA, 15 bp, Homo sapiens
ctgattcccctccac

SEQ ID NO: 4202637 - DNA, 18 bp, Homo sapiens
ctgattctcctgtcagag

SEQ ID NO: 4202638 - DNA, 14 bp, Homo sapiens
ctgattggctcacc

SEQ ID NO: 4202639 - DNA, 23 bp, Homo sapiens
ctgatttaacactatccaatgaa

SEQ ID NO: 4202640 - DNA, 22 bp, Homo sapiens
ctgattttggtttattccctcc

SEQ ID NO: 4202641 - DNA, 19 bp, Homo sapiens
ctgcaaagggaactgaaga

SEQ ID NO: 4202642 - DNA, 18 bp, Homo sapiens
ctgcaagacacaggctca

SEQ ID NO: 4202643 - DNA, 22 bp, Homo sapiens
ctgcaagacacaggctcagcat

SEQ ID NO: 4202644 - DNA, 14 bp, Homo sapiens
ctgcaatctccagg

SEQ ID NO: 4202645 - DNA, 20 bp, Homo sapiens
ctgcacacagctaggcatgc

SEQ ID NO: 4202646 - DNA, 17 bp, Homo sapiens
ctgcaccatcacacatg

SEQ ID NO: 4202647 - DNA, 18 bp, Homo sapiens
ctgcaccatcacacatgc

SEQ ID NO: 4202648 - DNA, 13 bp, Homo sapiens
ctgcacccagggg

SEQ ID NO: 4202649 - DNA, 20 bp, Homo sapiens
ctgcacctgccagcctggct

SEQ ID NO: 4202650 - DNA, 17 bp, Homo sapiens
ctgcactccagcctggg

SEQ ID NO: 4202651 - DNA, 20 bp, Homo sapiens
ctgcactccagcctgggcga

SEQ ID NO: 4202652 - DNA, 21 bp, Homo sapiens
ctgcactccagcctggggtga

SEQ ID NO: 4202653 - DNA, 12 bp, Homo sapiens
ctgcactgccct

SEQ ID NO: 4202654 - DNA, 13 bp, Homo sapiens
ctgcactgccctc

SEQ ID NO: 4202655 - DNA, 15 bp, Homo sapiens
ctgcagaatgggcca

SEQ ID NO: 4202656 - DNA, 24 bp, Homo sapiens
ctgcagaatgggccactgtagggg

SEQ ID NO: 4202657 - DNA, 14 bp, Homo sapiens
ctgcagagagaagc

SEQ ID NO: 4202658 - DNA, 15 bp, Homo sapiens
ctgcagagctatggt

SEQ ID NO: 4202659 - DNA, 17 bp, Homo sapiens
ctgcagatcttccgtgg

SEQ ID NO: 4202660 - DNA, 13 bp, Homo sapiens
ctgcagcaactcc

SEQ ID NO: 4202661 - DNA, 22 bp, Homo sapiens
ctgcagccagcagttgtaaaat

SEQ ID NO: 4202662 - DNA, 19 bp, Homo sapiens
ctgcagctgcaccatcaca

SEQ ID NO: 4202663 - DNA, 21 bp, Homo sapiens
ctgcagctttacatgcaattt

SEQ ID NO: 4202664 - DNA, 20 bp, Homo sapiens
ctgcagggagcaactctcca

SEQ ID NO: 4202665 - DNA, 23 bp, Homo sapiens
ctgcagggagcaactctccactc

SEQ ID NO: 4202666 - DNA, 13 bp, Homo sapiens
ctgcagggctgct

SEQ ID NO: 4202667 - DNA, 17 bp, Homo sapiens
ctgcagggctgctgtgg

SEQ ID NO: 4202668 - DNA, 19 bp, Homo sapiens
ctgcagggctgctgtggcc

SEQ ID NO: 4202669 - DNA, 22 bp, Homo sapiens
ctgcagggctgctgtggcccag

SEQ ID NO: 4202670 - DNA, 22 bp, Homo sapiens
ctgcatgcctggtctttcctct

SEQ ID NO: 4202671 - DNA, 23 bp, Homo sapiens
ctgccaattgctaccgagaaggt

SEQ ID NO: 4202672 - DNA, 13 bp, Homo sapiens
ctgccacagagag

SEQ ID NO: 4202673 - DNA, 14 bp, Homo sapiens
ctgccaccatcctg

SEQ ID NO: 4202674 - DNA, 11 bp, Homo sapiens
ctgccacctgt

SEQ ID NO: 4202675 - DNA, 13 bp, Homo sapiens
ctgccacctgtct

SEQ ID NO: 4202676 - DNA, 16 bp, Homo sapiens
ctgccacctgtctgtc

SEQ ID NO: 4202677 - DNA, 17 bp, Homo sapiens
ctgccacctgtctgtct

SEQ ID NO: 4202678 - DNA, 18 bp, Homo sapiens
ctgccacctgtctgtctg

SEQ ID NO: 4202679 - DNA, 14 bp, Homo sapiens
ctgccagcctggct

SEQ ID NO: 4202680 - DNA, 22 bp, Homo sapiens
ctgccagcctggcttctggagc

SEQ ID NO: 4202681 - DNA, 21 bp, Homo sapiens
ctgccatggcgtgtccctctc

SEQ ID NO: 4202682 - DNA, 22 bp, Homo sapiens
ctgccatggcgtgtccctctcg

SEQ ID NO: 4202683 - DNA, 15 bp, Homo sapiens
ctgccattcttctgg

SEQ ID NO: 4202684 - DNA, 23 bp, Homo sapiens
ctgccattgggaccctccagtgc

SEQ ID NO: 4202685 - DNA, 20 bp, Homo sapiens
ctgccatttgcaccctccgc

SEQ ID NO: 4202686 - DNA, 15 bp, Homo sapiens
ctgcccaggcactgc

SEQ ID NO: 4202687 - DNA, 16 bp, Homo sapiens
ctgcccaggcactgca

SEQ ID NO: 4202688 - DNA, 17 bp, Homo sapiens
ctgcccagtctggaaga

SEQ ID NO: 4202689 - DNA, 13 bp, Homo sapiens
ctgccccagaaca

SEQ ID NO: 4202690 - DNA, 13 bp, Homo sapiens
ctgccccatctcc

SEQ ID NO: 4202691 - DNA, 16 bp, Homo sapiens
ctgccccatctcctcc

SEQ ID NO: 4202692 - DNA, 18 bp, Homo sapiens
ctgcccccgacagcccag

SEQ ID NO: 4202693 - DNA, 13 bp, Homo sapiens
ctgccccctggtg

SEQ ID NO: 4202694 - DNA, 20 bp, Homo sapiens
ctgcccctgcacctgcttct

SEQ ID NO: 4202695 - DNA, 13 bp, Homo sapiens
ctgcccctgtagg

SEQ ID NO: 4202696 - DNA, 15 bp, Homo sapiens
ctgcccgcagagccc

SEQ ID NO: 4202697 - DNA, 19 bp, Homo sapiens
ctgccctccgcccttccct

SEQ ID NO: 4202698 - DNA, 11 bp, Homo sapiens
ctgccctgcca

SEQ ID NO: 4202699 - DNA, 20 bp, Homo sapiens
ctgccctgccacctgtctgt

SEQ ID NO: 4202700 - DNA, 14 bp, Homo sapiens
ctgccctgccctgc

SEQ ID NO: 4202701 - DNA, 22 bp, Homo sapiens
ctgccctgcgaagtggctctca

SEQ ID NO: 4202702 - DNA, 12 bp, Homo sapiens
ctgccctggagg

SEQ ID NO: 4202703 - DNA, 14 bp, Homo sapiens
ctgccctggaggga

SEQ ID NO: 4202704 - DNA, 17 bp, Homo sapiens
ctgccctggagggaggc

SEQ ID NO: 4202705 - DNA, 16 bp, Homo sapiens
ctgccgcctcccagcc

SEQ ID NO: 4202706 - DNA, 19 bp, Homo sapiens
ctgccgcctcccagcctgg

SEQ ID NO: 4202707 - DNA, 19 bp, Homo sapiens
ctgccgtcagtgctgtgct

SEQ ID NO: 4202708 - DNA, 14 bp, Homo sapiens
ctgcctatatatgt

SEQ ID NO: 4202709 - DNA, 16 bp, Homo sapiens
ctgcctatccatcctg

SEQ ID NO: 4202710 - DNA, 14 bp, Homo sapiens
ctgcctatcctctg

SEQ ID NO: 4202711 - DNA, 14 bp, Homo sapiens
ctgcctgcctgtgg

SEQ ID NO: 4202712 - DNA, 20 bp, Homo sapiens
ctgcctggaggatccctcca

SEQ ID NO: 4202713 - DNA, 15 bp, Homo sapiens
ctgcctgtagttagg

SEQ ID NO: 4202714 - DNA, 19 bp, Homo sapiens
ctgcctgtagttaggaaat

SEQ ID NO: 4202715 - DNA, 20 bp, Homo sapiens
ctgcctgtagttaggaaata

SEQ ID NO: 4202716 - DNA, 22 bp, Homo sapiens
ctgcctgtggagacagccctgc

SEQ ID NO: 4202717 - DNA, 17 bp, Homo sapiens
ctgccttttttcacagc

SEQ ID NO: 4202718 - DNA, 18 bp, Homo sapiens
ctgccttttttcacagcc

SEQ ID NO: 4202719 - DNA, 21 bp, Homo sapiens
ctgcgaaaacgttgacccctt

SEQ ID NO: 4202720 - DNA, 18 bp, Homo sapiens
ctgcgaaggggccctggt

SEQ ID NO: 4202721 - DNA, 19 bp, Homo sapiens
ctgcgaaggggccctggtc

SEQ ID NO: 4202722 - DNA, 17 bp, Homo sapiens
ctgcggctgctgtgtgc

SEQ ID NO: 4202723 - DNA, 17 bp, Homo sapiens
ctgcgggagctctgtat

SEQ ID NO: 4202724 - DNA, 22 bp, Homo sapiens
ctgcgggatggtcctggggctc

SEQ ID NO: 4202725 - DNA, 15 bp, Homo sapiens
ctgcggtatacattt

SEQ ID NO: 4202726 - DNA, 21 bp, Homo sapiens
ctgcgtcagaccagtactggg

SEQ ID NO: 4202727 - DNA, 13 bp, Homo sapiens
ctgcgtctgtgtt

SEQ ID NO: 4202728 - DNA, 22 bp, Homo sapiens
ctgcgtgactattttttaataa

SEQ ID NO: 4202729 - DNA, 15 bp, Homo sapiens
ctgctacctctgaga

SEQ ID NO: 4202730 - DNA, 15 bp, Homo sapiens
ctgctaggcgagtgc

SEQ ID NO: 4202731 - DNA, 20 bp, Homo sapiens
ctgctaggcgagtgccagga

SEQ ID NO: 4202732 - DNA, 22 bp, Homo sapiens
ctgctaggcgagtgccaggact

SEQ ID NO: 4202733 - DNA, 23 bp, Homo sapiens
ctgctaggcgagtgccaggactc

SEQ ID NO: 4202734 - DNA, 19 bp, Homo sapiens
ctgctatattttcatgact

SEQ ID NO: 4202735 - DNA, 15 bp, Homo sapiens
ctgctatcattattc

SEQ ID NO: 4202736 - DNA, 21 bp, Homo sapiens
ctgctatggttttctccaaga

SEQ ID NO: 4202737 - DNA, 20 bp, Homo sapiens
ctgctccagagagaggatgc

SEQ ID NO: 4202738 - DNA, 15 bp, Homo sapiens
ctgctcccatctgca

SEQ ID NO: 4202739 - DNA, 13 bp, Homo sapiens
ctgctcctccagc

SEQ ID NO: 4202740 - DNA, 22 bp, Homo sapiens
ctgctcggtcaggagggtgcag

SEQ ID NO: 4202741 - DNA, 11 bp, Homo sapiens
ctgctgaagag

SEQ ID NO: 4202742 - DNA, 18 bp, Homo sapiens
ctgctgaaggacagaaca

SEQ ID NO: 4202743 - DNA, 19 bp, Homo sapiens
ctgctgaaggacagaacat

SEQ ID NO: 4202744 - DNA, 20 bp, Homo sapiens
ctgctgacctgatcacctct

SEQ ID NO: 4202745 - DNA, 21 bp, Homo sapiens
ctgctgacctgatcacctctg

SEQ ID NO: 4202746 - DNA, 19 bp, Homo sapiens
ctgctgagatacatacaga

SEQ ID NO: 4202747 - DNA, 22 bp, Homo sapiens
ctgctgagcagcccagcacaac

SEQ ID NO: 4202748 - DNA, 17 bp, Homo sapiens
ctgctgcactgccctcc

SEQ ID NO: 4202749 - DNA, 18 bp, Homo sapiens
ctgctgcactgccctccg

SEQ ID NO: 4202750 - DNA, 17 bp, Homo sapiens
ctgctgccgcctcccag

SEQ ID NO: 4202751 - DNA, 21 bp, Homo sapiens
ctgctgccgcctcccagcctg

SEQ ID NO: 4202752 - DNA, 17 bp, Homo sapiens
ctgctgcggcgaccgcc

SEQ ID NO: 4202753 - DNA, 14 bp, Homo sapiens
ctgctggaaaccac

SEQ ID NO: 4202754 - DNA, 19 bp, Homo sapiens
ctgctggctgacctgggcc

SEQ ID NO: 4202755 - DNA, 19 bp, Homo sapiens
ctgctgggactggccaggt

SEQ ID NO: 4202756 - DNA, 23 bp, Homo sapiens
ctgctgggagatgccattctcca

SEQ ID NO: 4202757 - DNA, 20 bp, Homo sapiens
ctgctggtaatttgtatctg

SEQ ID NO: 4202758 - DNA, 14 bp, Homo sapiens
ctgctgtgtgcctt

SEQ ID NO: 4202759 - DNA, 19 bp, Homo sapiens
ctgcttactaatgtgcccc

SEQ ID NO: 4202760 - DNA, 12 bp, Homo sapiens
ctgcttcagtgg

SEQ ID NO: 4202761 - DNA, 21 bp, Homo sapiens
ctgcttcatgctcagccctga

SEQ ID NO: 4202762 - DNA, 16 bp, Homo sapiens
ctgcttggagctgagc

SEQ ID NO: 4202763 - DNA, 14 bp, Homo sapiens
ctgctttcactgtg

SEQ ID NO: 4202764 - DNA, 13 bp, Homo sapiens
cttgtaaaaccaa

SEQ ID NO: 4202765 - DNA, 16 bp, Homo sapiens
cttgtatagtgtaaaa

SEQ ID NO: 4202766 - DNA, 17 bp, Homo sapiens
cttgtatagtgtaaaat

SEQ ID NO: 4202767 - DNA, 15 bp, Homo sapiens
cttgtcactgaagat

SEQ ID NO: 4202768 - DNA, 22 bp, Homo sapiens
cttgtcagaattggcctcagtg

SEQ ID NO: 4202769 - DNA, 23 bp, Homo sapiens
cttgttcaagtatctaactcttc

SEQ ID NO: 4202770 - DNA, 15 bp, Homo sapiens
cttgttgtgctttta

SEQ ID NO: 4202771 - DNA, 15 bp, Homo sapiens
cttgttgtttttaag

SEQ ID NO: 4202772 - DNA, 23 bp, Homo sapiens
ctttaaagtgactaatggcatga

SEQ ID NO: 4202773 - DNA, 18 bp, Homo sapiens
ctttaaccctctcttccc

SEQ ID NO: 4202774 - DNA, 16 bp, Homo sapiens
ctttaaggagaagaga

SEQ ID NO: 4202775 - DNA, 16 bp, Homo sapiens
ctttaagtattgtttt

SEQ ID NO: 4202776 - DNA, 13 bp, Homo sapiens
ctttaatcaattc

SEQ ID NO: 4202777 - DNA, 17 bp, Homo sapiens
ctttaatttttataaat

SEQ ID NO: 4202778 - DNA, 18 bp, Homo sapiens
ctttaatttttataaata

SEQ ID NO: 4202779 - DNA, 21 bp, Homo sapiens
ctttacaggtatttataatat

SEQ ID NO: 4202780 - DNA, 14 bp, Homo sapiens
ctttacatgcaatt

SEQ ID NO: 4202781 - DNA, 17 bp, Homo sapiens
ctttacatgcaatttat

SEQ ID NO: 4202782 - DNA, 15 bp, Homo sapiens
ctttacctaccacct

SEQ ID NO: 4202783 - DNA, 20 bp, Homo sapiens
ctttacctaccaccttccct

SEQ ID NO: 4202784 - DNA, 20 bp, Homo sapiens
ctttactggtgatttctgag

SEQ ID NO: 4202785 - DNA, 13 bp, Homo sapiens
ctttagagtagca

SEQ ID NO: 4202786 - DNA, 22 bp, Homo sapiens
ctttaggcaggttacagttaac

SEQ ID NO: 4202787 - DNA, 17 bp, Homo sapiens
ctttataaaaagtgaaa

SEQ ID NO: 4202788 - DNA, 12 bp, Homo sapiens
ctttatatgtaa

SEQ ID NO: 4202789 - DNA, 19 bp, Homo sapiens
ctttcagcactcagaaaag

SEQ ID NO: 4202790 - DNA, 16 bp, Homo sapiens
ctttcaggtccaggcc

SEQ ID NO: 4202791 - DNA, 17 bp, Homo sapiens
ctttcaggtccaggcca

SEQ ID NO: 4202792 - DNA, 19 bp, Homo sapiens
ctttcccatgatccagaac

SEQ ID NO: 4202793 - DNA, 16 bp, Homo sapiens
ctttccccacctcttc

SEQ ID NO: 4202794 - DNA, 21 bp, Homo sapiens
ctttcccccaccccagagttg

SEQ ID NO: 4202795 - DNA, 22 bp, Homo sapiens
ctttccccgggggaggaagggg

SEQ ID NO: 4202796 - DNA, 11 bp, Homo sapiens
ctttcctcccc

SEQ ID NO: 4202797 - DNA, 12 bp, Homo sapiens
ctttcctcccca

SEQ ID NO: 4202798 - DNA, 19 bp, Homo sapiens
ctttcctccccaccttccc

SEQ ID NO: 4202799 - DNA, 16 bp, Homo sapiens
ctttcctctgcagcac

SEQ ID NO: 4202800 - DNA, 18 bp, Homo sapiens
ctttcctctgcagcactt

SEQ ID NO: 4202801 - DNA, 22 bp, Homo sapiens
ctttcctgatggtacaggaaag

SEQ ID NO: 4202802 - DNA, 18 bp, Homo sapiens
ctttccttctggctccaa

SEQ ID NO: 4202803 - DNA, 23 bp, Homo sapiens
ctttctacattctcatctactca

SEQ ID NO: 4202804 - DNA, 22 bp, Homo sapiens
ctttctcactaaatcttttata

SEQ ID NO: 4202805 - DNA, 16 bp, Homo sapiens
ctttctcactgctgtc

SEQ ID NO: 4202806 - DNA, 18 bp, Homo sapiens
ctttctcccactgagttt

SEQ ID NO: 4202807 - DNA, 20 bp, Homo sapiens
ctttctcgtggtagaagcca

SEQ ID NO: 4202808 - DNA, 21 bp, Homo sapiens
ctttctcgtggtagaagccag

SEQ ID NO: 4202809 - DNA, 14 bp, Homo sapiens
ctttctctggctcc

SEQ ID NO: 4202810 - DNA, 16 bp, Homo sapiens
ctttctctggctccag

SEQ ID NO: 4202811 - DNA, 17 bp, Homo sapiens
ctttctctggctccaga

SEQ ID NO: 4202812 - DNA, 18 bp, Homo sapiens
ctttctctggctccagaa

SEQ ID NO: 4202813 - DNA, 16 bp, Homo sapiens
ctttctgatcaaggcc

SEQ ID NO: 4202814 - DNA, 17 bp, Homo sapiens
ctttctgatcaaggcct

SEQ ID NO: 4202815 - DNA, 18 bp, Homo sapiens
ctttctgatcaaggcctt

SEQ ID NO: 4202816 - DNA, 21 bp, Homo sapiens
ctttctgtgtgcaccttacca

SEQ ID NO: 4202817 - DNA, 22 bp, Homo sapiens
ctttgaaacaagataactgaga

SEQ ID NO: 4202818 - DNA, 13 bp, Homo sapiens
ctttgaaacagaa

SEQ ID NO: 4202819 - DNA, 23 bp, Homo sapiens
ctttgacatttccttctttgtct

SEQ ID NO: 4202820 - DNA, 12 bp, Homo sapiens
ctttgactgaaa

SEQ ID NO: 4202821 - DNA, 16 bp, Homo sapiens
ctttgatctctgctta

SEQ ID NO: 4202822 - DNA, 14 bp, Homo sapiens
ctttgattcagaca

SEQ ID NO: 4202823 - DNA, 15 bp, Homo sapiens
ctttgcaatccaaat

SEQ ID NO: 4202824 - DNA, 19 bp, Homo sapiens
ctttgcaatccaaataaag

SEQ ID NO: 4202825 - DNA, 15 bp, Homo sapiens
ctttgccaaaatacc

SEQ ID NO: 4202826 - DNA, 16 bp, Homo sapiens
ctttgccaaaatacca

SEQ ID NO: 4202827 - DNA, 18 bp, Homo sapiens
ctttgccatgggcctgct

SEQ ID NO: 4202828 - DNA, 19 bp, Homo sapiens
ctttgccatgggcctgctg

SEQ ID NO: 4202829 - DNA, 20 bp, Homo sapiens
ctttgccatgggcctgctgc

SEQ ID NO: 4202830 - DNA, 15 bp, Homo sapiens
ctttgccccagttac

SEQ ID NO: 4202831 - DNA, 15 bp, Homo sapiens
ctttgcctcttcagc

SEQ ID NO: 4202832 - DNA, 14 bp, Homo sapiens
ctttgccttttgca

SEQ ID NO: 4202833 - DNA, 20 bp, Homo sapiens
ctttgctttttaattgagga

SEQ ID NO: 4202834 - DNA, 17 bp, Homo sapiens
ctttggggaagggggag

SEQ ID NO: 4202835 - DNA, 17 bp, Homo sapiens
ctttggggtcagccagg

SEQ ID NO: 4202836 - DNA, 17 bp, Homo sapiens
ctttgtctctagccggg

SEQ ID NO: 4202837 - DNA, 13 bp, Homo sapiens
ctttgtggtaact

SEQ ID NO: 4202838 - DNA, 12 bp, Homo sapiens
ctttgtgtaaag

SEQ ID NO: 4202839 - DNA, 13 bp, Homo sapiens
ctttgtgtaaaga

SEQ ID NO: 4202840 - DNA, 16 bp, Homo sapiens
ctttgttcagttgact

SEQ ID NO: 4202841 - DNA, 16 bp, Homo sapiens
ctttgttcccactgtc

SEQ ID NO: 4202842 - DNA, 21 bp, Homo sapiens
ctttgtttcctccttgtcact

SEQ ID NO: 4202843 - DNA, 19 bp, Homo sapiens
cttttaaaagaaaaagtat

SEQ ID NO: 4202844 - DNA, 18 bp, Homo sapiens
cttttaaaatgaaatgtt

SEQ ID NO: 4202845 - DNA, 17 bp, Homo sapiens
cttttaccatgaattct

SEQ ID NO: 4202846 - DNA, 20 bp, Homo sapiens
cttttaccatgaattcttga

SEQ ID NO: 4202847 - DNA, 14 bp, Homo sapiens
cttttatagctatt

SEQ ID NO: 4202848 - DNA, 19 bp, Homo sapiens
cttttatctgtagcagaaa

SEQ ID NO: 4202849 - DNA, 16 bp, Homo sapiens
cttttattgtataaac

SEQ ID NO: 4202850 - DNA, 21 bp, Homo sapiens
cttttcaaggaaaaatgctgc

SEQ ID NO: 4202851 - DNA, 20 bp, Homo sapiens
cttttcagttcccgctctgc

SEQ ID NO: 4202852 - DNA, 17 bp, Homo sapiens
cttttccactccaagat

SEQ ID NO: 4202853 - DNA, 18 bp, Homo sapiens
cttttcccaaaatgttga

SEQ ID NO: 4202854 - DNA, 20 bp, Homo sapiens
cttttgaaacagattccatt

SEQ ID NO: 4202855 - DNA, 20 bp, Homo sapiens
cttttgcaacatggtccagt

SEQ ID NO: 4202856 - DNA, 23 bp, Homo sapiens
cttttgcggttcaggaaaattga

SEQ ID NO: 4202857 - DNA, 18 bp, Homo sapiens
cttttgcttggcagagag

SEQ ID NO: 4202858 - DNA, 22 bp, Homo sapiens
cttttgggaggtccaggcagga

SEQ ID NO: 4202859 - DNA, 16 bp, Homo sapiens
cttttgtggattgaca

SEQ ID NO: 4202860 - DNA, 23 bp, Homo sapiens
ctttttccaacttggctgcagga

SEQ ID NO: 4202861 - DNA, 12 bp, Homo sapiens
ctttttctttat

SEQ ID NO: 4202862 - DNA, 16 bp, Homo sapiens
ctttttctttataaac

SEQ ID NO: 4202863 - DNA, 18 bp, Homo sapiens
ctttttctttataaactt

SEQ ID NO: 4202864 - DNA, 19 bp, Homo sapiens
ctttttgaatgttatttgt

SEQ ID NO: 4202865 - DNA, 22 bp, Homo sapiens
cttttttttaataaggaaaaaa

SEQ ID NO: 4202866 - DNA, 23 bp, Homo sapiens
cttttttttatacacaacattta

SEQ ID NO: 4202867 - DNA, 19 bp, Homo sapiens
gaaaaaaaaaaagaagaag

SEQ ID NO: 4202868 - DNA, 21 bp, Homo sapiens
gaaaaaaaaagtcagactgct

SEQ ID NO: 4202869 - DNA, 17 bp, Homo sapiens
gaaaaaatgtagaatga

SEQ ID NO: 4202870 - DNA, 17 bp, Homo sapiens
gaaaaacacggcagctg

SEQ ID NO: 4202871 - DNA, 14 bp, Homo sapiens
gaaaaataaagtta

SEQ ID NO: 4202872 - DNA, 16 bp, Homo sapiens
gaaaaatatgtaccaa

SEQ ID NO: 4202873 - DNA, 23 bp, Homo sapiens
gaaaacctcacttgaaggcccag

SEQ ID NO: 4202874 - DNA, 15 bp, Homo sapiens
gaaaacctttcttca

SEQ ID NO: 4202875 - DNA, 15 bp, Homo sapiens
gaaaacttatttgag

SEQ ID NO: 4202876 - DNA, 12 bp, Homo sapiens
gaaaactttaaa

SEQ ID NO: 4202877 - DNA, 20 bp, Homo sapiens
gaaaagaggagtttcgaggt

SEQ ID NO: 4202878 - DNA, 21 bp, Homo sapiens
gaaaagaggagtttcgaggta

SEQ ID NO: 4202879 - DNA, 23 bp, Homo sapiens
gaaaagctagaattgagtgttta

SEQ ID NO: 4202880 - DNA, 19 bp, Homo sapiens
gaaaataaattttgaatgt

SEQ ID NO: 4202881 - DNA, 13 bp, Homo sapiens
gaaaatagcagga

SEQ ID NO: 4202882 - DNA, 20 bp, Homo sapiens
gaaaatctaatattaaaaat

SEQ ID NO: 4202883 - DNA, 18 bp, Homo sapiens
gaaaatggctttaatcaa

SEQ ID NO: 4202884 - DNA, 13 bp, Homo sapiens
gaaaattatttaa

SEQ ID NO: 4202885 - DNA, 23 bp, Homo sapiens
gaaaattatttaaaccgctaaaa

SEQ ID NO: 4202886 - DNA, 17 bp, Homo sapiens
gaaaattattttaaaca

SEQ ID NO: 4202887 - DNA, 18 bp, Homo sapiens
gaaacaacttgtgttcta

SEQ ID NO: 4202888 - DNA, 19 bp, Homo sapiens
gaaacattcatttttacct

SEQ ID NO: 4202889 - DNA, 13 bp, Homo sapiens
gaaaccacacttc

SEQ ID NO: 4202890 - DNA, 13 bp, Homo sapiens
gaaaccacctggg

SEQ ID NO: 4202891 - DNA, 15 bp, Homo sapiens
gaaaccacctgggtt

SEQ ID NO: 4202892 - DNA, 19 bp, Homo sapiens
gaaaccagtgtagccttgc

SEQ ID NO: 4202893 - DNA, 19 bp, Homo sapiens
gaaaccattccagtaggaa

SEQ ID NO: 4202894 - DNA, 22 bp, Homo sapiens
gaaacccattaggcatgcctaa

SEQ ID NO: 4202895 - DNA, 13 bp, Homo sapiens
gaaacctactgcc

SEQ ID NO: 4202896 - DNA, 19 bp, Homo sapiens
gaaacctactgcccaggca

SEQ ID NO: 4202897 - DNA, 13 bp, Homo sapiens
gaaacctgaaaaa

SEQ ID NO: 4202898 - DNA, 22 bp, Homo sapiens
ggagcggagcttgcctgcctgc

SEQ ID NO: 4202899 - DNA, 23 bp, Homo sapiens
ggagctaaattgaatacacaaat

SEQ ID NO: 4202900 - DNA, 15 bp, Homo sapiens
ggagctctctgctga

SEQ ID NO: 4202901 - DNA, 16 bp, Homo sapiens
ggagctctgtatggtc

SEQ ID NO: 4202902 - DNA, 21 bp, Homo sapiens
ggagctgctggctgacctggg

SEQ ID NO: 4202903 - DNA, 22 bp, Homo sapiens
ggagctgctggctgacctgggc

SEQ ID NO: 4202904 - DNA, 23 bp, Homo sapiens
ggagctgctggctgacctgggcc

SEQ ID NO: 4202905 - DNA, 21 bp, Homo sapiens
ggagctggaaataaacctgga

SEQ ID NO: 4202906 - DNA, 23 bp, Homo sapiens
ggagctggaaataaacctggaga

SEQ ID NO: 4202907 - DNA, 22 bp, Homo sapiens
ggaggacggttgtaagcagttg

SEQ ID NO: 4202908 - DNA, 18 bp, Homo sapiens
ggaggaggcagagaagaa

SEQ ID NO: 4202909 - DNA, 14 bp, Homo sapiens
ggaggcagagaaga

SEQ ID NO: 4202910 - DNA, 15 bp, Homo sapiens
ggaggccctgtgccc

SEQ ID NO: 4202911 - DNA, 19 bp, Homo sapiens
ggaggcctcgtaccagcca

SEQ ID NO: 4202912 - DNA, 20 bp, Homo sapiens
ggaggcggagagtacagtga

SEQ ID NO: 4202913 - DNA, 18 bp, Homo sapiens
ggaggctgagacaggaga

SEQ ID NO: 4202914 - DNA, 12 bp, Homo sapiens
ggaggctgaggc

SEQ ID NO: 4202915 - DNA, 22 bp, Homo sapiens
ggaggggttgcgggggagctgg

SEQ ID NO: 4202916 - DNA, 14 bp, Homo sapiens
ggaggtccaggcag

SEQ ID NO: 4202917 - DNA, 16 bp, Homo sapiens
ggaggtccaggcagga

SEQ ID NO: 4202918 - DNA, 20 bp, Homo sapiens
ggaggtggaggttgcagtga

SEQ ID NO: 4202919 - DNA, 14 bp, Homo sapiens
ggaggttgcaggga

SEQ ID NO: 4202920 - DNA, 12 bp, Homo sapiens
ggagtagtggag

SEQ ID NO: 4202921 - DNA, 14 bp, Homo sapiens
ggagtagtggagag

SEQ ID NO: 4202922 - DNA, 20 bp, Homo sapiens
ggagttcagtggtgtgatct

SEQ ID NO: 4202923 - DNA, 19 bp, Homo sapiens
ggagttccatgaagaccac

SEQ ID NO: 4202924 - DNA, 19 bp, Homo sapiens
ggagtttgaggctgcagcg

SEQ ID NO: 4202925 - DNA, 18 bp, Homo sapiens
ggatactctgtcagatgg

SEQ ID NO: 4202926 - DNA, 20 bp, Homo sapiens
ggatatggtgcaaaaatgag

SEQ ID NO: 4202927 - DNA, 22 bp, Homo sapiens
ggatcagcctccgccattccaa

SEQ ID NO: 4202928 - DNA, 18 bp, Homo sapiens
ggatccctccatccggct

SEQ ID NO: 4202929 - DNA, 14 bp, Homo sapiens
ggatcctattctca

SEQ ID NO: 4202930 - DNA, 20 bp, Homo sapiens
ggatcctattctcaccagga

SEQ ID NO: 4202931 - DNA, 14 bp, Homo sapiens
ggatctttgactga

SEQ ID NO: 4202932 - DNA, 14 bp, Homo sapiens
ggatgaccagaaca

SEQ ID NO: 4202933 - DNA, 13 bp, Homo sapiens
ggatgcagagggg

SEQ ID NO: 4202934 - DNA, 22 bp, Homo sapiens
ggatgcagtggctcatgcctgt

SEQ ID NO: 4202935 - DNA, 23 bp, Homo sapiens
ggatgttctagccctccctggca

SEQ ID NO: 4202936 - DNA, 18 bp, Homo sapiens
ggatgtttttcatgaaaa

SEQ ID NO: 4202937 - DNA, 22 bp, Homo sapiens
ggattcccaccaaggtcttcag

SEQ ID NO: 4202938 - DNA, 18 bp, Homo sapiens
ggattccccatctcaggc

SEQ ID NO: 4202939 - DNA, 18 bp, Homo sapiens
ggattcctgggcaagaac

SEQ ID NO: 4202940 - DNA, 19 bp, Homo sapiens
ggattgcaggtgcctggct

SEQ ID NO: 4202941 - DNA, 19 bp, Homo sapiens
ggattggcctgtgtctggc

SEQ ID NO: 4202942 - DNA, 15 bp, Homo sapiens
ggattgttgacatga

SEQ ID NO: 4202943 - DNA, 17 bp, Homo sapiens
ggcaaacggagtacaga

SEQ ID NO: 4202944 - DNA, 16 bp, Homo sapiens
ggcaaagaactgcccc

SEQ ID NO: 4202945 - DNA, 13 bp, Homo sapiens
ggcaagggggcgg

SEQ ID NO: 4202946 - DNA, 15 bp, Homo sapiens
ggcaagggggcgggg

SEQ ID NO: 4202947 - DNA, 22 bp, Homo sapiens
ggcaagtggatggcccagcagg

SEQ ID NO: 4202948 - DNA, 22 bp, Homo sapiens
ggcacaatggctaattcccaga

SEQ ID NO: 4202949 - DNA, 18 bp, Homo sapiens
ggcaccatccaccctgca

SEQ ID NO: 4202950 - DNA, 16 bp, Homo sapiens
ggcaccccctggagag

SEQ ID NO: 4202951 - DNA, 20 bp, Homo sapiens
ggcaccccctggagagaagt

SEQ ID NO: 4202952 - DNA, 22 bp, Homo sapiens
ggcactgtctgcgtgactattt

SEQ ID NO: 4202953 - DNA, 16 bp, Homo sapiens
ggcacttgattccttg

SEQ ID NO: 4202954 - DNA, 16 bp, Homo sapiens
ggcagaaagtggccat

SEQ ID NO: 4202955 - DNA, 13 bp, Homo sapiens
ggcagaaggggaa

SEQ ID NO: 4202956 - DNA, 22 bp, Homo sapiens
ggcagactctttatgcttgcaa

SEQ ID NO: 4202957 - DNA, 14 bp, Homo sapiens
ggcagagaaagaag

SEQ ID NO: 4202958 - DNA, 21 bp, Homo sapiens
ggcagagaaagaagagacagg

SEQ ID NO: 4202959 - DNA, 15 bp, Homo sapiens
ggcagagcacagccc

SEQ ID NO: 4202960 - DNA, 18 bp, Homo sapiens
ggcagagtgaaataaaat

SEQ ID NO: 4202961 - DNA, 18 bp, Homo sapiens
ggcagataatcagcctct

SEQ ID NO: 4202962 - DNA, 20 bp, Homo sapiens
ggcagataatcagcctctta

SEQ ID NO: 4202963 - DNA, 16 bp, Homo sapiens
ggcagatcacaaggtc

SEQ ID NO: 4202964 - DNA, 11 bp, Homo sapiens
ggcagcctgcc

SEQ ID NO: 4202965 - DNA, 12 bp, Homo sapiens
ggcagcctgccg

SEQ ID NO: 4202966 - DNA, 14 bp, Homo sapiens
ggcaggaccaggac

SEQ ID NO: 4202967 - DNA, 16 bp, Homo sapiens
ggcaggctggctggcc

SEQ ID NO: 4202968 - DNA, 15 bp, Homo sapiens
ggcagggatttgagg

SEQ ID NO: 4202969 - DNA, 17 bp, Homo sapiens
ggcaggggagtagtgga

SEQ ID NO: 4202970 - DNA, 19 bp, Homo sapiens
ggcaggggagtagtggaga

SEQ ID NO: 4202971 - DNA, 15 bp, Homo sapiens
ggcaggggtgggaga

SEQ ID NO: 4202972 - DNA, 18 bp, Homo sapiens
ggcaggggtgggagagcc

SEQ ID NO: 4202973 - DNA, 23 bp, Homo sapiens
ggcagtgaacacactcagcagcc

SEQ ID NO: 4202974 - DNA, 20 bp, Homo sapiens
ggcagtggaaaaatcagaag

SEQ ID NO: 4202975 - DNA, 21 bp, Homo sapiens
ggcatacctgtcctagcagga

SEQ ID NO: 4202976 - DNA, 13 bp, Homo sapiens
ggcatagagggag

SEQ ID NO: 4202977 - DNA, 17 bp, Homo sapiens
ggcatcacagggcagag

SEQ ID NO: 4202978 - DNA, 19 bp, Homo sapiens
ggcatccttctgccttttt

SEQ ID NO: 4202979 - DNA, 15 bp, Homo sapiens
ggcatgaacgcactt

SEQ ID NO: 4202980 - DNA, 14 bp, Homo sapiens
ggcatgacactcta

SEQ ID NO: 4202981 - DNA, 21 bp, Homo sapiens
ggcatgacactctagtgactt

SEQ ID NO: 4202982 - DNA, 23 bp, Homo sapiens
ggcatgacactctagtgacttcc

SEQ ID NO: 4202983 - DNA, 13 bp, Homo sapiens
ggcatgagaaata

SEQ ID NO: 4202984 - DNA, 16 bp, Homo sapiens
ggcatgcctgggaatc

SEQ ID NO: 4202985 - DNA, 14 bp, Homo sapiens
ggcatgctggggca

SEQ ID NO: 4202986 - DNA, 15 bp, Homo sapiens
ggcattcctgcttat

SEQ ID NO: 4202987 - DNA, 21 bp, Homo sapiens
ggcattgaatgacaagcatca

SEQ ID NO: 4202988 - DNA, 15 bp, Homo sapiens
ggccaagacttggca

SEQ ID NO: 4202989 - DNA, 23 bp, Homo sapiens
ggccaagacttggcaacagaagc

SEQ ID NO: 4202990 - DNA, 14 bp, Homo sapiens
ggccaagcctggcc

SEQ ID NO: 4202991 - DNA, 19 bp, Homo sapiens
ggccactctcccctccctc

SEQ ID NO: 4202992 - DNA, 22 bp, Homo sapiens
ggccagatgattttcctccctg

SEQ ID NO: 4202993 - DNA, 19 bp, Homo sapiens
ggccaggcaggggtgggag

SEQ ID NO: 4202994 - DNA, 15 bp, Homo sapiens
ggccaggccaccagg

SEQ ID NO: 4202995 - DNA, 16 bp, Homo sapiens
ggccaggccaccagga

SEQ ID NO: 4202996 - DNA, 18 bp, Homo sapiens
ggccagggccctgcagag

SEQ ID NO: 4202997 - DNA, 14 bp, Homo sapiens
ggccaggtgcagtg

SEQ ID NO: 4202998 - DNA, 22 bp, Homo sapiens
ggccagtgagggctgggcccac

SEQ ID NO: 4202999 - DNA, 14 bp, Homo sapiens
ggccatcagggtgg

SEQ ID NO: 4203000 - DNA, 19 bp, Homo sapiens
ggccatgctttccttttct

SEQ ID NO: 4203001 - DNA, 18 bp, Homo sapiens
ggcccacagagcctggct

SEQ ID NO: 4203002 - DNA, 22 bp, Homo sapiens
ggcccacagagcctggctttgg

SEQ ID NO: 4203003 - DNA, 18 bp, Homo sapiens
ggcccagagaccccttcc

SEQ ID NO: 4203004 - DNA, 16 bp, Homo sapiens
ggcccagccagccagg

SEQ ID NO: 4203005 - DNA, 17 bp, Homo sapiens
ggcccagccagccagga

SEQ ID NO: 4203006 - DNA, 15 bp, Homo sapiens
ggcccagcctgtcct

SEQ ID NO: 4203007 - DNA, 15 bp, Homo sapiens
ggcccaggcaggcca

SEQ ID NO: 4203008 - DNA, 22 bp, Homo sapiens
ggcccagtcgtccgctcagcca

SEQ ID NO: 4203009 - DNA, 23 bp, Homo sapiens
ggccccaccctcgtggacacctg

SEQ ID NO: 4203010 - DNA, 13 bp, Homo sapiens
ggccccaggccct

SEQ ID NO: 4203011 - DNA, 12 bp, Homo sapiens
ggcccccctcca

SEQ ID NO: 4203012 - DNA, 14 bp, Homo sapiens
ggcccccctccagg

SEQ ID NO: 4203013 - DNA, 15 bp, Homo sapiens
ggcccccctccaggc

SEQ ID NO: 4203014 - DNA, 23 bp, Homo sapiens
ggcccccctccaggcatgctggc

SEQ ID NO: 4203015 - DNA, 22 bp, Homo sapiens
ggcccctccgcgagggctactc

SEQ ID NO: 4203016 - DNA, 21 bp, Homo sapiens
ggccctaggattcctccccca

SEQ ID NO: 4203017 - DNA, 14 bp, Homo sapiens
ggccctcagtgggc

SEQ ID NO: 4203018 - DNA, 21 bp, Homo sapiens
ggccctcccttgcaggtcggt

SEQ ID NO: 4203019 - DNA, 12 bp, Homo sapiens
ggccctggtcct

SEQ ID NO: 4203020 - DNA, 17 bp, Homo sapiens
ggccctggtccttccag

SEQ ID NO: 4203021 - DNA, 18 bp, Homo sapiens
ggcccttctgtccaccag

SEQ ID NO: 4203022 - DNA, 16 bp, Homo sapiens
ggccgaaggcagtgca

SEQ ID NO: 4203023 - DNA, 16 bp, Homo sapiens
ggccgggaggcagtgc

SEQ ID NO: 4203024 - DNA, 23 bp, Homo sapiens
ggcctcaaagcaagcattcagaa

SEQ ID NO: 4203025 - DNA, 20 bp, Homo sapiens
ggcctcccaataaagctgga

SEQ ID NO: 4203026 - DNA, 21 bp, Homo sapiens
ggcctcccaataaagctggac

SEQ ID NO: 4203027 - DNA, 15 bp, Homo sapiens
ggcctcgtaccagcc

SEQ ID NO: 4203028 - DNA, 17 bp, Homo sapiens
ggcctcgtaccagccag

SEQ ID NO: 4203029 - DNA, 14 bp, Homo sapiens
ggcctggtagcaca

SEQ ID NO: 4203030 - DNA, 18 bp, Homo sapiens
ggccttagtacggctgct

SEQ ID NO: 4203031 - DNA, 15 bp, Homo sapiens
ggccttccctcccca

SEQ ID NO: 4203032 - DNA, 20 bp, Homo sapiens
gtaagaaacctactgcccag

SEQ ID NO: 4203033 - DNA, 17 bp, Homo sapiens
gtaagctctggctttct

SEQ ID NO: 4203034 - DNA, 20 bp, Homo sapiens
gtaaggtaatttctgtgtat

SEQ ID NO: 4203035 - DNA, 18 bp, Homo sapiens
gtaagtaccactcaggcc

SEQ ID NO: 4203036 - DNA, 13 bp, Homo sapiens
gtaagtggcagga

SEQ ID NO: 4203037 - DNA, 12 bp, Homo sapiens
gtaatatattgc

SEQ ID NO: 4203038 - DNA, 13 bp, Homo sapiens
gtaatatattgct

SEQ ID NO: 4203039 - DNA, 21 bp, Homo sapiens
gtaatatctattattataaaa

SEQ ID NO: 4203040 - DNA, 15 bp, Homo sapiens
gtaatatgtctgcca

SEQ ID NO: 4203041 - DNA, 20 bp, Homo sapiens
gtaatcccagctacccagga

SEQ ID NO: 4203042 - DNA, 21 bp, Homo sapiens
gtaatcccagctacccaggag

SEQ ID NO: 4203043 - DNA, 22 bp, Homo sapiens
gtaatctccacagtcaaagaag

SEQ ID NO: 4203044 - DNA, 15 bp, Homo sapiens
gtaatgagaacttca

SEQ ID NO: 4203045 - DNA, 14 bp, Homo sapiens
gtaatgtaaataca

SEQ ID NO: 4203046 - DNA, 18 bp, Homo sapiens
gtaatgtatttatatgtt

SEQ ID NO: 4203047 - DNA, 14 bp, Homo sapiens
gtaattatatctgt

SEQ ID NO: 4203048 - DNA, 21 bp, Homo sapiens
gtaattcctctcactaaactt

SEQ ID NO: 4203049 - DNA, 23 bp, Homo sapiens
gtaattgtactaaagccaaacat

SEQ ID NO: 4203050 - DNA, 15 bp, Homo sapiens
gtaatttattgtctg

SEQ ID NO: 4203051 - DNA, 21 bp, Homo sapiens
gtaatttgtatctgaaggaga

SEQ ID NO: 4203052 - DNA, 17 bp, Homo sapiens
gtaatttttttgaaaaa

SEQ ID NO: 4203053 - DNA, 12 bp, Homo sapiens
gtacagcagggt

SEQ ID NO: 4203054 - DNA, 14 bp, Homo sapiens
gtacagcagggtct

SEQ ID NO: 4203055 - DNA, 18 bp, Homo sapiens
gtacagctgtttaagatg

SEQ ID NO: 4203056 - DNA, 14 bp, Homo sapiens
gtacagttcagttc

SEQ ID NO: 4203057 - DNA, 16 bp, Homo sapiens
gtacagttcagttcct

SEQ ID NO: 4203058 - DNA, 18 bp, Homo sapiens
gtacatacgtgttctata

SEQ ID NO: 4203059 - DNA, 10 bp, Homo sapiens
gtacatgtat

SEQ ID NO: 4203060 - DNA, 13 bp, Homo sapiens
gtacggctgctgc

SEQ ID NO: 4203061 - DNA, 13 bp, Homo sapiens
gtactaaagccaa

SEQ ID NO: 4203062 - DNA, 17 bp, Homo sapiens
gtactcaggaggctgag

SEQ ID NO: 4203063 - DNA, 14 bp, Homo sapiens
gtactccagcctgg

SEQ ID NO: 4203064 - DNA, 23 bp, Homo sapiens
gtactgggaatggaaggctttgc

SEQ ID NO: 4203065 - DNA, 22 bp, Homo sapiens
gtagaacaagcaacataaaaca

SEQ ID NO: 4203066 - DNA, 22 bp, Homo sapiens
gtagaaccacttggctgctcat

SEQ ID NO: 4203067 - DNA, 18 bp, Homo sapiens
gtagactcatcttttgaa

SEQ ID NO: 4203068 - DNA, 14 bp, Homo sapiens
gtagagagccgggc

SEQ ID NO: 4203069 - DNA, 14 bp, Homo sapiens
gtagagatgtgtgt

SEQ ID NO: 4203070 - DNA, 22 bp, Homo sapiens
gtagatattggacaaagaacct

SEQ ID NO: 4203071 - DNA, 23 bp, Homo sapiens
gtagatggaaatcagttgtgttt

SEQ ID NO: 4203072 - DNA, 20 bp, Homo sapiens
gtagcaagttctagagaaga

SEQ ID NO: 4203073 - DNA, 20 bp, Homo sapiens
gtagcacatgtctgtcctca

SEQ ID NO: 4203074 - DNA, 13 bp, Homo sapiens
gtagcagaaacca

SEQ ID NO: 4203075 - DNA, 13 bp, Homo sapiens
gtagccacaccag

SEQ ID NO: 4203076 - DNA, 17 bp, Homo sapiens
gtagcccatcaaaatgt

SEQ ID NO: 4203077 - DNA, 23 bp, Homo sapiens
gtaggaaaattagaagcaagctg

SEQ ID NO: 4203078 - DNA, 14 bp, Homo sapiens
gtaggaaatcaggc

SEQ ID NO: 4203079 - DNA, 19 bp, Homo sapiens
gtaggaacccagctctcag

SEQ ID NO: 4203080 - DNA, 15 bp, Homo sapiens
gtaggaaggaaaaaa

SEQ ID NO: 4203081 - DNA, 15 bp, Homo sapiens
gtaggattaatttat

SEQ ID NO: 4203082 - DNA, 13 bp, Homo sapiens
gtaggcagagcct

SEQ ID NO: 4203083 - DNA, 20 bp, Homo sapiens
gtagtagccctttctgtgtg

SEQ ID NO: 4203084 - DNA, 16 bp, Homo sapiens
gtagtggagagcgggt

SEQ ID NO: 4203085 - DNA, 17 bp, Homo sapiens
gtagttaaatagctata

SEQ ID NO: 4203086 - DNA, 11 bp, Homo sapiens
gtagttaggaa

SEQ ID NO: 4203087 - DNA, 13 bp, Homo sapiens
gtagttaggaaat

SEQ ID NO: 4203088 - DNA, 15 bp, Homo sapiens
gtagttaggaaataa

SEQ ID NO: 4203089 - DNA, 12 bp, Homo sapiens
gtataaatggtt

SEQ ID NO: 4203090 - DNA, 12 bp, Homo sapiens
gtataatgtgat

SEQ ID NO: 4203091 - DNA, 15 bp, Homo sapiens
gtataatgtgatttt

SEQ ID NO: 4203092 - DNA, 17 bp, Homo sapiens
gtatccgactctaagct

SEQ ID NO: 4203093 - DNA, 20 bp, Homo sapiens
gtatccgactctaagctgtg

SEQ ID NO: 4203094 - DNA, 15 bp, Homo sapiens
gtatctctggcctcc

SEQ ID NO: 4203095 - DNA, 11 bp, Homo sapiens
gtatctgaagg

SEQ ID NO: 4203096 - DNA, 20 bp, Homo sapiens
gtatgaacttgaggacacat

SEQ ID NO: 4203097 - DNA, 23 bp, Homo sapiens
gtatgggaagccatattcacacc

SEQ ID NO: 4203098 - DNA, 14 bp, Homo sapiens
gtatggtcaggatg

SEQ ID NO: 4203099 - DNA, 14 bp, Homo sapiens
gtatgtaaacagga

SEQ ID NO: 4203100 - DNA, 11 bp, Homo sapiens
gtatgtgtggg

SEQ ID NO: 4203101 - DNA, 13 bp, Homo sapiens
gtattagcaaagc

SEQ ID NO: 4203102 - DNA, 22 bp, Homo sapiens
gtattaggggtaatatattgct

SEQ ID NO: 4203103 - DNA, 16 bp, Homo sapiens
gtattccatgggatgt

SEQ ID NO: 4203104 - DNA, 23 bp, Homo sapiens
gtattccttttgtgtacagtgtg

SEQ ID NO: 4203105 - DNA, 18 bp, Homo sapiens
gtattctaaagctttctg

SEQ ID NO: 4203106 - DNA, 19 bp, Homo sapiens
gtattctaaagctttctga

SEQ ID NO: 4203107 - DNA, 23 bp, Homo sapiens
gtatttatatttggaaagagacc

SEQ ID NO: 4203108 - DNA, 13 bp, Homo sapiens
gtatttcctgcta

SEQ ID NO: 4203109 - DNA, 14 bp, Homo sapiens
gtatttgaaactga

SEQ ID NO: 4203110 - DNA, 18 bp, Homo sapiens
gtatttgttaatttagaa

SEQ ID NO: 4203111 - DNA, 22 bp, Homo sapiens
gtatttgttaatttagaaaact

SEQ ID NO: 4203112 - DNA, 15 bp, Homo sapiens
gtattttaagcattc

SEQ ID NO: 4203113 - DNA, 20 bp, Homo sapiens
gtattttagtgaacttgaaa

SEQ ID NO: 4203114 - DNA, 14 bp, Homo sapiens
gtattttgagataa

SEQ ID NO: 4203115 - DNA, 17 bp, Homo sapiens
gtattttggagaaatta

SEQ ID NO: 4203116 - DNA, 18 bp, Homo sapiens
gtcaacaaaaagacatgg

SEQ ID NO: 4203117 - DNA, 19 bp, Homo sapiens
gtcaacaaaaagacatgga

SEQ ID NO: 4203118 - DNA, 15 bp, Homo sapiens
gtcaacacaaagaca

SEQ ID NO: 4203119 - DNA, 23 bp, Homo sapiens
gtcaacacaaagacacaggaaga

SEQ ID NO: 4203120 - DNA, 18 bp, Homo sapiens
gtcaacacaaagacatgg

SEQ ID NO: 4203121 - DNA, 17 bp, Homo sapiens
gtcaacactcttcttga

SEQ ID NO: 4203122 - DNA, 19 bp, Homo sapiens
gtcaacactcttcttgagc

SEQ ID NO: 4203123 - DNA, 17 bp, Homo sapiens
gtcaagatcaacattcc

SEQ ID NO: 4203124 - DNA, 19 bp, Homo sapiens
gtcaatcatgtgtttaaat

SEQ ID NO: 4203125 - DNA, 11 bp, Homo sapiens
gtcactgaaga

SEQ ID NO: 4203126 - DNA, 20 bp, Homo sapiens
gtcagacatccatgtttgta

SEQ ID NO: 4203127 - DNA, 16 bp, Homo sapiens
gtcagactgctgggac

SEQ ID NO: 4203128 - DNA, 14 bp, Homo sapiens
gtcagactggctgg

SEQ ID NO: 4203129 - DNA, 23 bp, Homo sapiens
gtcagagacagaccccttggctt

SEQ ID NO: 4203130 - DNA, 12 bp, Homo sapiens
gtcagagccact

SEQ ID NO: 4203131 - DNA, 13 bp, Homo sapiens
gtcagagccactc

SEQ ID NO: 4203132 - DNA, 17 bp, Homo sapiens
gtcagagccaggctctg

SEQ ID NO: 4203133 - DNA, 18 bp, Homo sapiens
gtcagagccaggctctgc

SEQ ID NO: 4203134 - DNA, 11 bp, Homo sapiens
gtcagccaggg

SEQ ID NO: 4203135 - DNA, 11 bp, Homo sapiens
gtcagcccttg

SEQ ID NO: 4203136 - DNA, 22 bp, Homo sapiens
gtcaggaaagacaggctgagct

SEQ ID NO: 4203137 - DNA, 23 bp, Homo sapiens
gtcagtgctgtgctgtgctatgg

SEQ ID NO: 4203138 - DNA, 15 bp, Homo sapiens
gtcagttgataaaag

SEQ ID NO: 4203139 - DNA, 15 bp, Homo sapiens
gtcatgaatgccttc

SEQ ID NO: 4203140 - DNA, 20 bp, Homo sapiens
gtcatgaattcttatgctta

SEQ ID NO: 4203141 - DNA, 14 bp, Homo sapiens
gtcatggacagata

SEQ ID NO: 4203142 - DNA, 24 bp, Homo sapiens
gtcatggttggtaaccatgtaggt

SEQ ID NO: 4203143 - DNA, 15 bp, Homo sapiens
gtcattaatgttctt

SEQ ID NO: 4203144 - DNA, 15 bp, Homo sapiens
gtccaacctgcctgt

SEQ ID NO: 4203145 - DNA, 14 bp, Homo sapiens
gtccaatcagagaa

SEQ ID NO: 4203146 - DNA, 21 bp, Homo sapiens
gtccaccagacccacctggag

SEQ ID NO: 4203147 - DNA, 15 bp, Homo sapiens
gtccacctgcctatc

SEQ ID NO: 4203148 - DNA, 11 bp, Homo sapiens
gtccagccctc

SEQ ID NO: 4203149 - DNA, 12 bp, Homo sapiens
gtccagccctcc

SEQ ID NO: 4203150 - DNA, 22 bp, Homo sapiens
gtccaggccagtgggcctggta

SEQ ID NO: 4203151 - DNA, 18 bp, Homo sapiens
gtccaggtcaccagcctg

SEQ ID NO: 4203152 - DNA, 23 bp, Homo sapiens
gtccaggtcaccagcctgactgc

SEQ ID NO: 4203153 - DNA, 19 bp, Homo sapiens
gtccatgtggttcttcaaa

SEQ ID NO: 4203154 - DNA, 16 bp, Homo sapiens
gtccattcatctcatg

SEQ ID NO: 4203155 - DNA, 17 bp, Homo sapiens
gtccattcatctcatgc

SEQ ID NO: 4203156 - DNA, 13 bp, Homo sapiens
gtccccacagcct

SEQ ID NO: 4203157 - DNA, 13 bp, Homo sapiens
gtccccagcattg

SEQ ID NO: 4203158 - DNA, 23 bp, Homo sapiens
gtcccgcttattctcctccctgt

SEQ ID NO: 4203159 - DNA, 15 bp, Homo sapiens
gtcccggagctcagg

SEQ ID NO: 4203160 - DNA, 14 bp, Homo sapiens
gtccctcggagctg

SEQ ID NO: 4203161 - DNA, 19 bp, Homo sapiens
gtccctcggagctgccagc

SEQ ID NO: 4203162 - DNA, 22 bp, Homo sapiens
gtccctcggagctgccagccgg

SEQ ID NO: 4203163 - DNA, 21 bp, Homo sapiens
gtccctctcggaaggctggct

SEQ ID NO: 4203164 - DNA, 17 bp, Homo sapiens
gtccctgactctctgtg

SEQ ID NO: 4203165 - DNA, 20 bp, Homo sapiens
gtccctgactctctgtgacc

SEQ ID NO: 4203166 - DNA, 18 bp, Homo sapiens
gtcccttgctgacatggc

SEQ ID NO: 4203167 - DNA, 22 bp, Homo sapiens
gtcccttggaaagttcagccag

SEQ ID NO: 4203168 - DNA, 13 bp, Homo sapiens
taaagtttacagt

SEQ ID NO: 4203169 - DNA, 23 bp, Homo sapiens
taaagtttacagtaaataaattg

SEQ ID NO: 4203170 - DNA, 18 bp, Homo sapiens
taaataaaaaattcaaac

SEQ ID NO: 4203171 - DNA, 20 bp, Homo sapiens
taaataaattgtttgaccat

SEQ ID NO: 4203172 - DNA, 15 bp, Homo sapiens
taaataagaaacttt

SEQ ID NO: 4203173 - DNA, 16 bp, Homo sapiens
taaataagaaactttt

SEQ ID NO: 4203174 - DNA, 20 bp, Homo sapiens
taaatacatcaaaaatgggt

SEQ ID NO: 4203175 - DNA, 17 bp, Homo sapiens
taaatactgatatttca

SEQ ID NO: 4203176 - DNA, 15 bp, Homo sapiens
taaatagcattctct

SEQ ID NO: 4203177 - DNA, 12 bp, Homo sapiens
taaatatgtgaa

SEQ ID NO: 4203178 - DNA, 13 bp, Homo sapiens
taaatatgtgaaa

SEQ ID NO: 4203179 - DNA, 21 bp, Homo sapiens
taaatattgacttctcttgaa

SEQ ID NO: 4203180 - DNA, 21 bp, Homo sapiens
taaatcacgctttttgaaaaa

SEQ ID NO: 4203181 - DNA, 13 bp, Homo sapiens
taaatcagaaata

SEQ ID NO: 4203182 - DNA, 18 bp, Homo sapiens
taaatctctaatatggca

SEQ ID NO: 4203183 - DNA, 13 bp, Homo sapiens
taaatcttttata

SEQ ID NO: 4203184 - DNA, 16 bp, Homo sapiens
taaatgcctcttaaat

SEQ ID NO: 4203185 - DNA, 17 bp, Homo sapiens
taaatgcctcttaaatt

SEQ ID NO: 4203186 - DNA, 12 bp, Homo sapiens
taaatgttcaaa

SEQ ID NO: 4203187 - DNA, 16 bp, Homo sapiens
taaatgttcaaactgt

SEQ ID NO: 4203188 - DNA, 13 bp, Homo sapiens
taaatgttttaca

SEQ ID NO: 4203189 - DNA, 21 bp, Homo sapiens
taaatgttttacaagaattgt

SEQ ID NO: 4203190 - DNA, 18 bp, Homo sapiens
taaattagagaaatggtt

SEQ ID NO: 4203191 - DNA, 16 bp, Homo sapiens
taaattataagatgtc

SEQ ID NO: 4203192 - DNA, 17 bp, Homo sapiens
taaattataagatgtca

SEQ ID NO: 4203193 - DNA, 17 bp, Homo sapiens
taaattatttccttttt

SEQ ID NO: 4203194 - DNA, 19 bp, Homo sapiens
taaattatttttaagaaat

SEQ ID NO: 4203195 - DNA, 20 bp, Homo sapiens
taaattcagatatatttttc

SEQ ID NO: 4203196 - DNA, 16 bp, Homo sapiens
taaattgaatacacaa

SEQ ID NO: 4203197 - DNA, 16 bp, Homo sapiens
taaattggaatttaaa

SEQ ID NO: 4203198 - DNA, 19 bp, Homo sapiens
taaattggaatttaaaaat

SEQ ID NO: 4203199 - DNA, 15 bp, Homo sapiens
taaattttgaatgtt

SEQ ID NO: 4203200 - DNA, 9 bp, Homo sapiens
taacaacaa

SEQ ID NO: 4203201 - DNA, 11 bp, Homo sapiens
taacaacaatg

SEQ ID NO: 4203202 - DNA, 23 bp, Homo sapiens
taacaacaatggtttacatgaac

SEQ ID NO: 4203203 - DNA, 17 bp, Homo sapiens
taacaaccaaccaacca

SEQ ID NO: 4203204 - DNA, 16 bp, Homo sapiens
taacaactatttttgt

SEQ ID NO: 4203205 - DNA, 17 bp, Homo sapiens
taacaataatatttcaa

SEQ ID NO: 4203206 - DNA, 24 bp, Homo sapiens
taacaataatatttcaagtgccta

SEQ ID NO: 4203207 - DNA, 15 bp, Homo sapiens
taacaatctaacaat

SEQ ID NO: 4203208 - DNA, 23 bp, Homo sapiens
taacacaagtcctgtgaatttct

SEQ ID NO: 4203209 - DNA, 18 bp, Homo sapiens
taacacataactagaaac

SEQ ID NO: 4203210 - DNA, 14 bp, Homo sapiens
taacacatgtcctt

SEQ ID NO: 4203211 - DNA, 13 bp, Homo sapiens
taacatatcttta

SEQ ID NO: 4203212 - DNA, 22 bp, Homo sapiens
taacatgaaaaacacggcagct

SEQ ID NO: 4203213 - DNA, 22 bp, Homo sapiens
taacatggaagatattcctttt

SEQ ID NO: 4203214 - DNA, 19 bp, Homo sapiens
taacatggaatttaattta

SEQ ID NO: 4203215 - DNA, 15 bp, Homo sapiens
taacattaacatcta

SEQ ID NO: 4203216 - DNA, 16 bp, Homo sapiens
taacattcacagccca

SEQ ID NO: 4203217 - DNA, 14 bp, Homo sapiens
taaccactcctcag

SEQ ID NO: 4203218 - DNA, 20 bp, Homo sapiens
taaccactcctcaggaacag

SEQ ID NO: 4203219 - DNA, 20 bp, Homo sapiens
taaccagacacatactcatt

SEQ ID NO: 4203220 - DNA, 19 bp, Homo sapiens
taacccccagtgccacaga

SEQ ID NO: 4203221 - DNA, 20 bp, Homo sapiens
taacccccagtgccacagag

SEQ ID NO: 4203222 - DNA, 14 bp, Homo sapiens
taaccctctcttcc

SEQ ID NO: 4203223 - DNA, 13 bp, Homo sapiens
taacctggcttat

SEQ ID NO: 4203224 - DNA, 17 bp, Homo sapiens
taacgccctatttttgc

SEQ ID NO: 4203225 - DNA, 20 bp, Homo sapiens
taacgccctatttttgcaat

SEQ ID NO: 4203226 - DNA, 17 bp, Homo sapiens
taacgtttaagccaaaa

SEQ ID NO: 4203227 - DNA, 21 bp, Homo sapiens
taactaaggtcccataataaa

SEQ ID NO: 4203228 - DNA, 22 bp, Homo sapiens
taactagtcctgcagaggattt

SEQ ID NO: 4203229 - DNA, 17 bp, Homo sapiens
taactcagacattccaa

SEQ ID NO: 4203230 - DNA, 15 bp, Homo sapiens
taactccccacccca

SEQ ID NO: 4203231 - DNA, 22 bp, Homo sapiens
taactctatagttattgtttta

SEQ ID NO: 4203232 - DNA, 20 bp, Homo sapiens
taactgaaaattatttaaac

SEQ ID NO: 4203233 - DNA, 19 bp, Homo sapiens
taactgattacctgccaat

SEQ ID NO: 4203234 - DNA, 16 bp, Homo sapiens
taactgtgaaatacca

SEQ ID NO: 4203235 - DNA, 15 bp, Homo sapiens
taacttctgaagtaa

SEQ ID NO: 4203236 - DNA, 22 bp, Homo sapiens
taacttgttttgacttgaataa

SEQ ID NO: 4203237 - DNA, 23 bp, Homo sapiens
taagaaacctactgcccaggcac

SEQ ID NO: 4203238 - DNA, 13 bp, Homo sapiens
taagaagaaagca

SEQ ID NO: 4203239 - DNA, 14 bp, Homo sapiens
taagaagaaagcaa

SEQ ID NO: 4203240 - DNA, 20 bp, Homo sapiens
taagagaagtagaaatcata

SEQ ID NO: 4203241 - DNA, 14 bp, Homo sapiens
taagagcaataaat

SEQ ID NO: 4203242 - DNA, 22 bp, Homo sapiens
taagaggctatttaaaagtata

SEQ ID NO: 4203243 - DNA, 14 bp, Homo sapiens
taagatctgaaagt

SEQ ID NO: 4203244 - DNA, 18 bp, Homo sapiens
taagatgggcagctagtt

SEQ ID NO: 4203245 - DNA, 13 bp, Homo sapiens
taagattaaagga

SEQ ID NO: 4203246 - DNA, 16 bp, Homo sapiens
taagcaaaggaaacca

SEQ ID NO: 4203247 - DNA, 18 bp, Homo sapiens
taagcaaaggaaaccaaa

SEQ ID NO: 4203248 - DNA, 23 bp, Homo sapiens
taagcaccataaccaagaaatac

SEQ ID NO: 4203249 - DNA, 21 bp, Homo sapiens
taagcaggaaggatggcaagc

SEQ ID NO: 4203250 - DNA, 16 bp, Homo sapiens
taagcattcttagact

SEQ ID NO: 4203251 - DNA, 23 bp, Homo sapiens
taagcattcttagactagttgaa

SEQ ID NO: 4203252 - DNA, 22 bp, Homo sapiens
taagcattgaatggctatgttt

SEQ ID NO: 4203253 - DNA, 16 bp, Homo sapiens
taagccaaaacaatgt

SEQ ID NO: 4203254 - DNA, 22 bp, Homo sapiens
taagccacaagaaatttgattt

SEQ ID NO: 4203255 - DNA, 12 bp, Homo sapiens
taagctgtgtgc

SEQ ID NO: 4203256 - DNA, 14 bp, Homo sapiens
taagctgtgtgcag

SEQ ID NO: 4203257 - DNA, 19 bp, Homo sapiens
taaggacaaagaaggaaat

SEQ ID NO: 4203258 - DNA, 16 bp, Homo sapiens
taaggatttgttcaca

SEQ ID NO: 4203259 - DNA, 17 bp, Homo sapiens
taaggcatgttgggata

SEQ ID NO: 4203260 - DNA, 16 bp, Homo sapiens
taagggccgccggacc

SEQ ID NO: 4203261 - DNA, 18 bp, Homo sapiens
taaggtacaagaagcatt

SEQ ID NO: 4203262 - DNA, 13 bp, Homo sapiens
taaggtgtagcca

SEQ ID NO: 4203263 - DNA, 21 bp, Homo sapiens
taaggtgtagccacaccagga

SEQ ID NO: 4203264 - DNA, 14 bp, Homo sapiens
taagtaaacaacat

SEQ ID NO: 4203265 - DNA, 18 bp, Homo sapiens
taagtaccactcaggcca

SEQ ID NO: 4203266 - DNA, 21 bp, Homo sapiens
taagtgataaatctagaaaat

SEQ ID NO: 4203267 - DNA, 22 bp, Homo sapiens
taagtgataaatctagaaaatt

SEQ ID NO: 4203268 - DNA, 16 bp, Homo sapiens
taagtggcaggaccct

SEQ ID NO: 4203269 - DNA, 15 bp, Homo sapiens
taagtgtttgaaaac

SEQ ID NO: 4203270 - DNA, 15 bp, Homo sapiens
taagttatgtacgta

SEQ ID NO: 4203271 - DNA, 16 bp, Homo sapiens
taagtttgatcaaatc

SEQ ID NO: 4203272 - DNA, 19 bp, Homo sapiens
taataaaagtactgaagac

SEQ ID NO: 4203273 - DNA, 22 bp, Homo sapiens
taataaaggtcacataaacttt

SEQ ID NO: 4203274 - DNA, 15 bp, Homo sapiens
taataaattcagata

SEQ ID NO: 4203275 - DNA, 19 bp, Homo sapiens
taataaattttaacatttt

SEQ ID NO: 4203276 - DNA, 19 bp, Homo sapiens
taataagaatggttgcctt

SEQ ID NO: 4203277 - DNA, 15 bp, Homo sapiens
taataagtttgatca

SEQ ID NO: 4203278 - DNA, 21 bp, Homo sapiens
taataagtttgatcaaatcta

SEQ ID NO: 4203279 - DNA, 22 bp, Homo sapiens
taatacactaattcctttctat

SEQ ID NO: 4203280 - DNA, 20 bp, Homo sapiens
taatacattccaactcgtat

SEQ ID NO: 4203281 - DNA, 23 bp, Homo sapiens
taatactttttacccaaatatgt

SEQ ID NO: 4203282 - DNA, 15 bp, Homo sapiens
taatagaaaactgaa

SEQ ID NO: 4203283 - DNA, 16 bp, Homo sapiens
taatagatgtttgata

SEQ ID NO: 4203284 - DNA, 21 bp, Homo sapiens
taatagatgtttgatagattt

SEQ ID NO: 4203285 - DNA, 22 bp, Homo sapiens
taatagcgggttactttcacat

SEQ ID NO: 4203286 - DNA, 22 bp, Homo sapiens
taatatatttttatatttagtt

SEQ ID NO: 4203287 - DNA, 12 bp, Homo sapiens
taatatcctaaa

SEQ ID NO: 4203288 - DNA, 14 bp, Homo sapiens
taatatcctaaaca

SEQ ID NO: 4203289 - DNA, 16 bp, Homo sapiens
taatatggcaaaaatg

SEQ ID NO: 4203290 - DNA, 20 bp, Homo sapiens
taatatgtctgccacagaga

SEQ ID NO: 4203291 - DNA, 22 bp, Homo sapiens
taatattaaaaatatggaactt

SEQ ID NO: 4203292 - DNA, 18 bp, Homo sapiens
taatatttcaagtgccta

SEQ ID NO: 4203293 - DNA, 15 bp, Homo sapiens
taatcagcctcttaa

SEQ ID NO: 4203294 - DNA, 15 bp, Homo sapiens
taatcaggctgaggt

SEQ ID NO: 4203295 - DNA, 16 bp, Homo sapiens
taatcccacccacctc

SEQ ID NO: 4203296 - DNA, 22 bp, Homo sapiens
taatcctcaacaacaaaccaaa

SEQ ID NO: 4203297 - DNA, 18 bp, Homo sapiens
taatcgagtctacctctt

SEQ ID NO: 4203298 - DNA, 13 bp, Homo sapiens
taatgaaacaaag

SEQ ID NO: 4203299 - DNA, 17 bp, Homo sapiens
taatgattatatgacaa

SEQ ID NO: 4203300 - DNA, 19 bp, Homo sapiens
taatgcttagagaatgttc

SEQ ID NO: 4203301 - DNA, 15 bp, Homo sapiens
taatggcatgagaaa

SEQ ID NO: 4203302 - DNA, 14 bp, Homo sapiens
tatttatatatttg

SEQ ID NO: 4203303 - DNA, 16 bp, Homo sapiens
tatttatatatttgaa

SEQ ID NO: 4203304 - DNA, 14 bp, Homo sapiens
tatttatatttgga

SEQ ID NO: 4203305 - DNA, 21 bp, Homo sapiens
tatttatatttggaaagagac

SEQ ID NO: 4203306 - DNA, 13 bp, Homo sapiens
tatttatgtaaaa

SEQ ID NO: 4203307 - DNA, 13 bp, Homo sapiens
tatttcaaaataa

SEQ ID NO: 4203308 - DNA, 15 bp, Homo sapiens
tatttcacaattata

SEQ ID NO: 4203309 - DNA, 22 bp, Homo sapiens
tatttcacaattatatttttgt

SEQ ID NO: 4203310 - DNA, 18 bp, Homo sapiens
tatttccaaacctggttc

SEQ ID NO: 4203311 - DNA, 14 bp, Homo sapiens
tatttcctgctaca

SEQ ID NO: 4203312 - DNA, 19 bp, Homo sapiens
tatttcctttttctagttt

SEQ ID NO: 4203313 - DNA, 16 bp, Homo sapiens
tatttcttaaacactt

SEQ ID NO: 4203314 - DNA, 12 bp, Homo sapiens
tatttgaaattt

SEQ ID NO: 4203315 - DNA, 15 bp, Homo sapiens
tatttgaatatcatt

SEQ ID NO: 4203316 - DNA, 16 bp, Homo sapiens
tatttgaatatcatta

SEQ ID NO: 4203317 - DNA, 12 bp, Homo sapiens
tatttggaaaga

SEQ ID NO: 4203318 - DNA, 23 bp, Homo sapiens
tatttggggtttgcttgtaaaac

SEQ ID NO: 4203319 - DNA, 13 bp, Homo sapiens
tattttaaagaat

SEQ ID NO: 4203320 - DNA, 13 bp, Homo sapiens
tattttaaatgtt

SEQ ID NO: 4203321 - DNA, 19 bp, Homo sapiens
tattttattctatgtatgt

SEQ ID NO: 4203322 - DNA, 19 bp, Homo sapiens
tattttgaactaatttctt

SEQ ID NO: 4203323 - DNA, 22 bp, Homo sapiens
tatttttgaaaggcatgttcct

SEQ ID NO: 4203324 - DNA, 19 bp, Homo sapiens
tatttttgaacccctgtgt

SEQ ID NO: 4203325 - DNA, 22 bp, Homo sapiens
tatttttgagcaggagcagaaa

SEQ ID NO: 4203326 - DNA, 22 bp, Homo sapiens
tatttttgttgttgttgtttgt

SEQ ID NO: 4203327 - DNA, 18 bp, Homo sapiens
tattttttaaaataattt

SEQ ID NO: 4203328 - DNA, 18 bp, Homo sapiens
tcaaaagcaaatgagatc

SEQ ID NO: 4203329 - DNA, 14 bp, Homo sapiens
tcaaacacacaaac

SEQ ID NO: 4203330 - DNA, 16 bp, Homo sapiens
tcaaacagaattttaa

SEQ ID NO: 4203331 - DNA, 13 bp, Homo sapiens
tcaaaccaggatt

SEQ ID NO: 4203332 - DNA, 14 bp, Homo sapiens
tcaaaccaggattt

SEQ ID NO: 4203333 - DNA, 20 bp, Homo sapiens
tcaaaccgcactcacccatg

SEQ ID NO: 4203334 - DNA, 19 bp, Homo sapiens
tcaaactaggaggaaaaga

SEQ ID NO: 4203335 - DNA, 22 bp, Homo sapiens
tcaaactaggaggaaaagacag

SEQ ID NO: 4203336 - DNA, 15 bp, Homo sapiens
tcaaacttgtgctga

SEQ ID NO: 4203337 - DNA, 20 bp, Homo sapiens
tcaaacttgtgctgagaata

SEQ ID NO: 4203338 - DNA, 15 bp, Homo sapiens
tcaaagaaaacatag

SEQ ID NO: 4203339 - DNA, 12 bp, Homo sapiens
tcaaagaaatgc

SEQ ID NO: 4203340 - DNA, 16 bp, Homo sapiens
tcaaagagaaaactta

SEQ ID NO: 4203341 - DNA, 21 bp, Homo sapiens
tcaaagcaagcattcagaaga

SEQ ID NO: 4203342 - DNA, 13 bp, Homo sapiens
tcaaagcacctga

SEQ ID NO: 4203343 - DNA, 13 bp, Homo sapiens
tcaaagtttaata

SEQ ID NO: 4203344 - DNA, 15 bp, Homo sapiens
tcaaatattaccaaa

SEQ ID NO: 4203345 - DNA, 16 bp, Homo sapiens
tcaaatattaccaaaa

SEQ ID NO: 4203346 - DNA, 17 bp, Homo sapiens
tcaaatccactgacaga

SEQ ID NO: 4203347 - DNA, 17 bp, Homo sapiens
tcaaatccttgagcact

SEQ ID NO: 4203348 - DNA, 15 bp, Homo sapiens
tcaaatgaacacgtg

SEQ ID NO: 4203349 - DNA, 12 bp, Homo sapiens
tcaacaaaaaga

SEQ ID NO: 4203350 - DNA, 15 bp, Homo sapiens
tcaacaaaaagacat

SEQ ID NO: 4203351 - DNA, 19 bp, Homo sapiens
tcaacaaaaagacatggaa

SEQ ID NO: 4203352 - DNA, 17 bp, Homo sapiens
tcaacaataaagactga

SEQ ID NO: 4203353 - DNA, 15 bp, Homo sapiens
tcaacaattctaaaa

SEQ ID NO: 4203354 - DNA, 13 bp, Homo sapiens
tcaacacaaagac

SEQ ID NO: 4203355 - DNA, 21 bp, Homo sapiens
tcaacactcttcttgagcaga

SEQ ID NO: 4203356 - DNA, 18 bp, Homo sapiens
tcaacagtgaagacagaa

SEQ ID NO: 4203357 - DNA, 17 bp, Homo sapiens
tcaacagttttcctatg

SEQ ID NO: 4203358 - DNA, 22 bp, Homo sapiens
tcaacagttttcctatgctttg

SEQ ID NO: 4203359 - DNA, 13 bp, Homo sapiens
tcaacatatcatt

SEQ ID NO: 4203360 - DNA, 15 bp, Homo sapiens
tcaacatatcatttt

SEQ ID NO: 4203361 - DNA, 15 bp, Homo sapiens
tcaacatctaagcct

SEQ ID NO: 4203362 - DNA, 19 bp, Homo sapiens
tcaacattcaaagcagcag

SEQ ID NO: 4203363 - DNA, 12 bp, Homo sapiens
tcaactccagaa

SEQ ID NO: 4203364 - DNA, 13 bp, Homo sapiens
tcaactttatgta

SEQ ID NO: 4203365 - DNA, 22 bp, Homo sapiens
tcaactttcttttgattagtgt

SEQ ID NO: 4203366 - DNA, 17 bp, Homo sapiens
tcaagaaataagttttt

SEQ ID NO: 4203367 - DNA, 20 bp, Homo sapiens
tcaagaagactatggtcctg

SEQ ID NO: 4203368 - DNA, 14 bp, Homo sapiens
tcaagaatgagaaa

SEQ ID NO: 4203369 - DNA, 14 bp, Homo sapiens
tcaagactgatcat

SEQ ID NO: 4203370 - DNA, 16 bp, Homo sapiens
tcaagatacatagtaa

SEQ ID NO: 4203371 - DNA, 15 bp, Homo sapiens
tcaagatcaacattc

SEQ ID NO: 4203372 - DNA, 16 bp, Homo sapiens
tcaagatcaacattcc

SEQ ID NO: 4203373 - DNA, 17 bp, Homo sapiens
tcaagatttcaggatta

SEQ ID NO: 4203374 - DNA, 17 bp, Homo sapiens
tcaagcctgcagcgagc

SEQ ID NO: 4203375 - DNA, 19 bp, Homo sapiens
tcaagcctgcagcgagctg

SEQ ID NO: 4203376 - DNA, 21 bp, Homo sapiens
tcaaggaaaaatgctgcttct

SEQ ID NO: 4203377 - DNA, 14 bp, Homo sapiens
tcaaggaatcggct

SEQ ID NO: 4203378 - DNA, 16 bp, Homo sapiens
tcaaggcggtgcttga

SEQ ID NO: 4203379 - DNA, 14 bp, Homo sapiens
tcaaggtctgcttt

SEQ ID NO: 4203380 - DNA, 15 bp, Homo sapiens
tcaaggtctgctttt

SEQ ID NO: 4203381 - DNA, 19 bp, Homo sapiens
tcaagtaccaccaagggat

SEQ ID NO: 4203382 - DNA, 22 bp, Homo sapiens
tcaagtaccaccaagggatctg

SEQ ID NO: 4203383 - DNA, 18 bp, Homo sapiens
tcaagtgcctagactgtt

SEQ ID NO: 4203384 - DNA, 21 bp, Homo sapiens
tcaataaaaatctttgattca

SEQ ID NO: 4203385 - DNA, 12 bp, Homo sapiens
tcaataatattg

SEQ ID NO: 4203386 - DNA, 21 bp, Homo sapiens
tcaataccccaagtccacctg

SEQ ID NO: 4203387 - DNA, 19 bp, Homo sapiens
tcaatagtaaaagataaca

SEQ ID NO: 4203388 - DNA, 13 bp, Homo sapiens
tcaatatgcttac

SEQ ID NO: 4203389 - DNA, 16 bp, Homo sapiens
tcaatattcaataaag

SEQ ID NO: 4203390 - DNA, 19 bp, Homo sapiens
tcaatcagtctcagaatgt

SEQ ID NO: 4203391 - DNA, 20 bp, Homo sapiens
tcaatcatctgtgtgaaaat

SEQ ID NO: 4203392 - DNA, 16 bp, Homo sapiens
tcaatctgtttttcat

SEQ ID NO: 4203393 - DNA, 15 bp, Homo sapiens
tcaatggacttcaaa

SEQ ID NO: 4203394 - DNA, 18 bp, Homo sapiens
tcaatgttcagttttcct

SEQ ID NO: 4203395 - DNA, 22 bp, Homo sapiens
tcaattcaaagctgtgtgtttg

SEQ ID NO: 4203396 - DNA, 12 bp, Homo sapiens
tcaattctcaaa

SEQ ID NO: 4203397 - DNA, 17 bp, Homo sapiens
tcacaaaacctggcaca

SEQ ID NO: 4203398 - DNA, 21 bp, Homo sapiens
tcacaaaacctggcacaatgg

SEQ ID NO: 4203399 - DNA, 14 bp, Homo sapiens
tcacaacagcctga

SEQ ID NO: 4203400 - DNA, 18 bp, Homo sapiens
tcacaattatatttttgt

SEQ ID NO: 4203401 - DNA, 22 bp, Homo sapiens
tcacacccaacttggttttgct

SEQ ID NO: 4203402 - DNA, 13 bp, Homo sapiens
tcacactctgggt

SEQ ID NO: 4203403 - DNA, 11 bp, Homo sapiens
tcacagcccag

SEQ ID NO: 4203404 - DNA, 19 bp, Homo sapiens
tcacagcccagaaccacag

SEQ ID NO: 4203405 - DNA, 15 bp, Homo sapiens
tcacagcctctccct

SEQ ID NO: 4203406 - DNA, 19 bp, Homo sapiens
tcacagggcagagccggga

SEQ ID NO: 4203407 - DNA, 14 bp, Homo sapiens
tcacagtgtttgca

SEQ ID NO: 4203408 - DNA, 23 bp, Homo sapiens
tcacagtgtttgcaatggtgttg

SEQ ID NO: 4203409 - DNA, 22 bp, Homo sapiens
tcacagttaccctaaactctct

SEQ ID NO: 4203410 - DNA, 13 bp, Homo sapiens
tcacagttgacaa

SEQ ID NO: 4203411 - DNA, 13 bp, Homo sapiens
tcacatacactca

SEQ ID NO: 4203412 - DNA, 17 bp, Homo sapiens
tcacatgtttatatttg

SEQ ID NO: 4203413 - DNA, 12 bp, Homo sapiens
tcaccacaaact

SEQ ID NO: 4203414 - DNA, 12 bp, Homo sapiens
tcaccagcctga

SEQ ID NO: 4203415 - DNA, 15 bp, Homo sapiens
tcaccatgatttaat

SEQ ID NO: 4203416 - DNA, 19 bp, Homo sapiens
tcacccaagcaaggccaaa

SEQ ID NO: 4203417 - DNA, 13 bp, Homo sapiens
tcaccctgcagag

SEQ ID NO: 4203418 - DNA, 15 bp, Homo sapiens
tcaccctgcagagct

SEQ ID NO: 4203419 - DNA, 23 bp, Homo sapiens
tcaccctgcagagctatggtgag

SEQ ID NO: 4203420 - DNA, 22 bp, Homo sapiens
tcaccgagacggctggacctgc

SEQ ID NO: 4203421 - DNA, 23 bp, Homo sapiens
tcacctctctctaagtttagaag

SEQ ID NO: 4203422 - DNA, 13 bp, Homo sapiens
tcacctctggctt

SEQ ID NO: 4203423 - DNA, 19 bp, Homo sapiens
tcacctctggctttgtctc

SEQ ID NO: 4203424 - DNA, 19 bp, Homo sapiens
tcaccttgccgagagaggc

SEQ ID NO: 4203425 - DNA, 20 bp, Homo sapiens
tcaccttgccgagagaggcg

SEQ ID NO: 4203426 - DNA, 23 bp, Homo sapiens
tcacgatgaaattgaacctggtt

SEQ ID NO: 4203427 - DNA, 14 bp, Homo sapiens
tcacgccactgcac

SEQ ID NO: 4203428 - DNA, 19 bp, Homo sapiens
tcacgcctatgatcccagc

SEQ ID NO: 4203429 - DNA, 16 bp, Homo sapiens
tcactaaagggtgccc

SEQ ID NO: 4203430 - DNA, 22 bp, Homo sapiens
tcactacctttatagctcatca

SEQ ID NO: 4203431 - DNA, 23 bp, Homo sapiens
tcactacctttatagctctcatc

SEQ ID NO: 4203432 - DNA, 17 bp, Homo sapiens
tcactagatggcgagca

SEQ ID NO: 4203433 - DNA, 18 bp, Homo sapiens
tcactattcaagtattag

SEQ ID NO: 4203434 - DNA, 12 bp, Homo sapiens
tcactcaaggcg

SEQ ID NO: 4203435 - DNA, 17 bp, Homo sapiens
tcactccggtgtgcctg

SEQ ID NO: 4203436 - DNA, 20 bp, Homo sapiens
tcactccggtgtgcctgcag

SEQ ID NO: 4203437 - DNA, 21 bp, Homo sapiens
tcactccggtgtgcctgcagc

SEQ ID NO: 4203438 - DNA, 22 bp, Homo sapiens
tccaaacctggttcatatttat

SEQ ID NO: 4203439 - DNA, 23 bp, Homo sapiens
tccaacttggctgcaggaatctt

SEQ ID NO: 4203440 - DNA, 21 bp, Homo sapiens
tccaagagctacataatttag

SEQ ID NO: 4203441 - DNA, 12 bp, Homo sapiens
tccaaggagttc

SEQ ID NO: 4203442 - DNA, 18 bp, Homo sapiens
tccaaggtgctctgtgtc

SEQ ID NO: 4203443 - DNA, 15 bp, Homo sapiens
tccaagtcaacactc

SEQ ID NO: 4203444 - DNA, 22 bp, Homo sapiens
tccaagtcaacactcttcttga

SEQ ID NO: 4203445 - DNA, 18 bp, Homo sapiens
tccaagtccaacctgcct

SEQ ID NO: 4203446 - DNA, 22 bp, Homo sapiens
tccaagttcctgcactccagaa

SEQ ID NO: 4203447 - DNA, 14 bp, Homo sapiens
tccaatcagagaat

SEQ ID NO: 4203448 - DNA, 18 bp, Homo sapiens
tccaatggagttcagaga

SEQ ID NO: 4203449 - DNA, 20 bp, Homo sapiens
tccacaaagccgtgcctttc

SEQ ID NO: 4203450 - DNA, 13 bp, Homo sapiens
tccacaaatatga

SEQ ID NO: 4203451 - DNA, 14 bp, Homo sapiens
tccacacacgcagg

SEQ ID NO: 4203452 - DNA, 20 bp, Homo sapiens
tccacagtgcccagctaatt

SEQ ID NO: 4203453 - DNA, 18 bp, Homo sapiens
tccacatctttaagtatt

SEQ ID NO: 4203454 - DNA, 12 bp, Homo sapiens
tccacccactgt

SEQ ID NO: 4203455 - DNA, 13 bp, Homo sapiens
tccacccatgttt

SEQ ID NO: 4203456 - DNA, 20 bp, Homo sapiens
tccaccccctccagctccag

SEQ ID NO: 4203457 - DNA, 17 bp, Homo sapiens
tccaccgcagaaggaag

SEQ ID NO: 4203458 - DNA, 16 bp, Homo sapiens
tccacgcacacatgga

SEQ ID NO: 4203459 - DNA, 12 bp, Homo sapiens
tccactcatgcc

SEQ ID NO: 4203460 - DNA, 17 bp, Homo sapiens
tccactccacctccacc

SEQ ID NO: 4203461 - DNA, 23 bp, Homo sapiens
tccactccatatttatttaaaca

SEQ ID NO: 4203462 - DNA, 17 bp, Homo sapiens
tccactggacttgagct

SEQ ID NO: 4203463 - DNA, 18 bp, Homo sapiens
tccagaaaaccccagcat

SEQ ID NO: 4203464 - DNA, 24 bp, Homo sapiens
tccagaatccacaaagccgtgcct

SEQ ID NO: 4203465 - DNA, 12 bp, Homo sapiens
tccagagacagg

SEQ ID NO: 4203466 - DNA, 17 bp, Homo sapiens
tccagagacaggaaaga

SEQ ID NO: 4203467 - DNA, 18 bp, Homo sapiens
tccagagacaggaaagaa

SEQ ID NO: 4203468 - DNA, 21 bp, Homo sapiens
tccagagagaggatgcagagg

SEQ ID NO: 4203469 - DNA, 17 bp, Homo sapiens
tccagagagcaaacata

SEQ ID NO: 4203470 - DNA, 14 bp, Homo sapiens
tccagatgccttcc

SEQ ID NO: 4203471 - DNA, 15 bp, Homo sapiens
tccagcacaactcag

SEQ ID NO: 4203472 - DNA, 20 bp, Homo sapiens
tccagcacaactcagtctgt

SEQ ID NO: 4203473 - DNA, 18 bp, Homo sapiens
tccagcctgggcgacaga

SEQ ID NO: 4203474 - DNA, 21 bp, Homo sapiens
tccagcctgggcgacagagca

SEQ ID NO: 4203475 - DNA, 19 bp, Homo sapiens
tccagcctggggtgataga

SEQ ID NO: 4203476 - DNA, 14 bp, Homo sapiens
tccagcgcggctcc

SEQ ID NO: 4203477 - DNA, 10 bp, Homo sapiens
tccagctcca

SEQ ID NO: 4203478 - DNA, 19 bp, Homo sapiens
tccaggatctttgactgaa

SEQ ID NO: 4203479 - DNA, 19 bp, Homo sapiens
tccaggtccggaggggttg

SEQ ID NO: 4203480 - DNA, 15 bp, Homo sapiens
tccaggtggcaggat

SEQ ID NO: 4203481 - DNA, 13 bp, Homo sapiens
tccagtattcttg

SEQ ID NO: 4203482 - DNA, 13 bp, Homo sapiens
tccagtgctggat

SEQ ID NO: 4203483 - DNA, 21 bp, Homo sapiens
tccagtttagcccttccctgc

SEQ ID NO: 4203484 - DNA, 16 bp, Homo sapiens
tccagtttcagaagca

SEQ ID NO: 4203485 - DNA, 14 bp, Homo sapiens
tccagtttcccacc

SEQ ID NO: 4203486 - DNA, 21 bp, Homo sapiens
tccataagcaagtgagcagat

SEQ ID NO: 4203487 - DNA, 15 bp, Homo sapiens
tccatacagtcaaga

SEQ ID NO: 4203488 - DNA, 16 bp, Homo sapiens
tccatatgctccagga

SEQ ID NO: 4203489 - DNA, 14 bp, Homo sapiens
tccatccccaaact

SEQ ID NO: 4203490 - DNA, 17 bp, Homo sapiens
tccatgaagacacgctt

SEQ ID NO: 4203491 - DNA, 23 bp, Homo sapiens
tccatgaagaccacatccacaca

SEQ ID NO: 4203492 - DNA, 13 bp, Homo sapiens
tccatggctctgt

SEQ ID NO: 4203493 - DNA, 23 bp, Homo sapiens
tccatggctctgttatgcaagca

SEQ ID NO: 4203494 - DNA, 21 bp, Homo sapiens
tccatgtgcttccctaggctg

SEQ ID NO: 4203495 - DNA, 18 bp, Homo sapiens
tccatgtggttcttcaaa

SEQ ID NO: 4203496 - DNA, 14 bp, Homo sapiens
tccattcatctcat

SEQ ID NO: 4203497 - DNA, 15 bp, Homo sapiens
tccatttcaactcca

SEQ ID NO: 4203498 - DNA, 20 bp, Homo sapiens
tccatttcaactccagaagt

SEQ ID NO: 4203499 - DNA, 18 bp, Homo sapiens
tccatttggacaaaatgg

SEQ ID NO: 4203500 - DNA, 15 bp, Homo sapiens
tcccaacctcccctg

SEQ ID NO: 4203501 - DNA, 23 bp, Homo sapiens
tcccaacctcccctggtcctgca

SEQ ID NO: 4203502 - DNA, 14 bp, Homo sapiens
tcccaatatgtagc

SEQ ID NO: 4203503 - DNA, 18 bp, Homo sapiens
tcccacactggtgactgc

SEQ ID NO: 4203504 - DNA, 18 bp, Homo sapiens
tcccaccaaggtcttcag

SEQ ID NO: 4203505 - DNA, 23 bp, Homo sapiens
tcccacgactgttgtacaagctc

SEQ ID NO: 4203506 - DNA, 24 bp, Homo sapiens
tcccacgactgttgtacaagctca

SEQ ID NO: 4203507 - DNA, 18 bp, Homo sapiens
tcccactaagctttctcc

SEQ ID NO: 4203508 - DNA, 22 bp, Homo sapiens
tcccagaggccaggaatctgcc

SEQ ID NO: 4203509 - DNA, 16 bp, Homo sapiens
tcccagccactcggga

SEQ ID NO: 4203510 - DNA, 22 bp, Homo sapiens
tcccagccactcgggaggctga

SEQ ID NO: 4203511 - DNA, 16 bp, Homo sapiens
tcccagcgtgtgtatc

SEQ ID NO: 4203512 - DNA, 17 bp, Homo sapiens
tcccagctacccaggag

SEQ ID NO: 4203513 - DNA, 19 bp, Homo sapiens
tcccagctacccaggaggc

SEQ ID NO: 4203514 - DNA, 21 bp, Homo sapiens
tcccagctactcagaagcctg

SEQ ID NO: 4203515 - DNA, 23 bp, Homo sapiens
tcccagctactcagaagcctgag

SEQ ID NO: 4203516 - DNA, 21 bp, Homo sapiens
tcccataattgctttgccaaa

SEQ ID NO: 4203517 - DNA, 14 bp, Homo sapiens
tcccatgatccaga

SEQ ID NO: 4203518 - DNA, 16 bp, Homo sapiens
tcccatgatccagaac

SEQ ID NO: 4203519 - DNA, 20 bp, Homo sapiens
tccccaaactgtgccctgcc

SEQ ID NO: 4203520 - DNA, 21 bp, Homo sapiens
tccccacagtcctcacagcct

SEQ ID NO: 4203521 - DNA, 15 bp, Homo sapiens
tccccacctcttcct

SEQ ID NO: 4203522 - DNA, 17 bp, Homo sapiens
tccccacctcttccttc

SEQ ID NO: 4203523 - DNA, 23 bp, Homo sapiens
tccccaccttcaattcctgggcc

SEQ ID NO: 4203524 - DNA, 15 bp, Homo sapiens
tccccagccctttgc

SEQ ID NO: 4203525 - DNA, 16 bp, Homo sapiens
tccccaggagctctct

SEQ ID NO: 4203526 - DNA, 18 bp, Homo sapiens
tccccaggagctctctgc

SEQ ID NO: 4203527 - DNA, 12 bp, Homo sapiens
tccccaggccag

SEQ ID NO: 4203528 - DNA, 19 bp, Homo sapiens
tccccattagagtcagcct

SEQ ID NO: 4203529 - DNA, 21 bp, Homo sapiens
tccccattagagtcagccttc

SEQ ID NO: 4203530 - DNA, 16 bp, Homo sapiens
tcccccccctgtatag

SEQ ID NO: 4203531 - DNA, 10 bp, Homo sapiens
tccccctggg

SEQ ID NO: 4203532 - DNA, 22 bp, Homo sapiens
tccccctgggctctgccccagc

SEQ ID NO: 4203533 - DNA, 19 bp, Homo sapiens
tccccgcctgtcctgcctc

SEQ ID NO: 4203534 - DNA, 15 bp, Homo sapiens
tccccgggggaggaa

SEQ ID NO: 4203535 - DNA, 18 bp, Homo sapiens
tcccctccctcttccttc

SEQ ID NO: 4203536 - DNA, 19 bp, Homo sapiens
tcccctcgtgtgactctct

SEQ ID NO: 4203537 - DNA, 12 bp, Homo sapiens
tcccctgccctg

SEQ ID NO: 4203538 - DNA, 23 bp, Homo sapiens
tcccctgccctgctgccgcctcc

SEQ ID NO: 4203539 - DNA, 15 bp, Homo sapiens
tcccctgggcctgga

SEQ ID NO: 4203540 - DNA, 14 bp, Homo sapiens
tcccctggtcctgc

SEQ ID NO: 4203541 - DNA, 13 bp, Homo sapiens
tcccctttcctcc

SEQ ID NO: 4203542 - DNA, 19 bp, Homo sapiens
tcccgagcaaagtctaaag

SEQ ID NO: 4203543 - DNA, 21 bp, Homo sapiens
tcccgagctactctcttgcca

SEQ ID NO: 4203544 - DNA, 18 bp, Homo sapiens
tcccgagggagctgctgg

SEQ ID NO: 4203545 - DNA, 16 bp, Homo sapiens
tcccggttcaccttgc

SEQ ID NO: 4203546 - DNA, 15 bp, Homo sapiens
tccctacttttcaag

SEQ ID NO: 4203547 - DNA, 20 bp, Homo sapiens
tccctagctgaggatgacag

SEQ ID NO: 4203548 - DNA, 14 bp, Homo sapiens
tccctatactgctt

SEQ ID NO: 4203549 - DNA, 22 bp, Homo sapiens
tccctccagggaatccgcctgc

SEQ ID NO: 4203550 - DNA, 15 bp, Homo sapiens
tccctccatccggct

SEQ ID NO: 4203551 - DNA, 19 bp, Homo sapiens
tccctccatccggctcctg

SEQ ID NO: 4203552 - DNA, 22 bp, Homo sapiens
tccctccccacagtcctcacag

SEQ ID NO: 4203553 - DNA, 18 bp, Homo sapiens
tccctcctggagcatccc

SEQ ID NO: 4203554 - DNA, 13 bp, Homo sapiens
tccctccttccct

SEQ ID NO: 4203555 - DNA, 18 bp, Homo sapiens
tccctccttcccttctct

SEQ ID NO: 4203556 - DNA, 22 bp, Homo sapiens
tccctctcggaaggctggctgg

SEQ ID NO: 4203557 - DNA, 23 bp, Homo sapiens
tccctctcggaaggctggctggg

SEQ ID NO: 4203558 - DNA, 13 bp, Homo sapiens
tccctctgacctg

SEQ ID NO: 4203559 - DNA, 21 bp, Homo sapiens
tccctctgagaattccaagga

SEQ ID NO: 4203560 - DNA, 18 bp, Homo sapiens
tccctctgatttttcctt

SEQ ID NO: 4203561 - DNA, 15 bp, Homo sapiens
tccctcttccttccc

SEQ ID NO: 4203562 - DNA, 17 bp, Homo sapiens
tccctctttccccacct

SEQ ID NO: 4203563 - DNA, 18 bp, Homo sapiens
tccctctttccccacctc

SEQ ID NO: 4203564 - DNA, 19 bp, Homo sapiens
tccctctttccccacctct

SEQ ID NO: 4203565 - DNA, 16 bp, Homo sapiens
tccctctttctacatt

SEQ ID NO: 4203566 - DNA, 22 bp, Homo sapiens
tccctgacactgtctgctgccc

SEQ ID NO: 4203567 - DNA, 17 bp, Homo sapiens
tccctgactctctgtga

SEQ ID NO: 4203568 - DNA, 20 bp, Homo sapiens
tccctgactctctgtgacct

SEQ ID NO: 4203569 - DNA, 19 bp, Homo sapiens
tccctgagggcccttccca

SEQ ID NO: 4203570 - DNA, 21 bp, Homo sapiens
tccctgagggcccttcccaac

SEQ ID NO: 4203571 - DNA, 23 bp, Homo sapiens
tccctgagggcccttcccaacct

SEQ ID NO: 4203572 - DNA, 21 bp, Homo sapiens
tgaaagagagtaccatgctgg

SEQ ID NO: 4203573 - DNA, 17 bp, Homo sapiens
tgaaagagttctggatt

SEQ ID NO: 4203574 - DNA, 14 bp, Homo sapiens
tgaaagccatttgt

SEQ ID NO: 4203575 - DNA, 19 bp, Homo sapiens
tgaaataagatggaaaaat

SEQ ID NO: 4203576 - DNA, 17 bp, Homo sapiens
tgaaatatcctgcttga

SEQ ID NO: 4203577 - DNA, 22 bp, Homo sapiens
tgaaatcggaagggacttcctc

SEQ ID NO: 4203578 - DNA, 13 bp, Homo sapiens
tgaaatgaaagaa

SEQ ID NO: 4203579 - DNA, 15 bp, Homo sapiens
tgaaatgaaagaact

SEQ ID NO: 4203580 - DNA, 16 bp, Homo sapiens
tgaaattaaaatcact

SEQ ID NO: 4203581 - DNA, 22 bp, Homo sapiens
tgaaattaactgggtaatgaaa

SEQ ID NO: 4203582 - DNA, 22 bp, Homo sapiens
tgaaattgtctagcagagcagg

SEQ ID NO: 4203583 - DNA, 18 bp, Homo sapiens
tgaaattttctagacttt

SEQ ID NO: 4203584 - DNA, 21 bp, Homo sapiens
tgaaattttctagactttctg

SEQ ID NO: 4203585 - DNA, 12 bp, Homo sapiens
tgaacagagaga

SEQ ID NO: 4203586 - DNA, 13 bp, Homo sapiens
tgaacagagagaa

SEQ ID NO: 4203587 - DNA, 20 bp, Homo sapiens
tgaacagagagaaccaggag

SEQ ID NO: 4203588 - DNA, 16 bp, Homo sapiens
tgaacagggtccctgg

SEQ ID NO: 4203589 - DNA, 13 bp, Homo sapiens
tgaacatgcaatt

SEQ ID NO: 4203590 - DNA, 14 bp, Homo sapiens
tgaacatggactct

SEQ ID NO: 4203591 - DNA, 10 bp, Homo sapiens
tgaaccactg

SEQ ID NO: 4203592 - DNA, 19 bp, Homo sapiens
tgaacctgatgagcaagaa

SEQ ID NO: 4203593 - DNA, 21 bp, Homo sapiens
tgaaccttggtaaattgtaaa

SEQ ID NO: 4203594 - DNA, 21 bp, Homo sapiens
tgaactacgcttgctcatttt

SEQ ID NO: 4203595 - DNA, 11 bp, Homo sapiens
tgaactgttac

SEQ ID NO: 4203596 - DNA, 16 bp, Homo sapiens
tgaacttgaggacaca

SEQ ID NO: 4203597 - DNA, 21 bp, Homo sapiens
tgaagaaaccttcagatttgt

SEQ ID NO: 4203598 - DNA, 22 bp, Homo sapiens
tgaagactatctttgaagccag

SEQ ID NO: 4203599 - DNA, 16 bp, Homo sapiens
tgaagaggtgagagta

SEQ ID NO: 4203600 - DNA, 13 bp, Homo sapiens
tgaagctgtaccc

SEQ ID NO: 4203601 - DNA, 20 bp, Homo sapiens
tgaaggagattttccttcct

SEQ ID NO: 4203602 - DNA, 20 bp, Homo sapiens
tgaagggaccttgaagggta

SEQ ID NO: 4203603 - DNA, 14 bp, Homo sapiens
tgaagtagtttgta

SEQ ID NO: 4203604 - DNA, 23 bp, Homo sapiens
tgaagttagctttaacttaaata

SEQ ID NO: 4203605 - DNA, 14 bp, Homo sapiens
tgaagttatctgtg

SEQ ID NO: 4203606 - DNA, 20 bp, Homo sapiens
tgaagttatctgtgttattt

SEQ ID NO: 4203607 - DNA, 16 bp, Homo sapiens
tgaagttatgctgtca

SEQ ID NO: 4203608 - DNA, 12 bp, Homo sapiens
tgaataaagtac

SEQ ID NO: 4203609 - DNA, 14 bp, Homo sapiens
tgaatacacaaatt

SEQ ID NO: 4203610 - DNA, 15 bp, Homo sapiens
tgaatatcattaaat

SEQ ID NO: 4203611 - DNA, 17 bp, Homo sapiens
tgaatgacaacagaagc

SEQ ID NO: 4203612 - DNA, 15 bp, Homo sapiens
tgaatgcaaaccata

SEQ ID NO: 4203613 - DNA, 19 bp, Homo sapiens
tgaatgcaaaccatagcac

SEQ ID NO: 4203614 - DNA, 18 bp, Homo sapiens
tgaatgcttaaagcaagg

SEQ ID NO: 4203615 - DNA, 19 bp, Homo sapiens
tgaatgcttaaagcaaggc

SEQ ID NO: 4203616 - DNA, 20 bp, Homo sapiens
tgaatgtctaaggtcacaca

SEQ ID NO: 4203617 - DNA, 22 bp, Homo sapiens
tgaatgtgtgtatgtatgaagg

SEQ ID NO: 4203618 - DNA, 19 bp, Homo sapiens
tgaatgtttattccttgat

SEQ ID NO: 4203619 - DNA, 18 bp, Homo sapiens
tgaattagccaaaacact

SEQ ID NO: 4203620 - DNA, 14 bp, Homo sapiens
tgaattattttgca

SEQ ID NO: 4203621 - DNA, 18 bp, Homo sapiens
tgaattccaactcacttt

SEQ ID NO: 4203622 - DNA, 22 bp, Homo sapiens
tgaattgcctgcagagagaagc

SEQ ID NO: 4203623 - DNA, 15 bp, Homo sapiens
tgaatttattattgt

SEQ ID NO: 4203624 - DNA, 14 bp, Homo sapiens
tgaatttggagact

SEQ ID NO: 4203625 - DNA, 15 bp, Homo sapiens
tgaatttggagactc

SEQ ID NO: 4203626 - DNA, 17 bp, Homo sapiens
tgaatttggagactctg

SEQ ID NO: 4203627 - DNA, 20 bp, Homo sapiens
tgaatttggagactctgtgg

SEQ ID NO: 4203628 - DNA, 23 bp, Homo sapiens
tgaatttttaaacaagtatttgt

SEQ ID NO: 4203629 - DNA, 21 bp, Homo sapiens
tgacaaaaggctcggaatgtt

SEQ ID NO: 4203630 - DNA, 13 bp, Homo sapiens
tgacaacagaagc

SEQ ID NO: 4203631 - DNA, 16 bp, Homo sapiens
tgacaatcctgaagaa

SEQ ID NO: 4203632 - DNA, 20 bp, Homo sapiens
tgacaatcctgaagaaacca

SEQ ID NO: 4203633 - DNA, 19 bp, Homo sapiens
tgacacacgtatttatatt

SEQ ID NO: 4203634 - DNA, 19 bp, Homo sapiens
tgacactctagtgacttcc

SEQ ID NO: 4203635 - DNA, 16 bp, Homo sapiens
tgacactgtctgctgc

SEQ ID NO: 4203636 - DNA, 20 bp, Homo sapiens
tgacagacattttcaataat

SEQ ID NO: 4203637 - DNA, 17 bp, Homo sapiens
tgacagatataaaatag

SEQ ID NO: 4203638 - DNA, 15 bp, Homo sapiens
tgacaggctgaaagc

SEQ ID NO: 4203639 - DNA, 21 bp, Homo sapiens
tgacagtcccttgctgacatg

SEQ ID NO: 4203640 - DNA, 17 bp, Homo sapiens
tgacatgtaatgaatgg

SEQ ID NO: 4203641 - DNA, 20 bp, Homo sapiens
tgacatgtaatgaatggtca

SEQ ID NO: 4203642 - DNA, 19 bp, Homo sapiens
tgacatgttatatattttt

SEQ ID NO: 4203643 - DNA, 22 bp, Homo sapiens
tgacatttccttctttgtctta

SEQ ID NO: 4203644 - DNA, 18 bp, Homo sapiens
tgacatttgacagtgtgg

SEQ ID NO: 4203645 - DNA, 18 bp, Homo sapiens
tgacattttaaaaaacaa

SEQ ID NO: 4203646 - DNA, 15 bp, Homo sapiens
tgacccatctgtagt

SEQ ID NO: 4203647 - DNA, 17 bp, Homo sapiens
tgacccctttcccccac

SEQ ID NO: 4203648 - DNA, 18 bp, Homo sapiens
tgacctcgtgatccaccc

SEQ ID NO: 4203649 - DNA, 20 bp, Homo sapiens
tgacctgaggctcctgtgct

SEQ ID NO: 4203650 - DNA, 21 bp, Homo sapiens
tgacctgcagtcagggcccag

SEQ ID NO: 4203651 - DNA, 22 bp, Homo sapiens
tgacctgcagtcagggcccaga

SEQ ID NO: 4203652 - DNA, 13 bp, Homo sapiens
tgacctgccccgc

SEQ ID NO: 4203653 - DNA, 21 bp, Homo sapiens
tgacctgctgggtaaactgtg

SEQ ID NO: 4203654 - DNA, 18 bp, Homo sapiens
tgacctgggcccacagag

SEQ ID NO: 4203655 - DNA, 20 bp, Homo sapiens
tgacctgggcccacagagcc

SEQ ID NO: 4203656 - DNA, 21 bp, Homo sapiens
tgacctgggcccacagagcct

SEQ ID NO: 4203657 - DNA, 12 bp, Homo sapiens
tgacgcatcctg

SEQ ID NO: 4203658 - DNA, 19 bp, Homo sapiens
tgacggtcccacactggtg

SEQ ID NO: 4203659 - DNA, 23 bp, Homo sapiens
tgacggtcctttaggcagcctgc

SEQ ID NO: 4203660 - DNA, 23 bp, Homo sapiens
tgacgtgcacctgtactcaggag

SEQ ID NO: 4203661 - DNA, 16 bp, Homo sapiens
tgactagtcatagaaa

SEQ ID NO: 4203662 - DNA, 18 bp, Homo sapiens
tgactagtcatagaaata

SEQ ID NO: 4203663 - DNA, 20 bp, Homo sapiens
tgactatggctctggcacca

SEQ ID NO: 4203664 - DNA, 17 bp, Homo sapiens
tgactattttttaataa

SEQ ID NO: 4203665 - DNA, 13 bp, Homo sapiens
tgactcaaactcc

SEQ ID NO: 4203666 - DNA, 16 bp, Homo sapiens
tgactcaaatctccag

SEQ ID NO: 4203667 - DNA, 12 bp, Homo sapiens
tgactcaggagc

SEQ ID NO: 4203668 - DNA, 16 bp, Homo sapiens
tgactcaggagcctcc

SEQ ID NO: 4203669 - DNA, 13 bp, Homo sapiens
tgactctctgtga

SEQ ID NO: 4203670 - DNA, 15 bp, Homo sapiens
tgactctctgtgacc

SEQ ID NO: 4203671 - DNA, 15 bp, Homo sapiens
tgactgttcttggta

SEQ ID NO: 4203672 - DNA, 14 bp, Homo sapiens
tgacttcctggtga

SEQ ID NO: 4203673 - DNA, 13 bp, Homo sapiens
tgacttctgctga

SEQ ID NO: 4203674 - DNA, 22 bp, Homo sapiens
tgagaaagagagagatacatct

SEQ ID NO: 4203675 - DNA, 16 bp, Homo sapiens
tgagaaagccttcttt

SEQ ID NO: 4203676 - DNA, 21 bp, Homo sapiens
tgagaacctgggttgcagaca

SEQ ID NO: 4203677 - DNA, 23 bp, Homo sapiens
tgagaacctgggttgcagacagg

SEQ ID NO: 4203678 - DNA, 24 bp, Homo sapiens
tgagaagttttgtacagagaatta

SEQ ID NO: 4203679 - DNA, 15 bp, Homo sapiens
tgagaattccaagga

SEQ ID NO: 4203680 - DNA, 12 bp, Homo sapiens
tgagaccacctc

SEQ ID NO: 4203681 - DNA, 23 bp, Homo sapiens
tgagaccctcgccacggggaggg

SEQ ID NO: 4203682 - DNA, 14 bp, Homo sapiens
tgagaccctgtctc

SEQ ID NO: 4203683 - DNA, 15 bp, Homo sapiens
tgagaccctgtctct

SEQ ID NO: 4203684 - DNA, 21 bp, Homo sapiens
tgagacggagaccccggtggc

SEQ ID NO: 4203685 - DNA, 22 bp, Homo sapiens
tgagactgcgggatggtcctgg

SEQ ID NO: 4203686 - DNA, 19 bp, Homo sapiens
tgagagaattgtatcattt

SEQ ID NO: 4203687 - DNA, 12 bp, Homo sapiens
tgagagactttt

SEQ ID NO: 4203688 - DNA, 19 bp, Homo sapiens
tgagagctgctctggaaaa

SEQ ID NO: 4203689 - DNA, 22 bp, Homo sapiens
tgagatccagcacaactcagtc

SEQ ID NO: 4203690 - DNA, 23 bp, Homo sapiens
tgagatccagcacaactcagtct

SEQ ID NO: 4203691 - DNA, 18 bp, Homo sapiens
tgagatctccctccaggg

SEQ ID NO: 4203692 - DNA, 22 bp, Homo sapiens
tgagatgaaaaaaatacatcta

SEQ ID NO: 4203693 - DNA, 19 bp, Homo sapiens
tgagattacagaggaagtt

SEQ ID NO: 4203694 - DNA, 22 bp, Homo sapiens
tgagcactcagtctagtgaaga

SEQ ID NO: 4203695 - DNA, 12 bp, Homo sapiens
tgagcaggagca

SEQ ID NO: 4203696 - DNA, 16 bp, Homo sapiens
tgagcaggagcagaaa

SEQ ID NO: 4203697 - DNA, 12 bp, Homo sapiens
tgagccaagacc

SEQ ID NO: 4203698 - DNA, 17 bp, Homo sapiens
tgagcctaactccctcc

SEQ ID NO: 4203699 - DNA, 13 bp, Homo sapiens
tgagcggaggctc

SEQ ID NO: 4203700 - DNA, 17 bp, Homo sapiens
tgagctcagctcactgg

SEQ ID NO: 4203701 - DNA, 24 bp, Homo sapiens
tgagctgaccagccgtgagcatgt

SEQ ID NO: 4203702 - DNA, 15 bp, Homo sapiens
tgaggaaagacacag

SEQ ID NO: 4203703 - DNA, 16 bp, Homo sapiens
tgaggaaagacacaga

SEQ ID NO: 4203704 - DNA, 21 bp, Homo sapiens
tgaggaatatgactgttttta

SEQ ID NO: 4203705 - DNA, 16 bp, Homo sapiens
tgaggagcagcttcag

SEQ ID NO: 4203706 - DNA, 15 bp, Homo sapiens
tgcagcagaggacag

SEQ ID NO: 4203707 - DNA, 23 bp, Homo sapiens
tgcagccagcagttgtaaaattg

SEQ ID NO: 4203708 - DNA, 14 bp, Homo sapiens
tgcagcgagctgag

SEQ ID NO: 4203709 - DNA, 15 bp, Homo sapiens
tgcagcgagctgaga

SEQ ID NO: 4203710 - DNA, 19 bp, Homo sapiens
tgcagcgagctgagatcac

SEQ ID NO: 4203711 - DNA, 18 bp, Homo sapiens
tgcagctgttttcaaagc

SEQ ID NO: 4203712 - DNA, 19 bp, Homo sapiens
tgcagctgttttcaaagcc

SEQ ID NO: 4203713 - DNA, 20 bp, Homo sapiens
tgcagctgttttcaaagccc

SEQ ID NO: 4203714 - DNA, 16 bp, Homo sapiens
tgcagcttctgtcctg

SEQ ID NO: 4203715 - DNA, 16 bp, Homo sapiens
tgcagctttacatgca

SEQ ID NO: 4203716 - DNA, 19 bp, Homo sapiens
tgcaggcaccttagtggct

SEQ ID NO: 4203717 - DNA, 21 bp, Homo sapiens
tgcaggcaccttagtggcttt

SEQ ID NO: 4203718 - DNA, 17 bp, Homo sapiens
tgcaggcccagcagact

SEQ ID NO: 4203719 - DNA, 14 bp, Homo sapiens
tgcagggagccgag

SEQ ID NO: 4203720 - DNA, 14 bp, Homo sapiens
tgcagggctgctgt

SEQ ID NO: 4203721 - DNA, 17 bp, Homo sapiens
tgcagggctgctgtggc

SEQ ID NO: 4203722 - DNA, 22 bp, Homo sapiens
tgcaggtagttggtgaacagag

SEQ ID NO: 4203723 - DNA, 12 bp, Homo sapiens
tgcaggtatttt

SEQ ID NO: 4203724 - DNA, 18 bp, Homo sapiens
tgcaggtgcctggcttgc

SEQ ID NO: 4203725 - DNA, 17 bp, Homo sapiens
tgcagtcagggcccaga

SEQ ID NO: 4203726 - DNA, 14 bp, Homo sapiens
tgcagtgagctgag

SEQ ID NO: 4203727 - DNA, 14 bp, Homo sapiens
tgcagttttccagg

SEQ ID NO: 4203728 - DNA, 16 bp, Homo sapiens
tgcataaaggttctgg

SEQ ID NO: 4203729 - DNA, 22 bp, Homo sapiens
tgcataagattaaaggaaggaa

SEQ ID NO: 4203730 - DNA, 18 bp, Homo sapiens
tgcatcccccagcactga

SEQ ID NO: 4203731 - DNA, 16 bp, Homo sapiens
tgcatgcgcaggctca

SEQ ID NO: 4203732 - DNA, 15 bp, Homo sapiens
tgcatggaaacctga

SEQ ID NO: 4203733 - DNA, 19 bp, Homo sapiens
tgcatggaaacctgaaaaa

SEQ ID NO: 4203734 - DNA, 23 bp, Homo sapiens
tgcatggacaccccttatccagg

SEQ ID NO: 4203735 - DNA, 19 bp, Homo sapiens
tgcattagaaatagacagt

SEQ ID NO: 4203736 - DNA, 22 bp, Homo sapiens
tgcattcttaatctccactgtt

SEQ ID NO: 4203737 - DNA, 16 bp, Homo sapiens
tgccaaagcaaaagaa

SEQ ID NO: 4203738 - DNA, 22 bp, Homo sapiens
tgccaaagcaaaagaagtaaaa

SEQ ID NO: 4203739 - DNA, 19 bp, Homo sapiens
tgccaaattccatgtccct

SEQ ID NO: 4203740 - DNA, 18 bp, Homo sapiens
tgccaaattgtagttctt

SEQ ID NO: 4203741 - DNA, 18 bp, Homo sapiens
tgccaagtctcagaagag

SEQ ID NO: 4203742 - DNA, 14 bp, Homo sapiens
tgccaagtggccct

SEQ ID NO: 4203743 - DNA, 17 bp, Homo sapiens
tgccaagtggccctcag

SEQ ID NO: 4203744 - DNA, 18 bp, Homo sapiens
tgccaagtggccctcaga

SEQ ID NO: 4203745 - DNA, 14 bp, Homo sapiens
tgccacacactgtt

SEQ ID NO: 4203746 - DNA, 11 bp, Homo sapiens
tgccacagaga

SEQ ID NO: 4203747 - DNA, 12 bp, Homo sapiens
tgccacctgtct

SEQ ID NO: 4203748 - DNA, 23 bp, Homo sapiens
tgccactttggtacatggccagt

SEQ ID NO: 4203749 - DNA, 17 bp, Homo sapiens
tgccagcctgagcggag

SEQ ID NO: 4203750 - DNA, 12 bp, Homo sapiens
tgccaggactcc

SEQ ID NO: 4203751 - DNA, 21 bp, Homo sapiens
tgccaggactccccaggccag

SEQ ID NO: 4203752 - DNA, 17 bp, Homo sapiens
tgccaggctaatttttt

SEQ ID NO: 4203753 - DNA, 20 bp, Homo sapiens
tgccatgatgcctctgtctt

SEQ ID NO: 4203754 - DNA, 17 bp, Homo sapiens
tgccatggcgtgtccct

SEQ ID NO: 4203755 - DNA, 12 bp, Homo sapiens
tgccattcccac

SEQ ID NO: 4203756 - DNA, 18 bp, Homo sapiens
tgccattcttctggtgct

SEQ ID NO: 4203757 - DNA, 21 bp, Homo sapiens
tgccattcttctggtgctact

SEQ ID NO: 4203758 - DNA, 13 bp, Homo sapiens
tgccattgggacc

SEQ ID NO: 4203759 - DNA, 21 bp, Homo sapiens
tgccatttctgaactgttaca

SEQ ID NO: 4203760 - DNA, 19 bp, Homo sapiens
tgcccaatctgagcaaaca

SEQ ID NO: 4203761 - DNA, 18 bp, Homo sapiens
tgcccagagggcccaggc

SEQ ID NO: 4203762 - DNA, 13 bp, Homo sapiens
tgcccagcctgga

SEQ ID NO: 4203763 - DNA, 15 bp, Homo sapiens
tgcccagcctggagc

SEQ ID NO: 4203764 - DNA, 13 bp, Homo sapiens
tgcccagctctcg

SEQ ID NO: 4203765 - DNA, 20 bp, Homo sapiens
tgcccaggggcccacaggga

SEQ ID NO: 4203766 - DNA, 21 bp, Homo sapiens
tgcccagtcgatatctcactt

SEQ ID NO: 4203767 - DNA, 12 bp, Homo sapiens
tgccccagaaca

SEQ ID NO: 4203768 - DNA, 16 bp, Homo sapiens
tgcccccacccagtcc

SEQ ID NO: 4203769 - DNA, 15 bp, Homo sapiens
tgccccccatgccct

SEQ ID NO: 4203770 - DNA, 21 bp, Homo sapiens
tgccccctggtggacagtcct

SEQ ID NO: 4203771 - DNA, 22 bp, Homo sapiens
tgccccctggtggacagtcctg

SEQ ID NO: 4203772 - DNA, 18 bp, Homo sapiens
tgcccctccagagacagg

SEQ ID NO: 4203773 - DNA, 20 bp, Homo sapiens
tgcccctgcacctgcttctc

SEQ ID NO: 4203774 - DNA, 17 bp, Homo sapiens
tgcccctgtaggttgct

SEQ ID NO: 4203775 - DNA, 21 bp, Homo sapiens
tgcccctgtaggttgcttaaa

SEQ ID NO: 4203776 - DNA, 21 bp, Homo sapiens
tgccccttgacaactggcagg

SEQ ID NO: 4203777 - DNA, 16 bp, Homo sapiens
tgcccggattctggga

SEQ ID NO: 4203778 - DNA, 18 bp, Homo sapiens
tgcccggattctgggagg

SEQ ID NO: 4203779 - DNA, 15 bp, Homo sapiens
tgccctccctgctgc

SEQ ID NO: 4203780 - DNA, 17 bp, Homo sapiens
tgccctccgcccttccc

SEQ ID NO: 4203781 - DNA, 15 bp, Homo sapiens
tgccctgccacctgt

SEQ ID NO: 4203782 - DNA, 16 bp, Homo sapiens
tgccctgccacctgtc

SEQ ID NO: 4203783 - DNA, 18 bp, Homo sapiens
tgccctgccctgccacct

SEQ ID NO: 4203784 - DNA, 15 bp, Homo sapiens
tgccctggagggagg

SEQ ID NO: 4203785 - DNA, 12 bp, Homo sapiens
tgcccttctgat

SEQ ID NO: 4203786 - DNA, 20 bp, Homo sapiens
tgccctttggggttgcccag

SEQ ID NO: 4203787 - DNA, 18 bp, Homo sapiens
tgccgccccgtgcctgta

SEQ ID NO: 4203788 - DNA, 16 bp, Homo sapiens
tgcctagactgttact

SEQ ID NO: 4203789 - DNA, 17 bp, Homo sapiens
tgcctaggcgattttgt

SEQ ID NO: 4203790 - DNA, 15 bp, Homo sapiens
tgcctatatatgtaa

SEQ ID NO: 4203791 - DNA, 18 bp, Homo sapiens
tgcctatatatgtaaata

SEQ ID NO: 4203792 - DNA, 14 bp, Homo sapiens
tgcctatccatcct

SEQ ID NO: 4203793 - DNA, 14 bp, Homo sapiens
tgcctatcctctgt

SEQ ID NO: 4203794 - DNA, 17 bp, Homo sapiens
tgcctctctgctccaga

SEQ ID NO: 4203795 - DNA, 22 bp, Homo sapiens
tgcctgaaaaaactggtatgtt

SEQ ID NO: 4203796 - DNA, 23 bp, Homo sapiens
tgcctgaaaaaactggtatgttg

SEQ ID NO: 4203797 - DNA, 19 bp, Homo sapiens
tgcctgagtcacccatgaa

SEQ ID NO: 4203798 - DNA, 18 bp, Homo sapiens
tgcctgcagagagaagcc

SEQ ID NO: 4203799 - DNA, 11 bp, Homo sapiens
tgcctgccctg

SEQ ID NO: 4203800 - DNA, 20 bp, Homo sapiens
tgcctggcccccctccaggc

SEQ ID NO: 4203801 - DNA, 20 bp, Homo sapiens
tgcctgggaatcctgctgcc

SEQ ID NO: 4203802 - DNA, 22 bp, Homo sapiens
tgcctgggaatcctgctgccag

SEQ ID NO: 4203803 - DNA, 14 bp, Homo sapiens
tgcctgggaggctt

SEQ ID NO: 4203804 - DNA, 19 bp, Homo sapiens
tgcctgtagctttcctggt

SEQ ID NO: 4203805 - DNA, 17 bp, Homo sapiens
tgcctgtagttaggaaa

SEQ ID NO: 4203806 - DNA, 20 bp, Homo sapiens
tgcctgtagttaggaaataa

SEQ ID NO: 4203807 - DNA, 22 bp, Homo sapiens
tgcctgtagttaggaaataaaa

SEQ ID NO: 4203808 - DNA, 21 bp, Homo sapiens
tgcctgtggagacagccctgc

SEQ ID NO: 4203809 - DNA, 20 bp, Homo sapiens
tgcctgtggtgaggtcctgt

SEQ ID NO: 4203810 - DNA, 13 bp, Homo sapiens
tgccttaaagaaa

SEQ ID NO: 4203811 - DNA, 16 bp, Homo sapiens
tgccttaggctgctgg

SEQ ID NO: 4203812 - DNA, 19 bp, Homo sapiens
tgccttcctcgtgcagagc

SEQ ID NO: 4203813 - DNA, 15 bp, Homo sapiens
tgccttgaagccact

SEQ ID NO: 4203814 - DNA, 15 bp, Homo sapiens
tgccttttaaaagaa

SEQ ID NO: 4203815 - DNA, 13 bp, Homo sapiens
tgccttttatagc

SEQ ID NO: 4203816 - DNA, 17 bp, Homo sapiens
tgccttttatagctatt

SEQ ID NO: 4203817 - DNA, 17 bp, Homo sapiens
tgccttttgctgctgct

SEQ ID NO: 4203818 - DNA, 21 bp, Homo sapiens
tgcgaaggggccctggtcctt

SEQ ID NO: 4203819 - DNA, 23 bp, Homo sapiens
tgcgaatggggcgatcaagtcca

SEQ ID NO: 4203820 - DNA, 15 bp, Homo sapiens
tgcggcatccctgtg

SEQ ID NO: 4203821 - DNA, 17 bp, Homo sapiens
tgcgggatggtcctggg

SEQ ID NO: 4203822 - DNA, 15 bp, Homo sapiens
tgcggggcagagcca

SEQ ID NO: 4203823 - DNA, 19 bp, Homo sapiens
tgcgggggagctggaaata

SEQ ID NO: 4203824 - DNA, 17 bp, Homo sapiens
tgcggtggtgccagagg

SEQ ID NO: 4203825 - DNA, 18 bp, Homo sapiens
tgcggtggtgccagaggt

SEQ ID NO: 4203826 - DNA, 21 bp, Homo sapiens
tgcgtgactattttttaataa

SEQ ID NO: 4203827 - DNA, 14 bp, Homo sapiens
tgctaaaacttcac

SEQ ID NO: 4203828 - DNA, 22 bp, Homo sapiens
tgctaaacgactccgagaacaa

SEQ ID NO: 4203829 - DNA, 23 bp, Homo sapiens
tgctaaacgactccgagaacaac

SEQ ID NO: 4203830 - DNA, 16 bp, Homo sapiens
tgctaagagaagtaga

SEQ ID NO: 4203831 - DNA, 22 bp, Homo sapiens
tgctaagagaagtagaaatcat

SEQ ID NO: 4203832 - DNA, 14 bp, Homo sapiens
tgctacacagtata

SEQ ID NO: 4203833 - DNA, 16 bp, Homo sapiens
tgctactgaggcaggg

SEQ ID NO: 4203834 - DNA, 18 bp, Homo sapiens
tgctactttgccttttgc

SEQ ID NO: 4203835 - DNA, 12 bp, Homo sapiens
tgctagctctta

SEQ ID NO: 4203836 - DNA, 21 bp, Homo sapiens
tgctagctcttaccaaaacag

SEQ ID NO: 4203837 - DNA, 17 bp, Homo sapiens
tgctatcattattcgta

SEQ ID NO: 4203838 - DNA, 17 bp, Homo sapiens
tgctatggttttctcca

SEQ ID NO: 4203839 - DNA, 13 bp, Homo sapiens
tgctattacatgt

SEQ ID NO: 4203840 - DNA, 19 bp, Homo sapiens
tgctcacgactcttcctgc

SEQ ID NO: 4203841 - DNA, 15 bp, Homo sapiens
tgttgtagaataata

SEQ ID NO: 4203842 - DNA, 13 bp, Homo sapiens
tgttgtgaatgtc

SEQ ID NO: 4203843 - DNA, 13 bp, Homo sapiens
tgttgtgctttta

SEQ ID NO: 4203844 - DNA, 15 bp, Homo sapiens
tgttgtttcttaaat

SEQ ID NO: 4203845 - DNA, 17 bp, Homo sapiens
tgttgtttcttaaataa

SEQ ID NO: 4203846 - DNA, 21 bp, Homo sapiens
tgttgtttcttaaataagaaa

SEQ ID NO: 4203847 - DNA, 12 bp, Homo sapiens
tgttgtttgtaa

SEQ ID NO: 4203848 - DNA, 12 bp, Homo sapiens
tgtttaaaacat

SEQ ID NO: 4203849 - DNA, 16 bp, Homo sapiens
tgtttaaaacatcatt

SEQ ID NO: 4203850 - DNA, 23 bp, Homo sapiens
tgtttaaacacttatcttctgga

SEQ ID NO: 4203851 - DNA, 14 bp, Homo sapiens
tgtttaagatgggc

SEQ ID NO: 4203852 - DNA, 13 bp, Homo sapiens
tgtttacagaact

SEQ ID NO: 4203853 - DNA, 20 bp, Homo sapiens
tgtttatgtaggtacttcac

SEQ ID NO: 4203854 - DNA, 18 bp, Homo sapiens
tgtttccagttgttactg

SEQ ID NO: 4203855 - DNA, 19 bp, Homo sapiens
tgtttcctccttgtcactg

SEQ ID NO: 4203856 - DNA, 17 bp, Homo sapiens
tgtttctccccctgggc

SEQ ID NO: 4203857 - DNA, 13 bp, Homo sapiens
tgtttgctttctg

SEQ ID NO: 4203858 - DNA, 22 bp, Homo sapiens
tgtttgctttctgatcaaggcc

SEQ ID NO: 4203859 - DNA, 23 bp, Homo sapiens
tgtttggaaaagctaagtagaaa

SEQ ID NO: 4203860 - DNA, 13 bp, Homo sapiens
tgtttggctttca

SEQ ID NO: 4203861 - DNA, 14 bp, Homo sapiens
tgtttggctttcag

SEQ ID NO: 4203862 - DNA, 16 bp, Homo sapiens
tgtttgggcagaaggg

SEQ ID NO: 4203863 - DNA, 14 bp, Homo sapiens
tgtttgtaaatgcc

SEQ ID NO: 4203864 - DNA, 16 bp, Homo sapiens
tgtttgtaaatgcctc

SEQ ID NO: 4203865 - DNA, 17 bp, Homo sapiens
tgttttacaaatttttc

SEQ ID NO: 4203866 - DNA, 15 bp, Homo sapiens
tgttttatgagaaag

SEQ ID NO: 4203867 - DNA, 16 bp, Homo sapiens
tgttttatgagaaagc

SEQ ID NO: 4203868 - DNA, 20 bp, Homo sapiens
tgttttccatttgggcacat

SEQ ID NO: 4203869 - DNA, 23 bp, Homo sapiens
tgttttcccgagcaaagtctaaa

SEQ ID NO: 4203870 - DNA, 18 bp, Homo sapiens
tgttttccctttaaagcc

SEQ ID NO: 4203871 - DNA, 16 bp, Homo sapiens
tgttttctatatgaac

SEQ ID NO: 4203872 - DNA, 13 bp, Homo sapiens
tgttttctctata

SEQ ID NO: 4203873 - DNA, 13 bp, Homo sapiens
tgttttgcactga

SEQ ID NO: 4203874 - DNA, 16 bp, Homo sapiens
tgttttgtttcttgac

SEQ ID NO: 4203875 - DNA, 17 bp, Homo sapiens
tgtttttaagtcctgta

SEQ ID NO: 4203876 - DNA, 11 bp, Homo sapiens
tgtttttgcta

SEQ ID NO: 4203877 - DNA, 12 bp, Homo sapiens
ttaaaaaagctt

SEQ ID NO: 4203878 - DNA, 23 bp, Homo sapiens
ttaaaaaggaaagaaaactaaca

SEQ ID NO: 4203879 - DNA, 18 bp, Homo sapiens
ttaaaaccattatttaat

SEQ ID NO: 4203880 - DNA, 20 bp, Homo sapiens
ttaaaacctagaacttcaaa

SEQ ID NO: 4203881 - DNA, 16 bp, Homo sapiens
ttaaaatgattgtaaa

SEQ ID NO: 4203882 - DNA, 17 bp, Homo sapiens
ttaaaatgtaggaagaa

SEQ ID NO: 4203883 - DNA, 17 bp, Homo sapiens
ttaaacagactttagct

SEQ ID NO: 4203884 - DNA, 15 bp, Homo sapiens
ttaaacctggatact

SEQ ID NO: 4203885 - DNA, 15 bp, Homo sapiens
ttaaagctgcctgta

SEQ ID NO: 4203886 - DNA, 17 bp, Homo sapiens
ttaaagctgcctgtagt

SEQ ID NO: 4203887 - DNA, 18 bp, Homo sapiens
ttaaagctgcctgtagtt

SEQ ID NO: 4203888 - DNA, 12 bp, Homo sapiens
ttaaaggagtta

SEQ ID NO: 4203889 - DNA, 18 bp, Homo sapiens
ttaaaggcaccatctaat

SEQ ID NO: 4203890 - DNA, 15 bp, Homo sapiens
ttaaaggtagagatg

SEQ ID NO: 4203891 - DNA, 20 bp, Homo sapiens
ttaaagtgactaatggcatg

SEQ ID NO: 4203892 - DNA, 15 bp, Homo sapiens
ttaaataagaaactt

SEQ ID NO: 4203893 - DNA, 16 bp, Homo sapiens
ttaaattataagatgt

SEQ ID NO: 4203894 - DNA, 12 bp, Homo sapiens
ttaaattatata

SEQ ID NO: 4203895 - DNA, 13 bp, Homo sapiens
ttaacaaatacat

SEQ ID NO: 4203896 - DNA, 17 bp, Homo sapiens
ttaacaatctaacaata

SEQ ID NO: 4203897 - DNA, 16 bp, Homo sapiens
ttaacacaagtcctgt

SEQ ID NO: 4203898 - DNA, 13 bp, Homo sapiens
ttaacatggaatt

SEQ ID NO: 4203899 - DNA, 18 bp, Homo sapiens
ttaacatggaatttaatt

SEQ ID NO: 4203900 - DNA, 23 bp, Homo sapiens
ttaacatggaatttaatttatgt

SEQ ID NO: 4203901 - DNA, 15 bp, Homo sapiens
ttaacattcacagcc

SEQ ID NO: 4203902 - DNA, 16 bp, Homo sapiens
ttaacattcacagccc

SEQ ID NO: 4203903 - DNA, 13 bp, Homo sapiens
ttaaccctctctt

SEQ ID NO: 4203904 - DNA, 16 bp, Homo sapiens
ttaaccctctcttccc

SEQ ID NO: 4203905 - DNA, 17 bp, Homo sapiens
ttaaccctctcttccct

SEQ ID NO: 4203906 - DNA, 13 bp, Homo sapiens
ttaactattatta

SEQ ID NO: 4203907 - DNA, 19 bp, Homo sapiens
ttaactctctttatgtctg

SEQ ID NO: 4203908 - DNA, 18 bp, Homo sapiens
ttaacttggtcagagcca

SEQ ID NO: 4203909 - DNA, 21 bp, Homo sapiens
ttaagactgagcacctgcttc

SEQ ID NO: 4203910 - DNA, 16 bp, Homo sapiens
ttaagagtgaatgtgt

SEQ ID NO: 4203911 - DNA, 18 bp, Homo sapiens
ttaagagtgaatgtgtac

SEQ ID NO: 4203912 - DNA, 21 bp, Homo sapiens
ttaagatctgaaagttttctc

SEQ ID NO: 4203913 - DNA, 15 bp, Homo sapiens
ttaagcttgaagatt

SEQ ID NO: 4203914 - DNA, 20 bp, Homo sapiens
ttaataaaaaaacaatcatt

SEQ ID NO: 4203915 - DNA, 20 bp, Homo sapiens
ttaataaaaacttcagaaaa

SEQ ID NO: 4203916 - DNA, 19 bp, Homo sapiens
ttaataaggaaaaaataat

SEQ ID NO: 4203917 - DNA, 20 bp, Homo sapiens
ttaataaggaaaaaataata

SEQ ID NO: 4203918 - DNA, 19 bp, Homo sapiens
ttaatatcctaaacatcat

SEQ ID NO: 4203919 - DNA, 19 bp, Homo sapiens
ttaatcaagaatattcaaa

SEQ ID NO: 4203920 - DNA, 16 bp, Homo sapiens
ttaatcttatgcttaa

SEQ ID NO: 4203921 - DNA, 19 bp, Homo sapiens
ttaatgtgtgtctgaagac

SEQ ID NO: 4203922 - DNA, 23 bp, Homo sapiens
ttaattaactatgtgatgttaac

SEQ ID NO: 4203923 - DNA, 16 bp, Homo sapiens
ttaattagaaacgtga

SEQ ID NO: 4203924 - DNA, 15 bp, Homo sapiens
ttaattcctcagtta

SEQ ID NO: 4203925 - DNA, 14 bp, Homo sapiens
ttaattctcagcca

SEQ ID NO: 4203926 - DNA, 16 bp, Homo sapiens
ttaatttatatttgaa

SEQ ID NO: 4203927 - DNA, 14 bp, Homo sapiens
ttaatttatgcaga

SEQ ID NO: 4203928 - DNA, 14 bp, Homo sapiens
ttaatttatgtgaa

SEQ ID NO: 4203929 - DNA, 14 bp, Homo sapiens
ttaatttcaaatag

SEQ ID NO: 4203930 - DNA, 15 bp, Homo sapiens
ttaatttcaaataga

SEQ ID NO: 4203931 - DNA, 19 bp, Homo sapiens
ttaattttcaggatttttg

SEQ ID NO: 4203932 - DNA, 15 bp, Homo sapiens
ttacaaaaatagtag

SEQ ID NO: 4203933 - DNA, 19 bp, Homo sapiens
ttacaaactgcggtataca

SEQ ID NO: 4203934 - DNA, 14 bp, Homo sapiens
ttacaacagtaaca

SEQ ID NO: 4203935 - DNA, 18 bp, Homo sapiens
ttacaacagtaacacatc

SEQ ID NO: 4203936 - DNA, 19 bp, Homo sapiens
ttacaacagtaacacatct

SEQ ID NO: 4203937 - DNA, 19 bp, Homo sapiens
ttacaacctggaaaataaa

SEQ ID NO: 4203938 - DNA, 21 bp, Homo sapiens
ttacaacctggccagaggcat

SEQ ID NO: 4203939 - DNA, 14 bp, Homo sapiens
ttacaagtgtatat

SEQ ID NO: 4203940 - DNA, 14 bp, Homo sapiens
ttacaataaacata

SEQ ID NO: 4203941 - DNA, 18 bp, Homo sapiens
ttacactctctgtacaaa

SEQ ID NO: 4203942 - DNA, 15 bp, Homo sapiens
ttacagcgagaggca

SEQ ID NO: 4203943 - DNA, 21 bp, Homo sapiens
ttacagcgagaggcagagaaa

SEQ ID NO: 4203944 - DNA, 13 bp, Homo sapiens
ttacagtaaataa

SEQ ID NO: 4203945 - DNA, 17 bp, Homo sapiens
ttacagtcaattttaca

SEQ ID NO: 4203946 - DNA, 16 bp, Homo sapiens
ttacatccagaaagaa

SEQ ID NO: 4203947 - DNA, 22 bp, Homo sapiens
ttacatgcaatttattaaaatg

SEQ ID NO: 4203948 - DNA, 15 bp, Homo sapiens
ttacatggctgtggt

SEQ ID NO: 4203949 - DNA, 13 bp, Homo sapiens
ttaccaaaacaga

SEQ ID NO: 4203950 - DNA, 22 bp, Homo sapiens
ttaccaaggaaagaacaaatgc

SEQ ID NO: 4203951 - DNA, 21 bp, Homo sapiens
ttaccagatagttatattaaa

SEQ ID NO: 4203952 - DNA, 21 bp, Homo sapiens
ttaccaggcaccaaaagaagt

SEQ ID NO: 4203953 - DNA, 13 bp, Homo sapiens
ttacccaaatatg

SEQ ID NO: 4203954 - DNA, 16 bp, Homo sapiens
ttaccctggtggaggc

SEQ ID NO: 4203955 - DNA, 18 bp, Homo sapiens
ttacctgccaattgctac

SEQ ID NO: 4203956 - DNA, 15 bp, Homo sapiens
ttaccttaaaaagta

SEQ ID NO: 4203957 - DNA, 18 bp, Homo sapiens
ttactggtgatttctgag

SEQ ID NO: 4203958 - DNA, 15 bp, Homo sapiens
ttactgtaactgatt

SEQ ID NO: 4203959 - DNA, 16 bp, Homo sapiens
ttacttccatgatact

SEQ ID NO: 4203960 - DNA, 19 bp, Homo sapiens
ttacttccatgatacttta

SEQ ID NO: 4203961 - DNA, 19 bp, Homo sapiens
ttactttggcaatttcctg

SEQ ID NO: 4203962 - DNA, 14 bp, Homo sapiens
ttagaaaccttaat

SEQ ID NO: 4203963 - DNA, 18 bp, Homo sapiens
ttagaaaccttaatatgt

SEQ ID NO: 4203964 - DNA, 13 bp, Homo sapiens
ttagaaatagaca

SEQ ID NO: 4203965 - DNA, 14 bp, Homo sapiens
ttagaagtgtttta

SEQ ID NO: 4203966 - DNA, 12 bp, Homo sapiens
ttagaatgaaaa

SEQ ID NO: 4203967 - DNA, 16 bp, Homo sapiens
ttagacaaggaccagg

SEQ ID NO: 4203968 - DNA, 20 bp, Homo sapiens
ttagagaggtagcgagctgc

SEQ ID NO: 4203969 - DNA, 19 bp, Homo sapiens
ttagaggtttgtcaacaca

SEQ ID NO: 4203970 - DNA, 12 bp, Homo sapiens
ttagcagaagtg

SEQ ID NO: 4203971 - DNA, 18 bp, Homo sapiens
ttagcccttccctgcctt

SEQ ID NO: 4203972 - DNA, 12 bp, Homo sapiens
ttagctgaggga

SEQ ID NO: 4203973 - DNA, 14 bp, Homo sapiens
ttaggaaacctggc

SEQ ID NO: 4203974 - DNA, 15 bp, Homo sapiens
ttaggaaataaaacc

SEQ ID NO: 4203975 - DNA, 19 bp, Homo sapiens
ttaggaaataaaacctttc

SEQ ID NO: 4203976 - DNA, 20 bp, Homo sapiens
ttaggaagaaatcacttaaa

SEQ ID NO: 4203977 - DNA, 16 bp, Homo sapiens
ttcctcccccagagcc

SEQ ID NO: 4203978 - DNA, 22 bp, Homo sapiens
ttcctccctggtttgcagctgt

SEQ ID NO: 4203979 - DNA, 16 bp, Homo sapiens
ttcctcgtgcagagct

SEQ ID NO: 4203980 - DNA, 19 bp, Homo sapiens
ttcctctcactaaacttta

SEQ ID NO: 4203981 - DNA, 16 bp, Homo sapiens
ttcctctgcagcactt

SEQ ID NO: 4203982 - DNA, 13 bp, Homo sapiens
ttcctcttcccca

SEQ ID NO: 4203983 - DNA, 19 bp, Homo sapiens
ttcctctttctctccttct

SEQ ID NO: 4203984 - DNA, 15 bp, Homo sapiens
ttcctgcaaagggaa

SEQ ID NO: 4203985 - DNA, 11 bp, Homo sapiens
ttcctgcactc

SEQ ID NO: 4203986 - DNA, 12 bp, Homo sapiens
ttcctggtgagg

SEQ ID NO: 4203987 - DNA, 19 bp, Homo sapiens
ttccttagtttttaccttg

SEQ ID NO: 4203988 - DNA, 18 bp, Homo sapiens
ttccttctttctcttccc

SEQ ID NO: 4203989 - DNA, 18 bp, Homo sapiens
ttccttgctgtcctaggc

SEQ ID NO: 4203990 - DNA, 15 bp, Homo sapiens
ttcctttcctctgca

SEQ ID NO: 4203991 - DNA, 14 bp, Homo sapiens
ttccttttcttcct

SEQ ID NO: 4203992 - DNA, 17 bp, Homo sapiens
ttccttttcttccttct

SEQ ID NO: 4203993 - DNA, 16 bp, Homo sapiens
ttcgagaccagcctgg

SEQ ID NO: 4203994 - DNA, 17 bp, Homo sapiens
ttcgagaccagcctggc

SEQ ID NO: 4203995 - DNA, 17 bp, Homo sapiens
ttcgcccccatgtgact

SEQ ID NO: 4203996 - DNA, 17 bp, Homo sapiens
ttcgctgctagagaagg

SEQ ID NO: 4203997 - DNA, 17 bp, Homo sapiens
ttcgcttgcttctgcag

SEQ ID NO: 4203998 - DNA, 14 bp, Homo sapiens
ttcggagcctgcct

SEQ ID NO: 4203999 - DNA, 13 bp, Homo sapiens
ttctaaaattgaa

SEQ ID NO: 4204000 - DNA, 21 bp, Homo sapiens
ttctacctttttttctctcct

SEQ ID NO: 4204001 - DNA, 19 bp, Homo sapiens
ttctacttgcactagcatg

SEQ ID NO: 4204002 - DNA, 15 bp, Homo sapiens
ttctagactttctgt

SEQ ID NO: 4204003 - DNA, 16 bp, Homo sapiens
ttctagagcactgcca

SEQ ID NO: 4204004 - DNA, 14 bp, Homo sapiens
ttctagccacagtt

SEQ ID NO: 4204005 - DNA, 20 bp, Homo sapiens
ttctagccacagttctaaga

SEQ ID NO: 4204006 - DNA, 18 bp, Homo sapiens
ttctaggtcctggcttct

SEQ ID NO: 4204007 - DNA, 14 bp, Homo sapiens
ttctataagctatt

SEQ ID NO: 4204008 - DNA, 17 bp, Homo sapiens
ttctatagccaaaaata

SEQ ID NO: 4204009 - DNA, 23 bp, Homo sapiens
ttctatcctacaacaagagttta

SEQ ID NO: 4204010 - DNA, 14 bp, Homo sapiens
ttctatgtatgtta

SEQ ID NO: 4204011 - DNA, 19 bp, Homo sapiens
ttctcaatcactgctcccc

SEQ ID NO: 4204012 - DNA, 12 bp, Homo sapiens
ttctcaccagga

SEQ ID NO: 4204013 - DNA, 18 bp, Homo sapiens
ttctcagtcggtgtgtaa

SEQ ID NO: 4204014 - DNA, 13 bp, Homo sapiens
ttctcatgcttct

SEQ ID NO: 4204015 - DNA, 16 bp, Homo sapiens
ttctccaagagctaca

SEQ ID NO: 4204016 - DNA, 21 bp, Homo sapiens
ttctcccagcctcttatcact

SEQ ID NO: 4204017 - DNA, 17 bp, Homo sapiens
ttctccccctgggctct

SEQ ID NO: 4204018 - DNA, 18 bp, Homo sapiens
ttctccccctgggctctg

SEQ ID NO: 4204019 - DNA, 16 bp, Homo sapiens
ttctcctactttacac

SEQ ID NO: 4204020 - DNA, 22 bp, Homo sapiens
ttctctattttgcctttaaatt

SEQ ID NO: 4204021 - DNA, 17 bp, Homo sapiens
ttctctccttccctctt

SEQ ID NO: 4204022 - DNA, 23 bp, Homo sapiens
ttctctccttcttccctgtttta

SEQ ID NO: 4204023 - DNA, 12 bp, Homo sapiens
ttctctggctcc

SEQ ID NO: 4204024 - DNA, 15 bp, Homo sapiens
ttctctggctccaga

SEQ ID NO: 4204025 - DNA, 13 bp, Homo sapiens
ttctcttgaatta

SEQ ID NO: 4204026 - DNA, 17 bp, Homo sapiens
ttctctttgccttgatg

SEQ ID NO: 4204027 - DNA, 22 bp, Homo sapiens
ttctgaaatgacagaatgctgt

SEQ ID NO: 4204028 - DNA, 14 bp, Homo sapiens
ttctgaactgttac

SEQ ID NO: 4204029 - DNA, 15 bp, Homo sapiens
ttctgaactgttaca

SEQ ID NO: 4204030 - DNA, 22 bp, Homo sapiens
ttctgaactgttacaacttgta

SEQ ID NO: 4204031 - DNA, 17 bp, Homo sapiens
ttctgaataacatttgt

SEQ ID NO: 4204032 - DNA, 15 bp, Homo sapiens
ttctgagattttagt

SEQ ID NO: 4204033 - DNA, 13 bp, Homo sapiens
ttctgagctgggc

SEQ ID NO: 4204034 - DNA, 12 bp, Homo sapiens
ttctgatacatt

SEQ ID NO: 4204035 - DNA, 14 bp, Homo sapiens
ttctgatcaaggcc

SEQ ID NO: 4204036 - DNA, 22 bp, Homo sapiens
ttctgatcaaggccttattgga

SEQ ID NO: 4204037 - DNA, 18 bp, Homo sapiens
ttctgatgggtcccaaaa

SEQ ID NO: 4204038 - DNA, 13 bp, Homo sapiens
ttctgatttcact

SEQ ID NO: 4204039 - DNA, 16 bp, Homo sapiens
ttctgcagcaactccc

SEQ ID NO: 4204040 - DNA, 18 bp, Homo sapiens
ttctgcagcaactcccac

SEQ ID NO: 4204041 - DNA, 13 bp, Homo sapiens
ttctgcatgccct

SEQ ID NO: 4204042 - DNA, 18 bp, Homo sapiens
ttctggaaaagaggagtt

SEQ ID NO: 4204043 - DNA, 17 bp, Homo sapiens
ttctggaaaccaaatag

SEQ ID NO: 4204044 - DNA, 22 bp, Homo sapiens
ttctggaccagatcctactctt

SEQ ID NO: 4204045 - DNA, 10 bp, Homo sapiens
ttctggagcc

SEQ ID NO: 4204046 - DNA, 19 bp, Homo sapiens
ttctggattagaatgccgg

SEQ ID NO: 4204047 - DNA, 13 bp, Homo sapiens
ttctggctccaag

SEQ ID NO: 4204048 - DNA, 13 bp, Homo sapiens
ttctggctcctcc

SEQ ID NO: 4204049 - DNA, 17 bp, Homo sapiens
ttctggctcctccttcc

SEQ ID NO: 4204050 - DNA, 17 bp, Homo sapiens
ttctggtcttcactgcc

SEQ ID NO: 4204051 - DNA, 20 bp, Homo sapiens
ttctgtaaactcaaaactta

SEQ ID NO: 4204052 - DNA, 16 bp, Homo sapiens
ttctgtgacccatctg

SEQ ID NO: 4204053 - DNA, 17 bp, Homo sapiens
ttctgtgacccatctgt

SEQ ID NO: 4204054 - DNA, 18 bp, Homo sapiens
ttctgtgacccatctgta

SEQ ID NO: 4204055 - DNA, 19 bp, Homo sapiens
ttctgtgacccatctgtag

SEQ ID NO: 4204056 - DNA, 12 bp, Homo sapiens
ttctgtgtattt

SEQ ID NO: 4204057 - DNA, 18 bp, Homo sapiens
ttctgtgtattttgagat

SEQ ID NO: 4204058 - DNA, 20 bp, Homo sapiens
ttctgtgtgtacatgtacat

SEQ ID NO: 4204059 - DNA, 20 bp, Homo sapiens
ttctgttttttctgtacaca

SEQ ID NO: 4204060 - DNA, 19 bp, Homo sapiens
ttcttaaataagaaacttt

SEQ ID NO: 4204061 - DNA, 13 bp, Homo sapiens
ttcttacataatt

SEQ ID NO: 4204062 - DNA, 15 bp, Homo sapiens
ttcttatcttctgca

SEQ ID NO: 4204063 - DNA, 16 bp, Homo sapiens
ttcttcaccaaatctt

SEQ ID NO: 4204064 - DNA, 17 bp, Homo sapiens
ttcttcagaagacactg

SEQ ID NO: 4204065 - DNA, 23 bp, Homo sapiens
ttcttctggtgctactccatgca

SEQ ID NO: 4204066 - DNA, 15 bp, Homo sapiens
ttcttcttcagaaga

SEQ ID NO: 4204067 - DNA, 19 bp, Homo sapiens
ttcttgagtagatctgctt

SEQ ID NO: 4204068 - DNA, 23 bp, Homo sapiens
ttcttgagtttacatcaataata

SEQ ID NO: 4204069 - DNA, 12 bp, Homo sapiens
ttcttgcccaga

SEQ ID NO: 4204070 - DNA, 18 bp, Homo sapiens
ttcttggccactgaatta

SEQ ID NO: 4204071 - DNA, 14 bp, Homo sapiens
ttcttgtcaaaaaa

SEQ ID NO: 4204072 - DNA, 15 bp, Homo sapiens
ttcttgttgttctgt

SEQ ID NO: 4204073 - DNA, 20 bp, Homo sapiens
ttctttaaaatgtaaagcca

SEQ ID NO: 4204074 - DNA, 19 bp, Homo sapiens
ttctttactggtgatttct

SEQ ID NO: 4204075 - DNA, 15 bp, Homo sapiens
ttctttctcactaaa

SEQ ID NO: 4204076 - DNA, 14 bp, Homo sapiens
ttctttctcttccc

SEQ ID NO: 4204077 - DNA, 23 bp, Homo sapiens
ttctttctcttccctccttccct

SEQ ID NO: 4204078 - DNA, 13 bp, Homo sapiens
ttctttgaagtta

SEQ ID NO: 4204079 - DNA, 23 bp, Homo sapiens
ttctttgactctgtcacactaaa

SEQ ID NO: 4204080 - DNA, 13 bp, Homo sapiens
ttgaaaaagcgaa

SEQ ID NO: 4204081 - DNA, 23 bp, Homo sapiens
ttgaaaaatattcatgtagatca

SEQ ID NO: 4204082 - DNA, 18 bp, Homo sapiens
ttgaaaacataatctgca

SEQ ID NO: 4204083 - DNA, 19 bp, Homo sapiens
ttgaaaattattttaaaca

SEQ ID NO: 4204084 - DNA, 20 bp, Homo sapiens
ttgaaaattattttaaacaa

SEQ ID NO: 4204085 - DNA, 20 bp, Homo sapiens
ttgaagagatttcaacatat

SEQ ID NO: 4204086 - DNA, 17 bp, Homo sapiens
ttgaagccactgaagct

SEQ ID NO: 4204087 - DNA, 18 bp, Homo sapiens
ttgaagtggccagatgag

SEQ ID NO: 4204088 - DNA, 14 bp, Homo sapiens
ttgaatatcattaa

SEQ ID NO: 4204089 - DNA, 17 bp, Homo sapiens
ttgaatgacaacagaag

SEQ ID NO: 4204090 - DNA, 18 bp, Homo sapiens
ttgaatgacaacagaagc

SEQ ID NO: 4204091 - DNA, 21 bp, Homo sapiens
ttgaatgacaacagaagcttc

SEQ ID NO: 4204092 - DNA, 23 bp, Homo sapiens
ttgaatgttatttgttattttca

SEQ ID NO: 4204093 - DNA, 18 bp, Homo sapiens
ttgacaactggcaggcag

SEQ ID NO: 4204094 - DNA, 14 bp, Homo sapiens
ttgacccctttccc

SEQ ID NO: 4204095 - DNA, 19 bp, Homo sapiens
ttgacccctttcccccacc

SEQ ID NO: 4204096 - DNA, 14 bp, Homo sapiens
ttgacttctcttga

SEQ ID NO: 4204097 - DNA, 12 bp, Homo sapiens
ttgagcaggagc

SEQ ID NO: 4204098 - DNA, 13 bp, Homo sapiens
ttgagcaggagca

SEQ ID NO: 4204099 - DNA, 19 bp, Homo sapiens
ttgagcaggagcagaaaga

SEQ ID NO: 4204100 - DNA, 23 bp, Homo sapiens
ttgagcaggagcagaaagattaa

SEQ ID NO: 4204101 - DNA, 16 bp, Homo sapiens
ttgaggacacatgtcc

SEQ ID NO: 4204102 - DNA, 20 bp, Homo sapiens
ttgagtgactcgagggttgg

SEQ ID NO: 4204103 - DNA, 13 bp, Homo sapiens
ttgagtgtttaaa

SEQ ID NO: 4204104 - DNA, 22 bp, Homo sapiens
ttgataaagattttttaataat

SEQ ID NO: 4204105 - DNA, 19 bp, Homo sapiens
ttgataaattccactggac

SEQ ID NO: 4204106 - DNA, 21 bp, Homo sapiens
ttgataaattccactggactt

SEQ ID NO: 4204107 - DNA, 14 bp, Homo sapiens
ttgatgccaaaaaa

SEQ ID NO: 4204108 - DNA, 17 bp, Homo sapiens
ttgatgcccagataata

SEQ ID NO: 4204109 - DNA, 17 bp, Homo sapiens
ttgattacagtgcagtg

SEQ ID NO: 4204110 - DNA, 17 bp, Homo sapiens
ttgattctgaatctgaa

SEQ ID NO: 4204111 - DNA, 12 bp, Homo sapiens
ttgatttatgca

SEQ ID NO: 4204112 - DNA, 20 bp, Homo sapiens
ttgcaaaaactacaaccaat

SEQ ID NO: 4204113 - DNA, 21 bp, Homo sapiens
gaaactagtatctctggcctc

SEQ ID NO: 4204114 - DNA, 18 bp, Homo sapiens
gaaactttgatctctgct

SEQ ID NO: 4204115 - DNA, 18 bp, Homo sapiens
gaaacttttttatttaaa

SEQ ID NO: 4204116 - DNA, 16 bp, Homo sapiens
gaaagaaaaaacaaaa

SEQ ID NO: 4204117 - DNA, 17 bp, Homo sapiens
gaaagaaaattagtaat

SEQ ID NO: 4204118 - DNA, 11 bp, Homo sapiens
gaaagaagaga

SEQ ID NO: 4204119 - DNA, 15 bp, Homo sapiens
gaaagaagagacagg

SEQ ID NO: 4204120 - DNA, 12 bp, Homo sapiens
gaaagacacaga

SEQ ID NO: 4204121 - DNA, 11 bp, Homo sapiens
gaaagagacca

SEQ ID NO: 4204122 - DNA, 22 bp, Homo sapiens
gaaagcaacaaagattgagaag

SEQ ID NO: 4204123 - DNA, 16 bp, Homo sapiens
gaaagcctctgctgcc

SEQ ID NO: 4204124 - DNA, 13 bp, Homo sapiens
gaaagctgagacc

SEQ ID NO: 4204125 - DNA, 18 bp, Homo sapiens
gaaaggctcagtctcagg

SEQ ID NO: 4204126 - DNA, 14 bp, Homo sapiens
gaaagggaagcctg

SEQ ID NO: 4204127 - DNA, 17 bp, Homo sapiens
gaaaggtggtgtttctg

SEQ ID NO: 4204128 - DNA, 16 bp, Homo sapiens
gaaaggtttcaagact

SEQ ID NO: 4204129 - DNA, 20 bp, Homo sapiens
gaaagtcagatgcccagagg

SEQ ID NO: 4204130 - DNA, 15 bp, Homo sapiens
gaaagttgtctggct

SEQ ID NO: 4204131 - DNA, 21 bp, Homo sapiens
gaaataagtttttgtttcaca

SEQ ID NO: 4204132 - DNA, 16 bp, Homo sapiens
gaaataccacaagcct

SEQ ID NO: 4204133 - DNA, 16 bp, Homo sapiens
gaaatatcatcgtatt

SEQ ID NO: 4204134 - DNA, 15 bp, Homo sapiens
gaaatatcctgcttg

SEQ ID NO: 4204135 - DNA, 16 bp, Homo sapiens
gaaatcagttgtgttt

SEQ ID NO: 4204136 - DNA, 19 bp, Homo sapiens
gaaatccagtttcccacca

SEQ ID NO: 4204137 - DNA, 20 bp, Homo sapiens
gaaatccagtttcccaccac

SEQ ID NO: 4204138 - DNA, 21 bp, Homo sapiens
gaaatggtatgagctgagggg

SEQ ID NO: 4204139 - DNA, 13 bp, Homo sapiens
gaaattagccggg

SEQ ID NO: 4204140 - DNA, 21 bp, Homo sapiens
gaaattctatatgatcctgaa

SEQ ID NO: 4204141 - DNA, 12 bp, Homo sapiens
gaaattctgtgg

SEQ ID NO: 4204142 - DNA, 17 bp, Homo sapiens
gaaattgtgtttgacat

SEQ ID NO: 4204143 - DNA, 23 bp, Homo sapiens
gaaatttaaactataagcaagaa

SEQ ID NO: 4204144 - DNA, 21 bp, Homo sapiens
gaaattttctagactttctgt

SEQ ID NO: 4204145 - DNA, 19 bp, Homo sapiens
gaacaacaacaacaataac

SEQ ID NO: 4204146 - DNA, 13 bp, Homo sapiens
gaacaagagaaaa

SEQ ID NO: 4204147 - DNA, 22 bp, Homo sapiens
gaacaattattttattgtctaa

SEQ ID NO: 4204148 - DNA, 14 bp, Homo sapiens
gaacacactcagca

SEQ ID NO: 4204149 - DNA, 15 bp, Homo sapiens
gaacacactcagcag

SEQ ID NO: 4204150 - DNA, 17 bp, Homo sapiens
gaacacactcagcagcc

SEQ ID NO: 4204151 - DNA, 20 bp, Homo sapiens
gaacacaggtgttggaagcc

SEQ ID NO: 4204152 - DNA, 18 bp, Homo sapiens
gaacaccaggactttaat

SEQ ID NO: 4204153 - DNA, 21 bp, Homo sapiens
gaacacccgactcctcaaaag

SEQ ID NO: 4204154 - DNA, 15 bp, Homo sapiens
gaacactagacaagc

SEQ ID NO: 4204155 - DNA, 18 bp, Homo sapiens
gaacacttctaggactgg

SEQ ID NO: 4204156 - DNA, 20 bp, Homo sapiens
gaacagaaggtatacctggg

SEQ ID NO: 4204157 - DNA, 12 bp, Homo sapiens
gaacagagagaa

SEQ ID NO: 4204158 - DNA, 20 bp, Homo sapiens
gaacagagagaaccaggagg

SEQ ID NO: 4204159 - DNA, 22 bp, Homo sapiens
gaacagccaaatgcatggtgca

SEQ ID NO: 4204160 - DNA, 20 bp, Homo sapiens
gaacagctcttcactcagcc

SEQ ID NO: 4204161 - DNA, 16 bp, Homo sapiens
gaacatagacagaaga

SEQ ID NO: 4204162 - DNA, 14 bp, Homo sapiens
gaacatccctgggc

SEQ ID NO: 4204163 - DNA, 19 bp, Homo sapiens
gaacattggagctgactgt

SEQ ID NO: 4204164 - DNA, 21 bp, Homo sapiens
gaaccacaagagatcagcagt

SEQ ID NO: 4204165 - DNA, 12 bp, Homo sapiens
gaaccaggaggg

SEQ ID NO: 4204166 - DNA, 12 bp, Homo sapiens
gaacccctgtgt

SEQ ID NO: 4204167 - DNA, 22 bp, Homo sapiens
gaacctaaagtagcaggactcg

SEQ ID NO: 4204168 - DNA, 18 bp, Homo sapiens
gaacctcaggcttccttg

SEQ ID NO: 4204169 - DNA, 24 bp, Homo sapiens
gaacgcaacttaggatggctagga

SEQ ID NO: 4204170 - DNA, 18 bp, Homo sapiens
gaactaggtttaaaacag

SEQ ID NO: 4204171 - DNA, 17 bp, Homo sapiens
gaactcccagcaacaca

SEQ ID NO: 4204172 - DNA, 19 bp, Homo sapiens
gaactcccagcaacacaag

SEQ ID NO: 4204173 - DNA, 21 bp, Homo sapiens
gaactcccgacctcaagtgat

SEQ ID NO: 4204174 - DNA, 16 bp, Homo sapiens
gaactctggcttccag

SEQ ID NO: 4204175 - DNA, 17 bp, Homo sapiens
gaactctggcttccagg

SEQ ID NO: 4204176 - DNA, 20 bp, Homo sapiens
gaactctggcttccaggtat

SEQ ID NO: 4204177 - DNA, 14 bp, Homo sapiens
gaactggaagaaag

SEQ ID NO: 4204178 - DNA, 16 bp, Homo sapiens
gaactggaagaaagca

SEQ ID NO: 4204179 - DNA, 17 bp, Homo sapiens
gaactggaagaaagcaa

SEQ ID NO: 4204180 - DNA, 16 bp, Homo sapiens
gaactggctcctttgc

SEQ ID NO: 4204181 - DNA, 18 bp, Homo sapiens
gaactggctcctttgcct

SEQ ID NO: 4204182 - DNA, 21 bp, Homo sapiens
gaactggctcctttgcctctg

SEQ ID NO: 4204183 - DNA, 20 bp, Homo sapiens
gaactggtcaccatgaaact

SEQ ID NO: 4204184 - DNA, 17 bp, Homo sapiens
gaacttgaggacacatg

SEQ ID NO: 4204185 - DNA, 18 bp, Homo sapiens
gaacttgaggacacatgt

SEQ ID NO: 4204186 - DNA, 19 bp, Homo sapiens
gaacttgaggacacatgtc

SEQ ID NO: 4204187 - DNA, 23 bp, Homo sapiens
gaactttctcttcatactttttt

SEQ ID NO: 4204188 - DNA, 18 bp, Homo sapiens
gaactttgtgccagcgct

SEQ ID NO: 4204189 - DNA, 22 bp, Homo sapiens
gaagaaaactcctttagcaggt

SEQ ID NO: 4204190 - DNA, 20 bp, Homo sapiens
gaagaaacaaggttttcagt

SEQ ID NO: 4204191 - DNA, 21 bp, Homo sapiens
gaagaatctcatctcagtgaa

SEQ ID NO: 4204192 - DNA, 14 bp, Homo sapiens
gaagacaattgaca

SEQ ID NO: 4204193 - DNA, 18 bp, Homo sapiens
gaagacaattgacaacag

SEQ ID NO: 4204194 - DNA, 19 bp, Homo sapiens
gaagactctggagccaagg

SEQ ID NO: 4204195 - DNA, 17 bp, Homo sapiens
gaagagaggcacctgct

SEQ ID NO: 4204196 - DNA, 19 bp, Homo sapiens
gaagagaggcacctgctgg

SEQ ID NO: 4204197 - DNA, 20 bp, Homo sapiens
gaagagaggcacctgctgga

SEQ ID NO: 4204198 - DNA, 17 bp, Homo sapiens
gaagattaaaaccacag

SEQ ID NO: 4204199 - DNA, 18 bp, Homo sapiens
gaagattaaaaccacaga

SEQ ID NO: 4204200 - DNA, 21 bp, Homo sapiens
gaagcaactccgtgtgcctgg

SEQ ID NO: 4204201 - DNA, 13 bp, Homo sapiens
gaagcaagcaggg

SEQ ID NO: 4204202 - DNA, 16 bp, Homo sapiens
gaagcaagctggatgc

SEQ ID NO: 4204203 - DNA, 21 bp, Homo sapiens
gaagcaagctggatgcagtgg

SEQ ID NO: 4204204 - DNA, 16 bp, Homo sapiens
gaagcaagcttaatgg

SEQ ID NO: 4204205 - DNA, 14 bp, Homo sapiens
gaagcacaaaggaa

SEQ ID NO: 4204206 - DNA, 13 bp, Homo sapiens
gaagcaggcaggg

SEQ ID NO: 4204207 - DNA, 14 bp, Homo sapiens
gaagcaggcagggc

SEQ ID NO: 4204208 - DNA, 16 bp, Homo sapiens
gaagcaggcagggcaa

SEQ ID NO: 4204209 - DNA, 19 bp, Homo sapiens
gaagcaggttgaggggctc

SEQ ID NO: 4204210 - DNA, 22 bp, Homo sapiens
gaagcaggttgaggggctcctg

SEQ ID NO: 4204211 - DNA, 15 bp, Homo sapiens
gaagccaacttggct

SEQ ID NO: 4204212 - DNA, 14 bp, Homo sapiens
gaagccaccagtga

SEQ ID NO: 4204213 - DNA, 17 bp, Homo sapiens
gaagcctattagctggg

SEQ ID NO: 4204214 - DNA, 14 bp, Homo sapiens
gaagcctgactgct

SEQ ID NO: 4204215 - DNA, 17 bp, Homo sapiens
gaagctgatgctttgct

SEQ ID NO: 4204216 - DNA, 21 bp, Homo sapiens
gaagctgatgctttgcttcaa

SEQ ID NO: 4204217 - DNA, 15 bp, Homo sapiens
gaagcttcagaagtt

SEQ ID NO: 4204218 - DNA, 21 bp, Homo sapiens
gaaggactatgaaaagctaga

SEQ ID NO: 4204219 - DNA, 19 bp, Homo sapiens
gaaggagagcaagaaggaa

SEQ ID NO: 4204220 - DNA, 14 bp, Homo sapiens
gaaggatcctggaa

SEQ ID NO: 4204221 - DNA, 16 bp, Homo sapiens
gaaggcagggaggagg

SEQ ID NO: 4204222 - DNA, 20 bp, Homo sapiens
gaaggcagggaggaggcaga

SEQ ID NO: 4204223 - DNA, 19 bp, Homo sapiens
gaaggcctcactcaagcct

SEQ ID NO: 4204224 - DNA, 20 bp, Homo sapiens
gaaggcctcactcaagcctg

SEQ ID NO: 4204225 - DNA, 18 bp, Homo sapiens
gaagggaccttgaagggt

SEQ ID NO: 4204226 - DNA, 22 bp, Homo sapiens
gaagggggattggagggaagac

SEQ ID NO: 4204227 - DNA, 17 bp, Homo sapiens
gaagggggtccacccag

SEQ ID NO: 4204228 - DNA, 14 bp, Homo sapiens
gaagggtgcatagc

SEQ ID NO: 4204229 - DNA, 19 bp, Homo sapiens
gaagggttggtgggctggc

SEQ ID NO: 4204230 - DNA, 17 bp, Homo sapiens
gaaggtattagcaaagc

SEQ ID NO: 4204231 - DNA, 21 bp, Homo sapiens
gaaggttaggtttgtcaacac

SEQ ID NO: 4204232 - DNA, 11 bp, Homo sapiens
gaagtatgtgt

SEQ ID NO: 4204233 - DNA, 16 bp, Homo sapiens
gaagtcattgtcgctc

SEQ ID NO: 4204234 - DNA, 18 bp, Homo sapiens
gaagtccctaggagggaa

SEQ ID NO: 4204235 - DNA, 18 bp, Homo sapiens
gaagtgcatgaacagggt

SEQ ID NO: 4204236 - DNA, 14 bp, Homo sapiens
gaagtgccacatga

SEQ ID NO: 4204237 - DNA, 17 bp, Homo sapiens
gaagttagctttaactt

SEQ ID NO: 4204238 - DNA, 18 bp, Homo sapiens
gaagttatttagaaatat

SEQ ID NO: 4204239 - DNA, 22 bp, Homo sapiens
gaagttatttagaaatatcctt

SEQ ID NO: 4204240 - DNA, 20 bp, Homo sapiens
gaagttgtgccttttatagc

SEQ ID NO: 4204241 - DNA, 19 bp, Homo sapiens
gaagtttgatattaaagga

SEQ ID NO: 4204242 - DNA, 22 bp, Homo sapiens
gaataaaattgtaaaattgtat

SEQ ID NO: 4204243 - DNA, 11 bp, Homo sapiens
gaataaatgtt

SEQ ID NO: 4204244 - DNA, 14 bp, Homo sapiens
gaataaatgttcaa

SEQ ID NO: 4204245 - DNA, 18 bp, Homo sapiens
gaataaatgttcaaactg

SEQ ID NO: 4204246 - DNA, 18 bp, Homo sapiens
gaataggaaaatgtacat

SEQ ID NO: 4204247 - DNA, 18 bp, Homo sapiens
gactccccaggccaggcc

SEQ ID NO: 4204248 - DNA, 13 bp, Homo sapiens
gactcctcccaca

SEQ ID NO: 4204249 - DNA, 14 bp, Homo sapiens
gactctaagctgtg

SEQ ID NO: 4204250 - DNA, 18 bp, Homo sapiens
gactctaagctgtgtgca

SEQ ID NO: 4204251 - DNA, 19 bp, Homo sapiens
gactctctgtgacctgccc

SEQ ID NO: 4204252 - DNA, 18 bp, Homo sapiens
gactctgggtccctcgga

SEQ ID NO: 4204253 - DNA, 16 bp, Homo sapiens
gactctttatgcttgc

SEQ ID NO: 4204254 - DNA, 22 bp, Homo sapiens
gactgaaaaaaaaaaagaagaa

SEQ ID NO: 4204255 - DNA, 23 bp, Homo sapiens
gactgaaaaaaaaaaagaagaag

SEQ ID NO: 4204256 - DNA, 15 bp, Homo sapiens
gactgagacccgttc

SEQ ID NO: 4204257 - DNA, 15 bp, Homo sapiens
gactgagcacctgct

SEQ ID NO: 4204258 - DNA, 16 bp, Homo sapiens
gactgagcacctgctt

SEQ ID NO: 4204259 - DNA, 23 bp, Homo sapiens
gactgcagaggggaaagacttcc

SEQ ID NO: 4204260 - DNA, 16 bp, Homo sapiens
gactgctacctctgag

SEQ ID NO: 4204261 - DNA, 18 bp, Homo sapiens
gactgctacctctgagaa

SEQ ID NO: 4204262 - DNA, 20 bp, Homo sapiens
gactgctacctctgagaaga

SEQ ID NO: 4204263 - DNA, 23 bp, Homo sapiens
gactgctacctctgagaagacac

SEQ ID NO: 4204264 - DNA, 15 bp, Homo sapiens
gactggaacactaga

SEQ ID NO: 4204265 - DNA, 15 bp, Homo sapiens
gactggaaccaggga

SEQ ID NO: 4204266 - DNA, 17 bp, Homo sapiens
gactggaaccagggaga

SEQ ID NO: 4204267 - DNA, 14 bp, Homo sapiens
gactggctggctgc

SEQ ID NO: 4204268 - DNA, 15 bp, Homo sapiens
gactggtcctgtgtg

SEQ ID NO: 4204269 - DNA, 18 bp, Homo sapiens
gactgttgtacaagctca

SEQ ID NO: 4204270 - DNA, 13 bp, Homo sapiens
gacttagaagcat

SEQ ID NO: 4204271 - DNA, 16 bp, Homo sapiens
gacttagaagcatcag

SEQ ID NO: 4204272 - DNA, 22 bp, Homo sapiens
gacttcctctttctctccttct

SEQ ID NO: 4204273 - DNA, 16 bp, Homo sapiens
gacttgaataaagtac

SEQ ID NO: 4204274 - DNA, 15 bp, Homo sapiens
gacttggggaccaga

SEQ ID NO: 4204275 - DNA, 16 bp, Homo sapiens
gacttggggaccagag

SEQ ID NO: 4204276 - DNA, 14 bp, Homo sapiens
gacttggtctgatt

SEQ ID NO: 4204277 - DNA, 15 bp, Homo sapiens
gactttatacagaac

SEQ ID NO: 4204278 - DNA, 16 bp, Homo sapiens
gactttatacagaact

SEQ ID NO: 4204279 - DNA, 11 bp, Homo sapiens
gactttctgtt

SEQ ID NO: 4204280 - DNA, 18 bp, Homo sapiens
gacttttccatgtatcta

SEQ ID NO: 4204281 - DNA, 19 bp, Homo sapiens
gacttttctggaagacatg

SEQ ID NO: 4204282 - DNA, 15 bp, Homo sapiens
gagaaatacaaaaat

SEQ ID NO: 4204283 - DNA, 11 bp, Homo sapiens
gagaaattatt

SEQ ID NO: 4204284 - DNA, 20 bp, Homo sapiens
gagaactttcggagcctgcc

SEQ ID NO: 4204285 - DNA, 16 bp, Homo sapiens
gagaagaaagaacgga

SEQ ID NO: 4204286 - DNA, 23 bp, Homo sapiens
gagaagctgatgctttgcttcaa

SEQ ID NO: 4204287 - DNA, 14 bp, Homo sapiens
gagaagggaagcct

SEQ ID NO: 4204288 - DNA, 15 bp, Homo sapiens
gagaagggggattgg

SEQ ID NO: 4204289 - DNA, 19 bp, Homo sapiens
gagacagaccccttggctt

SEQ ID NO: 4204290 - DNA, 14 bp, Homo sapiens
gagacagccctgcc

SEQ ID NO: 4204291 - DNA, 15 bp, Homo sapiens
gagacagccctgcct

SEQ ID NO: 4204292 - DNA, 21 bp, Homo sapiens
gagaccacagcaattggctcc

SEQ ID NO: 4204293 - DNA, 13 bp, Homo sapiens
gagaccagcctgg

SEQ ID NO: 4204294 - DNA, 15 bp, Homo sapiens
gagaccccttccttt

SEQ ID NO: 4204295 - DNA, 19 bp, Homo sapiens
gagaccccttcctttcctc

SEQ ID NO: 4204296 - DNA, 15 bp, Homo sapiens
gagacggctggacct

SEQ ID NO: 4204297 - DNA, 14 bp, Homo sapiens
gagactctggcctc

SEQ ID NO: 4204298 - DNA, 23 bp, Homo sapiens
gagactctgtggggccttggttc

SEQ ID NO: 4204299 - DNA, 20 bp, Homo sapiens
gagagaaaacttatttgagt

SEQ ID NO: 4204300 - DNA, 17 bp, Homo sapiens
gagagacgtgtacatag

SEQ ID NO: 4204301 - DNA, 18 bp, Homo sapiens
gagagaggatgcagaggg

SEQ ID NO: 4204302 - DNA, 23 bp, Homo sapiens
gagagattttgtcgggacagaga

SEQ ID NO: 4204303 - DNA, 19 bp, Homo sapiens
gagagcagctggctctcca

SEQ ID NO: 4204304 - DNA, 13 bp, Homo sapiens
gagagccagctct

SEQ ID NO: 4204305 - DNA, 14 bp, Homo sapiens
gagagccagctctc

SEQ ID NO: 4204306 - DNA, 10 bp, Homo sapiens
gagagcccag

SEQ ID NO: 4204307 - DNA, 13 bp, Homo sapiens
gagagcccagcca

SEQ ID NO: 4204308 - DNA, 21 bp, Homo sapiens
gagagcctagaacatccctgg

SEQ ID NO: 4204309 - DNA, 22 bp, Homo sapiens
gagagcgcctcttcctctgggc

SEQ ID NO: 4204310 - DNA, 14 bp, Homo sapiens
gagaggaagcacac

SEQ ID NO: 4204311 - DNA, 16 bp, Homo sapiens
gagaggactctgcctt

SEQ ID NO: 4204312 - DNA, 20 bp, Homo sapiens
gagaggactgatgaatgaca

SEQ ID NO: 4204313 - DNA, 15 bp, Homo sapiens
gagaggatgcagagg

SEQ ID NO: 4204314 - DNA, 16 bp, Homo sapiens
gagaggcagagaaaga

SEQ ID NO: 4204315 - DNA, 23 bp, Homo sapiens
gagaggcgcgtctgccccaccct

SEQ ID NO: 4204316 - DNA, 22 bp, Homo sapiens
gagagtcctttgggattctagg

SEQ ID NO: 4204317 - DNA, 13 bp, Homo sapiens
gagatgactgagt

SEQ ID NO: 4204318 - DNA, 21 bp, Homo sapiens
gagatgactgagtcctcgtag

SEQ ID NO: 4204319 - DNA, 13 bp, Homo sapiens
gagatgatgatga

SEQ ID NO: 4204320 - DNA, 12 bp, Homo sapiens
gagatgcagagg

SEQ ID NO: 4204321 - DNA, 23 bp, Homo sapiens
gagattaattttaacttaaattt

SEQ ID NO: 4204322 - DNA, 12 bp, Homo sapiens
gagattttcctt

SEQ ID NO: 4204323 - DNA, 18 bp, Homo sapiens
gagattttgtcgggacag

SEQ ID NO: 4204324 - DNA, 14 bp, Homo sapiens
gagcaaagtctaaa

SEQ ID NO: 4204325 - DNA, 16 bp, Homo sapiens
gagcaaagtctaaagt

SEQ ID NO: 4204326 - DNA, 19 bp, Homo sapiens
gagcaacctcttcagctgg

SEQ ID NO: 4204327 - DNA, 15 bp, Homo sapiens
gagcaactctccact

SEQ ID NO: 4204328 - DNA, 13 bp, Homo sapiens
gagcacagcccac

SEQ ID NO: 4204329 - DNA, 14 bp, Homo sapiens
gagcacagcccacg

SEQ ID NO: 4204330 - DNA, 24 bp, Homo sapiens
gagcacagcccacggggatcacag

SEQ ID NO: 4204331 - DNA, 23 bp, Homo sapiens
gagcacctgcttcatgctcagcc

SEQ ID NO: 4204332 - DNA, 17 bp, Homo sapiens
gagcagaaagattaaat

SEQ ID NO: 4204333 - DNA, 18 bp, Homo sapiens
gagcagaactttttttgt

SEQ ID NO: 4204334 - DNA, 16 bp, Homo sapiens
gagcagcccagcacaa

SEQ ID NO: 4204335 - DNA, 18 bp, Homo sapiens
gagcagcccagcacaacc

SEQ ID NO: 4204336 - DNA, 11 bp, Homo sapiens
gagcagctggc

SEQ ID NO: 4204337 - DNA, 17 bp, Homo sapiens
gagcagctggctctcca

SEQ ID NO: 4204338 - DNA, 19 bp, Homo sapiens
gagcagctggctctccacc

SEQ ID NO: 4204339 - DNA, 19 bp, Homo sapiens
gagcaggccacgctcaggc

SEQ ID NO: 4204340 - DNA, 20 bp, Homo sapiens
gagcattacgtgagccaggt

SEQ ID NO: 4204341 - DNA, 13 bp, Homo sapiens
gagccaaggcaga

SEQ ID NO: 4204342 - DNA, 22 bp, Homo sapiens
gagccaccagggcactgtctgc

SEQ ID NO: 4204343 - DNA, 23 bp, Homo sapiens
gagccactacctttgtccaggcc

SEQ ID NO: 4204344 - DNA, 21 bp, Homo sapiens
gagccactctatgagttggac

SEQ ID NO: 4204345 - DNA, 12 bp, Homo sapiens
gagccaggctct

SEQ ID NO: 4204346 - DNA, 22 bp, Homo sapiens
gagccaggtaatgagggactgg

SEQ ID NO: 4204347 - DNA, 23 bp, Homo sapiens
gagccataccgaccatcgtccag

SEQ ID NO: 4204348 - DNA, 12 bp, Homo sapiens
gagcccaggagt

SEQ ID NO: 4204349 - DNA, 16 bp, Homo sapiens
gagcccgcttcaagct

SEQ ID NO: 4204350 - DNA, 18 bp, Homo sapiens
gagcccgcttcaagctct

SEQ ID NO: 4204351 - DNA, 21 bp, Homo sapiens
gagcccgcttcaagctctctg

SEQ ID NO: 4204352 - DNA, 15 bp, Homo sapiens
gagcctggagaagct

SEQ ID NO: 4204353 - DNA, 15 bp, Homo sapiens
gagcctggcgtctgg

SEQ ID NO: 4204354 - DNA, 22 bp, Homo sapiens
gagcctggcgtctggacgccga

SEQ ID NO: 4204355 - DNA, 14 bp, Homo sapiens
gagccttcaagtgc

SEQ ID NO: 4204356 - DNA, 17 bp, Homo sapiens
gagccttcaagtgccaa

SEQ ID NO: 4204357 - DNA, 22 bp, Homo sapiens
gagcgcctcttcctctgggcag

SEQ ID NO: 4204358 - DNA, 23 bp, Homo sapiens
gagcgcctcttcctctgggcagc

SEQ ID NO: 4204359 - DNA, 14 bp, Homo sapiens
gagcggaggctcgg

SEQ ID NO: 4204360 - DNA, 20 bp, Homo sapiens
gagctacgtatttaatagca

SEQ ID NO: 4204361 - DNA, 11 bp, Homo sapiens
gagctactgcc

SEQ ID NO: 4204362 - DNA, 17 bp, Homo sapiens
gagctctctgctgagca

SEQ ID NO: 4204363 - DNA, 22 bp, Homo sapiens
gagctgaacccattttgagtga

SEQ ID NO: 4204364 - DNA, 18 bp, Homo sapiens
gagctgatggagaaggaa

SEQ ID NO: 4204365 - DNA, 12 bp, Homo sapiens
gagctgccagcc

SEQ ID NO: 4204366 - DNA, 14 bp, Homo sapiens
gagctgccagccgg

SEQ ID NO: 4204367 - DNA, 16 bp, Homo sapiens
gagctggcattggtct

SEQ ID NO: 4204368 - DNA, 22 bp, Homo sapiens
gagctggggctgccagcctgag

SEQ ID NO: 4204369 - DNA, 24 bp, Homo sapiens
gagctggggctgccagcctgagcg

SEQ ID NO: 4204370 - DNA, 15 bp, Homo sapiens
gagctggggtacagg

SEQ ID NO: 4204371 - DNA, 14 bp, Homo sapiens
gagcttgagggaca

SEQ ID NO: 4204372 - DNA, 22 bp, Homo sapiens
gagcttgagggacaatgccact

SEQ ID NO: 4204373 - DNA, 18 bp, Homo sapiens
gaggaaaagacagagcct

SEQ ID NO: 4204374 - DNA, 22 bp, Homo sapiens
gaggaagcacataatgtccaga

SEQ ID NO: 4204375 - DNA, 11 bp, Homo sapiens
gaggacacatg

SEQ ID NO: 4204376 - DNA, 13 bp, Homo sapiens
gaggacacatgtc

SEQ ID NO: 4204377 - DNA, 14 bp, Homo sapiens
gaggacacatgtcc

SEQ ID NO: 4204378 - DNA, 14 bp, Homo sapiens
gaggacagagctgg

SEQ ID NO: 4204379 - DNA, 20 bp, Homo sapiens
gaggacagtctggagaaggt

SEQ ID NO: 4204380 - DNA, 21 bp, Homo sapiens
gaggagctcagggtttcggaa

SEQ ID NO: 4204381 - DNA, 16 bp, Homo sapiens
gaggaggaagactctg

SEQ ID NO: 4204382 - DNA, 13 bp, Homo sapiens
gatctgcttcttc

SEQ ID NO: 4204383 - DNA, 11 bp, Homo sapiens
gatctgggagg

SEQ ID NO: 4204384 - DNA, 23 bp, Homo sapiens
gatctgggaggtctccactgagg

SEQ ID NO: 4204385 - DNA, 14 bp, Homo sapiens
gatgaaacattcat

SEQ ID NO: 4204386 - DNA, 14 bp, Homo sapiens
gatgaaagaggagg

SEQ ID NO: 4204387 - DNA, 14 bp, Homo sapiens
gatgacagagcgag

SEQ ID NO: 4204388 - DNA, 15 bp, Homo sapiens
gatgatgatgatgat

SEQ ID NO: 4204389 - DNA, 22 bp, Homo sapiens
gatgatggttgcaaaagactaa

SEQ ID NO: 4204390 - DNA, 17 bp, Homo sapiens
gatgcccaaatccttag

SEQ ID NO: 4204391 - DNA, 19 bp, Homo sapiens
gatgcccagagggcccagg

SEQ ID NO: 4204392 - DNA, 13 bp, Homo sapiens
gatgcccagtggt

SEQ ID NO: 4204393 - DNA, 20 bp, Homo sapiens
gatgctgtcactggcagagc

SEQ ID NO: 4204394 - DNA, 14 bp, Homo sapiens
gatgcttttaacag

SEQ ID NO: 4204395 - DNA, 15 bp, Homo sapiens
gatgcttttaacaga

SEQ ID NO: 4204396 - DNA, 12 bp, Homo sapiens
gatggagaagga

SEQ ID NO: 4204397 - DNA, 21 bp, Homo sapiens
gatggagtgtgcgtgtgtgca

SEQ ID NO: 4204398 - DNA, 18 bp, Homo sapiens
gatggataacctatatga

SEQ ID NO: 4204399 - DNA, 15 bp, Homo sapiens
gatggatttgaagca

SEQ ID NO: 4204400 - DNA, 21 bp, Homo sapiens
gatggcacttagctatcagaa

SEQ ID NO: 4204401 - DNA, 15 bp, Homo sapiens
gatggcccttcccac

SEQ ID NO: 4204402 - DNA, 13 bp, Homo sapiens
gatgggccctgca

SEQ ID NO: 4204403 - DNA, 21 bp, Homo sapiens
gatggggacactaatgaagat

SEQ ID NO: 4204404 - DNA, 13 bp, Homo sapiens
gatggtagagaga

SEQ ID NO: 4204405 - DNA, 23 bp, Homo sapiens
gatggtatctgggtaagaagaaa

SEQ ID NO: 4204406 - DNA, 17 bp, Homo sapiens
gatgtgtctgggagagc

SEQ ID NO: 4204407 - DNA, 22 bp, Homo sapiens
gatgttaaaaaaataagaagaa

SEQ ID NO: 4204408 - DNA, 13 bp, Homo sapiens
gatgttatagaat

SEQ ID NO: 4204409 - DNA, 16 bp, Homo sapiens
gatgtttttcatgaaa

SEQ ID NO: 4204410 - DNA, 16 bp, Homo sapiens
gattaaaggaaggaaa

SEQ ID NO: 4204411 - DNA, 22 bp, Homo sapiens
gattactgtttggctgacatga

SEQ ID NO: 4204412 - DNA, 16 bp, Homo sapiens
gattagaggtttgtca

SEQ ID NO: 4204413 - DNA, 13 bp, Homo sapiens
gattatatgacaa

SEQ ID NO: 4204414 - DNA, 21 bp, Homo sapiens
gattatttgttatttgtacag

SEQ ID NO: 4204415 - DNA, 22 bp, Homo sapiens
gattatttgttatttgtacagt

SEQ ID NO: 4204416 - DNA, 12 bp, Homo sapiens
gattcagagact

SEQ ID NO: 4204417 - DNA, 17 bp, Homo sapiens
gattccccatctcaggc

SEQ ID NO: 4204418 - DNA, 17 bp, Homo sapiens
gattcctcccccagagc

SEQ ID NO: 4204419 - DNA, 22 bp, Homo sapiens
gattgaaaccattccagtagga

SEQ ID NO: 4204420 - DNA, 22 bp, Homo sapiens
gattgcattagaaatagacagt

SEQ ID NO: 4204421 - DNA, 18 bp, Homo sapiens
gattgctgataataaatt

SEQ ID NO: 4204422 - DNA, 12 bp, Homo sapiens
gattggctcacc

SEQ ID NO: 4204423 - DNA, 15 bp, Homo sapiens
gattgtcttaatatt

SEQ ID NO: 4204424 - DNA, 18 bp, Homo sapiens
gatttagggaagcaggga

SEQ ID NO: 4204425 - DNA, 17 bp, Homo sapiens
gatttatagtttgtaca

SEQ ID NO: 4204426 - DNA, 12 bp, Homo sapiens
gatttcaacata

SEQ ID NO: 4204427 - DNA, 22 bp, Homo sapiens
gatttcaggatactctgtcaga

SEQ ID NO: 4204428 - DNA, 18 bp, Homo sapiens
gatttcatctgagtgtgg

SEQ ID NO: 4204429 - DNA, 22 bp, Homo sapiens
gatttgaggagcagcttcagtt

SEQ ID NO: 4204430 - DNA, 23 bp, Homo sapiens
gatttgaggagcagcttcagttg

SEQ ID NO: 4204431 - DNA, 21 bp, Homo sapiens
gatttgatgagttaactgtga

SEQ ID NO: 4204432 - DNA, 14 bp, Homo sapiens
gattttagcctctt

SEQ ID NO: 4204433 - DNA, 20 bp, Homo sapiens
gattttgtgttttttcgttc

SEQ ID NO: 4204434 - DNA, 11 bp, Homo sapiens
gatttttcctt

SEQ ID NO: 4204435 - DNA, 18 bp, Homo sapiens
gatttttgtaataaaagg

SEQ ID NO: 4204436 - DNA, 16 bp, Homo sapiens
gattttttaataattt

SEQ ID NO: 4204437 - DNA, 14 bp, Homo sapiens
gcaaaaaagaaaac

SEQ ID NO: 4204438 - DNA, 17 bp, Homo sapiens
gcaaaaaagaaaacctt

SEQ ID NO: 4204439 - DNA, 21 bp, Homo sapiens
gcaaaaacatagtttgtaaag

SEQ ID NO: 4204440 - DNA, 16 bp, Homo sapiens
gcaaaagactaattta

SEQ ID NO: 4204441 - DNA, 13 bp, Homo sapiens
gcaaaaggctgag

SEQ ID NO: 4204442 - DNA, 15 bp, Homo sapiens
gcaaaaggctgagaa

SEQ ID NO: 4204443 - DNA, 23 bp, Homo sapiens
gcaaaccatttcaaatggcagca

SEQ ID NO: 4204444 - DNA, 13 bp, Homo sapiens
gcaaacctcagag

SEQ ID NO: 4204445 - DNA, 19 bp, Homo sapiens
gcaaacctcagagggataa

SEQ ID NO: 4204446 - DNA, 18 bp, Homo sapiens
gcaaaggaaaccaaagga

SEQ ID NO: 4204447 - DNA, 20 bp, Homo sapiens
gcaaagggcttggtggccaa

SEQ ID NO: 4204448 - DNA, 18 bp, Homo sapiens
gcaaaggtggctctccag

SEQ ID NO: 4204449 - DNA, 16 bp, Homo sapiens
gcaaagtctaaagttt

SEQ ID NO: 4204450 - DNA, 15 bp, Homo sapiens
gcaacaaaatcaatt

SEQ ID NO: 4204451 - DNA, 12 bp, Homo sapiens
gcaacaagagca

SEQ ID NO: 4204452 - DNA, 16 bp, Homo sapiens
gcaacacaagctggaa

SEQ ID NO: 4204453 - DNA, 17 bp, Homo sapiens
gcaacacaagctggaag

SEQ ID NO: 4204454 - DNA, 15 bp, Homo sapiens
gcaacataaaacaat

SEQ ID NO: 4204455 - DNA, 15 bp, Homo sapiens
gcaacatggtccagt

SEQ ID NO: 4204456 - DNA, 19 bp, Homo sapiens
gcaacctacctgttgagca

SEQ ID NO: 4204457 - DNA, 17 bp, Homo sapiens
gcaacctcttcagctgg

SEQ ID NO: 4204458 - DNA, 23 bp, Homo sapiens
gcaacctcttcagctgggaaggc

SEQ ID NO: 4204459 - DNA, 15 bp, Homo sapiens
gcaacttaggatggc

SEQ ID NO: 4204460 - DNA, 14 bp, Homo sapiens
gcaagaaggaaaga

SEQ ID NO: 4204461 - DNA, 15 bp, Homo sapiens
gcaagaaggaaagat

SEQ ID NO: 4204462 - DNA, 20 bp, Homo sapiens
gcaagaaggcaaaaatagtt

SEQ ID NO: 4204463 - DNA, 20 bp, Homo sapiens
gcaagagactctggcctcca

SEQ ID NO: 4204464 - DNA, 21 bp, Homo sapiens
gcaaggacaacctgcccctcc

SEQ ID NO: 4204465 - DNA, 15 bp, Homo sapiens
gcaagggccatgctg

SEQ ID NO: 4204466 - DNA, 14 bp, Homo sapiens
gcaagtcatactta

SEQ ID NO: 4204467 - DNA, 15 bp, Homo sapiens
gcaagtcatacttag

SEQ ID NO: 4204468 - DNA, 23 bp, Homo sapiens
gcaagtcatacttaggaatttct

SEQ ID NO: 4204469 - DNA, 20 bp, Homo sapiens
gcaatataaaaatgtgaatc

SEQ ID NO: 4204470 - DNA, 20 bp, Homo sapiens
gcaatccatgttagttttta

SEQ ID NO: 4204471 - DNA, 20 bp, Homo sapiens
gcaatggtgttgccctgagt

SEQ ID NO: 4204472 - DNA, 14 bp, Homo sapiens
gcaatttcctggcc

SEQ ID NO: 4204473 - DNA, 18 bp, Homo sapiens
gcaatttcctggccctcc

SEQ ID NO: 4204474 - DNA, 23 bp, Homo sapiens
gcacaaaattctagaagcagaag

SEQ ID NO: 4204475 - DNA, 20 bp, Homo sapiens
gcacaaatttcatctcctag

SEQ ID NO: 4204476 - DNA, 20 bp, Homo sapiens
gcacacacaccggtcaccga

SEQ ID NO: 4204477 - DNA, 22 bp, Homo sapiens
gcacacacaccggtcaccgaga

SEQ ID NO: 4204478 - DNA, 17 bp, Homo sapiens
gcacacatggacacaga

SEQ ID NO: 4204479 - DNA, 20 bp, Homo sapiens
gcacactgcagggctgctgt

SEQ ID NO: 4204480 - DNA, 19 bp, Homo sapiens
gcacagcgcgggcggaggc

SEQ ID NO: 4204481 - DNA, 15 bp, Homo sapiens
gcacaggctaatttt

SEQ ID NO: 4204482 - DNA, 14 bp, Homo sapiens
gcacatatttcaca

SEQ ID NO: 4204483 - DNA, 21 bp, Homo sapiens
gcacattttacttagctggag

SEQ ID NO: 4204484 - DNA, 14 bp, Homo sapiens
gcaccaaaagaagt

SEQ ID NO: 4204485 - DNA, 18 bp, Homo sapiens
gcaccacccatggagagg

SEQ ID NO: 4204486 - DNA, 12 bp, Homo sapiens
gcaccagaatgc

SEQ ID NO: 4204487 - DNA, 19 bp, Homo sapiens
gcaccagcttctccaggct

SEQ ID NO: 4204488 - DNA, 19 bp, Homo sapiens
gcaccatccaccctgcagg

SEQ ID NO: 4204489 - DNA, 16 bp, Homo sapiens
gcaccctccgccttca

SEQ ID NO: 4204490 - DNA, 23 bp, Homo sapiens
gcacctaaaccaccagtgcccaa

SEQ ID NO: 4204491 - DNA, 17 bp, Homo sapiens
gcacctatagtcccagc

SEQ ID NO: 4204492 - DNA, 14 bp, Homo sapiens
gcacctcagggcca

SEQ ID NO: 4204493 - DNA, 13 bp, Homo sapiens
gcacctgaaccac

SEQ ID NO: 4204494 - DNA, 19 bp, Homo sapiens
gcacctgaaccactgtggc

SEQ ID NO: 4204495 - DNA, 23 bp, Homo sapiens
gcacctgaaccactgtggccttc

SEQ ID NO: 4204496 - DNA, 17 bp, Homo sapiens
gcacctgccagcctggc

SEQ ID NO: 4204497 - DNA, 18 bp, Homo sapiens
gcacctgccccctggtgg

SEQ ID NO: 4204498 - DNA, 12 bp, Homo sapiens
gcacctgcttct

SEQ ID NO: 4204499 - DNA, 14 bp, Homo sapiens
gcacctgcttctca

SEQ ID NO: 4204500 - DNA, 19 bp, Homo sapiens
gcacctgtactcaggaggc

SEQ ID NO: 4204501 - DNA, 21 bp, Homo sapiens
gcacctgtactcaggaggctg

SEQ ID NO: 4204502 - DNA, 19 bp, Homo sapiens
gcaccttaccaactttctg

SEQ ID NO: 4204503 - DNA, 21 bp, Homo sapiens
gcaccttaccaactttctgta

SEQ ID NO: 4204504 - DNA, 20 bp, Homo sapiens
gcactagaactttgtgccag

SEQ ID NO: 4204505 - DNA, 21 bp, Homo sapiens
gcactagaactttgtgccagc

SEQ ID NO: 4204506 - DNA, 18 bp, Homo sapiens
gcactatctttcagctcc

SEQ ID NO: 4204507 - DNA, 19 bp, Homo sapiens
gcactatctttcagctcca

SEQ ID NO: 4204508 - DNA, 22 bp, Homo sapiens
gcactcagtctagtgaagatgt

SEQ ID NO: 4204509 - DNA, 15 bp, Homo sapiens
gcactccagcctggg

SEQ ID NO: 4204510 - DNA, 21 bp, Homo sapiens
gcactccagcctgggcgacag

SEQ ID NO: 4204511 - DNA, 13 bp, Homo sapiens
gcactgcaggggc

SEQ ID NO: 4204512 - DNA, 13 bp, Homo sapiens
gcactgccctccg

SEQ ID NO: 4204513 - DNA, 20 bp, Homo sapiens
gcactgctaggcgagtgcca

SEQ ID NO: 4204514 - DNA, 15 bp, Homo sapiens
gcactggccccaccc

SEQ ID NO: 4204515 - DNA, 15 bp, Homo sapiens
gcactgtatgctgga

SEQ ID NO: 4204516 - DNA, 13 bp, Homo sapiens
gcactgtggccct

SEQ ID NO: 4204517 - DNA, 17 bp, Homo sapiens
gccactacactccagcc

SEQ ID NO: 4204518 - DNA, 18 bp, Homo sapiens
gccactacactccagcct

SEQ ID NO: 4204519 - DNA, 19 bp, Homo sapiens
gccactacactccagcctg

SEQ ID NO: 4204520 - DNA, 22 bp, Homo sapiens
gccactacactccagcctgagc

SEQ ID NO: 4204521 - DNA, 16 bp, Homo sapiens
gccactcattcctgta

SEQ ID NO: 4204522 - DNA, 15 bp, Homo sapiens
gccactctatgagtt

SEQ ID NO: 4204523 - DNA, 21 bp, Homo sapiens
gccactctatgagttggactt

SEQ ID NO: 4204524 - DNA, 15 bp, Homo sapiens
gccactgaagctggg

SEQ ID NO: 4204525 - DNA, 19 bp, Homo sapiens
gccactgaagctgggattc

SEQ ID NO: 4204526 - DNA, 18 bp, Homo sapiens
gccactgcactccagcct

SEQ ID NO: 4204527 - DNA, 20 bp, Homo sapiens
gccactgcactccagcctgg

SEQ ID NO: 4204528 - DNA, 22 bp, Homo sapiens
gccactgcactccagcctgggc

SEQ ID NO: 4204529 - DNA, 20 bp, Homo sapiens
gccagaatcttcgtcctgcc

SEQ ID NO: 4204530 - DNA, 22 bp, Homo sapiens
gccagaggcattttttaaatca

SEQ ID NO: 4204531 - DNA, 20 bp, Homo sapiens
gccagaggttttaggaaacc

SEQ ID NO: 4204532 - DNA, 17 bp, Homo sapiens
gccagatgattttcctc

SEQ ID NO: 4204533 - DNA, 16 bp, Homo sapiens
gccagccggtgcctgg

SEQ ID NO: 4204534 - DNA, 11 bp, Homo sapiens
gccagcctggc

SEQ ID NO: 4204535 - DNA, 20 bp, Homo sapiens
gccagcctggcttctggagc

SEQ ID NO: 4204536 - DNA, 15 bp, Homo sapiens
gccaggaatctgcca

SEQ ID NO: 4204537 - DNA, 15 bp, Homo sapiens
gccaggactccccag

SEQ ID NO: 4204538 - DNA, 23 bp, Homo sapiens
gccaggagttgacgcatcctgca

SEQ ID NO: 4204539 - DNA, 15 bp, Homo sapiens
gccaggctaattttt

SEQ ID NO: 4204540 - DNA, 15 bp, Homo sapiens
gccaggctctgcctg

SEQ ID NO: 4204541 - DNA, 15 bp, Homo sapiens
gccagggtgagagct

SEQ ID NO: 4204542 - DNA, 22 bp, Homo sapiens
gccaggtttctgcccacattgg

SEQ ID NO: 4204543 - DNA, 14 bp, Homo sapiens
gccagtatttttta

SEQ ID NO: 4204544 - DNA, 14 bp, Homo sapiens
gccagtgggcctgg

SEQ ID NO: 4204545 - DNA, 20 bp, Homo sapiens
gccagtgtgatcccaagtgc

SEQ ID NO: 4204546 - DNA, 22 bp, Homo sapiens
gccataccgaccatcgtccagc

SEQ ID NO: 4204547 - DNA, 16 bp, Homo sapiens
gccatagagtttaaca

SEQ ID NO: 4204548 - DNA, 17 bp, Homo sapiens
gccatcaacaagagttg

SEQ ID NO: 4204549 - DNA, 15 bp, Homo sapiens
gccatgctgaaggga

SEQ ID NO: 4204550 - DNA, 22 bp, Homo sapiens
gccatggcgtgtccctctcgga

SEQ ID NO: 4204551 - DNA, 13 bp, Homo sapiens
gccattaccatgg

SEQ ID NO: 4204552 - DNA, 23 bp, Homo sapiens
gccattctccagtttcagaagca

SEQ ID NO: 4204553 - DNA, 16 bp, Homo sapiens
gccattgggaccctcc

SEQ ID NO: 4204554 - DNA, 18 bp, Homo sapiens
gccattgggaccctccag

SEQ ID NO: 4204555 - DNA, 19 bp, Homo sapiens
gccatttccatggctctgt

SEQ ID NO: 4204556 - DNA, 16 bp, Homo sapiens
gccatttctgaactgt

SEQ ID NO: 4204557 - DNA, 20 bp, Homo sapiens
gccatttctgaactgttaca

SEQ ID NO: 4204558 - DNA, 17 bp, Homo sapiens
gccattttttgaggaga

SEQ ID NO: 4204559 - DNA, 14 bp, Homo sapiens
gcccaatctgagca

SEQ ID NO: 4204560 - DNA, 13 bp, Homo sapiens
gcccacagagcct

SEQ ID NO: 4204561 - DNA, 14 bp, Homo sapiens
gcccacagagcctg

SEQ ID NO: 4204562 - DNA, 17 bp, Homo sapiens
gcccacagagcctggct

SEQ ID NO: 4204563 - DNA, 14 bp, Homo sapiens
gcccagaaccacag

SEQ ID NO: 4204564 - DNA, 18 bp, Homo sapiens
gcccagagaccccttcct

SEQ ID NO: 4204565 - DNA, 21 bp, Homo sapiens
gcccagagggcccaggcaggc

SEQ ID NO: 4204566 - DNA, 12 bp, Homo sapiens
gcccagatagag

SEQ ID NO: 4204567 - DNA, 22 bp, Homo sapiens
gcccagcacaacccccaggaaa

SEQ ID NO: 4204568 - DNA, 13 bp, Homo sapiens
gcccagcaggcag

SEQ ID NO: 4204569 - DNA, 15 bp, Homo sapiens
gcccagcaggcaggc

SEQ ID NO: 4204570 - DNA, 23 bp, Homo sapiens
gcccagccattaccatggagaca

SEQ ID NO: 4204571 - DNA, 18 bp, Homo sapiens
gcccagcctgtcctggta

SEQ ID NO: 4204572 - DNA, 20 bp, Homo sapiens
gcccagcctgtcctggtaca

SEQ ID NO: 4204573 - DNA, 13 bp, Homo sapiens
gcccagctgcacc

SEQ ID NO: 4204574 - DNA, 14 bp, Homo sapiens
gcccagctgcacct

SEQ ID NO: 4204575 - DNA, 22 bp, Homo sapiens
gcccaggagtttgaggctgcag

SEQ ID NO: 4204576 - DNA, 14 bp, Homo sapiens
gcccaggcaggcca

SEQ ID NO: 4204577 - DNA, 15 bp, Homo sapiens
gcccaggtcctctga

SEQ ID NO: 4204578 - DNA, 16 bp, Homo sapiens
gcccaggtcctctgat

SEQ ID NO: 4204579 - DNA, 14 bp, Homo sapiens
gcccatctctccag

SEQ ID NO: 4204580 - DNA, 20 bp, Homo sapiens
gccccaaacgggctgccctg

SEQ ID NO: 4204581 - DNA, 16 bp, Homo sapiens
gccccagggctaccct

SEQ ID NO: 4204582 - DNA, 21 bp, Homo sapiens
gcccccaccactaggactctg

SEQ ID NO: 4204583 - DNA, 23 bp, Homo sapiens
gccccccccttgaatctgcaggg

SEQ ID NO: 4204584 - DNA, 16 bp, Homo sapiens
gcccccctccttgctc

SEQ ID NO: 4204585 - DNA, 17 bp, Homo sapiens
gcccccgacagcccagc

SEQ ID NO: 4204586 - DNA, 22 bp, Homo sapiens
gccccctggtggacagtcctgg

SEQ ID NO: 4204587 - DNA, 23 bp, Homo sapiens
gccccggacggacgttggttctg

SEQ ID NO: 4204588 - DNA, 17 bp, Homo sapiens
gccccgggtgcctcaga

SEQ ID NO: 4204589 - DNA, 23 bp, Homo sapiens
gccccgggtgcctcagagcaggc

SEQ ID NO: 4204590 - DNA, 22 bp, Homo sapiens
gcccctctccaaacaccggcag

SEQ ID NO: 4204591 - DNA, 13 bp, Homo sapiens
gcccgaaagctga

SEQ ID NO: 4204592 - DNA, 17 bp, Homo sapiens
gcccgaaagctgagacc

SEQ ID NO: 4204593 - DNA, 19 bp, Homo sapiens
gcccgaccccatctcattc

SEQ ID NO: 4204594 - DNA, 15 bp, Homo sapiens
gcccgcttcaagctc

SEQ ID NO: 4204595 - DNA, 15 bp, Homo sapiens
gcccggattctggga

SEQ ID NO: 4204596 - DNA, 20 bp, Homo sapiens
gcccgggtgtgcctgccctg

SEQ ID NO: 4204597 - DNA, 18 bp, Homo sapiens
gcccgtcatgttcctcaa

SEQ ID NO: 4204598 - DNA, 23 bp, Homo sapiens
gccctcaatccccaagctggcag

SEQ ID NO: 4204599 - DNA, 20 bp, Homo sapiens
gccctccctggcatgtcaga

SEQ ID NO: 4204600 - DNA, 15 bp, Homo sapiens
gccctccgcccttcc

SEQ ID NO: 4204601 - DNA, 22 bp, Homo sapiens
gccctgagtggatctccaagga

SEQ ID NO: 4204602 - DNA, 16 bp, Homo sapiens
gccctgccacctgtct

SEQ ID NO: 4204603 - DNA, 17 bp, Homo sapiens
gccctgccacctgtctg

SEQ ID NO: 4204604 - DNA, 13 bp, Homo sapiens
gccctgccctgcc

SEQ ID NO: 4204605 - DNA, 19 bp, Homo sapiens
gccctgcctatcctctgta

SEQ ID NO: 4204606 - DNA, 22 bp, Homo sapiens
gccctgcgaagtggctctcagg

SEQ ID NO: 4204607 - DNA, 21 bp, Homo sapiens
gccctgctgccgcctcccagc

SEQ ID NO: 4204608 - DNA, 19 bp, Homo sapiens
gccctggcaggatgaccct

SEQ ID NO: 4204609 - DNA, 18 bp, Homo sapiens
gccctgtggattccagca

SEQ ID NO: 4204610 - DNA, 15 bp, Homo sapiens
gcccttcccaacctc

SEQ ID NO: 4204611 - DNA, 18 bp, Homo sapiens
gcccttcccaacctcccc

SEQ ID NO: 4204612 - DNA, 21 bp, Homo sapiens
gcccttctgattcccctccac

SEQ ID NO: 4204613 - DNA, 18 bp, Homo sapiens
gcccttctgtccaccaga

SEQ ID NO: 4204614 - DNA, 21 bp, Homo sapiens
gcccttctgtccaccagaccc

SEQ ID NO: 4204615 - DNA, 16 bp, Homo sapiens
gcccttggcttctgct

SEQ ID NO: 4204616 - DNA, 13 bp, Homo sapiens
gccctttctgtgt

SEQ ID NO: 4204617 - DNA, 16 bp, Homo sapiens
gccctttgcaggccca

SEQ ID NO: 4204618 - DNA, 13 bp, Homo sapiens
gccgagagaggcg

SEQ ID NO: 4204619 - DNA, 18 bp, Homo sapiens
gccgcagcctccctctga

SEQ ID NO: 4204620 - DNA, 16 bp, Homo sapiens
gccgccccgtgcctgt

SEQ ID NO: 4204621 - DNA, 16 bp, Homo sapiens
gccgccgggcaggcct

SEQ ID NO: 4204622 - DNA, 18 bp, Homo sapiens
gccgccgtctctgtcccg

SEQ ID NO: 4204623 - DNA, 14 bp, Homo sapiens
gccgcctcccagcc

SEQ ID NO: 4204624 - DNA, 16 bp, Homo sapiens
gccgcctcccagcctg

SEQ ID NO: 4204625 - DNA, 20 bp, Homo sapiens
gccgcggtaggtaagggccg

SEQ ID NO: 4204626 - DNA, 21 bp, Homo sapiens
gccgcggtaggtaagggccgc

SEQ ID NO: 4204627 - DNA, 23 bp, Homo sapiens
gccggaccgcgtagagagccggg

SEQ ID NO: 4204628 - DNA, 17 bp, Homo sapiens
gccgggcggaaggggac

SEQ ID NO: 4204629 - DNA, 19 bp, Homo sapiens
gccgggtgcggtggctcac

SEQ ID NO: 4204630 - DNA, 13 bp, Homo sapiens
gccggtgcctggc

SEQ ID NO: 4204631 - DNA, 17 bp, Homo sapiens
gccgtcagtgctgtgct

SEQ ID NO: 4204632 - DNA, 12 bp, Homo sapiens
gccgtgcccagg

SEQ ID NO: 4204633 - DNA, 15 bp, Homo sapiens
gccgtgcccaggggc

SEQ ID NO: 4204634 - DNA, 23 bp, Homo sapiens
gcctaatatttaggcaagagaaa

SEQ ID NO: 4204635 - DNA, 16 bp, Homo sapiens
gcctacagcagtgtgg

SEQ ID NO: 4204636 - DNA, 19 bp, Homo sapiens
gcctagaacatccctgggc

SEQ ID NO: 4204637 - DNA, 22 bp, Homo sapiens
gcctagaacatccctgggcaag

SEQ ID NO: 4204638 - DNA, 17 bp, Homo sapiens
gcctatatatgtaaata

SEQ ID NO: 4204639 - DNA, 16 bp, Homo sapiens
gcctatccatcctgcg

SEQ ID NO: 4204640 - DNA, 18 bp, Homo sapiens
gcctatgatcccagcact

SEQ ID NO: 4204641 - DNA, 22 bp, Homo sapiens
gcctcaaagcaagcattcagaa

SEQ ID NO: 4204642 - DNA, 16 bp, Homo sapiens
gcctcactgagctaat

SEQ ID NO: 4204643 - DNA, 14 bp, Homo sapiens
gcctcagccacaaa

SEQ ID NO: 4204644 - DNA, 19 bp, Homo sapiens
gcctcccaataaagctgga

SEQ ID NO: 4204645 - DNA, 14 bp, Homo sapiens
gcctcccagcctgg

SEQ ID NO: 4204646 - DNA, 21 bp, Homo sapiens
gcctccctctgacctgcaggc

SEQ ID NO: 4204647 - DNA, 21 bp, Homo sapiens
gcctcctgacctgaggctcct

SEQ ID NO: 4204648 - DNA, 17 bp, Homo sapiens
gcctcctgggggcccat

SEQ ID NO: 4204649 - DNA, 18 bp, Homo sapiens
gcctctctgctccagaga

SEQ ID NO: 4204650 - DNA, 17 bp, Homo sapiens
gcctctgctactgaggc

SEQ ID NO: 4204651 - DNA, 18 bp, Homo sapiens
cgtccctgagggcccttc

SEQ ID NO: 4204652 - DNA, 21 bp, Homo sapiens
cgtcccttggaaagttcagcc

SEQ ID NO: 4204653 - DNA, 15 bp, Homo sapiens
cgtctcctttgacat

SEQ ID NO: 4204654 - DNA, 18 bp, Homo sapiens
cgtctgccccaccctcaa

SEQ ID NO: 4204655 - DNA, 16 bp, Homo sapiens
cgtgaaagcagatgag

SEQ ID NO: 4204656 - DNA, 12 bp, Homo sapiens
cgtgagccaggt

SEQ ID NO: 4204657 - DNA, 18 bp, Homo sapiens
cgtgatccacccacctcg

SEQ ID NO: 4204658 - DNA, 11 bp, Homo sapiens
cgtgcagagct

SEQ ID NO: 4204659 - DNA, 15 bp, Homo sapiens
cgtgcctttctctgg

SEQ ID NO: 4204660 - DNA, 23 bp, Homo sapiens
cgtgcctttctctggctccagaa

SEQ ID NO: 4204661 - DNA, 20 bp, Homo sapiens
cgtgcttagcctcctgacct

SEQ ID NO: 4204662 - DNA, 12 bp, Homo sapiens
cgtggacacctg

SEQ ID NO: 4204663 - DNA, 17 bp, Homo sapiens
cgtgggagagagacgtg

SEQ ID NO: 4204664 - DNA, 17 bp, Homo sapiens
cgtggtcagagtgccac

SEQ ID NO: 4204665 - DNA, 19 bp, Homo sapiens
cgtggtgccgacgtcccca

SEQ ID NO: 4204666 - DNA, 12 bp, Homo sapiens
cgtgtcctctcc

SEQ ID NO: 4204667 - DNA, 17 bp, Homo sapiens
cgtgtcttcaattaaaa

SEQ ID NO: 4204668 - DNA, 12 bp, Homo sapiens
cgtgtgtgaagt

SEQ ID NO: 4204669 - DNA, 15 bp, Homo sapiens
cgttgacccctttcc

SEQ ID NO: 4204670 - DNA, 16 bp, Homo sapiens
cgttgacccctttccc

SEQ ID NO: 4204671 - DNA, 19 bp, Homo sapiens
cgttgacccctttccccca

SEQ ID NO: 4204672 - DNA, 22 bp, Homo sapiens
cgtttaagccaaaacaatgttt

SEQ ID NO: 4204673 - DNA, 21 bp, Homo sapiens
cgttttctcttccttgtgatt

SEQ ID NO: 4204674 - DNA, 13 bp, Homo sapiens
ctaaaagaaactt

SEQ ID NO: 4204675 - DNA, 16 bp, Homo sapiens
ctaaaatcttattcct

SEQ ID NO: 4204676 - DNA, 17 bp, Homo sapiens
ctaaacacgtgacacaa

SEQ ID NO: 4204677 - DNA, 18 bp, Homo sapiens
ctaaacagactatttaac

SEQ ID NO: 4204678 - DNA, 13 bp, Homo sapiens
ctaaacattgtga

SEQ ID NO: 4204679 - DNA, 18 bp, Homo sapiens
ctaaacccccgctccaga

SEQ ID NO: 4204680 - DNA, 19 bp, Homo sapiens
ctaaacccccgctccagat

SEQ ID NO: 4204681 - DNA, 21 bp, Homo sapiens
ctaaacgactccgagaacaac

SEQ ID NO: 4204682 - DNA, 14 bp, Homo sapiens
ctaaagagaacaag

SEQ ID NO: 4204683 - DNA, 22 bp, Homo sapiens
ctaaagagaacaagaggtgcta

SEQ ID NO: 4204684 - DNA, 17 bp, Homo sapiens
ctaaagctggtttaatg

SEQ ID NO: 4204685 - DNA, 13 bp, Homo sapiens
ctaaagtttacag

SEQ ID NO: 4204686 - DNA, 18 bp, Homo sapiens
ctaaagtttacagtaaat

SEQ ID NO: 4204687 - DNA, 19 bp, Homo sapiens
ctaaagtttacagtaaata

SEQ ID NO: 4204688 - DNA, 21 bp, Homo sapiens
ctaaagtttacagtaaataaa

SEQ ID NO: 4204689 - DNA, 24 bp, Homo sapiens
ctaaagtttacagtaaataaattg

SEQ ID NO: 4204690 - DNA, 20 bp, Homo sapiens
ctaaatattatgagatgctg

SEQ ID NO: 4204691 - DNA, 22 bp, Homo sapiens
ctaaatcagaaataggaagatt

SEQ ID NO: 4204692 - DNA, 17 bp, Homo sapiens
ctaacaataatatttca

SEQ ID NO: 4204693 - DNA, 21 bp, Homo sapiens
ctaacaataatatttcaagtg

SEQ ID NO: 4204694 - DNA, 23 bp, Homo sapiens
ctaacaataatatttcaagtgcc

SEQ ID NO: 4204695 - DNA, 14 bp, Homo sapiens
ctaacagctgaagt

SEQ ID NO: 4204696 - DNA, 18 bp, Homo sapiens
ctaacccccagtgccaca

SEQ ID NO: 4204697 - DNA, 20 bp, Homo sapiens
ctaacccccagtgccacaga

SEQ ID NO: 4204698 - DNA, 22 bp, Homo sapiens
ctaagcatcttgtcaagaaata

SEQ ID NO: 4204699 - DNA, 14 bp, Homo sapiens
ctaagcctgttgct

SEQ ID NO: 4204700 - DNA, 23 bp, Homo sapiens
ctaagcctgttgctgaagtcatt

SEQ ID NO: 4204701 - DNA, 15 bp, Homo sapiens
ctaagctgtgtgcag

SEQ ID NO: 4204702 - DNA, 15 bp, Homo sapiens
ctaagctttctcctt

SEQ ID NO: 4204703 - DNA, 23 bp, Homo sapiens
ctaaggagtgtagcaactacagt

SEQ ID NO: 4204704 - DNA, 23 bp, Homo sapiens
ctaagtttagaagcgctcatctg

SEQ ID NO: 4204705 - DNA, 24 bp, Homo sapiens
ctaataaatattgacttctcttga

SEQ ID NO: 4204706 - DNA, 15 bp, Homo sapiens
ctaatatatttttat

SEQ ID NO: 4204707 - DNA, 21 bp, Homo sapiens
ctaatatatttttatatttag

SEQ ID NO: 4204708 - DNA, 16 bp, Homo sapiens
ctaatattaaaaatat

SEQ ID NO: 4204709 - DNA, 14 bp, Homo sapiens
ctaatggcatgaga

SEQ ID NO: 4204710 - DNA, 16 bp, Homo sapiens
ctaatggcatgagaaa

SEQ ID NO: 4204711 - DNA, 18 bp, Homo sapiens
ctaatggcatgagaaata

SEQ ID NO: 4204712 - DNA, 15 bp, Homo sapiens
ctaattcctttctat

SEQ ID NO: 4204713 - DNA, 13 bp, Homo sapiens
ctaattgaacatg

SEQ ID NO: 4204714 - DNA, 16 bp, Homo sapiens
ctaatttttttgtatt

SEQ ID NO: 4204715 - DNA, 12 bp, Homo sapiens
ctacaaaatgga

SEQ ID NO: 4204716 - DNA, 13 bp, Homo sapiens
ctacaagcatttg

SEQ ID NO: 4204717 - DNA, 15 bp, Homo sapiens
ctacaagcatttgcc

SEQ ID NO: 4204718 - DNA, 14 bp, Homo sapiens
ctacaccctctgcc

SEQ ID NO: 4204719 - DNA, 18 bp, Homo sapiens
ctacaccctctgccccag

SEQ ID NO: 4204720 - DNA, 14 bp, Homo sapiens
ctacactccagcct

SEQ ID NO: 4204721 - DNA, 13 bp, Homo sapiens
ctacataatggaa

SEQ ID NO: 4204722 - DNA, 13 bp, Homo sapiens
ctaccaccttccc

SEQ ID NO: 4204723 - DNA, 16 bp, Homo sapiens
ctaccaccttccctct

SEQ ID NO: 4204724 - DNA, 12 bp, Homo sapiens
ctacccaggagg

SEQ ID NO: 4204725 - DNA, 14 bp, Homo sapiens
ctaccctcccccag

SEQ ID NO: 4204726 - DNA, 11 bp, Homo sapiens
ctacctcagcc

SEQ ID NO: 4204727 - DNA, 12 bp, Homo sapiens
ctacctcagcct

SEQ ID NO: 4204728 - DNA, 20 bp, Homo sapiens
ctacctttatagctcatcac

SEQ ID NO: 4204729 - DNA, 19 bp, Homo sapiens
ctacctttttttctctcct

SEQ ID NO: 4204730 - DNA, 14 bp, Homo sapiens
ctacgtatttaata

SEQ ID NO: 4204731 - DNA, 17 bp, Homo sapiens
ctactcagaagcctgag

SEQ ID NO: 4204732 - DNA, 18 bp, Homo sapiens
ctactcctacctcagcct

SEQ ID NO: 4204733 - DNA, 16 bp, Homo sapiens
ctactgatttttgtga

SEQ ID NO: 4204734 - DNA, 21 bp, Homo sapiens
ctactgcacttagtagctatg

SEQ ID NO: 4204735 - DNA, 17 bp, Homo sapiens
ctactgcagctttacat

SEQ ID NO: 4204736 - DNA, 15 bp, Homo sapiens
ctactgcccaggcac

SEQ ID NO: 4204737 - DNA, 13 bp, Homo sapiens
ctactgtgactga

SEQ ID NO: 4204738 - DNA, 14 bp, Homo sapiens
ctacttgctcaggt

SEQ ID NO: 4204739 - DNA, 14 bp, Homo sapiens
ctactttacactct

SEQ ID NO: 4204740 - DNA, 17 bp, Homo sapiens
ctacttttgcatgaaaa

SEQ ID NO: 4204741 - DNA, 20 bp, Homo sapiens
ctagaacatccctgggcaag

SEQ ID NO: 4204742 - DNA, 17 bp, Homo sapiens
ctagaacttcaaaatgt

SEQ ID NO: 4204743 - DNA, 16 bp, Homo sapiens
ctagaatttgtatttt

SEQ ID NO: 4204744 - DNA, 14 bp, Homo sapiens
ctagacaagccaga

SEQ ID NO: 4204745 - DNA, 18 bp, Homo sapiens
ctagagattttcttggca

SEQ ID NO: 4204746 - DNA, 17 bp, Homo sapiens
ctagatcgtctctaatg

SEQ ID NO: 4204747 - DNA, 20 bp, Homo sapiens
ctagcagaaaatataaatgg

SEQ ID NO: 4204748 - DNA, 14 bp, Homo sapiens
ctagcaggatctgc

SEQ ID NO: 4204749 - DNA, 16 bp, Homo sapiens
ctagcaggatctgccc

SEQ ID NO: 4204750 - DNA, 22 bp, Homo sapiens
ctagcattcagggttatacaca

SEQ ID NO: 4204751 - DNA, 20 bp, Homo sapiens
ctagcccacttgtcatccat

SEQ ID NO: 4204752 - DNA, 14 bp, Homo sapiens
ctagccctccctgg

SEQ ID NO: 4204753 - DNA, 16 bp, Homo sapiens
ctagccgggccatgct

SEQ ID NO: 4204754 - DNA, 13 bp, Homo sapiens
ctagcctctccag

SEQ ID NO: 4204755 - DNA, 16 bp, Homo sapiens
ctagcgtctcggccct

SEQ ID NO: 4204756 - DNA, 19 bp, Homo sapiens
ctaggaaagggaagcctga

SEQ ID NO: 4204757 - DNA, 15 bp, Homo sapiens
ctaggactctgaggc

SEQ ID NO: 4204758 - DNA, 16 bp, Homo sapiens
ctaggactctgaggct

SEQ ID NO: 4204759 - DNA, 18 bp, Homo sapiens
ctaggaggaaaagacaga

SEQ ID NO: 4204760 - DNA, 17 bp, Homo sapiens
ctaggattcctccccca

SEQ ID NO: 4204761 - DNA, 15 bp, Homo sapiens
ctaggcgagtgccag

SEQ ID NO: 4204762 - DNA, 17 bp, Homo sapiens
ctaggcgagtgccagga

SEQ ID NO: 4204763 - DNA, 19 bp, Homo sapiens
ctaggcgagtgccaggact

SEQ ID NO: 4204764 - DNA, 19 bp, Homo sapiens
ctaggcgattttgtctacc

SEQ ID NO: 4204765 - DNA, 17 bp, Homo sapiens
ctaggctgagctggcat

SEQ ID NO: 4204766 - DNA, 16 bp, Homo sapiens
ctaggctgttttctcc

SEQ ID NO: 4204767 - DNA, 21 bp, Homo sapiens
ctaggcttcagcatatttata

SEQ ID NO: 4204768 - DNA, 17 bp, Homo sapiens
ctagggtcctggccctc

SEQ ID NO: 4204769 - DNA, 18 bp, Homo sapiens
ctaggtttaaaacagcct

SEQ ID NO: 4204770 - DNA, 16 bp, Homo sapiens
ctagtagaaagaaaat

SEQ ID NO: 4204771 - DNA, 18 bp, Homo sapiens
ctagtcacaaagactcct

SEQ ID NO: 4204772 - DNA, 14 bp, Homo sapiens
ctagtccagtgacc

SEQ ID NO: 4204773 - DNA, 13 bp, Homo sapiens
ctagtcttgcttt

SEQ ID NO: 4204774 - DNA, 13 bp, Homo sapiens
ctagtgaagatgt

SEQ ID NO: 4204775 - DNA, 17 bp, Homo sapiens
ctagttcagaggaagca

SEQ ID NO: 4204776 - DNA, 20 bp, Homo sapiens
ctagttctcaatcactgctc

SEQ ID NO: 4204777 - DNA, 15 bp, Homo sapiens
ctagtttggcacatg

SEQ ID NO: 4204778 - DNA, 16 bp, Homo sapiens
ctataaaacaaagtct

SEQ ID NO: 4204779 - DNA, 17 bp, Homo sapiens
ctataagaactttgagc

SEQ ID NO: 4204780 - DNA, 14 bp, Homo sapiens
ctatacaacaatgt

SEQ ID NO: 4204781 - DNA, 14 bp, Homo sapiens
ctatactaccctgg

SEQ ID NO: 4204782 - DNA, 12 bp, Homo sapiens
ctatagagaaaa

SEQ ID NO: 4204783 - DNA, 15 bp, Homo sapiens
ctatagagaaaaact

SEQ ID NO: 4204784 - DNA, 22 bp, Homo sapiens
ctatagagaaaaactttcattt

SEQ ID NO: 4204785 - DNA, 14 bp, Homo sapiens
ctatagccaaaaat

SEQ ID NO: 4204786 - DNA, 15 bp, Homo sapiens
ctatagcccaggtcc

SEQ ID NO: 4204787 - DNA, 16 bp, Homo sapiens
ctataggcagacgtgg

SEQ ID NO: 4204788 - DNA, 18 bp, Homo sapiens
ctataggctggagaagct

SEQ ID NO: 4204789 - DNA, 19 bp, Homo sapiens
ctataggtgacttttgcaa

SEQ ID NO: 4204790 - DNA, 20 bp, Homo sapiens
ctatagttattaagttcttt

SEQ ID NO: 4204791 - DNA, 20 bp, Homo sapiens
ctctgcggtggtgccagagg

SEQ ID NO: 4204792 - DNA, 12 bp, Homo sapiens
ctctgctccaga

SEQ ID NO: 4204793 - DNA, 16 bp, Homo sapiens
ctctggacagcagcag

SEQ ID NO: 4204794 - DNA, 13 bp, Homo sapiens
ctctggagccaag

SEQ ID NO: 4204795 - DNA, 16 bp, Homo sapiens
ctctggagccaaggca

SEQ ID NO: 4204796 - DNA, 14 bp, Homo sapiens
ctctggctccagaa

SEQ ID NO: 4204797 - DNA, 17 bp, Homo sapiens
ctctggcttagaaattt

SEQ ID NO: 4204798 - DNA, 17 bp, Homo sapiens
ctctggcttccaggtat

SEQ ID NO: 4204799 - DNA, 17 bp, Homo sapiens
ctctgggtccctcggag

SEQ ID NO: 4204800 - DNA, 13 bp, Homo sapiens
ctctgtcagatgg

SEQ ID NO: 4204801 - DNA, 23 bp, Homo sapiens
ctctgtcagatgggaagacatga

SEQ ID NO: 4204802 - DNA, 22 bp, Homo sapiens
ctctgtccaatcagagaataaa

SEQ ID NO: 4204803 - DNA, 13 bp, Homo sapiens
ctctgtcttctgg

SEQ ID NO: 4204804 - DNA, 15 bp, Homo sapiens
ctctgtgacctgccc

SEQ ID NO: 4204805 - DNA, 14 bp, Homo sapiens
ctcttaaattatat

SEQ ID NO: 4204806 - DNA, 21 bp, Homo sapiens
ctcttaaattatatatttatt

SEQ ID NO: 4204807 - DNA, 23 bp, Homo sapiens
ctcttataacttctgaagtaatt

SEQ ID NO: 4204808 - DNA, 12 bp, Homo sapiens
ctcttatttgct

SEQ ID NO: 4204809 - DNA, 22 bp, Homo sapiens
ctcttcactcagccacacccca

SEQ ID NO: 4204810 - DNA, 18 bp, Homo sapiens
ctcttcactcttcaaatg

SEQ ID NO: 4204811 - DNA, 15 bp, Homo sapiens
ctcttccctccttcc

SEQ ID NO: 4204812 - DNA, 16 bp, Homo sapiens
ctcttcctctgggcag

SEQ ID NO: 4204813 - DNA, 12 bp, Homo sapiens
ctcttccttccc

SEQ ID NO: 4204814 - DNA, 14 bp, Homo sapiens
ctccagtattcttg

SEQ ID NO: 4204815 - DNA, 16 bp, Homo sapiens
ctccagtgctggattt

SEQ ID NO: 4204816 - DNA, 19 bp, Homo sapiens
ctccagtttcagaagcagg

SEQ ID NO: 4204817 - DNA, 22 bp, Homo sapiens
ctccatgcaggggtcagtgcag

SEQ ID NO: 4204818 - DNA, 15 bp, Homo sapiens
ctccattccagtctc

SEQ ID NO: 4204819 - DNA, 22 bp, Homo sapiens
ctccattcctaggtcacttgaa

SEQ ID NO: 4204820 - DNA, 23 bp, Homo sapiens
ctccattctgaaaatagcaggac

SEQ ID NO: 4204821 - DNA, 11 bp, Homo sapiens
ctccatttcaa

SEQ ID NO: 4204822 - DNA, 16 bp, Homo sapiens
ctccatttcaactcca

SEQ ID NO: 4204823 - DNA, 17 bp, Homo sapiens
ctccatttcaactccag

SEQ ID NO: 4204824 - DNA, 18 bp, Homo sapiens
ctccatttcaactccaga

SEQ ID NO: 4204825 - DNA, 17 bp, Homo sapiens
ctcccaataaagctgga

SEQ ID NO: 4204826 - DNA, 18 bp, Homo sapiens
ctcccaataaagctggac

SEQ ID NO: 4204827 - DNA, 23 bp, Homo sapiens
ctccggaggggacccagctcctc

SEQ ID NO: 4204828 - DNA, 20 bp, Homo sapiens
ctccggcctgatgacagagc

SEQ ID NO: 4204829 - DNA, 18 bp, Homo sapiens
ctccggtgtgcctgcagc

SEQ ID NO: 4204830 - DNA, 19 bp, Homo sapiens
ctccgtcatgaatgccttc

SEQ ID NO: 4204831 - DNA, 15 bp, Homo sapiens
ctccgtgtgcctggg

SEQ ID NO: 4204832 - DNA, 14 bp, Homo sapiens
ctcctactttacac

SEQ ID NO: 4204833 - DNA, 15 bp, Homo sapiens
ctcctactttacact

SEQ ID NO: 4204834 - DNA, 13 bp, Homo sapiens
ctcctcaggaaca

SEQ ID NO: 4204835 - DNA, 21 bp, Homo sapiens
ctcctcatccccacaatctgg

SEQ ID NO: 4204836 - DNA, 14 bp, Homo sapiens
ctcctccactccac

SEQ ID NO: 4204837 - DNA, 16 bp, Homo sapiens
ctcctccactccacct

SEQ ID NO: 4204838 - DNA, 23 bp, Homo sapiens
ctcctccagcccttcagacgaga

SEQ ID NO: 4204839 - DNA, 14 bp, Homo sapiens
ctcctcccacaatc

SEQ ID NO: 4204840 - DNA, 18 bp, Homo sapiens
ctcctcccagcgtgtgta

SEQ ID NO: 4204841 - DNA, 20 bp, Homo sapiens
ctcctcccagcgtgtgtatc

SEQ ID NO: 4204842 - DNA, 14 bp, Homo sapiens
ctcctccgccaccc

SEQ ID NO: 4204843 - DNA, 14 bp, Homo sapiens
ctcctccttcccct

SEQ ID NO: 4204844 - DNA, 15 bp, Homo sapiens
ctcctccttcccctg

SEQ ID NO: 4204845 - DNA, 20 bp, Homo sapiens
ctcctctctctctctctctg

SEQ ID NO: 4204846 - DNA, 15 bp, Homo sapiens
ctcctctgctgctcc

SEQ ID NO: 4204847 - DNA, 11 bp, Homo sapiens
ctcctctgtgc

SEQ ID NO: 4204848 - DNA, 22 bp, Homo sapiens
ctcctctgtgctcctgtccctc

SEQ ID NO: 4204849 - DNA, 17 bp, Homo sapiens
ctcctggaaaggctcag

SEQ ID NO: 4204850 - DNA, 19 bp, Homo sapiens
ctcctggaaaggctcagtc

SEQ ID NO: 4204851 - DNA, 22 bp, Homo sapiens
ctcctggaaaggctcagtctca

SEQ ID NO: 4204852 - DNA, 18 bp, Homo sapiens
ctcctgtcccttcttggg

SEQ ID NO: 4204853 - DNA, 20 bp, Homo sapiens
ctcctgtgctactttgcctt

SEQ ID NO: 4204854 - DNA, 14 bp, Homo sapiens
ctcctgtgtacagg

SEQ ID NO: 4204855 - DNA, 14 bp, Homo sapiens
ctccttcagtgaca

SEQ ID NO: 4204856 - DNA, 13 bp, Homo sapiens
ctccttcttccct

SEQ ID NO: 4204857 - DNA, 14 bp, Homo sapiens
ctccttcttccctg

SEQ ID NO: 4204858 - DNA, 16 bp, Homo sapiens
ctcctttgcctctgct

SEQ ID NO: 4204859 - DNA, 15 bp, Homo sapiens
ctcgaggctcttcca

SEQ ID NO: 4204860 - DNA, 17 bp, Homo sapiens
ctcgaggctcttccatc

SEQ ID NO: 4204861 - DNA, 14 bp, Homo sapiens
ctcgccccacccag

SEQ ID NO: 4204862 - DNA, 20 bp, Homo sapiens
ctcggaaggctggctgggca

SEQ ID NO: 4204863 - DNA, 14 bp, Homo sapiens
ctcggtcaggaggg

SEQ ID NO: 4204864 - DNA, 14 bp, Homo sapiens
ctcgtaactggttt

SEQ ID NO: 4204865 - DNA, 14 bp, Homo sapiens
ctcgtatagcatgc

SEQ ID NO: 4204866 - DNA, 13 bp, Homo sapiens
ctcgtgcagagct

SEQ ID NO: 4204867 - DNA, 14 bp, Homo sapiens
ctcgtgcagagctg

SEQ ID NO: 4204868 - DNA, 18 bp, Homo sapiens
ctcgtgcagagctggggc

SEQ ID NO: 4204869 - DNA, 20 bp, Homo sapiens
ctcgtgcagagctggggctg

SEQ ID NO: 4204870 - DNA, 12 bp, Homo sapiens
ctcgtggacacc

SEQ ID NO: 4204871 - DNA, 16 bp, Homo sapiens
ctcgtggacacctgcc

SEQ ID NO: 4204872 - DNA, 20 bp, Homo sapiens
ctcgtggacacctgccctgc

SEQ ID NO: 4204873 - DNA, 21 bp, Homo sapiens
ctcgtggacacctgccctgcc

SEQ ID NO: 4204874 - DNA, 23 bp, Homo sapiens
ctctaacccccagtgccacagag

SEQ ID NO: 4204875 - DNA, 13 bp, Homo sapiens
ctctaagctgtgt

SEQ ID NO: 4204876 - DNA, 18 bp, Homo sapiens
ctctaagctgtgtgcagg

SEQ ID NO: 4204877 - DNA, 15 bp, Homo sapiens
ctctaatacattcca

SEQ ID NO: 4204878 - DNA, 16 bp, Homo sapiens
ctctacaccctctgcc

SEQ ID NO: 4204879 - DNA, 19 bp, Homo sapiens
ctctactaaaaatacagaa

SEQ ID NO: 4204880 - DNA, 19 bp, Homo sapiens
ctctactcctacctcagcc

SEQ ID NO: 4204881 - DNA, 21 bp, Homo sapiens
ctctagcctttattattactg

SEQ ID NO: 4204882 - DNA, 20 bp, Homo sapiens
ctctagtcttgctttgctgt

SEQ ID NO: 4204883 - DNA, 14 bp, Homo sapiens
ctctagtgaatgtg

SEQ ID NO: 4204884 - DNA, 19 bp, Homo sapiens
ctctagtgacttcctggtg

SEQ ID NO: 4204885 - DNA, 14 bp, Homo sapiens
ctctagtgccctcc

SEQ ID NO: 4204886 - DNA, 15 bp, Homo sapiens
ctctataggtcatga

SEQ ID NO: 4204887 - DNA, 21 bp, Homo sapiens
ctctataggtcatgatttctg

SEQ ID NO: 4204888 - DNA, 15 bp, Homo sapiens
ctctcaatatgctta

SEQ ID NO: 4204889 - DNA, 16 bp, Homo sapiens
ctctcagaaggtattc

SEQ ID NO: 4204890 - DNA, 15 bp, Homo sapiens
ctctcaggggccagt

SEQ ID NO: 4204891 - DNA, 20 bp, Homo sapiens
ctctcaggggccagtgaggg

SEQ ID NO: 4204892 - DNA, 16 bp, Homo sapiens
ctctcccctccctctt

SEQ ID NO: 4204893 - DNA, 17 bp, Homo sapiens
ctctcccctccctcttc

SEQ ID NO: 4204894 - DNA, 18 bp, Homo sapiens
ctctcccctgccctgctg

SEQ ID NO: 4204895 - DNA, 15 bp, Homo sapiens
ctctccctgccaagt

SEQ ID NO: 4204896 - DNA, 22 bp, Homo sapiens
ctctcctaccccacctcatgcc

SEQ ID NO: 4204897 - DNA, 23 bp, Homo sapiens
ctctcctcctctgtgctcctgtc

SEQ ID NO: 4204898 - DNA, 16 bp, Homo sapiens
ctctccttcttccctg

SEQ ID NO: 4204899 - DNA, 19 bp, Homo sapiens
ctctcggaaggctggctgg

SEQ ID NO: 4204900 - DNA, 16 bp, Homo sapiens
ctctctaagtttagaa

SEQ ID NO: 4204901 - DNA, 18 bp, Homo sapiens
ctctctacccggcccaga

SEQ ID NO: 4204902 - DNA, 20 bp, Homo sapiens
ctctctacccggcccagaga

SEQ ID NO: 4204903 - DNA, 21 bp, Homo sapiens
ctctctacccggcccagagac

SEQ ID NO: 4204904 - DNA, 20 bp, Homo sapiens
ctctctactcctacctcagc

SEQ ID NO: 4204905 - DNA, 15 bp, Homo sapiens
ctctctctctttcct

SEQ ID NO: 4204906 - DNA, 15 bp, Homo sapiens
ctctctcttcccagc

SEQ ID NO: 4204907 - DNA, 23 bp, Homo sapiens
ctctctggggcagggttattcct

SEQ ID NO: 4204908 - DNA, 16 bp, Homo sapiens
ctctctgttgcgctcc

SEQ ID NO: 4204909 - DNA, 23 bp, Homo sapiens
ctctctgttgcgctcccgcattt

SEQ ID NO: 4204910 - DNA, 14 bp, Homo sapiens
ctctcttgccagca

SEQ ID NO: 4204911 - DNA, 20 bp, Homo sapiens
ctctgaaacttaattacatc

SEQ ID NO: 4204912 - DNA, 17 bp, Homo sapiens
ctctgaatggtccaggg

SEQ ID NO: 4204913 - DNA, 15 bp, Homo sapiens
ctctgacctgcaggc

SEQ ID NO: 4204914 - DNA, 21 bp, Homo sapiens
ctctgagaattccaaggagtt

SEQ ID NO: 4204915 - DNA, 13 bp, Homo sapiens
ctctgcattgcct

SEQ ID NO: 4204916 - DNA, 16 bp, Homo sapiens
ctctgcccgcagagcc

SEQ ID NO: 4204917 - DNA, 22 bp, Homo sapiens
ctctgccttttttcacagcccg

SEQ ID NO: 4204918 - DNA, 18 bp, Homo sapiens
ctctgctgagcagcccag

SEQ ID NO: 4204919 - DNA, 21 bp, Homo sapiens
ctctgctgagcagcccagcac

SEQ ID NO: 4204920 - DNA, 12 bp, Homo sapiens
ctctgctgctcc

SEQ ID NO: 4204921 - DNA, 21 bp, Homo sapiens
ctctgcttactaatgtgcccc

SEQ ID NO: 4204922 - DNA, 22 bp, Homo sapiens
ctctgcttactaatgtgcccca

SEQ ID NO: 4204923 - DNA, 17 bp, Homo sapiens
ctctggaaaactcagga

SEQ ID NO: 4204924 - DNA, 18 bp, Homo sapiens
ctctggaaaactcaggat

SEQ ID NO: 4204925 - DNA, 23 bp, Homo sapiens
ctctggacatgatttagggaagc

SEQ ID NO: 4204926 - DNA, 18 bp, Homo sapiens
ctctggagccaaggcaga

SEQ ID NO: 4204927 - DNA, 15 bp, Homo sapiens
ctctggcctcctggg

SEQ ID NO: 4204928 - DNA, 12 bp, Homo sapiens
ctctggctccag

SEQ ID NO: 4204929 - DNA, 12 bp, Homo sapiens
ctctggcttcca

SEQ ID NO: 4204930 - DNA, 13 bp, Homo sapiens
ctctggcttccag

SEQ ID NO: 4204931 - DNA, 14 bp, Homo sapiens
ctctggcttccagg

SEQ ID NO: 4204932 - DNA, 18 bp, Homo sapiens
ctctggcttccaggtatc

SEQ ID NO: 4204933 - DNA, 13 bp, Homo sapiens
ctctggtctgtag

SEQ ID NO: 4204934 - DNA, 19 bp, Homo sapiens
ctctgtaaccgcttctggg

SEQ ID NO: 4204935 - DNA, 17 bp, Homo sapiens
ctctgtacaaaaacaaa

SEQ ID NO: 4204936 - DNA, 21 bp, Homo sapiens
ctctgtcccggttcaccttgc

SEQ ID NO: 4204937 - DNA, 22 bp, Homo sapiens
ctctgtcccggttcaccttgcc

SEQ ID NO: 4204938 - DNA, 19 bp, Homo sapiens
ctctgtctacttgctcagg

SEQ ID NO: 4204939 - DNA, 14 bp, Homo sapiens
ctctgtcttctgga

SEQ ID NO: 4204940 - DNA, 17 bp, Homo sapiens
ctctgtcttctggactg

SEQ ID NO: 4204941 - DNA, 20 bp, Homo sapiens
ctctgttatgcaagcacaaa

SEQ ID NO: 4204942 - DNA, 21 bp, Homo sapiens
ctctgttatgcaagcacaaat

SEQ ID NO: 4204943 - DNA, 14 bp, Homo sapiens
ctctgttctttata

SEQ ID NO: 4204944 - DNA, 18 bp, Homo sapiens
ctcttaaattatatattt

SEQ ID NO: 4204945 - DNA, 15 bp, Homo sapiens
ctcttataacttctg

SEQ ID NO: 4204946 - DNA, 16 bp, Homo sapiens
ctcttccctccttccc

SEQ ID NO: 4204947 - DNA, 15 bp, Homo sapiens
ctcttcctctgggca

SEQ ID NO: 4204948 - DNA, 14 bp, Homo sapiens
ctcttcctgcaagg

SEQ ID NO: 4204949 - DNA, 16 bp, Homo sapiens
ctcttccttgtgattg

SEQ ID NO: 4204950 - DNA, 22 bp, Homo sapiens
ctcttcttattcatgctttctc

SEQ ID NO: 4204951 - DNA, 15 bp, Homo sapiens
ctcttcttcttcaga

SEQ ID NO: 4204952 - DNA, 15 bp, Homo sapiens
ctcttggcctctgct

SEQ ID NO: 4204953 - DNA, 18 bp, Homo sapiens
ctcttggcctctgctttc

SEQ ID NO: 4204954 - DNA, 15 bp, Homo sapiens
ctctttcatctttta

SEQ ID NO: 4204955 - DNA, 15 bp, Homo sapiens
ctctttccccacctc

SEQ ID NO: 4204956 - DNA, 16 bp, Homo sapiens
ctctttctctccttct

SEQ ID NO: 4204957 - DNA, 23 bp, Homo sapiens
ctctttctctccttcttccctgt

SEQ ID NO: 4204958 - DNA, 12 bp, Homo sapiens
ctctttctgggc

SEQ ID NO: 4204959 - DNA, 20 bp, Homo sapiens
ctctttgccttgatgttgtg

SEQ ID NO: 4204960 - DNA, 19 bp, Homo sapiens
ctgaaaaaaaaaaagaaga

SEQ ID NO: 4204961 - DNA, 20 bp, Homo sapiens
ctgaaaaaaagtttacaagt

SEQ ID NO: 4204962 - DNA, 17 bp, Homo sapiens
ctgaaaaggtttatgaa

SEQ ID NO: 4204963 - DNA, 17 bp, Homo sapiens
ctgaaaatctaatatta

SEQ ID NO: 4204964 - DNA, 22 bp, Homo sapiens
ctgaaatcggaagggacttcct

SEQ ID NO: 4204965 - DNA, 21 bp, Homo sapiens
ctgaaattggtgggaagcaag

SEQ ID NO: 4204966 - DNA, 19 bp, Homo sapiens
ctgccatttgcaccctccg

SEQ ID NO: 4204967 - DNA, 16 bp, Homo sapiens
ctgcccaatctgagca

SEQ ID NO: 4204968 - DNA, 17 bp, Homo sapiens
ctgcccacattggaccc

SEQ ID NO: 4204969 - DNA, 13 bp, Homo sapiens
ctgcccagtctgg

SEQ ID NO: 4204970 - DNA, 19 bp, Homo sapiens
acacgcttaaaacctagaa

SEQ ID NO: 4204971 - DNA, 16 bp, Homo sapiens
acacggggtattttag

SEQ ID NO: 4204972 - DNA, 19 bp, Homo sapiens
acacgtatttatatttgga

SEQ ID NO: 4204973 - DNA, 23 bp, Homo sapiens
acacgtatttatatttggaaaga

SEQ ID NO: 4204974 - DNA, 15 bp, Homo sapiens
acactaaacagacta

SEQ ID NO: 4204975 - DNA, 21 bp, Homo sapiens
acactaaacagactatttaac

SEQ ID NO: 4204976 - DNA, 12 bp, Homo sapiens
acactaattcct

SEQ ID NO: 4204977 - DNA, 23 bp, Homo sapiens
acactaattcctttctatcctac

SEQ ID NO: 4204978 - DNA, 17 bp, Homo sapiens
acactacacactgtgta

SEQ ID NO: 4204979 - DNA, 13 bp, Homo sapiens
acactagcctctc

SEQ ID NO: 4204980 - DNA, 12 bp, Homo sapiens
acactccagcct

SEQ ID NO: 4204981 - DNA, 14 bp, Homo sapiens
acactccagcctga

SEQ ID NO: 4204982 - DNA, 17 bp, Homo sapiens
acactccagcctgagca

SEQ ID NO: 4204983 - DNA, 23 bp, Homo sapiens
acactctagtgacttcctggtga

SEQ ID NO: 4204984 - DNA, 17 bp, Homo sapiens
acactctctgtacaaaa

SEQ ID NO: 4204985 - DNA, 22 bp, Homo sapiens
acactctctgtacaaaaacaaa

SEQ ID NO: 4204986 - DNA, 18 bp, Homo sapiens
acactgcagggctgctgt

SEQ ID NO: 4204987 - DNA, 16 bp, Homo sapiens
acactgcctatatatg

SEQ ID NO: 4204988 - DNA, 20 bp, Homo sapiens
acactggaaaataaattttg

SEQ ID NO: 4204989 - DNA, 14 bp, Homo sapiens
acactgggagaaga

SEQ ID NO: 4204990 - DNA, 16 bp, Homo sapiens
acactgggagaagaga

SEQ ID NO: 4204991 - DNA, 13 bp, Homo sapiens
caatgtgaccagg

SEQ ID NO: 4204992 - DNA, 17 bp, Homo sapiens
caatgtgaccaggggtg

SEQ ID NO: 4204993 - DNA, 19 bp, Homo sapiens
caattattgtacactaaca

SEQ ID NO: 4204994 - DNA, 13 bp, Homo sapiens
caattcaaagctg

SEQ ID NO: 4204995 - DNA, 13 bp, Homo sapiens
caattcctgggcc

SEQ ID NO: 4204996 - DNA, 17 bp, Homo sapiens
caattctctttagttct

SEQ ID NO: 4204997 - DNA, 13 bp, Homo sapiens
caattggctcctc

SEQ ID NO: 4204998 - DNA, 15 bp, Homo sapiens
caattggctcctcca

SEQ ID NO: 4204999 - DNA, 18 bp, Homo sapiens
caattggctcctccatct

SEQ ID NO: 4205000 - DNA, 17 bp, Homo sapiens
caattggggaagaaaaa

SEQ ID NO: 4205001 - DNA, 16 bp, Homo sapiens
caattggttaatcttt

SEQ ID NO: 4205002 - DNA, 14 bp, Homo sapiens
caatttaattccat

SEQ ID NO: 4205003 - DNA, 12 bp, Homo sapiens
caatttcctggc

SEQ ID NO: 4205004 - DNA, 11 bp, Homo sapiens
caatttttcca

SEQ ID NO: 4205005 - DNA, 18 bp, Homo sapiens
cacaaaagttagctgagc

SEQ ID NO: 4205006 - DNA, 20 bp, Homo sapiens
cacaaaattctagaagcaga

SEQ ID NO: 4205007 - DNA, 17 bp, Homo sapiens
cacaaactgtaatacaa

SEQ ID NO: 4205008 - DNA, 19 bp, Homo sapiens
cacaaagacacaggaagaa

SEQ ID NO: 4205009 - DNA, 15 bp, Homo sapiens
cacaaagacatggaa

SEQ ID NO: 4205010 - DNA, 16 bp, Homo sapiens
cacaaagacatggaag

SEQ ID NO: 4205011 - DNA, 15 bp, Homo sapiens
cacaaagccgtgcct

SEQ ID NO: 4205012 - DNA, 17 bp, Homo sapiens
cacaaattgaagcatgt

SEQ ID NO: 4205013 - DNA, 23 bp, Homo sapiens
cacaacagcctgacaacatttct

SEQ ID NO: 4205014 - DNA, 12 bp, Homo sapiens
cacaagaaattt

SEQ ID NO: 4205015 - DNA, 16 bp, Homo sapiens
cacaagagatcagcag

SEQ ID NO: 4205016 - DNA, 17 bp, Homo sapiens
cacaagagatcagcagt

SEQ ID NO: 4205017 - DNA, 21 bp, Homo sapiens
cacaagagatcagcagtggca

SEQ ID NO: 4205018 - DNA, 21 bp, Homo sapiens
cacaagagcccagcagggcct

SEQ ID NO: 4205019 - DNA, 18 bp, Homo sapiens
cacaagccttactcacct

SEQ ID NO: 4205020 - DNA, 22 bp, Homo sapiens
cacaagccttactcacctctct

SEQ ID NO: 4205021 - DNA, 20 bp, Homo sapiens
cacaatctggcttagtgcca

SEQ ID NO: 4205022 - DNA, 21 bp, Homo sapiens
cacaatctggcttagtgccac

SEQ ID NO: 4205023 - DNA, 18 bp, Homo sapiens
cacaatctgggactttca

SEQ ID NO: 4205024 - DNA, 20 bp, Homo sapiens
cacaatggctaattcccaga

SEQ ID NO: 4205025 - DNA, 17 bp, Homo sapiens
cacacagtattaagtga

SEQ ID NO: 4205026 - DNA, 20 bp, Homo sapiens
cacacagtctcagtccagat

SEQ ID NO: 4205027 - DNA, 15 bp, Homo sapiens
cacaccaatcagaga

SEQ ID NO: 4205028 - DNA, 22 bp, Homo sapiens
cacaccaatcagagagcctaga

SEQ ID NO: 4205029 - DNA, 16 bp, Homo sapiens
cacacctcacgctctg

SEQ ID NO: 4205030 - DNA, 14 bp, Homo sapiens
cacacctgacaaat

SEQ ID NO: 4205031 - DNA, 16 bp, Homo sapiens
cacacctgacaaatgg

SEQ ID NO: 4205032 - DNA, 18 bp, Homo sapiens
cacacctgacaaatggaa

SEQ ID NO: 4205033 - DNA, 20 bp, Homo sapiens
cacacgcaggaactcccagc

SEQ ID NO: 4205034 - DNA, 22 bp, Homo sapiens
cacacgtatttatatttggaaa

SEQ ID NO: 4205035 - DNA, 17 bp, Homo sapiens
cacactagcctctccag

SEQ ID NO: 4205036 - DNA, 18 bp, Homo sapiens
cacactagcctctccagg

SEQ ID NO: 4205037 - DNA, 19 bp, Homo sapiens
cacactagcctctccagga

SEQ ID NO: 4205038 - DNA, 12 bp, Homo sapiens
cacactcagcag

SEQ ID NO: 4205039 - DNA, 15 bp, Homo sapiens
cacactcagcagccc

SEQ ID NO: 4205040 - DNA, 20 bp, Homo sapiens
cacactgcagggctgctgtg

SEQ ID NO: 4205041 - DNA, 21 bp, Homo sapiens
cacacttcttgaaacagcctg

SEQ ID NO: 4205042 - DNA, 22 bp, Homo sapiens
cacacttcttgaaacagcctgg

SEQ ID NO: 4205043 - DNA, 21 bp, Homo sapiens
cacagaagtccctaggaggga

SEQ ID NO: 4205044 - DNA, 13 bp, Homo sapiens
cacagagcctggc

SEQ ID NO: 4205045 - DNA, 18 bp, Homo sapiens
cacagagcctggctttgg

SEQ ID NO: 4205046 - DNA, 21 bp, Homo sapiens
cacagagctggcgactgcagc

SEQ ID NO: 4205047 - DNA, 16 bp, Homo sapiens
cacagatgtgtctggg

SEQ ID NO: 4205048 - DNA, 17 bp, Homo sapiens
cacagcccacggggatc

SEQ ID NO: 4205049 - DNA, 15 bp, Homo sapiens
cacagcctctccctt

SEQ ID NO: 4205050 - DNA, 16 bp, Homo sapiens
cacagctaggcatgcc

SEQ ID NO: 4205051 - DNA, 24 bp, Homo sapiens
cacaggatcctattctcaccagga

SEQ ID NO: 4205052 - DNA, 14 bp, Homo sapiens
cacaggctcagcat

SEQ ID NO: 4205053 - DNA, 15 bp, Homo sapiens
cacaggctcagcatg

SEQ ID NO: 4205054 - DNA, 13 bp, Homo sapiens
cacagggcagagc

SEQ ID NO: 4205055 - DNA, 22 bp, Homo sapiens
cacaggggcaaagaactgcccc

SEQ ID NO: 4205056 - DNA, 23 bp, Homo sapiens
cacaggggcaaagaactgcccca

SEQ ID NO: 4205057 - DNA, 18 bp, Homo sapiens
cacaggtgttggaagcca

SEQ ID NO: 4205058 - DNA, 23 bp, Homo sapiens
cacaggttctgcgttacaacagt

SEQ ID NO: 4205059 - DNA, 16 bp, Homo sapiens
cacagtctagattaga

SEQ ID NO: 4205060 - DNA, 13 bp, Homo sapiens
cacagtctcagtc

SEQ ID NO: 4205061 - DNA, 19 bp, Homo sapiens
cacagtctcagtccagatg

SEQ ID NO: 4205062 - DNA, 20 bp, Homo sapiens
cacagtgaatgtgtgtatgt

SEQ ID NO: 4205063 - DNA, 21 bp, Homo sapiens
cacagtgaatgtgtgtatgta

SEQ ID NO: 4205064 - DNA, 19 bp, Homo sapiens
cacagttcgacctgcggct

SEQ ID NO: 4205065 - DNA, 22 bp, Homo sapiens
cacagttggctggatgaaattt

SEQ ID NO: 4205066 - DNA, 19 bp, Homo sapiens
cacatactcatttttcatg

SEQ ID NO: 4205067 - DNA, 14 bp, Homo sapiens
cacatatttcacat

SEQ ID NO: 4205068 - DNA, 16 bp, Homo sapiens
cacatcaactttatgt

SEQ ID NO: 4205069 - DNA, 16 bp, Homo sapiens
cacatggacacagacc

SEQ ID NO: 4205070 - DNA, 20 bp, Homo sapiens
cacatgtctgtcctcagagc

SEQ ID NO: 4205071 - DNA, 14 bp, Homo sapiens
cacatgtttatatt

SEQ ID NO: 4205072 - DNA, 17 bp, Homo sapiens
cacattaagtggctttt

SEQ ID NO: 4205073 - DNA, 21 bp, Homo sapiens
cacattagaagacaattgaca

SEQ ID NO: 4205074 - DNA, 16 bp, Homo sapiens
cacattgacagtggtg

SEQ ID NO: 4205075 - DNA, 21 bp, Homo sapiens
cacattttacttagctggaga

SEQ ID NO: 4205076 - DNA, 14 bp, Homo sapiens
caccaaggtcttca

SEQ ID NO: 4205077 - DNA, 23 bp, Homo sapiens
caccaccttggactcctcccaca

SEQ ID NO: 4205078 - DNA, 21 bp, Homo sapiens
caccactagggtcctggccct

SEQ ID NO: 4205079 - DNA, 23 bp, Homo sapiens
caccactagggtcctggccctct

SEQ ID NO: 4205080 - DNA, 21 bp, Homo sapiens
caccagacccacctggagccc

SEQ ID NO: 4205081 - DNA, 17 bp, Homo sapiens
caccagcttctccaggc

SEQ ID NO: 4205082 - DNA, 19 bp, Homo sapiens
caccagcttctccaggctc

SEQ ID NO: 4205083 - DNA, 17 bp, Homo sapiens
caccaggactttaatct

SEQ ID NO: 4205084 - DNA, 15 bp, Homo sapiens
caccagtgaggctct

SEQ ID NO: 4205085 - DNA, 17 bp, Homo sapiens
caccatccaccctgcag

SEQ ID NO: 4205086 - DNA, 13 bp, Homo sapiens
caccatcctgctg

SEQ ID NO: 4205087 - DNA, 19 bp, Homo sapiens
cacccactgtccgcctctg

SEQ ID NO: 4205088 - DNA, 22 bp, Homo sapiens
cacccagggctccctcctggag

SEQ ID NO: 4205089 - DNA, 22 bp, Homo sapiens
cacccatgaagacaggacagtg

SEQ ID NO: 4205090 - DNA, 15 bp, Homo sapiens
cacccattttcacat

SEQ ID NO: 4205091 - DNA, 23 bp, Homo sapiens
caccccacattggacttccttgg

SEQ ID NO: 4205092 - DNA, 11 bp, Homo sapiens
caccccagagt

SEQ ID NO: 4205093 - DNA, 12 bp, Homo sapiens
caccccagagtt

SEQ ID NO: 4205094 - DNA, 13 bp, Homo sapiens
caccccagagttg

SEQ ID NO: 4205095 - DNA, 14 bp, Homo sapiens
caccccctcattcc

SEQ ID NO: 4205096 - DNA, 20 bp, Homo sapiens
caccccttatccaggactct

SEQ ID NO: 4205097 - DNA, 18 bp, Homo sapiens
caccctcgtggacacctg

SEQ ID NO: 4205098 - DNA, 15 bp, Homo sapiens
caccctctgccccag

SEQ ID NO: 4205099 - DNA, 16 bp, Homo sapiens
caccctctgccccaga

SEQ ID NO: 4205100 - DNA, 19 bp, Homo sapiens
caccctgcagagctatggt

SEQ ID NO: 4205101 - DNA, 11 bp, Homo sapiens
caccctggaat

SEQ ID NO: 4205102 - DNA, 18 bp, Homo sapiens
caccgagacggctggacc

SEQ ID NO: 4205103 - DNA, 13 bp, Homo sapiens
caccgcagaagga

SEQ ID NO: 4205104 - DNA, 15 bp, Homo sapiens
caccgcagaaggaag

SEQ ID NO: 4205105 - DNA, 14 bp, Homo sapiens
cacctcacgctctg

SEQ ID NO: 4205106 - DNA, 16 bp, Homo sapiens
cacctcacgctctgga

SEQ ID NO: 4205107 - DNA, 23 bp, Homo sapiens
cacctcaggccaggtgcagtggc

SEQ ID NO: 4205108 - DNA, 19 bp, Homo sapiens
cacctcatgcctggccccc

SEQ ID NO: 4205109 - DNA, 22 bp, Homo sapiens
cacctctcaatattcaataaag

SEQ ID NO: 4205110 - DNA, 23 bp, Homo sapiens
cacctctcaatattcaataaagc

SEQ ID NO: 4205111 - DNA, 23 bp, Homo sapiens
cacctctggctttgtctctagcc

SEQ ID NO: 4205112 - DNA, 22 bp, Homo sapiens
cacctcttcttttcacctcttt

SEQ ID NO: 4205113 - DNA, 19 bp, Homo sapiens
cacctctttaaccactcct

SEQ ID NO: 4205114 - DNA, 14 bp, Homo sapiens
cacctgaaccactg

SEQ ID NO: 4205115 - DNA, 16 bp, Homo sapiens
cacctgacaaatggaa

SEQ ID NO: 4205116 - DNA, 18 bp, Homo sapiens
cacctgaggttaggagtt

SEQ ID NO: 4205117 - DNA, 13 bp, Homo sapiens
cacctgccagcct

SEQ ID NO: 4205118 - DNA, 15 bp, Homo sapiens
cacctgccagcctgg

SEQ ID NO: 4205119 - DNA, 16 bp, Homo sapiens
cacctgccagcctggc

SEQ ID NO: 4205120 - DNA, 17 bp, Homo sapiens
cacctgccagcctggct

SEQ ID NO: 4205121 - DNA, 22 bp, Homo sapiens
cacctgccagcctggcttctgg

SEQ ID NO: 4205122 - DNA, 17 bp, Homo sapiens
cacctgccatttgcacc

SEQ ID NO: 4205123 - DNA, 15 bp, Homo sapiens
cacctgccccctggt

SEQ ID NO: 4205124 - DNA, 13 bp, Homo sapiens
cacctgccctgcc

SEQ ID NO: 4205125 - DNA, 20 bp, Homo sapiens
caggggcaaagaactgcccc

SEQ ID NO: 4205126 - DNA, 13 bp, Homo sapiens
caggggtgggaga

SEQ ID NO: 4205127 - DNA, 15 bp, Homo sapiens
caggggtgggagagc

SEQ ID NO: 4205128 - DNA, 21 bp, Homo sapiens
caggggtgggagagccagctc

SEQ ID NO: 4205129 - DNA, 19 bp, Homo sapiens
cagggtcctgggggctgct

SEQ ID NO: 4205130 - DNA, 22 bp, Homo sapiens
cagggtcctgggggctgctgca

SEQ ID NO: 4205131 - DNA, 22 bp, Homo sapiens
cagggtctaaagagaacaagag

SEQ ID NO: 4205132 - DNA, 17 bp, Homo sapiens
cagggtgggccactctc

SEQ ID NO: 4205133 - DNA, 17 bp, Homo sapiens
cagggttatacacagaa

SEQ ID NO: 4205134 - DNA, 18 bp, Homo sapiens
cagggttgatcacactct

SEQ ID NO: 4205135 - DNA, 20 bp, Homo sapiens
cagggtttcggaaatcatta

SEQ ID NO: 4205136 - DNA, 15 bp, Homo sapiens
caggtaagtggcagg

SEQ ID NO: 4205137 - DNA, 16 bp, Homo sapiens
caggtaagtggcagga

SEQ ID NO: 4205138 - DNA, 21 bp, Homo sapiens
caggtacttgtaaattattaa

SEQ ID NO: 4205139 - DNA, 21 bp, Homo sapiens
caggtaggggcacagtgaatg

SEQ ID NO: 4205140 - DNA, 23 bp, Homo sapiens
caggtagttggtgaacagagaga

SEQ ID NO: 4205141 - DNA, 14 bp, Homo sapiens
caggtatctccagg

SEQ ID NO: 4205142 - DNA, 16 bp, Homo sapiens
caggtatctccaggat

SEQ ID NO: 4205143 - DNA, 15 bp, Homo sapiens
caggtcaacatctaa

SEQ ID NO: 4205144 - DNA, 21 bp, Homo sapiens
caggtcaccagcctgactgca

SEQ ID NO: 4205145 - DNA, 12 bp, Homo sapiens
caggtgcagtgg

SEQ ID NO: 4205146 - DNA, 14 bp, Homo sapiens
caggtgcctggctt

SEQ ID NO: 4205147 - DNA, 18 bp, Homo sapiens
caggtggcaggaccagga

SEQ ID NO: 4205148 - DNA, 16 bp, Homo sapiens
caggtggtcctgagac

SEQ ID NO: 4205149 - DNA, 15 bp, Homo sapiens
caggtttgctgtgtc

SEQ ID NO: 4205150 - DNA, 13 bp, Homo sapiens
cagtaacactggc

SEQ ID NO: 4205151 - DNA, 16 bp, Homo sapiens
cagtaacactggcctt

SEQ ID NO: 4205152 - DNA, 14 bp, Homo sapiens
cagtaagtcttttt

SEQ ID NO: 4205153 - DNA, 22 bp, Homo sapiens
cagtacagagaaattctgtggt

SEQ ID NO: 4205154 - DNA, 16 bp, Homo sapiens
cagtagactcatcttt

SEQ ID NO: 4205155 - DNA, 19 bp, Homo sapiens
cagtagctgagtgcactcc

SEQ ID NO: 4205156 - DNA, 19 bp, Homo sapiens
cagtaggaaatcaggcagt

SEQ ID NO: 4205157 - DNA, 19 bp, Homo sapiens
cagtaggaacccagctctc

SEQ ID NO: 4205158 - DNA, 18 bp, Homo sapiens
cagtaggtttgtgtggat

SEQ ID NO: 4205159 - DNA, 21 bp, Homo sapiens
cagtatctcttgctgggaaca

SEQ ID NO: 4205160 - DNA, 22 bp, Homo sapiens
cagtatctcttgctgggaacac

SEQ ID NO: 4205161 - DNA, 17 bp, Homo sapiens
cagtattctcagtgctc

SEQ ID NO: 4205162 - DNA, 19 bp, Homo sapiens
cagtattttggagaaatta

SEQ ID NO: 4205163 - DNA, 20 bp, Homo sapiens
cagtattttggagaaattat

SEQ ID NO: 4205164 - DNA, 21 bp, Homo sapiens
cagtattttggagaaattatt

SEQ ID NO: 4205165 - DNA, 14 bp, Homo sapiens
cagtcatgaggaaa

SEQ ID NO: 4205166 - DNA, 19 bp, Homo sapiens
cagtcatgaggaaagacac

SEQ ID NO: 4205167 - DNA, 21 bp, Homo sapiens
cagtcccttgctgacatggct

SEQ ID NO: 4205168 - DNA, 20 bp, Homo sapiens
cagtccgccaaacactccac

SEQ ID NO: 4205169 - DNA, 22 bp, Homo sapiens
cagtccgccaaacactccaccc

SEQ ID NO: 4205170 - DNA, 17 bp, Homo sapiens
cagtcctcacagcctct

SEQ ID NO: 4205171 - DNA, 20 bp, Homo sapiens
cagtcctcacagcctctccc

SEQ ID NO: 4205172 - DNA, 22 bp, Homo sapiens
cagtcctcacagcctctccctt

SEQ ID NO: 4205173 - DNA, 13 bp, Homo sapiens
cagtcctgggaga

SEQ ID NO: 4205174 - DNA, 15 bp, Homo sapiens
cagtcgtccgctcag

SEQ ID NO: 4205175 - DNA, 17 bp, Homo sapiens
cagtcgttggcaccttc

SEQ ID NO: 4205176 - DNA, 21 bp, Homo sapiens
cagtctcagaatgtcattttg

SEQ ID NO: 4205177 - DNA, 13 bp, Homo sapiens
cagtctcaggagc

SEQ ID NO: 4205178 - DNA, 18 bp, Homo sapiens
cagtctcaggagcatggg

SEQ ID NO: 4205179 - DNA, 17 bp, Homo sapiens
cagtctcagtccagatg

SEQ ID NO: 4205180 - DNA, 19 bp, Homo sapiens
cagtctggaagaagaggag

SEQ ID NO: 4205181 - DNA, 21 bp, Homo sapiens
cagtctggaagaagaggagga

SEQ ID NO: 4205182 - DNA, 19 bp, Homo sapiens
cagtgaacacactcagcag

SEQ ID NO: 4205183 - DNA, 15 bp, Homo sapiens
cagtgaagacagaag

SEQ ID NO: 4205184 - DNA, 16 bp, Homo sapiens
cagtgaagacagaagt

SEQ ID NO: 4205185 - DNA, 17 bp, Homo sapiens
cagtgacaaaaggctcg

SEQ ID NO: 4205186 - DNA, 16 bp, Homo sapiens
cagtgacgtgcacctg

SEQ ID NO: 4205187 - DNA, 22 bp, Homo sapiens
cagtgacgtgcacctgtactca

SEQ ID NO: 4205188 - DNA, 18 bp, Homo sapiens
cagtgagattacagagga

SEQ ID NO: 4205189 - DNA, 19 bp, Homo sapiens
cagtgagattacagaggaa

SEQ ID NO: 4205190 - DNA, 21 bp, Homo sapiens
cagtgaggctctattgagcca

SEQ ID NO: 4205191 - DNA, 15 bp, Homo sapiens
cagtgagggctgggc

SEQ ID NO: 4205192 - DNA, 22 bp, Homo sapiens
cagtgagttacagcgagaggca

SEQ ID NO: 4205193 - DNA, 17 bp, Homo sapiens
cagtgatgggagagtag

SEQ ID NO: 4205194 - DNA, 16 bp, Homo sapiens
cagtgattgtcttaat

SEQ ID NO: 4205195 - DNA, 11 bp, Homo sapiens
cagtgcaagag

SEQ ID NO: 4205196 - DNA, 11 bp, Homo sapiens
cagtgccacag

SEQ ID NO: 4205197 - DNA, 14 bp, Homo sapiens
cagtgccacagaga

SEQ ID NO: 4205198 - DNA, 22 bp, Homo sapiens
cagtgctctcctaccccacctc

SEQ ID NO: 4205199 - DNA, 18 bp, Homo sapiens
cagtgctgattcagcctg

SEQ ID NO: 4205200 - DNA, 13 bp, Homo sapiens
cagtgctgccctg

SEQ ID NO: 4205201 - DNA, 14 bp, Homo sapiens
cagtgctgccctgc

SEQ ID NO: 4205202 - DNA, 16 bp, Homo sapiens
cagtgctgccctgcga

SEQ ID NO: 4205203 - DNA, 19 bp, Homo sapiens
cagtgctggatttgatgag

SEQ ID NO: 4205204 - DNA, 12 bp, Homo sapiens
cagtgctgtggc

SEQ ID NO: 4205205 - DNA, 13 bp, Homo sapiens
cagtgctgtggcc

SEQ ID NO: 4205206 - DNA, 14 bp, Homo sapiens
cagtgcttcagcct

SEQ ID NO: 4205207 - DNA, 19 bp, Homo sapiens
cagtgcttcagcctgaggc

SEQ ID NO: 4205208 - DNA, 20 bp, Homo sapiens
cagtgcttcagcctgaggct

SEQ ID NO: 4205209 - DNA, 20 bp, Homo sapiens
cagtggaaaaatcagaagca

SEQ ID NO: 4205210 - DNA, 20 bp, Homo sapiens
cagtggtaagctctggcttt

SEQ ID NO: 4205211 - DNA, 14 bp, Homo sapiens
cagtggtgaagaaa

SEQ ID NO: 4205212 - DNA, 23 bp, Homo sapiens
cagtggtgaagaaaactccttta

SEQ ID NO: 4205213 - DNA, 19 bp, Homo sapiens
cagtgtgaatatatggtct

SEQ ID NO: 4205214 - DNA, 22 bp, Homo sapiens
cagtgtgatcccaagtgccagt

SEQ ID NO: 4205215 - DNA, 20 bp, Homo sapiens
cagtgtggtctcttacatgg

SEQ ID NO: 4205216 - DNA, 20 bp, Homo sapiens
cagtgtgtgtttaacattca

SEQ ID NO: 4205217 - DNA, 13 bp, Homo sapiens
cagttactatttt

SEQ ID NO: 4205218 - DNA, 19 bp, Homo sapiens
cagttcataatatatggaa

SEQ ID NO: 4205219 - DNA, 18 bp, Homo sapiens
cagttcctctttgcatgg

SEQ ID NO: 4205220 - DNA, 14 bp, Homo sapiens
cagttgacagcagg

SEQ ID NO: 4205221 - DNA, 17 bp, Homo sapiens
cagttgattttctggat

SEQ ID NO: 4205222 - DNA, 18 bp, Homo sapiens
cagttgccgtctaggatt

SEQ ID NO: 4205223 - DNA, 16 bp, Homo sapiens
cagttgggagtgagtt

SEQ ID NO: 4205224 - DNA, 18 bp, Homo sapiens
cagttgttactgaagtta

SEQ ID NO: 4205225 - DNA, 22 bp, Homo sapiens
cagttgttactgaagttatctg

SEQ ID NO: 4205226 - DNA, 13 bp, Homo sapiens
cagttgttttccc

SEQ ID NO: 4205227 - DNA, 17 bp, Homo sapiens
cagtttatatttaactc

SEQ ID NO: 4205228 - DNA, 14 bp, Homo sapiens
cagtttcagaagca

SEQ ID NO: 4205229 - DNA, 15 bp, Homo sapiens
cagtttcagaagcag

SEQ ID NO: 4205230 - DNA, 19 bp, Homo sapiens
cagtttcagaagcaggcag

SEQ ID NO: 4205231 - DNA, 16 bp, Homo sapiens
cagtttgtgatttcta

SEQ ID NO: 4205232 - DNA, 18 bp, Homo sapiens
cataaactgtacaaatga

SEQ ID NO: 4205233 - DNA, 17 bp, Homo sapiens
cataaagcctctgactc

SEQ ID NO: 4205234 - DNA, 19 bp, Homo sapiens
cataactagtttaattaac

SEQ ID NO: 4205235 - DNA, 16 bp, Homo sapiens
cataagaccctaagcc

SEQ ID NO: 4205236 - DNA, 20 bp, Homo sapiens
cataagaccctaagcctcct

SEQ ID NO: 4205237 - DNA, 12 bp, Homo sapiens
cataagattaaa

SEQ ID NO: 4205238 - DNA, 15 bp, Homo sapiens
cataagattaaagga

SEQ ID NO: 4205239 - DNA, 22 bp, Homo sapiens
cataagattaaaggaaggaaaa

SEQ ID NO: 4205240 - DNA, 16 bp, Homo sapiens
cataagcaagtgagca

SEQ ID NO: 4205241 - DNA, 18 bp, Homo sapiens
cataagcaagtgagcaga

SEQ ID NO: 4205242 - DNA, 21 bp, Homo sapiens
cataattcactctgagtgttt

SEQ ID NO: 4205243 - DNA, 14 bp, Homo sapiens
cataattgctttgc

SEQ ID NO: 4205244 - DNA, 20 bp, Homo sapiens
cataccgaccatcgtccagc

SEQ ID NO: 4205245 - DNA, 21 bp, Homo sapiens
cataccgaccatcgtccagcc

SEQ ID NO: 4205246 - DNA, 22 bp, Homo sapiens
cataccgaccatcgtccagccc

SEQ ID NO: 4205247 - DNA, 16 bp, Homo sapiens
catacgtgttctatag

SEQ ID NO: 4205248 - DNA, 19 bp, Homo sapiens
catagacagaagaaacaag

SEQ ID NO: 4205249 - DNA, 22 bp, Homo sapiens
catagagggagaggaagcacac

SEQ ID NO: 4205250 - DNA, 15 bp, Homo sapiens
catagagtttaacac

SEQ ID NO: 4205251 - DNA, 18 bp, Homo sapiens
catagagtttaacacaag

SEQ ID NO: 4205252 - DNA, 18 bp, Homo sapiens
catagattgagaagtttt

SEQ ID NO: 4205253 - DNA, 22 bp, Homo sapiens
cataggttcacaccattttgtt

SEQ ID NO: 4205254 - DNA, 18 bp, Homo sapiens
catagttatttacttgaa

SEQ ID NO: 4205255 - DNA, 19 bp, Homo sapiens
catagttatttacttgaaa

SEQ ID NO: 4205256 - DNA, 15 bp, Homo sapiens
catagtttcttggcc

SEQ ID NO: 4205257 - DNA, 22 bp, Homo sapiens
catagtttcttggccactgaat

SEQ ID NO: 4205258 - DNA, 21 bp, Homo sapiens
catataaaaggtgagctcagc

SEQ ID NO: 4205259 - DNA, 15 bp, Homo sapiens
ccagaaaaccccagc

SEQ ID NO: 4205260 - DNA, 16 bp, Homo sapiens
ccagaaaaccccagca

SEQ ID NO: 4205261 - DNA, 17 bp, Homo sapiens
ccagaaattagaaacct

SEQ ID NO: 4205262 - DNA, 16 bp, Homo sapiens
ccagaacaattctgca

SEQ ID NO: 4205263 - DNA, 20 bp, Homo sapiens
ccagaacttgaccctgagct

SEQ ID NO: 4205264 - DNA, 16 bp, Homo sapiens
ccagacccacctggag

SEQ ID NO: 4205265 - DNA, 18 bp, Homo sapiens
ccagacccacctggagcc

SEQ ID NO: 4205266 - DNA, 22 bp, Homo sapiens
ccagacccacctggagcccgct

SEQ ID NO: 4205267 - DNA, 15 bp, Homo sapiens
ccagagaaccattcc

SEQ ID NO: 4205268 - DNA, 16 bp, Homo sapiens
ccagagaattcttaga

SEQ ID NO: 4205269 - DNA, 18 bp, Homo sapiens
ccagagaccccttccttt

SEQ ID NO: 4205270 - DNA, 21 bp, Homo sapiens
ccagagagaggatgcagaggg

SEQ ID NO: 4205271 - DNA, 23 bp, Homo sapiens
ccagagcattacgtgagccaggt

SEQ ID NO: 4205272 - DNA, 20 bp, Homo sapiens
ccagagccactacctttgtc

SEQ ID NO: 4205273 - DNA, 17 bp, Homo sapiens
ccagagccttcaagtgc

SEQ ID NO: 4205274 - DNA, 23 bp, Homo sapiens
ccagaggggtgggttcctcttcc

SEQ ID NO: 4205275 - DNA, 17 bp, Homo sapiens
ccagatcctcacaacca

SEQ ID NO: 4205276 - DNA, 19 bp, Homo sapiens
ccagatctgcactgggtgt

SEQ ID NO: 4205277 - DNA, 18 bp, Homo sapiens
ccagatgattttcctccc

SEQ ID NO: 4205278 - DNA, 16 bp, Homo sapiens
ccagatgcagctcaag

SEQ ID NO: 4205279 - DNA, 18 bp, Homo sapiens
ccagatggaaaaataaca

SEQ ID NO: 4205280 - DNA, 17 bp, Homo sapiens
ccagcaatatgtaaata

SEQ ID NO: 4205281 - DNA, 19 bp, Homo sapiens
ccagcacaactcagtctgt

SEQ ID NO: 4205282 - DNA, 10 bp, Homo sapiens
ccagcactga

SEQ ID NO: 4205283 - DNA, 21 bp, Homo sapiens
ccagcactttgggaggccaag

SEQ ID NO: 4205284 - DNA, 21 bp, Homo sapiens
ccagcactttgggaggctgag

SEQ ID NO: 4205285 - DNA, 13 bp, Homo sapiens
ccagcaggcaggc

SEQ ID NO: 4205286 - DNA, 19 bp, Homo sapiens
ccagcaggcaggcactgtg

SEQ ID NO: 4205287 - DNA, 22 bp, Homo sapiens
ccagcaggcaggcactgtggcc

SEQ ID NO: 4205288 - DNA, 16 bp, Homo sapiens
ccagcagttgtaaaat

SEQ ID NO: 4205289 - DNA, 21 bp, Homo sapiens
ccagccactcgggaggctgag

SEQ ID NO: 4205290 - DNA, 22 bp, Homo sapiens
ccagccaggatcccaagcgtcc

SEQ ID NO: 4205291 - DNA, 21 bp, Homo sapiens
ccagccattaccatggagaca

SEQ ID NO: 4205292 - DNA, 12 bp, Homo sapiens
ccagccctccta

SEQ ID NO: 4205293 - DNA, 16 bp, Homo sapiens
ccagccctcctacgca

SEQ ID NO: 4205294 - DNA, 22 bp, Homo sapiens
ccagccctttgcaggcccagca

SEQ ID NO: 4205295 - DNA, 14 bp, Homo sapiens
ccagccggtgcctg

SEQ ID NO: 4205296 - DNA, 16 bp, Homo sapiens
ccagccggtgcctggc

SEQ ID NO: 4205297 - DNA, 18 bp, Homo sapiens
ccagcctcttatcactgg

SEQ ID NO: 4205298 - DNA, 23 bp, Homo sapiens
ccagcctgggcgacagagcaaga

SEQ ID NO: 4205299 - DNA, 18 bp, Homo sapiens
ccagcctgtcctggtaca

SEQ ID NO: 4205300 - DNA, 23 bp, Homo sapiens
ccagcgcggctcccgccaccctc

SEQ ID NO: 4205301 - DNA, 13 bp, Homo sapiens
ccagcgtgtgtat

SEQ ID NO: 4205302 - DNA, 14 bp, Homo sapiens
ccagcgtgtgtatc

SEQ ID NO: 4205303 - DNA, 15 bp, Homo sapiens
ccagctacccaggag

SEQ ID NO: 4205304 - DNA, 16 bp, Homo sapiens
ccagctacccaggagg

SEQ ID NO: 4205305 - DNA, 11 bp, Homo sapiens
ccagctcctct

SEQ ID NO: 4205306 - DNA, 13 bp, Homo sapiens
ccagctcctctga

SEQ ID NO: 4205307 - DNA, 17 bp, Homo sapiens
ccagctcctctgagcca

SEQ ID NO: 4205308 - DNA, 12 bp, Homo sapiens
ccagctctggct

SEQ ID NO: 4205309 - DNA, 18 bp, Homo sapiens
ccagctgcacctgccagc

SEQ ID NO: 4205310 - DNA, 12 bp, Homo sapiens
ccagctgcagat

SEQ ID NO: 4205311 - DNA, 23 bp, Homo sapiens
ccagctgcagatgccacacctgc

SEQ ID NO: 4205312 - DNA, 13 bp, Homo sapiens
ccagctgcctggg

SEQ ID NO: 4205313 - DNA, 15 bp, Homo sapiens
ccagctgtcgcatct

SEQ ID NO: 4205314 - DNA, 15 bp, Homo sapiens
ccagctgtgcttatg

SEQ ID NO: 4205315 - DNA, 21 bp, Homo sapiens
ccagctgtgcttatggtacca

SEQ ID NO: 4205316 - DNA, 17 bp, Homo sapiens
ccagcttctccaggctc

SEQ ID NO: 4205317 - DNA, 15 bp, Homo sapiens
ccagcttgctgaggg

SEQ ID NO: 4205318 - DNA, 17 bp, Homo sapiens
ccagctttttctctcag

SEQ ID NO: 4205319 - DNA, 14 bp, Homo sapiens
ccaggaactggctc

SEQ ID NO: 4205320 - DNA, 15 bp, Homo sapiens
ccaggaactggctcc

SEQ ID NO: 4205321 - DNA, 20 bp, Homo sapiens
ccaggaactggctcctttgc

SEQ ID NO: 4205322 - DNA, 21 bp, Homo sapiens
ccaggaagggggtccacccag

SEQ ID NO: 4205323 - DNA, 16 bp, Homo sapiens
ccaggaatctgccatt

SEQ ID NO: 4205324 - DNA, 18 bp, Homo sapiens
ccaggactatagcccagg

SEQ ID NO: 4205325 - DNA, 22 bp, Homo sapiens
ccaggactatagcccaggtcct

SEQ ID NO: 4205326 - DNA, 23 bp, Homo sapiens
ccaggactgtgataatcagaagc

SEQ ID NO: 4205327 - DNA, 19 bp, Homo sapiens
ccaggagctctctgctgag

SEQ ID NO: 4205328 - DNA, 22 bp, Homo sapiens
ccaggagctctctgctgagcag

SEQ ID NO: 4205329 - DNA, 23 bp, Homo sapiens
ccaggagctctctgctgagcagc

SEQ ID NO: 4205330 - DNA, 18 bp, Homo sapiens
ccaggaggctgaggcagg

SEQ ID NO: 4205331 - DNA, 21 bp, Homo sapiens
ccaggaggtcaagcctgcagc

SEQ ID NO: 4205332 - DNA, 17 bp, Homo sapiens
ccaggatctttgactga

SEQ ID NO: 4205333 - DNA, 20 bp, Homo sapiens
ccaggatggcccttcccact

SEQ ID NO: 4205334 - DNA, 18 bp, Homo sapiens
ccaggattgcactgacat

SEQ ID NO: 4205335 - DNA, 17 bp, Homo sapiens
ccaggcaccccctggag

SEQ ID NO: 4205336 - DNA, 19 bp, Homo sapiens
ccaggcaccccctggagag

SEQ ID NO: 4205337 - DNA, 12 bp, Homo sapiens
ccaggcaggagg

SEQ ID NO: 4205338 - DNA, 13 bp, Homo sapiens
ccaggcaggagga

SEQ ID NO: 4205339 - DNA, 17 bp, Homo sapiens
ccaggcatgctggcctc

SEQ ID NO: 4205340 - DNA, 18 bp, Homo sapiens
ccaggcatgctggcctcc

SEQ ID NO: 4205341 - DNA, 12 bp, Homo sapiens
ccaggccaccag

SEQ ID NO: 4205342 - DNA, 15 bp, Homo sapiens
ccaggccaccaggat

SEQ ID NO: 4205343 - DNA, 18 bp, Homo sapiens
ccaggccaggccaccagg

SEQ ID NO: 4205344 - DNA, 15 bp, Homo sapiens
ccaggctctgcctgg

SEQ ID NO: 4205345 - DNA, 18 bp, Homo sapiens
ccagggacacctgggaga

SEQ ID NO: 4205346 - DNA, 15 bp, Homo sapiens
ccagggcactgtctg

SEQ ID NO: 4205347 - DNA, 16 bp, Homo sapiens
ccagggccagggccct

SEQ ID NO: 4205348 - DNA, 15 bp, Homo sapiens
ccagggccaggggtc

SEQ ID NO: 4205349 - DNA, 18 bp, Homo sapiens
ccagggcccaaagcccag

SEQ ID NO: 4205350 - DNA, 15 bp, Homo sapiens
ccagggccctgcaga

SEQ ID NO: 4205351 - DNA, 13 bp, Homo sapiens
ccagggctgcccc

SEQ ID NO: 4205352 - DNA, 16 bp, Homo sapiens
ccagggctgcccctgt

SEQ ID NO: 4205353 - DNA, 17 bp, Homo sapiens
ccaggggtctccctgga

SEQ ID NO: 4205354 - DNA, 18 bp, Homo sapiens
ccaggggtctccctggag

SEQ ID NO: 4205355 - DNA, 21 bp, Homo sapiens
ccaggggtgatttcagagagg

SEQ ID NO: 4205356 - DNA, 14 bp, Homo sapiens
ccagggtgagagct

SEQ ID NO: 4205357 - DNA, 16 bp, Homo sapiens
ccagggtgagagctgc

SEQ ID NO: 4205358 - DNA, 22 bp, Homo sapiens
ccagggtgagagctgctctgga

SEQ ID NO: 4205359 - DNA, 23 bp, Homo sapiens
ccagggtgagagctgctctggaa

SEQ ID NO: 4205360 - DNA, 16 bp, Homo sapiens
ccaggtaatgagggac

SEQ ID NO: 4205361 - DNA, 16 bp, Homo sapiens
ccaggtatctccagga

SEQ ID NO: 4205362 - DNA, 14 bp, Homo sapiens
ccaggtcctctgat

SEQ ID NO: 4205363 - DNA, 14 bp, Homo sapiens
ccaggtttgctgtg

SEQ ID NO: 4205364 - DNA, 20 bp, Homo sapiens
ccagtccgccaaacactcca

SEQ ID NO: 4205365 - DNA, 21 bp, Homo sapiens
ccagtccgccaaacactccac

SEQ ID NO: 4205366 - DNA, 18 bp, Homo sapiens
ccagtcgatatctcactt

SEQ ID NO: 4205367 - DNA, 20 bp, Homo sapiens
ccagtcgtccgctcagccaa

SEQ ID NO: 4205368 - DNA, 22 bp, Homo sapiens
ccagtctggaagaagaggagga

SEQ ID NO: 4205369 - DNA, 20 bp, Homo sapiens
ccagtgagggctgggcccac

SEQ ID NO: 4205370 - DNA, 16 bp, Homo sapiens
ccagtgccacagagaa

SEQ ID NO: 4205371 - DNA, 15 bp, Homo sapiens
ccagtgtgatcccaa

SEQ ID NO: 4205372 - DNA, 22 bp, Homo sapiens
ccagtttcagaagcaggcaggg

SEQ ID NO: 4205373 - DNA, 16 bp, Homo sapiens
ccataaccaagaaata

SEQ ID NO: 4205374 - DNA, 20 bp, Homo sapiens
ccataattgctttgccaaaa

SEQ ID NO: 4205375 - DNA, 16 bp, Homo sapiens
ccataccgaccatcgt

SEQ ID NO: 4205376 - DNA, 23 bp, Homo sapiens
ccataccgaccatcgtccagccc

SEQ ID NO: 4205377 - DNA, 17 bp, Homo sapiens
ccatagagtttaacaca

SEQ ID NO: 4205378 - DNA, 12 bp, Homo sapiens
ccatatgctcca

SEQ ID NO: 4205379 - DNA, 16 bp, Homo sapiens
ccatatgctccaggat

SEQ ID NO: 4205380 - DNA, 15 bp, Homo sapiens
ccatattcacacctc

SEQ ID NO: 4205381 - DNA, 13 bp, Homo sapiens
ccatcagggtggg

SEQ ID NO: 4205382 - DNA, 24 bp, Homo sapiens
ccatcagggtgggccactctcccc

SEQ ID NO: 4205383 - DNA, 21 bp, Homo sapiens
ccatccccaaactgtgccctg

SEQ ID NO: 4205384 - DNA, 15 bp, Homo sapiens
ccatccggctcctgt

SEQ ID NO: 4205385 - DNA, 16 bp, Homo sapiens
ccatcgtccagccctc

SEQ ID NO: 4205386 - DNA, 21 bp, Homo sapiens
ccatctgtagtaatttattgt

SEQ ID NO: 4205387 - DNA, 13 bp, Homo sapiens
ccatgaagacagg

SEQ ID NO: 4205388 - DNA, 13 bp, Homo sapiens
ccatgatacttta

SEQ ID NO: 4205389 - DNA, 14 bp, Homo sapiens
ccatgatactttaa

SEQ ID NO: 4205390 - DNA, 22 bp, Homo sapiens
ccatgatggtgctgacctctgg

SEQ ID NO: 4205391 - DNA, 18 bp, Homo sapiens
ccatgcacctcagggcca

SEQ ID NO: 4205392 - DNA, 14 bp, Homo sapiens
ccatgccctccctg

SEQ ID NO: 4205393 - DNA, 17 bp, Homo sapiens
cctctcggaaggctggc

SEQ ID NO: 4205394 - DNA, 13 bp, Homo sapiens
cctctctctaagt

SEQ ID NO: 4205395 - DNA, 19 bp, Homo sapiens
cctctctctaagtttagaa

SEQ ID NO: 4205396 - DNA, 12 bp, Homo sapiens
cctctcttccct

SEQ ID NO: 4205397 - DNA, 15 bp, Homo sapiens
cctctgatacccaga

SEQ ID NO: 4205398 - DNA, 12 bp, Homo sapiens
cctctgccccag

SEQ ID NO: 4205399 - DNA, 20 bp, Homo sapiens
cctctgctactgaggcaggg

SEQ ID NO: 4205400 - DNA, 22 bp, Homo sapiens
cctcttaaagctgcctgtagtt

SEQ ID NO: 4205401 - DNA, 23 bp, Homo sapiens
cctcttaaagctgcctgtagtta

SEQ ID NO: 4205402 - DNA, 14 bp, Homo sapiens
cctcttaaattata

SEQ ID NO: 4205403 - DNA, 19 bp, Homo sapiens
cctcttaaattatatattt

SEQ ID NO: 4205404 - DNA, 14 bp, Homo sapiens
cctcttcagctggg

SEQ ID NO: 4205405 - DNA, 13 bp, Homo sapiens
cctcttccctctg

SEQ ID NO: 4205406 - DNA, 13 bp, Homo sapiens
cctcttcctctgg

SEQ ID NO: 4205407 - DNA, 14 bp, Homo sapiens
cctcttcctctggg

SEQ ID NO: 4205408 - DNA, 12 bp, Homo sapiens
cctcttccttcc

SEQ ID NO: 4205409 - DNA, 14 bp, Homo sapiens
cctcttccttcccc

SEQ ID NO: 4205410 - DNA, 15 bp, Homo sapiens
cctcttcttcttcag

SEQ ID NO: 4205411 - DNA, 17 bp, Homo sapiens
cctctttccccacctct

SEQ ID NO: 4205412 - DNA, 13 bp, Homo sapiens
cctctttctctcc

SEQ ID NO: 4205413 - DNA, 17 bp, Homo sapiens
cctctttctctccttct

SEQ ID NO: 4205414 - DNA, 23 bp, Homo sapiens
cctctttttccaacttggctgca

SEQ ID NO: 4205415 - DNA, 19 bp, Homo sapiens
cctgaatttattattgttc

SEQ ID NO: 4205416 - DNA, 12 bp, Homo sapiens
cctgacaaatgg

SEQ ID NO: 4205417 - DNA, 20 bp, Homo sapiens
cctgacactgtctgctgccc

SEQ ID NO: 4205418 - DNA, 23 bp, Homo sapiens
cctgaccctccaccgcagaagga

SEQ ID NO: 4205419 - DNA, 19 bp, Homo sapiens
cctgactagggagccatgt

SEQ ID NO: 4205420 - DNA, 13 bp, Homo sapiens
cctgactctctgt

SEQ ID NO: 4205421 - DNA, 17 bp, Homo sapiens
cctgactctctgtgacc

SEQ ID NO: 4205422 - DNA, 18 bp, Homo sapiens
cctgactctctgtgacct

SEQ ID NO: 4205423 - DNA, 16 bp, Homo sapiens
cctgactgcacacagc

SEQ ID NO: 4205424 - DNA, 13 bp, Homo sapiens
cctgagaactgaa

SEQ ID NO: 4205425 - DNA, 20 bp, Homo sapiens
cctgagagaaactgaggtca

SEQ ID NO: 4205426 - DNA, 21 bp, Homo sapiens
cctgagcaacagagtgagacc

SEQ ID NO: 4205427 - DNA, 19 bp, Homo sapiens
cctgagcggaggctcggcc

SEQ ID NO: 4205428 - DNA, 12 bp, Homo sapiens
cctgaggctcct

SEQ ID NO: 4205429 - DNA, 21 bp, Homo sapiens
cctgaggctgagactgcggga

SEQ ID NO: 4205430 - DNA, 15 bp, Homo sapiens
cctgagggcccttcc

SEQ ID NO: 4205431 - DNA, 17 bp, Homo sapiens
cctgagggcccttccca

SEQ ID NO: 4205432 - DNA, 15 bp, Homo sapiens
cctgagtcacccatg

SEQ ID NO: 4205433 - DNA, 13 bp, Homo sapiens
cctgagtggatct

SEQ ID NO: 4205434 - DNA, 18 bp, Homo sapiens
cctgagtggatctccaag

SEQ ID NO: 4205435 - DNA, 23 bp, Homo sapiens
cctgatcacctctggctttgtct

SEQ ID NO: 4205436 - DNA, 22 bp, Homo sapiens
cctgatcattacatggctgtgg

SEQ ID NO: 4205437 - DNA, 16 bp, Homo sapiens
cctgatgctcatatca

SEQ ID NO: 4205438 - DNA, 18 bp, Homo sapiens
cctgcaagacacaggctc

SEQ ID NO: 4205439 - DNA, 21 bp, Homo sapiens
cctgcaagacacaggctcagc

SEQ ID NO: 4205440 - DNA, 22 bp, Homo sapiens
cctgcaagacacaggctcagca

SEQ ID NO: 4205441 - DNA, 23 bp, Homo sapiens
cctgcaagacacaggctcagcat

SEQ ID NO: 4205442 - DNA, 13 bp, Homo sapiens
cctgcaaggacta

SEQ ID NO: 4205443 - DNA, 18 bp, Homo sapiens
cctgcaatctccagggct

SEQ ID NO: 4205444 - DNA, 23 bp, Homo sapiens
cctgcaatctccagggctgcccc

SEQ ID NO: 4205445 - DNA, 16 bp, Homo sapiens
cctgcacgccaccgct

SEQ ID NO: 4205446 - DNA, 11 bp, Homo sapiens
cctgcagagag

SEQ ID NO: 4205447 - DNA, 18 bp, Homo sapiens
cctgcagaggacagagct

SEQ ID NO: 4205448 - DNA, 22 bp, Homo sapiens
cctgcagccccgcgcctccttc

SEQ ID NO: 4205449 - DNA, 15 bp, Homo sapiens
cctgcagcctggtag

SEQ ID NO: 4205450 - DNA, 17 bp, Homo sapiens
cctgcagcgagctgaga

SEQ ID NO: 4205451 - DNA, 16 bp, Homo sapiens
cctgcaggccaagagc

SEQ ID NO: 4205452 - DNA, 15 bp, Homo sapiens
cctgcagtcagggcc

SEQ ID NO: 4205453 - DNA, 14 bp, Homo sapiens
cctgcatttctcag

SEQ ID NO: 4205454 - DNA, 15 bp, Homo sapiens
cctgccagcctggct

SEQ ID NO: 4205455 - DNA, 17 bp, Homo sapiens
cctgccattcttctggt

SEQ ID NO: 4205456 - DNA, 13 bp, Homo sapiens
cctgccccctggt

SEQ ID NO: 4205457 - DNA, 17 bp, Homo sapiens
cctgccctgccacctgt

SEQ ID NO: 4205458 - DNA, 18 bp, Homo sapiens
cctgccctgccacctgtc

SEQ ID NO: 4205459 - DNA, 16 bp, Homo sapiens
cctgcctatccatcct

SEQ ID NO: 4205460 - DNA, 16 bp, Homo sapiens
cctgcctatcctctgt

SEQ ID NO: 4205461 - DNA, 15 bp, Homo sapiens
cctgcctccttcagt

SEQ ID NO: 4205462 - DNA, 18 bp, Homo sapiens
cctgcctctctgctccag

SEQ ID NO: 4205463 - DNA, 13 bp, Homo sapiens
cctgcctgtgcat

SEQ ID NO: 4205464 - DNA, 18 bp, Homo sapiens
cctgcctgtggagacagc

SEQ ID NO: 4205465 - DNA, 17 bp, Homo sapiens
cctgccttgaagccact

SEQ ID NO: 4205466 - DNA, 19 bp, Homo sapiens
cctgcgaaggggccctggt

SEQ ID NO: 4205467 - DNA, 20 bp, Homo sapiens
cctgcggctgctgtgtgcct

SEQ ID NO: 4205468 - DNA, 23 bp, Homo sapiens
cctgcgtcgaagctttgaaggcc

SEQ ID NO: 4205469 - DNA, 15 bp, Homo sapiens
cctgcgtgccgggag

SEQ ID NO: 4205470 - DNA, 18 bp, Homo sapiens
cctgctgccgcctcccag

SEQ ID NO: 4205471 - DNA, 22 bp, Homo sapiens
cctgctgccgcctcccagcctg

SEQ ID NO: 4205472 - DNA, 18 bp, Homo sapiens
cctgctgcggccagcctg

SEQ ID NO: 4205473 - DNA, 20 bp, Homo sapiens
cctgctgctgtgtttttgct

SEQ ID NO: 4205474 - DNA, 20 bp, Homo sapiens
cctgctggaaaccacacttc

SEQ ID NO: 4205475 - DNA, 21 bp, Homo sapiens
cctgcttgatgggattctgga

SEQ ID NO: 4205476 - DNA, 23 bp, Homo sapiens
cctggaaaggctcagtctcagga

SEQ ID NO: 4205477 - DNA, 17 bp, Homo sapiens
cctggaccgcttcccag

SEQ ID NO: 4205478 - DNA, 19 bp, Homo sapiens
cctggaccgcttcccagag

SEQ ID NO: 4205479 - DNA, 12 bp, Homo sapiens
cctggagatgat

SEQ ID NO: 4205480 - DNA, 15 bp, Homo sapiens
cctggagatgatgat

SEQ ID NO: 4205481 - DNA, 16 bp, Homo sapiens
cctggagcatcccagg

SEQ ID NO: 4205482 - DNA, 21 bp, Homo sapiens
cctggagcccgcttcaagctc

SEQ ID NO: 4205483 - DNA, 22 bp, Homo sapiens
cctggagcccgcttcaagctct

SEQ ID NO: 4205484 - DNA, 22 bp, Homo sapiens
cctggagcggagcttgcctgcc

SEQ ID NO: 4205485 - DNA, 20 bp, Homo sapiens
cctggaggatccctccatcc

SEQ ID NO: 4205486 - DNA, 13 bp, Homo sapiens
cctggagggaggc

SEQ ID NO: 4205487 - DNA, 18 bp, Homo sapiens
cctggagtcccctgggcc

SEQ ID NO: 4205488 - DNA, 22 bp, Homo sapiens
cctggcaaggcattcctcatca

SEQ ID NO: 4205489 - DNA, 19 bp, Homo sapiens
cctggcatggtgctttcag

SEQ ID NO: 4205490 - DNA, 13 bp, Homo sapiens
cctggccctccac

SEQ ID NO: 4205491 - DNA, 20 bp, Homo sapiens
cctggccctccactcctcat

SEQ ID NO: 4205492 - DNA, 16 bp, Homo sapiens
cctggcctcaagcaat

SEQ ID NO: 4205493 - DNA, 14 bp, Homo sapiens
cctggcttctggag

SEQ ID NO: 4205494 - DNA, 16 bp, Homo sapiens
cctggcttctggagcc

SEQ ID NO: 4205495 - DNA, 20 bp, Homo sapiens
cctggcttctggagcccttg

SEQ ID NO: 4205496 - DNA, 20 bp, Homo sapiens
cctggcttgctgtggctatg

SEQ ID NO: 4205497 - DNA, 15 bp, Homo sapiens
cctgggaagatacca

SEQ ID NO: 4205498 - DNA, 22 bp, Homo sapiens
cctgggagaaatctggcttctg

SEQ ID NO: 4205499 - DNA, 17 bp, Homo sapiens
cctgggagaacctcagg

SEQ ID NO: 4205500 - DNA, 16 bp, Homo sapiens
cctgggaggcggagag

SEQ ID NO: 4205501 - DNA, 13 bp, Homo sapiens
cctgggaggcttt

SEQ ID NO: 4205502 - DNA, 15 bp, Homo sapiens
cctgggcccacagag

SEQ ID NO: 4205503 - DNA, 18 bp, Homo sapiens
cctgggcccacagagcct

SEQ ID NO: 4205504 - DNA, 12 bp, Homo sapiens
cctgggctctgc

SEQ ID NO: 4205505 - DNA, 15 bp, Homo sapiens
cctggggctctgtgc

SEQ ID NO: 4205506 - DNA, 13 bp, Homo sapiens
cctgggggctgct

SEQ ID NO: 4205507 - DNA, 23 bp, Homo sapiens
cctgggggctgctgcactgccct

SEQ ID NO: 4205508 - DNA, 13 bp, Homo sapiens
cctgggtaggaaa

SEQ ID NO: 4205509 - DNA, 15 bp, Homo sapiens
cctggtacagcaggg

SEQ ID NO: 4205510 - DNA, 23 bp, Homo sapiens
cctggtagcacatgtctgtcctc

SEQ ID NO: 4205511 - DNA, 17 bp, Homo sapiens
cctggtcctgcactgtc

SEQ ID NO: 4205512 - DNA, 15 bp, Homo sapiens
cctggtccttccagg

SEQ ID NO: 4205513 - DNA, 19 bp, Homo sapiens
cctggtccttccaggcccc

SEQ ID NO: 4205514 - DNA, 22 bp, Homo sapiens
cctggtgattctgatgcagcct

SEQ ID NO: 4205515 - DNA, 17 bp, Homo sapiens
cctggtttgcagctgtt

SEQ ID NO: 4205516 - DNA, 18 bp, Homo sapiens
cctggttttccttgacca

SEQ ID NO: 4205517 - DNA, 23 bp, Homo sapiens
cctgtacatacgtgttctataga

SEQ ID NO: 4205518 - DNA, 14 bp, Homo sapiens
cctgtactcaggag

SEQ ID NO: 4205519 - DNA, 15 bp, Homo sapiens
cctgtactcaggagg

SEQ ID NO: 4205520 - DNA, 22 bp, Homo sapiens
cctgtactcaggaggctgaggg

SEQ ID NO: 4205521 - DNA, 23 bp, Homo sapiens
cctgtactcaggaggctgagggg

SEQ ID NO: 4205522 - DNA, 16 bp, Homo sapiens
cctgtagctttcctgg

SEQ ID NO: 4205523 - DNA, 17 bp, Homo sapiens
cctgtagctttcctggt

SEQ ID NO: 4205524 - DNA, 22 bp, Homo sapiens
cctgtagctttcctggtccctc

SEQ ID NO: 4205525 - DNA, 13 bp, Homo sapiens
cctgtagtcccag

SEQ ID NO: 4205526 - DNA, 18 bp, Homo sapiens
cctgtagtcccagccact

SEQ ID NO: 4205527 - DNA, 14 bp, Homo sapiens
cctgtagttaggaa

SEQ ID NO: 4205528 - DNA, 23 bp, Homo sapiens
ctcaggaggcgaataaatgttca

SEQ ID NO: 4205529 - DNA, 23 bp, Homo sapiens
ctcaggatgccaagtggccctca

SEQ ID NO: 4205530 - DNA, 17 bp, Homo sapiens
ctcaggccagagccaag

SEQ ID NO: 4205531 - DNA, 18 bp, Homo sapiens
ctcaggccaggtgcagtg

SEQ ID NO: 4205532 - DNA, 14 bp, Homo sapiens
ctcaggcccggcat

SEQ ID NO: 4205533 - DNA, 17 bp, Homo sapiens
ctcaggcttccttggca

SEQ ID NO: 4205534 - DNA, 18 bp, Homo sapiens
ctcagtaatttagaaatc

SEQ ID NO: 4205535 - DNA, 19 bp, Homo sapiens
ctcagtaatttagaaatca

SEQ ID NO: 4205536 - DNA, 21 bp, Homo sapiens
ctcagtccagatgccttcctg

SEQ ID NO: 4205537 - DNA, 15 bp, Homo sapiens
ctcagtctcaggagc

SEQ ID NO: 4205538 - DNA, 21 bp, Homo sapiens
ctcagtctgtgggagctcagc

SEQ ID NO: 4205539 - DNA, 16 bp, Homo sapiens
ctcagttgattttctg

SEQ ID NO: 4205540 - DNA, 20 bp, Homo sapiens
ctcagttgattttctggatt

SEQ ID NO: 4205541 - DNA, 16 bp, Homo sapiens
ctcatattttgtatat

SEQ ID NO: 4205542 - DNA, 20 bp, Homo sapiens
ctcatcaccatcgtgtttgc

SEQ ID NO: 4205543 - DNA, 20 bp, Homo sapiens
ctcatccctggtcgtctatc

SEQ ID NO: 4205544 - DNA, 18 bp, Homo sapiens
ctcatctcagtgaagaat

SEQ ID NO: 4205545 - DNA, 12 bp, Homo sapiens
ctcatcttttga

SEQ ID NO: 4205546 - DNA, 14 bp, Homo sapiens
ctcatgcctggccc

SEQ ID NO: 4205547 - DNA, 16 bp, Homo sapiens
ctcatgcctggccccc

SEQ ID NO: 4205548 - DNA, 22 bp, Homo sapiens
ctcatgcctggcccccctccag

SEQ ID NO: 4205549 - DNA, 23 bp, Homo sapiens
ctcatgcctggcccccctccagg

SEQ ID NO: 4205550 - DNA, 14 bp, Homo sapiens
ctcatgctctctga

SEQ ID NO: 4205551 - DNA, 18 bp, Homo sapiens
ctcatggcttagaaatct

SEQ ID NO: 4205552 - DNA, 17 bp, Homo sapiens
ctcatgtgtgctgtgct

SEQ ID NO: 4205553 - DNA, 12 bp, Homo sapiens
ctcattcccctc

SEQ ID NO: 4205554 - DNA, 20 bp, Homo sapiens
ctcattcgcctgtgggaaga

SEQ ID NO: 4205555 - DNA, 12 bp, Homo sapiens
ctcattgtagag

SEQ ID NO: 4205556 - DNA, 18 bp, Homo sapiens
ctccaaacaccggcagaa

SEQ ID NO: 4205557 - DNA, 14 bp, Homo sapiens
ctccaagagctaca

SEQ ID NO: 4205558 - DNA, 16 bp, Homo sapiens
ctccaagatgccctca

SEQ ID NO: 4205559 - DNA, 12 bp, Homo sapiens
ctccaaggacca

SEQ ID NO: 4205560 - DNA, 14 bp, Homo sapiens
ctccaaggaccagg

SEQ ID NO: 4205561 - DNA, 14 bp, Homo sapiens
ctccacagccgcag

SEQ ID NO: 4205562 - DNA, 21 bp, Homo sapiens
ctccacagttcgacctgcggc

SEQ ID NO: 4205563 - DNA, 16 bp, Homo sapiens
ctccacccactgtccg

SEQ ID NO: 4205564 - DNA, 15 bp, Homo sapiens
ctccaccccctccag

SEQ ID NO: 4205565 - DNA, 17 bp, Homo sapiens
ctccaccccctccagct

SEQ ID NO: 4205566 - DNA, 16 bp, Homo sapiens
ctccagaagtggggct

SEQ ID NO: 4205567 - DNA, 18 bp, Homo sapiens
ctccagcccttcagacga

SEQ ID NO: 4205568 - DNA, 14 bp, Homo sapiens
ctccagcctgggcg

SEQ ID NO: 4205569 - DNA, 23 bp, Homo sapiens
ctccagcctggggtgatagaaca

SEQ ID NO: 4205570 - DNA, 13 bp, Homo sapiens
ctccagctccagt

SEQ ID NO: 4205571 - DNA, 19 bp, Homo sapiens
ctccagctccagtttccaa

SEQ ID NO: 4205572 - DNA, 17 bp, Homo sapiens
ctccaggcatgctggcc

SEQ ID NO: 4205573 - DNA, 23 bp, Homo sapiens
ctccaggcatgctggcctcccaa

SEQ ID NO: 4205574 - DNA, 15 bp, Homo sapiens
ctccagggctgcccc

SEQ ID NO: 4205575 - DNA, 16 bp, Homo sapiens
ctccaggtttgctgtg

SEQ ID NO: 4205576 - DNA, 20 bp, Homo sapiens
ctccagtattcttgtcaaaa

SEQ ID NO: 4205577 - DNA, 17 bp, Homo sapiens
ctccagtgctggatttg

SEQ ID NO: 4205578 - DNA, 22 bp, Homo sapiens
ctccagtttcagaagcaggcag

SEQ ID NO: 4205579 - DNA, 13 bp, Homo sapiens
ctccatacatccc

SEQ ID NO: 4205580 - DNA, 15 bp, Homo sapiens
ctccatccggctcct

SEQ ID NO: 4205581 - DNA, 17 bp, Homo sapiens
ctccatccggctcctgt

SEQ ID NO: 4205582 - DNA, 21 bp, Homo sapiens
ctccatccggctcctgtcatc

SEQ ID NO: 4205583 - DNA, 16 bp, Homo sapiens
ctcccaataaagctgg

SEQ ID NO: 4205584 - DNA, 14 bp, Homo sapiens
ctcccaccaggcta

SEQ ID NO: 4205585 - DNA, 23 bp, Homo sapiens
ctcccacgactgttgtacaagct

SEQ ID NO: 4205586 - DNA, 22 bp, Homo sapiens
ctcccagcaagtttcaccttgg

SEQ ID NO: 4205587 - DNA, 11 bp, Homo sapiens
ctcccagcctg

SEQ ID NO: 4205588 - DNA, 16 bp, Homo sapiens
ctcccagcgtgtgtat

SEQ ID NO: 4205589 - DNA, 23 bp, Homo sapiens
ctcccagggccagggccctgcag

SEQ ID NO: 4205590 - DNA, 22 bp, Homo sapiens
ctcccataattgctttgccaaa

SEQ ID NO: 4205591 - DNA, 14 bp, Homo sapiens
ctcccatggccttc

SEQ ID NO: 4205592 - DNA, 17 bp, Homo sapiens
ctcccatggccttccct

SEQ ID NO: 4205593 - DNA, 13 bp, Homo sapiens
ctccccacagtcc

SEQ ID NO: 4205594 - DNA, 21 bp, Homo sapiens
ctccccacagtcctcacagcc

SEQ ID NO: 4205595 - DNA, 23 bp, Homo sapiens
ctccccaccttcaattcctgggc

SEQ ID NO: 4205596 - DNA, 12 bp, Homo sapiens
ctccccaggcca

SEQ ID NO: 4205597 - DNA, 15 bp, Homo sapiens
ctccccaggccaggc

SEQ ID NO: 4205598 - DNA, 12 bp, Homo sapiens
ctccccctgggc

SEQ ID NO: 4205599 - DNA, 15 bp, Homo sapiens
ctcccctcacttttc

SEQ ID NO: 4205600 - DNA, 14 bp, Homo sapiens
ctcccctccctctt

SEQ ID NO: 4205601 - DNA, 16 bp, Homo sapiens
ctcccctccctcttcc

SEQ ID NO: 4205602 - DNA, 15 bp, Homo sapiens
ctcccctgccctgct

SEQ ID NO: 4205603 - DNA, 16 bp, Homo sapiens
ctcccctgccctgctg

SEQ ID NO: 4205604 - DNA, 21 bp, Homo sapiens
ctccctatactgcttggagct

SEQ ID NO: 4205605 - DNA, 14 bp, Homo sapiens
ctccctctgacctg

SEQ ID NO: 4205606 - DNA, 15 bp, Homo sapiens
ctccctcttccttcc

SEQ ID NO: 4205607 - DNA, 19 bp, Homo sapiens
ctccctgccaagtctcaga

SEQ ID NO: 4205608 - DNA, 12 bp, Homo sapiens
ctccctggagtg

SEQ ID NO: 4205609 - DNA, 15 bp, Homo sapiens
ctccctggcccagcc

SEQ ID NO: 4205610 - DNA, 18 bp, Homo sapiens
ctccctggctctcagaag

SEQ ID NO: 4205611 - DNA, 16 bp, Homo sapiens
ctccgcacttggaaag

SEQ ID NO: 4205612 - DNA, 18 bp, Homo sapiens
ctccgcacttggaaaggt

SEQ ID NO: 4205613 - DNA, 19 bp, Homo sapiens
ctccgccttcactccggtg

SEQ ID NO: 4205614 - DNA, 21 bp, Homo sapiens
ctccgccttcactccggtgtg

SEQ ID NO: 4205615 - DNA, 22 bp, Homo sapiens
ctccgcgagggctactcagcag

SEQ ID NO: 4205616 - DNA, 18 bp, Homo sapiens
ctccggaggggacccagc

SEQ ID NO: 4205617 - DNA, 13 bp, Homo sapiens
ctccggtgtgcct

SEQ ID NO: 4205618 - DNA, 22 bp, Homo sapiens
ctccgtaggagctcacagtcta

SEQ ID NO: 4205619 - DNA, 16 bp, Homo sapiens
ctccgtgtgcctgggg

SEQ ID NO: 4205620 - DNA, 23 bp, Homo sapiens
ctcctaaacccccgctccagatc

SEQ ID NO: 4205621 - DNA, 12 bp, Homo sapiens
ctcctacctcag

SEQ ID NO: 4205622 - DNA, 13 bp, Homo sapiens
ctcctacctcagc

SEQ ID NO: 4205623 - DNA, 14 bp, Homo sapiens
ctcctacctcagcc

SEQ ID NO: 4205624 - DNA, 14 bp, Homo sapiens
ctcctatccttgga

SEQ ID NO: 4205625 - DNA, 16 bp, Homo sapiens
ctcctcaggaacagaa

SEQ ID NO: 4205626 - DNA, 13 bp, Homo sapiens
ctcctccagccct

SEQ ID NO: 4205627 - DNA, 14 bp, Homo sapiens
ctcctccagccctt

SEQ ID NO: 4205628 - DNA, 16 bp, Homo sapiens
ctcctcccatggcctt

SEQ ID NO: 4205629 - DNA, 15 bp, Homo sapiens
ctcctcctcccccag

SEQ ID NO: 4205630 - DNA, 15 bp, Homo sapiens
ctcctcctctgtgct

SEQ ID NO: 4205631 - DNA, 20 bp, Homo sapiens
ctcctctcctcctctgtgct

SEQ ID NO: 4205632 - DNA, 16 bp, Homo sapiens
ctcctctgagccatac

SEQ ID NO: 4205633 - DNA, 22 bp, Homo sapiens
ctcctgaaaaggtttatgaaaa

SEQ ID NO: 4205634 - DNA, 18 bp, Homo sapiens
ctcctggaaaggctcagt

SEQ ID NO: 4205635 - DNA, 23 bp, Homo sapiens
ctcctggaaaggctcagtctcag

SEQ ID NO: 4205636 - DNA, 19 bp, Homo sapiens
ctcctggagcatcccaggc

SEQ ID NO: 4205637 - DNA, 23 bp, Homo sapiens
ctcctgggcatgtttgtctgtgt

SEQ ID NO: 4205638 - DNA, 17 bp, Homo sapiens
ctcctgggggcccattc

SEQ ID NO: 4205639 - DNA, 20 bp, Homo sapiens
ctcctgggggcccattctgc

SEQ ID NO: 4205640 - DNA, 24 bp, Homo sapiens
ctcctgggggcccattctgcatgc

SEQ ID NO: 4205641 - DNA, 21 bp, Homo sapiens
ctccttcaacaattctaaaat

SEQ ID NO: 4205642 - DNA, 22 bp, Homo sapiens
ctccttcccctgtggtcttgga

SEQ ID NO: 4205643 - DNA, 10 bp, Homo sapiens
ctccttccct

SEQ ID NO: 4205644 - DNA, 19 bp, Homo sapiens
ctccttcccttctctcctt

SEQ ID NO: 4205645 - DNA, 23 bp, Homo sapiens
ctccttgaagaatctctcctctc

SEQ ID NO: 4205646 - DNA, 13 bp, Homo sapiens
ctccttgctctgc

SEQ ID NO: 4205647 - DNA, 15 bp, Homo sapiens
ctccttgtcactgaa

SEQ ID NO: 4205648 - DNA, 18 bp, Homo sapiens
ctccttgtcactgaagat

SEQ ID NO: 4205649 - DNA, 19 bp, Homo sapiens
ctccttgtcactgaagatt

SEQ ID NO: 4205650 - DNA, 14 bp, Homo sapiens
ctcctttagcaggt

SEQ ID NO: 4205651 - DNA, 20 bp, Homo sapiens
ctcctttagcaggtggtcct

SEQ ID NO: 4205652 - DNA, 15 bp, Homo sapiens
ctcctttgcctctgc

SEQ ID NO: 4205653 - DNA, 16 bp, Homo sapiens
ctcctttttctacctt

SEQ ID NO: 4205654 - DNA, 16 bp, Homo sapiens
ctcgaggagctcaggg

SEQ ID NO: 4205655 - DNA, 12 bp, Homo sapiens
ctcgaggctctt

SEQ ID NO: 4205656 - DNA, 23 bp, Homo sapiens
ctcgagggttgggttcatctgag

SEQ ID NO: 4205657 - DNA, 19 bp, Homo sapiens
ctcgccacggggaggggga

SEQ ID NO: 4205658 - DNA, 20 bp, Homo sapiens
ctcggccgtacatctctgtg

SEQ ID NO: 4205659 - DNA, 15 bp, Homo sapiens
ctcgggaggctgaga

SEQ ID NO: 4205660 - DNA, 14 bp, Homo sapiens
ctcgtagccatctc

SEQ ID NO: 4205661 - DNA, 13 bp, Homo sapiens
ctcgtatagcatg

SEQ ID NO: 4205662 - DNA, 16 bp, Homo sapiens
ctcgtggtagaagcca

SEQ ID NO: 4205663 - DNA, 15 bp, Homo sapiens
ctggaaaagaggagt

SEQ ID NO: 4205664 - DNA, 17 bp, Homo sapiens
ctggaaaataatactgc

SEQ ID NO: 4205665 - DNA, 20 bp, Homo sapiens
ctggaaaataatactgctga

SEQ ID NO: 4205666 - DNA, 18 bp, Homo sapiens
ctggaaaatgtgacccag

SEQ ID NO: 4205667 - DNA, 20 bp, Homo sapiens
ctggaaaccacacttcttga

SEQ ID NO: 4205668 - DNA, 23 bp, Homo sapiens
ctggaaaggctcagtctcaggag

SEQ ID NO: 4205669 - DNA, 23 bp, Homo sapiens
ctggaaataaacctggagatgat

SEQ ID NO: 4205670 - DNA, 23 bp, Homo sapiens
ctggaacactagacaagccagaa

SEQ ID NO: 4205671 - DNA, 23 bp, Homo sapiens
ctggaatcaagatgtcagactgg

SEQ ID NO: 4205672 - DNA, 14 bp, Homo sapiens
ctggacaagaagct

SEQ ID NO: 4205673 - DNA, 18 bp, Homo sapiens
ctggacaagaagctgcta

SEQ ID NO: 4205674 - DNA, 13 bp, Homo sapiens
ctggagaactagg

SEQ ID NO: 4205675 - DNA, 18 bp, Homo sapiens
ctggagaagctcacccaa

SEQ ID NO: 4205676 - DNA, 22 bp, Homo sapiens
ctggagaaggtattagcaaagc

SEQ ID NO: 4205677 - DNA, 12 bp, Homo sapiens
ctggagagaagt

SEQ ID NO: 4205678 - DNA, 15 bp, Homo sapiens
ctggagccaaggcag

SEQ ID NO: 4205679 - DNA, 12 bp, Homo sapiens
ctggagcccagg

SEQ ID NO: 4205680 - DNA, 15 bp, Homo sapiens
ctggagcccaggagt

SEQ ID NO: 4205681 - DNA, 18 bp, Homo sapiens
ctggagcccgcttcaagc

SEQ ID NO: 4205682 - DNA, 17 bp, Homo sapiens
ctggaggattttccagt

SEQ ID NO: 4205683 - DNA, 15 bp, Homo sapiens
ctggagggaggtggg

SEQ ID NO: 4205684 - DNA, 17 bp, Homo sapiens
ctggagtcttgtacact

SEQ ID NO: 4205685 - DNA, 15 bp, Homo sapiens
ctggatatatttaaa

SEQ ID NO: 4205686 - DNA, 13 bp, Homo sapiens
ctggatgaaattt

SEQ ID NO: 4205687 - DNA, 23 bp, Homo sapiens
ctggatgcagtggctcatgcctg

SEQ ID NO: 4205688 - DNA, 21 bp, Homo sapiens
ctggatggatttgaagcaaag

SEQ ID NO: 4205689 - DNA, 21 bp, Homo sapiens
ctggattccagagcactgctc

SEQ ID NO: 4205690 - DNA, 11 bp, Homo sapiens
ctggcagagca

SEQ ID NO: 4205691 - DNA, 14 bp, Homo sapiens
ctggcagagcacag

SEQ ID NO: 4205692 - DNA, 16 bp, Homo sapiens
ctggcagagcacagcc

SEQ ID NO: 4205693 - DNA, 18 bp, Homo sapiens
ctggcaggatgaccctgc

SEQ ID NO: 4205694 - DNA, 18 bp, Homo sapiens
ctggcaggcaggctccca

SEQ ID NO: 4205695 - DNA, 24 bp, Homo sapiens
ctggcaggcaggctcccagggaca

SEQ ID NO: 4205696 - DNA, 13 bp, Homo sapiens
ctggccagaggca

SEQ ID NO: 4205697 - DNA, 12 bp, Homo sapiens
ctggccctccac

SEQ ID NO: 4205698 - DNA, 21 bp, Homo sapiens
ctggccctccactcctcatcc

SEQ ID NO: 4205699 - DNA, 16 bp, Homo sapiens
ctggccctggggccat

SEQ ID NO: 4205700 - DNA, 16 bp, Homo sapiens
ctggcctcaaagcaag

SEQ ID NO: 4205701 - DNA, 19 bp, Homo sapiens
ctggcctcccaataaagct

SEQ ID NO: 4205702 - DNA, 14 bp, Homo sapiens
ctggcctcctgggg

SEQ ID NO: 4205703 - DNA, 16 bp, Homo sapiens
ctggcgactgcagctg

SEQ ID NO: 4205704 - DNA, 18 bp, Homo sapiens
ctggcgactgcagctgca

SEQ ID NO: 4205705 - DNA, 15 bp, Homo sapiens
ctggcggcgcagagg

SEQ ID NO: 4205706 - DNA, 22 bp, Homo sapiens
ctggctccaaggtgctctgtgt

SEQ ID NO: 4205707 - DNA, 23 bp, Homo sapiens
ctggctccaaggtgctctgtgtc

SEQ ID NO: 4205708 - DNA, 17 bp, Homo sapiens
ctggctcccagggtcct

SEQ ID NO: 4205709 - DNA, 22 bp, Homo sapiens
ctggctcctttgcctctgctac

SEQ ID NO: 4205710 - DNA, 15 bp, Homo sapiens
ctggctctccacctt

SEQ ID NO: 4205711 - DNA, 23 bp, Homo sapiens
ctggctgaccccaaagagcctgg

SEQ ID NO: 4205712 - DNA, 13 bp, Homo sapiens
ctggctgacctgg

SEQ ID NO: 4205713 - DNA, 17 bp, Homo sapiens
ctggctgacctgggccc

SEQ ID NO: 4205714 - DNA, 23 bp, Homo sapiens
ctggctgacctgggcccacagag

SEQ ID NO: 4205715 - DNA, 13 bp, Homo sapiens
ctggctgcagtga

SEQ ID NO: 4205716 - DNA, 14 bp, Homo sapiens
ctggctgggcatgg

SEQ ID NO: 4205717 - DNA, 17 bp, Homo sapiens
ctggctgggcatggacg

SEQ ID NO: 4205718 - DNA, 14 bp, Homo sapiens
ctggcttagtgcca

SEQ ID NO: 4205719 - DNA, 22 bp, Homo sapiens
ctggcttagtgccacccacctt

SEQ ID NO: 4205720 - DNA, 12 bp, Homo sapiens
ctggcttccagg

SEQ ID NO: 4205721 - DNA, 23 bp, Homo sapiens
ctggcttccaggtatctccagga

SEQ ID NO: 4205722 - DNA, 13 bp, Homo sapiens
ctggcttctagat

SEQ ID NO: 4205723 - DNA, 14 bp, Homo sapiens
ctggcttctggagc

SEQ ID NO: 4205724 - DNA, 16 bp, Homo sapiens
ctggcttctggagccc

SEQ ID NO: 4205725 - DNA, 19 bp, Homo sapiens
ctggcttctggccaggaag

SEQ ID NO: 4205726 - DNA, 14 bp, Homo sapiens
ctggcttgctgtgg

SEQ ID NO: 4205727 - DNA, 15 bp, Homo sapiens
ctggcttgctgtggc

SEQ ID NO: 4205728 - DNA, 16 bp, Homo sapiens
ctggcttgctgtggct

SEQ ID NO: 4205729 - DNA, 16 bp, Homo sapiens
ctggctttggtcccca

SEQ ID NO: 4205730 - DNA, 22 bp, Homo sapiens
ctggcttttcgcttgcttctgc

SEQ ID NO: 4205731 - DNA, 20 bp, Homo sapiens
ctgggaaggccgcaagaggc

SEQ ID NO: 4205732 - DNA, 13 bp, Homo sapiens
ctgggactggcca

SEQ ID NO: 4205733 - DNA, 14 bp, Homo sapiens
ctgggactggccag

SEQ ID NO: 4205734 - DNA, 19 bp, Homo sapiens
ctgggagaaatctggcttc

SEQ ID NO: 4205735 - DNA, 21 bp, Homo sapiens
ctgggagaaatctggcttctg

SEQ ID NO: 4205736 - DNA, 17 bp, Homo sapiens
ctgggagaacctcaggc

SEQ ID NO: 4205737 - DNA, 16 bp, Homo sapiens
ctgggagaagagaacc

SEQ ID NO: 4205738 - DNA, 18 bp, Homo sapiens
ctgggagagcctggcaag

SEQ ID NO: 4205739 - DNA, 19 bp, Homo sapiens
ctgggagagcctggcaagg

SEQ ID NO: 4205740 - DNA, 15 bp, Homo sapiens
ctgggaggaagcagg

SEQ ID NO: 4205741 - DNA, 14 bp, Homo sapiens
ctgggatatgtagt

SEQ ID NO: 4205742 - DNA, 20 bp, Homo sapiens
ctgggattacagacatgagc

SEQ ID NO: 4205743 - DNA, 15 bp, Homo sapiens
ctgggattcccacca

SEQ ID NO: 4205744 - DNA, 20 bp, Homo sapiens
ctgggcaatgaaaccaaagc

SEQ ID NO: 4205745 - DNA, 21 bp, Homo sapiens
ctgggcatgtttgtctgtgtg

SEQ ID NO: 4205746 - DNA, 12 bp, Homo sapiens
ctgggcattttc

SEQ ID NO: 4205747 - DNA, 21 bp, Homo sapiens
ctgggccaagttcctctagtg

SEQ ID NO: 4205748 - DNA, 18 bp, Homo sapiens
ctgggcccacagagatgc

SEQ ID NO: 4205749 - DNA, 16 bp, Homo sapiens
ctgggcccacagagcc

SEQ ID NO: 4205750 - DNA, 17 bp, Homo sapiens
ctgggctctgccccagc

SEQ ID NO: 4205751 - DNA, 23 bp, Homo sapiens
ctgggctctgccccagctctggc

SEQ ID NO: 4205752 - DNA, 14 bp, Homo sapiens
ctgggctctggtct

SEQ ID NO: 4205753 - DNA, 15 bp, Homo sapiens
ctggggctgccagcc

SEQ ID NO: 4205754 - DNA, 12 bp, Homo sapiens
ctggggctgggc

SEQ ID NO: 4205755 - DNA, 14 bp, Homo sapiens
ctggggctgggcct

SEQ ID NO: 4205756 - DNA, 20 bp, Homo sapiens
ctgggggcccattctgcatg

SEQ ID NO: 4205757 - DNA, 19 bp, Homo sapiens
ctggggtgatagaacaaga

SEQ ID NO: 4205758 - DNA, 19 bp, Homo sapiens
ctggggttcccgagggagc

SEQ ID NO: 4205759 - DNA, 16 bp, Homo sapiens
ctgggtaagaagaaag

SEQ ID NO: 4205760 - DNA, 18 bp, Homo sapiens
ctgggtaatgaaacaaag

SEQ ID NO: 4205761 - DNA, 22 bp, Homo sapiens
ctgggtccctcggagctgccag

SEQ ID NO: 4205762 - DNA, 17 bp, Homo sapiens
ctgggtggggggagaag

SEQ ID NO: 4205763 - DNA, 18 bp, Homo sapiens
ctggtaatttgtatctga

SEQ ID NO: 4205764 - DNA, 15 bp, Homo sapiens
ctggtacaatccttt

SEQ ID NO: 4205765 - DNA, 15 bp, Homo sapiens
ctggtacagcagggt

SEQ ID NO: 4205766 - DNA, 23 bp, Homo sapiens
ctggtacagcagggtcttgctgt

SEQ ID NO: 4205767 - DNA, 21 bp, Homo sapiens
ctggtatgaacttgaggacac

SEQ ID NO: 4205768 - DNA, 23 bp, Homo sapiens
ctggtatgaacttgaggacacat

SEQ ID NO: 4205769 - DNA, 12 bp, Homo sapiens
ctggtcctgcac

SEQ ID NO: 4205770 - DNA, 19 bp, Homo sapiens
ctggtccttccaggccccc

SEQ ID NO: 4205771 - DNA, 22 bp, Homo sapiens
ctggtgactgcgatcttcagag

SEQ ID NO: 4205772 - DNA, 19 bp, Homo sapiens
ctggtgcactggccccacc

SEQ ID NO: 4205773 - DNA, 15 bp, Homo sapiens
ctggtgccatttctg

SEQ ID NO: 4205774 - DNA, 22 bp, Homo sapiens
ctggtgctataggctggagaag

SEQ ID NO: 4205775 - DNA, 20 bp, Homo sapiens
ctggtgctgtggccagggtg

SEQ ID NO: 4205776 - DNA, 12 bp, Homo sapiens
ctggtggacagt

SEQ ID NO: 4205777 - DNA, 15 bp, Homo sapiens
ctggtggacagtcct

SEQ ID NO: 4205778 - DNA, 16 bp, Homo sapiens
ctggtggacagtcctg

SEQ ID NO: 4205779 - DNA, 19 bp, Homo sapiens
ctggtggacagtcctggga

SEQ ID NO: 4205780 - DNA, 21 bp, Homo sapiens
ctggtggacagtcctgggaga

SEQ ID NO: 4205781 - DNA, 14 bp, Homo sapiens
ctggtttaatgttt

SEQ ID NO: 4205782 - DNA, 15 bp, Homo sapiens
ctgtaacacagctga

SEQ ID NO: 4205783 - DNA, 21 bp, Homo sapiens
ctgtaacacagctgagagact

SEQ ID NO: 4205784 - DNA, 22 bp, Homo sapiens
ctgtaagcattctgagctgggc

SEQ ID NO: 4205785 - DNA, 16 bp, Homo sapiens
ctgtaatcccagcact

SEQ ID NO: 4205786 - DNA, 19 bp, Homo sapiens
ctgtaatgagaacttcaat

SEQ ID NO: 4205787 - DNA, 22 bp, Homo sapiens
ctgtaatgagaacttcaatcac

SEQ ID NO: 4205788 - DNA, 19 bp, Homo sapiens
ctgtaattaagtaaaccaa

SEQ ID NO: 4205789 - DNA, 18 bp, Homo sapiens
ctgtacatacgtgttcta

SEQ ID NO: 4205790 - DNA, 13 bp, Homo sapiens
ctgtactcaggag

SEQ ID NO: 4205791 - DNA, 16 bp, Homo sapiens
ctgtacttaataaatt

SEQ ID NO: 4205792 - DNA, 18 bp, Homo sapiens
ctgtacttaataaattca

SEQ ID NO: 4205793 - DNA, 21 bp, Homo sapiens
ctgtagctaggtatcttactc

SEQ ID NO: 4205794 - DNA, 22 bp, Homo sapiens
ctgtagctaggtatcttactct

SEQ ID NO: 4205795 - DNA, 19 bp, Homo sapiens
ctgtagctcccgagctact

SEQ ID NO: 4205796 - DNA, 18 bp, Homo sapiens
ctgtagcttgttccctgt

SEQ ID NO: 4205797 - DNA, 21 bp, Homo sapiens
gctcctggaaaggctcagtct

SEQ ID NO: 4205798 - DNA, 22 bp, Homo sapiens
gctcctggaaaggctcagtctc

SEQ ID NO: 4205799 - DNA, 21 bp, Homo sapiens
gctcctgtgctactttgcctt

SEQ ID NO: 4205800 - DNA, 17 bp, Homo sapiens
gctcctttacctaccac

SEQ ID NO: 4205801 - DNA, 17 bp, Homo sapiens
gctcctttgcctctgct

SEQ ID NO: 4205802 - DNA, 18 bp, Homo sapiens
gctcctttgcctctgcta

SEQ ID NO: 4205803 - DNA, 13 bp, Homo sapiens
gctcgccccaccc

SEQ ID NO: 4205804 - DNA, 18 bp, Homo sapiens
gctcgccccacccagggc

SEQ ID NO: 4205805 - DNA, 23 bp, Homo sapiens
gctcgctgcccagggataggtat

SEQ ID NO: 4205806 - DNA, 11 bp, Homo sapiens
gctctcagaag

SEQ ID NO: 4205807 - DNA, 20 bp, Homo sapiens
gctctcaggggccagtgagg

SEQ ID NO: 4205808 - DNA, 17 bp, Homo sapiens
gctctcctaccccacct

SEQ ID NO: 4205809 - DNA, 18 bp, Homo sapiens
gctctcctaccccacctc

SEQ ID NO: 4205810 - DNA, 22 bp, Homo sapiens
gctctctctacccggcccagag

SEQ ID NO: 4205811 - DNA, 23 bp, Homo sapiens
gctctctctacccggcccagaga

SEQ ID NO: 4205812 - DNA, 15 bp, Homo sapiens
gctctctgctgagca

SEQ ID NO: 4205813 - DNA, 18 bp, Homo sapiens
gctctctgctgagcagcc

SEQ ID NO: 4205814 - DNA, 21 bp, Homo sapiens
gctctctgttgcgctcccgca

SEQ ID NO: 4205815 - DNA, 17 bp, Homo sapiens
gctctgacccagtgaga

SEQ ID NO: 4205816 - DNA, 14 bp, Homo sapiens
gctctgcattgcct

SEQ ID NO: 4205817 - DNA, 15 bp, Homo sapiens
gctctgccccagctc

SEQ ID NO: 4205818 - DNA, 18 bp, Homo sapiens
gctctgccccagctctgg

SEQ ID NO: 4205819 - DNA, 16 bp, Homo sapiens
gctctggtctgtaggt

SEQ ID NO: 4205820 - DNA, 17 bp, Homo sapiens
gctctggtctgtaggtt

SEQ ID NO: 4205821 - DNA, 19 bp, Homo sapiens
gctctgtctacttgctcag

SEQ ID NO: 4205822 - DNA, 14 bp, Homo sapiens
gctctgtgcaggga

SEQ ID NO: 4205823 - DNA, 16 bp, Homo sapiens
gctctgtgtccgtctg

SEQ ID NO: 4205824 - DNA, 19 bp, Homo sapiens
gctctgtgtccgtctgtgt

SEQ ID NO: 4205825 - DNA, 18 bp, Homo sapiens
gctctgttatgcaagcac

SEQ ID NO: 4205826 - DNA, 17 bp, Homo sapiens
gctcttcactcagccac

SEQ ID NO: 4205827 - DNA, 21 bp, Homo sapiens
gctcttcactcagccacaccc

SEQ ID NO: 4205828 - DNA, 16 bp, Homo sapiens
gctcttgcctgtaatc

SEQ ID NO: 4205829 - DNA, 12 bp, Homo sapiens
gctctttcatct

SEQ ID NO: 4205830 - DNA, 18 bp, Homo sapiens
gctctttctgggccaagt

SEQ ID NO: 4205831 - DNA, 21 bp, Homo sapiens
gctgaagaggcaagagacaga

SEQ ID NO: 4205832 - DNA, 20 bp, Homo sapiens
gctgaagggaccttgaaggg

SEQ ID NO: 4205833 - DNA, 23 bp, Homo sapiens
gctgacatggctttgctttgtgt

SEQ ID NO: 4205834 - DNA, 18 bp, Homo sapiens
gctgaccccaaagagcct

SEQ ID NO: 4205835 - DNA, 13 bp, Homo sapiens
gctgacctctggt

SEQ ID NO: 4205836 - DNA, 17 bp, Homo sapiens
gctgactgttcttggta

SEQ ID NO: 4205837 - DNA, 11 bp, Homo sapiens
gctgagccctg

SEQ ID NO: 4205838 - DNA, 14 bp, Homo sapiens
gctgagccctggca

SEQ ID NO: 4205839 - DNA, 22 bp, Homo sapiens
gctgaggggaggatcactggag

SEQ ID NO: 4205840 - DNA, 15 bp, Homo sapiens
gctgaggggcaggga

SEQ ID NO: 4205841 - DNA, 17 bp, Homo sapiens
gctgagggtttttctaa

SEQ ID NO: 4205842 - DNA, 16 bp, Homo sapiens
gctgagtgcactcctg

SEQ ID NO: 4205843 - DNA, 18 bp, Homo sapiens
gctgagtgcactcctggt

SEQ ID NO: 4205844 - DNA, 19 bp, Homo sapiens
gctgagtgcactcctggtg

SEQ ID NO: 4205845 - DNA, 16 bp, Homo sapiens
gctgattcaagaaaca

SEQ ID NO: 4205846 - DNA, 15 bp, Homo sapiens
gctgcaccatcacac

SEQ ID NO: 4205847 - DNA, 19 bp, Homo sapiens
gctgcaccatcacacatgc

SEQ ID NO: 4205848 - DNA, 20 bp, Homo sapiens
gctgcacctgccagcctggc

SEQ ID NO: 4205849 - DNA, 16 bp, Homo sapiens
gctgcactgccctccg

SEQ ID NO: 4205850 - DNA, 20 bp, Homo sapiens
gctgcagtgacgtgcacctg

SEQ ID NO: 4205851 - DNA, 22 bp, Homo sapiens
gctgcatctgggattcccacca

SEQ ID NO: 4205852 - DNA, 14 bp, Homo sapiens
gctgcatgcctggt

SEQ ID NO: 4205853 - DNA, 21 bp, Homo sapiens
gctgccagcctgagcggaggc

SEQ ID NO: 4205854 - DNA, 13 bp, Homo sapiens
gctgcccctgtag

SEQ ID NO: 4205855 - DNA, 12 bp, Homo sapiens
gctgcctgtagt

SEQ ID NO: 4205856 - DNA, 20 bp, Homo sapiens
gctgcctgtagttaggaaat

SEQ ID NO: 4205857 - DNA, 15 bp, Homo sapiens
gctgctcctccagcc

SEQ ID NO: 4205858 - DNA, 16 bp, Homo sapiens
gctgctcctccagccc

SEQ ID NO: 4205859 - DNA, 18 bp, Homo sapiens
gctgctcctccagccctt

SEQ ID NO: 4205860 - DNA, 16 bp, Homo sapiens
gctgctgcactgccct

SEQ ID NO: 4205861 - DNA, 17 bp, Homo sapiens
gctgctgcactgccctc

SEQ ID NO: 4205862 - DNA, 12 bp, Homo sapiens
gctgctggctga

SEQ ID NO: 4205863 - DNA, 20 bp, Homo sapiens
gctgctggctgacctgggcc

SEQ ID NO: 4205864 - DNA, 15 bp, Homo sapiens
gctgctgtggcccag

SEQ ID NO: 4205865 - DNA, 16 bp, Homo sapiens
gctgctgtggcccagt

SEQ ID NO: 4205866 - DNA, 17 bp, Homo sapiens
gctgctgtggcccagtc

SEQ ID NO: 4205867 - DNA, 14 bp, Homo sapiens
gctggaaataaacc

SEQ ID NO: 4205868 - DNA, 16 bp, Homo sapiens
gctggaaataaacctg

SEQ ID NO: 4205869 - DNA, 23 bp, Homo sapiens
gctggaaataaacctggagatga

SEQ ID NO: 4205870 - DNA, 15 bp, Homo sapiens
gctggacaagaagct

SEQ ID NO: 4205871 - DNA, 19 bp, Homo sapiens
gctggacaagaagctgcta

SEQ ID NO: 4205872 - DNA, 13 bp, Homo sapiens
gctggacctgcac

SEQ ID NO: 4205873 - DNA, 16 bp, Homo sapiens
gctggacggcattcct

SEQ ID NO: 4205874 - DNA, 21 bp, Homo sapiens
gctggagcgcagtccccagct

SEQ ID NO: 4205875 - DNA, 20 bp, Homo sapiens
gctggcaaaggtggctctcc

SEQ ID NO: 4205876 - DNA, 23 bp, Homo sapiens
gctggcagctgtcattcaggacc

SEQ ID NO: 4205877 - DNA, 22 bp, Homo sapiens
gctggcctcccaataaagctgg

SEQ ID NO: 4205878 - DNA, 15 bp, Homo sapiens
gctggctgacctggg

SEQ ID NO: 4205879 - DNA, 15 bp, Homo sapiens
gctgggggaagggtg

SEQ ID NO: 4205880 - DNA, 16 bp, Homo sapiens
gctgggggaagggtgg

SEQ ID NO: 4205881 - DNA, 15 bp, Homo sapiens
gctggtgctgtggcc

SEQ ID NO: 4205882 - DNA, 20 bp, Homo sapiens
gctgtagtagccctttctgt

SEQ ID NO: 4205883 - DNA, 16 bp, Homo sapiens
gctgtagtaggcattt

SEQ ID NO: 4205884 - DNA, 23 bp, Homo sapiens
gctgtagtaggcatttttaccat

SEQ ID NO: 4205885 - DNA, 17 bp, Homo sapiens
gctgtgctatggtgctc

SEQ ID NO: 4205886 - DNA, 17 bp, Homo sapiens
gctgtgcttatggtacc

SEQ ID NO: 4205887 - DNA, 12 bp, Homo sapiens
gctgtggcccag

SEQ ID NO: 4205888 - DNA, 15 bp, Homo sapiens
gctgtgtctcacaga

SEQ ID NO: 4205889 - DNA, 23 bp, Homo sapiens
gctgtgtttggctttcagggagg

SEQ ID NO: 4205890 - DNA, 15 bp, Homo sapiens
gctgttttagctgag

SEQ ID NO: 4205891 - DNA, 16 bp, Homo sapiens
gctgttttcaaagccc

SEQ ID NO: 4205892 - DNA, 22 bp, Homo sapiens
gcttacaatggagtctgcagtg

SEQ ID NO: 4205893 - DNA, 19 bp, Homo sapiens
gcttactaatgtgccccat

SEQ ID NO: 4205894 - DNA, 19 bp, Homo sapiens
gcttaggctgcttattgga

SEQ ID NO: 4205895 - DNA, 17 bp, Homo sapiens
gcttaggtgccaggctg

SEQ ID NO: 4205896 - DNA, 17 bp, Homo sapiens
gcttatcaataaacctg

SEQ ID NO: 4205897 - DNA, 13 bp, Homo sapiens
gcttatcatcagc

SEQ ID NO: 4205898 - DNA, 15 bp, Homo sapiens
gcttatcatcagccc

SEQ ID NO: 4205899 - DNA, 16 bp, Homo sapiens
gcttatggtaccagat

SEQ ID NO: 4205900 - DNA, 20 bp, Homo sapiens
gcttatggtaccagatgcag

SEQ ID NO: 4205901 - DNA, 18 bp, Homo sapiens
gcttattttttaaaataa

SEQ ID NO: 4205902 - DNA, 18 bp, Homo sapiens
gcttcaaaccctcaagag

SEQ ID NO: 4205903 - DNA, 14 bp, Homo sapiens
gcttcaagctctct

SEQ ID NO: 4205904 - DNA, 17 bp, Homo sapiens
gcttcagcatatttata

SEQ ID NO: 4205905 - DNA, 12 bp, Homo sapiens
gcttcagcctga

SEQ ID NO: 4205906 - DNA, 15 bp, Homo sapiens
gcttcagcctgaggc

SEQ ID NO: 4205907 - DNA, 20 bp, Homo sapiens
gcttcagcctgaggctgaga

SEQ ID NO: 4205908 - DNA, 15 bp, Homo sapiens
gcttcaggtccaggc

SEQ ID NO: 4205909 - DNA, 15 bp, Homo sapiens
gcttcagttgttttc

SEQ ID NO: 4205910 - DNA, 22 bp, Homo sapiens
gcttccaggtatctccaggatt

SEQ ID NO: 4205911 - DNA, 18 bp, Homo sapiens
gcttccaggtggcaggat

SEQ ID NO: 4205912 - DNA, 11 bp, Homo sapiens
gcttccatgcc

SEQ ID NO: 4205913 - DNA, 12 bp, Homo sapiens
gcttccatgcct

SEQ ID NO: 4205914 - DNA, 12 bp, Homo sapiens
gcttcccagagg

SEQ ID NO: 4205915 - DNA, 23 bp, Homo sapiens
gcttccccaggagctctctgctg

SEQ ID NO: 4205916 - DNA, 13 bp, Homo sapiens
gcttctattaaat

SEQ ID NO: 4205917 - DNA, 18 bp, Homo sapiens
gcttctattaaatgtata

SEQ ID NO: 4205918 - DNA, 12 bp, Homo sapiens
gcttctgcagca

SEQ ID NO: 4205919 - DNA, 18 bp, Homo sapiens
gcttctgcagcaactccc

SEQ ID NO: 4205920 - DNA, 14 bp, Homo sapiens
gcttctggagccct

SEQ ID NO: 4205921 - DNA, 18 bp, Homo sapiens
gcttctggagcccttggg

SEQ ID NO: 4205922 - DNA, 15 bp, Homo sapiens
gcttctggctcctcc

SEQ ID NO: 4205923 - DNA, 19 bp, Homo sapiens
gcttgatgggattctggac

SEQ ID NO: 4205924 - DNA, 20 bp, Homo sapiens
gcttgatgggattctggaca

SEQ ID NO: 4205925 - DNA, 22 bp, Homo sapiens
gcttgatgggattctggacagg

SEQ ID NO: 4205926 - DNA, 19 bp, Homo sapiens
gcttggaaagcatcacctc

SEQ ID NO: 4205927 - DNA, 14 bp, Homo sapiens
gcttggagctgagc

SEQ ID NO: 4205928 - DNA, 15 bp, Homo sapiens
gcttggcagagagga

SEQ ID NO: 4205929 - DNA, 20 bp, Homo sapiens
gcttgggtggtgggtgctgg

SEQ ID NO: 4205930 - DNA, 14 bp, Homo sapiens
gcttgtatagtgta

SEQ ID NO: 4205931 - DNA, 18 bp, Homo sapiens
gctttcactgtgactggg

SEQ ID NO: 4205932 - DNA, 16 bp, Homo sapiens
ggggcatgctggggca

SEQ ID NO: 4205933 - DNA, 13 bp, Homo sapiens
ggggccatgggtg

SEQ ID NO: 4205934 - DNA, 22 bp, Homo sapiens
ggggcccattctgcatgccctc

SEQ ID NO: 4205935 - DNA, 14 bp, Homo sapiens
ggggccccagggct

SEQ ID NO: 4205936 - DNA, 20 bp, Homo sapiens
ggggcgatcaagtccagagc

SEQ ID NO: 4205937 - DNA, 15 bp, Homo sapiens
ggggcgtggctggcc

SEQ ID NO: 4205938 - DNA, 15 bp, Homo sapiens
ggggctccggagggg

SEQ ID NO: 4205939 - DNA, 13 bp, Homo sapiens
ggggctcctggaa

SEQ ID NO: 4205940 - DNA, 14 bp, Homo sapiens
ggggctgccagcct

SEQ ID NO: 4205941 - DNA, 15 bp, Homo sapiens
ggggctttctggaga

SEQ ID NO: 4205942 - DNA, 18 bp, Homo sapiens
ggggtgatttcagagagg

SEQ ID NO: 4205943 - DNA, 13 bp, Homo sapiens
ggggttgcccagc

SEQ ID NO: 4205944 - DNA, 14 bp, Homo sapiens
gggtatttcctgct

SEQ ID NO: 4205945 - DNA, 17 bp, Homo sapiens
gggtcagccagggccag

SEQ ID NO: 4205946 - DNA, 20 bp, Homo sapiens
gggtccacccagcaaagagt

SEQ ID NO: 4205947 - DNA, 17 bp, Homo sapiens
gggtctaaagagaacaa

SEQ ID NO: 4205948 - DNA, 15 bp, Homo sapiens
gggtctccctggagt

SEQ ID NO: 4205949 - DNA, 20 bp, Homo sapiens
gggtcttttggctctgaagg

SEQ ID NO: 4205950 - DNA, 16 bp, Homo sapiens
gggtgccccccatgcc

SEQ ID NO: 4205951 - DNA, 18 bp, Homo sapiens
gggtgcctcagagcaggc

SEQ ID NO: 4205952 - DNA, 19 bp, Homo sapiens
gggtgcctcagagcaggct

SEQ ID NO: 4205953 - DNA, 15 bp, Homo sapiens
gggtggcaagggggc

SEQ ID NO: 4205954 - DNA, 19 bp, Homo sapiens
gggtgggagagcccagcca

SEQ ID NO: 4205955 - DNA, 22 bp, Homo sapiens
gggtggggaatgtttgggcaga

SEQ ID NO: 4205956 - DNA, 16 bp, Homo sapiens
gggtggtgggtgctgg

SEQ ID NO: 4205957 - DNA, 16 bp, Homo sapiens
gggttctttggaagga

SEQ ID NO: 4205958 - DNA, 14 bp, Homo sapiens
gggttgtgaggcct

SEQ ID NO: 4205959 - DNA, 14 bp, Homo sapiens
ggtaccagatgcag

SEQ ID NO: 4205960 - DNA, 11 bp, Homo sapiens
ggtagaagcca

SEQ ID NO: 4205961 - DNA, 14 bp, Homo sapiens
ggtagcgagctgct

SEQ ID NO: 4205962 - DNA, 15 bp, Homo sapiens
ggtagcgagctgctc

SEQ ID NO: 4205963 - DNA, 16 bp, Homo sapiens
ggtagcgagctgctct

SEQ ID NO: 4205964 - DNA, 19 bp, Homo sapiens
ggtagcgagctgctctgct

SEQ ID NO: 4205965 - DNA, 13 bp, Homo sapiens
ggtagtactggga

SEQ ID NO: 4205966 - DNA, 22 bp, Homo sapiens
ggtatacaggtggtttttggtt

SEQ ID NO: 4205967 - DNA, 23 bp, Homo sapiens
ggtatagttcatgtctgctatca

SEQ ID NO: 4205968 - DNA, 19 bp, Homo sapiens
ggtatccattataaacaat

SEQ ID NO: 4205969 - DNA, 12 bp, Homo sapiens
ggtatctccagg

SEQ ID NO: 4205970 - DNA, 13 bp, Homo sapiens
ggtatctccagga

SEQ ID NO: 4205971 - DNA, 23 bp, Homo sapiens
ggtatctccaggattgaagagca

SEQ ID NO: 4205972 - DNA, 16 bp, Homo sapiens
ggtatgaacttgagga

SEQ ID NO: 4205973 - DNA, 20 bp, Homo sapiens
ggtatgaacttgaggacaca

SEQ ID NO: 4205974 - DNA, 17 bp, Homo sapiens
ggtattagcaaagcaaa

SEQ ID NO: 4205975 - DNA, 22 bp, Homo sapiens
ggtcaaaccgcactcacccatg

SEQ ID NO: 4205976 - DNA, 21 bp, Homo sapiens
ggtcacattcaggaagatgaa

SEQ ID NO: 4205977 - DNA, 13 bp, Homo sapiens
ggtcaccagcctg

SEQ ID NO: 4205978 - DNA, 14 bp, Homo sapiens
ggtcaccatgaaac

SEQ ID NO: 4205979 - DNA, 15 bp, Homo sapiens
ggtcaccatgaaact

SEQ ID NO: 4205980 - DNA, 15 bp, Homo sapiens
ggtcagagccactct

SEQ ID NO: 4205981 - DNA, 14 bp, Homo sapiens
ggtcagagtgccac

SEQ ID NO: 4205982 - DNA, 12 bp, Homo sapiens
ggtcagccaggg

SEQ ID NO: 4205983 - DNA, 15 bp, Homo sapiens
ggtcagccagggcca

SEQ ID NO: 4205984 - DNA, 22 bp, Homo sapiens
ggtcaggatgtaggggttaact

SEQ ID NO: 4205985 - DNA, 17 bp, Homo sapiens
ggtcagtgcagcagagg

SEQ ID NO: 4205986 - DNA, 20 bp, Homo sapiens
ggtcatataaaatatattta

SEQ ID NO: 4205987 - DNA, 18 bp, Homo sapiens
ggtcatgatttctgtgaa

SEQ ID NO: 4205988 - DNA, 13 bp, Homo sapiens
ggtccaggcagga

SEQ ID NO: 4205989 - DNA, 13 bp, Homo sapiens
ggtcccacactgg

SEQ ID NO: 4205990 - DNA, 20 bp, Homo sapiens
ggtcctccatttcaactcca

SEQ ID NO: 4205991 - DNA, 13 bp, Homo sapiens
ggtcctgagacct

SEQ ID NO: 4205992 - DNA, 18 bp, Homo sapiens
ggtcctgcaatctccagg

SEQ ID NO: 4205993 - DNA, 23 bp, Homo sapiens
ggtcctgcaatctccagggctgc

SEQ ID NO: 4205994 - DNA, 18 bp, Homo sapiens
ggtcctgggggctgctgc

SEQ ID NO: 4205995 - DNA, 21 bp, Homo sapiens
ggtcctgtcctggctcccagg

SEQ ID NO: 4205996 - DNA, 16 bp, Homo sapiens
ggtcctttctggaagt

SEQ ID NO: 4205997 - DNA, 20 bp, Homo sapiens
ggtcgaccccaaagcccctt

SEQ ID NO: 4205998 - DNA, 13 bp, Homo sapiens
ggtctaaagagaa

SEQ ID NO: 4205999 - DNA, 15 bp, Homo sapiens
ggtctggctgagctg

SEQ ID NO: 4206000 - DNA, 14 bp, Homo sapiens
ggtcttcagccatc

SEQ ID NO: 4206001 - DNA, 22 bp, Homo sapiens
ggtcttggaagtgtgtggaagg

SEQ ID NO: 4206002 - DNA, 15 bp, Homo sapiens
ggtcttttggctctg

SEQ ID NO: 4206003 - DNA, 14 bp, Homo sapiens
ggtgaacagagaga

SEQ ID NO: 4206004 - DNA, 17 bp, Homo sapiens
ggtgaataaagcaggga

SEQ ID NO: 4206005 - DNA, 13 bp, Homo sapiens
ggtgagaaattta

SEQ ID NO: 4206006 - DNA, 15 bp, Homo sapiens
ggtgagaaatttaaa

SEQ ID NO: 4206007 - DNA, 14 bp, Homo sapiens
ggtgagaccacctc

SEQ ID NO: 4206008 - DNA, 11 bp, Homo sapiens
ggtgagctcag

SEQ ID NO: 4206009 - DNA, 14 bp, Homo sapiens
ggtgagctcagctc

SEQ ID NO: 4206010 - DNA, 15 bp, Homo sapiens
ggtgaggcccagcct

SEQ ID NO: 4206011 - DNA, 22 bp, Homo sapiens
ggtgatttctgagattttagtt

SEQ ID NO: 4206012 - DNA, 17 bp, Homo sapiens
ggtgcactggccccacc

SEQ ID NO: 4206013 - DNA, 18 bp, Homo sapiens
ggtgccaggctgtaagca

SEQ ID NO: 4206014 - DNA, 22 bp, Homo sapiens
ggtgccccccatgccctccctg

SEQ ID NO: 4206015 - DNA, 17 bp, Homo sapiens
ggtgcctggcttgctgt

SEQ ID NO: 4206016 - DNA, 12 bp, Homo sapiens
ggtgctctgtct

SEQ ID NO: 4206017 - DNA, 16 bp, Homo sapiens
ggtgctgtggccaggg

SEQ ID NO: 4206018 - DNA, 15 bp, Homo sapiens
ggtggacagtcctgg

SEQ ID NO: 4206019 - DNA, 16 bp, Homo sapiens
ggtggacagtcctggg

SEQ ID NO: 4206020 - DNA, 18 bp, Homo sapiens
ggtggacagtcctgggag

SEQ ID NO: 4206021 - DNA, 16 bp, Homo sapiens
ggtggcagagtgagac

SEQ ID NO: 4206022 - DNA, 14 bp, Homo sapiens
ggtggccaagcctg

SEQ ID NO: 4206023 - DNA, 18 bp, Homo sapiens
ggtggccaagcctggccc

SEQ ID NO: 4206024 - DNA, 14 bp, Homo sapiens
ggtggcttttgcgg

SEQ ID NO: 4206025 - DNA, 20 bp, Homo sapiens
ggtgggagacgaacggaagg

SEQ ID NO: 4206026 - DNA, 12 bp, Homo sapiens
ggtgggccactc

SEQ ID NO: 4206027 - DNA, 15 bp, Homo sapiens
ggtgggccactctcc

SEQ ID NO: 4206028 - DNA, 17 bp, Homo sapiens
ggtggtcctgagacctg

SEQ ID NO: 4206029 - DNA, 18 bp, Homo sapiens
ggtggtcctgagacctga

SEQ ID NO: 4206030 - DNA, 15 bp, Homo sapiens
ggtggtgccagaggt

SEQ ID NO: 4206031 - DNA, 14 bp, Homo sapiens
ggtggtggatctgt

SEQ ID NO: 4206032 - DNA, 21 bp, Homo sapiens
ggtggtggatctgtccaagga

SEQ ID NO: 4206033 - DNA, 20 bp, Homo sapiens
ggtgtcaccctgcagagcta

SEQ ID NO: 4206034 - DNA, 16 bp, Homo sapiens
ggttaaaacaaaaaca

SEQ ID NO: 4206035 - DNA, 20 bp, Homo sapiens
ggttattgaaaatatgatgt

SEQ ID NO: 4206036 - DNA, 13 bp, Homo sapiens
ggttcatatttat

SEQ ID NO: 4206037 - DNA, 17 bp, Homo sapiens
ggttcccgagggagctg

SEQ ID NO: 4206038 - DNA, 23 bp, Homo sapiens
ggttctggggctgggcctgagcc

SEQ ID NO: 4206039 - DNA, 14 bp, Homo sapiens
ggttgcagacagga

SEQ ID NO: 4206040 - DNA, 16 bp, Homo sapiens
ggttgcccagcctgga

SEQ ID NO: 4206041 - DNA, 22 bp, Homo sapiens
ggttgcgggggagctggaaata

SEQ ID NO: 4206042 - DNA, 16 bp, Homo sapiens
ggttggggcaaagcct

SEQ ID NO: 4206043 - DNA, 13 bp, Homo sapiens
ggtttaatgtttt

SEQ ID NO: 4206044 - DNA, 19 bp, Homo sapiens
ggtttaatgttttggccaa

SEQ ID NO: 4206045 - DNA, 20 bp, Homo sapiens
ggtttcaccatgttggccag

SEQ ID NO: 4206046 - DNA, 12 bp, Homo sapiens
ggtttgaaagcc

SEQ ID NO: 4206047 - DNA, 11 bp, Homo sapiens
ggtttgcagtt

SEQ ID NO: 4206048 - DNA, 13 bp, Homo sapiens
ggtttggggctgc

SEQ ID NO: 4206049 - DNA, 19 bp, Homo sapiens
ggtttgtcaacacaaagac

SEQ ID NO: 4206050 - DNA, 20 bp, Homo sapiens
ggtttgtcaacacaaagaca

SEQ ID NO: 4206051 - DNA, 23 bp, Homo sapiens
ggttttccttgaccactggccct

SEQ ID NO: 4206052 - DNA, 19 bp, Homo sapiens
gtaaaaacaaaaagacagt

SEQ ID NO: 4206053 - DNA, 14 bp, Homo sapiens
gtaaaaatatgtga

SEQ ID NO: 4206054 - DNA, 12 bp, Homo sapiens
gtaaaagcaaaa

SEQ ID NO: 4206055 - DNA, 15 bp, Homo sapiens
gtaaaagtgtgagca

SEQ ID NO: 4206056 - DNA, 12 bp, Homo sapiens
gtaaacaacata

SEQ ID NO: 4206057 - DNA, 15 bp, Homo sapiens
gtaaaggaaataatt

SEQ ID NO: 4206058 - DNA, 16 bp, Homo sapiens
gtaaagtatgtaaaca

SEQ ID NO: 4206059 - DNA, 14 bp, Homo sapiens
gtaaataaattgtt

SEQ ID NO: 4206060 - DNA, 21 bp, Homo sapiens
gtaaatacagtggatctcaat

SEQ ID NO: 4206061 - DNA, 22 bp, Homo sapiens
gtaaatagcttttcatcaattc

SEQ ID NO: 4206062 - DNA, 14 bp, Homo sapiens
gtaaatattttaaa

SEQ ID NO: 4206063 - DNA, 21 bp, Homo sapiens
gtaaatcacgctttttgaaaa

SEQ ID NO: 4206064 - DNA, 23 bp, Homo sapiens
gtaaatgcagccttcttttcaaa

SEQ ID NO: 4206065 - DNA, 12 bp, Homo sapiens
gtaacacatctt

SEQ ID NO: 4206066 - DNA, 18 bp, Homo sapiens
gtaactcagacattccaa

SEQ ID NO: 4206067 - DNA, 23 bp, Homo sapiens
gtaacttaattttgtgaccacag

SEQ ID NO: 4206068 - DNA, 21 bp, Homo sapiens
gttgcgggggagctggaaata

SEQ ID NO: 4206069 - DNA, 20 bp, Homo sapiens
gttgctgattcaagaaacag

SEQ ID NO: 4206070 - DNA, 18 bp, Homo sapiens
gttgtacaagctcaggag

SEQ ID NO: 4206071 - DNA, 14 bp, Homo sapiens
gttgtacacagtct

SEQ ID NO: 4206072 - DNA, 16 bp, Homo sapiens
gttgtacgtaatgtat

SEQ ID NO: 4206073 - DNA, 19 bp, Homo sapiens
gttgtggaaagcctctgct

SEQ ID NO: 4206074 - DNA, 21 bp, Homo sapiens
gttgtgttgttatcatttaag

SEQ ID NO: 4206075 - DNA, 14 bp, Homo sapiens
gttgttactgaagt

SEQ ID NO: 4206076 - DNA, 19 bp, Homo sapiens
gttgttatcatttaagatt

SEQ ID NO: 4206077 - DNA, 17 bp, Homo sapiens
gttgtttgtaaatgcct

SEQ ID NO: 4206078 - DNA, 12 bp, Homo sapiens
gtttaacacaat

SEQ ID NO: 4206079 - DNA, 14 bp, Homo sapiens
gtttaacattcaca

SEQ ID NO: 4206080 - DNA, 20 bp, Homo sapiens
gtttaagccaaaacaatgtt

SEQ ID NO: 4206081 - DNA, 13 bp, Homo sapiens
gtttaatgttttg

SEQ ID NO: 4206082 - DNA, 19 bp, Homo sapiens
gtttacaagtgtatatcag

SEQ ID NO: 4206083 - DNA, 23 bp, Homo sapiens
gtttacaagtgtatatcagaaaa

SEQ ID NO: 4206084 - DNA, 22 bp, Homo sapiens
gtttacatgaacacagctgctg

SEQ ID NO: 4206085 - DNA, 20 bp, Homo sapiens
gtttagcccatctctccaga

SEQ ID NO: 4206086 - DNA, 21 bp, Homo sapiens
gtttatttccaaataaaatga

SEQ ID NO: 4206087 - DNA, 18 bp, Homo sapiens
gtttcagaagcaggcagg

SEQ ID NO: 4206088 - DNA, 20 bp, Homo sapiens
gtttcaggagattgttaatt

SEQ ID NO: 4206089 - DNA, 16 bp, Homo sapiens
gtttcccaagagctac

SEQ ID NO: 4206090 - DNA, 22 bp, Homo sapiens
gtttcctccttgtcactgaaga

SEQ ID NO: 4206091 - DNA, 13 bp, Homo sapiens
gtttctagagggc

SEQ ID NO: 4206092 - DNA, 15 bp, Homo sapiens
gtttctccccctggg

SEQ ID NO: 4206093 - DNA, 17 bp, Homo sapiens
gtttctccccctgggct

SEQ ID NO: 4206094 - DNA, 21 bp, Homo sapiens
gtttctgcccacattggaccc

SEQ ID NO: 4206095 - DNA, 18 bp, Homo sapiens
gtttctggtgccatttct

SEQ ID NO: 4206096 - DNA, 22 bp, Homo sapiens
gtttcttaaataagaaactttt

SEQ ID NO: 4206097 - DNA, 12 bp, Homo sapiens
gtttgaacttca

SEQ ID NO: 4206098 - DNA, 16 bp, Homo sapiens
gtttgaggctgcagcg

SEQ ID NO: 4206099 - DNA, 20 bp, Homo sapiens
gtttgcactgtatgctggac

SEQ ID NO: 4206100 - DNA, 21 bp, Homo sapiens
gtttgctttctgatcaaggcc

SEQ ID NO: 4206101 - DNA, 16 bp, Homo sapiens
gtttggacacagtgtt

SEQ ID NO: 4206102 - DNA, 13 bp, Homo sapiens
gtttggctttcag

SEQ ID NO: 4206103 - DNA, 18 bp, Homo sapiens
gtttggctttcagggagg

SEQ ID NO: 4206104 - DNA, 13 bp, Homo sapiens
gtttgtaaaacta

SEQ ID NO: 4206105 - DNA, 23 bp, Homo sapiens
gtttgtcaacacaaagacacagg

SEQ ID NO: 4206106 - DNA, 13 bp, Homo sapiens
gtttgtgtggatg

SEQ ID NO: 4206107 - DNA, 21 bp, Homo sapiens
gtttgtttctccccctgggct

SEQ ID NO: 4206108 - DNA, 22 bp, Homo sapiens
gttttacaaatttttcctgcaa

SEQ ID NO: 4206109 - DNA, 23 bp, Homo sapiens
gttttatactgtacttaataaat

SEQ ID NO: 4206110 - DNA, 14 bp, Homo sapiens
gttttccaccctgg

SEQ ID NO: 4206111 - DNA, 22 bp, Homo sapiens
gttttcccgagcaaagtctaaa

SEQ ID NO: 4206112 - DNA, 23 bp, Homo sapiens
gttttcccgagcaaagtctaaag

SEQ ID NO: 4206113 - DNA, 21 bp, Homo sapiens
gttttcctatgctttgaaaca

SEQ ID NO: 4206114 - DNA, 21 bp, Homo sapiens
gttttccttagtttttacctt

SEQ ID NO: 4206115 - DNA, 19 bp, Homo sapiens
gttttctcttactgcagta

SEQ ID NO: 4206116 - DNA, 21 bp, Homo sapiens
gttttctcttccttgtgattg

SEQ ID NO: 4206117 - DNA, 14 bp, Homo sapiens
gttttctttgaatg

SEQ ID NO: 4206118 - DNA, 14 bp, Homo sapiens
gttttgcactgaca

SEQ ID NO: 4206119 - DNA, 18 bp, Homo sapiens
gttttgcactgacaagat

SEQ ID NO: 4206120 - DNA, 17 bp, Homo sapiens
gttttgctacataatta

SEQ ID NO: 4206121 - DNA, 18 bp, Homo sapiens
gtttttaacaatctaaca

SEQ ID NO: 4206122 - DNA, 15 bp, Homo sapiens
gtttttaagtcctgt

SEQ ID NO: 4206123 - DNA, 13 bp, Homo sapiens
gtttttaataatt

SEQ ID NO: 4206124 - DNA, 12 bp, Homo sapiens
gtttttaatgta

SEQ ID NO: 4206125 - DNA, 20 bp, Homo sapiens
gtttttaccttgttttctct

SEQ ID NO: 4206126 - DNA, 22 bp, Homo sapiens
gtttttaccttgttttctctat

SEQ ID NO: 4206127 - DNA, 11 bp, Homo sapiens
gtttttagttt

SEQ ID NO: 4206128 - DNA, 12 bp, Homo sapiens
gtttttgctatt

SEQ ID NO: 4206129 - DNA, 21 bp, Homo sapiens
taaaaaaacaatcatttgctt

SEQ ID NO: 4206130 - DNA, 18 bp, Homo sapiens
taaaaaagcttaaaactt

SEQ ID NO: 4206131 - DNA, 21 bp, Homo sapiens
taaaaaatgtctatagagaaa

SEQ ID NO: 4206132 - DNA, 19 bp, Homo sapiens
taaaaaattcaaaccaatt

SEQ ID NO: 4206133 - DNA, 20 bp, Homo sapiens
taaaaactagaggtgagaaa

SEQ ID NO: 4206134 - DNA, 22 bp, Homo sapiens
taaaaacttcgtgcatttgtta

SEQ ID NO: 4206135 - DNA, 19 bp, Homo sapiens
taaaaagagagaaaactta

SEQ ID NO: 4206136 - DNA, 20 bp, Homo sapiens
taaaaagagagaaaacttat

SEQ ID NO: 4206137 - DNA, 13 bp, Homo sapiens
taaaaagatttgt

SEQ ID NO: 4206138 - DNA, 22 bp, Homo sapiens
taaaaagtaattgtagatggaa

SEQ ID NO: 4206139 - DNA, 15 bp, Homo sapiens
taaaaatgatctaaa

SEQ ID NO: 4206140 - DNA, 22 bp, Homo sapiens
taaaaatgtatcccattggcta

SEQ ID NO: 4206141 - DNA, 13 bp, Homo sapiens
taaaaatgtgaat

SEQ ID NO: 4206142 - DNA, 23 bp, Homo sapiens
taaaacaatgaaggaaaacctca

SEQ ID NO: 4206143 - DNA, 13 bp, Homo sapiens
taaaacagcctgg

SEQ ID NO: 4206144 - DNA, 22 bp, Homo sapiens
taaaacagcctgggtaggaaaa

SEQ ID NO: 4206145 - DNA, 16 bp, Homo sapiens
taaaaccacagaacag

SEQ ID NO: 4206146 - DNA, 22 bp, Homo sapiens
taaaaccattatttaataagag

SEQ ID NO: 4206147 - DNA, 17 bp, Homo sapiens
taaaacctagaacttca

SEQ ID NO: 4206148 - DNA, 18 bp, Homo sapiens
taaaacctagaacttcaa

SEQ ID NO: 4206149 - DNA, 21 bp, Homo sapiens
taaaacctttcaaatttcaca

SEQ ID NO: 4206150 - DNA, 14 bp, Homo sapiens
taaaactttgaagt

SEQ ID NO: 4206151 - DNA, 19 bp, Homo sapiens
taaaagcaaaaaagaaaac

SEQ ID NO: 4206152 - DNA, 20 bp, Homo sapiens
taaaagcaaaaaagaaaacc

SEQ ID NO: 4206153 - DNA, 15 bp, Homo sapiens
taaaaggtgagctca

SEQ ID NO: 4206154 - DNA, 16 bp, Homo sapiens
taaaagtactgaagac

SEQ ID NO: 4206155 - DNA, 15 bp, Homo sapiens
taaaagttatatcta

SEQ ID NO: 4206156 - DNA, 21 bp, Homo sapiens
taaaagttgtgattccagata

SEQ ID NO: 4206157 - DNA, 18 bp, Homo sapiens
taaaataattttaaaagt

SEQ ID NO: 4206158 - DNA, 13 bp, Homo sapiens
taaaatagcaaaa

SEQ ID NO: 4206159 - DNA, 17 bp, Homo sapiens
taaaatagcaaaagaag

SEQ ID NO: 4206160 - DNA, 22 bp, Homo sapiens
taaaatagcaaaagaagaagtt

SEQ ID NO: 4206161 - DNA, 14 bp, Homo sapiens
taaaatagcttgta

SEQ ID NO: 4206162 - DNA, 18 bp, Homo sapiens
taaaatagcttgtatagt

SEQ ID NO: 4206163 - DNA, 17 bp, Homo sapiens
taaaatatttttgaaag

SEQ ID NO: 4206164 - DNA, 13 bp, Homo sapiens
taaaatcaaagaa

SEQ ID NO: 4206165 - DNA, 18 bp, Homo sapiens
taaaatgagtgatctcaa

SEQ ID NO: 4206166 - DNA, 16 bp, Homo sapiens
taaaatgattgtaaaa

SEQ ID NO: 4206167 - DNA, 18 bp, Homo sapiens
taaaatgattgtaaaata

SEQ ID NO: 4206168 - DNA, 16 bp, Homo sapiens
taaaatgattgtagta

SEQ ID NO: 4206169 - DNA, 18 bp, Homo sapiens
taaaatgctatctcaaag

SEQ ID NO: 4206170 - DNA, 23 bp, Homo sapiens
taaaatgtaaagccatgctggaa

SEQ ID NO: 4206171 - DNA, 23 bp, Homo sapiens
taaaattgtatagagatatgcag

SEQ ID NO: 4206172 - DNA, 19 bp, Homo sapiens
taaacaacaaacttggtct

SEQ ID NO: 4206173 - DNA, 21 bp, Homo sapiens
taaacacttatcttctggatt

SEQ ID NO: 4206174 - DNA, 17 bp, Homo sapiens
taaacatcatagtttct

SEQ ID NO: 4206175 - DNA, 21 bp, Homo sapiens
taaacattgtgatgattatta

SEQ ID NO: 4206176 - DNA, 19 bp, Homo sapiens
taaacccaggaggcggagg

SEQ ID NO: 4206177 - DNA, 22 bp, Homo sapiens
taaacccccgctccagatctgc

SEQ ID NO: 4206178 - DNA, 17 bp, Homo sapiens
taaacctggagatgatg

SEQ ID NO: 4206179 - DNA, 19 bp, Homo sapiens
taaacctggagatgatgat

SEQ ID NO: 4206180 - DNA, 13 bp, Homo sapiens
taaactaaacacg

SEQ ID NO: 4206181 - DNA, 17 bp, Homo sapiens
taaactataagcaagaa

SEQ ID NO: 4206182 - DNA, 13 bp, Homo sapiens
taaactatcagtt

SEQ ID NO: 4206183 - DNA, 15 bp, Homo sapiens
taaactatttgtctt

SEQ ID NO: 4206184 - DNA, 19 bp, Homo sapiens
taaactcaaaacttaacat

SEQ ID NO: 4206185 - DNA, 20 bp, Homo sapiens
taaacttagaataaaattgt

SEQ ID NO: 4206186 - DNA, 19 bp, Homo sapiens
taaagacagggtttcacca

SEQ ID NO: 4206187 - DNA, 20 bp, Homo sapiens
taaagataacccttattcca

SEQ ID NO: 4206188 - DNA, 12 bp, Homo sapiens
taaagatttttt

SEQ ID NO: 4206189 - DNA, 20 bp, Homo sapiens
taaagattttttaataattt

SEQ ID NO: 4206190 - DNA, 21 bp, Homo sapiens
taaagcgtttgcacagatcaa

SEQ ID NO: 4206191 - DNA, 17 bp, Homo sapiens
taaagctgcctgtagtt

SEQ ID NO: 4206192 - DNA, 23 bp, Homo sapiens
taaagctgcctgtagttaggaaa

SEQ ID NO: 4206193 - DNA, 19 bp, Homo sapiens
taaagctggacaagaagct

SEQ ID NO: 4206194 - DNA, 23 bp, Homo sapiens
taaagctggacaagaagctgcta

SEQ ID NO: 4206195 - DNA, 19 bp, Homo sapiens
taaagctggtttaatgttt

SEQ ID NO: 4206196 - DNA, 18 bp, Homo sapiens
taaaggtagagatgtgtg

SEQ ID NO: 4206197 - DNA, 21 bp, Homo sapiens
taaagtatgtaaagtatgtaa

SEQ ID NO: 4206198 - DNA, 18 bp, Homo sapiens
taaagtctattgtttgtt

SEQ ID NO: 4206199 - DNA, 15 bp, Homo sapiens
taaagtgtagcaccc

SEQ ID NO: 4206200 - DNA, 20 bp, Homo sapiens
taaagttgataaagattttt

SEQ ID NO: 4206201 - DNA, 16 bp, Homo sapiens
tagaagcgctcatctg

SEQ ID NO: 4206202 - DNA, 16 bp, Homo sapiens
tagaagctgtagtagc

SEQ ID NO: 4206203 - DNA, 22 bp, Homo sapiens
tagaagtgttttaatttctaca

SEQ ID NO: 4206204 - DNA, 19 bp, Homo sapiens
tagaataagttggagaaat

SEQ ID NO: 4206205 - DNA, 22 bp, Homo sapiens
tagaataagttggagaaatgtt

SEQ ID NO: 4206206 - DNA, 13 bp, Homo sapiens
tagaataataata

SEQ ID NO: 4206207 - DNA, 15 bp, Homo sapiens
tagaataataataaa

SEQ ID NO: 4206208 - DNA, 14 bp, Homo sapiens
tagaatatggactt

SEQ ID NO: 4206209 - DNA, 22 bp, Homo sapiens
tagaatatggacttaaatgtta

SEQ ID NO: 4206210 - DNA, 17 bp, Homo sapiens
tagaatgatttttgcta

SEQ ID NO: 4206211 - DNA, 19 bp, Homo sapiens
tagaatgatttttgctatt

SEQ ID NO: 4206212 - DNA, 17 bp, Homo sapiens
tagaattctgagatcca

SEQ ID NO: 4206213 - DNA, 18 bp, Homo sapiens
tagacaactcttccattt

SEQ ID NO: 4206214 - DNA, 12 bp, Homo sapiens
tagacagaagaa

SEQ ID NO: 4206215 - DNA, 15 bp, Homo sapiens
tagacagaagaaaca

SEQ ID NO: 4206216 - DNA, 18 bp, Homo sapiens
tagacagtgctgccctgc

SEQ ID NO: 4206217 - DNA, 15 bp, Homo sapiens
tagactttctcagtg

SEQ ID NO: 4206218 - DNA, 12 bp, Homo sapiens
tagagaggaaaa

SEQ ID NO: 4206219 - DNA, 20 bp, Homo sapiens
tagagaggtagcgagctgct

SEQ ID NO: 4206220 - DNA, 20 bp, Homo sapiens
tagagatatgcagaaggaag

SEQ ID NO: 4206221 - DNA, 16 bp, Homo sapiens
tagagcactgccacca

SEQ ID NO: 4206222 - DNA, 19 bp, Homo sapiens
tagagccccccgtgtggct

SEQ ID NO: 4206223 - DNA, 12 bp, Homo sapiens
tagagcctggcg

SEQ ID NO: 4206224 - DNA, 17 bp, Homo sapiens
tagagctttcaagtaca

SEQ ID NO: 4206225 - DNA, 23 bp, Homo sapiens
tagagggcactagaactttgtgc

SEQ ID NO: 4206226 - DNA, 21 bp, Homo sapiens
tagaggtttgtcaacaaaaag

SEQ ID NO: 4206227 - DNA, 14 bp, Homo sapiens
tagatcatggcagc

SEQ ID NO: 4206228 - DNA, 21 bp, Homo sapiens
tagatccatttggacaaaatg

SEQ ID NO: 4206229 - DNA, 22 bp, Homo sapiens
tagatccatttggacaaaatgg

SEQ ID NO: 4206230 - DNA, 21 bp, Homo sapiens
tagatgagattgttttatcat

SEQ ID NO: 4206231 - DNA, 15 bp, Homo sapiens
tagatggtgaaattt

SEQ ID NO: 4206232 - DNA, 16 bp, Homo sapiens
tagatgtgcaagtctt

SEQ ID NO: 4206233 - DNA, 20 bp, Homo sapiens
tagatgtgcaagtcttgtca

SEQ ID NO: 4206234 - DNA, 18 bp, Homo sapiens
tagatttgtattttaaaa

SEQ ID NO: 4206235 - DNA, 20 bp, Homo sapiens
tagcaaagcaaaaggctgag

SEQ ID NO: 4206236 - DNA, 19 bp, Homo sapiens
tagcaagttctagagaaga

SEQ ID NO: 4206237 - DNA, 22 bp, Homo sapiens
tagcacaggttagggtgtgtgc

SEQ ID NO: 4206238 - DNA, 16 bp, Homo sapiens
tagcacatatttcaca

SEQ ID NO: 4206239 - DNA, 20 bp, Homo sapiens
tagcacatgtctgtcctcag

SEQ ID NO: 4206240 - DNA, 21 bp, Homo sapiens
tagcacatgtctgtcctcaga

SEQ ID NO: 4206241 - DNA, 21 bp, Homo sapiens
tagcacgggttaagatctgaa

SEQ ID NO: 4206242 - DNA, 23 bp, Homo sapiens
tagcacgggttaagatctgaaag

SEQ ID NO: 4206243 - DNA, 23 bp, Homo sapiens
tagcagaaaccaagtctacttca

SEQ ID NO: 4206244 - DNA, 18 bp, Homo sapiens
tagcagaggaaaaagaaa

SEQ ID NO: 4206245 - DNA, 16 bp, Homo sapiens
tagcaggatctgccca

SEQ ID NO: 4206246 - DNA, 23 bp, Homo sapiens
tagcaggtggtcctgagacctga

SEQ ID NO: 4206247 - DNA, 19 bp, Homo sapiens
tagcattttcttgaaccaa

SEQ ID NO: 4206248 - DNA, 20 bp, Homo sapiens
tagcatttttgatttatgca

SEQ ID NO: 4206249 - DNA, 17 bp, Homo sapiens
tagcccttccctgcctt

SEQ ID NO: 4206250 - DNA, 18 bp, Homo sapiens
tagcctaagtgtggagaa

SEQ ID NO: 4206251 - DNA, 22 bp, Homo sapiens
tagccttgcccggattctggga

SEQ ID NO: 4206252 - DNA, 19 bp, Homo sapiens
tagcctttattattactgt

SEQ ID NO: 4206253 - DNA, 17 bp, Homo sapiens
tagcgagctgctctgct

SEQ ID NO: 4206254 - DNA, 18 bp, Homo sapiens
tagcgtgggttatcagtt

SEQ ID NO: 4206255 - DNA, 17 bp, Homo sapiens
tagctaatctcggtaga

SEQ ID NO: 4206256 - DNA, 15 bp, Homo sapiens
tagctatcagaagac

SEQ ID NO: 4206257 - DNA, 16 bp, Homo sapiens
tagctatcagaagacc

SEQ ID NO: 4206258 - DNA, 13 bp, Homo sapiens
tagctattactgt

SEQ ID NO: 4206259 - DNA, 15 bp, Homo sapiens
tagctattactgtct

SEQ ID NO: 4206260 - DNA, 23 bp, Homo sapiens
tagctcccgagctactctcttgc

SEQ ID NO: 4206261 - DNA, 16 bp, Homo sapiens
tagctcctctgctgct

SEQ ID NO: 4206262 - DNA, 19 bp, Homo sapiens
tagctggaactacaggctc

SEQ ID NO: 4206263 - DNA, 19 bp, Homo sapiens
tagcttgtatagtgtaaaa

SEQ ID NO: 4206264 - DNA, 23 bp, Homo sapiens
tagcttttcagttcccgctctgc

SEQ ID NO: 4206265 - DNA, 19 bp, Homo sapiens
tagcttttcatcaattctt

SEQ ID NO: 4206266 - DNA, 23 bp, Homo sapiens
tagcttttgcaacatggtccagt

SEQ ID NO: 4206267 - DNA, 14 bp, Homo sapiens
taggaaaatgtaca

SEQ ID NO: 4206268 - DNA, 15 bp, Homo sapiens
taggaaaatgtacat

SEQ ID NO: 4206269 - DNA, 14 bp, Homo sapiens
taggaaataaaacc

SEQ ID NO: 4206270 - DNA, 14 bp, Homo sapiens
taggaagctggagg

SEQ ID NO: 4206271 - DNA, 15 bp, Homo sapiens
taggactctgaggct

SEQ ID NO: 4206272 - DNA, 12 bp, Homo sapiens
taggaggaaaag

SEQ ID NO: 4206273 - DNA, 15 bp, Homo sapiens
taggaggaaaagaca

SEQ ID NO: 4206274 - DNA, 19 bp, Homo sapiens
taggaggaaaagacagagc

SEQ ID NO: 4206275 - DNA, 23 bp, Homo sapiens
taggaggaaaagacagagcctcc

SEQ ID NO: 4206276 - DNA, 21 bp, Homo sapiens
taggagttcgagaccagcctg

SEQ ID NO: 4206277 - DNA, 19 bp, Homo sapiens
taggatgtttttcatgaaa

SEQ ID NO: 4206278 - DNA, 21 bp, Homo sapiens
taggatttatttaaaatagca

SEQ ID NO: 4206279 - DNA, 17 bp, Homo sapiens
taggcagacgtggggag

SEQ ID NO: 4206280 - DNA, 13 bp, Homo sapiens
taggcagcctgcc

SEQ ID NO: 4206281 - DNA, 21 bp, Homo sapiens
taggccacattgacagtggtg

SEQ ID NO: 4206282 - DNA, 14 bp, Homo sapiens
taggctggagaagc

SEQ ID NO: 4206283 - DNA, 19 bp, Homo sapiens
taggctggagaagctcacc

SEQ ID NO: 4206284 - DNA, 21 bp, Homo sapiens
tagggaagcagggacaccccc

SEQ ID NO: 4206285 - DNA, 12 bp, Homo sapiens
tagggagccatg

SEQ ID NO: 4206286 - DNA, 12 bp, Homo sapiens
taggtaagggcc

SEQ ID NO: 4206287 - DNA, 13 bp, Homo sapiens
taggtatcttact

SEQ ID NO: 4206288 - DNA, 19 bp, Homo sapiens
taggtgagtcacactcaga

SEQ ID NO: 4206289 - DNA, 20 bp, Homo sapiens
taggttgccaataatacact

SEQ ID NO: 4206290 - DNA, 19 bp, Homo sapiens
taggtttaaaacagcctgg

SEQ ID NO: 4206291 - DNA, 22 bp, Homo sapiens
tagtaaatcacgctttttgaaa

SEQ ID NO: 4206292 - DNA, 14 bp, Homo sapiens
tagtaatctgcatt

SEQ ID NO: 4206293 - DNA, 23 bp, Homo sapiens
tagtaatttattgtctgtctaca

SEQ ID NO: 4206294 - DNA, 13 bp, Homo sapiens
tagtagaaagaaa

SEQ ID NO: 4206295 - DNA, 15 bp, Homo sapiens
tagtagaaagaaaat

SEQ ID NO: 4206296 - DNA, 20 bp, Homo sapiens
tagtagcagtgattgtctta

SEQ ID NO: 4206297 - DNA, 18 bp, Homo sapiens
tagtagccctttctgtgt

SEQ ID NO: 4206298 - DNA, 17 bp, Homo sapiens
tagtatgatttttacaa

SEQ ID NO: 4206299 - DNA, 19 bp, Homo sapiens
tagtcaatcaagtctgttt

SEQ ID NO: 4206300 - DNA, 18 bp, Homo sapiens
tagtcctagaggacctga

SEQ ID NO: 4206301 - DNA, 13 bp, Homo sapiens
tagtgaagatgtt

SEQ ID NO: 4206302 - DNA, 15 bp, Homo sapiens
tagtgaagatgttgt

SEQ ID NO: 4206303 - DNA, 22 bp, Homo sapiens
tagtgccccctctaacccccag

SEQ ID NO: 4206304 - DNA, 23 bp, Homo sapiens
tagtgctgtagagttcactgttg

SEQ ID NO: 4206305 - DNA, 15 bp, Homo sapiens
tagtggcaataagtt

SEQ ID NO: 4206306 - DNA, 19 bp, Homo sapiens
tagtgtaaaataagaatga

SEQ ID NO: 4206307 - DNA, 20 bp, Homo sapiens
tagtgtaggtcagcgtgctt

SEQ ID NO: 4206308 - DNA, 23 bp, Homo sapiens
tagtgtgatttttttcacattta

SEQ ID NO: 4206309 - DNA, 16 bp, Homo sapiens
tagttaggaaataaaa

SEQ ID NO: 4206310 - DNA, 22 bp, Homo sapiens
tagttaggaaataaaacctttc

SEQ ID NO: 4206311 - DNA, 20 bp, Homo sapiens
tagttaggatagcatttttg

SEQ ID NO: 4206312 - DNA, 16 bp, Homo sapiens
tagttatagtttcaga

SEQ ID NO: 4206313 - DNA, 16 bp, Homo sapiens
tagttcagaggaagca

SEQ ID NO: 4206314 - DNA, 17 bp, Homo sapiens
tagttcctttatttaat

SEQ ID NO: 4206315 - DNA, 22 bp, Homo sapiens
tagttctcaatcactgctcccc

SEQ ID NO: 4206316 - DNA, 19 bp, Homo sapiens
tagttgaacatctcacttt

SEQ ID NO: 4206317 - DNA, 12 bp, Homo sapiens
tagttgtgtctg

SEQ ID NO: 4206318 - DNA, 21 bp, Homo sapiens
tagtttaataccccattacca

SEQ ID NO: 4206319 - DNA, 15 bp, Homo sapiens
tagtttaattaacta

SEQ ID NO: 4206320 - DNA, 14 bp, Homo sapiens
tagtttattttgtt

SEQ ID NO: 4206321 - DNA, 19 bp, Homo sapiens
tagtttcatataaagtatc

SEQ ID NO: 4206322 - DNA, 18 bp, Homo sapiens
tagtttgtataacttctt

SEQ ID NO: 4206323 - DNA, 14 bp, Homo sapiens
tagttttgggaggg

SEQ ID NO: 4206324 - DNA, 16 bp, Homo sapiens
tataaaaagtgaaata

SEQ ID NO: 4206325 - DNA, 13 bp, Homo sapiens
tataaaaatgtga

SEQ ID NO: 4206326 - DNA, 16 bp, Homo sapiens
tataaaatatatttat

SEQ ID NO: 4206327 - DNA, 22 bp, Homo sapiens
tataaactttagagtagcatga

SEQ ID NO: 4206328 - DNA, 18 bp, Homo sapiens
tataacagcaaggaaaca

SEQ ID NO: 4206329 - DNA, 18 bp, Homo sapiens
tataataaaggtcacata

SEQ ID NO: 4206330 - DNA, 18 bp, Homo sapiens
tataattgttttatctga

SEQ ID NO: 4206331 - DNA, 15 bp, Homo sapiens
tatacacaacattta

SEQ ID NO: 4206332 - DNA, 20 bp, Homo sapiens
tatacacaacatttatttca

SEQ ID NO: 4206333 - DNA, 18 bp, Homo sapiens
tatacatcctattttgta

SEQ ID NO: 4206334 - DNA, 23 bp, Homo sapiens
tcactccggtgtgcctgcagccc

SEQ ID NO: 4206335 - DNA, 15 bp, Homo sapiens
tcactctgagtgttt

SEQ ID NO: 4206336 - DNA, 17 bp, Homo sapiens
tcactctgagtgtttta

SEQ ID NO: 4206337 - DNA, 22 bp, Homo sapiens
tcactgaatgcctcaatgtgac

SEQ ID NO: 4206338 - DNA, 23 bp, Homo sapiens
tcactgagttttccatggcagga

SEQ ID NO: 4206339 - DNA, 14 bp, Homo sapiens
tcactggagcccag

SEQ ID NO: 4206340 - DNA, 13 bp, Homo sapiens
tcactggcagagc

SEQ ID NO: 4206341 - DNA, 18 bp, Homo sapiens
tcactggcagagcacagc

SEQ ID NO: 4206342 - DNA, 23 bp, Homo sapiens
tcactgtaagactcattccctag

SEQ ID NO: 4206343 - DNA, 18 bp, Homo sapiens
tcacttgggcccaggagg

SEQ ID NO: 4206344 - DNA, 19 bp, Homo sapiens
tcacttgggcccaggaggt

SEQ ID NO: 4206345 - DNA, 23 bp, Homo sapiens
tcacttgggcccaggaggtcaag

SEQ ID NO: 4206346 - DNA, 16 bp, Homo sapiens
tcacttttcagtgatg

SEQ ID NO: 4206347 - DNA, 14 bp, Homo sapiens
tcacttttttacaa

SEQ ID NO: 4206348 - DNA, 18 bp, Homo sapiens
tcagaaaccaaacagttt

SEQ ID NO: 4206349 - DNA, 20 bp, Homo sapiens
tcagaaataggaagattaaa

SEQ ID NO: 4206350 - DNA, 13 bp, Homo sapiens
tcagaagaaaaag

SEQ ID NO: 4206351 - DNA, 12 bp, Homo sapiens
tcagaagcacaa

SEQ ID NO: 4206352 - DNA, 13 bp, Homo sapiens
tcagaagcaggca

SEQ ID NO: 4206353 - DNA, 15 bp, Homo sapiens
tcagaagcaggcagg

SEQ ID NO: 4206354 - DNA, 17 bp, Homo sapiens
tcagaaggcctcactca

SEQ ID NO: 4206355 - DNA, 21 bp, Homo sapiens
tcagaagtaggaaggaaaaaa

SEQ ID NO: 4206356 - DNA, 17 bp, Homo sapiens
tcagaatcaggttgaca

SEQ ID NO: 4206357 - DNA, 15 bp, Homo sapiens
tcagaatggaaagaa

SEQ ID NO: 4206358 - DNA, 22 bp, Homo sapiens
tcagacagcttatggggtattt

SEQ ID NO: 4206359 - DNA, 16 bp, Homo sapiens
tcagactgctgggact

SEQ ID NO: 4206360 - DNA, 23 bp, Homo sapiens
tcagactgctgggactggccagg

SEQ ID NO: 4206361 - DNA, 14 bp, Homo sapiens
tcagactggctggc

SEQ ID NO: 4206362 - DNA, 20 bp, Homo sapiens
tcagactggctggctgcagt

SEQ ID NO: 4206363 - DNA, 14 bp, Homo sapiens
tcagactgtttagt

SEQ ID NO: 4206364 - DNA, 17 bp, Homo sapiens
tcagagaataaacatca

SEQ ID NO: 4206365 - DNA, 11 bp, Homo sapiens
tcagagccact

SEQ ID NO: 4206366 - DNA, 18 bp, Homo sapiens
tcagagccaggctctgcc

SEQ ID NO: 4206367 - DNA, 22 bp, Homo sapiens
tcagataaggtaaaatgccatg

SEQ ID NO: 4206368 - DNA, 16 bp, Homo sapiens
tcagatatatttttca

SEQ ID NO: 4206369 - DNA, 22 bp, Homo sapiens
tcagatgcccagagggcccagg

SEQ ID NO: 4206370 - DNA, 18 bp, Homo sapiens
tcagatgggaagacatga

SEQ ID NO: 4206371 - DNA, 18 bp, Homo sapiens
tcagcagtaagcaggcct

SEQ ID NO: 4206372 - DNA, 17 bp, Homo sapiens
tcagcataagtaaacaa

SEQ ID NO: 4206373 - DNA, 14 bp, Homo sapiens
tcagccagggccag

SEQ ID NO: 4206374 - DNA, 18 bp, Homo sapiens
tcagccagggccaggggt

SEQ ID NO: 4206375 - DNA, 15 bp, Homo sapiens
tcagccctcacaccc

SEQ ID NO: 4206376 - DNA, 20 bp, Homo sapiens
tcagcccttggcttctgctt

SEQ ID NO: 4206377 - DNA, 20 bp, Homo sapiens
tcagcctcccaagtagctgg

SEQ ID NO: 4206378 - DNA, 22 bp, Homo sapiens
tcagccttccccctcccagggc

SEQ ID NO: 4206379 - DNA, 14 bp, Homo sapiens
tcagctactgattt

SEQ ID NO: 4206380 - DNA, 12 bp, Homo sapiens
tcagctggtggc

SEQ ID NO: 4206381 - DNA, 21 bp, Homo sapiens
tcagctgtgaacatggactct

SEQ ID NO: 4206382 - DNA, 16 bp, Homo sapiens
tcagcttttgcttcat

SEQ ID NO: 4206383 - DNA, 14 bp, Homo sapiens
tcaggaaagacgga

SEQ ID NO: 4206384 - DNA, 20 bp, Homo sapiens
tcaggaagagaaggagcaga

SEQ ID NO: 4206385 - DNA, 18 bp, Homo sapiens
tcaggatactctgtcaga

SEQ ID NO: 4206386 - DNA, 18 bp, Homo sapiens
tcaggattgcaggtgcct

SEQ ID NO: 4206387 - DNA, 22 bp, Homo sapiens
tcaggcattgaatgacaagcat

SEQ ID NO: 4206388 - DNA, 20 bp, Homo sapiens
tcaggcccggcatgcgggcc

SEQ ID NO: 4206389 - DNA, 15 bp, Homo sapiens
tcaggcttccttggc

SEQ ID NO: 4206390 - DNA, 22 bp, Homo sapiens
tcagggaatttcaggaactaga

SEQ ID NO: 4206391 - DNA, 15 bp, Homo sapiens
tcagggaggccctgt

SEQ ID NO: 4206392 - DNA, 19 bp, Homo sapiens
tcagggaggccctgtgccc

SEQ ID NO: 4206393 - DNA, 12 bp, Homo sapiens
tcagggcccaga

SEQ ID NO: 4206394 - DNA, 20 bp, Homo sapiens
tcaggggggttgtgaggcct

SEQ ID NO: 4206395 - DNA, 21 bp, Homo sapiens
tcagggtgggccactctcccc

SEQ ID NO: 4206396 - DNA, 23 bp, Homo sapiens
tcagggtgggccactctcccctc

SEQ ID NO: 4206397 - DNA, 18 bp, Homo sapiens
tcagggttatacacagaa

SEQ ID NO: 4206398 - DNA, 14 bp, Homo sapiens
tcaggtagtactgg

SEQ ID NO: 4206399 - DNA, 14 bp, Homo sapiens
tcaggtccaggcca

SEQ ID NO: 4206400 - DNA, 14 bp, Homo sapiens
tcagtagctgagtg

SEQ ID NO: 4206401 - DNA, 22 bp, Homo sapiens
tcagtcatgaggaaagacacag

SEQ ID NO: 4206402 - DNA, 20 bp, Homo sapiens
tcagtccagatgccttcctg

SEQ ID NO: 4206403 - DNA, 21 bp, Homo sapiens
tcagtccagatgccttcctgt

SEQ ID NO: 4206404 - DNA, 23 bp, Homo sapiens
tcagtctgtgggagctcagctcg

SEQ ID NO: 4206405 - DNA, 13 bp, Homo sapiens
tcagtgctgtgct

SEQ ID NO: 4206406 - DNA, 14 bp, Homo sapiens
tcagtgctgtgctg

SEQ ID NO: 4206407 - DNA, 22 bp, Homo sapiens
tcagtgctgtgctgtgctatgg

SEQ ID NO: 4206408 - DNA, 15 bp, Homo sapiens
tcagtgctgtggcct

SEQ ID NO: 4206409 - DNA, 17 bp, Homo sapiens
tcagtgctgtggcctgg

SEQ ID NO: 4206410 - DNA, 22 bp, Homo sapiens
tcagtgctgtggcctgggcaag

SEQ ID NO: 4206411 - DNA, 21 bp, Homo sapiens
tcagtgtagttaaagggcaga

SEQ ID NO: 4206412 - DNA, 13 bp, Homo sapiens
tcagttcccgctc

SEQ ID NO: 4206413 - DNA, 20 bp, Homo sapiens
tcagttcccgctctgcattg

SEQ ID NO: 4206414 - DNA, 18 bp, Homo sapiens
tcagttgataaaaggaaa

SEQ ID NO: 4206415 - DNA, 19 bp, Homo sapiens
tcagttgtacgtaatgtat

SEQ ID NO: 4206416 - DNA, 20 bp, Homo sapiens
tcagttgtacgtaatgtatt

SEQ ID NO: 4206417 - DNA, 22 bp, Homo sapiens
tcataacgtaatgattatatga

SEQ ID NO: 4206418 - DNA, 12 bp, Homo sapiens
tcataaggaaat

SEQ ID NO: 4206419 - DNA, 20 bp, Homo sapiens
tcataccctctacctggatg

SEQ ID NO: 4206420 - DNA, 12 bp, Homo sapiens
tcatagtttctt

SEQ ID NO: 4206421 - DNA, 13 bp, Homo sapiens
tcatataaagtat

SEQ ID NO: 4206422 - DNA, 21 bp, Homo sapiens
tcatatcagctttatcccttg

SEQ ID NO: 4206423 - DNA, 19 bp, Homo sapiens
tcatattgaatgtttccaa

SEQ ID NO: 4206424 - DNA, 14 bp, Homo sapiens
tcatattgtttcct

SEQ ID NO: 4206425 - DNA, 16 bp, Homo sapiens
tcatcaccatcgtgtt

SEQ ID NO: 4206426 - DNA, 20 bp, Homo sapiens
tcatccataaagcaagctca

SEQ ID NO: 4206427 - DNA, 17 bp, Homo sapiens
tcatccccacaatctgg

SEQ ID NO: 4206428 - DNA, 21 bp, Homo sapiens
tcatccccacaatctggctta

SEQ ID NO: 4206429 - DNA, 14 bp, Homo sapiens
tcatccccttgtgt

SEQ ID NO: 4206430 - DNA, 20 bp, Homo sapiens
tcatctaaaatttttctaga

SEQ ID NO: 4206431 - DNA, 17 bp, Homo sapiens
tcatctacaagcatttg

SEQ ID NO: 4206432 - DNA, 17 bp, Homo sapiens
tcatctcatgctctctg

SEQ ID NO: 4206433 - DNA, 13 bp, Homo sapiens
tcatctccagtgt

SEQ ID NO: 4206434 - DNA, 17 bp, Homo sapiens
tcatctggattccagag

SEQ ID NO: 4206435 - DNA, 13 bp, Homo sapiens
tcatcttgacatg

SEQ ID NO: 4206436 - DNA, 16 bp, Homo sapiens
tcatcttttaattcac

SEQ ID NO: 4206437 - DNA, 21 bp, Homo sapiens
tcatgaatatttcaaaataaa

SEQ ID NO: 4206438 - DNA, 21 bp, Homo sapiens
tcatgacatgttatatatttt

SEQ ID NO: 4206439 - DNA, 17 bp, Homo sapiens
tcatgacttttccatgt

SEQ ID NO: 4206440 - DNA, 19 bp, Homo sapiens
tcatgaggaaagacacaga

SEQ ID NO: 4206441 - DNA, 17 bp, Homo sapiens
tcatgagtcagacattt

SEQ ID NO: 4206442 - DNA, 21 bp, Homo sapiens
tcatgataatgaacagaacat

SEQ ID NO: 4206443 - DNA, 19 bp, Homo sapiens
tcatgatagtgtgattttt

SEQ ID NO: 4206444 - DNA, 16 bp, Homo sapiens
tcatgcccttctgatt

SEQ ID NO: 4206445 - DNA, 14 bp, Homo sapiens
tcatgcctggcccc

SEQ ID NO: 4206446 - DNA, 21 bp, Homo sapiens
tcatgcctggcccccctccag

SEQ ID NO: 4206447 - DNA, 16 bp, Homo sapiens
tcatgcctgtaatccc

SEQ ID NO: 4206448 - DNA, 15 bp, Homo sapiens
tcatgcttcttctca

SEQ ID NO: 4206449 - DNA, 15 bp, Homo sapiens
tcatggaagccacca

SEQ ID NO: 4206450 - DNA, 16 bp, Homo sapiens
tcatggggtggggttg

SEQ ID NO: 4206451 - DNA, 15 bp, Homo sapiens
tcatggtcctttctg

SEQ ID NO: 4206452 - DNA, 16 bp, Homo sapiens
tcatgtaaattttgta

SEQ ID NO: 4206453 - DNA, 23 bp, Homo sapiens
tcatgtaaattttgtatgaaaaa

SEQ ID NO: 4206454 - DNA, 21 bp, Homo sapiens
tcatgtggaatggattataga

SEQ ID NO: 4206455 - DNA, 17 bp, Homo sapiens
tcatgttggccaggctg

SEQ ID NO: 4206456 - DNA, 23 bp, Homo sapiens
tcattaaggtattattttttcca

SEQ ID NO: 4206457 - DNA, 14 bp, Homo sapiens
tcattcatttttgt

SEQ ID NO: 4206458 - DNA, 17 bp, Homo sapiens
tcattcgcctgtgggaa

SEQ ID NO: 4206459 - DNA, 17 bp, Homo sapiens
tcattctacataatgga

SEQ ID NO: 4206460 - DNA, 20 bp, Homo sapiens
tcattgaaaaaaatatatga

SEQ ID NO: 4206461 - DNA, 16 bp, Homo sapiens
tcattgtcgctcagca

SEQ ID NO: 4206462 - DNA, 18 bp, Homo sapiens
tcattgtctcagtgctgg

SEQ ID NO: 4206463 - DNA, 19 bp, Homo sapiens
tcatttctactgtgactga

SEQ ID NO: 4206464 - DNA, 23 bp, Homo sapiens
tcatttgtcatttaccctggtgg

SEQ ID NO: 4206465 - DNA, 14 bp, Homo sapiens
tcattttggtactt

SEQ ID NO: 4206466 - DNA, 16 bp, Homo sapiens
tcattttttaaaaaag

SEQ ID NO: 4206467 - DNA, 21 bp, Homo sapiens
tccaaaaaggaacactggaaa

SEQ ID NO: 4206468 - DNA, 17 bp, Homo sapiens
tctgccaccatcctgct

SEQ ID NO: 4206469 - DNA, 24 bp, Homo sapiens
tctgccattgggaccctccagtgc

SEQ ID NO: 4206470 - DNA, 12 bp, Homo sapiens
tctgccccaccc

SEQ ID NO: 4206471 - DNA, 13 bp, Homo sapiens
tctgccccaccct

SEQ ID NO: 4206472 - DNA, 19 bp, Homo sapiens
tctgcggtggtgccagagg

SEQ ID NO: 4206473 - DNA, 14 bp, Homo sapiens
tctgctactgaggc

SEQ ID NO: 4206474 - DNA, 12 bp, Homo sapiens
tctgctccagag

SEQ ID NO: 4206475 - DNA, 15 bp, Homo sapiens
tctgctgaaggacag

SEQ ID NO: 4206476 - DNA, 16 bp, Homo sapiens
tctgctgaaggacaga

SEQ ID NO: 4206477 - DNA, 16 bp, Homo sapiens
tctgctgagcagccca

SEQ ID NO: 4206478 - DNA, 18 bp, Homo sapiens
tctgctgagcagcccagc

SEQ ID NO: 4206479 - DNA, 13 bp, Homo sapiens
tctgcttcagtgg

SEQ ID NO: 4206480 - DNA, 20 bp, Homo sapiens
tctggaaaactcaggattct

SEQ ID NO: 4206481 - DNA, 13 bp, Homo sapiens
tctggaaaagagg

SEQ ID NO: 4206482 - DNA, 18 bp, Homo sapiens
tctggaagaagaggagga

SEQ ID NO: 4206483 - DNA, 17 bp, Homo sapiens
tctggagccaaggcaga

SEQ ID NO: 4206484 - DNA, 12 bp, Homo sapiens
tctggagccctt

SEQ ID NO: 4206485 - DNA, 21 bp, Homo sapiens
tctggaggacacacagtctca

SEQ ID NO: 4206486 - DNA, 24 bp, Homo sapiens
tctggcccctccgcgagggctact

SEQ ID NO: 4206487 - DNA, 13 bp, Homo sapiens
tctggcctcctgg

SEQ ID NO: 4206488 - DNA, 10 bp, Homo sapiens
tctggctcca

SEQ ID NO: 4206489 - DNA, 21 bp, Homo sapiens
tctggcttagaaattttttca

SEQ ID NO: 4206490 - DNA, 13 bp, Homo sapiens
tctggcttagtgc

SEQ ID NO: 4206491 - DNA, 16 bp, Homo sapiens
tctggcttagtgccac

SEQ ID NO: 4206492 - DNA, 17 bp, Homo sapiens
tctggcttagtgccacc

SEQ ID NO: 4206493 - DNA, 13 bp, Homo sapiens
tctggcttccagg

SEQ ID NO: 4206494 - DNA, 24 bp, Homo sapiens
tctggcttccaggtatctccagga

SEQ ID NO: 4206495 - DNA, 23 bp, Homo sapiens
tctggctttctccgactgctagg

SEQ ID NO: 4206496 - DNA, 15 bp, Homo sapiens
tctggctttgtctct

SEQ ID NO: 4206497 - DNA, 19 bp, Homo sapiens
tctgggaggtctccactga

SEQ ID NO: 4206498 - DNA, 14 bp, Homo sapiens
tctgggagtcctgt

SEQ ID NO: 4206499 - DNA, 17 bp, Homo sapiens
tctgggagtcctgtcag

SEQ ID NO: 4206500 - DNA, 14 bp, Homo sapiens
tctgggcagcgcta

SEQ ID NO: 4206501 - DNA, 16 bp, Homo sapiens
tctgggtaagaagaaa

SEQ ID NO: 4206502 - DNA, 22 bp, Homo sapiens
tctggtatgaacttgaggacac

SEQ ID NO: 4206503 - DNA, 13 bp, Homo sapiens
tctggtcaagtag

SEQ ID NO: 4206504 - DNA, 22 bp, Homo sapiens
tctgtaagaaacctactgccca

SEQ ID NO: 4206505 - DNA, 15 bp, Homo sapiens
tctgtacaaaaacaa

SEQ ID NO: 4206506 - DNA, 16 bp, Homo sapiens
tctgtacaaaaacaaa

SEQ ID NO: 4206507 - DNA, 15 bp, Homo sapiens
tctgtagtaatttat

SEQ ID NO: 4206508 - DNA, 16 bp, Homo sapiens
tctgtagtaatttatt

SEQ ID NO: 4206509 - DNA, 23 bp, Homo sapiens
tctgtagtaatttattgtctgtc

SEQ ID NO: 4206510 - DNA, 19 bp, Homo sapiens
tctgtcaccaattggttaa

SEQ ID NO: 4206511 - DNA, 19 bp, Homo sapiens
tctgtcagatgggaagaca

SEQ ID NO: 4206512 - DNA, 13 bp, Homo sapiens
tctgtccaaggaa

SEQ ID NO: 4206513 - DNA, 16 bp, Homo sapiens
tctgtcctcagagcag

SEQ ID NO: 4206514 - DNA, 18 bp, Homo sapiens
tctgtctacttgctcagg

SEQ ID NO: 4206515 - DNA, 15 bp, Homo sapiens
tctgtctgtcccaaa

SEQ ID NO: 4206516 - DNA, 16 bp, Homo sapiens
tctgtctgtcccaaag

SEQ ID NO: 4206517 - DNA, 18 bp, Homo sapiens
tctgtgggagctcagctc

SEQ ID NO: 4206518 - DNA, 23 bp, Homo sapiens
tctgtgtaaatctaactacaagg

SEQ ID NO: 4206519 - DNA, 20 bp, Homo sapiens
tctgtgtccgtctgtgtatg

SEQ ID NO: 4206520 - DNA, 13 bp, Homo sapiens
tctgtgtgaaaat

SEQ ID NO: 4206521 - DNA, 20 bp, Homo sapiens
tctgtgtgatgaactttctc

SEQ ID NO: 4206522 - DNA, 16 bp, Homo sapiens
tctgtgtgtctgatgt

SEQ ID NO: 4206523 - DNA, 19 bp, Homo sapiens
tctgtgtgtctgatgtttg

SEQ ID NO: 4206524 - DNA, 14 bp, Homo sapiens
tctgttgagtgcaa

SEQ ID NO: 4206525 - DNA, 23 bp, Homo sapiens
tcttaaaagttgtgattccagat

SEQ ID NO: 4206526 - DNA, 16 bp, Homo sapiens
tcttaaacacttgcaa

SEQ ID NO: 4206527 - DNA, 19 bp, Homo sapiens
tcttaaagctgcctgtagt

SEQ ID NO: 4206528 - DNA, 15 bp, Homo sapiens
tcttaaataagaaac

SEQ ID NO: 4206529 - DNA, 19 bp, Homo sapiens
tcttaagtaaggacaaaga

SEQ ID NO: 4206530 - DNA, 16 bp, Homo sapiens
tcttaatcaagaatat

SEQ ID NO: 4206531 - DNA, 23 bp, Homo sapiens
tcttaattctcagccatgtgctt

SEQ ID NO: 4206532 - DNA, 17 bp, Homo sapiens
tcttacccatatatctt

SEQ ID NO: 4206533 - DNA, 14 bp, Homo sapiens
tcttaccttaaaaa

SEQ ID NO: 4206534 - DNA, 15 bp, Homo sapiens
tcttataacttctga

SEQ ID NO: 4206535 - DNA, 20 bp, Homo sapiens
tcttcactgccatgcctcaa

SEQ ID NO: 4206536 - DNA, 19 bp, Homo sapiens
tcttcagcagcatctactc

SEQ ID NO: 4206537 - DNA, 16 bp, Homo sapiens
tcttcagccatcaaca

SEQ ID NO: 4206538 - DNA, 16 bp, Homo sapiens
tcttcagggtgagtga

SEQ ID NO: 4206539 - DNA, 17 bp, Homo sapiens
tcttcagggtgagtgaa

SEQ ID NO: 4206540 - DNA, 15 bp, Homo sapiens
tcttcatactttttt

SEQ ID NO: 4206541 - DNA, 20 bp, Homo sapiens
tcttcatcagcatttaataa

SEQ ID NO: 4206542 - DNA, 23 bp, Homo sapiens
tcttcatcagcatttaataaatg

SEQ ID NO: 4206543 - DNA, 15 bp, Homo sapiens
tcttccaaaggcata

SEQ ID NO: 4206544 - DNA, 14 bp, Homo sapiens
tcttccactgcaaa

SEQ ID NO: 4206545 - DNA, 15 bp, Homo sapiens
tcttccatttattgc

SEQ ID NO: 4206546 - DNA, 19 bp, Homo sapiens
tcttccccactccccacct

SEQ ID NO: 4206547 - DNA, 14 bp, Homo sapiens
tcttccctccttcc

SEQ ID NO: 4206548 - DNA, 21 bp, Homo sapiens
tcttccctctgatttttcctt

SEQ ID NO: 4206549 - DNA, 14 bp, Homo sapiens
tcttcctctgggca

SEQ ID NO: 4206550 - DNA, 18 bp, Homo sapiens
tcttcctgcaaggactac

SEQ ID NO: 4206551 - DNA, 14 bp, Homo sapiens
tcttccttccccca

SEQ ID NO: 4206552 - DNA, 14 bp, Homo sapiens
tcttccttctttct

SEQ ID NO: 4206553 - DNA, 22 bp, Homo sapiens
tcttcggccaatttatgcagag

SEQ ID NO: 4206554 - DNA, 17 bp, Homo sapiens
tcttctagccacagttc

SEQ ID NO: 4206555 - DNA, 21 bp, Homo sapiens
tcttctggtgctactccatgc

SEQ ID NO: 4206556 - DNA, 19 bp, Homo sapiens
tcttctgttgtagaataat

SEQ ID NO: 4206557 - DNA, 18 bp, Homo sapiens
tcttgacatgtaatgaat

SEQ ID NO: 4206558 - DNA, 15 bp, Homo sapiens
tcttgagtagatctg

SEQ ID NO: 4206559 - DNA, 23 bp, Homo sapiens
tcttggcagtattccatgggatg

SEQ ID NO: 4206560 - DNA, 11 bp, Homo sapiens
tcttggcctct

SEQ ID NO: 4206561 - DNA, 13 bp, Homo sapiens
tcttggggctcgc

SEQ ID NO: 4206562 - DNA, 20 bp, Homo sapiens
tcttggtggatgggccctgc

SEQ ID NO: 4206563 - DNA, 19 bp, Homo sapiens
tctttaaaagatgctttta

SEQ ID NO: 4206564 - DNA, 20 bp, Homo sapiens
tctttaaaatgtaaagccat

SEQ ID NO: 4206565 - DNA, 23 bp, Homo sapiens
tctttaaagtgactaatggcatg

SEQ ID NO: 4206566 - DNA, 14 bp, Homo sapiens
tctttacaataaac

SEQ ID NO: 4206567 - DNA, 17 bp, Homo sapiens
tctttataaaaagtgaa

SEQ ID NO: 4206568 - DNA, 14 bp, Homo sapiens
tctttccccacctc

SEQ ID NO: 4206569 - DNA, 18 bp, Homo sapiens
tctttctacattctcatc

SEQ ID NO: 4206570 - DNA, 15 bp, Homo sapiens
tctttctattccaaa

SEQ ID NO: 4206571 - DNA, 17 bp, Homo sapiens
tctttctcttccctcct

SEQ ID NO: 4206572 - DNA, 13 bp, Homo sapiens
tctttctggagtc

SEQ ID NO: 4206573 - DNA, 12 bp, Homo sapiens
tctttgaagtta

SEQ ID NO: 4206574 - DNA, 13 bp, Homo sapiens
tctttgaagttat

SEQ ID NO: 4206575 - DNA, 14 bp, Homo sapiens
tctttgaatgcttt

SEQ ID NO: 4206576 - DNA, 23 bp, Homo sapiens
tctttgactgaaaaaaaaaaaga

SEQ ID NO: 4206577 - DNA, 15 bp, Homo sapiens
tctttgcatggaatt

SEQ ID NO: 4206578 - DNA, 17 bp, Homo sapiens
tctttgccttgatgttg

SEQ ID NO: 4206579 - DNA, 17 bp, Homo sapiens
tctttggaaggagtgag

SEQ ID NO: 4206580 - DNA, 24 bp, Homo sapiens
tctttggaaggagtgagatcattt

SEQ ID NO: 4206581 - DNA, 18 bp, Homo sapiens
tctttggggtcagccagg

SEQ ID NO: 4206582 - DNA, 21 bp, Homo sapiens
tctttggggtcagccagggcc

SEQ ID NO: 4206583 - DNA, 15 bp, Homo sapiens
tcttttccacaaata

SEQ ID NO: 4206584 - DNA, 13 bp, Homo sapiens
tctttttagattg

SEQ ID NO: 4206585 - DNA, 19 bp, Homo sapiens
tgaaaaaaaaaaagaagaa

SEQ ID NO: 4206586 - DNA, 21 bp, Homo sapiens
tgaaaaaaaaaaagaagaaga

SEQ ID NO: 4206587 - DNA, 17 bp, Homo sapiens
tgaaaaaaagtttacaa

SEQ ID NO: 4206588 - DNA, 14 bp, Homo sapiens
tgaaaaaaatatat

SEQ ID NO: 4206589 - DNA, 22 bp, Homo sapiens
tgaaaaacacggcagctgtagc

SEQ ID NO: 4206590 - DNA, 13 bp, Homo sapiens
tgaaaaagcgaaa

SEQ ID NO: 4206591 - DNA, 15 bp, Homo sapiens
tgaaaaatatgtgct

SEQ ID NO: 4206592 - DNA, 16 bp, Homo sapiens
tgaaaacgtttcaaag

SEQ ID NO: 4206593 - DNA, 13 bp, Homo sapiens
tgaaaataataaa

SEQ ID NO: 4206594 - DNA, 14 bp, Homo sapiens
tgaaaatctaatat

SEQ ID NO: 4206595 - DNA, 21 bp, Homo sapiens
tgaaaatctaatattaaaaat

SEQ ID NO: 4206596 - DNA, 13 bp, Homo sapiens
tgaaaattattta

SEQ ID NO: 4206597 - DNA, 14 bp, Homo sapiens
tgaaaattatttaa

SEQ ID NO: 4206598 - DNA, 14 bp, Homo sapiens
tgaaacaaagagtt

SEQ ID NO: 4206599 - DNA, 23 bp, Homo sapiens
tgaaacaaagagttcaagaaata

SEQ ID NO: 4206600 - DNA, 21 bp, Homo sapiens
tgaaacaagataactgagaat

SEQ ID NO: 4206601 - DNA, 17 bp, Homo sapiens
tgaaacagcctgggtga

SEQ ID NO: 4206602 - DNA, 15 bp, Homo sapiens
tgaaagaaagtgtta

SEQ ID NO: 4206603 - DNA, 20 bp, Homo sapiens
tgctcacgactcttcctgca

SEQ ID NO: 4206604 - DNA, 21 bp, Homo sapiens
tgctcacgactcttcctgcaa

SEQ ID NO: 4206605 - DNA, 23 bp, Homo sapiens
tgctcacgactcttcctgcaaag

SEQ ID NO: 4206606 - DNA, 22 bp, Homo sapiens
tgctcagccctgactggtgcta

SEQ ID NO: 4206607 - DNA, 18 bp, Homo sapiens
tgctcattccttctggag

SEQ ID NO: 4206608 - DNA, 10 bp, Homo sapiens
tgctccagag

SEQ ID NO: 4206609 - DNA, 16 bp, Homo sapiens
tgctcctccagccctt

SEQ ID NO: 4206610 - DNA, 15 bp, Homo sapiens
tgctcggtcaggagg

SEQ ID NO: 4206611 - DNA, 18 bp, Homo sapiens
tgctctagtcttgctttg

SEQ ID NO: 4206612 - DNA, 21 bp, Homo sapiens
tgctctagtcttgctttgctg

SEQ ID NO: 4206613 - DNA, 17 bp, Homo sapiens
tgctctcccctgccctg

SEQ ID NO: 4206614 - DNA, 20 bp, Homo sapiens
tgctctcccctgccctgctg

SEQ ID NO: 4206615 - DNA, 22 bp, Homo sapiens
tgctctcctaccccacctcatg

SEQ ID NO: 4206616 - DNA, 18 bp, Homo sapiens
tgctctctgaacagaagg

SEQ ID NO: 4206617 - DNA, 16 bp, Homo sapiens
tgctctgcaggcacct

SEQ ID NO: 4206618 - DNA, 20 bp, Homo sapiens
tgctctgcaggcaccttagt

SEQ ID NO: 4206619 - DNA, 14 bp, Homo sapiens
tgctctgcccactg

SEQ ID NO: 4206620 - DNA, 19 bp, Homo sapiens
tgctgagatacatacagaa

SEQ ID NO: 4206621 - DNA, 17 bp, Homo sapiens
tgctgatcaatgaaatg

SEQ ID NO: 4206622 - DNA, 22 bp, Homo sapiens
tgctgatgtcaaagtgtaacag

SEQ ID NO: 4206623 - DNA, 17 bp, Homo sapiens
tgctgcactgccctccg

SEQ ID NO: 4206624 - DNA, 16 bp, Homo sapiens
tgctgccaggctccca

SEQ ID NO: 4206625 - DNA, 17 bp, Homo sapiens
tgctgccgcctcccagc

SEQ ID NO: 4206626 - DNA, 19 bp, Homo sapiens
tgctgccgcctcccagcct

SEQ ID NO: 4206627 - DNA, 20 bp, Homo sapiens
tgctgccgcctcccagcctg

SEQ ID NO: 4206628 - DNA, 21 bp, Homo sapiens
tgctgccgcctcccagcctgg

SEQ ID NO: 4206629 - DNA, 15 bp, Homo sapiens
tgctgctgctgctgc

SEQ ID NO: 4206630 - DNA, 14 bp, Homo sapiens
tgctgcttctcctc

SEQ ID NO: 4206631 - DNA, 20 bp, Homo sapiens
tgctgcttctcctcccagcg

SEQ ID NO: 4206632 - DNA, 22 bp, Homo sapiens
tgctgcttctcctcccagcgtg

SEQ ID NO: 4206633 - DNA, 19 bp, Homo sapiens
tgctggacggcattcctgc

SEQ ID NO: 4206634 - DNA, 16 bp, Homo sapiens
tgctggcggcgcagag

SEQ ID NO: 4206635 - DNA, 17 bp, Homo sapiens
tgctggctgacctgggc

SEQ ID NO: 4206636 - DNA, 19 bp, Homo sapiens
tgctggctgacctgggccc

SEQ ID NO: 4206637 - DNA, 15 bp, Homo sapiens
tgctgggactggcca

SEQ ID NO: 4206638 - DNA, 17 bp, Homo sapiens
tgctgggactggccagg

SEQ ID NO: 4206639 - DNA, 21 bp, Homo sapiens
tgctgggagatgccattctcc

SEQ ID NO: 4206640 - DNA, 23 bp, Homo sapiens
tgctggggcaagtccctgactct

SEQ ID NO: 4206641 - DNA, 23 bp, Homo sapiens
tgctgtagctaggtatcttactc

SEQ ID NO: 4206642 - DNA, 17 bp, Homo sapiens
tgctgtcactggcagag

SEQ ID NO: 4206643 - DNA, 14 bp, Homo sapiens
tgctgtcctaggcc

SEQ ID NO: 4206644 - DNA, 15 bp, Homo sapiens
tgctgtgctgtgcta

SEQ ID NO: 4206645 - DNA, 12 bp, Homo sapiens
tgctgtggccag

SEQ ID NO: 4206646 - DNA, 15 bp, Homo sapiens
tgctgtggcccagtc

SEQ ID NO: 4206647 - DNA, 13 bp, Homo sapiens
tgctgtgtgcctt

SEQ ID NO: 4206648 - DNA, 15 bp, Homo sapiens
tgcttaaagcaaggc

SEQ ID NO: 4206649 - DNA, 12 bp, Homo sapiens
tgcttaaatatt

SEQ ID NO: 4206650 - DNA, 17 bp, Homo sapiens
tgcttagaattctgaga

SEQ ID NO: 4206651 - DNA, 14 bp, Homo sapiens
tgcttatggtacca

SEQ ID NO: 4206652 - DNA, 21 bp, Homo sapiens
tgcttatggtaccagatgcag

SEQ ID NO: 4206653 - DNA, 14 bp, Homo sapiens
tgcttcccaaccta

SEQ ID NO: 4206654 - DNA, 18 bp, Homo sapiens
tgcttctcctcccagcgt

SEQ ID NO: 4206655 - DNA, 23 bp, Homo sapiens
tgcttctcctcccagcgtgtgta

SEQ ID NO: 4206656 - DNA, 16 bp, Homo sapiens
tgcttctgcagcaact

SEQ ID NO: 4206657 - DNA, 17 bp, Homo sapiens
tgcttctgcagcaactc

SEQ ID NO: 4206658 - DNA, 21 bp, Homo sapiens
tgcttctgcagcaactcccac

SEQ ID NO: 4206659 - DNA, 20 bp, Homo sapiens
tgcttctggctcctccttcc

SEQ ID NO: 4206660 - DNA, 20 bp, Homo sapiens
tgcttcttcatcttgacatg

SEQ ID NO: 4206661 - DNA, 15 bp, Homo sapiens
tgcttgtaaaaccaa

SEQ ID NO: 4206662 - DNA, 20 bp, Homo sapiens
tgctttccccgggggaggaa

SEQ ID NO: 4206663 - DNA, 14 bp, Homo sapiens
tgctttctgatcaa

SEQ ID NO: 4206664 - DNA, 13 bp, Homo sapiens
tgctttgccaaaa

SEQ ID NO: 4206665 - DNA, 13 bp, Homo sapiens
tgctttgcttttt

SEQ ID NO: 4206666 - DNA, 14 bp, Homo sapiens
tgcttttcatcctt

SEQ ID NO: 4206667 - DNA, 18 bp, Homo sapiens
tggaaaaagaaagaaaca

SEQ ID NO: 4206668 - DNA, 20 bp, Homo sapiens
tggaaaaatcagaagcacaa

SEQ ID NO: 4206669 - DNA, 16 bp, Homo sapiens
tggaaaagaggagttt

SEQ ID NO: 4206670 - DNA, 16 bp, Homo sapiens
tggaaaataaattata

SEQ ID NO: 4206671 - DNA, 15 bp, Homo sapiens
tggaaaataaatttt

SEQ ID NO: 4206672 - DNA, 20 bp, Homo sapiens
tggaaaccacacttcttgaa

SEQ ID NO: 4206673 - DNA, 21 bp, Homo sapiens
tggaaaccacacttcttgaaa

SEQ ID NO: 4206674 - DNA, 15 bp, Homo sapiens
tggaaacctgaaaaa

SEQ ID NO: 4206675 - DNA, 13 bp, Homo sapiens
tggaaagagacca

SEQ ID NO: 4206676 - DNA, 20 bp, Homo sapiens
tggaaagcatcacctcaggc

SEQ ID NO: 4206677 - DNA, 21 bp, Homo sapiens
tggaaagcatcacctcaggcc

SEQ ID NO: 4206678 - DNA, 16 bp, Homo sapiens
tggaaagcctctgctg

SEQ ID NO: 4206679 - DNA, 21 bp, Homo sapiens
tggaaatataggctatgtaat

SEQ ID NO: 4206680 - DNA, 20 bp, Homo sapiens
tggaacaattattttattgt

SEQ ID NO: 4206681 - DNA, 12 bp, Homo sapiens
tggaagaagagg

SEQ ID NO: 4206682 - DNA, 16 bp, Homo sapiens
tggaagaagaggagga

SEQ ID NO: 4206683 - DNA, 15 bp, Homo sapiens
tggaagagaggcacc

SEQ ID NO: 4206684 - DNA, 23 bp, Homo sapiens
tggaagagaggcacctgctggaa

SEQ ID NO: 4206685 - DNA, 22 bp, Homo sapiens
tggaagataattttatgtgtta

SEQ ID NO: 4206686 - DNA, 15 bp, Homo sapiens
tggaagatattcctt

SEQ ID NO: 4206687 - DNA, 13 bp, Homo sapiens
tggaagattagag

SEQ ID NO: 4206688 - DNA, 14 bp, Homo sapiens
tggaagccaggact

SEQ ID NO: 4206689 - DNA, 14 bp, Homo sapiens
tggaaggctttgcc

SEQ ID NO: 4206690 - DNA, 17 bp, Homo sapiens
tggaagtagttctatga

SEQ ID NO: 4206691 - DNA, 14 bp, Homo sapiens
tggaatttaaaaat

SEQ ID NO: 4206692 - DNA, 18 bp, Homo sapiens
tggaatttaatttatgtg

SEQ ID NO: 4206693 - DNA, 13 bp, Homo sapiens
tggaattttctta

SEQ ID NO: 4206694 - DNA, 14 bp, Homo sapiens
tggacaaaatggaa

SEQ ID NO: 4206695 - DNA, 15 bp, Homo sapiens
tggacaagaagctgc

SEQ ID NO: 4206696 - DNA, 14 bp, Homo sapiens
tggacacagaagtc

SEQ ID NO: 4206697 - DNA, 17 bp, Homo sapiens
tggacacagtgttccag

SEQ ID NO: 4206698 - DNA, 13 bp, Homo sapiens
tggacacctgccc

SEQ ID NO: 4206699 - DNA, 14 bp, Homo sapiens
tggacacctgccct

SEQ ID NO: 4206700 - DNA, 13 bp, Homo sapiens
tggacaggatgtg

SEQ ID NO: 4206701 - DNA, 18 bp, Homo sapiens
tggacaggatgtgtttgc

SEQ ID NO: 4206702 - DNA, 13 bp, Homo sapiens
tggacagtcctgg

SEQ ID NO: 4206703 - DNA, 15 bp, Homo sapiens
tggacagtcctggga

SEQ ID NO: 4206704 - DNA, 21 bp, Homo sapiens
tggacatgatttagggaagca

SEQ ID NO: 4206705 - DNA, 16 bp, Homo sapiens
tggaccgcttcccaga

SEQ ID NO: 4206706 - DNA, 21 bp, Homo sapiens
tggacctttggggaaggggga

SEQ ID NO: 4206707 - DNA, 17 bp, Homo sapiens
tggacgttcggggcatg

SEQ ID NO: 4206708 - DNA, 16 bp, Homo sapiens
tggacttccttggttt

SEQ ID NO: 4206709 - DNA, 17 bp, Homo sapiens
tggacttgagcttggca

SEQ ID NO: 4206710 - DNA, 14 bp, Homo sapiens
tggactttgttcac

SEQ ID NO: 4206711 - DNA, 11 bp, Homo sapiens
tggagaaggaa

SEQ ID NO: 4206712 - DNA, 14 bp, Homo sapiens
tggagaattatata

SEQ ID NO: 4206713 - DNA, 15 bp, Homo sapiens
tggagacagccctgc

SEQ ID NO: 4206714 - DNA, 17 bp, Homo sapiens
tggagacttggaagagt

SEQ ID NO: 4206715 - DNA, 13 bp, Homo sapiens
tggagagaagttt

SEQ ID NO: 4206716 - DNA, 23 bp, Homo sapiens
tggagagaagtttctggccctgg

SEQ ID NO: 4206717 - DNA, 14 bp, Homo sapiens
tggagagcagctgg

SEQ ID NO: 4206718 - DNA, 21 bp, Homo sapiens
tggagaggagggatgctgcct

SEQ ID NO: 4206719 - DNA, 23 bp, Homo sapiens
tggagaggtttgtcaacacaaag

SEQ ID NO: 4206720 - DNA, 11 bp, Homo sapiens
tggagatgatg

SEQ ID NO: 4206721 - DNA, 15 bp, Homo sapiens
tggagcatcccaggc

SEQ ID NO: 4206722 - DNA, 17 bp, Homo sapiens
tggagcccgcttcaagc

SEQ ID NO: 4206723 - DNA, 21 bp, Homo sapiens
tggagcgcacctgccccctgg

SEQ ID NO: 4206724 - DNA, 22 bp, Homo sapiens
tggagcgcacctgccccctggt

SEQ ID NO: 4206725 - DNA, 16 bp, Homo sapiens
tggagcggagcttgcc

SEQ ID NO: 4206726 - DNA, 21 bp, Homo sapiens
tggagcggagcttgcctgcct

SEQ ID NO: 4206727 - DNA, 12 bp, Homo sapiens
tggagctgagca

SEQ ID NO: 4206728 - DNA, 17 bp, Homo sapiens
tggaggcaaatttcagc

SEQ ID NO: 4206729 - DNA, 20 bp, Homo sapiens
tggaggtcacattcaggaag

SEQ ID NO: 4206730 - DNA, 15 bp, Homo sapiens
tggaggttgcagtga

SEQ ID NO: 4206731 - DNA, 14 bp, Homo sapiens
tggagtctgcagtg

SEQ ID NO: 4206732 - DNA, 15 bp, Homo sapiens
tggagtctgcagtga

SEQ ID NO: 4206733 - DNA, 21 bp, Homo sapiens
tggagtgtgcgtgtgtgcatg

SEQ ID NO: 4206734 - DNA, 17 bp, Homo sapiens
tggagttttttgtacca

SEQ ID NO: 4206735 - DNA, 22 bp, Homo sapiens
tggatacaaggatcagaatgga

SEQ ID NO: 4206736 - DNA, 13 bp, Homo sapiens
tggatatatttaa

SEQ ID NO: 4206737 - DNA, 20 bp, Homo sapiens
tggatatggtgcaaaaatga

SEQ ID NO: 4206738 - DNA, 20 bp, Homo sapiens
tgtattttaaatgttttaca

SEQ ID NO: 4206739 - DNA, 16 bp, Homo sapiens
tgtattttagcagaga

SEQ ID NO: 4206740 - DNA, 15 bp, Homo sapiens
tgtcaacacaaagac

SEQ ID NO: 4206741 - DNA, 22 bp, Homo sapiens
tgtcaacacaaagacatggaag

SEQ ID NO: 4206742 - DNA, 23 bp, Homo sapiens
tgtcaatacccctgttaagcaat

SEQ ID NO: 4206743 - DNA, 16 bp, Homo sapiens
tgtcaatccaatctgt

SEQ ID NO: 4206744 - DNA, 16 bp, Homo sapiens
tgtcaccctgcagagc

SEQ ID NO: 4206745 - DNA, 23 bp, Homo sapiens
tgtcaccgtgagcagctttggaa

SEQ ID NO: 4206746 - DNA, 14 bp, Homo sapiens
tgtcactcaaggcg

SEQ ID NO: 4206747 - DNA, 15 bp, Homo sapiens
tgtcactggcagagc

SEQ ID NO: 4206748 - DNA, 17 bp, Homo sapiens
tgtcactggcagagcac

SEQ ID NO: 4206749 - DNA, 22 bp, Homo sapiens
tgtcagaattggcctcagtgta

SEQ ID NO: 4206750 - DNA, 23 bp, Homo sapiens
tgtcagacatccatgtttgtaaa

SEQ ID NO: 4206751 - DNA, 18 bp, Homo sapiens
tgtcagagatctgggagg

SEQ ID NO: 4206752 - DNA, 11 bp, Homo sapiens
tgtcagccttg

SEQ ID NO: 4206753 - DNA, 12 bp, Homo sapiens
tgtcagccttgc

SEQ ID NO: 4206754 - DNA, 19 bp, Homo sapiens
tgtcatcaaatattaccaa

SEQ ID NO: 4206755 - DNA, 20 bp, Homo sapiens
tgtcatggtcctttctggaa

SEQ ID NO: 4206756 - DNA, 21 bp, Homo sapiens
tgtcatggtcctttctggaag

SEQ ID NO: 4206757 - DNA, 12 bp, Homo sapiens
tgtcattatgta

SEQ ID NO: 4206758 - DNA, 12 bp, Homo sapiens
tgtcattcagga

SEQ ID NO: 4206759 - DNA, 14 bp, Homo sapiens
tgtccaaggaaact

SEQ ID NO: 4206760 - DNA, 17 bp, Homo sapiens
tgtccacctcaccaggg

SEQ ID NO: 4206761 - DNA, 21 bp, Homo sapiens
tgtccattcatctcatgctct

SEQ ID NO: 4206762 - DNA, 23 bp, Homo sapiens
tgtccgcctctgcccgcagagcc

SEQ ID NO: 4206763 - DNA, 18 bp, Homo sapiens
tgtcctcagagcaggggc

SEQ ID NO: 4206764 - DNA, 14 bp, Homo sapiens
tgtcctctccctgc

SEQ ID NO: 4206765 - DNA, 21 bp, Homo sapiens
tgtcctgcctctctgctccag

SEQ ID NO: 4206766 - DNA, 21 bp, Homo sapiens
tgtcctggctcccagggtcct

SEQ ID NO: 4206767 - DNA, 15 bp, Homo sapiens
tgtccttgtgtgttt

SEQ ID NO: 4206768 - DNA, 14 bp, Homo sapiens
tgtcctttctagag

SEQ ID NO: 4206769 - DNA, 19 bp, Homo sapiens
tgtcctttctagagcactg

SEQ ID NO: 4206770 - DNA, 22 bp, Homo sapiens
tgtctaaggtcacacagtatta

SEQ ID NO: 4206771 - DNA, 13 bp, Homo sapiens
tgtctacatttct

SEQ ID NO: 4206772 - DNA, 15 bp, Homo sapiens
tgtctcagtgctggt

SEQ ID NO: 4206773 - DNA, 19 bp, Homo sapiens
tgtctctagccactttggt

SEQ ID NO: 4206774 - DNA, 19 bp, Homo sapiens
tgtctgattggctcaccca

SEQ ID NO: 4206775 - DNA, 20 bp, Homo sapiens
tgtctgccttaggctgctgg

SEQ ID NO: 4206776 - DNA, 16 bp, Homo sapiens
tgtctgggagagcctg

SEQ ID NO: 4206777 - DNA, 14 bp, Homo sapiens
tgtctggtgtagct

SEQ ID NO: 4206778 - DNA, 18 bp, Homo sapiens
tgtctgtcctcagagcag

SEQ ID NO: 4206779 - DNA, 15 bp, Homo sapiens
tgtctgtctgtctgt

SEQ ID NO: 4206780 - DNA, 14 bp, Homo sapiens
tgtctgtgtgctgt

SEQ ID NO: 4206781 - DNA, 12 bp, Homo sapiens
tgtctgttttcc

SEQ ID NO: 4206782 - DNA, 13 bp, Homo sapiens
tgtctgttttcca

SEQ ID NO: 4206783 - DNA, 20 bp, Homo sapiens
tgtcttataaacaaatgaat

SEQ ID NO: 4206784 - DNA, 14 bp, Homo sapiens
tgtgaaaatgggtt

SEQ ID NO: 4206785 - DNA, 13 bp, Homo sapiens
tgtgaaataccac

SEQ ID NO: 4206786 - DNA, 16 bp, Homo sapiens
tgtgaactggaagaaa

SEQ ID NO: 4206787 - DNA, 20 bp, Homo sapiens
tgtgaactggaagaaagcaa

SEQ ID NO: 4206788 - DNA, 17 bp, Homo sapiens
tgtgaagcaaaaagatg

SEQ ID NO: 4206789 - DNA, 20 bp, Homo sapiens
tgtgacccaaagaagtttaa

SEQ ID NO: 4206790 - DNA, 21 bp, Homo sapiens
tgtgacccagatcctcacaac

SEQ ID NO: 4206791 - DNA, 21 bp, Homo sapiens
tgtgagattactttgtcccgc

SEQ ID NO: 4206792 - DNA, 13 bp, Homo sapiens
tgtgataaggaaa

SEQ ID NO: 4206793 - DNA, 15 bp, Homo sapiens
tgtgatgaactttct

SEQ ID NO: 4206794 - DNA, 17 bp, Homo sapiens
tgtgatgctttgaagta

SEQ ID NO: 4206795 - DNA, 21 bp, Homo sapiens
tgtgcaagtcttgtcagaatt

SEQ ID NO: 4206796 - DNA, 23 bp, Homo sapiens
tgtgcaagtcttgtcagaattgg

SEQ ID NO: 4206797 - DNA, 18 bp, Homo sapiens
tgtgcaatgtaaatattt

SEQ ID NO: 4206798 - DNA, 17 bp, Homo sapiens
tgtgcatatatactaca

SEQ ID NO: 4206799 - DNA, 16 bp, Homo sapiens
tgtgccccttgacaac

SEQ ID NO: 4206800 - DNA, 12 bp, Homo sapiens
tgtgcctgcagc

SEQ ID NO: 4206801 - DNA, 13 bp, Homo sapiens
tgtgcctgcagcc

SEQ ID NO: 4206802 - DNA, 12 bp, Homo sapiens
tgtgcctgccct

SEQ ID NO: 4206803 - DNA, 13 bp, Homo sapiens
tgtgcctgccctg

SEQ ID NO: 4206804 - DNA, 17 bp, Homo sapiens
tgtgcctttgggaggca

SEQ ID NO: 4206805 - DNA, 18 bp, Homo sapiens
tgtgccttttatagctat

SEQ ID NO: 4206806 - DNA, 14 bp, Homo sapiens
tgtgcgtgtgtgca

SEQ ID NO: 4206807 - DNA, 17 bp, Homo sapiens
tgtgctgtgtctgcacc

SEQ ID NO: 4206808 - DNA, 17 bp, Homo sapiens
tgtgcttaataatacca

SEQ ID NO: 4206809 - DNA, 19 bp, Homo sapiens
tgtgcttccctaggctgag

SEQ ID NO: 4206810 - DNA, 12 bp, Homo sapiens
tgtggaaagcct

SEQ ID NO: 4206811 - DNA, 21 bp, Homo sapiens
tgtggaatggattatagagta

SEQ ID NO: 4206812 - DNA, 22 bp, Homo sapiens
tgtggaatggattatagagtat

SEQ ID NO: 4206813 - DNA, 17 bp, Homo sapiens
tgtggagacagccctgc

SEQ ID NO: 4206814 - DNA, 16 bp, Homo sapiens
tgtggatgtgtaaatg

SEQ ID NO: 4206815 - DNA, 19 bp, Homo sapiens
tgtggccagggtgagagct

SEQ ID NO: 4206816 - DNA, 20 bp, Homo sapiens
tgtggccagggtgagagctg

SEQ ID NO: 4206817 - DNA, 14 bp, Homo sapiens
tgtggggtctggct

SEQ ID NO: 4206818 - DNA, 14 bp, Homo sapiens
tgtgggtgttaatt

SEQ ID NO: 4206819 - DNA, 13 bp, Homo sapiens
tgtggtgatgaaa

SEQ ID NO: 4206820 - DNA, 22 bp, Homo sapiens
tgtggtgggttctttggaagga

SEQ ID NO: 4206821 - DNA, 21 bp, Homo sapiens
tgtggttcctaagcctgttgc

SEQ ID NO: 4206822 - DNA, 16 bp, Homo sapiens
tgtgtaatagaaaact

SEQ ID NO: 4206823 - DNA, 14 bp, Homo sapiens
tgtgtacatgtaca

SEQ ID NO: 4206824 - DNA, 16 bp, Homo sapiens
tgtgtacatgtacatg

SEQ ID NO: 4206825 - DNA, 21 bp, Homo sapiens
tgtgtaggtattaaagatgtg

SEQ ID NO: 4206826 - DNA, 22 bp, Homo sapiens
tgtgtaggtattaaagatgtgt

SEQ ID NO: 4206827 - DNA, 17 bp, Homo sapiens
tgtgtatccgactctaa

SEQ ID NO: 4206828 - DNA, 23 bp, Homo sapiens
tgtgtatccgactctaagctgtg

SEQ ID NO: 4206829 - DNA, 17 bp, Homo sapiens
tgtgtcaagacatttct

SEQ ID NO: 4206830 - DNA, 14 bp, Homo sapiens
tgtgtccgtctgtg

SEQ ID NO: 4206831 - DNA, 18 bp, Homo sapiens
tgtgtctgggagagcctg

SEQ ID NO: 4206832 - DNA, 12 bp, Homo sapiens
tgtgtctgtgcg

SEQ ID NO: 4206833 - DNA, 23 bp, Homo sapiens
tgtgtgcaccttaccaactttct

SEQ ID NO: 4206834 - DNA, 13 bp, Homo sapiens
tgtgtgcagtgaa

SEQ ID NO: 4206835 - DNA, 21 bp, Homo sapiens
tgtgtgccatagagtttaaca

SEQ ID NO: 4206836 - DNA, 23 bp, Homo sapiens
tgtgtgccatagagtttaacaca

SEQ ID NO: 4206837 - DNA, 23 bp, Homo sapiens
tgtgtgggctcctttaggcaggt

SEQ ID NO: 4206838 - DNA, 23 bp, Homo sapiens
tgtgtgtttaacattcacagccc

SEQ ID NO: 4206839 - DNA, 13 bp, Homo sapiens
tgtgtgtttggaa

SEQ ID NO: 4206840 - DNA, 15 bp, Homo sapiens
tgtgtttaacattca

SEQ ID NO: 4206841 - DNA, 21 bp, Homo sapiens
tgtgtttaacattcacagccc

SEQ ID NO: 4206842 - DNA, 15 bp, Homo sapiens
tgtgtttgctttctg

SEQ ID NO: 4206843 - DNA, 15 bp, Homo sapiens
tgtgtttggctttca

SEQ ID NO: 4206844 - DNA, 17 bp, Homo sapiens
tgtgtttggctttcagg

SEQ ID NO: 4206845 - DNA, 13 bp, Homo sapiens
tgtgttttctgaa

SEQ ID NO: 4206846 - DNA, 14 bp, Homo sapiens
tgtgttttctgaat

SEQ ID NO: 4206847 - DNA, 21 bp, Homo sapiens
tgtgtttttgctatcacacag

SEQ ID NO: 4206848 - DNA, 18 bp, Homo sapiens
tgttaaaatagacaactc

SEQ ID NO: 4206849 - DNA, 14 bp, Homo sapiens
tgttaaatgaaacc

SEQ ID NO: 4206850 - DNA, 18 bp, Homo sapiens
tgttaactattattaata

SEQ ID NO: 4206851 - DNA, 20 bp, Homo sapiens
tgttaatttagaaaacttta

SEQ ID NO: 4206852 - DNA, 22 bp, Homo sapiens
tgttaatttagaaaactttaaa

SEQ ID NO: 4206853 - DNA, 14 bp, Homo sapiens
tgttaatttgttat

SEQ ID NO: 4206854 - DNA, 16 bp, Homo sapiens
tgttaatttttgatac

SEQ ID NO: 4206855 - DNA, 16 bp, Homo sapiens
tgttaccatgaagata

SEQ ID NO: 4206856 - DNA, 14 bp, Homo sapiens
tgttactgaagtta

SEQ ID NO: 4206857 - DNA, 15 bp, Homo sapiens
tgttactgaagttat

SEQ ID NO: 4206858 - DNA, 21 bp, Homo sapiens
tgttactgattctcctgtcag

SEQ ID NO: 4206859 - DNA, 23 bp, Homo sapiens
tgttactttggcaatttcctggc

SEQ ID NO: 4206860 - DNA, 21 bp, Homo sapiens
tgttagatagaatttccaata

SEQ ID NO: 4206861 - DNA, 17 bp, Homo sapiens
tgttatgtatatagatg

SEQ ID NO: 4206862 - DNA, 16 bp, Homo sapiens
tgttatttgtacagtt

SEQ ID NO: 4206863 - DNA, 17 bp, Homo sapiens
tgttcaagtatctaact

SEQ ID NO: 4206864 - DNA, 21 bp, Homo sapiens
tgttcagcttcagacttttat

SEQ ID NO: 4206865 - DNA, 17 bp, Homo sapiens
tgttccagctgcctggg

SEQ ID NO: 4206866 - DNA, 13 bp, Homo sapiens
tgttctgtatttt

SEQ ID NO: 4206867 - DNA, 13 bp, Homo sapiens
tgttgagacagag

SEQ ID NO: 4206868 - DNA, 17 bp, Homo sapiens
tgttgagcatcacagaa

SEQ ID NO: 4206869 - DNA, 19 bp, Homo sapiens
tgttgataaattccactgg

SEQ ID NO: 4206870 - DNA, 17 bp, Homo sapiens
tgttgatacgtgtgtga

SEQ ID NO: 4206871 - DNA, 22 bp, Homo sapiens
tgttgggcttgggggaaaagag

SEQ ID NO: 4206872 - DNA, 15 bp, Homo sapiens
tgttggggcagtggt

SEQ ID NO: 4206873 - DNA, 20 bp, Homo sapiens
tttactaaagagacatattt

SEQ ID NO: 4206874 - DNA, 17 bp, Homo sapiens
tttactatgccacagat

SEQ ID NO: 4206875 - DNA, 13 bp, Homo sapiens
tttactccagtgg

SEQ ID NO: 4206876 - DNA, 21 bp, Homo sapiens
tttactgattaacaaataaat

SEQ ID NO: 4206877 - DNA, 12 bp, Homo sapiens
tttagaaaactt

SEQ ID NO: 4206878 - DNA, 14 bp, Homo sapiens
tttagaaaacttta

SEQ ID NO: 4206879 - DNA, 16 bp, Homo sapiens
tttagaaatatccttt

SEQ ID NO: 4206880 - DNA, 13 bp, Homo sapiens
tttagaaatcatt

SEQ ID NO: 4206881 - DNA, 17 bp, Homo sapiens
tttagctctgttcttta

SEQ ID NO: 4206882 - DNA, 18 bp, Homo sapiens
tttaggaagcaagcttaa

SEQ ID NO: 4206883 - DNA, 11 bp, Homo sapiens
tttaggcagcc

SEQ ID NO: 4206884 - DNA, 22 bp, Homo sapiens
tttaggcaggttacagttaact

SEQ ID NO: 4206885 - DNA, 13 bp, Homo sapiens
tttagggaagcag

SEQ ID NO: 4206886 - DNA, 14 bp, Homo sapiens
tttagttatagttt

SEQ ID NO: 4206887 - DNA, 15 bp, Homo sapiens
tttagttatagtttc

SEQ ID NO: 4206888 - DNA, 14 bp, Homo sapiens
tttagtttactcaa

SEQ ID NO: 4206889 - DNA, 19 bp, Homo sapiens
tttatagtttgtacatgca

SEQ ID NO: 4206890 - DNA, 16 bp, Homo sapiens
tttatattacactaca

SEQ ID NO: 4206891 - DNA, 22 bp, Homo sapiens
tttatcaaacagaattttaaag

SEQ ID NO: 4206892 - DNA, 14 bp, Homo sapiens
tttatcatgacatg

SEQ ID NO: 4206893 - DNA, 19 bp, Homo sapiens
tttatcttctagccacagt

SEQ ID NO: 4206894 - DNA, 14 bp, Homo sapiens
tttatgtctaaaga

SEQ ID NO: 4206895 - DNA, 14 bp, Homo sapiens
tttatgtgaaagag

SEQ ID NO: 4206896 - DNA, 14 bp, Homo sapiens
tttattaaaatgat

SEQ ID NO: 4206897 - DNA, 17 bp, Homo sapiens
tttattttgaactaatt

SEQ ID NO: 4206898 - DNA, 14 bp, Homo sapiens
tttattttgacata

SEQ ID NO: 4206899 - DNA, 23 bp, Homo sapiens
tttatttttgaacccctgtgtcc

SEQ ID NO: 4206900 - DNA, 14 bp, Homo sapiens
tttcaaatttcaca

SEQ ID NO: 4206901 - DNA, 14 bp, Homo sapiens
tttcaactccagaa

SEQ ID NO: 4206902 - DNA, 16 bp, Homo sapiens
tttcaagacttgatac

SEQ ID NO: 4206903 - DNA, 23 bp, Homo sapiens
tttcaagtgcctagactgttact

SEQ ID NO: 4206904 - DNA, 14 bp, Homo sapiens
tttcaattctcaaa

SEQ ID NO: 4206905 - DNA, 15 bp, Homo sapiens
tttcaattctcaaaa

SEQ ID NO: 4206906 - DNA, 14 bp, Homo sapiens
tttcacaaggtctt

SEQ ID NO: 4206907 - DNA, 16 bp, Homo sapiens
tttcacaatgcctaga

SEQ ID NO: 4206908 - DNA, 13 bp, Homo sapiens
tttcacagttttt

SEQ ID NO: 4206909 - DNA, 17 bp, Homo sapiens
tttcagaagcaggcagg

SEQ ID NO: 4206910 - DNA, 15 bp, Homo sapiens
tttcagactgcagag

SEQ ID NO: 4206911 - DNA, 15 bp, Homo sapiens
tttcagatatatatc

SEQ ID NO: 4206912 - DNA, 21 bp, Homo sapiens
tttcagctgtgaacatggact

SEQ ID NO: 4206913 - DNA, 16 bp, Homo sapiens
tttcaggaccttttga

SEQ ID NO: 4206914 - DNA, 19 bp, Homo sapiens
tttcaggatactctgtcag

SEQ ID NO: 4206915 - DNA, 21 bp, Homo sapiens
tttcagtattttggagaaatt

SEQ ID NO: 4206916 - DNA, 18 bp, Homo sapiens
tttcagtccccacagata

SEQ ID NO: 4206917 - DNA, 18 bp, Homo sapiens
tttcagttcccgctctgc

SEQ ID NO: 4206918 - DNA, 15 bp, Homo sapiens
tttccaaagataatg

SEQ ID NO: 4206919 - DNA, 21 bp, Homo sapiens
tttccaagttcctgcactcca

SEQ ID NO: 4206920 - DNA, 20 bp, Homo sapiens
tttccacagttgctgctcct

SEQ ID NO: 4206921 - DNA, 19 bp, Homo sapiens
tttcccaccaccttggact

SEQ ID NO: 4206922 - DNA, 17 bp, Homo sapiens
tttcccatgatccagaa

SEQ ID NO: 4206923 - DNA, 12 bp, Homo sapiens
tttccccacctc

SEQ ID NO: 4206924 - DNA, 20 bp, Homo sapiens
tttcccccaccccagagttg

SEQ ID NO: 4206925 - DNA, 22 bp, Homo sapiens
tttcccgagcaaagtctaaagt

SEQ ID NO: 4206926 - DNA, 14 bp, Homo sapiens
tttccctgactcct

SEQ ID NO: 4206927 - DNA, 12 bp, Homo sapiens
tttccctgtgct

SEQ ID NO: 4206928 - DNA, 13 bp, Homo sapiens
tttccctgtgctg

SEQ ID NO: 4206929 - DNA, 17 bp, Homo sapiens
tttcctccccaccttcc

SEQ ID NO: 4206930 - DNA, 16 bp, Homo sapiens
tttcctggccctccac

SEQ ID NO: 4206931 - DNA, 18 bp, Homo sapiens
tttccttttcttccttct

SEQ ID NO: 4206932 - DNA, 18 bp, Homo sapiens
tttcgcttgcttctgcag

SEQ ID NO: 4206933 - DNA, 12 bp, Homo sapiens
tttcgctttcct

SEQ ID NO: 4206934 - DNA, 15 bp, Homo sapiens
tttctaaatctgaga

SEQ ID NO: 4206935 - DNA, 16 bp, Homo sapiens
tttctcactaaatctt

SEQ ID NO: 4206936 - DNA, 15 bp, Homo sapiens
tttctccaagagcta

SEQ ID NO: 4206937 - DNA, 22 bp, Homo sapiens
tttctcccagcctcttatcact

SEQ ID NO: 4206938 - DNA, 14 bp, Homo sapiens
tttctccccctggg

SEQ ID NO: 4206939 - DNA, 17 bp, Homo sapiens
tttctccctaaactgta

SEQ ID NO: 4206940 - DNA, 19 bp, Homo sapiens
tttctcctactttacactc

SEQ ID NO: 4206941 - DNA, 12 bp, Homo sapiens
tttctcttccct

SEQ ID NO: 4206942 - DNA, 17 bp, Homo sapiens
tttctgaactgttacaa

SEQ ID NO: 4206943 - DNA, 17 bp, Homo sapiens
tttctgatcaaggcctt

SEQ ID NO: 4206944 - DNA, 13 bp, Homo sapiens
tttctgatttcac

SEQ ID NO: 4206945 - DNA, 24 bp, Homo sapiens
tttctggtgccatttctgaactgt

SEQ ID NO: 4206946 - DNA, 11 bp, Homo sapiens
tttctgtgtgc

SEQ ID NO: 4206947 - DNA, 20 bp, Homo sapiens
tttctgtgtgcaccttacca

SEQ ID NO: 4206948 - DNA, 17 bp, Homo sapiens
tttcttacataattttt

SEQ ID NO: 4206949 - DNA, 17 bp, Homo sapiens
tttcttatcttctgcaa

SEQ ID NO: 4206950 - DNA, 18 bp, Homo sapiens
tttcttcaccaaatcttg

SEQ ID NO: 4206951 - DNA, 12 bp, Homo sapiens
tttcttccttct

SEQ ID NO: 4206952 - DNA, 16 bp, Homo sapiens
tttctttgaatgcttt

SEQ ID NO: 4206953 - DNA, 17 bp, Homo sapiens
tttctttttttaaattg

SEQ ID NO: 4206954 - DNA, 18 bp, Homo sapiens
tttcttttttttaataag

SEQ ID NO: 4206955 - DNA, 19 bp, Homo sapiens
tttcttttttttaataagg

SEQ ID NO: 4206956 - DNA, 16 bp, Homo sapiens
tttgaagtacaattgt

SEQ ID NO: 4206957 - DNA, 20 bp, Homo sapiens
tttgaagttacaaacctgta

SEQ ID NO: 4206958 - DNA, 16 bp, Homo sapiens
tttgaagttagcttta

SEQ ID NO: 4206959 - DNA, 23 bp, Homo sapiens
tttgaagttagctttaacttaaa

SEQ ID NO: 4206960 - DNA, 20 bp, Homo sapiens
tttgaatgtttatgttctca

SEQ ID NO: 4206961 - DNA, 14 bp, Homo sapiens
tttgacatttcctt

SEQ ID NO: 4206962 - DNA, 20 bp, Homo sapiens
tttgacatttccttctttgt

SEQ ID NO: 4206963 - DNA, 15 bp, Homo sapiens
tttgagcaattttcg

SEQ ID NO: 4206964 - DNA, 15 bp, Homo sapiens
tttgaggagagtgaa

SEQ ID NO: 4206965 - DNA, 18 bp, Homo sapiens
tttgatactaagcattga

SEQ ID NO: 4206966 - DNA, 22 bp, Homo sapiens
tttgcagctgttttcaaagccc

SEQ ID NO: 4206967 - DNA, 21 bp, Homo sapiens
tttgccaaaataccagagcct

SEQ ID NO: 4206968 - DNA, 15 bp, Homo sapiens
tttgcctctgctact

SEQ ID NO: 4206969 - DNA, 12 bp, Homo sapiens
tttgcttggcag

SEQ ID NO: 4206970 - DNA, 15 bp, Homo sapiens
tttggatatgtaaaa

SEQ ID NO: 4206971 - DNA, 15 bp, Homo sapiens
tttggccctacctgt

SEQ ID NO: 4206972 - DNA, 13 bp, Homo sapiens
tttggctttcagg

SEQ ID NO: 4206973 - DNA, 14 bp, Homo sapiens
tttgggacttctac

SEQ ID NO: 4206974 - DNA, 22 bp, Homo sapiens
tttgggaggggatggcagacag

SEQ ID NO: 4206975 - DNA, 19 bp, Homo sapiens
tttggggagggggaagaga

SEQ ID NO: 4206976 - DNA, 19 bp, Homo sapiens
tttggggttgcccagcctg

SEQ ID NO: 4206977 - DNA, 19 bp, Homo sapiens
tttggtttcccaagagcta

SEQ ID NO: 4206978 - DNA, 17 bp, Homo sapiens
tttgtaaaggaaataat

SEQ ID NO: 4206979 - DNA, 19 bp, Homo sapiens
tttgtaaatgcctcttaaa

SEQ ID NO: 4206980 - DNA, 21 bp, Homo sapiens
tttgtaagtttatgtctaaag

SEQ ID NO: 4206981 - DNA, 20 bp, Homo sapiens
tttgtaataaaaggtatgaa

SEQ ID NO: 4206982 - DNA, 15 bp, Homo sapiens
tttgtacctatgtga

SEQ ID NO: 4206983 - DNA, 21 bp, Homo sapiens
tttgtaggggtcaaagaaatg

SEQ ID NO: 4206984 - DNA, 13 bp, Homo sapiens
tttgtatctgaag

SEQ ID NO: 4206985 - DNA, 20 bp, Homo sapiens
tttgtcaacacaaagacatg

SEQ ID NO: 4206986 - DNA, 14 bp, Homo sapiens
tttgtccaggcctg

SEQ ID NO: 4206987 - DNA, 18 bp, Homo sapiens
tttgtgaactggaagaaa

SEQ ID NO: 4206988 - DNA, 14 bp, Homo sapiens
tttgtgtacagtgt

SEQ ID NO: 4206989 - DNA, 12 bp, Homo sapiens
tttgttaattta

SEQ ID NO: 4206990 - DNA, 19 bp, Homo sapiens
tttgttgaaagtaaaagtt

SEQ ID NO: 4206991 - DNA, 23 bp, Homo sapiens
tttgttggaaggtttggtgtgtg

SEQ ID NO: 4206992 - DNA, 12 bp, Homo sapiens
tttgtttcttga

SEQ ID NO: 4206993 - DNA, 16 bp, Homo sapiens
tttgtttttttccaac

SEQ ID NO: 4206994 - DNA, 14 bp, Homo sapiens
ttttaaaaaagctt

SEQ ID NO: 4206995 - DNA, 15 bp, Homo sapiens
ttttaaaaaagctta

SEQ ID NO: 4206996 - DNA, 20 bp, Homo sapiens
ttttaaaaaagcttaaaact

SEQ ID NO: 4206997 - DNA, 23 bp, Homo sapiens
ttttaaacaaaatagaagctgta

SEQ ID NO: 4206998 - DNA, 17 bp, Homo sapiens
ttttaaaggtagagatg

SEQ ID NO: 4206999 - DNA, 13 bp, Homo sapiens
ttttaaataagat

SEQ ID NO: 4207000 - DNA, 17 bp, Homo sapiens
ttttaaattataagatg

SEQ ID NO: 4207001 - DNA, 17 bp, Homo sapiens
ttttaacttaaatttta

SEQ ID NO: 4207002 - DNA, 21 bp, Homo sapiens
ttttaatttatatttgaaatt

SEQ ID NO: 4207003 - DNA, 14 bp, Homo sapiens
ttttaatttctaca

SEQ ID NO: 4207004 - DNA, 12 bp, Homo sapiens
ttttacaaagcc

SEQ ID NO: 4207005 - DNA, 15 bp, Homo sapiens
ttttactccagtggt

SEQ ID NO: 4207006 - DNA, 21 bp, Homo sapiens
ttttacttagctggagaacta

SEQ ID NO: 4207007 - DNA, 15 bp, Homo sapiens
ttttacttttgttct

SEQ ID NO: 4207008 - DNA, 19 bp, Homo sapiens
ttttagtgaacttgaaata

SEQ ID NO: 4207009 - DNA, 13 bp, Homo sapiens
aagaggaggaaga

SEQ ID NO: 4207010 - DNA, 15 bp, Homo sapiens
aagaggaggagggat

SEQ ID NO: 4207011 - DNA, 13 bp, Homo sapiens
aagaggagggacc

SEQ ID NO: 4207012 - DNA, 23 bp, Homo sapiens
aagaggccctgtctgtacctaac

SEQ ID NO: 4207013 - DNA, 17 bp, Homo sapiens
aagaggctggtgctgtg

SEQ ID NO: 4207014 - DNA, 18 bp, Homo sapiens
aagagggagttggctgga

SEQ ID NO: 4207015 - DNA, 17 bp, Homo sapiens
aagagtaaaaatatgtg

SEQ ID NO: 4207016 - DNA, 21 bp, Homo sapiens
aagagtagcaagttctagaga

SEQ ID NO: 4207017 - DNA, 19 bp, Homo sapiens
aagataacaagatctttca

SEQ ID NO: 4207018 - DNA, 20 bp, Homo sapiens
aagataacaagatctttcag

SEQ ID NO: 4207019 - DNA, 13 bp, Homo sapiens
aagatagaacagg

SEQ ID NO: 4207020 - DNA, 21 bp, Homo sapiens
aagatagaacaggctggttct

SEQ ID NO: 4207021 - DNA, 15 bp, Homo sapiens
aagatagggaacact

SEQ ID NO: 4207022 - DNA, 23 bp, Homo sapiens
aagatatatatttactaaaagaa

SEQ ID NO: 4207023 - DNA, 15 bp, Homo sapiens
aagatattccttttt

SEQ ID NO: 4207024 - DNA, 18 bp, Homo sapiens
aagatattcctttttaac

SEQ ID NO: 4207025 - DNA, 20 bp, Homo sapiens
aagatcgcgccactgcactc

SEQ ID NO: 4207026 - DNA, 17 bp, Homo sapiens
aagatggagaataaatt

SEQ ID NO: 4207027 - DNA, 18 bp, Homo sapiens
aagatgggcagctagttc

SEQ ID NO: 4207028 - DNA, 16 bp, Homo sapiens
aagatgtcagactggc

SEQ ID NO: 4207029 - DNA, 12 bp, Homo sapiens
aagatgtgttgt

SEQ ID NO: 4207030 - DNA, 13 bp, Homo sapiens
aagatgttgtcat

SEQ ID NO: 4207031 - DNA, 15 bp, Homo sapiens
aagattaaaggaagg

SEQ ID NO: 4207032 - DNA, 15 bp, Homo sapiens
aagattaaatatgat

SEQ ID NO: 4207033 - DNA, 20 bp, Homo sapiens
aagattagaggtttgtcaac

SEQ ID NO: 4207034 - DNA, 23 bp, Homo sapiens
aagattaggtactatctgtgaag

SEQ ID NO: 4207035 - DNA, 15 bp, Homo sapiens
aagattgagaagcca

SEQ ID NO: 4207036 - DNA, 14 bp, Homo sapiens
aagatttaacacta

SEQ ID NO: 4207037 - DNA, 21 bp, Homo sapiens
aagatttgttttgtcaagtgt

SEQ ID NO: 4207038 - DNA, 13 bp, Homo sapiens
aagattttttaat

SEQ ID NO: 4207039 - DNA, 14 bp, Homo sapiens
aagattttttaata

SEQ ID NO: 4207040 - DNA, 16 bp, Homo sapiens
aagattttttaataat

SEQ ID NO: 4207041 - DNA, 15 bp, Homo sapiens
aagcaaaagaagtaa

SEQ ID NO: 4207042 - DNA, 20 bp, Homo sapiens
aagcaaaaggctgagaagga

SEQ ID NO: 4207043 - DNA, 21 bp, Homo sapiens
aagcaaaaggctgagaaggaa

SEQ ID NO: 4207044 - DNA, 17 bp, Homo sapiens
aagcaaagcaccagctt

SEQ ID NO: 4207045 - DNA, 17 bp, Homo sapiens
aagcaaatcgaatgaaa

SEQ ID NO: 4207046 - DNA, 20 bp, Homo sapiens
aagcaacctcagtaatttag

SEQ ID NO: 4207047 - DNA, 19 bp, Homo sapiens
aagcaagcattcagaagaa

SEQ ID NO: 4207048 - DNA, 21 bp, Homo sapiens
aagcacactgcagggctgctg

SEQ ID NO: 4207049 - DNA, 24 bp, Homo sapiens
aagcacactgcagggctgctgtgg

SEQ ID NO: 4207050 - DNA, 17 bp, Homo sapiens
aagcacatatgtgccaa

SEQ ID NO: 4207051 - DNA, 19 bp, Homo sapiens
aagcaccagcttctccagg

SEQ ID NO: 4207052 - DNA, 19 bp, Homo sapiens
aagcactgctaggcgagtg

SEQ ID NO: 4207053 - DNA, 16 bp, Homo sapiens
aagcactttttaaaaa

SEQ ID NO: 4207054 - DNA, 19 bp, Homo sapiens
aagcaggaaggatggcaag

SEQ ID NO: 4207055 - DNA, 22 bp, Homo sapiens
aagcaggttgaggggctcctgg

SEQ ID NO: 4207056 - DNA, 15 bp, Homo sapiens
aagcagtgtttctac

SEQ ID NO: 4207057 - DNA, 18 bp, Homo sapiens
aagcatcacctcaggcca

SEQ ID NO: 4207058 - DNA, 23 bp, Homo sapiens
aagcatcacctcaggccaggtgc

SEQ ID NO: 4207059 - DNA, 18 bp, Homo sapiens
aagcattctgagctgggc

SEQ ID NO: 4207060 - DNA, 19 bp, Homo sapiens
aagcattttgtaagttgaa

SEQ ID NO: 4207061 - DNA, 12 bp, Homo sapiens
aagccaaaacaa

SEQ ID NO: 4207062 - DNA, 14 bp, Homo sapiens
aagccaaactgttg

SEQ ID NO: 4207063 - DNA, 20 bp, Homo sapiens
aagccaaactgttggaagtt

SEQ ID NO: 4207064 - DNA, 21 bp, Homo sapiens
aagccatgctggaaaataata

SEQ ID NO: 4207065 - DNA, 19 bp, Homo sapiens
aagcccagctctttgttca

SEQ ID NO: 4207066 - DNA, 18 bp, Homo sapiens
aagcccgcctctgtccta

SEQ ID NO: 4207067 - DNA, 13 bp, Homo sapiens
aagccctgctggg

SEQ ID NO: 4207068 - DNA, 11 bp, Homo sapiens
aagcctctgct

SEQ ID NO: 4207069 - DNA, 14 bp, Homo sapiens
aagcctctgctgcc

SEQ ID NO: 4207070 - DNA, 13 bp, Homo sapiens
aagcctctggaaa

SEQ ID NO: 4207071 - DNA, 15 bp, Homo sapiens
aagcctgactgctcg

SEQ ID NO: 4207072 - DNA, 23 bp, Homo sapiens
aagcctgcagcgagctgagatca

SEQ ID NO: 4207073 - DNA, 15 bp, Homo sapiens
aagccttactcacct

SEQ ID NO: 4207074 - DNA, 17 bp, Homo sapiens
aagccttactcacctct

SEQ ID NO: 4207075 - DNA, 21 bp, Homo sapiens
aagcgatgaatttggagactc

SEQ ID NO: 4207076 - DNA, 17 bp, Homo sapiens
aagcgggggcgtggctg

SEQ ID NO: 4207077 - DNA, 20 bp, Homo sapiens
aagcggttgcttctggctcc

SEQ ID NO: 4207078 - DNA, 12 bp, Homo sapiens
aagctcatattt

SEQ ID NO: 4207079 - DNA, 23 bp, Homo sapiens
aagctcatattttgtatatatct

SEQ ID NO: 4207080 - DNA, 16 bp, Homo sapiens
aagctctagtgggaag

SEQ ID NO: 4207081 - DNA, 11 bp, Homo sapiens
aagctctggct

SEQ ID NO: 4207082 - DNA, 15 bp, Homo sapiens
aagctgcctgtagtt

SEQ ID NO: 4207083 - DNA, 16 bp, Homo sapiens
aagctgcctgtagtta

SEQ ID NO: 4207084 - DNA, 11 bp, Homo sapiens
aagctggaagc

SEQ ID NO: 4207085 - DNA, 19 bp, Homo sapiens
aagctggcagctgtcattc

SEQ ID NO: 4207086 - DNA, 11 bp, Homo sapiens
aagctgtaccc

SEQ ID NO: 4207087 - DNA, 13 bp, Homo sapiens
aagcttaaaactt

SEQ ID NO: 4207088 - DNA, 12 bp, Homo sapiens
aagctttctcct

SEQ ID NO: 4207089 - DNA, 22 bp, Homo sapiens
aagctttggtgagaacctgggt

SEQ ID NO: 4207090 - DNA, 16 bp, Homo sapiens
aaggaaaaaataatat

SEQ ID NO: 4207091 - DNA, 15 bp, Homo sapiens
aaggaaaactcttgg

SEQ ID NO: 4207092 - DNA, 15 bp, Homo sapiens
aaggaaagatttgtg

SEQ ID NO: 4207093 - DNA, 19 bp, Homo sapiens
aaggaaatgtgtgttgtaa

SEQ ID NO: 4207094 - DNA, 14 bp, Homo sapiens
aaggaacaagagaa

SEQ ID NO: 4207095 - DNA, 17 bp, Homo sapiens
aaggaaggctccatctc

SEQ ID NO: 4207096 - DNA, 17 bp, Homo sapiens
aaggacaacctgcccct

SEQ ID NO: 4207097 - DNA, 21 bp, Homo sapiens
aaggacaacctgcccctcccc

SEQ ID NO: 4207098 - DNA, 13 bp, Homo sapiens
aaggacaatgcct

SEQ ID NO: 4207099 - DNA, 20 bp, Homo sapiens
aaggacaatgccttgggaga

SEQ ID NO: 4207100 - DNA, 12 bp, Homo sapiens
aaggacacttgt

SEQ ID NO: 4207101 - DNA, 23 bp, Homo sapiens
aaggagcagagctgatggagaag

SEQ ID NO: 4207102 - DNA, 13 bp, Homo sapiens
aaggagttaagag

SEQ ID NO: 4207103 - DNA, 13 bp, Homo sapiens
aaggatcagaatg

SEQ ID NO: 4207104 - DNA, 15 bp, Homo sapiens
aaggatcagaatgga

SEQ ID NO: 4207105 - DNA, 19 bp, Homo sapiens
aaggatcctggaaccactg

SEQ ID NO: 4207106 - DNA, 22 bp, Homo sapiens
aaggatggcaagcacgggacag

SEQ ID NO: 4207107 - DNA, 16 bp, Homo sapiens
aaggatgttgttatga

SEQ ID NO: 4207108 - DNA, 21 bp, Homo sapiens
aaggattgatcactttgttaa

SEQ ID NO: 4207109 - DNA, 20 bp, Homo sapiens
aaggcagggacagagatgga

SEQ ID NO: 4207110 - DNA, 14 bp, Homo sapiens
aaggcagggaggag

SEQ ID NO: 4207111 - DNA, 19 bp, Homo sapiens
aaggcagggaggaggcaga

SEQ ID NO: 4207112 - DNA, 23 bp, Homo sapiens
aaggcagtgaacacactcagcag

SEQ ID NO: 4207113 - DNA, 16 bp, Homo sapiens
aaggcatacctgtcct

SEQ ID NO: 4207114 - DNA, 14 bp, Homo sapiens
aaggcatgttggga

SEQ ID NO: 4207115 - DNA, 19 bp, Homo sapiens
aaggcctcactcaagcctg

SEQ ID NO: 4207116 - DNA, 21 bp, Homo sapiens
aaggctagtttattttgttac

SEQ ID NO: 4207117 - DNA, 16 bp, Homo sapiens
aaggctcagtctcagg

SEQ ID NO: 4207118 - DNA, 12 bp, Homo sapiens
aaggctgagaag

SEQ ID NO: 4207119 - DNA, 16 bp, Homo sapiens
aaggctggctgggcat

SEQ ID NO: 4207120 - DNA, 19 bp, Homo sapiens
aaggcttgttgtgctttta

SEQ ID NO: 4207121 - DNA, 17 bp, Homo sapiens
aagggaagcctgactgc

SEQ ID NO: 4207122 - DNA, 14 bp, Homo sapiens
aagggaagctttgt

SEQ ID NO: 4207123 - DNA, 20 bp, Homo sapiens
aagggcaaaccatttcaaat

SEQ ID NO: 4207124 - DNA, 18 bp, Homo sapiens
aagggcagaaggggaaga

SEQ ID NO: 4207125 - DNA, 14 bp, Homo sapiens
aagggcatccttct

SEQ ID NO: 4207126 - DNA, 15 bp, Homo sapiens
aagggctcttttcct

SEQ ID NO: 4207127 - DNA, 17 bp, Homo sapiens
aagggcttggtggccaa

SEQ ID NO: 4207128 - DNA, 18 bp, Homo sapiens
aagggcttggtggccaag

SEQ ID NO: 4207129 - DNA, 19 bp, Homo sapiens
aaggggacgcgggctgtgc

SEQ ID NO: 4207130 - DNA, 13 bp, Homo sapiens
aaggggcttcagg

SEQ ID NO: 4207131 - DNA, 16 bp, Homo sapiens
aagggggtccacccag

SEQ ID NO: 4207132 - DNA, 13 bp, Homo sapiens
aagggtaaagaag

SEQ ID NO: 4207133 - DNA, 22 bp, Homo sapiens
aaggtaaaatgccatgatgcct

SEQ ID NO: 4207134 - DNA, 18 bp, Homo sapiens
aaggtacaagaagcattt

SEQ ID NO: 4207135 - DNA, 16 bp, Homo sapiens
aaggtagagatgtgtg

SEQ ID NO: 4207136 - DNA, 17 bp, Homo sapiens
aaggtagagatgtgtgt

SEQ ID NO: 4207137 - DNA, 15 bp, Homo sapiens
aaggtccatgctttg

SEQ ID NO: 4207138 - DNA, 12 bp, Homo sapiens
aaggtctgcttt

SEQ ID NO: 4207139 - DNA, 19 bp, Homo sapiens
aaggtgatttcagactgca

SEQ ID NO: 4207140 - DNA, 15 bp, Homo sapiens
aaggtggtgtttctg

SEQ ID NO: 4207141 - DNA, 17 bp, Homo sapiens
aaggttagaggtttgtc

SEQ ID NO: 4207142 - DNA, 21 bp, Homo sapiens
aaggttagaggtttgtcaaca

SEQ ID NO: 4207143 - DNA, 16 bp, Homo sapiens
aaggttaggtttgtca

SEQ ID NO: 4207144 - DNA, 15 bp, Homo sapiens
aaatattttgttctt

SEQ ID NO: 4207145 - DNA, 17 bp, Homo sapiens
aaatccagtttcccacc

SEQ ID NO: 4207146 - DNA, 21 bp, Homo sapiens
aaatccttagatctggcatgt

SEQ ID NO: 4207147 - DNA, 17 bp, Homo sapiens
aaatcctttttctttat

SEQ ID NO: 4207148 - DNA, 15 bp, Homo sapiens
aaatctagaaaattg

SEQ ID NO: 4207149 - DNA, 12 bp, Homo sapiens
aaatctctaata

SEQ ID NO: 4207150 - DNA, 18 bp, Homo sapiens
aaatctttgattcagaca

SEQ ID NO: 4207151 - DNA, 18 bp, Homo sapiens
aaatgaaagcatgtctca

SEQ ID NO: 4207152 - DNA, 15 bp, Homo sapiens
aaatgaatgttgtct

SEQ ID NO: 4207153 - DNA, 14 bp, Homo sapiens
aaatgaattgtatt

SEQ ID NO: 4207154 - DNA, 19 bp, Homo sapiens
aaatgaattgtattttttg

SEQ ID NO: 4207155 - DNA, 19 bp, Homo sapiens
aaatggtttttgcaagatt

SEQ ID NO: 4207156 - DNA, 17 bp, Homo sapiens
aactgaaaattatttaa

SEQ ID NO: 4207157 - DNA, 22 bp, Homo sapiens
aactgaataggaaaatgtacat

SEQ ID NO: 4207158 - DNA, 16 bp, Homo sapiens
aactgaattttgggac

SEQ ID NO: 4207159 - DNA, 23 bp, Homo sapiens
aactgagaaagagagagatacat

SEQ ID NO: 4207160 - DNA, 20 bp, Homo sapiens
aactgaggtcactgggttct

SEQ ID NO: 4207161 - DNA, 12 bp, Homo sapiens
aactgctctgcc

SEQ ID NO: 4207162 - DNA, 14 bp, Homo sapiens
aactgctctgccca

SEQ ID NO: 4207163 - DNA, 15 bp, Homo sapiens
aactggaagaaagca

SEQ ID NO: 4207164 - DNA, 19 bp, Homo sapiens
aactggggagttataaaaa

SEQ ID NO: 4207165 - DNA, 23 bp, Homo sapiens
aactggggagttataaaaataca

SEQ ID NO: 4207166 - DNA, 13 bp, Homo sapiens
aactgtaatacaa

SEQ ID NO: 4207167 - DNA, 17 bp, Homo sapiens
aactgtacaaatgaaat

SEQ ID NO: 4207168 - DNA, 19 bp, Homo sapiens
aactgtgaaataccacaag

SEQ ID NO: 4207169 - DNA, 22 bp, Homo sapiens
aactgtgaaataccacaagcct

SEQ ID NO: 4207170 - DNA, 18 bp, Homo sapiens
aactgtgccctgccttca

SEQ ID NO: 4207171 - DNA, 19 bp, Homo sapiens
aactgttggaagttcactg

SEQ ID NO: 4207172 - DNA, 15 bp, Homo sapiens
aacttaaacaatttc

SEQ ID NO: 4207173 - DNA, 15 bp, Homo sapiens
aacttagaataaaat

SEQ ID NO: 4207174 - DNA, 17 bp, Homo sapiens
aacttagaataaaattg

SEQ ID NO: 4207175 - DNA, 17 bp, Homo sapiens
aacttcgtgcatttgtt

SEQ ID NO: 4207176 - DNA, 16 bp, Homo sapiens
aacttctatgtttatc

SEQ ID NO: 4207177 - DNA, 19 bp, Homo sapiens
aacttctttgaagttattt

SEQ ID NO: 4207178 - DNA, 19 bp, Homo sapiens
aacttgagggtaataaact

SEQ ID NO: 4207179 - DNA, 18 bp, Homo sapiens
aacttgcttatcaacttc

SEQ ID NO: 4207180 - DNA, 19 bp, Homo sapiens
aacttggctgcaggaatct

SEQ ID NO: 4207181 - DNA, 15 bp, Homo sapiens
aacttgtatttccaa

SEQ ID NO: 4207182 - DNA, 13 bp, Homo sapiens
aacttgtgttcta

SEQ ID NO: 4207183 - DNA, 16 bp, Homo sapiens
aacttgttcacaggtt

SEQ ID NO: 4207184 - DNA, 20 bp, Homo sapiens
aactttacccaaaaactaaa

SEQ ID NO: 4207185 - DNA, 22 bp, Homo sapiens
aactttgtggtaacttctttga

SEQ ID NO: 4207186 - DNA, 19 bp, Homo sapiens
aagaaaatacataagacca

SEQ ID NO: 4207187 - DNA, 21 bp, Homo sapiens
aagaaaatgtctgttttccaa

SEQ ID NO: 4207188 - DNA, 19 bp, Homo sapiens
aagaaaattagtaattgta

SEQ ID NO: 4207189 - DNA, 22 bp, Homo sapiens
aagaaacactcaacaataaaga

SEQ ID NO: 4207190 - DNA, 20 bp, Homo sapiens
aagaaaccacaggttccata

SEQ ID NO: 4207191 - DNA, 21 bp, Homo sapiens
aagaaacctactgcccaggca

SEQ ID NO: 4207192 - DNA, 11 bp, Homo sapiens
aagaaactttc

SEQ ID NO: 4207193 - DNA, 23 bp, Homo sapiens
aagaaactttctttctcactaaa

SEQ ID NO: 4207194 - DNA, 18 bp, Homo sapiens
aagaaagcacctgttttt

SEQ ID NO: 4207195 - DNA, 20 bp, Homo sapiens
aagaaagcacctgtttttac

SEQ ID NO: 4207196 - DNA, 17 bp, Homo sapiens
aagaaagctggtaaact

SEQ ID NO: 4207197 - DNA, 18 bp, Homo sapiens
aagaaagtgcagaatcaa

SEQ ID NO: 4207198 - DNA, 21 bp, Homo sapiens
aagaaattcttttcaaaagct

SEQ ID NO: 4207199 - DNA, 16 bp, Homo sapiens
aagaaatttgatttct

SEQ ID NO: 4207200 - DNA, 14 bp, Homo sapiens
aagaacaacaacaa

SEQ ID NO: 4207201 - DNA, 19 bp, Homo sapiens
aagaacaacaacaacaata

SEQ ID NO: 4207202 - DNA, 16 bp, Homo sapiens
aagaacgtcattttgg

SEQ ID NO: 4207203 - DNA, 10 bp, Homo sapiens
aagaagagac

SEQ ID NO: 4207204 - DNA, 22 bp, Homo sapiens
aagaagcattttgtaagttgaa

SEQ ID NO: 4207205 - DNA, 21 bp, Homo sapiens
aagaaggagagcaagaaggaa

SEQ ID NO: 4207206 - DNA, 19 bp, Homo sapiens
aagaagggaagctttgttt

SEQ ID NO: 4207207 - DNA, 23 bp, Homo sapiens
aagaataatgccttgtatggtgt

SEQ ID NO: 4207208 - DNA, 16 bp, Homo sapiens
aagaatacttctcatt

SEQ ID NO: 4207209 - DNA, 22 bp, Homo sapiens
aagaatacttctcattttttaa

SEQ ID NO: 4207210 - DNA, 20 bp, Homo sapiens
aagaatctcatctcagtgaa

SEQ ID NO: 4207211 - DNA, 13 bp, Homo sapiens
aagaatctctcct

SEQ ID NO: 4207212 - DNA, 21 bp, Homo sapiens
aagaatgagaaggagtcagaa

SEQ ID NO: 4207213 - DNA, 17 bp, Homo sapiens
aagaatgcttaatcaga

SEQ ID NO: 4207214 - DNA, 15 bp, Homo sapiens
aagaattcacacctt

SEQ ID NO: 4207215 - DNA, 14 bp, Homo sapiens
aagaattgtccatg

SEQ ID NO: 4207216 - DNA, 21 bp, Homo sapiens
aagacacaaggtgatttcaga

SEQ ID NO: 4207217 - DNA, 19 bp, Homo sapiens
aagacaggtctagactttc

SEQ ID NO: 4207218 - DNA, 15 bp, Homo sapiens
aagacagtgtgtgtg

SEQ ID NO: 4207219 - DNA, 13 bp, Homo sapiens
aagacatggaaga

SEQ ID NO: 4207220 - DNA, 14 bp, Homo sapiens
aagacatggaagat

SEQ ID NO: 4207221 - DNA, 20 bp, Homo sapiens
aagacatggaagattagagg

SEQ ID NO: 4207222 - DNA, 20 bp, Homo sapiens
aagacatggaaggttaggtt

SEQ ID NO: 4207223 - DNA, 23 bp, Homo sapiens
aagactaagcaccataaccaaga

SEQ ID NO: 4207224 - DNA, 16 bp, Homo sapiens
aagactattaagagca

SEQ ID NO: 4207225 - DNA, 17 bp, Homo sapiens
aagactattaagagcaa

SEQ ID NO: 4207226 - DNA, 13 bp, Homo sapiens
aagactctggagc

SEQ ID NO: 4207227 - DNA, 14 bp, Homo sapiens
aagactgaaacggc

SEQ ID NO: 4207228 - DNA, 21 bp, Homo sapiens
aagacttgatactgcaataaa

SEQ ID NO: 4207229 - DNA, 19 bp, Homo sapiens
aagacttggcaacagaagc

SEQ ID NO: 4207230 - DNA, 16 bp, Homo sapiens
aagagaacaagaggtg

SEQ ID NO: 4207231 - DNA, 18 bp, Homo sapiens
aagagaacaagaggtgct

SEQ ID NO: 4207232 - DNA, 13 bp, Homo sapiens
aagagaaggagca

SEQ ID NO: 4207233 - DNA, 14 bp, Homo sapiens
aagagaagggaagc

SEQ ID NO: 4207234 - DNA, 16 bp, Homo sapiens
aagagacactgcttgg

SEQ ID NO: 4207235 - DNA, 14 bp, Homo sapiens
aagagacagaatga

SEQ ID NO: 4207236 - DNA, 18 bp, Homo sapiens
aagagagaaaacttattt

SEQ ID NO: 4207237 - DNA, 13 bp, Homo sapiens
aagagaggcacct

SEQ ID NO: 4207238 - DNA, 17 bp, Homo sapiens
aagagatcagcagtggc

SEQ ID NO: 4207239 - DNA, 18 bp, Homo sapiens
aagagatcagcagtggca

SEQ ID NO: 4207240 - DNA, 22 bp, Homo sapiens
aagagatcaggaagagaaggag

SEQ ID NO: 4207241 - DNA, 11 bp, Homo sapiens
aagagcctgga

SEQ ID NO: 4207242 - DNA, 14 bp, Homo sapiens
aagagctacataat

SEQ ID NO: 4207243 - DNA, 20 bp, Homo sapiens
aagaggagtttcgaggtaga

SEQ ID NO: 4207244 - DNA, 21 bp, Homo sapiens
aagaggcaagagacagaatga

SEQ ID NO: 4207245 - DNA, 18 bp, Homo sapiens
aagagggagatggagact

SEQ ID NO: 4207246 - DNA, 23 bp, Homo sapiens
aagaggttgggcttccatgcctg

SEQ ID NO: 4207247 - DNA, 13 bp, Homo sapiens
aagagtcagccct

SEQ ID NO: 4207248 - DNA, 18 bp, Homo sapiens
aagagttcttgcccttca

SEQ ID NO: 4207249 - DNA, 22 bp, Homo sapiens
aagataacaagatctttcagga

SEQ ID NO: 4207250 - DNA, 14 bp, Homo sapiens
aagataattttatg

SEQ ID NO: 4207251 - DNA, 22 bp, Homo sapiens
aagatatatatttactaaaaga

SEQ ID NO: 4207252 - DNA, 13 bp, Homo sapiens
aagatctttcagg

SEQ ID NO: 4207253 - DNA, 22 bp, Homo sapiens
aagatgcttttaacagagtctg

SEQ ID NO: 4207254 - DNA, 20 bp, Homo sapiens
aagattaaaaccacagaaca

SEQ ID NO: 4207255 - DNA, 21 bp, Homo sapiens
aagattaaaaccacagaacag

SEQ ID NO: 4207256 - DNA, 18 bp, Homo sapiens
aagattaaaggaaggaaa

SEQ ID NO: 4207257 - DNA, 14 bp, Homo sapiens
aagattagaggttt

SEQ ID NO: 4207258 - DNA, 15 bp, Homo sapiens
aagattagaggtttg

SEQ ID NO: 4207259 - DNA, 17 bp, Homo sapiens
aagatttagatgttttc

SEQ ID NO: 4207260 - DNA, 16 bp, Homo sapiens
aagatttgtgaactgg

SEQ ID NO: 4207261 - DNA, 18 bp, Homo sapiens
aagatttgtgaactggaa

SEQ ID NO: 4207262 - DNA, 22 bp, Homo sapiens
aagatttgtgaactggaagaaa

SEQ ID NO: 4207263 - DNA, 17 bp, Homo sapiens
aagattttttaataatt

SEQ ID NO: 4207264 - DNA, 12 bp, Homo sapiens
aagcaaaaagat

SEQ ID NO: 4207265 - DNA, 17 bp, Homo sapiens
aagcaaagttgggtgta

SEQ ID NO: 4207266 - DNA, 20 bp, Homo sapiens
aagcaacaaagattgagaag

SEQ ID NO: 4207267 - DNA, 12 bp, Homo sapiens
aagcaacataaa

SEQ ID NO: 4207268 - DNA, 15 bp, Homo sapiens
aagcaacctcagtaa

SEQ ID NO: 4207269 - DNA, 22 bp, Homo sapiens
aagcaacctcagtaatttagaa

SEQ ID NO: 4207270 - DNA, 21 bp, Homo sapiens
aagcaactccgtgtgcctggg

SEQ ID NO: 4207271 - DNA, 12 bp, Homo sapiens
aagcaagcaggg

SEQ ID NO: 4207272 - DNA, 15 bp, Homo sapiens
aatccactgacagat

SEQ ID NO: 4207273 - DNA, 22 bp, Homo sapiens
aatccatgttagtttttacttt

SEQ ID NO: 4207274 - DNA, 16 bp, Homo sapiens
aatcccacccacctca

SEQ ID NO: 4207275 - DNA, 21 bp, Homo sapiens
aatccgcctgcagaggacaga

SEQ ID NO: 4207276 - DNA, 12 bp, Homo sapiens
aatcctgaagaa

SEQ ID NO: 4207277 - DNA, 19 bp, Homo sapiens
aatccttagatctggcatg

SEQ ID NO: 4207278 - DNA, 20 bp, Homo sapiens
aatcgcttgaaccggggagg

SEQ ID NO: 4207279 - DNA, 18 bp, Homo sapiens
aatcggctggggactgct

SEQ ID NO: 4207280 - DNA, 17 bp, Homo sapiens
aatctaacaataatatt

SEQ ID NO: 4207281 - DNA, 18 bp, Homo sapiens
aatctaacaataatattt

SEQ ID NO: 4207282 - DNA, 13 bp, Homo sapiens
aatctaactacaa

SEQ ID NO: 4207283 - DNA, 16 bp, Homo sapiens
aatctcagttgatttt

SEQ ID NO: 4207284 - DNA, 18 bp, Homo sapiens
aatctccagggctgcccc

SEQ ID NO: 4207285 - DNA, 20 bp, Homo sapiens
aatctccagggctgcccctg

SEQ ID NO: 4207286 - DNA, 15 bp, Homo sapiens
aatctccagtattct

SEQ ID NO: 4207287 - DNA, 14 bp, Homo sapiens
aatctgaaagcccg

SEQ ID NO: 4207288 - DNA, 18 bp, Homo sapiens
aatctgagcaaacaccag

SEQ ID NO: 4207289 - DNA, 16 bp, Homo sapiens
aatctgggaagggaag

SEQ ID NO: 4207290 - DNA, 19 bp, Homo sapiens
aatcttggggggtttttac

SEQ ID NO: 4207291 - DNA, 19 bp, Homo sapiens
aatcttggttgatgccaaa

SEQ ID NO: 4207292 - DNA, 12 bp, Homo sapiens
aatgaaaccaaa

SEQ ID NO: 4207293 - DNA, 15 bp, Homo sapiens
aatgaaaccaaagcc

SEQ ID NO: 4207294 - DNA, 18 bp, Homo sapiens
aatgaatgatcattgaaa

SEQ ID NO: 4207295 - DNA, 18 bp, Homo sapiens
aatgaattgtattttttg

SEQ ID NO: 4207296 - DNA, 14 bp, Homo sapiens
aatgacagaatgct

SEQ ID NO: 4207297 - DNA, 15 bp, Homo sapiens
aatgagaacttcaat

SEQ ID NO: 4207298 - DNA, 14 bp, Homo sapiens
aatgaggacatgtt

SEQ ID NO: 4207299 - DNA, 16 bp, Homo sapiens
aatgaggacatgtttt

SEQ ID NO: 4207300 - DNA, 14 bp, Homo sapiens
aatgagggactgga

SEQ ID NO: 4207301 - DNA, 15 bp, Homo sapiens
aatgataagcaggaa

SEQ ID NO: 4207302 - DNA, 16 bp, Homo sapiens
aatgatcattgaaagt

SEQ ID NO: 4207303 - DNA, 22 bp, Homo sapiens
aatgatcattgaaagtaaaaaa

SEQ ID NO: 4207304 - DNA, 13 bp, Homo sapiens
aatgattgtaaaa

SEQ ID NO: 4207305 - DNA, 15 bp, Homo sapiens
aatgattgtagtaat

SEQ ID NO: 4207306 - DNA, 16 bp, Homo sapiens
aatgcacctaaagaaa

SEQ ID NO: 4207307 - DNA, 23 bp, Homo sapiens
aatgccaacttgtccttttgtac

SEQ ID NO: 4207308 - DNA, 19 bp, Homo sapiens
aatgccggttaaattccat

SEQ ID NO: 4207309 - DNA, 15 bp, Homo sapiens
aatgccttttcccaa

SEQ ID NO: 4207310 - DNA, 16 bp, Homo sapiens
aatgctgcttctcctc

SEQ ID NO: 4207311 - DNA, 22 bp, Homo sapiens
aatgctgcttctcctcccagcg

SEQ ID NO: 4207312 - DNA, 22 bp, Homo sapiens
aatgcttaatcagatagatatt

SEQ ID NO: 4207313 - DNA, 12 bp, Homo sapiens
aatggaagaaaa

SEQ ID NO: 4207314 - DNA, 15 bp, Homo sapiens
aatggacttcaaatt

SEQ ID NO: 4207315 - DNA, 15 bp, Homo sapiens
aatggagtgggagat

SEQ ID NO: 4207316 - DNA, 14 bp, Homo sapiens
aatggcctgccttg

SEQ ID NO: 4207317 - DNA, 14 bp, Homo sapiens
aatggctatgtttt

SEQ ID NO: 4207318 - DNA, 16 bp, Homo sapiens
aatggctatgttttta

SEQ ID NO: 4207319 - DNA, 20 bp, Homo sapiens
aatggctatgtttttaatgt

SEQ ID NO: 4207320 - DNA, 15 bp, Homo sapiens
aatggctgataattt

SEQ ID NO: 4207321 - DNA, 19 bp, Homo sapiens
aatggctgataattttaaa

SEQ ID NO: 4207322 - DNA, 23 bp, Homo sapiens
aatgggccactgtaggggttggg

SEQ ID NO: 4207323 - DNA, 14 bp, Homo sapiens
aatggggcttgccc

SEQ ID NO: 4207324 - DNA, 12 bp, Homo sapiens
aatgggtaatat

SEQ ID NO: 4207325 - DNA, 15 bp, Homo sapiens
aatggtattgggcag

SEQ ID NO: 4207326 - DNA, 21 bp, Homo sapiens
aatggtattgggcagttggga

SEQ ID NO: 4207327 - DNA, 14 bp, Homo sapiens
aatggtccagggtt

SEQ ID NO: 4207328 - DNA, 14 bp, Homo sapiens
aatggtttacatga

SEQ ID NO: 4207329 - DNA, 16 bp, Homo sapiens
aatggtttacatgaac

SEQ ID NO: 4207330 - DNA, 13 bp, Homo sapiens
aatgtaaatacat

SEQ ID NO: 4207331 - DNA, 14 bp, Homo sapiens
aatgtaaatacatc

SEQ ID NO: 4207332 - DNA, 19 bp, Homo sapiens
aatgtaaatattttaaaga

SEQ ID NO: 4207333 - DNA, 14 bp, Homo sapiens
aatgtaataataat

SEQ ID NO: 4207334 - DNA, 23 bp, Homo sapiens
aatgtaattatgaggtgaaacaa

SEQ ID NO: 4207335 - DNA, 16 bp, Homo sapiens
aatgtacatactatgt

SEQ ID NO: 4207336 - DNA, 19 bp, Homo sapiens
aatgtagaatgatttttgc

SEQ ID NO: 4207337 - DNA, 14 bp, Homo sapiens
aatgtagtggagag

SEQ ID NO: 4207338 - DNA, 17 bp, Homo sapiens
aatgtatatgtcattta

SEQ ID NO: 4207339 - DNA, 14 bp, Homo sapiens
aatgtcattttggt

SEQ ID NO: 4207340 - DNA, 14 bp, Homo sapiens
aatgtctgttttcc

SEQ ID NO: 4207341 - DNA, 17 bp, Homo sapiens
aatgtgaatctcttaat

SEQ ID NO: 4207342 - DNA, 19 bp, Homo sapiens
aatgtgtgccatagagttt

SEQ ID NO: 4207343 - DNA, 18 bp, Homo sapiens
aatgtgtgtctgaagact

SEQ ID NO: 4207344 - DNA, 20 bp, Homo sapiens
aatgtgtgttgtaacaaata

SEQ ID NO: 4207345 - DNA, 23 bp, Homo sapiens
aatgttatttgttattttcagta

SEQ ID NO: 4207346 - DNA, 16 bp, Homo sapiens
aatgttcgtattctat

SEQ ID NO: 4207347 - DNA, 20 bp, Homo sapiens
aatgttcgtattctattcaa

SEQ ID NO: 4207348 - DNA, 20 bp, Homo sapiens
aattaaaaaggaaagaaaac

SEQ ID NO: 4207349 - DNA, 18 bp, Homo sapiens
aattaactgggtaatgaa

SEQ ID NO: 4207350 - DNA, 16 bp, Homo sapiens
aattaaggcatttgtt

SEQ ID NO: 4207351 - DNA, 14 bp, Homo sapiens
aattaatagctttt

SEQ ID NO: 4207352 - DNA, 15 bp, Homo sapiens
aattacatccagaaa

SEQ ID NO: 4207353 - DNA, 16 bp, Homo sapiens
aattagaaaatcctat

SEQ ID NO: 4207354 - DNA, 12 bp, Homo sapiens
aattataataaa

SEQ ID NO: 4207355 - DNA, 13 bp, Homo sapiens
aattataataaag

SEQ ID NO: 4207356 - DNA, 17 bp, Homo sapiens
aattataataaaggtca

SEQ ID NO: 4207357 - DNA, 20 bp, Homo sapiens
aattatataggttgtgcaaa

SEQ ID NO: 4207358 - DNA, 13 bp, Homo sapiens
aattatccaggaa

SEQ ID NO: 4207359 - DNA, 22 bp, Homo sapiens
aattatgagatgatgaaaataa

SEQ ID NO: 4207360 - DNA, 15 bp, Homo sapiens
aattattgtacacta

SEQ ID NO: 4207361 - DNA, 14 bp, Homo sapiens
aattatttaataaa

SEQ ID NO: 4207362 - DNA, 18 bp, Homo sapiens
aattatttgtgtaataga

SEQ ID NO: 4207363 - DNA, 19 bp, Homo sapiens
aattatttgtgtaatagaa

SEQ ID NO: 4207364 - DNA, 14 bp, Homo sapiens
aattattttaaaca

SEQ ID NO: 4207365 - DNA, 17 bp, Homo sapiens
aattattttattgtcta

SEQ ID NO: 4207366 - DNA, 23 bp, Homo sapiens
aattattttgagtggcaaaataa

SEQ ID NO: 4207367 - DNA, 20 bp, Homo sapiens
aattatttttgagcaggagc

SEQ ID NO: 4207368 - DNA, 21 bp, Homo sapiens
aattatttttgagcaggagca

SEQ ID NO: 4207369 - DNA, 22 bp, Homo sapiens
aattcaaagctgtgtgtttgga

SEQ ID NO: 4207370 - DNA, 15 bp, Homo sapiens
aattcaattcaaagc

SEQ ID NO: 4207371 - DNA, 23 bp, Homo sapiens
aattcactctgagtgttttatga

SEQ ID NO: 4207372 - DNA, 12 bp, Homo sapiens
aattccaaggag

SEQ ID NO: 4207373 - DNA, 21 bp, Homo sapiens
aattcctctcactaaacttta

SEQ ID NO: 4207374 - DNA, 18 bp, Homo sapiens
aattccttaccccagctg

SEQ ID NO: 4207375 - DNA, 22 bp, Homo sapiens
aattctagcattttattactgt

SEQ ID NO: 4207376 - DNA, 13 bp, Homo sapiens
aattctgagatcc

SEQ ID NO: 4207377 - DNA, 21 bp, Homo sapiens
aattgaagagatttcaacata

SEQ ID NO: 4207378 - DNA, 16 bp, Homo sapiens
aattgaatacacaaat

SEQ ID NO: 4207379 - DNA, 21 bp, Homo sapiens
aattgatagcaggtgtaataa

SEQ ID NO: 4207380 - DNA, 14 bp, Homo sapiens
aattgctttgccaa

SEQ ID NO: 4207381 - DNA, 16 bp, Homo sapiens
aattgctttgccaaaa

SEQ ID NO: 4207382 - DNA, 13 bp, Homo sapiens
aattggctcctcc

SEQ ID NO: 4207383 - DNA, 16 bp, Homo sapiens
aattgggaagctgggg

SEQ ID NO: 4207384 - DNA, 16 bp, Homo sapiens
aattgtagatggaaat

SEQ ID NO: 4207385 - DNA, 19 bp, Homo sapiens
aattgtagatggaaatcag

SEQ ID NO: 4207386 - DNA, 23 bp, Homo sapiens
aattgtatagagatatgcagaag

SEQ ID NO: 4207387 - DNA, 22 bp, Homo sapiens
aattgtatttttgtatgtggca

SEQ ID NO: 4207388 - DNA, 15 bp, Homo sapiens
aatttaagggctcag

SEQ ID NO: 4207389 - DNA, 17 bp, Homo sapiens
aatttagaaatcatttt

SEQ ID NO: 4207390 - DNA, 21 bp, Homo sapiens
aatttagaaatcattttgcaa

SEQ ID NO: 4207391 - DNA, 17 bp, Homo sapiens
aatttatatttgaaatt

SEQ ID NO: 4207392 - DNA, 18 bp, Homo sapiens
aatttattagttaatata

SEQ ID NO: 4207393 - DNA, 15 bp, Homo sapiens
aatttattgtctgtc

SEQ ID NO: 4207394 - DNA, 19 bp, Homo sapiens
aatttattgtctgtctaca

SEQ ID NO: 4207395 - DNA, 17 bp, Homo sapiens
aatttatttagttttta

SEQ ID NO: 4207396 - DNA, 13 bp, Homo sapiens
aatttcaaataga

SEQ ID NO: 4207397 - DNA, 21 bp, Homo sapiens
aatttcctggccctccactcc

SEQ ID NO: 4207398 - DNA, 21 bp, Homo sapiens
aatttcctttatatttagtga

SEQ ID NO: 4207399 - DNA, 14 bp, Homo sapiens
aatttctattgtgt

SEQ ID NO: 4207400 - DNA, 17 bp, Homo sapiens
aatttctattgtgtttc

SEQ ID NO: 4207401 - DNA, 19 bp, Homo sapiens
aatttctttttttaaattg

SEQ ID NO: 4207402 - DNA, 18 bp, Homo sapiens
aatttgaaaataattgtt

SEQ ID NO: 4207403 - DNA, 19 bp, Homo sapiens
aatttgaaaataattgttc

SEQ ID NO: 4207404 - DNA, 19 bp, Homo sapiens
aatttgtatctgaaggaga

SEQ ID NO: 4207405 - DNA, 12 bp, Homo sapiens
aatttgtatttt

SEQ ID NO: 4207406 - DNA, 13 bp, Homo sapiens
acaacaacaataa

SEQ ID NO: 4207407 - DNA, 17 bp, Homo sapiens
acaacaacaataacaac

SEQ ID NO: 4207408 - DNA, 17 bp, Homo sapiens
acaacaatacaacaaga

SEQ ID NO: 4207409 - DNA, 19 bp, Homo sapiens
acaacagaagcttcagaag

SEQ ID NO: 4207410 - DNA, 12 bp, Homo sapiens
acaacagtaaca

SEQ ID NO: 4207411 - DNA, 14 bp, Homo sapiens
acaacagtaacaca

SEQ ID NO: 4207412 - DNA, 23 bp, Homo sapiens
acaacatttatttcaaactattg

SEQ ID NO: 4207413 - DNA, 20 bp, Homo sapiens
acaacatttctatagccaaa

SEQ ID NO: 4207414 - DNA, 21 bp, Homo sapiens
acaaccacctaatcaggctga

SEQ ID NO: 4207415 - DNA, 17 bp, Homo sapiens
acaaccctgttttatac

SEQ ID NO: 4207416 - DNA, 15 bp, Homo sapiens
acaacctgcccctcc

SEQ ID NO: 4207417 - DNA, 16 bp, Homo sapiens
acaacctgcccctccc

SEQ ID NO: 4207418 - DNA, 18 bp, Homo sapiens
acaacctggccagaggca

SEQ ID NO: 4207419 - DNA, 20 bp, Homo sapiens
acaactattttcagatgtga

SEQ ID NO: 4207420 - DNA, 13 bp, Homo sapiens
acaactcagtctg

SEQ ID NO: 4207421 - DNA, 16 bp, Homo sapiens
acaactggcaggcagg

SEQ ID NO: 4207422 - DNA, 16 bp, Homo sapiens
acaacttgtgttctat

SEQ ID NO: 4207423 - DNA, 17 bp, Homo sapiens
acaacttgtgttctatt

SEQ ID NO: 4207424 - DNA, 11 bp, Homo sapiens
acaagaacaac

SEQ ID NO: 4207425 - DNA, 18 bp, Homo sapiens
acaagaagcattttgtaa

SEQ ID NO: 4207426 - DNA, 13 bp, Homo sapiens
acaagaagctgct

SEQ ID NO: 4207427 - DNA, 19 bp, Homo sapiens
acaagaccctgtctcaaaa

SEQ ID NO: 4207428 - DNA, 14 bp, Homo sapiens
acaagatctttcag

SEQ ID NO: 4207429 - DNA, 22 bp, Homo sapiens
acaagatggaaaataaattata

SEQ ID NO: 4207430 - DNA, 22 bp, Homo sapiens
acaagcaacataaaacaatgaa

SEQ ID NO: 4207431 - DNA, 13 bp, Homo sapiens
acaagcctgagaa

SEQ ID NO: 4207432 - DNA, 20 bp, Homo sapiens
acaagccttactcacctctc

SEQ ID NO: 4207433 - DNA, 18 bp, Homo sapiens
acaagctggaagcacatg

SEQ ID NO: 4207434 - DNA, 18 bp, Homo sapiens
acaaggttcttctaaaat

SEQ ID NO: 4207435 - DNA, 14 bp, Homo sapiens
acaagtatttgtta

SEQ ID NO: 4207436 - DNA, 22 bp, Homo sapiens
acaagtatttgttaatttagaa

SEQ ID NO: 4207437 - DNA, 16 bp, Homo sapiens
acaagtcctgtgaatt

SEQ ID NO: 4207438 - DNA, 17 bp, Homo sapiens
acaagtcctgtgaattt

SEQ ID NO: 4207439 - DNA, 15 bp, Homo sapiens
acaataacaacaatg

SEQ ID NO: 4207440 - DNA, 18 bp, Homo sapiens
acaataatatttcaagtg

SEQ ID NO: 4207441 - DNA, 22 bp, Homo sapiens
acaataatatttcaagtgccta

SEQ ID NO: 4207442 - DNA, 15 bp, Homo sapiens
acaatacaacaagaa

SEQ ID NO: 4207443 - DNA, 21 bp, Homo sapiens
acaatattaattataataaag

SEQ ID NO: 4207444 - DNA, 20 bp, Homo sapiens
acaatcatgagtcagacatt

SEQ ID NO: 4207445 - DNA, 14 bp, Homo sapiens
acaatcctgaagaa

SEQ ID NO: 4207446 - DNA, 20 bp, Homo sapiens
acaatcctgaagaaaccaca

SEQ ID NO: 4207447 - DNA, 18 bp, Homo sapiens
acaatctaacaataatat

SEQ ID NO: 4207448 - DNA, 22 bp, Homo sapiens
acaatctaacaataatatttca

SEQ ID NO: 4207449 - DNA, 21 bp, Homo sapiens
acaatgaaggaaaacctcact

SEQ ID NO: 4207450 - DNA, 20 bp, Homo sapiens
acaatgatcctgtattcaga

SEQ ID NO: 4207451 - DNA, 23 bp, Homo sapiens
acaatggagtgggagatcagcca

SEQ ID NO: 4207452 - DNA, 22 bp, Homo sapiens
acaatggtttacatgaacacag

SEQ ID NO: 4207453 - DNA, 18 bp, Homo sapiens
acaattattgtacactaa

SEQ ID NO: 4207454 - DNA, 14 bp, Homo sapiens
acaattctaaaatg

SEQ ID NO: 4207455 - DNA, 23 bp, Homo sapiens
acaattctaaaatgattgtagta

SEQ ID NO: 4207456 - DNA, 13 bp, Homo sapiens
acaattttaaata

SEQ ID NO: 4207457 - DNA, 14 bp, Homo sapiens
acaattttaaataa

SEQ ID NO: 4207458 - DNA, 15 bp, Homo sapiens
acacaaagacatgga

SEQ ID NO: 4207459 - DNA, 18 bp, Homo sapiens
acacaaagacatggaagg

SEQ ID NO: 4207460 - DNA, 16 bp, Homo sapiens
acacaagtcctgtgaa

SEQ ID NO: 4207461 - DNA, 21 bp, Homo sapiens
acacacgcaggaactcccagc

SEQ ID NO: 4207462 - DNA, 23 bp, Homo sapiens
acacacgtatttatatttggaaa

SEQ ID NO: 4207463 - DNA, 19 bp, Homo sapiens
acacactcagcagccccct

SEQ ID NO: 4207464 - DNA, 14 bp, Homo sapiens
acacagaagtccct

SEQ ID NO: 4207465 - DNA, 22 bp, Homo sapiens
acacagaagtccctaggaggga

SEQ ID NO: 4207466 - DNA, 23 bp, Homo sapiens
acacagatttcggtcataaagaa

SEQ ID NO: 4207467 - DNA, 24 bp, Homo sapiens
acacaggatcctattctcaccagg

SEQ ID NO: 4207468 - DNA, 16 bp, Homo sapiens
acacagtctgttttct

SEQ ID NO: 4207469 - DNA, 20 bp, Homo sapiens
acacagtgggtggtggatct

SEQ ID NO: 4207470 - DNA, 23 bp, Homo sapiens
acacagtgttccagctgcctggg

SEQ ID NO: 4207471 - DNA, 15 bp, Homo sapiens
acacatggacacaga

SEQ ID NO: 4207472 - DNA, 21 bp, Homo sapiens
acacatggacacagacccaca

SEQ ID NO: 4207473 - DNA, 21 bp, Homo sapiens
acaccaatcagagagcctaga

SEQ ID NO: 4207474 - DNA, 16 bp, Homo sapiens
acaccactgcactcca

SEQ ID NO: 4207475 - DNA, 21 bp, Homo sapiens
acaccagagtgtagaataata

SEQ ID NO: 4207476 - DNA, 15 bp, Homo sapiens
acaccaggactttaa

SEQ ID NO: 4207477 - DNA, 18 bp, Homo sapiens
acaccaggactttaatct

SEQ ID NO: 4207478 - DNA, 22 bp, Homo sapiens
acaccaggatagagactggaac

SEQ ID NO: 4207479 - DNA, 16 bp, Homo sapiens
acacccatgtaaatgt

SEQ ID NO: 4207480 - DNA, 21 bp, Homo sapiens
acaccccatgcacctcagggc

SEQ ID NO: 4207481 - DNA, 20 bp, Homo sapiens
acaccccttatccaggactc

SEQ ID NO: 4207482 - DNA, 18 bp, Homo sapiens
acacccttggacttgagg

SEQ ID NO: 4207483 - DNA, 17 bp, Homo sapiens
acacctgacaaatggaa

SEQ ID NO: 4207484 - DNA, 12 bp, Homo sapiens
acacctgccctg

SEQ ID NO: 4207485 - DNA, 14 bp, Homo sapiens
acacctgccctgcc

SEQ ID NO: 4207486 - DNA, 21 bp, Homo sapiens
acacctttgttttgcactgac

SEQ ID NO: 4207487 - DNA, 17 bp, Homo sapiens
acacggggtattttagg

SEQ ID NO: 4207488 - DNA, 21 bp, Homo sapiens
acacgtatttatatttggaaa

SEQ ID NO: 4207489 - DNA, 15 bp, Homo sapiens
acactaatgaagata

SEQ ID NO: 4207490 - DNA, 17 bp, Homo sapiens
acactaattcctttcta

SEQ ID NO: 4207491 - DNA, 13 bp, Homo sapiens
acactcatccctg

SEQ ID NO: 4207492 - DNA, 15 bp, Homo sapiens
acactcatccctggt

SEQ ID NO: 4207493 - DNA, 19 bp, Homo sapiens
acactccaccccctccagc

SEQ ID NO: 4207494 - DNA, 15 bp, Homo sapiens
acactctctgtacaa

SEQ ID NO: 4207495 - DNA, 16 bp, Homo sapiens
acactgcagggctgct

SEQ ID NO: 4207496 - DNA, 22 bp, Homo sapiens
acactgcctatatatgtaaata

SEQ ID NO: 4207497 - DNA, 13 bp, Homo sapiens
acactggccttcc

SEQ ID NO: 4207498 - DNA, 14 bp, Homo sapiens
tctcccctgccctg

SEQ ID NO: 4207499 - DNA, 12 bp, Homo sapiens
tctccctccagg

SEQ ID NO: 4207500 - DNA, 20 bp, Homo sapiens
tctccctgccaagtctcaga

SEQ ID NO: 4207501 - DNA, 23 bp, Homo sapiens
tctccctgccaagtctcagaaga

SEQ ID NO: 4207502 - DNA, 19 bp, Homo sapiens
tctcctaccccacctcatg

SEQ ID NO: 4207503 - DNA, 19 bp, Homo sapiens
tctcctcccagcgtgtgta

SEQ ID NO: 4207504 - DNA, 21 bp, Homo sapiens
tctcctcccatggccttccct

SEQ ID NO: 4207505 - DNA, 17 bp, Homo sapiens
tctccttccctctttcc

SEQ ID NO: 4207506 - DNA, 15 bp, Homo sapiens
tctccttcttccctg

SEQ ID NO: 4207507 - DNA, 17 bp, Homo sapiens
tctcggaaggctggctg

SEQ ID NO: 4207508 - DNA, 15 bp, Homo sapiens
tctcggcccttgccg

SEQ ID NO: 4207509 - DNA, 17 bp, Homo sapiens
tctcgtggtagaagcca

SEQ ID NO: 4207510 - DNA, 16 bp, Homo sapiens
tctctaactcctgcca

SEQ ID NO: 4207511 - DNA, 18 bp, Homo sapiens
tctctacccggcccagag

SEQ ID NO: 4207512 - DNA, 21 bp, Homo sapiens
tctctactcctacctcagcct

SEQ ID NO: 4207513 - DNA, 13 bp, Homo sapiens
tctctccagagag

SEQ ID NO: 4207514 - DNA, 13 bp, Homo sapiens
tctctccttccct

SEQ ID NO: 4207515 - DNA, 19 bp, Homo sapiens
tctctccttcttccctgtt

SEQ ID NO: 4207516 - DNA, 22 bp, Homo sapiens
tctctctactcctacctcagcc

SEQ ID NO: 4207517 - DNA, 16 bp, Homo sapiens
tctctgaaacatattt

SEQ ID NO: 4207518 - DNA, 16 bp, Homo sapiens
tctctgctccagagag

SEQ ID NO: 4207519 - DNA, 14 bp, Homo sapiens
tctctgctgagcag

SEQ ID NO: 4207520 - DNA, 19 bp, Homo sapiens
tctctgctgagcagcccag

SEQ ID NO: 4207521 - DNA, 16 bp, Homo sapiens
tctctggctccagaat

SEQ ID NO: 4207522 - DNA, 19 bp, Homo sapiens
tctctgtaaccgcttctgg

SEQ ID NO: 4207523 - DNA, 18 bp, Homo sapiens
tctctgtacaaaaacaaa

SEQ ID NO: 4207524 - DNA, 21 bp, Homo sapiens
tctgaaatataggtttaattt

SEQ ID NO: 4207525 - DNA, 17 bp, Homo sapiens
tctgaaccactttgcct

SEQ ID NO: 4207526 - DNA, 13 bp, Homo sapiens
tctgaactgttac

SEQ ID NO: 4207527 - DNA, 18 bp, Homo sapiens
tctgaactgttacaactt

SEQ ID NO: 4207528 - DNA, 15 bp, Homo sapiens
tctgaagtaatttgt

SEQ ID NO: 4207529 - DNA, 23 bp, Homo sapiens
tctgaagtaatttgtaaaaaaga

SEQ ID NO: 4207530 - DNA, 19 bp, Homo sapiens
tctgacaagataaaggaag

SEQ ID NO: 4207531 - DNA, 15 bp, Homo sapiens
tctgacctgcaggcc

SEQ ID NO: 4207532 - DNA, 11 bp, Homo sapiens
tctgagaagac

SEQ ID NO: 4207533 - DNA, 21 bp, Homo sapiens
tctgagatctccctccaggga

SEQ ID NO: 4207534 - DNA, 14 bp, Homo sapiens
tctgagatgtgttc

SEQ ID NO: 4207535 - DNA, 16 bp, Homo sapiens
tctgagcaccccctca

SEQ ID NO: 4207536 - DNA, 22 bp, Homo sapiens
tctgagcaccccctcattcccc

SEQ ID NO: 4207537 - DNA, 17 bp, Homo sapiens
tctgaggccccaggccc

SEQ ID NO: 4207538 - DNA, 13 bp, Homo sapiens
tctgagtcagagg

SEQ ID NO: 4207539 - DNA, 16 bp, Homo sapiens
tctgagtcagaggaca

SEQ ID NO: 4207540 - DNA, 15 bp, Homo sapiens
tctgatcaaggcctt

SEQ ID NO: 4207541 - DNA, 18 bp, Homo sapiens
tctgatgtttgttgctag

SEQ ID NO: 4207542 - DNA, 17 bp, Homo sapiens
tctgattggctcaccca

SEQ ID NO: 4207543 - DNA, 13 bp, Homo sapiens
tctgatttcagga

SEQ ID NO: 4207544 - DNA, 16 bp, Homo sapiens
tctgatttttcctttc

SEQ ID NO: 4207545 - DNA, 12 bp, Homo sapiens
tctgcaaaaaga

SEQ ID NO: 4207546 - DNA, 21 bp, Homo sapiens
tctgcaaaaagatttaacaaa

SEQ ID NO: 4207547 - DNA, 18 bp, Homo sapiens
tctgcaaagaatgagaag

SEQ ID NO: 4207548 - DNA, 13 bp, Homo sapiens
tctgcacccaggg

SEQ ID NO: 4207549 - DNA, 15 bp, Homo sapiens
tctgcacccaggggt

SEQ ID NO: 4207550 - DNA, 18 bp, Homo sapiens
tctgcagaatgggccact

SEQ ID NO: 4207551 - DNA, 17 bp, Homo sapiens
tctgcagagtggtgaag

SEQ ID NO: 4207552 - DNA, 14 bp, Homo sapiens
tctgcagcaactcc

SEQ ID NO: 4207553 - DNA, 16 bp, Homo sapiens
tctgcagcaactccca

SEQ ID NO: 4207554 - DNA, 17 bp, Homo sapiens
tctgcagcaactcccac

SEQ ID NO: 4207555 - DNA, 22 bp, Homo sapiens
tctgcaggcaccttagtggctt

SEQ ID NO: 4207556 - DNA, 13 bp, Homo sapiens
tctgcagggagca

SEQ ID NO: 4207557 - DNA, 13 bp, Homo sapiens
tctgcatgccctc

SEQ ID NO: 4207558 - DNA, 23 bp, Homo sapiens
tctgccacagagagtcctttggg

SEQ ID NO: 4207559 - DNA, 21 bp, Homo sapiens
tggaggggtgacagtggagga

SEQ ID NO: 4207560 - DNA, 18 bp, Homo sapiens
tggaggttgcagtgagct

SEQ ID NO: 4207561 - DNA, 16 bp, Homo sapiens
tggagtataatattca

SEQ ID NO: 4207562 - DNA, 13 bp, Homo sapiens
tggagtgggagat

SEQ ID NO: 4207563 - DNA, 16 bp, Homo sapiens
tggatactatatgata

SEQ ID NO: 4207564 - DNA, 14 bp, Homo sapiens
tggatctccaagga

SEQ ID NO: 4207565 - DNA, 18 bp, Homo sapiens
tggatctccaaggaccag

SEQ ID NO: 4207566 - DNA, 20 bp, Homo sapiens
tggatgaccagaacaaggtt

SEQ ID NO: 4207567 - DNA, 17 bp, Homo sapiens
tggatggcccagcaggc

SEQ ID NO: 4207568 - DNA, 22 bp, Homo sapiens
tggattatagagtatactaaaa

SEQ ID NO: 4207569 - DNA, 12 bp, Homo sapiens
tggattccagag

SEQ ID NO: 4207570 - DNA, 18 bp, Homo sapiens
tggattccccatctcagg

SEQ ID NO: 4207571 - DNA, 24 bp, Homo sapiens
tggatttgatgagttaactgtgaa

SEQ ID NO: 4207572 - DNA, 17 bp, Homo sapiens
tggcaaaaatggctaga

SEQ ID NO: 4207573 - DNA, 16 bp, Homo sapiens
tggcaaatgagtgaca

SEQ ID NO: 4207574 - DNA, 15 bp, Homo sapiens
tggcaagaaagctgg

SEQ ID NO: 4207575 - DNA, 21 bp, Homo sapiens
tggcaatttcctggccctcca

SEQ ID NO: 4207576 - DNA, 21 bp, Homo sapiens
tggcaccactagggtcctggc

SEQ ID NO: 4207577 - DNA, 12 bp, Homo sapiens
tggcaccatcca

SEQ ID NO: 4207578 - DNA, 13 bp, Homo sapiens
tggcaccatccac

SEQ ID NO: 4207579 - DNA, 14 bp, Homo sapiens
tggcagagcacagc

SEQ ID NO: 4207580 - DNA, 18 bp, Homo sapiens
tggcagcagttccatgaa

SEQ ID NO: 4207581 - DNA, 22 bp, Homo sapiens
tggcagcagttccatgaagaca

SEQ ID NO: 4207582 - DNA, 22 bp, Homo sapiens
tggcagcatgaattccaactca

SEQ ID NO: 4207583 - DNA, 20 bp, Homo sapiens
tggcagcattcagaacttca

SEQ ID NO: 4207584 - DNA, 12 bp, Homo sapiens
tggcagccctgt

SEQ ID NO: 4207585 - DNA, 18 bp, Homo sapiens
tggcagctgtcattcagg

SEQ ID NO: 4207586 - DNA, 17 bp, Homo sapiens
tggcaggaccaggacta

SEQ ID NO: 4207587 - DNA, 21 bp, Homo sapiens
tggcagtattccatgggatgt

SEQ ID NO: 4207588 - DNA, 20 bp, Homo sapiens
tggcagtgctgattcagcct

SEQ ID NO: 4207589 - DNA, 21 bp, Homo sapiens
tggcagtggaaaaatcagaag

SEQ ID NO: 4207590 - DNA, 16 bp, Homo sapiens
tggcagtttatattta

SEQ ID NO: 4207591 - DNA, 13 bp, Homo sapiens
tggcatgagaaat

SEQ ID NO: 4207592 - DNA, 17 bp, Homo sapiens
tggcattggtctgctga

SEQ ID NO: 4207593 - DNA, 21 bp, Homo sapiens
tggccactgaattagccaaaa

SEQ ID NO: 4207594 - DNA, 21 bp, Homo sapiens
tggccaggaagctttggtgag

SEQ ID NO: 4207595 - DNA, 20 bp, Homo sapiens
tggccaggctggtctcgaac

SEQ ID NO: 4207596 - DNA, 16 bp, Homo sapiens
tggcccagcaggcagg

SEQ ID NO: 4207597 - DNA, 20 bp, Homo sapiens
tggcccagcaggcaggcact

SEQ ID NO: 4207598 - DNA, 14 bp, Homo sapiens
tggcccagccagcc

SEQ ID NO: 4207599 - DNA, 16 bp, Homo sapiens
tggcccccctccaggc

SEQ ID NO: 4207600 - DNA, 17 bp, Homo sapiens
tggcccccctccaggca

SEQ ID NO: 4207601 - DNA, 15 bp, Homo sapiens
tggccctccactcct

SEQ ID NO: 4207602 - DNA, 13 bp, Homo sapiens
tggccctcttctt

SEQ ID NO: 4207603 - DNA, 19 bp, Homo sapiens
tggcccttcccactggagg

SEQ ID NO: 4207604 - DNA, 22 bp, Homo sapiens
tggcctcccaataaagctggac

SEQ ID NO: 4207605 - DNA, 18 bp, Homo sapiens
tggcctcctgggggccca

SEQ ID NO: 4207606 - DNA, 20 bp, Homo sapiens
tggcctcctgggggcccatt

SEQ ID NO: 4207607 - DNA, 11 bp, Homo sapiens
tggccttccct

SEQ ID NO: 4207608 - DNA, 16 bp, Homo sapiens
tggcgactgcagctgc

SEQ ID NO: 4207609 - DNA, 23 bp, Homo sapiens
tggcgctgagggtttttctaagt

SEQ ID NO: 4207610 - DNA, 17 bp, Homo sapiens
tggctaggaaagggaag

SEQ ID NO: 4207611 - DNA, 20 bp, Homo sapiens
tggctaggaaagggaagcct

SEQ ID NO: 4207612 - DNA, 15 bp, Homo sapiens
tggctcacccaagca

SEQ ID NO: 4207613 - DNA, 18 bp, Homo sapiens
tggctcctttgcctctgc

SEQ ID NO: 4207614 - DNA, 19 bp, Homo sapiens
tggctcctttgcctctgct

SEQ ID NO: 4207615 - DNA, 20 bp, Homo sapiens
tggctcctttgcctctgcta

SEQ ID NO: 4207616 - DNA, 23 bp, Homo sapiens
tggctcctttgcctctgctactg

SEQ ID NO: 4207617 - DNA, 21 bp, Homo sapiens
tggctctgttatgcaagcaca

SEQ ID NO: 4207618 - DNA, 16 bp, Homo sapiens
tggctgacctgggccc

SEQ ID NO: 4207619 - DNA, 14 bp, Homo sapiens
tggctgataatttt

SEQ ID NO: 4207620 - DNA, 19 bp, Homo sapiens
tggctggatgaaattttct

SEQ ID NO: 4207621 - DNA, 22 bp, Homo sapiens
tggctggatgaaattttctaga

SEQ ID NO: 4207622 - DNA, 17 bp, Homo sapiens
tggctggcccgtcatgt

SEQ ID NO: 4207623 - DNA, 12 bp, Homo sapiens
tggctgggcatg

SEQ ID NO: 4207624 - DNA, 23 bp, Homo sapiens
tggcttaaaaacttccatcccta

SEQ ID NO: 4207625 - DNA, 21 bp, Homo sapiens
tggcttattttttaaaataat

SEQ ID NO: 4207626 - DNA, 14 bp, Homo sapiens
tggcttccaggtat

SEQ ID NO: 4207627 - DNA, 21 bp, Homo sapiens
tggcttccaggtatctccagg

SEQ ID NO: 4207628 - DNA, 22 bp, Homo sapiens
tggcttccaggtatctccagga

SEQ ID NO: 4207629 - DNA, 15 bp, Homo sapiens
tggcttcctcactcc

SEQ ID NO: 4207630 - DNA, 16 bp, Homo sapiens
tggcttctggccagga

SEQ ID NO: 4207631 - DNA, 17 bp, Homo sapiens
tggcttctggccaggaa

SEQ ID NO: 4207632 - DNA, 18 bp, Homo sapiens
tggcttctggccaggaag

SEQ ID NO: 4207633 - DNA, 16 bp, Homo sapiens
tggcttgggcagcatc

SEQ ID NO: 4207634 - DNA, 21 bp, Homo sapiens
tggctttcccggactgcaagc

SEQ ID NO: 4207635 - DNA, 16 bp, Homo sapiens
tggctttggtccccag

SEQ ID NO: 4207636 - DNA, 15 bp, Homo sapiens
tggctttttaacatg

SEQ ID NO: 4207637 - DNA, 21 bp, Homo sapiens
tggctttttgtgcttggcaaa

SEQ ID NO: 4207638 - DNA, 20 bp, Homo sapiens
tgggaaaagtgttattattt

SEQ ID NO: 4207639 - DNA, 17 bp, Homo sapiens
tgggaactggttcaaga

SEQ ID NO: 4207640 - DNA, 16 bp, Homo sapiens
tgggaagagaagggaa

SEQ ID NO: 4207641 - DNA, 22 bp, Homo sapiens
tgggaatcctgctgccagagaa

SEQ ID NO: 4207642 - DNA, 22 bp, Homo sapiens
tgggaattctttacaataaaca

SEQ ID NO: 4207643 - DNA, 12 bp, Homo sapiens
tgggacacacat

SEQ ID NO: 4207644 - DNA, 23 bp, Homo sapiens
tgggaccctccagtgctggattt

SEQ ID NO: 4207645 - DNA, 19 bp, Homo sapiens
tgggacctgaatgacctgc

SEQ ID NO: 4207646 - DNA, 17 bp, Homo sapiens
tgggactgtgcctttgg

SEQ ID NO: 4207647 - DNA, 14 bp, Homo sapiens
tgggacttctaccc

SEQ ID NO: 4207648 - DNA, 16 bp, Homo sapiens
tgggacttctacccag

SEQ ID NO: 4207649 - DNA, 23 bp, Homo sapiens
tgggacttctacccagatggaaa

SEQ ID NO: 4207650 - DNA, 15 bp, Homo sapiens
tgggagagcctggca

SEQ ID NO: 4207651 - DNA, 12 bp, Homo sapiens
tgggagctcagc

SEQ ID NO: 4207652 - DNA, 11 bp, Homo sapiens
tgggaggaagc

SEQ ID NO: 4207653 - DNA, 13 bp, Homo sapiens
tgggaggaagcag

SEQ ID NO: 4207654 - DNA, 14 bp, Homo sapiens
tgggaggctgaggc

SEQ ID NO: 4207655 - DNA, 21 bp, Homo sapiens
tgggaggggatggcagacagt

SEQ ID NO: 4207656 - DNA, 20 bp, Homo sapiens
tgggatataagaggcagcgt

SEQ ID NO: 4207657 - DNA, 13 bp, Homo sapiens
tgggatcagcctc

SEQ ID NO: 4207658 - DNA, 20 bp, Homo sapiens
tgggatgttaagcaaaggaa

SEQ ID NO: 4207659 - DNA, 18 bp, Homo sapiens
tgggcaagtggatggccc

SEQ ID NO: 4207660 - DNA, 15 bp, Homo sapiens
tgggcagaagggaga

SEQ ID NO: 4207661 - DNA, 19 bp, Homo sapiens
tgggcagaagggagaagga

SEQ ID NO: 4207662 - DNA, 21 bp, Homo sapiens
tgggccactctcccctccctc

SEQ ID NO: 4207663 - DNA, 20 bp, Homo sapiens
tgggcccacagagcctggct

SEQ ID NO: 4207664 - DNA, 21 bp, Homo sapiens
tgggcccacagagcctggctt

SEQ ID NO: 4207665 - DNA, 12 bp, Homo sapiens
tgggccctgcaa

SEQ ID NO: 4207666 - DNA, 17 bp, Homo sapiens
tgggctccctggcccag

SEQ ID NO: 4207667 - DNA, 19 bp, Homo sapiens
tgggctctgccccagctct

SEQ ID NO: 4207668 - DNA, 20 bp, Homo sapiens
tgggctctgccccagctctg

SEQ ID NO: 4207669 - DNA, 21 bp, Homo sapiens
tgggctctgccccagctctgg

SEQ ID NO: 4207670 - DNA, 16 bp, Homo sapiens
tgggctgagccctggc

SEQ ID NO: 4207671 - DNA, 17 bp, Homo sapiens
tgggctgagccctggca

SEQ ID NO: 4207672 - DNA, 21 bp, Homo sapiens
tgggctggcccagccaactgc

SEQ ID NO: 4207673 - DNA, 12 bp, Homo sapiens
tggggacactaa

SEQ ID NO: 4207674 - DNA, 22 bp, Homo sapiens
tggggacataaagcctctgact

SEQ ID NO: 4207675 - DNA, 23 bp, Homo sapiens
tggggacataaagcctctgactc

SEQ ID NO: 4207676 - DNA, 16 bp, Homo sapiens
tggggagggggaagag

SEQ ID NO: 4207677 - DNA, 22 bp, Homo sapiens
tggggagggggaagagaaattt

SEQ ID NO: 4207678 - DNA, 16 bp, Homo sapiens
tggggagttataaaaa

SEQ ID NO: 4207679 - DNA, 16 bp, Homo sapiens
tggggcaaagcctcct

SEQ ID NO: 4207680 - DNA, 19 bp, Homo sapiens
tggggcaagtccctgactc

SEQ ID NO: 4207681 - DNA, 17 bp, Homo sapiens
tggggcaggctggctgg

SEQ ID NO: 4207682 - DNA, 12 bp, Homo sapiens
tggggccttggt

SEQ ID NO: 4207683 - DNA, 15 bp, Homo sapiens
tggggctctgtgcag

SEQ ID NO: 4207684 - DNA, 17 bp, Homo sapiens
tggggctctgtgcaggg

SEQ ID NO: 4207685 - DNA, 15 bp, Homo sapiens
tggggctgccagcct

SEQ ID NO: 4207686 - DNA, 19 bp, Homo sapiens
tggggctgccagcctgagc

SEQ ID NO: 4207687 - DNA, 17 bp, Homo sapiens
tggggctgggcctgagc

SEQ ID NO: 4207688 - DNA, 13 bp, Homo sapiens
tggggcttgccct

SEQ ID NO: 4207689 - DNA, 11 bp, Homo sapiens
tgggggctgct

SEQ ID NO: 4207690 - DNA, 16 bp, Homo sapiens
tgggggctgctgcact

SEQ ID NO: 4207691 - DNA, 20 bp, Homo sapiens
tggggtacaggtttggggag

SEQ ID NO: 4207692 - DNA, 14 bp, Homo sapiens
tggggtagactgag

SEQ ID NO: 4207693 - DNA, 19 bp, Homo sapiens
tggggtatggattctaaaa

SEQ ID NO: 4207694 - DNA, 20 bp, Homo sapiens
tggggtcttgctatattgcc

SEQ ID NO: 4207695 - DNA, 14 bp, Homo sapiens
tggggttgcccagc

SEQ ID NO: 4207696 - DNA, 16 bp, Homo sapiens
tgggtatttcctgcta

SEQ ID NO: 4207697 - DNA, 22 bp, Homo sapiens
tgggtcctgcaatctccagggc

SEQ ID NO: 4207698 - DNA, 17 bp, Homo sapiens
tgccatttctgaactgt

SEQ ID NO: 4207699 - DNA, 21 bp, Homo sapiens
tgccatttgcaccctccgcct

SEQ ID NO: 4207700 - DNA, 22 bp, Homo sapiens
tgccatttgcaccctccgcctt

SEQ ID NO: 4207701 - DNA, 20 bp, Homo sapiens
tgcccaaatccttagatctg

SEQ ID NO: 4207702 - DNA, 17 bp, Homo sapiens
tgcccactgtctctcct

SEQ ID NO: 4207703 - DNA, 23 bp, Homo sapiens
tgcccagagggcccaggcaggcc

SEQ ID NO: 4207704 - DNA, 20 bp, Homo sapiens
tgcccagcctggagcggagc

SEQ ID NO: 4207705 - DNA, 20 bp, Homo sapiens
tgcccaggctggtcttgaac

SEQ ID NO: 4207706 - DNA, 12 bp, Homo sapiens
tgcccagtctgg

SEQ ID NO: 4207707 - DNA, 23 bp, Homo sapiens
tgcccagtctggaagaagaggag

SEQ ID NO: 4207708 - DNA, 18 bp, Homo sapiens
tgcccagtggtttccctt

SEQ ID NO: 4207709 - DNA, 22 bp, Homo sapiens
tgcccagtggtttccctttgct

SEQ ID NO: 4207710 - DNA, 13 bp, Homo sapiens
tgccccagctctg

SEQ ID NO: 4207711 - DNA, 22 bp, Homo sapiens
tgccccatctcctcccatggcc

SEQ ID NO: 4207712 - DNA, 14 bp, Homo sapiens
tgccccccatgccc

SEQ ID NO: 4207713 - DNA, 17 bp, Homo sapiens
tgccccccatgccctcc

SEQ ID NO: 4207714 - DNA, 19 bp, Homo sapiens
tgccccccatgccctccct

SEQ ID NO: 4207715 - DNA, 20 bp, Homo sapiens
tgccccccatgccctccctg

SEQ ID NO: 4207716 - DNA, 12 bp, Homo sapiens
tgccccctggtg

SEQ ID NO: 4207717 - DNA, 14 bp, Homo sapiens
tgcccgcagagccc

SEQ ID NO: 4207718 - DNA, 22 bp, Homo sapiens
tgcccggattctgggaggaagc

SEQ ID NO: 4207719 - DNA, 20 bp, Homo sapiens
tgccctccctgctgccaggc

SEQ ID NO: 4207720 - DNA, 17 bp, Homo sapiens
tgccctgccacctgtct

SEQ ID NO: 4207721 - DNA, 13 bp, Homo sapiens
tgccctgccttca

SEQ ID NO: 4207722 - DNA, 23 bp, Homo sapiens
tgccctgcgaagtggctctcagg

SEQ ID NO: 4207723 - DNA, 21 bp, Homo sapiens
tgccctgctgccgcctcccag

SEQ ID NO: 4207724 - DNA, 13 bp, Homo sapiens
tgccctggaggga

SEQ ID NO: 4207725 - DNA, 23 bp, Homo sapiens
tgccctgggtcacctagctggtt

SEQ ID NO: 4207726 - DNA, 22 bp, Homo sapiens
tgcccttctgattcccctccac

SEQ ID NO: 4207727 - DNA, 16 bp, Homo sapiens
tgccgagagaggcgcg

SEQ ID NO: 4207728 - DNA, 23 bp, Homo sapiens
tgccgagagaggcgcgtctgccc

SEQ ID NO: 4207729 - DNA, 18 bp, Homo sapiens
tgccgccgtctctgtccc

SEQ ID NO: 4207730 - DNA, 14 bp, Homo sapiens
tgccgcctcccagc

SEQ ID NO: 4207731 - DNA, 18 bp, Homo sapiens
tgccgcctcccagcctgg

SEQ ID NO: 4207732 - DNA, 18 bp, Homo sapiens
tgccgggcgtggtggcac

SEQ ID NO: 4207733 - DNA, 20 bp, Homo sapiens
tgccgtctaggattgggcct

SEQ ID NO: 4207734 - DNA, 14 bp, Homo sapiens
tgcctaattcctgg

SEQ ID NO: 4207735 - DNA, 19 bp, Homo sapiens
tgcctagactgttactttg

SEQ ID NO: 4207736 - DNA, 21 bp, Homo sapiens
tgcctaggcgattttgtctac

SEQ ID NO: 4207737 - DNA, 13 bp, Homo sapiens
tgcctcaagaaca

SEQ ID NO: 4207738 - DNA, 18 bp, Homo sapiens
tgcctcaatgtgaccagg

SEQ ID NO: 4207739 - DNA, 23 bp, Homo sapiens
tgcctcaatgtgaccaggggtga

SEQ ID NO: 4207740 - DNA, 15 bp, Homo sapiens
tgcctctctgctcca

SEQ ID NO: 4207741 - DNA, 16 bp, Homo sapiens
tgcctctctgctccag

SEQ ID NO: 4207742 - DNA, 13 bp, Homo sapiens
tgcctctgaaact

SEQ ID NO: 4207743 - DNA, 22 bp, Homo sapiens
tgcctctgctactgaggcaggg

SEQ ID NO: 4207744 - DNA, 14 bp, Homo sapiens
tgcctgcagagaga

SEQ ID NO: 4207745 - DNA, 15 bp, Homo sapiens
tgcctgcagccccgc

SEQ ID NO: 4207746 - DNA, 22 bp, Homo sapiens
tgcctgcagccccgcgcctcct

SEQ ID NO: 4207747 - DNA, 14 bp, Homo sapiens
tgcctgccctggag

SEQ ID NO: 4207748 - DNA, 17 bp, Homo sapiens
tgcctgcctgcctgtgg

SEQ ID NO: 4207749 - DNA, 19 bp, Homo sapiens
tgcctggcccccctccagg

SEQ ID NO: 4207750 - DNA, 16 bp, Homo sapiens
tgcctgggaatcctgc

SEQ ID NO: 4207751 - DNA, 19 bp, Homo sapiens
tgcctgggaatcctgctgc

SEQ ID NO: 4207752 - DNA, 19 bp, Homo sapiens
tgcctggtgcactgtgtct

SEQ ID NO: 4207753 - DNA, 16 bp, Homo sapiens
tgcctgtagctttcct

SEQ ID NO: 4207754 - DNA, 15 bp, Homo sapiens
tgcctgtagttagga

SEQ ID NO: 4207755 - DNA, 18 bp, Homo sapiens
tgcctgtagttaggaaat

SEQ ID NO: 4207756 - DNA, 16 bp, Homo sapiens
tgcctgtggagacagc

SEQ ID NO: 4207757 - DNA, 23 bp, Homo sapiens
tgcctgtggagacagccctgcct

SEQ ID NO: 4207758 - DNA, 14 bp, Homo sapiens
tgcctgtggtgagg

SEQ ID NO: 4207759 - DNA, 18 bp, Homo sapiens
tgccttaggctgctggga

SEQ ID NO: 4207760 - DNA, 16 bp, Homo sapiens
tgccttcctcgtgcag

SEQ ID NO: 4207761 - DNA, 20 bp, Homo sapiens
tgccttcctcgtgcagagct

SEQ ID NO: 4207762 - DNA, 20 bp, Homo sapiens
tgccttcgcggtggaaggcc

SEQ ID NO: 4207763 - DNA, 17 bp, Homo sapiens
tgccttctccctgggaa

SEQ ID NO: 4207764 - DNA, 17 bp, Homo sapiens
tgcctttaaggagaaga

SEQ ID NO: 4207765 - DNA, 21 bp, Homo sapiens
tgcctttctctggctccagaa

SEQ ID NO: 4207766 - DNA, 23 bp, Homo sapiens
tgccttttgctgctgctgctgcg

SEQ ID NO: 4207767 - DNA, 18 bp, Homo sapiens
tgcgaaggggccctggtc

SEQ ID NO: 4207768 - DNA, 16 bp, Homo sapiens
tgcgatcttcagagca

SEQ ID NO: 4207769 - DNA, 16 bp, Homo sapiens
tgcgggagctctgtat

SEQ ID NO: 4207770 - DNA, 17 bp, Homo sapiens
tgcgggggagctggaaa

SEQ ID NO: 4207771 - DNA, 20 bp, Homo sapiens
tgcgggggagctggaaataa

SEQ ID NO: 4207772 - DNA, 22 bp, Homo sapiens
tgcggtatacattttacatatg

SEQ ID NO: 4207773 - DNA, 23 bp, Homo sapiens
tgcggttcaggaaaattgaatgc

SEQ ID NO: 4207774 - DNA, 19 bp, Homo sapiens
tgcgtcagaccagtactgg

SEQ ID NO: 4207775 - DNA, 23 bp, Homo sapiens
tgcgtgactattttttaataaaa

SEQ ID NO: 4207776 - DNA, 13 bp, Homo sapiens
tgcgtgtcgtggg

SEQ ID NO: 4207777 - DNA, 14 bp, Homo sapiens
tgctacctctgaga

SEQ ID NO: 4207778 - DNA, 15 bp, Homo sapiens
tgctacctctgagaa

SEQ ID NO: 4207779 - DNA, 14 bp, Homo sapiens
tcttataacttctg

SEQ ID NO: 4207780 - DNA, 18 bp, Homo sapiens
tcttataacttctgaagt

SEQ ID NO: 4207781 - DNA, 22 bp, Homo sapiens
tcttattcatgctttctccttt

SEQ ID NO: 4207782 - DNA, 11 bp, Homo sapiens
tcttatttgct

SEQ ID NO: 4207783 - DNA, 16 bp, Homo sapiens
tcttcactcagccaca

SEQ ID NO: 4207784 - DNA, 13 bp, Homo sapiens
tcttcatactttt

SEQ ID NO: 4207785 - DNA, 22 bp, Homo sapiens
tcttcatactttttttcacagt

SEQ ID NO: 4207786 - DNA, 13 bp, Homo sapiens
tcttcatcttgac

SEQ ID NO: 4207787 - DNA, 18 bp, Homo sapiens
tcttccagtgcaacaaaa

SEQ ID NO: 4207788 - DNA, 14 bp, Homo sapiens
tcttccccactccc

SEQ ID NO: 4207789 - DNA, 20 bp, Homo sapiens
tcttcccccacccctaacct

SEQ ID NO: 4207790 - DNA, 22 bp, Homo sapiens
tcttcccccacccctaacctgg

SEQ ID NO: 4207791 - DNA, 23 bp, Homo sapiens
tcttcccccacccctaacctggc

SEQ ID NO: 4207792 - DNA, 15 bp, Homo sapiens
tcttccctccttccc

SEQ ID NO: 4207793 - DNA, 13 bp, Homo sapiens
tcttccttccccc

SEQ ID NO: 4207794 - DNA, 15 bp, Homo sapiens
tcttccttcccccat

SEQ ID NO: 4207795 - DNA, 15 bp, Homo sapiens
tcttccttctttctc

SEQ ID NO: 4207796 - DNA, 18 bp, Homo sapiens
tcttccttctttctcttc

SEQ ID NO: 4207797 - DNA, 22 bp, Homo sapiens
tcttctaaaattgaagagattt

SEQ ID NO: 4207798 - DNA, 18 bp, Homo sapiens
tcttctggactggttttc

SEQ ID NO: 4207799 - DNA, 16 bp, Homo sapiens
tcttcttcagaagaca

SEQ ID NO: 4207800 - DNA, 15 bp, Homo sapiens
tcttgaaacagcctg

SEQ ID NO: 4207801 - DNA, 15 bp, Homo sapiens
tcttgacatgtaatg

SEQ ID NO: 4207802 - DNA, 18 bp, Homo sapiens
tcttgagtactagaattt

SEQ ID NO: 4207803 - DNA, 18 bp, Homo sapiens
tcttgagtagatctgctt

SEQ ID NO: 4207804 - DNA, 23 bp, Homo sapiens
tcttgcaggaaggactatgaaaa

SEQ ID NO: 4207805 - DNA, 21 bp, Homo sapiens
tcttgccagcattttcacatt

SEQ ID NO: 4207806 - DNA, 14 bp, Homo sapiens
tcttgctttgctgt

SEQ ID NO: 4207807 - DNA, 16 bp, Homo sapiens
tcttggaagtgtgtgg

SEQ ID NO: 4207808 - DNA, 22 bp, Homo sapiens
tcttggaagtgtgtggaaggca

SEQ ID NO: 4207809 - DNA, 13 bp, Homo sapiens
tcttggcctctgc

SEQ ID NO: 4207810 - DNA, 21 bp, Homo sapiens
tcttgggagggaatgggacag

SEQ ID NO: 4207811 - DNA, 21 bp, Homo sapiens
tcttgggatgagaatgaaagc

SEQ ID NO: 4207812 - DNA, 11 bp, Homo sapiens
tcttgtcagaa

SEQ ID NO: 4207813 - DNA, 20 bp, Homo sapiens
tcttgtcagaattggcctca

SEQ ID NO: 4207814 - DNA, 22 bp, Homo sapiens
tcttgtccatgtggttcttcaa

SEQ ID NO: 4207815 - DNA, 23 bp, Homo sapiens
tcttgtccatgtggttcttcaaa

SEQ ID NO: 4207816 - DNA, 13 bp, Homo sapiens
tcttgtgtcctga

SEQ ID NO: 4207817 - DNA, 14 bp, Homo sapiens
tctttaacctcatc

SEQ ID NO: 4207818 - DNA, 15 bp, Homo sapiens
tctttaagtattgtt

SEQ ID NO: 4207819 - DNA, 13 bp, Homo sapiens
tctttacaataaa

SEQ ID NO: 4207820 - DNA, 19 bp, Homo sapiens
tctttactggtgatttctg

SEQ ID NO: 4207821 - DNA, 20 bp, Homo sapiens
tctttactggtgatttctga

SEQ ID NO: 4207822 - DNA, 21 bp, Homo sapiens
tctttactggtgatttctgag

SEQ ID NO: 4207823 - DNA, 14 bp, Homo sapiens
tctttatgcttgca

SEQ ID NO: 4207824 - DNA, 15 bp, Homo sapiens
tctttatgcttgcaa

SEQ ID NO: 4207825 - DNA, 20 bp, Homo sapiens
tctttcaggggggttgtgag

SEQ ID NO: 4207826 - DNA, 19 bp, Homo sapiens
tctttccccacctcttcct

SEQ ID NO: 4207827 - DNA, 11 bp, Homo sapiens
tctttcctgtc

SEQ ID NO: 4207828 - DNA, 18 bp, Homo sapiens
tctttctcactaaatctt

SEQ ID NO: 4207829 - DNA, 21 bp, Homo sapiens
tctttctctccttcttccctg

SEQ ID NO: 4207830 - DNA, 22 bp, Homo sapiens
tctttcttttgattcttcctaa

SEQ ID NO: 4207831 - DNA, 17 bp, Homo sapiens
tctttgaagttatttag

SEQ ID NO: 4207832 - DNA, 13 bp, Homo sapiens
tctttgactgaaa

SEQ ID NO: 4207833 - DNA, 12 bp, Homo sapiens
tctttgcctggt

SEQ ID NO: 4207834 - DNA, 14 bp, Homo sapiens
tcttttataggatt

SEQ ID NO: 4207835 - DNA, 22 bp, Homo sapiens
tcttttctccctagaaacaaag

SEQ ID NO: 4207836 - DNA, 18 bp, Homo sapiens
tctttttgtgtgtgccaa

SEQ ID NO: 4207837 - DNA, 20 bp, Homo sapiens
tgaaaaaaaaaaagaagaag

SEQ ID NO: 4207838 - DNA, 24 bp, Homo sapiens
tgaaaaaaatatatgattgtataa

SEQ ID NO: 4207839 - DNA, 17 bp, Homo sapiens
tgaaaaacacggcagct

SEQ ID NO: 4207840 - DNA, 19 bp, Homo sapiens
tgaaaactcattacttttc

SEQ ID NO: 4207841 - DNA, 19 bp, Homo sapiens
tgaaaaggtttatgaaaaa

SEQ ID NO: 4207842 - DNA, 15 bp, Homo sapiens
tgaaaattattttaa

SEQ ID NO: 4207843 - DNA, 19 bp, Homo sapiens
tgaaaattattttaaacaa

SEQ ID NO: 4207844 - DNA, 21 bp, Homo sapiens
tgaaaattattttaaacaaaa

SEQ ID NO: 4207845 - DNA, 20 bp, Homo sapiens
tgaaacaattattgtacact

SEQ ID NO: 4207846 - DNA, 12 bp, Homo sapiens
tgaaacagaaaa

SEQ ID NO: 4207847 - DNA, 23 bp, Homo sapiens
tgaaacagaaaaatatgtaccaa

SEQ ID NO: 4207848 - DNA, 13 bp, Homo sapiens
tgaaacagcctgg

SEQ ID NO: 4207849 - DNA, 11 bp, Homo sapiens
tgaaacattca

SEQ ID NO: 4207850 - DNA, 20 bp, Homo sapiens
tgaaacccattaggcatgcc

SEQ ID NO: 4207851 - DNA, 21 bp, Homo sapiens
tgaaacccattaggcatgcct

SEQ ID NO: 4207852 - DNA, 17 bp, Homo sapiens
tgaaacttaattacatc

SEQ ID NO: 4207853 - DNA, 15 bp, Homo sapiens
tgaaacttcataaat

SEQ ID NO: 4207854 - DNA, 17 bp, Homo sapiens
tgaaagaatatctaatt

SEQ ID NO: 4207855 - DNA, 18 bp, Homo sapiens
tgaaagtaaaaaataact

SEQ ID NO: 4207856 - DNA, 13 bp, Homo sapiens
tgaaataaaatgc

SEQ ID NO: 4207857 - DNA, 13 bp, Homo sapiens
tgaaataattaaa

SEQ ID NO: 4207858 - DNA, 18 bp, Homo sapiens
tgaaataattaaaaacca

SEQ ID NO: 4207859 - DNA, 19 bp, Homo sapiens
tgaaataattaaaaaccac

SEQ ID NO: 4207860 - DNA, 17 bp, Homo sapiens
tgaaatgacagaatgct

SEQ ID NO: 4207861 - DNA, 20 bp, Homo sapiens
tgaaatttattagttaatat

SEQ ID NO: 4207862 - DNA, 21 bp, Homo sapiens
tgaaatttattagttaatata

SEQ ID NO: 4207863 - DNA, 19 bp, Homo sapiens
tgaaattttctagactttc

SEQ ID NO: 4207864 - DNA, 13 bp, Homo sapiens
tgaacaattctct

SEQ ID NO: 4207865 - DNA, 16 bp, Homo sapiens
tgaacacactcagcag

SEQ ID NO: 4207866 - DNA, 16 bp, Homo sapiens
tgaacacagctgctga

SEQ ID NO: 4207867 - DNA, 13 bp, Homo sapiens
tgaacagaacata

SEQ ID NO: 4207868 - DNA, 21 bp, Homo sapiens
tgaacagagagaaccaggagg

SEQ ID NO: 4207869 - DNA, 22 bp, Homo sapiens
tgaacagagagaaccaggaggg

SEQ ID NO: 4207870 - DNA, 17 bp, Homo sapiens
tgaacatctcactttgc

SEQ ID NO: 4207871 - DNA, 16 bp, Homo sapiens
tgaaccactttgcctc

SEQ ID NO: 4207872 - DNA, 17 bp, Homo sapiens
tgaaccattaaccagat

SEQ ID NO: 4207873 - DNA, 13 bp, Homo sapiens
tgaacccctgtgt

SEQ ID NO: 4207874 - DNA, 14 bp, Homo sapiens
tgaacccctgtgtc

SEQ ID NO: 4207875 - DNA, 15 bp, Homo sapiens
tgaactcttcactct

SEQ ID NO: 4207876 - DNA, 12 bp, Homo sapiens
tgaactggaaga

SEQ ID NO: 4207877 - DNA, 14 bp, Homo sapiens
tgaactggaagaaa

SEQ ID NO: 4207878 - DNA, 16 bp, Homo sapiens
tgaactggaagaaagc

SEQ ID NO: 4207879 - DNA, 22 bp, Homo sapiens
tgaactgttacaacttgtattt

SEQ ID NO: 4207880 - DNA, 21 bp, Homo sapiens
tgaacttgaaatatcctgctt

SEQ ID NO: 4207881 - DNA, 18 bp, Homo sapiens
tgaacttgaggacacatg

SEQ ID NO: 4207882 - DNA, 19 bp, Homo sapiens
tgaacttgaggacacatgt

SEQ ID NO: 4207883 - DNA, 20 bp, Homo sapiens
tgaacttgaggacacatgtc

SEQ ID NO: 4207884 - DNA, 11 bp, Homo sapiens
tgaactttctc

SEQ ID NO: 4207885 - DNA, 14 bp, Homo sapiens
tgaagaaaccacag

SEQ ID NO: 4207886 - DNA, 19 bp, Homo sapiens
tgaagaatacttctcattt

SEQ ID NO: 4207887 - DNA, 21 bp, Homo sapiens
tgaagaatacttctcattttt

SEQ ID NO: 4207888 - DNA, 18 bp, Homo sapiens
tgaagaggcaagagacag

SEQ ID NO: 4207889 - DNA, 19 bp, Homo sapiens
tgaagaggcaagagacaga

SEQ ID NO: 4207890 - DNA, 20 bp, Homo sapiens
tgaagaggcaagagacagaa

SEQ ID NO: 4207891 - DNA, 21 bp, Homo sapiens
tgaagaggcaagagacagaat

SEQ ID NO: 4207892 - DNA, 22 bp, Homo sapiens
tgaagatgaaaggagtaagaaa

SEQ ID NO: 4207893 - DNA, 19 bp, Homo sapiens
tgaagccactgaagctggg

SEQ ID NO: 4207894 - DNA, 16 bp, Homo sapiens
tgaagccagtatttct

SEQ ID NO: 4207895 - DNA, 20 bp, Homo sapiens
tgaaggaataggcaaaatgt

SEQ ID NO: 4207896 - DNA, 22 bp, Homo sapiens
tgaaggcccaggtcaacatcta

SEQ ID NO: 4207897 - DNA, 19 bp, Homo sapiens
tgaagtaatttgtaaaaaa

SEQ ID NO: 4207898 - DNA, 15 bp, Homo sapiens
tgaagtagtttgtat

SEQ ID NO: 4207899 - DNA, 17 bp, Homo sapiens
tgaagtattttatttgt

SEQ ID NO: 4207900 - DNA, 18 bp, Homo sapiens
tgaagtattttatttgtc

SEQ ID NO: 4207901 - DNA, 21 bp, Homo sapiens
tgaagtcattgtcgctcagca

SEQ ID NO: 4207902 - DNA, 20 bp, Homo sapiens
tgaagtgttttgttctttct

SEQ ID NO: 4207903 - DNA, 18 bp, Homo sapiens
tgaagttagctttaactt

SEQ ID NO: 4207904 - DNA, 18 bp, Homo sapiens
tgaagttttatacactgg

SEQ ID NO: 4207905 - DNA, 17 bp, Homo sapiens
tgaataagtattcttca

SEQ ID NO: 4207906 - DNA, 23 bp, Homo sapiens
tgaataattttctggcactggtt

SEQ ID NO: 4207907 - DNA, 15 bp, Homo sapiens
tgaataggaaaatgt

SEQ ID NO: 4207908 - DNA, 16 bp, Homo sapiens
tgaataggaaaatgta

SEQ ID NO: 4207909 - DNA, 19 bp, Homo sapiens
tgaataggaaaatgtacat

SEQ ID NO: 4207910 - DNA, 19 bp, Homo sapiens
tgaatatttcaaaataaac

SEQ ID NO: 4207911 - DNA, 16 bp, Homo sapiens
tgaatctcttaattct

SEQ ID NO: 4207912 - DNA, 13 bp, Homo sapiens
tgatattaaagga

SEQ ID NO: 4207913 - DNA, 23 bp, Homo sapiens
tgatattaaaggagttaagagta

SEQ ID NO: 4207914 - DNA, 12 bp, Homo sapiens
tgatcaatgaaa

SEQ ID NO: 4207915 - DNA, 13 bp, Homo sapiens
tgatcacactctg

SEQ ID NO: 4207916 - DNA, 22 bp, Homo sapiens
tgatcactttgttaaaaatatt

SEQ ID NO: 4207917 - DNA, 17 bp, Homo sapiens
tgatcataattaaactg

SEQ ID NO: 4207918 - DNA, 22 bp, Homo sapiens
tgatcattacatggctgtggtt

SEQ ID NO: 4207919 - DNA, 16 bp, Homo sapiens
tgatgaaaataataaa

SEQ ID NO: 4207920 - DNA, 14 bp, Homo sapiens
tgatgaaacattca

SEQ ID NO: 4207921 - DNA, 14 bp, Homo sapiens
tgatgaactttctc

SEQ ID NO: 4207922 - DNA, 15 bp, Homo sapiens
tgatgaactttctct

SEQ ID NO: 4207923 - DNA, 15 bp, Homo sapiens
tgatgacagagcgag

SEQ ID NO: 4207924 - DNA, 19 bp, Homo sapiens
tgatgagttaactgtgaaa

SEQ ID NO: 4207925 - DNA, 16 bp, Homo sapiens
tgatgatgatgatgat

SEQ ID NO: 4207926 - DNA, 16 bp, Homo sapiens
tgatgattaatacaat

SEQ ID NO: 4207927 - DNA, 13 bp, Homo sapiens
tgatggagaagga

SEQ ID NO: 4207928 - DNA, 15 bp, Homo sapiens
tgatggtgctgacct

SEQ ID NO: 4207929 - DNA, 12 bp, Homo sapiens
tgatgtcagcct

SEQ ID NO: 4207930 - DNA, 13 bp, Homo sapiens
tgatgttaaaaaa

SEQ ID NO: 4207931 - DNA, 16 bp, Homo sapiens
tgatgttatagaatta

SEQ ID NO: 4207932 - DNA, 16 bp, Homo sapiens
tgatgttgtgttgtta

SEQ ID NO: 4207933 - DNA, 13 bp, Homo sapiens
tgattacctgcca

SEQ ID NO: 4207934 - DNA, 15 bp, Homo sapiens
tgattcaagaaacag

SEQ ID NO: 4207935 - DNA, 16 bp, Homo sapiens
tgattcaagaaacaga

SEQ ID NO: 4207936 - DNA, 23 bp, Homo sapiens
tgattctcctgtcagagatctgg

SEQ ID NO: 4207937 - DNA, 14 bp, Homo sapiens
tgattctgaatctg

SEQ ID NO: 4207938 - DNA, 17 bp, Homo sapiens
tgattctgaatctgaaa

SEQ ID NO: 4207939 - DNA, 12 bp, Homo sapiens
tgattgtaaaat

SEQ ID NO: 4207940 - DNA, 14 bp, Homo sapiens
tgattgtaaaatag

SEQ ID NO: 4207941 - DNA, 17 bp, Homo sapiens
tgattgtaaaatagctt

SEQ ID NO: 4207942 - DNA, 17 bp, Homo sapiens
tgattgtataatgtgat

SEQ ID NO: 4207943 - DNA, 19 bp, Homo sapiens
tgattgtataatgtgattt

SEQ ID NO: 4207944 - DNA, 16 bp, Homo sapiens
tgatttatagtttgta

SEQ ID NO: 4207945 - DNA, 13 bp, Homo sapiens
tgatttatgcatg

SEQ ID NO: 4207946 - DNA, 19 bp, Homo sapiens
tgatttcaggatactctgt

SEQ ID NO: 4207947 - DNA, 19 bp, Homo sapiens
tgatttggaagagaggcac

SEQ ID NO: 4207948 - DNA, 22 bp, Homo sapiens
tgatttggaagagaggcacctg

SEQ ID NO: 4207949 - DNA, 21 bp, Homo sapiens
tgattttaagatagaacaggc

SEQ ID NO: 4207950 - DNA, 19 bp, Homo sapiens
tgcaaaaactacaaccaat

SEQ ID NO: 4207951 - DNA, 21 bp, Homo sapiens
tgcaaaaagatttaacaaata

SEQ ID NO: 4207952 - DNA, 19 bp, Homo sapiens
tgcaaaaatgagttttcac

SEQ ID NO: 4207953 - DNA, 17 bp, Homo sapiens
tgcaaacctcagaggga

SEQ ID NO: 4207954 - DNA, 17 bp, Homo sapiens
tgcaaactttattttca

SEQ ID NO: 4207955 - DNA, 14 bp, Homo sapiens
tgcaaattaacagt

SEQ ID NO: 4207956 - DNA, 22 bp, Homo sapiens
tgcaagacacaggctcagcatg

SEQ ID NO: 4207957 - DNA, 18 bp, Homo sapiens
tgcaagtcatacttagga

SEQ ID NO: 4207958 - DNA, 15 bp, Homo sapiens
tgcaattgcttagga

SEQ ID NO: 4207959 - DNA, 18 bp, Homo sapiens
tgcaatttattaaaatga

SEQ ID NO: 4207960 - DNA, 18 bp, Homo sapiens
tgcacactgttggaatgt

SEQ ID NO: 4207961 - DNA, 19 bp, Homo sapiens
tgcacacttgtatattgaa

SEQ ID NO: 4207962 - DNA, 14 bp, Homo sapiens
tgcacagcgcgggc

SEQ ID NO: 4207963 - DNA, 20 bp, Homo sapiens
tgcacagcgcgggcggaggc

SEQ ID NO: 4207964 - DNA, 15 bp, Homo sapiens
tgcacctaaagaaaa

SEQ ID NO: 4207965 - DNA, 16 bp, Homo sapiens
tgcacctaaagaaaaa

SEQ ID NO: 4207966 - DNA, 13 bp, Homo sapiens
tgcacctcagggc

SEQ ID NO: 4207967 - DNA, 19 bp, Homo sapiens
tgcacctgccagcctggct

SEQ ID NO: 4207968 - DNA, 20 bp, Homo sapiens
tgcacctgccagcctggctt

SEQ ID NO: 4207969 - DNA, 14 bp, Homo sapiens
tgcacctgcttctc

SEQ ID NO: 4207970 - DNA, 15 bp, Homo sapiens
tgcacctgcttctca

SEQ ID NO: 4207971 - DNA, 17 bp, Homo sapiens
tgcacctgtactcagga

SEQ ID NO: 4207972 - DNA, 20 bp, Homo sapiens
tgcacctgtactcaggaggc

SEQ ID NO: 4207973 - DNA, 20 bp, Homo sapiens
tgcaccttaccaactttctg

SEQ ID NO: 4207974 - DNA, 22 bp, Homo sapiens
tgcactaaaacccatcttcccc

SEQ ID NO: 4207975 - DNA, 11 bp, Homo sapiens
tgcactccaga

SEQ ID NO: 4207976 - DNA, 13 bp, Homo sapiens
tgcactccagaat

SEQ ID NO: 4207977 - DNA, 16 bp, Homo sapiens
tgcactccagcctggg

SEQ ID NO: 4207978 - DNA, 13 bp, Homo sapiens
tgcactgacaaga

SEQ ID NO: 4207979 - DNA, 15 bp, Homo sapiens
tgcactgacaagatg

SEQ ID NO: 4207980 - DNA, 17 bp, Homo sapiens
tgcactgccctccgccc

SEQ ID NO: 4207981 - DNA, 15 bp, Homo sapiens
tgcactgggtgtggc

SEQ ID NO: 4207982 - DNA, 16 bp, Homo sapiens
tgcactgtatgctgga

SEQ ID NO: 4207983 - DNA, 22 bp, Homo sapiens
tgcactgtcccggagctcaggc

SEQ ID NO: 4207984 - DNA, 12 bp, Homo sapiens
tgcagaaagccc

SEQ ID NO: 4207985 - DNA, 19 bp, Homo sapiens
tgcagaaagctttatatgt

SEQ ID NO: 4207986 - DNA, 13 bp, Homo sapiens
tgcagacactgtg

SEQ ID NO: 4207987 - DNA, 16 bp, Homo sapiens
tgcagacaggaatctt

SEQ ID NO: 4207988 - DNA, 14 bp, Homo sapiens
tgcagagctatggt

SEQ ID NO: 4207989 - DNA, 13 bp, Homo sapiens
tgcagaggggaaa

SEQ ID NO: 4207990 - DNA, 18 bp, Homo sapiens
ccacagtcctcacagcct

SEQ ID NO: 4207991 - DNA, 20 bp, Homo sapiens
ccacagttgctgctcctttg

SEQ ID NO: 4207992 - DNA, 22 bp, Homo sapiens
ccacatccacacacgcaggaac

SEQ ID NO: 4207993 - DNA, 17 bp, Homo sapiens
ccacatccctttgaaac

SEQ ID NO: 4207994 - DNA, 16 bp, Homo sapiens
ccacattgacagtggt

SEQ ID NO: 4207995 - DNA, 17 bp, Homo sapiens
ccacattggacttcctt

SEQ ID NO: 4207996 - DNA, 11 bp, Homo sapiens
ccaccaaggtc

SEQ ID NO: 4207997 - DNA, 17 bp, Homo sapiens
ccaccacaccgcagaag

SEQ ID NO: 4207998 - DNA, 17 bp, Homo sapiens
ccaccatgcccagtcga

SEQ ID NO: 4207999 - DNA, 18 bp, Homo sapiens
ccacccagcaacacagag

SEQ ID NO: 4208000 - DNA, 23 bp, Homo sapiens
ccacccagggctccctcctggag

SEQ ID NO: 4208001 - DNA, 15 bp, Homo sapiens
ccacccatggagagg

SEQ ID NO: 4208002 - DNA, 14 bp, Homo sapiens
ccaccccagagttg

SEQ ID NO: 4208003 - DNA, 16 bp, Homo sapiens
ccaccccagagttggg

SEQ ID NO: 4208004 - DNA, 22 bp, Homo sapiens
ccaccctcgtggacacctgccc

SEQ ID NO: 4208005 - DNA, 14 bp, Homo sapiens
ccaccctgcaggct

SEQ ID NO: 4208006 - DNA, 15 bp, Homo sapiens
ccaccgcagaaggaa

SEQ ID NO: 4208007 - DNA, 15 bp, Homo sapiens
ccacctccacccact

SEQ ID NO: 4208008 - DNA, 14 bp, Homo sapiens
ccacctctcaatat

SEQ ID NO: 4208009 - DNA, 14 bp, Homo sapiens
ccacctgcctatcc

SEQ ID NO: 4208010 - DNA, 16 bp, Homo sapiens
ccacctgcctatccat

SEQ ID NO: 4208011 - DNA, 12 bp, Homo sapiens
ccacctgtctgt

SEQ ID NO: 4208012 - DNA, 17 bp, Homo sapiens
ccaccttcaattcctgg

SEQ ID NO: 4208013 - DNA, 16 bp, Homo sapiens
ccaccttccccagact

SEQ ID NO: 4208014 - DNA, 19 bp, Homo sapiens
ccaccttggactcctccca

SEQ ID NO: 4208015 - DNA, 20 bp, Homo sapiens
ccaccttggactcctcccac

SEQ ID NO: 4208016 - DNA, 14 bp, Homo sapiens
ccacgcacacatgg

SEQ ID NO: 4208017 - DNA, 16 bp, Homo sapiens
ccacggggatcacagc

SEQ ID NO: 4208018 - DNA, 16 bp, Homo sapiens
ccacgtggtgtccctg

SEQ ID NO: 4208019 - DNA, 18 bp, Homo sapiens
ccacgtggtgtccctgcg

SEQ ID NO: 4208020 - DNA, 18 bp, Homo sapiens
ccactaagctttctcctt

SEQ ID NO: 4208021 - DNA, 19 bp, Homo sapiens
ccactaagctttctccttt

SEQ ID NO: 4208022 - DNA, 14 bp, Homo sapiens
ccactacactccag

SEQ ID NO: 4208023 - DNA, 14 bp, Homo sapiens
ccactacctttgtc

SEQ ID NO: 4208024 - DNA, 22 bp, Homo sapiens
ccactagggtcctggccctctt

SEQ ID NO: 4208025 - DNA, 20 bp, Homo sapiens
ccactcaggccaacaagcca

SEQ ID NO: 4208026 - DNA, 23 bp, Homo sapiens
ccactcgggaggctgagacagga

SEQ ID NO: 4208027 - DNA, 17 bp, Homo sapiens
ccactctatgagttgga

SEQ ID NO: 4208028 - DNA, 16 bp, Homo sapiens
ccactctcccctccct

SEQ ID NO: 4208029 - DNA, 13 bp, Homo sapiens
ccactgcactcca

SEQ ID NO: 4208030 - DNA, 18 bp, Homo sapiens
ccactgcactccagcctg

SEQ ID NO: 4208031 - DNA, 19 bp, Homo sapiens
ccactgcactccagcctgg

SEQ ID NO: 4208032 - DNA, 21 bp, Homo sapiens
ccactgcactccagcctgggc

SEQ ID NO: 4208033 - DNA, 14 bp, Homo sapiens
ccactgcccctgca

SEQ ID NO: 4208034 - DNA, 23 bp, Homo sapiens
ccactgcgggagctctgtatggt

SEQ ID NO: 4208035 - DNA, 21 bp, Homo sapiens
ccactggacttgagcttggca

SEQ ID NO: 4208036 - DNA, 22 bp, Homo sapiens
ccactggacttgagcttggcag

SEQ ID NO: 4208037 - DNA, 21 bp, Homo sapiens
ccactgtggccttctcagcct

SEQ ID NO: 4208038 - DNA, 22 bp, Homo sapiens
ccacttagttttgggaggggat

SEQ ID NO: 4208039 - DNA, 12 bp, Homo sapiens
ccacttcccctc

SEQ ID NO: 4208040 - DNA, 22 bp, Homo sapiens
ccacttctgcgatatttttcca

SEQ ID NO: 4208041 - DNA, 22 bp, Homo sapiens
ccacttgtcatccataaagcaa

SEQ ID NO: 4208042 - DNA, 19 bp, Homo sapiens
ccagaaaaaaaaaaactta

SEQ ID NO: 4208043 - DNA, 13 bp, Homo sapiens
ccagaaattagaa

SEQ ID NO: 4208044 - DNA, 22 bp, Homo sapiens
ccagaactgaggtcactgggtt

SEQ ID NO: 4208045 - DNA, 21 bp, Homo sapiens
ccagacccacctggagcccgc

SEQ ID NO: 4208046 - DNA, 16 bp, Homo sapiens
ccagagaccccttcct

SEQ ID NO: 4208047 - DNA, 17 bp, Homo sapiens
ccagagaccccttcctt

SEQ ID NO: 4208048 - DNA, 21 bp, Homo sapiens
ccagagaccccttcctttcct

SEQ ID NO: 4208049 - DNA, 23 bp, Homo sapiens
ccagagagcaaacataggaatat

SEQ ID NO: 4208050 - DNA, 16 bp, Homo sapiens
ccagagcactgctcca

SEQ ID NO: 4208051 - DNA, 21 bp, Homo sapiens
ccagagcattacgtgagccag

SEQ ID NO: 4208052 - DNA, 12 bp, Homo sapiens
ccagagccttca

SEQ ID NO: 4208053 - DNA, 22 bp, Homo sapiens
ccagaggccaggaatctgccat

SEQ ID NO: 4208054 - DNA, 15 bp, Homo sapiens
ccagagggcccaggc

SEQ ID NO: 4208055 - DNA, 22 bp, Homo sapiens
ccagaggttttaggaaacctgg

SEQ ID NO: 4208056 - DNA, 14 bp, Homo sapiens
ccagatcctcacaa

SEQ ID NO: 4208057 - DNA, 17 bp, Homo sapiens
ccagatgaagctttggc

SEQ ID NO: 4208058 - DNA, 19 bp, Homo sapiens
ccagatgaagctttggccc

SEQ ID NO: 4208059 - DNA, 16 bp, Homo sapiens
ccagatgattttcctc

SEQ ID NO: 4208060 - DNA, 21 bp, Homo sapiens
ccagatgattttcctccctgg

SEQ ID NO: 4208061 - DNA, 20 bp, Homo sapiens
ccagatgccttcctgtcttt

SEQ ID NO: 4208062 - DNA, 12 bp, Homo sapiens
taaaagaaaaag

SEQ ID NO: 4208063 - DNA, 14 bp, Homo sapiens
taaaagaaactttc

SEQ ID NO: 4208064 - DNA, 17 bp, Homo sapiens
taaaagaaactttcttt

SEQ ID NO: 4208065 - DNA, 12 bp, Homo sapiens
taaaagatgctt

SEQ ID NO: 4208066 - DNA, 12 bp, Homo sapiens
taaaagcaaaaa

SEQ ID NO: 4208067 - DNA, 11 bp, Homo sapiens
taaaagctaat

SEQ ID NO: 4208068 - DNA, 12 bp, Homo sapiens
taaaagctaatt

SEQ ID NO: 4208069 - DNA, 21 bp, Homo sapiens
taaaaggaaaaccagtgaagt

SEQ ID NO: 4208070 - DNA, 17 bp, Homo sapiens
taaaaggtgagctcagc

SEQ ID NO: 4208071 - DNA, 16 bp, Homo sapiens
taaaagttatatctaa

SEQ ID NO: 4208072 - DNA, 24 bp, Homo sapiens
taaaagttgggaaaagtgttatta

SEQ ID NO: 4208073 - DNA, 15 bp, Homo sapiens
taaaagtttttgtca

SEQ ID NO: 4208074 - DNA, 16 bp, Homo sapiens
taaaatagcaaaagaa

SEQ ID NO: 4208075 - DNA, 16 bp, Homo sapiens
taaaatatatttatga

SEQ ID NO: 4208076 - DNA, 22 bp, Homo sapiens
taaaatatatttatgataacta

SEQ ID NO: 4208077 - DNA, 19 bp, Homo sapiens
taaaatcaaagaaaacata

SEQ ID NO: 4208078 - DNA, 12 bp, Homo sapiens
taaaatgacagc

SEQ ID NO: 4208079 - DNA, 23 bp, Homo sapiens
taaaatgagtgatctcaaatcca

SEQ ID NO: 4208080 - DNA, 15 bp, Homo sapiens
taaaattgtaaaatt

SEQ ID NO: 4208081 - DNA, 16 bp, Homo sapiens
taaaattgttagtaaa

SEQ ID NO: 4208082 - DNA, 20 bp, Homo sapiens
taaaattttacttttgttct

SEQ ID NO: 4208083 - DNA, 23 bp, Homo sapiens
taaacaaaatagaagctgtagta

SEQ ID NO: 4208084 - DNA, 18 bp, Homo sapiens
taaacaagtatttgttaa

SEQ ID NO: 4208085 - DNA, 22 bp, Homo sapiens
taaacaatttctgcattcttaa

SEQ ID NO: 4208086 - DNA, 19 bp, Homo sapiens
taaacacttatcttctgga

SEQ ID NO: 4208087 - DNA, 20 bp, Homo sapiens
taaacacttatcttctggat

SEQ ID NO: 4208088 - DNA, 18 bp, Homo sapiens
taaacagctaataatgaa

SEQ ID NO: 4208089 - DNA, 15 bp, Homo sapiens
taaacatcattcatt

SEQ ID NO: 4208090 - DNA, 22 bp, Homo sapiens
taaacattaatcaatcatctgt

SEQ ID NO: 4208091 - DNA, 20 bp, Homo sapiens
taaacattggtatatttcca

SEQ ID NO: 4208092 - DNA, 18 bp, Homo sapiens
taaacccccgctccagat

SEQ ID NO: 4208093 - DNA, 18 bp, Homo sapiens
taaacctggagatgatga

SEQ ID NO: 4208094 - DNA, 15 bp, Homo sapiens
taaactataagcaag

SEQ ID NO: 4208095 - DNA, 22 bp, Homo sapiens
taaactggggagttataaaaat

SEQ ID NO: 4208096 - DNA, 14 bp, Homo sapiens
taaactgtacaaat

SEQ ID NO: 4208097 - DNA, 16 bp, Homo sapiens
taaactgtacaaatga

SEQ ID NO: 4208098 - DNA, 15 bp, Homo sapiens
taaacttagaataaa

SEQ ID NO: 4208099 - DNA, 22 bp, Homo sapiens
taaactttttttgtccttttaa

SEQ ID NO: 4208100 - DNA, 15 bp, Homo sapiens
taaagagaacaagag

SEQ ID NO: 4208101 - DNA, 21 bp, Homo sapiens
taaagataacccttattccat

SEQ ID NO: 4208102 - DNA, 16 bp, Homo sapiens
taaagattttttaata

SEQ ID NO: 4208103 - DNA, 17 bp, Homo sapiens
taaagattttttaataa

SEQ ID NO: 4208104 - DNA, 22 bp, Homo sapiens
taaagcacagtctgatgacaca

SEQ ID NO: 4208105 - DNA, 11 bp, Homo sapiens
taaagcaggga

SEQ ID NO: 4208106 - DNA, 15 bp, Homo sapiens
taaagccatgctgga

SEQ ID NO: 4208107 - DNA, 17 bp, Homo sapiens
taaagcctctgactcaa

SEQ ID NO: 4208108 - DNA, 11 bp, Homo sapiens
taaagcctttt

SEQ ID NO: 4208109 - DNA, 18 bp, Homo sapiens
taaagctgcctgtagtta

SEQ ID NO: 4208110 - DNA, 21 bp, Homo sapiens
taaagggcagaaggggaagat

SEQ ID NO: 4208111 - DNA, 22 bp, Homo sapiens
taaagtgtaaatcctttttctt

SEQ ID NO: 4208112 - DNA, 15 bp, Homo sapiens
taaagttcaacatgt

SEQ ID NO: 4208113 - DNA, 18 bp, Homo sapiens
taaagttcaacatgttat

SEQ ID NO: 4208114 - DNA, 21 bp, Homo sapiens
taaagttgttcacatatatgt

SEQ ID NO: 4208115 - DNA, 17 bp, Homo sapiens
taaagtttacagtaaat

SEQ ID NO: 4208116 - DNA, 19 bp, Homo sapiens
taaataaaaaattcaaacc

SEQ ID NO: 4208117 - DNA, 12 bp, Homo sapiens
taaataaattgt

SEQ ID NO: 4208118 - DNA, 13 bp, Homo sapiens
taaataaattgtt

SEQ ID NO: 4208119 - DNA, 13 bp, Homo sapiens
taaataagaaact

SEQ ID NO: 4208120 - DNA, 21 bp, Homo sapiens
taaatacctctggcttagaaa

SEQ ID NO: 4208121 - DNA, 22 bp, Homo sapiens
taaatagagttccaaataagga

SEQ ID NO: 4208122 - DNA, 16 bp, Homo sapiens
taaatagctatattta

SEQ ID NO: 4208123 - DNA, 18 bp, Homo sapiens
taaatatgtgaaaatgat

SEQ ID NO: 4208124 - DNA, 16 bp, Homo sapiens
taaatcacgctttttg

SEQ ID NO: 4208125 - DNA, 19 bp, Homo sapiens
taaatcacgctttttgaaa

SEQ ID NO: 4208126 - DNA, 22 bp, Homo sapiens
taaatcacgctttttgaaaaag

SEQ ID NO: 4208127 - DNA, 19 bp, Homo sapiens
taaatcctttttctttata

SEQ ID NO: 4208128 - DNA, 17 bp, Homo sapiens
taaatctagaaaattga

SEQ ID NO: 4208129 - DNA, 14 bp, Homo sapiens
taaatctctaatat

SEQ ID NO: 4208130 - DNA, 23 bp, Homo sapiens
taaatctgagatctccctccagg

SEQ ID NO: 4208131 - DNA, 19 bp, Homo sapiens
taaatcttttataggattt

SEQ ID NO: 4208132 - DNA, 23 bp, Homo sapiens
taaatcttttataggatttattt

SEQ ID NO: 4208133 - DNA, 17 bp, Homo sapiens
taaatgttaatgagaaa

SEQ ID NO: 4208134 - DNA, 13 bp, Homo sapiens
taaattatatatt

SEQ ID NO: 4208135 - DNA, 14 bp, Homo sapiens
taaattatatattt

SEQ ID NO: 4208136 - DNA, 23 bp, Homo sapiens
taaattattgaggggactaggct

SEQ ID NO: 4208137 - DNA, 14 bp, Homo sapiens
taaattccactgga

SEQ ID NO: 4208138 - DNA, 16 bp, Homo sapiens
taaattccactggact

SEQ ID NO: 4208139 - DNA, 18 bp, Homo sapiens
taaattccatatgctcca

SEQ ID NO: 4208140 - DNA, 12 bp, Homo sapiens
taaattgtttga

SEQ ID NO: 4208141 - DNA, 23 bp, Homo sapiens
taaatttaataaaaacttcagaa

SEQ ID NO: 4208142 - DNA, 16 bp, Homo sapiens
taaattttgaatgttt

SEQ ID NO: 4208143 - DNA, 17 bp, Homo sapiens
taaattttgtatgaaaa

SEQ ID NO: 4208144 - DNA, 13 bp, Homo sapiens
taacaaataaatt

SEQ ID NO: 4208145 - DNA, 14 bp, Homo sapiens
taacagctgaagta

SEQ ID NO: 4208146 - DNA, 17 bp, Homo sapiens
taacatatctttatctt

SEQ ID NO: 4208147 - DNA, 22 bp, Homo sapiens
taacatatttactaagccacaa

SEQ ID NO: 4208148 - DNA, 20 bp, Homo sapiens
taacatgaaaaacacggcag

SEQ ID NO: 4208149 - DNA, 23 bp, Homo sapiens
taacatgaaaaacacggcagctg

SEQ ID NO: 4208150 - DNA, 17 bp, Homo sapiens
taacattcacagcccag

SEQ ID NO: 4208151 - DNA, 22 bp, Homo sapiens
taaccactcctcaggaacagaa

SEQ ID NO: 4208152 - DNA, 15 bp, Homo sapiens
taaccagctgtaaca

SEQ ID NO: 4208153 - DNA, 22 bp, Homo sapiens
taaccatagttatttacttgaa

SEQ ID NO: 4208154 - DNA, 20 bp, Homo sapiens
taaccatgtaggttcttggg

SEQ ID NO: 4208155 - DNA, 18 bp, Homo sapiens
taacccccagtgccacag

SEQ ID NO: 4208156 - DNA, 21 bp, Homo sapiens
taacccccagtgccacagaga

SEQ ID NO: 4208157 - DNA, 23 bp, Homo sapiens
taacccccagtgccacagagaag

SEQ ID NO: 4208158 - DNA, 20 bp, Homo sapiens
taacctatatgatttatagt

SEQ ID NO: 4208159 - DNA, 20 bp, Homo sapiens
taacgtttaagccaaaacaa

SEQ ID NO: 4208160 - DNA, 20 bp, Homo sapiens
taactgggtaatgaaacaaa

SEQ ID NO: 4208161 - DNA, 14 bp, Homo sapiens
taacttaaatagta

SEQ ID NO: 4208162 - DNA, 16 bp, Homo sapiens
taacttaaatagtatt

SEQ ID NO: 4208163 - DNA, 13 bp, Homo sapiens
taacttctttgaa

SEQ ID NO: 4208164 - DNA, 24 bp, Homo sapiens
taactttgtggtaacttctttgaa

SEQ ID NO: 4208165 - DNA, 19 bp, Homo sapiens
taactttttaatcatctgg

SEQ ID NO: 4208166 - DNA, 12 bp, Homo sapiens
taagaaagacat

SEQ ID NO: 4208167 - DNA, 23 bp, Homo sapiens
taagaaattaaggcatttgttta

SEQ ID NO: 4208168 - DNA, 21 bp, Homo sapiens
taagaagaatgcttaatcaga

SEQ ID NO: 4208169 - DNA, 19 bp, Homo sapiens
taagaatcattgtgcttaa

SEQ ID NO: 4208170 - DNA, 13 bp, Homo sapiens
taagaatggaaga

SEQ ID NO: 4208171 - DNA, 14 bp, Homo sapiens
taagaatggaagaa

SEQ ID NO: 4208172 - DNA, 18 bp, Homo sapiens
taagactcattccctaga

SEQ ID NO: 4208173 - DNA, 22 bp, Homo sapiens
taagagaactttcggagcctgc

SEQ ID NO: 4208174 - DNA, 12 bp, Homo sapiens
taagagaagtag

SEQ ID NO: 4208175 - DNA, 21 bp, Homo sapiens
taagagctttatatattgatt

SEQ ID NO: 4208176 - DNA, 15 bp, Homo sapiens
taagaggcagcgtga

SEQ ID NO: 4208177 - DNA, 15 bp, Homo sapiens
taagatggagaataa

SEQ ID NO: 4208178 - DNA, 18 bp, Homo sapiens
taagatggagaataaatt

SEQ ID NO: 4208179 - DNA, 15 bp, Homo sapiens
taagattaaaggaag

SEQ ID NO: 4208180 - DNA, 16 bp, Homo sapiens
taagcaagtgagcaga

SEQ ID NO: 4208181 - DNA, 19 bp, Homo sapiens
taagcagagcagaactttt

SEQ ID NO: 4208182 - DNA, 15 bp, Homo sapiens
taagcctgttgagac

SEQ ID NO: 4208183 - DNA, 16 bp, Homo sapiens
taagcctgttgagact

SEQ ID NO: 4208184 - DNA, 23 bp, Homo sapiens
taagcgaatgtgtacaaagtgta

SEQ ID NO: 4208185 - DNA, 17 bp, Homo sapiens
taagctatttatgtaaa

SEQ ID NO: 4208186 - DNA, 12 bp, Homo sapiens
taagctgtaaaa

SEQ ID NO: 4208187 - DNA, 13 bp, Homo sapiens
taagctgtaaaaa

SEQ ID NO: 4208188 - DNA, 15 bp, Homo sapiens
taagctgtgtgcagg

SEQ ID NO: 4208189 - DNA, 16 bp, Homo sapiens
taagctttctcctttg

SEQ ID NO: 4208190 - DNA, 16 bp, Homo sapiens
taaggaaaaaataata

SEQ ID NO: 4208191 - DNA, 20 bp, Homo sapiens
taaggaaatcaacttgctta

SEQ ID NO: 4208192 - DNA, 19 bp, Homo sapiens
taaggatctctgaaacata

SEQ ID NO: 4208193 - DNA, 20 bp, Homo sapiens
taaggtaatttctgtgtatt

SEQ ID NO: 4208194 - DNA, 17 bp, Homo sapiens
taaggtcttcttgtgtc

SEQ ID NO: 4208195 - DNA, 20 bp, Homo sapiens
taagtagatagaaagcaata

SEQ ID NO: 4208196 - DNA, 16 bp, Homo sapiens
tcatataaagtatcat

SEQ ID NO: 4208197 - DNA, 11 bp, Homo sapiens
tcatatgaaaa

SEQ ID NO: 4208198 - DNA, 23 bp, Homo sapiens
tcatattttgtatatatctgctt

SEQ ID NO: 4208199 - DNA, 13 bp, Homo sapiens
tcatcactgtgcc

SEQ ID NO: 4208200 - DNA, 14 bp, Homo sapiens
tcatcactgtgcct

SEQ ID NO: 4208201 - DNA, 19 bp, Homo sapiens
tcatctacaagcatttgcc

SEQ ID NO: 4208202 - DNA, 17 bp, Homo sapiens
tcatctcaaatccttga

SEQ ID NO: 4208203 - DNA, 17 bp, Homo sapiens
tcatctgtgtgaaaatg

SEQ ID NO: 4208204 - DNA, 18 bp, Homo sapiens
tcatcttgacatgtaatg

SEQ ID NO: 4208205 - DNA, 12 bp, Homo sapiens
tcatcttttgaa

SEQ ID NO: 4208206 - DNA, 18 bp, Homo sapiens
tcatgacttttccatgta

SEQ ID NO: 4208207 - DNA, 13 bp, Homo sapiens
tcatgaggaaaga

SEQ ID NO: 4208208 - DNA, 18 bp, Homo sapiens
tcatgaggaaagacacag

SEQ ID NO: 4208209 - DNA, 14 bp, Homo sapiens
tcatgatttctgtg

SEQ ID NO: 4208210 - DNA, 15 bp, Homo sapiens
tcatgatttctgtga

SEQ ID NO: 4208211 - DNA, 22 bp, Homo sapiens
tcatgcttcttctcatggggtg

SEQ ID NO: 4208212 - DNA, 15 bp, Homo sapiens
tcatgctttctcctt

SEQ ID NO: 4208213 - DNA, 15 bp, Homo sapiens
tcatggcttagaaat

SEQ ID NO: 4208214 - DNA, 18 bp, Homo sapiens
tcatggtcctttctggaa

SEQ ID NO: 4208215 - DNA, 18 bp, Homo sapiens
tcattaaattggaatttt

SEQ ID NO: 4208216 - DNA, 15 bp, Homo sapiens
tcattaatgttcttt

SEQ ID NO: 4208217 - DNA, 23 bp, Homo sapiens
tcattattcgtagatattggaca

SEQ ID NO: 4208218 - DNA, 21 bp, Homo sapiens
tcattcgcctgtgggaagaga

SEQ ID NO: 4208219 - DNA, 18 bp, Homo sapiens
tcattgaaagtaaaaaat

SEQ ID NO: 4208220 - DNA, 11 bp, Homo sapiens
tcattgtctca

SEQ ID NO: 4208221 - DNA, 16 bp, Homo sapiens
tcattgtctcagtgct

SEQ ID NO: 4208222 - DNA, 17 bp, Homo sapiens
tcattgtgcttaataat

SEQ ID NO: 4208223 - DNA, 12 bp, Homo sapiens
tcatttaagatt

SEQ ID NO: 4208224 - DNA, 13 bp, Homo sapiens
tcatttattttgt

SEQ ID NO: 4208225 - DNA, 18 bp, Homo sapiens
tcatttctactgtgactg

SEQ ID NO: 4208226 - DNA, 16 bp, Homo sapiens
tcatttttttaacaca

SEQ ID NO: 4208227 - DNA, 18 bp, Homo sapiens
tcatttttttaacacata

SEQ ID NO: 4208228 - DNA, 20 bp, Homo sapiens
tccaaatgaatgttgtctgt

SEQ ID NO: 4208229 - DNA, 18 bp, Homo sapiens
tccaactgtgttcattag

SEQ ID NO: 4208230 - DNA, 15 bp, Homo sapiens
tccaacttggctgca

SEQ ID NO: 4208231 - DNA, 21 bp, Homo sapiens
tccaaggagttccatgaagac

SEQ ID NO: 4208232 - DNA, 16 bp, Homo sapiens
tccaagtccaacctgc

SEQ ID NO: 4208233 - DNA, 22 bp, Homo sapiens
tccaatcagagaataaacatca

SEQ ID NO: 4208234 - DNA, 19 bp, Homo sapiens
tccaatctgtaatttcact

SEQ ID NO: 4208235 - DNA, 19 bp, Homo sapiens
tccaatgaatgatcattga

SEQ ID NO: 4208236 - DNA, 16 bp, Homo sapiens
tccacaaagccgtgcc

SEQ ID NO: 4208237 - DNA, 19 bp, Homo sapiens
tccacacacgcaggaactc

SEQ ID NO: 4208238 - DNA, 12 bp, Homo sapiens
tccacccagcaa

SEQ ID NO: 4208239 - DNA, 19 bp, Homo sapiens
tccctgccaagtctcagaa

SEQ ID NO: 4208240 - DNA, 19 bp, Homo sapiens
tccctgcctttaaggagaa

SEQ ID NO: 4208241 - DNA, 19 bp, Homo sapiens
tccctggcccagccagcca

SEQ ID NO: 4208242 - DNA, 16 bp, Homo sapiens
tccctggctctcagaa

SEQ ID NO: 4208243 - DNA, 20 bp, Homo sapiens
tccctggctctcagaaggta

SEQ ID NO: 4208244 - DNA, 23 bp, Homo sapiens
tccctgggcaagtggatggccca

SEQ ID NO: 4208245 - DNA, 20 bp, Homo sapiens
tccctgtgctgacggaagcc

SEQ ID NO: 4208246 - DNA, 22 bp, Homo sapiens
tcccttagtaatcccccttgcc

SEQ ID NO: 4208247 - DNA, 23 bp, Homo sapiens
tcccttgctgacatggctttgct

SEQ ID NO: 4208248 - DNA, 19 bp, Homo sapiens
tcccttgtgtcaagacatt

SEQ ID NO: 4208249 - DNA, 15 bp, Homo sapiens
tcccttgtgtgtgtg

SEQ ID NO: 4208250 - DNA, 20 bp, Homo sapiens
tcccttttgcataagattaa

SEQ ID NO: 4208251 - DNA, 13 bp, Homo sapiens
tccgcccttccct

SEQ ID NO: 4208252 - DNA, 22 bp, Homo sapiens
tccgcgagggctactcagcagt

SEQ ID NO: 4208253 - DNA, 12 bp, Homo sapiens
tccgctcagcca

SEQ ID NO: 4208254 - DNA, 21 bp, Homo sapiens
tccgctcctttacctaccacc

SEQ ID NO: 4208255 - DNA, 19 bp, Homo sapiens
tccggaggggacccagctc

SEQ ID NO: 4208256 - DNA, 21 bp, Homo sapiens
tccggaggggacccagctcct

SEQ ID NO: 4208257 - DNA, 23 bp, Homo sapiens
tccggaggggttgcgggggagct

SEQ ID NO: 4208258 - DNA, 19 bp, Homo sapiens
tccggctgctcctccagcc

SEQ ID NO: 4208259 - DNA, 22 bp, Homo sapiens
tccggctgctcctccagccctt

SEQ ID NO: 4208260 - DNA, 18 bp, Homo sapiens
tccggtgtgcctgcagcc

SEQ ID NO: 4208261 - DNA, 19 bp, Homo sapiens
tccggtgtgcctgcagccc

SEQ ID NO: 4208262 - DNA, 14 bp, Homo sapiens
tccgtggtcagagt

SEQ ID NO: 4208263 - DNA, 18 bp, Homo sapiens
tccgtgtgcctggggttc

SEQ ID NO: 4208264 - DNA, 22 bp, Homo sapiens
tcctaaacccccgctccagatc

SEQ ID NO: 4208265 - DNA, 21 bp, Homo sapiens
tcctaaatattatgagatgct

SEQ ID NO: 4208266 - DNA, 14 bp, Homo sapiens
tcctaaggcatgtt

SEQ ID NO: 4208267 - DNA, 13 bp, Homo sapiens
tcctacaaaatgg

SEQ ID NO: 4208268 - DNA, 14 bp, Homo sapiens
tcctaccccacctc

SEQ ID NO: 4208269 - DNA, 13 bp, Homo sapiens
tcctacctcagcc

SEQ ID NO: 4208270 - DNA, 16 bp, Homo sapiens
tcctagcaggatctgc

SEQ ID NO: 4208271 - DNA, 22 bp, Homo sapiens
tcctagcaggatctgcccacac

SEQ ID NO: 4208272 - DNA, 13 bp, Homo sapiens
tcctaggccacac

SEQ ID NO: 4208273 - DNA, 19 bp, Homo sapiens
tcctatccttggagagcag

SEQ ID NO: 4208274 - DNA, 22 bp, Homo sapiens
tcctatccttggagagcagctg

SEQ ID NO: 4208275 - DNA, 15 bp, Homo sapiens
tcctatcgactttat

SEQ ID NO: 4208276 - DNA, 13 bp, Homo sapiens
tcctatgctttga

SEQ ID NO: 4208277 - DNA, 14 bp, Homo sapiens
tcctcaaacacaca

SEQ ID NO: 4208278 - DNA, 15 bp, Homo sapiens
tcctcaaacacacaa

SEQ ID NO: 4208279 - DNA, 13 bp, Homo sapiens
tcctcagagcagg

SEQ ID NO: 4208280 - DNA, 23 bp, Homo sapiens
tcctcagagcaggggccagatga

SEQ ID NO: 4208281 - DNA, 16 bp, Homo sapiens
tcctcaggaacagaac

SEQ ID NO: 4208282 - DNA, 17 bp, Homo sapiens
tcctcaggaacagaaca

SEQ ID NO: 4208283 - DNA, 17 bp, Homo sapiens
tcctcaggtagtactgg

SEQ ID NO: 4208284 - DNA, 13 bp, Homo sapiens
tcctccactccac

SEQ ID NO: 4208285 - DNA, 16 bp, Homo sapiens
tcctccactccacctc

SEQ ID NO: 4208286 - DNA, 11 bp, Homo sapiens
tcctccagccc

SEQ ID NO: 4208287 - DNA, 22 bp, Homo sapiens
tcctccatctagagattttctt

SEQ ID NO: 4208288 - DNA, 14 bp, Homo sapiens
tcctcccatggcct

SEQ ID NO: 4208289 - DNA, 17 bp, Homo sapiens
tcctccccaccttcccc

SEQ ID NO: 4208290 - DNA, 20 bp, Homo sapiens
tcctccccaccttccccaga

SEQ ID NO: 4208291 - DNA, 16 bp, Homo sapiens
tcctcctgtgtacagg

SEQ ID NO: 4208292 - DNA, 15 bp, Homo sapiens
tcctcggtactccca

SEQ ID NO: 4208293 - DNA, 15 bp, Homo sapiens
tcctctaacatttgc

SEQ ID NO: 4208294 - DNA, 14 bp, Homo sapiens
tcctctccctgcca

SEQ ID NO: 4208295 - DNA, 15 bp, Homo sapiens
tcctctccctgccaa

SEQ ID NO: 4208296 - DNA, 14 bp, Homo sapiens
tcctctgcaaaaag

SEQ ID NO: 4208297 - DNA, 14 bp, Homo sapiens
tcctctttgcatgg

SEQ ID NO: 4208298 - DNA, 17 bp, Homo sapiens
tcctctttgcatggaat

SEQ ID NO: 4208299 - DNA, 23 bp, Homo sapiens
tcctgatggtacaggaaagctca

SEQ ID NO: 4208300 - DNA, 16 bp, Homo sapiens
tcctgcaatctccagg

SEQ ID NO: 4208301 - DNA, 19 bp, Homo sapiens
tcctgcaatctccagggct

SEQ ID NO: 4208302 - DNA, 21 bp, Homo sapiens
tcctgcaatctccagggctgc

SEQ ID NO: 4208303 - DNA, 12 bp, Homo sapiens
tcctgcactcca

SEQ ID NO: 4208304 - DNA, 13 bp, Homo sapiens
tcctgcactccag

SEQ ID NO: 4208305 - DNA, 17 bp, Homo sapiens
tcctgccattcttctgg

SEQ ID NO: 4208306 - DNA, 19 bp, Homo sapiens
tcctgcccccgacagccca

SEQ ID NO: 4208307 - DNA, 15 bp, Homo sapiens
tcctgcctctctgct

SEQ ID NO: 4208308 - DNA, 17 bp, Homo sapiens
tcctgcctctctgctcc

SEQ ID NO: 4208309 - DNA, 22 bp, Homo sapiens
tcctgcctctctgctccagaga

SEQ ID NO: 4208310 - DNA, 15 bp, Homo sapiens
tcctgctgctgtgtt

SEQ ID NO: 4208311 - DNA, 23 bp, Homo sapiens
tcctgcttgatgggattctggac

SEQ ID NO: 4208312 - DNA, 19 bp, Homo sapiens
tcctggaaaggctcagtct

SEQ ID NO: 4208313 - DNA, 22 bp, Homo sapiens
tcctggaaaggctcagtctcag

SEQ ID NO: 4208314 - DNA, 18 bp, Homo sapiens
tcctggagggggcaagcc

SEQ ID NO: 4208315 - DNA, 16 bp, Homo sapiens
tcctggccctccactc

SEQ ID NO: 4208316 - DNA, 19 bp, Homo sapiens
tcctggccctccactcctc

SEQ ID NO: 4208317 - DNA, 14 bp, Homo sapiens
tcctggctcccagg

SEQ ID NO: 4208318 - DNA, 14 bp, Homo sapiens
tcctggcttctaga

SEQ ID NO: 4208319 - DNA, 19 bp, Homo sapiens
tcctggcttctagatctgg

SEQ ID NO: 4208320 - DNA, 17 bp, Homo sapiens
tcctgggagaacctcag

SEQ ID NO: 4208321 - DNA, 18 bp, Homo sapiens
tcctgggagaacctcagg

SEQ ID NO: 4208322 - DNA, 22 bp, Homo sapiens
tcctgggcatgtttgtctgtgt

SEQ ID NO: 4208323 - DNA, 16 bp, Homo sapiens
tcctggggctctgtgc

SEQ ID NO: 4208324 - DNA, 17 bp, Homo sapiens
tcctggtacagcagggt

SEQ ID NO: 4208325 - DNA, 17 bp, Homo sapiens
tcctggtgaggcccagc

SEQ ID NO: 4208326 - DNA, 19 bp, Homo sapiens
tcctggtgaggcccagcct

SEQ ID NO: 4208327 - DNA, 21 bp, Homo sapiens
tcctgtagaggttttgttgtt

SEQ ID NO: 4208328 - DNA, 16 bp, Homo sapiens
tcctgtataatttaac

SEQ ID NO: 4208329 - DNA, 20 bp, Homo sapiens
tcctgtattcagacagatga

SEQ ID NO: 4208330 - DNA, 16 bp, Homo sapiens
tcctgtcatcccctac

SEQ ID NO: 4208331 - DNA, 17 bp, Homo sapiens
tcctgtcctggctccca

SEQ ID NO: 4208332 - DNA, 18 bp, Homo sapiens
tcctgtgctactttgcct

SEQ ID NO: 4208333 - DNA, 15 bp, Homo sapiens
tcctgtgtgcagtga

SEQ ID NO: 4208334 - DNA, 13 bp, Homo sapiens
tccttaccccagc

SEQ ID NO: 4208335 - DNA, 19 bp, Homo sapiens
tccttaccccagctgcggc

SEQ ID NO: 4208336 - DNA, 23 bp, Homo sapiens
tccttattgtttgtaaacaacaa

SEQ ID NO: 4208337 - DNA, 21 bp, Homo sapiens
tccttcaaagtttaataaatt

SEQ ID NO: 4208338 - DNA, 20 bp, Homo sapiens
tccttcaacaattctaaaat

SEQ ID NO: 4208339 - DNA, 20 bp, Homo sapiens
tccttcaagttagctcagga

SEQ ID NO: 4208340 - DNA, 9 bp, Homo sapiens
tccttcccc

SEQ ID NO: 4208341 - DNA, 23 bp, Homo sapiens
tccttcccccatcccctttcctc

SEQ ID NO: 4208342 - DNA, 18 bp, Homo sapiens
tccttcccttctctcctt

SEQ ID NO: 4208343 - DNA, 21 bp, Homo sapiens
tccttcccttctctccttccc

SEQ ID NO: 4208344 - DNA, 15 bp, Homo sapiens
tccttccgctccttt

SEQ ID NO: 4208345 - DNA, 22 bp, Homo sapiens
tccttcctacacccttggactt

SEQ ID NO: 4208346 - DNA, 16 bp, Homo sapiens
tccttggagagcagct

SEQ ID NO: 4208347 - DNA, 20 bp, Homo sapiens
tccttggatggcaccatcca

SEQ ID NO: 4208348 - DNA, 14 bp, Homo sapiens
tccttgggtcctgc

SEQ ID NO: 4208349 - DNA, 21 bp, Homo sapiens
tcctttcagggaatttcagga

SEQ ID NO: 4208350 - DNA, 11 bp, Homo sapiens
tcctttcctct

SEQ ID NO: 4208351 - DNA, 11 bp, Homo sapiens
tcctttctatc

SEQ ID NO: 4208352 - DNA, 14 bp, Homo sapiens
tcctttgagggcag

SEQ ID NO: 4208353 - DNA, 14 bp, Homo sapiens
tcctttgcctctgc

SEQ ID NO: 4208354 - DNA, 15 bp, Homo sapiens
tcctttgcctctgct

SEQ ID NO: 4208355 - DNA, 13 bp, Homo sapiens
tccttttcttcct

SEQ ID NO: 4208356 - DNA, 18 bp, Homo sapiens
tcctttttcaacttggaa

SEQ ID NO: 4208357 - DNA, 15 bp, Homo sapiens
tcctttttgcagtat

SEQ ID NO: 4208358 - DNA, 13 bp, Homo sapiens
tcgagaccagcct

SEQ ID NO: 4208359 - DNA, 19 bp, Homo sapiens
tcgagaccagcctggccaa

SEQ ID NO: 4208360 - DNA, 21 bp, Homo sapiens
tcgaggtagagtttgaaggag

SEQ ID NO: 4208361 - DNA, 13 bp, Homo sapiens
tcgagtttacttc

SEQ ID NO: 4208362 - DNA, 17 bp, Homo sapiens
tcgcccacaagccttac

SEQ ID NO: 4208363 - DNA, 11 bp, Homo sapiens
tcgccccaccc

SEQ ID NO: 4208364 - DNA, 13 bp, Homo sapiens
tcgccccacccag

SEQ ID NO: 4208365 - DNA, 16 bp, Homo sapiens
tcgcctgtgggaagag

SEQ ID NO: 4208366 - DNA, 22 bp, Homo sapiens
tcgcttgaaccggggaggtgga

SEQ ID NO: 4208367 - DNA, 13 bp, Homo sapiens
tcggagcctgcct

SEQ ID NO: 4208368 - DNA, 15 bp, Homo sapiens
tcggagctgccagcc

SEQ ID NO: 4208369 - DNA, 16 bp, Homo sapiens
tcggggcatgctgggg

SEQ ID NO: 4208370 - DNA, 21 bp, Homo sapiens
tcggtaagttgaatggcctgc

SEQ ID NO: 4208371 - DNA, 18 bp, Homo sapiens
tcggtcataaagaatgta

SEQ ID NO: 4208372 - DNA, 14 bp, Homo sapiens
tcgtaccagccagg

SEQ ID NO: 4208373 - DNA, 22 bp, Homo sapiens
tcgtagctttcccaaataaact

SEQ ID NO: 4208374 - DNA, 16 bp, Homo sapiens
tcgtccgctcagccaa

SEQ ID NO: 4208375 - DNA, 19 bp, Homo sapiens
tcgtgatccacccacctcg

SEQ ID NO: 4208376 - DNA, 12 bp, Homo sapiens
tcgtgcagagct

SEQ ID NO: 4208377 - DNA, 23 bp, Homo sapiens
tcgtgccctttggggttgcccag

SEQ ID NO: 4208378 - DNA, 13 bp, Homo sapiens
gggccgtgcccag

SEQ ID NO: 4208379 - DNA, 17 bp, Homo sapiens
gggccgtgcccaggggc

SEQ ID NO: 4208380 - DNA, 12 bp, Homo sapiens
gggcctgctgcg

SEQ ID NO: 4208381 - DNA, 20 bp, Homo sapiens
gggcctgctgcgtcagacca

SEQ ID NO: 4208382 - DNA, 14 bp, Homo sapiens
gggcggaaggggac

SEQ ID NO: 4208383 - DNA, 13 bp, Homo sapiens
gggcgtggctggc

SEQ ID NO: 4208384 - DNA, 14 bp, Homo sapiens
gggctaggctcttg

SEQ ID NO: 4208385 - DNA, 22 bp, Homo sapiens
gggctaggggctggtccttctc

SEQ ID NO: 4208386 - DNA, 15 bp, Homo sapiens
gggctccctcctgga

SEQ ID NO: 4208387 - DNA, 21 bp, Homo sapiens
gggctccctcctggagcatcc

SEQ ID NO: 4208388 - DNA, 14 bp, Homo sapiens
gggctccctggccc

SEQ ID NO: 4208389 - DNA, 16 bp, Homo sapiens
gggctccctggcccag

SEQ ID NO: 4208390 - DNA, 23 bp, Homo sapiens
gggctcctggaaaggctcagtct

SEQ ID NO: 4208391 - DNA, 18 bp, Homo sapiens
gggctcgccccacccagg

SEQ ID NO: 4208392 - DNA, 19 bp, Homo sapiens
gggctctgccccagctctg

SEQ ID NO: 4208393 - DNA, 12 bp, Homo sapiens
gggctctggtct

SEQ ID NO: 4208394 - DNA, 17 bp, Homo sapiens
gggctcttttcctgctg

SEQ ID NO: 4208395 - DNA, 16 bp, Homo sapiens
gggctgagccctggca

SEQ ID NO: 4208396 - DNA, 14 bp, Homo sapiens
gggctgccagcctg

SEQ ID NO: 4208397 - DNA, 21 bp, Homo sapiens
gggctgcccctgtaggttgct

SEQ ID NO: 4208398 - DNA, 12 bp, Homo sapiens
gggctgccctgc

SEQ ID NO: 4208399 - DNA, 13 bp, Homo sapiens
gggctgccctgcc

SEQ ID NO: 4208400 - DNA, 11 bp, Homo sapiens
gggctggccca

SEQ ID NO: 4208401 - DNA, 16 bp, Homo sapiens
gggctggcccagccaa

SEQ ID NO: 4208402 - DNA, 15 bp, Homo sapiens
gggctgggcccacag

SEQ ID NO: 4208403 - DNA, 15 bp, Homo sapiens
gggctggtccttctc

SEQ ID NO: 4208404 - DNA, 14 bp, Homo sapiens
gggcttccatgcct

SEQ ID NO: 4208405 - DNA, 16 bp, Homo sapiens
gggcttggtggccaag

SEQ ID NO: 4208406 - DNA, 19 bp, Homo sapiens
gggcttggtggccaagcct

SEQ ID NO: 4208407 - DNA, 20 bp, Homo sapiens
gggcttggtggccaagcctg

SEQ ID NO: 4208408 - DNA, 19 bp, Homo sapiens
ggggacaggtaagtggcag

SEQ ID NO: 4208409 - DNA, 16 bp, Homo sapiens
ggggacccagctcctc

SEQ ID NO: 4208410 - DNA, 17 bp, Homo sapiens
ggggacgcgcacacaca

SEQ ID NO: 4208411 - DNA, 19 bp, Homo sapiens
ggggaggatcactggagcc

SEQ ID NO: 4208412 - DNA, 14 bp, Homo sapiens
ggggatggcagaca

SEQ ID NO: 4208413 - DNA, 24 bp, Homo sapiens
ggggccagatgattttcctccctg

SEQ ID NO: 4208414 - DNA, 18 bp, Homo sapiens
ggggcccattctgcatgc

SEQ ID NO: 4208415 - DNA, 12 bp, Homo sapiens
ggggccctggtc

SEQ ID NO: 4208416 - DNA, 17 bp, Homo sapiens
ggggctaggggctggtc

SEQ ID NO: 4208417 - DNA, 21 bp, Homo sapiens
ggggctgctgcactgccctcc

SEQ ID NO: 4208418 - DNA, 16 bp, Homo sapiens
ggggcttgccctgggt

SEQ ID NO: 4208419 - DNA, 16 bp, Homo sapiens
gggggtccacccagca

SEQ ID NO: 4208420 - DNA, 19 bp, Homo sapiens
ggggtacaggtttggggag

SEQ ID NO: 4208421 - DNA, 18 bp, Homo sapiens
ggggtattttaggcaggg

SEQ ID NO: 4208422 - DNA, 18 bp, Homo sapiens
ggggtccacccagcaaag

SEQ ID NO: 4208423 - DNA, 22 bp, Homo sapiens
ggggtgatagaacaagaccctg

SEQ ID NO: 4208424 - DNA, 17 bp, Homo sapiens
ggggttgcgggggagct

SEQ ID NO: 4208425 - DNA, 23 bp, Homo sapiens
ggggttgcgggggagctggaaat

SEQ ID NO: 4208426 - DNA, 13 bp, Homo sapiens
gggtaaactgtgg

SEQ ID NO: 4208427 - DNA, 15 bp, Homo sapiens
gggtactccagcagg

SEQ ID NO: 4208428 - DNA, 17 bp, Homo sapiens
gggtactccagcaggta

SEQ ID NO: 4208429 - DNA, 22 bp, Homo sapiens
gggtcacacctgacaaatggaa

SEQ ID NO: 4208430 - DNA, 19 bp, Homo sapiens
gggtcctgcaatctccagg

SEQ ID NO: 4208431 - DNA, 20 bp, Homo sapiens
gggtcctgcaatctccaggg

SEQ ID NO: 4208432 - DNA, 15 bp, Homo sapiens
gggtcttttagctcc

SEQ ID NO: 4208433 - DNA, 22 bp, Homo sapiens
gggtgatttcagagagggcaga

SEQ ID NO: 4208434 - DNA, 13 bp, Homo sapiens
gggtgcctcagag

SEQ ID NO: 4208435 - DNA, 21 bp, Homo sapiens
gggtggggttggggcaaagcc

SEQ ID NO: 4208436 - DNA, 16 bp, Homo sapiens
gggtggtctgagcacc

SEQ ID NO: 4208437 - DNA, 21 bp, Homo sapiens
gggtggtctgagcaccccctc

SEQ ID NO: 4208438 - DNA, 16 bp, Homo sapiens
gggtggtggggacagg

SEQ ID NO: 4208439 - DNA, 14 bp, Homo sapiens
gggttcctcttccc

SEQ ID NO: 4208440 - DNA, 23 bp, Homo sapiens
gggttgcgggggagctggaaata

SEQ ID NO: 4208441 - DNA, 23 bp, Homo sapiens
gggttgtgaggcctggccaggca

SEQ ID NO: 4208442 - DNA, 21 bp, Homo sapiens
gggtttcattgtgtgttagca

SEQ ID NO: 4208443 - DNA, 17 bp, Homo sapiens
gggttttccaccctgga

SEQ ID NO: 4208444 - DNA, 11 bp, Homo sapiens
ggtaacttctt

SEQ ID NO: 4208445 - DNA, 14 bp, Homo sapiens
ggtaagaagaaagc

SEQ ID NO: 4208446 - DNA, 20 bp, Homo sapiens
ggtaattatatctgttttgt

SEQ ID NO: 4208447 - DNA, 17 bp, Homo sapiens
ggtaattattttgagtg

SEQ ID NO: 4208448 - DNA, 11 bp, Homo sapiens
ggtacagcagg

SEQ ID NO: 4208449 - DNA, 21 bp, Homo sapiens
ggtacagcagggtcttgctgt

SEQ ID NO: 4208450 - DNA, 15 bp, Homo sapiens
ggtacatttccctgt

SEQ ID NO: 4208451 - DNA, 18 bp, Homo sapiens
ggtacatttccctgtgct

SEQ ID NO: 4208452 - DNA, 12 bp, Homo sapiens
ggtagaagccag

SEQ ID NO: 4208453 - DNA, 23 bp, Homo sapiens
ggtagaattgggaagctggggga

SEQ ID NO: 4208454 - DNA, 13 bp, Homo sapiens
ggtagagatgtgt

SEQ ID NO: 4208455 - DNA, 20 bp, Homo sapiens
ggtagcgagctgctctgcta

SEQ ID NO: 4208456 - DNA, 14 bp, Homo sapiens
ggtaggcagagcct

SEQ ID NO: 4208457 - DNA, 14 bp, Homo sapiens
ggtatctccaggat

SEQ ID NO: 4208458 - DNA, 21 bp, Homo sapiens
ggtatgaacttgaggacacat

SEQ ID NO: 4208459 - DNA, 23 bp, Homo sapiens
ggtattagcaaagcaaaaggctg

SEQ ID NO: 4208460 - DNA, 18 bp, Homo sapiens
ggtattccttttgtgtac

SEQ ID NO: 4208461 - DNA, 14 bp, Homo sapiens
ggtatttataatat

SEQ ID NO: 4208462 - DNA, 16 bp, Homo sapiens
ggtcaacagttttcct

SEQ ID NO: 4208463 - DNA, 23 bp, Homo sapiens
ggtcaagctatttctctggatct

SEQ ID NO: 4208464 - DNA, 21 bp, Homo sapiens
ggtcactcttcctgcaaggac

SEQ ID NO: 4208465 - DNA, 22 bp, Homo sapiens
ggtcactcttcctgcaaggact

SEQ ID NO: 4208466 - DNA, 14 bp, Homo sapiens
ggtcagagccactc

SEQ ID NO: 4208467 - DNA, 13 bp, Homo sapiens
ggtcaggagggtg

SEQ ID NO: 4208468 - DNA, 12 bp, Homo sapiens
ggtccaggcagg

SEQ ID NO: 4208469 - DNA, 15 bp, Homo sapiens
ggtccaggcaggagg

SEQ ID NO: 4208470 - DNA, 20 bp, Homo sapiens
ggtccaggccagtgggcctg

SEQ ID NO: 4208471 - DNA, 21 bp, Homo sapiens
ggtccagggttgatcacactc

SEQ ID NO: 4208472 - DNA, 19 bp, Homo sapiens
ggtcccgggtgccccccat

SEQ ID NO: 4208473 - DNA, 20 bp, Homo sapiens
ggtccctcacccccatggcc

SEQ ID NO: 4208474 - DNA, 21 bp, Homo sapiens
ggtcctccatttcaactccag

SEQ ID NO: 4208475 - DNA, 22 bp, Homo sapiens
ggtcctccatttcaactccaga

SEQ ID NO: 4208476 - DNA, 21 bp, Homo sapiens
ggtcctctgatacccagagca

SEQ ID NO: 4208477 - DNA, 14 bp, Homo sapiens
ggtcctggccctct

SEQ ID NO: 4208478 - DNA, 12 bp, Homo sapiens
ggtcctggggct

SEQ ID NO: 4208479 - DNA, 22 bp, Homo sapiens
ggtcctggggctctgtgcaggg

SEQ ID NO: 4208480 - DNA, 23 bp, Homo sapiens
ggtcctggggctctgtgcaggga

SEQ ID NO: 4208481 - DNA, 15 bp, Homo sapiens
ggtcctgggggctgc

SEQ ID NO: 4208482 - DNA, 17 bp, Homo sapiens
ggtcctgggggctgctg

SEQ ID NO: 4208483 - DNA, 21 bp, Homo sapiens
ggtcctgggggctgctgcact

SEQ ID NO: 4208484 - DNA, 21 bp, Homo sapiens
gccccctggtggacagtcctg

SEQ ID NO: 4208485 - DNA, 20 bp, Homo sapiens
gccccgacccctgtccagcg

SEQ ID NO: 4208486 - DNA, 20 bp, Homo sapiens
gccccgggtgcctcagagca

SEQ ID NO: 4208487 - DNA, 21 bp, Homo sapiens
gcccctcatgtgtgctgtgct

SEQ ID NO: 4208488 - DNA, 16 bp, Homo sapiens
gcccctccccagccct

SEQ ID NO: 4208489 - DNA, 17 bp, Homo sapiens
gcccctccccagccctt

SEQ ID NO: 4208490 - DNA, 18 bp, Homo sapiens
gcccctgtaggttgctta

SEQ ID NO: 4208491 - DNA, 14 bp, Homo sapiens
gcccgcttcaagct

SEQ ID NO: 4208492 - DNA, 16 bp, Homo sapiens
gcccgcttcaagctct

SEQ ID NO: 4208493 - DNA, 17 bp, Homo sapiens
gcccggattctgggagg

SEQ ID NO: 4208494 - DNA, 23 bp, Homo sapiens
gcccgggtgtgcctgccctggag

SEQ ID NO: 4208495 - DNA, 20 bp, Homo sapiens
gccctaggattcctccccca

SEQ ID NO: 4208496 - DNA, 15 bp, Homo sapiens
gccctatttttgcaa

SEQ ID NO: 4208497 - DNA, 21 bp, Homo sapiens
gccctcagtgggctccctggc

SEQ ID NO: 4208498 - DNA, 14 bp, Homo sapiens
gccctccacagccg

SEQ ID NO: 4208499 - DNA, 20 bp, Homo sapiens
gccctccacagccgcagcct

SEQ ID NO: 4208500 - DNA, 18 bp, Homo sapiens
gccctctgctccccagtg

SEQ ID NO: 4208501 - DNA, 23 bp, Homo sapiens
gccctgagtggatctccaaggac

SEQ ID NO: 4208502 - DNA, 13 bp, Homo sapiens
gccctgcaagaca

SEQ ID NO: 4208503 - DNA, 17 bp, Homo sapiens
gccctgccctgccacct

SEQ ID NO: 4208504 - DNA, 22 bp, Homo sapiens
gccctgctgccgcctcccagcc

SEQ ID NO: 4208505 - DNA, 20 bp, Homo sapiens
gccctggagtcccctgggcc

SEQ ID NO: 4208506 - DNA, 11 bp, Homo sapiens
gccctgtctgt

SEQ ID NO: 4208507 - DNA, 18 bp, Homo sapiens
gcccttaaacaactgcag

SEQ ID NO: 4208508 - DNA, 19 bp, Homo sapiens
gcccttcagacgagatcct

SEQ ID NO: 4208509 - DNA, 20 bp, Homo sapiens
gcccttcccaacctcccctg

SEQ ID NO: 4208510 - DNA, 12 bp, Homo sapiens
gcccttcccact

SEQ ID NO: 4208511 - DNA, 21 bp, Homo sapiens
gcccttccctgacactgtctg

SEQ ID NO: 4208512 - DNA, 15 bp, Homo sapiens
gcccttccctgcctt

SEQ ID NO: 4208513 - DNA, 19 bp, Homo sapiens
gcccttctgattcccctcc

SEQ ID NO: 4208514 - DNA, 14 bp, Homo sapiens
gccctttctggacc

SEQ ID NO: 4208515 - DNA, 19 bp, Homo sapiens
gccctttggggttgcccag

SEQ ID NO: 4208516 - DNA, 15 bp, Homo sapiens
gccgcctcccagcct

SEQ ID NO: 4208517 - DNA, 17 bp, Homo sapiens
gccgcctcccagcctgg

SEQ ID NO: 4208518 - DNA, 20 bp, Homo sapiens
gccggaccgcgtagagagcc

SEQ ID NO: 4208519 - DNA, 13 bp, Homo sapiens
gccgggcaggcct

SEQ ID NO: 4208520 - DNA, 20 bp, Homo sapiens
gccgtggccatcagggtggg

SEQ ID NO: 4208521 - DNA, 18 bp, Homo sapiens
gccgtgggccgggaggca

SEQ ID NO: 4208522 - DNA, 15 bp, Homo sapiens
gccgtggggctccgg

SEQ ID NO: 4208523 - DNA, 21 bp, Homo sapiens
gcctaactccctccactaccg

SEQ ID NO: 4208524 - DNA, 20 bp, Homo sapiens
gcctaatatttaggcaagag

SEQ ID NO: 4208525 - DNA, 22 bp, Homo sapiens
gcctaattcctggcatgacact

SEQ ID NO: 4208526 - DNA, 16 bp, Homo sapiens
gcctagaacatccctg

SEQ ID NO: 4208527 - DNA, 18 bp, Homo sapiens
gcctagaacatccctggg

SEQ ID NO: 4208528 - DNA, 21 bp, Homo sapiens
gcctagaacatccctgggcaa

SEQ ID NO: 4208529 - DNA, 16 bp, Homo sapiens
gcctagactgtgtatg

SEQ ID NO: 4208530 - DNA, 16 bp, Homo sapiens
gcctatatatgtaaat

SEQ ID NO: 4208531 - DNA, 14 bp, Homo sapiens
gcctatccatcctg

SEQ ID NO: 4208532 - DNA, 15 bp, Homo sapiens
gcctatccatcctgc

SEQ ID NO: 4208533 - DNA, 16 bp, Homo sapiens
gcctatcctctgtata

SEQ ID NO: 4208534 - DNA, 15 bp, Homo sapiens
gcctatgatcccagc

SEQ ID NO: 4208535 - DNA, 17 bp, Homo sapiens
gcctcaagaacaccttt

SEQ ID NO: 4208536 - DNA, 17 bp, Homo sapiens
gcctcactcaagcctga

SEQ ID NO: 4208537 - DNA, 15 bp, Homo sapiens
gcctcagccacaaaa

SEQ ID NO: 4208538 - DNA, 16 bp, Homo sapiens
gcctcccaataaagct

SEQ ID NO: 4208539 - DNA, 17 bp, Homo sapiens
gcctcccaataaagctg

SEQ ID NO: 4208540 - DNA, 10 bp, Homo sapiens
gcctcccagc

SEQ ID NO: 4208541 - DNA, 13 bp, Homo sapiens
gcctcccagcctg

SEQ ID NO: 4208542 - DNA, 16 bp, Homo sapiens
gcctcctgacctgagg

SEQ ID NO: 4208543 - DNA, 17 bp, Homo sapiens
gcctcctgacctgaggc

SEQ ID NO: 4208544 - DNA, 20 bp, Homo sapiens
gcctccttccttgctgtcct

SEQ ID NO: 4208545 - DNA, 18 bp, Homo sapiens
gcctcgtaccagccagga

SEQ ID NO: 4208546 - DNA, 13 bp, Homo sapiens
gctcctccagccc

SEQ ID NO: 4208547 - DNA, 11 bp, Homo sapiens
gctcctctgag

SEQ ID NO: 4208548 - DNA, 14 bp, Homo sapiens
gctcctctgctgct

SEQ ID NO: 4208549 - DNA, 16 bp, Homo sapiens
gctcctctgctgctcc

SEQ ID NO: 4208550 - DNA, 13 bp, Homo sapiens
gctcctgtccctc

SEQ ID NO: 4208551 - DNA, 16 bp, Homo sapiens
gctccttgggtcctgc

SEQ ID NO: 4208552 - DNA, 18 bp, Homo sapiens
gctcctttacctaccacc

SEQ ID NO: 4208553 - DNA, 16 bp, Homo sapiens
gctcctttgcctctgc

SEQ ID NO: 4208554 - DNA, 19 bp, Homo sapiens
gctcctttgcctctgctac

SEQ ID NO: 4208555 - DNA, 15 bp, Homo sapiens
gctcgccccacccag

SEQ ID NO: 4208556 - DNA, 14 bp, Homo sapiens
gctctattgagcca

SEQ ID NO: 4208557 - DNA, 13 bp, Homo sapiens
gctctccaccttg

SEQ ID NO: 4208558 - DNA, 19 bp, Homo sapiens
gctctcccctgccctgctg

SEQ ID NO: 4208559 - DNA, 14 bp, Homo sapiens
gctctgcaggcacc

SEQ ID NO: 4208560 - DNA, 20 bp, Homo sapiens
gctctgccccagaggcctct

SEQ ID NO: 4208561 - DNA, 19 bp, Homo sapiens
gctctgccccagctctggc

SEQ ID NO: 4208562 - DNA, 20 bp, Homo sapiens
gctctgccccagctctggct

SEQ ID NO: 4208563 - DNA, 23 bp, Homo sapiens
gctctgcctggaggatccctcca

SEQ ID NO: 4208564 - DNA, 21 bp, Homo sapiens
gctctgtctacttgctcaggt

SEQ ID NO: 4208565 - DNA, 20 bp, Homo sapiens
gctctgttatgcaagcacaa

SEQ ID NO: 4208566 - DNA, 14 bp, Homo sapiens
gctcttcactcagc

SEQ ID NO: 4208567 - DNA, 18 bp, Homo sapiens
gctcttcactcagccaca

SEQ ID NO: 4208568 - DNA, 12 bp, Homo sapiens
gctctttcaggg

SEQ ID NO: 4208569 - DNA, 23 bp, Homo sapiens
gctctttggggtcagccagggcc

SEQ ID NO: 4208570 - DNA, 15 bp, Homo sapiens
gctcttttccactcc

SEQ ID NO: 4208571 - DNA, 22 bp, Homo sapiens
gctgaacccattttgagtgact

SEQ ID NO: 4208572 - DNA, 20 bp, Homo sapiens
gctgacctgggcccacagag

SEQ ID NO: 4208573 - DNA, 22 bp, Homo sapiens
gctgacctgggcccacagagcc

SEQ ID NO: 4208574 - DNA, 16 bp, Homo sapiens
gctgacctgtttttgt

SEQ ID NO: 4208575 - DNA, 15 bp, Homo sapiens
gctgagacaggagaa

SEQ ID NO: 4208576 - DNA, 14 bp, Homo sapiens
gctgagactgcggg

SEQ ID NO: 4208577 - DNA, 21 bp, Homo sapiens
gctgagcaacctcttcagctg

SEQ ID NO: 4208578 - DNA, 14 bp, Homo sapiens
gctgagcagcccag

SEQ ID NO: 4208579 - DNA, 12 bp, Homo sapiens
gctgagctggca

SEQ ID NO: 4208580 - DNA, 17 bp, Homo sapiens
gctgagctttctagcct

SEQ ID NO: 4208581 - DNA, 12 bp, Homo sapiens
gctgaggcagga

SEQ ID NO: 4208582 - DNA, 23 bp, Homo sapiens
gctgaggctctgacccagtgaga

SEQ ID NO: 4208583 - DNA, 21 bp, Homo sapiens
gctgaggggggccgtgcccag

SEQ ID NO: 4208584 - DNA, 21 bp, Homo sapiens
gctgaggtgtcttaagccttt

SEQ ID NO: 4208585 - DNA, 13 bp, Homo sapiens
gctgataatttta

SEQ ID NO: 4208586 - DNA, 14 bp, Homo sapiens
gctgataattttaa

SEQ ID NO: 4208587 - DNA, 15 bp, Homo sapiens
gctgataattttaaa

SEQ ID NO: 4208588 - DNA, 12 bp, Homo sapiens
gctgatccggct

SEQ ID NO: 4208589 - DNA, 13 bp, Homo sapiens
gctgatccggctg

SEQ ID NO: 4208590 - DNA, 16 bp, Homo sapiens
gctgatggagaaggaa

SEQ ID NO: 4208591 - DNA, 14 bp, Homo sapiens
gctgatgtcaaagt

SEQ ID NO: 4208592 - DNA, 21 bp, Homo sapiens
gctgcacctgccagcctggct

SEQ ID NO: 4208593 - DNA, 22 bp, Homo sapiens
gctgcaggaatctttaaaagat

SEQ ID NO: 4208594 - DNA, 13 bp, Homo sapiens
gctgccagagaac

SEQ ID NO: 4208595 - DNA, 16 bp, Homo sapiens
gctgccaggctcccac

SEQ ID NO: 4208596 - DNA, 22 bp, Homo sapiens
gctgccatggcgtgtccctctc

SEQ ID NO: 4208597 - DNA, 13 bp, Homo sapiens
gctgccgcctccc

SEQ ID NO: 4208598 - DNA, 19 bp, Homo sapiens
gctgccgcctcccagcctg

SEQ ID NO: 4208599 - DNA, 19 bp, Homo sapiens
gctgcctgtagttaggaaa

SEQ ID NO: 4208600 - DNA, 17 bp, Homo sapiens
gctgccttttgctgctg

SEQ ID NO: 4208601 - DNA, 21 bp, Homo sapiens
gctgcgtcagaccagtactgg

SEQ ID NO: 4208602 - DNA, 14 bp, Homo sapiens
gctgctagggcccc

SEQ ID NO: 4208603 - DNA, 17 bp, Homo sapiens
gctgctcctccagccct

SEQ ID NO: 4208604 - DNA, 12 bp, Homo sapiens
gctgctctgcta

SEQ ID NO: 4208605 - DNA, 22 bp, Homo sapiens
gctgctgaagaggcaagagaca

SEQ ID NO: 4208606 - DNA, 12 bp, Homo sapiens
gctgctgcactg

SEQ ID NO: 4208607 - DNA, 22 bp, Homo sapiens
gctggaaaataatactgctgag

SEQ ID NO: 4208608 - DNA, 20 bp, Homo sapiens
gctggaaataaacctggaga

SEQ ID NO: 4208609 - DNA, 22 bp, Homo sapiens
gctggaaataaacctggagatg

SEQ ID NO: 4208610 - DNA, 18 bp, Homo sapiens
gctggacaagaagctgct

SEQ ID NO: 4208611 - DNA, 22 bp, Homo sapiens
gctggacctgcacgccaccgct

SEQ ID NO: 4208612 - DNA, 16 bp, Homo sapiens
gctggagaagctcacc

SEQ ID NO: 4208613 - DNA, 20 bp, Homo sapiens
gctggagttcagtggtgtga

SEQ ID NO: 4208614 - DNA, 12 bp, Homo sapiens
gctggcccagcc

SEQ ID NO: 4208615 - DNA, 23 bp, Homo sapiens
gctggcccagccaactgccccgg

SEQ ID NO: 4208616 - DNA, 18 bp, Homo sapiens
gctggcctcccaataaag

SEQ ID NO: 4208617 - DNA, 23 bp, Homo sapiens
gctggcctttcaggtccaggcca

SEQ ID NO: 4208618 - DNA, 15 bp, Homo sapiens
gctggcggcgcagag

SEQ ID NO: 4208619 - DNA, 16 bp, Homo sapiens
gctggcggcgcagagg

SEQ ID NO: 4208620 - DNA, 17 bp, Homo sapiens
gctggcggcgcagaggg

SEQ ID NO: 4208621 - DNA, 18 bp, Homo sapiens
gctggctgacctgggccc

SEQ ID NO: 4208622 - DNA, 14 bp, Homo sapiens
gctggctgcagtga

SEQ ID NO: 4208623 - DNA, 15 bp, Homo sapiens
gctgggaacacagcc

SEQ ID NO: 4208624 - DNA, 15 bp, Homo sapiens
gctgggactggccag

SEQ ID NO: 4208625 - DNA, 17 bp, Homo sapiens
gctggggctgccagcct

SEQ ID NO: 4208626 - DNA, 20 bp, Homo sapiens
gctggggctgccagcctgag

SEQ ID NO: 4208627 - DNA, 21 bp, Homo sapiens
gctggggctgccagcctgagc

SEQ ID NO: 4208628 - DNA, 14 bp, Homo sapiens
gctgggtcccgggt

SEQ ID NO: 4208629 - DNA, 23 bp, Homo sapiens
gctggtaatttgtatctgaagga

SEQ ID NO: 4208630 - DNA, 21 bp, Homo sapiens
gtatattatgtatttatattt

SEQ ID NO: 4208631 - DNA, 23 bp, Homo sapiens
gtatattatgtatttatattttg

SEQ ID NO: 4208632 - DNA, 18 bp, Homo sapiens
gtatcaatccttgttcag

SEQ ID NO: 4208633 - DNA, 23 bp, Homo sapiens
gtatccgactctaagctgtgtgc

SEQ ID NO: 4208634 - DNA, 18 bp, Homo sapiens
gtatctaggcaacatagt

SEQ ID NO: 4208635 - DNA, 20 bp, Homo sapiens
gtatctcggacctttcagct

SEQ ID NO: 4208636 - DNA, 16 bp, Homo sapiens
gtatcttctgcagaca

SEQ ID NO: 4208637 - DNA, 23 bp, Homo sapiens
gtatgaacttgaggacacatgtc

SEQ ID NO: 4208638 - DNA, 14 bp, Homo sapiens
gtatgacttctgct

SEQ ID NO: 4208639 - DNA, 17 bp, Homo sapiens
gtatgacttctgctgaa

SEQ ID NO: 4208640 - DNA, 12 bp, Homo sapiens
gtatgagctgag

SEQ ID NO: 4208641 - DNA, 19 bp, Homo sapiens
gtatgatttttacaataat

SEQ ID NO: 4208642 - DNA, 12 bp, Homo sapiens
gtatgtgtgtgg

SEQ ID NO: 4208643 - DNA, 22 bp, Homo sapiens
gtatgtgtgtggtgtgtgtgct

SEQ ID NO: 4208644 - DNA, 15 bp, Homo sapiens
gtattaaagatgtgt

SEQ ID NO: 4208645 - DNA, 14 bp, Homo sapiens
gtattcttgtcaaa

SEQ ID NO: 4208646 - DNA, 14 bp, Homo sapiens
gtatttatatttgg

SEQ ID NO: 4208647 - DNA, 19 bp, Homo sapiens
gtatttatatttggaaaga

SEQ ID NO: 4208648 - DNA, 21 bp, Homo sapiens
gtatttcttttttttaataag

SEQ ID NO: 4208649 - DNA, 19 bp, Homo sapiens
gtattttaggcagggattt

SEQ ID NO: 4208650 - DNA, 19 bp, Homo sapiens
gtattttagtgaacttgaa

SEQ ID NO: 4208651 - DNA, 12 bp, Homo sapiens
gtattttgagat

SEQ ID NO: 4208652 - DNA, 17 bp, Homo sapiens
gtcaaaatcatgaatat

SEQ ID NO: 4208653 - DNA, 13 bp, Homo sapiens
gtcaaaccgcact

SEQ ID NO: 4208654 - DNA, 21 bp, Homo sapiens
gtcaaaccgcactcacccatg

SEQ ID NO: 4208655 - DNA, 23 bp, Homo sapiens
gtcaaacttgtcaagaatgagaa

SEQ ID NO: 4208656 - DNA, 16 bp, Homo sapiens
gtcaaagaaatgctga

SEQ ID NO: 4208657 - DNA, 19 bp, Homo sapiens
gtcaacacaaagacatgga

SEQ ID NO: 4208658 - DNA, 21 bp, Homo sapiens
gtcaacagttttcctatgctt

SEQ ID NO: 4208659 - DNA, 14 bp, Homo sapiens
gtcaagacatttct

SEQ ID NO: 4208660 - DNA, 13 bp, Homo sapiens
gtcaagatacata

SEQ ID NO: 4208661 - DNA, 20 bp, Homo sapiens
gtcaagcctgcagcgagctg

SEQ ID NO: 4208662 - DNA, 18 bp, Homo sapiens
gtcaatcaagtctgttta

SEQ ID NO: 4208663 - DNA, 22 bp, Homo sapiens
gtcaatttccctgactcctcta

SEQ ID NO: 4208664 - DNA, 17 bp, Homo sapiens
gtcacaagagcccagca

SEQ ID NO: 4208665 - DNA, 13 bp, Homo sapiens
gtcaccagcctga

SEQ ID NO: 4208666 - DNA, 13 bp, Homo sapiens
gtcactcaaggcg

SEQ ID NO: 4208667 - DNA, 12 bp, Homo sapiens
gtcactggcaga

SEQ ID NO: 4208668 - DNA, 13 bp, Homo sapiens
gtcactggcagag

SEQ ID NO: 4208669 - DNA, 14 bp, Homo sapiens
gtcactggcagagc

SEQ ID NO: 4208670 - DNA, 19 bp, Homo sapiens
gtcactggcagagcacagc

SEQ ID NO: 4208671 - DNA, 21 bp, Homo sapiens
gtcactggcagagcacagccc

SEQ ID NO: 4208672 - DNA, 13 bp, Homo sapiens
gtcagaaactgtt

SEQ ID NO: 4208673 - DNA, 20 bp, Homo sapiens
gtcagactgctgggactggc

SEQ ID NO: 4208674 - DNA, 13 bp, Homo sapiens
gtcagagtgccac

SEQ ID NO: 4208675 - DNA, 15 bp, Homo sapiens
gtcagagtgccactg

SEQ ID NO: 4208676 - DNA, 12 bp, Homo sapiens
gtcagccagggc

SEQ ID NO: 4208677 - DNA, 14 bp, Homo sapiens
gtcagccagggcca

SEQ ID NO: 4208678 - DNA, 10 bp, Homo sapiens
gtcagccctt

SEQ ID NO: 4208679 - DNA, 20 bp, Homo sapiens
gtcagcccttggcttctgct

SEQ ID NO: 4208680 - DNA, 22 bp, Homo sapiens
gtcagccttgcatcaagggctt

SEQ ID NO: 4208681 - DNA, 21 bp, Homo sapiens
gtcagcgcaggtttagtttac

SEQ ID NO: 4208682 - DNA, 20 bp, Homo sapiens
gtcagcgtgcttagcctcct

SEQ ID NO: 4208683 - DNA, 23 bp, Homo sapiens
gtcaggattgcaggtgcctggct

SEQ ID NO: 4208684 - DNA, 16 bp, Homo sapiens
gtcagttcataatata

SEQ ID NO: 4208685 - DNA, 23 bp, Homo sapiens
gtcagttgtacgtaatgtattta

SEQ ID NO: 4208686 - DNA, 15 bp, Homo sapiens
gtcatataaaatata

SEQ ID NO: 4208687 - DNA, 14 bp, Homo sapiens
gtcatattcttatg

SEQ ID NO: 4208688 - DNA, 15 bp, Homo sapiens
gtcatcacttttcag

SEQ ID NO: 4208689 - DNA, 16 bp, Homo sapiens
gtcatgaggaaagaca

SEQ ID NO: 4208690 - DNA, 14 bp, Homo sapiens
gtcatgatttctgt

SEQ ID NO: 4208691 - DNA, 16 bp, Homo sapiens
gtcatgatttctgtga

SEQ ID NO: 4208692 - DNA, 20 bp, Homo sapiens
gtcattttggtactttggtg

SEQ ID NO: 4208693 - DNA, 22 bp, Homo sapiens
gtccaaggaaacttgaatcaaa

SEQ ID NO: 4208694 - DNA, 18 bp, Homo sapiens
gtccaatcagagaataaa

SEQ ID NO: 4208695 - DNA, 14 bp, Homo sapiens
gtccacccagcaaa

SEQ ID NO: 4208696 - DNA, 15 bp, Homo sapiens
gtccagatgccttcc

SEQ ID NO: 4208697 - DNA, 10 bp, Homo sapiens
gtccagccct

SEQ ID NO: 4208698 - DNA, 11 bp, Homo sapiens
gtccaggcagg

SEQ ID NO: 4208699 - DNA, 12 bp, Homo sapiens
gtccaggcagga

SEQ ID NO: 4208700 - DNA, 21 bp, Homo sapiens
gtccaggccagtgggcctggt

SEQ ID NO: 4208701 - DNA, 17 bp, Homo sapiens
gtccagtgacctgctgg

SEQ ID NO: 4208702 - DNA, 19 bp, Homo sapiens
gtcccggagctcaggccct

SEQ ID NO: 4208703 - DNA, 23 bp, Homo sapiens
gtcccgggtgccccccatgccct

SEQ ID NO: 4208704 - DNA, 14 bp, Homo sapiens
gtccctaggaggga

SEQ ID NO: 4208705 - DNA, 16 bp, Homo sapiens
gtccctcggagctgcc

SEQ ID NO: 4208706 - DNA, 15 bp, Homo sapiens
gtccctgagggccct

SEQ ID NO: 4208707 - DNA, 18 bp, Homo sapiens
gtccctgagggcccttcc

SEQ ID NO: 4208708 - DNA, 21 bp, Homo sapiens
gtcccttggaaagttcagcca

SEQ ID NO: 4208709 - DNA, 20 bp, Homo sapiens
gtccgaaaccagttaagaat

SEQ ID NO: 4208710 - DNA, 13 bp, Homo sapiens
gtccgtctgtgta

SEQ ID NO: 4208711 - DNA, 16 bp, Homo sapiens
gtcctaactggtatag

SEQ ID NO: 4208712 - DNA, 16 bp, Homo sapiens
gtcctatcgactttat

SEQ ID NO: 4208713 - DNA, 16 bp, Homo sapiens
gtcctcacagcctctc

SEQ ID NO: 4208714 - DNA, 18 bp, Homo sapiens
gtcctcacagcctctccc

SEQ ID NO: 4208715 - DNA, 12 bp, Homo sapiens
gtcctcagagca

SEQ ID NO: 4208716 - DNA, 13 bp, Homo sapiens
gtcctcagagcag

SEQ ID NO: 4208717 - DNA, 18 bp, Homo sapiens
gtcctcagagcaggggcc

SEQ ID NO: 4208718 - DNA, 20 bp, Homo sapiens
gtcctccatttcaactccag

SEQ ID NO: 4208719 - DNA, 13 bp, Homo sapiens
gtcctcccgggag

SEQ ID NO: 4208720 - DNA, 16 bp, Homo sapiens
gtcctctccctgccaa

SEQ ID NO: 4208721 - DNA, 19 bp, Homo sapiens
gtcctctgatacccagagc

SEQ ID NO: 4208722 - DNA, 20 bp, Homo sapiens
gtcctgcaatctccagggct

SEQ ID NO: 4208723 - DNA, 22 bp, Homo sapiens
gtcctgcatttctcagtcggtg

SEQ ID NO: 4208724 - DNA, 20 bp, Homo sapiens
gtcctgcctctctgctccag

SEQ ID NO: 4208725 - DNA, 12 bp, Homo sapiens
gtcctggcttct

SEQ ID NO: 4208726 - DNA, 23 bp, Homo sapiens
gtcctggcttctagatctggaac

SEQ ID NO: 4208727 - DNA, 16 bp, Homo sapiens
gtcctggggctctgtg

SEQ ID NO: 4208728 - DNA, 15 bp, Homo sapiens
gtcctgggggctgct

SEQ ID NO: 4208729 - DNA, 21 bp, Homo sapiens
gtcctggtacagcagggtctt

SEQ ID NO: 4208730 - DNA, 18 bp, Homo sapiens
gtccttattatcccagct

SEQ ID NO: 4208731 - DNA, 15 bp, Homo sapiens
gtcctttaggcagcc

SEQ ID NO: 4208732 - DNA, 19 bp, Homo sapiens
gtcctttaggcagcctgcc

SEQ ID NO: 4208733 - DNA, 15 bp, Homo sapiens
gtcctttctggaagt

SEQ ID NO: 4208734 - DNA, 20 bp, Homo sapiens
gtcctttctggaagtttctg

SEQ ID NO: 4208735 - DNA, 17 bp, Homo sapiens
gtcgaattaatagcttt

SEQ ID NO: 4208736 - DNA, 13 bp, Homo sapiens
gtcgccaggctag

SEQ ID NO: 4208737 - DNA, 22 bp, Homo sapiens
gtcgcgcgcagcgcgtgcacag

SEQ ID NO: 4208738 - DNA, 13 bp, Homo sapiens
gtcgggggtggca

SEQ ID NO: 4208739 - DNA, 17 bp, Homo sapiens
gtcgtccgctcagccaa

SEQ ID NO: 4208740 - DNA, 23 bp, Homo sapiens
gtcgtggcagataatcagcctct

SEQ ID NO: 4208741 - DNA, 14 bp, Homo sapiens
gtctaaagagcttt

SEQ ID NO: 4208742 - DNA, 15 bp, Homo sapiens
gtctaaagtttacag

SEQ ID NO: 4208743 - DNA, 12 bp, Homo sapiens
gtctacatttct

SEQ ID NO: 4208744 - DNA, 19 bp, Homo sapiens
gtctagcagagcaggggca

SEQ ID NO: 4208745 - DNA, 13 bp, Homo sapiens
gtctcacagaggc

SEQ ID NO: 4208746 - DNA, 21 bp, Homo sapiens
gtctcacagaggcagtaggaa

SEQ ID NO: 4208747 - DNA, 20 bp, Homo sapiens
gtctcagtccagatgccttc

SEQ ID NO: 4208748 - DNA, 17 bp, Homo sapiens
gtctccactgaggatgt

SEQ ID NO: 4208749 - DNA, 11 bp, Homo sapiens
gtgtttcacaa

SEQ ID NO: 4208750 - DNA, 18 bp, Homo sapiens
gtgtttctgtaagaaacc

SEQ ID NO: 4208751 - DNA, 18 bp, Homo sapiens
gtgtttgcaaaggttaaa

SEQ ID NO: 4208752 - DNA, 14 bp, Homo sapiens
gtgtttggctttca

SEQ ID NO: 4208753 - DNA, 13 bp, Homo sapiens
gtgttttctgaat

SEQ ID NO: 4208754 - DNA, 20 bp, Homo sapiens
gttaaagggcagaaggggaa

SEQ ID NO: 4208755 - DNA, 18 bp, Homo sapiens
gttaaatgcaggtatttt

SEQ ID NO: 4208756 - DNA, 14 bp, Homo sapiens
gttaacttggtcag

SEQ ID NO: 4208757 - DNA, 23 bp, Homo sapiens
gttaactttaagactgagcacct

SEQ ID NO: 4208758 - DNA, 18 bp, Homo sapiens
gttaagaatggaagaaaa

SEQ ID NO: 4208759 - DNA, 18 bp, Homo sapiens
gttaagagctaagagcag

SEQ ID NO: 4208760 - DNA, 16 bp, Homo sapiens
gttaagatctgaaagt

SEQ ID NO: 4208761 - DNA, 14 bp, Homo sapiens
gttaagcaaaggaa

SEQ ID NO: 4208762 - DNA, 19 bp, Homo sapiens
gttaatttagaaaacttta

SEQ ID NO: 4208763 - DNA, 14 bp, Homo sapiens
gttaatttatttag

SEQ ID NO: 4208764 - DNA, 16 bp, Homo sapiens
gttaatttatttagtt

SEQ ID NO: 4208765 - DNA, 16 bp, Homo sapiens
gttacaacagtaacac

SEQ ID NO: 4208766 - DNA, 17 bp, Homo sapiens
gttacatcacagtgttt

SEQ ID NO: 4208767 - DNA, 22 bp, Homo sapiens
gttacattgtcaaagcttgccg

SEQ ID NO: 4208768 - DNA, 13 bp, Homo sapiens
gttaccatgaaga

SEQ ID NO: 4208769 - DNA, 15 bp, Homo sapiens
gttactgtgtgaaga

SEQ ID NO: 4208770 - DNA, 12 bp, Homo sapiens
gttactttggca

SEQ ID NO: 4208771 - DNA, 20 bp, Homo sapiens
gttagagaggtagcgagctg

SEQ ID NO: 4208772 - DNA, 11 bp, Homo sapiens
gttagctgagc

SEQ ID NO: 4208773 - DNA, 11 bp, Homo sapiens
gttagctggag

SEQ ID NO: 4208774 - DNA, 16 bp, Homo sapiens
gttaggaaataaaacc

SEQ ID NO: 4208775 - DNA, 17 bp, Homo sapiens
gttaggaaataaaacct

SEQ ID NO: 4208776 - DNA, 18 bp, Homo sapiens
gttaggaaataaaacctt

SEQ ID NO: 4208777 - DNA, 13 bp, Homo sapiens
gttataaaaatac

SEQ ID NO: 4208778 - DNA, 20 bp, Homo sapiens
gttatacatcctattttgta

SEQ ID NO: 4208779 - DNA, 15 bp, Homo sapiens
gttatcagttaacat

SEQ ID NO: 4208780 - DNA, 17 bp, Homo sapiens
gttattgtacagctgtt

SEQ ID NO: 4208781 - DNA, 19 bp, Homo sapiens
gttatttagaaatatcctt

SEQ ID NO: 4208782 - DNA, 22 bp, Homo sapiens
gttatttggaccactccaggct

SEQ ID NO: 4208783 - DNA, 19 bp, Homo sapiens
gttatttgttattttcagt

SEQ ID NO: 4208784 - DNA, 15 bp, Homo sapiens
gttcaacttccagaa

SEQ ID NO: 4208785 - DNA, 19 bp, Homo sapiens
gttcactgttgtacacagt

SEQ ID NO: 4208786 - DNA, 14 bp, Homo sapiens
gttcagaggaagca

SEQ ID NO: 4208787 - DNA, 17 bp, Homo sapiens
gttcagaggaagcacat

SEQ ID NO: 4208788 - DNA, 20 bp, Homo sapiens
gttcatctgagcaagagctg

SEQ ID NO: 4208789 - DNA, 15 bp, Homo sapiens
gttccagctgcctgg

SEQ ID NO: 4208790 - DNA, 20 bp, Homo sapiens
gttcccgagggagctgctgg

SEQ ID NO: 4208791 - DNA, 14 bp, Homo sapiens
gttcccgctctgca

SEQ ID NO: 4208792 - DNA, 12 bp, Homo sapiens
gttccctctgag

SEQ ID NO: 4208793 - DNA, 22 bp, Homo sapiens
gttccctctgagaattccaagg

SEQ ID NO: 4208794 - DNA, 14 bp, Homo sapiens
gttcctctttgcat

SEQ ID NO: 4208795 - DNA, 12 bp, Homo sapiens
gttcctgcactc

SEQ ID NO: 4208796 - DNA, 23 bp, Homo sapiens
gttctagagaagaggctggtgct

SEQ ID NO: 4208797 - DNA, 23 bp, Homo sapiens
gttctggtatgaacttgaggaca

SEQ ID NO: 4208798 - DNA, 13 bp, Homo sapiens
gttctgtattttc

SEQ ID NO: 4208799 - DNA, 18 bp, Homo sapiens
gttctgtgatagagcaga

SEQ ID NO: 4208800 - DNA, 22 bp, Homo sapiens
gttcttgagtagatctgcttct

SEQ ID NO: 4208801 - DNA, 12 bp, Homo sapiens
gttcttgtctga

SEQ ID NO: 4208802 - DNA, 18 bp, Homo sapiens
gttctttggaaggagtga

SEQ ID NO: 4208803 - DNA, 19 bp, Homo sapiens
gttgaaaattattttaaac

SEQ ID NO: 4208804 - DNA, 15 bp, Homo sapiens
gttgaaagtaaaagt

SEQ ID NO: 4208805 - DNA, 12 bp, Homo sapiens
gttgacagcagg

SEQ ID NO: 4208806 - DNA, 14 bp, Homo sapiens
gttgacccctttcc

SEQ ID NO: 4208807 - DNA, 16 bp, Homo sapiens
gttgacccctttcccc

SEQ ID NO: 4208808 - DNA, 16 bp, Homo sapiens
gttgattacagtgcag

SEQ ID NO: 4208809 - DNA, 13 bp, Homo sapiens
gttgcagtgagct

SEQ ID NO: 4208810 - DNA, 15 bp, Homo sapiens
gttgcccagcctgga

SEQ ID NO: 4208811 - DNA, 19 bp, Homo sapiens
gttgcgggggagctggaaa

SEQ ID NO: 4208812 - DNA, 20 bp, Homo sapiens
gttgcgggggagctggaaat

SEQ ID NO: 4208813 - DNA, 22 bp, Homo sapiens
gttgctgattcaagaaacagaa

SEQ ID NO: 4208814 - DNA, 18 bp, Homo sapiens
gttggaaatattcatgct

SEQ ID NO: 4208815 - DNA, 20 bp, Homo sapiens
gttggaggtggggaaggctt

SEQ ID NO: 4208816 - DNA, 14 bp, Homo sapiens
gttggctggatgaa

SEQ ID NO: 4208817 - DNA, 20 bp, Homo sapiens
gttggtcttatagaaagcac

SEQ ID NO: 4208818 - DNA, 17 bp, Homo sapiens
gttggtgaacagagaga

SEQ ID NO: 4208819 - DNA, 15 bp, Homo sapiens
gttggttctgcacta

SEQ ID NO: 4208820 - DNA, 12 bp, Homo sapiens
gttgtaaataaa

SEQ ID NO: 4208821 - DNA, 14 bp, Homo sapiens
gttgtgaggcctgg

SEQ ID NO: 4208822 - DNA, 13 bp, Homo sapiens
gttgtgctgcctg

SEQ ID NO: 4208823 - DNA, 15 bp, Homo sapiens
gttgtgggtgggaga

SEQ ID NO: 4208824 - DNA, 16 bp, Homo sapiens
gttgtgggtgggagag

SEQ ID NO: 4208825 - DNA, 16 bp, Homo sapiens
gttgttcttgatgaca

SEQ ID NO: 4208826 - DNA, 22 bp, Homo sapiens
gtttaaacacttatcttctgga

SEQ ID NO: 4208827 - DNA, 17 bp, Homo sapiens
gtttaacattcacagcc

SEQ ID NO: 4208828 - DNA, 14 bp, Homo sapiens
gtttaatacttttt

SEQ ID NO: 4208829 - DNA, 18 bp, Homo sapiens
gtttacaagtgtatatca

SEQ ID NO: 4208830 - DNA, 13 bp, Homo sapiens
gtttacagaactg

SEQ ID NO: 4208831 - DNA, 13 bp, Homo sapiens
gtttacagtaaat

SEQ ID NO: 4208832 - DNA, 15 bp, Homo sapiens
gtttacatgaacaca

SEQ ID NO: 4208833 - DNA, 20 bp, Homo sapiens
gtttatagagggccaagact

SEQ ID NO: 4208834 - DNA, 17 bp, Homo sapiens
gtttatatttggctctc

SEQ ID NO: 4208835 - DNA, 18 bp, Homo sapiens
gtttatgaaaaagaagaa

SEQ ID NO: 4208836 - DNA, 13 bp, Homo sapiens
gtttatgtctaaa

SEQ ID NO: 4208837 - DNA, 17 bp, Homo sapiens
gtttatttattctgcat

SEQ ID NO: 4208838 - DNA, 23 bp, Homo sapiens
gtttcaaatggactcatggctta

SEQ ID NO: 4208839 - DNA, 17 bp, Homo sapiens
gtttcagaagcaggcag

SEQ ID NO: 4208840 - DNA, 14 bp, Homo sapiens
gtttccagttgtta

SEQ ID NO: 4208841 - DNA, 14 bp, Homo sapiens
gtttcccaccacct

SEQ ID NO: 4208842 - DNA, 16 bp, Homo sapiens
gtttctagagggcact

SEQ ID NO: 4208843 - DNA, 17 bp, Homo sapiens
gtttgaaggaggtgagg

SEQ ID NO: 4208844 - DNA, 16 bp, Homo sapiens
gtttgatagattttct

SEQ ID NO: 4208845 - DNA, 17 bp, Homo sapiens
gtttgcactatctttca

SEQ ID NO: 4208846 - DNA, 22 bp, Homo sapiens
gtttggcttaagcaacagataa

SEQ ID NO: 4208847 - DNA, 15 bp, Homo sapiens
gtttgtataacttct

SEQ ID NO: 4208848 - DNA, 16 bp, Homo sapiens
gtttgtataacttctt

SEQ ID NO: 4208849 - DNA, 13 bp, Homo sapiens
gtttgtctgtgtg

SEQ ID NO: 4208850 - DNA, 18 bp, Homo sapiens
gtttgtttctccccctgg

SEQ ID NO: 4208851 - DNA, 22 bp, Homo sapiens
gttttaacaatttcctttatat

SEQ ID NO: 4208852 - DNA, 21 bp, Homo sapiens
gttttacaaatttttcctgca

SEQ ID NO: 4208853 - DNA, 18 bp, Homo sapiens
gttttatactgtacttaa

SEQ ID NO: 4208854 - DNA, 21 bp, Homo sapiens
gttttatgagaaagccttctt

SEQ ID NO: 4208855 - DNA, 21 bp, Homo sapiens
gttttattttttattgttttc

SEQ ID NO: 4208856 - DNA, 19 bp, Homo sapiens
gttttcacatacactcaaa

SEQ ID NO: 4208857 - DNA, 16 bp, Homo sapiens
gttttccaccctggaa

SEQ ID NO: 4208858 - DNA, 17 bp, Homo sapiens
gttttcctatgctttga

SEQ ID NO: 4208859 - DNA, 18 bp, Homo sapiens
gttttctccaagagctac

SEQ ID NO: 4208860 - DNA, 19 bp, Homo sapiens
gttttgacttaagtagaag

SEQ ID NO: 4208861 - DNA, 17 bp, Homo sapiens
gttttgtctctgcatct

SEQ ID NO: 4208862 - DNA, 14 bp, Homo sapiens
gttttgtttcttga

SEQ ID NO: 4208863 - DNA, 14 bp, Homo sapiens
gtttttactccagt

SEQ ID NO: 4208864 - DNA, 19 bp, Homo sapiens
gtttttctacttttaaaga

SEQ ID NO: 4208865 - DNA, 14 bp, Homo sapiens
gttttttctgtaca

SEQ ID NO: 4208866 - DNA, 20 bp, Homo sapiens
taaaaaaataagaagaatgc

SEQ ID NO: 4208867 - DNA, 12 bp, Homo sapiens
taaaaaagattt

SEQ ID NO: 4208868 - DNA, 17 bp, Homo sapiens
taaaaaagatttgtaga

SEQ ID NO: 4208869 - DNA, 20 bp, Homo sapiens
taaaaaagcttaaaactttg

SEQ ID NO: 4208870 - DNA, 18 bp, Homo sapiens
taaaaacaaagaaataaa

SEQ ID NO: 4208871 - DNA, 17 bp, Homo sapiens
taaaaacttcagaaaaa

SEQ ID NO: 4208872 - DNA, 13 bp, Homo sapiens
taaaaagctcttt

SEQ ID NO: 4208873 - DNA, 22 bp, Homo sapiens
taaaaatgtgaatctcttaatt

SEQ ID NO: 4208874 - DNA, 20 bp, Homo sapiens
taaaacatttattttgacat

SEQ ID NO: 4208875 - DNA, 20 bp, Homo sapiens
taaaaccaactaaataaaaa

SEQ ID NO: 4208876 - DNA, 23 bp, Homo sapiens
taaaaccaactaaataaaaaatt

SEQ ID NO: 4208877 - DNA, 17 bp, Homo sapiens
taaaaccacagaacagt

SEQ ID NO: 4208878 - DNA, 21 bp, Homo sapiens
taaaaccccagccaactcatt

SEQ ID NO: 4208879 - DNA, 13 bp, Homo sapiens
taaaacctttcaa

SEQ ID NO: 4208880 - DNA, 17 bp, Homo sapiens
taaaacgttttctcttc

SEQ ID NO: 4208881 - DNA, 16 bp, Homo sapiens
gagcgcctcttcctct

SEQ ID NO: 4208882 - DNA, 21 bp, Homo sapiens
gagcgcctcttcctctgggca

SEQ ID NO: 4208883 - DNA, 18 bp, Homo sapiens
gagcgctttctggaaaag

SEQ ID NO: 4208884 - DNA, 15 bp, Homo sapiens
gagctacgtatttaa

SEQ ID NO: 4208885 - DNA, 19 bp, Homo sapiens
gagctactctcttgccagc

SEQ ID NO: 4208886 - DNA, 14 bp, Homo sapiens
gagctcagctcact

SEQ ID NO: 4208887 - DNA, 12 bp, Homo sapiens
gagctcagctcg

SEQ ID NO: 4208888 - DNA, 20 bp, Homo sapiens
gagctcaggccctggtgagg

SEQ ID NO: 4208889 - DNA, 12 bp, Homo sapiens
gagctctctgct

SEQ ID NO: 4208890 - DNA, 16 bp, Homo sapiens
gagctctctgctgagc

SEQ ID NO: 4208891 - DNA, 17 bp, Homo sapiens
gagctctgtatggtcag

SEQ ID NO: 4208892 - DNA, 23 bp, Homo sapiens
gagctgaacccattttgagtgac

SEQ ID NO: 4208893 - DNA, 17 bp, Homo sapiens
gagctgagatcacgcca

SEQ ID NO: 4208894 - DNA, 23 bp, Homo sapiens
gagctgaggggggccgtgcccag

SEQ ID NO: 4208895 - DNA, 19 bp, Homo sapiens
gagctgatggagaaggaag

SEQ ID NO: 4208896 - DNA, 13 bp, Homo sapiens
gagctgctctgct

SEQ ID NO: 4208897 - DNA, 16 bp, Homo sapiens
gagctgctctggaaaa

SEQ ID NO: 4208898 - DNA, 22 bp, Homo sapiens
gagctgctggctgacctgggcc

SEQ ID NO: 4208899 - DNA, 12 bp, Homo sapiens
gagctggaaata

SEQ ID NO: 4208900 - DNA, 23 bp, Homo sapiens
gagctggaaataaacctggagat

SEQ ID NO: 4208901 - DNA, 19 bp, Homo sapiens
gagctggggtacaggtttg

SEQ ID NO: 4208902 - DNA, 20 bp, Homo sapiens
gagctgtggactttgttcac

SEQ ID NO: 4208903 - DNA, 11 bp, Homo sapiens
gagcttgcctg

SEQ ID NO: 4208904 - DNA, 15 bp, Homo sapiens
gagcttgcctgcctg

SEQ ID NO: 4208905 - DNA, 14 bp, Homo sapiens
gagctttctagcct

SEQ ID NO: 4208906 - DNA, 13 bp, Homo sapiens
gaggaaagacaca

SEQ ID NO: 4208907 - DNA, 14 bp, Homo sapiens
gaggaagactctgg

SEQ ID NO: 4208908 - DNA, 19 bp, Homo sapiens
gaggaagcacactgcaggg

SEQ ID NO: 4208909 - DNA, 12 bp, Homo sapiens
gaggaagcacat

SEQ ID NO: 4208910 - DNA, 12 bp, Homo sapiens
gaggacacatgt

SEQ ID NO: 4208911 - DNA, 21 bp, Homo sapiens
gaggacatgtttttgttttct

SEQ ID NO: 4208912 - DNA, 16 bp, Homo sapiens
gaggaggcagagaaga

SEQ ID NO: 4208913 - DNA, 19 bp, Homo sapiens
gaggagggatgctgcctga

SEQ ID NO: 4208914 - DNA, 18 bp, Homo sapiens
gaggaggtggcagccctg

SEQ ID NO: 4208915 - DNA, 17 bp, Homo sapiens
gaggcagagaaagaaga

SEQ ID NO: 4208916 - DNA, 13 bp, Homo sapiens
gaggcaggagaat

SEQ ID NO: 4208917 - DNA, 19 bp, Homo sapiens
gaggccaggaatctgccat

SEQ ID NO: 4208918 - DNA, 21 bp, Homo sapiens
gaggcccagcctgtcctggta

SEQ ID NO: 4208919 - DNA, 23 bp, Homo sapiens
gaggcctgccctcagggatcttg

SEQ ID NO: 4208920 - DNA, 15 bp, Homo sapiens
gaggcctggccaggc

SEQ ID NO: 4208921 - DNA, 19 bp, Homo sapiens
gaggcgggtggatcacctg

SEQ ID NO: 4208922 - DNA, 22 bp, Homo sapiens
gaggctcctgtgctactttgcc

SEQ ID NO: 4208923 - DNA, 16 bp, Homo sapiens
gaggctgagacaggag

SEQ ID NO: 4208924 - DNA, 15 bp, Homo sapiens
gaggctgaggcagga

SEQ ID NO: 4208925 - DNA, 16 bp, Homo sapiens
gaggctgaggcaggag

SEQ ID NO: 4208926 - DNA, 12 bp, Homo sapiens
gaggctgaggcg

SEQ ID NO: 4208927 - DNA, 13 bp, Homo sapiens
gaggctggggctc

SEQ ID NO: 4208928 - DNA, 15 bp, Homo sapiens
gaggcttggaaagca

SEQ ID NO: 4208929 - DNA, 16 bp, Homo sapiens
gagggaatgggacagg

SEQ ID NO: 4208930 - DNA, 13 bp, Homo sapiens
gagggagctgctg

SEQ ID NO: 4208931 - DNA, 16 bp, Homo sapiens
gagggagctgctggct

SEQ ID NO: 4208932 - DNA, 23 bp, Homo sapiens
gagggaggtggggcatggtttta

SEQ ID NO: 4208933 - DNA, 20 bp, Homo sapiens
gagggatgctgcctgagtca

SEQ ID NO: 4208934 - DNA, 17 bp, Homo sapiens
gagggatgtaactattg

SEQ ID NO: 4208935 - DNA, 19 bp, Homo sapiens
gagggattttagcctcttc

SEQ ID NO: 4208936 - DNA, 14 bp, Homo sapiens
gagggcagccccga

SEQ ID NO: 4208937 - DNA, 18 bp, Homo sapiens
gagggcagccccgacccc

SEQ ID NO: 4208938 - DNA, 16 bp, Homo sapiens
gagggctactcagcag

SEQ ID NO: 4208939 - DNA, 13 bp, Homo sapiens
gagggctgggccc

SEQ ID NO: 4208940 - DNA, 20 bp, Homo sapiens
gaggggacccagctcctctg

SEQ ID NO: 4208941 - DNA, 22 bp, Homo sapiens
gaggggacccagctcctctgag

SEQ ID NO: 4208942 - DNA, 23 bp, Homo sapiens
gaggggacccagctcctctgagc

SEQ ID NO: 4208943 - DNA, 15 bp, Homo sapiens
gaggggcagaacaga

SEQ ID NO: 4208944 - DNA, 12 bp, Homo sapiens
gaggggcaggga

SEQ ID NO: 4208945 - DNA, 22 bp, Homo sapiens
gaggggcagggagagcgcctct

SEQ ID NO: 4208946 - DNA, 12 bp, Homo sapiens
gaggggctcctg

SEQ ID NO: 4208947 - DNA, 18 bp, Homo sapiens
gaggggtaggcagagcct

SEQ ID NO: 4208948 - DNA, 15 bp, Homo sapiens
gaggggtgacagtgg

SEQ ID NO: 4208949 - DNA, 17 bp, Homo sapiens
gaggggttgcgggggag

SEQ ID NO: 4208950 - DNA, 18 bp, Homo sapiens
gaggggttgcgggggagc

SEQ ID NO: 4208951 - DNA, 19 bp, Homo sapiens
gaggtagagtttgaaggag

SEQ ID NO: 4208952 - DNA, 14 bp, Homo sapiens
gaggtagcgagctg

SEQ ID NO: 4208953 - DNA, 22 bp, Homo sapiens
gaggtcaagcctgcagcgagct

SEQ ID NO: 4208954 - DNA, 22 bp, Homo sapiens
gaggtcacattcaggaagatga

SEQ ID NO: 4208955 - DNA, 15 bp, Homo sapiens
gaggtccaggcagga

SEQ ID NO: 4208956 - DNA, 17 bp, Homo sapiens
gaggtccaggcaggagg

SEQ ID NO: 4208957 - DNA, 22 bp, Homo sapiens
gaggtcgaccccaaagcccctt

SEQ ID NO: 4208958 - DNA, 16 bp, Homo sapiens
gaggtctccactgagg

SEQ ID NO: 4208959 - DNA, 22 bp, Homo sapiens
gaggtctccactgaggatgtga

SEQ ID NO: 4208960 - DNA, 19 bp, Homo sapiens
gaggtggattcctgggcaa

SEQ ID NO: 4208961 - DNA, 18 bp, Homo sapiens
gaggtggcagccctgtag

SEQ ID NO: 4208962 - DNA, 22 bp, Homo sapiens
gaggtggtagaaccacttggct

SEQ ID NO: 4208963 - DNA, 15 bp, Homo sapiens
gaggtgtcaccctgc

SEQ ID NO: 4208964 - DNA, 21 bp, Homo sapiens
gaggtgtcaccctgcagagct

SEQ ID NO: 4208965 - DNA, 22 bp, Homo sapiens
gaggtgtcaccctgcagagcta

SEQ ID NO: 4208966 - DNA, 13 bp, Homo sapiens
gaggttgcaggga

SEQ ID NO: 4208967 - DNA, 20 bp, Homo sapiens
gattctagccaaactattct

SEQ ID NO: 4208968 - DNA, 15 bp, Homo sapiens
gattctgggaggaag

SEQ ID NO: 4208969 - DNA, 19 bp, Homo sapiens
gattgacctataaaacaaa

SEQ ID NO: 4208970 - DNA, 12 bp, Homo sapiens
gattgagaagcc

SEQ ID NO: 4208971 - DNA, 14 bp, Homo sapiens
gattgagaagccat

SEQ ID NO: 4208972 - DNA, 18 bp, Homo sapiens
gattggctcacccaagca

SEQ ID NO: 4208973 - DNA, 22 bp, Homo sapiens
gattggctcacccaagcaaggc

SEQ ID NO: 4208974 - DNA, 20 bp, Homo sapiens
gattgtaaaatagcttgtat

SEQ ID NO: 4208975 - DNA, 18 bp, Homo sapiens
gattgtataatgtgattt

SEQ ID NO: 4208976 - DNA, 13 bp, Homo sapiens
gattgttcatcat

SEQ ID NO: 4208977 - DNA, 12 bp, Homo sapiens
gattgttttatc

SEQ ID NO: 4208978 - DNA, 21 bp, Homo sapiens
gatttaacaaatacattcata

SEQ ID NO: 4208979 - DNA, 22 bp, Homo sapiens
gatttaacactaaaattccact

SEQ ID NO: 4208980 - DNA, 15 bp, Homo sapiens
gatttaactgtgaac

SEQ ID NO: 4208981 - DNA, 16 bp, Homo sapiens
gatttagggaagcagg

SEQ ID NO: 4208982 - DNA, 18 bp, Homo sapiens
gatttatttaaaatagca

SEQ ID NO: 4208983 - DNA, 20 bp, Homo sapiens
gatttcaggatactctgtca

SEQ ID NO: 4208984 - DNA, 10 bp, Homo sapiens
gatttctgag

SEQ ID NO: 4208985 - DNA, 16 bp, Homo sapiens
gatttgaagcaaagca

SEQ ID NO: 4208986 - DNA, 19 bp, Homo sapiens
gatttggaagagaggcacc

SEQ ID NO: 4208987 - DNA, 23 bp, Homo sapiens
gatttggaagagaggcacctgct

SEQ ID NO: 4208988 - DNA, 22 bp, Homo sapiens
gatttgtgaactggaagaaagc

SEQ ID NO: 4208989 - DNA, 14 bp, Homo sapiens
gattttagttcact

SEQ ID NO: 4208990 - DNA, 19 bp, Homo sapiens
gattttttaataatttaga

SEQ ID NO: 4208991 - DNA, 15 bp, Homo sapiens
gcaaaaaagaaaacc

SEQ ID NO: 4208992 - DNA, 23 bp, Homo sapiens
gcaaaaatagtttggatatgtaa

SEQ ID NO: 4208993 - DNA, 15 bp, Homo sapiens
gcaaaagaagaagtt

SEQ ID NO: 4208994 - DNA, 18 bp, Homo sapiens
gcaaaagaagtaaaagct

SEQ ID NO: 4208995 - DNA, 16 bp, Homo sapiens
gcaaaaggctgagaag

SEQ ID NO: 4208996 - DNA, 15 bp, Homo sapiens
gcaaacaccagtgag

SEQ ID NO: 4208997 - DNA, 18 bp, Homo sapiens
gcaaaccatttcaaatgg

SEQ ID NO: 4208998 - DNA, 22 bp, Homo sapiens
gcaaacctcagtcatattctta

SEQ ID NO: 4208999 - DNA, 15 bp, Homo sapiens
gcaaagaactgcccc

SEQ ID NO: 4209000 - DNA, 14 bp, Homo sapiens
gcaaagaattgact

SEQ ID NO: 4209001 - DNA, 21 bp, Homo sapiens
gcaaagcaaaaggctgagaag

SEQ ID NO: 4209002 - DNA, 13 bp, Homo sapiens
gcaaagcaccagc

SEQ ID NO: 4209003 - DNA, 13 bp, Homo sapiens
gcaaagcctcctt

SEQ ID NO: 4209004 - DNA, 15 bp, Homo sapiens
gcaaaggaaaccaaa

SEQ ID NO: 4209005 - DNA, 15 bp, Homo sapiens
gcaaagggctgaaag

SEQ ID NO: 4209006 - DNA, 22 bp, Homo sapiens
gcaaagggctgaaagccatttg

SEQ ID NO: 4209007 - DNA, 21 bp, Homo sapiens
gcaaagtctaaagtttacagt

SEQ ID NO: 4209008 - DNA, 22 bp, Homo sapiens
gcaaagtctaaagtttacagta

SEQ ID NO: 4209009 - DNA, 22 bp, Homo sapiens
gcaaatcgaatgaaattaactg

SEQ ID NO: 4209010 - DNA, 17 bp, Homo sapiens
gcaacaaagattgagaa

SEQ ID NO: 4209011 - DNA, 18 bp, Homo sapiens
gcaacaagagcaaaatga

SEQ ID NO: 4209012 - DNA, 23 bp, Homo sapiens
gcaacacaagctggaagcacatg

SEQ ID NO: 4209013 - DNA, 19 bp, Homo sapiens
gcaacagagtgagaccctg

SEQ ID NO: 4209014 - DNA, 16 bp, Homo sapiens
gcaacagctgtgtgtg

SEQ ID NO: 4209015 - DNA, 19 bp, Homo sapiens
gcaacatggtccagtttct

SEQ ID NO: 4209016 - DNA, 16 bp, Homo sapiens
gcaagaaggcaaaaat

SEQ ID NO: 4209017 - DNA, 13 bp, Homo sapiens
gcaagacacaggc

SEQ ID NO: 4209018 - DNA, 16 bp, Homo sapiens
gcaagatttaacacta

SEQ ID NO: 4209019 - DNA, 17 bp, Homo sapiens
gcaagcattcagaagaa

SEQ ID NO: 4209020 - DNA, 18 bp, Homo sapiens
gcaagcattcagaagaaa

SEQ ID NO: 4209021 - DNA, 15 bp, Homo sapiens
gcaagctggatgcag

SEQ ID NO: 4209022 - DNA, 19 bp, Homo sapiens
gcaagctggatgcagtggc

SEQ ID NO: 4209023 - DNA, 19 bp, Homo sapiens
gcaaggacaacctgcccct

SEQ ID NO: 4209024 - DNA, 19 bp, Homo sapiens
gcaagggccatgctgaagg

SEQ ID NO: 4209025 - DNA, 15 bp, Homo sapiens
ctgtgtattttgaga

SEQ ID NO: 4209026 - DNA, 16 bp, Homo sapiens
ctgtgtcccttttgca

SEQ ID NO: 4209027 - DNA, 19 bp, Homo sapiens
ctgtgtccgtctgtgtatg

SEQ ID NO: 4209028 - DNA, 13 bp, Homo sapiens
ctgtgtctcacag

SEQ ID NO: 4209029 - DNA, 13 bp, Homo sapiens
ctgtgtctgcacc

SEQ ID NO: 4209030 - DNA, 15 bp, Homo sapiens
ctgtgtgatgaactt

SEQ ID NO: 4209031 - DNA, 18 bp, Homo sapiens
ctgtgtgatgaactttct

SEQ ID NO: 4209032 - DNA, 19 bp, Homo sapiens
ctgtgtgatgaactttctc

SEQ ID NO: 4209033 - DNA, 15 bp, Homo sapiens
ctgtgtgcagtgaag

SEQ ID NO: 4209034 - DNA, 18 bp, Homo sapiens
ctgtgtgtacatgtacat

SEQ ID NO: 4209035 - DNA, 17 bp, Homo sapiens
ctgtgtttggctttcag

SEQ ID NO: 4209036 - DNA, 18 bp, Homo sapiens
ctgtgtttggctttcagg

SEQ ID NO: 4209037 - DNA, 23 bp, Homo sapiens
ctgtgtttggctttcagggaggc

SEQ ID NO: 4209038 - DNA, 13 bp, Homo sapiens
ctgttcttggtaa

SEQ ID NO: 4209039 - DNA, 21 bp, Homo sapiens
ctgttgaaaattattttaaac

SEQ ID NO: 4209040 - DNA, 14 bp, Homo sapiens
ctgttgagacttag

SEQ ID NO: 4209041 - DNA, 22 bp, Homo sapiens
ctgttgagtgcaacaagagcaa

SEQ ID NO: 4209042 - DNA, 23 bp, Homo sapiens
ctgttgagtgcaacaagagcaaa

SEQ ID NO: 4209043 - DNA, 16 bp, Homo sapiens
ctgttgcgctcccgca

SEQ ID NO: 4209044 - DNA, 16 bp, Homo sapiens
ctgttggaagttcact

SEQ ID NO: 4209045 - DNA, 17 bp, Homo sapiens
ctgttggaatgtatgct

SEQ ID NO: 4209046 - DNA, 23 bp, Homo sapiens
ctgtttaccaaggaaagaacaaa

SEQ ID NO: 4209047 - DNA, 15 bp, Homo sapiens
ctgtttactgcaagg

SEQ ID NO: 4209048 - DNA, 15 bp, Homo sapiens
ctgtttcttacctta

SEQ ID NO: 4209049 - DNA, 15 bp, Homo sapiens
ctgttttagctgagg

SEQ ID NO: 4209050 - DNA, 14 bp, Homo sapiens
ctgttttatactgt

SEQ ID NO: 4209051 - DNA, 19 bp, Homo sapiens
ctgttttccaaagataatg

SEQ ID NO: 4209052 - DNA, 13 bp, Homo sapiens
ctgttttgtttct

SEQ ID NO: 4209053 - DNA, 16 bp, Homo sapiens
ctgttttgtttcttga

SEQ ID NO: 4209054 - DNA, 15 bp, Homo sapiens
ctgtttttgctatta

SEQ ID NO: 4209055 - DNA, 16 bp, Homo sapiens
cttaaaaagtaattgt

SEQ ID NO: 4209056 - DNA, 12 bp, Homo sapiens
cttaaaactttg

SEQ ID NO: 4209057 - DNA, 21 bp, Homo sapiens
cttaaagaaagtcgaattaat

SEQ ID NO: 4209058 - DNA, 18 bp, Homo sapiens
cttaaagctgcctgtagt

SEQ ID NO: 4209059 - DNA, 13 bp, Homo sapiens
cttaaataagaaa

SEQ ID NO: 4209060 - DNA, 22 bp, Homo sapiens
cttaaatattgaataagtattc

SEQ ID NO: 4209061 - DNA, 20 bp, Homo sapiens
cttaaattatatatttattt

SEQ ID NO: 4209062 - DNA, 19 bp, Homo sapiens
cttaacatggaagatattc

SEQ ID NO: 4209063 - DNA, 17 bp, Homo sapiens
cttaaggtgtagccaca

SEQ ID NO: 4209064 - DNA, 18 bp, Homo sapiens
cttaataaattcagatat

SEQ ID NO: 4209065 - DNA, 22 bp, Homo sapiens
cttaatcaagaatattcaaatg

SEQ ID NO: 4209066 - DNA, 18 bp, Homo sapiens
cttacaaattctacagca

SEQ ID NO: 4209067 - DNA, 16 bp, Homo sapiens
cttacataatttttta

SEQ ID NO: 4209068 - DNA, 23 bp, Homo sapiens
cttaccaaaacagatggtagaga

SEQ ID NO: 4209069 - DNA, 16 bp, Homo sapiens
cttaccaactttctgt

SEQ ID NO: 4209070 - DNA, 19 bp, Homo sapiens
cttaccaactttctgtaaa

SEQ ID NO: 4209071 - DNA, 20 bp, Homo sapiens
cttaccacgttactgcatac

SEQ ID NO: 4209072 - DNA, 20 bp, Homo sapiens
cttaccaggcaccaaaagaa

SEQ ID NO: 4209073 - DNA, 15 bp, Homo sapiens
cttaccccagctgcg

SEQ ID NO: 4209074 - DNA, 23 bp, Homo sapiens
cttactaatgtgccccatgtcca

SEQ ID NO: 4209075 - DNA, 19 bp, Homo sapiens
cttactcacctctctctaa

SEQ ID NO: 4209076 - DNA, 15 bp, Homo sapiens
cttagaagcatcaga

SEQ ID NO: 4209077 - DNA, 11 bp, Homo sapiens
cttagaataaa

SEQ ID NO: 4209078 - DNA, 12 bp, Homo sapiens
cttagaattctg

SEQ ID NO: 4209079 - DNA, 15 bp, Homo sapiens
cttagaattctgaga

SEQ ID NO: 4209080 - DNA, 16 bp, Homo sapiens
cttagatctggcatgt

SEQ ID NO: 4209081 - DNA, 12 bp, Homo sapiens
cttagctggaga

SEQ ID NO: 4209082 - DNA, 14 bp, Homo sapiens
cttaggaagaaatc

SEQ ID NO: 4209083 - DNA, 14 bp, Homo sapiens
cttaggctgctggg

SEQ ID NO: 4209084 - DNA, 23 bp, Homo sapiens
cttaggtaatttggaagaaaact

SEQ ID NO: 4209085 - DNA, 18 bp, Homo sapiens
cttaggtgccaggctgta

SEQ ID NO: 4209086 - DNA, 17 bp, Homo sapiens
cttagtttttaccttgt

SEQ ID NO: 4209087 - DNA, 22 bp, Homo sapiens
cttataagtgggagctaaataa

SEQ ID NO: 4209088 - DNA, 15 bp, Homo sapiens
cttatagaaagcact

SEQ ID NO: 4209089 - DNA, 13 bp, Homo sapiens
cttatatataata

SEQ ID NO: 4209090 - DNA, 18 bp, Homo sapiens
cttatatgtgtattgcta

SEQ ID NO: 4209091 - DNA, 22 bp, Homo sapiens
cttatcactggcgcagacttca

SEQ ID NO: 4209092 - DNA, 13 bp, Homo sapiens
cttatcttctgga

SEQ ID NO: 4209093 - DNA, 14 bp, Homo sapiens
cttatgcttaaaat

SEQ ID NO: 4209094 - DNA, 18 bp, Homo sapiens
cttatgcttaaaatgcca

SEQ ID NO: 4209095 - DNA, 21 bp, Homo sapiens
cttattaacaattaggcagac

SEQ ID NO: 4209096 - DNA, 22 bp, Homo sapiens
cttattcatgctttctcctttt

SEQ ID NO: 4209097 - DNA, 20 bp, Homo sapiens
cttattcccaactgctctgc

SEQ ID NO: 4209098 - DNA, 12 bp, Homo sapiens
cttatttgagtg

SEQ ID NO: 4209099 - DNA, 16 bp, Homo sapiens
cttcaaatccatccag

SEQ ID NO: 4209100 - DNA, 17 bp, Homo sapiens
cttcaaatccatccaga

SEQ ID NO: 4209101 - DNA, 16 bp, Homo sapiens
cttcaaatgcctgact

SEQ ID NO: 4209102 - DNA, 12 bp, Homo sapiens
cttcaagctctc

SEQ ID NO: 4209103 - DNA, 13 bp, Homo sapiens
cttcaagctctct

SEQ ID NO: 4209104 - DNA, 19 bp, Homo sapiens
cttcaagtgccaaacagag

SEQ ID NO: 4209105 - DNA, 16 bp, Homo sapiens
cttcaagttagctcag

SEQ ID NO: 4209106 - DNA, 18 bp, Homo sapiens
cttcaagttagctcagga

SEQ ID NO: 4209107 - DNA, 15 bp, Homo sapiens
cttcaattcctgggc

SEQ ID NO: 4209108 - DNA, 14 bp, Homo sapiens
cttcactcagccac

SEQ ID NO: 4209109 - DNA, 22 bp, Homo sapiens
cttcactccggtgtgcctgcag

SEQ ID NO: 4209110 - DNA, 19 bp, Homo sapiens
cttcactcttcaaatgcct

SEQ ID NO: 4209111 - DNA, 17 bp, Homo sapiens
cttcagaagacactgca

SEQ ID NO: 4209112 - DNA, 18 bp, Homo sapiens
cttcagcagcatctactc

SEQ ID NO: 4209113 - DNA, 18 bp, Homo sapiens
cttcagcatatttatagc

SEQ ID NO: 4209114 - DNA, 10 bp, Homo sapiens
cttcaggtcc

SEQ ID NO: 4209115 - DNA, 21 bp, Homo sapiens
cttcatactttttttcacagt

SEQ ID NO: 4209116 - DNA, 20 bp, Homo sapiens
cttcatccacccatgtttat

SEQ ID NO: 4209117 - DNA, 19 bp, Homo sapiens
cttcatctggattccagag

SEQ ID NO: 4209118 - DNA, 19 bp, Homo sapiens
cttcatgctcagccctgac

SEQ ID NO: 4209119 - DNA, 16 bp, Homo sapiens
cttccagaaaacaaaa

SEQ ID NO: 4209120 - DNA, 19 bp, Homo sapiens
cttccaggcccccaccact

SEQ ID NO: 4209121 - DNA, 21 bp, Homo sapiens
cttccatccccaaactgtgcc

SEQ ID NO: 4209122 - DNA, 11 bp, Homo sapiens
cttcccagagg

SEQ ID NO: 4209123 - DNA, 12 bp, Homo sapiens
cttcccagaggc

SEQ ID NO: 4209124 - DNA, 13 bp, Homo sapiens
cttcccagaggcc

SEQ ID NO: 4209125 - DNA, 17 bp, Homo sapiens
cttccccaggagctctc

SEQ ID NO: 4209126 - DNA, 21 bp, Homo sapiens
cttccccaggagctctctgct

SEQ ID NO: 4209127 - DNA, 13 bp, Homo sapiens
cttcccccatccc

SEQ ID NO: 4209128 - DNA, 16 bp, Homo sapiens
cttccccctcccaggg

SEQ ID NO: 4209129 - DNA, 13 bp, Homo sapiens
cttcccctttccc

SEQ ID NO: 4209130 - DNA, 22 bp, Homo sapiens
cttccctctttccccacctctt

SEQ ID NO: 4209131 - DNA, 16 bp, Homo sapiens
cttccctgacactgtc

SEQ ID NO: 4209132 - DNA, 15 bp, Homo sapiens
cttccctgttttaaa

SEQ ID NO: 4209133 - DNA, 20 bp, Homo sapiens
cttccgtggtcagagtgcca

SEQ ID NO: 4209134 - DNA, 19 bp, Homo sapiens
cttcctaaatattatgaga

SEQ ID NO: 4209135 - DNA, 22 bp, Homo sapiens
cttcctaaatattatgagatgc

SEQ ID NO: 4209136 - DNA, 16 bp, Homo sapiens
cttcctctgggcagcg

SEQ ID NO: 4209137 - DNA, 17 bp, Homo sapiens
cttcctctgggcagcgc

SEQ ID NO: 4209138 - DNA, 19 bp, Homo sapiens
cttcctggtgaggcccagc

SEQ ID NO: 4209139 - DNA, 20 bp, Homo sapiens
cttcctggtgaggcccagcc

SEQ ID NO: 4209140 - DNA, 23 bp, Homo sapiens
cttcctggtgaggcccagcctgt

SEQ ID NO: 4209141 - DNA, 18 bp, Homo sapiens
gcataagattaaaggaag

SEQ ID NO: 4209142 - DNA, 19 bp, Homo sapiens
gcataagattaaaggaagg

SEQ ID NO: 4209143 - DNA, 19 bp, Homo sapiens
gcatagagggagaggaagc

SEQ ID NO: 4209144 - DNA, 17 bp, Homo sapiens
gcatagctgttttagct

SEQ ID NO: 4209145 - DNA, 15 bp, Homo sapiens
gcataggctgcccaa

SEQ ID NO: 4209146 - DNA, 16 bp, Homo sapiens
gcatcaagggctttat

SEQ ID NO: 4209147 - DNA, 14 bp, Homo sapiens
gcatcacagggcag

SEQ ID NO: 4209148 - DNA, 17 bp, Homo sapiens
gcatcacagggcagagc

SEQ ID NO: 4209149 - DNA, 12 bp, Homo sapiens
gcatccctgtgt

SEQ ID NO: 4209150 - DNA, 19 bp, Homo sapiens
gcatctcattgtagagctt

SEQ ID NO: 4209151 - DNA, 20 bp, Homo sapiens
gcatctgggattcccaccaa

SEQ ID NO: 4209152 - DNA, 23 bp, Homo sapiens
gcatctgggattcccaccaaggt

SEQ ID NO: 4209153 - DNA, 13 bp, Homo sapiens
gcatctgtttatt

SEQ ID NO: 4209154 - DNA, 19 bp, Homo sapiens
gcatgaacagggtccctgg

SEQ ID NO: 4209155 - DNA, 15 bp, Homo sapiens
gcatggctattttat

SEQ ID NO: 4209156 - DNA, 22 bp, Homo sapiens
gcatggggataaaggagaaggc

SEQ ID NO: 4209157 - DNA, 13 bp, Homo sapiens
gcatggtgcagtt

SEQ ID NO: 4209158 - DNA, 16 bp, Homo sapiens
gcattagaaatagaca

SEQ ID NO: 4209159 - DNA, 13 bp, Homo sapiens
gcattcccagtgg

SEQ ID NO: 4209160 - DNA, 21 bp, Homo sapiens
gcattctaccactacattttg

SEQ ID NO: 4209161 - DNA, 21 bp, Homo sapiens
gcattgaatggctatgttttt

SEQ ID NO: 4209162 - DNA, 13 bp, Homo sapiens
gcattgcatggac

SEQ ID NO: 4209163 - DNA, 18 bp, Homo sapiens
gcatttactatgccacag

SEQ ID NO: 4209164 - DNA, 22 bp, Homo sapiens
gcatttctcatgcttcttctca

SEQ ID NO: 4209165 - DNA, 15 bp, Homo sapiens
gcatttgccattcct

SEQ ID NO: 4209166 - DNA, 19 bp, Homo sapiens
gcatttgccctgtggattc

SEQ ID NO: 4209167 - DNA, 20 bp, Homo sapiens
gcatttttgatttatgcatg

SEQ ID NO: 4209168 - DNA, 21 bp, Homo sapiens
gcatttttgatttatgcatgg

SEQ ID NO: 4209169 - DNA, 16 bp, Homo sapiens
gccaaaaaaaaataca

SEQ ID NO: 4209170 - DNA, 19 bp, Homo sapiens
gccaaattatttgtgtaat

SEQ ID NO: 4209171 - DNA, 19 bp, Homo sapiens
gccaacaggtggcaggacc

SEQ ID NO: 4209172 - DNA, 14 bp, Homo sapiens
gccaacgacaaagc

SEQ ID NO: 4209173 - DNA, 16 bp, Homo sapiens
gccaagagcagaggca

SEQ ID NO: 4209174 - DNA, 12 bp, Homo sapiens
gccaagcctggc

SEQ ID NO: 4209175 - DNA, 13 bp, Homo sapiens
gccaagcctggcc

SEQ ID NO: 4209176 - DNA, 15 bp, Homo sapiens
gccaagcctggccct

SEQ ID NO: 4209177 - DNA, 23 bp, Homo sapiens
gccaaggagtcagatggcaatgg

SEQ ID NO: 4209178 - DNA, 16 bp, Homo sapiens
gccaagggctaggctc

SEQ ID NO: 4209179 - DNA, 19 bp, Homo sapiens
gccaaggtgggctgagccc

SEQ ID NO: 4209180 - DNA, 21 bp, Homo sapiens
gccaaggtgggctgagccctg

SEQ ID NO: 4209181 - DNA, 14 bp, Homo sapiens
gccaagtctcagaa

SEQ ID NO: 4209182 - DNA, 15 bp, Homo sapiens
gccaagttcctctag

SEQ ID NO: 4209183 - DNA, 21 bp, Homo sapiens
gccaagttcctctagtgccct

SEQ ID NO: 4209184 - DNA, 21 bp, Homo sapiens
gccaatgcacctaaagaaaaa

SEQ ID NO: 4209185 - DNA, 18 bp, Homo sapiens
gccacaaaactctgtcag

SEQ ID NO: 4209186 - DNA, 21 bp, Homo sapiens
gccacaccaggatagagactg

SEQ ID NO: 4209187 - DNA, 21 bp, Homo sapiens
gccacattgacagtggtgggc

SEQ ID NO: 4209188 - DNA, 17 bp, Homo sapiens
gccaccaggatggccct

SEQ ID NO: 4209189 - DNA, 22 bp, Homo sapiens
gccaccatattcagtgctgtgg

SEQ ID NO: 4209190 - DNA, 14 bp, Homo sapiens
gccaccatcctgct

SEQ ID NO: 4209191 - DNA, 15 bp, Homo sapiens
gccaccatcctgctg

SEQ ID NO: 4209192 - DNA, 16 bp, Homo sapiens
gccacccagcaacaca

SEQ ID NO: 4209193 - DNA, 15 bp, Homo sapiens
gccaccgctgccttt

SEQ ID NO: 4209194 - DNA, 10 bp, Homo sapiens
gccacctgtc

SEQ ID NO: 4209195 - DNA, 12 bp, Homo sapiens
gccacctgtctg

SEQ ID NO: 4209196 - DNA, 14 bp, Homo sapiens
gccacctgtctgtc

SEQ ID NO: 4209197 - DNA, 13 bp, Homo sapiens
gccacgctcaggc

SEQ ID NO: 4209198 - DNA, 15 bp, Homo sapiens
gccactacctttgtc

SEQ ID NO: 4209199 - DNA, 23 bp, Homo sapiens
gccactcgggaggctgagacagg

SEQ ID NO: 4209200 - DNA, 17 bp, Homo sapiens
gccactctcccctccct

SEQ ID NO: 4209201 - DNA, 21 bp, Homo sapiens
gccactgcactccagcctggg

SEQ ID NO: 4209202 - DNA, 21 bp, Homo sapiens
gccagcattttcacattttgc

SEQ ID NO: 4209203 - DNA, 12 bp, Homo sapiens
gccagcctggct

SEQ ID NO: 4209204 - DNA, 18 bp, Homo sapiens
gccagcctggcttctgga

SEQ ID NO: 4209205 - DNA, 15 bp, Homo sapiens
gccagctgtttccag

SEQ ID NO: 4209206 - DNA, 21 bp, Homo sapiens
gccaggaactggctcctttgc

SEQ ID NO: 4209207 - DNA, 16 bp, Homo sapiens
gccaggaatctgccat

SEQ ID NO: 4209208 - DNA, 19 bp, Homo sapiens
gccaggactccccaggcca

SEQ ID NO: 4209209 - DNA, 22 bp, Homo sapiens
gccaggactccccaggccaggc

SEQ ID NO: 4209210 - DNA, 12 bp, Homo sapiens
ctaagctgtgtg

SEQ ID NO: 4209211 - DNA, 14 bp, Homo sapiens
ctaagctgtgtgca

SEQ ID NO: 4209212 - DNA, 16 bp, Homo sapiens
ctaagctgtgtgcagg

SEQ ID NO: 4209213 - DNA, 14 bp, Homo sapiens
ctaagctttctcct

SEQ ID NO: 4209214 - DNA, 21 bp, Homo sapiens
ctaagtagatagaaagcaata

SEQ ID NO: 4209215 - DNA, 20 bp, Homo sapiens
ctaagtggggtgcatccccc

SEQ ID NO: 4209216 - DNA, 13 bp, Homo sapiens
ctaagtgtggaga

SEQ ID NO: 4209217 - DNA, 18 bp, Homo sapiens
ctaagtttagaagcgctc

SEQ ID NO: 4209218 - DNA, 19 bp, Homo sapiens
ctaatagaaccaagaattc

SEQ ID NO: 4209219 - DNA, 23 bp, Homo sapiens
ctaatagcgggttactttcacat

SEQ ID NO: 4209220 - DNA, 18 bp, Homo sapiens
ctaatattaaaaatatgg

SEQ ID NO: 4209221 - DNA, 18 bp, Homo sapiens
ctaatgacgatgccgtgt

SEQ ID NO: 4209222 - DNA, 15 bp, Homo sapiens
ctaattcaattcaaa

SEQ ID NO: 4209223 - DNA, 14 bp, Homo sapiens
ctaatttaaaaaat

SEQ ID NO: 4209224 - DNA, 20 bp, Homo sapiens
ctaatttttgtatttttcgt

SEQ ID NO: 4209225 - DNA, 20 bp, Homo sapiens
ctaatttttttgtattttag

SEQ ID NO: 4209226 - DNA, 15 bp, Homo sapiens
ctacaaccaatggaa

SEQ ID NO: 4209227 - DNA, 18 bp, Homo sapiens
ctacactccagcctgagc

SEQ ID NO: 4209228 - DNA, 21 bp, Homo sapiens
ctacagacttctccagaccca

SEQ ID NO: 4209229 - DNA, 15 bp, Homo sapiens
ctacataatttagtt

SEQ ID NO: 4209230 - DNA, 14 bp, Homo sapiens
ctacattctcatct

SEQ ID NO: 4209231 - DNA, 15 bp, Homo sapiens
ctacatttctgcaga

SEQ ID NO: 4209232 - DNA, 19 bp, Homo sapiens
ctacccagatggaaaaata

SEQ ID NO: 4209233 - DNA, 14 bp, Homo sapiens
ctacccggcccaga

SEQ ID NO: 4209234 - DNA, 15 bp, Homo sapiens
ctaccctgggctctg

SEQ ID NO: 4209235 - DNA, 18 bp, Homo sapiens
ctaccctgggctctggtc

SEQ ID NO: 4209236 - DNA, 13 bp, Homo sapiens
ctacctctgagaa

SEQ ID NO: 4209237 - DNA, 16 bp, Homo sapiens
ctacctctgagaagac

SEQ ID NO: 4209238 - DNA, 19 bp, Homo sapiens
ctacctttatagctcatca

SEQ ID NO: 4209239 - DNA, 18 bp, Homo sapiens
ctacctttatagctctca

SEQ ID NO: 4209240 - DNA, 14 bp, Homo sapiens
ctacctttttttct

SEQ ID NO: 4209241 - DNA, 19 bp, Homo sapiens
ctactcagaagcctgaggc

SEQ ID NO: 4209242 - DNA, 14 bp, Homo sapiens
ctactcattgtctc

SEQ ID NO: 4209243 - DNA, 16 bp, Homo sapiens
ctactcctacctcagc

SEQ ID NO: 4209244 - DNA, 23 bp, Homo sapiens
ctactctcttgccagcattttca

SEQ ID NO: 4209245 - DNA, 14 bp, Homo sapiens
ctactgcagcttta

SEQ ID NO: 4209246 - DNA, 16 bp, Homo sapiens
ctactttgcctcttca

SEQ ID NO: 4209247 - DNA, 22 bp, Homo sapiens
ctactttgcctcttcagcagca

SEQ ID NO: 4209248 - DNA, 18 bp, Homo sapiens
ctactttgtctaaaaata

SEQ ID NO: 4209249 - DNA, 16 bp, Homo sapiens
ctagaaacagatcttg

SEQ ID NO: 4209250 - DNA, 19 bp, Homo sapiens
ctagaacatccctgggcaa

SEQ ID NO: 4209251 - DNA, 13 bp, Homo sapiens
ctagaagcagaag

SEQ ID NO: 4209252 - DNA, 16 bp, Homo sapiens
ctagaatagccatgta

SEQ ID NO: 4209253 - DNA, 21 bp, Homo sapiens
ctagaattgagtgtttaaagt

SEQ ID NO: 4209254 - DNA, 14 bp, Homo sapiens
ctagactgtgtatg

SEQ ID NO: 4209255 - DNA, 15 bp, Homo sapiens
ctagactgtgtatgt

SEQ ID NO: 4209256 - DNA, 17 bp, Homo sapiens
ctagactgttactttgg

SEQ ID NO: 4209257 - DNA, 20 bp, Homo sapiens
ctagactgttactttggcaa

SEQ ID NO: 4209258 - DNA, 12 bp, Homo sapiens
ctagactttctc

SEQ ID NO: 4209259 - DNA, 14 bp, Homo sapiens
ctagactttctgtt

SEQ ID NO: 4209260 - DNA, 17 bp, Homo sapiens
ctagagaagaggctggt

SEQ ID NO: 4209261 - DNA, 10 bp, Homo sapiens
ctagagcctg

SEQ ID NO: 4209262 - DNA, 23 bp, Homo sapiens
ctagatcgtctctaatgttaggt

SEQ ID NO: 4209263 - DNA, 21 bp, Homo sapiens
ctagcattcagggttatacac

SEQ ID NO: 4209264 - DNA, 23 bp, Homo sapiens
ctaggaaagggaagcctgactgc

SEQ ID NO: 4209265 - DNA, 22 bp, Homo sapiens
ctaggactctgaggctctttct

SEQ ID NO: 4209266 - DNA, 12 bp, Homo sapiens
ctaggaggaaaa

SEQ ID NO: 4209267 - DNA, 20 bp, Homo sapiens
ctaggaggaaaagacagagc

SEQ ID NO: 4209268 - DNA, 21 bp, Homo sapiens
ctaggaggaaaagacagagcc

SEQ ID NO: 4209269 - DNA, 16 bp, Homo sapiens
ctaggatggttctgtg

SEQ ID NO: 4209270 - DNA, 22 bp, Homo sapiens
ctaggattcctcccccagagcc

SEQ ID NO: 4209271 - DNA, 19 bp, Homo sapiens
ctaggccacaccatctcct

SEQ ID NO: 4209272 - DNA, 16 bp, Homo sapiens
ctaggcgagtgccagg

SEQ ID NO: 4209273 - DNA, 20 bp, Homo sapiens
ctaggcgagtgccaggactc

SEQ ID NO: 4209274 - DNA, 13 bp, Homo sapiens
ctaggctgttttc

SEQ ID NO: 4209275 - DNA, 16 bp, Homo sapiens
ctaggtcctggcttct

SEQ ID NO: 4209276 - DNA, 21 bp, Homo sapiens
ctaggtttaaaacagcctggg

SEQ ID NO: 4209277 - DNA, 17 bp, Homo sapiens
ctagtagaaagaaaatg

SEQ ID NO: 4209278 - DNA, 20 bp, Homo sapiens
ctagtagaaagaaaatgtct

SEQ ID NO: 4209279 - DNA, 22 bp, Homo sapiens
ctagtagaaagaaaatgtctgt

SEQ ID NO: 4209280 - DNA, 15 bp, Homo sapiens
ctagtatctctggcc

SEQ ID NO: 4209281 - DNA, 16 bp, Homo sapiens
ctagtcaatcaagtct

SEQ ID NO: 4209282 - DNA, 21 bp, Homo sapiens
ctagtcaatcaagtctgttta

SEQ ID NO: 4209283 - DNA, 20 bp, Homo sapiens
ctagtcatagaaatacctca

SEQ ID NO: 4209284 - DNA, 19 bp, Homo sapiens
ctagtctatggtcagttga

SEQ ID NO: 4209285 - DNA, 23 bp, Homo sapiens
ctagtcttgctttgctgtctggt

SEQ ID NO: 4209286 - DNA, 14 bp, Homo sapiens
ctagtgacttcctg

SEQ ID NO: 4209287 - DNA, 18 bp, Homo sapiens
ctagtgccctccacagcc

SEQ ID NO: 4209288 - DNA, 22 bp, Homo sapiens
ctagtggcaataagttccatgt

SEQ ID NO: 4209289 - DNA, 18 bp, Homo sapiens
ctagttctcaatcactgc

SEQ ID NO: 4209290 - DNA, 23 bp, Homo sapiens
ctagttctcaatcactgctcccc

SEQ ID NO: 4209291 - DNA, 13 bp, Homo sapiens
ctatacaacaatg

SEQ ID NO: 4209292 - DNA, 15 bp, Homo sapiens
ctatacatttctgtt

SEQ ID NO: 4209293 - DNA, 12 bp, Homo sapiens
ctatactgcttg

SEQ ID NO: 4209294 - DNA, 19 bp, Homo sapiens
ctatagccaaaaatagcta

SEQ ID NO: 4209295 - DNA, 22 bp, Homo sapiens
ctataggctggagaagctcacc

SEQ ID NO: 4209296 - DNA, 19 bp, Homo sapiens
ctataggtcatgatttctg

SEQ ID NO: 4209297 - DNA, 12 bp, Homo sapiens
ctatatatgtaa

SEQ ID NO: 4209298 - DNA, 21 bp, Homo sapiens
ctatatatgtaaatagctttt

SEQ ID NO: 4209299 - DNA, 15 bp, Homo sapiens
ctatatgatcctgaa

SEQ ID NO: 4209300 - DNA, 16 bp, Homo sapiens
ctatatgatcctgaaa

SEQ ID NO: 4209301 - DNA, 22 bp, Homo sapiens
ctatatgatcctgaaaaaatga

SEQ ID NO: 4209302 - DNA, 16 bp, Homo sapiens
ctatatgatttatagt

SEQ ID NO: 4209303 - DNA, 18 bp, Homo sapiens
ctatatgatttatagttt

SEQ ID NO: 4209304 - DNA, 13 bp, Homo sapiens
ctatatggcaaga

SEQ ID NO: 4209305 - DNA, 18 bp, Homo sapiens
ctatcaatatataaattt

SEQ ID NO: 4209306 - DNA, 14 bp, Homo sapiens
ctatccatcctgcg

SEQ ID NO: 4209307 - DNA, 21 bp, Homo sapiens
ctatcctctgtatataggcct

SEQ ID NO: 4209308 - DNA, 20 bp, Homo sapiens
ctatccttggagagcagctg

SEQ ID NO: 4209309 - DNA, 14 bp, Homo sapiens
ctatcgactttata

SEQ ID NO: 4209310 - DNA, 18 bp, Homo sapiens
ctatcttactatttcaca

SEQ ID NO: 4209311 - DNA, 21 bp, Homo sapiens
ctatgaaaagctagaattgag

SEQ ID NO: 4209312 - DNA, 13 bp, Homo sapiens
ctatgctgaagag

SEQ ID NO: 4209313 - DNA, 16 bp, Homo sapiens
ctatgggaatcagctg

SEQ ID NO: 4209314 - DNA, 19 bp, Homo sapiens
ctatggtcctgcagaaagc

SEQ ID NO: 4209315 - DNA, 14 bp, Homo sapiens
ctatggtgaggtgt

SEQ ID NO: 4209316 - DNA, 14 bp, Homo sapiens
ctatggtgctctgt

SEQ ID NO: 4209317 - DNA, 16 bp, Homo sapiens
ctatggtgctctgtct

SEQ ID NO: 4209318 - DNA, 23 bp, Homo sapiens
ctatggtgctctgtctacttgct

SEQ ID NO: 4209319 - DNA, 11 bp, Homo sapiens
ctatgtatgtt

SEQ ID NO: 4209320 - DNA, 19 bp, Homo sapiens
ctatgtcctagtttcctta

SEQ ID NO: 4209321 - DNA, 15 bp, Homo sapiens
ctatgtgatgttaac

SEQ ID NO: 4209322 - DNA, 16 bp, Homo sapiens
ctatgtttttaatgta

SEQ ID NO: 4209323 - DNA, 14 bp, Homo sapiens
ctattataaaacca

SEQ ID NO: 4209324 - DNA, 15 bp, Homo sapiens
ctattataaaaccat

SEQ ID NO: 4209325 - DNA, 16 bp, Homo sapiens
ctattataaaaccatg

SEQ ID NO: 4209326 - DNA, 15 bp, Homo sapiens
ctattctcaccagga

SEQ ID NO: 4209327 - DNA, 17 bp, Homo sapiens
ctattgggagggatgag

SEQ ID NO: 4209328 - DNA, 18 bp, Homo sapiens
ctatttcttaaacacttg

SEQ ID NO: 4209329 - DNA, 12 bp, Homo sapiens
ctattttcagat

SEQ ID NO: 4209330 - DNA, 18 bp, Homo sapiens
ctattttcagatgtgaac

SEQ ID NO: 4209331 - DNA, 19 bp, Homo sapiens
cctaaacccccgctccaga

SEQ ID NO: 4209332 - DNA, 21 bp, Homo sapiens
cctaagtgacacaaattgaag

SEQ ID NO: 4209333 - DNA, 16 bp, Homo sapiens
cctaattcaattcaaa

SEQ ID NO: 4209334 - DNA, 14 bp, Homo sapiens
cctaccaccttccc

SEQ ID NO: 4209335 - DNA, 17 bp, Homo sapiens
cctaccaccttccctct

SEQ ID NO: 4209336 - DNA, 13 bp, Homo sapiens
cctaccccacctc

SEQ ID NO: 4209337 - DNA, 18 bp, Homo sapiens
cctacctcagcctagacc

SEQ ID NO: 4209338 - DNA, 21 bp, Homo sapiens
cctacctcagcctagaccctc

SEQ ID NO: 4209339 - DNA, 16 bp, Homo sapiens
cctactgcccaggcac

SEQ ID NO: 4209340 - DNA, 13 bp, Homo sapiens
cctacttttcaag

SEQ ID NO: 4209341 - DNA, 20 bp, Homo sapiens
cctagaaaccacctgggttc

SEQ ID NO: 4209342 - DNA, 17 bp, Homo sapiens
cctagaacatccctggg

SEQ ID NO: 4209343 - DNA, 22 bp, Homo sapiens
cctagaacatccctgggcaagt

SEQ ID NO: 4209344 - DNA, 12 bp, Homo sapiens
cctagactgtgt

SEQ ID NO: 4209345 - DNA, 17 bp, Homo sapiens
cctaggattcctccccc

SEQ ID NO: 4209346 - DNA, 22 bp, Homo sapiens
cctagggccttttgtggattga

SEQ ID NO: 4209347 - DNA, 13 bp, Homo sapiens
cctataaaacaaa

SEQ ID NO: 4209348 - DNA, 13 bp, Homo sapiens
cctatactgcttg

SEQ ID NO: 4209349 - DNA, 13 bp, Homo sapiens
cctatagtcccag

SEQ ID NO: 4209350 - DNA, 17 bp, Homo sapiens
cctatcctctgtatata

SEQ ID NO: 4209351 - DNA, 16 bp, Homo sapiens
cctattctcaccagga

SEQ ID NO: 4209352 - DNA, 19 bp, Homo sapiens
cctattctcaccaggaagg

SEQ ID NO: 4209353 - DNA, 16 bp, Homo sapiens
cctattttgtaatttt

SEQ ID NO: 4209354 - DNA, 23 bp, Homo sapiens
cctattttgtaatttttttgaaa

SEQ ID NO: 4209355 - DNA, 16 bp, Homo sapiens
cctcaaaagcaccctt

SEQ ID NO: 4209356 - DNA, 20 bp, Homo sapiens
cctcaaacacacaaactatt

SEQ ID NO: 4209357 - DNA, 20 bp, Homo sapiens
cctcaaactaggaggaaaag

SEQ ID NO: 4209358 - DNA, 21 bp, Homo sapiens
cctcaatccccaagctggcag

SEQ ID NO: 4209359 - DNA, 19 bp, Homo sapiens
cctcaatggacttcaaatt

SEQ ID NO: 4209360 - DNA, 14 bp, Homo sapiens
cctcaatgtgacca

SEQ ID NO: 4209361 - DNA, 19 bp, Homo sapiens
cctcagcctagaccctcct

SEQ ID NO: 4209362 - DNA, 23 bp, Homo sapiens
cctcagggatcttgcattcccag

SEQ ID NO: 4209363 - DNA, 23 bp, Homo sapiens
cctcatgcctggcccccctccag

SEQ ID NO: 4209364 - DNA, 13 bp, Homo sapiens
cctcattcccctc

SEQ ID NO: 4209365 - DNA, 17 bp, Homo sapiens
cctcattcgcctgtggg

SEQ ID NO: 4209366 - DNA, 18 bp, Homo sapiens
cctccaacccacagcctt

SEQ ID NO: 4209367 - DNA, 17 bp, Homo sapiens
cctccacagccgcagcc

SEQ ID NO: 4209368 - DNA, 16 bp, Homo sapiens
cctccagagacaggaa

SEQ ID NO: 4209369 - DNA, 14 bp, Homo sapiens
cctccagcccttca

SEQ ID NO: 4209370 - DNA, 20 bp, Homo sapiens
cctccagcccttcagacgag

SEQ ID NO: 4209371 - DNA, 13 bp, Homo sapiens
cctccagctccag

SEQ ID NO: 4209372 - DNA, 10 bp, Homo sapiens
cctccaggca

SEQ ID NO: 4209373 - DNA, 17 bp, Homo sapiens
cctccaggcatgctggc

SEQ ID NO: 4209374 - DNA, 18 bp, Homo sapiens
cctccaggcatgctggcc

SEQ ID NO: 4209375 - DNA, 19 bp, Homo sapiens
cctccaggcatgctggcct

SEQ ID NO: 4209376 - DNA, 22 bp, Homo sapiens
cctccaggcatgctggcctccc

SEQ ID NO: 4209377 - DNA, 15 bp, Homo sapiens
cctccattggcttcc

SEQ ID NO: 4209378 - DNA, 19 bp, Homo sapiens
cctccatttcaactccaga

SEQ ID NO: 4209379 - DNA, 18 bp, Homo sapiens
cctcccaataaagctgga

SEQ ID NO: 4209380 - DNA, 19 bp, Homo sapiens
cctcccatggccttccctc

SEQ ID NO: 4209381 - DNA, 16 bp, Homo sapiens
cctccccaccttcccc

SEQ ID NO: 4209382 - DNA, 20 bp, Homo sapiens
cctccccattagagtcagcc

SEQ ID NO: 4209383 - DNA, 14 bp, Homo sapiens
cctcccccagagcc

SEQ ID NO: 4209384 - DNA, 15 bp, Homo sapiens
cctcccccagagcca

SEQ ID NO: 4209385 - DNA, 15 bp, Homo sapiens
cctcccccagagggg

SEQ ID NO: 4209386 - DNA, 18 bp, Homo sapiens
cctcccctggtcctgcac

SEQ ID NO: 4209387 - DNA, 17 bp, Homo sapiens
cctccctcttccttccc

SEQ ID NO: 4209388 - DNA, 13 bp, Homo sapiens
cctccctgctgcc

SEQ ID NO: 4209389 - DNA, 22 bp, Homo sapiens
cctccctgctgccaggctccca

SEQ ID NO: 4209390 - DNA, 21 bp, Homo sapiens
cctccctggtttgcagctgtt

SEQ ID NO: 4209391 - DNA, 19 bp, Homo sapiens
cctccgccttcactccggt

SEQ ID NO: 4209392 - DNA, 20 bp, Homo sapiens
cctccgcgagggctactcag

SEQ ID NO: 4209393 - DNA, 17 bp, Homo sapiens
cctcctacgcagatgct

SEQ ID NO: 4209394 - DNA, 23 bp, Homo sapiens
cctcctatccttggagagcagct

SEQ ID NO: 4209395 - DNA, 14 bp, Homo sapiens
cctcctctgtgctc

SEQ ID NO: 4209396 - DNA, 15 bp, Homo sapiens
cctcctgacctgtca

SEQ ID NO: 4209397 - DNA, 16 bp, Homo sapiens
cctcctgggggcccat

SEQ ID NO: 4209398 - DNA, 19 bp, Homo sapiens
cctccttcccttctctcct

SEQ ID NO: 4209399 - DNA, 10 bp, Homo sapiens
cctccttttt

SEQ ID NO: 4209400 - DNA, 19 bp, Homo sapiens
cctcgaggctcttccatcc

SEQ ID NO: 4209401 - DNA, 15 bp, Homo sapiens
cctcggtactcccat

SEQ ID NO: 4209402 - DNA, 14 bp, Homo sapiens
cctcgtaccagcca

SEQ ID NO: 4209403 - DNA, 14 bp, Homo sapiens
cctcgtgcagagct

SEQ ID NO: 4209404 - DNA, 17 bp, Homo sapiens
cctcgtgcagagctggg

SEQ ID NO: 4209405 - DNA, 15 bp, Homo sapiens
cctcgtggacacctg

SEQ ID NO: 4209406 - DNA, 20 bp, Homo sapiens
cctcgtggacacctgccctg

SEQ ID NO: 4209407 - DNA, 21 bp, Homo sapiens
cctcgtggacacctgccctgc

SEQ ID NO: 4209408 - DNA, 13 bp, Homo sapiens
cctctagtgccct

SEQ ID NO: 4209409 - DNA, 14 bp, Homo sapiens
cctctagtgccctc

SEQ ID NO: 4209410 - DNA, 18 bp, Homo sapiens
cctctcaatattcaataa

SEQ ID NO: 4209411 - DNA, 13 bp, Homo sapiens
cctctccctgcca

SEQ ID NO: 4209412 - DNA, 20 bp, Homo sapiens
cctctctctctctctctgga

SEQ ID NO: 4209413 - DNA, 16 bp, Homo sapiens
cctctctcttcccagc

SEQ ID NO: 4209414 - DNA, 15 bp, Homo sapiens
cctctgacctgcagg

SEQ ID NO: 4209415 - DNA, 16 bp, Homo sapiens
cctctgacctgcaggc

SEQ ID NO: 4209416 - DNA, 16 bp, Homo sapiens
cctctgactcaaactc

SEQ ID NO: 4209417 - DNA, 19 bp, Homo sapiens
cctctgagaattccaagga

SEQ ID NO: 4209418 - DNA, 20 bp, Homo sapiens
cctctgatacccagagcatt

SEQ ID NO: 4209419 - DNA, 15 bp, Homo sapiens
cctctgatttttcct

SEQ ID NO: 4209420 - DNA, 16 bp, Homo sapiens
cctctgccccagaaca

SEQ ID NO: 4209421 - DNA, 14 bp, Homo sapiens
cctctgcccgcaga

SEQ ID NO: 4209422 - DNA, 18 bp, Homo sapiens
cctctgcccgcagagccc

SEQ ID NO: 4209423 - DNA, 16 bp, Homo sapiens
cctctgctactgaggc

SEQ ID NO: 4209424 - DNA, 15 bp, Homo sapiens
cctctgggcagcgct

SEQ ID NO: 4209425 - DNA, 16 bp, Homo sapiens
cctctgtcttctggac

SEQ ID NO: 4209426 - DNA, 19 bp, Homo sapiens
cctcttaaagctgcctgta

SEQ ID NO: 4209427 - DNA, 20 bp, Homo sapiens
cctcttaaagctgcctgtag

SEQ ID NO: 4209428 - DNA, 12 bp, Homo sapiens
cctcttccccac

SEQ ID NO: 4209429 - DNA, 22 bp, Homo sapiens
cctcttccctctgatttttcct

SEQ ID NO: 4209430 - DNA, 12 bp, Homo sapiens
cctcttcctctg

SEQ ID NO: 4209431 - DNA, 16 bp, Homo sapiens
cctcttcctctgggca

SEQ ID NO: 4209432 - DNA, 17 bp, Homo sapiens
cctcttcttcttcagaa

SEQ ID NO: 4209433 - DNA, 18 bp, Homo sapiens
cctctttaacctcatcta

SEQ ID NO: 4209434 - DNA, 16 bp, Homo sapiens
cctctttccccacctc

SEQ ID NO: 4209435 - DNA, 15 bp, Homo sapiens
cctgaacatgacatt

SEQ ID NO: 4209436 - DNA, 19 bp, Homo sapiens
cctgaagaaaccacaggtt

SEQ ID NO: 4209437 - DNA, 18 bp, Homo sapiens
cctgaatgacctgcagtc

SEQ ID NO: 4209438 - DNA, 14 bp, Homo sapiens
cctgacaagcactg

SEQ ID NO: 4209439 - DNA, 14 bp, Homo sapiens
cctgacatgtctca

SEQ ID NO: 4209440 - DNA, 21 bp, Homo sapiens
cctgaccctcctccactccac

SEQ ID NO: 4209441 - DNA, 15 bp, Homo sapiens
cctgactcctctaag

SEQ ID NO: 4209442 - DNA, 18 bp, Homo sapiens
cctgactgctcggtcagg

SEQ ID NO: 4209443 - DNA, 23 bp, Homo sapiens
cctgactggtgctataggctgga

SEQ ID NO: 4209444 - DNA, 18 bp, Homo sapiens
cctgagcctaactccctc

SEQ ID NO: 4209445 - DNA, 18 bp, Homo sapiens
cctgagcggaggctcggc

SEQ ID NO: 4209446 - DNA, 20 bp, Homo sapiens
cctgagtgtgggcttctgaa

SEQ ID NO: 4209447 - DNA, 24 bp, Homo sapiens
cctgatcacctctggctttgtctc

SEQ ID NO: 4209448 - DNA, 13 bp, Homo sapiens
cctgatgacagag

SEQ ID NO: 4209449 - DNA, 16 bp, Homo sapiens
cctgcaatctccaggg

SEQ ID NO: 4209450 - DNA, 15 bp, Homo sapiens
cctgcactccagaat

SEQ ID NO: 4209451 - DNA, 16 bp, Homo sapiens
cctgcagagagaagcc

SEQ ID NO: 4209452 - DNA, 19 bp, Homo sapiens
cctgcagaggggaaaccag

SEQ ID NO: 4209453 - DNA, 18 bp, Homo sapiens
cctgcagtcagggcccag

SEQ ID NO: 4209454 - DNA, 20 bp, Homo sapiens
cctgccaagtctcagaagag

SEQ ID NO: 4209455 - DNA, 12 bp, Homo sapiens
cctgccacctgt

SEQ ID NO: 4209456 - DNA, 14 bp, Homo sapiens
cctgccacctgtct

SEQ ID NO: 4209457 - DNA, 17 bp, Homo sapiens
cctgccacctgtctgtc

SEQ ID NO: 4209458 - DNA, 21 bp, Homo sapiens
cctgccagcctggcttctgga

SEQ ID NO: 4209459 - DNA, 18 bp, Homo sapiens
cctgccattcttctggtg

SEQ ID NO: 4209460 - DNA, 19 bp, Homo sapiens
cctgcccccgacagcccag

SEQ ID NO: 4209461 - DNA, 21 bp, Homo sapiens
cctgcccccgacagcccagcc

SEQ ID NO: 4209462 - DNA, 12 bp, Homo sapiens
cctgccccctgg

SEQ ID NO: 4209463 - DNA, 16 bp, Homo sapiens
cctgccccgcccagct

SEQ ID NO: 4209464 - DNA, 22 bp, Homo sapiens
cctgccccgcccagctgcacct

SEQ ID NO: 4209465 - DNA, 17 bp, Homo sapiens
cctgcccctccccagcc

SEQ ID NO: 4209466 - DNA, 14 bp, Homo sapiens
cctgccctgccacc

SEQ ID NO: 4209467 - DNA, 15 bp, Homo sapiens
cctgccctgccacct

SEQ ID NO: 4209468 - DNA, 21 bp, Homo sapiens
cctgccctgccacctgtctgt

SEQ ID NO: 4209469 - DNA, 16 bp, Homo sapiens
cctgccctgccctgcc

SEQ ID NO: 4209470 - DNA, 17 bp, Homo sapiens
cctgcctgtggagacag

SEQ ID NO: 4209471 - DNA, 19 bp, Homo sapiens
cacctgccaattctacatg

SEQ ID NO: 4209472 - DNA, 14 bp, Homo sapiens
cacctgccagcctg

SEQ ID NO: 4209473 - DNA, 22 bp, Homo sapiens
cacctgccatttgcaccctccg

SEQ ID NO: 4209474 - DNA, 14 bp, Homo sapiens
cacctgccctgccc

SEQ ID NO: 4209475 - DNA, 21 bp, Homo sapiens
cacctgccctgccctgccacc

SEQ ID NO: 4209476 - DNA, 23 bp, Homo sapiens
cacctgccctgccctgccacctg

SEQ ID NO: 4209477 - DNA, 13 bp, Homo sapiens
cacctgctggaaa

SEQ ID NO: 4209478 - DNA, 13 bp, Homo sapiens
cacctgcttctca

SEQ ID NO: 4209479 - DNA, 15 bp, Homo sapiens
cacctgcttctcagc

SEQ ID NO: 4209480 - DNA, 21 bp, Homo sapiens
cacctggagcccgcttcaagc

SEQ ID NO: 4209481 - DNA, 16 bp, Homo sapiens
cacctgggagaaatct

SEQ ID NO: 4209482 - DNA, 19 bp, Homo sapiens
cacctgggttcagcctctc

SEQ ID NO: 4209483 - DNA, 13 bp, Homo sapiens
cacctgtctgtct

SEQ ID NO: 4209484 - DNA, 16 bp, Homo sapiens
cacctgtctgtctgtc

SEQ ID NO: 4209485 - DNA, 17 bp, Homo sapiens
caccttaccaactttct

SEQ ID NO: 4209486 - DNA, 19 bp, Homo sapiens
caccttaccaactttctgt

SEQ ID NO: 4209487 - DNA, 18 bp, Homo sapiens
caccttcaattcctgggc

SEQ ID NO: 4209488 - DNA, 14 bp, Homo sapiens
caccttccccagac

SEQ ID NO: 4209489 - DNA, 15 bp, Homo sapiens
caccttccccagact

SEQ ID NO: 4209490 - DNA, 16 bp, Homo sapiens
caccttccccagactc

SEQ ID NO: 4209491 - DNA, 19 bp, Homo sapiens
caccttgccgagagaggcg

SEQ ID NO: 4209492 - DNA, 17 bp, Homo sapiens
caccttgggtttgtatt

SEQ ID NO: 4209493 - DNA, 18 bp, Homo sapiens
cacctttgggatcagcct

SEQ ID NO: 4209494 - DNA, 17 bp, Homo sapiens
caccttttttcaacagt

SEQ ID NO: 4209495 - DNA, 20 bp, Homo sapiens
cacgactgttgtacaagctc

SEQ ID NO: 4209496 - DNA, 21 bp, Homo sapiens
cacgactgttgtacaagctca

SEQ ID NO: 4209497 - DNA, 22 bp, Homo sapiens
cacgactgttgtacaagctcag

SEQ ID NO: 4209498 - DNA, 13 bp, Homo sapiens
cacgcacacatgg

SEQ ID NO: 4209499 - DNA, 16 bp, Homo sapiens
cacgcccgactagcag

SEQ ID NO: 4209500 - DNA, 18 bp, Homo sapiens
cacgcctatgatcccagc

SEQ ID NO: 4209501 - DNA, 19 bp, Homo sapiens
cacgcctgtaatcccagca

SEQ ID NO: 4209502 - DNA, 21 bp, Homo sapiens
cacgcctgtaatcccagcact

SEQ ID NO: 4209503 - DNA, 14 bp, Homo sapiens
cacgctctggacat

SEQ ID NO: 4209504 - DNA, 22 bp, Homo sapiens
cacgtatttatatttggaaaga

SEQ ID NO: 4209505 - DNA, 13 bp, Homo sapiens
cacgtggtgtccc

SEQ ID NO: 4209506 - DNA, 17 bp, Homo sapiens
cactaaacagactattt

SEQ ID NO: 4209507 - DNA, 16 bp, Homo sapiens
cactaaagtatgtaaa

SEQ ID NO: 4209508 - DNA, 17 bp, Homo sapiens
cactaagctttctcctt

SEQ ID NO: 4209509 - DNA, 14 bp, Homo sapiens
cactacctttgtcc

SEQ ID NO: 4209510 - DNA, 21 bp, Homo sapiens
cactacctttgtccaggcctg

SEQ ID NO: 4209511 - DNA, 19 bp, Homo sapiens
cactagacaagccagaact

SEQ ID NO: 4209512 - DNA, 21 bp, Homo sapiens
cactagacaagccagaacttg

SEQ ID NO: 4209513 - DNA, 18 bp, Homo sapiens
cactaggactctgaggct

SEQ ID NO: 4209514 - DNA, 18 bp, Homo sapiens
cactagttcagaggaagc

SEQ ID NO: 4209515 - DNA, 14 bp, Homo sapiens
cactcaacaataaa

SEQ ID NO: 4209516 - DNA, 17 bp, Homo sapiens
cactcagccacacccca

SEQ ID NO: 4209517 - DNA, 13 bp, Homo sapiens
cactccagcctga

SEQ ID NO: 4209518 - DNA, 15 bp, Homo sapiens
cactccagcctgagc

SEQ ID NO: 4209519 - DNA, 22 bp, Homo sapiens
cactccagcctggggtgataga

SEQ ID NO: 4209520 - DNA, 15 bp, Homo sapiens
cactccccaccttca

SEQ ID NO: 4209521 - DNA, 20 bp, Homo sapiens
cactcctcaggaacagaaca

SEQ ID NO: 4209522 - DNA, 19 bp, Homo sapiens
cactctagtgacttcctgg

SEQ ID NO: 4209523 - DNA, 22 bp, Homo sapiens
cactctagtgacttcctggtga

SEQ ID NO: 4209524 - DNA, 13 bp, Homo sapiens
cactctcccctcc

SEQ ID NO: 4209525 - DNA, 11 bp, Homo sapiens
cactcttccaa

SEQ ID NO: 4209526 - DNA, 16 bp, Homo sapiens
cactgaacatttgctt

SEQ ID NO: 4209527 - DNA, 13 bp, Homo sapiens
cactgaagctggg

SEQ ID NO: 4209528 - DNA, 17 bp, Homo sapiens
cactgaagctgggattc

SEQ ID NO: 4209529 - DNA, 21 bp, Homo sapiens
cactgaattagccaaaacact

SEQ ID NO: 4209530 - DNA, 18 bp, Homo sapiens
cactgaggatgtgagcct

SEQ ID NO: 4209531 - DNA, 15 bp, Homo sapiens
cactgagttttccat

SEQ ID NO: 4209532 - DNA, 21 bp, Homo sapiens
cactgagttttccatggcagg

SEQ ID NO: 4209533 - DNA, 22 bp, Homo sapiens
cactgagttttccatggcagga

SEQ ID NO: 4209534 - DNA, 12 bp, Homo sapiens
cactgcactcca

SEQ ID NO: 4209535 - DNA, 19 bp, Homo sapiens
cactgcactccagcctggg

SEQ ID NO: 4209536 - DNA, 16 bp, Homo sapiens
cactgcagggctgctg

SEQ ID NO: 4209537 - DNA, 14 bp, Homo sapiens
cactgccatgcctc

SEQ ID NO: 4209538 - DNA, 16 bp, Homo sapiens
cactgcctatatatgt

SEQ ID NO: 4209539 - DNA, 17 bp, Homo sapiens
cactgcgggagctctgt

SEQ ID NO: 4209540 - DNA, 20 bp, Homo sapiens
cactgctaggcgagtgccag

SEQ ID NO: 4209541 - DNA, 21 bp, Homo sapiens
cactgctaggcgagtgccagg

SEQ ID NO: 4209542 - DNA, 12 bp, Homo sapiens
cactgctgtcag

SEQ ID NO: 4209543 - DNA, 17 bp, Homo sapiens
cactggaaaataaattt

SEQ ID NO: 4209544 - DNA, 15 bp, Homo sapiens
cactggagcccagga

SEQ ID NO: 4209545 - DNA, 13 bp, Homo sapiens
cactggcagagca

SEQ ID NO: 4209546 - DNA, 19 bp, Homo sapiens
cactggcagagcacagccc

SEQ ID NO: 4209547 - DNA, 17 bp, Homo sapiens
cactggccttcccttct

SEQ ID NO: 4209548 - DNA, 23 bp, Homo sapiens
cactgggtgtggccccgcagtgc

SEQ ID NO: 4209549 - DNA, 17 bp, Homo sapiens
cactgtaacctcaaact

SEQ ID NO: 4209550 - DNA, 22 bp, Homo sapiens
cactgtattttcattttaattt

SEQ ID NO: 4209551 - DNA, 12 bp, Homo sapiens
cactgtccgcct

SEQ ID NO: 4209552 - DNA, 16 bp, Homo sapiens
cactgtccgcctctgc

SEQ ID NO: 4209553 - DNA, 17 bp, Homo sapiens
cactgtccgcctctgcc

SEQ ID NO: 4209554 - DNA, 16 bp, Homo sapiens
cactgtggccttctca

SEQ ID NO: 4209555 - DNA, 19 bp, Homo sapiens
cactgtggccttctcagcc

SEQ ID NO: 4209556 - DNA, 20 bp, Homo sapiens
cactgtggccttctcagcct

SEQ ID NO: 4209557 - DNA, 12 bp, Homo sapiens
cacttaggaaga

SEQ ID NO: 4209558 - DNA, 16 bp, Homo sapiens
cacttaggaagaaatc

SEQ ID NO: 4209559 - DNA, 18 bp, Homo sapiens
cacttatcttctggatta

SEQ ID NO: 4209560 - DNA, 15 bp, Homo sapiens
cacttcatacttcta

SEQ ID NO: 4209561 - DNA, 15 bp, Homo sapiens
cacttggtaattgta

SEQ ID NO: 4209562 - DNA, 16 bp, Homo sapiens
cactttaaccctctct

SEQ ID NO: 4209563 - DNA, 17 bp, Homo sapiens
cactttcctacaaaatg

SEQ ID NO: 4209564 - DNA, 19 bp, Homo sapiens
cactttggtacatggccag

SEQ ID NO: 4209565 - DNA, 20 bp, Homo sapiens
cactttggtacatggccagt

SEQ ID NO: 4209566 - DNA, 15 bp, Homo sapiens
cactttgttaaaaat

SEQ ID NO: 4209567 - DNA, 19 bp, Homo sapiens
cagagaaagaagagacagg

SEQ ID NO: 4209568 - DNA, 20 bp, Homo sapiens
cagagaaagaagagacagga

SEQ ID NO: 4209569 - DNA, 23 bp, Homo sapiens
cagagaaagaagagacaggaggg

SEQ ID NO: 4209570 - DNA, 15 bp, Homo sapiens
cagagaataaacatc

SEQ ID NO: 4209571 - DNA, 14 bp, Homo sapiens
cagagaattcttag

SEQ ID NO: 4209572 - DNA, 16 bp, Homo sapiens
cagagacttagaagca

SEQ ID NO: 4209573 - DNA, 17 bp, Homo sapiens
cagagacttagaagcat

SEQ ID NO: 4209574 - DNA, 18 bp, Homo sapiens
cagagacttggggaccag

SEQ ID NO: 4209575 - DNA, 20 bp, Homo sapiens
cagagacttggggaccagag

SEQ ID NO: 4209576 - DNA, 11 bp, Homo sapiens
cagagagaacc

SEQ ID NO: 4209577 - DNA, 17 bp, Homo sapiens
cagagagaaccaggagg

SEQ ID NO: 4209578 - DNA, 18 bp, Homo sapiens
cagagagaggatgcagag

SEQ ID NO: 4209579 - DNA, 20 bp, Homo sapiens
cagagagaggatgcagaggg

SEQ ID NO: 4209580 - DNA, 13 bp, Homo sapiens
cagagagcaaaca

SEQ ID NO: 4209581 - DNA, 18 bp, Homo sapiens
cagagaggagttgccagg

SEQ ID NO: 4209582 - DNA, 16 bp, Homo sapiens
cagagagtcctttggg

SEQ ID NO: 4209583 - DNA, 19 bp, Homo sapiens
cagagatgcatgcgcaggc

SEQ ID NO: 4209584 - DNA, 18 bp, Homo sapiens
cagagatggaggccgagc

SEQ ID NO: 4209585 - DNA, 15 bp, Homo sapiens
cagagcaagactcca

SEQ ID NO: 4209586 - DNA, 15 bp, Homo sapiens
cagagcacagcccac

SEQ ID NO: 4209587 - DNA, 21 bp, Homo sapiens
cagagcaggccacgctcaggc

SEQ ID NO: 4209588 - DNA, 20 bp, Homo sapiens
cagagcattacgtgagccag

SEQ ID NO: 4209589 - DNA, 16 bp, Homo sapiens
cagagccactctatga

SEQ ID NO: 4209590 - DNA, 17 bp, Homo sapiens
cagagccactctatgag

SEQ ID NO: 4209591 - DNA, 22 bp, Homo sapiens
cagagccactctatgagttgga

SEQ ID NO: 4209592 - DNA, 15 bp, Homo sapiens
cagagccaggctctg

SEQ ID NO: 4209593 - DNA, 20 bp, Homo sapiens
cagagccaggctctgcctgg

SEQ ID NO: 4209594 - DNA, 19 bp, Homo sapiens
cagagccggggcactttca

SEQ ID NO: 4209595 - DNA, 13 bp, Homo sapiens
cagagctggggct

SEQ ID NO: 4209596 - DNA, 21 bp, Homo sapiens
cagagctggggctgccagcct

SEQ ID NO: 4209597 - DNA, 22 bp, Homo sapiens
cagagctggggctgccagcctg

SEQ ID NO: 4209598 - DNA, 17 bp, Homo sapiens
cagaggaaaaagaaaaa

SEQ ID NO: 4209599 - DNA, 13 bp, Homo sapiens
cagaggaagcaca

SEQ ID NO: 4209600 - DNA, 15 bp, Homo sapiens
cagaggacagtctgg

SEQ ID NO: 4209601 - DNA, 20 bp, Homo sapiens
cagaggccaggaatctgcca

SEQ ID NO: 4209602 - DNA, 18 bp, Homo sapiens
cagagggaaggggcctac

SEQ ID NO: 4209603 - DNA, 20 bp, Homo sapiens
cagagggaaggggcctacac

SEQ ID NO: 4209604 - DNA, 16 bp, Homo sapiens
cagagggcccaggcag

SEQ ID NO: 4209605 - DNA, 19 bp, Homo sapiens
cagaggggctttctggaga

SEQ ID NO: 4209606 - DNA, 20 bp, Homo sapiens
cagaggggtaggcagagcct

SEQ ID NO: 4209607 - DNA, 21 bp, Homo sapiens
cagaggggtaggcagagcctt

SEQ ID NO: 4209608 - DNA, 18 bp, Homo sapiens
cagaggtaaaagtgtgag

SEQ ID NO: 4209609 - DNA, 20 bp, Homo sapiens
cagaggtaaaagtgtgagca

SEQ ID NO: 4209610 - DNA, 21 bp, Homo sapiens
cagaggtgacccaatgctcct

SEQ ID NO: 4209611 - DNA, 22 bp, Homo sapiens
cagagtatgtccgatggtatct

SEQ ID NO: 4209612 - DNA, 14 bp, Homo sapiens
cagagtcaggaaga

SEQ ID NO: 4209613 - DNA, 14 bp, Homo sapiens
cagagtgccactgc

SEQ ID NO: 4209614 - DNA, 22 bp, Homo sapiens
cagataaggtaaaatgccatga

SEQ ID NO: 4209615 - DNA, 18 bp, Homo sapiens
cagataatcagcctctta

SEQ ID NO: 4209616 - DNA, 19 bp, Homo sapiens
cagataatcagcctcttaa

SEQ ID NO: 4209617 - DNA, 16 bp, Homo sapiens
cagatagacagtgctg

SEQ ID NO: 4209618 - DNA, 20 bp, Homo sapiens
cagatagacagtgctgccct

SEQ ID NO: 4209619 - DNA, 24 bp, Homo sapiens
cagatagacagtgctgccctgcga

SEQ ID NO: 4209620 - DNA, 19 bp, Homo sapiens
cagatatatttttcacagt

SEQ ID NO: 4209621 - DNA, 15 bp, Homo sapiens
cagatatcagtgtct

SEQ ID NO: 4209622 - DNA, 15 bp, Homo sapiens
cagatctgcactggg

SEQ ID NO: 4209623 - DNA, 23 bp, Homo sapiens
cagatcttccgtggtcagagtgc

SEQ ID NO: 4209624 - DNA, 12 bp, Homo sapiens
cagatgagctgt

SEQ ID NO: 4209625 - DNA, 15 bp, Homo sapiens
cagatgattttcctc

SEQ ID NO: 4209626 - DNA, 16 bp, Homo sapiens
cagatgattttcctcc

SEQ ID NO: 4209627 - DNA, 22 bp, Homo sapiens
cagatgcaccacccatggagag

SEQ ID NO: 4209628 - DNA, 23 bp, Homo sapiens
cagatgctgtcactggcagagca

SEQ ID NO: 4209629 - DNA, 17 bp, Homo sapiens
cagatggaaaaataaca

SEQ ID NO: 4209630 - DNA, 14 bp, Homo sapiens
cagatgtgaaccat

SEQ ID NO: 4209631 - DNA, 18 bp, Homo sapiens
cagatgtgtctgggagag

SEQ ID NO: 4209632 - DNA, 14 bp, Homo sapiens
cagatttgtgttat

SEQ ID NO: 4209633 - DNA, 17 bp, Homo sapiens
cagcaacacaagctgga

SEQ ID NO: 4209634 - DNA, 10 bp, Homo sapiens
cagcaactcc

SEQ ID NO: 4209635 - DNA, 11 bp, Homo sapiens
cagcaactccc

SEQ ID NO: 4209636 - DNA, 13 bp, Homo sapiens
cagcaactcccac

SEQ ID NO: 4209637 - DNA, 18 bp, Homo sapiens
cagcaagtttcaccttgg

SEQ ID NO: 4209638 - DNA, 17 bp, Homo sapiens
cagcaatagggtgcagt

SEQ ID NO: 4209639 - DNA, 18 bp, Homo sapiens
cagcactttaaccctctc

SEQ ID NO: 4209640 - DNA, 23 bp, Homo sapiens
cagcactttaaccctctcttccc

SEQ ID NO: 4209641 - DNA, 24 bp, Homo sapiens
cagcactttaaccctctcttccct

SEQ ID NO: 4209642 - DNA, 20 bp, Homo sapiens
cagcactttgggaggctgag

SEQ ID NO: 4209643 - DNA, 22 bp, Homo sapiens
cagcactttgggaggctgaggc

SEQ ID NO: 4209644 - DNA, 23 bp, Homo sapiens
cagcagaggacagtctggagaag

SEQ ID NO: 4209645 - DNA, 20 bp, Homo sapiens
cagcaggcaggcactgtggc

SEQ ID NO: 4209646 - DNA, 15 bp, Homo sapiens
cagcagggcctcaaa

SEQ ID NO: 4209647 - DNA, 17 bp, Homo sapiens
cagcagggcctcaaagt

SEQ ID NO: 4209648 - DNA, 19 bp, Homo sapiens
cagcaggtaggggcacagt

SEQ ID NO: 4209649 - DNA, 14 bp, Homo sapiens
cagcagtaagcagg

SEQ ID NO: 4209650 - DNA, 18 bp, Homo sapiens
cagcagtaagcaggcctt

SEQ ID NO: 4209651 - DNA, 13 bp, Homo sapiens
cagcagtggcagg

SEQ ID NO: 4209652 - DNA, 16 bp, Homo sapiens
cagcagtggcaggacc

SEQ ID NO: 4209653 - DNA, 12 bp, Homo sapiens
cagcatatttat

SEQ ID NO: 4209654 - DNA, 14 bp, Homo sapiens
cagcatatttatag

SEQ ID NO: 4209655 - DNA, 19 bp, Homo sapiens
cagcatccccttgaactct

SEQ ID NO: 4209656 - DNA, 23 bp, Homo sapiens
cagcatccttttctgcagagggg

SEQ ID NO: 4209657 - DNA, 23 bp, Homo sapiens
cagggagcaactctccactccat

SEQ ID NO: 4209658 - DNA, 21 bp, Homo sapiens
cagggaggaggcagagaagaa

SEQ ID NO: 4209659 - DNA, 20 bp, Homo sapiens
cagggaggaggtggcagccc

SEQ ID NO: 4209660 - DNA, 21 bp, Homo sapiens
cagggaggaggtggcagccct

SEQ ID NO: 4209661 - DNA, 16 bp, Homo sapiens
cagggcaaaggtcaag

SEQ ID NO: 4209662 - DNA, 12 bp, Homo sapiens
cagggccagggc

SEQ ID NO: 4209663 - DNA, 18 bp, Homo sapiens
cagggccagggccctgca

SEQ ID NO: 4209664 - DNA, 19 bp, Homo sapiens
cagggccagggccctgcag

SEQ ID NO: 4209665 - DNA, 21 bp, Homo sapiens
cagggcccaaagcccagctct

SEQ ID NO: 4209666 - DNA, 13 bp, Homo sapiens
cagggccctgcag

SEQ ID NO: 4209667 - DNA, 15 bp, Homo sapiens
cagggccctgcagag

SEQ ID NO: 4209668 - DNA, 18 bp, Homo sapiens
cagggccctgcagagggg

SEQ ID NO: 4209669 - DNA, 12 bp, Homo sapiens
cagggctccctc

SEQ ID NO: 4209670 - DNA, 13 bp, Homo sapiens
cagggctctgccc

SEQ ID NO: 4209671 - DNA, 21 bp, Homo sapiens
cagggctgatagagtgatttt

SEQ ID NO: 4209672 - DNA, 18 bp, Homo sapiens
cagggctgcccctgtagg

SEQ ID NO: 4209673 - DNA, 12 bp, Homo sapiens
cagggctgctgt

SEQ ID NO: 4209674 - DNA, 13 bp, Homo sapiens
cagggctgctgtg

SEQ ID NO: 4209675 - DNA, 19 bp, Homo sapiens
cagggctgctgtggcccag

SEQ ID NO: 4209676 - DNA, 22 bp, Homo sapiens
cagggctgtcttggtggatggg

SEQ ID NO: 4209677 - DNA, 16 bp, Homo sapiens
caggggcccacaggga

SEQ ID NO: 4209678 - DNA, 20 bp, Homo sapiens
caggggggttgtgaggcctg

SEQ ID NO: 4209679 - DNA, 12 bp, Homo sapiens
cagggtccctgg

SEQ ID NO: 4209680 - DNA, 21 bp, Homo sapiens
cagggtcctgggggctgctgc

SEQ ID NO: 4209681 - DNA, 14 bp, Homo sapiens
cagggtctaaagag

SEQ ID NO: 4209682 - DNA, 18 bp, Homo sapiens
cagggtctaaagagaaca

SEQ ID NO: 4209683 - DNA, 21 bp, Homo sapiens
cagggtctaaagagaacaaga

SEQ ID NO: 4209684 - DNA, 22 bp, Homo sapiens
cagggtgagagctgctctggaa

SEQ ID NO: 4209685 - DNA, 12 bp, Homo sapiens
caggtaagtggc

SEQ ID NO: 4209686 - DNA, 20 bp, Homo sapiens
caggtaatgagggactggaa

SEQ ID NO: 4209687 - DNA, 23 bp, Homo sapiens
caggtaatgagggactggaacca

SEQ ID NO: 4209688 - DNA, 20 bp, Homo sapiens
caggtaggggcacagtgaat

SEQ ID NO: 4209689 - DNA, 19 bp, Homo sapiens
caggtagttggtgaacaga

SEQ ID NO: 4209690 - DNA, 22 bp, Homo sapiens
caggtagttggtgaacagagag

SEQ ID NO: 4209691 - DNA, 24 bp, Homo sapiens
caggtagttggtgaacagagagaa

SEQ ID NO: 4209692 - DNA, 18 bp, Homo sapiens
caggtatctccaggattg

SEQ ID NO: 4209693 - DNA, 16 bp, Homo sapiens
caggtcaccagcctga

SEQ ID NO: 4209694 - DNA, 19 bp, Homo sapiens
caggtccaggccagtgggc

SEQ ID NO: 4209695 - DNA, 16 bp, Homo sapiens
caggtccaggctgtgt

SEQ ID NO: 4209696 - DNA, 22 bp, Homo sapiens
caggtcctctgatacccagagc

SEQ ID NO: 4209697 - DNA, 15 bp, Homo sapiens
caggtctagactttc

SEQ ID NO: 4209698 - DNA, 17 bp, Homo sapiens
caggtctagactttctc

SEQ ID NO: 4209699 - DNA, 18 bp, Homo sapiens
caggtctagactttctca

SEQ ID NO: 4209700 - DNA, 13 bp, Homo sapiens
caggtctggggct

SEQ ID NO: 4209701 - DNA, 13 bp, Homo sapiens
caggtgcagtggc

SEQ ID NO: 4209702 - DNA, 15 bp, Homo sapiens
caggtgcagtggctc

SEQ ID NO: 4209703 - DNA, 22 bp, Homo sapiens
caggtgcctggcttgctgtggc

SEQ ID NO: 4209704 - DNA, 15 bp, Homo sapiens
caggtggcaggacca

SEQ ID NO: 4209705 - DNA, 21 bp, Homo sapiens
caggtgttggaagccaggact

SEQ ID NO: 4209706 - DNA, 21 bp, Homo sapiens
caggttctgcgttacaacagt

SEQ ID NO: 4209707 - DNA, 22 bp, Homo sapiens
caggttgaggggctcctggaaa

SEQ ID NO: 4209708 - DNA, 13 bp, Homo sapiens
caggtttgctgtg

SEQ ID NO: 4209709 - DNA, 14 bp, Homo sapiens
caggtttgctgtgt

SEQ ID NO: 4209710 - DNA, 23 bp, Homo sapiens
caggtttggggagggggaagaga

SEQ ID NO: 4209711 - DNA, 22 bp, Homo sapiens
acaggacagtgcttcagcctga

SEQ ID NO: 4209712 - DNA, 18 bp, Homo sapiens
acaggagggcaagggcca

SEQ ID NO: 4209713 - DNA, 19 bp, Homo sapiens
acaggaggggcccacaatg

SEQ ID NO: 4209714 - DNA, 21 bp, Homo sapiens
acaggaggggcccacaatgga

SEQ ID NO: 4209715 - DNA, 16 bp, Homo sapiens
acaggatgtgtttgct

SEQ ID NO: 4209716 - DNA, 19 bp, Homo sapiens
acaggatgtgtttgctttc

SEQ ID NO: 4209717 - DNA, 22 bp, Homo sapiens
acaggctgagctttctagccta

SEQ ID NO: 4209718 - DNA, 21 bp, Homo sapiens
acagggtccctggatcagggt

SEQ ID NO: 4209719 - DNA, 16 bp, Homo sapiens
acaggtaagtggcagg

SEQ ID NO: 4209720 - DNA, 16 bp, Homo sapiens
acaggtggcaggacca

SEQ ID NO: 4209721 - DNA, 20 bp, Homo sapiens
acaggtggcaggaccaggac

SEQ ID NO: 4209722 - DNA, 21 bp, Homo sapiens
acaggtggcaggaccaggact

SEQ ID NO: 4209723 - DNA, 22 bp, Homo sapiens
acaggtttggggagggggaaga

SEQ ID NO: 4209724 - DNA, 17 bp, Homo sapiens
acagtaaataaattgtt

SEQ ID NO: 4209725 - DNA, 16 bp, Homo sapiens
acagtcaagatacata

SEQ ID NO: 4209726 - DNA, 16 bp, Homo sapiens
acagtcaaggagatga

SEQ ID NO: 4209727 - DNA, 19 bp, Homo sapiens
acagtcctaactggtatag

SEQ ID NO: 4209728 - DNA, 16 bp, Homo sapiens
acagtcctcacagcct

SEQ ID NO: 4209729 - DNA, 18 bp, Homo sapiens
acagtcctcacagcctct

SEQ ID NO: 4209730 - DNA, 20 bp, Homo sapiens
acagtcctcacagcctctcc

SEQ ID NO: 4209731 - DNA, 15 bp, Homo sapiens
acagtctgttttcta

SEQ ID NO: 4209732 - DNA, 13 bp, Homo sapiens
acagtgaagacag

SEQ ID NO: 4209733 - DNA, 21 bp, Homo sapiens
acagtgaagacagaagtttgc

SEQ ID NO: 4209734 - DNA, 18 bp, Homo sapiens
acagtgaatgtgtgtatg

SEQ ID NO: 4209735 - DNA, 10 bp, Homo sapiens
acagtgaatt

SEQ ID NO: 4209736 - DNA, 15 bp, Homo sapiens
acagtgaatttctga

SEQ ID NO: 4209737 - DNA, 14 bp, Homo sapiens
acagtgacaaaagg

SEQ ID NO: 4209738 - DNA, 13 bp, Homo sapiens
acagtgagccaag

SEQ ID NO: 4209739 - DNA, 16 bp, Homo sapiens
acagtgctgccctgcg

SEQ ID NO: 4209740 - DNA, 14 bp, Homo sapiens
acagtgcttcagcc

SEQ ID NO: 4209741 - DNA, 21 bp, Homo sapiens
acagtgcttcagcctgaggct

SEQ ID NO: 4209742 - DNA, 11 bp, Homo sapiens
acagtgtgtgt

SEQ ID NO: 4209743 - DNA, 17 bp, Homo sapiens
acagtgtttgcaatggt

SEQ ID NO: 4209744 - DNA, 14 bp, Homo sapiens
acagttaactttct

SEQ ID NO: 4209745 - DNA, 20 bp, Homo sapiens
acataactagtttaattaac

SEQ ID NO: 4209746 - DNA, 14 bp, Homo sapiens
acataagaccataa

SEQ ID NO: 4209747 - DNA, 18 bp, Homo sapiens
acataagccattattcac

SEQ ID NO: 4209748 - DNA, 16 bp, Homo sapiens
acataattcactctga

SEQ ID NO: 4209749 - DNA, 17 bp, Homo sapiens
acataattcactctgag

SEQ ID NO: 4209750 - DNA, 21 bp, Homo sapiens
acataatttagtttcatataa

SEQ ID NO: 4209751 - DNA, 18 bp, Homo sapiens
acatacagaattactgta

SEQ ID NO: 4209752 - DNA, 19 bp, Homo sapiens
acatacagaattactgtaa

SEQ ID NO: 4209753 - DNA, 16 bp, Homo sapiens
acatactcatttttca

SEQ ID NO: 4209754 - DNA, 16 bp, Homo sapiens
acatagacagaagaaa

SEQ ID NO: 4209755 - DNA, 18 bp, Homo sapiens
acatagacagaagaaaca

SEQ ID NO: 4209756 - DNA, 18 bp, Homo sapiens
acataggcaaattggaaa

SEQ ID NO: 4209757 - DNA, 14 bp, Homo sapiens
acatagtattcatg

SEQ ID NO: 4209758 - DNA, 19 bp, Homo sapiens
acatagtattcatgactat

SEQ ID NO: 4209759 - DNA, 17 bp, Homo sapiens
acatatttatagtttaa

SEQ ID NO: 4209760 - DNA, 23 bp, Homo sapiens
acatcaaaaatgggtaattttct

SEQ ID NO: 4209761 - DNA, 22 bp, Homo sapiens
acatcaactttatgtagcaaag

SEQ ID NO: 4209762 - DNA, 19 bp, Homo sapiens
acatcaataatattgtata

SEQ ID NO: 4209763 - DNA, 18 bp, Homo sapiens
acatcacatccctctcct

SEQ ID NO: 4209764 - DNA, 15 bp, Homo sapiens
acatcagtgtggaaa

SEQ ID NO: 4209765 - DNA, 18 bp, Homo sapiens
acatcattactataagaa

SEQ ID NO: 4209766 - DNA, 21 bp, Homo sapiens
acatcattctacataatggaa

SEQ ID NO: 4209767 - DNA, 11 bp, Homo sapiens
acatgacattt

SEQ ID NO: 4209768 - DNA, 19 bp, Homo sapiens
acatgacttttctggaaga

SEQ ID NO: 4209769 - DNA, 22 bp, Homo sapiens
acatgagaaaatcagtaattgg

SEQ ID NO: 4209770 - DNA, 18 bp, Homo sapiens
acatgcaagtgagaagct

SEQ ID NO: 4209771 - DNA, 12 bp, Homo sapiens
acatgcattcta

SEQ ID NO: 4209772 - DNA, 17 bp, Homo sapiens
acatggaaggttagagg

SEQ ID NO: 4209773 - DNA, 15 bp, Homo sapiens
acatggccagtgtga

SEQ ID NO: 4209774 - DNA, 19 bp, Homo sapiens
acatgtctgtcctcagagc

SEQ ID NO: 4209775 - DNA, 13 bp, Homo sapiens
acatgtgcctgta

SEQ ID NO: 4209776 - DNA, 15 bp, Homo sapiens
acatgttatatattt

SEQ ID NO: 4209777 - DNA, 19 bp, Homo sapiens
acatgttatccacaagcaa

SEQ ID NO: 4209778 - DNA, 21 bp, Homo sapiens
acatgtttacttttcagggca

SEQ ID NO: 4209779 - DNA, 21 bp, Homo sapiens
acatgtttatttattctgcat

SEQ ID NO: 4209780 - DNA, 16 bp, Homo sapiens
acattaacatctatta

SEQ ID NO: 4209781 - DNA, 20 bp, Homo sapiens
acattaagattgaggcctgc

SEQ ID NO: 4209782 - DNA, 18 bp, Homo sapiens
acattagaacactgcatt

SEQ ID NO: 4209783 - DNA, 15 bp, Homo sapiens
acattcacagcccag

SEQ ID NO: 4209784 - DNA, 16 bp, Homo sapiens
acattcacagcccaga

SEQ ID NO: 4209785 - DNA, 17 bp, Homo sapiens
acattcataaggaaatg

SEQ ID NO: 4209786 - DNA, 18 bp, Homo sapiens
acattgcattgtgactat

SEQ ID NO: 4209787 - DNA, 13 bp, Homo sapiens
acattggacttcc

SEQ ID NO: 4209788 - DNA, 14 bp, Homo sapiens
acattggacttcct

SEQ ID NO: 4209789 - DNA, 21 bp, Homo sapiens
acatttaagcaggaatgcaat

SEQ ID NO: 4209790 - DNA, 13 bp, Homo sapiens
acatttacatcaa

SEQ ID NO: 4209791 - DNA, 19 bp, Homo sapiens
acatttatttcaaactatt

SEQ ID NO: 4209792 - DNA, 15 bp, Homo sapiens
acatttccctgtgct

SEQ ID NO: 4209793 - DNA, 13 bp, Homo sapiens
acatttcctctta

SEQ ID NO: 4209794 - DNA, 21 bp, Homo sapiens
acatttctctaactcctgcca

SEQ ID NO: 4209795 - DNA, 22 bp, Homo sapiens
acatttctctaactcctgccat

SEQ ID NO: 4209796 - DNA, 22 bp, Homo sapiens
acatttgaaagaaagtgttaaa

SEQ ID NO: 4209797 - DNA, 17 bp, Homo sapiens
acattttaaaaaacaaa

SEQ ID NO: 4209798 - DNA, 14 bp, Homo sapiens
cataaccaagaaat

SEQ ID NO: 4209799 - DNA, 11 bp, Homo sapiens
cataagaccat

SEQ ID NO: 4209800 - DNA, 20 bp, Homo sapiens
cataagaccataacagccaa

SEQ ID NO: 4209801 - DNA, 11 bp, Homo sapiens
cataagattaa

SEQ ID NO: 4209802 - DNA, 16 bp, Homo sapiens
cataagattaaaggaa

SEQ ID NO: 4209803 - DNA, 17 bp, Homo sapiens
cataagattaaaggaag

SEQ ID NO: 4209804 - DNA, 20 bp, Homo sapiens
cataagattaaaggaaggaa

SEQ ID NO: 4209805 - DNA, 23 bp, Homo sapiens
cataagcaagtgagcagatggga

SEQ ID NO: 4209806 - DNA, 20 bp, Homo sapiens
cataagtaaacaacatattt

SEQ ID NO: 4209807 - DNA, 17 bp, Homo sapiens
cataagtttgtttaaac

SEQ ID NO: 4209808 - DNA, 21 bp, Homo sapiens
cataattatccaggaagggaa

SEQ ID NO: 4209809 - DNA, 19 bp, Homo sapiens
cataattgctttgccaaaa

SEQ ID NO: 4209810 - DNA, 17 bp, Homo sapiens
cataccctctacctgga

SEQ ID NO: 4209811 - DNA, 22 bp, Homo sapiens
catactcatttttcatgataat

SEQ ID NO: 4209812 - DNA, 16 bp, Homo sapiens
catagaaatacctcat

SEQ ID NO: 4209813 - DNA, 15 bp, Homo sapiens
catagacagaagaaa

SEQ ID NO: 4209814 - DNA, 20 bp, Homo sapiens
catagacagaagaaacaagg

SEQ ID NO: 4209815 - DNA, 20 bp, Homo sapiens
catagagggagaggaagcac

SEQ ID NO: 4209816 - DNA, 14 bp, Homo sapiens
catagagtttaaca

SEQ ID NO: 4209817 - DNA, 21 bp, Homo sapiens
catagctgttttagctgaggg

SEQ ID NO: 4209818 - DNA, 13 bp, Homo sapiens
cataggctgccca

SEQ ID NO: 4209819 - DNA, 16 bp, Homo sapiens
cataggtatttcaaaa

SEQ ID NO: 4209820 - DNA, 20 bp, Homo sapiens
catagtaaatggtatcattt

SEQ ID NO: 4209821 - DNA, 18 bp, Homo sapiens
catagtgcacacttgtat

SEQ ID NO: 4209822 - DNA, 15 bp, Homo sapiens
catatctttatcttt

SEQ ID NO: 4209823 - DNA, 11 bp, Homo sapiens
catatgaaaaa

SEQ ID NO: 4209824 - DNA, 16 bp, Homo sapiens
catattgaatgtttcc

SEQ ID NO: 4209825 - DNA, 22 bp, Homo sapiens
catatttatagcaatccatgtt

SEQ ID NO: 4209826 - DNA, 18 bp, Homo sapiens
catcaataatattgtata

SEQ ID NO: 4209827 - DNA, 16 bp, Homo sapiens
catcactgagttttcc

SEQ ID NO: 4209828 - DNA, 14 bp, Homo sapiens
catcactgtgcctt

SEQ ID NO: 4209829 - DNA, 15 bp, Homo sapiens
catcacttttcagtg

SEQ ID NO: 4209830 - DNA, 20 bp, Homo sapiens
catcagtagctgagtgcact

SEQ ID NO: 4209831 - DNA, 16 bp, Homo sapiens
catccaaccccccacc

SEQ ID NO: 4209832 - DNA, 14 bp, Homo sapiens
catccaccctgcag

SEQ ID NO: 4209833 - DNA, 22 bp, Homo sapiens
catccacgcacacatggacaca

SEQ ID NO: 4209834 - DNA, 19 bp, Homo sapiens
catccataaagcaagctca

SEQ ID NO: 4209835 - DNA, 18 bp, Homo sapiens
catccatgtttgtaaaac

SEQ ID NO: 4209836 - DNA, 19 bp, Homo sapiens
catccatgtttgtaaaact

SEQ ID NO: 4209837 - DNA, 13 bp, Homo sapiens
catcccctttcct

SEQ ID NO: 4209838 - DNA, 15 bp, Homo sapiens
catcccctttcctcc

SEQ ID NO: 4209839 - DNA, 16 bp, Homo sapiens
catcccctttcctccc

SEQ ID NO: 4209840 - DNA, 17 bp, Homo sapiens
catcccctttcctcccc

SEQ ID NO: 4209841 - DNA, 21 bp, Homo sapiens
catcccctttcctccccacct

SEQ ID NO: 4209842 - DNA, 19 bp, Homo sapiens
catccctttgaaacaagat

SEQ ID NO: 4209843 - DNA, 12 bp, Homo sapiens
catccggctcct

SEQ ID NO: 4209844 - DNA, 13 bp, Homo sapiens
catccggctcctg

SEQ ID NO: 4209845 - DNA, 14 bp, Homo sapiens
catccggctcctgt

SEQ ID NO: 4209846 - DNA, 16 bp, Homo sapiens
catcctattttgtaat

SEQ ID NO: 4209847 - DNA, 23 bp, Homo sapiens
catcgtatttcttttttttaata

SEQ ID NO: 4209848 - DNA, 16 bp, Homo sapiens
catcgtccagccctcc

SEQ ID NO: 4209849 - DNA, 18 bp, Homo sapiens
catctaagcctgttgaga

SEQ ID NO: 4209850 - DNA, 23 bp, Homo sapiens
catctactcattgtctcagtgct

SEQ ID NO: 4209851 - DNA, 18 bp, Homo sapiens
catctattataaaaccat

SEQ ID NO: 4209852 - DNA, 20 bp, Homo sapiens
catctattataaaaccatgt

SEQ ID NO: 4209853 - DNA, 12 bp, Homo sapiens
catctcatgctc

SEQ ID NO: 4209854 - DNA, 15 bp, Homo sapiens
catctcattgtagag

SEQ ID NO: 4209855 - DNA, 15 bp, Homo sapiens
catctccctcccaca

SEQ ID NO: 4209856 - DNA, 20 bp, Homo sapiens
catctcctcccatggccttc

SEQ ID NO: 4209857 - DNA, 14 bp, Homo sapiens
catctctccagaga

SEQ ID NO: 4209858 - DNA, 18 bp, Homo sapiens
catctctccagagagcaa

SEQ ID NO: 4209859 - DNA, 11 bp, Homo sapiens
ccctgccctgc

SEQ ID NO: 4209860 - DNA, 14 bp, Homo sapiens
ccctgccttcagct

SEQ ID NO: 4209861 - DNA, 21 bp, Homo sapiens
ccctgcgaagtggctctcagg

SEQ ID NO: 4209862 - DNA, 19 bp, Homo sapiens
ccctgctgccgcctcccag

SEQ ID NO: 4209863 - DNA, 23 bp, Homo sapiens
ccctggagtcccctgggcctgga

SEQ ID NO: 4209864 - DNA, 23 bp, Homo sapiens
ccctgggcctggaccgcttccca

SEQ ID NO: 4209865 - DNA, 15 bp, Homo sapiens
ccctgggctctgccc

SEQ ID NO: 4209866 - DNA, 13 bp, Homo sapiens
ccctgggctctgg

SEQ ID NO: 4209867 - DNA, 18 bp, Homo sapiens
ccctggggccatgggtgc

SEQ ID NO: 4209868 - DNA, 21 bp, Homo sapiens
ccctggtgcactggccccacc

SEQ ID NO: 4209869 - DNA, 17 bp, Homo sapiens
ccctggtggacagtcct

SEQ ID NO: 4209870 - DNA, 20 bp, Homo sapiens
ccctggtggacagtcctggg

SEQ ID NO: 4209871 - DNA, 21 bp, Homo sapiens
ccctggtggacagtcctggga

SEQ ID NO: 4209872 - DNA, 23 bp, Homo sapiens
ccctggtggacagtcctgggaga

SEQ ID NO: 4209873 - DNA, 14 bp, Homo sapiens
ccctggtggaggct

SEQ ID NO: 4209874 - DNA, 20 bp, Homo sapiens
ccctggtggaggcttcttgc

SEQ ID NO: 4209875 - DNA, 14 bp, Homo sapiens
ccctgtaggttgct

SEQ ID NO: 4209876 - DNA, 12 bp, Homo sapiens
ccctgtccagcg

SEQ ID NO: 4209877 - DNA, 15 bp, Homo sapiens
ccctgtggggcctga

SEQ ID NO: 4209878 - DNA, 17 bp, Homo sapiens
ccctgttatctgctaga

SEQ ID NO: 4209879 - DNA, 14 bp, Homo sapiens
ccctgttttatact

SEQ ID NO: 4209880 - DNA, 14 bp, Homo sapiens
cccttcataccctc

SEQ ID NO: 4209881 - DNA, 12 bp, Homo sapiens
cccttccctgcc

SEQ ID NO: 4209882 - DNA, 13 bp, Homo sapiens
cccttcctttcct

SEQ ID NO: 4209883 - DNA, 14 bp, Homo sapiens
cccttcctttcctc

SEQ ID NO: 4209884 - DNA, 15 bp, Homo sapiens
cccttcctttcctct

SEQ ID NO: 4209885 - DNA, 18 bp, Homo sapiens
cccttctctccttccctc

SEQ ID NO: 4209886 - DNA, 19 bp, Homo sapiens
cccttctctccttccctct

SEQ ID NO: 4209887 - DNA, 18 bp, Homo sapiens
cccttgacaactggcagg

SEQ ID NO: 4209888 - DNA, 22 bp, Homo sapiens
cccttgcactaaagtatgtaaa

SEQ ID NO: 4209889 - DNA, 16 bp, Homo sapiens
cccttggaaagttcag

SEQ ID NO: 4209890 - DNA, 19 bp, Homo sapiens
cccttggaaagttcagcca

SEQ ID NO: 4209891 - DNA, 23 bp, Homo sapiens
cccttggcttttgcttggcagag

SEQ ID NO: 4209892 - DNA, 21 bp, Homo sapiens
ccctttcccccaccccagagt

SEQ ID NO: 4209893 - DNA, 22 bp, Homo sapiens
ccctttcccccaccccagagtt

SEQ ID NO: 4209894 - DNA, 12 bp, Homo sapiens
ccctttcctccc

SEQ ID NO: 4209895 - DNA, 12 bp, Homo sapiens
ccgacagcccag

SEQ ID NO: 4209896 - DNA, 16 bp, Homo sapiens
ccgacagcccagccta

SEQ ID NO: 4209897 - DNA, 17 bp, Homo sapiens
ccgaccatcgtccagcc

SEQ ID NO: 4209898 - DNA, 22 bp, Homo sapiens
ccgaccatcgtccagccctcct

SEQ ID NO: 4209899 - DNA, 13 bp, Homo sapiens
ccgacccctgtcc

SEQ ID NO: 4209900 - DNA, 14 bp, Homo sapiens
ccgactagcaggca

SEQ ID NO: 4209901 - DNA, 22 bp, Homo sapiens
ccgactctaagctgtgtgcagg

SEQ ID NO: 4209902 - DNA, 12 bp, Homo sapiens
ccgagaacaaca

SEQ ID NO: 4209903 - DNA, 18 bp, Homo sapiens
ccgagacggctggacctg

SEQ ID NO: 4209904 - DNA, 11 bp, Homo sapiens
ccgagattgca

SEQ ID NO: 4209905 - DNA, 18 bp, Homo sapiens
ccgagcaaagtctaaagt

SEQ ID NO: 4209906 - DNA, 18 bp, Homo sapiens
ccgagggagctgctggct

SEQ ID NO: 4209907 - DNA, 13 bp, Homo sapiens
ccgcagaaggaag

SEQ ID NO: 4209908 - DNA, 15 bp, Homo sapiens
ccgcagaaggaaggc

SEQ ID NO: 4209909 - DNA, 18 bp, Homo sapiens
ccgcagaaggaaggcagg

SEQ ID NO: 4209910 - DNA, 23 bp, Homo sapiens
ccgcagccagccggtgcctggcg

SEQ ID NO: 4209911 - DNA, 17 bp, Homo sapiens
ccgcccagctgcacctg

SEQ ID NO: 4209912 - DNA, 18 bp, Homo sapiens
ccgcccctctccaaacac

SEQ ID NO: 4209913 - DNA, 14 bp, Homo sapiens
ccgcctcccagcct

SEQ ID NO: 4209914 - DNA, 15 bp, Homo sapiens
ccgcctcccagcctg

SEQ ID NO: 4209915 - DNA, 18 bp, Homo sapiens
ccgcctctgcccgcagag

SEQ ID NO: 4209916 - DNA, 14 bp, Homo sapiens
ccgcctgcagagga

SEQ ID NO: 4209917 - DNA, 21 bp, Homo sapiens
ccgcgtagagagccgggcccc

SEQ ID NO: 4209918 - DNA, 18 bp, Homo sapiens
ccgctccagatctgcact

SEQ ID NO: 4209919 - DNA, 20 bp, Homo sapiens
ccgctcccctctcctccgcc

SEQ ID NO: 4209920 - DNA, 21 bp, Homo sapiens
ccgctcctttacctaccacct

SEQ ID NO: 4209921 - DNA, 16 bp, Homo sapiens
ccgcttcaagctctct

SEQ ID NO: 4209922 - DNA, 20 bp, Homo sapiens
ccggactgcaagcagggctc

SEQ ID NO: 4209923 - DNA, 19 bp, Homo sapiens
ccggaggggacccagctcc

SEQ ID NO: 4209924 - DNA, 19 bp, Homo sapiens
ccggcccagagaccccttc

SEQ ID NO: 4209925 - DNA, 23 bp, Homo sapiens
ccggcctcagcacccctgtctct

SEQ ID NO: 4209926 - DNA, 15 bp, Homo sapiens
ccggctcctgtcatc

SEQ ID NO: 4209927 - DNA, 17 bp, Homo sapiens
ccggctgctcctccagc

SEQ ID NO: 4209928 - DNA, 17 bp, Homo sapiens
ccgggagaggactctgc

SEQ ID NO: 4209929 - DNA, 20 bp, Homo sapiens
ccgggcggaaggggacgcgg

SEQ ID NO: 4209930 - DNA, 23 bp, Homo sapiens
ccgggtgccccccatgccctccc

SEQ ID NO: 4209931 - DNA, 20 bp, Homo sapiens
ccgggtggaaaagaatccct

SEQ ID NO: 4209932 - DNA, 19 bp, Homo sapiens
ccgggtgtgcctgccctgg

SEQ ID NO: 4209933 - DNA, 23 bp, Homo sapiens
ccggtcaccgagacggctggacc

SEQ ID NO: 4209934 - DNA, 17 bp, Homo sapiens
ccggtgtgcctgcagcc

SEQ ID NO: 4209935 - DNA, 19 bp, Homo sapiens
ccggttaaattccatatgc

SEQ ID NO: 4209936 - DNA, 21 bp, Homo sapiens
ccgtatctgcagaatgggcca

SEQ ID NO: 4209937 - DNA, 12 bp, Homo sapiens
ccgtcagtgctg

SEQ ID NO: 4209938 - DNA, 15 bp, Homo sapiens
ccgtcatgttcctca

SEQ ID NO: 4209939 - DNA, 16 bp, Homo sapiens
ccgtcatgttcctcaa

SEQ ID NO: 4209940 - DNA, 17 bp, Homo sapiens
ccgtcatgttcctcaaa

SEQ ID NO: 4209941 - DNA, 14 bp, Homo sapiens
ccgtctctgtcccg

SEQ ID NO: 4209942 - DNA, 12 bp, Homo sapiens
ccgtctgttttt

SEQ ID NO: 4209943 - DNA, 22 bp, Homo sapiens
ccgtcttggggctcgccccacc

SEQ ID NO: 4209944 - DNA, 18 bp, Homo sapiens
ccgtgcagcttctgtcct

SEQ ID NO: 4209945 - DNA, 12 bp, Homo sapiens
ccgtgcccaggg

SEQ ID NO: 4209946 - DNA, 14 bp, Homo sapiens
ccgtgtcctctccc

SEQ ID NO: 4209947 - DNA, 17 bp, Homo sapiens
ccgtgtcctctccctgc

SEQ ID NO: 4209948 - DNA, 19 bp, Homo sapiens
ccgtgtcctctccctgcca

SEQ ID NO: 4209949 - DNA, 13 bp, Homo sapiens
ccgtgtgcctggg

SEQ ID NO: 4209950 - DNA, 14 bp, Homo sapiens
cctaaaatgacagc

SEQ ID NO: 4209951 - DNA, 17 bp, Homo sapiens
tgggtctggctgagctg

SEQ ID NO: 4209952 - DNA, 14 bp, Homo sapiens
tgggtgttaatttt

SEQ ID NO: 4209953 - DNA, 17 bp, Homo sapiens
tgggttctttggaagga

SEQ ID NO: 4209954 - DNA, 21 bp, Homo sapiens
tgggttgcagacaggaatctt

SEQ ID NO: 4209955 - DNA, 14 bp, Homo sapiens
tgggttttgtctct

SEQ ID NO: 4209956 - DNA, 13 bp, Homo sapiens
tggtaaactattt

SEQ ID NO: 4209957 - DNA, 21 bp, Homo sapiens
tggtaaactatttgtctttca

SEQ ID NO: 4209958 - DNA, 17 bp, Homo sapiens
tggtaacttctttgaag

SEQ ID NO: 4209959 - DNA, 23 bp, Homo sapiens
tggtaagtaccacatctacaatt

SEQ ID NO: 4209960 - DNA, 19 bp, Homo sapiens
tggtaatttgtatctgaag

SEQ ID NO: 4209961 - DNA, 16 bp, Homo sapiens
tggtacatggccagtg

SEQ ID NO: 4209962 - DNA, 13 bp, Homo sapiens
tggtagaagccag

SEQ ID NO: 4209963 - DNA, 18 bp, Homo sapiens
tggtagaattgggaagct

SEQ ID NO: 4209964 - DNA, 21 bp, Homo sapiens
tggtatgaacttgaggacaca

SEQ ID NO: 4209965 - DNA, 23 bp, Homo sapiens
tggtatgaacttgaggacacatg

SEQ ID NO: 4209966 - DNA, 15 bp, Homo sapiens
tggtatgagctgagg

SEQ ID NO: 4209967 - DNA, 16 bp, Homo sapiens
tggtatgagctgaggg

SEQ ID NO: 4209968 - DNA, 16 bp, Homo sapiens
tggtcaccatgaaact

SEQ ID NO: 4209969 - DNA, 15 bp, Homo sapiens
tggtcagagtgccac

SEQ ID NO: 4209970 - DNA, 17 bp, Homo sapiens
tggtccccagcattgca

SEQ ID NO: 4209971 - DNA, 14 bp, Homo sapiens
tggtcctgagacct

SEQ ID NO: 4209972 - DNA, 16 bp, Homo sapiens
tggtcctggggctctg

SEQ ID NO: 4209973 - DNA, 19 bp, Homo sapiens
tggtcctggggctctgtgc

SEQ ID NO: 4209974 - DNA, 23 bp, Homo sapiens
tggtccttccaggcccccaccac

SEQ ID NO: 4209975 - DNA, 12 bp, Homo sapiens
tggtctcagaaa

SEQ ID NO: 4209976 - DNA, 16 bp, Homo sapiens
tggtctgagcaccccc

SEQ ID NO: 4209977 - DNA, 15 bp, Homo sapiens
tggtctgctgacctg

SEQ ID NO: 4209978 - DNA, 15 bp, Homo sapiens
tggtcttcactgcca

SEQ ID NO: 4209979 - DNA, 19 bp, Homo sapiens
tggtctttgggcagggaat

SEQ ID NO: 4209980 - DNA, 18 bp, Homo sapiens
tggtgaggcccagcctgt

SEQ ID NO: 4209981 - DNA, 21 bp, Homo sapiens
tggtgccatttctgaactgtt

SEQ ID NO: 4209982 - DNA, 22 bp, Homo sapiens
tggtgctataggctggagaagc

SEQ ID NO: 4209983 - DNA, 13 bp, Homo sapiens
tggtgctgacctc

SEQ ID NO: 4209984 - DNA, 12 bp, Homo sapiens
tggtgctgtggc

SEQ ID NO: 4209985 - DNA, 17 bp, Homo sapiens
tggtgctttcaggtctg

SEQ ID NO: 4209986 - DNA, 16 bp, Homo sapiens
tggtggacagtcctgg

SEQ ID NO: 4209987 - DNA, 18 bp, Homo sapiens
tggtggacagtcctggga

SEQ ID NO: 4209988 - DNA, 17 bp, Homo sapiens
tggtggccaagcctggc

SEQ ID NO: 4209989 - DNA, 20 bp, Homo sapiens
tggtgggaagcaagcagggg

SEQ ID NO: 4209990 - DNA, 15 bp, Homo sapiens
tggtgtcaccagcct

SEQ ID NO: 4209991 - DNA, 18 bp, Homo sapiens
tggtgtgaccctctgaat

SEQ ID NO: 4209992 - DNA, 20 bp, Homo sapiens
tggtgtttgtaggctgtggg

SEQ ID NO: 4209993 - DNA, 21 bp, Homo sapiens
tggtgtttgtaggctgtgggg

SEQ ID NO: 4209994 - DNA, 16 bp, Homo sapiens
tggttcctaagcctgt

SEQ ID NO: 4209995 - DNA, 17 bp, Homo sapiens
tggttcctaagcctgtt

SEQ ID NO: 4209996 - DNA, 13 bp, Homo sapiens
tggttctgtgacc

SEQ ID NO: 4209997 - DNA, 22 bp, Homo sapiens
tggttggtaacacaaattttca

SEQ ID NO: 4209998 - DNA, 11 bp, Homo sapiens
tggtttacatg

SEQ ID NO: 4209999 - DNA, 17 bp, Homo sapiens
tggtttacatgaacaca

SEQ ID NO: 4210000 - DNA, 21 bp, Homo sapiens
tggtttatagagggccaagac

SEQ ID NO: 4210001 - DNA, 11 bp, Homo sapiens
tggtttcaaat

SEQ ID NO: 4210002 - DNA, 24 bp, Homo sapiens
tggtttgcagctgttttcaaagcc

SEQ ID NO: 4210003 - DNA, 17 bp, Homo sapiens
tggtttgccttccagaa

SEQ ID NO: 4210004 - DNA, 18 bp, Homo sapiens
tggttttaacaatttcct

SEQ ID NO: 4210005 - DNA, 24 bp, Homo sapiens
tggtttttgcaagatttaacacta

SEQ ID NO: 4210006 - DNA, 22 bp, Homo sapiens
tgtaaaaagagagaaaacttat

SEQ ID NO: 4210007 - DNA, 14 bp, Homo sapiens
tgtaaaatagcttg

SEQ ID NO: 4210008 - DNA, 15 bp, Homo sapiens
tgtaaacaacaaact

SEQ ID NO: 4210009 - DNA, 13 bp, Homo sapiens
tgtaaagccatgc

SEQ ID NO: 4210010 - DNA, 18 bp, Homo sapiens
tgtaaagtatgtaaacag

SEQ ID NO: 4210011 - DNA, 17 bp, Homo sapiens
tgtaaatattttaaaga

SEQ ID NO: 4210012 - DNA, 12 bp, Homo sapiens
tgtaaatccttt

SEQ ID NO: 4210013 - DNA, 19 bp, Homo sapiens
tgtaaatcctttttcttta

SEQ ID NO: 4210014 - DNA, 20 bp, Homo sapiens
tgtaaatcctttttctttat

SEQ ID NO: 4210015 - DNA, 22 bp, Homo sapiens
tgtaaatcctttttctttataa

SEQ ID NO: 4210016 - DNA, 18 bp, Homo sapiens
tgtaaatgcctcttaaat

SEQ ID NO: 4210017 - DNA, 20 bp, Homo sapiens
tgtaacacagctgagagact

SEQ ID NO: 4210018 - DNA, 13 bp, Homo sapiens
tgtaactcagaca

SEQ ID NO: 4210019 - DNA, 15 bp, Homo sapiens
tgtaagaaaatttga

SEQ ID NO: 4210020 - DNA, 14 bp, Homo sapiens
tgtaagctcaagct

SEQ ID NO: 4210021 - DNA, 20 bp, Homo sapiens
tgtaatagaaaactgaaaat

SEQ ID NO: 4210022 - DNA, 19 bp, Homo sapiens
tgtaatttttttgaaaaaa

SEQ ID NO: 4210023 - DNA, 15 bp, Homo sapiens
tgtacaaatgaaatt

SEQ ID NO: 4210024 - DNA, 11 bp, Homo sapiens
tgtacacagaa

SEQ ID NO: 4210025 - DNA, 14 bp, Homo sapiens
tgtacagttcagtt

SEQ ID NO: 4210026 - DNA, 19 bp, Homo sapiens
tgtacccaatttaattcca

SEQ ID NO: 4210027 - DNA, 18 bp, Homo sapiens
tgtactaaagccaaacat

SEQ ID NO: 4210028 - DNA, 15 bp, Homo sapiens
tgtactccagcctgg

SEQ ID NO: 4210029 - DNA, 17 bp, Homo sapiens
tgtactccagcctgggc

SEQ ID NO: 4210030 - DNA, 19 bp, Homo sapiens
tgtactccagcctgggcga

SEQ ID NO: 4210031 - DNA, 16 bp, Homo sapiens
tgtacttaataaattc

SEQ ID NO: 4210032 - DNA, 20 bp, Homo sapiens
tgtacttaataaattcagat

SEQ ID NO: 4210033 - DNA, 22 bp, Homo sapiens
tgtagaataataataaaaagac

SEQ ID NO: 4210034 - DNA, 20 bp, Homo sapiens
tgtagcaaccttctgcattc

SEQ ID NO: 4210035 - DNA, 13 bp, Homo sapiens
tgtagcacaaaga

SEQ ID NO: 4210036 - DNA, 18 bp, Homo sapiens
tgtagcacaaagagggag

SEQ ID NO: 4210037 - DNA, 23 bp, Homo sapiens
tgtagctcccgagctactctctt

SEQ ID NO: 4210038 - DNA, 17 bp, Homo sapiens
tgtagctcctctgctgc

SEQ ID NO: 4210039 - DNA, 20 bp, Homo sapiens
tgtagctttcctggtccctc

SEQ ID NO: 4210040 - DNA, 16 bp, Homo sapiens
tgtaggtattaaagat

SEQ ID NO: 4210041 - DNA, 11 bp, Homo sapiens
tgtaggttgct

SEQ ID NO: 4210042 - DNA, 23 bp, Homo sapiens
tgtagttaggaaataaaaccttt

SEQ ID NO: 4210043 - DNA, 19 bp, Homo sapiens
tgtagttcttgtctgattg

SEQ ID NO: 4210044 - DNA, 21 bp, Homo sapiens
tgtataacttcttaaaagttg

SEQ ID NO: 4210045 - DNA, 20 bp, Homo sapiens
tgtataatcccacccacctc

SEQ ID NO: 4210046 - DNA, 17 bp, Homo sapiens
tgtatacagattctagc

SEQ ID NO: 4210047 - DNA, 21 bp, Homo sapiens
tgtatatactatacaacaatg

SEQ ID NO: 4210048 - DNA, 15 bp, Homo sapiens
tgtatatagatgtgc

SEQ ID NO: 4210049 - DNA, 18 bp, Homo sapiens
tgtatatagatgtgcaag

SEQ ID NO: 4210050 - DNA, 14 bp, Homo sapiens
tgtatatcagaaaa

SEQ ID NO: 4210051 - DNA, 15 bp, Homo sapiens
tgtatccgactctaa

SEQ ID NO: 4210052 - DNA, 19 bp, Homo sapiens
tgtatccgactctaagctg

SEQ ID NO: 4210053 - DNA, 21 bp, Homo sapiens
tgtatccgactctaagctgtg

SEQ ID NO: 4210054 - DNA, 22 bp, Homo sapiens
tgtatccgactctaagctgtgt

SEQ ID NO: 4210055 - DNA, 15 bp, Homo sapiens
tgtatctacctcact

SEQ ID NO: 4210056 - DNA, 15 bp, Homo sapiens
tgtatgacttctgct

SEQ ID NO: 4210057 - DNA, 21 bp, Homo sapiens
tgtatgtcagacatccatgtt

SEQ ID NO: 4210058 - DNA, 21 bp, Homo sapiens
tgtatgtgtgtgtctgtgcgt

SEQ ID NO: 4210059 - DNA, 21 bp, Homo sapiens
tgtattaccttccacttccat

SEQ ID NO: 4210060 - DNA, 14 bp, Homo sapiens
tgtattcagacaga

SEQ ID NO: 4210061 - DNA, 19 bp, Homo sapiens
tgtatttttgtatgtggca

SEQ ID NO: 4210062 - DNA, 14 bp, Homo sapiens
tgtcaaaaaaaaaa

SEQ ID NO: 4210063 - DNA, 23 bp, Homo sapiens
tgtcaaaatcatgaatatttcaa

SEQ ID NO: 4210064 - DNA, 14 bp, Homo sapiens
tgtcaaagcttgcc

SEQ ID NO: 4210065 - DNA, 15 bp, Homo sapiens
tgtcaaagcttgccg

SEQ ID NO: 4210066 - DNA, 12 bp, Homo sapiens
tgtcaacaaaaa

SEQ ID NO: 4210067 - DNA, 15 bp, Homo sapiens
tgtcaacaaaaagac

SEQ ID NO: 4210068 - DNA, 20 bp, Homo sapiens
tgtcaacaaaaagacatgga

SEQ ID NO: 4210069 - DNA, 22 bp, Homo sapiens
tgtcaacaaaaagacatggaag

SEQ ID NO: 4210070 - DNA, 16 bp, Homo sapiens
tgtcaacacaaagaca

SEQ ID NO: 4210071 - DNA, 23 bp, Homo sapiens
tgtcaacacaaagacatggaagg

SEQ ID NO: 4210072 - DNA, 15 bp, Homo sapiens
tgtcaagaatgagaa

SEQ ID NO: 4210073 - DNA, 23 bp, Homo sapiens
tgtcaatccaatctgtaatttca

SEQ ID NO: 4210074 - DNA, 23 bp, Homo sapiens
tgtcaatttccctgactcctcta

SEQ ID NO: 4210075 - DNA, 17 bp, Homo sapiens
atgcatatttgcaaagt

SEQ ID NO: 4210076 - DNA, 19 bp, Homo sapiens
atgccgctcttctgtcatc

SEQ ID NO: 4210077 - DNA, 20 bp, Homo sapiens
atgccgctcttctgtcatcc

SEQ ID NO: 4210078 - DNA, 19 bp, Homo sapiens
atgctttcctccctggcat

SEQ ID NO: 4210079 - DNA, 19 bp, Homo sapiens
atggaggatctctaaagag

SEQ ID NO: 4210080 - DNA, 17 bp, Homo sapiens
atggcatccctttttca

SEQ ID NO: 4210081 - DNA, 16 bp, Homo sapiens
atggcatttttttaaa

SEQ ID NO: 4210082 - DNA, 15 bp, Homo sapiens
atgggaaaacttcac

SEQ ID NO: 4210083 - DNA, 16 bp, Homo sapiens
atggtgatgaaatgta

SEQ ID NO: 4210084 - DNA, 17 bp, Homo sapiens
atgtatattaaaaaaga

SEQ ID NO: 4210085 - DNA, 17 bp, Homo sapiens
atgtcacgtcttgaaaa

SEQ ID NO: 4210086 - DNA, 15 bp, Homo sapiens
atgtcagttgttatt

SEQ ID NO: 4210087 - DNA, 20 bp, Homo sapiens
atgtctatgttttctactcc

SEQ ID NO: 4210088 - DNA, 15 bp, Homo sapiens
atgtctttttattaa

SEQ ID NO: 4210089 - DNA, 22 bp, Homo sapiens
atgtctttttattaaaatattt

SEQ ID NO: 4210090 - DNA, 17 bp, Homo sapiens
atgttgtttataataaa

SEQ ID NO: 4210091 - DNA, 21 bp, Homo sapiens
atgtttaaaaacattccccaa

SEQ ID NO: 4210092 - DNA, 23 bp, Homo sapiens
atgtttgggagactgctgagtca

SEQ ID NO: 4210093 - DNA, 12 bp, Homo sapiens
atgttttcaaat

SEQ ID NO: 4210094 - DNA, 12 bp, Homo sapiens
attaaaatattt

SEQ ID NO: 4210095 - DNA, 18 bp, Homo sapiens
attaagagcaaactttag

SEQ ID NO: 4210096 - DNA, 13 bp, Homo sapiens
attacaaagttaa

SEQ ID NO: 4210097 - DNA, 15 bp, Homo sapiens
attacaaagttaaaa

SEQ ID NO: 4210098 - DNA, 21 bp, Homo sapiens
attactgagagtgcaaattgt

SEQ ID NO: 4210099 - DNA, 22 bp, Homo sapiens
attagataaccatattcacaat

SEQ ID NO: 4210100 - DNA, 15 bp, Homo sapiens
attaggaagtgttta

SEQ ID NO: 4210101 - DNA, 18 bp, Homo sapiens
attataaaggataaagaa

SEQ ID NO: 4210102 - DNA, 22 bp, Homo sapiens
attataaaggataaagaaggat

SEQ ID NO: 4210103 - DNA, 17 bp, Homo sapiens
attattctaattttata

SEQ ID NO: 4210104 - DNA, 17 bp, Homo sapiens
attattgatgttttcat

SEQ ID NO: 4210105 - DNA, 14 bp, Homo sapiens
attatttaagacta

SEQ ID NO: 4210106 - DNA, 20 bp, Homo sapiens
attattttagtctgtcatcc

SEQ ID NO: 4210107 - DNA, 18 bp, Homo sapiens
attcacaatggaaacttt

SEQ ID NO: 4210108 - DNA, 23 bp, Homo sapiens
attcacaatggaaactttaggtc

SEQ ID NO: 4210109 - DNA, 14 bp, Homo sapiens
attcactttattat

SEQ ID NO: 4210110 - DNA, 12 bp, Homo sapiens
attcagatgtat

SEQ ID NO: 4210111 - DNA, 17 bp, Homo sapiens
attcataagtctttggt

SEQ ID NO: 4210112 - DNA, 14 bp, Homo sapiens
attcattagttttg

SEQ ID NO: 4210113 - DNA, 18 bp, Homo sapiens
attccacagtctctggga

SEQ ID NO: 4210114 - DNA, 15 bp, Homo sapiens
attccccatcttcca

SEQ ID NO: 4210115 - DNA, 12 bp, Homo sapiens
attcctttttct

SEQ ID NO: 4210116 - DNA, 17 bp, Homo sapiens
attcttactaaaaagta

SEQ ID NO: 4210117 - DNA, 22 bp, Homo sapiens
attcttactaaaaagtataaaa

SEQ ID NO: 4210118 - DNA, 16 bp, Homo sapiens
attcttggagaacttt

SEQ ID NO: 4210119 - DNA, 20 bp, Homo sapiens
attcttgttgctgtacaaaa

SEQ ID NO: 4210120 - DNA, 21 bp, Homo sapiens
attcttgttgctgtacaaaag

SEQ ID NO: 4210121 - DNA, 22 bp, Homo sapiens
attcttgttgctgtacaaaagc

SEQ ID NO: 4210122 - DNA, 10 bp, Homo sapiens
attgaagaat

SEQ ID NO: 4210123 - DNA, 22 bp, Homo sapiens
attgaagatgtgatcaatagat

SEQ ID NO: 4210124 - DNA, 13 bp, Homo sapiens
attgagccattta

SEQ ID NO: 4210125 - DNA, 22 bp, Homo sapiens
attgagtttaagtctctgactc

SEQ ID NO: 4210126 - DNA, 15 bp, Homo sapiens
attgatccacttctt

SEQ ID NO: 4210127 - DNA, 18 bp, Homo sapiens
attggtaaagaatggaag

SEQ ID NO: 4210128 - DNA, 19 bp, Homo sapiens
attgtaaacagaaattgca

SEQ ID NO: 4210129 - DNA, 20 bp, Homo sapiens
attgtaaacagaaattgcaa

SEQ ID NO: 4210130 - DNA, 15 bp, Homo sapiens
attgtaatacacata

SEQ ID NO: 4210131 - DNA, 21 bp, Homo sapiens
attgtctttaatataataaaa

SEQ ID NO: 4210132 - DNA, 12 bp, Homo sapiens
attgttatcaaa

SEQ ID NO: 4210133 - DNA, 22 bp, Homo sapiens
atttaatttgaaggtagaatgt

SEQ ID NO: 4210134 - DNA, 23 bp, Homo sapiens
atttataatataaatcaatctta

SEQ ID NO: 4210135 - DNA, 15 bp, Homo sapiens
atttattgaaatgat

SEQ ID NO: 4210136 - DNA, 17 bp, Homo sapiens
atttcacagtgtgtggt

SEQ ID NO: 4210137 - DNA, 18 bp, Homo sapiens
atttgaaggtagaatgtt

SEQ ID NO: 4210138 - DNA, 13 bp, Homo sapiens
atttggaaaataa

SEQ ID NO: 4210139 - DNA, 21 bp, Homo sapiens
atttgtcttcccttctttgca

SEQ ID NO: 4210140 - DNA, 13 bp, Homo sapiens
attttacagagct

SEQ ID NO: 4210141 - DNA, 22 bp, Homo sapiens
attttacctagctaattattta

SEQ ID NO: 4210142 - DNA, 18 bp, Homo sapiens
attttagtctgtcatcca

SEQ ID NO: 4210143 - DNA, 20 bp, Homo sapiens
attttagtctgtcatccaga

SEQ ID NO: 4210144 - DNA, 19 bp, Homo sapiens
attttcattaaaaatgaaa

SEQ ID NO: 4210145 - DNA, 13 bp, Homo sapiens
attttccaataaa

SEQ ID NO: 4210146 - DNA, 22 bp, Homo sapiens
attttccaataaaattttcaaa

SEQ ID NO: 4210147 - DNA, 15 bp, Homo sapiens
attttctaaagactt

SEQ ID NO: 4210148 - DNA, 18 bp, Homo sapiens
attttgccagtgggaact

SEQ ID NO: 4210149 - DNA, 19 bp, Homo sapiens
atttttgataaattatgtt

SEQ ID NO: 4210150 - DNA, 19 bp, Homo sapiens
attttttatgtacaaccct

SEQ ID NO: 4210151 - DNA, 22 bp, Homo sapiens
caaaaaacttttaatgccttcc

SEQ ID NO: 4210152 - DNA, 14 bp, Homo sapiens
caaaatatttaatt

SEQ ID NO: 4210153 - DNA, 15 bp, Homo sapiens
caaaatatttaatta

SEQ ID NO: 4210154 - DNA, 21 bp, Homo sapiens
caaacagaaaagtgcaaagtt

SEQ ID NO: 4210155 - DNA, 12 bp, Homo sapiens
caaacatttctt

SEQ ID NO: 4210156 - DNA, 18 bp, Homo sapiens
caaagaaaatgaaatgca

SEQ ID NO: 4210157 - DNA, 17 bp, Homo sapiens
caaaggaaaatgtctgt

SEQ ID NO: 4210158 - DNA, 20 bp, Homo sapiens
caaagtctgctctcatataa

SEQ ID NO: 4210159 - DNA, 22 bp, Homo sapiens
caaagttattccccatcttcca

SEQ ID NO: 4210160 - DNA, 15 bp, Homo sapiens
caaatgatccttcct

SEQ ID NO: 4210161 - DNA, 16 bp, Homo sapiens
caaatgatccttccta

SEQ ID NO: 4210162 - DNA, 22 bp, Homo sapiens
caaattccaaacttctaaatgt

SEQ ID NO: 4210163 - DNA, 23 bp, Homo sapiens
caacatgccagccactgtgatag

SEQ ID NO: 4210164 - DNA, 18 bp, Homo sapiens
caacattggagacatcac

SEQ ID NO: 4210165 - DNA, 17 bp, Homo sapiens
caactatgatttggaaa

SEQ ID NO: 4210166 - DNA, 20 bp, Homo sapiens
caacttcatataactgagat

SEQ ID NO: 4210167 - DNA, 12 bp, Homo sapiens
caacttgggaac

SEQ ID NO: 4210168 - DNA, 16 bp, Homo sapiens
caacttgtaaatgtgg

SEQ ID NO: 4210169 - DNA, 20 bp, Homo sapiens
caagaaggaaatagccaccg

SEQ ID NO: 4210170 - DNA, 24 bp, Homo sapiens
caagagttctttaggtgcctcctg

SEQ ID NO: 4210171 - DNA, 15 bp, Homo sapiens
caataaaattttcaa

SEQ ID NO: 4210172 - DNA, 20 bp, Homo sapiens
caataaaattttcaaacttt

SEQ ID NO: 4210173 - DNA, 15 bp, Homo sapiens
caatgaacaaaggga

SEQ ID NO: 4210174 - DNA, 22 bp, Homo sapiens
caatgaacaaagggattctcca

SEQ ID NO: 4210175 - DNA, 13 bp, Homo sapiens
caatgagagcata

SEQ ID NO: 4210176 - DNA, 19 bp, Homo sapiens
caatgagagcataatttaa

SEQ ID NO: 4210177 - DNA, 21 bp, Homo sapiens
caatgttcctgctaataattt

SEQ ID NO: 4210178 - DNA, 18 bp, Homo sapiens
caattatcttatttaatt

SEQ ID NO: 4210179 - DNA, 17 bp, Homo sapiens
caattccacagtctctg

SEQ ID NO: 4210180 - DNA, 22 bp, Homo sapiens
caattgtaaacagaaattgcaa

SEQ ID NO: 4210181 - DNA, 12 bp, Homo sapiens
cacacgcctgta

SEQ ID NO: 4210182 - DNA, 21 bp, Homo sapiens
cacagactacagccagaagcc

SEQ ID NO: 4210183 - DNA, 16 bp, Homo sapiens
cacagcaattcctcag

SEQ ID NO: 4210184 - DNA, 12 bp, Homo sapiens
cacagtctctgg

SEQ ID NO: 4210185 - DNA, 18 bp, Homo sapiens
cacatgaaccatccttcc

SEQ ID NO: 4210186 - DNA, 22 bp, Homo sapiens
cacatgaaccatccttcccatg

SEQ ID NO: 4210187 - DNA, 23 bp, Homo sapiens
cacatgaaccatccttcccatga

SEQ ID NO: 4210188 - DNA, 23 bp, Homo sapiens
cacattaattagattttcttgca

SEQ ID NO: 4210189 - DNA, 22 bp, Homo sapiens
caccaagttggaacatccttgg

SEQ ID NO: 4210190 - DNA, 16 bp, Homo sapiens
caccagcatgtcactc

SEQ ID NO: 4210191 - DNA, 18 bp, Homo sapiens
caccgtctacagatggct

SEQ ID NO: 4210192 - DNA, 21 bp, Homo sapiens
cacctcccaggggctccacct

SEQ ID NO: 4210193 - DNA, 16 bp, Homo sapiens
cacctccctgccctgt

SEQ ID NO: 4210194 - DNA, 15 bp, Homo sapiens
ctttaagaactaaaa

SEQ ID NO: 4210195 - DNA, 16 bp, Homo sapiens
ctttccacctgctttc

SEQ ID NO: 4210196 - DNA, 13 bp, Homo sapiens
ctttcctccctgg

SEQ ID NO: 4210197 - DNA, 16 bp, Homo sapiens
ctttgagcttaagaat

SEQ ID NO: 4210198 - DNA, 16 bp, Homo sapiens
ctttgcacttttgaaa

SEQ ID NO: 4210199 - DNA, 16 bp, Homo sapiens
ctttgcttctctccac

SEQ ID NO: 4210200 - DNA, 18 bp, Homo sapiens
ctttggaggaacagctcc

SEQ ID NO: 4210201 - DNA, 21 bp, Homo sapiens
ctttttaaaaattgttattta

SEQ ID NO: 4210202 - DNA, 18 bp, Homo sapiens
ctttttattaaaatattt

SEQ ID NO: 4210203 - DNA, 14 bp, Homo sapiens
ctttttgaaatgtc

SEQ ID NO: 4210204 - DNA, 20 bp, Homo sapiens
ctttttgttttttgcttatt

SEQ ID NO: 4210205 - DNA, 19 bp, Homo sapiens
cttttttttacttatatat

SEQ ID NO: 4210206 - DNA, 13 bp, Homo sapiens
gaaaaaatggcaa

SEQ ID NO: 4210207 - DNA, 16 bp, Homo sapiens
gaaaaaatggcaagag

SEQ ID NO: 4210208 - DNA, 19 bp, Homo sapiens
gaaaaaatggcaagagatc

SEQ ID NO: 4210209 - DNA, 18 bp, Homo sapiens
gaaaacttcactccaaag

SEQ ID NO: 4210210 - DNA, 23 bp, Homo sapiens
gaaaataaatcaatgctataact

SEQ ID NO: 4210211 - DNA, 17 bp, Homo sapiens
gaaaatgaaatgcatat

SEQ ID NO: 4210212 - DNA, 18 bp, Homo sapiens
gaaaatgtgtcagcatgc

SEQ ID NO: 4210213 - DNA, 15 bp, Homo sapiens
gaaacacctcccagg

SEQ ID NO: 4210214 - DNA, 12 bp, Homo sapiens
gaaagaaatgta

SEQ ID NO: 4210215 - DNA, 16 bp, Homo sapiens
gaaataaaatatatct

SEQ ID NO: 4210216 - DNA, 23 bp, Homo sapiens
gaaatatcaaagtcattaaagac

SEQ ID NO: 4210217 - DNA, 14 bp, Homo sapiens
gaaatgacattttg

SEQ ID NO: 4210218 - DNA, 24 bp, Homo sapiens
gaaatggaggatctctaaagagca

SEQ ID NO: 4210219 - DNA, 22 bp, Homo sapiens
gaaatgtctatgttttctactc

SEQ ID NO: 4210220 - DNA, 16 bp, Homo sapiens
gaaatgtgatttgtct

SEQ ID NO: 4210221 - DNA, 13 bp, Homo sapiens
gaacaagcttcag

SEQ ID NO: 4210222 - DNA, 18 bp, Homo sapiens
gaacagataatccctgta

SEQ ID NO: 4210223 - DNA, 19 bp, Homo sapiens
gaaccacattgaagaatgt

SEQ ID NO: 4210224 - DNA, 15 bp, Homo sapiens
gaactgccaagaaaa

SEQ ID NO: 4210225 - DNA, 18 bp, Homo sapiens
gaagaagacacattccta

SEQ ID NO: 4210226 - DNA, 17 bp, Homo sapiens
gaagattctatgttaat

SEQ ID NO: 4210227 - DNA, 16 bp, Homo sapiens
gaagcccatggagcag

SEQ ID NO: 4210228 - DNA, 21 bp, Homo sapiens
gaaggatgatgtctttttatt

SEQ ID NO: 4210229 - DNA, 17 bp, Homo sapiens
gaaggtagaatgttttc

SEQ ID NO: 4210230 - DNA, 20 bp, Homo sapiens
gaaggtagaatgttttcaaa

SEQ ID NO: 4210231 - DNA, 22 bp, Homo sapiens
gaagtgcggggtaggggaagaa

SEQ ID NO: 4210232 - DNA, 13 bp, Homo sapiens
gaataagccatga

SEQ ID NO: 4210233 - DNA, 19 bp, Homo sapiens
gaatatgtagtatctatat

SEQ ID NO: 4210234 - DNA, 15 bp, Homo sapiens
gaatggcagctggaa

SEQ ID NO: 4210235 - DNA, 20 bp, Homo sapiens
gaatgtaattttgaactgtt

SEQ ID NO: 4210236 - DNA, 17 bp, Homo sapiens
gaatgtcagttgttatt

SEQ ID NO: 4210237 - DNA, 22 bp, Homo sapiens
gaatgtcagttgttatttattg

SEQ ID NO: 4210238 - DNA, 23 bp, Homo sapiens
gaatgttagagtaatgaaatgga

SEQ ID NO: 4210239 - DNA, 20 bp, Homo sapiens
gaatgtttgaactgccaaga

SEQ ID NO: 4210240 - DNA, 11 bp, Homo sapiens
gaattcccagg

SEQ ID NO: 4210241 - DNA, 17 bp, Homo sapiens
gaattctggaggaagaa

SEQ ID NO: 4210242 - DNA, 20 bp, Homo sapiens
gacaaaattggccagagagt

SEQ ID NO: 4210243 - DNA, 15 bp, Homo sapiens
gacaaagttatatat

SEQ ID NO: 4210244 - DNA, 22 bp, Homo sapiens
gacaaatattcctttgcatatt

SEQ ID NO: 4210245 - DNA, 17 bp, Homo sapiens
gacactgttgataaaaa

SEQ ID NO: 4210246 - DNA, 21 bp, Homo sapiens
gacagatctctgctttggaaa

SEQ ID NO: 4210247 - DNA, 18 bp, Homo sapiens
gacccaagtactttccaa

SEQ ID NO: 4210248 - DNA, 16 bp, Homo sapiens
gacggaggttgcagtg

SEQ ID NO: 4210249 - DNA, 17 bp, Homo sapiens
gactacagccagaagcc

SEQ ID NO: 4210250 - DNA, 12 bp, Homo sapiens
gactcttgcctt

SEQ ID NO: 4210251 - DNA, 17 bp, Homo sapiens
gactgacacctcactga

SEQ ID NO: 4210252 - DNA, 17 bp, Homo sapiens
gactgtacttattttcc

SEQ ID NO: 4210253 - DNA, 12 bp, Homo sapiens
gacttccacaaa

SEQ ID NO: 4210254 - DNA, 17 bp, Homo sapiens
gacttccacaaacctgg

SEQ ID NO: 4210255 - DNA, 21 bp, Homo sapiens
gacttgagcctccatttctgg

SEQ ID NO: 4210256 - DNA, 16 bp, Homo sapiens
gagacactgttgataa

SEQ ID NO: 4210257 - DNA, 11 bp, Homo sapiens
gagagaactta

SEQ ID NO: 4210258 - DNA, 14 bp, Homo sapiens
gagagaacttaaaa

SEQ ID NO: 4210259 - DNA, 12 bp, Homo sapiens
gagagcataatt

SEQ ID NO: 4210260 - DNA, 18 bp, Homo sapiens
gagatccagggcaaggcc

SEQ ID NO: 4210261 - DNA, 22 bp, Homo sapiens
gagcacaagaggagatccaggg

SEQ ID NO: 4210262 - DNA, 15 bp, Homo sapiens
gagcggctctcctga

SEQ ID NO: 4210263 - DNA, 16 bp, Homo sapiens
gaggcaaacatttctt

SEQ ID NO: 4210264 - DNA, 12 bp, Homo sapiens
gaggccttctcg

SEQ ID NO: 4210265 - DNA, 18 bp, Homo sapiens
gaggctgaggcaggagaa

SEQ ID NO: 4210266 - DNA, 14 bp, Homo sapiens
gaggttgcagtgag

SEQ ID NO: 4210267 - DNA, 21 bp, Homo sapiens
gagttctttaggtgcctcctg

SEQ ID NO: 4210268 - DNA, 21 bp, Homo sapiens
gagttggtgtgctatttttga

SEQ ID NO: 4210269 - DNA, 15 bp, Homo sapiens
gagttttttttaacc

SEQ ID NO: 4210270 - DNA, 20 bp, Homo sapiens
gatactgagattgtctgttc

SEQ ID NO: 4210271 - DNA, 19 bp, Homo sapiens
gatacttcccacaccacaa

SEQ ID NO: 4210272 - DNA, 16 bp, Homo sapiens
gatgaaatgtaaatac

SEQ ID NO: 4210273 - DNA, 15 bp, Homo sapiens
gatgcactttggaag

SEQ ID NO: 4210274 - DNA, 20 bp, Homo sapiens
gatgccgctcttctgtcatc

SEQ ID NO: 4210275 - DNA, 22 bp, Homo sapiens
gatggcttagttaagtcatcca

SEQ ID NO: 4210276 - DNA, 21 bp, Homo sapiens
gatggtggtgagcacatctgg

SEQ ID NO: 4210277 - DNA, 23 bp, Homo sapiens
gatgtctttttattaaaatattt

SEQ ID NO: 4210278 - DNA, 22 bp, Homo sapiens
gatgtggtgatactgagattgt

SEQ ID NO: 4210279 - DNA, 21 bp, Homo sapiens
gattacaggcttgaaagtcta

SEQ ID NO: 4210280 - DNA, 17 bp, Homo sapiens
gattatttaagactaaa

SEQ ID NO: 4210281 - DNA, 12 bp, Homo sapiens
gattcatattta

SEQ ID NO: 4210282 - DNA, 20 bp, Homo sapiens
gattctatgttaatatttta

SEQ ID NO: 4210283 - DNA, 16 bp, Homo sapiens
gatttgtcttcccttc

SEQ ID NO: 4210284 - DNA, 22 bp, Homo sapiens
gattttttatgtacaaccctga

SEQ ID NO: 4210285 - DNA, 16 bp, Homo sapiens
gcaaactttagtgtct

SEQ ID NO: 4210286 - DNA, 12 bp, Homo sapiens
gcaaagaaaatg

SEQ ID NO: 4210287 - DNA, 16 bp, Homo sapiens
gcaacagtagcaggga

SEQ ID NO: 4210288 - DNA, 18 bp, Homo sapiens
gcaagcaagaaacactgg

SEQ ID NO: 4210289 - DNA, 18 bp, Homo sapiens
gcacaatttatattttcc

SEQ ID NO: 4210290 - DNA, 14 bp, Homo sapiens
gcactcctctgtct

SEQ ID NO: 4210291 - DNA, 17 bp, Homo sapiens
gcactcctctgtctctg

SEQ ID NO: 4210292 - DNA, 18 bp, Homo sapiens
gcactcctctgtctctgc

SEQ ID NO: 4210293 - DNA, 19 bp, Homo sapiens
gcactcctctgtctctgct

SEQ ID NO: 4210294 - DNA, 21 bp, Homo sapiens
gcactcctctgtctctgctct

SEQ ID NO: 4210295 - DNA, 21 bp, Homo sapiens
gcactgaatggctgacctgac

SEQ ID NO: 4210296 - DNA, 20 bp, Homo sapiens
gcactttgggaggctgaagt

SEQ ID NO: 4210297 - DNA, 14 bp, Homo sapiens
gcagatgtggtgat

SEQ ID NO: 4210298 - DNA, 23 bp, Homo sapiens
gcagattattttagtctgtcatc

SEQ ID NO: 4210299 - DNA, 20 bp, Homo sapiens
gcaggaaggctgagaggaga

SEQ ID NO: 4210300 - DNA, 11 bp, Homo sapiens
gcagttttttt

SEQ ID NO: 4210301 - DNA, 20 bp, Homo sapiens
gcataatttaaaaatatatt

SEQ ID NO: 4210302 - DNA, 19 bp, Homo sapiens
gcatataatgaataaatca

SEQ ID NO: 4210303 - DNA, 23 bp, Homo sapiens
gcatattataaaggataaagaag

SEQ ID NO: 4210304 - DNA, 19 bp, Homo sapiens
gcatatttgcaaagtgtat

SEQ ID NO: 4210305 - DNA, 14 bp, Homo sapiens
gcatgaaataaaat

SEQ ID NO: 4210306 - DNA, 18 bp, Homo sapiens
gcatgaaataaaatatat

SEQ ID NO: 4210307 - DNA, 16 bp, Homo sapiens
gcatgaccatcctgtc

SEQ ID NO: 4210308 - DNA, 16 bp, Homo sapiens
gcattgtctttaatat

SEQ ID NO: 4210309 - DNA, 22 bp, Homo sapiens
gcattgtctttaatataataaa

SEQ ID NO: 4210310 - DNA, 14 bp, Homo sapiens
gccaaatccatcct

SEQ ID NO: 4210311 - DNA, 14 bp, Homo sapiens
gccaaatttatatg

SEQ ID NO: 4210312 - DNA, 19 bp, Homo sapiens
gccactgcactctagcctg

SEQ ID NO: 4210313 - DNA, 22 bp, Homo sapiens
gccagatgcacatccctggaag

SEQ ID NO: 4210314 - DNA, 16 bp, Homo sapiens
tgggagagccatacat

SEQ ID NO: 4210315 - DNA, 17 bp, Homo sapiens
tgggaggctgaagtggg

SEQ ID NO: 4210316 - DNA, 19 bp, Homo sapiens
tgggcccgctttgcctgct

SEQ ID NO: 4210317 - DNA, 21 bp, Homo sapiens
tgggtagaaagagatacagag

SEQ ID NO: 4210318 - DNA, 22 bp, Homo sapiens
tgggtggaggaagatccaaaca

SEQ ID NO: 4210319 - DNA, 22 bp, Homo sapiens
tgggtggatcaccagaggtcag

SEQ ID NO: 4210320 - DNA, 17 bp, Homo sapiens
tgggttggaaaacagta

SEQ ID NO: 4210321 - DNA, 14 bp, Homo sapiens
tggtctccctccag

SEQ ID NO: 4210322 - DNA, 19 bp, Homo sapiens
tggtctccctccagctgga

SEQ ID NO: 4210323 - DNA, 20 bp, Homo sapiens
tggtctttgaaagaaatgta

SEQ ID NO: 4210324 - DNA, 18 bp, Homo sapiens
tggtgatactgagattgt

SEQ ID NO: 4210325 - DNA, 17 bp, Homo sapiens
tggtggctgtctctgtc

SEQ ID NO: 4210326 - DNA, 23 bp, Homo sapiens
tggtggctgtctctgtccctcac

SEQ ID NO: 4210327 - DNA, 21 bp, Homo sapiens
tgtaaatactgtttttaacaa

SEQ ID NO: 4210328 - DNA, 15 bp, Homo sapiens
tgtaacatagattta

SEQ ID NO: 4210329 - DNA, 15 bp, Homo sapiens
tgtaacttccaaata

SEQ ID NO: 4210330 - DNA, 13 bp, Homo sapiens
tgtacaaaagcaa

SEQ ID NO: 4210331 - DNA, 20 bp, Homo sapiens
tgtacttattttccaataaa

SEQ ID NO: 4210332 - DNA, 19 bp, Homo sapiens
tgtatagcatgaaataaaa

SEQ ID NO: 4210333 - DNA, 21 bp, Homo sapiens
tgtatgaacatggagaggact

SEQ ID NO: 4210334 - DNA, 15 bp, Homo sapiens
tgtattagtcacaga

SEQ ID NO: 4210335 - DNA, 14 bp, Homo sapiens
tgtattttccatac

SEQ ID NO: 4210336 - DNA, 13 bp, Homo sapiens
tgtcactcccaga

SEQ ID NO: 4210337 - DNA, 19 bp, Homo sapiens
tgtcagcatgcatagtgct

SEQ ID NO: 4210338 - DNA, 18 bp, Homo sapiens
tgtcagttgttatttatt

SEQ ID NO: 4210339 - DNA, 22 bp, Homo sapiens
tgtcagttgttatttattgaaa

SEQ ID NO: 4210340 - DNA, 16 bp, Homo sapiens
tgtcatcccgctcctg

SEQ ID NO: 4210341 - DNA, 22 bp, Homo sapiens
tgtccgaagaccgaattttatt

SEQ ID NO: 4210342 - DNA, 15 bp, Homo sapiens
tgtcctattatattc

SEQ ID NO: 4210343 - DNA, 11 bp, Homo sapiens
tgtcctgctgt

SEQ ID NO: 4210344 - DNA, 23 bp, Homo sapiens
tgtcctttgttattatcctgcat

SEQ ID NO: 4210345 - DNA, 16 bp, Homo sapiens
tgtcgcctgcccccag

SEQ ID NO: 4210346 - DNA, 17 bp, Homo sapiens
tgtctctgctcttgcct

SEQ ID NO: 4210347 - DNA, 18 bp, Homo sapiens
tgtctggggaccctgtag

SEQ ID NO: 4210348 - DNA, 22 bp, Homo sapiens
tgtgaattcccaggttggcctg

SEQ ID NO: 4210349 - DNA, 15 bp, Homo sapiens
tgtgagaagaaatga

SEQ ID NO: 4210350 - DNA, 22 bp, Homo sapiens
tgtgatttgtcttcccttcttt

SEQ ID NO: 4210351 - DNA, 17 bp, Homo sapiens
tgtgcacatctgttttg

SEQ ID NO: 4210352 - DNA, 17 bp, Homo sapiens
tgtgcacttatttatga

SEQ ID NO: 4210353 - DNA, 14 bp, Homo sapiens
tgtgcctaatgtgt

SEQ ID NO: 4210354 - DNA, 23 bp, Homo sapiens
tgtgcttcaaatgatccttccta

SEQ ID NO: 4210355 - DNA, 21 bp, Homo sapiens
tgtggccatcaggactttccc

SEQ ID NO: 4210356 - DNA, 14 bp, Homo sapiens
tgtgtttagatttt

SEQ ID NO: 4210357 - DNA, 17 bp, Homo sapiens
tgttatttattgaaatg

SEQ ID NO: 4210358 - DNA, 18 bp, Homo sapiens
tgttatttattgaaatga

SEQ ID NO: 4210359 - DNA, 17 bp, Homo sapiens
tgttctggagctgctgt

SEQ ID NO: 4210360 - DNA, 21 bp, Homo sapiens
tgttgaagaagagtttgcaaa

SEQ ID NO: 4210361 - DNA, 19 bp, Homo sapiens
tgttgctgtacaaaagcaa

SEQ ID NO: 4210362 - DNA, 21 bp, Homo sapiens
tgttgtcccagggctgatgct

SEQ ID NO: 4210363 - DNA, 21 bp, Homo sapiens
tgttgtttataataaaaatat

SEQ ID NO: 4210364 - DNA, 15 bp, Homo sapiens
tgtttaatggtagtt

SEQ ID NO: 4210365 - DNA, 20 bp, Homo sapiens
tgtttagatgaatgtcagtt

SEQ ID NO: 4210366 - DNA, 15 bp, Homo sapiens
tgtttatataatttt

SEQ ID NO: 4210367 - DNA, 18 bp, Homo sapiens
tgtttatgttgtttataa

SEQ ID NO: 4210368 - DNA, 22 bp, Homo sapiens
tgtttatgttgtttataataaa

SEQ ID NO: 4210369 - DNA, 18 bp, Homo sapiens
tgtttgaactgccaagaa

SEQ ID NO: 4210370 - DNA, 22 bp, Homo sapiens
tgtttgagcatcgcttaggaga

SEQ ID NO: 4210371 - DNA, 13 bp, Homo sapiens
tgtttgtgcttca

SEQ ID NO: 4210372 - DNA, 23 bp, Homo sapiens
ttaaaaaaatcacactctaagtt

SEQ ID NO: 4210373 - DNA, 14 bp, Homo sapiens
ttaaaaattgttat

SEQ ID NO: 4210374 - DNA, 18 bp, Homo sapiens
ttaacctgtttatataat

SEQ ID NO: 4210375 - DNA, 23 bp, Homo sapiens
ttaacttaatggcacaaagtctt

SEQ ID NO: 4210376 - DNA, 19 bp, Homo sapiens
ttaagaactaaaatgttct

SEQ ID NO: 4210377 - DNA, 22 bp, Homo sapiens
ttaagtctctgactcttgcctt

SEQ ID NO: 4210378 - DNA, 14 bp, Homo sapiens
ttaatgccttccac

SEQ ID NO: 4210379 - DNA, 12 bp, Homo sapiens
ttaattttcact

SEQ ID NO: 4210380 - DNA, 13 bp, Homo sapiens
ttaatttttgcaa

SEQ ID NO: 4210381 - DNA, 14 bp, Homo sapiens
ttacattgccattt

SEQ ID NO: 4210382 - DNA, 12 bp, Homo sapiens
ttacttatatat

SEQ ID NO: 4210383 - DNA, 20 bp, Homo sapiens
ttagataaccatattcacaa

SEQ ID NO: 4210384 - DNA, 20 bp, Homo sapiens
ttaggaagtgtttatgttgt

SEQ ID NO: 4210385 - DNA, 20 bp, Homo sapiens
ttaggagaagtcttctattt

SEQ ID NO: 4210386 - DNA, 23 bp, Homo sapiens
ttatcaaaatagtctaaggccat

SEQ ID NO: 4210387 - DNA, 16 bp, Homo sapiens
ttatcatgtctatttt

SEQ ID NO: 4210388 - DNA, 15 bp, Homo sapiens
ttatctactaattga

SEQ ID NO: 4210389 - DNA, 14 bp, Homo sapiens
ttatcttatttaat

SEQ ID NO: 4210390 - DNA, 13 bp, Homo sapiens
ttatgactgtgaa

SEQ ID NO: 4210391 - DNA, 14 bp, Homo sapiens
ttatgtaatgcttt

SEQ ID NO: 4210392 - DNA, 11 bp, Homo sapiens
ttatgtacaac

SEQ ID NO: 4210393 - DNA, 13 bp, Homo sapiens
ttatgtacaaccc

SEQ ID NO: 4210394 - DNA, 18 bp, Homo sapiens
ttattcattagttttgaa

SEQ ID NO: 4210395 - DNA, 21 bp, Homo sapiens
ttattcattagttttgaagat

SEQ ID NO: 4210396 - DNA, 22 bp, Homo sapiens
ttattgtccccactaaaacaaa

SEQ ID NO: 4210397 - DNA, 11 bp, Homo sapiens
ttatttattga

SEQ ID NO: 4210398 - DNA, 20 bp, Homo sapiens
ttatttggaataataatttt

SEQ ID NO: 4210399 - DNA, 20 bp, Homo sapiens
ttattttagtctgtcatcca

SEQ ID NO: 4210400 - DNA, 20 bp, Homo sapiens
ttcaaaaattgtgtttagat

SEQ ID NO: 4210401 - DNA, 21 bp, Homo sapiens
ttcaagacaccaaattccaaa

SEQ ID NO: 4210402 - DNA, 19 bp, Homo sapiens
ttcaatctggattcatatt

SEQ ID NO: 4210403 - DNA, 17 bp, Homo sapiens
ttcacaatggaaacttt

SEQ ID NO: 4210404 - DNA, 12 bp, Homo sapiens
ttcactccaaag

SEQ ID NO: 4210405 - DNA, 15 bp, Homo sapiens
ttcagaaagaagtgg

SEQ ID NO: 4210406 - DNA, 16 bp, Homo sapiens
ttcagaacatcctcca

SEQ ID NO: 4210407 - DNA, 17 bp, Homo sapiens
ttcagaagtcacacatt

SEQ ID NO: 4210408 - DNA, 20 bp, Homo sapiens
ttcagtaagttatctttgaa

SEQ ID NO: 4210409 - DNA, 14 bp, Homo sapiens
ttcataaattattt

SEQ ID NO: 4210410 - DNA, 18 bp, Homo sapiens
ttcatagagaatataaaa

SEQ ID NO: 4210411 - DNA, 11 bp, Homo sapiens
ttccaataaaa

SEQ ID NO: 4210412 - DNA, 13 bp, Homo sapiens
ttccaataaaatt

SEQ ID NO: 4210413 - DNA, 20 bp, Homo sapiens
ttccacattaattagatttt

SEQ ID NO: 4210414 - DNA, 13 bp, Homo sapiens
ttccatttcttcc

SEQ ID NO: 4210415 - DNA, 14 bp, Homo sapiens
ttccatttcttcca

SEQ ID NO: 4210416 - DNA, 22 bp, Homo sapiens
ttcccaccaactcctatttccc

SEQ ID NO: 4210417 - DNA, 15 bp, Homo sapiens
ttcccctcgctgtcc

SEQ ID NO: 4210418 - DNA, 16 bp, Homo sapiens
ttcctaagttcccttc

SEQ ID NO: 4210419 - DNA, 19 bp, Homo sapiens
ttcctaagttcccttctat

SEQ ID NO: 4210420 - DNA, 12 bp, Homo sapiens
ttcctctccagc

SEQ ID NO: 4210421 - DNA, 13 bp, Homo sapiens
ttcctctccagcc

SEQ ID NO: 4210422 - DNA, 14 bp, Homo sapiens
ttcctttgcatatt

SEQ ID NO: 4210423 - DNA, 19 bp, Homo sapiens
ttcctttgcatattataaa

SEQ ID NO: 4210424 - DNA, 13 bp, Homo sapiens
ttcctttttctat

SEQ ID NO: 4210425 - DNA, 17 bp, Homo sapiens
ttctcccctctctttct

SEQ ID NO: 4210426 - DNA, 22 bp, Homo sapiens
ttctcccctctctttctaagag

SEQ ID NO: 4210427 - DNA, 12 bp, Homo sapiens
ttctctctctgg

SEQ ID NO: 4210428 - DNA, 15 bp, Homo sapiens
ttctggagctgctgt

SEQ ID NO: 4210429 - DNA, 22 bp, Homo sapiens
ttctgtcatcccgctcctgctg

SEQ ID NO: 4210430 - DNA, 14 bp, Homo sapiens
ttctgtttaatttt

SEQ ID NO: 4210431 - DNA, 19 bp, Homo sapiens
ttcttaaaatgtttcattt

SEQ ID NO: 4210432 - DNA, 20 bp, Homo sapiens
ttcttactaaaaagtataaa

SEQ ID NO: 4210433 - DNA, 17 bp, Homo sapiens
ttcttatgttgcccagt

SEQ ID NO: 4210434 - DNA, 16 bp, Homo sapiens
aagaaaaaatggcaag

SEQ ID NO: 4210435 - DNA, 18 bp, Homo sapiens
aagaaaaaatggcaagag

SEQ ID NO: 4210436 - DNA, 20 bp, Homo sapiens
aagaacgcgacttccacaaa

SEQ ID NO: 4210437 - DNA, 23 bp, Homo sapiens
aagaactattgtgctcagagaca

SEQ ID NO: 4210438 - DNA, 16 bp, Homo sapiens
aagaagagtttgcaaa

SEQ ID NO: 4210439 - DNA, 15 bp, Homo sapiens
aagaatgttagagta

SEQ ID NO: 4210440 - DNA, 20 bp, Homo sapiens
aagaatgttagagtaatgaa

SEQ ID NO: 4210441 - DNA, 14 bp, Homo sapiens
aagacacattccta

SEQ ID NO: 4210442 - DNA, 13 bp, Homo sapiens
aagagacctgaac

SEQ ID NO: 4210443 - DNA, 14 bp, Homo sapiens
aagagatacagagg

SEQ ID NO: 4210444 - DNA, 18 bp, Homo sapiens
aagagcagtggtaagaat

SEQ ID NO: 4210445 - DNA, 15 bp, Homo sapiens
aagaggcgacttcct

SEQ ID NO: 4210446 - DNA, 17 bp, Homo sapiens
aagatatttctttaaat

SEQ ID NO: 4210447 - DNA, 21 bp, Homo sapiens
aagattctatgttaatatttt

SEQ ID NO: 4210448 - DNA, 17 bp, Homo sapiens
aagcaagccaatttgga

SEQ ID NO: 4210449 - DNA, 13 bp, Homo sapiens
aagcaccaaattc

SEQ ID NO: 4210450 - DNA, 17 bp, Homo sapiens
aagcctgaaaattccaa

SEQ ID NO: 4210451 - DNA, 16 bp, Homo sapiens
aagcttggttctgtga

SEQ ID NO: 4210452 - DNA, 17 bp, Homo sapiens
aagcttggttctgtgaa

SEQ ID NO: 4210453 - DNA, 21 bp, Homo sapiens
aagcttggttctgtgaacaag

SEQ ID NO: 4210454 - DNA, 13 bp, Homo sapiens
aaggaaattttac

SEQ ID NO: 4210455 - DNA, 17 bp, Homo sapiens
aaggagggacaagaatc

SEQ ID NO: 4210456 - DNA, 13 bp, Homo sapiens
aaggataaagaag

SEQ ID NO: 4210457 - DNA, 17 bp, Homo sapiens
aaggtagaaatgtctat

SEQ ID NO: 4210458 - DNA, 22 bp, Homo sapiens
aagtatgtatattaaaaaagag

SEQ ID NO: 4210459 - DNA, 12 bp, Homo sapiens
aagtcatccaca

SEQ ID NO: 4210460 - DNA, 14 bp, Homo sapiens
aagtctctgactct

SEQ ID NO: 4210461 - DNA, 17 bp, Homo sapiens
aagtcttctatttattt

SEQ ID NO: 4210462 - DNA, 12 bp, Homo sapiens
aagtgcaaagtt

SEQ ID NO: 4210463 - DNA, 22 bp, Homo sapiens
aagtgcggggtaggggaagaag

SEQ ID NO: 4210464 - DNA, 11 bp, Homo sapiens
aagttaagaat

SEQ ID NO: 4210465 - DNA, 15 bp, Homo sapiens
aagttatctttgaat

SEQ ID NO: 4210466 - DNA, 21 bp, Homo sapiens
aagttatgactgtgaaatgat

SEQ ID NO: 4210467 - DNA, 11 bp, Homo sapiens
aagttcccttc

SEQ ID NO: 4210468 - DNA, 13 bp, Homo sapiens
aagttcccttcta

SEQ ID NO: 4210469 - DNA, 14 bp, Homo sapiens
aagttgccaagagt

SEQ ID NO: 4210470 - DNA, 20 bp, Homo sapiens
aataaaatatatcttataaa

SEQ ID NO: 4210471 - DNA, 23 bp, Homo sapiens
aataaaattaaagctgaaaactg

SEQ ID NO: 4210472 - DNA, 15 bp, Homo sapiens
aataaaattttcaaa

SEQ ID NO: 4210473 - DNA, 18 bp, Homo sapiens
aataaaattttcaaactt

SEQ ID NO: 4210474 - DNA, 15 bp, Homo sapiens
aatacatgcatataa

SEQ ID NO: 4210475 - DNA, 12 bp, Homo sapiens
aatacttccaga

SEQ ID NO: 4210476 - DNA, 16 bp, Homo sapiens
aatagaatgaaaagtt

SEQ ID NO: 4210477 - DNA, 17 bp, Homo sapiens
aatagaatgaaaagttt

SEQ ID NO: 4210478 - DNA, 17 bp, Homo sapiens
aatagtatgaaaatgga

SEQ ID NO: 4210479 - DNA, 18 bp, Homo sapiens
aatagtatgaaaatggaa

SEQ ID NO: 4210480 - DNA, 16 bp, Homo sapiens
aatataataaaagtta

SEQ ID NO: 4210481 - DNA, 21 bp, Homo sapiens
aatatatcttataaagtggaa

SEQ ID NO: 4210482 - DNA, 21 bp, Homo sapiens
aatatatttataaggaaattt

SEQ ID NO: 4210483 - DNA, 21 bp, Homo sapiens
aatattcctttgcatattata

SEQ ID NO: 4210484 - DNA, 17 bp, Homo sapiens
aatcacactctaagttc

SEQ ID NO: 4210485 - DNA, 18 bp, Homo sapiens
aatcattcttactaaaaa

SEQ ID NO: 4210486 - DNA, 17 bp, Homo sapiens
aatctggattcatattt

SEQ ID NO: 4210487 - DNA, 18 bp, Homo sapiens
aatctggattcatattta

SEQ ID NO: 4210488 - DNA, 19 bp, Homo sapiens
aatctggattcatatttaa

SEQ ID NO: 4210489 - DNA, 14 bp, Homo sapiens
aatgaaaagtttag

SEQ ID NO: 4210490 - DNA, 14 bp, Homo sapiens
aatgaaatgcatat

SEQ ID NO: 4210491 - DNA, 17 bp, Homo sapiens
aatgaatgcataaaatg

SEQ ID NO: 4210492 - DNA, 15 bp, Homo sapiens
aatgactcaaagtct

SEQ ID NO: 4210493 - DNA, 16 bp, Homo sapiens
aatgcataaaatgtta

SEQ ID NO: 4210494 - DNA, 14 bp, Homo sapiens
aatgcatatttgca

SEQ ID NO: 4210495 - DNA, 17 bp, Homo sapiens
aatgcatatttgcaaag

SEQ ID NO: 4210496 - DNA, 13 bp, Homo sapiens
aatgccctctctg

SEQ ID NO: 4210497 - DNA, 20 bp, Homo sapiens
aatggaggatctctaaagag

SEQ ID NO: 4210498 - DNA, 13 bp, Homo sapiens
aatgggaaaactt

SEQ ID NO: 4210499 - DNA, 14 bp, Homo sapiens
aatggtagttttac

SEQ ID NO: 4210500 - DNA, 17 bp, Homo sapiens
aatggttgatgatactt

SEQ ID NO: 4210501 - DNA, 16 bp, Homo sapiens
aatgtctgtaataata

SEQ ID NO: 4210502 - DNA, 20 bp, Homo sapiens
aatgttagagtaatgaaatg

SEQ ID NO: 4210503 - DNA, 18 bp, Homo sapiens
aatgttggaattttcaaa

SEQ ID NO: 4210504 - DNA, 15 bp, Homo sapiens
aattaaaaattactg

SEQ ID NO: 4210505 - DNA, 12 bp, Homo sapiens
aattacttaaat

SEQ ID NO: 4210506 - DNA, 16 bp, Homo sapiens
aattacttaaatttta

SEQ ID NO: 4210507 - DNA, 22 bp, Homo sapiens
aattacttaaattttaaagcct

SEQ ID NO: 4210508 - DNA, 14 bp, Homo sapiens
aattatcttattta

SEQ ID NO: 4210509 - DNA, 12 bp, Homo sapiens
aattattctaat

SEQ ID NO: 4210510 - DNA, 18 bp, Homo sapiens
aattattctaattttata

SEQ ID NO: 4210511 - DNA, 21 bp, Homo sapiens
aattattctaattttatatat

SEQ ID NO: 4210512 - DNA, 17 bp, Homo sapiens
aattattgatgttttca

SEQ ID NO: 4210513 - DNA, 23 bp, Homo sapiens
aattgtaaacagaaattgcaata

SEQ ID NO: 4210514 - DNA, 15 bp, Homo sapiens
aatttaaaaatatat

SEQ ID NO: 4210515 - DNA, 18 bp, Homo sapiens
aatttctcacctgaaaat

SEQ ID NO: 4210516 - DNA, 23 bp, Homo sapiens
aattttaaagcctgaaaattcca

SEQ ID NO: 4210517 - DNA, 15 bp, Homo sapiens
acaaaaaacttttaa

SEQ ID NO: 4210518 - DNA, 13 bp, Homo sapiens
acaaaagagcagt

SEQ ID NO: 4210519 - DNA, 18 bp, Homo sapiens
acaaagggattctccagg

SEQ ID NO: 4210520 - DNA, 19 bp, Homo sapiens
acaaatttaattttgcaga

SEQ ID NO: 4210521 - DNA, 11 bp, Homo sapiens
acaaccctgac

SEQ ID NO: 4210522 - DNA, 12 bp, Homo sapiens
acaaccctgacc

SEQ ID NO: 4210523 - DNA, 19 bp, Homo sapiens
acaagcacagttttaagag

SEQ ID NO: 4210524 - DNA, 18 bp, Homo sapiens
acaaggtatttacacata

SEQ ID NO: 4210525 - DNA, 21 bp, Homo sapiens
acacagacactaacgaaatat

SEQ ID NO: 4210526 - DNA, 18 bp, Homo sapiens
acacagactacagccaga

SEQ ID NO: 4210527 - DNA, 22 bp, Homo sapiens
acacagtgctgaccagacagcc

SEQ ID NO: 4210528 - DNA, 22 bp, Homo sapiens
acacattacaaagttaaaattg

SEQ ID NO: 4210529 - DNA, 11 bp, Homo sapiens
acacctcccag

SEQ ID NO: 4210530 - DNA, 12 bp, Homo sapiens
acacctcccagg

SEQ ID NO: 4210531 - DNA, 17 bp, Homo sapiens
acactaacgaaatatca

SEQ ID NO: 4210532 - DNA, 19 bp, Homo sapiens
acactgttgataaaaactc

SEQ ID NO: 4210533 - DNA, 14 bp, Homo sapiens
acagagcttgaaaa

SEQ ID NO: 4210534 - DNA, 17 bp, Homo sapiens
acagcaattcctcaggc

SEQ ID NO: 4210535 - DNA, 13 bp, Homo sapiens
acagccagaagcc

SEQ ID NO: 4210536 - DNA, 18 bp, Homo sapiens
acaggagacaaaagagca

SEQ ID NO: 4210537 - DNA, 21 bp, Homo sapiens
acagttgaagaaaaaatggca

SEQ ID NO: 4210538 - DNA, 22 bp, Homo sapiens
acatactcaggataacagagaa

SEQ ID NO: 4210539 - DNA, 13 bp, Homo sapiens
acatgcatataat

SEQ ID NO: 4210540 - DNA, 16 bp, Homo sapiens
acatgcatataatgaa

SEQ ID NO: 4210541 - DNA, 20 bp, Homo sapiens
accaagaattacaagtagaa

SEQ ID NO: 4210542 - DNA, 23 bp, Homo sapiens
accaagttggaacatccttggaa

SEQ ID NO: 4210543 - DNA, 21 bp, Homo sapiens
accagactacttgggagcacc

SEQ ID NO: 4210544 - DNA, 23 bp, Homo sapiens
accagactacttgggagcaccgc

SEQ ID NO: 4210545 - DNA, 19 bp, Homo sapiens
accaggcaacttgggaact

SEQ ID NO: 4210546 - DNA, 20 bp, Homo sapiens
accctggagcggctctcctg

SEQ ID NO: 4210547 - DNA, 15 bp, Homo sapiens
acccttcctcctcct

SEQ ID NO: 4210548 - DNA, 22 bp, Homo sapiens
acccttcctcctcctttgccta

SEQ ID NO: 4210549 - DNA, 17 bp, Homo sapiens
accgaattttattttac

SEQ ID NO: 4210550 - DNA, 14 bp, Homo sapiens
accgtctacagatg

SEQ ID NO: 4210551 - DNA, 18 bp, Homo sapiens
accgtgaccgtttgctat

SEQ ID NO: 4210552 - DNA, 21 bp, Homo sapiens
acctcccaggggctccacctg

SEQ ID NO: 4210553 - DNA, 13 bp, Homo sapiens
acctccctgccct

SEQ ID NO: 4210554 - DNA, 23 bp, Homo sapiens
acctgaacccagaaacaacacaa

SEQ ID NO: 4210555 - DNA, 16 bp, Homo sapiens
cacctgaaaatgtgga

SEQ ID NO: 4210556 - DNA, 18 bp, Homo sapiens
cacctgttcaggagctga

SEQ ID NO: 4210557 - DNA, 20 bp, Homo sapiens
cactaaaacaaaacaaaaaa

SEQ ID NO: 4210558 - DNA, 21 bp, Homo sapiens
cactcctctgtctctgctctt

SEQ ID NO: 4210559 - DNA, 20 bp, Homo sapiens
cactctagcctggcaacaga

SEQ ID NO: 4210560 - DNA, 17 bp, Homo sapiens
cactgaccctggagcgg

SEQ ID NO: 4210561 - DNA, 15 bp, Homo sapiens
cactgcactctagcc

SEQ ID NO: 4210562 - DNA, 12 bp, Homo sapiens
cactgcagagat

SEQ ID NO: 4210563 - DNA, 13 bp, Homo sapiens
cactgccttccag

SEQ ID NO: 4210564 - DNA, 15 bp, Homo sapiens
cactgccttccagga

SEQ ID NO: 4210565 - DNA, 16 bp, Homo sapiens
cactgtcctattatat

SEQ ID NO: 4210566 - DNA, 20 bp, Homo sapiens
cacttatttatgaacctgcc

SEQ ID NO: 4210567 - DNA, 17 bp, Homo sapiens
cagaaaagtgcaaagtt

SEQ ID NO: 4210568 - DNA, 14 bp, Homo sapiens
cagaacatcctcca

SEQ ID NO: 4210569 - DNA, 19 bp, Homo sapiens
cagaccacctccctgccct

SEQ ID NO: 4210570 - DNA, 16 bp, Homo sapiens
cagactacagccagaa

SEQ ID NO: 4210571 - DNA, 16 bp, Homo sapiens
cagagataaagacctt

SEQ ID NO: 4210572 - DNA, 17 bp, Homo sapiens
cagagcaagactccgtc

SEQ ID NO: 4210573 - DNA, 20 bp, Homo sapiens
cagagcaagactccgtctca

SEQ ID NO: 4210574 - DNA, 14 bp, Homo sapiens
cagatacttattaa

SEQ ID NO: 4210575 - DNA, 22 bp, Homo sapiens
cagattattttagtctgtcatc

SEQ ID NO: 4210576 - DNA, 17 bp, Homo sapiens
cagcactcctctgtctc

SEQ ID NO: 4210577 - DNA, 18 bp, Homo sapiens
cagcactcctctgtctct

SEQ ID NO: 4210578 - DNA, 18 bp, Homo sapiens
cagcactttgggaggctg

SEQ ID NO: 4210579 - DNA, 23 bp, Homo sapiens
cagcactttgggaggctgaagtg

SEQ ID NO: 4210580 - DNA, 12 bp, Homo sapiens
cagccagaagcc

SEQ ID NO: 4210581 - DNA, 16 bp, Homo sapiens
cagccttctctctctg

SEQ ID NO: 4210582 - DNA, 14 bp, Homo sapiens
cagctacacctgag

SEQ ID NO: 4210583 - DNA, 18 bp, Homo sapiens
cagctccctagtggcttc

SEQ ID NO: 4210584 - DNA, 14 bp, Homo sapiens
cagctggaatttaa

SEQ ID NO: 4210585 - DNA, 16 bp, Homo sapiens
cagctgggttggaaaa

SEQ ID NO: 4210586 - DNA, 19 bp, Homo sapiens
caggaaggctgagaggaga

SEQ ID NO: 4210587 - DNA, 13 bp, Homo sapiens
caggagacaaaag

SEQ ID NO: 4210588 - DNA, 16 bp, Homo sapiens
caggagttggaagtgt

SEQ ID NO: 4210589 - DNA, 20 bp, Homo sapiens
caggcaggaaggctgagagg

SEQ ID NO: 4210590 - DNA, 22 bp, Homo sapiens
caggcagttttgaaatgaaaat

SEQ ID NO: 4210591 - DNA, 17 bp, Homo sapiens
caggcccactgcagaga

SEQ ID NO: 4210592 - DNA, 14 bp, Homo sapiens
cagggcctagcttt

SEQ ID NO: 4210593 - DNA, 15 bp, Homo sapiens
caggggctccacctg

SEQ ID NO: 4210594 - DNA, 16 bp, Homo sapiens
cagtggtaagaatagt

SEQ ID NO: 4210595 - DNA, 21 bp, Homo sapiens
cagtgtgtggtcaacatttct

SEQ ID NO: 4210596 - DNA, 14 bp, Homo sapiens
cagttgaagaaaaa

SEQ ID NO: 4210597 - DNA, 21 bp, Homo sapiens
cagttgaagaaaaaatggcaa

SEQ ID NO: 4210598 - DNA, 22 bp, Homo sapiens
cagttgaagaaaaaatggcaag

SEQ ID NO: 4210599 - DNA, 21 bp, Homo sapiens
cagttgttatttattgaaatg

SEQ ID NO: 4210600 - DNA, 17 bp, Homo sapiens
cataaattatttgatta

SEQ ID NO: 4210601 - DNA, 18 bp, Homo sapiens
cataatttaaaaatatat

SEQ ID NO: 4210602 - DNA, 24 bp, Homo sapiens
catacacatccccagccagaagtt

SEQ ID NO: 4210603 - DNA, 13 bp, Homo sapiens
catacataaaaga

SEQ ID NO: 4210604 - DNA, 15 bp, Homo sapiens
catacataaaagaaa

SEQ ID NO: 4210605 - DNA, 20 bp, Homo sapiens
catacataaaagaaataaac

SEQ ID NO: 4210606 - DNA, 23 bp, Homo sapiens
catagtgctaagaaagcaagcca

SEQ ID NO: 4210607 - DNA, 20 bp, Homo sapiens
catataagacaaatattcct

SEQ ID NO: 4210608 - DNA, 16 bp, Homo sapiens
catatgcagatactta

SEQ ID NO: 4210609 - DNA, 16 bp, Homo sapiens
catattcacaatggaa

SEQ ID NO: 4210610 - DNA, 13 bp, Homo sapiens
catattcttggag

SEQ ID NO: 4210611 - DNA, 22 bp, Homo sapiens
catattcttggagaactttcca

SEQ ID NO: 4210612 - DNA, 17 bp, Homo sapiens
catatttaatttgaagg

SEQ ID NO: 4210613 - DNA, 18 bp, Homo sapiens
catccatgttccgagaag

SEQ ID NO: 4210614 - DNA, 14 bp, Homo sapiens
catcccgctcctgc

SEQ ID NO: 4210615 - DNA, 15 bp, Homo sapiens
catcccgctcctgct

SEQ ID NO: 4210616 - DNA, 17 bp, Homo sapiens
catctattctttcccta

SEQ ID NO: 4210617 - DNA, 23 bp, Homo sapiens
catctattctttccctagaggca

SEQ ID NO: 4210618 - DNA, 16 bp, Homo sapiens
catcttagctttccac

SEQ ID NO: 4210619 - DNA, 18 bp, Homo sapiens
catgaaataaaatatatc

SEQ ID NO: 4210620 - DNA, 17 bp, Homo sapiens
catgacctttttcactg

SEQ ID NO: 4210621 - DNA, 20 bp, Homo sapiens
catgatgccgctcttctgtc

SEQ ID NO: 4210622 - DNA, 20 bp, Homo sapiens
catgattcttccaaggaaat

SEQ ID NO: 4210623 - DNA, 16 bp, Homo sapiens
catgcaccctcataca

SEQ ID NO: 4210624 - DNA, 20 bp, Homo sapiens
catgcatataatgaataaat

SEQ ID NO: 4210625 - DNA, 21 bp, Homo sapiens
catgcatcacggatcaataga

SEQ ID NO: 4210626 - DNA, 15 bp, Homo sapiens
catgctgacttgcag

SEQ ID NO: 4210627 - DNA, 22 bp, Homo sapiens
catggagaagttgccaagagtt

SEQ ID NO: 4210628 - DNA, 23 bp, Homo sapiens
catggcatccctttttcataaat

SEQ ID NO: 4210629 - DNA, 16 bp, Homo sapiens
catgtaacatagattt

SEQ ID NO: 4210630 - DNA, 19 bp, Homo sapiens
catgtcaaacgtgaaaatg

SEQ ID NO: 4210631 - DNA, 14 bp, Homo sapiens
catgtcactcccag

SEQ ID NO: 4210632 - DNA, 15 bp, Homo sapiens
catgtcactcccaga

SEQ ID NO: 4210633 - DNA, 20 bp, Homo sapiens
catgtcgcctgcccccagca

SEQ ID NO: 4210634 - DNA, 16 bp, Homo sapiens
cattagttttgaagat

SEQ ID NO: 4210635 - DNA, 16 bp, Homo sapiens
cattatgttaatattt

SEQ ID NO: 4210636 - DNA, 16 bp, Homo sapiens
cattctttttgaaatg

SEQ ID NO: 4210637 - DNA, 19 bp, Homo sapiens
cattgagtttaagtctctg

SEQ ID NO: 4210638 - DNA, 17 bp, Homo sapiens
catttctcatgttgaaa

SEQ ID NO: 4210639 - DNA, 18 bp, Homo sapiens
catttttgaatacaggca

SEQ ID NO: 4210640 - DNA, 19 bp, Homo sapiens
ccaaactaaaccctcacaa

SEQ ID NO: 4210641 - DNA, 20 bp, Homo sapiens
ccaaaggaaaatgtctgtaa

SEQ ID NO: 4210642 - DNA, 20 bp, Homo sapiens
ccaagaaaaggcatggagac

SEQ ID NO: 4210643 - DNA, 22 bp, Homo sapiens
ccaatagttgttgattggcagg

SEQ ID NO: 4210644 - DNA, 19 bp, Homo sapiens
ccaattccacagtctctgg

SEQ ID NO: 4210645 - DNA, 22 bp, Homo sapiens
ccacaaatgggaaaaccagact

SEQ ID NO: 4210646 - DNA, 22 bp, Homo sapiens
ccacactggcacgtttgtgaga

SEQ ID NO: 4210647 - DNA, 14 bp, Homo sapiens
ccacaggagggaga

SEQ ID NO: 4210648 - DNA, 14 bp, Homo sapiens
ccacagtctctggg

SEQ ID NO: 4210649 - DNA, 22 bp, Homo sapiens
ccaccagcatgtcactcccaga

SEQ ID NO: 4210650 - DNA, 13 bp, Homo sapiens
ccacctgctttct

SEQ ID NO: 4210651 - DNA, 15 bp, Homo sapiens
ccacctgctttctcc

SEQ ID NO: 4210652 - DNA, 21 bp, Homo sapiens
ccactaaaacaaaacaaaaaa

SEQ ID NO: 4210653 - DNA, 16 bp, Homo sapiens
ccagactacttgggag

SEQ ID NO: 4210654 - DNA, 18 bp, Homo sapiens
ccagatgcacatccctgg

SEQ ID NO: 4210655 - DNA, 12 bp, Homo sapiens
ccagatgtaaag

SEQ ID NO: 4210656 - DNA, 20 bp, Homo sapiens
ccagatgtaaagaacgcgac

SEQ ID NO: 4210657 - DNA, 16 bp, Homo sapiens
ccagcactcctctgtc

SEQ ID NO: 4210658 - DNA, 18 bp, Homo sapiens
ccagcactcctctgtctc

SEQ ID NO: 4210659 - DNA, 20 bp, Homo sapiens
ccagcactcctctgtctctg

SEQ ID NO: 4210660 - DNA, 17 bp, Homo sapiens
ccagcactttgggaggc

SEQ ID NO: 4210661 - DNA, 18 bp, Homo sapiens
ccagcatgtcactcccag

SEQ ID NO: 4210662 - DNA, 19 bp, Homo sapiens
ccagccttctctctctggt

SEQ ID NO: 4210663 - DNA, 19 bp, Homo sapiens
ccagctggaattgctgctc

SEQ ID NO: 4210664 - DNA, 16 bp, Homo sapiens
ccagctgggttggaaa

SEQ ID NO: 4210665 - DNA, 19 bp, Homo sapiens
ccagcttcccctcgctgtc

SEQ ID NO: 4210666 - DNA, 15 bp, Homo sapiens
ccaggtggaattact

SEQ ID NO: 4210667 - DNA, 22 bp, Homo sapiens
ccagtcattatgttaatatttc

SEQ ID NO: 4210668 - DNA, 19 bp, Homo sapiens
ccatcaggactttccctga

SEQ ID NO: 4210669 - DNA, 16 bp, Homo sapiens
ccatcctgctcttcca

SEQ ID NO: 4210670 - DNA, 21 bp, Homo sapiens
ccatcctgctcttccatttct

SEQ ID NO: 4210671 - DNA, 16 bp, Homo sapiens
ccatcgctgtcatctc

SEQ ID NO: 4210672 - DNA, 17 bp, Homo sapiens
ccatgtcgcctgccccc

SEQ ID NO: 4210673 - DNA, 23 bp, Homo sapiens
cccaccagcatgtcactcccaga

SEQ ID NO: 4210674 - DNA, 18 bp, Homo sapiens
gccatcaggactttccct

SEQ ID NO: 4210675 - DNA, 17 bp, Homo sapiens
gccatgtcgcctgcccc

SEQ ID NO: 4210676 - DNA, 21 bp, Homo sapiens
gccattatctgtattaatgct

SEQ ID NO: 4210677 - DNA, 21 bp, Homo sapiens
gccctaagtgttgaagaagag

SEQ ID NO: 4210678 - DNA, 18 bp, Homo sapiens
gccgctcttctgtcatcc

SEQ ID NO: 4210679 - DNA, 20 bp, Homo sapiens
gccgctcttctgtcatcccg

SEQ ID NO: 4210680 - DNA, 16 bp, Homo sapiens
gcctccatttctggct

SEQ ID NO: 4210681 - DNA, 19 bp, Homo sapiens
gcctgcacccttcctcctc

SEQ ID NO: 4210682 - DNA, 23 bp, Homo sapiens
gcctttccacctgctttctcctg

SEQ ID NO: 4210683 - DNA, 18 bp, Homo sapiens
gcgtgggtggaggaagat

SEQ ID NO: 4210684 - DNA, 18 bp, Homo sapiens
gctaataatttgccatta

SEQ ID NO: 4210685 - DNA, 20 bp, Homo sapiens
gctataactatgttgataaa

SEQ ID NO: 4210686 - DNA, 20 bp, Homo sapiens
gctatattcctttttctatg

SEQ ID NO: 4210687 - DNA, 18 bp, Homo sapiens
gctattttctaaagactt

SEQ ID NO: 4210688 - DNA, 19 bp, Homo sapiens
gctccacctgttcaggagc

SEQ ID NO: 4210689 - DNA, 19 bp, Homo sapiens
gctccctagtggcttcctc

SEQ ID NO: 4210690 - DNA, 21 bp, Homo sapiens
gctctcctgagaggtgctgca

SEQ ID NO: 4210691 - DNA, 21 bp, Homo sapiens
gctcttaattaaaaattactg

SEQ ID NO: 4210692 - DNA, 11 bp, Homo sapiens
gctcttgcctg

SEQ ID NO: 4210693 - DNA, 12 bp, Homo sapiens
gctcttgcctgc

SEQ ID NO: 4210694 - DNA, 13 bp, Homo sapiens
gctgacctgacct

SEQ ID NO: 4210695 - DNA, 12 bp, Homo sapiens
gctgaggcagga

SEQ ID NO: 4210696 - DNA, 18 bp, Homo sapiens
gctgaggcaggagaattg

SEQ ID NO: 4210697 - DNA, 17 bp, Homo sapiens
gctggaattgctgctct

SEQ ID NO: 4210698 - DNA, 20 bp, Homo sapiens
gctggtctccctccagctgg

SEQ ID NO: 4210699 - DNA, 19 bp, Homo sapiens
gctgtattagtcacagaga

SEQ ID NO: 4210700 - DNA, 16 bp, Homo sapiens
gctgtctctgtccctc

SEQ ID NO: 4210701 - DNA, 19 bp, Homo sapiens
gctgtggtggctgtctctg

SEQ ID NO: 4210702 - DNA, 20 bp, Homo sapiens
gctgtggtggctgtctctgt

SEQ ID NO: 4210703 - DNA, 20 bp, Homo sapiens
gctgttctggagctgctgtt

SEQ ID NO: 4210704 - DNA, 22 bp, Homo sapiens
gcttagttaagtcatccacagc

SEQ ID NO: 4210705 - DNA, 18 bp, Homo sapiens
gcttcaaatgatccttcc

SEQ ID NO: 4210706 - DNA, 19 bp, Homo sapiens
gcttcaaatgatccttcct

SEQ ID NO: 4210707 - DNA, 22 bp, Homo sapiens
gcttcaaatgatccttcctact

SEQ ID NO: 4210708 - DNA, 22 bp, Homo sapiens
gctttcccaccagcatgtcact

SEQ ID NO: 4210709 - DNA, 11 bp, Homo sapiens
gctttcctccc

SEQ ID NO: 4210710 - DNA, 20 bp, Homo sapiens
gctttcctccctggcatgac

SEQ ID NO: 4210711 - DNA, 22 bp, Homo sapiens
gctttgaaacttgcaactttga

SEQ ID NO: 4210712 - DNA, 11 bp, Homo sapiens
gctttgcctgc

SEQ ID NO: 4210713 - DNA, 14 bp, Homo sapiens
gctttgcctgcttg

SEQ ID NO: 4210714 - DNA, 12 bp, Homo sapiens
ggaaaaccagac

SEQ ID NO: 4210715 - DNA, 22 bp, Homo sapiens
ggaaaaccagactacttgggag

SEQ ID NO: 4210716 - DNA, 11 bp, Homo sapiens
ggaaaacttca

SEQ ID NO: 4210717 - DNA, 19 bp, Homo sapiens
ggaaaacttcactccaaag

SEQ ID NO: 4210718 - DNA, 22 bp, Homo sapiens
ggaaaacttcactccaaagaga

SEQ ID NO: 4210719 - DNA, 23 bp, Homo sapiens
ggaaaacttcactccaaagagaa

SEQ ID NO: 4210720 - DNA, 22 bp, Homo sapiens
ggaaactttaggtctagtttct

SEQ ID NO: 4210721 - DNA, 23 bp, Homo sapiens
ggaactagactcccaagctggac

SEQ ID NO: 4210722 - DNA, 15 bp, Homo sapiens
ggaattttcaaaaat

SEQ ID NO: 4210723 - DNA, 17 bp, Homo sapiens
ggacccaagtactttcc

SEQ ID NO: 4210724 - DNA, 20 bp, Homo sapiens
ggagaagtcttctatttatt

SEQ ID NO: 4210725 - DNA, 14 bp, Homo sapiens
ggagagagactcca

SEQ ID NO: 4210726 - DNA, 21 bp, Homo sapiens
ggagagccatacataaaagaa

SEQ ID NO: 4210727 - DNA, 14 bp, Homo sapiens
ggaggttgcagtga

SEQ ID NO: 4210728 - DNA, 21 bp, Homo sapiens
ggagttggaagtgtgtgatct

SEQ ID NO: 4210729 - DNA, 19 bp, Homo sapiens
ggatatataggctattttc

SEQ ID NO: 4210730 - DNA, 23 bp, Homo sapiens
ggattgtgcctaatgtgtttgag

SEQ ID NO: 4210731 - DNA, 13 bp, Homo sapiens
ggcaacagagcaa

SEQ ID NO: 4210732 - DNA, 23 bp, Homo sapiens
ggcaacttgggaactagactccc

SEQ ID NO: 4210733 - DNA, 17 bp, Homo sapiens
ggcaataaatgccctct

SEQ ID NO: 4210734 - DNA, 14 bp, Homo sapiens
ggcatttttttaaa

SEQ ID NO: 4210735 - DNA, 23 bp, Homo sapiens
ggccagatgcacatccctggaag

SEQ ID NO: 4210736 - DNA, 17 bp, Homo sapiens
ggccatcaggactttcc

SEQ ID NO: 4210737 - DNA, 15 bp, Homo sapiens
ggcccactgcagaga

SEQ ID NO: 4210738 - DNA, 13 bp, Homo sapiens
ggcccgctttgcc

SEQ ID NO: 4210739 - DNA, 16 bp, Homo sapiens
ggcccgctttgcctgc

SEQ ID NO: 4210740 - DNA, 14 bp, Homo sapiens
ggcggggctatgcc

SEQ ID NO: 4210741 - DNA, 23 bp, Homo sapiens
ggctcacgcctataatcccagca

SEQ ID NO: 4210742 - DNA, 23 bp, Homo sapiens
ggctctcctgagaggtgctgcag

SEQ ID NO: 4210743 - DNA, 22 bp, Homo sapiens
ggctggtctccctccagctgga

SEQ ID NO: 4210744 - DNA, 14 bp, Homo sapiens
ggctgtctctgtcc

SEQ ID NO: 4210745 - DNA, 20 bp, Homo sapiens
ggctgtggtggctgtctctg

SEQ ID NO: 4210746 - DNA, 22 bp, Homo sapiens
ggctgtggtggctgtctctgtc

SEQ ID NO: 4210747 - DNA, 12 bp, Homo sapiens
ggcttcacagat

SEQ ID NO: 4210748 - DNA, 23 bp, Homo sapiens
gggagacatattcttggagaact

SEQ ID NO: 4210749 - DNA, 22 bp, Homo sapiens
gggcaataaatgccctctctga

SEQ ID NO: 4210750 - DNA, 24 bp, Homo sapiens
gggtaggggaagaagagctatcag

SEQ ID NO: 4210751 - DNA, 18 bp, Homo sapiens
gggtgatgatgaccaaga

SEQ ID NO: 4210752 - DNA, 19 bp, Homo sapiens
gggtgatgatgaccaagaa

SEQ ID NO: 4210753 - DNA, 20 bp, Homo sapiens
ggtagaaagagatacagagg

SEQ ID NO: 4210754 - DNA, 10 bp, Homo sapiens
ggtccttcaa

SEQ ID NO: 4210755 - DNA, 16 bp, Homo sapiens
ggtctccctccagctg

SEQ ID NO: 4210756 - DNA, 15 bp, Homo sapiens
ggtggaacaagcaca

SEQ ID NO: 4210757 - DNA, 16 bp, Homo sapiens
ggtggaattacttaaa

SEQ ID NO: 4210758 - DNA, 19 bp, Homo sapiens
ggtggctcacgcctataat

SEQ ID NO: 4210759 - DNA, 16 bp, Homo sapiens
ggtgtggtggctcacg

SEQ ID NO: 4210760 - DNA, 13 bp, Homo sapiens
gtaaaaataaaat

SEQ ID NO: 4210761 - DNA, 23 bp, Homo sapiens
gtaaagaacgcgacttccacaaa

SEQ ID NO: 4210762 - DNA, 18 bp, Homo sapiens
gtaacttccaaataaata

SEQ ID NO: 4210763 - DNA, 19 bp, Homo sapiens
gtaacttccaaataaataa

SEQ ID NO: 4210764 - DNA, 16 bp, Homo sapiens
gtaagttatctttgaa

SEQ ID NO: 4210765 - DNA, 16 bp, Homo sapiens
gtaataatagactgta

SEQ ID NO: 4210766 - DNA, 17 bp, Homo sapiens
gtaatacacatatctaa

SEQ ID NO: 4210767 - DNA, 20 bp, Homo sapiens
gtaatacacatatctaaaaa

SEQ ID NO: 4210768 - DNA, 16 bp, Homo sapiens
gtaatctgacttctca

SEQ ID NO: 4210769 - DNA, 20 bp, Homo sapiens
gtacttattttccaataaaa

SEQ ID NO: 4210770 - DNA, 17 bp, Homo sapiens
gtagaatggcagctgga

SEQ ID NO: 4210771 - DNA, 22 bp, Homo sapiens
gtaggcccggtgtggtggctca

SEQ ID NO: 4210772 - DNA, 14 bp, Homo sapiens
gtatttacacatac

SEQ ID NO: 4210773 - DNA, 14 bp, Homo sapiens
gtcaaacgtgaaaa

SEQ ID NO: 4210774 - DNA, 19 bp, Homo sapiens
gtcacacattacaaagtta

SEQ ID NO: 4210775 - DNA, 13 bp, Homo sapiens
gtcacgtcttgaa

SEQ ID NO: 4210776 - DNA, 11 bp, Homo sapiens
gtcactcccag

SEQ ID NO: 4210777 - DNA, 15 bp, Homo sapiens
gtcatcatctccaaa

SEQ ID NO: 4210778 - DNA, 12 bp, Homo sapiens
gtcatccacagc

SEQ ID NO: 4210779 - DNA, 23 bp, Homo sapiens
gtcatccagaaaatgtgtcagca

SEQ ID NO: 4210780 - DNA, 16 bp, Homo sapiens
gtccctcactgccttc

SEQ ID NO: 4210781 - DNA, 18 bp, Homo sapiens
gtccctcactgccttcca

SEQ ID NO: 4210782 - DNA, 19 bp, Homo sapiens
gtcctattatattcattct

SEQ ID NO: 4210783 - DNA, 23 bp, Homo sapiens
gtcctccagcttcccctcgctgt

SEQ ID NO: 4210784 - DNA, 20 bp, Homo sapiens
gtctattaaagatatttctt

SEQ ID NO: 4210785 - DNA, 18 bp, Homo sapiens
gtctctgctcttgcctgc

SEQ ID NO: 4210786 - DNA, 16 bp, Homo sapiens
gtctgcaatgtccctt

SEQ ID NO: 4210787 - DNA, 11 bp, Homo sapiens
gtctgtcatcc

SEQ ID NO: 4210788 - DNA, 16 bp, Homo sapiens
gtcttcccttctttgc

SEQ ID NO: 4210789 - DNA, 17 bp, Homo sapiens
gtcttctatttatttat

SEQ ID NO: 4210790 - DNA, 22 bp, Homo sapiens
gtgaaataccaacctgaagaca

SEQ ID NO: 4210791 - DNA, 20 bp, Homo sapiens
gtgacaaagttatatattta

SEQ ID NO: 4210792 - DNA, 21 bp, Homo sapiens
gtgagaagaaatgacattttg

SEQ ID NO: 4210793 - DNA, 17 bp, Homo sapiens
tatattttccctctctt

SEQ ID NO: 4210794 - DNA, 22 bp, Homo sapiens
tatattttccctctcttgcctt

SEQ ID NO: 4210795 - DNA, 12 bp, Homo sapiens
tatcaaagtcat

SEQ ID NO: 4210796 - DNA, 21 bp, Homo sapiens
tatcatgtcaaacgtgaaaat

SEQ ID NO: 4210797 - DNA, 18 bp, Homo sapiens
tatcccttggacatttta

SEQ ID NO: 4210798 - DNA, 15 bp, Homo sapiens
tatcctgcattttac

SEQ ID NO: 4210799 - DNA, 22 bp, Homo sapiens
tatcttataaagtggaagtatg

SEQ ID NO: 4210800 - DNA, 22 bp, Homo sapiens
tatcttatttaatttttgcaat

SEQ ID NO: 4210801 - DNA, 23 bp, Homo sapiens
tatcttatttaatttttgcaatt

SEQ ID NO: 4210802 - DNA, 16 bp, Homo sapiens
tatgtacaaccctgac

SEQ ID NO: 4210803 - DNA, 17 bp, Homo sapiens
tatgtacaaccctgacc

SEQ ID NO: 4210804 - DNA, 20 bp, Homo sapiens
tatgtgcacatctgttttgt

SEQ ID NO: 4210805 - DNA, 13 bp, Homo sapiens
tatgttaatattt

SEQ ID NO: 4210806 - DNA, 14 bp, Homo sapiens
tatgttgataaaag

SEQ ID NO: 4210807 - DNA, 21 bp, Homo sapiens
tatgttttctactccaattca

SEQ ID NO: 4210808 - DNA, 16 bp, Homo sapiens
tattaaaatatttcag

SEQ ID NO: 4210809 - DNA, 17 bp, Homo sapiens
tattaaaatatttcagg

SEQ ID NO: 4210810 - DNA, 15 bp, Homo sapiens
tattacctttacata

SEQ ID NO: 4210811 - DNA, 19 bp, Homo sapiens
tattacctttacatattat

SEQ ID NO: 4210812 - DNA, 17 bp, Homo sapiens
tattatattcattcttt

SEQ ID NO: 4210813 - DNA, 21 bp, Homo sapiens
tattcacaatggaaactttag

SEQ ID NO: 4210814 - DNA, 15 bp, Homo sapiens
tattcagatgtatgt

SEQ ID NO: 4210815 - DNA, 23 bp, Homo sapiens
tattcattctttttgaaatgtca

SEQ ID NO: 4210816 - DNA, 17 bp, Homo sapiens
tattgtgctcagagaca

SEQ ID NO: 4210817 - DNA, 16 bp, Homo sapiens
tatttaatttgaaggt

SEQ ID NO: 4210818 - DNA, 23 bp, Homo sapiens
tatttctgaggagcctgcaacat

SEQ ID NO: 4210819 - DNA, 15 bp, Homo sapiens
tattttctaaagact

SEQ ID NO: 4210820 - DNA, 21 bp, Homo sapiens
tattttgttttgtgcagagat

SEQ ID NO: 4210821 - DNA, 20 bp, Homo sapiens
tcaaaaaaagggcaataaat

SEQ ID NO: 4210822 - DNA, 16 bp, Homo sapiens
tcaaacgtgaaaatgc

SEQ ID NO: 4210823 - DNA, 16 bp, Homo sapiens
tcaaatgatccttcct

SEQ ID NO: 4210824 - DNA, 20 bp, Homo sapiens
tcaacattggagacatcact

SEQ ID NO: 4210825 - DNA, 22 bp, Homo sapiens
tcaatagattgtaatacacata

SEQ ID NO: 4210826 - DNA, 19 bp, Homo sapiens
tcaatctggattcatattt

SEQ ID NO: 4210827 - DNA, 14 bp, Homo sapiens
tcacacagacacta

SEQ ID NO: 4210828 - DNA, 23 bp, Homo sapiens
tcacataggttagattctcattc

SEQ ID NO: 4210829 - DNA, 11 bp, Homo sapiens
tcactccaaag

SEQ ID NO: 4210830 - DNA, 18 bp, Homo sapiens
tcactgaccctggagcgg

SEQ ID NO: 4210831 - DNA, 15 bp, Homo sapiens
tcactgccttccagg

SEQ ID NO: 4210832 - DNA, 12 bp, Homo sapiens
tcacttgccaat

SEQ ID NO: 4210833 - DNA, 17 bp, Homo sapiens
tcagaacatcctccaat

SEQ ID NO: 4210834 - DNA, 21 bp, Homo sapiens
tcagagtagagggcttgggaa

SEQ ID NO: 4210835 - DNA, 20 bp, Homo sapiens
tcagcatgcatagtgctaag

SEQ ID NO: 4210836 - DNA, 23 bp, Homo sapiens
tcaggagttcgagaccagcccag

SEQ ID NO: 4210837 - DNA, 16 bp, Homo sapiens
tcaggcaaagaaaatg

SEQ ID NO: 4210838 - DNA, 13 bp, Homo sapiens
tcaggtcaataac

SEQ ID NO: 4210839 - DNA, 13 bp, Homo sapiens
tcataaatctatt

SEQ ID NO: 4210840 - DNA, 11 bp, Homo sapiens
tcataaattat

SEQ ID NO: 4210841 - DNA, 15 bp, Homo sapiens
tcataagtctttggt

SEQ ID NO: 4210842 - DNA, 13 bp, Homo sapiens
tcatacacagaaa

SEQ ID NO: 4210843 - DNA, 15 bp, Homo sapiens
tcatataactgagat

SEQ ID NO: 4210844 - DNA, 15 bp, Homo sapiens
tcatcatctccaaac

SEQ ID NO: 4210845 - DNA, 14 bp, Homo sapiens
tcatcccgctcctg

SEQ ID NO: 4210846 - DNA, 17 bp, Homo sapiens
tcatcccgctcctgctg

SEQ ID NO: 4210847 - DNA, 13 bp, Homo sapiens
tcatgctgacttg

SEQ ID NO: 4210848 - DNA, 17 bp, Homo sapiens
tcatgctgacttgcaga

SEQ ID NO: 4210849 - DNA, 12 bp, Homo sapiens
tcatgtctattt

SEQ ID NO: 4210850 - DNA, 15 bp, Homo sapiens
tcattaaagacagga

SEQ ID NO: 4210851 - DNA, 14 bp, Homo sapiens
tcattagttttgaa

SEQ ID NO: 4210852 - DNA, 15 bp, Homo sapiens
tcattcttactaaaa

SEQ ID NO: 4210853 - DNA, 20 bp, Homo sapiens
tcattcttactaaaaagtat

SEQ ID NO: 4210854 - DNA, 21 bp, Homo sapiens
tccaaactaaaccctcacaag

SEQ ID NO: 4210855 - DNA, 15 bp, Homo sapiens
tccaaacttctaaat

SEQ ID NO: 4210856 - DNA, 19 bp, Homo sapiens
tccaaacttctaaatgttg

SEQ ID NO: 4210857 - DNA, 13 bp, Homo sapiens
tccaaagagaaac

SEQ ID NO: 4210858 - DNA, 16 bp, Homo sapiens
tccaatctcagtcact

SEQ ID NO: 4210859 - DNA, 23 bp, Homo sapiens
tccacccatgacctttttcactg

SEQ ID NO: 4210860 - DNA, 21 bp, Homo sapiens
tccacttcttaatgctttcct

SEQ ID NO: 4210861 - DNA, 22 bp, Homo sapiens
tccagaaaatgtgtcagcatgc

SEQ ID NO: 4210862 - DNA, 20 bp, Homo sapiens
tccagctggaattgctgctc

SEQ ID NO: 4210863 - DNA, 24 bp, Homo sapiens
tccagctggaattgctgctctctg

SEQ ID NO: 4210864 - DNA, 17 bp, Homo sapiens
tccatcctgctcttcca

SEQ ID NO: 4210865 - DNA, 20 bp, Homo sapiens
tcccaccagcatgtcactcc

SEQ ID NO: 4210866 - DNA, 18 bp, Homo sapiens
tcccagctacacctgagg

SEQ ID NO: 4210867 - DNA, 14 bp, Homo sapiens
tcccaggttggcct

SEQ ID NO: 4210868 - DNA, 23 bp, Homo sapiens
tcccatgatgccgctcttctgtc

SEQ ID NO: 4210869 - DNA, 15 bp, Homo sapiens
tccccagccagaagt

SEQ ID NO: 4210870 - DNA, 15 bp, Homo sapiens
tcccgctcctgctga

SEQ ID NO: 4210871 - DNA, 19 bp, Homo sapiens
tccctagaggcaaacattt

SEQ ID NO: 4210872 - DNA, 16 bp, Homo sapiens
tccctcactgccttcc

SEQ ID NO: 4210873 - DNA, 17 bp, Homo sapiens
tccctcactgccttcca

SEQ ID NO: 4210874 - DNA, 18 bp, Homo sapiens
tccctcactgccttccag

SEQ ID NO: 4210875 - DNA, 16 bp, Homo sapiens
tccctgaggtcacctg

SEQ ID NO: 4210876 - DNA, 17 bp, Homo sapiens
tccctgaggtcacctgg

SEQ ID NO: 4210877 - DNA, 21 bp, Homo sapiens
tccctgccctgtcctccagct

SEQ ID NO: 4210878 - DNA, 20 bp, Homo sapiens
tccctggcatgaccatcctg

SEQ ID NO: 4210879 - DNA, 18 bp, Homo sapiens
tcccttggacattttatg

SEQ ID NO: 4210880 - DNA, 14 bp, Homo sapiens
tcctaagttccctt

SEQ ID NO: 4210881 - DNA, 22 bp, Homo sapiens
tcctaatgaatgcataaaatgt

SEQ ID NO: 4210882 - DNA, 20 bp, Homo sapiens
tcctactttgcttctctcca

SEQ ID NO: 4210883 - DNA, 21 bp, Homo sapiens
tcctactttgcttctctccac

SEQ ID NO: 4210884 - DNA, 12 bp, Homo sapiens
tcctattatatt

SEQ ID NO: 4210885 - DNA, 21 bp, Homo sapiens
tcctccaattccacagtctct

SEQ ID NO: 4210886 - DNA, 17 bp, Homo sapiens
tcctcctaaacaaaaac

SEQ ID NO: 4210887 - DNA, 17 bp, Homo sapiens
tcctctccagccttctc

SEQ ID NO: 4210888 - DNA, 14 bp, Homo sapiens
tcctctgtctctgc

SEQ ID NO: 4210889 - DNA, 15 bp, Homo sapiens
tcctctgtctctgct

SEQ ID NO: 4210890 - DNA, 17 bp, Homo sapiens
tcctctgtctctgctct

SEQ ID NO: 4210891 - DNA, 18 bp, Homo sapiens
tcctgctaagttaatgtt

SEQ ID NO: 4210892 - DNA, 21 bp, Homo sapiens
tcctgctgaaacacctcccag

SEQ ID NO: 4210893 - DNA, 22 bp, Homo sapiens
tcctgctgtgtgaattcccagg

SEQ ID NO: 4210894 - DNA, 21 bp, Homo sapiens
tcctgggcccgctttgcctgc

SEQ ID NO: 4210895 - DNA, 21 bp, Homo sapiens
tcctttgttattatcctgcat

SEQ ID NO: 4210896 - DNA, 12 bp, Homo sapiens
tcgctgtcctgc

SEQ ID NO: 4210897 - DNA, 19 bp, Homo sapiens
tctaagttatgactgtgaa

SEQ ID NO: 4210898 - DNA, 16 bp, Homo sapiens
tctaagttctattgaa

SEQ ID NO: 4210899 - DNA, 22 bp, Homo sapiens
tctaatgttgtctttttaatgt

SEQ ID NO: 4210900 - DNA, 20 bp, Homo sapiens
tctactaaaaatacaaaaat

SEQ ID NO: 4210901 - DNA, 17 bp, Homo sapiens
tctactagattgtgatc

SEQ ID NO: 4210902 - DNA, 17 bp, Homo sapiens
tctaggactctgcactg

SEQ ID NO: 4210903 - DNA, 14 bp, Homo sapiens
tctagtttcttttg

SEQ ID NO: 4210904 - DNA, 18 bp, Homo sapiens
tctatgaaataatgtgaa

SEQ ID NO: 4210905 - DNA, 14 bp, Homo sapiens
tctatgttaatatt

SEQ ID NO: 4210906 - DNA, 18 bp, Homo sapiens
tctcacctgaaaatgtgg

SEQ ID NO: 4210907 - DNA, 20 bp, Homo sapiens
tctccagccttctctctctg

SEQ ID NO: 4210908 - DNA, 16 bp, Homo sapiens
tctccctccagctgga

SEQ ID NO: 4210909 - DNA, 16 bp, Homo sapiens
tctcctgagaggtgct

SEQ ID NO: 4210910 - DNA, 17 bp, Homo sapiens
tctcctgagaggtgctg

SEQ ID NO: 4210911 - DNA, 21 bp, Homo sapiens
tctcctgggcccgctttgcct

SEQ ID NO: 4210912 - DNA, 14 bp, Homo sapiens
tctctaagttatga

SEQ ID NO: 4210913 - DNA, 15 bp, Homo sapiens
agtttagtgtttctt

SEQ ID NO: 4210914 - DNA, 23 bp, Homo sapiens
agtttccccatttgtttgtgctt

SEQ ID NO: 4210915 - DNA, 16 bp, Homo sapiens
agtttgggccactgca

SEQ ID NO: 4210916 - DNA, 18 bp, Homo sapiens
agtttgggccactgcact

SEQ ID NO: 4210917 - DNA, 19 bp, Homo sapiens
agtttgggccactgcactc

SEQ ID NO: 4210918 - DNA, 21 bp, Homo sapiens
agttttttttaacctgtttat

SEQ ID NO: 4210919 - DNA, 13 bp, Homo sapiens
ataaaagaaataa

SEQ ID NO: 4210920 - DNA, 17 bp, Homo sapiens
ataaaatatatcttata

SEQ ID NO: 4210921 - DNA, 22 bp, Homo sapiens
ataaagtggaagtatgtatatt

SEQ ID NO: 4210922 - DNA, 21 bp, Homo sapiens
ataaatcattcttactaaaaa

SEQ ID NO: 4210923 - DNA, 17 bp, Homo sapiens
ataaattatttgattat

SEQ ID NO: 4210924 - DNA, 16 bp, Homo sapiens
ataaattgtatgaaga

SEQ ID NO: 4210925 - DNA, 13 bp, Homo sapiens
ataataaaaatat

SEQ ID NO: 4210926 - DNA, 19 bp, Homo sapiens
ataataaaaatatattttc

SEQ ID NO: 4210927 - DNA, 17 bp, Homo sapiens
ataatttaaaaatatat

SEQ ID NO: 4210928 - DNA, 21 bp, Homo sapiens
ataatttaaaaatatatttat

SEQ ID NO: 4210929 - DNA, 18 bp, Homo sapiens
atacataaaagaaataaa

SEQ ID NO: 4210930 - DNA, 20 bp, Homo sapiens
atacataaaagaaataaacc

SEQ ID NO: 4210931 - DNA, 13 bp, Homo sapiens
atacatgcatata

SEQ ID NO: 4210932 - DNA, 15 bp, Homo sapiens
atacatgcatataat

SEQ ID NO: 4210933 - DNA, 20 bp, Homo sapiens
atactcaggataacagagaa

SEQ ID NO: 4210934 - DNA, 20 bp, Homo sapiens
atactgccttgtttaatggt

SEQ ID NO: 4210935 - DNA, 22 bp, Homo sapiens
atacttattaagagcaaacttt

SEQ ID NO: 4210936 - DNA, 23 bp, Homo sapiens
atacttattaagagcaaacttta

SEQ ID NO: 4210937 - DNA, 21 bp, Homo sapiens
atagactgtacttattttcca

SEQ ID NO: 4210938 - DNA, 18 bp, Homo sapiens
atagattgtaatacacat

SEQ ID NO: 4210939 - DNA, 19 bp, Homo sapiens
atagattgtaatacacata

SEQ ID NO: 4210940 - DNA, 21 bp, Homo sapiens
ataggctattttctaaagact

SEQ ID NO: 4210941 - DNA, 22 bp, Homo sapiens
ataggctattttctaaagactt

SEQ ID NO: 4210942 - DNA, 19 bp, Homo sapiens
atataaatcaatcttatta

SEQ ID NO: 4210943 - DNA, 19 bp, Homo sapiens
atataatgaataaatcatt

SEQ ID NO: 4210944 - DNA, 13 bp, Homo sapiens
atatagagaaagt

SEQ ID NO: 4210945 - DNA, 13 bp, Homo sapiens
atataggctattt

SEQ ID NO: 4210946 - DNA, 23 bp, Homo sapiens
atatcccttggacattttatgtc

SEQ ID NO: 4210947 - DNA, 14 bp, Homo sapiens
atatgcagacatgt

SEQ ID NO: 4210948 - DNA, 15 bp, Homo sapiens
atatgtagtatctat

SEQ ID NO: 4210949 - DNA, 20 bp, Homo sapiens
atattataaaggataaagaa

SEQ ID NO: 4210950 - DNA, 23 bp, Homo sapiens
atattataaaggataaagaagga

SEQ ID NO: 4210951 - DNA, 16 bp, Homo sapiens
atattcagatgtatgt

SEQ ID NO: 4210952 - DNA, 17 bp, Homo sapiens
atattcattctttttga

SEQ ID NO: 4210953 - DNA, 21 bp, Homo sapiens
atattcctttttctatgaaat

SEQ ID NO: 4210954 - DNA, 13 bp, Homo sapiens
atattttccctct

SEQ ID NO: 4210955 - DNA, 18 bp, Homo sapiens
atattttccctctcttgc

SEQ ID NO: 4210956 - DNA, 14 bp, Homo sapiens
atcaaaatagtcta

SEQ ID NO: 4210957 - DNA, 19 bp, Homo sapiens
atcaaagtcattaaagaca

SEQ ID NO: 4210958 - DNA, 15 bp, Homo sapiens
atcaagtgaacatta

SEQ ID NO: 4210959 - DNA, 22 bp, Homo sapiens
atcaagttggcttctaatcaaa

SEQ ID NO: 4210960 - DNA, 23 bp, Homo sapiens
atcaatagattgtaatacacata

SEQ ID NO: 4210961 - DNA, 12 bp, Homo sapiens
atcaattttgtc

SEQ ID NO: 4210962 - DNA, 20 bp, Homo sapiens
atcaattttgtctattaaag

SEQ ID NO: 4210963 - DNA, 21 bp, Homo sapiens
atcacactctaagttctattg

SEQ ID NO: 4210964 - DNA, 16 bp, Homo sapiens
atcagaattttaccaa

SEQ ID NO: 4210965 - DNA, 15 bp, Homo sapiens
atcagctaccattca

SEQ ID NO: 4210966 - DNA, 13 bp, Homo sapiens
atcatctccaaac

SEQ ID NO: 4210967 - DNA, 14 bp, Homo sapiens
atcattcttactaa

SEQ ID NO: 4210968 - DNA, 18 bp, Homo sapiens
atcattcttactaaaaag

SEQ ID NO: 4210969 - DNA, 23 bp, Homo sapiens
atccaaacagaaaagtgcaaagt

SEQ ID NO: 4210970 - DNA, 22 bp, Homo sapiens
atccaaatttttttttaaagca

SEQ ID NO: 4210971 - DNA, 16 bp, Homo sapiens
atccaagtgacaaagt

SEQ ID NO: 4210972 - DNA, 15 bp, Homo sapiens
atccagaaaatgtgt

SEQ ID NO: 4210973 - DNA, 17 bp, Homo sapiens
atccatcctgctcttcc

SEQ ID NO: 4210974 - DNA, 23 bp, Homo sapiens
aaagtgagactgacacctcactg

SEQ ID NO: 4210975 - DNA, 15 bp, Homo sapiens
aaagtggaagtatgt

SEQ ID NO: 4210976 - DNA, 19 bp, Homo sapiens
aaatacatgcatataatga

SEQ ID NO: 4210977 - DNA, 22 bp, Homo sapiens
aaatactgtttttaacaactat

SEQ ID NO: 4210978 - DNA, 17 bp, Homo sapiens
aaatagaatgaaaagtt

SEQ ID NO: 4210979 - DNA, 14 bp, Homo sapiens
aaatagttaacaca

SEQ ID NO: 4210980 - DNA, 19 bp, Homo sapiens
aaatcaatgctataactat

SEQ ID NO: 4210981 - DNA, 21 bp, Homo sapiens
aaatcattcttactaaaaagt

SEQ ID NO: 4210982 - DNA, 17 bp, Homo sapiens
aaatcctgaagagcatt

SEQ ID NO: 4210983 - DNA, 13 bp, Homo sapiens
aaatgacattttg

SEQ ID NO: 4210984 - DNA, 15 bp, Homo sapiens
aaatgacatttttga

SEQ ID NO: 4210985 - DNA, 14 bp, Homo sapiens
aaatgccctctctg

SEQ ID NO: 4210986 - DNA, 12 bp, Homo sapiens
aaatggcaagag

SEQ ID NO: 4210987 - DNA, 20 bp, Homo sapiens
aaatggcaagagatcatatc

SEQ ID NO: 4210988 - DNA, 15 bp, Homo sapiens
aaatgtgtcagcatg

SEQ ID NO: 4210989 - DNA, 18 bp, Homo sapiens
aaatgttggaattttcaa

SEQ ID NO: 4210990 - DNA, 19 bp, Homo sapiens
aaatgttggaattttcaaa

SEQ ID NO: 4210991 - DNA, 17 bp, Homo sapiens
aaatgtttcattttcat

SEQ ID NO: 4210992 - DNA, 17 bp, Homo sapiens
aaattaaagctgaaaac

SEQ ID NO: 4210993 - DNA, 17 bp, Homo sapiens
aaattatttgattattt

SEQ ID NO: 4210994 - DNA, 19 bp, Homo sapiens
aaattccaaacttctaaat

SEQ ID NO: 4210995 - DNA, 22 bp, Homo sapiens
aaattgtgtttagattttatga

SEQ ID NO: 4210996 - DNA, 15 bp, Homo sapiens
aaatttaattttgca

SEQ ID NO: 4210997 - DNA, 11 bp, Homo sapiens
aaattttcaaa

SEQ ID NO: 4210998 - DNA, 13 bp, Homo sapiens
aaattttcaaact

SEQ ID NO: 4210999 - DNA, 20 bp, Homo sapiens
aacaaaacagtcctttaaat

SEQ ID NO: 4211000 - DNA, 12 bp, Homo sapiens
aacaagcttcag

SEQ ID NO: 4211001 - DNA, 21 bp, Homo sapiens
aacacagatcaagtgaacatt

SEQ ID NO: 4211002 - DNA, 12 bp, Homo sapiens
aacagagcaaga

SEQ ID NO: 4211003 - DNA, 22 bp, Homo sapiens
aacagttgaagaaaaaatggca

SEQ ID NO: 4211004 - DNA, 12 bp, Homo sapiens
aacccaattttc

SEQ ID NO: 4211005 - DNA, 12 bp, Homo sapiens
aactagaagaaa

SEQ ID NO: 4211006 - DNA, 20 bp, Homo sapiens
aactagactcccaagctgga

SEQ ID NO: 4211007 - DNA, 15 bp, Homo sapiens
aactcaggcaaagaa

SEQ ID NO: 4211008 - DNA, 12 bp, Homo sapiens
aactgccaagaa

SEQ ID NO: 4211009 - DNA, 13 bp, Homo sapiens
aactgtttagatg

SEQ ID NO: 4211010 - DNA, 13 bp, Homo sapiens
aacttaatggcac

SEQ ID NO: 4211011 - DNA, 14 bp, Homo sapiens
aacttcactccaaa

SEQ ID NO: 4211012 - DNA, 16 bp, Homo sapiens
aacttccaaataaata

SEQ ID NO: 4211013 - DNA, 17 bp, Homo sapiens
aacttttaatgccttcc

SEQ ID NO: 4211014 - DNA, 13 bp, Homo sapiens
aagaaaaggcatg

SEQ ID NO: 4211015 - DNA, 15 bp, Homo sapiens
aagaaagggcaagaa

SEQ ID NO: 4211016 - DNA, 17 bp, Homo sapiens
aagaaataaaccaaagg

SEQ ID NO: 4211017 - DNA, 20 bp, Homo sapiens
aagaagagctatcaggagaa

SEQ ID NO: 4211018 - DNA, 16 bp, Homo sapiens
aagaatgttagagtaa

SEQ ID NO: 4211019 - DNA, 18 bp, Homo sapiens
aagacaggagacaaaaga

SEQ ID NO: 4211020 - DNA, 13 bp, Homo sapiens
aagagcaaacttt

SEQ ID NO: 4211021 - DNA, 20 bp, Homo sapiens
aagagtttgcaaatgcaaca

SEQ ID NO: 4211022 - DNA, 21 bp, Homo sapiens
aagatcttttaaaaaggcagt

SEQ ID NO: 4211023 - DNA, 11 bp, Homo sapiens
aagattctatg

SEQ ID NO: 4211024 - DNA, 22 bp, Homo sapiens
aagcaaagactttcctcttagt

SEQ ID NO: 4211025 - DNA, 14 bp, Homo sapiens
aagcccatgctttc

SEQ ID NO: 4211026 - DNA, 19 bp, Homo sapiens
acacacagactacagccag

SEQ ID NO: 4211027 - DNA, 14 bp, Homo sapiens
acacatacaacttc

SEQ ID NO: 4211028 - DNA, 23 bp, Homo sapiens
acacattacaaagttaaaattgt

SEQ ID NO: 4211029 - DNA, 20 bp, Homo sapiens
acacctgaggctgaggcagg

SEQ ID NO: 4211030 - DNA, 21 bp, Homo sapiens
acactaacgaaatatcaaagt

SEQ ID NO: 4211031 - DNA, 22 bp, Homo sapiens
acagatctctgctttggaaatc

SEQ ID NO: 4211032 - DNA, 18 bp, Homo sapiens
acagcgaactagaagaaa

SEQ ID NO: 4211033 - DNA, 15 bp, Homo sapiens
acaggagacaaaaga

SEQ ID NO: 4211034 - DNA, 11 bp, Homo sapiens
acagtctctgg

SEQ ID NO: 4211035 - DNA, 13 bp, Homo sapiens
acagttgaagaaa

SEQ ID NO: 4211036 - DNA, 16 bp, Homo sapiens
acagttttaagagttg

SEQ ID NO: 4211037 - DNA, 18 bp, Homo sapiens
acatatctaaaaatagtt

SEQ ID NO: 4211038 - DNA, 16 bp, Homo sapiens
acatattcttggagaa

SEQ ID NO: 4211039 - DNA, 16 bp, Homo sapiens
acatcacttgccaatg

SEQ ID NO: 4211040 - DNA, 22 bp, Homo sapiens
acattacaaagttaaaattgtt

SEQ ID NO: 4211041 - DNA, 17 bp, Homo sapiens
acattacattgccattt

SEQ ID NO: 4211042 - DNA, 19 bp, Homo sapiens
accaaaggaaaatgtctgt

SEQ ID NO: 4211043 - DNA, 15 bp, Homo sapiens
accacattgaagaat

SEQ ID NO: 4211044 - DNA, 20 bp, Homo sapiens
acccagaaacaacacaatcc

SEQ ID NO: 4211045 - DNA, 16 bp, Homo sapiens
acccatgacctttttc

SEQ ID NO: 4211046 - DNA, 14 bp, Homo sapiens
accctagaggacta

SEQ ID NO: 4211047 - DNA, 20 bp, Homo sapiens
acctattaagtcatcatctc

SEQ ID NO: 4211048 - DNA, 14 bp, Homo sapiens
acctattttttaaa

SEQ ID NO: 4211049 - DNA, 18 bp, Homo sapiens
acctccctgccctgtcct

SEQ ID NO: 4211050 - DNA, 17 bp, Homo sapiens
acctgtttatataattt

SEQ ID NO: 4211051 - DNA, 18 bp, Homo sapiens
acgcctataatcccagca

SEQ ID NO: 4211052 - DNA, 16 bp, Homo sapiens
acgcctgtaatcccag

SEQ ID NO: 4211053 - DNA, 19 bp, Homo sapiens
actagactcccaagctgga

SEQ ID NO: 4211054 - DNA, 17 bp, Homo sapiens
actagttgatgaaggag

SEQ ID NO: 4211055 - DNA, 22 bp, Homo sapiens
actatcatgtcaaacgtgaaaa

SEQ ID NO: 4211056 - DNA, 19 bp, Homo sapiens
actatgcgtggctggaacc

SEQ ID NO: 4211057 - DNA, 23 bp, Homo sapiens
actatgcgtggctggaaccacat

SEQ ID NO: 4211058 - DNA, 13 bp, Homo sapiens
actccaaagagaa

SEQ ID NO: 4211059 - DNA, 14 bp, Homo sapiens
actccaaagagaaa

SEQ ID NO: 4211060 - DNA, 16 bp, Homo sapiens
actcctctgtctctgc

SEQ ID NO: 4211061 - DNA, 17 bp, Homo sapiens
actcttgcctttccacc

SEQ ID NO: 4211062 - DNA, 22 bp, Homo sapiens
actcttgcctttccacctgctt

SEQ ID NO: 4211063 - DNA, 15 bp, Homo sapiens
actgaccctggagcg

SEQ ID NO: 4211064 - DNA, 18 bp, Homo sapiens
actgaccctggagcggct

SEQ ID NO: 4211065 - DNA, 15 bp, Homo sapiens
actgaggatattcag

SEQ ID NO: 4211066 - DNA, 12 bp, Homo sapiens
actgccaagaaa

SEQ ID NO: 4211067 - DNA, 11 bp, Homo sapiens
actgccttcca

SEQ ID NO: 4211068 - DNA, 17 bp, Homo sapiens
actgctcaattctgttt

SEQ ID NO: 4211069 - DNA, 23 bp, Homo sapiens
actggcacgtttgtgagaagaaa

SEQ ID NO: 4211070 - DNA, 20 bp, Homo sapiens
actgtaacttccaaataaat

SEQ ID NO: 4211071 - DNA, 16 bp, Homo sapiens
actgtcctattatatt

SEQ ID NO: 4211072 - DNA, 22 bp, Homo sapiens
actgtgtgtgtcctacacaatg

SEQ ID NO: 4211073 - DNA, 14 bp, Homo sapiens
actgtttagatgaa

SEQ ID NO: 4211074 - DNA, 18 bp, Homo sapiens
acttattgaatatatgat

SEQ ID NO: 4211075 - DNA, 12 bp, Homo sapiens
acttattttcca

SEQ ID NO: 4211076 - DNA, 18 bp, Homo sapiens
acttattttccaataaaa

SEQ ID NO: 4211077 - DNA, 14 bp, Homo sapiens
acttcactccaaag

SEQ ID NO: 4211078 - DNA, 20 bp, Homo sapiens
acttcactccaaagagaaac

SEQ ID NO: 4211079 - DNA, 15 bp, Homo sapiens
acttcatataactga

SEQ ID NO: 4211080 - DNA, 21 bp, Homo sapiens
acttcttaatgctttcctccc

SEQ ID NO: 4211081 - DNA, 19 bp, Homo sapiens
tgcttgaaggaacagtgct

SEQ ID NO: 4211082 - DNA, 20 bp, Homo sapiens
tgcttgaaggaacagtgctg

SEQ ID NO: 4211083 - DNA, 22 bp, Homo sapiens
tgcttgaaggaacagtgctgtt

SEQ ID NO: 4211084 - DNA, 13 bp, Homo sapiens
tgctttggaaatc

SEQ ID NO: 4211085 - DNA, 15 bp, Homo sapiens
tggaaatacacagtg

SEQ ID NO: 4211086 - DNA, 17 bp, Homo sapiens
tggaaattggaagagca

SEQ ID NO: 4211087 - DNA, 17 bp, Homo sapiens
tggaaccacattgaaga

SEQ ID NO: 4211088 - DNA, 19 bp, Homo sapiens
tggaaccacattgaagaat

SEQ ID NO: 4211089 - DNA, 22 bp, Homo sapiens
tggaagtatgtatattaaaaaa

SEQ ID NO: 4211090 - DNA, 23 bp, Homo sapiens
tggaataataattttcctcctaa

SEQ ID NO: 4211091 - DNA, 18 bp, Homo sapiens
tggaattgctgctctctg

SEQ ID NO: 4211092 - DNA, 16 bp, Homo sapiens
tggacattttatgtct

SEQ ID NO: 4211093 - DNA, 17 bp, Homo sapiens
tggacattttatgtctt

SEQ ID NO: 4211094 - DNA, 14 bp, Homo sapiens
tggagcggctctcc

SEQ ID NO: 4211095 - DNA, 12 bp, Homo sapiens
tggaggaacagc

SEQ ID NO: 4211096 - DNA, 22 bp, Homo sapiens
tggagtattattgaagatgtga

SEQ ID NO: 4211097 - DNA, 21 bp, Homo sapiens
tggataaattgtatgaagatc

SEQ ID NO: 4211098 - DNA, 14 bp, Homo sapiens
tggataagcgtggg

SEQ ID NO: 4211099 - DNA, 19 bp, Homo sapiens
tggatatataggctatttt

SEQ ID NO: 4211100 - DNA, 17 bp, Homo sapiens
tggcaagagatcatatc

SEQ ID NO: 4211101 - DNA, 19 bp, Homo sapiens
tggcaggagttggaagtgt

SEQ ID NO: 4211102 - DNA, 21 bp, Homo sapiens
tggcatgaccatcctgtcctt

SEQ ID NO: 4211103 - DNA, 18 bp, Homo sapiens
ttcctccgtctgcaatgt

SEQ ID NO: 4211104 - DNA, 19 bp, Homo sapiens
ttcctctccagccttctct

SEQ ID NO: 4211105 - DNA, 22 bp, Homo sapiens
ttcctctccagccttctctctc

SEQ ID NO: 4211106 - DNA, 16 bp, Homo sapiens
ttcctttttctatgaa

SEQ ID NO: 4211107 - DNA, 22 bp, Homo sapiens
ttctaaatatcccttggacatt

SEQ ID NO: 4211108 - DNA, 18 bp, Homo sapiens
ttctagtctggtgttctg

SEQ ID NO: 4211109 - DNA, 21 bp, Homo sapiens
ttctagtctggtgttctgagt

SEQ ID NO: 4211110 - DNA, 21 bp, Homo sapiens
ttctatttatttatttattca

SEQ ID NO: 4211111 - DNA, 15 bp, Homo sapiens
ttctcttttcctttg

SEQ ID NO: 4211112 - DNA, 22 bp, Homo sapiens
ttctgagtacttgatttcaggt

SEQ ID NO: 4211113 - DNA, 14 bp, Homo sapiens
ttctggagctgctg

SEQ ID NO: 4211114 - DNA, 15 bp, Homo sapiens
ttctggaggaagaag

SEQ ID NO: 4211115 - DNA, 14 bp, Homo sapiens
ttctttttgaaatg

SEQ ID NO: 4211116 - DNA, 17 bp, Homo sapiens
ttgaagaaaaaatggca

SEQ ID NO: 4211117 - DNA, 20 bp, Homo sapiens
ttgaaggaacagtgctgttc

SEQ ID NO: 4211118 - DNA, 16 bp, Homo sapiens
ttgaaggtagaatgtt

SEQ ID NO: 4211119 - DNA, 13 bp, Homo sapiens
ttgaatcacagta

SEQ ID NO: 4211120 - DNA, 17 bp, Homo sapiens
ttgagcctccatttctg

SEQ ID NO: 4211121 - DNA, 17 bp, Homo sapiens
gattgtaatacacatat

SEQ ID NO: 4211122 - DNA, 18 bp, Homo sapiens
gattgtgcctaatgtgtt

SEQ ID NO: 4211123 - DNA, 18 bp, Homo sapiens
gatttgtcttcccttctt

SEQ ID NO: 4211124 - DNA, 22 bp, Homo sapiens
gatttgtcttcccttctttgca

SEQ ID NO: 4211125 - DNA, 23 bp, Homo sapiens
gattttttatgtacaaccctgac

SEQ ID NO: 4211126 - DNA, 20 bp, Homo sapiens
gcaaacatttcttaaaatgt

SEQ ID NO: 4211127 - DNA, 16 bp, Homo sapiens
gcaacaaaatatttaa

SEQ ID NO: 4211128 - DNA, 16 bp, Homo sapiens
gcaacagagcaagact

SEQ ID NO: 4211129 - DNA, 15 bp, Homo sapiens
gcaattattctaatt

SEQ ID NO: 4211130 - DNA, 16 bp, Homo sapiens
gcaattgtaaacagaa

SEQ ID NO: 4211131 - DNA, 22 bp, Homo sapiens
gcaattgtaaacagaaattgca

SEQ ID NO: 4211132 - DNA, 21 bp, Homo sapiens
gcacacgcctgtaatcccagc

SEQ ID NO: 4211133 - DNA, 15 bp, Homo sapiens
gcacagttttaagag

SEQ ID NO: 4211134 - DNA, 12 bp, Homo sapiens
gcacatctggga

SEQ ID NO: 4211135 - DNA, 13 bp, Homo sapiens
gcactcctctgtc

SEQ ID NO: 4211136 - DNA, 17 bp, Homo sapiens
gcacttattgaatatat

SEQ ID NO: 4211137 - DNA, 20 bp, Homo sapiens
gcacttattgaatatatgat

SEQ ID NO: 4211138 - DNA, 11 bp, Homo sapiens
gcagcagaagc

SEQ ID NO: 4211139 - DNA, 23 bp, Homo sapiens
gcagcttttgccttggttcttcc

SEQ ID NO: 4211140 - DNA, 23 bp, Homo sapiens
gcaggcaaagtgagactgacacc

SEQ ID NO: 4211141 - DNA, 20 bp, Homo sapiens
gcaggccaggttatgcctca

SEQ ID NO: 4211142 - DNA, 22 bp, Homo sapiens
gcagggatgtcacgtcttgaaa

SEQ ID NO: 4211143 - DNA, 13 bp, Homo sapiens
gcagtgagccgag

SEQ ID NO: 4211144 - DNA, 22 bp, Homo sapiens
gcagtttttttatggcattttt

SEQ ID NO: 4211145 - DNA, 13 bp, Homo sapiens
gcataaagtaaat

SEQ ID NO: 4211146 - DNA, 17 bp, Homo sapiens
gcataatttaaaaatat

SEQ ID NO: 4211147 - DNA, 13 bp, Homo sapiens
gcatttaaaaaaa

SEQ ID NO: 4211148 - DNA, 14 bp, Homo sapiens
gcattttctctagc

SEQ ID NO: 4211149 - DNA, 15 bp, Homo sapiens
gcattttctctagct

SEQ ID NO: 4211150 - DNA, 20 bp, Homo sapiens
gccaaatttatatgccaccg

SEQ ID NO: 4211151 - DNA, 19 bp, Homo sapiens
gccatcaggactttccctg

SEQ ID NO: 4211152 - DNA, 21 bp, Homo sapiens
gccatttaatttttaaatgtt

SEQ ID NO: 4211153 - DNA, 14 bp, Homo sapiens
gcccatggagcagg

SEQ ID NO: 4211154 - DNA, 11 bp, Homo sapiens
gccctctctga

SEQ ID NO: 4211155 - DNA, 14 bp, Homo sapiens
gccctgtcctccag

SEQ ID NO: 4211156 - DNA, 15 bp, Homo sapiens
gccctgtcctccagc

SEQ ID NO: 4211157 - DNA, 19 bp, Homo sapiens
gccgctcttctgtcatccc

SEQ ID NO: 4211158 - DNA, 18 bp, Homo sapiens
gcctacaatgggaaaact

SEQ ID NO: 4211159 - DNA, 20 bp, Homo sapiens
gcctattagatgttttacaa

SEQ ID NO: 4211160 - DNA, 23 bp, Homo sapiens
gcctccatttctggcttctagtc

SEQ ID NO: 4211161 - DNA, 14 bp, Homo sapiens
gccttctcgcattt

SEQ ID NO: 4211162 - DNA, 15 bp, Homo sapiens
gccttggttcttcct

SEQ ID NO: 4211163 - DNA, 15 bp, Homo sapiens
gccttgtttaatggt

SEQ ID NO: 4211164 - DNA, 19 bp, Homo sapiens
gcctttcttatttgcaata

SEQ ID NO: 4211165 - DNA, 14 bp, Homo sapiens
gcgacttccacaaa

SEQ ID NO: 4211166 - DNA, 19 bp, Homo sapiens
gcgacttccacaaacctgg

SEQ ID NO: 4211167 - DNA, 13 bp, Homo sapiens
gcggctctcctga

SEQ ID NO: 4211168 - DNA, 14 bp, Homo sapiens
gctccacctgttca

SEQ ID NO: 4211169 - DNA, 20 bp, Homo sapiens
gctccctagtggcttcctcc

SEQ ID NO: 4211170 - DNA, 22 bp, Homo sapiens
gctcctgctgaaacacctccca

SEQ ID NO: 4211171 - DNA, 23 bp, Homo sapiens
gctctcctgagaggtgctgcagg

SEQ ID NO: 4211172 - DNA, 16 bp, Homo sapiens
gctcttctgtcatccc

SEQ ID NO: 4211173 - DNA, 10 bp, Homo sapiens
gctcttgcct

SEQ ID NO: 4211174 - DNA, 17 bp, Homo sapiens
gctgaaacacctcccag

SEQ ID NO: 4211175 - DNA, 15 bp, Homo sapiens
gctgctctctgaggg

SEQ ID NO: 4211176 - DNA, 15 bp, Homo sapiens
gctggtctccctcca

SEQ ID NO: 4211177 - DNA, 16 bp, Homo sapiens
gctggtctccctccag

SEQ ID NO: 4211178 - DNA, 13 bp, Homo sapiens
gctgtctctgtcc

SEQ ID NO: 4211179 - DNA, 23 bp, Homo sapiens
gctgtctctgtccctcactgcct

SEQ ID NO: 4211180 - DNA, 17 bp, Homo sapiens
gctgtggtggctgtctc

SEQ ID NO: 4211181 - DNA, 23 bp, Homo sapiens
gctgtgtactcttaggctaagag

SEQ ID NO: 4211182 - DNA, 22 bp, Homo sapiens
gctgttccaacagacagggcct

SEQ ID NO: 4211183 - DNA, 22 bp, Homo sapiens
gcttaattattgatgttttcat

SEQ ID NO: 4211184 - DNA, 15 bp, Homo sapiens
gcttcccctcgctgt

SEQ ID NO: 4211185 - DNA, 19 bp, Homo sapiens
gcttcccctcgctgtcctg

SEQ ID NO: 4211186 - DNA, 18 bp, Homo sapiens
gcttcctccgtctgcaat

SEQ ID NO: 4211187 - DNA, 19 bp, Homo sapiens
gcttcctccgtctgcaatg

SEQ ID NO: 4211188 - DNA, 16 bp, Homo sapiens
gcttctagtctggtgt

SEQ ID NO: 4211189 - DNA, 17 bp, Homo sapiens
gcttctctccacccatg

SEQ ID NO: 4211190 - DNA, 15 bp, Homo sapiens
gcttgaaggaacagt

SEQ ID NO: 4211191 - DNA, 13 bp, Homo sapiens
gcttgtattttcc

SEQ ID NO: 4211192 - DNA, 14 bp, Homo sapiens
gcttgtattttcca

SEQ ID NO: 4211193 - DNA, 16 bp, Homo sapiens
gctttaagcaccctag

SEQ ID NO: 4211194 - DNA, 12 bp, Homo sapiens
gctttccacagg

SEQ ID NO: 4211195 - DNA, 14 bp, Homo sapiens
gctttcctccctgg

SEQ ID NO: 4211196 - DNA, 12 bp, Homo sapiens
gctttctcctgg

SEQ ID NO: 4211197 - DNA, 13 bp, Homo sapiens
ggaataagccatg

SEQ ID NO: 4211198 - DNA, 15 bp, Homo sapiens
ggaattgctgctctc

SEQ ID NO: 4211199 - DNA, 21 bp, Homo sapiens
ggaatttaaggagggacaaga

SEQ ID NO: 4211200 - DNA, 15 bp, Homo sapiens
ggagacaaaagagca

SEQ ID NO: 4211201 - DNA, 22 bp, Homo sapiens
ggagactgctgagtcaacccaa

SEQ ID NO: 4211202 - DNA, 13 bp, Homo sapiens
ggagcggctctcc

SEQ ID NO: 4211203 - DNA, 22 bp, Homo sapiens
ggaggctgaagtgggtggatca

SEQ ID NO: 4211204 - DNA, 12 bp, Homo sapiens
ggataaattgta

SEQ ID NO: 4211205 - DNA, 18 bp, Homo sapiens
ggcaacttgggaactaga

SEQ ID NO: 4211206 - DNA, 13 bp, Homo sapiens
ggcaagagatcat

SEQ ID NO: 4211207 - DNA, 20 bp, Homo sapiens
ggcagttttgaaatgaaaat

SEQ ID NO: 4211208 - DNA, 12 bp, Homo sapiens
ggcataaagtaa

SEQ ID NO: 4211209 - DNA, 15 bp, Homo sapiens
ggcatgaccatcctg

SEQ ID NO: 4211210 - DNA, 18 bp, Homo sapiens
ggcatgaccatcctgtcc

SEQ ID NO: 4211211 - DNA, 21 bp, Homo sapiens
ggccagatgcacatccctgga

SEQ ID NO: 4211212 - DNA, 17 bp, Homo sapiens
ggcccgctttgcctgct

SEQ ID NO: 4211213 - DNA, 18 bp, Homo sapiens
ggcccgctttgcctgctt

SEQ ID NO: 4211214 - DNA, 12 bp, Homo sapiens
ggcgacttcctc

SEQ ID NO: 4211215 - DNA, 20 bp, Homo sapiens
ggctattttctaaagacttg

SEQ ID NO: 4211216 - DNA, 22 bp, Homo sapiens
ggctccacctgttcaggagctg

SEQ ID NO: 4211217 - DNA, 14 bp, Homo sapiens
ggcttcctccgtct

SEQ ID NO: 4211218 - DNA, 22 bp, Homo sapiens
gggaaaacttcactccaaagag

SEQ ID NO: 4211219 - DNA, 16 bp, Homo sapiens
gggaataagccatgac

SEQ ID NO: 4211220 - DNA, 11 bp, Homo sapiens
gggagagaact

SEQ ID NO: 4211221 - DNA, 14 bp, Homo sapiens
gggcataaagtaaa

SEQ ID NO: 4211222 - DNA, 17 bp, Homo sapiens
gggcccgctttgcctgc

SEQ ID NO: 4211223 - DNA, 15 bp, Homo sapiens
gggctatgccttgtc

SEQ ID NO: 4211224 - DNA, 16 bp, Homo sapiens
ggggctatgccttgtc

SEQ ID NO: 4211225 - DNA, 21 bp, Homo sapiens
ggggtgatgatgaccaagaat

SEQ ID NO: 4211226 - DNA, 23 bp, Homo sapiens
ggtagaatgttttcaaatgttct

SEQ ID NO: 4211227 - DNA, 12 bp, Homo sapiens
ggtgcctcctgt

SEQ ID NO: 4211228 - DNA, 20 bp, Homo sapiens
ggtggcacacgcctgtaatc

SEQ ID NO: 4211229 - DNA, 17 bp, Homo sapiens
ggtggctgtctctgtcc

SEQ ID NO: 4211230 - DNA, 17 bp, Homo sapiens
gtaaacagaaattgcaa

SEQ ID NO: 4211231 - DNA, 14 bp, Homo sapiens
gtaacatagattta

SEQ ID NO: 4211232 - DNA, 13 bp, Homo sapiens
gtaataatagact

SEQ ID NO: 4211233 - DNA, 15 bp, Homo sapiens
gtacaaggtatttac

SEQ ID NO: 4211234 - DNA, 16 bp, Homo sapiens
gtacaaggtatttaca

SEQ ID NO: 4211235 - DNA, 20 bp, Homo sapiens
gtacaaggtatttacacata

SEQ ID NO: 4211236 - DNA, 14 bp, Homo sapiens
gtagagtcactgac

SEQ ID NO: 4211237 - DNA, 13 bp, Homo sapiens
gtatattaaaaaa

SEQ ID NO: 4211238 - DNA, 19 bp, Homo sapiens
gtatattaaaaaagagaca

SEQ ID NO: 4211239 - DNA, 21 bp, Homo sapiens
gtattgagccattttttaaat

SEQ ID NO: 4211240 - DNA, 22 bp, Homo sapiens
gtatttatctcctgtctacagt

SEQ ID NO: 4211241 - DNA, 17 bp, Homo sapiens
gtcaaacgtgaaaatgc

SEQ ID NO: 4211242 - DNA, 12 bp, Homo sapiens
gtcactcccaga

SEQ ID NO: 4211243 - DNA, 22 bp, Homo sapiens
gtcactctaggactctgcactg

SEQ ID NO: 4211244 - DNA, 17 bp, Homo sapiens
gtcagttgttatttatt

SEQ ID NO: 4211245 - DNA, 18 bp, Homo sapiens
gtcatcccgctcctgctg

SEQ ID NO: 4211246 - DNA, 15 bp, Homo sapiens
gtcctccagcttccc

SEQ ID NO: 4211247 - DNA, 17 bp, Homo sapiens
gtctattaaagatattt

SEQ ID NO: 4211248 - DNA, 14 bp, Homo sapiens
gtctccctccagct

SEQ ID NO: 4211249 - DNA, 16 bp, Homo sapiens
gtctctgactcttgcc

SEQ ID NO: 4211250 - DNA, 18 bp, Homo sapiens
gtctctgtccctcactgc

SEQ ID NO: 4211251 - DNA, 15 bp, Homo sapiens
gtctggcttcacaga

SEQ ID NO: 4211252 - DNA, 14 bp, Homo sapiens
gtcttcccttcttt

SEQ ID NO: 4211253 - DNA, 12 bp, Homo sapiens
gtcttctattta

SEQ ID NO: 4211254 - DNA, 17 bp, Homo sapiens
gtctttggaggaacagc

SEQ ID NO: 4211255 - DNA, 18 bp, Homo sapiens
gtgaacttcctttgactt

SEQ ID NO: 4211256 - DNA, 20 bp, Homo sapiens
gtgagactgacacctcactg

SEQ ID NO: 4211257 - DNA, 20 bp, Homo sapiens
gtgattcacagtgtgaatct

SEQ ID NO: 4211258 - DNA, 16 bp, Homo sapiens
gtgatttgtcttccct

SEQ ID NO: 4211259 - DNA, 17 bp, Homo sapiens
gtgcacatctgttttgt

SEQ ID NO: 4211260 - DNA, 15 bp, Homo sapiens
gtgcctaatgtgttt

SEQ ID NO: 4211261 - DNA, 20 bp, Homo sapiens
gtgctaagaaagcaagccaa

SEQ ID NO: 4211262 - DNA, 15 bp, Homo sapiens
gtggaattacttaaa

SEQ ID NO: 4211263 - DNA, 21 bp, Homo sapiens
gtggccatcaggactttccct

SEQ ID NO: 4211264 - DNA, 18 bp, Homo sapiens
gtggccatgtcgcctgcc

SEQ ID NO: 4211265 - DNA, 22 bp, Homo sapiens
gtggctcacgcctataatccca

SEQ ID NO: 4211266 - DNA, 18 bp, Homo sapiens
gtggtggctgtctctgtc

SEQ ID NO: 4211267 - DNA, 12 bp, Homo sapiens
gtgtcagcatgc

SEQ ID NO: 4211268 - DNA, 23 bp, Homo sapiens
gtgtgtggtcaacatttctcatg

SEQ ID NO: 4211269 - DNA, 22 bp, Homo sapiens
gtgttctgagtacttgatttca

SEQ ID NO: 4211270 - DNA, 22 bp, Homo sapiens
gttaagttgatggtgatgaaat

SEQ ID NO: 4211271 - DNA, 18 bp, Homo sapiens
gttctccagtcattatgt

SEQ ID NO: 4211272 - DNA, 20 bp, Homo sapiens
gttctccagtcattatgtta

SEQ ID NO: 4211273 - DNA, 21 bp, Homo sapiens
gttctggagctgctgttccaa

SEQ ID NO: 4211274 - DNA, 17 bp, Homo sapiens
gttctttaggtgcctcc

SEQ ID NO: 4211275 - DNA, 18 bp, Homo sapiens
gttgaagaaaaaatggca

SEQ ID NO: 4211276 - DNA, 23 bp, Homo sapiens
gttgcattttaaccctattttac

SEQ ID NO: 4211277 - DNA, 20 bp, Homo sapiens
gttggtgtgctatttttgaa

SEQ ID NO: 4211278 - DNA, 13 bp, Homo sapiens
gtttataataaaa

SEQ ID NO: 4211279 - DNA, 22 bp, Homo sapiens
gttttacaaatttaattttgca

SEQ ID NO: 4211280 - DNA, 15 bp, Homo sapiens
tattatcatgtctat

SEQ ID NO: 4211281 - DNA, 13 bp, Homo sapiens
tattatcctgcat

SEQ ID NO: 4211282 - DNA, 18 bp, Homo sapiens
tattcattctttttgaaa

SEQ ID NO: 4211283 - DNA, 17 bp, Homo sapiens
tattccccatcttccaa

SEQ ID NO: 4211284 - DNA, 15 bp, Homo sapiens
tattcctttttctat

SEQ ID NO: 4211285 - DNA, 21 bp, Homo sapiens
tattcttggagaactttccat

SEQ ID NO: 4211286 - DNA, 15 bp, Homo sapiens
tattgaacctaggac

SEQ ID NO: 4211287 - DNA, 14 bp, Homo sapiens
tattgatgttttca

SEQ ID NO: 4211288 - DNA, 14 bp, Homo sapiens
tatttaagactaaa

SEQ ID NO: 4211289 - DNA, 16 bp, Homo sapiens
tatttaatttttgcaa

SEQ ID NO: 4211290 - DNA, 12 bp, Homo sapiens
tatttacacata

SEQ ID NO: 4211291 - DNA, 15 bp, Homo sapiens
tatttatctcctgtc

SEQ ID NO: 4211292 - DNA, 20 bp, Homo sapiens
tatttattgaaatgatttca

SEQ ID NO: 4211293 - DNA, 22 bp, Homo sapiens
tattttaggtgtaaaataatta

SEQ ID NO: 4211294 - DNA, 14 bp, Homo sapiens
tattttccaataaa

SEQ ID NO: 4211295 - DNA, 17 bp, Homo sapiens
tcaaacacctctgtatt

SEQ ID NO: 4211296 - DNA, 21 bp, Homo sapiens
tcaaagtctgctctcatataa

SEQ ID NO: 4211297 - DNA, 17 bp, Homo sapiens
tcaatagactgtactta

SEQ ID NO: 4211298 - DNA, 16 bp, Homo sapiens
tcaatcttattactga

SEQ ID NO: 4211299 - DNA, 14 bp, Homo sapiens
tcaatgagagcata

SEQ ID NO: 4211300 - DNA, 21 bp, Homo sapiens
tcacagatgtgtgattcacag

SEQ ID NO: 4211301 - DNA, 14 bp, Homo sapiens
tcactccaaagaga

SEQ ID NO: 4211302 - DNA, 17 bp, Homo sapiens
tcactccaaagagaaac

SEQ ID NO: 4211303 - DNA, 18 bp, Homo sapiens
tcactgcaagctccgcct

SEQ ID NO: 4211304 - DNA, 14 bp, Homo sapiens
tcacttcaatgaac

SEQ ID NO: 4211305 - DNA, 21 bp, Homo sapiens
tcacttcctaagttcccttct

SEQ ID NO: 4211306 - DNA, 15 bp, Homo sapiens
tcagaacatcctcca

SEQ ID NO: 4211307 - DNA, 12 bp, Homo sapiens
tcagagacactg

SEQ ID NO: 4211308 - DNA, 15 bp, Homo sapiens
tcagcatgattcttc

SEQ ID NO: 4211309 - DNA, 14 bp, Homo sapiens
tcagtaagttatct

SEQ ID NO: 4211310 - DNA, 23 bp, Homo sapiens
tcatatcctcagaccaggtggaa

SEQ ID NO: 4211311 - DNA, 18 bp, Homo sapiens
tcatcaattttgtctatt

SEQ ID NO: 4211312 - DNA, 15 bp, Homo sapiens
tcatcttagctttcc

SEQ ID NO: 4211313 - DNA, 19 bp, Homo sapiens
tcatgctgacttgcagagt

SEQ ID NO: 4211314 - DNA, 14 bp, Homo sapiens
tcatgtacagcatg

SEQ ID NO: 4211315 - DNA, 16 bp, Homo sapiens
tcattatgttaatatt

SEQ ID NO: 4211316 - DNA, 21 bp, Homo sapiens
tcattctttttgaaatgtcaa

SEQ ID NO: 4211317 - DNA, 14 bp, Homo sapiens
tcatttttgaatac

SEQ ID NO: 4211318 - DNA, 22 bp, Homo sapiens
tccaaacttctaaatgttggaa

SEQ ID NO: 4211319 - DNA, 21 bp, Homo sapiens
tccaaatttttttttaaagca

SEQ ID NO: 4211320 - DNA, 23 bp, Homo sapiens
tccaagggttgaattctggagga

SEQ ID NO: 4211321 - DNA, 20 bp, Homo sapiens
tccaattccacagtctctgg

SEQ ID NO: 4211322 - DNA, 13 bp, Homo sapiens
tccacagtctctg

SEQ ID NO: 4211323 - DNA, 18 bp, Homo sapiens
tccacccatgaccttttt

SEQ ID NO: 4211324 - DNA, 18 bp, Homo sapiens
tccacctgctttctcctg

SEQ ID NO: 4211325 - DNA, 19 bp, Homo sapiens
tccacctgctttctcctgg

SEQ ID NO: 4211326 - DNA, 20 bp, Homo sapiens
tccacctgctttctcctggg

SEQ ID NO: 4211327 - DNA, 18 bp, Homo sapiens
tccacctgttcaggagct

SEQ ID NO: 4211328 - DNA, 22 bp, Homo sapiens
tccagctggaattgctgctctc

SEQ ID NO: 4211329 - DNA, 23 bp, Homo sapiens
tccagctggaattgctgctctct

SEQ ID NO: 4211330 - DNA, 19 bp, Homo sapiens
tccagctgggttggaaaac

SEQ ID NO: 4211331 - DNA, 22 bp, Homo sapiens
tccagcttcccctcgctgtcct

SEQ ID NO: 4211332 - DNA, 21 bp, Homo sapiens
tccaggagcaatttgcacatg

SEQ ID NO: 4211333 - DNA, 15 bp, Homo sapiens
tccagtcattatgtt

SEQ ID NO: 4211334 - DNA, 21 bp, Homo sapiens
tccatgcaccctcatacacag

SEQ ID NO: 4211335 - DNA, 22 bp, Homo sapiens
tccatttctggcttctagtctg

SEQ ID NO: 4211336 - DNA, 13 bp, Homo sapiens
tccatttcttcca

SEQ ID NO: 4211337 - DNA, 14 bp, Homo sapiens
tcccaccagcatgt

SEQ ID NO: 4211338 - DNA, 19 bp, Homo sapiens
tcccaccagcatgtcactc

SEQ ID NO: 4211339 - DNA, 15 bp, Homo sapiens
tcccagaccacctcc

SEQ ID NO: 4211340 - DNA, 14 bp, Homo sapiens
tcccagatgtaaag

SEQ ID NO: 4211341 - DNA, 16 bp, Homo sapiens
tcccagatgtaaagaa

SEQ ID NO: 4211342 - DNA, 13 bp, Homo sapiens
tcccagcactttg

SEQ ID NO: 4211343 - DNA, 21 bp, Homo sapiens
tcccagcactttgggaggctg

SEQ ID NO: 4211344 - DNA, 16 bp, Homo sapiens
tcccagctacacctga

SEQ ID NO: 4211345 - DNA, 19 bp, Homo sapiens
tcccaggttggcctggtgg

SEQ ID NO: 4211346 - DNA, 18 bp, Homo sapiens
tcccatgatgccgctctt

SEQ ID NO: 4211347 - DNA, 14 bp, Homo sapiens
tccccagccagaag

SEQ ID NO: 4211348 - DNA, 16 bp, Homo sapiens
tcccctcgctgtcctg

SEQ ID NO: 4211349 - DNA, 12 bp, Homo sapiens
tcccgctcctgc

SEQ ID NO: 4211350 - DNA, 17 bp, Homo sapiens
tccctagtggcttcctc

SEQ ID NO: 4211351 - DNA, 14 bp, Homo sapiens
tccctcactgcctt

SEQ ID NO: 4211352 - DNA, 14 bp, Homo sapiens
tccctccagctgga

SEQ ID NO: 4211353 - DNA, 14 bp, Homo sapiens
tccctctcttgcct

SEQ ID NO: 4211354 - DNA, 20 bp, Homo sapiens
tcccttctatatcctcaagg

SEQ ID NO: 4211355 - DNA, 16 bp, Homo sapiens
tcccttggacatttta

SEQ ID NO: 4211356 - DNA, 20 bp, Homo sapiens
tccctttttcataaattatt

SEQ ID NO: 4211357 - DNA, 17 bp, Homo sapiens
tccgttgcaaacccaaa

SEQ ID NO: 4211358 - DNA, 12 bp, Homo sapiens
tcctacacaatg

SEQ ID NO: 4211359 - DNA, 18 bp, Homo sapiens
tcctactttgcttctctc

SEQ ID NO: 4211360 - DNA, 19 bp, Homo sapiens
tcctcagaccaggtggaat

SEQ ID NO: 4211361 - DNA, 21 bp, Homo sapiens
tcctctccagccttctctctc

SEQ ID NO: 4211362 - DNA, 24 bp, Homo sapiens
tcctctccagccttctctctctgg

SEQ ID NO: 4211363 - DNA, 13 bp, Homo sapiens
tcctgagaggtgc

SEQ ID NO: 4211364 - DNA, 12 bp, Homo sapiens
tcctgcatttta

SEQ ID NO: 4211365 - DNA, 13 bp, Homo sapiens
tcctgctcttcca

SEQ ID NO: 4211366 - DNA, 23 bp, Homo sapiens
tcctgctgtgtgaattcccaggt

SEQ ID NO: 4211367 - DNA, 18 bp, Homo sapiens
tcctgtcctttgttatta

SEQ ID NO: 4211368 - DNA, 15 bp, Homo sapiens
tcctttatccctgag

SEQ ID NO: 4211369 - DNA, 23 bp, Homo sapiens
tcctttgcctaggaggccttctc

SEQ ID NO: 4211370 - DNA, 12 bp, Homo sapiens
tctcttgccttt

SEQ ID NO: 4211371 - DNA, 20 bp, Homo sapiens
tctctttctaagagacctga

SEQ ID NO: 4211372 - DNA, 23 bp, Homo sapiens
tctctttctaagagacctgaact

SEQ ID NO: 4211373 - DNA, 15 bp, Homo sapiens
tctgactcttgcctt

SEQ ID NO: 4211374 - DNA, 14 bp, Homo sapiens
tctgctcttgcctg

SEQ ID NO: 4211375 - DNA, 16 bp, Homo sapiens
tctgctcttgcctgca

SEQ ID NO: 4211376 - DNA, 19 bp, Homo sapiens
tctgcttgtattttccata

SEQ ID NO: 4211377 - DNA, 19 bp, Homo sapiens
tctggattcatatttaatt

SEQ ID NO: 4211378 - DNA, 13 bp, Homo sapiens
tctgggaggctgg

SEQ ID NO: 4211379 - DNA, 17 bp, Homo sapiens
tctggggaccctgtaga

SEQ ID NO: 4211380 - DNA, 15 bp, Homo sapiens
tctggtgttctgagt

SEQ ID NO: 4211381 - DNA, 13 bp, Homo sapiens
tctgtaataatag

SEQ ID NO: 4211382 - DNA, 15 bp, Homo sapiens
tctgtaataatagac

SEQ ID NO: 4211383 - DNA, 16 bp, Homo sapiens
tctgtaataatagact

SEQ ID NO: 4211384 - DNA, 19 bp, Homo sapiens
tctgtaataatagactgta

SEQ ID NO: 4211385 - DNA, 11 bp, Homo sapiens
tctgtcatcca

SEQ ID NO: 4211386 - DNA, 14 bp, Homo sapiens
tctgtccctcactg

SEQ ID NO: 4211387 - DNA, 11 bp, Homo sapiens
tctgtctctgc

SEQ ID NO: 4211388 - DNA, 13 bp, Homo sapiens
tcttaaaatgttt

SEQ ID NO: 4211389 - DNA, 17 bp, Homo sapiens
tcttaaaatgtttcatt

SEQ ID NO: 4211390 - DNA, 18 bp, Homo sapiens
tcttaatgctttcctccc

SEQ ID NO: 4211391 - DNA, 18 bp, Homo sapiens
tcttccatttcttccacg

SEQ ID NO: 4211392 - DNA, 16 bp, Homo sapiens
tcttcccttctttgca

SEQ ID NO: 4211393 - DNA, 12 bp, Homo sapiens
tcttctgtcatc

SEQ ID NO: 4211394 - DNA, 14 bp, Homo sapiens
tcttgcctgcaccc

SEQ ID NO: 4211395 - DNA, 23 bp, Homo sapiens
tcttgcctttccacctgctttct

SEQ ID NO: 4211396 - DNA, 14 bp, Homo sapiens
tcttggagaacttt

SEQ ID NO: 4211397 - DNA, 15 bp, Homo sapiens
tctttaatataataa

SEQ ID NO: 4211398 - DNA, 20 bp, Homo sapiens
tctttaggtgcctcctgtct

SEQ ID NO: 4211399 - DNA, 17 bp, Homo sapiens
tctttccctagaggcaa

SEQ ID NO: 4211400 - DNA, 18 bp, Homo sapiens
tctttctaagagacctga

SEQ ID NO: 4211401 - DNA, 19 bp, Homo sapiens
tgaaaagtttagtgtttct

SEQ ID NO: 4211402 - DNA, 11 bp, Homo sapiens
tgaaaattcca

SEQ ID NO: 4211403 - DNA, 12 bp, Homo sapiens
tgaaaattccaa

SEQ ID NO: 4211404 - DNA, 16 bp, Homo sapiens
tgaaacttgcaacttt

SEQ ID NO: 4211405 - DNA, 17 bp, Homo sapiens
tgaaagccaaatttata

SEQ ID NO: 4211406 - DNA, 18 bp, Homo sapiens
tgaaatgaaaatcaattt

SEQ ID NO: 4211407 - DNA, 21 bp, Homo sapiens
tgaacaaagggattctccagg

SEQ ID NO: 4211408 - DNA, 17 bp, Homo sapiens
tgaacaccaacttttat

SEQ ID NO: 4211409 - DNA, 23 bp, Homo sapiens
tgaacagatatttttaacttaat

SEQ ID NO: 4211410 - DNA, 21 bp, Homo sapiens
tgaacattacattgccatttt

SEQ ID NO: 4211411 - DNA, 12 bp, Homo sapiens
tgaacctgccct

SEQ ID NO: 4211412 - DNA, 22 bp, Homo sapiens
tgaagaaaaaatggcaagagat

SEQ ID NO: 4211413 - DNA, 17 bp, Homo sapiens
tgaagaagagtttgcaa

SEQ ID NO: 4211414 - DNA, 18 bp, Homo sapiens
tgaagtcatcttagcttt

SEQ ID NO: 4211415 - DNA, 23 bp, Homo sapiens
tgaatatgtagtatctatatgac

SEQ ID NO: 4211416 - DNA, 14 bp, Homo sapiens
tgaattctggagga

SEQ ID NO: 4211417 - DNA, 17 bp, Homo sapiens
tgacaaaattggccaga

SEQ ID NO: 4211418 - DNA, 13 bp, Homo sapiens
tgacaaagttata

SEQ ID NO: 4211419 - DNA, 20 bp, Homo sapiens
tgactatgcgtggctggaac

SEQ ID NO: 4211420 - DNA, 14 bp, Homo sapiens
tgactcaaagtctg

SEQ ID NO: 4211421 - DNA, 14 bp, Homo sapiens
tgagactgacacct

SEQ ID NO: 4211422 - DNA, 15 bp, Homo sapiens
tgagaggtgctgcag

SEQ ID NO: 4211423 - DNA, 16 bp, Homo sapiens
tgagcacatctgggag

SEQ ID NO: 4211424 - DNA, 21 bp, Homo sapiens
tgagcacatctgggaggctgg

SEQ ID NO: 4211425 - DNA, 20 bp, Homo sapiens
tgagcctccatttctggctt

SEQ ID NO: 4211426 - DNA, 13 bp, Homo sapiens
tgagctaggcatg

SEQ ID NO: 4211427 - DNA, 16 bp, Homo sapiens
tgatacatataattct

SEQ ID NO: 4211428 - DNA, 15 bp, Homo sapiens
tgatcagaattttac

SEQ ID NO: 4211429 - DNA, 23 bp, Homo sapiens
tgatccacttcttaatgctttcc

SEQ ID NO: 4211430 - DNA, 17 bp, Homo sapiens
tgatcccttgagatatg

SEQ ID NO: 4211431 - DNA, 17 bp, Homo sapiens
tgatgtctttttattaa

SEQ ID NO: 4211432 - DNA, 12 bp, Homo sapiens
tgatttggaaaa

SEQ ID NO: 4211433 - DNA, 14 bp, Homo sapiens
tgatttgtcttccc

SEQ ID NO: 4211434 - DNA, 22 bp, Homo sapiens
tgatttgtcttcccttctttgc

SEQ ID NO: 4211435 - DNA, 18 bp, Homo sapiens
tgcaaagttattccccat

SEQ ID NO: 4211436 - DNA, 15 bp, Homo sapiens
tgcaaatgcaacaaa

SEQ ID NO: 4211437 - DNA, 23 bp, Homo sapiens
tgcaattgtaaacagaaattgca

SEQ ID NO: 4211438 - DNA, 21 bp, Homo sapiens
tgcacactgtcctattatatt

SEQ ID NO: 4211439 - DNA, 21 bp, Homo sapiens
tgcacatgtaacatagattta

SEQ ID NO: 4211440 - DNA, 15 bp, Homo sapiens
tgcacccttcctcct

SEQ ID NO: 4211441 - DNA, 14 bp, Homo sapiens
tgcacttttgaaat

SEQ ID NO: 4211442 - DNA, 22 bp, Homo sapiens
tgcacttttgaaataaagtatt

SEQ ID NO: 4211443 - DNA, 13 bp, Homo sapiens
tgcagcagaagcc

SEQ ID NO: 4211444 - DNA, 16 bp, Homo sapiens
tgcagcagaagccaaa

SEQ ID NO: 4211445 - DNA, 19 bp, Homo sapiens
tgcattttaaccctatttt

SEQ ID NO: 4211446 - DNA, 15 bp, Homo sapiens
tgcattttcttcact

SEQ ID NO: 4211447 - DNA, 17 bp, Homo sapiens
tgcccccagcactcctc

SEQ ID NO: 4211448 - DNA, 15 bp, Homo sapiens
tgccctgtcctccag

SEQ ID NO: 4211449 - DNA, 12 bp, Homo sapiens
tgccgctcttct

SEQ ID NO: 4211450 - DNA, 18 bp, Homo sapiens
tgccgctcttctgtcatc

SEQ ID NO: 4211451 - DNA, 19 bp, Homo sapiens
tgccgctcttctgtcatcc

SEQ ID NO: 4211452 - DNA, 21 bp, Homo sapiens
tgccgctcttctgtcatcccg

SEQ ID NO: 4211453 - DNA, 17 bp, Homo sapiens
tgcctacaatgggaaaa

SEQ ID NO: 4211454 - DNA, 21 bp, Homo sapiens
tgcctaggaggccttctcgca

SEQ ID NO: 4211455 - DNA, 18 bp, Homo sapiens
tgcctcatgctgacttgc

SEQ ID NO: 4211456 - DNA, 19 bp, Homo sapiens
tgcctgcacccttcctcct

SEQ ID NO: 4211457 - DNA, 18 bp, Homo sapiens
tgcctttccacctgcttt

SEQ ID NO: 4211458 - DNA, 23 bp, Homo sapiens
tgcctttcttatttgcaataaaa

SEQ ID NO: 4211459 - DNA, 16 bp, Homo sapiens
tgctaataatttgcca

SEQ ID NO: 4211460 - DNA, 12 bp, Homo sapiens
tgctaggaagtg

SEQ ID NO: 4211461 - DNA, 13 bp, Homo sapiens
tgctcttgcctgc

SEQ ID NO: 4211462 - DNA, 14 bp, Homo sapiens
tgctcttgcctgca

SEQ ID NO: 4211463 - DNA, 18 bp, Homo sapiens
tgctgaaacacctcccag

SEQ ID NO: 4211464 - DNA, 20 bp, Homo sapiens
tgctgaaacacctcccaggg

SEQ ID NO: 4211465 - DNA, 13 bp, Homo sapiens
tgctgctctctga

SEQ ID NO: 4211466 - DNA, 13 bp, Homo sapiens
tgcttgaaggaac

SEQ ID NO: 4211467 - DNA, 11 bp, Homo sapiens
aaaaatggcaa

SEQ ID NO: 4211468 - DNA, 18 bp, Homo sapiens
aaaaatggcaagagatca

SEQ ID NO: 4211469 - DNA, 23 bp, Homo sapiens
aaaactcaggcaaagaaaatgaa

SEQ ID NO: 4211470 - DNA, 20 bp, Homo sapiens
aaaacttcactccaaagaga

SEQ ID NO: 4211471 - DNA, 21 bp, Homo sapiens
aaaacttcactccaaagagaa

SEQ ID NO: 4211472 - DNA, 15 bp, Homo sapiens
aaaagcaatggttga

SEQ ID NO: 4211473 - DNA, 18 bp, Homo sapiens
aaaaggaacccaattttc

SEQ ID NO: 4211474 - DNA, 22 bp, Homo sapiens
aaaagttattacctttacatat

SEQ ID NO: 4211475 - DNA, 17 bp, Homo sapiens
aaaagttgcattttaac

SEQ ID NO: 4211476 - DNA, 18 bp, Homo sapiens
aaaatatatttataagga

SEQ ID NO: 4211477 - DNA, 12 bp, Homo sapiens
aaaatcaattta

SEQ ID NO: 4211478 - DNA, 14 bp, Homo sapiens
aaaatgaaatgcat

SEQ ID NO: 4211479 - DNA, 21 bp, Homo sapiens
aaaatgctgtattagtcacag

SEQ ID NO: 4211480 - DNA, 17 bp, Homo sapiens
aaaatggcaagagatca

SEQ ID NO: 4211481 - DNA, 17 bp, Homo sapiens
aaaatgtgtcagcatgc

SEQ ID NO: 4211482 - DNA, 14 bp, Homo sapiens
aaaattgctataaa

SEQ ID NO: 4211483 - DNA, 20 bp, Homo sapiens
aaaattgtgtttagatttta

SEQ ID NO: 4211484 - DNA, 19 bp, Homo sapiens
aaaattttcaaactttgta

SEQ ID NO: 4211485 - DNA, 14 bp, Homo sapiens
aaacacctcccagg

SEQ ID NO: 4211486 - DNA, 14 bp, Homo sapiens
aaacagaaattgca

SEQ ID NO: 4211487 - DNA, 21 bp, Homo sapiens
aaacctattaagtcatcatct

SEQ ID NO: 4211488 - DNA, 16 bp, Homo sapiens
aaacttgcaactttga

SEQ ID NO: 4211489 - DNA, 19 bp, Homo sapiens
aaacttttaatgccttcca

SEQ ID NO: 4211490 - DNA, 11 bp, Homo sapiens
aaagaaatgta

SEQ ID NO: 4211491 - DNA, 18 bp, Homo sapiens
aaagcaacagtagcaggg

SEQ ID NO: 4211492 - DNA, 21 bp, Homo sapiens
aaagcaacagtagcagggaat

SEQ ID NO: 4211493 - DNA, 15 bp, Homo sapiens
aaagcctgaaaattc

SEQ ID NO: 4211494 - DNA, 17 bp, Homo sapiens
aaagcctgaaaattcca

SEQ ID NO: 4211495 - DNA, 18 bp, Homo sapiens
aaagcctgaaaattccaa

SEQ ID NO: 4211496 - DNA, 20 bp, Homo sapiens
aaagcctgaaaattccaatt

SEQ ID NO: 4211497 - DNA, 16 bp, Homo sapiens
aaaggacccaagtact

SEQ ID NO: 4211498 - DNA, 22 bp, Homo sapiens
aaaggataaagaaggatgatgt

SEQ ID NO: 4211499 - DNA, 15 bp, Homo sapiens
aaagtatttatctcc

SEQ ID NO: 4211500 - DNA, 17 bp, Homo sapiens
aaagtcattaaagacag

SEQ ID NO: 4211501 - DNA, 23 bp, Homo sapiens
aaagtctgctctcatataagaca

SEQ ID NO: 4211502 - DNA, 17 bp, Homo sapiens
aaagttaaaattgttat

SEQ ID NO: 4211503 - DNA, 14 bp, Homo sapiens
aaataaaatatatc

SEQ ID NO: 4211504 - DNA, 22 bp, Homo sapiens
aaataaaattaaagctgaaaac

SEQ ID NO: 4211505 - DNA, 16 bp, Homo sapiens
aaatagtaaaaataaa

SEQ ID NO: 4211506 - DNA, 12 bp, Homo sapiens
aaatatcaaagt

SEQ ID NO: 4211507 - DNA, 21 bp, Homo sapiens
aaatatcaaagtcattaaaga

SEQ ID NO: 4211508 - DNA, 22 bp, Homo sapiens
aaatatcaaagtcattaaagac

SEQ ID NO: 4211509 - DNA, 19 bp, Homo sapiens
aaatattcctttgcatatt

SEQ ID NO: 4211510 - DNA, 19 bp, Homo sapiens
aaatcattcttactaaaaa

SEQ ID NO: 4211511 - DNA, 22 bp, Homo sapiens
aaatgaaagccaaatttatatg

SEQ ID NO: 4211512 - DNA, 12 bp, Homo sapiens
aaatgaaatgca

SEQ ID NO: 4211513 - DNA, 14 bp, Homo sapiens
aaatgaaatgcata

SEQ ID NO: 4211514 - DNA, 14 bp, Homo sapiens
aaatgacatttttg

SEQ ID NO: 4211515 - DNA, 14 bp, Homo sapiens
aaatgatccttcct

SEQ ID NO: 4211516 - DNA, 12 bp, Homo sapiens
aaatggaaattt

SEQ ID NO: 4211517 - DNA, 20 bp, Homo sapiens
aaatggaggatctctaaaga

SEQ ID NO: 4211518 - DNA, 17 bp, Homo sapiens
aaatgttggaattttca

SEQ ID NO: 4211519 - DNA, 14 bp, Homo sapiens
aaatgtttatatta

SEQ ID NO: 4211520 - DNA, 16 bp, Homo sapiens
aaatgtttcattttca

SEQ ID NO: 4211521 - DNA, 14 bp, Homo sapiens
aaattttaaagcct

SEQ ID NO: 4211522 - DNA, 14 bp, Homo sapiens
aaattttcaaactt

SEQ ID NO: 4211523 - DNA, 22 bp, Homo sapiens
aacagctccctagtggcttcct

SEQ ID NO: 4211524 - DNA, 23 bp, Homo sapiens
aacagctccctagtggcttcctc

SEQ ID NO: 4211525 - DNA, 16 bp, Homo sapiens
aacagttgaagaaaaa

SEQ ID NO: 4211526 - DNA, 17 bp, Homo sapiens
aacatggagaggacttt

SEQ ID NO: 4211527 - DNA, 14 bp, Homo sapiens
aaccacattgaaga

SEQ ID NO: 4211528 - DNA, 22 bp, Homo sapiens
aaccacattgaagaatgttaga

SEQ ID NO: 4211529 - DNA, 17 bp, Homo sapiens
aacccaaaggacccaag

SEQ ID NO: 4211530 - DNA, 23 bp, Homo sapiens
aacctggattttttatgtacaac

SEQ ID NO: 4211531 - DNA, 18 bp, Homo sapiens
aacggtcccccctcactc

SEQ ID NO: 4211532 - DNA, 12 bp, Homo sapiens
aacgtgaaaatg

SEQ ID NO: 4211533 - DNA, 21 bp, Homo sapiens
aactagaagaaagggcaagaa

SEQ ID NO: 4211534 - DNA, 23 bp, Homo sapiens
aactagactcccaagctggacta

SEQ ID NO: 4211535 - DNA, 17 bp, Homo sapiens
aactcacttcaatgaac

SEQ ID NO: 4211536 - DNA, 15 bp, Homo sapiens
aactcttctactttc

SEQ ID NO: 4211537 - DNA, 22 bp, Homo sapiens
aactggtttagcacaatttata

SEQ ID NO: 4211538 - DNA, 20 bp, Homo sapiens
aacttcactccaaagagaaa

SEQ ID NO: 4211539 - DNA, 23 bp, Homo sapiens
aacttccaaataaataattttca

SEQ ID NO: 4211540 - DNA, 17 bp, Homo sapiens
aactttccatctgcttg

SEQ ID NO: 4211541 - DNA, 15 bp, Homo sapiens
aagaaaaaatggcaa

SEQ ID NO: 4211542 - DNA, 15 bp, Homo sapiens
acctgctttctcctg

SEQ ID NO: 4211543 - DNA, 14 bp, Homo sapiens
acctgttcaggagc

SEQ ID NO: 4211544 - DNA, 16 bp, Homo sapiens
acctgttcaggagctg

SEQ ID NO: 4211545 - DNA, 16 bp, Homo sapiens
acgcctataatcccag

SEQ ID NO: 4211546 - DNA, 16 bp, Homo sapiens
acgcgacttccacaaa

SEQ ID NO: 4211547 - DNA, 15 bp, Homo sapiens
acgttaccaggcagg

SEQ ID NO: 4211548 - DNA, 14 bp, Homo sapiens
acgtttgtgagaag

SEQ ID NO: 4211549 - DNA, 14 bp, Homo sapiens
actaaaatgttcta

SEQ ID NO: 4211550 - DNA, 15 bp, Homo sapiens
actagattgtgatcc

SEQ ID NO: 4211551 - DNA, 13 bp, Homo sapiens
actatgttgataa

SEQ ID NO: 4211552 - DNA, 20 bp, Homo sapiens
actccagctgggttggaaaa

SEQ ID NO: 4211553 - DNA, 15 bp, Homo sapiens
actcctctgtctctg

SEQ ID NO: 4211554 - DNA, 23 bp, Homo sapiens
actcttaggctaagagatgtgac

SEQ ID NO: 4211555 - DNA, 16 bp, Homo sapiens
actcttctactttcat

SEQ ID NO: 4211556 - DNA, 19 bp, Homo sapiens
actcttgcctttccacctg

SEQ ID NO: 4211557 - DNA, 16 bp, Homo sapiens
actgacacctcactga

SEQ ID NO: 4211558 - DNA, 19 bp, Homo sapiens
actgacacctcactgagga

SEQ ID NO: 4211559 - DNA, 21 bp, Homo sapiens
actgacacctcactgaggaag

SEQ ID NO: 4211560 - DNA, 23 bp, Homo sapiens
actgagattgtctgttcagtttc

SEQ ID NO: 4211561 - DNA, 20 bp, Homo sapiens
actgcaacttgtaaatgtgg

SEQ ID NO: 4211562 - DNA, 12 bp, Homo sapiens
actgccttccag

SEQ ID NO: 4211563 - DNA, 17 bp, Homo sapiens
actgccttccaggagca

SEQ ID NO: 4211564 - DNA, 15 bp, Homo sapiens
actggataaattgta

SEQ ID NO: 4211565 - DNA, 22 bp, Homo sapiens
actggataaattgtatgaagat

SEQ ID NO: 4211566 - DNA, 20 bp, Homo sapiens
actggcacgtttgtgagaag

SEQ ID NO: 4211567 - DNA, 18 bp, Homo sapiens
actgtcctattatattca

SEQ ID NO: 4211568 - DNA, 14 bp, Homo sapiens
acttaatactcatg

SEQ ID NO: 4211569 - DNA, 18 bp, Homo sapiens
acttaatactcatgcatt

SEQ ID NO: 4211570 - DNA, 20 bp, Homo sapiens
acttatatatttgatacata

SEQ ID NO: 4211571 - DNA, 21 bp, Homo sapiens
acttattaagagcaaacttta

SEQ ID NO: 4211572 - DNA, 23 bp, Homo sapiens
acttattaagagcaaactttagt

SEQ ID NO: 4211573 - DNA, 17 bp, Homo sapiens
acttattgaatatatga

SEQ ID NO: 4211574 - DNA, 17 bp, Homo sapiens
acttattttccaataaa

SEQ ID NO: 4211575 - DNA, 18 bp, Homo sapiens
acttcactccaaagagaa

SEQ ID NO: 4211576 - DNA, 16 bp, Homo sapiens
acttcatataactgag

SEQ ID NO: 4211577 - DNA, 15 bp, Homo sapiens
acttcctctccagcc

SEQ ID NO: 4211578 - DNA, 14 bp, Homo sapiens
acttctcacttcct

SEQ ID NO: 4211579 - DNA, 22 bp, Homo sapiens
acttcttaatgctttcctccct

SEQ ID NO: 4211580 - DNA, 13 bp, Homo sapiens
acttgcaactttg

SEQ ID NO: 4211581 - DNA, 14 bp, Homo sapiens
acttgcagagttca

SEQ ID NO: 4211582 - DNA, 18 bp, Homo sapiens
acttgtaaatgtggtaaa

SEQ ID NO: 4211583 - DNA, 20 bp, Homo sapiens
acttgtaaatgtggtaaaga

SEQ ID NO: 4211584 - DNA, 16 bp, Homo sapiens
actttattattttgct

SEQ ID NO: 4211585 - DNA, 17 bp, Homo sapiens
actttccatctgcttgt

SEQ ID NO: 4211586 - DNA, 14 bp, Homo sapiens
actttgcttctctc

SEQ ID NO: 4211587 - DNA, 20 bp, Homo sapiens
acttttaatgccttccacat

SEQ ID NO: 4211588 - DNA, 12 bp, Homo sapiens
acttttggtttt

SEQ ID NO: 4211589 - DNA, 19 bp, Homo sapiens
agaaagtgacctatttttt

SEQ ID NO: 4211590 - DNA, 21 bp, Homo sapiens
agaaagtgacctattttttaa

SEQ ID NO: 4211591 - DNA, 13 bp, Homo sapiens
agaaataaaccaa

SEQ ID NO: 4211592 - DNA, 23 bp, Homo sapiens
agaacaaaacagtcctttaaatt

SEQ ID NO: 4211593 - DNA, 20 bp, Homo sapiens
agaacaaaggggcttaatta

SEQ ID NO: 4211594 - DNA, 17 bp, Homo sapiens
agaaccaggcaacttgg

SEQ ID NO: 4211595 - DNA, 20 bp, Homo sapiens
agaaccaggcaacttgggaa

SEQ ID NO: 4211596 - DNA, 19 bp, Homo sapiens
agaacgcgacttccacaaa

SEQ ID NO: 4211597 - DNA, 17 bp, Homo sapiens
agaactaaaatgttcta

SEQ ID NO: 4211598 - DNA, 21 bp, Homo sapiens
agaactattgtgctcagagac

SEQ ID NO: 4211599 - DNA, 23 bp, Homo sapiens
agaactattgtgctcagagacac

SEQ ID NO: 4211600 - DNA, 19 bp, Homo sapiens
agaactttccatctgcttg

SEQ ID NO: 4211601 - DNA, 16 bp, Homo sapiens
agaagccaaatttttt

SEQ ID NO: 4211602 - DNA, 15 bp, Homo sapiens
agaagttgccaagag

SEQ ID NO: 4211603 - DNA, 15 bp, Homo sapiens
agaatggcagctgga

SEQ ID NO: 4211604 - DNA, 21 bp, Homo sapiens
agaattgcttgaaccggggag

SEQ ID NO: 4211605 - DNA, 15 bp, Homo sapiens
agacaaaagagcagt

SEQ ID NO: 4211606 - DNA, 17 bp, Homo sapiens
agacaccgttcattcag

SEQ ID NO: 4211607 - DNA, 14 bp, Homo sapiens
agacactgttgata

SEQ ID NO: 4211608 - DNA, 19 bp, Homo sapiens
agacagcgaactagaagaa

SEQ ID NO: 4211609 - DNA, 14 bp, Homo sapiens
agaccacctccctg

SEQ ID NO: 4211610 - DNA, 18 bp, Homo sapiens
agaccagcccagccaaca

SEQ ID NO: 4211611 - DNA, 14 bp, Homo sapiens
agaccgaattttat

SEQ ID NO: 4211612 - DNA, 13 bp, Homo sapiens
agacctgaactgg

SEQ ID NO: 4211613 - DNA, 16 bp, Homo sapiens
agactaaaagttgcat

SEQ ID NO: 4211614 - DNA, 16 bp, Homo sapiens
agactcccaagctgga

SEQ ID NO: 4211615 - DNA, 17 bp, Homo sapiens
agactgacacctcactg

SEQ ID NO: 4211616 - DNA, 19 bp, Homo sapiens
agactttttttaaatagta

SEQ ID NO: 4211617 - DNA, 23 bp, Homo sapiens
agagaaacctattaagtcatcat

SEQ ID NO: 4211618 - DNA, 11 bp, Homo sapiens
agagacctgaa

SEQ ID NO: 4211619 - DNA, 17 bp, Homo sapiens
agagatcatatcctcag

SEQ ID NO: 4211620 - DNA, 22 bp, Homo sapiens
agagcactagttgtgaatttag

SEQ ID NO: 4211621 - DNA, 17 bp, Homo sapiens
agagcagtggtaagaat

SEQ ID NO: 4211622 - DNA, 19 bp, Homo sapiens
agagcagtggtaagaatag

SEQ ID NO: 4211623 - DNA, 18 bp, Homo sapiens
agagcataatttaaaaat

SEQ ID NO: 4211624 - DNA, 20 bp, Homo sapiens
agagcataatttaaaaatat

SEQ ID NO: 4211625 - DNA, 23 bp, Homo sapiens
agagcataatttaaaaatatatt

SEQ ID NO: 4211626 - DNA, 18 bp, Homo sapiens
agagccatacataaaaga

SEQ ID NO: 4211627 - DNA, 17 bp, Homo sapiens
agaggctgtggtggctg

SEQ ID NO: 4211628 - DNA, 23 bp, Homo sapiens
agaggctgtggtggctgtctctg

SEQ ID NO: 4211629 - DNA, 15 bp, Homo sapiens
agagtgcaaattgta

SEQ ID NO: 4211630 - DNA, 20 bp, Homo sapiens
agagttctttaggtgcctcc

SEQ ID NO: 4211631 - DNA, 22 bp, Homo sapiens
agagttctttaggtgcctcctg

SEQ ID NO: 4211632 - DNA, 23 bp, Homo sapiens
agagttctttaggtgcctcctgt

SEQ ID NO: 4211633 - DNA, 18 bp, Homo sapiens
agataattctagctttga

SEQ ID NO: 4211634 - DNA, 22 bp, Homo sapiens
agatatttttaacttaatggca

SEQ ID NO: 4211635 - DNA, 13 bp, Homo sapiens
agatgttttacaa

SEQ ID NO: 4211636 - DNA, 21 bp, Homo sapiens
agattctcattcacgggacta

SEQ ID NO: 4211637 - DNA, 20 bp, Homo sapiens
agattgtgatcccttgagat

SEQ ID NO: 4211638 - DNA, 22 bp, Homo sapiens
agcaagactccgtctcaaaaaa

SEQ ID NO: 4211639 - DNA, 14 bp, Homo sapiens
agcaatttgcacat

SEQ ID NO: 4211640 - DNA, 15 bp, Homo sapiens
agcaatttgcacatg

SEQ ID NO: 4211641 - DNA, 14 bp, Homo sapiens
agcactcctctgtc

SEQ ID NO: 4211642 - DNA, 17 bp, Homo sapiens
agcactcctctgtctct

SEQ ID NO: 4211643 - DNA, 18 bp, Homo sapiens
agcactcctctgtctctg

SEQ ID NO: 4211644 - DNA, 19 bp, Homo sapiens
agcactttgggaggctgaa

SEQ ID NO: 4211645 - DNA, 21 bp, Homo sapiens
agcactttgggaggctgaagt

SEQ ID NO: 4211646 - DNA, 16 bp, Homo sapiens
agcataatttaaaaat

SEQ ID NO: 4211647 - DNA, 18 bp, Homo sapiens
agcataatttaaaaatat

SEQ ID NO: 4211648 - DNA, 17 bp, Homo sapiens
agcatgaaataaaatat

SEQ ID NO: 4211649 - DNA, 20 bp, Homo sapiens
agccaccgtctacagatggc

SEQ ID NO: 4211650 - DNA, 17 bp, Homo sapiens
agccatacataaaagaa

SEQ ID NO: 4211651 - DNA, 18 bp, Homo sapiens
agccatacataaaagaaa

SEQ ID NO: 4211652 - DNA, 16 bp, Homo sapiens
agccatttaattttta

SEQ ID NO: 4211653 - DNA, 19 bp, Homo sapiens
agccatttaatttttaaat

SEQ ID NO: 4211654 - DNA, 22 bp, Homo sapiens
agcccaagggcggggctatgcc

SEQ ID NO: 4211655 - DNA, 17 bp, Homo sapiens
agcccatggagcaggga

SEQ ID NO: 4211656 - DNA, 20 bp, Homo sapiens
agcctattagatgttttaca

SEQ ID NO: 4211657 - DNA, 19 bp, Homo sapiens
agcctccatttctggcttc

SEQ ID NO: 4211658 - DNA, 12 bp, Homo sapiens
agccttctctct

SEQ ID NO: 4211659 - DNA, 14 bp, Homo sapiens
agcggctctcctga

SEQ ID NO: 4211660 - DNA, 12 bp, Homo sapiens
agctaggcatgg

SEQ ID NO: 4211661 - DNA, 20 bp, Homo sapiens
agctgctgttccaacagaca

SEQ ID NO: 4211662 - DNA, 15 bp, Homo sapiens
cccagatgtaaagaa

SEQ ID NO: 4211663 - DNA, 16 bp, Homo sapiens
cccagcactcctctgt

SEQ ID NO: 4211664 - DNA, 19 bp, Homo sapiens
cccagcactcctctgtctc

SEQ ID NO: 4211665 - DNA, 23 bp, Homo sapiens
cccagcactttgggaggctgaag

SEQ ID NO: 4211666 - DNA, 14 bp, Homo sapiens
cccagctacacctg

SEQ ID NO: 4211667 - DNA, 17 bp, Homo sapiens
cccaggggctccacctg

SEQ ID NO: 4211668 - DNA, 21 bp, Homo sapiens
cccatgatgccgctcttctgt

SEQ ID NO: 4211669 - DNA, 12 bp, Homo sapiens
cccatgctttcc

SEQ ID NO: 4211670 - DNA, 20 bp, Homo sapiens
ccccaattatcttatttaat

SEQ ID NO: 4211671 - DNA, 16 bp, Homo sapiens
ccccagcactcctctg

SEQ ID NO: 4211672 - DNA, 19 bp, Homo sapiens
ccccagcactcctctgtct

SEQ ID NO: 4211673 - DNA, 22 bp, Homo sapiens
ccccagcactcctctgtctctg

SEQ ID NO: 4211674 - DNA, 20 bp, Homo sapiens
cccgctttgcctgcttgaag

SEQ ID NO: 4211675 - DNA, 16 bp, Homo sapiens
cccggtgtggtggctc

SEQ ID NO: 4211676 - DNA, 22 bp, Homo sapiens
ccctagtggcttcctccgtctg

SEQ ID NO: 4211677 - DNA, 17 bp, Homo sapiens
ccctattggtaaagaat

SEQ ID NO: 4211678 - DNA, 21 bp, Homo sapiens
ccctcacaagtaacagttgaa

SEQ ID NO: 4211679 - DNA, 17 bp, Homo sapiens
ccctcgctgtcctgctg

SEQ ID NO: 4211680 - DNA, 23 bp, Homo sapiens
ccctgaggtcacctggaatcaga

SEQ ID NO: 4211681 - DNA, 19 bp, Homo sapiens
ccctggagcggctctcctg

SEQ ID NO: 4211682 - DNA, 21 bp, Homo sapiens
ccctggcatgaccatcctgtc

SEQ ID NO: 4211683 - DNA, 17 bp, Homo sapiens
cccttcctcctcctttg

SEQ ID NO: 4211684 - DNA, 21 bp, Homo sapiens
ccgagtttgggccactgcact

SEQ ID NO: 4211685 - DNA, 13 bp, Homo sapiens
ccgctcctgctga

SEQ ID NO: 4211686 - DNA, 15 bp, Homo sapiens
ccgtctacagatggc

SEQ ID NO: 4211687 - DNA, 18 bp, Homo sapiens
cctaagtgttgaagaaga

SEQ ID NO: 4211688 - DNA, 16 bp, Homo sapiens
cctacaatgggaaaac

SEQ ID NO: 4211689 - DNA, 17 bp, Homo sapiens
cctacaatgggaaaact

SEQ ID NO: 4211690 - DNA, 15 bp, Homo sapiens
cctagctaattattt

SEQ ID NO: 4211691 - DNA, 19 bp, Homo sapiens
cctaggacttgagcctcca

SEQ ID NO: 4211692 - DNA, 18 bp, Homo sapiens
cctaggaggccttctcgc

SEQ ID NO: 4211693 - DNA, 15 bp, Homo sapiens
cctagtggcttcctc

SEQ ID NO: 4211694 - DNA, 19 bp, Homo sapiens
cctagtggcttcctccgtc

SEQ ID NO: 4211695 - DNA, 17 bp, Homo sapiens
cctcactccacactggc

SEQ ID NO: 4211696 - DNA, 12 bp, Homo sapiens
cctcactgagga

SEQ ID NO: 4211697 - DNA, 15 bp, Homo sapiens
cctcactgccttcca

SEQ ID NO: 4211698 - DNA, 16 bp, Homo sapiens
cctcactgccttccag

SEQ ID NO: 4211699 - DNA, 21 bp, Homo sapiens
cctcagaccaggtggaattac

SEQ ID NO: 4211700 - DNA, 23 bp, Homo sapiens
cctcatttttgaatacaggcata

SEQ ID NO: 4211701 - DNA, 15 bp, Homo sapiens
cctccaattccacag

SEQ ID NO: 4211702 - DNA, 23 bp, Homo sapiens
cctccagctggaattgctgctct

SEQ ID NO: 4211703 - DNA, 24 bp, Homo sapiens
cctccatttctggcttctagtctg

SEQ ID NO: 4211704 - DNA, 13 bp, Homo sapiens
cctccctgccctg

SEQ ID NO: 4211705 - DNA, 14 bp, Homo sapiens
cctccctgccctgt

SEQ ID NO: 4211706 - DNA, 21 bp, Homo sapiens
cctccctgccctgtcctccag

SEQ ID NO: 4211707 - DNA, 15 bp, Homo sapiens
cctcctcctttgcct

SEQ ID NO: 4211708 - DNA, 14 bp, Homo sapiens
cctctccagccttc

SEQ ID NO: 4211709 - DNA, 11 bp, Homo sapiens
cctctcttgcc

SEQ ID NO: 4211710 - DNA, 13 bp, Homo sapiens
cctctgtctctgc

SEQ ID NO: 4211711 - DNA, 17 bp, Homo sapiens
cctctgtctctgctctt

SEQ ID NO: 4211712 - DNA, 23 bp, Homo sapiens
cctctgtctctgctcttgcctgc

SEQ ID NO: 4211713 - DNA, 11 bp, Homo sapiens
cctgaaaattc

SEQ ID NO: 4211714 - DNA, 23 bp, Homo sapiens
cctgaacccagaaacaacacaat

SEQ ID NO: 4211715 - DNA, 19 bp, Homo sapiens
cctgaagtaagcaaagact

SEQ ID NO: 4211716 - DNA, 14 bp, Homo sapiens
cctgaggtcacctg

SEQ ID NO: 4211717 - DNA, 12 bp, Homo sapiens
cctgctcttcca

SEQ ID NO: 4211718 - DNA, 16 bp, Homo sapiens
cctgctcttccatttc

SEQ ID NO: 4211719 - DNA, 22 bp, Homo sapiens
cctgctcttccatttcttccac

SEQ ID NO: 4211720 - DNA, 21 bp, Homo sapiens
cctgctgaaacacctcccagg

SEQ ID NO: 4211721 - DNA, 22 bp, Homo sapiens
cctgctgaaacacctcccaggg

SEQ ID NO: 4211722 - DNA, 20 bp, Homo sapiens
cctgctgtgtgaattcccag

SEQ ID NO: 4211723 - DNA, 15 bp, Homo sapiens
cctgctttctcctgg

SEQ ID NO: 4211724 - DNA, 19 bp, Homo sapiens
cctggagcggctctcctga

SEQ ID NO: 4211725 - DNA, 21 bp, Homo sapiens
cctggattttttatgtacaac

SEQ ID NO: 4211726 - DNA, 20 bp, Homo sapiens
cctggcatgaccatcctgtc

SEQ ID NO: 4211727 - DNA, 12 bp, Homo sapiens
cctgtttatata

SEQ ID NO: 4211728 - DNA, 23 bp, Homo sapiens
ccttcccatgatgccgctcttct

SEQ ID NO: 4211729 - DNA, 15 bp, Homo sapiens
ccttggttcttccta

SEQ ID NO: 4211730 - DNA, 23 bp, Homo sapiens
cctttatccctgaggtcacctgg

SEQ ID NO: 4211731 - DNA, 16 bp, Homo sapiens
cctttccacctgcttt

SEQ ID NO: 4211732 - DNA, 22 bp, Homo sapiens
cctttccacctgctttctcctg

SEQ ID NO: 4211733 - DNA, 21 bp, Homo sapiens
cctttcttatttgcaataaaa

SEQ ID NO: 4211734 - DNA, 20 bp, Homo sapiens
cctttgttattatcctgcat

SEQ ID NO: 4211735 - DNA, 12 bp, Homo sapiens
ccttttccatgc

SEQ ID NO: 4211736 - DNA, 19 bp, Homo sapiens
cctttttcataaattattt

SEQ ID NO: 4211737 - DNA, 23 bp, Homo sapiens
cgaattttattttacagagcttg

SEQ ID NO: 4211738 - DNA, 13 bp, Homo sapiens
cgacttcctctcc

SEQ ID NO: 4211739 - DNA, 22 bp, Homo sapiens
cgacttcctctccagccttctc

SEQ ID NO: 4211740 - DNA, 18 bp, Homo sapiens
cgcctgcccccagcactc

SEQ ID NO: 4211741 - DNA, 19 bp, Homo sapiens
cgcctgcccccagcactcc

SEQ ID NO: 4211742 - DNA, 15 bp, Homo sapiens
cgctgtcctgctgtg

SEQ ID NO: 4211743 - DNA, 16 bp, Homo sapiens
cgctgtcctgctgtgt

SEQ ID NO: 4211744 - DNA, 18 bp, Homo sapiens
cgtctttggaggaacagc

SEQ ID NO: 4211745 - DNA, 17 bp, Homo sapiens
ctaaaaagtataaaata

SEQ ID NO: 4211746 - DNA, 16 bp, Homo sapiens
ctaacttttttttact

SEQ ID NO: 4211747 - DNA, 23 bp, Homo sapiens
ctaaggccatggcatcccttttt

SEQ ID NO: 4211748 - DNA, 16 bp, Homo sapiens
ctaagtgttgaagaag

SEQ ID NO: 4211749 - DNA, 18 bp, Homo sapiens
ctaagtgttgaagaagag

SEQ ID NO: 4211750 - DNA, 20 bp, Homo sapiens
ctaagttatgactgtgaaat

SEQ ID NO: 4211751 - DNA, 23 bp, Homo sapiens
ctaagttatgactgtgaaatgat

SEQ ID NO: 4211752 - DNA, 16 bp, Homo sapiens
ctaatcctctttttct

SEQ ID NO: 4211753 - DNA, 13 bp, Homo sapiens
ctacacctgaggc

SEQ ID NO: 4211754 - DNA, 13 bp, Homo sapiens
ctacagccagaag

SEQ ID NO: 4211755 - DNA, 18 bp, Homo sapiens
ctaccttccagttcctca

SEQ ID NO: 4211756 - DNA, 17 bp, Homo sapiens
ctagtctggtgttctga

SEQ ID NO: 4211757 - DNA, 13 bp, Homo sapiens
ctagttgtgaatt

SEQ ID NO: 4211758 - DNA, 14 bp, Homo sapiens
ctataatcccagca

SEQ ID NO: 4211759 - DNA, 22 bp, Homo sapiens
ctatatcatcctttatccctga

SEQ ID NO: 4211760 - DNA, 15 bp, Homo sapiens
ctatattcctttttc

SEQ ID NO: 4211761 - DNA, 18 bp, Homo sapiens
ctatcatgtcaaacgtga

SEQ ID NO: 4211762 - DNA, 17 bp, Homo sapiens
ctatgaaataatgtgaa

SEQ ID NO: 4211763 - DNA, 15 bp, Homo sapiens
ctatgatttggaaaa

SEQ ID NO: 4211764 - DNA, 19 bp, Homo sapiens
ctatgccttgtctggggac

SEQ ID NO: 4211765 - DNA, 13 bp, Homo sapiens
ctatgttaatatt

SEQ ID NO: 4211766 - DNA, 21 bp, Homo sapiens
ctcaaaaaaagggcaataaat

SEQ ID NO: 4211767 - DNA, 21 bp, Homo sapiens
ctcaacattggagacatcact

SEQ ID NO: 4211768 - DNA, 17 bp, Homo sapiens
ctcacctgaaaatgtgg

SEQ ID NO: 4211769 - DNA, 21 bp, Homo sapiens
ctcacgcctataatcccagca

SEQ ID NO: 4211770 - DNA, 15 bp, Homo sapiens
ctcacttcaatgaac

SEQ ID NO: 4211771 - DNA, 18 bp, Homo sapiens
ctcagaccaggtggaatt

SEQ ID NO: 4211772 - DNA, 16 bp, Homo sapiens
ctcatgcattcttttg

SEQ ID NO: 4211773 - DNA, 13 bp, Homo sapiens
ctccacctgttca

SEQ ID NO: 4211774 - DNA, 23 bp, Homo sapiens
ctccacctgttcaggagctgaag

SEQ ID NO: 4211775 - DNA, 14 bp, Homo sapiens
ctccagccttctct

SEQ ID NO: 4211776 - DNA, 19 bp, Homo sapiens
ctccagccttctctctctg

SEQ ID NO: 4211777 - DNA, 20 bp, Homo sapiens
ctccagccttctctctctgg

SEQ ID NO: 4211778 - DNA, 21 bp, Homo sapiens
ctccagctggaattgctgctc

SEQ ID NO: 4211779 - DNA, 14 bp, Homo sapiens
ctccagcttcccct

SEQ ID NO: 4211780 - DNA, 19 bp, Homo sapiens
ctccagcttcccctcgctg

SEQ ID NO: 4211781 - DNA, 22 bp, Homo sapiens
gtgagactgacacctcactgag

SEQ ID NO: 4211782 - DNA, 18 bp, Homo sapiens
gtgatgatgaccaagaat

SEQ ID NO: 4211783 - DNA, 17 bp, Homo sapiens
gtgatttgtcttccctt

SEQ ID NO: 4211784 - DNA, 20 bp, Homo sapiens
gtgatttgtcttcccttctt

SEQ ID NO: 4211785 - DNA, 19 bp, Homo sapiens
gtgcaattgtaaacagaaa

SEQ ID NO: 4211786 - DNA, 14 bp, Homo sapiens
gtgcctcctgtctt

SEQ ID NO: 4211787 - DNA, 13 bp, Homo sapiens
gtgctatttttga

SEQ ID NO: 4211788 - DNA, 22 bp, Homo sapiens
gtggcacacgcctgtaatccca

SEQ ID NO: 4211789 - DNA, 24 bp, Homo sapiens
gtggctggaaccacattgaagaat

SEQ ID NO: 4211790 - DNA, 21 bp, Homo sapiens
gtggctgtctctgtccctcac

SEQ ID NO: 4211791 - DNA, 22 bp, Homo sapiens
gttagtgacaaaattggccaga

SEQ ID NO: 4211792 - DNA, 12 bp, Homo sapiens
gttcaggagctg

SEQ ID NO: 4211793 - DNA, 13 bp, Homo sapiens
gttcaggagctga

SEQ ID NO: 4211794 - DNA, 13 bp, Homo sapiens
gttctggagctgc

SEQ ID NO: 4211795 - DNA, 19 bp, Homo sapiens
gttctttaggtgcctcctg

SEQ ID NO: 4211796 - DNA, 13 bp, Homo sapiens
gttgaagaaaaaa

SEQ ID NO: 4211797 - DNA, 19 bp, Homo sapiens
gttgaagaaaaaatggcaa

SEQ ID NO: 4211798 - DNA, 20 bp, Homo sapiens
gttgaagaagagtttgcaaa

SEQ ID NO: 4211799 - DNA, 19 bp, Homo sapiens
gttgttaaaactggtttag

SEQ ID NO: 4211800 - DNA, 16 bp, Homo sapiens
gttgtttataataaaa

SEQ ID NO: 4211801 - DNA, 14 bp, Homo sapiens
gtttaagtctctga

SEQ ID NO: 4211802 - DNA, 12 bp, Homo sapiens
gtttaatggtag

SEQ ID NO: 4211803 - DNA, 20 bp, Homo sapiens
gtttaatggtagttttacag

SEQ ID NO: 4211804 - DNA, 17 bp, Homo sapiens
gtttagatgaatgtcag

SEQ ID NO: 4211805 - DNA, 14 bp, Homo sapiens
gtttataataaaaa

SEQ ID NO: 4211806 - DNA, 16 bp, Homo sapiens
gttttgaagattctat

SEQ ID NO: 4211807 - DNA, 23 bp, Homo sapiens
taaaagttattacctttacatat

SEQ ID NO: 4211808 - DNA, 17 bp, Homo sapiens
taaaagttgcattttaa

SEQ ID NO: 4211809 - DNA, 16 bp, Homo sapiens
taaaatagtatgaaaa

SEQ ID NO: 4211810 - DNA, 18 bp, Homo sapiens
taaaattaaagctgaaaa

SEQ ID NO: 4211811 - DNA, 15 bp, Homo sapiens
taaaattgttatcaa

SEQ ID NO: 4211812 - DNA, 16 bp, Homo sapiens
taaaattgttatcaaa

SEQ ID NO: 4211813 - DNA, 22 bp, Homo sapiens
taaactttttaccaagtacaaa

SEQ ID NO: 4211814 - DNA, 16 bp, Homo sapiens
taaagaaggatgatgt

SEQ ID NO: 4211815 - DNA, 15 bp, Homo sapiens
taaagacaggagaca

SEQ ID NO: 4211816 - DNA, 22 bp, Homo sapiens
taaagacttgtatagcatgaaa

SEQ ID NO: 4211817 - DNA, 14 bp, Homo sapiens
taaagcctgaaaat

SEQ ID NO: 4211818 - DNA, 15 bp, Homo sapiens
taaatacatgcatat

SEQ ID NO: 4211819 - DNA, 21 bp, Homo sapiens
taaatacatgcatataatgaa

SEQ ID NO: 4211820 - DNA, 19 bp, Homo sapiens
taaatagtaaaaataaaat

SEQ ID NO: 4211821 - DNA, 22 bp, Homo sapiens
taaatatatttttttcaactgc

SEQ ID NO: 4211822 - DNA, 22 bp, Homo sapiens
taaatatcccttggacatttta

SEQ ID NO: 4211823 - DNA, 14 bp, Homo sapiens
taaatcaatcttat

SEQ ID NO: 4211824 - DNA, 16 bp, Homo sapiens
taaatcaatcttatta

SEQ ID NO: 4211825 - DNA, 21 bp, Homo sapiens
taaattatgtttgtactagtt

SEQ ID NO: 4211826 - DNA, 22 bp, Homo sapiens
taaattatttgattatttaaga

SEQ ID NO: 4211827 - DNA, 21 bp, Homo sapiens
taaattgtatgaagatcttct

SEQ ID NO: 4211828 - DNA, 22 bp, Homo sapiens
taaattttaaagcctgaaaatt

SEQ ID NO: 4211829 - DNA, 21 bp, Homo sapiens
taacaactatgatttggaaaa

SEQ ID NO: 4211830 - DNA, 22 bp, Homo sapiens
taacaactatgatttggaaaat

SEQ ID NO: 4211831 - DNA, 19 bp, Homo sapiens
taacagagaatggtggtat

SEQ ID NO: 4211832 - DNA, 14 bp, Homo sapiens
taacagttgaagaa

SEQ ID NO: 4211833 - DNA, 19 bp, Homo sapiens
taacagttgaagaaaaaat

SEQ ID NO: 4211834 - DNA, 14 bp, Homo sapiens
taaccatattcaca

SEQ ID NO: 4211835 - DNA, 14 bp, Homo sapiens
taacttaatggcac

SEQ ID NO: 4211836 - DNA, 16 bp, Homo sapiens
taagaactaaaatgtt

SEQ ID NO: 4211837 - DNA, 15 bp, Homo sapiens
taaggagggacaaga

SEQ ID NO: 4211838 - DNA, 16 bp, Homo sapiens
taagtcatcatctcca

SEQ ID NO: 4211839 - DNA, 13 bp, Homo sapiens
taagttatctttg

SEQ ID NO: 4211840 - DNA, 12 bp, Homo sapiens
taagttcccttc

SEQ ID NO: 4211841 - DNA, 18 bp, Homo sapiens
taatcccagctacacctg

SEQ ID NO: 4211842 - DNA, 17 bp, Homo sapiens
taatctgacttctcact

SEQ ID NO: 4211843 - DNA, 13 bp, Homo sapiens
taatgaaatggag

SEQ ID NO: 4211844 - DNA, 13 bp, Homo sapiens
taatgccttccac

SEQ ID NO: 4211845 - DNA, 18 bp, Homo sapiens
taatggtagttttacagt

SEQ ID NO: 4211846 - DNA, 21 bp, Homo sapiens
taatgttgtctttttaatgtt

SEQ ID NO: 4211847 - DNA, 19 bp, Homo sapiens
taattagattttcttgcag

SEQ ID NO: 4211848 - DNA, 16 bp, Homo sapiens
taattattgatgtttt

SEQ ID NO: 4211849 - DNA, 18 bp, Homo sapiens
taattattgatgttttca

SEQ ID NO: 4211850 - DNA, 22 bp, Homo sapiens
taatttaaaaatatatttataa

SEQ ID NO: 4211851 - DNA, 22 bp, Homo sapiens
taatttgccattatctgtatta

SEQ ID NO: 4211852 - DNA, 14 bp, Homo sapiens
taattttgaactgt

SEQ ID NO: 4211853 - DNA, 20 bp, Homo sapiens
taatttttaaatgtttatat

SEQ ID NO: 4211854 - DNA, 18 bp, Homo sapiens
tacaaagttaaaattgtt

SEQ ID NO: 4211855 - DNA, 11 bp, Homo sapiens
tacaaccctga

SEQ ID NO: 4211856 - DNA, 15 bp, Homo sapiens
tacaacttcatataa

SEQ ID NO: 4211857 - DNA, 20 bp, Homo sapiens
tacaaggtatttacacatac

SEQ ID NO: 4211858 - DNA, 22 bp, Homo sapiens
tacaagtagaatggcagctgga

SEQ ID NO: 4211859 - DNA, 16 bp, Homo sapiens
tacacaggcagttttg

SEQ ID NO: 4211860 - DNA, 23 bp, Homo sapiens
tacacctgaggctgaggcaggag

SEQ ID NO: 4211861 - DNA, 13 bp, Homo sapiens
tacagccagaagc

SEQ ID NO: 4211862 - DNA, 17 bp, Homo sapiens
tacataaaagaaataaa

SEQ ID NO: 4211863 - DNA, 19 bp, Homo sapiens
tacatattatcatgtctat

SEQ ID NO: 4211864 - DNA, 14 bp, Homo sapiens
tacatgcatataat

SEQ ID NO: 4211865 - DNA, 13 bp, Homo sapiens
tacattgccattt

SEQ ID NO: 4211866 - DNA, 17 bp, Homo sapiens
tacctagctaattattt

SEQ ID NO: 4211867 - DNA, 24 bp, Homo sapiens
tacgctccatcgctgtcatctcag

SEQ ID NO: 4211868 - DNA, 15 bp, Homo sapiens
tactaattgagccat

SEQ ID NO: 4211869 - DNA, 14 bp, Homo sapiens
tactcaggataaca

SEQ ID NO: 4211870 - DNA, 20 bp, Homo sapiens
tactcaggataacagagaat

SEQ ID NO: 4211871 - DNA, 19 bp, Homo sapiens
tactggataaattgtatga

SEQ ID NO: 4211872 - DNA, 15 bp, Homo sapiens
tacttattttccaat

SEQ ID NO: 4211873 - DNA, 20 bp, Homo sapiens
tacttattttccaataaaat

SEQ ID NO: 4211874 - DNA, 18 bp, Homo sapiens
tagaaagagatacagagg

SEQ ID NO: 4211875 - DNA, 22 bp, Homo sapiens
tagaagaaagggcaagaaggaa

SEQ ID NO: 4211876 - DNA, 23 bp, Homo sapiens
tagaagaaagggcaagaaggaaa

SEQ ID NO: 4211877 - DNA, 23 bp, Homo sapiens
tagaatggcagctggaatttaag

SEQ ID NO: 4211878 - DNA, 12 bp, Homo sapiens
tagagtaatgaa

SEQ ID NO: 4211879 - DNA, 15 bp, Homo sapiens
tagagtaatgaaatg

SEQ ID NO: 4211880 - DNA, 17 bp, Homo sapiens
tagagtaatgaaatgga

SEQ ID NO: 4211881 - DNA, 15 bp, Homo sapiens
tagatgttttacaaa

SEQ ID NO: 4211882 - DNA, 17 bp, Homo sapiens
tagattgtaatacacat

SEQ ID NO: 4211883 - DNA, 18 bp, Homo sapiens
tagattgtaatacacata

SEQ ID NO: 4211884 - DNA, 19 bp, Homo sapiens
tagattgtaatacacatat

SEQ ID NO: 4211885 - DNA, 16 bp, Homo sapiens
tagcacaatttatatt

SEQ ID NO: 4211886 - DNA, 15 bp, Homo sapiens
tagctttccacagga

SEQ ID NO: 4211887 - DNA, 23 bp, Homo sapiens
taggaatgcttttattcaagaca

SEQ ID NO: 4211888 - DNA, 17 bp, Homo sapiens
taggacttgagcctcca

SEQ ID NO: 4211889 - DNA, 13 bp, Homo sapiens
taggtgcctcctg

SEQ ID NO: 4211890 - DNA, 16 bp, Homo sapiens
taggtgcctcctgtct

SEQ ID NO: 4211891 - DNA, 18 bp, Homo sapiens
taggtgcctcctgtctta

SEQ ID NO: 4211892 - DNA, 16 bp, Homo sapiens
tagtaaaaataaaatt

SEQ ID NO: 4211893 - DNA, 12 bp, Homo sapiens
tagtctgtcatc

SEQ ID NO: 4211894 - DNA, 14 bp, Homo sapiens
tagtctgtcatcca

SEQ ID NO: 4211895 - DNA, 18 bp, Homo sapiens
tagtctgtcatccagaaa

SEQ ID NO: 4211896 - DNA, 15 bp, Homo sapiens
tagtggcttcctccg

SEQ ID NO: 4211897 - DNA, 16 bp, Homo sapiens
tataatgaataaatca

SEQ ID NO: 4211898 - DNA, 18 bp, Homo sapiens
tatataggctattttcta

SEQ ID NO: 4211899 - DNA, 21 bp, Homo sapiens
tatattagataaccatattca

SEQ ID NO: 4211900 - DNA, 18 bp, Homo sapiens
tatatttgatacatataa

SEQ ID NO: 4211901 - DNA, 13 bp, Homo sapiens
ttcttatttgcaa

SEQ ID NO: 4211902 - DNA, 15 bp, Homo sapiens
ttcttatttgcaata

SEQ ID NO: 4211903 - DNA, 17 bp, Homo sapiens
ttcttatttgcaataaa

SEQ ID NO: 4211904 - DNA, 18 bp, Homo sapiens
ttcttcacacagacacta

SEQ ID NO: 4211905 - DNA, 18 bp, Homo sapiens
ttctttaggtgcctcctg

SEQ ID NO: 4211906 - DNA, 22 bp, Homo sapiens
ttcttttggctttgaaacttgc

SEQ ID NO: 4211907 - DNA, 18 bp, Homo sapiens
ttgaactgtttaacactt

SEQ ID NO: 4211908 - DNA, 15 bp, Homo sapiens
ttgaaggtagaatgt

SEQ ID NO: 4211909 - DNA, 19 bp, Homo sapiens
ttgaaggtagaatgttttc

SEQ ID NO: 4211910 - DNA, 23 bp, Homo sapiens
ttgaattctggaggaagaagaca

SEQ ID NO: 4211911 - DNA, 18 bp, Homo sapiens
ttgagtttaagtctctga

SEQ ID NO: 4211912 - DNA, 19 bp, Homo sapiens
ttgatacatataattcttt

SEQ ID NO: 4211913 - DNA, 16 bp, Homo sapiens
ttgatagtatttataa

SEQ ID NO: 4211914 - DNA, 22 bp, Homo sapiens
ttgatccacttcttaatgcttt

SEQ ID NO: 4211915 - DNA, 23 bp, Homo sapiens
ttgatggtgatgaaatgtaaata

SEQ ID NO: 4211916 - DNA, 16 bp, Homo sapiens
ttgcaattattctaat

SEQ ID NO: 4211917 - DNA, 14 bp, Homo sapiens
ttgctgctctctga

SEQ ID NO: 4211918 - DNA, 17 bp, Homo sapiens
ttgctgtacaaaagcaa

SEQ ID NO: 4211919 - DNA, 16 bp, Homo sapiens
ttggaataataatttt

SEQ ID NO: 4211920 - DNA, 19 bp, Homo sapiens
ttggaataataattttcct

SEQ ID NO: 4211921 - DNA, 18 bp, Homo sapiens
ttggacattttatgtctt

SEQ ID NO: 4211922 - DNA, 24 bp, Homo sapiens
ttggcctggtggccatgtcgcctg

SEQ ID NO: 4211923 - DNA, 12 bp, Homo sapiens
ttgggaggctga

SEQ ID NO: 4211924 - DNA, 13 bp, Homo sapiens
ttgggggtgggag

SEQ ID NO: 4211925 - DNA, 23 bp, Homo sapiens
ttgggtagaaagagatacagagg

SEQ ID NO: 4211926 - DNA, 14 bp, Homo sapiens
ttggttctgtgaac

SEQ ID NO: 4211927 - DNA, 21 bp, Homo sapiens
ttgtaactgtttagatgaatg

SEQ ID NO: 4211928 - DNA, 22 bp, Homo sapiens
ttgtaactgtttagatgaatgt

SEQ ID NO: 4211929 - DNA, 18 bp, Homo sapiens
ttgtaatacacatatcta

SEQ ID NO: 4211930 - DNA, 13 bp, Homo sapiens
ttgtattttccat

SEQ ID NO: 4211931 - DNA, 16 bp, Homo sapiens
ttgtattttccataca

SEQ ID NO: 4211932 - DNA, 11 bp, Homo sapiens
ttgtcttccct

SEQ ID NO: 4211933 - DNA, 14 bp, Homo sapiens
ttgtctttaatata

SEQ ID NO: 4211934 - DNA, 11 bp, Homo sapiens
ttgtgcagaga

SEQ ID NO: 4211935 - DNA, 13 bp, Homo sapiens
ttgtgtttagatt

SEQ ID NO: 4211936 - DNA, 14 bp, Homo sapiens
ttgttatcaaaata

SEQ ID NO: 4211937 - DNA, 16 bp, Homo sapiens
ttgttatcaaaatagt

SEQ ID NO: 4211938 - DNA, 20 bp, Homo sapiens
ttgttatttattgaaatgat

SEQ ID NO: 4211939 - DNA, 16 bp, Homo sapiens
ttgtttataataaaaa

SEQ ID NO: 4211940 - DNA, 20 bp, Homo sapiens
tttaaagcctgaaaattcca

SEQ ID NO: 4211941 - DNA, 21 bp, Homo sapiens
tttaaagcctgaaaattccaa

SEQ ID NO: 4211942 - DNA, 22 bp, Homo sapiens
tttaaagcctgaaaattccaat

SEQ ID NO: 4211943 - DNA, 17 bp, Homo sapiens
tttaaatgtttatatta

SEQ ID NO: 4211944 - DNA, 21 bp, Homo sapiens
tttaacctgtttatataattt

SEQ ID NO: 4211945 - DNA, 16 bp, Homo sapiens
tttaacttaatggcac

SEQ ID NO: 4211946 - DNA, 17 bp, Homo sapiens
tttaagaactaaaatgt

SEQ ID NO: 4211947 - DNA, 13 bp, Homo sapiens
tttaagtctctga

SEQ ID NO: 4211948 - DNA, 12 bp, Homo sapiens
tttaatgccttc

SEQ ID NO: 4211949 - DNA, 20 bp, Homo sapiens
tttaattgtccagtttgtct

SEQ ID NO: 4211950 - DNA, 14 bp, Homo sapiens
tttaattttcactt

SEQ ID NO: 4211951 - DNA, 14 bp, Homo sapiens
tttaatttttaaat

SEQ ID NO: 4211952 - DNA, 19 bp, Homo sapiens
tttacaaatttaattttgc

SEQ ID NO: 4211953 - DNA, 20 bp, Homo sapiens
tttacaagggcataaagtaa

SEQ ID NO: 4211954 - DNA, 20 bp, Homo sapiens
tttacatgataaaaagaaat

SEQ ID NO: 4211955 - DNA, 18 bp, Homo sapiens
tttataatataaatcaat

SEQ ID NO: 4211956 - DNA, 23 bp, Homo sapiens
tttataatataaatcaatcttat

SEQ ID NO: 4211957 - DNA, 14 bp, Homo sapiens
tttatatgccaccg

SEQ ID NO: 4211958 - DNA, 15 bp, Homo sapiens
tttatatttctcgta

SEQ ID NO: 4211959 - DNA, 21 bp, Homo sapiens
tttatgaaaaactcttctact

SEQ ID NO: 4211960 - DNA, 16 bp, Homo sapiens
tttatgtacaaccctg

SEQ ID NO: 4211961 - DNA, 14 bp, Homo sapiens
tttattaaaatatt

SEQ ID NO: 4211962 - DNA, 21 bp, Homo sapiens
tttattaaaatatttcaggtt

SEQ ID NO: 4211963 - DNA, 19 bp, Homo sapiens
tttcataaattatttgatt

SEQ ID NO: 4211964 - DNA, 21 bp, Homo sapiens
tttccacctgctttctcctgg

SEQ ID NO: 4211965 - DNA, 23 bp, Homo sapiens
tttccatgcaccctcatacacag

SEQ ID NO: 4211966 - DNA, 13 bp, Homo sapiens
tttccctctcttg

SEQ ID NO: 4211967 - DNA, 12 bp, Homo sapiens
tttcctccctgg

SEQ ID NO: 4211968 - DNA, 16 bp, Homo sapiens
tttcctcctaaacaaa

SEQ ID NO: 4211969 - DNA, 22 bp, Homo sapiens
tttcctcttagtcgagccaagt

SEQ ID NO: 4211970 - DNA, 19 bp, Homo sapiens
tttctctagctgatcagaa

SEQ ID NO: 4211971 - DNA, 22 bp, Homo sapiens
tttctctgcatttaaaaaaatc

SEQ ID NO: 4211972 - DNA, 12 bp, Homo sapiens
tttctttatcta

SEQ ID NO: 4211973 - DNA, 21 bp, Homo sapiens
tttgaaggtagaatgttttca

SEQ ID NO: 4211974 - DNA, 21 bp, Homo sapiens
tttgatagtatttataatata

SEQ ID NO: 4211975 - DNA, 15 bp, Homo sapiens
tttgcaattattcta

SEQ ID NO: 4211976 - DNA, 23 bp, Homo sapiens
tttgcacatgtaacatagattta

SEQ ID NO: 4211977 - DNA, 21 bp, Homo sapiens
tttgcacttttgaaataaagt

SEQ ID NO: 4211978 - DNA, 15 bp, Homo sapiens
tttgtcttcccttct

SEQ ID NO: 4211979 - DNA, 20 bp, Homo sapiens
tttgtcttcccttctttgca

SEQ ID NO: 4211980 - DNA, 19 bp, Homo sapiens
ttttaaaaattgttattta

SEQ ID NO: 4211981 - DNA, 14 bp, Homo sapiens
ttttaattcattct

SEQ ID NO: 4211982 - DNA, 19 bp, Homo sapiens
ttttatgtacaaccctgac

SEQ ID NO: 4211983 - DNA, 22 bp, Homo sapiens
ttttattaaaatatttcaggtt

SEQ ID NO: 4211984 - DNA, 12 bp, Homo sapiens
ttttcaaacttt

SEQ ID NO: 4211985 - DNA, 13 bp, Homo sapiens
ttttccaataaaa

SEQ ID NO: 4211986 - DNA, 17 bp, Homo sapiens
ttttccctctcttgcct

SEQ ID NO: 4211987 - DNA, 21 bp, Homo sapiens
ttttctatgaaataatgtgaa

SEQ ID NO: 4211988 - DNA, 13 bp, Homo sapiens
ttttcttgcagtt

SEQ ID NO: 4211989 - DNA, 13 bp, Homo sapiens
tttttatgtacaa

SEQ ID NO: 4211990 - DNA, 17 bp, Homo sapiens
ttttttatgtacaaccc

SEQ ID NO: 4211991 - DNA, 21 bp, Homo sapiens
agctggaattgctgctctctg

SEQ ID NO: 4211992 - DNA, 15 bp, Homo sapiens
agcttcccctcgctg

SEQ ID NO: 4211993 - DNA, 20 bp, Homo sapiens
agcttcccctcgctgtcctg

SEQ ID NO: 4211994 - DNA, 22 bp, Homo sapiens
agcttcccctcgctgtcctgct

SEQ ID NO: 4211995 - DNA, 20 bp, Homo sapiens
agctttcatttgacacacag

SEQ ID NO: 4211996 - DNA, 14 bp, Homo sapiens
aggaaaatgtctgt

SEQ ID NO: 4211997 - DNA, 22 bp, Homo sapiens
aggagaagtcttctatttattt

SEQ ID NO: 4211998 - DNA, 16 bp, Homo sapiens
aggagacaaaagagca

SEQ ID NO: 4211999 - DNA, 15 bp, Homo sapiens
aggagggacaagaat

SEQ ID NO: 4212000 - DNA, 17 bp, Homo sapiens
aggagttttttttaacc

SEQ ID NO: 4212001 - DNA, 19 bp, Homo sapiens
aggatattcagatgtatgt

SEQ ID NO: 4212002 - DNA, 14 bp, Homo sapiens
aggatctctaaaga

SEQ ID NO: 4212003 - DNA, 15 bp, Homo sapiens
aggattccaaagttt

SEQ ID NO: 4212004 - DNA, 19 bp, Homo sapiens
aggattccaaagttttgaa

SEQ ID NO: 4212005 - DNA, 13 bp, Homo sapiens
aggattctgtaat

SEQ ID NO: 4212006 - DNA, 13 bp, Homo sapiens
aggcatggagaca

SEQ ID NO: 4212007 - DNA, 15 bp, Homo sapiens
aggcatggagacagc

SEQ ID NO: 4212008 - DNA, 18 bp, Homo sapiens
aggcatggagacagcgaa

SEQ ID NO: 4212009 - DNA, 22 bp, Homo sapiens
aggccatggcatccctttttca

SEQ ID NO: 4212010 - DNA, 23 bp, Homo sapiens
aggcgacttcctctccagccttc

SEQ ID NO: 4212011 - DNA, 17 bp, Homo sapiens
aggctaagagatgtgac

SEQ ID NO: 4212012 - DNA, 19 bp, Homo sapiens
aggctattttctaaagact

SEQ ID NO: 4212013 - DNA, 15 bp, Homo sapiens
agggcaagaaggaaa

SEQ ID NO: 4212014 - DNA, 14 bp, Homo sapiens
agggcataaagtaa

SEQ ID NO: 4212015 - DNA, 23 bp, Homo sapiens
agggcggggctatgccttgtctg

SEQ ID NO: 4212016 - DNA, 14 bp, Homo sapiens
aggtctagtttctt

SEQ ID NO: 4212017 - DNA, 17 bp, Homo sapiens
aggtgcctcctgtctta

SEQ ID NO: 4212018 - DNA, 17 bp, Homo sapiens
aggtggaattacttaaa

SEQ ID NO: 4212019 - DNA, 14 bp, Homo sapiens
aggttatgcctcat

SEQ ID NO: 4212020 - DNA, 15 bp, Homo sapiens
aggttcttcagaagt

SEQ ID NO: 4212021 - DNA, 20 bp, Homo sapiens
agtaagttatctttgaatat

SEQ ID NO: 4212022 - DNA, 20 bp, Homo sapiens
agtagatgtggcctttgaat

SEQ ID NO: 4212023 - DNA, 21 bp, Homo sapiens
agtagatgtggcctttgaatt

SEQ ID NO: 4212024 - DNA, 18 bp, Homo sapiens
agtatgtatattaaaaaa

SEQ ID NO: 4212025 - DNA, 22 bp, Homo sapiens
agtatgtatattaaaaaagaga

SEQ ID NO: 4212026 - DNA, 20 bp, Homo sapiens
agtatttatctcctgtctac

SEQ ID NO: 4212027 - DNA, 22 bp, Homo sapiens
agtcacagagataattctagct

SEQ ID NO: 4212028 - DNA, 18 bp, Homo sapiens
agtcactctaggactctg

SEQ ID NO: 4212029 - DNA, 13 bp, Homo sapiens
agtcatccacagc

SEQ ID NO: 4212030 - DNA, 14 bp, Homo sapiens
agtcattaaagaca

SEQ ID NO: 4212031 - DNA, 23 bp, Homo sapiens
agtcattaaagacaggagacaaa

SEQ ID NO: 4212032 - DNA, 20 bp, Homo sapiens
agtctaacttttttttactt

SEQ ID NO: 4212033 - DNA, 12 bp, Homo sapiens
agtctgtcatcc

SEQ ID NO: 4212034 - DNA, 13 bp, Homo sapiens
agtgacaaagtta

SEQ ID NO: 4212035 - DNA, 22 bp, Homo sapiens
agtgcctacaatgggaaaactt

SEQ ID NO: 4212036 - DNA, 22 bp, Homo sapiens
agtgggggtgatgatgaccaag

SEQ ID NO: 4212037 - DNA, 21 bp, Homo sapiens
agtgttgaagaagagtttgca

SEQ ID NO: 4212038 - DNA, 23 bp, Homo sapiens
agtgttgaagaagagtttgcaaa

SEQ ID NO: 4212039 - DNA, 18 bp, Homo sapiens
agtgtttatgttgtttat

SEQ ID NO: 4212040 - DNA, 19 bp, Homo sapiens
agttattccccatcttcca

SEQ ID NO: 4212041 - DNA, 19 bp, Homo sapiens
agttctttaggtgcctcct

SEQ ID NO: 4212042 - DNA, 20 bp, Homo sapiens
agttctttaggtgcctcctg

SEQ ID NO: 4212043 - DNA, 21 bp, Homo sapiens
agttctttaggtgcctcctgt

SEQ ID NO: 4212044 - DNA, 20 bp, Homo sapiens
agttgaagaaaaaatggcaa

SEQ ID NO: 4212045 - DNA, 13 bp, Homo sapiens
agttggcttctaa

SEQ ID NO: 4212046 - DNA, 14 bp, Homo sapiens
agttttgaaatgaa

SEQ ID NO: 4212047 - DNA, 21 bp, Homo sapiens
ataaaaactcaggcaaagaaa

SEQ ID NO: 4212048 - DNA, 12 bp, Homo sapiens
ataaaaatatat

SEQ ID NO: 4212049 - DNA, 16 bp, Homo sapiens
ataaaattaaagctga

SEQ ID NO: 4212050 - DNA, 13 bp, Homo sapiens
ataaaattttcaa

SEQ ID NO: 4212051 - DNA, 14 bp, Homo sapiens
ataaaggataaaga

SEQ ID NO: 4212052 - DNA, 21 bp, Homo sapiens
ataaatgccctctctgaatgt

SEQ ID NO: 4212053 - DNA, 12 bp, Homo sapiens
ataaggaaattt

SEQ ID NO: 4212054 - DNA, 14 bp, Homo sapiens
ataataattttcct

SEQ ID NO: 4212055 - DNA, 12 bp, Homo sapiens
ataatgtgaatg

SEQ ID NO: 4212056 - DNA, 19 bp, Homo sapiens
ataatttaaaaatatattt

SEQ ID NO: 4212057 - DNA, 21 bp, Homo sapiens
ataattttcctcctaaacaaa

SEQ ID NO: 4212058 - DNA, 15 bp, Homo sapiens
ataattttgcagcag

SEQ ID NO: 4212059 - DNA, 23 bp, Homo sapiens
atacaaaaatgagctaggcatgg

SEQ ID NO: 4212060 - DNA, 23 bp, Homo sapiens
atacaacttcatataactgagat

SEQ ID NO: 4212061 - DNA, 23 bp, Homo sapiens
atacatatgcagatacttattaa

SEQ ID NO: 4212062 - DNA, 20 bp, Homo sapiens
atacatgcatataatgaata

SEQ ID NO: 4212063 - DNA, 19 bp, Homo sapiens
atagactgtaacttccaaa

SEQ ID NO: 4212064 - DNA, 13 bp, Homo sapiens
atagcatgaaata

SEQ ID NO: 4212065 - DNA, 20 bp, Homo sapiens
ataggctattttctaaagac

SEQ ID NO: 4212066 - DNA, 16 bp, Homo sapiens
ataggttagattctca

SEQ ID NO: 4212067 - DNA, 18 bp, Homo sapiens
ataggttagattctcatt

SEQ ID NO: 4212068 - DNA, 13 bp, Homo sapiens
atagtaaaaataa

SEQ ID NO: 4212069 - DNA, 14 bp, Homo sapiens
atagtaaaaataaa

SEQ ID NO: 4212070 - DNA, 22 bp, Homo sapiens
atagtgctaagaaagcaagcca

SEQ ID NO: 4212071 - DNA, 13 bp, Homo sapiens
atataagacaaat

SEQ ID NO: 4212072 - DNA, 13 bp, Homo sapiens
atatcaaagtcat

SEQ ID NO: 4212073 - DNA, 21 bp, Homo sapiens
atatcaaagtcattaaagaca

SEQ ID NO: 4212074 - DNA, 22 bp, Homo sapiens
atatcccttggacattttatgt

SEQ ID NO: 4212075 - DNA, 18 bp, Homo sapiens
atatgcagatacttatta

SEQ ID NO: 4212076 - DNA, 17 bp, Homo sapiens
atatgccaccgattgca

SEQ ID NO: 4212077 - DNA, 12 bp, Homo sapiens
atattactggat

SEQ ID NO: 4212078 - DNA, 23 bp, Homo sapiens
atattagataaccatattcacaa

SEQ ID NO: 4212079 - DNA, 22 bp, Homo sapiens
atattcacaatggaaactttag

SEQ ID NO: 4212080 - DNA, 23 bp, Homo sapiens
atattcctttgcatattataaag

SEQ ID NO: 4212081 - DNA, 23 bp, Homo sapiens
atattcctttttctatgaaataa

SEQ ID NO: 4212082 - DNA, 20 bp, Homo sapiens
atatttcaggttcttcagaa

SEQ ID NO: 4212083 - DNA, 22 bp, Homo sapiens
atcaaagtcattaaagacagga

SEQ ID NO: 4212084 - DNA, 16 bp, Homo sapiens
atcaagggaagaacta

SEQ ID NO: 4212085 - DNA, 23 bp, Homo sapiens
atcaagttggcttctaatcaaag

SEQ ID NO: 4212086 - DNA, 23 bp, Homo sapiens
atcaggagaaagcttggttctgt

SEQ ID NO: 4212087 - DNA, 15 bp, Homo sapiens
atccacttcttaatg

SEQ ID NO: 4212088 - DNA, 21 bp, Homo sapiens
atccacttcttaatgctttcc

SEQ ID NO: 4212089 - DNA, 14 bp, Homo sapiens
atcccgctcctgct

SEQ ID NO: 4212090 - DNA, 18 bp, Homo sapiens
atccctgaggtcacctgg

SEQ ID NO: 4212091 - DNA, 21 bp, Homo sapiens
atcccttggacattttatgtc

SEQ ID NO: 4212092 - DNA, 22 bp, Homo sapiens
atccctttttcataaattattt

SEQ ID NO: 4212093 - DNA, 13 bp, Homo sapiens
atcctaatgaatg

SEQ ID NO: 4212094 - DNA, 13 bp, Homo sapiens
atcctgaagagca

SEQ ID NO: 4212095 - DNA, 13 bp, Homo sapiens
atcctgctaagtt

SEQ ID NO: 4212096 - DNA, 22 bp, Homo sapiens
atcctgctcttccatttcttcc

SEQ ID NO: 4212097 - DNA, 18 bp, Homo sapiens
atccttcctactttgctt

SEQ ID NO: 4212098 - DNA, 21 bp, Homo sapiens
atctactaattgagccattta

SEQ ID NO: 4212099 - DNA, 17 bp, Homo sapiens
atctccaaactaaaccc

SEQ ID NO: 4212100 - DNA, 18 bp, Homo sapiens
atctgatgcaagcaagaa

SEQ ID NO: 4212101 - DNA, 13 bp, Homo sapiens
atctgggaggctg

SEQ ID NO: 4212102 - DNA, 24 bp, Homo sapiens
atctgggaggctggtctccctcca

SEQ ID NO: 4212103 - DNA, 13 bp, Homo sapiens
atgaaaagtttag

SEQ ID NO: 4212104 - DNA, 12 bp, Homo sapiens
atgaaaatggaa

SEQ ID NO: 4212105 - DNA, 12 bp, Homo sapiens
atgaccaagaat

SEQ ID NO: 4212106 - DNA, 15 bp, Homo sapiens
atgaccatcctgtcc

SEQ ID NO: 4212107 - DNA, 22 bp, Homo sapiens
atgactatgcgtggctggaacc

SEQ ID NO: 4212108 - DNA, 19 bp, Homo sapiens
atgatgtctttttattaaa

SEQ ID NO: 4212109 - DNA, 12 bp, Homo sapiens
atgcatatttgc

SEQ ID NO: 4212110 - DNA, 20 bp, Homo sapiens
ctccagcttcccctcgctgt

SEQ ID NO: 4212111 - DNA, 22 bp, Homo sapiens
ctccagtcattatgttaatatt

SEQ ID NO: 4212112 - DNA, 11 bp, Homo sapiens
ctccatttctg

SEQ ID NO: 4212113 - DNA, 17 bp, Homo sapiens
ctccctagtggcttcct

SEQ ID NO: 4212114 - DNA, 18 bp, Homo sapiens
ctccctagtggcttcctc

SEQ ID NO: 4212115 - DNA, 14 bp, Homo sapiens
ctcctctgtctctg

SEQ ID NO: 4212116 - DNA, 19 bp, Homo sapiens
ctcctctgtctctgctctt

SEQ ID NO: 4212117 - DNA, 19 bp, Homo sapiens
ctcctgagaggtgctgcag

SEQ ID NO: 4212118 - DNA, 18 bp, Homo sapiens
ctcgcattttctctagct

SEQ ID NO: 4212119 - DNA, 14 bp, Homo sapiens
ctctctgagggaga

SEQ ID NO: 4212120 - DNA, 14 bp, Homo sapiens
ctctcttgcctttc

SEQ ID NO: 4212121 - DNA, 17 bp, Homo sapiens
ctctgagggagaggctg

SEQ ID NO: 4212122 - DNA, 22 bp, Homo sapiens
ctctgagggagaggctgtggtg

SEQ ID NO: 4212123 - DNA, 17 bp, Homo sapiens
ctctgcatttaaaaaaa

SEQ ID NO: 4212124 - DNA, 15 bp, Homo sapiens
ctctgctcttgcctg

SEQ ID NO: 4212125 - DNA, 17 bp, Homo sapiens
ctctgctcttgcctgca

SEQ ID NO: 4212126 - DNA, 15 bp, Homo sapiens
ctctgctttggaaat

SEQ ID NO: 4212127 - DNA, 18 bp, Homo sapiens
ctctgggagactttccct

SEQ ID NO: 4212128 - DNA, 15 bp, Homo sapiens
ctcttctgtcatccc

SEQ ID NO: 4212129 - DNA, 19 bp, Homo sapiens
ctcttctgtcatcccgctc

SEQ ID NO: 4212130 - DNA, 12 bp, Homo sapiens
ctcttgcctgca

SEQ ID NO: 4212131 - DNA, 14 bp, Homo sapiens
ctcttgcctgcacc

SEQ ID NO: 4212132 - DNA, 16 bp, Homo sapiens
ctcttgcctgcaccct

SEQ ID NO: 4212133 - DNA, 15 bp, Homo sapiens
ctcttgcctttctta

SEQ ID NO: 4212134 - DNA, 23 bp, Homo sapiens
ctctttctaagagacctgaactg

SEQ ID NO: 4212135 - DNA, 14 bp, Homo sapiens
ctgaaaattccaat

SEQ ID NO: 4212136 - DNA, 15 bp, Homo sapiens
ctgacacctcactga

SEQ ID NO: 4212137 - DNA, 15 bp, Homo sapiens
ctgacagctgtgtac

SEQ ID NO: 4212138 - DNA, 14 bp, Homo sapiens
ctgaccctggagcg

SEQ ID NO: 4212139 - DNA, 20 bp, Homo sapiens
ctgaccctggagcggctctc

SEQ ID NO: 4212140 - DNA, 14 bp, Homo sapiens
ctgactcttgcctt

SEQ ID NO: 4212141 - DNA, 17 bp, Homo sapiens
ctgactcttgcctttcc

SEQ ID NO: 4212142 - DNA, 13 bp, Homo sapiens
ctgacttgcagag

SEQ ID NO: 4212143 - DNA, 17 bp, Homo sapiens
ctgagagtgcaaattgt

SEQ ID NO: 4212144 - DNA, 11 bp, Homo sapiens
ctgagggagag

SEQ ID NO: 4212145 - DNA, 15 bp, Homo sapiens
ctgatcagaatttta

SEQ ID NO: 4212146 - DNA, 20 bp, Homo sapiens
ctgatctgatgcaagcaaga

SEQ ID NO: 4212147 - DNA, 13 bp, Homo sapiens
ctgcacccttcct

SEQ ID NO: 4212148 - DNA, 17 bp, Homo sapiens
ctgcacccttcctcctc

SEQ ID NO: 4212149 - DNA, 22 bp, Homo sapiens
ctgcactgaatggctgacctga

SEQ ID NO: 4212150 - DNA, 17 bp, Homo sapiens
ctgcaggcaaagtgaga

SEQ ID NO: 4212151 - DNA, 17 bp, Homo sapiens
ctgcccccagcactcct

SEQ ID NO: 4212152 - DNA, 20 bp, Homo sapiens
ctgcccccagcactcctctg

SEQ ID NO: 4212153 - DNA, 23 bp, Homo sapiens
ctgccggttcttaaatccatcct

SEQ ID NO: 4212154 - DNA, 12 bp, Homo sapiens
ctgccttccagg

SEQ ID NO: 4212155 - DNA, 16 bp, Homo sapiens
ctgctcttgcctgcac

SEQ ID NO: 4212156 - DNA, 18 bp, Homo sapiens
ctgctcttgcctgcaccc

SEQ ID NO: 4212157 - DNA, 16 bp, Homo sapiens
ctgctgaaacacctcc

SEQ ID NO: 4212158 - DNA, 20 bp, Homo sapiens
ctgctgaaacacctcccagg

SEQ ID NO: 4212159 - DNA, 21 bp, Homo sapiens
ctgctgtgtgaattcccaggt

SEQ ID NO: 4212160 - DNA, 23 bp, Homo sapiens
ctgcttgaaggaacagtgctgtt

SEQ ID NO: 4212161 - DNA, 13 bp, Homo sapiens
ctgctttctcctg

SEQ ID NO: 4212162 - DNA, 17 bp, Homo sapiens
ctggaaccacattgaag

SEQ ID NO: 4212163 - DNA, 15 bp, Homo sapiens
ctggaattgctgctc

SEQ ID NO: 4212164 - DNA, 23 bp, Homo sapiens
ctggaatttaaggagggacaaga

SEQ ID NO: 4212165 - DNA, 16 bp, Homo sapiens
ctggagcggctctcct

SEQ ID NO: 4212166 - DNA, 13 bp, Homo sapiens
ctggataaattgt

SEQ ID NO: 4212167 - DNA, 20 bp, Homo sapiens
ctggattttttatgtacaac

SEQ ID NO: 4212168 - DNA, 21 bp, Homo sapiens
ctggattttttatgtacaacc

SEQ ID NO: 4212169 - DNA, 14 bp, Homo sapiens
ctggcaacagagca

SEQ ID NO: 4212170 - DNA, 14 bp, Homo sapiens
ctggcttcacagat

SEQ ID NO: 4212171 - DNA, 22 bp, Homo sapiens
ctggcttctagtctggtgttct

SEQ ID NO: 4212172 - DNA, 16 bp, Homo sapiens
ctgggcccgctttgcc

SEQ ID NO: 4212173 - DNA, 13 bp, Homo sapiens
ctgggttggaaaa

SEQ ID NO: 4212174 - DNA, 18 bp, Homo sapiens
ctgggttggaaaacagta

SEQ ID NO: 4212175 - DNA, 21 bp, Homo sapiens
ctggtcaggcccactgcagag

SEQ ID NO: 4212176 - DNA, 18 bp, Homo sapiens
ctggtctccctccagctg

SEQ ID NO: 4212177 - DNA, 22 bp, Homo sapiens
ctggtctttgaaagaaatgtac

SEQ ID NO: 4212178 - DNA, 19 bp, Homo sapiens
ctggtggccatgtcgcctg

SEQ ID NO: 4212179 - DNA, 21 bp, Homo sapiens
ctgtacttattttccaataaa

SEQ ID NO: 4212180 - DNA, 22 bp, Homo sapiens
ctgtcaatgagagcataattta

SEQ ID NO: 4212181 - DNA, 21 bp, Homo sapiens
ctgtcatcccgctcctgctga

SEQ ID NO: 4212182 - DNA, 17 bp, Homo sapiens
ctgtccctcactgcctt

SEQ ID NO: 4212183 - DNA, 18 bp, Homo sapiens
ctgtccctcactgccttc

SEQ ID NO: 4212184 - DNA, 11 bp, Homo sapiens
ctgtcctccag

SEQ ID NO: 4212185 - DNA, 17 bp, Homo sapiens
ctgtctctgctcttgcc

SEQ ID NO: 4212186 - DNA, 18 bp, Homo sapiens
ctgtctctgctcttgcct

SEQ ID NO: 4212187 - DNA, 18 bp, Homo sapiens
ctgtgtgaattcccaggt

SEQ ID NO: 4212188 - DNA, 16 bp, Homo sapiens
ctgttcagtttcccca

SEQ ID NO: 4212189 - DNA, 17 bp, Homo sapiens
ctgttctggagctgctg

SEQ ID NO: 4212190 - DNA, 18 bp, Homo sapiens
ctgttctggagctgctgt

SEQ ID NO: 4212191 - DNA, 18 bp, Homo sapiens
ctgttgataaaaactcag

SEQ ID NO: 4212192 - DNA, 17 bp, Homo sapiens
cttaatgctttcctccc

SEQ ID NO: 4212193 - DNA, 10 bp, Homo sapiens
cttaattatt

SEQ ID NO: 4212194 - DNA, 18 bp, Homo sapiens
cttataaagtggaagtat

SEQ ID NO: 4212195 - DNA, 19 bp, Homo sapiens
cttattaagagcaaacttt

SEQ ID NO: 4212196 - DNA, 20 bp, Homo sapiens
cttattaagagcaaacttta

SEQ ID NO: 4212197 - DNA, 14 bp, Homo sapiens
cttattactgagag

SEQ ID NO: 4212198 - DNA, 12 bp, Homo sapiens
cttatttgcaat

SEQ ID NO: 4212199 - DNA, 16 bp, Homo sapiens
cttatttgcaataaaa

SEQ ID NO: 4212200 - DNA, 12 bp, Homo sapiens
cttattttccaa

SEQ ID NO: 4212201 - DNA, 17 bp, Homo sapiens
cttcaaatgatccttcc

SEQ ID NO: 4212202 - DNA, 14 bp, Homo sapiens
cttcacacagacac

SEQ ID NO: 4212203 - DNA, 13 bp, Homo sapiens
cttcactccaaag

SEQ ID NO: 4212204 - DNA, 17 bp, Homo sapiens
cttcactccaaagagaa

SEQ ID NO: 4212205 - DNA, 19 bp, Homo sapiens
cttcagagtagagggcttg

SEQ ID NO: 4212206 - DNA, 17 bp, Homo sapiens
cttcatataactgagat

SEQ ID NO: 4212207 - DNA, 14 bp, Homo sapiens
cttccaaataaata

SEQ ID NO: 4212208 - DNA, 17 bp, Homo sapiens
cttcccatgatgccgct

SEQ ID NO: 4212209 - DNA, 19 bp, Homo sapiens
cttcccctcgctgtcctgc

SEQ ID NO: 4212210 - DNA, 14 bp, Homo sapiens
cttcctagtgccta

SEQ ID NO: 4212211 - DNA, 13 bp, Homo sapiens
cttctagaaccag

SEQ ID NO: 4212212 - DNA, 16 bp, Homo sapiens
cttctatttatttatt

SEQ ID NO: 4212213 - DNA, 14 bp, Homo sapiens
cttctcgcattttc

SEQ ID NO: 4212214 - DNA, 15 bp, Homo sapiens
cttctcgcattttct

SEQ ID NO: 4212215 - DNA, 13 bp, Homo sapiens
cttctgtcatccc

SEQ ID NO: 4212216 - DNA, 17 bp, Homo sapiens
cttcttaatgctttcct

SEQ ID NO: 4212217 - DNA, 14 bp, Homo sapiens
cttgaaggaacagt

SEQ ID NO: 4212218 - DNA, 20 bp, Homo sapiens
cttgatttcaggtcaataac

SEQ ID NO: 4212219 - DNA, 19 bp, Homo sapiens
cttgcacagcccacacatg

SEQ ID NO: 4212220 - DNA, 21 bp, Homo sapiens
cttgcagagttcatggaatgt

SEQ ID NO: 4212221 - DNA, 15 bp, Homo sapiens
cttgcaggcaaactt

SEQ ID NO: 4212222 - DNA, 23 bp, Homo sapiens
cttgcctgcacccttcctcctcc

SEQ ID NO: 4212223 - DNA, 17 bp, Homo sapiens
cttggacattttatgtc

SEQ ID NO: 4212224 - DNA, 20 bp, Homo sapiens
cttggcacttattgaatata

SEQ ID NO: 4212225 - DNA, 16 bp, Homo sapiens
cttggttctgtgaaca

SEQ ID NO: 4212226 - DNA, 14 bp, Homo sapiens
cttgtattttccat

SEQ ID NO: 4212227 - DNA, 15 bp, Homo sapiens
cttgtattttccata

SEQ ID NO: 4212228 - DNA, 19 bp, Homo sapiens
cttgttatatgcagacatg

SEQ ID NO: 4212229 - DNA, 22 bp, Homo sapiens
cttgttatatgcagacatgtat

SEQ ID NO: 4212230 - DNA, 16 bp, Homo sapiens
cttgtttaatggtagt

SEQ ID NO: 4212231 - DNA, 21 bp, Homo sapiens
tctctaagttatgactgtgaa

SEQ ID NO: 4212232 - DNA, 12 bp, Homo sapiens
tctctctctggt

SEQ ID NO: 4212233 - DNA, 20 bp, Homo sapiens
tctctgcatttaaaaaaatc

SEQ ID NO: 4212234 - DNA, 18 bp, Homo sapiens
tctctgctcttgcctgca

SEQ ID NO: 4212235 - DNA, 18 bp, Homo sapiens
tctgacttctcacttcct

SEQ ID NO: 4212236 - DNA, 19 bp, Homo sapiens
tctgacttctcacttccta

SEQ ID NO: 4212237 - DNA, 23 bp, Homo sapiens
tctgatgcaagcaagaaacactg

SEQ ID NO: 4212238 - DNA, 22 bp, Homo sapiens
tctgcactgaatggctgacctg

SEQ ID NO: 4212239 - DNA, 18 bp, Homo sapiens
tctgcttgtattttccat

SEQ ID NO: 4212240 - DNA, 14 bp, Homo sapiens
tctggagctgctgt

SEQ ID NO: 4212241 - DNA, 15 bp, Homo sapiens
tctggagctgctgtt

SEQ ID NO: 4212242 - DNA, 15 bp, Homo sapiens
tctggattcatattt

SEQ ID NO: 4212243 - DNA, 16 bp, Homo sapiens
tctggattcatattta

SEQ ID NO: 4212244 - DNA, 12 bp, Homo sapiens
tctgtaataata

SEQ ID NO: 4212245 - DNA, 12 bp, Homo sapiens
tctgtcatcccg

SEQ ID NO: 4212246 - DNA, 16 bp, Homo sapiens
tctgtccctcactgcc

SEQ ID NO: 4212247 - DNA, 22 bp, Homo sapiens
tctgtccctcactgccttccag

SEQ ID NO: 4212248 - DNA, 17 bp, Homo sapiens
tctgttcagtttcccca

SEQ ID NO: 4212249 - DNA, 18 bp, Homo sapiens
tctgtttaattttcactt

SEQ ID NO: 4212250 - DNA, 13 bp, Homo sapiens
tcttagctttcca

SEQ ID NO: 4212251 - DNA, 15 bp, Homo sapiens
tcttagctttccaca

SEQ ID NO: 4212252 - DNA, 15 bp, Homo sapiens
tcttattactgagag

SEQ ID NO: 4212253 - DNA, 16 bp, Homo sapiens
tcttccatttcttcca

SEQ ID NO: 4212254 - DNA, 16 bp, Homo sapiens
tcttctactttcatct

SEQ ID NO: 4212255 - DNA, 17 bp, Homo sapiens
tcttctgtcatcccgct

SEQ ID NO: 4212256 - DNA, 22 bp, Homo sapiens
tcttctgtcatcccgctcctgc

SEQ ID NO: 4212257 - DNA, 22 bp, Homo sapiens
tctttctaagagacctgaactg

SEQ ID NO: 4212258 - DNA, 21 bp, Homo sapiens
tctttggtacaagtttacatg

SEQ ID NO: 4212259 - DNA, 20 bp, Homo sapiens
tctttttaaaaattgttatt

SEQ ID NO: 4212260 - DNA, 11 bp, Homo sapiens
tgaaaatggaa

SEQ ID NO: 4212261 - DNA, 14 bp, Homo sapiens
tgaaaattccaatt

SEQ ID NO: 4212262 - DNA, 17 bp, Homo sapiens
tgaaacacctcccaggg

SEQ ID NO: 4212263 - DNA, 14 bp, Homo sapiens
tgaaataaaatata

SEQ ID NO: 4212264 - DNA, 20 bp, Homo sapiens
tgaaatgattggtaggaaat

SEQ ID NO: 4212265 - DNA, 13 bp, Homo sapiens
tgaaatgcatatt

SEQ ID NO: 4212266 - DNA, 13 bp, Homo sapiens
tgaaatgtcaacc

SEQ ID NO: 4212267 - DNA, 17 bp, Homo sapiens
tgaacaagcttcagtaa

SEQ ID NO: 4212268 - DNA, 22 bp, Homo sapiens
tgaacatggagaggacttttgg

SEQ ID NO: 4212269 - DNA, 15 bp, Homo sapiens
tgaaccatccttccc

SEQ ID NO: 4212270 - DNA, 19 bp, Homo sapiens
tgaaccatccttcccatga

SEQ ID NO: 4212271 - DNA, 16 bp, Homo sapiens
tgaagaaaaaatggca

SEQ ID NO: 4212272 - DNA, 17 bp, Homo sapiens
tgaagaaaaaatggcaa

SEQ ID NO: 4212273 - DNA, 17 bp, Homo sapiens
tgaagcccatgctttcc

SEQ ID NO: 4212274 - DNA, 12 bp, Homo sapiens
tgaaggaacagt

SEQ ID NO: 4212275 - DNA, 21 bp, Homo sapiens
tgaaggaacagtgctgttctg

SEQ ID NO: 4212276 - DNA, 19 bp, Homo sapiens
tgaaggtagaatgttttca

SEQ ID NO: 4212277 - DNA, 12 bp, Homo sapiens
tgaatatatgat

SEQ ID NO: 4212278 - DNA, 16 bp, Homo sapiens
tgaatcttggtgtcta

SEQ ID NO: 4212279 - DNA, 16 bp, Homo sapiens
tgacaaagttatatat

SEQ ID NO: 4212280 - DNA, 20 bp, Homo sapiens
tgacacacagactacagcca

SEQ ID NO: 4212281 - DNA, 15 bp, Homo sapiens
tgaccatcctgtcct

SEQ ID NO: 4212282 - DNA, 22 bp, Homo sapiens
tgaccgagtctaggaatgcttt

SEQ ID NO: 4212283 - DNA, 14 bp, Homo sapiens
tgactcttgccttt

SEQ ID NO: 4212284 - DNA, 13 bp, Homo sapiens
tgagagcataatt

SEQ ID NO: 4212285 - DNA, 23 bp, Homo sapiens
tgagcatcgcttaggagaagtct

SEQ ID NO: 4212286 - DNA, 16 bp, Homo sapiens
tgagcctccatttctg

SEQ ID NO: 4212287 - DNA, 18 bp, Homo sapiens
tgaggatattcagatgta

SEQ ID NO: 4212288 - DNA, 15 bp, Homo sapiens
tgaggctgaggcagg

SEQ ID NO: 4212289 - DNA, 13 bp, Homo sapiens
tgaggtcacctgg

SEQ ID NO: 4212290 - DNA, 13 bp, Homo sapiens
tgatacatataat

SEQ ID NO: 4212291 - DNA, 21 bp, Homo sapiens
tgatccttcctactttgcttc

SEQ ID NO: 4212292 - DNA, 13 bp, Homo sapiens
tgatgatgaccaa

SEQ ID NO: 4212293 - DNA, 17 bp, Homo sapiens
tgatgccgctcttctgt

SEQ ID NO: 4212294 - DNA, 23 bp, Homo sapiens
tgatgccgctcttctgtcatccc

SEQ ID NO: 4212295 - DNA, 22 bp, Homo sapiens
tgattatttaagactaaaagtt

SEQ ID NO: 4212296 - DNA, 20 bp, Homo sapiens
tgattggcaggagttggaag

SEQ ID NO: 4212297 - DNA, 23 bp, Homo sapiens
tgatttgtcttcccttctttgca

SEQ ID NO: 4212298 - DNA, 18 bp, Homo sapiens
tgcaacaaaatatttaat

SEQ ID NO: 4212299 - DNA, 14 bp, Homo sapiens
tgcacactgtccta

SEQ ID NO: 4212300 - DNA, 14 bp, Homo sapiens
tgcacagcccacac

SEQ ID NO: 4212301 - DNA, 15 bp, Homo sapiens
tgcactctagcctgg

SEQ ID NO: 4212302 - DNA, 23 bp, Homo sapiens
tgcactgaatggctgacctgacc

SEQ ID NO: 4212303 - DNA, 22 bp, Homo sapiens
tgcacttatttatgaacctgcc

SEQ ID NO: 4212304 - DNA, 11 bp, Homo sapiens
tgcataaaatg

SEQ ID NO: 4212305 - DNA, 19 bp, Homo sapiens
tgcatagtgctaagaaagc

SEQ ID NO: 4212306 - DNA, 20 bp, Homo sapiens
tgcatattataaaggataaa

SEQ ID NO: 4212307 - DNA, 23 bp, Homo sapiens
tgcatattataaaggataaagaa

SEQ ID NO: 4212308 - DNA, 19 bp, Homo sapiens
tgcatatttgcaaagtgta

SEQ ID NO: 4212309 - DNA, 22 bp, Homo sapiens
tgccaatgttcctgctaataat

SEQ ID NO: 4212310 - DNA, 15 bp, Homo sapiens
tgcccccagcactcc

SEQ ID NO: 4212311 - DNA, 20 bp, Homo sapiens
tgcccccagcactcctctgt

SEQ ID NO: 4212312 - DNA, 13 bp, Homo sapiens
tgccctgtcctcc

SEQ ID NO: 4212313 - DNA, 14 bp, Homo sapiens
tgccctgtcctcca

SEQ ID NO: 4212314 - DNA, 13 bp, Homo sapiens
tgccgctcttctg

SEQ ID NO: 4212315 - DNA, 15 bp, Homo sapiens
tgccgctcttctgtc

SEQ ID NO: 4212316 - DNA, 16 bp, Homo sapiens
tgccgctcttctgtca

SEQ ID NO: 4212317 - DNA, 22 bp, Homo sapiens
tgcctacaatgggaaaacttca

SEQ ID NO: 4212318 - DNA, 18 bp, Homo sapiens
tgcctaggaggccttctc

SEQ ID NO: 4212319 - DNA, 15 bp, Homo sapiens
tgcctcatgctgact

SEQ ID NO: 4212320 - DNA, 12 bp, Homo sapiens
tgcctcctgtct

SEQ ID NO: 4212321 - DNA, 17 bp, Homo sapiens
tgcctcctgtcttatgg

SEQ ID NO: 4212322 - DNA, 20 bp, Homo sapiens
tgcctgcacccttcctcctc

SEQ ID NO: 4212323 - DNA, 15 bp, Homo sapiens
tgccttgtctgggga

SEQ ID NO: 4212324 - DNA, 15 bp, Homo sapiens
tgcctttccacctgc

SEQ ID NO: 4212325 - DNA, 20 bp, Homo sapiens
tgcctttccacctgctttct

SEQ ID NO: 4212326 - DNA, 18 bp, Homo sapiens
tgcctttcttatttgcaa

SEQ ID NO: 4212327 - DNA, 19 bp, Homo sapiens
tgcctttcttatttgcaat

SEQ ID NO: 4212328 - DNA, 22 bp, Homo sapiens
tgctaataatttgccattatct

SEQ ID NO: 4212329 - DNA, 21 bp, Homo sapiens
tgctataactatgttgataaa

SEQ ID NO: 4212330 - DNA, 12 bp, Homo sapiens
tgctcttgcctg

SEQ ID NO: 4212331 - DNA, 17 bp, Homo sapiens
tgctcttgcctgcaccc

SEQ ID NO: 4212332 - DNA, 17 bp, Homo sapiens
tgctgctctctgaggga

SEQ ID NO: 4212333 - DNA, 13 bp, Homo sapiens
tgctgttctggag

SEQ ID NO: 4212334 - DNA, 21 bp, Homo sapiens
tgcttcaaatgatccttccta

SEQ ID NO: 4212335 - DNA, 16 bp, Homo sapiens
tgcttgaaggaacagt

SEQ ID NO: 4212336 - DNA, 19 bp, Homo sapiens
tgctttcccaccagcatgt

SEQ ID NO: 4212337 - DNA, 13 bp, Homo sapiens
tgctttctcctgg

SEQ ID NO: 4212338 - DNA, 15 bp, Homo sapiens
tggaaaataaatcaa

SEQ ID NO: 4212339 - DNA, 14 bp, Homo sapiens
tggaacatccttgg

SEQ ID NO: 4212340 - DNA, 23 bp, Homo sapiens
tggaatgtaactatatcatcctt

SEQ ID NO: 4212341 - DNA, 16 bp, Homo sapiens
tggaattgctgctctc

SEQ ID NO: 4212342 - DNA, 19 bp, Homo sapiens
tggaattgctgctctctga

SEQ ID NO: 4212343 - DNA, 19 bp, Homo sapiens
tggagaactttccatctgc

SEQ ID NO: 4212344 - DNA, 16 bp, Homo sapiens
tggagcggctctcctg

SEQ ID NO: 4212345 - DNA, 17 bp, Homo sapiens
tggcagctggaatttaa

SEQ ID NO: 4212346 - DNA, 19 bp, Homo sapiens
tggcatgaccatcctgtcc

SEQ ID NO: 4212347 - DNA, 15 bp, Homo sapiens
tggctagtccttgtt

SEQ ID NO: 4212348 - DNA, 12 bp, Homo sapiens
tggctgtctctg

SEQ ID NO: 4212349 - DNA, 16 bp, Homo sapiens
tggcttcctccgtctg

SEQ ID NO: 4212350 - DNA, 21 bp, Homo sapiens
tggcttcctccgtctgcaatg

SEQ ID NO: 4212351 - DNA, 12 bp, Homo sapiens
aaaaaagagaca

SEQ ID NO: 4212352 - DNA, 14 bp, Homo sapiens
aaaaaagcaacagt

SEQ ID NO: 4212353 - DNA, 12 bp, Homo sapiens
aaaaaatggcaa

SEQ ID NO: 4212354 - DNA, 15 bp, Homo sapiens
aaaaagagacatcca

SEQ ID NO: 4212355 - DNA, 14 bp, Homo sapiens
aaaaagtataaaat

SEQ ID NO: 4212356 - DNA, 11 bp, Homo sapiens
aaaaattactg

SEQ ID NO: 4212357 - DNA, 15 bp, Homo sapiens
aaaacaaaaaacttt

SEQ ID NO: 4212358 - DNA, 17 bp, Homo sapiens
aaaacagtcctttaaat

SEQ ID NO: 4212359 - DNA, 15 bp, Homo sapiens
aaaacttcactccaa

SEQ ID NO: 4212360 - DNA, 17 bp, Homo sapiens
aaaacttcactccaaag

SEQ ID NO: 4212361 - DNA, 20 bp, Homo sapiens
aaaagttattacctttacat

SEQ ID NO: 4212362 - DNA, 12 bp, Homo sapiens
aaaatatatctt

SEQ ID NO: 4212363 - DNA, 18 bp, Homo sapiens
aaaatcccaaattcactt

SEQ ID NO: 4212364 - DNA, 18 bp, Homo sapiens
aaaatgaaatgcatattt

SEQ ID NO: 4212365 - DNA, 17 bp, Homo sapiens
aaaatgagctaggcatg

SEQ ID NO: 4212366 - DNA, 14 bp, Homo sapiens
aaaatggcaagaga

SEQ ID NO: 4212367 - DNA, 15 bp, Homo sapiens
aaaatggcaagagat

SEQ ID NO: 4212368 - DNA, 18 bp, Homo sapiens
aaaatgtttcattttcat

SEQ ID NO: 4212369 - DNA, 18 bp, Homo sapiens
aaaattgctataaatcga

SEQ ID NO: 4212370 - DNA, 13 bp, Homo sapiens
aaacacctcccag

SEQ ID NO: 4212371 - DNA, 15 bp, Homo sapiens
aaacacctctgtatt

SEQ ID NO: 4212372 - DNA, 15 bp, Homo sapiens
aaacagaaattgcaa

SEQ ID NO: 4212373 - DNA, 17 bp, Homo sapiens
aaacagtcctttaaatt

SEQ ID NO: 4212374 - DNA, 17 bp, Homo sapiens
aaacatcaattgatatt

SEQ ID NO: 4212375 - DNA, 11 bp, Homo sapiens
aaacatttctt

SEQ ID NO: 4212376 - DNA, 23 bp, Homo sapiens
aaacctggattttttatgtacaa

SEQ ID NO: 4212377 - DNA, 17 bp, Homo sapiens
aaactcaggcaaagaaa

SEQ ID NO: 4212378 - DNA, 14 bp, Homo sapiens
aaactcttctactt

SEQ ID NO: 4212379 - DNA, 23 bp, Homo sapiens
aaactggtttagcacaatttata

SEQ ID NO: 4212380 - DNA, 20 bp, Homo sapiens
aaacttcactccaaagagaa

SEQ ID NO: 4212381 - DNA, 20 bp, Homo sapiens
aaagaaggtttcagaaagaa

SEQ ID NO: 4212382 - DNA, 18 bp, Homo sapiens
aaagaagtggggacagag

SEQ ID NO: 4212383 - DNA, 15 bp, Homo sapiens
aaagccaaatttata

SEQ ID NO: 4212384 - DNA, 22 bp, Homo sapiens
aaaggacccaagtactttccaa

SEQ ID NO: 4212385 - DNA, 13 bp, Homo sapiens
aaaggataaagaa

SEQ ID NO: 4212386 - DNA, 14 bp, Homo sapiens
aaaggataaagaag

SEQ ID NO: 4212387 - DNA, 16 bp, Homo sapiens
aaagtcattaaagaca

SEQ ID NO: 4212388 - DNA, 21 bp, Homo sapiens
aagcctgaaaattccaatttg

SEQ ID NO: 4212389 - DNA, 20 bp, Homo sapiens
aagcgtgggtggaggaagat

SEQ ID NO: 4212390 - DNA, 16 bp, Homo sapiens
aaggagggacaagaat

SEQ ID NO: 4212391 - DNA, 19 bp, Homo sapiens
aaggatgatgtctttttat

SEQ ID NO: 4212392 - DNA, 20 bp, Homo sapiens
aaggcaggggaatgtatgtg

SEQ ID NO: 4212393 - DNA, 15 bp, Homo sapiens
aagggcataaagtaa

SEQ ID NO: 4212394 - DNA, 22 bp, Homo sapiens
aagggcggggctatgccttgtc

SEQ ID NO: 4212395 - DNA, 13 bp, Homo sapiens
aaggtagaatgtt

SEQ ID NO: 4212396 - DNA, 17 bp, Homo sapiens
aaggtatttacacatac

SEQ ID NO: 4212397 - DNA, 18 bp, Homo sapiens
aagtaaatacatgcatat

SEQ ID NO: 4212398 - DNA, 19 bp, Homo sapiens
aagtagaatggcagctgga

SEQ ID NO: 4212399 - DNA, 22 bp, Homo sapiens
aagtataaaatagtatgaaaat

SEQ ID NO: 4212400 - DNA, 20 bp, Homo sapiens
aagtatgtatattaaaaaag

SEQ ID NO: 4212401 - DNA, 21 bp, Homo sapiens
aagtcacacattacaaagtta

SEQ ID NO: 4212402 - DNA, 15 bp, Homo sapiens
aagtcatcatctcca

SEQ ID NO: 4212403 - DNA, 23 bp, Homo sapiens
aagtcatcttagctttccacagg

SEQ ID NO: 4212404 - DNA, 16 bp, Homo sapiens
aagtgttgaagaagag

SEQ ID NO: 4212405 - DNA, 19 bp, Homo sapiens
aagtgttgaagaagagttt

SEQ ID NO: 4212406 - DNA, 14 bp, Homo sapiens
aataaaaatatatt

SEQ ID NO: 4212407 - DNA, 15 bp, Homo sapiens
aataaaaatatattt

SEQ ID NO: 4212408 - DNA, 20 bp, Homo sapiens
aataaaaatatattttcaac

SEQ ID NO: 4212409 - DNA, 15 bp, Homo sapiens
aataaaatatatctt

SEQ ID NO: 4212410 - DNA, 12 bp, Homo sapiens
aataaaattttc

SEQ ID NO: 4212411 - DNA, 14 bp, Homo sapiens
aataaaattttcaa

SEQ ID NO: 4212412 - DNA, 18 bp, Homo sapiens
aataaaccaaaggaaaat

SEQ ID NO: 4212413 - DNA, 16 bp, Homo sapiens
aataaataattttcat

SEQ ID NO: 4212414 - DNA, 14 bp, Homo sapiens
aataatagactgta

SEQ ID NO: 4212415 - DNA, 18 bp, Homo sapiens
aataattttcattttgca

SEQ ID NO: 4212416 - DNA, 21 bp, Homo sapiens
aatagactgtaacttccaaat

SEQ ID NO: 4212417 - DNA, 23 bp, Homo sapiens
aatagactgtacttattttccaa

SEQ ID NO: 4212418 - DNA, 19 bp, Homo sapiens
aatagattgtaatacacat

SEQ ID NO: 4212419 - DNA, 21 bp, Homo sapiens
aatattactggataaattgta

SEQ ID NO: 4212420 - DNA, 20 bp, Homo sapiens
aatatttcaggttcttcaga

SEQ ID NO: 4212421 - DNA, 23 bp, Homo sapiens
aatcaagttggcttctaatcaaa

SEQ ID NO: 4212422 - DNA, 19 bp, Homo sapiens
aatcacattcgagtgtttc

SEQ ID NO: 4212423 - DNA, 19 bp, Homo sapiens
aatcccaaattcactttat

SEQ ID NO: 4212424 - DNA, 22 bp, Homo sapiens
aatctattcataagtctttggt

SEQ ID NO: 4212425 - DNA, 18 bp, Homo sapiens
aatctgacttctcacttc

SEQ ID NO: 4212426 - DNA, 20 bp, Homo sapiens
aatctgacttctcacttcct

SEQ ID NO: 4212427 - DNA, 16 bp, Homo sapiens
aatctggattcatatt

SEQ ID NO: 4212428 - DNA, 13 bp, Homo sapiens
aatgacatttttg

SEQ ID NO: 4212429 - DNA, 17 bp, Homo sapiens
aatgacatttttgataa

SEQ ID NO: 4212430 - DNA, 16 bp, Homo sapiens
aatgactcaaagtctg

SEQ ID NO: 4212431 - DNA, 12 bp, Homo sapiens
aatgagagcata

SEQ ID NO: 4212432 - DNA, 13 bp, Homo sapiens
aatgatccttcct

SEQ ID NO: 4212433 - DNA, 18 bp, Homo sapiens
aatgcatatttgcaaagt

SEQ ID NO: 4212434 - DNA, 12 bp, Homo sapiens
aatgctttcctc

SEQ ID NO: 4212435 - DNA, 18 bp, Homo sapiens
aatggctgacctgacctg

SEQ ID NO: 4212436 - DNA, 22 bp, Homo sapiens
aatgtcagttgttatttattga

SEQ ID NO: 4212437 - DNA, 18 bp, Homo sapiens
aatgtctgtaataataga

SEQ ID NO: 4212438 - DNA, 18 bp, Homo sapiens
aatgtgatttgtcttccc

SEQ ID NO: 4212439 - DNA, 16 bp, Homo sapiens
aatgttggaattttca

SEQ ID NO: 4212440 - DNA, 15 bp, Homo sapiens
aattcactttattat

SEQ ID NO: 4212441 - DNA, 22 bp, Homo sapiens
aattctagctttgagcttaaga

SEQ ID NO: 4212442 - DNA, 15 bp, Homo sapiens
aattctgtttaattt

SEQ ID NO: 4212443 - DNA, 16 bp, Homo sapiens
aattgctataaatcga

SEQ ID NO: 4212444 - DNA, 16 bp, Homo sapiens
aattgctgctctctga

SEQ ID NO: 4212445 - DNA, 23 bp, Homo sapiens
aattgtacaaggtatttacacat

SEQ ID NO: 4212446 - DNA, 20 bp, Homo sapiens
aatttaaggagggacaagaa

SEQ ID NO: 4212447 - DNA, 12 bp, Homo sapiens
aatttgccatta

SEQ ID NO: 4212448 - DNA, 19 bp, Homo sapiens
aattttcattttgcactga

SEQ ID NO: 4212449 - DNA, 15 bp, Homo sapiens
aattttgcagcagaa

SEQ ID NO: 4212450 - DNA, 13 bp, Homo sapiens
aatttttgcaatt

SEQ ID NO: 4212451 - DNA, 24 bp, Homo sapiens
acaaaaaacttttaatgccttcca

SEQ ID NO: 4212452 - DNA, 17 bp, Homo sapiens
acaaaggggcttaatta

SEQ ID NO: 4212453 - DNA, 18 bp, Homo sapiens
acaacttcatataactga

SEQ ID NO: 4212454 - DNA, 12 bp, Homo sapiens
acaatttatatt

SEQ ID NO: 4212455 - DNA, 23 bp, Homo sapiens
acttcttaatgctttcctccctg

SEQ ID NO: 4212456 - DNA, 20 bp, Homo sapiens
acttgccaatgtacatacct

SEQ ID NO: 4212457 - DNA, 21 bp, Homo sapiens
actttcctcttagtcgagcca

SEQ ID NO: 4212458 - DNA, 17 bp, Homo sapiens
actttgcttctctccac

SEQ ID NO: 4212459 - DNA, 17 bp, Homo sapiens
acttttgaaataaagta

SEQ ID NO: 4212460 - DNA, 18 bp, Homo sapiens
acttttggtttttatatt

SEQ ID NO: 4212461 - DNA, 17 bp, Homo sapiens
agaaaagtgcaaagtta

SEQ ID NO: 4212462 - DNA, 21 bp, Homo sapiens
agaaaatgaaatgcatatttg

SEQ ID NO: 4212463 - DNA, 19 bp, Homo sapiens
agaaacctattaagtcatc

SEQ ID NO: 4212464 - DNA, 21 bp, Homo sapiens
agaaacctattaagtcatcat

SEQ ID NO: 4212465 - DNA, 21 bp, Homo sapiens
agaaagcaagccaatttggaa

SEQ ID NO: 4212466 - DNA, 14 bp, Homo sapiens
agaaataaaccaaa

SEQ ID NO: 4212467 - DNA, 14 bp, Homo sapiens
agaaatgtactact

SEQ ID NO: 4212468 - DNA, 14 bp, Homo sapiens
agaacaaaacagtc

SEQ ID NO: 4212469 - DNA, 18 bp, Homo sapiens
agaagaaatgacattttg

SEQ ID NO: 4212470 - DNA, 14 bp, Homo sapiens
agaagagtttgcaa

SEQ ID NO: 4212471 - DNA, 15 bp, Homo sapiens
agaagccaaattttt

SEQ ID NO: 4212472 - DNA, 13 bp, Homo sapiens
agaaggatgatgt

SEQ ID NO: 4212473 - DNA, 19 bp, Homo sapiens
agaagttgccaagagttct

SEQ ID NO: 4212474 - DNA, 15 bp, Homo sapiens
agaatgaaaagttta

SEQ ID NO: 4212475 - DNA, 16 bp, Homo sapiens
agaatgaaaagtttag

SEQ ID NO: 4212476 - DNA, 13 bp, Homo sapiens
agaatggcagctg

SEQ ID NO: 4212477 - DNA, 14 bp, Homo sapiens
agaattttaccaaa

SEQ ID NO: 4212478 - DNA, 15 bp, Homo sapiens
agaattttgagcagg

SEQ ID NO: 4212479 - DNA, 22 bp, Homo sapiens
agacaaatattcctttgcatat

SEQ ID NO: 4212480 - DNA, 19 bp, Homo sapiens
agacaccgttcattcaggc

SEQ ID NO: 4212481 - DNA, 20 bp, Homo sapiens
agacagcgaactagaagaaa

SEQ ID NO: 4212482 - DNA, 16 bp, Homo sapiens
agacatattcttggag

SEQ ID NO: 4212483 - DNA, 22 bp, Homo sapiens
agacatccaaatttttttttaa

SEQ ID NO: 4212484 - DNA, 15 bp, Homo sapiens
agaccacctccctgc

SEQ ID NO: 4212485 - DNA, 18 bp, Homo sapiens
agaccacctccctgccct

SEQ ID NO: 4212486 - DNA, 19 bp, Homo sapiens
agactacagccagaagccc

SEQ ID NO: 4212487 - DNA, 21 bp, Homo sapiens
agactccagctgggttggaaa

SEQ ID NO: 4212488 - DNA, 18 bp, Homo sapiens
agactgacacctcactga

SEQ ID NO: 4212489 - DNA, 21 bp, Homo sapiens
agactgtacttattttccaat

SEQ ID NO: 4212490 - DNA, 17 bp, Homo sapiens
agagaaagtgacctatt

SEQ ID NO: 4212491 - DNA, 20 bp, Homo sapiens
agagacactgttgataaaaa

SEQ ID NO: 4212492 - DNA, 22 bp, Homo sapiens
agagacactgttgataaaaact

SEQ ID NO: 4212493 - DNA, 13 bp, Homo sapiens
agagatacagagg

SEQ ID NO: 4212494 - DNA, 14 bp, Homo sapiens
agagcaaactttag

SEQ ID NO: 4212495 - DNA, 18 bp, Homo sapiens
agagcaagactccgtctc

SEQ ID NO: 4212496 - DNA, 15 bp, Homo sapiens
agagccatacataaa

SEQ ID NO: 4212497 - DNA, 19 bp, Homo sapiens
agagccatacataaaagaa

SEQ ID NO: 4212498 - DNA, 20 bp, Homo sapiens
agagccatacataaaagaaa

SEQ ID NO: 4212499 - DNA, 24 bp, Homo sapiens
agaggactagggtaatctgacttc

SEQ ID NO: 4212500 - DNA, 16 bp, Homo sapiens
agaggtgctgcaggca

SEQ ID NO: 4212501 - DNA, 21 bp, Homo sapiens
agagttctttaggtgcctcct

SEQ ID NO: 4212502 - DNA, 16 bp, Homo sapiens
agataaccatattcac

SEQ ID NO: 4212503 - DNA, 13 bp, Homo sapiens
agataatccctgt

SEQ ID NO: 4212504 - DNA, 18 bp, Homo sapiens
agatctctgctttggaaa

SEQ ID NO: 4212505 - DNA, 23 bp, Homo sapiens
agatctctgctttggaaatcaca

SEQ ID NO: 4212506 - DNA, 14 bp, Homo sapiens
agatcttttaaaaa

SEQ ID NO: 4212507 - DNA, 17 bp, Homo sapiens
agcaacagtagcaggga

SEQ ID NO: 4212508 - DNA, 14 bp, Homo sapiens
agcacagttttaag

SEQ ID NO: 4212509 - DNA, 22 bp, Homo sapiens
agcataatttaaaaatatattt

SEQ ID NO: 4212510 - DNA, 19 bp, Homo sapiens
agcatcgcttaggagaagt

SEQ ID NO: 4212511 - DNA, 16 bp, Homo sapiens
agcatgtcactcccag

SEQ ID NO: 4212512 - DNA, 21 bp, Homo sapiens
agccaaatccatcctgctctt

SEQ ID NO: 4212513 - DNA, 14 bp, Homo sapiens
agccaatttggaaa

SEQ ID NO: 4212514 - DNA, 21 bp, Homo sapiens
agccatacataaaagaaataa

SEQ ID NO: 4212515 - DNA, 22 bp, Homo sapiens
agccatacataaaagaaataaa

SEQ ID NO: 4212516 - DNA, 18 bp, Homo sapiens
agcctccatttctggctt

SEQ ID NO: 4212517 - DNA, 14 bp, Homo sapiens
agcctgaaaattcc

SEQ ID NO: 4212518 - DNA, 14 bp, Homo sapiens
agccttctctctct

SEQ ID NO: 4212519 - DNA, 13 bp, Homo sapiens
agcggctctcctg

SEQ ID NO: 4212520 - DNA, 12 bp, Homo sapiens
agctaattattt

SEQ ID NO: 4212521 - DNA, 14 bp, Homo sapiens
agctgatcagaatt

SEQ ID NO: 4212522 - DNA, 14 bp, Homo sapiens
agctggaatttaag

SEQ ID NO: 4212523 - DNA, 14 bp, Homo sapiens
agctgggttggaaa

SEQ ID NO: 4212524 - DNA, 20 bp, Homo sapiens
agctgggttggaaaacagta

SEQ ID NO: 4212525 - DNA, 21 bp, Homo sapiens
agcttcagtaagttatctttg

SEQ ID NO: 4212526 - DNA, 16 bp, Homo sapiens
agcttcccctcgctgt

SEQ ID NO: 4212527 - DNA, 16 bp, Homo sapiens
agctttcatttgacac

SEQ ID NO: 4212528 - DNA, 13 bp, Homo sapiens
agctttccacagg

SEQ ID NO: 4212529 - DNA, 16 bp, Homo sapiens
agcttttaaaccctat

SEQ ID NO: 4212530 - DNA, 20 bp, Homo sapiens
aggaaaatgtctgtaataat

SEQ ID NO: 4212531 - DNA, 22 bp, Homo sapiens
aggaaggctgagaggagagaga

SEQ ID NO: 4212532 - DNA, 23 bp, Homo sapiens
aggacacaagcacagttttaaga

SEQ ID NO: 4212533 - DNA, 15 bp, Homo sapiens
aggagcaatttgcac

SEQ ID NO: 4212534 - DNA, 18 bp, Homo sapiens
aggagcaatttgcacatg

SEQ ID NO: 4212535 - DNA, 16 bp, Homo sapiens
aggcaggggaatgtat

SEQ ID NO: 4212536 - DNA, 19 bp, Homo sapiens
aggcaggggaatgtatgtg

SEQ ID NO: 4212537 - DNA, 20 bp, Homo sapiens
aggcatggtggcacacgcct

SEQ ID NO: 4212538 - DNA, 14 bp, Homo sapiens
aggctaagctgccg

SEQ ID NO: 4212539 - DNA, 17 bp, Homo sapiens
aggctattttctaaaga

SEQ ID NO: 4212540 - DNA, 18 bp, Homo sapiens
aggctggtctccctccag

SEQ ID NO: 4212541 - DNA, 21 bp, Homo sapiens
aggctgtggtggctgtctctg

SEQ ID NO: 4212542 - DNA, 14 bp, Homo sapiens
agggaagaactatt

SEQ ID NO: 4212543 - DNA, 13 bp, Homo sapiens
agggcataaagta

SEQ ID NO: 4212544 - DNA, 15 bp, Homo sapiens
agggcataaagtaaa

SEQ ID NO: 4212545 - DNA, 14 bp, Homo sapiens
aggggctccacctg

SEQ ID NO: 4212546 - DNA, 19 bp, Homo sapiens
agggttgaattctggagga

SEQ ID NO: 4212547 - DNA, 14 bp, Homo sapiens
aggtgcctcctgtc

SEQ ID NO: 4212548 - DNA, 21 bp, Homo sapiens
aggttagtgacaaaattggcc

SEQ ID NO: 4212549 - DNA, 18 bp, Homo sapiens
agtagaatggcagctgga

SEQ ID NO: 4212550 - DNA, 18 bp, Homo sapiens
agtagatgtggcctttga

SEQ ID NO: 4212551 - DNA, 16 bp, Homo sapiens
agtagcagggaattga

SEQ ID NO: 4212552 - DNA, 23 bp, Homo sapiens
agtatgtatattaaaaaagagac

SEQ ID NO: 4212553 - DNA, 19 bp, Homo sapiens
agtatttataatataaatc

SEQ ID NO: 4212554 - DNA, 18 bp, Homo sapiens
agtcacacattacaaagt

SEQ ID NO: 4212555 - DNA, 23 bp, Homo sapiens
agtcactctaggactctgcactg

SEQ ID NO: 4212556 - DNA, 12 bp, Homo sapiens
agtcatcatctc

SEQ ID NO: 4212557 - DNA, 17 bp, Homo sapiens
agtcatcatctccaaac

SEQ ID NO: 4212558 - DNA, 19 bp, Homo sapiens
agtcatgcgtttaatcaca

SEQ ID NO: 4212559 - DNA, 16 bp, Homo sapiens
agtcctttaaattttg

SEQ ID NO: 4212560 - DNA, 15 bp, Homo sapiens
agtgaacattacatt

SEQ ID NO: 4212561 - DNA, 19 bp, Homo sapiens
agtgacaaaattggccaga

SEQ ID NO: 4212562 - DNA, 13 bp, Homo sapiens
agtgcaaattgta

SEQ ID NO: 4212563 - DNA, 14 bp, Homo sapiens
agtgcctacaatgg

SEQ ID NO: 4212564 - DNA, 19 bp, Homo sapiens
agtgctgggattacaggct

SEQ ID NO: 4212565 - DNA, 18 bp, Homo sapiens
agtgctgttctggagctg

SEQ ID NO: 4212566 - DNA, 21 bp, Homo sapiens
agtggaagtatgtatattaaa

SEQ ID NO: 4212567 - DNA, 14 bp, Homo sapiens
agtggcttcctccg

SEQ ID NO: 4212568 - DNA, 15 bp, Homo sapiens
agtggggacagagca

SEQ ID NO: 4212569 - DNA, 19 bp, Homo sapiens
agtgtgtggtcaacatttc

SEQ ID NO: 4212570 - DNA, 14 bp, Homo sapiens
agttaagtcatcca

SEQ ID NO: 4212571 - DNA, 18 bp, Homo sapiens
agttatctttgaatatgt

SEQ ID NO: 4212572 - DNA, 16 bp, Homo sapiens
agttatgactgtgaaa

SEQ ID NO: 4212573 - DNA, 24 bp, Homo sapiens
agttcaatctggattcatatttaa

SEQ ID NO: 4212574 - DNA, 19 bp, Homo sapiens
agttgaagaaaaaatggca

SEQ ID NO: 4212575 - DNA, 23 bp, Homo sapiens
agttgcattttaaccctatttta

SEQ ID NO: 4212576 - DNA, 15 bp, Homo sapiens
agtttaagtctctga

SEQ ID NO: 4212577 - DNA, 15 bp, Homo sapiens
atcccgctcctgctg

SEQ ID NO: 4212578 - DNA, 18 bp, Homo sapiens
atcctccaattccacagt

SEQ ID NO: 4212579 - DNA, 15 bp, Homo sapiens
atcctgcattttacg

SEQ ID NO: 4212580 - DNA, 15 bp, Homo sapiens
atcctgctcttccat

SEQ ID NO: 4212581 - DNA, 13 bp, Homo sapiens
atccttcccatga

SEQ ID NO: 4212582 - DNA, 20 bp, Homo sapiens
atccttcctactttgcttct

SEQ ID NO: 4212583 - DNA, 12 bp, Homo sapiens
atctcctgtcta

SEQ ID NO: 4212584 - DNA, 14 bp, Homo sapiens
atctgacttctcac

SEQ ID NO: 4212585 - DNA, 16 bp, Homo sapiens
atcttagctttccaca

SEQ ID NO: 4212586 - DNA, 18 bp, Homo sapiens
atcttagctttccacagg

SEQ ID NO: 4212587 - DNA, 15 bp, Homo sapiens
atgaaataatgtgaa

SEQ ID NO: 4212588 - DNA, 18 bp, Homo sapiens
atgaaatgcatatttgca

SEQ ID NO: 4212589 - DNA, 19 bp, Homo sapiens
atgacatttttgataaatt

SEQ ID NO: 4212590 - DNA, 16 bp, Homo sapiens
atgacctttttcactg

SEQ ID NO: 4212591 - DNA, 21 bp, Homo sapiens
atgacgtcaatagcagcccag

SEQ ID NO: 4212592 - DNA, 20 bp, Homo sapiens
atgagagcataatttaaaaa

SEQ ID NO: 4212593 - DNA, 17 bp, Homo sapiens
atgataaaaagaaatgt

SEQ ID NO: 4212594 - DNA, 15 bp, Homo sapiens
atgatgaccaagaat

SEQ ID NO: 4212595 - DNA, 20 bp, Homo sapiens
atgatgccgctcttctgtca

SEQ ID NO: 4212596 - DNA, 23 bp, Homo sapiens
atgatgccgctcttctgtcatcc

SEQ ID NO: 4212597 - DNA, 13 bp, Homo sapiens
atgatttcacagt

SEQ ID NO: 4212598 - DNA, 20 bp, Homo sapiens
atgcaccctcatacacagaa

SEQ ID NO: 4212599 - DNA, 17 bp, Homo sapiens
atgcagcatctaagtaa

SEQ ID NO: 4212600 - DNA, 14 bp, Homo sapiens
atgccgctcttctg

SEQ ID NO: 4212601 - DNA, 11 bp, Homo sapiens
atgccttccac

SEQ ID NO: 4212602 - DNA, 16 bp, Homo sapiens
atgccttgtctgggga

SEQ ID NO: 4212603 - DNA, 18 bp, Homo sapiens
atgctgacttgcagagtt

SEQ ID NO: 4212604 - DNA, 13 bp, Homo sapiens
atgctttcctccc

SEQ ID NO: 4212605 - DNA, 18 bp, Homo sapiens
atgctttcctccctggca

SEQ ID NO: 4212606 - DNA, 14 bp, Homo sapiens
atggagacagcgaa

SEQ ID NO: 4212607 - DNA, 17 bp, Homo sapiens
atggcaagagatcatat

SEQ ID NO: 4212608 - DNA, 21 bp, Homo sapiens
atggcatccctttttcataaa

SEQ ID NO: 4212609 - DNA, 22 bp, Homo sapiens
atggcatccctttttcataaat

SEQ ID NO: 4212610 - DNA, 21 bp, Homo sapiens
atgggaaaacttcactccaaa

SEQ ID NO: 4212611 - DNA, 15 bp, Homo sapiens
atggtagttttacag

SEQ ID NO: 4212612 - DNA, 21 bp, Homo sapiens
atggtagttttacagtgtttc

SEQ ID NO: 4212613 - DNA, 18 bp, Homo sapiens
atgtaattttgaactgtt

SEQ ID NO: 4212614 - DNA, 13 bp, Homo sapiens
atgtacaaccctg

SEQ ID NO: 4212615 - DNA, 13 bp, Homo sapiens
atgtacagcatgc

SEQ ID NO: 4212616 - DNA, 14 bp, Homo sapiens
atgtagtatctata

SEQ ID NO: 4212617 - DNA, 16 bp, Homo sapiens
atgtatattaaaaaag

SEQ ID NO: 4212618 - DNA, 22 bp, Homo sapiens
atgtatattaaaaaagagacat

SEQ ID NO: 4212619 - DNA, 14 bp, Homo sapiens
atgttagagtaatg

SEQ ID NO: 4212620 - DNA, 16 bp, Homo sapiens
atgttcctgctaataa

SEQ ID NO: 4212621 - DNA, 20 bp, Homo sapiens
atgttctccagtcattatgt

SEQ ID NO: 4212622 - DNA, 20 bp, Homo sapiens
atgtttgaactgccaagaaa

SEQ ID NO: 4212623 - DNA, 16 bp, Homo sapiens
attaaaaaagagacat

SEQ ID NO: 4212624 - DNA, 13 bp, Homo sapiens
attaaaatatttc

SEQ ID NO: 4212625 - DNA, 22 bp, Homo sapiens
attaaagacaggagacaaaaga

SEQ ID NO: 4212626 - DNA, 15 bp, Homo sapiens
attaaagatatttct

SEQ ID NO: 4212627 - DNA, 22 bp, Homo sapiens
attaaagatatttctttaaatt

SEQ ID NO: 4212628 - DNA, 16 bp, Homo sapiens
attaagagcaaacttt

SEQ ID NO: 4212629 - DNA, 15 bp, Homo sapiens
attaagtcatcatct

SEQ ID NO: 4212630 - DNA, 14 bp, Homo sapiens
attaattagatttt

SEQ ID NO: 4212631 - DNA, 15 bp, Homo sapiens
attacattgccattt

SEQ ID NO: 4212632 - DNA, 16 bp, Homo sapiens
attagattttcttgca

SEQ ID NO: 4212633 - DNA, 21 bp, Homo sapiens
attagttttgaagattctatg

SEQ ID NO: 4212634 - DNA, 13 bp, Homo sapiens
attatgttaatat

SEQ ID NO: 4212635 - DNA, 16 bp, Homo sapiens
attatgttaatatttc

SEQ ID NO: 4212636 - DNA, 16 bp, Homo sapiens
attattgaagatgtga

SEQ ID NO: 4212637 - DNA, 15 bp, Homo sapiens
attatttaattgtcc

SEQ ID NO: 4212638 - DNA, 18 bp, Homo sapiens
attatttgattatttaag

SEQ ID NO: 4212639 - DNA, 22 bp, Homo sapiens
attatttgattatttaagacta

SEQ ID NO: 4212640 - DNA, 17 bp, Homo sapiens
attcagaacatcctcca

SEQ ID NO: 4212641 - DNA, 15 bp, Homo sapiens
attcattagttttga

SEQ ID NO: 4212642 - DNA, 16 bp, Homo sapiens
attcattctttttgaa

SEQ ID NO: 4212643 - DNA, 17 bp, Homo sapiens
attccaaacttctaaat

SEQ ID NO: 4212644 - DNA, 16 bp, Homo sapiens
attccacagtctctgg

SEQ ID NO: 4212645 - DNA, 15 bp, Homo sapiens
attcctttttctatg

SEQ ID NO: 4212646 - DNA, 18 bp, Homo sapiens
attctatgttaatatttt

SEQ ID NO: 4212647 - DNA, 20 bp, Homo sapiens
attctccaggattccaaagt

SEQ ID NO: 4212648 - DNA, 18 bp, Homo sapiens
attctggaggaagaagac

SEQ ID NO: 4212649 - DNA, 19 bp, Homo sapiens
attctggaggaagaagaca

SEQ ID NO: 4212650 - DNA, 14 bp, Homo sapiens
attcttggagaact

SEQ ID NO: 4212651 - DNA, 13 bp, Homo sapiens
attctttccctag

SEQ ID NO: 4212652 - DNA, 23 bp, Homo sapiens
attcttttggctttgaaacttgc

SEQ ID NO: 4212653 - DNA, 16 bp, Homo sapiens
attgaagaatgttaga

SEQ ID NO: 4212654 - DNA, 14 bp, Homo sapiens
attgctataaatcg

SEQ ID NO: 4212655 - DNA, 14 bp, Homo sapiens
attgtccagtttgt

SEQ ID NO: 4212656 - DNA, 20 bp, Homo sapiens
atttaaatcctgaagagcat

SEQ ID NO: 4212657 - DNA, 15 bp, Homo sapiens
atttaatttttgcaa

SEQ ID NO: 4212658 - DNA, 18 bp, Homo sapiens
atttacacatacaacttc

SEQ ID NO: 4212659 - DNA, 16 bp, Homo sapiens
atttataaggaaattt

SEQ ID NO: 4212660 - DNA, 22 bp, Homo sapiens
atttattgaaatgatttcacag

SEQ ID NO: 4212661 - DNA, 15 bp, Homo sapiens
atttctcatgttgaa

SEQ ID NO: 4212662 - DNA, 18 bp, Homo sapiens
atttcttacgtacactgt

SEQ ID NO: 4212663 - DNA, 15 bp, Homo sapiens
atttgatacatataa

SEQ ID NO: 4212664 - DNA, 19 bp, Homo sapiens
atttgattatttaagacta

SEQ ID NO: 4212665 - DNA, 11 bp, Homo sapiens
atttgccatta

SEQ ID NO: 4212666 - DNA, 12 bp, Homo sapiens
atttggaaaata

SEQ ID NO: 4212667 - DNA, 16 bp, Homo sapiens
atttgtcttcccttct

SEQ ID NO: 4212668 - DNA, 18 bp, Homo sapiens
attttaaagcctgaaaat

SEQ ID NO: 4212669 - DNA, 12 bp, Homo sapiens
attttgcagatt

SEQ ID NO: 4212670 - DNA, 14 bp, Homo sapiens
atttttaaatgttt

SEQ ID NO: 4212671 - DNA, 17 bp, Homo sapiens
atttttgcaattattct

SEQ ID NO: 4212672 - DNA, 17 bp, Homo sapiens
attttttatgtacaacc

SEQ ID NO: 4212673 - DNA, 16 bp, Homo sapiens
caaaaccccatctcta

SEQ ID NO: 4212674 - DNA, 15 bp, Homo sapiens
caaacccaaaggacc

SEQ ID NO: 4212675 - DNA, 12 bp, Homo sapiens
caaagtcattaa

SEQ ID NO: 4212676 - DNA, 16 bp, Homo sapiens
caaagtcattaaagac

SEQ ID NO: 4212677 - DNA, 18 bp, Homo sapiens
caaagttattccccatct

SEQ ID NO: 4212678 - DNA, 21 bp, Homo sapiens
caaatccatcctgctcttcca

SEQ ID NO: 4212679 - DNA, 19 bp, Homo sapiens
caaattcatgtacagcatg

SEQ ID NO: 4212680 - DNA, 23 bp, Homo sapiens
caaattccaaacttctaaatgtt

SEQ ID NO: 4212681 - DNA, 16 bp, Homo sapiens
caaatttaattttgca

SEQ ID NO: 4212682 - DNA, 13 bp, Homo sapiens
caacagagcaaga

SEQ ID NO: 4212683 - DNA, 22 bp, Homo sapiens
caacatttctcatgttgaaact

SEQ ID NO: 4212684 - DNA, 11 bp, Homo sapiens
caaccctgacc

SEQ ID NO: 4212685 - DNA, 19 bp, Homo sapiens
caactatgatttggaaaat

SEQ ID NO: 4212686 - DNA, 15 bp, Homo sapiens
caagaaaaggcatgg

SEQ ID NO: 4212687 - DNA, 19 bp, Homo sapiens
caagactccgtctcaaaaa

SEQ ID NO: 4212688 - DNA, 21 bp, Homo sapiens
caagactccgtctcaaaaaaa

SEQ ID NO: 4212689 - DNA, 22 bp, Homo sapiens
caagagttctttaggtgcctcc

SEQ ID NO: 4212690 - DNA, 23 bp, Homo sapiens
caagagttctttaggtgcctcct

SEQ ID NO: 4212691 - DNA, 17 bp, Homo sapiens
caagcacagttttaaga

SEQ ID NO: 4212692 - DNA, 16 bp, Homo sapiens
caagggcataaagtaa

SEQ ID NO: 4212693 - DNA, 15 bp, Homo sapiens
caataaatgccctct

SEQ ID NO: 4212694 - DNA, 15 bp, Homo sapiens
caatagattgtaata

SEQ ID NO: 4212695 - DNA, 12 bp, Homo sapiens
caatcttattac

SEQ ID NO: 4212696 - DNA, 21 bp, Homo sapiens
caatgtcccttgcacagccca

SEQ ID NO: 4212697 - DNA, 17 bp, Homo sapiens
caattatcttatttaat

SEQ ID NO: 4212698 - DNA, 13 bp, Homo sapiens
caattattctaat

SEQ ID NO: 4212699 - DNA, 19 bp, Homo sapiens
caattccacagtctctggg

SEQ ID NO: 4212700 - DNA, 22 bp, Homo sapiens
cacaagtaacagttgaagaaaa

SEQ ID NO: 4212701 - DNA, 17 bp, Homo sapiens
cacaatggaaactttag

SEQ ID NO: 4212702 - DNA, 13 bp, Homo sapiens
cacaatttatatt

SEQ ID NO: 4212703 - DNA, 22 bp, Homo sapiens
cacagacactaacgaaatatca

SEQ ID NO: 4212704 - DNA, 17 bp, Homo sapiens
cacagactacagccaga

SEQ ID NO: 4212705 - DNA, 15 bp, Homo sapiens
cacagatcaagtgaa

SEQ ID NO: 4212706 - DNA, 18 bp, Homo sapiens
cacagcaattcctcaggc

SEQ ID NO: 4212707 - DNA, 20 bp, Homo sapiens
cacaggagggagagaactta

SEQ ID NO: 4212708 - DNA, 21 bp, Homo sapiens
cacagtgtgtggtcaacattt

SEQ ID NO: 4212709 - DNA, 23 bp, Homo sapiens
cacagtgtgtggtcaacatttct

SEQ ID NO: 4212710 - DNA, 15 bp, Homo sapiens
cacatctgttttgta

SEQ ID NO: 4212711 - DNA, 21 bp, Homo sapiens
cacattaattagattttcttg

SEQ ID NO: 4212712 - DNA, 22 bp, Homo sapiens
cacattaattagattttcttgc

SEQ ID NO: 4212713 - DNA, 23 bp, Homo sapiens
cacattgaagaatgttagagtaa

SEQ ID NO: 4212714 - DNA, 22 bp, Homo sapiens
caccaaattcatgtacagcatg

SEQ ID NO: 4212715 - DNA, 17 bp, Homo sapiens
caccagaggtcaggagt

SEQ ID NO: 4212716 - DNA, 20 bp, Homo sapiens
caccagcatgtcactcccag

SEQ ID NO: 4212717 - DNA, 15 bp, Homo sapiens
cacctcactgaggaa

SEQ ID NO: 4212718 - DNA, 17 bp, Homo sapiens
cacctgaggctgaggca

SEQ ID NO: 4212719 - DNA, 22 bp, Homo sapiens
cacctgaggctgaggcaggaga

SEQ ID NO: 4212720 - DNA, 14 bp, Homo sapiens
cactccacactggc

SEQ ID NO: 4212721 - DNA, 23 bp, Homo sapiens
cactcctctgtctctgctcttgc

SEQ ID NO: 4212722 - DNA, 20 bp, Homo sapiens
cactctaggactctgcactg

SEQ ID NO: 4212723 - DNA, 18 bp, Homo sapiens
cactgccttccaggagca

SEQ ID NO: 4212724 - DNA, 14 bp, Homo sapiens
cactgttgataaaa

SEQ ID NO: 4212725 - DNA, 17 bp, Homo sapiens
cacttcttaatgctttc

SEQ ID NO: 4212726 - DNA, 19 bp, Homo sapiens
cagaaaatgtgtcagcatg

SEQ ID NO: 4212727 - DNA, 12 bp, Homo sapiens
cagaaattgcaa

SEQ ID NO: 4212728 - DNA, 23 bp, Homo sapiens
cagaagcccatggagcagggatg

SEQ ID NO: 4212729 - DNA, 19 bp, Homo sapiens
cagacactaacgaaatatc

SEQ ID NO: 4212730 - DNA, 19 bp, Homo sapiens
cagacagggcctagctttc

SEQ ID NO: 4212731 - DNA, 20 bp, Homo sapiens
cagactttttttaaatagta

SEQ ID NO: 4212732 - DNA, 22 bp, Homo sapiens
cagagacactgttgataaaaac

SEQ ID NO: 4212733 - DNA, 23 bp, Homo sapiens
cagagacactgttgataaaaact

SEQ ID NO: 4212734 - DNA, 12 bp, Homo sapiens
cagatgtaaaga

SEQ ID NO: 4212735 - DNA, 19 bp, Homo sapiens
cagcactcctctgtctctg

SEQ ID NO: 4212736 - DNA, 14 bp, Homo sapiens
cagcactttgggag

SEQ ID NO: 4212737 - DNA, 16 bp, Homo sapiens
cagccaaatccatcct

SEQ ID NO: 4212738 - DNA, 12 bp, Homo sapiens
cagccagaagtt

SEQ ID NO: 4212739 - DNA, 16 bp, Homo sapiens
cagcccagggcacttc

SEQ ID NO: 4212740 - DNA, 23 bp, Homo sapiens
cagcctccccctgtcccctctat

SEQ ID NO: 4212741 - DNA, 17 bp, Homo sapiens
cagccttctctctctgg

SEQ ID NO: 4212742 - DNA, 18 bp, Homo sapiens
cagccttctctctctggt

SEQ ID NO: 4212743 - DNA, 18 bp, Homo sapiens
cagctacacctgaggctg

SEQ ID NO: 4212744 - DNA, 19 bp, Homo sapiens
cagctggaattgctgctct

SEQ ID NO: 4212745 - DNA, 20 bp, Homo sapiens
cagctggaattgctgctctc

SEQ ID NO: 4212746 - DNA, 23 bp, Homo sapiens
cagcttcccctcgctgtcctgct

SEQ ID NO: 4212747 - DNA, 20 bp, Homo sapiens
cagcttttgccttggttctt

SEQ ID NO: 4212748 - DNA, 15 bp, Homo sapiens
caggactttccctga

SEQ ID NO: 4212749 - DNA, 16 bp, Homo sapiens
caggagcaatttgcac

SEQ ID NO: 4212750 - DNA, 18 bp, Homo sapiens
caggagggagagaactta

SEQ ID NO: 4212751 - DNA, 14 bp, Homo sapiens
caggattccaaagt

SEQ ID NO: 4212752 - DNA, 15 bp, Homo sapiens
caggattccaaagtt

SEQ ID NO: 4212753 - DNA, 16 bp, Homo sapiens
caggggctccacctgt

SEQ ID NO: 4212754 - DNA, 16 bp, Homo sapiens
caggttatgcctcatg

SEQ ID NO: 4212755 - DNA, 15 bp, Homo sapiens
cagtaagttatcttt

SEQ ID NO: 4212756 - DNA, 16 bp, Homo sapiens
cagtctctgggagact

SEQ ID NO: 4212757 - DNA, 19 bp, Homo sapiens
cagtctctgggagactttc

SEQ ID NO: 4212758 - DNA, 15 bp, Homo sapiens
cagtgcctattgata

SEQ ID NO: 4212759 - DNA, 18 bp, Homo sapiens
cagtgctgttctggagct

SEQ ID NO: 4212760 - DNA, 14 bp, Homo sapiens
cagttgttatttat

SEQ ID NO: 4212761 - DNA, 14 bp, Homo sapiens
cataaagtaaatac

SEQ ID NO: 4212762 - DNA, 15 bp, Homo sapiens
cataaagtaaataca

SEQ ID NO: 4212763 - DNA, 22 bp, Homo sapiens
cataaattatttgattatttaa

SEQ ID NO: 4212764 - DNA, 14 bp, Homo sapiens
cataatttaaaaat

SEQ ID NO: 4212765 - DNA, 14 bp, Homo sapiens
catacataaaagaa

SEQ ID NO: 4212766 - DNA, 18 bp, Homo sapiens
catacataaaagaaataa

SEQ ID NO: 4212767 - DNA, 12 bp, Homo sapiens
catataattctt

SEQ ID NO: 4212768 - DNA, 21 bp, Homo sapiens
catattataaaggataaagaa

SEQ ID NO: 4212769 - DNA, 22 bp, Homo sapiens
catattataaaggataaagaag

SEQ ID NO: 4212770 - DNA, 17 bp, Homo sapiens
catcaattttgtctatt

SEQ ID NO: 4212771 - DNA, 16 bp, Homo sapiens
catcccgctcctgctg

SEQ ID NO: 4212772 - DNA, 17 bp, Homo sapiens
catcccgctcctgctga

SEQ ID NO: 4212773 - DNA, 14 bp, Homo sapiens
catccttcccatga

SEQ ID NO: 4212774 - DNA, 15 bp, Homo sapiens
catctctactaaaaa

SEQ ID NO: 4212775 - DNA, 18 bp, Homo sapiens
catctgggaggctggtct

SEQ ID NO: 4212776 - DNA, 18 bp, Homo sapiens
catcttagctttccacag

SEQ ID NO: 4212777 - DNA, 23 bp, Homo sapiens
catgatgccgctcttctgtcatc

SEQ ID NO: 4212778 - DNA, 16 bp, Homo sapiens
cattacattgccattt

SEQ ID NO: 4212779 - DNA, 13 bp, Homo sapiens
cattagttttgaa

SEQ ID NO: 4212780 - DNA, 14 bp, Homo sapiens
cattatgttaatat

SEQ ID NO: 4212781 - DNA, 15 bp, Homo sapiens
cattatgttaatatt

SEQ ID NO: 4212782 - DNA, 22 bp, Homo sapiens
cattccccaattatcttattta

SEQ ID NO: 4212783 - DNA, 18 bp, Homo sapiens
cattcttactaaaaagta

SEQ ID NO: 4212784 - DNA, 20 bp, Homo sapiens
cattgagtttaagtctctga

SEQ ID NO: 4212785 - DNA, 23 bp, Homo sapiens
cattgagtttaagtctctgactc

SEQ ID NO: 4212786 - DNA, 20 bp, Homo sapiens
catttaatttttaaatgttt

SEQ ID NO: 4212787 - DNA, 14 bp, Homo sapiens
catttgtttgtgct

SEQ ID NO: 4212788 - DNA, 18 bp, Homo sapiens
cattttaaccctatttta

SEQ ID NO: 4212789 - DNA, 14 bp, Homo sapiens
cattttacgtcttt

SEQ ID NO: 4212790 - DNA, 14 bp, Homo sapiens
cattttctctagct

SEQ ID NO: 4212791 - DNA, 16 bp, Homo sapiens
ccaaattcactttatt

SEQ ID NO: 4212792 - DNA, 19 bp, Homo sapiens
ccaaatttatatgccaccg

SEQ ID NO: 4212793 - DNA, 21 bp, Homo sapiens
ccacaaacctggattttttat

SEQ ID NO: 4212794 - DNA, 15 bp, Homo sapiens
ccacagtctctggga

SEQ ID NO: 4212795 - DNA, 17 bp, Homo sapiens
ccacccatgaccttttt

SEQ ID NO: 4212796 - DNA, 12 bp, Homo sapiens
ccacctccctgc

SEQ ID NO: 4212797 - DNA, 13 bp, Homo sapiens
ccacctccctgcc

SEQ ID NO: 4212798 - DNA, 18 bp, Homo sapiens
ccacctgctttctcctgg

SEQ ID NO: 4212799 - DNA, 19 bp, Homo sapiens
ccacctgctttctcctggg

SEQ ID NO: 4212800 - DNA, 17 bp, Homo sapiens
ccacctgttcaggagct

SEQ ID NO: 4212801 - DNA, 18 bp, Homo sapiens
ccacctgttcaggagctg

SEQ ID NO: 4212802 - DNA, 14 bp, Homo sapiens
ccactgcagagatg

SEQ ID NO: 4212803 - DNA, 14 bp, Homo sapiens
ccagcactttggga

SEQ ID NO: 4212804 - DNA, 20 bp, Homo sapiens
ccagcactttgggaggctga

SEQ ID NO: 4212805 - DNA, 16 bp, Homo sapiens
ccagccttctctctct

SEQ ID NO: 4212806 - DNA, 15 bp, Homo sapiens
ccagctggaattgct

SEQ ID NO: 4212807 - DNA, 17 bp, Homo sapiens
ccagctgggttggaaaa

SEQ ID NO: 4212808 - DNA, 21 bp, Homo sapiens
ccagcttcccctcgctgtcct

SEQ ID NO: 4212809 - DNA, 17 bp, Homo sapiens
ccaggcaacttgggaac

SEQ ID NO: 4212810 - DNA, 22 bp, Homo sapiens
ccatattcacaatggaaacttt

SEQ ID NO: 4212811 - DNA, 14 bp, Homo sapiens
ccatgtcgcctgcc

SEQ ID NO: 4212812 - DNA, 18 bp, Homo sapiens
ccatgtcgcctgccccca

SEQ ID NO: 4212813 - DNA, 23 bp, Homo sapiens
ccatgtcgcctgcccccagcact

SEQ ID NO: 4212814 - DNA, 17 bp, Homo sapiens
cccaccagcatgtcact

SEQ ID NO: 4212815 - DNA, 21 bp, Homo sapiens
cccaccagcatgtcactccca

SEQ ID NO: 4212816 - DNA, 17 bp, Homo sapiens
cccagaccacctccctg

SEQ ID NO: 4212817 - DNA, 12 bp, Homo sapiens
cccagcactcct

SEQ ID NO: 4212818 - DNA, 13 bp, Homo sapiens
cccagccagaagt

SEQ ID NO: 4212819 - DNA, 18 bp, Homo sapiens
cccaggggctccacctgt

SEQ ID NO: 4212820 - DNA, 19 bp, Homo sapiens
cccatgatgccgctcttct

SEQ ID NO: 4212821 - DNA, 20 bp, Homo sapiens
cccatgatgccgctcttctg

SEQ ID NO: 4212822 - DNA, 17 bp, Homo sapiens
cccccagcactcctctg

SEQ ID NO: 4212823 - DNA, 20 bp, Homo sapiens
cccctcgctgtcctgctgtg

SEQ ID NO: 4212824 - DNA, 16 bp, Homo sapiens
cccgctcctgctgaaa

SEQ ID NO: 4212825 - DNA, 15 bp, Homo sapiens
cccgctttgcctgct

SEQ ID NO: 4212826 - DNA, 18 bp, Homo sapiens
ccctcactccacactggc

SEQ ID NO: 4212827 - DNA, 13 bp, Homo sapiens
ccctccagctgga

SEQ ID NO: 4212828 - DNA, 16 bp, Homo sapiens
ccctcgctgtcctgct

SEQ ID NO: 4212829 - DNA, 13 bp, Homo sapiens
ccctctcttgcct

SEQ ID NO: 4212830 - DNA, 15 bp, Homo sapiens
ccctgaggtcacctg

SEQ ID NO: 4212831 - DNA, 13 bp, Homo sapiens
ccctgccctgtcc

SEQ ID NO: 4212832 - DNA, 15 bp, Homo sapiens
ccctgccctgtcctc

SEQ ID NO: 4212833 - DNA, 17 bp, Homo sapiens
ccctgccctgtcctcca

SEQ ID NO: 4212834 - DNA, 17 bp, Homo sapiens
ccctgctcccacagaac

SEQ ID NO: 4212835 - DNA, 20 bp, Homo sapiens
ccctggagcggctctcctga

SEQ ID NO: 4212836 - DNA, 24 bp, Homo sapiens
cctaagaggcgacttcctctccag

SEQ ID NO: 4212837 - DNA, 14 bp, Homo sapiens
cctactttgcttct

SEQ ID NO: 4212838 - DNA, 21 bp, Homo sapiens
cctagaggcaaacatttctta

SEQ ID NO: 4212839 - DNA, 17 bp, Homo sapiens
cctagtggcttcctccg

SEQ ID NO: 4212840 - DNA, 16 bp, Homo sapiens
cctagttccccgtgaa

SEQ ID NO: 4212841 - DNA, 22 bp, Homo sapiens
cctcaacattggagacatcact

SEQ ID NO: 4212842 - DNA, 19 bp, Homo sapiens
cctcactgccttccaggag

SEQ ID NO: 4212843 - DNA, 16 bp, Homo sapiens
cctccaattccacagt

SEQ ID NO: 4212844 - DNA, 12 bp, Homo sapiens
cctccagctgga

SEQ ID NO: 4212845 - DNA, 19 bp, Homo sapiens
cctcccaggggctccacct

SEQ ID NO: 4212846 - DNA, 15 bp, Homo sapiens
cctccgtctgcaatg

SEQ ID NO: 4212847 - DNA, 16 bp, Homo sapiens
cctccgtctgcaatgt

SEQ ID NO: 4212848 - DNA, 16 bp, Homo sapiens
cctcgctgtcctgctg

SEQ ID NO: 4212849 - DNA, 17 bp, Homo sapiens
cctcgctgtcctgctgt

SEQ ID NO: 4212850 - DNA, 22 bp, Homo sapiens
cctctccagccttctctctctg

SEQ ID NO: 4212851 - DNA, 13 bp, Homo sapiens
cctctctgaatgt

SEQ ID NO: 4212852 - DNA, 12 bp, Homo sapiens
cctctcttgcct

SEQ ID NO: 4212853 - DNA, 15 bp, Homo sapiens
cctctcttgcctttc

SEQ ID NO: 4212854 - DNA, 15 bp, Homo sapiens
cctctgtctctgctc

SEQ ID NO: 4212855 - DNA, 14 bp, Homo sapiens
cctgaaaattccaa

SEQ ID NO: 4212856 - DNA, 15 bp, Homo sapiens
cctgaggtcacctgg

SEQ ID NO: 4212857 - DNA, 17 bp, Homo sapiens
cctgcccccagcactcc

SEQ ID NO: 4212858 - DNA, 18 bp, Homo sapiens
cctgcccccagcactcct

SEQ ID NO: 4212859 - DNA, 13 bp, Homo sapiens
cctgctcttccat

SEQ ID NO: 4212860 - DNA, 19 bp, Homo sapiens
cctgctgaaacacctccca

SEQ ID NO: 4212861 - DNA, 20 bp, Homo sapiens
cctgctgaaacacctcccag

SEQ ID NO: 4212862 - DNA, 22 bp, Homo sapiens
cctggaaggacatccatgttcc

SEQ ID NO: 4212863 - DNA, 20 bp, Homo sapiens
cctggattttttatgtacaa

SEQ ID NO: 4212864 - DNA, 23 bp, Homo sapiens
cctggattttttatgtacaaccc

SEQ ID NO: 4212865 - DNA, 21 bp, Homo sapiens
cctggtggccatgtcgcctgc

SEQ ID NO: 4212866 - DNA, 22 bp, Homo sapiens
cctgtaatcccagctacacctg

SEQ ID NO: 4212867 - DNA, 15 bp, Homo sapiens
cctgtcctccagctt

SEQ ID NO: 4212868 - DNA, 18 bp, Homo sapiens
ccttcccatgatgccgct

SEQ ID NO: 4212869 - DNA, 19 bp, Homo sapiens
ccttcccatgatgccgctc

SEQ ID NO: 4212870 - DNA, 17 bp, Homo sapiens
ccttggttcttcctagt

SEQ ID NO: 4212871 - DNA, 15 bp, Homo sapiens
cctttccacctgctt

SEQ ID NO: 4212872 - DNA, 16 bp, Homo sapiens
cgaattttattttaca

SEQ ID NO: 4212873 - DNA, 21 bp, Homo sapiens
cgagtttgggccactgcactc

SEQ ID NO: 4212874 - DNA, 17 bp, Homo sapiens
cgcctgtaatcccagct

SEQ ID NO: 4212875 - DNA, 16 bp, Homo sapiens
cgcgacttccacaaac

SEQ ID NO: 4212876 - DNA, 14 bp, Homo sapiens
cgctgtcctgctgt

SEQ ID NO: 4212877 - DNA, 12 bp, Homo sapiens
cgctttgcctgc

SEQ ID NO: 4212878 - DNA, 15 bp, Homo sapiens
ctaaaaagtataaaa

SEQ ID NO: 4212879 - DNA, 16 bp, Homo sapiens
ctaaaaagtataaaat

SEQ ID NO: 4212880 - DNA, 21 bp, Homo sapiens
ctaaagaaggtttcagaaaga

SEQ ID NO: 4212881 - DNA, 23 bp, Homo sapiens
ctaagaggcgacttcctctccag

SEQ ID NO: 4212882 - DNA, 14 bp, Homo sapiens
ctaagttcccttct

SEQ ID NO: 4212883 - DNA, 14 bp, Homo sapiens
ctaattatttaatt

SEQ ID NO: 4212884 - DNA, 16 bp, Homo sapiens
ctacaatgggaaaact

SEQ ID NO: 4212885 - DNA, 18 bp, Homo sapiens
ctacaatgggaaaacttc

SEQ ID NO: 4212886 - DNA, 15 bp, Homo sapiens
ctacagccagaagcc

SEQ ID NO: 4212887 - DNA, 19 bp, Homo sapiens
ctactaattgagccattta

SEQ ID NO: 4212888 - DNA, 12 bp, Homo sapiens
ctagtccttgtt

SEQ ID NO: 4212889 - DNA, 21 bp, Homo sapiens
ctagttccccgtgaacttcct

SEQ ID NO: 4212890 - DNA, 19 bp, Homo sapiens
ctatgatttggaaaataaa

SEQ ID NO: 4212891 - DNA, 14 bp, Homo sapiens
ctatgttaatattt

SEQ ID NO: 4212892 - DNA, 15 bp, Homo sapiens
ctatgttaatatttt

SEQ ID NO: 4212893 - DNA, 21 bp, Homo sapiens
ctatgttaatattttaggtgt

SEQ ID NO: 4212894 - DNA, 21 bp, Homo sapiens
ctattagatgttttacaaatt

SEQ ID NO: 4212895 - DNA, 16 bp, Homo sapiens
ctattgaacctaggac

SEQ ID NO: 4212896 - DNA, 19 bp, Homo sapiens
ctattgaacctaggacttg

SEQ ID NO: 4212897 - DNA, 16 bp, Homo sapiens
ctcactccacactggc

SEQ ID NO: 4212898 - DNA, 16 bp, Homo sapiens
ctcactgaggaaggga

SEQ ID NO: 4212899 - DNA, 18 bp, Homo sapiens
ctcactgaggaagggaga

SEQ ID NO: 4212900 - DNA, 18 bp, Homo sapiens
ctcagcctcccaaagtgc

SEQ ID NO: 4212901 - DNA, 20 bp, Homo sapiens
ctcagcctcccaaagtgctg

SEQ ID NO: 4212902 - DNA, 18 bp, Homo sapiens
ctcatgctgacttgcaga

SEQ ID NO: 4212903 - DNA, 16 bp, Homo sapiens
ctccaaagagaaacct

SEQ ID NO: 4212904 - DNA, 15 bp, Homo sapiens
ctccaattccacagt

SEQ ID NO: 4212905 - DNA, 21 bp, Homo sapiens
ctccaattccacagtctctgg

SEQ ID NO: 4212906 - DNA, 20 bp, Homo sapiens
ctccagctggaattgctgct

SEQ ID NO: 4212907 - DNA, 14 bp, Homo sapiens
ctccatttctggct

SEQ ID NO: 4212908 - DNA, 16 bp, Homo sapiens
ctcccagaccacctcc

SEQ ID NO: 4212909 - DNA, 19 bp, Homo sapiens
ctcccaggggctccacctg

SEQ ID NO: 4212910 - DNA, 14 bp, Homo sapiens
ctccctgccctgtc

SEQ ID NO: 4212911 - DNA, 21 bp, Homo sapiens
ctccctgccctgtcctccagc

SEQ ID NO: 4212912 - DNA, 15 bp, Homo sapiens
ctcctaaacaaaaac

SEQ ID NO: 4212913 - DNA, 14 bp, Homo sapiens
ctcctcctttgcct

SEQ ID NO: 4212914 - DNA, 20 bp, Homo sapiens
ctcctcctttgcctaggagg

SEQ ID NO: 4212915 - DNA, 23 bp, Homo sapiens
ctcctctgtctctgctcttgcct

SEQ ID NO: 4212916 - DNA, 20 bp, Homo sapiens
ctcctgagaggtgctgcagg

SEQ ID NO: 4212917 - DNA, 22 bp, Homo sapiens
ctcctgctgaaacacctcccag

SEQ ID NO: 4212918 - DNA, 23 bp, Homo sapiens
ctcctgctgaaacacctcccagg

SEQ ID NO: 4212919 - DNA, 20 bp, Homo sapiens
ctcctgggcccgctttgcct

SEQ ID NO: 4212920 - DNA, 15 bp, Homo sapiens
ctcgctgtcctgctg

SEQ ID NO: 4212921 - DNA, 21 bp, Homo sapiens
ctctccagccttctctctctg

SEQ ID NO: 4212922 - DNA, 22 bp, Homo sapiens
ctctccagccttctctctctgg

SEQ ID NO: 4212923 - DNA, 17 bp, Homo sapiens
ctctcctgagaggtgct

SEQ ID NO: 4212924 - DNA, 18 bp, Homo sapiens
ctctcctgagaggtgctg

SEQ ID NO: 4212925 - DNA, 13 bp, Homo sapiens
ctctcttgccttt

SEQ ID NO: 4212926 - DNA, 14 bp, Homo sapiens
ctctgctcttgcct

SEQ ID NO: 4212927 - DNA, 20 bp, Homo sapiens
ctctggtcaggcccactgca

SEQ ID NO: 4212928 - DNA, 17 bp, Homo sapiens
ctctgtccctcactgcc

SEQ ID NO: 4212929 - DNA, 10 bp, Homo sapiens
ctctgtctct

SEQ ID NO: 4212930 - DNA, 20 bp, Homo sapiens
ctctgtgcacttatttatga

SEQ ID NO: 4212931 - DNA, 17 bp, Homo sapiens
ctcttccatttcttcca

SEQ ID NO: 4212932 - DNA, 20 bp, Homo sapiens
ctcttccatttcttccacga

SEQ ID NO: 4212933 - DNA, 20 bp, Homo sapiens
ctcttgcctgcacccttcct

SEQ ID NO: 4212934 - DNA, 21 bp, Homo sapiens
ctcttgcctgcacccttcctc

SEQ ID NO: 4212935 - DNA, 23 bp, Homo sapiens
ctcttgcctgcacccttcctcct

SEQ ID NO: 4212936 - DNA, 10 bp, Homo sapiens
ctcttgcctt

SEQ ID NO: 4212937 - DNA, 20 bp, Homo sapiens
ctcttgcctttccacctgct

SEQ ID NO: 4212938 - DNA, 13 bp, Homo sapiens
ctgaaaattccaa

SEQ ID NO: 4212939 - DNA, 17 bp, Homo sapiens
ctgaaacacctcccagg

SEQ ID NO: 4212940 - DNA, 18 bp, Homo sapiens
ctgaaacacctcccaggg

SEQ ID NO: 4212941 - DNA, 12 bp, Homo sapiens
ctgaagagcatt

SEQ ID NO: 4212942 - DNA, 19 bp, Homo sapiens
ctgacacctcactgaggaa

SEQ ID NO: 4212943 - DNA, 21 bp, Homo sapiens
ctgaccctggagcggctctcc

SEQ ID NO: 4212944 - DNA, 11 bp, Homo sapiens
ctgaccgtgac

SEQ ID NO: 4212945 - DNA, 16 bp, Homo sapiens
ctgactcttgcctttc

SEQ ID NO: 4212946 - DNA, 19 bp, Homo sapiens
ctgactgtgttgtcccagg

SEQ ID NO: 4212947 - DNA, 17 bp, Homo sapiens
ctgagaggtgctgcagg

SEQ ID NO: 4212948 - DNA, 18 bp, Homo sapiens
ctgagagtgcaaattgta

SEQ ID NO: 4212949 - DNA, 15 bp, Homo sapiens
ctgaggctgaggcag

SEQ ID NO: 4212950 - DNA, 15 bp, Homo sapiens
ctgaggtcacctgga

SEQ ID NO: 4212951 - DNA, 22 bp, Homo sapiens
ctgattcttgttgctgtacaaa

SEQ ID NO: 4212952 - DNA, 19 bp, Homo sapiens
ctgcaacttgtaaatgtgg

SEQ ID NO: 4212953 - DNA, 14 bp, Homo sapiens
ctgcacccttcctc

SEQ ID NO: 4212954 - DNA, 16 bp, Homo sapiens
ctgcacccttcctcct

SEQ ID NO: 4212955 - DNA, 20 bp, Homo sapiens
ctgcacccttcctcctcctt

SEQ ID NO: 4212956 - DNA, 13 bp, Homo sapiens
ctgcactctagcc

SEQ ID NO: 4212957 - DNA, 20 bp, Homo sapiens
ctgcactgaatggctgacct

SEQ ID NO: 4212958 - DNA, 15 bp, Homo sapiens
ctgcatttaaaaaaa

SEQ ID NO: 4212959 - DNA, 23 bp, Homo sapiens
ctgcattttacgtctttggagga

SEQ ID NO: 4212960 - DNA, 11 bp, Homo sapiens
ctgccaagaaa

SEQ ID NO: 4212961 - DNA, 16 bp, Homo sapiens
ctgccctgtcctccag

SEQ ID NO: 4212962 - DNA, 17 bp, Homo sapiens
ctgccctgtcctccagc

SEQ ID NO: 4212963 - DNA, 22 bp, Homo sapiens
ctgccctgtcctccagcttccc

SEQ ID NO: 4212964 - DNA, 17 bp, Homo sapiens
ctgctctcatataagac

SEQ ID NO: 4212965 - DNA, 15 bp, Homo sapiens
ctgctctctgaggga

SEQ ID NO: 4212966 - DNA, 20 bp, Homo sapiens
ctgctcttccatttcttcca

SEQ ID NO: 4212967 - DNA, 13 bp, Homo sapiens
ctgctcttgcctg

SEQ ID NO: 4212968 - DNA, 20 bp, Homo sapiens
ctgctgtgtgaattcccagg

SEQ ID NO: 4212969 - DNA, 13 bp, Homo sapiens
ctgctttggaaat

SEQ ID NO: 4212970 - DNA, 15 bp, Homo sapiens
ctggaggaagaagac

SEQ ID NO: 4212971 - DNA, 14 bp, Homo sapiens
ctggataaattgta

SEQ ID NO: 4212972 - DNA, 19 bp, Homo sapiens
ctggcatgaccatcctgtc

SEQ ID NO: 4212973 - DNA, 16 bp, Homo sapiens
ctgggaggctggtctc

SEQ ID NO: 4212974 - DNA, 22 bp, Homo sapiens
ctgggattacaggcttgaaagt

SEQ ID NO: 4212975 - DNA, 18 bp, Homo sapiens
ctgggcccgctttgcctg

SEQ ID NO: 4212976 - DNA, 14 bp, Homo sapiens
ctggtctccctcca

SEQ ID NO: 4212977 - DNA, 16 bp, Homo sapiens
ctggtctccctccagc

SEQ ID NO: 4212978 - DNA, 20 bp, Homo sapiens
ctggtttagcacaatttata

SEQ ID NO: 4212979 - DNA, 15 bp, Homo sapiens
ctgtacaaaagcaat

SEQ ID NO: 4212980 - DNA, 17 bp, Homo sapiens
ctgtacttattttccaa

SEQ ID NO: 4212981 - DNA, 17 bp, Homo sapiens
ctgtattagtcacagag

SEQ ID NO: 4212982 - DNA, 19 bp, Homo sapiens
ctgtattagtcacagagat

SEQ ID NO: 4212983 - DNA, 16 bp, Homo sapiens
ctgtcatccagaaaat

SEQ ID NO: 4212984 - DNA, 18 bp, Homo sapiens
ctgtcatccagaaaatgt

SEQ ID NO: 4212985 - DNA, 19 bp, Homo sapiens
ctgtcatcccgctcctgct

SEQ ID NO: 4212986 - DNA, 20 bp, Homo sapiens
ctgtcatcccgctcctgctg

SEQ ID NO: 4212987 - DNA, 15 bp, Homo sapiens
ctgtcctattatatt

SEQ ID NO: 4212988 - DNA, 14 bp, Homo sapiens
ctgtcctccagctt

SEQ ID NO: 4212989 - DNA, 14 bp, Homo sapiens
ctgtctctgctctt

SEQ ID NO: 4212990 - DNA, 20 bp, Homo sapiens
ctgtctctgctcttgcctgc

SEQ ID NO: 4212991 - DNA, 17 bp, Homo sapiens
ctgtggtggctgtctct

SEQ ID NO: 4212992 - DNA, 20 bp, Homo sapiens
ctgttattgccaatgttcct

SEQ ID NO: 4212993 - DNA, 15 bp, Homo sapiens
ctgttcaggagctga

SEQ ID NO: 4212994 - DNA, 19 bp, Homo sapiens
ctgttctggagctgctgtt

SEQ ID NO: 4212995 - DNA, 14 bp, Homo sapiens
ctgttgataaaaac

SEQ ID NO: 4212996 - DNA, 15 bp, Homo sapiens
ctgttgataaaaact

SEQ ID NO: 4212997 - DNA, 18 bp, Homo sapiens
cttaagaattttgagcag

SEQ ID NO: 4212998 - DNA, 18 bp, Homo sapiens
cttaattaaaaattactg

SEQ ID NO: 4212999 - DNA, 18 bp, Homo sapiens
cttactaaaaagtataaa

SEQ ID NO: 4213000 - DNA, 14 bp, Homo sapiens
cttagctttccaca

SEQ ID NO: 4213001 - DNA, 16 bp, Homo sapiens
cttagctttccacagg

SEQ ID NO: 4213002 - DNA, 17 bp, Homo sapiens
cttagttaagtcatcca

SEQ ID NO: 4213003 - DNA, 20 bp, Homo sapiens
cttataaagtggaagtatgt

SEQ ID NO: 4213004 - DNA, 24 bp, Homo sapiens
cttataaagtggaagtatgtatat

SEQ ID NO: 4213005 - DNA, 21 bp, Homo sapiens
cttattactgagagtgcaaat

SEQ ID NO: 4213006 - DNA, 22 bp, Homo sapiens
cttattactgagagtgcaaatt

SEQ ID NO: 4213007 - DNA, 15 bp, Homo sapiens
cttattgtccccact

SEQ ID NO: 4213008 - DNA, 19 bp, Homo sapiens
cttatttaatttttgcaat

SEQ ID NO: 4213009 - DNA, 15 bp, Homo sapiens
cttccaaataaataa

SEQ ID NO: 4213010 - DNA, 19 bp, Homo sapiens
cttccaagggttgaattct

SEQ ID NO: 4213011 - DNA, 21 bp, Homo sapiens
cttccacattaattagatttt

SEQ ID NO: 4213012 - DNA, 21 bp, Homo sapiens
cttccaggagcaatttgcaca

SEQ ID NO: 4213013 - DNA, 17 bp, Homo sapiens
cttcccctcgctgtcct

SEQ ID NO: 4213014 - DNA, 23 bp, Homo sapiens
cttcccctcgctgtcctgctgtg

SEQ ID NO: 4213015 - DNA, 12 bp, Homo sapiens
cttcccttcttt

SEQ ID NO: 4213016 - DNA, 20 bp, Homo sapiens
cttcctaagttcccttctat

SEQ ID NO: 4213017 - DNA, 17 bp, Homo sapiens
cttcctactttgcttct

SEQ ID NO: 4213018 - DNA, 18 bp, Homo sapiens
cttcctccgtctgcaatg

SEQ ID NO: 4213019 - DNA, 16 bp, Homo sapiens
cttcctcctcctttgc

SEQ ID NO: 4213020 - DNA, 13 bp, Homo sapiens
cttcctctccagc

SEQ ID NO: 4213021 - DNA, 14 bp, Homo sapiens
cttcctctccagcc

SEQ ID NO: 4213022 - DNA, 18 bp, Homo sapiens
cttctcgcattttctcta

SEQ ID NO: 4213023 - DNA, 13 bp, Homo sapiens
cttctctctctgg

SEQ ID NO: 4213024 - DNA, 14 bp, Homo sapiens
cttctgtcatcccg

SEQ ID NO: 4213025 - DNA, 21 bp, Homo sapiens
cttgcctgcacccttcctcct

SEQ ID NO: 4213026 - DNA, 22 bp, Homo sapiens
cttgcctttccacctgctttct

SEQ ID NO: 4213027 - DNA, 17 bp, Homo sapiens
cttgcctttcttatttg

SEQ ID NO: 4213028 - DNA, 18 bp, Homo sapiens
cttggacattttatgtct

SEQ ID NO: 4213029 - DNA, 18 bp, Homo sapiens
cttggagaactttccatc

SEQ ID NO: 4213030 - DNA, 17 bp, Homo sapiens
ctttaggtgcctcctgt

SEQ ID NO: 4213031 - DNA, 21 bp, Homo sapiens
ctttcatctattctttcccta

SEQ ID NO: 4213032 - DNA, 14 bp, Homo sapiens
ctttccacaggagg

SEQ ID NO: 4213033 - DNA, 22 bp, Homo sapiens
ctttccacctgctttctcctgg

SEQ ID NO: 4213034 - DNA, 13 bp, Homo sapiens
ctttccatctgct

SEQ ID NO: 4213035 - DNA, 15 bp, Homo sapiens
ctttccatctgcttg

SEQ ID NO: 4213036 - DNA, 23 bp, Homo sapiens
ctttccctaagaggcgacttcct

SEQ ID NO: 4213037 - DNA, 20 bp, Homo sapiens
ctttccctagaggcaaacat

SEQ ID NO: 4213038 - DNA, 20 bp, Homo sapiens
ctttctcttttcctctacca

SEQ ID NO: 4213039 - DNA, 19 bp, Homo sapiens
ctttgaaacttgcaacttt

SEQ ID NO: 4213040 - DNA, 15 bp, Homo sapiens
ctttgcatattataa

SEQ ID NO: 4213041 - DNA, 12 bp, Homo sapiens
ctttgcctgctt

SEQ ID NO: 4213042 - DNA, 15 bp, Homo sapiens
ctttgcttctctcca

SEQ ID NO: 4213043 - DNA, 14 bp, Homo sapiens
ctttggtccttcaa

SEQ ID NO: 4213044 - DNA, 18 bp, Homo sapiens
ctttgtattataaaattt

SEQ ID NO: 4213045 - DNA, 17 bp, Homo sapiens
cttttaaaaaggcagta

SEQ ID NO: 4213046 - DNA, 16 bp, Homo sapiens
cttttaatgccttcca

SEQ ID NO: 4213047 - DNA, 23 bp, Homo sapiens
cttttggcaatgactcaaagtct

SEQ ID NO: 4213048 - DNA, 13 bp, Homo sapiens
ctttttattaaaa

SEQ ID NO: 4213049 - DNA, 22 bp, Homo sapiens
ctttttttctctgcatttaaaa

SEQ ID NO: 4213050 - DNA, 23 bp, Homo sapiens
gaaaaactcttctactttcatct

SEQ ID NO: 4213051 - DNA, 19 bp, Homo sapiens
gaaaactgcaacttgtaaa

SEQ ID NO: 4213052 - DNA, 17 bp, Homo sapiens
gaaaacttcactccaaa

SEQ ID NO: 4213053 - DNA, 20 bp, Homo sapiens
gaaaacttcactccaaagag

SEQ ID NO: 4213054 - DNA, 18 bp, Homo sapiens
gaaaatgaaatgcatatt

SEQ ID NO: 4213055 - DNA, 11 bp, Homo sapiens
gaaaattccaa

SEQ ID NO: 4213056 - DNA, 12 bp, Homo sapiens
gaaaattccaat

SEQ ID NO: 4213057 - DNA, 16 bp, Homo sapiens
gaaacacctcccaggg

SEQ ID NO: 4213058 - DNA, 17 bp, Homo sapiens
gaaacacctcccagggg

SEQ ID NO: 4213059 - DNA, 20 bp, Homo sapiens
gaaacctattaagtcatcat

SEQ ID NO: 4213060 - DNA, 16 bp, Homo sapiens
gaaatatcaaagtcat

SEQ ID NO: 4213061 - DNA, 21 bp, Homo sapiens
gaaatgtgatttgtcttccct

SEQ ID NO: 4213062 - DNA, 20 bp, Homo sapiens
gaacaaagggattctccagg

SEQ ID NO: 4213063 - DNA, 18 bp, Homo sapiens
gaacaagcttcagtaagt

SEQ ID NO: 4213064 - DNA, 16 bp, Homo sapiens
gaacaccaacttttat

SEQ ID NO: 4213065 - DNA, 17 bp, Homo sapiens
gaacaccaacttttatt

SEQ ID NO: 4213066 - DNA, 23 bp, Homo sapiens
gaacattacattgccatttttaa

SEQ ID NO: 4213067 - DNA, 21 bp, Homo sapiens
gaagaaaaaatggcaagagat

SEQ ID NO: 4213068 - DNA, 16 bp, Homo sapiens
gaagaccgaattttat

SEQ ID NO: 4213069 - DNA, 14 bp, Homo sapiens
gaagagtttgcaaa

SEQ ID NO: 4213070 - DNA, 15 bp, Homo sapiens
gaagatcttttaaaa

SEQ ID NO: 4213071 - DNA, 16 bp, Homo sapiens
gaagcccatgctttcc

SEQ ID NO: 4213072 - DNA, 15 bp, Homo sapiens
gaaggtagaatgttt

SEQ ID NO: 4213073 - DNA, 16 bp, Homo sapiens
gaaggtagaatgtttt

SEQ ID NO: 4213074 - DNA, 21 bp, Homo sapiens
gaagtatgtatattaaaaaag

SEQ ID NO: 4213075 - DNA, 16 bp, Homo sapiens
gaagtgtttatgttgt

SEQ ID NO: 4213076 - DNA, 16 bp, Homo sapiens
gaatattactggataa

SEQ ID NO: 4213077 - DNA, 23 bp, Homo sapiens
gaatattttgttttgtgcagaga

SEQ ID NO: 4213078 - DNA, 15 bp, Homo sapiens
gaatcagattattaa

SEQ ID NO: 4213079 - DNA, 21 bp, Homo sapiens
gaatgtcagttgttatttatt

SEQ ID NO: 4213080 - DNA, 22 bp, Homo sapiens
gaatgtttgaactgccaagaaa

SEQ ID NO: 4213081 - DNA, 17 bp, Homo sapiens
gaatgttttcaaatgtt

SEQ ID NO: 4213082 - DNA, 12 bp, Homo sapiens
gaattcccaggt

SEQ ID NO: 4213083 - DNA, 14 bp, Homo sapiens
gaattctggaggaa

SEQ ID NO: 4213084 - DNA, 13 bp, Homo sapiens
gaattgctgctct

SEQ ID NO: 4213085 - DNA, 14 bp, Homo sapiens
gaattgctgctctc

SEQ ID NO: 4213086 - DNA, 21 bp, Homo sapiens
gacaaagttatatatttataa

SEQ ID NO: 4213087 - DNA, 23 bp, Homo sapiens
gacatccatgttccgagaagaac

SEQ ID NO: 4213088 - DNA, 23 bp, Homo sapiens
gaccacctccctgccctgtcctc

SEQ ID NO: 4213089 - DNA, 17 bp, Homo sapiens
gaccaggtggaattact

SEQ ID NO: 4213090 - DNA, 13 bp, Homo sapiens
gaccatcctgtcc

SEQ ID NO: 4213091 - DNA, 15 bp, Homo sapiens
gaccatcctgtcctt

SEQ ID NO: 4213092 - DNA, 18 bp, Homo sapiens
gacggaggttgcagtgag

SEQ ID NO: 4213093 - DNA, 14 bp, Homo sapiens
gactcttgcctttc

SEQ ID NO: 4213094 - DNA, 21 bp, Homo sapiens
gactcttgcctttccacctgc

SEQ ID NO: 4213095 - DNA, 16 bp, Homo sapiens
gactgacacctcactg

SEQ ID NO: 4213096 - DNA, 20 bp, Homo sapiens
gacttgagcctccatttctg

SEQ ID NO: 4213097 - DNA, 19 bp, Homo sapiens
gacttttggtttttatatt

SEQ ID NO: 4213098 - DNA, 20 bp, Homo sapiens
gagaagtcttctatttattt

SEQ ID NO: 4213099 - DNA, 16 bp, Homo sapiens
gagagcataatttaaa

SEQ ID NO: 4213100 - DNA, 17 bp, Homo sapiens
gagatcatatcctcaga

SEQ ID NO: 4213101 - DNA, 12 bp, Homo sapiens
gagcaaacttta

SEQ ID NO: 4213102 - DNA, 17 bp, Homo sapiens
gagcataatttaaaaat

SEQ ID NO: 4213103 - DNA, 20 bp, Homo sapiens
gagcataatttaaaaatata

SEQ ID NO: 4213104 - DNA, 19 bp, Homo sapiens
gagccatttaatttttaaa

SEQ ID NO: 4213105 - DNA, 15 bp, Homo sapiens
gagcctccatttctg

SEQ ID NO: 4213106 - DNA, 14 bp, Homo sapiens
gagcggctctcctg

SEQ ID NO: 4213107 - DNA, 24 bp, Homo sapiens
gagctgctgttccaacagacaggg

SEQ ID NO: 4213108 - DNA, 11 bp, Homo sapiens
gaggaacagct

SEQ ID NO: 4213109 - DNA, 17 bp, Homo sapiens
gaggcgacttcctctcc

SEQ ID NO: 4213110 - DNA, 19 bp, Homo sapiens
gaggttgcagtgagccgag

SEQ ID NO: 4213111 - DNA, 20 bp, Homo sapiens
gagtctaggaatgcttttat

SEQ ID NO: 4213112 - DNA, 20 bp, Homo sapiens
gagttctttaggtgcctcct

SEQ ID NO: 4213113 - DNA, 22 bp, Homo sapiens
gagttctttaggtgcctcctgt

SEQ ID NO: 4213114 - DNA, 17 bp, Homo sapiens
gataaccatattcacaa

SEQ ID NO: 4213115 - DNA, 15 bp, Homo sapiens
gatagtatttataat

SEQ ID NO: 4213116 - DNA, 17 bp, Homo sapiens
gatattcagatgtatgt

SEQ ID NO: 4213117 - DNA, 21 bp, Homo sapiens
gatcaatagattgtaatacac

SEQ ID NO: 4213118 - DNA, 14 bp, Homo sapiens
gatcagaattttac

SEQ ID NO: 4213119 - DNA, 16 bp, Homo sapiens
gatccttcctactttg

SEQ ID NO: 4213120 - DNA, 22 bp, Homo sapiens
gatcggccatcaagggaagaac

SEQ ID NO: 4213121 - DNA, 20 bp, Homo sapiens
gatcttttaaaaaggcagta

SEQ ID NO: 4213122 - DNA, 15 bp, Homo sapiens
gatgcacatccctgg

SEQ ID NO: 4213123 - DNA, 16 bp, Homo sapiens
gatgcacatccctgga

SEQ ID NO: 4213124 - DNA, 15 bp, Homo sapiens
gatgccgctcttctg

SEQ ID NO: 4213125 - DNA, 16 bp, Homo sapiens
gatgtctttttattaa

SEQ ID NO: 4213126 - DNA, 20 bp, Homo sapiens
gattattttagtctgtcatc

SEQ ID NO: 4213127 - DNA, 21 bp, Homo sapiens
gattattttagtctgtcatcc

SEQ ID NO: 4213128 - DNA, 14 bp, Homo sapiens
gttttacagtgttt

SEQ ID NO: 4213129 - DNA, 20 bp, Homo sapiens
gttttgaagattctatgtta

SEQ ID NO: 4213130 - DNA, 20 bp, Homo sapiens
taaaaactcaggcaaagaaa

SEQ ID NO: 4213131 - DNA, 19 bp, Homo sapiens
taaaaagtataaaatagta

SEQ ID NO: 4213132 - DNA, 17 bp, Homo sapiens
taaaaatagttaacaca

SEQ ID NO: 4213133 - DNA, 12 bp, Homo sapiens
taaaaattgtta

SEQ ID NO: 4213134 - DNA, 13 bp, Homo sapiens
taaaaggtattga

SEQ ID NO: 4213135 - DNA, 12 bp, Homo sapiens
taaaattgttat

SEQ ID NO: 4213136 - DNA, 22 bp, Homo sapiens
taaacaaaaacacattgagttt

SEQ ID NO: 4213137 - DNA, 14 bp, Homo sapiens
taaagaaggtttca

SEQ ID NO: 4213138 - DNA, 23 bp, Homo sapiens
taaagacaggagacaaaagagca

SEQ ID NO: 4213139 - DNA, 18 bp, Homo sapiens
taaagagttagtttgagt

SEQ ID NO: 4213140 - DNA, 20 bp, Homo sapiens
taaagcctgaaaattccaat

SEQ ID NO: 4213141 - DNA, 14 bp, Homo sapiens
taaagctgaaaact

SEQ ID NO: 4213142 - DNA, 13 bp, Homo sapiens
taaagtaaataca

SEQ ID NO: 4213143 - DNA, 16 bp, Homo sapiens
taaatacatgcatata

SEQ ID NO: 4213144 - DNA, 20 bp, Homo sapiens
taaatagtaaaaataaaatt

SEQ ID NO: 4213145 - DNA, 19 bp, Homo sapiens
taaatcaagttggcttcta

SEQ ID NO: 4213146 - DNA, 15 bp, Homo sapiens
taaatgccctctctg

SEQ ID NO: 4213147 - DNA, 19 bp, Homo sapiens
taaatgttggaattttcaa

SEQ ID NO: 4213148 - DNA, 10 bp, Homo sapiens
taaattattt

SEQ ID NO: 4213149 - DNA, 16 bp, Homo sapiens
taacaactatgatttg

SEQ ID NO: 4213150 - DNA, 18 bp, Homo sapiens
taacagttgaagaaaaaa

SEQ ID NO: 4213151 - DNA, 13 bp, Homo sapiens
taacttaatggca

SEQ ID NO: 4213152 - DNA, 19 bp, Homo sapiens
taacttccaaataaataat

SEQ ID NO: 4213153 - DNA, 18 bp, Homo sapiens
taagaatagtagatgtgg

SEQ ID NO: 4213154 - DNA, 15 bp, Homo sapiens
taagagatgtgacta

SEQ ID NO: 4213155 - DNA, 14 bp, Homo sapiens
taagagcaaacttt

SEQ ID NO: 4213156 - DNA, 15 bp, Homo sapiens
taagtctctgactct

SEQ ID NO: 4213157 - DNA, 20 bp, Homo sapiens
taagttatgactgtgaaatg

SEQ ID NO: 4213158 - DNA, 15 bp, Homo sapiens
taagttcccttctat

SEQ ID NO: 4213159 - DNA, 19 bp, Homo sapiens
taataatttgccattatct

SEQ ID NO: 4213160 - DNA, 13 bp, Homo sapiens
taatcccagcact

SEQ ID NO: 4213161 - DNA, 16 bp, Homo sapiens
taatgcttgaatatta

SEQ ID NO: 4213162 - DNA, 17 bp, Homo sapiens
taatgctttatgtttaa

SEQ ID NO: 4213163 - DNA, 20 bp, Homo sapiens
taatttgaaggtagaatgtt

SEQ ID NO: 4213164 - DNA, 16 bp, Homo sapiens
taatttgccattatct

SEQ ID NO: 4213165 - DNA, 13 bp, Homo sapiens
taattttcctcct

SEQ ID NO: 4213166 - DNA, 14 bp, Homo sapiens
taattttgcagcag

SEQ ID NO: 4213167 - DNA, 14 bp, Homo sapiens
taatttttaaatgt

SEQ ID NO: 4213168 - DNA, 22 bp, Homo sapiens
tacaaaaatgagctaggcatgg

SEQ ID NO: 4213169 - DNA, 21 bp, Homo sapiens
tacaaatttaattttgcagat

SEQ ID NO: 4213170 - DNA, 13 bp, Homo sapiens
tacaaccctgacc

SEQ ID NO: 4213171 - DNA, 16 bp, Homo sapiens
tacaacttcatataac

SEQ ID NO: 4213172 - DNA, 18 bp, Homo sapiens
tacaagggcataaagtaa

SEQ ID NO: 4213173 - DNA, 16 bp, Homo sapiens
tacaaggtatttacac

SEQ ID NO: 4213174 - DNA, 18 bp, Homo sapiens
tacaaggtatttacacat

SEQ ID NO: 4213175 - DNA, 15 bp, Homo sapiens
tacaatgggaaaact

SEQ ID NO: 4213176 - DNA, 16 bp, Homo sapiens
tacaatgggaaaactt

SEQ ID NO: 4213177 - DNA, 18 bp, Homo sapiens
tacacatatctaaaaata

SEQ ID NO: 4213178 - DNA, 18 bp, Homo sapiens
tacacatccccagccaga

SEQ ID NO: 4213179 - DNA, 12 bp, Homo sapiens
tacagccagaag

SEQ ID NO: 4213180 - DNA, 14 bp, Homo sapiens
tacagccagaagcc

SEQ ID NO: 4213181 - DNA, 15 bp, Homo sapiens
tacaggcatagagtt

SEQ ID NO: 4213182 - DNA, 13 bp, Homo sapiens
tacataaaagaaa

SEQ ID NO: 4213183 - DNA, 20 bp, Homo sapiens
tacctttacatattatcatg

SEQ ID NO: 4213184 - DNA, 16 bp, Homo sapiens
tactaaaaagtataaa

SEQ ID NO: 4213185 - DNA, 18 bp, Homo sapiens
tactaaaaagtataaaat

SEQ ID NO: 4213186 - DNA, 18 bp, Homo sapiens
tactagttgatgaaggag

SEQ ID NO: 4213187 - DNA, 16 bp, Homo sapiens
tactggataaattgta

SEQ ID NO: 4213188 - DNA, 19 bp, Homo sapiens
tactgtttaattgacatac

SEQ ID NO: 4213189 - DNA, 18 bp, Homo sapiens
tacttctgtgtgcaattg

SEQ ID NO: 4213190 - DNA, 23 bp, Homo sapiens
tagaaccaggcaacttgggaact

SEQ ID NO: 4213191 - DNA, 14 bp, Homo sapiens
tagaatgaaaagtt

SEQ ID NO: 4213192 - DNA, 16 bp, Homo sapiens
tagaatggcagctgga

SEQ ID NO: 4213193 - DNA, 18 bp, Homo sapiens
tagaatgttttcaaatgt

SEQ ID NO: 4213194 - DNA, 20 bp, Homo sapiens
tagactgtacttattttcca

SEQ ID NO: 4213195 - DNA, 17 bp, Homo sapiens
tagaggcaaacatttct

SEQ ID NO: 4213196 - DNA, 16 bp, Homo sapiens
tagatgttttacaaat

SEQ ID NO: 4213197 - DNA, 17 bp, Homo sapiens
tagattttatgaaaaac

SEQ ID NO: 4213198 - DNA, 14 bp, Homo sapiens
tagcacaatttata

SEQ ID NO: 4213199 - DNA, 14 bp, Homo sapiens
taggaagtgaccga

SEQ ID NO: 4213200 - DNA, 20 bp, Homo sapiens
taggagaagtcttctattta

SEQ ID NO: 4213201 - DNA, 13 bp, Homo sapiens
tagtaaaaataaa

SEQ ID NO: 4213202 - DNA, 15 bp, Homo sapiens
tagtatctatatgac

SEQ ID NO: 4213203 - DNA, 16 bp, Homo sapiens
tagtatctatatgact

SEQ ID NO: 4213204 - DNA, 13 bp, Homo sapiens
tagtatgaaaatg

SEQ ID NO: 4213205 - DNA, 20 bp, Homo sapiens
tagtctggtgttctgagtac

SEQ ID NO: 4213206 - DNA, 13 bp, Homo sapiens
tagtctgtcatcc

SEQ ID NO: 4213207 - DNA, 19 bp, Homo sapiens
tagtgtctctaagttatga

SEQ ID NO: 4213208 - DNA, 20 bp, Homo sapiens
tagttaagtcatccacagcc

SEQ ID NO: 4213209 - DNA, 23 bp, Homo sapiens
tagttcaatctggattcatattt

SEQ ID NO: 4213210 - DNA, 19 bp, Homo sapiens
tataactatgttgataaaa

SEQ ID NO: 4213211 - DNA, 12 bp, Homo sapiens
tataactgagat

SEQ ID NO: 4213212 - DNA, 16 bp, Homo sapiens
tataactgagatgaat

SEQ ID NO: 4213213 - DNA, 14 bp, Homo sapiens
tataataaaaatat

SEQ ID NO: 4213214 - DNA, 18 bp, Homo sapiens
tataataaaaatatattt

SEQ ID NO: 4213215 - DNA, 17 bp, Homo sapiens
tataataaaagttatta

SEQ ID NO: 4213216 - DNA, 13 bp, Homo sapiens
tataatgaataaa

SEQ ID NO: 4213217 - DNA, 15 bp, Homo sapiens
tataatgaataaatc

SEQ ID NO: 4213218 - DNA, 16 bp, Homo sapiens
tatagcatgaaataaa

SEQ ID NO: 4213219 - DNA, 20 bp, Homo sapiens
tatagcatgaaataaaatat

SEQ ID NO: 4213220 - DNA, 17 bp, Homo sapiens
tataggctattttctaa

SEQ ID NO: 4213221 - DNA, 21 bp, Homo sapiens
tataggctattttctaaagac

SEQ ID NO: 4213222 - DNA, 17 bp, Homo sapiens
tatataattttgcagca

SEQ ID NO: 4213223 - DNA, 16 bp, Homo sapiens
tatattagataaccat

SEQ ID NO: 4213224 - DNA, 18 bp, Homo sapiens
tatattagataaccatat

SEQ ID NO: 4213225 - DNA, 19 bp, Homo sapiens
tatattcattctttttgaa

SEQ ID NO: 4213226 - DNA, 20 bp, Homo sapiens
tatattcattctttttgaaa

SEQ ID NO: 4213227 - DNA, 14 bp, Homo sapiens
tatatttataaaat

SEQ ID NO: 4213228 - DNA, 15 bp, Homo sapiens
tatatttataaggaa

SEQ ID NO: 4213229 - DNA, 14 bp, Homo sapiens
tatcaaaatagtct

SEQ ID NO: 4213230 - DNA, 18 bp, Homo sapiens
tatcaaagtcattaaaga

SEQ ID NO: 4213231 - DNA, 20 bp, Homo sapiens
tatcaaagtcattaaagaca

SEQ ID NO: 4213232 - DNA, 16 bp, Homo sapiens
tatcatgtcaaacgtg

SEQ ID NO: 4213233 - DNA, 21 bp, Homo sapiens
tatctaaaaatagttaacaca

SEQ ID NO: 4213234 - DNA, 23 bp, Homo sapiens
tatcttataaagtggaagtatgt

SEQ ID NO: 4213235 - DNA, 21 bp, Homo sapiens
tatcttatttaatttttgcaa

SEQ ID NO: 4213236 - DNA, 15 bp, Homo sapiens
tatctttgaatatgt

SEQ ID NO: 4213237 - DNA, 21 bp, Homo sapiens
tatgaaaaactcttctacttt

SEQ ID NO: 4213238 - DNA, 20 bp, Homo sapiens
tatgaagatcttctgcagaa

SEQ ID NO: 4213239 - DNA, 18 bp, Homo sapiens
tatgatttggaaaataaa

SEQ ID NO: 4213240 - DNA, 12 bp, Homo sapiens
tatggcattttt

SEQ ID NO: 4213241 - DNA, 13 bp, Homo sapiens
tatgtacaaccct

SEQ ID NO: 4213242 - DNA, 18 bp, Homo sapiens
tatgttgtttataataaa

SEQ ID NO: 4213243 - DNA, 14 bp, Homo sapiens
tatgtttaaaaaca

SEQ ID NO: 4213244 - DNA, 17 bp, Homo sapiens
tattaaaaaagagacat

SEQ ID NO: 4213245 - DNA, 23 bp, Homo sapiens
tattaaaaaagagacatccaaat

SEQ ID NO: 4213246 - DNA, 17 bp, Homo sapiens
tattacctttacatatt

SEQ ID NO: 4213247 - DNA, 18 bp, Homo sapiens
tattagatgttttacaaa

SEQ ID NO: 4213248 - DNA, 22 bp, Homo sapiens
tcctttgttattatcctgcatt

SEQ ID NO: 4213249 - DNA, 12 bp, Homo sapiens
tcctttttctat

SEQ ID NO: 4213250 - DNA, 13 bp, Homo sapiens
tcctttttctatg

SEQ ID NO: 4213251 - DNA, 12 bp, Homo sapiens
tcgcctgccccc

SEQ ID NO: 4213252 - DNA, 13 bp, Homo sapiens
tctaaagagcatc

SEQ ID NO: 4213253 - DNA, 22 bp, Homo sapiens
tctaacttttttttacttatat

SEQ ID NO: 4213254 - DNA, 15 bp, Homo sapiens
tctagtttcttttga

SEQ ID NO: 4213255 - DNA, 15 bp, Homo sapiens
tctatgttttctact

SEQ ID NO: 4213256 - DNA, 19 bp, Homo sapiens
tctatgttttctactccaa

SEQ ID NO: 4213257 - DNA, 13 bp, Homo sapiens
tctatttatttat

SEQ ID NO: 4213258 - DNA, 16 bp, Homo sapiens
tctcacctgaaaatgt

SEQ ID NO: 4213259 - DNA, 20 bp, Homo sapiens
tctccacccatgaccttttt

SEQ ID NO: 4213260 - DNA, 14 bp, Homo sapiens
tctccagccttctc

SEQ ID NO: 4213261 - DNA, 22 bp, Homo sapiens
tctccagccttctctctctggt

SEQ ID NO: 4213262 - DNA, 21 bp, Homo sapiens
tctcctgagaggtgctgcagg

SEQ ID NO: 4213263 - DNA, 22 bp, Homo sapiens
tctcctgggcccgctttgcctg

SEQ ID NO: 4213264 - DNA, 23 bp, Homo sapiens
tctcctgggcccgctttgcctgc

SEQ ID NO: 4213265 - DNA, 19 bp, Homo sapiens
tctcgcattttctctagct

SEQ ID NO: 4213266 - DNA, 14 bp, Homo sapiens
tctctactaaaaat

SEQ ID NO: 4213267 - DNA, 11 bp, Homo sapiens
tctctctctgg

SEQ ID NO: 4213268 - DNA, 14 bp, Homo sapiens
tctctctctggtca

SEQ ID NO: 4213269 - DNA, 16 bp, Homo sapiens
tctctgactcttgcct

SEQ ID NO: 4213270 - DNA, 17 bp, Homo sapiens
tctctgagggagaggct

SEQ ID NO: 4213271 - DNA, 16 bp, Homo sapiens
tctctgctcttgcctg

SEQ ID NO: 4213272 - DNA, 16 bp, Homo sapiens
tctctgtccctcactg

SEQ ID NO: 4213273 - DNA, 18 bp, Homo sapiens
tctctgtccctcactgcc

SEQ ID NO: 4213274 - DNA, 19 bp, Homo sapiens
tctctgtccctcactgcct

SEQ ID NO: 4213275 - DNA, 21 bp, Homo sapiens
tggccatcaggactttccctg

SEQ ID NO: 4213276 - DNA, 17 bp, Homo sapiens
tggccatgtcgcctgcc

SEQ ID NO: 4213277 - DNA, 15 bp, Homo sapiens
tggctgacctgacct

SEQ ID NO: 4213278 - DNA, 13 bp, Homo sapiens
tggctgtctctgt

SEQ ID NO: 4213279 - DNA, 16 bp, Homo sapiens
tggctgtctctgtccc

SEQ ID NO: 4213280 - DNA, 22 bp, Homo sapiens
tgggaaaacttcactccaaaga

SEQ ID NO: 4213281 - DNA, 13 bp, Homo sapiens
tgggaactagact

SEQ ID NO: 4213282 - DNA, 14 bp, Homo sapiens
tgggaggctgaagt

SEQ ID NO: 4213283 - DNA, 17 bp, Homo sapiens
tgggaggctggtctccc

SEQ ID NO: 4213284 - DNA, 13 bp, Homo sapiens
tgggaggtggaaa

SEQ ID NO: 4213285 - DNA, 22 bp, Homo sapiens
tgggccactgcactctagcctg

SEQ ID NO: 4213286 - DNA, 17 bp, Homo sapiens
tggggacagagcagaac

SEQ ID NO: 4213287 - DNA, 15 bp, Homo sapiens
tggtagttttacagt

SEQ ID NO: 4213288 - DNA, 15 bp, Homo sapiens
tggtggctgtctctg

SEQ ID NO: 4213289 - DNA, 13 bp, Homo sapiens
tggtttttatatt

SEQ ID NO: 4213290 - DNA, 18 bp, Homo sapiens
tgtaaacagaaattgcaa

SEQ ID NO: 4213291 - DNA, 19 bp, Homo sapiens
tgtaacttccaaataaata

SEQ ID NO: 4213292 - DNA, 16 bp, Homo sapiens
tgtaatacacatatct

SEQ ID NO: 4213293 - DNA, 14 bp, Homo sapiens
tgtacaaccctgac

SEQ ID NO: 4213294 - DNA, 18 bp, Homo sapiens
tgtacaaccctgaccgtg

SEQ ID NO: 4213295 - DNA, 21 bp, Homo sapiens
tgtacaaggtatttacacata

SEQ ID NO: 4213296 - DNA, 13 bp, Homo sapiens
tgtacagcatgca

SEQ ID NO: 4213297 - DNA, 11 bp, Homo sapiens
tgtattttcca

SEQ ID NO: 4213298 - DNA, 20 bp, Homo sapiens
tgtcaaccccaagttagttc

SEQ ID NO: 4213299 - DNA, 20 bp, Homo sapiens
tgtcatcccgctcctgctga

SEQ ID NO: 4213300 - DNA, 23 bp, Homo sapiens
tgtcatcccgctcctgctgaaac

SEQ ID NO: 4213301 - DNA, 13 bp, Homo sapiens
tgtcatctcagct

SEQ ID NO: 4213302 - DNA, 20 bp, Homo sapiens
tgtccctcactgccttccag

SEQ ID NO: 4213303 - DNA, 22 bp, Homo sapiens
tgtccctcactgccttccagga

SEQ ID NO: 4213304 - DNA, 21 bp, Homo sapiens
tgtctatgttttctactccaa

SEQ ID NO: 4213305 - DNA, 14 bp, Homo sapiens
tgtctctgctcttg

SEQ ID NO: 4213306 - DNA, 16 bp, Homo sapiens
tgtctctgtccctcac

SEQ ID NO: 4213307 - DNA, 19 bp, Homo sapiens
tgtctctgtccctcactgc

SEQ ID NO: 4213308 - DNA, 23 bp, Homo sapiens
tgtctctgtccctcactgccttc

SEQ ID NO: 4213309 - DNA, 17 bp, Homo sapiens
tgtcttcccttctttgc

SEQ ID NO: 4213310 - DNA, 21 bp, Homo sapiens
tgtctttttattaaaatattt

SEQ ID NO: 4213311 - DNA, 23 bp, Homo sapiens
tgtgaacaagcttcagtaagtta

SEQ ID NO: 4213312 - DNA, 23 bp, Homo sapiens
tgtgaaggcaggggaatgtatgt

SEQ ID NO: 4213313 - DNA, 15 bp, Homo sapiens
tgtgaattcccaggt

SEQ ID NO: 4213314 - DNA, 15 bp, Homo sapiens
tgtgcctaatgtgtt

SEQ ID NO: 4213315 - DNA, 15 bp, Homo sapiens
tgtgctcagagacac

SEQ ID NO: 4213316 - DNA, 16 bp, Homo sapiens
tgtgtactcttaggct

SEQ ID NO: 4213317 - DNA, 14 bp, Homo sapiens
tgtgtggtcaacat

SEQ ID NO: 4213318 - DNA, 15 bp, Homo sapiens
tgttattatcctgca

SEQ ID NO: 4213319 - DNA, 20 bp, Homo sapiens
tgttattatcctgcatttta

SEQ ID NO: 4213320 - DNA, 13 bp, Homo sapiens
tgttcaggagctg

SEQ ID NO: 4213321 - DNA, 22 bp, Homo sapiens
tgttctaaatatcccttggaca

SEQ ID NO: 4213322 - DNA, 14 bp, Homo sapiens
tgttctggagctgc

SEQ ID NO: 4213323 - DNA, 15 bp, Homo sapiens
tgttctggagctgct

SEQ ID NO: 4213324 - DNA, 16 bp, Homo sapiens
tgttgaaactttaaga

SEQ ID NO: 4213325 - DNA, 20 bp, Homo sapiens
tgttgaagaagagtttgcaa

SEQ ID NO: 4213326 - DNA, 20 bp, Homo sapiens
tgttgtttataataaaaata

SEQ ID NO: 4213327 - DNA, 16 bp, Homo sapiens
tgtttataataaaaat

SEQ ID NO: 4213328 - DNA, 19 bp, Homo sapiens
tgtttgtgcttcaaatgat

SEQ ID NO: 4213329 - DNA, 14 bp, Homo sapiens
tgttttcaaatgtt

SEQ ID NO: 4213330 - DNA, 15 bp, Homo sapiens
ttaaaaaagagacat

SEQ ID NO: 4213331 - DNA, 22 bp, Homo sapiens
ttaaaaacattccccaattatc

SEQ ID NO: 4213332 - DNA, 13 bp, Homo sapiens
ttaaaaattactg

SEQ ID NO: 4213333 - DNA, 18 bp, Homo sapiens
ttaaagacaggagacaaa

SEQ ID NO: 4213334 - DNA, 15 bp, Homo sapiens
ttaaagcaccaaatt

SEQ ID NO: 4213335 - DNA, 15 bp, Homo sapiens
ttaaatgacattttt

SEQ ID NO: 4213336 - DNA, 14 bp, Homo sapiens
ttaacttaatggca

SEQ ID NO: 4213337 - DNA, 19 bp, Homo sapiens
ttaatgctttcctccctgg

SEQ ID NO: 4213338 - DNA, 13 bp, Homo sapiens
ttaattaaaaatt

SEQ ID NO: 4213339 - DNA, 13 bp, Homo sapiens
ttaattagatttt

SEQ ID NO: 4213340 - DNA, 21 bp, Homo sapiens
ttacaaagttaaaattgttat

SEQ ID NO: 4213341 - DNA, 20 bp, Homo sapiens
ttacaagggcataaagtaaa

SEQ ID NO: 4213342 - DNA, 21 bp, Homo sapiens
ttacctagctaattatttaat

SEQ ID NO: 4213343 - DNA, 13 bp, Homo sapiens
ttagataaccata

SEQ ID NO: 4213344 - DNA, 15 bp, Homo sapiens
ttagatgttttacaa

SEQ ID NO: 4213345 - DNA, 14 bp, Homo sapiens
ttagtctgtcatcc

SEQ ID NO: 4213346 - DNA, 14 bp, Homo sapiens
ttatctttgaatat

SEQ ID NO: 4213347 - DNA, 17 bp, Homo sapiens
ttatgtacaaccctgac

SEQ ID NO: 4213348 - DNA, 19 bp, Homo sapiens
ttatgttgtttataataaa

SEQ ID NO: 4213349 - DNA, 13 bp, Homo sapiens
ttattactgagag

SEQ ID NO: 4213350 - DNA, 18 bp, Homo sapiens
ttattccccatcttccaa

SEQ ID NO: 4213351 - DNA, 13 bp, Homo sapiens
ttattctaatttt

SEQ ID NO: 4213352 - DNA, 15 bp, Homo sapiens
ttattgatgttttca

SEQ ID NO: 4213353 - DNA, 20 bp, Homo sapiens
ttatttgattatttaagact

SEQ ID NO: 4213354 - DNA, 14 bp, Homo sapiens
ttatttgcaataaa

SEQ ID NO: 4213355 - DNA, 15 bp, Homo sapiens
ttattttccaataaa

SEQ ID NO: 4213356 - DNA, 22 bp, Homo sapiens
ttcaagacaccaaattccaaac

SEQ ID NO: 4213357 - DNA, 19 bp, Homo sapiens
ttcacaatggaaactttag

SEQ ID NO: 4213358 - DNA, 13 bp, Homo sapiens
ttcagatgtatgt

SEQ ID NO: 4213359 - DNA, 15 bp, Homo sapiens
ttcaggagctgaagc

SEQ ID NO: 4213360 - DNA, 20 bp, Homo sapiens
ttcataaattatttgattat

SEQ ID NO: 4213361 - DNA, 14 bp, Homo sapiens
ttcattagttttga

SEQ ID NO: 4213362 - DNA, 22 bp, Homo sapiens
ttcattttgcactgaggatatt

SEQ ID NO: 4213363 - DNA, 19 bp, Homo sapiens
ttccaaagttttgaagtca

SEQ ID NO: 4213364 - DNA, 16 bp, Homo sapiens
ttccaaataaataatt

SEQ ID NO: 4213365 - DNA, 17 bp, Homo sapiens
ttccaaggaaatacata

SEQ ID NO: 4213366 - DNA, 11 bp, Homo sapiens
ttccacaaacc

SEQ ID NO: 4213367 - DNA, 18 bp, Homo sapiens
ttccacagtctctgggag

SEQ ID NO: 4213368 - DNA, 13 bp, Homo sapiens
ttccacattaatt

SEQ ID NO: 4213369 - DNA, 14 bp, Homo sapiens
ttccacctgctttc

SEQ ID NO: 4213370 - DNA, 16 bp, Homo sapiens
ttcccatgatgccgct

SEQ ID NO: 4213371 - DNA, 17 bp, Homo sapiens
ttcccctcgctgtcctg

SEQ ID NO: 4213372 - DNA, 19 bp, Homo sapiens
ttcccctcgctgtcctgct

SEQ ID NO: 4213373 - DNA, 16 bp, Homo sapiens
ttccctctcttgcctt

SEQ ID NO: 4213374 - DNA, 14 bp, Homo sapiens
ttcctactttgctt

SEQ ID NO: 4213375 - DNA, 22 bp, Homo sapiens
ttcctagtgcctacaatgggaa

SEQ ID NO: 4213376 - DNA, 23 bp, Homo sapiens
ttgagcctccatttctggcttct

SEQ ID NO: 4213377 - DNA, 13 bp, Homo sapiens
ttgcaaagtgtat

SEQ ID NO: 4213378 - DNA, 22 bp, Homo sapiens
ttgcacatgtaacatagattta

SEQ ID NO: 4213379 - DNA, 14 bp, Homo sapiens
ttgcagcagaagcc

SEQ ID NO: 4213380 - DNA, 22 bp, Homo sapiens
ttgcagcagaagccaaattttt

SEQ ID NO: 4213381 - DNA, 20 bp, Homo sapiens
ttgcaggccaggttatgcct

SEQ ID NO: 4213382 - DNA, 22 bp, Homo sapiens
ttgcaggccaggttatgcctca

SEQ ID NO: 4213383 - DNA, 16 bp, Homo sapiens
ttgcctttccacctgc

SEQ ID NO: 4213384 - DNA, 22 bp, Homo sapiens
ttgctatattcctttttctatg

SEQ ID NO: 4213385 - DNA, 15 bp, Homo sapiens
ttggaaaataaatca

SEQ ID NO: 4213386 - DNA, 22 bp, Homo sapiens
ttggaataataattttcctcct

SEQ ID NO: 4213387 - DNA, 23 bp, Homo sapiens
ttggaataataattttcctccta

SEQ ID NO: 4213388 - DNA, 15 bp, Homo sapiens
ttggacattttatgt

SEQ ID NO: 4213389 - DNA, 23 bp, Homo sapiens
ttggagtattattgaagatgtga

SEQ ID NO: 4213390 - DNA, 21 bp, Homo sapiens
ttggcaatgactcaaagtctg

SEQ ID NO: 4213391 - DNA, 15 bp, Homo sapiens
ttggtttttatattt

SEQ ID NO: 4213392 - DNA, 14 bp, Homo sapiens
ttgtaatacacata

SEQ ID NO: 4213393 - DNA, 15 bp, Homo sapiens
ttgtaatacacatat

SEQ ID NO: 4213394 - DNA, 20 bp, Homo sapiens
ttgtacaaggtatttacaca

SEQ ID NO: 4213395 - DNA, 22 bp, Homo sapiens
ttgtacaaggtatttacacata

SEQ ID NO: 4213396 - DNA, 20 bp, Homo sapiens
ttgtatagcatgaaataaaa

SEQ ID NO: 4213397 - DNA, 15 bp, Homo sapiens
ttgtcttcccttctt

SEQ ID NO: 4213398 - DNA, 23 bp, Homo sapiens
ttgtcttcccttctttgcacttt

SEQ ID NO: 4213399 - DNA, 15 bp, Homo sapiens
ttgtgcctaatgtgt

SEQ ID NO: 4213400 - DNA, 16 bp, Homo sapiens
ttgtgctcagagacac

SEQ ID NO: 4213401 - DNA, 21 bp, Homo sapiens
tttaaattttgcactgctcaa

SEQ ID NO: 4213402 - DNA, 23 bp, Homo sapiens
tttaacaactatgatttggaaaa

SEQ ID NO: 4213403 - DNA, 18 bp, Homo sapiens
tttaattgacatactcag

SEQ ID NO: 4213404 - DNA, 22 bp, Homo sapiens
tttaatttgaaggtagaatgtt

SEQ ID NO: 4213405 - DNA, 21 bp, Homo sapiens
tttacacatacaacttcatat

SEQ ID NO: 4213406 - DNA, 19 bp, Homo sapiens
tttacagtgtttctggctt

SEQ ID NO: 4213407 - DNA, 17 bp, Homo sapiens
tttagatgaatgtcagt

SEQ ID NO: 4213408 - DNA, 13 bp, Homo sapiens
tttagattttatg

SEQ ID NO: 4213409 - DNA, 13 bp, Homo sapiens
tttaggtgcctcc

SEQ ID NO: 4213410 - DNA, 17 bp, Homo sapiens
tttaggtgcctcctgtc

SEQ ID NO: 4213411 - DNA, 16 bp, Homo sapiens
tttataataaaaatat

SEQ ID NO: 4213412 - DNA, 19 bp, Homo sapiens
tttatattagataaccata

SEQ ID NO: 4213413 - DNA, 13 bp, Homo sapiens
tttatattttccc

SEQ ID NO: 4213414 - DNA, 21 bp, Homo sapiens
tttatctcctgtctacagttt

SEQ ID NO: 4213415 - DNA, 12 bp, Homo sapiens
tttatgtacaac

SEQ ID NO: 4213416 - DNA, 16 bp, Homo sapiens
tttatttatttattca

SEQ ID NO: 4213417 - DNA, 21 bp, Homo sapiens
tttcagaaagaagtggggaca

SEQ ID NO: 4213418 - DNA, 18 bp, Homo sapiens
tttcataaattatttgat

SEQ ID NO: 4213419 - DNA, 12 bp, Homo sapiens
tttctaaagact

SEQ ID NO: 4213420 - DNA, 20 bp, Homo sapiens
tttctaagagacctgaactg

SEQ ID NO: 4213421 - DNA, 15 bp, Homo sapiens
tttctcatgttgaaa

SEQ ID NO: 4213422 - DNA, 23 bp, Homo sapiens
tttctcctgggcccgctttgcct

SEQ ID NO: 4213423 - DNA, 15 bp, Homo sapiens
tttcttatttgcaat

SEQ ID NO: 4213424 - DNA, 20 bp, Homo sapiens
tttctttgtattataaaatt

SEQ ID NO: 4213425 - DNA, 15 bp, Homo sapiens
tttgaaagaaatgta

SEQ ID NO: 4213426 - DNA, 14 bp, Homo sapiens
tttgaaatgaaaat

SEQ ID NO: 4213427 - DNA, 19 bp, Homo sapiens
tttgacttattgtccccac

SEQ ID NO: 4213428 - DNA, 21 bp, Homo sapiens
tttgcacacctgttattgcca

SEQ ID NO: 4213429 - DNA, 18 bp, Homo sapiens
tttgcagcagaagccaaa

SEQ ID NO: 4213430 - DNA, 20 bp, Homo sapiens
tttgcctaggaggccttctc

SEQ ID NO: 4213431 - DNA, 22 bp, Homo sapiens
tttgccttggttcttcctagtg

SEQ ID NO: 4213432 - DNA, 13 bp, Homo sapiens
tttgcttctctcc

SEQ ID NO: 4213433 - DNA, 14 bp, Homo sapiens
tttgcttctctcca

SEQ ID NO: 4213434 - DNA, 20 bp, Homo sapiens
tttggaataataattttcct

SEQ ID NO: 4213435 - DNA, 14 bp, Homo sapiens
tttggtacaagttt

SEQ ID NO: 4213436 - DNA, 19 bp, Homo sapiens
tttgttggagtattattga

SEQ ID NO: 4213437 - DNA, 15 bp, Homo sapiens
ttttaaatgacattt

SEQ ID NO: 4213438 - DNA, 20 bp, Homo sapiens
ttttatgtacaaccctgacc

SEQ ID NO: 4213439 - DNA, 15 bp, Homo sapiens
ttttcaaatgttctc

SEQ ID NO: 4213440 - DNA, 12 bp, Homo sapiens
ttttccaataaa

SEQ ID NO: 4213441 - DNA, 12 bp, Homo sapiens
ttttcttgcagt

SEQ ID NO: 4213442 - DNA, 21 bp, Homo sapiens
ttttgaagattctatgttaat

SEQ ID NO: 4213443 - DNA, 15 bp, Homo sapiens
ttttgaagtcatctt

SEQ ID NO: 4213444 - DNA, 21 bp, Homo sapiens
ttttgcactgaggatattcag

SEQ ID NO: 4213445 - DNA, 19 bp, Homo sapiens
ttttgcactgctcaattct

SEQ ID NO: 4213446 - DNA, 14 bp, Homo sapiens
tttttacttatata

SEQ ID NO: 4213447 - DNA, 11 bp, Homo sapiens
aaaaatatatt

SEQ ID NO: 4213448 - DNA, 15 bp, Homo sapiens
aaaaatggcaagaga

SEQ ID NO: 4213449 - DNA, 23 bp, Homo sapiens
aaaaattgtgtttagattttatg

SEQ ID NO: 4213450 - DNA, 11 bp, Homo sapiens
aaaaattgtta

SEQ ID NO: 4213451 - DNA, 18 bp, Homo sapiens
aaaacacattgagtttaa

SEQ ID NO: 4213452 - DNA, 18 bp, Homo sapiens
aaaactcaggcaaagaaa

SEQ ID NO: 4213453 - DNA, 21 bp, Homo sapiens
aaaagagcagtggtaagaata

SEQ ID NO: 4213454 - DNA, 18 bp, Homo sapiens
aaaagggcaataaatgcc

SEQ ID NO: 4213455 - DNA, 19 bp, Homo sapiens
aaaataaaattaaagctga

SEQ ID NO: 4213456 - DNA, 18 bp, Homo sapiens
aaaatgaaagccaaattt

SEQ ID NO: 4213457 - DNA, 16 bp, Homo sapiens
aaaatgaaatgcatat

SEQ ID NO: 4213458 - DNA, 23 bp, Homo sapiens
aaaatgctgtattagtcacagag

SEQ ID NO: 4213459 - DNA, 13 bp, Homo sapiens
aaaatggaaattt

SEQ ID NO: 4213460 - DNA, 18 bp, Homo sapiens
aaaatggcaagagatcat

SEQ ID NO: 4213461 - DNA, 17 bp, Homo sapiens
aaaatgtctgtaataat

SEQ ID NO: 4213462 - DNA, 18 bp, Homo sapiens
aaaatgtctgtaataata

SEQ ID NO: 4213463 - DNA, 16 bp, Homo sapiens
aaaattggccagagag

SEQ ID NO: 4213464 - DNA, 13 bp, Homo sapiens
aaaattgtgttta

SEQ ID NO: 4213465 - DNA, 19 bp, Homo sapiens
aaaattgtgtttagatttt

SEQ ID NO: 4213466 - DNA, 21 bp, Homo sapiens
aaaattgtgtttagattttat

SEQ ID NO: 4213467 - DNA, 13 bp, Homo sapiens
aaaattgttattt

SEQ ID NO: 4213468 - DNA, 17 bp, Homo sapiens
aaacacattgagtttaa

SEQ ID NO: 4213469 - DNA, 12 bp, Homo sapiens
aaacgtgaaaat

SEQ ID NO: 4213470 - DNA, 21 bp, Homo sapiens
aaactcacttcaatgaacaaa

SEQ ID NO: 4213471 - DNA, 19 bp, Homo sapiens
aaactcaggcaaagaaaat

SEQ ID NO: 4213472 - DNA, 13 bp, Homo sapiens
aaactcttctact

SEQ ID NO: 4213473 - DNA, 16 bp, Homo sapiens
aaacttcactccaaag

SEQ ID NO: 4213474 - DNA, 15 bp, Homo sapiens
aaacttttaatgcct

SEQ ID NO: 4213475 - DNA, 21 bp, Homo sapiens
aaacttttaatgccttccaca

SEQ ID NO: 4213476 - DNA, 13 bp, Homo sapiens
aaagaaaatgaaa

SEQ ID NO: 4213477 - DNA, 13 bp, Homo sapiens
aaagaaataaacc

SEQ ID NO: 4213478 - DNA, 14 bp, Homo sapiens
aaagcaccaaattc

SEQ ID NO: 4213479 - DNA, 14 bp, Homo sapiens
aaagccaaatttat

SEQ ID NO: 4213480 - DNA, 17 bp, Homo sapiens
aaagccaaatttatatg

SEQ ID NO: 4213481 - DNA, 18 bp, Homo sapiens
aaagcctattagatgttt

SEQ ID NO: 4213482 - DNA, 12 bp, Homo sapiens
aaagctgaaaac

SEQ ID NO: 4213483 - DNA, 15 bp, Homo sapiens
aaagctgaaaactgc

SEQ ID NO: 4213484 - DNA, 18 bp, Homo sapiens
aaagcttggttctgtgaa

SEQ ID NO: 4213485 - DNA, 18 bp, Homo sapiens
aaagtaaatacatgcata

SEQ ID NO: 4213486 - DNA, 22 bp, Homo sapiens
aaataaaccaaaggaaaatgtc

SEQ ID NO: 4213487 - DNA, 16 bp, Homo sapiens
aaatagaatgaaaagt

SEQ ID NO: 4213488 - DNA, 13 bp, Homo sapiens
aaatagtaaaaat

SEQ ID NO: 4213489 - DNA, 13 bp, Homo sapiens
aaatagttaacac

SEQ ID NO: 4213490 - DNA, 18 bp, Homo sapiens
aaatagttaacacagatc

SEQ ID NO: 4213491 - DNA, 17 bp, Homo sapiens
aaatatatcttataaag

SEQ ID NO: 4213492 - DNA, 23 bp, Homo sapiens
aaatatcccttggacattttatg

SEQ ID NO: 4213493 - DNA, 16 bp, Homo sapiens
aaatattcctttgcat

SEQ ID NO: 4213494 - DNA, 17 bp, Homo sapiens
aaatccatcctgctctt

SEQ ID NO: 4213495 - DNA, 20 bp, Homo sapiens
aaatgaaagccaaatttata

SEQ ID NO: 4213496 - DNA, 15 bp, Homo sapiens
aaatgaaatgcatat

SEQ ID NO: 4213497 - DNA, 22 bp, Homo sapiens
aaatggaggatctctaaagagc

SEQ ID NO: 4213498 - DNA, 22 bp, Homo sapiens
aaatgtgatttgtcttcccttc

SEQ ID NO: 4213499 - DNA, 11 bp, Homo sapiens
aaatgtttata

SEQ ID NO: 4213500 - DNA, 16 bp, Homo sapiens
aaattgttatcaaaat

SEQ ID NO: 4213501 - DNA, 22 bp, Homo sapiens
aaattttaaagcctgaaaattc

SEQ ID NO: 4213502 - DNA, 21 bp, Homo sapiens
aaattttacaagggcataaag

SEQ ID NO: 4213503 - DNA, 17 bp, Homo sapiens
aacaaaacaaaaaactt

SEQ ID NO: 4213504 - DNA, 12 bp, Homo sapiens
aacaacacaatc

SEQ ID NO: 4213505 - DNA, 18 bp, Homo sapiens
aacacagcaattcctcag

SEQ ID NO: 4213506 - DNA, 23 bp, Homo sapiens
aacacattgagtttaagtctctg

SEQ ID NO: 4213507 - DNA, 15 bp, Homo sapiens
aacagctccctagtg

SEQ ID NO: 4213508 - DNA, 15 bp, Homo sapiens
aacagtgctgttctg

SEQ ID NO: 4213509 - DNA, 23 bp, Homo sapiens
aacatggcaaaaccccatctcta

SEQ ID NO: 4213510 - DNA, 14 bp, Homo sapiens
aacccaaaggaccc

SEQ ID NO: 4213511 - DNA, 16 bp, Homo sapiens
aaccccaagttagttc

SEQ ID NO: 4213512 - DNA, 16 bp, Homo sapiens
aacgaaatatcaaagt

SEQ ID NO: 4213513 - DNA, 15 bp, Homo sapiens
aactaaaatgttcta

SEQ ID NO: 4213514 - DNA, 16 bp, Homo sapiens
aactatgatttggaaa

SEQ ID NO: 4213515 - DNA, 21 bp, Homo sapiens
aactatgatttggaaaataaa

SEQ ID NO: 4213516 - DNA, 21 bp, Homo sapiens
aactattgtgctcagagacac

SEQ ID NO: 4213517 - DNA, 22 bp, Homo sapiens
aactattgtgctcagagacact

SEQ ID NO: 4213518 - DNA, 14 bp, Homo sapiens
aactcaggcaaaga

SEQ ID NO: 4213519 - DNA, 17 bp, Homo sapiens
aactcaggcaaagaaaa

SEQ ID NO: 4213520 - DNA, 13 bp, Homo sapiens
aactgccaagaaa

SEQ ID NO: 4213521 - DNA, 14 bp, Homo sapiens
aactgtttaacact

SEQ ID NO: 4213522 - DNA, 23 bp, Homo sapiens
aacttcactccaaagagaaacct

SEQ ID NO: 4213523 - DNA, 22 bp, Homo sapiens
aacttggctctcaataaacttt

SEQ ID NO: 4213524 - DNA, 12 bp, Homo sapiens
aacttgggaact

SEQ ID NO: 4213525 - DNA, 15 bp, Homo sapiens
aacttgtaaatgtgg

SEQ ID NO: 4213526 - DNA, 21 bp, Homo sapiens
aacttttaatgccttccacat

SEQ ID NO: 4213527 - DNA, 22 bp, Homo sapiens
aactttttaccaagtacaaaaa

SEQ ID NO: 4213528 - DNA, 14 bp, Homo sapiens
aagaaaaaatggca

SEQ ID NO: 4213529 - DNA, 15 bp, Homo sapiens
aagaagagctatcag

SEQ ID NO: 4213530 - DNA, 15 bp, Homo sapiens
aagaagagtttgcaa

SEQ ID NO: 4213531 - DNA, 17 bp, Homo sapiens
aagaaggatgatgtctt

SEQ ID NO: 4213532 - DNA, 21 bp, Homo sapiens
aagaatgttagagtaatgaaa

SEQ ID NO: 4213533 - DNA, 13 bp, Homo sapiens
aagacaaatattc

SEQ ID NO: 4213534 - DNA, 20 bp, Homo sapiens
aagacaaatattcctttgca

SEQ ID NO: 4213535 - DNA, 14 bp, Homo sapiens
aagacaccaaattc

SEQ ID NO: 4213536 - DNA, 14 bp, Homo sapiens
aagacaggagacaa

SEQ ID NO: 4213537 - DNA, 16 bp, Homo sapiens
aagaccgaattttatt

SEQ ID NO: 4213538 - DNA, 12 bp, Homo sapiens
aagactaaaagt

SEQ ID NO: 4213539 - DNA, 15 bp, Homo sapiens
aagagacatccaaat

SEQ ID NO: 4213540 - DNA, 15 bp, Homo sapiens
aagagcaaactttag

SEQ ID NO: 4213541 - DNA, 16 bp, Homo sapiens
aagagcaaactttagt

SEQ ID NO: 4213542 - DNA, 16 bp, Homo sapiens
aagaggcgacttcctc

SEQ ID NO: 4213543 - DNA, 21 bp, Homo sapiens
aagagttctttaggtgcctcc

SEQ ID NO: 4213544 - DNA, 18 bp, Homo sapiens
aagatatttctttaaatt

SEQ ID NO: 4213545 - DNA, 22 bp, Homo sapiens
aagattctatgttaatatttta

SEQ ID NO: 4213546 - DNA, 16 bp, Homo sapiens
aagcctgaaaattcca

SEQ ID NO: 4213547 - DNA, 16 bp, Homo sapiens
aaggaacccaattttc

SEQ ID NO: 4213548 - DNA, 12 bp, Homo sapiens
aaggataaagaa

SEQ ID NO: 4213549 - DNA, 19 bp, Homo sapiens
aaggctgagaggagagaga

SEQ ID NO: 4213550 - DNA, 14 bp, Homo sapiens
aagggcataaagta

SEQ ID NO: 4213551 - DNA, 19 bp, Homo sapiens
aaggtattgagccattttt

SEQ ID NO: 4213552 - DNA, 16 bp, Homo sapiens
aaggtatttacacata

SEQ ID NO: 4213553 - DNA, 23 bp, Homo sapiens
aaggtttcagaaagaagtgggga

SEQ ID NO: 4213554 - DNA, 18 bp, Homo sapiens
aagtaacagttgaagaaa

SEQ ID NO: 4213555 - DNA, 19 bp, Homo sapiens
aagtaacagttgaagaaaa

SEQ ID NO: 4213556 - DNA, 21 bp, Homo sapiens
aagtaacagttgaagaaaaaa

SEQ ID NO: 4213557 - DNA, 20 bp, Homo sapiens
aagtataaaatagtatgaaa

SEQ ID NO: 4213558 - DNA, 19 bp, Homo sapiens
aagtatgtatattaaaaaa

SEQ ID NO: 4213559 - DNA, 21 bp, Homo sapiens
aagtatgtatattaaaaaaga

SEQ ID NO: 4213560 - DNA, 17 bp, Homo sapiens
aagtcatcatctccaaa

SEQ ID NO: 4213561 - DNA, 21 bp, Homo sapiens
aagtcatgcgtttaatcacat

SEQ ID NO: 4213562 - DNA, 15 bp, Homo sapiens
aagtcattaaagaca

SEQ ID NO: 4213563 - DNA, 13 bp, Homo sapiens
aagtcttctattt

SEQ ID NO: 4213564 - DNA, 14 bp, Homo sapiens
aagtgttgaagaag

SEQ ID NO: 4213565 - DNA, 22 bp, Homo sapiens
aagtgttgaagaagagtttgca

SEQ ID NO: 4213566 - DNA, 15 bp, Homo sapiens
aagtgtttatgttgt

SEQ ID NO: 4213567 - DNA, 19 bp, Homo sapiens
aataaaattttcaaacttt

SEQ ID NO: 4213568 - DNA, 23 bp, Homo sapiens
aataaacttttaccacaaattga

SEQ ID NO: 4213569 - DNA, 21 bp, Homo sapiens
aataaatcattcttactaaaa

SEQ ID NO: 4213570 - DNA, 13 bp, Homo sapiens
aataatagactgt

SEQ ID NO: 4213571 - DNA, 15 bp, Homo sapiens
aataattttcctcct

SEQ ID NO: 4213572 - DNA, 23 bp, Homo sapiens
aatacaaaaatgagctaggcatg

SEQ ID NO: 4213573 - DNA, 14 bp, Homo sapiens
aatagtatgaaaat

SEQ ID NO: 4213574 - DNA, 14 bp, Homo sapiens
aatagttgttgatt

SEQ ID NO: 4213575 - DNA, 20 bp, Homo sapiens
aatatcaaagtcattaaaga

SEQ ID NO: 4213576 - DNA, 21 bp, Homo sapiens
aatattttaggtgtaaaataa

SEQ ID NO: 4213577 - DNA, 17 bp, Homo sapiens
aatcagcatgattcttc

SEQ ID NO: 4213578 - DNA, 17 bp, Homo sapiens
aatccatcctgctcttc

SEQ ID NO: 4213579 - DNA, 20 bp, Homo sapiens
aatgcaacaaaatatttaat

SEQ ID NO: 4213580 - DNA, 13 bp, Homo sapiens
aatgcataaaatg

SEQ ID NO: 4213581 - DNA, 14 bp, Homo sapiens
aatgccctctctga

SEQ ID NO: 4213582 - DNA, 22 bp, Homo sapiens
aatgctgtattagtcacagaga

SEQ ID NO: 4213583 - DNA, 14 bp, Homo sapiens
aatgctttcctccc

SEQ ID NO: 4213584 - DNA, 16 bp, Homo sapiens
aatgctttcctccctg

SEQ ID NO: 4213585 - DNA, 13 bp, Homo sapiens
aatggaaacttta

SEQ ID NO: 4213586 - DNA, 13 bp, Homo sapiens
aatggcaagagat

SEQ ID NO: 4213587 - DNA, 22 bp, Homo sapiens
aatgggaaaacttcactccaaa

SEQ ID NO: 4213588 - DNA, 19 bp, Homo sapiens
aatgtcagttgttatttat

SEQ ID NO: 4213589 - DNA, 20 bp, Homo sapiens
aatgtcagttgttatttatt

SEQ ID NO: 4213590 - DNA, 17 bp, Homo sapiens
aatgtctgtaataatag

SEQ ID NO: 4213591 - DNA, 17 bp, Homo sapiens
aatgtgatttgtcttcc

SEQ ID NO: 4213592 - DNA, 12 bp, Homo sapiens
aatgttagagta

SEQ ID NO: 4213593 - DNA, 16 bp, Homo sapiens
aattatttaattgtcc

SEQ ID NO: 4213594 - DNA, 14 bp, Homo sapiens
aattatttgattat

SEQ ID NO: 4213595 - DNA, 20 bp, Homo sapiens
aattatttgattatttaaga

SEQ ID NO: 4213596 - DNA, 18 bp, Homo sapiens
aattcatgtacagcatgc

SEQ ID NO: 4213597 - DNA, 17 bp, Homo sapiens
aattccacagtctctgg

SEQ ID NO: 4213598 - DNA, 20 bp, Homo sapiens
aattctggaggaagaagaca

SEQ ID NO: 4213599 - DNA, 16 bp, Homo sapiens
aattgtaaacagaaat

SEQ ID NO: 4213600 - DNA, 13 bp, Homo sapiens
aattgtgtttaga

SEQ ID NO: 4213601 - DNA, 17 bp, Homo sapiens
aattgtgtttagatttt

SEQ ID NO: 4213602 - DNA, 14 bp, Homo sapiens
aatttaaaaatata

SEQ ID NO: 4213603 - DNA, 17 bp, Homo sapiens
aatttaaaaatatattt

SEQ ID NO: 4213604 - DNA, 17 bp, Homo sapiens
aatttagggtgttaaac

SEQ ID NO: 4213605 - DNA, 19 bp, Homo sapiens
aattttaaagcctgaaaat

SEQ ID NO: 4213606 - DNA, 21 bp, Homo sapiens
aattttaaagcctgaaaattc

SEQ ID NO: 4213607 - DNA, 13 bp, Homo sapiens
aattttcctccta

SEQ ID NO: 4213608 - DNA, 20 bp, Homo sapiens
aattttgcagattattttag

SEQ ID NO: 4213609 - DNA, 18 bp, Homo sapiens
aattttgcagcagaagcc

SEQ ID NO: 4213610 - DNA, 14 bp, Homo sapiens
aattttttgtatat

SEQ ID NO: 4213611 - DNA, 15 bp, Homo sapiens
acaaaatatttaatt

SEQ ID NO: 4213612 - DNA, 19 bp, Homo sapiens
acaaaatctaatgttgtct

SEQ ID NO: 4213613 - DNA, 18 bp, Homo sapiens
acaaagttaaaattgtta

SEQ ID NO: 4213614 - DNA, 16 bp, Homo sapiens
acaagcttcagtaagt

SEQ ID NO: 4213615 - DNA, 19 bp, Homo sapiens
acaagcttcagtaagttat

SEQ ID NO: 4213616 - DNA, 16 bp, Homo sapiens
acaatggaaactttag

SEQ ID NO: 4213617 - DNA, 19 bp, Homo sapiens
acaatgggaaaacttcact

SEQ ID NO: 4213618 - DNA, 20 bp, Homo sapiens
acacatccccagccagaagt

SEQ ID NO: 4213619 - DNA, 18 bp, Homo sapiens
acacattacaaagttaaa

SEQ ID NO: 4213620 - DNA, 18 bp, Homo sapiens
acaccgttcattcaggca

SEQ ID NO: 4213621 - DNA, 18 bp, Homo sapiens
acacctcactgaggaagg

SEQ ID NO: 4213622 - DNA, 23 bp, Homo sapiens
acacctcccaggggctccacctg

SEQ ID NO: 4213623 - DNA, 17 bp, Homo sapiens
acacgcctgtaatccca

SEQ ID NO: 4213624 - DNA, 18 bp, Homo sapiens
acactgtcctattatatt

SEQ ID NO: 4213625 - DNA, 17 bp, Homo sapiens
acactgttgataaaaac

SEQ ID NO: 4213626 - DNA, 14 bp, Homo sapiens
acagaaattgcaat

SEQ ID NO: 4213627 - DNA, 19 bp, Homo sapiens
acagcaattcctcaggcta

SEQ ID NO: 4213628 - DNA, 12 bp, Homo sapiens
acagctccctag

SEQ ID NO: 4213629 - DNA, 21 bp, Homo sapiens
acagcttggtgtacttaatac

SEQ ID NO: 4213630 - DNA, 21 bp, Homo sapiens
acaggcagttttgaaatgaaa

SEQ ID NO: 4213631 - DNA, 22 bp, Homo sapiens
acagtagcagggaattgatcca

SEQ ID NO: 4213632 - DNA, 12 bp, Homo sapiens
acagtctctggg

SEQ ID NO: 4213633 - DNA, 20 bp, Homo sapiens
acagtgctgaccagacagcc

SEQ ID NO: 4213634 - DNA, 13 bp, Homo sapiens
acagtgctgttct

SEQ ID NO: 4213635 - DNA, 15 bp, Homo sapiens
acagtgctgttctgg

SEQ ID NO: 4213636 - DNA, 21 bp, Homo sapiens
acagtgctgttctggagctgc

SEQ ID NO: 4213637 - DNA, 22 bp, Homo sapiens
acagtgtgtggtcaacatttct

SEQ ID NO: 4213638 - DNA, 17 bp, Homo sapiens
acataaaagaaataaac

SEQ ID NO: 4213639 - DNA, 21 bp, Homo sapiens
acatactcaggataacagaga

SEQ ID NO: 4213640 - DNA, 20 bp, Homo sapiens
acataggttagattctcatt

SEQ ID NO: 4213641 - DNA, 22 bp, Homo sapiens
acattggagacatcacttgcca

SEQ ID NO: 4213642 - DNA, 13 bp, Homo sapiens
acattttatgtct

SEQ ID NO: 4213643 - DNA, 19 bp, Homo sapiens
accaacctgaagacaccgt

SEQ ID NO: 4213644 - DNA, 21 bp, Homo sapiens
accaagaattacaagtagaat

SEQ ID NO: 4213645 - DNA, 18 bp, Homo sapiens
accagcatgtcactccca

SEQ ID NO: 4213646 - DNA, 19 bp, Homo sapiens
acccagaaacaacacaatc

SEQ ID NO: 4213647 - DNA, 18 bp, Homo sapiens
accctcatacacagaaac

SEQ ID NO: 4213648 - DNA, 19 bp, Homo sapiens
accctggagcggctctcct

SEQ ID NO: 4213649 - DNA, 12 bp, Homo sapiens
accgaattttat

SEQ ID NO: 4213650 - DNA, 22 bp, Homo sapiens
accgaattttattttacagagc

SEQ ID NO: 4213651 - DNA, 20 bp, Homo sapiens
acctcccaggggctccacct

SEQ ID NO: 4213652 - DNA, 20 bp, Homo sapiens
acctggaatcagattattaa

SEQ ID NO: 4213653 - DNA, 22 bp, Homo sapiens
acctggattgtgcctaatgtgt

SEQ ID NO: 4213654 - DNA, 22 bp, Homo sapiens
acctggattttttatgtacaac

SEQ ID NO: 4213655 - DNA, 21 bp, Homo sapiens
acctgtttatataattttgca

SEQ ID NO: 4213656 - DNA, 22 bp, Homo sapiens
acgcgacttccacaaacctgga

SEQ ID NO: 4213657 - DNA, 17 bp, Homo sapiens
actaaaaagtataaaat

SEQ ID NO: 4213658 - DNA, 21 bp, Homo sapiens
actaaaaagtataaaatagta

SEQ ID NO: 4213659 - DNA, 13 bp, Homo sapiens
actaaaccctcac

SEQ ID NO: 4213660 - DNA, 15 bp, Homo sapiens
actaattgagccatt

SEQ ID NO: 4213661 - DNA, 17 bp, Homo sapiens
actacttgggagcaccg

SEQ ID NO: 4213662 - DNA, 23 bp, Homo sapiens
actagaagaaagggcaagaagga

SEQ ID NO: 4213663 - DNA, 20 bp, Homo sapiens
cagctccctagtggcttcct

SEQ ID NO: 4213664 - DNA, 23 bp, Homo sapiens
cagctccctagtggcttcctccg

SEQ ID NO: 4213665 - DNA, 21 bp, Homo sapiens
cagctggaattgctgctctct

SEQ ID NO: 4213666 - DNA, 22 bp, Homo sapiens
cagcttcccctcgctgtcctgc

SEQ ID NO: 4213667 - DNA, 12 bp, Homo sapiens
caggagggagag

SEQ ID NO: 4213668 - DNA, 21 bp, Homo sapiens
caggagttcgagaccagccca

SEQ ID NO: 4213669 - DNA, 22 bp, Homo sapiens
caggagttcgagaccagcccag

SEQ ID NO: 4213670 - DNA, 15 bp, Homo sapiens
caggataacagagaa

SEQ ID NO: 4213671 - DNA, 21 bp, Homo sapiens
caggattccaaagttttgaag

SEQ ID NO: 4213672 - DNA, 17 bp, Homo sapiens
caggcaaagaaaatgaa

SEQ ID NO: 4213673 - DNA, 23 bp, Homo sapiens
caggcagttttgaaatgaaaatc

SEQ ID NO: 4213674 - DNA, 19 bp, Homo sapiens
caggccaggttatgcctca

SEQ ID NO: 4213675 - DNA, 19 bp, Homo sapiens
caggctggagattttcaca

SEQ ID NO: 4213676 - DNA, 15 bp, Homo sapiens
cagggcaaggccatt

SEQ ID NO: 4213677 - DNA, 19 bp, Homo sapiens
caggggctccacctgttca

SEQ ID NO: 4213678 - DNA, 12 bp, Homo sapiens
cagtagcaggga

SEQ ID NO: 4213679 - DNA, 14 bp, Homo sapiens
cagtgctgttctgg

SEQ ID NO: 4213680 - DNA, 11 bp, Homo sapiens
cagtgggaact

SEQ ID NO: 4213681 - DNA, 17 bp, Homo sapiens
cagtggtaagaatagta

SEQ ID NO: 4213682 - DNA, 17 bp, Homo sapiens
cagtgtgtggtcaacat

SEQ ID NO: 4213683 - DNA, 20 bp, Homo sapiens
cagttgaagaaaaaatggca

SEQ ID NO: 4213684 - DNA, 16 bp, Homo sapiens
cagtttgtcttggata

SEQ ID NO: 4213685 - DNA, 21 bp, Homo sapiens
cagtttttttatggcattttt

SEQ ID NO: 4213686 - DNA, 16 bp, Homo sapiens
cataaaagaaataaac

SEQ ID NO: 4213687 - DNA, 22 bp, Homo sapiens
cataaagtaaatacatgcatat

SEQ ID NO: 4213688 - DNA, 15 bp, Homo sapiens
cataatttaaaaata

SEQ ID NO: 4213689 - DNA, 20 bp, Homo sapiens
cataatttaaaaatatattt

SEQ ID NO: 4213690 - DNA, 11 bp, Homo sapiens
catataagaca

SEQ ID NO: 4213691 - DNA, 18 bp, Homo sapiens
catataagacaaatattc

SEQ ID NO: 4213692 - DNA, 17 bp, Homo sapiens
catattataaaggataa

SEQ ID NO: 4213693 - DNA, 17 bp, Homo sapiens
catattcttggagaact

SEQ ID NO: 4213694 - DNA, 19 bp, Homo sapiens
catattcttggagaacttt

SEQ ID NO: 4213695 - DNA, 15 bp, Homo sapiens
catcaggactttccc

SEQ ID NO: 4213696 - DNA, 17 bp, Homo sapiens
catcaggactttccctg

SEQ ID NO: 4213697 - DNA, 14 bp, Homo sapiens
catcatctccaaac

SEQ ID NO: 4213698 - DNA, 18 bp, Homo sapiens
catcctccaattccacag

SEQ ID NO: 4213699 - DNA, 14 bp, Homo sapiens
catcctgctcttcc

SEQ ID NO: 4213700 - DNA, 15 bp, Homo sapiens
catctgggaggctgg

SEQ ID NO: 4213701 - DNA, 20 bp, Homo sapiens
catctgggaggctggtctcc

SEQ ID NO: 4213702 - DNA, 21 bp, Homo sapiens
catgaaataaaatatatctta

SEQ ID NO: 4213703 - DNA, 19 bp, Homo sapiens
catgaaccatccttcccat

SEQ ID NO: 4213704 - DNA, 16 bp, Homo sapiens
catgaccatcctgtcc

SEQ ID NO: 4213705 - DNA, 20 bp, Homo sapiens
catgcaccctcatacacaga

SEQ ID NO: 4213706 - DNA, 12 bp, Homo sapiens
catgcatataat

SEQ ID NO: 4213707 - DNA, 14 bp, Homo sapiens
catgcatataatga

SEQ ID NO: 4213708 - DNA, 18 bp, Homo sapiens
catgcatataatgaataa

SEQ ID NO: 4213709 - DNA, 21 bp, Homo sapiens
catgcatataatgaataaatc

SEQ ID NO: 4213710 - DNA, 22 bp, Homo sapiens
catgcatataatgaataaatca

SEQ ID NO: 4213711 - DNA, 12 bp, Homo sapiens
catgctttccca

SEQ ID NO: 4213712 - DNA, 21 bp, Homo sapiens
catgctttcccaccagcatgt

SEQ ID NO: 4213713 - DNA, 21 bp, Homo sapiens
catggagaagttgccaagagt

SEQ ID NO: 4213714 - DNA, 14 bp, Homo sapiens
catgtacagcatgc

SEQ ID NO: 4213715 - DNA, 15 bp, Homo sapiens
catgtacagcatgca

SEQ ID NO: 4213716 - DNA, 13 bp, Homo sapiens
catgtcgcctgcc

SEQ ID NO: 4213717 - DNA, 18 bp, Homo sapiens
catgtcgcctgcccccag

SEQ ID NO: 4213718 - DNA, 15 bp, Homo sapiens
catgtctatttttga

SEQ ID NO: 4213719 - DNA, 14 bp, Homo sapiens
cattagttttgaag

SEQ ID NO: 4213720 - DNA, 15 bp, Homo sapiens
cattagttttgaaga

SEQ ID NO: 4213721 - DNA, 12 bp, Homo sapiens
cattcttactaa

SEQ ID NO: 4213722 - DNA, 19 bp, Homo sapiens
cattcttactaaaaagtat

SEQ ID NO: 4213723 - DNA, 22 bp, Homo sapiens
cattcttactaaaaagtataaa

SEQ ID NO: 4213724 - DNA, 13 bp, Homo sapiens
cattctttttgaa

SEQ ID NO: 4213725 - DNA, 21 bp, Homo sapiens
cattgaagaatgttagagtaa

SEQ ID NO: 4213726 - DNA, 22 bp, Homo sapiens
cattgaagaatgttagagtaat

SEQ ID NO: 4213727 - DNA, 16 bp, Homo sapiens
catttctcatgttgaa

SEQ ID NO: 4213728 - DNA, 17 bp, Homo sapiens
catttcttaaaatgttt

SEQ ID NO: 4213729 - DNA, 17 bp, Homo sapiens
catttggggtaatactt

SEQ ID NO: 4213730 - DNA, 20 bp, Homo sapiens
catttttgaatacaggcata

SEQ ID NO: 4213731 - DNA, 11 bp, Homo sapiens
ccaaagagaaa

SEQ ID NO: 4213732 - DNA, 14 bp, Homo sapiens
ccaaagagaaacct

SEQ ID NO: 4213733 - DNA, 19 bp, Homo sapiens
ccaagaaaaggcatggaga

SEQ ID NO: 4213734 - DNA, 22 bp, Homo sapiens
ccaagggcggggctatgccttg

SEQ ID NO: 4213735 - DNA, 18 bp, Homo sapiens
ccaatgttcctgctaata

SEQ ID NO: 4213736 - DNA, 13 bp, Homo sapiens
ccacagtctctgg

SEQ ID NO: 4213737 - DNA, 18 bp, Homo sapiens
ccacattaattagatttt

SEQ ID NO: 4213738 - DNA, 22 bp, Homo sapiens
ccacctccctgccctgtcctcc

SEQ ID NO: 4213739 - DNA, 19 bp, Homo sapiens
ccacctgttcaggagctga

SEQ ID NO: 4213740 - DNA, 22 bp, Homo sapiens
ccactaaaacaaaacaaaaaac

SEQ ID NO: 4213741 - DNA, 17 bp, Homo sapiens
ccactgcagagatggtg

SEQ ID NO: 4213742 - DNA, 21 bp, Homo sapiens
ccacttcttaatgctttcctc

SEQ ID NO: 4213743 - DNA, 23 bp, Homo sapiens
ccagaagacctcccttcaggtgc

SEQ ID NO: 4213744 - DNA, 20 bp, Homo sapiens
ccagaccacctccctgccct

SEQ ID NO: 4213745 - DNA, 14 bp, Homo sapiens
ccagcactcctctg

SEQ ID NO: 4213746 - DNA, 17 bp, Homo sapiens
ccagcactcctctgtct

SEQ ID NO: 4213747 - DNA, 21 bp, Homo sapiens
ccagcactcctctgtctctgc

SEQ ID NO: 4213748 - DNA, 19 bp, Homo sapiens
ccagcatgtcactcccaga

SEQ ID NO: 4213749 - DNA, 15 bp, Homo sapiens
ccagccttctctctc

SEQ ID NO: 4213750 - DNA, 18 bp, Homo sapiens
ccagccttctctctctgg

SEQ ID NO: 4213751 - DNA, 22 bp, Homo sapiens
ccagcttcccctcgctgtcctg

SEQ ID NO: 4213752 - DNA, 15 bp, Homo sapiens
ccaggggctccacct

SEQ ID NO: 4213753 - DNA, 16 bp, Homo sapiens
ccaggggctccacctg

SEQ ID NO: 4213754 - DNA, 16 bp, Homo sapiens
ccatacacatccccag

SEQ ID NO: 4213755 - DNA, 19 bp, Homo sapiens
ccatacataaaagaaataa

SEQ ID NO: 4213756 - DNA, 12 bp, Homo sapiens
ccatccttccca

SEQ ID NO: 4213757 - DNA, 15 bp, Homo sapiens
ccatccttcccatga

SEQ ID NO: 4213758 - DNA, 22 bp, Homo sapiens
ccatgatgccgctcttctgtca

SEQ ID NO: 4213759 - DNA, 14 bp, Homo sapiens
ccatggagcaggga

SEQ ID NO: 4213760 - DNA, 22 bp, Homo sapiens
cccagcactcctctgtctctgc

SEQ ID NO: 4213761 - DNA, 23 bp, Homo sapiens
cccagcactcctctgtctctgct

SEQ ID NO: 4213762 - DNA, 19 bp, Homo sapiens
cccagggcacttcagagta

SEQ ID NO: 4213763 - DNA, 15 bp, Homo sapiens
cccatgacctttttc

SEQ ID NO: 4213764 - DNA, 13 bp, Homo sapiens
ccccagccagaag

SEQ ID NO: 4213765 - DNA, 20 bp, Homo sapiens
ccccatttgtttgtgcttca

SEQ ID NO: 4213766 - DNA, 13 bp, Homo sapiens
cccctcgctgtcc

SEQ ID NO: 4213767 - DNA, 16 bp, Homo sapiens
cccgctttgcctgctt

SEQ ID NO: 4213768 - DNA, 16 bp, Homo sapiens
ccctcactgccttcca

SEQ ID NO: 4213769 - DNA, 15 bp, Homo sapiens
ccctcgctgtcctgc

SEQ ID NO: 4213770 - DNA, 19 bp, Homo sapiens
ccctcgctgtcctgctgtg

SEQ ID NO: 4213771 - DNA, 14 bp, Homo sapiens
ccctctcttgcctt

SEQ ID NO: 4213772 - DNA, 14 bp, Homo sapiens
ccctctctttctaa

SEQ ID NO: 4213773 - DNA, 21 bp, Homo sapiens
ccctgactgtgttgtcccagg

SEQ ID NO: 4213774 - DNA, 21 bp, Homo sapiens
ccctggaaggacatccatgtt

SEQ ID NO: 4213775 - DNA, 18 bp, Homo sapiens
ccctggagcggctctcct

SEQ ID NO: 4213776 - DNA, 21 bp, Homo sapiens
ccctggagcggctctcctgag

SEQ ID NO: 4213777 - DNA, 15 bp, Homo sapiens
ccctgtagagtcact

SEQ ID NO: 4213778 - DNA, 18 bp, Homo sapiens
ccctgtcctccagcttcc

SEQ ID NO: 4213779 - DNA, 15 bp, Homo sapiens
cccttggacatttta

SEQ ID NO: 4213780 - DNA, 17 bp, Homo sapiens
ccgaagaccgaatttta

SEQ ID NO: 4213781 - DNA, 23 bp, Homo sapiens
ccgaattttattttacagagctt

SEQ ID NO: 4213782 - DNA, 17 bp, Homo sapiens
ccgagtttgggccactg

SEQ ID NO: 4213783 - DNA, 14 bp, Homo sapiens
ccgctttgcctgct

SEQ ID NO: 4213784 - DNA, 21 bp, Homo sapiens
ccggtgtggtggctcacgcct

SEQ ID NO: 4213785 - DNA, 23 bp, Homo sapiens
attaagagcaaactttagtgtct

SEQ ID NO: 4213786 - DNA, 20 bp, Homo sapiens
attaagtcatcatctccaaa

SEQ ID NO: 4213787 - DNA, 20 bp, Homo sapiens
attaattagattttcttgca

SEQ ID NO: 4213788 - DNA, 17 bp, Homo sapiens
attactggataaattgt

SEQ ID NO: 4213789 - DNA, 24 bp, Homo sapiens
attactgtttaattgacatactca

SEQ ID NO: 4213790 - DNA, 16 bp, Homo sapiens
attagatgttttacaa

SEQ ID NO: 4213791 - DNA, 13 bp, Homo sapiens
attataaaatttt

SEQ ID NO: 4213792 - DNA, 16 bp, Homo sapiens
attatattcattcttt

SEQ ID NO: 4213793 - DNA, 16 bp, Homo sapiens
attatcatgtctattt

SEQ ID NO: 4213794 - DNA, 21 bp, Homo sapiens
attatcatgtctatttttgat

SEQ ID NO: 4213795 - DNA, 14 bp, Homo sapiens
attatgttaatatt

SEQ ID NO: 4213796 - DNA, 12 bp, Homo sapiens
attattctaatt

SEQ ID NO: 4213797 - DNA, 15 bp, Homo sapiens
attatttgattattt

SEQ ID NO: 4213798 - DNA, 19 bp, Homo sapiens
attatttgattatttaaga

SEQ ID NO: 4213799 - DNA, 20 bp, Homo sapiens
attcacaatggaaactttag

SEQ ID NO: 4213800 - DNA, 15 bp, Homo sapiens
attcattctttttga

SEQ ID NO: 4213801 - DNA, 21 bp, Homo sapiens
attcattctttttgaaatgtc

SEQ ID NO: 4213802 - DNA, 23 bp, Homo sapiens
attcctagttccccgtgaacttc

SEQ ID NO: 4213803 - DNA, 14 bp, Homo sapiens
attcctttgcatat

SEQ ID NO: 4213804 - DNA, 15 bp, Homo sapiens
attctaattttatat

SEQ ID NO: 4213805 - DNA, 15 bp, Homo sapiens
attctatgttaatat

SEQ ID NO: 4213806 - DNA, 21 bp, Homo sapiens
attctccaggattccaaagtt

SEQ ID NO: 4213807 - DNA, 13 bp, Homo sapiens
attcttactaaaa

SEQ ID NO: 4213808 - DNA, 19 bp, Homo sapiens
attcttgttgctgtacaaa

SEQ ID NO: 4213809 - DNA, 13 bp, Homo sapiens
attgatgttttca

SEQ ID NO: 4213810 - DNA, 15 bp, Homo sapiens
attgctgctctctga

SEQ ID NO: 4213811 - DNA, 18 bp, Homo sapiens
attgctgctctctgaggg

SEQ ID NO: 4213812 - DNA, 19 bp, Homo sapiens
attgcttgaaccggggaga

SEQ ID NO: 4213813 - DNA, 19 bp, Homo sapiens
attgtaatacacatatcta

SEQ ID NO: 4213814 - DNA, 19 bp, Homo sapiens
attgtacaaggtatttaca

SEQ ID NO: 4213815 - DNA, 23 bp, Homo sapiens
attgtacaaggtatttacacata

SEQ ID NO: 4213816 - DNA, 23 bp, Homo sapiens
attgtccagtttgtcttggatat

SEQ ID NO: 4213817 - DNA, 15 bp, Homo sapiens
attgtgctcagagac

SEQ ID NO: 4213818 - DNA, 15 bp, Homo sapiens
atttaaaaatatatt

SEQ ID NO: 4213819 - DNA, 13 bp, Homo sapiens
atttaatttgaag

SEQ ID NO: 4213820 - DNA, 16 bp, Homo sapiens
atttaatttttgcaat

SEQ ID NO: 4213821 - DNA, 14 bp, Homo sapiens
atttatattttccc

SEQ ID NO: 4213822 - DNA, 21 bp, Homo sapiens
atttatgtaatgctttatgtt

SEQ ID NO: 4213823 - DNA, 13 bp, Homo sapiens
atttattgaaatg

SEQ ID NO: 4213824 - DNA, 14 bp, Homo sapiens
atttatttattcat

SEQ ID NO: 4213825 - DNA, 16 bp, Homo sapiens
atttctggcttctagt

SEQ ID NO: 4213826 - DNA, 15 bp, Homo sapiens
atttcttaaaatgtt

SEQ ID NO: 4213827 - DNA, 16 bp, Homo sapiens
atttgattatttaaga

SEQ ID NO: 4213828 - DNA, 13 bp, Homo sapiens
atttgcaataaaa

SEQ ID NO: 4213829 - DNA, 13 bp, Homo sapiens
atttgtcttccct

SEQ ID NO: 4213830 - DNA, 14 bp, Homo sapiens
atttgtttgtgctt

SEQ ID NO: 4213831 - DNA, 16 bp, Homo sapiens
atttgtttgtgcttca

SEQ ID NO: 4213832 - DNA, 22 bp, Homo sapiens
attttacaagggcataaagtaa

SEQ ID NO: 4213833 - DNA, 17 bp, Homo sapiens
attttacctagctaatt

SEQ ID NO: 4213834 - DNA, 19 bp, Homo sapiens
attttacctagctaattat

SEQ ID NO: 4213835 - DNA, 17 bp, Homo sapiens
attttagtctgtcatcc

SEQ ID NO: 4213836 - DNA, 22 bp, Homo sapiens
attttcacttttggcaatgact

SEQ ID NO: 4213837 - DNA, 14 bp, Homo sapiens
attttccctctctt

SEQ ID NO: 4213838 - DNA, 11 bp, Homo sapiens
attttcctcct

SEQ ID NO: 4213839 - DNA, 19 bp, Homo sapiens
attttgcagattattttag

SEQ ID NO: 4213840 - DNA, 11 bp, Homo sapiens
atttttgcaat

SEQ ID NO: 4213841 - DNA, 16 bp, Homo sapiens
attttttatgtacaac

SEQ ID NO: 4213842 - DNA, 19 bp, Homo sapiens
caaaaaaagggcaataaat

SEQ ID NO: 4213843 - DNA, 20 bp, Homo sapiens
caaaaatgagctaggcatgg

SEQ ID NO: 4213844 - DNA, 21 bp, Homo sapiens
caaaaattgtgtttagatttt

SEQ ID NO: 4213845 - DNA, 13 bp, Homo sapiens
caaactaaaccct

SEQ ID NO: 4213846 - DNA, 16 bp, Homo sapiens
caaacttctaaatgtt

SEQ ID NO: 4213847 - DNA, 14 bp, Homo sapiens
caaagaaaatgaaa

SEQ ID NO: 4213848 - DNA, 22 bp, Homo sapiens
caaagtgtattaggaagtgttt

SEQ ID NO: 4213849 - DNA, 17 bp, Homo sapiens
caaagttaaaattgtta

SEQ ID NO: 4213850 - DNA, 17 bp, Homo sapiens
caaataaataattttca

SEQ ID NO: 4213851 - DNA, 12 bp, Homo sapiens
caaatttatatg

SEQ ID NO: 4213852 - DNA, 16 bp, Homo sapiens
caacaaaatatttaat

SEQ ID NO: 4213853 - DNA, 14 bp, Homo sapiens
caagactccgtctc

SEQ ID NO: 4213854 - DNA, 14 bp, Homo sapiens
caagaggagatcca

SEQ ID NO: 4213855 - DNA, 13 bp, Homo sapiens
caagcaagaaaca

SEQ ID NO: 4213856 - DNA, 18 bp, Homo sapiens
caagggcggggctatgcc

SEQ ID NO: 4213857 - DNA, 16 bp, Homo sapiens
caagttagttcaatct

SEQ ID NO: 4213858 - DNA, 13 bp, Homo sapiens
caagtttacatga

SEQ ID NO: 4213859 - DNA, 16 bp, Homo sapiens
caatctggattcatat

SEQ ID NO: 4213860 - DNA, 20 bp, Homo sapiens
caatctggattcatatttaa

SEQ ID NO: 4213861 - DNA, 18 bp, Homo sapiens
caatcttattactgagag

SEQ ID NO: 4213862 - DNA, 19 bp, Homo sapiens
caatgagatcattgtgaag

SEQ ID NO: 4213863 - DNA, 16 bp, Homo sapiens
caatttatattttccc

SEQ ID NO: 4213864 - DNA, 15 bp, Homo sapiens
caatttgcacatgta

SEQ ID NO: 4213865 - DNA, 18 bp, Homo sapiens
cacacgcctgtaatccca

SEQ ID NO: 4213866 - DNA, 19 bp, Homo sapiens
cacagactacagccagaag

SEQ ID NO: 4213867 - DNA, 14 bp, Homo sapiens
cacagtctctggga

SEQ ID NO: 4213868 - DNA, 21 bp, Homo sapiens
cacataggttagattctcatt

SEQ ID NO: 4213869 - DNA, 13 bp, Homo sapiens
cacattgaagaat

SEQ ID NO: 4213870 - DNA, 13 bp, Homo sapiens
caccagcatgtca

SEQ ID NO: 4213871 - DNA, 14 bp, Homo sapiens
caccagcatgtcac

SEQ ID NO: 4213872 - DNA, 23 bp, Homo sapiens
cacctcccaggggctccacctgt

SEQ ID NO: 4213873 - DNA, 15 bp, Homo sapiens
cacctgctttctcct

SEQ ID NO: 4213874 - DNA, 16 bp, Homo sapiens
cacctgctttctcctg

SEQ ID NO: 4213875 - DNA, 17 bp, Homo sapiens
cacctgctttctcctgg

SEQ ID NO: 4213876 - DNA, 14 bp, Homo sapiens
cacctggaatcaga

SEQ ID NO: 4213877 - DNA, 17 bp, Homo sapiens
cacgcctataatcccag

SEQ ID NO: 4213878 - DNA, 19 bp, Homo sapiens
cacgcctataatcccagca

SEQ ID NO: 4213879 - DNA, 21 bp, Homo sapiens
cacgcctataatcccagcact

SEQ ID NO: 4213880 - DNA, 14 bp, Homo sapiens
cacgcctgtaatcc

SEQ ID NO: 4213881 - DNA, 17 bp, Homo sapiens
cacgcctgtaatcccag

SEQ ID NO: 4213882 - DNA, 19 bp, Homo sapiens
cacgcctgtaatcccagct

SEQ ID NO: 4213883 - DNA, 18 bp, Homo sapiens
cacgtttgtgagaagaaa

SEQ ID NO: 4213884 - DNA, 21 bp, Homo sapiens
cactccaaagagaaacctatt

SEQ ID NO: 4213885 - DNA, 16 bp, Homo sapiens
cactcctctgtctctg

SEQ ID NO: 4213886 - DNA, 20 bp, Homo sapiens
cactcctctgtctctgctct

SEQ ID NO: 4213887 - DNA, 20 bp, Homo sapiens
cactgaatggctgacctgac

SEQ ID NO: 4213888 - DNA, 19 bp, Homo sapiens
cactgcactctagcctggc

SEQ ID NO: 4213889 - DNA, 19 bp, Homo sapiens
cactggcacgtttgtgaga

SEQ ID NO: 4213890 - DNA, 13 bp, Homo sapiens
cactgggcttcta

SEQ ID NO: 4213891 - DNA, 13 bp, Homo sapiens
cactgttgataaa

SEQ ID NO: 4213892 - DNA, 15 bp, Homo sapiens
cacttattgaatata

SEQ ID NO: 4213893 - DNA, 19 bp, Homo sapiens
cacttcagagtagagggct

SEQ ID NO: 4213894 - DNA, 19 bp, Homo sapiens
cacttcctaagttcccttc

SEQ ID NO: 4213895 - DNA, 24 bp, Homo sapiens
cagaaagaagtggggacagagcag

SEQ ID NO: 4213896 - DNA, 22 bp, Homo sapiens
cagaagtcacacattacaaagt

SEQ ID NO: 4213897 - DNA, 17 bp, Homo sapiens
cagaccacctccctgcc

SEQ ID NO: 4213898 - DNA, 19 bp, Homo sapiens
cagactacagccagaagcc

SEQ ID NO: 4213899 - DNA, 19 bp, Homo sapiens
cagagtagagggcttggga

SEQ ID NO: 4213900 - DNA, 23 bp, Homo sapiens
cagatatttttaacttaatggca

SEQ ID NO: 4213901 - DNA, 20 bp, Homo sapiens
cagatgtggtgatactgaga

SEQ ID NO: 4213902 - DNA, 14 bp, Homo sapiens
cagcactcctctgt

SEQ ID NO: 4213903 - DNA, 20 bp, Homo sapiens
cagcactcctctgtctctgc

SEQ ID NO: 4213904 - DNA, 11 bp, Homo sapiens
cagcagaagcc

SEQ ID NO: 4213905 - DNA, 22 bp, Homo sapiens
cagcccaagggcggggctatgc

SEQ ID NO: 4213906 - DNA, 15 bp, Homo sapiens
cagccccgctcccag

SEQ ID NO: 4213907 - DNA, 20 bp, Homo sapiens
cagccttctctctctggtca

SEQ ID NO: 4213908 - DNA, 17 bp, Homo sapiens
agtagaatggcagctgg

SEQ ID NO: 4213909 - DNA, 19 bp, Homo sapiens
agtatgaaaatggaaattt

SEQ ID NO: 4213910 - DNA, 15 bp, Homo sapiens
agtatgtatattaaa

SEQ ID NO: 4213911 - DNA, 20 bp, Homo sapiens
agtatgtatattaaaaaaga

SEQ ID NO: 4213912 - DNA, 14 bp, Homo sapiens
agtattattgaaga

SEQ ID NO: 4213913 - DNA, 17 bp, Homo sapiens
agtatttataatataaa

SEQ ID NO: 4213914 - DNA, 16 bp, Homo sapiens
agtcatcatctccaaa

SEQ ID NO: 4213915 - DNA, 16 bp, Homo sapiens
agtcatccacagccca

SEQ ID NO: 4213916 - DNA, 18 bp, Homo sapiens
agtcattatgttaatatt

SEQ ID NO: 4213917 - DNA, 17 bp, Homo sapiens
agtctctgactcttgcc

SEQ ID NO: 4213918 - DNA, 19 bp, Homo sapiens
agtctctgactcttgcctt

SEQ ID NO: 4213919 - DNA, 11 bp, Homo sapiens
agtctctggga

SEQ ID NO: 4213920 - DNA, 13 bp, Homo sapiens
agtctctgggaga

SEQ ID NO: 4213921 - DNA, 21 bp, Homo sapiens
agtctctgggagactttccct

SEQ ID NO: 4213922 - DNA, 14 bp, Homo sapiens
agtcttctatttat

SEQ ID NO: 4213923 - DNA, 22 bp, Homo sapiens
agtgaacattacattgccattt

SEQ ID NO: 4213924 - DNA, 20 bp, Homo sapiens
agtgacaaagttatatattt

SEQ ID NO: 4213925 - DNA, 14 bp, Homo sapiens
agtgctgttctgga

SEQ ID NO: 4213926 - DNA, 17 bp, Homo sapiens
agtgctgttctggagct

SEQ ID NO: 4213927 - DNA, 20 bp, Homo sapiens
agtggaagtatgtatattaa

SEQ ID NO: 4213928 - DNA, 22 bp, Homo sapiens
agtggaagtatgtatattaaaa

SEQ ID NO: 4213929 - DNA, 12 bp, Homo sapiens
agtggcttcctc

SEQ ID NO: 4213930 - DNA, 22 bp, Homo sapiens
agtgtaacgatgcactttggaa

SEQ ID NO: 4213931 - DNA, 20 bp, Homo sapiens
agttaaaattgttatcaaaa

SEQ ID NO: 4213932 - DNA, 20 bp, Homo sapiens
agttattacctttacatatt

SEQ ID NO: 4213933 - DNA, 16 bp, Homo sapiens
agttctttaggtgcct

SEQ ID NO: 4213934 - DNA, 22 bp, Homo sapiens
agttctttaggtgcctcctgtc

SEQ ID NO: 4213935 - DNA, 23 bp, Homo sapiens
agttctttaggtgcctcctgtct

SEQ ID NO: 4213936 - DNA, 14 bp, Homo sapiens
agttgaagaaaaaa

SEQ ID NO: 4213937 - DNA, 17 bp, Homo sapiens
agttgttatttattgaa

SEQ ID NO: 4213938 - DNA, 19 bp, Homo sapiens
agtttacatgataaaaaga

SEQ ID NO: 4213939 - DNA, 14 bp, Homo sapiens
agtttagtgtttct

SEQ ID NO: 4213940 - DNA, 19 bp, Homo sapiens
agtttgcaaatgcaacaaa

SEQ ID NO: 4213941 - DNA, 18 bp, Homo sapiens
agttttgaagattctatg

SEQ ID NO: 4213942 - DNA, 18 bp, Homo sapiens
ataaaattgctataaatc

SEQ ID NO: 4213943 - DNA, 23 bp, Homo sapiens
ataaagaaggatgatgtcttttt

SEQ ID NO: 4213944 - DNA, 12 bp, Homo sapiens
ataaataatttt

SEQ ID NO: 4213945 - DNA, 19 bp, Homo sapiens
ataaatcattcttactaaa

SEQ ID NO: 4213946 - DNA, 19 bp, Homo sapiens
ataaattatttgattattt

SEQ ID NO: 4213947 - DNA, 16 bp, Homo sapiens
ataactgagatgaatg

SEQ ID NO: 4213948 - DNA, 13 bp, Homo sapiens
ataatgaataaat

SEQ ID NO: 4213949 - DNA, 11 bp, Homo sapiens
ataattttcct

SEQ ID NO: 4213950 - DNA, 14 bp, Homo sapiens
ataattttcctcct

SEQ ID NO: 4213951 - DNA, 15 bp, Homo sapiens
ataattttcctccta

SEQ ID NO: 4213952 - DNA, 14 bp, Homo sapiens
atacataaaagaaa

SEQ ID NO: 4213953 - DNA, 16 bp, Homo sapiens
atacatataattcttt

SEQ ID NO: 4213954 - DNA, 21 bp, Homo sapiens
atacatgcatataatgaataa

SEQ ID NO: 4213955 - DNA, 18 bp, Homo sapiens
atactgccttgtttaatg

SEQ ID NO: 4213956 - DNA, 14 bp, Homo sapiens
atacttattaagag

SEQ ID NO: 4213957 - DNA, 21 bp, Homo sapiens
atagattgtaatacacatatc

SEQ ID NO: 4213958 - DNA, 15 bp, Homo sapiens
atagcatgaaataaa

SEQ ID NO: 4213959 - DNA, 16 bp, Homo sapiens
atagcatgaaataaaa

SEQ ID NO: 4213960 - DNA, 18 bp, Homo sapiens
ataggctattttctaaag

SEQ ID NO: 4213961 - DNA, 22 bp, Homo sapiens
atagtagatgtggcctttgaat

SEQ ID NO: 4213962 - DNA, 22 bp, Homo sapiens
atagtatttataatataaatca

SEQ ID NO: 4213963 - DNA, 12 bp, Homo sapiens
atataactgaga

SEQ ID NO: 4213964 - DNA, 13 bp, Homo sapiens
atataattctttt

SEQ ID NO: 4213965 - DNA, 19 bp, Homo sapiens
atatatcttataaagtgga

SEQ ID NO: 4213966 - DNA, 20 bp, Homo sapiens
atatcccttggacattttat

SEQ ID NO: 4213967 - DNA, 15 bp, Homo sapiens
atatgcagatactta

SEQ ID NO: 4213968 - DNA, 20 bp, Homo sapiens
atattactggataaattgta

SEQ ID NO: 4213969 - DNA, 19 bp, Homo sapiens
atattataaaggataaaga

SEQ ID NO: 4213970 - DNA, 12 bp, Homo sapiens
atattcctttgc

SEQ ID NO: 4213971 - DNA, 16 bp, Homo sapiens
atattcctttttctat

SEQ ID NO: 4213972 - DNA, 17 bp, Homo sapiens
atatttctcgtatttaa

SEQ ID NO: 4213973 - DNA, 18 bp, Homo sapiens
atatttctcgtatttaat

SEQ ID NO: 4213974 - DNA, 23 bp, Homo sapiens
atatttctgaggagcctgcaaca

SEQ ID NO: 4213975 - DNA, 16 bp, Homo sapiens
atatttgatacatata

SEQ ID NO: 4213976 - DNA, 21 bp, Homo sapiens
atattttccctctcttgcctt

SEQ ID NO: 4213977 - DNA, 14 bp, Homo sapiens
atcagaattttacc

SEQ ID NO: 4213978 - DNA, 13 bp, Homo sapiens
atccaaacagaaa

SEQ ID NO: 4213979 - DNA, 22 bp, Homo sapiens
atccagaaaatgtgtcagcatg

SEQ ID NO: 4213980 - DNA, 13 bp, Homo sapiens
atccatcctgctc

SEQ ID NO: 4213981 - DNA, 12 bp, Homo sapiens
atcctaatgaat

SEQ ID NO: 4213982 - DNA, 19 bp, Homo sapiens
atcctaatgaatgcataaa

SEQ ID NO: 4213983 - DNA, 23 bp, Homo sapiens
atctaatgttgtctttttaatgt

SEQ ID NO: 4213984 - DNA, 15 bp, Homo sapiens
atctctaaagagcat

SEQ ID NO: 4213985 - DNA, 18 bp, Homo sapiens
atctgcttgtattttcca

SEQ ID NO: 4213986 - DNA, 22 bp, Homo sapiens
atctgggaggctggtctccctc

SEQ ID NO: 4213987 - DNA, 15 bp, Homo sapiens
atcttagctttccac

SEQ ID NO: 4213988 - DNA, 15 bp, Homo sapiens
atctttgaatatgta

SEQ ID NO: 4213989 - DNA, 13 bp, Homo sapiens
atgaaccatcctt

SEQ ID NO: 4213990 - DNA, 14 bp, Homo sapiens
atgactcaaagtct

SEQ ID NO: 4213991 - DNA, 16 bp, Homo sapiens
atgactcatcaatttt

SEQ ID NO: 4213992 - DNA, 16 bp, Homo sapiens
atgagagcataattta

SEQ ID NO: 4213993 - DNA, 16 bp, Homo sapiens
atgatgaccaagaatt

SEQ ID NO: 4213994 - DNA, 17 bp, Homo sapiens
atgatgaccaagaatta

SEQ ID NO: 4213995 - DNA, 22 bp, Homo sapiens
atgattggtaggaaatagaatg

SEQ ID NO: 4213996 - DNA, 20 bp, Homo sapiens
atgcaacaaaatatttaatt

SEQ ID NO: 4213997 - DNA, 14 bp, Homo sapiens
atgcacatccctgg

SEQ ID NO: 4213998 - DNA, 18 bp, Homo sapiens
atgcatataatgaataaa

SEQ ID NO: 4213999 - DNA, 19 bp, Homo sapiens
atgcatataatgaataaat

SEQ ID NO: 4214000 - DNA, 21 bp, Homo sapiens
atgcatataatgaataaatca

SEQ ID NO: 4214001 - DNA, 22 bp, Homo sapiens
atgccctaagtgttgaagaaga

SEQ ID NO: 4214002 - DNA, 16 bp, Homo sapiens
atgctttatgtttaaa

SEQ ID NO: 4214003 - DNA, 23 bp, Homo sapiens
atgctttatgtttaaaaacattc

SEQ ID NO: 4214004 - DNA, 21 bp, Homo sapiens
atggaggatctctaaagagca

SEQ ID NO: 4214005 - DNA, 12 bp, Homo sapiens
atggcagctgga

SEQ ID NO: 4214006 - DNA, 15 bp, Homo sapiens
atggcgttgcaggcc

SEQ ID NO: 4214007 - DNA, 24 bp, Homo sapiens
atggcttagttaagtcatccacag

SEQ ID NO: 4214008 - DNA, 22 bp, Homo sapiens
atggtagttttacagtgtttct

SEQ ID NO: 4214009 - DNA, 14 bp, Homo sapiens
atggtgatgaaatg

SEQ ID NO: 4214010 - DNA, 17 bp, Homo sapiens
atggtgatgaaatgtaa

SEQ ID NO: 4214011 - DNA, 12 bp, Homo sapiens
atgtacaaccct

SEQ ID NO: 4214012 - DNA, 15 bp, Homo sapiens
atgtacaaccctgac

SEQ ID NO: 4214013 - DNA, 19 bp, Homo sapiens
atgtagtatctatatgact

SEQ ID NO: 4214014 - DNA, 20 bp, Homo sapiens
atgtatattaaaaaagagac

SEQ ID NO: 4214015 - DNA, 21 bp, Homo sapiens
atgtatattaaaaaagagaca

SEQ ID NO: 4214016 - DNA, 17 bp, Homo sapiens
atgtcagttgttattta

SEQ ID NO: 4214017 - DNA, 14 bp, Homo sapiens
atgtcgcctgcccc

SEQ ID NO: 4214018 - DNA, 22 bp, Homo sapiens
atgtgatttgtcttcccttctt

SEQ ID NO: 4214019 - DNA, 20 bp, Homo sapiens
atgtggcctttgaattctgt

SEQ ID NO: 4214020 - DNA, 13 bp, Homo sapiens
atgttaatatttc

SEQ ID NO: 4214021 - DNA, 23 bp, Homo sapiens
atgttcctgctaataatttgcca

SEQ ID NO: 4214022 - DNA, 16 bp, Homo sapiens
atgttgtttataataa

SEQ ID NO: 4214023 - DNA, 20 bp, Homo sapiens
atgttgtttataataaaaat

SEQ ID NO: 4214024 - DNA, 22 bp, Homo sapiens
atgttgtttataataaaaatat

SEQ ID NO: 4214025 - DNA, 22 bp, Homo sapiens
atgtttgtactagttgatgaag

SEQ ID NO: 4214026 - DNA, 15 bp, Homo sapiens
atgttttcaaatgtt

SEQ ID NO: 4214027 - DNA, 18 bp, Homo sapiens
atgttttcaaatgttctc

SEQ ID NO: 4214028 - DNA, 17 bp, Homo sapiens
attaaaatatttcaggt

SEQ ID NO: 4214029 - DNA, 19 bp, Homo sapiens
attaaagcaccaaattcat

SEQ ID NO: 4214030 - DNA, 15 bp, Homo sapiens
actatgatttggaaa

SEQ ID NO: 4214031 - DNA, 13 bp, Homo sapiens
actcacttcaatg

SEQ ID NO: 4214032 - DNA, 15 bp, Homo sapiens
actccaaagagaaac

SEQ ID NO: 4214033 - DNA, 17 bp, Homo sapiens
actccaaagagaaacct

SEQ ID NO: 4214034 - DNA, 15 bp, Homo sapiens
actcccaagctggac

SEQ ID NO: 4214035 - DNA, 17 bp, Homo sapiens
actcccagaccacctcc

SEQ ID NO: 4214036 - DNA, 16 bp, Homo sapiens
actctagcctggcaac

SEQ ID NO: 4214037 - DNA, 22 bp, Homo sapiens
actctagcctggcaacagagca

SEQ ID NO: 4214038 - DNA, 17 bp, Homo sapiens
actctaggactctgcac

SEQ ID NO: 4214039 - DNA, 23 bp, Homo sapiens
actctgcactgaatggctgacct

SEQ ID NO: 4214040 - DNA, 13 bp, Homo sapiens
actcttaggctaa

SEQ ID NO: 4214041 - DNA, 16 bp, Homo sapiens
actcttgcctttccac

SEQ ID NO: 4214042 - DNA, 20 bp, Homo sapiens
actgaccctggagcggctct

SEQ ID NO: 4214043 - DNA, 17 bp, Homo sapiens
actgaggaagggagaca

SEQ ID NO: 4214044 - DNA, 24 bp, Homo sapiens
actgaggaagggagacatattctt

SEQ ID NO: 4214045 - DNA, 22 bp, Homo sapiens
actgtacttctgtgtgcaattg

SEQ ID NO: 4214046 - DNA, 20 bp, Homo sapiens
actgtgtgtgtcctacacaa

SEQ ID NO: 4214047 - DNA, 12 bp, Homo sapiens
acttaatggcac

SEQ ID NO: 4214048 - DNA, 15 bp, Homo sapiens
acttatatatttgat

SEQ ID NO: 4214049 - DNA, 13 bp, Homo sapiens
acttattgaatat

SEQ ID NO: 4214050 - DNA, 17 bp, Homo sapiens
acttatttatgaacctg

SEQ ID NO: 4214051 - DNA, 21 bp, Homo sapiens
acttattttccaataaaattt

SEQ ID NO: 4214052 - DNA, 12 bp, Homo sapiens
acttcaatgaac

SEQ ID NO: 4214053 - DNA, 15 bp, Homo sapiens
acttcaatgaacaaa

SEQ ID NO: 4214054 - DNA, 13 bp, Homo sapiens
acttcactccaaa

SEQ ID NO: 4214055 - DNA, 17 bp, Homo sapiens
acttcactccaaagaga

SEQ ID NO: 4214056 - DNA, 14 bp, Homo sapiens
acttctaaatgttg

SEQ ID NO: 4214057 - DNA, 15 bp, Homo sapiens
acttctcacttccta

SEQ ID NO: 4214058 - DNA, 19 bp, Homo sapiens
acttgagcctccatttctg

SEQ ID NO: 4214059 - DNA, 14 bp, Homo sapiens
actttagtgtctct

SEQ ID NO: 4214060 - DNA, 21 bp, Homo sapiens
actttagtgtctctaagttat

SEQ ID NO: 4214061 - DNA, 12 bp, Homo sapiens
actttgcttctc

SEQ ID NO: 4214062 - DNA, 13 bp, Homo sapiens
actttgcttctct

SEQ ID NO: 4214063 - DNA, 15 bp, Homo sapiens
actttgcttctctcc

SEQ ID NO: 4214064 - DNA, 21 bp, Homo sapiens
acttttggtttttatatttct

SEQ ID NO: 4214065 - DNA, 18 bp, Homo sapiens
agaaaaaatggcaagaga

SEQ ID NO: 4214066 - DNA, 22 bp, Homo sapiens
agaaaaaatggcaagagatcat

SEQ ID NO: 4214067 - DNA, 13 bp, Homo sapiens
agaaaaggcatgg

SEQ ID NO: 4214068 - DNA, 14 bp, Homo sapiens
agaaaaggcatgga

SEQ ID NO: 4214069 - DNA, 18 bp, Homo sapiens
agaaaagtgcaaagttat

SEQ ID NO: 4214070 - DNA, 17 bp, Homo sapiens
agaaaatgaaatgcata

SEQ ID NO: 4214071 - DNA, 23 bp, Homo sapiens
agaaataaaccaaaggaaaatgt

SEQ ID NO: 4214072 - DNA, 12 bp, Homo sapiens
agaacttaaaaa

SEQ ID NO: 4214073 - DNA, 14 bp, Homo sapiens
agaagccaaatttt

SEQ ID NO: 4214074 - DNA, 18 bp, Homo sapiens
agaagtcttctatttatt

SEQ ID NO: 4214075 - DNA, 15 bp, Homo sapiens
agaatgttagagtaa

SEQ ID NO: 4214076 - DNA, 15 bp, Homo sapiens
agaatgttttcaaat

SEQ ID NO: 4214077 - DNA, 17 bp, Homo sapiens
agaattttaccaaaatt

SEQ ID NO: 4214078 - DNA, 12 bp, Homo sapiens
agacaaatattc

SEQ ID NO: 4214079 - DNA, 23 bp, Homo sapiens
agacacattcctagttccccgtg

SEQ ID NO: 4214080 - DNA, 19 bp, Homo sapiens
agacactgttgataaaaac

SEQ ID NO: 4214081 - DNA, 21 bp, Homo sapiens
agacagcgaactagaagaaag

SEQ ID NO: 4214082 - DNA, 15 bp, Homo sapiens
agacaggagacaaaa

SEQ ID NO: 4214083 - DNA, 18 bp, Homo sapiens
agacatcacttgccaatg

SEQ ID NO: 4214084 - DNA, 13 bp, Homo sapiens
agaccacctccct

SEQ ID NO: 4214085 - DNA, 21 bp, Homo sapiens
agaccacctccctgccctgtc

SEQ ID NO: 4214086 - DNA, 20 bp, Homo sapiens
agaccagcccagccaacatg

SEQ ID NO: 4214087 - DNA, 19 bp, Homo sapiens
agaccaggtggaattactt

SEQ ID NO: 4214088 - DNA, 18 bp, Homo sapiens
agacctctgtgcacttat

SEQ ID NO: 4214089 - DNA, 15 bp, Homo sapiens
agactacagccagaa

SEQ ID NO: 4214090 - DNA, 17 bp, Homo sapiens
agactgtacttattttc

SEQ ID NO: 4214091 - DNA, 21 bp, Homo sapiens
agacttgtatagcatgaaata

SEQ ID NO: 4214092 - DNA, 21 bp, Homo sapiens
agagcataatttaaaaatata

SEQ ID NO: 4214093 - DNA, 16 bp, Homo sapiens
agagccatacataaaa

SEQ ID NO: 4214094 - DNA, 14 bp, Homo sapiens
agaggcaaacattt

SEQ ID NO: 4214095 - DNA, 17 bp, Homo sapiens
agaggcaaacatttctt

SEQ ID NO: 4214096 - DNA, 21 bp, Homo sapiens
agagtcactgaccctggagcg

SEQ ID NO: 4214097 - DNA, 14 bp, Homo sapiens
agagtttgcaaatg

SEQ ID NO: 4214098 - DNA, 14 bp, Homo sapiens
agatgttttacaaa

SEQ ID NO: 4214099 - DNA, 18 bp, Homo sapiens
agattctatgttaatatt

SEQ ID NO: 4214100 - DNA, 20 bp, Homo sapiens
agatttatgtaatgctttat

SEQ ID NO: 4214101 - DNA, 13 bp, Homo sapiens
agattttcttgca

SEQ ID NO: 4214102 - DNA, 16 bp, Homo sapiens
agcaaactttagtgtc

SEQ ID NO: 4214103 - DNA, 14 bp, Homo sapiens
agcacaatttatat

SEQ ID NO: 4214104 - DNA, 13 bp, Homo sapiens
agcacatctggga

SEQ ID NO: 4214105 - DNA, 16 bp, Homo sapiens
agcactcctctgtctc

SEQ ID NO: 4214106 - DNA, 21 bp, Homo sapiens
agcataatttaaaaatatatt

SEQ ID NO: 4214107 - DNA, 22 bp, Homo sapiens
agcatgcatagtgctaagaaag

SEQ ID NO: 4214108 - DNA, 21 bp, Homo sapiens
agccaccgtctacagatggct

SEQ ID NO: 4214109 - DNA, 20 bp, Homo sapiens
agccagccaaatccatcctg

SEQ ID NO: 4214110 - DNA, 16 bp, Homo sapiens
agccatacataaaaga

SEQ ID NO: 4214111 - DNA, 23 bp, Homo sapiens
agccatacataaaagaaataaac

SEQ ID NO: 4214112 - DNA, 12 bp, Homo sapiens
agccatttaatt

SEQ ID NO: 4214113 - DNA, 23 bp, Homo sapiens
agccatttaatttttaaatgttt

SEQ ID NO: 4214114 - DNA, 14 bp, Homo sapiens
agcccatggagcag

SEQ ID NO: 4214115 - DNA, 16 bp, Homo sapiens
agcctgaaaattccaa

SEQ ID NO: 4214116 - DNA, 17 bp, Homo sapiens
agcctgaaaattccaat

SEQ ID NO: 4214117 - DNA, 20 bp, Homo sapiens
agcctgcccctgactgtgtt

SEQ ID NO: 4214118 - DNA, 13 bp, Homo sapiens
agccttctctctc

SEQ ID NO: 4214119 - DNA, 15 bp, Homo sapiens
agccttctctctctg

SEQ ID NO: 4214120 - DNA, 17 bp, Homo sapiens
agccttctctctctggt

SEQ ID NO: 4214121 - DNA, 23 bp, Homo sapiens
agctgaagcccatgctttcccac

SEQ ID NO: 4214122 - DNA, 21 bp, Homo sapiens
agctgctgttccaacagacag

SEQ ID NO: 4214123 - DNA, 22 bp, Homo sapiens
agctggaattgctgctctctga

SEQ ID NO: 4214124 - DNA, 16 bp, Homo sapiens
agctgggttggaaaac

SEQ ID NO: 4214125 - DNA, 22 bp, Homo sapiens
agctttaagcaccctagaggac

SEQ ID NO: 4214126 - DNA, 15 bp, Homo sapiens
agctttcatttgaca

SEQ ID NO: 4214127 - DNA, 16 bp, Homo sapiens
agctttccacaggagg

SEQ ID NO: 4214128 - DNA, 22 bp, Homo sapiens
aggaaactaactggtgtgagtc

SEQ ID NO: 4214129 - DNA, 12 bp, Homo sapiens
aggaacagctcc

SEQ ID NO: 4214130 - DNA, 11 bp, Homo sapiens
aggaagaagac

SEQ ID NO: 4214131 - DNA, 19 bp, Homo sapiens
aggagaattgcttgaaccg

SEQ ID NO: 4214132 - DNA, 13 bp, Homo sapiens
aggagacaaaaga

SEQ ID NO: 4214133 - DNA, 21 bp, Homo sapiens
aggagttcgagaccagcccag

SEQ ID NO: 4214134 - DNA, 17 bp, Homo sapiens
aggatctctaaagagca

SEQ ID NO: 4214135 - DNA, 23 bp, Homo sapiens
aggatgatgtctttttattaaaa

SEQ ID NO: 4214136 - DNA, 14 bp, Homo sapiens
aggattccaaagtt

SEQ ID NO: 4214137 - DNA, 15 bp, Homo sapiens
aggcaggagaattgc

SEQ ID NO: 4214138 - DNA, 20 bp, Homo sapiens
aggccaggttatgcctcatg

SEQ ID NO: 4214139 - DNA, 14 bp, Homo sapiens
aggctattttctaa

SEQ ID NO: 4214140 - DNA, 18 bp, Homo sapiens
aggctattttctaaagac

SEQ ID NO: 4214141 - DNA, 17 bp, Homo sapiens
aggctgaggcaggagaa

SEQ ID NO: 4214142 - DNA, 20 bp, Homo sapiens
aggctgtggtggctgtctct

SEQ ID NO: 4214143 - DNA, 23 bp, Homo sapiens
agggagaggctgtggtggctgtc

SEQ ID NO: 4214144 - DNA, 19 bp, Homo sapiens
agggcataaagtaaataca

SEQ ID NO: 4214145 - DNA, 20 bp, Homo sapiens
agggcataaagtaaatacat

SEQ ID NO: 4214146 - DNA, 21 bp, Homo sapiens
agggcggggctatgccttgtc

SEQ ID NO: 4214147 - DNA, 21 bp, Homo sapiens
aggggcttaattattgatgtt

SEQ ID NO: 4214148 - DNA, 21 bp, Homo sapiens
agggtaatctgacttctcact

SEQ ID NO: 4214149 - DNA, 16 bp, Homo sapiens
agggtgttaaactttt

SEQ ID NO: 4214150 - DNA, 22 bp, Homo sapiens
aggtattgagccattttttaaa

SEQ ID NO: 4214151 - DNA, 19 bp, Homo sapiens
aggtggaaaaggaacccaa

SEQ ID NO: 4214152 - DNA, 22 bp, Homo sapiens
aggtggaattacttaaatttta

SEQ ID NO: 4214153 - DNA, 14 bp, Homo sapiens
ttttcttgcagttt

SEQ ID NO: 4214154 - DNA, 13 bp, Homo sapiens
ttttgaaatgtca

SEQ ID NO: 4214155 - DNA, 23 bp, Homo sapiens
ttttggcaatgactcaaagtctg

SEQ ID NO: 4214156 - DNA, 23 bp, Homo sapiens
tttttattaaaatatttcaggtt

SEQ ID NO: 4214157 - DNA, 15 bp, Homo sapiens
ttactaaaaagtata

SEQ ID NO: 4214158 - DNA, 17 bp, Homo sapiens
ttactaaaaagtataaa

SEQ ID NO: 4214159 - DNA, 19 bp, Homo sapiens
ttactatcatgtcaaacgt

SEQ ID NO: 4214160 - DNA, 21 bp, Homo sapiens
ttactatcatgtcaaacgtga

SEQ ID NO: 4214161 - DNA, 20 bp, Homo sapiens
ttacttaaattttaaagcct

SEQ ID NO: 4214162 - DNA, 13 bp, Homo sapiens
ttagattctcatt

SEQ ID NO: 4214163 - DNA, 18 bp, Homo sapiens
ttagcacaatttatattt

SEQ ID NO: 4214164 - DNA, 17 bp, Homo sapiens
ttataaggaaattttac

SEQ ID NO: 4214165 - DNA, 23 bp, Homo sapiens
ttatctactaattgagccattta

SEQ ID NO: 4214166 - DNA, 17 bp, Homo sapiens
ttatcttatttaatttt

SEQ ID NO: 4214167 - DNA, 15 bp, Homo sapiens
ttatgactgtgaaat

SEQ ID NO: 4214168 - DNA, 16 bp, Homo sapiens
ttatgactgtgaaatg

SEQ ID NO: 4214169 - DNA, 13 bp, Homo sapiens
ttatgttaatatt

SEQ ID NO: 4214170 - DNA, 19 bp, Homo sapiens
ttatttgattatttaagac

SEQ ID NO: 4214171 - DNA, 23 bp, Homo sapiens
ttcaaaaattgtgtttagatttt

SEQ ID NO: 4214172 - DNA, 17 bp, Homo sapiens
ttcaaatgatccttcct

SEQ ID NO: 4214173 - DNA, 23 bp, Homo sapiens
ttcaatctggattcatatttaat

SEQ ID NO: 4214174 - DNA, 11 bp, Homo sapiens
ttcactccaaa

SEQ ID NO: 4214175 - DNA, 22 bp, Homo sapiens
ttcagaagtcacacattacaaa

SEQ ID NO: 4214176 - DNA, 11 bp, Homo sapiens
ttcatagagaa

SEQ ID NO: 4214177 - DNA, 16 bp, Homo sapiens
ttcatataactgagat

SEQ ID NO: 4214178 - DNA, 13 bp, Homo sapiens
ttcatatttaatt

SEQ ID NO: 4214179 - DNA, 20 bp, Homo sapiens
ttcatatttaatttgaaggt

SEQ ID NO: 4214180 - DNA, 16 bp, Homo sapiens
ttcattaaaaatgaaa

SEQ ID NO: 4214181 - DNA, 19 bp, Homo sapiens
ttcattagttttgaagatt

SEQ ID NO: 4214182 - DNA, 15 bp, Homo sapiens
ttccacctgctttct

SEQ ID NO: 4214183 - DNA, 22 bp, Homo sapiens
ttcccaccagcatgtcactccc

SEQ ID NO: 4214184 - DNA, 23 bp, Homo sapiens
ttcccaccagcatgtcactccca

SEQ ID NO: 4214185 - DNA, 20 bp, Homo sapiens
ttccctagaggcaaacattt

SEQ ID NO: 4214186 - DNA, 18 bp, Homo sapiens
ttcctaagttcccttcta

SEQ ID NO: 4214187 - DNA, 24 bp, Homo sapiens
ttcctccctggcatgaccatcctg

SEQ ID NO: 4214188 - DNA, 17 bp, Homo sapiens
ttcctcctcctttgcct

SEQ ID NO: 4214189 - DNA, 16 bp, Homo sapiens
ttcctctccagccttc

SEQ ID NO: 4214190 - DNA, 15 bp, Homo sapiens
ttcctttttctatga

SEQ ID NO: 4214191 - DNA, 22 bp, Homo sapiens
ttctaaatgttggaattttcaa

SEQ ID NO: 4214192 - DNA, 19 bp, Homo sapiens
ttctagtctggtgttctga

SEQ ID NO: 4214193 - DNA, 20 bp, Homo sapiens
ttctcgcattttctctagct

SEQ ID NO: 4214194 - DNA, 21 bp, Homo sapiens
ttctctagctgatcagaattt

SEQ ID NO: 4214195 - DNA, 23 bp, Homo sapiens
ttctgcagaatcagcatgattct

SEQ ID NO: 4214196 - DNA, 18 bp, Homo sapiens
ttctggagctgctgttcc

SEQ ID NO: 4214197 - DNA, 22 bp, Homo sapiens
ttctggagctgctgttccaaca

SEQ ID NO: 4214198 - DNA, 15 bp, Homo sapiens
ttctggcttctagtc

SEQ ID NO: 4214199 - DNA, 19 bp, Homo sapiens
ttctgtcatcccgctcctg

SEQ ID NO: 4214200 - DNA, 20 bp, Homo sapiens
ttcttaatgctttcctccct

SEQ ID NO: 4214201 - DNA, 14 bp, Homo sapiens
ttcttatttgcaat

SEQ ID NO: 4214202 - DNA, 18 bp, Homo sapiens
ttcttatttgcaataaaa

SEQ ID NO: 4214203 - DNA, 14 bp, Homo sapiens
ttgaaactttaaga

SEQ ID NO: 4214204 - DNA, 14 bp, Homo sapiens
ttgaaatgatttca

SEQ ID NO: 4214205 - DNA, 15 bp, Homo sapiens
ttgaactgtttaaca

SEQ ID NO: 4214206 - DNA, 16 bp, Homo sapiens
ttgaactgtttaacac

SEQ ID NO: 4214207 - DNA, 20 bp, Homo sapiens
ttgaagaagagtttgcaaat

SEQ ID NO: 4214208 - DNA, 14 bp, Homo sapiens
ttgaatattactgg

SEQ ID NO: 4214209 - DNA, 12 bp, Homo sapiens
ttgaattctgga

SEQ ID NO: 4214210 - DNA, 23 bp, Homo sapiens
ttgagtttaagtctctgactctt

SEQ ID NO: 4214211 - DNA, 21 bp, Homo sapiens
ttgcaattattctaattttat

SEQ ID NO: 4214212 - DNA, 19 bp, Homo sapiens
ttgcagattattttagtct

SEQ ID NO: 4214213 - DNA, 15 bp, Homo sapiens
ttgcagcagaagcca

SEQ ID NO: 4214214 - DNA, 19 bp, Homo sapiens
ttgcagcagaagccaaatt

SEQ ID NO: 4214215 - DNA, 16 bp, Homo sapiens
ttgcaggacacaagca

SEQ ID NO: 4214216 - DNA, 21 bp, Homo sapiens
ttgcagtttttttatggcatt

SEQ ID NO: 4214217 - DNA, 19 bp, Homo sapiens
ttgcatattataaaggata

SEQ ID NO: 4214218 - DNA, 11 bp, Homo sapiens
ttgcttctctc

SEQ ID NO: 4214219 - DNA, 12 bp, Homo sapiens
ttggaaaataaa

SEQ ID NO: 4214220 - DNA, 16 bp, Homo sapiens
ttggacattttatgtc

SEQ ID NO: 4214221 - DNA, 17 bp, Homo sapiens
ttggacattttatgtct

SEQ ID NO: 4214222 - DNA, 18 bp, Homo sapiens
ttggcacttattgaatat

SEQ ID NO: 4214223 - DNA, 15 bp, Homo sapiens
ttggttctgtgaaca

SEQ ID NO: 4214224 - DNA, 16 bp, Homo sapiens
ttgtaaatgtggtaaa

SEQ ID NO: 4214225 - DNA, 22 bp, Homo sapiens
ttgtatagcatgaaataaaata

SEQ ID NO: 4214226 - DNA, 20 bp, Homo sapiens
ttgtatgatcctaatgaatg

SEQ ID NO: 4214227 - DNA, 15 bp, Homo sapiens
ttgtgtttagatttt

SEQ ID NO: 4214228 - DNA, 12 bp, Homo sapiens
ttgttatcaaaa

SEQ ID NO: 4214229 - DNA, 12 bp, Homo sapiens
ttgtttaatggt

SEQ ID NO: 4214230 - DNA, 18 bp, Homo sapiens
ttgtttataataaaaata

SEQ ID NO: 4214231 - DNA, 16 bp, Homo sapiens
ttgttttgtgcagaga

SEQ ID NO: 4214232 - DNA, 11 bp, Homo sapiens
tttaaaaatat

SEQ ID NO: 4214233 - DNA, 16 bp, Homo sapiens
tttaaagcctgaaaat

SEQ ID NO: 4214234 - DNA, 13 bp, Homo sapiens
tttaaatgtttat

SEQ ID NO: 4214235 - DNA, 15 bp, Homo sapiens
tttaacttaatggca

SEQ ID NO: 4214236 - DNA, 17 bp, Homo sapiens
tttacagtgtttctggc

SEQ ID NO: 4214237 - DNA, 20 bp, Homo sapiens
tttacatattatcatgtcta

SEQ ID NO: 4214238 - DNA, 15 bp, Homo sapiens
tttaccaagtacaaa

SEQ ID NO: 4214239 - DNA, 17 bp, Homo sapiens
tttacttatatatttga

SEQ ID NO: 4214240 - DNA, 18 bp, Homo sapiens
tttagatgaatgtcagtt

SEQ ID NO: 4214241 - DNA, 22 bp, Homo sapiens
tttagatgaatgtcagttgtta

SEQ ID NO: 4214242 - DNA, 18 bp, Homo sapiens
tttagcacaatttatatt

SEQ ID NO: 4214243 - DNA, 18 bp, Homo sapiens
tttaggtgcctcctgtct

SEQ ID NO: 4214244 - DNA, 20 bp, Homo sapiens
tttaggtgcctcctgtctta

SEQ ID NO: 4214245 - DNA, 12 bp, Homo sapiens
tttagtgtttct

SEQ ID NO: 4214246 - DNA, 19 bp, Homo sapiens
tttagtgtttctttatcta

SEQ ID NO: 4214247 - DNA, 14 bp, Homo sapiens
tttataataaaaat

SEQ ID NO: 4214248 - DNA, 19 bp, Homo sapiens
tttataataaaaatatatt

SEQ ID NO: 4214249 - DNA, 14 bp, Homo sapiens
tttatatttctcgt

SEQ ID NO: 4214250 - DNA, 14 bp, Homo sapiens
tttatattttccct

SEQ ID NO: 4214251 - DNA, 18 bp, Homo sapiens
tttattaaaatatttcag

SEQ ID NO: 4214252 - DNA, 19 bp, Homo sapiens
tttattaaaatatttcagg

SEQ ID NO: 4214253 - DNA, 14 bp, Homo sapiens
tttcaaatgttctc

SEQ ID NO: 4214254 - DNA, 22 bp, Homo sapiens
tttcacagtgtgtggtcaacat

SEQ ID NO: 4214255 - DNA, 14 bp, Homo sapiens
tttcattaaaaatg

SEQ ID NO: 4214256 - DNA, 23 bp, Homo sapiens
tttccatctgcttgtattttcca

SEQ ID NO: 4214257 - DNA, 20 bp, Homo sapiens
tttcccaccagcatgtcact

SEQ ID NO: 4214258 - DNA, 23 bp, Homo sapiens
tttctgatctgatgcaagcaaga

SEQ ID NO: 4214259 - DNA, 14 bp, Homo sapiens
tttgaaagaaatgt

SEQ ID NO: 4214260 - DNA, 18 bp, Homo sapiens
tttgaactgccaagaaaa

SEQ ID NO: 4214261 - DNA, 14 bp, Homo sapiens
tttgaatatgtagt

SEQ ID NO: 4214262 - DNA, 19 bp, Homo sapiens
tttgaatatgtagtatcta

SEQ ID NO: 4214263 - DNA, 17 bp, Homo sapiens
tttgattatttaagact

SEQ ID NO: 4214264 - DNA, 18 bp, Homo sapiens
tttgcaaagtgtattagg

SEQ ID NO: 4214265 - DNA, 18 bp, Homo sapiens
tttgcaataaaaggtatt

SEQ ID NO: 4214266 - DNA, 15 bp, Homo sapiens
tttgccattatctgt

SEQ ID NO: 4214267 - DNA, 22 bp, Homo sapiens
tttggaggaacagctccctagt

SEQ ID NO: 4214268 - DNA, 16 bp, Homo sapiens
tttggctagtccttgt

SEQ ID NO: 4214269 - DNA, 15 bp, Homo sapiens
tttggtttttatatt

SEQ ID NO: 4214270 - DNA, 18 bp, Homo sapiens
tttgtactagttgatgaa

SEQ ID NO: 4214271 - DNA, 14 bp, Homo sapiens
tttgtgcttcaaat

SEQ ID NO: 4214272 - DNA, 16 bp, Homo sapiens
ttttacaaatttaatt

SEQ ID NO: 4214273 - DNA, 19 bp, Homo sapiens
ttttacctagctaattatt

SEQ ID NO: 4214274 - DNA, 22 bp, Homo sapiens
ttttatttggaataataatttt

SEQ ID NO: 4214275 - DNA, 23 bp, Homo sapiens
ttttcataaattatttgattatt

SEQ ID NO: 4214276 - DNA, 19 bp, Homo sapiens
ttttccctctcttgccttt

SEQ ID NO: 4214277 - DNA, 14 bp, Homo sapiens
ttttctaaagactt

SEQ ID NO: 4214278 - DNA, 20 bp, Homo sapiens
ttttctctgcatttaaaaaa

SEQ ID NO: 4214279 - DNA, 17 bp, Homo sapiens
tgcactctagcctggca

SEQ ID NO: 4214280 - DNA, 22 bp, Homo sapiens
tgcagattattttagtctgtca

SEQ ID NO: 4214281 - DNA, 16 bp, Homo sapiens
tgcatagtgctaagaa

SEQ ID NO: 4214282 - DNA, 16 bp, Homo sapiens
tgcatataatgaataa

SEQ ID NO: 4214283 - DNA, 17 bp, Homo sapiens
tgcatataatgaataaa

SEQ ID NO: 4214284 - DNA, 20 bp, Homo sapiens
tgcatataatgaataaatca

SEQ ID NO: 4214285 - DNA, 13 bp, Homo sapiens
tgcatattataaa

SEQ ID NO: 4214286 - DNA, 13 bp, Homo sapiens
tgcattttcttca

SEQ ID NO: 4214287 - DNA, 23 bp, Homo sapiens
tgcccccagcactcctctgtctc

SEQ ID NO: 4214288 - DNA, 12 bp, Homo sapiens
tgccctctctga

SEQ ID NO: 4214289 - DNA, 12 bp, Homo sapiens
tgccctgtcctc

SEQ ID NO: 4214290 - DNA, 17 bp, Homo sapiens
tgccctgtcctccagct

SEQ ID NO: 4214291 - DNA, 21 bp, Homo sapiens
tgccctgtcctccagcttccc

SEQ ID NO: 4214292 - DNA, 14 bp, Homo sapiens
tgccgctcttctgt

SEQ ID NO: 4214293 - DNA, 11 bp, Homo sapiens
tgcctcctgtc

SEQ ID NO: 4214294 - DNA, 16 bp, Homo sapiens
tgccttggttcttcct

SEQ ID NO: 4214295 - DNA, 19 bp, Homo sapiens
tgccttggttcttcctagt

SEQ ID NO: 4214296 - DNA, 20 bp, Homo sapiens
tgctaataatttgccattat

SEQ ID NO: 4214297 - DNA, 12 bp, Homo sapiens
tgctctctgagg

SEQ ID NO: 4214298 - DNA, 18 bp, Homo sapiens
tgctcttccatttcttcc

SEQ ID NO: 4214299 - DNA, 15 bp, Homo sapiens
tgctgaaacacctcc

SEQ ID NO: 4214300 - DNA, 21 bp, Homo sapiens
tgctgttccaacagacagggc

SEQ ID NO: 4214301 - DNA, 15 bp, Homo sapiens
tgctgttctggagct

SEQ ID NO: 4214302 - DNA, 23 bp, Homo sapiens
tgctttcccaccagcatgtcact

SEQ ID NO: 4214303 - DNA, 14 bp, Homo sapiens
tgctttcctccctg

SEQ ID NO: 4214304 - DNA, 12 bp, Homo sapiens
tgctttctcctg

SEQ ID NO: 4214305 - DNA, 20 bp, Homo sapiens
tggaaaaggaacccaatttt

SEQ ID NO: 4214306 - DNA, 16 bp, Homo sapiens
tggaaattggaagagc

SEQ ID NO: 4214307 - DNA, 21 bp, Homo sapiens
tggaagtgtgtgatctgtggg

SEQ ID NO: 4214308 - DNA, 18 bp, Homo sapiens
tggaataataattttcct

SEQ ID NO: 4214309 - DNA, 21 bp, Homo sapiens
tggaataataattttcctcct

SEQ ID NO: 4214310 - DNA, 14 bp, Homo sapiens
tggaattacttaaa

SEQ ID NO: 4214311 - DNA, 13 bp, Homo sapiens
tggacattttatg

SEQ ID NO: 4214312 - DNA, 22 bp, Homo sapiens
tggagaactttccatctgcttg

SEQ ID NO: 4214313 - DNA, 21 bp, Homo sapiens
tggagaagctccctgaagtaa

SEQ ID NO: 4214314 - DNA, 15 bp, Homo sapiens
tggagacagcgaact

SEQ ID NO: 4214315 - DNA, 11 bp, Homo sapiens
tggagcaggga

SEQ ID NO: 4214316 - DNA, 17 bp, Homo sapiens
tggagcggctctcctga

SEQ ID NO: 4214317 - DNA, 13 bp, Homo sapiens
tggagctgctgtt

SEQ ID NO: 4214318 - DNA, 15 bp, Homo sapiens
tggaggaacagctcc

SEQ ID NO: 4214319 - DNA, 22 bp, Homo sapiens
tggaggaacagctccctagtgg

SEQ ID NO: 4214320 - DNA, 17 bp, Homo sapiens
tggattcatatttaatt

SEQ ID NO: 4214321 - DNA, 23 bp, Homo sapiens
tggattgtgcctaatgtgtttga

SEQ ID NO: 4214322 - DNA, 19 bp, Homo sapiens
tggattttttatgtacaac

SEQ ID NO: 4214323 - DNA, 22 bp, Homo sapiens
tggattttttatgtacaaccct

SEQ ID NO: 4214324 - DNA, 23 bp, Homo sapiens
tggattttttatgtacaaccctg

SEQ ID NO: 4214325 - DNA, 17 bp, Homo sapiens
tggcaacagagcaagac

SEQ ID NO: 4214326 - DNA, 19 bp, Homo sapiens
tggcaatgactcaaagtct

SEQ ID NO: 4214327 - DNA, 11 bp, Homo sapiens
tggcagctgga

SEQ ID NO: 4214328 - DNA, 15 bp, Homo sapiens
tggccagagagtggg

SEQ ID NO: 4214329 - DNA, 15 bp, Homo sapiens
tggccatgtcgcctg

SEQ ID NO: 4214330 - DNA, 21 bp, Homo sapiens
tggccatgtcgcctgccccca

SEQ ID NO: 4214331 - DNA, 23 bp, Homo sapiens
tggcctggtggccatgtcgcctg

SEQ ID NO: 4214332 - DNA, 23 bp, Homo sapiens
tggctcacgcctataatcccagc

SEQ ID NO: 4214333 - DNA, 14 bp, Homo sapiens
tggctgtctctgtc

SEQ ID NO: 4214334 - DNA, 15 bp, Homo sapiens
tggctgtctctgtcc

SEQ ID NO: 4214335 - DNA, 22 bp, Homo sapiens
tggctgtctctgtccctcactg

SEQ ID NO: 4214336 - DNA, 20 bp, Homo sapiens
tggcttagttaagtcatcca

SEQ ID NO: 4214337 - DNA, 11 bp, Homo sapiens
tgggaaaactt

SEQ ID NO: 4214338 - DNA, 15 bp, Homo sapiens
tgggaaaacttcact

SEQ ID NO: 4214339 - DNA, 21 bp, Homo sapiens
tgggaaaacttcactccaaag

SEQ ID NO: 4214340 - DNA, 14 bp, Homo sapiens
tgggaggtggaaaa

SEQ ID NO: 4214341 - DNA, 17 bp, Homo sapiens
tgggcccgctttgcctg

SEQ ID NO: 4214342 - DNA, 17 bp, Homo sapiens
tggggaccctgtagagt

SEQ ID NO: 4214343 - DNA, 14 bp, Homo sapiens
tggtcaacatttct

SEQ ID NO: 4214344 - DNA, 18 bp, Homo sapiens
tggtcaggcccactgcag

SEQ ID NO: 4214345 - DNA, 20 bp, Homo sapiens
tggtggccatgtcgcctgcc

SEQ ID NO: 4214346 - DNA, 13 bp, Homo sapiens
tggttctgtgaac

SEQ ID NO: 4214347 - DNA, 13 bp, Homo sapiens
tgtaaacagaaat

SEQ ID NO: 4214348 - DNA, 17 bp, Homo sapiens
tgtaacttccaaataaa

SEQ ID NO: 4214349 - DNA, 20 bp, Homo sapiens
tgtaacttccaaataaataa

SEQ ID NO: 4214350 - DNA, 21 bp, Homo sapiens
tgtaacttccaaataaataat

SEQ ID NO: 4214351 - DNA, 14 bp, Homo sapiens
tgtaataatagact

SEQ ID NO: 4214352 - DNA, 13 bp, Homo sapiens
tgtaatacacata

SEQ ID NO: 4214353 - DNA, 15 bp, Homo sapiens
tgtacaaaagcaatg

SEQ ID NO: 4214354 - DNA, 20 bp, Homo sapiens
tgtactcttaggctaagaga

SEQ ID NO: 4214355 - DNA, 13 bp, Homo sapiens
tgtatagcatgaa

SEQ ID NO: 4214356 - DNA, 14 bp, Homo sapiens
tgtcactcccagac

SEQ ID NO: 4214357 - DNA, 21 bp, Homo sapiens
tgtcactcccagaccacctcc

SEQ ID NO: 4214358 - DNA, 18 bp, Homo sapiens
tgtcatcccgctcctgct

SEQ ID NO: 4214359 - DNA, 12 bp, Homo sapiens
tgtcctgctgtg

SEQ ID NO: 4214360 - DNA, 12 bp, Homo sapiens
tgtcgcctgccc

SEQ ID NO: 4214361 - DNA, 14 bp, Homo sapiens
tgtcgcctgccccc

SEQ ID NO: 4214362 - DNA, 13 bp, Homo sapiens
tgtctctgctctt

SEQ ID NO: 4214363 - DNA, 20 bp, Homo sapiens
tgtctctgctcttgcctgca

SEQ ID NO: 4214364 - DNA, 19 bp, Homo sapiens
tgtctgttcagtttcccca

SEQ ID NO: 4214365 - DNA, 19 bp, Homo sapiens
tgtcttatggcgttgcagg

SEQ ID NO: 4214366 - DNA, 12 bp, Homo sapiens
tgtcttcccttc

SEQ ID NO: 4214367 - DNA, 13 bp, Homo sapiens
tgtcttcccttct

SEQ ID NO: 4214368 - DNA, 17 bp, Homo sapiens
tgtgatttgtcttccct

SEQ ID NO: 4214369 - DNA, 15 bp, Homo sapiens
tgtgcacatctgttt

SEQ ID NO: 4214370 - DNA, 18 bp, Homo sapiens
tgtgcctaatgtgtttga

SEQ ID NO: 4214371 - DNA, 22 bp, Homo sapiens
tgtgcttcaaatgatccttcct

SEQ ID NO: 4214372 - DNA, 22 bp, Homo sapiens
tgtggtcaacatttctcatgtt

SEQ ID NO: 4214373 - DNA, 23 bp, Homo sapiens
tgtgtggtcaacatttctcatgt

SEQ ID NO: 4214374 - DNA, 17 bp, Homo sapiens
tgttaaactttttacca

SEQ ID NO: 4214375 - DNA, 22 bp, Homo sapiens
tgttaagttgatggtgatgaaa

SEQ ID NO: 4214376 - DNA, 13 bp, Homo sapiens
tgttatcaaaata

SEQ ID NO: 4214377 - DNA, 13 bp, Homo sapiens
tgttatttattga

SEQ ID NO: 4214378 - DNA, 15 bp, Homo sapiens
tgttatttattgaaa

SEQ ID NO: 4214379 - DNA, 21 bp, Homo sapiens
tgttctccagtcattatgtta

SEQ ID NO: 4214380 - DNA, 20 bp, Homo sapiens
tgttctttggaaatacacag

SEQ ID NO: 4214381 - DNA, 16 bp, Homo sapiens
tgttgaagaagagttt

SEQ ID NO: 4214382 - DNA, 15 bp, Homo sapiens
tgttgtttataataa

SEQ ID NO: 4214383 - DNA, 20 bp, Homo sapiens
tgtttaaaaacattccccaa

SEQ ID NO: 4214384 - DNA, 10 bp, Homo sapiens
tgtttatatt

SEQ ID NO: 4214385 - DNA, 18 bp, Homo sapiens
tgtttctggcttagaaca

SEQ ID NO: 4214386 - DNA, 20 bp, Homo sapiens
ttaaagatatttctttaaat

SEQ ID NO: 4214387 - DNA, 18 bp, Homo sapiens
ttaaagcctgaaaattcc

SEQ ID NO: 4214388 - DNA, 20 bp, Homo sapiens
ttaaagcctgaaaattccaa

SEQ ID NO: 4214389 - DNA, 18 bp, Homo sapiens
ttaaatagtaaaaataaa

SEQ ID NO: 4214390 - DNA, 19 bp, Homo sapiens
ttaacctgtttatataatt

SEQ ID NO: 4214391 - DNA, 15 bp, Homo sapiens
ttaacttaatggcac

SEQ ID NO: 4214392 - DNA, 13 bp, Homo sapiens
ttaagggtatgat

SEQ ID NO: 4214393 - DNA, 23 bp, Homo sapiens
ttaagtctctgactcttgccttt

SEQ ID NO: 4214394 - DNA, 12 bp, Homo sapiens
ttaatgccttcc

SEQ ID NO: 4214395 - DNA, 22 bp, Homo sapiens
ttaatgctttcctccctggcat

SEQ ID NO: 4214396 - DNA, 19 bp, Homo sapiens
ttaatggtagttttacagt

SEQ ID NO: 4214397 - DNA, 15 bp, Homo sapiens
ttaatttttaaatgt

SEQ ID NO: 4214398 - DNA, 13 bp, Homo sapiens
ttacaaatttaat

SEQ ID NO: 4214399 - DNA, 14 bp, Homo sapiens
ttacaaatttaatt

SEQ ID NO: 4214400 - DNA, 15 bp, Homo sapiens
ttacaaatttaattt

SEQ ID NO: 4214401 - DNA, 15 bp, Homo sapiens
ttacattgccatttt

SEQ ID NO: 4214402 - DNA, 17 bp, Homo sapiens
tcccaggggctccacct

SEQ ID NO: 4214403 - DNA, 19 bp, Homo sapiens
tcccaggggctccacctgt

SEQ ID NO: 4214404 - DNA, 21 bp, Homo sapiens
tcccatgatgccgctcttctg

SEQ ID NO: 4214405 - DNA, 12 bp, Homo sapiens
tccccagccaga

SEQ ID NO: 4214406 - DNA, 14 bp, Homo sapiens
tcccccctcactcc

SEQ ID NO: 4214407 - DNA, 18 bp, Homo sapiens
tcccctcgctgtcctgct

SEQ ID NO: 4214408 - DNA, 15 bp, Homo sapiens
tccctgccctgtcct

SEQ ID NO: 4214409 - DNA, 18 bp, Homo sapiens
tccctgccctgtcctcca

SEQ ID NO: 4214410 - DNA, 20 bp, Homo sapiens
tcccttctttgcacttttga

SEQ ID NO: 4214411 - DNA, 20 bp, Homo sapiens
tccgtctgcaatgtcccttg

SEQ ID NO: 4214412 - DNA, 17 bp, Homo sapiens
tcctaagttcccttcta

SEQ ID NO: 4214413 - DNA, 18 bp, Homo sapiens
tcctaagttcccttctat

SEQ ID NO: 4214414 - DNA, 14 bp, Homo sapiens
tcctactttgcttc

SEQ ID NO: 4214415 - DNA, 19 bp, Homo sapiens
tcctactttgcttctctcc

SEQ ID NO: 4214416 - DNA, 17 bp, Homo sapiens
tcctccaattccacagt

SEQ ID NO: 4214417 - DNA, 18 bp, Homo sapiens
tcctcctttgcctaggag

SEQ ID NO: 4214418 - DNA, 13 bp, Homo sapiens
tcctctgtctctg

SEQ ID NO: 4214419 - DNA, 18 bp, Homo sapiens
tcctgagaggtgctgcag

SEQ ID NO: 4214420 - DNA, 18 bp, Homo sapiens
tcctgctcttccatttct

SEQ ID NO: 4214421 - DNA, 22 bp, Homo sapiens
tcctgctcttccatttcttcca

SEQ ID NO: 4214422 - DNA, 18 bp, Homo sapiens
tcctgctgaaacacctcc

SEQ ID NO: 4214423 - DNA, 21 bp, Homo sapiens
tcctgctgtgtgaattcccag

SEQ ID NO: 4214424 - DNA, 22 bp, Homo sapiens
tcctttgacttattgtccccac

SEQ ID NO: 4214425 - DNA, 19 bp, Homo sapiens
tcctttgttattatcctgc

SEQ ID NO: 4214426 - DNA, 14 bp, Homo sapiens
tcgctgtcctgctg

SEQ ID NO: 4214427 - DNA, 17 bp, Homo sapiens
tcgtttgaatcacagta

SEQ ID NO: 4214428 - DNA, 14 bp, Homo sapiens
tctaaatgttggaa

SEQ ID NO: 4214429 - DNA, 15 bp, Homo sapiens
tctaagagacctgaa

SEQ ID NO: 4214430 - DNA, 23 bp, Homo sapiens
tctaagttatgactgtgaaatga

SEQ ID NO: 4214431 - DNA, 18 bp, Homo sapiens
tctagctgatcagaattt

SEQ ID NO: 4214432 - DNA, 13 bp, Homo sapiens
tctatatcctcaa

SEQ ID NO: 4214433 - DNA, 16 bp, Homo sapiens
tctatgttaatatttt

SEQ ID NO: 4214434 - DNA, 18 bp, Homo sapiens
tctatgttttctactcca

SEQ ID NO: 4214435 - DNA, 20 bp, Homo sapiens
tctatgttttctactccaat

SEQ ID NO: 4214436 - DNA, 16 bp, Homo sapiens
tctccaggattccaaa

SEQ ID NO: 4214437 - DNA, 12 bp, Homo sapiens
tctccctccagc

SEQ ID NO: 4214438 - DNA, 20 bp, Homo sapiens
tctcctgagaggtgctgcag

SEQ ID NO: 4214439 - DNA, 16 bp, Homo sapiens
tctcctgtctacagtt

SEQ ID NO: 4214440 - DNA, 12 bp, Homo sapiens
tctcgcattttc

SEQ ID NO: 4214441 - DNA, 15 bp, Homo sapiens
tctcgtatttaatat

SEQ ID NO: 4214442 - DNA, 17 bp, Homo sapiens
tctctaagttatgactg

SEQ ID NO: 4214443 - DNA, 20 bp, Homo sapiens
tctctagctgatcagaattt

SEQ ID NO: 4214444 - DNA, 17 bp, Homo sapiens
tctctgactcttgcctt

SEQ ID NO: 4214445 - DNA, 20 bp, Homo sapiens
tctctgactcttgcctttcc

SEQ ID NO: 4214446 - DNA, 21 bp, Homo sapiens
tctctgactcttgcctttcca

SEQ ID NO: 4214447 - DNA, 14 bp, Homo sapiens
tctctgctcttgcc

SEQ ID NO: 4214448 - DNA, 17 bp, Homo sapiens
tctctgctcttgcctgc

SEQ ID NO: 4214449 - DNA, 21 bp, Homo sapiens
tctctgctcttgcctgcaccc

SEQ ID NO: 4214450 - DNA, 15 bp, Homo sapiens
tctctgggagacttt

SEQ ID NO: 4214451 - DNA, 22 bp, Homo sapiens
tctctgtccctcactgccttcc

SEQ ID NO: 4214452 - DNA, 16 bp, Homo sapiens
tctcttgcctttctta

SEQ ID NO: 4214453 - DNA, 14 bp, Homo sapiens
tctgactcttgcct

SEQ ID NO: 4214454 - DNA, 17 bp, Homo sapiens
tctgactcttgcctttc

SEQ ID NO: 4214455 - DNA, 22 bp, Homo sapiens
tctgactcttgcctttccacct

SEQ ID NO: 4214456 - DNA, 23 bp, Homo sapiens
tctgactcttgcctttccacctg

SEQ ID NO: 4214457 - DNA, 17 bp, Homo sapiens
tctgagtacttgatttc

SEQ ID NO: 4214458 - DNA, 15 bp, Homo sapiens
tctgcatttaaaaaa

SEQ ID NO: 4214459 - DNA, 13 bp, Homo sapiens
tctgctcttgcct

SEQ ID NO: 4214460 - DNA, 18 bp, Homo sapiens
tctggtcaggcccactgc

SEQ ID NO: 4214461 - DNA, 21 bp, Homo sapiens
tctggtcaggcccactgcaga

SEQ ID NO: 4214462 - DNA, 22 bp, Homo sapiens
tctggtctttgaaagaaatgta

SEQ ID NO: 4214463 - DNA, 19 bp, Homo sapiens
tctgtcatcccgctcctgc

SEQ ID NO: 4214464 - DNA, 20 bp, Homo sapiens
tctgtcatcccgctcctgct

SEQ ID NO: 4214465 - DNA, 20 bp, Homo sapiens
tctgtccctcactgccttcc

SEQ ID NO: 4214466 - DNA, 21 bp, Homo sapiens
tctgtccctcactgccttcca

SEQ ID NO: 4214467 - DNA, 19 bp, Homo sapiens
tctgtgaacaagcttcagt

SEQ ID NO: 4214468 - DNA, 16 bp, Homo sapiens
tcttactaaaaagtat

SEQ ID NO: 4214469 - DNA, 16 bp, Homo sapiens
tcttatttgcaataaa

SEQ ID NO: 4214470 - DNA, 15 bp, Homo sapiens
tcttccatttcttcc

SEQ ID NO: 4214471 - DNA, 13 bp, Homo sapiens
tcttcccttcttt

SEQ ID NO: 4214472 - DNA, 16 bp, Homo sapiens
tcttcctagtgcctac

SEQ ID NO: 4214473 - DNA, 22 bp, Homo sapiens
tcttctactttcatctattctt

SEQ ID NO: 4214474 - DNA, 13 bp, Homo sapiens
tcttctgtcatcc

SEQ ID NO: 4214475 - DNA, 15 bp, Homo sapiens
tcttgcctgcaccct

SEQ ID NO: 4214476 - DNA, 19 bp, Homo sapiens
tcttgcctttccacctgct

SEQ ID NO: 4214477 - DNA, 17 bp, Homo sapiens
tcttggagaactttcca

SEQ ID NO: 4214478 - DNA, 18 bp, Homo sapiens
tcttgttgctgtacaaaa

SEQ ID NO: 4214479 - DNA, 16 bp, Homo sapiens
tctttaggtgcctcct

SEQ ID NO: 4214480 - DNA, 18 bp, Homo sapiens
tctttaggtgcctcctgt

SEQ ID NO: 4214481 - DNA, 19 bp, Homo sapiens
tctttaggtgcctcctgtc

SEQ ID NO: 4214482 - DNA, 21 bp, Homo sapiens
tctttaggtgcctcctgtctt

SEQ ID NO: 4214483 - DNA, 13 bp, Homo sapiens
tctttatctacta

SEQ ID NO: 4214484 - DNA, 20 bp, Homo sapiens
tctttgaaagaaatgtacta

SEQ ID NO: 4214485 - DNA, 16 bp, Homo sapiens
tctttgaatatgtagt

SEQ ID NO: 4214486 - DNA, 18 bp, Homo sapiens
tctttgcacttttgaaat

SEQ ID NO: 4214487 - DNA, 22 bp, Homo sapiens
tcttttgatagtatttataata

SEQ ID NO: 4214488 - DNA, 18 bp, Homo sapiens
tcttttggctttgaaact

SEQ ID NO: 4214489 - DNA, 18 bp, Homo sapiens
tgaaaaactcttctactt

SEQ ID NO: 4214490 - DNA, 11 bp, Homo sapiens
tgaaaatgtgg

SEQ ID NO: 4214491 - DNA, 12 bp, Homo sapiens
tgaaataaaata

SEQ ID NO: 4214492 - DNA, 23 bp, Homo sapiens
tgaacaccaacttttatttggaa

SEQ ID NO: 4214493 - DNA, 17 bp, Homo sapiens
tgaacattacattgcca

SEQ ID NO: 4214494 - DNA, 13 bp, Homo sapiens
tgaactgccaaga

SEQ ID NO: 4214495 - DNA, 23 bp, Homo sapiens
tgaagaatgttagagtaatgaaa

SEQ ID NO: 4214496 - DNA, 14 bp, Homo sapiens
tgaagtaagcaaag

SEQ ID NO: 4214497 - DNA, 21 bp, Homo sapiens
tgaagtgggtggatcaccaga

SEQ ID NO: 4214498 - DNA, 14 bp, Homo sapiens
tgaatgcataaaat

SEQ ID NO: 4214499 - DNA, 15 bp, Homo sapiens
tgaatgcataaaatg

SEQ ID NO: 4214500 - DNA, 16 bp, Homo sapiens
tgaatgcataaaatgt

SEQ ID NO: 4214501 - DNA, 15 bp, Homo sapiens
tgaatgtcagttgtt

SEQ ID NO: 4214502 - DNA, 22 bp, Homo sapiens
tgacaaagttatatatttataa

SEQ ID NO: 4214503 - DNA, 15 bp, Homo sapiens
tgacatatttttgct

SEQ ID NO: 4214504 - DNA, 16 bp, Homo sapiens
tgaccatcctgtcctt

SEQ ID NO: 4214505 - DNA, 16 bp, Homo sapiens
tgaccgagtctaggaa

SEQ ID NO: 4214506 - DNA, 17 bp, Homo sapiens
tgacttctcacttccta

SEQ ID NO: 4214507 - DNA, 21 bp, Homo sapiens
tgacttgcagagttcatggaa

SEQ ID NO: 4214508 - DNA, 16 bp, Homo sapiens
tgagccattttttaaa

SEQ ID NO: 4214509 - DNA, 13 bp, Homo sapiens
tgataaaaactca

SEQ ID NO: 4214510 - DNA, 16 bp, Homo sapiens
tgataaaaagaaatgt

SEQ ID NO: 4214511 - DNA, 22 bp, Homo sapiens
tgatcctaatgaatgcataaaa

SEQ ID NO: 4214512 - DNA, 18 bp, Homo sapiens
tgatccttcctactttgc

SEQ ID NO: 4214513 - DNA, 21 bp, Homo sapiens
tgatctgatgcaagcaagaaa

SEQ ID NO: 4214514 - DNA, 14 bp, Homo sapiens
tgatgaccaagaat

SEQ ID NO: 4214515 - DNA, 15 bp, Homo sapiens
tgatggtgatgaaat

SEQ ID NO: 4214516 - DNA, 16 bp, Homo sapiens
tgatggtgatgaaatg

SEQ ID NO: 4214517 - DNA, 12 bp, Homo sapiens
tgattcacagtg

SEQ ID NO: 4214518 - DNA, 19 bp, Homo sapiens
tgattcttccaaggaaata

SEQ ID NO: 4214519 - DNA, 16 bp, Homo sapiens
tgatttcacagtgtgt

SEQ ID NO: 4214520 - DNA, 18 bp, Homo sapiens
tgcaacttgtaaatgtgg

SEQ ID NO: 4214521 - DNA, 19 bp, Homo sapiens
tgcacacctgttattgcca

SEQ ID NO: 4214522 - DNA, 13 bp, Homo sapiens
tgcacatctgttt

SEQ ID NO: 4214523 - DNA, 17 bp, Homo sapiens
tgcacatctgttttgta

SEQ ID NO: 4214524 - DNA, 23 bp, Homo sapiens
tgcacatgtaacatagatttatg

SEQ ID NO: 4214525 - DNA, 18 bp, Homo sapiens
taatttttaaatgtttat

SEQ ID NO: 4214526 - DNA, 17 bp, Homo sapiens
tacaaagttaaaattgt

SEQ ID NO: 4214527 - DNA, 19 bp, Homo sapiens
tacaagggcataaagtaaa

SEQ ID NO: 4214528 - DNA, 19 bp, Homo sapiens
tacaaggtatttacacata

SEQ ID NO: 4214529 - DNA, 21 bp, Homo sapiens
tacaagtagaatggcagctgg

SEQ ID NO: 4214530 - DNA, 17 bp, Homo sapiens
tacaatgggaaaacttc

SEQ ID NO: 4214531 - DNA, 18 bp, Homo sapiens
tacaatgggaaaacttca

SEQ ID NO: 4214532 - DNA, 19 bp, Homo sapiens
tacaatgggaaaacttcac

SEQ ID NO: 4214533 - DNA, 20 bp, Homo sapiens
tacaatgggaaaacttcact

SEQ ID NO: 4214534 - DNA, 21 bp, Homo sapiens
tacacatccccagccagaagt

SEQ ID NO: 4214535 - DNA, 18 bp, Homo sapiens
tacacctgaggctgaggc

SEQ ID NO: 4214536 - DNA, 17 bp, Homo sapiens
tacagagcttgaaaact

SEQ ID NO: 4214537 - DNA, 12 bp, Homo sapiens
tacaggtacagg

SEQ ID NO: 4214538 - DNA, 16 bp, Homo sapiens
tacatataattctttt

SEQ ID NO: 4214539 - DNA, 20 bp, Homo sapiens
tacatgcatataatgaataa

SEQ ID NO: 4214540 - DNA, 19 bp, Homo sapiens
tacattgccatttttaatt

SEQ ID NO: 4214541 - DNA, 14 bp, Homo sapiens
tacgttaccaggca

SEQ ID NO: 4214542 - DNA, 19 bp, Homo sapiens
tactaaaaagtataaaata

SEQ ID NO: 4214543 - DNA, 18 bp, Homo sapiens
tactaattgagccattta

SEQ ID NO: 4214544 - DNA, 20 bp, Homo sapiens
tactatcatgtcaaacgtga

SEQ ID NO: 4214545 - DNA, 20 bp, Homo sapiens
tactgagagtgcaaattgta

SEQ ID NO: 4214546 - DNA, 19 bp, Homo sapiens
tacttattttccaataaaa

SEQ ID NO: 4214547 - DNA, 17 bp, Homo sapiens
tactttgcttctctcca

SEQ ID NO: 4214548 - DNA, 23 bp, Homo sapiens
tactttgcttctctccacccatg

SEQ ID NO: 4214549 - DNA, 17 bp, Homo sapiens
tagaaagagatacagag

SEQ ID NO: 4214550 - DNA, 12 bp, Homo sapiens
tagaaccaggca

SEQ ID NO: 4214551 - DNA, 19 bp, Homo sapiens
tagaatgttttcaaatgtt

SEQ ID NO: 4214552 - DNA, 14 bp, Homo sapiens
tagagtaatgaaat

SEQ ID NO: 4214553 - DNA, 19 bp, Homo sapiens
tagatttatgtaatgcttt

SEQ ID NO: 4214554 - DNA, 15 bp, Homo sapiens
tagcatgaaataaaa

SEQ ID NO: 4214555 - DNA, 13 bp, Homo sapiens
tagctaattattt

SEQ ID NO: 4214556 - DNA, 16 bp, Homo sapiens
tagctgatcagaattt

SEQ ID NO: 4214557 - DNA, 23 bp, Homo sapiens
taggaagtgaccgagtctaggaa

SEQ ID NO: 4214558 - DNA, 18 bp, Homo sapiens
tagtgcctacaatgggaa

SEQ ID NO: 4214559 - DNA, 15 bp, Homo sapiens
tagttaagtcatcca

SEQ ID NO: 4214560 - DNA, 19 bp, Homo sapiens
tataaagtggaagtatgta

SEQ ID NO: 4214561 - DNA, 12 bp, Homo sapiens
tataataaaaat

SEQ ID NO: 4214562 - DNA, 20 bp, Homo sapiens
tataattttgcagcagaagc

SEQ ID NO: 4214563 - DNA, 18 bp, Homo sapiens
tatattaaaaaagagaca

SEQ ID NO: 4214564 - DNA, 13 bp, Homo sapiens
tatatttataaaa

SEQ ID NO: 4214565 - DNA, 15 bp, Homo sapiens
tatatttgatacata

SEQ ID NO: 4214566 - DNA, 13 bp, Homo sapiens
tatcatgtctatt

SEQ ID NO: 4214567 - DNA, 17 bp, Homo sapiens
tatcccttggacatttt

SEQ ID NO: 4214568 - DNA, 19 bp, Homo sapiens
tatcccttggacattttat

SEQ ID NO: 4214569 - DNA, 15 bp, Homo sapiens
tatctcctgtctaca

SEQ ID NO: 4214570 - DNA, 14 bp, Homo sapiens
tatgaaaatggaaa

SEQ ID NO: 4214571 - DNA, 21 bp, Homo sapiens
tatgaacatggagaggacttt

SEQ ID NO: 4214572 - DNA, 16 bp, Homo sapiens
tatgactgtgaaatga

SEQ ID NO: 4214573 - DNA, 17 bp, Homo sapiens
tatgatttggaaaataa

SEQ ID NO: 4214574 - DNA, 14 bp, Homo sapiens
tatgcctcatgctg

SEQ ID NO: 4214575 - DNA, 18 bp, Homo sapiens
tatgtagtatctatatga

SEQ ID NO: 4214576 - DNA, 17 bp, Homo sapiens
tattaaagatatttctt

SEQ ID NO: 4214577 - DNA, 19 bp, Homo sapiens
tattaatgcttgaatatta

SEQ ID NO: 4214578 - DNA, 18 bp, Homo sapiens
tattacctttacatatta

SEQ ID NO: 4214579 - DNA, 16 bp, Homo sapiens
tattactggataaatt

SEQ ID NO: 4214580 - DNA, 18 bp, Homo sapiens
tattactggataaattgt

SEQ ID NO: 4214581 - DNA, 18 bp, Homo sapiens
tattagataaccatattc

SEQ ID NO: 4214582 - DNA, 20 bp, Homo sapiens
tattagatgttttacaaatt

SEQ ID NO: 4214583 - DNA, 16 bp, Homo sapiens
tattataaaggataaa

SEQ ID NO: 4214584 - DNA, 18 bp, Homo sapiens
tattataaaggataaaga

SEQ ID NO: 4214585 - DNA, 13 bp, Homo sapiens
tattatattcatt

SEQ ID NO: 4214586 - DNA, 23 bp, Homo sapiens
tattatattcattctttttgaaa

SEQ ID NO: 4214587 - DNA, 14 bp, Homo sapiens
tattctaattttat

SEQ ID NO: 4214588 - DNA, 14 bp, Homo sapiens
tattcttggagaac

SEQ ID NO: 4214589 - DNA, 17 bp, Homo sapiens
tattcttggagaacttt

SEQ ID NO: 4214590 - DNA, 16 bp, Homo sapiens
tattgaaatgatttca

SEQ ID NO: 4214591 - DNA, 23 bp, Homo sapiens
tatttaatttgaaggtagaatgt

SEQ ID NO: 4214592 - DNA, 23 bp, Homo sapiens
tatttataaaattgctataaatc

SEQ ID NO: 4214593 - DNA, 15 bp, Homo sapiens
tatttataatataaa

SEQ ID NO: 4214594 - DNA, 12 bp, Homo sapiens
tatttattgaaa

SEQ ID NO: 4214595 - DNA, 16 bp, Homo sapiens
tatttattgaaatgat

SEQ ID NO: 4214596 - DNA, 14 bp, Homo sapiens
tatttatttattta

SEQ ID NO: 4214597 - DNA, 17 bp, Homo sapiens
tattttagtctgtcatc

SEQ ID NO: 4214598 - DNA, 18 bp, Homo sapiens
tattttccaataaaattt

SEQ ID NO: 4214599 - DNA, 22 bp, Homo sapiens
tcaaaaattgtgtttagatttt

SEQ ID NO: 4214600 - DNA, 17 bp, Homo sapiens
tcaaagtcattaaagac

SEQ ID NO: 4214601 - DNA, 18 bp, Homo sapiens
tcaaagtcattaaagaca

SEQ ID NO: 4214602 - DNA, 20 bp, Homo sapiens
tcaaatgatccttcctactt

SEQ ID NO: 4214603 - DNA, 21 bp, Homo sapiens
tcaatagattgtaatacacat

SEQ ID NO: 4214604 - DNA, 19 bp, Homo sapiens
tcaatgagagcataattta

SEQ ID NO: 4214605 - DNA, 18 bp, Homo sapiens
tcacaagtaacagttgaa

SEQ ID NO: 4214606 - DNA, 23 bp, Homo sapiens
tcacagatgtgtgattcacagtg

SEQ ID NO: 4214607 - DNA, 22 bp, Homo sapiens
tcacataggttagattctcatt

SEQ ID NO: 4214608 - DNA, 17 bp, Homo sapiens
tcaccagaggtcaggag

SEQ ID NO: 4214609 - DNA, 19 bp, Homo sapiens
tcactcccagaccacctcc

SEQ ID NO: 4214610 - DNA, 17 bp, Homo sapiens
tcactgaccctggagcg

SEQ ID NO: 4214611 - DNA, 20 bp, Homo sapiens
tcacttttggcaatgactca

SEQ ID NO: 4214612 - DNA, 16 bp, Homo sapiens
tcagaacatcctccaa

SEQ ID NO: 4214613 - DNA, 15 bp, Homo sapiens
tcagaattttaccaa

SEQ ID NO: 4214614 - DNA, 14 bp, Homo sapiens
tcaggagttcgaga

SEQ ID NO: 4214615 - DNA, 21 bp, Homo sapiens
tcaggatccaagtgacaaagt

SEQ ID NO: 4214616 - DNA, 15 bp, Homo sapiens
tcagttgttatttat

SEQ ID NO: 4214617 - DNA, 20 bp, Homo sapiens
tcagttgttatttattgaaa

SEQ ID NO: 4214618 - DNA, 22 bp, Homo sapiens
tcataaattatttgattattta

SEQ ID NO: 4214619 - DNA, 21 bp, Homo sapiens
tcatataactgagatgaatgt

SEQ ID NO: 4214620 - DNA, 12 bp, Homo sapiens
tcatataagaca

SEQ ID NO: 4214621 - DNA, 17 bp, Homo sapiens
tcatcaattttgtctat

SEQ ID NO: 4214622 - DNA, 12 bp, Homo sapiens
tcatcccgctcc

SEQ ID NO: 4214623 - DNA, 18 bp, Homo sapiens
tcatgctgacttgcagag

SEQ ID NO: 4214624 - DNA, 17 bp, Homo sapiens
tcatggtccgcctgcct

SEQ ID NO: 4214625 - DNA, 16 bp, Homo sapiens
tcatgtacagcatgca

SEQ ID NO: 4214626 - DNA, 17 bp, Homo sapiens
tcattatgttaatattt

SEQ ID NO: 4214627 - DNA, 12 bp, Homo sapiens
tccaaagagaaa

SEQ ID NO: 4214628 - DNA, 15 bp, Homo sapiens
tccaacagacagggc

SEQ ID NO: 4214629 - DNA, 18 bp, Homo sapiens
tccaacagacagggccta

SEQ ID NO: 4214630 - DNA, 22 bp, Homo sapiens
tccacaggagggagagaactta

SEQ ID NO: 4214631 - DNA, 14 bp, Homo sapiens
tccacagtctctgg

SEQ ID NO: 4214632 - DNA, 15 bp, Homo sapiens
tccacagtctctggg

SEQ ID NO: 4214633 - DNA, 12 bp, Homo sapiens
tccacctgcttt

SEQ ID NO: 4214634 - DNA, 22 bp, Homo sapiens
tccacctgttcaggagctgaag

SEQ ID NO: 4214635 - DNA, 18 bp, Homo sapiens
tccacttcttaatgcttt

SEQ ID NO: 4214636 - DNA, 19 bp, Homo sapiens
tccagccttctctctctgg

SEQ ID NO: 4214637 - DNA, 19 bp, Homo sapiens
tccagctggaattgctgct

SEQ ID NO: 4214638 - DNA, 15 bp, Homo sapiens
tccaggattccaaag

SEQ ID NO: 4214639 - DNA, 16 bp, Homo sapiens
tccaggattccaaagt

SEQ ID NO: 4214640 - DNA, 17 bp, Homo sapiens
tccaggattccaaagtt

SEQ ID NO: 4214641 - DNA, 14 bp, Homo sapiens
tccagtcattatgt

SEQ ID NO: 4214642 - DNA, 21 bp, Homo sapiens
tccagtcattatgttaatatt

SEQ ID NO: 4214643 - DNA, 23 bp, Homo sapiens
tccagtcattatgttaatatttc

SEQ ID NO: 4214644 - DNA, 15 bp, Homo sapiens
tccatttcttccacg

SEQ ID NO: 4214645 - DNA, 23 bp, Homo sapiens
tcccaccagcatgtcactcccag

SEQ ID NO: 4214646 - DNA, 20 bp, Homo sapiens
tcccagaccacctccctgcc

SEQ ID NO: 4214647 - DNA, 17 bp, Homo sapiens
gcttcccctcgctgtcc

SEQ ID NO: 4214648 - DNA, 22 bp, Homo sapiens
gcttcccctcgctgtcctgctg

SEQ ID NO: 4214649 - DNA, 16 bp, Homo sapiens
gcttcctccgtctgca

SEQ ID NO: 4214650 - DNA, 23 bp, Homo sapiens
gcttgaaaactcacttcaatgaa

SEQ ID NO: 4214651 - DNA, 18 bp, Homo sapiens
gcttgaaggaacagtgct

SEQ ID NO: 4214652 - DNA, 13 bp, Homo sapiens
gctttcctccctg

SEQ ID NO: 4214653 - DNA, 23 bp, Homo sapiens
ggaaattttacaagggcataaag

SEQ ID NO: 4214654 - DNA, 15 bp, Homo sapiens
ggacattttatgtct

SEQ ID NO: 4214655 - DNA, 17 bp, Homo sapiens
ggagaactttccatctg

SEQ ID NO: 4214656 - DNA, 19 bp, Homo sapiens
ggagaactttccatctgct

SEQ ID NO: 4214657 - DNA, 19 bp, Homo sapiens
ggagaagtcttctatttat

SEQ ID NO: 4214658 - DNA, 12 bp, Homo sapiens
ggagaggctgtg

SEQ ID NO: 4214659 - DNA, 19 bp, Homo sapiens
ggaggctggtctccctcca

SEQ ID NO: 4214660 - DNA, 14 bp, Homo sapiens
ggagggacaagaat

SEQ ID NO: 4214661 - DNA, 21 bp, Homo sapiens
ggataagcgtgggtggaggaa

SEQ ID NO: 4214662 - DNA, 23 bp, Homo sapiens
ggatgatgtctttttattaaaat

SEQ ID NO: 4214663 - DNA, 18 bp, Homo sapiens
ggattttttatgtacaac

SEQ ID NO: 4214664 - DNA, 21 bp, Homo sapiens
ggattttttatgtacaaccct

SEQ ID NO: 4214665 - DNA, 18 bp, Homo sapiens
ggcaacagagcaagactc

SEQ ID NO: 4214666 - DNA, 20 bp, Homo sapiens
ggcaacagagcaagactccg

SEQ ID NO: 4214667 - DNA, 16 bp, Homo sapiens
ggcaacgcacaaaaca

SEQ ID NO: 4214668 - DNA, 18 bp, Homo sapiens
ggcgacttcctctccagc

SEQ ID NO: 4214669 - DNA, 16 bp, Homo sapiens
ggctgtggtggctgtc

SEQ ID NO: 4214670 - DNA, 21 bp, Homo sapiens
ggcttaattattgatgttttc

SEQ ID NO: 4214671 - DNA, 11 bp, Homo sapiens
ggcttgctgcc

SEQ ID NO: 4214672 - DNA, 21 bp, Homo sapiens
ggcttgggaagatcttttaaa

SEQ ID NO: 4214673 - DNA, 19 bp, Homo sapiens
gggaaaacttcactccaaa

SEQ ID NO: 4214674 - DNA, 20 bp, Homo sapiens
gggaaaacttcactccaaag

SEQ ID NO: 4214675 - DNA, 20 bp, Homo sapiens
gggagacggaggttgcagtg

SEQ ID NO: 4214676 - DNA, 20 bp, Homo sapiens
ggggagacggaggttgcagt

SEQ ID NO: 4214677 - DNA, 22 bp, Homo sapiens
gggtggatcaccagaggtcagg

SEQ ID NO: 4214678 - DNA, 19 bp, Homo sapiens
ggtaagaatagtagatgtg

SEQ ID NO: 4214679 - DNA, 18 bp, Homo sapiens
ggtctccctccagctgga

SEQ ID NO: 4214680 - DNA, 21 bp, Homo sapiens
ggtggaattacttaaatttta

SEQ ID NO: 4214681 - DNA, 19 bp, Homo sapiens
ggtggccatgtcgcctgcc

SEQ ID NO: 4214682 - DNA, 14 bp, Homo sapiens
ggtggctgtctctg

SEQ ID NO: 4214683 - DNA, 14 bp, Homo sapiens
ggtgtggtggctca

SEQ ID NO: 4214684 - DNA, 13 bp, Homo sapiens
ggtgttaaacttt

SEQ ID NO: 4214685 - DNA, 14 bp, Homo sapiens
gtaaaaataaaatt

SEQ ID NO: 4214686 - DNA, 17 bp, Homo sapiens
gtaaatacatgcatata

SEQ ID NO: 4214687 - DNA, 17 bp, Homo sapiens
gtaatacttccagaagt

SEQ ID NO: 4214688 - DNA, 18 bp, Homo sapiens
gtaatgatgtcgtttgaa

SEQ ID NO: 4214689 - DNA, 12 bp, Homo sapiens
gtacaaccctga

SEQ ID NO: 4214690 - DNA, 20 bp, Homo sapiens
gtatagcatgaaataaaata

SEQ ID NO: 4214691 - DNA, 15 bp, Homo sapiens
gtatttataatataa

SEQ ID NO: 4214692 - DNA, 13 bp, Homo sapiens
gtcaacatttctc

SEQ ID NO: 4214693 - DNA, 18 bp, Homo sapiens
gtcagttgttatttattg

SEQ ID NO: 4214694 - DNA, 21 bp, Homo sapiens
gtcagttgttatttattgaaa

SEQ ID NO: 4214695 - DNA, 19 bp, Homo sapiens
gtcatcccgctcctgctga

SEQ ID NO: 4214696 - DNA, 16 bp, Homo sapiens
gtcatctcagctggat

SEQ ID NO: 4214697 - DNA, 19 bp, Homo sapiens
gtcattatgttaatatttc

SEQ ID NO: 4214698 - DNA, 14 bp, Homo sapiens
gtcccagggctgat

SEQ ID NO: 4214699 - DNA, 15 bp, Homo sapiens
gtcccccctcactcc

SEQ ID NO: 4214700 - DNA, 17 bp, Homo sapiens
gtctccctccagctgga

SEQ ID NO: 4214701 - DNA, 22 bp, Homo sapiens
gtctctaagttatgactgtgaa

SEQ ID NO: 4214702 - DNA, 15 bp, Homo sapiens
gtctctgctcttgcc

SEQ ID NO: 4214703 - DNA, 19 bp, Homo sapiens
gtctctgctcttgcctgca

SEQ ID NO: 4214704 - DNA, 22 bp, Homo sapiens
gtctctgtccctcactgccttc

SEQ ID NO: 4214705 - DNA, 18 bp, Homo sapiens
gtgacaaaattggccaga

SEQ ID NO: 4214706 - DNA, 18 bp, Homo sapiens
gtgagcacatctgggagg

SEQ ID NO: 4214707 - DNA, 12 bp, Homo sapiens
gtgcctcctgtc

SEQ ID NO: 4214708 - DNA, 17 bp, Homo sapiens
gtgctgttctggagctg

SEQ ID NO: 4214709 - DNA, 12 bp, Homo sapiens
gtggaaaaggaa

SEQ ID NO: 4214710 - DNA, 21 bp, Homo sapiens
gtggatcaccagaggtcagga

SEQ ID NO: 4214711 - DNA, 14 bp, Homo sapiens
gtggctgtctctgt

SEQ ID NO: 4214712 - DNA, 13 bp, Homo sapiens
gtggcttcctccg

SEQ ID NO: 4214713 - DNA, 17 bp, Homo sapiens
gtggcttcctccgtctg

SEQ ID NO: 4214714 - DNA, 16 bp, Homo sapiens
gtggtggctgtctctg

SEQ ID NO: 4214715 - DNA, 14 bp, Homo sapiens
gtgtgaattcccag

SEQ ID NO: 4214716 - DNA, 20 bp, Homo sapiens
gtgttgaagaagagtttgca

SEQ ID NO: 4214717 - DNA, 14 bp, Homo sapiens
gttaagtcatccac

SEQ ID NO: 4214718 - DNA, 17 bp, Homo sapiens
gttatcaaaatagtcta

SEQ ID NO: 4214719 - DNA, 18 bp, Homo sapiens
gttattacctttacatat

SEQ ID NO: 4214720 - DNA, 17 bp, Homo sapiens
gttcaggagctgaagcc

SEQ ID NO: 4214721 - DNA, 14 bp, Homo sapiens
gttccaacagacag

SEQ ID NO: 4214722 - DNA, 15 bp, Homo sapiens
gttccctgttcttcg

SEQ ID NO: 4214723 - DNA, 16 bp, Homo sapiens
gttcctgctaataatt

SEQ ID NO: 4214724 - DNA, 16 bp, Homo sapiens
gttctggagctgctgt

SEQ ID NO: 4214725 - DNA, 18 bp, Homo sapiens
gttctttaggtgcctcct

SEQ ID NO: 4214726 - DNA, 20 bp, Homo sapiens
gttctttaggtgcctcctgt

SEQ ID NO: 4214727 - DNA, 21 bp, Homo sapiens
gttctttaggtgcctcctgtc

SEQ ID NO: 4214728 - DNA, 12 bp, Homo sapiens
gttgataaaaac

SEQ ID NO: 4214729 - DNA, 14 bp, Homo sapiens
gttgcaggccaggt

SEQ ID NO: 4214730 - DNA, 22 bp, Homo sapiens
gtttgggccactgcactctagc

SEQ ID NO: 4214731 - DNA, 17 bp, Homo sapiens
gttttgaagattctatg

SEQ ID NO: 4214732 - DNA, 11 bp, Homo sapiens
taaaaacattc

SEQ ID NO: 4214733 - DNA, 23 bp, Homo sapiens
taaaaattactgtttaattgaca

SEQ ID NO: 4214734 - DNA, 20 bp, Homo sapiens
taaaactggtttagcacaat

SEQ ID NO: 4214735 - DNA, 16 bp, Homo sapiens
taaaagaaataaacca

SEQ ID NO: 4214736 - DNA, 22 bp, Homo sapiens
taaaaggtattgagccattttt

SEQ ID NO: 4214737 - DNA, 13 bp, Homo sapiens
taaaattttcaaa

SEQ ID NO: 4214738 - DNA, 20 bp, Homo sapiens
taaagagcatctgattcttg

SEQ ID NO: 4214739 - DNA, 22 bp, Homo sapiens
taaagatgccctaagtgttgaa

SEQ ID NO: 4214740 - DNA, 19 bp, Homo sapiens
taaagcctgaaaattccaa

SEQ ID NO: 4214741 - DNA, 14 bp, Homo sapiens
taaaggataaagaa

SEQ ID NO: 4214742 - DNA, 20 bp, Homo sapiens
taaatacatgcatataatga

SEQ ID NO: 4214743 - DNA, 23 bp, Homo sapiens
taaatcaatcttattactgagag

SEQ ID NO: 4214744 - DNA, 14 bp, Homo sapiens
taaatcctgaagag

SEQ ID NO: 4214745 - DNA, 16 bp, Homo sapiens
taaatcctgaagagca

SEQ ID NO: 4214746 - DNA, 18 bp, Homo sapiens
taaatcctgaagagcatt

SEQ ID NO: 4214747 - DNA, 20 bp, Homo sapiens
taaattatttgattatttaa

SEQ ID NO: 4214748 - DNA, 16 bp, Homo sapiens
taacatagatttatgt

SEQ ID NO: 4214749 - DNA, 19 bp, Homo sapiens
taacggtcccccctcactc

SEQ ID NO: 4214750 - DNA, 15 bp, Homo sapiens
taacttccaaataaa

SEQ ID NO: 4214751 - DNA, 19 bp, Homo sapiens
taagagcaaactttagtgt

SEQ ID NO: 4214752 - DNA, 18 bp, Homo sapiens
taagaggcgacttcctct

SEQ ID NO: 4214753 - DNA, 19 bp, Homo sapiens
taagcaccctagaggacta

SEQ ID NO: 4214754 - DNA, 16 bp, Homo sapiens
taaggagggacaagaa

SEQ ID NO: 4214755 - DNA, 18 bp, Homo sapiens
taagggaataagccatga

SEQ ID NO: 4214756 - DNA, 18 bp, Homo sapiens
taagtcatcatctccaaa

SEQ ID NO: 4214757 - DNA, 19 bp, Homo sapiens
taagtcatcatctccaaac

SEQ ID NO: 4214758 - DNA, 18 bp, Homo sapiens
taagtcatccacagccca

SEQ ID NO: 4214759 - DNA, 17 bp, Homo sapiens
taataatttgccattat

SEQ ID NO: 4214760 - DNA, 13 bp, Homo sapiens
taatataataaaa

SEQ ID NO: 4214761 - DNA, 22 bp, Homo sapiens
taatatgggtgaacaccaactt

SEQ ID NO: 4214762 - DNA, 15 bp, Homo sapiens
taatgaaatggagga

SEQ ID NO: 4214763 - DNA, 15 bp, Homo sapiens
taatgaatgcataaa

SEQ ID NO: 4214764 - DNA, 17 bp, Homo sapiens
taatgatgtcgtttgaa

SEQ ID NO: 4214765 - DNA, 12 bp, Homo sapiens
taatgccttcca

SEQ ID NO: 4214766 - DNA, 18 bp, Homo sapiens
taatgctttcctccctgg

SEQ ID NO: 4214767 - DNA, 18 bp, Homo sapiens
taattgagccatttaatt

SEQ ID NO: 4214768 - DNA, 14 bp, Homo sapiens
taatttaaaaatat

SEQ ID NO: 4214769 - DNA, 22 bp, Homo sapiens
gacaaaatctaatgttgtcttt

SEQ ID NO: 4214770 - DNA, 18 bp, Homo sapiens
gacaaaattggccagaga

SEQ ID NO: 4214771 - DNA, 14 bp, Homo sapiens
gacaaagttatata

SEQ ID NO: 4214772 - DNA, 20 bp, Homo sapiens
gacaccaaattccaaacttc

SEQ ID NO: 4214773 - DNA, 18 bp, Homo sapiens
gacactgttgataaaaac

SEQ ID NO: 4214774 - DNA, 19 bp, Homo sapiens
gacagcgaactagaagaaa

SEQ ID NO: 4214775 - DNA, 15 bp, Homo sapiens
gacatattcttggag

SEQ ID NO: 4214776 - DNA, 21 bp, Homo sapiens
gacatattcttggagaacttt

SEQ ID NO: 4214777 - DNA, 20 bp, Homo sapiens
gacattttatgtctttcttg

SEQ ID NO: 4214778 - DNA, 10 bp, Homo sapiens
gaccaagaat

SEQ ID NO: 4214779 - DNA, 21 bp, Homo sapiens
gaccctggagcggctctcctg

SEQ ID NO: 4214780 - DNA, 22 bp, Homo sapiens
gaccctggagcggctctcctga

SEQ ID NO: 4214781 - DNA, 19 bp, Homo sapiens
gaccctgtagagtcactga

SEQ ID NO: 4214782 - DNA, 22 bp, Homo sapiens
gaccctgtagagtcactgaccc

SEQ ID NO: 4214783 - DNA, 21 bp, Homo sapiens
gacggaggttgcagtgagccg

SEQ ID NO: 4214784 - DNA, 18 bp, Homo sapiens
gactacttgggagcaccg

SEQ ID NO: 4214785 - DNA, 20 bp, Homo sapiens
gactacttgggagcaccgcc

SEQ ID NO: 4214786 - DNA, 20 bp, Homo sapiens
gactatgcgtggctggaacc

SEQ ID NO: 4214787 - DNA, 13 bp, Homo sapiens
gactctgcactga

SEQ ID NO: 4214788 - DNA, 18 bp, Homo sapiens
gactgtacttattttcca

SEQ ID NO: 4214789 - DNA, 15 bp, Homo sapiens
gactgtgaaatgatt

SEQ ID NO: 4214790 - DNA, 15 bp, Homo sapiens
gacttgagcctccat

SEQ ID NO: 4214791 - DNA, 22 bp, Homo sapiens
gacttgtatagcatgaaataaa

SEQ ID NO: 4214792 - DNA, 23 bp, Homo sapiens
gacttgtatagcatgaaataaaa

SEQ ID NO: 4214793 - DNA, 21 bp, Homo sapiens
gagaagtcttctatttattta

SEQ ID NO: 4214794 - DNA, 20 bp, Homo sapiens
gagacactgttgataaaaac

SEQ ID NO: 4214795 - DNA, 18 bp, Homo sapiens
gagactgacacctcactg

SEQ ID NO: 4214796 - DNA, 16 bp, Homo sapiens
gagagccatacataaa

SEQ ID NO: 4214797 - DNA, 18 bp, Homo sapiens
gagaggctgtggtggctg

SEQ ID NO: 4214798 - DNA, 23 bp, Homo sapiens
gagaggctgtggtggctgtctct

SEQ ID NO: 4214799 - DNA, 13 bp, Homo sapiens
gagattttcacat

SEQ ID NO: 4214800 - DNA, 13 bp, Homo sapiens
gagcaatttgcac

SEQ ID NO: 4214801 - DNA, 22 bp, Homo sapiens
gagcaccgcctgtgaaatacca

SEQ ID NO: 4214802 - DNA, 12 bp, Homo sapiens
gagcataattta

SEQ ID NO: 4214803 - DNA, 18 bp, Homo sapiens
gagccatttaatttttaa

SEQ ID NO: 4214804 - DNA, 17 bp, Homo sapiens
gagctgaagcccatgct

SEQ ID NO: 4214805 - DNA, 13 bp, Homo sapiens
gaggctggtctcc

SEQ ID NO: 4214806 - DNA, 23 bp, Homo sapiens
gaggctgtggtggctgtctctgt

SEQ ID NO: 4214807 - DNA, 12 bp, Homo sapiens
gagggcttggga

SEQ ID NO: 4214808 - DNA, 19 bp, Homo sapiens
gagttcgagaccagcccag

SEQ ID NO: 4214809 - DNA, 16 bp, Homo sapiens
gagtttaagtctctga

SEQ ID NO: 4214810 - DNA, 18 bp, Homo sapiens
gataattctagctttgag

SEQ ID NO: 4214811 - DNA, 14 bp, Homo sapiens
gatagtatttataa

SEQ ID NO: 4214812 - DNA, 22 bp, Homo sapiens
gatccacttcttaatgctttcc

SEQ ID NO: 4214813 - DNA, 23 bp, Homo sapiens
gatcctaatgaatgcataaaatg

SEQ ID NO: 4214814 - DNA, 17 bp, Homo sapiens
gatctgatgcaagcaag

SEQ ID NO: 4214815 - DNA, 22 bp, Homo sapiens
gatgaatgtcagttgttattta

SEQ ID NO: 4214816 - DNA, 17 bp, Homo sapiens
gatgccgctcttctgtc

SEQ ID NO: 4214817 - DNA, 15 bp, Homo sapiens
gatttgtcttccctt

SEQ ID NO: 4214818 - DNA, 21 bp, Homo sapiens
gatttgtcttcccttctttgc

SEQ ID NO: 4214819 - DNA, 17 bp, Homo sapiens
gattttttatgtacaac

SEQ ID NO: 4214820 - DNA, 13 bp, Homo sapiens
gcaaacatttctt

SEQ ID NO: 4214821 - DNA, 22 bp, Homo sapiens
gcaaacatttcttaaaatgttt

SEQ ID NO: 4214822 - DNA, 18 bp, Homo sapiens
gcaaatgcaacaaaatat

SEQ ID NO: 4214823 - DNA, 21 bp, Homo sapiens
gcaagagatcatatcctcaga

SEQ ID NO: 4214824 - DNA, 19 bp, Homo sapiens
gcaataaatgccctctctg

SEQ ID NO: 4214825 - DNA, 20 bp, Homo sapiens
gcaataaatgccctctctga

SEQ ID NO: 4214826 - DNA, 20 bp, Homo sapiens
gcaatgtcccttgcacagcc

SEQ ID NO: 4214827 - DNA, 20 bp, Homo sapiens
gcaattattctaattttata

SEQ ID NO: 4214828 - DNA, 22 bp, Homo sapiens
gcaattattctaattttatata

SEQ ID NO: 4214829 - DNA, 23 bp, Homo sapiens
gcaattgtaaacagaaattgcaa

SEQ ID NO: 4214830 - DNA, 18 bp, Homo sapiens
gcacacgcctgtaatccc

SEQ ID NO: 4214831 - DNA, 13 bp, Homo sapiens
gcacatccctgga

SEQ ID NO: 4214832 - DNA, 17 bp, Homo sapiens
gcaccctcatacacaga

SEQ ID NO: 4214833 - DNA, 19 bp, Homo sapiens
gcacgtttgtgagaagaaa

SEQ ID NO: 4214834 - DNA, 16 bp, Homo sapiens
gcactcctctgtctct

SEQ ID NO: 4214835 - DNA, 18 bp, Homo sapiens
gcacttattgaatatatg

SEQ ID NO: 4214836 - DNA, 18 bp, Homo sapiens
gcagatgtccttgatgct

SEQ ID NO: 4214837 - DNA, 20 bp, Homo sapiens
gcagcccagggcacttcaga

SEQ ID NO: 4214838 - DNA, 16 bp, Homo sapiens
gcataaagtaaataca

SEQ ID NO: 4214839 - DNA, 19 bp, Homo sapiens
gcataatttaaaaatatat

SEQ ID NO: 4214840 - DNA, 18 bp, Homo sapiens
gcatataatgaataaatc

SEQ ID NO: 4214841 - DNA, 15 bp, Homo sapiens
gcatgaaataaaata

SEQ ID NO: 4214842 - DNA, 15 bp, Homo sapiens
gcatgtcactcccag

SEQ ID NO: 4214843 - DNA, 16 bp, Homo sapiens
gcatgtcactcccaga

SEQ ID NO: 4214844 - DNA, 23 bp, Homo sapiens
gcatgtcactcccagaccacctc

SEQ ID NO: 4214845 - DNA, 14 bp, Homo sapiens
gccagaagcccatg

SEQ ID NO: 4214846 - DNA, 21 bp, Homo sapiens
gccagatgcacatccctggaa

SEQ ID NO: 4214847 - DNA, 18 bp, Homo sapiens
gccaggttatgcctcatg

SEQ ID NO: 4214848 - DNA, 17 bp, Homo sapiens
gccatcaggactttccc

SEQ ID NO: 4214849 - DNA, 15 bp, Homo sapiens
gccatgtcgcctgcc

SEQ ID NO: 4214850 - DNA, 22 bp, Homo sapiens
gccatttaatttttaaatgttt

SEQ ID NO: 4214851 - DNA, 19 bp, Homo sapiens
gcccaggctggagtgcagt

SEQ ID NO: 4214852 - DNA, 15 bp, Homo sapiens
gcccatgctttccca

SEQ ID NO: 4214853 - DNA, 15 bp, Homo sapiens
gcccgctttgcctgc

SEQ ID NO: 4214854 - DNA, 16 bp, Homo sapiens
gcccgctttgcctgct

SEQ ID NO: 4214855 - DNA, 13 bp, Homo sapiens
gcctataatccca

SEQ ID NO: 4214856 - DNA, 15 bp, Homo sapiens
gcctattgatacttg

SEQ ID NO: 4214857 - DNA, 19 bp, Homo sapiens
gcctcatgctgacttgcag

SEQ ID NO: 4214858 - DNA, 13 bp, Homo sapiens
gcctcctgtctta

SEQ ID NO: 4214859 - DNA, 14 bp, Homo sapiens
gcctgaaaattcca

SEQ ID NO: 4214860 - DNA, 15 bp, Homo sapiens
gcctgcacccttcct

SEQ ID NO: 4214861 - DNA, 23 bp, Homo sapiens
gcctgcccccagcactcctctgt

SEQ ID NO: 4214862 - DNA, 18 bp, Homo sapiens
gcctggcaacagagcaag

SEQ ID NO: 4214863 - DNA, 14 bp, Homo sapiens
gcctggttagaggc

SEQ ID NO: 4214864 - DNA, 18 bp, Homo sapiens
gccttggttcttcctagt

SEQ ID NO: 4214865 - DNA, 14 bp, Homo sapiens
gccttgtctgggga

SEQ ID NO: 4214866 - DNA, 17 bp, Homo sapiens
gcgacttcctctccagc

SEQ ID NO: 4214867 - DNA, 19 bp, Homo sapiens
gctatattcctttttctat

SEQ ID NO: 4214868 - DNA, 11 bp, Homo sapiens
gctatgccttg

SEQ ID NO: 4214869 - DNA, 22 bp, Homo sapiens
gctattttctaaagacttgtat

SEQ ID NO: 4214870 - DNA, 22 bp, Homo sapiens
gctcacgcctataatcccagca

SEQ ID NO: 4214871 - DNA, 23 bp, Homo sapiens
gctcacgcctataatcccagcac

SEQ ID NO: 4214872 - DNA, 13 bp, Homo sapiens
gctcccacagaac

SEQ ID NO: 4214873 - DNA, 23 bp, Homo sapiens
gctcctgctgaaacacctcccag

SEQ ID NO: 4214874 - DNA, 22 bp, Homo sapiens
gctctcctgagaggtgctgcag

SEQ ID NO: 4214875 - DNA, 22 bp, Homo sapiens
gctctctgagggagaggctgtg

SEQ ID NO: 4214876 - DNA, 15 bp, Homo sapiens
gctcttctgtcatcc

SEQ ID NO: 4214877 - DNA, 15 bp, Homo sapiens
gctcttgcctgcacc

SEQ ID NO: 4214878 - DNA, 18 bp, Homo sapiens
gctgaaacacctcccagg

SEQ ID NO: 4214879 - DNA, 12 bp, Homo sapiens
gctgaccagaca

SEQ ID NO: 4214880 - DNA, 23 bp, Homo sapiens
gctgacttgcagagttcatggaa

SEQ ID NO: 4214881 - DNA, 16 bp, Homo sapiens
gctgagaggagagaga

SEQ ID NO: 4214882 - DNA, 17 bp, Homo sapiens
gctggtctccctccagc

SEQ ID NO: 4214883 - DNA, 22 bp, Homo sapiens
gctgtacaggtacaggctggag

SEQ ID NO: 4214884 - DNA, 13 bp, Homo sapiens
gctgtcatctcag

SEQ ID NO: 4214885 - DNA, 13 bp, Homo sapiens
gctgtcctgctgt

SEQ ID NO: 4214886 - DNA, 17 bp, Homo sapiens
gctgtctctgtccctca

SEQ ID NO: 4214887 - DNA, 19 bp, Homo sapiens
gctgtgtgaattcccaggt

SEQ ID NO: 4214888 - DNA, 15 bp, Homo sapiens
gctgttctggagctg

SEQ ID NO: 4214889 - DNA, 18 bp, Homo sapiens
gctgttctggagctgctg

SEQ ID NO: 4214890 - DNA, 21 bp, Homo sapiens
gcttaggagaagtcttctatt

SEQ ID NO: 4214891 - DNA, 22 bp, Homo sapiens
ctgctgttccaacagacagggc

SEQ ID NO: 4214892 - DNA, 14 bp, Homo sapiens
ctgcttgaaggaac

SEQ ID NO: 4214893 - DNA, 19 bp, Homo sapiens
ctggaattgctgctctctg

SEQ ID NO: 4214894 - DNA, 18 bp, Homo sapiens
ctggagcggctctcctga

SEQ ID NO: 4214895 - DNA, 20 bp, Homo sapiens
ctggagcggctctcctgaga

SEQ ID NO: 4214896 - DNA, 15 bp, Homo sapiens
ctggcacgtttgtga

SEQ ID NO: 4214897 - DNA, 21 bp, Homo sapiens
ctggcatgaccatcctgtcct

SEQ ID NO: 4214898 - DNA, 20 bp, Homo sapiens
ctgggcccgctttgcctgct

SEQ ID NO: 4214899 - DNA, 16 bp, Homo sapiens
ctggtcaggcccactg

SEQ ID NO: 4214900 - DNA, 17 bp, Homo sapiens
ctggtcaggcccactgc

SEQ ID NO: 4214901 - DNA, 22 bp, Homo sapiens
ctggtcaggcccactgcagaga

SEQ ID NO: 4214902 - DNA, 15 bp, Homo sapiens
ctggtctccctccag

SEQ ID NO: 4214903 - DNA, 20 bp, Homo sapiens
ctggtctccctccagctgga

SEQ ID NO: 4214904 - DNA, 21 bp, Homo sapiens
ctggtggccatgtcgcctgcc

SEQ ID NO: 4214905 - DNA, 16 bp, Homo sapiens
ctgtaacttccaaata

SEQ ID NO: 4214906 - DNA, 19 bp, Homo sapiens
ctgtaacttccaaataaat

SEQ ID NO: 4214907 - DNA, 20 bp, Homo sapiens
ctgtaacttccaaataaata

SEQ ID NO: 4214908 - DNA, 14 bp, Homo sapiens
ctgtaatcccagct

SEQ ID NO: 4214909 - DNA, 20 bp, Homo sapiens
ctgtaatcccagctacacct

SEQ ID NO: 4214910 - DNA, 16 bp, Homo sapiens
ctgtacttattttcca

SEQ ID NO: 4214911 - DNA, 21 bp, Homo sapiens
ctgtcctattatattcattct

SEQ ID NO: 4214912 - DNA, 13 bp, Homo sapiens
ctgtcctccagct

SEQ ID NO: 4214913 - DNA, 13 bp, Homo sapiens
ctgtcctgctgtg

SEQ ID NO: 4214914 - DNA, 13 bp, Homo sapiens
ctgtctctgctct

SEQ ID NO: 4214915 - DNA, 19 bp, Homo sapiens
ctgtctctgctcttgcctg

SEQ ID NO: 4214916 - DNA, 12 bp, Homo sapiens
ctgtctctgtcc

SEQ ID NO: 4214917 - DNA, 19 bp, Homo sapiens
ctgtctctgtccctcactg

SEQ ID NO: 4214918 - DNA, 19 bp, Homo sapiens
ctgtcttatggcgttgcag

SEQ ID NO: 4214919 - DNA, 20 bp, Homo sapiens
ctgtgaacaagcttcagtaa

SEQ ID NO: 4214920 - DNA, 21 bp, Homo sapiens
ctgtgaacaagcttcagtaag

SEQ ID NO: 4214921 - DNA, 14 bp, Homo sapiens
ctgtggtggctgtc

SEQ ID NO: 4214922 - DNA, 18 bp, Homo sapiens
ctgtggtggctgtctctg

SEQ ID NO: 4214923 - DNA, 17 bp, Homo sapiens
ctgtgtgaattcccagg

SEQ ID NO: 4214924 - DNA, 13 bp, Homo sapiens
ctgttctggagct

SEQ ID NO: 4214925 - DNA, 21 bp, Homo sapiens
ctgttctggagctgctgttcc

SEQ ID NO: 4214926 - DNA, 21 bp, Homo sapiens
ctgtttatataattttgcagc

SEQ ID NO: 4214927 - DNA, 18 bp, Homo sapiens
cttaaattttaaagcctg

SEQ ID NO: 4214928 - DNA, 14 bp, Homo sapiens
cttaatgctttcct

SEQ ID NO: 4214929 - DNA, 16 bp, Homo sapiens
cttaatgctttcctcc

SEQ ID NO: 4214930 - DNA, 13 bp, Homo sapiens
cttactaaaaagt

SEQ ID NO: 4214931 - DNA, 17 bp, Homo sapiens
cttactaaaaagtataa

SEQ ID NO: 4214932 - DNA, 21 bp, Homo sapiens
cttagttaagtcatccacagc

SEQ ID NO: 4214933 - DNA, 15 bp, Homo sapiens
cttatgaacagatat

SEQ ID NO: 4214934 - DNA, 21 bp, Homo sapiens
cttattaagagcaaactttag

SEQ ID NO: 4214935 - DNA, 18 bp, Homo sapiens
cttatttaatttttgcaa

SEQ ID NO: 4214936 - DNA, 14 bp, Homo sapiens
cttattttccaata

SEQ ID NO: 4214937 - DNA, 16 bp, Homo sapiens
cttattttccaataaa

SEQ ID NO: 4214938 - DNA, 17 bp, Homo sapiens
cttattttccaataaaa

SEQ ID NO: 4214939 - DNA, 18 bp, Homo sapiens
cttcaaatgatccttcct

SEQ ID NO: 4214940 - DNA, 19 bp, Homo sapiens
cttcactccaaagagaaac

SEQ ID NO: 4214941 - DNA, 15 bp, Homo sapiens
cttccatttcttcca

SEQ ID NO: 4214942 - DNA, 18 bp, Homo sapiens
cttccatttcttccacga

SEQ ID NO: 4214943 - DNA, 22 bp, Homo sapiens
cttcccatgatgccgctcttct

SEQ ID NO: 4214944 - DNA, 18 bp, Homo sapiens
cttcccctcgctgtcctg

SEQ ID NO: 4214945 - DNA, 20 bp, Homo sapiens
cttcccctcgctgtcctgct

SEQ ID NO: 4214946 - DNA, 18 bp, Homo sapiens
cttcctaagttcccttct

SEQ ID NO: 4214947 - DNA, 18 bp, Homo sapiens
cttcctcctcctttgcct

SEQ ID NO: 4214948 - DNA, 20 bp, Homo sapiens
cttctaaatgttggaatttt

SEQ ID NO: 4214949 - DNA, 19 bp, Homo sapiens
cttctagtctggtgttctg

SEQ ID NO: 4214950 - DNA, 17 bp, Homo sapiens
cttctatatcctcaagg

SEQ ID NO: 4214951 - DNA, 22 bp, Homo sapiens
cttctatttatttatttattca

SEQ ID NO: 4214952 - DNA, 14 bp, Homo sapiens
cttctctctctggt

SEQ ID NO: 4214953 - DNA, 16 bp, Homo sapiens
cttctctctctggtca

SEQ ID NO: 4214954 - DNA, 22 bp, Homo sapiens
cttcttaatgctttcctccctg

SEQ ID NO: 4214955 - DNA, 20 bp, Homo sapiens
cttctttgcacttttgaaat

SEQ ID NO: 4214956 - DNA, 16 bp, Homo sapiens
cttgaaggaacagtgc

SEQ ID NO: 4214957 - DNA, 22 bp, Homo sapiens
cttgaaggaacagtgctgttct

SEQ ID NO: 4214958 - DNA, 23 bp, Homo sapiens
cttgaaggaacagtgctgttctg

SEQ ID NO: 4214959 - DNA, 19 bp, Homo sapiens
cttgagcctccatttctgg

SEQ ID NO: 4214960 - DNA, 15 bp, Homo sapiens
cttgcctttccacct

SEQ ID NO: 4214961 - DNA, 17 bp, Homo sapiens
cttgcctttccacctgc

SEQ ID NO: 4214962 - DNA, 21 bp, Homo sapiens
cttgcctttcttatttgcaat

SEQ ID NO: 4214963 - DNA, 16 bp, Homo sapiens
cttggacattttatgt

SEQ ID NO: 4214964 - DNA, 19 bp, Homo sapiens
cttggacattttatgtctt

SEQ ID NO: 4214965 - DNA, 22 bp, Homo sapiens
cttggatatataggctattttc

SEQ ID NO: 4214966 - DNA, 18 bp, Homo sapiens
cttggcacttattgaata

SEQ ID NO: 4214967 - DNA, 21 bp, Homo sapiens
cttggttcttcctagtgccta

SEQ ID NO: 4214968 - DNA, 21 bp, Homo sapiens
cttgtatagcatgaaataaaa

SEQ ID NO: 4214969 - DNA, 21 bp, Homo sapiens
ctttaatataataaaagttat

SEQ ID NO: 4214970 - DNA, 18 bp, Homo sapiens
ctttaggtgcctcctgtc

SEQ ID NO: 4214971 - DNA, 21 bp, Homo sapiens
ctttaggtgcctcctgtctta

SEQ ID NO: 4214972 - DNA, 13 bp, Homo sapiens
ctttccacctgct

SEQ ID NO: 4214973 - DNA, 14 bp, Homo sapiens
ctttccacctgctt

SEQ ID NO: 4214974 - DNA, 14 bp, Homo sapiens
ctttccatctgctt

SEQ ID NO: 4214975 - DNA, 23 bp, Homo sapiens
ctttcccaccagcatgtcactcc

SEQ ID NO: 4214976 - DNA, 23 bp, Homo sapiens
ctttgcatattataaaggataaa

SEQ ID NO: 4214977 - DNA, 11 bp, Homo sapiens
ctttgcctgct

SEQ ID NO: 4214978 - DNA, 19 bp, Homo sapiens
ctttgttattatcctgcat

SEQ ID NO: 4214979 - DNA, 21 bp, Homo sapiens
ctttgttattatcctgcattt

SEQ ID NO: 4214980 - DNA, 15 bp, Homo sapiens
cttttaatgccttcc

SEQ ID NO: 4214981 - DNA, 18 bp, Homo sapiens
ctttttaaaaattgttat

SEQ ID NO: 4214982 - DNA, 18 bp, Homo sapiens
ctttttcataaattattt

SEQ ID NO: 4214983 - DNA, 22 bp, Homo sapiens
gaaaaggcatggagacagcgaa

SEQ ID NO: 4214984 - DNA, 23 bp, Homo sapiens
gaaaagtttagtgtttctttatc

SEQ ID NO: 4214985 - DNA, 23 bp, Homo sapiens
gaaaatgctgtattagtcacaga

SEQ ID NO: 4214986 - DNA, 17 bp, Homo sapiens
gaaaatgtctgtaataa

SEQ ID NO: 4214987 - DNA, 22 bp, Homo sapiens
gaaaatgtctgtaataatagac

SEQ ID NO: 4214988 - DNA, 18 bp, Homo sapiens
gaaagaagtggggacaga

SEQ ID NO: 4214989 - DNA, 16 bp, Homo sapiens
gaaagagatacagagg

SEQ ID NO: 4214990 - DNA, 17 bp, Homo sapiens
gaaagggcaagaaggaa

SEQ ID NO: 4214991 - DNA, 23 bp, Homo sapiens
gaaatgtgatttgtcttcccttc

SEQ ID NO: 4214992 - DNA, 16 bp, Homo sapiens
gaaattggaagagcac

SEQ ID NO: 4214993 - DNA, 22 bp, Homo sapiens
gaacaccaacttttatttggaa

SEQ ID NO: 4214994 - DNA, 17 bp, Homo sapiens
gaaccatccttcccatg

SEQ ID NO: 4214995 - DNA, 12 bp, Homo sapiens
gaacccaatttt

SEQ ID NO: 4214996 - DNA, 20 bp, Homo sapiens
gaactattgtgctcagagac

SEQ ID NO: 4214997 - DNA, 15 bp, Homo sapiens
gaactcctaaatcaa

SEQ ID NO: 4214998 - DNA, 17 bp, Homo sapiens
gaagaaatgacattttg

SEQ ID NO: 4214999 - DNA, 19 bp, Homo sapiens
gaagaatgttagagtaatg

SEQ ID NO: 4215000 - DNA, 17 bp, Homo sapiens
gaagatcttctgcagaa

SEQ ID NO: 4215001 - DNA, 21 bp, Homo sapiens
gaagatcttttaaaaaggcag

SEQ ID NO: 4215002 - DNA, 23 bp, Homo sapiens
gaagatcttttaaaaaggcagta

SEQ ID NO: 4215003 - DNA, 23 bp, Homo sapiens
gaagattctatgttaatatttta

SEQ ID NO: 4215004 - DNA, 18 bp, Homo sapiens
gaagcccatggagcaggg

SEQ ID NO: 4215005 - DNA, 17 bp, Homo sapiens
gaagtcttctatttatt

SEQ ID NO: 4215006 - DNA, 15 bp, Homo sapiens
gaagtggggacagag

SEQ ID NO: 4215007 - DNA, 16 bp, Homo sapiens
gaagttgccaagagtt

SEQ ID NO: 4215008 - DNA, 13 bp, Homo sapiens
gaatgaaaagttt

SEQ ID NO: 4215009 - DNA, 14 bp, Homo sapiens
gaatggcagctgga

SEQ ID NO: 4215010 - DNA, 21 bp, Homo sapiens
gaatgtaattttgaactgttt

SEQ ID NO: 4215011 - DNA, 19 bp, Homo sapiens
gaattctgtttaattttca

SEQ ID NO: 4215012 - DNA, 20 bp, Homo sapiens
cctaagaggcgacttcctct

SEQ ID NO: 4215013 - DNA, 13 bp, Homo sapiens
cctactttgcttc

SEQ ID NO: 4215014 - DNA, 18 bp, Homo sapiens
cctattaagtcatcatct

SEQ ID NO: 4215015 - DNA, 14 bp, Homo sapiens
cctcactgccttcc

SEQ ID NO: 4215016 - DNA, 18 bp, Homo sapiens
cctcagaccaggtggaat

SEQ ID NO: 4215017 - DNA, 22 bp, Homo sapiens
cctccaattccacagtctctgg

SEQ ID NO: 4215018 - DNA, 15 bp, Homo sapiens
cctccagctggaatt

SEQ ID NO: 4215019 - DNA, 21 bp, Homo sapiens
cctccagctggaattgctgct

SEQ ID NO: 4215020 - DNA, 22 bp, Homo sapiens
cctccagctggaattgctgctc

SEQ ID NO: 4215021 - DNA, 22 bp, Homo sapiens
cctcctgggttcacaccattct

SEQ ID NO: 4215022 - DNA, 19 bp, Homo sapiens
cctcctttgcctaggaggc

SEQ ID NO: 4215023 - DNA, 13 bp, Homo sapiens
cctcgctgtcctg

SEQ ID NO: 4215024 - DNA, 19 bp, Homo sapiens
cctcgctgtcctgctgtgt

SEQ ID NO: 4215025 - DNA, 13 bp, Homo sapiens
cctctcttgcctt

SEQ ID NO: 4215026 - DNA, 13 bp, Homo sapiens
cctctctttctaa

SEQ ID NO: 4215027 - DNA, 23 bp, Homo sapiens
cctctctttctaagagacctgaa

SEQ ID NO: 4215028 - DNA, 14 bp, Homo sapiens
cctctgtctctgct

SEQ ID NO: 4215029 - DNA, 22 bp, Homo sapiens
cctctgtctctgctcttgcctg

SEQ ID NO: 4215030 - DNA, 15 bp, Homo sapiens
cctgaaaattccaat

SEQ ID NO: 4215031 - DNA, 13 bp, Homo sapiens
cctgaagagcatt

SEQ ID NO: 4215032 - DNA, 17 bp, Homo sapiens
cctgcacccttcctcct

SEQ ID NO: 4215033 - DNA, 23 bp, Homo sapiens
cctgcccccagcactcctctgtc

SEQ ID NO: 4215034 - DNA, 21 bp, Homo sapiens
cctgctcttccatttcttcca

SEQ ID NO: 4215035 - DNA, 18 bp, Homo sapiens
cctgcttgaaggaacagt

SEQ ID NO: 4215036 - DNA, 22 bp, Homo sapiens
cctgcttgaaggaacagtgctg

SEQ ID NO: 4215037 - DNA, 20 bp, Homo sapiens
cctggaaggacatccatgtt

SEQ ID NO: 4215038 - DNA, 20 bp, Homo sapiens
cctggagcggctctcctgag

SEQ ID NO: 4215039 - DNA, 22 bp, Homo sapiens
cctggcatgaccatcctgtcct

SEQ ID NO: 4215040 - DNA, 21 bp, Homo sapiens
cctgggcccgctttgcctgct

SEQ ID NO: 4215041 - DNA, 21 bp, Homo sapiens
cctgtaatcccagctacacct

SEQ ID NO: 4215042 - DNA, 17 bp, Homo sapiens
cctgtagagtcactgac

SEQ ID NO: 4215043 - DNA, 17 bp, Homo sapiens
cctgtcctttgttatta

SEQ ID NO: 4215044 - DNA, 20 bp, Homo sapiens
ccttgcacagcccacacatg

SEQ ID NO: 4215045 - DNA, 16 bp, Homo sapiens
ccttggacattttatg

SEQ ID NO: 4215046 - DNA, 20 bp, Homo sapiens
ccttgtctggggaccctgta

SEQ ID NO: 4215047 - DNA, 13 bp, Homo sapiens
ccttgtttaatgg

SEQ ID NO: 4215048 - DNA, 18 bp, Homo sapiens
cctttccacctgctttct

SEQ ID NO: 4215049 - DNA, 15 bp, Homo sapiens
cgaaatatcaaagtc

SEQ ID NO: 4215050 - DNA, 14 bp, Homo sapiens
cgaactagaagaaa

SEQ ID NO: 4215051 - DNA, 16 bp, Homo sapiens
cgacaaaatctaatgt

SEQ ID NO: 4215052 - DNA, 16 bp, Homo sapiens
cgatgcactttggaag

SEQ ID NO: 4215053 - DNA, 11 bp, Homo sapiens
cgatggtgcag

SEQ ID NO: 4215054 - DNA, 13 bp, Homo sapiens
cgcattttctcta

SEQ ID NO: 4215055 - DNA, 15 bp, Homo sapiens
cgcattttctctagc

SEQ ID NO: 4215056 - DNA, 16 bp, Homo sapiens
cgcattttctctagct

SEQ ID NO: 4215057 - DNA, 21 bp, Homo sapiens
cgcctgcccccagcactcctc

SEQ ID NO: 4215058 - DNA, 23 bp, Homo sapiens
cgcctgcccccagcactcctctg

SEQ ID NO: 4215059 - DNA, 13 bp, Homo sapiens
cgctttgcctgct

SEQ ID NO: 4215060 - DNA, 14 bp, Homo sapiens
cggctctcctgaga

SEQ ID NO: 4215061 - DNA, 13 bp, Homo sapiens
cgtctttggagga

SEQ ID NO: 4215062 - DNA, 13 bp, Homo sapiens
cgtgggtggagga

SEQ ID NO: 4215063 - DNA, 14 bp, Homo sapiens
cgttaccaggcagg

SEQ ID NO: 4215064 - DNA, 13 bp, Homo sapiens
ctaaaaagtataa

SEQ ID NO: 4215065 - DNA, 19 bp, Homo sapiens
ctaaaacaaaacaaaaaac

SEQ ID NO: 4215066 - DNA, 18 bp, Homo sapiens
ctaaatgttggaattttc

SEQ ID NO: 4215067 - DNA, 11 bp, Homo sapiens
ctaagagacct

SEQ ID NO: 4215068 - DNA, 24 bp, Homo sapiens
ctaagaggcgacttcctctccagc

SEQ ID NO: 4215069 - DNA, 22 bp, Homo sapiens
ctaatgaatgcataaaatgtta

SEQ ID NO: 4215070 - DNA, 17 bp, Homo sapiens
ctacaatgggaaaactt

SEQ ID NO: 4215071 - DNA, 21 bp, Homo sapiens
ctacaatgggaaaacttcact

SEQ ID NO: 4215072 - DNA, 16 bp, Homo sapiens
ctacagccagaagccc

SEQ ID NO: 4215073 - DNA, 20 bp, Homo sapiens
ctacagccagaagcccatgg

SEQ ID NO: 4215074 - DNA, 19 bp, Homo sapiens
ctactaaaaatacaaaaat

SEQ ID NO: 4215075 - DNA, 20 bp, Homo sapiens
ctactaattgagccatttaa

SEQ ID NO: 4215076 - DNA, 18 bp, Homo sapiens
ctagactcccaagctgga

SEQ ID NO: 4215077 - DNA, 19 bp, Homo sapiens
ctagcctggcaacagagca

SEQ ID NO: 4215078 - DNA, 14 bp, Homo sapiens
ctagctaattattt

SEQ ID NO: 4215079 - DNA, 15 bp, Homo sapiens
ctagctaattattta

SEQ ID NO: 4215080 - DNA, 16 bp, Homo sapiens
ctagctaattatttaa

SEQ ID NO: 4215081 - DNA, 18 bp, Homo sapiens
ctaggaggccttctcgca

SEQ ID NO: 4215082 - DNA, 19 bp, Homo sapiens
ctagtctggtgttctgagt

SEQ ID NO: 4215083 - DNA, 16 bp, Homo sapiens
ctagtggcttcctccg

SEQ ID NO: 4215084 - DNA, 23 bp, Homo sapiens
ctagttccccgtgaacttccttt

SEQ ID NO: 4215085 - DNA, 16 bp, Homo sapiens
ctatattcctttttct

SEQ ID NO: 4215086 - DNA, 18 bp, Homo sapiens
ctatattcctttttctat

SEQ ID NO: 4215087 - DNA, 23 bp, Homo sapiens
ctattaagtcatcatctccaaac

SEQ ID NO: 4215088 - DNA, 12 bp, Homo sapiens
ctatttatttat

SEQ ID NO: 4215089 - DNA, 23 bp, Homo sapiens
ctcacaagtaacagttgaagaaa

SEQ ID NO: 4215090 - DNA, 14 bp, Homo sapiens
ctcactccacactg

SEQ ID NO: 4215091 - DNA, 14 bp, Homo sapiens
ctcactgccttcca

SEQ ID NO: 4215092 - DNA, 15 bp, Homo sapiens
ctcactgccttccag

SEQ ID NO: 4215093 - DNA, 22 bp, Homo sapiens
ctcagaccaggtggaattactt

SEQ ID NO: 4215094 - DNA, 13 bp, Homo sapiens
ctcatataagaca

SEQ ID NO: 4215095 - DNA, 17 bp, Homo sapiens
ctcatgttgaaacttta

SEQ ID NO: 4215096 - DNA, 18 bp, Homo sapiens
ctccacctgttcaggagc

SEQ ID NO: 4215097 - DNA, 19 bp, Homo sapiens
ctccacctgttcaggagct

SEQ ID NO: 4215098 - DNA, 20 bp, Homo sapiens
ctccatcgctgtcatctcag

SEQ ID NO: 4215099 - DNA, 17 bp, Homo sapiens
ctccatttctggcttct

SEQ ID NO: 4215100 - DNA, 22 bp, Homo sapiens
ctccctagtggcttcctccgtc

SEQ ID NO: 4215101 - DNA, 23 bp, Homo sapiens
ctccctggcatgaccatcctgtc

SEQ ID NO: 4215102 - DNA, 23 bp, Homo sapiens
ctcctgggcccgctttgcctgct

SEQ ID NO: 4215103 - DNA, 14 bp, Homo sapiens
ctcctgtcttatgg

SEQ ID NO: 4215104 - DNA, 17 bp, Homo sapiens
ctcgctgtcctgctgtg

SEQ ID NO: 4215105 - DNA, 21 bp, Homo sapiens
ctctcctgagaggtgctgcag

SEQ ID NO: 4215106 - DNA, 18 bp, Homo sapiens
ctctctgagggagaggct

SEQ ID NO: 4215107 - DNA, 16 bp, Homo sapiens
ctctgactcttgcctt

SEQ ID NO: 4215108 - DNA, 17 bp, Homo sapiens
ctctgactcttgccttt

SEQ ID NO: 4215109 - DNA, 14 bp, Homo sapiens
ctctgggagacttt

SEQ ID NO: 4215110 - DNA, 18 bp, Homo sapiens
ctctgtccctcactgcct

SEQ ID NO: 4215111 - DNA, 21 bp, Homo sapiens
ctctgtccctcactgccttcc

SEQ ID NO: 4215112 - DNA, 18 bp, Homo sapiens
ctcttccatttcttccac

SEQ ID NO: 4215113 - DNA, 15 bp, Homo sapiens
ctcttgcctgcaccc

SEQ ID NO: 4215114 - DNA, 22 bp, Homo sapiens
ctcttttcctttggtccttcaa

SEQ ID NO: 4215115 - DNA, 23 bp, Homo sapiens
ctgaagacaccgttcattcaggc

SEQ ID NO: 4215116 - DNA, 15 bp, Homo sapiens
ctgaagcccatgctt

SEQ ID NO: 4215117 - DNA, 17 bp, Homo sapiens
ctgaagcccatgctttc

SEQ ID NO: 4215118 - DNA, 12 bp, Homo sapiens
ctgactcttgcc

SEQ ID NO: 4215119 - DNA, 13 bp, Homo sapiens
ctgacttctcact

SEQ ID NO: 4215120 - DNA, 22 bp, Homo sapiens
ctgaggatattcagatgtatgt

SEQ ID NO: 4215121 - DNA, 14 bp, Homo sapiens
ctgaggtcacctgg

SEQ ID NO: 4215122 - DNA, 18 bp, Homo sapiens
ctgatcagaattttacca

SEQ ID NO: 4215123 - DNA, 18 bp, Homo sapiens
ctgcaacttgtaaatgtg

SEQ ID NO: 4215124 - DNA, 15 bp, Homo sapiens
ctgcactctagcctg

SEQ ID NO: 4215125 - DNA, 18 bp, Homo sapiens
ctgcactctagcctggca

SEQ ID NO: 4215126 - DNA, 23 bp, Homo sapiens
ctgcactctagcctggcaacaga

SEQ ID NO: 4215127 - DNA, 12 bp, Homo sapiens
ctgcattttacg

SEQ ID NO: 4215128 - DNA, 14 bp, Homo sapiens
ctgctcttgcctgc

SEQ ID NO: 4215129 - DNA, 15 bp, Homo sapiens
ctgctcttgcctgca

SEQ ID NO: 4215130 - DNA, 17 bp, Homo sapiens
ctgctcttgcctgcacc

SEQ ID NO: 4215131 - DNA, 17 bp, Homo sapiens
ctgctgaaacacctccc

SEQ ID NO: 4215132 - DNA, 19 bp, Homo sapiens
ctgctgaaacacctcccag

SEQ ID NO: 4215133 - DNA, 19 bp, Homo sapiens
ctgctgtgtgaattcccag

SEQ ID NO: 4215134 - DNA, 12 bp, Homo sapiens
aaaaagagacat

SEQ ID NO: 4215135 - DNA, 15 bp, Homo sapiens
aaaaatcccaaattc

SEQ ID NO: 4215136 - DNA, 22 bp, Homo sapiens
aaaaattgtgtttagattttat

SEQ ID NO: 4215137 - DNA, 21 bp, Homo sapiens
aaaacattccccaattatctt

SEQ ID NO: 4215138 - DNA, 18 bp, Homo sapiens
aaaacttcactccaaaga

SEQ ID NO: 4215139 - DNA, 16 bp, Homo sapiens
aaaagtataaaatagt

SEQ ID NO: 4215140 - DNA, 14 bp, Homo sapiens
aaaagtgcaaagtt

SEQ ID NO: 4215141 - DNA, 17 bp, Homo sapiens
aaaatcccccagcactt

SEQ ID NO: 4215142 - DNA, 21 bp, Homo sapiens
aaaatgaaagccaaatttata

SEQ ID NO: 4215143 - DNA, 12 bp, Homo sapiens
aaaattttcaaa

SEQ ID NO: 4215144 - DNA, 16 bp, Homo sapiens
aaaattttcaaacttt

SEQ ID NO: 4215145 - DNA, 16 bp, Homo sapiens
aaaccctattggtaaa

SEQ ID NO: 4215146 - DNA, 22 bp, Homo sapiens
aaacctattaagtcatcatctc

SEQ ID NO: 4215147 - DNA, 19 bp, Homo sapiens
aaacttcactccaaagaga

SEQ ID NO: 4215148 - DNA, 16 bp, Homo sapiens
aaacttctaaatgttg

SEQ ID NO: 4215149 - DNA, 17 bp, Homo sapiens
aaagaatggaaggtgga

SEQ ID NO: 4215150 - DNA, 13 bp, Homo sapiens
aaagagaaaccta

SEQ ID NO: 4215151 - DNA, 14 bp, Homo sapiens
aaagagatacagag

SEQ ID NO: 4215152 - DNA, 12 bp, Homo sapiens
aaagccaaattt

SEQ ID NO: 4215153 - DNA, 16 bp, Homo sapiens
aaaggaaaatgtctgt

SEQ ID NO: 4215154 - DNA, 13 bp, Homo sapiens
aaagggcaataaa

SEQ ID NO: 4215155 - DNA, 23 bp, Homo sapiens
aaaggtattgagccattttttaa

SEQ ID NO: 4215156 - DNA, 11 bp, Homo sapiens
aaataaataat

SEQ ID NO: 4215157 - DNA, 14 bp, Homo sapiens
aaataaataatttt

SEQ ID NO: 4215158 - DNA, 18 bp, Homo sapiens
aaatagaatgaaaagttt

SEQ ID NO: 4215159 - DNA, 16 bp, Homo sapiens
aaatagtatgaaaatg

SEQ ID NO: 4215160 - DNA, 19 bp, Homo sapiens
aaatagtatgaaaatggaa

SEQ ID NO: 4215161 - DNA, 23 bp, Homo sapiens
aaatatatttttttcaactgcca

SEQ ID NO: 4215162 - DNA, 14 bp, Homo sapiens
aaatatcaaagtca

SEQ ID NO: 4215163 - DNA, 22 bp, Homo sapiens
aaatatcccttggacattttat

SEQ ID NO: 4215164 - DNA, 15 bp, Homo sapiens
aaatcctgaagagca

SEQ ID NO: 4215165 - DNA, 15 bp, Homo sapiens
aaatgacattttgct

SEQ ID NO: 4215166 - DNA, 21 bp, Homo sapiens
aaatgatccttcctactttgc

SEQ ID NO: 4215167 - DNA, 18 bp, Homo sapiens
aaatgattggtaggaaat

SEQ ID NO: 4215168 - DNA, 15 bp, Homo sapiens
aaatgatttcacagt

SEQ ID NO: 4215169 - DNA, 23 bp, Homo sapiens
aaatggaggatctctaaagagca

SEQ ID NO: 4215170 - DNA, 13 bp, Homo sapiens
aaatggcaagaga

SEQ ID NO: 4215171 - DNA, 15 bp, Homo sapiens
aaatggcaagagatc

SEQ ID NO: 4215172 - DNA, 18 bp, Homo sapiens
aaatgtctgtaataatag

SEQ ID NO: 4215173 - DNA, 19 bp, Homo sapiens
aaatgtgatttgtcttccc

SEQ ID NO: 4215174 - DNA, 23 bp, Homo sapiens
aaatgtgatttgtcttcccttct

SEQ ID NO: 4215175 - DNA, 20 bp, Homo sapiens
aaatgttaagttgatggtga

SEQ ID NO: 4215176 - DNA, 13 bp, Homo sapiens
aaattaaagctga

SEQ ID NO: 4215177 - DNA, 13 bp, Homo sapiens
aaattccaaactt

SEQ ID NO: 4215178 - DNA, 13 bp, Homo sapiens
aaattgcaatatg

SEQ ID NO: 4215179 - DNA, 19 bp, Homo sapiens
aaattgtgtttagatttta

SEQ ID NO: 4215180 - DNA, 19 bp, Homo sapiens
aaattgttatcaaaatagt

SEQ ID NO: 4215181 - DNA, 19 bp, Homo sapiens
aaatttttttttaaagcag

SEQ ID NO: 4215182 - DNA, 14 bp, Homo sapiens
aacaagcttcagta

SEQ ID NO: 4215183 - DNA, 14 bp, Homo sapiens
aacacagatcaagt

SEQ ID NO: 4215184 - DNA, 13 bp, Homo sapiens
aacacctcccagg

SEQ ID NO: 4215185 - DNA, 12 bp, Homo sapiens
aacatagattta

SEQ ID NO: 4215186 - DNA, 19 bp, Homo sapiens
aacatcctccaattccaca

SEQ ID NO: 4215187 - DNA, 17 bp, Homo sapiens
aacattggagacatcac

SEQ ID NO: 4215188 - DNA, 19 bp, Homo sapiens
aacatttcttaaaatgttt

SEQ ID NO: 4215189 - DNA, 16 bp, Homo sapiens
aaccaaaggaaaatgt

SEQ ID NO: 4215190 - DNA, 16 bp, Homo sapiens
aaccacattgaagaat

SEQ ID NO: 4215191 - DNA, 13 bp, Homo sapiens
aacccaatagttg

SEQ ID NO: 4215192 - DNA, 15 bp, Homo sapiens
aaccctattggtaaa

SEQ ID NO: 4215193 - DNA, 19 bp, Homo sapiens
aacgcgacttccacaaacc

SEQ ID NO: 4215194 - DNA, 15 bp, Homo sapiens
aactatgttgataaa

SEQ ID NO: 4215195 - DNA, 24 bp, Homo sapiens
aactattgtgctcagagacactgt

SEQ ID NO: 4215196 - DNA, 18 bp, Homo sapiens
aactcaggcaaagaaaat

SEQ ID NO: 4215197 - DNA, 13 bp, Homo sapiens
aactggtttagca

SEQ ID NO: 4215198 - DNA, 23 bp, Homo sapiens
aactggtttagcacaatttatat

SEQ ID NO: 4215199 - DNA, 13 bp, Homo sapiens
aactgtttaacac

SEQ ID NO: 4215200 - DNA, 16 bp, Homo sapiens
aacttcactccaaaga

SEQ ID NO: 4215201 - DNA, 21 bp, Homo sapiens
aacttcactccaaagagaaac

SEQ ID NO: 4215202 - DNA, 13 bp, Homo sapiens
aacttcatataac

SEQ ID NO: 4215203 - DNA, 21 bp, Homo sapiens
aactttaagaactaaaatgtt

SEQ ID NO: 4215204 - DNA, 18 bp, Homo sapiens
aacttttaatgccttcca

SEQ ID NO: 4215205 - DNA, 21 bp, Homo sapiens
aacttttttttacttatatat

SEQ ID NO: 4215206 - DNA, 21 bp, Homo sapiens
aagaaaaaatggcaagagatc

SEQ ID NO: 4215207 - DNA, 16 bp, Homo sapiens
aagaaaatgaaatgca

SEQ ID NO: 4215208 - DNA, 14 bp, Homo sapiens
aagaaggatgatgt

SEQ ID NO: 4215209 - DNA, 23 bp, Homo sapiens
aagaaggtttcagaaagaagtgg

SEQ ID NO: 4215210 - DNA, 18 bp, Homo sapiens
aagacaccgttcattcag

SEQ ID NO: 4215211 - DNA, 14 bp, Homo sapiens
aagagcatctgatt

SEQ ID NO: 4215212 - DNA, 22 bp, Homo sapiens
aagagttctttaggtgcctcct

SEQ ID NO: 4215213 - DNA, 12 bp, Homo sapiens
aagatcttttaa

SEQ ID NO: 4215214 - DNA, 19 bp, Homo sapiens
aagattctatgttaatatt

SEQ ID NO: 4215215 - DNA, 18 bp, Homo sapiens
aagcaagccaatttggaa

SEQ ID NO: 4215216 - DNA, 13 bp, Homo sapiens
aagcaatggttga

SEQ ID NO: 4215217 - DNA, 15 bp, Homo sapiens
aagccaaatttatat

SEQ ID NO: 4215218 - DNA, 21 bp, Homo sapiens
aagccaaatttatatgccacc

SEQ ID NO: 4215219 - DNA, 15 bp, Homo sapiens
aagccaaattttttg

SEQ ID NO: 4215220 - DNA, 21 bp, Homo sapiens
aagcccatggagcagggatgt

SEQ ID NO: 4215221 - DNA, 12 bp, Homo sapiens
aagcctgaaaat

SEQ ID NO: 4215222 - DNA, 19 bp, Homo sapiens
aaggaacagtgctgttctg

SEQ ID NO: 4215223 - DNA, 13 bp, Homo sapiens
aaggagttttttt

SEQ ID NO: 4215224 - DNA, 18 bp, Homo sapiens
aaggcaggggaatgtatg

SEQ ID NO: 4215225 - DNA, 15 bp, Homo sapiens
aagggattctccagg

SEQ ID NO: 4215226 - DNA, 13 bp, Homo sapiens
aagggcaataaat

SEQ ID NO: 4215227 - DNA, 21 bp, Homo sapiens
aagggcataaagtaaatacat

SEQ ID NO: 4215228 - DNA, 14 bp, Homo sapiens
aaggtagaatgttt

SEQ ID NO: 4215229 - DNA, 15 bp, Homo sapiens
aaggtatttacacat

SEQ ID NO: 4215230 - DNA, 13 bp, Homo sapiens
aagtaagcaaaga

SEQ ID NO: 4215231 - DNA, 20 bp, Homo sapiens
aagtctctgactcttgcctt

SEQ ID NO: 4215232 - DNA, 22 bp, Homo sapiens
aagtctctgactcttgcctttc

SEQ ID NO: 4215233 - DNA, 22 bp, Homo sapiens
aagtctgctctcatataagaca

SEQ ID NO: 4215234 - DNA, 23 bp, Homo sapiens
aagtgaacattacattgccattt

SEQ ID NO: 4215235 - DNA, 14 bp, Homo sapiens
aagtgacaaagtta

SEQ ID NO: 4215236 - DNA, 16 bp, Homo sapiens
aagtggaagtatgtat

SEQ ID NO: 4215237 - DNA, 15 bp, Homo sapiens
aagtggggacagagc

SEQ ID NO: 4215238 - DNA, 12 bp, Homo sapiens
aagtgttgaaga

SEQ ID NO: 4215239 - DNA, 19 bp, Homo sapiens
aagtgtttatgttgtttat

SEQ ID NO: 4215240 - DNA, 13 bp, Homo sapiens
aagttaaaattgt

SEQ ID NO: 4215241 - DNA, 23 bp, Homo sapiens
aagttaagaatgttcttatgttg

SEQ ID NO: 4215242 - DNA, 13 bp, Homo sapiens
aagttatctttga

SEQ ID NO: 4215243 - DNA, 14 bp, Homo sapiens
aagttatctttgaa

SEQ ID NO: 4215244 - DNA, 22 bp, Homo sapiens
aagttatctttgaatatgtagt

SEQ ID NO: 4215245 - DNA, 23 bp, Homo sapiens
aagttattccccatcttccaagg

SEQ ID NO: 4215246 - DNA, 18 bp, Homo sapiens
aagttgatggtgatgaaa

SEQ ID NO: 4215247 - DNA, 16 bp, Homo sapiens
aagttgccaagagttc

SEQ ID NO: 4215248 - DNA, 11 bp, Homo sapiens
aataaaaatat

SEQ ID NO: 4215249 - DNA, 12 bp, Homo sapiens
aataattttcct

SEQ ID NO: 4215250 - DNA, 14 bp, Homo sapiens
aatacttccagaag

SEQ ID NO: 4215251 - DNA, 15 bp, Homo sapiens
aatacttccagaagt

SEQ ID NO: 4215252 - DNA, 14 bp, Homo sapiens
aatagaatgaaaag

SEQ ID NO: 4215253 - DNA, 15 bp, Homo sapiens
aatagaatgaaaagt

SEQ ID NO: 4215254 - DNA, 20 bp, Homo sapiens
aatagattgtaatacacata

SEQ ID NO: 4215255 - DNA, 13 bp, Homo sapiens
aatagtagatgtg

SEQ ID NO: 4215256 - DNA, 22 bp, Homo sapiens
aatagtagatgtggcctttgaa

SEQ ID NO: 4215257 - DNA, 13 bp, Homo sapiens
aatagttaacaca

SEQ ID NO: 4215258 - DNA, 13 bp, Homo sapiens
aatataaaaataa

SEQ ID NO: 4215259 - DNA, 13 bp, Homo sapiens
aatataataaaag

SEQ ID NO: 4215260 - DNA, 15 bp, Homo sapiens
aatataataaaagtt

SEQ ID NO: 4215261 - DNA, 14 bp, Homo sapiens
aatatcaaagtcat

SEQ ID NO: 4215262 - DNA, 21 bp, Homo sapiens
aatatcaaagtcattaaagac

SEQ ID NO: 4215263 - DNA, 20 bp, Homo sapiens
aatatcccttggacatttta

SEQ ID NO: 4215264 - DNA, 21 bp, Homo sapiens
aatatcccttggacattttat

SEQ ID NO: 4215265 - DNA, 22 bp, Homo sapiens
aatatcccttggacattttatg

SEQ ID NO: 4215266 - DNA, 16 bp, Homo sapiens
aatatgtagtatctat

SEQ ID NO: 4215267 - DNA, 19 bp, Homo sapiens
aatattactggataaattg

SEQ ID NO: 4215268 - DNA, 20 bp, Homo sapiens
aatattcctttgcatattat

SEQ ID NO: 4215269 - DNA, 22 bp, Homo sapiens
aatcaatgctataactatgttg

SEQ ID NO: 4215270 - DNA, 17 bp, Homo sapiens
aatcattcttactaaaa

SEQ ID NO: 4215271 - DNA, 16 bp, Homo sapiens
aatctgacttctcact

SEQ ID NO: 4215272 - DNA, 17 bp, Homo sapiens
aatctgacttctcactt

SEQ ID NO: 4215273 - DNA, 24 bp, Homo sapiens
aatgattggtaggaaatagaatga

SEQ ID NO: 4215274 - DNA, 23 bp, Homo sapiens
aatgcatatttgcaaagtgtatt

SEQ ID NO: 4215275 - DNA, 23 bp, Homo sapiens
aatgctataactatgttgataaa

SEQ ID NO: 4215276 - DNA, 15 bp, Homo sapiens
aatggaaactttagg

SEQ ID NO: 4215277 - DNA, 19 bp, Homo sapiens
aatggaggatctctaaaga

SEQ ID NO: 4215278 - DNA, 18 bp, Homo sapiens
aatggcaagagatcatat

SEQ ID NO: 4215279 - DNA, 19 bp, Homo sapiens
aatgtctgtaataatagac

SEQ ID NO: 4215280 - DNA, 23 bp, Homo sapiens
aatgtctgtaataatagactgta

SEQ ID NO: 4215281 - DNA, 21 bp, Homo sapiens
aatgtgatttgtcttcccttc

SEQ ID NO: 4215282 - DNA, 13 bp, Homo sapiens
aatgttggaattt

SEQ ID NO: 4215283 - DNA, 20 bp, Homo sapiens
aatgtttatattagataacc

SEQ ID NO: 4215284 - DNA, 15 bp, Homo sapiens
aatgtttcattttca

SEQ ID NO: 4215285 - DNA, 21 bp, Homo sapiens
aatgtttcattttcattaaaa

SEQ ID NO: 4215286 - DNA, 22 bp, Homo sapiens
aatgtttgaactgccaagaaaa

SEQ ID NO: 4215287 - DNA, 16 bp, Homo sapiens
aattatcttatttaat

SEQ ID NO: 4215288 - DNA, 17 bp, Homo sapiens
aattcataaatctattc

SEQ ID NO: 4215289 - DNA, 17 bp, Homo sapiens
aattctggaggaagaag

SEQ ID NO: 4215290 - DNA, 12 bp, Homo sapiens
aattgctataaa

SEQ ID NO: 4215291 - DNA, 20 bp, Homo sapiens
aattgtaaacagaaattgca

SEQ ID NO: 4215292 - DNA, 21 bp, Homo sapiens
aatttctcacctgaaaatgtg

SEQ ID NO: 4215293 - DNA, 13 bp, Homo sapiens
aattttaaagcct

SEQ ID NO: 4215294 - DNA, 23 bp, Homo sapiens
aattttacaagggcataaagtaa

SEQ ID NO: 4215295 - DNA, 18 bp, Homo sapiens
aattttcacttttggcaa

SEQ ID NO: 4215296 - DNA, 21 bp, Homo sapiens
aattttcacttttggcaatga

SEQ ID NO: 4215297 - DNA, 19 bp, Homo sapiens
aattttcctcctaaacaaa

SEQ ID NO: 4215298 - DNA, 20 bp, Homo sapiens
aattttgaactgtttaacac

SEQ ID NO: 4215299 - DNA, 17 bp, Homo sapiens
aattttgtctattaaag

SEQ ID NO: 4215300 - DNA, 20 bp, Homo sapiens
aattttgtctattaaagata

SEQ ID NO: 4215301 - DNA, 14 bp, Homo sapiens
aatttttaaatgtt

SEQ ID NO: 4215302 - DNA, 19 bp, Homo sapiens
aatttttgcaattattcta

SEQ ID NO: 4215303 - DNA, 11 bp, Homo sapiens
acaaaagcaat

SEQ ID NO: 4215304 - DNA, 17 bp, Homo sapiens
acaaattgaaataaata

SEQ ID NO: 4215305 - DNA, 17 bp, Homo sapiens
acaaatttaattttgca

SEQ ID NO: 4215306 - DNA, 19 bp, Homo sapiens
acaaccctgaccgtgaccg

SEQ ID NO: 4215307 - DNA, 18 bp, Homo sapiens
acaactatgatttggaaa

SEQ ID NO: 4215308 - DNA, 16 bp, Homo sapiens
acaagcacagttttaa

SEQ ID NO: 4215309 - DNA, 19 bp, Homo sapiens
acaagtaacagttgaagaa

SEQ ID NO: 4215310 - DNA, 21 bp, Homo sapiens
acaagtagaatggcagctgga

SEQ ID NO: 4215311 - DNA, 15 bp, Homo sapiens
acaatggaaacttta

SEQ ID NO: 4215312 - DNA, 17 bp, Homo sapiens
acaatggaaactttagg

SEQ ID NO: 4215313 - DNA, 14 bp, Homo sapiens
acacagaaaccaat

SEQ ID NO: 4215314 - DNA, 22 bp, Homo sapiens
acacatgaaccatccttcccat

SEQ ID NO: 4215315 - DNA, 14 bp, Homo sapiens
acacattacaaagt

SEQ ID NO: 4215316 - DNA, 19 bp, Homo sapiens
acaccaaattccaaacttc

SEQ ID NO: 4215317 - DNA, 16 bp, Homo sapiens
acactaacgaaatatc

SEQ ID NO: 4215318 - DNA, 17 bp, Homo sapiens
acactctaagttctatt

SEQ ID NO: 4215319 - DNA, 19 bp, Homo sapiens
acactttttgttttttgct

SEQ ID NO: 4215320 - DNA, 13 bp, Homo sapiens
acagaaattgcaa

SEQ ID NO: 4215321 - DNA, 22 bp, Homo sapiens
acagacactaacgaaatatcaa

SEQ ID NO: 4215322 - DNA, 19 bp, Homo sapiens
acagacagggcctagcttt

SEQ ID NO: 4215323 - DNA, 16 bp, Homo sapiens
acagatggcttagtta

SEQ ID NO: 4215324 - DNA, 15 bp, Homo sapiens
acagcaattcctcag

SEQ ID NO: 4215325 - DNA, 17 bp, Homo sapiens
acagcgaactagaagaa

SEQ ID NO: 4215326 - DNA, 12 bp, Homo sapiens
acaggagggaga

SEQ ID NO: 4215327 - DNA, 14 bp, Homo sapiens
acaggagggagaga

SEQ ID NO: 4215328 - DNA, 19 bp, Homo sapiens
acaggagggagagaactta

SEQ ID NO: 4215329 - DNA, 20 bp, Homo sapiens
acaggctggagattttcaca

SEQ ID NO: 4215330 - DNA, 18 bp, Homo sapiens
acagtcctttaaattttg

SEQ ID NO: 4215331 - DNA, 16 bp, Homo sapiens
acagtgctgttctgga

SEQ ID NO: 4215332 - DNA, 14 bp, Homo sapiens
acataaaagaaata

SEQ ID NO: 4215333 - DNA, 15 bp, Homo sapiens
acataaaagaaataa

SEQ ID NO: 4215334 - DNA, 21 bp, Homo sapiens
acatctgggaggctggtctcc

SEQ ID NO: 4215335 - DNA, 13 bp, Homo sapiens
acatctgttttgt

SEQ ID NO: 4215336 - DNA, 18 bp, Homo sapiens
acatgcatataatgaata

SEQ ID NO: 4215337 - DNA, 23 bp, Homo sapiens
acatgcatataatgaataaatca

SEQ ID NO: 4215338 - DNA, 17 bp, Homo sapiens
acatggtctgtcaatga

SEQ ID NO: 4215339 - DNA, 17 bp, Homo sapiens
acatgtaacatagattt

SEQ ID NO: 4215340 - DNA, 21 bp, Homo sapiens
acatgtaacatagatttatgt

SEQ ID NO: 4215341 - DNA, 15 bp, Homo sapiens
acattaattagattt

SEQ ID NO: 4215342 - DNA, 12 bp, Homo sapiens
acattgaagaat

SEQ ID NO: 4215343 - DNA, 17 bp, Homo sapiens
acatttctcatgttgaa

SEQ ID NO: 4215344 - DNA, 15 bp, Homo sapiens
acattttatgtcttt

SEQ ID NO: 4215345 - DNA, 20 bp, Homo sapiens
accagcatgtcactcccaga

SEQ ID NO: 4215346 - DNA, 17 bp, Homo sapiens
acccaagtactttccaa

SEQ ID NO: 4215347 - DNA, 21 bp, Homo sapiens
accctggagcggctctcctga

SEQ ID NO: 4215348 - DNA, 13 bp, Homo sapiens
acccttcctcctc

SEQ ID NO: 4215349 - DNA, 18 bp, Homo sapiens
accgaattttattttaca

SEQ ID NO: 4215350 - DNA, 16 bp, Homo sapiens
accgtctacagatggc

SEQ ID NO: 4215351 - DNA, 16 bp, Homo sapiens
acctagctaattattt

SEQ ID NO: 4215352 - DNA, 15 bp, Homo sapiens
acctcactgaggaag

SEQ ID NO: 4215353 - DNA, 22 bp, Homo sapiens
acctccctgccctgtcctccag

SEQ ID NO: 4215354 - DNA, 14 bp, Homo sapiens
acctgaaaatgtgg

SEQ ID NO: 4215355 - DNA, 20 bp, Homo sapiens
acctgcacactgtcctatta

SEQ ID NO: 4215356 - DNA, 16 bp, Homo sapiens
acctgctttctcctgg

SEQ ID NO: 4215357 - DNA, 15 bp, Homo sapiens
acctgttcaggagct

SEQ ID NO: 4215358 - DNA, 18 bp, Homo sapiens
acctgttcaggagctgaa

SEQ ID NO: 4215359 - DNA, 13 bp, Homo sapiens
acctgtttatata

SEQ ID NO: 4215360 - DNA, 17 bp, Homo sapiens
acgaaatatcaaagtca

SEQ ID NO: 4215361 - DNA, 20 bp, Homo sapiens
actaaaaagtataaaatagt

SEQ ID NO: 4215362 - DNA, 22 bp, Homo sapiens
actaacgaaatatcaaagtcat

SEQ ID NO: 4215363 - DNA, 15 bp, Homo sapiens
actacagccagaagc

SEQ ID NO: 4215364 - DNA, 16 bp, Homo sapiens
actatgatttggaaaa

SEQ ID NO: 4215365 - DNA, 23 bp, Homo sapiens
actattgtgctcagagacactgt

SEQ ID NO: 4215366 - DNA, 20 bp, Homo sapiens
actcccagaccacctccctg

SEQ ID NO: 4215367 - DNA, 12 bp, Homo sapiens
actcctctgtct

SEQ ID NO: 4215368 - DNA, 17 bp, Homo sapiens
actcctctgtctctgct

SEQ ID NO: 4215369 - DNA, 23 bp, Homo sapiens
actcctctgtctctgctcttgcc

SEQ ID NO: 4215370 - DNA, 16 bp, Homo sapiens
actctacctgcacact

SEQ ID NO: 4215371 - DNA, 18 bp, Homo sapiens
actgaatggctgacctga

SEQ ID NO: 4215372 - DNA, 17 bp, Homo sapiens
actgacacctcactgag

SEQ ID NO: 4215373 - DNA, 20 bp, Homo sapiens
actgacacctcactgaggaa

SEQ ID NO: 4215374 - DNA, 22 bp, Homo sapiens
actgaccctggagcggctctcc

SEQ ID NO: 4215375 - DNA, 24 bp, Homo sapiens
actgaccctggagcggctctcctg

SEQ ID NO: 4215376 - DNA, 19 bp, Homo sapiens
actgagagtgcaaattgta

SEQ ID NO: 4215377 - DNA, 16 bp, Homo sapiens
actgagatgaatgtaa

SEQ ID NO: 4215378 - DNA, 23 bp, Homo sapiens
actgaggatattcagatgtatgt

SEQ ID NO: 4215379 - DNA, 20 bp, Homo sapiens
actgccaagaaaaggcatgg

SEQ ID NO: 4215380 - DNA, 16 bp, Homo sapiens
actgctcaattctgtt

SEQ ID NO: 4215381 - DNA, 17 bp, Homo sapiens
actggcacgtttgtgag

SEQ ID NO: 4215382 - DNA, 22 bp, Homo sapiens
actgtaacttccaaataaataa

SEQ ID NO: 4215383 - DNA, 17 bp, Homo sapiens
actgtacttattttcca

SEQ ID NO: 4215384 - DNA, 23 bp, Homo sapiens
actgtacttattttccaataaaa

SEQ ID NO: 4215385 - DNA, 15 bp, Homo sapiens
actgtcctattatat

SEQ ID NO: 4215386 - DNA, 15 bp, Homo sapiens
actgttgataaaaac

SEQ ID NO: 4215387 - DNA, 18 bp, Homo sapiens
acttaaattttaaagcct

SEQ ID NO: 4215388 - DNA, 15 bp, Homo sapiens
acttattgaatatat

SEQ ID NO: 4215389 - DNA, 18 bp, Homo sapiens
acttcctaagttcccttc

SEQ ID NO: 4215390 - DNA, 20 bp, Homo sapiens
acttcctaagttcccttcta

SEQ ID NO: 4215391 - DNA, 13 bp, Homo sapiens
acttctaaatgtt

SEQ ID NO: 4215392 - DNA, 22 bp, Homo sapiens
acttgagcctccatttctggct

SEQ ID NO: 4215393 - DNA, 22 bp, Homo sapiens
actttcaggccacatggctaaa

SEQ ID NO: 4215394 - DNA, 23 bp, Homo sapiens
acttttctcccctctctttctaa

SEQ ID NO: 4215395 - DNA, 13 bp, Homo sapiens
agaaaaaatggca

SEQ ID NO: 4215396 - DNA, 16 bp, Homo sapiens
agaaaaaatggcaaga

SEQ ID NO: 4215397 - DNA, 18 bp, Homo sapiens
agaaacctattaagtcat

SEQ ID NO: 4215398 - DNA, 14 bp, Homo sapiens
agaaagggcaagaa

SEQ ID NO: 4215399 - DNA, 24 bp, Homo sapiens
agaaatgtctatgttttctactcc

SEQ ID NO: 4215400 - DNA, 22 bp, Homo sapiens
agaacaaaacagtcctttaaat

SEQ ID NO: 4215401 - DNA, 20 bp, Homo sapiens
agaacacagcaattcctcag

SEQ ID NO: 4215402 - DNA, 15 bp, Homo sapiens
agaagagtttgcaaa

SEQ ID NO: 4215403 - DNA, 14 bp, Homo sapiens
agaagcccatggag

SEQ ID NO: 4215404 - DNA, 23 bp, Homo sapiens
agaagctccctgaagtaagcaaa

SEQ ID NO: 4215405 - DNA, 14 bp, Homo sapiens
agaaggaaatagcc

SEQ ID NO: 4215406 - DNA, 18 bp, Homo sapiens
agaaggtttcagaaagaa

SEQ ID NO: 4215407 - DNA, 21 bp, Homo sapiens
agaagtcttctatttatttat

SEQ ID NO: 4215408 - DNA, 20 bp, Homo sapiens
agaagtggggacagagcaga

SEQ ID NO: 4215409 - DNA, 16 bp, Homo sapiens
agaagttgccaagagt

SEQ ID NO: 4215410 - DNA, 21 bp, Homo sapiens
agaatggcagctggaatttaa

SEQ ID NO: 4215411 - DNA, 16 bp, Homo sapiens
agaatgttagagtaat

SEQ ID NO: 4215412 - DNA, 12 bp, Homo sapiens
agaatgttttca

SEQ ID NO: 4215413 - DNA, 21 bp, Homo sapiens
agaatgttttcaaatgttctc

SEQ ID NO: 4215414 - DNA, 21 bp, Homo sapiens
agacaccaaattccaaacttc

SEQ ID NO: 4215415 - DNA, 20 bp, Homo sapiens
agacactaacgaaatatcaa

SEQ ID NO: 4215416 - DNA, 17 bp, Homo sapiens
agacactgttgataaaa

SEQ ID NO: 4215417 - DNA, 18 bp, Homo sapiens
agacactgttgataaaaa

SEQ ID NO: 4215418 - DNA, 21 bp, Homo sapiens
agacatattcttggagaactt

SEQ ID NO: 4215419 - DNA, 22 bp, Homo sapiens
agaccacctccctgccctgtcc

SEQ ID NO: 4215420 - DNA, 15 bp, Homo sapiens
agaccaggtggaatt

SEQ ID NO: 4215421 - DNA, 21 bp, Homo sapiens
agactgtaacttccaaataaa

SEQ ID NO: 4215422 - DNA, 22 bp, Homo sapiens
agactgtaacttccaaataaat

SEQ ID NO: 4215423 - DNA, 16 bp, Homo sapiens
agagaatggtggtatt

SEQ ID NO: 4215424 - DNA, 16 bp, Homo sapiens
agagactccagctggg

SEQ ID NO: 4215425 - DNA, 13 bp, Homo sapiens
agagcaaacttta

SEQ ID NO: 4215426 - DNA, 17 bp, Homo sapiens
agagcaagactccgtct

SEQ ID NO: 4215427 - DNA, 14 bp, Homo sapiens
agagcataatttaa

SEQ ID NO: 4215428 - DNA, 13 bp, Homo sapiens
agagccatacata

SEQ ID NO: 4215429 - DNA, 21 bp, Homo sapiens
agagccatacataaaagaaat

SEQ ID NO: 4215430 - DNA, 17 bp, Homo sapiens
agagctatcaggagaaa

SEQ ID NO: 4215431 - DNA, 14 bp, Homo sapiens
agaggcgacttcct

SEQ ID NO: 4215432 - DNA, 15 bp, Homo sapiens
agataaccatattca

SEQ ID NO: 4215433 - DNA, 15 bp, Homo sapiens
agatcatatcctcag

SEQ ID NO: 4215434 - DNA, 12 bp, Homo sapiens
agatcttttaaa

SEQ ID NO: 4215435 - DNA, 11 bp, Homo sapiens
agatgaatgtc

SEQ ID NO: 4215436 - DNA, 15 bp, Homo sapiens
agatgaatgtcagtt

SEQ ID NO: 4215437 - DNA, 19 bp, Homo sapiens
agatgttttacaaatttaa

SEQ ID NO: 4215438 - DNA, 22 bp, Homo sapiens
agattattttagtctgtcatcc

SEQ ID NO: 4215439 - DNA, 21 bp, Homo sapiens
agattctatgttaatatttta

SEQ ID NO: 4215440 - DNA, 15 bp, Homo sapiens
agcaaactttagtgt

SEQ ID NO: 4215441 - DNA, 17 bp, Homo sapiens
agcaccctagaggacta

SEQ ID NO: 4215442 - DNA, 20 bp, Homo sapiens
agcactagttgtgaatttag

SEQ ID NO: 4215443 - DNA, 12 bp, Homo sapiens
agcactcctctg

SEQ ID NO: 4215444 - DNA, 15 bp, Homo sapiens
agcactcctctgtct

SEQ ID NO: 4215445 - DNA, 19 bp, Homo sapiens
agcactcctctgtctctgc

SEQ ID NO: 4215446 - DNA, 13 bp, Homo sapiens
agcagaagccaaa

SEQ ID NO: 4215447 - DNA, 17 bp, Homo sapiens
agcataatttaaaaata

SEQ ID NO: 4215448 - DNA, 20 bp, Homo sapiens
agcataatttaaaaatatat

SEQ ID NO: 4215449 - DNA, 19 bp, Homo sapiens
agcatgaaataaaatatat

SEQ ID NO: 4215450 - DNA, 17 bp, Homo sapiens
agcatgtcactcccaga

SEQ ID NO: 4215451 - DNA, 13 bp, Homo sapiens
agccaaatttata

SEQ ID NO: 4215452 - DNA, 14 bp, Homo sapiens
agcctccatttctg

SEQ ID NO: 4215453 - DNA, 17 bp, Homo sapiens
agcctggcaacagagca

SEQ ID NO: 4215454 - DNA, 11 bp, Homo sapiens
agccttctctc

SEQ ID NO: 4215455 - DNA, 16 bp, Homo sapiens
agccttctctctctgg

SEQ ID NO: 4215456 - DNA, 16 bp, Homo sapiens
agcgaactagaagaaa

SEQ ID NO: 4215457 - DNA, 18 bp, Homo sapiens
agctacacctgaggctga

SEQ ID NO: 4215458 - DNA, 19 bp, Homo sapiens
agctacacctgaggctgag

SEQ ID NO: 4215459 - DNA, 15 bp, Homo sapiens
agctccctagtggct

SEQ ID NO: 4215460 - DNA, 18 bp, Homo sapiens
agctggaattgctgctct

SEQ ID NO: 4215461 - DNA, 19 bp, Homo sapiens
agctggaattgctgctctc

SEQ ID NO: 4215462 - DNA, 22 bp, Homo sapiens
agctggatctccattctctcag

SEQ ID NO: 4215463 - DNA, 22 bp, Homo sapiens
agcttcagtaagttatctttga

SEQ ID NO: 4215464 - DNA, 21 bp, Homo sapiens
agcttcccctcgctgtcctgc

SEQ ID NO: 4215465 - DNA, 17 bp, Homo sapiens
agcttgaaaactcactt

SEQ ID NO: 4215466 - DNA, 18 bp, Homo sapiens
agcttggttctgtgaaca

SEQ ID NO: 4215467 - DNA, 23 bp, Homo sapiens
aggaaaatgtctgtaataataga

SEQ ID NO: 4215468 - DNA, 16 bp, Homo sapiens
aggaactgtgtgtgtc

SEQ ID NO: 4215469 - DNA, 15 bp, Homo sapiens
aggaaggctgagagg

SEQ ID NO: 4215470 - DNA, 14 bp, Homo sapiens
aggaagtgtttatg

SEQ ID NO: 4215471 - DNA, 16 bp, Homo sapiens
aggacttgagcctcca

SEQ ID NO: 4215472 - DNA, 22 bp, Homo sapiens
aggacttgagcctccatttctg

SEQ ID NO: 4215473 - DNA, 23 bp, Homo sapiens
aggagaagtcttctatttattta

SEQ ID NO: 4215474 - DNA, 22 bp, Homo sapiens
aggagatccagggcaaggccat

SEQ ID NO: 4215475 - DNA, 14 bp, Homo sapiens
aggagggacaagaa

SEQ ID NO: 4215476 - DNA, 19 bp, Homo sapiens
aggatctctaaagagcatc

SEQ ID NO: 4215477 - DNA, 15 bp, Homo sapiens
aggcaaacatttctt

SEQ ID NO: 4215478 - DNA, 17 bp, Homo sapiens
aggcaaagaaaatgaaa

SEQ ID NO: 4215479 - DNA, 16 bp, Homo sapiens
aggcaacttgggaact

SEQ ID NO: 4215480 - DNA, 14 bp, Homo sapiens
aggcaggggaatgt

SEQ ID NO: 4215481 - DNA, 16 bp, Homo sapiens
aggcagttttgaaatg

SEQ ID NO: 4215482 - DNA, 18 bp, Homo sapiens
aggcccactgcagagatg

SEQ ID NO: 4215483 - DNA, 18 bp, Homo sapiens
aggcgacttcctctccag

SEQ ID NO: 4215484 - DNA, 19 bp, Homo sapiens
aggcgacttcctctccagc

SEQ ID NO: 4215485 - DNA, 23 bp, Homo sapiens
aggctggtctccctccagctgga

SEQ ID NO: 4215486 - DNA, 22 bp, Homo sapiens
aggctgtggtggctgtctctgt

SEQ ID NO: 4215487 - DNA, 15 bp, Homo sapiens
agggaagaactattg

SEQ ID NO: 4215488 - DNA, 12 bp, Homo sapiens
agggcaataaat

SEQ ID NO: 4215489 - DNA, 22 bp, Homo sapiens
agggcaataaatgccctctctg

SEQ ID NO: 4215490 - DNA, 18 bp, Homo sapiens
aggggctccacctgttca

SEQ ID NO: 4215491 - DNA, 17 bp, Homo sapiens
aggtagaatgttttcaa

SEQ ID NO: 4215492 - DNA, 15 bp, Homo sapiens
aggtatttacacata

SEQ ID NO: 4215493 - DNA, 15 bp, Homo sapiens
aggtgcctcctgtct

SEQ ID NO: 4215494 - DNA, 14 bp, Homo sapiens
aggtggaattactt

SEQ ID NO: 4215495 - DNA, 15 bp, Homo sapiens
aggttagattctcat

SEQ ID NO: 4215496 - DNA, 14 bp, Homo sapiens
aggttagtgacaaa

SEQ ID NO: 4215497 - DNA, 12 bp, Homo sapiens
agtaaaaataaa

SEQ ID NO: 4215498 - DNA, 15 bp, Homo sapiens
agtaaaaataaaatt

SEQ ID NO: 4215499 - DNA, 18 bp, Homo sapiens
agtaacagttgaagaaaa

SEQ ID NO: 4215500 - DNA, 16 bp, Homo sapiens
agtaagttatctttga

SEQ ID NO: 4215501 - DNA, 15 bp, Homo sapiens
agtaatgaaatggag

SEQ ID NO: 4215502 - DNA, 14 bp, Homo sapiens
agtacttgatttca

SEQ ID NO: 4215503 - DNA, 13 bp, Homo sapiens
agtataaaatagt

SEQ ID NO: 4215504 - DNA, 22 bp, Homo sapiens
agtataaaatagtatgaaaatg

SEQ ID NO: 4215505 - DNA, 20 bp, Homo sapiens
agtatttataatataaatca

SEQ ID NO: 4215506 - DNA, 17 bp, Homo sapiens
agtatttatctcctgtc

SEQ ID NO: 4215507 - DNA, 22 bp, Homo sapiens
agtcactctaggactctgcact

SEQ ID NO: 4215508 - DNA, 12 bp, Homo sapiens
agtcattatgtt

SEQ ID NO: 4215509 - DNA, 18 bp, Homo sapiens
agtctaaggccatggcat

SEQ ID NO: 4215510 - DNA, 18 bp, Homo sapiens
agtctctgactcttgcct

SEQ ID NO: 4215511 - DNA, 14 bp, Homo sapiens
agtctggtgttctg

SEQ ID NO: 4215512 - DNA, 13 bp, Homo sapiens
agtctgtcatcca

SEQ ID NO: 4215513 - DNA, 21 bp, Homo sapiens
agtctttggtacaagtttaca

SEQ ID NO: 4215514 - DNA, 23 bp, Homo sapiens
agtgacaaaattggccagagagt

SEQ ID NO: 4215515 - DNA, 18 bp, Homo sapiens
agtgagactgacacctca

SEQ ID NO: 4215516 - DNA, 14 bp, Homo sapiens
agtgcctattgata

SEQ ID NO: 4215517 - DNA, 15 bp, Homo sapiens
agtgctgttctggag

SEQ ID NO: 4215518 - DNA, 20 bp, Homo sapiens
agtgctgttctggagctgct

SEQ ID NO: 4215519 - DNA, 21 bp, Homo sapiens
agtgtaacgatgcactttgga

SEQ ID NO: 4215520 - DNA, 17 bp, Homo sapiens
agtgtattaggaagtgt

SEQ ID NO: 4215521 - DNA, 13 bp, Homo sapiens
agtgttgaagaag

SEQ ID NO: 4215522 - DNA, 22 bp, Homo sapiens
agttaaaattgttatcaaaata

SEQ ID NO: 4215523 - DNA, 23 bp, Homo sapiens
agttactatcatgtcaaacgtga

SEQ ID NO: 4215524 - DNA, 21 bp, Homo sapiens
agttattacctttacatatta

SEQ ID NO: 4215525 - DNA, 14 bp, Homo sapiens
agttgcattttaac

SEQ ID NO: 4215526 - DNA, 15 bp, Homo sapiens
agttttacagtgttt

SEQ ID NO: 4215527 - DNA, 18 bp, Homo sapiens
agttttgaaatgaaaatc

SEQ ID NO: 4215528 - DNA, 17 bp, Homo sapiens
agttttgaagattctat

SEQ ID NO: 4215529 - DNA, 13 bp, Homo sapiens
ataaaaatatatt

SEQ ID NO: 4215530 - DNA, 22 bp, Homo sapiens
ataaaagttattacctttacat

SEQ ID NO: 4215531 - DNA, 18 bp, Homo sapiens
ataaaatagtatgaaaat

SEQ ID NO: 4215532 - DNA, 16 bp, Homo sapiens
ataaagtaaatacatg

SEQ ID NO: 4215533 - DNA, 18 bp, Homo sapiens
ataaagtaaatacatgca

SEQ ID NO: 4215534 - DNA, 17 bp, Homo sapiens
ataaagtatttatctcc

SEQ ID NO: 4215535 - DNA, 17 bp, Homo sapiens
ataaatcaatcttatta

SEQ ID NO: 4215536 - DNA, 20 bp, Homo sapiens
ataaatcattcttactaaaa

SEQ ID NO: 4215537 - DNA, 17 bp, Homo sapiens
ataaatgccctctctga

SEQ ID NO: 4215538 - DNA, 15 bp, Homo sapiens
ataactatgttgata

SEQ ID NO: 4215539 - DNA, 23 bp, Homo sapiens
ataagacaaatattcctttgcat

SEQ ID NO: 4215540 - DNA, 11 bp, Homo sapiens
ataataaaaat

SEQ ID NO: 4215541 - DNA, 15 bp, Homo sapiens
ataataaaaatatat

SEQ ID NO: 4215542 - DNA, 13 bp, Homo sapiens
ataatagactgta

SEQ ID NO: 4215543 - DNA, 14 bp, Homo sapiens
ataatgaataaatc

SEQ ID NO: 4215544 - DNA, 14 bp, Homo sapiens
ataatttgccatta

SEQ ID NO: 4215545 - DNA, 17 bp, Homo sapiens
ataattttgcagcagaa

SEQ ID NO: 4215546 - DNA, 20 bp, Homo sapiens
atacacatccccagccagaa

SEQ ID NO: 4215547 - DNA, 16 bp, Homo sapiens
atacataaaagaaata

SEQ ID NO: 4215548 - DNA, 22 bp, Homo sapiens
atacatatgcagatacttatta

SEQ ID NO: 4215549 - DNA, 18 bp, Homo sapiens
atactcatgcattctttt

SEQ ID NO: 4215550 - DNA, 17 bp, Homo sapiens
atagaatgaaaagttta

SEQ ID NO: 4215551 - DNA, 17 bp, Homo sapiens
ataggctattttctaaa

SEQ ID NO: 4215552 - DNA, 15 bp, Homo sapiens
atataataaaagtta

SEQ ID NO: 4215553 - DNA, 22 bp, Homo sapiens
atataggctattttctaaagac

SEQ ID NO: 4215554 - DNA, 13 bp, Homo sapiens
atatatagagaaa

SEQ ID NO: 4215555 - DNA, 20 bp, Homo sapiens
atatataggctattttctaa

SEQ ID NO: 4215556 - DNA, 19 bp, Homo sapiens
atatatttttttcaactgc

SEQ ID NO: 4215557 - DNA, 19 bp, Homo sapiens
atatcccttggacatttta

SEQ ID NO: 4215558 - DNA, 17 bp, Homo sapiens
atattaaaaaagagaca

SEQ ID NO: 4215559 - DNA, 13 bp, Homo sapiens
atattataaagga

SEQ ID NO: 4215560 - DNA, 17 bp, Homo sapiens
atattcacaatggaaac

SEQ ID NO: 4215561 - DNA, 21 bp, Homo sapiens
atattcacaatggaaacttta

SEQ ID NO: 4215562 - DNA, 14 bp, Homo sapiens
atattcctttttct

SEQ ID NO: 4215563 - DNA, 17 bp, Homo sapiens
atattcctttttctatg

SEQ ID NO: 4215564 - DNA, 17 bp, Homo sapiens
atatttgatacatataa

SEQ ID NO: 4215565 - DNA, 17 bp, Homo sapiens
atatttgcaaagtgtat

SEQ ID NO: 4215566 - DNA, 20 bp, Homo sapiens
atatttgcaaagtgtattag

SEQ ID NO: 4215567 - DNA, 20 bp, Homo sapiens
atattttccctctcttgcct

SEQ ID NO: 4215568 - DNA, 21 bp, Homo sapiens
atatttttttcaactgccaat

SEQ ID NO: 4215569 - DNA, 18 bp, Homo sapiens
atcaagggaagaactatt

SEQ ID NO: 4215570 - DNA, 22 bp, Homo sapiens
atcaatagactgtacttatttt

SEQ ID NO: 4215571 - DNA, 17 bp, Homo sapiens
atcacggatcaatagac

SEQ ID NO: 4215572 - DNA, 14 bp, Homo sapiens
atcatatcctcaga

SEQ ID NO: 4215573 - DNA, 12 bp, Homo sapiens
atcatgtctatt

SEQ ID NO: 4215574 - DNA, 23 bp, Homo sapiens
atcattcttactaaaaagtataa

SEQ ID NO: 4215575 - DNA, 23 bp, Homo sapiens
atccagaaaatgtgtcagcatgc

SEQ ID NO: 4215576 - DNA, 23 bp, Homo sapiens
atccatcctgctcttccatttct

SEQ ID NO: 4215577 - DNA, 12 bp, Homo sapiens
atccccagccag

SEQ ID NO: 4215578 - DNA, 17 bp, Homo sapiens
atcccttggacatttta

SEQ ID NO: 4215579 - DNA, 19 bp, Homo sapiens
atcccttggacattttatg

SEQ ID NO: 4215580 - DNA, 20 bp, Homo sapiens
atcccttggacattttatgt

SEQ ID NO: 4215581 - DNA, 22 bp, Homo sapiens
atcctgcattttacgtctttgg

SEQ ID NO: 4215582 - DNA, 21 bp, Homo sapiens
atcggccatcaagggaagaac

SEQ ID NO: 4215583 - DNA, 16 bp, Homo sapiens
atctctgctttggaaa

SEQ ID NO: 4215584 - DNA, 17 bp, Homo sapiens
atctctgctttggaaat

SEQ ID NO: 4215585 - DNA, 18 bp, Homo sapiens
atctgacttctcacttcc

SEQ ID NO: 4215586 - DNA, 16 bp, Homo sapiens
atctgcttgtattttc

SEQ ID NO: 4215587 - DNA, 24 bp, Homo sapiens
atcttataaagtggaagtatgtat

SEQ ID NO: 4215588 - DNA, 13 bp, Homo sapiens
atcttctgcagaa

SEQ ID NO: 4215589 - DNA, 19 bp, Homo sapiens
atgaaagccaaatttatat

SEQ ID NO: 4215590 - DNA, 16 bp, Homo sapiens
atgaaataaaatatat

SEQ ID NO: 4215591 - DNA, 22 bp, Homo sapiens
atgaacaaagggattctccagg

SEQ ID NO: 4215592 - DNA, 19 bp, Homo sapiens
atgaaggagttttttttaa

SEQ ID NO: 4215593 - DNA, 13 bp, Homo sapiens
atgacatttttga

SEQ ID NO: 4215594 - DNA, 14 bp, Homo sapiens
atgacatttttgat

SEQ ID NO: 4215595 - DNA, 14 bp, Homo sapiens
atgaccaagaatta

SEQ ID NO: 4215596 - DNA, 14 bp, Homo sapiens
atgaccatcctgtc

SEQ ID NO: 4215597 - DNA, 13 bp, Homo sapiens
atgagagcataat

SEQ ID NO: 4215598 - DNA, 15 bp, Homo sapiens
atgatcctaatgaat

SEQ ID NO: 4215599 - DNA, 13 bp, Homo sapiens
atgatccttccta

SEQ ID NO: 4215600 - DNA, 16 bp, Homo sapiens
atgatccttcctactt

SEQ ID NO: 4215601 - DNA, 14 bp, Homo sapiens
atgatgaccaagaa

SEQ ID NO: 4215602 - DNA, 17 bp, Homo sapiens
atgcatagtgctaagaa

SEQ ID NO: 4215603 - DNA, 15 bp, Homo sapiens
atgcatataatgaat

SEQ ID NO: 4215604 - DNA, 21 bp, Homo sapiens
atgcatatttgcaaagtgtat

SEQ ID NO: 4215605 - DNA, 12 bp, Homo sapiens
atgcattctttt

SEQ ID NO: 4215606 - DNA, 13 bp, Homo sapiens
atgccctctctga

SEQ ID NO: 4215607 - DNA, 21 bp, Homo sapiens
atgccgctcttctgtcatccc

SEQ ID NO: 4215608 - DNA, 22 bp, Homo sapiens
atgccgctcttctgtcatcccg

SEQ ID NO: 4215609 - DNA, 19 bp, Homo sapiens
atgcctttttttctctgca

SEQ ID NO: 4215610 - DNA, 20 bp, Homo sapiens
atgctttcccaccagcatgt

SEQ ID NO: 4215611 - DNA, 15 bp, Homo sapiens
atgcttttattcaag

SEQ ID NO: 4215612 - DNA, 14 bp, Homo sapiens
atggcaagagatca

SEQ ID NO: 4215613 - DNA, 17 bp, Homo sapiens
atggttgatgatacttc

SEQ ID NO: 4215614 - DNA, 14 bp, Homo sapiens
atgtacaaccctga

SEQ ID NO: 4215615 - DNA, 16 bp, Homo sapiens
atgtacaaccctgacc

SEQ ID NO: 4215616 - DNA, 14 bp, Homo sapiens
atgtatattaaaaa

SEQ ID NO: 4215617 - DNA, 18 bp, Homo sapiens
atgtcacgtcttgaaaag

SEQ ID NO: 4215618 - DNA, 14 bp, Homo sapiens
atgtcactcccaga

SEQ ID NO: 4215619 - DNA, 13 bp, Homo sapiens
atgtctatttttg

SEQ ID NO: 4215620 - DNA, 19 bp, Homo sapiens
atgtgcacatctgttttgt

SEQ ID NO: 4215621 - DNA, 16 bp, Homo sapiens
atgtggcctttgaatt

SEQ ID NO: 4215622 - DNA, 14 bp, Homo sapiens
atgtgtcagcatgc

SEQ ID NO: 4215623 - DNA, 15 bp, Homo sapiens
atgtgtcagcatgca

SEQ ID NO: 4215624 - DNA, 13 bp, Homo sapiens
atgttaatatttt

SEQ ID NO: 4215625 - DNA, 22 bp, Homo sapiens
atgttaatattttaggtgtaaa

SEQ ID NO: 4215626 - DNA, 18 bp, Homo sapiens
atgttgtttataataaaa

SEQ ID NO: 4215627 - DNA, 13 bp, Homo sapiens
attaaaaaagaga

SEQ ID NO: 4215628 - DNA, 22 bp, Homo sapiens
attaaaaaagagacatccaaat

SEQ ID NO: 4215629 - DNA, 14 bp, Homo sapiens
attaaaaattactg

SEQ ID NO: 4215630 - DNA, 14 bp, Homo sapiens
attaaaatatttca

SEQ ID NO: 4215631 - DNA, 15 bp, Homo sapiens
attaattagattttc

SEQ ID NO: 4215632 - DNA, 23 bp, Homo sapiens
attacaaagttaaaattgttatc

SEQ ID NO: 4215633 - DNA, 24 bp, Homo sapiens
attacaaagttaaaattgttatca

SEQ ID NO: 4215634 - DNA, 20 bp, Homo sapiens
attacaggcttgaaagtcta

SEQ ID NO: 4215635 - DNA, 16 bp, Homo sapiens
attatctgtattaatg

SEQ ID NO: 4215636 - DNA, 17 bp, Homo sapiens
attatgttaatatttct

SEQ ID NO: 4215637 - DNA, 17 bp, Homo sapiens
attattgaagatgtgat

SEQ ID NO: 4215638 - DNA, 19 bp, Homo sapiens
attatttaagactaaaagt

SEQ ID NO: 4215639 - DNA, 16 bp, Homo sapiens
attatttgattattta

SEQ ID NO: 4215640 - DNA, 21 bp, Homo sapiens
attatttgattatttaagact

SEQ ID NO: 4215641 - DNA, 18 bp, Homo sapiens
attcagaacatcctccaa

SEQ ID NO: 4215642 - DNA, 14 bp, Homo sapiens
attcagatgtatgt

SEQ ID NO: 4215643 - DNA, 16 bp, Homo sapiens
attcatgtacagcatg

SEQ ID NO: 4215644 - DNA, 18 bp, Homo sapiens
attccaaacttctaaatg

SEQ ID NO: 4215645 - DNA, 20 bp, Homo sapiens
attccaaacttctaaatgtt

SEQ ID NO: 4215646 - DNA, 21 bp, Homo sapiens
attccaaacttctaaatgttg

SEQ ID NO: 4215647 - DNA, 23 bp, Homo sapiens
attccaaagttttgaagtcatct

SEQ ID NO: 4215648 - DNA, 15 bp, Homo sapiens
attccacagtctctg

SEQ ID NO: 4215649 - DNA, 14 bp, Homo sapiens
attcctttttctat

SEQ ID NO: 4215650 - DNA, 23 bp, Homo sapiens
attctaattttatatatagagaa

SEQ ID NO: 4215651 - DNA, 15 bp, Homo sapiens
attctagctttgagc

SEQ ID NO: 4215652 - DNA, 15 bp, Homo sapiens
attctggaggaagaa

SEQ ID NO: 4215653 - DNA, 18 bp, Homo sapiens
attcttttggctttgaaa

SEQ ID NO: 4215654 - DNA, 16 bp, Homo sapiens
attctttttgaaatgt

SEQ ID NO: 4215655 - DNA, 18 bp, Homo sapiens
attgagccattttttaaa

SEQ ID NO: 4215656 - DNA, 15 bp, Homo sapiens
attgagtttaagtct

SEQ ID NO: 4215657 - DNA, 19 bp, Homo sapiens
attgagtttaagtctctga

SEQ ID NO: 4215658 - DNA, 16 bp, Homo sapiens
attgatgttttcatag

SEQ ID NO: 4215659 - DNA, 17 bp, Homo sapiens
attgatgttttcataga

SEQ ID NO: 4215660 - DNA, 17 bp, Homo sapiens
attgcaggacacaagca

SEQ ID NO: 4215661 - DNA, 14 bp, Homo sapiens
attggccagagagt

SEQ ID NO: 4215662 - DNA, 18 bp, Homo sapiens
attgtaatacacatatct

SEQ ID NO: 4215663 - DNA, 20 bp, Homo sapiens
attgtacaaggtatttacac

SEQ ID NO: 4215664 - DNA, 15 bp, Homo sapiens
atttaatttgaaggt

SEQ ID NO: 4215665 - DNA, 19 bp, Homo sapiens
atttaatttttaaatgttt

SEQ ID NO: 4215666 - DNA, 20 bp, Homo sapiens
atttaatttttaaatgttta

SEQ ID NO: 4215667 - DNA, 17 bp, Homo sapiens
atttaatttttgcaatt

SEQ ID NO: 4215668 - DNA, 18 bp, Homo sapiens
atttagggtgttaaactt

SEQ ID NO: 4215669 - DNA, 14 bp, Homo sapiens
atttattcattagt

SEQ ID NO: 4215670 - DNA, 16 bp, Homo sapiens
atttatttatttattc

SEQ ID NO: 4215671 - DNA, 16 bp, Homo sapiens
atttcttaaaatgttt

SEQ ID NO: 4215672 - DNA, 23 bp, Homo sapiens
atttgaaggtagaatgttttcaa

SEQ ID NO: 4215673 - DNA, 15 bp, Homo sapiens
atttgtcttcccttc

SEQ ID NO: 4215674 - DNA, 18 bp, Homo sapiens
atttgtcttcccttcttt

SEQ ID NO: 4215675 - DNA, 17 bp, Homo sapiens
attttaaagcctgaaaa

SEQ ID NO: 4215676 - DNA, 23 bp, Homo sapiens
attttaaagcctgaaaattccaa

SEQ ID NO: 4215677 - DNA, 18 bp, Homo sapiens
attttatatatagagaaa

SEQ ID NO: 4215678 - DNA, 13 bp, Homo sapiens
attttatgtcttt

SEQ ID NO: 4215679 - DNA, 15 bp, Homo sapiens
attttcaaaaattgt

SEQ ID NO: 4215680 - DNA, 18 bp, Homo sapiens
attttcaaactttgtact

SEQ ID NO: 4215681 - DNA, 14 bp, Homo sapiens
attttccaataaaa

SEQ ID NO: 4215682 - DNA, 21 bp, Homo sapiens
attttcctcctaaacaaaaac

SEQ ID NO: 4215683 - DNA, 14 bp, Homo sapiens
attttctaaagact

SEQ ID NO: 4215684 - DNA, 15 bp, Homo sapiens
attttcttgcagttt

SEQ ID NO: 4215685 - DNA, 18 bp, Homo sapiens
attttgcagcagaagcca

SEQ ID NO: 4215686 - DNA, 13 bp, Homo sapiens
atttttgataaat

SEQ ID NO: 4215687 - DNA, 20 bp, Homo sapiens
attttttatgtacaaccctg

SEQ ID NO: 4215688 - DNA, 18 bp, Homo sapiens
atttttttaaagatgccc

SEQ ID NO: 4215689 - DNA, 20 bp, Homo sapiens
caaacatttcttaaaatgtt

SEQ ID NO: 4215690 - DNA, 16 bp, Homo sapiens
caaagaaaatgaaatg

SEQ ID NO: 4215691 - DNA, 21 bp, Homo sapiens
caaagaaaatgaaatgcatat

SEQ ID NO: 4215692 - DNA, 13 bp, Homo sapiens
caaagagaaacct

SEQ ID NO: 4215693 - DNA, 22 bp, Homo sapiens
caaagagaaacctattaagtca

SEQ ID NO: 4215694 - DNA, 17 bp, Homo sapiens
caaagtcattaaagaca

SEQ ID NO: 4215695 - DNA, 23 bp, Homo sapiens
caaagtctgctctcatataagac

SEQ ID NO: 4215696 - DNA, 14 bp, Homo sapiens
caaatgatccttcc

SEQ ID NO: 4215697 - DNA, 18 bp, Homo sapiens
caaatgatccttcctact

SEQ ID NO: 4215698 - DNA, 22 bp, Homo sapiens
caaatgatccttcctactttgc

SEQ ID NO: 4215699 - DNA, 16 bp, Homo sapiens
caacacaatccgttgc

SEQ ID NO: 4215700 - DNA, 15 bp, Homo sapiens
caacagtagcaggga

SEQ ID NO: 4215701 - DNA, 21 bp, Homo sapiens
caacatggcaaaaccccatct

SEQ ID NO: 4215702 - DNA, 12 bp, Homo sapiens
caaccctgaccg

SEQ ID NO: 4215703 - DNA, 18 bp, Homo sapiens
caactatgatttggaaaa

SEQ ID NO: 4215704 - DNA, 22 bp, Homo sapiens
caactatgatttggaaaataaa

SEQ ID NO: 4215705 - DNA, 12 bp, Homo sapiens
caagagatcata

SEQ ID NO: 4215706 - DNA, 20 bp, Homo sapiens
caagagatcatatcctcaga

SEQ ID NO: 4215707 - DNA, 18 bp, Homo sapiens
caagcaagaaacactggg

SEQ ID NO: 4215708 - DNA, 22 bp, Homo sapiens
caagtaacagttgaagaaaaaa

SEQ ID NO: 4215709 - DNA, 20 bp, Homo sapiens
caagtagaatggcagctgga

SEQ ID NO: 4215710 - DNA, 19 bp, Homo sapiens
caataaatgccctctctga

SEQ ID NO: 4215711 - DNA, 23 bp, Homo sapiens
caatagactgtacttattttcca

SEQ ID NO: 4215712 - DNA, 15 bp, Homo sapiens
caatgactcaaagtc

SEQ ID NO: 4215713 - DNA, 15 bp, Homo sapiens
caatggaaactttag

SEQ ID NO: 4215714 - DNA, 21 bp, Homo sapiens
caattattctaattttatata

SEQ ID NO: 4215715 - DNA, 18 bp, Homo sapiens
caattccacagtctctgg

SEQ ID NO: 4215716 - DNA, 21 bp, Homo sapiens
caattgtaaacagaaattgca

SEQ ID NO: 4215717 - DNA, 20 bp, Homo sapiens
caattttgtctattaaagat

SEQ ID NO: 4215718 - DNA, 21 bp, Homo sapiens
cacacagactacagccagaag

SEQ ID NO: 4215719 - DNA, 22 bp, Homo sapiens
cacactggcacgtttgtgagaa

SEQ ID NO: 4215720 - DNA, 16 bp, Homo sapiens
cacagaaaccaatttt

SEQ ID NO: 4215721 - DNA, 15 bp, Homo sapiens
cacagactacagcca

SEQ ID NO: 4215722 - DNA, 16 bp, Homo sapiens
cacagcccacacatga

SEQ ID NO: 4215723 - DNA, 13 bp, Homo sapiens
cacagtctctggg

SEQ ID NO: 4215724 - DNA, 21 bp, Homo sapiens
cacatacaacttcatataact

SEQ ID NO: 4215725 - DNA, 19 bp, Homo sapiens
cacatgtaacatagattta

SEQ ID NO: 4215726 - DNA, 17 bp, Homo sapiens
cacattaattagatttt

SEQ ID NO: 4215727 - DNA, 22 bp, Homo sapiens
cacattgagtttaagtctctga

SEQ ID NO: 4215728 - DNA, 23 bp, Homo sapiens
caccaagttggaacatccttgga

SEQ ID NO: 4215729 - DNA, 21 bp, Homo sapiens
caccagcatgtcactcccaga

SEQ ID NO: 4215730 - DNA, 14 bp, Homo sapiens
caccgttcattcag

SEQ ID NO: 4215731 - DNA, 14 bp, Homo sapiens
cacctcactgagga

SEQ ID NO: 4215732 - DNA, 12 bp, Homo sapiens
cacctcccaggg

SEQ ID NO: 4215733 - DNA, 15 bp, Homo sapiens
cacctcccaggggct

SEQ ID NO: 4215734 - DNA, 21 bp, Homo sapiens
cacctccctgccctgtcctcc

SEQ ID NO: 4215735 - DNA, 16 bp, Homo sapiens
cactaacgaaatatca

SEQ ID NO: 4215736 - DNA, 15 bp, Homo sapiens
cactccaaagagaaa

SEQ ID NO: 4215737 - DNA, 17 bp, Homo sapiens
cactcctctgtctctgc

SEQ ID NO: 4215738 - DNA, 21 bp, Homo sapiens
cactgaatggctgacctgacc

SEQ ID NO: 4215739 - DNA, 17 bp, Homo sapiens
cactgcactctagcctg

SEQ ID NO: 4215740 - DNA, 20 bp, Homo sapiens
cactgcactctagcctggca

SEQ ID NO: 4215741 - DNA, 19 bp, Homo sapiens
cactgcagagatggtggtg

SEQ ID NO: 4215742 - DNA, 16 bp, Homo sapiens
cactgttgataaaaac

SEQ ID NO: 4215743 - DNA, 17 bp, Homo sapiens
cactgttgataaaaact

SEQ ID NO: 4215744 - DNA, 16 bp, Homo sapiens
cacttattgaatatat

SEQ ID NO: 4215745 - DNA, 17 bp, Homo sapiens
cacttattgaatatatg

SEQ ID NO: 4215746 - DNA, 20 bp, Homo sapiens
cacttcctaagttcccttct

SEQ ID NO: 4215747 - DNA, 22 bp, Homo sapiens
cagaaaatgtgtcagcatgcat

SEQ ID NO: 4215748 - DNA, 16 bp, Homo sapiens
cagaacatcctccaat

SEQ ID NO: 4215749 - DNA, 14 bp, Homo sapiens
cagaagccaaattt

SEQ ID NO: 4215750 - DNA, 20 bp, Homo sapiens
cagaagtcacacattacaaa

SEQ ID NO: 4215751 - DNA, 12 bp, Homo sapiens
cagaattttacc

SEQ ID NO: 4215752 - DNA, 18 bp, Homo sapiens
cagaattttaccaaaatt

SEQ ID NO: 4215753 - DNA, 13 bp, Homo sapiens
cagactacagcca

SEQ ID NO: 4215754 - DNA, 15 bp, Homo sapiens
cagactacagccaga

SEQ ID NO: 4215755 - DNA, 21 bp, Homo sapiens
cagagacactgttgataaaaa

SEQ ID NO: 4215756 - DNA, 15 bp, Homo sapiens
cagataatccctgta

SEQ ID NO: 4215757 - DNA, 23 bp, Homo sapiens
cagattattttagtctgtcatcc

SEQ ID NO: 4215758 - DNA, 16 bp, Homo sapiens
cagcactcctctgtct

SEQ ID NO: 4215759 - DNA, 12 bp, Homo sapiens
cagcatgtcact

SEQ ID NO: 4215760 - DNA, 17 bp, Homo sapiens
cagcatgtcactcccag

SEQ ID NO: 4215761 - DNA, 18 bp, Homo sapiens
cagcatgtcactcccaga

SEQ ID NO: 4215762 - DNA, 21 bp, Homo sapiens
cagccaaatccatcctgctct

SEQ ID NO: 4215763 - DNA, 17 bp, Homo sapiens
cagccagaagcccatgg

SEQ ID NO: 4215764 - DNA, 12 bp, Homo sapiens
cagcccagggca

SEQ ID NO: 4215765 - DNA, 17 bp, Homo sapiens
cagctacacctgaggct

SEQ ID NO: 4215766 - DNA, 11 bp, Homo sapiens
cagctccctag

SEQ ID NO: 4215767 - DNA, 22 bp, Homo sapiens
cagctggaattgctgctctctg

SEQ ID NO: 4215768 - DNA, 21 bp, Homo sapiens
cagctggaatttaaggaggga

SEQ ID NO: 4215769 - DNA, 17 bp, Homo sapiens
cagctgggttggaaaac

SEQ ID NO: 4215770 - DNA, 14 bp, Homo sapiens
caggactttccctg

SEQ ID NO: 4215771 - DNA, 20 bp, Homo sapiens
caggattccaaagttttgaa

SEQ ID NO: 4215772 - DNA, 22 bp, Homo sapiens
caggcaacgcacaaaacagaaa

SEQ ID NO: 4215773 - DNA, 17 bp, Homo sapiens
caggttatgcctcatgc

SEQ ID NO: 4215774 - DNA, 20 bp, Homo sapiens
cagtaagttatctttgaata

SEQ ID NO: 4215775 - DNA, 19 bp, Homo sapiens
cagtcattatgttaatatt

SEQ ID NO: 4215776 - DNA, 14 bp, Homo sapiens
cagtctctgggaga

SEQ ID NO: 4215777 - DNA, 23 bp, Homo sapiens
cagtctctgggagactttcccta

SEQ ID NO: 4215778 - DNA, 23 bp, Homo sapiens
cagtgctgaccagacagcctccc

SEQ ID NO: 4215779 - DNA, 19 bp, Homo sapiens
cagttgttatttattgaaa

SEQ ID NO: 4215780 - DNA, 18 bp, Homo sapiens
cagttttgaaatgaaaat

SEQ ID NO: 4215781 - DNA, 12 bp, Homo sapiens
cataaattattt

SEQ ID NO: 4215782 - DNA, 16 bp, Homo sapiens
cataagtctttggtac

SEQ ID NO: 4215783 - DNA, 13 bp, Homo sapiens
cataatttaaaaa

SEQ ID NO: 4215784 - DNA, 14 bp, Homo sapiens
catataatgaataa

SEQ ID NO: 4215785 - DNA, 16 bp, Homo sapiens
catataatgaataaat

SEQ ID NO: 4215786 - DNA, 14 bp, Homo sapiens
catatgcagatact

SEQ ID NO: 4215787 - DNA, 19 bp, Homo sapiens
catccatgttccgagaaga

SEQ ID NO: 4215788 - DNA, 15 bp, Homo sapiens
catcctgctcttcca

SEQ ID NO: 4215789 - DNA, 19 bp, Homo sapiens
catctgcttgtattttcca

SEQ ID NO: 4215790 - DNA, 14 bp, Homo sapiens
catctgggaggctg

SEQ ID NO: 4215791 - DNA, 13 bp, Homo sapiens
catgaaataaaat

SEQ ID NO: 4215792 - DNA, 14 bp, Homo sapiens
catgaaataaaata

SEQ ID NO: 4215793 - DNA, 14 bp, Homo sapiens
catgcagcatctaa

SEQ ID NO: 4215794 - DNA, 19 bp, Homo sapiens
catgcatagtgctaagaaa

SEQ ID NO: 4215795 - DNA, 19 bp, Homo sapiens
catgctgaaggctgaaaga

SEQ ID NO: 4215796 - DNA, 16 bp, Homo sapiens
catgctgacttgcaga

SEQ ID NO: 4215797 - DNA, 14 bp, Homo sapiens
catgctttcccacc

SEQ ID NO: 4215798 - DNA, 15 bp, Homo sapiens
catgctttcccacca

SEQ ID NO: 4215799 - DNA, 23 bp, Homo sapiens
catggaatgtaactatatcatcc

SEQ ID NO: 4215800 - DNA, 17 bp, Homo sapiens
catggcatccctttttc

SEQ ID NO: 4215801 - DNA, 16 bp, Homo sapiens
catgtacagcatgcat

SEQ ID NO: 4215802 - DNA, 14 bp, Homo sapiens
catgtcaaacgtga

SEQ ID NO: 4215803 - DNA, 20 bp, Homo sapiens
cattatctgtattaatgctt

SEQ ID NO: 4215804 - DNA, 17 bp, Homo sapiens
cattatgttaatatttc

SEQ ID NO: 4215805 - DNA, 14 bp, Homo sapiens
cattctttttgaaa

SEQ ID NO: 4215806 - DNA, 12 bp, Homo sapiens
catttaaaaaaa

SEQ ID NO: 4215807 - DNA, 20 bp, Homo sapiens
catttctagcgcatggcctg

SEQ ID NO: 4215808 - DNA, 19 bp, Homo sapiens
catttctggcttctagtct

SEQ ID NO: 4215809 - DNA, 12 bp, Homo sapiens
catttcttccac

SEQ ID NO: 4215810 - DNA, 13 bp, Homo sapiens
catttcttccacg

SEQ ID NO: 4215811 - DNA, 15 bp, Homo sapiens
cattttctctagctg

SEQ ID NO: 4215812 - DNA, 22 bp, Homo sapiens
ccaaaattcagaacatcctcca

SEQ ID NO: 4215813 - DNA, 14 bp, Homo sapiens
ccaaaggaaaatgt

SEQ ID NO: 4215814 - DNA, 20 bp, Homo sapiens
ccaaagttttgaagtcatct

SEQ ID NO: 4215815 - DNA, 12 bp, Homo sapiens
ccaaataaataa

SEQ ID NO: 4215816 - DNA, 17 bp, Homo sapiens
ccaaatccatcctgctc

SEQ ID NO: 4215817 - DNA, 22 bp, Homo sapiens
ccaagagttctttaggtgcctc

SEQ ID NO: 4215818 - DNA, 22 bp, Homo sapiens
ccaagggttgaattctggagga

SEQ ID NO: 4215819 - DNA, 15 bp, Homo sapiens
ccaagtactttccaa

SEQ ID NO: 4215820 - DNA, 21 bp, Homo sapiens
ccacacatgaaccatccttcc

SEQ ID NO: 4215821 - DNA, 16 bp, Homo sapiens
ccacattgaagaatgt

SEQ ID NO: 4215822 - DNA, 17 bp, Homo sapiens
ccaccgattgcaggaca

SEQ ID NO: 4215823 - DNA, 18 bp, Homo sapiens
ccaccgtctacagatggc

SEQ ID NO: 4215824 - DNA, 15 bp, Homo sapiens
ccacctccctgccct

SEQ ID NO: 4215825 - DNA, 12 bp, Homo sapiens
ccagaaacaaca

SEQ ID NO: 4215826 - DNA, 20 bp, Homo sapiens
ccagaagcccatggagcagg

SEQ ID NO: 4215827 - DNA, 15 bp, Homo sapiens
ccagcactcctctgt

SEQ ID NO: 4215828 - DNA, 19 bp, Homo sapiens
ccagcactcctctgtctct

SEQ ID NO: 4215829 - DNA, 17 bp, Homo sapiens
ccagccttctctctctg

SEQ ID NO: 4215830 - DNA, 23 bp, Homo sapiens
ccagcttcccctcgctgtcctgc

SEQ ID NO: 4215831 - DNA, 15 bp, Homo sapiens
ccaggttatgcctca

SEQ ID NO: 4215832 - DNA, 13 bp, Homo sapiens
ccaggttggcctg

SEQ ID NO: 4215833 - DNA, 17 bp, Homo sapiens
ccaggttggcctggtgg

SEQ ID NO: 4215834 - DNA, 21 bp, Homo sapiens
ccagtcattatgttaatattt

SEQ ID NO: 4215835 - DNA, 17 bp, Homo sapiens
ccatacacatccccagc

SEQ ID NO: 4215836 - DNA, 17 bp, Homo sapiens
ccatattcacaatggaa

SEQ ID NO: 4215837 - DNA, 15 bp, Homo sapiens
ccatcaggactttcc

SEQ ID NO: 4215838 - DNA, 15 bp, Homo sapiens
ccatcctgtcctttg

SEQ ID NO: 4215839 - DNA, 12 bp, Homo sapiens
ccatctgcttgt

SEQ ID NO: 4215840 - DNA, 15 bp, Homo sapiens
ccatgacctttttca

SEQ ID NO: 4215841 - DNA, 19 bp, Homo sapiens
ccatgatgccgctcttctg

SEQ ID NO: 4215842 - DNA, 21 bp, Homo sapiens
ccatgcaccctcatacacaga

SEQ ID NO: 4215843 - DNA, 18 bp, Homo sapiens
ccatttgtttgtgcttca

SEQ ID NO: 4215844 - DNA, 23 bp, Homo sapiens
cccactaaaacaaaacaaaaaac

SEQ ID NO: 4215845 - DNA, 22 bp, Homo sapiens
cccagaccacctccctgccctg

SEQ ID NO: 4215846 - DNA, 15 bp, Homo sapiens
cccagcactcctctg

SEQ ID NO: 4215847 - DNA, 17 bp, Homo sapiens
cccaggttggcctggtg

SEQ ID NO: 4215848 - DNA, 20 bp, Homo sapiens
cccaggttggcctggtggcc

SEQ ID NO: 4215849 - DNA, 23 bp, Homo sapiens
cccatgatgccgctcttctgtca

SEQ ID NO: 4215850 - DNA, 20 bp, Homo sapiens
ccccctcactccacactggc

SEQ ID NO: 4215851 - DNA, 20 bp, Homo sapiens
ccctagaggcaaacatttct

SEQ ID NO: 4215852 - DNA, 12 bp, Homo sapiens
ccctcactgcct

SEQ ID NO: 4215853 - DNA, 23 bp, Homo sapiens
ccctccagctggaattgctgctc

SEQ ID NO: 4215854 - DNA, 12 bp, Homo sapiens
ccctctcttgcc

SEQ ID NO: 4215855 - DNA, 19 bp, Homo sapiens
ccctgtcctccagcttccc

SEQ ID NO: 4215856 - DNA, 23 bp, Homo sapiens
cccttgcacagcccacacatgaa

SEQ ID NO: 4215857 - DNA, 14 bp, Homo sapiens
cccttggacatttt

SEQ ID NO: 4215858 - DNA, 13 bp, Homo sapiens
ccgagaagaacag

SEQ ID NO: 4215859 - DNA, 16 bp, Homo sapiens
ccgttgcaaacccaaa

SEQ ID NO: 4215860 - DNA, 19 bp, Homo sapiens
cctaagaggcgacttcctc

SEQ ID NO: 4215861 - DNA, 12 bp, Homo sapiens
cctaatgtgttt

SEQ ID NO: 4215862 - DNA, 15 bp, Homo sapiens
cctactttgcttctc

SEQ ID NO: 4215863 - DNA, 13 bp, Homo sapiens
cctaggaggcctt

SEQ ID NO: 4215864 - DNA, 13 bp, Homo sapiens
cctcactccacac

SEQ ID NO: 4215865 - DNA, 20 bp, Homo sapiens
cctccaattccacagtctct

SEQ ID NO: 4215866 - DNA, 14 bp, Homo sapiens
cctccccctgtccc

SEQ ID NO: 4215867 - DNA, 12 bp, Homo sapiens
cctccctgccct

SEQ ID NO: 4215868 - DNA, 14 bp, Homo sapiens
cctcgctgtcctgc

SEQ ID NO: 4215869 - DNA, 16 bp, Homo sapiens
cctctccagccttctc

SEQ ID NO: 4215870 - DNA, 16 bp, Homo sapiens
cctgaaaattccaatt

SEQ ID NO: 4215871 - DNA, 17 bp, Homo sapiens
cctgactgtgttgtccc

SEQ ID NO: 4215872 - DNA, 17 bp, Homo sapiens
cctgagaggtgctgcag

SEQ ID NO: 4215873 - DNA, 15 bp, Homo sapiens
cctgcacccttcctc

SEQ ID NO: 4215874 - DNA, 19 bp, Homo sapiens
cctgcacccttcctcctcc

SEQ ID NO: 4215875 - DNA, 11 bp, Homo sapiens
cctgcatttta

SEQ ID NO: 4215876 - DNA, 15 bp, Homo sapiens
cctgcccccagcact

SEQ ID NO: 4215877 - DNA, 22 bp, Homo sapiens
cctgctgtgtgaattcccaggt

SEQ ID NO: 4215878 - DNA, 21 bp, Homo sapiens
cctgcttgaaggaacagtgct

SEQ ID NO: 4215879 - DNA, 16 bp, Homo sapiens
cctggagcggctctcc

SEQ ID NO: 4215880 - DNA, 18 bp, Homo sapiens
cctgggcccgctttgcct

SEQ ID NO: 4215881 - DNA, 22 bp, Homo sapiens
cctgggcccgctttgcctgctt

SEQ ID NO: 4215882 - DNA, 23 bp, Homo sapiens
cctgggcccgctttgcctgcttg

SEQ ID NO: 4215883 - DNA, 20 bp, Homo sapiens
cctggtggccatgtcgcctg

SEQ ID NO: 4215884 - DNA, 22 bp, Homo sapiens
cctggtggccatgtcgcctgcc

SEQ ID NO: 4215885 - DNA, 15 bp, Homo sapiens
cctgtaatcccagct

SEQ ID NO: 4215886 - DNA, 14 bp, Homo sapiens
cctgtagagtcact

SEQ ID NO: 4215887 - DNA, 14 bp, Homo sapiens
cctgtcctccagct

SEQ ID NO: 4215888 - DNA, 23 bp, Homo sapiens
cctgtcctttgttattatcctgc

SEQ ID NO: 4215889 - DNA, 22 bp, Homo sapiens
cctgtcttatggcgttgcaggc

SEQ ID NO: 4215890 - DNA, 20 bp, Homo sapiens
ccttcctactttgcttctct

SEQ ID NO: 4215891 - DNA, 16 bp, Homo sapiens
ccttcctcctcctttg

SEQ ID NO: 4215892 - DNA, 19 bp, Homo sapiens
ccttcctcctcctttgcct

SEQ ID NO: 4215893 - DNA, 15 bp, Homo sapiens
ccttctcgcattttc

SEQ ID NO: 4215894 - DNA, 19 bp, Homo sapiens
ccttctcgcattttctcta

SEQ ID NO: 4215895 - DNA, 20 bp, Homo sapiens
ccttctcgcattttctctag

SEQ ID NO: 4215896 - DNA, 22 bp, Homo sapiens
ccttctcgcattttctctagct

SEQ ID NO: 4215897 - DNA, 14 bp, Homo sapiens
ccttctctctctgg

SEQ ID NO: 4215898 - DNA, 15 bp, Homo sapiens
ccttctctctctggt

SEQ ID NO: 4215899 - DNA, 21 bp, Homo sapiens
ccttgcacagcccacacatga

SEQ ID NO: 4215900 - DNA, 18 bp, Homo sapiens
ccttggacattttatgtc

SEQ ID NO: 4215901 - DNA, 21 bp, Homo sapiens
ccttggacattttatgtcttt

SEQ ID NO: 4215902 - DNA, 22 bp, Homo sapiens
cctttgcctaggaggccttctc

SEQ ID NO: 4215903 - DNA, 17 bp, Homo sapiens
cgaaatatcaaagtcat

SEQ ID NO: 4215904 - DNA, 15 bp, Homo sapiens
cgaattttattttac

SEQ ID NO: 4215905 - DNA, 20 bp, Homo sapiens
cgcctgcccccagcactcct

SEQ ID NO: 4215906 - DNA, 16 bp, Homo sapiens
cggctctcctgagagg

SEQ ID NO: 4215907 - DNA, 16 bp, Homo sapiens
cggtcccccctcactc

SEQ ID NO: 4215908 - DNA, 21 bp, Homo sapiens
cggtcccccctcactccacac

SEQ ID NO: 4215909 - DNA, 21 bp, Homo sapiens
cgtctttggaggaacagctcc

SEQ ID NO: 4215910 - DNA, 16 bp, Homo sapiens
cgtttgtgagaagaaa

SEQ ID NO: 4215911 - DNA, 19 bp, Homo sapiens
ctaaaaatagttaacacag

SEQ ID NO: 4215912 - DNA, 13 bp, Homo sapiens
ctaaaatgttcta

SEQ ID NO: 4215913 - DNA, 21 bp, Homo sapiens
ctaaatgttggaattttcaaa

SEQ ID NO: 4215914 - DNA, 20 bp, Homo sapiens
ctaacgaaatatcaaagtca

SEQ ID NO: 4215915 - DNA, 15 bp, Homo sapiens
ctaagttcccttcta

SEQ ID NO: 4215916 - DNA, 19 bp, Homo sapiens
ctaatgaatgcataaaatg

SEQ ID NO: 4215917 - DNA, 21 bp, Homo sapiens
ctaatgttgtctttttaatgt

SEQ ID NO: 4215918 - DNA, 18 bp, Homo sapiens
ctaattatttaattgtcc

SEQ ID NO: 4215919 - DNA, 22 bp, Homo sapiens
ctacaatgggaaaacttcactc

SEQ ID NO: 4215920 - DNA, 19 bp, Homo sapiens
ctacagcctgcccctgact

SEQ ID NO: 4215921 - DNA, 17 bp, Homo sapiens
ctacgttaccaggcagg

SEQ ID NO: 4215922 - DNA, 20 bp, Homo sapiens
ctagaagaaagggcaagaag

SEQ ID NO: 4215923 - DNA, 18 bp, Homo sapiens
ctagctgatcagaatttt

SEQ ID NO: 4215924 - DNA, 19 bp, Homo sapiens
ctagctgatcagaatttta

SEQ ID NO: 4215925 - DNA, 18 bp, Homo sapiens
ctaggacttgagcctcca

SEQ ID NO: 4215926 - DNA, 15 bp, Homo sapiens
ctaggaggccttctc

SEQ ID NO: 4215927 - DNA, 21 bp, Homo sapiens
ctagtctggtgttctgagtac

SEQ ID NO: 4215928 - DNA, 19 bp, Homo sapiens
ctagtgcctacaatgggaa

SEQ ID NO: 4215929 - DNA, 18 bp, Homo sapiens
ctagtggcttcctccgtc

SEQ ID NO: 4215930 - DNA, 23 bp, Homo sapiens
ctagttagctttaagcaccctag

SEQ ID NO: 4215931 - DNA, 22 bp, Homo sapiens
ctatattcctttttctatgaaa

SEQ ID NO: 4215932 - DNA, 21 bp, Homo sapiens
ctatgacctcgccctccacaa

SEQ ID NO: 4215933 - DNA, 17 bp, Homo sapiens
ctatgttaatattttag

SEQ ID NO: 4215934 - DNA, 21 bp, Homo sapiens
ctattaagtcatcatctccaa

SEQ ID NO: 4215935 - DNA, 15 bp, Homo sapiens
ctattagatgtttta

SEQ ID NO: 4215936 - DNA, 17 bp, Homo sapiens
ctattagatgttttaca

SEQ ID NO: 4215937 - DNA, 11 bp, Homo sapiens
ctattggtaaa

SEQ ID NO: 4215938 - DNA, 19 bp, Homo sapiens
ctatttatttatttattca

SEQ ID NO: 4215939 - DNA, 15 bp, Homo sapiens
ctattttctaaagac

SEQ ID NO: 4215940 - DNA, 17 bp, Homo sapiens
ctattttttaaaaaaat

SEQ ID NO: 4215941 - DNA, 18 bp, Homo sapiens
ctcaattctgtttttcgt

SEQ ID NO: 4215942 - DNA, 18 bp, Homo sapiens
ctcacgcctataatccca

SEQ ID NO: 4215943 - DNA, 15 bp, Homo sapiens
ctcactccacactgg

SEQ ID NO: 4215944 - DNA, 13 bp, Homo sapiens
ctcactgccttcc

SEQ ID NO: 4215945 - DNA, 19 bp, Homo sapiens
ctcactgccttccaggagc

SEQ ID NO: 4215946 - DNA, 21 bp, Homo sapiens
ctcacttcctaagttcccttc

SEQ ID NO: 4215947 - DNA, 16 bp, Homo sapiens
ctcagaccaggtggaa

SEQ ID NO: 4215948 - DNA, 17 bp, Homo sapiens
ctcagaccaggtggaat

SEQ ID NO: 4215949 - DNA, 22 bp, Homo sapiens
ctcagagacactgttgataaaa

SEQ ID NO: 4215950 - DNA, 17 bp, Homo sapiens
ctcaggataacagagaa

SEQ ID NO: 4215951 - DNA, 16 bp, Homo sapiens
ctccaaactaaaccct

SEQ ID NO: 4215952 - DNA, 24 bp, Homo sapiens
ctccagccttctctctctggtcag

SEQ ID NO: 4215953 - DNA, 11 bp, Homo sapiens
ctccagctgga

SEQ ID NO: 4215954 - DNA, 19 bp, Homo sapiens
ctccagctgggttggaaaa

SEQ ID NO: 4215955 - DNA, 23 bp, Homo sapiens
ctccagcttcccctcgctgtcct

SEQ ID NO: 4215956 - DNA, 14 bp, Homo sapiens
ctcccagatgtaaa

SEQ ID NO: 4215957 - DNA, 20 bp, Homo sapiens
ctccctgaagtaagcaaaga

SEQ ID NO: 4215958 - DNA, 15 bp, Homo sapiens
ctccctgccctgtcc

SEQ ID NO: 4215959 - DNA, 19 bp, Homo sapiens
ctccctgccctgtcctcca

SEQ ID NO: 4215960 - DNA, 20 bp, Homo sapiens
ctccctgccctgtcctccag

SEQ ID NO: 4215961 - DNA, 13 bp, Homo sapiens
ctcctctgtctct

SEQ ID NO: 4215962 - DNA, 15 bp, Homo sapiens
ctcctctgtctctgc

SEQ ID NO: 4215963 - DNA, 17 bp, Homo sapiens
ctcctctgtctctgctc

SEQ ID NO: 4215964 - DNA, 12 bp, Homo sapiens
ctcctgctgaaa

SEQ ID NO: 4215965 - DNA, 22 bp, Homo sapiens
ctcctgggcccgctttgcctgc

SEQ ID NO: 4215966 - DNA, 11 bp, Homo sapiens
ctcctttgcct

SEQ ID NO: 4215967 - DNA, 23 bp, Homo sapiens
ctcctttgcctaggaggccttct

SEQ ID NO: 4215968 - DNA, 16 bp, Homo sapiens
ctcgctgtcctgctgt

SEQ ID NO: 4215969 - DNA, 12 bp, Homo sapiens
ctcgtatttaat

SEQ ID NO: 4215970 - DNA, 14 bp, Homo sapiens
ctctaaagagcatc

SEQ ID NO: 4215971 - DNA, 22 bp, Homo sapiens
ctctaagttatgactgtgaaat

SEQ ID NO: 4215972 - DNA, 18 bp, Homo sapiens
ctctagcctggcaacaga

SEQ ID NO: 4215973 - DNA, 20 bp, Homo sapiens
ctctagcctggcaacagagc

SEQ ID NO: 4215974 - DNA, 14 bp, Homo sapiens
ctctccagccttct

SEQ ID NO: 4215975 - DNA, 13 bp, Homo sapiens
ctctcctgagagg

SEQ ID NO: 4215976 - DNA, 11 bp, Homo sapiens
ctctctgaggg

SEQ ID NO: 4215977 - DNA, 10 bp, Homo sapiens
ctctcttgcc

SEQ ID NO: 4215978 - DNA, 15 bp, Homo sapiens
ctctgactcttgcct

SEQ ID NO: 4215979 - DNA, 16 bp, Homo sapiens
ctctgctcttgcctgc

SEQ ID NO: 4215980 - DNA, 15 bp, Homo sapiens
ctctgtccctcactg

SEQ ID NO: 4215981 - DNA, 22 bp, Homo sapiens
ctctgtccctcactgccttcca

SEQ ID NO: 4215982 - DNA, 12 bp, Homo sapiens
ctctgtctctgc

SEQ ID NO: 4215983 - DNA, 13 bp, Homo sapiens
ctctgtctctgct

SEQ ID NO: 4215984 - DNA, 16 bp, Homo sapiens
ctctgtctctgctctt

SEQ ID NO: 4215985 - DNA, 17 bp, Homo sapiens
ctctgtctctgctcttg

SEQ ID NO: 4215986 - DNA, 21 bp, Homo sapiens
ctctgtctctgctcttgcctg

SEQ ID NO: 4215987 - DNA, 13 bp, Homo sapiens
ctcttccatttct

SEQ ID NO: 4215988 - DNA, 16 bp, Homo sapiens
ctcttctgtcatcccg

SEQ ID NO: 4215989 - DNA, 18 bp, Homo sapiens
ctcttgcctttccacctg

SEQ ID NO: 4215990 - DNA, 21 bp, Homo sapiens
ctcttgcctttcttatttgca

SEQ ID NO: 4215991 - DNA, 22 bp, Homo sapiens
ctctttctaagagacctgaact

SEQ ID NO: 4215992 - DNA, 17 bp, Homo sapiens
ctgaaaattccaatttg

SEQ ID NO: 4215993 - DNA, 16 bp, Homo sapiens
ctgaaacacctcccag

SEQ ID NO: 4215994 - DNA, 18 bp, Homo sapiens
ctgaagcccatgctttcc

SEQ ID NO: 4215995 - DNA, 19 bp, Homo sapiens
ctgaagcccatgctttccc

SEQ ID NO: 4215996 - DNA, 22 bp, Homo sapiens
ctgaatgtttgaactgccaaga

SEQ ID NO: 4215997 - DNA, 12 bp, Homo sapiens
ctgacacctcac

SEQ ID NO: 4215998 - DNA, 14 bp, Homo sapiens
ctgacacctcactg

SEQ ID NO: 4215999 - DNA, 18 bp, Homo sapiens
ctgacacctcactgagga

SEQ ID NO: 4216000 - DNA, 22 bp, Homo sapiens
ctgaccctggagcggctctcct

SEQ ID NO: 4216001 - DNA, 14 bp, Homo sapiens
ctgagagtgcaaat

SEQ ID NO: 4216002 - DNA, 15 bp, Homo sapiens
ctgaggaagggagac

SEQ ID NO: 4216003 - DNA, 19 bp, Homo sapiens
ctgagtacttgatttcagg

SEQ ID NO: 4216004 - DNA, 22 bp, Homo sapiens
ctgcacccttcctcctcctttg

SEQ ID NO: 4216005 - DNA, 20 bp, Homo sapiens
ctgcattttacgtctttgga

SEQ ID NO: 4216006 - DNA, 17 bp, Homo sapiens
ctgcattttcttcactt

SEQ ID NO: 4216007 - DNA, 15 bp, Homo sapiens
ctgcccccagcactc

SEQ ID NO: 4216008 - DNA, 23 bp, Homo sapiens
ctgcccctgactgtgttgtccca

SEQ ID NO: 4216009 - DNA, 13 bp, Homo sapiens
ctgccttccagga

SEQ ID NO: 4216010 - DNA, 16 bp, Homo sapiens
ctgccttccaggagca

SEQ ID NO: 4216011 - DNA, 19 bp, Homo sapiens
ctgctaataatttgccatt

SEQ ID NO: 4216012 - DNA, 16 bp, Homo sapiens
ctgctctctgagggag

SEQ ID NO: 4216013 - DNA, 17 bp, Homo sapiens
ctgcttgaaggaacagt

SEQ ID NO: 4216014 - DNA, 20 bp, Homo sapiens
ctgcttgaaggaacagtgct

SEQ ID NO: 4216015 - DNA, 14 bp, Homo sapiens
ctgctttctcctgg

SEQ ID NO: 4216016 - DNA, 20 bp, Homo sapiens
ctggaaccacattgaagaat

SEQ ID NO: 4216017 - DNA, 16 bp, Homo sapiens
ctggaattgctgctct

SEQ ID NO: 4216018 - DNA, 17 bp, Homo sapiens
ctggaattgctgctctc

SEQ ID NO: 4216019 - DNA, 17 bp, Homo sapiens
ctggagcggctctcctg

SEQ ID NO: 4216020 - DNA, 22 bp, Homo sapiens
ctggagcggctctcctgagagg

SEQ ID NO: 4216021 - DNA, 14 bp, Homo sapiens
ctggagctgctgtt

SEQ ID NO: 4216022 - DNA, 16 bp, Homo sapiens
ctggagctgctgttcc

SEQ ID NO: 4216023 - DNA, 20 bp, Homo sapiens
ctggatctccattctctcag

SEQ ID NO: 4216024 - DNA, 23 bp, Homo sapiens
ctggattttttatgtacaaccct

SEQ ID NO: 4216025 - DNA, 20 bp, Homo sapiens
ctggcttctagtctggtgtt

SEQ ID NO: 4216026 - DNA, 17 bp, Homo sapiens
ctggtctccctccagct

SEQ ID NO: 4216027 - DNA, 22 bp, Homo sapiens
ctggtggccatgtcgcctgccc

SEQ ID NO: 4216028 - DNA, 21 bp, Homo sapiens
ctggtttagcacaatttatat

SEQ ID NO: 4216029 - DNA, 12 bp, Homo sapiens
ctgtaataatag

SEQ ID NO: 4216030 - DNA, 22 bp, Homo sapiens
ctgtacaggtacaggctggaga

SEQ ID NO: 4216031 - DNA, 22 bp, Homo sapiens
ctgtacttattttccaataaaa

SEQ ID NO: 4216032 - DNA, 19 bp, Homo sapiens
ctgtagagtcactgaccct

SEQ ID NO: 4216033 - DNA, 16 bp, Homo sapiens
ctgtcaatgagagcat

SEQ ID NO: 4216034 - DNA, 14 bp, Homo sapiens
ctgtcatccagaaa

SEQ ID NO: 4216035 - DNA, 13 bp, Homo sapiens
ctgtcatcccgct

SEQ ID NO: 4216036 - DNA, 17 bp, Homo sapiens
ctgtcatcccgctcctg

SEQ ID NO: 4216037 - DNA, 18 bp, Homo sapiens
ctgtcatcccgctcctgc

SEQ ID NO: 4216038 - DNA, 19 bp, Homo sapiens
ctgtcctccagcttcccct

SEQ ID NO: 4216039 - DNA, 16 bp, Homo sapiens
ctgtctctgctcttgc

SEQ ID NO: 4216040 - DNA, 11 bp, Homo sapiens
ctgtctctgtc

SEQ ID NO: 4216041 - DNA, 17 bp, Homo sapiens
ctgtctctgtccctcac

SEQ ID NO: 4216042 - DNA, 16 bp, Homo sapiens
ctgtggtggctgtctc

SEQ ID NO: 4216043 - DNA, 19 bp, Homo sapiens
ctgtggtggctgtctctgt

SEQ ID NO: 4216044 - DNA, 20 bp, Homo sapiens
ctgtggtggctgtctctgtc

SEQ ID NO: 4216045 - DNA, 23 bp, Homo sapiens
ctgtgtactcttaggctaagaga

SEQ ID NO: 4216046 - DNA, 17 bp, Homo sapiens
ctgttcagtttccccat

SEQ ID NO: 4216047 - DNA, 17 bp, Homo sapiens
ctgttgaatttcccaca

SEQ ID NO: 4216048 - DNA, 20 bp, Homo sapiens
cttaaaaaagcaacagtagc

SEQ ID NO: 4216049 - DNA, 20 bp, Homo sapiens
cttaatgctttcctccctgg

SEQ ID NO: 4216050 - DNA, 11 bp, Homo sapiens
cttaatggcac

SEQ ID NO: 4216051 - DNA, 16 bp, Homo sapiens
cttaattattgatgtt

SEQ ID NO: 4216052 - DNA, 15 bp, Homo sapiens
cttactaaaaagtat

SEQ ID NO: 4216053 - DNA, 21 bp, Homo sapiens
cttactaaaaagtataaaata

SEQ ID NO: 4216054 - DNA, 17 bp, Homo sapiens
cttagctttccacagga

SEQ ID NO: 4216055 - DNA, 19 bp, Homo sapiens
cttagctttccacaggagg

SEQ ID NO: 4216056 - DNA, 20 bp, Homo sapiens
cttatatatttgatacatat

SEQ ID NO: 4216057 - DNA, 13 bp, Homo sapiens
cttattactgaga

SEQ ID NO: 4216058 - DNA, 13 bp, Homo sapiens
cttattgaatata

SEQ ID NO: 4216059 - DNA, 15 bp, Homo sapiens
cttatttgcaataaa

SEQ ID NO: 4216060 - DNA, 11 bp, Homo sapiens
cttccacaaac

SEQ ID NO: 4216061 - DNA, 23 bp, Homo sapiens
cttccaccaagttggaacatcct

SEQ ID NO: 4216062 - DNA, 23 bp, Homo sapiens
cttccaggagcaatttgcacatg

SEQ ID NO: 4216063 - DNA, 14 bp, Homo sapiens
cttccatttcttcc

SEQ ID NO: 4216064 - DNA, 23 bp, Homo sapiens
cttcccatgatgccgctcttctg

SEQ ID NO: 4216065 - DNA, 21 bp, Homo sapiens
cttcccctcgctgtcctgctg

SEQ ID NO: 4216066 - DNA, 17 bp, Homo sapiens
cttcctaagttcccttc

SEQ ID NO: 4216067 - DNA, 22 bp, Homo sapiens
cttcctactttgcttctctcca

SEQ ID NO: 4216068 - DNA, 15 bp, Homo sapiens
cttcctcctcctttg

SEQ ID NO: 4216069 - DNA, 12 bp, Homo sapiens
cttcctctccag

SEQ ID NO: 4216070 - DNA, 17 bp, Homo sapiens
cttctagaaccaggcaa

SEQ ID NO: 4216071 - DNA, 12 bp, Homo sapiens
cttctctctctg

SEQ ID NO: 4216072 - DNA, 21 bp, Homo sapiens
cttctgtcatcccgctcctgc

SEQ ID NO: 4216073 - DNA, 22 bp, Homo sapiens
cttctgtcatcccgctcctgct

SEQ ID NO: 4216074 - DNA, 23 bp, Homo sapiens
cttctgtcatcccgctcctgctg

SEQ ID NO: 4216075 - DNA, 23 bp, Homo sapiens
cttcttaatgctttcctccctgg

SEQ ID NO: 4216076 - DNA, 14 bp, Homo sapiens
cttgagcctccatt

SEQ ID NO: 4216077 - DNA, 20 bp, Homo sapiens
cttgcctgcacccttcctcc

SEQ ID NO: 4216078 - DNA, 14 bp, Homo sapiens
cttgcctttccacc

SEQ ID NO: 4216079 - DNA, 16 bp, Homo sapiens
cttgcctttccacctg

SEQ ID NO: 4216080 - DNA, 20 bp, Homo sapiens
cttgcctttccacctgcttt

SEQ ID NO: 4216081 - DNA, 13 bp, Homo sapiens
cttgtattttcca

SEQ ID NO: 4216082 - DNA, 15 bp, Homo sapiens
ctttaggtgcctcct

SEQ ID NO: 4216083 - DNA, 20 bp, Homo sapiens
ctttaggtgcctcctgtctt

SEQ ID NO: 4216084 - DNA, 21 bp, Homo sapiens
ctttatccctgaggtcacctg

SEQ ID NO: 4216085 - DNA, 23 bp, Homo sapiens
ctttcatctattctttccctaga

SEQ ID NO: 4216086 - DNA, 16 bp, Homo sapiens
ctttcccaccagcatg

SEQ ID NO: 4216087 - DNA, 24 bp, Homo sapiens
ctttcccaccagcatgtcactccc

SEQ ID NO: 4216088 - DNA, 14 bp, Homo sapiens
ctttcttatttgca

SEQ ID NO: 4216089 - DNA, 23 bp, Homo sapiens
ctttgaatatgtagtatctatat

SEQ ID NO: 4216090 - DNA, 13 bp, Homo sapiens
ctttgcatattat

SEQ ID NO: 4216091 - DNA, 13 bp, Homo sapiens
ctttgcttctctc

SEQ ID NO: 4216092 - DNA, 15 bp, Homo sapiens
ctttggaggaacagc

SEQ ID NO: 4216093 - DNA, 13 bp, Homo sapiens
cttttatttggaa

SEQ ID NO: 4216094 - DNA, 17 bp, Homo sapiens
cttttgatagtatttat

SEQ ID NO: 4216095 - DNA, 19 bp, Homo sapiens
cttttgatagtatttataa

SEQ ID NO: 4216096 - DNA, 16 bp, Homo sapiens
ctttttattaaaatat

SEQ ID NO: 4216097 - DNA, 12 bp, Homo sapiens
gaaaaaatggca

SEQ ID NO: 4216098 - DNA, 17 bp, Homo sapiens
gaaaaaatggcaagaga

SEQ ID NO: 4216099 - DNA, 21 bp, Homo sapiens
gaaaaaatggcaagagatcat

SEQ ID NO: 4216100 - DNA, 19 bp, Homo sapiens
gaaaacttcactccaaaga

SEQ ID NO: 4216101 - DNA, 21 bp, Homo sapiens
gaaaacttcactccaaagaga

SEQ ID NO: 4216102 - DNA, 22 bp, Homo sapiens
gaaaacttcactccaaagagaa

SEQ ID NO: 4216103 - DNA, 23 bp, Homo sapiens
gaaaacttcactccaaagagaaa

SEQ ID NO: 4216104 - DNA, 14 bp, Homo sapiens
gaaaatgaaatgca

SEQ ID NO: 4216105 - DNA, 22 bp, Homo sapiens
gaaacactgggcttctagaacc

SEQ ID NO: 4216106 - DNA, 19 bp, Homo sapiens
gaaataaaccaaaggaaaa

SEQ ID NO: 4216107 - DNA, 18 bp, Homo sapiens
gaaatacatatgcagata

SEQ ID NO: 4216108 - DNA, 18 bp, Homo sapiens
gaaatagaatgaaaagtt

SEQ ID NO: 4216109 - DNA, 19 bp, Homo sapiens
gaaatgattggtaggaaat

SEQ ID NO: 4216110 - DNA, 21 bp, Homo sapiens
gaaatggaggatctctaaaga

SEQ ID NO: 4216111 - DNA, 23 bp, Homo sapiens
gaaatttgggagagccatacata

SEQ ID NO: 4216112 - DNA, 17 bp, Homo sapiens
gaacagataatccctgt

SEQ ID NO: 4216113 - DNA, 15 bp, Homo sapiens
gaaccatccttccca

SEQ ID NO: 4216114 - DNA, 16 bp, Homo sapiens
gaaccatccttcccat

SEQ ID NO: 4216115 - DNA, 16 bp, Homo sapiens
gaactcctaaatcaag

SEQ ID NO: 4216116 - DNA, 14 bp, Homo sapiens
gaactgccaagaaa

SEQ ID NO: 4216117 - DNA, 15 bp, Homo sapiens
gaagaaaaaatggca

SEQ ID NO: 4216118 - DNA, 20 bp, Homo sapiens
gaagaaaaaatggcaagaga

SEQ ID NO: 4216119 - DNA, 17 bp, Homo sapiens
gaagaccgaattttatt

SEQ ID NO: 4216120 - DNA, 20 bp, Homo sapiens
gaagattctatgttaatatt

SEQ ID NO: 4216121 - DNA, 13 bp, Homo sapiens
gaagtcttctatt

SEQ ID NO: 4216122 - DNA, 23 bp, Homo sapiens
gaatatgtagtatctatatgact

SEQ ID NO: 4216123 - DNA, 14 bp, Homo sapiens
gaatgcataaaatg

SEQ ID NO: 4216124 - DNA, 16 bp, Homo sapiens
gaatgtttgaactgcc

SEQ ID NO: 4216125 - DNA, 15 bp, Homo sapiens
gaattgctgctctct

SEQ ID NO: 4216126 - DNA, 21 bp, Homo sapiens
gaatttaaggagggacaagaa

SEQ ID NO: 4216127 - DNA, 17 bp, Homo sapiens
gaatttcccacataccc

SEQ ID NO: 4216128 - DNA, 22 bp, Homo sapiens
gaattttattttacagagcttg

SEQ ID NO: 4216129 - DNA, 11 bp, Homo sapiens
gacaaatattc

SEQ ID NO: 4216130 - DNA, 13 bp, Homo sapiens
gacacctcactga

SEQ ID NO: 4216131 - DNA, 19 bp, Homo sapiens
gacagatctctgctttgga

SEQ ID NO: 4216132 - DNA, 23 bp, Homo sapiens
gacagatctctgctttggaaatc

SEQ ID NO: 4216133 - DNA, 18 bp, Homo sapiens
gacagcctccccctgtcc

SEQ ID NO: 4216134 - DNA, 20 bp, Homo sapiens
gacagcctccccctgtcccc

SEQ ID NO: 4216135 - DNA, 16 bp, Homo sapiens
gacattttatgtcttt

SEQ ID NO: 4216136 - DNA, 18 bp, Homo sapiens
gaccaggtggaattactt

SEQ ID NO: 4216137 - DNA, 14 bp, Homo sapiens
gaccatcctgtcct

SEQ ID NO: 4216138 - DNA, 19 bp, Homo sapiens
gaccctggagcggctctcc

SEQ ID NO: 4216139 - DNA, 14 bp, Homo sapiens
gaccgaattttatt

SEQ ID NO: 4216140 - DNA, 16 bp, Homo sapiens
gactacagccagaagc

SEQ ID NO: 4216141 - DNA, 20 bp, Homo sapiens
gactcttgcctttccacctg

SEQ ID NO: 4216142 - DNA, 16 bp, Homo sapiens
gacttctcacttccta

SEQ ID NO: 4216143 - DNA, 11 bp, Homo sapiens
gactttcctct

SEQ ID NO: 4216144 - DNA, 20 bp, Homo sapiens
gagacagcgaactagaagaa

SEQ ID NO: 4216145 - DNA, 21 bp, Homo sapiens
gagacggaggttgcagtgagc

SEQ ID NO: 4216146 - DNA, 14 bp, Homo sapiens
gagccatacataaa

SEQ ID NO: 4216147 - DNA, 20 bp, Homo sapiens
gagctaggcatggtggcaca

SEQ ID NO: 4216148 - DNA, 20 bp, Homo sapiens
gaggcgacttcctctccagc

SEQ ID NO: 4216149 - DNA, 16 bp, Homo sapiens
gaggctgaggcaggag

SEQ ID NO: 4216150 - DNA, 19 bp, Homo sapiens
gaggctgaggcaggagaat

SEQ ID NO: 4216151 - DNA, 23 bp, Homo sapiens
gaggctggtctccctccagctgg

SEQ ID NO: 4216152 - DNA, 14 bp, Homo sapiens
gagtgcaaattgta

SEQ ID NO: 4216153 - DNA, 19 bp, Homo sapiens
gataaattgtatgaagatc

SEQ ID NO: 4216154 - DNA, 19 bp, Homo sapiens
gatatataggctattttct

SEQ ID NO: 4216155 - DNA, 21 bp, Homo sapiens
gatatataggctattttctaa

SEQ ID NO: 4216156 - DNA, 15 bp, Homo sapiens
gatattcagatgtat

SEQ ID NO: 4216157 - DNA, 21 bp, Homo sapiens
gatatttttaacttaatggca

SEQ ID NO: 4216158 - DNA, 14 bp, Homo sapiens
gatccaaacagaaa

SEQ ID NO: 4216159 - DNA, 17 bp, Homo sapiens
gatgccctaagtgttga

SEQ ID NO: 4216160 - DNA, 19 bp, Homo sapiens
gatgtctttttattaaaat

SEQ ID NO: 4216161 - DNA, 18 bp, Homo sapiens
gattattttagtctgtca

SEQ ID NO: 4216162 - DNA, 17 bp, Homo sapiens
gattctatgttaatatt

SEQ ID NO: 4216163 - DNA, 16 bp, Homo sapiens
gattgtaatacacata

SEQ ID NO: 4216164 - DNA, 22 bp, Homo sapiens
gattgtaatacacatatctaaa

SEQ ID NO: 4216165 - DNA, 14 bp, Homo sapiens
gatttgtcttccct

SEQ ID NO: 4216166 - DNA, 19 bp, Homo sapiens
gatttgtcttcccttcttt

SEQ ID NO: 4216167 - DNA, 17 bp, Homo sapiens
gcaaaaccccatctcta

SEQ ID NO: 4216168 - DNA, 16 bp, Homo sapiens
gcaaacatttcttaaa

SEQ ID NO: 4216169 - DNA, 18 bp, Homo sapiens
gcaaactttagtgtctct

SEQ ID NO: 4216170 - DNA, 19 bp, Homo sapiens
gcaagactccgtctcaaaa

SEQ ID NO: 4216171 - DNA, 14 bp, Homo sapiens
gcacaatttatatt

SEQ ID NO: 4216172 - DNA, 23 bp, Homo sapiens
gcacatctgggaggctggtctcc

SEQ ID NO: 4216173 - DNA, 15 bp, Homo sapiens
gcacatctgttttgt

SEQ ID NO: 4216174 - DNA, 20 bp, Homo sapiens
gcaccctcatacacagaaac

SEQ ID NO: 4216175 - DNA, 20 bp, Homo sapiens
gcacccttcctcctcctttg

SEQ ID NO: 4216176 - DNA, 21 bp, Homo sapiens
gcactctagcctggcaacaga

SEQ ID NO: 4216177 - DNA, 12 bp, Homo sapiens
gcagcagaagcc

SEQ ID NO: 4216178 - DNA, 13 bp, Homo sapiens
gcagcagaagcca

SEQ ID NO: 4216179 - DNA, 16 bp, Homo sapiens
gcataatttaaaaata

SEQ ID NO: 4216180 - DNA, 22 bp, Homo sapiens
gcatactgccttgtttaatggt

SEQ ID NO: 4216181 - DNA, 17 bp, Homo sapiens
gcatataatgaataaat

SEQ ID NO: 4216182 - DNA, 16 bp, Homo sapiens
gcatattataaaggat

SEQ ID NO: 4216183 - DNA, 22 bp, Homo sapiens
gcatccctttttcataaattat

SEQ ID NO: 4216184 - DNA, 21 bp, Homo sapiens
gcatgattcttccaaggaaat

SEQ ID NO: 4216185 - DNA, 17 bp, Homo sapiens
gcattttctctagctga

SEQ ID NO: 4216186 - DNA, 14 bp, Homo sapiens
gcattttcttcact

SEQ ID NO: 4216187 - DNA, 22 bp, Homo sapiens
gccaaatccatcctgctcttcc

SEQ ID NO: 4216188 - DNA, 22 bp, Homo sapiens
gccaaattttttgtatattaaa

SEQ ID NO: 4216189 - DNA, 12 bp, Homo sapiens
gccactgcactc

SEQ ID NO: 4216190 - DNA, 18 bp, Homo sapiens
gccagccaaatccatcct

SEQ ID NO: 4216191 - DNA, 19 bp, Homo sapiens
gccaggttatgcctcatgc

SEQ ID NO: 4216192 - DNA, 19 bp, Homo sapiens
gccatacataaaagaaata

SEQ ID NO: 4216193 - DNA, 19 bp, Homo sapiens
gccatgtcgcctgccccca

SEQ ID NO: 4216194 - DNA, 23 bp, Homo sapiens
gccgagtttgggccactgcactc

SEQ ID NO: 4216195 - DNA, 17 bp, Homo sapiens
gcctacaatgggaaaac

SEQ ID NO: 4216196 - DNA, 22 bp, Homo sapiens
gcctatgtgcatgcagcatcta

SEQ ID NO: 4216197 - DNA, 18 bp, Homo sapiens
gcctgcacccttcctcct

SEQ ID NO: 4216198 - DNA, 18 bp, Homo sapiens
gcctgcccccagcactcc

SEQ ID NO: 4216199 - DNA, 16 bp, Homo sapiens
gcctgtaatcccagct

SEQ ID NO: 4216200 - DNA, 14 bp, Homo sapiens
gccttctctctctg

SEQ ID NO: 4216201 - DNA, 15 bp, Homo sapiens
gccttctctctctgg

SEQ ID NO: 4216202 - DNA, 23 bp, Homo sapiens
gccttgtttaatggtagttttac

SEQ ID NO: 4216203 - DNA, 22 bp, Homo sapiens
gcctttcttatttgcaataaaa

SEQ ID NO: 4216204 - DNA, 13 bp, Homo sapiens
gcggggctatgcc

SEQ ID NO: 4216205 - DNA, 16 bp, Homo sapiens
gctatcaggagaaagc

SEQ ID NO: 4216206 - DNA, 17 bp, Homo sapiens
gctattttctaaagact

SEQ ID NO: 4216207 - DNA, 12 bp, Homo sapiens
gctccacctgtt

SEQ ID NO: 4216208 - DNA, 21 bp, Homo sapiens
gctccacctgttcaggagctg

SEQ ID NO: 4216209 - DNA, 19 bp, Homo sapiens
gctcccacagaacacagca

SEQ ID NO: 4216210 - DNA, 17 bp, Homo sapiens
gctctcaataaactttt

SEQ ID NO: 4216211 - DNA, 20 bp, Homo sapiens
gctctcctgagaggtgctgc

SEQ ID NO: 4216212 - DNA, 13 bp, Homo sapiens
gctcttgcctgca

SEQ ID NO: 4216213 - DNA, 19 bp, Homo sapiens
gctgaaacacctcccaggg

SEQ ID NO: 4216214 - DNA, 13 bp, Homo sapiens
gctggtctccctc

SEQ ID NO: 4216215 - DNA, 14 bp, Homo sapiens
gctgtcctgctgtg

SEQ ID NO: 4216216 - DNA, 17 bp, Homo sapiens
gctgtcctgctgtgtga

SEQ ID NO: 4216217 - DNA, 12 bp, Homo sapiens
gctgtctctgtc

SEQ ID NO: 4216218 - DNA, 20 bp, Homo sapiens
gctgtctctgtccctcactg

SEQ ID NO: 4216219 - DNA, 18 bp, Homo sapiens
gctgtggtggctgtctct

SEQ ID NO: 4216220 - DNA, 15 bp, Homo sapiens
gcttggttctgtgaa

SEQ ID NO: 4216221 - DNA, 17 bp, Homo sapiens
ggaaattggaagagcac

SEQ ID NO: 4216222 - DNA, 23 bp, Homo sapiens
ggaacagaagaggaaagagagac

SEQ ID NO: 4216223 - DNA, 17 bp, Homo sapiens
ggaaggctgagaggaga

SEQ ID NO: 4216224 - DNA, 18 bp, Homo sapiens
ggaagtatgtatattaaa

SEQ ID NO: 4216225 - DNA, 16 bp, Homo sapiens
ggacttgagcctccat

SEQ ID NO: 4216226 - DNA, 24 bp, Homo sapiens
ggagaaagcttggttctgtgaaca

SEQ ID NO: 4216227 - DNA, 16 bp, Homo sapiens
ggagaagttgccaaga

SEQ ID NO: 4216228 - DNA, 12 bp, Homo sapiens
ggagacagcgaa

SEQ ID NO: 4216229 - DNA, 11 bp, Homo sapiens
ggagacatcac

SEQ ID NO: 4216230 - DNA, 13 bp, Homo sapiens
ggagcaatttgca

SEQ ID NO: 4216231 - DNA, 14 bp, Homo sapiens
ggaggaagaagaca

SEQ ID NO: 4216232 - DNA, 22 bp, Homo sapiens
ggaggctggtctccctccagct

SEQ ID NO: 4216233 - DNA, 12 bp, Homo sapiens
ggagggagagaa

SEQ ID NO: 4216234 - DNA, 12 bp, Homo sapiens
ggattctccagg

SEQ ID NO: 4216235 - DNA, 23 bp, Homo sapiens
ggattttttatgtacaaccctga

SEQ ID NO: 4216236 - DNA, 23 bp, Homo sapiens
ggcaacagagcaagactccgtct

SEQ ID NO: 4216237 - DNA, 22 bp, Homo sapiens
ggcaagagatcatatcctcaga

SEQ ID NO: 4216238 - DNA, 17 bp, Homo sapiens
ggcacacgcctgtaatc

SEQ ID NO: 4216239 - DNA, 10 bp, Homo sapiens
ggcagctgga

SEQ ID NO: 4216240 - DNA, 14 bp, Homo sapiens
ggcaggaaggctga

SEQ ID NO: 4216241 - DNA, 22 bp, Homo sapiens
ggcatccctttttcataaatta

SEQ ID NO: 4216242 - DNA, 17 bp, Homo sapiens
ggcatgaccatcctgtc

SEQ ID NO: 4216243 - DNA, 20 bp, Homo sapiens
ggccagatgcacatccctgg

SEQ ID NO: 4216244 - DNA, 17 bp, Homo sapiens
ggccaggttatgcctca

SEQ ID NO: 4216245 - DNA, 22 bp, Homo sapiens
ggcctggtggccatgtcgcctg

SEQ ID NO: 4216246 - DNA, 16 bp, Homo sapiens
ggcgttgcaggccagg

SEQ ID NO: 4216247 - DNA, 15 bp, Homo sapiens
ggctatgccttgtct

SEQ ID NO: 4216248 - DNA, 18 bp, Homo sapiens
ggctattttctaaagact

SEQ ID NO: 4216249 - DNA, 12 bp, Homo sapiens
ggctctcctgag

SEQ ID NO: 4216250 - DNA, 13 bp, Homo sapiens
ggctgaaagacag

SEQ ID NO: 4216251 - DNA, 20 bp, Homo sapiens
ggcttagttaagtcatccac

SEQ ID NO: 4216252 - DNA, 13 bp, Homo sapiens
gggacagagcaga

SEQ ID NO: 4216253 - DNA, 20 bp, Homo sapiens
ggtaatacttccagaagtgc

SEQ ID NO: 4216254 - DNA, 18 bp, Homo sapiens
ggtaatctgacttctcac

SEQ ID NO: 4216255 - DNA, 15 bp, Homo sapiens
ggtatttacacatac

SEQ ID NO: 4216256 - DNA, 19 bp, Homo sapiens
ggtctccctccagctggaa

SEQ ID NO: 4216257 - DNA, 17 bp, Homo sapiens
ggtgagcacatctggga

SEQ ID NO: 4216258 - DNA, 16 bp, Homo sapiens
ggttatgcctcatgct

SEQ ID NO: 4216259 - DNA, 19 bp, Homo sapiens
ggtttttatatttctcgta

SEQ ID NO: 4216260 - DNA, 16 bp, Homo sapiens
gtaaatacatgcatat

SEQ ID NO: 4216261 - DNA, 17 bp, Homo sapiens
gtaacagttgaagaaaa

SEQ ID NO: 4216262 - DNA, 22 bp, Homo sapiens
gtaactgtttagatgaatgtca

SEQ ID NO: 4216263 - DNA, 11 bp, Homo sapiens
gtacaaccctg

SEQ ID NO: 4216264 - DNA, 13 bp, Homo sapiens
gtacaaccctgac

SEQ ID NO: 4216265 - DNA, 14 bp, Homo sapiens
gtacaaccctgacc

SEQ ID NO: 4216266 - DNA, 19 bp, Homo sapiens
gtacagcatgcatcacgga

SEQ ID NO: 4216267 - DNA, 13 bp, Homo sapiens
gtacaggctggag

SEQ ID NO: 4216268 - DNA, 14 bp, Homo sapiens
gtagaatgttttca

SEQ ID NO: 4216269 - DNA, 23 bp, Homo sapiens
gtatgtatattaaaaaagagaca

SEQ ID NO: 4216270 - DNA, 15 bp, Homo sapiens
gtattattgaagatg

SEQ ID NO: 4216271 - DNA, 23 bp, Homo sapiens
gtattttccatacacatccccag

SEQ ID NO: 4216272 - DNA, 18 bp, Homo sapiens
gtattttttaaaacatca

SEQ ID NO: 4216273 - DNA, 15 bp, Homo sapiens
gtcaaacgtgaaaat

SEQ ID NO: 4216274 - DNA, 17 bp, Homo sapiens
gtcaacatttctcatgt

SEQ ID NO: 4216275 - DNA, 19 bp, Homo sapiens
gtcactgaccctggagcgg

SEQ ID NO: 4216276 - DNA, 16 bp, Homo sapiens
gtcagttgttatttat

SEQ ID NO: 4216277 - DNA, 16 bp, Homo sapiens
gtcatcatctccaaac

SEQ ID NO: 4216278 - DNA, 15 bp, Homo sapiens
gtcatcccgctcctg

SEQ ID NO: 4216279 - DNA, 17 bp, Homo sapiens
gtcattatgttaatatt

SEQ ID NO: 4216280 - DNA, 21 bp, Homo sapiens
gtcctattatattcattcttt

SEQ ID NO: 4216281 - DNA, 13 bp, Homo sapiens
gtccttcaaaggc

SEQ ID NO: 4216282 - DNA, 14 bp, Homo sapiens
gtcgcctgccccca

SEQ ID NO: 4216283 - DNA, 23 bp, Homo sapiens
gtctcaaaaaaagggcaataaat

SEQ ID NO: 4216284 - DNA, 20 bp, Homo sapiens
gtctctgactcttgcctttc

SEQ ID NO: 4216285 - DNA, 16 bp, Homo sapiens
gtctctgctcttgcct

SEQ ID NO: 4216286 - DNA, 17 bp, Homo sapiens
gtctctgctcttgcctg

SEQ ID NO: 4216287 - DNA, 17 bp, Homo sapiens
gtctctgtccctcactg

SEQ ID NO: 4216288 - DNA, 13 bp, Homo sapiens
gtctggtgttctg

SEQ ID NO: 4216289 - DNA, 17 bp, Homo sapiens
gtcttatggcgttgcag

SEQ ID NO: 4216290 - DNA, 13 bp, Homo sapiens
gtcttcccttctt

SEQ ID NO: 4216291 - DNA, 15 bp, Homo sapiens
gtcttcccttctttg

SEQ ID NO: 4216292 - DNA, 14 bp, Homo sapiens
gtcttctatttatt

SEQ ID NO: 4216293 - DNA, 15 bp, Homo sapiens
gtcttggatatatag

SEQ ID NO: 4216294 - DNA, 21 bp, Homo sapiens
gtctttaatataataaaagtt

SEQ ID NO: 4216295 - DNA, 21 bp, Homo sapiens
gtctttggtacaagtttacat

SEQ ID NO: 4216296 - DNA, 19 bp, Homo sapiens
gtgaacaccaacttttatt

SEQ ID NO: 4216297 - DNA, 21 bp, Homo sapiens
gtgacaaagttatatatttat

SEQ ID NO: 4216298 - DNA, 14 bp, Homo sapiens
gtgagactgacacc

SEQ ID NO: 4216299 - DNA, 22 bp, Homo sapiens
gtgagcacatctgggaggctgg

SEQ ID NO: 4216300 - DNA, 12 bp, Homo sapiens
gtgcaaattgta

SEQ ID NO: 4216301 - DNA, 18 bp, Homo sapiens
gtgcatgcagcatctaag

SEQ ID NO: 4216302 - DNA, 16 bp, Homo sapiens
gtgcctacaatgggaa

SEQ ID NO: 4216303 - DNA, 16 bp, Homo sapiens
gtgctgcaggcaaagt

SEQ ID NO: 4216304 - DNA, 21 bp, Homo sapiens
gtgcttcaaatgatccttcct

SEQ ID NO: 4216305 - DNA, 22 bp, Homo sapiens
gtgcttcaaatgatccttccta

SEQ ID NO: 4216306 - DNA, 16 bp, Homo sapiens
gtggaggaagatccaa

SEQ ID NO: 4216307 - DNA, 22 bp, Homo sapiens
gtggccatgtcgcctgccccca

SEQ ID NO: 4216308 - DNA, 23 bp, Homo sapiens
gtggctcacgcctataatcccag

SEQ ID NO: 4216309 - DNA, 22 bp, Homo sapiens
gtggctggaaccacattgaaga

SEQ ID NO: 4216310 - DNA, 15 bp, Homo sapiens
gtggtggctgtctct

SEQ ID NO: 4216311 - DNA, 15 bp, Homo sapiens
gtgtgcaattgtaaa

SEQ ID NO: 4216312 - DNA, 15 bp, Homo sapiens
gtgtgtttctgatct

SEQ ID NO: 4216313 - DNA, 13 bp, Homo sapiens
gtgttaaactttt

SEQ ID NO: 4216314 - DNA, 24 bp, Homo sapiens
gttagttcaatctggattcatatt

SEQ ID NO: 4216315 - DNA, 23 bp, Homo sapiens
gttcaatctggattcatatttaa

SEQ ID NO: 4216316 - DNA, 15 bp, Homo sapiens
gttcctgctaataat

SEQ ID NO: 4216317 - DNA, 12 bp, Homo sapiens
gttgaagaagag

SEQ ID NO: 4216318 - DNA, 15 bp, Homo sapiens
gttgtttataataaa

SEQ ID NO: 4216319 - DNA, 18 bp, Homo sapiens
gttgtttataataaaaat

SEQ ID NO: 4216320 - DNA, 17 bp, Homo sapiens
gtttaatggtagtttta

SEQ ID NO: 4216321 - DNA, 18 bp, Homo sapiens
gtttagatgaatgtcagt

SEQ ID NO: 4216322 - DNA, 14 bp, Homo sapiens
gtttagattttatg

SEQ ID NO: 4216323 - DNA, 22 bp, Homo sapiens
gtttagtgtttctttatctact

SEQ ID NO: 4216324 - DNA, 15 bp, Homo sapiens
gtttataataaaaat

SEQ ID NO: 4216325 - DNA, 20 bp, Homo sapiens
gtttgtcttggatatatagg

SEQ ID NO: 4216326 - DNA, 13 bp, Homo sapiens
taaaaaagagaca

SEQ ID NO: 4216327 - DNA, 13 bp, Homo sapiens
taaaaagtataaa

SEQ ID NO: 4216328 - DNA, 19 bp, Homo sapiens
taaaacatcaattgatatt

SEQ ID NO: 4216329 - DNA, 14 bp, Homo sapiens
taaaagaaataaac

SEQ ID NO: 4216330 - DNA, 13 bp, Homo sapiens
taaaatgtttcat

SEQ ID NO: 4216331 - DNA, 16 bp, Homo sapiens
taaaattaaagctgaa

SEQ ID NO: 4216332 - DNA, 19 bp, Homo sapiens
taaaattaaagctgaaaac

SEQ ID NO: 4216333 - DNA, 16 bp, Homo sapiens
taaacagaaattgcaa

SEQ ID NO: 4216334 - DNA, 15 bp, Homo sapiens
taaagatatttcttt

SEQ ID NO: 4216335 - DNA, 20 bp, Homo sapiens
taaagatatttctttaaatt

SEQ ID NO: 4216336 - DNA, 13 bp, Homo sapiens
taaagcctgaaaa

SEQ ID NO: 4216337 - DNA, 15 bp, Homo sapiens
taaagcctgaaaatt

SEQ ID NO: 4216338 - DNA, 16 bp, Homo sapiens
taaagcctgaaaattc

SEQ ID NO: 4216339 - DNA, 18 bp, Homo sapiens
taaagcctgaaaattcca

SEQ ID NO: 4216340 - DNA, 17 bp, Homo sapiens
taaatcaatcttattac

SEQ ID NO: 4216341 - DNA, 17 bp, Homo sapiens
taaatcattcttactaa

SEQ ID NO: 4216342 - DNA, 16 bp, Homo sapiens
taaatgccctctctga

SEQ ID NO: 4216343 - DNA, 13 bp, Homo sapiens
taaatgtggtaaa

SEQ ID NO: 4216344 - DNA, 20 bp, Homo sapiens
taaatgttggaattttcaaa

SEQ ID NO: 4216345 - DNA, 15 bp, Homo sapiens
taaatgtttatatta

SEQ ID NO: 4216346 - DNA, 23 bp, Homo sapiens
taaattatttgattatttaagac

SEQ ID NO: 4216347 - DNA, 15 bp, Homo sapiens
taacagttgaagaaa

SEQ ID NO: 4216348 - DNA, 23 bp, Homo sapiens
taacagttgaagaaaaaatggca

SEQ ID NO: 4216349 - DNA, 15 bp, Homo sapiens
taacctgtttatata

SEQ ID NO: 4216350 - DNA, 16 bp, Homo sapiens
taactatgttgataaa

SEQ ID NO: 4216351 - DNA, 19 bp, Homo sapiens
taagacaaatattcctttg

SEQ ID NO: 4216352 - DNA, 15 bp, Homo sapiens
taagagttgtatgaa

SEQ ID NO: 4216353 - DNA, 11 bp, Homo sapiens
taagtctctga

SEQ ID NO: 4216354 - DNA, 19 bp, Homo sapiens
taataaaagttattacctt

SEQ ID NO: 4216355 - DNA, 22 bp, Homo sapiens
taatagactgtaacttccaaat

SEQ ID NO: 4216356 - DNA, 16 bp, Homo sapiens
taatataataaaagtt

SEQ ID NO: 4216357 - DNA, 21 bp, Homo sapiens
taatctgacttctcacttcct

SEQ ID NO: 4216358 - DNA, 23 bp, Homo sapiens
taatgatgtcgtttgaatcacag

SEQ ID NO: 4216359 - DNA, 16 bp, Homo sapiens
taatggtagttttaca

SEQ ID NO: 4216360 - DNA, 21 bp, Homo sapiens
taatgttgggtagaaagagat

SEQ ID NO: 4216361 - DNA, 22 bp, Homo sapiens
taattttgaactgtttaacact

SEQ ID NO: 4216362 - DNA, 13 bp, Homo sapiens
taatttttgcaat

SEQ ID NO: 4216363 - DNA, 23 bp, Homo sapiens
tacaaaaatcccaaattcacttt

SEQ ID NO: 4216364 - DNA, 19 bp, Homo sapiens
tacacatccccagccagaa

SEQ ID NO: 4216365 - DNA, 15 bp, Homo sapiens
tacacctgaggctga

SEQ ID NO: 4216366 - DNA, 21 bp, Homo sapiens
tacataccttgttatatgcag

SEQ ID NO: 4216367 - DNA, 15 bp, Homo sapiens
tacatataattcttt

SEQ ID NO: 4216368 - DNA, 18 bp, Homo sapiens
tacctagctaattattta

SEQ ID NO: 4216369 - DNA, 15 bp, Homo sapiens
tactaaaaagtataa

SEQ ID NO: 4216370 - DNA, 21 bp, Homo sapiens
tactaaaaagtataaaatagt

SEQ ID NO: 4216371 - DNA, 19 bp, Homo sapiens
tacttaaattttaaagcct

SEQ ID NO: 4216372 - DNA, 20 bp, Homo sapiens
tacttatatatttgatacat

SEQ ID NO: 4216373 - DNA, 21 bp, Homo sapiens
tacttattaagagcaaacttt

SEQ ID NO: 4216374 - DNA, 15 bp, Homo sapiens
tagaatgaaaagttt

SEQ ID NO: 4216375 - DNA, 20 bp, Homo sapiens
tagatgaatgtcagttgtta

SEQ ID NO: 4216376 - DNA, 16 bp, Homo sapiens
tagcatgaaataaaat

SEQ ID NO: 4216377 - DNA, 20 bp, Homo sapiens
taggctattttctaaagact

SEQ ID NO: 4216378 - DNA, 14 bp, Homo sapiens
taggtgcctcctgt

SEQ ID NO: 4216379 - DNA, 20 bp, Homo sapiens
tagtatttataatataaatc

SEQ ID NO: 4216380 - DNA, 19 bp, Homo sapiens
tagtctggtgttctgagta

SEQ ID NO: 4216381 - DNA, 23 bp, Homo sapiens
tagtctggtgttctgagtacttg

SEQ ID NO: 4216382 - DNA, 20 bp, Homo sapiens
tagtgacaaaattggccaga

SEQ ID NO: 4216383 - DNA, 21 bp, Homo sapiens
tagttccccgtgaacttcctt

SEQ ID NO: 4216384 - DNA, 16 bp, Homo sapiens
tataaaggataaagaa

SEQ ID NO: 4216385 - DNA, 15 bp, Homo sapiens
tataaatcaatctta

SEQ ID NO: 4216386 - DNA, 13 bp, Homo sapiens
tataataaaaata

SEQ ID NO: 4216387 - DNA, 17 bp, Homo sapiens
tataattttgcagcaga

SEQ ID NO: 4216388 - DNA, 13 bp, Homo sapiens
tataggctatttt

SEQ ID NO: 4216389 - DNA, 14 bp, Homo sapiens
tatataggctattt

SEQ ID NO: 4216390 - DNA, 23 bp, Homo sapiens
tatataggctattttctaaagac

SEQ ID NO: 4216391 - DNA, 19 bp, Homo sapiens
tatatatttgatacatata

SEQ ID NO: 4216392 - DNA, 22 bp, Homo sapiens
tatatttttttcaactgccaat

SEQ ID NO: 4216393 - DNA, 12 bp, Homo sapiens
tatgactgtgaa

SEQ ID NO: 4216394 - DNA, 15 bp, Homo sapiens
tatgatttggaaaat

SEQ ID NO: 4216395 - DNA, 18 bp, Homo sapiens
tatgcagatacttattaa

SEQ ID NO: 4216396 - DNA, 17 bp, Homo sapiens
tatgccttgtctgggga

SEQ ID NO: 4216397 - DNA, 14 bp, Homo sapiens
tatgtacaaccctg

SEQ ID NO: 4216398 - DNA, 15 bp, Homo sapiens
tatgtacaaccctga

SEQ ID NO: 4216399 - DNA, 19 bp, Homo sapiens
tatgtagtatctatatgac

SEQ ID NO: 4216400 - DNA, 18 bp, Homo sapiens
tatgtatattaaaaaaga

SEQ ID NO: 4216401 - DNA, 16 bp, Homo sapiens
tatgttaatatttctg

SEQ ID NO: 4216402 - DNA, 14 bp, Homo sapiens
tatgttaatatttt

SEQ ID NO: 4216403 - DNA, 20 bp, Homo sapiens
tatgttgtttataataaaaa

SEQ ID NO: 4216404 - DNA, 22 bp, Homo sapiens
tattaaagatatttctttaaat

SEQ ID NO: 4216405 - DNA, 19 bp, Homo sapiens
tattaagagcaaactttag

SEQ ID NO: 4216406 - DNA, 19 bp, Homo sapiens
tattaggaagtgtttatgt

SEQ ID NO: 4216407 - DNA, 20 bp, Homo sapiens
tattataaaggataaagaag

SEQ ID NO: 4216408 - DNA, 18 bp, Homo sapiens
tattcataagtctttggt

SEQ ID NO: 4216409 - DNA, 15 bp, Homo sapiens
tattctaattttata

SEQ ID NO: 4216410 - DNA, 13 bp, Homo sapiens
tattgatgttttc

SEQ ID NO: 4216411 - DNA, 17 bp, Homo sapiens
tattgtccccactaaaa

SEQ ID NO: 4216412 - DNA, 21 bp, Homo sapiens
tatttaaatcctgaagagcat

SEQ ID NO: 4216413 - DNA, 23 bp, Homo sapiens
tatttaatatgggtgaacaccaa

SEQ ID NO: 4216414 - DNA, 13 bp, Homo sapiens
tatttaatttgaa

SEQ ID NO: 4216415 - DNA, 17 bp, Homo sapiens
tatttaatttttgcaat

SEQ ID NO: 4216416 - DNA, 13 bp, Homo sapiens
tatttacacatac

SEQ ID NO: 4216417 - DNA, 18 bp, Homo sapiens
tatttacacatacaactt

SEQ ID NO: 4216418 - DNA, 13 bp, Homo sapiens
tatttataaaatt

SEQ ID NO: 4216419 - DNA, 22 bp, Homo sapiens
tatttataatataaatcaatct

SEQ ID NO: 4216420 - DNA, 14 bp, Homo sapiens
tatttgatacatat

SEQ ID NO: 4216421 - DNA, 16 bp, Homo sapiens
tatttgatacatataa

SEQ ID NO: 4216422 - DNA, 13 bp, Homo sapiens
tatttgattattt

SEQ ID NO: 4216423 - DNA, 14 bp, Homo sapiens
tatttgattattta

SEQ ID NO: 4216424 - DNA, 9 bp, Homo sapiens
tatttgcaa

SEQ ID NO: 4216425 - DNA, 18 bp, Homo sapiens
tatttggaataataattt

SEQ ID NO: 4216426 - DNA, 21 bp, Homo sapiens
tattttacagagcttgaaaac

SEQ ID NO: 4216427 - DNA, 20 bp, Homo sapiens
tattttccctctcttgcctt

SEQ ID NO: 4216428 - DNA, 21 bp, Homo sapiens
tattttccctctcttgccttt

SEQ ID NO: 4216429 - DNA, 15 bp, Homo sapiens
tcaaacgtgaaaatg

SEQ ID NO: 4216430 - DNA, 13 bp, Homo sapiens
tcaaagtcattaa

SEQ ID NO: 4216431 - DNA, 17 bp, Homo sapiens
tcaaatgatccttccta

SEQ ID NO: 4216432 - DNA, 17 bp, Homo sapiens
tcaacatttctcatgtt

SEQ ID NO: 4216433 - DNA, 14 bp, Homo sapiens
tcaagtgaacatta

SEQ ID NO: 4216434 - DNA, 13 bp, Homo sapiens
tcaatgagagcat

SEQ ID NO: 4216435 - DNA, 17 bp, Homo sapiens
tcaatgctataactatg

SEQ ID NO: 4216436 - DNA, 14 bp, Homo sapiens
tcaattttgtctat

SEQ ID NO: 4216437 - DNA, 22 bp, Homo sapiens
tcacaagtaacagttgaagaaa

SEQ ID NO: 4216438 - DNA, 22 bp, Homo sapiens
tcacacgtctggcttcacagat

SEQ ID NO: 4216439 - DNA, 19 bp, Homo sapiens
tcacactctaagttctatt

SEQ ID NO: 4216440 - DNA, 15 bp, Homo sapiens
tcacctgaaaatgtg

SEQ ID NO: 4216441 - DNA, 16 bp, Homo sapiens
tcacctgaaaatgtgg

SEQ ID NO: 4216442 - DNA, 15 bp, Homo sapiens
tcacctggaatcaga

SEQ ID NO: 4216443 - DNA, 18 bp, Homo sapiens
tcacgcctataatcccag

SEQ ID NO: 4216444 - DNA, 20 bp, Homo sapiens
tcacgcctataatcccagca

SEQ ID NO: 4216445 - DNA, 11 bp, Homo sapiens
tcactcccaga

SEQ ID NO: 4216446 - DNA, 18 bp, Homo sapiens
tcactcccagaccacctc

SEQ ID NO: 4216447 - DNA, 16 bp, Homo sapiens
tcactgaccctggagc

SEQ ID NO: 4216448 - DNA, 12 bp, Homo sapiens
tcactgccttcc

SEQ ID NO: 4216449 - DNA, 20 bp, Homo sapiens
tcacttcctaagttcccttc

SEQ ID NO: 4216450 - DNA, 14 bp, Homo sapiens
tcactttattattt

SEQ ID NO: 4216451 - DNA, 20 bp, Homo sapiens
tcagaccaggtggaattact

SEQ ID NO: 4216452 - DNA, 17 bp, Homo sapiens
tcaggcccactgcagag

SEQ ID NO: 4216453 - DNA, 23 bp, Homo sapiens
tcagtaagttatctttgaatatg

SEQ ID NO: 4216454 - DNA, 15 bp, Homo sapiens
tcagtgcttcgcaga

SEQ ID NO: 4216455 - DNA, 13 bp, Homo sapiens
tcataaattattt

SEQ ID NO: 4216456 - DNA, 22 bp, Homo sapiens
tcatcccaccctctcacagttc

SEQ ID NO: 4216457 - DNA, 23 bp, Homo sapiens
tcatctattctttccctagaggc

SEQ ID NO: 4216458 - DNA, 20 bp, Homo sapiens
tcatcttagctttccacagg

SEQ ID NO: 4216459 - DNA, 15 bp, Homo sapiens
tcatgtacagcatgc

SEQ ID NO: 4216460 - DNA, 23 bp, Homo sapiens
tcattagttttgaagattctatg

SEQ ID NO: 4216461 - DNA, 19 bp, Homo sapiens
tccaaactaccttccagtt

SEQ ID NO: 4216462 - DNA, 16 bp, Homo sapiens
tccaaagagaaaccta

SEQ ID NO: 4216463 - DNA, 21 bp, Homo sapiens
tccaattccacagtctctggg

SEQ ID NO: 4216464 - DNA, 21 bp, Homo sapiens
tccacaaacctggatttttta

SEQ ID NO: 4216465 - DNA, 22 bp, Homo sapiens
tccacattaattagattttctt

SEQ ID NO: 4216466 - DNA, 16 bp, Homo sapiens
tccacgatggtgcagt

SEQ ID NO: 4216467 - DNA, 17 bp, Homo sapiens
tccagaaaatgtgtcag

SEQ ID NO: 4216468 - DNA, 23 bp, Homo sapiens
tccagccagccaaatccatcctg

SEQ ID NO: 4216469 - DNA, 18 bp, Homo sapiens
tccagccttctctctctg

SEQ ID NO: 4216470 - DNA, 21 bp, Homo sapiens
tccagctggaattgctgctct

SEQ ID NO: 4216471 - DNA, 20 bp, Homo sapiens
tccagcttcccctcgctgtc

SEQ ID NO: 4216472 - DNA, 17 bp, Homo sapiens
tccagtttgtcttggat

SEQ ID NO: 4216473 - DNA, 17 bp, Homo sapiens
tccatacacatccccag

SEQ ID NO: 4216474 - DNA, 12 bp, Homo sapiens
tccatttctggc

SEQ ID NO: 4216475 - DNA, 14 bp, Homo sapiens
tccatttcttccac

SEQ ID NO: 4216476 - DNA, 13 bp, Homo sapiens
tcccaccagcatg

SEQ ID NO: 4216477 - DNA, 22 bp, Homo sapiens
tcccagctacacctgaggctga

SEQ ID NO: 4216478 - DNA, 14 bp, Homo sapiens
tccccaattatctt

SEQ ID NO: 4216479 - DNA, 17 bp, Homo sapiens
tccccagccagaagtta

SEQ ID NO: 4216480 - DNA, 15 bp, Homo sapiens
tcccctcgctgtcct

SEQ ID NO: 4216481 - DNA, 13 bp, Homo sapiens
tcccgctcctgct

SEQ ID NO: 4216482 - DNA, 17 bp, Homo sapiens
tccctgccctgtcctcc

SEQ ID NO: 4216483 - DNA, 22 bp, Homo sapiens
tccctgccctgtcctccagctt

SEQ ID NO: 4216484 - DNA, 18 bp, Homo sapiens
tccctggaaggacatcca

SEQ ID NO: 4216485 - DNA, 22 bp, Homo sapiens
tccctggcatgaccatcctgtc

SEQ ID NO: 4216486 - DNA, 15 bp, Homo sapiens
tcccttggacatttt

SEQ ID NO: 4216487 - DNA, 19 bp, Homo sapiens
tcccttggacattttatgt

SEQ ID NO: 4216488 - DNA, 21 bp, Homo sapiens
tcccttggacattttatgtct

SEQ ID NO: 4216489 - DNA, 22 bp, Homo sapiens
tcctcagaccaggtggaattac

SEQ ID NO: 4216490 - DNA, 23 bp, Homo sapiens
tcctcagaccaggtggaattact

SEQ ID NO: 4216491 - DNA, 22 bp, Homo sapiens
tcctccaattccacagtctctg

SEQ ID NO: 4216492 - DNA, 23 bp, Homo sapiens
tcctccaattccacagtctctgg

SEQ ID NO: 4216493 - DNA, 20 bp, Homo sapiens
tcctcctttgcctaggaggc

SEQ ID NO: 4216494 - DNA, 23 bp, Homo sapiens
tcctctccagccttctctctctg

SEQ ID NO: 4216495 - DNA, 15 bp, Homo sapiens
tcctgagaggtgctg

SEQ ID NO: 4216496 - DNA, 14 bp, Homo sapiens
tcctgcctcagcct

SEQ ID NO: 4216497 - DNA, 22 bp, Homo sapiens
tcctgctgaaacacctcccagg

SEQ ID NO: 4216498 - DNA, 23 bp, Homo sapiens
tcctgctgaaacacctcccaggg

SEQ ID NO: 4216499 - DNA, 19 bp, Homo sapiens
tcctgggcccgctttgcct

SEQ ID NO: 4216500 - DNA, 22 bp, Homo sapiens
tcctgggcccgctttgcctgct

SEQ ID NO: 4216501 - DNA, 19 bp, Homo sapiens
tcctgtctacagtttaata

SEQ ID NO: 4216502 - DNA, 15 bp, Homo sapiens
tccttccaccaagtt

SEQ ID NO: 4216503 - DNA, 15 bp, Homo sapiens
tcgagaccagcccag

SEQ ID NO: 4216504 - DNA, 20 bp, Homo sapiens
tcgcctgcccccagcactcc

SEQ ID NO: 4216505 - DNA, 15 bp, Homo sapiens
tcgctgtcctgctgt

SEQ ID NO: 4216506 - DNA, 16 bp, Homo sapiens
tcgctgtcctgctgtg

SEQ ID NO: 4216507 - DNA, 12 bp, Homo sapiens
tctaaagagcat

SEQ ID NO: 4216508 - DNA, 14 bp, Homo sapiens
tctaaagagcatct

SEQ ID NO: 4216509 - DNA, 22 bp, Homo sapiens
tctaaatatcccttggacattt

SEQ ID NO: 4216510 - DNA, 21 bp, Homo sapiens
tctaaatgttggaattttcaa

SEQ ID NO: 4216511 - DNA, 13 bp, Homo sapiens
tctaagttctatt

SEQ ID NO: 4216512 - DNA, 15 bp, Homo sapiens
tctatatcctcaagg

SEQ ID NO: 4216513 - DNA, 17 bp, Homo sapiens
tctatgttttctactcc

SEQ ID NO: 4216514 - DNA, 20 bp, Homo sapiens
tctattcataagtctttggt

SEQ ID NO: 4216515 - DNA, 14 bp, Homo sapiens
tctatttatttatt

SEQ ID NO: 4216516 - DNA, 22 bp, Homo sapiens
tctcaaaaaaagggcaataaat

SEQ ID NO: 4216517 - DNA, 21 bp, Homo sapiens
tctccagccttctctctctgg

SEQ ID NO: 4216518 - DNA, 14 bp, Homo sapiens
tctccctccagctg

SEQ ID NO: 4216519 - DNA, 15 bp, Homo sapiens
tctcctgagaggtgc

SEQ ID NO: 4216520 - DNA, 22 bp, Homo sapiens
tctcctgagaggtgctgcaggc

SEQ ID NO: 4216521 - DNA, 22 bp, Homo sapiens
tctctaagttatgactgtgaaa

SEQ ID NO: 4216522 - DNA, 13 bp, Homo sapiens
tctctctctggtc

SEQ ID NO: 4216523 - DNA, 19 bp, Homo sapiens
tctctgagggagaggctgt

SEQ ID NO: 4216524 - DNA, 15 bp, Homo sapiens
tctctgctcttgcct

SEQ ID NO: 4216525 - DNA, 13 bp, Homo sapiens
tctgactcttgcc

SEQ ID NO: 4216526 - DNA, 17 bp, Homo sapiens
tctgacttctcacttcc

SEQ ID NO: 4216527 - DNA, 13 bp, Homo sapiens
tctgagggagagg

SEQ ID NO: 4216528 - DNA, 16 bp, Homo sapiens
tctgagggagaggctg

SEQ ID NO: 4216529 - DNA, 17 bp, Homo sapiens
tctgagggagaggctgt

SEQ ID NO: 4216530 - DNA, 16 bp, Homo sapiens
tctgatgcaagcaaga

SEQ ID NO: 4216531 - DNA, 21 bp, Homo sapiens
tctgatgcaagcaagaaacac

SEQ ID NO: 4216532 - DNA, 18 bp, Homo sapiens
tctgcaatgtcccttgca

SEQ ID NO: 4216533 - DNA, 19 bp, Homo sapiens
tctggagctgctgttccaa

SEQ ID NO: 4216534 - DNA, 21 bp, Homo sapiens
tctggagctgctgttccaaca

SEQ ID NO: 4216535 - DNA, 19 bp, Homo sapiens
tctgggaggctggtctccc

SEQ ID NO: 4216536 - DNA, 22 bp, Homo sapiens
tctgggaggctggtctccctcc

SEQ ID NO: 4216537 - DNA, 23 bp, Homo sapiens
tctgggaggctggtctccctcca

SEQ ID NO: 4216538 - DNA, 17 bp, Homo sapiens
tctgtccctcactgcct

SEQ ID NO: 4216539 - DNA, 21 bp, Homo sapiens
tctgtctctgctcttgcctgc

SEQ ID NO: 4216540 - DNA, 22 bp, Homo sapiens
tctgtctctgctcttgcctgca

SEQ ID NO: 4216541 - DNA, 13 bp, Homo sapiens
tctgtgtgcaatt

SEQ ID NO: 4216542 - DNA, 21 bp, Homo sapiens
tcttaatgctttcctccctgg

SEQ ID NO: 4216543 - DNA, 22 bp, Homo sapiens
tcttaatgctttcctccctggc

SEQ ID NO: 4216544 - DNA, 17 bp, Homo sapiens
tcttactaaaaagtata

SEQ ID NO: 4216545 - DNA, 21 bp, Homo sapiens
tcttataaagtggaagtatgt

SEQ ID NO: 4216546 - DNA, 12 bp, Homo sapiens
tcttatttgcaa

SEQ ID NO: 4216547 - DNA, 13 bp, Homo sapiens
tcttatttgcaat

SEQ ID NO: 4216548 - DNA, 14 bp, Homo sapiens
tcttatttgcaata

SEQ ID NO: 4216549 - DNA, 12 bp, Homo sapiens
tcttcccttctt

SEQ ID NO: 4216550 - DNA, 12 bp, Homo sapiens
tcttctatttat

SEQ ID NO: 4216551 - DNA, 22 bp, Homo sapiens
tcttctatttatttatttattc

SEQ ID NO: 4216552 - DNA, 15 bp, Homo sapiens
tcttctgtcatcccg

SEQ ID NO: 4216553 - DNA, 18 bp, Homo sapiens
tcttgcctttccacctgc

SEQ ID NO: 4216554 - DNA, 22 bp, Homo sapiens
tcttgcctttccacctgctttc

SEQ ID NO: 4216555 - DNA, 22 bp, Homo sapiens
tcttgcctttcttatttgcaat

SEQ ID NO: 4216556 - DNA, 18 bp, Homo sapiens
tcttggagaactttccat

SEQ ID NO: 4216557 - DNA, 14 bp, Homo sapiens
tctttaatataata

SEQ ID NO: 4216558 - DNA, 17 bp, Homo sapiens
tctttaatataataaaa

SEQ ID NO: 4216559 - DNA, 17 bp, Homo sapiens
tctttaggtgcctcctg

SEQ ID NO: 4216560 - DNA, 16 bp, Homo sapiens
tctttggaggaacagc

SEQ ID NO: 4216561 - DNA, 19 bp, Homo sapiens
tcttttgatagtatttata

SEQ ID NO: 4216562 - DNA, 14 bp, Homo sapiens
tctttttgaaatgt

SEQ ID NO: 4216563 - DNA, 12 bp, Homo sapiens
tgaaaagtttag

SEQ ID NO: 4216564 - DNA, 15 bp, Homo sapiens
tgaaacacctcccag

SEQ ID NO: 4216565 - DNA, 16 bp, Homo sapiens
tgaaacacctcccagg

SEQ ID NO: 4216566 - DNA, 16 bp, Homo sapiens
tgaaagccaaatttat

SEQ ID NO: 4216567 - DNA, 13 bp, Homo sapiens
tgaaataaagtat

SEQ ID NO: 4216568 - DNA, 21 bp, Homo sapiens
tgaaataccaacctgaagaca

SEQ ID NO: 4216569 - DNA, 22 bp, Homo sapiens
tgaacaaagggattctccagga

SEQ ID NO: 4216570 - DNA, 22 bp, Homo sapiens
tgaacccagaaacaacacaatc

SEQ ID NO: 4216571 - DNA, 22 bp, Homo sapiens
tgaactgccaagaaaaggcatg

SEQ ID NO: 4216572 - DNA, 21 bp, Homo sapiens
tgaagattctatgttaatatt

SEQ ID NO: 4216573 - DNA, 18 bp, Homo sapiens
tgaaggtagaatgttttc

SEQ ID NO: 4216574 - DNA, 13 bp, Homo sapiens
tgaagtaagcaaa

SEQ ID NO: 4216575 - DNA, 15 bp, Homo sapiens
tgaagtaagcaaaga

SEQ ID NO: 4216576 - DNA, 22 bp, Homo sapiens
tgaatattactggataaattgt

SEQ ID NO: 4216577 - DNA, 21 bp, Homo sapiens
tgaatgtttgaactgccaaga

SEQ ID NO: 4216578 - DNA, 13 bp, Homo sapiens
tgaattcccaggt

SEQ ID NO: 4216579 - DNA, 20 bp, Homo sapiens
tgaattctggaggaagaaga

SEQ ID NO: 4216580 - DNA, 22 bp, Homo sapiens
tgaccctggagcggctctcctg

SEQ ID NO: 4216581 - DNA, 23 bp, Homo sapiens
tgaccctggagcggctctcctga

SEQ ID NO: 4216582 - DNA, 21 bp, Homo sapiens
tgactcatcaattttgtctat

SEQ ID NO: 4216583 - DNA, 13 bp, Homo sapiens
tgactcttgcctt

SEQ ID NO: 4216584 - DNA, 20 bp, Homo sapiens
tgactcttgcctttccacct

SEQ ID NO: 4216585 - DNA, 16 bp, Homo sapiens
tgagactgacacctca

SEQ ID NO: 4216586 - DNA, 15 bp, Homo sapiens
tgagagcataattta

SEQ ID NO: 4216587 - DNA, 16 bp, Homo sapiens
tgagagtgcaaattgt

SEQ ID NO: 4216588 - DNA, 14 bp, Homo sapiens
tgagcacatctggg

SEQ ID NO: 4216589 - DNA, 15 bp, Homo sapiens
tgagcacatctggga

SEQ ID NO: 4216590 - DNA, 14 bp, Homo sapiens
tgagccatttaatt

SEQ ID NO: 4216591 - DNA, 23 bp, Homo sapiens
tgagcttaagaattttgagcagg

SEQ ID NO: 4216592 - DNA, 16 bp, Homo sapiens
tgaggcaggagaattg

SEQ ID NO: 4216593 - DNA, 17 bp, Homo sapiens
tgagtttaagtctctga

SEQ ID NO: 4216594 - DNA, 22 bp, Homo sapiens
tgagtttaagtctctgactctt

SEQ ID NO: 4216595 - DNA, 14 bp, Homo sapiens
tgataaaaactcag

SEQ ID NO: 4216596 - DNA, 15 bp, Homo sapiens
tgatagtatttataa

SEQ ID NO: 4216597 - DNA, 20 bp, Homo sapiens
tgatccacctgcctcagcct

SEQ ID NO: 4216598 - DNA, 19 bp, Homo sapiens
tgatcccttgagatatgga

SEQ ID NO: 4216599 - DNA, 20 bp, Homo sapiens
tgatctgatgcaagcaagaa

SEQ ID NO: 4216600 - DNA, 15 bp, Homo sapiens
tgatctgtgggcaca

SEQ ID NO: 4216601 - DNA, 18 bp, Homo sapiens
tgatgaaatgtaaatact

SEQ ID NO: 4216602 - DNA, 15 bp, Homo sapiens
tgatgatgaccaaga

SEQ ID NO: 4216603 - DNA, 16 bp, Homo sapiens
tgatgatgaccaagaa

SEQ ID NO: 4216604 - DNA, 17 bp, Homo sapiens
tgatggtgatgaaatgt

SEQ ID NO: 4216605 - DNA, 14 bp, Homo sapiens
tgatttcacagtgt

SEQ ID NO: 4216606 - DNA, 13 bp, Homo sapiens
tgatttgtcttcc

SEQ ID NO: 4216607 - DNA, 16 bp, Homo sapiens
tgcaacttgtaaatgt

SEQ ID NO: 4216608 - DNA, 19 bp, Homo sapiens
tgcaatgtcccttgcacag

SEQ ID NO: 4216609 - DNA, 23 bp, Homo sapiens
tgcaattattctaattttatata

SEQ ID NO: 4216610 - DNA, 12 bp, Homo sapiens
tgcacatccctg

SEQ ID NO: 4216611 - DNA, 16 bp, Homo sapiens
tgcagagttcatggaa

SEQ ID NO: 4216612 - DNA, 23 bp, Homo sapiens
tgcagattattttagtctgtcat

SEQ ID NO: 4216613 - DNA, 15 bp, Homo sapiens
tgcagcagaagccaa

SEQ ID NO: 4216614 - DNA, 22 bp, Homo sapiens
tgcaggccaggttatgcctcat

SEQ ID NO: 4216615 - DNA, 23 bp, Homo sapiens
tgcaggccaggttatgcctcatg

SEQ ID NO: 4216616 - DNA, 16 bp, Homo sapiens
tgcatattataaagga

SEQ ID NO: 4216617 - DNA, 18 bp, Homo sapiens
tgcattgtctttaatata

SEQ ID NO: 4216618 - DNA, 17 bp, Homo sapiens
tgccaagaaaaggcatg

SEQ ID NO: 4216619 - DNA, 16 bp, Homo sapiens
tgccaccgattgcagg

SEQ ID NO: 4216620 - DNA, 17 bp, Homo sapiens
tgccagccactgtgata

SEQ ID NO: 4216621 - DNA, 17 bp, Homo sapiens
tgccgctcttctgtcat

SEQ ID NO: 4216622 - DNA, 20 bp, Homo sapiens
tgccgctcttctgtcatccc

SEQ ID NO: 4216623 - DNA, 19 bp, Homo sapiens
tgcctacaatgggaaaact

SEQ ID NO: 4216624 - DNA, 17 bp, Homo sapiens
tgcctgcacccttcctc

SEQ ID NO: 4216625 - DNA, 17 bp, Homo sapiens
tgccttccaggagcaat

SEQ ID NO: 4216626 - DNA, 19 bp, Homo sapiens
tgctaataatttgccatta

SEQ ID NO: 4216627 - DNA, 19 bp, Homo sapiens
tgctcttccatttcttcca

SEQ ID NO: 4216628 - DNA, 21 bp, Homo sapiens
tgctcttgcctgcacccttcc

SEQ ID NO: 4216629 - DNA, 19 bp, Homo sapiens
tgctgaaacacctcccagg

SEQ ID NO: 4216630 - DNA, 16 bp, Homo sapiens
tgctgctctctgaggg

SEQ ID NO: 4216631 - DNA, 14 bp, Homo sapiens
tgctgtacaaaagc

SEQ ID NO: 4216632 - DNA, 16 bp, Homo sapiens
tgctgttctggagctg

SEQ ID NO: 4216633 - DNA, 19 bp, Homo sapiens
tgcttcaaatgatccttcc

SEQ ID NO: 4216634 - DNA, 12 bp, Homo sapiens
tgctttcctccc

SEQ ID NO: 4216635 - DNA, 15 bp, Homo sapiens
tgctttcctccctgg

SEQ ID NO: 4216636 - DNA, 11 bp, Homo sapiens
tggaaaataaa

SEQ ID NO: 4216637 - DNA, 14 bp, Homo sapiens
tggaaatacacagt

SEQ ID NO: 4216638 - DNA, 23 bp, Homo sapiens
tggaattacttaaattttaaagc

SEQ ID NO: 4216639 - DNA, 11 bp, Homo sapiens
tggacatttta

SEQ ID NO: 4216640 - DNA, 17 bp, Homo sapiens
tggagaactttccatct

SEQ ID NO: 4216641 - DNA, 22 bp, Homo sapiens
tggaggaagatccaaacagaaa

SEQ ID NO: 4216642 - DNA, 14 bp, Homo sapiens
tggattcatattta

SEQ ID NO: 4216643 - DNA, 19 bp, Homo sapiens
tggattgtgcctaatgtgt

SEQ ID NO: 4216644 - DNA, 20 bp, Homo sapiens
tggattgtgcctaatgtgtt

SEQ ID NO: 4216645 - DNA, 13 bp, Homo sapiens
tggcaacagagca

SEQ ID NO: 4216646 - DNA, 16 bp, Homo sapiens
tggccatcaggacttt

SEQ ID NO: 4216647 - DNA, 20 bp, Homo sapiens
tgggaaaacttcactccaaa

SEQ ID NO: 4216648 - DNA, 18 bp, Homo sapiens
tgggagactgctgagtca

SEQ ID NO: 4216649 - DNA, 11 bp, Homo sapiens
tgggaggctga

SEQ ID NO: 4216650 - DNA, 23 bp, Homo sapiens
tggtgagcacatctgggaggctg

SEQ ID NO: 4216651 - DNA, 14 bp, Homo sapiens
tggtggctgtctct

SEQ ID NO: 4216652 - DNA, 19 bp, Homo sapiens
tggtttagcacaatttata

SEQ ID NO: 4216653 - DNA, 17 bp, Homo sapiens
tgtaaacagaaattgca

SEQ ID NO: 4216654 - DNA, 18 bp, Homo sapiens
tgtaactatatcatcctt

SEQ ID NO: 4216655 - DNA, 21 bp, Homo sapiens
tgtaactgtttagatgaatgt

SEQ ID NO: 4216656 - DNA, 14 bp, Homo sapiens
tgtaatacacatat

SEQ ID NO: 4216657 - DNA, 11 bp, Homo sapiens
tgtacaaaagc

SEQ ID NO: 4216658 - DNA, 12 bp, Homo sapiens
tgtacaaccctg

SEQ ID NO: 4216659 - DNA, 13 bp, Homo sapiens
tgtacaaccctga

SEQ ID NO: 4216660 - DNA, 15 bp, Homo sapiens
tgtacaaccctgacc

SEQ ID NO: 4216661 - DNA, 19 bp, Homo sapiens
tgtacaaggtatttacaca

SEQ ID NO: 4216662 - DNA, 16 bp, Homo sapiens
tgtacttattttccaa

SEQ ID NO: 4216663 - DNA, 17 bp, Homo sapiens
tgtacttattttccaat

SEQ ID NO: 4216664 - DNA, 21 bp, Homo sapiens
tgtacttattttccaataaaa

SEQ ID NO: 4216665 - DNA, 12 bp, Homo sapiens
tgtattttccat

SEQ ID NO: 4216666 - DNA, 17 bp, Homo sapiens
tgtcaatgagagcataa

SEQ ID NO: 4216667 - DNA, 19 bp, Homo sapiens
tgtcacgtcttgaaaagcc

SEQ ID NO: 4216668 - DNA, 17 bp, Homo sapiens
tgtcagttgttatttat

SEQ ID NO: 4216669 - DNA, 14 bp, Homo sapiens
tgtcatccagaaaa

SEQ ID NO: 4216670 - DNA, 19 bp, Homo sapiens
tgtcatcccgctcctgctg

SEQ ID NO: 4216671 - DNA, 15 bp, Homo sapiens
tgtcctccagcttcc

SEQ ID NO: 4216672 - DNA, 24 bp, Homo sapiens
tgtcctccagcttcccctcgctgt

SEQ ID NO: 4216673 - DNA, 13 bp, Homo sapiens
tgtcgcctgcccc

SEQ ID NO: 4216674 - DNA, 24 bp, Homo sapiens
tgtcgcctgcccccagcactcctc

SEQ ID NO: 4216675 - DNA, 12 bp, Homo sapiens
tgtctctgtccc

SEQ ID NO: 4216676 - DNA, 13 bp, Homo sapiens
tgtctgttcagtt

SEQ ID NO: 4216677 - DNA, 17 bp, Homo sapiens
tgtgcctaatgtgtttg

SEQ ID NO: 4216678 - DNA, 16 bp, Homo sapiens
tgtggtggctgtctct

SEQ ID NO: 4216679 - DNA, 17 bp, Homo sapiens
tgtggtggctgtctctg

SEQ ID NO: 4216680 - DNA, 13 bp, Homo sapiens
tgtgtcagcatgc

SEQ ID NO: 4216681 - DNA, 14 bp, Homo sapiens
tgtgtcagcatgca

SEQ ID NO: 4216682 - DNA, 13 bp, Homo sapiens
tgtgtttagattt

SEQ ID NO: 4216683 - DNA, 13 bp, Homo sapiens
tgttaatatttta

SEQ ID NO: 4216684 - DNA, 16 bp, Homo sapiens
tgttattatcctgcat

SEQ ID NO: 4216685 - DNA, 19 bp, Homo sapiens
tgttatttattgaaatgat

SEQ ID NO: 4216686 - DNA, 15 bp, Homo sapiens
tgttcagtttcccca

SEQ ID NO: 4216687 - DNA, 15 bp, Homo sapiens
tgttctgagtacttg

SEQ ID NO: 4216688 - DNA, 19 bp, Homo sapiens
tgttctgagtacttgattt

SEQ ID NO: 4216689 - DNA, 16 bp, Homo sapiens
tgttctggagctgctg

SEQ ID NO: 4216690 - DNA, 16 bp, Homo sapiens
tgttggaattttcaaa

SEQ ID NO: 4216691 - DNA, 13 bp, Homo sapiens
tgtttaacacttt

SEQ ID NO: 4216692 - DNA, 15 bp, Homo sapiens
tgtttagatgaatgt

SEQ ID NO: 4216693 - DNA, 18 bp, Homo sapiens
tgtttatataattttgca

SEQ ID NO: 4216694 - DNA, 21 bp, Homo sapiens
tgtttatataattttgcagca

SEQ ID NO: 4216695 - DNA, 19 bp, Homo sapiens
tgtttcattttcattaaaa

SEQ ID NO: 4216696 - DNA, 19 bp, Homo sapiens
tgtttgaactgccaagaaa

SEQ ID NO: 4216697 - DNA, 16 bp, Homo sapiens
tgtttgtgcttcaaat

SEQ ID NO: 4216698 - DNA, 13 bp, Homo sapiens
tgttttcaaatgt

SEQ ID NO: 4216699 - DNA, 13 bp, Homo sapiens
ttaaaaaagagac

SEQ ID NO: 4216700 - DNA, 19 bp, Homo sapiens
ttaaagcctgaaaattcca

SEQ ID NO: 4216701 - DNA, 14 bp, Homo sapiens
ttaaatgtttatat

SEQ ID NO: 4216702 - DNA, 22 bp, Homo sapiens
ttaaatgtttatattagataac

SEQ ID NO: 4216703 - DNA, 18 bp, Homo sapiens
ttaaattttaaagcctga

SEQ ID NO: 4216704 - DNA, 22 bp, Homo sapiens
ttaaattttaaagcctgaaaat

SEQ ID NO: 4216705 - DNA, 20 bp, Homo sapiens
ttaacacagatcaagtgaac

SEQ ID NO: 4216706 - DNA, 16 bp, Homo sapiens
ttaagaactaaaatgt

SEQ ID NO: 4216707 - DNA, 20 bp, Homo sapiens
ttaagaactaaaatgttcta

SEQ ID NO: 4216708 - DNA, 15 bp, Homo sapiens
ttaagtcatcatctc

SEQ ID NO: 4216709 - DNA, 12 bp, Homo sapiens
ttaagtcatcca

SEQ ID NO: 4216710 - DNA, 12 bp, Homo sapiens
ttaagtctctga

SEQ ID NO: 4216711 - DNA, 16 bp, Homo sapiens
ttaatgccttccacat

SEQ ID NO: 4216712 - DNA, 19 bp, Homo sapiens
ttaatgcttgaatattact

SEQ ID NO: 4216713 - DNA, 18 bp, Homo sapiens
ttacctagctaattattt

SEQ ID NO: 4216714 - DNA, 14 bp, Homo sapiens
ttacgtctttggag

SEQ ID NO: 4216715 - DNA, 13 bp, Homo sapiens
ttagattttatga

SEQ ID NO: 4216716 - DNA, 14 bp, Homo sapiens
ttagcacaatttat

SEQ ID NO: 4216717 - DNA, 15 bp, Homo sapiens
ttagcacaatttata

SEQ ID NO: 4216718 - DNA, 13 bp, Homo sapiens
ttaggtgcctcct

SEQ ID NO: 4216719 - DNA, 19 bp, Homo sapiens
ttataaagtggaagtatgt

SEQ ID NO: 4216720 - DNA, 22 bp, Homo sapiens
ttatattagataaccatattca

SEQ ID NO: 4216721 - DNA, 20 bp, Homo sapiens
ttatcaaaatagtctaaggc

SEQ ID NO: 4216722 - DNA, 14 bp, Homo sapiens
ttatccctgaggtc

SEQ ID NO: 4216723 - DNA, 20 bp, Homo sapiens
ttatcttatttaatttttgc

SEQ ID NO: 4216724 - DNA, 12 bp, Homo sapiens
ttatgtacaacc

SEQ ID NO: 4216725 - DNA, 14 bp, Homo sapiens
ttatgtacaaccct

SEQ ID NO: 4216726 - DNA, 15 bp, Homo sapiens
ttatgtacaaccctg

SEQ ID NO: 4216727 - DNA, 16 bp, Homo sapiens
ttatgtacaaccctga

SEQ ID NO: 4216728 - DNA, 14 bp, Homo sapiens
ttattatcctgcat

SEQ ID NO: 4216729 - DNA, 17 bp, Homo sapiens
ttattcaagacaccaaa

SEQ ID NO: 4216730 - DNA, 16 bp, Homo sapiens
ttattgaatatatgat

SEQ ID NO: 4216731 - DNA, 20 bp, Homo sapiens
ttattgtcttcctgtaagac

SEQ ID NO: 4216732 - DNA, 14 bp, Homo sapiens
ttatttaagactaa

SEQ ID NO: 4216733 - DNA, 15 bp, Homo sapiens
ttatttaagactaaa

SEQ ID NO: 4216734 - DNA, 11 bp, Homo sapiens
ttatttgcaat

SEQ ID NO: 4216735 - DNA, 13 bp, Homo sapiens
ttattttccaata

SEQ ID NO: 4216736 - DNA, 22 bp, Homo sapiens
ttcaaatgatccttcctacttt

SEQ ID NO: 4216737 - DNA, 20 bp, Homo sapiens
ttcaatctggattcatattt

SEQ ID NO: 4216738 - DNA, 14 bp, Homo sapiens
ttcataaatctatt

SEQ ID NO: 4216739 - DNA, 16 bp, Homo sapiens
ttcatgtacagcatgc

SEQ ID NO: 4216740 - DNA, 19 bp, Homo sapiens
ttcattctttttgaaatgt

SEQ ID NO: 4216741 - DNA, 20 bp, Homo sapiens
ttccaaacttctaaatgttg

SEQ ID NO: 4216742 - DNA, 14 bp, Homo sapiens
ttccaaataaataa

SEQ ID NO: 4216743 - DNA, 13 bp, Homo sapiens
ttccaacagacag

SEQ ID NO: 4216744 - DNA, 16 bp, Homo sapiens
ttccaacagacagggc

SEQ ID NO: 4216745 - DNA, 13 bp, Homo sapiens
ttccaaggaaata

SEQ ID NO: 4216746 - DNA, 22 bp, Homo sapiens
ttccaagggttgaattctggag

SEQ ID NO: 4216747 - DNA, 23 bp, Homo sapiens
ttccacaggagggagagaactta

SEQ ID NO: 4216748 - DNA, 20 bp, Homo sapiens
ttccacctgctttctcctgg

SEQ ID NO: 4216749 - DNA, 22 bp, Homo sapiens
ttccatctgcttgtattttcca

SEQ ID NO: 4216750 - DNA, 14 bp, Homo sapiens
ttcccaccagcatg

SEQ ID NO: 4216751 - DNA, 15 bp, Homo sapiens
ttcccaccagcatgt

SEQ ID NO: 4216752 - DNA, 20 bp, Homo sapiens
ttccccatttgtttgtgctt

SEQ ID NO: 4216753 - DNA, 21 bp, Homo sapiens
ttcccctcgctgtcctgctgt

SEQ ID NO: 4216754 - DNA, 23 bp, Homo sapiens
ttccctctcttgcctttcttatt

SEQ ID NO: 4216755 - DNA, 20 bp, Homo sapiens
ttcctactttgcttctctcc

SEQ ID NO: 4216756 - DNA, 13 bp, Homo sapiens
ttcctccctggca

SEQ ID NO: 4216757 - DNA, 14 bp, Homo sapiens
ttcctctccagcct

SEQ ID NO: 4216758 - DNA, 21 bp, Homo sapiens
ttcctctccagccttctctct

SEQ ID NO: 4216759 - DNA, 23 bp, Homo sapiens
ttcctgctaataatttgccatta

SEQ ID NO: 4216760 - DNA, 15 bp, Homo sapiens
ttcgagaccagccca

SEQ ID NO: 4216761 - DNA, 16 bp, Homo sapiens
ttctagtctggtgttc

SEQ ID NO: 4216762 - DNA, 20 bp, Homo sapiens
ttctagtctggtgttctgag

SEQ ID NO: 4216763 - DNA, 22 bp, Homo sapiens
ttctcatgttgaaactttaaga

SEQ ID NO: 4216764 - DNA, 17 bp, Homo sapiens
ttctccaggattccaaa

SEQ ID NO: 4216765 - DNA, 18 bp, Homo sapiens
ttctccaggattccaaag

SEQ ID NO: 4216766 - DNA, 19 bp, Homo sapiens
ttctccaggattccaaagt

SEQ ID NO: 4216767 - DNA, 17 bp, Homo sapiens
ttctccagtcattatgt

SEQ ID NO: 4216768 - DNA, 19 bp, Homo sapiens
ttctccagtcattatgtta

SEQ ID NO: 4216769 - DNA, 21 bp, Homo sapiens
ttctcctgggcccgctttgcc

SEQ ID NO: 4216770 - DNA, 22 bp, Homo sapiens
ttctcctgggcccgctttgcct

SEQ ID NO: 4216771 - DNA, 20 bp, Homo sapiens
ttctctagctgatcagaatt

SEQ ID NO: 4216772 - DNA, 13 bp, Homo sapiens
ttctctctctggt

SEQ ID NO: 4216773 - DNA, 23 bp, Homo sapiens
ttctgagtacttgatttcaggtc

SEQ ID NO: 4216774 - DNA, 12 bp, Homo sapiens
ttctggagctgc

SEQ ID NO: 4216775 - DNA, 12 bp, Homo sapiens
ttctgtcatccc

SEQ ID NO: 4216776 - DNA, 21 bp, Homo sapiens
ttctgtcatcccgctcctgct

SEQ ID NO: 4216777 - DNA, 19 bp, Homo sapiens
ttctgtttaattttcactt

SEQ ID NO: 4216778 - DNA, 15 bp, Homo sapiens
ttcttactaaaaagt

SEQ ID NO: 4216779 - DNA, 18 bp, Homo sapiens
ttcttactaaaaagtata

SEQ ID NO: 4216780 - DNA, 14 bp, Homo sapiens
ttcttggagaactt

SEQ ID NO: 4216781 - DNA, 15 bp, Homo sapiens
ttcttggagaacttt

SEQ ID NO: 4216782 - DNA, 20 bp, Homo sapiens
ttctttaggtgcctcctgtc

SEQ ID NO: 4216783 - DNA, 23 bp, Homo sapiens
ttctttaggtgcctcctgtctta

SEQ ID NO: 4216784 - DNA, 15 bp, Homo sapiens
ttctttttgaaatgt

SEQ ID NO: 4216785 - DNA, 15 bp, Homo sapiens
ttgaactgccaagaa

SEQ ID NO: 4216786 - DNA, 19 bp, Homo sapiens
ttgaactgtttaacacttt

SEQ ID NO: 4216787 - DNA, 13 bp, Homo sapiens
ttgaagattctat

SEQ ID NO: 4216788 - DNA, 22 bp, Homo sapiens
ttgaagattctatgttaatatt

SEQ ID NO: 4216789 - DNA, 23 bp, Homo sapiens
ttgaagattctatgttaatattt

SEQ ID NO: 4216790 - DNA, 20 bp, Homo sapiens
ttgaagtcatcttagctttc

SEQ ID NO: 4216791 - DNA, 13 bp, Homo sapiens
ttgaatatatgat

SEQ ID NO: 4216792 - DNA, 13 bp, Homo sapiens
ttgaattctggag

SEQ ID NO: 4216793 - DNA, 18 bp, Homo sapiens
ttgagcctccatttctgg

SEQ ID NO: 4216794 - DNA, 17 bp, Homo sapiens
ttgagtttaagtctctg

SEQ ID NO: 4216795 - DNA, 15 bp, Homo sapiens
ttgatgaaggagttt

SEQ ID NO: 4216796 - DNA, 14 bp, Homo sapiens
ttgcaattattcta

SEQ ID NO: 4216797 - DNA, 17 bp, Homo sapiens
ttgcaattattctaatt

SEQ ID NO: 4216798 - DNA, 15 bp, Homo sapiens
ttgcctttccacctg

SEQ ID NO: 4216799 - DNA, 13 bp, Homo sapiens
ttgctgtacaaaa

SEQ ID NO: 4216800 - DNA, 20 bp, Homo sapiens
ttggacattttatgtctttc

SEQ ID NO: 4216801 - DNA, 21 bp, Homo sapiens
ttgggagagccatacataaaa

SEQ ID NO: 4216802 - DNA, 17 bp, Homo sapiens
ttgggccactgcactct

SEQ ID NO: 4216803 - DNA, 23 bp, Homo sapiens
ttgggccactgcactctagcctg

SEQ ID NO: 4216804 - DNA, 18 bp, Homo sapiens
ttgtaaacagaaattgca

SEQ ID NO: 4216805 - DNA, 21 bp, Homo sapiens
ttgtaaatgtggtaaagagtt

SEQ ID NO: 4216806 - DNA, 22 bp, Homo sapiens
ttgtgaaggcaggggaatgtat

SEQ ID NO: 4216807 - DNA, 18 bp, Homo sapiens
ttgtgcctaatgtgtttg

SEQ ID NO: 4216808 - DNA, 15 bp, Homo sapiens
ttgttatttattgaa

SEQ ID NO: 4216809 - DNA, 23 bp, Homo sapiens
ttgtttaatggtagttttacagt

SEQ ID NO: 4216810 - DNA, 15 bp, Homo sapiens
ttgtttataataaaa

SEQ ID NO: 4216811 - DNA, 12 bp, Homo sapiens
tttaaaaattgt

SEQ ID NO: 4216812 - DNA, 15 bp, Homo sapiens
tttaaaaattgttat

SEQ ID NO: 4216813 - DNA, 19 bp, Homo sapiens
tttaaatcctgaagagcat

SEQ ID NO: 4216814 - DNA, 22 bp, Homo sapiens
tttaaatgacatttttgataaa

SEQ ID NO: 4216815 - DNA, 21 bp, Homo sapiens
tttaaggagggacaagaatca

SEQ ID NO: 4216816 - DNA, 13 bp, Homo sapiens
tttaatgccttcc

SEQ ID NO: 4216817 - DNA, 19 bp, Homo sapiens
tttacatattatcatgtct

SEQ ID NO: 4216818 - DNA, 14 bp, Homo sapiens
tttaggtgcctcct

SEQ ID NO: 4216819 - DNA, 13 bp, Homo sapiens
tttagtctgtcat

SEQ ID NO: 4216820 - DNA, 15 bp, Homo sapiens
tttatataattttgc

SEQ ID NO: 4216821 - DNA, 20 bp, Homo sapiens
tttatattagataaccatat

SEQ ID NO: 4216822 - DNA, 12 bp, Homo sapiens
tttatatttctc

SEQ ID NO: 4216823 - DNA, 20 bp, Homo sapiens
tttatctcctgtctacagtt

SEQ ID NO: 4216824 - DNA, 17 bp, Homo sapiens
tttatgtacaaccctga

SEQ ID NO: 4216825 - DNA, 15 bp, Homo sapiens
tttatttggaataat

SEQ ID NO: 4216826 - DNA, 21 bp, Homo sapiens
tttcaaaaattgtgtttagat

SEQ ID NO: 4216827 - DNA, 13 bp, Homo sapiens
tttcattaaaaat

SEQ ID NO: 4216828 - DNA, 17 bp, Homo sapiens
tttcattttcattaaaa

SEQ ID NO: 4216829 - DNA, 19 bp, Homo sapiens
tttccacctgctttctcct

SEQ ID NO: 4216830 - DNA, 17 bp, Homo sapiens
tttctaagagacctgaa

SEQ ID NO: 4216831 - DNA, 13 bp, Homo sapiens
tttctcatgttga

SEQ ID NO: 4216832 - DNA, 13 bp, Homo sapiens
tttcttaaaatgt

SEQ ID NO: 4216833 - DNA, 16 bp, Homo sapiens
tttgaagattctatgt

SEQ ID NO: 4216834 - DNA, 22 bp, Homo sapiens
tttgataaattatgtttgtact

SEQ ID NO: 4216835 - DNA, 18 bp, Homo sapiens
tttgatagtatttataat

SEQ ID NO: 4216836 - DNA, 18 bp, Homo sapiens
tttgcaattattctaatt

SEQ ID NO: 4216837 - DNA, 18 bp, Homo sapiens
tttgcactgaggatattc

SEQ ID NO: 4216838 - DNA, 18 bp, Homo sapiens
tttgcactgctcaattct

SEQ ID NO: 4216839 - DNA, 19 bp, Homo sapiens
tttgcagattattttagtc

SEQ ID NO: 4216840 - DNA, 15 bp, Homo sapiens
tttgccagtgggaac

SEQ ID NO: 4216841 - DNA, 16 bp, Homo sapiens
tttgccagtgggaact

SEQ ID NO: 4216842 - DNA, 19 bp, Homo sapiens
tttgcctaggaggccttct

SEQ ID NO: 4216843 - DNA, 18 bp, Homo sapiens
tttgggccactgcactct

SEQ ID NO: 4216844 - DNA, 23 bp, Homo sapiens
tttgggccactgcactctagcct

SEQ ID NO: 4216845 - DNA, 21 bp, Homo sapiens
tttggtccttcaaaggcttgt

SEQ ID NO: 4216846 - DNA, 22 bp, Homo sapiens
tttgtaactgtttagatgaatg

SEQ ID NO: 4216847 - DNA, 23 bp, Homo sapiens
tttgtaactgtttagatgaatgt

SEQ ID NO: 4216848 - DNA, 14 bp, Homo sapiens
tttgtgagaagaaa

SEQ ID NO: 4216849 - DNA, 15 bp, Homo sapiens
ttttaaaaaggcagt

SEQ ID NO: 4216850 - DNA, 20 bp, Homo sapiens
ttttaaaccctattggtaaa

SEQ ID NO: 4216851 - DNA, 16 bp, Homo sapiens
ttttaaatgtttatat

SEQ ID NO: 4216852 - DNA, 14 bp, Homo sapiens
ttttaatgccttcc

SEQ ID NO: 4216853 - DNA, 20 bp, Homo sapiens
ttttacagagcttgaaaact

SEQ ID NO: 4216854 - DNA, 16 bp, Homo sapiens
ttttaccaagtacaaa

SEQ ID NO: 4216855 - DNA, 13 bp, Homo sapiens
ttttatgtacaac

SEQ ID NO: 4216856 - DNA, 18 bp, Homo sapiens
ttttatgtacaaccctga

SEQ ID NO: 4216857 - DNA, 19 bp, Homo sapiens
ttttattaaaatatttcag

SEQ ID NO: 4216858 - DNA, 18 bp, Homo sapiens
ttttcaaaaattgtgttt

SEQ ID NO: 4216859 - DNA, 17 bp, Homo sapiens
ttttccaataaaatttt

SEQ ID NO: 4216860 - DNA, 19 bp, Homo sapiens
ttttccgctcttaattaaa

SEQ ID NO: 4216861 - DNA, 22 bp, Homo sapiens
ttttggcaatgactcaaagtct

SEQ ID NO: 4216862 - DNA, 15 bp, Homo sapiens
tttttaacctgttta

SEQ ID NO: 4216863 - DNA, 14 bp, Homo sapiens
tttttattaaaata

SEQ ID NO: 4216864 - DNA, 21 bp, Homo sapiens
aaaaaataaatataattggga

SEQ ID NO: 4216865 - DNA, 12 bp, Homo sapiens
aaaaaatgaaat

SEQ ID NO: 4216866 - DNA, 19 bp, Homo sapiens
aaaaacagcctcacagaag

SEQ ID NO: 4216867 - DNA, 14 bp, Homo sapiens
aaaaaccataaaca

SEQ ID NO: 4216868 - DNA, 18 bp, Homo sapiens
aaaaaccataaacatttg

SEQ ID NO: 4216869 - DNA, 19 bp, Homo sapiens
aaaaactttctctttgcca

SEQ ID NO: 4216870 - DNA, 22 bp, Homo sapiens
aaaaactttctctttgccattt

SEQ ID NO: 4216871 - DNA, 11 bp, Homo sapiens
aaaaaggaaaa

SEQ ID NO: 4216872 - DNA, 18 bp, Homo sapiens
aaaaagtttgccagaagt

SEQ ID NO: 4216873 - DNA, 11 bp, Homo sapiens
aaaaataaata

SEQ ID NO: 4216874 - DNA, 13 bp, Homo sapiens
aaaaataaatata

SEQ ID NO: 4216875 - DNA, 20 bp, Homo sapiens
aaaaattgaaaaataaaaac

SEQ ID NO: 4216876 - DNA, 14 bp, Homo sapiens
aaaacactttccca

SEQ ID NO: 4216877 - DNA, 19 bp, Homo sapiens
aaaacatgagaaatgtgaa

SEQ ID NO: 4216878 - DNA, 21 bp, Homo sapiens
aaaacatgagaaatgtgaact

SEQ ID NO: 4216879 - DNA, 20 bp, Homo sapiens
aaaaccaaaagtgcattcaa

SEQ ID NO: 4216880 - DNA, 18 bp, Homo sapiens
aaaaccataaacatttgc

SEQ ID NO: 4216881 - DNA, 15 bp, Homo sapiens
aaaagaaaaaggaaa

SEQ ID NO: 4216882 - DNA, 16 bp, Homo sapiens
aaaagaagagccttgt

SEQ ID NO: 4216883 - DNA, 24 bp, Homo sapiens
aaaagaaggtatttttccaatcac

SEQ ID NO: 4216884 - DNA, 23 bp, Homo sapiens
aaaagatgtatatttgcatattt

SEQ ID NO: 4216885 - DNA, 11 bp, Homo sapiens
aaaagccaaaa

SEQ ID NO: 4216886 - DNA, 19 bp, Homo sapiens
aaaagtgcattcaacctta

SEQ ID NO: 4216887 - DNA, 16 bp, Homo sapiens
aaaagtttgccagaag

SEQ ID NO: 4216888 - DNA, 14 bp, Homo sapiens
aaaataaaaaccat

SEQ ID NO: 4216889 - DNA, 18 bp, Homo sapiens
aaaatagcttattataga

SEQ ID NO: 4216890 - DNA, 17 bp, Homo sapiens
aaaatatattttatgat

SEQ ID NO: 4216891 - DNA, 17 bp, Homo sapiens
aaaatattttagatgtt

SEQ ID NO: 4216892 - DNA, 13 bp, Homo sapiens
aaaatcactgtca

SEQ ID NO: 4216893 - DNA, 18 bp, Homo sapiens
aaaatccagtattatatt

SEQ ID NO: 4216894 - DNA, 14 bp, Homo sapiens
aaaatcctgaataa

SEQ ID NO: 4216895 - DNA, 23 bp, Homo sapiens
aaaatgctgtattagtcacagag

SEQ ID NO: 4216896 - DNA, 14 bp, Homo sapiens
aaaatgcttctgtt

SEQ ID NO: 4216897 - DNA, 15 bp, Homo sapiens
aaaattgaaaaataa

SEQ ID NO: 4216898 - DNA, 21 bp, Homo sapiens
aaaatttttacaaaactgcca

SEQ ID NO: 4216899 - DNA, 18 bp, Homo sapiens
aaacagtgcctgctgaat

SEQ ID NO: 4216900 - DNA, 19 bp, Homo sapiens
aaacatgaatcctgtgata

SEQ ID NO: 4216901 - DNA, 16 bp, Homo sapiens
aaacatgctagtgata

SEQ ID NO: 4216902 - DNA, 15 bp, Homo sapiens
aaacatggaaaacag

SEQ ID NO: 4216903 - DNA, 13 bp, Homo sapiens
aaacatttgcacc

SEQ ID NO: 4216904 - DNA, 13 bp, Homo sapiens
aaaccaaaataaa

SEQ ID NO: 4216905 - DNA, 15 bp, Homo sapiens
aaaccagtatcgtta

SEQ ID NO: 4216906 - DNA, 20 bp, Homo sapiens
aaaccataaacatttgcacc

SEQ ID NO: 4216907 - DNA, 15 bp, Homo sapiens
aaacccaaacttcca

SEQ ID NO: 4216908 - DNA, 11 bp, Homo sapiens
aaacccagaga

SEQ ID NO: 4216909 - DNA, 12 bp, Homo sapiens
aaacccagagag

SEQ ID NO: 4216910 - DNA, 12 bp, Homo sapiens
aaacgtgaaaat

SEQ ID NO: 4216911 - DNA, 19 bp, Homo sapiens
aaactacctcaaaacactt

SEQ ID NO: 4216912 - DNA, 17 bp, Homo sapiens
aaactttctctttgcca

SEQ ID NO: 4216913 - DNA, 21 bp, Homo sapiens
aaactttctctttgccatttc

SEQ ID NO: 4216914 - DNA, 22 bp, Homo sapiens
aaagaaaaaaaaaagaaaaagg

SEQ ID NO: 4216915 - DNA, 16 bp, Homo sapiens
aaagaaaaaaatatat

SEQ ID NO: 4216916 - DNA, 13 bp, Homo sapiens
aaagaaatatatt

SEQ ID NO: 4216917 - DNA, 20 bp, Homo sapiens
aaagaaatttgaaaaaactt

SEQ ID NO: 4216918 - DNA, 18 bp, Homo sapiens
aaagaaggtatttttcca

SEQ ID NO: 4216919 - DNA, 14 bp, Homo sapiens
aaagaatctatcac

SEQ ID NO: 4216920 - DNA, 21 bp, Homo sapiens
aaagaccatgcatttaaagta

SEQ ID NO: 4216921 - DNA, 23 bp, Homo sapiens
aaagagcaagtctggatctggga

SEQ ID NO: 4216922 - DNA, 22 bp, Homo sapiens
aaagcaaaaagatgtatatttg

SEQ ID NO: 4216923 - DNA, 14 bp, Homo sapiens
aaagcaattgtgaa

SEQ ID NO: 4216924 - DNA, 19 bp, Homo sapiens
aaagccaaaaaatgggaga

SEQ ID NO: 4216925 - DNA, 19 bp, Homo sapiens
aaaggatgtaaacagtgcc

SEQ ID NO: 4216926 - DNA, 21 bp, Homo sapiens
aaaggtgcctgtgaggcaggg

SEQ ID NO: 4216927 - DNA, 14 bp, Homo sapiens
aaagtatcaaagaa

SEQ ID NO: 4216928 - DNA, 22 bp, Homo sapiens
aaagtgcattcaaccttaccaa

SEQ ID NO: 4216929 - DNA, 11 bp, Homo sapiens
aaataaatata

SEQ ID NO: 4216930 - DNA, 12 bp, Homo sapiens
aaataaatataa

SEQ ID NO: 4216931 - DNA, 13 bp, Homo sapiens
aaataaatataat

SEQ ID NO: 4216932 - DNA, 21 bp, Homo sapiens
aaatagccgggcatggtggcg

SEQ ID NO: 4216933 - DNA, 16 bp, Homo sapiens
aaatagtaaaaataaa

SEQ ID NO: 4216934 - DNA, 19 bp, Homo sapiens
aaatagttttaaatatgaa

SEQ ID NO: 4216935 - DNA, 21 bp, Homo sapiens
aaatataattgggattttaaa

SEQ ID NO: 4216936 - DNA, 12 bp, Homo sapiens
aaatatgaacaa

SEQ ID NO: 4216937 - DNA, 13 bp, Homo sapiens
aaatatgaacaaa

SEQ ID NO: 4216938 - DNA, 12 bp, Homo sapiens
aaatcctctggc

SEQ ID NO: 4216939 - DNA, 11 bp, Homo sapiens
aaatctgaaga

SEQ ID NO: 4216940 - DNA, 20 bp, Homo sapiens
aaatgcatccattcctcagg

SEQ ID NO: 4216941 - DNA, 22 bp, Homo sapiens
aaatgcatccattcctcaggga

SEQ ID NO: 4216942 - DNA, 18 bp, Homo sapiens
aaatgcttctgttgtaat

SEQ ID NO: 4216943 - DNA, 23 bp, Homo sapiens
aaatgtcaacctttgtaagaaaa

SEQ ID NO: 4216944 - DNA, 14 bp, Homo sapiens
aaatgtcagagcta

SEQ ID NO: 4216945 - DNA, 21 bp, Homo sapiens
aaattaactgctccaaattta

SEQ ID NO: 4216946 - DNA, 22 bp, Homo sapiens
aaattaactgctccaaatttaa

SEQ ID NO: 4216947 - DNA, 19 bp, Homo sapiens
aaattaattatatttctac

SEQ ID NO: 4216948 - DNA, 16 bp, Homo sapiens
aaattaatttgtgaat

SEQ ID NO: 4216949 - DNA, 13 bp, Homo sapiens
aaattgatttgtt

SEQ ID NO: 4216950 - DNA, 13 bp, Homo sapiens
aaattgtgaaaaa

SEQ ID NO: 4216951 - DNA, 23 bp, Homo sapiens
aaatttagagtcaatttgctgaa

SEQ ID NO: 4216952 - DNA, 20 bp, Homo sapiens
aaatttcagtcaattctgat

SEQ ID NO: 4216953 - DNA, 22 bp, Homo sapiens
aaatttgccaccactagagctg

SEQ ID NO: 4216954 - DNA, 12 bp, Homo sapiens
aaatttttacaa

SEQ ID NO: 4216955 - DNA, 17 bp, Homo sapiens
aacaaagaaaaaaatat

SEQ ID NO: 4216956 - DNA, 11 bp, Homo sapiens
aacagacagga

SEQ ID NO: 4216957 - DNA, 15 bp, Homo sapiens
aacagacaggagaaa

SEQ ID NO: 4216958 - DNA, 13 bp, Homo sapiens
aacagagaaggca

SEQ ID NO: 4216959 - DNA, 13 bp, Homo sapiens
aacagcctcacag

SEQ ID NO: 4216960 - DNA, 14 bp, Homo sapiens
aacagcctcacaga

SEQ ID NO: 4216961 - DNA, 11 bp, Homo sapiens
aacagctcaga

SEQ ID NO: 4216962 - DNA, 17 bp, Homo sapiens
aacagggaaaaaaagaa

SEQ ID NO: 4216963 - DNA, 13 bp, Homo sapiens
aacagtgcctgct

SEQ ID NO: 4216964 - DNA, 16 bp, Homo sapiens
aacataaggagaatgt

SEQ ID NO: 4216965 - DNA, 12 bp, Homo sapiens
aacatccagaag

SEQ ID NO: 4216966 - DNA, 13 bp, Homo sapiens
aacatgaccaaaa

SEQ ID NO: 4216967 - DNA, 16 bp, Homo sapiens
aacatgaccaaaaacc

SEQ ID NO: 4216968 - DNA, 18 bp, Homo sapiens
aacatgaccaaaaaccaa

SEQ ID NO: 4216969 - DNA, 19 bp, Homo sapiens
aacatgaccaaaaaccaaa

SEQ ID NO: 4216970 - DNA, 13 bp, Homo sapiens
aacatgagaaatg

SEQ ID NO: 4216971 - DNA, 14 bp, Homo sapiens
aacatgagaaatgt

SEQ ID NO: 4216972 - DNA, 15 bp, Homo sapiens
aacatgagaaatgtg

SEQ ID NO: 4216973 - DNA, 17 bp, Homo sapiens
aacatggaaaacagagt

SEQ ID NO: 4216974 - DNA, 20 bp, Homo sapiens
aacatggagaaaccctgtct

SEQ ID NO: 4216975 - DNA, 20 bp, Homo sapiens
aaccaaaagtgcattcaacc

SEQ ID NO: 4216976 - DNA, 22 bp, Homo sapiens
aaccaaaagtgcattcaacctt

SEQ ID NO: 4216977 - DNA, 14 bp, Homo sapiens
aaccataaacattt

SEQ ID NO: 4216978 - DNA, 18 bp, Homo sapiens
aaccataaacatttgcac

SEQ ID NO: 4216979 - DNA, 14 bp, Homo sapiens
aacccacctgctga

SEQ ID NO: 4216980 - DNA, 11 bp, Homo sapiens
aacccagagag

SEQ ID NO: 4216981 - DNA, 11 bp, Homo sapiens
aacccaggagg

SEQ ID NO: 4216982 - DNA, 15 bp, Homo sapiens
aacccatcagaagga

SEQ ID NO: 4216983 - DNA, 19 bp, Homo sapiens
aacccatcagaaggagaag

SEQ ID NO: 4216984 - DNA, 13 bp, Homo sapiens
aaccccagttctg

SEQ ID NO: 4216985 - DNA, 16 bp, Homo sapiens
aaccccagttctgctc

SEQ ID NO: 4216986 - DNA, 16 bp, Homo sapiens
aaccgaacatgaccaa

SEQ ID NO: 4216987 - DNA, 17 bp, Homo sapiens
aaccgaacatgaccaaa

SEQ ID NO: 4216988 - DNA, 17 bp, Homo sapiens
aacctctctaagccaca

SEQ ID NO: 4216989 - DNA, 21 bp, Homo sapiens
aacctggctccctcccaccca

SEQ ID NO: 4216990 - DNA, 12 bp, Homo sapiens
aaccttaccaaa

SEQ ID NO: 4216991 - DNA, 13 bp, Homo sapiens
aaccttaccaaaa

SEQ ID NO: 4216992 - DNA, 12 bp, Homo sapiens
aacggggagaaa

SEQ ID NO: 4216993 - DNA, 17 bp, Homo sapiens
aactacctcaaaacact

SEQ ID NO: 4216994 - DNA, 20 bp, Homo sapiens
aactagactcccaagctgga

SEQ ID NO: 4216995 - DNA, 16 bp, Homo sapiens
aactatgatttggaaa

SEQ ID NO: 4216996 - DNA, 17 bp, Homo sapiens
aactcaatctaaattaa

SEQ ID NO: 4216997 - DNA, 16 bp, Homo sapiens
aactctggattttgaa

SEQ ID NO: 4216998 - DNA, 16 bp, Homo sapiens
aactgaaaaatgtcag

SEQ ID NO: 4216999 - DNA, 20 bp, Homo sapiens
aactgaaagctgaatccttc

SEQ ID NO: 4217000 - DNA, 13 bp, Homo sapiens
aactgaaggagaa

SEQ ID NO: 4217001 - DNA, 15 bp, Homo sapiens
aactgaaggagaagg

SEQ ID NO: 4217002 - DNA, 18 bp, Homo sapiens
aactgctccaaatttaac

SEQ ID NO: 4217003 - DNA, 20 bp, Homo sapiens
aactggaagcatgtaggaga

SEQ ID NO: 4217004 - DNA, 16 bp, Homo sapiens
aacttagtttttatct

SEQ ID NO: 4217005 - DNA, 15 bp, Homo sapiens
aacttgatgcatgtg

SEQ ID NO: 4217006 - DNA, 22 bp, Homo sapiens
aacttgtgaactccatcattca

SEQ ID NO: 4217007 - DNA, 12 bp, Homo sapiens
aactttcccccc

SEQ ID NO: 4217008 - DNA, 16 bp, Homo sapiens
aactttctctttgcca

SEQ ID NO: 4217009 - DNA, 13 bp, Homo sapiens
aagaaaaaaatat

SEQ ID NO: 4217010 - DNA, 13 bp, Homo sapiens
aagaaaaaggaaa

SEQ ID NO: 4217011 - DNA, 11 bp, Homo sapiens
aagaaaacaaa

SEQ ID NO: 4217012 - DNA, 17 bp, Homo sapiens
aagaaggtatttttcca

SEQ ID NO: 4217013 - DNA, 19 bp, Homo sapiens
aagaattattcagtgaatt

SEQ ID NO: 4217014 - DNA, 20 bp, Homo sapiens
aagaattcctgaagccagat

SEQ ID NO: 4217015 - DNA, 20 bp, Homo sapiens
aagaattgaacccaggaggt

SEQ ID NO: 4217016 - DNA, 22 bp, Homo sapiens
aagaattttcagaccccagcgg

SEQ ID NO: 4217017 - DNA, 15 bp, Homo sapiens
aagagcaagtctgga

SEQ ID NO: 4217018 - DNA, 21 bp, Homo sapiens
aagagccttggtgtccacctg

SEQ ID NO: 4217019 - DNA, 22 bp, Homo sapiens
aagagccttggtgtccacctgg

SEQ ID NO: 4217020 - DNA, 19 bp, Homo sapiens
aagagctagcgctgccgca

SEQ ID NO: 4217021 - DNA, 17 bp, Homo sapiens
aagaggctccctcctgt

SEQ ID NO: 4217022 - DNA, 12 bp, Homo sapiens
aagattcccaga

SEQ ID NO: 4217023 - DNA, 15 bp, Homo sapiens
aagattcccagagac

SEQ ID NO: 4217024 - DNA, 19 bp, Homo sapiens
aagattcccagagacagga

SEQ ID NO: 4217025 - DNA, 15 bp, Homo sapiens
aagcaaaaagatgta

SEQ ID NO: 4217026 - DNA, 22 bp, Homo sapiens
aagcaaagactttcctcttagt

SEQ ID NO: 4217027 - DNA, 12 bp, Homo sapiens
aagcacctgccg

SEQ ID NO: 4217028 - DNA, 13 bp, Homo sapiens
aagcagaaaaatt

SEQ ID NO: 4217029 - DNA, 16 bp, Homo sapiens
aagcagtttttccccc

SEQ ID NO: 4217030 - DNA, 20 bp, Homo sapiens
aagcataaagcaattgtgaa

SEQ ID NO: 4217031 - DNA, 16 bp, Homo sapiens
aagcatgtaggagaat

SEQ ID NO: 4217032 - DNA, 14 bp, Homo sapiens
aagcattgagatct

SEQ ID NO: 4217033 - DNA, 12 bp, Homo sapiens
aagccctccttc

SEQ ID NO: 4217034 - DNA, 17 bp, Homo sapiens
aagcctgtaatcccagc

SEQ ID NO: 4217035 - DNA, 14 bp, Homo sapiens
aagctagagatatg

SEQ ID NO: 4217036 - DNA, 11 bp, Homo sapiens
aagctcacagt

SEQ ID NO: 4217037 - DNA, 15 bp, Homo sapiens
aagctcacagttcct

SEQ ID NO: 4217038 - DNA, 20 bp, Homo sapiens
aagctcacagttcctcgccc

SEQ ID NO: 4217039 - DNA, 22 bp, Homo sapiens
aagctcacagttcctcgccctg

SEQ ID NO: 4217040 - DNA, 12 bp, Homo sapiens
aagctcctctgc

SEQ ID NO: 4217041 - DNA, 13 bp, Homo sapiens
aagctcctctgct

SEQ ID NO: 4217042 - DNA, 12 bp, Homo sapiens
aagctgtgtcct

SEQ ID NO: 4217043 - DNA, 22 bp, Homo sapiens
aagctgtgtccttgcacctgca

SEQ ID NO: 4217044 - DNA, 23 bp, Homo sapiens
aaggagaagactgggctagggag

SEQ ID NO: 4217045 - DNA, 15 bp, Homo sapiens
aaggagaaggaagga

SEQ ID NO: 4217046 - DNA, 11 bp, Homo sapiens
aaggaggaaaa

SEQ ID NO: 4217047 - DNA, 17 bp, Homo sapiens
aagggagagcggggcag

SEQ ID NO: 4217048 - DNA, 20 bp, Homo sapiens
aaggggttggttgaggtgga

SEQ ID NO: 4217049 - DNA, 16 bp, Homo sapiens
aagggtctagggagag

SEQ ID NO: 4217050 - DNA, 18 bp, Homo sapiens
aagggtctagggagagac

SEQ ID NO: 4217051 - DNA, 13 bp, Homo sapiens
aaggtcatcatcg

SEQ ID NO: 4217052 - DNA, 11 bp, Homo sapiens
aaggtgcctgt

SEQ ID NO: 4217053 - DNA, 14 bp, Homo sapiens
aaggtttataaagc

SEQ ID NO: 4217054 - DNA, 20 bp, Homo sapiens
aagtatcaaagaaaaacaat

SEQ ID NO: 4217055 - DNA, 19 bp, Homo sapiens
aagtcaaaaggtgcctgtg

SEQ ID NO: 4217056 - DNA, 23 bp, Homo sapiens
aagtcaattccacccctcctcga

SEQ ID NO: 4217057 - DNA, 18 bp, Homo sapiens
aagtctcctttactgaat

SEQ ID NO: 4217058 - DNA, 18 bp, Homo sapiens
aagtctggatctgggacc

SEQ ID NO: 4217059 - DNA, 19 bp, Homo sapiens
aagtgatttagttgtggaa

SEQ ID NO: 4217060 - DNA, 16 bp, Homo sapiens
aagtggaccaggacag

SEQ ID NO: 4217061 - DNA, 11 bp, Homo sapiens
aagttaagaat

SEQ ID NO: 4217062 - DNA, 12 bp, Homo sapiens
aataaaaaccat

SEQ ID NO: 4217063 - DNA, 15 bp, Homo sapiens
aataaaaattgaaaa

SEQ ID NO: 4217064 - DNA, 16 bp, Homo sapiens
aataaaaattgaaaaa

SEQ ID NO: 4217065 - DNA, 14 bp, Homo sapiens
aataaaattgcact

SEQ ID NO: 4217066 - DNA, 18 bp, Homo sapiens
aataaagctcctctgctc

SEQ ID NO: 4217067 - DNA, 11 bp, Homo sapiens
aataaatataa

SEQ ID NO: 4217068 - DNA, 13 bp, Homo sapiens
aataaatataatt

SEQ ID NO: 4217069 - DNA, 16 bp, Homo sapiens
aataaattgtgaaaaa

SEQ ID NO: 4217070 - DNA, 17 bp, Homo sapiens
aatactccctttaaaga

SEQ ID NO: 4217071 - DNA, 19 bp, Homo sapiens
aatactccctttaaagaga

SEQ ID NO: 4217072 - DNA, 20 bp, Homo sapiens
aatagacacatcaaatgccc

SEQ ID NO: 4217073 - DNA, 20 bp, Homo sapiens
aatagcttattatagaattg

SEQ ID NO: 4217074 - DNA, 13 bp, Homo sapiens
aatataaactgaa

SEQ ID NO: 4217075 - DNA, 19 bp, Homo sapiens
aatatcagttactcagccc

SEQ ID NO: 4217076 - DNA, 21 bp, Homo sapiens
aatatcagttactcagccctg

SEQ ID NO: 4217077 - DNA, 22 bp, Homo sapiens
aatattaaaatcactgtcaata

SEQ ID NO: 4217078 - DNA, 20 bp, Homo sapiens
aatattggtaattaaaagac

SEQ ID NO: 4217079 - DNA, 14 bp, Homo sapiens
aatatttttttcct

SEQ ID NO: 4217080 - DNA, 15 bp, Homo sapiens
aatatttttttcctt

SEQ ID NO: 4217081 - DNA, 18 bp, Homo sapiens
aatatttttttcctttgc

SEQ ID NO: 4217082 - DNA, 23 bp, Homo sapiens
aatatttttttcctttgcattca

SEQ ID NO: 4217083 - DNA, 22 bp, Homo sapiens
aatcaatgctataactatgttg

SEQ ID NO: 4217084 - DNA, 12 bp, Homo sapiens
aatcacagtgtt

SEQ ID NO: 4217085 - DNA, 19 bp, Homo sapiens
aatcacattcgagtgtttc

SEQ ID NO: 4217086 - DNA, 20 bp, Homo sapiens
aatcagaccctaccccacca

SEQ ID NO: 4217087 - DNA, 14 bp, Homo sapiens
aatcccctcattca

SEQ ID NO: 4217088 - DNA, 15 bp, Homo sapiens
aatccttccatttct

SEQ ID NO: 4217089 - DNA, 16 bp, Homo sapiens
aatccttccatttctt

SEQ ID NO: 4217090 - DNA, 17 bp, Homo sapiens
aatccttccatttcttc

SEQ ID NO: 4217091 - DNA, 21 bp, Homo sapiens
aatccttccatttcttctgca

SEQ ID NO: 4217092 - DNA, 14 bp, Homo sapiens
aatcgccccagact

SEQ ID NO: 4217093 - DNA, 12 bp, Homo sapiens
aatctgaagaaa

SEQ ID NO: 4217094 - DNA, 16 bp, Homo sapiens
aatgaagtatttctca

SEQ ID NO: 4217095 - DNA, 21 bp, Homo sapiens
aatgagtttttatggggctga

SEQ ID NO: 4217096 - DNA, 16 bp, Homo sapiens
aatgatcataagtcta

SEQ ID NO: 4217097 - DNA, 21 bp, Homo sapiens
aatgcaagattttccacaaga

SEQ ID NO: 4217098 - DNA, 21 bp, Homo sapiens
aatgccttgacaacagactga

SEQ ID NO: 4217099 - DNA, 23 bp, Homo sapiens
aatgctataactatgttgataaa

SEQ ID NO: 4217100 - DNA, 21 bp, Homo sapiens
aatgtaatgatcataagtcta

SEQ ID NO: 4217101 - DNA, 14 bp, Homo sapiens
aatgtcaacctttg

SEQ ID NO: 4217102 - DNA, 23 bp, Homo sapiens
aatgtcaacctttgtaagaaaac

SEQ ID NO: 4217103 - DNA, 19 bp, Homo sapiens
aatgtcacagtaatgcaag

SEQ ID NO: 4217104 - DNA, 18 bp, Homo sapiens
aatgtcaccaccttccca

SEQ ID NO: 4217105 - DNA, 20 bp, Homo sapiens
aatgtcagagctatgttccc

SEQ ID NO: 4217106 - DNA, 20 bp, Homo sapiens
aatgtctcttcctctgttct

SEQ ID NO: 4217107 - DNA, 18 bp, Homo sapiens
aatgtgtattttatatga

SEQ ID NO: 4217108 - DNA, 15 bp, Homo sapiens
aatgttgaatgtatt

SEQ ID NO: 4217109 - DNA, 12 bp, Homo sapiens
aattaatacaga

SEQ ID NO: 4217110 - DNA, 15 bp, Homo sapiens
aattaatacagagta

SEQ ID NO: 4217111 - DNA, 14 bp, Homo sapiens
aattaatttgtgaa

SEQ ID NO: 4217112 - DNA, 15 bp, Homo sapiens
aattaatttgtgaat

SEQ ID NO: 4217113 - DNA, 19 bp, Homo sapiens
aattagattatttctgtat

SEQ ID NO: 4217114 - DNA, 22 bp, Homo sapiens
aattctagctttgagcttaaga

SEQ ID NO: 4217115 - DNA, 18 bp, Homo sapiens
aattcttcaggtggaaaa

SEQ ID NO: 4217116 - DNA, 20 bp, Homo sapiens
acgtgactgccccaactcct

SEQ ID NO: 4217117 - DNA, 18 bp, Homo sapiens
acgtgccaggcccggggc

SEQ ID NO: 4217118 - DNA, 19 bp, Homo sapiens
acgtgccaggcccggggct

SEQ ID NO: 4217119 - DNA, 16 bp, Homo sapiens
acgttccttactgcag

SEQ ID NO: 4217120 - DNA, 21 bp, Homo sapiens
acgttccttactgcagaatag

SEQ ID NO: 4217121 - DNA, 14 bp, Homo sapiens
actaaaaattttta

SEQ ID NO: 4217122 - DNA, 21 bp, Homo sapiens
actagccatgataactgcaat

SEQ ID NO: 4217123 - DNA, 16 bp, Homo sapiens
actatgatttggaaaa

SEQ ID NO: 4217124 - DNA, 17 bp, Homo sapiens
actcaagggtccagaag

SEQ ID NO: 4217125 - DNA, 13 bp, Homo sapiens
actcacctctgcc

SEQ ID NO: 4217126 - DNA, 15 bp, Homo sapiens
actcacctctgcctc

SEQ ID NO: 4217127 - DNA, 17 bp, Homo sapiens
actcagcagccctcctc

SEQ ID NO: 4217128 - DNA, 22 bp, Homo sapiens
actcagcagccctcctcacccc

SEQ ID NO: 4217129 - DNA, 20 bp, Homo sapiens
actcaggaggctgaggcaga

SEQ ID NO: 4217130 - DNA, 16 bp, Homo sapiens
actcattctatgaaca

SEQ ID NO: 4217131 - DNA, 15 bp, Homo sapiens
actccaccaacccat

SEQ ID NO: 4217132 - DNA, 20 bp, Homo sapiens
actccaggatttataaagca

SEQ ID NO: 4217133 - DNA, 16 bp, Homo sapiens
actcctggaagctgtg

SEQ ID NO: 4217134 - DNA, 17 bp, Homo sapiens
actctccaacctggaca

SEQ ID NO: 4217135 - DNA, 11 bp, Homo sapiens
actgaaggaga

SEQ ID NO: 4217136 - DNA, 21 bp, Homo sapiens
actgaaggagaaggtgcccca

SEQ ID NO: 4217137 - DNA, 19 bp, Homo sapiens
actgaattttaaatgttca

SEQ ID NO: 4217138 - DNA, 21 bp, Homo sapiens
actgaattttaaatgttcaca

SEQ ID NO: 4217139 - DNA, 19 bp, Homo sapiens
actgagccatcatttcctg

SEQ ID NO: 4217140 - DNA, 20 bp, Homo sapiens
actgcaacttgtaaatgtgg

SEQ ID NO: 4217141 - DNA, 16 bp, Homo sapiens
actgcaacttgtgaac

SEQ ID NO: 4217142 - DNA, 21 bp, Homo sapiens
actgcaacttgtgaactccat

SEQ ID NO: 4217143 - DNA, 16 bp, Homo sapiens
actgcaagagccttgg

SEQ ID NO: 4217144 - DNA, 21 bp, Homo sapiens
actgcaggccccgcttgtcca

SEQ ID NO: 4217145 - DNA, 15 bp, Homo sapiens
actgccccaactcct

SEQ ID NO: 4217146 - DNA, 18 bp, Homo sapiens
actgccccaactcctgga

SEQ ID NO: 4217147 - DNA, 12 bp, Homo sapiens
actgctccaaat

SEQ ID NO: 4217148 - DNA, 19 bp, Homo sapiens
actggaagcatgtaggaga

SEQ ID NO: 4217149 - DNA, 16 bp, Homo sapiens
actggagcaccaggca

SEQ ID NO: 4217150 - DNA, 16 bp, Homo sapiens
actgtaatttctttga

SEQ ID NO: 4217151 - DNA, 21 bp, Homo sapiens
actgtaggcagggaaccttaa

SEQ ID NO: 4217152 - DNA, 22 bp, Homo sapiens
acttcaagtgcatgctctctgc

SEQ ID NO: 4217153 - DNA, 13 bp, Homo sapiens
acttcacactgca

SEQ ID NO: 4217154 - DNA, 14 bp, Homo sapiens
acttcacactgcaa

SEQ ID NO: 4217155 - DNA, 13 bp, Homo sapiens
acttgatgcatgt

SEQ ID NO: 4217156 - DNA, 14 bp, Homo sapiens
acttgatgcatgtg

SEQ ID NO: 4217157 - DNA, 20 bp, Homo sapiens
acttgcttaaattgtgggca

SEQ ID NO: 4217158 - DNA, 20 bp, Homo sapiens
acttgtaaatgtggtaaaga

SEQ ID NO: 4217159 - DNA, 21 bp, Homo sapiens
acttgtgaactccatcattca

SEQ ID NO: 4217160 - DNA, 15 bp, Homo sapiens
actttagaatgagag

SEQ ID NO: 4217161 - DNA, 17 bp, Homo sapiens
actttattctcctccga

SEQ ID NO: 4217162 - DNA, 10 bp, Homo sapiens
actttccccc

SEQ ID NO: 4217163 - DNA, 15 bp, Homo sapiens
actttctctttgcca

SEQ ID NO: 4217164 - DNA, 17 bp, Homo sapiens
actttctctttgccatt

SEQ ID NO: 4217165 - DNA, 23 bp, Homo sapiens
actttggaaaatatttttttcct

SEQ ID NO: 4217166 - DNA, 15 bp, Homo sapiens
agaaaaaaatatatt

SEQ ID NO: 4217167 - DNA, 23 bp, Homo sapiens
agaaaaaaatatattttatgatt

SEQ ID NO: 4217168 - DNA, 12 bp, Homo sapiens
agaaaaaggaaa

SEQ ID NO: 4217169 - DNA, 16 bp, Homo sapiens
agaaaaccaaaataaa

SEQ ID NO: 4217170 - DNA, 16 bp, Homo sapiens
agaaaagcacctgccg

SEQ ID NO: 4217171 - DNA, 18 bp, Homo sapiens
agaaagaaatttgaaaaa

SEQ ID NO: 4217172 - DNA, 23 bp, Homo sapiens
agaaagaaatttgaaaaaacttt

SEQ ID NO: 4217173 - DNA, 23 bp, Homo sapiens
agaaagaccatgcatttaaagta

SEQ ID NO: 4217174 - DNA, 22 bp, Homo sapiens
agaaagatccaccctcaaatgt

SEQ ID NO: 4217175 - DNA, 22 bp, Homo sapiens
agaaatgcatccattcctcagg

SEQ ID NO: 4217176 - DNA, 14 bp, Homo sapiens
agaaatttgaaaaa

SEQ ID NO: 4217177 - DNA, 17 bp, Homo sapiens
agaagaattgaacccag

SEQ ID NO: 4217178 - DNA, 23 bp, Homo sapiens
agaagaattttcagaccccagcg

SEQ ID NO: 4217179 - DNA, 17 bp, Homo sapiens
agaagcagtgagccgca

SEQ ID NO: 4217180 - DNA, 23 bp, Homo sapiens
agaagcagtgagccgcatcttct

SEQ ID NO: 4217181 - DNA, 15 bp, Homo sapiens
agaagtggaccagga

SEQ ID NO: 4217182 - DNA, 23 bp, Homo sapiens
agaagtggaccaggacaggacca

SEQ ID NO: 4217183 - DNA, 18 bp, Homo sapiens
agaatgtcaccagtcctg

SEQ ID NO: 4217184 - DNA, 18 bp, Homo sapiens
agaattcctgaagccaga

SEQ ID NO: 4217185 - DNA, 18 bp, Homo sapiens
agaattgaacccaggagg

SEQ ID NO: 4217186 - DNA, 20 bp, Homo sapiens
agaattttcagaccccagcg

SEQ ID NO: 4217187 - DNA, 21 bp, Homo sapiens
agaattttcagaccccagcgg

SEQ ID NO: 4217188 - DNA, 15 bp, Homo sapiens
agaattttgagcagg

SEQ ID NO: 4217189 - DNA, 19 bp, Homo sapiens
agacaaagcggctttctaa

SEQ ID NO: 4217190 - DNA, 15 bp, Homo sapiens
agacacaggaaacaa

SEQ ID NO: 4217191 - DNA, 14 bp, Homo sapiens
agacacctgcacct

SEQ ID NO: 4217192 - DNA, 17 bp, Homo sapiens
agacacctgcacctccc

SEQ ID NO: 4217193 - DNA, 20 bp, Homo sapiens
agacacctgcacctcccccc

SEQ ID NO: 4217194 - DNA, 21 bp, Homo sapiens
agacacctgcacctcccccca

SEQ ID NO: 4217195 - DNA, 21 bp, Homo sapiens
agacagaccggggttcaagcc

SEQ ID NO: 4217196 - DNA, 18 bp, Homo sapiens
agacaggaaaatcctctg

SEQ ID NO: 4217197 - DNA, 14 bp, Homo sapiens
agacaggagaaatg

SEQ ID NO: 4217198 - DNA, 14 bp, Homo sapiens
agaccatgcattta

SEQ ID NO: 4217199 - DNA, 23 bp, Homo sapiens
agacccatttccttgtgctcctg

SEQ ID NO: 4217200 - DNA, 13 bp, Homo sapiens
agacctgcatttg

SEQ ID NO: 4217201 - DNA, 16 bp, Homo sapiens
agactcacctctgcct

SEQ ID NO: 4217202 - DNA, 18 bp, Homo sapiens
agactcacctctgcctca

SEQ ID NO: 4217203 - DNA, 21 bp, Homo sapiens
agactccagctgggttggaaa

SEQ ID NO: 4217204 - DNA, 16 bp, Homo sapiens
agactcctttcctctg

SEQ ID NO: 4217205 - DNA, 17 bp, Homo sapiens
agactcctttcctctga

SEQ ID NO: 4217206 - DNA, 20 bp, Homo sapiens
agactgatgggacatcaaat

SEQ ID NO: 4217207 - DNA, 14 bp, Homo sapiens
agagaaaatgaatt

SEQ ID NO: 4217208 - DNA, 16 bp, Homo sapiens
agagaaaatgaatttg

SEQ ID NO: 4217209 - DNA, 20 bp, Homo sapiens
agagaaggcaggaatgtgtg

SEQ ID NO: 4217210 - DNA, 13 bp, Homo sapiens
agagacacctgca

SEQ ID NO: 4217211 - DNA, 15 bp, Homo sapiens
agagacacctgcacc

SEQ ID NO: 4217212 - DNA, 22 bp, Homo sapiens
agagacacctgcacctcccccc

SEQ ID NO: 4217213 - DNA, 13 bp, Homo sapiens
agagacaggaaaa

SEQ ID NO: 4217214 - DNA, 21 bp, Homo sapiens
agagacaggaaaatcctctgg

SEQ ID NO: 4217215 - DNA, 14 bp, Homo sapiens
agagacccaaggag

SEQ ID NO: 4217216 - DNA, 19 bp, Homo sapiens
agagactgttctgttcctt

SEQ ID NO: 4217217 - DNA, 14 bp, Homo sapiens
agagaggaatcaga

SEQ ID NO: 4217218 - DNA, 16 bp, Homo sapiens
agagatgcctccaccg

SEQ ID NO: 4217219 - DNA, 17 bp, Homo sapiens
agagatgcctccaccgc

SEQ ID NO: 4217220 - DNA, 23 bp, Homo sapiens
agagatgcctccaccgctgccta

SEQ ID NO: 4217221 - DNA, 17 bp, Homo sapiens
agagatgtcatcagagc

SEQ ID NO: 4217222 - DNA, 22 bp, Homo sapiens
agagccagccctccctgtcctc

SEQ ID NO: 4217223 - DNA, 13 bp, Homo sapiens
agagcctgctccc

SEQ ID NO: 4217224 - DNA, 19 bp, Homo sapiens
agagcctgctcccccaccc

SEQ ID NO: 4217225 - DNA, 14 bp, Homo sapiens
agagctagcgctgc

SEQ ID NO: 4217226 - DNA, 16 bp, Homo sapiens
agagctagcgctgccg

SEQ ID NO: 4217227 - DNA, 23 bp, Homo sapiens
agagctcctctgtcctgcttctg

SEQ ID NO: 4217228 - DNA, 23 bp, Homo sapiens
agagctgagagtctgaaagacag

SEQ ID NO: 4217229 - DNA, 20 bp, Homo sapiens
agaggaaaaacagggaaaaa

SEQ ID NO: 4217230 - DNA, 21 bp, Homo sapiens
agaggcttcttcagatcagtg

SEQ ID NO: 4217231 - DNA, 19 bp, Homo sapiens
agagggaagtttaaaaccc

SEQ ID NO: 4217232 - DNA, 18 bp, Homo sapiens
agagggtctggagaagca

SEQ ID NO: 4217233 - DNA, 16 bp, Homo sapiens
agaggtcacaaagaat

SEQ ID NO: 4217234 - DNA, 18 bp, Homo sapiens
agagtagccgagagcctg

SEQ ID NO: 4217235 - DNA, 19 bp, Homo sapiens
agagtagccgagagcctgc

SEQ ID NO: 4217236 - DNA, 17 bp, Homo sapiens
agagtctgaaagacaga

SEQ ID NO: 4217237 - DNA, 18 bp, Homo sapiens
agagtctgaaagacagaa

SEQ ID NO: 4217238 - DNA, 20 bp, Homo sapiens
agagtgtgggaagggagagc

SEQ ID NO: 4217239 - DNA, 14 bp, Homo sapiens
agagttctgctcta

SEQ ID NO: 4217240 - DNA, 17 bp, Homo sapiens
agataaatttgttgaat

SEQ ID NO: 4217241 - DNA, 19 bp, Homo sapiens
agataataaattgatttgt

SEQ ID NO: 4217242 - DNA, 14 bp, Homo sapiens
aattgattattctg

SEQ ID NO: 4217243 - DNA, 13 bp, Homo sapiens
aattgtccccagt

SEQ ID NO: 4217244 - DNA, 15 bp, Homo sapiens
aattgtgggcaaaag

SEQ ID NO: 4217245 - DNA, 13 bp, Homo sapiens
aatttaaccataa

SEQ ID NO: 4217246 - DNA, 18 bp, Homo sapiens
aatttaaccataaatcaa

SEQ ID NO: 4217247 - DNA, 17 bp, Homo sapiens
aatttcacatggacttt

SEQ ID NO: 4217248 - DNA, 19 bp, Homo sapiens
aatttcagtcaattctgat

SEQ ID NO: 4217249 - DNA, 22 bp, Homo sapiens
aatttgccaccactagagctga

SEQ ID NO: 4217250 - DNA, 19 bp, Homo sapiens
aatttgggatactaaagta

SEQ ID NO: 4217251 - DNA, 16 bp, Homo sapiens
aatttgtatgctaaat

SEQ ID NO: 4217252 - DNA, 16 bp, Homo sapiens
aatttgtccattgtaa

SEQ ID NO: 4217253 - DNA, 12 bp, Homo sapiens
aattttgtgcta

SEQ ID NO: 4217254 - DNA, 15 bp, Homo sapiens
aatttttttaaattt

SEQ ID NO: 4217255 - DNA, 19 bp, Homo sapiens
acaaacatggaaaacagag

SEQ ID NO: 4217256 - DNA, 17 bp, Homo sapiens
acaaagcagtttttccc

SEQ ID NO: 4217257 - DNA, 15 bp, Homo sapiens
acaagattcccagag

SEQ ID NO: 4217258 - DNA, 16 bp, Homo sapiens
acaagattcccagaga

SEQ ID NO: 4217259 - DNA, 21 bp, Homo sapiens
acaagattcccagagacagga

SEQ ID NO: 4217260 - DNA, 15 bp, Homo sapiens
acaagcaacccaaac

SEQ ID NO: 4217261 - DNA, 19 bp, Homo sapiens
acaagggtctagggagaga

SEQ ID NO: 4217262 - DNA, 16 bp, Homo sapiens
acaatacatgctgcta

SEQ ID NO: 4217263 - DNA, 22 bp, Homo sapiens
acaatgtaaaccacatgaacta

SEQ ID NO: 4217264 - DNA, 11 bp, Homo sapiens
acacctgcacc

SEQ ID NO: 4217265 - DNA, 12 bp, Homo sapiens
acacctgcacct

SEQ ID NO: 4217266 - DNA, 15 bp, Homo sapiens
acacctgcacctccc

SEQ ID NO: 4217267 - DNA, 19 bp, Homo sapiens
acacctgcacctcccccca

SEQ ID NO: 4217268 - DNA, 18 bp, Homo sapiens
acagacaaaaacagcctc

SEQ ID NO: 4217269 - DNA, 18 bp, Homo sapiens
acagacaagcaacccaaa

SEQ ID NO: 4217270 - DNA, 11 bp, Homo sapiens
acagacaggag

SEQ ID NO: 4217271 - DNA, 15 bp, Homo sapiens
acagagaaggcagga

SEQ ID NO: 4217272 - DNA, 15 bp, Homo sapiens
acagagacacctgca

SEQ ID NO: 4217273 - DNA, 20 bp, Homo sapiens
acagcctgtggcggtgcctg

SEQ ID NO: 4217274 - DNA, 14 bp, Homo sapiens
acagctcagagatg

SEQ ID NO: 4217275 - DNA, 14 bp, Homo sapiens
acagctcccacccc

SEQ ID NO: 4217276 - DNA, 16 bp, Homo sapiens
acagctgtccctgtca

SEQ ID NO: 4217277 - DNA, 18 bp, Homo sapiens
acagctgtccctgtcacc

SEQ ID NO: 4217278 - DNA, 17 bp, Homo sapiens
acagggaaaaaaagaaa

SEQ ID NO: 4217279 - DNA, 15 bp, Homo sapiens
acaggttggaagaga

SEQ ID NO: 4217280 - DNA, 16 bp, Homo sapiens
acaggttggaagagaa

SEQ ID NO: 4217281 - DNA, 13 bp, Homo sapiens
acagtaatcagag

SEQ ID NO: 4217282 - DNA, 14 bp, Homo sapiens
acagtgcctgctga

SEQ ID NO: 4217283 - DNA, 17 bp, Homo sapiens
acagtggagaaatattt

SEQ ID NO: 4217284 - DNA, 16 bp, Homo sapiens
acagttcctcgccctg

SEQ ID NO: 4217285 - DNA, 19 bp, Homo sapiens
acagttcctcgccctgggt

SEQ ID NO: 4217286 - DNA, 23 bp, Homo sapiens
acagtttcattaactccttcccc

SEQ ID NO: 4217287 - DNA, 17 bp, Homo sapiens
acatagtggatggacag

SEQ ID NO: 4217288 - DNA, 22 bp, Homo sapiens
acatagtggatggacagatgga

SEQ ID NO: 4217289 - DNA, 23 bp, Homo sapiens
acatagtggatggacagatggac

SEQ ID NO: 4217290 - DNA, 17 bp, Homo sapiens
acatcaaatttgccacc

SEQ ID NO: 4217291 - DNA, 20 bp, Homo sapiens
acatcaaatttgccaccact

SEQ ID NO: 4217292 - DNA, 19 bp, Homo sapiens
acatctaatgtctcttcct

SEQ ID NO: 4217293 - DNA, 22 bp, Homo sapiens
acatctaatgtctcttcctctg

SEQ ID NO: 4217294 - DNA, 22 bp, Homo sapiens
acatggaaaacagagtatttct

SEQ ID NO: 4217295 - DNA, 11 bp, Homo sapiens
accaaaacagg

SEQ ID NO: 4217296 - DNA, 13 bp, Homo sapiens
accaaaataaaaa

SEQ ID NO: 4217297 - DNA, 21 bp, Homo sapiens
accaacatcccattgccctgg

SEQ ID NO: 4217298 - DNA, 14 bp, Homo sapiens
accaactttccccc

SEQ ID NO: 4217299 - DNA, 19 bp, Homo sapiens
accaagctcacagttcctc

SEQ ID NO: 4217300 - DNA, 17 bp, Homo sapiens
accaccttcccagctct

SEQ ID NO: 4217301 - DNA, 19 bp, Homo sapiens
accaccttcccagctctcc

SEQ ID NO: 4217302 - DNA, 21 bp, Homo sapiens
accaccttcccagctctccct

SEQ ID NO: 4217303 - DNA, 17 bp, Homo sapiens
accacgatgtggccctg

SEQ ID NO: 4217304 - DNA, 19 bp, Homo sapiens
accacgatgtggccctggc

SEQ ID NO: 4217305 - DNA, 13 bp, Homo sapiens
accactagagctg

SEQ ID NO: 4217306 - DNA, 15 bp, Homo sapiens
accaggacaggacca

SEQ ID NO: 4217307 - DNA, 17 bp, Homo sapiens
accaggacaggaccaga

SEQ ID NO: 4217308 - DNA, 23 bp, Homo sapiens
accaggcacgaacccacctgctg

SEQ ID NO: 4217309 - DNA, 19 bp, Homo sapiens
accatccttacaatgtaaa

SEQ ID NO: 4217310 - DNA, 20 bp, Homo sapiens
accatcttaaatgacagtga

SEQ ID NO: 4217311 - DNA, 16 bp, Homo sapiens
accatgcatttaaagt

SEQ ID NO: 4217312 - DNA, 18 bp, Homo sapiens
accatgcatttaaagtat

SEQ ID NO: 4217313 - DNA, 20 bp, Homo sapiens
accatgtttgagctcagacc

SEQ ID NO: 4217314 - DNA, 22 bp, Homo sapiens
acccagcccattctctctcctg

SEQ ID NO: 4217315 - DNA, 11 bp, Homo sapiens
acccaggaggt

SEQ ID NO: 4217316 - DNA, 21 bp, Homo sapiens
acccaggaggtggaggttgca

SEQ ID NO: 4217317 - DNA, 23 bp, Homo sapiens
acccaggaggtggaggttgcagt

SEQ ID NO: 4217318 - DNA, 15 bp, Homo sapiens
acccagtccctgggg

SEQ ID NO: 4217319 - DNA, 21 bp, Homo sapiens
accccacccccttcagtgccc

SEQ ID NO: 4217320 - DNA, 22 bp, Homo sapiens
accccacccccttcagtgccca

SEQ ID NO: 4217321 - DNA, 15 bp, Homo sapiens
accccagttctgctc

SEQ ID NO: 4217322 - DNA, 21 bp, Homo sapiens
accccagttctgctcctctcc

SEQ ID NO: 4217323 - DNA, 21 bp, Homo sapiens
accccctcaaaagccaaaaaa

SEQ ID NO: 4217324 - DNA, 15 bp, Homo sapiens
accctaccccaccac

SEQ ID NO: 4217325 - DNA, 21 bp, Homo sapiens
accctcaaatgtcagagctat

SEQ ID NO: 4217326 - DNA, 13 bp, Homo sapiens
accctccagagtg

SEQ ID NO: 4217327 - DNA, 20 bp, Homo sapiens
accctctagtttacttgctc

SEQ ID NO: 4217328 - DNA, 14 bp, Homo sapiens
accctttccttcct

SEQ ID NO: 4217329 - DNA, 19 bp, Homo sapiens
accctttccttccttccct

SEQ ID NO: 4217330 - DNA, 15 bp, Homo sapiens
accgaacatgaccaa

SEQ ID NO: 4217331 - DNA, 20 bp, Homo sapiens
accgctgcctaagtggctgc

SEQ ID NO: 4217332 - DNA, 15 bp, Homo sapiens
acctagctgttgtaa

SEQ ID NO: 4217333 - DNA, 17 bp, Homo sapiens
acctagctgttgtaaag

SEQ ID NO: 4217334 - DNA, 15 bp, Homo sapiens
acctcaaaacacttt

SEQ ID NO: 4217335 - DNA, 22 bp, Homo sapiens
acctcagccatgaggagttgct

SEQ ID NO: 4217336 - DNA, 19 bp, Homo sapiens
acctcccagccctatggat

SEQ ID NO: 4217337 - DNA, 22 bp, Homo sapiens
acctcccagccctatggatgtg

SEQ ID NO: 4217338 - DNA, 13 bp, Homo sapiens
acctccccccact

SEQ ID NO: 4217339 - DNA, 17 bp, Homo sapiens
acctcccctatccaccc

SEQ ID NO: 4217340 - DNA, 18 bp, Homo sapiens
acctcccctatccaccca

SEQ ID NO: 4217341 - DNA, 20 bp, Homo sapiens
acctcccctatccacccagc

SEQ ID NO: 4217342 - DNA, 15 bp, Homo sapiens
acctcctgcccagga

SEQ ID NO: 4217343 - DNA, 17 bp, Homo sapiens
acctcctgcccaggaga

SEQ ID NO: 4217344 - DNA, 20 bp, Homo sapiens
acctcctgcccaggagagcc

SEQ ID NO: 4217345 - DNA, 18 bp, Homo sapiens
acctcgtcctccccctgc

SEQ ID NO: 4217346 - DNA, 21 bp, Homo sapiens
acctcgtcctccccctgccag

SEQ ID NO: 4217347 - DNA, 22 bp, Homo sapiens
acctcgtcctccccctgccagt

SEQ ID NO: 4217348 - DNA, 20 bp, Homo sapiens
acctctctaagccacagctt

SEQ ID NO: 4217349 - DNA, 21 bp, Homo sapiens
acctgaaattaatttgtgaat

SEQ ID NO: 4217350 - DNA, 23 bp, Homo sapiens
acctgaatcacaacgggccagct

SEQ ID NO: 4217351 - DNA, 15 bp, Homo sapiens
acctgcacctccccc

SEQ ID NO: 4217352 - DNA, 20 bp, Homo sapiens
acctgcacctccccccactg

SEQ ID NO: 4217353 - DNA, 21 bp, Homo sapiens
acctgcacctccccccactgc

SEQ ID NO: 4217354 - DNA, 22 bp, Homo sapiens
acctgcacctccccccactgca

SEQ ID NO: 4217355 - DNA, 18 bp, Homo sapiens
acctgccgacctcgtcct

SEQ ID NO: 4217356 - DNA, 22 bp, Homo sapiens
acctgctgagagacccaaggag

SEQ ID NO: 4217357 - DNA, 14 bp, Homo sapiens
acctggctccctcc

SEQ ID NO: 4217358 - DNA, 13 bp, Homo sapiens
accttaccaaaaa

SEQ ID NO: 4217359 - DNA, 11 bp, Homo sapiens
accttcccagc

SEQ ID NO: 4217360 - DNA, 12 bp, Homo sapiens
accttcccagct

SEQ ID NO: 4217361 - DNA, 17 bp, Homo sapiens
accttcccagctctccc

SEQ ID NO: 4217362 - DNA, 18 bp, Homo sapiens
accttcccagctctccct

SEQ ID NO: 4217363 - DNA, 19 bp, Homo sapiens
accttcccagctctccctc

SEQ ID NO: 4217364 - DNA, 22 bp, Homo sapiens
acctttgaaatattaaaatcac

SEQ ID NO: 4217365 - DNA, 18 bp, Homo sapiens
acgatgtggccctggcct

SEQ ID NO: 4217366 - DNA, 22 bp, Homo sapiens
acgatgtggccctggcctgctg

SEQ ID NO: 4217367 - DNA, 19 bp, Homo sapiens
acgtacatttgtgctgttt

SEQ ID NO: 4217368 - DNA, 20 bp, Homo sapiens
attgacctagttcagataca

SEQ ID NO: 4217369 - DNA, 13 bp, Homo sapiens
attggtaattaaa

SEQ ID NO: 4217370 - DNA, 17 bp, Homo sapiens
attggtaattaaaagac

SEQ ID NO: 4217371 - DNA, 22 bp, Homo sapiens
attggtcttaatgttgaatgta

SEQ ID NO: 4217372 - DNA, 18 bp, Homo sapiens
attgtaaatctgaagaaa

SEQ ID NO: 4217373 - DNA, 13 bp, Homo sapiens
attgtgaaaaaaa

SEQ ID NO: 4217374 - DNA, 15 bp, Homo sapiens
attgtggctgttcac

SEQ ID NO: 4217375 - DNA, 14 bp, Homo sapiens
attgtttattcttt

SEQ ID NO: 4217376 - DNA, 13 bp, Homo sapiens
atttaaaaaataa

SEQ ID NO: 4217377 - DNA, 17 bp, Homo sapiens
atttaaaaaataaatat

SEQ ID NO: 4217378 - DNA, 17 bp, Homo sapiens
atttaaccataaatcaa

SEQ ID NO: 4217379 - DNA, 24 bp, Homo sapiens
atttaaccataaatcaattcatgt

SEQ ID NO: 4217380 - DNA, 15 bp, Homo sapiens
atttagagtcaattt

SEQ ID NO: 4217381 - DNA, 21 bp, Homo sapiens
atttagagtcaatttgctgaa

SEQ ID NO: 4217382 - DNA, 20 bp, Homo sapiens
atttagtgaaagctagagat

SEQ ID NO: 4217383 - DNA, 14 bp, Homo sapiens
atttagttgtggaa

SEQ ID NO: 4217384 - DNA, 12 bp, Homo sapiens
atttataaagca

SEQ ID NO: 4217385 - DNA, 13 bp, Homo sapiens
atttatacctttg

SEQ ID NO: 4217386 - DNA, 17 bp, Homo sapiens
atttctacagagaaaat

SEQ ID NO: 4217387 - DNA, 18 bp, Homo sapiens
atttgagaagaaatactc

SEQ ID NO: 4217388 - DNA, 21 bp, Homo sapiens
atttgcaacagtaatcagagt

SEQ ID NO: 4217389 - DNA, 21 bp, Homo sapiens
atttgcatatttttctaaaga

SEQ ID NO: 4217390 - DNA, 22 bp, Homo sapiens
atttgcatatttttctaaagaa

SEQ ID NO: 4217391 - DNA, 12 bp, Homo sapiens
atttgtgaagaa

SEQ ID NO: 4217392 - DNA, 13 bp, Homo sapiens
atttgtgaagaat

SEQ ID NO: 4217393 - DNA, 12 bp, Homo sapiens
atttgtgaattt

SEQ ID NO: 4217394 - DNA, 13 bp, Homo sapiens
atttgtgaatttg

SEQ ID NO: 4217395 - DNA, 15 bp, Homo sapiens
atttgtgaatttgca

SEQ ID NO: 4217396 - DNA, 14 bp, Homo sapiens
atttgttatggtta

SEQ ID NO: 4217397 - DNA, 15 bp, Homo sapiens
attttaaaaacatga

SEQ ID NO: 4217398 - DNA, 23 bp, Homo sapiens
attttaaaaacatgagaaatgtg

SEQ ID NO: 4217399 - DNA, 15 bp, Homo sapiens
attttaaatgttcac

SEQ ID NO: 4217400 - DNA, 15 bp, Homo sapiens
attttagatgttatt

SEQ ID NO: 4217401 - DNA, 21 bp, Homo sapiens
attttagatgttattatgcta

SEQ ID NO: 4217402 - DNA, 16 bp, Homo sapiens
attttagctgcagaac

SEQ ID NO: 4217403 - DNA, 20 bp, Homo sapiens
attttatgatttaaaaaata

SEQ ID NO: 4217404 - DNA, 12 bp, Homo sapiens
attttcagaccc

SEQ ID NO: 4217405 - DNA, 21 bp, Homo sapiens
attttccacaagattcccaga

SEQ ID NO: 4217406 - DNA, 15 bp, Homo sapiens
attttctgttccagg

SEQ ID NO: 4217407 - DNA, 21 bp, Homo sapiens
attttgaattagattatttct

SEQ ID NO: 4217408 - DNA, 20 bp, Homo sapiens
attttggttgctgatgttta

SEQ ID NO: 4217409 - DNA, 23 bp, Homo sapiens
atttttaactctggattttgaat

SEQ ID NO: 4217410 - DNA, 15 bp, Homo sapiens
atttttctaaagaaa

SEQ ID NO: 4217411 - DNA, 22 bp, Homo sapiens
atttttgaaaatcctgaataaa

SEQ ID NO: 4217412 - DNA, 20 bp, Homo sapiens
atttttttcctttgcattca

SEQ ID NO: 4217413 - DNA, 21 bp, Homo sapiens
atttttttcctttgcattcat

SEQ ID NO: 4217414 - DNA, 14 bp, Homo sapiens
caaaaaatgggaga

SEQ ID NO: 4217415 - DNA, 22 bp, Homo sapiens
caaaaacagcctcacagaagaa

SEQ ID NO: 4217416 - DNA, 11 bp, Homo sapiens
caaaactgcca

SEQ ID NO: 4217417 - DNA, 15 bp, Homo sapiens
caaaagatgggtggt

SEQ ID NO: 4217418 - DNA, 13 bp, Homo sapiens
caaaaggtgcctg

SEQ ID NO: 4217419 - DNA, 18 bp, Homo sapiens
caaaaggtgcctgtgagg

SEQ ID NO: 4217420 - DNA, 23 bp, Homo sapiens
caaacacccaagtggcccccacc

SEQ ID NO: 4217421 - DNA, 21 bp, Homo sapiens
caaacttagtttttatctttg

SEQ ID NO: 4217422 - DNA, 22 bp, Homo sapiens
caaacttccaaaggtttaaact

SEQ ID NO: 4217423 - DNA, 22 bp, Homo sapiens
caaagaaaaacaatgaaattga

SEQ ID NO: 4217424 - DNA, 21 bp, Homo sapiens
caaagaattcctgaagccaga

SEQ ID NO: 4217425 - DNA, 15 bp, Homo sapiens
caaagtatcaaagaa

SEQ ID NO: 4217426 - DNA, 16 bp, Homo sapiens
caaatctgtctcccca

SEQ ID NO: 4217427 - DNA, 20 bp, Homo sapiens
caaatgtcacagtaatgcaa

SEQ ID NO: 4217428 - DNA, 15 bp, Homo sapiens
caaatgtcagagcta

SEQ ID NO: 4217429 - DNA, 14 bp, Homo sapiens
caaattactccaag

SEQ ID NO: 4217430 - DNA, 20 bp, Homo sapiens
caaatttaaccataaatcaa

SEQ ID NO: 4217431 - DNA, 18 bp, Homo sapiens
caacagagaaggcaggaa

SEQ ID NO: 4217432 - DNA, 16 bp, Homo sapiens
caaccaatgtagaaag

SEQ ID NO: 4217433 - DNA, 13 bp, Homo sapiens
caacccaaactga

SEQ ID NO: 4217434 - DNA, 14 bp, Homo sapiens
caaccccagttctg

SEQ ID NO: 4217435 - DNA, 19 bp, Homo sapiens
caaccccagttctgctcct

SEQ ID NO: 4217436 - DNA, 22 bp, Homo sapiens
caaccccagttctgctcctctc

SEQ ID NO: 4217437 - DNA, 15 bp, Homo sapiens
caacctgaccaacat

SEQ ID NO: 4217438 - DNA, 21 bp, Homo sapiens
caacctgaccaacatggagaa

SEQ ID NO: 4217439 - DNA, 14 bp, Homo sapiens
caaccttaccaaaa

SEQ ID NO: 4217440 - DNA, 18 bp, Homo sapiens
caacctttgtaagaaaac

SEQ ID NO: 4217441 - DNA, 22 bp, Homo sapiens
caacctttgtaagaaaaccaaa

SEQ ID NO: 4217442 - DNA, 18 bp, Homo sapiens
caactatgatttggaaaa

SEQ ID NO: 4217443 - DNA, 19 bp, Homo sapiens
caactatgatttggaaaat

SEQ ID NO: 4217444 - DNA, 14 bp, Homo sapiens
caactcctggaagc

SEQ ID NO: 4217445 - DNA, 16 bp, Homo sapiens
caacttcaagtgcatg

SEQ ID NO: 4217446 - DNA, 12 bp, Homo sapiens
caacttcccaaa

SEQ ID NO: 4217447 - DNA, 14 bp, Homo sapiens
caacttcccaaagc

SEQ ID NO: 4217448 - DNA, 16 bp, Homo sapiens
caacttgtaaatgtgg

SEQ ID NO: 4217449 - DNA, 12 bp, Homo sapiens
caacttgtgaac

SEQ ID NO: 4217450 - DNA, 12 bp, Homo sapiens
caactttccccc

SEQ ID NO: 4217451 - DNA, 13 bp, Homo sapiens
caactttcccccc

SEQ ID NO: 4217452 - DNA, 18 bp, Homo sapiens
caagagccttggtgtcca

SEQ ID NO: 4217453 - DNA, 11 bp, Homo sapiens
caagaggaaaa

SEQ ID NO: 4217454 - DNA, 17 bp, Homo sapiens
caagaggaaaaacaggg

SEQ ID NO: 4217455 - DNA, 13 bp, Homo sapiens
caagattcccaga

SEQ ID NO: 4217456 - DNA, 18 bp, Homo sapiens
caagattcccagagacag

SEQ ID NO: 4217457 - DNA, 23 bp, Homo sapiens
caagattcccagagacaggaaaa

SEQ ID NO: 4217458 - DNA, 18 bp, Homo sapiens
caagattttccacaagat

SEQ ID NO: 4217459 - DNA, 16 bp, Homo sapiens
caagcaacccaaactg

SEQ ID NO: 4217460 - DNA, 17 bp, Homo sapiens
caagcagaaaaattaaa

SEQ ID NO: 4217461 - DNA, 21 bp, Homo sapiens
caagcctgtaatcccagctac

SEQ ID NO: 4217462 - DNA, 20 bp, Homo sapiens
caagcgaggtcaacagagaa

SEQ ID NO: 4217463 - DNA, 21 bp, Homo sapiens
caagctcacagttcctcgccc

SEQ ID NO: 4217464 - DNA, 20 bp, Homo sapiens
caaggaggaaaaacagacaa

SEQ ID NO: 4217465 - DNA, 19 bp, Homo sapiens
caaggccgctgttcaccca

SEQ ID NO: 4217466 - DNA, 22 bp, Homo sapiens
caaggccgctgttcacccacag

SEQ ID NO: 4217467 - DNA, 14 bp, Homo sapiens
caaggtttataaag

SEQ ID NO: 4217468 - DNA, 16 bp, Homo sapiens
caaggtttataaagca

SEQ ID NO: 4217469 - DNA, 18 bp, Homo sapiens
caaggtttataaagcaga

SEQ ID NO: 4217470 - DNA, 14 bp, Homo sapiens
caagtactgctgta

SEQ ID NO: 4217471 - DNA, 18 bp, Homo sapiens
caagtctggatctgggac

SEQ ID NO: 4217472 - DNA, 17 bp, Homo sapiens
caagtgcatgctctctg

SEQ ID NO: 4217473 - DNA, 14 bp, Homo sapiens
caagtgggggcaga

SEQ ID NO: 4217474 - DNA, 13 bp, Homo sapiens
caatactgagcca

SEQ ID NO: 4217475 - DNA, 17 bp, Homo sapiens
caatatttttattttta

SEQ ID NO: 4217476 - DNA, 15 bp, Homo sapiens
caatctaaattaaaa

SEQ ID NO: 4217477 - DNA, 12 bp, Homo sapiens
caatgcaacatt

SEQ ID NO: 4217478 - DNA, 18 bp, Homo sapiens
caatgctcaaacacccaa

SEQ ID NO: 4217479 - DNA, 17 bp, Homo sapiens
caatgtagaaagctttg

SEQ ID NO: 4217480 - DNA, 16 bp, Homo sapiens
caattccacccctcct

SEQ ID NO: 4217481 - DNA, 23 bp, Homo sapiens
caatttgctgaaaacattacatg

SEQ ID NO: 4217482 - DNA, 19 bp, Homo sapiens
cacaaagcagtttttcccc

SEQ ID NO: 4217483 - DNA, 23 bp, Homo sapiens
cacaacataaggagaatgtatct

SEQ ID NO: 4217484 - DNA, 14 bp, Homo sapiens
cacaacgggccagc

SEQ ID NO: 4217485 - DNA, 14 bp, Homo sapiens
cacaagattcccag

SEQ ID NO: 4217486 - DNA, 15 bp, Homo sapiens
cacaagattcccaga

SEQ ID NO: 4217487 - DNA, 19 bp, Homo sapiens
cacaagattcccagagaca

SEQ ID NO: 4217488 - DNA, 22 bp, Homo sapiens
cacaagattcccagagacagga

SEQ ID NO: 4217489 - DNA, 20 bp, Homo sapiens
cacaccatcttaaatgacag

SEQ ID NO: 4217490 - DNA, 17 bp, Homo sapiens
cacactgcaagagcctt

SEQ ID NO: 4217491 - DNA, 18 bp, Homo sapiens
cacactgcaagagccttg

SEQ ID NO: 4217492 - DNA, 12 bp, Homo sapiens
cacagcctgggt

SEQ ID NO: 4217493 - DNA, 16 bp, Homo sapiens
cacagctcccacccca

SEQ ID NO: 4217494 - DNA, 17 bp, Homo sapiens
cacagctcccaccccac

SEQ ID NO: 4217495 - DNA, 23 bp, Homo sapiens
atcaagttggcttctaatcaaag

SEQ ID NO: 4217496 - DNA, 16 bp, Homo sapiens
atcaattcatgtttaa

SEQ ID NO: 4217497 - DNA, 20 bp, Homo sapiens
atcacaagaatcacctcaaa

SEQ ID NO: 4217498 - DNA, 15 bp, Homo sapiens
atcacagaggcttct

SEQ ID NO: 4217499 - DNA, 20 bp, Homo sapiens
atcacagtgttatgtagtat

SEQ ID NO: 4217500 - DNA, 17 bp, Homo sapiens
atcactgagccatcatt

SEQ ID NO: 4217501 - DNA, 19 bp, Homo sapiens
atcagaccctaccccacca

SEQ ID NO: 4217502 - DNA, 13 bp, Homo sapiens
atcagagctcctc

SEQ ID NO: 4217503 - DNA, 20 bp, Homo sapiens
atcagagctcctctgtcctg

SEQ ID NO: 4217504 - DNA, 19 bp, Homo sapiens
atcagctgttaaccatttg

SEQ ID NO: 4217505 - DNA, 17 bp, Homo sapiens
atcagttactcagccct

SEQ ID NO: 4217506 - DNA, 18 bp, Homo sapiens
atcagttactcagccctg

SEQ ID NO: 4217507 - DNA, 21 bp, Homo sapiens
atcagttactcagccctgggc

SEQ ID NO: 4217508 - DNA, 21 bp, Homo sapiens
atcattcatccaggactgaga

SEQ ID NO: 4217509 - DNA, 23 bp, Homo sapiens
atcattctttcccctcagagctc

SEQ ID NO: 4217510 - DNA, 12 bp, Homo sapiens
atcatttgtgaa

SEQ ID NO: 4217511 - DNA, 13 bp, Homo sapiens
atcatttgtgaag

SEQ ID NO: 4217512 - DNA, 16 bp, Homo sapiens
atcatttgtgaagaat

SEQ ID NO: 4217513 - DNA, 21 bp, Homo sapiens
atccaccctatccctgtacag

SEQ ID NO: 4217514 - DNA, 18 bp, Homo sapiens
atccaccctcaaatgtca

SEQ ID NO: 4217515 - DNA, 14 bp, Homo sapiens
atccattcctcagg

SEQ ID NO: 4217516 - DNA, 18 bp, Homo sapiens
atccattcctcagggaca

SEQ ID NO: 4217517 - DNA, 20 bp, Homo sapiens
atcccacccaacagctcaga

SEQ ID NO: 4217518 - DNA, 14 bp, Homo sapiens
atcccattgccctg

SEQ ID NO: 4217519 - DNA, 19 bp, Homo sapiens
atcctaatgaatgcataaa

SEQ ID NO: 4217520 - DNA, 10 bp, Homo sapiens
atcctctggc

SEQ ID NO: 4217521 - DNA, 14 bp, Homo sapiens
atcctctggctggc

SEQ ID NO: 4217522 - DNA, 16 bp, Homo sapiens
atcctgaataaaccag

SEQ ID NO: 4217523 - DNA, 21 bp, Homo sapiens
atccttaggaaaatgcttctg

SEQ ID NO: 4217524 - DNA, 17 bp, Homo sapiens
atccttccatttcttct

SEQ ID NO: 4217525 - DNA, 17 bp, Homo sapiens
atccttcctataacttg

SEQ ID NO: 4217526 - DNA, 22 bp, Homo sapiens
atccttcctataacttgatgca

SEQ ID NO: 4217527 - DNA, 13 bp, Homo sapiens
atcgaaaagaagg

SEQ ID NO: 4217528 - DNA, 20 bp, Homo sapiens
atcggcccacagctcccacc

SEQ ID NO: 4217529 - DNA, 16 bp, Homo sapiens
atcgtgatcactgagc

SEQ ID NO: 4217530 - DNA, 23 bp, Homo sapiens
atcgtgccgttactctccaacct

SEQ ID NO: 4217531 - DNA, 21 bp, Homo sapiens
atctaatgtctcttcctctgt

SEQ ID NO: 4217532 - DNA, 17 bp, Homo sapiens
atctagcagtaaaagat

SEQ ID NO: 4217533 - DNA, 18 bp, Homo sapiens
atctagcagtaaaagata

SEQ ID NO: 4217534 - DNA, 12 bp, Homo sapiens
atctccctgccg

SEQ ID NO: 4217535 - DNA, 14 bp, Homo sapiens
atctctcaaactta

SEQ ID NO: 4217536 - DNA, 16 bp, Homo sapiens
atctgggaccctttcc

SEQ ID NO: 4217537 - DNA, 19 bp, Homo sapiens
atcttattcccaattaaaa

SEQ ID NO: 4217538 - DNA, 21 bp, Homo sapiens
atgaacaaagaaaaaaatata

SEQ ID NO: 4217539 - DNA, 18 bp, Homo sapiens
atgaatttgggatactaa

SEQ ID NO: 4217540 - DNA, 19 bp, Homo sapiens
atgacaagattaggaatat

SEQ ID NO: 4217541 - DNA, 21 bp, Homo sapiens
atgacagctgtccctgtcacc

SEQ ID NO: 4217542 - DNA, 15 bp, Homo sapiens
atgacatgacctttc

SEQ ID NO: 4217543 - DNA, 11 bp, Homo sapiens
atgagaaatgt

SEQ ID NO: 4217544 - DNA, 15 bp, Homo sapiens
atgagctgtatctgt

SEQ ID NO: 4217545 - DNA, 15 bp, Homo sapiens
atgatcctaatgaat

SEQ ID NO: 4217546 - DNA, 12 bp, Homo sapiens
atgatctccctg

SEQ ID NO: 4217547 - DNA, 17 bp, Homo sapiens
atgatttaaaaaataaa

SEQ ID NO: 4217548 - DNA, 21 bp, Homo sapiens
atgatttaaaaaataaatata

SEQ ID NO: 4217549 - DNA, 23 bp, Homo sapiens
atgatttaaaaaataaatataat

SEQ ID NO: 4217550 - DNA, 17 bp, Homo sapiens
atgcagcatctaagtaa

SEQ ID NO: 4217551 - DNA, 14 bp, Homo sapiens
atgcatccattcct

SEQ ID NO: 4217552 - DNA, 23 bp, Homo sapiens
atgcatccattcctcagggacag

SEQ ID NO: 4217553 - DNA, 22 bp, Homo sapiens
atgccatgtttagattccagga

SEQ ID NO: 4217554 - DNA, 13 bp, Homo sapiens
atgcctccaccgc

SEQ ID NO: 4217555 - DNA, 19 bp, Homo sapiens
atgctctctgcagccagcc

SEQ ID NO: 4217556 - DNA, 23 bp, Homo sapiens
atgctctctgcagccagcccagc

SEQ ID NO: 4217557 - DNA, 19 bp, Homo sapiens
atgctgctaattcaaagct

SEQ ID NO: 4217558 - DNA, 14 bp, Homo sapiens
atgctgttgcctca

SEQ ID NO: 4217559 - DNA, 13 bp, Homo sapiens
atgcttgtgtata

SEQ ID NO: 4217560 - DNA, 17 bp, Homo sapiens
atgctttgaatgcaaaa

SEQ ID NO: 4217561 - DNA, 22 bp, Homo sapiens
atggaaaacagagtatttctgg

SEQ ID NO: 4217562 - DNA, 16 bp, Homo sapiens
atggacaatataaact

SEQ ID NO: 4217563 - DNA, 16 bp, Homo sapiens
atggacagatggacca

SEQ ID NO: 4217564 - DNA, 13 bp, Homo sapiens
atggaggagaaga

SEQ ID NO: 4217565 - DNA, 22 bp, Homo sapiens
atgggacatcaaatttgccacc

SEQ ID NO: 4217566 - DNA, 13 bp, Homo sapiens
atgggaggaaaga

SEQ ID NO: 4217567 - DNA, 22 bp, Homo sapiens
atggggctgaacggggagaaaa

SEQ ID NO: 4217568 - DNA, 19 bp, Homo sapiens
atggggtgggcagggctgg

SEQ ID NO: 4217569 - DNA, 20 bp, Homo sapiens
atgtaaacagtgcctgctga

SEQ ID NO: 4217570 - DNA, 18 bp, Homo sapiens
atgtatatttgcatattt

SEQ ID NO: 4217571 - DNA, 13 bp, Homo sapiens
atgtcaccacctt

SEQ ID NO: 4217572 - DNA, 15 bp, Homo sapiens
atgtcaccaccttcc

SEQ ID NO: 4217573 - DNA, 19 bp, Homo sapiens
atgtcaccaccttcccagc

SEQ ID NO: 4217574 - DNA, 21 bp, Homo sapiens
atgtctctcagaattcttcag

SEQ ID NO: 4217575 - DNA, 20 bp, Homo sapiens
atgtctcttcctctgttcta

SEQ ID NO: 4217576 - DNA, 20 bp, Homo sapiens
atgtctgcttctgtccagga

SEQ ID NO: 4217577 - DNA, 16 bp, Homo sapiens
atgtgaatcagaccct

SEQ ID NO: 4217578 - DNA, 17 bp, Homo sapiens
atgtgataatatattgc

SEQ ID NO: 4217579 - DNA, 14 bp, Homo sapiens
atgtggccctggcc

SEQ ID NO: 4217580 - DNA, 16 bp, Homo sapiens
atgtggccctggcctg

SEQ ID NO: 4217581 - DNA, 17 bp, Homo sapiens
atgtggtttggttcctc

SEQ ID NO: 4217582 - DNA, 15 bp, Homo sapiens
atgtgtggcagattt

SEQ ID NO: 4217583 - DNA, 19 bp, Homo sapiens
atgttactgagatgtttta

SEQ ID NO: 4217584 - DNA, 14 bp, Homo sapiens
atgttattatgcta

SEQ ID NO: 4217585 - DNA, 16 bp, Homo sapiens
atgttattatgctaat

SEQ ID NO: 4217586 - DNA, 16 bp, Homo sapiens
atgtttagattccagg

SEQ ID NO: 4217587 - DNA, 17 bp, Homo sapiens
atgtttagattccagga

SEQ ID NO: 4217588 - DNA, 15 bp, Homo sapiens
atgtttataaactga

SEQ ID NO: 4217589 - DNA, 23 bp, Homo sapiens
atgtttggttttccaaaagaaca

SEQ ID NO: 4217590 - DNA, 12 bp, Homo sapiens
atgttttaccat

SEQ ID NO: 4217591 - DNA, 23 bp, Homo sapiens
attaaaaaagaaagaaatttgaa

SEQ ID NO: 4217592 - DNA, 11 bp, Homo sapiens
attaaaagact

SEQ ID NO: 4217593 - DNA, 17 bp, Homo sapiens
attaaaagactccacat

SEQ ID NO: 4217594 - DNA, 13 bp, Homo sapiens
attaagatttcca

SEQ ID NO: 4217595 - DNA, 13 bp, Homo sapiens
attaatacagagt

SEQ ID NO: 4217596 - DNA, 14 bp, Homo sapiens
attaatgttgatga

SEQ ID NO: 4217597 - DNA, 19 bp, Homo sapiens
attaatttgtgaatttgca

SEQ ID NO: 4217598 - DNA, 13 bp, Homo sapiens
attagaaatcaac

SEQ ID NO: 4217599 - DNA, 18 bp, Homo sapiens
attagattatttctgtat

SEQ ID NO: 4217600 - DNA, 14 bp, Homo sapiens
attatagaattgca

SEQ ID NO: 4217601 - DNA, 21 bp, Homo sapiens
attatatttctacagagaaaa

SEQ ID NO: 4217602 - DNA, 17 bp, Homo sapiens
attatgtaacatccaga

SEQ ID NO: 4217603 - DNA, 15 bp, Homo sapiens
attatgtgcaacatt

SEQ ID NO: 4217604 - DNA, 18 bp, Homo sapiens
attattcagtgaatttgt

SEQ ID NO: 4217605 - DNA, 13 bp, Homo sapiens
attattgctgttg

SEQ ID NO: 4217606 - DNA, 14 bp, Homo sapiens
attatttaatttgt

SEQ ID NO: 4217607 - DNA, 16 bp, Homo sapiens
attatttaatttgtat

SEQ ID NO: 4217608 - DNA, 17 bp, Homo sapiens
attcaaagctctattaa

SEQ ID NO: 4217609 - DNA, 18 bp, Homo sapiens
attcaaccttaccaaaaa

SEQ ID NO: 4217610 - DNA, 18 bp, Homo sapiens
attcatccaggactgaga

SEQ ID NO: 4217611 - DNA, 18 bp, Homo sapiens
attcatctctcaaactta

SEQ ID NO: 4217612 - DNA, 19 bp, Homo sapiens
attcatctctcaaacttag

SEQ ID NO: 4217613 - DNA, 19 bp, Homo sapiens
attcatttgagttatttta

SEQ ID NO: 4217614 - DNA, 12 bp, Homo sapiens
attcccagagac

SEQ ID NO: 4217615 - DNA, 22 bp, Homo sapiens
attccccaggtggctgacccag

SEQ ID NO: 4217616 - DNA, 19 bp, Homo sapiens
attccctgagtcaccagga

SEQ ID NO: 4217617 - DNA, 14 bp, Homo sapiens
attcctcagggaca

SEQ ID NO: 4217618 - DNA, 15 bp, Homo sapiens
attctagctttgagc

SEQ ID NO: 4217619 - DNA, 16 bp, Homo sapiens
attctcactccaccac

SEQ ID NO: 4217620 - DNA, 21 bp, Homo sapiens
attctttcccctcagagctct

SEQ ID NO: 4217621 - DNA, 14 bp, Homo sapiens
attctttttaaagt

SEQ ID NO: 4217622 - DNA, 15 bp, Homo sapiens
agggccttgcccaga

SEQ ID NO: 4217623 - DNA, 16 bp, Homo sapiens
agggcgtgactcaccc

SEQ ID NO: 4217624 - DNA, 13 bp, Homo sapiens
agggctaagagct

SEQ ID NO: 4217625 - DNA, 16 bp, Homo sapiens
agggctggggccaaga

SEQ ID NO: 4217626 - DNA, 10 bp, Homo sapiens
aggggagagg

SEQ ID NO: 4217627 - DNA, 14 bp, Homo sapiens
aggggttgaagaaa

SEQ ID NO: 4217628 - DNA, 13 bp, Homo sapiens
agggtctggagaa

SEQ ID NO: 4217629 - DNA, 17 bp, Homo sapiens
aggtcaacagagaaggc

SEQ ID NO: 4217630 - DNA, 17 bp, Homo sapiens
aggtgccccaaaatgca

SEQ ID NO: 4217631 - DNA, 11 bp, Homo sapiens
aggtgcctgtg

SEQ ID NO: 4217632 - DNA, 17 bp, Homo sapiens
aggtgcctgtgaggcag

SEQ ID NO: 4217633 - DNA, 18 bp, Homo sapiens
aggtgcctgtgaggcagg

SEQ ID NO: 4217634 - DNA, 22 bp, Homo sapiens
aggtgccttcttattctcactc

SEQ ID NO: 4217635 - DNA, 18 bp, Homo sapiens
aggtggaaaaacatctga

SEQ ID NO: 4217636 - DNA, 13 bp, Homo sapiens
aggtggaagccct

SEQ ID NO: 4217637 - DNA, 19 bp, Homo sapiens
aggtgggttttcttcccat

SEQ ID NO: 4217638 - DNA, 17 bp, Homo sapiens
aggttgcagtgagctga

SEQ ID NO: 4217639 - DNA, 17 bp, Homo sapiens
aggttggaagagaatca

SEQ ID NO: 4217640 - DNA, 18 bp, Homo sapiens
aggttggaagagaatcac

SEQ ID NO: 4217641 - DNA, 15 bp, Homo sapiens
aggtttataaagcag

SEQ ID NO: 4217642 - DNA, 16 bp, Homo sapiens
aggtttataaagcaga

SEQ ID NO: 4217643 - DNA, 15 bp, Homo sapiens
aggtttcttccaccc

SEQ ID NO: 4217644 - DNA, 23 bp, Homo sapiens
aggtttcttggggtcccagggaa

SEQ ID NO: 4217645 - DNA, 12 bp, Homo sapiens
agtaaaaataaa

SEQ ID NO: 4217646 - DNA, 14 bp, Homo sapiens
agtaaatatgtgaa

SEQ ID NO: 4217647 - DNA, 16 bp, Homo sapiens
agtacgttaaaagcaa

SEQ ID NO: 4217648 - DNA, 17 bp, Homo sapiens
agtagccgagagcctgc

SEQ ID NO: 4217649 - DNA, 18 bp, Homo sapiens
agtagccgagagcctgct

SEQ ID NO: 4217650 - DNA, 16 bp, Homo sapiens
agtataagatttttga

SEQ ID NO: 4217651 - DNA, 20 bp, Homo sapiens
agtatgcagattatttgccc

SEQ ID NO: 4217652 - DNA, 19 bp, Homo sapiens
agtattgttctatttttgt

SEQ ID NO: 4217653 - DNA, 14 bp, Homo sapiens
agtcaattccaccc

SEQ ID NO: 4217654 - DNA, 19 bp, Homo sapiens
agtcaattccacccctcct

SEQ ID NO: 4217655 - DNA, 14 bp, Homo sapiens
agtcaatttgctga

SEQ ID NO: 4217656 - DNA, 16 bp, Homo sapiens
agtcaatttgctgaaa

SEQ ID NO: 4217657 - DNA, 17 bp, Homo sapiens
agtcatgatctccctgc

SEQ ID NO: 4217658 - DNA, 20 bp, Homo sapiens
agtcatgatctccctgccgc

SEQ ID NO: 4217659 - DNA, 23 bp, Homo sapiens
agtcatgatctccctgccgcctc

SEQ ID NO: 4217660 - DNA, 18 bp, Homo sapiens
agtcccccagagatgtca

SEQ ID NO: 4217661 - DNA, 11 bp, Homo sapiens
agtcccggctt

SEQ ID NO: 4217662 - DNA, 17 bp, Homo sapiens
agtccctgggggaagcc

SEQ ID NO: 4217663 - DNA, 18 bp, Homo sapiens
agtctaggagctgggagg

SEQ ID NO: 4217664 - DNA, 18 bp, Homo sapiens
agtctcccactgcaactt

SEQ ID NO: 4217665 - DNA, 15 bp, Homo sapiens
agtctgaaagacaga

SEQ ID NO: 4217666 - DNA, 17 bp, Homo sapiens
agtctggatctgggacc

SEQ ID NO: 4217667 - DNA, 14 bp, Homo sapiens
agtgaatttgtcca

SEQ ID NO: 4217668 - DNA, 19 bp, Homo sapiens
agtgaatttgtccattgta

SEQ ID NO: 4217669 - DNA, 22 bp, Homo sapiens
agtgaatttgtccattgtaaat

SEQ ID NO: 4217670 - DNA, 23 bp, Homo sapiens
agtgagctgagatcgtgccgtta

SEQ ID NO: 4217671 - DNA, 15 bp, Homo sapiens
agtgcatgctctctg

SEQ ID NO: 4217672 - DNA, 22 bp, Homo sapiens
agtgcatgctctctgcagccag

SEQ ID NO: 4217673 - DNA, 19 bp, Homo sapiens
agtgccttacctcctgccc

SEQ ID NO: 4217674 - DNA, 22 bp, Homo sapiens
agtgccttacctcctgcccagg

SEQ ID NO: 4217675 - DNA, 12 bp, Homo sapiens
agtggagaaata

SEQ ID NO: 4217676 - DNA, 19 bp, Homo sapiens
agtggatggacagatggac

SEQ ID NO: 4217677 - DNA, 20 bp, Homo sapiens
agtgggaacgtgactgcccc

SEQ ID NO: 4217678 - DNA, 12 bp, Homo sapiens
agtgggagaaaa

SEQ ID NO: 4217679 - DNA, 17 bp, Homo sapiens
agtgggagaaaacactt

SEQ ID NO: 4217680 - DNA, 13 bp, Homo sapiens
agtgggccaggac

SEQ ID NO: 4217681 - DNA, 15 bp, Homo sapiens
agtgggccaggacag

SEQ ID NO: 4217682 - DNA, 18 bp, Homo sapiens
agtggggtctccctctcc

SEQ ID NO: 4217683 - DNA, 20 bp, Homo sapiens
agtggggtctccctctcctg

SEQ ID NO: 4217684 - DNA, 16 bp, Homo sapiens
agtgtgcagactgatg

SEQ ID NO: 4217685 - DNA, 15 bp, Homo sapiens
agtgtgggaagggag

SEQ ID NO: 4217686 - DNA, 17 bp, Homo sapiens
agtgtgggaagggagag

SEQ ID NO: 4217687 - DNA, 19 bp, Homo sapiens
agtgttatgtagtattgtt

SEQ ID NO: 4217688 - DNA, 18 bp, Homo sapiens
agttactcagccctgggc

SEQ ID NO: 4217689 - DNA, 23 bp, Homo sapiens
agttattcttggtactgttgctt

SEQ ID NO: 4217690 - DNA, 16 bp, Homo sapiens
agttcagatacagggt

SEQ ID NO: 4217691 - DNA, 14 bp, Homo sapiens
agttccctgaaaac

SEQ ID NO: 4217692 - DNA, 24 bp, Homo sapiens
agttccctgaaaacccagagagga

SEQ ID NO: 4217693 - DNA, 13 bp, Homo sapiens
agttcctcgccct

SEQ ID NO: 4217694 - DNA, 15 bp, Homo sapiens
agttcctcgccctgg

SEQ ID NO: 4217695 - DNA, 17 bp, Homo sapiens
agttcctcgccctgggt

SEQ ID NO: 4217696 - DNA, 18 bp, Homo sapiens
agttcgagaccaacctga

SEQ ID NO: 4217697 - DNA, 22 bp, Homo sapiens
agttctgcccaaattatgtgaa

SEQ ID NO: 4217698 - DNA, 17 bp, Homo sapiens
agttctgctcctctcca

SEQ ID NO: 4217699 - DNA, 17 bp, Homo sapiens
agttgtggaaagataat

SEQ ID NO: 4217700 - DNA, 14 bp, Homo sapiens
agtttaagtctcct

SEQ ID NO: 4217701 - DNA, 23 bp, Homo sapiens
agtttgcagaaaagcacctgccg

SEQ ID NO: 4217702 - DNA, 11 bp, Homo sapiens
agttttaaata

SEQ ID NO: 4217703 - DNA, 12 bp, Homo sapiens
agttttaaatat

SEQ ID NO: 4217704 - DNA, 21 bp, Homo sapiens
agttttaaatatgaacaaaga

SEQ ID NO: 4217705 - DNA, 13 bp, Homo sapiens
ataaaaaccataa

SEQ ID NO: 4217706 - DNA, 18 bp, Homo sapiens
ataaaaaccataaacatt

SEQ ID NO: 4217707 - DNA, 14 bp, Homo sapiens
ataaaaattgaaaa

SEQ ID NO: 4217708 - DNA, 15 bp, Homo sapiens
ataaaaattgaaaaa

SEQ ID NO: 4217709 - DNA, 16 bp, Homo sapiens
ataaaattaaagctga

SEQ ID NO: 4217710 - DNA, 19 bp, Homo sapiens
ataaactgaaaaatgtcag

SEQ ID NO: 4217711 - DNA, 15 bp, Homo sapiens
ataaacttaattttg

SEQ ID NO: 4217712 - DNA, 16 bp, Homo sapiens
ataaagcaaattactc

SEQ ID NO: 4217713 - DNA, 17 bp, Homo sapiens
ataaagcagattacctc

SEQ ID NO: 4217714 - DNA, 17 bp, Homo sapiens
ataaagctcctctgctc

SEQ ID NO: 4217715 - DNA, 15 bp, Homo sapiens
ataaatataattggg

SEQ ID NO: 4217716 - DNA, 14 bp, Homo sapiens
ataaattgatttgt

SEQ ID NO: 4217717 - DNA, 14 bp, Homo sapiens
ataactgaaggaga

SEQ ID NO: 4217718 - DNA, 16 bp, Homo sapiens
ataactgaaggagaag

SEQ ID NO: 4217719 - DNA, 17 bp, Homo sapiens
ataacttgatgcatgtg

SEQ ID NO: 4217720 - DNA, 14 bp, Homo sapiens
ataagatttttgaa

SEQ ID NO: 4217721 - DNA, 15 bp, Homo sapiens
ataagatttttgaaa

SEQ ID NO: 4217722 - DNA, 16 bp, Homo sapiens
ataagcttttggtaat

SEQ ID NO: 4217723 - DNA, 14 bp, Homo sapiens
ataataaattgatt

SEQ ID NO: 4217724 - DNA, 22 bp, Homo sapiens
ataatcggcccacagctcccac

SEQ ID NO: 4217725 - DNA, 21 bp, Homo sapiens
ataccatatgtctgcttctgt

SEQ ID NO: 4217726 - DNA, 22 bp, Homo sapiens
atactgccggtcacccaggctc

SEQ ID NO: 4217727 - DNA, 18 bp, Homo sapiens
atagccgggcatggtggc

SEQ ID NO: 4217728 - DNA, 21 bp, Homo sapiens
atagcttattatagaattgca

SEQ ID NO: 4217729 - DNA, 23 bp, Homo sapiens
atagtatttcagatacttgaaga

SEQ ID NO: 4217730 - DNA, 15 bp, Homo sapiens
atataattgggattt

SEQ ID NO: 4217731 - DNA, 18 bp, Homo sapiens
atataattgggattttaa

SEQ ID NO: 4217732 - DNA, 18 bp, Homo sapiens
atatcagttactcagccc

SEQ ID NO: 4217733 - DNA, 19 bp, Homo sapiens
atatcagttactcagccct

SEQ ID NO: 4217734 - DNA, 21 bp, Homo sapiens
atatcagttactcagccctgg

SEQ ID NO: 4217735 - DNA, 22 bp, Homo sapiens
atatcagttactcagccctggg

SEQ ID NO: 4217736 - DNA, 14 bp, Homo sapiens
atatgtataaatta

SEQ ID NO: 4217737 - DNA, 13 bp, Homo sapiens
atatgtctgcttc

SEQ ID NO: 4217738 - DNA, 16 bp, Homo sapiens
atatgtctgcttctgt

SEQ ID NO: 4217739 - DNA, 13 bp, Homo sapiens
atatgtgaagaaa

SEQ ID NO: 4217740 - DNA, 18 bp, Homo sapiens
atatgtgaagaaaaagac

SEQ ID NO: 4217741 - DNA, 13 bp, Homo sapiens
atattaaaatcac

SEQ ID NO: 4217742 - DNA, 21 bp, Homo sapiens
atattgctaaaatattttaga

SEQ ID NO: 4217743 - DNA, 22 bp, Homo sapiens
atatttctacagagaaaatgaa

SEQ ID NO: 4217744 - DNA, 13 bp, Homo sapiens
atattttatgatt

SEQ ID NO: 4217745 - DNA, 16 bp, Homo sapiens
atatttttctaaagaa

SEQ ID NO: 4217746 - DNA, 13 bp, Homo sapiens
atatttttttcct

SEQ ID NO: 4217747 - DNA, 23 bp, Homo sapiens
atatttttttcctttgcattcat

SEQ ID NO: 4217748 - DNA, 24 bp, Homo sapiens
atcaaagaaaaacaatgaaattga

SEQ ID NO: 4217749 - DNA, 17 bp, Homo sapiens
atcaaatttgccaccac

SEQ ID NO: 4217750 - DNA, 15 bp, Homo sapiens
agatatgagttgttt

SEQ ID NO: 4217751 - DNA, 17 bp, Homo sapiens
agatatggcagcgaaag

SEQ ID NO: 4217752 - DNA, 18 bp, Homo sapiens
agatctccacggtcagat

SEQ ID NO: 4217753 - DNA, 18 bp, Homo sapiens
agatctctgctttggaaa

SEQ ID NO: 4217754 - DNA, 13 bp, Homo sapiens
agatggaccaaaa

SEQ ID NO: 4217755 - DNA, 19 bp, Homo sapiens
agatgggaggaaagagagc

SEQ ID NO: 4217756 - DNA, 17 bp, Homo sapiens
agatgtatgctttgaat

SEQ ID NO: 4217757 - DNA, 20 bp, Homo sapiens
agatgtatgctttgaatgca

SEQ ID NO: 4217758 - DNA, 15 bp, Homo sapiens
agatgtcatcagagc

SEQ ID NO: 4217759 - DNA, 22 bp, Homo sapiens
agatgtcatcagagctcctctg

SEQ ID NO: 4217760 - DNA, 19 bp, Homo sapiens
agatgttttaccatcctta

SEQ ID NO: 4217761 - DNA, 12 bp, Homo sapiens
agattatttctg

SEQ ID NO: 4217762 - DNA, 18 bp, Homo sapiens
agattatttctgtatttg

SEQ ID NO: 4217763 - DNA, 12 bp, Homo sapiens
agattccaggat

SEQ ID NO: 4217764 - DNA, 21 bp, Homo sapiens
agatttttgaaaatcctgaat

SEQ ID NO: 4217765 - DNA, 20 bp, Homo sapiens
agcaaaagactctgtaccta

SEQ ID NO: 4217766 - DNA, 13 bp, Homo sapiens
agcaacccaaact

SEQ ID NO: 4217767 - DNA, 14 bp, Homo sapiens
agcaacccaaactg

SEQ ID NO: 4217768 - DNA, 22 bp, Homo sapiens
agcacaaagcagtttttccccc

SEQ ID NO: 4217769 - DNA, 16 bp, Homo sapiens
agcagccctcctcacc

SEQ ID NO: 4217770 - DNA, 15 bp, Homo sapiens
agcagtttttccccc

SEQ ID NO: 4217771 - DNA, 21 bp, Homo sapiens
agcatcgtgatcactgagcca

SEQ ID NO: 4217772 - DNA, 17 bp, Homo sapiens
agcattgtgcaatacag

SEQ ID NO: 4217773 - DNA, 17 bp, Homo sapiens
agccacgttccttactg

SEQ ID NO: 4217774 - DNA, 22 bp, Homo sapiens
agccacgttccttactgcagaa

SEQ ID NO: 4217775 - DNA, 15 bp, Homo sapiens
agccagagagacaga

SEQ ID NO: 4217776 - DNA, 15 bp, Homo sapiens
agccagcccagccca

SEQ ID NO: 4217777 - DNA, 23 bp, Homo sapiens
agccagccctccctgtcctcctc

SEQ ID NO: 4217778 - DNA, 21 bp, Homo sapiens
agccatttatacctttgaaat

SEQ ID NO: 4217779 - DNA, 23 bp, Homo sapiens
agccatttatacctttgaaatat

SEQ ID NO: 4217780 - DNA, 15 bp, Homo sapiens
agcccagcccagctg

SEQ ID NO: 4217781 - DNA, 13 bp, Homo sapiens
agcccagctggtg

SEQ ID NO: 4217782 - DNA, 17 bp, Homo sapiens
agcccattctctctcct

SEQ ID NO: 4217783 - DNA, 19 bp, Homo sapiens
agcccattctctctcctgt

SEQ ID NO: 4217784 - DNA, 20 bp, Homo sapiens
agcccattctctctcctgtc

SEQ ID NO: 4217785 - DNA, 11 bp, Homo sapiens
agcccctcctc

SEQ ID NO: 4217786 - DNA, 12 bp, Homo sapiens
agcccctcctct

SEQ ID NO: 4217787 - DNA, 14 bp, Homo sapiens
agcccctcctctgc

SEQ ID NO: 4217788 - DNA, 21 bp, Homo sapiens
agcccctcctctgccacctcc

SEQ ID NO: 4217789 - DNA, 13 bp, Homo sapiens
agccctatggatg

SEQ ID NO: 4217790 - DNA, 15 bp, Homo sapiens
agccctccctgtcct

SEQ ID NO: 4217791 - DNA, 19 bp, Homo sapiens
agccctccctgtcctcctc

SEQ ID NO: 4217792 - DNA, 22 bp, Homo sapiens
agccctccctgtcctcctcgga

SEQ ID NO: 4217793 - DNA, 11 bp, Homo sapiens
agccctccttc

SEQ ID NO: 4217794 - DNA, 17 bp, Homo sapiens
agccctccttccacgga

SEQ ID NO: 4217795 - DNA, 16 bp, Homo sapiens
agccgagagcctgctc

SEQ ID NO: 4217796 - DNA, 17 bp, Homo sapiens
agccgcatcttctccat

SEQ ID NO: 4217797 - DNA, 21 bp, Homo sapiens
agccgcatcttctccatctgg

SEQ ID NO: 4217798 - DNA, 15 bp, Homo sapiens
agcctcacagaagaa

SEQ ID NO: 4217799 - DNA, 11 bp, Homo sapiens
agcctgctccc

SEQ ID NO: 4217800 - DNA, 21 bp, Homo sapiens
agcctgctcccccaccccctc

SEQ ID NO: 4217801 - DNA, 23 bp, Homo sapiens
agcctgctcccccaccccctccc

SEQ ID NO: 4217802 - DNA, 16 bp, Homo sapiens
agcctgtaatcccagc

SEQ ID NO: 4217803 - DNA, 19 bp, Homo sapiens
agcctgtggcggtgcctgg

SEQ ID NO: 4217804 - DNA, 22 bp, Homo sapiens
agccttggataatgctgttgcc

SEQ ID NO: 4217805 - DNA, 23 bp, Homo sapiens
agccttggataatgctgttgcct

SEQ ID NO: 4217806 - DNA, 18 bp, Homo sapiens
agccttggtgtccacctg

SEQ ID NO: 4217807 - DNA, 12 bp, Homo sapiens
agcgaaactccg

SEQ ID NO: 4217808 - DNA, 19 bp, Homo sapiens
agcgaggtcaacagagaag

SEQ ID NO: 4217809 - DNA, 22 bp, Homo sapiens
agcgcctagtggggtctccctc

SEQ ID NO: 4217810 - DNA, 19 bp, Homo sapiens
agctaagccttatgtgagc

SEQ ID NO: 4217811 - DNA, 15 bp, Homo sapiens
agctagaagtgggcc

SEQ ID NO: 4217812 - DNA, 19 bp, Homo sapiens
agctagaagtgggccagga

SEQ ID NO: 4217813 - DNA, 22 bp, Homo sapiens
agctagaagtgggccaggacag

SEQ ID NO: 4217814 - DNA, 20 bp, Homo sapiens
agctagcgctgccgcacccc

SEQ ID NO: 4217815 - DNA, 18 bp, Homo sapiens
agctatgttccctccagc

SEQ ID NO: 4217816 - DNA, 19 bp, Homo sapiens
agctatgttccctccagca

SEQ ID NO: 4217817 - DNA, 17 bp, Homo sapiens
agctcagacccccactc

SEQ ID NO: 4217818 - DNA, 13 bp, Homo sapiens
agctcccacccca

SEQ ID NO: 4217819 - DNA, 15 bp, Homo sapiens
agctcccaccccacc

SEQ ID NO: 4217820 - DNA, 17 bp, Homo sapiens
agctcccaccccacccc

SEQ ID NO: 4217821 - DNA, 12 bp, Homo sapiens
agctcctctgct

SEQ ID NO: 4217822 - DNA, 15 bp, Homo sapiens
agctcctctgctcca

SEQ ID NO: 4217823 - DNA, 15 bp, Homo sapiens
agctcctctgtcctg

SEQ ID NO: 4217824 - DNA, 15 bp, Homo sapiens
agctctccctctggc

SEQ ID NO: 4217825 - DNA, 22 bp, Homo sapiens
agctgaatccttccatttcttc

SEQ ID NO: 4217826 - DNA, 16 bp, Homo sapiens
agctgagagtctgaaa

SEQ ID NO: 4217827 - DNA, 22 bp, Homo sapiens
agctggatctccattctctcag

SEQ ID NO: 4217828 - DNA, 20 bp, Homo sapiens
agctgggttggaaaacagta

SEQ ID NO: 4217829 - DNA, 13 bp, Homo sapiens
agctggtgggaag

SEQ ID NO: 4217830 - DNA, 20 bp, Homo sapiens
agctgtaggtgtgcgggacc

SEQ ID NO: 4217831 - DNA, 18 bp, Homo sapiens
agctgtccctgtcaccaa

SEQ ID NO: 4217832 - DNA, 19 bp, Homo sapiens
agcttgctcttcagtggga

SEQ ID NO: 4217833 - DNA, 22 bp, Homo sapiens
agcttgctcttcagtgggagaa

SEQ ID NO: 4217834 - DNA, 13 bp, Homo sapiens
aggaaaagaaaag

SEQ ID NO: 4217835 - DNA, 14 bp, Homo sapiens
aggaaaatcctctg

SEQ ID NO: 4217836 - DNA, 12 bp, Homo sapiens
aggaaagagagc

SEQ ID NO: 4217837 - DNA, 21 bp, Homo sapiens
aggaaggagactcacctctgc

SEQ ID NO: 4217838 - DNA, 23 bp, Homo sapiens
aggaaggagactcacctctgcct

SEQ ID NO: 4217839 - DNA, 15 bp, Homo sapiens
aggaaggctgagagg

SEQ ID NO: 4217840 - DNA, 22 bp, Homo sapiens
aggaaggctgagaggagagaga

SEQ ID NO: 4217841 - DNA, 22 bp, Homo sapiens
aggactcacaggttggaagaga

SEQ ID NO: 4217842 - DNA, 18 bp, Homo sapiens
aggagaatccaagcgagg

SEQ ID NO: 4217843 - DNA, 11 bp, Homo sapiens
aggagactcac

SEQ ID NO: 4217844 - DNA, 17 bp, Homo sapiens
aggagactcacctctgc

SEQ ID NO: 4217845 - DNA, 19 bp, Homo sapiens
aggagactcacctctgcct

SEQ ID NO: 4217846 - DNA, 16 bp, Homo sapiens
aggagctgggaggaaa

SEQ ID NO: 4217847 - DNA, 17 bp, Homo sapiens
aggagctgggaggaaaa

SEQ ID NO: 4217848 - DNA, 20 bp, Homo sapiens
aggaggtggaggttgcagtg

SEQ ID NO: 4217849 - DNA, 21 bp, Homo sapiens
aggagttgctgtttgtttgac

SEQ ID NO: 4217850 - DNA, 18 bp, Homo sapiens
aggatgtaaacagtgcct

SEQ ID NO: 4217851 - DNA, 22 bp, Homo sapiens
aggatgtaaacagtgcctgctg

SEQ ID NO: 4217852 - DNA, 20 bp, Homo sapiens
aggcacgaacccacctgctg

SEQ ID NO: 4217853 - DNA, 15 bp, Homo sapiens
aggcagaagaattga

SEQ ID NO: 4217854 - DNA, 21 bp, Homo sapiens
aggcagaagaattgaacccag

SEQ ID NO: 4217855 - DNA, 20 bp, Homo sapiens
aggcagggccttgcccagag

SEQ ID NO: 4217856 - DNA, 19 bp, Homo sapiens
aggccactcctccaaagga

SEQ ID NO: 4217857 - DNA, 17 bp, Homo sapiens
aggccccgcttgtccag

SEQ ID NO: 4217858 - DNA, 20 bp, Homo sapiens
aggccccgcttgtccagcgc

SEQ ID NO: 4217859 - DNA, 22 bp, Homo sapiens
aggcgctgggggctggacctgc

SEQ ID NO: 4217860 - DNA, 19 bp, Homo sapiens
aggcgttcttcgaggtgga

SEQ ID NO: 4217861 - DNA, 15 bp, Homo sapiens
aggctggaggcaggg

SEQ ID NO: 4217862 - DNA, 17 bp, Homo sapiens
aggctggaggcagggcc

SEQ ID NO: 4217863 - DNA, 22 bp, Homo sapiens
aggcttcttcagatcagtgctt

SEQ ID NO: 4217864 - DNA, 13 bp, Homo sapiens
agggaacagacag

SEQ ID NO: 4217865 - DNA, 18 bp, Homo sapiens
agggaacagacaggagaa

SEQ ID NO: 4217866 - DNA, 20 bp, Homo sapiens
agggactcaagggtccagaa

SEQ ID NO: 4217867 - DNA, 21 bp, Homo sapiens
agggactcaagggtccagaag

SEQ ID NO: 4217868 - DNA, 13 bp, Homo sapiens
agggagaatgcag

SEQ ID NO: 4217869 - DNA, 20 bp, Homo sapiens
agggataatagacacatcaa

SEQ ID NO: 4217870 - DNA, 15 bp, Homo sapiens
agggccacgtgccag

SEQ ID NO: 4217871 - DNA, 16 bp, Homo sapiens
agggccacgtgccagg

SEQ ID NO: 4217872 - DNA, 18 bp, Homo sapiens
agggccacgtgccaggcc

SEQ ID NO: 4217873 - DNA, 19 bp, Homo sapiens
agggccacgtgccaggccc

SEQ ID NO: 4217874 - DNA, 12 bp, Homo sapiens
agggccttgccc

SEQ ID NO: 4217875 - DNA, 14 bp, Homo sapiens
agggccttgcccag

SEQ ID NO: 4217876 - DNA, 14 bp, Homo sapiens
ctgtaatcccagca

SEQ ID NO: 4217877 - DNA, 19 bp, Homo sapiens
ctgtaatcccagctactca

SEQ ID NO: 4217878 - DNA, 15 bp, Homo sapiens
ctgtaattaatattc

SEQ ID NO: 4217879 - DNA, 17 bp, Homo sapiens
ctgtactgtaatttctt

SEQ ID NO: 4217880 - DNA, 14 bp, Homo sapiens
ctgtatctgtaatt

SEQ ID NO: 4217881 - DNA, 20 bp, Homo sapiens
ctgtatctgtaattaatatt

SEQ ID NO: 4217882 - DNA, 14 bp, Homo sapiens
ctgtcacctggcct

SEQ ID NO: 4217883 - DNA, 16 bp, Homo sapiens
ctgtccaacctaaccc

SEQ ID NO: 4217884 - DNA, 23 bp, Homo sapiens
ctgtccaacctaacccctttcct

SEQ ID NO: 4217885 - DNA, 12 bp, Homo sapiens
ctgtccctgtca

SEQ ID NO: 4217886 - DNA, 15 bp, Homo sapiens
ctgtcctgcttctga

SEQ ID NO: 4217887 - DNA, 21 bp, Homo sapiens
ctgtgaattgtggctgttcac

SEQ ID NO: 4217888 - DNA, 13 bp, Homo sapiens
ctgtgaggcaggg

SEQ ID NO: 4217889 - DNA, 14 bp, Homo sapiens
ctgtgaggcagggg

SEQ ID NO: 4217890 - DNA, 17 bp, Homo sapiens
ctgtgatggggtgggca

SEQ ID NO: 4217891 - DNA, 22 bp, Homo sapiens
ctgtgatggggtgggcagggct

SEQ ID NO: 4217892 - DNA, 14 bp, Homo sapiens
ctgtgcccctgtaa

SEQ ID NO: 4217893 - DNA, 15 bp, Homo sapiens
ctgtggcggtgcctg

SEQ ID NO: 4217894 - DNA, 18 bp, Homo sapiens
ctgtggcggtgcctgggt

SEQ ID NO: 4217895 - DNA, 19 bp, Homo sapiens
ctgtggtacaaatgtgata

SEQ ID NO: 4217896 - DNA, 14 bp, Homo sapiens
ctgtgtccttgcac

SEQ ID NO: 4217897 - DNA, 22 bp, Homo sapiens
ctgtgtccttgcacctgcatcc

SEQ ID NO: 4217898 - DNA, 13 bp, Homo sapiens
ctgttaaccattt

SEQ ID NO: 4217899 - DNA, 16 bp, Homo sapiens
ctgttaagtaaaatgt

SEQ ID NO: 4217900 - DNA, 18 bp, Homo sapiens
ctgttctatcccacccaa

SEQ ID NO: 4217901 - DNA, 12 bp, Homo sapiens
ctgttgcctcat

SEQ ID NO: 4217902 - DNA, 18 bp, Homo sapiens
cttaagaattttgagcag

SEQ ID NO: 4217903 - DNA, 15 bp, Homo sapiens
cttaatgttgaatgt

SEQ ID NO: 4217904 - DNA, 16 bp, Homo sapiens
cttaatgttgaatgta

SEQ ID NO: 4217905 - DNA, 15 bp, Homo sapiens
cttacattgtgaaac

SEQ ID NO: 4217906 - DNA, 15 bp, Homo sapiens
cttacctcctgccca

SEQ ID NO: 4217907 - DNA, 18 bp, Homo sapiens
cttaggaaaatgcttctg

SEQ ID NO: 4217908 - DNA, 22 bp, Homo sapiens
cttatgacagaggttttgaaat

SEQ ID NO: 4217909 - DNA, 17 bp, Homo sapiens
cttattcccaattaaaa

SEQ ID NO: 4217910 - DNA, 16 bp, Homo sapiens
cttcaaagcttaaaaa

SEQ ID NO: 4217911 - DNA, 17 bp, Homo sapiens
cttcagatcagtgcttg

SEQ ID NO: 4217912 - DNA, 23 bp, Homo sapiens
cttcagggactcaagggtccaga

SEQ ID NO: 4217913 - DNA, 11 bp, Homo sapiens
cttcagtgccc

SEQ ID NO: 4217914 - DNA, 15 bp, Homo sapiens
cttcagtgcccacca

SEQ ID NO: 4217915 - DNA, 14 bp, Homo sapiens
cttccatttcttct

SEQ ID NO: 4217916 - DNA, 19 bp, Homo sapiens
cttcccagtataagatttt

SEQ ID NO: 4217917 - DNA, 23 bp, Homo sapiens
cttcccagtataagatttttgaa

SEQ ID NO: 4217918 - DNA, 11 bp, Homo sapiens
cttcccatcac

SEQ ID NO: 4217919 - DNA, 13 bp, Homo sapiens
cttccccttgccc

SEQ ID NO: 4217920 - DNA, 17 bp, Homo sapiens
cttccccttgcccttgc

SEQ ID NO: 4217921 - DNA, 11 bp, Homo sapiens
cttccctggct

SEQ ID NO: 4217922 - DNA, 12 bp, Homo sapiens
cttccctggctt

SEQ ID NO: 4217923 - DNA, 19 bp, Homo sapiens
cttcctataacttgatgca

SEQ ID NO: 4217924 - DNA, 20 bp, Homo sapiens
cttcctataacttgatgcat

SEQ ID NO: 4217925 - DNA, 14 bp, Homo sapiens
cttcctctgttcta

SEQ ID NO: 4217926 - DNA, 14 bp, Homo sapiens
cttccttccctggc

SEQ ID NO: 4217927 - DNA, 15 bp, Homo sapiens
cttccttccctggct

SEQ ID NO: 4217928 - DNA, 17 bp, Homo sapiens
cttccttccctggcttg

SEQ ID NO: 4217929 - DNA, 19 bp, Homo sapiens
cttcggggaactcctggaa

SEQ ID NO: 4217930 - DNA, 14 bp, Homo sapiens
cttctccatctggc

SEQ ID NO: 4217931 - DNA, 15 bp, Homo sapiens
cttctgtccaggaca

SEQ ID NO: 4217932 - DNA, 12 bp, Homo sapiens
cttctgttccag

SEQ ID NO: 4217933 - DNA, 22 bp, Homo sapiens
cttcttattctcactccaccac

SEQ ID NO: 4217934 - DNA, 18 bp, Homo sapiens
cttcttcatctttaaaat

SEQ ID NO: 4217935 - DNA, 17 bp, Homo sapiens
cttcttcggggaactcc

SEQ ID NO: 4217936 - DNA, 21 bp, Homo sapiens
cttcttcggggaactcctgga

SEQ ID NO: 4217937 - DNA, 13 bp, Homo sapiens
cttcttgcatcct

SEQ ID NO: 4217938 - DNA, 18 bp, Homo sapiens
cttcttgcatccttccta

SEQ ID NO: 4217939 - DNA, 11 bp, Homo sapiens
cttctttcctc

SEQ ID NO: 4217940 - DNA, 21 bp, Homo sapiens
cttgaacctgtcacctggcct

SEQ ID NO: 4217941 - DNA, 15 bp, Homo sapiens
cttgacaacagactg

SEQ ID NO: 4217942 - DNA, 16 bp, Homo sapiens
cttgacaacagactga

SEQ ID NO: 4217943 - DNA, 16 bp, Homo sapiens
cttgagacctcagcca

SEQ ID NO: 4217944 - DNA, 14 bp, Homo sapiens
cttgcacctgcatc

SEQ ID NO: 4217945 - DNA, 14 bp, Homo sapiens
cttgcatccttcct

SEQ ID NO: 4217946 - DNA, 17 bp, Homo sapiens
cttgcatccttcctata

SEQ ID NO: 4217947 - DNA, 20 bp, Homo sapiens
cttgcatccttcctataact

SEQ ID NO: 4217948 - DNA, 19 bp, Homo sapiens
cttgcccagagatgcctcc

SEQ ID NO: 4217949 - DNA, 17 bp, Homo sapiens
cttgccctgacctccca

SEQ ID NO: 4217950 - DNA, 18 bp, Homo sapiens
cttgccctgacctcccag

SEQ ID NO: 4217951 - DNA, 17 bp, Homo sapiens
cttgcccttgccctgac

SEQ ID NO: 4217952 - DNA, 19 bp, Homo sapiens
cttgctcttcagtgggaga

SEQ ID NO: 4217953 - DNA, 22 bp, Homo sapiens
cttggataatgctgttgcctca

SEQ ID NO: 4217954 - DNA, 23 bp, Homo sapiens
cttggataatgctgttgcctcat

SEQ ID NO: 4217955 - DNA, 15 bp, Homo sapiens
cttggggtcccaggg

SEQ ID NO: 4217956 - DNA, 18 bp, Homo sapiens
cttggggtcccagggaag

SEQ ID NO: 4217957 - DNA, 15 bp, Homo sapiens
cttgtaactccacca

SEQ ID NO: 4217958 - DNA, 17 bp, Homo sapiens
cttgtcaatactgagcc

SEQ ID NO: 4217959 - DNA, 14 bp, Homo sapiens
cttgtgctcctgcc

SEQ ID NO: 4217960 - DNA, 13 bp, Homo sapiens
cttgtggcagagg

SEQ ID NO: 4217961 - DNA, 12 bp, Homo sapiens
cttgtgtatatg

SEQ ID NO: 4217962 - DNA, 15 bp, Homo sapiens
cttgttattaccaaa

SEQ ID NO: 4217963 - DNA, 21 bp, Homo sapiens
cttgttattaccaaaacagga

SEQ ID NO: 4217964 - DNA, 22 bp, Homo sapiens
cttgtttgattttagctgcaga

SEQ ID NO: 4217965 - DNA, 23 bp, Homo sapiens
cttgtttgattttagctgcagaa

SEQ ID NO: 4217966 - DNA, 17 bp, Homo sapiens
ctttaaactaccctcca

SEQ ID NO: 4217967 - DNA, 21 bp, Homo sapiens
ctttaaactaccctccagagt

SEQ ID NO: 4217968 - DNA, 14 bp, Homo sapiens
ctttaaagagagtt

SEQ ID NO: 4217969 - DNA, 22 bp, Homo sapiens
ctttagaatgagagtgtgaaat

SEQ ID NO: 4217970 - DNA, 14 bp, Homo sapiens
ctttattctcctcc

SEQ ID NO: 4217971 - DNA, 16 bp, Homo sapiens
ctttcccctcagagct

SEQ ID NO: 4217972 - DNA, 17 bp, Homo sapiens
ctttcccctcagagctc

SEQ ID NO: 4217973 - DNA, 11 bp, Homo sapiens
ctttccttcct

SEQ ID NO: 4217974 - DNA, 14 bp, Homo sapiens
ctttccttcctaat

SEQ ID NO: 4217975 - DNA, 23 bp, Homo sapiens
ctttgaactagttttactttgaa

SEQ ID NO: 4217976 - DNA, 16 bp, Homo sapiens
ctttgagcttaagaat

SEQ ID NO: 4217977 - DNA, 12 bp, Homo sapiens
ctttgcattcat

SEQ ID NO: 4217978 - DNA, 13 bp, Homo sapiens
ctttgccatttct

SEQ ID NO: 4217979 - DNA, 15 bp, Homo sapiens
ctttgccatttcttc

SEQ ID NO: 4217980 - DNA, 17 bp, Homo sapiens
ctttgtaagaaaaccaa

SEQ ID NO: 4217981 - DNA, 18 bp, Homo sapiens
ctttgtaagaaaaccaaa

SEQ ID NO: 4217982 - DNA, 22 bp, Homo sapiens
gaaaaaaaaaagaaaaaggaaa

SEQ ID NO: 4217983 - DNA, 18 bp, Homo sapiens
gaaaaaaagtttgccaga

SEQ ID NO: 4217984 - DNA, 13 bp, Homo sapiens
gaaaaaactttct

SEQ ID NO: 4217985 - DNA, 14 bp, Homo sapiens
gaaaaataaaaacc

SEQ ID NO: 4217986 - DNA, 15 bp, Homo sapiens
gaaaaataaaaacca

SEQ ID NO: 4217987 - DNA, 18 bp, Homo sapiens
gaaaacattacatgctca

SEQ ID NO: 4217988 - DNA, 16 bp, Homo sapiens
gaaaactgacagagga

SEQ ID NO: 4217989 - DNA, 23 bp, Homo sapiens
gaaaataaatcaatgctataact

SEQ ID NO: 4217990 - DNA, 19 bp, Homo sapiens
gaaaatatttttttccttt

SEQ ID NO: 4217991 - DNA, 23 bp, Homo sapiens
gaaaatgagtttttatggggctg

SEQ ID NO: 4217992 - DNA, 14 bp, Homo sapiens
gaaaatgcttctgt

SEQ ID NO: 4217993 - DNA, 22 bp, Homo sapiens
gaaagaaaagaacacttgccca

SEQ ID NO: 4217994 - DNA, 18 bp, Homo sapiens
gaaagaaatttgaaaaaa

SEQ ID NO: 4217995 - DNA, 17 bp, Homo sapiens
gaaagataataaattga

SEQ ID NO: 4217996 - DNA, 15 bp, Homo sapiens
gaaagctgaatcctt

SEQ ID NO: 4217997 - DNA, 22 bp, Homo sapiens
gaaaggatgtaaacagtgcctg

SEQ ID NO: 4217998 - DNA, 21 bp, Homo sapiens
gaaatatcagttactcagccc

SEQ ID NO: 4217999 - DNA, 22 bp, Homo sapiens
gaaatatcagttactcagccct

SEQ ID NO: 4218000 - DNA, 13 bp, Homo sapiens
gaaatattaaaat

SEQ ID NO: 4218001 - DNA, 14 bp, Homo sapiens
gaaatcaacttgtg

SEQ ID NO: 4218002 - DNA, 20 bp, Homo sapiens
gaaatgcttatgcttgtgta

SEQ ID NO: 4218003 - DNA, 15 bp, Homo sapiens
gaaattaatttgtga

SEQ ID NO: 4218004 - DNA, 16 bp, Homo sapiens
ctctctgcagccagcc

SEQ ID NO: 4218005 - DNA, 18 bp, Homo sapiens
ctctctgcagccagccca

SEQ ID NO: 4218006 - DNA, 19 bp, Homo sapiens
ctctctgcagccagcccag

SEQ ID NO: 4218007 - DNA, 21 bp, Homo sapiens
ctctctgcagccagcccagcc

SEQ ID NO: 4218008 - DNA, 14 bp, Homo sapiens
ctctgcacggggga

SEQ ID NO: 4218009 - DNA, 13 bp, Homo sapiens
ctctgcagccagc

SEQ ID NO: 4218010 - DNA, 19 bp, Homo sapiens
ctctgcagccagcccagcc

SEQ ID NO: 4218011 - DNA, 13 bp, Homo sapiens
ctctgccacctcc

SEQ ID NO: 4218012 - DNA, 18 bp, Homo sapiens
ctctgccacctcccctat

SEQ ID NO: 4218013 - DNA, 13 bp, Homo sapiens
ctctgctggcctg

SEQ ID NO: 4218014 - DNA, 21 bp, Homo sapiens
ctctgctggcctggccggcaa

SEQ ID NO: 4218015 - DNA, 13 bp, Homo sapiens
ctctggagccaga

SEQ ID NO: 4218016 - DNA, 14 bp, Homo sapiens
ctctggccctgcct

SEQ ID NO: 4218017 - DNA, 13 bp, Homo sapiens
ctctggctggcta

SEQ ID NO: 4218018 - DNA, 19 bp, Homo sapiens
ctctgtgcccctgtaaata

SEQ ID NO: 4218019 - DNA, 16 bp, Homo sapiens
ctcttccccttgccct

SEQ ID NO: 4218020 - DNA, 19 bp, Homo sapiens
ctcttccccttgcccttgc

SEQ ID NO: 4218021 - DNA, 23 bp, Homo sapiens
ctcttccccttgcccttgccctg

SEQ ID NO: 4218022 - DNA, 12 bp, Homo sapiens
ctcttcctctgt

SEQ ID NO: 4218023 - DNA, 15 bp, Homo sapiens
ctcttcctctgttct

SEQ ID NO: 4218024 - DNA, 17 bp, Homo sapiens
ctctttgccatttcttc

SEQ ID NO: 4218025 - DNA, 13 bp, Homo sapiens
ctgaaagacagaa

SEQ ID NO: 4218026 - DNA, 17 bp, Homo sapiens
ctgaaagacagaatgtc

SEQ ID NO: 4218027 - DNA, 18 bp, Homo sapiens
ctgaaagacagaatgtca

SEQ ID NO: 4218028 - DNA, 21 bp, Homo sapiens
ctgaaagacagaatgtcacca

SEQ ID NO: 4218029 - DNA, 18 bp, Homo sapiens
ctgaaattaatttgtgaa

SEQ ID NO: 4218030 - DNA, 21 bp, Homo sapiens
ctgaaattaatttgtgaattt

SEQ ID NO: 4218031 - DNA, 22 bp, Homo sapiens
ctgaaattaatttgtgaatttg

SEQ ID NO: 4218032 - DNA, 13 bp, Homo sapiens
ctgaacggggaga

SEQ ID NO: 4218033 - DNA, 17 bp, Homo sapiens
ctgaacggggagaaaag

SEQ ID NO: 4218034 - DNA, 11 bp, Homo sapiens
ctgaagccaga

SEQ ID NO: 4218035 - DNA, 12 bp, Homo sapiens
ctgaagccagat

SEQ ID NO: 4218036 - DNA, 16 bp, Homo sapiens
ctgaagccagatccac

SEQ ID NO: 4218037 - DNA, 14 bp, Homo sapiens
ctgaataaaccagt

SEQ ID NO: 4218038 - DNA, 17 bp, Homo sapiens
ctgaatgtgctgatcat

SEQ ID NO: 4218039 - DNA, 15 bp, Homo sapiens
ctgaattgtccccag

SEQ ID NO: 4218040 - DNA, 18 bp, Homo sapiens
ctgaattttaaatgttca

SEQ ID NO: 4218041 - DNA, 19 bp, Homo sapiens
ctgacatagtggatggaca

SEQ ID NO: 4218042 - DNA, 22 bp, Homo sapiens
ctgacatagtggatggacagat

SEQ ID NO: 4218043 - DNA, 23 bp, Homo sapiens
ctgacatagtggatggacagatg

SEQ ID NO: 4218044 - DNA, 17 bp, Homo sapiens
ctgacccagtccctggg

SEQ ID NO: 4218045 - DNA, 13 bp, Homo sapiens
ctgacctcccagc

SEQ ID NO: 4218046 - DNA, 14 bp, Homo sapiens
ctgacctcccagcc

SEQ ID NO: 4218047 - DNA, 17 bp, Homo sapiens
ctgacctcccagcccta

SEQ ID NO: 4218048 - DNA, 15 bp, Homo sapiens
ctgagagacccaagg

SEQ ID NO: 4218049 - DNA, 19 bp, Homo sapiens
ctgagagtctgaaagacag

SEQ ID NO: 4218050 - DNA, 17 bp, Homo sapiens
ctgagatgcaaatgtca

SEQ ID NO: 4218051 - DNA, 19 bp, Homo sapiens
ctgagtcatgatctccctg

SEQ ID NO: 4218052 - DNA, 22 bp, Homo sapiens
ctgagtgactgtaggcagggaa

SEQ ID NO: 4218053 - DNA, 16 bp, Homo sapiens
ctgatgttactgagat

SEQ ID NO: 4218054 - DNA, 20 bp, Homo sapiens
ctgatgttactgagatgttt

SEQ ID NO: 4218055 - DNA, 14 bp, Homo sapiens
ctgatgtttataaa

SEQ ID NO: 4218056 - DNA, 20 bp, Homo sapiens
ctgatgtttataaactgaga

SEQ ID NO: 4218057 - DNA, 17 bp, Homo sapiens
ctgattatacaccattt

SEQ ID NO: 4218058 - DNA, 15 bp, Homo sapiens
ctgcaacttgtgaac

SEQ ID NO: 4218059 - DNA, 17 bp, Homo sapiens
ctgcaagagccttggtg

SEQ ID NO: 4218060 - DNA, 19 bp, Homo sapiens
ctgcaagagccttggtgtc

SEQ ID NO: 4218061 - DNA, 23 bp, Homo sapiens
ctgcaagagccttggtgtccacc

SEQ ID NO: 4218062 - DNA, 14 bp, Homo sapiens
ctgcacttctgttc

SEQ ID NO: 4218063 - DNA, 16 bp, Homo sapiens
ctgcacttctgttcca

SEQ ID NO: 4218064 - DNA, 20 bp, Homo sapiens
ctgcagaacgtattggtcca

SEQ ID NO: 4218065 - DNA, 15 bp, Homo sapiens
ctgcagccagcccag

SEQ ID NO: 4218066 - DNA, 16 bp, Homo sapiens
ctgcagccagcccagc

SEQ ID NO: 4218067 - DNA, 19 bp, Homo sapiens
ctgcatccgtagttccctg

SEQ ID NO: 4218068 - DNA, 14 bp, Homo sapiens
ctgccaccctcctg

SEQ ID NO: 4218069 - DNA, 15 bp, Homo sapiens
ctgccaccctcctgc

SEQ ID NO: 4218070 - DNA, 14 bp, Homo sapiens
ctgccacctcccct

SEQ ID NO: 4218071 - DNA, 14 bp, Homo sapiens
ctgccagtgcctta

SEQ ID NO: 4218072 - DNA, 17 bp, Homo sapiens
ctgccagtgccttacct

SEQ ID NO: 4218073 - DNA, 23 bp, Homo sapiens
ctgccagtgccttacctcctgcc

SEQ ID NO: 4218074 - DNA, 11 bp, Homo sapiens
ctgcccaggag

SEQ ID NO: 4218075 - DNA, 16 bp, Homo sapiens
ctgccccaactcctgg

SEQ ID NO: 4218076 - DNA, 20 bp, Homo sapiens
ctgccccaactcctggaagc

SEQ ID NO: 4218077 - DNA, 21 bp, Homo sapiens
ctgccccaactcctggaagct

SEQ ID NO: 4218078 - DNA, 15 bp, Homo sapiens
ctgcctaagtggctg

SEQ ID NO: 4218079 - DNA, 18 bp, Homo sapiens
ctgcctaagtggctgctg

SEQ ID NO: 4218080 - DNA, 14 bp, Homo sapiens
ctgcctactcacga

SEQ ID NO: 4218081 - DNA, 24 bp, Homo sapiens
ctgccttcttcggggaactcctgg

SEQ ID NO: 4218082 - DNA, 15 bp, Homo sapiens
ctgcgcaggccatgc

SEQ ID NO: 4218083 - DNA, 22 bp, Homo sapiens
ctgctattatgtaacatccaga

SEQ ID NO: 4218084 - DNA, 12 bp, Homo sapiens
ctgctcactttc

SEQ ID NO: 4218085 - DNA, 13 bp, Homo sapiens
ctgctcctctcca

SEQ ID NO: 4218086 - DNA, 23 bp, Homo sapiens
ctgctgaatgatttccaaagaga

SEQ ID NO: 4218087 - DNA, 15 bp, Homo sapiens
ctgctgagagaccca

SEQ ID NO: 4218088 - DNA, 14 bp, Homo sapiens
ctgctgggctctcc

SEQ ID NO: 4218089 - DNA, 16 bp, Homo sapiens
ctgctgggctctccac

SEQ ID NO: 4218090 - DNA, 17 bp, Homo sapiens
ctgctgggctctccacc

SEQ ID NO: 4218091 - DNA, 15 bp, Homo sapiens
ctgcttctgaatgtg

SEQ ID NO: 4218092 - DNA, 17 bp, Homo sapiens
ctgcttctgtccaggac

SEQ ID NO: 4218093 - DNA, 12 bp, Homo sapiens
ctggaagctgtg

SEQ ID NO: 4218094 - DNA, 16 bp, Homo sapiens
ctggaagctgtgtcct

SEQ ID NO: 4218095 - DNA, 21 bp, Homo sapiens
ctggacctgctgacatagtgg

SEQ ID NO: 4218096 - DNA, 21 bp, Homo sapiens
ctggagaagcagtgagccgca

SEQ ID NO: 4218097 - DNA, 23 bp, Homo sapiens
ctggagcaccaggcacgaaccca

SEQ ID NO: 4218098 - DNA, 12 bp, Homo sapiens
ctggaggcaggg

SEQ ID NO: 4218099 - DNA, 16 bp, Homo sapiens
ctggaggcagggcctt

SEQ ID NO: 4218100 - DNA, 19 bp, Homo sapiens
ctggaggcagggccttgcc

SEQ ID NO: 4218101 - DNA, 23 bp, Homo sapiens
ctggaggcagggccttgcccaga

SEQ ID NO: 4218102 - DNA, 18 bp, Homo sapiens
ctggcacctgaaattaat

SEQ ID NO: 4218103 - DNA, 18 bp, Homo sapiens
ctggcattttctgttcca

SEQ ID NO: 4218104 - DNA, 16 bp, Homo sapiens
ctggccccatgtctct

SEQ ID NO: 4218105 - DNA, 21 bp, Homo sapiens
ctggccccatgtctctcagaa

SEQ ID NO: 4218106 - DNA, 18 bp, Homo sapiens
ctggccggcaaccccagt

SEQ ID NO: 4218107 - DNA, 20 bp, Homo sapiens
ctggcctgctgggctctcca

SEQ ID NO: 4218108 - DNA, 17 bp, Homo sapiens
ctggcggctactcagca

SEQ ID NO: 4218109 - DNA, 18 bp, Homo sapiens
ctggcggctactcagcag

SEQ ID NO: 4218110 - DNA, 22 bp, Homo sapiens
ctggcggctactcagcagccct

SEQ ID NO: 4218111 - DNA, 17 bp, Homo sapiens
ctggctaactggaagca

SEQ ID NO: 4218112 - DNA, 14 bp, Homo sapiens
ctggcttcacagat

SEQ ID NO: 4218113 - DNA, 23 bp, Homo sapiens
ctggcttctctgtgcccctgtaa

SEQ ID NO: 4218114 - DNA, 19 bp, Homo sapiens
ctggcttgtaactccacca

SEQ ID NO: 4218115 - DNA, 16 bp, Homo sapiens
ctgggaccctgctccc

SEQ ID NO: 4218116 - DNA, 20 bp, Homo sapiens
ctgggaccctttccttcctt

SEQ ID NO: 4218117 - DNA, 22 bp, Homo sapiens
ctgggagaaagaccatgcattt

SEQ ID NO: 4218118 - DNA, 13 bp, Homo sapiens
ctgggaggaaaag

SEQ ID NO: 4218119 - DNA, 16 bp, Homo sapiens
ctgggccccaccacct

SEQ ID NO: 4218120 - DNA, 15 bp, Homo sapiens
ctgggctagggagaa

SEQ ID NO: 4218121 - DNA, 19 bp, Homo sapiens
ctgggctctccacctcagc

SEQ ID NO: 4218122 - DNA, 13 bp, Homo sapiens
ctgggggctggac

SEQ ID NO: 4218123 - DNA, 17 bp, Homo sapiens
ctggggttcagcccctc

SEQ ID NO: 4218124 - DNA, 20 bp, Homo sapiens
ctggggttcagcccctcctc

SEQ ID NO: 4218125 - DNA, 22 bp, Homo sapiens
ctggggttcagcccctcctctg

SEQ ID NO: 4218126 - DNA, 13 bp, Homo sapiens
ctgggtggggctg

SEQ ID NO: 4218127 - DNA, 17 bp, Homo sapiens
ctgggtggggctgctcc

SEQ ID NO: 4218128 - DNA, 19 bp, Homo sapiens
ctgtaaatagttttaaata

SEQ ID NO: 4218129 - DNA, 20 bp, Homo sapiens
ctgtaaatagttttaaatat

SEQ ID NO: 4218130 - DNA, 21 bp, Homo sapiens
ctgtaaatagttttaaatatg

SEQ ID NO: 4218131 - DNA, 16 bp, Homo sapiens
ctaatttcccttcttg

SEQ ID NO: 4218132 - DNA, 15 bp, Homo sapiens
ctacatttactttaa

SEQ ID NO: 4218133 - DNA, 14 bp, Homo sapiens
ctaccctccagagt

SEQ ID NO: 4218134 - DNA, 19 bp, Homo sapiens
ctaccttaaaatgtaaaac

SEQ ID NO: 4218135 - DNA, 17 bp, Homo sapiens
ctacgttaccaggcagg

SEQ ID NO: 4218136 - DNA, 19 bp, Homo sapiens
ctactcagcagccctcctc

SEQ ID NO: 4218137 - DNA, 13 bp, Homo sapiens
ctactcaggaggc

SEQ ID NO: 4218138 - DNA, 19 bp, Homo sapiens
ctagaagtgggccaggaca

SEQ ID NO: 4218139 - DNA, 17 bp, Homo sapiens
ctagacagagatgaact

SEQ ID NO: 4218140 - DNA, 18 bp, Homo sapiens
ctagactcccaagctgga

SEQ ID NO: 4218141 - DNA, 17 bp, Homo sapiens
ctagagctgagagtctg

SEQ ID NO: 4218142 - DNA, 17 bp, Homo sapiens
ctagcagtaaaagataa

SEQ ID NO: 4218143 - DNA, 19 bp, Homo sapiens
ctaggaatggagtctccca

SEQ ID NO: 4218144 - DNA, 15 bp, Homo sapiens
ctaggagctgggagg

SEQ ID NO: 4218145 - DNA, 13 bp, Homo sapiens
ctagtcagagaga

SEQ ID NO: 4218146 - DNA, 17 bp, Homo sapiens
ctagtggggtctccctc

SEQ ID NO: 4218147 - DNA, 20 bp, Homo sapiens
ctagtggggtctccctctcc

SEQ ID NO: 4218148 - DNA, 16 bp, Homo sapiens
ctagtttacttgctcg

SEQ ID NO: 4218149 - DNA, 22 bp, Homo sapiens
ctagttttactttgaactttca

SEQ ID NO: 4218150 - DNA, 16 bp, Homo sapiens
ctataacttgatgcat

SEQ ID NO: 4218151 - DNA, 17 bp, Homo sapiens
ctataacttgatgcatg

SEQ ID NO: 4218152 - DNA, 22 bp, Homo sapiens
ctataccatatgtctgcttctg

SEQ ID NO: 4218153 - DNA, 18 bp, Homo sapiens
ctatcatgtcaaacgtga

SEQ ID NO: 4218154 - DNA, 23 bp, Homo sapiens
ctatcccacccaacagctcagag

SEQ ID NO: 4218155 - DNA, 15 bp, Homo sapiens
ctatgatttggaaaa

SEQ ID NO: 4218156 - DNA, 10 bp, Homo sapiens
ctatggatgt

SEQ ID NO: 4218157 - DNA, 14 bp, Homo sapiens
ctattgtttattct

SEQ ID NO: 4218158 - DNA, 15 bp, Homo sapiens
ctcaaaagccaaaaa

SEQ ID NO: 4218159 - DNA, 17 bp, Homo sapiens
ctcaaatgtcagagcta

SEQ ID NO: 4218160 - DNA, 18 bp, Homo sapiens
ctcaaatgtcagagctat

SEQ ID NO: 4218161 - DNA, 21 bp, Homo sapiens
ctcaatgtgaatcagacccta

SEQ ID NO: 4218162 - DNA, 18 bp, Homo sapiens
ctcacaggttggaagaga

SEQ ID NO: 4218163 - DNA, 23 bp, Homo sapiens
ctcacaggttggaagagaatcac

SEQ ID NO: 4218164 - DNA, 17 bp, Homo sapiens
ctcacagttcctcgccc

SEQ ID NO: 4218165 - DNA, 23 bp, Homo sapiens
ctcacagttcctcgccctgggtc

SEQ ID NO: 4218166 - DNA, 12 bp, Homo sapiens
ctcacctctgcc

SEQ ID NO: 4218167 - DNA, 18 bp, Homo sapiens
ctcacctctgcctcaatg

SEQ ID NO: 4218168 - DNA, 19 bp, Homo sapiens
ctcacgcctgtaatcccag

SEQ ID NO: 4218169 - DNA, 22 bp, Homo sapiens
ctcacgcctgtaatcccagcag

SEQ ID NO: 4218170 - DNA, 19 bp, Homo sapiens
ctcacgggcagtagctgtg

SEQ ID NO: 4218171 - DNA, 17 bp, Homo sapiens
ctcactccaccacccaa

SEQ ID NO: 4218172 - DNA, 20 bp, Homo sapiens
ctcactccaccacccaaaag

SEQ ID NO: 4218173 - DNA, 17 bp, Homo sapiens
ctcagagatgaaactat

SEQ ID NO: 4218174 - DNA, 19 bp, Homo sapiens
ctcagagtcccggcgttta

SEQ ID NO: 4218175 - DNA, 12 bp, Homo sapiens
ctcagcagccct

SEQ ID NO: 4218176 - DNA, 14 bp, Homo sapiens
ctcagcagccctcc

SEQ ID NO: 4218177 - DNA, 15 bp, Homo sapiens
ctcagccatgaggag

SEQ ID NO: 4218178 - DNA, 21 bp, Homo sapiens
ctcagccatgaggagttgctg

SEQ ID NO: 4218179 - DNA, 14 bp, Homo sapiens
ctcagccctgggcc

SEQ ID NO: 4218180 - DNA, 19 bp, Homo sapiens
ctcagccctgggccccacc

SEQ ID NO: 4218181 - DNA, 11 bp, Homo sapiens
ctcagccttgg

SEQ ID NO: 4218182 - DNA, 23 bp, Homo sapiens
ctcaggaggctgaggcagaagaa

SEQ ID NO: 4218183 - DNA, 15 bp, Homo sapiens
ctcaggatattatgt

SEQ ID NO: 4218184 - DNA, 19 bp, Homo sapiens
ctcagggacagagacacct

SEQ ID NO: 4218185 - DNA, 14 bp, Homo sapiens
ctcattccccaggt

SEQ ID NO: 4218186 - DNA, 15 bp, Homo sapiens
ctccaaatctccagt

SEQ ID NO: 4218187 - DNA, 13 bp, Homo sapiens
ctccaaatttaac

SEQ ID NO: 4218188 - DNA, 21 bp, Homo sapiens
ctccaagaggctccctcctgt

SEQ ID NO: 4218189 - DNA, 20 bp, Homo sapiens
ctccaaggtttataaagcag

SEQ ID NO: 4218190 - DNA, 20 bp, Homo sapiens
ctccaccaacccatcagaag

SEQ ID NO: 4218191 - DNA, 13 bp, Homo sapiens
ctccaccacccaa

SEQ ID NO: 4218192 - DNA, 14 bp, Homo sapiens
ctccaccgctgcct

SEQ ID NO: 4218193 - DNA, 15 bp, Homo sapiens
ctccacctcagcctt

SEQ ID NO: 4218194 - DNA, 19 bp, Homo sapiens
ctccaccttgaacctgtca

SEQ ID NO: 4218195 - DNA, 17 bp, Homo sapiens
ctccactccttcccaaa

SEQ ID NO: 4218196 - DNA, 16 bp, Homo sapiens
ctccagagtgtgcaga

SEQ ID NO: 4218197 - DNA, 21 bp, Homo sapiens
ctccagagtgtgcagactgat

SEQ ID NO: 4218198 - DNA, 11 bp, Homo sapiens
ctccagcccag

SEQ ID NO: 4218199 - DNA, 16 bp, Homo sapiens
ctccaggatttataaa

SEQ ID NO: 4218200 - DNA, 18 bp, Homo sapiens
ctccagggccacgtgcca

SEQ ID NO: 4218201 - DNA, 23 bp, Homo sapiens
ctccagtctcatctatgtcatat

SEQ ID NO: 4218202 - DNA, 16 bp, Homo sapiens
ctccatctggcagggt

SEQ ID NO: 4218203 - DNA, 16 bp, Homo sapiens
ctcccacccaaccaac

SEQ ID NO: 4218204 - DNA, 13 bp, Homo sapiens
ctcccaccccacc

SEQ ID NO: 4218205 - DNA, 19 bp, Homo sapiens
ctcccaccccacccccttc

SEQ ID NO: 4218206 - DNA, 17 bp, Homo sapiens
ctcccacgcctgcttct

SEQ ID NO: 4218207 - DNA, 18 bp, Homo sapiens
ctcccagccctatggatg

SEQ ID NO: 4218208 - DNA, 16 bp, Homo sapiens
ctccccctgccagtgc

SEQ ID NO: 4218209 - DNA, 17 bp, Homo sapiens
ctccccctgccagtgcc

SEQ ID NO: 4218210 - DNA, 19 bp, Homo sapiens
ctcccctatccacccagcc

SEQ ID NO: 4218211 - DNA, 21 bp, Homo sapiens
ctcccctatccacccagccca

SEQ ID NO: 4218212 - DNA, 12 bp, Homo sapiens
ctccctcccacc

SEQ ID NO: 4218213 - DNA, 12 bp, Homo sapiens
ctccctctcctg

SEQ ID NO: 4218214 - DNA, 15 bp, Homo sapiens
ctccctctcctgcct

SEQ ID NO: 4218215 - DNA, 15 bp, Homo sapiens
ctccctctggccctg

SEQ ID NO: 4218216 - DNA, 20 bp, Homo sapiens
ctccctgaagtaagcaaaga

SEQ ID NO: 4218217 - DNA, 18 bp, Homo sapiens
ctccctgccgcctcaatg

SEQ ID NO: 4218218 - DNA, 15 bp, Homo sapiens
ctccctgtcctcctc

SEQ ID NO: 4218219 - DNA, 18 bp, Homo sapiens
ctcctcaccccgtctggg

SEQ ID NO: 4218220 - DNA, 11 bp, Homo sapiens
ctcctccaggg

SEQ ID NO: 4218221 - DNA, 21 bp, Homo sapiens
ctcctcgaagtcccggcttcc

SEQ ID NO: 4218222 - DNA, 13 bp, Homo sapiens
ctcctctccaggc

SEQ ID NO: 4218223 - DNA, 15 bp, Homo sapiens
ctcctctccaggcac

SEQ ID NO: 4218224 - DNA, 14 bp, Homo sapiens
ctcctctgccacct

SEQ ID NO: 4218225 - DNA, 13 bp, Homo sapiens
ctcctctgctcca

SEQ ID NO: 4218226 - DNA, 16 bp, Homo sapiens
ctcctctgtcctgctt

SEQ ID NO: 4218227 - DNA, 20 bp, Homo sapiens
ctcctctgtcctgcttctga

SEQ ID NO: 4218228 - DNA, 12 bp, Homo sapiens
ctcctgcccagg

SEQ ID NO: 4218229 - DNA, 16 bp, Homo sapiens
ctcctgcccaggagag

SEQ ID NO: 4218230 - DNA, 17 bp, Homo sapiens
ctcctgcccaggagagc

SEQ ID NO: 4218231 - DNA, 22 bp, Homo sapiens
ctcctgcccaggagagccagcc

SEQ ID NO: 4218232 - DNA, 15 bp, Homo sapiens
ctcctgcccgcccag

SEQ ID NO: 4218233 - DNA, 13 bp, Homo sapiens
ctcctgcctactc

SEQ ID NO: 4218234 - DNA, 17 bp, Homo sapiens
ctcctgcgcaggccatg

SEQ ID NO: 4218235 - DNA, 11 bp, Homo sapiens
ctcctggaaat

SEQ ID NO: 4218236 - DNA, 20 bp, Homo sapiens
ctcctggaagctgtgtcctt

SEQ ID NO: 4218237 - DNA, 12 bp, Homo sapiens
ctcgccctgggt

SEQ ID NO: 4218238 - DNA, 12 bp, Homo sapiens
ctcgtcctcccc

SEQ ID NO: 4218239 - DNA, 14 bp, Homo sapiens
ctcgtcctccccct

SEQ ID NO: 4218240 - DNA, 17 bp, Homo sapiens
ctcgtcctccccctgcc

SEQ ID NO: 4218241 - DNA, 18 bp, Homo sapiens
ctcgtcctccccctgcca

SEQ ID NO: 4218242 - DNA, 20 bp, Homo sapiens
ctcgtcctccccctgccagt

SEQ ID NO: 4218243 - DNA, 22 bp, Homo sapiens
ctcgtcctccccctgccagtgc

SEQ ID NO: 4218244 - DNA, 24 bp, Homo sapiens
ctcgtcctccccctgccagtgcct

SEQ ID NO: 4218245 - DNA, 23 bp, Homo sapiens
ctctaccccaaagaattcctgaa

SEQ ID NO: 4218246 - DNA, 15 bp, Homo sapiens
ctctcattccccagg

SEQ ID NO: 4218247 - DNA, 16 bp, Homo sapiens
ctctcattccccaggt

SEQ ID NO: 4218248 - DNA, 13 bp, Homo sapiens
ctctccaacctgg

SEQ ID NO: 4218249 - DNA, 16 bp, Homo sapiens
ctctccaacctggaca

SEQ ID NO: 4218250 - DNA, 13 bp, Homo sapiens
ctctccacctcag

SEQ ID NO: 4218251 - DNA, 15 bp, Homo sapiens
ctctccacctcagcc

SEQ ID NO: 4218252 - DNA, 17 bp, Homo sapiens
ctctccacctcagcctt

SEQ ID NO: 4218253 - DNA, 13 bp, Homo sapiens
ctctccaggcacc

SEQ ID NO: 4218254 - DNA, 19 bp, Homo sapiens
ctctccaggcacccttctt

SEQ ID NO: 4218255 - DNA, 18 bp, Homo sapiens
ctctccctctggccctgc

SEQ ID NO: 4218256 - DNA, 12 bp, Homo sapiens
ctctcctgccta

SEQ ID NO: 4218257 - DNA, 15 bp, Homo sapiens
ctctctaagccacag

SEQ ID NO: 4218258 - DNA, 17 bp, Homo sapiens
ctctctaagccacagct

SEQ ID NO: 4218259 - DNA, 14 bp, Homo sapiens
cctctgccacctcc

SEQ ID NO: 4218260 - DNA, 15 bp, Homo sapiens
cctctgccacctccc

SEQ ID NO: 4218261 - DNA, 16 bp, Homo sapiens
cctgaaaacccagaga

SEQ ID NO: 4218262 - DNA, 12 bp, Homo sapiens
cctgaaattaat

SEQ ID NO: 4218263 - DNA, 13 bp, Homo sapiens
cctgaagccagat

SEQ ID NO: 4218264 - DNA, 16 bp, Homo sapiens
cctgaataaaccagta

SEQ ID NO: 4218265 - DNA, 14 bp, Homo sapiens
cctgacctcccagc

SEQ ID NO: 4218266 - DNA, 17 bp, Homo sapiens
cctgacctcccagccct

SEQ ID NO: 4218267 - DNA, 19 bp, Homo sapiens
cctgcatccgtagttccct

SEQ ID NO: 4218268 - DNA, 22 bp, Homo sapiens
cctgcatccgtagttccctgaa

SEQ ID NO: 4218269 - DNA, 14 bp, Homo sapiens
cctgccgcctcaat

SEQ ID NO: 4218270 - DNA, 13 bp, Homo sapiens
cctgctaatagct

SEQ ID NO: 4218271 - DNA, 14 bp, Homo sapiens
cctgctcccccacc

SEQ ID NO: 4218272 - DNA, 23 bp, Homo sapiens
cctgctcccccaccccctcccca

SEQ ID NO: 4218273 - DNA, 17 bp, Homo sapiens
cctgctgagagacccaa

SEQ ID NO: 4218274 - DNA, 21 bp, Homo sapiens
cctgctgagagacccaaggag

SEQ ID NO: 4218275 - DNA, 18 bp, Homo sapiens
cctgctgggctctccacc

SEQ ID NO: 4218276 - DNA, 20 bp, Homo sapiens
cctgctgggctctccacctc

SEQ ID NO: 4218277 - DNA, 24 bp, Homo sapiens
cctgctgggctctccacctcagcc

SEQ ID NO: 4218278 - DNA, 20 bp, Homo sapiens
cctgcttcttaaggtccctg

SEQ ID NO: 4218279 - DNA, 13 bp, Homo sapiens
cctggaagctgtg

SEQ ID NO: 4218280 - DNA, 12 bp, Homo sapiens
cctggccccatg

SEQ ID NO: 4218281 - DNA, 14 bp, Homo sapiens
cctggccccatgtc

SEQ ID NO: 4218282 - DNA, 15 bp, Homo sapiens
cctggccccatgtct

SEQ ID NO: 4218283 - DNA, 22 bp, Homo sapiens
cctggctccctcccacccaacc

SEQ ID NO: 4218284 - DNA, 18 bp, Homo sapiens
cctggcttgtaactccac

SEQ ID NO: 4218285 - DNA, 22 bp, Homo sapiens
cctggcttgtaactccaccaac

SEQ ID NO: 4218286 - DNA, 15 bp, Homo sapiens
cctgggccccaccac

SEQ ID NO: 4218287 - DNA, 19 bp, Homo sapiens
cctgggggaagccctggat

SEQ ID NO: 4218288 - DNA, 16 bp, Homo sapiens
cctgggtggggctgct

SEQ ID NO: 4218289 - DNA, 19 bp, Homo sapiens
cctgggtggggctgctcct

SEQ ID NO: 4218290 - DNA, 23 bp, Homo sapiens
cctgggtggggtcagggaaagtc

SEQ ID NO: 4218291 - DNA, 21 bp, Homo sapiens
cctgtaaatagttttaaatat

SEQ ID NO: 4218292 - DNA, 23 bp, Homo sapiens
cctgtaaatagttttaaatatga

SEQ ID NO: 4218293 - DNA, 18 bp, Homo sapiens
cctgtaatcccagctact

SEQ ID NO: 4218294 - DNA, 23 bp, Homo sapiens
cctgtaatcccagctactcagga

SEQ ID NO: 4218295 - DNA, 23 bp, Homo sapiens
cctgtcctcctcggatcaccgag

SEQ ID NO: 4218296 - DNA, 17 bp, Homo sapiens
cctgtgaggcaggggcg

SEQ ID NO: 4218297 - DNA, 20 bp, Homo sapiens
cctgttatggaaaatgtcaa

SEQ ID NO: 4218298 - DNA, 12 bp, Homo sapiens
ccttaccaaaaa

SEQ ID NO: 4218299 - DNA, 13 bp, Homo sapiens
ccttacctcctgc

SEQ ID NO: 4218300 - DNA, 20 bp, Homo sapiens
ccttacctcctgcccaggag

SEQ ID NO: 4218301 - DNA, 20 bp, Homo sapiens
ccttccacggatccatgtag

SEQ ID NO: 4218302 - DNA, 21 bp, Homo sapiens
ccttccacggatccatgtagc

SEQ ID NO: 4218303 - DNA, 12 bp, Homo sapiens
ccttcccagctc

SEQ ID NO: 4218304 - DNA, 13 bp, Homo sapiens
ccttcccagctct

SEQ ID NO: 4218305 - DNA, 17 bp, Homo sapiens
ccttcccagctctccct

SEQ ID NO: 4218306 - DNA, 9 bp, Homo sapiens
ccttcctaa

SEQ ID NO: 4218307 - DNA, 21 bp, Homo sapiens
ccttcctataacttgatgcat

SEQ ID NO: 4218308 - DNA, 23 bp, Homo sapiens
ccttcctataacttgatgcatgt

SEQ ID NO: 4218309 - DNA, 22 bp, Homo sapiens
ccttcttcggggaactcctgga

SEQ ID NO: 4218310 - DNA, 18 bp, Homo sapiens
ccttgaacctgtcacctg

SEQ ID NO: 4218311 - DNA, 16 bp, Homo sapiens
ccttgagacctcagcc

SEQ ID NO: 4218312 - DNA, 14 bp, Homo sapiens
ccttgcccagagat

SEQ ID NO: 4218313 - DNA, 21 bp, Homo sapiens
ccttgcccagagatgcctcca

SEQ ID NO: 4218314 - DNA, 17 bp, Homo sapiens
ccttgcccttgccctga

SEQ ID NO: 4218315 - DNA, 18 bp, Homo sapiens
ccttggataatgctgttg

SEQ ID NO: 4218316 - DNA, 20 bp, Homo sapiens
ccttggtgtccacctggccc

SEQ ID NO: 4218317 - DNA, 21 bp, Homo sapiens
ccttggtgtccacctggcccc

SEQ ID NO: 4218318 - DNA, 20 bp, Homo sapiens
ccttgtgctcctgccagctc

SEQ ID NO: 4218319 - DNA, 12 bp, Homo sapiens
ccttgtggcaga

SEQ ID NO: 4218320 - DNA, 16 bp, Homo sapiens
ccttgtggcagaggat

SEQ ID NO: 4218321 - DNA, 22 bp, Homo sapiens
cctttaaagagagtttgccact

SEQ ID NO: 4218322 - DNA, 13 bp, Homo sapiens
cctttccttcctt

SEQ ID NO: 4218323 - DNA, 14 bp, Homo sapiens
cctttctccacacc

SEQ ID NO: 4218324 - DNA, 13 bp, Homo sapiens
cctttgcattcat

SEQ ID NO: 4218325 - DNA, 18 bp, Homo sapiens
cctttgtaagaaaaccaa

SEQ ID NO: 4218326 - DNA, 15 bp, Homo sapiens
ccttttcactacacc

SEQ ID NO: 4218327 - DNA, 20 bp, Homo sapiens
cgaacatatcatttgtgaag

SEQ ID NO: 4218328 - DNA, 22 bp, Homo sapiens
cgaacatatcatttgtgaagaa

SEQ ID NO: 4218329 - DNA, 23 bp, Homo sapiens
cgaacccacctgctgagagaccc

SEQ ID NO: 4218330 - DNA, 23 bp, Homo sapiens
cgacaggaggtatgacctgggtg

SEQ ID NO: 4218331 - DNA, 22 bp, Homo sapiens
cgacctcgtcctccccctgcca

SEQ ID NO: 4218332 - DNA, 16 bp, Homo sapiens
cgagaaaggcctctgt

SEQ ID NO: 4218333 - DNA, 17 bp, Homo sapiens
cgagaccaacctgacca

SEQ ID NO: 4218334 - DNA, 22 bp, Homo sapiens
cgagacccatttccttgtgctc

SEQ ID NO: 4218335 - DNA, 13 bp, Homo sapiens
cgagagcctgctc

SEQ ID NO: 4218336 - DNA, 14 bp, Homo sapiens
cgagagcctgctcc

SEQ ID NO: 4218337 - DNA, 15 bp, Homo sapiens
cgaggtcaacagaga

SEQ ID NO: 4218338 - DNA, 17 bp, Homo sapiens
cgaggtcaacagagaag

SEQ ID NO: 4218339 - DNA, 21 bp, Homo sapiens
cgaggtcaacagagaaggcag

SEQ ID NO: 4218340 - DNA, 23 bp, Homo sapiens
cgaggtcaacagagaaggcagga

SEQ ID NO: 4218341 - DNA, 22 bp, Homo sapiens
cgaggtggatcacagaggcttc

SEQ ID NO: 4218342 - DNA, 14 bp, Homo sapiens
cgcatcttctccat

SEQ ID NO: 4218343 - DNA, 17 bp, Homo sapiens
cgcctcaatgtggttgc

SEQ ID NO: 4218344 - DNA, 18 bp, Homo sapiens
cgctctgctggcctggcc

SEQ ID NO: 4218345 - DNA, 13 bp, Homo sapiens
cgctgccgcaccc

SEQ ID NO: 4218346 - DNA, 21 bp, Homo sapiens
cgctgccgcaccccagagtgt

SEQ ID NO: 4218347 - DNA, 19 bp, Homo sapiens
cggcaaccccagttctgct

SEQ ID NO: 4218348 - DNA, 19 bp, Homo sapiens
cggcccacagctcccaccc

SEQ ID NO: 4218349 - DNA, 15 bp, Homo sapiens
cggccgcattccctg

SEQ ID NO: 4218350 - DNA, 13 bp, Homo sapiens
cggcgcggtggct

SEQ ID NO: 4218351 - DNA, 12 bp, Homo sapiens
cggctactcagc

SEQ ID NO: 4218352 - DNA, 19 bp, Homo sapiens
cggctactcagcagccctc

SEQ ID NO: 4218353 - DNA, 20 bp, Homo sapiens
cggctactcagcagccctcc

SEQ ID NO: 4218354 - DNA, 23 bp, Homo sapiens
cggctccccattttataccaaag

SEQ ID NO: 4218355 - DNA, 12 bp, Homo sapiens
cggctccctcct

SEQ ID NO: 4218356 - DNA, 23 bp, Homo sapiens
cggctgagtcatgatctccctgc

SEQ ID NO: 4218357 - DNA, 15 bp, Homo sapiens
cgggcttttccccgg

SEQ ID NO: 4218358 - DNA, 18 bp, Homo sapiens
cgggtggctagtcagaga

SEQ ID NO: 4218359 - DNA, 20 bp, Homo sapiens
cggtcagatttgctgttcac

SEQ ID NO: 4218360 - DNA, 23 bp, Homo sapiens
cggtcccttgagacctcagccat

SEQ ID NO: 4218361 - DNA, 19 bp, Homo sapiens
cggtgcctgggtggggctg

SEQ ID NO: 4218362 - DNA, 20 bp, Homo sapiens
cggtggctcacgcctgtaat

SEQ ID NO: 4218363 - DNA, 15 bp, Homo sapiens
cgtattggtccagct

SEQ ID NO: 4218364 - DNA, 17 bp, Homo sapiens
cgtctggggttcagccc

SEQ ID NO: 4218365 - DNA, 23 bp, Homo sapiens
cgtcttagaagtggaccaggaca

SEQ ID NO: 4218366 - DNA, 21 bp, Homo sapiens
cgtgacctctgcaagacaaag

SEQ ID NO: 4218367 - DNA, 13 bp, Homo sapiens
cgtgactcaccca

SEQ ID NO: 4218368 - DNA, 15 bp, Homo sapiens
cgtgactcacccaag

SEQ ID NO: 4218369 - DNA, 13 bp, Homo sapiens
cgtgactgcccca

SEQ ID NO: 4218370 - DNA, 16 bp, Homo sapiens
cgtgactgccccaact

SEQ ID NO: 4218371 - DNA, 16 bp, Homo sapiens
cgtgatcactgagcca

SEQ ID NO: 4218372 - DNA, 19 bp, Homo sapiens
cgtgccaggcccggggctg

SEQ ID NO: 4218373 - DNA, 13 bp, Homo sapiens
cgtggttccaaga

SEQ ID NO: 4218374 - DNA, 18 bp, Homo sapiens
cgttccttactgcagaat

SEQ ID NO: 4218375 - DNA, 15 bp, Homo sapiens
ctaaaatattttaga

SEQ ID NO: 4218376 - DNA, 16 bp, Homo sapiens
ctaaaatattttagat

SEQ ID NO: 4218377 - DNA, 21 bp, Homo sapiens
ctaaagtagtttaagtctcct

SEQ ID NO: 4218378 - DNA, 12 bp, Homo sapiens
ctaaattaaaaa

SEQ ID NO: 4218379 - DNA, 17 bp, Homo sapiens
ctaaattaaaaaagaaa

SEQ ID NO: 4218380 - DNA, 18 bp, Homo sapiens
ctaagagctagcgctgcc

SEQ ID NO: 4218381 - DNA, 20 bp, Homo sapiens
ctaataaagctcctctgctc

SEQ ID NO: 4218382 - DNA, 22 bp, Homo sapiens
ctaataaagctcctctgctcca

SEQ ID NO: 4218383 - DNA, 17 bp, Homo sapiens
ctaatagagagattagt

SEQ ID NO: 4218384 - DNA, 22 bp, Homo sapiens
ctaatgaatgcataaaatgtta

SEQ ID NO: 4218385 - DNA, 20 bp, Homo sapiens
cccattctctctcctgtcca

SEQ ID NO: 4218386 - DNA, 12 bp, Homo sapiens
ccccaccccctt

SEQ ID NO: 4218387 - DNA, 21 bp, Homo sapiens
ccccacccccttcagtgccca

SEQ ID NO: 4218388 - DNA, 18 bp, Homo sapiens
ccccactgcaggccccgc

SEQ ID NO: 4218389 - DNA, 17 bp, Homo sapiens
ccccagaagacacagga

SEQ ID NO: 4218390 - DNA, 13 bp, Homo sapiens
ccccaggtggctg

SEQ ID NO: 4218391 - DNA, 23 bp, Homo sapiens
ccccaggtggctgacccagtccc

SEQ ID NO: 4218392 - DNA, 15 bp, Homo sapiens
ccccagttctgctcc

SEQ ID NO: 4218393 - DNA, 19 bp, Homo sapiens
ccccagttctgctcctctc

SEQ ID NO: 4218394 - DNA, 20 bp, Homo sapiens
ccccagttctgctcctctcc

SEQ ID NO: 4218395 - DNA, 15 bp, Homo sapiens
ccccatgtctctcag

SEQ ID NO: 4218396 - DNA, 21 bp, Homo sapiens
cccccactctcattccccagg

SEQ ID NO: 4218397 - DNA, 12 bp, Homo sapiens
ccccccactgca

SEQ ID NO: 4218398 - DNA, 14 bp, Homo sapiens
ccccccaggccagc

SEQ ID NO: 4218399 - DNA, 14 bp, Homo sapiens
ccccctgccagtgc

SEQ ID NO: 4218400 - DNA, 18 bp, Homo sapiens
ccccgcttgtccagcgcc

SEQ ID NO: 4218401 - DNA, 19 bp, Homo sapiens
ccccgcttgtccagcgcct

SEQ ID NO: 4218402 - DNA, 13 bp, Homo sapiens
ccccggctgcaca

SEQ ID NO: 4218403 - DNA, 24 bp, Homo sapiens
ccccggtcccttgagacctcagcc

SEQ ID NO: 4218404 - DNA, 13 bp, Homo sapiens
cccctcagagctc

SEQ ID NO: 4218405 - DNA, 17 bp, Homo sapiens
cccctgccagtgcctta

SEQ ID NO: 4218406 - DNA, 23 bp, Homo sapiens
ccccttgcccttgccctgacctc

SEQ ID NO: 4218407 - DNA, 14 bp, Homo sapiens
cccggcgcggtggc

SEQ ID NO: 4218408 - DNA, 19 bp, Homo sapiens
cccggcgcggtggctcacg

SEQ ID NO: 4218409 - DNA, 19 bp, Homo sapiens
cccggcgtttacctcgtgg

SEQ ID NO: 4218410 - DNA, 22 bp, Homo sapiens
cccggcgtttacctcgtggtgt

SEQ ID NO: 4218411 - DNA, 21 bp, Homo sapiens
cccgtctggggttcagcccct

SEQ ID NO: 4218412 - DNA, 23 bp, Homo sapiens
ccctaaactccaggatttataaa

SEQ ID NO: 4218413 - DNA, 16 bp, Homo sapiens
ccctatccacccagcc

SEQ ID NO: 4218414 - DNA, 19 bp, Homo sapiens
ccctatccacccagcccat

SEQ ID NO: 4218415 - DNA, 17 bp, Homo sapiens
ccctattggtaaagaat

SEQ ID NO: 4218416 - DNA, 23 bp, Homo sapiens
ccctctaataaagctcctctgct

SEQ ID NO: 4218417 - DNA, 17 bp, Homo sapiens
ccctctcctgcctactc

SEQ ID NO: 4218418 - DNA, 14 bp, Homo sapiens
ccctctggccctgc

SEQ ID NO: 4218419 - DNA, 22 bp, Homo sapiens
ccctgacctcccagccctatgg

SEQ ID NO: 4218420 - DNA, 17 bp, Homo sapiens
ccctgctcggccggtgt

SEQ ID NO: 4218421 - DNA, 13 bp, Homo sapiens
ccctggcctgctg

SEQ ID NO: 4218422 - DNA, 21 bp, Homo sapiens
ccctggcctgctgggctctcc

SEQ ID NO: 4218423 - DNA, 20 bp, Homo sapiens
ccctggcttgtaactccacc

SEQ ID NO: 4218424 - DNA, 18 bp, Homo sapiens
ccctgggccccaccacct

SEQ ID NO: 4218425 - DNA, 17 bp, Homo sapiens
ccctgggggaagccctg

SEQ ID NO: 4218426 - DNA, 18 bp, Homo sapiens
ccctgggggaagccctgg

SEQ ID NO: 4218427 - DNA, 19 bp, Homo sapiens
ccctgggggaagccctgga

SEQ ID NO: 4218428 - DNA, 18 bp, Homo sapiens
ccctggttatattctcac

SEQ ID NO: 4218429 - DNA, 19 bp, Homo sapiens
ccctggttatattctcacg

SEQ ID NO: 4218430 - DNA, 17 bp, Homo sapiens
cccttcagtgcccacca

SEQ ID NO: 4218431 - DNA, 15 bp, Homo sapiens
cccttgccctgacct

SEQ ID NO: 4218432 - DNA, 20 bp, Homo sapiens
cccttgccctgacctcccag

SEQ ID NO: 4218433 - DNA, 13 bp, Homo sapiens
ccctttcctgcgg

SEQ ID NO: 4218434 - DNA, 18 bp, Homo sapiens
ccctttccttccttccct

SEQ ID NO: 4218435 - DNA, 19 bp, Homo sapiens
ccgaacatatcatttgtga

SEQ ID NO: 4218436 - DNA, 20 bp, Homo sapiens
ccgaacatatcatttgtgaa

SEQ ID NO: 4218437 - DNA, 19 bp, Homo sapiens
ccgaatttagtcacaccat

SEQ ID NO: 4218438 - DNA, 14 bp, Homo sapiens
ccgacctctctcct

SEQ ID NO: 4218439 - DNA, 16 bp, Homo sapiens
ccgaggatgtgtccta

SEQ ID NO: 4218440 - DNA, 12 bp, Homo sapiens
ccgcatcttctc

SEQ ID NO: 4218441 - DNA, 16 bp, Homo sapiens
ccgcatcttctccatc

SEQ ID NO: 4218442 - DNA, 19 bp, Homo sapiens
ccgcatcttctccatctgg

SEQ ID NO: 4218443 - DNA, 19 bp, Homo sapiens
ccgctgctcactttccacc

SEQ ID NO: 4218444 - DNA, 19 bp, Homo sapiens
ccgctgttcacccacaggg

SEQ ID NO: 4218445 - DNA, 19 bp, Homo sapiens
ccgcttgtccagcgcctag

SEQ ID NO: 4218446 - DNA, 17 bp, Homo sapiens
ccggcaaccccagttct

SEQ ID NO: 4218447 - DNA, 21 bp, Homo sapiens
ccggcaaccccagttctgctc

SEQ ID NO: 4218448 - DNA, 23 bp, Homo sapiens
ccggcaaccccagttctgctcct

SEQ ID NO: 4218449 - DNA, 13 bp, Homo sapiens
ccggctccctcct

SEQ ID NO: 4218450 - DNA, 18 bp, Homo sapiens
ccggggttcaagccatgg

SEQ ID NO: 4218451 - DNA, 19 bp, Homo sapiens
ccggggttcaagccatggc

SEQ ID NO: 4218452 - DNA, 14 bp, Homo sapiens
ccggtcacccaggc

SEQ ID NO: 4218453 - DNA, 18 bp, Homo sapiens
ccggtcccttgagacctc

SEQ ID NO: 4218454 - DNA, 11 bp, Homo sapiens
ccggtgtcctt

SEQ ID NO: 4218455 - DNA, 19 bp, Homo sapiens
ccgtctggggttcagcccc

SEQ ID NO: 4218456 - DNA, 22 bp, Homo sapiens
ccgtcttagaagtggaccagga

SEQ ID NO: 4218457 - DNA, 13 bp, Homo sapiens
ccgttactctcca

SEQ ID NO: 4218458 - DNA, 14 bp, Homo sapiens
ccgttactctccaa

SEQ ID NO: 4218459 - DNA, 17 bp, Homo sapiens
ccgttactctccaacct

SEQ ID NO: 4218460 - DNA, 22 bp, Homo sapiens
ccgttactctccaacctggaca

SEQ ID NO: 4218461 - DNA, 15 bp, Homo sapiens
cctaacccctttcct

SEQ ID NO: 4218462 - DNA, 16 bp, Homo sapiens
cctaagtggctgctga

SEQ ID NO: 4218463 - DNA, 15 bp, Homo sapiens
cctacctgctgctgc

SEQ ID NO: 4218464 - DNA, 14 bp, Homo sapiens
cctaggccactcct

SEQ ID NO: 4218465 - DNA, 15 bp, Homo sapiens
cctaggccactcctc

SEQ ID NO: 4218466 - DNA, 16 bp, Homo sapiens
cctaggccactcctcc

SEQ ID NO: 4218467 - DNA, 19 bp, Homo sapiens
cctaggccactcctccaaa

SEQ ID NO: 4218468 - DNA, 19 bp, Homo sapiens
cctagtggggtctccctct

SEQ ID NO: 4218469 - DNA, 18 bp, Homo sapiens
cctataccatatgtctgc

SEQ ID NO: 4218470 - DNA, 14 bp, Homo sapiens
cctatccacccagc

SEQ ID NO: 4218471 - DNA, 17 bp, Homo sapiens
cctatccacccagccca

SEQ ID NO: 4218472 - DNA, 20 bp, Homo sapiens
cctattttgtatatgtgaga

SEQ ID NO: 4218473 - DNA, 13 bp, Homo sapiens
cctcaaaacactt

SEQ ID NO: 4218474 - DNA, 14 bp, Homo sapiens
cctcaaatgtcaga

SEQ ID NO: 4218475 - DNA, 20 bp, Homo sapiens
cctcaatgtgaatcagaccc

SEQ ID NO: 4218476 - DNA, 11 bp, Homo sapiens
cctcagagctc

SEQ ID NO: 4218477 - DNA, 12 bp, Homo sapiens
cctcagagctct

SEQ ID NO: 4218478 - DNA, 14 bp, Homo sapiens
cctcagagtcccgg

SEQ ID NO: 4218479 - DNA, 23 bp, Homo sapiens
cctcagggacagagacacctgca

SEQ ID NO: 4218480 - DNA, 16 bp, Homo sapiens
cctcattcaggaaaac

SEQ ID NO: 4218481 - DNA, 16 bp, Homo sapiens
cctccagggccacgtg

SEQ ID NO: 4218482 - DNA, 17 bp, Homo sapiens
cctccagggccacgtgc

SEQ ID NO: 4218483 - DNA, 20 bp, Homo sapiens
cctccagggccacgtgccag

SEQ ID NO: 4218484 - DNA, 22 bp, Homo sapiens
cctccagggccacgtgccaggc

SEQ ID NO: 4218485 - DNA, 14 bp, Homo sapiens
cctccccaggggag

SEQ ID NO: 4218486 - DNA, 20 bp, Homo sapiens
cctccccccactgcaggccc

SEQ ID NO: 4218487 - DNA, 14 bp, Homo sapiens
cctccccctgccag

SEQ ID NO: 4218488 - DNA, 18 bp, Homo sapiens
cctccccctgccagtgcc

SEQ ID NO: 4218489 - DNA, 19 bp, Homo sapiens
cctccccctgccagtgcct

SEQ ID NO: 4218490 - DNA, 20 bp, Homo sapiens
cctccccctgccagtgcctt

SEQ ID NO: 4218491 - DNA, 18 bp, Homo sapiens
cctcccctatccacccag

SEQ ID NO: 4218492 - DNA, 22 bp, Homo sapiens
cctcccctatccacccagccca

SEQ ID NO: 4218493 - DNA, 15 bp, Homo sapiens
cctccctgtcctcct

SEQ ID NO: 4218494 - DNA, 15 bp, Homo sapiens
cctcctcgaagtccc

SEQ ID NO: 4218495 - DNA, 22 bp, Homo sapiens
cctcctcgaagtcccggcttcc

SEQ ID NO: 4218496 - DNA, 12 bp, Homo sapiens
cctcctctgcca

SEQ ID NO: 4218497 - DNA, 15 bp, Homo sapiens
cctcctctgccacct

SEQ ID NO: 4218498 - DNA, 20 bp, Homo sapiens
cctcctctgccacctcccct

SEQ ID NO: 4218499 - DNA, 21 bp, Homo sapiens
cctcctctgccacctccccta

SEQ ID NO: 4218500 - DNA, 13 bp, Homo sapiens
cctcctgcccagg

SEQ ID NO: 4218501 - DNA, 15 bp, Homo sapiens
cctcctgcccaggag

SEQ ID NO: 4218502 - DNA, 16 bp, Homo sapiens
cctcctgcccaggaga

SEQ ID NO: 4218503 - DNA, 19 bp, Homo sapiens
cctcctgcccaggagagcc

SEQ ID NO: 4218504 - DNA, 21 bp, Homo sapiens
cctcctgcccaggagagccag

SEQ ID NO: 4218505 - DNA, 15 bp, Homo sapiens
cctcggatcaccgag

SEQ ID NO: 4218506 - DNA, 14 bp, Homo sapiens
cctctagtttactt

SEQ ID NO: 4218507 - DNA, 12 bp, Homo sapiens
cctctccaggca

SEQ ID NO: 4218508 - DNA, 14 bp, Homo sapiens
cctctccaggcacc

SEQ ID NO: 4218509 - DNA, 12 bp, Homo sapiens
cctctcctgcct

SEQ ID NO: 4218510 - DNA, 15 bp, Homo sapiens
cctctcctgcctact

SEQ ID NO: 4218511 - DNA, 23 bp, Homo sapiens
cctctctaagccacagcttcttc

SEQ ID NO: 4218512 - DNA, 14 bp, Homo sapiens
ccaactttcccccc

SEQ ID NO: 4218513 - DNA, 19 bp, Homo sapiens
ccaactttccccccaaccc

SEQ ID NO: 4218514 - DNA, 13 bp, Homo sapiens
ccaagaggaaaaa

SEQ ID NO: 4218515 - DNA, 20 bp, Homo sapiens
ccaagaggaaaaacagggaa

SEQ ID NO: 4218516 - DNA, 21 bp, Homo sapiens
ccaagcgaggtcaacagagaa

SEQ ID NO: 4218517 - DNA, 14 bp, Homo sapiens
ccaaggtttataaa

SEQ ID NO: 4218518 - DNA, 19 bp, Homo sapiens
ccacaagattcccagagac

SEQ ID NO: 4218519 - DNA, 21 bp, Homo sapiens
ccacaagattcccagagacag

SEQ ID NO: 4218520 - DNA, 23 bp, Homo sapiens
ccacagagggaagtttaaaaccc

SEQ ID NO: 4218521 - DNA, 16 bp, Homo sapiens
ccacagctgcagccca

SEQ ID NO: 4218522 - DNA, 20 bp, Homo sapiens
ccacagggctaagagctagc

SEQ ID NO: 4218523 - DNA, 13 bp, Homo sapiens
ccacataagtcca

SEQ ID NO: 4218524 - DNA, 12 bp, Homo sapiens
ccaccaacccat

SEQ ID NO: 4218525 - DNA, 21 bp, Homo sapiens
ccaccaacccatcagaaggag

SEQ ID NO: 4218526 - DNA, 21 bp, Homo sapiens
ccaccacgatgtggccctggc

SEQ ID NO: 4218527 - DNA, 16 bp, Homo sapiens
ccaccactagagctga

SEQ ID NO: 4218528 - DNA, 14 bp, Homo sapiens
ccacccaacagctc

SEQ ID NO: 4218529 - DNA, 13 bp, Homo sapiens
ccacccagcccat

SEQ ID NO: 4218530 - DNA, 17 bp, Homo sapiens
ccaccccacccccttca

SEQ ID NO: 4218531 - DNA, 16 bp, Homo sapiens
ccaccccctccccagg

SEQ ID NO: 4218532 - DNA, 18 bp, Homo sapiens
ccaccccctccccagggg

SEQ ID NO: 4218533 - DNA, 18 bp, Homo sapiens
ccacccccttcagtgccc

SEQ ID NO: 4218534 - DNA, 21 bp, Homo sapiens
ccaccgctgcctaagtggctg

SEQ ID NO: 4218535 - DNA, 15 bp, Homo sapiens
ccacctcagccttgg

SEQ ID NO: 4218536 - DNA, 17 bp, Homo sapiens
ccacctcccctatccac

SEQ ID NO: 4218537 - DNA, 22 bp, Homo sapiens
ccacctcccctatccacccagc

SEQ ID NO: 4218538 - DNA, 23 bp, Homo sapiens
ccacctgctgagagacccaagga

SEQ ID NO: 4218539 - DNA, 15 bp, Homo sapiens
ccaccttcccagctc

SEQ ID NO: 4218540 - DNA, 19 bp, Homo sapiens
ccaccttcccagctctccc

SEQ ID NO: 4218541 - DNA, 18 bp, Homo sapiens
ccacgatgtggccctggc

SEQ ID NO: 4218542 - DNA, 20 bp, Homo sapiens
ccacgatgtggccctggcct

SEQ ID NO: 4218543 - DNA, 15 bp, Homo sapiens
ccacgttccttactg

SEQ ID NO: 4218544 - DNA, 20 bp, Homo sapiens
ccacgttccttactgcagaa

SEQ ID NO: 4218545 - DNA, 19 bp, Homo sapiens
ccactcccctaaactccag

SEQ ID NO: 4218546 - DNA, 14 bp, Homo sapiens
ccactctcattccc

SEQ ID NO: 4218547 - DNA, 18 bp, Homo sapiens
ccactgcaacttgtgaac

SEQ ID NO: 4218548 - DNA, 17 bp, Homo sapiens
ccactgcctttcagaag

SEQ ID NO: 4218549 - DNA, 15 bp, Homo sapiens
ccagaagtccctccc

SEQ ID NO: 4218550 - DNA, 19 bp, Homo sapiens
ccagactcctttcctctga

SEQ ID NO: 4218551 - DNA, 15 bp, Homo sapiens
ccagagaaaattaat

SEQ ID NO: 4218552 - DNA, 20 bp, Homo sapiens
ccagagatgcctccaccgct

SEQ ID NO: 4218553 - DNA, 20 bp, Homo sapiens
ccagagtgtgcagactgatg

SEQ ID NO: 4218554 - DNA, 18 bp, Homo sapiens
ccagagtgtgggaaggga

SEQ ID NO: 4218555 - DNA, 14 bp, Homo sapiens
ccagcccagcccag

SEQ ID NO: 4218556 - DNA, 18 bp, Homo sapiens
ccagcccagcccagctgg

SEQ ID NO: 4218557 - DNA, 15 bp, Homo sapiens
ccagccctatggatg

SEQ ID NO: 4218558 - DNA, 13 bp, Homo sapiens
ccagccctccctg

SEQ ID NO: 4218559 - DNA, 13 bp, Homo sapiens
ccagctactcagg

SEQ ID NO: 4218560 - DNA, 21 bp, Homo sapiens
ccagctctccctctggccctg

SEQ ID NO: 4218561 - DNA, 16 bp, Homo sapiens
ccagctgggttggaaa

SEQ ID NO: 4218562 - DNA, 17 bp, Homo sapiens
ccagctgggttggaaaa

SEQ ID NO: 4218563 - DNA, 16 bp, Homo sapiens
ccagcttgctcttcag

SEQ ID NO: 4218564 - DNA, 22 bp, Homo sapiens
ccaggaaccgaacatatcattt

SEQ ID NO: 4218565 - DNA, 13 bp, Homo sapiens
ccaggacaggccc

SEQ ID NO: 4218566 - DNA, 13 bp, Homo sapiens
ccaggactgagat

SEQ ID NO: 4218567 - DNA, 17 bp, Homo sapiens
ccaggagagccagccct

SEQ ID NO: 4218568 - DNA, 20 bp, Homo sapiens
ccaggagagccagccctccc

SEQ ID NO: 4218569 - DNA, 18 bp, Homo sapiens
ccaggatttataaagcaa

SEQ ID NO: 4218570 - DNA, 17 bp, Homo sapiens
ccaggcaacttgggaac

SEQ ID NO: 4218571 - DNA, 13 bp, Homo sapiens
ccaggcacccttc

SEQ ID NO: 4218572 - DNA, 18 bp, Homo sapiens
ccaggcacgaacccacct

SEQ ID NO: 4218573 - DNA, 23 bp, Homo sapiens
ccaggcacgaacccacctgctga

SEQ ID NO: 4218574 - DNA, 17 bp, Homo sapiens
ccagggccacgtgccag

SEQ ID NO: 4218575 - DNA, 22 bp, Homo sapiens
ccagtattatattatcatatct

SEQ ID NO: 4218576 - DNA, 19 bp, Homo sapiens
ccagtccctgggggaagcc

SEQ ID NO: 4218577 - DNA, 23 bp, Homo sapiens
ccagtccctgggggaagccctgg

SEQ ID NO: 4218578 - DNA, 17 bp, Homo sapiens
ccagtgccttacctcct

SEQ ID NO: 4218579 - DNA, 17 bp, Homo sapiens
ccagttctgctcctctc

SEQ ID NO: 4218580 - DNA, 19 bp, Homo sapiens
ccagttctgctcctctcca

SEQ ID NO: 4218581 - DNA, 22 bp, Homo sapiens
ccagttctgctcctctccaggc

SEQ ID NO: 4218582 - DNA, 14 bp, Homo sapiens
ccagtttgcagaaa

SEQ ID NO: 4218583 - DNA, 12 bp, Homo sapiens
ccatatgatatt

SEQ ID NO: 4218584 - DNA, 19 bp, Homo sapiens
ccatatgtctgcttctgtc

SEQ ID NO: 4218585 - DNA, 14 bp, Homo sapiens
ccatcactggagca

SEQ ID NO: 4218586 - DNA, 14 bp, Homo sapiens
ccatcatcccagct

SEQ ID NO: 4218587 - DNA, 16 bp, Homo sapiens
ccatcgctgtcatctc

SEQ ID NO: 4218588 - DNA, 14 bp, Homo sapiens
ccatctggcagggt

SEQ ID NO: 4218589 - DNA, 16 bp, Homo sapiens
ccatctggcagggtgg

SEQ ID NO: 4218590 - DNA, 16 bp, Homo sapiens
ccatgcatttaaagta

SEQ ID NO: 4218591 - DNA, 16 bp, Homo sapiens
ccatgtctctcagaat

SEQ ID NO: 4218592 - DNA, 12 bp, Homo sapiens
ccatgttccctt

SEQ ID NO: 4218593 - DNA, 17 bp, Homo sapiens
ccatgtttgagctcaga

SEQ ID NO: 4218594 - DNA, 21 bp, Homo sapiens
ccatgtttgagctcagacccc

SEQ ID NO: 4218595 - DNA, 15 bp, Homo sapiens
ccattttataccaaa

SEQ ID NO: 4218596 - DNA, 14 bp, Homo sapiens
cccaaaaatttgaa

SEQ ID NO: 4218597 - DNA, 14 bp, Homo sapiens
cccaacccggaaac

SEQ ID NO: 4218598 - DNA, 12 bp, Homo sapiens
cccaactcctgg

SEQ ID NO: 4218599 - DNA, 17 bp, Homo sapiens
cccaactcctggaagct

SEQ ID NO: 4218600 - DNA, 22 bp, Homo sapiens
cccaaggaggaaaaacagacaa

SEQ ID NO: 4218601 - DNA, 14 bp, Homo sapiens
cccaagtgggggca

SEQ ID NO: 4218602 - DNA, 19 bp, Homo sapiens
cccaagtgggggcagaggg

SEQ ID NO: 4218603 - DNA, 23 bp, Homo sapiens
cccaagtgggggcagagggcaga

SEQ ID NO: 4218604 - DNA, 14 bp, Homo sapiens
cccacagctcccac

SEQ ID NO: 4218605 - DNA, 20 bp, Homo sapiens
cccacagctcccaccccacc

SEQ ID NO: 4218606 - DNA, 21 bp, Homo sapiens
cccaccaacatcccattgccc

SEQ ID NO: 4218607 - DNA, 19 bp, Homo sapiens
cccaccacgatgtggccct

SEQ ID NO: 4218608 - DNA, 16 bp, Homo sapiens
cccaccctcagcccgc

SEQ ID NO: 4218609 - DNA, 12 bp, Homo sapiens
cccacctgctga

SEQ ID NO: 4218610 - DNA, 13 bp, Homo sapiens
cccacctgctgag

SEQ ID NO: 4218611 - DNA, 14 bp, Homo sapiens
cccactctcattcc

SEQ ID NO: 4218612 - DNA, 13 bp, Homo sapiens
cccagagacagga

SEQ ID NO: 4218613 - DNA, 15 bp, Homo sapiens
cccagagacaggaaa

SEQ ID NO: 4218614 - DNA, 14 bp, Homo sapiens
cccagagatgcctc

SEQ ID NO: 4218615 - DNA, 19 bp, Homo sapiens
cccagagatgcctccaccg

SEQ ID NO: 4218616 - DNA, 23 bp, Homo sapiens
cccagagatgcctccaccgctgc

SEQ ID NO: 4218617 - DNA, 16 bp, Homo sapiens
cccagagtgtgggaag

SEQ ID NO: 4218618 - DNA, 18 bp, Homo sapiens
cccagcccagctggtggg

SEQ ID NO: 4218619 - DNA, 22 bp, Homo sapiens
cccagcccattctctctcctgt

SEQ ID NO: 4218620 - DNA, 20 bp, Homo sapiens
cccagcccgctgctcacttt

SEQ ID NO: 4218621 - DNA, 14 bp, Homo sapiens
cccagctactcagg

SEQ ID NO: 4218622 - DNA, 20 bp, Homo sapiens
cccagctactcaggaggctg

SEQ ID NO: 4218623 - DNA, 17 bp, Homo sapiens
cccagctctccctctgg

SEQ ID NO: 4218624 - DNA, 21 bp, Homo sapiens
cccagctctccctctggccct

SEQ ID NO: 4218625 - DNA, 23 bp, Homo sapiens
cccagctctccctctggccctgc

SEQ ID NO: 4218626 - DNA, 18 bp, Homo sapiens
cccaggagagccagccct

SEQ ID NO: 4218627 - DNA, 15 bp, Homo sapiens
cccaggggagagggt

SEQ ID NO: 4218628 - DNA, 23 bp, Homo sapiens
cccaggggagagggtctggagaa

SEQ ID NO: 4218629 - DNA, 16 bp, Homo sapiens
cccaggtggctgaccc

SEQ ID NO: 4218630 - DNA, 18 bp, Homo sapiens
cccaggtggctgacccag

SEQ ID NO: 4218631 - DNA, 15 bp, Homo sapiens
cccagttctgctcct

SEQ ID NO: 4218632 - DNA, 22 bp, Homo sapiens
cccagttctgctcctctccagg

SEQ ID NO: 4218633 - DNA, 15 bp, Homo sapiens
cccatcactggagca

SEQ ID NO: 4218634 - DNA, 20 bp, Homo sapiens
cccatcactggagcaccagg

SEQ ID NO: 4218635 - DNA, 14 bp, Homo sapiens
cccatcatcccagc

SEQ ID NO: 4218636 - DNA, 17 bp, Homo sapiens
cccattctctctcctgt

SEQ ID NO: 4218637 - DNA, 18 bp, Homo sapiens
cccattctctctcctgtc

SEQ ID NO: 4218638 - DNA, 19 bp, Homo sapiens
cccattctctctcctgtcc

SEQ ID NO: 4218639 - DNA, 14 bp, Homo sapiens
cagctcccacccca

SEQ ID NO: 4218640 - DNA, 17 bp, Homo sapiens
cagctgggttggaaaac

SEQ ID NO: 4218641 - DNA, 12 bp, Homo sapiens
cagctgtccctg

SEQ ID NO: 4218642 - DNA, 16 bp, Homo sapiens
cagctgtccctgtcac

SEQ ID NO: 4218643 - DNA, 17 bp, Homo sapiens
cagctgtccctgtcacc

SEQ ID NO: 4218644 - DNA, 12 bp, Homo sapiens
cagctttgccct

SEQ ID NO: 4218645 - DNA, 19 bp, Homo sapiens
caggaatgttaaagtcagt

SEQ ID NO: 4218646 - DNA, 13 bp, Homo sapiens
caggacaggacca

SEQ ID NO: 4218647 - DNA, 19 bp, Homo sapiens
caggactgaattgtcccca

SEQ ID NO: 4218648 - DNA, 13 bp, Homo sapiens
caggaggctgagg

SEQ ID NO: 4218649 - DNA, 16 bp, Homo sapiens
caggaggctgaggcag

SEQ ID NO: 4218650 - DNA, 17 bp, Homo sapiens
caggaggctgaggcaga

SEQ ID NO: 4218651 - DNA, 18 bp, Homo sapiens
caggaggctgaggcagaa

SEQ ID NO: 4218652 - DNA, 20 bp, Homo sapiens
caggaggctgaggcagaaga

SEQ ID NO: 4218653 - DNA, 15 bp, Homo sapiens
caggaggtggaggtt

SEQ ID NO: 4218654 - DNA, 17 bp, Homo sapiens
caggatttataaagcaa

SEQ ID NO: 4218655 - DNA, 16 bp, Homo sapiens
caggcacgaacccacc

SEQ ID NO: 4218656 - DNA, 19 bp, Homo sapiens
caggcacgaacccacctgc

SEQ ID NO: 4218657 - DNA, 21 bp, Homo sapiens
caggcacgaacccacctgctg

SEQ ID NO: 4218658 - DNA, 23 bp, Homo sapiens
caggcatgtcctaggctctgggt

SEQ ID NO: 4218659 - DNA, 19 bp, Homo sapiens
caggccccgcttgtccagc

SEQ ID NO: 4218660 - DNA, 14 bp, Homo sapiens
caggcccggggctg

SEQ ID NO: 4218661 - DNA, 19 bp, Homo sapiens
caggcgctgggggctggac

SEQ ID NO: 4218662 - DNA, 19 bp, Homo sapiens
caggctctggagccagaga

SEQ ID NO: 4218663 - DNA, 22 bp, Homo sapiens
cagggacagagacacctgcacc

SEQ ID NO: 4218664 - DNA, 18 bp, Homo sapiens
cagggccacgtgccaggc

SEQ ID NO: 4218665 - DNA, 13 bp, Homo sapiens
cagggccttgccc

SEQ ID NO: 4218666 - DNA, 20 bp, Homo sapiens
cagggccttgcccagagatg

SEQ ID NO: 4218667 - DNA, 23 bp, Homo sapiens
cagggctggggccaagaggaaaa

SEQ ID NO: 4218668 - DNA, 16 bp, Homo sapiens
caggtggctgacccag

SEQ ID NO: 4218669 - DNA, 20 bp, Homo sapiens
caggtggctgacccagtccc

SEQ ID NO: 4218670 - DNA, 20 bp, Homo sapiens
cagtagctgtggtgaggtgg

SEQ ID NO: 4218671 - DNA, 20 bp, Homo sapiens
cagtccctgggggaagccct

SEQ ID NO: 4218672 - DNA, 21 bp, Homo sapiens
cagtccctgggggaagccctg

SEQ ID NO: 4218673 - DNA, 22 bp, Homo sapiens
cagtctaggaatggagtctccc

SEQ ID NO: 4218674 - DNA, 15 bp, Homo sapiens
cagtctcgggtggct

SEQ ID NO: 4218675 - DNA, 22 bp, Homo sapiens
cagtctcgggtggctagtcaga

SEQ ID NO: 4218676 - DNA, 23 bp, Homo sapiens
cagtctggtttatataaggcagt

SEQ ID NO: 4218677 - DNA, 17 bp, Homo sapiens
cagtgaatttgtccatt

SEQ ID NO: 4218678 - DNA, 22 bp, Homo sapiens
cagtgaatttgtccattgtaaa

SEQ ID NO: 4218679 - DNA, 10 bp, Homo sapiens
cagtgcctgc

SEQ ID NO: 4218680 - DNA, 17 bp, Homo sapiens
cagtgccttacctcctg

SEQ ID NO: 4218681 - DNA, 21 bp, Homo sapiens
cagtgccttacctcctgccca

SEQ ID NO: 4218682 - DNA, 17 bp, Homo sapiens
cagtggagaaatattta

SEQ ID NO: 4218683 - DNA, 13 bp, Homo sapiens
cagttactcagcc

SEQ ID NO: 4218684 - DNA, 17 bp, Homo sapiens
cagttactcagccctgg

SEQ ID NO: 4218685 - DNA, 14 bp, Homo sapiens
cagttcctcgccct

SEQ ID NO: 4218686 - DNA, 19 bp, Homo sapiens
cagttctgctcctctccag

SEQ ID NO: 4218687 - DNA, 22 bp, Homo sapiens
cagttctgctcctctccaggca

SEQ ID NO: 4218688 - DNA, 22 bp, Homo sapiens
cagtttgcagaaaagcacctgc

SEQ ID NO: 4218689 - DNA, 11 bp, Homo sapiens
cagtttttccc

SEQ ID NO: 4218690 - DNA, 13 bp, Homo sapiens
cagtttttccccc

SEQ ID NO: 4218691 - DNA, 22 bp, Homo sapiens
cataaaccaatgagctgtatct

SEQ ID NO: 4218692 - DNA, 19 bp, Homo sapiens
cataaagcaattgtgaaat

SEQ ID NO: 4218693 - DNA, 19 bp, Homo sapiens
cataaggagaatgtatctc

SEQ ID NO: 4218694 - DNA, 16 bp, Homo sapiens
catagtggatggacag

SEQ ID NO: 4218695 - DNA, 20 bp, Homo sapiens
catagtggatggacagatgg

SEQ ID NO: 4218696 - DNA, 23 bp, Homo sapiens
catagtggatggacagatggacc

SEQ ID NO: 4218697 - DNA, 14 bp, Homo sapiens
catatcatttgtga

SEQ ID NO: 4218698 - DNA, 15 bp, Homo sapiens
catatcatttgtgaa

SEQ ID NO: 4218699 - DNA, 16 bp, Homo sapiens
catatttttctaaaga

SEQ ID NO: 4218700 - DNA, 18 bp, Homo sapiens
catcaaatttgccaccac

SEQ ID NO: 4218701 - DNA, 14 bp, Homo sapiens
catcagaaggagaa

SEQ ID NO: 4218702 - DNA, 15 bp, Homo sapiens
catcagaaggagaag

SEQ ID NO: 4218703 - DNA, 15 bp, Homo sapiens
catcatcccagctgc

SEQ ID NO: 4218704 - DNA, 17 bp, Homo sapiens
catccattcctcaggga

SEQ ID NO: 4218705 - DNA, 17 bp, Homo sapiens
catcccattgccctggt

SEQ ID NO: 4218706 - DNA, 18 bp, Homo sapiens
catccgtagttccctgaa

SEQ ID NO: 4218707 - DNA, 21 bp, Homo sapiens
catccgtagttccctgaaaac

SEQ ID NO: 4218708 - DNA, 14 bp, Homo sapiens
catcctcccggctc

SEQ ID NO: 4218709 - DNA, 19 bp, Homo sapiens
catcgtgatcactgagcca

SEQ ID NO: 4218710 - DNA, 21 bp, Homo sapiens
catctaatgtctcttcctctg

SEQ ID NO: 4218711 - DNA, 22 bp, Homo sapiens
catctaatgtctcttcctctgt

SEQ ID NO: 4218712 - DNA, 19 bp, Homo sapiens
catctctcaaacttagttt

SEQ ID NO: 4218713 - DNA, 14 bp, Homo sapiens
catctgaaagccac

SEQ ID NO: 4218714 - DNA, 23 bp, Homo sapiens
catgaactacgtgacctctgcaa

SEQ ID NO: 4218715 - DNA, 14 bp, Homo sapiens
catgagaaatgtga

SEQ ID NO: 4218716 - DNA, 16 bp, Homo sapiens
catgaggagttgctgt

SEQ ID NO: 4218717 - DNA, 17 bp, Homo sapiens
catgatctccctgccgc

SEQ ID NO: 4218718 - DNA, 19 bp, Homo sapiens
catgatctccctgccgcct

SEQ ID NO: 4218719 - DNA, 18 bp, Homo sapiens
catgccccggctgcacac

SEQ ID NO: 4218720 - DNA, 13 bp, Homo sapiens
catgctctctgca

SEQ ID NO: 4218721 - DNA, 14 bp, Homo sapiens
catgctctctgcag

SEQ ID NO: 4218722 - DNA, 23 bp, Homo sapiens
catgctctctgcagccagcccag

SEQ ID NO: 4218723 - DNA, 16 bp, Homo sapiens
catggaaaacagagta

SEQ ID NO: 4218724 - DNA, 22 bp, Homo sapiens
catggacaatataaactgaaaa

SEQ ID NO: 4218725 - DNA, 19 bp, Homo sapiens
catggactttggaaaatat

SEQ ID NO: 4218726 - DNA, 15 bp, Homo sapiens
catggagaaaccctg

SEQ ID NO: 4218727 - DNA, 20 bp, Homo sapiens
catggagaaaccctgtctct

SEQ ID NO: 4218728 - DNA, 17 bp, Homo sapiens
catggtccggtgtcctt

SEQ ID NO: 4218729 - DNA, 17 bp, Homo sapiens
catggtggcgcaagcct

SEQ ID NO: 4218730 - DNA, 14 bp, Homo sapiens
catgtcaaacgtga

SEQ ID NO: 4218731 - DNA, 15 bp, Homo sapiens
catgtcctaggctct

SEQ ID NO: 4218732 - DNA, 22 bp, Homo sapiens
catgtggaaatgacccaaacat

SEQ ID NO: 4218733 - DNA, 20 bp, Homo sapiens
catgtggtttggttcctctc

SEQ ID NO: 4218734 - DNA, 18 bp, Homo sapiens
catgtttagattccagga

SEQ ID NO: 4218735 - DNA, 18 bp, Homo sapiens
catgtttgagctcagacc

SEQ ID NO: 4218736 - DNA, 20 bp, Homo sapiens
catgtttgagctcagacccc

SEQ ID NO: 4218737 - DNA, 20 bp, Homo sapiens
cattaattattattgctgtt

SEQ ID NO: 4218738 - DNA, 15 bp, Homo sapiens
cattcaaccttacca

SEQ ID NO: 4218739 - DNA, 17 bp, Homo sapiens
cattcaaccttaccaaa

SEQ ID NO: 4218740 - DNA, 13 bp, Homo sapiens
cattccccaggtg

SEQ ID NO: 4218741 - DNA, 17 bp, Homo sapiens
cattccctgagtcacca

SEQ ID NO: 4218742 - DNA, 12 bp, Homo sapiens
cattctctctcc

SEQ ID NO: 4218743 - DNA, 15 bp, Homo sapiens
cattctttcccctca

SEQ ID NO: 4218744 - DNA, 14 bp, Homo sapiens
cattgagatctcca

SEQ ID NO: 4218745 - DNA, 12 bp, Homo sapiens
cattgccctggt

SEQ ID NO: 4218746 - DNA, 21 bp, Homo sapiens
cattgtaaatctgaagaaagt

SEQ ID NO: 4218747 - DNA, 15 bp, Homo sapiens
catttcctgggagaa

SEQ ID NO: 4218748 - DNA, 18 bp, Homo sapiens
catttcctgggagaaaga

SEQ ID NO: 4218749 - DNA, 22 bp, Homo sapiens
catttgagttattttaattatc

SEQ ID NO: 4218750 - DNA, 13 bp, Homo sapiens
catttgcaagctg

SEQ ID NO: 4218751 - DNA, 14 bp, Homo sapiens
catttgtgaagaat

SEQ ID NO: 4218752 - DNA, 15 bp, Homo sapiens
cattttataccaaag

SEQ ID NO: 4218753 - DNA, 14 bp, Homo sapiens
cattttctgttcca

SEQ ID NO: 4218754 - DNA, 15 bp, Homo sapiens
cattttctgttccag

SEQ ID NO: 4218755 - DNA, 21 bp, Homo sapiens
ccaaaagtcaaaaggtgcctg

SEQ ID NO: 4218756 - DNA, 18 bp, Homo sapiens
ccaaaataaaaattgaaa

SEQ ID NO: 4218757 - DNA, 21 bp, Homo sapiens
ccaaagaattcctgaagccag

SEQ ID NO: 4218758 - DNA, 14 bp, Homo sapiens
ccaaattatgtgaa

SEQ ID NO: 4218759 - DNA, 17 bp, Homo sapiens
ccaacagctcagagatg

SEQ ID NO: 4218760 - DNA, 20 bp, Homo sapiens
ccaacatcccattgccctgg

SEQ ID NO: 4218761 - DNA, 20 bp, Homo sapiens
ccaaccgaacatgaccaaaa

SEQ ID NO: 4218762 - DNA, 14 bp, Homo sapiens
ccaacctggacaac

SEQ ID NO: 4218763 - DNA, 18 bp, Homo sapiens
ccaacctggctccctccc

SEQ ID NO: 4218764 - DNA, 15 bp, Homo sapiens
ccaactcctggaagc

SEQ ID NO: 4218765 - DNA, 22 bp, Homo sapiens
ccaactcctggaagctgtgtcc

SEQ ID NO: 4218766 - DNA, 22 bp, Homo sapiens
cacagctgcagcccatcctccc

SEQ ID NO: 4218767 - DNA, 19 bp, Homo sapiens
cacagttcctcgccctggg

SEQ ID NO: 4218768 - DNA, 16 bp, Homo sapiens
cacataggaaactttt

SEQ ID NO: 4218769 - DNA, 23 bp, Homo sapiens
caccaacatcccattgccctggt

SEQ ID NO: 4218770 - DNA, 19 bp, Homo sapiens
caccaagctcacagttcct

SEQ ID NO: 4218771 - DNA, 22 bp, Homo sapiens
caccacctaggccactcctcca

SEQ ID NO: 4218772 - DNA, 14 bp, Homo sapiens
caccaccttcccag

SEQ ID NO: 4218773 - DNA, 16 bp, Homo sapiens
caccaccttcccagct

SEQ ID NO: 4218774 - DNA, 21 bp, Homo sapiens
caccaccttcccagctctccc

SEQ ID NO: 4218775 - DNA, 22 bp, Homo sapiens
caccaccttcccagctctccct

SEQ ID NO: 4218776 - DNA, 18 bp, Homo sapiens
caccacgatgtggccctg

SEQ ID NO: 4218777 - DNA, 14 bp, Homo sapiens
caccactagagctg

SEQ ID NO: 4218778 - DNA, 23 bp, Homo sapiens
caccaggcacgaacccacctgct

SEQ ID NO: 4218779 - DNA, 14 bp, Homo sapiens
cacccaaaagtcaa

SEQ ID NO: 4218780 - DNA, 17 bp, Homo sapiens
cacccaacagctcagag

SEQ ID NO: 4218781 - DNA, 20 bp, Homo sapiens
cacccaaccaactttccccc

SEQ ID NO: 4218782 - DNA, 20 bp, Homo sapiens
cacccaagtggcccccaccc

SEQ ID NO: 4218783 - DNA, 10 bp, Homo sapiens
cacccagccc

SEQ ID NO: 4218784 - DNA, 12 bp, Homo sapiens
cacccagcccat

SEQ ID NO: 4218785 - DNA, 13 bp, Homo sapiens
cacccagcccatt

SEQ ID NO: 4218786 - DNA, 15 bp, Homo sapiens
cacccagcccattct

SEQ ID NO: 4218787 - DNA, 19 bp, Homo sapiens
cacccagcttcaaagctta

SEQ ID NO: 4218788 - DNA, 23 bp, Homo sapiens
cacccaggctctggagccagaga

SEQ ID NO: 4218789 - DNA, 22 bp, Homo sapiens
caccccacccccttcagtgccc

SEQ ID NO: 4218790 - DNA, 14 bp, Homo sapiens
caccccctccccag

SEQ ID NO: 4218791 - DNA, 18 bp, Homo sapiens
caccccctccccagggga

SEQ ID NO: 4218792 - DNA, 17 bp, Homo sapiens
cacccccttcagtgccc

SEQ ID NO: 4218793 - DNA, 23 bp, Homo sapiens
caccccgtctggggttcagcccc

SEQ ID NO: 4218794 - DNA, 20 bp, Homo sapiens
caccctcaaatgtcagagct

SEQ ID NO: 4218795 - DNA, 13 bp, Homo sapiens
cacccttctttcc

SEQ ID NO: 4218796 - DNA, 16 bp, Homo sapiens
cacccttctttcctct

SEQ ID NO: 4218797 - DNA, 19 bp, Homo sapiens
cacccttctttcctcttcc

SEQ ID NO: 4218798 - DNA, 20 bp, Homo sapiens
cacccttctttcctcttccc

SEQ ID NO: 4218799 - DNA, 21 bp, Homo sapiens
caccgagagtagccgagagcc

SEQ ID NO: 4218800 - DNA, 22 bp, Homo sapiens
caccgctgcctaagtggctgct

SEQ ID NO: 4218801 - DNA, 16 bp, Homo sapiens
cacctaggccactcct

SEQ ID NO: 4218802 - DNA, 17 bp, Homo sapiens
cacctaggccactcctc

SEQ ID NO: 4218803 - DNA, 16 bp, Homo sapiens
cacctccccccactgc

SEQ ID NO: 4218804 - DNA, 13 bp, Homo sapiens
cacctcccctatc

SEQ ID NO: 4218805 - DNA, 19 bp, Homo sapiens
cacctcccctatccaccca

SEQ ID NO: 4218806 - DNA, 20 bp, Homo sapiens
cacctgaaattaatttgtga

SEQ ID NO: 4218807 - DNA, 14 bp, Homo sapiens
cacctgcacctccc

SEQ ID NO: 4218808 - DNA, 15 bp, Homo sapiens
cacctgcacctcccc

SEQ ID NO: 4218809 - DNA, 22 bp, Homo sapiens
cacctgcacctccccccactgc

SEQ ID NO: 4218810 - DNA, 21 bp, Homo sapiens
cacctgccgacctcgtcctcc

SEQ ID NO: 4218811 - DNA, 11 bp, Homo sapiens
cacctggcccc

SEQ ID NO: 4218812 - DNA, 16 bp, Homo sapiens
cacctggccccatgtc

SEQ ID NO: 4218813 - DNA, 20 bp, Homo sapiens
cacctggccccatgtctctc

SEQ ID NO: 4218814 - DNA, 13 bp, Homo sapiens
caccttcccagct

SEQ ID NO: 4218815 - DNA, 22 bp, Homo sapiens
caccttcccagctctccctctg

SEQ ID NO: 4218816 - DNA, 16 bp, Homo sapiens
caccttgaacctgtca

SEQ ID NO: 4218817 - DNA, 14 bp, Homo sapiens
cacgaacccacctg

SEQ ID NO: 4218818 - DNA, 18 bp, Homo sapiens
cacgaacccacctgctga

SEQ ID NO: 4218819 - DNA, 14 bp, Homo sapiens
cacgatgtggccct

SEQ ID NO: 4218820 - DNA, 15 bp, Homo sapiens
cacgatgtggccctg

SEQ ID NO: 4218821 - DNA, 21 bp, Homo sapiens
cacgatgtggccctggcctgc

SEQ ID NO: 4218822 - DNA, 20 bp, Homo sapiens
cacgcctgtaatcccagcag

SEQ ID NO: 4218823 - DNA, 13 bp, Homo sapiens
cacgtgccaggcc

SEQ ID NO: 4218824 - DNA, 15 bp, Homo sapiens
cactccaccacccaa

SEQ ID NO: 4218825 - DNA, 14 bp, Homo sapiens
cactcccataagct

SEQ ID NO: 4218826 - DNA, 12 bp, Homo sapiens
cactccttccca

SEQ ID NO: 4218827 - DNA, 14 bp, Homo sapiens
cactgatttggaga

SEQ ID NO: 4218828 - DNA, 21 bp, Homo sapiens
cactgcaacttgtgaactcca

SEQ ID NO: 4218829 - DNA, 16 bp, Homo sapiens
cactgcaagagccttg

SEQ ID NO: 4218830 - DNA, 16 bp, Homo sapiens
cactgcaggccccgct

SEQ ID NO: 4218831 - DNA, 18 bp, Homo sapiens
cacttgcttgaagaccca

SEQ ID NO: 4218832 - DNA, 13 bp, Homo sapiens
cagaaaaattaaa

SEQ ID NO: 4218833 - DNA, 15 bp, Homo sapiens
cagaaaagcacctgc

SEQ ID NO: 4218834 - DNA, 18 bp, Homo sapiens
cagaagaatatgacagct

SEQ ID NO: 4218835 - DNA, 22 bp, Homo sapiens
cagaagaattgaacccaggagg

SEQ ID NO: 4218836 - DNA, 20 bp, Homo sapiens
cagaagacacaggaaacaat

SEQ ID NO: 4218837 - DNA, 18 bp, Homo sapiens
cagaaggagaaggaagga

SEQ ID NO: 4218838 - DNA, 15 bp, Homo sapiens
cagaagtgatttagt

SEQ ID NO: 4218839 - DNA, 19 bp, Homo sapiens
cagaagtttgtcaagtcaa

SEQ ID NO: 4218840 - DNA, 19 bp, Homo sapiens
cagacaaaaacagcctcac

SEQ ID NO: 4218841 - DNA, 21 bp, Homo sapiens
cagacaaaaacagcctcacag

SEQ ID NO: 4218842 - DNA, 22 bp, Homo sapiens
cagacaaaaacagcctcacaga

SEQ ID NO: 4218843 - DNA, 16 bp, Homo sapiens
cagacaagcaacccaa

SEQ ID NO: 4218844 - DNA, 18 bp, Homo sapiens
cagacaagcaacccaaac

SEQ ID NO: 4218845 - DNA, 14 bp, Homo sapiens
cagaccccagcggc

SEQ ID NO: 4218846 - DNA, 16 bp, Homo sapiens
cagaccctaccccacc

SEQ ID NO: 4218847 - DNA, 15 bp, Homo sapiens
cagacttcacactgc

SEQ ID NO: 4218848 - DNA, 13 bp, Homo sapiens
cagagaaaattaa

SEQ ID NO: 4218849 - DNA, 13 bp, Homo sapiens
cagagacaggaaa

SEQ ID NO: 4218850 - DNA, 14 bp, Homo sapiens
cagagacaggaaaa

SEQ ID NO: 4218851 - DNA, 15 bp, Homo sapiens
cagagacaggaaaat

SEQ ID NO: 4218852 - DNA, 23 bp, Homo sapiens
cagagacaggaaaatcctctggc

SEQ ID NO: 4218853 - DNA, 15 bp, Homo sapiens
cagagaggaatcaga

SEQ ID NO: 4218854 - DNA, 15 bp, Homo sapiens
cagagatgcctccac

SEQ ID NO: 4218855 - DNA, 13 bp, Homo sapiens
cagagctcctctg

SEQ ID NO: 4218856 - DNA, 14 bp, Homo sapiens
cagaggctggaggc

SEQ ID NO: 4218857 - DNA, 16 bp, Homo sapiens
cagaggctggaggcag

SEQ ID NO: 4218858 - DNA, 21 bp, Homo sapiens
cagaggctggaggcagggcct

SEQ ID NO: 4218859 - DNA, 15 bp, Homo sapiens
cagaggcttcttcag

SEQ ID NO: 4218860 - DNA, 21 bp, Homo sapiens
cagagggaagtttaaaaccca

SEQ ID NO: 4218861 - DNA, 18 bp, Homo sapiens
cagagggcagaggctgga

SEQ ID NO: 4218862 - DNA, 14 bp, Homo sapiens
cagagtatttctgg

SEQ ID NO: 4218863 - DNA, 20 bp, Homo sapiens
cagagtgtgggaagggagag

SEQ ID NO: 4218864 - DNA, 20 bp, Homo sapiens
cagatccaccctatccctgt

SEQ ID NO: 4218865 - DNA, 14 bp, Homo sapiens
cagatggaccaaaa

SEQ ID NO: 4218866 - DNA, 21 bp, Homo sapiens
cagatggaccaaaagatgggt

SEQ ID NO: 4218867 - DNA, 17 bp, Homo sapiens
cagatttagtgaaagct

SEQ ID NO: 4218868 - DNA, 11 bp, Homo sapiens
cagcagccctc

SEQ ID NO: 4218869 - DNA, 12 bp, Homo sapiens
cagcagccctcc

SEQ ID NO: 4218870 - DNA, 18 bp, Homo sapiens
cagcagccctcctcaccc

SEQ ID NO: 4218871 - DNA, 21 bp, Homo sapiens
cagcatcgtgatcactgagcc

SEQ ID NO: 4218872 - DNA, 18 bp, Homo sapiens
cagcatttgttctttgcc

SEQ ID NO: 4218873 - DNA, 11 bp, Homo sapiens
cagccagccca

SEQ ID NO: 4218874 - DNA, 12 bp, Homo sapiens
cagccagcccag

SEQ ID NO: 4218875 - DNA, 15 bp, Homo sapiens
cagccagcccagccc

SEQ ID NO: 4218876 - DNA, 13 bp, Homo sapiens
cagcccagcccag

SEQ ID NO: 4218877 - DNA, 21 bp, Homo sapiens
cagcccattctctctcctgtc

SEQ ID NO: 4218878 - DNA, 17 bp, Homo sapiens
cagcccctcctctgcca

SEQ ID NO: 4218879 - DNA, 23 bp, Homo sapiens
cagcccctcctctgccacctccc

SEQ ID NO: 4218880 - DNA, 20 bp, Homo sapiens
cagccctatggatgtggggt

SEQ ID NO: 4218881 - DNA, 19 bp, Homo sapiens
cagccctccctgtcctcct

SEQ ID NO: 4218882 - DNA, 22 bp, Homo sapiens
cagccctccctgtcctcctcgg

SEQ ID NO: 4218883 - DNA, 17 bp, Homo sapiens
cagccctgggccccacc

SEQ ID NO: 4218884 - DNA, 18 bp, Homo sapiens
cagccctgggccccacca

SEQ ID NO: 4218885 - DNA, 20 bp, Homo sapiens
cagccctgggccccaccacc

SEQ ID NO: 4218886 - DNA, 23 bp, Homo sapiens
cagccctgggccccaccacctag

SEQ ID NO: 4218887 - DNA, 14 bp, Homo sapiens
cagcctcacagaag

SEQ ID NO: 4218888 - DNA, 18 bp, Homo sapiens
cagcctgtggcggtgcct

SEQ ID NO: 4218889 - DNA, 22 bp, Homo sapiens
cagcctgtggcggtgcctgggt

SEQ ID NO: 4218890 - DNA, 23 bp, Homo sapiens
cagcgcctagtggggtctccctc

SEQ ID NO: 4218891 - DNA, 16 bp, Homo sapiens
cagctactcaggaggc

SEQ ID NO: 4218892 - DNA, 12 bp, Homo sapiens
cagctcccaccc

SEQ ID NO: 4218893 - DNA, 22 bp, Homo sapiens
tgaaccccctcaaaagccaaaa

SEQ ID NO: 4218894 - DNA, 15 bp, Homo sapiens
tgaacctgtcacctg

SEQ ID NO: 4218895 - DNA, 19 bp, Homo sapiens
tgaacctgtcacctggcct

SEQ ID NO: 4218896 - DNA, 13 bp, Homo sapiens
tgaacggggagaa

SEQ ID NO: 4218897 - DNA, 14 bp, Homo sapiens
tgaactccatcatt

SEQ ID NO: 4218898 - DNA, 17 bp, Homo sapiens
tgaactccatcattcat

SEQ ID NO: 4218899 - DNA, 12 bp, Homo sapiens
tgaagaaaacaa

SEQ ID NO: 4218900 - DNA, 13 bp, Homo sapiens
tgaagaaaacaaa

SEQ ID NO: 4218901 - DNA, 16 bp, Homo sapiens
tgaagaattattcagt

SEQ ID NO: 4218902 - DNA, 20 bp, Homo sapiens
tgaagaattattcagtgaat

SEQ ID NO: 4218903 - DNA, 19 bp, Homo sapiens
tgaagccagatccacccta

SEQ ID NO: 4218904 - DNA, 13 bp, Homo sapiens
tgaagtaagcaaa

SEQ ID NO: 4218905 - DNA, 14 bp, Homo sapiens
tgaagtaagcaaag

SEQ ID NO: 4218906 - DNA, 15 bp, Homo sapiens
tgaagtaagcaaaga

SEQ ID NO: 4218907 - DNA, 21 bp, Homo sapiens
tgaatcagaccctaccccacc

SEQ ID NO: 4218908 - DNA, 19 bp, Homo sapiens
tgaatgcaaaagaaattta

SEQ ID NO: 4218909 - DNA, 19 bp, Homo sapiens
tgaatgtattttggttgct

SEQ ID NO: 4218910 - DNA, 20 bp, Homo sapiens
tgaatgtgctgatcatttga

SEQ ID NO: 4218911 - DNA, 17 bp, Homo sapiens
tgaattgtggctgttca

SEQ ID NO: 4218912 - DNA, 18 bp, Homo sapiens
tgaattgtggctgttcac

SEQ ID NO: 4218913 - DNA, 16 bp, Homo sapiens
tgaatttgcaacagta

SEQ ID NO: 4218914 - DNA, 17 bp, Homo sapiens
tgaattttaaatgttca

SEQ ID NO: 4218915 - DNA, 15 bp, Homo sapiens
tgacaaagaaaccca

SEQ ID NO: 4218916 - DNA, 16 bp, Homo sapiens
tgacaacagactgaat

SEQ ID NO: 4218917 - DNA, 12 bp, Homo sapiens
tgacagctgtcc

SEQ ID NO: 4218918 - DNA, 16 bp, Homo sapiens
tgacagctgtccctgt

SEQ ID NO: 4218919 - DNA, 17 bp, Homo sapiens
tgacagctgtccctgtc

SEQ ID NO: 4218920 - DNA, 21 bp, Homo sapiens
tgacagctgtccctgtcacca

SEQ ID NO: 4218921 - DNA, 18 bp, Homo sapiens
tgacatagtggatggaca

SEQ ID NO: 4218922 - DNA, 16 bp, Homo sapiens
tgaccaaaaaccaaaa

SEQ ID NO: 4218923 - DNA, 20 bp, Homo sapiens
tgaccaacatggagaaaccc

SEQ ID NO: 4218924 - DNA, 16 bp, Homo sapiens
tgacccatgttccctt

SEQ ID NO: 4218925 - DNA, 11 bp, Homo sapiens
tgacctcccag

SEQ ID NO: 4218926 - DNA, 12 bp, Homo sapiens
tgacctcccagc

SEQ ID NO: 4218927 - DNA, 15 bp, Homo sapiens
tgacctcccagccct

SEQ ID NO: 4218928 - DNA, 18 bp, Homo sapiens
tgacctctgcaagacaaa

SEQ ID NO: 4218929 - DNA, 12 bp, Homo sapiens
tgactcacccaa

SEQ ID NO: 4218930 - DNA, 15 bp, Homo sapiens
tgactcacccaagca

SEQ ID NO: 4218931 - DNA, 16 bp, Homo sapiens
tgactgccccaactcc

SEQ ID NO: 4218932 - DNA, 17 bp, Homo sapiens
tgactgccccaactcct

SEQ ID NO: 4218933 - DNA, 20 bp, Homo sapiens
tgactgccccaactcctgga

SEQ ID NO: 4218934 - DNA, 12 bp, Homo sapiens
tgagaaatgtga

SEQ ID NO: 4218935 - DNA, 20 bp, Homo sapiens
tgagatgcccccccaggcca

SEQ ID NO: 4218936 - DNA, 15 bp, Homo sapiens
tgagatgttttacca

SEQ ID NO: 4218937 - DNA, 20 bp, Homo sapiens
tgagccgcatcttctccatc

SEQ ID NO: 4218938 - DNA, 20 bp, Homo sapiens
tgagctcagacccccactct

SEQ ID NO: 4218939 - DNA, 19 bp, Homo sapiens
tgagctctatttccccacc

SEQ ID NO: 4218940 - DNA, 19 bp, Homo sapiens
tgagctgagatcgtgccgt

SEQ ID NO: 4218941 - DNA, 15 bp, Homo sapiens
tgaggcaggggcgga

SEQ ID NO: 4218942 - DNA, 16 bp, Homo sapiens
tgagggaacagacagg

SEQ ID NO: 4218943 - DNA, 22 bp, Homo sapiens
tgagggaacagacaggagaaat

SEQ ID NO: 4218944 - DNA, 22 bp, Homo sapiens
tgaggtggaagccctccttcca

SEQ ID NO: 4218945 - DNA, 20 bp, Homo sapiens
tgagtcccccagagatgtca

SEQ ID NO: 4218946 - DNA, 23 bp, Homo sapiens
tgagttgttttcagactcagact

SEQ ID NO: 4218947 - DNA, 18 bp, Homo sapiens
tgagtttttatggggctg

SEQ ID NO: 4218948 - DNA, 19 bp, Homo sapiens
tgagtttttatggggctga

SEQ ID NO: 4218949 - DNA, 20 bp, Homo sapiens
tgatattttgtctcctacct

SEQ ID NO: 4218950 - DNA, 14 bp, Homo sapiens
tgatcactgagcca

SEQ ID NO: 4218951 - DNA, 21 bp, Homo sapiens
tgatcactgagccatcatttc

SEQ ID NO: 4218952 - DNA, 20 bp, Homo sapiens
tgatcagagcattgtgcaat

SEQ ID NO: 4218953 - DNA, 15 bp, Homo sapiens
tgatcataagtctaa

SEQ ID NO: 4218954 - DNA, 21 bp, Homo sapiens
tgatcataagtctaaataaat

SEQ ID NO: 4218955 - DNA, 22 bp, Homo sapiens
tgatcctaatgaatgcataaaa

SEQ ID NO: 4218956 - DNA, 21 bp, Homo sapiens
tgatctgatgcaagcaagaaa

SEQ ID NO: 4218957 - DNA, 18 bp, Homo sapiens
tgatgaaatgtaaatact

SEQ ID NO: 4218958 - DNA, 16 bp, Homo sapiens
tgatggggtgggcagg

SEQ ID NO: 4218959 - DNA, 19 bp, Homo sapiens
tgatggggtgggcagggct

SEQ ID NO: 4218960 - DNA, 22 bp, Homo sapiens
tgatggggtgggcagggctggg

SEQ ID NO: 4218961 - DNA, 15 bp, Homo sapiens
tgatggtgatgaaat

SEQ ID NO: 4218962 - DNA, 17 bp, Homo sapiens
tgatgtttataaactga

SEQ ID NO: 4218963 - DNA, 15 bp, Homo sapiens
tgattccacttttat

SEQ ID NO: 4218964 - DNA, 20 bp, Homo sapiens
tgatttaaaaaataaatata

SEQ ID NO: 4218965 - DNA, 23 bp, Homo sapiens
tgatttttaatttttttaaattt

SEQ ID NO: 4218966 - DNA, 16 bp, Homo sapiens
tgcaacagtaatcaga

SEQ ID NO: 4218967 - DNA, 15 bp, Homo sapiens
tgcaacatctcccct

SEQ ID NO: 4218968 - DNA, 18 bp, Homo sapiens
tgcaacttgtgaactcca

SEQ ID NO: 4218969 - DNA, 15 bp, Homo sapiens
tgcaagtactgctgt

SEQ ID NO: 4218970 - DNA, 19 bp, Homo sapiens
tgcaagtactgctgtaaat

SEQ ID NO: 4218971 - DNA, 17 bp, Homo sapiens
tgcacctccccccactg

SEQ ID NO: 4218972 - DNA, 18 bp, Homo sapiens
tgcacctccccccactgc

SEQ ID NO: 4218973 - DNA, 17 bp, Homo sapiens
tgcagaaaagcacctgc

SEQ ID NO: 4218974 - DNA, 18 bp, Homo sapiens
tgcagaaaagcacctgcc

SEQ ID NO: 4218975 - DNA, 19 bp, Homo sapiens
tgcagaaaagcacctgccg

SEQ ID NO: 4218976 - DNA, 14 bp, Homo sapiens
tgcagccagcccag

SEQ ID NO: 4218977 - DNA, 16 bp, Homo sapiens
tgcagccagcccagcc

SEQ ID NO: 4218978 - DNA, 11 bp, Homo sapiens
tgcataaaatg

SEQ ID NO: 4218979 - DNA, 14 bp, Homo sapiens
tgcatccttcctat

SEQ ID NO: 4218980 - DNA, 16 bp, Homo sapiens
tgcatgctctctgcag

SEQ ID NO: 4218981 - DNA, 17 bp, Homo sapiens
tgcatgctctctgcagc

SEQ ID NO: 4218982 - DNA, 18 bp, Homo sapiens
tgcatgctctctgcagcc

SEQ ID NO: 4218983 - DNA, 21 bp, Homo sapiens
tgcatgtggtttggttcctct

SEQ ID NO: 4218984 - DNA, 14 bp, Homo sapiens
tgcattcaacctta

SEQ ID NO: 4218985 - DNA, 20 bp, Homo sapiens
tgcattcatctctcaaactt

SEQ ID NO: 4218986 - DNA, 21 bp, Homo sapiens
tgcattcatctctcaaactta

SEQ ID NO: 4218987 - DNA, 21 bp, Homo sapiens
tgcatttggcaggaagatgta

SEQ ID NO: 4218988 - DNA, 16 bp, Homo sapiens
tgccaccactagagct

SEQ ID NO: 4218989 - DNA, 20 bp, Homo sapiens
tgccaccactagagctgaga

SEQ ID NO: 4218990 - DNA, 15 bp, Homo sapiens
tgccaccctcctgcg

SEQ ID NO: 4218991 - DNA, 13 bp, Homo sapiens
tgccacctcccct

SEQ ID NO: 4218992 - DNA, 17 bp, Homo sapiens
tgccacctcccctatcc

SEQ ID NO: 4218993 - DNA, 22 bp, Homo sapiens
tgccagctcaggatattatgtt

SEQ ID NO: 4218994 - DNA, 17 bp, Homo sapiens
tgccagtctcattttca

SEQ ID NO: 4218995 - DNA, 11 bp, Homo sapiens
tgccagtgcct

SEQ ID NO: 4218996 - DNA, 13 bp, Homo sapiens
tgccagtgcctta

SEQ ID NO: 4218997 - DNA, 21 bp, Homo sapiens
tgccagtgccttacctcctgc

SEQ ID NO: 4218998 - DNA, 23 bp, Homo sapiens
tgccagtgccttacctcctgccc

SEQ ID NO: 4218999 - DNA, 21 bp, Homo sapiens
tgccatgtttagattccagga

SEQ ID NO: 4219000 - DNA, 12 bp, Homo sapiens
tgcccagagatg

SEQ ID NO: 4219001 - DNA, 17 bp, Homo sapiens
tgcccagagatgcctcc

SEQ ID NO: 4219002 - DNA, 19 bp, Homo sapiens
tgcccagagatgcctccac

SEQ ID NO: 4219003 - DNA, 20 bp, Homo sapiens
tgcccagagatgcctccacc

SEQ ID NO: 4219004 - DNA, 21 bp, Homo sapiens
tgcccagagatgcctccaccg

SEQ ID NO: 4219005 - DNA, 19 bp, Homo sapiens
tgcccaggagagccagccc

SEQ ID NO: 4219006 - DNA, 21 bp, Homo sapiens
tgcccaggagagccagccctc

SEQ ID NO: 4219007 - DNA, 12 bp, Homo sapiens
tgccctgacctc

SEQ ID NO: 4219008 - DNA, 15 bp, Homo sapiens
tgccctgacctccca

SEQ ID NO: 4219009 - DNA, 13 bp, Homo sapiens
tgcccttgccctg

SEQ ID NO: 4219010 - DNA, 17 bp, Homo sapiens
tgcccttgccctgacct

SEQ ID NO: 4219011 - DNA, 19 bp, Homo sapiens
tgcccttgccctgacctcc

SEQ ID NO: 4219012 - DNA, 17 bp, Homo sapiens
tgccgacctcgtcctcc

SEQ ID NO: 4219013 - DNA, 15 bp, Homo sapiens
tgcctagtggcttcc

SEQ ID NO: 4219014 - DNA, 23 bp, Homo sapiens
tgcctcaatgtgaatcagaccct

SEQ ID NO: 4219015 - DNA, 17 bp, Homo sapiens
tgcctccaccgctgcct

SEQ ID NO: 4219016 - DNA, 18 bp, Homo sapiens
tgcctccaccgctgccta

SEQ ID NO: 4219017 - DNA, 22 bp, Homo sapiens
tgcctgcaactttttgccttct

SEQ ID NO: 4219018 - DNA, 23 bp, Homo sapiens
tgcctgctgaatgatttccaaag

SEQ ID NO: 4219019 - DNA, 16 bp, Homo sapiens
tgccttacctcctgcc

SEQ ID NO: 4219020 - DNA, 14 bp, Homo sapiens
tccctgtcaccaag

SEQ ID NO: 4219021 - DNA, 22 bp, Homo sapiens
tccctgtcaccaagctcacagt

SEQ ID NO: 4219022 - DNA, 14 bp, Homo sapiens
tccctgtcctcctc

SEQ ID NO: 4219023 - DNA, 23 bp, Homo sapiens
tcccttcttgcatccttcctata

SEQ ID NO: 4219024 - DNA, 16 bp, Homo sapiens
tcccttgagacctcag

SEQ ID NO: 4219025 - DNA, 18 bp, Homo sapiens
tccctttaaaattaaaaa

SEQ ID NO: 4219026 - DNA, 16 bp, Homo sapiens
tccctttccttcctaa

SEQ ID NO: 4219027 - DNA, 17 bp, Homo sapiens
tccctttccttcctaat

SEQ ID NO: 4219028 - DNA, 22 bp, Homo sapiens
tccgacctctctcctctgaaac

SEQ ID NO: 4219029 - DNA, 15 bp, Homo sapiens
tccgtagttccctga

SEQ ID NO: 4219030 - DNA, 14 bp, Homo sapiens
tcctaatttccctt

SEQ ID NO: 4219031 - DNA, 13 bp, Homo sapiens
tcctataacttga

SEQ ID NO: 4219032 - DNA, 23 bp, Homo sapiens
tcctataccatatgtctgcttct

SEQ ID NO: 4219033 - DNA, 19 bp, Homo sapiens
tcctccagggccacgtgcc

SEQ ID NO: 4219034 - DNA, 20 bp, Homo sapiens
tcctccagggccacgtgcca

SEQ ID NO: 4219035 - DNA, 14 bp, Homo sapiens
tcctccccctgcca

SEQ ID NO: 4219036 - DNA, 15 bp, Homo sapiens
tcctccccctgccag

SEQ ID NO: 4219037 - DNA, 18 bp, Homo sapiens
tcctcgaagtcccggctt

SEQ ID NO: 4219038 - DNA, 13 bp, Homo sapiens
tcctcgccctggg

SEQ ID NO: 4219039 - DNA, 14 bp, Homo sapiens
tcctcgccctgggt

SEQ ID NO: 4219040 - DNA, 19 bp, Homo sapiens
tcctcggatcaccgagagt

SEQ ID NO: 4219041 - DNA, 12 bp, Homo sapiens
tcctctccaggc

SEQ ID NO: 4219042 - DNA, 21 bp, Homo sapiens
tcctctgaaaccctcctccac

SEQ ID NO: 4219043 - DNA, 15 bp, Homo sapiens
tcctctgccacctcc

SEQ ID NO: 4219044 - DNA, 18 bp, Homo sapiens
tcctctgccacctcccct

SEQ ID NO: 4219045 - DNA, 12 bp, Homo sapiens
tcctctgctcca

SEQ ID NO: 4219046 - DNA, 12 bp, Homo sapiens
tcctctgttcta

SEQ ID NO: 4219047 - DNA, 19 bp, Homo sapiens
tcctcttccccttgccctt

SEQ ID NO: 4219048 - DNA, 12 bp, Homo sapiens
tcctgaagccag

SEQ ID NO: 4219049 - DNA, 14 bp, Homo sapiens
tcctgcccaggaga

SEQ ID NO: 4219050 - DNA, 12 bp, Homo sapiens
tcctgcgggctt

SEQ ID NO: 4219051 - DNA, 20 bp, Homo sapiens
tccttaggaaaatgcttctg

SEQ ID NO: 4219052 - DNA, 22 bp, Homo sapiens
tccttaggaaaatgcttctgtt

SEQ ID NO: 4219053 - DNA, 14 bp, Homo sapiens
tccttccatttctt

SEQ ID NO: 4219054 - DNA, 15 bp, Homo sapiens
tccttccatttcttc

SEQ ID NO: 4219055 - DNA, 16 bp, Homo sapiens
tccttccatttcttct

SEQ ID NO: 4219056 - DNA, 12 bp, Homo sapiens
tccttccctggc

SEQ ID NO: 4219057 - DNA, 14 bp, Homo sapiens
tccttccctggctt

SEQ ID NO: 4219058 - DNA, 16 bp, Homo sapiens
tccttgtgctcctgcc

SEQ ID NO: 4219059 - DNA, 20 bp, Homo sapiens
tccttgtgctcctgccagct

SEQ ID NO: 4219060 - DNA, 15 bp, Homo sapiens
tccttgtggcagagg

SEQ ID NO: 4219061 - DNA, 16 bp, Homo sapiens
tcctttactgaatgta

SEQ ID NO: 4219062 - DNA, 23 bp, Homo sapiens
tcgaggtaggtggatcacctgag

SEQ ID NO: 4219063 - DNA, 13 bp, Homo sapiens
tcgccccagactc

SEQ ID NO: 4219064 - DNA, 15 bp, Homo sapiens
tcgctctgctggcct

SEQ ID NO: 4219065 - DNA, 23 bp, Homo sapiens
tcgctctgctggcctggccggca

SEQ ID NO: 4219066 - DNA, 16 bp, Homo sapiens
tcggcccacagctccc

SEQ ID NO: 4219067 - DNA, 15 bp, Homo sapiens
tcggggaactcctgg

SEQ ID NO: 4219068 - DNA, 13 bp, Homo sapiens
tcgtcctccccct

SEQ ID NO: 4219069 - DNA, 14 bp, Homo sapiens
tcgtcctccccctg

SEQ ID NO: 4219070 - DNA, 17 bp, Homo sapiens
tcgtttgaatcacagta

SEQ ID NO: 4219071 - DNA, 15 bp, Homo sapiens
tctaaattaaaaaag

SEQ ID NO: 4219072 - DNA, 13 bp, Homo sapiens
tctacagagaaaa

SEQ ID NO: 4219073 - DNA, 22 bp, Homo sapiens
tctactttagaatgagagtgtg

SEQ ID NO: 4219074 - DNA, 23 bp, Homo sapiens
tctagcagtaaaagataaatttg

SEQ ID NO: 4219075 - DNA, 16 bp, Homo sapiens
tctaggagctgggagg

SEQ ID NO: 4219076 - DNA, 18 bp, Homo sapiens
tctaggagctgggaggaa

SEQ ID NO: 4219077 - DNA, 13 bp, Homo sapiens
tctcactccacca

SEQ ID NO: 4219078 - DNA, 14 bp, Homo sapiens
tctcactccaccac

SEQ ID NO: 4219079 - DNA, 17 bp, Homo sapiens
tctcactccaccaccca

SEQ ID NO: 4219080 - DNA, 14 bp, Homo sapiens
tctcactggcatct

SEQ ID NO: 4219081 - DNA, 16 bp, Homo sapiens
tctcactggcatcttg

SEQ ID NO: 4219082 - DNA, 12 bp, Homo sapiens
tctcattaaaat

SEQ ID NO: 4219083 - DNA, 12 bp, Homo sapiens
tctccacctcag

SEQ ID NO: 4219084 - DNA, 15 bp, Homo sapiens
tctccacctcagcct

SEQ ID NO: 4219085 - DNA, 19 bp, Homo sapiens
tctccacctcagccttgga

SEQ ID NO: 4219086 - DNA, 14 bp, Homo sapiens
tctccctctcctgc

SEQ ID NO: 4219087 - DNA, 12 bp, Homo sapiens
tctccctgccgc

SEQ ID NO: 4219088 - DNA, 18 bp, Homo sapiens
tctcctcagagtcccggc

SEQ ID NO: 4219089 - DNA, 17 bp, Homo sapiens
tctcctgcctactcacg

SEQ ID NO: 4219090 - DNA, 16 bp, Homo sapiens
tctcctgtccaaccta

SEQ ID NO: 4219091 - DNA, 17 bp, Homo sapiens
tctctaagccacagctt

SEQ ID NO: 4219092 - DNA, 14 bp, Homo sapiens
tctctcctgtccaa

SEQ ID NO: 4219093 - DNA, 17 bp, Homo sapiens
tctctgcagccagccca

SEQ ID NO: 4219094 - DNA, 18 bp, Homo sapiens
tctctgtgcccctgtaaa

SEQ ID NO: 4219095 - DNA, 11 bp, Homo sapiens
tctctttgcca

SEQ ID NO: 4219096 - DNA, 14 bp, Homo sapiens
tctgaaagacagaa

SEQ ID NO: 4219097 - DNA, 16 bp, Homo sapiens
tctgatgcaagcaaga

SEQ ID NO: 4219098 - DNA, 21 bp, Homo sapiens
tctgatgcaagcaagaaacac

SEQ ID NO: 4219099 - DNA, 23 bp, Homo sapiens
tctgatgcaagcaagaaacactg

SEQ ID NO: 4219100 - DNA, 11 bp, Homo sapiens
tctgattccac

SEQ ID NO: 4219101 - DNA, 17 bp, Homo sapiens
tctgcacatctacttgc

SEQ ID NO: 4219102 - DNA, 16 bp, Homo sapiens
tctgcacttctgttcc

SEQ ID NO: 4219103 - DNA, 15 bp, Homo sapiens
tctgcagccagccca

SEQ ID NO: 4219104 - DNA, 16 bp, Homo sapiens
tctgcagccagcccag

SEQ ID NO: 4219105 - DNA, 19 bp, Homo sapiens
tctgcagccagcccagccc

SEQ ID NO: 4219106 - DNA, 15 bp, Homo sapiens
tctgccacctcccct

SEQ ID NO: 4219107 - DNA, 16 bp, Homo sapiens
tctgcctcaatgtgaa

SEQ ID NO: 4219108 - DNA, 21 bp, Homo sapiens
tctgcctcaatgtgaatcaga

SEQ ID NO: 4219109 - DNA, 14 bp, Homo sapiens
tctgctcctctcca

SEQ ID NO: 4219110 - DNA, 15 bp, Homo sapiens
tctgctggcctggcc

SEQ ID NO: 4219111 - DNA, 23 bp, Homo sapiens
tctgcttaggtgccaggcatgtc

SEQ ID NO: 4219112 - DNA, 19 bp, Homo sapiens
tctgcttctgtccaggaca

SEQ ID NO: 4219113 - DNA, 16 bp, Homo sapiens
tctggagaagcagtga

SEQ ID NO: 4219114 - DNA, 22 bp, Homo sapiens
tctggagaagcagtgagccgca

SEQ ID NO: 4219115 - DNA, 13 bp, Homo sapiens
tctggagccagag

SEQ ID NO: 4219116 - DNA, 20 bp, Homo sapiens
tctggcagggtgggatggag

SEQ ID NO: 4219117 - DNA, 17 bp, Homo sapiens
tctggcattttctgttc

SEQ ID NO: 4219118 - DNA, 18 bp, Homo sapiens
tctggcattttctgttcc

SEQ ID NO: 4219119 - DNA, 15 bp, Homo sapiens
tctggccctgccttc

SEQ ID NO: 4219120 - DNA, 16 bp, Homo sapiens
tctggccctgccttct

SEQ ID NO: 4219121 - DNA, 22 bp, Homo sapiens
tctggggttcagcccctcctct

SEQ ID NO: 4219122 - DNA, 20 bp, Homo sapiens
tctgtccgtttactccaagg

SEQ ID NO: 4219123 - DNA, 23 bp, Homo sapiens
tctgttccaggtttttctggcat

SEQ ID NO: 4219124 - DNA, 13 bp, Homo sapiens
tcttaaatgacag

SEQ ID NO: 4219125 - DNA, 16 bp, Homo sapiens
tcttcaggtggaaaaa

SEQ ID NO: 4219126 - DNA, 23 bp, Homo sapiens
tcttccccttgcccttgccctga

SEQ ID NO: 4219127 - DNA, 14 bp, Homo sapiens
tcttctccatctgg

SEQ ID NO: 4219128 - DNA, 19 bp, Homo sapiens
tcttcttttttaactgaaa

SEQ ID NO: 4219129 - DNA, 18 bp, Homo sapiens
tcttgcatccttcctata

SEQ ID NO: 4219130 - DNA, 22 bp, Homo sapiens
tcttgcatccttcctataactt

SEQ ID NO: 4219131 - DNA, 17 bp, Homo sapiens
tcttggggtcccaggga

SEQ ID NO: 4219132 - DNA, 11 bp, Homo sapiens
tctttgaccaa

SEQ ID NO: 4219133 - DNA, 18 bp, Homo sapiens
tctttgccagtctcattt

SEQ ID NO: 4219134 - DNA, 15 bp, Homo sapiens
tctttgccatttctt

SEQ ID NO: 4219135 - DNA, 23 bp, Homo sapiens
tctttgtaatgtcaccaccttcc

SEQ ID NO: 4219136 - DNA, 15 bp, Homo sapiens
tgaaaaataaaaacc

SEQ ID NO: 4219137 - DNA, 14 bp, Homo sapiens
tgaaaacccagaga

SEQ ID NO: 4219138 - DNA, 23 bp, Homo sapiens
tgaaaacccagagaggaatcaga

SEQ ID NO: 4219139 - DNA, 15 bp, Homo sapiens
tgaaagacagaatgt

SEQ ID NO: 4219140 - DNA, 20 bp, Homo sapiens
tgaaagctgaatccttccat

SEQ ID NO: 4219141 - DNA, 14 bp, Homo sapiens
tgaaatattaaaat

SEQ ID NO: 4219142 - DNA, 17 bp, Homo sapiens
tgaaatattaaaatcac

SEQ ID NO: 4219143 - DNA, 23 bp, Homo sapiens
tgaaatgcttatgcttgtgtata

SEQ ID NO: 4219144 - DNA, 16 bp, Homo sapiens
tgaaattaatttgtga

SEQ ID NO: 4219145 - DNA, 17 bp, Homo sapiens
tgaaattaatttgtgaa

SEQ ID NO: 4219146 - DNA, 20 bp, Homo sapiens
tgaacaaagaaaaaaatata

SEQ ID NO: 4219147 - DNA, 14 bp, Homo sapiens
tgaacccaggaggt

SEQ ID NO: 4219148 - DNA, 20 bp, Homo sapiens
tcaatcccctcattcaggaa

SEQ ID NO: 4219149 - DNA, 15 bp, Homo sapiens
tcaatctaaattaaa

SEQ ID NO: 4219150 - DNA, 16 bp, Homo sapiens
tcaattcacattcatc

SEQ ID NO: 4219151 - DNA, 18 bp, Homo sapiens
tcaattccacccctcctc

SEQ ID NO: 4219152 - DNA, 19 bp, Homo sapiens
tcaattccacccctcctcg

SEQ ID NO: 4219153 - DNA, 19 bp, Homo sapiens
tcacaccatcttaaatgac

SEQ ID NO: 4219154 - DNA, 18 bp, Homo sapiens
tcacactgcaagagcctt

SEQ ID NO: 4219155 - DNA, 12 bp, Homo sapiens
tcacagaggctt

SEQ ID NO: 4219156 - DNA, 23 bp, Homo sapiens
tcacagatgtgtgattcacagtg

SEQ ID NO: 4219157 - DNA, 21 bp, Homo sapiens
tcacaggttggaagagaatca

SEQ ID NO: 4219158 - DNA, 17 bp, Homo sapiens
tcacagtaatgcaagca

SEQ ID NO: 4219159 - DNA, 13 bp, Homo sapiens
tcacagttcctcg

SEQ ID NO: 4219160 - DNA, 20 bp, Homo sapiens
tcacatggactttggaaaat

SEQ ID NO: 4219161 - DNA, 16 bp, Homo sapiens
tcaccaccttcccagc

SEQ ID NO: 4219162 - DNA, 11 bp, Homo sapiens
tcacccacagg

SEQ ID NO: 4219163 - DNA, 12 bp, Homo sapiens
tcacccaggctc

SEQ ID NO: 4219164 - DNA, 13 bp, Homo sapiens
tcacctctgcctc

SEQ ID NO: 4219165 - DNA, 17 bp, Homo sapiens
tcacctgaggtcgggag

SEQ ID NO: 4219166 - DNA, 13 bp, Homo sapiens
tcacctggcctgc

SEQ ID NO: 4219167 - DNA, 19 bp, Homo sapiens
tcacgcctgtaatcccagc

SEQ ID NO: 4219168 - DNA, 20 bp, Homo sapiens
tcacgcctgtaatcccagca

SEQ ID NO: 4219169 - DNA, 21 bp, Homo sapiens
tcacgcctgtaatcccagcag

SEQ ID NO: 4219170 - DNA, 15 bp, Homo sapiens
tcactccaccaccca

SEQ ID NO: 4219171 - DNA, 18 bp, Homo sapiens
tcactcccataagctaag

SEQ ID NO: 4219172 - DNA, 18 bp, Homo sapiens
tcactgagccatcatttc

SEQ ID NO: 4219173 - DNA, 20 bp, Homo sapiens
tcactgagccatcatttcct

SEQ ID NO: 4219174 - DNA, 17 bp, Homo sapiens
tcactggagcaccaggc

SEQ ID NO: 4219175 - DNA, 14 bp, Homo sapiens
tcagaaagagcaag

SEQ ID NO: 4219176 - DNA, 23 bp, Homo sapiens
tcagaaagagcaagtctggatct

SEQ ID NO: 4219177 - DNA, 12 bp, Homo sapiens
tcagaagtgatt

SEQ ID NO: 4219178 - DNA, 18 bp, Homo sapiens
tcagacccccactctcat

SEQ ID NO: 4219179 - DNA, 16 bp, Homo sapiens
tcagaccctaccccac

SEQ ID NO: 4219180 - DNA, 15 bp, Homo sapiens
tcagagatgaaacta

SEQ ID NO: 4219181 - DNA, 14 bp, Homo sapiens
tcagagctcctctg

SEQ ID NO: 4219182 - DNA, 23 bp, Homo sapiens
tcagagttaccattatttaattt

SEQ ID NO: 4219183 - DNA, 19 bp, Homo sapiens
tcagatacagggtgctcct

SEQ ID NO: 4219184 - DNA, 15 bp, Homo sapiens
tcagcagccctcctc

SEQ ID NO: 4219185 - DNA, 16 bp, Homo sapiens
tcagcagccctcctca

SEQ ID NO: 4219186 - DNA, 17 bp, Homo sapiens
tcagcagccctcctcac

SEQ ID NO: 4219187 - DNA, 20 bp, Homo sapiens
tcagcatttgttctttgcca

SEQ ID NO: 4219188 - DNA, 23 bp, Homo sapiens
tcagccatgaggagttgctgttt

SEQ ID NO: 4219189 - DNA, 14 bp, Homo sapiens
tcagcccctcctct

SEQ ID NO: 4219190 - DNA, 17 bp, Homo sapiens
tcagcccctcctctgcc

SEQ ID NO: 4219191 - DNA, 20 bp, Homo sapiens
tcagcccctcctctgccacc

SEQ ID NO: 4219192 - DNA, 21 bp, Homo sapiens
tcagccctgggccccaccacc

SEQ ID NO: 4219193 - DNA, 18 bp, Homo sapiens
tcagctgttaaccatttg

SEQ ID NO: 4219194 - DNA, 20 bp, Homo sapiens
tcaggaaaactgacagagga

SEQ ID NO: 4219195 - DNA, 20 bp, Homo sapiens
tcaggaggctgaggcagaag

SEQ ID NO: 4219196 - DNA, 14 bp, Homo sapiens
tcagggctggggcc

SEQ ID NO: 4219197 - DNA, 17 bp, Homo sapiens
tcagggctggggccaag

SEQ ID NO: 4219198 - DNA, 18 bp, Homo sapiens
tcagtgaatttgtccatt

SEQ ID NO: 4219199 - DNA, 15 bp, Homo sapiens
tcagtgcttcgcaga

SEQ ID NO: 4219200 - DNA, 13 bp, Homo sapiens
tcagtgggagaaa

SEQ ID NO: 4219201 - DNA, 15 bp, Homo sapiens
tcagttactcagccc

SEQ ID NO: 4219202 - DNA, 16 bp, Homo sapiens
tcagttactcagccct

SEQ ID NO: 4219203 - DNA, 17 bp, Homo sapiens
tcagttactcagccctg

SEQ ID NO: 4219204 - DNA, 18 bp, Homo sapiens
tcagttactcagccctgg

SEQ ID NO: 4219205 - DNA, 17 bp, Homo sapiens
tcatcagagctcctctg

SEQ ID NO: 4219206 - DNA, 14 bp, Homo sapiens
tcatgatctccctg

SEQ ID NO: 4219207 - DNA, 17 bp, Homo sapiens
tcatgatctccctgccg

SEQ ID NO: 4219208 - DNA, 19 bp, Homo sapiens
tcatgatctccctgccgcc

SEQ ID NO: 4219209 - DNA, 22 bp, Homo sapiens
tcatgatctccctgccgcctca

SEQ ID NO: 4219210 - DNA, 16 bp, Homo sapiens
tcattaaaatccagta

SEQ ID NO: 4219211 - DNA, 16 bp, Homo sapiens
tcatttgcaagctgag

SEQ ID NO: 4219212 - DNA, 19 bp, Homo sapiens
tccaaactaccttccagtt

SEQ ID NO: 4219213 - DNA, 13 bp, Homo sapiens
tccaaagagaaaa

SEQ ID NO: 4219214 - DNA, 23 bp, Homo sapiens
tccaaaggaagtctaggagctgg

SEQ ID NO: 4219215 - DNA, 21 bp, Homo sapiens
tccaaatttaaccataaatca

SEQ ID NO: 4219216 - DNA, 17 bp, Homo sapiens
tccaacctggacaacaa

SEQ ID NO: 4219217 - DNA, 20 bp, Homo sapiens
tccaagaggctccctcctgt

SEQ ID NO: 4219218 - DNA, 18 bp, Homo sapiens
tccaaggtttataaagca

SEQ ID NO: 4219219 - DNA, 15 bp, Homo sapiens
tccaagtgccaatat

SEQ ID NO: 4219220 - DNA, 17 bp, Homo sapiens
tccacaagattcccaga

SEQ ID NO: 4219221 - DNA, 18 bp, Homo sapiens
tccacaagattcccagag

SEQ ID NO: 4219222 - DNA, 19 bp, Homo sapiens
tccacaagattcccagaga

SEQ ID NO: 4219223 - DNA, 23 bp, Homo sapiens
tccacaagattcccagagacagg

SEQ ID NO: 4219224 - DNA, 12 bp, Homo sapiens
tccacccagccc

SEQ ID NO: 4219225 - DNA, 14 bp, Homo sapiens
tccaccctatccct

SEQ ID NO: 4219226 - DNA, 23 bp, Homo sapiens
tccaccctcaaatgtcagagcta

SEQ ID NO: 4219227 - DNA, 15 bp, Homo sapiens
tccaccgctgcctaa

SEQ ID NO: 4219228 - DNA, 19 bp, Homo sapiens
tccaccgctgcctaagtgg

SEQ ID NO: 4219229 - DNA, 17 bp, Homo sapiens
tccacctggccccatgt

SEQ ID NO: 4219230 - DNA, 22 bp, Homo sapiens
tccacggtcagatttgctgttc

SEQ ID NO: 4219231 - DNA, 20 bp, Homo sapiens
tccagagtgtgcagactgat

SEQ ID NO: 4219232 - DNA, 15 bp, Homo sapiens
tccagcccagcccgc

SEQ ID NO: 4219233 - DNA, 15 bp, Homo sapiens
tccagcttgctcttc

SEQ ID NO: 4219234 - DNA, 19 bp, Homo sapiens
tccagcttgctcttcagtg

SEQ ID NO: 4219235 - DNA, 18 bp, Homo sapiens
tccaggatttataaagca

SEQ ID NO: 4219236 - DNA, 20 bp, Homo sapiens
tccaggatttataaagcaaa

SEQ ID NO: 4219237 - DNA, 23 bp, Homo sapiens
tccagggccacgtgccaggcccg

SEQ ID NO: 4219238 - DNA, 14 bp, Homo sapiens
tccatgtagcagga

SEQ ID NO: 4219239 - DNA, 15 bp, Homo sapiens
tccatgtagcaggac

SEQ ID NO: 4219240 - DNA, 17 bp, Homo sapiens
tccatgtagcaggactg

SEQ ID NO: 4219241 - DNA, 15 bp, Homo sapiens
tccattcctcaggga

SEQ ID NO: 4219242 - DNA, 17 bp, Homo sapiens
tccattgtaaatctgaa

SEQ ID NO: 4219243 - DNA, 21 bp, Homo sapiens
tccattgtaaatctgaagaaa

SEQ ID NO: 4219244 - DNA, 23 bp, Homo sapiens
tcccacccaacagctcagagatg

SEQ ID NO: 4219245 - DNA, 12 bp, Homo sapiens
tcccaccccacc

SEQ ID NO: 4219246 - DNA, 13 bp, Homo sapiens
tcccaccccaccc

SEQ ID NO: 4219247 - DNA, 22 bp, Homo sapiens
tcccaccccacccccttcagtg

SEQ ID NO: 4219248 - DNA, 17 bp, Homo sapiens
tcccagccctatggatg

SEQ ID NO: 4219249 - DNA, 14 bp, Homo sapiens
tcccagctctccct

SEQ ID NO: 4219250 - DNA, 22 bp, Homo sapiens
tcccagctctccctctggccct

SEQ ID NO: 4219251 - DNA, 12 bp, Homo sapiens
tcccataagcta

SEQ ID NO: 4219252 - DNA, 14 bp, Homo sapiens
tcccataagctaag

SEQ ID NO: 4219253 - DNA, 22 bp, Homo sapiens
tcccataagctaagccttatgt

SEQ ID NO: 4219254 - DNA, 13 bp, Homo sapiens
tcccattgccctg

SEQ ID NO: 4219255 - DNA, 13 bp, Homo sapiens
tccccaccccact

SEQ ID NO: 4219256 - DNA, 22 bp, Homo sapiens
tccccagaagacacaggaaaca

SEQ ID NO: 4219257 - DNA, 23 bp, Homo sapiens
tccccagaagacacaggaaacaa

SEQ ID NO: 4219258 - DNA, 18 bp, Homo sapiens
tccccaggtggctgaccc

SEQ ID NO: 4219259 - DNA, 19 bp, Homo sapiens
tccccaggtggctgaccca

SEQ ID NO: 4219260 - DNA, 17 bp, Homo sapiens
tccccatcatcccagct

SEQ ID NO: 4219261 - DNA, 18 bp, Homo sapiens
tcccccaccccctcccca

SEQ ID NO: 4219262 - DNA, 18 bp, Homo sapiens
tccccctgccagtgcctt

SEQ ID NO: 4219263 - DNA, 15 bp, Homo sapiens
tcccctatccaccca

SEQ ID NO: 4219264 - DNA, 14 bp, Homo sapiens
tcccctcagagctc

SEQ ID NO: 4219265 - DNA, 20 bp, Homo sapiens
tcccctcagagctcttatgt

SEQ ID NO: 4219266 - DNA, 13 bp, Homo sapiens
tcccgagtacagt

SEQ ID NO: 4219267 - DNA, 18 bp, Homo sapiens
tccctctaataaagctcc

SEQ ID NO: 4219268 - DNA, 14 bp, Homo sapiens
tccctctcctgcct

SEQ ID NO: 4219269 - DNA, 20 bp, Homo sapiens
tccctctggccctgccttct

SEQ ID NO: 4219270 - DNA, 17 bp, Homo sapiens
tccctgaaaacccagag

SEQ ID NO: 4219271 - DNA, 20 bp, Homo sapiens
tccctgaaaacccagagagg

SEQ ID NO: 4219272 - DNA, 21 bp, Homo sapiens
tccctgagtcaccaggaatgt

SEQ ID NO: 4219273 - DNA, 18 bp, Homo sapiens
tccctgggggaagccctg

SEQ ID NO: 4219274 - DNA, 21 bp, Homo sapiens
tccctgggggaagccctggat

SEQ ID NO: 4219275 - DNA, 15 bp, Homo sapiens
taaatatgaacaaag

SEQ ID NO: 4219276 - DNA, 13 bp, Homo sapiens
taaatatgtgaag

SEQ ID NO: 4219277 - DNA, 14 bp, Homo sapiens
taaatatgtgaaga

SEQ ID NO: 4219278 - DNA, 15 bp, Homo sapiens
taaatatgtgaagaa

SEQ ID NO: 4219279 - DNA, 11 bp, Homo sapiens
taaatttgttg

SEQ ID NO: 4219280 - DNA, 16 bp, Homo sapiens
taacaactatgatttg

SEQ ID NO: 4219281 - DNA, 21 bp, Homo sapiens
taacaactatgatttggaaaa

SEQ ID NO: 4219282 - DNA, 12 bp, Homo sapiens
taacccctttcc

SEQ ID NO: 4219283 - DNA, 18 bp, Homo sapiens
taacctctctaagccaca

SEQ ID NO: 4219284 - DNA, 16 bp, Homo sapiens
taactatgttgataaa

SEQ ID NO: 4219285 - DNA, 21 bp, Homo sapiens
taactgaaagctgaatccttc

SEQ ID NO: 4219286 - DNA, 14 bp, Homo sapiens
taactgaaggagaa

SEQ ID NO: 4219287 - DNA, 15 bp, Homo sapiens
taactgaaggagaag

SEQ ID NO: 4219288 - DNA, 15 bp, Homo sapiens
taacttgatgcatgt

SEQ ID NO: 4219289 - DNA, 23 bp, Homo sapiens
taagaaaaccaaaataaaaattg

SEQ ID NO: 4219290 - DNA, 18 bp, Homo sapiens
taagagctagcgctgccg

SEQ ID NO: 4219291 - DNA, 13 bp, Homo sapiens
taaggtccctgct

SEQ ID NO: 4219292 - DNA, 13 bp, Homo sapiens
taagtggctgctg

SEQ ID NO: 4219293 - DNA, 18 bp, Homo sapiens
taatagagagattagtaa

SEQ ID NO: 4219294 - DNA, 15 bp, Homo sapiens
taatgaatgcataaa

SEQ ID NO: 4219295 - DNA, 23 bp, Homo sapiens
taatgcaagcaaagtatcaaaga

SEQ ID NO: 4219296 - DNA, 15 bp, Homo sapiens
taatgcgaatagtgc

SEQ ID NO: 4219297 - DNA, 15 bp, Homo sapiens
taatgtcaccacctt

SEQ ID NO: 4219298 - DNA, 16 bp, Homo sapiens
taatgtctcttcctct

SEQ ID NO: 4219299 - DNA, 11 bp, Homo sapiens
taatgttgaat

SEQ ID NO: 4219300 - DNA, 10 bp, Homo sapiens
taattaaaag

SEQ ID NO: 4219301 - DNA, 15 bp, Homo sapiens
taattagaaatcaac

SEQ ID NO: 4219302 - DNA, 14 bp, Homo sapiens
taattatatttcta

SEQ ID NO: 4219303 - DNA, 23 bp, Homo sapiens
taattatatttctacagagaaaa

SEQ ID NO: 4219304 - DNA, 21 bp, Homo sapiens
taattcttagtggaagacaat

SEQ ID NO: 4219305 - DNA, 12 bp, Homo sapiens
taattgggattt

SEQ ID NO: 4219306 - DNA, 18 bp, Homo sapiens
taatttgtgaatttgcaa

SEQ ID NO: 4219307 - DNA, 23 bp, Homo sapiens
taatttttattatgaaactttcc

SEQ ID NO: 4219308 - DNA, 19 bp, Homo sapiens
tacaaaggtgctaattaat

SEQ ID NO: 4219309 - DNA, 20 bp, Homo sapiens
tacaaaggtgctaattaata

SEQ ID NO: 4219310 - DNA, 16 bp, Homo sapiens
tacaaatgtgataata

SEQ ID NO: 4219311 - DNA, 18 bp, Homo sapiens
tacaagggtctagggaga

SEQ ID NO: 4219312 - DNA, 19 bp, Homo sapiens
tacaccatgtttgagctca

SEQ ID NO: 4219313 - DNA, 19 bp, Homo sapiens
tacagagaaaatgaatttg

SEQ ID NO: 4219314 - DNA, 15 bp, Homo sapiens
tacaggcatagagtt

SEQ ID NO: 4219315 - DNA, 16 bp, Homo sapiens
tacagtagtatctgct

SEQ ID NO: 4219316 - DNA, 15 bp, Homo sapiens
tacagtggagaaata

SEQ ID NO: 4219317 - DNA, 16 bp, Homo sapiens
tacagtggagaaatat

SEQ ID NO: 4219318 - DNA, 12 bp, Homo sapiens
tacatgctgcta

SEQ ID NO: 4219319 - DNA, 15 bp, Homo sapiens
taccattatttaatt

SEQ ID NO: 4219320 - DNA, 20 bp, Homo sapiens
tacctagcacacaataagca

SEQ ID NO: 4219321 - DNA, 14 bp, Homo sapiens
tacgttaccaggca

SEQ ID NO: 4219322 - DNA, 20 bp, Homo sapiens
tactatcatgtcaaacgtga

SEQ ID NO: 4219323 - DNA, 17 bp, Homo sapiens
tactcagcagccctcct

SEQ ID NO: 4219324 - DNA, 12 bp, Homo sapiens
tactcaggaggc

SEQ ID NO: 4219325 - DNA, 19 bp, Homo sapiens
tactccaaggtttataaag

SEQ ID NO: 4219326 - DNA, 15 bp, Homo sapiens
tactccctttaaaga

SEQ ID NO: 4219327 - DNA, 18 bp, Homo sapiens
tactctccaacctggaca

SEQ ID NO: 4219328 - DNA, 19 bp, Homo sapiens
tagaagtggaccaggacag

SEQ ID NO: 4219329 - DNA, 20 bp, Homo sapiens
tagaagtggaccaggacagg

SEQ ID NO: 4219330 - DNA, 19 bp, Homo sapiens
tagacatttgtaaatgtaa

SEQ ID NO: 4219331 - DNA, 19 bp, Homo sapiens
tagagtcaatttgctgaaa

SEQ ID NO: 4219332 - DNA, 13 bp, Homo sapiens
tagattatttctg

SEQ ID NO: 4219333 - DNA, 22 bp, Homo sapiens
tagcaggactgaattgtcccca

SEQ ID NO: 4219334 - DNA, 20 bp, Homo sapiens
tagctagaagtgggccagga

SEQ ID NO: 4219335 - DNA, 18 bp, Homo sapiens
tagctgtggtgaggtggg

SEQ ID NO: 4219336 - DNA, 19 bp, Homo sapiens
taggaatattttcttctgc

SEQ ID NO: 4219337 - DNA, 14 bp, Homo sapiens
taggagctgggagg

SEQ ID NO: 4219338 - DNA, 13 bp, Homo sapiens
taggccactcctc

SEQ ID NO: 4219339 - DNA, 18 bp, Homo sapiens
tagggtaaggtgccttct

SEQ ID NO: 4219340 - DNA, 20 bp, Homo sapiens
taggtgccaggcatgtccta

SEQ ID NO: 4219341 - DNA, 21 bp, Homo sapiens
tagtaggggttgaagaaaaca

SEQ ID NO: 4219342 - DNA, 23 bp, Homo sapiens
tagtccatggacaatataaactg

SEQ ID NO: 4219343 - DNA, 21 bp, Homo sapiens
tagtggatggacagatggacc

SEQ ID NO: 4219344 - DNA, 23 bp, Homo sapiens
tagtggatggacagatggaccaa

SEQ ID NO: 4219345 - DNA, 21 bp, Homo sapiens
tagtggggtctccctctcctg

SEQ ID NO: 4219346 - DNA, 16 bp, Homo sapiens
tagttttaaatatgaa

SEQ ID NO: 4219347 - DNA, 18 bp, Homo sapiens
tagttttaaatatgaaca

SEQ ID NO: 4219348 - DNA, 16 bp, Homo sapiens
tagttttactttgaac

SEQ ID NO: 4219349 - DNA, 13 bp, Homo sapiens
tataccatatgtc

SEQ ID NO: 4219350 - DNA, 16 bp, Homo sapiens
tatagaattgcacata

SEQ ID NO: 4219351 - DNA, 20 bp, Homo sapiens
tatagtaggggttgaagaaa

SEQ ID NO: 4219352 - DNA, 15 bp, Homo sapiens
tatatatttttctga

SEQ ID NO: 4219353 - DNA, 13 bp, Homo sapiens
tatatcatcttta

SEQ ID NO: 4219354 - DNA, 16 bp, Homo sapiens
tatatttctacagaga

SEQ ID NO: 4219355 - DNA, 23 bp, Homo sapiens
tatatttctacagagaaaatgaa

SEQ ID NO: 4219356 - DNA, 16 bp, Homo sapiens
tatcaaagaaaaacaa

SEQ ID NO: 4219357 - DNA, 15 bp, Homo sapiens
tatcagttactcagc

SEQ ID NO: 4219358 - DNA, 18 bp, Homo sapiens
tatcagttactcagccct

SEQ ID NO: 4219359 - DNA, 19 bp, Homo sapiens
tatcagttactcagccctg

SEQ ID NO: 4219360 - DNA, 16 bp, Homo sapiens
tatcatgtcaaacgtg

SEQ ID NO: 4219361 - DNA, 14 bp, Homo sapiens
tatcatttgtgaag

SEQ ID NO: 4219362 - DNA, 15 bp, Homo sapiens
tatcatttgtgaaga

SEQ ID NO: 4219363 - DNA, 12 bp, Homo sapiens
tatccacccagc

SEQ ID NO: 4219364 - DNA, 13 bp, Homo sapiens
tatccacccagcc

SEQ ID NO: 4219365 - DNA, 15 bp, Homo sapiens
tatccacccagccca

SEQ ID NO: 4219366 - DNA, 19 bp, Homo sapiens
tatccacccagcccattct

SEQ ID NO: 4219367 - DNA, 23 bp, Homo sapiens
tatcccacccaacagctcagaga

SEQ ID NO: 4219368 - DNA, 15 bp, Homo sapiens
tatcgcaaatcacaa

SEQ ID NO: 4219369 - DNA, 17 bp, Homo sapiens
tatctagcagtaaaaga

SEQ ID NO: 4219370 - DNA, 19 bp, Homo sapiens
tatctagcagtaaaagata

SEQ ID NO: 4219371 - DNA, 21 bp, Homo sapiens
tatgaacaaagaaaaaaatat

SEQ ID NO: 4219372 - DNA, 13 bp, Homo sapiens
tatgacctgggtg

SEQ ID NO: 4219373 - DNA, 18 bp, Homo sapiens
tatgagttgttttcagac

SEQ ID NO: 4219374 - DNA, 17 bp, Homo sapiens
tatgatttaaaaaataa

SEQ ID NO: 4219375 - DNA, 20 bp, Homo sapiens
tatgatttaaaaaataaata

SEQ ID NO: 4219376 - DNA, 21 bp, Homo sapiens
tatgatttaaaaaataaatat

SEQ ID NO: 4219377 - DNA, 22 bp, Homo sapiens
tatgatttaaaaaataaatata

SEQ ID NO: 4219378 - DNA, 18 bp, Homo sapiens
tatgatttggaaaataaa

SEQ ID NO: 4219379 - DNA, 16 bp, Homo sapiens
tatgattttttcatga

SEQ ID NO: 4219380 - DNA, 18 bp, Homo sapiens
tatgctttgaatgcaaaa

SEQ ID NO: 4219381 - DNA, 17 bp, Homo sapiens
tatgtataaattaatac

SEQ ID NO: 4219382 - DNA, 12 bp, Homo sapiens
tatgtgaagaaa

SEQ ID NO: 4219383 - DNA, 18 bp, Homo sapiens
tattatgtaacatccaga

SEQ ID NO: 4219384 - DNA, 16 bp, Homo sapiens
tattatgtgcaacatt

SEQ ID NO: 4219385 - DNA, 13 bp, Homo sapiens
tattctcactcca

SEQ ID NO: 4219386 - DNA, 14 bp, Homo sapiens
tattctcactccac

SEQ ID NO: 4219387 - DNA, 19 bp, Homo sapiens
tattgctaaaatattttag

SEQ ID NO: 4219388 - DNA, 18 bp, Homo sapiens
tattggtggctttccttg

SEQ ID NO: 4219389 - DNA, 24 bp, Homo sapiens
tattgtttattctttttaaagtat

SEQ ID NO: 4219390 - DNA, 20 bp, Homo sapiens
tatttatgaaaaccatatga

SEQ ID NO: 4219391 - DNA, 16 bp, Homo sapiens
tatttctacagagaaa

SEQ ID NO: 4219392 - DNA, 20 bp, Homo sapiens
tatttgcatatttttctaaa

SEQ ID NO: 4219393 - DNA, 23 bp, Homo sapiens
tatttttaactctggattttgaa

SEQ ID NO: 4219394 - DNA, 14 bp, Homo sapiens
tatttttgtttaca

SEQ ID NO: 4219395 - DNA, 13 bp, Homo sapiens
tcaaaaggtgcct

SEQ ID NO: 4219396 - DNA, 15 bp, Homo sapiens
tcaaacgtgaaaatg

SEQ ID NO: 4219397 - DNA, 16 bp, Homo sapiens
tcaaagcttaaaaaga

SEQ ID NO: 4219398 - DNA, 15 bp, Homo sapiens
tcaaatttgccacca

SEQ ID NO: 4219399 - DNA, 23 bp, Homo sapiens
tcaacctttgtaagaaaaccaaa

SEQ ID NO: 4219400 - DNA, 20 bp, Homo sapiens
tcaagtgcatgctctctgca

SEQ ID NO: 4219401 - DNA, 17 bp, Homo sapiens
tcaatcccctcattcag

SEQ ID NO: 4219402 - DNA, 17 bp, Homo sapiens
gtcaccaccttcccagc

SEQ ID NO: 4219403 - DNA, 23 bp, Homo sapiens
gtcaccaggaatgttaaagtcag

SEQ ID NO: 4219404 - DNA, 20 bp, Homo sapiens
gtcatcagagctcctctgtc

SEQ ID NO: 4219405 - DNA, 14 bp, Homo sapiens
gtcatgatctccct

SEQ ID NO: 4219406 - DNA, 16 bp, Homo sapiens
gtcatgatctccctgc

SEQ ID NO: 4219407 - DNA, 18 bp, Homo sapiens
gtcatgatctccctgccg

SEQ ID NO: 4219408 - DNA, 19 bp, Homo sapiens
gtcatgatctccctgccgc

SEQ ID NO: 4219409 - DNA, 17 bp, Homo sapiens
gtccaacctaacccctt

SEQ ID NO: 4219410 - DNA, 12 bp, Homo sapiens
gtcccagggaag

SEQ ID NO: 4219411 - DNA, 20 bp, Homo sapiens
gtccccatcatcccagctgc

SEQ ID NO: 4219412 - DNA, 14 bp, Homo sapiens
gtcccggcttccac

SEQ ID NO: 4219413 - DNA, 21 bp, Homo sapiens
gtccctcccatctctacccca

SEQ ID NO: 4219414 - DNA, 23 bp, Homo sapiens
gtccctgggggaagccctggatt

SEQ ID NO: 4219415 - DNA, 20 bp, Homo sapiens
gtcccttgagacctcagcca

SEQ ID NO: 4219416 - DNA, 17 bp, Homo sapiens
gtccggtgtccttttca

SEQ ID NO: 4219417 - DNA, 24 bp, Homo sapiens
gtccggtgtccttttcactacacc

SEQ ID NO: 4219418 - DNA, 14 bp, Homo sapiens
gtccgtttactcca

SEQ ID NO: 4219419 - DNA, 20 bp, Homo sapiens
gtcctccccctgccagtgcc

SEQ ID NO: 4219420 - DNA, 21 bp, Homo sapiens
gtcctccccctgccagtgcct

SEQ ID NO: 4219421 - DNA, 13 bp, Homo sapiens
gtctaggagctgg

SEQ ID NO: 4219422 - DNA, 21 bp, Homo sapiens
gtctaggagctgggaggaaaa

SEQ ID NO: 4219423 - DNA, 14 bp, Homo sapiens
gtctagggagagac

SEQ ID NO: 4219424 - DNA, 20 bp, Homo sapiens
gtctccctctcctgcctact

SEQ ID NO: 4219425 - DNA, 19 bp, Homo sapiens
gtctcctttactgaatgta

SEQ ID NO: 4219426 - DNA, 12 bp, Homo sapiens
gtctctcagaat

SEQ ID NO: 4219427 - DNA, 13 bp, Homo sapiens
gtctcttcctctg

SEQ ID NO: 4219428 - DNA, 23 bp, Homo sapiens
gtctgaaagacagaatgtcacca

SEQ ID NO: 4219429 - DNA, 14 bp, Homo sapiens
gtctggagaagcag

SEQ ID NO: 4219430 - DNA, 17 bp, Homo sapiens
gtctggggttcagcccc

SEQ ID NO: 4219431 - DNA, 20 bp, Homo sapiens
gtctggggttcagcccctcc

SEQ ID NO: 4219432 - DNA, 23 bp, Homo sapiens
gtctggggttcagcccctcctct

SEQ ID NO: 4219433 - DNA, 23 bp, Homo sapiens
gtctgtgaattgtggctgttcac

SEQ ID NO: 4219434 - DNA, 13 bp, Homo sapiens
gtcttaatgttga

SEQ ID NO: 4219435 - DNA, 14 bp, Homo sapiens
gtcttaatgttgaa

SEQ ID NO: 4219436 - DNA, 20 bp, Homo sapiens
gtcttagaagtggaccagga

SEQ ID NO: 4219437 - DNA, 22 bp, Homo sapiens
gtcttagaagtggaccaggaca

SEQ ID NO: 4219438 - DNA, 23 bp, Homo sapiens
gtcttagaagtggaccaggacag

SEQ ID NO: 4219439 - DNA, 16 bp, Homo sapiens
gtctttgtaatgtcac

SEQ ID NO: 4219440 - DNA, 18 bp, Homo sapiens
gtctttgtaatgtcacca

SEQ ID NO: 4219441 - DNA, 19 bp, Homo sapiens
gtctttgtaatgtcaccac

SEQ ID NO: 4219442 - DNA, 20 bp, Homo sapiens
gtctttgtaatgtcaccacc

SEQ ID NO: 4219443 - DNA, 21 bp, Homo sapiens
gtctttgtaatgtcaccacct

SEQ ID NO: 4219444 - DNA, 16 bp, Homo sapiens
gtgaaaaaaatgaaat

SEQ ID NO: 4219445 - DNA, 15 bp, Homo sapiens
gtgaatcagacccta

SEQ ID NO: 4219446 - DNA, 12 bp, Homo sapiens
gtgaggcagggg

SEQ ID NO: 4219447 - DNA, 20 bp, Homo sapiens
gtgaggtgggttttcttccc

SEQ ID NO: 4219448 - DNA, 20 bp, Homo sapiens
gtgatggggtgggcagggct

SEQ ID NO: 4219449 - DNA, 17 bp, Homo sapiens
gtgatttagttgtggaa

SEQ ID NO: 4219450 - DNA, 19 bp, Homo sapiens
gtgcatgctctctgcagcc

SEQ ID NO: 4219451 - DNA, 18 bp, Homo sapiens
gtgcctgggtggggctgc

SEQ ID NO: 4219452 - DNA, 20 bp, Homo sapiens
gtgctatttaacatgggagg

SEQ ID NO: 4219453 - DNA, 13 bp, Homo sapiens
gtggaagccctcc

SEQ ID NO: 4219454 - DNA, 13 bp, Homo sapiens
gtggatcacagag

SEQ ID NO: 4219455 - DNA, 15 bp, Homo sapiens
gtggatcacctgagg

SEQ ID NO: 4219456 - DNA, 14 bp, Homo sapiens
gtggatggacagat

SEQ ID NO: 4219457 - DNA, 17 bp, Homo sapiens
gtggatggacagatgga

SEQ ID NO: 4219458 - DNA, 9 bp, Homo sapiens
gtggcagag

SEQ ID NO: 4219459 - DNA, 18 bp, Homo sapiens
gtggccctggcctgctgg

SEQ ID NO: 4219460 - DNA, 19 bp, Homo sapiens
gtggctagtcagagagagt

SEQ ID NO: 4219461 - DNA, 13 bp, Homo sapiens
gtgggcagggctg

SEQ ID NO: 4219462 - DNA, 15 bp, Homo sapiens
gtgggcagggctggg

SEQ ID NO: 4219463 - DNA, 14 bp, Homo sapiens
gtgggccaggacag

SEQ ID NO: 4219464 - DNA, 17 bp, Homo sapiens
gtggggtctccctctcc

SEQ ID NO: 4219465 - DNA, 17 bp, Homo sapiens
gtggtacaaatgtgata

SEQ ID NO: 4219466 - DNA, 15 bp, Homo sapiens
gtgtatatgtataaa

SEQ ID NO: 4219467 - DNA, 13 bp, Homo sapiens
gtgtgcagactga

SEQ ID NO: 4219468 - DNA, 14 bp, Homo sapiens
gtgtgcagactgat

SEQ ID NO: 4219469 - DNA, 16 bp, Homo sapiens
gtgtgggaagggagag

SEQ ID NO: 4219470 - DNA, 20 bp, Homo sapiens
gtgttgtgaaactgtaaatt

SEQ ID NO: 4219471 - DNA, 12 bp, Homo sapiens
gttactcagccc

SEQ ID NO: 4219472 - DNA, 13 bp, Homo sapiens
gttactcagccct

SEQ ID NO: 4219473 - DNA, 14 bp, Homo sapiens
gttactcagccctg

SEQ ID NO: 4219474 - DNA, 18 bp, Homo sapiens
gttactcagccctgggcc

SEQ ID NO: 4219475 - DNA, 22 bp, Homo sapiens
gttactctccaacctggacaac

SEQ ID NO: 4219476 - DNA, 15 bp, Homo sapiens
gttactgagatgttt

SEQ ID NO: 4219477 - DNA, 19 bp, Homo sapiens
gttactggcacctgaaatt

SEQ ID NO: 4219478 - DNA, 20 bp, Homo sapiens
gttactggcacctgaaatta

SEQ ID NO: 4219479 - DNA, 21 bp, Homo sapiens
gttactggcacctgaaattaa

SEQ ID NO: 4219480 - DNA, 18 bp, Homo sapiens
gttattaccaaaacagga

SEQ ID NO: 4219481 - DNA, 18 bp, Homo sapiens
gttcacaacataaggaga

SEQ ID NO: 4219482 - DNA, 15 bp, Homo sapiens
gttcagcccctcctc

SEQ ID NO: 4219483 - DNA, 23 bp, Homo sapiens
gttcagcccctcctctgccacct

SEQ ID NO: 4219484 - DNA, 18 bp, Homo sapiens
gttccctgaaaacccaga

SEQ ID NO: 4219485 - DNA, 16 bp, Homo sapiens
gttcctcgccctgggt

SEQ ID NO: 4219486 - DNA, 18 bp, Homo sapiens
gttctatttttgtttaca

SEQ ID NO: 4219487 - DNA, 23 bp, Homo sapiens
gttctgcccaaattatgtgaaat

SEQ ID NO: 4219488 - DNA, 11 bp, Homo sapiens
gttctgctcct

SEQ ID NO: 4219489 - DNA, 16 bp, Homo sapiens
gttctgctcctctcca

SEQ ID NO: 4219490 - DNA, 17 bp, Homo sapiens
gttctgctcctctccag

SEQ ID NO: 4219491 - DNA, 22 bp, Homo sapiens
gttctgctcctctccaggcacc

SEQ ID NO: 4219492 - DNA, 22 bp, Homo sapiens
gttgaatattggtaattaaaag

SEQ ID NO: 4219493 - DNA, 17 bp, Homo sapiens
gttgagggaacagacag

SEQ ID NO: 4219494 - DNA, 19 bp, Homo sapiens
gttgagggaacagacagga

SEQ ID NO: 4219495 - DNA, 22 bp, Homo sapiens
gttgagggaacagacaggagaa

SEQ ID NO: 4219496 - DNA, 20 bp, Homo sapiens
gttgaggtggaagccctcct

SEQ ID NO: 4219497 - DNA, 17 bp, Homo sapiens
gttgcaagtactgctgt

SEQ ID NO: 4219498 - DNA, 14 bp, Homo sapiens
gttggaagagaatc

SEQ ID NO: 4219499 - DNA, 21 bp, Homo sapiens
gttgtggaaagataataaatt

SEQ ID NO: 4219500 - DNA, 22 bp, Homo sapiens
gtttaaactacctcaaaacact

SEQ ID NO: 4219501 - DNA, 15 bp, Homo sapiens
gtttagattccagga

SEQ ID NO: 4219502 - DNA, 12 bp, Homo sapiens
gtttataaagca

SEQ ID NO: 4219503 - DNA, 18 bp, Homo sapiens
gtttggttcctctctggt

SEQ ID NO: 4219504 - DNA, 20 bp, Homo sapiens
gttttcttcccatcactgga

SEQ ID NO: 4219505 - DNA, 11 bp, Homo sapiens
gtttttccccc

SEQ ID NO: 4219506 - DNA, 15 bp, Homo sapiens
gtttttctggaagta

SEQ ID NO: 4219507 - DNA, 15 bp, Homo sapiens
taaaaaataaatata

SEQ ID NO: 4219508 - DNA, 17 bp, Homo sapiens
taaaaaataaatataat

SEQ ID NO: 4219509 - DNA, 12 bp, Homo sapiens
taaaaacatgag

SEQ ID NO: 4219510 - DNA, 19 bp, Homo sapiens
taaaaacatgagaaatgtg

SEQ ID NO: 4219511 - DNA, 10 bp, Homo sapiens
taaaaaccat

SEQ ID NO: 4219512 - DNA, 19 bp, Homo sapiens
taaaaaccataaacatttg

SEQ ID NO: 4219513 - DNA, 20 bp, Homo sapiens
taaaagataaatttgttgaa

SEQ ID NO: 4219514 - DNA, 21 bp, Homo sapiens
taaaatattttagatgttatt

SEQ ID NO: 4219515 - DNA, 18 bp, Homo sapiens
taaaattaaagctgaaaa

SEQ ID NO: 4219516 - DNA, 19 bp, Homo sapiens
taaaattaaagctgaaaac

SEQ ID NO: 4219517 - DNA, 13 bp, Homo sapiens
taaacagtgcctg

SEQ ID NO: 4219518 - DNA, 17 bp, Homo sapiens
taaacagtgcctgctga

SEQ ID NO: 4219519 - DNA, 20 bp, Homo sapiens
taaactacctcaaaacactt

SEQ ID NO: 4219520 - DNA, 20 bp, Homo sapiens
taaagaattggtcttaatgt

SEQ ID NO: 4219521 - DNA, 14 bp, Homo sapiens
taaagcaaattact

SEQ ID NO: 4219522 - DNA, 12 bp, Homo sapiens
taaagcagatta

SEQ ID NO: 4219523 - DNA, 14 bp, Homo sapiens
taaagctgaaaact

SEQ ID NO: 4219524 - DNA, 14 bp, Homo sapiens
taaagtattctcca

SEQ ID NO: 4219525 - DNA, 19 bp, Homo sapiens
taaatagtaaaaataaaat

SEQ ID NO: 4219526 - DNA, 20 bp, Homo sapiens
taaatagtaaaaataaaatt

SEQ ID NO: 4219527 - DNA, 18 bp, Homo sapiens
taaatagttttaaatatg

SEQ ID NO: 4219528 - DNA, 14 bp, Homo sapiens
taaatatgaacaaa

SEQ ID NO: 4219529 - DNA, 19 bp, Homo sapiens
ggcacgaacccacctgctg

SEQ ID NO: 4219530 - DNA, 22 bp, Homo sapiens
ggcagaggctggaggcagggcc

SEQ ID NO: 4219531 - DNA, 16 bp, Homo sapiens
ggcagagggcagaggc

SEQ ID NO: 4219532 - DNA, 19 bp, Homo sapiens
ggcagagggcagaggctgg

SEQ ID NO: 4219533 - DNA, 18 bp, Homo sapiens
ggcagggccttgcccaga

SEQ ID NO: 4219534 - DNA, 19 bp, Homo sapiens
ggcagggccttgcccagag

SEQ ID NO: 4219535 - DNA, 12 bp, Homo sapiens
ggcaggggcgga

SEQ ID NO: 4219536 - DNA, 23 bp, Homo sapiens
ggcagggtgggatggaggagaag

SEQ ID NO: 4219537 - DNA, 22 bp, Homo sapiens
ggcatggtggcgcaagcctgta

SEQ ID NO: 4219538 - DNA, 14 bp, Homo sapiens
ggcattttctgttc

SEQ ID NO: 4219539 - DNA, 16 bp, Homo sapiens
ggcattttctgttcca

SEQ ID NO: 4219540 - DNA, 12 bp, Homo sapiens
ggccaagaggaa

SEQ ID NO: 4219541 - DNA, 12 bp, Homo sapiens
ggccactcctcc

SEQ ID NO: 4219542 - DNA, 13 bp, Homo sapiens
ggcccacagctcc

SEQ ID NO: 4219543 - DNA, 17 bp, Homo sapiens
ggcccacagctcccacc

SEQ ID NO: 4219544 - DNA, 19 bp, Homo sapiens
ggcccacagctcccacccc

SEQ ID NO: 4219545 - DNA, 14 bp, Homo sapiens
ggccctggcctgct

SEQ ID NO: 4219546 - DNA, 16 bp, Homo sapiens
ggccctggcctgctgg

SEQ ID NO: 4219547 - DNA, 16 bp, Homo sapiens
ggccgctgttcaccca

SEQ ID NO: 4219548 - DNA, 15 bp, Homo sapiens
ggcctctgtggccgt

SEQ ID NO: 4219549 - DNA, 20 bp, Homo sapiens
ggcctgctgggctctccacc

SEQ ID NO: 4219550 - DNA, 14 bp, Homo sapiens
ggcgagaaaggcct

SEQ ID NO: 4219551 - DNA, 14 bp, Homo sapiens
ggcgcaagcctgta

SEQ ID NO: 4219552 - DNA, 19 bp, Homo sapiens
ggcgcggtggctcacgcct

SEQ ID NO: 4219553 - DNA, 20 bp, Homo sapiens
ggcgctgggggctggacctg

SEQ ID NO: 4219554 - DNA, 21 bp, Homo sapiens
ggcggctactcagcagccctc

SEQ ID NO: 4219555 - DNA, 22 bp, Homo sapiens
ggcggctactcagcagccctcc

SEQ ID NO: 4219556 - DNA, 15 bp, Homo sapiens
ggcgtgactcaccca

SEQ ID NO: 4219557 - DNA, 14 bp, Homo sapiens
ggctaactggaagc

SEQ ID NO: 4219558 - DNA, 19 bp, Homo sapiens
ggctaagagctagcgctgc

SEQ ID NO: 4219559 - DNA, 16 bp, Homo sapiens
ggctactcagcagccc

SEQ ID NO: 4219560 - DNA, 12 bp, Homo sapiens
ggctccccattt

SEQ ID NO: 4219561 - DNA, 13 bp, Homo sapiens
ggctctccacctc

SEQ ID NO: 4219562 - DNA, 14 bp, Homo sapiens
ggctctccacctca

SEQ ID NO: 4219563 - DNA, 17 bp, Homo sapiens
ggctctccacctcagcc

SEQ ID NO: 4219564 - DNA, 20 bp, Homo sapiens
ggctctccacctcagccttg

SEQ ID NO: 4219565 - DNA, 21 bp, Homo sapiens
ggctctccacctcagccttgg

SEQ ID NO: 4219566 - DNA, 15 bp, Homo sapiens
ggctctttgggctgg

SEQ ID NO: 4219567 - DNA, 17 bp, Homo sapiens
ggctgacccagtccctg

SEQ ID NO: 4219568 - DNA, 18 bp, Homo sapiens
ggctgacccagtccctgg

SEQ ID NO: 4219569 - DNA, 13 bp, Homo sapiens
ggctgaggcagaa

SEQ ID NO: 4219570 - DNA, 14 bp, Homo sapiens
ggctgaggcagaag

SEQ ID NO: 4219571 - DNA, 17 bp, Homo sapiens
ggctgaggcagaagaat

SEQ ID NO: 4219572 - DNA, 23 bp, Homo sapiens
ggctgctcctccagggccacgtg

SEQ ID NO: 4219573 - DNA, 13 bp, Homo sapiens
ggctggaggcagg

SEQ ID NO: 4219574 - DNA, 17 bp, Homo sapiens
ggctggaggcagggcct

SEQ ID NO: 4219575 - DNA, 16 bp, Homo sapiens
ggctggggccaagagg

SEQ ID NO: 4219576 - DNA, 12 bp, Homo sapiens
ggcttcacagat

SEQ ID NO: 4219577 - DNA, 11 bp, Homo sapiens
ggcttgctgcc

SEQ ID NO: 4219578 - DNA, 20 bp, Homo sapiens
ggctttccttgtggcagagg

SEQ ID NO: 4219579 - DNA, 16 bp, Homo sapiens
gggaacagacaggaga

SEQ ID NO: 4219580 - DNA, 14 bp, Homo sapiens
gggaacgtgactgc

SEQ ID NO: 4219581 - DNA, 18 bp, Homo sapiens
gggaacgtgactgcccca

SEQ ID NO: 4219582 - DNA, 13 bp, Homo sapiens
gggaactcctgga

SEQ ID NO: 4219583 - DNA, 20 bp, Homo sapiens
gggactcaagggtccagaag

SEQ ID NO: 4219584 - DNA, 10 bp, Homo sapiens
gggagaaaac

SEQ ID NO: 4219585 - DNA, 13 bp, Homo sapiens
gggagagaccctt

SEQ ID NO: 4219586 - DNA, 15 bp, Homo sapiens
gggaggtcgaggtag

SEQ ID NO: 4219587 - DNA, 14 bp, Homo sapiens
gggatggaggagaa

SEQ ID NO: 4219588 - DNA, 15 bp, Homo sapiens
gggcagaggctggag

SEQ ID NO: 4219589 - DNA, 21 bp, Homo sapiens
gggcagaggctggaggcaggg

SEQ ID NO: 4219590 - DNA, 20 bp, Homo sapiens
gggcagagggcagaggctgg

SEQ ID NO: 4219591 - DNA, 11 bp, Homo sapiens
gggcagggctg

SEQ ID NO: 4219592 - DNA, 19 bp, Homo sapiens
gggccacgtgccaggcccg

SEQ ID NO: 4219593 - DNA, 12 bp, Homo sapiens
gggccttgccca

SEQ ID NO: 4219594 - DNA, 22 bp, Homo sapiens
gggccttgcccagagatgcctc

SEQ ID NO: 4219595 - DNA, 20 bp, Homo sapiens
gggctaagagctagcgctgc

SEQ ID NO: 4219596 - DNA, 17 bp, Homo sapiens
gggctctccacctcagc

SEQ ID NO: 4219597 - DNA, 19 bp, Homo sapiens
gggctctccacctcagcct

SEQ ID NO: 4219598 - DNA, 18 bp, Homo sapiens
gggctgaacggggagaaa

SEQ ID NO: 4219599 - DNA, 16 bp, Homo sapiens
gggctgctcctccagg

SEQ ID NO: 4219600 - DNA, 19 bp, Homo sapiens
gggctgctcctccagggcc

SEQ ID NO: 4219601 - DNA, 15 bp, Homo sapiens
gggctggacctgctg

SEQ ID NO: 4219602 - DNA, 13 bp, Homo sapiens
ggggaactgtgtg

SEQ ID NO: 4219603 - DNA, 17 bp, Homo sapiens
ggggagccaccagcccc

SEQ ID NO: 4219604 - DNA, 12 bp, Homo sapiens
ggggccaagagg

SEQ ID NO: 4219605 - DNA, 20 bp, Homo sapiens
ggggctgctcctccagggcc

SEQ ID NO: 4219606 - DNA, 12 bp, Homo sapiens
ggggctggacct

SEQ ID NO: 4219607 - DNA, 13 bp, Homo sapiens
ggggctggacctg

SEQ ID NO: 4219608 - DNA, 19 bp, Homo sapiens
ggggctggcggctactcag

SEQ ID NO: 4219609 - DNA, 12 bp, Homo sapiens
gggggcagaggg

SEQ ID NO: 4219610 - DNA, 16 bp, Homo sapiens
ggggtgggcagggctg

SEQ ID NO: 4219611 - DNA, 22 bp, Homo sapiens
gggtagcaggtaccactgattt

SEQ ID NO: 4219612 - DNA, 18 bp, Homo sapiens
gggtctccctctcctgcc

SEQ ID NO: 4219613 - DNA, 20 bp, Homo sapiens
gggtctccctctcctgccta

SEQ ID NO: 4219614 - DNA, 11 bp, Homo sapiens
gggtgggcagg

SEQ ID NO: 4219615 - DNA, 12 bp, Homo sapiens
gggtggggctgc

SEQ ID NO: 4219616 - DNA, 20 bp, Homo sapiens
gggttcagcccctcctctgc

SEQ ID NO: 4219617 - DNA, 12 bp, Homo sapiens
ggtacaaatgtg

SEQ ID NO: 4219618 - DNA, 13 bp, Homo sapiens
ggtacaaatgtga

SEQ ID NO: 4219619 - DNA, 18 bp, Homo sapiens
ggtattggtggctttcct

SEQ ID NO: 4219620 - DNA, 14 bp, Homo sapiens
ggtcaacagagaag

SEQ ID NO: 4219621 - DNA, 15 bp, Homo sapiens
ggtcagggaaagtct

SEQ ID NO: 4219622 - DNA, 14 bp, Homo sapiens
ggtctccctctcct

SEQ ID NO: 4219623 - DNA, 19 bp, Homo sapiens
ggtctccctctcctgccta

SEQ ID NO: 4219624 - DNA, 22 bp, Homo sapiens
ggtctccctctcctgcctactc

SEQ ID NO: 4219625 - DNA, 17 bp, Homo sapiens
ggtgcctgtgaggcagg

SEQ ID NO: 4219626 - DNA, 19 bp, Homo sapiens
ggtgcctgtgaggcagggg

SEQ ID NO: 4219627 - DNA, 13 bp, Homo sapiens
ggtggaagccctc

SEQ ID NO: 4219628 - DNA, 17 bp, Homo sapiens
ggtggatcacagaggct

SEQ ID NO: 4219629 - DNA, 21 bp, Homo sapiens
ggtggctgacccagtccctgg

SEQ ID NO: 4219630 - DNA, 22 bp, Homo sapiens
ggtggctgacccagtccctggg

SEQ ID NO: 4219631 - DNA, 13 bp, Homo sapiens
ggtgggcagggct

SEQ ID NO: 4219632 - DNA, 17 bp, Homo sapiens
ggtgggttttcttccca

SEQ ID NO: 4219633 - DNA, 20 bp, Homo sapiens
ggttcagcccctcctctgcc

SEQ ID NO: 4219634 - DNA, 22 bp, Homo sapiens
ggttcagcccctcctctgccac

SEQ ID NO: 4219635 - DNA, 23 bp, Homo sapiens
ggttccaagaaagatccaccctc

SEQ ID NO: 4219636 - DNA, 13 bp, Homo sapiens
ggttcctctctgg

SEQ ID NO: 4219637 - DNA, 20 bp, Homo sapiens
gtaaaacaaaaatgtaatga

SEQ ID NO: 4219638 - DNA, 15 bp, Homo sapiens
gtaaacagtgcctgc

SEQ ID NO: 4219639 - DNA, 14 bp, Homo sapiens
gtaaatagttttaa

SEQ ID NO: 4219640 - DNA, 15 bp, Homo sapiens
gtaaatatgtgaaga

SEQ ID NO: 4219641 - DNA, 21 bp, Homo sapiens
gtaaatctgaagaaagttatt

SEQ ID NO: 4219642 - DNA, 12 bp, Homo sapiens
gtaatcccagca

SEQ ID NO: 4219643 - DNA, 13 bp, Homo sapiens
gtaatcccagcag

SEQ ID NO: 4219644 - DNA, 12 bp, Homo sapiens
gtaatgtcacca

SEQ ID NO: 4219645 - DNA, 20 bp, Homo sapiens
gtaatgtcaccaccttccca

SEQ ID NO: 4219646 - DNA, 16 bp, Homo sapiens
gtacagtggagaaata

SEQ ID NO: 4219647 - DNA, 15 bp, Homo sapiens
gtacatttgtgctgt

SEQ ID NO: 4219648 - DNA, 19 bp, Homo sapiens
gtagccgagagcctgctcc

SEQ ID NO: 4219649 - DNA, 18 bp, Homo sapiens
gtaggcagggaaccttaa

SEQ ID NO: 4219650 - DNA, 16 bp, Homo sapiens
gtataagatttttgaa

SEQ ID NO: 4219651 - DNA, 17 bp, Homo sapiens
gtatcaaagaaaaacaa

SEQ ID NO: 4219652 - DNA, 22 bp, Homo sapiens
gtatttggctatggatctgatt

SEQ ID NO: 4219653 - DNA, 19 bp, Homo sapiens
gtatttttccaatcacagt

SEQ ID NO: 4219654 - DNA, 19 bp, Homo sapiens
gtcaacagagaaggcagga

SEQ ID NO: 4219655 - DNA, 19 bp, Homo sapiens
gtcaacctttgtaagaaaa

SEQ ID NO: 4219656 - DNA, 15 bp, Homo sapiens
gtcaatactgagcca

SEQ ID NO: 4219657 - DNA, 16 bp, Homo sapiens
gtcaatcccctcattc

SEQ ID NO: 4219658 - DNA, 19 bp, Homo sapiens
gccttcttattctcactcc

SEQ ID NO: 4219659 - DNA, 21 bp, Homo sapiens
gccttcttattctcactccac

SEQ ID NO: 4219660 - DNA, 12 bp, Homo sapiens
gccttgcccaga

SEQ ID NO: 4219661 - DNA, 14 bp, Homo sapiens
gccttgcccagaga

SEQ ID NO: 4219662 - DNA, 16 bp, Homo sapiens
gccttgcccagagatg

SEQ ID NO: 4219663 - DNA, 22 bp, Homo sapiens
gccttgcccagagatgcctcca

SEQ ID NO: 4219664 - DNA, 16 bp, Homo sapiens
gccttggtgtccacct

SEQ ID NO: 4219665 - DNA, 17 bp, Homo sapiens
gccttggtgtccacctg

SEQ ID NO: 4219666 - DNA, 22 bp, Homo sapiens
gccttggtgtccacctggcccc

SEQ ID NO: 4219667 - DNA, 22 bp, Homo sapiens
gcgcaagcctgtaatcccagct

SEQ ID NO: 4219668 - DNA, 23 bp, Homo sapiens
gcgcaagcctgtaatcccagcta

SEQ ID NO: 4219669 - DNA, 21 bp, Homo sapiens
gcgcacccagagaaaattaat

SEQ ID NO: 4219670 - DNA, 22 bp, Homo sapiens
gcgctgggggctggacctgctg

SEQ ID NO: 4219671 - DNA, 13 bp, Homo sapiens
gcgtgactcaccc

SEQ ID NO: 4219672 - DNA, 12 bp, Homo sapiens
gctaactggaag

SEQ ID NO: 4219673 - DNA, 18 bp, Homo sapiens
gctaagagctagcgctgc

SEQ ID NO: 4219674 - DNA, 11 bp, Homo sapiens
gctactcagca

SEQ ID NO: 4219675 - DNA, 18 bp, Homo sapiens
gctactcagcagccctcc

SEQ ID NO: 4219676 - DNA, 15 bp, Homo sapiens
gctactcaggaggct

SEQ ID NO: 4219677 - DNA, 16 bp, Homo sapiens
gctactcaggaggctg

SEQ ID NO: 4219678 - DNA, 20 bp, Homo sapiens
gctagaagtgggccaggaca

SEQ ID NO: 4219679 - DNA, 20 bp, Homo sapiens
gctagcgctgccgcacccca

SEQ ID NO: 4219680 - DNA, 19 bp, Homo sapiens
gctagggagaatgcagaga

SEQ ID NO: 4219681 - DNA, 20 bp, Homo sapiens
gctatctagcagtaaaagat

SEQ ID NO: 4219682 - DNA, 21 bp, Homo sapiens
gctattatgtaacatccagaa

SEQ ID NO: 4219683 - DNA, 15 bp, Homo sapiens
gctcacagttcctcg

SEQ ID NO: 4219684 - DNA, 16 bp, Homo sapiens
gctcacagttcctcgc

SEQ ID NO: 4219685 - DNA, 15 bp, Homo sapiens
gctcagacccccact

SEQ ID NO: 4219686 - DNA, 19 bp, Homo sapiens
gctcagacccccactctca

SEQ ID NO: 4219687 - DNA, 19 bp, Homo sapiens
gctcccacgcctgcttctt

SEQ ID NO: 4219688 - DNA, 14 bp, Homo sapiens
gctcccccaccccc

SEQ ID NO: 4219689 - DNA, 22 bp, Homo sapiens
gctcccccaccccctccccagg

SEQ ID NO: 4219690 - DNA, 16 bp, Homo sapiens
gctccctcccacccaa

SEQ ID NO: 4219691 - DNA, 14 bp, Homo sapiens
gctcctccagggcc

SEQ ID NO: 4219692 - DNA, 17 bp, Homo sapiens
gctcctctccaggcacc

SEQ ID NO: 4219693 - DNA, 12 bp, Homo sapiens
gctcctctgctc

SEQ ID NO: 4219694 - DNA, 15 bp, Homo sapiens
gctcctctgctccac

SEQ ID NO: 4219695 - DNA, 19 bp, Homo sapiens
gctcctctgtcctgcttct

SEQ ID NO: 4219696 - DNA, 15 bp, Homo sapiens
gctcctgcccgccca

SEQ ID NO: 4219697 - DNA, 20 bp, Homo sapiens
gctccttgtcaatactgagc

SEQ ID NO: 4219698 - DNA, 22 bp, Homo sapiens
gctccttgtcaatactgagcca

SEQ ID NO: 4219699 - DNA, 18 bp, Homo sapiens
gctctccacctcagcctt

SEQ ID NO: 4219700 - DNA, 19 bp, Homo sapiens
gctctccacctcagccttg

SEQ ID NO: 4219701 - DNA, 20 bp, Homo sapiens
gctctccacctcagccttgg

SEQ ID NO: 4219702 - DNA, 21 bp, Homo sapiens
gctctccacctcagccttgga

SEQ ID NO: 4219703 - DNA, 14 bp, Homo sapiens
gctctccctctggc

SEQ ID NO: 4219704 - DNA, 19 bp, Homo sapiens
gctctccctctggccctgc

SEQ ID NO: 4219705 - DNA, 20 bp, Homo sapiens
gctctccctctggccctgcc

SEQ ID NO: 4219706 - DNA, 17 bp, Homo sapiens
gctctctgcagccagcc

SEQ ID NO: 4219707 - DNA, 19 bp, Homo sapiens
gctctctgcagccagccca

SEQ ID NO: 4219708 - DNA, 20 bp, Homo sapiens
gctctctgcagccagcccag

SEQ ID NO: 4219709 - DNA, 21 bp, Homo sapiens
gctctctgcagccagcccagc

SEQ ID NO: 4219710 - DNA, 22 bp, Homo sapiens
gctctctgcagccagcccagcc

SEQ ID NO: 4219711 - DNA, 17 bp, Homo sapiens
gctctgctggcctggcc

SEQ ID NO: 4219712 - DNA, 18 bp, Homo sapiens
gctctgctggcctggccg

SEQ ID NO: 4219713 - DNA, 19 bp, Homo sapiens
gctcttcagtgggagaaaa

SEQ ID NO: 4219714 - DNA, 13 bp, Homo sapiens
gctgacccagtcc

SEQ ID NO: 4219715 - DNA, 19 bp, Homo sapiens
gctgacccagtccctgggg

SEQ ID NO: 4219716 - DNA, 18 bp, Homo sapiens
gctgactgatgttgaggg

SEQ ID NO: 4219717 - DNA, 17 bp, Homo sapiens
gctgagagacccaagga

SEQ ID NO: 4219718 - DNA, 22 bp, Homo sapiens
gctgatgtttataaactgagag

SEQ ID NO: 4219719 - DNA, 12 bp, Homo sapiens
gctgcagcccat

SEQ ID NO: 4219720 - DNA, 11 bp, Homo sapiens
gctgctcctcc

SEQ ID NO: 4219721 - DNA, 17 bp, Homo sapiens
gctggcctggccggcaa

SEQ ID NO: 4219722 - DNA, 20 bp, Homo sapiens
gctggcggctactcagcagc

SEQ ID NO: 4219723 - DNA, 15 bp, Homo sapiens
gctgggctctccacc

SEQ ID NO: 4219724 - DNA, 15 bp, Homo sapiens
gctgggggctggacc

SEQ ID NO: 4219725 - DNA, 19 bp, Homo sapiens
gctgggggctggacctgct

SEQ ID NO: 4219726 - DNA, 14 bp, Homo sapiens
gctgtaaataaatg

SEQ ID NO: 4219727 - DNA, 13 bp, Homo sapiens
gctgtcatctcag

SEQ ID NO: 4219728 - DNA, 23 bp, Homo sapiens
gctgtgtccttgcacctgcatcc

SEQ ID NO: 4219729 - DNA, 20 bp, Homo sapiens
gctgttcacccacagggcta

SEQ ID NO: 4219730 - DNA, 21 bp, Homo sapiens
gctgtttgtttgacaaagaaa

SEQ ID NO: 4219731 - DNA, 17 bp, Homo sapiens
gcttccacccctctcct

SEQ ID NO: 4219732 - DNA, 15 bp, Homo sapiens
gcttctgttgtaata

SEQ ID NO: 4219733 - DNA, 20 bp, Homo sapiens
gctttaaactaccctccaga

SEQ ID NO: 4219734 - DNA, 22 bp, Homo sapiens
gctttccttgtggcagaggatg

SEQ ID NO: 4219735 - DNA, 18 bp, Homo sapiens
gcttttccccggtccctt

SEQ ID NO: 4219736 - DNA, 21 bp, Homo sapiens
ggaaaaacatctgaaagccac

SEQ ID NO: 4219737 - DNA, 18 bp, Homo sapiens
ggaaaatatttttttcct

SEQ ID NO: 4219738 - DNA, 22 bp, Homo sapiens
ggaaatatcagttactcagccc

SEQ ID NO: 4219739 - DNA, 16 bp, Homo sapiens
ggaacagacaggagaa

SEQ ID NO: 4219740 - DNA, 17 bp, Homo sapiens
ggaacagacaggagaaa

SEQ ID NO: 4219741 - DNA, 23 bp, Homo sapiens
ggaaccttaacctctctaagcca

SEQ ID NO: 4219742 - DNA, 16 bp, Homo sapiens
ggaacgtgactgcccc

SEQ ID NO: 4219743 - DNA, 23 bp, Homo sapiens
ggaactagactcccaagctggac

SEQ ID NO: 4219744 - DNA, 11 bp, Homo sapiens
ggaagccctgg

SEQ ID NO: 4219745 - DNA, 21 bp, Homo sapiens
ggaagctgtgtccttgcacct

SEQ ID NO: 4219746 - DNA, 15 bp, Homo sapiens
ggaaggagactcacc

SEQ ID NO: 4219747 - DNA, 21 bp, Homo sapiens
ggaaggagactcacctctgcc

SEQ ID NO: 4219748 - DNA, 22 bp, Homo sapiens
ggaaggagactcacctctgcct

SEQ ID NO: 4219749 - DNA, 17 bp, Homo sapiens
ggaatcgccccagactc

SEQ ID NO: 4219750 - DNA, 16 bp, Homo sapiens
ggaatgttaaagtcag

SEQ ID NO: 4219751 - DNA, 14 bp, Homo sapiens
ggacagagacacct

SEQ ID NO: 4219752 - DNA, 19 bp, Homo sapiens
ggacagagacacctgcacc

SEQ ID NO: 4219753 - DNA, 20 bp, Homo sapiens
ggacagagacacctgcacct

SEQ ID NO: 4219754 - DNA, 11 bp, Homo sapiens
ggacagatgga

SEQ ID NO: 4219755 - DNA, 11 bp, Homo sapiens
ggacaggcccg

SEQ ID NO: 4219756 - DNA, 12 bp, Homo sapiens
ggaccctttcct

SEQ ID NO: 4219757 - DNA, 16 bp, Homo sapiens
ggaccctttccttcct

SEQ ID NO: 4219758 - DNA, 15 bp, Homo sapiens
ggagaagcagtgagc

SEQ ID NO: 4219759 - DNA, 19 bp, Homo sapiens
ggagaagcagtgagccgca

SEQ ID NO: 4219760 - DNA, 17 bp, Homo sapiens
ggagaaggaaggagact

SEQ ID NO: 4219761 - DNA, 19 bp, Homo sapiens
ggagactcacctctgcctc

SEQ ID NO: 4219762 - DNA, 21 bp, Homo sapiens
ggagactcacctctgcctcaa

SEQ ID NO: 4219763 - DNA, 14 bp, Homo sapiens
ggagagagactcca

SEQ ID NO: 4219764 - DNA, 11 bp, Homo sapiens
ggagagccagc

SEQ ID NO: 4219765 - DNA, 12 bp, Homo sapiens
ggagagccagcc

SEQ ID NO: 4219766 - DNA, 20 bp, Homo sapiens
ggaggttgcagtgagctgag

SEQ ID NO: 4219767 - DNA, 22 bp, Homo sapiens
ggagtctcccactgcaacttgt

SEQ ID NO: 4219768 - DNA, 21 bp, Homo sapiens
ggagttggaagtgtgtgatct

SEQ ID NO: 4219769 - DNA, 19 bp, Homo sapiens
ggataatagacacatcaaa

SEQ ID NO: 4219770 - DNA, 23 bp, Homo sapiens
ggatctgggaccctttccttcct

SEQ ID NO: 4219771 - DNA, 14 bp, Homo sapiens
ggatggacagatgg

SEQ ID NO: 4219772 - DNA, 15 bp, Homo sapiens
ggatggacagatgga

SEQ ID NO: 4219773 - DNA, 22 bp, Homo sapiens
ggatggacagatggaccaaaag

SEQ ID NO: 4219774 - DNA, 16 bp, Homo sapiens
ggatgtaaacagtgcc

SEQ ID NO: 4219775 - DNA, 17 bp, Homo sapiens
ggatgtaaacagtgcct

SEQ ID NO: 4219776 - DNA, 19 bp, Homo sapiens
ggatgtaaacagtgcctgc

SEQ ID NO: 4219777 - DNA, 20 bp, Homo sapiens
ggcaaccccagttctgctcc

SEQ ID NO: 4219778 - DNA, 15 bp, Homo sapiens
ggcaagcagaaaaat

SEQ ID NO: 4219779 - DNA, 19 bp, Homo sapiens
ggcaagcagaaaaattaaa

SEQ ID NO: 4219780 - DNA, 12 bp, Homo sapiens
ggcacccttctt

SEQ ID NO: 4219781 - DNA, 20 bp, Homo sapiens
ggcacccttctttcctcttc

SEQ ID NO: 4219782 - DNA, 22 bp, Homo sapiens
ggcacccttctttcctcttccc

SEQ ID NO: 4219783 - DNA, 18 bp, Homo sapiens
ggcacgaacccacctgct

SEQ ID NO: 4219784 - DNA, 20 bp, Homo sapiens
gaaattaatttgtgaatttg

SEQ ID NO: 4219785 - DNA, 22 bp, Homo sapiens
gaaattaatttgtgaatttgca

SEQ ID NO: 4219786 - DNA, 17 bp, Homo sapiens
gaaatttgaaaaaactt

SEQ ID NO: 4219787 - DNA, 18 bp, Homo sapiens
gaacaaagaaaaaaatat

SEQ ID NO: 4219788 - DNA, 20 bp, Homo sapiens
gaacaaagaaaaaaatatat

SEQ ID NO: 4219789 - DNA, 22 bp, Homo sapiens
gaacatatcatttgtgaagaat

SEQ ID NO: 4219790 - DNA, 22 bp, Homo sapiens
gaaccgaacatatcatttgtga

SEQ ID NO: 4219791 - DNA, 21 bp, Homo sapiens
gaaccttaacctctctaagcc

SEQ ID NO: 4219792 - DNA, 14 bp, Homo sapiens
gaacgtgactgccc

SEQ ID NO: 4219793 - DNA, 22 bp, Homo sapiens
gaacgtgactgccccaactcct

SEQ ID NO: 4219794 - DNA, 24 bp, Homo sapiens
gaactacgtgacctctgcaagaca

SEQ ID NO: 4219795 - DNA, 19 bp, Homo sapiens
gaactcaatctaaattaaa

SEQ ID NO: 4219796 - DNA, 21 bp, Homo sapiens
gaactgtgatggggtgggcag

SEQ ID NO: 4219797 - DNA, 21 bp, Homo sapiens
gaagaaaaagacctgcatttg

SEQ ID NO: 4219798 - DNA, 21 bp, Homo sapiens
gaagaattattcagtgaattt

SEQ ID NO: 4219799 - DNA, 22 bp, Homo sapiens
gaagaattattcagtgaatttg

SEQ ID NO: 4219800 - DNA, 23 bp, Homo sapiens
gaagaattgaacccaggaggtgg

SEQ ID NO: 4219801 - DNA, 21 bp, Homo sapiens
gaagaattttcagaccccagc

SEQ ID NO: 4219802 - DNA, 21 bp, Homo sapiens
gaagatgtatgctttgaatgc

SEQ ID NO: 4219803 - DNA, 16 bp, Homo sapiens
gaagcagtgagccgca

SEQ ID NO: 4219804 - DNA, 22 bp, Homo sapiens
gaagggggccacagcctgggtg

SEQ ID NO: 4219805 - DNA, 15 bp, Homo sapiens
gaagtctaggagctg

SEQ ID NO: 4219806 - DNA, 20 bp, Homo sapiens
gaagtgatttagttgtggaa

SEQ ID NO: 4219807 - DNA, 19 bp, Homo sapiens
gaagtgggccaggacaggc

SEQ ID NO: 4219808 - DNA, 14 bp, Homo sapiens
gaagtttaaaaccc

SEQ ID NO: 4219809 - DNA, 15 bp, Homo sapiens
gaagtttaaaaccca

SEQ ID NO: 4219810 - DNA, 23 bp, Homo sapiens
gaatcagaccctaccccaccacg

SEQ ID NO: 4219811 - DNA, 19 bp, Homo sapiens
gaatcagacttcacactgc

SEQ ID NO: 4219812 - DNA, 16 bp, Homo sapiens
gaatgatttccaaaga

SEQ ID NO: 4219813 - DNA, 12 bp, Homo sapiens
gaatgtattttg

SEQ ID NO: 4219814 - DNA, 16 bp, Homo sapiens
gaatgttaaagtcagt

SEQ ID NO: 4219815 - DNA, 16 bp, Homo sapiens
gaattgaacccaggag

SEQ ID NO: 4219816 - DNA, 17 bp, Homo sapiens
gaattggtcttaatgtt

SEQ ID NO: 4219817 - DNA, 20 bp, Homo sapiens
gaattggtcttaatgttgaa

SEQ ID NO: 4219818 - DNA, 23 bp, Homo sapiens
gaattgtccccagtttgcagaaa

SEQ ID NO: 4219819 - DNA, 20 bp, Homo sapiens
gacacctgcacctcccccca

SEQ ID NO: 4219820 - DNA, 22 bp, Homo sapiens
gacacctgcacctccccccact

SEQ ID NO: 4219821 - DNA, 22 bp, Homo sapiens
gacagaccggggttcaagccat

SEQ ID NO: 4219822 - DNA, 15 bp, Homo sapiens
gacagaggttttgaa

SEQ ID NO: 4219823 - DNA, 19 bp, Homo sapiens
gacagatctctgctttgga

SEQ ID NO: 4219824 - DNA, 21 bp, Homo sapiens
gacagatctctgctttggaaa

SEQ ID NO: 4219825 - DNA, 23 bp, Homo sapiens
gacagatctctgctttggaaatc

SEQ ID NO: 4219826 - DNA, 15 bp, Homo sapiens
gacagatggaccaaa

SEQ ID NO: 4219827 - DNA, 18 bp, Homo sapiens
gacagatggaccaaaaga

SEQ ID NO: 4219828 - DNA, 18 bp, Homo sapiens
gacagctgtccctgtcac

SEQ ID NO: 4219829 - DNA, 22 bp, Homo sapiens
gacagctgtccctgtcaccaag

SEQ ID NO: 4219830 - DNA, 12 bp, Homo sapiens
gacaggagaaat

SEQ ID NO: 4219831 - DNA, 24 bp, Homo sapiens
gacaggagaaatgcatccattcct

SEQ ID NO: 4219832 - DNA, 22 bp, Homo sapiens
gacaggaggtatgacctgggtg

SEQ ID NO: 4219833 - DNA, 22 bp, Homo sapiens
gacagtgaattgacccatgttc

SEQ ID NO: 4219834 - DNA, 17 bp, Homo sapiens
gacatagtggatggaca

SEQ ID NO: 4219835 - DNA, 20 bp, Homo sapiens
gacatagtggatggacagat

SEQ ID NO: 4219836 - DNA, 21 bp, Homo sapiens
gacatagtggatggacagatg

SEQ ID NO: 4219837 - DNA, 21 bp, Homo sapiens
gacatcaaatttgccaccact

SEQ ID NO: 4219838 - DNA, 23 bp, Homo sapiens
gaccaaaaaccaaaagtgcattc

SEQ ID NO: 4219839 - DNA, 22 bp, Homo sapiens
gaccaacatggagaaaccctgt

SEQ ID NO: 4219840 - DNA, 14 bp, Homo sapiens
gaccaacctgacca

SEQ ID NO: 4219841 - DNA, 14 bp, Homo sapiens
gacccagtccctgg

SEQ ID NO: 4219842 - DNA, 23 bp, Homo sapiens
gacccccactctcattccccagg

SEQ ID NO: 4219843 - DNA, 14 bp, Homo sapiens
gaccctttccttcc

SEQ ID NO: 4219844 - DNA, 15 bp, Homo sapiens
gaccggtacagaaag

SEQ ID NO: 4219845 - DNA, 11 bp, Homo sapiens
gacctcagcca

SEQ ID NO: 4219846 - DNA, 14 bp, Homo sapiens
gacctcccagccct

SEQ ID NO: 4219847 - DNA, 19 bp, Homo sapiens
gacctcgtcctccccctgc

SEQ ID NO: 4219848 - DNA, 21 bp, Homo sapiens
gacctcgtcctccccctgcca

SEQ ID NO: 4219849 - DNA, 18 bp, Homo sapiens
gacctctgcaagacaaag

SEQ ID NO: 4219850 - DNA, 12 bp, Homo sapiens
gactcacccaag

SEQ ID NO: 4219851 - DNA, 15 bp, Homo sapiens
gactcacctctgcct

SEQ ID NO: 4219852 - DNA, 15 bp, Homo sapiens
gactcctttcctctg

SEQ ID NO: 4219853 - DNA, 14 bp, Homo sapiens
gactgccaaagaag

SEQ ID NO: 4219854 - DNA, 18 bp, Homo sapiens
gactgccccaactcctgg

SEQ ID NO: 4219855 - DNA, 13 bp, Homo sapiens
gacttcacactgc

SEQ ID NO: 4219856 - DNA, 11 bp, Homo sapiens
gactttcctct

SEQ ID NO: 4219857 - DNA, 18 bp, Homo sapiens
gagaaagaccatgcattt

SEQ ID NO: 4219858 - DNA, 21 bp, Homo sapiens
gagaagaattttcagacccca

SEQ ID NO: 4219859 - DNA, 14 bp, Homo sapiens
gagaagcagtgagc

SEQ ID NO: 4219860 - DNA, 18 bp, Homo sapiens
gagaagcagtgagccgca

SEQ ID NO: 4219861 - DNA, 14 bp, Homo sapiens
gagaaggaaggaga

SEQ ID NO: 4219862 - DNA, 13 bp, Homo sapiens
gagaaggcaggaa

SEQ ID NO: 4219863 - DNA, 23 bp, Homo sapiens
gagaaggcaggaatgtgtggcag

SEQ ID NO: 4219864 - DNA, 18 bp, Homo sapiens
gagacacctgcacctccc

SEQ ID NO: 4219865 - DNA, 19 bp, Homo sapiens
gagacacctgcacctcccc

SEQ ID NO: 4219866 - DNA, 20 bp, Homo sapiens
gagacacctgcacctccccc

SEQ ID NO: 4219867 - DNA, 20 bp, Homo sapiens
gagacaggaaaatcctctgg

SEQ ID NO: 4219868 - DNA, 21 bp, Homo sapiens
gagacaggaaaatcctctggc

SEQ ID NO: 4219869 - DNA, 14 bp, Homo sapiens
gagaccaacctgac

SEQ ID NO: 4219870 - DNA, 14 bp, Homo sapiens
gagacccaaggagg

SEQ ID NO: 4219871 - DNA, 11 bp, Homo sapiens
gagacctcagc

SEQ ID NO: 4219872 - DNA, 16 bp, Homo sapiens
gagactcacctctgcc

SEQ ID NO: 4219873 - DNA, 20 bp, Homo sapiens
gagactcacctctgcctcaa

SEQ ID NO: 4219874 - DNA, 17 bp, Homo sapiens
gagagcctgctccccca

SEQ ID NO: 4219875 - DNA, 21 bp, Homo sapiens
gagagcctgctcccccacccc

SEQ ID NO: 4219876 - DNA, 21 bp, Homo sapiens
gagagtagccgagagcctgct

SEQ ID NO: 4219877 - DNA, 16 bp, Homo sapiens
gagatatggcagcgaa

SEQ ID NO: 4219878 - DNA, 17 bp, Homo sapiens
gagatatggcagcgaaa

SEQ ID NO: 4219879 - DNA, 22 bp, Homo sapiens
gagatatttatggggggagaac

SEQ ID NO: 4219880 - DNA, 22 bp, Homo sapiens
gagatcgtgccgttactctcca

SEQ ID NO: 4219881 - DNA, 15 bp, Homo sapiens
gagatgcctccaccg

SEQ ID NO: 4219882 - DNA, 19 bp, Homo sapiens
gagatgcctccaccgctgc

SEQ ID NO: 4219883 - DNA, 20 bp, Homo sapiens
gagatgcctccaccgctgcc

SEQ ID NO: 4219884 - DNA, 21 bp, Homo sapiens
gagcactttattctcctccga

SEQ ID NO: 4219885 - DNA, 14 bp, Homo sapiens
gagccaccagcccc

SEQ ID NO: 4219886 - DNA, 13 bp, Homo sapiens
gagccagccctcc

SEQ ID NO: 4219887 - DNA, 15 bp, Homo sapiens
gagccagccctccct

SEQ ID NO: 4219888 - DNA, 16 bp, Homo sapiens
gagccagccctccctg

SEQ ID NO: 4219889 - DNA, 19 bp, Homo sapiens
gagccagccctccctgtcc

SEQ ID NO: 4219890 - DNA, 19 bp, Homo sapiens
gagcctgctcccccacccc

SEQ ID NO: 4219891 - DNA, 16 bp, Homo sapiens
gagcgtgtgcggctcc

SEQ ID NO: 4219892 - DNA, 18 bp, Homo sapiens
gagctagcgctgccgcac

SEQ ID NO: 4219893 - DNA, 21 bp, Homo sapiens
gagctcagacccccactctca

SEQ ID NO: 4219894 - DNA, 16 bp, Homo sapiens
gagctgggaggaaaag

SEQ ID NO: 4219895 - DNA, 23 bp, Homo sapiens
gaggcagaagaattgaacccagg

SEQ ID NO: 4219896 - DNA, 23 bp, Homo sapiens
gaggcagggccttgcccagagat

SEQ ID NO: 4219897 - DNA, 15 bp, Homo sapiens
gaggcaggggcggag

SEQ ID NO: 4219898 - DNA, 17 bp, Homo sapiens
gaggctggaggcagggc

SEQ ID NO: 4219899 - DNA, 19 bp, Homo sapiens
gaggctggaggcagggcct

SEQ ID NO: 4219900 - DNA, 22 bp, Homo sapiens
gaggcttcttcagatcagtgct

SEQ ID NO: 4219901 - DNA, 16 bp, Homo sapiens
gagggcagaggctgga

SEQ ID NO: 4219902 - DNA, 24 bp, Homo sapiens
gagggtctggagaagcagtgagcc

SEQ ID NO: 4219903 - DNA, 20 bp, Homo sapiens
gaggtcgggagttcgagacc

SEQ ID NO: 4219904 - DNA, 18 bp, Homo sapiens
gagtagccgagagcctgc

SEQ ID NO: 4219905 - DNA, 20 bp, Homo sapiens
gagtcaatcccctcattcag

SEQ ID NO: 4219906 - DNA, 14 bp, Homo sapiens
gagtgtgcagactg

SEQ ID NO: 4219907 - DNA, 15 bp, Homo sapiens
gatcagagcattgtg

SEQ ID NO: 4219908 - DNA, 13 bp, Homo sapiens
gatccacattgtt

SEQ ID NO: 4219909 - DNA, 19 bp, Homo sapiens
gatccaccctcaaatgtca

SEQ ID NO: 4219910 - DNA, 23 bp, Homo sapiens
gatcctaatgaatgcataaaatg

SEQ ID NO: 4219911 - DNA, 23 bp, Homo sapiens
gatcgtgccgttactctccaacc

SEQ ID NO: 4219912 - DNA, 12 bp, Homo sapiens
gatctccctgcc

SEQ ID NO: 4219913 - DNA, 15 bp, Homo sapiens
gatctccctgccgcc

SEQ ID NO: 4219914 - DNA, 20 bp, Homo sapiens
gatctccctgccgcctcaat

SEQ ID NO: 4219915 - DNA, 23 bp, Homo sapiens
gatctgggaccctttccttcctt

SEQ ID NO: 4219916 - DNA, 23 bp, Homo sapiens
gatgcatgtggtttggttcctct

SEQ ID NO: 4219917 - DNA, 12 bp, Homo sapiens
gatgccatgttt

SEQ ID NO: 4219918 - DNA, 13 bp, Homo sapiens
gatgcccccccag

SEQ ID NO: 4219919 - DNA, 12 bp, Homo sapiens
gatgcctccacc

SEQ ID NO: 4219920 - DNA, 18 bp, Homo sapiens
gatggggtgggcagggct

SEQ ID NO: 4219921 - DNA, 16 bp, Homo sapiens
gatgtaaacagtgcct

SEQ ID NO: 4219922 - DNA, 19 bp, Homo sapiens
gatgtaaacagtgcctgct

SEQ ID NO: 4219923 - DNA, 20 bp, Homo sapiens
gatgtaaacagtgcctgctg

SEQ ID NO: 4219924 - DNA, 13 bp, Homo sapiens
gatgtggccctgg

SEQ ID NO: 4219925 - DNA, 17 bp, Homo sapiens
gattattctgattccac

SEQ ID NO: 4219926 - DNA, 16 bp, Homo sapiens
gattatttctgtattt

SEQ ID NO: 4219927 - DNA, 23 bp, Homo sapiens
gattgatcagagcattgtgcaat

SEQ ID NO: 4219928 - DNA, 14 bp, Homo sapiens
gattttgaattaga

SEQ ID NO: 4219929 - DNA, 24 bp, Homo sapiens
gcaaccccagttctgctcctctcc

SEQ ID NO: 4219930 - DNA, 12 bp, Homo sapiens
gcaacttgtgaa

SEQ ID NO: 4219931 - DNA, 16 bp, Homo sapiens
gcaacttgtgaactcc

SEQ ID NO: 4219932 - DNA, 22 bp, Homo sapiens
gcaagattttccacaagattcc

SEQ ID NO: 4219933 - DNA, 21 bp, Homo sapiens
gcaaggccgctgttcacccac

SEQ ID NO: 4219934 - DNA, 17 bp, Homo sapiens
gcacaaagcagtttttc

SEQ ID NO: 4219935 - DNA, 17 bp, Homo sapiens
gcacctccccccactgc

SEQ ID NO: 4219936 - DNA, 18 bp, Homo sapiens
gcacctccccccactgca

SEQ ID NO: 4219937 - DNA, 21 bp, Homo sapiens
gcacctccccccactgcaggc

SEQ ID NO: 4219938 - DNA, 22 bp, Homo sapiens
gcacctgcatccgtagttccct

SEQ ID NO: 4219939 - DNA, 21 bp, Homo sapiens
gcacctgccgacctcgtcctc

SEQ ID NO: 4219940 - DNA, 15 bp, Homo sapiens
gcagaaaagcacctg

SEQ ID NO: 4219941 - DNA, 22 bp, Homo sapiens
gcagaggctggaggcagggcct

SEQ ID NO: 4219942 - DNA, 23 bp, Homo sapiens
gcagatttagtgaaagctagaga

SEQ ID NO: 4219943 - DNA, 15 bp, Homo sapiens
gcagccagcccagcc

SEQ ID NO: 4219944 - DNA, 17 bp, Homo sapiens
gcagccagcccagccca

SEQ ID NO: 4219945 - DNA, 18 bp, Homo sapiens
gcagccctcctcaccccg

SEQ ID NO: 4219946 - DNA, 19 bp, Homo sapiens
gcatatttttctaaagaaa

SEQ ID NO: 4219947 - DNA, 16 bp, Homo sapiens
gcatccattcctcagg

SEQ ID NO: 4219948 - DNA, 18 bp, Homo sapiens
gcatccattcctcaggga

SEQ ID NO: 4219949 - DNA, 19 bp, Homo sapiens
gcatccgtagttccctgaa

SEQ ID NO: 4219950 - DNA, 16 bp, Homo sapiens
gcatccttcctataac

SEQ ID NO: 4219951 - DNA, 13 bp, Homo sapiens
gcatcttctccat

SEQ ID NO: 4219952 - DNA, 23 bp, Homo sapiens
gcatgctctctgcagccagccca

SEQ ID NO: 4219953 - DNA, 19 bp, Homo sapiens
gcatggtggcgcaagcctg

SEQ ID NO: 4219954 - DNA, 15 bp, Homo sapiens
gcatgtaggagaatc

SEQ ID NO: 4219955 - DNA, 20 bp, Homo sapiens
gcatgtggtttggttcctct

SEQ ID NO: 4219956 - DNA, 18 bp, Homo sapiens
gcatttgttctttgccag

SEQ ID NO: 4219957 - DNA, 11 bp, Homo sapiens
gccaagaggaa

SEQ ID NO: 4219958 - DNA, 13 bp, Homo sapiens
gccaagaggaaaa

SEQ ID NO: 4219959 - DNA, 16 bp, Homo sapiens
gccacgtgccaggccc

SEQ ID NO: 4219960 - DNA, 22 bp, Homo sapiens
gccactcccctaaactccagga

SEQ ID NO: 4219961 - DNA, 23 bp, Homo sapiens
gccactgcctttcagaagtgatt

SEQ ID NO: 4219962 - DNA, 13 bp, Homo sapiens
gccagatccaccc

SEQ ID NO: 4219963 - DNA, 13 bp, Homo sapiens
gccagcccagccc

SEQ ID NO: 4219964 - DNA, 13 bp, Homo sapiens
gccagccctccct

SEQ ID NO: 4219965 - DNA, 17 bp, Homo sapiens
gccagccctccctgtcc

SEQ ID NO: 4219966 - DNA, 22 bp, Homo sapiens
gccagccctccctgtcctcctc

SEQ ID NO: 4219967 - DNA, 18 bp, Homo sapiens
gccaggcccggggctggc

SEQ ID NO: 4219968 - DNA, 20 bp, Homo sapiens
gccagtgccttacctcctgc

SEQ ID NO: 4219969 - DNA, 23 bp, Homo sapiens
gccagtgccttacctcctgccca

SEQ ID NO: 4219970 - DNA, 20 bp, Homo sapiens
gccatgaggagttgctgttt

SEQ ID NO: 4219971 - DNA, 14 bp, Homo sapiens
gccatttcttcttc

SEQ ID NO: 4219972 - DNA, 16 bp, Homo sapiens
gcccacagctcccacc

SEQ ID NO: 4219973 - DNA, 20 bp, Homo sapiens
gcccagagatgcctccaccg

SEQ ID NO: 4219974 - DNA, 16 bp, Homo sapiens
gcccagcccagctggt

SEQ ID NO: 4219975 - DNA, 10 bp, Homo sapiens
gcccaggaga

SEQ ID NO: 4219976 - DNA, 18 bp, Homo sapiens
gcccaggagagccagccc

SEQ ID NO: 4219977 - DNA, 19 bp, Homo sapiens
gcccaggagagccagccct

SEQ ID NO: 4219978 - DNA, 20 bp, Homo sapiens
gcccaggagagccagccctc

SEQ ID NO: 4219979 - DNA, 17 bp, Homo sapiens
gcccattctctctcctg

SEQ ID NO: 4219980 - DNA, 14 bp, Homo sapiens
gccccaactcctgg

SEQ ID NO: 4219981 - DNA, 15 bp, Homo sapiens
gccccaactcctgga

SEQ ID NO: 4219982 - DNA, 16 bp, Homo sapiens
gccccaactcctggaa

SEQ ID NO: 4219983 - DNA, 15 bp, Homo sapiens
gccccatgtctctca

SEQ ID NO: 4219984 - DNA, 18 bp, Homo sapiens
gcccccaccctcagcccg

SEQ ID NO: 4219985 - DNA, 20 bp, Homo sapiens
gccccgcttgtccagcgcct

SEQ ID NO: 4219986 - DNA, 13 bp, Homo sapiens
gcccctcctctgc

SEQ ID NO: 4219987 - DNA, 18 bp, Homo sapiens
gcccctcctctgccacct

SEQ ID NO: 4219988 - DNA, 11 bp, Homo sapiens
gcccctgtaaa

SEQ ID NO: 4219989 - DNA, 16 bp, Homo sapiens
gcccgctgctcacttt

SEQ ID NO: 4219990 - DNA, 13 bp, Homo sapiens
gccctatggatgt

SEQ ID NO: 4219991 - DNA, 21 bp, Homo sapiens
gccctccctgtcctcctcgga

SEQ ID NO: 4219992 - DNA, 12 bp, Homo sapiens
gccctgacctcc

SEQ ID NO: 4219993 - DNA, 13 bp, Homo sapiens
gccctgacctccc

SEQ ID NO: 4219994 - DNA, 17 bp, Homo sapiens
gccctgacctcccagcc

SEQ ID NO: 4219995 - DNA, 19 bp, Homo sapiens
gccctgacctcccagccct

SEQ ID NO: 4219996 - DNA, 18 bp, Homo sapiens
gccctggatttcagaaag

SEQ ID NO: 4219997 - DNA, 17 bp, Homo sapiens
gccctggcctgctgggc

SEQ ID NO: 4219998 - DNA, 21 bp, Homo sapiens
gccctgggtctaaggggttgg

SEQ ID NO: 4219999 - DNA, 14 bp, Homo sapiens
gcccttgccctgac

SEQ ID NO: 4220000 - DNA, 20 bp, Homo sapiens
gccgacctcgtcctccccct

SEQ ID NO: 4220001 - DNA, 12 bp, Homo sapiens
gccgagagcctg

SEQ ID NO: 4220002 - DNA, 19 bp, Homo sapiens
gccgagagcctgctccccc

SEQ ID NO: 4220003 - DNA, 22 bp, Homo sapiens
gccgagagcctgctcccccacc

SEQ ID NO: 4220004 - DNA, 23 bp, Homo sapiens
gccgcaccccagagtgtgggaag

SEQ ID NO: 4220005 - DNA, 20 bp, Homo sapiens
gccgcatcttctccatctgg

SEQ ID NO: 4220006 - DNA, 14 bp, Homo sapiens
gccgcattccctga

SEQ ID NO: 4220007 - DNA, 11 bp, Homo sapiens
gccggcaaccc

SEQ ID NO: 4220008 - DNA, 18 bp, Homo sapiens
gccggcaaccccagttct

SEQ ID NO: 4220009 - DNA, 17 bp, Homo sapiens
gccggtcacccaggctc

SEQ ID NO: 4220010 - DNA, 15 bp, Homo sapiens
gccggtgtaaatatg

SEQ ID NO: 4220011 - DNA, 18 bp, Homo sapiens
gccgttactctccaacct

SEQ ID NO: 4220012 - DNA, 22 bp, Homo sapiens
gcctatgtgcatgcagcatcta

SEQ ID NO: 4220013 - DNA, 15 bp, Homo sapiens
gcctcacagaagaat

SEQ ID NO: 4220014 - DNA, 18 bp, Homo sapiens
gcctccaccgctgcctaa

SEQ ID NO: 4220015 - DNA, 17 bp, Homo sapiens
gcctgccaccctcctgc

SEQ ID NO: 4220016 - DNA, 13 bp, Homo sapiens
gcctgctccccca

SEQ ID NO: 4220017 - DNA, 16 bp, Homo sapiens
gcctgctcccccaccc

SEQ ID NO: 4220018 - DNA, 17 bp, Homo sapiens
gcctgctcccccacccc

SEQ ID NO: 4220019 - DNA, 13 bp, Homo sapiens
gcctgctgggctc

SEQ ID NO: 4220020 - DNA, 19 bp, Homo sapiens
gcctgctgggctctccacc

SEQ ID NO: 4220021 - DNA, 22 bp, Homo sapiens
gcctgctgggctctccacctca

SEQ ID NO: 4220022 - DNA, 16 bp, Homo sapiens
gcctgggtggggctgc

SEQ ID NO: 4220023 - DNA, 20 bp, Homo sapiens
gcctgggtggggctgctcct

SEQ ID NO: 4220024 - DNA, 22 bp, Homo sapiens
gcctgggtggggctgctcctcc

SEQ ID NO: 4220025 - DNA, 23 bp, Homo sapiens
gcctgggtggggctgctcctcca

SEQ ID NO: 4220026 - DNA, 24 bp, Homo sapiens
gcctgggtggggctgctcctccag

SEQ ID NO: 4220027 - DNA, 15 bp, Homo sapiens
gcctgtaatcccagc

SEQ ID NO: 4220028 - DNA, 16 bp, Homo sapiens
gcctgtaatcccagca

SEQ ID NO: 4220029 - DNA, 18 bp, Homo sapiens
gcctgtaatcccagcagt

SEQ ID NO: 4220030 - DNA, 16 bp, Homo sapiens
gcctgtaatcccagct

SEQ ID NO: 4220031 - DNA, 19 bp, Homo sapiens
gcctgtaatcccagctact

SEQ ID NO: 4220032 - DNA, 18 bp, Homo sapiens
gcctgtgaggcaggggcg

SEQ ID NO: 4220033 - DNA, 17 bp, Homo sapiens
gccttacctcctgccca

SEQ ID NO: 4220034 - DNA, 18 bp, Homo sapiens
gccttacctcctgcccag

SEQ ID NO: 4220035 - DNA, 19 bp, Homo sapiens
gccttacctcctgcccagg

SEQ ID NO: 4220036 - DNA, 18 bp, Homo sapiens
ttgtggaaagataataaa

SEQ ID NO: 4220037 - DNA, 11 bp, Homo sapiens
ttgtggcagag

SEQ ID NO: 4220038 - DNA, 12 bp, Homo sapiens
ttgttctttgcc

SEQ ID NO: 4220039 - DNA, 13 bp, Homo sapiens
ttgttctttgcca

SEQ ID NO: 4220040 - DNA, 19 bp, Homo sapiens
ttgttgcaagtactgctgt

SEQ ID NO: 4220041 - DNA, 14 bp, Homo sapiens
tttaaaaaataaat

SEQ ID NO: 4220042 - DNA, 17 bp, Homo sapiens
tttaaaaaataaatata

SEQ ID NO: 4220043 - DNA, 22 bp, Homo sapiens
tttaaaaacatgagaaatgtga

SEQ ID NO: 4220044 - DNA, 23 bp, Homo sapiens
tttaaaaacatgagaaatgtgaa

SEQ ID NO: 4220045 - DNA, 17 bp, Homo sapiens
tttaaaacccaaacttc

SEQ ID NO: 4220046 - DNA, 22 bp, Homo sapiens
tttaaaataaggataataatca

SEQ ID NO: 4220047 - DNA, 23 bp, Homo sapiens
tttaaaattaaaaaaaagaagag

SEQ ID NO: 4220048 - DNA, 18 bp, Homo sapiens
tttaaataaattgtgaaa

SEQ ID NO: 4220049 - DNA, 17 bp, Homo sapiens
tttaaccataaatcaat

SEQ ID NO: 4220050 - DNA, 20 bp, Homo sapiens
tttaaccataaatcaattca

SEQ ID NO: 4220051 - DNA, 12 bp, Homo sapiens
tttactgaatgt

SEQ ID NO: 4220052 - DNA, 12 bp, Homo sapiens
tttactttgaac

SEQ ID NO: 4220053 - DNA, 14 bp, Homo sapiens
tttataaactgaga

SEQ ID NO: 4220054 - DNA, 17 bp, Homo sapiens
tttataaactgagaggt

SEQ ID NO: 4220055 - DNA, 12 bp, Homo sapiens
tttataccaaag

SEQ ID NO: 4220056 - DNA, 19 bp, Homo sapiens
tttatgatttaaaaaataa

SEQ ID NO: 4220057 - DNA, 11 bp, Homo sapiens
tttcacatgga

SEQ ID NO: 4220058 - DNA, 23 bp, Homo sapiens
tttcacatggactttggaaaata

SEQ ID NO: 4220059 - DNA, 21 bp, Homo sapiens
tttcagaaagaagtggggaca

SEQ ID NO: 4220060 - DNA, 14 bp, Homo sapiens
tttcagaagtgatt

SEQ ID NO: 4220061 - DNA, 22 bp, Homo sapiens
tttcagtcaattctgatgttac

SEQ ID NO: 4220062 - DNA, 18 bp, Homo sapiens
tttccaatcacagtgtta

SEQ ID NO: 4220063 - DNA, 22 bp, Homo sapiens
tttccacaagattcccagagac

SEQ ID NO: 4220064 - DNA, 16 bp, Homo sapiens
tttcccttcttgcatc

SEQ ID NO: 4220065 - DNA, 18 bp, Homo sapiens
tttccttccttccctggc

SEQ ID NO: 4220066 - DNA, 18 bp, Homo sapiens
tttccttgtggcagagga

SEQ ID NO: 4220067 - DNA, 12 bp, Homo sapiens
tttcctttgcat

SEQ ID NO: 4220068 - DNA, 23 bp, Homo sapiens
tttctacagagaaaatgaatttg

SEQ ID NO: 4220069 - DNA, 15 bp, Homo sapiens
tttctctttgccatt

SEQ ID NO: 4220070 - DNA, 18 bp, Homo sapiens
tttcttccccttcctctc

SEQ ID NO: 4220071 - DNA, 13 bp, Homo sapiens
tttgaaaaaactt

SEQ ID NO: 4220072 - DNA, 15 bp, Homo sapiens
tttgaatgcaaaaga

SEQ ID NO: 4220073 - DNA, 20 bp, Homo sapiens
tttgaattagattatttctg

SEQ ID NO: 4220074 - DNA, 22 bp, Homo sapiens
tttgcaacagtaatcagagtta

SEQ ID NO: 4220075 - DNA, 10 bp, Homo sapiens
tttgcattca

SEQ ID NO: 4220076 - DNA, 19 bp, Homo sapiens
tttgccaccactagagctg

SEQ ID NO: 4220077 - DNA, 19 bp, Homo sapiens
tttgccttgggcctttcat

SEQ ID NO: 4220078 - DNA, 21 bp, Homo sapiens
tttggaaaatatttttttcct

SEQ ID NO: 4220079 - DNA, 13 bp, Homo sapiens
tttggttcctctc

SEQ ID NO: 4220080 - DNA, 15 bp, Homo sapiens
tttggttcctctctg

SEQ ID NO: 4220081 - DNA, 18 bp, Homo sapiens
tttgtacagtggagaaat

SEQ ID NO: 4220082 - DNA, 12 bp, Homo sapiens
tttgtgaagaat

SEQ ID NO: 4220083 - DNA, 13 bp, Homo sapiens
tttgtgaatttgc

SEQ ID NO: 4220084 - DNA, 19 bp, Homo sapiens
tttgttagactagtttctt

SEQ ID NO: 4220085 - DNA, 13 bp, Homo sapiens
tttgttctttgcc

SEQ ID NO: 4220086 - DNA, 13 bp, Homo sapiens
ttttaaaaaattt

SEQ ID NO: 4220087 - DNA, 19 bp, Homo sapiens
ttttaaaaacatgagaaat

SEQ ID NO: 4220088 - DNA, 20 bp, Homo sapiens
ttttaaaccctattggtaaa

SEQ ID NO: 4220089 - DNA, 22 bp, Homo sapiens
ttttaaagtatgttattgcata

SEQ ID NO: 4220090 - DNA, 14 bp, Homo sapiens
ttttaaatatgaac

SEQ ID NO: 4220091 - DNA, 16 bp, Homo sapiens
ttttaactctggattt

SEQ ID NO: 4220092 - DNA, 13 bp, Homo sapiens
ttttactttgaac

SEQ ID NO: 4220093 - DNA, 12 bp, Homo sapiens
ttttagatgtta

SEQ ID NO: 4220094 - DNA, 16 bp, Homo sapiens
ttttcagactcagact

SEQ ID NO: 4220095 - DNA, 14 bp, Homo sapiens
ttttccaatcacag

SEQ ID NO: 4220096 - DNA, 23 bp, Homo sapiens
ttttccccggtcccttgagacct

SEQ ID NO: 4220097 - DNA, 15 bp, Homo sapiens
ttttctaaagaaata

SEQ ID NO: 4220098 - DNA, 21 bp, Homo sapiens
ttttgaattagattatttctg

SEQ ID NO: 4220099 - DNA, 23 bp, Homo sapiens
ttttggttgctgatgtttataaa

SEQ ID NO: 4220100 - DNA, 15 bp, Homo sapiens
tttttaaatttcagt

SEQ ID NO: 4220101 - DNA, 20 bp, Homo sapiens
tttttcatttttgccagtct

SEQ ID NO: 4220102 - DNA, 18 bp, Homo sapiens
tgtgtccttgcacctgca

SEQ ID NO: 4220103 - DNA, 19 bp, Homo sapiens
tgtgtccttgcacctgcat

SEQ ID NO: 4220104 - DNA, 21 bp, Homo sapiens
tgtgtttgccttgggcctttc

SEQ ID NO: 4220105 - DNA, 15 bp, Homo sapiens
tgttactgagatgtt

SEQ ID NO: 4220106 - DNA, 17 bp, Homo sapiens
tgttagactagtttctt

SEQ ID NO: 4220107 - DNA, 17 bp, Homo sapiens
tgtttcaccctgtccct

SEQ ID NO: 4220108 - DNA, 18 bp, Homo sapiens
tgtttcaccctgtccctc

SEQ ID NO: 4220109 - DNA, 21 bp, Homo sapiens
tgtttgacaaagaaacccaag

SEQ ID NO: 4220110 - DNA, 13 bp, Homo sapiens
tgtttgagctcag

SEQ ID NO: 4220111 - DNA, 20 bp, Homo sapiens
ttaaaaaactgacaggcact

SEQ ID NO: 4220112 - DNA, 23 bp, Homo sapiens
ttaaaaaactgacaggcactata

SEQ ID NO: 4220113 - DNA, 11 bp, Homo sapiens
ttaaaaaagaa

SEQ ID NO: 4220114 - DNA, 19 bp, Homo sapiens
ttaaaaaataaatataatt

SEQ ID NO: 4220115 - DNA, 18 bp, Homo sapiens
ttaaaaacatgagaaatg

SEQ ID NO: 4220116 - DNA, 19 bp, Homo sapiens
ttaaaaacatgagaaatgt

SEQ ID NO: 4220117 - DNA, 16 bp, Homo sapiens
ttaaaacacagaaact

SEQ ID NO: 4220118 - DNA, 13 bp, Homo sapiens
ttaaaacccaaac

SEQ ID NO: 4220119 - DNA, 15 bp, Homo sapiens
ttaaaagcaaaaaga

SEQ ID NO: 4220120 - DNA, 19 bp, Homo sapiens
ttaaaagcaaaaagatgta

SEQ ID NO: 4220121 - DNA, 20 bp, Homo sapiens
ttaaaatcactgtcaatatt

SEQ ID NO: 4220122 - DNA, 14 bp, Homo sapiens
ttaaaatccagtat

SEQ ID NO: 4220123 - DNA, 16 bp, Homo sapiens
ttaaaatccagtatta

SEQ ID NO: 4220124 - DNA, 18 bp, Homo sapiens
ttaaagtatgttattgca

SEQ ID NO: 4220125 - DNA, 20 bp, Homo sapiens
ttaacgtttctcattaaaat

SEQ ID NO: 4220126 - DNA, 14 bp, Homo sapiens
ttaactctggattt

SEQ ID NO: 4220127 - DNA, 18 bp, Homo sapiens
ttaatgttgaatgtattt

SEQ ID NO: 4220128 - DNA, 17 bp, Homo sapiens
ttaatttgtatgctaaa

SEQ ID NO: 4220129 - DNA, 13 bp, Homo sapiens
ttaatttgtgaat

SEQ ID NO: 4220130 - DNA, 20 bp, Homo sapiens
ttacaaacatggaaaacaga

SEQ ID NO: 4220131 - DNA, 20 bp, Homo sapiens
ttacacctgttatggaaaat

SEQ ID NO: 4220132 - DNA, 13 bp, Homo sapiens
ttaccaaaacagg

SEQ ID NO: 4220133 - DNA, 13 bp, Homo sapiens
ttacctcctgccc

SEQ ID NO: 4220134 - DNA, 15 bp, Homo sapiens
ttacctcctgcccag

SEQ ID NO: 4220135 - DNA, 19 bp, Homo sapiens
ttacctcctgcccaggaga

SEQ ID NO: 4220136 - DNA, 21 bp, Homo sapiens
ttactatcatgtcaaacgtga

SEQ ID NO: 4220137 - DNA, 12 bp, Homo sapiens
ttactgagatgt

SEQ ID NO: 4220138 - DNA, 18 bp, Homo sapiens
ttactttaatttccttga

SEQ ID NO: 4220139 - DNA, 16 bp, Homo sapiens
ttagattccaggatca

SEQ ID NO: 4220140 - DNA, 15 bp, Homo sapiens
ttagtaaatatgtga

SEQ ID NO: 4220141 - DNA, 16 bp, Homo sapiens
ttagtaaatatgtgaa

SEQ ID NO: 4220142 - DNA, 20 bp, Homo sapiens
ttagtaaatatgtgaagaaa

SEQ ID NO: 4220143 - DNA, 23 bp, Homo sapiens
ttataaaagaataaaattgcact

SEQ ID NO: 4220144 - DNA, 14 bp, Homo sapiens
ttataaactgagag

SEQ ID NO: 4220145 - DNA, 21 bp, Homo sapiens
ttatgacagaggttttgaaat

SEQ ID NO: 4220146 - DNA, 23 bp, Homo sapiens
ttatgcttgtgtatatgtataaa

SEQ ID NO: 4220147 - DNA, 20 bp, Homo sapiens
ttatgtgaaatgcttatgct

SEQ ID NO: 4220148 - DNA, 14 bp, Homo sapiens
ttattcatttgagt

SEQ ID NO: 4220149 - DNA, 13 bp, Homo sapiens
ttattctttttaa

SEQ ID NO: 4220150 - DNA, 16 bp, Homo sapiens
ttattctttttaaagt

SEQ ID NO: 4220151 - DNA, 14 bp, Homo sapiens
ttattgagctctat

SEQ ID NO: 4220152 - DNA, 12 bp, Homo sapiens
ttattgctgttg

SEQ ID NO: 4220153 - DNA, 20 bp, Homo sapiens
ttattggcctgctaatagct

SEQ ID NO: 4220154 - DNA, 17 bp, Homo sapiens
ttcaaccttaccaaaaa

SEQ ID NO: 4220155 - DNA, 12 bp, Homo sapiens
ttcaagccatgg

SEQ ID NO: 4220156 - DNA, 22 bp, Homo sapiens
ttcaagtgcatgctctctgcag

SEQ ID NO: 4220157 - DNA, 21 bp, Homo sapiens
ttcacactgcaagagccttgg

SEQ ID NO: 4220158 - DNA, 10 bp, Homo sapiens
ttcacatgga

SEQ ID NO: 4220159 - DNA, 19 bp, Homo sapiens
ttcaccctgtccctctaat

SEQ ID NO: 4220160 - DNA, 15 bp, Homo sapiens
ttcagaaagaagtgg

SEQ ID NO: 4220161 - DNA, 13 bp, Homo sapiens
ttcagaccccagc

SEQ ID NO: 4220162 - DNA, 15 bp, Homo sapiens
ttcagaccccagcgg

SEQ ID NO: 4220163 - DNA, 21 bp, Homo sapiens
ttcagatgggaggaaagagag

SEQ ID NO: 4220164 - DNA, 18 bp, Homo sapiens
ttcagcccctcctctgcc

SEQ ID NO: 4220165 - DNA, 23 bp, Homo sapiens
ttcagcccctcctctgccacctc

SEQ ID NO: 4220166 - DNA, 13 bp, Homo sapiens
ttcagtgaatttg

SEQ ID NO: 4220167 - DNA, 14 bp, Homo sapiens
ttcagtgggagaaa

SEQ ID NO: 4220168 - DNA, 13 bp, Homo sapiens
ttcatacatttga

SEQ ID NO: 4220169 - DNA, 14 bp, Homo sapiens
ttccacccctcctc

SEQ ID NO: 4220170 - DNA, 14 bp, Homo sapiens
ttcccaaagcacaa

SEQ ID NO: 4220171 - DNA, 14 bp, Homo sapiens
ttcccagctctccc

SEQ ID NO: 4220172 - DNA, 20 bp, Homo sapiens
ttcccagctctccctctggc

SEQ ID NO: 4220173 - DNA, 15 bp, Homo sapiens
ttcccctcagagctc

SEQ ID NO: 4220174 - DNA, 16 bp, Homo sapiens
ttcccctcagagctct

SEQ ID NO: 4220175 - DNA, 13 bp, Homo sapiens
ttccccttgccct

SEQ ID NO: 4220176 - DNA, 22 bp, Homo sapiens
ttccccttgcccttgccctgac

SEQ ID NO: 4220177 - DNA, 17 bp, Homo sapiens
ttccctgaaaacccaga

SEQ ID NO: 4220178 - DNA, 16 bp, Homo sapiens
ttccctgagtcaccag

SEQ ID NO: 4220179 - DNA, 15 bp, Homo sapiens
ttcctctctccccca

SEQ ID NO: 4220180 - DNA, 13 bp, Homo sapiens
ttcctctgttcta

SEQ ID NO: 4220181 - DNA, 19 bp, Homo sapiens
ttcctcttccccttgccct

SEQ ID NO: 4220182 - DNA, 14 bp, Homo sapiens
ttcctgaagccaga

SEQ ID NO: 4220183 - DNA, 23 bp, Homo sapiens
ttcctgaagccagatccacccta

SEQ ID NO: 4220184 - DNA, 18 bp, Homo sapiens
ttcctgggagaaagacca

SEQ ID NO: 4220185 - DNA, 15 bp, Homo sapiens
ttcctttgcattcat

SEQ ID NO: 4220186 - DNA, 17 bp, Homo sapiens
ttctacagagaaaatga

SEQ ID NO: 4220187 - DNA, 23 bp, Homo sapiens
ttctatcccacccaacagctcag

SEQ ID NO: 4220188 - DNA, 15 bp, Homo sapiens
ttctcactccaccac

SEQ ID NO: 4220189 - DNA, 16 bp, Homo sapiens
ttctctctcctgtcca

SEQ ID NO: 4220190 - DNA, 16 bp, Homo sapiens
ttctgcccaaattatg

SEQ ID NO: 4220191 - DNA, 13 bp, Homo sapiens
ttctgctcctctc

SEQ ID NO: 4220192 - DNA, 14 bp, Homo sapiens
ttctgctcctctcc

SEQ ID NO: 4220193 - DNA, 16 bp, Homo sapiens
ttctgctcctctccag

SEQ ID NO: 4220194 - DNA, 16 bp, Homo sapiens
ttctgttgtaatagtc

SEQ ID NO: 4220195 - DNA, 19 bp, Homo sapiens
ttcttattctcactccacc

SEQ ID NO: 4220196 - DNA, 16 bp, Homo sapiens
ttcttgcatccttcct

SEQ ID NO: 4220197 - DNA, 22 bp, Homo sapiens
ttctttcctcttccccttgccc

SEQ ID NO: 4220198 - DNA, 10 bp, Homo sapiens
ttgaaaaaac

SEQ ID NO: 4220199 - DNA, 16 bp, Homo sapiens
ttgaaaaataaaaacc

SEQ ID NO: 4220200 - DNA, 21 bp, Homo sapiens
ttgaaaaataaaaaccataaa

SEQ ID NO: 4220201 - DNA, 13 bp, Homo sapiens
ttgaatcacagta

SEQ ID NO: 4220202 - DNA, 15 bp, Homo sapiens
ttgaatgtattttgg

SEQ ID NO: 4220203 - DNA, 15 bp, Homo sapiens
ttgaattagattatt

SEQ ID NO: 4220204 - DNA, 14 bp, Homo sapiens
ttgagacctcagcc

SEQ ID NO: 4220205 - DNA, 21 bp, Homo sapiens
ttgatcagagcattgtgcaat

SEQ ID NO: 4220206 - DNA, 13 bp, Homo sapiens
ttgatgaatgttg

SEQ ID NO: 4220207 - DNA, 12 bp, Homo sapiens
ttgatgcatgtg

SEQ ID NO: 4220208 - DNA, 12 bp, Homo sapiens
ttgattattctg

SEQ ID NO: 4220209 - DNA, 23 bp, Homo sapiens
ttgcaaggccgctgttcacccac

SEQ ID NO: 4220210 - DNA, 17 bp, Homo sapiens
ttgcagaaaagcacctg

SEQ ID NO: 4220211 - DNA, 21 bp, Homo sapiens
ttgcagaaaagcacctgccga

SEQ ID NO: 4220212 - DNA, 17 bp, Homo sapiens
ttgcattcatctctcaa

SEQ ID NO: 4220213 - DNA, 16 bp, Homo sapiens
ttgcatttgtcaaagc

SEQ ID NO: 4220214 - DNA, 18 bp, Homo sapiens
ttgccactcccctaaact

SEQ ID NO: 4220215 - DNA, 12 bp, Homo sapiens
ttgcccagagat

SEQ ID NO: 4220216 - DNA, 12 bp, Homo sapiens
ttgccctgacct

SEQ ID NO: 4220217 - DNA, 10 bp, Homo sapiens
ttgccctggt

SEQ ID NO: 4220218 - DNA, 17 bp, Homo sapiens
ttgcccttgccctgacc

SEQ ID NO: 4220219 - DNA, 18 bp, Homo sapiens
ttgcccttgccctgacct

SEQ ID NO: 4220220 - DNA, 22 bp, Homo sapiens
ttgctaaaatattttagatgtt

SEQ ID NO: 4220221 - DNA, 19 bp, Homo sapiens
ttgctgatgtttataaact

SEQ ID NO: 4220222 - DNA, 15 bp, Homo sapiens
ttggaagagaatcac

SEQ ID NO: 4220223 - DNA, 21 bp, Homo sapiens
ttgggattttaaaaacatgag

SEQ ID NO: 4220224 - DNA, 14 bp, Homo sapiens
ttggtggctttcct

SEQ ID NO: 4220225 - DNA, 14 bp, Homo sapiens
ttgtaactccacca

SEQ ID NO: 4220226 - DNA, 23 bp, Homo sapiens
ttgtaagaaaaccaaaataaaaa

SEQ ID NO: 4220227 - DNA, 11 bp, Homo sapiens
ttgtaatagtc

SEQ ID NO: 4220228 - DNA, 14 bp, Homo sapiens
ttgtaatagtccat

SEQ ID NO: 4220229 - DNA, 14 bp, Homo sapiens
ttgtcaatactgag

SEQ ID NO: 4220230 - DNA, 23 bp, Homo sapiens
ttgtctttgtaatgtcaccacct

SEQ ID NO: 4220231 - DNA, 17 bp, Homo sapiens
tgccttacctcctgccc

SEQ ID NO: 4220232 - DNA, 19 bp, Homo sapiens
tgccttacctcctgcccag

SEQ ID NO: 4220233 - DNA, 20 bp, Homo sapiens
tgccttacctcctgcccagg

SEQ ID NO: 4220234 - DNA, 22 bp, Homo sapiens
tgccttcttcggggaactcctg

SEQ ID NO: 4220235 - DNA, 15 bp, Homo sapiens
tgccttgggcctttc

SEQ ID NO: 4220236 - DNA, 18 bp, Homo sapiens
tgcctttcagaagtgatt

SEQ ID NO: 4220237 - DNA, 17 bp, Homo sapiens
tgcgggcttttccccgg

SEQ ID NO: 4220238 - DNA, 21 bp, Homo sapiens
tgctataactatgttgataaa

SEQ ID NO: 4220239 - DNA, 22 bp, Homo sapiens
tgctattatgtaacatccagaa

SEQ ID NO: 4220240 - DNA, 23 bp, Homo sapiens
tgctattatgtaacatccagaag

SEQ ID NO: 4220241 - DNA, 19 bp, Homo sapiens
tgctcccacgcctgcttct

SEQ ID NO: 4220242 - DNA, 16 bp, Homo sapiens
tgctcctccagggcca

SEQ ID NO: 4220243 - DNA, 21 bp, Homo sapiens
tgctcctccagggccacgtgc

SEQ ID NO: 4220244 - DNA, 22 bp, Homo sapiens
tgctcctccagggccacgtgcc

SEQ ID NO: 4220245 - DNA, 14 bp, Homo sapiens
tgctcctctccagg

SEQ ID NO: 4220246 - DNA, 15 bp, Homo sapiens
tgctcctctccaggc

SEQ ID NO: 4220247 - DNA, 15 bp, Homo sapiens
tgctctctgcagcca

SEQ ID NO: 4220248 - DNA, 20 bp, Homo sapiens
tgctctctgcagccagccca

SEQ ID NO: 4220249 - DNA, 15 bp, Homo sapiens
tgctgagagacccaa

SEQ ID NO: 4220250 - DNA, 17 bp, Homo sapiens
tgctgagagacccaagg

SEQ ID NO: 4220251 - DNA, 16 bp, Homo sapiens
tgctgatgtttataaa

SEQ ID NO: 4220252 - DNA, 16 bp, Homo sapiens
tgctggcagcctcagg

SEQ ID NO: 4220253 - DNA, 17 bp, Homo sapiens
tgctgggctctccacct

SEQ ID NO: 4220254 - DNA, 22 bp, Homo sapiens
tgctgggctctccacctcagcc

SEQ ID NO: 4220255 - DNA, 20 bp, Homo sapiens
tgctgtaaataaatgcttta

SEQ ID NO: 4220256 - DNA, 15 bp, Homo sapiens
tgcttctgtccagga

SEQ ID NO: 4220257 - DNA, 21 bp, Homo sapiens
tgcttctgtccaggacatgat

SEQ ID NO: 4220258 - DNA, 23 bp, Homo sapiens
tgcttctgttgtaatagtccatg

SEQ ID NO: 4220259 - DNA, 11 bp, Homo sapiens
tggaaaataaa

SEQ ID NO: 4220260 - DNA, 16 bp, Homo sapiens
tggaaatgacccaaac

SEQ ID NO: 4220261 - DNA, 12 bp, Homo sapiens
tggaagagaatc

SEQ ID NO: 4220262 - DNA, 14 bp, Homo sapiens
tggaagagaatcac

SEQ ID NO: 4220263 - DNA, 22 bp, Homo sapiens
tggaagcatgtaggagaatcca

SEQ ID NO: 4220264 - DNA, 13 bp, Homo sapiens
tggaagccctcct

SEQ ID NO: 4220265 - DNA, 17 bp, Homo sapiens
tggaagccctccttcca

SEQ ID NO: 4220266 - DNA, 16 bp, Homo sapiens
tggaagctgtgtcctt

SEQ ID NO: 4220267 - DNA, 19 bp, Homo sapiens
tggacagatggaccaaaag

SEQ ID NO: 4220268 - DNA, 15 bp, Homo sapiens
tggactttggaaaat

SEQ ID NO: 4220269 - DNA, 14 bp, Homo sapiens
tggagaaatattta

SEQ ID NO: 4220270 - DNA, 12 bp, Homo sapiens
tggatggacaga

SEQ ID NO: 4220271 - DNA, 15 bp, Homo sapiens
tggattttgaattag

SEQ ID NO: 4220272 - DNA, 19 bp, Homo sapiens
tggcaggagttggaagtgt

SEQ ID NO: 4220273 - DNA, 16 bp, Homo sapiens
tggcagggtgggatgg

SEQ ID NO: 4220274 - DNA, 16 bp, Homo sapiens
tggcattttctgttcc

SEQ ID NO: 4220275 - DNA, 23 bp, Homo sapiens
tggccccatgtctctcagaattc

SEQ ID NO: 4220276 - DNA, 13 bp, Homo sapiens
tggcccccaccct

SEQ ID NO: 4220277 - DNA, 21 bp, Homo sapiens
tggcccccaccctcagcccgc

SEQ ID NO: 4220278 - DNA, 11 bp, Homo sapiens
tggccctgcct

SEQ ID NO: 4220279 - DNA, 14 bp, Homo sapiens
tggccctggcctgc

SEQ ID NO: 4220280 - DNA, 22 bp, Homo sapiens
tggcggctactcagcagccctc

SEQ ID NO: 4220281 - DNA, 16 bp, Homo sapiens
tggctgacccagtccc

SEQ ID NO: 4220282 - DNA, 17 bp, Homo sapiens
tggctgacccagtccct

SEQ ID NO: 4220283 - DNA, 20 bp, Homo sapiens
tggctgacccagtccctggg

SEQ ID NO: 4220284 - DNA, 22 bp, Homo sapiens
tggcttcgtcatttgcaagctg

SEQ ID NO: 4220285 - DNA, 21 bp, Homo sapiens
tggctttccttgtggcagagg

SEQ ID NO: 4220286 - DNA, 16 bp, Homo sapiens
tgggaacgtgactgcc

SEQ ID NO: 4220287 - DNA, 13 bp, Homo sapiens
tgggaccctttcc

SEQ ID NO: 4220288 - DNA, 18 bp, Homo sapiens
tgggaccctttccttcct

SEQ ID NO: 4220289 - DNA, 21 bp, Homo sapiens
tgggagaactttgtacagtgg

SEQ ID NO: 4220290 - DNA, 13 bp, Homo sapiens
tgggaggtcgagg

SEQ ID NO: 4220291 - DNA, 22 bp, Homo sapiens
tgggcaagcagaaaaattaaat

SEQ ID NO: 4220292 - DNA, 15 bp, Homo sapiens
tgggcagggctggga

SEQ ID NO: 4220293 - DNA, 18 bp, Homo sapiens
tgggccccaccacctagg

SEQ ID NO: 4220294 - DNA, 16 bp, Homo sapiens
tgggctctccacctca

SEQ ID NO: 4220295 - DNA, 17 bp, Homo sapiens
tggggctgctcctccag

SEQ ID NO: 4220296 - DNA, 21 bp, Homo sapiens
tggggctgctcctccagggcc

SEQ ID NO: 4220297 - DNA, 15 bp, Homo sapiens
tgggggaagccctgg

SEQ ID NO: 4220298 - DNA, 13 bp, Homo sapiens
tggggtctccctc

SEQ ID NO: 4220299 - DNA, 14 bp, Homo sapiens
tggggttcagcccc

SEQ ID NO: 4220300 - DNA, 17 bp, Homo sapiens
tggggttcagcccctcc

SEQ ID NO: 4220301 - DNA, 23 bp, Homo sapiens
tgggtctaaggggttggttgagg

SEQ ID NO: 4220302 - DNA, 14 bp, Homo sapiens
tgggttttcttccc

SEQ ID NO: 4220303 - DNA, 24 bp, Homo sapiens
tgggttttcttcccatcactggag

SEQ ID NO: 4220304 - DNA, 16 bp, Homo sapiens
tggtggcgcaagcctg

SEQ ID NO: 4220305 - DNA, 21 bp, Homo sapiens
tggtgggaagcgtctgtccgt

SEQ ID NO: 4220306 - DNA, 23 bp, Homo sapiens
tgtaaaacaaaaatgtaatgatc

SEQ ID NO: 4220307 - DNA, 12 bp, Homo sapiens
tgtaaacagtgc

SEQ ID NO: 4220308 - DNA, 17 bp, Homo sapiens
tgtaaacagtgcctgct

SEQ ID NO: 4220309 - DNA, 19 bp, Homo sapiens
tgtaaacagtgcctgctga

SEQ ID NO: 4220310 - DNA, 21 bp, Homo sapiens
tgtaaatactgtttttaacaa

SEQ ID NO: 4220311 - DNA, 20 bp, Homo sapiens
tgtaaatagttttaaatatg

SEQ ID NO: 4220312 - DNA, 21 bp, Homo sapiens
tgtaaatagttttaaatatga

SEQ ID NO: 4220313 - DNA, 23 bp, Homo sapiens
tgtaaatagttttaaatatgaac

SEQ ID NO: 4220314 - DNA, 20 bp, Homo sapiens
tgtaaatatgtttcaccctg

SEQ ID NO: 4220315 - DNA, 13 bp, Homo sapiens
tgtaagaaaacca

SEQ ID NO: 4220316 - DNA, 20 bp, Homo sapiens
tgtaagaaaaccaaaataaa

SEQ ID NO: 4220317 - DNA, 23 bp, Homo sapiens
tgtaatcccagctactcaggagg

SEQ ID NO: 4220318 - DNA, 11 bp, Homo sapiens
tgtaggagaat

SEQ ID NO: 4220319 - DNA, 14 bp, Homo sapiens
tgtatatgtataaa

SEQ ID NO: 4220320 - DNA, 19 bp, Homo sapiens
tgtatatgtataaattaat

SEQ ID NO: 4220321 - DNA, 14 bp, Homo sapiens
tgtatatttgcata

SEQ ID NO: 4220322 - DNA, 15 bp, Homo sapiens
tgtatgctttgaatg

SEQ ID NO: 4220323 - DNA, 21 bp, Homo sapiens
tgtcaccaccttcccagctct

SEQ ID NO: 4220324 - DNA, 21 bp, Homo sapiens
tgtcagagctatgttccctcc

SEQ ID NO: 4220325 - DNA, 22 bp, Homo sapiens
tgtccaacctaacccctttcct

SEQ ID NO: 4220326 - DNA, 11 bp, Homo sapiens
tgtccacctgg

SEQ ID NO: 4220327 - DNA, 12 bp, Homo sapiens
tgtccacctggc

SEQ ID NO: 4220328 - DNA, 14 bp, Homo sapiens
tgtccacctggccc

SEQ ID NO: 4220329 - DNA, 13 bp, Homo sapiens
tgtccattgtaaa

SEQ ID NO: 4220330 - DNA, 14 bp, Homo sapiens
tgtccattgtaaat

SEQ ID NO: 4220331 - DNA, 23 bp, Homo sapiens
tgtccattgtaaatctgaagaaa

SEQ ID NO: 4220332 - DNA, 19 bp, Homo sapiens
tgtccccagtttgcagaaa

SEQ ID NO: 4220333 - DNA, 16 bp, Homo sapiens
tgtccctgtcaccaag

SEQ ID NO: 4220334 - DNA, 16 bp, Homo sapiens
tgtcctagactccggg

SEQ ID NO: 4220335 - DNA, 14 bp, Homo sapiens
tgtcctaggctctg

SEQ ID NO: 4220336 - DNA, 10 bp, Homo sapiens
tgtcctcctc

SEQ ID NO: 4220337 - DNA, 13 bp, Homo sapiens
tgtccttgcacct

SEQ ID NO: 4220338 - DNA, 16 bp, Homo sapiens
tgtccttgcacctgca

SEQ ID NO: 4220339 - DNA, 19 bp, Homo sapiens
tgtcgctctgctggcctgg

SEQ ID NO: 4220340 - DNA, 21 bp, Homo sapiens
tgtctcaaacttcagatggga

SEQ ID NO: 4220341 - DNA, 20 bp, Homo sapiens
tgtctcctacctgctgctgc

SEQ ID NO: 4220342 - DNA, 15 bp, Homo sapiens
tgtctcttcctctgt

SEQ ID NO: 4220343 - DNA, 14 bp, Homo sapiens
tgtctgcttctgtc

SEQ ID NO: 4220344 - DNA, 19 bp, Homo sapiens
tgtctgcttctgtccagga

SEQ ID NO: 4220345 - DNA, 20 bp, Homo sapiens
tgtgaaaaaaatgaaataaa

SEQ ID NO: 4220346 - DNA, 16 bp, Homo sapiens
tgtgaactccatcatt

SEQ ID NO: 4220347 - DNA, 18 bp, Homo sapiens
tgtgaactccatcattca

SEQ ID NO: 4220348 - DNA, 10 bp, Homo sapiens
tgtgaagaat

SEQ ID NO: 4220349 - DNA, 15 bp, Homo sapiens
tgtgaatcagaccct

SEQ ID NO: 4220350 - DNA, 18 bp, Homo sapiens
tgtgaattgtggctgttc

SEQ ID NO: 4220351 - DNA, 12 bp, Homo sapiens
tgtgaggcaggg

SEQ ID NO: 4220352 - DNA, 22 bp, Homo sapiens
tgtgatggggtgggcagggctg

SEQ ID NO: 4220353 - DNA, 15 bp, Homo sapiens
tgtgcccctgtaaat

SEQ ID NO: 4220354 - DNA, 20 bp, Homo sapiens
tgtgctgatcatttgaggaa

SEQ ID NO: 4220355 - DNA, 14 bp, Homo sapiens
tgtggccctggcct

SEQ ID NO: 4220356 - DNA, 18 bp, Homo sapiens
tgtggtttggttcctctc

SEQ ID NO: 4220357 - DNA, 14 bp, Homo sapiens
tgtgtccttgcacc

SEQ ID NO: 4220358 - DNA, 13 bp, Homo sapiens
aaaaaattaactg

SEQ ID NO: 4220359 - DNA, 23 bp, Homo sapiens
aaaaagagctcaggcttttccag

SEQ ID NO: 4220360 - DNA, 17 bp, Homo sapiens
aaaaatgaaataaagca

SEQ ID NO: 4220361 - DNA, 13 bp, Homo sapiens
aaaaattgaaaaa

SEQ ID NO: 4220362 - DNA, 16 bp, Homo sapiens
aaaacatgagaaatgt

SEQ ID NO: 4220363 - DNA, 14 bp, Homo sapiens
aaaacccaaacttc

SEQ ID NO: 4220364 - DNA, 15 bp, Homo sapiens
aaaacccagagagga

SEQ ID NO: 4220365 - DNA, 17 bp, Homo sapiens
aaaactttctctttgcc

SEQ ID NO: 4220366 - DNA, 22 bp, Homo sapiens
aaaagatgggtggttgaatgat

SEQ ID NO: 4220367 - DNA, 20 bp, Homo sapiens
aaaaggtgcctgtgaggcag

SEQ ID NO: 4220368 - DNA, 22 bp, Homo sapiens
aaaagtatgcagattatttgcc

SEQ ID NO: 4220369 - DNA, 14 bp, Homo sapiens
aaaagtgcattcaa

SEQ ID NO: 4220370 - DNA, 21 bp, Homo sapiens
aaaataaaaaccataaacatt

SEQ ID NO: 4220371 - DNA, 16 bp, Homo sapiens
aaaataaatataattg

SEQ ID NO: 4220372 - DNA, 20 bp, Homo sapiens
aaaatatattttatgattta

SEQ ID NO: 4220373 - DNA, 13 bp, Homo sapiens
aaaatattttaga

SEQ ID NO: 4220374 - DNA, 23 bp, Homo sapiens
aaaatgagtttttatggggctga

SEQ ID NO: 4220375 - DNA, 22 bp, Homo sapiens
aaaatgggagacaatttcacat

SEQ ID NO: 4220376 - DNA, 15 bp, Homo sapiens
aaaatgtcaaccttt

SEQ ID NO: 4220377 - DNA, 14 bp, Homo sapiens
aaacagagtatttc

SEQ ID NO: 4220378 - DNA, 13 bp, Homo sapiens
aaacatgagaaat

SEQ ID NO: 4220379 - DNA, 18 bp, Homo sapiens
aaacatgagaaatgtgaa

SEQ ID NO: 4220380 - DNA, 18 bp, Homo sapiens
aaacatggaaaacagagt

SEQ ID NO: 4220381 - DNA, 18 bp, Homo sapiens
aaaccaaaagtgcattca

SEQ ID NO: 4220382 - DNA, 17 bp, Homo sapiens
aaactaccctccagagt

SEQ ID NO: 4220383 - DNA, 18 bp, Homo sapiens
aaactacctcaaaacact

SEQ ID NO: 4220384 - DNA, 21 bp, Homo sapiens
aaactacctcaaaacactttc

SEQ ID NO: 4220385 - DNA, 19 bp, Homo sapiens
aaactccaggatttataaa

SEQ ID NO: 4220386 - DNA, 23 bp, Homo sapiens
aaactccaggatttataaagcaa

SEQ ID NO: 4220387 - DNA, 20 bp, Homo sapiens
aaacttcagatgggaggaaa

SEQ ID NO: 4220388 - DNA, 12 bp, Homo sapiens
aaactttctctt

SEQ ID NO: 4220389 - DNA, 18 bp, Homo sapiens
aaagaaaaaaatatattt

SEQ ID NO: 4220390 - DNA, 15 bp, Homo sapiens
aaagaaaaaggaaaa

SEQ ID NO: 4220391 - DNA, 20 bp, Homo sapiens
aaagaaatttagagtcaatt

SEQ ID NO: 4220392 - DNA, 21 bp, Homo sapiens
actccaggatttataaagcaa

SEQ ID NO: 4220393 - DNA, 16 bp, Homo sapiens
actccctttaaagaga

SEQ ID NO: 4220394 - DNA, 12 bp, Homo sapiens
actcctggaaat

SEQ ID NO: 4220395 - DNA, 14 bp, Homo sapiens
actctcattcccca

SEQ ID NO: 4220396 - DNA, 15 bp, Homo sapiens
actctcattccccag

SEQ ID NO: 4220397 - DNA, 16 bp, Homo sapiens
actctcattccccagg

SEQ ID NO: 4220398 - DNA, 21 bp, Homo sapiens
actctcattccccaggtggct

SEQ ID NO: 4220399 - DNA, 19 bp, Homo sapiens
actctccaacctggacaac

SEQ ID NO: 4220400 - DNA, 14 bp, Homo sapiens
actgaaaaatgtca

SEQ ID NO: 4220401 - DNA, 13 bp, Homo sapiens
actgaaggagaag

SEQ ID NO: 4220402 - DNA, 14 bp, Homo sapiens
actgaaggagaagg

SEQ ID NO: 4220403 - DNA, 17 bp, Homo sapiens
actgaattgtccccagt

SEQ ID NO: 4220404 - DNA, 12 bp, Homo sapiens
actgacacaggg

SEQ ID NO: 4220405 - DNA, 18 bp, Homo sapiens
actgagatgttttaccat

SEQ ID NO: 4220406 - DNA, 16 bp, Homo sapiens
actgatttggagatat

SEQ ID NO: 4220407 - DNA, 15 bp, Homo sapiens
actgcaacttgtgaa

SEQ ID NO: 4220408 - DNA, 18 bp, Homo sapiens
actgcaacttgtgaactc

SEQ ID NO: 4220409 - DNA, 17 bp, Homo sapiens
actgcaagagccttggt

SEQ ID NO: 4220410 - DNA, 18 bp, Homo sapiens
actgcaagagccttggtg

SEQ ID NO: 4220411 - DNA, 15 bp, Homo sapiens
actgcaggccccgct

SEQ ID NO: 4220412 - DNA, 20 bp, Homo sapiens
actgccggtcacccaggctc

SEQ ID NO: 4220413 - DNA, 19 bp, Homo sapiens
actgcctttcagaagtgat

SEQ ID NO: 4220414 - DNA, 22 bp, Homo sapiens
actgctgtaaataaatgcttta

SEQ ID NO: 4220415 - DNA, 20 bp, Homo sapiens
actggaagcatgtaggagaa

SEQ ID NO: 4220416 - DNA, 13 bp, Homo sapiens
actggagcaccag

SEQ ID NO: 4220417 - DNA, 15 bp, Homo sapiens
actggagcaccaggc

SEQ ID NO: 4220418 - DNA, 23 bp, Homo sapiens
actgtgatggggtgggcagggct

SEQ ID NO: 4220419 - DNA, 15 bp, Homo sapiens
acttagtttttatct

SEQ ID NO: 4220420 - DNA, 15 bp, Homo sapiens
acttcacactgcaag

SEQ ID NO: 4220421 - DNA, 16 bp, Homo sapiens
acttcacactgcaaga

SEQ ID NO: 4220422 - DNA, 19 bp, Homo sapiens
acttcacactgcaagagcc

SEQ ID NO: 4220423 - DNA, 23 bp, Homo sapiens
acttcacactgcaagagccttgg

SEQ ID NO: 4220424 - DNA, 18 bp, Homo sapiens
acttcagatgggaggaaa

SEQ ID NO: 4220425 - DNA, 16 bp, Homo sapiens
actttccccccaaccc

SEQ ID NO: 4220426 - DNA, 17 bp, Homo sapiens
actttccccccaacccg

SEQ ID NO: 4220427 - DNA, 14 bp, Homo sapiens
actttctctttgcc

SEQ ID NO: 4220428 - DNA, 20 bp, Homo sapiens
actttgtacagtggagaaat

SEQ ID NO: 4220429 - DNA, 19 bp, Homo sapiens
agaaaaaaatatattttat

SEQ ID NO: 4220430 - DNA, 20 bp, Homo sapiens
agaaaaaaatatattttatg

SEQ ID NO: 4220431 - DNA, 13 bp, Homo sapiens
agaaaaaggaaaa

SEQ ID NO: 4220432 - DNA, 17 bp, Homo sapiens
agaaaacacttgtaagt

SEQ ID NO: 4220433 - DNA, 15 bp, Homo sapiens
agaaaagcacctgcc

SEQ ID NO: 4220434 - DNA, 20 bp, Homo sapiens
agaaaattaattatatttct

SEQ ID NO: 4220435 - DNA, 13 bp, Homo sapiens
agaaagaaatttg

SEQ ID NO: 4220436 - DNA, 14 bp, Homo sapiens
agaaagatccaccc

SEQ ID NO: 4220437 - DNA, 18 bp, Homo sapiens
agaaatgcatccattcct

SEQ ID NO: 4220438 - DNA, 22 bp, Homo sapiens
agaactttgtacagtggagaaa

SEQ ID NO: 4220439 - DNA, 20 bp, Homo sapiens
agaagaattgaacccaggag

SEQ ID NO: 4220440 - DNA, 23 bp, Homo sapiens
agaagaatttgagaagaaatact

SEQ ID NO: 4220441 - DNA, 18 bp, Homo sapiens
agaagacacaggaaacaa

SEQ ID NO: 4220442 - DNA, 13 bp, Homo sapiens
agaagcagtgagc

SEQ ID NO: 4220443 - DNA, 14 bp, Homo sapiens
agaagcagtgagcc

SEQ ID NO: 4220444 - DNA, 15 bp, Homo sapiens
agaaggagaaggaag

SEQ ID NO: 4220445 - DNA, 16 bp, Homo sapiens
agaagggataatagac

SEQ ID NO: 4220446 - DNA, 18 bp, Homo sapiens
agaaggtttcagaaagaa

SEQ ID NO: 4220447 - DNA, 13 bp, Homo sapiens
agaagtccctccc

SEQ ID NO: 4220448 - DNA, 22 bp, Homo sapiens
agaagtccctcccatctctacc

SEQ ID NO: 4220449 - DNA, 11 bp, Homo sapiens
agaagtgattt

SEQ ID NO: 4220450 - DNA, 14 bp, Homo sapiens
agaagtgatttagt

SEQ ID NO: 4220451 - DNA, 18 bp, Homo sapiens
agaagtggaccaggacag

SEQ ID NO: 4220452 - DNA, 20 bp, Homo sapiens
agaagtggggacagagcaga

SEQ ID NO: 4220453 - DNA, 15 bp, Homo sapiens
agaagtttgtcaagt

SEQ ID NO: 4220454 - DNA, 14 bp, Homo sapiens
agaatctatcacta

SEQ ID NO: 4220455 - DNA, 17 bp, Homo sapiens
agaattcctgaagccag

SEQ ID NO: 4220456 - DNA, 22 bp, Homo sapiens
agacaaaaacagcctcacagaa

SEQ ID NO: 4220457 - DNA, 17 bp, Homo sapiens
agacaagcaacccaaac

SEQ ID NO: 4220458 - DNA, 14 bp, Homo sapiens
agacagaatgtcac

SEQ ID NO: 4220459 - DNA, 22 bp, Homo sapiens
agacatttgtaaatgtaaaact

SEQ ID NO: 4220460 - DNA, 14 bp, Homo sapiens
agacccaaggagga

SEQ ID NO: 4220461 - DNA, 16 bp, Homo sapiens
agacccaaggaggaaa

SEQ ID NO: 4220462 - DNA, 12 bp, Homo sapiens
agacccccactc

SEQ ID NO: 4220463 - DNA, 11 bp, Homo sapiens
agacctcagcc

SEQ ID NO: 4220464 - DNA, 14 bp, Homo sapiens
agacctcagccatg

SEQ ID NO: 4220465 - DNA, 19 bp, Homo sapiens
agactcacctctgcctcaa

SEQ ID NO: 4220466 - DNA, 16 bp, Homo sapiens
agactgttctgttcct

SEQ ID NO: 4220467 - DNA, 21 bp, Homo sapiens
agacttcacactgcaagagcc

SEQ ID NO: 4220468 - DNA, 13 bp, Homo sapiens
agagaaaatgaat

SEQ ID NO: 4220469 - DNA, 12 bp, Homo sapiens
agagaaggcagg

SEQ ID NO: 4220470 - DNA, 14 bp, Homo sapiens
agagacacctgcac

SEQ ID NO: 4220471 - DNA, 16 bp, Homo sapiens
agagacacctgcacct

SEQ ID NO: 4220472 - DNA, 14 bp, Homo sapiens
agagagagtgtttg

SEQ ID NO: 4220473 - DNA, 17 bp, Homo sapiens
agagaggaatcagactt

SEQ ID NO: 4220474 - DNA, 14 bp, Homo sapiens
agagatgcctccac

SEQ ID NO: 4220475 - DNA, 20 bp, Homo sapiens
agagattagtaaatatgtga

SEQ ID NO: 4220476 - DNA, 14 bp, Homo sapiens
agagcaagtctgga

SEQ ID NO: 4220477 - DNA, 17 bp, Homo sapiens
agagccagccctccctg

SEQ ID NO: 4220478 - DNA, 16 bp, Homo sapiens
agagcctgctccccca

SEQ ID NO: 4220479 - DNA, 21 bp, Homo sapiens
agagccttggtgtccacctgg

SEQ ID NO: 4220480 - DNA, 22 bp, Homo sapiens
agagccttggtgtccacctggc

SEQ ID NO: 4220481 - DNA, 13 bp, Homo sapiens
agagctagcgctg

SEQ ID NO: 4220482 - DNA, 15 bp, Homo sapiens
agagctatgttccct

SEQ ID NO: 4220483 - DNA, 17 bp, Homo sapiens
agagctatgttccctcc

SEQ ID NO: 4220484 - DNA, 16 bp, Homo sapiens
agaggctccctcctgt

SEQ ID NO: 4220485 - DNA, 16 bp, Homo sapiens
agaggctggaggcagg

SEQ ID NO: 4220486 - DNA, 17 bp, Homo sapiens
agagtacgttaaaagca

SEQ ID NO: 4220487 - DNA, 23 bp, Homo sapiens
agagtagccgagagcctgctccc

SEQ ID NO: 4220488 - DNA, 17 bp, Homo sapiens
agagtcaatttgctgaa

SEQ ID NO: 4220489 - DNA, 22 bp, Homo sapiens
agagttaccattatttaatttg

SEQ ID NO: 4220490 - DNA, 18 bp, Homo sapiens
agataaatttgttgaata

SEQ ID NO: 4220491 - DNA, 16 bp, Homo sapiens
agataatgtatataaa

SEQ ID NO: 4220492 - DNA, 22 bp, Homo sapiens
agatattgtcagagttctgctc

SEQ ID NO: 4220493 - DNA, 13 bp, Homo sapiens
agatccaccctca

SEQ ID NO: 4220494 - DNA, 21 bp, Homo sapiens
agatcgtgccgttactctcca

SEQ ID NO: 4220495 - DNA, 23 bp, Homo sapiens
agatctctgctttggaaatcaca

SEQ ID NO: 4220496 - DNA, 12 bp, Homo sapiens
agatgcctccac

SEQ ID NO: 4220497 - DNA, 14 bp, Homo sapiens
agatgcctccaccg

SEQ ID NO: 4220498 - DNA, 16 bp, Homo sapiens
agatgcctccaccgct

SEQ ID NO: 4220499 - DNA, 17 bp, Homo sapiens
agatgcctccaccgctg

SEQ ID NO: 4220500 - DNA, 20 bp, Homo sapiens
agatgggaggaaagagagca

SEQ ID NO: 4220501 - DNA, 18 bp, Homo sapiens
agatgttattatgctaat

SEQ ID NO: 4220502 - DNA, 20 bp, Homo sapiens
agattacctcttgcccttgg

SEQ ID NO: 4220503 - DNA, 21 bp, Homo sapiens
agattagtaaatatgtgaaga

SEQ ID NO: 4220504 - DNA, 13 bp, Homo sapiens
agattatttctgt

SEQ ID NO: 4220505 - DNA, 13 bp, Homo sapiens
agattcccagaga

SEQ ID NO: 4220506 - DNA, 23 bp, Homo sapiens
agattttccacaagattcccaga

SEQ ID NO: 4220507 - DNA, 19 bp, Homo sapiens
agcactttattctcctccg

SEQ ID NO: 4220508 - DNA, 16 bp, Homo sapiens
agcagaaaaattaaat

SEQ ID NO: 4220509 - DNA, 20 bp, Homo sapiens
agcagattacctcttgccct

SEQ ID NO: 4220510 - DNA, 16 bp, Homo sapiens
aggtggaagccctcct

SEQ ID NO: 4220511 - DNA, 19 bp, Homo sapiens
aggtggaagccctccttcc

SEQ ID NO: 4220512 - DNA, 16 bp, Homo sapiens
aggtggatcacagagg

SEQ ID NO: 4220513 - DNA, 23 bp, Homo sapiens
aggtggctgacccagtccctggg

SEQ ID NO: 4220514 - DNA, 21 bp, Homo sapiens
aggtggggtctttgtgagagt

SEQ ID NO: 4220515 - DNA, 14 bp, Homo sapiens
aggtttataaagca

SEQ ID NO: 4220516 - DNA, 18 bp, Homo sapiens
agtaaatatgtgaagaaa

SEQ ID NO: 4220517 - DNA, 19 bp, Homo sapiens
agtagccgagagcctgctc

SEQ ID NO: 4220518 - DNA, 21 bp, Homo sapiens
agtaggggttgaagaaaacaa

SEQ ID NO: 4220519 - DNA, 13 bp, Homo sapiens
agtataagatttt

SEQ ID NO: 4220520 - DNA, 16 bp, Homo sapiens
agtattctccatcctc

SEQ ID NO: 4220521 - DNA, 17 bp, Homo sapiens
agtcaaaaggtgcctgt

SEQ ID NO: 4220522 - DNA, 12 bp, Homo sapiens
agtcaatttgct

SEQ ID NO: 4220523 - DNA, 15 bp, Homo sapiens
agtcatgatctccct

SEQ ID NO: 4220524 - DNA, 16 bp, Homo sapiens
agtcatgatctccctg

SEQ ID NO: 4220525 - DNA, 20 bp, Homo sapiens
attttagatgttattatgct

SEQ ID NO: 4220526 - DNA, 15 bp, Homo sapiens
attttagctgcagaa

SEQ ID NO: 4220527 - DNA, 17 bp, Homo sapiens
attttatgatttaaaaa

SEQ ID NO: 4220528 - DNA, 23 bp, Homo sapiens
attttccacaagattcccagaga

SEQ ID NO: 4220529 - DNA, 18 bp, Homo sapiens
attttgccagtgggaact

SEQ ID NO: 4220530 - DNA, 13 bp, Homo sapiens
attttgtaaaaca

SEQ ID NO: 4220531 - DNA, 18 bp, Homo sapiens
atttttgaaaatcctgaa

SEQ ID NO: 4220532 - DNA, 21 bp, Homo sapiens
atttttgaaaatcctgaataa

SEQ ID NO: 4220533 - DNA, 14 bp, Homo sapiens
attttttaaaaaat

SEQ ID NO: 4220534 - DNA, 17 bp, Homo sapiens
atttttttcctttgcat

SEQ ID NO: 4220535 - DNA, 14 bp, Homo sapiens
caaaaacagcctca

SEQ ID NO: 4220536 - DNA, 16 bp, Homo sapiens
caaaaacagcctcaca

SEQ ID NO: 4220537 - DNA, 16 bp, Homo sapiens
caaaaagatgtatatt

SEQ ID NO: 4220538 - DNA, 15 bp, Homo sapiens
caaaagaaatttaga

SEQ ID NO: 4220539 - DNA, 22 bp, Homo sapiens
caaaagaaatttagagtcaatt

SEQ ID NO: 4220540 - DNA, 16 bp, Homo sapiens
caaaagagaaaaagaa

SEQ ID NO: 4220541 - DNA, 12 bp, Homo sapiens
caaaagccaaaa

SEQ ID NO: 4220542 - DNA, 22 bp, Homo sapiens
caaaaggtgcctgtgaggcagg

SEQ ID NO: 4220543 - DNA, 19 bp, Homo sapiens
caaaagtcaaaaggtgcct

SEQ ID NO: 4220544 - DNA, 14 bp, Homo sapiens
caaaagtgcattca

SEQ ID NO: 4220545 - DNA, 17 bp, Homo sapiens
caaaagtgcattcaacc

SEQ ID NO: 4220546 - DNA, 20 bp, Homo sapiens
caaaatagcttattatagaa

SEQ ID NO: 4220547 - DNA, 16 bp, Homo sapiens
caaactacatgtaatc

SEQ ID NO: 4220548 - DNA, 22 bp, Homo sapiens
caaacttagtttttatctttga

SEQ ID NO: 4220549 - DNA, 22 bp, Homo sapiens
caaagaaaaaaatatattttat

SEQ ID NO: 4220550 - DNA, 13 bp, Homo sapiens
caaagaaacccaa

SEQ ID NO: 4220551 - DNA, 22 bp, Homo sapiens
caaagcagtttttccccctagg

SEQ ID NO: 4220552 - DNA, 15 bp, Homo sapiens
caaagcttaaaaaga

SEQ ID NO: 4220553 - DNA, 16 bp, Homo sapiens
caaaggaagtctagga

SEQ ID NO: 4220554 - DNA, 14 bp, Homo sapiens
caaagtatcaaaga

SEQ ID NO: 4220555 - DNA, 14 bp, Homo sapiens
caacaagagcgaaa

SEQ ID NO: 4220556 - DNA, 12 bp, Homo sapiens
caacagctcaga

SEQ ID NO: 4220557 - DNA, 16 bp, Homo sapiens
caacagctcagagatg

SEQ ID NO: 4220558 - DNA, 21 bp, Homo sapiens
caacataaggagaatgtatct

SEQ ID NO: 4220559 - DNA, 17 bp, Homo sapiens
caacatcccattgccct

SEQ ID NO: 4220560 - DNA, 18 bp, Homo sapiens
caacatcccattgccctg

SEQ ID NO: 4220561 - DNA, 17 bp, Homo sapiens
caaccaactttcccccc

SEQ ID NO: 4220562 - DNA, 22 bp, Homo sapiens
caaccaactttccccccaaccc

SEQ ID NO: 4220563 - DNA, 18 bp, Homo sapiens
caacctaacccctttcct

SEQ ID NO: 4220564 - DNA, 17 bp, Homo sapiens
caacctggctccctccc

SEQ ID NO: 4220565 - DNA, 20 bp, Homo sapiens
caacctggctccctcccacc

SEQ ID NO: 4220566 - DNA, 22 bp, Homo sapiens
caacctggctccctcccaccca

SEQ ID NO: 4220567 - DNA, 19 bp, Homo sapiens
caacctttgtaagaaaacc

SEQ ID NO: 4220568 - DNA, 22 bp, Homo sapiens
caactatgatttggaaaataaa

SEQ ID NO: 4220569 - DNA, 21 bp, Homo sapiens
caactcctggaagctgtgtcc

SEQ ID NO: 4220570 - DNA, 12 bp, Homo sapiens
caagagccttgg

SEQ ID NO: 4220571 - DNA, 21 bp, Homo sapiens
caagagccttggtgtccacct

SEQ ID NO: 4220572 - DNA, 22 bp, Homo sapiens
caagagccttggtgtccacctg

SEQ ID NO: 4220573 - DNA, 23 bp, Homo sapiens
caagagccttggtgtccacctgg

SEQ ID NO: 4220574 - DNA, 16 bp, Homo sapiens
caagaggaaaaacagg

SEQ ID NO: 4220575 - DNA, 20 bp, Homo sapiens
caagaggaaaaacagggaaa

SEQ ID NO: 4220576 - DNA, 21 bp, Homo sapiens
caagcaaagtatcaaagaaaa

SEQ ID NO: 4220577 - DNA, 14 bp, Homo sapiens
caagcaacccaaac

SEQ ID NO: 4220578 - DNA, 13 bp, Homo sapiens
caagcagaaaaat

SEQ ID NO: 4220579 - DNA, 18 bp, Homo sapiens
caagcctgtaatcccagc

SEQ ID NO: 4220580 - DNA, 14 bp, Homo sapiens
caagcctgtccatt

SEQ ID NO: 4220581 - DNA, 19 bp, Homo sapiens
caagctcacagttcctcgc

SEQ ID NO: 4220582 - DNA, 20 bp, Homo sapiens
caagctcacagttcctcgcc

SEQ ID NO: 4220583 - DNA, 20 bp, Homo sapiens
caaggccgctgttcacccac

SEQ ID NO: 4220584 - DNA, 14 bp, Homo sapiens
caagggtccagaag

SEQ ID NO: 4220585 - DNA, 16 bp, Homo sapiens
caagggtctagggaga

SEQ ID NO: 4220586 - DNA, 15 bp, Homo sapiens
caaggtttataaagc

SEQ ID NO: 4220587 - DNA, 19 bp, Homo sapiens
caaggtttataaagcagat

SEQ ID NO: 4220588 - DNA, 16 bp, Homo sapiens
caagtactgctgtaaa

SEQ ID NO: 4220589 - DNA, 13 bp, Homo sapiens
caagtctggatct

SEQ ID NO: 4220590 - DNA, 19 bp, Homo sapiens
caagtgcatgctctctgca

SEQ ID NO: 4220591 - DNA, 16 bp, Homo sapiens
caagtggcccccaccc

SEQ ID NO: 4220592 - DNA, 13 bp, Homo sapiens
caagtgggggcag

SEQ ID NO: 4220593 - DNA, 15 bp, Homo sapiens
caatacatgctgcta

SEQ ID NO: 4220594 - DNA, 17 bp, Homo sapiens
caatacatgctgctaat

SEQ ID NO: 4220595 - DNA, 20 bp, Homo sapiens
caatactccctttaaagaga

SEQ ID NO: 4220596 - DNA, 14 bp, Homo sapiens
caatactgagccat

SEQ ID NO: 4220597 - DNA, 12 bp, Homo sapiens
caatgagctgta

SEQ ID NO: 4220598 - DNA, 13 bp, Homo sapiens
caatgagctgtat

SEQ ID NO: 4220599 - DNA, 17 bp, Homo sapiens
caatgccttgacaacag

SEQ ID NO: 4220600 - DNA, 23 bp, Homo sapiens
caatgccttgacaacagactgaa

SEQ ID NO: 4220601 - DNA, 20 bp, Homo sapiens
caatgctcaaacacccaagt

SEQ ID NO: 4220602 - DNA, 14 bp, Homo sapiens
caatgtgaatcaga

SEQ ID NO: 4220603 - DNA, 19 bp, Homo sapiens
caatgtgaatcagacccta

SEQ ID NO: 4220604 - DNA, 16 bp, Homo sapiens
caatttgctgaaaaca

SEQ ID NO: 4220605 - DNA, 16 bp, Homo sapiens
cacactgcaagagcct

SEQ ID NO: 4220606 - DNA, 18 bp, Homo sapiens
cacagaggcttcttcaga

SEQ ID NO: 4220607 - DNA, 23 bp, Homo sapiens
cacagagggaagtttaaaaccca

SEQ ID NO: 4220608 - DNA, 23 bp, Homo sapiens
cacagcatcgtgatcactgagcc

SEQ ID NO: 4220609 - DNA, 14 bp, Homo sapiens
cacagctcccaccc

SEQ ID NO: 4220610 - DNA, 15 bp, Homo sapiens
cacagctgcagccca

SEQ ID NO: 4220611 - DNA, 12 bp, Homo sapiens
cacaggaaacaa

SEQ ID NO: 4220612 - DNA, 13 bp, Homo sapiens
cacagggctaaga

SEQ ID NO: 4220613 - DNA, 15 bp, Homo sapiens
cacaggttggaagag

SEQ ID NO: 4220614 - DNA, 16 bp, Homo sapiens
cacaggttggaagaga

SEQ ID NO: 4220615 - DNA, 18 bp, Homo sapiens
cacaggttggaagagaat

SEQ ID NO: 4220616 - DNA, 20 bp, Homo sapiens
cacaggttggaagagaatca

SEQ ID NO: 4220617 - DNA, 19 bp, Homo sapiens
cacagtaatgcaagcaaag

SEQ ID NO: 4220618 - DNA, 20 bp, Homo sapiens
cacagttcctcgccctgggt

SEQ ID NO: 4220619 - DNA, 18 bp, Homo sapiens
cacataggaaacttttga

SEQ ID NO: 4220620 - DNA, 16 bp, Homo sapiens
cacatctaatgtctct

SEQ ID NO: 4220621 - DNA, 14 bp, Homo sapiens
caccaacatcccat

SEQ ID NO: 4220622 - DNA, 11 bp, Homo sapiens
caccacccaaa

SEQ ID NO: 4220623 - DNA, 23 bp, Homo sapiens
caccacctaggccactcctccaa

SEQ ID NO: 4220624 - DNA, 22 bp, Homo sapiens
caccacgatgtggccctggcct

SEQ ID NO: 4220625 - DNA, 17 bp, Homo sapiens
caccaggaatgttaaag

SEQ ID NO: 4220626 - DNA, 21 bp, Homo sapiens
caccaggaatgttaaagtcag

SEQ ID NO: 4220627 - DNA, 23 bp, Homo sapiens
caccaggaatgttaaagtcagtg

SEQ ID NO: 4220628 - DNA, 20 bp, Homo sapiens
caccaggcacgaacccacct

SEQ ID NO: 4220629 - DNA, 19 bp, Homo sapiens
caccatgtttgagctcaga

SEQ ID NO: 4220630 - DNA, 23 bp, Homo sapiens
cacccaaaagtcaaaaggtgcct

SEQ ID NO: 4220631 - DNA, 11 bp, Homo sapiens
cacccagccca

SEQ ID NO: 4220632 - DNA, 22 bp, Homo sapiens
cacccagcccattctctctcct

SEQ ID NO: 4220633 - DNA, 23 bp, Homo sapiens
cacccagcccattctctctcctg

SEQ ID NO: 4220634 - DNA, 15 bp, Homo sapiens
caccccctccccagg

SEQ ID NO: 4220635 - DNA, 17 bp, Homo sapiens
caccccctccccagggg

SEQ ID NO: 4220636 - DNA, 18 bp, Homo sapiens
caccctatccctgtacag

SEQ ID NO: 4220637 - DNA, 21 bp, Homo sapiens
caccctatccctgtacagagt

SEQ ID NO: 4220638 - DNA, 16 bp, Homo sapiens
caccctcaaatgtcag

SEQ ID NO: 4220639 - DNA, 13 bp, Homo sapiens
caccgctgcctaa

SEQ ID NO: 4220640 - DNA, 19 bp, Homo sapiens
caccgctgcctaagtggct

SEQ ID NO: 4220641 - DNA, 18 bp, Homo sapiens
cacctaggccactcctcc

SEQ ID NO: 4220642 - DNA, 15 bp, Homo sapiens
cacctccccccactg

SEQ ID NO: 4220643 - DNA, 14 bp, Homo sapiens
cacctctgcctcaa

SEQ ID NO: 4220644 - DNA, 18 bp, Homo sapiens
cacctgaaattaatttgt

SEQ ID NO: 4220645 - DNA, 21 bp, Homo sapiens
cacctgaaattaatttgtgaa

SEQ ID NO: 4220646 - DNA, 22 bp, Homo sapiens
cacctgaaattaatttgtgaat

SEQ ID NO: 4220647 - DNA, 13 bp, Homo sapiens
cacctgcacctcc

SEQ ID NO: 4220648 - DNA, 22 bp, Homo sapiens
cacctgcatccgtagttccctg

SEQ ID NO: 4220649 - DNA, 13 bp, Homo sapiens
cacctgccgacct

SEQ ID NO: 4220650 - DNA, 23 bp, Homo sapiens
cacctgccgacctcgtcctcccc

SEQ ID NO: 4220651 - DNA, 15 bp, Homo sapiens
ccactcagggctggg

SEQ ID NO: 4220652 - DNA, 17 bp, Homo sapiens
ccagactcctttcctct

SEQ ID NO: 4220653 - DNA, 18 bp, Homo sapiens
ccagagaaaattaattat

SEQ ID NO: 4220654 - DNA, 12 bp, Homo sapiens
ccagagacagga

SEQ ID NO: 4220655 - DNA, 14 bp, Homo sapiens
ccagagacaggaaa

SEQ ID NO: 4220656 - DNA, 13 bp, Homo sapiens
ccagatccaccct

SEQ ID NO: 4220657 - DNA, 18 bp, Homo sapiens
ccagcaaatgttcctttt

SEQ ID NO: 4220658 - DNA, 16 bp, Homo sapiens
ccagcccagcccagct

SEQ ID NO: 4220659 - DNA, 15 bp, Homo sapiens
ccagcccagcccgct

SEQ ID NO: 4220660 - DNA, 13 bp, Homo sapiens
ccagcccagctgg

SEQ ID NO: 4220661 - DNA, 14 bp, Homo sapiens
ccagccctccctgt

SEQ ID NO: 4220662 - DNA, 16 bp, Homo sapiens
ccagccctccctgtcc

SEQ ID NO: 4220663 - DNA, 17 bp, Homo sapiens
ccagccctccctgtcct

SEQ ID NO: 4220664 - DNA, 18 bp, Homo sapiens
ccagccctccctgtcctc

SEQ ID NO: 4220665 - DNA, 16 bp, Homo sapiens
ccagctctccctctgg

SEQ ID NO: 4220666 - DNA, 20 bp, Homo sapiens
ccagctctccctctggccct

SEQ ID NO: 4220667 - DNA, 22 bp, Homo sapiens
ccagctctccctctggccctgc

SEQ ID NO: 4220668 - DNA, 13 bp, Homo sapiens
ccaggaagatcca

SEQ ID NO: 4220669 - DNA, 13 bp, Homo sapiens
ccaggacaggacc

SEQ ID NO: 4220670 - DNA, 14 bp, Homo sapiens
ccaggacaggacca

SEQ ID NO: 4220671 - DNA, 14 bp, Homo sapiens
ccaggacaggcccg

SEQ ID NO: 4220672 - DNA, 18 bp, Homo sapiens
ccaggagagccagccctc

SEQ ID NO: 4220673 - DNA, 15 bp, Homo sapiens
ccaggatttataaag

SEQ ID NO: 4220674 - DNA, 17 bp, Homo sapiens
ccaggatttataaagca

SEQ ID NO: 4220675 - DNA, 21 bp, Homo sapiens
ccaggcacccttctttcctct

SEQ ID NO: 4220676 - DNA, 22 bp, Homo sapiens
ccaggcacccttctttcctctt

SEQ ID NO: 4220677 - DNA, 19 bp, Homo sapiens
ccaggcacgaacccacctg

SEQ ID NO: 4220678 - DNA, 22 bp, Homo sapiens
ccaggcacgaacccacctgctg

SEQ ID NO: 4220679 - DNA, 14 bp, Homo sapiens
ccaggcatgtccta

SEQ ID NO: 4220680 - DNA, 22 bp, Homo sapiens
ccaggcgctgggggctggacct

SEQ ID NO: 4220681 - DNA, 19 bp, Homo sapiens
ccagggccacgtgccaggc

SEQ ID NO: 4220682 - DNA, 21 bp, Homo sapiens
ccagggccacgtgccaggccc

SEQ ID NO: 4220683 - DNA, 22 bp, Homo sapiens
ccagggccacgtgccaggcccg

SEQ ID NO: 4220684 - DNA, 17 bp, Homo sapiens
ccaggtggctgacccag

SEQ ID NO: 4220685 - DNA, 23 bp, Homo sapiens
ccaggtggctgacccagtccctg

SEQ ID NO: 4220686 - DNA, 15 bp, Homo sapiens
ccagtccctggggga

SEQ ID NO: 4220687 - DNA, 22 bp, Homo sapiens
ccagtccctgggggaagccctg

SEQ ID NO: 4220688 - DNA, 18 bp, Homo sapiens
ccagtgccttacctcctg

SEQ ID NO: 4220689 - DNA, 13 bp, Homo sapiens
ccagttctgctcc

SEQ ID NO: 4220690 - DNA, 14 bp, Homo sapiens
ccagttctgctcct

SEQ ID NO: 4220691 - DNA, 16 bp, Homo sapiens
ccagttctgctcctct

SEQ ID NO: 4220692 - DNA, 12 bp, Homo sapiens
ccataaatcaat

SEQ ID NO: 4220693 - DNA, 15 bp, Homo sapiens
ccatatgtctgcttc

SEQ ID NO: 4220694 - DNA, 17 bp, Homo sapiens
ccatatgtctgcttctg

SEQ ID NO: 4220695 - DNA, 21 bp, Homo sapiens
ccatcctcccggctccctcct

SEQ ID NO: 4220696 - DNA, 20 bp, Homo sapiens
ccatcttattcccaattaaa

SEQ ID NO: 4220697 - DNA, 18 bp, Homo sapiens
ccatgaggagttgctgtt

SEQ ID NO: 4220698 - DNA, 16 bp, Homo sapiens
ccatgtttgagctcag

SEQ ID NO: 4220699 - DNA, 13 bp, Homo sapiens
ccattcctcaggg

SEQ ID NO: 4220700 - DNA, 16 bp, Homo sapiens
ccattcctcagggaca

SEQ ID NO: 4220701 - DNA, 14 bp, Homo sapiens
ccattctctctcct

SEQ ID NO: 4220702 - DNA, 20 bp, Homo sapiens
ccattctctctcctgtccaa

SEQ ID NO: 4220703 - DNA, 23 bp, Homo sapiens
cccaaagaattcctgaagccaga

SEQ ID NO: 4220704 - DNA, 13 bp, Homo sapiens
cccaaccaacttt

SEQ ID NO: 4220705 - DNA, 19 bp, Homo sapiens
cccaacctggctccctccc

SEQ ID NO: 4220706 - DNA, 20 bp, Homo sapiens
cccaacctggctccctccca

SEQ ID NO: 4220707 - DNA, 23 bp, Homo sapiens
cccaactcctggaagctgtgtcc

SEQ ID NO: 4220708 - DNA, 15 bp, Homo sapiens
cccaaggaggaaaaa

SEQ ID NO: 4220709 - DNA, 18 bp, Homo sapiens
cccaagtggcccccaccc

SEQ ID NO: 4220710 - DNA, 13 bp, Homo sapiens
cccaccacctagg

SEQ ID NO: 4220711 - DNA, 19 bp, Homo sapiens
cccaccacctaggccactc

SEQ ID NO: 4220712 - DNA, 21 bp, Homo sapiens
cccaccacctaggccactcct

SEQ ID NO: 4220713 - DNA, 22 bp, Homo sapiens
cccaccacctaggccactcctc

SEQ ID NO: 4220714 - DNA, 20 bp, Homo sapiens
cccaccacgatgtggccctg

SEQ ID NO: 4220715 - DNA, 19 bp, Homo sapiens
cccacccccttcagtgccc

SEQ ID NO: 4220716 - DNA, 23 bp, Homo sapiens
cccacccccttcagtgcccacca

SEQ ID NO: 4220717 - DNA, 17 bp, Homo sapiens
cccaccctcagcccgct

SEQ ID NO: 4220718 - DNA, 19 bp, Homo sapiens
cccactctcattccccagg

SEQ ID NO: 4220719 - DNA, 15 bp, Homo sapiens
cccactgcaacttgt

SEQ ID NO: 4220720 - DNA, 19 bp, Homo sapiens
cccactgcaacttgtgaac

SEQ ID NO: 4220721 - DNA, 15 bp, Homo sapiens
cccagagaggaatca

SEQ ID NO: 4220722 - DNA, 21 bp, Homo sapiens
cccagagaggaatcagacttc

SEQ ID NO: 4220723 - DNA, 17 bp, Homo sapiens
cccagagatgcctccac

SEQ ID NO: 4220724 - DNA, 20 bp, Homo sapiens
cccagagatgcctccaccgc

SEQ ID NO: 4220725 - DNA, 21 bp, Homo sapiens
cccagagatgcctccaccgct

SEQ ID NO: 4220726 - DNA, 23 bp, Homo sapiens
cccagagtgtgggaagggagagc

SEQ ID NO: 4220727 - DNA, 17 bp, Homo sapiens
cccagccctatggatgt

SEQ ID NO: 4220728 - DNA, 19 bp, Homo sapiens
cccagctctccctctggcc

SEQ ID NO: 4220729 - DNA, 21 bp, Homo sapiens
cccagcttcaaagcttaaaaa

SEQ ID NO: 4220730 - DNA, 15 bp, Homo sapiens
cccaggagagccagc

SEQ ID NO: 4220731 - DNA, 20 bp, Homo sapiens
cccaggctctggagccagag

SEQ ID NO: 4220732 - DNA, 13 bp, Homo sapiens
cccaggggagagg

SEQ ID NO: 4220733 - DNA, 22 bp, Homo sapiens
cccaggggagagggtctggaga

SEQ ID NO: 4220734 - DNA, 23 bp, Homo sapiens
cccaggtggctgacccagtccct

SEQ ID NO: 4220735 - DNA, 12 bp, Homo sapiens
cccagtccctgg

SEQ ID NO: 4220736 - DNA, 16 bp, Homo sapiens
cccagtccctggggga

SEQ ID NO: 4220737 - DNA, 14 bp, Homo sapiens
cccagttctgctcc

SEQ ID NO: 4220738 - DNA, 14 bp, Homo sapiens
cccatcagaaggag

SEQ ID NO: 4220739 - DNA, 22 bp, Homo sapiens
cccatcctcccggctccctcct

SEQ ID NO: 4220740 - DNA, 14 bp, Homo sapiens
cccattgccctggt

SEQ ID NO: 4220741 - DNA, 13 bp, Homo sapiens
ccccaactcctgg

SEQ ID NO: 4220742 - DNA, 15 bp, Homo sapiens
ccccaactcctggaa

SEQ ID NO: 4220743 - DNA, 17 bp, Homo sapiens
ccccaccccctccccag

SEQ ID NO: 4220744 - DNA, 23 bp, Homo sapiens
ccccaccccctccccaggggaga

SEQ ID NO: 4220745 - DNA, 15 bp, Homo sapiens
ccccactctcattcc

SEQ ID NO: 4220746 - DNA, 12 bp, Homo sapiens
ccccactgcagg

SEQ ID NO: 4220747 - DNA, 21 bp, Homo sapiens
ccccaggtggctgacccagtc

SEQ ID NO: 4220748 - DNA, 23 bp, Homo sapiens
ccccagtttgcagaaaagcacct

SEQ ID NO: 4220749 - DNA, 17 bp, Homo sapiens
ccccatgtctctcagaa

SEQ ID NO: 4220750 - DNA, 12 bp, Homo sapiens
cccccaccccct

SEQ ID NO: 4220751 - DNA, 14 bp, Homo sapiens
cccccactgcaggc

SEQ ID NO: 4220752 - DNA, 23 bp, Homo sapiens
cccccttcagtgcccaccaacat

SEQ ID NO: 4220753 - DNA, 15 bp, Homo sapiens
ccccgcttgtccagc

SEQ ID NO: 4220754 - DNA, 17 bp, Homo sapiens
ccccgcttgtccagcgc

SEQ ID NO: 4220755 - DNA, 15 bp, Homo sapiens
ccccggtcccttgag

SEQ ID NO: 4220756 - DNA, 20 bp, Homo sapiens
ccccgtctggggttcagccc

SEQ ID NO: 4220757 - DNA, 22 bp, Homo sapiens
ccccgtctggggttcagcccct

SEQ ID NO: 4220758 - DNA, 14 bp, Homo sapiens
cccctgccagtgcc

SEQ ID NO: 4220759 - DNA, 20 bp, Homo sapiens
cccgctcccccaaaaatttg

SEQ ID NO: 4220760 - DNA, 18 bp, Homo sapiens
cccgcttgtccagcgcct

SEQ ID NO: 4220761 - DNA, 22 bp, Homo sapiens
cccggtcccttgagacctcagc

SEQ ID NO: 4220762 - DNA, 23 bp, Homo sapiens
cccgtctggggttcagcccctcc

SEQ ID NO: 4220763 - DNA, 18 bp, Homo sapiens
ccctatccacccagccca

SEQ ID NO: 4220764 - DNA, 15 bp, Homo sapiens
ccctcaaatgtcaga

SEQ ID NO: 4220765 - DNA, 16 bp, Homo sapiens
ccctcattcaggaaaa

SEQ ID NO: 4220766 - DNA, 14 bp, Homo sapiens
ccctccccagggga

SEQ ID NO: 4220767 - DNA, 11 bp, Homo sapiens
ccctccttcca

SEQ ID NO: 4220768 - DNA, 19 bp, Homo sapiens
ccctctaataaagctcctc

SEQ ID NO: 4220769 - DNA, 11 bp, Homo sapiens
ccctctcctgc

SEQ ID NO: 4220770 - DNA, 16 bp, Homo sapiens
ccctgaaaacccagag

SEQ ID NO: 4220771 - DNA, 14 bp, Homo sapiens
ccctgacctcccag

SEQ ID NO: 4220772 - DNA, 16 bp, Homo sapiens
ccctgacctcccagcc

SEQ ID NO: 4220773 - DNA, 17 bp, Homo sapiens
ccctgacctcccagccc

SEQ ID NO: 4220774 - DNA, 13 bp, Homo sapiens
ccctgccgcctca

SEQ ID NO: 4220775 - DNA, 14 bp, Homo sapiens
ccctgccgcctcaa

SEQ ID NO: 4220776 - DNA, 16 bp, Homo sapiens
ccctgggccccaccac

SEQ ID NO: 4220777 - DNA, 20 bp, Homo sapiens
ccctgtaaatagttttaaat

SEQ ID NO: 4220778 - DNA, 15 bp, Homo sapiens
ccttggtgtccacct

SEQ ID NO: 4220779 - DNA, 16 bp, Homo sapiens
ccttggtgtccacctg

SEQ ID NO: 4220780 - DNA, 17 bp, Homo sapiens
ccttggtgtccacctgg

SEQ ID NO: 4220781 - DNA, 19 bp, Homo sapiens
ccttgtcaatactgagcca

SEQ ID NO: 4220782 - DNA, 14 bp, Homo sapiens
ccttgtgctcctgc

SEQ ID NO: 4220783 - DNA, 13 bp, Homo sapiens
ccttgtggcagag

SEQ ID NO: 4220784 - DNA, 22 bp, Homo sapiens
ccttgtttgattttagctgcag

SEQ ID NO: 4220785 - DNA, 14 bp, Homo sapiens
cctttactgaatgt

SEQ ID NO: 4220786 - DNA, 12 bp, Homo sapiens
cctttcctctga

SEQ ID NO: 4220787 - DNA, 13 bp, Homo sapiens
cctttccttccta

SEQ ID NO: 4220788 - DNA, 15 bp, Homo sapiens
cctttccttcctaat

SEQ ID NO: 4220789 - DNA, 21 bp, Homo sapiens
cctttccttccttccctggct

SEQ ID NO: 4220790 - DNA, 15 bp, Homo sapiens
cctttgcattcatct

SEQ ID NO: 4220791 - DNA, 22 bp, Homo sapiens
cgaaaggatgtaaacagtgcct

SEQ ID NO: 4220792 - DNA, 19 bp, Homo sapiens
cgaacatatcatttgtgaa

SEQ ID NO: 4220793 - DNA, 23 bp, Homo sapiens
cgaacatatcatttgtgaagaat

SEQ ID NO: 4220794 - DNA, 14 bp, Homo sapiens
cgaacatgaccaaa

SEQ ID NO: 4220795 - DNA, 16 bp, Homo sapiens
cgaacccacctgctga

SEQ ID NO: 4220796 - DNA, 14 bp, Homo sapiens
cgacctcgtcctcc

SEQ ID NO: 4220797 - DNA, 19 bp, Homo sapiens
cgacctcgtcctccccctg

SEQ ID NO: 4220798 - DNA, 15 bp, Homo sapiens
cgagagcctgctccc

SEQ ID NO: 4220799 - DNA, 19 bp, Homo sapiens
cgagagcctgctcccccac

SEQ ID NO: 4220800 - DNA, 20 bp, Homo sapiens
cgagagcctgctcccccacc

SEQ ID NO: 4220801 - DNA, 19 bp, Homo sapiens
cgagagtagccgagagcct

SEQ ID NO: 4220802 - DNA, 20 bp, Homo sapiens
cgagagtagccgagagcctg

SEQ ID NO: 4220803 - DNA, 16 bp, Homo sapiens
cgaggtcaacagagaa

SEQ ID NO: 4220804 - DNA, 20 bp, Homo sapiens
cgagtcaatcccctcattca

SEQ ID NO: 4220805 - DNA, 16 bp, Homo sapiens
cgatgtggccctggcc

SEQ ID NO: 4220806 - DNA, 17 bp, Homo sapiens
cgatgtggccctggcct

SEQ ID NO: 4220807 - DNA, 18 bp, Homo sapiens
cgatgtggccctggcctg

SEQ ID NO: 4220808 - DNA, 21 bp, Homo sapiens
cgcaagcctgtaatcccagct

SEQ ID NO: 4220809 - DNA, 20 bp, Homo sapiens
cgcacccagagaaaattaat

SEQ ID NO: 4220810 - DNA, 15 bp, Homo sapiens
cgcatcttctccatc

SEQ ID NO: 4220811 - DNA, 16 bp, Homo sapiens
cgcatcttctccatct

SEQ ID NO: 4220812 - DNA, 21 bp, Homo sapiens
cgcatcttctccatctggcag

SEQ ID NO: 4220813 - DNA, 13 bp, Homo sapiens
cgcattccctgag

SEQ ID NO: 4220814 - DNA, 20 bp, Homo sapiens
cgccgcgggccgtctgcact

SEQ ID NO: 4220815 - DNA, 20 bp, Homo sapiens
cgcctagtggggtctccctc

SEQ ID NO: 4220816 - DNA, 17 bp, Homo sapiens
cgcctgtaatcccagca

SEQ ID NO: 4220817 - DNA, 15 bp, Homo sapiens
cgctctgctggcctg

SEQ ID NO: 4220818 - DNA, 18 bp, Homo sapiens
cgctgccgcaccccagag

SEQ ID NO: 4220819 - DNA, 17 bp, Homo sapiens
cgctgcctaagtggctg

SEQ ID NO: 4220820 - DNA, 22 bp, Homo sapiens
cggaaacagacaagcaacccaa

SEQ ID NO: 4220821 - DNA, 20 bp, Homo sapiens
cggcaaccccagttctgctc

SEQ ID NO: 4220822 - DNA, 21 bp, Homo sapiens
cggcaaccccagttctgctcc

SEQ ID NO: 4220823 - DNA, 22 bp, Homo sapiens
cggcaaccccagttctgctcct

SEQ ID NO: 4220824 - DNA, 22 bp, Homo sapiens
cggcccacagctcccaccccac

SEQ ID NO: 4220825 - DNA, 13 bp, Homo sapiens
cggctactcagca

SEQ ID NO: 4220826 - DNA, 20 bp, Homo sapiens
cggctgagtcatgatctccc

SEQ ID NO: 4220827 - DNA, 15 bp, Homo sapiens
cggggaactcctgga

SEQ ID NO: 4220828 - DNA, 22 bp, Homo sapiens
cgtagttccctgaaaacccaga

SEQ ID NO: 4220829 - DNA, 13 bp, Homo sapiens
cgtcctccccctg

SEQ ID NO: 4220830 - DNA, 16 bp, Homo sapiens
cgtcctccccctgcca

SEQ ID NO: 4220831 - DNA, 17 bp, Homo sapiens
cgtcctccccctgccag

SEQ ID NO: 4220832 - DNA, 22 bp, Homo sapiens
cgtcctccccctgccagtgcct

SEQ ID NO: 4220833 - DNA, 18 bp, Homo sapiens
cgtctggggttcagcccc

SEQ ID NO: 4220834 - DNA, 19 bp, Homo sapiens
cgtctggggttcagcccct

SEQ ID NO: 4220835 - DNA, 23 bp, Homo sapiens
cgtctggggttcagcccctcctc

SEQ ID NO: 4220836 - DNA, 14 bp, Homo sapiens
cgtgactcacccaa

SEQ ID NO: 4220837 - DNA, 17 bp, Homo sapiens
cgtgactcacccaagca

SEQ ID NO: 4220838 - DNA, 23 bp, Homo sapiens
cgtgactgccccaactcctggaa

SEQ ID NO: 4220839 - DNA, 17 bp, Homo sapiens
cgtgatcactgagccat

SEQ ID NO: 4220840 - DNA, 23 bp, Homo sapiens
cgtgatgtagggtaaggtgcctt

SEQ ID NO: 4220841 - DNA, 10 bp, Homo sapiens
ctctgccacc

SEQ ID NO: 4220842 - DNA, 14 bp, Homo sapiens
ctctgccacctccc

SEQ ID NO: 4220843 - DNA, 16 bp, Homo sapiens
ctctgctggcctggcc

SEQ ID NO: 4220844 - DNA, 17 bp, Homo sapiens
ctctgctggcctggccg

SEQ ID NO: 4220845 - DNA, 16 bp, Homo sapiens
ctctggagccagagag

SEQ ID NO: 4220846 - DNA, 13 bp, Homo sapiens
ctctggccctgcc

SEQ ID NO: 4220847 - DNA, 14 bp, Homo sapiens
ctctgtcctgcttc

SEQ ID NO: 4220848 - DNA, 15 bp, Homo sapiens
ctcttccccttgccc

SEQ ID NO: 4220849 - DNA, 18 bp, Homo sapiens
ctctttgccatttcttct

SEQ ID NO: 4220850 - DNA, 13 bp, Homo sapiens
ctgaaaaatgtca

SEQ ID NO: 4220851 - DNA, 14 bp, Homo sapiens
ctgaaaacccagag

SEQ ID NO: 4220852 - DNA, 17 bp, Homo sapiens
ctgaaaacccagagagg

SEQ ID NO: 4220853 - DNA, 12 bp, Homo sapiens
ctgaaagccacg

SEQ ID NO: 4220854 - DNA, 17 bp, Homo sapiens
ctgaaattaatttgtga

SEQ ID NO: 4220855 - DNA, 17 bp, Homo sapiens
ctgaaccccctcaaaag

SEQ ID NO: 4220856 - DNA, 12 bp, Homo sapiens
ctgaaggagaag

SEQ ID NO: 4220857 - DNA, 19 bp, Homo sapiens
ctgaatccttccatttctt

SEQ ID NO: 4220858 - DNA, 21 bp, Homo sapiens
ctgaatccttccatttcttct

SEQ ID NO: 4220859 - DNA, 16 bp, Homo sapiens
ctgaattgtccccagt

SEQ ID NO: 4220860 - DNA, 16 bp, Homo sapiens
ctgaattttaaatgtt

SEQ ID NO: 4220861 - DNA, 21 bp, Homo sapiens
ctgacaggcactataatttct

SEQ ID NO: 4220862 - DNA, 14 bp, Homo sapiens
ctgacccagtccct

SEQ ID NO: 4220863 - DNA, 15 bp, Homo sapiens
ctgacccagtccctg

SEQ ID NO: 4220864 - DNA, 11 bp, Homo sapiens
ctgacctccca

SEQ ID NO: 4220865 - DNA, 23 bp, Homo sapiens
ctgacctcccagccctatggatg

SEQ ID NO: 4220866 - DNA, 20 bp, Homo sapiens
ctgagagacccaaggaggaa

SEQ ID NO: 4220867 - DNA, 13 bp, Homo sapiens
ctgaggaagaagg

SEQ ID NO: 4220868 - DNA, 15 bp, Homo sapiens
ctgagtcaccaggaa

SEQ ID NO: 4220869 - DNA, 17 bp, Homo sapiens
ctgagtcaccaggaatg

SEQ ID NO: 4220870 - DNA, 18 bp, Homo sapiens
ctgagtcatgatctccct

SEQ ID NO: 4220871 - DNA, 22 bp, Homo sapiens
ctgagtcatgatctccctgccg

SEQ ID NO: 4220872 - DNA, 13 bp, Homo sapiens
ctgagtgactgta

SEQ ID NO: 4220873 - DNA, 14 bp, Homo sapiens
ctgatgccatgttt

SEQ ID NO: 4220874 - DNA, 15 bp, Homo sapiens
ctgatgttactgaga

SEQ ID NO: 4220875 - DNA, 22 bp, Homo sapiens
ctgatgttgagggaacagacag

SEQ ID NO: 4220876 - DNA, 18 bp, Homo sapiens
ctgatgtttataaactga

SEQ ID NO: 4220877 - DNA, 19 bp, Homo sapiens
ctgcaacttgtaaatgtgg

SEQ ID NO: 4220878 - DNA, 11 bp, Homo sapiens
ctgcacctccc

SEQ ID NO: 4220879 - DNA, 17 bp, Homo sapiens
ctgcacctccccccact

SEQ ID NO: 4220880 - DNA, 18 bp, Homo sapiens
ctgcacctccccccactg

SEQ ID NO: 4220881 - DNA, 19 bp, Homo sapiens
ctgcacctccccccactgc

SEQ ID NO: 4220882 - DNA, 22 bp, Homo sapiens
ctgcacctccccccactgcagg

SEQ ID NO: 4220883 - DNA, 12 bp, Homo sapiens
ctgcagccagcc

SEQ ID NO: 4220884 - DNA, 14 bp, Homo sapiens
ctgcagccagccca

SEQ ID NO: 4220885 - DNA, 22 bp, Homo sapiens
ctgcaggccccgcttgtccagc

SEQ ID NO: 4220886 - DNA, 20 bp, Homo sapiens
ctgcatccgtagttccctga

SEQ ID NO: 4220887 - DNA, 21 bp, Homo sapiens
ctgcatccgtagttccctgaa

SEQ ID NO: 4220888 - DNA, 13 bp, Homo sapiens
ctgccaccctcct

SEQ ID NO: 4220889 - DNA, 16 bp, Homo sapiens
ctgccaccctcctgcg

SEQ ID NO: 4220890 - DNA, 13 bp, Homo sapiens
ctgccacctcccc

SEQ ID NO: 4220891 - DNA, 12 bp, Homo sapiens
ctgccagtgcct

SEQ ID NO: 4220892 - DNA, 18 bp, Homo sapiens
ctgccagtgccttacctc

SEQ ID NO: 4220893 - DNA, 20 bp, Homo sapiens
ctgccagtgccttacctcct

SEQ ID NO: 4220894 - DNA, 22 bp, Homo sapiens
ctgccagtgccttacctcctgc

SEQ ID NO: 4220895 - DNA, 23 bp, Homo sapiens
ctgcccaggagagccagccctcc

SEQ ID NO: 4220896 - DNA, 18 bp, Homo sapiens
ctgccccaactcctggaa

SEQ ID NO: 4220897 - DNA, 21 bp, Homo sapiens
ctgcccgcccagcacccccag

SEQ ID NO: 4220898 - DNA, 20 bp, Homo sapiens
ctgccctttctgctcctttc

SEQ ID NO: 4220899 - DNA, 15 bp, Homo sapiens
ctgccgacctcgtcc

SEQ ID NO: 4220900 - DNA, 17 bp, Homo sapiens
ctgccgacctcgtcctc

SEQ ID NO: 4220901 - DNA, 14 bp, Homo sapiens
ctgcctaagtggct

SEQ ID NO: 4220902 - DNA, 14 bp, Homo sapiens
ctgcgtgcggcgcg

SEQ ID NO: 4220903 - DNA, 16 bp, Homo sapiens
ctgctattatgtaaca

SEQ ID NO: 4220904 - DNA, 17 bp, Homo sapiens
ctgctcactttccaccc

SEQ ID NO: 4220905 - DNA, 13 bp, Homo sapiens
ctgctcccccacc

SEQ ID NO: 4220906 - DNA, 14 bp, Homo sapiens
ctgctcccccaccc

SEQ ID NO: 4220907 - DNA, 23 bp, Homo sapiens
ctgctcccccaccccctccccag

SEQ ID NO: 4220908 - DNA, 12 bp, Homo sapiens
ctgctcctccag

SEQ ID NO: 4220909 - DNA, 16 bp, Homo sapiens
ctgctcctccagggcc

SEQ ID NO: 4220910 - DNA, 22 bp, Homo sapiens
ctgctcctccagggccacgtgc

SEQ ID NO: 4220911 - DNA, 24 bp, Homo sapiens
ctgctcctccagggccacgtgcca

SEQ ID NO: 4220912 - DNA, 10 bp, Homo sapiens
gccagtgcct

SEQ ID NO: 4220913 - DNA, 15 bp, Homo sapiens
gccagtgccttacct

SEQ ID NO: 4220914 - DNA, 17 bp, Homo sapiens
gccagtgccttacctcc

SEQ ID NO: 4220915 - DNA, 19 bp, Homo sapiens
gccagtgccttacctcctg

SEQ ID NO: 4220916 - DNA, 21 bp, Homo sapiens
gccagtgccttacctcctgcc

SEQ ID NO: 4220917 - DNA, 19 bp, Homo sapiens
gccatttatacctttgaaa

SEQ ID NO: 4220918 - DNA, 13 bp, Homo sapiens
gcccacagctccc

SEQ ID NO: 4220919 - DNA, 13 bp, Homo sapiens
gcccagcaatcaa

SEQ ID NO: 4220920 - DNA, 17 bp, Homo sapiens
gcccagctggtgggaag

SEQ ID NO: 4220921 - DNA, 15 bp, Homo sapiens
gcccaggagagccag

SEQ ID NO: 4220922 - DNA, 14 bp, Homo sapiens
gcccattctctctc

SEQ ID NO: 4220923 - DNA, 18 bp, Homo sapiens
gccccaactcctggaagc

SEQ ID NO: 4220924 - DNA, 22 bp, Homo sapiens
gccccaactcctggaagctgtg

SEQ ID NO: 4220925 - DNA, 13 bp, Homo sapiens
gccccaccaccta

SEQ ID NO: 4220926 - DNA, 14 bp, Homo sapiens
gccccaccacctag

SEQ ID NO: 4220927 - DNA, 22 bp, Homo sapiens
gccccagactcctttcctctga

SEQ ID NO: 4220928 - DNA, 16 bp, Homo sapiens
gccccatgtctctcag

SEQ ID NO: 4220929 - DNA, 18 bp, Homo sapiens
gccccatgtctctcagaa

SEQ ID NO: 4220930 - DNA, 14 bp, Homo sapiens
gccccgcttgtcca

SEQ ID NO: 4220931 - DNA, 16 bp, Homo sapiens
gccccgcttgtccagc

SEQ ID NO: 4220932 - DNA, 18 bp, Homo sapiens
gccccgcttgtccagcgc

SEQ ID NO: 4220933 - DNA, 15 bp, Homo sapiens
gcccctcctctgcca

SEQ ID NO: 4220934 - DNA, 16 bp, Homo sapiens
gcccctcctctgccac

SEQ ID NO: 4220935 - DNA, 20 bp, Homo sapiens
gcccctcctctgccacctcc

SEQ ID NO: 4220936 - DNA, 23 bp, Homo sapiens
gccctccaagaggctccctcctg

SEQ ID NO: 4220937 - DNA, 14 bp, Homo sapiens
gccctccctgtcct

SEQ ID NO: 4220938 - DNA, 16 bp, Homo sapiens
gccctccctgtcctcc

SEQ ID NO: 4220939 - DNA, 18 bp, Homo sapiens
gccctccctgtcctcctc

SEQ ID NO: 4220940 - DNA, 21 bp, Homo sapiens
gccctcctcaccccgtctggg

SEQ ID NO: 4220941 - DNA, 10 bp, Homo sapiens
gccctccttc

SEQ ID NO: 4220942 - DNA, 13 bp, Homo sapiens
gccctggcctgct

SEQ ID NO: 4220943 - DNA, 16 bp, Homo sapiens
gccctggcctgctggg

SEQ ID NO: 4220944 - DNA, 16 bp, Homo sapiens
gcccttgccctgacct

SEQ ID NO: 4220945 - DNA, 21 bp, Homo sapiens
gcccttgccctgacctcccag

SEQ ID NO: 4220946 - DNA, 19 bp, Homo sapiens
gccgacctcgtcctccccc

SEQ ID NO: 4220947 - DNA, 16 bp, Homo sapiens
gccgagagcctgctcc

SEQ ID NO: 4220948 - DNA, 17 bp, Homo sapiens
gccgagagcctgctccc

SEQ ID NO: 4220949 - DNA, 17 bp, Homo sapiens
gccgcatcttctccatc

SEQ ID NO: 4220950 - DNA, 18 bp, Homo sapiens
gccgcatcttctccatct

SEQ ID NO: 4220951 - DNA, 15 bp, Homo sapiens
gccgcattccctgag

SEQ ID NO: 4220952 - DNA, 16 bp, Homo sapiens
gccgcattccctgagt

SEQ ID NO: 4220953 - DNA, 15 bp, Homo sapiens
gccgctgttcaccca

SEQ ID NO: 4220954 - DNA, 16 bp, Homo sapiens
gccgctgttcacccac

SEQ ID NO: 4220955 - DNA, 14 bp, Homo sapiens
gccgttactctcca

SEQ ID NO: 4220956 - DNA, 16 bp, Homo sapiens
gcctaagtggctgctg

SEQ ID NO: 4220957 - DNA, 17 bp, Homo sapiens
gcctaagtggctgctga

SEQ ID NO: 4220958 - DNA, 23 bp, Homo sapiens
gcctagtggggtctccctctcct

SEQ ID NO: 4220959 - DNA, 13 bp, Homo sapiens
gcctcacagaaga

SEQ ID NO: 4220960 - DNA, 16 bp, Homo sapiens
gcctcacagaagaata

SEQ ID NO: 4220961 - DNA, 22 bp, Homo sapiens
gcctcatctataacatgcattt

SEQ ID NO: 4220962 - DNA, 16 bp, Homo sapiens
gcctgccaccctcctg

SEQ ID NO: 4220963 - DNA, 20 bp, Homo sapiens
gcctgccaccctcctgcgca

SEQ ID NO: 4220964 - DNA, 15 bp, Homo sapiens
gcctgctaatagctg

SEQ ID NO: 4220965 - DNA, 19 bp, Homo sapiens
gcctgctcccccaccccct

SEQ ID NO: 4220966 - DNA, 17 bp, Homo sapiens
gcctgctgggctctcca

SEQ ID NO: 4220967 - DNA, 20 bp, Homo sapiens
gcctgctgggctctccacct

SEQ ID NO: 4220968 - DNA, 18 bp, Homo sapiens
gcctggccggcaacccca

SEQ ID NO: 4220969 - DNA, 17 bp, Homo sapiens
gcctgtaatcccagcta

SEQ ID NO: 4220970 - DNA, 18 bp, Homo sapiens
gcctgtaatcccagctac

SEQ ID NO: 4220971 - DNA, 18 bp, Homo sapiens
gcctgtggcggtgcctgg

SEQ ID NO: 4220972 - DNA, 13 bp, Homo sapiens
gccttacctcctg

SEQ ID NO: 4220973 - DNA, 14 bp, Homo sapiens
gccttacctcctgc

SEQ ID NO: 4220974 - DNA, 21 bp, Homo sapiens
gccttacctcctgcccaggag

SEQ ID NO: 4220975 - DNA, 22 bp, Homo sapiens
gccttacctcctgcccaggaga

SEQ ID NO: 4220976 - DNA, 22 bp, Homo sapiens
gccttcttcggggaactcctgg

SEQ ID NO: 4220977 - DNA, 19 bp, Homo sapiens
gccttggataatgctgttg

SEQ ID NO: 4220978 - DNA, 19 bp, Homo sapiens
gcctttcagaagtgattta

SEQ ID NO: 4220979 - DNA, 17 bp, Homo sapiens
gcgagaaaggcctctgt

SEQ ID NO: 4220980 - DNA, 22 bp, Homo sapiens
gcgaggtcaacagagaaggcag

SEQ ID NO: 4220981 - DNA, 21 bp, Homo sapiens
gcgcaagcctgtaatcccagc

SEQ ID NO: 4220982 - DNA, 20 bp, Homo sapiens
gcgcctagtggggtctccct

SEQ ID NO: 4220983 - DNA, 16 bp, Homo sapiens
gcgctgccgcacccca

SEQ ID NO: 4220984 - DNA, 21 bp, Homo sapiens
gcgctgggggctggacctgct

SEQ ID NO: 4220985 - DNA, 18 bp, Homo sapiens
gcggccgcattccctgag

SEQ ID NO: 4220986 - DNA, 19 bp, Homo sapiens
gcggccgcattccctgagt

SEQ ID NO: 4220987 - DNA, 20 bp, Homo sapiens
gcggctactcagcagccctc

SEQ ID NO: 4220988 - DNA, 21 bp, Homo sapiens
gcggctactcagcagccctcc

SEQ ID NO: 4220989 - DNA, 22 bp, Homo sapiens
gcggctactcagcagccctcct

SEQ ID NO: 4220990 - DNA, 14 bp, Homo sapiens
gcggctccagccca

SEQ ID NO: 4220991 - DNA, 23 bp, Homo sapiens
gcggctgagtcatgatctccctg

SEQ ID NO: 4220992 - DNA, 20 bp, Homo sapiens
gcgggaccggtacagaaagg

SEQ ID NO: 4220993 - DNA, 14 bp, Homo sapiens
gcgtgactcaccca

SEQ ID NO: 4220994 - DNA, 16 bp, Homo sapiens
gcgtgactcacccaag

SEQ ID NO: 4220995 - DNA, 21 bp, Homo sapiens
gctaattagaaatcaacttgt

SEQ ID NO: 4220996 - DNA, 12 bp, Homo sapiens
gctactcagcag

SEQ ID NO: 4220997 - DNA, 16 bp, Homo sapiens
gctactcagcagccct

SEQ ID NO: 4220998 - DNA, 19 bp, Homo sapiens
gctactcagcagccctcct

SEQ ID NO: 4220999 - DNA, 21 bp, Homo sapiens
gctactcagcagccctcctca

SEQ ID NO: 4221000 - DNA, 22 bp, Homo sapiens
gctactcagcagccctcctcac

SEQ ID NO: 4221001 - DNA, 24 bp, Homo sapiens
gctactcagcagccctcctcaccc

SEQ ID NO: 4221002 - DNA, 14 bp, Homo sapiens
gctactcaggaggc

SEQ ID NO: 4221003 - DNA, 21 bp, Homo sapiens
gctagcgctgccgcaccccag

SEQ ID NO: 4221004 - DNA, 18 bp, Homo sapiens
gctagggagaatgcagag

SEQ ID NO: 4221005 - DNA, 14 bp, Homo sapiens
gctagtcagagaga

SEQ ID NO: 4221006 - DNA, 19 bp, Homo sapiens
gctcacagttcctcgccct

SEQ ID NO: 4221007 - DNA, 22 bp, Homo sapiens
gctcacgcctgtaatcccagca

SEQ ID NO: 4221008 - DNA, 18 bp, Homo sapiens
gctcccaccccaccccct

SEQ ID NO: 4221009 - DNA, 21 bp, Homo sapiens
gctcccaccccacccccttca

SEQ ID NO: 4221010 - DNA, 18 bp, Homo sapiens
gctcccacgcctgcttct

SEQ ID NO: 4221011 - DNA, 13 bp, Homo sapiens
gctcctctccagg

SEQ ID NO: 4221012 - DNA, 15 bp, Homo sapiens
gctcctctccaggca

SEQ ID NO: 4221013 - DNA, 16 bp, Homo sapiens
gctcctctccaggcac

SEQ ID NO: 4221014 - DNA, 22 bp, Homo sapiens
gctcctctccaggcacccttct

SEQ ID NO: 4221015 - DNA, 20 bp, Homo sapiens
gctcctctgtcctgcttctg

SEQ ID NO: 4221016 - DNA, 16 bp, Homo sapiens
gctctatttccccacc

SEQ ID NO: 4221017 - DNA, 17 bp, Homo sapiens
gctctccacctcagcct

SEQ ID NO: 4221018 - DNA, 15 bp, Homo sapiens
gctctccctctggcc

SEQ ID NO: 4221019 - DNA, 17 bp, Homo sapiens
gctctccctctggccct

SEQ ID NO: 4221020 - DNA, 13 bp, Homo sapiens
gctctgctggcct

SEQ ID NO: 4221021 - DNA, 19 bp, Homo sapiens
gctctgctggcctggccgg

SEQ ID NO: 4221022 - DNA, 15 bp, Homo sapiens
gctctggagccagag

SEQ ID NO: 4221023 - DNA, 16 bp, Homo sapiens
gctgaacggggagaaa

SEQ ID NO: 4221024 - DNA, 21 bp, Homo sapiens
gctgaatccttccatttcttc

SEQ ID NO: 4221025 - DNA, 21 bp, Homo sapiens
gctgacatagtggatggacag

SEQ ID NO: 4221026 - DNA, 22 bp, Homo sapiens
gctgacatagtggatggacaga

SEQ ID NO: 4221027 - DNA, 15 bp, Homo sapiens
gctgacccagtccct

SEQ ID NO: 4221028 - DNA, 20 bp, Homo sapiens
gctgactgatgttgagggaa

SEQ ID NO: 4221029 - DNA, 21 bp, Homo sapiens
gctgagagtctgaaagacaga

SEQ ID NO: 4221030 - DNA, 13 bp, Homo sapiens
gctgaggcagaag

SEQ ID NO: 4221031 - DNA, 22 bp, Homo sapiens
gctgagtcatgatctccctgcc

SEQ ID NO: 4221032 - DNA, 19 bp, Homo sapiens
gctgatgtttataaactga

SEQ ID NO: 4221033 - DNA, 18 bp, Homo sapiens
gctgcctaagtggctgct

SEQ ID NO: 4221034 - DNA, 15 bp, Homo sapiens
gctgctcctccaggg

SEQ ID NO: 4221035 - DNA, 23 bp, Homo sapiens
gctgctcctccagggccacgtgc

SEQ ID NO: 4221036 - DNA, 14 bp, Homo sapiens
gctggaggcagggc

SEQ ID NO: 4221037 - DNA, 15 bp, Homo sapiens
gctggcagcctcagg

SEQ ID NO: 4221038 - DNA, 21 bp, Homo sapiens
gctggcggctactcagcagcc

SEQ ID NO: 4221039 - DNA, 21 bp, Homo sapiens
gctgggctctccacctcagcc

SEQ ID NO: 4221040 - DNA, 17 bp, Homo sapiens
gctgggggctggacctg

SEQ ID NO: 4221041 - DNA, 20 bp, Homo sapiens
gctgggggctggacctgctg

SEQ ID NO: 4221042 - DNA, 18 bp, Homo sapiens
gctggtattggtggcttt

SEQ ID NO: 4221043 - DNA, 21 bp, Homo sapiens
gctggtgggaagcgtctgtcc

SEQ ID NO: 4221044 - DNA, 15 bp, Homo sapiens
gctgtaaataaatgc

SEQ ID NO: 4221045 - DNA, 14 bp, Homo sapiens
gctgtccctgtcac

SEQ ID NO: 4221046 - DNA, 22 bp, Homo sapiens
gctgtggtacaaatgtgataat

SEQ ID NO: 4221047 - DNA, 14 bp, Homo sapiens
gctgtgtccttgca

SEQ ID NO: 4221048 - DNA, 21 bp, Homo sapiens
gctgtgtccttgcacctgcat

SEQ ID NO: 4221049 - DNA, 15 bp, Homo sapiens
gctgttgcctcatct

SEQ ID NO: 4221050 - DNA, 13 bp, Homo sapiens
gctgttgtaaaga

SEQ ID NO: 4221051 - DNA, 18 bp, Homo sapiens
gcttccacccctctcctc

SEQ ID NO: 4221052 - DNA, 21 bp, Homo sapiens
gcttctctgtgcccctgtaaa

SEQ ID NO: 4221053 - DNA, 19 bp, Homo sapiens
gcttcttcagatcagtgct

SEQ ID NO: 4221054 - DNA, 13 bp, Homo sapiens
gcttcttcatctt

SEQ ID NO: 4221055 - DNA, 21 bp, Homo sapiens
gcttgtgtatatgtataaatt

SEQ ID NO: 4221056 - DNA, 18 bp, Homo sapiens
gctttaaactaccctcca

SEQ ID NO: 4221057 - DNA, 22 bp, Homo sapiens
gctttaaactaccctccagagt

SEQ ID NO: 4221058 - DNA, 19 bp, Homo sapiens
gcttttccaggaagatcca

SEQ ID NO: 4221059 - DNA, 22 bp, Homo sapiens
gcttttccccggtcccttgaga

SEQ ID NO: 4221060 - DNA, 13 bp, Homo sapiens
ggaaaaaattaac

SEQ ID NO: 4221061 - DNA, 16 bp, Homo sapiens
ggaaaactgacagagg

SEQ ID NO: 4221062 - DNA, 15 bp, Homo sapiens
ggaaaatgcttctgt

SEQ ID NO: 4221063 - DNA, 16 bp, Homo sapiens
ggaaatatcagttact

SEQ ID NO: 4221064 - DNA, 23 bp, Homo sapiens
ggaaccgaacatatcatttgtga

SEQ ID NO: 4221065 - DNA, 17 bp, Homo sapiens
ggaagcatgtaggagaa

SEQ ID NO: 4221066 - DNA, 15 bp, Homo sapiens
ggaagccctccttcc

SEQ ID NO: 4221067 - DNA, 17 bp, Homo sapiens
ggaagccctccttccac

SEQ ID NO: 4221068 - DNA, 23 bp, Homo sapiens
ggaagccctggatttcagaaaga

SEQ ID NO: 4221069 - DNA, 20 bp, Homo sapiens
ggaaggagactcacctctgc

SEQ ID NO: 4221070 - DNA, 17 bp, Homo sapiens
ggaaggctgagaggaga

SEQ ID NO: 4221071 - DNA, 18 bp, Homo sapiens
ggacagagacacctgcac

SEQ ID NO: 4221072 - DNA, 21 bp, Homo sapiens
ggacagcctgtggcggtgcct

SEQ ID NO: 4221073 - DNA, 23 bp, Homo sapiens
ggacagcctgtggcggtgcctgg

SEQ ID NO: 4221074 - DNA, 22 bp, Homo sapiens
ggacaggcccggcgcggtggct

SEQ ID NO: 4221075 - DNA, 23 bp, Homo sapiens
ggaccctttccttccttccctgg

SEQ ID NO: 4221076 - DNA, 19 bp, Homo sapiens
ggactcaagggtccagaag

SEQ ID NO: 4221077 - DNA, 21 bp, Homo sapiens
ggactcacaggttggaagaga

SEQ ID NO: 4221078 - DNA, 19 bp, Homo sapiens
ggactgaattgtccccagt

SEQ ID NO: 4221079 - DNA, 20 bp, Homo sapiens
ggagaaatgcatccattcct

SEQ ID NO: 4221080 - DNA, 23 bp, Homo sapiens
ggagaaatgcatccattcctcag

SEQ ID NO: 4221081 - DNA, 9 bp, Homo sapiens
ggagactca

SEQ ID NO: 4221082 - DNA, 14 bp, Homo sapiens
ggagagccagccct

SEQ ID NO: 4221083 - DNA, 17 bp, Homo sapiens
ggagagggtctggagaa

SEQ ID NO: 4221084 - DNA, 20 bp, Homo sapiens
ggagagggtctggagaagca

SEQ ID NO: 4221085 - DNA, 23 bp, Homo sapiens
ggagagggtctggagaagcagtg

SEQ ID NO: 4221086 - DNA, 22 bp, Homo sapiens
ggagatatttatggggggagaa

SEQ ID NO: 4221087 - DNA, 15 bp, Homo sapiens
ggagccaccagcccc

SEQ ID NO: 4221088 - DNA, 15 bp, Homo sapiens
ggagctgggaggaaa

SEQ ID NO: 4221089 - DNA, 13 bp, Homo sapiens
ggaggcagggcct

SEQ ID NO: 4221090 - DNA, 18 bp, Homo sapiens
ggaggcagggccttgccc

SEQ ID NO: 4221091 - DNA, 14 bp, Homo sapiens
ggaggctgaggcag

SEQ ID NO: 4221092 - DNA, 15 bp, Homo sapiens
ggaggctgaggcaga

SEQ ID NO: 4221093 - DNA, 20 bp, Homo sapiens
ggatcacaagaatcacctca

SEQ ID NO: 4221094 - DNA, 12 bp, Homo sapiens
ggatggacagat

SEQ ID NO: 4221095 - DNA, 16 bp, Homo sapiens
ggatggacagatggac

SEQ ID NO: 4221096 - DNA, 20 bp, Homo sapiens
ggatggacagatggaccaaa

SEQ ID NO: 4221097 - DNA, 18 bp, Homo sapiens
ggatgtaaacagtgcctg

SEQ ID NO: 4221098 - DNA, 20 bp, Homo sapiens
ggatgtaaacagtgcctgct

SEQ ID NO: 4221099 - DNA, 22 bp, Homo sapiens
ggatgtggggtccccatcatcc

SEQ ID NO: 4221100 - DNA, 23 bp, Homo sapiens
ggattttgaattagattatttct

SEQ ID NO: 4221101 - DNA, 17 bp, Homo sapiens
ggcaaccccagttctgc

SEQ ID NO: 4221102 - DNA, 18 bp, Homo sapiens
ggcaaccccagttctgct

SEQ ID NO: 4221103 - DNA, 21 bp, Homo sapiens
ggcaaccccagttctgctcct

SEQ ID NO: 4221104 - DNA, 22 bp, Homo sapiens
ggcaaccccagttctgctcctc

SEQ ID NO: 4221105 - DNA, 23 bp, Homo sapiens
ggcaaccccagttctgctcctct

SEQ ID NO: 4221106 - DNA, 20 bp, Homo sapiens
ggcaagcagaaaaattaaat

SEQ ID NO: 4221107 - DNA, 17 bp, Homo sapiens
ggcacgaacccacctgc

SEQ ID NO: 4221108 - DNA, 20 bp, Homo sapiens
ggcacgaacccacctgctga

SEQ ID NO: 4221109 - DNA, 18 bp, Homo sapiens
ggcagaggatgtctcaaa

SEQ ID NO: 4221110 - DNA, 13 bp, Homo sapiens
ggcagaggctgga

SEQ ID NO: 4221111 - DNA, 23 bp, Homo sapiens
ggcagaggctggaggcagggcct

SEQ ID NO: 4221112 - DNA, 20 bp, Homo sapiens
ggcagagggcagaggctgga

SEQ ID NO: 4221113 - DNA, 16 bp, Homo sapiens
ggcagggccttgccca

SEQ ID NO: 4221114 - DNA, 21 bp, Homo sapiens
ggcagggccttgcccagagat

SEQ ID NO: 4221115 - DNA, 11 bp, Homo sapiens
ggcagggctgg

SEQ ID NO: 4221116 - DNA, 21 bp, Homo sapiens
ggcatggtggcgcaagcctgt

SEQ ID NO: 4221117 - DNA, 16 bp, Homo sapiens
ggccacgtgccaggcc

SEQ ID NO: 4221118 - DNA, 16 bp, Homo sapiens
ggccaggacaggcccg

SEQ ID NO: 4221119 - DNA, 15 bp, Homo sapiens
ggcccacagctccca

SEQ ID NO: 4221120 - DNA, 20 bp, Homo sapiens
ggcccacagctcccacccca

SEQ ID NO: 4221121 - DNA, 19 bp, Homo sapiens
ggccccgcttgtccagcgc

SEQ ID NO: 4221122 - DNA, 23 bp, Homo sapiens
ggcccggcgcggtggctcacgcc

SEQ ID NO: 4221123 - DNA, 19 bp, Homo sapiens
ggcccggggctggcggcta

SEQ ID NO: 4221124 - DNA, 22 bp, Homo sapiens
ggcccggggctggcggctactc

SEQ ID NO: 4221125 - DNA, 10 bp, Homo sapiens
ggccctgcct

SEQ ID NO: 4221126 - DNA, 17 bp, Homo sapiens
ggccgcattccctgagt

SEQ ID NO: 4221127 - DNA, 19 bp, Homo sapiens
ggccgctgttcacccacag

SEQ ID NO: 4221128 - DNA, 17 bp, Homo sapiens
ggcctgccaccctcctg

SEQ ID NO: 4221129 - DNA, 17 bp, Homo sapiens
ggcctgctgggctctcc

SEQ ID NO: 4221130 - DNA, 21 bp, Homo sapiens
ggcctgctgggctctccacct

SEQ ID NO: 4221131 - DNA, 21 bp, Homo sapiens
ggcctggccggcaaccccagt

SEQ ID NO: 4221132 - DNA, 15 bp, Homo sapiens
ggccttgcccagaga

SEQ ID NO: 4221133 - DNA, 18 bp, Homo sapiens
ggcgctgggggctggacc

SEQ ID NO: 4221134 - DNA, 17 bp, Homo sapiens
ggcgtgactcacccaag

SEQ ID NO: 4221135 - DNA, 20 bp, Homo sapiens
ggctactcagcagccctcct

SEQ ID NO: 4221136 - DNA, 21 bp, Homo sapiens
ggctactcagcagccctcctc

SEQ ID NO: 4221137 - DNA, 15 bp, Homo sapiens
ggctagtcagagaga

SEQ ID NO: 4221138 - DNA, 18 bp, Homo sapiens
ggctagtcagagagagtg

SEQ ID NO: 4221139 - DNA, 22 bp, Homo sapiens
ggctcacgcctgtaatcccagc

SEQ ID NO: 4221140 - DNA, 24 bp, Homo sapiens
ggctcacgcctgtaatcccagcag

SEQ ID NO: 4221141 - DNA, 11 bp, Homo sapiens
ggctccctcct

SEQ ID NO: 4221142 - DNA, 13 bp, Homo sapiens
ggctccctcctgt

SEQ ID NO: 4221143 - DNA, 16 bp, Homo sapiens
ggctctccacctcagc

SEQ ID NO: 4221144 - DNA, 19 bp, Homo sapiens
ggctctccacctcagcctt

SEQ ID NO: 4221145 - DNA, 16 bp, Homo sapiens
ggctctggagccagag

SEQ ID NO: 4221146 - DNA, 22 bp, Homo sapiens
ggctgacccagtccctggggga

SEQ ID NO: 4221147 - DNA, 12 bp, Homo sapiens
ggctgctcctcc

SEQ ID NO: 4221148 - DNA, 13 bp, Homo sapiens
ggctgctcctcca

SEQ ID NO: 4221149 - DNA, 15 bp, Homo sapiens
ggctgctcctccagg

SEQ ID NO: 4221150 - DNA, 13 bp, Homo sapiens
ggctggacctgct

SEQ ID NO: 4221151 - DNA, 20 bp, Homo sapiens
ggctggcggctactcagcag

SEQ ID NO: 4221152 - DNA, 19 bp, Homo sapiens
ggctggggccaagaggaaa

SEQ ID NO: 4221153 - DNA, 15 bp, Homo sapiens
ggcttgtaactccac

SEQ ID NO: 4221154 - DNA, 17 bp, Homo sapiens
ggcttgtaactccacca

SEQ ID NO: 4221155 - DNA, 23 bp, Homo sapiens
ggctttaaactaccctccagagt

SEQ ID NO: 4221156 - DNA, 13 bp, Homo sapiens
ggctttccttgtg

SEQ ID NO: 4221157 - DNA, 16 bp, Homo sapiens
gggaaaaaaagaaaaa

SEQ ID NO: 4221158 - DNA, 14 bp, Homo sapiens
gggaacagacagga

SEQ ID NO: 4221159 - DNA, 15 bp, Homo sapiens
gggaacagacaggag

SEQ ID NO: 4221160 - DNA, 12 bp, Homo sapiens
gggaagccctgg

SEQ ID NO: 4221161 - DNA, 16 bp, Homo sapiens
gggaccctttccttcc

SEQ ID NO: 4221162 - DNA, 18 bp, Homo sapiens
gggaccggtacagaaagg

SEQ ID NO: 4221163 - DNA, 19 bp, Homo sapiens
gggactcaagggtccagaa

SEQ ID NO: 4221164 - DNA, 15 bp, Homo sapiens
gggagagggtctgga

SEQ ID NO: 4221165 - DNA, 16 bp, Homo sapiens
gggaggaaaagaaaag

SEQ ID NO: 4221166 - DNA, 16 bp, Homo sapiens
gggaggtcgaggtagg

SEQ ID NO: 4221167 - DNA, 14 bp, Homo sapiens
gggcagaggctgga

SEQ ID NO: 4221168 - DNA, 23 bp, Homo sapiens
gggcagaggctggaggcagggcc

SEQ ID NO: 4221169 - DNA, 15 bp, Homo sapiens
gggcagagggcagag

SEQ ID NO: 4221170 - DNA, 14 bp, Homo sapiens
gggcagggctggga

SEQ ID NO: 4221171 - DNA, 14 bp, Homo sapiens
gggccacgtgccag

SEQ ID NO: 4221172 - DNA, 16 bp, Homo sapiens
gggccaggacaggccc

SEQ ID NO: 4221173 - DNA, 17 bp, Homo sapiens
gggccaggacaggcccg

SEQ ID NO: 4221174 - DNA, 14 bp, Homo sapiens
gggccttgcccaga

SEQ ID NO: 4221175 - DNA, 15 bp, Homo sapiens
gggccttgcccagag

SEQ ID NO: 4221176 - DNA, 17 bp, Homo sapiens
gggccttgcccagagat

SEQ ID NO: 4221177 - DNA, 23 bp, Homo sapiens
gggctaagagctagcgctgccgc

SEQ ID NO: 4221178 - DNA, 13 bp, Homo sapiens
gggctctccacct

SEQ ID NO: 4221179 - DNA, 14 bp, Homo sapiens
gggctctccacctc

SEQ ID NO: 4221180 - DNA, 15 bp, Homo sapiens
ggggaaaaaattaac

SEQ ID NO: 4221181 - DNA, 22 bp, Homo sapiens
ggggcagagggcagaggctgga

SEQ ID NO: 4221182 - DNA, 15 bp, Homo sapiens
ggggctgctcctcca

SEQ ID NO: 4221183 - DNA, 19 bp, Homo sapiens
ggggtctccctctcctgcc

SEQ ID NO: 4221184 - DNA, 20 bp, Homo sapiens
ggggtctccctctcctgcct

SEQ ID NO: 4221185 - DNA, 23 bp, Homo sapiens
ggggttcagcccctcctctgcca

SEQ ID NO: 4221186 - DNA, 13 bp, Homo sapiens
ggggttgaagaaa

SEQ ID NO: 4221187 - DNA, 13 bp, Homo sapiens
gggtaaggtgcct

SEQ ID NO: 4221188 - DNA, 22 bp, Homo sapiens
gggtccccatcatcccagctgc

SEQ ID NO: 4221189 - DNA, 19 bp, Homo sapiens
gggtctccctctcctgcct

SEQ ID NO: 4221190 - DNA, 12 bp, Homo sapiens
gggtgggcaggg

SEQ ID NO: 4221191 - DNA, 16 bp, Homo sapiens
gggtgggcagggctgg

SEQ ID NO: 4221192 - DNA, 13 bp, Homo sapiens
gggttcagcccct

SEQ ID NO: 4221193 - DNA, 19 bp, Homo sapiens
gggttcagcccctcctctg

SEQ ID NO: 4221194 - DNA, 21 bp, Homo sapiens
gggttcagcccctcctctgcc

SEQ ID NO: 4221195 - DNA, 13 bp, Homo sapiens
ggtaaggtgcctt

SEQ ID NO: 4221196 - DNA, 14 bp, Homo sapiens
ggtactgttgcttt

SEQ ID NO: 4221197 - DNA, 22 bp, Homo sapiens
ggtatatcattataactgaagg

SEQ ID NO: 4221198 - DNA, 20 bp, Homo sapiens
ggtcaacagagaaggcagga

SEQ ID NO: 4221199 - DNA, 21 bp, Homo sapiens
ggtccccatcatcccagctgc

SEQ ID NO: 4221200 - DNA, 19 bp, Homo sapiens
ggtcccttgagacctcagc

SEQ ID NO: 4221201 - DNA, 17 bp, Homo sapiens
ggtccggtgtccttttc

SEQ ID NO: 4221202 - DNA, 14 bp, Homo sapiens
ggtctagggagaga

SEQ ID NO: 4221203 - DNA, 18 bp, Homo sapiens
ggtctccctctcctgcct

SEQ ID NO: 4221204 - DNA, 18 bp, Homo sapiens
ggtgcctgtgaggcaggg

SEQ ID NO: 4221205 - DNA, 18 bp, Homo sapiens
ggtggaagccctccttcc

SEQ ID NO: 4221206 - DNA, 20 bp, Homo sapiens
ggtggaggttgcagtgagct

SEQ ID NO: 4221207 - DNA, 13 bp, Homo sapiens
ggtggctgaccca

SEQ ID NO: 4221208 - DNA, 18 bp, Homo sapiens
ggtggctgacccagtccc

SEQ ID NO: 4221209 - DNA, 22 bp, Homo sapiens
ggtggctttccttgtggcagag

SEQ ID NO: 4221210 - DNA, 23 bp, Homo sapiens
ggtggctttccttgtggcagagg

SEQ ID NO: 4221211 - DNA, 17 bp, Homo sapiens
ggtgggatggaggagaa

SEQ ID NO: 4221212 - DNA, 18 bp, Homo sapiens
ggttcagcccctcctctg

SEQ ID NO: 4221213 - DNA, 19 bp, Homo sapiens
ggttcagcccctcctctgc

SEQ ID NO: 4221214 - DNA, 21 bp, Homo sapiens
ggttcagcccctcctctgcca

SEQ ID NO: 4221215 - DNA, 13 bp, Homo sapiens
gtaaacagtgcct

SEQ ID NO: 4221216 - DNA, 19 bp, Homo sapiens
gtaaatagttttaaatatg

SEQ ID NO: 4221217 - DNA, 17 bp, Homo sapiens
gtaaatatgtgaagaaa

SEQ ID NO: 4221218 - DNA, 12 bp, Homo sapiens
gtaactccacca

SEQ ID NO: 4221219 - DNA, 14 bp, Homo sapiens
gtaagaaaaccaaa

SEQ ID NO: 4221220 - DNA, 17 bp, Homo sapiens
gtaatccatcactagcc

SEQ ID NO: 4221221 - DNA, 19 bp, Homo sapiens
gtaatgtcaccaccttccc

SEQ ID NO: 4221222 - DNA, 13 bp, Homo sapiens
gtaattaaaagac

SEQ ID NO: 4221223 - DNA, 19 bp, Homo sapiens
gtacaaatgtgataatata

SEQ ID NO: 4221224 - DNA, 18 bp, Homo sapiens
gtacagtagtatctgctt

SEQ ID NO: 4221225 - DNA, 17 bp, Homo sapiens
gtacagtggagaaatat

SEQ ID NO: 4221226 - DNA, 20 bp, Homo sapiens
gtacattgaaaccctccaaa

SEQ ID NO: 4221227 - DNA, 18 bp, Homo sapiens
gtagcaggtaccactgat

SEQ ID NO: 4221228 - DNA, 16 bp, Homo sapiens
gtaggggttgaagaaa

SEQ ID NO: 4221229 - DNA, 13 bp, Homo sapiens
gtagttccctgaa

SEQ ID NO: 4221230 - DNA, 20 bp, Homo sapiens
gtagttccctgaaaacccag

SEQ ID NO: 4221231 - DNA, 23 bp, Homo sapiens
gtagttccctgaaaacccagaga

SEQ ID NO: 4221232 - DNA, 12 bp, Homo sapiens
gtataaattaat

SEQ ID NO: 4221233 - DNA, 17 bp, Homo sapiens
gtattggtggctttcct

SEQ ID NO: 4221234 - DNA, 14 bp, Homo sapiens
gtcaaacgtgaaaa

SEQ ID NO: 4221235 - DNA, 15 bp, Homo sapiens
gtcaaacgtgaaaat

SEQ ID NO: 4221236 - DNA, 18 bp, Homo sapiens
gtcaaagcattgagatct

SEQ ID NO: 4221237 - DNA, 18 bp, Homo sapiens
gtcaacagagaaggcagg

SEQ ID NO: 4221238 - DNA, 23 bp, Homo sapiens
gtcaacagagaaggcaggaatgt

SEQ ID NO: 4221239 - DNA, 19 bp, Homo sapiens
gtcaattccacccctcctc

SEQ ID NO: 4221240 - DNA, 17 bp, Homo sapiens
gtcaccaagctcacagt

SEQ ID NO: 4221241 - DNA, 14 bp, Homo sapiens
gtcaccaccttccc

SEQ ID NO: 4221242 - DNA, 16 bp, Homo sapiens
gtcaccaccttcccag

SEQ ID NO: 4221243 - DNA, 19 bp, Homo sapiens
gtcaccaccttcccagctc

SEQ ID NO: 4221244 - DNA, 20 bp, Homo sapiens
gtcaccaccttcccagctct

SEQ ID NO: 4221245 - DNA, 18 bp, Homo sapiens
gtcaccaggaatgttaaa

SEQ ID NO: 4221246 - DNA, 21 bp, Homo sapiens
gtcacccaggctctggagcca

SEQ ID NO: 4221247 - DNA, 13 bp, Homo sapiens
gtcagagctatgt

SEQ ID NO: 4221248 - DNA, 17 bp, Homo sapiens
gtcatgatctccctgcc

SEQ ID NO: 4221249 - DNA, 15 bp, Homo sapiens
gtcatttgcaagctg

SEQ ID NO: 4221250 - DNA, 22 bp, Homo sapiens
gtccattgtaaatctgaagaaa

SEQ ID NO: 4221251 - DNA, 24 bp, Homo sapiens
gtcccagggaagaggaatcgcccc

SEQ ID NO: 4221252 - DNA, 17 bp, Homo sapiens
gtccccatcatcccagc

SEQ ID NO: 4221253 - DNA, 19 bp, Homo sapiens
gtccccatcatcccagctg

SEQ ID NO: 4221254 - DNA, 21 bp, Homo sapiens
gtcccggcgtttacctcgtgg

SEQ ID NO: 4221255 - DNA, 15 bp, Homo sapiens
gtcccggcttccacc

SEQ ID NO: 4221256 - DNA, 14 bp, Homo sapiens
gtcccttgagacct

SEQ ID NO: 4221257 - DNA, 18 bp, Homo sapiens
gtcccttgagacctcagc

SEQ ID NO: 4221258 - DNA, 15 bp, Homo sapiens
gtcctaggctctggg

SEQ ID NO: 4221259 - DNA, 15 bp, Homo sapiens
gtcctccccctgcca

SEQ ID NO: 4221260 - DNA, 19 bp, Homo sapiens
gtcctccccctgccagtgc

SEQ ID NO: 4221261 - DNA, 22 bp, Homo sapiens
gtcctcctcggatcaccgagag

SEQ ID NO: 4221262 - DNA, 15 bp, Homo sapiens
gtcctgcccaatgcc

SEQ ID NO: 4221263 - DNA, 13 bp, Homo sapiens
gtcctgcttctga

SEQ ID NO: 4221264 - DNA, 14 bp, Homo sapiens
gtccttgcacctgc

SEQ ID NO: 4221265 - DNA, 18 bp, Homo sapiens
gtccttgcacctgcatcc

SEQ ID NO: 4221266 - DNA, 18 bp, Homo sapiens
gtcgctctgctggcctgg

SEQ ID NO: 4221267 - DNA, 22 bp, Homo sapiens
gtctcccactgcaacttgtgaa

SEQ ID NO: 4221268 - DNA, 14 bp, Homo sapiens
gtctccctctcctg

SEQ ID NO: 4221269 - DNA, 17 bp, Homo sapiens
gtctccctctcctgcct

SEQ ID NO: 4221270 - DNA, 22 bp, Homo sapiens
gtctccctctcctgcctactca

SEQ ID NO: 4221271 - DNA, 18 bp, Homo sapiens
gtctcctacctgctgctg

SEQ ID NO: 4221272 - DNA, 23 bp, Homo sapiens
gtctcgggtggctagtcagagag

SEQ ID NO: 4221273 - DNA, 17 bp, Homo sapiens
gtctggagaagcagtga

SEQ ID NO: 4221274 - DNA, 19 bp, Homo sapiens
gtctggagaagcagtgagc

SEQ ID NO: 4221275 - DNA, 22 bp, Homo sapiens
gtctggatctgggaccctttcc

SEQ ID NO: 4221276 - DNA, 16 bp, Homo sapiens
gtctggggttcagccc

SEQ ID NO: 4221277 - DNA, 15 bp, Homo sapiens
gtcttaatgttgaat

SEQ ID NO: 4221278 - DNA, 15 bp, Homo sapiens
gtgaactccatcatt

SEQ ID NO: 4221279 - DNA, 20 bp, Homo sapiens
gtgaagaaaaagacctgcat

SEQ ID NO: 4221280 - DNA, 16 bp, Homo sapiens
gtgactgccccaactc

SEQ ID NO: 4221281 - DNA, 20 bp, Homo sapiens
gtgactgccccaactcctgg

SEQ ID NO: 4221282 - DNA, 13 bp, Homo sapiens
gtgagagtgagct

SEQ ID NO: 4221283 - DNA, 12 bp, Homo sapiens
gtgagccgcatc

SEQ ID NO: 4221284 - DNA, 21 bp, Homo sapiens
gtgagccgcatcttctccatc

SEQ ID NO: 4221285 - DNA, 15 bp, Homo sapiens
gtgatggggtgggca

SEQ ID NO: 4221286 - DNA, 13 bp, Homo sapiens
gtgcatgctctct

SEQ ID NO: 4221287 - DNA, 21 bp, Homo sapiens
gtgcatgctctctgcagccag

SEQ ID NO: 4221288 - DNA, 12 bp, Homo sapiens
gtgccaggcccg

SEQ ID NO: 4221289 - DNA, 20 bp, Homo sapiens
gtgccaggcccggggctggc

SEQ ID NO: 4221290 - DNA, 23 bp, Homo sapiens
gtgcccaccaacatcccattgcc

SEQ ID NO: 4221291 - DNA, 17 bp, Homo sapiens
tcgtcatttgcaagctg

SEQ ID NO: 4221292 - DNA, 17 bp, Homo sapiens
tcgtcctccccctgcca

SEQ ID NO: 4221293 - DNA, 12 bp, Homo sapiens
tcgttactggca

SEQ ID NO: 4221294 - DNA, 20 bp, Homo sapiens
tggctttccttgtggcagag

SEQ ID NO: 4221295 - DNA, 13 bp, Homo sapiens
tgggaactagact

SEQ ID NO: 4221296 - DNA, 21 bp, Homo sapiens
tgggaagggagagcggggcag

SEQ ID NO: 4221297 - DNA, 17 bp, Homo sapiens
tgggaccctttccttcc

SEQ ID NO: 4221298 - DNA, 18 bp, Homo sapiens
tgggaggaaagagagcag

SEQ ID NO: 4221299 - DNA, 9 bp, Homo sapiens
tcagtgccc

SEQ ID NO: 4221300 - DNA, 12 bp, Homo sapiens
tcagtgggagaa

SEQ ID NO: 4221301 - DNA, 14 bp, Homo sapiens
tcagttactcagcc

SEQ ID NO: 4221302 - DNA, 19 bp, Homo sapiens
tcagttactcagccctggg

SEQ ID NO: 4221303 - DNA, 16 bp, Homo sapiens
tcatattttccatctt

SEQ ID NO: 4221304 - DNA, 13 bp, Homo sapiens
tcatattttgcca

SEQ ID NO: 4221305 - DNA, 21 bp, Homo sapiens
tcatattttgccactgccttt

SEQ ID NO: 4221306 - DNA, 14 bp, Homo sapiens
tcatccaggactga

SEQ ID NO: 4221307 - DNA, 16 bp, Homo sapiens
tcatccaggactgaga

SEQ ID NO: 4221308 - DNA, 13 bp, Homo sapiens
ttcatgccccggc

SEQ ID NO: 4221309 - DNA, 21 bp, Homo sapiens
ttccaagaaagatccaccctc

SEQ ID NO: 4221310 - DNA, 18 bp, Homo sapiens
ttccaccacaggaatgta

SEQ ID NO: 4221311 - DNA, 18 bp, Homo sapiens
ttccacccagcttcaaag

SEQ ID NO: 4221312 - DNA, 15 bp, Homo sapiens
ttccacccctctcct

SEQ ID NO: 4221313 - DNA, 21 bp, Homo sapiens
ttccaggtttttctggcattt

SEQ ID NO: 4221314 - DNA, 19 bp, Homo sapiens
ttcccagagacaggaaaat

SEQ ID NO: 4221315 - DNA, 14 bp, Homo sapiens
ttcccagtataaga

SEQ ID NO: 4221316 - DNA, 23 bp, Homo sapiens
ttcccagtataagatttttgaaa

SEQ ID NO: 4221317 - DNA, 21 bp, Homo sapiens
ttccccccaacccggaaacag

SEQ ID NO: 4221318 - DNA, 21 bp, Homo sapiens
ttccccttgcccttgccctga

SEQ ID NO: 4221319 - DNA, 19 bp, Homo sapiens
ttccctgaaaacccagaga

SEQ ID NO: 4221320 - DNA, 14 bp, Homo sapiens
ttcctcgccctggg

SEQ ID NO: 4221321 - DNA, 16 bp, Homo sapiens
ttcctcttccccttgc

SEQ ID NO: 4221322 - DNA, 18 bp, Homo sapiens
ttcctcttccccttgccc

SEQ ID NO: 4221323 - DNA, 16 bp, Homo sapiens
ttccttactgcagaat

SEQ ID NO: 4221324 - DNA, 11 bp, Homo sapiens
ttccttcctaa

SEQ ID NO: 4221325 - DNA, 14 bp, Homo sapiens
ttccttccttccct

SEQ ID NO: 4221326 - DNA, 11 bp, Homo sapiens
ttcctttgcat

SEQ ID NO: 4221327 - DNA, 17 bp, Homo sapiens
ttcggggaactcctgga

SEQ ID NO: 4221328 - DNA, 18 bp, Homo sapiens
ttcgtcatttgcaagctg

SEQ ID NO: 4221329 - DNA, 14 bp, Homo sapiens
ttctaatagagaga

SEQ ID NO: 4221330 - DNA, 16 bp, Homo sapiens
ttctaatagagagatt

SEQ ID NO: 4221331 - DNA, 22 bp, Homo sapiens
ttctacagagaaaatgaatttg

SEQ ID NO: 4221332 - DNA, 19 bp, Homo sapiens
ttctattcattcattttga

SEQ ID NO: 4221333 - DNA, 22 bp, Homo sapiens
ttctattcattcattttgaaat

SEQ ID NO: 4221334 - DNA, 14 bp, Homo sapiens
ttctcactccacca

SEQ ID NO: 4221335 - DNA, 18 bp, Homo sapiens
ttctccatctggcagggt

SEQ ID NO: 4221336 - DNA, 11 bp, Homo sapiens
ttctctttgcc

SEQ ID NO: 4221337 - DNA, 19 bp, Homo sapiens
ttctgaatgtgctgatcat

SEQ ID NO: 4221338 - DNA, 11 bp, Homo sapiens
ttctgctcctc

SEQ ID NO: 4221339 - DNA, 15 bp, Homo sapiens
ttctgctcctctcca

SEQ ID NO: 4221340 - DNA, 12 bp, Homo sapiens
ttctgtccagga

SEQ ID NO: 4221341 - DNA, 22 bp, Homo sapiens
ttctgtggaagtagctttgaac

SEQ ID NO: 4221342 - DNA, 19 bp, Homo sapiens
ttcttcccatcactggagc

SEQ ID NO: 4221343 - DNA, 20 bp, Homo sapiens
ttcttcggggaactcctgga

SEQ ID NO: 4221344 - DNA, 22 bp, Homo sapiens
ttcttgggcaagcagaaaaatt

SEQ ID NO: 4221345 - DNA, 19 bp, Homo sapiens
ttcttggggtcccagggaa

SEQ ID NO: 4221346 - DNA, 13 bp, Homo sapiens
ttgaaaaaacttt

SEQ ID NO: 4221347 - DNA, 12 bp, Homo sapiens
ttgaaaaataaa

SEQ ID NO: 4221348 - DNA, 13 bp, Homo sapiens
ttgaaaaataaaa

SEQ ID NO: 4221349 - DNA, 14 bp, Homo sapiens
ttgaaaaataaaaa

SEQ ID NO: 4221350 - DNA, 17 bp, Homo sapiens
ttgaaaaataaaaacca

SEQ ID NO: 4221351 - DNA, 22 bp, Homo sapiens
ttgaatattggtaattaaaaga

SEQ ID NO: 4221352 - DNA, 23 bp, Homo sapiens
ttgaatgcaaaagaaatttagag

SEQ ID NO: 4221353 - DNA, 14 bp, Homo sapiens
ttgacaacagactg

SEQ ID NO: 4221354 - DNA, 21 bp, Homo sapiens
ttgagatgcccccccaggcca

SEQ ID NO: 4221355 - DNA, 19 bp, Homo sapiens
ttgaggtggaagccctcct

SEQ ID NO: 4221356 - DNA, 23 bp, Homo sapiens
ttgatggtgatgaaatgtaaata

SEQ ID NO: 4221357 - DNA, 14 bp, Homo sapiens
ttgcaaggccgctg

SEQ ID NO: 4221358 - DNA, 18 bp, Homo sapiens
ttgcagaaaagcacctgc

SEQ ID NO: 4221359 - DNA, 20 bp, Homo sapiens
ttgcagaaaagcacctgccg

SEQ ID NO: 4221360 - DNA, 20 bp, Homo sapiens
ttgcatatttttctaaagaa

SEQ ID NO: 4221361 - DNA, 15 bp, Homo sapiens
ttgcatccttcctat

SEQ ID NO: 4221362 - DNA, 21 bp, Homo sapiens
ttgcatccttcctataacttg

SEQ ID NO: 4221363 - DNA, 21 bp, Homo sapiens
ttgcattcatctctcaaactt

SEQ ID NO: 4221364 - DNA, 21 bp, Homo sapiens
ttgccactcccctaaactcca

SEQ ID NO: 4221365 - DNA, 14 bp, Homo sapiens
ttgccatttcttct

SEQ ID NO: 4221366 - DNA, 18 bp, Homo sapiens
ttgcccagagatgcctcc

SEQ ID NO: 4221367 - DNA, 19 bp, Homo sapiens
ttgcccagagatgcctcca

SEQ ID NO: 4221368 - DNA, 16 bp, Homo sapiens
ttgcccttgccctgac

SEQ ID NO: 4221369 - DNA, 23 bp, Homo sapiens
ttggaaaatatttttttcctttg

SEQ ID NO: 4221370 - DNA, 22 bp, Homo sapiens
ttggataatgctgttgcctcat

SEQ ID NO: 4221371 - DNA, 15 bp, Homo sapiens
ttggggtcccaggga

SEQ ID NO: 4221372 - DNA, 17 bp, Homo sapiens
ttgtaaatctgaagaaa

SEQ ID NO: 4221373 - DNA, 16 bp, Homo sapiens
ttgtaaatgtggtaaa

SEQ ID NO: 4221374 - DNA, 18 bp, Homo sapiens
ttgtaagaaaaccaaaat

SEQ ID NO: 4221375 - DNA, 11 bp, Homo sapiens
ttgtgaagaat

SEQ ID NO: 4221376 - DNA, 19 bp, Homo sapiens
ttgtgaagaattattcagt

SEQ ID NO: 4221377 - DNA, 12 bp, Homo sapiens
ttgtttacaaac

SEQ ID NO: 4221378 - DNA, 16 bp, Homo sapiens
tttaaaaaataaatat

SEQ ID NO: 4221379 - DNA, 18 bp, Homo sapiens
tttaaaaacatgagaaat

SEQ ID NO: 4221380 - DNA, 20 bp, Homo sapiens
tttaaaaacatgagaaatgt

SEQ ID NO: 4221381 - DNA, 21 bp, Homo sapiens
tttaaaaacatgagaaatgtg

SEQ ID NO: 4221382 - DNA, 16 bp, Homo sapiens
tttaaactacctcaaa

SEQ ID NO: 4221383 - DNA, 19 bp, Homo sapiens
tttaaactacctcaaaaca

SEQ ID NO: 4221384 - DNA, 12 bp, Homo sapiens
tttaaatatgaa

SEQ ID NO: 4221385 - DNA, 23 bp, Homo sapiens
tttaacaactatgatttggaaaa

SEQ ID NO: 4221386 - DNA, 21 bp, Homo sapiens
tttaaccataaatcaattcat

SEQ ID NO: 4221387 - DNA, 13 bp, Homo sapiens
tttacaaaactgc

SEQ ID NO: 4221388 - DNA, 23 bp, Homo sapiens
tttacaaaactgccaaaaatata

SEQ ID NO: 4221389 - DNA, 21 bp, Homo sapiens
tttacaaacatggaaaacaga

SEQ ID NO: 4221390 - DNA, 14 bp, Homo sapiens
tttagattccagga

SEQ ID NO: 4221391 - DNA, 14 bp, Homo sapiens
tttataaacttaat

SEQ ID NO: 4221392 - DNA, 22 bp, Homo sapiens
tttatggggctgaacggggaga

SEQ ID NO: 4221393 - DNA, 21 bp, Homo sapiens
tttcagtcaattctgatgtta

SEQ ID NO: 4221394 - DNA, 22 bp, Homo sapiens
tttccccccaacccggaaacag

SEQ ID NO: 4221395 - DNA, 23 bp, Homo sapiens
tttccccccaacccggaaacaga

SEQ ID NO: 4221396 - DNA, 22 bp, Homo sapiens
tttcctcttagtcgagccaagt

SEQ ID NO: 4221397 - DNA, 15 bp, Homo sapiens
tttcctttgcattca

SEQ ID NO: 4221398 - DNA, 15 bp, Homo sapiens
tttctaatagagaga

SEQ ID NO: 4221399 - DNA, 18 bp, Homo sapiens
tttctggcagctgtggta

SEQ ID NO: 4221400 - DNA, 14 bp, Homo sapiens
tttcttcccatcac

SEQ ID NO: 4221401 - DNA, 23 bp, Homo sapiens
tttgaaataattatgcagacaca

SEQ ID NO: 4221402 - DNA, 19 bp, Homo sapiens
tttgcaacagtaatcagag

SEQ ID NO: 4221403 - DNA, 19 bp, Homo sapiens
tttgcagaaaagcacctgc

SEQ ID NO: 4221404 - DNA, 20 bp, Homo sapiens
tttgcagaaaagcacctgcc

SEQ ID NO: 4221405 - DNA, 16 bp, Homo sapiens
tttggttcctctctgg

SEQ ID NO: 4221406 - DNA, 12 bp, Homo sapiens
tttgtaagaaaa

SEQ ID NO: 4221407 - DNA, 22 bp, Homo sapiens
tttgtaagaaaaccaaaataaa

SEQ ID NO: 4221408 - DNA, 21 bp, Homo sapiens
tttgtgaatttgcaacagtaa

SEQ ID NO: 4221409 - DNA, 18 bp, Homo sapiens
ttttaaatatgaacaaag

SEQ ID NO: 4221410 - DNA, 23 bp, Homo sapiens
ttttaaatttcagtcaattctga

SEQ ID NO: 4221411 - DNA, 15 bp, Homo sapiens
ttttaattgattatt

SEQ ID NO: 4221412 - DNA, 12 bp, Homo sapiens
ttttacaaaact

SEQ ID NO: 4221413 - DNA, 14 bp, Homo sapiens
ttttcagactcaga

SEQ ID NO: 4221414 - DNA, 13 bp, Homo sapiens
ttttctgttccag

SEQ ID NO: 4221415 - DNA, 16 bp, Homo sapiens
ttttgaaaatcctgaa

SEQ ID NO: 4221416 - DNA, 17 bp, Homo sapiens
tttttcctttgcattca

SEQ ID NO: 4221417 - DNA, 23 bp, Homo sapiens
aagaaggtttcagaaagaagtgg

SEQ ID NO: 4221418 - DNA, 19 bp, Homo sapiens
aagaatcacctcaaattgt

SEQ ID NO: 4221419 - DNA, 21 bp, Homo sapiens
aagaattattcagtgaatttg

SEQ ID NO: 4221420 - DNA, 18 bp, Homo sapiens
aagaattgaacccaggag

SEQ ID NO: 4221421 - DNA, 22 bp, Homo sapiens
aagaatttgagaagaaatactc

SEQ ID NO: 4221422 - DNA, 20 bp, Homo sapiens
aagaattttcagaccccagc

SEQ ID NO: 4221423 - DNA, 15 bp, Homo sapiens
aagacaatactccct

SEQ ID NO: 4221424 - DNA, 12 bp, Homo sapiens
aagacagaatgt

SEQ ID NO: 4221425 - DNA, 18 bp, Homo sapiens
aagacagaatgtcaccag

SEQ ID NO: 4221426 - DNA, 22 bp, Homo sapiens
aagagaaaaaaagtttgccaga

SEQ ID NO: 4221427 - DNA, 14 bp, Homo sapiens
aagagaaaaagaag

SEQ ID NO: 4221428 - DNA, 14 bp, Homo sapiens
aagagagtttgcca

SEQ ID NO: 4221429 - DNA, 16 bp, Homo sapiens
aagagagtttgccact

SEQ ID NO: 4221430 - DNA, 16 bp, Homo sapiens
aagagctagcgctgcc

SEQ ID NO: 4221431 - DNA, 20 bp, Homo sapiens
aagagctagcgctgccgcac

SEQ ID NO: 4221432 - DNA, 19 bp, Homo sapiens
aagagctcaggcttttcca

SEQ ID NO: 4221433 - DNA, 18 bp, Homo sapiens
aagaggaaaaacagggaa

SEQ ID NO: 4221434 - DNA, 20 bp, Homo sapiens
aagaggaaaaacagggaaaa

SEQ ID NO: 4221435 - DNA, 13 bp, Homo sapiens
aagatgtatgctt

SEQ ID NO: 4221436 - DNA, 16 bp, Homo sapiens
aagcaacccaaactga

SEQ ID NO: 4221437 - DNA, 21 bp, Homo sapiens
aagcacaaagcagtttttccc

SEQ ID NO: 4221438 - DNA, 20 bp, Homo sapiens
aagcacctgccgacctcgtc

SEQ ID NO: 4221439 - DNA, 16 bp, Homo sapiens
aagcagaaaaattaaa

SEQ ID NO: 4221440 - DNA, 16 bp, Homo sapiens
aagcagattacctctt

SEQ ID NO: 4221441 - DNA, 22 bp, Homo sapiens
aagcatgtggaaatgacccaaa

SEQ ID NO: 4221442 - DNA, 14 bp, Homo sapiens
aagccctccttcca

SEQ ID NO: 4221443 - DNA, 23 bp, Homo sapiens
aagctgagtgactgtaggcaggg

SEQ ID NO: 4221444 - DNA, 20 bp, Homo sapiens
aagctgtgtccttgcacctg

SEQ ID NO: 4221445 - DNA, 20 bp, Homo sapiens
aaggaaggagactcacctct

SEQ ID NO: 4221446 - DNA, 22 bp, Homo sapiens
aaggaaggagactcacctctgc

SEQ ID NO: 4221447 - DNA, 22 bp, Homo sapiens
aaggagactcacctctgcctca

SEQ ID NO: 4221448 - DNA, 23 bp, Homo sapiens
aaggagactcacctctgcctcaa

SEQ ID NO: 4221449 - DNA, 19 bp, Homo sapiens
aaggatgtaaacagtgcct

SEQ ID NO: 4221450 - DNA, 17 bp, Homo sapiens
aaggcaatgctcaaaca

SEQ ID NO: 4221451 - DNA, 16 bp, Homo sapiens
aaggcaggaatgtgtg

SEQ ID NO: 4221452 - DNA, 22 bp, Homo sapiens
aaggccgctgttcacccacagg

SEQ ID NO: 4221453 - DNA, 13 bp, Homo sapiens
aagggtccagaag

SEQ ID NO: 4221454 - DNA, 23 bp, Homo sapiens
aaggtttcagaaagaagtgggga

SEQ ID NO: 4221455 - DNA, 17 bp, Homo sapiens
aagtactgctgtaaata

SEQ ID NO: 4221456 - DNA, 13 bp, Homo sapiens
aagtagctttgaa

SEQ ID NO: 4221457 - DNA, 21 bp, Homo sapiens
aagtatgcagattatttgccc

SEQ ID NO: 4221458 - DNA, 21 bp, Homo sapiens
aagtcatgcgtttaatcacat

SEQ ID NO: 4221459 - DNA, 22 bp, Homo sapiens
aagtctaggagctgggaggaaa

SEQ ID NO: 4221460 - DNA, 13 bp, Homo sapiens
aagtgcattcaac

SEQ ID NO: 4221461 - DNA, 17 bp, Homo sapiens
aagtgcattcaacctta

SEQ ID NO: 4221462 - DNA, 21 bp, Homo sapiens
aagtgcattcaaccttaccaa

SEQ ID NO: 4221463 - DNA, 16 bp, Homo sapiens
aagtggcccccaccct

SEQ ID NO: 4221464 - DNA, 14 bp, Homo sapiens
aagtggctgctgac

SEQ ID NO: 4221465 - DNA, 15 bp, Homo sapiens
aagtggggacagagc

SEQ ID NO: 4221466 - DNA, 18 bp, Homo sapiens
aagttgatggtgatgaaa

SEQ ID NO: 4221467 - DNA, 17 bp, Homo sapiens
aataaataaataacttt

SEQ ID NO: 4221468 - DNA, 15 bp, Homo sapiens
aataaattgtgaaaa

SEQ ID NO: 4221469 - DNA, 22 bp, Homo sapiens
aataaattgtgaaaaaaatgaa

SEQ ID NO: 4221470 - DNA, 16 bp, Homo sapiens
aataatcggcccacag

SEQ ID NO: 4221471 - DNA, 23 bp, Homo sapiens
aatacaaaggtgctaattaatag

SEQ ID NO: 4221472 - DNA, 20 bp, Homo sapiens
aatacagagtacgttaaaag

SEQ ID NO: 4221473 - DNA, 22 bp, Homo sapiens
aatacagtttcattaactcctt

SEQ ID NO: 4221474 - DNA, 18 bp, Homo sapiens
aatactccctttaaagag

SEQ ID NO: 4221475 - DNA, 19 bp, Homo sapiens
aatagttttaaatatgaac

SEQ ID NO: 4221476 - DNA, 23 bp, Homo sapiens
aatataaactgaaaaatgtcagt

SEQ ID NO: 4221477 - DNA, 15 bp, Homo sapiens
aatataattgggatt

SEQ ID NO: 4221478 - DNA, 22 bp, Homo sapiens
aatatcagttactcagccctgg

SEQ ID NO: 4221479 - DNA, 12 bp, Homo sapiens
aatatgaacaaa

SEQ ID NO: 4221480 - DNA, 12 bp, Homo sapiens
aatatgtgaaga

SEQ ID NO: 4221481 - DNA, 15 bp, Homo sapiens
aatatgtgaagaaaa

SEQ ID NO: 4221482 - DNA, 19 bp, Homo sapiens
aatattggtaattaaaaga

SEQ ID NO: 4221483 - DNA, 19 bp, Homo sapiens
aatatttttttcctttgca

SEQ ID NO: 4221484 - DNA, 23 bp, Homo sapiens
aatcaagttggcttctaatcaaa

SEQ ID NO: 4221485 - DNA, 16 bp, Homo sapiens
aatcattctttcccct

SEQ ID NO: 4221486 - DNA, 23 bp, Homo sapiens
aatccaagcgaggtcaacagaga

SEQ ID NO: 4221487 - DNA, 15 bp, Homo sapiens
aatctaaattaaaaa

SEQ ID NO: 4221488 - DNA, 23 bp, Homo sapiens
aatctatcactaaaaatttttac

SEQ ID NO: 4221489 - DNA, 13 bp, Homo sapiens
aatctgaagaaag

SEQ ID NO: 4221490 - DNA, 18 bp, Homo sapiens
aatctgtctccccagaag

SEQ ID NO: 4221491 - DNA, 19 bp, Homo sapiens
aatctgtctccccagaaga

SEQ ID NO: 4221492 - DNA, 16 bp, Homo sapiens
aatgacccaaacataa

SEQ ID NO: 4221493 - DNA, 19 bp, Homo sapiens
aatgagctgtatctgtaat

SEQ ID NO: 4221494 - DNA, 15 bp, Homo sapiens
aatgcaagcaaagta

SEQ ID NO: 4221495 - DNA, 22 bp, Homo sapiens
aatgcaagcaaagtatcaaaga

SEQ ID NO: 4221496 - DNA, 13 bp, Homo sapiens
aatgcataaaatg

SEQ ID NO: 4221497 - DNA, 16 bp, Homo sapiens
aatgctgttgcctcat

SEQ ID NO: 4221498 - DNA, 21 bp, Homo sapiens
aatggagtctcccactgcaac

SEQ ID NO: 4221499 - DNA, 22 bp, Homo sapiens
aatgtcaacctttgtaagaaaa

SEQ ID NO: 4221500 - DNA, 15 bp, Homo sapiens
aatgtcaccaccttc

SEQ ID NO: 4221501 - DNA, 22 bp, Homo sapiens
aatgtcagagctatgttccctc

SEQ ID NO: 4221502 - DNA, 13 bp, Homo sapiens
aatgtgaactgtg

SEQ ID NO: 4221503 - DNA, 21 bp, Homo sapiens
aatgtgataatatattgctaa

SEQ ID NO: 4221504 - DNA, 14 bp, Homo sapiens
aatgttaaagtcag

SEQ ID NO: 4221505 - DNA, 18 bp, Homo sapiens
aattaaaaaaaagaagag

SEQ ID NO: 4221506 - DNA, 20 bp, Homo sapiens
aattaactgctccaaattta

SEQ ID NO: 4221507 - DNA, 17 bp, Homo sapiens
aattaatttgtgaattt

SEQ ID NO: 4221508 - DNA, 18 bp, Homo sapiens
aattaatttgtgaatttg

SEQ ID NO: 4221509 - DNA, 15 bp, Homo sapiens
aattagattatttct

SEQ ID NO: 4221510 - DNA, 17 bp, Homo sapiens
aattagattatttctgt

SEQ ID NO: 4221511 - DNA, 18 bp, Homo sapiens
aattagattatttctgta

SEQ ID NO: 4221512 - DNA, 12 bp, Homo sapiens
aattatatttct

SEQ ID NO: 4221513 - DNA, 19 bp, Homo sapiens
aattatatttctacagaga

SEQ ID NO: 4221514 - DNA, 17 bp, Homo sapiens
aattattcagtgaattt

SEQ ID NO: 4221515 - DNA, 15 bp, Homo sapiens
aattccacccctcct

SEQ ID NO: 4221516 - DNA, 16 bp, Homo sapiens
aattcctgaagccaga

SEQ ID NO: 4221517 - DNA, 19 bp, Homo sapiens
aattgaaaaataaaaacca

SEQ ID NO: 4221518 - DNA, 22 bp, Homo sapiens
aattgattattctgattccact

SEQ ID NO: 4221519 - DNA, 14 bp, Homo sapiens
aattgcacttttaa

SEQ ID NO: 4221520 - DNA, 23 bp, Homo sapiens
aattgtgggcaaaagagaaaaag

SEQ ID NO: 4221521 - DNA, 19 bp, Homo sapiens
aatttagagtcaatttgct

SEQ ID NO: 4221522 - DNA, 15 bp, Homo sapiens
aatttcagtcaattc

SEQ ID NO: 4221523 - DNA, 17 bp, Homo sapiens
aatttcccttcttgcat

SEQ ID NO: 4221524 - DNA, 12 bp, Homo sapiens
aatttgaaaaaa

SEQ ID NO: 4221525 - DNA, 15 bp, Homo sapiens
aatttgagaagaaat

SEQ ID NO: 4221526 - DNA, 19 bp, Homo sapiens
aatttgtatgctaaatgag

SEQ ID NO: 4221527 - DNA, 12 bp, Homo sapiens
aatttgtgaatt

SEQ ID NO: 4221528 - DNA, 15 bp, Homo sapiens
aatttgtgaatttgc

SEQ ID NO: 4221529 - DNA, 12 bp, Homo sapiens
aattttgtaaaa

SEQ ID NO: 4221530 - DNA, 21 bp, Homo sapiens
acaaaaacagcctcacagaag

SEQ ID NO: 4221531 - DNA, 14 bp, Homo sapiens
acaaacatgaatcc

SEQ ID NO: 4221532 - DNA, 17 bp, Homo sapiens
acaaacatggaaaacag

SEQ ID NO: 4221533 - DNA, 15 bp, Homo sapiens
acaaagcagaaacat

SEQ ID NO: 4221534 - DNA, 19 bp, Homo sapiens
acaaagcagtttttccccc

SEQ ID NO: 4221535 - DNA, 18 bp, Homo sapiens
acaacataaggagaatgt

SEQ ID NO: 4221536 - DNA, 18 bp, Homo sapiens
acaactatgatttggaaa

SEQ ID NO: 4221537 - DNA, 17 bp, Homo sapiens
acaacttcaagtgcatg

SEQ ID NO: 4221538 - DNA, 17 bp, Homo sapiens
acaagagcgaaactccg

SEQ ID NO: 4221539 - DNA, 14 bp, Homo sapiens
acaagattcccaga

SEQ ID NO: 4221540 - DNA, 13 bp, Homo sapiens
aggccactcctcc

SEQ ID NO: 4221541 - DNA, 19 bp, Homo sapiens
aggccagcaaatgttcctt

SEQ ID NO: 4221542 - DNA, 22 bp, Homo sapiens
aggccccgcttgtccagcgcct

SEQ ID NO: 4221543 - DNA, 19 bp, Homo sapiens
aggctctggagccagagag

SEQ ID NO: 4221544 - DNA, 14 bp, Homo sapiens
aggctgaggcagaa

SEQ ID NO: 4221545 - DNA, 14 bp, Homo sapiens
aggctggaggcagg

SEQ ID NO: 4221546 - DNA, 16 bp, Homo sapiens
aggctggaggcagggc

SEQ ID NO: 4221547 - DNA, 14 bp, Homo sapiens
agggaaaaaaagaa

SEQ ID NO: 4221548 - DNA, 14 bp, Homo sapiens
agggaacagacagg

SEQ ID NO: 4221549 - DNA, 20 bp, Homo sapiens
agggaacagacaggagaaat

SEQ ID NO: 4221550 - DNA, 17 bp, Homo sapiens
agggaagtttaaaaccc

SEQ ID NO: 4221551 - DNA, 18 bp, Homo sapiens
agggaagtttaaaaccca

SEQ ID NO: 4221552 - DNA, 14 bp, Homo sapiens
agggcagaggctgg

SEQ ID NO: 4221553 - DNA, 17 bp, Homo sapiens
agggcagaggctggagg

SEQ ID NO: 4221554 - DNA, 18 bp, Homo sapiens
agggccttgcccagagat

SEQ ID NO: 4221555 - DNA, 17 bp, Homo sapiens
agggcgtgactcaccca

SEQ ID NO: 4221556 - DNA, 14 bp, Homo sapiens
agggctaagagcta

SEQ ID NO: 4221557 - DNA, 13 bp, Homo sapiens
agggctaattaga

SEQ ID NO: 4221558 - DNA, 19 bp, Homo sapiens
agggctggggccaagagga

SEQ ID NO: 4221559 - DNA, 16 bp, Homo sapiens
agggtctagggagaga

SEQ ID NO: 4221560 - DNA, 19 bp, Homo sapiens
agggtctagggagagaccc

SEQ ID NO: 4221561 - DNA, 23 bp, Homo sapiens
agggtctagggagagacccttgt

SEQ ID NO: 4221562 - DNA, 19 bp, Homo sapiens
agggtctggagaagcagtg

SEQ ID NO: 4221563 - DNA, 17 bp, Homo sapiens
agggtgggatggaggag

SEQ ID NO: 4221564 - DNA, 21 bp, Homo sapiens
aggtaccactgatttggagat

SEQ ID NO: 4221565 - DNA, 20 bp, Homo sapiens
aggtaggtggatcacctgag

SEQ ID NO: 4221566 - DNA, 20 bp, Homo sapiens
aggtatttttccaatcacag

SEQ ID NO: 4221567 - DNA, 19 bp, Homo sapiens
aggtgcctgtgaggcaggg

SEQ ID NO: 4221568 - DNA, 20 bp, Homo sapiens
aggtgcctgtgaggcagggg

SEQ ID NO: 4221569 - DNA, 13 bp, Homo sapiens
aggtgccttctta

SEQ ID NO: 4221570 - DNA, 23 bp, Homo sapiens
aggtgccttcttattctcactcc

SEQ ID NO: 4221571 - DNA, 11 bp, Homo sapiens
aggtggaagcc

SEQ ID NO: 4221572 - DNA, 14 bp, Homo sapiens
aggtggaagccctc

SEQ ID NO: 4221573 - DNA, 20 bp, Homo sapiens
aggtggaagccctccttcca

SEQ ID NO: 4221574 - DNA, 21 bp, Homo sapiens
aggtggaagccctccttccac

SEQ ID NO: 4221575 - DNA, 20 bp, Homo sapiens
aggtggaggttgcagtgagc

SEQ ID NO: 4221576 - DNA, 17 bp, Homo sapiens
aggtggatcacctgagg

SEQ ID NO: 4221577 - DNA, 19 bp, Homo sapiens
aggtggctgacccagtccc

SEQ ID NO: 4221578 - DNA, 20 bp, Homo sapiens
aggtggctgacccagtccct

SEQ ID NO: 4221579 - DNA, 14 bp, Homo sapiens
aggttggaagagaa

SEQ ID NO: 4221580 - DNA, 15 bp, Homo sapiens
aggttggaagagaat

SEQ ID NO: 4221581 - DNA, 17 bp, Homo sapiens
aggtttgcacccctcct

SEQ ID NO: 4221582 - DNA, 16 bp, Homo sapiens
aggtttttctggcatt

SEQ ID NO: 4221583 - DNA, 14 bp, Homo sapiens
agtacgttaaaagc

SEQ ID NO: 4221584 - DNA, 17 bp, Homo sapiens
agtactttagcctggta

SEQ ID NO: 4221585 - DNA, 15 bp, Homo sapiens
agtagccgagagcct

SEQ ID NO: 4221586 - DNA, 15 bp, Homo sapiens
agtagtatctgctta

SEQ ID NO: 4221587 - DNA, 12 bp, Homo sapiens
agtataagattt

SEQ ID NO: 4221588 - DNA, 18 bp, Homo sapiens
agtataagatttttgaaa

SEQ ID NO: 4221589 - DNA, 17 bp, Homo sapiens
agtatcaaagaaaaaca

SEQ ID NO: 4221590 - DNA, 15 bp, Homo sapiens
agtattctccatcct

SEQ ID NO: 4221591 - DNA, 15 bp, Homo sapiens
agtcaaaaggtgcct

SEQ ID NO: 4221592 - DNA, 16 bp, Homo sapiens
agtcaaaaggtgcctg

SEQ ID NO: 4221593 - DNA, 18 bp, Homo sapiens
agtcaaaaggtgcctgtg

SEQ ID NO: 4221594 - DNA, 15 bp, Homo sapiens
agtcaatttgctgaa

SEQ ID NO: 4221595 - DNA, 20 bp, Homo sapiens
agtcaatttgctgaaaacat

SEQ ID NO: 4221596 - DNA, 22 bp, Homo sapiens
agtcacaccatcttaaatgaca

SEQ ID NO: 4221597 - DNA, 13 bp, Homo sapiens
agtcaccaggaat

SEQ ID NO: 4221598 - DNA, 19 bp, Homo sapiens
agtcaccaggaatgttaaa

SEQ ID NO: 4221599 - DNA, 17 bp, Homo sapiens
agtcagagagagtgttt

SEQ ID NO: 4221600 - DNA, 18 bp, Homo sapiens
agtcatgatctccctgcc

SEQ ID NO: 4221601 - DNA, 19 bp, Homo sapiens
agtcatgatctccctgccg

SEQ ID NO: 4221602 - DNA, 22 bp, Homo sapiens
agtcccggcgtttacctcgtgg

SEQ ID NO: 4221603 - DNA, 13 bp, Homo sapiens
agtcccggcttcc

SEQ ID NO: 4221604 - DNA, 20 bp, Homo sapiens
agtccctgggggaagccctg

SEQ ID NO: 4221605 - DNA, 21 bp, Homo sapiens
agtccctgggggaagccctgg

SEQ ID NO: 4221606 - DNA, 22 bp, Homo sapiens
agtccctgggggaagccctgga

SEQ ID NO: 4221607 - DNA, 23 bp, Homo sapiens
agtctcccactgcaacttgtgaa

SEQ ID NO: 4221608 - DNA, 11 bp, Homo sapiens
agtcttagctg

SEQ ID NO: 4221609 - DNA, 20 bp, Homo sapiens
agtgaatttgtccattgtaa

SEQ ID NO: 4221610 - DNA, 21 bp, Homo sapiens
agtgaatttgtccattgtaaa

SEQ ID NO: 4221611 - DNA, 17 bp, Homo sapiens
agtgagctgtaggtgtg

SEQ ID NO: 4221612 - DNA, 19 bp, Homo sapiens
agtgatttagttgtggaaa

SEQ ID NO: 4221613 - DNA, 20 bp, Homo sapiens
agtgcatgctctctgcagcc

SEQ ID NO: 4221614 - DNA, 15 bp, Homo sapiens
agtgcattcaacctt

SEQ ID NO: 4221615 - DNA, 16 bp, Homo sapiens
agtgcattcaacctta

SEQ ID NO: 4221616 - DNA, 22 bp, Homo sapiens
agtgcattcaaccttaccaaaa

SEQ ID NO: 4221617 - DNA, 16 bp, Homo sapiens
agtgcccaccaacatc

SEQ ID NO: 4221618 - DNA, 19 bp, Homo sapiens
agtgcccaccaacatccca

SEQ ID NO: 4221619 - DNA, 17 bp, Homo sapiens
agtgccttacctcctgc

SEQ ID NO: 4221620 - DNA, 21 bp, Homo sapiens
agtgccttacctcctgcccag

SEQ ID NO: 4221621 - DNA, 19 bp, Homo sapiens
agtgcttgagtttggggaa

SEQ ID NO: 4221622 - DNA, 13 bp, Homo sapiens
agtggaccaggac

SEQ ID NO: 4221623 - DNA, 14 bp, Homo sapiens
agtggaccaggaca

SEQ ID NO: 4221624 - DNA, 16 bp, Homo sapiens
agtggaccaggacagg

SEQ ID NO: 4221625 - DNA, 20 bp, Homo sapiens
agtggaccaggacaggacca

SEQ ID NO: 4221626 - DNA, 12 bp, Homo sapiens
agtggatggaca

SEQ ID NO: 4221627 - DNA, 17 bp, Homo sapiens
agtggatggacagatgg

SEQ ID NO: 4221628 - DNA, 14 bp, Homo sapiens
agtggctgctgact

SEQ ID NO: 4221629 - DNA, 14 bp, Homo sapiens
agtgggagaaaaca

SEQ ID NO: 4221630 - DNA, 16 bp, Homo sapiens
agtgggccaggacagg

SEQ ID NO: 4221631 - DNA, 15 bp, Homo sapiens
agtgtgaaatagaca

SEQ ID NO: 4221632 - DNA, 15 bp, Homo sapiens
agtgtgcagactgat

SEQ ID NO: 4221633 - DNA, 22 bp, Homo sapiens
agttaccattatttaatttgta

SEQ ID NO: 4221634 - DNA, 12 bp, Homo sapiens
agttactcagcc

SEQ ID NO: 4221635 - DNA, 20 bp, Homo sapiens
agttattcttggtactgttg

SEQ ID NO: 4221636 - DNA, 23 bp, Homo sapiens
agttctcaattattggcctgcta

SEQ ID NO: 4221637 - DNA, 14 bp, Homo sapiens
agttgtggaaagat

SEQ ID NO: 4221638 - DNA, 19 bp, Homo sapiens
agttgttttcagactcaga

SEQ ID NO: 4221639 - DNA, 13 bp, Homo sapiens
agtttacttgctc

SEQ ID NO: 4221640 - DNA, 13 bp, Homo sapiens
agtttgcagaaaa

SEQ ID NO: 4221641 - DNA, 22 bp, Homo sapiens
agtttgccactcccctaaactc

SEQ ID NO: 4221642 - DNA, 13 bp, Homo sapiens
agtttgccagaag

SEQ ID NO: 4221643 - DNA, 15 bp, Homo sapiens
agttttaaatatgaa

SEQ ID NO: 4221644 - DNA, 19 bp, Homo sapiens
agttttaaatatgaacaaa

SEQ ID NO: 4221645 - DNA, 17 bp, Homo sapiens
agtttttatggggctga

SEQ ID NO: 4221646 - DNA, 17 bp, Homo sapiens
ataaactgaaaaatgtc

SEQ ID NO: 4221647 - DNA, 23 bp, Homo sapiens
ataaagtactttagcctggtacc

SEQ ID NO: 4221648 - DNA, 16 bp, Homo sapiens
ataaattaatacagag

SEQ ID NO: 4221649 - DNA, 15 bp, Homo sapiens
ataaattgtgaaaaa

SEQ ID NO: 4221650 - DNA, 16 bp, Homo sapiens
ataaattgtgaaaaaa

SEQ ID NO: 4221651 - DNA, 18 bp, Homo sapiens
ataactgaaggagaaggt

SEQ ID NO: 4221652 - DNA, 16 bp, Homo sapiens
ataacttgatgcatgt

SEQ ID NO: 4221653 - DNA, 13 bp, Homo sapiens
ataaggagaatgt

SEQ ID NO: 4221654 - DNA, 15 bp, Homo sapiens
ataaggataataatc

SEQ ID NO: 4221655 - DNA, 16 bp, Homo sapiens
ataagtccattaactg

SEQ ID NO: 4221656 - DNA, 16 bp, Homo sapiens
ataatagacacatcaa

SEQ ID NO: 4221657 - DNA, 13 bp, Homo sapiens
ataatatattgct

SEQ ID NO: 4221658 - DNA, 16 bp, Homo sapiens
ataatatattgctaaa

SEQ ID NO: 4221659 - DNA, 15 bp, Homo sapiens
atacatgctgctaat

SEQ ID NO: 4221660 - DNA, 15 bp, Homo sapiens
atactccctttaaag

SEQ ID NO: 4221661 - DNA, 17 bp, Homo sapiens
atactccctttaaagag

SEQ ID NO: 4221662 - DNA, 22 bp, Homo sapiens
atactccctttaaagagagttt

SEQ ID NO: 4221663 - DNA, 14 bp, Homo sapiens
atagccgggcatgg

SEQ ID NO: 4221664 - DNA, 15 bp, Homo sapiens
cagctgtccctgtca

SEQ ID NO: 4221665 - DNA, 19 bp, Homo sapiens
cagctgtggtacaaatgtg

SEQ ID NO: 4221666 - DNA, 15 bp, Homo sapiens
cagcttgctcttcag

SEQ ID NO: 4221667 - DNA, 23 bp, Homo sapiens
caggaaaactgacagaggagggc

SEQ ID NO: 4221668 - DNA, 22 bp, Homo sapiens
caggaaccgaacatatcatttg

SEQ ID NO: 4221669 - DNA, 19 bp, Homo sapiens
caggaaggctgagaggaga

SEQ ID NO: 4221670 - DNA, 17 bp, Homo sapiens
caggaatgtgtggcaga

SEQ ID NO: 4221671 - DNA, 12 bp, Homo sapiens
caggacaggacc

SEQ ID NO: 4221672 - DNA, 16 bp, Homo sapiens
caggacatgatactga

SEQ ID NO: 4221673 - DNA, 18 bp, Homo sapiens
caggactgaattgtcccc

SEQ ID NO: 4221674 - DNA, 13 bp, Homo sapiens
caggagagccagc

SEQ ID NO: 4221675 - DNA, 17 bp, Homo sapiens
caggagagccagccctc

SEQ ID NO: 4221676 - DNA, 18 bp, Homo sapiens
caggagagccagccctcc

SEQ ID NO: 4221677 - DNA, 19 bp, Homo sapiens
caggagagccagccctccc

SEQ ID NO: 4221678 - DNA, 21 bp, Homo sapiens
caggagcgatcgctcccctgg

SEQ ID NO: 4221679 - DNA, 15 bp, Homo sapiens
caggaggctgaggca

SEQ ID NO: 4221680 - DNA, 21 bp, Homo sapiens
caggaggctgaggcagaagaa

SEQ ID NO: 4221681 - DNA, 18 bp, Homo sapiens
caggagggctaattagaa

SEQ ID NO: 4221682 - DNA, 19 bp, Homo sapiens
caggaggtggaggttgcag

SEQ ID NO: 4221683 - DNA, 20 bp, Homo sapiens
caggaggtggaggttgcagt

SEQ ID NO: 4221684 - DNA, 15 bp, Homo sapiens
caggatttataaagc

SEQ ID NO: 4221685 - DNA, 21 bp, Homo sapiens
caggcacccttctttcctctt

SEQ ID NO: 4221686 - DNA, 23 bp, Homo sapiens
caggcacccttctttcctcttcc

SEQ ID NO: 4221687 - DNA, 20 bp, Homo sapiens
caggcacgaacccacctgct

SEQ ID NO: 4221688 - DNA, 22 bp, Homo sapiens
caggcacgaacccacctgctga

SEQ ID NO: 4221689 - DNA, 20 bp, Homo sapiens
caggcaggaaggctgagagg

SEQ ID NO: 4221690 - DNA, 22 bp, Homo sapiens
caggcatgtcctaggctctggg

SEQ ID NO: 4221691 - DNA, 22 bp, Homo sapiens
caggccccgcttgtccagcgcc

SEQ ID NO: 4221692 - DNA, 18 bp, Homo sapiens
caggcccggcgcggtggc

SEQ ID NO: 4221693 - DNA, 19 bp, Homo sapiens
caggcccggcgcggtggct

SEQ ID NO: 4221694 - DNA, 22 bp, Homo sapiens
caggcctctgctctccgacctc

SEQ ID NO: 4221695 - DNA, 18 bp, Homo sapiens
caggctctggagccagag

SEQ ID NO: 4221696 - DNA, 19 bp, Homo sapiens
caggcttttccaggaagat

SEQ ID NO: 4221697 - DNA, 14 bp, Homo sapiens
cagggacagagaca

SEQ ID NO: 4221698 - DNA, 17 bp, Homo sapiens
cagggacagagacacct

SEQ ID NO: 4221699 - DNA, 19 bp, Homo sapiens
cagggacagagacacctgc

SEQ ID NO: 4221700 - DNA, 23 bp, Homo sapiens
cagggacagagacacctgcacct

SEQ ID NO: 4221701 - DNA, 16 bp, Homo sapiens
cagggccacgtgccag

SEQ ID NO: 4221702 - DNA, 21 bp, Homo sapiens
cagggccacgtgccaggcccg

SEQ ID NO: 4221703 - DNA, 15 bp, Homo sapiens
cagggccttgcccag

SEQ ID NO: 4221704 - DNA, 16 bp, Homo sapiens
cagggccttgcccaga

SEQ ID NO: 4221705 - DNA, 24 bp, Homo sapiens
cagggccttgcccagagatgcctc

SEQ ID NO: 4221706 - DNA, 17 bp, Homo sapiens
cagggctgggagaactt

SEQ ID NO: 4221707 - DNA, 17 bp, Homo sapiens
cagggctggggccaaga

SEQ ID NO: 4221708 - DNA, 21 bp, Homo sapiens
cagggctggggccaagaggaa

SEQ ID NO: 4221709 - DNA, 20 bp, Homo sapiens
caggggagagggtctggaga

SEQ ID NO: 4221710 - DNA, 13 bp, Homo sapiens
cagggtagcaggt

SEQ ID NO: 4221711 - DNA, 20 bp, Homo sapiens
cagggtgggatggaggagaa

SEQ ID NO: 4221712 - DNA, 19 bp, Homo sapiens
caggtggctgacccagtcc

SEQ ID NO: 4221713 - DNA, 22 bp, Homo sapiens
caggtggctgacccagtccctg

SEQ ID NO: 4221714 - DNA, 20 bp, Homo sapiens
caggttggaagagaatcacc

SEQ ID NO: 4221715 - DNA, 21 bp, Homo sapiens
cagtaatcagagttaccatta

SEQ ID NO: 4221716 - DNA, 17 bp, Homo sapiens
cagtcaattctgatgtt

SEQ ID NO: 4221717 - DNA, 12 bp, Homo sapiens
cagtccctgggg

SEQ ID NO: 4221718 - DNA, 22 bp, Homo sapiens
cagtccctgggggaagccctgg

SEQ ID NO: 4221719 - DNA, 17 bp, Homo sapiens
cagtctggtttatataa

SEQ ID NO: 4221720 - DNA, 15 bp, Homo sapiens
cagtgaatttgtcca

SEQ ID NO: 4221721 - DNA, 13 bp, Homo sapiens
cagtgcctgctga

SEQ ID NO: 4221722 - DNA, 18 bp, Homo sapiens
cagtgccttacctcctgc

SEQ ID NO: 4221723 - DNA, 22 bp, Homo sapiens
cagtgccttacctcctgcccag

SEQ ID NO: 4221724 - DNA, 15 bp, Homo sapiens
cagtggagaaatatt

SEQ ID NO: 4221725 - DNA, 20 bp, Homo sapiens
cagtgggaacgtgactgccc

SEQ ID NO: 4221726 - DNA, 11 bp, Homo sapiens
cagtgggaact

SEQ ID NO: 4221727 - DNA, 14 bp, Homo sapiens
cagtgggagaaaac

SEQ ID NO: 4221728 - DNA, 15 bp, Homo sapiens
cagttactcagccct

SEQ ID NO: 4221729 - DNA, 14 bp, Homo sapiens
cagttctgctcctc

SEQ ID NO: 4221730 - DNA, 17 bp, Homo sapiens
cagttctgctcctctcc

SEQ ID NO: 4221731 - DNA, 20 bp, Homo sapiens
cagttctgctcctctccagg

SEQ ID NO: 4221732 - DNA, 14 bp, Homo sapiens
cataaggagaatgt

SEQ ID NO: 4221733 - DNA, 13 bp, Homo sapiens
catagtggatgga

SEQ ID NO: 4221734 - DNA, 17 bp, Homo sapiens
catagtggatggacaga

SEQ ID NO: 4221735 - DNA, 18 bp, Homo sapiens
catatataactagctaga

SEQ ID NO: 4221736 - DNA, 13 bp, Homo sapiens
catatcatttgtg

SEQ ID NO: 4221737 - DNA, 18 bp, Homo sapiens
catatcatttgtgaagaa

SEQ ID NO: 4221738 - DNA, 17 bp, Homo sapiens
catatgtctgcttctgt

SEQ ID NO: 4221739 - DNA, 14 bp, Homo sapiens
catattttgccact

SEQ ID NO: 4221740 - DNA, 17 bp, Homo sapiens
catatttttctaaagaa

SEQ ID NO: 4221741 - DNA, 18 bp, Homo sapiens
catatttttctaaagaaa

SEQ ID NO: 4221742 - DNA, 11 bp, Homo sapiens
catcagaagga

SEQ ID NO: 4221743 - DNA, 13 bp, Homo sapiens
catcatcccagct

SEQ ID NO: 4221744 - DNA, 14 bp, Homo sapiens
catccattcctcag

SEQ ID NO: 4221745 - DNA, 18 bp, Homo sapiens
catccattcctcagggac

SEQ ID NO: 4221746 - DNA, 12 bp, Homo sapiens
catcccattgcc

SEQ ID NO: 4221747 - DNA, 13 bp, Homo sapiens
catcccattgccc

SEQ ID NO: 4221748 - DNA, 15 bp, Homo sapiens
catcccattgccctg

SEQ ID NO: 4221749 - DNA, 16 bp, Homo sapiens
catccttacaatgtaa

SEQ ID NO: 4221750 - DNA, 14 bp, Homo sapiens
catctctcaaactt

SEQ ID NO: 4221751 - DNA, 16 bp, Homo sapiens
catctgaaagccacgt

SEQ ID NO: 4221752 - DNA, 20 bp, Homo sapiens
catcttattcccaattaaaa

SEQ ID NO: 4221753 - DNA, 14 bp, Homo sapiens
catcttctccatct

SEQ ID NO: 4221754 - DNA, 17 bp, Homo sapiens
catcttctccatctggc

SEQ ID NO: 4221755 - DNA, 11 bp, Homo sapiens
catgaccaaaa

SEQ ID NO: 4221756 - DNA, 13 bp, Homo sapiens
catgaccaaaaac

SEQ ID NO: 4221757 - DNA, 17 bp, Homo sapiens
catgaccaaaaaccaaa

SEQ ID NO: 4221758 - DNA, 19 bp, Homo sapiens
catgaccaaaaaccaaaag

SEQ ID NO: 4221759 - DNA, 20 bp, Homo sapiens
catgatctccctgccgcctc

SEQ ID NO: 4221760 - DNA, 14 bp, Homo sapiens
catgcagcatctaa

SEQ ID NO: 4221761 - DNA, 13 bp, Homo sapiens
catgccccggctg

SEQ ID NO: 4221762 - DNA, 20 bp, Homo sapiens
catgctctctgcagccagcc

SEQ ID NO: 4221763 - DNA, 21 bp, Homo sapiens
catggacaatataaactgaaa

SEQ ID NO: 4221764 - DNA, 12 bp, Homo sapiens
catggtggcgca

SEQ ID NO: 4221765 - DNA, 18 bp, Homo sapiens
catggtggcgcaagcctg

SEQ ID NO: 4221766 - DNA, 23 bp, Homo sapiens
catgtggtttggttcctctctgg

SEQ ID NO: 4221767 - DNA, 16 bp, Homo sapiens
catgtttgagctcaga

SEQ ID NO: 4221768 - DNA, 21 bp, Homo sapiens
cattaattattattgctgttg

SEQ ID NO: 4221769 - DNA, 15 bp, Homo sapiens
cattatttaatttgt

SEQ ID NO: 4221770 - DNA, 23 bp, Homo sapiens
cattatttaatttgtatgctaaa

SEQ ID NO: 4221771 - DNA, 20 bp, Homo sapiens
cattcaaccttaccaaaaaa

SEQ ID NO: 4221772 - DNA, 20 bp, Homo sapiens
cattcaggaaaactgacaga

SEQ ID NO: 4221773 - DNA, 19 bp, Homo sapiens
cattcatccaggactgaga

SEQ ID NO: 4221774 - DNA, 15 bp, Homo sapiens
cattcattttgaaat

SEQ ID NO: 4221775 - DNA, 23 bp, Homo sapiens
cattccccaggtggctgacccag

SEQ ID NO: 4221776 - DNA, 20 bp, Homo sapiens
cattccctgagtcaccagga

SEQ ID NO: 4221777 - DNA, 16 bp, Homo sapiens
cattcctcagggacag

SEQ ID NO: 4221778 - DNA, 18 bp, Homo sapiens
cattctctctcctgtcca

SEQ ID NO: 4221779 - DNA, 19 bp, Homo sapiens
cattctttcccctcagagc

SEQ ID NO: 4221780 - DNA, 18 bp, Homo sapiens
cattgtaaatctgaagaa

SEQ ID NO: 4221781 - DNA, 19 bp, Homo sapiens
cattgtaaatctgaagaaa

SEQ ID NO: 4221782 - DNA, 16 bp, Homo sapiens
catttatacctttgaa

SEQ ID NO: 4221783 - DNA, 23 bp, Homo sapiens
catttgacttctagaaaacattt

SEQ ID NO: 4221784 - DNA, 20 bp, Homo sapiens
catttgtcaaagcattgaga

SEQ ID NO: 4221785 - DNA, 22 bp, Homo sapiens
catttttgagcagatcttggaa

SEQ ID NO: 4221786 - DNA, 12 bp, Homo sapiens
ccaaaaaccaaa

SEQ ID NO: 4221787 - DNA, 17 bp, Homo sapiens
cctctccaggcaccctt

SEQ ID NO: 4221788 - DNA, 11 bp, Homo sapiens
cctctcctgcc

SEQ ID NO: 4221789 - DNA, 16 bp, Homo sapiens
cctctctaagccacag

SEQ ID NO: 4221790 - DNA, 22 bp, Homo sapiens
cctctctcccccaccagggggc

SEQ ID NO: 4221791 - DNA, 20 bp, Homo sapiens
cctctgccacctcccctatc

SEQ ID NO: 4221792 - DNA, 11 bp, Homo sapiens
cctctgcctca

SEQ ID NO: 4221793 - DNA, 12 bp, Homo sapiens
cctctgcctcaa

SEQ ID NO: 4221794 - DNA, 12 bp, Homo sapiens
cctcttgccctt

SEQ ID NO: 4221795 - DNA, 13 bp, Homo sapiens
cctgaaaacccag

SEQ ID NO: 4221796 - DNA, 19 bp, Homo sapiens
cctgaaattaatttgtgaa

SEQ ID NO: 4221797 - DNA, 12 bp, Homo sapiens
cctgaagccaga

SEQ ID NO: 4221798 - DNA, 19 bp, Homo sapiens
cctgaccaacatggagaaa

SEQ ID NO: 4221799 - DNA, 12 bp, Homo sapiens
cctgacctccca

SEQ ID NO: 4221800 - DNA, 13 bp, Homo sapiens
cctgagtcaccag

SEQ ID NO: 4221801 - DNA, 18 bp, Homo sapiens
cctgcacctccccccact

SEQ ID NO: 4221802 - DNA, 19 bp, Homo sapiens
cctgcacctccccccactg

SEQ ID NO: 4221803 - DNA, 16 bp, Homo sapiens
cctgccaccctcctgc

SEQ ID NO: 4221804 - DNA, 14 bp, Homo sapiens
cctgccagtgcctt

SEQ ID NO: 4221805 - DNA, 21 bp, Homo sapiens
cctgccagtgccttacctcct

SEQ ID NO: 4221806 - DNA, 22 bp, Homo sapiens
cctgccagtgccttacctcctg

SEQ ID NO: 4221807 - DNA, 12 bp, Homo sapiens
cctgcccaggag

SEQ ID NO: 4221808 - DNA, 18 bp, Homo sapiens
cctgccgacctcgtcctc

SEQ ID NO: 4221809 - DNA, 18 bp, Homo sapiens
cctgccttcttcggggaa

SEQ ID NO: 4221810 - DNA, 19 bp, Homo sapiens
cctgcgtcctctgtccccg

SEQ ID NO: 4221811 - DNA, 17 bp, Homo sapiens
cctgctaatagctgcta

SEQ ID NO: 4221812 - DNA, 21 bp, Homo sapiens
cctgctcccacgcctgcttct

SEQ ID NO: 4221813 - DNA, 12 bp, Homo sapiens
cctgctgggctc

SEQ ID NO: 4221814 - DNA, 21 bp, Homo sapiens
cctgctgggctctccacctca

SEQ ID NO: 4221815 - DNA, 22 bp, Homo sapiens
cctgctgggctctccacctcag

SEQ ID NO: 4221816 - DNA, 18 bp, Homo sapiens
cctggaagctgtgtcctt

SEQ ID NO: 4221817 - DNA, 20 bp, Homo sapiens
cctggaagctgtgtccttgc

SEQ ID NO: 4221818 - DNA, 21 bp, Homo sapiens
cctggaagctgtgtccttgca

SEQ ID NO: 4221819 - DNA, 23 bp, Homo sapiens
cctggaagctgtgtccttgcacc

SEQ ID NO: 4221820 - DNA, 18 bp, Homo sapiens
cctggccccatgtctctc

SEQ ID NO: 4221821 - DNA, 19 bp, Homo sapiens
cctggccggcaaccccagt

SEQ ID NO: 4221822 - DNA, 22 bp, Homo sapiens
cctggccggcaaccccagttct

SEQ ID NO: 4221823 - DNA, 13 bp, Homo sapiens
cctggcctgctgg

SEQ ID NO: 4221824 - DNA, 23 bp, Homo sapiens
cctggctccctcccacccaacca

SEQ ID NO: 4221825 - DNA, 20 bp, Homo sapiens
cctggcttgtaactccacca

SEQ ID NO: 4221826 - DNA, 14 bp, Homo sapiens
cctgggccccacca

SEQ ID NO: 4221827 - DNA, 23 bp, Homo sapiens
cctgggccccaccacctaggcca

SEQ ID NO: 4221828 - DNA, 18 bp, Homo sapiens
cctgggggaagccctgga

SEQ ID NO: 4221829 - DNA, 15 bp, Homo sapiens
cctgggtggggctgc

SEQ ID NO: 4221830 - DNA, 18 bp, Homo sapiens
cctgtcacctggcctgcc

SEQ ID NO: 4221831 - DNA, 12 bp, Homo sapiens
cctgtccaacct

SEQ ID NO: 4221832 - DNA, 19 bp, Homo sapiens
cctgtccaacctaacccct

SEQ ID NO: 4221833 - DNA, 23 bp, Homo sapiens
cctgtccaacctaacccctttcc

SEQ ID NO: 4221834 - DNA, 13 bp, Homo sapiens
cctgtcctcctcg

SEQ ID NO: 4221835 - DNA, 16 bp, Homo sapiens
cctgtggcggtgcctg

SEQ ID NO: 4221836 - DNA, 21 bp, Homo sapiens
ccttaacctctctaagccaca

SEQ ID NO: 4221837 - DNA, 16 bp, Homo sapiens
ccttacctcctgccca

SEQ ID NO: 4221838 - DNA, 18 bp, Homo sapiens
ccttacctcctgcccagg

SEQ ID NO: 4221839 - DNA, 19 bp, Homo sapiens
ccttaggaaaatgcttctg

SEQ ID NO: 4221840 - DNA, 20 bp, Homo sapiens
ccttaggaaaatgcttctgt

SEQ ID NO: 4221841 - DNA, 12 bp, Homo sapiens
ccttcagtgccc

SEQ ID NO: 4221842 - DNA, 14 bp, Homo sapiens
ccttcagtgcccac

SEQ ID NO: 4221843 - DNA, 20 bp, Homo sapiens
ccttcccaaatctgtctccc

SEQ ID NO: 4221844 - DNA, 11 bp, Homo sapiens
ccttcctataa

SEQ ID NO: 4221845 - DNA, 14 bp, Homo sapiens
ccttccttccctgg

SEQ ID NO: 4221846 - DNA, 16 bp, Homo sapiens
ccttccttccctggct

SEQ ID NO: 4221847 - DNA, 17 bp, Homo sapiens
ccttcttattctcactc

SEQ ID NO: 4221848 - DNA, 19 bp, Homo sapiens
ccttcttattctcactcca

SEQ ID NO: 4221849 - DNA, 21 bp, Homo sapiens
ccttcttcggggaactcctgg

SEQ ID NO: 4221850 - DNA, 16 bp, Homo sapiens
ccttgacaacagactg

SEQ ID NO: 4221851 - DNA, 17 bp, Homo sapiens
ccttgagacctcagcca

SEQ ID NO: 4221852 - DNA, 19 bp, Homo sapiens
ccttgagacctcagccatg

SEQ ID NO: 4221853 - DNA, 12 bp, Homo sapiens
ccttgcccagag

SEQ ID NO: 4221854 - DNA, 19 bp, Homo sapiens
ccttgcccagagatgcctc

SEQ ID NO: 4221855 - DNA, 23 bp, Homo sapiens
ccttgcccagagatgcctccacc

SEQ ID NO: 4221856 - DNA, 14 bp, Homo sapiens
ccttgccctgacct

SEQ ID NO: 4221857 - DNA, 19 bp, Homo sapiens
ccttgccctgacctcccag

SEQ ID NO: 4221858 - DNA, 22 bp, Homo sapiens
ccttggataatgctgttgcctc

SEQ ID NO: 4221859 - DNA, 18 bp, Homo sapiens
ccttggtgtccacctggc

SEQ ID NO: 4221860 - DNA, 19 bp, Homo sapiens
ccttggtgtccacctggcc

SEQ ID NO: 4221861 - DNA, 12 bp, Homo sapiens
cctttccttcct

SEQ ID NO: 4221862 - DNA, 16 bp, Homo sapiens
cctttcgaaagcaatg

SEQ ID NO: 4221863 - DNA, 22 bp, Homo sapiens
cctttgaaatattaaaatcact

SEQ ID NO: 4221864 - DNA, 18 bp, Homo sapiens
cgaaaagaaggtattttt

SEQ ID NO: 4221865 - DNA, 14 bp, Homo sapiens
cgaacccacctgct

SEQ ID NO: 4221866 - DNA, 14 bp, Homo sapiens
cgaagtcccggctt

SEQ ID NO: 4221867 - DNA, 16 bp, Homo sapiens
cgacaaagcagaaaca

SEQ ID NO: 4221868 - DNA, 20 bp, Homo sapiens
cgaggtggatcacagaggct

SEQ ID NO: 4221869 - DNA, 16 bp, Homo sapiens
cgagtcaatcccctca

SEQ ID NO: 4221870 - DNA, 13 bp, Homo sapiens
cgatgtggccctg

SEQ ID NO: 4221871 - DNA, 22 bp, Homo sapiens
cgatgtggccctggcctgctgg

SEQ ID NO: 4221872 - DNA, 12 bp, Homo sapiens
cgcattccctga

SEQ ID NO: 4221873 - DNA, 21 bp, Homo sapiens
cgcctagtggggtctccctct

SEQ ID NO: 4221874 - DNA, 16 bp, Homo sapiens
cgcctgtaatcccagc

SEQ ID NO: 4221875 - DNA, 15 bp, Homo sapiens
cgctcccccaaaaat

SEQ ID NO: 4221876 - DNA, 17 bp, Homo sapiens
cgctctgctggcctggc

SEQ ID NO: 4221877 - DNA, 20 bp, Homo sapiens
cgctctgctggcctggccgg

SEQ ID NO: 4221878 - DNA, 21 bp, Homo sapiens
cgctctgctggcctggccggc

SEQ ID NO: 4221879 - DNA, 17 bp, Homo sapiens
cgctgggggctggacct

SEQ ID NO: 4221880 - DNA, 14 bp, Homo sapiens
cgctgttcacccac

SEQ ID NO: 4221881 - DNA, 17 bp, Homo sapiens
cgcttgtccagcgccta

SEQ ID NO: 4221882 - DNA, 20 bp, Homo sapiens
cgcttgtccagcgcctagtg

SEQ ID NO: 4221883 - DNA, 18 bp, Homo sapiens
cggatcaccgagagtagc

SEQ ID NO: 4221884 - DNA, 23 bp, Homo sapiens
cggcaaccccagttctgctcctc

SEQ ID NO: 4221885 - DNA, 16 bp, Homo sapiens
cggccgcattccctga

SEQ ID NO: 4221886 - DNA, 18 bp, Homo sapiens
cggccgcattccctgagt

SEQ ID NO: 4221887 - DNA, 14 bp, Homo sapiens
cggctactcagcag

SEQ ID NO: 4221888 - DNA, 16 bp, Homo sapiens
cggctactcagcagcc

SEQ ID NO: 4221889 - DNA, 18 bp, Homo sapiens
cggctactcagcagccct

SEQ ID NO: 4221890 - DNA, 14 bp, Homo sapiens
cggctccagcccag

SEQ ID NO: 4221891 - DNA, 21 bp, Homo sapiens
cgggcatggtggcgcaagcct

SEQ ID NO: 4221892 - DNA, 14 bp, Homo sapiens
cggggaactcctgg

SEQ ID NO: 4221893 - DNA, 16 bp, Homo sapiens
cggggaactcctggaa

SEQ ID NO: 4221894 - DNA, 19 bp, Homo sapiens
cggtcagatttgctgttca

SEQ ID NO: 4221895 - DNA, 21 bp, Homo sapiens
cggtcccttgagacctcagcc

SEQ ID NO: 4221896 - DNA, 22 bp, Homo sapiens
cggtcccttgagacctcagcca

SEQ ID NO: 4221897 - DNA, 20 bp, Homo sapiens
cggtgcctgggtggggctgc

SEQ ID NO: 4221898 - DNA, 14 bp, Homo sapiens
cgtagttccctgaa

SEQ ID NO: 4221899 - DNA, 18 bp, Homo sapiens
cgtgactcacccaagcat

SEQ ID NO: 4221900 - DNA, 17 bp, Homo sapiens
cgtgactgccccaactc

SEQ ID NO: 4221901 - DNA, 20 bp, Homo sapiens
cgtgactgccccaactcctg

SEQ ID NO: 4221902 - DNA, 21 bp, Homo sapiens
cgtgactgccccaactcctgg

SEQ ID NO: 4221903 - DNA, 19 bp, Homo sapiens
cgtgccgttactctccaac

SEQ ID NO: 4221904 - DNA, 14 bp, Homo sapiens
cgttaccaggcagg

SEQ ID NO: 4221905 - DNA, 18 bp, Homo sapiens
ctaaaaatttttacaaaa

SEQ ID NO: 4221906 - DNA, 19 bp, Homo sapiens
ctaaactccaggatttata

SEQ ID NO: 4221907 - DNA, 14 bp, Homo sapiens
ctaacccctttcct

SEQ ID NO: 4221908 - DNA, 16 bp, Homo sapiens
ctaacccctttcctgc

SEQ ID NO: 4221909 - DNA, 13 bp, Homo sapiens
ctaactggaagca

SEQ ID NO: 4221910 - DNA, 16 bp, Homo sapiens
ctaagagctagcgctg

SEQ ID NO: 4221911 - DNA, 16 bp, Homo sapiens
gatgcccccccaggcc

SEQ ID NO: 4221912 - DNA, 20 bp, Homo sapiens
gatgcctccaccgctgccta

SEQ ID NO: 4221913 - DNA, 13 bp, Homo sapiens
gatggacagatgg

SEQ ID NO: 4221914 - DNA, 15 bp, Homo sapiens
gatggacagatggac

SEQ ID NO: 4221915 - DNA, 22 bp, Homo sapiens
gatggacagatggaccaaaaga

SEQ ID NO: 4221916 - DNA, 14 bp, Homo sapiens
gatggaggagaaga

SEQ ID NO: 4221917 - DNA, 16 bp, Homo sapiens
gatggggtgggcaggg

SEQ ID NO: 4221918 - DNA, 19 bp, Homo sapiens
gatggggtgggcagggctg

SEQ ID NO: 4221919 - DNA, 21 bp, Homo sapiens
gatggggtgggcagggctggg

SEQ ID NO: 4221920 - DNA, 21 bp, Homo sapiens
gatgtaaacagtgcctgctga

SEQ ID NO: 4221921 - DNA, 20 bp, Homo sapiens
gatgtagggtaaggtgcctt

SEQ ID NO: 4221922 - DNA, 21 bp, Homo sapiens
gatgtagggtaaggtgccttc

SEQ ID NO: 4221923 - DNA, 20 bp, Homo sapiens
gatgtcatcagagctcctct

SEQ ID NO: 4221924 - DNA, 12 bp, Homo sapiens
gatgtggccctg

SEQ ID NO: 4221925 - DNA, 14 bp, Homo sapiens
gatgtggccctggc

SEQ ID NO: 4221926 - DNA, 21 bp, Homo sapiens
gatgtggccctggcctgctgg

SEQ ID NO: 4221927 - DNA, 14 bp, Homo sapiens
gatgtttataaact

SEQ ID NO: 4221928 - DNA, 19 bp, Homo sapiens
gattagtaaatatgtgaag

SEQ ID NO: 4221929 - DNA, 12 bp, Homo sapiens
gatttaaaaaat

SEQ ID NO: 4221930 - DNA, 13 bp, Homo sapiens
gatttataaagca

SEQ ID NO: 4221931 - DNA, 23 bp, Homo sapiens
gattttaaaaacatgagaaatgt

SEQ ID NO: 4221932 - DNA, 23 bp, Homo sapiens
gcaaagtatcaaagaaaaacaat

SEQ ID NO: 4221933 - DNA, 16 bp, Homo sapiens
gcaaatgtcacagtaa

SEQ ID NO: 4221934 - DNA, 18 bp, Homo sapiens
gcaaccccagttctgctc

SEQ ID NO: 4221935 - DNA, 22 bp, Homo sapiens
gcaaccccagttctgctcctct

SEQ ID NO: 4221936 - DNA, 14 bp, Homo sapiens
gcaacttgtgaact

SEQ ID NO: 4221937 - DNA, 18 bp, Homo sapiens
gcaagcagaaaaattaaa

SEQ ID NO: 4221938 - DNA, 20 bp, Homo sapiens
gcaagcctgtaatcccagct

SEQ ID NO: 4221939 - DNA, 21 bp, Homo sapiens
gcacaaagcagtttttccccc

SEQ ID NO: 4221940 - DNA, 23 bp, Homo sapiens
gcaccaggcacgaacccacctgc

SEQ ID NO: 4221941 - DNA, 14 bp, Homo sapiens
gcacccagagaaaa

SEQ ID NO: 4221942 - DNA, 21 bp, Homo sapiens
gcacccttctttcctcttccc

SEQ ID NO: 4221943 - DNA, 23 bp, Homo sapiens
gcacctgaaattaatttgtgaat

SEQ ID NO: 4221944 - DNA, 23 bp, Homo sapiens
gcacctgcatccgtagttccctg

SEQ ID NO: 4221945 - DNA, 19 bp, Homo sapiens
gcacctgccgacctcgtcc

SEQ ID NO: 4221946 - DNA, 20 bp, Homo sapiens
gcagactgatgggacatcaa

SEQ ID NO: 4221947 - DNA, 19 bp, Homo sapiens
gcagaggctggaggcaggg

SEQ ID NO: 4221948 - DNA, 16 bp, Homo sapiens
gcagagggcagaggct

SEQ ID NO: 4221949 - DNA, 18 bp, Homo sapiens
gcagagggcagaggctgg

SEQ ID NO: 4221950 - DNA, 13 bp, Homo sapiens
gcagccagcccag

SEQ ID NO: 4221951 - DNA, 21 bp, Homo sapiens
gcagccagcccagcccagctg

SEQ ID NO: 4221952 - DNA, 20 bp, Homo sapiens
gcaggaaggctgagaggaga

SEQ ID NO: 4221953 - DNA, 20 bp, Homo sapiens
gcaggacctagctgttgtaa

SEQ ID NO: 4221954 - DNA, 21 bp, Homo sapiens
gcaggacctagctgttgtaaa

SEQ ID NO: 4221955 - DNA, 23 bp, Homo sapiens
gcaggactcacaggttggaagag

SEQ ID NO: 4221956 - DNA, 21 bp, Homo sapiens
gcagggccttgcccagagatg

SEQ ID NO: 4221957 - DNA, 12 bp, Homo sapiens
gcagggctggga

SEQ ID NO: 4221958 - DNA, 14 bp, Homo sapiens
gcaggtaccactga

SEQ ID NO: 4221959 - DNA, 21 bp, Homo sapiens
gcagtgagccgcatcttctcc

SEQ ID NO: 4221960 - DNA, 14 bp, Homo sapiens
gcagtgagctgaga

SEQ ID NO: 4221961 - DNA, 14 bp, Homo sapiens
gcagtttgggaggt

SEQ ID NO: 4221962 - DNA, 18 bp, Homo sapiens
gcataaaccaatgagctg

SEQ ID NO: 4221963 - DNA, 21 bp, Homo sapiens
gcatccattcctcagggacag

SEQ ID NO: 4221964 - DNA, 14 bp, Homo sapiens
gcatccttcctata

SEQ ID NO: 4221965 - DNA, 15 bp, Homo sapiens
gcatccttcctataa

SEQ ID NO: 4221966 - DNA, 23 bp, Homo sapiens
gcatccttcctataacttgatgc

SEQ ID NO: 4221967 - DNA, 14 bp, Homo sapiens
gcatcttctccatc

SEQ ID NO: 4221968 - DNA, 14 bp, Homo sapiens
gcatgctctctgca

SEQ ID NO: 4221969 - DNA, 13 bp, Homo sapiens
gcattcaacctta

SEQ ID NO: 4221970 - DNA, 18 bp, Homo sapiens
gcattcaaccttaccaaa

SEQ ID NO: 4221971 - DNA, 19 bp, Homo sapiens
gcattcaaccttaccaaaa

SEQ ID NO: 4221972 - DNA, 15 bp, Homo sapiens
gcattcaataaatat

SEQ ID NO: 4221973 - DNA, 22 bp, Homo sapiens
gcattccctgagtcaccaggaa

SEQ ID NO: 4221974 - DNA, 16 bp, Homo sapiens
gcatttaaagtattct

SEQ ID NO: 4221975 - DNA, 17 bp, Homo sapiens
gcatttgttctttgcca

SEQ ID NO: 4221976 - DNA, 22 bp, Homo sapiens
gccacagcttcttcatctttaa

SEQ ID NO: 4221977 - DNA, 13 bp, Homo sapiens
gccaccctcctgc

SEQ ID NO: 4221978 - DNA, 15 bp, Homo sapiens
gccacctcccctatc

SEQ ID NO: 4221979 - DNA, 17 bp, Homo sapiens
gccacctcccctatcca

SEQ ID NO: 4221980 - DNA, 21 bp, Homo sapiens
gccacctcccctatccaccca

SEQ ID NO: 4221981 - DNA, 13 bp, Homo sapiens
gccacgtgccagg

SEQ ID NO: 4221982 - DNA, 14 bp, Homo sapiens
gccacgtgccaggc

SEQ ID NO: 4221983 - DNA, 17 bp, Homo sapiens
gccacgtgccaggcccg

SEQ ID NO: 4221984 - DNA, 15 bp, Homo sapiens
gccagatccacccta

SEQ ID NO: 4221985 - DNA, 14 bp, Homo sapiens
gccagcccagccca

SEQ ID NO: 4221986 - DNA, 14 bp, Homo sapiens
gccagccctccctg

SEQ ID NO: 4221987 - DNA, 15 bp, Homo sapiens
gccagccctccctgt

SEQ ID NO: 4221988 - DNA, 23 bp, Homo sapiens
gccagccctccctgtcctcctcg

SEQ ID NO: 4221989 - DNA, 14 bp, Homo sapiens
gccaggacaggccc

SEQ ID NO: 4221990 - DNA, 11 bp, Homo sapiens
gccagtgcctt

SEQ ID NO: 4221991 - DNA, 22 bp, Homo sapiens
gccagtgccttacctcctgccc

SEQ ID NO: 4221992 - DNA, 20 bp, Homo sapiens
gccatgtttagattccagga

SEQ ID NO: 4221993 - DNA, 20 bp, Homo sapiens
gccatttcttcttcttcttt

SEQ ID NO: 4221994 - DNA, 19 bp, Homo sapiens
gcccacagctcccacccca

SEQ ID NO: 4221995 - DNA, 17 bp, Homo sapiens
gcccaccaacatcccat

SEQ ID NO: 4221996 - DNA, 16 bp, Homo sapiens
gcccagagatgcctcc

SEQ ID NO: 4221997 - DNA, 17 bp, Homo sapiens
gcccagagatgcctcca

SEQ ID NO: 4221998 - DNA, 22 bp, Homo sapiens
gcccagagatgcctccaccgct

SEQ ID NO: 4221999 - DNA, 14 bp, Homo sapiens
gcccagcccagctg

SEQ ID NO: 4222000 - DNA, 15 bp, Homo sapiens
gcccagcccagctgg

SEQ ID NO: 4222001 - DNA, 21 bp, Homo sapiens
gcccaggagagccagccctcc

SEQ ID NO: 4222002 - DNA, 19 bp, Homo sapiens
gcccattctctctcctgtc

SEQ ID NO: 4222003 - DNA, 21 bp, Homo sapiens
gcccattctctctcctgtcca

SEQ ID NO: 4222004 - DNA, 15 bp, Homo sapiens
gccccaccacctagg

SEQ ID NO: 4222005 - DNA, 20 bp, Homo sapiens
gccccaccacctaggccact

SEQ ID NO: 4222006 - DNA, 19 bp, Homo sapiens
gccccgcttgtccagcgcc

SEQ ID NO: 4222007 - DNA, 12 bp, Homo sapiens
gcccctcctctg

SEQ ID NO: 4222008 - DNA, 14 bp, Homo sapiens
gcccctcctctgcc

SEQ ID NO: 4222009 - DNA, 17 bp, Homo sapiens
gcccctcctctgccacc

SEQ ID NO: 4222010 - DNA, 14 bp, Homo sapiens
gccctatggatgtg

SEQ ID NO: 4222011 - DNA, 14 bp, Homo sapiens
gccctgaagggggc

SEQ ID NO: 4222012 - DNA, 15 bp, Homo sapiens
gccctgacctcccag

SEQ ID NO: 4222013 - DNA, 12 bp, Homo sapiens
gccctggcctgc

SEQ ID NO: 4222014 - DNA, 14 bp, Homo sapiens
gccctggcctgctg

SEQ ID NO: 4222015 - DNA, 20 bp, Homo sapiens
gccctgggccccaccaccta

SEQ ID NO: 4222016 - DNA, 22 bp, Homo sapiens
gccctgggccccaccacctagg

SEQ ID NO: 4222017 - DNA, 13 bp, Homo sapiens
gccgacctcgtcc

SEQ ID NO: 4222018 - DNA, 21 bp, Homo sapiens
gccgacctcgtcctccccctg

SEQ ID NO: 4222019 - DNA, 15 bp, Homo sapiens
gccgagagcctgctc

SEQ ID NO: 4222020 - DNA, 15 bp, Homo sapiens
gccgcaccccagagt

SEQ ID NO: 4222021 - DNA, 16 bp, Homo sapiens
gccgcaccccagagtg

SEQ ID NO: 4222022 - DNA, 18 bp, Homo sapiens
gccgcattccctgagtca

SEQ ID NO: 4222023 - DNA, 13 bp, Homo sapiens
gccgcctcaatgt

SEQ ID NO: 4222024 - DNA, 19 bp, Homo sapiens
gccggcaaccccagttctg

SEQ ID NO: 4222025 - DNA, 20 bp, Homo sapiens
gccggcaaccccagttctgc

SEQ ID NO: 4222026 - DNA, 23 bp, Homo sapiens
gccgggcatggtggcgcaagcct

SEQ ID NO: 4222027 - DNA, 12 bp, Homo sapiens
gcctactcacga

SEQ ID NO: 4222028 - DNA, 22 bp, Homo sapiens
gcctagtggggtctccctctcc

SEQ ID NO: 4222029 - DNA, 22 bp, Homo sapiens
gcctcaatgtgaatcagaccct

SEQ ID NO: 4222030 - DNA, 21 bp, Homo sapiens
gcctcaatgtggttgcaaggc

SEQ ID NO: 4222031 - DNA, 18 bp, Homo sapiens
gcctgccaccctcctgcg

SEQ ID NO: 4222032 - DNA, 23 bp, Homo sapiens
gcctgctgggctctccacctcag

SEQ ID NO: 4222033 - DNA, 24 bp, Homo sapiens
gcctgctgggctctccacctcagc

SEQ ID NO: 4222034 - DNA, 22 bp, Homo sapiens
ggtctggagaagcagtgagccg

SEQ ID NO: 4222035 - DNA, 18 bp, Homo sapiens
ggtgcctgggtggggctg

SEQ ID NO: 4222036 - DNA, 22 bp, Homo sapiens
ggtgcctgggtggggctgctcc

SEQ ID NO: 4222037 - DNA, 21 bp, Homo sapiens
ggtgcctgtgaggcaggggcg

SEQ ID NO: 4222038 - DNA, 15 bp, Homo sapiens
ggtggatcacagagg

SEQ ID NO: 4222039 - DNA, 17 bp, Homo sapiens
ggtggctagtcagagag

SEQ ID NO: 4222040 - DNA, 15 bp, Homo sapiens
ggtggctgacccagt

SEQ ID NO: 4222041 - DNA, 19 bp, Homo sapiens
ggtggctgacccagtccct

SEQ ID NO: 4222042 - DNA, 16 bp, Homo sapiens
ggtgggatggaggaga

SEQ ID NO: 4222043 - DNA, 14 bp, Homo sapiens
ggtgggcagggctg

SEQ ID NO: 4222044 - DNA, 15 bp, Homo sapiens
ggtgggcagggctgg

SEQ ID NO: 4222045 - DNA, 18 bp, Homo sapiens
ggtggggctgctcctcca

SEQ ID NO: 4222046 - DNA, 16 bp, Homo sapiens
ggtgggttttcttccc

SEQ ID NO: 4222047 - DNA, 14 bp, Homo sapiens
ggttcagcccctcc

SEQ ID NO: 4222048 - DNA, 17 bp, Homo sapiens
ggttcagcccctcctct

SEQ ID NO: 4222049 - DNA, 11 bp, Homo sapiens
ggttcctctct

SEQ ID NO: 4222050 - DNA, 16 bp, Homo sapiens
ggttgcaaggccgctg

SEQ ID NO: 4222051 - DNA, 22 bp, Homo sapiens
gtaaaagataaatttgttgaat

SEQ ID NO: 4222052 - DNA, 17 bp, Homo sapiens
gtaaacagtgcctgctg

SEQ ID NO: 4222053 - DNA, 20 bp, Homo sapiens
gtaaacagtgcctgctgaat

SEQ ID NO: 4222054 - DNA, 20 bp, Homo sapiens
gtaaatagttttaaatatga

SEQ ID NO: 4222055 - DNA, 21 bp, Homo sapiens
gtaaatagttttaaatatgaa

SEQ ID NO: 4222056 - DNA, 15 bp, Homo sapiens
gtaaatctgaagaaa

SEQ ID NO: 4222057 - DNA, 23 bp, Homo sapiens
gtaagggggggatcgaaaagaag

SEQ ID NO: 4222058 - DNA, 12 bp, Homo sapiens
gtaaggtgcctt

SEQ ID NO: 4222059 - DNA, 17 bp, Homo sapiens
gtaatcccagctactca

SEQ ID NO: 4222060 - DNA, 18 bp, Homo sapiens
gtaatcccagctactcag

SEQ ID NO: 4222061 - DNA, 17 bp, Homo sapiens
gtagcaggtaccactga

SEQ ID NO: 4222062 - DNA, 17 bp, Homo sapiens
gtataagatttttgaaa

SEQ ID NO: 4222063 - DNA, 16 bp, Homo sapiens
gtattttttaaaaaat

SEQ ID NO: 4222064 - DNA, 17 bp, Homo sapiens
gtcaaacgtgaaaatgc

SEQ ID NO: 4222065 - DNA, 13 bp, Homo sapiens
gtcaagtcaacca

SEQ ID NO: 4222066 - DNA, 22 bp, Homo sapiens
gtcaatcccctcattcaggaaa

SEQ ID NO: 4222067 - DNA, 23 bp, Homo sapiens
gtcaattctgatgttactgagat

SEQ ID NO: 4222068 - DNA, 15 bp, Homo sapiens
gtcacaccatcttaa

SEQ ID NO: 4222069 - DNA, 11 bp, Homo sapiens
gtcaccacctt

SEQ ID NO: 4222070 - DNA, 22 bp, Homo sapiens
gtcaccaccttcccagctctcc

SEQ ID NO: 4222071 - DNA, 23 bp, Homo sapiens
gtcacccaggctctggagccaga

SEQ ID NO: 4222072 - DNA, 10 bp, Homo sapiens
gtcagagcta

SEQ ID NO: 4222073 - DNA, 21 bp, Homo sapiens
gtcatattttgccactgcctt

SEQ ID NO: 4222074 - DNA, 16 bp, Homo sapiens
gtcatctcagctggat

SEQ ID NO: 4222075 - DNA, 15 bp, Homo sapiens
gtcatgatctccctg

SEQ ID NO: 4222076 - DNA, 20 bp, Homo sapiens
gtcatgatctccctgccgcc

SEQ ID NO: 4222077 - DNA, 22 bp, Homo sapiens
gtcatgatctccctgccgcctc

SEQ ID NO: 4222078 - DNA, 14 bp, Homo sapiens
gtccaacctaaccc

SEQ ID NO: 4222079 - DNA, 21 bp, Homo sapiens
gtccaacctaacccctttcct

SEQ ID NO: 4222080 - DNA, 21 bp, Homo sapiens
gtccacctggccccatgtctc

SEQ ID NO: 4222081 - DNA, 14 bp, Homo sapiens
gtccagcttgctct

SEQ ID NO: 4222082 - DNA, 16 bp, Homo sapiens
gtccagcttgctcttc

SEQ ID NO: 4222083 - DNA, 12 bp, Homo sapiens
gtccattgtaaa

SEQ ID NO: 4222084 - DNA, 21 bp, Homo sapiens
gtccattgtaaatctgaagaa

SEQ ID NO: 4222085 - DNA, 18 bp, Homo sapiens
gtccccagtttgcagaaa

SEQ ID NO: 4222086 - DNA, 15 bp, Homo sapiens
gtccccatcatccca

SEQ ID NO: 4222087 - DNA, 15 bp, Homo sapiens
gtccctgctcggccg

SEQ ID NO: 4222088 - DNA, 19 bp, Homo sapiens
gtccctgggggaagccctg

SEQ ID NO: 4222089 - DNA, 20 bp, Homo sapiens
gtccctgggggaagccctgg

SEQ ID NO: 4222090 - DNA, 21 bp, Homo sapiens
gtccctgggggaagccctgga

SEQ ID NO: 4222091 - DNA, 17 bp, Homo sapiens
gtcctccccctgccagt

SEQ ID NO: 4222092 - DNA, 22 bp, Homo sapiens
gtcctccccctgccagtgcctt

SEQ ID NO: 4222093 - DNA, 21 bp, Homo sapiens
gtcctcctcggatcaccgaga

SEQ ID NO: 4222094 - DNA, 16 bp, Homo sapiens
gtcctgcccaatgcct

SEQ ID NO: 4222095 - DNA, 15 bp, Homo sapiens
gtccttgcacctgca

SEQ ID NO: 4222096 - DNA, 16 bp, Homo sapiens
gtccttgcacctgcat

SEQ ID NO: 4222097 - DNA, 17 bp, Homo sapiens
gtccttgcacctgcatc

SEQ ID NO: 4222098 - DNA, 15 bp, Homo sapiens
gtccttttcactaca

SEQ ID NO: 4222099 - DNA, 18 bp, Homo sapiens
gtccttttcactacacca

SEQ ID NO: 4222100 - DNA, 20 bp, Homo sapiens
gtcgctctgctggcctggcc

SEQ ID NO: 4222101 - DNA, 18 bp, Homo sapiens
gtcgggagttcgagacca

SEQ ID NO: 4222102 - DNA, 12 bp, Homo sapiens
gtctagggagag

SEQ ID NO: 4222103 - DNA, 15 bp, Homo sapiens
gtctccctctcctgc

SEQ ID NO: 4222104 - DNA, 16 bp, Homo sapiens
gtctccctctcctgcc

SEQ ID NO: 4222105 - DNA, 21 bp, Homo sapiens
gtctccctctcctgcctactc

SEQ ID NO: 4222106 - DNA, 14 bp, Homo sapiens
gtctcttcctctgt

SEQ ID NO: 4222107 - DNA, 17 bp, Homo sapiens
gtctcttcctctgttct

SEQ ID NO: 4222108 - DNA, 23 bp, Homo sapiens
gtctcttcctctgttctatccca

SEQ ID NO: 4222109 - DNA, 15 bp, Homo sapiens
gtctgaaagacagaa

SEQ ID NO: 4222110 - DNA, 12 bp, Homo sapiens
gtctgcttctgt

SEQ ID NO: 4222111 - DNA, 19 bp, Homo sapiens
gtctgcttctgtccaggac

SEQ ID NO: 4222112 - DNA, 23 bp, Homo sapiens
gtctgcttctgtccaggacatga

SEQ ID NO: 4222113 - DNA, 18 bp, Homo sapiens
gtctggggttcagcccct

SEQ ID NO: 4222114 - DNA, 10 bp, Homo sapiens
gtgaaaaaaa

SEQ ID NO: 4222115 - DNA, 14 bp, Homo sapiens
gtgaactccatcat

SEQ ID NO: 4222116 - DNA, 18 bp, Homo sapiens
gtgaagcaaacacagcat

SEQ ID NO: 4222117 - DNA, 21 bp, Homo sapiens
gtgactgccccaactcctgga

SEQ ID NO: 4222118 - DNA, 18 bp, Homo sapiens
gtgagccgcatcttctcc

SEQ ID NO: 4222119 - DNA, 17 bp, Homo sapiens
gtgaggcaggggcggag

SEQ ID NO: 4222120 - DNA, 20 bp, Homo sapiens
gtgatacaacttcaagtgca

SEQ ID NO: 4222121 - DNA, 15 bp, Homo sapiens
gtgatcactgagcca

SEQ ID NO: 4222122 - DNA, 14 bp, Homo sapiens
gtgatggggtgggc

SEQ ID NO: 4222123 - DNA, 16 bp, Homo sapiens
gtgatggggtgggcag

SEQ ID NO: 4222124 - DNA, 18 bp, Homo sapiens
gtgatggggtgggcaggg

SEQ ID NO: 4222125 - DNA, 22 bp, Homo sapiens
gtgatggggtgggcagggctgg

SEQ ID NO: 4222126 - DNA, 20 bp, Homo sapiens
gtgattcacagtgtgaatct

SEQ ID NO: 4222127 - DNA, 18 bp, Homo sapiens
gtgcatgcagcatctaag

SEQ ID NO: 4222128 - DNA, 15 bp, Homo sapiens
gtgcatgctctctgc

SEQ ID NO: 4222129 - DNA, 16 bp, Homo sapiens
gtgcatgctctctgca

SEQ ID NO: 4222130 - DNA, 18 bp, Homo sapiens
gtgcatgctctctgcagc

SEQ ID NO: 4222131 - DNA, 17 bp, Homo sapiens
gtgccaggcccggggct

SEQ ID NO: 4222132 - DNA, 19 bp, Homo sapiens
gtgccaggcccggggctgg

SEQ ID NO: 4222133 - DNA, 15 bp, Homo sapiens
gtgccgttactctcc

SEQ ID NO: 4222134 - DNA, 21 bp, Homo sapiens
gtgccgttactctccaacctg

SEQ ID NO: 4222135 - DNA, 22 bp, Homo sapiens
gtgccgttactctccaacctgg

SEQ ID NO: 4222136 - DNA, 15 bp, Homo sapiens
gtgcctgtgaggcag

SEQ ID NO: 4222137 - DNA, 16 bp, Homo sapiens
gtgcctgtgaggcagg

SEQ ID NO: 4222138 - DNA, 17 bp, Homo sapiens
gtgccttacctcctgcc

SEQ ID NO: 4222139 - DNA, 18 bp, Homo sapiens
gtgccttacctcctgccc

SEQ ID NO: 4222140 - DNA, 19 bp, Homo sapiens
gtgccttacctcctgccca

SEQ ID NO: 4222141 - DNA, 20 bp, Homo sapiens
gtggaagacaatactccctt

SEQ ID NO: 4222142 - DNA, 18 bp, Homo sapiens
gtggaagccctccttcca

SEQ ID NO: 4222143 - DNA, 19 bp, Homo sapiens
gtggaggttgcagtgagct

SEQ ID NO: 4222144 - DNA, 14 bp, Homo sapiens
gtggatcacagagg

SEQ ID NO: 4222145 - DNA, 15 bp, Homo sapiens
gtggatcacagaggc

SEQ ID NO: 4222146 - DNA, 16 bp, Homo sapiens
gtggatcacagaggct

SEQ ID NO: 4222147 - DNA, 15 bp, Homo sapiens
gtggatggacagatg

SEQ ID NO: 4222148 - DNA, 17 bp, Homo sapiens
gtggcggtgcctgggtg

SEQ ID NO: 4222149 - DNA, 17 bp, Homo sapiens
gtggctagtcagagaga

SEQ ID NO: 4222150 - DNA, 15 bp, Homo sapiens
gtggctgacccagtc

SEQ ID NO: 4222151 - DNA, 17 bp, Homo sapiens
gtggctgacccagtccc

SEQ ID NO: 4222152 - DNA, 21 bp, Homo sapiens
gtggctttccttgtggcagag

SEQ ID NO: 4222153 - DNA, 23 bp, Homo sapiens
gtggctttccttgtggcagagga

SEQ ID NO: 4222154 - DNA, 17 bp, Homo sapiens
gtgggaacgtgactgcc

SEQ ID NO: 4222155 - DNA, 12 bp, Homo sapiens
gtggggctgctc

SEQ ID NO: 4222156 - DNA, 14 bp, Homo sapiens
gtggggctgctcct

SEQ ID NO: 4222157 - DNA, 17 bp, Homo sapiens
gtggggctgctcctcca

SEQ ID NO: 4222158 - DNA, 15 bp, Homo sapiens
tcatctctcaaactt

SEQ ID NO: 4222159 - DNA, 14 bp, Homo sapiens
tcatgccccggctg

SEQ ID NO: 4222160 - DNA, 20 bp, Homo sapiens
tcatgtttaacgtttctcat

SEQ ID NO: 4222161 - DNA, 22 bp, Homo sapiens
tcatgtttaacgtttctcatta

SEQ ID NO: 4222162 - DNA, 12 bp, Homo sapiens
tcattcaggaaa

SEQ ID NO: 4222163 - DNA, 14 bp, Homo sapiens
tcattccccaggtg

SEQ ID NO: 4222164 - DNA, 23 bp, Homo sapiens
tcattccccaggtggctgaccca

SEQ ID NO: 4222165 - DNA, 18 bp, Homo sapiens
tcattctatgaacagtga

SEQ ID NO: 4222166 - DNA, 18 bp, Homo sapiens
tcatttcctgggagaaag

SEQ ID NO: 4222167 - DNA, 14 bp, Homo sapiens
tcatttttgaatac

SEQ ID NO: 4222168 - DNA, 18 bp, Homo sapiens
tccaacctaacccctttc

SEQ ID NO: 4222169 - DNA, 19 bp, Homo sapiens
tccaaggtttataaagcag

SEQ ID NO: 4222170 - DNA, 21 bp, Homo sapiens
tccaaggtttataaagcagat

SEQ ID NO: 4222171 - DNA, 21 bp, Homo sapiens
tccacaagattcccagagaca

SEQ ID NO: 4222172 - DNA, 18 bp, Homo sapiens
tccaccaacccatcagaa

SEQ ID NO: 4222173 - DNA, 13 bp, Homo sapiens
tccacccacgagc

SEQ ID NO: 4222174 - DNA, 15 bp, Homo sapiens
tccacccagcccatt

SEQ ID NO: 4222175 - DNA, 14 bp, Homo sapiens
tccacccctcctcg

SEQ ID NO: 4222176 - DNA, 13 bp, Homo sapiens
tccacctcagcct

SEQ ID NO: 4222177 - DNA, 20 bp, Homo sapiens
tccacttgcttgaagaccca

SEQ ID NO: 4222178 - DNA, 19 bp, Homo sapiens
tccagctgggttggaaaac

SEQ ID NO: 4222179 - DNA, 17 bp, Homo sapiens
tccagcttgctcttcag

SEQ ID NO: 4222180 - DNA, 15 bp, Homo sapiens
tccaggacatgatac

SEQ ID NO: 4222181 - DNA, 15 bp, Homo sapiens
tccaggatttataaa

SEQ ID NO: 4222182 - DNA, 16 bp, Homo sapiens
tccaggcacccttctt

SEQ ID NO: 4222183 - DNA, 22 bp, Homo sapiens
tccagggccacgtgccaggccc

SEQ ID NO: 4222184 - DNA, 13 bp, Homo sapiens
tccatcattcatc

SEQ ID NO: 4222185 - DNA, 15 bp, Homo sapiens
tccatctggcagggt

SEQ ID NO: 4222186 - DNA, 22 bp, Homo sapiens
tccatcttattcccaattaaaa

SEQ ID NO: 4222187 - DNA, 23 bp, Homo sapiens
tccatcttattcccaattaaaag

SEQ ID NO: 4222188 - DNA, 19 bp, Homo sapiens
tccattaactgctttccac

SEQ ID NO: 4222189 - DNA, 13 bp, Homo sapiens
tccattcctcagg

SEQ ID NO: 4222190 - DNA, 19 bp, Homo sapiens
tcccacccaacagctcaga

SEQ ID NO: 4222191 - DNA, 16 bp, Homo sapiens
tcccaccccaccccct

SEQ ID NO: 4222192 - DNA, 18 bp, Homo sapiens
tcccaccccacccccttc

SEQ ID NO: 4222193 - DNA, 14 bp, Homo sapiens
tcccacgcctgctt

SEQ ID NO: 4222194 - DNA, 16 bp, Homo sapiens
tcccacgcctgcttct

SEQ ID NO: 4222195 - DNA, 15 bp, Homo sapiens
tcccagccctatgga

SEQ ID NO: 4222196 - DNA, 16 bp, Homo sapiens
tcccagccctatggat

SEQ ID NO: 4222197 - DNA, 15 bp, Homo sapiens
tcccagctactcagg

SEQ ID NO: 4222198 - DNA, 17 bp, Homo sapiens
tcccagctactcaggag

SEQ ID NO: 4222199 - DNA, 21 bp, Homo sapiens
tcccagctctccctctggccc

SEQ ID NO: 4222200 - DNA, 23 bp, Homo sapiens
tcccagctctccctctggccctg

SEQ ID NO: 4222201 - DNA, 23 bp, Homo sapiens
tcccaggaaccgaacatatcatt

SEQ ID NO: 4222202 - DNA, 22 bp, Homo sapiens
tcccatcactggagcaccaggc

SEQ ID NO: 4222203 - DNA, 14 bp, Homo sapiens
tcccattgccctgg

SEQ ID NO: 4222204 - DNA, 23 bp, Homo sapiens
tccccaggggagagggtctggag

SEQ ID NO: 4222205 - DNA, 15 bp, Homo sapiens
tccccaggtggctga

SEQ ID NO: 4222206 - DNA, 20 bp, Homo sapiens
tccccaggtggctgacccag

SEQ ID NO: 4222207 - DNA, 17 bp, Homo sapiens
tccccagtttgcagaaa

SEQ ID NO: 4222208 - DNA, 19 bp, Homo sapiens
tccccccactgcaggcccc

SEQ ID NO: 4222209 - DNA, 17 bp, Homo sapiens
tccccctgccagtgcct

SEQ ID NO: 4222210 - DNA, 16 bp, Homo sapiens
tcccctatccacccag

SEQ ID NO: 4222211 - DNA, 18 bp, Homo sapiens
tcccctatccacccagcc

SEQ ID NO: 4222212 - DNA, 13 bp, Homo sapiens
tcccctcagagct

SEQ ID NO: 4222213 - DNA, 23 bp, Homo sapiens
tccccttgcccttgccctgacct

SEQ ID NO: 4222214 - DNA, 14 bp, Homo sapiens
tcccggctccctcc

SEQ ID NO: 4222215 - DNA, 15 bp, Homo sapiens
tccctctcctgccta

SEQ ID NO: 4222216 - DNA, 16 bp, Homo sapiens
tccctctggccctgcc

SEQ ID NO: 4222217 - DNA, 17 bp, Homo sapiens
tccctctggccctgcct

SEQ ID NO: 4222218 - DNA, 19 bp, Homo sapiens
tccctctggccctgccttc

SEQ ID NO: 4222219 - DNA, 14 bp, Homo sapiens
tccctgagtcacca

SEQ ID NO: 4222220 - DNA, 16 bp, Homo sapiens
tccctgagtcaccagg

SEQ ID NO: 4222221 - DNA, 17 bp, Homo sapiens
tccctgagtcaccagga

SEQ ID NO: 4222222 - DNA, 14 bp, Homo sapiens
tccctgccgcctca

SEQ ID NO: 4222223 - DNA, 18 bp, Homo sapiens
tccctggcttgtaactcc

SEQ ID NO: 4222224 - DNA, 22 bp, Homo sapiens
tccctggcttgtaactccacca

SEQ ID NO: 4222225 - DNA, 16 bp, Homo sapiens
tcccttcttgcatcct

SEQ ID NO: 4222226 - DNA, 23 bp, Homo sapiens
tccctttaaagagagtttgccac

SEQ ID NO: 4222227 - DNA, 14 bp, Homo sapiens
tccctttctgcccg

SEQ ID NO: 4222228 - DNA, 18 bp, Homo sapiens
tccgagacccccttttct

SEQ ID NO: 4222229 - DNA, 16 bp, Homo sapiens
tcctacctgctgctgc

SEQ ID NO: 4222230 - DNA, 20 bp, Homo sapiens
tcctacctgctgctgctatt

SEQ ID NO: 4222231 - DNA, 20 bp, Homo sapiens
tcctataacttgatgcatgt

SEQ ID NO: 4222232 - DNA, 21 bp, Homo sapiens
tcctcagagtcccggcgttta

SEQ ID NO: 4222233 - DNA, 22 bp, Homo sapiens
tcctcagggacagagacacctg

SEQ ID NO: 4222234 - DNA, 23 bp, Homo sapiens
tcctccaaaggaagtctaggagc

SEQ ID NO: 4222235 - DNA, 13 bp, Homo sapiens
tcctccagggcca

SEQ ID NO: 4222236 - DNA, 18 bp, Homo sapiens
tcctccctttccttccta

SEQ ID NO: 4222237 - DNA, 16 bp, Homo sapiens
tcctcgaagtcccggc

SEQ ID NO: 4222238 - DNA, 14 bp, Homo sapiens
tcctctccaggcac

SEQ ID NO: 4222239 - DNA, 15 bp, Homo sapiens
tcctctccaggcacc

SEQ ID NO: 4222240 - DNA, 17 bp, Homo sapiens
tcctctctggtggctct

SEQ ID NO: 4222241 - DNA, 17 bp, Homo sapiens
tcctctgaggaagaagg

SEQ ID NO: 4222242 - DNA, 12 bp, Homo sapiens
tcctctgccacc

SEQ ID NO: 4222243 - DNA, 23 bp, Homo sapiens
tcctctgccacctcccctatcca

SEQ ID NO: 4222244 - DNA, 17 bp, Homo sapiens
tcctctgtcctgcttct

SEQ ID NO: 4222245 - DNA, 19 bp, Homo sapiens
tcctctgtcctgcttctga

SEQ ID NO: 4222246 - DNA, 17 bp, Homo sapiens
tcctctgttctatccca

SEQ ID NO: 4222247 - DNA, 15 bp, Homo sapiens
tcctcttccccttgc

SEQ ID NO: 4222248 - DNA, 18 bp, Homo sapiens
tcctcttccccttgccct

SEQ ID NO: 4222249 - DNA, 21 bp, Homo sapiens
tcctgaagccagatccaccct

SEQ ID NO: 4222250 - DNA, 17 bp, Homo sapiens
tcctgaataaaccagta

SEQ ID NO: 4222251 - DNA, 18 bp, Homo sapiens
tcctgcccaggagagcca

SEQ ID NO: 4222252 - DNA, 23 bp, Homo sapiens
tcctgcccaggagagccagccct

SEQ ID NO: 4222253 - DNA, 11 bp, Homo sapiens
tcctgcctact

SEQ ID NO: 4222254 - DNA, 21 bp, Homo sapiens
tcctggaagctgtgtccttgc

SEQ ID NO: 4222255 - DNA, 23 bp, Homo sapiens
tccttaggaaaatgcttctgttg

SEQ ID NO: 4222256 - DNA, 19 bp, Homo sapiens
tccttccatttcttctgca

SEQ ID NO: 4222257 - DNA, 14 bp, Homo sapiens
tccttgcacctgca

SEQ ID NO: 4222258 - DNA, 15 bp, Homo sapiens
tccttgtgctcctgc

SEQ ID NO: 4222259 - DNA, 17 bp, Homo sapiens
tcctttactgaatgtaa

SEQ ID NO: 4222260 - DNA, 14 bp, Homo sapiens
tcctttgcattcat

SEQ ID NO: 4222261 - DNA, 12 bp, Homo sapiens
tcgaaaagaagg

SEQ ID NO: 4222262 - DNA, 21 bp, Homo sapiens
tcgctctgctggcctggccgg

SEQ ID NO: 4222263 - DNA, 12 bp, Homo sapiens
tcggcccacagc

SEQ ID NO: 4222264 - DNA, 19 bp, Homo sapiens
tcggcccacagctcccacc

SEQ ID NO: 4222265 - DNA, 23 bp, Homo sapiens
tcggcccacagctcccaccccac

SEQ ID NO: 4222266 - DNA, 16 bp, Homo sapiens
tcgtcctccccctgcc

SEQ ID NO: 4222267 - DNA, 18 bp, Homo sapiens
tcgtcctccccctgccag

SEQ ID NO: 4222268 - DNA, 23 bp, Homo sapiens
tcgtcctccccctgccagtgcct

SEQ ID NO: 4222269 - DNA, 17 bp, Homo sapiens
tcgtgatcactgagcca

SEQ ID NO: 4222270 - DNA, 11 bp, Homo sapiens
tctaaattaaa

SEQ ID NO: 4222271 - DNA, 13 bp, Homo sapiens
tctaaattaaaaa

SEQ ID NO: 4222272 - DNA, 19 bp, Homo sapiens
tctaataaagctcctctgc

SEQ ID NO: 4222273 - DNA, 20 bp, Homo sapiens
tctaatgtctcttcctctgt

SEQ ID NO: 4222274 - DNA, 21 bp, Homo sapiens
tctacagagaaaatgaatttg

SEQ ID NO: 4222275 - DNA, 17 bp, Homo sapiens
tctagggagagaccctt

SEQ ID NO: 4222276 - DNA, 14 bp, Homo sapiens
tctattacactgga

SEQ ID NO: 4222277 - DNA, 20 bp, Homo sapiens
tctatttttgtttacaaaca

SEQ ID NO: 4222278 - DNA, 23 bp, Homo sapiens
tctatttttgtttacaaacatgg

SEQ ID NO: 4222279 - DNA, 15 bp, Homo sapiens
tctcactccaccacc

SEQ ID NO: 4222280 - DNA, 17 bp, Homo sapiens
tctcattaaaatccagt

SEQ ID NO: 4222281 - DNA, 13 bp, Homo sapiens
tctcattccccag

SEQ ID NO: 4222282 - DNA, 18 bp, Homo sapiens
ttctctgtgcccctgtaa

SEQ ID NO: 4222283 - DNA, 17 bp, Homo sapiens
ttctgatgttactgaga

SEQ ID NO: 4222284 - DNA, 20 bp, Homo sapiens
ttctggcattttctgttcca

SEQ ID NO: 4222285 - DNA, 19 bp, Homo sapiens
ttctgttgtaatagtccat

SEQ ID NO: 4222286 - DNA, 15 bp, Homo sapiens
ttcttaaggtccctg

SEQ ID NO: 4222287 - DNA, 17 bp, Homo sapiens
ttcttcagatcagtgct

SEQ ID NO: 4222288 - DNA, 18 bp, Homo sapiens
ttcttccccttcctctct

SEQ ID NO: 4222289 - DNA, 23 bp, Homo sapiens
ttcttcgaggtggatcacagagg

SEQ ID NO: 4222290 - DNA, 20 bp, Homo sapiens
ttcttgcatccttcctataa

SEQ ID NO: 4222291 - DNA, 17 bp, Homo sapiens
ttgaaaaaactttctct

SEQ ID NO: 4222292 - DNA, 21 bp, Homo sapiens
ttgaaaaaactttctctttgc

SEQ ID NO: 4222293 - DNA, 22 bp, Homo sapiens
ttgaaaaaactttctctttgcc

SEQ ID NO: 4222294 - DNA, 18 bp, Homo sapiens
ttgaaaaataaaaaccat

SEQ ID NO: 4222295 - DNA, 22 bp, Homo sapiens
ttgaaataattatgcagacaca

SEQ ID NO: 4222296 - DNA, 15 bp, Homo sapiens
ttgaaatattaaaat

SEQ ID NO: 4222297 - DNA, 13 bp, Homo sapiens
ttgaacccaggag

SEQ ID NO: 4222298 - DNA, 15 bp, Homo sapiens
ttgacaacagactga

SEQ ID NO: 4222299 - DNA, 15 bp, Homo sapiens
ttgagacctcagcca

SEQ ID NO: 4222300 - DNA, 17 bp, Homo sapiens
ttgagacctcagccatg

SEQ ID NO: 4222301 - DNA, 23 bp, Homo sapiens
ttgagctcagacccccactctca

SEQ ID NO: 4222302 - DNA, 18 bp, Homo sapiens
ttgagggccttgcacata

SEQ ID NO: 4222303 - DNA, 22 bp, Homo sapiens
ttgaggtggaagccctccttcc

SEQ ID NO: 4222304 - DNA, 20 bp, Homo sapiens
ttgattattctgattccact

SEQ ID NO: 4222305 - DNA, 19 bp, Homo sapiens
ttgcacataggaaactttt

SEQ ID NO: 4222306 - DNA, 10 bp, Homo sapiens
ttgcattcat

SEQ ID NO: 4222307 - DNA, 18 bp, Homo sapiens
ttgccaccactagagctg

SEQ ID NO: 4222308 - DNA, 19 bp, Homo sapiens
ttgccaccactagagctga

SEQ ID NO: 4222309 - DNA, 12 bp, Homo sapiens
ttgccatttctt

SEQ ID NO: 4222310 - DNA, 17 bp, Homo sapiens
ttgcccagggcagcttt

SEQ ID NO: 4222311 - DNA, 13 bp, Homo sapiens
ttgccctgacctc

SEQ ID NO: 4222312 - DNA, 15 bp, Homo sapiens
ttgccctgacctccc

SEQ ID NO: 4222313 - DNA, 18 bp, Homo sapiens
ttgccctgacctcccagc

SEQ ID NO: 4222314 - DNA, 15 bp, Homo sapiens
ttgccttgggccttt

SEQ ID NO: 4222315 - DNA, 20 bp, Homo sapiens
ttgcttaaattgtgggcaaa

SEQ ID NO: 4222316 - DNA, 15 bp, Homo sapiens
ttggaaaataaatca

SEQ ID NO: 4222317 - DNA, 13 bp, Homo sapiens
ttggaagagaatc

SEQ ID NO: 4222318 - DNA, 14 bp, Homo sapiens
ttggttcctctctg

SEQ ID NO: 4222319 - DNA, 12 bp, Homo sapiens
ttgtaatagtcc

SEQ ID NO: 4222320 - DNA, 14 bp, Homo sapiens
ttgtaatgtcacca

SEQ ID NO: 4222321 - DNA, 16 bp, Homo sapiens
ttgtacagtggagaaa

SEQ ID NO: 4222322 - DNA, 20 bp, Homo sapiens
ttgtccattgtaaatctgaa

SEQ ID NO: 4222323 - DNA, 11 bp, Homo sapiens
ttgtccccagt

SEQ ID NO: 4222324 - DNA, 23 bp, Homo sapiens
ttgtctcctacctgctgctgcta

SEQ ID NO: 4222325 - DNA, 23 bp, Homo sapiens
ttgtggaaagataataaattgat

SEQ ID NO: 4222326 - DNA, 20 bp, Homo sapiens
ttgtttattctttttaaagt

SEQ ID NO: 4222327 - DNA, 19 bp, Homo sapiens
tttaaaaacatgagaaatg

SEQ ID NO: 4222328 - DNA, 11 bp, Homo sapiens
tttaaaaccca

SEQ ID NO: 4222329 - DNA, 21 bp, Homo sapiens
tttaaactacctcaaaacact

SEQ ID NO: 4222330 - DNA, 21 bp, Homo sapiens
tttaaataaattgtgaaaaaa

SEQ ID NO: 4222331 - DNA, 19 bp, Homo sapiens
tttaactctggattttgaa

SEQ ID NO: 4222332 - DNA, 16 bp, Homo sapiens
tttaatgtttttctgg

SEQ ID NO: 4222333 - DNA, 22 bp, Homo sapiens
tttacaaacatggaaaacagag

SEQ ID NO: 4222334 - DNA, 21 bp, Homo sapiens
tttagcctggtacctagcaca

SEQ ID NO: 4222335 - DNA, 20 bp, Homo sapiens
tttagcgcacccagagaaaa

SEQ ID NO: 4222336 - DNA, 21 bp, Homo sapiens
tttataaagcaaattactcca

SEQ ID NO: 4222337 - DNA, 14 bp, Homo sapiens
tttcagaccccagc

SEQ ID NO: 4222338 - DNA, 20 bp, Homo sapiens
tttccacaagattcccagag

SEQ ID NO: 4222339 - DNA, 18 bp, Homo sapiens
tttccccggtcccttgag

SEQ ID NO: 4222340 - DNA, 16 bp, Homo sapiens
tttcccctcagagctc

SEQ ID NO: 4222341 - DNA, 16 bp, Homo sapiens
tttccttccttccctg

SEQ ID NO: 4222342 - DNA, 19 bp, Homo sapiens
tttccttgtgctcctgcca

SEQ ID NO: 4222343 - DNA, 13 bp, Homo sapiens
tttctctttgcca

SEQ ID NO: 4222344 - DNA, 12 bp, Homo sapiens
tttctgttccag

SEQ ID NO: 4222345 - DNA, 10 bp, Homo sapiens
tttgaaaaaa

SEQ ID NO: 4222346 - DNA, 19 bp, Homo sapiens
tttgagcagatcttggaat

SEQ ID NO: 4222347 - DNA, 19 bp, Homo sapiens
tttgagttattttaattat

SEQ ID NO: 4222348 - DNA, 11 bp, Homo sapiens
tttgcattcat

SEQ ID NO: 4222349 - DNA, 18 bp, Homo sapiens
tttgccaccactagagct

SEQ ID NO: 4222350 - DNA, 15 bp, Homo sapiens
tttgccagtgggaac

SEQ ID NO: 4222351 - DNA, 16 bp, Homo sapiens
tttgccagtgggaact

SEQ ID NO: 4222352 - DNA, 13 bp, Homo sapiens
tttgccatttctt

SEQ ID NO: 4222353 - DNA, 19 bp, Homo sapiens
tttgctgaaaacattacat

SEQ ID NO: 4222354 - DNA, 17 bp, Homo sapiens
tttggcaggaagatgta

SEQ ID NO: 4222355 - DNA, 21 bp, Homo sapiens
tttggcaggaagatgtatgct

SEQ ID NO: 4222356 - DNA, 23 bp, Homo sapiens
tttgtaatgtcaccaccttccca

SEQ ID NO: 4222357 - DNA, 16 bp, Homo sapiens
tttgtatgctaaatga

SEQ ID NO: 4222358 - DNA, 14 bp, Homo sapiens
tttgtctcctacct

SEQ ID NO: 4222359 - DNA, 12 bp, Homo sapiens
tttgtgaatttg

SEQ ID NO: 4222360 - DNA, 15 bp, Homo sapiens
tttgtttacaaacat

SEQ ID NO: 4222361 - DNA, 18 bp, Homo sapiens
ttttaaaaacatgagaaa

SEQ ID NO: 4222362 - DNA, 17 bp, Homo sapiens
ttttcctttgcattcat

SEQ ID NO: 4222363 - DNA, 16 bp, Homo sapiens
ttttcttccccttcct

SEQ ID NO: 4222364 - DNA, 19 bp, Homo sapiens
aaaaaactttctctttgcc

SEQ ID NO: 4222365 - DNA, 17 bp, Homo sapiens
aaaaaccataaacattt

SEQ ID NO: 4222366 - DNA, 15 bp, Homo sapiens
aaaaactttctcttt

SEQ ID NO: 4222367 - DNA, 15 bp, Homo sapiens
aaaaagaaaaaggaa

SEQ ID NO: 4222368 - DNA, 10 bp, Homo sapiens
aaaaaggaaa

SEQ ID NO: 4222369 - DNA, 22 bp, Homo sapiens
aaaaataaatataattgggatt

SEQ ID NO: 4222370 - DNA, 18 bp, Homo sapiens
aaaacagcctcacagaag

SEQ ID NO: 4222371 - DNA, 16 bp, Homo sapiens
aaaaccataaacattt

SEQ ID NO: 4222372 - DNA, 13 bp, Homo sapiens
aaaacccagagag

SEQ ID NO: 4222373 - DNA, 21 bp, Homo sapiens
aaaagaaagaaatttgaaaaa

SEQ ID NO: 4222374 - DNA, 12 bp, Homo sapiens
aaaagagaaaaa

SEQ ID NO: 4222375 - DNA, 13 bp, Homo sapiens
aaaagataaattt

SEQ ID NO: 4222376 - DNA, 18 bp, Homo sapiens
aaaagcaaaaagatgtat

SEQ ID NO: 4222377 - DNA, 22 bp, Homo sapiens
aaaaggtgcctgtgaggcaggg

SEQ ID NO: 4222378 - DNA, 23 bp, Homo sapiens
aaaagtatgcagattatttgccc

SEQ ID NO: 4222379 - DNA, 15 bp, Homo sapiens
aaaagtcaaaaggtg

SEQ ID NO: 4222380 - DNA, 22 bp, Homo sapiens
aaaagtgcattcaaccttacca

SEQ ID NO: 4222381 - DNA, 17 bp, Homo sapiens
aaaagtttgccagaagt

SEQ ID NO: 4222382 - DNA, 13 bp, Homo sapiens
aaaataaaaacca

SEQ ID NO: 4222383 - DNA, 14 bp, Homo sapiens
aaaataaaaattga

SEQ ID NO: 4222384 - DNA, 19 bp, Homo sapiens
aaaataaaattaaagctga

SEQ ID NO: 4222385 - DNA, 22 bp, Homo sapiens
aaaataaatataattgggattt

SEQ ID NO: 4222386 - DNA, 16 bp, Homo sapiens
aaaatatttttttcct

SEQ ID NO: 4222387 - DNA, 20 bp, Homo sapiens
aaaatatttttttcctttgc

SEQ ID NO: 4222388 - DNA, 18 bp, Homo sapiens
aaaatcctgaataaacca

SEQ ID NO: 4222389 - DNA, 13 bp, Homo sapiens
aaaatgaaataaa

SEQ ID NO: 4222390 - DNA, 12 bp, Homo sapiens
aaaatgaatttg

SEQ ID NO: 4222391 - DNA, 15 bp, Homo sapiens
aaaatgaatttggga

SEQ ID NO: 4222392 - DNA, 13 bp, Homo sapiens
aaaattaactgct

SEQ ID NO: 4222393 - DNA, 19 bp, Homo sapiens
aaacatgagaaatgtgaac

SEQ ID NO: 4222394 - DNA, 16 bp, Homo sapiens
aaaccaaaataaaaat

SEQ ID NO: 4222395 - DNA, 13 bp, Homo sapiens
aaaccataaacat

SEQ ID NO: 4222396 - DNA, 12 bp, Homo sapiens
aaaccctgtctc

SEQ ID NO: 4222397 - DNA, 14 bp, Homo sapiens
aaacgagataatgt

SEQ ID NO: 4222398 - DNA, 20 bp, Homo sapiens
aaactacctcaaaacacttt

SEQ ID NO: 4222399 - DNA, 16 bp, Homo sapiens
aaactgaaaaatgtca

SEQ ID NO: 4222400 - DNA, 21 bp, Homo sapiens
aaacttagtttttatctttga

SEQ ID NO: 4222401 - DNA, 21 bp, Homo sapiens
aaacttccaaaggtttaaact

SEQ ID NO: 4222402 - DNA, 16 bp, Homo sapiens
aaactttctctttgcc

SEQ ID NO: 4222403 - DNA, 22 bp, Homo sapiens
aaactttctctttgccatttct

SEQ ID NO: 4222404 - DNA, 21 bp, Homo sapiens
aaagaaaaacaatgaaattga

SEQ ID NO: 4222405 - DNA, 13 bp, Homo sapiens
aaagaaaaaggaa

SEQ ID NO: 4222406 - DNA, 19 bp, Homo sapiens
aaagaaatttgaaaaaact

SEQ ID NO: 4222407 - DNA, 22 bp, Homo sapiens
aaagaaatttgaaaaaactttc

SEQ ID NO: 4222408 - DNA, 23 bp, Homo sapiens
aaagaaatttgaaaaaactttct

SEQ ID NO: 4222409 - DNA, 21 bp, Homo sapiens
aaagaattcctgaagccagat

SEQ ID NO: 4222410 - DNA, 16 bp, Homo sapiens
aaagacagaatgtcac

SEQ ID NO: 4222411 - DNA, 14 bp, Homo sapiens
aaagagaaaaagaa

SEQ ID NO: 4222412 - DNA, 18 bp, Homo sapiens
aaagataataaattgatt

SEQ ID NO: 4222413 - DNA, 21 bp, Homo sapiens
aaagatccaccctcaaatgtc

SEQ ID NO: 4222414 - DNA, 17 bp, Homo sapiens
aaagatgtatatttgca

SEQ ID NO: 4222415 - DNA, 22 bp, Homo sapiens
aaagatgtatatttgcatattt

SEQ ID NO: 4222416 - DNA, 17 bp, Homo sapiens
aaagcaaaaagatgtat

SEQ ID NO: 4222417 - DNA, 12 bp, Homo sapiens
aaagcacctgcc

SEQ ID NO: 4222418 - DNA, 21 bp, Homo sapiens
aaagcagattacctcttgccc

SEQ ID NO: 4222419 - DNA, 11 bp, Homo sapiens
aaagccaaaaa

SEQ ID NO: 4222420 - DNA, 18 bp, Homo sapiens
aaagtcaaaaggtgcctg

SEQ ID NO: 4222421 - DNA, 20 bp, Homo sapiens
aaagtcaaaaggtgcctgtg

SEQ ID NO: 4222422 - DNA, 13 bp, Homo sapiens
aaagtttgccaga

SEQ ID NO: 4222423 - DNA, 15 bp, Homo sapiens
aaataaatataattg

SEQ ID NO: 4222424 - DNA, 18 bp, Homo sapiens
aaataaatataattggga

SEQ ID NO: 4222425 - DNA, 13 bp, Homo sapiens
aaataattatgca

SEQ ID NO: 4222426 - DNA, 22 bp, Homo sapiens
aaatactgtttttaacaactat

SEQ ID NO: 4222427 - DNA, 18 bp, Homo sapiens
aaatagcttattatagaa

SEQ ID NO: 4222428 - DNA, 18 bp, Homo sapiens
aaatatcagttactcagc

SEQ ID NO: 4222429 - DNA, 13 bp, Homo sapiens
aaatatgtgaaga

SEQ ID NO: 4222430 - DNA, 15 bp, Homo sapiens
aaatatttttttcct

SEQ ID NO: 4222431 - DNA, 16 bp, Homo sapiens
aaatatttttttcctt

SEQ ID NO: 4222432 - DNA, 19 bp, Homo sapiens
aaatcaatgctataactat

SEQ ID NO: 4222433 - DNA, 17 bp, Homo sapiens
aaatccagtattatatt

SEQ ID NO: 4222434 - DNA, 12 bp, Homo sapiens
aaatgaaataaa

SEQ ID NO: 4222435 - DNA, 14 bp, Homo sapiens
aaatgaatttggga

SEQ ID NO: 4222436 - DNA, 13 bp, Homo sapiens
aaatgacagtgaa

SEQ ID NO: 4222437 - DNA, 16 bp, Homo sapiens
aaatgcatccattcct

SEQ ID NO: 4222438 - DNA, 14 bp, Homo sapiens
aaattaaaaaagaa

SEQ ID NO: 4222439 - DNA, 13 bp, Homo sapiens
aaattaactgctc

SEQ ID NO: 4222440 - DNA, 14 bp, Homo sapiens
aaattaattatatt

SEQ ID NO: 4222441 - DNA, 13 bp, Homo sapiens
aaattatgtgaaa

SEQ ID NO: 4222442 - DNA, 18 bp, Homo sapiens
aaattatgtgaaatgctt

SEQ ID NO: 4222443 - DNA, 20 bp, Homo sapiens
aaattgaaaaataaaaacca

SEQ ID NO: 4222444 - DNA, 21 bp, Homo sapiens
aaattgaaaaataaaaaccat

SEQ ID NO: 4222445 - DNA, 11 bp, Homo sapiens
aaattgagatg

SEQ ID NO: 4222446 - DNA, 15 bp, Homo sapiens
aaattgtgaaaaaaa

SEQ ID NO: 4222447 - DNA, 21 bp, Homo sapiens
aaatttaatgtttttctggaa

SEQ ID NO: 4222448 - DNA, 22 bp, Homo sapiens
aaatttaatgtttttctggaag

SEQ ID NO: 4222449 - DNA, 14 bp, Homo sapiens
aaatttgaaaaaac

SEQ ID NO: 4222450 - DNA, 18 bp, Homo sapiens
aaatttgaaaaaactttc

SEQ ID NO: 4222451 - DNA, 23 bp, Homo sapiens
aaatttgccaccactagagctga

SEQ ID NO: 4222452 - DNA, 15 bp, Homo sapiens
aacaatgaaattgac

SEQ ID NO: 4222453 - DNA, 16 bp, Homo sapiens
aacactcttacacctg

SEQ ID NO: 4222454 - DNA, 23 bp, Homo sapiens
aacagacaagcaacccaaactga

SEQ ID NO: 4222455 - DNA, 14 bp, Homo sapiens
aacagacaggagaa

SEQ ID NO: 4222456 - DNA, 16 bp, Homo sapiens
aacatctgaaagccac

SEQ ID NO: 4222457 - DNA, 16 bp, Homo sapiens
aacatgagaaatgtga

SEQ ID NO: 4222458 - DNA, 11 bp, Homo sapiens
aacatgggagg

SEQ ID NO: 4222459 - DNA, 14 bp, Homo sapiens
aaccaaaataaaaa

SEQ ID NO: 4222460 - DNA, 16 bp, Homo sapiens
aaccaaaataaaaatt

SEQ ID NO: 4222461 - DNA, 15 bp, Homo sapiens
aaccaactttccccc

SEQ ID NO: 4222462 - DNA, 16 bp, Homo sapiens
aacccaagtgggggca

SEQ ID NO: 4222463 - DNA, 12 bp, Homo sapiens
aacccagagagg

SEQ ID NO: 4222464 - DNA, 23 bp, Homo sapiens
aaccccagttctgctcctctcca

SEQ ID NO: 4222465 - DNA, 13 bp, Homo sapiens
aacccggaaacag

SEQ ID NO: 4222466 - DNA, 18 bp, Homo sapiens
aaccgaacatgaccaaaa

SEQ ID NO: 4222467 - DNA, 16 bp, Homo sapiens
aacctggctccctccc

SEQ ID NO: 4222468 - DNA, 19 bp, Homo sapiens
aacctggctccctcccacc

SEQ ID NO: 4222469 - DNA, 18 bp, Homo sapiens
aacctttgtaagaaaacc

SEQ ID NO: 4222470 - DNA, 18 bp, Homo sapiens
aactacctcaaaacactt

SEQ ID NO: 4222471 - DNA, 15 bp, Homo sapiens
aactacgtgacctct

SEQ ID NO: 4222472 - DNA, 18 bp, Homo sapiens
aactcaatctaaattaaa

SEQ ID NO: 4222473 - DNA, 21 bp, Homo sapiens
aactcaatctaaattaaaaaa

SEQ ID NO: 4222474 - DNA, 15 bp, Homo sapiens
aactccaccaaccca

SEQ ID NO: 4222475 - DNA, 19 bp, Homo sapiens
aactccaggatttataaag

SEQ ID NO: 4222476 - DNA, 18 bp, Homo sapiens
aactcctggaaatatcag

SEQ ID NO: 4222477 - DNA, 17 bp, Homo sapiens
aactctggattttgaat

SEQ ID NO: 4222478 - DNA, 21 bp, Homo sapiens
aactgtgatggggtgggcagg

SEQ ID NO: 4222479 - DNA, 11 bp, Homo sapiens
aacttgatgca

SEQ ID NO: 4222480 - DNA, 12 bp, Homo sapiens
aacttgatgcat

SEQ ID NO: 4222481 - DNA, 11 bp, Homo sapiens
aacttgtgaac

SEQ ID NO: 4222482 - DNA, 20 bp, Homo sapiens
aacttgtgaactccatcatt

SEQ ID NO: 4222483 - DNA, 21 bp, Homo sapiens
aacttgtgaactccatcattc

SEQ ID NO: 4222484 - DNA, 23 bp, Homo sapiens
aacttgtgaactccatcattcat

SEQ ID NO: 4222485 - DNA, 22 bp, Homo sapiens
aactttctctttgccatttctt

SEQ ID NO: 4222486 - DNA, 22 bp, Homo sapiens
aactttgtacagtggagaaata

SEQ ID NO: 4222487 - DNA, 23 bp, Homo sapiens
aactttgtacagtggagaaatat

SEQ ID NO: 4222488 - DNA, 14 bp, Homo sapiens
aagaaaaaaatata

SEQ ID NO: 4222489 - DNA, 21 bp, Homo sapiens
aagaaaaaaatatattttatg

SEQ ID NO: 4222490 - DNA, 14 bp, Homo sapiens
aagaaaaaggaaaa

SEQ ID NO: 4222491 - DNA, 11 bp, Homo sapiens
aagaaaaccaa

SEQ ID NO: 4222492 - DNA, 15 bp, Homo sapiens
aagaaaaccaaaata

SEQ ID NO: 4222493 - DNA, 11 bp, Homo sapiens
aagaaacccaa

SEQ ID NO: 4222494 - DNA, 14 bp, Homo sapiens
aagaaatttgaaaa

SEQ ID NO: 4222495 - DNA, 18 bp, Homo sapiens
aagaattattcagtgaat

SEQ ID NO: 4222496 - DNA, 20 bp, Homo sapiens
aagaattattcagtgaattt

SEQ ID NO: 4222497 - DNA, 19 bp, Homo sapiens
aagaattcctgaagccaga

SEQ ID NO: 4222498 - DNA, 19 bp, Homo sapiens
aagaattgaacccaggagg

SEQ ID NO: 4222499 - DNA, 16 bp, Homo sapiens
aagacagaatgtcacc

SEQ ID NO: 4222500 - DNA, 17 bp, Homo sapiens
aagacagaatgtcacca

SEQ ID NO: 4222501 - DNA, 20 bp, Homo sapiens
aagagccttggtgtccacct

SEQ ID NO: 4222502 - DNA, 15 bp, Homo sapiens
aagaggctccctcct

SEQ ID NO: 4222503 - DNA, 18 bp, Homo sapiens
aagataataaattgattt

SEQ ID NO: 4222504 - DNA, 23 bp, Homo sapiens
aagatccaccctcaaatgtcaga

SEQ ID NO: 4222505 - DNA, 18 bp, Homo sapiens
aagatgtatgctttgaat

SEQ ID NO: 4222506 - DNA, 14 bp, Homo sapiens
aagattcccagaga

SEQ ID NO: 4222507 - DNA, 18 bp, Homo sapiens
aagcaaaaagatgtatat

SEQ ID NO: 4222508 - DNA, 16 bp, Homo sapiens
aagcaaattactccaa

SEQ ID NO: 4222509 - DNA, 23 bp, Homo sapiens
aagcacaaagcagtttttccccc

SEQ ID NO: 4222510 - DNA, 13 bp, Homo sapiens
aagcacctgccga

SEQ ID NO: 4222511 - DNA, 14 bp, Homo sapiens
aagccacagcttct

SEQ ID NO: 4222512 - DNA, 9 bp, Homo sapiens
aagccctcc

SEQ ID NO: 4222513 - DNA, 11 bp, Homo sapiens
aagccctcctt

SEQ ID NO: 4222514 - DNA, 15 bp, Homo sapiens
aagccctccttccac

SEQ ID NO: 4222515 - DNA, 19 bp, Homo sapiens
aagctcacagttcctcgcc

SEQ ID NO: 4222516 - DNA, 15 bp, Homo sapiens
aagctctattaagat

SEQ ID NO: 4222517 - DNA, 14 bp, Homo sapiens
aaggaagtctagga

SEQ ID NO: 4222518 - DNA, 16 bp, Homo sapiens
aaggagactcacctct

SEQ ID NO: 4222519 - DNA, 17 bp, Homo sapiens
aaggagactcacctctg

SEQ ID NO: 4222520 - DNA, 20 bp, Homo sapiens
aaggagactcacctctgcct

SEQ ID NO: 4222521 - DNA, 23 bp, Homo sapiens
aaggatgtaaacagtgcctgctg

SEQ ID NO: 4222522 - DNA, 19 bp, Homo sapiens
aaggctgagaggagagaga

SEQ ID NO: 4222523 - DNA, 17 bp, Homo sapiens
aagggtctagggagaga

SEQ ID NO: 4222524 - DNA, 16 bp, Homo sapiens
aaggtttataaagcag

SEQ ID NO: 4222525 - DNA, 17 bp, Homo sapiens
aaggtttataaagcaga

SEQ ID NO: 4222526 - DNA, 13 bp, Homo sapiens
aagtaagcaaaga

SEQ ID NO: 4222527 - DNA, 20 bp, Homo sapiens
aagtactgctgtaaataaat

SEQ ID NO: 4222528 - DNA, 22 bp, Homo sapiens
aagtcaaccaatgtagaaagct

SEQ ID NO: 4222529 - DNA, 20 bp, Homo sapiens
aagtctcctttactgaatgt

SEQ ID NO: 4222530 - DNA, 12 bp, Homo sapiens
aagtgcattcaa

SEQ ID NO: 4222531 - DNA, 18 bp, Homo sapiens
aagtgcattcaaccttac

SEQ ID NO: 4222532 - DNA, 20 bp, Homo sapiens
aagtgcattcaaccttacca

SEQ ID NO: 4222533 - DNA, 23 bp, Homo sapiens
aagtgcattcaaccttaccaaaa

SEQ ID NO: 4222534 - DNA, 19 bp, Homo sapiens
aagtggaccaggacaggac

SEQ ID NO: 4222535 - DNA, 23 bp, Homo sapiens
aagttaagaatgttcttatgttg

SEQ ID NO: 4222536 - DNA, 14 bp, Homo sapiens
aataaattgatttg

SEQ ID NO: 4222537 - DNA, 22 bp, Homo sapiens
aatactgccggtcacccaggct

SEQ ID NO: 4222538 - DNA, 16 bp, Homo sapiens
aatagttttaaatatg

SEQ ID NO: 4222539 - DNA, 22 bp, Homo sapiens
aatagttttaaatatgaacaaa

SEQ ID NO: 4222540 - DNA, 23 bp, Homo sapiens
aatatagtaggggttgaagaaaa

SEQ ID NO: 4222541 - DNA, 14 bp, Homo sapiens
aatatattttatga

SEQ ID NO: 4222542 - DNA, 16 bp, Homo sapiens
aatatattttatgatt

SEQ ID NO: 4222543 - DNA, 14 bp, Homo sapiens
aatatgaacaaaga

SEQ ID NO: 4222544 - DNA, 16 bp, Homo sapiens
aatatgacagctgtcc

SEQ ID NO: 4222545 - DNA, 22 bp, Homo sapiens
aatatgacagctgtccctgtca

SEQ ID NO: 4222546 - DNA, 18 bp, Homo sapiens
aatattggtaattaaaag

SEQ ID NO: 4222547 - DNA, 16 bp, Homo sapiens
aatcacagtgttatgt

SEQ ID NO: 4222548 - DNA, 14 bp, Homo sapiens
aatcactgtcaata

SEQ ID NO: 4222549 - DNA, 19 bp, Homo sapiens
aatcagagttaccattatt

SEQ ID NO: 4222550 - DNA, 23 bp, Homo sapiens
aatcattctttcccctcagagct

SEQ ID NO: 4222551 - DNA, 24 bp, Homo sapiens
aatccagtattatattatcatatc

SEQ ID NO: 4222552 - DNA, 18 bp, Homo sapiens
aatcctgaataaaccagt

SEQ ID NO: 4222553 - DNA, 14 bp, Homo sapiens
aatccttccatttc

SEQ ID NO: 4222554 - DNA, 20 bp, Homo sapiens
aatccttccatttcttctgc

SEQ ID NO: 4222555 - DNA, 18 bp, Homo sapiens
aatcggcccacagctccc

SEQ ID NO: 4222556 - DNA, 22 bp, Homo sapiens
aatcggcccacagctcccaccc

SEQ ID NO: 4222557 - DNA, 20 bp, Homo sapiens
aatctaaattaaaaaagaaa

SEQ ID NO: 4222558 - DNA, 23 bp, Homo sapiens
aatctggtctgaataacactgga

SEQ ID NO: 4222559 - DNA, 14 bp, Homo sapiens
aatctgtctcccca

SEQ ID NO: 4222560 - DNA, 14 bp, Homo sapiens
aatgaaattgacct

SEQ ID NO: 4222561 - DNA, 17 bp, Homo sapiens
aatgaatgcataaaatg

SEQ ID NO: 4222562 - DNA, 12 bp, Homo sapiens
aatgacccaaac

SEQ ID NO: 4222563 - DNA, 18 bp, Homo sapiens
aatgaggaggtacattga

SEQ ID NO: 4222564 - DNA, 20 bp, Homo sapiens
aatgatttccaaagagaaaa

SEQ ID NO: 4222565 - DNA, 22 bp, Homo sapiens
aatgctgtattagtcacagaga

SEQ ID NO: 4222566 - DNA, 20 bp, Homo sapiens
aatggagtctcccactgcaa

SEQ ID NO: 4222567 - DNA, 15 bp, Homo sapiens
aatgtaatgatcata

SEQ ID NO: 4222568 - DNA, 21 bp, Homo sapiens
aatgtattttggttgctgatg

SEQ ID NO: 4222569 - DNA, 23 bp, Homo sapiens
aatgtcaccaccttcccagctct

SEQ ID NO: 4222570 - DNA, 16 bp, Homo sapiens
aatgtctcttcctctg

SEQ ID NO: 4222571 - DNA, 23 bp, Homo sapiens
aatgtgaatcagaccctacccca

SEQ ID NO: 4222572 - DNA, 23 bp, Homo sapiens
aatgtgataatatattgctaaaa

SEQ ID NO: 4222573 - DNA, 14 bp, Homo sapiens
aattaaaaaagaaa

SEQ ID NO: 4222574 - DNA, 21 bp, Homo sapiens
aattagattatttctgtattt

SEQ ID NO: 4222575 - DNA, 20 bp, Homo sapiens
aattatatttctacagagaa

SEQ ID NO: 4222576 - DNA, 15 bp, Homo sapiens
aattattcagtgaat

SEQ ID NO: 4222577 - DNA, 18 bp, Homo sapiens
aattcaaagctctattaa

SEQ ID NO: 4222578 - DNA, 20 bp, Homo sapiens
aattctgatgttactgagat

SEQ ID NO: 4222579 - DNA, 20 bp, Homo sapiens
aattgaaaaataaaaaccat

SEQ ID NO: 4222580 - DNA, 22 bp, Homo sapiens
aattgggattttaaaaacatga

SEQ ID NO: 4222581 - DNA, 17 bp, Homo sapiens
aatttaaccataaatca

SEQ ID NO: 4222582 - DNA, 17 bp, Homo sapiens
aatttgaaaaaactttc

SEQ ID NO: 4222583 - DNA, 15 bp, Homo sapiens
aatttgtccattgta

SEQ ID NO: 4222584 - DNA, 17 bp, Homo sapiens
aattttcagaccccagc

SEQ ID NO: 4222585 - DNA, 19 bp, Homo sapiens
aatttttttaaatttcagt

SEQ ID NO: 4222586 - DNA, 18 bp, Homo sapiens
acaaagaaaaaaatatat

SEQ ID NO: 4222587 - DNA, 18 bp, Homo sapiens
acaaagcggctttctaat

SEQ ID NO: 4222588 - DNA, 22 bp, Homo sapiens
acaaagcggctttctaatagag

SEQ ID NO: 4222589 - DNA, 12 bp, Homo sapiens
acaaatgtgata

SEQ ID NO: 4222590 - DNA, 17 bp, Homo sapiens
acaagaatcacctcaaa

SEQ ID NO: 4222591 - DNA, 16 bp, Homo sapiens
acaagagcgaaactcc

SEQ ID NO: 4222592 - DNA, 18 bp, Homo sapiens
acaagcaacccaaactga

SEQ ID NO: 4222593 - DNA, 12 bp, Homo sapiens
acaatgaaattg

SEQ ID NO: 4222594 - DNA, 22 bp, Homo sapiens
acaatttcacatggactttgga

SEQ ID NO: 4222595 - DNA, 13 bp, Homo sapiens
acacaggaaacaa

SEQ ID NO: 4222596 - DNA, 14 bp, Homo sapiens
acacatcaaatgcc

SEQ ID NO: 4222597 - DNA, 18 bp, Homo sapiens
acacctgcacctcccccc

SEQ ID NO: 4222598 - DNA, 16 bp, Homo sapiens
acagaaactatatgca

SEQ ID NO: 4222599 - DNA, 16 bp, Homo sapiens
acagaatgtcaccagt

SEQ ID NO: 4222600 - DNA, 20 bp, Homo sapiens
acagacaaaaacagcctcac

SEQ ID NO: 4222601 - DNA, 18 bp, Homo sapiens
acagagaaaatgaatttg

SEQ ID NO: 4222602 - DNA, 14 bp, Homo sapiens
acagagaaggcagg

SEQ ID NO: 4222603 - DNA, 14 bp, Homo sapiens
acagagacacctgc

SEQ ID NO: 4222604 - DNA, 21 bp, Homo sapiens
acagagggaagtttaaaaccc

SEQ ID NO: 4222605 - DNA, 22 bp, Homo sapiens
acagagggaagtttaaaaccca

SEQ ID NO: 4222606 - DNA, 18 bp, Homo sapiens
acagagtacgttaaaagc

SEQ ID NO: 4222607 - DNA, 11 bp, Homo sapiens
acagatggacc

SEQ ID NO: 4222608 - DNA, 14 bp, Homo sapiens
acagatggaccaaa

SEQ ID NO: 4222609 - DNA, 16 bp, Homo sapiens
acagatggaccaaaag

SEQ ID NO: 4222610 - DNA, 14 bp, Homo sapiens
acagcctcacagaa

SEQ ID NO: 4222611 - DNA, 21 bp, Homo sapiens
acagcctgtggcggtgcctgg

SEQ ID NO: 4222612 - DNA, 15 bp, Homo sapiens
acagctgtccctgtc

SEQ ID NO: 4222613 - DNA, 23 bp, Homo sapiens
acaggaaaatcctctggctggct

SEQ ID NO: 4222614 - DNA, 14 bp, Homo sapiens
acaggaccagattt

SEQ ID NO: 4222615 - DNA, 22 bp, Homo sapiens
acaggcccggcgcggtggctca

SEQ ID NO: 4222616 - DNA, 15 bp, Homo sapiens
acagggaaaaaaaga

SEQ ID NO: 4222617 - DNA, 19 bp, Homo sapiens
acagggaaaaaaagaaaaa

SEQ ID NO: 4222618 - DNA, 22 bp, Homo sapiens
acagggctaagagctagcgctg

SEQ ID NO: 4222619 - DNA, 17 bp, Homo sapiens
acagggtagcaggtacc

SEQ ID NO: 4222620 - DNA, 20 bp, Homo sapiens
acaggttggaagagaatcac

SEQ ID NO: 4222621 - DNA, 15 bp, Homo sapiens
acagtggagaaatat

SEQ ID NO: 4222622 - DNA, 16 bp, Homo sapiens
acagtggagaaatatt

SEQ ID NO: 4222623 - DNA, 12 bp, Homo sapiens
acagttcctcgc

SEQ ID NO: 4222624 - DNA, 14 bp, Homo sapiens
acagttcctcgccc

SEQ ID NO: 4222625 - DNA, 15 bp, Homo sapiens
acagttcctcgccct

SEQ ID NO: 4222626 - DNA, 18 bp, Homo sapiens
acataagtccattaactg

SEQ ID NO: 4222627 - DNA, 14 bp, Homo sapiens
acatagtggatgga

SEQ ID NO: 4222628 - DNA, 18 bp, Homo sapiens
acatagtggatggacaga

SEQ ID NO: 4222629 - DNA, 16 bp, Homo sapiens
acatatcatttgtgaa

SEQ ID NO: 4222630 - DNA, 18 bp, Homo sapiens
acatatcatttgtgaaga

SEQ ID NO: 4222631 - DNA, 17 bp, Homo sapiens
acatctccccttcgttt

SEQ ID NO: 4222632 - DNA, 13 bp, Homo sapiens
acatctgaaagcc

SEQ ID NO: 4222633 - DNA, 13 bp, Homo sapiens
acatgaccaaaaa

SEQ ID NO: 4222634 - DNA, 11 bp, Homo sapiens
acatgagaaat

SEQ ID NO: 4222635 - DNA, 14 bp, Homo sapiens
acatggaaaacaga

SEQ ID NO: 4222636 - DNA, 22 bp, Homo sapiens
acatttactttaatttccttga

SEQ ID NO: 4222637 - DNA, 18 bp, Homo sapiens
accaaaataaaaattgaa

SEQ ID NO: 4222638 - DNA, 22 bp, Homo sapiens
accaaaataaaaattgaaaaat

SEQ ID NO: 4222639 - DNA, 22 bp, Homo sapiens
accaacatcccattgccctggt

SEQ ID NO: 4222640 - DNA, 16 bp, Homo sapiens
accaacatggagaaac

SEQ ID NO: 4222641 - DNA, 23 bp, Homo sapiens
accaacatggagaaaccctgtct

SEQ ID NO: 4222642 - DNA, 20 bp, Homo sapiens
accaaccgaacatgaccaaa

SEQ ID NO: 4222643 - DNA, 13 bp, Homo sapiens
accaacctgacca

SEQ ID NO: 4222644 - DNA, 16 bp, Homo sapiens
accacctaggccactc

SEQ ID NO: 4222645 - DNA, 13 bp, Homo sapiens
accaccttcccag

SEQ ID NO: 4222646 - DNA, 16 bp, Homo sapiens
accaccttcccagctc

SEQ ID NO: 4222647 - DNA, 22 bp, Homo sapiens
accacgatgtggccctggcctg

SEQ ID NO: 4222648 - DNA, 16 bp, Homo sapiens
accactagagctgaga

SEQ ID NO: 4222649 - DNA, 19 bp, Homo sapiens
accaggcaacttgggaact

SEQ ID NO: 4222650 - DNA, 20 bp, Homo sapiens
accatatgtctgcttctgtc

SEQ ID NO: 4222651 - DNA, 18 bp, Homo sapiens
accatcttaaatgacagt

SEQ ID NO: 4222652 - DNA, 19 bp, Homo sapiens
accatgtttgagctcagac

SEQ ID NO: 4222653 - DNA, 15 bp, Homo sapiens
acccaacagctcaga

SEQ ID NO: 4222654 - DNA, 16 bp, Homo sapiens
acccaagtgggggcag

SEQ ID NO: 4222655 - DNA, 22 bp, Homo sapiens
acccagagaaaattaattatat

SEQ ID NO: 4222656 - DNA, 17 bp, Homo sapiens
acccagagaggaatcag

SEQ ID NO: 4222657 - DNA, 23 bp, Homo sapiens
acccagcccattctctctcctgt

SEQ ID NO: 4222658 - DNA, 14 bp, Homo sapiens
acccaggaggtgga

SEQ ID NO: 4222659 - DNA, 20 bp, Homo sapiens
acccaggaggtggaggttgc

SEQ ID NO: 4222660 - DNA, 13 bp, Homo sapiens
acccagtccctgg

SEQ ID NO: 4222661 - DNA, 14 bp, Homo sapiens
acccatcagaagga

SEQ ID NO: 4222662 - DNA, 13 bp, Homo sapiens
acccccactctca

SEQ ID NO: 4222663 - DNA, 18 bp, Homo sapiens
acccccactctcattccc

SEQ ID NO: 4222664 - DNA, 21 bp, Homo sapiens
acccccactctcattccccag

SEQ ID NO: 4222665 - DNA, 22 bp, Homo sapiens
acccccactctcattccccagg

SEQ ID NO: 4222666 - DNA, 12 bp, Homo sapiens
accccctcccca

SEQ ID NO: 4222667 - DNA, 12 bp, Homo sapiens
acccctttcctg

SEQ ID NO: 4222668 - DNA, 14 bp, Homo sapiens
accctcaaatgtca

SEQ ID NO: 4222669 - DNA, 19 bp, Homo sapiens
accctcaaatgtcagagct

SEQ ID NO: 4222670 - DNA, 11 bp, Homo sapiens
accctgctccc

SEQ ID NO: 4222671 - DNA, 16 bp, Homo sapiens
acccttctttcctctt

SEQ ID NO: 4222672 - DNA, 21 bp, Homo sapiens
accctttccttccttccctgg

SEQ ID NO: 4222673 - DNA, 23 bp, Homo sapiens
accctttccttccttccctggct

SEQ ID NO: 4222674 - DNA, 17 bp, Homo sapiens
accgaacatgaccaaaa

SEQ ID NO: 4222675 - DNA, 18 bp, Homo sapiens
accgaacatgaccaaaaa

SEQ ID NO: 4222676 - DNA, 23 bp, Homo sapiens
accgaacatgaccaaaaaccaaa

SEQ ID NO: 4222677 - DNA, 17 bp, Homo sapiens
accgagagtagccgaga

SEQ ID NO: 4222678 - DNA, 13 bp, Homo sapiens
accggtacagaaa

SEQ ID NO: 4222679 - DNA, 16 bp, Homo sapiens
acctaacccctttcct

SEQ ID NO: 4222680 - DNA, 18 bp, Homo sapiens
acctaacccctttcctgc

SEQ ID NO: 4222681 - DNA, 16 bp, Homo sapiens
acctagctgttgtaaa

SEQ ID NO: 4222682 - DNA, 21 bp, Homo sapiens
acctagctgttgtaaagaatt

SEQ ID NO: 4222683 - DNA, 16 bp, Homo sapiens
acctcaaaacactttc

SEQ ID NO: 4222684 - DNA, 23 bp, Homo sapiens
acctcagccatgaggagttgctg

SEQ ID NO: 4222685 - DNA, 14 bp, Homo sapiens
acctcccagcccta

SEQ ID NO: 4222686 - DNA, 14 bp, Homo sapiens
acctccccccactg

SEQ ID NO: 4222687 - DNA, 16 bp, Homo sapiens
acctccccccactgca

SEQ ID NO: 4222688 - DNA, 17 bp, Homo sapiens
acctccccccactgcag

SEQ ID NO: 4222689 - DNA, 22 bp, Homo sapiens
acctccccccactgcaggcccc

SEQ ID NO: 4222690 - DNA, 12 bp, Homo sapiens
acctcctgccca

SEQ ID NO: 4222691 - DNA, 15 bp, Homo sapiens
acctcgtcctccccc

SEQ ID NO: 4222692 - DNA, 15 bp, Homo sapiens
acctctgcctcaatg

SEQ ID NO: 4222693 - DNA, 18 bp, Homo sapiens
acctgaaattaatttgtg

SEQ ID NO: 4222694 - DNA, 19 bp, Homo sapiens
acctgaaattaatttgtga

SEQ ID NO: 4222695 - DNA, 17 bp, Homo sapiens
acctgaccaacatggag

SEQ ID NO: 4222696 - DNA, 19 bp, Homo sapiens
acctgaccaacatggagaa

SEQ ID NO: 4222697 - DNA, 19 bp, Homo sapiens
acctgcatccgtagttccc

SEQ ID NO: 4222698 - DNA, 13 bp, Homo sapiens
acctgccgacctc

SEQ ID NO: 4222699 - DNA, 16 bp, Homo sapiens
acctgctgagagaccc

SEQ ID NO: 4222700 - DNA, 23 bp, Homo sapiens
acctggcctgccaccctcctgcg

SEQ ID NO: 4222701 - DNA, 15 bp, Homo sapiens
acctgtcacctggcc

SEQ ID NO: 4222702 - DNA, 13 bp, Homo sapiens
accttcccagctc

SEQ ID NO: 4222703 - DNA, 18 bp, Homo sapiens
acctttgtaagaaaacca

SEQ ID NO: 4222704 - DNA, 23 bp, Homo sapiens
acctttgtaagaaaaccaaaata

SEQ ID NO: 4222705 - DNA, 17 bp, Homo sapiens
acgagtcaatcccctca

SEQ ID NO: 4222706 - DNA, 14 bp, Homo sapiens
acgatgtggccctg

SEQ ID NO: 4222707 - DNA, 19 bp, Homo sapiens
acgatgtggccctggcctg

SEQ ID NO: 4222708 - DNA, 16 bp, Homo sapiens
acgtattggtccagct

SEQ ID NO: 4222709 - DNA, 18 bp, Homo sapiens
acgtgactgccccaactc

SEQ ID NO: 4222710 - DNA, 14 bp, Homo sapiens
acgtgccaggcccg

SEQ ID NO: 4222711 - DNA, 21 bp, Homo sapiens
acgttaaaagcaaaaagatgt

SEQ ID NO: 4222712 - DNA, 23 bp, Homo sapiens
acgttaaaagcaaaaagatgtat

SEQ ID NO: 4222713 - DNA, 22 bp, Homo sapiens
acgtttctcattaaaatccagt

SEQ ID NO: 4222714 - DNA, 23 bp, Homo sapiens
actacaccatgtttgagctcaga

SEQ ID NO: 4222715 - DNA, 15 bp, Homo sapiens
actacctcaaaacac

SEQ ID NO: 4222716 - DNA, 23 bp, Homo sapiens
actagctagaagtgggccaggac

SEQ ID NO: 4222717 - DNA, 13 bp, Homo sapiens
actatgttgataa

SEQ ID NO: 4222718 - DNA, 17 bp, Homo sapiens
actcaatctaaattaaa

SEQ ID NO: 4222719 - DNA, 14 bp, Homo sapiens
actcacctctgcct

SEQ ID NO: 4222720 - DNA, 23 bp, Homo sapiens
actcacgataaataatcggccca

SEQ ID NO: 4222721 - DNA, 14 bp, Homo sapiens
actcagcagccctc

SEQ ID NO: 4222722 - DNA, 19 bp, Homo sapiens
actcagcagccctcctcac

SEQ ID NO: 4222723 - DNA, 23 bp, Homo sapiens
actcagcagccctcctcaccccg

SEQ ID NO: 4222724 - DNA, 12 bp, Homo sapiens
actcagccctgg

SEQ ID NO: 4222725 - DNA, 16 bp, Homo sapiens
actcagccctgggccc

SEQ ID NO: 4222726 - DNA, 14 bp, Homo sapiens
actcaggaggctga

SEQ ID NO: 4222727 - DNA, 17 bp, Homo sapiens
actccaaggtttataaa

SEQ ID NO: 4222728 - DNA, 19 bp, Homo sapiens
actccaaggtttataaagc

SEQ ID NO: 4222729 - DNA, 23 bp, Homo sapiens
actccaaggtttataaagcagat

SEQ ID NO: 4222730 - DNA, 14 bp, Homo sapiens
actccacataagtc

SEQ ID NO: 4222731 - DNA, 14 bp, Homo sapiens
actccaccacccaa

SEQ ID NO: 4222732 - DNA, 17 bp, Homo sapiens
actccatcattcatcca

SEQ ID NO: 4222733 - DNA, 15 bp, Homo sapiens
actcccaagctggac

SEQ ID NO: 4222734 - DNA, 14 bp, Homo sapiens
actccctttaaaga

SEQ ID NO: 4222735 - DNA, 17 bp, Homo sapiens
actccctttaaagagag

SEQ ID NO: 4222736 - DNA, 14 bp, Homo sapiens
actcctttcctctg

SEQ ID NO: 4222737 - DNA, 15 bp, Homo sapiens
actcctttcctctga

SEQ ID NO: 4222738 - DNA, 15 bp, Homo sapiens
actctggattttgaa

SEQ ID NO: 4222739 - DNA, 15 bp, Homo sapiens
actgaaaaatgtcag

SEQ ID NO: 4222740 - DNA, 17 bp, Homo sapiens
actgaaaaatgtcagtc

SEQ ID NO: 4222741 - DNA, 18 bp, Homo sapiens
actgaaaaatgtcagtct

SEQ ID NO: 4222742 - DNA, 21 bp, Homo sapiens
actgaaagctgaatccttcca

SEQ ID NO: 4222743 - DNA, 21 bp, Homo sapiens
actgaaccccctcaaaagcca

SEQ ID NO: 4222744 - DNA, 23 bp, Homo sapiens
actgaaccccctcaaaagccaaa

SEQ ID NO: 4222745 - DNA, 17 bp, Homo sapiens
actgagatgcaaatgtc

SEQ ID NO: 4222746 - DNA, 17 bp, Homo sapiens
actgagatgttttacca

SEQ ID NO: 4222747 - DNA, 14 bp, Homo sapiens
actgagccatcatt

SEQ ID NO: 4222748 - DNA, 16 bp, Homo sapiens
actgagccatcatttc

SEQ ID NO: 4222749 - DNA, 16 bp, Homo sapiens
actgatgggacatcaa

SEQ ID NO: 4222750 - DNA, 17 bp, Homo sapiens
actgatgggacatcaaa

SEQ ID NO: 4222751 - DNA, 12 bp, Homo sapiens
actgcaggcccc

SEQ ID NO: 4222752 - DNA, 23 bp, Homo sapiens
actgcaggccccgcttgtccagc

SEQ ID NO: 4222753 - DNA, 21 bp, Homo sapiens
actgccccaactcctggaagc

SEQ ID NO: 4222754 - DNA, 19 bp, Homo sapiens
actggagcaccaggcacga

SEQ ID NO: 4222755 - DNA, 20 bp, Homo sapiens
actgtaaagagaagtaattt

SEQ ID NO: 4222756 - DNA, 21 bp, Homo sapiens
actgtgatggggtgggcaggg

SEQ ID NO: 4222757 - DNA, 22 bp, Homo sapiens
acttagtttttatctttgacca

SEQ ID NO: 4222758 - DNA, 23 bp, Homo sapiens
acttagtttttatctttgaccaa

SEQ ID NO: 4222759 - DNA, 16 bp, Homo sapiens
acttcccaaagcacaa

SEQ ID NO: 4222760 - DNA, 14 bp, Homo sapiens
acttgtaagttgct

SEQ ID NO: 4222761 - DNA, 11 bp, Homo sapiens
actttcccccc

SEQ ID NO: 4222762 - DNA, 20 bp, Homo sapiens
actttctctttgccatttct

SEQ ID NO: 4222763 - DNA, 23 bp, Homo sapiens
actttctctttgccatttcttct

SEQ ID NO: 4222764 - DNA, 21 bp, Homo sapiens
agaaaaaaagtttgccagaag

SEQ ID NO: 4222765 - DNA, 14 bp, Homo sapiens
agaaaaaaatatat

SEQ ID NO: 4222766 - DNA, 19 bp, Homo sapiens
agaaaaagacctgcatttg

SEQ ID NO: 4222767 - DNA, 11 bp, Homo sapiens
agaaaaaggaa

SEQ ID NO: 4222768 - DNA, 14 bp, Homo sapiens
agaaaaaggaaaag

SEQ ID NO: 4222769 - DNA, 15 bp, Homo sapiens
agaaaatgaatttgg

SEQ ID NO: 4222770 - DNA, 13 bp, Homo sapiens
agaaaccctgtct

SEQ ID NO: 4222771 - DNA, 22 bp, Homo sapiens
agaaagaccatgcatttaaagt

SEQ ID NO: 4222772 - DNA, 13 bp, Homo sapiens
agaaagatccacc

SEQ ID NO: 4222773 - DNA, 15 bp, Homo sapiens
agaaaggcctctgtg

SEQ ID NO: 4222774 - DNA, 17 bp, Homo sapiens
agaaagttattcttggt

SEQ ID NO: 4222775 - DNA, 18 bp, Homo sapiens
agaaatttagagtcaatt

SEQ ID NO: 4222776 - DNA, 17 bp, Homo sapiens
agaaatttgaaaaaact

SEQ ID NO: 4222777 - DNA, 18 bp, Homo sapiens
agaaatttgaaaaaactt

SEQ ID NO: 4222778 - DNA, 17 bp, Homo sapiens
agaaccaggcaacttgg

SEQ ID NO: 4222779 - DNA, 22 bp, Homo sapiens
agaacgtattggtccagcttgc

SEQ ID NO: 4222780 - DNA, 23 bp, Homo sapiens
agaactttgtacagtggagaaat

SEQ ID NO: 4222781 - DNA, 22 bp, Homo sapiens
agaaggaaggagactcacctct

SEQ ID NO: 4222782 - DNA, 18 bp, Homo sapiens
agaaggtatttttccaat

SEQ ID NO: 4222783 - DNA, 19 bp, Homo sapiens
agaagtggaccaggacagg

SEQ ID NO: 4222784 - DNA, 17 bp, Homo sapiens
agaagtgggccaggaca

SEQ ID NO: 4222785 - DNA, 18 bp, Homo sapiens
agaagtgggccaggacag

SEQ ID NO: 4222786 - DNA, 23 bp, Homo sapiens
agaagtgggccaggacaggcccg

SEQ ID NO: 4222787 - DNA, 17 bp, Homo sapiens
agaatgtatctcctcct

SEQ ID NO: 4222788 - DNA, 19 bp, Homo sapiens
agaattattcagtgaattt

SEQ ID NO: 4222789 - DNA, 19 bp, Homo sapiens
agaattgaacccaggaggt

SEQ ID NO: 4222790 - DNA, 22 bp, Homo sapiens
agaattgaacccaggaggtgga

SEQ ID NO: 4222791 - DNA, 21 bp, Homo sapiens
agacaatactccctttaaaga

SEQ ID NO: 4222792 - DNA, 18 bp, Homo sapiens
agacacatcaaatgcccc

SEQ ID NO: 4222793 - DNA, 16 bp, Homo sapiens
agacacctgcacctcc

SEQ ID NO: 4222794 - DNA, 15 bp, Homo sapiens
agacagaatgtcacc

SEQ ID NO: 4222795 - DNA, 19 bp, Homo sapiens
agacaggaaaatcctctgg

SEQ ID NO: 4222796 - DNA, 14 bp, Homo sapiens
agaccaacctgacc

SEQ ID NO: 4222797 - DNA, 13 bp, Homo sapiens
agacccccactct

SEQ ID NO: 4222798 - DNA, 16 bp, Homo sapiens
agaccctaccccacca

SEQ ID NO: 4222799 - DNA, 18 bp, Homo sapiens
agaccctaccccaccacg

SEQ ID NO: 4222800 - DNA, 16 bp, Homo sapiens
agacctgcatttggca

SEQ ID NO: 4222801 - DNA, 12 bp, Homo sapiens
agactcacctct

SEQ ID NO: 4222802 - DNA, 14 bp, Homo sapiens
agactcacctctgc

SEQ ID NO: 4222803 - DNA, 17 bp, Homo sapiens
agactcacctctgcctc

SEQ ID NO: 4222804 - DNA, 15 bp, Homo sapiens
agactcagactccat

SEQ ID NO: 4222805 - DNA, 16 bp, Homo sapiens
agactcccaagctgga

SEQ ID NO: 4222806 - DNA, 22 bp, Homo sapiens
agactgaattttaaatgttcac

SEQ ID NO: 4222807 - DNA, 16 bp, Homo sapiens
agactgggctagggag

SEQ ID NO: 4222808 - DNA, 19 bp, Homo sapiens
agactttttttaaatagta

SEQ ID NO: 4222809 - DNA, 13 bp, Homo sapiens
agagaaggcagga

SEQ ID NO: 4222810 - DNA, 18 bp, Homo sapiens
agagacacctgcacctcc

SEQ ID NO: 4222811 - DNA, 19 bp, Homo sapiens
agagacacctgcacctccc

SEQ ID NO: 4222812 - DNA, 21 bp, Homo sapiens
agagacacctgcacctccccc

SEQ ID NO: 4222813 - DNA, 12 bp, Homo sapiens
agagacccaagg

SEQ ID NO: 4222814 - DNA, 16 bp, Homo sapiens
agagacccaaggagga

SEQ ID NO: 4222815 - DNA, 21 bp, Homo sapiens
agagacccaaggaggaaaaac

SEQ ID NO: 4222816 - DNA, 17 bp, Homo sapiens
agagatatggcagcgaa

SEQ ID NO: 4222817 - DNA, 21 bp, Homo sapiens
agagatgcctccaccgctgcc

SEQ ID NO: 4222818 - DNA, 21 bp, Homo sapiens
agagattagtaaatatgtgaa

SEQ ID NO: 4222819 - DNA, 13 bp, Homo sapiens
agagccagccctc

SEQ ID NO: 4222820 - DNA, 16 bp, Homo sapiens
agagccagccctccct

SEQ ID NO: 4222821 - DNA, 20 bp, Homo sapiens
agagccagccctccctgtcc

SEQ ID NO: 4222822 - DNA, 19 bp, Homo sapiens
agagccttggtgtccacct

SEQ ID NO: 4222823 - DNA, 20 bp, Homo sapiens
agagccttggtgtccacctg

SEQ ID NO: 4222824 - DNA, 23 bp, Homo sapiens
agagcgtgtgcggctccagccca

SEQ ID NO: 4222825 - DNA, 21 bp, Homo sapiens
agagctgagagtctgaaagac

SEQ ID NO: 4222826 - DNA, 19 bp, Homo sapiens
agaggaaaaacagggaaaa

SEQ ID NO: 4222827 - DNA, 17 bp, Homo sapiens
agaggctggaggcaggg

SEQ ID NO: 4222828 - DNA, 20 bp, Homo sapiens
agaggctggaggcagggcct

SEQ ID NO: 4222829 - DNA, 22 bp, Homo sapiens
agagggtctggagaagcagtga

SEQ ID NO: 4222830 - DNA, 13 bp, Homo sapiens
agagtagccgaga

SEQ ID NO: 4222831 - DNA, 22 bp, Homo sapiens
agagtagccgagagcctgctcc

SEQ ID NO: 4222832 - DNA, 11 bp, Homo sapiens
agagtatttct

SEQ ID NO: 4222833 - DNA, 13 bp, Homo sapiens
agagtatttctgg

SEQ ID NO: 4222834 - DNA, 19 bp, Homo sapiens
agagtgtgaaatagacatt

SEQ ID NO: 4222835 - DNA, 16 bp, Homo sapiens
agagtgtgcagactga

SEQ ID NO: 4222836 - DNA, 17 bp, Homo sapiens
agagtgtgcagactgat

SEQ ID NO: 4222837 - DNA, 23 bp, Homo sapiens
agataagcttttggtaatattca

SEQ ID NO: 4222838 - DNA, 14 bp, Homo sapiens
agataataaattga

SEQ ID NO: 4222839 - DNA, 21 bp, Homo sapiens
agataataaattgatttgtta

SEQ ID NO: 4222840 - DNA, 21 bp, Homo sapiens
agatccaccctcaaatgtcag

SEQ ID NO: 4222841 - DNA, 22 bp, Homo sapiens
agatcgtgccgttactctccaa

SEQ ID NO: 4222842 - DNA, 16 bp, Homo sapiens
agatgcaaatgtcaca

SEQ ID NO: 4222843 - DNA, 15 bp, Homo sapiens
agatgcctccaccgc

SEQ ID NO: 4222844 - DNA, 12 bp, Homo sapiens
agatggaccaaa

SEQ ID NO: 4222845 - DNA, 15 bp, Homo sapiens
agatggaccaaaaga

SEQ ID NO: 4222846 - DNA, 15 bp, Homo sapiens
agatgtttaaataaa

SEQ ID NO: 4222847 - DNA, 19 bp, Homo sapiens
agattacctcttgcccttg

SEQ ID NO: 4222848 - DNA, 23 bp, Homo sapiens
agattagtaaatatgtgaagaaa

SEQ ID NO: 4222849 - DNA, 12 bp, Homo sapiens
agattcccagag

SEQ ID NO: 4222850 - DNA, 18 bp, Homo sapiens
agatttagtgaaagctag

SEQ ID NO: 4222851 - DNA, 14 bp, Homo sapiens
agcaaaaagatgta

SEQ ID NO: 4222852 - DNA, 17 bp, Homo sapiens
agcaaaaagatgtatat

SEQ ID NO: 4222853 - DNA, 14 bp, Homo sapiens
agcaccaggcacga

SEQ ID NO: 4222854 - DNA, 19 bp, Homo sapiens
agcacctgccgacctcgtc

SEQ ID NO: 4222855 - DNA, 20 bp, Homo sapiens
agcacctgccgacctcgtcc

SEQ ID NO: 4222856 - DNA, 21 bp, Homo sapiens
agcacctgccgacctcgtcct

SEQ ID NO: 4222857 - DNA, 12 bp, Homo sapiens
agcagccctcct

SEQ ID NO: 4222858 - DNA, 14 bp, Homo sapiens
agcagccctcctca

SEQ ID NO: 4222859 - DNA, 17 bp, Homo sapiens
agcagccctcctcaccc

SEQ ID NO: 4222860 - DNA, 14 bp, Homo sapiens
agcaggtaccactg

SEQ ID NO: 4222861 - DNA, 22 bp, Homo sapiens
agcagtaaaagataaatttgtt

SEQ ID NO: 4222862 - DNA, 22 bp, Homo sapiens
agcagtgagccgcatcttctcc

SEQ ID NO: 4222863 - DNA, 15 bp, Homo sapiens
agcatgtaggagaat

SEQ ID NO: 4222864 - DNA, 17 bp, Homo sapiens
agcatttgttctttgcc

SEQ ID NO: 4222865 - DNA, 21 bp, Homo sapiens
agccacgttccttactgcaga

SEQ ID NO: 4222866 - DNA, 23 bp, Homo sapiens
agccacgttccttactgcagaat

SEQ ID NO: 4222867 - DNA, 18 bp, Homo sapiens
agccagcccagcccagct

SEQ ID NO: 4222868 - DNA, 13 bp, Homo sapiens
agccagccctccc

SEQ ID NO: 4222869 - DNA, 20 bp, Homo sapiens
agccagccctccctgtcctc

SEQ ID NO: 4222870 - DNA, 22 bp, Homo sapiens
agccatttatacctttgaaata

SEQ ID NO: 4222871 - DNA, 16 bp, Homo sapiens
agcccagcccagctgg

SEQ ID NO: 4222872 - DNA, 12 bp, Homo sapiens
agccctatggat

SEQ ID NO: 4222873 - DNA, 14 bp, Homo sapiens
agccctccctgtcc

SEQ ID NO: 4222874 - DNA, 17 bp, Homo sapiens
agccctccctgtcctcc

SEQ ID NO: 4222875 - DNA, 21 bp, Homo sapiens
agccctccctgtcctcctcgg

SEQ ID NO: 4222876 - DNA, 23 bp, Homo sapiens
agccctgggccccaccacctagg

SEQ ID NO: 4222877 - DNA, 15 bp, Homo sapiens
agccgagagcctgct

SEQ ID NO: 4222878 - DNA, 17 bp, Homo sapiens
agccgagagcctgctcc

SEQ ID NO: 4222879 - DNA, 18 bp, Homo sapiens
agccgagagcctgctccc

SEQ ID NO: 4222880 - DNA, 16 bp, Homo sapiens
agccgcatcttctcca

SEQ ID NO: 4222881 - DNA, 17 bp, Homo sapiens
agcctgctcccccaccc

SEQ ID NO: 4222882 - DNA, 19 bp, Homo sapiens
agcctgctcccccaccccc

SEQ ID NO: 4222883 - DNA, 15 bp, Homo sapiens
agcctgtaatcccag

SEQ ID NO: 4222884 - DNA, 20 bp, Homo sapiens
agcctgtggcggtgcctggg

SEQ ID NO: 4222885 - DNA, 22 bp, Homo sapiens
agcctgtggcggtgcctgggtg

SEQ ID NO: 4222886 - DNA, 16 bp, Homo sapiens
agccttggtgtccacc

SEQ ID NO: 4222887 - DNA, 17 bp, Homo sapiens
agccttggtgtccacct

SEQ ID NO: 4222888 - DNA, 23 bp, Homo sapiens
agcgaggtcaacagagaaggcag

SEQ ID NO: 4222889 - DNA, 18 bp, Homo sapiens
agcgcacccagagaaaat

SEQ ID NO: 4222890 - DNA, 19 bp, Homo sapiens
agcgctgccgcaccccaga

SEQ ID NO: 4222891 - DNA, 21 bp, Homo sapiens
agcggctgagtcatgatctcc

SEQ ID NO: 4222892 - DNA, 18 bp, Homo sapiens
agctactcaggaggctga

SEQ ID NO: 4222893 - DNA, 24 bp, Homo sapiens
agctagaagtgggccaggacaggc

SEQ ID NO: 4222894 - DNA, 16 bp, Homo sapiens
agctagcgctgccgca

SEQ ID NO: 4222895 - DNA, 21 bp, Homo sapiens
agctagcgctgccgcacccca

SEQ ID NO: 4222896 - DNA, 15 bp, Homo sapiens
agctcagacccccac

SEQ ID NO: 4222897 - DNA, 16 bp, Homo sapiens
agctcagacccccact

SEQ ID NO: 4222898 - DNA, 23 bp, Homo sapiens
agctcccaccccacccccttcag

SEQ ID NO: 4222899 - DNA, 14 bp, Homo sapiens
agctcctctgctcc

SEQ ID NO: 4222900 - DNA, 21 bp, Homo sapiens
agctcctctgtcctgcttctg

SEQ ID NO: 4222901 - DNA, 22 bp, Homo sapiens
agctctattaagatttccaagt

SEQ ID NO: 4222902 - DNA, 13 bp, Homo sapiens
agctctccctctg

SEQ ID NO: 4222903 - DNA, 19 bp, Homo sapiens
agctctccctctggccctg

SEQ ID NO: 4222904 - DNA, 23 bp, Homo sapiens
agctctccctctggccctgcctt

SEQ ID NO: 4222905 - DNA, 15 bp, Homo sapiens
agctgggaggaaaag

SEQ ID NO: 4222906 - DNA, 14 bp, Homo sapiens
agctgggttggaaa

SEQ ID NO: 4222907 - DNA, 14 bp, Homo sapiens
agctgtccctgtca

SEQ ID NO: 4222908 - DNA, 20 bp, Homo sapiens
agctgtccctgtcaccaagc

SEQ ID NO: 4222909 - DNA, 20 bp, Homo sapiens
agctgtggtacaaatgtgat

SEQ ID NO: 4222910 - DNA, 15 bp, Homo sapiens
agctgtgtccttgca

SEQ ID NO: 4222911 - DNA, 21 bp, Homo sapiens
agctgtgtccttgcacctgca

SEQ ID NO: 4222912 - DNA, 14 bp, Homo sapiens
agctgttgtaaaga

SEQ ID NO: 4222913 - DNA, 16 bp, Homo sapiens
agctgttgtaaagaat

SEQ ID NO: 4222914 - DNA, 14 bp, Homo sapiens
agcttgctcttcag

SEQ ID NO: 4222915 - DNA, 14 bp, Homo sapiens
agctttgtttcttg

SEQ ID NO: 4222916 - DNA, 16 bp, Homo sapiens
aggaaaaacagggaaa

SEQ ID NO: 4222917 - DNA, 23 bp, Homo sapiens
aggaaccacaccaatgcaacatt

SEQ ID NO: 4222918 - DNA, 23 bp, Homo sapiens
aggacagcctgtggcggtgcctg

SEQ ID NO: 4222919 - DNA, 12 bp, Homo sapiens
aggagaaatgca

SEQ ID NO: 4222920 - DNA, 16 bp, Homo sapiens
aggagaaatgcatcca

SEQ ID NO: 4222921 - DNA, 16 bp, Homo sapiens
aggagaaggaaggaga

SEQ ID NO: 4222922 - DNA, 18 bp, Homo sapiens
aggagactcacctctgcc

SEQ ID NO: 4222923 - DNA, 21 bp, Homo sapiens
aggagactcacctctgcctca

SEQ ID NO: 4222924 - DNA, 15 bp, Homo sapiens
aggagagccagccct

SEQ ID NO: 4222925 - DNA, 16 bp, Homo sapiens
aggagagccagccctc

SEQ ID NO: 4222926 - DNA, 17 bp, Homo sapiens
aggaggctgaggcagaa

SEQ ID NO: 4222927 - DNA, 21 bp, Homo sapiens
aggatgtaaacagtgcctgct

SEQ ID NO: 4222928 - DNA, 18 bp, Homo sapiens
aggcacgaacccacctgc

SEQ ID NO: 4222929 - DNA, 19 bp, Homo sapiens
aggcacgaacccacctgct

SEQ ID NO: 4222930 - DNA, 23 bp, Homo sapiens
aggcagaagaattgaacccagga

SEQ ID NO: 4222931 - DNA, 23 bp, Homo sapiens
aggcagggccttgcccagagatg

SEQ ID NO: 4222932 - DNA, 18 bp, Homo sapiens
aggccccgcttgtccagc

SEQ ID NO: 4222933 - DNA, 13 bp, Homo sapiens
aggcccggggctg

SEQ ID NO: 4222934 - DNA, 15 bp, Homo sapiens
aggcccggggctggc

SEQ ID NO: 4222935 - DNA, 14 bp, Homo sapiens
aggctccctcctgt

SEQ ID NO: 4222936 - DNA, 15 bp, Homo sapiens
aggctgaggcagaag

SEQ ID NO: 4222937 - DNA, 17 bp, Homo sapiens
aggctgaggcagaagaa

SEQ ID NO: 4222938 - DNA, 13 bp, Homo sapiens
aggctggaggcag

SEQ ID NO: 4222939 - DNA, 18 bp, Homo sapiens
aggctggaggcagggcct

SEQ ID NO: 4222940 - DNA, 23 bp, Homo sapiens
aggcttcttcagatcagtgcttg

SEQ ID NO: 4222941 - DNA, 15 bp, Homo sapiens
agggaacagacagga

SEQ ID NO: 4222942 - DNA, 21 bp, Homo sapiens
agggaacagacaggagaaatg

SEQ ID NO: 4222943 - DNA, 10 bp, Homo sapiens
agggacagag

SEQ ID NO: 4222944 - DNA, 19 bp, Homo sapiens
agggacagagacacctgca

SEQ ID NO: 4222945 - DNA, 16 bp, Homo sapiens
agggagagcggggcag

SEQ ID NO: 4222946 - DNA, 15 bp, Homo sapiens
agggcagaggctgga

SEQ ID NO: 4222947 - DNA, 17 bp, Homo sapiens
agggccttgcccagaga

SEQ ID NO: 4222948 - DNA, 19 bp, Homo sapiens
agggccttgcccagagatg

SEQ ID NO: 4222949 - DNA, 23 bp, Homo sapiens
agggccttgcccagagatgcctc

SEQ ID NO: 4222950 - DNA, 21 bp, Homo sapiens
agggctaagagctagcgctgc

SEQ ID NO: 4222951 - DNA, 22 bp, Homo sapiens
agggctaagagctagcgctgcc

SEQ ID NO: 4222952 - DNA, 13 bp, Homo sapiens
agggctggggcca

SEQ ID NO: 4222953 - DNA, 17 bp, Homo sapiens
agggctggggccaagag

SEQ ID NO: 4222954 - DNA, 21 bp, Homo sapiens
agggctggggccaagaggaaa

SEQ ID NO: 4222955 - DNA, 17 bp, Homo sapiens
aggggagagggtctgga

SEQ ID NO: 4222956 - DNA, 19 bp, Homo sapiens
aggggttggttgaggtgga

SEQ ID NO: 4222957 - DNA, 20 bp, Homo sapiens
aggggttggttgaggtggaa

SEQ ID NO: 4222958 - DNA, 14 bp, Homo sapiens
agggtctggagaag

SEQ ID NO: 4222959 - DNA, 18 bp, Homo sapiens
agggtgggatggaggaga

SEQ ID NO: 4222960 - DNA, 13 bp, Homo sapiens
aggtatttttcca

SEQ ID NO: 4222961 - DNA, 21 bp, Homo sapiens
aggtatttttccaatcacagt

SEQ ID NO: 4222962 - DNA, 21 bp, Homo sapiens
aggtcaacagagaaggcagga

SEQ ID NO: 4222963 - DNA, 13 bp, Homo sapiens
aggtccctgctcg

SEQ ID NO: 4222964 - DNA, 21 bp, Homo sapiens
aggtgcctgtgaggcaggggc

SEQ ID NO: 4222965 - DNA, 22 bp, Homo sapiens
aggtgcctgtgaggcaggggcg

SEQ ID NO: 4222966 - DNA, 15 bp, Homo sapiens
aggtggaagccctcc

SEQ ID NO: 4222967 - DNA, 17 bp, Homo sapiens
aggtggaagccctcctt

SEQ ID NO: 4222968 - DNA, 21 bp, Homo sapiens
aggtggctgacccagtccctg

SEQ ID NO: 4222969 - DNA, 22 bp, Homo sapiens
aggtggctgacccagtccctgg

SEQ ID NO: 4222970 - DNA, 22 bp, Homo sapiens
aggtggggtctttgtgagagtg

SEQ ID NO: 4222971 - DNA, 21 bp, Homo sapiens
aggtgggttttcttcccatca

SEQ ID NO: 4222972 - DNA, 22 bp, Homo sapiens
aggtgggttttcttcccatcac

SEQ ID NO: 4222973 - DNA, 23 bp, Homo sapiens
aggtgggttttcttcccatcact

SEQ ID NO: 4222974 - DNA, 15 bp, Homo sapiens
agtaaaaataaaatt

SEQ ID NO: 4222975 - DNA, 16 bp, Homo sapiens
agtaaatatgtgaaga

SEQ ID NO: 4222976 - DNA, 17 bp, Homo sapiens
agtaaatatgtgaagaa

SEQ ID NO: 4222977 - DNA, 20 bp, Homo sapiens
agtaacgtacatttgtgctg

SEQ ID NO: 4222978 - DNA, 16 bp, Homo sapiens
agtagccgagagcctg

SEQ ID NO: 4222979 - DNA, 16 bp, Homo sapiens
agtaggggttgaagaa

SEQ ID NO: 4222980 - DNA, 17 bp, Homo sapiens
agtaggggttgaagaaa

SEQ ID NO: 4222981 - DNA, 15 bp, Homo sapiens
agtataagatttttg

SEQ ID NO: 4222982 - DNA, 21 bp, Homo sapiens
agtcaaaaggtgcctgtgagg

SEQ ID NO: 4222983 - DNA, 18 bp, Homo sapiens
agtcaatcccctcattca

SEQ ID NO: 4222984 - DNA, 21 bp, Homo sapiens
agtcaattctgatgttactga

SEQ ID NO: 4222985 - DNA, 23 bp, Homo sapiens
agtcacaccatcttaaatgacag

SEQ ID NO: 4222986 - DNA, 22 bp, Homo sapiens
agtcacagagataattctagct

SEQ ID NO: 4222987 - DNA, 22 bp, Homo sapiens
agtcagtgggaacgtgactgcc

SEQ ID NO: 4222988 - DNA, 22 bp, Homo sapiens
agtccattaactgctttccacc

SEQ ID NO: 4222989 - DNA, 23 bp, Homo sapiens
agtccctcccatctctaccccaa

SEQ ID NO: 4222990 - DNA, 14 bp, Homo sapiens
agtccctgggggaa

SEQ ID NO: 4222991 - DNA, 20 bp, Homo sapiens
agtctaggaatggagtctcc

SEQ ID NO: 4222992 - DNA, 16 bp, Homo sapiens
agtctaggagctggga

SEQ ID NO: 4222993 - DNA, 18 bp, Homo sapiens
agtctcatctatgtcata

SEQ ID NO: 4222994 - DNA, 15 bp, Homo sapiens
agtctggatctggga

SEQ ID NO: 4222995 - DNA, 16 bp, Homo sapiens
agtgaaagctagagat

SEQ ID NO: 4222996 - DNA, 15 bp, Homo sapiens
agtgaatttgtccat

SEQ ID NO: 4222997 - DNA, 20 bp, Homo sapiens
agtgagccgcatcttctcca

SEQ ID NO: 4222998 - DNA, 24 bp, Homo sapiens
agtgagccgcatcttctccatctg

SEQ ID NO: 4222999 - DNA, 23 bp, Homo sapiens
agtgatacaacttcaagtgcatg

SEQ ID NO: 4223000 - DNA, 16 bp, Homo sapiens
agtgcatgctctctgc

SEQ ID NO: 4223001 - DNA, 12 bp, Homo sapiens
agtgcctgctga

SEQ ID NO: 4223002 - DNA, 18 bp, Homo sapiens
agtgccttacctcctgcc

SEQ ID NO: 4223003 - DNA, 20 bp, Homo sapiens
agtgccttacctcctgccca

SEQ ID NO: 4223004 - DNA, 15 bp, Homo sapiens
agtggaccaggacag

SEQ ID NO: 4223005 - DNA, 18 bp, Homo sapiens
agtggagaaatatttata

SEQ ID NO: 4223006 - DNA, 13 bp, Homo sapiens
agtggatggacag

SEQ ID NO: 4223007 - DNA, 15 bp, Homo sapiens
agtggatggacagat

SEQ ID NO: 4223008 - DNA, 18 bp, Homo sapiens
agtggatggacagatgga

SEQ ID NO: 4223009 - DNA, 23 bp, Homo sapiens
agtggatggacagatggaccaaa

SEQ ID NO: 4223010 - DNA, 15 bp, Homo sapiens
agtggcccccaccct

SEQ ID NO: 4223011 - DNA, 11 bp, Homo sapiens
agtggctgctg

SEQ ID NO: 4223012 - DNA, 19 bp, Homo sapiens
agtgggccaggacaggccc

SEQ ID NO: 4223013 - DNA, 19 bp, Homo sapiens
agtggggtctccctctcct

SEQ ID NO: 4223014 - DNA, 18 bp, Homo sapiens
agttaccattatttaatt

SEQ ID NO: 4223015 - DNA, 23 bp, Homo sapiens
agttactatcatgtcaaacgtga

SEQ ID NO: 4223016 - DNA, 14 bp, Homo sapiens
agttactcagccct

SEQ ID NO: 4223017 - DNA, 16 bp, Homo sapiens
agttactcagccctgg

SEQ ID NO: 4223018 - DNA, 19 bp, Homo sapiens
agttactcagccctgggcc

SEQ ID NO: 4223019 - DNA, 19 bp, Homo sapiens
agttattttaattatcttt

SEQ ID NO: 4223020 - DNA, 12 bp, Homo sapiens
agttcctcgccc

SEQ ID NO: 4223021 - DNA, 14 bp, Homo sapiens
agttctgctcctct

SEQ ID NO: 4223022 - DNA, 15 bp, Homo sapiens
agttctgctcctctc

SEQ ID NO: 4223023 - DNA, 19 bp, Homo sapiens
agttctgctcctctccagg

SEQ ID NO: 4223024 - DNA, 20 bp, Homo sapiens
agttctgctcctctccaggc

SEQ ID NO: 4223025 - DNA, 21 bp, Homo sapiens
agttctgctcctctccaggca

SEQ ID NO: 4223026 - DNA, 13 bp, Homo sapiens
agtttaaaaccca

SEQ ID NO: 4223027 - DNA, 14 bp, Homo sapiens
agtttaaaacccaa

SEQ ID NO: 4223028 - DNA, 14 bp, Homo sapiens
agtttgcagaaaag

SEQ ID NO: 4223029 - DNA, 13 bp, Homo sapiens
agttttaaatatg

SEQ ID NO: 4223030 - DNA, 16 bp, Homo sapiens
agttttaaatatgaac

SEQ ID NO: 4223031 - DNA, 11 bp, Homo sapiens
ataaaaaccat

SEQ ID NO: 4223032 - DNA, 13 bp, Homo sapiens
ataaacatttgca

SEQ ID NO: 4223033 - DNA, 16 bp, Homo sapiens
ataaactgaaaaatgt

SEQ ID NO: 4223034 - DNA, 15 bp, Homo sapiens
ataaagcaaattact

SEQ ID NO: 4223035 - DNA, 14 bp, Homo sapiens
ataaagctcctctg

SEQ ID NO: 4223036 - DNA, 20 bp, Homo sapiens
ataaatcaattcatgtttaa

SEQ ID NO: 4223037 - DNA, 21 bp, Homo sapiens
ataaattgtgaaaaaaatgaa

SEQ ID NO: 4223038 - DNA, 11 bp, Homo sapiens
ataacttgatg

SEQ ID NO: 4223039 - DNA, 13 bp, Homo sapiens
ataagctaagcct

SEQ ID NO: 4223040 - DNA, 18 bp, Homo sapiens
ataagtccattaactgct

SEQ ID NO: 4223041 - DNA, 19 bp, Homo sapiens
ataagtccattaactgctt

SEQ ID NO: 4223042 - DNA, 14 bp, Homo sapiens
ataagtctaaataa

SEQ ID NO: 4223043 - DNA, 18 bp, Homo sapiens
ataataaattgatttgtt

SEQ ID NO: 4223044 - DNA, 21 bp, Homo sapiens
ataattcttagtggaagacaa

SEQ ID NO: 4223045 - DNA, 17 bp, Homo sapiens
atacagagtacgttaaa

SEQ ID NO: 4223046 - DNA, 19 bp, Homo sapiens
ataccatatgtctgcttct

SEQ ID NO: 4223047 - DNA, 16 bp, Homo sapiens
atactccctttaaaga

SEQ ID NO: 4223048 - DNA, 18 bp, Homo sapiens
atagacacatcaaatgcc

SEQ ID NO: 4223049 - DNA, 20 bp, Homo sapiens
atagccactattaacatttc

SEQ ID NO: 4223050 - DNA, 19 bp, Homo sapiens
atagtaggggttgaagaaa

SEQ ID NO: 4223051 - DNA, 17 bp, Homo sapiens
atagttttaaatatgaa

SEQ ID NO: 4223052 - DNA, 21 bp, Homo sapiens
atagttttaaatatgaacaaa

SEQ ID NO: 4223053 - DNA, 14 bp, Homo sapiens
atatattgctaaaa

SEQ ID NO: 4223054 - DNA, 13 bp, Homo sapiens
atatattttatga

SEQ ID NO: 4223055 - DNA, 14 bp, Homo sapiens
atatattttatgat

SEQ ID NO: 4223056 - DNA, 18 bp, Homo sapiens
atatattttatgatttaa

SEQ ID NO: 4223057 - DNA, 18 bp, Homo sapiens
atatcatttgtgaagaat

SEQ ID NO: 4223058 - DNA, 11 bp, Homo sapiens
atatgaacaaa

SEQ ID NO: 4223059 - DNA, 15 bp, Homo sapiens
atatgtctgcttctg

SEQ ID NO: 4223060 - DNA, 19 bp, Homo sapiens
atatgtttcaccctgtccc

SEQ ID NO: 4223061 - DNA, 21 bp, Homo sapiens
atattggtaattaaaagactc

SEQ ID NO: 4223062 - DNA, 22 bp, Homo sapiens
atattgtcagagttctgctcta

SEQ ID NO: 4223063 - DNA, 21 bp, Homo sapiens
atatttctacagagaaaatga

SEQ ID NO: 4223064 - DNA, 18 bp, Homo sapiens
atatttgcatatttttct

SEQ ID NO: 4223065 - DNA, 15 bp, Homo sapiens
atattttatgattta

SEQ ID NO: 4223066 - DNA, 22 bp, Homo sapiens
atcaagttggcttctaatcaaa

SEQ ID NO: 4223067 - DNA, 14 bp, Homo sapiens
atcacagaggcttc

SEQ ID NO: 4223068 - DNA, 20 bp, Homo sapiens
atcaccgagagtagccgaga

SEQ ID NO: 4223069 - DNA, 18 bp, Homo sapiens
atcactgagccatcattt

SEQ ID NO: 4223070 - DNA, 17 bp, Homo sapiens
atcactggagcaccagg

SEQ ID NO: 4223071 - DNA, 23 bp, Homo sapiens
atcactggagcaccaggcacgaa

SEQ ID NO: 4223072 - DNA, 16 bp, Homo sapiens
atcactgtcaatattt

SEQ ID NO: 4223073 - DNA, 12 bp, Homo sapiens
atcagaaggaga

SEQ ID NO: 4223074 - DNA, 15 bp, Homo sapiens
atcagaccctacccc

SEQ ID NO: 4223075 - DNA, 16 bp, Homo sapiens
atcagaccctacccca

SEQ ID NO: 4223076 - DNA, 14 bp, Homo sapiens
atcagagttaccat

SEQ ID NO: 4223077 - DNA, 22 bp, Homo sapiens
atcattctttcccctcagagct

SEQ ID NO: 4223078 - DNA, 19 bp, Homo sapiens
atcatttcctgggagaaag

SEQ ID NO: 4223079 - DNA, 23 bp, Homo sapiens
atcatttcctgggagaaagacca

SEQ ID NO: 4223080 - DNA, 13 bp, Homo sapiens
atccacccagccc

SEQ ID NO: 4223081 - DNA, 15 bp, Homo sapiens
atccaccctatccct

SEQ ID NO: 4223082 - DNA, 22 bp, Homo sapiens
atccaccctatccctgtacaga

SEQ ID NO: 4223083 - DNA, 17 bp, Homo sapiens
atccagtattatattat

SEQ ID NO: 4223084 - DNA, 20 bp, Homo sapiens
atcccaacctggctccctcc

SEQ ID NO: 4223085 - DNA, 20 bp, Homo sapiens
atcccagctactcaggaggc

SEQ ID NO: 4223086 - DNA, 17 bp, Homo sapiens
atcccattgccctggtt

SEQ ID NO: 4223087 - DNA, 16 bp, Homo sapiens
atccgtagttccctga

SEQ ID NO: 4223088 - DNA, 12 bp, Homo sapiens
atcctaatgaat

SEQ ID NO: 4223089 - DNA, 13 bp, Homo sapiens
atcctaatgaatg

SEQ ID NO: 4223090 - DNA, 19 bp, Homo sapiens
atcctcccggctccctcct

SEQ ID NO: 4223091 - DNA, 23 bp, Homo sapiens
atccttaggaaaatgcttctgtt

SEQ ID NO: 4223092 - DNA, 18 bp, Homo sapiens
atccttccatttcttctg

SEQ ID NO: 4223093 - DNA, 12 bp, Homo sapiens
atccttcctata

SEQ ID NO: 4223094 - DNA, 15 bp, Homo sapiens
atccttcctataact

SEQ ID NO: 4223095 - DNA, 20 bp, Homo sapiens
atccttcctataacttgatg

SEQ ID NO: 4223096 - DNA, 23 bp, Homo sapiens
atcggcccacagctcccacccca

SEQ ID NO: 4223097 - DNA, 16 bp, Homo sapiens
atctaatgtctcttcc

SEQ ID NO: 4223098 - DNA, 19 bp, Homo sapiens
atctccctgccgcctcaat

SEQ ID NO: 4223099 - DNA, 12 bp, Homo sapiens
atctctcaaact

SEQ ID NO: 4223100 - DNA, 17 bp, Homo sapiens
atctctgctttggaaat

SEQ ID NO: 4223101 - DNA, 12 bp, Homo sapiens
atctggcagggt

SEQ ID NO: 4223102 - DNA, 19 bp, Homo sapiens
atctggcgctcccatggct

SEQ ID NO: 4223103 - DNA, 15 bp, Homo sapiens
atcttctccatctgg

SEQ ID NO: 4223104 - DNA, 13 bp, Homo sapiens
atgagaaatgtga

SEQ ID NO: 4223105 - DNA, 14 bp, Homo sapiens
atgagaaatgtgaa

SEQ ID NO: 4223106 - DNA, 18 bp, Homo sapiens
atgagctgtatctgtaat

SEQ ID NO: 4223107 - DNA, 14 bp, Homo sapiens
atgaggagttgctg

SEQ ID NO: 4223108 - DNA, 20 bp, Homo sapiens
atgatattttgtctcctacc

SEQ ID NO: 4223109 - DNA, 20 bp, Homo sapiens
atgatttccaaagagaaaaa

SEQ ID NO: 4223110 - DNA, 15 bp, Homo sapiens
atgattttttcatga

SEQ ID NO: 4223111 - DNA, 18 bp, Homo sapiens
atgcatccattcctcagg

SEQ ID NO: 4223112 - DNA, 22 bp, Homo sapiens
atgcatccattcctcagggaca

SEQ ID NO: 4223113 - DNA, 23 bp, Homo sapiens
atgcatgtggtttggttcctctc

SEQ ID NO: 4223114 - DNA, 19 bp, Homo sapiens
atgcggccgcattccctga

SEQ ID NO: 4223115 - DNA, 14 bp, Homo sapiens
atgctagagaatca

SEQ ID NO: 4223116 - DNA, 13 bp, Homo sapiens
atgctctctgcag

SEQ ID NO: 4223117 - DNA, 15 bp, Homo sapiens
atgctgttgcctcat

SEQ ID NO: 4223118 - DNA, 18 bp, Homo sapiens
atgcttatgcttgtgtat

SEQ ID NO: 4223119 - DNA, 14 bp, Homo sapiens
atgcttctgttgta

SEQ ID NO: 4223120 - DNA, 23 bp, Homo sapiens
atgctttgaatgcaaaagaaatt

SEQ ID NO: 4223121 - DNA, 18 bp, Homo sapiens
atggacaatataaactga

SEQ ID NO: 4223122 - DNA, 14 bp, Homo sapiens
atggacagatggac

SEQ ID NO: 4223123 - DNA, 18 bp, Homo sapiens
atggacagatggaccaaa

SEQ ID NO: 4223124 - DNA, 15 bp, Homo sapiens
atggaggagaagaat

SEQ ID NO: 4223125 - DNA, 20 bp, Homo sapiens
atggatgtggggtccccatc

SEQ ID NO: 4223126 - DNA, 20 bp, Homo sapiens
atggctttaaactaccctcc

SEQ ID NO: 4223127 - DNA, 18 bp, Homo sapiens
atgggaggaaagagagca

SEQ ID NO: 4223128 - DNA, 17 bp, Homo sapiens
atggggtgggcagggct

SEQ ID NO: 4223129 - DNA, 22 bp, Homo sapiens
atgggtggttgaatgatttccc

SEQ ID NO: 4223130 - DNA, 14 bp, Homo sapiens
atggtgatgaaatg

SEQ ID NO: 4223131 - DNA, 22 bp, Homo sapiens
atgtaaacagtgcctgctgaat

SEQ ID NO: 4223132 - DNA, 15 bp, Homo sapiens
atgtaacatccagaa

SEQ ID NO: 4223133 - DNA, 20 bp, Homo sapiens
atgtaccaagtaaccatttc

SEQ ID NO: 4223134 - DNA, 12 bp, Homo sapiens
atgtagaaagct

SEQ ID NO: 4223135 - DNA, 19 bp, Homo sapiens
atgtagtattgttctattt

SEQ ID NO: 4223136 - DNA, 14 bp, Homo sapiens
atgtataaattaat

SEQ ID NO: 4223137 - DNA, 21 bp, Homo sapiens
atgtataaattaatacagagt

SEQ ID NO: 4223138 - DNA, 15 bp, Homo sapiens
atgtatgctttgaat

SEQ ID NO: 4223139 - DNA, 15 bp, Homo sapiens
atgtcagagctatgt

SEQ ID NO: 4223140 - DNA, 22 bp, Homo sapiens
atgtcagagctatgttccctcc

SEQ ID NO: 4223141 - DNA, 16 bp, Homo sapiens
atgtcatattttgcca

SEQ ID NO: 4223142 - DNA, 22 bp, Homo sapiens
atgtcatattttgccactgcct

SEQ ID NO: 4223143 - DNA, 15 bp, Homo sapiens
atgtctcttcctctg

SEQ ID NO: 4223144 - DNA, 16 bp, Homo sapiens
atgtctcttcctctgt

SEQ ID NO: 4223145 - DNA, 21 bp, Homo sapiens
atgtctgcttctgtccaggac

SEQ ID NO: 4223146 - DNA, 19 bp, Homo sapiens
atgtgaaatgcttatgctt

SEQ ID NO: 4223147 - DNA, 11 bp, Homo sapiens
atgtgaagaaa

SEQ ID NO: 4223148 - DNA, 12 bp, Homo sapiens
atgtgaatcaga

SEQ ID NO: 4223149 - DNA, 13 bp, Homo sapiens
atgtggccctggc

SEQ ID NO: 4223150 - DNA, 15 bp, Homo sapiens
atgtggccctggcct

SEQ ID NO: 4223151 - DNA, 21 bp, Homo sapiens
atgtggtttggttcctctctg

SEQ ID NO: 4223152 - DNA, 13 bp, Homo sapiens
atgttgaatgtat

SEQ ID NO: 4223153 - DNA, 11 bp, Homo sapiens
atgtttataaa

SEQ ID NO: 4223154 - DNA, 20 bp, Homo sapiens
atgtttcaccctgtccctct

SEQ ID NO: 4223155 - DNA, 23 bp, Homo sapiens
atgtttgggagactgctgagtca

SEQ ID NO: 4223156 - DNA, 18 bp, Homo sapiens
attactccaaggtttata

SEQ ID NO: 4223157 - DNA, 16 bp, Homo sapiens
attagattatttctgt

SEQ ID NO: 4223158 - DNA, 14 bp, Homo sapiens
attagtaaatatgt

SEQ ID NO: 4223159 - DNA, 15 bp, Homo sapiens
attatacaccatttt

SEQ ID NO: 4223160 - DNA, 18 bp, Homo sapiens
attatgtaacatccagaa

SEQ ID NO: 4223161 - DNA, 19 bp, Homo sapiens
attatgtaacatccagaag

SEQ ID NO: 4223162 - DNA, 12 bp, Homo sapiens
attatgtgaaat

SEQ ID NO: 4223163 - DNA, 20 bp, Homo sapiens
attattcagtgaatttgtcc

SEQ ID NO: 4223164 - DNA, 16 bp, Homo sapiens
attattctgattccac

SEQ ID NO: 4223165 - DNA, 21 bp, Homo sapiens
attattgagctctatttcccc

SEQ ID NO: 4223166 - DNA, 11 bp, Homo sapiens
attatttctgt

SEQ ID NO: 4223167 - DNA, 19 bp, Homo sapiens
attatttctgtatttggct

SEQ ID NO: 4223168 - DNA, 22 bp, Homo sapiens
attcaggaaaactgacagagga

SEQ ID NO: 4223169 - DNA, 14 bp, Homo sapiens
attcagtgaatttg

SEQ ID NO: 4223170 - DNA, 15 bp, Homo sapiens
attcagtgaatttgt

SEQ ID NO: 4223171 - DNA, 18 bp, Homo sapiens
attcagtgaatttgtcca

SEQ ID NO: 4223172 - DNA, 19 bp, Homo sapiens
attcatccaggactgagat

SEQ ID NO: 4223173 - DNA, 22 bp, Homo sapiens
attcatgtttaacgtttctcat

SEQ ID NO: 4223174 - DNA, 22 bp, Homo sapiens
attccaccacaggaatgtatca

SEQ ID NO: 4223175 - DNA, 16 bp, Homo sapiens
attcccagagacagga

SEQ ID NO: 4223176 - DNA, 21 bp, Homo sapiens
attccccaggtggctgaccca

SEQ ID NO: 4223177 - DNA, 20 bp, Homo sapiens
attccctgagtcaccaggaa

SEQ ID NO: 4223178 - DNA, 14 bp, Homo sapiens
attcctgaagccag

SEQ ID NO: 4223179 - DNA, 14 bp, Homo sapiens
attctcactccacc

SEQ ID NO: 4223180 - DNA, 17 bp, Homo sapiens
attctcactccaccacc

SEQ ID NO: 4223181 - DNA, 12 bp, Homo sapiens
attctctctcct

SEQ ID NO: 4223182 - DNA, 16 bp, Homo sapiens
attctctctcctgtcc

SEQ ID NO: 4223183 - DNA, 13 bp, Homo sapiens
attctgattccac

SEQ ID NO: 4223184 - DNA, 20 bp, Homo sapiens
attctttcccctcagagctc

SEQ ID NO: 4223185 - DNA, 16 bp, Homo sapiens
attctttttaaagtat

SEQ ID NO: 4223186 - DNA, 19 bp, Homo sapiens
attgaaaaataaaaaccat

SEQ ID NO: 4223187 - DNA, 22 bp, Homo sapiens
attgattattctgattccactt

SEQ ID NO: 4223188 - DNA, 15 bp, Homo sapiens
attgggattttaaaa

SEQ ID NO: 4223189 - DNA, 14 bp, Homo sapiens
attggtccagcttg

SEQ ID NO: 4223190 - DNA, 15 bp, Homo sapiens
attggtccagcttgc

SEQ ID NO: 4223191 - DNA, 18 bp, Homo sapiens
attggtcttaatgttgaa

SEQ ID NO: 4223192 - DNA, 21 bp, Homo sapiens
attggtcttaatgttgaatgt

SEQ ID NO: 4223193 - DNA, 15 bp, Homo sapiens
attgtaaatctgaag

SEQ ID NO: 4223194 - DNA, 17 bp, Homo sapiens
attgtggctgttcactc

SEQ ID NO: 4223195 - DNA, 11 bp, Homo sapiens
atttaaaaaat

SEQ ID NO: 4223196 - DNA, 18 bp, Homo sapiens
atttaaaaaataaatata

SEQ ID NO: 4223197 - DNA, 21 bp, Homo sapiens
atttaaaaaataaatataatt

SEQ ID NO: 4223198 - DNA, 18 bp, Homo sapiens
atttaaagtattctccat

SEQ ID NO: 4223199 - DNA, 16 bp, Homo sapiens
atttaaccataaatca

SEQ ID NO: 4223200 - DNA, 21 bp, Homo sapiens
atttaaccataaatcaattca

SEQ ID NO: 4223201 - DNA, 18 bp, Homo sapiens
atttaatttgtatgctaa

SEQ ID NO: 4223202 - DNA, 21 bp, Homo sapiens
atttagcgcacccagagaaaa

SEQ ID NO: 4223203 - DNA, 22 bp, Homo sapiens
atttagcgcacccagagaaaat

SEQ ID NO: 4223204 - DNA, 17 bp, Homo sapiens
atttataaagcaaatta

SEQ ID NO: 4223205 - DNA, 16 bp, Homo sapiens
atttatacctttgaaa

SEQ ID NO: 4223206 - DNA, 22 bp, Homo sapiens
atttcacatggactttggaaaa

SEQ ID NO: 4223207 - DNA, 17 bp, Homo sapiens
atttcagtcaattctga

SEQ ID NO: 4223208 - DNA, 20 bp, Homo sapiens
atttcagtcaattctgatgt

SEQ ID NO: 4223209 - DNA, 16 bp, Homo sapiens
atttccaaagagaaaa

SEQ ID NO: 4223210 - DNA, 16 bp, Homo sapiens
atttcccttcttgcat

SEQ ID NO: 4223211 - DNA, 23 bp, Homo sapiens
atttcccttcttgcatccttcct

SEQ ID NO: 4223212 - DNA, 18 bp, Homo sapiens
atttcctgggagaaagac

SEQ ID NO: 4223213 - DNA, 13 bp, Homo sapiens
atttctacagaga

SEQ ID NO: 4223214 - DNA, 16 bp, Homo sapiens
atttctacagagaaaa

SEQ ID NO: 4223215 - DNA, 11 bp, Homo sapiens
atttgaaaaaa

SEQ ID NO: 4223216 - DNA, 12 bp, Homo sapiens
atttgaaaaaac

SEQ ID NO: 4223217 - DNA, 20 bp, Homo sapiens
atttgaaaaaactttctctt

SEQ ID NO: 4223218 - DNA, 15 bp, Homo sapiens
atttgcccaaatctt

SEQ ID NO: 4223219 - DNA, 12 bp, Homo sapiens
atttggaaaata

SEQ ID NO: 4223220 - DNA, 14 bp, Homo sapiens
atttgtatgctaaa

SEQ ID NO: 4223221 - DNA, 15 bp, Homo sapiens
atttgtatgctaaat

SEQ ID NO: 4223222 - DNA, 17 bp, Homo sapiens
atttgtatgctaaatga

SEQ ID NO: 4223223 - DNA, 22 bp, Homo sapiens
atttgtccattgtaaatctgaa

SEQ ID NO: 4223224 - DNA, 10 bp, Homo sapiens
atttgtgaat

SEQ ID NO: 4223225 - DNA, 16 bp, Homo sapiens
atttgttatggttaca

SEQ ID NO: 4223226 - DNA, 21 bp, Homo sapiens
attttaaaaacatgagaaatg

SEQ ID NO: 4223227 - DNA, 18 bp, Homo sapiens
attttaattatcttttct

SEQ ID NO: 4223228 - DNA, 23 bp, Homo sapiens
attttagatgttattatgctaat

SEQ ID NO: 4223229 - DNA, 16 bp, Homo sapiens
attttatgatttaaaa

SEQ ID NO: 4223230 - DNA, 21 bp, Homo sapiens
attttgtctcctacctgctgc

SEQ ID NO: 4223231 - DNA, 22 bp, Homo sapiens
atttttaactctggattttgaa

SEQ ID NO: 4223232 - DNA, 18 bp, Homo sapiens
atttttacaaaactgcca

SEQ ID NO: 4223233 - DNA, 19 bp, Homo sapiens
atttttctaaagaaatata

SEQ ID NO: 4223234 - DNA, 17 bp, Homo sapiens
attttttaaaaaatttg

SEQ ID NO: 4223235 - DNA, 16 bp, Homo sapiens
atttttttcctttgca

SEQ ID NO: 4223236 - DNA, 22 bp, Homo sapiens
caaaaaatgggagacaatttca

SEQ ID NO: 4223237 - DNA, 13 bp, Homo sapiens
caaaaacagcctc

SEQ ID NO: 4223238 - DNA, 15 bp, Homo sapiens
caaaaacagcctcac

SEQ ID NO: 4223239 - DNA, 14 bp, Homo sapiens
caaaagagaaaaag

SEQ ID NO: 4223240 - DNA, 17 bp, Homo sapiens
caaaagagaaaaagaag

SEQ ID NO: 4223241 - DNA, 14 bp, Homo sapiens
caaaagccaaaaaa

SEQ ID NO: 4223242 - DNA, 15 bp, Homo sapiens
caaaagtgcattcaa

SEQ ID NO: 4223243 - DNA, 19 bp, Homo sapiens
caaaataaaaattgaaaaa

SEQ ID NO: 4223244 - DNA, 21 bp, Homo sapiens
caaagaaaaaaatatatttta

SEQ ID NO: 4223245 - DNA, 14 bp, Homo sapiens
caaagaaaaacaat

SEQ ID NO: 4223246 - DNA, 14 bp, Homo sapiens
caaagcttaaaaag

SEQ ID NO: 4223247 - DNA, 17 bp, Homo sapiens
caaaggtgctaattaat

SEQ ID NO: 4223248 - DNA, 18 bp, Homo sapiens
caaaggtgctaattaata

SEQ ID NO: 4223249 - DNA, 16 bp, Homo sapiens
caaagtatcaaagaaa

SEQ ID NO: 4223250 - DNA, 14 bp, Homo sapiens
caaattatgtgaaa

SEQ ID NO: 4223251 - DNA, 22 bp, Homo sapiens
caacaatacatgctgctaattc

SEQ ID NO: 4223252 - DNA, 15 bp, Homo sapiens
caacagtaatcagag

SEQ ID NO: 4223253 - DNA, 20 bp, Homo sapiens
caacatcccattgccctggt

SEQ ID NO: 4223254 - DNA, 13 bp, Homo sapiens
caacatggagaaa

SEQ ID NO: 4223255 - DNA, 22 bp, Homo sapiens
caacatggagaaaccctgtctc

SEQ ID NO: 4223256 - DNA, 23 bp, Homo sapiens
caacatttgtgcagaaatttgaa

SEQ ID NO: 4223257 - DNA, 14 bp, Homo sapiens
caaccaactttccc

SEQ ID NO: 4223258 - DNA, 16 bp, Homo sapiens
caaccaactttccccc

SEQ ID NO: 4223259 - DNA, 12 bp, Homo sapiens
caacccaaactg

SEQ ID NO: 4223260 - DNA, 13 bp, Homo sapiens
caaccccagttct

SEQ ID NO: 4223261 - DNA, 20 bp, Homo sapiens
caaccccagttctgctcctc

SEQ ID NO: 4223262 - DNA, 14 bp, Homo sapiens
caacccggaaacag

SEQ ID NO: 4223263 - DNA, 20 bp, Homo sapiens
caaccgaacatgaccaaaaa

SEQ ID NO: 4223264 - DNA, 23 bp, Homo sapiens
caacctgaccaacatggagaaac

SEQ ID NO: 4223265 - DNA, 15 bp, Homo sapiens
caaccttaccaaaaa

SEQ ID NO: 4223266 - DNA, 20 bp, Homo sapiens
caacctttgtaagaaaacca

SEQ ID NO: 4223267 - DNA, 21 bp, Homo sapiens
caacctttgtaagaaaaccaa

SEQ ID NO: 4223268 - DNA, 17 bp, Homo sapiens
caactatgatttggaaa

SEQ ID NO: 4223269 - DNA, 17 bp, Homo sapiens
caacttcaagtgcatgc

SEQ ID NO: 4223270 - DNA, 22 bp, Homo sapiens
caacttcaagtgcatgctctct

SEQ ID NO: 4223271 - DNA, 11 bp, Homo sapiens
caacttcccaa

SEQ ID NO: 4223272 - DNA, 22 bp, Homo sapiens
caacttgtgaactccatcattc

SEQ ID NO: 4223273 - DNA, 17 bp, Homo sapiens
caagaaagatccaccct

SEQ ID NO: 4223274 - DNA, 18 bp, Homo sapiens
caagaggctccctcctgt

SEQ ID NO: 4223275 - DNA, 19 bp, Homo sapiens
caagaggctccctcctgtc

SEQ ID NO: 4223276 - DNA, 17 bp, Homo sapiens
caagattttccacaaga

SEQ ID NO: 4223277 - DNA, 22 bp, Homo sapiens
caagctcacagttcctcgccct

SEQ ID NO: 4223278 - DNA, 13 bp, Homo sapiens
caaggaggaaaaa

SEQ ID NO: 4223279 - DNA, 14 bp, Homo sapiens
caaggaggaaaaac

SEQ ID NO: 4223280 - DNA, 13 bp, Homo sapiens
caagtactgctgt

SEQ ID NO: 4223281 - DNA, 19 bp, Homo sapiens
caagtcaaccaatgtagaa

SEQ ID NO: 4223282 - DNA, 20 bp, Homo sapiens
caagtgggggcagagggcag

SEQ ID NO: 4223283 - DNA, 13 bp, Homo sapiens
caatactcccttt

SEQ ID NO: 4223284 - DNA, 18 bp, Homo sapiens
caatactccctttaaaga

SEQ ID NO: 4223285 - DNA, 15 bp, Homo sapiens
caatcccctcattca

SEQ ID NO: 4223286 - DNA, 22 bp, Homo sapiens
caatcccctcattcaggaaaac

SEQ ID NO: 4223287 - DNA, 16 bp, Homo sapiens
caatctaaattaaaaa

SEQ ID NO: 4223288 - DNA, 20 bp, Homo sapiens
caatctaaattaaaaaagaa

SEQ ID NO: 4223289 - DNA, 21 bp, Homo sapiens
caatctaaattaaaaaagaaa

SEQ ID NO: 4223290 - DNA, 19 bp, Homo sapiens
caatgagctgtatctgtaa

SEQ ID NO: 4223291 - DNA, 21 bp, Homo sapiens
caatgccttgacaacagactg

SEQ ID NO: 4223292 - DNA, 18 bp, Homo sapiens
caatgtgaatcagaccct

SEQ ID NO: 4223293 - DNA, 21 bp, Homo sapiens
caatgtggttgcaaggccgct

SEQ ID NO: 4223294 - DNA, 18 bp, Homo sapiens
caattccacccctcctcg

SEQ ID NO: 4223295 - DNA, 20 bp, Homo sapiens
caattctgatgttactgaga

SEQ ID NO: 4223296 - DNA, 21 bp, Homo sapiens
caattctgatgttactgagat

SEQ ID NO: 4223297 - DNA, 18 bp, Homo sapiens
cacaaagcagtttttccc

SEQ ID NO: 4223298 - DNA, 20 bp, Homo sapiens
cacaaagcagtttttccccc

SEQ ID NO: 4223299 - DNA, 18 bp, Homo sapiens
cacaagattcccagagac

SEQ ID NO: 4223300 - DNA, 21 bp, Homo sapiens
cacactgcaagagccttggtg

SEQ ID NO: 4223301 - DNA, 15 bp, Homo sapiens
cacagctcccacccc

SEQ ID NO: 4223302 - DNA, 19 bp, Homo sapiens
cacagctcccaccccaccc

SEQ ID NO: 4223303 - DNA, 22 bp, Homo sapiens
cacagctcccaccccaccccct

SEQ ID NO: 4223304 - DNA, 16 bp, Homo sapiens
cacagctgcagcccat

SEQ ID NO: 4223305 - DNA, 16 bp, Homo sapiens
cacagttcctcgccct

SEQ ID NO: 4223306 - DNA, 17 bp, Homo sapiens
caccaacatcccattgc

SEQ ID NO: 4223307 - DNA, 22 bp, Homo sapiens
caccaacatcccattgccctgg

SEQ ID NO: 4223308 - DNA, 14 bp, Homo sapiens
caccaagctcacag

SEQ ID NO: 4223309 - DNA, 13 bp, Homo sapiens
caccaccttccca

SEQ ID NO: 4223310 - DNA, 15 bp, Homo sapiens
caccaccttcccagc

SEQ ID NO: 4223311 - DNA, 18 bp, Homo sapiens
caccaccttcccagctct

SEQ ID NO: 4223312 - DNA, 15 bp, Homo sapiens
caccacgatgtggcc

SEQ ID NO: 4223313 - DNA, 19 bp, Homo sapiens
caccacgatgtggccctgg

SEQ ID NO: 4223314 - DNA, 20 bp, Homo sapiens
caccacgatgtggccctggc

SEQ ID NO: 4223315 - DNA, 21 bp, Homo sapiens
caccacgatgtggccctggcc

SEQ ID NO: 4223316 - DNA, 22 bp, Homo sapiens
caccaggcacgaacccacctgc

SEQ ID NO: 4223317 - DNA, 16 bp, Homo sapiens
caccagggggcgcgct

SEQ ID NO: 4223318 - DNA, 20 bp, Homo sapiens
cacccaacagctcagagatg

SEQ ID NO: 4223319 - DNA, 21 bp, Homo sapiens
cacccaaccaactttcccccc

SEQ ID NO: 4223320 - DNA, 22 bp, Homo sapiens
cacccaagtggcccccaccctc

SEQ ID NO: 4223321 - DNA, 13 bp, Homo sapiens
cacccacagggct

SEQ ID NO: 4223322 - DNA, 13 bp, Homo sapiens
cacccagagaaaa

SEQ ID NO: 4223323 - DNA, 22 bp, Homo sapiens
cacccaggctctggagccagag

SEQ ID NO: 4223324 - DNA, 11 bp, Homo sapiens
caccccctccc

SEQ ID NO: 4223325 - DNA, 21 bp, Homo sapiens
caccctcaaatgtcagagcta

SEQ ID NO: 4223326 - DNA, 15 bp, Homo sapiens
caccctcagcccgct

SEQ ID NO: 4223327 - DNA, 11 bp, Homo sapiens
caccctcctgc

SEQ ID NO: 4223328 - DNA, 14 bp, Homo sapiens
caccctcctgcgca

SEQ ID NO: 4223329 - DNA, 18 bp, Homo sapiens
cacccttctttcctcttc

SEQ ID NO: 4223330 - DNA, 21 bp, Homo sapiens
cacccttctttcctcttcccc

SEQ ID NO: 4223331 - DNA, 12 bp, Homo sapiens
caccgctgccta

SEQ ID NO: 4223332 - DNA, 19 bp, Homo sapiens
cacctaggccactcctcca

SEQ ID NO: 4223333 - DNA, 12 bp, Homo sapiens
cacctcagcctt

SEQ ID NO: 4223334 - DNA, 15 bp, Homo sapiens
cacctcagccttgga

SEQ ID NO: 4223335 - DNA, 14 bp, Homo sapiens
cacctccccccact

SEQ ID NO: 4223336 - DNA, 18 bp, Homo sapiens
cacctccccccactgcag

SEQ ID NO: 4223337 - DNA, 21 bp, Homo sapiens
cacctccccccactgcaggcc

SEQ ID NO: 4223338 - DNA, 22 bp, Homo sapiens
cacctccccccactgcaggccc

SEQ ID NO: 4223339 - DNA, 23 bp, Homo sapiens
cacctccccccactgcaggcccc

SEQ ID NO: 4223340 - DNA, 14 bp, Homo sapiens
cacctcccctatcc

SEQ ID NO: 4223341 - DNA, 18 bp, Homo sapiens
cacctcccctatccaccc

SEQ ID NO: 4223342 - DNA, 11 bp, Homo sapiens
cacctgcacct

SEQ ID NO: 4223343 - DNA, 17 bp, Homo sapiens
cacctgcacctcccccc

SEQ ID NO: 4223344 - DNA, 19 bp, Homo sapiens
cacctgcacctccccccac

SEQ ID NO: 4223345 - DNA, 19 bp, Homo sapiens
cacctgctgagagacccaa

SEQ ID NO: 4223346 - DNA, 14 bp, Homo sapiens
cacctggccccatg

SEQ ID NO: 4223347 - DNA, 13 bp, Homo sapiens
cacctggcctgcc

SEQ ID NO: 4223348 - DNA, 15 bp, Homo sapiens
caccttcccagctct

SEQ ID NO: 4223349 - DNA, 17 bp, Homo sapiens
caccttcccagctctcc

SEQ ID NO: 4223350 - DNA, 19 bp, Homo sapiens
caccttcccagctctccct

SEQ ID NO: 4223351 - DNA, 16 bp, Homo sapiens
cacgaacccacctgct

SEQ ID NO: 4223352 - DNA, 22 bp, Homo sapiens
cacgaacccacctgctgagaga

SEQ ID NO: 4223353 - DNA, 19 bp, Homo sapiens
cacgcctgtaatcccagca

SEQ ID NO: 4223354 - DNA, 20 bp, Homo sapiens
cacggatccatgtagcagga

SEQ ID NO: 4223355 - DNA, 23 bp, Homo sapiens
cacggatccatgtagcaggactg

SEQ ID NO: 4223356 - DNA, 16 bp, Homo sapiens
cacgtgccaggcccgg

SEQ ID NO: 4223357 - DNA, 14 bp, Homo sapiens
cactcagggctggg

SEQ ID NO: 4223358 - DNA, 11 bp, Homo sapiens
cactccaccac

SEQ ID NO: 4223359 - DNA, 15 bp, Homo sapiens
cactcctccaaagga

SEQ ID NO: 4223360 - DNA, 17 bp, Homo sapiens
cactctcattccccagg

SEQ ID NO: 4223361 - DNA, 18 bp, Homo sapiens
cactctcattccccaggt

SEQ ID NO: 4223362 - DNA, 22 bp, Homo sapiens
cactgcaacttgtgaactccat

SEQ ID NO: 4223363 - DNA, 13 bp, Homo sapiens
cactgcaggcccc

SEQ ID NO: 4223364 - DNA, 21 bp, Homo sapiens
cactggagcaccaggcacgaa

SEQ ID NO: 4223365 - DNA, 14 bp, Homo sapiens
cacttctgttccag

SEQ ID NO: 4223366 - DNA, 14 bp, Homo sapiens
cagaaaaattaaat

SEQ ID NO: 4223367 - DNA, 15 bp, Homo sapiens
cagaaaaattaaatt

SEQ ID NO: 4223368 - DNA, 20 bp, Homo sapiens
cagaagaattgaacccagga

SEQ ID NO: 4223369 - DNA, 21 bp, Homo sapiens
cagaagaattgaacccaggag

SEQ ID NO: 4223370 - DNA, 12 bp, Homo sapiens
cagaagtgattt

SEQ ID NO: 4223371 - DNA, 24 bp, Homo sapiens
cagaagtgatttagttgtggaaag

SEQ ID NO: 4223372 - DNA, 19 bp, Homo sapiens
cagacaagcaacccaaact

SEQ ID NO: 4223373 - DNA, 21 bp, Homo sapiens
cagacaggagaaatgcatcca

SEQ ID NO: 4223374 - DNA, 15 bp, Homo sapiens
cagaccctaccccac

SEQ ID NO: 4223375 - DNA, 22 bp, Homo sapiens
cagaccggggttcaagccatgg

SEQ ID NO: 4223376 - DNA, 17 bp, Homo sapiens
cagactcctttcctctg

SEQ ID NO: 4223377 - DNA, 12 bp, Homo sapiens
cagactgccaaa

SEQ ID NO: 4223378 - DNA, 14 bp, Homo sapiens
cagactgccaaaga

SEQ ID NO: 4223379 - DNA, 14 bp, Homo sapiens
cagacttcacactg

SEQ ID NO: 4223380 - DNA, 13 bp, Homo sapiens
cagagaaaatgaa

SEQ ID NO: 4223381 - DNA, 17 bp, Homo sapiens
cagagaaaatgaatttg

SEQ ID NO: 4223382 - DNA, 17 bp, Homo sapiens
cagagaaggcaggaatg

SEQ ID NO: 4223383 - DNA, 17 bp, Homo sapiens
cagagacacctgcacct

SEQ ID NO: 4223384 - DNA, 21 bp, Homo sapiens
cagagacaggaaaatcctctg

SEQ ID NO: 4223385 - DNA, 22 bp, Homo sapiens
cagagacaggaaaatcctctgg

SEQ ID NO: 4223386 - DNA, 15 bp, Homo sapiens
cagagagacagaccg

SEQ ID NO: 4223387 - DNA, 16 bp, Homo sapiens
cagagagacagaccgg

SEQ ID NO: 4223388 - DNA, 13 bp, Homo sapiens
cagagaggaatca

SEQ ID NO: 4223389 - DNA, 14 bp, Homo sapiens
cagagatgcctcca

SEQ ID NO: 4223390 - DNA, 19 bp, Homo sapiens
cagagatgcctccaccgct

SEQ ID NO: 4223391 - DNA, 18 bp, Homo sapiens
cagagatgtcatcagagc

SEQ ID NO: 4223392 - DNA, 17 bp, Homo sapiens
cagaggctggaggcagg

SEQ ID NO: 4223393 - DNA, 18 bp, Homo sapiens
cagaggctggaggcaggg

SEQ ID NO: 4223394 - DNA, 20 bp, Homo sapiens
cagaggcttcttcagatcag

SEQ ID NO: 4223395 - DNA, 17 bp, Homo sapiens
cagagggcagaggctgg

SEQ ID NO: 4223396 - DNA, 19 bp, Homo sapiens
cagagtacgttaaaagcaa

SEQ ID NO: 4223397 - DNA, 13 bp, Homo sapiens
cagatcttggaat

SEQ ID NO: 4223398 - DNA, 12 bp, Homo sapiens
cagatggaccaa

SEQ ID NO: 4223399 - DNA, 16 bp, Homo sapiens
cagatggaccaaaaga

SEQ ID NO: 4223400 - DNA, 13 bp, Homo sapiens
cagattatttgcc

SEQ ID NO: 4223401 - DNA, 20 bp, Homo sapiens
cagatttagtgaaagctaga

SEQ ID NO: 4223402 - DNA, 22 bp, Homo sapiens
cagatttagtgaaagctagaga

SEQ ID NO: 4223403 - DNA, 13 bp, Homo sapiens
cagcagccctcct

SEQ ID NO: 4223404 - DNA, 22 bp, Homo sapiens
cagcatcgtgatcactgagcca

SEQ ID NO: 4223405 - DNA, 14 bp, Homo sapiens
cagccagcccagcc

SEQ ID NO: 4223406 - DNA, 17 bp, Homo sapiens
cagccagcccagcccag

SEQ ID NO: 4223407 - DNA, 14 bp, Homo sapiens
cagcccatcctccc

SEQ ID NO: 4223408 - DNA, 18 bp, Homo sapiens
cagcccattctctctcct

SEQ ID NO: 4223409 - DNA, 22 bp, Homo sapiens
cagcccattctctctcctgtcc

SEQ ID NO: 4223410 - DNA, 12 bp, Homo sapiens
cagcccctcctc

SEQ ID NO: 4223411 - DNA, 20 bp, Homo sapiens
cagcccctcctctgccacct

SEQ ID NO: 4223412 - DNA, 15 bp, Homo sapiens
cagccctatggatgt

SEQ ID NO: 4223413 - DNA, 18 bp, Homo sapiens
cagccctccctgtcctcc

SEQ ID NO: 4223414 - DNA, 21 bp, Homo sapiens
cagccctccctgtcctcctcg

SEQ ID NO: 4223415 - DNA, 14 bp, Homo sapiens
cagccctcctcacc

SEQ ID NO: 4223416 - DNA, 22 bp, Homo sapiens
cagccctcctcaccccgtctgg

SEQ ID NO: 4223417 - DNA, 13 bp, Homo sapiens
cagccctgggccc

SEQ ID NO: 4223418 - DNA, 19 bp, Homo sapiens
cagcctgtggcggtgcctg

SEQ ID NO: 4223419 - DNA, 13 bp, Homo sapiens
cagctactcagga

SEQ ID NO: 4223420 - DNA, 11 bp, Homo sapiens
cagctcagaga

SEQ ID NO: 4223421 - DNA, 22 bp, Homo sapiens
cagctcaggatattatgtttct

SEQ ID NO: 4223422 - DNA, 23 bp, Homo sapiens
cagctcccaccccacccccttca

SEQ ID NO: 4223423 - DNA, 17 bp, Homo sapiens
cagctctccctctggcc

SEQ ID NO: 4223424 - DNA, 23 bp, Homo sapiens
cagctctccctctggccctgcct

SEQ ID NO: 4223425 - DNA, 20 bp, Homo sapiens
cagctggtgggaagcgtctg

SEQ ID NO: 4223426 - DNA, 13 bp, Homo sapiens
cagctgtccctgt

SEQ ID NO: 4223427 - DNA, 18 bp, Homo sapiens
cagctgtccctgtcacca

SEQ ID NO: 4223428 - DNA, 22 bp, Homo sapiens
cagctgtccctgtcaccaagct

SEQ ID NO: 4223429 - DNA, 23 bp, Homo sapiens
cagcttgctcttcagtgggagaa

SEQ ID NO: 4223430 - DNA, 13 bp, Homo sapiens
cagctttgccctc

SEQ ID NO: 4223431 - DNA, 17 bp, Homo sapiens
caggaaaatcctctggc

SEQ ID NO: 4223432 - DNA, 21 bp, Homo sapiens
caggaaccgaacatatcattt

SEQ ID NO: 4223433 - DNA, 13 bp, Homo sapiens
caggactcacagg

SEQ ID NO: 4223434 - DNA, 22 bp, Homo sapiens
caggactcacaggttggaagag

SEQ ID NO: 4223435 - DNA, 15 bp, Homo sapiens
caggagagccagccc

SEQ ID NO: 4223436 - DNA, 16 bp, Homo sapiens
caggagagccagccct

SEQ ID NO: 4223437 - DNA, 23 bp, Homo sapiens
caggagagccagccctccctgtc

SEQ ID NO: 4223438 - DNA, 23 bp, Homo sapiens
caggagggctaattagaaatcaa

SEQ ID NO: 4223439 - DNA, 16 bp, Homo sapiens
caggagttggaagtgt

SEQ ID NO: 4223440 - DNA, 17 bp, Homo sapiens
caggatattatgtttct

SEQ ID NO: 4223441 - DNA, 12 bp, Homo sapiens
caggatttataa

SEQ ID NO: 4223442 - DNA, 17 bp, Homo sapiens
caggcacgaacccacct

SEQ ID NO: 4223443 - DNA, 17 bp, Homo sapiens
caggccccgcttgtcca

SEQ ID NO: 4223444 - DNA, 18 bp, Homo sapiens
caggccccgcttgtccag

SEQ ID NO: 4223445 - DNA, 23 bp, Homo sapiens
caggccccgcttgtccagcgcct

SEQ ID NO: 4223446 - DNA, 15 bp, Homo sapiens
caggcccggggctgg

SEQ ID NO: 4223447 - DNA, 16 bp, Homo sapiens
caggcccggggctggc

SEQ ID NO: 4223448 - DNA, 21 bp, Homo sapiens
caggcgctgggggctggacct

SEQ ID NO: 4223449 - DNA, 17 bp, Homo sapiens
caggctctggagccaga

SEQ ID NO: 4223450 - DNA, 18 bp, Homo sapiens
cagggacagagacacctg

SEQ ID NO: 4223451 - DNA, 14 bp, Homo sapiens
cagggccttgccca

SEQ ID NO: 4223452 - DNA, 18 bp, Homo sapiens
cagggccttgcccagaga

SEQ ID NO: 4223453 - DNA, 19 bp, Homo sapiens
cagggccttgcccagagat

SEQ ID NO: 4223454 - DNA, 17 bp, Homo sapiens
cagggctaagagctagc

SEQ ID NO: 4223455 - DNA, 13 bp, Homo sapiens
cagggctggggcc

SEQ ID NO: 4223456 - DNA, 19 bp, Homo sapiens
cagggctggggccaagagg

SEQ ID NO: 4223457 - DNA, 22 bp, Homo sapiens
cagggctggggccaagaggaaa

SEQ ID NO: 4223458 - DNA, 17 bp, Homo sapiens
caggggagagggtctgg

SEQ ID NO: 4223459 - DNA, 15 bp, Homo sapiens
caggtggctgaccca

SEQ ID NO: 4223460 - DNA, 18 bp, Homo sapiens
caggttggaagagaatca

SEQ ID NO: 4223461 - DNA, 20 bp, Homo sapiens
cagtaaaagataaatttgtt

SEQ ID NO: 4223462 - DNA, 15 bp, Homo sapiens
cagtagtatctgctt

SEQ ID NO: 4223463 - DNA, 19 bp, Homo sapiens
cagtataagatttttgaaa

SEQ ID NO: 4223464 - DNA, 11 bp, Homo sapiens
cagtgaatttg

SEQ ID NO: 4223465 - DNA, 14 bp, Homo sapiens
cagtgaatttgtcc

SEQ ID NO: 4223466 - DNA, 11 bp, Homo sapiens
cagtgcctgct

SEQ ID NO: 4223467 - DNA, 12 bp, Homo sapiens
cagtgcctgctg

SEQ ID NO: 4223468 - DNA, 20 bp, Homo sapiens
cagtgccttacctcctgccc

SEQ ID NO: 4223469 - DNA, 23 bp, Homo sapiens
cagtgccttacctcctgcccagg

SEQ ID NO: 4223470 - DNA, 20 bp, Homo sapiens
cagtgcttgagtttggggaa

SEQ ID NO: 4223471 - DNA, 21 bp, Homo sapiens
cagtgggaacgtgactgcccc

SEQ ID NO: 4223472 - DNA, 19 bp, Homo sapiens
cagttactcagccctgggc

SEQ ID NO: 4223473 - DNA, 17 bp, Homo sapiens
cagttcctcgccctggg

SEQ ID NO: 4223474 - DNA, 18 bp, Homo sapiens
cagttcctcgccctgggt

SEQ ID NO: 4223475 - DNA, 16 bp, Homo sapiens
cagttctgctcctctc

SEQ ID NO: 4223476 - DNA, 21 bp, Homo sapiens
cagttctgctcctctccaggc

SEQ ID NO: 4223477 - DNA, 23 bp, Homo sapiens
cagtttgcagaaaagcacctgcc

SEQ ID NO: 4223478 - DNA, 19 bp, Homo sapiens
cataaaccaatgagctgta

SEQ ID NO: 4223479 - DNA, 23 bp, Homo sapiens
cataaaccaatgagctgtatctg

SEQ ID NO: 4223480 - DNA, 21 bp, Homo sapiens
cataaatcaattcatgtttaa

SEQ ID NO: 4223481 - DNA, 18 bp, Homo sapiens
catagtggatggacagat

SEQ ID NO: 4223482 - DNA, 21 bp, Homo sapiens
catagtggatggacagatgga

SEQ ID NO: 4223483 - DNA, 22 bp, Homo sapiens
catagtggatggacagatggac

SEQ ID NO: 4223484 - DNA, 15 bp, Homo sapiens
catatgtctgcttct

SEQ ID NO: 4223485 - DNA, 20 bp, Homo sapiens
catattttgccactgccttt

SEQ ID NO: 4223486 - DNA, 19 bp, Homo sapiens
catcactggagcaccaggc

SEQ ID NO: 4223487 - DNA, 22 bp, Homo sapiens
catcattcatccaggactgaga

SEQ ID NO: 4223488 - DNA, 15 bp, Homo sapiens
catccaggactgaga

SEQ ID NO: 4223489 - DNA, 15 bp, Homo sapiens
catccattcctcagg

SEQ ID NO: 4223490 - DNA, 16 bp, Homo sapiens
catccattcctcaggg

SEQ ID NO: 4223491 - DNA, 22 bp, Homo sapiens
catcccaacctggctccctccc

SEQ ID NO: 4223492 - DNA, 16 bp, Homo sapiens
catccgtagttccctg

SEQ ID NO: 4223493 - DNA, 19 bp, Homo sapiens
catcctcccggctccctcc

SEQ ID NO: 4223494 - DNA, 13 bp, Homo sapiens
catccttcctata

SEQ ID NO: 4223495 - DNA, 18 bp, Homo sapiens
catctaatgtctcttcct

SEQ ID NO: 4223496 - DNA, 13 bp, Homo sapiens
catctatgtcata

SEQ ID NO: 4223497 - DNA, 13 bp, Homo sapiens
catctgaaagcca

SEQ ID NO: 4223498 - DNA, 12 bp, Homo sapiens
catcttaaatga

SEQ ID NO: 4223499 - DNA, 15 bp, Homo sapiens
catcttaaatgacag

SEQ ID NO: 4223500 - DNA, 19 bp, Homo sapiens
catcttattcccaattaaa

SEQ ID NO: 4223501 - DNA, 16 bp, Homo sapiens
catcttctccatctgg

SEQ ID NO: 4223502 - DNA, 18 bp, Homo sapiens
catgaactacgtgacctc

SEQ ID NO: 4223503 - DNA, 14 bp, Homo sapiens
catgaccaaaaacc

SEQ ID NO: 4223504 - DNA, 15 bp, Homo sapiens
catgaccaaaaacca

SEQ ID NO: 4223505 - DNA, 12 bp, Homo sapiens
catgagaaatgt

SEQ ID NO: 4223506 - DNA, 15 bp, Homo sapiens
catgaggagttgctg

SEQ ID NO: 4223507 - DNA, 15 bp, Homo sapiens
catgatctccctgcc

SEQ ID NO: 4223508 - DNA, 18 bp, Homo sapiens
catgatctccctgccgcc

SEQ ID NO: 4223509 - DNA, 15 bp, Homo sapiens
catgctctctgcagc

SEQ ID NO: 4223510 - DNA, 19 bp, Homo sapiens
catgctctctgcagccagc

SEQ ID NO: 4223511 - DNA, 21 bp, Homo sapiens
catgctctctgcagccagccc

SEQ ID NO: 4223512 - DNA, 16 bp, Homo sapiens
catggacaatataaac

SEQ ID NO: 4223513 - DNA, 20 bp, Homo sapiens
catggacaatataaactgaa

SEQ ID NO: 4223514 - DNA, 16 bp, Homo sapiens
catggagaaaccctgt

SEQ ID NO: 4223515 - DNA, 20 bp, Homo sapiens
catggtggcgcaagcctgta

SEQ ID NO: 4223516 - DNA, 17 bp, Homo sapiens
catgtctctcagaattc

SEQ ID NO: 4223517 - DNA, 23 bp, Homo sapiens
catgtggaaatgacccaaacata

SEQ ID NO: 4223518 - DNA, 21 bp, Homo sapiens
catgtggtttggttcctctct

SEQ ID NO: 4223519 - DNA, 22 bp, Homo sapiens
catgtggtttggttcctctctg

SEQ ID NO: 4223520 - DNA, 17 bp, Homo sapiens
catgttccctttaaaat

SEQ ID NO: 4223521 - DNA, 19 bp, Homo sapiens
catgtttgagctcagaccc

SEQ ID NO: 4223522 - DNA, 18 bp, Homo sapiens
cattataactgaaggaga

SEQ ID NO: 4223523 - DNA, 18 bp, Homo sapiens
cattatttaatttgtatg

SEQ ID NO: 4223524 - DNA, 20 bp, Homo sapiens
cattatttaatttgtatgct

SEQ ID NO: 4223525 - DNA, 19 bp, Homo sapiens
cattcaaccttaccaaaaa

SEQ ID NO: 4223526 - DNA, 13 bp, Homo sapiens
cattcaggaaaac

SEQ ID NO: 4223527 - DNA, 21 bp, Homo sapiens
cattcatccaggactgagatg

SEQ ID NO: 4223528 - DNA, 18 bp, Homo sapiens
cattcatctctcaaactt

SEQ ID NO: 4223529 - DNA, 19 bp, Homo sapiens
cattcatctctcaaactta

SEQ ID NO: 4223530 - DNA, 17 bp, Homo sapiens
cattccccaggtggctg

SEQ ID NO: 4223531 - DNA, 21 bp, Homo sapiens
cattccctgagtcaccaggaa

SEQ ID NO: 4223532 - DNA, 15 bp, Homo sapiens
cattctctctcctgt

SEQ ID NO: 4223533 - DNA, 20 bp, Homo sapiens
cattctctctcctgtccaac

SEQ ID NO: 4223534 - DNA, 21 bp, Homo sapiens
cattctttcccctcagagctc

SEQ ID NO: 4223535 - DNA, 15 bp, Homo sapiens
cattgtaaatctgaa

SEQ ID NO: 4223536 - DNA, 16 bp, Homo sapiens
cattgtaaatctgaag

SEQ ID NO: 4223537 - DNA, 19 bp, Homo sapiens
catttatacctttgaaata

SEQ ID NO: 4223538 - DNA, 17 bp, Homo sapiens
catttcctgggagaaag

SEQ ID NO: 4223539 - DNA, 18 bp, Homo sapiens
catttggcaggaagatgt

SEQ ID NO: 4223540 - DNA, 13 bp, Homo sapiens
cattttcatcttc

SEQ ID NO: 4223541 - DNA, 13 bp, Homo sapiens
cattttctgttcc

SEQ ID NO: 4223542 - DNA, 18 bp, Homo sapiens
catttttgaatacaggca

SEQ ID NO: 4223543 - DNA, 10 bp, Homo sapiens
ccaaaagaac

SEQ ID NO: 4223544 - DNA, 16 bp, Homo sapiens
ccaaaagtgcattcaa

SEQ ID NO: 4223545 - DNA, 20 bp, Homo sapiens
ccaaaagtgcattcaacctt

SEQ ID NO: 4223546 - DNA, 21 bp, Homo sapiens
ccaaaataaaaattgaaaaat

SEQ ID NO: 4223547 - DNA, 23 bp, Homo sapiens
ccaaagaattcctgaagccagat

SEQ ID NO: 4223548 - DNA, 11 bp, Homo sapiens
ccaaaggtgct

SEQ ID NO: 4223549 - DNA, 22 bp, Homo sapiens
ccaaatctgtctccccagaaga

SEQ ID NO: 4223550 - DNA, 13 bp, Homo sapiens
ccaaatcttcttc

SEQ ID NO: 4223551 - DNA, 18 bp, Homo sapiens
ccaaattatgtgaaatgc

SEQ ID NO: 4223552 - DNA, 21 bp, Homo sapiens
ccaacatcccattgccctggt

SEQ ID NO: 4223553 - DNA, 13 bp, Homo sapiens
ccaacctgaccaa

SEQ ID NO: 4223554 - DNA, 19 bp, Homo sapiens
ccaactcctggaagctgtg

SEQ ID NO: 4223555 - DNA, 14 bp, Homo sapiens
ccaagaaagatcca

SEQ ID NO: 4223556 - DNA, 18 bp, Homo sapiens
ccaagaggctccctcctg

SEQ ID NO: 4223557 - DNA, 13 bp, Homo sapiens
ccaagctcacagt

SEQ ID NO: 4223558 - DNA, 21 bp, Homo sapiens
ccaaggaggaaaaacagacaa

SEQ ID NO: 4223559 - DNA, 18 bp, Homo sapiens
ccaaggtttataaagcag

SEQ ID NO: 4223560 - DNA, 16 bp, Homo sapiens
ccaagtgggggcagag

SEQ ID NO: 4223561 - DNA, 17 bp, Homo sapiens
ccacaagattcccagag

SEQ ID NO: 4223562 - DNA, 16 bp, Homo sapiens
ccacagctcccacccc

SEQ ID NO: 4223563 - DNA, 18 bp, Homo sapiens
ccaccacctaggccactc

SEQ ID NO: 4223564 - DNA, 19 bp, Homo sapiens
ccaccacgatgtggccctg

SEQ ID NO: 4223565 - DNA, 12 bp, Homo sapiens
ccacccagccca

SEQ ID NO: 4223566 - DNA, 17 bp, Homo sapiens
ccacccccttcagtgcc

SEQ ID NO: 4223567 - DNA, 15 bp, Homo sapiens
ccaccgctgcctaag

SEQ ID NO: 4223568 - DNA, 16 bp, Homo sapiens
ccacctaggccactcc

SEQ ID NO: 4223569 - DNA, 18 bp, Homo sapiens
ccacctaggccactcctc

SEQ ID NO: 4223570 - DNA, 16 bp, Homo sapiens
ccacctcagccttgga

SEQ ID NO: 4223571 - DNA, 15 bp, Homo sapiens
ccacctgctgagaga

SEQ ID NO: 4223572 - DNA, 21 bp, Homo sapiens
ccacctggccccatgtctctc

SEQ ID NO: 4223573 - DNA, 13 bp, Homo sapiens
ccaccttcccagc

SEQ ID NO: 4223574 - DNA, 14 bp, Homo sapiens
ccaccttcccagct

SEQ ID NO: 4223575 - DNA, 15 bp, Homo sapiens
ccacgtgccaggccc

SEQ ID NO: 4223576 - DNA, 16 bp, Homo sapiens
ccacgtgccaggcccg

SEQ ID NO: 4223577 - DNA, 23 bp, Homo sapiens
ccacgtgccaggcccggggctgg

SEQ ID NO: 4223578 - DNA, 16 bp, Homo sapiens
ccactcctccaaagga

SEQ ID NO: 4223579 - DNA, 16 bp, Homo sapiens
ccactctcattcccca

SEQ ID NO: 4223580 - DNA, 17 bp, Homo sapiens
ccactctcattccccag

SEQ ID NO: 4223581 - DNA, 17 bp, Homo sapiens
ccactgcaacttgtgaa

SEQ ID NO: 4223582 - DNA, 22 bp, Homo sapiens
ccactgcaacttgtgaactcca

SEQ ID NO: 4223583 - DNA, 13 bp, Homo sapiens
ccactgcaggccc

SEQ ID NO: 4223584 - DNA, 14 bp, Homo sapiens
ccactgcaggcccc

SEQ ID NO: 4223585 - DNA, 16 bp, Homo sapiens
ccacttttattcattt

SEQ ID NO: 4223586 - DNA, 20 bp, Homo sapiens
ccagaagtttgtcaagtcaa

SEQ ID NO: 4223587 - DNA, 15 bp, Homo sapiens
ccagactcctttcct

SEQ ID NO: 4223588 - DNA, 13 bp, Homo sapiens
ccagagacaggaa

SEQ ID NO: 4223589 - DNA, 15 bp, Homo sapiens
ccagagacaggaaaa

SEQ ID NO: 4223590 - DNA, 14 bp, Homo sapiens
ccagagatgcctcc

SEQ ID NO: 4223591 - DNA, 15 bp, Homo sapiens
ccagagatgcctcca

SEQ ID NO: 4223592 - DNA, 17 bp, Homo sapiens
ccagagatgcctccacc

SEQ ID NO: 4223593 - DNA, 23 bp, Homo sapiens
ccagagatgcctccaccgctgcc

SEQ ID NO: 4223594 - DNA, 12 bp, Homo sapiens
ccagagatgtca

SEQ ID NO: 4223595 - DNA, 15 bp, Homo sapiens
ccagcagtttgggag

SEQ ID NO: 4223596 - DNA, 12 bp, Homo sapiens
ccagcccagccc

SEQ ID NO: 4223597 - DNA, 17 bp, Homo sapiens
ccagcccattctctctc

SEQ ID NO: 4223598 - DNA, 21 bp, Homo sapiens
ccagcccattctctctcctgt

SEQ ID NO: 4223599 - DNA, 22 bp, Homo sapiens
ccagcccattctctctcctgtc

SEQ ID NO: 4223600 - DNA, 14 bp, Homo sapiens
ccagctactcagga

SEQ ID NO: 4223601 - DNA, 17 bp, Homo sapiens
ccagctactcaggaggc

SEQ ID NO: 4223602 - DNA, 19 bp, Homo sapiens
ccagctactcaggaggctg

SEQ ID NO: 4223603 - DNA, 14 bp, Homo sapiens
ccagctctccctct

SEQ ID NO: 4223604 - DNA, 17 bp, Homo sapiens
ccagctctccctctggc

SEQ ID NO: 4223605 - DNA, 18 bp, Homo sapiens
ccagctctccctctggcc

SEQ ID NO: 4223606 - DNA, 23 bp, Homo sapiens
ccagctctccctctggccctgcc

SEQ ID NO: 4223607 - DNA, 15 bp, Homo sapiens
ccaggacaggcccgg

SEQ ID NO: 4223608 - DNA, 16 bp, Homo sapiens
ccaggagagccagccc

SEQ ID NO: 4223609 - DNA, 19 bp, Homo sapiens
ccaggagagccagccctcc

SEQ ID NO: 4223610 - DNA, 14 bp, Homo sapiens
ccaggatttataaa

SEQ ID NO: 4223611 - DNA, 21 bp, Homo sapiens
ccaggcatgtcctaggctctg

SEQ ID NO: 4223612 - DNA, 16 bp, Homo sapiens
ccaggcccggggctgg

SEQ ID NO: 4223613 - DNA, 20 bp, Homo sapiens
ccaggcccggggctggcggc

SEQ ID NO: 4223614 - DNA, 21 bp, Homo sapiens
ccaggcgctgggggctggacc

SEQ ID NO: 4223615 - DNA, 19 bp, Homo sapiens
ccaggctctggagccagag

SEQ ID NO: 4223616 - DNA, 20 bp, Homo sapiens
ccaggctctggagccagaga

SEQ ID NO: 4223617 - DNA, 13 bp, Homo sapiens
ccagggccacgtg

SEQ ID NO: 4223618 - DNA, 20 bp, Homo sapiens
ccaggggagagggtctggag

SEQ ID NO: 4223619 - DNA, 16 bp, Homo sapiens
ccaggtggctgaccca

SEQ ID NO: 4223620 - DNA, 20 bp, Homo sapiens
ccaggtggctgacccagtcc

SEQ ID NO: 4223621 - DNA, 21 bp, Homo sapiens
ccaggtggctgacccagtccc

SEQ ID NO: 4223622 - DNA, 12 bp, Homo sapiens
ccagtccctggg

SEQ ID NO: 4223623 - DNA, 13 bp, Homo sapiens
ccagtccctgggg

SEQ ID NO: 4223624 - DNA, 19 bp, Homo sapiens
ccagtgccttacctcctgc

SEQ ID NO: 4223625 - DNA, 20 bp, Homo sapiens
ccagtgccttacctcctgcc

SEQ ID NO: 4223626 - DNA, 21 bp, Homo sapiens
ccagtgccttacctcctgccc

SEQ ID NO: 4223627 - DNA, 22 bp, Homo sapiens
ccagtgccttacctcctgccca

SEQ ID NO: 4223628 - DNA, 23 bp, Homo sapiens
ccagtgccttacctcctgcccag

SEQ ID NO: 4223629 - DNA, 16 bp, Homo sapiens
ccatatgtctgcttct

SEQ ID NO: 4223630 - DNA, 18 bp, Homo sapiens
ccatatgtctgcttctgt

SEQ ID NO: 4223631 - DNA, 20 bp, Homo sapiens
ccatgaggagttgctgtttg

SEQ ID NO: 4223632 - DNA, 21 bp, Homo sapiens
ccatggacaatataaactgaa

SEQ ID NO: 4223633 - DNA, 22 bp, Homo sapiens
ccatgtttagattccaggatca

SEQ ID NO: 4223634 - DNA, 14 bp, Homo sapiens
ccattaactgcttt

SEQ ID NO: 4223635 - DNA, 18 bp, Homo sapiens
ccattatttaatttgtat

SEQ ID NO: 4223636 - DNA, 16 bp, Homo sapiens
ccattctctctcctgt

SEQ ID NO: 4223637 - DNA, 19 bp, Homo sapiens
ccattctctctcctgtcca

SEQ ID NO: 4223638 - DNA, 14 bp, Homo sapiens
ccattgccctggtt

SEQ ID NO: 4223639 - DNA, 19 bp, Homo sapiens
ccattgtaaatctgaagaa

SEQ ID NO: 4223640 - DNA, 20 bp, Homo sapiens
ccattgtaaatctgaagaaa

SEQ ID NO: 4223641 - DNA, 13 bp, Homo sapiens
ccatttcttcttc

SEQ ID NO: 4223642 - DNA, 22 bp, Homo sapiens
cccaaaagtcaaaaggtgcctg

SEQ ID NO: 4223643 - DNA, 23 bp, Homo sapiens
cccaaaagtcaaaaggtgcctgt

SEQ ID NO: 4223644 - DNA, 18 bp, Homo sapiens
cccaaccaactttccccc

SEQ ID NO: 4223645 - DNA, 20 bp, Homo sapiens
cccaaccaactttcccccca

SEQ ID NO: 4223646 - DNA, 15 bp, Homo sapiens
cccaactcctggaag

SEQ ID NO: 4223647 - DNA, 14 bp, Homo sapiens
cccaaggaggaaaa

SEQ ID NO: 4223648 - DNA, 11 bp, Homo sapiens
cccaattaaaa

SEQ ID NO: 4223649 - DNA, 12 bp, Homo sapiens
cccacagctccc

SEQ ID NO: 4223650 - DNA, 19 bp, Homo sapiens
cccacagctcccaccccac

SEQ ID NO: 4223651 - DNA, 16 bp, Homo sapiens
cccaccacctaggcca

SEQ ID NO: 4223652 - DNA, 20 bp, Homo sapiens
cccaccacctaggccactcc

SEQ ID NO: 4223653 - DNA, 17 bp, Homo sapiens
cccaccccctccccagg

SEQ ID NO: 4223654 - DNA, 19 bp, Homo sapiens
cccaccccctccccagggg

SEQ ID NO: 4223655 - DNA, 19 bp, Homo sapiens
cccacctgctgagagaccc

SEQ ID NO: 4223656 - DNA, 13 bp, Homo sapiens
cccacgcctgctt

SEQ ID NO: 4223657 - DNA, 13 bp, Homo sapiens
cccactctcattc

SEQ ID NO: 4223658 - DNA, 21 bp, Homo sapiens
cccactctcattccccaggtg

SEQ ID NO: 4223659 - DNA, 15 bp, Homo sapiens
cccactgcaggcccc

SEQ ID NO: 4223660 - DNA, 14 bp, Homo sapiens
cccagagacaggaa

SEQ ID NO: 4223661 - DNA, 17 bp, Homo sapiens
cccagagacaggaaaat

SEQ ID NO: 4223662 - DNA, 19 bp, Homo sapiens
cccagagaggaatcagact

SEQ ID NO: 4223663 - DNA, 18 bp, Homo sapiens
cccagagatgcctccacc

SEQ ID NO: 4223664 - DNA, 13 bp, Homo sapiens
cccagagatgtca

SEQ ID NO: 4223665 - DNA, 20 bp, Homo sapiens
cccagagatgtcatcagagc

SEQ ID NO: 4223666 - DNA, 16 bp, Homo sapiens
cccagcagtttgggag

SEQ ID NO: 4223667 - DNA, 13 bp, Homo sapiens
cccagcccagctg

SEQ ID NO: 4223668 - DNA, 16 bp, Homo sapiens
cccagcccagctggtg

SEQ ID NO: 4223669 - DNA, 21 bp, Homo sapiens
cccagcccattctctctcctg

SEQ ID NO: 4223670 - DNA, 18 bp, Homo sapiens
cccagccctatggatgtg

SEQ ID NO: 4223671 - DNA, 12 bp, Homo sapiens
cccagctctccc

SEQ ID NO: 4223672 - DNA, 16 bp, Homo sapiens
cccagctctccctctg

SEQ ID NO: 4223673 - DNA, 18 bp, Homo sapiens
cccagctctccctctggc

SEQ ID NO: 4223674 - DNA, 16 bp, Homo sapiens
cccagctggtgggaag

SEQ ID NO: 4223675 - DNA, 19 bp, Homo sapiens
cccagctggtgggaagcgt

SEQ ID NO: 4223676 - DNA, 22 bp, Homo sapiens
cccagctggtgggaagcgtctg

SEQ ID NO: 4223677 - DNA, 14 bp, Homo sapiens
cccaggagagccag

SEQ ID NO: 4223678 - DNA, 19 bp, Homo sapiens
cccaggagagccagccctc

SEQ ID NO: 4223679 - DNA, 21 bp, Homo sapiens
cccaggagagccagccctccc

SEQ ID NO: 4223680 - DNA, 22 bp, Homo sapiens
cccaggagagccagccctccct

SEQ ID NO: 4223681 - DNA, 23 bp, Homo sapiens
cccaggagagccagccctccctg

SEQ ID NO: 4223682 - DNA, 21 bp, Homo sapiens
cccaggggagagggtctggag

SEQ ID NO: 4223683 - DNA, 22 bp, Homo sapiens
cccaggtggctgacccagtccc

SEQ ID NO: 4223684 - DNA, 13 bp, Homo sapiens
cccagtccctggg

SEQ ID NO: 4223685 - DNA, 16 bp, Homo sapiens
cccagttctgctcctc

SEQ ID NO: 4223686 - DNA, 15 bp, Homo sapiens
cccagtttgcagaaa

SEQ ID NO: 4223687 - DNA, 22 bp, Homo sapiens
cccagtttgcagaaaagcacct

SEQ ID NO: 4223688 - DNA, 13 bp, Homo sapiens
cccatcactggag

SEQ ID NO: 4223689 - DNA, 12 bp, Homo sapiens
cccatcctcccg

SEQ ID NO: 4223690 - DNA, 16 bp, Homo sapiens
cccatgtctctcagaa

SEQ ID NO: 4223691 - DNA, 17 bp, Homo sapiens
ccccacccccttcagtg

SEQ ID NO: 4223692 - DNA, 16 bp, Homo sapiens
ccccactgcaggcccc

SEQ ID NO: 4223693 - DNA, 20 bp, Homo sapiens
ccccaggtggctgacccagt

SEQ ID NO: 4223694 - DNA, 23 bp, Homo sapiens
ccccagttctgctcctctccagg

SEQ ID NO: 4223695 - DNA, 16 bp, Homo sapiens
ccccctgccagtgcct

SEQ ID NO: 4223696 - DNA, 14 bp, Homo sapiens
cccccttcagtgcc

SEQ ID NO: 4223697 - DNA, 15 bp, Homo sapiens
cccccttcagtgccc

SEQ ID NO: 4223698 - DNA, 16 bp, Homo sapiens
ccccggtcccttgaga

SEQ ID NO: 4223699 - DNA, 21 bp, Homo sapiens
ccccgtctggggttcagcccc

SEQ ID NO: 4223700 - DNA, 16 bp, Homo sapiens
cccctatccacccagc

SEQ ID NO: 4223701 - DNA, 13 bp, Homo sapiens
cccctcctctgcc

SEQ ID NO: 4223702 - DNA, 14 bp, Homo sapiens
cccctcctctgcca

SEQ ID NO: 4223703 - DNA, 15 bp, Homo sapiens
cccctgccagtgcct

SEQ ID NO: 4223704 - DNA, 16 bp, Homo sapiens
cccctgccagtgcctt

SEQ ID NO: 4223705 - DNA, 15 bp, Homo sapiens
cccctgtaaatagtt

SEQ ID NO: 4223706 - DNA, 23 bp, Homo sapiens
cccctgtaaatagttttaaatat

SEQ ID NO: 4223707 - DNA, 13 bp, Homo sapiens
ccccttcagtgcc

SEQ ID NO: 4223708 - DNA, 18 bp, Homo sapiens
ccccttgcccttgccctg

SEQ ID NO: 4223709 - DNA, 24 bp, Homo sapiens
ccccttgcccttgccctgacctcc

SEQ ID NO: 4223710 - DNA, 17 bp, Homo sapiens
cccgaatttagtcacac

SEQ ID NO: 4223711 - DNA, 22 bp, Homo sapiens
cccggcgcggtggctcacgcct

SEQ ID NO: 4223712 - DNA, 20 bp, Homo sapiens
cccgtctggggttcagcccc

SEQ ID NO: 4223713 - DNA, 14 bp, Homo sapiens
ccctaccccaccac

SEQ ID NO: 4223714 - DNA, 17 bp, Homo sapiens
ccctatccctgtacaga

SEQ ID NO: 4223715 - DNA, 16 bp, Homo sapiens
ccctatggatgtgggg

SEQ ID NO: 4223716 - DNA, 17 bp, Homo sapiens
ccctcaaaagccaaaaa

SEQ ID NO: 4223717 - DNA, 12 bp, Homo sapiens
ccctcagagctc

SEQ ID NO: 4223718 - DNA, 11 bp, Homo sapiens
ccctccagagt

SEQ ID NO: 4223719 - DNA, 11 bp, Homo sapiens
ccctccctgtc

SEQ ID NO: 4223720 - DNA, 14 bp, Homo sapiens
ccctcctcaccccg

SEQ ID NO: 4223721 - DNA, 11 bp, Homo sapiens
ccctcctctgc

SEQ ID NO: 4223722 - DNA, 13 bp, Homo sapiens
ccctcctctgcca

SEQ ID NO: 4223723 - DNA, 12 bp, Homo sapiens
ccctctcctgcc

SEQ ID NO: 4223724 - DNA, 13 bp, Homo sapiens
ccctctcctgcct

SEQ ID NO: 4223725 - DNA, 13 bp, Homo sapiens
ccctctggccctg

SEQ ID NO: 4223726 - DNA, 16 bp, Homo sapiens
ccctctggccctgcct

SEQ ID NO: 4223727 - DNA, 14 bp, Homo sapiens
ccctgaaaacccag

SEQ ID NO: 4223728 - DNA, 17 bp, Homo sapiens
ccctgaaaacccagaga

SEQ ID NO: 4223729 - DNA, 11 bp, Homo sapiens
ccctgacctcc

SEQ ID NO: 4223730 - DNA, 15 bp, Homo sapiens
ccctgacctcccagc

SEQ ID NO: 4223731 - DNA, 18 bp, Homo sapiens
ccctgacctcccagccct

SEQ ID NO: 4223732 - DNA, 19 bp, Homo sapiens
ccctgacctcccagcccta

SEQ ID NO: 4223733 - DNA, 20 bp, Homo sapiens
ccctgacctcccagccctat

SEQ ID NO: 4223734 - DNA, 21 bp, Homo sapiens
ccctgacctcccagccctatg

SEQ ID NO: 4223735 - DNA, 16 bp, Homo sapiens
ccctgagtcaccagga

SEQ ID NO: 4223736 - DNA, 15 bp, Homo sapiens
ccctgccagtgcctt

SEQ ID NO: 4223737 - DNA, 19 bp, Homo sapiens
ccctgctcccacgcctgct

SEQ ID NO: 4223738 - DNA, 20 bp, Homo sapiens
ccctgctcccacgcctgctt

SEQ ID NO: 4223739 - DNA, 19 bp, Homo sapiens
ccctggcttgtaactccac

SEQ ID NO: 4223740 - DNA, 20 bp, Homo sapiens
ccctgggccccaccacctag

SEQ ID NO: 4223741 - DNA, 14 bp, Homo sapiens
ccctgtcaccaagc

SEQ ID NO: 4223742 - DNA, 14 bp, Homo sapiens
ccctgtcctcctcg

SEQ ID NO: 4223743 - DNA, 16 bp, Homo sapiens
ccctgtcctcctcgga

SEQ ID NO: 4223744 - DNA, 13 bp, Homo sapiens
cccttcagtgccc

SEQ ID NO: 4223745 - DNA, 15 bp, Homo sapiens
cccttgagacctcag

SEQ ID NO: 4223746 - DNA, 18 bp, Homo sapiens
cccttgagacctcagcca

SEQ ID NO: 4223747 - DNA, 20 bp, Homo sapiens
cccttgagacctcagccatg

SEQ ID NO: 4223748 - DNA, 13 bp, Homo sapiens
cccttgccctgac

SEQ ID NO: 4223749 - DNA, 21 bp, Homo sapiens
cccttgccctgacctcccagc

SEQ ID NO: 4223750 - DNA, 16 bp, Homo sapiens
cccttgcccttgccct

SEQ ID NO: 4223751 - DNA, 17 bp, Homo sapiens
cccttgcccttgccctg

SEQ ID NO: 4223752 - DNA, 21 bp, Homo sapiens
ccgaacatatcatttgtgaag

SEQ ID NO: 4223753 - DNA, 13 bp, Homo sapiens
ccgacctcgtcct

SEQ ID NO: 4223754 - DNA, 20 bp, Homo sapiens
ccgagagcctgctcccccac

SEQ ID NO: 4223755 - DNA, 16 bp, Homo sapiens
ccgagagtagccgaga

SEQ ID NO: 4223756 - DNA, 20 bp, Homo sapiens
ccgagagtagccgagagcct

SEQ ID NO: 4223757 - DNA, 11 bp, Homo sapiens
ccgcaccccag

SEQ ID NO: 4223758 - DNA, 17 bp, Homo sapiens
ccgcaccccagagtgtg

SEQ ID NO: 4223759 - DNA, 23 bp, Homo sapiens
ccgcctcaatgtggttgcaaggc

SEQ ID NO: 4223760 - DNA, 19 bp, Homo sapiens
ccgctgcctaagtggctgc

SEQ ID NO: 4223761 - DNA, 21 bp, Homo sapiens
ccgctgttcacccacagggct

SEQ ID NO: 4223762 - DNA, 18 bp, Homo sapiens
ccgcttgtccagcgccta

SEQ ID NO: 4223763 - DNA, 22 bp, Homo sapiens
ccgggcatggtggcgcaagcct

SEQ ID NO: 4223764 - DNA, 16 bp, Homo sapiens
ccggtcacccaggctc

SEQ ID NO: 4223765 - DNA, 22 bp, Homo sapiens
ccggtcccttgagacctcagcc

SEQ ID NO: 4223766 - DNA, 14 bp, Homo sapiens
ccgtagttccctga

SEQ ID NO: 4223767 - DNA, 22 bp, Homo sapiens
ccgtagttccctgaaaacccag

SEQ ID NO: 4223768 - DNA, 20 bp, Homo sapiens
ccgtctggggttcagcccct

SEQ ID NO: 4223769 - DNA, 21 bp, Homo sapiens
ccgtctggggttcagcccctc

SEQ ID NO: 4223770 - DNA, 22 bp, Homo sapiens
ccgtctggggttcagcccctcc

SEQ ID NO: 4223771 - DNA, 14 bp, Homo sapiens
cctaagtggctgct

SEQ ID NO: 4223772 - DNA, 11 bp, Homo sapiens
cctaccccacc

SEQ ID NO: 4223773 - DNA, 14 bp, Homo sapiens
cctacctgctgctg

SEQ ID NO: 4223774 - DNA, 20 bp, Homo sapiens
cctaggccactcctccaaag

SEQ ID NO: 4223775 - DNA, 17 bp, Homo sapiens
cctagtggggtctccct

SEQ ID NO: 4223776 - DNA, 21 bp, Homo sapiens
cctagtggggtctccctctcc

SEQ ID NO: 4223777 - DNA, 24 bp, Homo sapiens
cctagtggggtctccctctcctgc

SEQ ID NO: 4223778 - DNA, 18 bp, Homo sapiens
cctataacttgatgcatg

SEQ ID NO: 4223779 - DNA, 21 bp, Homo sapiens
cctataccatatgtctgcttc

SEQ ID NO: 4223780 - DNA, 13 bp, Homo sapiens
cctcaaatgtcag

SEQ ID NO: 4223781 - DNA, 18 bp, Homo sapiens
cctcaaatgtcagagcta

SEQ ID NO: 4223782 - DNA, 21 bp, Homo sapiens
cctcaatgtgaatcagaccct

SEQ ID NO: 4223783 - DNA, 16 bp, Homo sapiens
cctcaccccgtctggg

SEQ ID NO: 4223784 - DNA, 17 bp, Homo sapiens
cctcaccccgtctgggg

SEQ ID NO: 4223785 - DNA, 20 bp, Homo sapiens
cctcagggacagagacacct

SEQ ID NO: 4223786 - DNA, 13 bp, Homo sapiens
cctcattcaggaa

SEQ ID NO: 4223787 - DNA, 17 bp, Homo sapiens
cctcattcaggaaaact

SEQ ID NO: 4223788 - DNA, 12 bp, Homo sapiens
cctccagggcca

SEQ ID NO: 4223789 - DNA, 14 bp, Homo sapiens
cctccagggccacg

SEQ ID NO: 4223790 - DNA, 18 bp, Homo sapiens
cctccagggccacgtgcc

SEQ ID NO: 4223791 - DNA, 20 bp, Homo sapiens
cctcccagccctatggatgt

SEQ ID NO: 4223792 - DNA, 12 bp, Homo sapiens
cctccccagggg

SEQ ID NO: 4223793 - DNA, 22 bp, Homo sapiens
cctccccaggggagagggtctg

SEQ ID NO: 4223794 - DNA, 17 bp, Homo sapiens
cctccccccactgcagg

SEQ ID NO: 4223795 - DNA, 15 bp, Homo sapiens
cctccccctgccagt

SEQ ID NO: 4223796 - DNA, 13 bp, Homo sapiens
cctcccctatcca

SEQ ID NO: 4223797 - DNA, 15 bp, Homo sapiens
cctcccctatccacc

SEQ ID NO: 4223798 - DNA, 14 bp, Homo sapiens
cctccctgtcctcc

SEQ ID NO: 4223799 - DNA, 13 bp, Homo sapiens
cctcctctgccac

SEQ ID NO: 4223800 - DNA, 14 bp, Homo sapiens
cctcctctgccacc

SEQ ID NO: 4223801 - DNA, 18 bp, Homo sapiens
cctcctctgccacctccc

SEQ ID NO: 4223802 - DNA, 12 bp, Homo sapiens
cctcctgcccag

SEQ ID NO: 4223803 - DNA, 23 bp, Homo sapiens
cctcctgcccaggagagccagcc

SEQ ID NO: 4223804 - DNA, 14 bp, Homo sapiens
cctcgaagtcccgg

SEQ ID NO: 4223805 - DNA, 19 bp, Homo sapiens
cctcgtcctccccctgcca

SEQ ID NO: 4223806 - DNA, 21 bp, Homo sapiens
cctcgtcctccccctgccagt

SEQ ID NO: 4223807 - DNA, 23 bp, Homo sapiens
cctctaataaagctcctctgctc

SEQ ID NO: 4223808 - DNA, 21 bp, Homo sapiens
cctctgaaaccctcctccaca

SEQ ID NO: 4223809 - DNA, 16 bp, Homo sapiens
cctctgaggaagaagg

SEQ ID NO: 4223810 - DNA, 11 bp, Homo sapiens
cctctgccacc

SEQ ID NO: 4223811 - DNA, 16 bp, Homo sapiens
cctctgccacctcccc

SEQ ID NO: 4223812 - DNA, 13 bp, Homo sapiens
cctctgcctcaat

SEQ ID NO: 4223813 - DNA, 14 bp, Homo sapiens
cctctgcctcaatg

SEQ ID NO: 4223814 - DNA, 12 bp, Homo sapiens
cctctggccctg

SEQ ID NO: 4223815 - DNA, 15 bp, Homo sapiens
cctctggccctgcct

SEQ ID NO: 4223816 - DNA, 17 bp, Homo sapiens
cctctggccctgccttc

SEQ ID NO: 4223817 - DNA, 18 bp, Homo sapiens
cctctggccctgccttct

SEQ ID NO: 4223818 - DNA, 23 bp, Homo sapiens
cctctggctggctaactggaagc

SEQ ID NO: 4223819 - DNA, 18 bp, Homo sapiens
cctctgtcctgcttctga

SEQ ID NO: 4223820 - DNA, 17 bp, Homo sapiens
cctcttccccttgccct

SEQ ID NO: 4223821 - DNA, 21 bp, Homo sapiens
cctcttccccttgcccttgcc

SEQ ID NO: 4223822 - DNA, 17 bp, Homo sapiens
cctgaaaacccagagag

SEQ ID NO: 4223823 - DNA, 23 bp, Homo sapiens
cctgaaattaatttgtgaatttg

SEQ ID NO: 4223824 - DNA, 19 bp, Homo sapiens
cctgaagtaagcaaagact

SEQ ID NO: 4223825 - DNA, 14 bp, Homo sapiens
cctgagtcaccagg

SEQ ID NO: 4223826 - DNA, 15 bp, Homo sapiens
cctgagtcaccagga

SEQ ID NO: 4223827 - DNA, 14 bp, Homo sapiens
cctgcacctccccc

SEQ ID NO: 4223828 - DNA, 20 bp, Homo sapiens
cctgcacctccccccactgc

SEQ ID NO: 4223829 - DNA, 21 bp, Homo sapiens
cctgcacctccccccactgca

SEQ ID NO: 4223830 - DNA, 17 bp, Homo sapiens
cctgccaccctcctgcg

SEQ ID NO: 4223831 - DNA, 13 bp, Homo sapiens
cctgccagtgcct

SEQ ID NO: 4223832 - DNA, 17 bp, Homo sapiens
cctgccagtgccttacc

SEQ ID NO: 4223833 - DNA, 19 bp, Homo sapiens
cctgcgggcttttccccgg

SEQ ID NO: 4223834 - DNA, 21 bp, Homo sapiens
cctgcgggcttttccccggtc

SEQ ID NO: 4223835 - DNA, 17 bp, Homo sapiens
cctgcgtcctctgtccc

SEQ ID NO: 4223836 - DNA, 16 bp, Homo sapiens
cctgctcccccacccc

SEQ ID NO: 4223837 - DNA, 23 bp, Homo sapiens
cctgctgaatgatttccaaagag

SEQ ID NO: 4223838 - DNA, 23 bp, Homo sapiens
cctgctgacatagtggatggaca

SEQ ID NO: 4223839 - DNA, 17 bp, Homo sapiens
cctgctgggctctccac

SEQ ID NO: 4223840 - DNA, 19 bp, Homo sapiens
cctgctgggctctccacct

SEQ ID NO: 4223841 - DNA, 22 bp, Homo sapiens
cctggaaatatcagttactcag

SEQ ID NO: 4223842 - DNA, 20 bp, Homo sapiens
cctggccccatgtctctcag

SEQ ID NO: 4223843 - DNA, 23 bp, Homo sapiens
cctggccggcaaccccagttctg

SEQ ID NO: 4223844 - DNA, 21 bp, Homo sapiens
cctgggccccaccacctaggc

SEQ ID NO: 4223845 - DNA, 18 bp, Homo sapiens
cctgggtctaaggggttg

SEQ ID NO: 4223846 - DNA, 17 bp, Homo sapiens
cctgggtggggctgctc

SEQ ID NO: 4223847 - DNA, 21 bp, Homo sapiens
cctgggtggggctgctcctcc

SEQ ID NO: 4223848 - DNA, 23 bp, Homo sapiens
cctgggtggggctgctcctccag

SEQ ID NO: 4223849 - DNA, 22 bp, Homo sapiens
cctgtaaatagttttaaatatg

SEQ ID NO: 4223850 - DNA, 13 bp, Homo sapiens
cctgtaatcccag

SEQ ID NO: 4223851 - DNA, 15 bp, Homo sapiens
cctgtaatcccagct

SEQ ID NO: 4223852 - DNA, 14 bp, Homo sapiens
cctgtcaccaagct

SEQ ID NO: 4223853 - DNA, 16 bp, Homo sapiens
cctgtcacctggcctg

SEQ ID NO: 4223854 - DNA, 14 bp, Homo sapiens
cctgtcctcctcgg

SEQ ID NO: 4223855 - DNA, 15 bp, Homo sapiens
cctgtcctcctcgga

SEQ ID NO: 4223856 - DNA, 14 bp, Homo sapiens
cctgtgaggcaggg

SEQ ID NO: 4223857 - DNA, 15 bp, Homo sapiens
cctgtggcggtgcct

SEQ ID NO: 4223858 - DNA, 17 bp, Homo sapiens
cctgtggcggtgcctgg

SEQ ID NO: 4223859 - DNA, 19 bp, Homo sapiens
cctgtggcggtgcctgggt

SEQ ID NO: 4223860 - DNA, 20 bp, Homo sapiens
cctgtggcggtgcctgggtg

SEQ ID NO: 4223861 - DNA, 11 bp, Homo sapiens
ccttcagtgcc

SEQ ID NO: 4223862 - DNA, 18 bp, Homo sapiens
ccttcagtgcccaccaac

SEQ ID NO: 4223863 - DNA, 12 bp, Homo sapiens
ccttccatttct

SEQ ID NO: 4223864 - DNA, 13 bp, Homo sapiens
ccttccatttctt

SEQ ID NO: 4223865 - DNA, 14 bp, Homo sapiens
ccttcccagctctc

SEQ ID NO: 4223866 - DNA, 19 bp, Homo sapiens
ccttcccagctctccctct

SEQ ID NO: 4223867 - DNA, 21 bp, Homo sapiens
ccttcccagctctccctctgg

SEQ ID NO: 4223868 - DNA, 15 bp, Homo sapiens
ccttccttccctggc

SEQ ID NO: 4223869 - DNA, 20 bp, Homo sapiens
ccttcttattctcactccac

SEQ ID NO: 4223870 - DNA, 13 bp, Homo sapiens
ccttctttcctct

SEQ ID NO: 4223871 - DNA, 17 bp, Homo sapiens
ccttctttcctcttccc

SEQ ID NO: 4223872 - DNA, 17 bp, Homo sapiens
ccttgacaacagactga

SEQ ID NO: 4223873 - DNA, 14 bp, Homo sapiens
ccttgagacctcag

SEQ ID NO: 4223874 - DNA, 18 bp, Homo sapiens
ccttgagacctcagccat

SEQ ID NO: 4223875 - DNA, 13 bp, Homo sapiens
ccttgcacctgca

SEQ ID NO: 4223876 - DNA, 14 bp, Homo sapiens
ccttgcacctgcat

SEQ ID NO: 4223877 - DNA, 12 bp, Homo sapiens
ccttgccctgac

SEQ ID NO: 4223878 - DNA, 23 bp, Homo sapiens
ccttgccctgacctcccagccct

SEQ ID NO: 4223879 - DNA, 15 bp, Homo sapiens
ccttgcccttgccct

SEQ ID NO: 4223880 - DNA, 18 bp, Homo sapiens
ccttgcccttgccctgac

SEQ ID NO: 4223881 - DNA, 13 bp, Homo sapiens
ccttgggcctttc

SEQ ID NO: 4223882 - DNA, 13 bp, Homo sapiens
ccttgtgtttctg

SEQ ID NO: 4223883 - DNA, 14 bp, Homo sapiens
ccttgtgtttctgt

SEQ ID NO: 4223884 - DNA, 16 bp, Homo sapiens
ccttgtgtttctgtgg

SEQ ID NO: 4223885 - DNA, 22 bp, Homo sapiens
cctttctgctcctttctccaca

SEQ ID NO: 4223886 - DNA, 12 bp, Homo sapiens
cctttgcattca

SEQ ID NO: 4223887 - DNA, 23 bp, Homo sapiens
cgaaaggatgtaaacagtgcctg

SEQ ID NO: 4223888 - DNA, 15 bp, Homo sapiens
cgaacatgaccaaaa

SEQ ID NO: 4223889 - DNA, 23 bp, Homo sapiens
cgacctcgtcctccccctgccag

SEQ ID NO: 4223890 - DNA, 21 bp, Homo sapiens
cgagagcctgctcccccaccc

SEQ ID NO: 4223891 - DNA, 15 bp, Homo sapiens
cgagataatgtatat

SEQ ID NO: 4223892 - DNA, 22 bp, Homo sapiens
cgagcactttattctcctccga

SEQ ID NO: 4223893 - DNA, 23 bp, Homo sapiens
cgaggtggatcacagaggcttct

SEQ ID NO: 4223894 - DNA, 11 bp, Homo sapiens
cgatgtggccc

SEQ ID NO: 4223895 - DNA, 15 bp, Homo sapiens
cgatgtggccctggc

SEQ ID NO: 4223896 - DNA, 20 bp, Homo sapiens
cgcaagcctgtaatcccagc

SEQ ID NO: 4223897 - DNA, 14 bp, Homo sapiens
cgcaccccagagtg

SEQ ID NO: 4223898 - DNA, 13 bp, Homo sapiens
cgcatcttctcca

SEQ ID NO: 4223899 - DNA, 22 bp, Homo sapiens
cgcctcaatgtggttgcaaggc

SEQ ID NO: 4223900 - DNA, 18 bp, Homo sapiens
cgcctgtaatcccagcag

SEQ ID NO: 4223901 - DNA, 16 bp, Homo sapiens
cgctctgctggcctgg

SEQ ID NO: 4223902 - DNA, 20 bp, Homo sapiens
cgctgccgcaccccagagtg

SEQ ID NO: 4223903 - DNA, 20 bp, Homo sapiens
cgctgcctaagtggctgctg

SEQ ID NO: 4223904 - DNA, 20 bp, Homo sapiens
cgctgggggctggacctgct

SEQ ID NO: 4223905 - DNA, 23 bp, Homo sapiens
cggatcaccgagagtagccgaga

SEQ ID NO: 4223906 - DNA, 17 bp, Homo sapiens
cggcaaccccagttctg

SEQ ID NO: 4223907 - DNA, 12 bp, Homo sapiens
cggcccacagct

SEQ ID NO: 4223908 - DNA, 15 bp, Homo sapiens
cggcccacagctccc

SEQ ID NO: 4223909 - DNA, 13 bp, Homo sapiens
cggccgcattccc

SEQ ID NO: 4223910 - DNA, 20 bp, Homo sapiens
cggcgcggtggctcacgcct

SEQ ID NO: 4223911 - DNA, 21 bp, Homo sapiens
cggctactcagcagccctcct

SEQ ID NO: 4223912 - DNA, 22 bp, Homo sapiens
cggctccccattttataccaaa

SEQ ID NO: 4223913 - DNA, 22 bp, Homo sapiens
cggctgagtcatgatctccctg

SEQ ID NO: 4223914 - DNA, 19 bp, Homo sapiens
cggctttctaatagagaga

SEQ ID NO: 4223915 - DNA, 19 bp, Homo sapiens
cggtcccttgagacctcag

SEQ ID NO: 4223916 - DNA, 13 bp, Homo sapiens
cgtagttccctga

SEQ ID NO: 4223917 - DNA, 15 bp, Homo sapiens
cgtcctccccctgcc

SEQ ID NO: 4223918 - DNA, 16 bp, Homo sapiens
cgtctgcacttctgtt

SEQ ID NO: 4223919 - DNA, 18 bp, Homo sapiens
cgtctgcacttctgttcc

SEQ ID NO: 4223920 - DNA, 16 bp, Homo sapiens
cgtgactcacccaagc

SEQ ID NO: 4223921 - DNA, 22 bp, Homo sapiens
cgtgactgccccaactcctgga

SEQ ID NO: 4223922 - DNA, 17 bp, Homo sapiens
cgtgccgttactctcca

SEQ ID NO: 4223923 - DNA, 19 bp, Homo sapiens
ctaaaatattttagatgtt

SEQ ID NO: 4223924 - DNA, 22 bp, Homo sapiens
ctaaagaaatatattattcatc

SEQ ID NO: 4223925 - DNA, 11 bp, Homo sapiens
ctaaaggtgct

SEQ ID NO: 4223926 - DNA, 16 bp, Homo sapiens
ctaaattaaaaaagaa

SEQ ID NO: 4223927 - DNA, 13 bp, Homo sapiens
ctaacccctttcc

SEQ ID NO: 4223928 - DNA, 19 bp, Homo sapiens
ctaagccacagcttcttca

SEQ ID NO: 4223929 - DNA, 13 bp, Homo sapiens
ctaatagctgcta

SEQ ID NO: 4223930 - DNA, 19 bp, Homo sapiens
ctaatgtctcttcctctgt

SEQ ID NO: 4223931 - DNA, 23 bp, Homo sapiens
ctaatgtctcttcctctgttcta

SEQ ID NO: 4223932 - DNA, 14 bp, Homo sapiens
ctaattagaaatca

SEQ ID NO: 4223933 - DNA, 17 bp, Homo sapiens
ctacagagaaaatgaat

SEQ ID NO: 4223934 - DNA, 13 bp, Homo sapiens
ctaccccaccacg

SEQ ID NO: 4223935 - DNA, 18 bp, Homo sapiens
ctaccttccagttcctca

SEQ ID NO: 4223936 - DNA, 16 bp, Homo sapiens
ctactcagcagccctc

SEQ ID NO: 4223937 - DNA, 20 bp, Homo sapiens
ctactcagcagccctcctca

SEQ ID NO: 4223938 - DNA, 16 bp, Homo sapiens
ctactcaggaggctga

SEQ ID NO: 4223939 - DNA, 16 bp, Homo sapiens
ctactttctattcttt

SEQ ID NO: 4223940 - DNA, 20 bp, Homo sapiens
ctagaagtgggccaggacag

SEQ ID NO: 4223941 - DNA, 21 bp, Homo sapiens
ctagaagtgggccaggacagg

SEQ ID NO: 4223942 - DNA, 16 bp, Homo sapiens
ctaggccactcctcca

SEQ ID NO: 4223943 - DNA, 17 bp, Homo sapiens
ctaggccactcctccaa

SEQ ID NO: 4223944 - DNA, 22 bp, Homo sapiens
ctagtggggtctccctctcctg

SEQ ID NO: 4223945 - DNA, 23 bp, Homo sapiens
ctagttcagatacagggtgctcc

SEQ ID NO: 4223946 - DNA, 15 bp, Homo sapiens
ctagtttacttgctc

SEQ ID NO: 4223947 - DNA, 16 bp, Homo sapiens
ctagttttactttgaa

SEQ ID NO: 4223948 - DNA, 15 bp, Homo sapiens
ctataacttgatgca

SEQ ID NO: 4223949 - DNA, 22 bp, Homo sapiens
ctataacttgatgcatgtggtt

SEQ ID NO: 4223950 - DNA, 20 bp, Homo sapiens
ctataccatatgtctgcttc

SEQ ID NO: 4223951 - DNA, 20 bp, Homo sapiens
ctatataatatatcatcttt

SEQ ID NO: 4223952 - DNA, 12 bp, Homo sapiens
ctatccacccag

SEQ ID NO: 4223953 - DNA, 13 bp, Homo sapiens
ctatccacccagc

SEQ ID NO: 4223954 - DNA, 14 bp, Homo sapiens
ctatccacccagcc

SEQ ID NO: 4223955 - DNA, 19 bp, Homo sapiens
ctatccacccagcccattc

SEQ ID NO: 4223956 - DNA, 20 bp, Homo sapiens
ctatctagcagtaaaagata

SEQ ID NO: 4223957 - DNA, 13 bp, Homo sapiens
ctatgttccctcc

SEQ ID NO: 4223958 - DNA, 16 bp, Homo sapiens
ctattaagatttccaa

SEQ ID NO: 4223959 - DNA, 17 bp, Homo sapiens
ctattaagatttccaag

SEQ ID NO: 4223960 - DNA, 21 bp, Homo sapiens
ctattatgtaacatccagaag

SEQ ID NO: 4223961 - DNA, 17 bp, Homo sapiens
ctatttaacatgggagg

SEQ ID NO: 4223962 - DNA, 14 bp, Homo sapiens
ctatttttattcct

SEQ ID NO: 4223963 - DNA, 13 bp, Homo sapiens
ctcaaaagccaaa

SEQ ID NO: 4223964 - DNA, 16 bp, Homo sapiens
ctcaaaagccaaaaaa

SEQ ID NO: 4223965 - DNA, 17 bp, Homo sapiens
ctcaaattgttaggaag

SEQ ID NO: 4223966 - DNA, 16 bp, Homo sapiens
ctcaagggtccagaag

SEQ ID NO: 4223967 - DNA, 18 bp, Homo sapiens
ctcaatctaaattaaaaa

SEQ ID NO: 4223968 - DNA, 20 bp, Homo sapiens
ctcaatgtgaatcagaccct

SEQ ID NO: 4223969 - DNA, 19 bp, Homo sapiens
ctcacaggttggaagagaa

SEQ ID NO: 4223970 - DNA, 20 bp, Homo sapiens
ctcacagttcctcgccctgg

SEQ ID NO: 4223971 - DNA, 21 bp, Homo sapiens
ctcacagttcctcgccctggg

SEQ ID NO: 4223972 - DNA, 15 bp, Homo sapiens
ctcaccccgtctggg

SEQ ID NO: 4223973 - DNA, 15 bp, Homo sapiens
ctcacctctgcctca

SEQ ID NO: 4223974 - DNA, 16 bp, Homo sapiens
ctcacctctgcctcaa

SEQ ID NO: 4223975 - DNA, 24 bp, Homo sapiens
ctcactttccaccctctctccacc

SEQ ID NO: 4223976 - DNA, 13 bp, Homo sapiens
ctcagacccccac

SEQ ID NO: 4223977 - DNA, 15 bp, Homo sapiens
ctcagacccccactc

SEQ ID NO: 4223978 - DNA, 17 bp, Homo sapiens
ctcagcagccctcctca

SEQ ID NO: 4223979 - DNA, 18 bp, Homo sapiens
ctcagcagccctcctcac

SEQ ID NO: 4223980 - DNA, 21 bp, Homo sapiens
ctcagccctgggccccaccac

SEQ ID NO: 4223981 - DNA, 15 bp, Homo sapiens
ctcaggaggctgagg

SEQ ID NO: 4223982 - DNA, 20 bp, Homo sapiens
ctcaggaggctgaggcagaa

SEQ ID NO: 4223983 - DNA, 14 bp, Homo sapiens
ctcagggacagaga

SEQ ID NO: 4223984 - DNA, 20 bp, Homo sapiens
ctcagggacagagacacctg

SEQ ID NO: 4223985 - DNA, 21 bp, Homo sapiens
ctcagggacagagacacctgc

SEQ ID NO: 4223986 - DNA, 23 bp, Homo sapiens
ctcagggacagagacacctgcac

SEQ ID NO: 4223987 - DNA, 15 bp, Homo sapiens
ctcatctatgtcata

SEQ ID NO: 4223988 - DNA, 22 bp, Homo sapiens
ctcattcaggaaaactgacaga

SEQ ID NO: 4223989 - DNA, 18 bp, Homo sapiens
ctcattttcatcttcttc

SEQ ID NO: 4223990 - DNA, 22 bp, Homo sapiens
ctccaaaggaagtctaggagct

SEQ ID NO: 4223991 - DNA, 20 bp, Homo sapiens
ctccaagaggctccctcctg

SEQ ID NO: 4223992 - DNA, 16 bp, Homo sapiens
ctccaaggtttataaa

SEQ ID NO: 4223993 - DNA, 17 bp, Homo sapiens
ctccaaggtttataaag

SEQ ID NO: 4223994 - DNA, 19 bp, Homo sapiens
ctccaaggtttataaagca

SEQ ID NO: 4223995 - DNA, 12 bp, Homo sapiens
ctccaccaaccc

SEQ ID NO: 4223996 - DNA, 12 bp, Homo sapiens
ctccaccaccca

SEQ ID NO: 4223997 - DNA, 19 bp, Homo sapiens
ctccaccgctgcctaagtg

SEQ ID NO: 4223998 - DNA, 12 bp, Homo sapiens
ctccacctcagc

SEQ ID NO: 4223999 - DNA, 14 bp, Homo sapiens
ctccacctcagcct

SEQ ID NO: 4224000 - DNA, 17 bp, Homo sapiens
ctccacctcagccttgg

SEQ ID NO: 4224001 - DNA, 18 bp, Homo sapiens
ctccacctcagccttgga

SEQ ID NO: 4224002 - DNA, 15 bp, Homo sapiens
ctccactccttccca

SEQ ID NO: 4224003 - DNA, 20 bp, Homo sapiens
ctccagagtgtgcagactga

SEQ ID NO: 4224004 - DNA, 17 bp, Homo sapiens
ctccaggatttataaag

SEQ ID NO: 4224005 - DNA, 16 bp, Homo sapiens
ctccaggcacccttct

SEQ ID NO: 4224006 - DNA, 23 bp, Homo sapiens
ctccagggccacgtgccaggccc

SEQ ID NO: 4224007 - DNA, 13 bp, Homo sapiens
ctccatcattcat

SEQ ID NO: 4224008 - DNA, 20 bp, Homo sapiens
ctcccacccaaccaactttc

SEQ ID NO: 4224009 - DNA, 12 bp, Homo sapiens
ctcccaccccac

SEQ ID NO: 4224010 - DNA, 23 bp, Homo sapiens
ctcccaccccacccccttcagtg

SEQ ID NO: 4224011 - DNA, 20 bp, Homo sapiens
ctcccactgcaacttgtgaa

SEQ ID NO: 4224012 - DNA, 16 bp, Homo sapiens
ctcccagccctatgga

SEQ ID NO: 4224013 - DNA, 21 bp, Homo sapiens
ctccccaggggagagggtctg

SEQ ID NO: 4224014 - DNA, 19 bp, Homo sapiens
ctccccattttataccaaa

SEQ ID NO: 4224015 - DNA, 19 bp, Homo sapiens
ctcccccaccccctcccca

SEQ ID NO: 4224016 - DNA, 13 bp, Homo sapiens
ctccccccactgc

SEQ ID NO: 4224017 - DNA, 18 bp, Homo sapiens
ctccccctgccagtgcct

SEQ ID NO: 4224018 - DNA, 17 bp, Homo sapiens
ctcccctatccacccag

SEQ ID NO: 4224019 - DNA, 18 bp, Homo sapiens
ctcccctatccacccagc

SEQ ID NO: 4224020 - DNA, 15 bp, Homo sapiens
ctccctgccgcctca

SEQ ID NO: 4224021 - DNA, 16 bp, Homo sapiens
ctccctgccgcctcaa

SEQ ID NO: 4224022 - DNA, 19 bp, Homo sapiens
ctccctgccgcctcaatgt

SEQ ID NO: 4224023 - DNA, 11 bp, Homo sapiens
ctccctgtcct

SEQ ID NO: 4224024 - DNA, 13 bp, Homo sapiens
ctccctgtcctcc

SEQ ID NO: 4224025 - DNA, 16 bp, Homo sapiens
ctccctgtcctcctcg

SEQ ID NO: 4224026 - DNA, 18 bp, Homo sapiens
ctccctgtcctcctcgga

SEQ ID NO: 4224027 - DNA, 15 bp, Homo sapiens
ctcctcaccccgtct

SEQ ID NO: 4224028 - DNA, 19 bp, Homo sapiens
ctcctccagggccacgtgc

SEQ ID NO: 4224029 - DNA, 22 bp, Homo sapiens
ctcctccagggccacgtgccag

SEQ ID NO: 4224030 - DNA, 18 bp, Homo sapiens
ctcctccctttccttcct

SEQ ID NO: 4224031 - DNA, 19 bp, Homo sapiens
ctcctcgaagtcccggctt

SEQ ID NO: 4224032 - DNA, 11 bp, Homo sapiens
ctcctctccag

SEQ ID NO: 4224033 - DNA, 17 bp, Homo sapiens
ctcctctgccacctccc

SEQ ID NO: 4224034 - DNA, 17 bp, Homo sapiens
ctcctctgtcctgcttc

SEQ ID NO: 4224035 - DNA, 13 bp, Homo sapiens
ctcctgcccagga

SEQ ID NO: 4224036 - DNA, 15 bp, Homo sapiens
ctcctggaagctgtg

SEQ ID NO: 4224037 - DNA, 17 bp, Homo sapiens
ctcctggaagctgtgtc

SEQ ID NO: 4224038 - DNA, 23 bp, Homo sapiens
ctcctggaagctgtgtccttgca

SEQ ID NO: 4224039 - DNA, 17 bp, Homo sapiens
ctcctttctccacaccc

SEQ ID NO: 4224040 - DNA, 21 bp, Homo sapiens
ctcgggtggctagtcagagag

SEQ ID NO: 4224041 - DNA, 22 bp, Homo sapiens
ctctaccccaaagaattcctga

SEQ ID NO: 4224042 - DNA, 21 bp, Homo sapiens
ctctcattccccaggtggctg

SEQ ID NO: 4224043 - DNA, 14 bp, Homo sapiens
ctctccaacctgga

SEQ ID NO: 4224044 - DNA, 18 bp, Homo sapiens
ctctccaggcacccttct

SEQ ID NO: 4224045 - DNA, 12 bp, Homo sapiens
ctctccctctgg

SEQ ID NO: 4224046 - DNA, 12 bp, Homo sapiens
ctctcctgtcca

SEQ ID NO: 4224047 - DNA, 14 bp, Homo sapiens
ctctctaagccaca

SEQ ID NO: 4224048 - DNA, 23 bp, Homo sapiens
ctctctaagccacagcttcttca

SEQ ID NO: 4224049 - DNA, 15 bp, Homo sapiens
ctctctcctgtccaa

SEQ ID NO: 4224050 - DNA, 15 bp, Homo sapiens
ctctctggtggctct

SEQ ID NO: 4224051 - DNA, 15 bp, Homo sapiens
ctctgcagccagccc

SEQ ID NO: 4224052 - DNA, 12 bp, Homo sapiens
ctctgccacctc

SEQ ID NO: 4224053 - DNA, 14 bp, Homo sapiens
ctctgctggcctgg

SEQ ID NO: 4224054 - DNA, 15 bp, Homo sapiens
ctctgctggcctggc

SEQ ID NO: 4224055 - DNA, 15 bp, Homo sapiens
ctctgctttggaaat

SEQ ID NO: 4224056 - DNA, 14 bp, Homo sapiens
ctctggagccagag

SEQ ID NO: 4224057 - DNA, 15 bp, Homo sapiens
ctctggagccagaga

SEQ ID NO: 4224058 - DNA, 14 bp, Homo sapiens
ctctggattttgaa

SEQ ID NO: 4224059 - DNA, 18 bp, Homo sapiens
ctctggccctgccttctt

SEQ ID NO: 4224060 - DNA, 23 bp, Homo sapiens
ctctggctggctaactggaagca

SEQ ID NO: 4224061 - DNA, 15 bp, Homo sapiens
ctctgtcctgcttct

SEQ ID NO: 4224062 - DNA, 16 bp, Homo sapiens
ctctgtcctgcttctg

SEQ ID NO: 4224063 - DNA, 16 bp, Homo sapiens
ctctgtgcccctgtaa

SEQ ID NO: 4224064 - DNA, 18 bp, Homo sapiens
ctcttccccttgcccttg

SEQ ID NO: 4224065 - DNA, 15 bp, Homo sapiens
ctgaagccagatcca

SEQ ID NO: 4224066 - DNA, 13 bp, Homo sapiens
ctgaataaaccag

SEQ ID NO: 4224067 - DNA, 12 bp, Homo sapiens
ctgacagaggag

SEQ ID NO: 4224068 - DNA, 18 bp, Homo sapiens
ctgacatagtggatggac

SEQ ID NO: 4224069 - DNA, 20 bp, Homo sapiens
ctgacatagtggatggacag

SEQ ID NO: 4224070 - DNA, 12 bp, Homo sapiens
ctgacccagtcc

SEQ ID NO: 4224071 - DNA, 13 bp, Homo sapiens
ctgacccagtccc

SEQ ID NO: 4224072 - DNA, 18 bp, Homo sapiens
ctgacccagtccctgggg

SEQ ID NO: 4224073 - DNA, 18 bp, Homo sapiens
ctgacctcccagccctat

SEQ ID NO: 4224074 - DNA, 22 bp, Homo sapiens
ctgacctcccagccctatggat

SEQ ID NO: 4224075 - DNA, 19 bp, Homo sapiens
ctgagagacccaaggagga

SEQ ID NO: 4224076 - DNA, 22 bp, Homo sapiens
ctgagagtctgaaagacagaat

SEQ ID NO: 4224077 - DNA, 18 bp, Homo sapiens
ctgagatgcaaatgtcac

SEQ ID NO: 4224078 - DNA, 21 bp, Homo sapiens
ctgagatgcaaatgtcacagt

SEQ ID NO: 4224079 - DNA, 15 bp, Homo sapiens
ctgaggcagaagaat

SEQ ID NO: 4224080 - DNA, 21 bp, Homo sapiens
ctgagtcatgatctccctgcc

SEQ ID NO: 4224081 - DNA, 15 bp, Homo sapiens
ctgatgtttataaac

SEQ ID NO: 4224082 - DNA, 18 bp, Homo sapiens
ctgcaacttgtaaatgtg

SEQ ID NO: 4224083 - DNA, 20 bp, Homo sapiens
ctgcaacttgtgaactccat

SEQ ID NO: 4224084 - DNA, 18 bp, Homo sapiens
ctgcaagagccttggtgt

SEQ ID NO: 4224085 - DNA, 20 bp, Homo sapiens
ctgcacctccccccactgca

SEQ ID NO: 4224086 - DNA, 21 bp, Homo sapiens
ctgcacctccccccactgcag

SEQ ID NO: 4224087 - DNA, 17 bp, Homo sapiens
ctgcacttctgttccag

SEQ ID NO: 4224088 - DNA, 21 bp, Homo sapiens
ctgcagaacgtattggtccag

SEQ ID NO: 4224089 - DNA, 17 bp, Homo sapiens
ctgcagccagcccagcc

SEQ ID NO: 4224090 - DNA, 17 bp, Homo sapiens
ctgcagcccatcctccc

SEQ ID NO: 4224091 - DNA, 14 bp, Homo sapiens
ctgcaggccccgct

SEQ ID NO: 4224092 - DNA, 23 bp, Homo sapiens
ctgcaggccccgcttgtccagcg

SEQ ID NO: 4224093 - DNA, 20 bp, Homo sapiens
ctgccaaagaagccttgcca

SEQ ID NO: 4224094 - DNA, 12 bp, Homo sapiens
ctgccacctccc

SEQ ID NO: 4224095 - DNA, 13 bp, Homo sapiens
ctgcccaaattat

SEQ ID NO: 4224096 - DNA, 18 bp, Homo sapiens
ctgcccaaattatgtgaa

SEQ ID NO: 4224097 - DNA, 12 bp, Homo sapiens
ctgcccaggaga

SEQ ID NO: 4224098 - DNA, 18 bp, Homo sapiens
ctgcccaggagagccagc

SEQ ID NO: 4224099 - DNA, 19 bp, Homo sapiens
ctgcccaggagagccagcc

SEQ ID NO: 4224100 - DNA, 21 bp, Homo sapiens
ctgcccaggagagccagccct

SEQ ID NO: 4224101 - DNA, 22 bp, Homo sapiens
ctgcccaggagagccagccctc

SEQ ID NO: 4224102 - DNA, 14 bp, Homo sapiens
ctgccccaactcct

SEQ ID NO: 4224103 - DNA, 19 bp, Homo sapiens
ctgccgacctcgtcctccc

SEQ ID NO: 4224104 - DNA, 16 bp, Homo sapiens
ctgccgcaccccagag

SEQ ID NO: 4224105 - DNA, 16 bp, Homo sapiens
ctgcctaagtggctgc

SEQ ID NO: 4224106 - DNA, 19 bp, Homo sapiens
ctgcctaagtggctgctga

SEQ ID NO: 4224107 - DNA, 21 bp, Homo sapiens
ctgcctcaatgtgaatcagac

SEQ ID NO: 4224108 - DNA, 19 bp, Homo sapiens
ctgctcccacgcctgcttc

SEQ ID NO: 4224109 - DNA, 21 bp, Homo sapiens
ctgctcccccaccccctcccc

SEQ ID NO: 4224110 - DNA, 11 bp, Homo sapiens
ctgctcctcca

SEQ ID NO: 4224111 - DNA, 13 bp, Homo sapiens
ctgctcctccagg

SEQ ID NO: 4224112 - DNA, 14 bp, Homo sapiens
ctgctcctccaggg

SEQ ID NO: 4224113 - DNA, 21 bp, Homo sapiens
ctgctgagagacccaaggagg

SEQ ID NO: 4224114 - DNA, 16 bp, Homo sapiens
ctgctggcctggccgg

SEQ ID NO: 4224115 - DNA, 20 bp, Homo sapiens
ctgctggcctggccggcaac

SEQ ID NO: 4224116 - DNA, 21 bp, Homo sapiens
ctgctgggctctccacctcag

SEQ ID NO: 4224117 - DNA, 20 bp, Homo sapiens
ctgcttcttaaggtccctgc

SEQ ID NO: 4224118 - DNA, 23 bp, Homo sapiens
ctggaaatatcagttactcagcc

SEQ ID NO: 4224119 - DNA, 22 bp, Homo sapiens
ctggaagctgtgtccttgcacc

SEQ ID NO: 4224120 - DNA, 15 bp, Homo sapiens
ctggagcaccaggca

SEQ ID NO: 4224121 - DNA, 15 bp, Homo sapiens
ctggaggcagggcct

SEQ ID NO: 4224122 - DNA, 17 bp, Homo sapiens
ctggcattttctgttcc

SEQ ID NO: 4224123 - DNA, 15 bp, Homo sapiens
ctggcctgctgggct

SEQ ID NO: 4224124 - DNA, 15 bp, Homo sapiens
ctggcctggccggca

SEQ ID NO: 4224125 - DNA, 20 bp, Homo sapiens
ctggcggctactcagcagcc

SEQ ID NO: 4224126 - DNA, 16 bp, Homo sapiens
ctggctaactggaagc

SEQ ID NO: 4224127 - DNA, 13 bp, Homo sapiens
ctggctccctccc

SEQ ID NO: 4224128 - DNA, 19 bp, Homo sapiens
ctggctccctcccacccaa

SEQ ID NO: 4224129 - DNA, 17 bp, Homo sapiens
ctggcttgtaactccac

SEQ ID NO: 4224130 - DNA, 23 bp, Homo sapiens
ctgggaccctttccttccttccc

SEQ ID NO: 4224131 - DNA, 15 bp, Homo sapiens
ctgggagaaagacca

SEQ ID NO: 4224132 - DNA, 23 bp, Homo sapiens
ctgggagaaagaccatgcattta

SEQ ID NO: 4224133 - DNA, 14 bp, Homo sapiens
ctgggccccaccac

SEQ ID NO: 4224134 - DNA, 22 bp, Homo sapiens
ctgggctagggagaatgcagag

SEQ ID NO: 4224135 - DNA, 23 bp, Homo sapiens
ctgggctagggagaatgcagaga

SEQ ID NO: 4224136 - DNA, 14 bp, Homo sapiens
ctgggctctccacc

SEQ ID NO: 4224137 - DNA, 16 bp, Homo sapiens
ctgggctctccacctc

SEQ ID NO: 4224138 - DNA, 20 bp, Homo sapiens
ctgggctctccacctcagcc

SEQ ID NO: 4224139 - DNA, 21 bp, Homo sapiens
ctgggctctccacctcagcct

SEQ ID NO: 4224140 - DNA, 16 bp, Homo sapiens
ctgggggctggacctg

SEQ ID NO: 4224141 - DNA, 15 bp, Homo sapiens
ctggggttcagcccc

SEQ ID NO: 4224142 - DNA, 21 bp, Homo sapiens
ctggggttcagcccctcctct

SEQ ID NO: 4224143 - DNA, 23 bp, Homo sapiens
ctggggttcagcccctcctctgc

SEQ ID NO: 4224144 - DNA, 23 bp, Homo sapiens
ctgggtgcagtagtgagcaggac

SEQ ID NO: 4224145 - DNA, 18 bp, Homo sapiens
ctgggtggggctgctcct

SEQ ID NO: 4224146 - DNA, 22 bp, Homo sapiens
ctgggtggggctgctcctccag

SEQ ID NO: 4224147 - DNA, 13 bp, Homo sapiens
ctgggttggaaaa

SEQ ID NO: 4224148 - DNA, 17 bp, Homo sapiens
ctggtggctctttgggc

SEQ ID NO: 4224149 - DNA, 14 bp, Homo sapiens
ctgtaatcccagct

SEQ ID NO: 4224150 - DNA, 18 bp, Homo sapiens
ctgtaattaatattccta

SEQ ID NO: 4224151 - DNA, 15 bp, Homo sapiens
ctgtatctgtaatta

SEQ ID NO: 4224152 - DNA, 23 bp, Homo sapiens
ctgtcaccaagctcacagttcct

SEQ ID NO: 4224153 - DNA, 16 bp, Homo sapiens
ctgtcacctggcctgc

SEQ ID NO: 4224154 - DNA, 17 bp, Homo sapiens
ctgtcacctggcctgcc

SEQ ID NO: 4224155 - DNA, 19 bp, Homo sapiens
ctgtcacctggcctgccac

SEQ ID NO: 4224156 - DNA, 20 bp, Homo sapiens
ctgtccaacctaaccccttt

SEQ ID NO: 4224157 - DNA, 17 bp, Homo sapiens
ctgtccctgtcaccaag

SEQ ID NO: 4224158 - DNA, 13 bp, Homo sapiens
ctgtcctgcttct

SEQ ID NO: 4224159 - DNA, 20 bp, Homo sapiens
ctgtgaattgtggctgttca

SEQ ID NO: 4224160 - DNA, 18 bp, Homo sapiens
ctgtgatggggtgggcag

SEQ ID NO: 4224161 - DNA, 20 bp, Homo sapiens
ctgtgatggggtgggcaggg

SEQ ID NO: 4224162 - DNA, 15 bp, Homo sapiens
ctgtggttgcatttg

SEQ ID NO: 4224163 - DNA, 18 bp, Homo sapiens
ctgtgtccttgcacctgc

SEQ ID NO: 4224164 - DNA, 19 bp, Homo sapiens
ctgtgtccttgcacctgca

SEQ ID NO: 4224165 - DNA, 12 bp, Homo sapiens
ctgttcacccac

SEQ ID NO: 4224166 - DNA, 14 bp, Homo sapiens
ctgttcacccacag

SEQ ID NO: 4224167 - DNA, 12 bp, Homo sapiens
ctgttgtaatag

SEQ ID NO: 4224168 - DNA, 17 bp, Homo sapiens
ctgttgtaatagtccat

SEQ ID NO: 4224169 - DNA, 20 bp, Homo sapiens
cttaaattgtgggcaaaaga

SEQ ID NO: 4224170 - DNA, 12 bp, Homo sapiens
cttaccaaaaaa

SEQ ID NO: 4224171 - DNA, 13 bp, Homo sapiens
cttactgcagaat

SEQ ID NO: 4224172 - DNA, 18 bp, Homo sapiens
cttagaagtggaccagga

SEQ ID NO: 4224173 - DNA, 21 bp, Homo sapiens
cttagaagtggaccaggacag

SEQ ID NO: 4224174 - DNA, 22 bp, Homo sapiens
cttagaagtggaccaggacagg

SEQ ID NO: 4224175 - DNA, 22 bp, Homo sapiens
cttcaagtgcatgctctctgca

SEQ ID NO: 4224176 - DNA, 18 bp, Homo sapiens
cttcacactgcaagagcc

SEQ ID NO: 4224177 - DNA, 15 bp, Homo sapiens
cttcagtgggagaaa

SEQ ID NO: 4224178 - DNA, 20 bp, Homo sapiens
cttcccagctctccctctgg

SEQ ID NO: 4224179 - DNA, 21 bp, Homo sapiens
cttcccagctctccctctggc

SEQ ID NO: 4224180 - DNA, 22 bp, Homo sapiens
cttcccagctctccctctggcc

SEQ ID NO: 4224181 - DNA, 22 bp, Homo sapiens
cttcccagtataagatttttga

SEQ ID NO: 4224182 - DNA, 14 bp, Homo sapiens
cttccccttgccct

SEQ ID NO: 4224183 - DNA, 10 bp, Homo sapiens
cttccctggc

SEQ ID NO: 4224184 - DNA, 21 bp, Homo sapiens
cttcctaatttcccttcttgc

SEQ ID NO: 4224185 - DNA, 23 bp, Homo sapiens
cttcctaatttcccttcttgcat

SEQ ID NO: 4224186 - DNA, 15 bp, Homo sapiens
cttcctataacttga

SEQ ID NO: 4224187 - DNA, 17 bp, Homo sapiens
cttcctataacttgatg

SEQ ID NO: 4224188 - DNA, 19 bp, Homo sapiens
cttcctctgttctatccca

SEQ ID NO: 4224189 - DNA, 17 bp, Homo sapiens
cttctaccttaaaatgt

SEQ ID NO: 4224190 - DNA, 17 bp, Homo sapiens
cttctccatctggcagg

SEQ ID NO: 4224191 - DNA, 21 bp, Homo sapiens
cttctctgtgcccctgtaaat

SEQ ID NO: 4224192 - DNA, 20 bp, Homo sapiens
cttctgaatgtgctgatcat

SEQ ID NO: 4224193 - DNA, 18 bp, Homo sapiens
cttctgtccaggacatga

SEQ ID NO: 4224194 - DNA, 23 bp, Homo sapiens
cttctgtccaggacatgatactg

SEQ ID NO: 4224195 - DNA, 20 bp, Homo sapiens
cttcttcggggaactcctgg

SEQ ID NO: 4224196 - DNA, 15 bp, Homo sapiens
cttctttcctcttcc

SEQ ID NO: 4224197 - DNA, 12 bp, Homo sapiens
cttgcacctgca

SEQ ID NO: 4224198 - DNA, 13 bp, Homo sapiens
cttgcccagagat

SEQ ID NO: 4224199 - DNA, 22 bp, Homo sapiens
cttgcccagagatgcctccacc

SEQ ID NO: 4224200 - DNA, 16 bp, Homo sapiens
cttgcccttgccctga

SEQ ID NO: 4224201 - DNA, 18 bp, Homo sapiens
cttggataatgctgttgc

SEQ ID NO: 4224202 - DNA, 12 bp, Homo sapiens
cttgggcctttc

SEQ ID NO: 4224203 - DNA, 17 bp, Homo sapiens
cttggtgtccacctggc

SEQ ID NO: 4224204 - DNA, 19 bp, Homo sapiens
cttggtgtccacctggccc

SEQ ID NO: 4224205 - DNA, 21 bp, Homo sapiens
cttgtaactccaccaacccat

SEQ ID NO: 4224206 - DNA, 18 bp, Homo sapiens
cttgtccagcgcctagtg

SEQ ID NO: 4224207 - DNA, 22 bp, Homo sapiens
ctttaaaataaggataataatc

SEQ ID NO: 4224208 - DNA, 13 bp, Homo sapiens
ctttattctcctc

SEQ ID NO: 4224209 - DNA, 16 bp, Homo sapiens
ctttccttccttccct

SEQ ID NO: 4224210 - DNA, 19 bp, Homo sapiens
ctttccttgtggcagagga

SEQ ID NO: 4224211 - DNA, 22 bp, Homo sapiens
ctttcgaaagcaatgcttctat

SEQ ID NO: 4224212 - DNA, 13 bp, Homo sapiens
ctttctaatagag

SEQ ID NO: 4224213 - DNA, 17 bp, Homo sapiens
ctttctaatagagagat

SEQ ID NO: 4224214 - DNA, 20 bp, Homo sapiens
ctttctctttgccatttctt

SEQ ID NO: 4224215 - DNA, 19 bp, Homo sapiens
ctttgagtcccccagagat

SEQ ID NO: 4224216 - DNA, 20 bp, Homo sapiens
ctttgagtcccccagagatg

SEQ ID NO: 4224217 - DNA, 14 bp, Homo sapiens
ctttgccatttctt

SEQ ID NO: 4224218 - DNA, 22 bp, Homo sapiens
ctttggaaaatatttttttcct

SEQ ID NO: 4224219 - DNA, 13 bp, Homo sapiens
ctttgtaagaaaa

SEQ ID NO: 4224220 - DNA, 17 bp, Homo sapiens
ctttgtaatgtcaccac

SEQ ID NO: 4224221 - DNA, 22 bp, Homo sapiens
ctttgtacagtggagaaatatt

SEQ ID NO: 4224222 - DNA, 17 bp, Homo sapiens
cttttattcatttgagt

SEQ ID NO: 4224223 - DNA, 19 bp, Homo sapiens
cttttcttccccttcctct

SEQ ID NO: 4224224 - DNA, 22 bp, Homo sapiens
cttttcttccccttcctctctc

SEQ ID NO: 4224225 - DNA, 16 bp, Homo sapiens
cttttgaatatcttcc

SEQ ID NO: 4224226 - DNA, 23 bp, Homo sapiens
gaaaaaaaaaagaaaaaggaaaa

SEQ ID NO: 4224227 - DNA, 22 bp, Homo sapiens
gaaaaaactttctctttgccat

SEQ ID NO: 4224228 - DNA, 12 bp, Homo sapiens
gaaaaaattaac

SEQ ID NO: 4224229 - DNA, 10 bp, Homo sapiens
gaaaaaggaa

SEQ ID NO: 4224230 - DNA, 12 bp, Homo sapiens
gaaaaaggaaaa

SEQ ID NO: 4224231 - DNA, 16 bp, Homo sapiens
gaaaaataaaaaccat

SEQ ID NO: 4224232 - DNA, 13 bp, Homo sapiens
gaaaacccagaga

SEQ ID NO: 4224233 - DNA, 19 bp, Homo sapiens
gaaaactgcaacttgtaaa

SEQ ID NO: 4224234 - DNA, 20 bp, Homo sapiens
gaaaatcctgaataaaccag

SEQ ID NO: 4224235 - DNA, 23 bp, Homo sapiens
gaaaatgctgtattagtcacaga

SEQ ID NO: 4224236 - DNA, 18 bp, Homo sapiens
gaaaattaattatatttc

SEQ ID NO: 4224237 - DNA, 19 bp, Homo sapiens
gaaaattaattatatttct

SEQ ID NO: 4224238 - DNA, 22 bp, Homo sapiens
gaaacactgggcttctagaacc

SEQ ID NO: 4224239 - DNA, 22 bp, Homo sapiens
gaaacagacaagcaacccaaac

SEQ ID NO: 4224240 - DNA, 17 bp, Homo sapiens
gaaagaaatttgaaaaa

SEQ ID NO: 4224241 - DNA, 15 bp, Homo sapiens
gaaagatccaccctc

SEQ ID NO: 4224242 - DNA, 11 bp, Homo sapiens
gaaatattaaa

SEQ ID NO: 4224243 - DNA, 15 bp, Homo sapiens
gaaatgacccaaaca

SEQ ID NO: 4224244 - DNA, 23 bp, Homo sapiens
gaaatgcatccattcctcaggga

SEQ ID NO: 4224245 - DNA, 19 bp, Homo sapiens
gaaattaatttgtgaattt

SEQ ID NO: 4224246 - DNA, 21 bp, Homo sapiens
gaaattaatttgtgaatttgc

SEQ ID NO: 4224247 - DNA, 15 bp, Homo sapiens
gaaatttgaaaaaac

SEQ ID NO: 4224248 - DNA, 23 bp, Homo sapiens
gaaatttgaaaaaactttctctt

SEQ ID NO: 4224249 - DNA, 15 bp, Homo sapiens
gaacagacaggagaa

SEQ ID NO: 4224250 - DNA, 16 bp, Homo sapiens
gaacagacaggagaaa

SEQ ID NO: 4224251 - DNA, 17 bp, Homo sapiens
gaacagacaggagaaat

SEQ ID NO: 4224252 - DNA, 17 bp, Homo sapiens
gaacatatcatttgtga

SEQ ID NO: 4224253 - DNA, 19 bp, Homo sapiens
gaacatatcatttgtgaag

SEQ ID NO: 4224254 - DNA, 21 bp, Homo sapiens
gaacatatcatttgtgaagaa

SEQ ID NO: 4224255 - DNA, 22 bp, Homo sapiens
gaacatgaccaaaaaccaaaag

SEQ ID NO: 4224256 - DNA, 16 bp, Homo sapiens
gaacccaggaggtgga

SEQ ID NO: 4224257 - DNA, 19 bp, Homo sapiens
gaactagttttactttgaa

SEQ ID NO: 4224258 - DNA, 15 bp, Homo sapiens
gaactcctaaatcaa

SEQ ID NO: 4224259 - DNA, 23 bp, Homo sapiens
gaagaattattcagtgaatttgt

SEQ ID NO: 4224260 - DNA, 17 bp, Homo sapiens
gaagaatttgagaagaa

SEQ ID NO: 4224261 - DNA, 15 bp, Homo sapiens
gaagaattttcagac

SEQ ID NO: 4224262 - DNA, 17 bp, Homo sapiens
gaagaattttcagaccc

SEQ ID NO: 4224263 - DNA, 18 bp, Homo sapiens
gaagatgtatgctttgaa

SEQ ID NO: 4224264 - DNA, 16 bp, Homo sapiens
gaagcatgtaggagaa

SEQ ID NO: 4224265 - DNA, 15 bp, Homo sapiens
gaagccctccttcca

SEQ ID NO: 4224266 - DNA, 19 bp, Homo sapiens
gaagccctccttccacgga

SEQ ID NO: 4224267 - DNA, 18 bp, Homo sapiens
gaagccctggatttcaga

SEQ ID NO: 4224268 - DNA, 19 bp, Homo sapiens
gaagccctggatttcagaa

SEQ ID NO: 4224269 - DNA, 12 bp, Homo sapiens
gaagctgtgtcc

SEQ ID NO: 4224270 - DNA, 20 bp, Homo sapiens
gaagctgtgtccttgcacct

SEQ ID NO: 4224271 - DNA, 22 bp, Homo sapiens
gaagctgtgtccttgcacctgc

SEQ ID NO: 4224272 - DNA, 17 bp, Homo sapiens
gaaggagaaggaaggag

SEQ ID NO: 4224273 - DNA, 15 bp, Homo sapiens
gaaggagactcacct

SEQ ID NO: 4224274 - DNA, 22 bp, Homo sapiens
gaagtctaggagctgggaggaa

SEQ ID NO: 4224275 - DNA, 16 bp, Homo sapiens
gaagtggaccaggaca

SEQ ID NO: 4224276 - DNA, 18 bp, Homo sapiens
gaagtggaccaggacagg

SEQ ID NO: 4224277 - DNA, 18 bp, Homo sapiens
gaagtgggccaggacagg

SEQ ID NO: 4224278 - DNA, 16 bp, Homo sapiens
gaatccaagcgaggtc

SEQ ID NO: 4224279 - DNA, 20 bp, Homo sapiens
gaatgatttccaaagagaaa

SEQ ID NO: 4224280 - DNA, 14 bp, Homo sapiens
gaatgcataaaatg

SEQ ID NO: 4224281 - DNA, 21 bp, Homo sapiens
gaatgcggccgcattccctga

SEQ ID NO: 4224282 - DNA, 17 bp, Homo sapiens
gaatgtcaccagtcctg

SEQ ID NO: 4224283 - DNA, 18 bp, Homo sapiens
gaattcctgaagccagat

SEQ ID NO: 4224284 - DNA, 18 bp, Homo sapiens
gaattgaacccaggaggt

SEQ ID NO: 4224285 - DNA, 14 bp, Homo sapiens
gaattgtccccagt

SEQ ID NO: 4224286 - DNA, 16 bp, Homo sapiens
gaatttgcaacagtaa

SEQ ID NO: 4224287 - DNA, 16 bp, Homo sapiens
gacaagcaacccaaac

SEQ ID NO: 4224288 - DNA, 17 bp, Homo sapiens
gacaagcaacccaaact

SEQ ID NO: 4224289 - DNA, 22 bp, Homo sapiens
gacaatactccctttaaagaga

SEQ ID NO: 4224290 - DNA, 14 bp, Homo sapiens
gacaatataaactg

SEQ ID NO: 4224291 - DNA, 14 bp, Homo sapiens
gacacatcaaatgc

SEQ ID NO: 4224292 - DNA, 16 bp, Homo sapiens
gacacctgcacctccc

SEQ ID NO: 4224293 - DNA, 19 bp, Homo sapiens
gacacctgcacctcccccc

SEQ ID NO: 4224294 - DNA, 15 bp, Homo sapiens
gacagagacacctgc

SEQ ID NO: 4224295 - DNA, 16 bp, Homo sapiens
gacagagacacctgca

SEQ ID NO: 4224296 - DNA, 13 bp, Homo sapiens
gacagatggacca

SEQ ID NO: 4224297 - DNA, 14 bp, Homo sapiens
gacagatggaccaa

SEQ ID NO: 4224298 - DNA, 20 bp, Homo sapiens
gacagcctgtggcggtgcct

SEQ ID NO: 4224299 - DNA, 15 bp, Homo sapiens
gacagctgtccctgt

SEQ ID NO: 4224300 - DNA, 17 bp, Homo sapiens
gacagctgtccctgtca

SEQ ID NO: 4224301 - DNA, 19 bp, Homo sapiens
gacaggaaaatcctctggc

SEQ ID NO: 4224302 - DNA, 20 bp, Homo sapiens
gacagtgaattgacccatgt

SEQ ID NO: 4224303 - DNA, 22 bp, Homo sapiens
gacatagtggatggacagatgg

SEQ ID NO: 4224304 - DNA, 21 bp, Homo sapiens
gacatgatactgatgccatgt

SEQ ID NO: 4224305 - DNA, 16 bp, Homo sapiens
gaccaacatggagaaa

SEQ ID NO: 4224306 - DNA, 17 bp, Homo sapiens
gaccaacatggagaaac

SEQ ID NO: 4224307 - DNA, 13 bp, Homo sapiens
gaccaacctgacc

SEQ ID NO: 4224308 - DNA, 16 bp, Homo sapiens
gaccaggacaggacca

SEQ ID NO: 4224309 - DNA, 13 bp, Homo sapiens
gacccaaggagga

SEQ ID NO: 4224310 - DNA, 14 bp, Homo sapiens
gacccaaggaggaa

SEQ ID NO: 4224311 - DNA, 15 bp, Homo sapiens
gacccagtccctggg

SEQ ID NO: 4224312 - DNA, 18 bp, Homo sapiens
gaccccagcggctgagtc

SEQ ID NO: 4224313 - DNA, 22 bp, Homo sapiens
gaccctttccttccttccctgg

SEQ ID NO: 4224314 - DNA, 23 bp, Homo sapiens
gaccctttccttccttccctggc

SEQ ID NO: 4224315 - DNA, 18 bp, Homo sapiens
gaccgcttgtttcttgtt

SEQ ID NO: 4224316 - DNA, 17 bp, Homo sapiens
gacctagctgttgtaaa

SEQ ID NO: 4224317 - DNA, 15 bp, Homo sapiens
gacctcccagcccta

SEQ ID NO: 4224318 - DNA, 15 bp, Homo sapiens
gacctcgtcctcccc

SEQ ID NO: 4224319 - DNA, 18 bp, Homo sapiens
gacctcgtcctccccctg

SEQ ID NO: 4224320 - DNA, 22 bp, Homo sapiens
gacctcgtcctccccctgccag

SEQ ID NO: 4224321 - DNA, 15 bp, Homo sapiens
gacctgctgacatag

SEQ ID NO: 4224322 - DNA, 18 bp, Homo sapiens
gactcaagggtccagaag

SEQ ID NO: 4224323 - DNA, 13 bp, Homo sapiens
gactcacctctgc

SEQ ID NO: 4224324 - DNA, 16 bp, Homo sapiens
gactcctttcctctga

SEQ ID NO: 4224325 - DNA, 14 bp, Homo sapiens
gacttcacactgca

SEQ ID NO: 4224326 - DNA, 16 bp, Homo sapiens
gagaaaatgaatttgg

SEQ ID NO: 4224327 - DNA, 12 bp, Homo sapiens
gagaaaccctgt

SEQ ID NO: 4224328 - DNA, 21 bp, Homo sapiens
gagaaggaaggagactcacct

SEQ ID NO: 4224329 - DNA, 17 bp, Homo sapiens
gagacacctgcacctcc

SEQ ID NO: 4224330 - DNA, 21 bp, Homo sapiens
gagacacctgcacctcccccc

SEQ ID NO: 4224331 - DNA, 22 bp, Homo sapiens
gagacagaccggggttcaagcc

SEQ ID NO: 4224332 - DNA, 15 bp, Homo sapiens
gagaccaacctgacc

SEQ ID NO: 4224333 - DNA, 13 bp, Homo sapiens
gagacctcagcca

SEQ ID NO: 4224334 - DNA, 14 bp, Homo sapiens
gagacctcagccat

SEQ ID NO: 4224335 - DNA, 15 bp, Homo sapiens
gagactcacctctgc

SEQ ID NO: 4224336 - DNA, 18 bp, Homo sapiens
gagactcacctctgcctc

SEQ ID NO: 4224337 - DNA, 23 bp, Homo sapiens
gagactcacctctgcctcaatgt

SEQ ID NO: 4224338 - DNA, 20 bp, Homo sapiens
gagagccagccctccctgtc

SEQ ID NO: 4224339 - DNA, 22 bp, Homo sapiens
gagagcctgctcccccaccccc

SEQ ID NO: 4224340 - DNA, 23 bp, Homo sapiens
gagagcctgctcccccaccccct

SEQ ID NO: 4224341 - DNA, 18 bp, Homo sapiens
gagagtagccgagagcct

SEQ ID NO: 4224342 - DNA, 22 bp, Homo sapiens
gagagtagccgagagcctgctc

SEQ ID NO: 4224343 - DNA, 14 bp, Homo sapiens
gagatgcctccacc

SEQ ID NO: 4224344 - DNA, 23 bp, Homo sapiens
gagcaccaggcacgaacccacct

SEQ ID NO: 4224345 - DNA, 20 bp, Homo sapiens
gagccagccctccctgtcct

SEQ ID NO: 4224346 - DNA, 21 bp, Homo sapiens
gagccgcatcttctccatctg

SEQ ID NO: 4224347 - DNA, 23 bp, Homo sapiens
gagcgtgtgcggctccagcccag

SEQ ID NO: 4224348 - DNA, 18 bp, Homo sapiens
gagctcagacccccactc

SEQ ID NO: 4224349 - DNA, 20 bp, Homo sapiens
gagctcagacccccactctc

SEQ ID NO: 4224350 - DNA, 21 bp, Homo sapiens
gagctcctctgtcctgcttct

SEQ ID NO: 4224351 - DNA, 14 bp, Homo sapiens
gagctgggaggaaa

SEQ ID NO: 4224352 - DNA, 13 bp, Homo sapiens
gaggaaagagagc

SEQ ID NO: 4224353 - DNA, 19 bp, Homo sapiens
gaggaatcgccccagactc

SEQ ID NO: 4224354 - DNA, 13 bp, Homo sapiens
gaggctgaggcag

SEQ ID NO: 4224355 - DNA, 18 bp, Homo sapiens
gaggctgaggcagaagaa

SEQ ID NO: 4224356 - DNA, 19 bp, Homo sapiens
gagggaagtttaaaaccca

SEQ ID NO: 4224357 - DNA, 20 bp, Homo sapiens
gagggcgtgactcacccaag

SEQ ID NO: 4224358 - DNA, 15 bp, Homo sapiens
gagggtctggagaag

SEQ ID NO: 4224359 - DNA, 17 bp, Homo sapiens
gaggtatgacctgggtg

SEQ ID NO: 4224360 - DNA, 16 bp, Homo sapiens
gaggtcaacagagaag

SEQ ID NO: 4224361 - DNA, 23 bp, Homo sapiens
gaggtcaacagagaaggcaggaa

SEQ ID NO: 4224362 - DNA, 15 bp, Homo sapiens
gaggtggaagccctc

SEQ ID NO: 4224363 - DNA, 20 bp, Homo sapiens
gaggtggaggttgcagtgag

SEQ ID NO: 4224364 - DNA, 15 bp, Homo sapiens
gaggttgcagtgagc

SEQ ID NO: 4224365 - DNA, 14 bp, Homo sapiens
gagtacgttaaaag

SEQ ID NO: 4224366 - DNA, 23 bp, Homo sapiens
gagtacgttaaaagcaaaaagat

SEQ ID NO: 4224367 - DNA, 17 bp, Homo sapiens
gagtagccgagagcctg

SEQ ID NO: 4224368 - DNA, 19 bp, Homo sapiens
gagtagccgagagcctgct

SEQ ID NO: 4224369 - DNA, 21 bp, Homo sapiens
gagtagccgagagcctgctcc

SEQ ID NO: 4224370 - DNA, 13 bp, Homo sapiens
gagtcaatttgct

SEQ ID NO: 4224371 - DNA, 15 bp, Homo sapiens
gagtcaatttgctga

SEQ ID NO: 4224372 - DNA, 20 bp, Homo sapiens
gagtcatgatctccctgccg

SEQ ID NO: 4224373 - DNA, 12 bp, Homo sapiens
gagtgtgggaag

SEQ ID NO: 4224374 - DNA, 23 bp, Homo sapiens
gagttaccattatttaatttgta

SEQ ID NO: 4224375 - DNA, 19 bp, Homo sapiens
gagtttttatggggctgaa

SEQ ID NO: 4224376 - DNA, 18 bp, Homo sapiens
gataattctagctttgag

SEQ ID NO: 4224377 - DNA, 13 bp, Homo sapiens
gatcacagaggct

SEQ ID NO: 4224378 - DNA, 20 bp, Homo sapiens
gatcactgagccatcatttc

SEQ ID NO: 4224379 - DNA, 21 bp, Homo sapiens
gatccaccctcaaatgtcaga

SEQ ID NO: 4224380 - DNA, 13 bp, Homo sapiens
gatctccctgccg

SEQ ID NO: 4224381 - DNA, 17 bp, Homo sapiens
gatctgatgcaagcaag

SEQ ID NO: 4224382 - DNA, 22 bp, Homo sapiens
gatctgggaccctttccttcct

SEQ ID NO: 4224383 - DNA, 13 bp, Homo sapiens
gatgcctccaccg

SEQ ID NO: 4224384 - DNA, 17 bp, Homo sapiens
gatgcctccaccgctgc

SEQ ID NO: 4224385 - DNA, 21 bp, Homo sapiens
gatggacagatggaccaaaag

SEQ ID NO: 4224386 - DNA, 21 bp, Homo sapiens
gatggaccaaaagatgggtgg

SEQ ID NO: 4224387 - DNA, 13 bp, Homo sapiens
gatggaggagaag

SEQ ID NO: 4224388 - DNA, 20 bp, Homo sapiens
gatgggaggaaagagagcag

SEQ ID NO: 4224389 - DNA, 19 bp, Homo sapiens
gatgtagggtaaggtgcct

SEQ ID NO: 4224390 - DNA, 12 bp, Homo sapiens
gatgtttataaa

SEQ ID NO: 4224391 - DNA, 22 bp, Homo sapiens
gattagtaaatatgtgaagaaa

SEQ ID NO: 4224392 - DNA, 19 bp, Homo sapiens
gattattctgattccactt

SEQ ID NO: 4224393 - DNA, 13 bp, Homo sapiens
gattcccagagac

SEQ ID NO: 4224394 - DNA, 14 bp, Homo sapiens
gattcccagagaca

SEQ ID NO: 4224395 - DNA, 19 bp, Homo sapiens
gattcccagagacaggaaa

SEQ ID NO: 4224396 - DNA, 17 bp, Homo sapiens
gatttaaaaaataaata

SEQ ID NO: 4224397 - DNA, 21 bp, Homo sapiens
gatttcagaaagagcaagtct

SEQ ID NO: 4224398 - DNA, 21 bp, Homo sapiens
gattttaaaaacatgagaaat

SEQ ID NO: 4224399 - DNA, 13 bp, Homo sapiens
gcaaaagagaaaa

SEQ ID NO: 4224400 - DNA, 18 bp, Homo sapiens
gcaaaagagaaaaagaag

SEQ ID NO: 4224401 - DNA, 22 bp, Homo sapiens
gcaaagtatcaaagaaaaacaa

SEQ ID NO: 4224402 - DNA, 14 bp, Homo sapiens
gcaaattactccaa

SEQ ID NO: 4224403 - DNA, 22 bp, Homo sapiens
gcaacaatacatgctgctaatt

SEQ ID NO: 4224404 - DNA, 20 bp, Homo sapiens
gcaaccccagttctgctcct

SEQ ID NO: 4224405 - DNA, 13 bp, Homo sapiens
gcaacttgtgaac

SEQ ID NO: 4224406 - DNA, 13 bp, Homo sapiens
gcaagagccttgg

SEQ ID NO: 4224407 - DNA, 22 bp, Homo sapiens
gcaagagccttggtgtccacct

SEQ ID NO: 4224408 - DNA, 17 bp, Homo sapiens
gcaagtctggatctggg

SEQ ID NO: 4224409 - DNA, 19 bp, Homo sapiens
gcaattttaattgattatt

SEQ ID NO: 4224410 - DNA, 21 bp, Homo sapiens
gcaccaggcacgaacccacct

SEQ ID NO: 4224411 - DNA, 19 bp, Homo sapiens
gcacccagagaaaattaat

SEQ ID NO: 4224412 - DNA, 16 bp, Homo sapiens
gcacccttctttcctc

SEQ ID NO: 4224413 - DNA, 18 bp, Homo sapiens
gcacccttctttcctctt

SEQ ID NO: 4224414 - DNA, 19 bp, Homo sapiens
gcacccttctttcctcttc

SEQ ID NO: 4224415 - DNA, 13 bp, Homo sapiens
gcacctcccccca

SEQ ID NO: 4224416 - DNA, 19 bp, Homo sapiens
gcacctccccccactgcag

SEQ ID NO: 4224417 - DNA, 15 bp, Homo sapiens
gcacctgaaattaat

SEQ ID NO: 4224418 - DNA, 16 bp, Homo sapiens
gcacgaacccacctgc

SEQ ID NO: 4224419 - DNA, 17 bp, Homo sapiens
gcacgaacccacctgct

SEQ ID NO: 4224420 - DNA, 23 bp, Homo sapiens
gcacgaacccacctgctgagaga

SEQ ID NO: 4224421 - DNA, 12 bp, Homo sapiens
gcacttctgttc

SEQ ID NO: 4224422 - DNA, 14 bp, Homo sapiens
gcagaaaaattaaa

SEQ ID NO: 4224423 - DNA, 20 bp, Homo sapiens
gcagaaaagcacctgccgac

SEQ ID NO: 4224424 - DNA, 21 bp, Homo sapiens
gcagaaaagcacctgccgacc

SEQ ID NO: 4224425 - DNA, 21 bp, Homo sapiens
gcagaacgtattggtccagct

SEQ ID NO: 4224426 - DNA, 23 bp, Homo sapiens
gcagaagaattgaacccaggagg

SEQ ID NO: 4224427 - DNA, 11 bp, Homo sapiens
gcagaggctgg

SEQ ID NO: 4224428 - DNA, 21 bp, Homo sapiens
gcagaggctggaggcagggcc

SEQ ID NO: 4224429 - DNA, 18 bp, Homo sapiens
gcagatgtccttgatgct

SEQ ID NO: 4224430 - DNA, 16 bp, Homo sapiens
gcagccagcccagccc

SEQ ID NO: 4224431 - DNA, 23 bp, Homo sapiens
gcagccagcccagcccagctggt

SEQ ID NO: 4224432 - DNA, 17 bp, Homo sapiens
gcaggaatgtgtggcag

SEQ ID NO: 4224433 - DNA, 11 bp, Homo sapiens
gcagggctggg

SEQ ID NO: 4224434 - DNA, 14 bp, Homo sapiens
gcagtttttccccc

SEQ ID NO: 4224435 - DNA, 18 bp, Homo sapiens
gcatatttttctaaagaa

SEQ ID NO: 4224436 - DNA, 17 bp, Homo sapiens
gcatccgtagttccctg

SEQ ID NO: 4224437 - DNA, 18 bp, Homo sapiens
gcatcgtgatcactgagc

SEQ ID NO: 4224438 - DNA, 13 bp, Homo sapiens
gcatgctctctgc

SEQ ID NO: 4224439 - DNA, 20 bp, Homo sapiens
gcatgtggaaatgacccaaa

SEQ ID NO: 4224440 - DNA, 23 bp, Homo sapiens
gcatgtggtttggttcctctctg

SEQ ID NO: 4224441 - DNA, 16 bp, Homo sapiens
gcattcaaccttacca

SEQ ID NO: 4224442 - DNA, 13 bp, Homo sapiens
gcattccctgagt

SEQ ID NO: 4224443 - DNA, 21 bp, Homo sapiens
gcattccctgagtcaccagga

SEQ ID NO: 4224444 - DNA, 20 bp, Homo sapiens
gcatttggcaggaagatgta

SEQ ID NO: 4224445 - DNA, 16 bp, Homo sapiens
gccaccactagagctg

SEQ ID NO: 4224446 - DNA, 12 bp, Homo sapiens
gccacctcccct

SEQ ID NO: 4224447 - DNA, 22 bp, Homo sapiens
gccacgttccttactgcagaat

SEQ ID NO: 4224448 - DNA, 21 bp, Homo sapiens
gccactcccctaaactccagg

SEQ ID NO: 4224449 - DNA, 10 bp, Homo sapiens
gccagccctc

SEQ ID NO: 4224450 - DNA, 21 bp, Homo sapiens
gccagccctccctgtcctcct

SEQ ID NO: 4224451 - DNA, 21 bp, Homo sapiens
gccatgtttagattccaggat

SEQ ID NO: 4224452 - DNA, 22 bp, Homo sapiens
gccatttatacctttgaaatat

SEQ ID NO: 4224453 - DNA, 14 bp, Homo sapiens
gcccacagctccca

SEQ ID NO: 4224454 - DNA, 17 bp, Homo sapiens
gcccacagctcccaccc

SEQ ID NO: 4224455 - DNA, 21 bp, Homo sapiens
gcccaccaacatcccattgcc

SEQ ID NO: 4224456 - DNA, 18 bp, Homo sapiens
gcccagagatgcctccac

SEQ ID NO: 4224457 - DNA, 19 bp, Homo sapiens
gcccagagatgcctccacc

SEQ ID NO: 4224458 - DNA, 23 bp, Homo sapiens
gcccatcctcccggctccctcct

SEQ ID NO: 4224459 - DNA, 15 bp, Homo sapiens
gcccattctctctcc

SEQ ID NO: 4224460 - DNA, 20 bp, Homo sapiens
gcccattctctctcctgtcc

SEQ ID NO: 4224461 - DNA, 17 bp, Homo sapiens
gccccaactcctggaag

SEQ ID NO: 4224462 - DNA, 11 bp, Homo sapiens
gccccaccacc

SEQ ID NO: 4224463 - DNA, 18 bp, Homo sapiens
gccccaccacctaggcca

SEQ ID NO: 4224464 - DNA, 23 bp, Homo sapiens
gccccaccacctaggccactcct

SEQ ID NO: 4224465 - DNA, 21 bp, Homo sapiens
gcccctcctctgccacctccc

SEQ ID NO: 4224466 - DNA, 22 bp, Homo sapiens
gcccctcctctgccacctcccc

SEQ ID NO: 4224467 - DNA, 23 bp, Homo sapiens
gcccctcctctgccacctcccct

SEQ ID NO: 4224468 - DNA, 21 bp, Homo sapiens
gcccggcgcggtggctcacgc

SEQ ID NO: 4224469 - DNA, 13 bp, Homo sapiens
gccctcctcaccc

SEQ ID NO: 4224470 - DNA, 14 bp, Homo sapiens
gccctcctcacccc

SEQ ID NO: 4224471 - DNA, 16 bp, Homo sapiens
gccctgacctcccagc

SEQ ID NO: 4224472 - DNA, 15 bp, Homo sapiens
gccctggcctgctgg

SEQ ID NO: 4224473 - DNA, 15 bp, Homo sapiens
gccctgggccccacc

SEQ ID NO: 4224474 - DNA, 18 bp, Homo sapiens
gccctgggccccaccacc

SEQ ID NO: 4224475 - DNA, 19 bp, Homo sapiens
gccctgggccccaccacct

SEQ ID NO: 4224476 - DNA, 13 bp, Homo sapiens
gcccttgccctga

SEQ ID NO: 4224477 - DNA, 15 bp, Homo sapiens
gcccttgccctgacc

SEQ ID NO: 4224478 - DNA, 18 bp, Homo sapiens
gcccttgccctgacctcc

SEQ ID NO: 4224479 - DNA, 13 bp, Homo sapiens
gccgcaccccaga

SEQ ID NO: 4224480 - DNA, 15 bp, Homo sapiens
gccgcatcttctcca

SEQ ID NO: 4224481 - DNA, 17 bp, Homo sapiens
gccgctgttcacccaca

SEQ ID NO: 4224482 - DNA, 21 bp, Homo sapiens
gccggcaaccccagttctgct

SEQ ID NO: 4224483 - DNA, 23 bp, Homo sapiens
gccggcaaccccagttctgctcc

SEQ ID NO: 4224484 - DNA, 16 bp, Homo sapiens
gccggtcacccaggct

SEQ ID NO: 4224485 - DNA, 16 bp, Homo sapiens
gccgtctgcacttctg

SEQ ID NO: 4224486 - DNA, 15 bp, Homo sapiens
gccgttactctccaa

SEQ ID NO: 4224487 - DNA, 20 bp, Homo sapiens
gccgttactctccaacctgg

SEQ ID NO: 4224488 - DNA, 18 bp, Homo sapiens
gcctagtggggtctccct

SEQ ID NO: 4224489 - DNA, 19 bp, Homo sapiens
gcctagtggggtctccctc

SEQ ID NO: 4224490 - DNA, 21 bp, Homo sapiens
gcctcaatgtgaatcagaccc

SEQ ID NO: 4224491 - DNA, 12 bp, Homo sapiens
gcctccaccgct

SEQ ID NO: 4224492 - DNA, 23 bp, Homo sapiens
gcctcccctccactccttcccaa

SEQ ID NO: 4224493 - DNA, 19 bp, Homo sapiens
gcctgctaatagctgctag

SEQ ID NO: 4224494 - DNA, 11 bp, Homo sapiens
gcctgctcccc

SEQ ID NO: 4224495 - DNA, 15 bp, Homo sapiens
gcctgctcccccacc

SEQ ID NO: 4224496 - DNA, 23 bp, Homo sapiens
gcctgctgaatgatttccaaaga

SEQ ID NO: 4224497 - DNA, 16 bp, Homo sapiens
gcctgctgggctctcc

SEQ ID NO: 4224498 - DNA, 18 bp, Homo sapiens
gcctgctgggctctccac

SEQ ID NO: 4224499 - DNA, 21 bp, Homo sapiens
gcctgctgggctctccacctc

SEQ ID NO: 4224500 - DNA, 23 bp, Homo sapiens
gcctgcttcttaaggtccctgct

SEQ ID NO: 4224501 - DNA, 15 bp, Homo sapiens
gcctggccggcaacc

SEQ ID NO: 4224502 - DNA, 18 bp, Homo sapiens
gcctgggtggggctgctc

SEQ ID NO: 4224503 - DNA, 17 bp, Homo sapiens
gcctgtaatcccagcag

SEQ ID NO: 4224504 - DNA, 14 bp, Homo sapiens
gcctgtgaggcagg

SEQ ID NO: 4224505 - DNA, 19 bp, Homo sapiens
gcctgtggcggtgcctggg

SEQ ID NO: 4224506 - DNA, 12 bp, Homo sapiens
gccttacctcct

SEQ ID NO: 4224507 - DNA, 15 bp, Homo sapiens
gccttacctcctgcc

SEQ ID NO: 4224508 - DNA, 20 bp, Homo sapiens
gccttacctcctgcccagga

SEQ ID NO: 4224509 - DNA, 18 bp, Homo sapiens
gccttcttattctcactc

SEQ ID NO: 4224510 - DNA, 23 bp, Homo sapiens
gccttcttattctcactccacca

SEQ ID NO: 4224511 - DNA, 23 bp, Homo sapiens
gccttcttcggggaactcctgga

SEQ ID NO: 4224512 - DNA, 15 bp, Homo sapiens
gccttgcccagagat

SEQ ID NO: 4224513 - DNA, 23 bp, Homo sapiens
gccttggataatgctgttgcctc

SEQ ID NO: 4224514 - DNA, 16 bp, Homo sapiens
gcgaggtcaacagaga

SEQ ID NO: 4224515 - DNA, 17 bp, Homo sapiens
gcgaggtcaacagagaa

SEQ ID NO: 4224516 - DNA, 18 bp, Homo sapiens
gcgaggtcaacagagaag

SEQ ID NO: 4224517 - DNA, 19 bp, Homo sapiens
gcgaggtcaacagagaagg

SEQ ID NO: 4224518 - DNA, 23 bp, Homo sapiens
gcgaggtcaacagagaaggcagg

SEQ ID NO: 4224519 - DNA, 13 bp, Homo sapiens
gcgcaagcctgta

SEQ ID NO: 4224520 - DNA, 21 bp, Homo sapiens
gcgcctagtggggtctccctc

SEQ ID NO: 4224521 - DNA, 21 bp, Homo sapiens
gcgctgccgcaccccagagtg

SEQ ID NO: 4224522 - DNA, 13 bp, Homo sapiens
gcggctactcagc

SEQ ID NO: 4224523 - DNA, 19 bp, Homo sapiens
gcgggaccggtacagaaag

SEQ ID NO: 4224524 - DNA, 16 bp, Homo sapiens
gctaattagaaatcaa

SEQ ID NO: 4224525 - DNA, 21 bp, Homo sapiens
gctaattaggtctcatccttt

SEQ ID NO: 4224526 - DNA, 23 bp, Homo sapiens
gctactcaggaggctgaggcaga

SEQ ID NO: 4224527 - DNA, 22 bp, Homo sapiens
gctagaagaatttgagaagaaa

SEQ ID NO: 4224528 - DNA, 23 bp, Homo sapiens
gctagaagaatttgagaagaaat

SEQ ID NO: 4224529 - DNA, 14 bp, Homo sapiens
gctagcgctgccgc

SEQ ID NO: 4224530 - DNA, 15 bp, Homo sapiens
gctagcgctgccgca

SEQ ID NO: 4224531 - DNA, 22 bp, Homo sapiens
gctagcgctgccgcaccccaga

SEQ ID NO: 4224532 - DNA, 20 bp, Homo sapiens
gctataactatgttgataaa

SEQ ID NO: 4224533 - DNA, 15 bp, Homo sapiens
gctatggatctgatt

SEQ ID NO: 4224534 - DNA, 18 bp, Homo sapiens
gctatttaacatgggagg

SEQ ID NO: 4224535 - DNA, 21 bp, Homo sapiens
gctcacgcctgtaatcccagc

SEQ ID NO: 4224536 - DNA, 12 bp, Homo sapiens
gctccagcccag

SEQ ID NO: 4224537 - DNA, 20 bp, Homo sapiens
gctcccccaccccctcccca

SEQ ID NO: 4224538 - DNA, 18 bp, Homo sapiens
gctcctccagggccacgt

SEQ ID NO: 4224539 - DNA, 23 bp, Homo sapiens
gctcctccagggccacgtgccag

SEQ ID NO: 4224540 - DNA, 12 bp, Homo sapiens
gctcctctccag

SEQ ID NO: 4224541 - DNA, 14 bp, Homo sapiens
gctcctctccaggc

SEQ ID NO: 4224542 - DNA, 11 bp, Homo sapiens
gctctccctct

SEQ ID NO: 4224543 - DNA, 23 bp, Homo sapiens
gctctccctctggccctgccttc

SEQ ID NO: 4224544 - DNA, 15 bp, Homo sapiens
gctctgctggcctgg

SEQ ID NO: 4224545 - DNA, 21 bp, Homo sapiens
gctcttatgtggattaaacga

SEQ ID NO: 4224546 - DNA, 17 bp, Homo sapiens
gctgacccagtccctgg

SEQ ID NO: 4224547 - DNA, 20 bp, Homo sapiens
gctgagagacccaaggagga

SEQ ID NO: 4224548 - DNA, 22 bp, Homo sapiens
gctgagagacccaaggaggaaa

SEQ ID NO: 4224549 - DNA, 15 bp, Homo sapiens
gctgaggcagaagaa

SEQ ID NO: 4224550 - DNA, 23 bp, Homo sapiens
gctgagtcatgatctccctgccg

SEQ ID NO: 4224551 - DNA, 16 bp, Homo sapiens
gctgcctaagtggctg

SEQ ID NO: 4224552 - DNA, 12 bp, Homo sapiens
gctgctcctcca

SEQ ID NO: 4224553 - DNA, 16 bp, Homo sapiens
gctgctgactgatgtt

SEQ ID NO: 4224554 - DNA, 15 bp, Homo sapiens
gctggaggcagggcc

SEQ ID NO: 4224555 - DNA, 21 bp, Homo sapiens
gctggaggcagggccttgccc

SEQ ID NO: 4224556 - DNA, 14 bp, Homo sapiens
gctggcctggccgg

SEQ ID NO: 4224557 - DNA, 20 bp, Homo sapiens
gctgggctctccacctcagc

SEQ ID NO: 4224558 - DNA, 22 bp, Homo sapiens
gctgggctctccacctcagcct

SEQ ID NO: 4224559 - DNA, 17 bp, Homo sapiens
gctggggccaagaggaa

SEQ ID NO: 4224560 - DNA, 13 bp, Homo sapiens
gctgggggctgga

SEQ ID NO: 4224561 - DNA, 16 bp, Homo sapiens
gctgggggctggacct

SEQ ID NO: 4224562 - DNA, 13 bp, Homo sapiens
gctgtaggtgtgc

SEQ ID NO: 4224563 - DNA, 19 bp, Homo sapiens
gctgtattagtcacagaga

SEQ ID NO: 4224564 - DNA, 18 bp, Homo sapiens
gctgtccctgtcaccaag

SEQ ID NO: 4224565 - DNA, 19 bp, Homo sapiens
gctgtgtccttgcacctgc

SEQ ID NO: 4224566 - DNA, 22 bp, Homo sapiens
gctgttcacccacagggctaag

SEQ ID NO: 4224567 - DNA, 14 bp, Homo sapiens
gctgttcactcccg

SEQ ID NO: 4224568 - DNA, 20 bp, Homo sapiens
gctgtttgtttgacaaagaa

SEQ ID NO: 4224569 - DNA, 16 bp, Homo sapiens
gcttatgcttgtgtat

SEQ ID NO: 4224570 - DNA, 17 bp, Homo sapiens
gcttatgcttgtgtata

SEQ ID NO: 4224571 - DNA, 14 bp, Homo sapiens
gcttctgtccagga

SEQ ID NO: 4224572 - DNA, 15 bp, Homo sapiens
gcttctgtccaggac

SEQ ID NO: 4224573 - DNA, 19 bp, Homo sapiens
gcttgagtttggggaatgc

SEQ ID NO: 4224574 - DNA, 23 bp, Homo sapiens
gcttgctcttcagtgggagaaaa

SEQ ID NO: 4224575 - DNA, 16 bp, Homo sapiens
gcttgtaactccacca

SEQ ID NO: 4224576 - DNA, 16 bp, Homo sapiens
gcttgtccagcgccta

SEQ ID NO: 4224577 - DNA, 17 bp, Homo sapiens
gctttaaactaccctcc

SEQ ID NO: 4224578 - DNA, 19 bp, Homo sapiens
gctttccttgtggcagagg

SEQ ID NO: 4224579 - DNA, 15 bp, Homo sapiens
gctttgagtccccca

SEQ ID NO: 4224580 - DNA, 21 bp, Homo sapiens
gctttgcttatggtaataaaa

SEQ ID NO: 4224581 - DNA, 23 bp, Homo sapiens
ggaaagataataaattgatttgt

SEQ ID NO: 4224582 - DNA, 13 bp, Homo sapiens
ggaacagacagga

SEQ ID NO: 4224583 - DNA, 17 bp, Homo sapiens
ggaacgtgactgcccca

SEQ ID NO: 4224584 - DNA, 20 bp, Homo sapiens
ggaagcatgtaggagaatcc

SEQ ID NO: 4224585 - DNA, 21 bp, Homo sapiens
ggaagcatgtaggagaatcca

SEQ ID NO: 4224586 - DNA, 11 bp, Homo sapiens
ggaagccctcc

SEQ ID NO: 4224587 - DNA, 17 bp, Homo sapiens
ggaagctgtgtccttgc

SEQ ID NO: 4224588 - DNA, 23 bp, Homo sapiens
ggaagctgtgtccttgcacctgc

SEQ ID NO: 4224589 - DNA, 17 bp, Homo sapiens
ggaagtctaggagctgg

SEQ ID NO: 4224590 - DNA, 23 bp, Homo sapiens
ggaatcagacttcacactgcaag

SEQ ID NO: 4224591 - DNA, 23 bp, Homo sapiens
ggacaatataaactgaaaaatgt

SEQ ID NO: 4224592 - DNA, 17 bp, Homo sapiens
ggacagagacacctgca

SEQ ID NO: 4224593 - DNA, 21 bp, Homo sapiens
ggacagagacacctgcacctc

SEQ ID NO: 4224594 - DNA, 12 bp, Homo sapiens
ggaccaaaagat

SEQ ID NO: 4224595 - DNA, 17 bp, Homo sapiens
ggaccaggacaggacca

SEQ ID NO: 4224596 - DNA, 21 bp, Homo sapiens
ggaccctttccttccttccct

SEQ ID NO: 4224597 - DNA, 17 bp, Homo sapiens
ggaccggtacagaaagg

SEQ ID NO: 4224598 - DNA, 13 bp, Homo sapiens
ggagactcacctc

SEQ ID NO: 4224599 - DNA, 16 bp, Homo sapiens
ggagactcacctctgc

SEQ ID NO: 4224600 - DNA, 17 bp, Homo sapiens
ggagactcacctctgcc

SEQ ID NO: 4224601 - DNA, 18 bp, Homo sapiens
ggagactcacctctgcct

SEQ ID NO: 4224602 - DNA, 18 bp, Homo sapiens
ggagagccagccctccct

SEQ ID NO: 4224603 - DNA, 21 bp, Homo sapiens
ggagagccagccctccctgtc

SEQ ID NO: 4224604 - DNA, 23 bp, Homo sapiens
ggagagccagccctccctgtcct

SEQ ID NO: 4224605 - DNA, 14 bp, Homo sapiens
ggagagggtctgga

SEQ ID NO: 4224606 - DNA, 23 bp, Homo sapiens
ggagatatttatggggggagaac

SEQ ID NO: 4224607 - DNA, 19 bp, Homo sapiens
ggaggcagggccttgccca

SEQ ID NO: 4224608 - DNA, 21 bp, Homo sapiens
ggaggcagggccttgcccaga

SEQ ID NO: 4224609 - DNA, 18 bp, Homo sapiens
ggaggctgaggcagaaga

SEQ ID NO: 4224610 - DNA, 20 bp, Homo sapiens
ggataatgctgttgcctcat

SEQ ID NO: 4224611 - DNA, 13 bp, Homo sapiens
ggatactaaagta

SEQ ID NO: 4224612 - DNA, 18 bp, Homo sapiens
ggatggacagatggacca

SEQ ID NO: 4224613 - DNA, 14 bp, Homo sapiens
ggatggaggagaag

SEQ ID NO: 4224614 - DNA, 21 bp, Homo sapiens
ggatgtaaacagtgcctgctg

SEQ ID NO: 4224615 - DNA, 22 bp, Homo sapiens
ggatgtgtcctagactccgggt

SEQ ID NO: 4224616 - DNA, 23 bp, Homo sapiens
ggattttaaaaacatgagaaatg

SEQ ID NO: 4224617 - DNA, 18 bp, Homo sapiens
ggcaacttgggaactaga

SEQ ID NO: 4224618 - DNA, 17 bp, Homo sapiens
ggcacccttctttcctc

SEQ ID NO: 4224619 - DNA, 22 bp, Homo sapiens
ggcacctgaaattaatttgtga

SEQ ID NO: 4224620 - DNA, 19 bp, Homo sapiens
ggcagaggctggaggcagg

SEQ ID NO: 4224621 - DNA, 14 bp, Homo sapiens
ggcagagggcagag

SEQ ID NO: 4224622 - DNA, 24 bp, Homo sapiens
ggcagatttagtgaaagctagaga

SEQ ID NO: 4224623 - DNA, 14 bp, Homo sapiens
ggcaggaaggctga

SEQ ID NO: 4224624 - DNA, 20 bp, Homo sapiens
ggcagggccttgcccagaga

SEQ ID NO: 4224625 - DNA, 13 bp, Homo sapiens
ggcagggctggga

SEQ ID NO: 4224626 - DNA, 21 bp, Homo sapiens
ggcagggtgggatggaggaga

SEQ ID NO: 4224627 - DNA, 15 bp, Homo sapiens
ggccaagaggaaaaa

SEQ ID NO: 4224628 - DNA, 11 bp, Homo sapiens
ggccacgtgcc

SEQ ID NO: 4224629 - DNA, 12 bp, Homo sapiens
ggccacgtgcca

SEQ ID NO: 4224630 - DNA, 18 bp, Homo sapiens
ggccacgtgccaggcccg

SEQ ID NO: 4224631 - DNA, 13 bp, Homo sapiens
ggccactcctcca

SEQ ID NO: 4224632 - DNA, 14 bp, Homo sapiens
ggcccacagctccc

SEQ ID NO: 4224633 - DNA, 18 bp, Homo sapiens
ggcccacagctcccaccc

SEQ ID NO: 4224634 - DNA, 21 bp, Homo sapiens
ggccccgcttgtccagcgcct

SEQ ID NO: 4224635 - DNA, 13 bp, Homo sapiens
ggcccggggctgg

SEQ ID NO: 4224636 - DNA, 12 bp, Homo sapiens
ggccctggcctg

SEQ ID NO: 4224637 - DNA, 15 bp, Homo sapiens
ggccctggcctgctg

SEQ ID NO: 4224638 - DNA, 17 bp, Homo sapiens
ggccctggcctgctggg

SEQ ID NO: 4224639 - DNA, 15 bp, Homo sapiens
ggccgcattccctga

SEQ ID NO: 4224640 - DNA, 22 bp, Homo sapiens
ggccgtctgcacttctgttcca

SEQ ID NO: 4224641 - DNA, 20 bp, Homo sapiens
ggcctgctaatagctgctag

SEQ ID NO: 4224642 - DNA, 22 bp, Homo sapiens
ggcgcaagcctgtaatcccagc

SEQ ID NO: 4224643 - DNA, 23 bp, Homo sapiens
ggcggctactcagcagccctcct

SEQ ID NO: 4224644 - DNA, 20 bp, Homo sapiens
ggctaagagctagcgctgcc

SEQ ID NO: 4224645 - DNA, 18 bp, Homo sapiens
ggctaattagaaatcaac

SEQ ID NO: 4224646 - DNA, 15 bp, Homo sapiens
ggctactcagcagcc

SEQ ID NO: 4224647 - DNA, 17 bp, Homo sapiens
ggctactcagcagccct

SEQ ID NO: 4224648 - DNA, 14 bp, Homo sapiens
ggctccagcccagc

SEQ ID NO: 4224649 - DNA, 16 bp, Homo sapiens
ggctccctcccaccca

SEQ ID NO: 4224650 - DNA, 12 bp, Homo sapiens
ggctctccacct

SEQ ID NO: 4224651 - DNA, 18 bp, Homo sapiens
ggctctccacctcagcct

SEQ ID NO: 4224652 - DNA, 17 bp, Homo sapiens
ggctctggagccagaga

SEQ ID NO: 4224653 - DNA, 20 bp, Homo sapiens
ggctgaacggggagaaaagg

SEQ ID NO: 4224654 - DNA, 19 bp, Homo sapiens
ggctgacccagtccctggg

SEQ ID NO: 4224655 - DNA, 23 bp, Homo sapiens
ggctgagtcatgatctccctgcc

SEQ ID NO: 4224656 - DNA, 18 bp, Homo sapiens
ggctgctcctccagggcc

SEQ ID NO: 4224657 - DNA, 19 bp, Homo sapiens
ggctgctcctccagggcca

SEQ ID NO: 4224658 - DNA, 16 bp, Homo sapiens
ggctggacctgctgac

SEQ ID NO: 4224659 - DNA, 15 bp, Homo sapiens
ggctggaggcagggc

SEQ ID NO: 4224660 - DNA, 19 bp, Homo sapiens
ggctggaggcagggccttg

SEQ ID NO: 4224661 - DNA, 17 bp, Homo sapiens
ggctggctaactggaag

SEQ ID NO: 4224662 - DNA, 19 bp, Homo sapiens
ggctggtattggtggcttt

SEQ ID NO: 4224663 - DNA, 21 bp, Homo sapiens
ggctttaaactaccctccaga

SEQ ID NO: 4224664 - DNA, 13 bp, Homo sapiens
gggaagggagagc

SEQ ID NO: 4224665 - DNA, 16 bp, Homo sapiens
gggaagggagagcggg

SEQ ID NO: 4224666 - DNA, 18 bp, Homo sapiens
gggaagtttaaaacccaa

SEQ ID NO: 4224667 - DNA, 17 bp, Homo sapiens
gggacagagacacctgc

SEQ ID NO: 4224668 - DNA, 18 bp, Homo sapiens
gggacagagacacctgca

SEQ ID NO: 4224669 - DNA, 20 bp, Homo sapiens
gggacagagacacctgcacc

SEQ ID NO: 4224670 - DNA, 16 bp, Homo sapiens
gggaggaaagagagca

SEQ ID NO: 4224671 - DNA, 14 bp, Homo sapiens
gggcagagggcaga

SEQ ID NO: 4224672 - DNA, 18 bp, Homo sapiens
gggcgagaaaggcctctg

SEQ ID NO: 4224673 - DNA, 19 bp, Homo sapiens
gggcgagaaaggcctctgt

SEQ ID NO: 4224674 - DNA, 16 bp, Homo sapiens
gggcgtgactcaccca

SEQ ID NO: 4224675 - DNA, 18 bp, Homo sapiens
gggctctccacctcagcc

SEQ ID NO: 4224676 - DNA, 15 bp, Homo sapiens
gggctgctcctccag

SEQ ID NO: 4224677 - DNA, 19 bp, Homo sapiens
gggctggcggctactcagc

SEQ ID NO: 4224678 - DNA, 13 bp, Homo sapiens
ggggaagccctgg

SEQ ID NO: 4224679 - DNA, 19 bp, Homo sapiens
ggggagaacttacattgtg

SEQ ID NO: 4224680 - DNA, 16 bp, Homo sapiens
ggggcagagggcagag

SEQ ID NO: 4224681 - DNA, 14 bp, Homo sapiens
ggggctgctcctcc

SEQ ID NO: 4224682 - DNA, 17 bp, Homo sapiens
ggggctggacctgctga

SEQ ID NO: 4224683 - DNA, 19 bp, Homo sapiens
gggggctggacctgctgac

SEQ ID NO: 4224684 - DNA, 23 bp, Homo sapiens
ggggtccccatcatcccagctgc

SEQ ID NO: 4224685 - DNA, 17 bp, Homo sapiens
ggggttcagcccctcct

SEQ ID NO: 4224686 - DNA, 14 bp, Homo sapiens
gggtaaggtgcctt

SEQ ID NO: 4224687 - DNA, 14 bp, Homo sapiens
gggtctagggagag

SEQ ID NO: 4224688 - DNA, 15 bp, Homo sapiens
gggtctccctctcct

SEQ ID NO: 4224689 - DNA, 16 bp, Homo sapiens
gggtctccctctcctg

SEQ ID NO: 4224690 - DNA, 19 bp, Homo sapiens
gggtgctggcagcctcagg

SEQ ID NO: 4224691 - DNA, 16 bp, Homo sapiens
gggttcagcccctcct

SEQ ID NO: 4224692 - DNA, 17 bp, Homo sapiens
gggttcagcccctcctc

SEQ ID NO: 4224693 - DNA, 22 bp, Homo sapiens
gggttcagcccctcctctgcca

SEQ ID NO: 4224694 - DNA, 12 bp, Homo sapiens
gggttgaagaaa

SEQ ID NO: 4224695 - DNA, 17 bp, Homo sapiens
ggtactgttgctttggg

SEQ ID NO: 4224696 - DNA, 17 bp, Homo sapiens
ggtcatgccgggggagc

SEQ ID NO: 4224697 - DNA, 17 bp, Homo sapiens
ggtccagcttgctcttc

SEQ ID NO: 4224698 - DNA, 16 bp, Homo sapiens
ggtccccatcatccca

SEQ ID NO: 4224699 - DNA, 20 bp, Homo sapiens
ggtcccttgagacctcagcc

SEQ ID NO: 4224700 - DNA, 15 bp, Homo sapiens
ggtctccctctcctg

SEQ ID NO: 4224701 - DNA, 19 bp, Homo sapiens
ggtgcctgggtggggctgc

SEQ ID NO: 4224702 - DNA, 23 bp, Homo sapiens
ggtgcctgggtggggctgctcct

SEQ ID NO: 4224703 - DNA, 23 bp, Homo sapiens
ggtgccttcttattctcactcca

SEQ ID NO: 4224704 - DNA, 19 bp, Homo sapiens
ggtggaagccctccttcca

SEQ ID NO: 4224705 - DNA, 20 bp, Homo sapiens
ggtggaagccctccttccac

SEQ ID NO: 4224706 - DNA, 15 bp, Homo sapiens
ggtggctagtcagag

SEQ ID NO: 4224707 - DNA, 16 bp, Homo sapiens
ggtggctagtcagaga

SEQ ID NO: 4224708 - DNA, 23 bp, Homo sapiens
ggtggctgacccagtccctgggg

SEQ ID NO: 4224709 - DNA, 21 bp, Homo sapiens
ggtggctttccttgtggcaga

SEQ ID NO: 4224710 - DNA, 12 bp, Homo sapiens
ggtgggcagggc

SEQ ID NO: 4224711 - DNA, 17 bp, Homo sapiens
ggtgggcagggctggga

SEQ ID NO: 4224712 - DNA, 13 bp, Homo sapiens
ggtggggctgctc

SEQ ID NO: 4224713 - DNA, 17 bp, Homo sapiens
ggtggggctgctcctcc

SEQ ID NO: 4224714 - DNA, 22 bp, Homo sapiens
ggtggggctgctcctccagggc

SEQ ID NO: 4224715 - DNA, 22 bp, Homo sapiens
ggtgtaaatatgtttcaccctg

SEQ ID NO: 4224716 - DNA, 21 bp, Homo sapiens
ggtgtcgctctgctggcctgg

SEQ ID NO: 4224717 - DNA, 16 bp, Homo sapiens
ggttcagcccctcctc

SEQ ID NO: 4224718 - DNA, 14 bp, Homo sapiens
ggttcctctctggt

SEQ ID NO: 4224719 - DNA, 11 bp, Homo sapiens
ggttgaagaaa

SEQ ID NO: 4224720 - DNA, 19 bp, Homo sapiens
ggttgaggtggaagccctc

SEQ ID NO: 4224721 - DNA, 22 bp, Homo sapiens
ggtttcttggggtcccagggaa

SEQ ID NO: 4224722 - DNA, 17 bp, Homo sapiens
ggtttggttcctctctg

SEQ ID NO: 4224723 - DNA, 14 bp, Homo sapiens
ggttttcttcccat

SEQ ID NO: 4224724 - DNA, 13 bp, Homo sapiens
gtaaaaataaaat

SEQ ID NO: 4224725 - DNA, 14 bp, Homo sapiens
gtaaaaataaaatt

SEQ ID NO: 4224726 - DNA, 23 bp, Homo sapiens
gtaaaagataaatttgttgaata

SEQ ID NO: 4224727 - DNA, 14 bp, Homo sapiens
gtaaacagtgcctg

SEQ ID NO: 4224728 - DNA, 18 bp, Homo sapiens
gtaaacagtgcctgctga

SEQ ID NO: 4224729 - DNA, 22 bp, Homo sapiens
gtaaacagtgcctgctgaatga

SEQ ID NO: 4224730 - DNA, 16 bp, Homo sapiens
gtaaatatgtgaagaa

SEQ ID NO: 4224731 - DNA, 16 bp, Homo sapiens
gtaaatatgtttcacc

SEQ ID NO: 4224732 - DNA, 14 bp, Homo sapiens
gtaacatccagaag

SEQ ID NO: 4224733 - DNA, 17 bp, Homo sapiens
gtaactccaccaaccca

SEQ ID NO: 4224734 - DNA, 13 bp, Homo sapiens
gtaagaaaaccaa

SEQ ID NO: 4224735 - DNA, 21 bp, Homo sapiens
gtaatcccagctactcaggag

SEQ ID NO: 4224736 - DNA, 18 bp, Homo sapiens
gtaatgatgtcgtttgaa

SEQ ID NO: 4224737 - DNA, 22 bp, Homo sapiens
gtaatgtcaccaccttcccagc

SEQ ID NO: 4224738 - DNA, 19 bp, Homo sapiens
gtaattaaaagactccaca

SEQ ID NO: 4224739 - DNA, 18 bp, Homo sapiens
gtagctgtggtgaggtgg

SEQ ID NO: 4224740 - DNA, 16 bp, Homo sapiens
gtagctttatccttag

SEQ ID NO: 4224741 - DNA, 17 bp, Homo sapiens
gtagggtaaggtgcctt

SEQ ID NO: 4224742 - DNA, 14 bp, Homo sapiens
gtagtatctgctta

SEQ ID NO: 4224743 - DNA, 17 bp, Homo sapiens
gtagttccctgaaaacc

SEQ ID NO: 4224744 - DNA, 18 bp, Homo sapiens
gtatatgtataaattaat

SEQ ID NO: 4224745 - DNA, 17 bp, Homo sapiens
gtatttttccaatcaca

SEQ ID NO: 4224746 - DNA, 14 bp, Homo sapiens
gtcaaaaggtgcct

SEQ ID NO: 4224747 - DNA, 15 bp, Homo sapiens
gtcaaaaggtgcctg

SEQ ID NO: 4224748 - DNA, 16 bp, Homo sapiens
gtcaaaaggtgcctgt

SEQ ID NO: 4224749 - DNA, 22 bp, Homo sapiens
gtcaacagagaaggcaggaatg

SEQ ID NO: 4224750 - DNA, 17 bp, Homo sapiens
gtcaatcccctcattca

SEQ ID NO: 4224751 - DNA, 20 bp, Homo sapiens
gtcaattccacccctcctcg

SEQ ID NO: 4224752 - DNA, 20 bp, Homo sapiens
gtcaattctgatgttactga

SEQ ID NO: 4224753 - DNA, 15 bp, Homo sapiens
gtcaatttgctgaaa

SEQ ID NO: 4224754 - DNA, 21 bp, Homo sapiens
gtcaatttgctgaaaacatta

SEQ ID NO: 4224755 - DNA, 15 bp, Homo sapiens
gtcaccaccttccca

SEQ ID NO: 4224756 - DNA, 19 bp, Homo sapiens
gtcagagctatgttccctc

SEQ ID NO: 4224757 - DNA, 22 bp, Homo sapiens
gtcagtgggaacgtgactgccc

SEQ ID NO: 4224758 - DNA, 20 bp, Homo sapiens
gtccaacctaacccctttcc

SEQ ID NO: 4224759 - DNA, 17 bp, Homo sapiens
gtccagcttgctcttca

SEQ ID NO: 4224760 - DNA, 13 bp, Homo sapiens
gtccaggacatga

SEQ ID NO: 4224761 - DNA, 19 bp, Homo sapiens
gtccccagtttgcagaaaa

SEQ ID NO: 4224762 - DNA, 22 bp, Homo sapiens
gtccctgggggaagccctggat

SEQ ID NO: 4224763 - DNA, 16 bp, Homo sapiens
gtcccttgagacctca

SEQ ID NO: 4224764 - DNA, 17 bp, Homo sapiens
gtcccttgagacctcag

SEQ ID NO: 4224765 - DNA, 19 bp, Homo sapiens
gtcccttgagacctcagcc

SEQ ID NO: 4224766 - DNA, 21 bp, Homo sapiens
gtcccttgagacctcagccat

SEQ ID NO: 4224767 - DNA, 22 bp, Homo sapiens
gtcccttgagacctcagccatg

SEQ ID NO: 4224768 - DNA, 16 bp, Homo sapiens
gtcctccccctgccag

SEQ ID NO: 4224769 - DNA, 12 bp, Homo sapiens
gtcctgcttctg

SEQ ID NO: 4224770 - DNA, 23 bp, Homo sapiens
gtctcccactgcaacttgtgaac

SEQ ID NO: 4224771 - DNA, 21 bp, Homo sapiens
gtctccccagaagacacagga

SEQ ID NO: 4224772 - DNA, 18 bp, Homo sapiens
gtctccctctcctgccta

SEQ ID NO: 4224773 - DNA, 19 bp, Homo sapiens
gtctccctctcctgcctac

SEQ ID NO: 4224774 - DNA, 17 bp, Homo sapiens
gtctcctacctgctgct

SEQ ID NO: 4224775 - DNA, 21 bp, Homo sapiens
gtctcctacctgctgctgcta

SEQ ID NO: 4224776 - DNA, 19 bp, Homo sapiens
gtctgcacttctgttccag

SEQ ID NO: 4224777 - DNA, 11 bp, Homo sapiens
gtctgcttctg

SEQ ID NO: 4224778 - DNA, 17 bp, Homo sapiens
gtctgcttctgtccagg

SEQ ID NO: 4224779 - DNA, 15 bp, Homo sapiens
gtctggcttcacaga

SEQ ID NO: 4224780 - DNA, 19 bp, Homo sapiens
gtcttagaagtggaccagg

SEQ ID NO: 4224781 - DNA, 22 bp, Homo sapiens
gtctttgtaatgtcaccacctt

SEQ ID NO: 4224782 - DNA, 20 bp, Homo sapiens
gtgaattgtggctgttcact

SEQ ID NO: 4224783 - DNA, 15 bp, Homo sapiens
gtgactcacccaagc

SEQ ID NO: 4224784 - DNA, 23 bp, Homo sapiens
gtgactgccccaactcctggaag

SEQ ID NO: 4224785 - DNA, 21 bp, Homo sapiens
gtgatggggtgggcagggctg

SEQ ID NO: 4224786 - DNA, 16 bp, Homo sapiens
gtgcagaaatttgaat

SEQ ID NO: 4224787 - DNA, 9 bp, Homo sapiens
gtgcattca

SEQ ID NO: 4224788 - DNA, 10 bp, Homo sapiens
gtgcattcaa

SEQ ID NO: 4224789 - DNA, 20 bp, Homo sapiens
gtgcattcaaccttaccaaa

SEQ ID NO: 4224790 - DNA, 13 bp, Homo sapiens
gtgccaggcccgg

SEQ ID NO: 4224791 - DNA, 12 bp, Homo sapiens
gtgcccctgtaa

SEQ ID NO: 4224792 - DNA, 21 bp, Homo sapiens
gtgcctgggtggggctgctcc

SEQ ID NO: 4224793 - DNA, 23 bp, Homo sapiens
gtgcctgggtggggctgctcctc

SEQ ID NO: 4224794 - DNA, 17 bp, Homo sapiens
gtgcctgtgaggcaggg

SEQ ID NO: 4224795 - DNA, 14 bp, Homo sapiens
gtgccttacctcct

SEQ ID NO: 4224796 - DNA, 15 bp, Homo sapiens
gtgccttacctcctg

SEQ ID NO: 4224797 - DNA, 20 bp, Homo sapiens
gtgccttacctcctgcccag

SEQ ID NO: 4224798 - DNA, 21 bp, Homo sapiens
gtgccttacctcctgcccagg

SEQ ID NO: 4224799 - DNA, 16 bp, Homo sapiens
gtgcggctccagccca

SEQ ID NO: 4224800 - DNA, 22 bp, Homo sapiens
gtggaaagataataaattgatt

SEQ ID NO: 4224801 - DNA, 13 bp, Homo sapiens
gtggaccaggaca

SEQ ID NO: 4224802 - DNA, 14 bp, Homo sapiens
gtggaccaggacag

SEQ ID NO: 4224803 - DNA, 13 bp, Homo sapiens
gtggatggacaga

SEQ ID NO: 4224804 - DNA, 18 bp, Homo sapiens
gtggatggacagatggac

SEQ ID NO: 4224805 - DNA, 16 bp, Homo sapiens
gtggccctggcctgct

SEQ ID NO: 4224806 - DNA, 19 bp, Homo sapiens
gtggccctggcctgctggg

SEQ ID NO: 4224807 - DNA, 19 bp, Homo sapiens
gtggctgacccagtccctg

SEQ ID NO: 4224808 - DNA, 14 bp, Homo sapiens
gtgggaagggagag

SEQ ID NO: 4224809 - DNA, 14 bp, Homo sapiens
gtgggatggaggag

SEQ ID NO: 4224810 - DNA, 16 bp, Homo sapiens
gtgggatggaggagaa

SEQ ID NO: 4224811 - DNA, 14 bp, Homo sapiens
gtgggcaaaagaga

SEQ ID NO: 4224812 - DNA, 14 bp, Homo sapiens
gtgggcagggctgg

SEQ ID NO: 4224813 - DNA, 16 bp, Homo sapiens
gtggggctgctcctcc

SEQ ID NO: 4224814 - DNA, 14 bp, Homo sapiens
gtgggggcagaggg

SEQ ID NO: 4224815 - DNA, 17 bp, Homo sapiens
gtgggggcagagggcag

SEQ ID NO: 4224816 - DNA, 14 bp, Homo sapiens
gtggggtctccctc

SEQ ID NO: 4224817 - DNA, 21 bp, Homo sapiens
gtggggtctccctctcctgcc

SEQ ID NO: 4224818 - DNA, 21 bp, Homo sapiens
gtggtgtattttttaaaaaat

SEQ ID NO: 4224819 - DNA, 20 bp, Homo sapiens
gtgtatatgtataaattaat

SEQ ID NO: 4224820 - DNA, 17 bp, Homo sapiens
gtgtccttgcacctgca

SEQ ID NO: 4224821 - DNA, 18 bp, Homo sapiens
gttaccattatttaattt

SEQ ID NO: 4224822 - DNA, 16 bp, Homo sapiens
gttactcagccctggg

SEQ ID NO: 4224823 - DNA, 18 bp, Homo sapiens
gttactctccaacctgga

SEQ ID NO: 4224824 - DNA, 13 bp, Homo sapiens
gttcaagccatgg

SEQ ID NO: 4224825 - DNA, 14 bp, Homo sapiens
gttcagcccctcct

SEQ ID NO: 4224826 - DNA, 16 bp, Homo sapiens
gttcagcccctcctct

SEQ ID NO: 4224827 - DNA, 19 bp, Homo sapiens
gttcagcccctcctctgcc

SEQ ID NO: 4224828 - DNA, 19 bp, Homo sapiens
gttcattgtaaaaattttt

SEQ ID NO: 4224829 - DNA, 21 bp, Homo sapiens
gttccaagaaagatccaccct

SEQ ID NO: 4224830 - DNA, 17 bp, Homo sapiens
gttccctgaaaacccag

SEQ ID NO: 4224831 - DNA, 13 bp, Homo sapiens
gttcctcgccctg

SEQ ID NO: 4224832 - DNA, 12 bp, Homo sapiens
gttcctctctgg

SEQ ID NO: 4224833 - DNA, 22 bp, Homo sapiens
gttcctctctggtggctctttg

SEQ ID NO: 4224834 - DNA, 15 bp, Homo sapiens
gttccttactgcaga

SEQ ID NO: 4224835 - DNA, 21 bp, Homo sapiens
gttctgcccaaattatgtgaa

SEQ ID NO: 4224836 - DNA, 19 bp, Homo sapiens
gttctgctcctctccaggc

SEQ ID NO: 4224837 - DNA, 14 bp, Homo sapiens
gttcttcgaggtgg

SEQ ID NO: 4224838 - DNA, 13 bp, Homo sapiens
gttgaagaaaaca

SEQ ID NO: 4224839 - DNA, 15 bp, Homo sapiens
gttgcaaggccgctg

SEQ ID NO: 4224840 - DNA, 16 bp, Homo sapiens
gttgcaaggccgctgt

SEQ ID NO: 4224841 - DNA, 17 bp, Homo sapiens
gttgcaaggccgctgtt

SEQ ID NO: 4224842 - DNA, 13 bp, Homo sapiens
gtttataaactga

SEQ ID NO: 4224843 - DNA, 16 bp, Homo sapiens
gtttatataaggcagt

SEQ ID NO: 4224844 - DNA, 13 bp, Homo sapiens
gtttgagctcaga

SEQ ID NO: 4224845 - DNA, 16 bp, Homo sapiens
gtttgagctcagaccc

SEQ ID NO: 4224846 - DNA, 22 bp, Homo sapiens
gtttgcagaaaagcacctgccg

SEQ ID NO: 4224847 - DNA, 18 bp, Homo sapiens
gtttgccttgggcctttc

SEQ ID NO: 4224848 - DNA, 22 bp, Homo sapiens
gtttggggaatgcggccgcatt

SEQ ID NO: 4224849 - DNA, 14 bp, Homo sapiens
gtttggttcctctc

SEQ ID NO: 4224850 - DNA, 20 bp, Homo sapiens
gtttggttttccaaaagaac

SEQ ID NO: 4224851 - DNA, 14 bp, Homo sapiens
gttttcagactcag

SEQ ID NO: 4224852 - DNA, 17 bp, Homo sapiens
gttttcagactcagact

SEQ ID NO: 4224853 - DNA, 15 bp, Homo sapiens
gttttcttcccatca

SEQ ID NO: 4224854 - DNA, 16 bp, Homo sapiens
gtttttatggggctga

SEQ ID NO: 4224855 - DNA, 15 bp, Homo sapiens
taaaaacatgagaaa

SEQ ID NO: 4224856 - DNA, 18 bp, Homo sapiens
taaaaacatgagaaatgt

SEQ ID NO: 4224857 - DNA, 15 bp, Homo sapiens
taaaaattgaaaaat

SEQ ID NO: 4224858 - DNA, 21 bp, Homo sapiens
taaaaatttttacaaaactgc

SEQ ID NO: 4224859 - DNA, 15 bp, Homo sapiens
taaaacccaaacttc

SEQ ID NO: 4224860 - DNA, 17 bp, Homo sapiens
taaaagcaaaaagatgt

SEQ ID NO: 4224861 - DNA, 19 bp, Homo sapiens
taaaataaggataataatc

SEQ ID NO: 4224862 - DNA, 16 bp, Homo sapiens
taaaattaaagctgaa

SEQ ID NO: 4224863 - DNA, 19 bp, Homo sapiens
taaactccaggatttataa

SEQ ID NO: 4224864 - DNA, 20 bp, Homo sapiens
taaactccaggatttataaa

SEQ ID NO: 4224865 - DNA, 18 bp, Homo sapiens
taaagagttagtttgagt

SEQ ID NO: 4224866 - DNA, 19 bp, Homo sapiens
taaagtattctccatcctc

SEQ ID NO: 4224867 - DNA, 22 bp, Homo sapiens
taaataaatgaagtatttctca

SEQ ID NO: 4224868 - DNA, 15 bp, Homo sapiens
taaatataattggga

SEQ ID NO: 4224869 - DNA, 18 bp, Homo sapiens
taaatataattgggattt

SEQ ID NO: 4224870 - DNA, 21 bp, Homo sapiens
taaatataattgggattttaa

SEQ ID NO: 4224871 - DNA, 13 bp, Homo sapiens
taaatatgaacaa

SEQ ID NO: 4224872 - DNA, 16 bp, Homo sapiens
taaatatgtgaagaaa

SEQ ID NO: 4224873 - DNA, 22 bp, Homo sapiens
taaatatgtttcaccctgtccc

SEQ ID NO: 4224874 - DNA, 19 bp, Homo sapiens
taaatcaagttggcttcta

SEQ ID NO: 4224875 - DNA, 13 bp, Homo sapiens
taaattgatttgt

SEQ ID NO: 4224876 - DNA, 15 bp, Homo sapiens
taaattgatttgtta

SEQ ID NO: 4224877 - DNA, 14 bp, Homo sapiens
taaattgtgaaaaa

SEQ ID NO: 4224878 - DNA, 15 bp, Homo sapiens
taaattgtgaaaaaa

SEQ ID NO: 4224879 - DNA, 22 bp, Homo sapiens
taaattgtgaaaaaaatgaaat

SEQ ID NO: 4224880 - DNA, 23 bp, Homo sapiens
taaattgtgaaaaaaatgaaata

SEQ ID NO: 4224881 - DNA, 11 bp, Homo sapiens
taaatttcagt

SEQ ID NO: 4224882 - DNA, 20 bp, Homo sapiens
taaatttcagtcaattctga

SEQ ID NO: 4224883 - DNA, 13 bp, Homo sapiens
taaatttgttgaa

SEQ ID NO: 4224884 - DNA, 22 bp, Homo sapiens
taacaactatgatttggaaaat

SEQ ID NO: 4224885 - DNA, 16 bp, Homo sapiens
taacccctttcctgcg

SEQ ID NO: 4224886 - DNA, 11 bp, Homo sapiens
taactccacca

SEQ ID NO: 4224887 - DNA, 16 bp, Homo sapiens
taactccaccaaccca

SEQ ID NO: 4224888 - DNA, 20 bp, Homo sapiens
taactctggattttgaatta

SEQ ID NO: 4224889 - DNA, 10 bp, Homo sapiens
taactgaaag

SEQ ID NO: 4224890 - DNA, 22 bp, Homo sapiens
taactggaagcatgtaggagaa

SEQ ID NO: 4224891 - DNA, 13 bp, Homo sapiens
taacttgatgcat

SEQ ID NO: 4224892 - DNA, 14 bp, Homo sapiens
taagaaaaccaaaa

SEQ ID NO: 4224893 - DNA, 16 bp, Homo sapiens
taagagctagcgctgc

SEQ ID NO: 4224894 - DNA, 12 bp, Homo sapiens
taagccacagct

SEQ ID NO: 4224895 - DNA, 13 bp, Homo sapiens
taaggtgccttct

SEQ ID NO: 4224896 - DNA, 21 bp, Homo sapiens
taagtctcctttactgaatgt

SEQ ID NO: 4224897 - DNA, 13 bp, Homo sapiens
taataaattgatt

SEQ ID NO: 4224898 - DNA, 20 bp, Homo sapiens
taataatatactgtactata

SEQ ID NO: 4224899 - DNA, 23 bp, Homo sapiens
taatatagtaggggttgaagaaa

SEQ ID NO: 4224900 - DNA, 16 bp, Homo sapiens
taatcggcccacagct

SEQ ID NO: 4224901 - DNA, 17 bp, Homo sapiens
taatgcaagcaaagtat

SEQ ID NO: 4224902 - DNA, 17 bp, Homo sapiens
taatgctgttgcctcat

SEQ ID NO: 4224903 - DNA, 14 bp, Homo sapiens
taatgttgaatgta

SEQ ID NO: 4224904 - DNA, 14 bp, Homo sapiens
taattagaaatcaa

SEQ ID NO: 4224905 - DNA, 13 bp, Homo sapiens
taattatatttct

SEQ ID NO: 4224906 - DNA, 16 bp, Homo sapiens
taatttgtatgctaaa

SEQ ID NO: 4224907 - DNA, 21 bp, Homo sapiens
taatttgtatgctaaatgagg

SEQ ID NO: 4224908 - DNA, 15 bp, Homo sapiens
taatttgtgaatttg

SEQ ID NO: 4224909 - DNA, 14 bp, Homo sapiens
tacaatgtaaacca

SEQ ID NO: 4224910 - DNA, 18 bp, Homo sapiens
tacagagaaaatgaattt

SEQ ID NO: 4224911 - DNA, 22 bp, Homo sapiens
tacagggtagcaggtaccactg

SEQ ID NO: 4224912 - DNA, 23 bp, Homo sapiens
tacagtttcattaactccttccc

SEQ ID NO: 4224913 - DNA, 14 bp, Homo sapiens
tacatgctgctaat

SEQ ID NO: 4224914 - DNA, 16 bp, Homo sapiens
tacattgtgaaacttc

SEQ ID NO: 4224915 - DNA, 19 bp, Homo sapiens
taccatatgtctgcttctg

SEQ ID NO: 4224916 - DNA, 20 bp, Homo sapiens
taccatatgtctgcttctgt

SEQ ID NO: 4224917 - DNA, 19 bp, Homo sapiens
taccattatttaatttgta

SEQ ID NO: 4224918 - DNA, 13 bp, Homo sapiens
taccctccagagt

SEQ ID NO: 4224919 - DNA, 14 bp, Homo sapiens
taccctccagagtg

SEQ ID NO: 4224920 - DNA, 16 bp, Homo sapiens
tacctcaaaacacttt

SEQ ID NO: 4224921 - DNA, 15 bp, Homo sapiens
tacctcctgcccagg

SEQ ID NO: 4224922 - DNA, 19 bp, Homo sapiens
tacctttgaaatattaaaa

SEQ ID NO: 4224923 - DNA, 20 bp, Homo sapiens
tacgtgacctctgcaagaca

SEQ ID NO: 4224924 - DNA, 15 bp, Homo sapiens
tacgttaaaagcaaa

SEQ ID NO: 4224925 - DNA, 23 bp, Homo sapiens
tacgttaaaagcaaaaagatgta

SEQ ID NO: 4224926 - DNA, 14 bp, Homo sapiens
tactcagcagccct

SEQ ID NO: 4224927 - DNA, 15 bp, Homo sapiens
tactcagcagccctc

SEQ ID NO: 4224928 - DNA, 18 bp, Homo sapiens
tactcagcagccctcctc

SEQ ID NO: 4224929 - DNA, 23 bp, Homo sapiens
tactcagcagccctcctcacccc

SEQ ID NO: 4224930 - DNA, 15 bp, Homo sapiens
tactcaggaggctga

SEQ ID NO: 4224931 - DNA, 19 bp, Homo sapiens
tactgccggtcacccaggc

SEQ ID NO: 4224932 - DNA, 16 bp, Homo sapiens
tagaagtggaccagga

SEQ ID NO: 4224933 - DNA, 20 bp, Homo sapiens
tagaagtgggccaggacagg

SEQ ID NO: 4224934 - DNA, 17 bp, Homo sapiens
tagagtcaatttgctga

SEQ ID NO: 4224935 - DNA, 17 bp, Homo sapiens
tagattatttctgtatt

SEQ ID NO: 4224936 - DNA, 14 bp, Homo sapiens
tagccgagagcctg

SEQ ID NO: 4224937 - DNA, 18 bp, Homo sapiens
tagccgagagcctgctcc

SEQ ID NO: 4224938 - DNA, 14 bp, Homo sapiens
tagctagaagtggg

SEQ ID NO: 4224939 - DNA, 19 bp, Homo sapiens
tagctagaagtgggccagg

SEQ ID NO: 4224940 - DNA, 11 bp, Homo sapiens
tagctgcagaa

SEQ ID NO: 4224941 - DNA, 12 bp, Homo sapiens
tagctgcagaac

SEQ ID NO: 4224942 - DNA, 14 bp, Homo sapiens
tagctgtggtgagg

SEQ ID NO: 4224943 - DNA, 22 bp, Homo sapiens
taggaaagcgtggttccaagaa

SEQ ID NO: 4224944 - DNA, 18 bp, Homo sapiens
taggagctgggaggaaaa

SEQ ID NO: 4224945 - DNA, 17 bp, Homo sapiens
tagggagaatgcagaga

SEQ ID NO: 4224946 - DNA, 15 bp, Homo sapiens
tagggtaaggtgcct

SEQ ID NO: 4224947 - DNA, 16 bp, Homo sapiens
tagtaaaaataaaatt

SEQ ID NO: 4224948 - DNA, 17 bp, Homo sapiens
tagtaaatatgtgaaga

SEQ ID NO: 4224949 - DNA, 17 bp, Homo sapiens
tagtaggggttgaagaa

SEQ ID NO: 4224950 - DNA, 18 bp, Homo sapiens
tagtaggggttgaagaaa

SEQ ID NO: 4224951 - DNA, 14 bp, Homo sapiens
tagtcacaccatct

SEQ ID NO: 4224952 - DNA, 16 bp, Homo sapiens
tagttgtggaaagata

SEQ ID NO: 4224953 - DNA, 15 bp, Homo sapiens
tagtttcctatggaa

SEQ ID NO: 4224954 - DNA, 11 bp, Homo sapiens
tataaactgaa

SEQ ID NO: 4224955 - DNA, 23 bp, Homo sapiens
tataaactgagaggtcacaaaga

SEQ ID NO: 4224956 - DNA, 14 bp, Homo sapiens
tataaagcagatta

SEQ ID NO: 4224957 - DNA, 18 bp, Homo sapiens
tataaagcagattacctc

SEQ ID NO: 4224958 - DNA, 16 bp, Homo sapiens
tataaattaatacaga

SEQ ID NO: 4224959 - DNA, 17 bp, Homo sapiens
tataccatatgtctgct

SEQ ID NO: 4224960 - DNA, 10 bp, Homo sapiens
tatattttat

SEQ ID NO: 4224961 - DNA, 11 bp, Homo sapiens
tatattttatg

SEQ ID NO: 4224962 - DNA, 12 bp, Homo sapiens
tatattttatga

SEQ ID NO: 4224963 - DNA, 17 bp, Homo sapiens
tatattttatgatttaa

SEQ ID NO: 4224964 - DNA, 16 bp, Homo sapiens
tatcatttgtgaagaa

SEQ ID NO: 4224965 - DNA, 17 bp, Homo sapiens
tatcatttgtgaagaat

SEQ ID NO: 4224966 - DNA, 14 bp, Homo sapiens
tatccacccagccc

SEQ ID NO: 4224967 - DNA, 21 bp, Homo sapiens
tatccttaggaaaatgcttct

SEQ ID NO: 4224968 - DNA, 14 bp, Homo sapiens
tatcgttactggca

SEQ ID NO: 4224969 - DNA, 23 bp, Homo sapiens
tatcttttctattgtttattctt

SEQ ID NO: 4224970 - DNA, 16 bp, Homo sapiens
tatgacagctgtccct

SEQ ID NO: 4224971 - DNA, 17 bp, Homo sapiens
tatgatttggaaaataa

SEQ ID NO: 4224972 - DNA, 14 bp, Homo sapiens
tatgcttgtgtata

SEQ ID NO: 4224973 - DNA, 20 bp, Homo sapiens
tatggggctgaacggggaga

SEQ ID NO: 4224974 - DNA, 21 bp, Homo sapiens
tatgtctgcttctgtccagga

SEQ ID NO: 4224975 - DNA, 15 bp, Homo sapiens
tattaagatttccaa

SEQ ID NO: 4224976 - DNA, 20 bp, Homo sapiens
tattatgtaacatccagaag

SEQ ID NO: 4224977 - DNA, 17 bp, Homo sapiens
tattattcatcttttca

SEQ ID NO: 4224978 - DNA, 15 bp, Homo sapiens
tattcattcattttg

SEQ ID NO: 4224979 - DNA, 15 bp, Homo sapiens
tattctcactccacc

SEQ ID NO: 4224980 - DNA, 19 bp, Homo sapiens
tattctcactccaccaccc

SEQ ID NO: 4224981 - DNA, 15 bp, Homo sapiens
tatttaacatgggag

SEQ ID NO: 4224982 - DNA, 14 bp, Homo sapiens
tatttaatttgtat

SEQ ID NO: 4224983 - DNA, 17 bp, Homo sapiens
tatttagcgcacccaga

SEQ ID NO: 4224984 - DNA, 16 bp, Homo sapiens
tattttagatgttatt

SEQ ID NO: 4224985 - DNA, 15 bp, Homo sapiens
tattttgtctcctac

SEQ ID NO: 4224986 - DNA, 18 bp, Homo sapiens
tatttttaactctggatt

SEQ ID NO: 4224987 - DNA, 11 bp, Homo sapiens
tcaaaagccaa

SEQ ID NO: 4224988 - DNA, 13 bp, Homo sapiens
tcaaaagccaaaa

SEQ ID NO: 4224989 - DNA, 15 bp, Homo sapiens
tcaaaagccaaaaaa

SEQ ID NO: 4224990 - DNA, 16 bp, Homo sapiens
tcaaagaaaaacaatg

SEQ ID NO: 4224991 - DNA, 13 bp, Homo sapiens
tcaaagcttaaaa

SEQ ID NO: 4224992 - DNA, 16 bp, Homo sapiens
tcaaatgtcagagcta

SEQ ID NO: 4224993 - DNA, 15 bp, Homo sapiens
tcaaccaatgtagaa

SEQ ID NO: 4224994 - DNA, 15 bp, Homo sapiens
tcaagggtccagaag

SEQ ID NO: 4224995 - DNA, 16 bp, Homo sapiens
tcaagggtccagaagt

SEQ ID NO: 4224996 - DNA, 21 bp, Homo sapiens
tcaagtgcatgctctctgcag

SEQ ID NO: 4224997 - DNA, 13 bp, Homo sapiens
tcaatactgagcc

SEQ ID NO: 4224998 - DNA, 15 bp, Homo sapiens
tcaatcccctcattc

SEQ ID NO: 4224999 - DNA, 16 bp, Homo sapiens
tcaatctaaattaaaa

SEQ ID NO: 4225000 - DNA, 14 bp, Homo sapiens
tcaatttgctgaaa

SEQ ID NO: 4225001 - DNA, 22 bp, Homo sapiens
tcacacgtctggcttcacagat

SEQ ID NO: 4225002 - DNA, 20 bp, Homo sapiens
tcacactgcaagagccttgg

SEQ ID NO: 4225003 - DNA, 21 bp, Homo sapiens
tcacactgcaagagccttggt

SEQ ID NO: 4225004 - DNA, 21 bp, Homo sapiens
tcacagatgtgtgattcacag

SEQ ID NO: 4225005 - DNA, 20 bp, Homo sapiens
tcacaggttggaagagaatc

SEQ ID NO: 4225006 - DNA, 16 bp, Homo sapiens
tcacagtgttatgtag

SEQ ID NO: 4225007 - DNA, 14 bp, Homo sapiens
tcacagttcctcgc

SEQ ID NO: 4225008 - DNA, 16 bp, Homo sapiens
tcacagttcctcgccc

SEQ ID NO: 4225009 - DNA, 20 bp, Homo sapiens
tcacagttcctcgccctggg

SEQ ID NO: 4225010 - DNA, 21 bp, Homo sapiens
tcacagttcctcgccctgggt

SEQ ID NO: 4225011 - DNA, 12 bp, Homo sapiens
tcaccaagctca

SEQ ID NO: 4225012 - DNA, 20 bp, Homo sapiens
tcaccaagctcacagttcct

SEQ ID NO: 4225013 - DNA, 22 bp, Homo sapiens
tcaccaagctcacagttcctcg

SEQ ID NO: 4225014 - DNA, 14 bp, Homo sapiens
tcacccacagggct

SEQ ID NO: 4225015 - DNA, 22 bp, Homo sapiens
tcacccacagggctaagagcta

SEQ ID NO: 4225016 - DNA, 15 bp, Homo sapiens
tcacctctgcctcaa

SEQ ID NO: 4225017 - DNA, 14 bp, Homo sapiens
tcacctggcctgcc

SEQ ID NO: 4225018 - DNA, 18 bp, Homo sapiens
tcacgggcagtagctgtg

SEQ ID NO: 4225019 - DNA, 20 bp, Homo sapiens
tcactcccgaggatgtgtcc

SEQ ID NO: 4225020 - DNA, 22 bp, Homo sapiens
tcactcccgaggatgtgtccta

SEQ ID NO: 4225021 - DNA, 16 bp, Homo sapiens
tcactgagccatcatt

SEQ ID NO: 4225022 - DNA, 22 bp, Homo sapiens
tcactggagcaccaggcacgaa

SEQ ID NO: 4225023 - DNA, 16 bp, Homo sapiens
tcagaaggagaaggaa

SEQ ID NO: 4225024 - DNA, 18 bp, Homo sapiens
tcagaaggagaaggaagg

SEQ ID NO: 4225025 - DNA, 13 bp, Homo sapiens
tcagaccccagcg

SEQ ID NO: 4225026 - DNA, 12 bp, Homo sapiens
tcagacccccac

SEQ ID NO: 4225027 - DNA, 13 bp, Homo sapiens
tcagaccctaccc

SEQ ID NO: 4225028 - DNA, 20 bp, Homo sapiens
tcagagacaacttcccaaag

SEQ ID NO: 4225029 - DNA, 14 bp, Homo sapiens
tcagagagagtgtt

SEQ ID NO: 4225030 - DNA, 20 bp, Homo sapiens
tcagatgggaggaaagagag

SEQ ID NO: 4225031 - DNA, 14 bp, Homo sapiens
tcagcagccctcct

SEQ ID NO: 4225032 - DNA, 19 bp, Homo sapiens
tcagcatttgttctttgcc

SEQ ID NO: 4225033 - DNA, 21 bp, Homo sapiens
tcagccatgaggagttgctgt

SEQ ID NO: 4225034 - DNA, 13 bp, Homo sapiens
tcagcccctcctc

SEQ ID NO: 4225035 - DNA, 16 bp, Homo sapiens
tcagcccctcctctgc

SEQ ID NO: 4225036 - DNA, 23 bp, Homo sapiens
tcagcccctcctctgccacctcc

SEQ ID NO: 4225037 - DNA, 12 bp, Homo sapiens
tcagccctgggc

SEQ ID NO: 4225038 - DNA, 22 bp, Homo sapiens
tcagccctgggccccaccacct

SEQ ID NO: 4225039 - DNA, 23 bp, Homo sapiens
tcagccctgggccccaccaccta

SEQ ID NO: 4225040 - DNA, 22 bp, Homo sapiens
tcaggaaaactgacagaggagg

SEQ ID NO: 4225041 - DNA, 18 bp, Homo sapiens
tcaggaggctgaggcaga

SEQ ID NO: 4225042 - DNA, 23 bp, Homo sapiens
tcagggacagagacacctgcacc

SEQ ID NO: 4225043 - DNA, 18 bp, Homo sapiens
tcagggctggggccaaga

SEQ ID NO: 4225044 - DNA, 16 bp, Homo sapiens
tcagtgaatttgtcca

SEQ ID NO: 4225045 - DNA, 17 bp, Homo sapiens
tcagtgaatttgtccat

SEQ ID NO: 4225046 - DNA, 21 bp, Homo sapiens
tcagtgaatttgtccattgta

SEQ ID NO: 4225047 - DNA, 13 bp, Homo sapiens
tcagtgcccacca

SEQ ID NO: 4225048 - DNA, 22 bp, Homo sapiens
tcagtgcccaccaacatcccat

SEQ ID NO: 4225049 - DNA, 22 bp, Homo sapiens
tcagtgggaacgtgactgcccc

SEQ ID NO: 4225050 - DNA, 23 bp, Homo sapiens
tcagtgggaacgtgactgcccca

SEQ ID NO: 4225051 - DNA, 15 bp, Homo sapiens
tcatattttgccact

SEQ ID NO: 4225052 - DNA, 21 bp, Homo sapiens
tcatcagagctcctctgtcct

SEQ ID NO: 4225053 - DNA, 16 bp, Homo sapiens
tcatctctcaaactta

SEQ ID NO: 4225054 - DNA, 13 bp, Homo sapiens
tcatgatctccct

SEQ ID NO: 4225055 - DNA, 15 bp, Homo sapiens
tcattaaaatccagt

SEQ ID NO: 4225056 - DNA, 21 bp, Homo sapiens
tcattctttcccctcagagct

SEQ ID NO: 4225057 - DNA, 12 bp, Homo sapiens
tcatttgtgaag

SEQ ID NO: 4225058 - DNA, 14 bp, Homo sapiens
tcatttgtgaagaa

SEQ ID NO: 4225059 - DNA, 15 bp, Homo sapiens
tcatttgtgaagaat

SEQ ID NO: 4225060 - DNA, 12 bp, Homo sapiens
tccaaaagaaca

SEQ ID NO: 4225061 - DNA, 19 bp, Homo sapiens
tccaaatttaaccataaat

SEQ ID NO: 4225062 - DNA, 23 bp, Homo sapiens
tccaacctaacccctttcctgcg

SEQ ID NO: 4225063 - DNA, 14 bp, Homo sapiens
tccaacctggacaa

SEQ ID NO: 4225064 - DNA, 17 bp, Homo sapiens
tccaagaaagatccacc

SEQ ID NO: 4225065 - DNA, 15 bp, Homo sapiens
tccaaggtttataaa

SEQ ID NO: 4225066 - DNA, 20 bp, Homo sapiens
tccacaagattcccagagac

SEQ ID NO: 4225067 - DNA, 16 bp, Homo sapiens
tccaccaacccatcag

SEQ ID NO: 4225068 - DNA, 14 bp, Homo sapiens
tccacccctctcct

SEQ ID NO: 4225069 - DNA, 14 bp, Homo sapiens
tccaccgctgccta

SEQ ID NO: 4225070 - DNA, 12 bp, Homo sapiens
tccacctcagcc

SEQ ID NO: 4225071 - DNA, 17 bp, Homo sapiens
tccacctcagccttgga

SEQ ID NO: 4225072 - DNA, 20 bp, Homo sapiens
tccaccttgaacctgtcacc

SEQ ID NO: 4225073 - DNA, 19 bp, Homo sapiens
tccacggtcagatttgctg

SEQ ID NO: 4225074 - DNA, 15 bp, Homo sapiens
tccagaagtccctcc

SEQ ID NO: 4225075 - DNA, 18 bp, Homo sapiens
tccagagtgtgcagactg

SEQ ID NO: 4225076 - DNA, 18 bp, Homo sapiens
tccaggacatgatactga

SEQ ID NO: 4225077 - DNA, 21 bp, Homo sapiens
tccaggagggctaattagaaa

SEQ ID NO: 4225078 - DNA, 17 bp, Homo sapiens
tccaggatttataaagc

SEQ ID NO: 4225079 - DNA, 15 bp, Homo sapiens
tccaggcacccttct

SEQ ID NO: 4225080 - DNA, 19 bp, Homo sapiens
tccaggcacccttctttcc

SEQ ID NO: 4225081 - DNA, 21 bp, Homo sapiens
tccaggcacccttctttcctc

SEQ ID NO: 4225082 - DNA, 23 bp, Homo sapiens
tccaggcacccttctttcctctt

SEQ ID NO: 4225083 - DNA, 22 bp, Homo sapiens
tccaggtttttctggcattttc

SEQ ID NO: 4225084 - DNA, 17 bp, Homo sapiens
tccagtattatattatc

SEQ ID NO: 4225085 - DNA, 21 bp, Homo sapiens
tccagtctcatctatgtcata

SEQ ID NO: 4225086 - DNA, 14 bp, Homo sapiens
tccatcccaacctg

SEQ ID NO: 4225087 - DNA, 16 bp, Homo sapiens
tccatcctcccaggaa

SEQ ID NO: 4225088 - DNA, 21 bp, Homo sapiens
tccatggacaatataaactga

SEQ ID NO: 4225089 - DNA, 12 bp, Homo sapiens
tccattcctcag

SEQ ID NO: 4225090 - DNA, 23 bp, Homo sapiens
tcccaacctggctccctcccacc

SEQ ID NO: 4225091 - DNA, 20 bp, Homo sapiens
tcccacccaacagctcagag

SEQ ID NO: 4225092 - DNA, 20 bp, Homo sapiens
tcccaccccacccccttcag

SEQ ID NO: 4225093 - DNA, 17 bp, Homo sapiens
tcccagagacaggaaaa

SEQ ID NO: 4225094 - DNA, 18 bp, Homo sapiens
tcccagagacaggaaaat

SEQ ID NO: 4225095 - DNA, 20 bp, Homo sapiens
tcccagagacaggaaaatcc

SEQ ID NO: 4225096 - DNA, 16 bp, Homo sapiens
tcccagctactcagga

SEQ ID NO: 4225097 - DNA, 16 bp, Homo sapiens
tcccagctctccctct

SEQ ID NO: 4225098 - DNA, 18 bp, Homo sapiens
tcccagctctccctctgg

SEQ ID NO: 4225099 - DNA, 22 bp, Homo sapiens
tcccagtataagatttttgaaa

SEQ ID NO: 4225100 - DNA, 14 bp, Homo sapiens
tcccatcactggag

SEQ ID NO: 4225101 - DNA, 15 bp, Homo sapiens
tcccattgccctggt

SEQ ID NO: 4225102 - DNA, 21 bp, Homo sapiens
tccccagaagacacaggaaac

SEQ ID NO: 4225103 - DNA, 22 bp, Homo sapiens
tccccaggtggctgacccagtc

SEQ ID NO: 4225104 - DNA, 19 bp, Homo sapiens
tccccatcatcccagctgc

SEQ ID NO: 4225105 - DNA, 19 bp, Homo sapiens
tccccattttataccaaag

SEQ ID NO: 4225106 - DNA, 15 bp, Homo sapiens
tcccccaaaaatttg

SEQ ID NO: 4225107 - DNA, 19 bp, Homo sapiens
tcccccaccccctccccag

SEQ ID NO: 4225108 - DNA, 20 bp, Homo sapiens
tcccccaccccctccccagg

SEQ ID NO: 4225109 - DNA, 13 bp, Homo sapiens
tccccccaacccg

SEQ ID NO: 4225110 - DNA, 18 bp, Homo sapiens
tccccccactgcaggccc

SEQ ID NO: 4225111 - DNA, 22 bp, Homo sapiens
tccccggtcccttgagacctca

SEQ ID NO: 4225112 - DNA, 17 bp, Homo sapiens
tcccctatccacccagc

SEQ ID NO: 4225113 - DNA, 21 bp, Homo sapiens
tcccctatccacccagcccat

SEQ ID NO: 4225114 - DNA, 15 bp, Homo sapiens
tcccctcagagctct

SEQ ID NO: 4225115 - DNA, 16 bp, Homo sapiens
tcccctcagagctctt

SEQ ID NO: 4225116 - DNA, 21 bp, Homo sapiens
tccccttgcccttgccctgac

SEQ ID NO: 4225117 - DNA, 15 bp, Homo sapiens
tcccggctccctcct

SEQ ID NO: 4225118 - DNA, 12 bp, Homo sapiens
tccctcccaccc

SEQ ID NO: 4225119 - DNA, 21 bp, Homo sapiens
tccctcccacccaaccaactt

SEQ ID NO: 4225120 - DNA, 14 bp, Homo sapiens
tccctcctgtctct

SEQ ID NO: 4225121 - DNA, 18 bp, Homo sapiens
tccctctggccctgcctt

SEQ ID NO: 4225122 - DNA, 18 bp, Homo sapiens
tccctgaaaacccagaga

SEQ ID NO: 4225123 - DNA, 11 bp, Homo sapiens
tccctggcttg

SEQ ID NO: 4225124 - DNA, 21 bp, Homo sapiens
tccctggcttgtaactccacc

SEQ ID NO: 4225125 - DNA, 20 bp, Homo sapiens
tccctgggggaagccctgga

SEQ ID NO: 4225126 - DNA, 15 bp, Homo sapiens
tccctgtcctcctcg

SEQ ID NO: 4225127 - DNA, 13 bp, Homo sapiens
tcccttgagacct

SEQ ID NO: 4225128 - DNA, 19 bp, Homo sapiens
tcccttgagacctcagcca

SEQ ID NO: 4225129 - DNA, 13 bp, Homo sapiens
tccctttaaagag

SEQ ID NO: 4225130 - DNA, 14 bp, Homo sapiens
tccctttaaagaga

SEQ ID NO: 4225131 - DNA, 22 bp, Homo sapiens
tcctaatgaatgcataaaatgt

SEQ ID NO: 4225132 - DNA, 19 bp, Homo sapiens
tcctaatttcccttcttgc

SEQ ID NO: 4225133 - DNA, 14 bp, Homo sapiens
tcctataacttgat

SEQ ID NO: 4225134 - DNA, 19 bp, Homo sapiens
tcctataccatatgtctgc

SEQ ID NO: 4225135 - DNA, 20 bp, Homo sapiens
tcctcaccccgtctggggtt

SEQ ID NO: 4225136 - DNA, 19 bp, Homo sapiens
tcctcagagtcccggcgtt

SEQ ID NO: 4225137 - DNA, 18 bp, Homo sapiens
tcctcagggacagagaca

SEQ ID NO: 4225138 - DNA, 24 bp, Homo sapiens
tcctcagggacagagacacctgca

SEQ ID NO: 4225139 - DNA, 21 bp, Homo sapiens
tcctccacagctgcagcccat

SEQ ID NO: 4225140 - DNA, 23 bp, Homo sapiens
tcctccagggccacgtgccaggc

SEQ ID NO: 4225141 - DNA, 13 bp, Homo sapiens
tcctccccctgcc

SEQ ID NO: 4225142 - DNA, 20 bp, Homo sapiens
tcctccccctgccagtgcct

SEQ ID NO: 4225143 - DNA, 23 bp, Homo sapiens
tcctccccctgccagtgccttac

SEQ ID NO: 4225144 - DNA, 19 bp, Homo sapiens
tcctccctttccttcctaa

SEQ ID NO: 4225145 - DNA, 16 bp, Homo sapiens
tcctcggatcaccgag

SEQ ID NO: 4225146 - DNA, 11 bp, Homo sapiens
tcctctccagg

SEQ ID NO: 4225147 - DNA, 14 bp, Homo sapiens
tcctctgccacctc

SEQ ID NO: 4225148 - DNA, 22 bp, Homo sapiens
tcctctgccacctcccctatcc

SEQ ID NO: 4225149 - DNA, 23 bp, Homo sapiens
tcctctggctggctaactggaag

SEQ ID NO: 4225150 - DNA, 16 bp, Homo sapiens
tcctcttccccttgcc

SEQ ID NO: 4225151 - DNA, 13 bp, Homo sapiens
tcctgaagccaga

SEQ ID NO: 4225152 - DNA, 12 bp, Homo sapiens
tcctgcccagga

SEQ ID NO: 4225153 - DNA, 16 bp, Homo sapiens
tcctgcccaggagagc

SEQ ID NO: 4225154 - DNA, 20 bp, Homo sapiens
tcctgcgggcttttccccgg

SEQ ID NO: 4225155 - DNA, 23 bp, Homo sapiens
tcctgcgggcttttccccggtcc

SEQ ID NO: 4225156 - DNA, 18 bp, Homo sapiens
tcctgtccaacctaaccc

SEQ ID NO: 4225157 - DNA, 20 bp, Homo sapiens
tcctgtccaacctaacccct

SEQ ID NO: 4225158 - DNA, 14 bp, Homo sapiens
tccttacaatgtaa

SEQ ID NO: 4225159 - DNA, 19 bp, Homo sapiens
tccttaggaaaatgcttct

SEQ ID NO: 4225160 - DNA, 15 bp, Homo sapiens
tccttccctggcttg

SEQ ID NO: 4225161 - DNA, 20 bp, Homo sapiens
tccttcctaatttcccttct

SEQ ID NO: 4225162 - DNA, 15 bp, Homo sapiens
tccttccttccctgg

SEQ ID NO: 4225163 - DNA, 19 bp, Homo sapiens
tccttgtcaatactgagcc

SEQ ID NO: 4225164 - DNA, 18 bp, Homo sapiens
tcctttactgaatgtaag

SEQ ID NO: 4225165 - DNA, 17 bp, Homo sapiens
tcgctctgctggcctgg

SEQ ID NO: 4225166 - DNA, 20 bp, Homo sapiens
tcgctctgctggcctggccg

SEQ ID NO: 4225167 - DNA, 16 bp, Homo sapiens
tcgtgatcactgagcc

SEQ ID NO: 4225168 - DNA, 20 bp, Homo sapiens
tcgtgccgttactctccaac

SEQ ID NO: 4225169 - DNA, 23 bp, Homo sapiens
tcgtgccgttactctccaacctg

SEQ ID NO: 4225170 - DNA, 14 bp, Homo sapiens
tctaaattaaaaaa

SEQ ID NO: 4225171 - DNA, 17 bp, Homo sapiens
tctaaattaaaaaagaa

SEQ ID NO: 4225172 - DNA, 20 bp, Homo sapiens
tctaataaagctcctctgct

SEQ ID NO: 4225173 - DNA, 14 bp, Homo sapiens
tctaatagagagat

SEQ ID NO: 4225174 - DNA, 21 bp, Homo sapiens
tctaatgtctcttcctctgtt

SEQ ID NO: 4225175 - DNA, 22 bp, Homo sapiens
tctacagagaaaatgaatttgg

SEQ ID NO: 4225176 - DNA, 19 bp, Homo sapiens
tctagcagtaaaagataaa

SEQ ID NO: 4225177 - DNA, 21 bp, Homo sapiens
tctaggagctgggaggaaaag

SEQ ID NO: 4225178 - DNA, 15 bp, Homo sapiens
tctataacatgcatt

SEQ ID NO: 4225179 - DNA, 23 bp, Homo sapiens
tctatcactaaaaatttttacaa

SEQ ID NO: 4225180 - DNA, 23 bp, Homo sapiens
tctatcccacccaacagctcaga

SEQ ID NO: 4225181 - DNA, 17 bp, Homo sapiens
tctattaagatttccaa

SEQ ID NO: 4225182 - DNA, 18 bp, Homo sapiens
tctattaagatttccaag

SEQ ID NO: 4225183 - DNA, 16 bp, Homo sapiens
tctattgtttattctt

SEQ ID NO: 4225184 - DNA, 11 bp, Homo sapiens
tctatttttgt

SEQ ID NO: 4225185 - DNA, 18 bp, Homo sapiens
tctcactccaccacccaa

SEQ ID NO: 4225186 - DNA, 11 bp, Homo sapiens
tctccacctca

SEQ ID NO: 4225187 - DNA, 13 bp, Homo sapiens
tctccacctcagc

SEQ ID NO: 4225188 - DNA, 17 bp, Homo sapiens
tctccacctcagccttg

SEQ ID NO: 4225189 - DNA, 17 bp, Homo sapiens
tctccaggcacccttct

SEQ ID NO: 4225190 - DNA, 23 bp, Homo sapiens
tctccaggcacccttctttcctc

SEQ ID NO: 4225191 - DNA, 15 bp, Homo sapiens
tctccctctcctgcc

SEQ ID NO: 4225192 - DNA, 18 bp, Homo sapiens
tctccctctcctgcctac

SEQ ID NO: 4225193 - DNA, 12 bp, Homo sapiens
tctccctctggc

SEQ ID NO: 4225194 - DNA, 14 bp, Homo sapiens
tctccctgccgcct

SEQ ID NO: 4225195 - DNA, 21 bp, Homo sapiens
tctctaagccacagcttcttc

SEQ ID NO: 4225196 - DNA, 17 bp, Homo sapiens
tctctcaaacttagttt

SEQ ID NO: 4225197 - DNA, 11 bp, Homo sapiens
tctctctcctg

SEQ ID NO: 4225198 - DNA, 13 bp, Homo sapiens
tctctctcctgtc

SEQ ID NO: 4225199 - DNA, 19 bp, Homo sapiens
tctctgcagccagcccagc

SEQ ID NO: 4225200 - DNA, 20 bp, Homo sapiens
tctctgcagccagcccagcc

SEQ ID NO: 4225201 - DNA, 18 bp, Homo sapiens
tctctttacttcccagta

SEQ ID NO: 4225202 - DNA, 17 bp, Homo sapiens
tctgaaagacagaatgt

SEQ ID NO: 4225203 - DNA, 13 bp, Homo sapiens
tctgattccactt

SEQ ID NO: 4225204 - DNA, 13 bp, Homo sapiens
tctgatttttaat

SEQ ID NO: 4225205 - DNA, 13 bp, Homo sapiens
tctgcaagacaaa

SEQ ID NO: 4225206 - DNA, 18 bp, Homo sapiens
tctgcacttctgttccag

SEQ ID NO: 4225207 - DNA, 14 bp, Homo sapiens
tctgccacctcccc

SEQ ID NO: 4225208 - DNA, 23 bp, Homo sapiens
tctgccacctcccctatccaccc

SEQ ID NO: 4225209 - DNA, 16 bp, Homo sapiens
tctgctcctctccagg

SEQ ID NO: 4225210 - DNA, 17 bp, Homo sapiens
tctgctcctctccaggc

SEQ ID NO: 4225211 - DNA, 20 bp, Homo sapiens
tctgctcctctccaggcacc

SEQ ID NO: 4225212 - DNA, 16 bp, Homo sapiens
tctgctggcctggccg

SEQ ID NO: 4225213 - DNA, 21 bp, Homo sapiens
tctgcttaggtgccaggcatg

SEQ ID NO: 4225214 - DNA, 11 bp, Homo sapiens
tctggagaagc

SEQ ID NO: 4225215 - DNA, 14 bp, Homo sapiens
tctggattttgaat

SEQ ID NO: 4225216 - DNA, 14 bp, Homo sapiens
tctggccctgcctt

SEQ ID NO: 4225217 - DNA, 15 bp, Homo sapiens
tctgggaccctttcc

SEQ ID NO: 4225218 - DNA, 16 bp, Homo sapiens
tctgggaccctttcct

SEQ ID NO: 4225219 - DNA, 23 bp, Homo sapiens
tctggggttcagcccctcctctg

SEQ ID NO: 4225220 - DNA, 15 bp, Homo sapiens
tctgtcctgcttctg

SEQ ID NO: 4225221 - DNA, 22 bp, Homo sapiens
tctgtgcccctgtaaatagttt

SEQ ID NO: 4225222 - DNA, 21 bp, Homo sapiens
tctgttaagtaaaatgtcata

SEQ ID NO: 4225223 - DNA, 18 bp, Homo sapiens
tcttaaatgacagtgaat

SEQ ID NO: 4225224 - DNA, 16 bp, Homo sapiens
tcttagtggaagacaa

SEQ ID NO: 4225225 - DNA, 17 bp, Homo sapiens
tcttagtggaagacaat

SEQ ID NO: 4225226 - DNA, 23 bp, Homo sapiens
tcttcaggtggaaaaacatctga

SEQ ID NO: 4225227 - DNA, 19 bp, Homo sapiens
tcttcagtgggagaaaaca

SEQ ID NO: 4225228 - DNA, 16 bp, Homo sapiens
tcttcccatcactgga

SEQ ID NO: 4225229 - DNA, 16 bp, Homo sapiens
tcttccccttgccctt

SEQ ID NO: 4225230 - DNA, 19 bp, Homo sapiens
tcttcggggaactcctgga

SEQ ID NO: 4225231 - DNA, 12 bp, Homo sapiens
tcttctccatct

SEQ ID NO: 4225232 - DNA, 23 bp, Homo sapiens
tcttgcatccttcctataacttg

SEQ ID NO: 4225233 - DNA, 16 bp, Homo sapiens
tcttggggtcccaggg

SEQ ID NO: 4225234 - DNA, 18 bp, Homo sapiens
tctttcccctcagagctc

SEQ ID NO: 4225235 - DNA, 22 bp, Homo sapiens
tctttcctcttccccttgccct

SEQ ID NO: 4225236 - DNA, 16 bp, Homo sapiens
tctttgccatttcttc

SEQ ID NO: 4225237 - DNA, 14 bp, Homo sapiens
tgaaaaaaatgaaa

SEQ ID NO: 4225238 - DNA, 16 bp, Homo sapiens
tgaaaacccagagagg

SEQ ID NO: 4225239 - DNA, 13 bp, Homo sapiens
tgaaagctagaga

SEQ ID NO: 4225240 - DNA, 14 bp, Homo sapiens
tgaaattaatttgt

SEQ ID NO: 4225241 - DNA, 20 bp, Homo sapiens
tgaaattaatttgtgaattt

SEQ ID NO: 4225242 - DNA, 22 bp, Homo sapiens
tgaacaaagaaaaaaatatatt

SEQ ID NO: 4225243 - DNA, 12 bp, Homo sapiens
tgaacccaggag

SEQ ID NO: 4225244 - DNA, 13 bp, Homo sapiens
tgaacccaggagg

SEQ ID NO: 4225245 - DNA, 20 bp, Homo sapiens
tgaaccccctcaaaagccaa

SEQ ID NO: 4225246 - DNA, 16 bp, Homo sapiens
tgaacggggagaaaag

SEQ ID NO: 4225247 - DNA, 22 bp, Homo sapiens
tgaagaaaaagacctgcatttg

SEQ ID NO: 4225248 - DNA, 23 bp, Homo sapiens
tgaagaattattcagtgaatttg

SEQ ID NO: 4225249 - DNA, 19 bp, Homo sapiens
tgaatattggtaattaaaa

SEQ ID NO: 4225250 - DNA, 14 bp, Homo sapiens
tgaatgcataaaat

SEQ ID NO: 4225251 - DNA, 19 bp, Homo sapiens
tgaattagattatttctgt

SEQ ID NO: 4225252 - DNA, 20 bp, Homo sapiens
tgaatttgggatactaaagt

SEQ ID NO: 4225253 - DNA, 24 bp, Homo sapiens
tgaatttgtccattgtaaatctga

SEQ ID NO: 4225254 - DNA, 19 bp, Homo sapiens
tgacaaagaaacccaagtg

SEQ ID NO: 4225255 - DNA, 18 bp, Homo sapiens
tgacagctgtccctgtca

SEQ ID NO: 4225256 - DNA, 17 bp, Homo sapiens
tgaccaacatggagaaa

SEQ ID NO: 4225257 - DNA, 18 bp, Homo sapiens
tgaccaacatggagaaac

SEQ ID NO: 4225258 - DNA, 15 bp, Homo sapiens
tgacccagtccctgg

SEQ ID NO: 4225259 - DNA, 22 bp, Homo sapiens
tgacctcccagccctatggatg

SEQ ID NO: 4225260 - DNA, 11 bp, Homo sapiens
tgactcaccca

SEQ ID NO: 4225261 - DNA, 14 bp, Homo sapiens
tgactcacccaagc

SEQ ID NO: 4225262 - DNA, 11 bp, Homo sapiens
tgagaaatgtg

SEQ ID NO: 4225263 - DNA, 12 bp, Homo sapiens
tgagacctcagc

SEQ ID NO: 4225264 - DNA, 19 bp, Homo sapiens
tgagacctcagccatgagg

SEQ ID NO: 4225265 - DNA, 20 bp, Homo sapiens
tgagagtctgaaagacagaa

SEQ ID NO: 4225266 - DNA, 18 bp, Homo sapiens
tgagatgtttaaataaat

SEQ ID NO: 4225267 - DNA, 17 bp, Homo sapiens
tgagccatcatttcctg

SEQ ID NO: 4225268 - DNA, 17 bp, Homo sapiens
tgagccgcatcttctcc

SEQ ID NO: 4225269 - DNA, 17 bp, Homo sapiens
tgagctcagacccccac

SEQ ID NO: 4225270 - DNA, 19 bp, Homo sapiens
tgagctcagacccccactc

SEQ ID NO: 4225271 - DNA, 17 bp, Homo sapiens
tgagggaacagacagga

SEQ ID NO: 4225272 - DNA, 15 bp, Homo sapiens
tgaggtggaagccct

SEQ ID NO: 4225273 - DNA, 21 bp, Homo sapiens
tgaggtgggttttcttcccat

SEQ ID NO: 4225274 - DNA, 13 bp, Homo sapiens
tgagtcaccagga

SEQ ID NO: 4225275 - DNA, 20 bp, Homo sapiens
tgagtcatgatctccctgcc

SEQ ID NO: 4225276 - DNA, 18 bp, Homo sapiens
tgataatatattgctaaa

SEQ ID NO: 4225277 - DNA, 15 bp, Homo sapiens
tgatcactgagccat

SEQ ID NO: 4225278 - DNA, 22 bp, Homo sapiens
tgatcactgagccatcatttcc

SEQ ID NO: 4225279 - DNA, 18 bp, Homo sapiens
tgatcagagcattgtgca

SEQ ID NO: 4225280 - DNA, 15 bp, Homo sapiens
tgatggggtgggcag

SEQ ID NO: 4225281 - DNA, 17 bp, Homo sapiens
tgatggggtgggcaggg

SEQ ID NO: 4225282 - DNA, 20 bp, Homo sapiens
tgatgtagggtaaggtgcct

SEQ ID NO: 4225283 - DNA, 14 bp, Homo sapiens
tgatgttactgaga

SEQ ID NO: 4225284 - DNA, 17 bp, Homo sapiens
tgatgttgagggaacag

SEQ ID NO: 4225285 - DNA, 12 bp, Homo sapiens
tgattcacagtg

SEQ ID NO: 4225286 - DNA, 20 bp, Homo sapiens
tgattggcaggagttggaag

SEQ ID NO: 4225287 - DNA, 19 bp, Homo sapiens
tgatttagcattcatattt

SEQ ID NO: 4225288 - DNA, 18 bp, Homo sapiens
tgatttccaaagagaaaa

SEQ ID NO: 4225289 - DNA, 16 bp, Homo sapiens
tgattttcagacaggg

SEQ ID NO: 4225290 - DNA, 17 bp, Homo sapiens
tgcaacagtaatcagag

SEQ ID NO: 4225291 - DNA, 16 bp, Homo sapiens
tgcaacttgtaaatgt

SEQ ID NO: 4225292 - DNA, 18 bp, Homo sapiens
tgcaacttgtaaatgtgg

SEQ ID NO: 4225293 - DNA, 13 bp, Homo sapiens
tgcaacttgtgaa

SEQ ID NO: 4225294 - DNA, 14 bp, Homo sapiens
tgcaagagccttgg

SEQ ID NO: 4225295 - DNA, 23 bp, Homo sapiens
tgcaagagccttggtgtccacct

SEQ ID NO: 4225296 - DNA, 20 bp, Homo sapiens
tgcaattttaattgattatt

SEQ ID NO: 4225297 - DNA, 14 bp, Homo sapiens
tgcacctcccccca

SEQ ID NO: 4225298 - DNA, 20 bp, Homo sapiens
tgcacctccccccactgcag

SEQ ID NO: 4225299 - DNA, 20 bp, Homo sapiens
tgcacgggggaactgtgtgt

SEQ ID NO: 4225300 - DNA, 13 bp, Homo sapiens
tgcacttctgttc

SEQ ID NO: 4225301 - DNA, 20 bp, Homo sapiens
tgcagaaaagcacctgccga

SEQ ID NO: 4225302 - DNA, 23 bp, Homo sapiens
tgcagccagcccagcccagctgg

SEQ ID NO: 4225303 - DNA, 13 bp, Homo sapiens
tgcataaaccaat

SEQ ID NO: 4225304 - DNA, 19 bp, Homo sapiens
tgcatatttttctaaagaa

SEQ ID NO: 4225305 - DNA, 18 bp, Homo sapiens
tgcatccattcctcaggg

SEQ ID NO: 4225306 - DNA, 19 bp, Homo sapiens
tgcatccattcctcaggga

SEQ ID NO: 4225307 - DNA, 20 bp, Homo sapiens
tgcatccattcctcagggac

SEQ ID NO: 4225308 - DNA, 19 bp, Homo sapiens
tgcatccgtagttccctga

SEQ ID NO: 4225309 - DNA, 13 bp, Homo sapiens
tgcatccttccta

SEQ ID NO: 4225310 - DNA, 15 bp, Homo sapiens
tgcatccttcctata

SEQ ID NO: 4225311 - DNA, 19 bp, Homo sapiens
tgcatgctctctgcagcca

SEQ ID NO: 4225312 - DNA, 21 bp, Homo sapiens
tgcattcaaccttaccaaaaa

SEQ ID NO: 4225313 - DNA, 14 bp, Homo sapiens
tgcatttaaagtat

SEQ ID NO: 4225314 - DNA, 17 bp, Homo sapiens
tgccaccactagagctg

SEQ ID NO: 4225315 - DNA, 13 bp, Homo sapiens
tgccaccctcctg

SEQ ID NO: 4225316 - DNA, 22 bp, Homo sapiens
tgccactgcctttcagaagtga

SEQ ID NO: 4225317 - DNA, 21 bp, Homo sapiens
tgccagtctcattttcatctt

SEQ ID NO: 4225318 - DNA, 22 bp, Homo sapiens
tgccagtctgttaagtaaaatg

SEQ ID NO: 4225319 - DNA, 12 bp, Homo sapiens
tgccatttcttc

SEQ ID NO: 4225320 - DNA, 18 bp, Homo sapiens
tgcccaaattatgtgaaa

SEQ ID NO: 4225321 - DNA, 22 bp, Homo sapiens
tgcccagagatgcctccaccgc

SEQ ID NO: 4225322 - DNA, 16 bp, Homo sapiens
tgcccaggagagccag

SEQ ID NO: 4225323 - DNA, 12 bp, Homo sapiens
tgcccctgtaaa

SEQ ID NO: 4225324 - DNA, 20 bp, Homo sapiens
tgccctgacctcccagccct

SEQ ID NO: 4225325 - DNA, 14 bp, Homo sapiens
tgcccttgccctga

SEQ ID NO: 4225326 - DNA, 14 bp, Homo sapiens
tgccgacctcgtcc

SEQ ID NO: 4225327 - DNA, 15 bp, Homo sapiens
tgccgacctcgtcct

SEQ ID NO: 4225328 - DNA, 12 bp, Homo sapiens
tgccgcacccca

SEQ ID NO: 4225329 - DNA, 15 bp, Homo sapiens
tgccgcaccccagag

SEQ ID NO: 4225330 - DNA, 18 bp, Homo sapiens
tgccgggggagccaccag

SEQ ID NO: 4225331 - DNA, 16 bp, Homo sapiens
tgccgttactctccaa

SEQ ID NO: 4225332 - DNA, 22 bp, Homo sapiens
tgccgttactctccaacctgga

SEQ ID NO: 4225333 - DNA, 15 bp, Homo sapiens
tgcctaagtggctgc

SEQ ID NO: 4225334 - DNA, 17 bp, Homo sapiens
tgcctaagtggctgctg

SEQ ID NO: 4225335 - DNA, 20 bp, Homo sapiens
tgcctccaccgctgcctaag

SEQ ID NO: 4225336 - DNA, 19 bp, Homo sapiens
tgcctgggtggggctgctc

SEQ ID NO: 4225337 - DNA, 21 bp, Homo sapiens
tgcctgggtggggctgctcct

SEQ ID NO: 4225338 - DNA, 22 bp, Homo sapiens
tgcctgggtggggctgctcctc

SEQ ID NO: 4225339 - DNA, 16 bp, Homo sapiens
tgcctgtgaggcaggg

SEQ ID NO: 4225340 - DNA, 17 bp, Homo sapiens
tgcctgtgaggcagggg

SEQ ID NO: 4225341 - DNA, 14 bp, Homo sapiens
tgccttacctcctg

SEQ ID NO: 4225342 - DNA, 18 bp, Homo sapiens
tgccttacctcctgccca

SEQ ID NO: 4225343 - DNA, 21 bp, Homo sapiens
tgccttacctcctgcccagga

SEQ ID NO: 4225344 - DNA, 21 bp, Homo sapiens
tgccttgacaacagactgaat

SEQ ID NO: 4225345 - DNA, 19 bp, Homo sapiens
tgcctttcagaagtgattt

SEQ ID NO: 4225346 - DNA, 21 bp, Homo sapiens
tgctaaaatattttagatgtt

SEQ ID NO: 4225347 - DNA, 17 bp, Homo sapiens
tgctattatgtaacatc

SEQ ID NO: 4225348 - DNA, 11 bp, Homo sapiens
tgctcctccag

SEQ ID NO: 4225349 - DNA, 13 bp, Homo sapiens
tgctcctccaggg

SEQ ID NO: 4225350 - DNA, 11 bp, Homo sapiens
tgctcctctcc

SEQ ID NO: 4225351 - DNA, 12 bp, Homo sapiens
tgctcctctcca

SEQ ID NO: 4225352 - DNA, 13 bp, Homo sapiens
tgctcctctccag

SEQ ID NO: 4225353 - DNA, 21 bp, Homo sapiens
tgctctctgcagccagcccag

SEQ ID NO: 4225354 - DNA, 18 bp, Homo sapiens
tgctgagagacccaagga

SEQ ID NO: 4225355 - DNA, 21 bp, Homo sapiens
tgctgagagacccaaggagga

SEQ ID NO: 4225356 - DNA, 22 bp, Homo sapiens
tgctgagagacccaaggaggaa

SEQ ID NO: 4225357 - DNA, 14 bp, Homo sapiens
tgctgggctctcca

SEQ ID NO: 4225358 - DNA, 16 bp, Homo sapiens
tgctgggctctccacc

SEQ ID NO: 4225359 - DNA, 20 bp, Homo sapiens
tgctgggctctccacctcag

SEQ ID NO: 4225360 - DNA, 19 bp, Homo sapiens
tgctgtttgtttgacaaag

SEQ ID NO: 4225361 - DNA, 13 bp, Homo sapiens
tgctttggaaatc

SEQ ID NO: 4225362 - DNA, 23 bp, Homo sapiens
tggaaaaacatctgaaagccacg

SEQ ID NO: 4225363 - DNA, 22 bp, Homo sapiens
tggaaatatcagttactcagcc

SEQ ID NO: 4225364 - DNA, 21 bp, Homo sapiens
tggaagtgtgtgatctgtggg

SEQ ID NO: 4225365 - DNA, 15 bp, Homo sapiens
tggacagatggacca

SEQ ID NO: 4225366 - DNA, 17 bp, Homo sapiens
tggacagatggaccaaa

SEQ ID NO: 4225367 - DNA, 20 bp, Homo sapiens
tggacagatggaccaaaaga

SEQ ID NO: 4225368 - DNA, 18 bp, Homo sapiens
tggaccaggacaggacca

SEQ ID NO: 4225369 - DNA, 19 bp, Homo sapiens
tggaccaggacaggaccag

SEQ ID NO: 4225370 - DNA, 14 bp, Homo sapiens
tggagaaaccctgt

SEQ ID NO: 4225371 - DNA, 16 bp, Homo sapiens
tggagaaaccctgtct

SEQ ID NO: 4225372 - DNA, 13 bp, Homo sapiens
tggagaagcagtg

SEQ ID NO: 4225373 - DNA, 21 bp, Homo sapiens
tggagaagctccctgaagtaa

SEQ ID NO: 4225374 - DNA, 22 bp, Homo sapiens
tggagtcatggtccggtgtcct

SEQ ID NO: 4225375 - DNA, 18 bp, Homo sapiens
tggataatgctgttgcct

SEQ ID NO: 4225376 - DNA, 20 bp, Homo sapiens
tggatctgggaccctttcct

SEQ ID NO: 4225377 - DNA, 21 bp, Homo sapiens
tggatctgggaccctttcctt

SEQ ID NO: 4225378 - DNA, 23 bp, Homo sapiens
tggatctgggaccctttccttcc

SEQ ID NO: 4225379 - DNA, 18 bp, Homo sapiens
tggatggacagatggacc

SEQ ID NO: 4225380 - DNA, 22 bp, Homo sapiens
tggcagatttagtgaaagctag

SEQ ID NO: 4225381 - DNA, 15 bp, Homo sapiens
tggcaggaagatgta

SEQ ID NO: 4225382 - DNA, 17 bp, Homo sapiens
tggcagggtgggatgga

SEQ ID NO: 4225383 - DNA, 14 bp, Homo sapiens
tggcattttctgtt

SEQ ID NO: 4225384 - DNA, 15 bp, Homo sapiens
tggcattttctgttc

SEQ ID NO: 4225385 - DNA, 12 bp, Homo sapiens
tggccctgcctt

SEQ ID NO: 4225386 - DNA, 18 bp, Homo sapiens
tggccctggcctgctggg

SEQ ID NO: 4225387 - DNA, 24 bp, Homo sapiens
tggccggcaaccccagttctgctc

SEQ ID NO: 4225388 - DNA, 20 bp, Homo sapiens
tggcctgccaccctcctgcg

SEQ ID NO: 4225389 - DNA, 20 bp, Homo sapiens
tggcctgctgggctctccac

SEQ ID NO: 4225390 - DNA, 22 bp, Homo sapiens
tggcctgctgggctctccacct

SEQ ID NO: 4225391 - DNA, 13 bp, Homo sapiens
tggcctggccggc

SEQ ID NO: 4225392 - DNA, 16 bp, Homo sapiens
tggcctggccggcaac

SEQ ID NO: 4225393 - DNA, 15 bp, Homo sapiens
tggcggctactcagc

SEQ ID NO: 4225394 - DNA, 17 bp, Homo sapiens
tggcggctactcagcag

SEQ ID NO: 4225395 - DNA, 13 bp, Homo sapiens
tggcggtgcctgg

SEQ ID NO: 4225396 - DNA, 16 bp, Homo sapiens
tggctagtcagagaga

SEQ ID NO: 4225397 - DNA, 19 bp, Homo sapiens
tggctgacccagtccctgg

SEQ ID NO: 4225398 - DNA, 18 bp, Homo sapiens
tgggaacgtgactgcccc

SEQ ID NO: 4225399 - DNA, 13 bp, Homo sapiens
tgggaagggagag

SEQ ID NO: 4225400 - DNA, 14 bp, Homo sapiens
tgggaccctttcct

SEQ ID NO: 4225401 - DNA, 13 bp, Homo sapiens
tgggagaaagacc

SEQ ID NO: 4225402 - DNA, 18 bp, Homo sapiens
tgggagacagtctaggaa

SEQ ID NO: 4225403 - DNA, 18 bp, Homo sapiens
tgggagactgctgagtca

SEQ ID NO: 4225404 - DNA, 12 bp, Homo sapiens
tgggaggaaaag

SEQ ID NO: 4225405 - DNA, 20 bp, Homo sapiens
tgggaggaaaagaaaagagg

SEQ ID NO: 4225406 - DNA, 16 bp, Homo sapiens
tgggaggaaagagagc

SEQ ID NO: 4225407 - DNA, 13 bp, Homo sapiens
tgggatggaggag

SEQ ID NO: 4225408 - DNA, 14 bp, Homo sapiens
tgggatggaggaga

SEQ ID NO: 4225409 - DNA, 16 bp, Homo sapiens
tgggatggaggagaag

SEQ ID NO: 4225410 - DNA, 20 bp, Homo sapiens
tgggcaaaagagaaaaagaa

SEQ ID NO: 4225411 - DNA, 10 bp, Homo sapiens
tgggcagggc

SEQ ID NO: 4225412 - DNA, 13 bp, Homo sapiens
tgggcagggctgg

SEQ ID NO: 4225413 - DNA, 21 bp, Homo sapiens
tgggcagggctgggagaactt

SEQ ID NO: 4225414 - DNA, 15 bp, Homo sapiens
tgggctctccacctc

SEQ ID NO: 4225415 - DNA, 20 bp, Homo sapiens
tgggctctccacctcagcct

SEQ ID NO: 4225416 - DNA, 17 bp, Homo sapiens
tggggacagagcagaac

SEQ ID NO: 4225417 - DNA, 11 bp, Homo sapiens
tggggccaaga

SEQ ID NO: 4225418 - DNA, 15 bp, Homo sapiens
tggggctgctcctcc

SEQ ID NO: 4225419 - DNA, 14 bp, Homo sapiens
tgggggaagccctg

SEQ ID NO: 4225420 - DNA, 13 bp, Homo sapiens
tgggggctggacc

SEQ ID NO: 4225421 - DNA, 18 bp, Homo sapiens
tgggggctggacctgctg

SEQ ID NO: 4225422 - DNA, 15 bp, Homo sapiens
tggggtcccagggaa

SEQ ID NO: 4225423 - DNA, 21 bp, Homo sapiens
tggggtctccctctcctgcct

SEQ ID NO: 4225424 - DNA, 22 bp, Homo sapiens
tggtccagcttgctcttcagtg

SEQ ID NO: 4225425 - DNA, 17 bp, Homo sapiens
tggtggcgcaagcctgt

SEQ ID NO: 4225426 - DNA, 23 bp, Homo sapiens
tggtgtattttttaaaaaatttg

SEQ ID NO: 4225427 - DNA, 18 bp, Homo sapiens
tggtgtccacctggcccc

SEQ ID NO: 4225428 - DNA, 14 bp, Homo sapiens
tggttccaagaaag

SEQ ID NO: 4225429 - DNA, 15 bp, Homo sapiens
tggttcctctctggt

SEQ ID NO: 4225430 - DNA, 12 bp, Homo sapiens
tgtaaagaattg

SEQ ID NO: 4225431 - DNA, 19 bp, Homo sapiens
tgtaaatagttttaaatat

SEQ ID NO: 4225432 - DNA, 22 bp, Homo sapiens
tgtaaatagttttaaatatgaa

SEQ ID NO: 4225433 - DNA, 12 bp, Homo sapiens
tgtaactccacc

SEQ ID NO: 4225434 - DNA, 13 bp, Homo sapiens
tgtaactccacca

SEQ ID NO: 4225435 - DNA, 14 bp, Homo sapiens
tgtaagaaaaccaa

SEQ ID NO: 4225436 - DNA, 20 bp, Homo sapiens
tgtaatgtcaccaccttccc

SEQ ID NO: 4225437 - DNA, 14 bp, Homo sapiens
tgtaattaatattc

SEQ ID NO: 4225438 - DNA, 16 bp, Homo sapiens
tgtacagtggagaaat

SEQ ID NO: 4225439 - DNA, 19 bp, Homo sapiens
tgtataaattaatacagag

SEQ ID NO: 4225440 - DNA, 13 bp, Homo sapiens
tgtatctcctcct

SEQ ID NO: 4225441 - DNA, 14 bp, Homo sapiens
tgtatgctaaatga

SEQ ID NO: 4225442 - DNA, 15 bp, Homo sapiens
tgtattagtcacaga

SEQ ID NO: 4225443 - DNA, 19 bp, Homo sapiens
tgtcaccaccttcccagct

SEQ ID NO: 4225444 - DNA, 23 bp, Homo sapiens
tgtcaccaccttcccagctctcc

SEQ ID NO: 4225445 - DNA, 13 bp, Homo sapiens
tgtcacctggcct

SEQ ID NO: 4225446 - DNA, 14 bp, Homo sapiens
tgtcacctggcctg

SEQ ID NO: 4225447 - DNA, 11 bp, Homo sapiens
tgtcagagcta

SEQ ID NO: 4225448 - DNA, 16 bp, Homo sapiens
tgtcagagttctgctc

SEQ ID NO: 4225449 - DNA, 16 bp, Homo sapiens
tgtcagtctggtttat

SEQ ID NO: 4225450 - DNA, 13 bp, Homo sapiens
tgtcatctcagct

SEQ ID NO: 4225451 - DNA, 13 bp, Homo sapiens
tgtccacctggcc

SEQ ID NO: 4225452 - DNA, 14 bp, Homo sapiens
tgtccagcgcctag

SEQ ID NO: 4225453 - DNA, 19 bp, Homo sapiens
tgtccattgtaaatctgaa

SEQ ID NO: 4225454 - DNA, 13 bp, Homo sapiens
tgtccctgtcacc

SEQ ID NO: 4225455 - DNA, 16 bp, Homo sapiens
tgtcctaggctctggg

SEQ ID NO: 4225456 - DNA, 11 bp, Homo sapiens
tgtcctcctcg

SEQ ID NO: 4225457 - DNA, 13 bp, Homo sapiens
tgtctctcagaat

SEQ ID NO: 4225458 - DNA, 20 bp, Homo sapiens
tgtctcttcctctgttctat

SEQ ID NO: 4225459 - DNA, 11 bp, Homo sapiens
tgtgaaaaaaa

SEQ ID NO: 4225460 - DNA, 17 bp, Homo sapiens
tgtgaaaaaaatgaaat

SEQ ID NO: 4225461 - DNA, 21 bp, Homo sapiens
tgtgaaaaaaatgaaataaag

SEQ ID NO: 4225462 - DNA, 14 bp, Homo sapiens
tgtgaatcagaccc

SEQ ID NO: 4225463 - DNA, 18 bp, Homo sapiens
tgtgaatttgcaacagta

SEQ ID NO: 4225464 - DNA, 13 bp, Homo sapiens
tgtgaggcagggg

SEQ ID NO: 4225465 - DNA, 12 bp, Homo sapiens
tgtgcagactga

SEQ ID NO: 4225466 - DNA, 18 bp, Homo sapiens
tgtgcggctccagcccag

SEQ ID NO: 4225467 - DNA, 17 bp, Homo sapiens
tgtggccctggcctgct

SEQ ID NO: 4225468 - DNA, 20 bp, Homo sapiens
tgtggccctggcctgctggg

SEQ ID NO: 4225469 - DNA, 15 bp, Homo sapiens
tgtgggaagggagag

SEQ ID NO: 4225470 - DNA, 21 bp, Homo sapiens
tgtggtgtattttttaaaaaa

SEQ ID NO: 4225471 - DNA, 22 bp, Homo sapiens
tgtggtttggttcctctctggt

SEQ ID NO: 4225472 - DNA, 19 bp, Homo sapiens
tgttatggaaaatgtcaac

SEQ ID NO: 4225473 - DNA, 22 bp, Homo sapiens
tgttctttgccagtctcatttt

SEQ ID NO: 4225474 - DNA, 19 bp, Homo sapiens
tgttgcaagtactgctgta

SEQ ID NO: 4225475 - DNA, 15 bp, Homo sapiens
tgttgtaatagtcca

SEQ ID NO: 4225476 - DNA, 17 bp, Homo sapiens
tgtttagattccaggat

SEQ ID NO: 4225477 - DNA, 12 bp, Homo sapiens
tgtttgccttgg

SEQ ID NO: 4225478 - DNA, 17 bp, Homo sapiens
ttaaaaaataaatataa

SEQ ID NO: 4225479 - DNA, 18 bp, Homo sapiens
ttaaaaaataaatataat

SEQ ID NO: 4225480 - DNA, 21 bp, Homo sapiens
ttaaaaacatgagaaatgtga

SEQ ID NO: 4225481 - DNA, 14 bp, Homo sapiens
ttaaatatgaacaa

SEQ ID NO: 4225482 - DNA, 14 bp, Homo sapiens
ttaaatgacagtga

SEQ ID NO: 4225483 - DNA, 19 bp, Homo sapiens
ttaacctctctaagccaca

SEQ ID NO: 4225484 - DNA, 13 bp, Homo sapiens
ttaatgttgaatg

SEQ ID NO: 4225485 - DNA, 15 bp, Homo sapiens
ttaattatcttttct

SEQ ID NO: 4225486 - DNA, 16 bp, Homo sapiens
ttaatttgtgaatttg

SEQ ID NO: 4225487 - DNA, 20 bp, Homo sapiens
ttaatttttttaaatttcag

SEQ ID NO: 4225488 - DNA, 13 bp, Homo sapiens
ttacaaaactgcc

SEQ ID NO: 4225489 - DNA, 19 bp, Homo sapiens
ttactatcatgtcaaacgt

SEQ ID NO: 4225490 - DNA, 13 bp, Homo sapiens
ttactcagccctg

SEQ ID NO: 4225491 - DNA, 14 bp, Homo sapiens
ttactcagccctgg

SEQ ID NO: 4225492 - DNA, 18 bp, Homo sapiens
ttactccaaggtttataa

SEQ ID NO: 4225493 - DNA, 21 bp, Homo sapiens
ttactccaaggtttataaagc

SEQ ID NO: 4225494 - DNA, 24 bp, Homo sapiens
ttactccaaggtttataaagcaga

SEQ ID NO: 4225495 - DNA, 16 bp, Homo sapiens
ttactctccaacctgg

SEQ ID NO: 4225496 - DNA, 19 bp, Homo sapiens
ttactctccaacctggaca

SEQ ID NO: 4225497 - DNA, 13 bp, Homo sapiens
ttactgagatgtt

SEQ ID NO: 4225498 - DNA, 13 bp, Homo sapiens
ttagattccagga

SEQ ID NO: 4225499 - DNA, 15 bp, Homo sapiens
ttagattccaggatc

SEQ ID NO: 4225500 - DNA, 14 bp, Homo sapiens
ttatacctttgaaa

SEQ ID NO: 4225501 - DNA, 20 bp, Homo sapiens
ttatccttaggaaaatgctt

SEQ ID NO: 4225502 - DNA, 22 bp, Homo sapiens
ttatccttaggaaaatgcttct

SEQ ID NO: 4225503 - DNA, 20 bp, Homo sapiens
ttatgatttaaaaaataaat

SEQ ID NO: 4225504 - DNA, 17 bp, Homo sapiens
ttatgtaacatccagaa

SEQ ID NO: 4225505 - DNA, 14 bp, Homo sapiens
ttatttaatttgta

SEQ ID NO: 4225506 - DNA, 15 bp, Homo sapiens
ttcaaccttaccaaa

SEQ ID NO: 4225507 - DNA, 16 bp, Homo sapiens
ttcaaccttaccaaaa

SEQ ID NO: 4225508 - DNA, 18 bp, Homo sapiens
ttcaaccttaccaaaaaa

SEQ ID NO: 4225509 - DNA, 13 bp, Homo sapiens
ttcagactcagac

SEQ ID NO: 4225510 - DNA, 19 bp, Homo sapiens
ttcagagacaacttcccaa

SEQ ID NO: 4225511 - DNA, 18 bp, Homo sapiens
ttcagatacagggtgctc

SEQ ID NO: 4225512 - DNA, 21 bp, Homo sapiens
ttcagatacagggtgctcctt

SEQ ID NO: 4225513 - DNA, 20 bp, Homo sapiens
ttcagcatttgttctttgcc

SEQ ID NO: 4225514 - DNA, 21 bp, Homo sapiens
ttcagcatttgttctttgcca

SEQ ID NO: 4225515 - DNA, 14 bp, Homo sapiens
ttcagcccctcctc

SEQ ID NO: 4225516 - DNA, 16 bp, Homo sapiens
ttcagcccctcctctg

SEQ ID NO: 4225517 - DNA, 17 bp, Homo sapiens
ttcagcccctcctctgc

SEQ ID NO: 4225518 - DNA, 20 bp, Homo sapiens
ttcagcccctcctctgccac

SEQ ID NO: 4225519 - DNA, 13 bp, Homo sapiens
ttcatcttttcat

SEQ ID NO: 4225520 - DNA, 16 bp, Homo sapiens
ttccaatcacagtgtt

SEQ ID NO: 4225521 - DNA, 20 bp, Homo sapiens
ttccacaagattcccagaga

SEQ ID NO: 4225522 - DNA, 21 bp, Homo sapiens
ttccacaagattcccagagac

SEQ ID NO: 4225523 - DNA, 22 bp, Homo sapiens
ttccacagagggaagtttaaaa

SEQ ID NO: 4225524 - DNA, 13 bp, Homo sapiens
ttccacccctcct

SEQ ID NO: 4225525 - DNA, 16 bp, Homo sapiens
ttccacccctcctcga

SEQ ID NO: 4225526 - DNA, 13 bp, Homo sapiens
ttccatttcttct

SEQ ID NO: 4225527 - DNA, 15 bp, Homo sapiens
ttcccagagacagga

SEQ ID NO: 4225528 - DNA, 22 bp, Homo sapiens
ttcccagagacaggaaaatcct

SEQ ID NO: 4225529 - DNA, 16 bp, Homo sapiens
ttcccagctctccctc

SEQ ID NO: 4225530 - DNA, 18 bp, Homo sapiens
ttcccagctctccctctg

SEQ ID NO: 4225531 - DNA, 23 bp, Homo sapiens
ttcccagctctccctctggccct

SEQ ID NO: 4225532 - DNA, 23 bp, Homo sapiens
ttcccatcactggagcaccaggc

SEQ ID NO: 4225533 - DNA, 14 bp, Homo sapiens
ttccccttgccctt

SEQ ID NO: 4225534 - DNA, 17 bp, Homo sapiens
ttcctataacttgatgc

SEQ ID NO: 4225535 - DNA, 19 bp, Homo sapiens
ttcctataacttgatgcat

SEQ ID NO: 4225536 - DNA, 21 bp, Homo sapiens
ttcctataacttgatgcatgt

SEQ ID NO: 4225537 - DNA, 11 bp, Homo sapiens
ttcctctctgg

SEQ ID NO: 4225538 - DNA, 18 bp, Homo sapiens
ttcctctgaggaagaagg

SEQ ID NO: 4225539 - DNA, 13 bp, Homo sapiens
ttcctgaagccag

SEQ ID NO: 4225540 - DNA, 21 bp, Homo sapiens
ttcctgcgggcttttccccgg

SEQ ID NO: 4225541 - DNA, 13 bp, Homo sapiens
ttccttccctggc

SEQ ID NO: 4225542 - DNA, 14 bp, Homo sapiens
ttccttccctggct

SEQ ID NO: 4225543 - DNA, 12 bp, Homo sapiens
ttccttgtgctc

SEQ ID NO: 4225544 - DNA, 13 bp, Homo sapiens
ttcctttgcattc

SEQ ID NO: 4225545 - DNA, 19 bp, Homo sapiens
ttctacagagaaaatgaat

SEQ ID NO: 4225546 - DNA, 17 bp, Homo sapiens
ttctattgtttattctt

SEQ ID NO: 4225547 - DNA, 23 bp, Homo sapiens
ttctcaattattggcctgctaat

SEQ ID NO: 4225548 - DNA, 16 bp, Homo sapiens
ttctcagactgccaaa

SEQ ID NO: 4225549 - DNA, 22 bp, Homo sapiens
ttctcattaaaatccagtatta

SEQ ID NO: 4225550 - DNA, 20 bp, Homo sapiens
ttctctgtgcccctgtaaat

SEQ ID NO: 4225551 - DNA, 12 bp, Homo sapiens
ttctctttgcca

SEQ ID NO: 4225552 - DNA, 12 bp, Homo sapiens
ttctgattccac

SEQ ID NO: 4225553 - DNA, 17 bp, Homo sapiens
ttctgctcctctccagg

SEQ ID NO: 4225554 - DNA, 18 bp, Homo sapiens
ttctgctcctctccaggc

SEQ ID NO: 4225555 - DNA, 17 bp, Homo sapiens
ttctggcattttctgtt

SEQ ID NO: 4225556 - DNA, 16 bp, Homo sapiens
ttcttaaggtccctgc

SEQ ID NO: 4225557 - DNA, 17 bp, Homo sapiens
ttcttatgttgcccagt

SEQ ID NO: 4225558 - DNA, 17 bp, Homo sapiens
ttcttggggtcccaggg

SEQ ID NO: 4225559 - DNA, 20 bp, Homo sapiens
ttgaaaaaactttctctttg

SEQ ID NO: 4225560 - DNA, 12 bp, Homo sapiens
ttgaacccagga

SEQ ID NO: 4225561 - DNA, 19 bp, Homo sapiens
ttgaacctgtcacctggcc

SEQ ID NO: 4225562 - DNA, 14 bp, Homo sapiens
ttgaatgtattttg

SEQ ID NO: 4225563 - DNA, 23 bp, Homo sapiens
ttgaattagattatttctgtatt

SEQ ID NO: 4225564 - DNA, 11 bp, Homo sapiens
ttgatgcatgt

SEQ ID NO: 4225565 - DNA, 17 bp, Homo sapiens
ttgcaaggccgctgttc

SEQ ID NO: 4225566 - DNA, 19 bp, Homo sapiens
ttgcagaaaagcacctgcc

SEQ ID NO: 4225567 - DNA, 18 bp, Homo sapiens
ttgcatccttcctataac

SEQ ID NO: 4225568 - DNA, 21 bp, Homo sapiens
ttgccaccactagagctgaga

SEQ ID NO: 4225569 - DNA, 16 bp, Homo sapiens
ttgcccagagatgcct

SEQ ID NO: 4225570 - DNA, 17 bp, Homo sapiens
ttgcccagagatgcctc

SEQ ID NO: 4225571 - DNA, 22 bp, Homo sapiens
ttgcccagagatgcctccaccg

SEQ ID NO: 4225572 - DNA, 21 bp, Homo sapiens
ttgccctgacctcccagccct

SEQ ID NO: 4225573 - DNA, 14 bp, Homo sapiens
ttgcccttgccctg

SEQ ID NO: 4225574 - DNA, 15 bp, Homo sapiens
ttgcccttgccctga

SEQ ID NO: 4225575 - DNA, 18 bp, Homo sapiens
ttgctaaaatattttaga

SEQ ID NO: 4225576 - DNA, 16 bp, Homo sapiens
ttgctgatgtttataa

SEQ ID NO: 4225577 - DNA, 12 bp, Homo sapiens
ttggaaaataaa

SEQ ID NO: 4225578 - DNA, 23 bp, Homo sapiens
ttgggcaagcagaaaaattaaat

SEQ ID NO: 4225579 - DNA, 14 bp, Homo sapiens
ttggtaattaaaag

SEQ ID NO: 4225580 - DNA, 16 bp, Homo sapiens
ttggtaattaaaagac

SEQ ID NO: 4225581 - DNA, 15 bp, Homo sapiens
ttggttcctctctgg

SEQ ID NO: 4225582 - DNA, 21 bp, Homo sapiens
ttgtaaatgtggtaaagagtt

SEQ ID NO: 4225583 - DNA, 14 bp, Homo sapiens
ttgtaagaaaacca

SEQ ID NO: 4225584 - DNA, 15 bp, Homo sapiens
ttgtaagaaaaccaa

SEQ ID NO: 4225585 - DNA, 17 bp, Homo sapiens
ttgtacagtggagaaat

SEQ ID NO: 4225586 - DNA, 20 bp, Homo sapiens
ttgtatgatcctaatgaatg

SEQ ID NO: 4225587 - DNA, 18 bp, Homo sapiens
ttgtatgctaaatgagga

SEQ ID NO: 4225588 - DNA, 11 bp, Homo sapiens
ttgtcaatact

SEQ ID NO: 4225589 - DNA, 16 bp, Homo sapiens
ttgtcaatactgagcc

SEQ ID NO: 4225590 - DNA, 13 bp, Homo sapiens
ttgtccagcgcct

SEQ ID NO: 4225591 - DNA, 19 bp, Homo sapiens
ttgtccattgtaaatctga

SEQ ID NO: 4225592 - DNA, 19 bp, Homo sapiens
ttgtctcctacctgctgct

SEQ ID NO: 4225593 - DNA, 22 bp, Homo sapiens
ttgtgaaaaaaatgaaataaag

SEQ ID NO: 4225594 - DNA, 23 bp, Homo sapiens
ttgtgggcaaaagagaaaaagaa

SEQ ID NO: 4225595 - DNA, 18 bp, Homo sapiens
tttaaaaaataaatataa

SEQ ID NO: 4225596 - DNA, 19 bp, Homo sapiens
tttaaaaaataaatataat

SEQ ID NO: 4225597 - DNA, 20 bp, Homo sapiens
tttaaaaaataaatataatt

SEQ ID NO: 4225598 - DNA, 13 bp, Homo sapiens
tttaaaacccaaa

SEQ ID NO: 4225599 - DNA, 14 bp, Homo sapiens
tttaaaacccaaac

SEQ ID NO: 4225600 - DNA, 21 bp, Homo sapiens
tttaaactaccctccagagtg

SEQ ID NO: 4225601 - DNA, 17 bp, Homo sapiens
tttaaagtattctccat

SEQ ID NO: 4225602 - DNA, 14 bp, Homo sapiens
tttaaatatgaaca

SEQ ID NO: 4225603 - DNA, 16 bp, Homo sapiens
tttaaatatgaacaaa

SEQ ID NO: 4225604 - DNA, 21 bp, Homo sapiens
tttaagtctcctttactgaat

SEQ ID NO: 4225605 - DNA, 14 bp, Homo sapiens
tttaattgattatt

SEQ ID NO: 4225606 - DNA, 19 bp, Homo sapiens
tttagagtcaatttgctga

SEQ ID NO: 4225607 - DNA, 23 bp, Homo sapiens
tttataaaagaataaaattgcac

SEQ ID NO: 4225608 - DNA, 12 bp, Homo sapiens
tttataaagcag

SEQ ID NO: 4225609 - DNA, 19 bp, Homo sapiens
tttataaagcagattacct

SEQ ID NO: 4225610 - DNA, 14 bp, Homo sapiens
tttatccttaggaa

SEQ ID NO: 4225611 - DNA, 13 bp, Homo sapiens
tttatctttgacc

SEQ ID NO: 4225612 - DNA, 16 bp, Homo sapiens
tttattctttttaaag

SEQ ID NO: 4225613 - DNA, 19 bp, Homo sapiens
tttcacatggactttggaa

SEQ ID NO: 4225614 - DNA, 10 bp, Homo sapiens
tttcagaccc

SEQ ID NO: 4225615 - DNA, 19 bp, Homo sapiens
tttcagagacaacttccca

SEQ ID NO: 4225616 - DNA, 14 bp, Homo sapiens
tttcatttttgcca

SEQ ID NO: 4225617 - DNA, 12 bp, Homo sapiens
tttccttcctaa

SEQ ID NO: 4225618 - DNA, 16 bp, Homo sapiens
tttccttgtgctcctg

SEQ ID NO: 4225619 - DNA, 21 bp, Homo sapiens
tttccttgtggcagaggatgt

SEQ ID NO: 4225620 - DNA, 18 bp, Homo sapiens
tttctaatagagagatta

SEQ ID NO: 4225621 - DNA, 23 bp, Homo sapiens
tttctgatctgatgcaagcaaga

SEQ ID NO: 4225622 - DNA, 17 bp, Homo sapiens
tttcttgttattaccaa

SEQ ID NO: 4225623 - DNA, 17 bp, Homo sapiens
tttgagatgtttttaat

SEQ ID NO: 4225624 - DNA, 22 bp, Homo sapiens
tttgcagaaaagcacctgccga

SEQ ID NO: 4225625 - DNA, 17 bp, Homo sapiens
tttggttcctctctggt

SEQ ID NO: 4225626 - DNA, 16 bp, Homo sapiens
tttgtaagaaaaccaa

SEQ ID NO: 4225627 - DNA, 20 bp, Homo sapiens
tttgtccattgtaaatctga

SEQ ID NO: 4225628 - DNA, 15 bp, Homo sapiens
tttgtgaatttgcaa

SEQ ID NO: 4225629 - DNA, 22 bp, Homo sapiens
tttgttcaaagtctatttttat

SEQ ID NO: 4225630 - DNA, 17 bp, Homo sapiens
ttttaaatatgaacaaa

SEQ ID NO: 4225631 - DNA, 19 bp, Homo sapiens
ttttaaatatgaacaaaga

SEQ ID NO: 4225632 - DNA, 13 bp, Homo sapiens
ttttaaatgttca

SEQ ID NO: 4225633 - DNA, 13 bp, Homo sapiens
ttttaaatttcag

SEQ ID NO: 4225634 - DNA, 19 bp, Homo sapiens
ttttaactctggattttga

SEQ ID NO: 4225635 - DNA, 19 bp, Homo sapiens
ttttatgatttaaaaaata

SEQ ID NO: 4225636 - DNA, 11 bp, Homo sapiens
ttttcagaccc

SEQ ID NO: 4225637 - DNA, 19 bp, Homo sapiens
ttttccaatcacagtgtta

SEQ ID NO: 4225638 - DNA, 22 bp, Homo sapiens
ttttccacaagattcccagaga

SEQ ID NO: 4225639 - DNA, 19 bp, Homo sapiens
ttttccccggtcccttgag

SEQ ID NO: 4225640 - DNA, 14 bp, Homo sapiens
ttttctaaagaaat

SEQ ID NO: 4225641 - DNA, 20 bp, Homo sapiens
ttttgccactgcctttcaga

SEQ ID NO: 4225642 - DNA, 20 bp, Homo sapiens
tttttccaatcacagtgtta

SEQ ID NO: 4225643 - DNA, 11 bp, Homo sapiens
tttttccccct

SEQ ID NO: 4225644 - DNA, 23 bp, Homo sapiens
tttttgctgctacttctgtggaa

SEQ ID NO: 4225645 - DNA, 14 bp, Homo sapiens
ttttttcaacactc

SEQ ID NO: 4225646 - DNA, 13 bp, Homo sapiens
aaaaaataaatat

SEQ ID NO: 4225647 - DNA, 20 bp, Homo sapiens
aaaaaccataaacatttgca

SEQ ID NO: 4225648 - DNA, 17 bp, Homo sapiens
aaaaagtttgccagaag

SEQ ID NO: 4225649 - DNA, 11 bp, Homo sapiens
aaaaattaaat

SEQ ID NO: 4225650 - DNA, 15 bp, Homo sapiens
aaaaattaaattgta

SEQ ID NO: 4225651 - DNA, 12 bp, Homo sapiens
aaaaattaactg

SEQ ID NO: 4225652 - DNA, 13 bp, Homo sapiens
aaaacatgagaaa

SEQ ID NO: 4225653 - DNA, 12 bp, Homo sapiens
aaaacccagaga

SEQ ID NO: 4225654 - DNA, 15 bp, Homo sapiens
aaaactgacagagga

SEQ ID NO: 4225655 - DNA, 16 bp, Homo sapiens
aaaagaaaaaggaaaa

SEQ ID NO: 4225656 - DNA, 22 bp, Homo sapiens
aaaagaaatttagagtcaattt

SEQ ID NO: 4225657 - DNA, 15 bp, Homo sapiens
aaaagacctgcattt

SEQ ID NO: 4225658 - DNA, 14 bp, Homo sapiens
aaaagatgtatatt

SEQ ID NO: 4225659 - DNA, 13 bp, Homo sapiens
aaaatataattct

SEQ ID NO: 4225660 - DNA, 19 bp, Homo sapiens
aaaatatttttttcctttg

SEQ ID NO: 4225661 - DNA, 21 bp, Homo sapiens
aaaatgctgtattagtcacag

SEQ ID NO: 4225662 - DNA, 16 bp, Homo sapiens
aaaatgcttctgttgt

SEQ ID NO: 4225663 - DNA, 19 bp, Homo sapiens
aaaatgcttctgttgtaat

SEQ ID NO: 4225664 - DNA, 15 bp, Homo sapiens
aaaattaactgctcc

SEQ ID NO: 4225665 - DNA, 20 bp, Homo sapiens
aaaattgaaaaataaaaacc

SEQ ID NO: 4225666 - DNA, 21 bp, Homo sapiens
aaacacagcatcgtgatcact

SEQ ID NO: 4225667 - DNA, 22 bp, Homo sapiens
aaacagacaaaaacagcctcac

SEQ ID NO: 4225668 - DNA, 20 bp, Homo sapiens
aaacagacaagcaacccaaa

SEQ ID NO: 4225669 - DNA, 15 bp, Homo sapiens
aaacagcctcacaga

SEQ ID NO: 4225670 - DNA, 12 bp, Homo sapiens
aaacagtgcctg

SEQ ID NO: 4225671 - DNA, 14 bp, Homo sapiens
aaacatgagaaatg

SEQ ID NO: 4225672 - DNA, 15 bp, Homo sapiens
aaacatgagaaatgt

SEQ ID NO: 4225673 - DNA, 17 bp, Homo sapiens
aaacatgagaaatgtga

SEQ ID NO: 4225674 - DNA, 20 bp, Homo sapiens
aaacatggaaaacagagtat

SEQ ID NO: 4225675 - DNA, 15 bp, Homo sapiens
aaaccataaacattt

SEQ ID NO: 4225676 - DNA, 18 bp, Homo sapiens
aaaccataaacatttgca

SEQ ID NO: 4225677 - DNA, 22 bp, Homo sapiens
acctgaaattaatttgtgaatt

SEQ ID NO: 4225678 - DNA, 16 bp, Homo sapiens
acctgcacctcccccc

SEQ ID NO: 4225679 - DNA, 21 bp, Homo sapiens
acctgcatccgtagttccctg

SEQ ID NO: 4225680 - DNA, 15 bp, Homo sapiens
acctgctgctgctat

SEQ ID NO: 4225681 - DNA, 20 bp, Homo sapiens
acctggctccctcccaccca

SEQ ID NO: 4225682 - DNA, 14 bp, Homo sapiens
accttaccaaaaaa

SEQ ID NO: 4225683 - DNA, 19 bp, Homo sapiens
acctttgtaagaaaaccaa

SEQ ID NO: 4225684 - DNA, 14 bp, Homo sapiens
acgaacccacctgc

SEQ ID NO: 4225685 - DNA, 15 bp, Homo sapiens
acgaacccacctgct

SEQ ID NO: 4225686 - DNA, 23 bp, Homo sapiens
acgagacccatttccttgtgctc

SEQ ID NO: 4225687 - DNA, 16 bp, Homo sapiens
acgatgtggccctggc

SEQ ID NO: 4225688 - DNA, 12 bp, Homo sapiens
acgcctgcttct

SEQ ID NO: 4225689 - DNA, 17 bp, Homo sapiens
acgcctgtaatcccagc

SEQ ID NO: 4225690 - DNA, 18 bp, Homo sapiens
acgcctgtaatcccagca

SEQ ID NO: 4225691 - DNA, 19 bp, Homo sapiens
acgcctgtaatcccagcag

SEQ ID NO: 4225692 - DNA, 14 bp, Homo sapiens
acgtgactgcccca

SEQ ID NO: 4225693 - DNA, 13 bp, Homo sapiens
acgtgccaggccc

SEQ ID NO: 4225694 - DNA, 18 bp, Homo sapiens
acgttccttactgcagaa

SEQ ID NO: 4225695 - DNA, 19 bp, Homo sapiens
acgttccttactgcagaat

SEQ ID NO: 4225696 - DNA, 16 bp, Homo sapiens
actaaaaatttttaca

SEQ ID NO: 4225697 - DNA, 14 bp, Homo sapiens
actaccctccagag

SEQ ID NO: 4225698 - DNA, 19 bp, Homo sapiens
actcaatctaaattaaaaa

SEQ ID NO: 4225699 - DNA, 23 bp, Homo sapiens
actcacaggttggaagagaatca

SEQ ID NO: 4225700 - DNA, 16 bp, Homo sapiens
actcacctctgcctca

SEQ ID NO: 4225701 - DNA, 20 bp, Homo sapiens
actcagcagccctcctcacc

SEQ ID NO: 4225702 - DNA, 21 bp, Homo sapiens
actcagcagccctcctcaccc

SEQ ID NO: 4225703 - DNA, 11 bp, Homo sapiens
actcagccctg

SEQ ID NO: 4225704 - DNA, 14 bp, Homo sapiens
actcagccctgggc

SEQ ID NO: 4225705 - DNA, 21 bp, Homo sapiens
actcagccctgggccccacca

SEQ ID NO: 4225706 - DNA, 22 bp, Homo sapiens
actcagccctgggccccaccac

SEQ ID NO: 4225707 - DNA, 13 bp, Homo sapiens
actcaggaggctg

SEQ ID NO: 4225708 - DNA, 23 bp, Homo sapiens
actcagggctggggccaagagga

SEQ ID NO: 4225709 - DNA, 20 bp, Homo sapiens
actccaaggtttataaagca

SEQ ID NO: 4225710 - DNA, 21 bp, Homo sapiens
actccaaggtttataaagcag

SEQ ID NO: 4225711 - DNA, 13 bp, Homo sapiens
actccaccaccca

SEQ ID NO: 4225712 - DNA, 20 bp, Homo sapiens
actccagctgggttggaaaa

SEQ ID NO: 4225713 - DNA, 16 bp, Homo sapiens
actccaggatttataa

SEQ ID NO: 4225714 - DNA, 21 bp, Homo sapiens
actcctccctttccttcctaa

SEQ ID NO: 4225715 - DNA, 17 bp, Homo sapiens
actctcattccccaggt

SEQ ID NO: 4225716 - DNA, 14 bp, Homo sapiens
actctccaacctgg

SEQ ID NO: 4225717 - DNA, 14 bp, Homo sapiens
actctggattttga

SEQ ID NO: 4225718 - DNA, 16 bp, Homo sapiens
actctggattttgaat

SEQ ID NO: 4225719 - DNA, 18 bp, Homo sapiens
actctggattttgaatta

SEQ ID NO: 4225720 - DNA, 12 bp, Homo sapiens
actgaatgtaag

SEQ ID NO: 4225721 - DNA, 12 bp, Homo sapiens
actgagatgttt

SEQ ID NO: 4225722 - DNA, 15 bp, Homo sapiens
actgagccatcattt

SEQ ID NO: 4225723 - DNA, 14 bp, Homo sapiens
actgcaacttgtga

SEQ ID NO: 4225724 - DNA, 15 bp, Homo sapiens
actgcaagagccttg

SEQ ID NO: 4225725 - DNA, 21 bp, Homo sapiens
actgccaaagaagccttgcca

SEQ ID NO: 4225726 - DNA, 17 bp, Homo sapiens
actgccccaactcctgg

SEQ ID NO: 4225727 - DNA, 21 bp, Homo sapiens
actggaagcatgtaggagaat

SEQ ID NO: 4225728 - DNA, 17 bp, Homo sapiens
actgtaatttctttgag

SEQ ID NO: 4225729 - DNA, 18 bp, Homo sapiens
actgtgatggggtgggca

SEQ ID NO: 4225730 - DNA, 21 bp, Homo sapiens
acttagtttttatctttgacc

SEQ ID NO: 4225731 - DNA, 18 bp, Homo sapiens
acttgtaaatgtggtaaa

SEQ ID NO: 4225732 - DNA, 18 bp, Homo sapiens
acttgtgaactccatcat

SEQ ID NO: 4225733 - DNA, 22 bp, Homo sapiens
actttcaggccacatggctaaa

SEQ ID NO: 4225734 - DNA, 21 bp, Homo sapiens
actttcctcttagtcgagcca

SEQ ID NO: 4225735 - DNA, 11 bp, Homo sapiens
actttctcttt

SEQ ID NO: 4225736 - DNA, 22 bp, Homo sapiens
actttgtacagtggagaaatat

SEQ ID NO: 4225737 - DNA, 12 bp, Homo sapiens
agaaaaaaatat

SEQ ID NO: 4225738 - DNA, 18 bp, Homo sapiens
agaaaagcacctgccgac

SEQ ID NO: 4225739 - DNA, 13 bp, Homo sapiens
agaaaatgaattt

SEQ ID NO: 4225740 - DNA, 17 bp, Homo sapiens
agaaaattaattatatt

SEQ ID NO: 4225741 - DNA, 14 bp, Homo sapiens
agaaaccctgtctc

SEQ ID NO: 4225742 - DNA, 14 bp, Homo sapiens
agaaaggcctctgt

SEQ ID NO: 4225743 - DNA, 20 bp, Homo sapiens
agaaagttattcttggtact

SEQ ID NO: 4225744 - DNA, 17 bp, Homo sapiens
agaaatatttataaact

SEQ ID NO: 4225745 - DNA, 15 bp, Homo sapiens
agaaatcaacttgtg

SEQ ID NO: 4225746 - DNA, 23 bp, Homo sapiens
agaaatttgaaaaaactttctct

SEQ ID NO: 4225747 - DNA, 20 bp, Homo sapiens
agaaccaggcaacttgggaa

SEQ ID NO: 4225748 - DNA, 19 bp, Homo sapiens
agaagaattgaacccagga

SEQ ID NO: 4225749 - DNA, 22 bp, Homo sapiens
agaagaattttcagaccccagc

SEQ ID NO: 4225750 - DNA, 19 bp, Homo sapiens
agaagactgggctagggag

SEQ ID NO: 4225751 - DNA, 23 bp, Homo sapiens
agaagctccctgaagtaagcaaa

SEQ ID NO: 4225752 - DNA, 14 bp, Homo sapiens
agaaggtatttttc

SEQ ID NO: 4225753 - DNA, 17 bp, Homo sapiens
agaagtggaccaggaca

SEQ ID NO: 4225754 - DNA, 19 bp, Homo sapiens
agaagtgggccaggacagg

SEQ ID NO: 4225755 - DNA, 14 bp, Homo sapiens
agaatgagagtgtg

SEQ ID NO: 4225756 - DNA, 15 bp, Homo sapiens
agaattattcagtga

SEQ ID NO: 4225757 - DNA, 21 bp, Homo sapiens
agaattattcagtgaatttgt

SEQ ID NO: 4225758 - DNA, 23 bp, Homo sapiens
agaattattcagtgaatttgtcc

SEQ ID NO: 4225759 - DNA, 19 bp, Homo sapiens
agaattcctgaagccagat

SEQ ID NO: 4225760 - DNA, 17 bp, Homo sapiens
agaattcttcaggtgga

SEQ ID NO: 4225761 - DNA, 16 bp, Homo sapiens
agaattgaacccagga

SEQ ID NO: 4225762 - DNA, 17 bp, Homo sapiens
agaattgaacccaggag

SEQ ID NO: 4225763 - DNA, 16 bp, Homo sapiens
agacaaaaacagcctc

SEQ ID NO: 4225764 - DNA, 17 bp, Homo sapiens
agacaaaaacagcctca

SEQ ID NO: 4225765 - DNA, 15 bp, Homo sapiens
agacaagcaacccaa

SEQ ID NO: 4225766 - DNA, 17 bp, Homo sapiens
agacacatcaaatgccc

SEQ ID NO: 4225767 - DNA, 20 bp, Homo sapiens
agacaggaaaatcctctggc

SEQ ID NO: 4225768 - DNA, 21 bp, Homo sapiens
agacaggaaaatcctctggct

SEQ ID NO: 4225769 - DNA, 12 bp, Homo sapiens
agacctcagcca

SEQ ID NO: 4225770 - DNA, 18 bp, Homo sapiens
agacctcagccatgagga

SEQ ID NO: 4225771 - DNA, 15 bp, Homo sapiens
agactcacctctgcc

SEQ ID NO: 4225772 - DNA, 15 bp, Homo sapiens
agactcctttcctct

SEQ ID NO: 4225773 - DNA, 15 bp, Homo sapiens
agacttcacactgca

SEQ ID NO: 4225774 - DNA, 21 bp, Homo sapiens
agagaaaaaaagtttgccaga

SEQ ID NO: 4225775 - DNA, 20 bp, Homo sapiens
agagacacctgcacctcccc

SEQ ID NO: 4225776 - DNA, 23 bp, Homo sapiens
agagacaggaaaatcctctggct

SEQ ID NO: 4225777 - DNA, 13 bp, Homo sapiens
agagacccaagga

SEQ ID NO: 4225778 - DNA, 17 bp, Homo sapiens
agagacccttgtttgat

SEQ ID NO: 4225779 - DNA, 16 bp, Homo sapiens
agagactccagctggg

SEQ ID NO: 4225780 - DNA, 15 bp, Homo sapiens
agagagtttgccact

SEQ ID NO: 4225781 - DNA, 12 bp, Homo sapiens
agagatgcctcc

SEQ ID NO: 4225782 - DNA, 12 bp, Homo sapiens
agagccagccct

SEQ ID NO: 4225783 - DNA, 14 bp, Homo sapiens
agagccagccctcc

SEQ ID NO: 4225784 - DNA, 21 bp, Homo sapiens
agagccagccctccctgtcct

SEQ ID NO: 4225785 - DNA, 15 bp, Homo sapiens
agagcctgctccccc

SEQ ID NO: 4225786 - DNA, 18 bp, Homo sapiens
agagcctgctcccccacc

SEQ ID NO: 4225787 - DNA, 20 bp, Homo sapiens
agagcctgctcccccacccc

SEQ ID NO: 4225788 - DNA, 17 bp, Homo sapiens
agagccttggtgtccac

SEQ ID NO: 4225789 - DNA, 23 bp, Homo sapiens
agagccttggtgtccacctggcc

SEQ ID NO: 4225790 - DNA, 21 bp, Homo sapiens
agagctagcgctgccgcaccc

SEQ ID NO: 4225791 - DNA, 18 bp, Homo sapiens
agaggaaaaacagggaaa

SEQ ID NO: 4225792 - DNA, 23 bp, Homo sapiens
agaggaatcagacttcacactgc

SEQ ID NO: 4225793 - DNA, 24 bp, Homo sapiens
agaggaatcagacttcacactgca

SEQ ID NO: 4225794 - DNA, 19 bp, Homo sapiens
agaggagggcgtgactcac

SEQ ID NO: 4225795 - DNA, 21 bp, Homo sapiens
agaggagggcgtgactcaccc

SEQ ID NO: 4225796 - DNA, 19 bp, Homo sapiens
agaggatgtctcaaacttc

SEQ ID NO: 4225797 - DNA, 14 bp, Homo sapiens
agaggctccctcct

SEQ ID NO: 4225798 - DNA, 15 bp, Homo sapiens
agaggctccctcctg

SEQ ID NO: 4225799 - DNA, 19 bp, Homo sapiens
agaggctggaggcagggcc

SEQ ID NO: 4225800 - DNA, 22 bp, Homo sapiens
agaggctggaggcagggccttg

SEQ ID NO: 4225801 - DNA, 14 bp, Homo sapiens
caatctaaattaaa

SEQ ID NO: 4225802 - DNA, 18 bp, Homo sapiens
caatctaaattaaaaaag

SEQ ID NO: 4225803 - DNA, 13 bp, Homo sapiens
caatgaaattgac

SEQ ID NO: 4225804 - DNA, 16 bp, Homo sapiens
caatgagctgtatctg

SEQ ID NO: 4225805 - DNA, 14 bp, Homo sapiens
caatttcacatgga

SEQ ID NO: 4225806 - DNA, 16 bp, Homo sapiens
cacaagattcccagag

SEQ ID NO: 4225807 - DNA, 17 bp, Homo sapiens
cacaagattcccagaga

SEQ ID NO: 4225808 - DNA, 19 bp, Homo sapiens
cacactgcaagagccttgg

SEQ ID NO: 4225809 - DNA, 20 bp, Homo sapiens
cacactgcaagagccttggt

SEQ ID NO: 4225810 - DNA, 22 bp, Homo sapiens
cacagagggaagtttaaaaccc

SEQ ID NO: 4225811 - DNA, 21 bp, Homo sapiens
cacaggttggaagagaatcac

SEQ ID NO: 4225812 - DNA, 22 bp, Homo sapiens
cacagttcctcgccctgggtct

SEQ ID NO: 4225813 - DNA, 22 bp, Homo sapiens
cacatagttctgcccaaattat

SEQ ID NO: 4225814 - DNA, 23 bp, Homo sapiens
cacatggactttggaaaatattt

SEQ ID NO: 4225815 - DNA, 19 bp, Homo sapiens
caccaacccatcagaagga

SEQ ID NO: 4225816 - DNA, 15 bp, Homo sapiens
caccaagctcacagt

SEQ ID NO: 4225817 - DNA, 20 bp, Homo sapiens
caccaagctcacagttcctc

SEQ ID NO: 4225818 - DNA, 19 bp, Homo sapiens
caccaccttcccagctctc

SEQ ID NO: 4225819 - DNA, 13 bp, Homo sapiens
caccactagagct

SEQ ID NO: 4225820 - DNA, 12 bp, Homo sapiens
caccaggaatgt

SEQ ID NO: 4225821 - DNA, 19 bp, Homo sapiens
caccaggcacgaacccacc

SEQ ID NO: 4225822 - DNA, 21 bp, Homo sapiens
caccaggcacgaacccacctg

SEQ ID NO: 4225823 - DNA, 24 bp, Homo sapiens
caccaggcacgaacccacctgctg

SEQ ID NO: 4225824 - DNA, 18 bp, Homo sapiens
caccatgtttgagctcag

SEQ ID NO: 4225825 - DNA, 22 bp, Homo sapiens
caccatgtttgagctcagaccc

SEQ ID NO: 4225826 - DNA, 23 bp, Homo sapiens
caccatgtttgagctcagacccc

SEQ ID NO: 4225827 - DNA, 13 bp, Homo sapiens
caccccaccccct

SEQ ID NO: 4225828 - DNA, 16 bp, Homo sapiens
caccccctccccaggg

SEQ ID NO: 4225829 - DNA, 16 bp, Homo sapiens
cacccccttcagtgcc

SEQ ID NO: 4225830 - DNA, 20 bp, Homo sapiens
cacccccttcagtgcccacc

SEQ ID NO: 4225831 - DNA, 21 bp, Homo sapiens
cacccccttcagtgcccacca

SEQ ID NO: 4225832 - DNA, 22 bp, Homo sapiens
caccccgtctggggttcagccc

SEQ ID NO: 4225833 - DNA, 17 bp, Homo sapiens
caccctatccctgtaca

SEQ ID NO: 4225834 - DNA, 18 bp, Homo sapiens
caccctcaaatgtcagag

SEQ ID NO: 4225835 - DNA, 15 bp, Homo sapiens
cacccttctttcctc

SEQ ID NO: 4225836 - DNA, 18 bp, Homo sapiens
caccgagagtagccgaga

SEQ ID NO: 4225837 - DNA, 11 bp, Homo sapiens
cacctcagcct

SEQ ID NO: 4225838 - DNA, 13 bp, Homo sapiens
cacctcagccttg

SEQ ID NO: 4225839 - DNA, 17 bp, Homo sapiens
cacctccccccactgca

SEQ ID NO: 4225840 - DNA, 20 bp, Homo sapiens
cacctcccctatccacccag

SEQ ID NO: 4225841 - DNA, 13 bp, Homo sapiens
cacctctgcctca

SEQ ID NO: 4225842 - DNA, 19 bp, Homo sapiens
cacctgaaattaatttgtg

SEQ ID NO: 4225843 - DNA, 18 bp, Homo sapiens
cacctgctgagagaccca

SEQ ID NO: 4225844 - DNA, 15 bp, Homo sapiens
cacctggcctgccac

SEQ ID NO: 4225845 - DNA, 23 bp, Homo sapiens
cacctggcctgccaccctcctgc

SEQ ID NO: 4225846 - DNA, 12 bp, Homo sapiens
caccttcccagc

SEQ ID NO: 4225847 - DNA, 16 bp, Homo sapiens
cacgatgtggccctgg

SEQ ID NO: 4225848 - DNA, 18 bp, Homo sapiens
cacgatgtggccctggcc

SEQ ID NO: 4225849 - DNA, 21 bp, Homo sapiens
cacgcctgtaatcccagcagt

SEQ ID NO: 4225850 - DNA, 15 bp, Homo sapiens
cacgtgccaggcccg

SEQ ID NO: 4225851 - DNA, 21 bp, Homo sapiens
cactcagggctggggccaaga

SEQ ID NO: 4225852 - DNA, 10 bp, Homo sapiens
cactccacca

SEQ ID NO: 4225853 - DNA, 17 bp, Homo sapiens
cactcccctaaactcca

SEQ ID NO: 4225854 - DNA, 16 bp, Homo sapiens
cactccttcccaaatc

SEQ ID NO: 4225855 - DNA, 17 bp, Homo sapiens
cactccttcccaaatct

SEQ ID NO: 4225856 - DNA, 24 bp, Homo sapiens
cactccttcccaaatctgtctccc

SEQ ID NO: 4225857 - DNA, 11 bp, Homo sapiens
cactgagccat

SEQ ID NO: 4225858 - DNA, 15 bp, Homo sapiens
cactgcaacttgtga

SEQ ID NO: 4225859 - DNA, 15 bp, Homo sapiens
cactgcaagagcctt

SEQ ID NO: 4225860 - DNA, 17 bp, Homo sapiens
cactgcaagagccttgg

SEQ ID NO: 4225861 - DNA, 19 bp, Homo sapiens
cactgcaagagccttggtg

SEQ ID NO: 4225862 - DNA, 20 bp, Homo sapiens
cactgcaagagccttggtgt

SEQ ID NO: 4225863 - DNA, 14 bp, Homo sapiens
cagaaaagcacctg

SEQ ID NO: 4225864 - DNA, 19 bp, Homo sapiens
cagaagaattgaacccagg

SEQ ID NO: 4225865 - DNA, 20 bp, Homo sapiens
cagaaggagaaggaaggaga

SEQ ID NO: 4225866 - DNA, 21 bp, Homo sapiens
cagaagtccctcccatctcta

SEQ ID NO: 4225867 - DNA, 13 bp, Homo sapiens
cagaagtgattta

SEQ ID NO: 4225868 - DNA, 20 bp, Homo sapiens
cagacaaaaacagcctcaca

SEQ ID NO: 4225869 - DNA, 21 bp, Homo sapiens
cagacaagcaacccaaactga

SEQ ID NO: 4225870 - DNA, 15 bp, Homo sapiens
cagaccccagcggct

SEQ ID NO: 4225871 - DNA, 14 bp, Homo sapiens
cagacccccactct

SEQ ID NO: 4225872 - DNA, 17 bp, Homo sapiens
cagaccctaccccacca

SEQ ID NO: 4225873 - DNA, 23 bp, Homo sapiens
cagaccggggttcaagccatggc

SEQ ID NO: 4225874 - DNA, 15 bp, Homo sapiens
cagactgccaaagaa

SEQ ID NO: 4225875 - DNA, 15 bp, Homo sapiens
cagagaaaatgaatt

SEQ ID NO: 4225876 - DNA, 18 bp, Homo sapiens
cagagaaaatgaatttgg

SEQ ID NO: 4225877 - DNA, 14 bp, Homo sapiens
cagagaaggcagga

SEQ ID NO: 4225878 - DNA, 20 bp, Homo sapiens
cagagaaggcaggaatgtgt

SEQ ID NO: 4225879 - DNA, 13 bp, Homo sapiens
cagagacacctgc

SEQ ID NO: 4225880 - DNA, 16 bp, Homo sapiens
cagagacacctgcacc

SEQ ID NO: 4225881 - DNA, 20 bp, Homo sapiens
cagagacacctgcacctccc

SEQ ID NO: 4225882 - DNA, 14 bp, Homo sapiens
cagagagacagacc

SEQ ID NO: 4225883 - DNA, 13 bp, Homo sapiens
cagagatgcctcc

SEQ ID NO: 4225884 - DNA, 16 bp, Homo sapiens
cagagatgcctccacc

SEQ ID NO: 4225885 - DNA, 23 bp, Homo sapiens
cagagatgtcatcagagctcctc

SEQ ID NO: 4225886 - DNA, 19 bp, Homo sapiens
cagaggctggaggcagggc

SEQ ID NO: 4225887 - DNA, 16 bp, Homo sapiens
cagagggcagaggctg

SEQ ID NO: 4225888 - DNA, 19 bp, Homo sapiens
cagagtgtgcagactgatg

SEQ ID NO: 4225889 - DNA, 19 bp, Homo sapiens
cagagtgtgggaagggaga

SEQ ID NO: 4225890 - DNA, 13 bp, Homo sapiens
cagatggaccaaa

SEQ ID NO: 4225891 - DNA, 20 bp, Homo sapiens
cagatgggaggaaagagagc

SEQ ID NO: 4225892 - DNA, 22 bp, Homo sapiens
cagatgggaggaaagagagcag

SEQ ID NO: 4225893 - DNA, 23 bp, Homo sapiens
cagatgggaggaaagagagcagg

SEQ ID NO: 4225894 - DNA, 14 bp, Homo sapiens
cagcagccctcctc

SEQ ID NO: 4225895 - DNA, 19 bp, Homo sapiens
cagcagccctcctcacccc

SEQ ID NO: 4225896 - DNA, 17 bp, Homo sapiens
cagcagtttgggaggtc

SEQ ID NO: 4225897 - DNA, 16 bp, Homo sapiens
cagccagcccagccca

SEQ ID NO: 4225898 - DNA, 11 bp, Homo sapiens
cagcccagccc

SEQ ID NO: 4225899 - DNA, 20 bp, Homo sapiens
cagcccattctctctcctgt

SEQ ID NO: 4225900 - DNA, 23 bp, Homo sapiens
cagcccattctctctcctgtcca

SEQ ID NO: 4225901 - DNA, 14 bp, Homo sapiens
cagcccctcctctg

SEQ ID NO: 4225902 - DNA, 14 bp, Homo sapiens
cagccctccctgtc

SEQ ID NO: 4225903 - DNA, 16 bp, Homo sapiens
cagccctccctgtcct

SEQ ID NO: 4225904 - DNA, 20 bp, Homo sapiens
cagccctccctgtcctcctc

SEQ ID NO: 4225905 - DNA, 11 bp, Homo sapiens
cagccctgggc

SEQ ID NO: 4225906 - DNA, 12 bp, Homo sapiens
cagccctgggcc

SEQ ID NO: 4225907 - DNA, 19 bp, Homo sapiens
cagccctgggccccaccac

SEQ ID NO: 4225908 - DNA, 21 bp, Homo sapiens
cagccctgggccccaccacct

SEQ ID NO: 4225909 - DNA, 22 bp, Homo sapiens
cagccctgggccccaccaccta

SEQ ID NO: 4225910 - DNA, 12 bp, Homo sapiens
cagcctcacaga

SEQ ID NO: 4225911 - DNA, 13 bp, Homo sapiens
cagcctcacagaa

SEQ ID NO: 4225912 - DNA, 20 bp, Homo sapiens
cagcctgtggcggtgcctgg

SEQ ID NO: 4225913 - DNA, 21 bp, Homo sapiens
cagcctgtggcggtgcctggg

SEQ ID NO: 4225914 - DNA, 21 bp, Homo sapiens
cagcgaaaggatgtaaacagt

SEQ ID NO: 4225915 - DNA, 22 bp, Homo sapiens
cagcgcctagtggggtctccct

SEQ ID NO: 4225916 - DNA, 16 bp, Homo sapiens
cagctcagagatgaaa

SEQ ID NO: 4225917 - DNA, 19 bp, Homo sapiens
cagctcccaccccaccccc

SEQ ID NO: 4225918 - DNA, 20 bp, Homo sapiens
cagctcccaccccaccccct

SEQ ID NO: 4225919 - DNA, 14 bp, Homo sapiens
cagctctccctctg

SEQ ID NO: 4225920 - DNA, 18 bp, Homo sapiens
cagctctccctctggccc

SEQ ID NO: 4225921 - DNA, 19 bp, Homo sapiens
cagctctccctctggccct

SEQ ID NO: 4225922 - DNA, 14 bp, Homo sapiens
cagctgcagcccat

SEQ ID NO: 4225923 - DNA, 16 bp, Homo sapiens
cagctgggttggaaaa

SEQ ID NO: 4225924 - DNA, 22 bp, Homo sapiens
cagctggtgggaagcgtctgtc

SEQ ID NO: 4225925 - DNA, 19 bp, Homo sapiens
ctaagagctagcgctgccg

SEQ ID NO: 4225926 - DNA, 19 bp, Homo sapiens
ctaataaagctcctctgct

SEQ ID NO: 4225927 - DNA, 16 bp, Homo sapiens
ctaatcctctttttct

SEQ ID NO: 4225928 - DNA, 17 bp, Homo sapiens
ctaatgtctcttcctct

SEQ ID NO: 4225929 - DNA, 20 bp, Homo sapiens
ctaattaatagtatttcaga

SEQ ID NO: 4225930 - DNA, 16 bp, Homo sapiens
ctaattagaaatcaac

SEQ ID NO: 4225931 - DNA, 15 bp, Homo sapiens
ctaatttcccttctt

SEQ ID NO: 4225932 - DNA, 11 bp, Homo sapiens
ctacagagaaa

SEQ ID NO: 4225933 - DNA, 14 bp, Homo sapiens
ctacctcaaaacac

SEQ ID NO: 4225934 - DNA, 16 bp, Homo sapiens
ctacctgctgctgcta

SEQ ID NO: 4225935 - DNA, 17 bp, Homo sapiens
ctactcagcagccctcc

SEQ ID NO: 4225936 - DNA, 22 bp, Homo sapiens
ctactcagcagccctcctcacc

SEQ ID NO: 4225937 - DNA, 16 bp, Homo sapiens
ctagcgctgccgcacc

SEQ ID NO: 4225938 - DNA, 22 bp, Homo sapiens
ctagcgctgccgcaccccagag

SEQ ID NO: 4225939 - DNA, 23 bp, Homo sapiens
ctagctagaagtgggccaggaca

SEQ ID NO: 4225940 - DNA, 15 bp, Homo sapiens
ctagctgttgtaaag

SEQ ID NO: 4225941 - DNA, 15 bp, Homo sapiens
ctaggccactcctcc

SEQ ID NO: 4225942 - DNA, 16 bp, Homo sapiens
ctagtcagagagagtg

SEQ ID NO: 4225943 - DNA, 18 bp, Homo sapiens
ctagtcagagagagtgtt

SEQ ID NO: 4225944 - DNA, 18 bp, Homo sapiens
ctagtggggtctccctct

SEQ ID NO: 4225945 - DNA, 23 bp, Homo sapiens
ctagtggggtctccctctcctgc

SEQ ID NO: 4225946 - DNA, 16 bp, Homo sapiens
ctatccacccagccca

SEQ ID NO: 4225947 - DNA, 17 bp, Homo sapiens
ctatccacccagcccat

SEQ ID NO: 4225948 - DNA, 18 bp, Homo sapiens
ctatcccacccaacagct

SEQ ID NO: 4225949 - DNA, 11 bp, Homo sapiens
ctatggatgtg

SEQ ID NO: 4225950 - DNA, 18 bp, Homo sapiens
ctatggatgtggggtccc

SEQ ID NO: 4225951 - DNA, 14 bp, Homo sapiens
ctatgttccctcca

SEQ ID NO: 4225952 - DNA, 14 bp, Homo sapiens
ctcaaaagccaaaa

SEQ ID NO: 4225953 - DNA, 23 bp, Homo sapiens
ctcaaaagccaaaaaatgggaga

SEQ ID NO: 4225954 - DNA, 16 bp, Homo sapiens
ctcaatctaaattaaa

SEQ ID NO: 4225955 - DNA, 13 bp, Homo sapiens
ctcacagaagaat

SEQ ID NO: 4225956 - DNA, 22 bp, Homo sapiens
ctcacaggttggaagagaatca

SEQ ID NO: 4225957 - DNA, 16 bp, Homo sapiens
ctcacagttcctcgcc

SEQ ID NO: 4225958 - DNA, 19 bp, Homo sapiens
ctcacagttcctcgccctg

SEQ ID NO: 4225959 - DNA, 22 bp, Homo sapiens
ctcacagttcctcgccctgggt

SEQ ID NO: 4225960 - DNA, 16 bp, Homo sapiens
ctcaccccgtctgggg

SEQ ID NO: 4225961 - DNA, 13 bp, Homo sapiens
ctcacctctgcct

SEQ ID NO: 4225962 - DNA, 23 bp, Homo sapiens
ctcacgcctgtaatcccagcagt

SEQ ID NO: 4225963 - DNA, 12 bp, Homo sapiens
ctcactccacca

SEQ ID NO: 4225964 - DNA, 14 bp, Homo sapiens
ctcactccaccacc

SEQ ID NO: 4225965 - DNA, 16 bp, Homo sapiens
ctcactccaccaccca

SEQ ID NO: 4225966 - DNA, 12 bp, Homo sapiens
ctcactttccac

SEQ ID NO: 4225967 - DNA, 14 bp, Homo sapiens
ctcactttccaccc

SEQ ID NO: 4225968 - DNA, 16 bp, Homo sapiens
ctcagacccccactct

SEQ ID NO: 4225969 - DNA, 22 bp, Homo sapiens
ctcagacccccactctcattcc

SEQ ID NO: 4225970 - DNA, 23 bp, Homo sapiens
ctcagacccccactctcattccc

SEQ ID NO: 4225971 - DNA, 13 bp, Homo sapiens
ctcagcagccctc

SEQ ID NO: 4225972 - DNA, 16 bp, Homo sapiens
ctcagcagccctcctc

SEQ ID NO: 4225973 - DNA, 19 bp, Homo sapiens
ctcagcagccctcctcacc

SEQ ID NO: 4225974 - DNA, 21 bp, Homo sapiens
ctcagcagccctcctcacccc

SEQ ID NO: 4225975 - DNA, 11 bp, Homo sapiens
ctcagccctgg

SEQ ID NO: 4225976 - DNA, 13 bp, Homo sapiens
ctcagccctgggc

SEQ ID NO: 4225977 - DNA, 15 bp, Homo sapiens
ctcagccctgggccc

SEQ ID NO: 4225978 - DNA, 13 bp, Homo sapiens
ctcaggaggctga

SEQ ID NO: 4225979 - DNA, 18 bp, Homo sapiens
ctcaggaggctgaggcag

SEQ ID NO: 4225980 - DNA, 22 bp, Homo sapiens
ctcagggacagagacacctgca

SEQ ID NO: 4225981 - DNA, 16 bp, Homo sapiens
ctcagggctggggcca

SEQ ID NO: 4225982 - DNA, 11 bp, Homo sapiens
ctcattaaaat

SEQ ID NO: 4225983 - DNA, 17 bp, Homo sapiens
ctcattaaaatccagta

SEQ ID NO: 4225984 - DNA, 15 bp, Homo sapiens
ctccaaatttaacca

SEQ ID NO: 4225985 - DNA, 14 bp, Homo sapiens
ctccaacctggaca

SEQ ID NO: 4225986 - DNA, 18 bp, Homo sapiens
ctccaagaggctccctcc

SEQ ID NO: 4225987 - DNA, 15 bp, Homo sapiens
ctccaaggtggggtc

SEQ ID NO: 4225988 - DNA, 23 bp, Homo sapiens
ctccaaggtttataaagcagatt

SEQ ID NO: 4225989 - DNA, 13 bp, Homo sapiens
ctccaccaaccca

SEQ ID NO: 4225990 - DNA, 14 bp, Homo sapiens
ctccaccacccaaa

SEQ ID NO: 4225991 - DNA, 16 bp, Homo sapiens
ctccaccgctgcctaa

SEQ ID NO: 4225992 - DNA, 13 bp, Homo sapiens
ctccacctcagcc

SEQ ID NO: 4225993 - DNA, 16 bp, Homo sapiens
ctccacctcagccttg

SEQ ID NO: 4225994 - DNA, 22 bp, Homo sapiens
ctccacggtcagatttgctgtt

SEQ ID NO: 4225995 - DNA, 16 bp, Homo sapiens
ctccactccttcccaa

SEQ ID NO: 4225996 - DNA, 17 bp, Homo sapiens
ctccagcccagcccgct

SEQ ID NO: 4225997 - DNA, 19 bp, Homo sapiens
ctccagctgggttggaaaa

SEQ ID NO: 4225998 - DNA, 19 bp, Homo sapiens
ctccaggatttataaagca

SEQ ID NO: 4225999 - DNA, 20 bp, Homo sapiens
ctccaggatttataaagcaa

SEQ ID NO: 4226000 - DNA, 20 bp, Homo sapiens
ctccaggcacccttctttcc

SEQ ID NO: 4226001 - DNA, 21 bp, Homo sapiens
ctccaggcacccttctttcct

SEQ ID NO: 4226002 - DNA, 16 bp, Homo sapiens
ctccagggccacgtgc

SEQ ID NO: 4226003 - DNA, 19 bp, Homo sapiens
ctccagggccacgtgccag

SEQ ID NO: 4226004 - DNA, 20 bp, Homo sapiens
ctccatcgctgtcatctcag

SEQ ID NO: 4226005 - DNA, 22 bp, Homo sapiens
ctcccaccccacccccttcagt

SEQ ID NO: 4226006 - DNA, 14 bp, Homo sapiens
ctcccacgcctgct

SEQ ID NO: 4226007 - DNA, 19 bp, Homo sapiens
ctcccagccctatggatgt

SEQ ID NO: 4226008 - DNA, 21 bp, Homo sapiens
ctcccagccctatggatgtgg

SEQ ID NO: 4226009 - DNA, 17 bp, Homo sapiens
ctcccatctctacccca

SEQ ID NO: 4226010 - DNA, 11 bp, Homo sapiens
ctccccagggg

SEQ ID NO: 4226011 - DNA, 14 bp, Homo sapiens
ctcccccaccccct

SEQ ID NO: 4226012 - DNA, 14 bp, Homo sapiens
ctccctctcctgcc

SEQ ID NO: 4226013 - DNA, 17 bp, Homo sapiens
ctccctctcctgcctac

SEQ ID NO: 4226014 - DNA, 14 bp, Homo sapiens
ctccctctggccct

SEQ ID NO: 4226015 - DNA, 18 bp, Homo sapiens
ctccctctggccctgcct

SEQ ID NO: 4226016 - DNA, 19 bp, Homo sapiens
ctccctctggccctgcctt

SEQ ID NO: 4226017 - DNA, 22 bp, Homo sapiens
ctccgtcttagaagtggaccag

SEQ ID NO: 4226018 - DNA, 15 bp, Homo sapiens
ctcctacctgctgct

SEQ ID NO: 4226019 - DNA, 15 bp, Homo sapiens
ctcctatttatgaaa

SEQ ID NO: 4226020 - DNA, 20 bp, Homo sapiens
ctcctcagagtcccggcgtt

SEQ ID NO: 4226021 - DNA, 18 bp, Homo sapiens
ctcctccaaaggaagtct

SEQ ID NO: 4226022 - DNA, 23 bp, Homo sapiens
ctcctccaaaggaagtctaggag

SEQ ID NO: 4226023 - DNA, 13 bp, Homo sapiens
ctcctccagggcc

SEQ ID NO: 4226024 - DNA, 14 bp, Homo sapiens
ctcctccagggcca

SEQ ID NO: 4226025 - DNA, 12 bp, Homo sapiens
ctcctctccagg

SEQ ID NO: 4226026 - DNA, 11 bp, Homo sapiens
ctcctctgcca

SEQ ID NO: 4226027 - DNA, 12 bp, Homo sapiens
ctcctctgccac

SEQ ID NO: 4226028 - DNA, 15 bp, Homo sapiens
ctcctctgccacctc

SEQ ID NO: 4226029 - DNA, 16 bp, Homo sapiens
ctcctctgccacctcc

SEQ ID NO: 4226030 - DNA, 12 bp, Homo sapiens
ctcctctgctcc

SEQ ID NO: 4226031 - DNA, 14 bp, Homo sapiens
ctcctgcccaggag

SEQ ID NO: 4226032 - DNA, 15 bp, Homo sapiens
ctcctgcccaggaga

SEQ ID NO: 4226033 - DNA, 20 bp, Homo sapiens
ctcctgcccaggagagccag

SEQ ID NO: 4226034 - DNA, 14 bp, Homo sapiens
ctcctgcctactca

SEQ ID NO: 4226035 - DNA, 16 bp, Homo sapiens
ctcctgcctactcacg

SEQ ID NO: 4226036 - DNA, 14 bp, Homo sapiens
ctcctttcctctga

SEQ ID NO: 4226037 - DNA, 15 bp, Homo sapiens
ctcgccctgggtcta

SEQ ID NO: 4226038 - DNA, 20 bp, Homo sapiens
ctcggatcaccgagagtagc

SEQ ID NO: 4226039 - DNA, 16 bp, Homo sapiens
ctcgtcctccccctgc

SEQ ID NO: 4226040 - DNA, 21 bp, Homo sapiens
ctctaagccacagcttcttca

SEQ ID NO: 4226041 - DNA, 21 bp, Homo sapiens
ctctaataaagctcctctgct

SEQ ID NO: 4226042 - DNA, 16 bp, Homo sapiens
ctctagtttacttgct

SEQ ID NO: 4226043 - DNA, 18 bp, Homo sapiens
ctctattaagatttccaa

SEQ ID NO: 4226044 - DNA, 17 bp, Homo sapiens
ctctcagaattcttcag

SEQ ID NO: 4226045 - DNA, 14 bp, Homo sapiens
ctctcattccccag

SEQ ID NO: 4226046 - DNA, 10 bp, Homo sapiens
ctctccacct

SEQ ID NO: 4226047 - DNA, 14 bp, Homo sapiens
ctctccacctcagc

SEQ ID NO: 4226048 - DNA, 16 bp, Homo sapiens
ctctccacctcagcct

SEQ ID NO: 4226049 - DNA, 18 bp, Homo sapiens
ctctccacctcagccttg

SEQ ID NO: 4226050 - DNA, 22 bp, Homo sapiens
ctgttccaggtttttctggcat

SEQ ID NO: 4226051 - DNA, 13 bp, Homo sapiens
ctgttctgttcct

SEQ ID NO: 4226052 - DNA, 14 bp, Homo sapiens
ctgttgcctcatct

SEQ ID NO: 4226053 - DNA, 22 bp, Homo sapiens
cttaaattgtgggcaaaagaga

SEQ ID NO: 4226054 - DNA, 23 bp, Homo sapiens
cttaaattgtgggcaaaagagaa

SEQ ID NO: 4226055 - DNA, 16 bp, Homo sapiens
cttaaggtccctgctc

SEQ ID NO: 4226056 - DNA, 13 bp, Homo sapiens
cttaatgttgaat

SEQ ID NO: 4226057 - DNA, 14 bp, Homo sapiens
cttacctcctgccc

SEQ ID NO: 4226058 - DNA, 16 bp, Homo sapiens
cttacctcctgcccag

SEQ ID NO: 4226059 - DNA, 18 bp, Homo sapiens
cttacctcctgcccagga

SEQ ID NO: 4226060 - DNA, 20 bp, Homo sapiens
cttacctcctgcccaggaga

SEQ ID NO: 4226061 - DNA, 20 bp, Homo sapiens
cttagaagtggaccaggaca

SEQ ID NO: 4226062 - DNA, 23 bp, Homo sapiens
cttagaagtggaccaggacagga

SEQ ID NO: 4226063 - DNA, 20 bp, Homo sapiens
cttaggaaaatgcttctgtt

SEQ ID NO: 4226064 - DNA, 17 bp, Homo sapiens
cttaggtgccaggcatg

SEQ ID NO: 4226065 - DNA, 23 bp, Homo sapiens
cttagtttttatctttgaccaac

SEQ ID NO: 4226066 - DNA, 15 bp, Homo sapiens
cttattatagaattg

SEQ ID NO: 4226067 - DNA, 12 bp, Homo sapiens
cttcacactgca

SEQ ID NO: 4226068 - DNA, 13 bp, Homo sapiens
cttcacactgcaa

SEQ ID NO: 4226069 - DNA, 20 bp, Homo sapiens
cttcacactgcaagagcctt

SEQ ID NO: 4226070 - DNA, 15 bp, Homo sapiens
cttcagatcagtgct

SEQ ID NO: 4226071 - DNA, 21 bp, Homo sapiens
cttcagatgggaggaaagaga

SEQ ID NO: 4226072 - DNA, 23 bp, Homo sapiens
cttcagatgggaggaaagagagc

SEQ ID NO: 4226073 - DNA, 13 bp, Homo sapiens
cttcagtgcccac

SEQ ID NO: 4226074 - DNA, 17 bp, Homo sapiens
cttcagtgcccaccaac

SEQ ID NO: 4226075 - DNA, 21 bp, Homo sapiens
cttccacccctctcctcagag

SEQ ID NO: 4226076 - DNA, 17 bp, Homo sapiens
cttccatttcttctgca

SEQ ID NO: 4226077 - DNA, 17 bp, Homo sapiens
cttcccaaagcacaaag

SEQ ID NO: 4226078 - DNA, 15 bp, Homo sapiens
cttcccagctctccc

SEQ ID NO: 4226079 - DNA, 16 bp, Homo sapiens
cttcccatcactggag

SEQ ID NO: 4226080 - DNA, 17 bp, Homo sapiens
cttcccatcactggagc

SEQ ID NO: 4226081 - DNA, 18 bp, Homo sapiens
cttcccatcactggagca

SEQ ID NO: 4226082 - DNA, 14 bp, Homo sapiens
cttccccttcctct

SEQ ID NO: 4226083 - DNA, 12 bp, Homo sapiens
cttccccttgcc

SEQ ID NO: 4226084 - DNA, 22 bp, Homo sapiens
cttccccttgcccttgccctga

SEQ ID NO: 4226085 - DNA, 23 bp, Homo sapiens
cttccccttgcccttgccctgac

SEQ ID NO: 4226086 - DNA, 22 bp, Homo sapiens
cttcctataacttgatgcatgt

SEQ ID NO: 4226087 - DNA, 16 bp, Homo sapiens
cttcctctctccccca

SEQ ID NO: 4226088 - DNA, 13 bp, Homo sapiens
cttccttccctgg

SEQ ID NO: 4226089 - DNA, 13 bp, Homo sapiens
cttctagaaccag

SEQ ID NO: 4226090 - DNA, 22 bp, Homo sapiens
cttctgtggaagtagctttgaa

SEQ ID NO: 4226091 - DNA, 23 bp, Homo sapiens
cttctgtggaagtagctttgaac

SEQ ID NO: 4226092 - DNA, 17 bp, Homo sapiens
cttcttattctcactcc

SEQ ID NO: 4226093 - DNA, 18 bp, Homo sapiens
cttcttcagatcagtgct

SEQ ID NO: 4226094 - DNA, 22 bp, Homo sapiens
cttcttgcatccttcctataac

SEQ ID NO: 4226095 - DNA, 14 bp, Homo sapiens
cttctttcctcttc

SEQ ID NO: 4226096 - DNA, 14 bp, Homo sapiens
cttgagacctcagc

SEQ ID NO: 4226097 - DNA, 15 bp, Homo sapiens
cttgagacctcagcc

SEQ ID NO: 4226098 - DNA, 13 bp, Homo sapiens
cttgcacctgcat

SEQ ID NO: 4226099 - DNA, 12 bp, Homo sapiens
cttgccctgacc

SEQ ID NO: 4226100 - DNA, 14 bp, Homo sapiens
cttgccctgacctc

SEQ ID NO: 4226101 - DNA, 16 bp, Homo sapiens
cttgcccttgggtgct

SEQ ID NO: 4226102 - DNA, 16 bp, Homo sapiens
cttggtgtccacctgg

SEQ ID NO: 4226103 - DNA, 14 bp, Homo sapiens
cttgtaactccacc

SEQ ID NO: 4226104 - DNA, 18 bp, Homo sapiens
cttgtcaatactgagcca

SEQ ID NO: 4226105 - DNA, 14 bp, Homo sapiens
cttgtccagcgcct

SEQ ID NO: 4226106 - DNA, 14 bp, Homo sapiens
cttgtgaactccat

SEQ ID NO: 4226107 - DNA, 18 bp, Homo sapiens
cttgtgaactccatcatt

SEQ ID NO: 4226108 - DNA, 18 bp, Homo sapiens
cttgtgctcctgccagct

SEQ ID NO: 4226109 - DNA, 16 bp, Homo sapiens
cttgttattaccaaaa

SEQ ID NO: 4226110 - DNA, 20 bp, Homo sapiens
cttgtttgattttagctgca

SEQ ID NO: 4226111 - DNA, 23 bp, Homo sapiens
ctttaaaataaggataataatca

SEQ ID NO: 4226112 - DNA, 17 bp, Homo sapiens
ctttacttcccagtata

SEQ ID NO: 4226113 - DNA, 18 bp, Homo sapiens
ctttagaatgagagtgtg

SEQ ID NO: 4226114 - DNA, 11 bp, Homo sapiens
ctttcctctga

SEQ ID NO: 4226115 - DNA, 13 bp, Homo sapiens
ctttcctcttccc

SEQ ID NO: 4226116 - DNA, 14 bp, Homo sapiens
ctttcctcttcccc

SEQ ID NO: 4226117 - DNA, 19 bp, Homo sapiens
ctttcctcttccccttgcc

SEQ ID NO: 4226118 - DNA, 13 bp, Homo sapiens
ctttccttcctaa

SEQ ID NO: 4226119 - DNA, 18 bp, Homo sapiens
ctttccttgtggcagagg

SEQ ID NO: 4226120 - DNA, 21 bp, Homo sapiens
ctttctgctcctttctccaca

SEQ ID NO: 4226121 - DNA, 17 bp, Homo sapiens
ctttgggagacagtcta

SEQ ID NO: 4226122 - DNA, 21 bp, Homo sapiens
ctttgttgcaagtactgctgt

SEQ ID NO: 4226123 - DNA, 14 bp, Homo sapiens
cttttccccggtcc

SEQ ID NO: 4226124 - DNA, 15 bp, Homo sapiens
cttttgaatatcttc

SEQ ID NO: 4226125 - DNA, 10 bp, Homo sapiens
cttttttaac

SEQ ID NO: 4226126 - DNA, 20 bp, Homo sapiens
gaaaaaaaaaagaaaaagga

SEQ ID NO: 4226127 - DNA, 21 bp, Homo sapiens
gaaaaaactttctctttgcca

SEQ ID NO: 4226128 - DNA, 18 bp, Homo sapiens
gaaaaacatctgaaagcc

SEQ ID NO: 4226129 - DNA, 11 bp, Homo sapiens
gaaaaaggaaa

SEQ ID NO: 4226130 - DNA, 13 bp, Homo sapiens
gaaaaaggaaaag

SEQ ID NO: 4226131 - DNA, 12 bp, Homo sapiens
gaaaaattaaat

SEQ ID NO: 4226132 - DNA, 17 bp, Homo sapiens
gaaaacagagtatttct

SEQ ID NO: 4226133 - DNA, 15 bp, Homo sapiens
gaaaacccagagagg

SEQ ID NO: 4226134 - DNA, 22 bp, Homo sapiens
gaaaacccagagaggaatcaga

SEQ ID NO: 4226135 - DNA, 17 bp, Homo sapiens
gaaaagcacctgccgac

SEQ ID NO: 4226136 - DNA, 21 bp, Homo sapiens
gaaaatatttttttcctttgc

SEQ ID NO: 4226137 - DNA, 14 bp, Homo sapiens
gaaaatcctctggc

SEQ ID NO: 4226138 - DNA, 23 bp, Homo sapiens
gaaaatgaatttgggatactaaa

SEQ ID NO: 4226139 - DNA, 14 bp, Homo sapiens
gaaaccctccaaat

SEQ ID NO: 4226140 - DNA, 18 bp, Homo sapiens
gaaactccgtcttagaag

SEQ ID NO: 4226141 - DNA, 22 bp, Homo sapiens
gaaactccgtcttagaagtgga

SEQ ID NO: 4226142 - DNA, 22 bp, Homo sapiens
gaaagaccatgcatttaaagta

SEQ ID NO: 4226143 - DNA, 13 bp, Homo sapiens
gaaagagagcagg

SEQ ID NO: 4226144 - DNA, 13 bp, Homo sapiens
gaaagctagagat

SEQ ID NO: 4226145 - DNA, 23 bp, Homo sapiens
gaaagctgaatccttccatttct

SEQ ID NO: 4226146 - DNA, 14 bp, Homo sapiens
gaaaggcctctgtg

SEQ ID NO: 4226147 - DNA, 15 bp, Homo sapiens
gaaaggcctctgtgg

SEQ ID NO: 4226148 - DNA, 14 bp, Homo sapiens
gaaatgacccaaac

SEQ ID NO: 4226149 - DNA, 16 bp, Homo sapiens
gaaattaatttgtgaa

SEQ ID NO: 4226150 - DNA, 18 bp, Homo sapiens
gaaatttagagtcaattt

SEQ ID NO: 4226151 - DNA, 17 bp, Homo sapiens
gaacaaagaaaaaaata

SEQ ID NO: 4226152 - DNA, 18 bp, Homo sapiens
gaacagacaggagaaatg

SEQ ID NO: 4226153 - DNA, 14 bp, Homo sapiens
gaacatatcatttg

SEQ ID NO: 4226154 - DNA, 18 bp, Homo sapiens
gaacatatcatttgtgaa

SEQ ID NO: 4226155 - DNA, 20 bp, Homo sapiens
gaacatatcatttgtgaaga

SEQ ID NO: 4226156 - DNA, 14 bp, Homo sapiens
gaacatgaccaaaa

SEQ ID NO: 4226157 - DNA, 12 bp, Homo sapiens
gaacccacctgc

SEQ ID NO: 4226158 - DNA, 13 bp, Homo sapiens
gaacccacctgct

SEQ ID NO: 4226159 - DNA, 19 bp, Homo sapiens
gaacccacctgctgagaga

SEQ ID NO: 4226160 - DNA, 20 bp, Homo sapiens
gaaccttaacctctctaagc

SEQ ID NO: 4226161 - DNA, 14 bp, Homo sapiens
gaacggggagaaaa

SEQ ID NO: 4226162 - DNA, 15 bp, Homo sapiens
gaacggggagaaaag

SEQ ID NO: 4226163 - DNA, 21 bp, Homo sapiens
gaactcaatctaaattaaaaa

SEQ ID NO: 4226164 - DNA, 23 bp, Homo sapiens
gaactcaatctaaattaaaaaag

SEQ ID NO: 4226165 - DNA, 16 bp, Homo sapiens
gaactcctaaatcaag

SEQ ID NO: 4226166 - DNA, 20 bp, Homo sapiens
gaactcctggaaatatcagt

SEQ ID NO: 4226167 - DNA, 23 bp, Homo sapiens
gaactttgtacagtggagaaata

SEQ ID NO: 4226168 - DNA, 19 bp, Homo sapiens
gaagaattgaacccaggag

SEQ ID NO: 4226169 - DNA, 20 bp, Homo sapiens
gaagaattgaacccaggagg

SEQ ID NO: 4226170 - DNA, 23 bp, Homo sapiens
gaagacaatactccctttaaaga

SEQ ID NO: 4226171 - DNA, 17 bp, Homo sapiens
gaagcatgtaggagaat

SEQ ID NO: 4226172 - DNA, 11 bp, Homo sapiens
gaagccctcct

SEQ ID NO: 4226173 - DNA, 12 bp, Homo sapiens
gaagccctcctt

SEQ ID NO: 4226174 - DNA, 14 bp, Homo sapiens
ggacagatggacca

SEQ ID NO: 4226175 - DNA, 19 bp, Homo sapiens
ggacagatggaccaaaaga

SEQ ID NO: 4226176 - DNA, 22 bp, Homo sapiens
ggacagatggaccaaaagatgg

SEQ ID NO: 4226177 - DNA, 22 bp, Homo sapiens
ggacagcctgtggcggtgcctg

SEQ ID NO: 4226178 - DNA, 14 bp, Homo sapiens
ggaccaggacagga

SEQ ID NO: 4226179 - DNA, 17 bp, Homo sapiens
ggaccctttccttcctt

SEQ ID NO: 4226180 - DNA, 22 bp, Homo sapiens
ggaccctttccttccttccctg

SEQ ID NO: 4226181 - DNA, 18 bp, Homo sapiens
ggactcaagggtccagaa

SEQ ID NO: 4226182 - DNA, 20 bp, Homo sapiens
ggactcacaggttggaagag

SEQ ID NO: 4226183 - DNA, 23 bp, Homo sapiens
ggactcacaggttggaagagaat

SEQ ID NO: 4226184 - DNA, 13 bp, Homo sapiens
ggagaaaacactt

SEQ ID NO: 4226185 - DNA, 22 bp, Homo sapiens
ggagaaagaccatgcatttaaa

SEQ ID NO: 4226186 - DNA, 22 bp, Homo sapiens
ggagaagaattttcagacccca

SEQ ID NO: 4226187 - DNA, 16 bp, Homo sapiens
ggagaagcagtgagcc

SEQ ID NO: 4226188 - DNA, 22 bp, Homo sapiens
ggagaaggaaggagactcacct

SEQ ID NO: 4226189 - DNA, 22 bp, Homo sapiens
ggagactgctgagtcaacccaa

SEQ ID NO: 4226190 - DNA, 15 bp, Homo sapiens
ggagagccagccctc

SEQ ID NO: 4226191 - DNA, 18 bp, Homo sapiens
ggagagggtctggagaag

SEQ ID NO: 4226192 - DNA, 21 bp, Homo sapiens
ggagagggtctggagaagcag

SEQ ID NO: 4226193 - DNA, 17 bp, Homo sapiens
ggagcaccaggcacgaa

SEQ ID NO: 4226194 - DNA, 14 bp, Homo sapiens
ggagccaccagccc

SEQ ID NO: 4226195 - DNA, 19 bp, Homo sapiens
ggagcgatcgctcccctgg

SEQ ID NO: 4226196 - DNA, 14 bp, Homo sapiens
ggagctgggaggaa

SEQ ID NO: 4226197 - DNA, 16 bp, Homo sapiens
ggaggctgaggcagaa

SEQ ID NO: 4226198 - DNA, 17 bp, Homo sapiens
ggagggcgtgactcacc

SEQ ID NO: 4226199 - DNA, 20 bp, Homo sapiens
ggaggtggaggttgcagtga

SEQ ID NO: 4226200 - DNA, 21 bp, Homo sapiens
ggaggttgcagtgagctgaga

SEQ ID NO: 4226201 - DNA, 19 bp, Homo sapiens
ggatctgggaccctttcct

SEQ ID NO: 4226202 - DNA, 11 bp, Homo sapiens
ggatggacaga

SEQ ID NO: 4226203 - DNA, 20 bp, Homo sapiens
ggattttaaaaacatgagaa

SEQ ID NO: 4226204 - DNA, 22 bp, Homo sapiens
ggattttaaaaacatgagaaat

SEQ ID NO: 4226205 - DNA, 16 bp, Homo sapiens
ggcaaccccagttctg

SEQ ID NO: 4226206 - DNA, 23 bp, Homo sapiens
ggcaacttgggaactagactccc

SEQ ID NO: 4226207 - DNA, 16 bp, Homo sapiens
ggcacctgaaattaat

SEQ ID NO: 4226208 - DNA, 17 bp, Homo sapiens
ggcagaagaattgaacc

SEQ ID NO: 4226209 - DNA, 22 bp, Homo sapiens
ggcagaagaattgaacccagga

SEQ ID NO: 4226210 - DNA, 23 bp, Homo sapiens
ggcagaagaattgaacccaggag

SEQ ID NO: 4226211 - DNA, 12 bp, Homo sapiens
ggcagaggctgg

SEQ ID NO: 4226212 - DNA, 21 bp, Homo sapiens
ggcagaggctggaggcagggc

SEQ ID NO: 4226213 - DNA, 10 bp, Homo sapiens
ggcagggctg

SEQ ID NO: 4226214 - DNA, 16 bp, Homo sapiens
ggcagggtgggatgga

SEQ ID NO: 4226215 - DNA, 23 bp, Homo sapiens
ggcagtagctgtggtgaggtggg

SEQ ID NO: 4226216 - DNA, 19 bp, Homo sapiens
ggcatggtggcgcaagcct

SEQ ID NO: 4226217 - DNA, 17 bp, Homo sapiens
ggccacgtgccaggccc

SEQ ID NO: 4226218 - DNA, 15 bp, Homo sapiens
ggccaggacaggccc

SEQ ID NO: 4226219 - DNA, 14 bp, Homo sapiens
ggccccaccaccta

SEQ ID NO: 4226220 - DNA, 15 bp, Homo sapiens
ggccccaccacctag

SEQ ID NO: 4226221 - DNA, 14 bp, Homo sapiens
ggccctgccttctt

SEQ ID NO: 4226222 - DNA, 22 bp, Homo sapiens
ggccctggcctgctgggctctc

SEQ ID NO: 4226223 - DNA, 14 bp, Homo sapiens
ggccctgggggacc

SEQ ID NO: 4226224 - DNA, 16 bp, Homo sapiens
ggccgcattccctgag

SEQ ID NO: 4226225 - DNA, 21 bp, Homo sapiens
ggccgtctgcacttctgttcc

SEQ ID NO: 4226226 - DNA, 18 bp, Homo sapiens
ggcctgccaccctcctgc

SEQ ID NO: 4226227 - DNA, 19 bp, Homo sapiens
ggcctgccaccctcctgcg

SEQ ID NO: 4226228 - DNA, 19 bp, Homo sapiens
ggcctgctgggctctccac

SEQ ID NO: 4226229 - DNA, 22 bp, Homo sapiens
ggcctgctgggctctccacctc

SEQ ID NO: 4226230 - DNA, 23 bp, Homo sapiens
ggcctgctgggctctccacctca

SEQ ID NO: 4226231 - DNA, 13 bp, Homo sapiens
ggccttgcccaga

SEQ ID NO: 4226232 - DNA, 14 bp, Homo sapiens
ggccttgcccagag

SEQ ID NO: 4226233 - DNA, 16 bp, Homo sapiens
ggccttgcccagagat

SEQ ID NO: 4226234 - DNA, 20 bp, Homo sapiens
ggcggctactcagcagccct

SEQ ID NO: 4226235 - DNA, 17 bp, Homo sapiens
ggcgtttacctcgtggt

SEQ ID NO: 4226236 - DNA, 18 bp, Homo sapiens
ggctactcagcagccctc

SEQ ID NO: 4226237 - DNA, 13 bp, Homo sapiens
ggctagtcagaga

SEQ ID NO: 4226238 - DNA, 14 bp, Homo sapiens
ggctagtcagagag

SEQ ID NO: 4226239 - DNA, 21 bp, Homo sapiens
ggctatggatctgatttttaa

SEQ ID NO: 4226240 - DNA, 16 bp, Homo sapiens
ggctccagcccagccc

SEQ ID NO: 4226241 - DNA, 11 bp, Homo sapiens
ggctccctccc

SEQ ID NO: 4226242 - DNA, 15 bp, Homo sapiens
ggctccctcccaccc

SEQ ID NO: 4226243 - DNA, 18 bp, Homo sapiens
ggctccctcccacccaac

SEQ ID NO: 4226244 - DNA, 15 bp, Homo sapiens
ggctctccacctcag

SEQ ID NO: 4226245 - DNA, 22 bp, Homo sapiens
ggctctccacctcagccttgga

SEQ ID NO: 4226246 - DNA, 15 bp, Homo sapiens
ggctgaacggggaga

SEQ ID NO: 4226247 - DNA, 17 bp, Homo sapiens
ggctgaacggggagaaa

SEQ ID NO: 4226248 - DNA, 22 bp, Homo sapiens
ggctgagtcatgatctccctgc

SEQ ID NO: 4226249 - DNA, 23 bp, Homo sapiens
ggctggaggcagggccttgccca

SEQ ID NO: 4226250 - DNA, 14 bp, Homo sapiens
ggctggggccaaga

SEQ ID NO: 4226251 - DNA, 20 bp, Homo sapiens
ggcttccacccctctcctca

SEQ ID NO: 4226252 - DNA, 20 bp, Homo sapiens
ggcttcttcagatcagtgct

SEQ ID NO: 4226253 - DNA, 18 bp, Homo sapiens
ggcttgtaactccaccaa

SEQ ID NO: 4226254 - DNA, 18 bp, Homo sapiens
gggaacagacaggagaaa

SEQ ID NO: 4226255 - DNA, 17 bp, Homo sapiens
gggaacgtgactgcccc

SEQ ID NO: 4226256 - DNA, 13 bp, Homo sapiens
gggacagagcaga

SEQ ID NO: 4226257 - DNA, 16 bp, Homo sapiens
gggagccaccagcccc

SEQ ID NO: 4226258 - DNA, 20 bp, Homo sapiens
gggagttcgagaccaacctg

SEQ ID NO: 4226259 - DNA, 23 bp, Homo sapiens
gggagttcgagaccaacctgacc

SEQ ID NO: 4226260 - DNA, 15 bp, Homo sapiens
gggatggaggagaag

SEQ ID NO: 4226261 - DNA, 18 bp, Homo sapiens
gggatggaggagaagaat

SEQ ID NO: 4226262 - DNA, 23 bp, Homo sapiens
gggattttaaaaacatgagaaat

SEQ ID NO: 4226263 - DNA, 16 bp, Homo sapiens
gggcagaggctggagg

SEQ ID NO: 4226264 - DNA, 12 bp, Homo sapiens
gggcagggctgg

SEQ ID NO: 4226265 - DNA, 12 bp, Homo sapiens
gggccaagagga

SEQ ID NO: 4226266 - DNA, 19 bp, Homo sapiens
gggccaagaggaaaaacag

SEQ ID NO: 4226267 - DNA, 23 bp, Homo sapiens
gggccaagaggaaaaacagggaa

SEQ ID NO: 4226268 - DNA, 18 bp, Homo sapiens
gggccacgtgccaggccc

SEQ ID NO: 4226269 - DNA, 15 bp, Homo sapiens
gggccccaccaccta

SEQ ID NO: 4226270 - DNA, 21 bp, Homo sapiens
gggctctccacctcagccttg

SEQ ID NO: 4226271 - DNA, 18 bp, Homo sapiens
gggctgctcctccagggc

SEQ ID NO: 4226272 - DNA, 19 bp, Homo sapiens
gggctggggccaagaggaa

SEQ ID NO: 4226273 - DNA, 13 bp, Homo sapiens
ggggaactcctgg

SEQ ID NO: 4226274 - DNA, 14 bp, Homo sapiens
ggggaagccctgga

SEQ ID NO: 4226275 - DNA, 18 bp, Homo sapiens
ggggcagagggcagaggc

SEQ ID NO: 4226276 - DNA, 18 bp, Homo sapiens
ggggctgaacggggagaa

SEQ ID NO: 4226277 - DNA, 16 bp, Homo sapiens
ggggctgctcctccag

SEQ ID NO: 4226278 - DNA, 11 bp, Homo sapiens
gggggcagagg

SEQ ID NO: 4226279 - DNA, 13 bp, Homo sapiens
gggggcagagggc

SEQ ID NO: 4226280 - DNA, 13 bp, Homo sapiens
gggggctggacct

SEQ ID NO: 4226281 - DNA, 22 bp, Homo sapiens
ggggtctccctctcctgcctac

SEQ ID NO: 4226282 - DNA, 22 bp, Homo sapiens
ggggtctttgtgagagtgagct

SEQ ID NO: 4226283 - DNA, 16 bp, Homo sapiens
ggggttcagcccctcc

SEQ ID NO: 4226284 - DNA, 22 bp, Homo sapiens
ggggttcagcccctcctctgcc

SEQ ID NO: 4226285 - DNA, 17 bp, Homo sapiens
gggtccccatcatccca

SEQ ID NO: 4226286 - DNA, 16 bp, Homo sapiens
gggtggctagtcagag

SEQ ID NO: 4226287 - DNA, 18 bp, Homo sapiens
gggtggctagtcagagag

SEQ ID NO: 4226288 - DNA, 17 bp, Homo sapiens
gggtgggatggaggaga

SEQ ID NO: 4226289 - DNA, 15 bp, Homo sapiens
gggtgggcagggctg

SEQ ID NO: 4226290 - DNA, 14 bp, Homo sapiens
gggtggggctgctc

SEQ ID NO: 4226291 - DNA, 14 bp, Homo sapiens
ggtaccactgattt

SEQ ID NO: 4226292 - DNA, 16 bp, Homo sapiens
ggtccagaagtccctc

SEQ ID NO: 4226293 - DNA, 18 bp, Homo sapiens
ggtccagcttgctcttca

SEQ ID NO: 4226294 - DNA, 18 bp, Homo sapiens
ggtccccatcatcccagc

SEQ ID NO: 4226295 - DNA, 21 bp, Homo sapiens
ggtcccttgagacctcagcca

SEQ ID NO: 4226296 - DNA, 17 bp, Homo sapiens
ggtctccctctcctgcc

SEQ ID NO: 4226297 - DNA, 15 bp, Homo sapiens
tctccaacctggaca

SEQ ID NO: 4226298 - DNA, 14 bp, Homo sapiens
tctccacctcagcc

SEQ ID NO: 4226299 - DNA, 16 bp, Homo sapiens
tctccacctcagcctt

SEQ ID NO: 4226300 - DNA, 18 bp, Homo sapiens
tctccacctcagccttgg

SEQ ID NO: 4226301 - DNA, 17 bp, Homo sapiens
tctccatctggcagggt

SEQ ID NO: 4226302 - DNA, 21 bp, Homo sapiens
tctcccactgcaacttgtgaa

SEQ ID NO: 4226303 - DNA, 16 bp, Homo sapiens
tctccctctggccctg

SEQ ID NO: 4226304 - DNA, 18 bp, Homo sapiens
tctccctctggccctgcc

SEQ ID NO: 4226305 - DNA, 19 bp, Homo sapiens
tctccctctggccctgcct

SEQ ID NO: 4226306 - DNA, 13 bp, Homo sapiens
tctccctgccgcc

SEQ ID NO: 4226307 - DNA, 11 bp, Homo sapiens
tctcctgccta

SEQ ID NO: 4226308 - DNA, 14 bp, Homo sapiens
tctcctgcctactc

SEQ ID NO: 4226309 - DNA, 15 bp, Homo sapiens
tctcctgcctactca

SEQ ID NO: 4226310 - DNA, 14 bp, Homo sapiens
tctcctgtccaacc

SEQ ID NO: 4226311 - DNA, 13 bp, Homo sapiens
tctctaagccaca

SEQ ID NO: 4226312 - DNA, 20 bp, Homo sapiens
tctctaagccacagcttctt

SEQ ID NO: 4226313 - DNA, 16 bp, Homo sapiens
tctctaccccaaagaa

SEQ ID NO: 4226314 - DNA, 12 bp, Homo sapiens
tctctcaaactt

SEQ ID NO: 4226315 - DNA, 15 bp, Homo sapiens
tctctccacctgcct

SEQ ID NO: 4226316 - DNA, 12 bp, Homo sapiens
tctctctcctgt

SEQ ID NO: 4226317 - DNA, 11 bp, Homo sapiens
tctctgcagcc

SEQ ID NO: 4226318 - DNA, 16 bp, Homo sapiens
tctctgcagccagccc

SEQ ID NO: 4226319 - DNA, 18 bp, Homo sapiens
tctctgcagccagcccag

SEQ ID NO: 4226320 - DNA, 12 bp, Homo sapiens
tctcttcctctg

SEQ ID NO: 4226321 - DNA, 16 bp, Homo sapiens
tctcttcctctgttct

SEQ ID NO: 4226322 - DNA, 19 bp, Homo sapiens
tctctttgccatttcttct

SEQ ID NO: 4226323 - DNA, 21 bp, Homo sapiens
tctgaaagacagaatgtcacc

SEQ ID NO: 4226324 - DNA, 14 bp, Homo sapiens
tctgaaagccacgt

SEQ ID NO: 4226325 - DNA, 19 bp, Homo sapiens
tctgattatacaccatttt

SEQ ID NO: 4226326 - DNA, 22 bp, Homo sapiens
tctgattatacaccatttttga

SEQ ID NO: 4226327 - DNA, 14 bp, Homo sapiens
tctgatttttaatt

SEQ ID NO: 4226328 - DNA, 14 bp, Homo sapiens
tctgcaagacaaag

SEQ ID NO: 4226329 - DNA, 18 bp, Homo sapiens
tctgcagccagcccagcc

SEQ ID NO: 4226330 - DNA, 20 bp, Homo sapiens
tctgccacctcccctatcca

SEQ ID NO: 4226331 - DNA, 15 bp, Homo sapiens
tctgcccaaattatg

SEQ ID NO: 4226332 - DNA, 22 bp, Homo sapiens
tctgcccagcaatcaaaggcaa

SEQ ID NO: 4226333 - DNA, 20 bp, Homo sapiens
tctgcttaggtgccaggcat

SEQ ID NO: 4226334 - DNA, 15 bp, Homo sapiens
tctggagaagcagtg

SEQ ID NO: 4226335 - DNA, 13 bp, Homo sapiens
tctggccctgcct

SEQ ID NO: 4226336 - DNA, 19 bp, Homo sapiens
tctgggaccctttccttcc

SEQ ID NO: 4226337 - DNA, 17 bp, Homo sapiens
tctggggttcagcccct

SEQ ID NO: 4226338 - DNA, 23 bp, Homo sapiens
tctgtccaggacatgatactgat

SEQ ID NO: 4226339 - DNA, 21 bp, Homo sapiens
tctgtgaattgtggctgttca

SEQ ID NO: 4226340 - DNA, 23 bp, Homo sapiens
tctgtgaattgtggctgttcact

SEQ ID NO: 4226341 - DNA, 15 bp, Homo sapiens
tctgtgcccctgtaa

SEQ ID NO: 4226342 - DNA, 16 bp, Homo sapiens
tctgttccaggtttct

SEQ ID NO: 4226343 - DNA, 12 bp, Homo sapiens
tcttaaatgaca

SEQ ID NO: 4226344 - DNA, 21 bp, Homo sapiens
tcttagaagtggaccaggaca

SEQ ID NO: 4226345 - DNA, 15 bp, Homo sapiens
tcttattctcactcc

SEQ ID NO: 4226346 - DNA, 17 bp, Homo sapiens
tcttcccatcactggag

SEQ ID NO: 4226347 - DNA, 13 bp, Homo sapiens
tcttccccttgcc

SEQ ID NO: 4226348 - DNA, 15 bp, Homo sapiens
tcttccccttgccct

SEQ ID NO: 4226349 - DNA, 22 bp, Homo sapiens
tcttccccttgcccttgccctg

SEQ ID NO: 4226350 - DNA, 13 bp, Homo sapiens
tcttcgaggtgga

SEQ ID NO: 4226351 - DNA, 15 bp, Homo sapiens
tcttcttcttctttt

SEQ ID NO: 4226352 - DNA, 21 bp, Homo sapiens
tcttgcatccttcctataact

SEQ ID NO: 4226353 - DNA, 19 bp, Homo sapiens
tcttggtactgttgctttg

SEQ ID NO: 4226354 - DNA, 20 bp, Homo sapiens
tcttgttattaccaaaacag

SEQ ID NO: 4226355 - DNA, 16 bp, Homo sapiens
tctttcccctcagagc

SEQ ID NO: 4226356 - DNA, 20 bp, Homo sapiens
tctttcccctcagagctctt

SEQ ID NO: 4226357 - DNA, 23 bp, Homo sapiens
tctttcctcttccccttgccctt

SEQ ID NO: 4226358 - DNA, 17 bp, Homo sapiens
tgaaaaaactttctctt

SEQ ID NO: 4226359 - DNA, 21 bp, Homo sapiens
tgaaaaaactttctctttgcc

SEQ ID NO: 4226360 - DNA, 22 bp, Homo sapiens
tgaaaaaactttctctttgcca

SEQ ID NO: 4226361 - DNA, 13 bp, Homo sapiens
tgaaaaataaaaa

SEQ ID NO: 4226362 - DNA, 16 bp, Homo sapiens
tgaaaaataaaaacca

SEQ ID NO: 4226363 - DNA, 17 bp, Homo sapiens
tgaaaaataaaaaccat

SEQ ID NO: 4226364 - DNA, 17 bp, Homo sapiens
tgaaaatcctgaataaa

SEQ ID NO: 4226365 - DNA, 21 bp, Homo sapiens
tgaaactatggctttaaacta

SEQ ID NO: 4226366 - DNA, 16 bp, Homo sapiens
tgaaatattaaaatca

SEQ ID NO: 4226367 - DNA, 18 bp, Homo sapiens
tgaaatattaaaatcact

SEQ ID NO: 4226368 - DNA, 22 bp, Homo sapiens
tgaaatgcttatgcttgtgtat

SEQ ID NO: 4226369 - DNA, 20 bp, Homo sapiens
tgaacctgtcacctggcctg

SEQ ID NO: 4226370 - DNA, 15 bp, Homo sapiens
tgaacggggagaaaa

SEQ ID NO: 4226371 - DNA, 20 bp, Homo sapiens
tgaactcaatctaaattaaa

SEQ ID NO: 4226372 - DNA, 21 bp, Homo sapiens
tgaactcaatctaaattaaaa

SEQ ID NO: 4226373 - DNA, 21 bp, Homo sapiens
tgaagaaaaagacctgcattt

SEQ ID NO: 4226374 - DNA, 12 bp, Homo sapiens
tgaagaattatt

SEQ ID NO: 4226375 - DNA, 11 bp, Homo sapiens
tgaagccagat

SEQ ID NO: 4226376 - DNA, 17 bp, Homo sapiens
tgaagtatttctcactc

SEQ ID NO: 4226377 - DNA, 21 bp, Homo sapiens
tgaatattggtaattaaaaga

SEQ ID NO: 4226378 - DNA, 16 bp, Homo sapiens
tgaatcagaccctacc

SEQ ID NO: 4226379 - DNA, 18 bp, Homo sapiens
tgaatcagaccctacccc

SEQ ID NO: 4226380 - DNA, 22 bp, Homo sapiens
tgaatcagaccctaccccacca

SEQ ID NO: 4226381 - DNA, 19 bp, Homo sapiens
tgaatccttccatttcttc

SEQ ID NO: 4226382 - DNA, 21 bp, Homo sapiens
tgaatccttccatttcttctg

SEQ ID NO: 4226383 - DNA, 16 bp, Homo sapiens
tgaatcttggtgtcta

SEQ ID NO: 4226384 - DNA, 19 bp, Homo sapiens
tgaatgatttccaaagaga

SEQ ID NO: 4226385 - DNA, 15 bp, Homo sapiens
tgaatgcataaaatg

SEQ ID NO: 4226386 - DNA, 12 bp, Homo sapiens
tgaatgtatttt

SEQ ID NO: 4226387 - DNA, 21 bp, Homo sapiens
tgaatgtattttggttgctga

SEQ ID NO: 4226388 - DNA, 22 bp, Homo sapiens
tgaatgtattttggttgctgat

SEQ ID NO: 4226389 - DNA, 17 bp, Homo sapiens
tgaattagattatttct

SEQ ID NO: 4226390 - DNA, 17 bp, Homo sapiens
tgacaaagaaacccaag

SEQ ID NO: 4226391 - DNA, 13 bp, Homo sapiens
tgacaacagactg

SEQ ID NO: 4226392 - DNA, 14 bp, Homo sapiens
tgacaacagactga

SEQ ID NO: 4226393 - DNA, 14 bp, Homo sapiens
tgacagctgtccct

SEQ ID NO: 4226394 - DNA, 20 bp, Homo sapiens
tgacagctgtccctgtcacc

SEQ ID NO: 4226395 - DNA, 16 bp, Homo sapiens
tgacatagtggatgga

SEQ ID NO: 4226396 - DNA, 20 bp, Homo sapiens
tgacatagtggatggacaga

SEQ ID NO: 4226397 - DNA, 21 bp, Homo sapiens
tgacatagtggatggacagat

SEQ ID NO: 4226398 - DNA, 23 bp, Homo sapiens
tgacatagtggatggacagatgg

SEQ ID NO: 4226399 - DNA, 15 bp, Homo sapiens
tgacatatttttgct

SEQ ID NO: 4226400 - DNA, 23 bp, Homo sapiens
tgaccaacatggagaaaccctgt

SEQ ID NO: 4226401 - DNA, 12 bp, Homo sapiens
tgacccagtccc

SEQ ID NO: 4226402 - DNA, 15 bp, Homo sapiens
tgactgccccaactc

SEQ ID NO: 4226403 - DNA, 20 bp, Homo sapiens
tgagagacccaaggaggaaa

SEQ ID NO: 4226404 - DNA, 21 bp, Homo sapiens
tgagagacccaaggaggaaaa

SEQ ID NO: 4226405 - DNA, 19 bp, Homo sapiens
tgagccatcatttcctggg

SEQ ID NO: 4226406 - DNA, 16 bp, Homo sapiens
tgagctcagaccccca

SEQ ID NO: 4226407 - DNA, 18 bp, Homo sapiens
tgagctcagacccccact

SEQ ID NO: 4226408 - DNA, 23 bp, Homo sapiens
tgagcttaagaattttgagcagg

SEQ ID NO: 4226409 - DNA, 13 bp, Homo sapiens
tgaggcagaagaa

SEQ ID NO: 4226410 - DNA, 18 bp, Homo sapiens
tgaggcagaagaattgaa

SEQ ID NO: 4226411 - DNA, 20 bp, Homo sapiens
tgagggaacagacaggagaa

SEQ ID NO: 4226412 - DNA, 16 bp, Homo sapiens
tgaggtggaagccctc

SEQ ID NO: 4226413 - DNA, 17 bp, Homo sapiens
tgaggtggaagccctcc

SEQ ID NO: 4226414 - DNA, 20 bp, Homo sapiens
tgaggtggaagccctccttc

SEQ ID NO: 4226415 - DNA, 21 bp, Homo sapiens
tgagtcatgatctccctgccg

SEQ ID NO: 4226416 - DNA, 22 bp, Homo sapiens
tgagtcatgatctccctgccgc

SEQ ID NO: 4226417 - DNA, 13 bp, Homo sapiens
tgatctccctgcc

SEQ ID NO: 4226418 - DNA, 14 bp, Homo sapiens
tgatctccctgccg

SEQ ID NO: 4226419 - DNA, 23 bp, Homo sapiens
tgatgccatgtttagattccagg

SEQ ID NO: 4226420 - DNA, 20 bp, Homo sapiens
tgatggggtgggcagggctg

SEQ ID NO: 4226421 - DNA, 18 bp, Homo sapiens
aaagaaatttgaaaaaac

SEQ ID NO: 4226422 - DNA, 18 bp, Homo sapiens
aaagaagtggggacagag

SEQ ID NO: 4226423 - DNA, 17 bp, Homo sapiens
aaagaatggaaggtgga

SEQ ID NO: 4226424 - DNA, 12 bp, Homo sapiens
aaagacagaatg

SEQ ID NO: 4226425 - DNA, 13 bp, Homo sapiens
aaagacagaatgt

SEQ ID NO: 4226426 - DNA, 14 bp, Homo sapiens
aaagaccatgcatt

SEQ ID NO: 4226427 - DNA, 22 bp, Homo sapiens
aaagactccacataagtccatt

SEQ ID NO: 4226428 - DNA, 18 bp, Homo sapiens
aaagagaaaaaaagtttg

SEQ ID NO: 4226429 - DNA, 15 bp, Homo sapiens
aaagagcaagtctgg

SEQ ID NO: 4226430 - DNA, 20 bp, Homo sapiens
aaagagctcaggcttttcca

SEQ ID NO: 4226431 - DNA, 23 bp, Homo sapiens
aaagatccaccctcaaatgtcag

SEQ ID NO: 4226432 - DNA, 15 bp, Homo sapiens
aaagcaaaaagatgt

SEQ ID NO: 4226433 - DNA, 23 bp, Homo sapiens
aaagcaaattactccaaggttta

SEQ ID NO: 4226434 - DNA, 15 bp, Homo sapiens
aaagctgaaaactgc

SEQ ID NO: 4226435 - DNA, 18 bp, Homo sapiens
aaagctgaatccttccat

SEQ ID NO: 4226436 - DNA, 21 bp, Homo sapiens
aaagctttgcttatggtaata

SEQ ID NO: 4226437 - DNA, 21 bp, Homo sapiens
aaaggatgtaaacagtgcctg

SEQ ID NO: 4226438 - DNA, 16 bp, Homo sapiens
aaagtattctccatcc

SEQ ID NO: 4226439 - DNA, 12 bp, Homo sapiens
aaagtgcattca

SEQ ID NO: 4226440 - DNA, 16 bp, Homo sapiens
aaagtgcattcaacct

SEQ ID NO: 4226441 - DNA, 12 bp, Homo sapiens
aaataaaaacca

SEQ ID NO: 4226442 - DNA, 13 bp, Homo sapiens
aaatagtaaaaat

SEQ ID NO: 4226443 - DNA, 18 bp, Homo sapiens
aaatagttttaaatatga

SEQ ID NO: 4226444 - DNA, 20 bp, Homo sapiens
aaatagttttaaatatgaac

SEQ ID NO: 4226445 - DNA, 21 bp, Homo sapiens
aaatagttttaaatatgaaca

SEQ ID NO: 4226446 - DNA, 22 bp, Homo sapiens
aaatagttttaaatatgaacaa

SEQ ID NO: 4226447 - DNA, 23 bp, Homo sapiens
aaatagttttaaatatgaacaaa

SEQ ID NO: 4226448 - DNA, 20 bp, Homo sapiens
aaatataattgggattttaa

SEQ ID NO: 4226449 - DNA, 17 bp, Homo sapiens
aaatatattttatgatt

SEQ ID NO: 4226450 - DNA, 22 bp, Homo sapiens
aaatatattttatgatttaaaa

SEQ ID NO: 4226451 - DNA, 15 bp, Homo sapiens
aaatatgaacaaaga

SEQ ID NO: 4226452 - DNA, 15 bp, Homo sapiens
aaatattaaaatcac

SEQ ID NO: 4226453 - DNA, 23 bp, Homo sapiens
aaatcaacttgtggttgaccgct

SEQ ID NO: 4226454 - DNA, 12 bp, Homo sapiens
aaatctgaagaa

SEQ ID NO: 4226455 - DNA, 13 bp, Homo sapiens
aaatgacccaaac

SEQ ID NO: 4226456 - DNA, 20 bp, Homo sapiens
aaatgaggaggtacattgaa

SEQ ID NO: 4226457 - DNA, 14 bp, Homo sapiens
aaatgcaagatttt

SEQ ID NO: 4226458 - DNA, 15 bp, Homo sapiens
aaatgtcaacctttg

SEQ ID NO: 4226459 - DNA, 18 bp, Homo sapiens
aaattaactgctccaaat

SEQ ID NO: 4226460 - DNA, 12 bp, Homo sapiens
aaattaatttgt

SEQ ID NO: 4226461 - DNA, 13 bp, Homo sapiens
aaattaatttgtg

SEQ ID NO: 4226462 - DNA, 20 bp, Homo sapiens
aaattaatttgtgaatttgc

SEQ ID NO: 4226463 - DNA, 13 bp, Homo sapiens
aaattactccaag

SEQ ID NO: 4226464 - DNA, 18 bp, Homo sapiens
aaattactccaaggttta

SEQ ID NO: 4226465 - DNA, 23 bp, Homo sapiens
aaattgagatgcccccccaggcc

SEQ ID NO: 4226466 - DNA, 17 bp, Homo sapiens
aaattgatttgttatgg

SEQ ID NO: 4226467 - DNA, 14 bp, Homo sapiens
aaattgtgaaaaaa

SEQ ID NO: 4226468 - DNA, 18 bp, Homo sapiens
aacaatgaaattgaccta

SEQ ID NO: 4226469 - DNA, 18 bp, Homo sapiens
aacagacaaaaacagcct

SEQ ID NO: 4226470 - DNA, 21 bp, Homo sapiens
aacagacaaaaacagcctcac

SEQ ID NO: 4226471 - DNA, 15 bp, Homo sapiens
aacagagaaggcagg

SEQ ID NO: 4226472 - DNA, 16 bp, Homo sapiens
aacagagaaggcagga

SEQ ID NO: 4226473 - DNA, 15 bp, Homo sapiens
aacagtgcctgctga

SEQ ID NO: 4226474 - DNA, 13 bp, Homo sapiens
aacatatcatttg

SEQ ID NO: 4226475 - DNA, 18 bp, Homo sapiens
aacatatcatttgtgaag

SEQ ID NO: 4226476 - DNA, 21 bp, Homo sapiens
aacatatcatttgtgaagaat

SEQ ID NO: 4226477 - DNA, 11 bp, Homo sapiens
aacatccagaa

SEQ ID NO: 4226478 - DNA, 18 bp, Homo sapiens
aacatcccattgccctgg

SEQ ID NO: 4226479 - DNA, 19 bp, Homo sapiens
aacatcccattgccctggt

SEQ ID NO: 4226480 - DNA, 14 bp, Homo sapiens
aacatgaccaaaaa

SEQ ID NO: 4226481 - DNA, 17 bp, Homo sapiens
aaccaaaagtgcattca

SEQ ID NO: 4226482 - DNA, 23 bp, Homo sapiens
aaccaatgagctgtatctgtaat

SEQ ID NO: 4226483 - DNA, 14 bp, Homo sapiens
aaccataaatcaat

SEQ ID NO: 4226484 - DNA, 13 bp, Homo sapiens
aacccaatagttg

SEQ ID NO: 4226485 - DNA, 12 bp, Homo sapiens
aacccaggaggt

SEQ ID NO: 4226486 - DNA, 12 bp, Homo sapiens
aaccccagttct

SEQ ID NO: 4226487 - DNA, 18 bp, Homo sapiens
aaccccagttctgctcct

SEQ ID NO: 4226488 - DNA, 19 bp, Homo sapiens
aaccccagttctgctcctc

SEQ ID NO: 4226489 - DNA, 22 bp, Homo sapiens
aaccccagttctgctcctctcc

SEQ ID NO: 4226490 - DNA, 11 bp, Homo sapiens
aacccctttcc

SEQ ID NO: 4226491 - DNA, 16 bp, Homo sapiens
aaccgaacatatcatt

SEQ ID NO: 4226492 - DNA, 17 bp, Homo sapiens
aaccgaacatatcattt

SEQ ID NO: 4226493 - DNA, 22 bp, Homo sapiens
aaccgaacatatcatttgtgaa

SEQ ID NO: 4226494 - DNA, 15 bp, Homo sapiens
aacctctctaagcca

SEQ ID NO: 4226495 - DNA, 20 bp, Homo sapiens
aacctctctaagccacagct

SEQ ID NO: 4226496 - DNA, 15 bp, Homo sapiens
aacctggctccctcc

SEQ ID NO: 4226497 - DNA, 18 bp, Homo sapiens
aacgtttctcattaaaat

SEQ ID NO: 4226498 - DNA, 19 bp, Homo sapiens
aactacctcaaaacacttt

SEQ ID NO: 4226499 - DNA, 20 bp, Homo sapiens
aactacctcaaaacactttc

SEQ ID NO: 4226500 - DNA, 23 bp, Homo sapiens
aactagactcccaagctggacta

SEQ ID NO: 4226501 - DNA, 21 bp, Homo sapiens
aactatgatttggaaaataaa

SEQ ID NO: 4226502 - DNA, 15 bp, Homo sapiens
aactatgttgataaa

SEQ ID NO: 4226503 - DNA, 23 bp, Homo sapiens
aactccaccaacccatcagaagg

SEQ ID NO: 4226504 - DNA, 19 bp, Homo sapiens
aactgtgatggggtgggca

SEQ ID NO: 4226505 - DNA, 22 bp, Homo sapiens
aactgtgatggggtgggcaggg

SEQ ID NO: 4226506 - DNA, 14 bp, Homo sapiens
aactttccccccaa

SEQ ID NO: 4226507 - DNA, 13 bp, Homo sapiens
aactttctctttg

SEQ ID NO: 4226508 - DNA, 15 bp, Homo sapiens
aactttctctttgcc

SEQ ID NO: 4226509 - DNA, 21 bp, Homo sapiens
aactttctctttgccatttct

SEQ ID NO: 4226510 - DNA, 17 bp, Homo sapiens
aagaaaaccaaaataaa

SEQ ID NO: 4226511 - DNA, 18 bp, Homo sapiens
aagaaaaccaaaataaaa

SEQ ID NO: 4226512 - DNA, 14 bp, Homo sapiens
aagaaatactcctg

SEQ ID NO: 4226513 - DNA, 15 bp, Homo sapiens
aagaaatatattatt

SEQ ID NO: 4226514 - DNA, 15 bp, Homo sapiens
aagaaatttgaaaaa

SEQ ID NO: 4226515 - DNA, 18 bp, Homo sapiens
aagaaggtatttttccaa

SEQ ID NO: 4226516 - DNA, 23 bp, Homo sapiens
aagaattattcagtgaatttgtc

SEQ ID NO: 4226517 - DNA, 13 bp, Homo sapiens
aagaattcctgaa

SEQ ID NO: 4226518 - DNA, 16 bp, Homo sapiens
aagaattgaacccagg

SEQ ID NO: 4226519 - DNA, 15 bp, Homo sapiens
aagatccaccctcaa

SEQ ID NO: 4226520 - DNA, 18 bp, Homo sapiens
aagatggcagatacagga

SEQ ID NO: 4226521 - DNA, 15 bp, Homo sapiens
aagatgggtggttga

SEQ ID NO: 4226522 - DNA, 13 bp, Homo sapiens
aagattcccagag

SEQ ID NO: 4226523 - DNA, 18 bp, Homo sapiens
aagattcccagagacagg

SEQ ID NO: 4226524 - DNA, 20 bp, Homo sapiens
aagattcccagagacaggaa

SEQ ID NO: 4226525 - DNA, 17 bp, Homo sapiens
aagatttccaagtgcca

SEQ ID NO: 4226526 - DNA, 12 bp, Homo sapiens
aagcaaaagact

SEQ ID NO: 4226527 - DNA, 17 bp, Homo sapiens
aagcacctgccgacctc

SEQ ID NO: 4226528 - DNA, 12 bp, Homo sapiens
aagcagaaaaat

SEQ ID NO: 4226529 - DNA, 14 bp, Homo sapiens
aagcagattacctc

SEQ ID NO: 4226530 - DNA, 23 bp, Homo sapiens
aagcatgtggaaatgacccaaac

SEQ ID NO: 4226531 - DNA, 13 bp, Homo sapiens
aagccctccttcc

SEQ ID NO: 4226532 - DNA, 18 bp, Homo sapiens
aagcgaggtcaacagaga

SEQ ID NO: 4226533 - DNA, 23 bp, Homo sapiens
aagctcacagttcctcgccctgg

SEQ ID NO: 4226534 - DNA, 13 bp, Homo sapiens
aagcttaaaaaga

SEQ ID NO: 4226535 - DNA, 15 bp, Homo sapiens
aagcttaaaaagagc

SEQ ID NO: 4226536 - DNA, 23 bp, Homo sapiens
aagctttgcttatggtaataaaa

SEQ ID NO: 4226537 - DNA, 17 bp, Homo sapiens
aaggatgtaaacagtgc

SEQ ID NO: 4226538 - DNA, 20 bp, Homo sapiens
aaggatgtaaacagtgcctg

SEQ ID NO: 4226539 - DNA, 19 bp, Homo sapiens
aaggcaggaatgtgtggca

SEQ ID NO: 4226540 - DNA, 20 bp, Homo sapiens
aagggtctagggagagaccc

SEQ ID NO: 4226541 - DNA, 22 bp, Homo sapiens
aagggtctagggagagaccctt

SEQ ID NO: 4226542 - DNA, 12 bp, Homo sapiens
aaggtccctgct

SEQ ID NO: 4226543 - DNA, 18 bp, Homo sapiens
aaggtgcctgtgaggcag

SEQ ID NO: 4226544 - DNA, 20 bp, Homo sapiens
aaggtgcctgtgaggcaggg

SEQ ID NO: 4226545 - DNA, 17 bp, Homo sapiens
aaggtgctatttaacat

SEQ ID NO: 4226546 - DNA, 21 bp, Homo sapiens
aaggtggggtctttgtgagag

SEQ ID NO: 4226547 - DNA, 23 bp, Homo sapiens
aagtactgctgtaaataaatgct

SEQ ID NO: 4226548 - DNA, 14 bp, Homo sapiens
aagtagtaattgca

SEQ ID NO: 4226549 - DNA, 20 bp, Homo sapiens
aagtagtttaagtctccttt

SEQ ID NO: 4226550 - DNA, 16 bp, Homo sapiens
aagtcaaaaggtgcct

SEQ ID NO: 4226551 - DNA, 16 bp, Homo sapiens
aagtcaaccaatgtag

SEQ ID NO: 4226552 - DNA, 18 bp, Homo sapiens
aagtcagtgggaacgtga

SEQ ID NO: 4226553 - DNA, 19 bp, Homo sapiens
aagtctaggagctgggagg

SEQ ID NO: 4226554 - DNA, 18 bp, Homo sapiens
aagtctatttttattcct

SEQ ID NO: 4226555 - DNA, 16 bp, Homo sapiens
aagtgcatgctctctg

SEQ ID NO: 4226556 - DNA, 11 bp, Homo sapiens
aagtgcattca

SEQ ID NO: 4226557 - DNA, 20 bp, Homo sapiens
aagtggaccaggacaggacc

SEQ ID NO: 4226558 - DNA, 12 bp, Homo sapiens
aagtggctgctg

SEQ ID NO: 4226559 - DNA, 16 bp, Homo sapiens
aagtgggccaggacag

SEQ ID NO: 4226560 - DNA, 21 bp, Homo sapiens
aagtgggccaggacaggcccg

SEQ ID NO: 4226561 - DNA, 19 bp, Homo sapiens
aagtgggggcagagggcag

SEQ ID NO: 4226562 - DNA, 14 bp, Homo sapiens
aagtttaaaaccca

SEQ ID NO: 4226563 - DNA, 20 bp, Homo sapiens
aagtttaaaacccaaacttc

SEQ ID NO: 4226564 - DNA, 15 bp, Homo sapiens
aataaaaaccataaa

SEQ ID NO: 4226565 - DNA, 23 bp, Homo sapiens
aataaaattaaagctgaaaactg

SEQ ID NO: 4226566 - DNA, 15 bp, Homo sapiens
aataaaattgcactt

SEQ ID NO: 4226567 - DNA, 19 bp, Homo sapiens
aataaagctcctctgctcc

SEQ ID NO: 4226568 - DNA, 20 bp, Homo sapiens
aataaagctcctctgctcca

SEQ ID NO: 4226569 - DNA, 12 bp, Homo sapiens
aataaatataat

SEQ ID NO: 4226570 - DNA, 15 bp, Homo sapiens
aataaattgatttgt

SEQ ID NO: 4226571 - DNA, 18 bp, Homo sapiens
aataaattgtgaaaaaaa

SEQ ID NO: 4226572 - DNA, 20 bp, Homo sapiens
aataatcattctttcccctc

SEQ ID NO: 4226573 - DNA, 13 bp, Homo sapiens
aataatcggccca

SEQ ID NO: 4226574 - DNA, 14 bp, Homo sapiens
aatacatgctgcta

SEQ ID NO: 4226575 - DNA, 14 bp, Homo sapiens
aatagttgttgatt

SEQ ID NO: 4226576 - DNA, 17 bp, Homo sapiens
aatagttttaaatatga

SEQ ID NO: 4226577 - DNA, 21 bp, Homo sapiens
aatataaactgaaaaatgtca

SEQ ID NO: 4226578 - DNA, 20 bp, Homo sapiens
aatatagtaggggttgaaga

SEQ ID NO: 4226579 - DNA, 22 bp, Homo sapiens
aatatagtaggggttgaagaaa

SEQ ID NO: 4226580 - DNA, 22 bp, Homo sapiens
aatatattattcatcttttcat

SEQ ID NO: 4226581 - DNA, 10 bp, Homo sapiens
aatatgaaca

SEQ ID NO: 4226582 - DNA, 11 bp, Homo sapiens
aatatgaacaa

SEQ ID NO: 4226583 - DNA, 13 bp, Homo sapiens
aatatgaacaaag

SEQ ID NO: 4226584 - DNA, 22 bp, Homo sapiens
aatatgaacaaagaaaaaaata

SEQ ID NO: 4226585 - DNA, 14 bp, Homo sapiens
aatatgtgaagaaa

SEQ ID NO: 4226586 - DNA, 16 bp, Homo sapiens
aatattaaaatcactg

SEQ ID NO: 4226587 - DNA, 18 bp, Homo sapiens
aatattttagatgttatt

SEQ ID NO: 4226588 - DNA, 18 bp, Homo sapiens
aatcactcattctatgaa

SEQ ID NO: 4226589 - DNA, 18 bp, Homo sapiens
aatcccagctactcagga

SEQ ID NO: 4226590 - DNA, 19 bp, Homo sapiens
aatcccctcattcaggaaa

SEQ ID NO: 4226591 - DNA, 11 bp, Homo sapiens
aatcctctggc

SEQ ID NO: 4226592 - DNA, 14 bp, Homo sapiens
aatctagtttccta

SEQ ID NO: 4226593 - DNA, 18 bp, Homo sapiens
aatctgaagaaagttatt

SEQ ID NO: 4226594 - DNA, 21 bp, Homo sapiens
aatctgaagaaagttattctt

SEQ ID NO: 4226595 - DNA, 11 bp, Homo sapiens
aatgaatttgg

SEQ ID NO: 4226596 - DNA, 19 bp, Homo sapiens
aatgaggaggtacattgaa

SEQ ID NO: 4226597 - DNA, 18 bp, Homo sapiens
aatgatttccaaagagaa

SEQ ID NO: 4226598 - DNA, 16 bp, Homo sapiens
aatgcataaaatgtta

SEQ ID NO: 4226599 - DNA, 19 bp, Homo sapiens
aatgcatccattcctcagg

SEQ ID NO: 4226600 - DNA, 23 bp, Homo sapiens
aatgcatccattcctcagggaca

SEQ ID NO: 4226601 - DNA, 20 bp, Homo sapiens
aatgcggccgcattccctga

SEQ ID NO: 4226602 - DNA, 19 bp, Homo sapiens
aatgcttatgcttgtgtat

SEQ ID NO: 4226603 - DNA, 19 bp, Homo sapiens
aatgggagacaatttcaca

SEQ ID NO: 4226604 - DNA, 15 bp, Homo sapiens
aatgtaaaccacatg

SEQ ID NO: 4226605 - DNA, 16 bp, Homo sapiens
aatgtatataaagtac

SEQ ID NO: 4226606 - DNA, 23 bp, Homo sapiens
aatgtattttggttgctgatgtt

SEQ ID NO: 4226607 - DNA, 17 bp, Homo sapiens
aatgtcacagtaatgca

SEQ ID NO: 4226608 - DNA, 16 bp, Homo sapiens
aatgtcaccaccttcc

SEQ ID NO: 4226609 - DNA, 19 bp, Homo sapiens
aatgtcaccaccttcccag

SEQ ID NO: 4226610 - DNA, 20 bp, Homo sapiens
aatgtcaccaccttcccagc

SEQ ID NO: 4226611 - DNA, 13 bp, Homo sapiens
aatgtcagagcta

SEQ ID NO: 4226612 - DNA, 23 bp, Homo sapiens
aatgtcagagctatgttccctcc

SEQ ID NO: 4226613 - DNA, 15 bp, Homo sapiens
aatgtcataacaggc

SEQ ID NO: 4226614 - DNA, 14 bp, Homo sapiens
aatgtctcttcctc

SEQ ID NO: 4226615 - DNA, 15 bp, Homo sapiens
aatgttaaagtcagt

SEQ ID NO: 4226616 - DNA, 14 bp, Homo sapiens
aattaatacagagt

SEQ ID NO: 4226617 - DNA, 13 bp, Homo sapiens
aattaatttgtga

SEQ ID NO: 4226618 - DNA, 21 bp, Homo sapiens
aattaatttgtgaatttgcaa

SEQ ID NO: 4226619 - DNA, 13 bp, Homo sapiens
aattagaaatcaa

SEQ ID NO: 4226620 - DNA, 16 bp, Homo sapiens
aattagattatttctg

SEQ ID NO: 4226621 - DNA, 16 bp, Homo sapiens
aattatgtgaaatgct

SEQ ID NO: 4226622 - DNA, 14 bp, Homo sapiens
aattcaaagctcta

SEQ ID NO: 4226623 - DNA, 18 bp, Homo sapiens
aattccacccctcctcga

SEQ ID NO: 4226624 - DNA, 17 bp, Homo sapiens
aattcctgaagccagat

SEQ ID NO: 4226625 - DNA, 19 bp, Homo sapiens
aattctgatgttactgaga

SEQ ID NO: 4226626 - DNA, 17 bp, Homo sapiens
aattgacccatgttccc

SEQ ID NO: 4226627 - DNA, 23 bp, Homo sapiens
aattgattattctgattccactt

SEQ ID NO: 4226628 - DNA, 15 bp, Homo sapiens
aattgatttgttatg

SEQ ID NO: 4226629 - DNA, 18 bp, Homo sapiens
aattgcacttttaaacct

SEQ ID NO: 4226630 - DNA, 19 bp, Homo sapiens
aattgggattttaaaaaca

SEQ ID NO: 4226631 - DNA, 23 bp, Homo sapiens
aattgggattttaaaaacatgag

SEQ ID NO: 4226632 - DNA, 20 bp, Homo sapiens
aatttcagtcaattctgatg

SEQ ID NO: 4226633 - DNA, 22 bp, Homo sapiens
aatttcagtcaattctgatgtt

SEQ ID NO: 4226634 - DNA, 21 bp, Homo sapiens
aatttgaaaaaactttctctt

SEQ ID NO: 4226635 - DNA, 16 bp, Homo sapiens
aatttgctgaaaacat

SEQ ID NO: 4226636 - DNA, 22 bp, Homo sapiens
aatttgctgaaaacattacatg

SEQ ID NO: 4226637 - DNA, 17 bp, Homo sapiens
aatttgggatactaaag

SEQ ID NO: 4226638 - DNA, 18 bp, Homo sapiens
aatttgtatgctaaatga

SEQ ID NO: 4226639 - DNA, 18 bp, Homo sapiens
aatttgtccattgtaaat

SEQ ID NO: 4226640 - DNA, 13 bp, Homo sapiens
aatttgtgaattt

SEQ ID NO: 4226641 - DNA, 14 bp, Homo sapiens
aatttgtgaatttg

SEQ ID NO: 4226642 - DNA, 16 bp, Homo sapiens
aatttgtgaatttgca

SEQ ID NO: 4226643 - DNA, 20 bp, Homo sapiens
aatttttttaaatttcagtc

SEQ ID NO: 4226644 - DNA, 15 bp, Homo sapiens
acaaaaacagcctca

SEQ ID NO: 4226645 - DNA, 21 bp, Homo sapiens
acaaaaatgtaatgatcataa

SEQ ID NO: 4226646 - DNA, 16 bp, Homo sapiens
acaaactacatgtaat

SEQ ID NO: 4226647 - DNA, 17 bp, Homo sapiens
acaaagaaaaaaatata

SEQ ID NO: 4226648 - DNA, 18 bp, Homo sapiens
acaaatgtgataatatat

SEQ ID NO: 4226649 - DNA, 12 bp, Homo sapiens
acaacagactga

SEQ ID NO: 4226650 - DNA, 13 bp, Homo sapiens
acaacagactgaa

SEQ ID NO: 4226651 - DNA, 14 bp, Homo sapiens
acaagcaacccaaa

SEQ ID NO: 4226652 - DNA, 17 bp, Homo sapiens
acaagggtctagggaga

SEQ ID NO: 4226653 - DNA, 20 bp, Homo sapiens
acaagggtctagggagagac

SEQ ID NO: 4226654 - DNA, 23 bp, Homo sapiens
acaccatgtttgagctcagaccc

SEQ ID NO: 4226655 - DNA, 16 bp, Homo sapiens
acacctgcacctcccc

SEQ ID NO: 4226656 - DNA, 24 bp, Homo sapiens
acacctgcacctccccccactgca

SEQ ID NO: 4226657 - DNA, 13 bp, Homo sapiens
acactcttacacc

SEQ ID NO: 4226658 - DNA, 18 bp, Homo sapiens
acactgcaagagccttgg

SEQ ID NO: 4226659 - DNA, 19 bp, Homo sapiens
acagacaaaaacagcctca

SEQ ID NO: 4226660 - DNA, 19 bp, Homo sapiens
acagacaagcaacccaaac

SEQ ID NO: 4226661 - DNA, 13 bp, Homo sapiens
acagacaggagaa

SEQ ID NO: 4226662 - DNA, 21 bp, Homo sapiens
acagacaggagaaatgcatcc

SEQ ID NO: 4226663 - DNA, 16 bp, Homo sapiens
acagagaaaatgaatt

SEQ ID NO: 4226664 - DNA, 22 bp, Homo sapiens
acagatctctgctttggaaatc

SEQ ID NO: 4226665 - DNA, 19 bp, Homo sapiens
acagcatcgtgatcactga

SEQ ID NO: 4226666 - DNA, 15 bp, Homo sapiens
acagctcccacccca

SEQ ID NO: 4226667 - DNA, 18 bp, Homo sapiens
acagctcccaccccaccc

SEQ ID NO: 4226668 - DNA, 22 bp, Homo sapiens
acagctcccaccccaccccctt

SEQ ID NO: 4226669 - DNA, 21 bp, Homo sapiens
acagctgcagcccatcctccc

SEQ ID NO: 4226670 - DNA, 14 bp, Homo sapiens
acagctgtccctgt

SEQ ID NO: 4226671 - DNA, 16 bp, Homo sapiens
acagcttcttcatctt

SEQ ID NO: 4226672 - DNA, 17 bp, Homo sapiens
acaggaaaatcctctgg

SEQ ID NO: 4226673 - DNA, 14 bp, Homo sapiens
acagggaaaaaaag

SEQ ID NO: 4226674 - DNA, 16 bp, Homo sapiens
acagggaaaaaaagaa

SEQ ID NO: 4226675 - DNA, 18 bp, Homo sapiens
acagggaaaaaaagaaaa

SEQ ID NO: 4226676 - DNA, 18 bp, Homo sapiens
acagtgacactactttct

SEQ ID NO: 4226677 - DNA, 13 bp, Homo sapiens
acagtggagaaat

SEQ ID NO: 4226678 - DNA, 14 bp, Homo sapiens
acagtggagaaata

SEQ ID NO: 4226679 - DNA, 19 bp, Homo sapiens
acatagtggatggacagat

SEQ ID NO: 4226680 - DNA, 20 bp, Homo sapiens
acatagtggatggacagatg

SEQ ID NO: 4226681 - DNA, 13 bp, Homo sapiens
acatatcatttgt

SEQ ID NO: 4226682 - DNA, 15 bp, Homo sapiens
acatatcatttgtga

SEQ ID NO: 4226683 - DNA, 17 bp, Homo sapiens
acatatcatttgtgaag

SEQ ID NO: 4226684 - DNA, 23 bp, Homo sapiens
acatctaatgtctcttcctctgt

SEQ ID NO: 4226685 - DNA, 12 bp, Homo sapiens
acatgagaaatg

SEQ ID NO: 4226686 - DNA, 13 bp, Homo sapiens
acatgagaaatgt

SEQ ID NO: 4226687 - DNA, 14 bp, Homo sapiens
acatgagaaatgtg

SEQ ID NO: 4226688 - DNA, 16 bp, Homo sapiens
acatggaaaacagagt

SEQ ID NO: 4226689 - DNA, 17 bp, Homo sapiens
acatggactttggaaaa

SEQ ID NO: 4226690 - DNA, 16 bp, Homo sapiens
accaaaagtgcattca

SEQ ID NO: 4226691 - DNA, 17 bp, Homo sapiens
accaaaagtgcattcaa

SEQ ID NO: 4226692 - DNA, 19 bp, Homo sapiens
accaaaataaaaattgaaa

SEQ ID NO: 4226693 - DNA, 24 bp, Homo sapiens
accaacatggagaaaccctgtctc

SEQ ID NO: 4226694 - DNA, 16 bp, Homo sapiens
accaaccgaacatgac

SEQ ID NO: 4226695 - DNA, 20 bp, Homo sapiens
accaactttccccccaaccc

SEQ ID NO: 4226696 - DNA, 18 bp, Homo sapiens
accaagctcacagttcct

SEQ ID NO: 4226697 - DNA, 21 bp, Homo sapiens
accacatgaactacgtgacct

SEQ ID NO: 4226698 - DNA, 17 bp, Homo sapiens
accacctaggccactcc

SEQ ID NO: 4226699 - DNA, 18 bp, Homo sapiens
accacctaggccactcct

SEQ ID NO: 4226700 - DNA, 21 bp, Homo sapiens
accacctaggccactcctcca

SEQ ID NO: 4226701 - DNA, 14 bp, Homo sapiens
accaccttcccagc

SEQ ID NO: 4226702 - DNA, 15 bp, Homo sapiens
accaccttcccagct

SEQ ID NO: 4226703 - DNA, 20 bp, Homo sapiens
accaccttcccagctctccc

SEQ ID NO: 4226704 - DNA, 22 bp, Homo sapiens
accaccttcccagctctccctc

SEQ ID NO: 4226705 - DNA, 16 bp, Homo sapiens
accacgatgtggccct

SEQ ID NO: 4226706 - DNA, 14 bp, Homo sapiens
accactagagctga

SEQ ID NO: 4226707 - DNA, 13 bp, Homo sapiens
accataaatcaat

SEQ ID NO: 4226708 - DNA, 22 bp, Homo sapiens
accataaatcaattcatgttta

SEQ ID NO: 4226709 - DNA, 17 bp, Homo sapiens
accatatgtctgcttct

SEQ ID NO: 4226710 - DNA, 23 bp, Homo sapiens
acccaaaagtcaaaaggtgcctg

SEQ ID NO: 4226711 - DNA, 11 bp, Homo sapiens
acccacctgct

SEQ ID NO: 4226712 - DNA, 17 bp, Homo sapiens
acccacctgctgagaga

SEQ ID NO: 4226713 - DNA, 22 bp, Homo sapiens
acccacctgctgagagacccaa

SEQ ID NO: 4226714 - DNA, 15 bp, Homo sapiens
acccagcttcaaagc

SEQ ID NO: 4226715 - DNA, 20 bp, Homo sapiens
acccaggctctggagccaga

SEQ ID NO: 4226716 - DNA, 21 bp, Homo sapiens
acccaggctctggagccagag

SEQ ID NO: 4226717 - DNA, 14 bp, Homo sapiens
acccagtccctggg

SEQ ID NO: 4226718 - DNA, 18 bp, Homo sapiens
acccatcagaaggagaag

SEQ ID NO: 4226719 - DNA, 19 bp, Homo sapiens
acccatcagaaggagaagg

SEQ ID NO: 4226720 - DNA, 23 bp, Homo sapiens
acccatttccttgtgctcctgcc

SEQ ID NO: 4226721 - DNA, 16 bp, Homo sapiens
accccagttctgctcc

SEQ ID NO: 4226722 - DNA, 17 bp, Homo sapiens
accccagttctgctcct

SEQ ID NO: 4226723 - DNA, 20 bp, Homo sapiens
accccagttctgctcctctc

SEQ ID NO: 4226724 - DNA, 13 bp, Homo sapiens
accccctccccag

SEQ ID NO: 4226725 - DNA, 14 bp, Homo sapiens
accccctccccagg

SEQ ID NO: 4226726 - DNA, 12 bp, Homo sapiens
acccggaaacag

SEQ ID NO: 4226727 - DNA, 14 bp, Homo sapiens
accctaccccacca

SEQ ID NO: 4226728 - DNA, 15 bp, Homo sapiens
accctcaaatgtcag

SEQ ID NO: 4226729 - DNA, 11 bp, Homo sapiens
accctccaaat

SEQ ID NO: 4226730 - DNA, 11 bp, Homo sapiens
accctcctgcg

SEQ ID NO: 4226731 - DNA, 11 bp, Homo sapiens
accctgtctct

SEQ ID NO: 4226732 - DNA, 14 bp, Homo sapiens
acccttctttcctc

SEQ ID NO: 4226733 - DNA, 18 bp, Homo sapiens
acccttctttcctcttcc

SEQ ID NO: 4226734 - DNA, 20 bp, Homo sapiens
acccttctttcctcttcccc

SEQ ID NO: 4226735 - DNA, 15 bp, Homo sapiens
accctttccttcctt

SEQ ID NO: 4226736 - DNA, 17 bp, Homo sapiens
accctttccttccttcc

SEQ ID NO: 4226737 - DNA, 18 bp, Homo sapiens
accctttccttccttccc

SEQ ID NO: 4226738 - DNA, 22 bp, Homo sapiens
accctttccttccttccctggc

SEQ ID NO: 4226739 - DNA, 20 bp, Homo sapiens
accgaacatatcatttgtga

SEQ ID NO: 4226740 - DNA, 23 bp, Homo sapiens
accgaacatatcatttgtgaaga

SEQ ID NO: 4226741 - DNA, 16 bp, Homo sapiens
accgaacatgaccaaa

SEQ ID NO: 4226742 - DNA, 23 bp, Homo sapiens
accgagagtagccgagagcctgc

SEQ ID NO: 4226743 - DNA, 19 bp, Homo sapiens
accgctgcctaagtggctg

SEQ ID NO: 4226744 - DNA, 21 bp, Homo sapiens
accgctgcctaagtggctgct

SEQ ID NO: 4226745 - DNA, 19 bp, Homo sapiens
acctagctgttgtaaagaa

SEQ ID NO: 4226746 - DNA, 17 bp, Homo sapiens
acctaggccactcctcc

SEQ ID NO: 4226747 - DNA, 18 bp, Homo sapiens
acctaggccactcctcca

SEQ ID NO: 4226748 - DNA, 14 bp, Homo sapiens
acctcagccttgga

SEQ ID NO: 4226749 - DNA, 21 bp, Homo sapiens
acctcccagccctatggatgt

SEQ ID NO: 4226750 - DNA, 18 bp, Homo sapiens
acctccccccactgcagg

SEQ ID NO: 4226751 - DNA, 14 bp, Homo sapiens
acctcccctatcca

SEQ ID NO: 4226752 - DNA, 19 bp, Homo sapiens
acctcccctatccacccag

SEQ ID NO: 4226753 - DNA, 21 bp, Homo sapiens
acctcccctatccacccagcc

SEQ ID NO: 4226754 - DNA, 13 bp, Homo sapiens
acctcctgcccag

SEQ ID NO: 4226755 - DNA, 16 bp, Homo sapiens
acctcctgcccaggag

SEQ ID NO: 4226756 - DNA, 19 bp, Homo sapiens
acctcctgcccaggagagc

SEQ ID NO: 4226757 - DNA, 14 bp, Homo sapiens
acctgcacctcccc

SEQ ID NO: 4226758 - DNA, 17 bp, Homo sapiens
acctgcacctcccccca

SEQ ID NO: 4226759 - DNA, 18 bp, Homo sapiens
acctgcacctccccccac

SEQ ID NO: 4226760 - DNA, 19 bp, Homo sapiens
acctgcacctccccccact

SEQ ID NO: 4226761 - DNA, 22 bp, Homo sapiens
acctgcatccgtagttccctga

SEQ ID NO: 4226762 - DNA, 12 bp, Homo sapiens
acctgccgacct

SEQ ID NO: 4226763 - DNA, 17 bp, Homo sapiens
acctgccgacctcgtcc

SEQ ID NO: 4226764 - DNA, 20 bp, Homo sapiens
acctgccgacctcgtcctcc

SEQ ID NO: 4226765 - DNA, 21 bp, Homo sapiens
acctggccccatgtctctcag

SEQ ID NO: 4226766 - DNA, 23 bp, Homo sapiens
acctggccccatgtctctcagaa

SEQ ID NO: 4226767 - DNA, 22 bp, Homo sapiens
acctggcctgccaccctcctgc

SEQ ID NO: 4226768 - DNA, 18 bp, Homo sapiens
acctggctccctcccacc

SEQ ID NO: 4226769 - DNA, 19 bp, Homo sapiens
acctgttatggaaaatgtc

SEQ ID NO: 4226770 - DNA, 17 bp, Homo sapiens
accttgaacctgtcacc

SEQ ID NO: 4226771 - DNA, 16 bp, Homo sapiens
acgaacccacctgctg

SEQ ID NO: 4226772 - DNA, 17 bp, Homo sapiens
acgatgtggccctggcc

SEQ ID NO: 4226773 - DNA, 16 bp, Homo sapiens
acgcctgtaatcccag

SEQ ID NO: 4226774 - DNA, 20 bp, Homo sapiens
acggatccatgtagcaggac

SEQ ID NO: 4226775 - DNA, 21 bp, Homo sapiens
acggatccatgtagcaggact

SEQ ID NO: 4226776 - DNA, 16 bp, Homo sapiens
acgggcagtagctgtg

SEQ ID NO: 4226777 - DNA, 12 bp, Homo sapiens
acggggagaaaa

SEQ ID NO: 4226778 - DNA, 21 bp, Homo sapiens
acgtgccaggcccggggctgg

SEQ ID NO: 4226779 - DNA, 19 bp, Homo sapiens
acgttaaaagcaaaaagat

SEQ ID NO: 4226780 - DNA, 15 bp, Homo sapiens
acgttaccaggcagg

SEQ ID NO: 4226781 - DNA, 20 bp, Homo sapiens
acgttccttactgcagaata

SEQ ID NO: 4226782 - DNA, 17 bp, Homo sapiens
acgtttctcattaaaat

SEQ ID NO: 4226783 - DNA, 13 bp, Homo sapiens
actaccctccaga

SEQ ID NO: 4226784 - DNA, 19 bp, Homo sapiens
actagactcccaagctgga

SEQ ID NO: 4226785 - DNA, 18 bp, Homo sapiens
actagttttactttgaac

SEQ ID NO: 4226786 - DNA, 22 bp, Homo sapiens
actatcatgtcaaacgtgaaaa

SEQ ID NO: 4226787 - DNA, 15 bp, Homo sapiens
actatgatttggaaa

SEQ ID NO: 4226788 - DNA, 18 bp, Homo sapiens
actcaatctaaattaaaa

SEQ ID NO: 4226789 - DNA, 22 bp, Homo sapiens
actcaatctaaattaaaaaaga

SEQ ID NO: 4226790 - DNA, 12 bp, Homo sapiens
actcacccaagc

SEQ ID NO: 4226791 - DNA, 11 bp, Homo sapiens
actcacctctg

SEQ ID NO: 4226792 - DNA, 17 bp, Homo sapiens
actcacctctgcctcaa

SEQ ID NO: 4226793 - DNA, 13 bp, Homo sapiens
actcagcagccct

SEQ ID NO: 4226794 - DNA, 15 bp, Homo sapiens
actcagcagccctcc

SEQ ID NO: 4226795 - DNA, 18 bp, Homo sapiens
actcagcagccctcctca

SEQ ID NO: 4226796 - DNA, 13 bp, Homo sapiens
actcagccctggg

SEQ ID NO: 4226797 - DNA, 15 bp, Homo sapiens
actcagccctgggcc

SEQ ID NO: 4226798 - DNA, 20 bp, Homo sapiens
actccaccaacccatcagaa

SEQ ID NO: 4226799 - DNA, 17 bp, Homo sapiens
actccaggatttataaa

SEQ ID NO: 4226800 - DNA, 19 bp, Homo sapiens
actccaggatttataaagc

SEQ ID NO: 4226801 - DNA, 13 bp, Homo sapiens
agcagccctcctc

SEQ ID NO: 4226802 - DNA, 18 bp, Homo sapiens
agcagccctcctcacccc

SEQ ID NO: 4226803 - DNA, 23 bp, Homo sapiens
agcaggactgaattgtccccagt

SEQ ID NO: 4226804 - DNA, 13 bp, Homo sapiens
agcagtaaaagat

SEQ ID NO: 4226805 - DNA, 19 bp, Homo sapiens
agcagtaaaagataaattt

SEQ ID NO: 4226806 - DNA, 23 bp, Homo sapiens
agcagtaaaagataaatttgttg

SEQ ID NO: 4226807 - DNA, 13 bp, Homo sapiens
agcagtttttccc

SEQ ID NO: 4226808 - DNA, 16 bp, Homo sapiens
agcagtttttccccct

SEQ ID NO: 4226809 - DNA, 20 bp, Homo sapiens
agcatttgttctttgccagt

SEQ ID NO: 4226810 - DNA, 17 bp, Homo sapiens
agccaaaaaatgggaga

SEQ ID NO: 4226811 - DNA, 20 bp, Homo sapiens
agccacgttccttactgcag

SEQ ID NO: 4226812 - DNA, 21 bp, Homo sapiens
agtcatgatctccctgccgcc

SEQ ID NO: 4226813 - DNA, 19 bp, Homo sapiens
agtcatgcgtttaatcaca

SEQ ID NO: 4226814 - DNA, 13 bp, Homo sapiens
agtccattaactg

SEQ ID NO: 4226815 - DNA, 20 bp, Homo sapiens
agtctaggagctgggaggaa

SEQ ID NO: 4226816 - DNA, 22 bp, Homo sapiens
agtctaggagctgggaggaaaa

SEQ ID NO: 4226817 - DNA, 20 bp, Homo sapiens
agtctatttttattccttga

SEQ ID NO: 4226818 - DNA, 21 bp, Homo sapiens
agtctcattttcatcttcttc

SEQ ID NO: 4226819 - DNA, 12 bp, Homo sapiens
agtgaatttgtc

SEQ ID NO: 4226820 - DNA, 15 bp, Homo sapiens
agtgagcaggacggg

SEQ ID NO: 4226821 - DNA, 19 bp, Homo sapiens
agtgagccgcatcttctcc

SEQ ID NO: 4226822 - DNA, 22 bp, Homo sapiens
agtgagccgcatcttctccatc

SEQ ID NO: 4226823 - DNA, 17 bp, Homo sapiens
agtgatacaacttcaag

SEQ ID NO: 4226824 - DNA, 18 bp, Homo sapiens
agtgatatctagaaaggg

SEQ ID NO: 4226825 - DNA, 18 bp, Homo sapiens
agtgatttagttgtggaa

SEQ ID NO: 4226826 - DNA, 17 bp, Homo sapiens
agtgcatgctctctgca

SEQ ID NO: 4226827 - DNA, 11 bp, Homo sapiens
agtgcattcaa

SEQ ID NO: 4226828 - DNA, 20 bp, Homo sapiens
agtgcccaccaacatcccat

SEQ ID NO: 4226829 - DNA, 16 bp, Homo sapiens
agtgccttacctcctg

SEQ ID NO: 4226830 - DNA, 23 bp, Homo sapiens
agtgccttacctcctgcccagga

SEQ ID NO: 4226831 - DNA, 19 bp, Homo sapiens
agtggaccaggacaggacc

SEQ ID NO: 4226832 - DNA, 14 bp, Homo sapiens
agtggagaaatatt

SEQ ID NO: 4226833 - DNA, 14 bp, Homo sapiens
agtggatggacaga

SEQ ID NO: 4226834 - DNA, 16 bp, Homo sapiens
agtggatggacagatg

SEQ ID NO: 4226835 - DNA, 21 bp, Homo sapiens
agtggatggacagatggacca

SEQ ID NO: 4226836 - DNA, 22 bp, Homo sapiens
agtggatggacagatggaccaa

SEQ ID NO: 4226837 - DNA, 13 bp, Homo sapiens
agtgggagaaaac

SEQ ID NO: 4226838 - DNA, 20 bp, Homo sapiens
agtgggccaggacaggcccg

SEQ ID NO: 4226839 - DNA, 21 bp, Homo sapiens
agtgggccaggacaggcccgg

SEQ ID NO: 4226840 - DNA, 15 bp, Homo sapiens
agtggggacagagca

SEQ ID NO: 4226841 - DNA, 22 bp, Homo sapiens
agtggggtctccctctcctgcc

SEQ ID NO: 4226842 - DNA, 23 bp, Homo sapiens
agtggggtctccctctcctgcct

SEQ ID NO: 4226843 - DNA, 14 bp, Homo sapiens
agtgtgcagactga

SEQ ID NO: 4226844 - DNA, 13 bp, Homo sapiens
agttactcagccc

SEQ ID NO: 4226845 - DNA, 15 bp, Homo sapiens
agttactcagccctg

SEQ ID NO: 4226846 - DNA, 17 bp, Homo sapiens
agttactcagccctggg

SEQ ID NO: 4226847 - DNA, 23 bp, Homo sapiens
agttactcagccctgggccccac

SEQ ID NO: 4226848 - DNA, 19 bp, Homo sapiens
agttccctgaaaacccaga

SEQ ID NO: 4226849 - DNA, 21 bp, Homo sapiens
agttccctgaaaacccagaga

SEQ ID NO: 4226850 - DNA, 14 bp, Homo sapiens
agttcctcgccctg

SEQ ID NO: 4226851 - DNA, 16 bp, Homo sapiens
agttcctcgccctggg

SEQ ID NO: 4226852 - DNA, 12 bp, Homo sapiens
agttctgctcct

SEQ ID NO: 4226853 - DNA, 16 bp, Homo sapiens
agttctgctcctctcc

SEQ ID NO: 4226854 - DNA, 18 bp, Homo sapiens
agttctgctcctctccag

SEQ ID NO: 4226855 - DNA, 12 bp, Homo sapiens
agttctgctcta

SEQ ID NO: 4226856 - DNA, 13 bp, Homo sapiens
agttggcttctaa

SEQ ID NO: 4226857 - DNA, 20 bp, Homo sapiens
agttgtggaaagataataaa

SEQ ID NO: 4226858 - DNA, 22 bp, Homo sapiens
agtttaagtctcctttactgaa

SEQ ID NO: 4226859 - DNA, 21 bp, Homo sapiens
agtttcattaactccttcccc

SEQ ID NO: 4226860 - DNA, 20 bp, Homo sapiens
agtttgcagaaaagcacctg

SEQ ID NO: 4226861 - DNA, 21 bp, Homo sapiens
agtttgcagaaaagcacctgc

SEQ ID NO: 4226862 - DNA, 22 bp, Homo sapiens
agtttgcagaaaagcacctgcc

SEQ ID NO: 4226863 - DNA, 14 bp, Homo sapiens
agttttaaatatga

SEQ ID NO: 4226864 - DNA, 18 bp, Homo sapiens
agttttaaatatgaacaa

SEQ ID NO: 4226865 - DNA, 20 bp, Homo sapiens
agtttttatctttgaccaac

SEQ ID NO: 4226866 - DNA, 12 bp, Homo sapiens
agtttttccccc

SEQ ID NO: 4226867 - DNA, 19 bp, Homo sapiens
ataaagcagattacctctt

SEQ ID NO: 4226868 - DNA, 15 bp, Homo sapiens
ataaagctcctctgc

SEQ ID NO: 4226869 - DNA, 21 bp, Homo sapiens
ataaataatcggcccacagct

SEQ ID NO: 4226870 - DNA, 14 bp, Homo sapiens
ataaatataattgg

SEQ ID NO: 4226871 - DNA, 17 bp, Homo sapiens
ataaatcaattcatgtt

SEQ ID NO: 4226872 - DNA, 13 bp, Homo sapiens
ataaattaataca

SEQ ID NO: 4226873 - DNA, 17 bp, Homo sapiens
ataaattgtgaaaaaaa

SEQ ID NO: 4226874 - DNA, 14 bp, Homo sapiens
ataaatttgttgaa

SEQ ID NO: 4226875 - DNA, 19 bp, Homo sapiens
ataaatttgttgaatattg

SEQ ID NO: 4226876 - DNA, 15 bp, Homo sapiens
ataactatgttgata

SEQ ID NO: 4226877 - DNA, 20 bp, Homo sapiens
ataacttgatgcatgtggtt

SEQ ID NO: 4226878 - DNA, 16 bp, Homo sapiens
ataagatttttgaaaa

SEQ ID NO: 4226879 - DNA, 23 bp, Homo sapiens
ataagatttttgaaaatcctgaa

SEQ ID NO: 4226880 - DNA, 21 bp, Homo sapiens
ataatcattctttcccctcag

SEQ ID NO: 4226881 - DNA, 18 bp, Homo sapiens
ataatgctgttgcctcat

SEQ ID NO: 4226882 - DNA, 16 bp, Homo sapiens
ataatgtatataaagt

SEQ ID NO: 4226883 - DNA, 13 bp, Homo sapiens
ataatttgagatg

SEQ ID NO: 4226884 - DNA, 21 bp, Homo sapiens
atacagagtacgttaaaagca

SEQ ID NO: 4226885 - DNA, 22 bp, Homo sapiens
atacagggtgctccttgtcaat

SEQ ID NO: 4226886 - DNA, 12 bp, Homo sapiens
atacctttgaaa

SEQ ID NO: 4226887 - DNA, 18 bp, Homo sapiens
atactgagccatttatac

SEQ ID NO: 4226888 - DNA, 14 bp, Homo sapiens
atagacacatcaaa

SEQ ID NO: 4226889 - DNA, 15 bp, Homo sapiens
atagacacatcaaat

SEQ ID NO: 4226890 - DNA, 16 bp, Homo sapiens
atagacatttgtaaat

SEQ ID NO: 4226891 - DNA, 13 bp, Homo sapiens
atagtaaaaataa

SEQ ID NO: 4226892 - DNA, 14 bp, Homo sapiens
atagtaaaaataaa

SEQ ID NO: 4226893 - DNA, 22 bp, Homo sapiens
atagtaggggttgaagaaaaca

SEQ ID NO: 4226894 - DNA, 13 bp, Homo sapiens
atagtggatggac

SEQ ID NO: 4226895 - DNA, 15 bp, Homo sapiens
atagtggatggacag

SEQ ID NO: 4226896 - DNA, 16 bp, Homo sapiens
atagtggatggacaga

SEQ ID NO: 4226897 - DNA, 23 bp, Homo sapiens
atagtggatggacagatggacca

SEQ ID NO: 4226898 - DNA, 13 bp, Homo sapiens
atagttttaaata

SEQ ID NO: 4226899 - DNA, 16 bp, Homo sapiens
atagttttaaatatga

SEQ ID NO: 4226900 - DNA, 21 bp, Homo sapiens
atatagtaggggttgaagaaa

SEQ ID NO: 4226901 - DNA, 14 bp, Homo sapiens
atatatttttctga

SEQ ID NO: 4226902 - DNA, 17 bp, Homo sapiens
atatcagttactcagcc

SEQ ID NO: 4226903 - DNA, 23 bp, Homo sapiens
atatcagttactcagccctgggc

SEQ ID NO: 4226904 - DNA, 14 bp, Homo sapiens
atatcatttgtgaa

SEQ ID NO: 4226905 - DNA, 15 bp, Homo sapiens
atatcatttgtgaag

SEQ ID NO: 4226906 - DNA, 16 bp, Homo sapiens
atatcatttgtgaaga

SEQ ID NO: 4226907 - DNA, 21 bp, Homo sapiens
atatgacagctgtccctgtca

SEQ ID NO: 4226908 - DNA, 22 bp, Homo sapiens
atatgtctgcttctgtccagga

SEQ ID NO: 4226909 - DNA, 11 bp, Homo sapiens
atatgtgaaga

SEQ ID NO: 4226910 - DNA, 22 bp, Homo sapiens
atatgtttcaccctgtccctct

SEQ ID NO: 4226911 - DNA, 22 bp, Homo sapiens
atattctcacgggcagtagctg

SEQ ID NO: 4226912 - DNA, 18 bp, Homo sapiens
atattggtaattaaaaga

SEQ ID NO: 4226913 - DNA, 15 bp, Homo sapiens
atatttctgatataa

SEQ ID NO: 4226914 - DNA, 17 bp, Homo sapiens
atattttatgatttaaa

SEQ ID NO: 4226915 - DNA, 14 bp, Homo sapiens
atatttttctaaag

SEQ ID NO: 4226916 - DNA, 17 bp, Homo sapiens
atatttttttcctttgc

SEQ ID NO: 4226917 - DNA, 16 bp, Homo sapiens
atcaaagaaaaacaat

SEQ ID NO: 4226918 - DNA, 20 bp, Homo sapiens
atcactgagccatcatttcc

SEQ ID NO: 4226919 - DNA, 18 bp, Homo sapiens
attggtaaagaatggaag

SEQ ID NO: 4226920 - DNA, 14 bp, Homo sapiens
attggtaattaaaa

SEQ ID NO: 4226921 - DNA, 16 bp, Homo sapiens
attggtaattaaaaga

SEQ ID NO: 4226922 - DNA, 23 bp, Homo sapiens
attggtaattaaaagactccaca

SEQ ID NO: 4226923 - DNA, 20 bp, Homo sapiens
attgtaaatctgaagaaagt

SEQ ID NO: 4226924 - DNA, 19 bp, Homo sapiens
attgtcagagttctgctct

SEQ ID NO: 4226925 - DNA, 22 bp, Homo sapiens
atttaatttgtatgctaaatga

SEQ ID NO: 4226926 - DNA, 18 bp, Homo sapiens
atttagagtcaatttgct

SEQ ID NO: 4226927 - DNA, 19 bp, Homo sapiens
atttagagtcaatttgctg

SEQ ID NO: 4226928 - DNA, 21 bp, Homo sapiens
atttagtcacaccatcttaaa

SEQ ID NO: 4226929 - DNA, 15 bp, Homo sapiens
atttagtgcctattt

SEQ ID NO: 4226930 - DNA, 14 bp, Homo sapiens
atttataaagcaaa

SEQ ID NO: 4226931 - DNA, 20 bp, Homo sapiens
atttcagatacttgaagaat

SEQ ID NO: 4226932 - DNA, 18 bp, Homo sapiens
atttcagtcaattctgat

SEQ ID NO: 4226933 - DNA, 13 bp, Homo sapiens
atttcccttcttg

SEQ ID NO: 4226934 - DNA, 20 bp, Homo sapiens
atttcctgggagaaagacca

SEQ ID NO: 4226935 - DNA, 14 bp, Homo sapiens
atttgaaaaaactt

SEQ ID NO: 4226936 - DNA, 18 bp, Homo sapiens
atttgaaaaaactttctc

SEQ ID NO: 4226937 - DNA, 21 bp, Homo sapiens
atttgaaaaaactttctcttt

SEQ ID NO: 4226938 - DNA, 15 bp, Homo sapiens
atttgagaagaaata

SEQ ID NO: 4226939 - DNA, 13 bp, Homo sapiens
atttggaaaataa

SEQ ID NO: 4226940 - DNA, 17 bp, Homo sapiens
atttgtccattgtaaat

SEQ ID NO: 4226941 - DNA, 14 bp, Homo sapiens
atttgtgaagaatt

SEQ ID NO: 4226942 - DNA, 17 bp, Homo sapiens
attttaaaaacatgaga

SEQ ID NO: 4226943 - DNA, 18 bp, Homo sapiens
attttaaaaacatgagaa

SEQ ID NO: 4226944 - DNA, 22 bp, Homo sapiens
cacctgctgagagacccaagga

SEQ ID NO: 4226945 - DNA, 15 bp, Homo sapiens
cacctggccccatgt

SEQ ID NO: 4226946 - DNA, 22 bp, Homo sapiens
cacctggccccatgtctctcag

SEQ ID NO: 4226947 - DNA, 21 bp, Homo sapiens
caccttcccagctctccctct

SEQ ID NO: 4226948 - DNA, 17 bp, Homo sapiens
cacgagacccatttcct

SEQ ID NO: 4226949 - DNA, 20 bp, Homo sapiens
cacgataaataatcggccca

SEQ ID NO: 4226950 - DNA, 17 bp, Homo sapiens
cacgatgtggccctggc

SEQ ID NO: 4226951 - DNA, 22 bp, Homo sapiens
cacgatgtggccctggcctgct

SEQ ID NO: 4226952 - DNA, 18 bp, Homo sapiens
cacgcctgtaatcccagc

SEQ ID NO: 4226953 - DNA, 14 bp, Homo sapiens
cacgtgccaggccc

SEQ ID NO: 4226954 - DNA, 19 bp, Homo sapiens
cacgttccttactgcagaa

SEQ ID NO: 4226955 - DNA, 23 bp, Homo sapiens
cactagagctgagagtctgaaag

SEQ ID NO: 4226956 - DNA, 16 bp, Homo sapiens
cactcagggctggggc

SEQ ID NO: 4226957 - DNA, 14 bp, Homo sapiens
cactccaccaccca

SEQ ID NO: 4226958 - DNA, 18 bp, Homo sapiens
cactccaccacccaaaag

SEQ ID NO: 4226959 - DNA, 19 bp, Homo sapiens
cactccaccacccaaaagt

SEQ ID NO: 4226960 - DNA, 15 bp, Homo sapiens
cactgagccatcatt

SEQ ID NO: 4226961 - DNA, 21 bp, Homo sapiens
cactgagccatcatttcctgg

SEQ ID NO: 4226962 - DNA, 16 bp, Homo sapiens
cactgatttggagata

SEQ ID NO: 4226963 - DNA, 14 bp, Homo sapiens
cactgcaacttgtg

SEQ ID NO: 4226964 - DNA, 17 bp, Homo sapiens
cactgcaacttgtgaac

SEQ ID NO: 4226965 - DNA, 13 bp, Homo sapiens
cactgcaagagcc

SEQ ID NO: 4226966 - DNA, 18 bp, Homo sapiens
cactgcaagagccttggt

SEQ ID NO: 4226967 - DNA, 16 bp, Homo sapiens
cactggagcaccaggc

SEQ ID NO: 4226968 - DNA, 17 bp, Homo sapiens
cactggagcaccaggca

SEQ ID NO: 4226969 - DNA, 13 bp, Homo sapiens
cactgggcttcta

SEQ ID NO: 4226970 - DNA, 16 bp, Homo sapiens
cactttattctcctcc

SEQ ID NO: 4226971 - DNA, 16 bp, Homo sapiens
cagaaaagcacctgcc

SEQ ID NO: 4226972 - DNA, 17 bp, Homo sapiens
cagaaaagcacctgccg

SEQ ID NO: 4226973 - DNA, 19 bp, Homo sapiens
cagaaaagcacctgccgac

SEQ ID NO: 4226974 - DNA, 24 bp, Homo sapiens
cagaaagaagtggggacagagcag

SEQ ID NO: 4226975 - DNA, 17 bp, Homo sapiens
cagaagaattgaaccca

SEQ ID NO: 4226976 - DNA, 14 bp, Homo sapiens
cagaaggagaagga

SEQ ID NO: 4226977 - DNA, 18 bp, Homo sapiens
cagacaaaaacagcctca

SEQ ID NO: 4226978 - DNA, 20 bp, Homo sapiens
cagacaagcaacccaaactg

SEQ ID NO: 4226979 - DNA, 13 bp, Homo sapiens
cagacaggagaaa

SEQ ID NO: 4226980 - DNA, 12 bp, Homo sapiens
cagaccccagcg

SEQ ID NO: 4226981 - DNA, 16 bp, Homo sapiens
cagaccccagcggctg

SEQ ID NO: 4226982 - DNA, 13 bp, Homo sapiens
cagacccccactc

SEQ ID NO: 4226983 - DNA, 16 bp, Homo sapiens
cagacccccactctca

SEQ ID NO: 4226984 - DNA, 18 bp, Homo sapiens
cagaccctaccccaccac

SEQ ID NO: 4226985 - DNA, 20 bp, Homo sapiens
cagaccggggttcaagccat

SEQ ID NO: 4226986 - DNA, 20 bp, Homo sapiens
cagactttttttaaatagta

SEQ ID NO: 4226987 - DNA, 13 bp, Homo sapiens
cagagaaggcagg

SEQ ID NO: 4226988 - DNA, 14 bp, Homo sapiens
cagagacacctgca

SEQ ID NO: 4226989 - DNA, 15 bp, Homo sapiens
cagagacacctgcac

SEQ ID NO: 4226990 - DNA, 18 bp, Homo sapiens
cagagacacctgcacctc

SEQ ID NO: 4226991 - DNA, 22 bp, Homo sapiens
cagagacacctgcacctccccc

SEQ ID NO: 4226992 - DNA, 12 bp, Homo sapiens
cagagagagtgt

SEQ ID NO: 4226993 - DNA, 18 bp, Homo sapiens
cagagatgcctccaccgc

SEQ ID NO: 4226994 - DNA, 21 bp, Homo sapiens
cagagatgcctccaccgctgc

SEQ ID NO: 4226995 - DNA, 14 bp, Homo sapiens
cagagcattgtgca

SEQ ID NO: 4226996 - DNA, 15 bp, Homo sapiens
cagagctcttatgtg

SEQ ID NO: 4226997 - DNA, 13 bp, Homo sapiens
cagaggctggagg

SEQ ID NO: 4226998 - DNA, 20 bp, Homo sapiens
cagaggctggaggcagggcc

SEQ ID NO: 4226999 - DNA, 16 bp, Homo sapiens
cagaggcttcttcaga

SEQ ID NO: 4227000 - DNA, 13 bp, Homo sapiens
cagagtatttctg

SEQ ID NO: 4227001 - DNA, 17 bp, Homo sapiens
cagagtgtgcagactga

SEQ ID NO: 4227002 - DNA, 15 bp, Homo sapiens
cagagttctgctcta

SEQ ID NO: 4227003 - DNA, 11 bp, Homo sapiens
cagatggacca

SEQ ID NO: 4227004 - DNA, 15 bp, Homo sapiens
cagcacccccaggcc

SEQ ID NO: 4227005 - DNA, 15 bp, Homo sapiens
cagcagccctcctca

SEQ ID NO: 4227006 - DNA, 17 bp, Homo sapiens
cagcagccctcctcacc

SEQ ID NO: 4227007 - DNA, 19 bp, Homo sapiens
cagcatttgttctttgcca

SEQ ID NO: 4227008 - DNA, 13 bp, Homo sapiens
cagccagcccagc

SEQ ID NO: 4227009 - DNA, 19 bp, Homo sapiens
cagccagcccagcccagct

SEQ ID NO: 4227010 - DNA, 20 bp, Homo sapiens
cagccagcccagcccagctg

SEQ ID NO: 4227011 - DNA, 18 bp, Homo sapiens
cagccatgaggagttgct

SEQ ID NO: 4227012 - DNA, 22 bp, Homo sapiens
cagccatgaggagttgctgttt

SEQ ID NO: 4227013 - DNA, 15 bp, Homo sapiens
cagcccagcccagct

SEQ ID NO: 4227014 - DNA, 17 bp, Homo sapiens
cagcccagcccagctgg

SEQ ID NO: 4227015 - DNA, 13 bp, Homo sapiens
cagcccctcctct

SEQ ID NO: 4227016 - DNA, 15 bp, Homo sapiens
cagcccctcctctgc

SEQ ID NO: 4227017 - DNA, 16 bp, Homo sapiens
cagcccctcctctgcc

SEQ ID NO: 4227018 - DNA, 19 bp, Homo sapiens
cagcccctcctctgccacc

SEQ ID NO: 4227019 - DNA, 21 bp, Homo sapiens
cagcccctcctctgccacctc

SEQ ID NO: 4227020 - DNA, 22 bp, Homo sapiens
cagcccctcctctgccacctcc

SEQ ID NO: 4227021 - DNA, 14 bp, Homo sapiens
cagccctatggatg

SEQ ID NO: 4227022 - DNA, 13 bp, Homo sapiens
cagccctccctgt

SEQ ID NO: 4227023 - DNA, 15 bp, Homo sapiens
cagccctccctgtcc

SEQ ID NO: 4227024 - DNA, 12 bp, Homo sapiens
cagccctcctca

SEQ ID NO: 4227025 - DNA, 13 bp, Homo sapiens
cagccctcctcac

SEQ ID NO: 4227026 - DNA, 16 bp, Homo sapiens
cagccctcctcacccc

SEQ ID NO: 4227027 - DNA, 12 bp, Homo sapiens
cagcctgtggcg

SEQ ID NO: 4227028 - DNA, 21 bp, Homo sapiens
cagccttggataatgctgttg

SEQ ID NO: 4227029 - DNA, 18 bp, Homo sapiens
cagctactcaggaggctg

SEQ ID NO: 4227030 - DNA, 13 bp, Homo sapiens
cagctcagagatg

SEQ ID NO: 4227031 - DNA, 15 bp, Homo sapiens
cagctcccaccccac

SEQ ID NO: 4227032 - DNA, 22 bp, Homo sapiens
cagctcccaccccacccccttc

SEQ ID NO: 4227033 - DNA, 12 bp, Homo sapiens
cagctctccctc

SEQ ID NO: 4227034 - DNA, 22 bp, Homo sapiens
ccaaaagtcaaaaggtgcctgt

SEQ ID NO: 4227035 - DNA, 18 bp, Homo sapiens
ccaaaggaagtctaggag

SEQ ID NO: 4227036 - DNA, 15 bp, Homo sapiens
ccaacatggagaaac

SEQ ID NO: 4227037 - DNA, 23 bp, Homo sapiens
ccaacatggagaaaccctgtctc

SEQ ID NO: 4227038 - DNA, 18 bp, Homo sapiens
ccaaccaactttcccccc

SEQ ID NO: 4227039 - DNA, 21 bp, Homo sapiens
ccaaccgaacatgaccaaaaa

SEQ ID NO: 4227040 - DNA, 18 bp, Homo sapiens
ccaacctaacccctttcc

SEQ ID NO: 4227041 - DNA, 12 bp, Homo sapiens
ccaacctgacca

SEQ ID NO: 4227042 - DNA, 22 bp, Homo sapiens
ccaacctgaccaacatggagaa

SEQ ID NO: 4227043 - DNA, 21 bp, Homo sapiens
ccaacctggctccctcccacc

SEQ ID NO: 4227044 - DNA, 18 bp, Homo sapiens
ccaagaggaaaaacaggg

SEQ ID NO: 4227045 - DNA, 19 bp, Homo sapiens
ccaagaggctccctcctgt

SEQ ID NO: 4227046 - DNA, 17 bp, Homo sapiens
ccaagctcacagttcct

SEQ ID NO: 4227047 - DNA, 18 bp, Homo sapiens
ccaagctcacagttcctc

SEQ ID NO: 4227048 - DNA, 22 bp, Homo sapiens
ccaatagttgttgattggcagg

SEQ ID NO: 4227049 - DNA, 11 bp, Homo sapiens
ccaattaaaag

SEQ ID NO: 4227050 - DNA, 15 bp, Homo sapiens
ccacaagattcccag

SEQ ID NO: 4227051 - DNA, 16 bp, Homo sapiens
ccacaagattcccaga

SEQ ID NO: 4227052 - DNA, 20 bp, Homo sapiens
ccacaagattcccagagaca

SEQ ID NO: 4227053 - DNA, 14 bp, Homo sapiens
ccacagcctgggtg

SEQ ID NO: 4227054 - DNA, 13 bp, Homo sapiens
ccacagctcccac

SEQ ID NO: 4227055 - DNA, 17 bp, Homo sapiens
ccacagggctaagagct

SEQ ID NO: 4227056 - DNA, 11 bp, Homo sapiens
ccaccacccaa

SEQ ID NO: 4227057 - DNA, 12 bp, Homo sapiens
ccaccacctagg

SEQ ID NO: 4227058 - DNA, 21 bp, Homo sapiens
ccaccacctaggccactcctc

SEQ ID NO: 4227059 - DNA, 20 bp, Homo sapiens
ccaccacgatgtggccctgg

SEQ ID NO: 4227060 - DNA, 14 bp, Homo sapiens
ccaccactagagct

SEQ ID NO: 4227061 - DNA, 15 bp, Homo sapiens
ccacccaacagctca

SEQ ID NO: 4227062 - DNA, 11 bp, Homo sapiens
ccacccagccc

SEQ ID NO: 4227063 - DNA, 22 bp, Homo sapiens
ccacccagcccattctctctcc

SEQ ID NO: 4227064 - DNA, 17 bp, Homo sapiens
ccaccccctccccaggg

SEQ ID NO: 4227065 - DNA, 19 bp, Homo sapiens
ccaccccctccccagggga

SEQ ID NO: 4227066 - DNA, 12 bp, Homo sapiens
ccacccccttca

SEQ ID NO: 4227067 - DNA, 12 bp, Homo sapiens
ccaccctcctgc

SEQ ID NO: 4227068 - DNA, 14 bp, Homo sapiens
ccaccgctgcctaa

SEQ ID NO: 4227069 - DNA, 20 bp, Homo sapiens
ccacctaggccactcctcca

SEQ ID NO: 4227070 - DNA, 22 bp, Homo sapiens
ccacctaggccactcctccaaa

SEQ ID NO: 4227071 - DNA, 12 bp, Homo sapiens
ccacctcagcct

SEQ ID NO: 4227072 - DNA, 19 bp, Homo sapiens
ccacctcccctatccaccc

SEQ ID NO: 4227073 - DNA, 12 bp, Homo sapiens
ccaccttcccag

SEQ ID NO: 4227074 - DNA, 21 bp, Homo sapiens
ccaccttcccagctctccctc

SEQ ID NO: 4227075 - DNA, 17 bp, Homo sapiens
ccacgatgtggccctgg

SEQ ID NO: 4227076 - DNA, 21 bp, Homo sapiens
ccacgttccttactgcagaat

SEQ ID NO: 4227077 - DNA, 23 bp, Homo sapiens
ccactagagctgagagtctgaaa

SEQ ID NO: 4227078 - DNA, 19 bp, Homo sapiens
ccctgtcaccaagctcaca

SEQ ID NO: 4227079 - DNA, 13 bp, Homo sapiens
cccttctttcctc

SEQ ID NO: 4227080 - DNA, 14 bp, Homo sapiens
cccttctttcctct

SEQ ID NO: 4227081 - DNA, 14 bp, Homo sapiens
cccttgagacctca

SEQ ID NO: 4227082 - DNA, 16 bp, Homo sapiens
cccttgagacctcagc

SEQ ID NO: 4227083 - DNA, 17 bp, Homo sapiens
cccttgagacctcagcc

SEQ ID NO: 4227084 - DNA, 19 bp, Homo sapiens
cccttgagacctcagccat

SEQ ID NO: 4227085 - DNA, 12 bp, Homo sapiens
cccttgccctga

SEQ ID NO: 4227086 - DNA, 16 bp, Homo sapiens
cccttgccctgacctc

SEQ ID NO: 4227087 - DNA, 19 bp, Homo sapiens
cccttgccctgacctccca

SEQ ID NO: 4227088 - DNA, 18 bp, Homo sapiens
cccttgcccttgccctga

SEQ ID NO: 4227089 - DNA, 22 bp, Homo sapiens
ccgacctcgtcctccccctgcc

SEQ ID NO: 4227090 - DNA, 14 bp, Homo sapiens
ccgagagcctgctc

SEQ ID NO: 4227091 - DNA, 22 bp, Homo sapiens
ccgcatcttctccatctggcag

SEQ ID NO: 4227092 - DNA, 15 bp, Homo sapiens
ccgctgttcacccac

SEQ ID NO: 4227093 - DNA, 16 bp, Homo sapiens
ccgctgttcacccaca

SEQ ID NO: 4227094 - DNA, 20 bp, Homo sapiens
ccggcaaccccagttctgct

SEQ ID NO: 4227095 - DNA, 16 bp, Homo sapiens
ccggctccctcctagt

SEQ ID NO: 4227096 - DNA, 20 bp, Homo sapiens
ccggtcccttgagacctcag

SEQ ID NO: 4227097 - DNA, 16 bp, Homo sapiens
ccgtagttccctgaaa

SEQ ID NO: 4227098 - DNA, 15 bp, Homo sapiens
cctaagtggctgctg

SEQ ID NO: 4227099 - DNA, 12 bp, Homo sapiens
cctacctgctgc

SEQ ID NO: 4227100 - DNA, 17 bp, Homo sapiens
cctaggccactcctcca

SEQ ID NO: 4227101 - DNA, 18 bp, Homo sapiens
cctagtggggtctccctc

SEQ ID NO: 4227102 - DNA, 17 bp, Homo sapiens
cctataacttgatgcat

SEQ ID NO: 4227103 - DNA, 19 bp, Homo sapiens
cctataacttgatgcatgt

SEQ ID NO: 4227104 - DNA, 13 bp, Homo sapiens
cctatccacccag

SEQ ID NO: 4227105 - DNA, 16 bp, Homo sapiens
cctatccacccagccc

SEQ ID NO: 4227106 - DNA, 11 bp, Homo sapiens
cctatggatgt

SEQ ID NO: 4227107 - DNA, 17 bp, Homo sapiens
cctcaaatgtcagagct

SEQ ID NO: 4227108 - DNA, 22 bp, Homo sapiens
cctcaatgtgaatcagacccta

SEQ ID NO: 4227109 - DNA, 16 bp, Homo sapiens
cctcagccatgaggag

SEQ ID NO: 4227110 - DNA, 21 bp, Homo sapiens
cctcagccatgaggagttgct

SEQ ID NO: 4227111 - DNA, 23 bp, Homo sapiens
cctcagccttggataatgctgtt

SEQ ID NO: 4227112 - DNA, 15 bp, Homo sapiens
cctcattcaggaaaa

SEQ ID NO: 4227113 - DNA, 23 bp, Homo sapiens
cctcatttttgaatacaggcata

SEQ ID NO: 4227114 - DNA, 22 bp, Homo sapiens
cctccaagaggctccctcctgt

SEQ ID NO: 4227115 - DNA, 13 bp, Homo sapiens
cctccaccgctgc

SEQ ID NO: 4227116 - DNA, 19 bp, Homo sapiens
cctccagggccacgtgcca

SEQ ID NO: 4227117 - DNA, 21 bp, Homo sapiens
cctccagggccacgtgccagg

SEQ ID NO: 4227118 - DNA, 12 bp, Homo sapiens
cctcccagccct

SEQ ID NO: 4227119 - DNA, 18 bp, Homo sapiens
cctcccagccctatggat

SEQ ID NO: 4227120 - DNA, 13 bp, Homo sapiens
cctccccccactg

SEQ ID NO: 4227121 - DNA, 14 bp, Homo sapiens
cctccccccactgc

SEQ ID NO: 4227122 - DNA, 16 bp, Homo sapiens
cctccccccactgcag

SEQ ID NO: 4227123 - DNA, 17 bp, Homo sapiens
cctcccctatccaccca

SEQ ID NO: 4227124 - DNA, 16 bp, Homo sapiens
cctcccggctccctcc

SEQ ID NO: 4227125 - DNA, 12 bp, Homo sapiens
cctccctgtcct

SEQ ID NO: 4227126 - DNA, 16 bp, Homo sapiens
cctccctgtcctcctc

SEQ ID NO: 4227127 - DNA, 14 bp, Homo sapiens
cctcctgcccagga

SEQ ID NO: 4227128 - DNA, 22 bp, Homo sapiens
cctcctgcgcaggccatgcatg

SEQ ID NO: 4227129 - DNA, 13 bp, Homo sapiens
cctcgccctgggt

SEQ ID NO: 4227130 - DNA, 14 bp, Homo sapiens
cctcgccctgggtc

SEQ ID NO: 4227131 - DNA, 17 bp, Homo sapiens
cctcggatcaccgagag

SEQ ID NO: 4227132 - DNA, 15 bp, Homo sapiens
cctcgtcctccccct

SEQ ID NO: 4227133 - DNA, 16 bp, Homo sapiens
cctcgtcctccccctg

SEQ ID NO: 4227134 - DNA, 17 bp, Homo sapiens
cctcgtcctccccctgc

SEQ ID NO: 4227135 - DNA, 17 bp, Homo sapiens
cctctcctcagagtccc

SEQ ID NO: 4227136 - DNA, 13 bp, Homo sapiens
cctctcctgccta

SEQ ID NO: 4227137 - DNA, 14 bp, Homo sapiens
cctctcctgcctac

SEQ ID NO: 4227138 - DNA, 16 bp, Homo sapiens
cctctcctgcctactc

SEQ ID NO: 4227139 - DNA, 17 bp, Homo sapiens
cctctcctgcctactca

SEQ ID NO: 4227140 - DNA, 18 bp, Homo sapiens
cctctctaagccacagct

SEQ ID NO: 4227141 - DNA, 10 bp, Homo sapiens
cctctctggt

SEQ ID NO: 4227142 - DNA, 12 bp, Homo sapiens
cctctgccacct

SEQ ID NO: 4227143 - DNA, 13 bp, Homo sapiens
cctctgccacctc

SEQ ID NO: 4227144 - DNA, 13 bp, Homo sapiens
cctctggccctgc

SEQ ID NO: 4227145 - DNA, 22 bp, Homo sapiens
cctctggctggctaactggaag

SEQ ID NO: 4227146 - DNA, 17 bp, Homo sapiens
cctctgtcctgcttctg

SEQ ID NO: 4227147 - DNA, 15 bp, Homo sapiens
cctcttccccttgcc

SEQ ID NO: 4227148 - DNA, 18 bp, Homo sapiens
cctgaaattaatttgtga

SEQ ID NO: 4227149 - DNA, 13 bp, Homo sapiens
cgtgccaggcccg

SEQ ID NO: 4227150 - DNA, 14 bp, Homo sapiens
cgtggttccaagaa

SEQ ID NO: 4227151 - DNA, 14 bp, Homo sapiens
cgtttacctcgtgg

SEQ ID NO: 4227152 - DNA, 22 bp, Homo sapiens
ctaaaaatttttacaaaactgc

SEQ ID NO: 4227153 - DNA, 20 bp, Homo sapiens
ctaaacgagtcaatcccctc

SEQ ID NO: 4227154 - DNA, 12 bp, Homo sapiens
ctaaactccagg

SEQ ID NO: 4227155 - DNA, 18 bp, Homo sapiens
ctaaactccaggatttat

SEQ ID NO: 4227156 - DNA, 21 bp, Homo sapiens
ctaaagaaggtttcagaaaga

SEQ ID NO: 4227157 - DNA, 15 bp, Homo sapiens
ctaaattaaaaaaga

SEQ ID NO: 4227158 - DNA, 20 bp, Homo sapiens
ctaagagctagcgctgccgc

SEQ ID NO: 4227159 - DNA, 13 bp, Homo sapiens
ctaagccacagct

SEQ ID NO: 4227160 - DNA, 23 bp, Homo sapiens
ctaataaagctcctctgctccac

SEQ ID NO: 4227161 - DNA, 17 bp, Homo sapiens
ctaatatacagggtagc

SEQ ID NO: 4227162 - DNA, 23 bp, Homo sapiens
ctaatatagtaggggttgaagaa

SEQ ID NO: 4227163 - DNA, 19 bp, Homo sapiens
ctaatgaatgcataaaatg

SEQ ID NO: 4227164 - DNA, 12 bp, Homo sapiens
ctacagagaaaa

SEQ ID NO: 4227165 - DNA, 20 bp, Homo sapiens
ctacagagaaaatgaatttg

SEQ ID NO: 4227166 - DNA, 14 bp, Homo sapiens
ctaccccaccacga

SEQ ID NO: 4227167 - DNA, 15 bp, Homo sapiens
ctaccctccagagtg

SEQ ID NO: 4227168 - DNA, 20 bp, Homo sapiens
ctacctcaaaacactttccc

SEQ ID NO: 4227169 - DNA, 15 bp, Homo sapiens
ctactcagcagccct

SEQ ID NO: 4227170 - DNA, 18 bp, Homo sapiens
ctactcagcagccctcct

SEQ ID NO: 4227171 - DNA, 21 bp, Homo sapiens
ctactcagcagccctcctcac

SEQ ID NO: 4227172 - DNA, 15 bp, Homo sapiens
ctactcaggaggctg

SEQ ID NO: 4227173 - DNA, 23 bp, Homo sapiens
ctactcaggaggctgaggcagaa

SEQ ID NO: 4227174 - DNA, 19 bp, Homo sapiens
ctagaagaatttgagaaga

SEQ ID NO: 4227175 - DNA, 17 bp, Homo sapiens
ctagaagtgggccagga

SEQ ID NO: 4227176 - DNA, 17 bp, Homo sapiens
ctagagatatggcagcg

SEQ ID NO: 4227177 - DNA, 15 bp, Homo sapiens
ctagcagtaaaagat

SEQ ID NO: 4227178 - DNA, 12 bp, Homo sapiens
ctagcgctgccg

SEQ ID NO: 4227179 - DNA, 19 bp, Homo sapiens
ctagctagaagtgggccag

SEQ ID NO: 4227180 - DNA, 18 bp, Homo sapiens
ctagctgttgtaaagaat

SEQ ID NO: 4227181 - DNA, 16 bp, Homo sapiens
ctaggagctgggagga

SEQ ID NO: 4227182 - DNA, 19 bp, Homo sapiens
ctaggagctgggaggaaaa

SEQ ID NO: 4227183 - DNA, 14 bp, Homo sapiens
ctaggccactcctc

SEQ ID NO: 4227184 - DNA, 19 bp, Homo sapiens
ctaggccactcctccaaag

SEQ ID NO: 4227185 - DNA, 14 bp, Homo sapiens
ctagggagagaccc

SEQ ID NO: 4227186 - DNA, 15 bp, Homo sapiens
ctagggagagaccct

SEQ ID NO: 4227187 - DNA, 19 bp, Homo sapiens
ctagtggggtctccctctc

SEQ ID NO: 4227188 - DNA, 21 bp, Homo sapiens
ctagtggggtctccctctcct

SEQ ID NO: 4227189 - DNA, 12 bp, Homo sapiens
ctataacttgat

SEQ ID NO: 4227190 - DNA, 21 bp, Homo sapiens
ctataccatatgtctgcttct

SEQ ID NO: 4227191 - DNA, 19 bp, Homo sapiens
ctatatgtagctttatcct

SEQ ID NO: 4227192 - DNA, 15 bp, Homo sapiens
ctatccacccagccc

SEQ ID NO: 4227193 - DNA, 15 bp, Homo sapiens
ctatccctgtacaga

SEQ ID NO: 4227194 - DNA, 19 bp, Homo sapiens
ctatgatttggaaaataaa

SEQ ID NO: 4227195 - DNA, 24 bp, Homo sapiens
ctatggatgtggggtccccatcat

SEQ ID NO: 4227196 - DNA, 23 bp, Homo sapiens
ctattaagatttccaagtgccaa

SEQ ID NO: 4227197 - DNA, 13 bp, Homo sapiens
ctattatgtaaca

SEQ ID NO: 4227198 - DNA, 20 bp, Homo sapiens
ctattatgtaacatccagaa

SEQ ID NO: 4227199 - DNA, 11 bp, Homo sapiens
ctattggtaaa

SEQ ID NO: 4227200 - DNA, 22 bp, Homo sapiens
ctattgtttattctttttaaag

SEQ ID NO: 4227201 - DNA, 15 bp, Homo sapiens
ctcaagggtccagaa

SEQ ID NO: 4227202 - DNA, 18 bp, Homo sapiens
ctcaagggtccagaagtc

SEQ ID NO: 4227203 - DNA, 17 bp, Homo sapiens
ctcaatctaaattaaaa

SEQ ID NO: 4227204 - DNA, 13 bp, Homo sapiens
ctcacagttcctc

SEQ ID NO: 4227205 - DNA, 18 bp, Homo sapiens
ctcacagttcctcgccct

SEQ ID NO: 4227206 - DNA, 14 bp, Homo sapiens
ctcacctctgcctc

SEQ ID NO: 4227207 - DNA, 19 bp, Homo sapiens
ctcacctctgcctcaatgt

SEQ ID NO: 4227208 - DNA, 20 bp, Homo sapiens
ctcacgcctgtaatcccagc

SEQ ID NO: 4227209 - DNA, 21 bp, Homo sapiens
ctcacgcctgtaatcccagca

SEQ ID NO: 4227210 - DNA, 14 bp, Homo sapiens
ctcagacccccact

SEQ ID NO: 4227211 - DNA, 14 bp, Homo sapiens
ctcagactccattt

SEQ ID NO: 4227212 - DNA, 15 bp, Homo sapiens
gaagtggggacagag

SEQ ID NO: 4227213 - DNA, 14 bp, Homo sapiens
gaatatgacagctg

SEQ ID NO: 4227214 - DNA, 19 bp, Homo sapiens
gaatattggtaattaaaag

SEQ ID NO: 4227215 - DNA, 18 bp, Homo sapiens
gaatcagaccctacccca

SEQ ID NO: 4227216 - DNA, 15 bp, Homo sapiens
gaatgtatctcctcc

SEQ ID NO: 4227217 - DNA, 19 bp, Homo sapiens
gaattattcagtgaatttg

SEQ ID NO: 4227218 - DNA, 21 bp, Homo sapiens
gaattattcagtgaatttgtc

SEQ ID NO: 4227219 - DNA, 15 bp, Homo sapiens
gaattcctgaagcca

SEQ ID NO: 4227220 - DNA, 15 bp, Homo sapiens
gaattgaacccagga

SEQ ID NO: 4227221 - DNA, 23 bp, Homo sapiens
gaattggtcttaatgttgaatgt

SEQ ID NO: 4227222 - DNA, 21 bp, Homo sapiens
gaatttgggatactaaagtag

SEQ ID NO: 4227223 - DNA, 18 bp, Homo sapiens
gaatttgtccattgtaaa

SEQ ID NO: 4227224 - DNA, 19 bp, Homo sapiens
gaatttgtccattgtaaat

SEQ ID NO: 4227225 - DNA, 15 bp, Homo sapiens
gaatttgttctcttt

SEQ ID NO: 4227226 - DNA, 14 bp, Homo sapiens
gaattttcagaccc

SEQ ID NO: 4227227 - DNA, 17 bp, Homo sapiens
gacaaaaacagcctcac

SEQ ID NO: 4227228 - DNA, 20 bp, Homo sapiens
gacaatactccctttaaaga

SEQ ID NO: 4227229 - DNA, 21 bp, Homo sapiens
gacaatactccctttaaagag

SEQ ID NO: 4227230 - DNA, 14 bp, Homo sapiens
gacacaggaaacaa

SEQ ID NO: 4227231 - DNA, 16 bp, Homo sapiens
gacacatcaaatgccc

SEQ ID NO: 4227232 - DNA, 15 bp, Homo sapiens
gacacctgcacctcc

SEQ ID NO: 4227233 - DNA, 18 bp, Homo sapiens
gacagagacacctgcacc

SEQ ID NO: 4227234 - DNA, 16 bp, Homo sapiens
gacagatggaccaaaa

SEQ ID NO: 4227235 - DNA, 23 bp, Homo sapiens
gacagcctgtggcggtgcctggg

SEQ ID NO: 4227236 - DNA, 14 bp, Homo sapiens
gacagctgtccctg

SEQ ID NO: 4227237 - DNA, 11 bp, Homo sapiens
gacaggagaaa

SEQ ID NO: 4227238 - DNA, 19 bp, Homo sapiens
gacatcaaatttgccacca

SEQ ID NO: 4227239 - DNA, 18 bp, Homo sapiens
gacatgatactgatgcca

SEQ ID NO: 4227240 - DNA, 23 bp, Homo sapiens
gacatgatactgatgccatgttt

SEQ ID NO: 4227241 - DNA, 18 bp, Homo sapiens
gaccaaaagatgggtggt

SEQ ID NO: 4227242 - DNA, 16 bp, Homo sapiens
gacccagtccctgggg

SEQ ID NO: 4227243 - DNA, 18 bp, Homo sapiens
gacccccactctcattcc

SEQ ID NO: 4227244 - DNA, 19 bp, Homo sapiens
gacccccactctcattccc

SEQ ID NO: 4227245 - DNA, 11 bp, Homo sapiens
gaccctacccc

SEQ ID NO: 4227246 - DNA, 14 bp, Homo sapiens
gaccctaccccacc

SEQ ID NO: 4227247 - DNA, 20 bp, Homo sapiens
gaccctttccttccttccct

SEQ ID NO: 4227248 - DNA, 21 bp, Homo sapiens
gacctcccagccctatggatg

SEQ ID NO: 4227249 - DNA, 23 bp, Homo sapiens
gacctcccagccctatggatgtg

SEQ ID NO: 4227250 - DNA, 13 bp, Homo sapiens
gacctcgtcctcc

SEQ ID NO: 4227251 - DNA, 17 bp, Homo sapiens
gacctcgtcctccccct

SEQ ID NO: 4227252 - DNA, 12 bp, Homo sapiens
gactcacctctg

SEQ ID NO: 4227253 - DNA, 14 bp, Homo sapiens
gactcacctctgcc

SEQ ID NO: 4227254 - DNA, 17 bp, Homo sapiens
gactcacctctgcctca

SEQ ID NO: 4227255 - DNA, 18 bp, Homo sapiens
gactcacctctgcctcaa

SEQ ID NO: 4227256 - DNA, 16 bp, Homo sapiens
gactcagactccattt

SEQ ID NO: 4227257 - DNA, 18 bp, Homo sapiens
gactgaattgtccccagt

SEQ ID NO: 4227258 - DNA, 21 bp, Homo sapiens
gactgatgttgagggaacaga

SEQ ID NO: 4227259 - DNA, 16 bp, Homo sapiens
gacttcacactgcaag

SEQ ID NO: 4227260 - DNA, 22 bp, Homo sapiens
gacttcacactgcaagagcctt

SEQ ID NO: 4227261 - DNA, 22 bp, Homo sapiens
gagaaagaccatgcatttaaag

SEQ ID NO: 4227262 - DNA, 20 bp, Homo sapiens
gagaagaattttcagacccc

SEQ ID NO: 4227263 - DNA, 12 bp, Homo sapiens
gagaaggcagga

SEQ ID NO: 4227264 - DNA, 13 bp, Homo sapiens
gagacacctgcac

SEQ ID NO: 4227265 - DNA, 15 bp, Homo sapiens
gagacacctgcacct

SEQ ID NO: 4227266 - DNA, 22 bp, Homo sapiens
gagacccatttccttgtgctcc

SEQ ID NO: 4227267 - DNA, 15 bp, Homo sapiens
gagacctcagccatg

SEQ ID NO: 4227268 - DNA, 14 bp, Homo sapiens
gagagacccaagga

SEQ ID NO: 4227269 - DNA, 15 bp, Homo sapiens
gagagacccaaggag

SEQ ID NO: 4227270 - DNA, 19 bp, Homo sapiens
gagagacccaaggaggaaa

SEQ ID NO: 4227271 - DNA, 11 bp, Homo sapiens
gagagccagcc

SEQ ID NO: 4227272 - DNA, 13 bp, Homo sapiens
gagagggtctgga

SEQ ID NO: 4227273 - DNA, 18 bp, Homo sapiens
gagagggtctggagaagc

SEQ ID NO: 4227274 - DNA, 20 bp, Homo sapiens
gagagtagccgagagcctgc

SEQ ID NO: 4227275 - DNA, 21 bp, Homo sapiens
gagatcgtgccgttactctcc

SEQ ID NO: 4227276 - DNA, 23 bp, Homo sapiens
gagatgcctccaccgctgcctaa

SEQ ID NO: 4227277 - DNA, 21 bp, Homo sapiens
gagatgtcatcagagctcctc

SEQ ID NO: 4227278 - DNA, 13 bp, Homo sapiens
gagcaccaggcac

SEQ ID NO: 4227279 - DNA, 12 bp, Homo sapiens
gagccagccctc

SEQ ID NO: 4227280 - DNA, 14 bp, Homo sapiens
gagccagccctccc

SEQ ID NO: 4227281 - DNA, 20 bp, Homo sapiens
gagccatttatacctttgaa

SEQ ID NO: 4227282 - DNA, 13 bp, Homo sapiens
gagcgaaactccg

SEQ ID NO: 4227283 - DNA, 17 bp, Homo sapiens
gagcgatcgctcccctg

SEQ ID NO: 4227284 - DNA, 14 bp, Homo sapiens
gagctagcgctgcc

SEQ ID NO: 4227285 - DNA, 16 bp, Homo sapiens
gagctatgttccctcc

SEQ ID NO: 4227286 - DNA, 14 bp, Homo sapiens
gagctcagaccccc

SEQ ID NO: 4227287 - DNA, 15 bp, Homo sapiens
gagctcagaccccca

SEQ ID NO: 4227288 - DNA, 22 bp, Homo sapiens
gagctcctctgtcctgcttctg

SEQ ID NO: 4227289 - DNA, 17 bp, Homo sapiens
gagctgggaggaaaaga

SEQ ID NO: 4227290 - DNA, 22 bp, Homo sapiens
gaggaaaaacagggaaaaaaag

SEQ ID NO: 4227291 - DNA, 14 bp, Homo sapiens
gaggaaagagagca

SEQ ID NO: 4227292 - DNA, 16 bp, Homo sapiens
gaggaaagagagcagg

SEQ ID NO: 4227293 - DNA, 12 bp, Homo sapiens
gaggagaagaat

SEQ ID NO: 4227294 - DNA, 14 bp, Homo sapiens
tgggattttaaaaa

SEQ ID NO: 4227295 - DNA, 21 bp, Homo sapiens
tgggcaagcagaaaaattaaa

SEQ ID NO: 4227296 - DNA, 14 bp, Homo sapiens
tgggcagggctggg

SEQ ID NO: 4227297 - DNA, 17 bp, Homo sapiens
tgggccaggacaggccc

SEQ ID NO: 4227298 - DNA, 17 bp, Homo sapiens
tgggccccaccacctag

SEQ ID NO: 4227299 - DNA, 23 bp, Homo sapiens
tgggccccaccacctaggccact

SEQ ID NO: 4227300 - DNA, 22 bp, Homo sapiens
tgggctagggagaatgcagaga

SEQ ID NO: 4227301 - DNA, 14 bp, Homo sapiens
tgggctctccacct

SEQ ID NO: 4227302 - DNA, 17 bp, Homo sapiens
tgggctctccacctcag

SEQ ID NO: 4227303 - DNA, 18 bp, Homo sapiens
tgggctctccacctcagc

SEQ ID NO: 4227304 - DNA, 19 bp, Homo sapiens
tgggctctccacctcagcc

SEQ ID NO: 4227305 - DNA, 21 bp, Homo sapiens
tgggctctccacctcagcctt

SEQ ID NO: 4227306 - DNA, 23 bp, Homo sapiens
tgggctctccacctcagccttgg

SEQ ID NO: 4227307 - DNA, 14 bp, Homo sapiens
tggggctgctcctc

SEQ ID NO: 4227308 - DNA, 16 bp, Homo sapiens
tgggggaagccctgga

SEQ ID NO: 4227309 - DNA, 13 bp, Homo sapiens
tgggggcagaggg

SEQ ID NO: 4227310 - DNA, 16 bp, Homo sapiens
tgggggcagagggcag

SEQ ID NO: 4227311 - DNA, 17 bp, Homo sapiens
tgggggcagagggcaga

SEQ ID NO: 4227312 - DNA, 18 bp, Homo sapiens
tgggggcagagggcagag

SEQ ID NO: 4227313 - DNA, 14 bp, Homo sapiens
tgggggctggacct

SEQ ID NO: 4227314 - DNA, 15 bp, Homo sapiens
tggggtgggcagggc

SEQ ID NO: 4227315 - DNA, 21 bp, Homo sapiens
tggggttcagcccctcctctg

SEQ ID NO: 4227316 - DNA, 22 bp, Homo sapiens
tggggttcagcccctcctctgc

SEQ ID NO: 4227317 - DNA, 13 bp, Homo sapiens
tgggtggggctgc

SEQ ID NO: 4227318 - DNA, 13 bp, Homo sapiens
tggtacaaatgtg

SEQ ID NO: 4227319 - DNA, 15 bp, Homo sapiens
tggtccggtgtcctt

SEQ ID NO: 4227320 - DNA, 13 bp, Homo sapiens
tggtggctttcct

SEQ ID NO: 4227321 - DNA, 13 bp, Homo sapiens
tggtgtccacctg

SEQ ID NO: 4227322 - DNA, 17 bp, Homo sapiens
tggtgtccacctggccc

SEQ ID NO: 4227323 - DNA, 22 bp, Homo sapiens
tggttgaggtggaagccctcct

SEQ ID NO: 4227324 - DNA, 14 bp, Homo sapiens
tgtaaacagtgcct

SEQ ID NO: 4227325 - DNA, 16 bp, Homo sapiens
tgtaaaccacatgaac

SEQ ID NO: 4227326 - DNA, 16 bp, Homo sapiens
tgtaaatctgaagaaa

SEQ ID NO: 4227327 - DNA, 15 bp, Homo sapiens
tgtaacatccagaag

SEQ ID NO: 4227328 - DNA, 13 bp, Homo sapiens
tgtaatagtccat

SEQ ID NO: 4227329 - DNA, 20 bp, Homo sapiens
tgtaatcccagctactcagg

SEQ ID NO: 4227330 - DNA, 13 bp, Homo sapiens
tgtaatgatcata

SEQ ID NO: 4227331 - DNA, 15 bp, Homo sapiens
tgtagctttatcctt

SEQ ID NO: 4227332 - DNA, 13 bp, Homo sapiens
tgtataaattaat

SEQ ID NO: 4227333 - DNA, 20 bp, Homo sapiens
tgtataaattaatacagagt

SEQ ID NO: 4227334 - DNA, 13 bp, Homo sapiens
tgtatatgtataa

SEQ ID NO: 4227335 - DNA, 17 bp, Homo sapiens
tgtatatgtataaatta

SEQ ID NO: 4227336 - DNA, 13 bp, Homo sapiens
tgtatatttgcat

SEQ ID NO: 4227337 - DNA, 12 bp, Homo sapiens
tgtatctcctcc

SEQ ID NO: 4227338 - DNA, 14 bp, Homo sapiens
tgtatgctttgaat

SEQ ID NO: 4227339 - DNA, 19 bp, Homo sapiens
tgtcaacctttgtaagaaa

SEQ ID NO: 4227340 - DNA, 13 bp, Homo sapiens
tgtcaatactgag

SEQ ID NO: 4227341 - DNA, 17 bp, Homo sapiens
tgtcaatactgagccat

SEQ ID NO: 4227342 - DNA, 15 bp, Homo sapiens
tgtcacagtaatgca

SEQ ID NO: 4227343 - DNA, 18 bp, Homo sapiens
tgtcaccaccttcccagc

SEQ ID NO: 4227344 - DNA, 17 bp, Homo sapiens
tgtcaccagtcctgccc

SEQ ID NO: 4227345 - DNA, 22 bp, Homo sapiens
tgtcagagctatgttccctcca

SEQ ID NO: 4227346 - DNA, 20 bp, Homo sapiens
tgtcatcagagctcctctgt

SEQ ID NO: 4227347 - DNA, 21 bp, Homo sapiens
tgtccaacctaacccctttcc

SEQ ID NO: 4227348 - DNA, 15 bp, Homo sapiens
tgtccacctggcccc

SEQ ID NO: 4227349 - DNA, 20 bp, Homo sapiens
tgtccattgtaaatctgaag

SEQ ID NO: 4227350 - DNA, 22 bp, Homo sapiens
tgtccattgtaaatctgaagaa

SEQ ID NO: 4227351 - DNA, 21 bp, Homo sapiens
tgtccctgtcaccaagctcac

SEQ ID NO: 4227352 - DNA, 15 bp, Homo sapiens
tgtcctgcttctgaa

SEQ ID NO: 4227353 - DNA, 15 bp, Homo sapiens
tgtccttgcacctgc

SEQ ID NO: 4227354 - DNA, 17 bp, Homo sapiens
tgtcgctctgctggcct

SEQ ID NO: 4227355 - DNA, 16 bp, Homo sapiens
tgtctcttcctctgtt

SEQ ID NO: 4227356 - DNA, 17 bp, Homo sapiens
tgtgaactccatcattc

SEQ ID NO: 4227357 - DNA, 14 bp, Homo sapiens
tgtgaagaaaaaga

SEQ ID NO: 4227358 - DNA, 18 bp, Homo sapiens
tgtgaatcagaccctacc

SEQ ID NO: 4227359 - DNA, 18 bp, Homo sapiens
tgtgaggcaggggcggag

SEQ ID NO: 4227360 - DNA, 14 bp, Homo sapiens
tgtgatggggtggg

SEQ ID NO: 4227361 - DNA, 23 bp, Homo sapiens
tgtgatggggtgggcagggctgg

SEQ ID NO: 4227362 - DNA, 17 bp, Homo sapiens
tgtgcggctccagccca

SEQ ID NO: 4227363 - DNA, 12 bp, Homo sapiens
tgtgctcctgcc

SEQ ID NO: 4227364 - DNA, 12 bp, Homo sapiens
tgtggccctggc

SEQ ID NO: 4227365 - DNA, 20 bp, Homo sapiens
tgtgtccttgcacctgcatc

SEQ ID NO: 4227366 - DNA, 22 bp, Homo sapiens
tgttaagttgatggtgatgaaa

SEQ ID NO: 4227367 - DNA, 16 bp, Homo sapiens
tgttattaccaaaaca

SEQ ID NO: 4227368 - DNA, 19 bp, Homo sapiens
tgttccaggtttcttccac

SEQ ID NO: 4227369 - DNA, 12 bp, Homo sapiens
tgttctttgcca

SEQ ID NO: 4227370 - DNA, 17 bp, Homo sapiens
tgttgcaagtactgctg

SEQ ID NO: 4227371 - DNA, 16 bp, Homo sapiens
tgttgtaatagtccat

SEQ ID NO: 4227372 - DNA, 22 bp, Homo sapiens
tgtttacaaacatggaaaacag

SEQ ID NO: 4227373 - DNA, 16 bp, Homo sapiens
tgtttagattccagga

SEQ ID NO: 4227374 - DNA, 22 bp, Homo sapiens
tgtttgacaaagaaacccaagt

SEQ ID NO: 4227375 - DNA, 14 bp, Homo sapiens
tgtttgagctcaga

SEQ ID NO: 4227376 - DNA, 15 bp, Homo sapiens
tgttttcagactcag

SEQ ID NO: 4227377 - DNA, 15 bp, Homo sapiens
ttaaaaaataaatat

SEQ ID NO: 4227378 - DNA, 17 bp, Homo sapiens
ttaaaaacatgagaaat

SEQ ID NO: 4227379 - DNA, 20 bp, Homo sapiens
ttaaaaacatgagaaatgtg

SEQ ID NO: 4227380 - DNA, 12 bp, Homo sapiens
ttaaaacccaaa

SEQ ID NO: 4227381 - DNA, 18 bp, Homo sapiens
ttaaaatcactgtcaata

SEQ ID NO: 4227382 - DNA, 18 bp, Homo sapiens
ttaaacctctcttctacc

SEQ ID NO: 4227383 - DNA, 16 bp, Homo sapiens
ttaaacgagataatgt

SEQ ID NO: 4227384 - DNA, 23 bp, Homo sapiens
ttaaactacctcaaaacactttc

SEQ ID NO: 4227385 - DNA, 23 bp, Homo sapiens
ttaaagtatgttattgcataatt

SEQ ID NO: 4227386 - DNA, 14 bp, Homo sapiens
ttaaagtggactta

SEQ ID NO: 4227387 - DNA, 18 bp, Homo sapiens
ttaaatagtaaaaataaa

SEQ ID NO: 4227388 - DNA, 17 bp, Homo sapiens
ttaaatatgaacaaaga

SEQ ID NO: 4227389 - DNA, 14 bp, Homo sapiens
ttaaccataaatca

SEQ ID NO: 4227390 - DNA, 14 bp, Homo sapiens
ttaacgtttctcat

SEQ ID NO: 4227391 - DNA, 22 bp, Homo sapiens
ttaattgattattctgattcca

SEQ ID NO: 4227392 - DNA, 12 bp, Homo sapiens
ttaatttgtatg

SEQ ID NO: 4227393 - DNA, 12 bp, Homo sapiens
ttacctcctgcc

SEQ ID NO: 4227394 - DNA, 14 bp, Homo sapiens
ttacctcctgccca

SEQ ID NO: 4227395 - DNA, 23 bp, Homo sapiens
ttacctcttgcccttgggtgcta

SEQ ID NO: 4227396 - DNA, 12 bp, Homo sapiens
ttactcagccct

SEQ ID NO: 4227397 - DNA, 22 bp, Homo sapiens
ttactcagccctgggccccacc

SEQ ID NO: 4227398 - DNA, 20 bp, Homo sapiens
ttactgagatgttttaccat

SEQ ID NO: 4227399 - DNA, 21 bp, Homo sapiens
ttacttcccagtataagattt

SEQ ID NO: 4227400 - DNA, 20 bp, Homo sapiens
ttagagtcaatttgctgaaa

SEQ ID NO: 4227401 - DNA, 14 bp, Homo sapiens
ttagattatttctg

SEQ ID NO: 4227402 - DNA, 19 bp, Homo sapiens
ttagattatttctgtattt

SEQ ID NO: 4227403 - DNA, 18 bp, Homo sapiens
ttagcattcatattttcc

SEQ ID NO: 4227404 - DNA, 13 bp, Homo sapiens
ttagctgcagaac

SEQ ID NO: 4227405 - DNA, 18 bp, Homo sapiens
ttatgtaacatccagaag

SEQ ID NO: 4227406 - DNA, 16 bp, Homo sapiens
ttattaccaaaacagg

SEQ ID NO: 4227407 - DNA, 21 bp, Homo sapiens
ttattcagtgaatttgtccat

SEQ ID NO: 4227408 - DNA, 17 bp, Homo sapiens
ttattctcactccacca

SEQ ID NO: 4227409 - DNA, 13 bp, Homo sapiens
ttcaaaagcaatc

SEQ ID NO: 4227410 - DNA, 17 bp, Homo sapiens
ttcaaagcttaaaaaga

SEQ ID NO: 4227411 - DNA, 18 bp, Homo sapiens
gaggatgtctcaaacttc

SEQ ID NO: 4227412 - DNA, 15 bp, Homo sapiens
gaggcagggccttgc

SEQ ID NO: 4227413 - DNA, 17 bp, Homo sapiens
gaggcagggccttgccc

SEQ ID NO: 4227414 - DNA, 18 bp, Homo sapiens
gaggcagggccttgccca

SEQ ID NO: 4227415 - DNA, 20 bp, Homo sapiens
gaggcagggccttgcccaga

SEQ ID NO: 4227416 - DNA, 22 bp, Homo sapiens
gaggcagggccttgcccagaga

SEQ ID NO: 4227417 - DNA, 14 bp, Homo sapiens
gaggctgaggcaga

SEQ ID NO: 4227418 - DNA, 14 bp, Homo sapiens
gaggctggaggcag

SEQ ID NO: 4227419 - DNA, 18 bp, Homo sapiens
gaggctggaggcagggcc

SEQ ID NO: 4227420 - DNA, 18 bp, Homo sapiens
gagggaacagacaggaga

SEQ ID NO: 4227421 - DNA, 21 bp, Homo sapiens
gaggtaggtggatcacctgag

SEQ ID NO: 4227422 - DNA, 15 bp, Homo sapiens
gaggtcaacagagaa

SEQ ID NO: 4227423 - DNA, 22 bp, Homo sapiens
gaggtcaacagagaaggcagga

SEQ ID NO: 4227424 - DNA, 19 bp, Homo sapiens
gaggtggaggttgcagtga

SEQ ID NO: 4227425 - DNA, 12 bp, Homo sapiens
gagtatttctgg

SEQ ID NO: 4227426 - DNA, 14 bp, Homo sapiens
gagtcaccaggaat

SEQ ID NO: 4227427 - DNA, 16 bp, Homo sapiens
gagtcatgatctccct

SEQ ID NO: 4227428 - DNA, 18 bp, Homo sapiens
gagtcatgatctccctgc

SEQ ID NO: 4227429 - DNA, 16 bp, Homo sapiens
gagtcccccagagatg

SEQ ID NO: 4227430 - DNA, 22 bp, Homo sapiens
gagtctcccactgcaacttgtg

SEQ ID NO: 4227431 - DNA, 22 bp, Homo sapiens
gagtgatacaacttcaagtgca

SEQ ID NO: 4227432 - DNA, 18 bp, Homo sapiens
gagtgtgggaagggagag

SEQ ID NO: 4227433 - DNA, 23 bp, Homo sapiens
gagttattttaattatcttttct

SEQ ID NO: 4227434 - DNA, 22 bp, Homo sapiens
gagttgttttcagactcagact

SEQ ID NO: 4227435 - DNA, 19 bp, Homo sapiens
gataaatttgttgaatatt

SEQ ID NO: 4227436 - DNA, 19 bp, Homo sapiens
gataatgctgttgcctcat

SEQ ID NO: 4227437 - DNA, 22 bp, Homo sapiens
gatacagggtgctccttgtcaa

SEQ ID NO: 4227438 - DNA, 21 bp, Homo sapiens
gatatgagttgttttcagact

SEQ ID NO: 4227439 - DNA, 18 bp, Homo sapiens
gatccaccctcaaatgtc

SEQ ID NO: 4227440 - DNA, 16 bp, Homo sapiens
gatccatgtagcagga

SEQ ID NO: 4227441 - DNA, 19 bp, Homo sapiens
gatccatgtagcaggactg

SEQ ID NO: 4227442 - DNA, 18 bp, Homo sapiens
gatctccctgccgcctca

SEQ ID NO: 4227443 - DNA, 16 bp, Homo sapiens
gatgaaatgtaaatac

SEQ ID NO: 4227444 - DNA, 22 bp, Homo sapiens
gatgcatgtggtttggttcctc

SEQ ID NO: 4227445 - DNA, 16 bp, Homo sapiens
gatgcctccaccgctg

SEQ ID NO: 4227446 - DNA, 17 bp, Homo sapiens
gatggacagatggacca

SEQ ID NO: 4227447 - DNA, 19 bp, Homo sapiens
gatggacagatggaccaaa

SEQ ID NO: 4227448 - DNA, 20 bp, Homo sapiens
gatggacagatggaccaaaa

SEQ ID NO: 4227449 - DNA, 13 bp, Homo sapiens
gatgggacatcaa

SEQ ID NO: 4227450 - DNA, 14 bp, Homo sapiens
gatggggtgggcag

SEQ ID NO: 4227451 - DNA, 17 bp, Homo sapiens
gatgtatatttgcatat

SEQ ID NO: 4227452 - DNA, 20 bp, Homo sapiens
gatgtggccctggcctgctg

SEQ ID NO: 4227453 - DNA, 18 bp, Homo sapiens
gattagtaaatatgtgaa

SEQ ID NO: 4227454 - DNA, 22 bp, Homo sapiens
gattcagcatttgttctttgcc

SEQ ID NO: 4227455 - DNA, 23 bp, Homo sapiens
gattcagcatttgttctttgcca

SEQ ID NO: 4227456 - DNA, 21 bp, Homo sapiens
gattcccagagacaggaaaat

SEQ ID NO: 4227457 - DNA, 19 bp, Homo sapiens
gatttaaaaaataaatata

SEQ ID NO: 4227458 - DNA, 22 bp, Homo sapiens
gatttagtgaaagctagagata

SEQ ID NO: 4227459 - DNA, 20 bp, Homo sapiens
gatttagttgtggaaagata

SEQ ID NO: 4227460 - DNA, 14 bp, Homo sapiens
gatttataaagcaa

SEQ ID NO: 4227461 - DNA, 20 bp, Homo sapiens
gatttcccactcagggctgg

SEQ ID NO: 4227462 - DNA, 18 bp, Homo sapiens
gatttgttatggttacat

SEQ ID NO: 4227463 - DNA, 14 bp, Homo sapiens
gattttaaaaacat

SEQ ID NO: 4227464 - DNA, 22 bp, Homo sapiens
gatttttgaaaatcctgaataa

SEQ ID NO: 4227465 - DNA, 17 bp, Homo sapiens
gcaaaagagaaaaagaa

SEQ ID NO: 4227466 - DNA, 22 bp, Homo sapiens
gcaaatgtcacagtaatgcaag

SEQ ID NO: 4227467 - DNA, 14 bp, Homo sapiens
gcaaatgttccttt

SEQ ID NO: 4227468 - DNA, 16 bp, Homo sapiens
gcaaattactccaagg

SEQ ID NO: 4227469 - DNA, 12 bp, Homo sapiens
gcaacccaaact

SEQ ID NO: 4227470 - DNA, 13 bp, Homo sapiens
gcaacccaaactg

SEQ ID NO: 4227471 - DNA, 16 bp, Homo sapiens
gcaaccccagttctgc

SEQ ID NO: 4227472 - DNA, 19 bp, Homo sapiens
gcaaccccagttctgctcc

SEQ ID NO: 4227473 - DNA, 21 bp, Homo sapiens
gcaaccccagttctgctcctc

SEQ ID NO: 4227474 - DNA, 23 bp, Homo sapiens
gcaagagccttggtgtccacctg

SEQ ID NO: 4227475 - DNA, 18 bp, Homo sapiens
gcaagcaagaaacactgg

SEQ ID NO: 4227476 - DNA, 19 bp, Homo sapiens
gcaagcagaaaaattaaat

SEQ ID NO: 4227477 - DNA, 19 bp, Homo sapiens
gcaagcctgtaatcccagc

SEQ ID NO: 4227478 - DNA, 19 bp, Homo sapiens
gcaatgctcaaacacccaa

SEQ ID NO: 4227479 - DNA, 20 bp, Homo sapiens
gcaccaggcacgaacccacc

SEQ ID NO: 4227480 - DNA, 13 bp, Homo sapiens
gcacccccaggcc

SEQ ID NO: 4227481 - DNA, 17 bp, Homo sapiens
gcacccttctttcctct

SEQ ID NO: 4227482 - DNA, 23 bp, Homo sapiens
gcacctccccccactgcaggccc

SEQ ID NO: 4227483 - DNA, 22 bp, Homo sapiens
gcacctgaaattaatttgtgaa

SEQ ID NO: 4227484 - DNA, 15 bp, Homo sapiens
gcacgaacccacctg

SEQ ID NO: 4227485 - DNA, 19 bp, Homo sapiens
gcacgaacccacctgctga

SEQ ID NO: 4227486 - DNA, 22 bp, Homo sapiens
gcacgagacccatttccttgtg

SEQ ID NO: 4227487 - DNA, 16 bp, Homo sapiens
gcagaaaagcacctgc

SEQ ID NO: 4227488 - DNA, 17 bp, Homo sapiens
gcagaaaagcacctgcc

SEQ ID NO: 4227489 - DNA, 18 bp, Homo sapiens
gcagaaaagcacctgccg

SEQ ID NO: 4227490 - DNA, 21 bp, Homo sapiens
gcagaagaattgaacccagga

SEQ ID NO: 4227491 - DNA, 19 bp, Homo sapiens
gcagagggcagaggctgga

SEQ ID NO: 4227492 - DNA, 15 bp, Homo sapiens
gcagattatttgccc

SEQ ID NO: 4227493 - DNA, 20 bp, Homo sapiens
gcagatttagtgaaagctag

SEQ ID NO: 4227494 - DNA, 13 bp, Homo sapiens
gcagccctcctca

SEQ ID NO: 4227495 - DNA, 15 bp, Homo sapiens
gcagccctcctcacc

SEQ ID NO: 4227496 - DNA, 21 bp, Homo sapiens
gcagctgtggtacaaatgtga

SEQ ID NO: 4227497 - DNA, 22 bp, Homo sapiens
gcaggaagatgtatgctttgaa

SEQ ID NO: 4227498 - DNA, 18 bp, Homo sapiens
gcagggccttgcccagag

SEQ ID NO: 4227499 - DNA, 19 bp, Homo sapiens
gcagggccttgcccagaga

SEQ ID NO: 4227500 - DNA, 19 bp, Homo sapiens
gcagggtggaagcggctcc

SEQ ID NO: 4227501 - DNA, 15 bp, Homo sapiens
gcagggtgggatgga

SEQ ID NO: 4227502 - DNA, 20 bp, Homo sapiens
gcagtaaaagataaatttgt

SEQ ID NO: 4227503 - DNA, 18 bp, Homo sapiens
gcagtctcgggtggctag

SEQ ID NO: 4227504 - DNA, 12 bp, Homo sapiens
gcagtttttccc

SEQ ID NO: 4227505 - DNA, 15 bp, Homo sapiens
gcagtttttccccct

SEQ ID NO: 4227506 - DNA, 12 bp, Homo sapiens
gcatccattcct

SEQ ID NO: 4227507 - DNA, 14 bp, Homo sapiens
gcatccattcctca

SEQ ID NO: 4227508 - DNA, 15 bp, Homo sapiens
gcatccattcctcag

SEQ ID NO: 4227509 - DNA, 18 bp, Homo sapiens
gcatccgtagttccctga

SEQ ID NO: 4227510 - DNA, 13 bp, Homo sapiens
gcatccttcctat

SEQ ID NO: 4227511 - DNA, 19 bp, Homo sapiens
gcatccttcctataacttg

SEQ ID NO: 4227512 - DNA, 15 bp, Homo sapiens
gcatgctctctgcag

SEQ ID NO: 4227513 - DNA, 17 bp, Homo sapiens
gcatgctctctgcagcc

SEQ ID NO: 4227514 - DNA, 18 bp, Homo sapiens
gcatgctctctgcagcca

SEQ ID NO: 4227515 - DNA, 21 bp, Homo sapiens
gcatgctctctgcagccagcc

SEQ ID NO: 4227516 - DNA, 22 bp, Homo sapiens
gcatgctctctgcagccagccc

SEQ ID NO: 4227517 - DNA, 14 bp, Homo sapiens
gcatgtaggagaat

SEQ ID NO: 4227518 - DNA, 19 bp, Homo sapiens
gcatgtggtttggttcctc

SEQ ID NO: 4227519 - DNA, 14 bp, Homo sapiens
gcattccctgagtc

SEQ ID NO: 4227520 - DNA, 16 bp, Homo sapiens
gcatttgttctttgcc

SEQ ID NO: 4227521 - DNA, 16 bp, Homo sapiens
gccaaaaaatgggaga

SEQ ID NO: 4227522 - DNA, 14 bp, Homo sapiens
gccaagaggaaaaa

SEQ ID NO: 4227523 - DNA, 23 bp, Homo sapiens
gccaagaggaaaaacagggaaaa

SEQ ID NO: 4227524 - DNA, 11 bp, Homo sapiens
gccacctcccc

SEQ ID NO: 4227525 - DNA, 13 bp, Homo sapiens
gccacctccccta

SEQ ID NO: 4227526 - DNA, 20 bp, Homo sapiens
gccacctcccctatccaccc

SEQ ID NO: 4227527 - DNA, 22 bp, Homo sapiens
gccacctcccctatccacccag

SEQ ID NO: 4227528 - DNA, 18 bp, Homo sapiens
gccacgtgccaggcccgg

SEQ ID NO: 4227529 - DNA, 16 bp, Homo sapiens
gccacgttccttactg

SEQ ID NO: 4227530 - DNA, 21 bp, Homo sapiens
gccacgttccttactgcagaa

SEQ ID NO: 4227531 - DNA, 17 bp, Homo sapiens
gccactgcctttcagaa

SEQ ID NO: 4227532 - DNA, 21 bp, Homo sapiens
gccagaagtttgtcaagtcaa

SEQ ID NO: 4227533 - DNA, 20 bp, Homo sapiens
gccagccctccctgtcctcc

SEQ ID NO: 4227534 - DNA, 15 bp, Homo sapiens
gccaggacaggcccg

SEQ ID NO: 4227535 - DNA, 16 bp, Homo sapiens
gccaggcccggggctg

SEQ ID NO: 4227536 - DNA, 17 bp, Homo sapiens
gccaggcccggggctgg

SEQ ID NO: 4227537 - DNA, 12 bp, Homo sapiens
tctaaattaaaa

SEQ ID NO: 4227538 - DNA, 23 bp, Homo sapiens
tctaataaagctcctctgctcca

SEQ ID NO: 4227539 - DNA, 16 bp, Homo sapiens
tctaatgtctcttcct

SEQ ID NO: 4227540 - DNA, 19 bp, Homo sapiens
tctaatgtctcttcctctg

SEQ ID NO: 4227541 - DNA, 14 bp, Homo sapiens
tctacagagaaaat

SEQ ID NO: 4227542 - DNA, 17 bp, Homo sapiens
tctaggagctgggagga

SEQ ID NO: 4227543 - DNA, 20 bp, Homo sapiens
tctaggagctgggaggaaaa

SEQ ID NO: 4227544 - DNA, 16 bp, Homo sapiens
tctattaagatttcca

SEQ ID NO: 4227545 - DNA, 17 bp, Homo sapiens
tctattgtttattcttt

SEQ ID NO: 4227546 - DNA, 20 bp, Homo sapiens
tctcacgggcagtagctgtg

SEQ ID NO: 4227547 - DNA, 12 bp, Homo sapiens
tctcactccacc

SEQ ID NO: 4227548 - DNA, 15 bp, Homo sapiens
tctcaggcctctgct

SEQ ID NO: 4227549 - DNA, 14 bp, Homo sapiens
tctcattccccagg

SEQ ID NO: 4227550 - DNA, 16 bp, Homo sapiens
tctcattccccaggtg

SEQ ID NO: 4227551 - DNA, 22 bp, Homo sapiens
tctcccactgcaacttgtgaac

SEQ ID NO: 4227552 - DNA, 20 bp, Homo sapiens
tctccccagaagacacagga

SEQ ID NO: 4227553 - DNA, 16 bp, Homo sapiens
tctccctctcctgcct

SEQ ID NO: 4227554 - DNA, 17 bp, Homo sapiens
tctccctctcctgccta

SEQ ID NO: 4227555 - DNA, 21 bp, Homo sapiens
tctccctctcctgcctactca

SEQ ID NO: 4227556 - DNA, 14 bp, Homo sapiens
tctccctctggccc

SEQ ID NO: 4227557 - DNA, 15 bp, Homo sapiens
tctccctctggccct

SEQ ID NO: 4227558 - DNA, 17 bp, Homo sapiens
tctccctctggccctgc

SEQ ID NO: 4227559 - DNA, 20 bp, Homo sapiens
tctccctctggccctgcctt

SEQ ID NO: 4227560 - DNA, 15 bp, Homo sapiens
tctccctgccgcctc

SEQ ID NO: 4227561 - DNA, 16 bp, Homo sapiens
tctcctacctgctgct

SEQ ID NO: 4227562 - DNA, 17 bp, Homo sapiens
tctcctacctgctgctg

SEQ ID NO: 4227563 - DNA, 20 bp, Homo sapiens
tctcctacctgctgctgcta

SEQ ID NO: 4227564 - DNA, 15 bp, Homo sapiens
tctcctcctatttat

SEQ ID NO: 4227565 - DNA, 12 bp, Homo sapiens
tctcctgcctac

SEQ ID NO: 4227566 - DNA, 16 bp, Homo sapiens
tctctaagccacagct

SEQ ID NO: 4227567 - DNA, 13 bp, Homo sapiens
tctctcctgtcca

SEQ ID NO: 4227568 - DNA, 15 bp, Homo sapiens
tctctgcagccagcc

SEQ ID NO: 4227569 - DNA, 13 bp, Homo sapiens
tctcttcctctgt

SEQ ID NO: 4227570 - DNA, 19 bp, Homo sapiens
tctgaaagacagaatgtca

SEQ ID NO: 4227571 - DNA, 20 bp, Homo sapiens
tctgaaagacagaatgtcac

SEQ ID NO: 4227572 - DNA, 12 bp, Homo sapiens
tctgaaagccac

SEQ ID NO: 4227573 - DNA, 18 bp, Homo sapiens
tctgaagaaagttattct

SEQ ID NO: 4227574 - DNA, 16 bp, Homo sapiens
tctgaataacactgga

SEQ ID NO: 4227575 - DNA, 15 bp, Homo sapiens
tctgcacttctgttc

SEQ ID NO: 4227576 - DNA, 17 bp, Homo sapiens
tctgcacttctgttcca

SEQ ID NO: 4227577 - DNA, 14 bp, Homo sapiens
tctgcagccagccc

SEQ ID NO: 4227578 - DNA, 19 bp, Homo sapiens
tctgcccaaattatgtgaa

SEQ ID NO: 4227579 - DNA, 12 bp, Homo sapiens
tctgctcctctc

SEQ ID NO: 4227580 - DNA, 13 bp, Homo sapiens
tctgctcctctcc

SEQ ID NO: 4227581 - DNA, 15 bp, Homo sapiens
tctgctcctctccag

SEQ ID NO: 4227582 - DNA, 18 bp, Homo sapiens
tctgctcctctccaggca

SEQ ID NO: 4227583 - DNA, 15 bp, Homo sapiens
tctggagccagagag

SEQ ID NO: 4227584 - DNA, 14 bp, Homo sapiens
tctggatctgggac

SEQ ID NO: 4227585 - DNA, 19 bp, Homo sapiens
tctggcagggtgggatgga

SEQ ID NO: 4227586 - DNA, 21 bp, Homo sapiens
tctggctggctaactggaagc

SEQ ID NO: 4227587 - DNA, 16 bp, Homo sapiens
tctggggttcagcccc

SEQ ID NO: 4227588 - DNA, 18 bp, Homo sapiens
tctggggttcagcccctc

SEQ ID NO: 4227589 - DNA, 19 bp, Homo sapiens
tctggggttcagcccctcc

SEQ ID NO: 4227590 - DNA, 21 bp, Homo sapiens
tctggggttcagcccctcctc

SEQ ID NO: 4227591 - DNA, 14 bp, Homo sapiens
tctgtccccgggtt

SEQ ID NO: 4227592 - DNA, 16 bp, Homo sapiens
tctgtcctgcttctga

SEQ ID NO: 4227593 - DNA, 21 bp, Homo sapiens
tctgtggaagtagctttgaac

SEQ ID NO: 4227594 - DNA, 12 bp, Homo sapiens
tctgttgtaata

SEQ ID NO: 4227595 - DNA, 17 bp, Homo sapiens
tcttaaatgacagtgaa

SEQ ID NO: 4227596 - DNA, 14 bp, Homo sapiens
tcttaatgttgaat

SEQ ID NO: 4227597 - DNA, 19 bp, Homo sapiens
tcttagaagtggaccagga

SEQ ID NO: 4227598 - DNA, 22 bp, Homo sapiens
tcttagtggaagacaatactcc

SEQ ID NO: 4227599 - DNA, 15 bp, Homo sapiens
tcttcctctgttcta

SEQ ID NO: 4227600 - DNA, 16 bp, Homo sapiens
tcttgcatccttccta

SEQ ID NO: 4227601 - DNA, 19 bp, Homo sapiens
tcttggggtcccagggaag

SEQ ID NO: 4227602 - DNA, 19 bp, Homo sapiens
tctttcccctcagagctct

SEQ ID NO: 4227603 - DNA, 11 bp, Homo sapiens
tctttcctctt

SEQ ID NO: 4227604 - DNA, 13 bp, Homo sapiens
tgaaaaaactttc

SEQ ID NO: 4227605 - DNA, 15 bp, Homo sapiens
tgaaaaaactttctc

SEQ ID NO: 4227606 - DNA, 12 bp, Homo sapiens
tgaaaaatgtca

SEQ ID NO: 4227607 - DNA, 15 bp, Homo sapiens
tgaaaacccagagag

SEQ ID NO: 4227608 - DNA, 16 bp, Homo sapiens
tgaaaatcctgaataa

SEQ ID NO: 4227609 - DNA, 16 bp, Homo sapiens
tgaaaccctccaaatc

SEQ ID NO: 4227610 - DNA, 17 bp, Homo sapiens
tgaaagacagaatgtca

SEQ ID NO: 4227611 - DNA, 19 bp, Homo sapiens
tgaaatattaaaatcactg

SEQ ID NO: 4227612 - DNA, 18 bp, Homo sapiens
tgaaattaatttgtgaat

SEQ ID NO: 4227613 - DNA, 19 bp, Homo sapiens
tgaacaaagaaaaaaatat

SEQ ID NO: 4227614 - DNA, 19 bp, Homo sapiens
tgaacccaggaggtggagg

SEQ ID NO: 4227615 - DNA, 19 bp, Homo sapiens
tgaactcaatctaaattaa

SEQ ID NO: 4227616 - DNA, 23 bp, Homo sapiens
tgaactccatcattcatccagga

SEQ ID NO: 4227617 - DNA, 19 bp, Homo sapiens
tgaactgtgatggggtggg

SEQ ID NO: 4227618 - DNA, 13 bp, Homo sapiens
tgaagaaagttat

SEQ ID NO: 4227619 - DNA, 22 bp, Homo sapiens
tgaagaattattcagtgaattt

SEQ ID NO: 4227620 - DNA, 16 bp, Homo sapiens
tgaagccagatccacc

SEQ ID NO: 4227621 - DNA, 22 bp, Homo sapiens
tgaataaaccagtatcgttact

SEQ ID NO: 4227622 - DNA, 22 bp, Homo sapiens
tgaatattggtaattaaaagac

SEQ ID NO: 4227623 - DNA, 23 bp, Homo sapiens
tgaatattggtaattaaaagact

SEQ ID NO: 4227624 - DNA, 15 bp, Homo sapiens
tgaatgcaaaagaaa

SEQ ID NO: 4227625 - DNA, 16 bp, Homo sapiens
tgaatgcataaaatgt

SEQ ID NO: 4227626 - DNA, 15 bp, Homo sapiens
tgaattgtccccagt

SEQ ID NO: 4227627 - DNA, 19 bp, Homo sapiens
tgacatagtggatggacag

SEQ ID NO: 4227628 - DNA, 14 bp, Homo sapiens
tgaccaaaaaccaa

SEQ ID NO: 4227629 - DNA, 16 bp, Homo sapiens
tgaccaacatggagaa

SEQ ID NO: 4227630 - DNA, 22 bp, Homo sapiens
tgaccaaccgaacatgaccaaa

SEQ ID NO: 4227631 - DNA, 14 bp, Homo sapiens
tgacccagtccctg

SEQ ID NO: 4227632 - DNA, 16 bp, Homo sapiens
tgacccagtccctggg

SEQ ID NO: 4227633 - DNA, 20 bp, Homo sapiens
tgacccagtccctgggggaa

SEQ ID NO: 4227634 - DNA, 21 bp, Homo sapiens
tgacctagttcagatacaggg

SEQ ID NO: 4227635 - DNA, 14 bp, Homo sapiens
tgacctcccagccc

SEQ ID NO: 4227636 - DNA, 16 bp, Homo sapiens
tgacctcccagcccta

SEQ ID NO: 4227637 - DNA, 23 bp, Homo sapiens
tgacctcccagccctatggatgt

SEQ ID NO: 4227638 - DNA, 13 bp, Homo sapiens
tgactcacccaag

SEQ ID NO: 4227639 - DNA, 15 bp, Homo sapiens
tgactcgttttattt

SEQ ID NO: 4227640 - DNA, 19 bp, Homo sapiens
tgactgccccaactcctgg

SEQ ID NO: 4227641 - DNA, 14 bp, Homo sapiens
tgagaaatgtgaac

SEQ ID NO: 4227642 - DNA, 13 bp, Homo sapiens
tgagacctcagcc

SEQ ID NO: 4227643 - DNA, 14 bp, Homo sapiens
tgagacctcagcca

SEQ ID NO: 4227644 - DNA, 16 bp, Homo sapiens
tgagacctcagccatg

SEQ ID NO: 4227645 - DNA, 17 bp, Homo sapiens
tgagacctcagccatga

SEQ ID NO: 4227646 - DNA, 19 bp, Homo sapiens
tgagagtctgaaagacaga

SEQ ID NO: 4227647 - DNA, 21 bp, Homo sapiens
tgagccgcatcttctccatct

SEQ ID NO: 4227648 - DNA, 23 bp, Homo sapiens
tgagccgcatcttctccatctgg

SEQ ID NO: 4227649 - DNA, 22 bp, Homo sapiens
tgagctcagacccccactctca

SEQ ID NO: 4227650 - DNA, 17 bp, Homo sapiens
tgagctgagatcgtgcc

SEQ ID NO: 4227651 - DNA, 24 bp, Homo sapiens
tgaggaagaagggataatagacac

SEQ ID NO: 4227652 - DNA, 20 bp, Homo sapiens
tgagggccttgcacatagga

SEQ ID NO: 4227653 - DNA, 16 bp, Homo sapiens
tgagggggtcatgccg

SEQ ID NO: 4227654 - DNA, 21 bp, Homo sapiens
tgaggtggaagccctccttcc

SEQ ID NO: 4227655 - DNA, 18 bp, Homo sapiens
tgagtcccccagagatgt

SEQ ID NO: 4227656 - DNA, 14 bp, Homo sapiens
tgagttattttaat

SEQ ID NO: 4227657 - DNA, 17 bp, Homo sapiens
tgagttattttaattat

SEQ ID NO: 4227658 - DNA, 19 bp, Homo sapiens
tgataactgcaattttaat

SEQ ID NO: 4227659 - DNA, 14 bp, Homo sapiens
tgatactgatgcca

SEQ ID NO: 4227660 - DNA, 15 bp, Homo sapiens
tgatctccctgccgc

SEQ ID NO: 4227661 - DNA, 16 bp, Homo sapiens
tgatctccctgccgcc

SEQ ID NO: 4227662 - DNA, 23 bp, Homo sapiens
ctgtgatggggtgggcagggctg

SEQ ID NO: 4227663 - DNA, 19 bp, Homo sapiens
ctgtgcccctgtaaatagt

SEQ ID NO: 4227664 - DNA, 14 bp, Homo sapiens
ctgtggcggtgcct

SEQ ID NO: 4227665 - DNA, 16 bp, Homo sapiens
ctgtgtccttgcacct

SEQ ID NO: 4227666 - DNA, 20 bp, Homo sapiens
ctgttaagtaaaatgtcata

SEQ ID NO: 4227667 - DNA, 22 bp, Homo sapiens
ctgttatcaattcacattcatc

SEQ ID NO: 4227668 - DNA, 20 bp, Homo sapiens
ctgtttgtttgacaaagaaa

SEQ ID NO: 4227669 - DNA, 16 bp, Homo sapiens
cttaaatgacagtgaa

SEQ ID NO: 4227670 - DNA, 15 bp, Homo sapiens
cttaaggtccctgct

SEQ ID NO: 4227671 - DNA, 14 bp, Homo sapiens
cttacaatgtaaac

SEQ ID NO: 4227672 - DNA, 13 bp, Homo sapiens
cttacctcctgcc

SEQ ID NO: 4227673 - DNA, 17 bp, Homo sapiens
cttacctcctgcccagg

SEQ ID NO: 4227674 - DNA, 19 bp, Homo sapiens
cttacctcctgcccaggag

SEQ ID NO: 4227675 - DNA, 17 bp, Homo sapiens
cttagaagtggaccagg

SEQ ID NO: 4227676 - DNA, 19 bp, Homo sapiens
cttaggaaaatgcttctgt

SEQ ID NO: 4227677 - DNA, 18 bp, Homo sapiens
cttattcccaattaaaag

SEQ ID NO: 4227678 - DNA, 15 bp, Homo sapiens
cttcacactgcaaga

SEQ ID NO: 4227679 - DNA, 21 bp, Homo sapiens
cttcacactgcaagagccttg

SEQ ID NO: 4227680 - DNA, 20 bp, Homo sapiens
cttcagatcagtgcttgagt

SEQ ID NO: 4227681 - DNA, 22 bp, Homo sapiens
cttcaggaagcataaagcaatt

SEQ ID NO: 4227682 - DNA, 16 bp, Homo sapiens
cttcaggtggaaaaac

SEQ ID NO: 4227683 - DNA, 13 bp, Homo sapiens
cttcagtgggaga

SEQ ID NO: 4227684 - DNA, 18 bp, Homo sapiens
cttcagtgggagaaaaca

SEQ ID NO: 4227685 - DNA, 17 bp, Homo sapiens
cttccacccctctcctc

SEQ ID NO: 4227686 - DNA, 14 bp, Homo sapiens
cttcccagctctcc

SEQ ID NO: 4227687 - DNA, 22 bp, Homo sapiens
cttcctaatttcccttcttgca

SEQ ID NO: 4227688 - DNA, 14 bp, Homo sapiens
cttcctataacttg

SEQ ID NO: 4227689 - DNA, 23 bp, Homo sapiens
cttcgaggtggatcacagaggct

SEQ ID NO: 4227690 - DNA, 18 bp, Homo sapiens
cttcggggaactcctgga

SEQ ID NO: 4227691 - DNA, 19 bp, Homo sapiens
cttctagaaaacatttttg

SEQ ID NO: 4227692 - DNA, 17 bp, Homo sapiens
cttctagaaccaggcaa

SEQ ID NO: 4227693 - DNA, 21 bp, Homo sapiens
cttctgaatgtgctgatcatt

SEQ ID NO: 4227694 - DNA, 18 bp, Homo sapiens
cttctgcacatctacttg

SEQ ID NO: 4227695 - DNA, 14 bp, Homo sapiens
cttctgtccaggac

SEQ ID NO: 4227696 - DNA, 14 bp, Homo sapiens
cttctgtggaagta

SEQ ID NO: 4227697 - DNA, 14 bp, Homo sapiens
cttctgttgtaata

SEQ ID NO: 4227698 - DNA, 14 bp, Homo sapiens
cttcttattctcac

SEQ ID NO: 4227699 - DNA, 20 bp, Homo sapiens
cttcttattctcactccacc

SEQ ID NO: 4227700 - DNA, 20 bp, Homo sapiens
cttcttgcatccttcctata

SEQ ID NO: 4227701 - DNA, 14 bp, Homo sapiens
cttgacaacagact

SEQ ID NO: 4227702 - DNA, 17 bp, Homo sapiens
cttgacaacagactgaa

SEQ ID NO: 4227703 - DNA, 18 bp, Homo sapiens
cttgagacctcagccatg

SEQ ID NO: 4227704 - DNA, 13 bp, Homo sapiens
cttgatgcatgtg

SEQ ID NO: 4227705 - DNA, 15 bp, Homo sapiens
cttgcatccttccta

SEQ ID NO: 4227706 - DNA, 16 bp, Homo sapiens
cttgcatccttcctat

SEQ ID NO: 4227707 - DNA, 21 bp, Homo sapiens
cttgcccagagatgcctccac

SEQ ID NO: 4227708 - DNA, 23 bp, Homo sapiens
cttgcccagagatgcctccaccg

SEQ ID NO: 4227709 - DNA, 13 bp, Homo sapiens
cttgccctgacct

SEQ ID NO: 4227710 - DNA, 15 bp, Homo sapiens
cttgccctgacctcc

SEQ ID NO: 4227711 - DNA, 19 bp, Homo sapiens
cttgccctgacctcccagc

SEQ ID NO: 4227712 - DNA, 15 bp, Homo sapiens
cttgcccttgccctg

SEQ ID NO: 4227713 - DNA, 18 bp, Homo sapiens
cttgcccttgggtgctat

SEQ ID NO: 4227714 - DNA, 17 bp, Homo sapiens
cttggggtcccagggaa

SEQ ID NO: 4227715 - DNA, 15 bp, Homo sapiens
cttggtgtccacctg

SEQ ID NO: 4227716 - DNA, 17 bp, Homo sapiens
cttgtaactccaccaac

SEQ ID NO: 4227717 - DNA, 19 bp, Homo sapiens
cttgtcaatactgagccat

SEQ ID NO: 4227718 - DNA, 22 bp, Homo sapiens
cttgtgaactccatcattcatc

SEQ ID NO: 4227719 - DNA, 15 bp, Homo sapiens
cttgtgaatttttct

SEQ ID NO: 4227720 - DNA, 17 bp, Homo sapiens
cttgtggcagaggatgt

SEQ ID NO: 4227721 - DNA, 23 bp, Homo sapiens
cttgtgtatatgtataaattaat

SEQ ID NO: 4227722 - DNA, 15 bp, Homo sapiens
ctttaaagagagttt

SEQ ID NO: 4227723 - DNA, 15 bp, Homo sapiens
ctttactgaatgtaa

SEQ ID NO: 4227724 - DNA, 16 bp, Homo sapiens
ctttatccttaggaaa

SEQ ID NO: 4227725 - DNA, 16 bp, Homo sapiens
ctttccccccaacccg

SEQ ID NO: 4227726 - DNA, 17 bp, Homo sapiens
ctttccttgtggcagag

SEQ ID NO: 4227727 - DNA, 16 bp, Homo sapiens
ctttctaatagagaga

SEQ ID NO: 4227728 - DNA, 13 bp, Homo sapiens
ctttctctttgcc

SEQ ID NO: 4227729 - DNA, 14 bp, Homo sapiens
ctttctctttgcca

SEQ ID NO: 4227730 - DNA, 19 bp, Homo sapiens
ctttctgctcctttctcca

SEQ ID NO: 4227731 - DNA, 17 bp, Homo sapiens
ctttgaaatattaaaat

SEQ ID NO: 4227732 - DNA, 11 bp, Homo sapiens
ctttgcattca

SEQ ID NO: 4227733 - DNA, 16 bp, Homo sapiens
ctttgtaagaaaacca

SEQ ID NO: 4227734 - DNA, 21 bp, Homo sapiens
ctttgtaatgtcaccaccttc

SEQ ID NO: 4227735 - DNA, 22 bp, Homo sapiens
ctttgtaatgtcaccaccttcc

SEQ ID NO: 4227736 - DNA, 19 bp, Homo sapiens
ctttgtgagagtgagctgt

SEQ ID NO: 4227737 - DNA, 20 bp, Homo sapiens
gaaaaaaagtttgccagaag

SEQ ID NO: 4227738 - DNA, 21 bp, Homo sapiens
ttcacaacataaggagaatgt

SEQ ID NO: 4227739 - DNA, 17 bp, Homo sapiens
ttcaccctgtccctcta

SEQ ID NO: 4227740 - DNA, 15 bp, Homo sapiens
ttcagaagtgattta

SEQ ID NO: 4227741 - DNA, 14 bp, Homo sapiens
ttcagactcagact

SEQ ID NO: 4227742 - DNA, 17 bp, Homo sapiens
ttcagatcagtgcttga

SEQ ID NO: 4227743 - DNA, 14 bp, Homo sapiens
ttcagtcaattctg

SEQ ID NO: 4227744 - DNA, 15 bp, Homo sapiens
ttcagtcaattctga

SEQ ID NO: 4227745 - DNA, 10 bp, Homo sapiens
ttcagtgccc

SEQ ID NO: 4227746 - DNA, 18 bp, Homo sapiens
ttcatacatttgacttct

SEQ ID NO: 4227747 - DNA, 17 bp, Homo sapiens
ttcatccaggactgaga

SEQ ID NO: 4227748 - DNA, 18 bp, Homo sapiens
ttcatccaggactgagat

SEQ ID NO: 4227749 - DNA, 16 bp, Homo sapiens
aaaccctattggtaaa

SEQ ID NO: 4227750 - DNA, 19 bp, Homo sapiens
aaacgagtcaatcccctca

SEQ ID NO: 4227751 - DNA, 20 bp, Homo sapiens
aaactatggctttaaactac

SEQ ID NO: 4227752 - DNA, 19 bp, Homo sapiens
aaactccgtcttagaagtg

SEQ ID NO: 4227753 - DNA, 17 bp, Homo sapiens
aaacttagtttttatct

SEQ ID NO: 4227754 - DNA, 14 bp, Homo sapiens
aaagaaaaaaatat

SEQ ID NO: 4227755 - DNA, 22 bp, Homo sapiens
aaagaaaaaaatatattttatg

SEQ ID NO: 4227756 - DNA, 15 bp, Homo sapiens
aaagaaagaaatttg

SEQ ID NO: 4227757 - DNA, 19 bp, Homo sapiens
aaagaaatatattattcat

SEQ ID NO: 4227758 - DNA, 16 bp, Homo sapiens
aaagaaatttgaaaaa

SEQ ID NO: 4227759 - DNA, 12 bp, Homo sapiens
aaagaagagcct

SEQ ID NO: 4227760 - DNA, 20 bp, Homo sapiens
aaagaaggtttcagaaagaa

SEQ ID NO: 4227761 - DNA, 22 bp, Homo sapiens
aaagaattggtcttaatgttga

SEQ ID NO: 4227762 - DNA, 10 bp, Homo sapiens
aaagactcca

SEQ ID NO: 4227763 - DNA, 18 bp, Homo sapiens
aaagataaatttgttgaa

SEQ ID NO: 4227764 - DNA, 16 bp, Homo sapiens
aaagataataaattga

SEQ ID NO: 4227765 - DNA, 13 bp, Homo sapiens
aaagatgggtggt

SEQ ID NO: 4227766 - DNA, 13 bp, Homo sapiens
aaagcacctgccg

SEQ ID NO: 4227767 - DNA, 17 bp, Homo sapiens
aaagcagtttttccccc

SEQ ID NO: 4227768 - DNA, 16 bp, Homo sapiens
aaagcatgatttttaa

SEQ ID NO: 4227769 - DNA, 18 bp, Homo sapiens
aaagccacgttccttact

SEQ ID NO: 4227770 - DNA, 14 bp, Homo sapiens
aaagctcctctgct

SEQ ID NO: 4227771 - DNA, 12 bp, Homo sapiens
aaagctgaaaac

SEQ ID NO: 4227772 - DNA, 9 bp, Homo sapiens
aaaggaaaa

SEQ ID NO: 4227773 - DNA, 14 bp, Homo sapiens
aaaggaagtctagg

SEQ ID NO: 4227774 - DNA, 20 bp, Homo sapiens
aaaggatgtaaacagtgcct

SEQ ID NO: 4227775 - DNA, 14 bp, Homo sapiens
aaagtattctccat

SEQ ID NO: 4227776 - DNA, 13 bp, Homo sapiens
aaagtgcattcaa

SEQ ID NO: 4227777 - DNA, 15 bp, Homo sapiens
aaagtttgccagaag

SEQ ID NO: 4227778 - DNA, 13 bp, Homo sapiens
aaataaaaaccat

SEQ ID NO: 4227779 - DNA, 22 bp, Homo sapiens
aaataaaattaaagctgaaaac

SEQ ID NO: 4227780 - DNA, 14 bp, Homo sapiens
aaataaatataatt

SEQ ID NO: 4227781 - DNA, 17 bp, Homo sapiens
aaataaattgtgaaaaa

SEQ ID NO: 4227782 - DNA, 15 bp, Homo sapiens
aaataatcggcccac

SEQ ID NO: 4227783 - DNA, 22 bp, Homo sapiens
aaatataattgggattttaaaa

SEQ ID NO: 4227784 - DNA, 15 bp, Homo sapiens
aaatatattttatga

SEQ ID NO: 4227785 - DNA, 16 bp, Homo sapiens
aaatatattttatgat

SEQ ID NO: 4227786 - DNA, 20 bp, Homo sapiens
aaatatattttatgatttaa

SEQ ID NO: 4227787 - DNA, 21 bp, Homo sapiens
aaatatattttatgatttaaa

SEQ ID NO: 4227788 - DNA, 20 bp, Homo sapiens
aaatatcagttactcagccc

SEQ ID NO: 4227789 - DNA, 15 bp, Homo sapiens
aaatatgtgaagaaa

SEQ ID NO: 4227790 - DNA, 12 bp, Homo sapiens
aaatattaaaat

SEQ ID NO: 4227791 - DNA, 16 bp, Homo sapiens
aaatattttagatgtt

SEQ ID NO: 4227792 - DNA, 17 bp, Homo sapiens
aaatattttagatgtta

SEQ ID NO: 4227793 - DNA, 19 bp, Homo sapiens
aaatattttagatgttatt

SEQ ID NO: 4227794 - DNA, 22 bp, Homo sapiens
aaatccagtattatattatcat

SEQ ID NO: 4227795 - DNA, 11 bp, Homo sapiens
aaatcctctgg

SEQ ID NO: 4227796 - DNA, 13 bp, Homo sapiens
aaatcctgaataa

SEQ ID NO: 4227797 - DNA, 13 bp, Homo sapiens
aaatctgaagaaa

SEQ ID NO: 4227798 - DNA, 15 bp, Homo sapiens
aaatctgtctcccca

SEQ ID NO: 4227799 - DNA, 11 bp, Homo sapiens
aaatcttcttc

SEQ ID NO: 4227800 - DNA, 16 bp, Homo sapiens
aaatgacccaaacata

SEQ ID NO: 4227801 - DNA, 16 bp, Homo sapiens
aaatgaggaggtacat

SEQ ID NO: 4227802 - DNA, 22 bp, Homo sapiens
aaatgagtttttatggggctga

SEQ ID NO: 4227803 - DNA, 23 bp, Homo sapiens
aaatgcatccattcctcagggac

SEQ ID NO: 4227804 - DNA, 24 bp, Homo sapiens
aaatgcttatgcttgtgtatatgt

SEQ ID NO: 4227805 - DNA, 18 bp, Homo sapiens
aaatgctttatgcaaacc

SEQ ID NO: 4227806 - DNA, 14 bp, Homo sapiens
aaatgtcacagtaa

SEQ ID NO: 4227807 - DNA, 17 bp, Homo sapiens
aaatgtgataatatatt

SEQ ID NO: 4227808 - DNA, 20 bp, Homo sapiens
aaatgttaagttgatggtga

SEQ ID NO: 4227809 - DNA, 13 bp, Homo sapiens
aaattaaagctga

SEQ ID NO: 4227810 - DNA, 17 bp, Homo sapiens
aaattaaagctgaaaac

SEQ ID NO: 4227811 - DNA, 14 bp, Homo sapiens
aaattaatttgtga

SEQ ID NO: 4227812 - DNA, 21 bp, Homo sapiens
aaattactccaaggtttataa

SEQ ID NO: 4227813 - DNA, 15 bp, Homo sapiens
aaattgaaaaataaa

SEQ ID NO: 4227814 - DNA, 18 bp, Homo sapiens
aaattgaaaaataaaaac

SEQ ID NO: 4227815 - DNA, 18 bp, Homo sapiens
aaattgacctagttcaga

SEQ ID NO: 4227816 - DNA, 23 bp, Homo sapiens
aaattgatttgttatggttacat

SEQ ID NO: 4227817 - DNA, 21 bp, Homo sapiens
aaatttgccaccactagagct

SEQ ID NO: 4227818 - DNA, 20 bp, Homo sapiens
aacaaaatagcttattatag

SEQ ID NO: 4227819 - DNA, 18 bp, Homo sapiens
aacaaagaaaaaaatata

SEQ ID NO: 4227820 - DNA, 19 bp, Homo sapiens
aacaagagcgaaactccgt

SEQ ID NO: 4227821 - DNA, 13 bp, Homo sapiens
aacagacaagcaa

SEQ ID NO: 4227822 - DNA, 19 bp, Homo sapiens
aacagacaagcaacccaaa

SEQ ID NO: 4227823 - DNA, 21 bp, Homo sapiens
aacagacaagcaacccaaact

SEQ ID NO: 4227824 - DNA, 23 bp, Homo sapiens
aacagactgaattttaaatgttc

SEQ ID NO: 4227825 - DNA, 12 bp, Homo sapiens
aacagtgcctgc

SEQ ID NO: 4227826 - DNA, 14 bp, Homo sapiens
aacagtgcctgctg

SEQ ID NO: 4227827 - DNA, 20 bp, Homo sapiens
aacatatcatttgtgaagaa

SEQ ID NO: 4227828 - DNA, 16 bp, Homo sapiens
aacatcccattgccct

SEQ ID NO: 4227829 - DNA, 12 bp, Homo sapiens
aacatgagaaat

SEQ ID NO: 4227830 - DNA, 17 bp, Homo sapiens
aacatgagaaatgtgaa

SEQ ID NO: 4227831 - DNA, 23 bp, Homo sapiens
aacatgagaaatgtgaactgtga

SEQ ID NO: 4227832 - DNA, 19 bp, Homo sapiens
aacatggagaaaccctgtc

SEQ ID NO: 4227833 - DNA, 16 bp, Homo sapiens
aaccaactttcccccc

SEQ ID NO: 4227834 - DNA, 14 bp, Homo sapiens
aaccaatgagctgt

SEQ ID NO: 4227835 - DNA, 23 bp, Homo sapiens
aaccacatgaactacgtgacctc

SEQ ID NO: 4227836 - DNA, 13 bp, Homo sapiens
aaccataaacatt

SEQ ID NO: 4227837 - DNA, 21 bp, Homo sapiens
aaccataaatcaattcatgtt

SEQ ID NO: 4227838 - DNA, 17 bp, Homo sapiens
aacccatcagaaggaga

SEQ ID NO: 4227839 - DNA, 16 bp, Homo sapiens
aaccccctcaaaagcc

SEQ ID NO: 4227840 - DNA, 15 bp, Homo sapiens
aaccctattggtaaa

SEQ ID NO: 4227841 - DNA, 23 bp, Homo sapiens
aaccgaacatatcatttgtgaag

SEQ ID NO: 4227842 - DNA, 15 bp, Homo sapiens
aacctaacccctttc

SEQ ID NO: 4227843 - DNA, 19 bp, Homo sapiens
aacctgtcacctggcctgc

SEQ ID NO: 4227844 - DNA, 14 bp, Homo sapiens
aaccttaccaaaaa

SEQ ID NO: 4227845 - DNA, 19 bp, Homo sapiens
aacctttgtaagaaaacca

SEQ ID NO: 4227846 - DNA, 20 bp, Homo sapiens
aacctttgtaagaaaaccaa

SEQ ID NO: 4227847 - DNA, 22 bp, Homo sapiens
aacctttgtaagaaaaccaaaa

SEQ ID NO: 4227848 - DNA, 16 bp, Homo sapiens
aacgagtcaatcccct

SEQ ID NO: 4227849 - DNA, 12 bp, Homo sapiens
aacgtgaaaatg

SEQ ID NO: 4227850 - DNA, 14 bp, Homo sapiens
aacgtttctcatta

SEQ ID NO: 4227851 - DNA, 16 bp, Homo sapiens
aactacctcaaaacac

SEQ ID NO: 4227852 - DNA, 21 bp, Homo sapiens
aactacgtgacctctgcaaga

SEQ ID NO: 4227853 - DNA, 19 bp, Homo sapiens
aactcaatctaaattaaaa

SEQ ID NO: 4227854 - DNA, 22 bp, Homo sapiens
aactccaggatttataaagcaa

SEQ ID NO: 4227855 - DNA, 13 bp, Homo sapiens
aactccatcattc

SEQ ID NO: 4227856 - DNA, 20 bp, Homo sapiens
aactgccaaaaatataattc

SEQ ID NO: 4227857 - DNA, 15 bp, Homo sapiens
aactgctccaaattt

SEQ ID NO: 4227858 - DNA, 21 bp, Homo sapiens
aactgctccaaatttaaccat

SEQ ID NO: 4227859 - DNA, 23 bp, Homo sapiens
aactgtgatggggtgggcagggc

SEQ ID NO: 4227860 - DNA, 23 bp, Homo sapiens
aacttacattgtgaaacttctgt

SEQ ID NO: 4227861 - DNA, 20 bp, Homo sapiens
aacttagtttttatctttga

SEQ ID NO: 4227862 - DNA, 22 bp, Homo sapiens
aacttcaagtgcatgctctctg

SEQ ID NO: 4227863 - DNA, 21 bp, Homo sapiens
aacttcagatgggaggaaaga

SEQ ID NO: 4227864 - DNA, 14 bp, Homo sapiens
aacttgatgcatgt

SEQ ID NO: 4227865 - DNA, 12 bp, Homo sapiens
aacttgggaact

SEQ ID NO: 4227866 - DNA, 15 bp, Homo sapiens
aacttgtaaatgtgg

SEQ ID NO: 4227867 - DNA, 11 bp, Homo sapiens
aactttccccc

SEQ ID NO: 4227868 - DNA, 17 bp, Homo sapiens
aactttccccccaaccc

SEQ ID NO: 4227869 - DNA, 12 bp, Homo sapiens
aactttctcttt

SEQ ID NO: 4227870 - DNA, 12 bp, Homo sapiens
aagaaaaaggaa

SEQ ID NO: 4227871 - DNA, 19 bp, Homo sapiens
aagaaagttattcttggta

SEQ ID NO: 4227872 - DNA, 11 bp, Homo sapiens
aagaaatactc

SEQ ID NO: 4227873 - DNA, 21 bp, Homo sapiens
aagaaatttgaaaaaactttc

SEQ ID NO: 4227874 - DNA, 14 bp, Homo sapiens
agaggcttcttcag

SEQ ID NO: 4227875 - DNA, 14 bp, Homo sapiens
agagggcagaggct

SEQ ID NO: 4227876 - DNA, 17 bp, Homo sapiens
agagtagccgagagcct

SEQ ID NO: 4227877 - DNA, 15 bp, Homo sapiens
agagtgtgcagactg

SEQ ID NO: 4227878 - DNA, 19 bp, Homo sapiens
agagtgtgggaagggagag

SEQ ID NO: 4227879 - DNA, 16 bp, Homo sapiens
agataataaattgatt

SEQ ID NO: 4227880 - DNA, 18 bp, Homo sapiens
agataattctagctttga

SEQ ID NO: 4227881 - DNA, 24 bp, Homo sapiens
agatacagggtgctccttgtcaat

SEQ ID NO: 4227882 - DNA, 14 bp, Homo sapiens
agatccaccctcaa

SEQ ID NO: 4227883 - DNA, 13 bp, Homo sapiens
agatgcctccacc

SEQ ID NO: 4227884 - DNA, 21 bp, Homo sapiens
agatgcctccaccgctgccta

SEQ ID NO: 4227885 - DNA, 15 bp, Homo sapiens
agatgtatatttgca

SEQ ID NO: 4227886 - DNA, 16 bp, Homo sapiens
agatgtatatttgcat

SEQ ID NO: 4227887 - DNA, 22 bp, Homo sapiens
agatgtatgctttgaatgcaaa

SEQ ID NO: 4227888 - DNA, 13 bp, Homo sapiens
agatgtcatcaga

SEQ ID NO: 4227889 - DNA, 14 bp, Homo sapiens
agattatttgccca

SEQ ID NO: 4227890 - DNA, 14 bp, Homo sapiens
agattcccagagac

SEQ ID NO: 4227891 - DNA, 16 bp, Homo sapiens
agcaaagtatcaaaga

SEQ ID NO: 4227892 - DNA, 23 bp, Homo sapiens
agcaccaggcacgaacccacctg

SEQ ID NO: 4227893 - DNA, 11 bp, Homo sapiens
agcacctgccg

SEQ ID NO: 4227894 - DNA, 15 bp, Homo sapiens
agcacctgccgacct

SEQ ID NO: 4227895 - DNA, 16 bp, Homo sapiens
agcacctgccgacctc

SEQ ID NO: 4227896 - DNA, 22 bp, Homo sapiens
agcacctgccgacctcgtcctc

SEQ ID NO: 4227897 - DNA, 14 bp, Homo sapiens
agcagattacctct

SEQ ID NO: 4227898 - DNA, 23 bp, Homo sapiens
agcagccctcctcaccccgtctg

SEQ ID NO: 4227899 - DNA, 14 bp, Homo sapiens
agcagtgagccgca

SEQ ID NO: 4227900 - DNA, 17 bp, Homo sapiens
agcatcgtgatcactga

SEQ ID NO: 4227901 - DNA, 18 bp, Homo sapiens
agcatttgttctttgcca

SEQ ID NO: 4227902 - DNA, 13 bp, Homo sapiens
agccaccagcccc

SEQ ID NO: 4227903 - DNA, 18 bp, Homo sapiens
agccacgttccttactgc

SEQ ID NO: 4227904 - DNA, 13 bp, Homo sapiens
agccagatccacc

SEQ ID NO: 4227905 - DNA, 14 bp, Homo sapiens
agccagatccaccc

SEQ ID NO: 4227906 - DNA, 14 bp, Homo sapiens
agccagcccagccc

SEQ ID NO: 4227907 - DNA, 17 bp, Homo sapiens
agccagcccagcccagc

SEQ ID NO: 4227908 - DNA, 12 bp, Homo sapiens
agccagccctcc

SEQ ID NO: 4227909 - DNA, 15 bp, Homo sapiens
agccagccctccctg

SEQ ID NO: 4227910 - DNA, 16 bp, Homo sapiens
agccagccctccctgt

SEQ ID NO: 4227911 - DNA, 19 bp, Homo sapiens
agccatgaggagttgctgt

SEQ ID NO: 4227912 - DNA, 18 bp, Homo sapiens
agccatgataactgcaat

SEQ ID NO: 4227913 - DNA, 16 bp, Homo sapiens
agcccagctggtggga

SEQ ID NO: 4227914 - DNA, 15 bp, Homo sapiens
agcccattctctctc

SEQ ID NO: 4227915 - DNA, 16 bp, Homo sapiens
agcccattctctctcc

SEQ ID NO: 4227916 - DNA, 21 bp, Homo sapiens
agcccattctctctcctgtcc

SEQ ID NO: 4227917 - DNA, 13 bp, Homo sapiens
agcccctcctctg

SEQ ID NO: 4227918 - DNA, 16 bp, Homo sapiens
agcccctcctctgcca

SEQ ID NO: 4227919 - DNA, 17 bp, Homo sapiens
agcccctcctctgccac

SEQ ID NO: 4227920 - DNA, 18 bp, Homo sapiens
agcccctcctctgccacc

SEQ ID NO: 4227921 - DNA, 22 bp, Homo sapiens
agcccctcctctgccacctccc

SEQ ID NO: 4227922 - DNA, 22 bp, Homo sapiens
agcccgctcctgcccgcccagc

SEQ ID NO: 4227923 - DNA, 14 bp, Homo sapiens
agccctatggatgt

SEQ ID NO: 4227924 - DNA, 15 bp, Homo sapiens
agccctatggatgtg

SEQ ID NO: 4227925 - DNA, 16 bp, Homo sapiens
agccctatggatgtgg

SEQ ID NO: 4227926 - DNA, 16 bp, Homo sapiens
agccctccctgtcctc

SEQ ID NO: 4227927 - DNA, 20 bp, Homo sapiens
agccctccctgtcctcctcg

SEQ ID NO: 4227928 - DNA, 13 bp, Homo sapiens
agccctccttcca

SEQ ID NO: 4227929 - DNA, 23 bp, Homo sapiens
agccctggatttcagaaagagca

SEQ ID NO: 4227930 - DNA, 16 bp, Homo sapiens
agccctgggccccacc

SEQ ID NO: 4227931 - DNA, 19 bp, Homo sapiens
agccctgggccccaccacc

SEQ ID NO: 4227932 - DNA, 14 bp, Homo sapiens
agcctgctccccca

SEQ ID NO: 4227933 - DNA, 17 bp, Homo sapiens
agcctgtaatcccagct

SEQ ID NO: 4227934 - DNA, 18 bp, Homo sapiens
agcctgtggcggtgcctg

SEQ ID NO: 4227935 - DNA, 19 bp, Homo sapiens
agccttggataatgctgtt

SEQ ID NO: 4227936 - DNA, 20 bp, Homo sapiens
agccttggataatgctgttg

SEQ ID NO: 4227937 - DNA, 19 bp, Homo sapiens
agccttggtgtccacctgg

SEQ ID NO: 4227938 - DNA, 22 bp, Homo sapiens
agccttggtgtccacctggccc

SEQ ID NO: 4227939 - DNA, 17 bp, Homo sapiens
agccttgtgtttctgtg

SEQ ID NO: 4227940 - DNA, 14 bp, Homo sapiens
agcgagcccagagt

SEQ ID NO: 4227941 - DNA, 21 bp, Homo sapiens
agcgcctagtggggtctccct

SEQ ID NO: 4227942 - DNA, 23 bp, Homo sapiens
agcgcctagtggggtctccctct

SEQ ID NO: 4227943 - DNA, 18 bp, Homo sapiens
agcgctgccgcaccccag

SEQ ID NO: 4227944 - DNA, 20 bp, Homo sapiens
agcgctgccgcaccccagag

SEQ ID NO: 4227945 - DNA, 21 bp, Homo sapiens
agcgctgccgcaccccagagt

SEQ ID NO: 4227946 - DNA, 15 bp, Homo sapiens
agctactcaggaggc

SEQ ID NO: 4227947 - DNA, 17 bp, Homo sapiens
agctactcaggaggctg

SEQ ID NO: 4227948 - DNA, 21 bp, Homo sapiens
agctagaagtgggccaggaca

SEQ ID NO: 4227949 - DNA, 18 bp, Homo sapiens
agctagcgctgccgcacc

SEQ ID NO: 4227950 - DNA, 16 bp, Homo sapiens
agctatgttccctcca

SEQ ID NO: 4227951 - DNA, 20 bp, Homo sapiens
agctcacagttcctcgccct

SEQ ID NO: 4227952 - DNA, 21 bp, Homo sapiens
agctcacagttcctcgccctg

SEQ ID NO: 4227953 - DNA, 18 bp, Homo sapiens
agctcagacccccactct

SEQ ID NO: 4227954 - DNA, 20 bp, Homo sapiens
agctcagacccccactctca

SEQ ID NO: 4227955 - DNA, 13 bp, Homo sapiens
agctcctctgctc

SEQ ID NO: 4227956 - DNA, 11 bp, Homo sapiens
agctctccctc

SEQ ID NO: 4227957 - DNA, 14 bp, Homo sapiens
agctctccctctgg

SEQ ID NO: 4227958 - DNA, 22 bp, Homo sapiens
agctctccctctggccctgcct

SEQ ID NO: 4227959 - DNA, 17 bp, Homo sapiens
agctgagagtctgaaag

SEQ ID NO: 4227960 - DNA, 22 bp, Homo sapiens
agctgagagtctgaaagacaga

SEQ ID NO: 4227961 - DNA, 23 bp, Homo sapiens
agctgagagtctgaaagacagaa

SEQ ID NO: 4227962 - DNA, 23 bp, Homo sapiens
agctgagtgactgtaggcaggga

SEQ ID NO: 4227963 - DNA, 11 bp, Homo sapiens
agctgcagaac

SEQ ID NO: 4227964 - DNA, 13 bp, Homo sapiens
agctgcagcccat

SEQ ID NO: 4227965 - DNA, 12 bp, Homo sapiens
agctgggaggaa

SEQ ID NO: 4227966 - DNA, 16 bp, Homo sapiens
agctgggttggaaaac

SEQ ID NO: 4227967 - DNA, 15 bp, Homo sapiens
agctggtgggaagcg

SEQ ID NO: 4227968 - DNA, 15 bp, Homo sapiens
agctgtccctgtcac

SEQ ID NO: 4227969 - DNA, 22 bp, Homo sapiens
agctgtccctgtcaccaagctc

SEQ ID NO: 4227970 - DNA, 20 bp, Homo sapiens
agctgtgtccttgcacctgc

SEQ ID NO: 4227971 - DNA, 13 bp, Homo sapiens
agcttaaaaagag

SEQ ID NO: 4227972 - DNA, 19 bp, Homo sapiens
agcttattatagaattgca

SEQ ID NO: 4227973 - DNA, 16 bp, Homo sapiens
agcttttaaaccctat

SEQ ID NO: 4227974 - DNA, 21 bp, Homo sapiens
aggaaagcgtggttccaagaa

SEQ ID NO: 4227975 - DNA, 21 bp, Homo sapiens
aggaagatgtatgctttgaat

SEQ ID NO: 4227976 - DNA, 17 bp, Homo sapiens
aggaagtctaggagctg

SEQ ID NO: 4227977 - DNA, 22 bp, Homo sapiens
aggaatgttaaagtcagtggga

SEQ ID NO: 4227978 - DNA, 18 bp, Homo sapiens
aggacaggaccagatttt

SEQ ID NO: 4227979 - DNA, 22 bp, Homo sapiens
aggacatgatactgatgccatg

SEQ ID NO: 4227980 - DNA, 17 bp, Homo sapiens
aggactgaattgtcccc

SEQ ID NO: 4227981 - DNA, 19 bp, Homo sapiens
aggactgaattgtccccag

SEQ ID NO: 4227982 - DNA, 20 bp, Homo sapiens
aggactgaattgtccccagt

SEQ ID NO: 4227983 - DNA, 13 bp, Homo sapiens
aggagactcacct

SEQ ID NO: 4227984 - DNA, 16 bp, Homo sapiens
aggagactcacctctg

SEQ ID NO: 4227985 - DNA, 16 bp, Homo sapiens
aggaggctgaggcaga

SEQ ID NO: 4227986 - DNA, 17 bp, Homo sapiens
aggagggcgtgactcac

SEQ ID NO: 4227987 - DNA, 20 bp, Homo sapiens
aggatgtaaacagtgcctgc

SEQ ID NO: 4227988 - DNA, 15 bp, Homo sapiens
aggatttataaagca

SEQ ID NO: 4227989 - DNA, 16 bp, Homo sapiens
aggcaacttgggaact

SEQ ID NO: 4227990 - DNA, 21 bp, Homo sapiens
aggcaatgctcaaacacccaa

SEQ ID NO: 4227991 - DNA, 16 bp, Homo sapiens
aggcacaaactctgca

SEQ ID NO: 4227992 - DNA, 20 bp, Homo sapiens
aggcacccttctttcctctt

SEQ ID NO: 4227993 - DNA, 14 bp, Homo sapiens
aggcacgaacccac

SEQ ID NO: 4227994 - DNA, 22 bp, Homo sapiens
aggcactataatttctgtaaca

SEQ ID NO: 4227995 - DNA, 19 bp, Homo sapiens
aggcagggccttgcccaga

SEQ ID NO: 4227996 - DNA, 21 bp, Homo sapiens
aggcagggccttgcccagaga

SEQ ID NO: 4227997 - DNA, 13 bp, Homo sapiens
aggcaggggcgga

SEQ ID NO: 4227998 - DNA, 23 bp, Homo sapiens
atgtggtttggttcctctctggt

SEQ ID NO: 4227999 - DNA, 12 bp, Homo sapiens
atgttactgaga

SEQ ID NO: 4228000 - DNA, 15 bp, Homo sapiens
atgttactgagatgt

SEQ ID NO: 4228001 - DNA, 15 bp, Homo sapiens
atgttattgcataat

SEQ ID NO: 4228002 - DNA, 15 bp, Homo sapiens
atgttccctttaaaa

SEQ ID NO: 4228003 - DNA, 14 bp, Homo sapiens
atgtttaaataaat

SEQ ID NO: 4228004 - DNA, 18 bp, Homo sapiens
atgtttagattccaggat

SEQ ID NO: 4228005 - DNA, 17 bp, Homo sapiens
atgtttataaactgaga

SEQ ID NO: 4228006 - DNA, 18 bp, Homo sapiens
atgtttataaactgagag

SEQ ID NO: 4228007 - DNA, 20 bp, Homo sapiens
atgtttggttttccaaaaga

SEQ ID NO: 4228008 - DNA, 23 bp, Homo sapiens
attaaaaaaaagaagagccttgt

SEQ ID NO: 4228009 - DNA, 17 bp, Homo sapiens
attaaacgagataatgt

SEQ ID NO: 4228010 - DNA, 23 bp, Homo sapiens
attaactgctccaaatttaacca

SEQ ID NO: 4228011 - DNA, 16 bp, Homo sapiens
attaattatatttcta

SEQ ID NO: 4228012 - DNA, 13 bp, Homo sapiens
attaatttgtgaa

SEQ ID NO: 4228013 - DNA, 14 bp, Homo sapiens
attaatttgtgaat

SEQ ID NO: 4228014 - DNA, 17 bp, Homo sapiens
attaatttgtgaatttg

SEQ ID NO: 4228015 - DNA, 13 bp, Homo sapiens
attaccaaaacag

SEQ ID NO: 4228016 - DNA, 11 bp, Homo sapiens
attactccaag

SEQ ID NO: 4228017 - DNA, 19 bp, Homo sapiens
attagattatttctgtatt

SEQ ID NO: 4228018 - DNA, 21 bp, Homo sapiens
attataactgaaggagaaggt

SEQ ID NO: 4228019 - DNA, 16 bp, Homo sapiens
attattcagtgaattt

SEQ ID NO: 4228020 - DNA, 14 bp, Homo sapiens
attcaaccttacca

SEQ ID NO: 4228021 - DNA, 17 bp, Homo sapiens
attcaaccttaccaaaa

SEQ ID NO: 4228022 - DNA, 21 bp, Homo sapiens
attcagcatttgttctttgcc

SEQ ID NO: 4228023 - DNA, 13 bp, Homo sapiens
attcagtgaattt

SEQ ID NO: 4228024 - DNA, 16 bp, Homo sapiens
attcagtgaatttgtc

SEQ ID NO: 4228025 - DNA, 16 bp, Homo sapiens
attcatctctcaaact

SEQ ID NO: 4228026 - DNA, 17 bp, Homo sapiens
attcatctctcaaactt

SEQ ID NO: 4228027 - DNA, 21 bp, Homo sapiens
attcatgtttaacgtttctca

SEQ ID NO: 4228028 - DNA, 17 bp, Homo sapiens
attccacccctcctcga

SEQ ID NO: 4228029 - DNA, 16 bp, Homo sapiens
attcctgaagccagat

SEQ ID NO: 4228030 - DNA, 15 bp, Homo sapiens
attctcactccacca

SEQ ID NO: 4228031 - DNA, 18 bp, Homo sapiens
attctgatgttactgaga

SEQ ID NO: 4228032 - DNA, 16 bp, Homo sapiens
attgaaaaataaaaac

SEQ ID NO: 4228033 - DNA, 13 bp, Homo sapiens
attgcacttttaa

SEQ ID NO: 4228034 - DNA, 15 bp, Homo sapiens
attggtaattaaaag

SEQ ID NO: 4228035 - DNA, 18 bp, Homo sapiens
attggtaattaaaagact

SEQ ID NO: 4228036 - DNA, 17 bp, Homo sapiens
attggtccagcttgctc

SEQ ID NO: 4228037 - DNA, 16 bp, Homo sapiens
attggtggctttcctt

SEQ ID NO: 4228038 - DNA, 14 bp, Homo sapiens
attgtaaatctgaa

SEQ ID NO: 4228039 - DNA, 16 bp, Homo sapiens
attgtaaatctgaaga

SEQ ID NO: 4228040 - DNA, 17 bp, Homo sapiens
attgtaaatctgaagaa

SEQ ID NO: 4228041 - DNA, 12 bp, Homo sapiens
attgtgaaaaaa

SEQ ID NO: 4228042 - DNA, 19 bp, Homo sapiens
atttaaaaaataaatataa

SEQ ID NO: 4228043 - DNA, 22 bp, Homo sapiens
atttaaaaaataaatataattg

SEQ ID NO: 4228044 - DNA, 15 bp, Homo sapiens
atttaacatgggagg

SEQ ID NO: 4228045 - DNA, 12 bp, Homo sapiens
atttaatttgta

SEQ ID NO: 4228046 - DNA, 13 bp, Homo sapiens
atttaatttgtat

SEQ ID NO: 4228047 - DNA, 20 bp, Homo sapiens
atttagagtcaatttgctga

SEQ ID NO: 4228048 - DNA, 19 bp, Homo sapiens
atttagttgtggaaagata

SEQ ID NO: 4228049 - DNA, 13 bp, Homo sapiens
atttataaagcaa

SEQ ID NO: 4228050 - DNA, 14 bp, Homo sapiens
atttcacatggact

SEQ ID NO: 4228051 - DNA, 20 bp, Homo sapiens
atttcacatggactttggaa

SEQ ID NO: 4228052 - DNA, 15 bp, Homo sapiens
atttccccaccccac

SEQ ID NO: 4228053 - DNA, 19 bp, Homo sapiens
atttccttgtgctcctgcc

SEQ ID NO: 4228054 - DNA, 17 bp, Homo sapiens
atttctgtatttggcta

SEQ ID NO: 4228055 - DNA, 16 bp, Homo sapiens
atttgaaaaaactttc

SEQ ID NO: 4228056 - DNA, 15 bp, Homo sapiens
atttgctgaaaacat

SEQ ID NO: 4228057 - DNA, 17 bp, Homo sapiens
atttgtgaatttgcaac

SEQ ID NO: 4228058 - DNA, 14 bp, Homo sapiens
atttgttctttgcc

SEQ ID NO: 4228059 - DNA, 15 bp, Homo sapiens
atttgttctttgcca

SEQ ID NO: 4228060 - DNA, 20 bp, Homo sapiens
attttaaaaacatgagaaat

SEQ ID NO: 4228061 - DNA, 22 bp, Homo sapiens
attttaaaaacatgagaaatgt

SEQ ID NO: 4228062 - DNA, 14 bp, Homo sapiens
attttataccaaag

SEQ ID NO: 4228063 - DNA, 20 bp, Homo sapiens
attttccacaagattcccag

SEQ ID NO: 4228064 - DNA, 22 bp, Homo sapiens
attttgtctcctacctgctgct

SEQ ID NO: 4228065 - DNA, 14 bp, Homo sapiens
atttttacaaaact

SEQ ID NO: 4228066 - DNA, 16 bp, Homo sapiens
atttttacaaaactgc

SEQ ID NO: 4228067 - DNA, 17 bp, Homo sapiens
atttttccaatcacagt

SEQ ID NO: 4228068 - DNA, 16 bp, Homo sapiens
atttttttaaatttca

SEQ ID NO: 4228069 - DNA, 21 bp, Homo sapiens
caaaaaccaaaagtgcattca

SEQ ID NO: 4228070 - DNA, 22 bp, Homo sapiens
caaaaaccaaaagtgcattcaa

SEQ ID NO: 4228071 - DNA, 20 bp, Homo sapiens
caaaacaggaggggaaaaaa

SEQ ID NO: 4228072 - DNA, 18 bp, Homo sapiens
caaaagatgggtggttga

SEQ ID NO: 4228073 - DNA, 15 bp, Homo sapiens
caaaaggtgcctgtg

SEQ ID NO: 4228074 - DNA, 23 bp, Homo sapiens
caaaaggtgcctgtgaggcaggg

SEQ ID NO: 4228075 - DNA, 20 bp, Homo sapiens
caaaagtgcattcaacctta

SEQ ID NO: 4228076 - DNA, 23 bp, Homo sapiens
caaaagtgcattcaaccttacca

SEQ ID NO: 4228077 - DNA, 18 bp, Homo sapiens
caaacatggaaaacagag

SEQ ID NO: 4228078 - DNA, 20 bp, Homo sapiens
caaacttagtttttatcttt

SEQ ID NO: 4228079 - DNA, 17 bp, Homo sapiens
caaagaaaaaaatatat

SEQ ID NO: 4228080 - DNA, 13 bp, Homo sapiens
caaagaaaaacaa

SEQ ID NO: 4228081 - DNA, 22 bp, Homo sapiens
caaagaattcctgaagccagat

SEQ ID NO: 4228082 - DNA, 18 bp, Homo sapiens
caaagcagtttttccccc

SEQ ID NO: 4228083 - DNA, 23 bp, Homo sapiens
caaagctctattaagatttccaa

SEQ ID NO: 4228084 - DNA, 14 bp, Homo sapiens
caaatgtcagagct

SEQ ID NO: 4228085 - DNA, 14 bp, Homo sapiens
caaatgttcctttt

SEQ ID NO: 4228086 - DNA, 15 bp, Homo sapiens
caaattatgtgaaat

SEQ ID NO: 4228087 - DNA, 23 bp, Homo sapiens
caaatttgccaccactagagctg

SEQ ID NO: 4228088 - DNA, 17 bp, Homo sapiens
caacagagaaggcagga

SEQ ID NO: 4228089 - DNA, 15 bp, Homo sapiens
caacatcccattgcc

SEQ ID NO: 4228090 - DNA, 19 bp, Homo sapiens
caacatcccattgccctgg

SEQ ID NO: 4228091 - DNA, 23 bp, Homo sapiens
caacatggagaaaccctgtctct

SEQ ID NO: 4228092 - DNA, 23 bp, Homo sapiens
caaccaactttccccccaacccg

SEQ ID NO: 4228093 - DNA, 17 bp, Homo sapiens
caaccccagttctgctc

SEQ ID NO: 4228094 - DNA, 19 bp, Homo sapiens
caaccgaacatgaccaaaa

SEQ ID NO: 4228095 - DNA, 20 bp, Homo sapiens
caacctgaccaacatggaga

SEQ ID NO: 4228096 - DNA, 18 bp, Homo sapiens
caacctggctccctccca

SEQ ID NO: 4228097 - DNA, 17 bp, Homo sapiens
caactcctggaagctgt

SEQ ID NO: 4228098 - DNA, 18 bp, Homo sapiens
caacttcaagtgcatgct

SEQ ID NO: 4228099 - DNA, 12 bp, Homo sapiens
caacttgggaac

SEQ ID NO: 4228100 - DNA, 18 bp, Homo sapiens
caagagcgaaactccgtc

SEQ ID NO: 4228101 - DNA, 21 bp, Homo sapiens
caagaggaaaaacagggaaaa

SEQ ID NO: 4228102 - DNA, 16 bp, Homo sapiens
caagaggctccctcct

SEQ ID NO: 4228103 - DNA, 14 bp, Homo sapiens
caagattcccagag

SEQ ID NO: 4228104 - DNA, 15 bp, Homo sapiens
caagattcccagaga

SEQ ID NO: 4228105 - DNA, 16 bp, Homo sapiens
caagattcccagagac

SEQ ID NO: 4228106 - DNA, 17 bp, Homo sapiens
caagattcccagagaca

SEQ ID NO: 4228107 - DNA, 19 bp, Homo sapiens
caagattcccagagacagg

SEQ ID NO: 4228108 - DNA, 13 bp, Homo sapiens
caagcaagaaaca

SEQ ID NO: 4228109 - DNA, 18 bp, Homo sapiens
caagcaagaaacactggg

SEQ ID NO: 4228110 - DNA, 17 bp, Homo sapiens
caagcgaggtcaacaga

SEQ ID NO: 4228111 - DNA, 12 bp, Homo sapiens
caagctcacagt

SEQ ID NO: 4228112 - DNA, 16 bp, Homo sapiens
caagctcacagttcct

SEQ ID NO: 4228113 - DNA, 15 bp, Homo sapiens
caagctgagtgactg

SEQ ID NO: 4228114 - DNA, 12 bp, Homo sapiens
caaggaggaaaa

SEQ ID NO: 4228115 - DNA, 13 bp, Homo sapiens
caagggtccagaa

SEQ ID NO: 4228116 - DNA, 17 bp, Homo sapiens
caagggtctagggagag

SEQ ID NO: 4228117 - DNA, 13 bp, Homo sapiens
caaggtttataaa

SEQ ID NO: 4228118 - DNA, 17 bp, Homo sapiens
caaggtttataaagcag

SEQ ID NO: 4228119 - DNA, 22 bp, Homo sapiens
caaggtttataaagcagattac

SEQ ID NO: 4228120 - DNA, 19 bp, Homo sapiens
caagtctggatctgggacc

SEQ ID NO: 4228121 - DNA, 21 bp, Homo sapiens
caatcccctcattcaggaaaa

SEQ ID NO: 4228122 - DNA, 13 bp, Homo sapiens
cccagttctgctc

SEQ ID NO: 4228123 - DNA, 20 bp, Homo sapiens
cccagttctgctcctctcca

SEQ ID NO: 4228124 - DNA, 21 bp, Homo sapiens
cccagttctgctcctctccag

SEQ ID NO: 4228125 - DNA, 23 bp, Homo sapiens
cccagttctgctcctctccaggc

SEQ ID NO: 4228126 - DNA, 16 bp, Homo sapiens
cccagtttgcagaaaa

SEQ ID NO: 4228127 - DNA, 23 bp, Homo sapiens
cccagtttgcagaaaagcacctg

SEQ ID NO: 4228128 - DNA, 12 bp, Homo sapiens
cccatcatccca

SEQ ID NO: 4228129 - DNA, 16 bp, Homo sapiens
cccattttataccaaa

SEQ ID NO: 4228130 - DNA, 18 bp, Homo sapiens
cccattttataccaaagg

SEQ ID NO: 4228131 - DNA, 16 bp, Homo sapiens
ccccaacccggaaaca

SEQ ID NO: 4228132 - DNA, 14 bp, Homo sapiens
ccccaactcctgga

SEQ ID NO: 4228133 - DNA, 12 bp, Homo sapiens
ccccaccaccta

SEQ ID NO: 4228134 - DNA, 23 bp, Homo sapiens
ccccaccacgatgtggccctggc

SEQ ID NO: 4228135 - DNA, 20 bp, Homo sapiens
ccccactctcattccccagg

SEQ ID NO: 4228136 - DNA, 22 bp, Homo sapiens
ccccagagtgtgggaagggaga

SEQ ID NO: 4228137 - DNA, 14 bp, Homo sapiens
ccccagttctgctc

SEQ ID NO: 4228138 - DNA, 16 bp, Homo sapiens
ccccagttctgctcct

SEQ ID NO: 4228139 - DNA, 17 bp, Homo sapiens
ccccagttctgctcctc

SEQ ID NO: 4228140 - DNA, 18 bp, Homo sapiens
ccccagttctgctcctct

SEQ ID NO: 4228141 - DNA, 21 bp, Homo sapiens
ccccagttctgctcctctcca

SEQ ID NO: 4228142 - DNA, 19 bp, Homo sapiens
ccccccaacccggaaacag

SEQ ID NO: 4228143 - DNA, 13 bp, Homo sapiens
ccccctccccagg

SEQ ID NO: 4228144 - DNA, 14 bp, Homo sapiens
cccctatccaccca

SEQ ID NO: 4228145 - DNA, 17 bp, Homo sapiens
cccctatccacccagcc

SEQ ID NO: 4228146 - DNA, 19 bp, Homo sapiens
cccctatccacccagccca

SEQ ID NO: 4228147 - DNA, 20 bp, Homo sapiens
cccctatccacccagcccat

SEQ ID NO: 4228148 - DNA, 21 bp, Homo sapiens
cccctatccacccagcccatt

SEQ ID NO: 4228149 - DNA, 14 bp, Homo sapiens
cccctcaaaagcca

SEQ ID NO: 4228150 - DNA, 18 bp, Homo sapiens
cccctcaaaagccaaaaa

SEQ ID NO: 4228151 - DNA, 15 bp, Homo sapiens
cccctccccagggga

SEQ ID NO: 4228152 - DNA, 11 bp, Homo sapiens
cccctcctctg

SEQ ID NO: 4228153 - DNA, 14 bp, Homo sapiens
ccccttcagtgccc

SEQ ID NO: 4228154 - DNA, 17 bp, Homo sapiens
ccccttgcccttgccct

SEQ ID NO: 4228155 - DNA, 19 bp, Homo sapiens
ccccttgcccttgccctga

SEQ ID NO: 4228156 - DNA, 21 bp, Homo sapiens
ccccttgcccttgccctgacc

SEQ ID NO: 4228157 - DNA, 14 bp, Homo sapiens
cccgcttgtccagc

SEQ ID NO: 4228158 - DNA, 15 bp, Homo sapiens
cccgcttgtccagcg

SEQ ID NO: 4228159 - DNA, 14 bp, Homo sapiens
ccctatccacccag

SEQ ID NO: 4228160 - DNA, 18 bp, Homo sapiens
ccctcaaatgtcagagct

SEQ ID NO: 4228161 - DNA, 15 bp, Homo sapiens
ccctcattcaggaaa

SEQ ID NO: 4228162 - DNA, 17 bp, Homo sapiens
ccctcattcaggaaaac

SEQ ID NO: 4228163 - DNA, 21 bp, Homo sapiens
ccctcccacccaaccaacttt

SEQ ID NO: 4228164 - DNA, 12 bp, Homo sapiens
ccctccccaggg

SEQ ID NO: 4228165 - DNA, 13 bp, Homo sapiens
ccctccccagggg

SEQ ID NO: 4228166 - DNA, 13 bp, Homo sapiens
ccctccctgtcct

SEQ ID NO: 4228167 - DNA, 13 bp, Homo sapiens
ccctcctcacccc

SEQ ID NO: 4228168 - DNA, 12 bp, Homo sapiens
ccctcctctgcc

SEQ ID NO: 4228169 - DNA, 16 bp, Homo sapiens
ccctcctctgccacct

SEQ ID NO: 4228170 - DNA, 15 bp, Homo sapiens
ccctgaaaacccaga

SEQ ID NO: 4228171 - DNA, 18 bp, Homo sapiens
ccctgaaaacccagagag

SEQ ID NO: 4228172 - DNA, 17 bp, Homo sapiens
ccctgagtcaccaggaa

SEQ ID NO: 4228173 - DNA, 14 bp, Homo sapiens
ccctgccagtgcct

SEQ ID NO: 4228174 - DNA, 14 bp, Homo sapiens
ccctggcctgctgg

SEQ ID NO: 4228175 - DNA, 22 bp, Homo sapiens
ccctggcctgctgggctctcca

SEQ ID NO: 4228176 - DNA, 23 bp, Homo sapiens
ccctggcttgtaactccaccaac

SEQ ID NO: 4228177 - DNA, 14 bp, Homo sapiens
ccctgggccccacc

SEQ ID NO: 4228178 - DNA, 22 bp, Homo sapiens
ccctgggccccaccacctaggc

SEQ ID NO: 4228179 - DNA, 20 bp, Homo sapiens
ccctgggggaagccctggat

SEQ ID NO: 4228180 - DNA, 15 bp, Homo sapiens
ccctgtcctcctcgg

SEQ ID NO: 4228181 - DNA, 13 bp, Homo sapiens
cccttgagacctc

SEQ ID NO: 4228182 - DNA, 14 bp, Homo sapiens
ccctttccttccta

SEQ ID NO: 4228183 - DNA, 21 bp, Homo sapiens
ccctttccttccttccctggc

SEQ ID NO: 4228184 - DNA, 15 bp, Homo sapiens
ccgaacatgaccaaa

SEQ ID NO: 4228185 - DNA, 17 bp, Homo sapiens
ccgaacatgaccaaaaa

SEQ ID NO: 4228186 - DNA, 19 bp, Homo sapiens
ccgacctcgtcctccccct

SEQ ID NO: 4228187 - DNA, 23 bp, Homo sapiens
ccgacctcgtcctccccctgcca

SEQ ID NO: 4228188 - DNA, 13 bp, Homo sapiens
ccgagagcctgct

SEQ ID NO: 4228189 - DNA, 15 bp, Homo sapiens
ccgagagcctgctcc

SEQ ID NO: 4228190 - DNA, 21 bp, Homo sapiens
ccgagagtagccgagagcctg

SEQ ID NO: 4228191 - DNA, 22 bp, Homo sapiens
ccgagagtagccgagagcctgc

SEQ ID NO: 4228192 - DNA, 13 bp, Homo sapiens
ccgcaccccagag

SEQ ID NO: 4228193 - DNA, 15 bp, Homo sapiens
ccgcatcttctccat

SEQ ID NO: 4228194 - DNA, 20 bp, Homo sapiens
ccgcatcttctccatctggc

SEQ ID NO: 4228195 - DNA, 13 bp, Homo sapiens
ccgcattccctga

SEQ ID NO: 4228196 - DNA, 14 bp, Homo sapiens
ccgcattccctgag

SEQ ID NO: 4228197 - DNA, 15 bp, Homo sapiens
ccgcattccctgagt

SEQ ID NO: 4228198 - DNA, 23 bp, Homo sapiens
ccgcattccctgagtcaccagga

SEQ ID NO: 4228199 - DNA, 20 bp, Homo sapiens
ccgctgcctaagtggctgct

SEQ ID NO: 4228200 - DNA, 14 bp, Homo sapiens
ccgctgttcaccca

SEQ ID NO: 4228201 - DNA, 18 bp, Homo sapiens
ccgctgttcacccacagg

SEQ ID NO: 4228202 - DNA, 16 bp, Homo sapiens
ccgcttgtccagcgcc

SEQ ID NO: 4228203 - DNA, 17 bp, Homo sapiens
ccgcttgtccagcgcct

SEQ ID NO: 4228204 - DNA, 22 bp, Homo sapiens
ccggcaaccccagttctgctcc

SEQ ID NO: 4228205 - DNA, 19 bp, Homo sapiens
ccggggctggcggctactc

SEQ ID NO: 4228206 - DNA, 15 bp, Homo sapiens
ccgtagttccctgaa

SEQ ID NO: 4228207 - DNA, 20 bp, Homo sapiens
ccgtctgcacttctgttcca

SEQ ID NO: 4228208 - DNA, 17 bp, Homo sapiens
ccgtctggggttcagcc

SEQ ID NO: 4228209 - DNA, 23 bp, Homo sapiens
ccgtctggggttcagcccctcct

SEQ ID NO: 4228210 - DNA, 23 bp, Homo sapiens
ccgtgatgtagggtaaggtgcct

SEQ ID NO: 4228211 - DNA, 12 bp, Homo sapiens
cctaaccccttt

SEQ ID NO: 4228212 - DNA, 13 bp, Homo sapiens
cctaccccaccac

SEQ ID NO: 4228213 - DNA, 14 bp, Homo sapiens
cctaccccaccacg

SEQ ID NO: 4228214 - DNA, 18 bp, Homo sapiens
cctaggccactcctccaa

SEQ ID NO: 4228215 - DNA, 20 bp, Homo sapiens
cctagtggggtctccctctc

SEQ ID NO: 4228216 - DNA, 23 bp, Homo sapiens
cctagtggggtctccctctcctg

SEQ ID NO: 4228217 - DNA, 14 bp, Homo sapiens
cctataacttgatg

SEQ ID NO: 4228218 - DNA, 22 bp, Homo sapiens
cctataccatatgtctgcttct

SEQ ID NO: 4228219 - DNA, 23 bp, Homo sapiens
cctataccatatgtctgcttctg

SEQ ID NO: 4228220 - DNA, 12 bp, Homo sapiens
cctatccaccca

SEQ ID NO: 4228221 - DNA, 18 bp, Homo sapiens
cctatccacccagcccat

SEQ ID NO: 4228222 - DNA, 21 bp, Homo sapiens
cctatccacccagcccattct

SEQ ID NO: 4228223 - DNA, 14 bp, Homo sapiens
cctatttatgaaaa

SEQ ID NO: 4228224 - DNA, 16 bp, Homo sapiens
cctcaaaagccaaaaa

SEQ ID NO: 4228225 - DNA, 20 bp, Homo sapiens
cctcagagtcccggcgttta

SEQ ID NO: 4228226 - DNA, 11 bp, Homo sapiens
cctcagggaca

SEQ ID NO: 4228227 - DNA, 21 bp, Homo sapiens
cctcagggacagagacacctg

SEQ ID NO: 4228228 - DNA, 22 bp, Homo sapiens
cctcagggacagagacacctgc

SEQ ID NO: 4228229 - DNA, 24 bp, Homo sapiens
cctcagggacagagacacctgcac

SEQ ID NO: 4228230 - DNA, 22 bp, Homo sapiens
cctcattcaggaaaactgacag

SEQ ID NO: 4228231 - DNA, 13 bp, Homo sapiens
cctcccagcccta

SEQ ID NO: 4228232 - DNA, 19 bp, Homo sapiens
cctcccagccctatggatg

SEQ ID NO: 4228233 - DNA, 15 bp, Homo sapiens
cctccccccactgca

SEQ ID NO: 4228234 - DNA, 18 bp, Homo sapiens
cctccccccactgcaggc

SEQ ID NO: 4228235 - DNA, 13 bp, Homo sapiens
cctccccctgcca

SEQ ID NO: 4228236 - DNA, 17 bp, Homo sapiens
cctccccctgccagtgc

SEQ ID NO: 4228237 - DNA, 16 bp, Homo sapiens
cctcccctccactcct

SEQ ID NO: 4228238 - DNA, 11 bp, Homo sapiens
cctccctgtcc

SEQ ID NO: 4228239 - DNA, 13 bp, Homo sapiens
cctcctcaccccg

SEQ ID NO: 4228240 - DNA, 15 bp, Homo sapiens
cctcctcaccccgtc

SEQ ID NO: 4228241 - DNA, 13 bp, Homo sapiens
cctcctccacagc

SEQ ID NO: 4228242 - DNA, 12 bp, Homo sapiens
cctcgccctggg

SEQ ID NO: 4228243 - DNA, 20 bp, Homo sapiens
cctcgtcctccccctgccag

SEQ ID NO: 4228244 - DNA, 22 bp, Homo sapiens
cctctaataaagctcctctgct

SEQ ID NO: 4228245 - DNA, 11 bp, Homo sapiens
cctctccaggc

SEQ ID NO: 4228246 - DNA, 13 bp, Homo sapiens
cctctccaggcac

SEQ ID NO: 4228247 - DNA, 14 bp, Homo sapiens
gaagccctccttcc

SEQ ID NO: 4228248 - DNA, 16 bp, Homo sapiens
gaagccctccttccac

SEQ ID NO: 4228249 - DNA, 22 bp, Homo sapiens
gaagccctggatttcagaaaga

SEQ ID NO: 4228250 - DNA, 17 bp, Homo sapiens
gaagctgtgtccttgca

SEQ ID NO: 4228251 - DNA, 23 bp, Homo sapiens
gaagctgtgtccttgcacctgca

SEQ ID NO: 4228252 - DNA, 23 bp, Homo sapiens
gaaggaaggagactcacctctgc

SEQ ID NO: 4228253 - DNA, 16 bp, Homo sapiens
gaaggagaaggaagga

SEQ ID NO: 4228254 - DNA, 20 bp, Homo sapiens
gaaggagactcacctctgcc

SEQ ID NO: 4228255 - DNA, 22 bp, Homo sapiens
gaaggagactcacctctgcctc

SEQ ID NO: 4228256 - DNA, 22 bp, Homo sapiens
gaaggtgccccaaaatgcaaga

SEQ ID NO: 4228257 - DNA, 16 bp, Homo sapiens
gaagtctaggagctgg

SEQ ID NO: 4228258 - DNA, 21 bp, Homo sapiens
gaatattggtaattaaaagac

SEQ ID NO: 4228259 - DNA, 22 bp, Homo sapiens
gaatcagaccctaccccaccac

SEQ ID NO: 4228260 - DNA, 16 bp, Homo sapiens
gaatccttccatttct

SEQ ID NO: 4228261 - DNA, 14 bp, Homo sapiens
gaatgagagtgtga

SEQ ID NO: 4228262 - DNA, 22 bp, Homo sapiens
gaatgatttccaaagagaaaaa

SEQ ID NO: 4228263 - DNA, 18 bp, Homo sapiens
gaattagattatttctgt

SEQ ID NO: 4228264 - DNA, 15 bp, Homo sapiens
gaattattcagtgaa

SEQ ID NO: 4228265 - DNA, 17 bp, Homo sapiens
gaattattcagtgaatt

SEQ ID NO: 4228266 - DNA, 18 bp, Homo sapiens
gaattattcagtgaattt

SEQ ID NO: 4228267 - DNA, 17 bp, Homo sapiens
gaattcctgaagccaga

SEQ ID NO: 4228268 - DNA, 19 bp, Homo sapiens
gaatttagtcacaccatct

SEQ ID NO: 4228269 - DNA, 21 bp, Homo sapiens
gaatttgtccattgtaaatct

SEQ ID NO: 4228270 - DNA, 23 bp, Homo sapiens
gaattttcagaccccagcggctg

SEQ ID NO: 4228271 - DNA, 16 bp, Homo sapiens
gacaaaaacagcctca

SEQ ID NO: 4228272 - DNA, 18 bp, Homo sapiens
gacaaaaacagcctcaca

SEQ ID NO: 4228273 - DNA, 20 bp, Homo sapiens
gacaaaaacagcctcacaga

SEQ ID NO: 4228274 - DNA, 13 bp, Homo sapiens
gacaacagactga

SEQ ID NO: 4228275 - DNA, 17 bp, Homo sapiens
gacaagcctgtccattg

SEQ ID NO: 4228276 - DNA, 13 bp, Homo sapiens
gacacctgcacct

SEQ ID NO: 4228277 - DNA, 17 bp, Homo sapiens
gacacctgcacctcccc

SEQ ID NO: 4228278 - DNA, 20 bp, Homo sapiens
gacagaccggggttcaagcc

SEQ ID NO: 4228279 - DNA, 17 bp, Homo sapiens
gacagagacacctgcac

SEQ ID NO: 4228280 - DNA, 21 bp, Homo sapiens
gacagagacacctgcacctcc

SEQ ID NO: 4228281 - DNA, 22 bp, Homo sapiens
gacagagacacctgcacctccc

SEQ ID NO: 4228282 - DNA, 12 bp, Homo sapiens
gacagaggaggg

SEQ ID NO: 4228283 - DNA, 22 bp, Homo sapiens
gacagcctgtggcggtgcctgg

SEQ ID NO: 4228284 - DNA, 16 bp, Homo sapiens
gacagctgtccctgtc

SEQ ID NO: 4228285 - DNA, 19 bp, Homo sapiens
gacagctgtccctgtcacc

SEQ ID NO: 4228286 - DNA, 18 bp, Homo sapiens
gacaggaaaatcctctgg

SEQ ID NO: 4228287 - DNA, 18 bp, Homo sapiens
gacatagtggatggacag

SEQ ID NO: 4228288 - DNA, 19 bp, Homo sapiens
gacatagtggatggacaga

SEQ ID NO: 4228289 - DNA, 23 bp, Homo sapiens
gacatagtggatggacagatgga

SEQ ID NO: 4228290 - DNA, 21 bp, Homo sapiens
gaccaacatggagaaaccctg

SEQ ID NO: 4228291 - DNA, 22 bp, Homo sapiens
gacccatttccttgtgctcctg

SEQ ID NO: 4228292 - DNA, 19 bp, Homo sapiens
gaccccagcggctgagtca

SEQ ID NO: 4228293 - DNA, 16 bp, Homo sapiens
gaccctaccccaccac

SEQ ID NO: 4228294 - DNA, 21 bp, Homo sapiens
gaccctttccttccttccctg

SEQ ID NO: 4228295 - DNA, 19 bp, Homo sapiens
gacctagctgttgtaaaga

SEQ ID NO: 4228296 - DNA, 22 bp, Homo sapiens
gacctcccagccctatggatgt

SEQ ID NO: 4228297 - DNA, 16 bp, Homo sapiens
gacctcgtcctccccc

SEQ ID NO: 4228298 - DNA, 17 bp, Homo sapiens
gactcaagggtccagaa

SEQ ID NO: 4228299 - DNA, 19 bp, Homo sapiens
gactcacaggttggaagag

SEQ ID NO: 4228300 - DNA, 15 bp, Homo sapiens
gactgggctagggag

SEQ ID NO: 4228301 - DNA, 13 bp, Homo sapiens
gagaaatatttat

SEQ ID NO: 4228302 - DNA, 19 bp, Homo sapiens
gagacaggaaaatcctctg

SEQ ID NO: 4228303 - DNA, 16 bp, Homo sapiens
gagaccaacctgacca

SEQ ID NO: 4228304 - DNA, 17 bp, Homo sapiens
gagaccaacctgaccaa

SEQ ID NO: 4228305 - DNA, 17 bp, Homo sapiens
gagactcacctctgcct

SEQ ID NO: 4228306 - DNA, 19 bp, Homo sapiens
gagactcacctctgcctca

SEQ ID NO: 4228307 - DNA, 20 bp, Homo sapiens
gagagacccaaggaggaaaa

SEQ ID NO: 4228308 - DNA, 12 bp, Homo sapiens
gagagccagccc

SEQ ID NO: 4228309 - DNA, 13 bp, Homo sapiens
gagagccagccct

SEQ ID NO: 4228310 - DNA, 14 bp, Homo sapiens
gagagccagccctc

SEQ ID NO: 4228311 - DNA, 14 bp, Homo sapiens
gagagcctgctccc

SEQ ID NO: 4228312 - DNA, 20 bp, Homo sapiens
gagagtgtgaaatagacatt

SEQ ID NO: 4228313 - DNA, 22 bp, Homo sapiens
gagatgcctccaccgctgccta

SEQ ID NO: 4228314 - DNA, 23 bp, Homo sapiens
gagattagtaaatatgtgaagaa

SEQ ID NO: 4228315 - DNA, 15 bp, Homo sapiens
gagcaccaggcacga

SEQ ID NO: 4228316 - DNA, 20 bp, Homo sapiens
gagcactttattctcctccg

SEQ ID NO: 4228317 - DNA, 15 bp, Homo sapiens
gagcagatcttggaa

SEQ ID NO: 4228318 - DNA, 21 bp, Homo sapiens
gagccagccctccctgtcctc

SEQ ID NO: 4228319 - DNA, 22 bp, Homo sapiens
gagccgcatcttctccatctgg

SEQ ID NO: 4228320 - DNA, 13 bp, Homo sapiens
gagcctgctcccc

SEQ ID NO: 4228321 - DNA, 17 bp, Homo sapiens
gagcctgctcccccacc

SEQ ID NO: 4228322 - DNA, 18 bp, Homo sapiens
gagcctgctcccccaccc

SEQ ID NO: 4228323 - DNA, 19 bp, Homo sapiens
gagccttggtgtccacctg

SEQ ID NO: 4228324 - DNA, 20 bp, Homo sapiens
gagccttggtgtccacctgg

SEQ ID NO: 4228325 - DNA, 22 bp, Homo sapiens
gagccttggtgtccacctggcc

SEQ ID NO: 4228326 - DNA, 18 bp, Homo sapiens
gagcgatcgctcccctgg

SEQ ID NO: 4228327 - DNA, 19 bp, Homo sapiens
gagctagcgctgccgcacc

SEQ ID NO: 4228328 - DNA, 23 bp, Homo sapiens
gagctagcgctgccgcaccccag

SEQ ID NO: 4228329 - DNA, 19 bp, Homo sapiens
gagctcctctgtcctgctt

SEQ ID NO: 4228330 - DNA, 13 bp, Homo sapiens
gagctgagatcgt

SEQ ID NO: 4228331 - DNA, 20 bp, Homo sapiens
gaggagaagaattttcagac

SEQ ID NO: 4228332 - DNA, 22 bp, Homo sapiens
gaggagaagaattttcagaccc

SEQ ID NO: 4228333 - DNA, 20 bp, Homo sapiens
gaggagggcgtgactcaccc

SEQ ID NO: 4228334 - DNA, 21 bp, Homo sapiens
gaggcagggccttgcccagag

SEQ ID NO: 4228335 - DNA, 14 bp, Homo sapiens
gaggcaggggcgga

SEQ ID NO: 4228336 - DNA, 15 bp, Homo sapiens
gaggctccctcctgt

SEQ ID NO: 4228337 - DNA, 16 bp, Homo sapiens
gaggctgaggcagaag

SEQ ID NO: 4228338 - DNA, 15 bp, Homo sapiens
gaggctggaggcagg

SEQ ID NO: 4228339 - DNA, 16 bp, Homo sapiens
gaggctggaggcaggg

SEQ ID NO: 4228340 - DNA, 16 bp, Homo sapiens
gaggcttcttcagatc

SEQ ID NO: 4228341 - DNA, 15 bp, Homo sapiens
gagggaacagacagg

SEQ ID NO: 4228342 - DNA, 19 bp, Homo sapiens
gagggaacagacaggagaa

SEQ ID NO: 4228343 - DNA, 14 bp, Homo sapiens
gagggcagaggctg

SEQ ID NO: 4228344 - DNA, 15 bp, Homo sapiens
gagggcagaggctgg

SEQ ID NO: 4228345 - DNA, 20 bp, Homo sapiens
gaggtggaagccctccttcc

SEQ ID NO: 4228346 - DNA, 20 bp, Homo sapiens
gaggtggatcacagaggctt

SEQ ID NO: 4228347 - DNA, 19 bp, Homo sapiens
gaggttgcagtgagctgag

SEQ ID NO: 4228348 - DNA, 19 bp, Homo sapiens
gagtcaatcccctcattca

SEQ ID NO: 4228349 - DNA, 12 bp, Homo sapiens
gagtcaatttgc

SEQ ID NO: 4228350 - DNA, 19 bp, Homo sapiens
gagtcatgatctccctgcc

SEQ ID NO: 4228351 - DNA, 22 bp, Homo sapiens
gagtctgaaagacagaatgtca

SEQ ID NO: 4228352 - DNA, 21 bp, Homo sapiens
gagtgactgtaggcagggaac

SEQ ID NO: 4228353 - DNA, 16 bp, Homo sapiens
gagttgttttcagact

SEQ ID NO: 4228354 - DNA, 18 bp, Homo sapiens
gagtttttatggggctga

SEQ ID NO: 4228355 - DNA, 18 bp, Homo sapiens
gataaataatcggcccac

SEQ ID NO: 4228356 - DNA, 15 bp, Homo sapiens
gataaatttgttgaa

SEQ ID NO: 4228357 - DNA, 18 bp, Homo sapiens
gataactgcaattttaat

SEQ ID NO: 4228358 - DNA, 21 bp, Homo sapiens
gataactgcaattttaattga

SEQ ID NO: 4228359 - DNA, 16 bp, Homo sapiens
gataataaattgattt

SEQ ID NO: 4228360 - DNA, 15 bp, Homo sapiens
gataatgctgttgcc

SEQ ID NO: 4228361 - DNA, 20 bp, Homo sapiens
gatacaacttcaagtgcatg

SEQ ID NO: 4228362 - DNA, 22 bp, Homo sapiens
gatattgtcagagttctgctct

SEQ ID NO: 4228363 - DNA, 19 bp, Homo sapiens
gatatttatggggggagaa

SEQ ID NO: 4228364 - DNA, 14 bp, Homo sapiens
gatcacctgaggtc

SEQ ID NO: 4228365 - DNA, 13 bp, Homo sapiens
gatcactgagcca

SEQ ID NO: 4228366 - DNA, 16 bp, Homo sapiens
gatccaccctatccct

SEQ ID NO: 4228367 - DNA, 14 bp, Homo sapiens
gatcgctcccctgg

SEQ ID NO: 4228368 - DNA, 14 bp, Homo sapiens
gatctccctgccgc

SEQ ID NO: 4228369 - DNA, 17 bp, Homo sapiens
gatctgggaccctttcc

SEQ ID NO: 4228370 - DNA, 18 bp, Homo sapiens
gtggggctgctcctccag

SEQ ID NO: 4228371 - DNA, 22 bp, Homo sapiens
gtgggggcagagggcagaggct

SEQ ID NO: 4228372 - DNA, 22 bp, Homo sapiens
gtggttccaagaaagatccacc

SEQ ID NO: 4228373 - DNA, 21 bp, Homo sapiens
gtggtttggttcctctctggt

SEQ ID NO: 4228374 - DNA, 18 bp, Homo sapiens
gtgtattttttaaaaaat

SEQ ID NO: 4228375 - DNA, 13 bp, Homo sapiens
gtgtccacctggc

SEQ ID NO: 4228376 - DNA, 19 bp, Homo sapiens
gtgtccttgcacctgcatc

SEQ ID NO: 4228377 - DNA, 23 bp, Homo sapiens
gtgtcgctctgctggcctggccg

SEQ ID NO: 4228378 - DNA, 13 bp, Homo sapiens
gtgtgggaaggga

SEQ ID NO: 4228379 - DNA, 15 bp, Homo sapiens
gtgtgtttctgatct

SEQ ID NO: 4228380 - DNA, 21 bp, Homo sapiens
gttaccattatttaatttgta

SEQ ID NO: 4228381 - DNA, 15 bp, Homo sapiens
gttactcagccctgg

SEQ ID NO: 4228382 - DNA, 17 bp, Homo sapiens
gttactcagccctgggc

SEQ ID NO: 4228383 - DNA, 14 bp, Homo sapiens
gttactctccaacc

SEQ ID NO: 4228384 - DNA, 22 bp, Homo sapiens
gttagtatctttattaattttt

SEQ ID NO: 4228385 - DNA, 17 bp, Homo sapiens
gttattcttggtactgt

SEQ ID NO: 4228386 - DNA, 16 bp, Homo sapiens
gttcacccacagggct

SEQ ID NO: 4228387 - DNA, 20 bp, Homo sapiens
gttcagcccctcctctgcca

SEQ ID NO: 4228388 - DNA, 21 bp, Homo sapiens
gttcagcccctcctctgccac

SEQ ID NO: 4228389 - DNA, 22 bp, Homo sapiens
gttcagcccctcctctgccacc

SEQ ID NO: 4228390 - DNA, 22 bp, Homo sapiens
gttccaggtttttctggcattt

SEQ ID NO: 4228391 - DNA, 19 bp, Homo sapiens
gttccctgaaaacccagag

SEQ ID NO: 4228392 - DNA, 20 bp, Homo sapiens
gttccctgaaaacccagaga

SEQ ID NO: 4228393 - DNA, 15 bp, Homo sapiens
gttcctcgccctggg

SEQ ID NO: 4228394 - DNA, 19 bp, Homo sapiens
gttcgagaccaacctgacc

SEQ ID NO: 4228395 - DNA, 14 bp, Homo sapiens
gttctgctcctctc

SEQ ID NO: 4228396 - DNA, 15 bp, Homo sapiens
gttctgctcctctcc

SEQ ID NO: 4228397 - DNA, 10 bp, Homo sapiens
gttgaagaaa

SEQ ID NO: 4228398 - DNA, 20 bp, Homo sapiens
gttgaatattggtaattaaa

SEQ ID NO: 4228399 - DNA, 23 bp, Homo sapiens
gttgagggaacagacaggagaaa

SEQ ID NO: 4228400 - DNA, 16 bp, Homo sapiens
gttgctgatgtttata

SEQ ID NO: 4228401 - DNA, 16 bp, Homo sapiens
gttggaagagaatcac

SEQ ID NO: 4228402 - DNA, 15 bp, Homo sapiens
gttgtaatagtccat

SEQ ID NO: 4228403 - DNA, 14 bp, Homo sapiens
gtttataaagcaga

SEQ ID NO: 4228404 - DNA, 21 bp, Homo sapiens
gtttcagagacaacttcccaa

SEQ ID NO: 4228405 - DNA, 21 bp, Homo sapiens
gtttcttggggtcccagggaa

SEQ ID NO: 4228406 - DNA, 21 bp, Homo sapiens
gtttgcagaaaagcacctgcc

SEQ ID NO: 4228407 - DNA, 15 bp, Homo sapiens
gttttaaatatgaac

SEQ ID NO: 4228408 - DNA, 15 bp, Homo sapiens
gttttccaaaagaac

SEQ ID NO: 4228409 - DNA, 12 bp, Homo sapiens
gttttcttccca

SEQ ID NO: 4228410 - DNA, 16 bp, Homo sapiens
gtttttatctttgacc

SEQ ID NO: 4228411 - DNA, 15 bp, Homo sapiens
taaaaaaaagaagag

SEQ ID NO: 4228412 - DNA, 16 bp, Homo sapiens
taaaaacatgagaaat

SEQ ID NO: 4228413 - DNA, 20 bp, Homo sapiens
taaaaacatgagaaatgtga

SEQ ID NO: 4228414 - DNA, 18 bp, Homo sapiens
taaaagcaaaaagatgta

SEQ ID NO: 4228415 - DNA, 14 bp, Homo sapiens
taaaattgcacttt

SEQ ID NO: 4228416 - DNA, 12 bp, Homo sapiens
taaacagtgcct

SEQ ID NO: 4228417 - DNA, 18 bp, Homo sapiens
taaactaccctccagagt

SEQ ID NO: 4228418 - DNA, 15 bp, Homo sapiens
taaactccaggattt

SEQ ID NO: 4228419 - DNA, 23 bp, Homo sapiens
taaactccaggatttataaagca

SEQ ID NO: 4228420 - DNA, 17 bp, Homo sapiens
taaactgaaaaatgtca

SEQ ID NO: 4228421 - DNA, 19 bp, Homo sapiens
taaactgaaaaatgtcagt

SEQ ID NO: 4228422 - DNA, 14 bp, Homo sapiens
taaagctcctctgc

SEQ ID NO: 4228423 - DNA, 16 bp, Homo sapiens
taaagctcctctgctc

SEQ ID NO: 4228424 - DNA, 19 bp, Homo sapiens
taaatagttttaaatatga

SEQ ID NO: 4228425 - DNA, 24 bp, Homo sapiens
taaatagttttaaatatgaacaaa

SEQ ID NO: 4228426 - DNA, 20 bp, Homo sapiens
taaatatgtgaagaaaaaga

SEQ ID NO: 4228427 - DNA, 21 bp, Homo sapiens
taaatatgtgaagaaaaagac

SEQ ID NO: 4228428 - DNA, 13 bp, Homo sapiens
taaatctgaagaa

SEQ ID NO: 4228429 - DNA, 14 bp, Homo sapiens
taaatctgaagaaa

SEQ ID NO: 4228430 - DNA, 20 bp, Homo sapiens
taaatctgaagaaagttatt

SEQ ID NO: 4228431 - DNA, 17 bp, Homo sapiens
taaatgctttatgcaaa

SEQ ID NO: 4228432 - DNA, 13 bp, Homo sapiens
taaatgtggtaaa

SEQ ID NO: 4228433 - DNA, 16 bp, Homo sapiens
taaattaaaaaagaaa

SEQ ID NO: 4228434 - DNA, 20 bp, Homo sapiens
taacaaactacatgtaatcc

SEQ ID NO: 4228435 - DNA, 13 bp, Homo sapiens
taacatccagaag

SEQ ID NO: 4228436 - DNA, 12 bp, Homo sapiens
taacatttccta

SEQ ID NO: 4228437 - DNA, 16 bp, Homo sapiens
taactgaaggagaagg

SEQ ID NO: 4228438 - DNA, 12 bp, Homo sapiens
taactgcaattt

SEQ ID NO: 4228439 - DNA, 20 bp, Homo sapiens
taactgcaattttaattgat

SEQ ID NO: 4228440 - DNA, 15 bp, Homo sapiens
taactgctccaaatt

SEQ ID NO: 4228441 - DNA, 12 bp, Homo sapiens
taacttgatgca

SEQ ID NO: 4228442 - DNA, 16 bp, Homo sapiens
taacttgatgcatgtg

SEQ ID NO: 4228443 - DNA, 13 bp, Homo sapiens
taagaaaaccaaa

SEQ ID NO: 4228444 - DNA, 22 bp, Homo sapiens
taagtctcctttactgaatgta

SEQ ID NO: 4228445 - DNA, 17 bp, Homo sapiens
taataaagctcctctgc

SEQ ID NO: 4228446 - DNA, 14 bp, Homo sapiens
taatagtccatgga

SEQ ID NO: 4228447 - DNA, 21 bp, Homo sapiens
taatatagtaggggttgaaga

SEQ ID NO: 4228448 - DNA, 17 bp, Homo sapiens
taatattcctatatgta

SEQ ID NO: 4228449 - DNA, 20 bp, Homo sapiens
taatcagagttaccattatt

SEQ ID NO: 4228450 - DNA, 15 bp, Homo sapiens
taatcggcccacagc

SEQ ID NO: 4228451 - DNA, 17 bp, Homo sapiens
taatgatgtcgtttgaa

SEQ ID NO: 4228452 - DNA, 23 bp, Homo sapiens
taatgatgtcgtttgaatcacag

SEQ ID NO: 4228453 - DNA, 16 bp, Homo sapiens
taatgctgttgcctca

SEQ ID NO: 4228454 - DNA, 22 bp, Homo sapiens
taatgtcaccaccttcccagct

SEQ ID NO: 4228455 - DNA, 13 bp, Homo sapiens
taatgttgaatgt

SEQ ID NO: 4228456 - DNA, 19 bp, Homo sapiens
taatgttgaatgtattttg

SEQ ID NO: 4228457 - DNA, 16 bp, Homo sapiens
taatgtttttctggaa

SEQ ID NO: 4228458 - DNA, 13 bp, Homo sapiens
taattaaaagact

SEQ ID NO: 4228459 - DNA, 20 bp, Homo sapiens
taattgggattttaaaaaca

SEQ ID NO: 4228460 - DNA, 22 bp, Homo sapiens
taatttgtatgctaaatgagga

SEQ ID NO: 4228461 - DNA, 20 bp, Homo sapiens
taatttgtgaatttgcaaca

SEQ ID NO: 4228462 - DNA, 16 bp, Homo sapiens
taatttttttaaattt

SEQ ID NO: 4228463 - DNA, 12 bp, Homo sapiens
tacaaatgtgat

SEQ ID NO: 4228464 - DNA, 13 bp, Homo sapiens
tacaaatgtgata

SEQ ID NO: 4228465 - DNA, 24 bp, Homo sapiens
tacaccatgtttgagctcagaccc

SEQ ID NO: 4228466 - DNA, 18 bp, Homo sapiens
tacagggtagcaggtacc

SEQ ID NO: 4228467 - DNA, 13 bp, Homo sapiens
tacagtggagaaa

SEQ ID NO: 4228468 - DNA, 22 bp, Homo sapiens
tacattaattattattgctgtt

SEQ ID NO: 4228469 - DNA, 23 bp, Homo sapiens
tacattaattattattgctgttg

SEQ ID NO: 4228470 - DNA, 13 bp, Homo sapiens
tacatttgtgctg

SEQ ID NO: 4228471 - DNA, 19 bp, Homo sapiens
tacatttgtgctgttttca

SEQ ID NO: 4228472 - DNA, 17 bp, Homo sapiens
taccaagtaaccatttc

SEQ ID NO: 4228473 - DNA, 18 bp, Homo sapiens
taccatatgtctgcttct

SEQ ID NO: 4228474 - DNA, 15 bp, Homo sapiens
taccgcagtggctct

SEQ ID NO: 4228475 - DNA, 15 bp, Homo sapiens
tacctcaaaacactt

SEQ ID NO: 4228476 - DNA, 11 bp, Homo sapiens
tacctcctgcc

SEQ ID NO: 4228477 - DNA, 16 bp, Homo sapiens
tacctcctgcccagga

SEQ ID NO: 4228478 - DNA, 22 bp, Homo sapiens
tacctcgtggtgtgtttgcctt

SEQ ID NO: 4228479 - DNA, 14 bp, Homo sapiens
tacctttgaaatat

SEQ ID NO: 4228480 - DNA, 14 bp, Homo sapiens
tactcagccctggg

SEQ ID NO: 4228481 - DNA, 16 bp, Homo sapiens
tactcagccctgggcc

SEQ ID NO: 4228482 - DNA, 22 bp, Homo sapiens
tactcagccctgggccccacca

SEQ ID NO: 4228483 - DNA, 22 bp, Homo sapiens
tactccaaggtttataaagcag

SEQ ID NO: 4228484 - DNA, 14 bp, Homo sapiens
tactctccaacctg

SEQ ID NO: 4228485 - DNA, 16 bp, Homo sapiens
tactctccaacctgga

SEQ ID NO: 4228486 - DNA, 20 bp, Homo sapiens
tactgccggtcacccaggct

SEQ ID NO: 4228487 - DNA, 22 bp, Homo sapiens
tactggcacctgaaattaattt

SEQ ID NO: 4228488 - DNA, 16 bp, Homo sapiens
tactgttgctttggga

SEQ ID NO: 4228489 - DNA, 13 bp, Homo sapiens
tagaaatcaactt

SEQ ID NO: 4228490 - DNA, 16 bp, Homo sapiens
tagaagtgggccagga

SEQ ID NO: 4228491 - DNA, 15 bp, Homo sapiens
tagagtcaatttgct

SEQ ID NO: 4228492 - DNA, 21 bp, Homo sapiens
tagagtcaatttgctgaaaac

SEQ ID NO: 4228493 - DNA, 19 bp, Homo sapiens
tagattatttctgtatttg

SEQ ID NO: 4228494 - DNA, 21 bp, Homo sapiens
tgatggggtgggcagggctgg

SEQ ID NO: 4228495 - DNA, 15 bp, Homo sapiens
tgatgttactgagat

SEQ ID NO: 4228496 - DNA, 12 bp, Homo sapiens
tgatttaaaaaa

SEQ ID NO: 4228497 - DNA, 14 bp, Homo sapiens
tgatttccaaagag

SEQ ID NO: 4228498 - DNA, 18 bp, Homo sapiens
tgattttagctgcagaac

SEQ ID NO: 4228499 - DNA, 15 bp, Homo sapiens
tgcaacagtaatcag

SEQ ID NO: 4228500 - DNA, 14 bp, Homo sapiens
tgcaacttgtgaac

SEQ ID NO: 4228501 - DNA, 23 bp, Homo sapiens
tgcacatagttctgcccaaatta

SEQ ID NO: 4228502 - DNA, 14 bp, Homo sapiens
tgcacatctacttg

SEQ ID NO: 4228503 - DNA, 15 bp, Homo sapiens
tgcacctccccccac

SEQ ID NO: 4228504 - DNA, 11 bp, Homo sapiens
tgcacctgcat

SEQ ID NO: 4228505 - DNA, 21 bp, Homo sapiens
tgcagaaaagcacctgccgac

SEQ ID NO: 4228506 - DNA, 22 bp, Homo sapiens
tgcagaaaagcacctgccgacc

SEQ ID NO: 4228507 - DNA, 17 bp, Homo sapiens
tgcagccagcccagccc

SEQ ID NO: 4228508 - DNA, 22 bp, Homo sapiens
tgcagccagcccagcccagctg

SEQ ID NO: 4228509 - DNA, 15 bp, Homo sapiens
tgcataaaccaatga

SEQ ID NO: 4228510 - DNA, 16 bp, Homo sapiens
tgcatccattcctcag

SEQ ID NO: 4228511 - DNA, 21 bp, Homo sapiens
tgcatccattcctcagggaca

SEQ ID NO: 4228512 - DNA, 22 bp, Homo sapiens
tgcatgtggtttggttcctctc

SEQ ID NO: 4228513 - DNA, 19 bp, Homo sapiens
tgcattcaaccttaccaaa

SEQ ID NO: 4228514 - DNA, 20 bp, Homo sapiens
tgcattcaaccttaccaaaa

SEQ ID NO: 4228515 - DNA, 17 bp, Homo sapiens
tgcatttaaagtattct

SEQ ID NO: 4228516 - DNA, 14 bp, Homo sapiens
tgccaccctcctgc

SEQ ID NO: 4228517 - DNA, 18 bp, Homo sapiens
tgccacctcccctatcca

SEQ ID NO: 4228518 - DNA, 11 bp, Homo sapiens
tgccaggcccg

SEQ ID NO: 4228519 - DNA, 15 bp, Homo sapiens
tgccagtgccttacc

SEQ ID NO: 4228520 - DNA, 20 bp, Homo sapiens
tgccagtgccttacctcctg

SEQ ID NO: 4228521 - DNA, 22 bp, Homo sapiens
tgccagtgccttacctcctgcc

SEQ ID NO: 4228522 - DNA, 23 bp, Homo sapiens
tgccatgtttagattccaggatc

SEQ ID NO: 4228523 - DNA, 14 bp, Homo sapiens
tgccatttcttctt

SEQ ID NO: 4228524 - DNA, 16 bp, Homo sapiens
tgcccagagatgcctc

SEQ ID NO: 4228525 - DNA, 18 bp, Homo sapiens
tgcccagagatgcctcca

SEQ ID NO: 4228526 - DNA, 17 bp, Homo sapiens
tgcccaggagagccagc

SEQ ID NO: 4228527 - DNA, 18 bp, Homo sapiens
tgcccaggagagccagcc

SEQ ID NO: 4228528 - DNA, 22 bp, Homo sapiens
tgcccaggagagccagccctcc

SEQ ID NO: 4228529 - DNA, 23 bp, Homo sapiens
tgcccaggagagccagccctccc

SEQ ID NO: 4228530 - DNA, 13 bp, Homo sapiens
tgccccaactcct

SEQ ID NO: 4228531 - DNA, 15 bp, Homo sapiens
tgccccaactcctgg

SEQ ID NO: 4228532 - DNA, 19 bp, Homo sapiens
tgccccgaatttagtcaca

SEQ ID NO: 4228533 - DNA, 23 bp, Homo sapiens
tgccctccaagaggctccctcct

SEQ ID NO: 4228534 - DNA, 13 bp, Homo sapiens
tgccctgacctcc

SEQ ID NO: 4228535 - DNA, 14 bp, Homo sapiens
tgccctgacctccc

SEQ ID NO: 4228536 - DNA, 17 bp, Homo sapiens
tgccctgacctcccagc

SEQ ID NO: 4228537 - DNA, 21 bp, Homo sapiens
tgccctgacctcccagcccta

SEQ ID NO: 4228538 - DNA, 15 bp, Homo sapiens
tgcccttgccctgac

SEQ ID NO: 4228539 - DNA, 21 bp, Homo sapiens
tgccgacctcgtcctccccct

SEQ ID NO: 4228540 - DNA, 18 bp, Homo sapiens
tgccgcaccccagagtgt

SEQ ID NO: 4228541 - DNA, 19 bp, Homo sapiens
tgccgttactctccaacct

SEQ ID NO: 4228542 - DNA, 22 bp, Homo sapiens
tgcctcaatgtgaatcagaccc

SEQ ID NO: 4228543 - DNA, 23 bp, Homo sapiens
tgcctgggtggggctgctcctcc

SEQ ID NO: 4228544 - DNA, 14 bp, Homo sapiens
tgcctgtgaggcag

SEQ ID NO: 4228545 - DNA, 23 bp, Homo sapiens
tgccttacctcctgcccaggaga

SEQ ID NO: 4228546 - DNA, 21 bp, Homo sapiens
tgccttcttcggggaactcct

SEQ ID NO: 4228547 - DNA, 19 bp, Homo sapiens
tgccttgacaacagactga

SEQ ID NO: 4228548 - DNA, 20 bp, Homo sapiens
tgcctttcagaagtgattta

SEQ ID NO: 4228549 - DNA, 15 bp, Homo sapiens
tgcggctccagccca

SEQ ID NO: 4228550 - DNA, 16 bp, Homo sapiens
tgcggctccagcccag

SEQ ID NO: 4228551 - DNA, 20 bp, Homo sapiens
tgcggctccagcccagcccg

SEQ ID NO: 4228552 - DNA, 22 bp, Homo sapiens
tgctaaaatattttagatgtta

SEQ ID NO: 4228553 - DNA, 21 bp, Homo sapiens
tgctattatgtaacatccaga

SEQ ID NO: 4228554 - DNA, 16 bp, Homo sapiens
tgctcactttccaccc

SEQ ID NO: 4228555 - DNA, 21 bp, Homo sapiens
tgctccaccttgaacctgtca

SEQ ID NO: 4228556 - DNA, 23 bp, Homo sapiens
tgctccaccttgaacctgtcacc

SEQ ID NO: 4228557 - DNA, 21 bp, Homo sapiens
tgctcccccaccccctcccca

SEQ ID NO: 4228558 - DNA, 12 bp, Homo sapiens
tgctcctccagg

SEQ ID NO: 4228559 - DNA, 13 bp, Homo sapiens
tgctctctgcagc

SEQ ID NO: 4228560 - DNA, 14 bp, Homo sapiens
tgctgaaaacatta

SEQ ID NO: 4228561 - DNA, 20 bp, Homo sapiens
tgctgaaaacattacatgct

SEQ ID NO: 4228562 - DNA, 20 bp, Homo sapiens
tgctgacatagtggatggac

SEQ ID NO: 4228563 - DNA, 21 bp, Homo sapiens
tgctgacatagtggatggaca

SEQ ID NO: 4228564 - DNA, 22 bp, Homo sapiens
tgctgacatagtggatggacag

SEQ ID NO: 4228565 - DNA, 18 bp, Homo sapiens
tgctgggctctccacctc

SEQ ID NO: 4228566 - DNA, 23 bp, Homo sapiens
tgctgggctctccacctcagcct

SEQ ID NO: 4228567 - DNA, 14 bp, Homo sapiens
tgctgttgcctcat

SEQ ID NO: 4228568 - DNA, 18 bp, Homo sapiens
tgcttctgaatgtgctga

SEQ ID NO: 4228569 - DNA, 18 bp, Homo sapiens
tgcttctgtccaggacat

SEQ ID NO: 4228570 - DNA, 13 bp, Homo sapiens
tgctttgaatgca

SEQ ID NO: 4228571 - DNA, 14 bp, Homo sapiens
tggaaaacagagta

SEQ ID NO: 4228572 - DNA, 19 bp, Homo sapiens
tggaagcatgtaggagaat

SEQ ID NO: 4228573 - DNA, 12 bp, Homo sapiens
tggaagccctcc

SEQ ID NO: 4228574 - DNA, 15 bp, Homo sapiens
tggaagccctccttc

SEQ ID NO: 4228575 - DNA, 16 bp, Homo sapiens
tggaagccctccttcc

SEQ ID NO: 4228576 - DNA, 19 bp, Homo sapiens
tggaagccctccttccacg

SEQ ID NO: 4228577 - DNA, 15 bp, Homo sapiens
tggaagctgtgtcct

SEQ ID NO: 4228578 - DNA, 17 bp, Homo sapiens
tggacaatataaactga

SEQ ID NO: 4228579 - DNA, 13 bp, Homo sapiens
tggacagatggac

SEQ ID NO: 4228580 - DNA, 14 bp, Homo sapiens
tggaccaggacagg

SEQ ID NO: 4228581 - DNA, 13 bp, Homo sapiens
tggagccagagag

SEQ ID NO: 4228582 - DNA, 21 bp, Homo sapiens
tggaggagaagaattttcaga

SEQ ID NO: 4228583 - DNA, 14 bp, Homo sapiens
tggaggcagggcct

SEQ ID NO: 4228584 - DNA, 22 bp, Homo sapiens
tggaggcagggccttgcccaga

SEQ ID NO: 4228585 - DNA, 20 bp, Homo sapiens
tggaggttgcagtgagctga

SEQ ID NO: 4228586 - DNA, 13 bp, Homo sapiens
tggatggacagat

SEQ ID NO: 4228587 - DNA, 14 bp, Homo sapiens
tggatggacagatg

SEQ ID NO: 4228588 - DNA, 15 bp, Homo sapiens
tggatggacagatgg

SEQ ID NO: 4228589 - DNA, 23 bp, Homo sapiens
tggatgtggggtccccatcatcc

SEQ ID NO: 4228590 - DNA, 23 bp, Homo sapiens
tggcaggaagatgtatgctttga

SEQ ID NO: 4228591 - DNA, 18 bp, Homo sapiens
tggcattttctgttccag

SEQ ID NO: 4228592 - DNA, 21 bp, Homo sapiens
tggccccatgtctctcagaat

SEQ ID NO: 4228593 - DNA, 16 bp, Homo sapiens
tggccctgccttcttc

SEQ ID NO: 4228594 - DNA, 13 bp, Homo sapiens
tggccctggcctg

SEQ ID NO: 4228595 - DNA, 15 bp, Homo sapiens
tggccctggcctgct

SEQ ID NO: 4228596 - DNA, 16 bp, Homo sapiens
tggccctggcctgctg

SEQ ID NO: 4228597 - DNA, 17 bp, Homo sapiens
tggccctggcctgctgg

SEQ ID NO: 4228598 - DNA, 21 bp, Homo sapiens
tggcctgctgggctctccacc

SEQ ID NO: 4228599 - DNA, 14 bp, Homo sapiens
tggcgcaagcctgt

SEQ ID NO: 4228600 - DNA, 21 bp, Homo sapiens
tggcggctactcagcagccct

SEQ ID NO: 4228601 - DNA, 18 bp, Homo sapiens
tggctccctcccacccaa

SEQ ID NO: 4228602 - DNA, 21 bp, Homo sapiens
tggctgacccagtccctgggg

SEQ ID NO: 4228603 - DNA, 22 bp, Homo sapiens
tggctggctaactggaagcatg

SEQ ID NO: 4228604 - DNA, 19 bp, Homo sapiens
tggctttccttgtggcaga

SEQ ID NO: 4228605 - DNA, 22 bp, Homo sapiens
tgggagaaagaccatgcattta

SEQ ID NO: 4228606 - DNA, 16 bp, Homo sapiens
tgggaggaagcaaaag

SEQ ID NO: 4228607 - DNA, 16 bp, Homo sapiens
tgggattttaaaaaca

SEQ ID NO: 4228608 - DNA, 12 bp, Homo sapiens
tgggcagggctg

SEQ ID NO: 4228609 - DNA, 14 bp, Homo sapiens
tgggccaggacagg

SEQ ID NO: 4228610 - DNA, 18 bp, Homo sapiens
tgggccaggacaggcccg

SEQ ID NO: 4228611 - DNA, 22 bp, Homo sapiens
tgggctggtattggtggctttc

SEQ ID NO: 4228612 - DNA, 13 bp, Homo sapiens
tggggccaagagg

SEQ ID NO: 4228613 - DNA, 18 bp, Homo sapiens
tggggccaagaggaaaaa

SEQ ID NO: 4228614 - DNA, 11 bp, Homo sapiens
tggggctgaac

SEQ ID NO: 4228615 - DNA, 16 bp, Homo sapiens
tggggctgctcctcca

SEQ ID NO: 4228616 - DNA, 19 bp, Homo sapiens
tggggctgctcctccaggg

SEQ ID NO: 4228617 - DNA, 17 bp, Homo sapiens
acaagattcccagagac

SEQ ID NO: 4228618 - DNA, 18 bp, Homo sapiens
acaagattcccagagaca

SEQ ID NO: 4228619 - DNA, 18 bp, Homo sapiens
acaagggtctagggagag

SEQ ID NO: 4228620 - DNA, 19 bp, Homo sapiens
acaatactccctttaaaga

SEQ ID NO: 4228621 - DNA, 15 bp, Homo sapiens
acacatcaaatgccc

SEQ ID NO: 4228622 - DNA, 19 bp, Homo sapiens
acaccatcttaaatgacag

SEQ ID NO: 4228623 - DNA, 14 bp, Homo sapiens
acacctgcacctcc

SEQ ID NO: 4228624 - DNA, 17 bp, Homo sapiens
acagacaagcaacccaa

SEQ ID NO: 4228625 - DNA, 14 bp, Homo sapiens
acagacaggagaaa

SEQ ID NO: 4228626 - DNA, 15 bp, Homo sapiens
acagacaggagaaat

SEQ ID NO: 4228627 - DNA, 17 bp, Homo sapiens
acagagaaaatgaattt

SEQ ID NO: 4228628 - DNA, 16 bp, Homo sapiens
acagagaaggcaggaa

SEQ ID NO: 4228629 - DNA, 16 bp, Homo sapiens
acagagacacctgcac

SEQ ID NO: 4228630 - DNA, 17 bp, Homo sapiens
acagagacacctgcacc

SEQ ID NO: 4228631 - DNA, 21 bp, Homo sapiens
acagagacacctgcacctccc

SEQ ID NO: 4228632 - DNA, 20 bp, Homo sapiens
acagaggagggcgtgactca

SEQ ID NO: 4228633 - DNA, 14 bp, Homo sapiens
acagagtatttctg

SEQ ID NO: 4228634 - DNA, 13 bp, Homo sapiens
acagatggaccaa

SEQ ID NO: 4228635 - DNA, 22 bp, Homo sapiens
acagatggaccaaaagatgggt

SEQ ID NO: 4228636 - DNA, 17 bp, Homo sapiens
acagcctcacagaagaa

SEQ ID NO: 4228637 - DNA, 22 bp, Homo sapiens
acagcctgtggcggtgcctggg

SEQ ID NO: 4228638 - DNA, 13 bp, Homo sapiens
acagctcccaccc

SEQ ID NO: 4228639 - DNA, 16 bp, Homo sapiens
acagctcccaccccac

SEQ ID NO: 4228640 - DNA, 15 bp, Homo sapiens
acagctgcagcccat

SEQ ID NO: 4228641 - DNA, 16 bp, Homo sapiens
acaggaaaatcctctg

SEQ ID NO: 4228642 - DNA, 18 bp, Homo sapiens
acaggaaaatcctctggc

SEQ ID NO: 4228643 - DNA, 11 bp, Homo sapiens
acaggagaaat

SEQ ID NO: 4228644 - DNA, 20 bp, Homo sapiens
acagggtgctccttgtcaat

SEQ ID NO: 4228645 - DNA, 22 bp, Homo sapiens
acagtaatcagagttaccatta

SEQ ID NO: 4228646 - DNA, 15 bp, Homo sapiens
acagtagtatctgct

SEQ ID NO: 4228647 - DNA, 11 bp, Homo sapiens
acagtgcctgc

SEQ ID NO: 4228648 - DNA, 13 bp, Homo sapiens
acagtgcctgctg

SEQ ID NO: 4228649 - DNA, 18 bp, Homo sapiens
acagttcctcgccctggg

SEQ ID NO: 4228650 - DNA, 15 bp, Homo sapiens
acataaggagaatgt

SEQ ID NO: 4228651 - DNA, 21 bp, Homo sapiens
acataagtccattaactgctt

SEQ ID NO: 4228652 - DNA, 21 bp, Homo sapiens
acatagtggatggacagatgg

SEQ ID NO: 4228653 - DNA, 12 bp, Homo sapiens
acatatcatttg

SEQ ID NO: 4228654 - DNA, 20 bp, Homo sapiens
acatatcatttgtgaagaat

SEQ ID NO: 4228655 - DNA, 14 bp, Homo sapiens
acatcaaatgcccc

SEQ ID NO: 4228656 - DNA, 11 bp, Homo sapiens
acatccagaag

SEQ ID NO: 4228657 - DNA, 16 bp, Homo sapiens
acatcccattgccctg

SEQ ID NO: 4228658 - DNA, 17 bp, Homo sapiens
acatcccattgccctgg

SEQ ID NO: 4228659 - DNA, 18 bp, Homo sapiens
acatcccattgccctggt

SEQ ID NO: 4228660 - DNA, 21 bp, Homo sapiens
acatctaatgtctcttcctct

SEQ ID NO: 4228661 - DNA, 20 bp, Homo sapiens
acatgaccaaaaaccaaaag

SEQ ID NO: 4228662 - DNA, 15 bp, Homo sapiens
acatgagaaatgtga

SEQ ID NO: 4228663 - DNA, 16 bp, Homo sapiens
acatgagaaatgtgaa

SEQ ID NO: 4228664 - DNA, 23 bp, Homo sapiens
acatggaaaacagagtatttctg

SEQ ID NO: 4228665 - DNA, 19 bp, Homo sapiens
acattgaaaccctccaaat

SEQ ID NO: 4228666 - DNA, 18 bp, Homo sapiens
accaaaaaccaaaagtgc

SEQ ID NO: 4228667 - DNA, 21 bp, Homo sapiens
accaaaagtgcattcaacctt

SEQ ID NO: 4228668 - DNA, 23 bp, Homo sapiens
accaaaagtgcattcaaccttac

SEQ ID NO: 4228669 - DNA, 17 bp, Homo sapiens
accaaaataaaaattga

SEQ ID NO: 4228670 - DNA, 18 bp, Homo sapiens
accaacatcccattgccc

SEQ ID NO: 4228671 - DNA, 15 bp, Homo sapiens
accaacatggagaaa

SEQ ID NO: 4228672 - DNA, 22 bp, Homo sapiens
accaacccatcagaaggagaag

SEQ ID NO: 4228673 - DNA, 21 bp, Homo sapiens
accaaccgaacatgaccaaaa

SEQ ID NO: 4228674 - DNA, 15 bp, Homo sapiens
accaactttcccccc

SEQ ID NO: 4228675 - DNA, 17 bp, Homo sapiens
accaagctcacagttcc

SEQ ID NO: 4228676 - DNA, 15 bp, Homo sapiens
accaatgtcataaca

SEQ ID NO: 4228677 - DNA, 20 bp, Homo sapiens
accacctaggccactcctcc

SEQ ID NO: 4228678 - DNA, 18 bp, Homo sapiens
accacgatgtggccctgg

SEQ ID NO: 4228679 - DNA, 20 bp, Homo sapiens
accacgatgtggccctggcc

SEQ ID NO: 4228680 - DNA, 21 bp, Homo sapiens
accacgatgtggccctggcct

SEQ ID NO: 4228681 - DNA, 16 bp, Homo sapiens
accagaaaatgagggc

SEQ ID NO: 4228682 - DNA, 20 bp, Homo sapiens
accaggaatgttaaagtcag

SEQ ID NO: 4228683 - DNA, 14 bp, Homo sapiens
accaggacaggacc

SEQ ID NO: 4228684 - DNA, 20 bp, Homo sapiens
accaggcacgaacccacctg

SEQ ID NO: 4228685 - DNA, 21 bp, Homo sapiens
accaggcacgaacccacctgc

SEQ ID NO: 4228686 - DNA, 22 bp, Homo sapiens
accaggcacgaacccacctgct

SEQ ID NO: 4228687 - DNA, 13 bp, Homo sapiens
accataaacattt

SEQ ID NO: 4228688 - DNA, 14 bp, Homo sapiens
accataaacatttg

SEQ ID NO: 4228689 - DNA, 19 bp, Homo sapiens
accatatgtctgcttctgt

SEQ ID NO: 4228690 - DNA, 12 bp, Homo sapiens
accatgtttgag

SEQ ID NO: 4228691 - DNA, 21 bp, Homo sapiens
accatgtttgagctcagaccc

SEQ ID NO: 4228692 - DNA, 18 bp, Homo sapiens
accattatttaatttgta

SEQ ID NO: 4228693 - DNA, 19 bp, Homo sapiens
acccaaccaactttccccc

SEQ ID NO: 4228694 - DNA, 15 bp, Homo sapiens
acccaaggaggaaaa

SEQ ID NO: 4228695 - DNA, 19 bp, Homo sapiens
acccaagtggcccccaccc

SEQ ID NO: 4228696 - DNA, 13 bp, Homo sapiens
acccacagggcta

SEQ ID NO: 4228697 - DNA, 13 bp, Homo sapiens
acccacctgctga

SEQ ID NO: 4228698 - DNA, 24 bp, Homo sapiens
acccagaaatagccactattaaca

SEQ ID NO: 4228699 - DNA, 11 bp, Homo sapiens
acccagcccat

SEQ ID NO: 4228700 - DNA, 14 bp, Homo sapiens
acccagcccattct

SEQ ID NO: 4228701 - DNA, 19 bp, Homo sapiens
acccagcccattctctctc

SEQ ID NO: 4228702 - DNA, 19 bp, Homo sapiens
acccaggctctggagccag

SEQ ID NO: 4228703 - DNA, 22 bp, Homo sapiens
accccaccacgatgtggccctg

SEQ ID NO: 4228704 - DNA, 12 bp, Homo sapiens
accccaccccct

SEQ ID NO: 4228705 - DNA, 13 bp, Homo sapiens
accccagagtgtg

SEQ ID NO: 4228706 - DNA, 13 bp, Homo sapiens
accccagcggctg

SEQ ID NO: 4228707 - DNA, 19 bp, Homo sapiens
accccagttctgctcctct

SEQ ID NO: 4228708 - DNA, 22 bp, Homo sapiens
accccagttctgctcctctcca

SEQ ID NO: 4228709 - DNA, 23 bp, Homo sapiens
accccagttctgctcctctccag

SEQ ID NO: 4228710 - DNA, 17 bp, Homo sapiens
acccccactctcattcc

SEQ ID NO: 4228711 - DNA, 16 bp, Homo sapiens
accccctccccagggg

SEQ ID NO: 4228712 - DNA, 16 bp, Homo sapiens
acccccttcagtgccc

SEQ ID NO: 4228713 - DNA, 18 bp, Homo sapiens
acccccttcagtgcccac

SEQ ID NO: 4228714 - DNA, 20 bp, Homo sapiens
acccccttcagtgcccacca

SEQ ID NO: 4228715 - DNA, 22 bp, Homo sapiens
accccgtctggggttcagcccc

SEQ ID NO: 4228716 - DNA, 23 bp, Homo sapiens
accccgtctggggttcagcccct

SEQ ID NO: 4228717 - DNA, 13 bp, Homo sapiens
accctatccctgt

SEQ ID NO: 4228718 - DNA, 16 bp, Homo sapiens
accctcaaatgtcaga

SEQ ID NO: 4228719 - DNA, 20 bp, Homo sapiens
accctcaaatgtcagagcta

SEQ ID NO: 4228720 - DNA, 22 bp, Homo sapiens
accctcaaatgtcagagctatg

SEQ ID NO: 4228721 - DNA, 15 bp, Homo sapiens
acccttctttcctct

SEQ ID NO: 4228722 - DNA, 15 bp, Homo sapiens
acctaacccctttcc

SEQ ID NO: 4228723 - DNA, 17 bp, Homo sapiens
acctaacccctttcctg

SEQ ID NO: 4228724 - DNA, 14 bp, Homo sapiens
acctcaaaacactt

SEQ ID NO: 4228725 - DNA, 14 bp, Homo sapiens
acctcagccatgag

SEQ ID NO: 4228726 - DNA, 13 bp, Homo sapiens
acctcccagccct

SEQ ID NO: 4228727 - DNA, 15 bp, Homo sapiens
acctcccagccctat

SEQ ID NO: 4228728 - DNA, 20 bp, Homo sapiens
acctcccagccctatggatg

SEQ ID NO: 4228729 - DNA, 15 bp, Homo sapiens
acctccccccactgc

SEQ ID NO: 4228730 - DNA, 23 bp, Homo sapiens
acctcccctatccacccagccca

SEQ ID NO: 4228731 - DNA, 14 bp, Homo sapiens
acctcctgcccagg

SEQ ID NO: 4228732 - DNA, 18 bp, Homo sapiens
acctcctgcccaggagag

SEQ ID NO: 4228733 - DNA, 21 bp, Homo sapiens
acctcctgcccaggagagcca

SEQ ID NO: 4228734 - DNA, 14 bp, Homo sapiens
acctcgtcctcccc

SEQ ID NO: 4228735 - DNA, 20 bp, Homo sapiens
acctcgtcctccccctgcca

SEQ ID NO: 4228736 - DNA, 15 bp, Homo sapiens
acctctctaagccac

SEQ ID NO: 4228737 - DNA, 19 bp, Homo sapiens
acctctctaagccacagct

SEQ ID NO: 4228738 - DNA, 12 bp, Homo sapiens
acctctgcctca

SEQ ID NO: 4228739 - DNA, 13 bp, Homo sapiens
acctctgcctcaa

SEQ ID NO: 4228740 - DNA, 14 bp, Homo sapiens
acctctgcctcaat

SEQ ID NO: 4228741 - DNA, 17 bp, Homo sapiens
atagtaggggttgaaga

SEQ ID NO: 4228742 - DNA, 20 bp, Homo sapiens
atagtaggggttgaagaaaa

SEQ ID NO: 4228743 - DNA, 21 bp, Homo sapiens
atagtccatggacaatataaa

SEQ ID NO: 4228744 - DNA, 17 bp, Homo sapiens
atagtggatggacagat

SEQ ID NO: 4228745 - DNA, 19 bp, Homo sapiens
atagtggatggacagatgg

SEQ ID NO: 4228746 - DNA, 22 bp, Homo sapiens
atagtggatggacagatggacc

SEQ ID NO: 4228747 - DNA, 15 bp, Homo sapiens
atagttttaaatatg

SEQ ID NO: 4228748 - DNA, 19 bp, Homo sapiens
atatagtaggggttgaaga

SEQ ID NO: 4228749 - DNA, 20 bp, Homo sapiens
atatagtaggggttgaagaa

SEQ ID NO: 4228750 - DNA, 16 bp, Homo sapiens
atatattattcatctt

SEQ ID NO: 4228751 - DNA, 20 bp, Homo sapiens
atatcagttactcagccctg

SEQ ID NO: 4228752 - DNA, 23 bp, Homo sapiens
atatcattataactgaaggagaa

SEQ ID NO: 4228753 - DNA, 12 bp, Homo sapiens
atatcatttgtg

SEQ ID NO: 4228754 - DNA, 13 bp, Homo sapiens
atatcatttgtga

SEQ ID NO: 4228755 - DNA, 20 bp, Homo sapiens
atatcatttgtgaagaatta

SEQ ID NO: 4228756 - DNA, 22 bp, Homo sapiens
atatgaacaaagaaaaaaatat

SEQ ID NO: 4228757 - DNA, 14 bp, Homo sapiens
atatgacagctgtc

SEQ ID NO: 4228758 - DNA, 15 bp, Homo sapiens
atatgacagctgtcc

SEQ ID NO: 4228759 - DNA, 15 bp, Homo sapiens
atatgtataaattaa

SEQ ID NO: 4228760 - DNA, 21 bp, Homo sapiens
atatgtataaattaatacaga

SEQ ID NO: 4228761 - DNA, 14 bp, Homo sapiens
atatgtgaagaaaa

SEQ ID NO: 4228762 - DNA, 15 bp, Homo sapiens
atattggtaattaaa

SEQ ID NO: 4228763 - DNA, 19 bp, Homo sapiens
atatttatggggggagaac
